United States Patent 11,369,692 (MATERIALS AND METHODS FOR TREATMENT OF DUCHENNE MUSCULAR DYSTROPHY) - sequence listing, part 9

SEQ ID NO: 272576 - DNA, 20 bp, Artificial Sequence
  chemically synthesized
gtattcttatttttttaaat

SEQ ID NO: 272577 - DNA, 20 bp, Artificial Sequence
  chemically synthesized
ggaaactgatttaaaaaaat

SEQ ID NO: 272578 - DNA, 20 bp, Artificial Sequence
  chemically synthesized
taaaaaaataagaatacact

SEQ ID NO: 272579 - DNA, 20 bp, Artificial Sequence
  chemically synthesized
aaaaaataagaatacactca

SEQ ID NO: 272580 - DNA, 20 bp, Artificial Sequence
  chemically synthesized
aaaataagaatacactcaga

SEQ ID NO: 272581 - DNA, 20 bp, Artificial Sequence
  chemically synthesized
aaataagaatacactcagag

SEQ ID NO: 272582 - DNA, 20 bp, Artificial Sequence
  chemically synthesized
aataagaatacactcagaga

SEQ ID NO: 272583 - DNA, 20 bp, Artificial Sequence
  chemically synthesized
ttgggccctctaccctctct

SEQ ID NO: 272584 - DNA, 20 bp, Artificial Sequence
  chemically synthesized
aagaatacactcagagaggg

SEQ ID NO: 272585 - DNA, 20 bp, Artificial Sequence
  chemically synthesized
gaatacactcagagagggta

SEQ ID NO: 272586 - DNA, 20 bp, Artificial Sequence
  chemically synthesized
aatacactcagagagggtag

SEQ ID NO: 272587 - DNA, 20 bp, Artificial Sequence
  chemically synthesized
atacactcagagagggtaga

SEQ ID NO: 272588 - DNA, 20 bp, Artificial Sequence
  chemically synthesized
tgattacagatgtataattt

SEQ ID NO: 272589 - DNA, 20 bp, Artificial Sequence
  chemically synthesized
atgattacagatgtataatt

SEQ ID NO: 272590 - DNA, 20 bp, Artificial Sequence
  chemically synthesized
catgtacacagatatgatta

SEQ ID NO: 272591 - DNA, 20 bp, Artificial Sequence
  chemically synthesized
aacttttaaatacatgtaca

SEQ ID NO: 272592 - DNA, 20 bp, Artificial Sequence
  chemically synthesized
atctgtgtacatgtatttaa

SEQ ID NO: 272593 - DNA, 20 bp, Artificial Sequence
  chemically synthesized
taaaagtttttccatcccct

SEQ ID NO: 272594 - DNA, 20 bp, Artificial Sequence
  chemically synthesized
aaccttggaggctaagggga

SEQ ID NO: 272595 - DNA, 20 bp, Artificial Sequence
  chemically synthesized
tactaaccttggaggctaag

SEQ ID NO: 272596 - DNA, 20 bp, Artificial Sequence
  chemically synthesized
ctactaaccttggaggctaa

SEQ ID NO: 272597 - DNA, 20 bp, Artificial Sequence
  chemically synthesized
tctactaaccttggaggcta

SEQ ID NO: 272598 - DNA, 20 bp, Artificial Sequence
  chemically synthesized
tttccatccccttagcctcc

SEQ ID NO: 272599 - DNA, 20 bp, Artificial Sequence
  chemically synthesized
ctctactaaccttggaggct

SEQ ID NO: 272600 - DNA, 20 bp, Artificial Sequence
  chemically synthesized
ttccatccccttagcctcca

SEQ ID NO: 272601 - DNA, 20 bp, Artificial Sequence
  chemically synthesized
atccccttagcctccaaggt

SEQ ID NO: 272602 - DNA, 20 bp, Artificial Sequence
  chemically synthesized
ttttcctctactaaccttgg

SEQ ID NO: 272603 - DNA, 20 bp, Artificial Sequence
  chemically synthesized
tttttcctctactaaccttg

SEQ ID NO: 272604 - DNA, 20 bp, Artificial Sequence
  chemically synthesized
cccttagcctccaaggttag

SEQ ID NO: 272605 - DNA, 20 bp, Artificial Sequence
  chemically synthesized
attttttcctctactaacct

SEQ ID NO: 272606 - DNA, 20 bp, Artificial Sequence
  chemically synthesized
cttagcctccaaggttagta

SEQ ID NO: 272607 - DNA, 20 bp, Artificial Sequence
  chemically synthesized
ttagcctccaaggttagtag

SEQ ID NO: 272608 - DNA, 20 bp, Artificial Sequence
  chemically synthesized
ggttagtagaggaaaaaatg

SEQ ID NO: 272609 - DNA, 20 bp, Artificial Sequence
  chemically synthesized
gaaaaaatgaagtatacaca

SEQ ID NO: 272610 - DNA, 20 bp, Artificial Sequence
  chemically synthesized
actctggtataaaaggttaa

SEQ ID NO: 272611 - DNA, 20 bp, Artificial Sequence
  chemically synthesized
cactctggtataaaaggtta

SEQ ID NO: 272612 - DNA, 20 bp, Artificial Sequence
  chemically synthesized
agtcctttaaccttttatac

SEQ ID NO: 272613 - DNA, 20 bp, Artificial Sequence
  chemically synthesized
tttgaccactctggtataaa

SEQ ID NO: 272614 - DNA, 20 bp, Artificial Sequence
  chemically synthesized
ctttgaccactctggtataa

SEQ ID NO: 272615 - DNA, 20 bp, Artificial Sequence
  chemically synthesized
tcctttaaccttttatacca

SEQ ID NO: 272616 - DNA, 20 bp, Artificial Sequence
  chemically synthesized
tttaaccttttataccagag

SEQ ID NO: 272617 - DNA, 20 bp, Artificial Sequence
  chemically synthesized
ttgctcttctttgaccactc

SEQ ID NO: 272618 - DNA, 20 bp, Artificial Sequence
  chemically synthesized
cttttataccagagtggtca

SEQ ID NO: 272619 - DNA, 20 bp, Artificial Sequence
  chemically synthesized
ttataccagagtggtcaaag

SEQ ID NO: 272620 - DNA, 20 bp, Artificial Sequence
  chemically synthesized
ataccagagtggtcaaagaa

SEQ ID NO: 272621 - DNA, 20 bp, Artificial Sequence
  chemically synthesized
aaaacaaaaaaaaaaaaaaa

SEQ ID NO: 272622 - DNA, 20 bp, Artificial Sequence
  chemically synthesized
aaaaaaaaaaaaaaaaagaa

SEQ ID NO: 272623 - DNA, 20 bp, Artificial Sequence
  chemically synthesized
aaaagaaaagaaatcatcat

SEQ ID NO: 272624 - DNA, 20 bp, Artificial Sequence
  chemically synthesized
cacaaatatctgtggtggtg

SEQ ID NO: 272625 - DNA, 20 bp, Artificial Sequence
  chemically synthesized
catcagtatcctcaccacca

SEQ ID NO: 272626 - DNA, 20 bp, Artificial Sequence
  chemically synthesized
ccacaaatatctgtggtggt

SEQ ID NO: 272627 - DNA, 20 bp, Artificial Sequence
  chemically synthesized
gttcccacaaatatctgtgg

SEQ ID NO: 272628 - DNA, 20 bp, Artificial Sequence
  chemically synthesized
taagttcccacaaatatctg

SEQ ID NO: 272629 - DNA, 20 bp, Artificial Sequence
  chemically synthesized
ctcaccaccacagatatttg

SEQ ID NO: 272630 - DNA, 20 bp, Artificial Sequence
  chemically synthesized
tcaccaccacagatatttgt

SEQ ID NO: 272631 - DNA, 20 bp, Artificial Sequence
  chemically synthesized
tatataaagtgttagcacat

SEQ ID NO: 272632 - DNA, 20 bp, Artificial Sequence
  chemically synthesized
gaattaattatataaagtgt

SEQ ID NO: 272633 - DNA, 20 bp, Artificial Sequence
  chemically synthesized
gagatggaattaattatata

SEQ ID NO: 272634 - DNA, 20 bp, Artificial Sequence
  chemically synthesized
atgttaatatgattaggaga

SEQ ID NO: 272635 - DNA, 20 bp, Artificial Sequence
  chemically synthesized
acttatgttaatatgattag

SEQ ID NO: 272636 - DNA, 20 bp, Artificial Sequence
  chemically synthesized
atacttatgttaatatgatt

SEQ ID NO: 272637 - DNA, 20 bp, Artificial Sequence
  chemically synthesized
aatacttatgttaatatgat

SEQ ID NO: 272638 - DNA, 20 bp, Artificial Sequence
  chemically synthesized
tctcctaatcatattaacat

SEQ ID NO: 272639 - DNA, 20 bp, Artificial Sequence
  chemically synthesized
tctaccttcatttgtacatg

SEQ ID NO: 272640 - DNA, 20 bp, Artificial Sequence
  chemically synthesized
atcatcttcatgtacaaatg

SEQ ID NO: 272641 - DNA, 20 bp, Artificial Sequence
  chemically synthesized
tcatcttcatgtacaaatga

SEQ ID NO: 272642 - DNA, 20 bp, Artificial Sequence
  chemically synthesized
tcttcatgtacaaatgaagg

SEQ ID NO: 272643 - DNA, 20 bp, Artificial Sequence
  chemically synthesized
gtagaaacatcaacatgccc

SEQ ID NO: 272644 - DNA, 20 bp, Artificial Sequence
  chemically synthesized
tagaaacatcaacatgccca

SEQ ID NO: 272645 - DNA, 20 bp, Artificial Sequence
  chemically synthesized
cttcctagttatgttacctt

SEQ ID NO: 272646 - DNA, 20 bp, Artificial Sequence
  chemically synthesized
acttcctagttatgttacct

SEQ ID NO: 272647 - DNA, 20 bp, Artificial Sequence
  chemically synthesized
catgcccaaggtaacataac

SEQ ID NO: 272648 - DNA, 20 bp, Artificial Sequence
  chemically synthesized
atgcccaaggtaacataact

SEQ ID NO: 272649 - DNA, 20 bp, Artificial Sequence
  chemically synthesized
cccaaggtaacataactagg

SEQ ID NO: 272650 - DNA, 20 bp, Artificial Sequence
  chemically synthesized
gcagcaagtttgttacttcc

SEQ ID NO: 272651 - DNA, 20 bp, Artificial Sequence
  chemically synthesized
tataattgttagagggcagc

SEQ ID NO: 272652 - DNA, 20 bp, Artificial Sequence
  chemically synthesized
gcagtataattgttagaggg

SEQ ID NO: 272653 - DNA, 20 bp, Artificial Sequence
  chemically synthesized
gaggcagtataattgttaga

SEQ ID NO: 272654 - DNA, 20 bp, Artificial Sequence
  chemically synthesized
agaggcagtataattgttag

SEQ ID NO: 272655 - DNA, 20 bp, Artificial Sequence
  chemically synthesized
aagaggcagtataattgtta

SEQ ID NO: 272656 - DNA, 20 bp, Artificial Sequence
  chemically synthesized
taaagaggcagtataattgt

SEQ ID NO: 272657 - DNA, 20 bp, Artificial Sequence
  chemically synthesized
taaaatcataattaaagagg

SEQ ID NO: 272658 - DNA, 20 bp, Artificial Sequence
  chemically synthesized
ttttaaaatcataattaaag

SEQ ID NO: 272659 - DNA, 20 bp, Artificial Sequence
  chemically synthesized
attttaaaatcataattaaa

SEQ ID NO: 272660 - DNA, 20 bp, Artificial Sequence
  chemically synthesized
ttattttaaaatcataatta

SEQ ID NO: 272661 - DNA, 20 bp, Artificial Sequence
  chemically synthesized
taattatgattttaaaataa

SEQ ID NO: 272662 - DNA, 20 bp, Artificial Sequence
  chemically synthesized
aaataaaagtatcctccaaa

SEQ ID NO: 272663 - DNA, 20 bp, Artificial Sequence
  chemically synthesized
tctcacaaatgtccatttgg

SEQ ID NO: 272664 - DNA, 20 bp, Artificial Sequence
  chemically synthesized
ttctcacaaatgtccatttg

SEQ ID NO: 272665 - DNA, 20 bp, Artificial Sequence
  chemically synthesized
ttttctcacaaatgtccatt

SEQ ID NO: 272666 - DNA, 20 bp, Artificial Sequence
  chemically synthesized
tcctccaaatggacatttgt

SEQ ID NO: 272667 - DNA, 20 bp, Artificial Sequence
  chemically synthesized
atggacatttgtgagaaaaa

SEQ ID NO: 272668 - DNA, 20 bp, Artificial Sequence
  chemically synthesized
aatgctatcaacatacgaat

SEQ ID NO: 272669 - DNA, 20 bp, Artificial Sequence
  chemically synthesized
taatcttattcgtatgttga

SEQ ID NO: 272670 - DNA, 20 bp, Artificial Sequence
  chemically synthesized
attcgtatgttgatagcatt

SEQ ID NO: 272671 - DNA, 20 bp, Artificial Sequence
  chemically synthesized
atttaattcaacaaatcgtt

SEQ ID NO: 272672 - DNA, 20 bp, Artificial Sequence
  chemically synthesized
tgtgtggaattgagtagtag

SEQ ID NO: 272673 - DNA, 20 bp, Artificial Sequence
  chemically synthesized
cactgtgtggaattgagtag

SEQ ID NO: 272674 - DNA, 20 bp, Artificial Sequence
  chemically synthesized
tctcactgtgtggaattgag

SEQ ID NO: 272675 - DNA, 20 bp, Artificial Sequence
  chemically synthesized
tgttctcactgtgtggaatt

SEQ ID NO: 272676 - DNA, 20 bp, Artificial Sequence
  chemically synthesized
ttctactactcaattccaca

SEQ ID NO: 272677 - DNA, 20 bp, Artificial Sequence
  chemically synthesized
actactcaattccacacagt

SEQ ID NO: 272678 - DNA, 20 bp, Artificial Sequence
  chemically synthesized
acaattttgttctcactgtg

SEQ ID NO: 272679 - DNA, 20 bp, Artificial Sequence
  chemically synthesized
taaggcttctgtaagtatag

SEQ ID NO: 272680 - DNA, 20 bp, Artificial Sequence
  chemically synthesized
ataaggcttctgtaagtata

SEQ ID NO: 272681 - DNA, 20 bp, Artificial Sequence
  chemically synthesized
aattgttgcccctatactta

SEQ ID NO: 272682 - DNA, 20 bp, Artificial Sequence
  chemically synthesized
aataaggcttctgtaagtat

SEQ ID NO: 272683 - DNA, 20 bp, Artificial Sequence
  chemically synthesized
aaataaggcttctgtaagta

SEQ ID NO: 272684 - DNA, 20 bp, Artificial Sequence
  chemically synthesized
tgttgcccctatacttacag

SEQ ID NO: 272685 - DNA, 20 bp, Artificial Sequence
  chemically synthesized
tcttaaaataaggcttctgt

SEQ ID NO: 272686 - DNA, 20 bp, Artificial Sequence
  chemically synthesized
acttacagaagccttatttt

SEQ ID NO: 272687 - DNA, 20 bp, Artificial Sequence
  chemically synthesized
acagtctgcctcttaaaata

SEQ ID NO: 272688 - DNA, 20 bp, Artificial Sequence
  chemically synthesized
ttacagaagccttattttaa

SEQ ID NO: 272689 - DNA, 20 bp, Artificial Sequence
  chemically synthesized
tacagtctgcctcttaaaat

SEQ ID NO: 272690 - DNA, 20 bp, Artificial Sequence
  chemically synthesized
tacagaagccttattttaag

SEQ ID NO: 272691 - DNA, 20 bp, Artificial Sequence
  chemically synthesized
agaagccttattttaagagg

SEQ ID NO: 272692 - DNA, 20 bp, Artificial Sequence
  chemically synthesized
ttattttaagaggcagactg

SEQ ID NO: 272693 - DNA, 20 bp, Artificial Sequence
  chemically synthesized
gtaatttacttatatatcta

SEQ ID NO: 272694 - DNA, 20 bp, Artificial Sequence
  chemically synthesized
gaggcagactgtagatatat

SEQ ID NO: 272695 - DNA, 20 bp, Artificial Sequence
  chemically synthesized
agatatataagtaaattaca

SEQ ID NO: 272696 - DNA, 20 bp, Artificial Sequence
  chemically synthesized
tatataagtaaattacaaag

SEQ ID NO: 272697 - DNA, 20 bp, Artificial Sequence
  chemically synthesized
cagaaatatatgcaatgtaa

SEQ ID NO: 272698 - DNA, 20 bp, Artificial Sequence
  chemically synthesized
caggccctggtgtgtgatgt

SEQ ID NO: 272699 - DNA, 20 bp, Artificial Sequence
  chemically synthesized
gaaaaactaacatcacacac

SEQ ID NO: 272700 - DNA, 20 bp, Artificial Sequence
  chemically synthesized
aaaaactaacatcacacacc

SEQ ID NO: 272701 - DNA, 20 bp, Artificial Sequence
  chemically synthesized
aaaactaacatcacacacca

SEQ ID NO: 272702 - DNA, 20 bp, Artificial Sequence
  chemically synthesized
ccccaccccacgacaggccc

SEQ ID NO: 272703 - DNA, 20 bp, Artificial Sequence
  chemically synthesized
tcacacaccagggcctgtcg

SEQ ID NO: 272704 - DNA, 20 bp, Artificial Sequence
  chemically synthesized
cacacaccagggcctgtcgt

SEQ ID NO: 272705 - DNA, 20 bp, Artificial Sequence
  chemically synthesized
acacaccagggcctgtcgtg

SEQ ID NO: 272706 - DNA, 20 bp, Artificial Sequence
  chemically synthesized
ccctccccccaccccacgac

SEQ ID NO: 272707 - DNA, 20 bp, Artificial Sequence
  chemically synthesized
cccctccccccaccccacga

SEQ ID NO: 272708 - DNA, 20 bp, Artificial Sequence
  chemically synthesized
caccagggcctgtcgtgggg

SEQ ID NO: 272709 - DNA, 20 bp, Artificial Sequence
  chemically synthesized
accagggcctgtcgtggggt

SEQ ID NO: 272710 - DNA, 20 bp, Artificial Sequence
  chemically synthesized
ccagggcctgtcgtggggtg

SEQ ID NO: 272711 - DNA, 20 bp, Artificial Sequence
  chemically synthesized
cagggcctgtcgtggggtgg

SEQ ID NO: 272712 - DNA, 20 bp, Artificial Sequence
  chemically synthesized
agggcctgtcgtggggtggg

SEQ ID NO: 272713 - DNA, 20 bp, Artificial Sequence
  chemically synthesized
ggcctgtcgtggggtggggg

SEQ ID NO: 272714 - DNA, 20 bp, Artificial Sequence
  chemically synthesized
gcctgtcgtggggtgggggg

SEQ ID NO: 272715 - DNA, 20 bp, Artificial Sequence
  chemically synthesized
cctgtcgtggggtgggggga

SEQ ID NO: 272716 - DNA, 20 bp, Artificial Sequence
  chemically synthesized
ctgtcgtggggtggggggag

SEQ ID NO: 272717 - DNA, 20 bp, Artificial Sequence
  chemically synthesized
tgtcgtggggtggggggagg

SEQ ID NO: 272718 - DNA, 20 bp, Artificial Sequence
  chemically synthesized
gtcgtggggtggggggaggg

SEQ ID NO: 272719 - DNA, 20 bp, Artificial Sequence
  chemically synthesized
cgtggggtggggggaggggg

SEQ ID NO: 272720 - DNA, 20 bp, Artificial Sequence
  chemically synthesized
gtggggtggggggagggggg

SEQ ID NO: 272721 - DNA, 20 bp, Artificial Sequence
  chemically synthesized
tggggtggggggagggggga

SEQ ID NO: 272722 - DNA, 20 bp, Artificial Sequence
  chemically synthesized
gtggggggaggggggaggga

SEQ ID NO: 272723 - DNA, 20 bp, Artificial Sequence
  chemically synthesized
ggaggggggagggatagcat

SEQ ID NO: 272724 - DNA, 20 bp, Artificial Sequence
  chemically synthesized
gaggggggagggatagcatt

SEQ ID NO: 272725 - DNA, 20 bp, Artificial Sequence
  chemically synthesized
ggggggagggatagcattag

SEQ ID NO: 272726 - DNA, 20 bp, Artificial Sequence
  chemically synthesized
attaacttgtcagttacatt

SEQ ID NO: 272727 - DNA, 20 bp, Artificial Sequence
  chemically synthesized
cattaacttgtcagttacat

SEQ ID NO: 272728 - DNA, 20 bp, Artificial Sequence
  chemically synthesized
atatacctaatgtaactgac

SEQ ID NO: 272729 - DNA, 20 bp, Artificial Sequence
  chemically synthesized
tgctgcacccattaacttgt

SEQ ID NO: 272730 - DNA, 20 bp, Artificial Sequence
  chemically synthesized
taatgtaactgacaagttaa

SEQ ID NO: 272731 - DNA, 20 bp, Artificial Sequence
  chemically synthesized
aatgtaactgacaagttaat

SEQ ID NO: 272732 - DNA, 20 bp, Artificial Sequence
  chemically synthesized
aactgacaagttaatgggtg

SEQ ID NO: 272733 - DNA, 20 bp, Artificial Sequence
  chemically synthesized
tatgtatccatgtgacatgt

SEQ ID NO: 272734 - DNA, 20 bp, Artificial Sequence
  chemically synthesized
cagcacaccaacatgtcaca

SEQ ID NO: 272735 - DNA, 20 bp, Artificial Sequence
  chemically synthesized
ggtacgtgtgcacaacatgc

SEQ ID NO: 272736 - DNA, 20 bp, Artificial Sequence
  chemically synthesized
gggtacgtgtgcacaacatg

SEQ ID NO: 272737 - DNA, 20 bp, Artificial Sequence
  chemically synthesized
catgttgtgcacacgtaccc

SEQ ID NO: 272738 - DNA, 20 bp, Artificial Sequence
  chemically synthesized
aaattatactttaagttcta

SEQ ID NO: 272739 - DNA, 20 bp, Artificial Sequence
  chemically synthesized
taaattatactttaagttct

SEQ ID NO: 272740 - DNA, 20 bp, Artificial Sequence
  chemically synthesized
cacacgtaccctagaactta

SEQ ID NO: 272741 - DNA, 20 bp, Artificial Sequence
  chemically synthesized
ttaaattatactttaagttc

SEQ ID NO: 272742 - DNA, 20 bp, Artificial Sequence
  chemically synthesized
atttttttaaattatacttt

SEQ ID NO: 272743 - DNA, 20 bp, Artificial Sequence
  chemically synthesized
atttaaaaaaattttaaaaa

SEQ ID NO: 272744 - DNA, 20 bp, Artificial Sequence
  chemically synthesized
tctttctgatcacagagcat

SEQ ID NO: 272745 - DNA, 20 bp, Artificial Sequence
  chemically synthesized
atctttctgatcacagagca

SEQ ID NO: 272746 - DNA, 20 bp, Artificial Sequence
  chemically synthesized
aaaaacccatgctctgtgat

SEQ ID NO: 272747 - DNA, 20 bp, Artificial Sequence
  chemically synthesized
tatttatctttctgatcaca

SEQ ID NO: 272748 - DNA, 20 bp, Artificial Sequence
  chemically synthesized
aatatttatctttctgatca

SEQ ID NO: 272749 - DNA, 20 bp, Artificial Sequence
  chemically synthesized
acccatgctctgtgatcaga

SEQ ID NO: 272750 - DNA, 20 bp, Artificial Sequence
  chemically synthesized
aaaatcaccagattatacag

SEQ ID NO: 272751 - DNA, 20 bp, Artificial Sequence
  chemically synthesized
ttaatatctgctgtataatc

SEQ ID NO: 272752 - DNA, 20 bp, Artificial Sequence
  chemically synthesized
ctaaaaatcaccagattata

SEQ ID NO: 272753 - DNA, 20 bp, Artificial Sequence
  chemically synthesized
gtaaatttcctaaaaatcac

SEQ ID NO: 272754 - DNA, 20 bp, Artificial Sequence
  chemically synthesized
ctgtataatctggtgatttt

SEQ ID NO: 272755 - DNA, 20 bp, Artificial Sequence
  chemically synthesized
tgtataatctggtgattttt

SEQ ID NO: 272756 - DNA, 20 bp, Artificial Sequence
  chemically synthesized
ggaaatttacatgatttaac

SEQ ID NO: 272757 - DNA, 20 bp, Artificial Sequence
  chemically synthesized
tacatgatttaactagcata

SEQ ID NO: 272758 - DNA, 20 bp, Artificial Sequence
  chemically synthesized
accctttctcagccatatgc

SEQ ID NO: 272759 - DNA, 20 bp, Artificial Sequence
  chemically synthesized
gatttaactagcatatggct

SEQ ID NO: 272760 - DNA, 20 bp, Artificial Sequence
  chemically synthesized
taactagcatatggctgaga

SEQ ID NO: 272761 - DNA, 20 bp, Artificial Sequence
  chemically synthesized
aactagcatatggctgagaa

SEQ ID NO: 272762 - DNA, 20 bp, Artificial Sequence
  chemically synthesized
actagcatatggctgagaaa

SEQ ID NO: 272763 - DNA, 20 bp, Artificial Sequence
  chemically synthesized
gaccctccaaaaccctttct

SEQ ID NO: 272764 - DNA, 20 bp, Artificial Sequence
  chemically synthesized
atatggctgagaaagggttt

SEQ ID NO: 272765 - DNA, 20 bp, Artificial Sequence
  chemically synthesized
atggctgagaaagggttttg

SEQ ID NO: 272766 - DNA, 20 bp, Artificial Sequence
  chemically synthesized
tggctgagaaagggttttgg

SEQ ID NO: 272767 - DNA, 20 bp, Artificial Sequence
  chemically synthesized
ggctgagaaagggttttgga

SEQ ID NO: 272768 - DNA, 20 bp, Artificial Sequence
  chemically synthesized
gagaaagggttttggagggt

SEQ ID NO: 272769 - DNA, 20 bp, Artificial Sequence
  chemically synthesized
gaaagggttttggagggtca

SEQ ID NO: 272770 - DNA, 20 bp, Artificial Sequence
  chemically synthesized
gttttggagggtcagagaat

SEQ ID NO: 272771 - DNA, 20 bp, Artificial Sequence
  chemically synthesized
agggtcagagaataagaata

SEQ ID NO: 272772 - DNA, 20 bp, Artificial Sequence
  chemically synthesized
gggtcagagaataagaatat

SEQ ID NO: 272773 - DNA, 20 bp, Artificial Sequence
  chemically synthesized
aagaatataggatcttattt

SEQ ID NO: 272774 - DNA, 20 bp, Artificial Sequence
  chemically synthesized
agaatataggatcttatttt

SEQ ID NO: 272775 - DNA, 20 bp, Artificial Sequence
  chemically synthesized
tgtttcctacagcctaaaat

SEQ ID NO: 272776 - DNA, 20 bp, Artificial Sequence
  chemically synthesized
taggatcttattttaggctg

SEQ ID NO: 272777 - DNA, 20 bp, Artificial Sequence
  chemically synthesized
aggatcttattttaggctgt

SEQ ID NO: 272778 - DNA, 20 bp, Artificial Sequence
  chemically synthesized
ctttgctagcttgtttccta

SEQ ID NO: 272779 - DNA, 20 bp, Artificial Sequence
  chemically synthesized
tattttaggctgtaggaaac

SEQ ID NO: 272780 - DNA, 20 bp, Artificial Sequence
  chemically synthesized
ttaggctgtaggaaacaagc

SEQ ID NO: 272781 - DNA, 20 bp, Artificial Sequence
  chemically synthesized
ctgtaggaaacaagctagca

SEQ ID NO: 272782 - DNA, 20 bp, Artificial Sequence
  chemically synthesized
gccccaagcctaatctttgc

SEQ ID NO: 272783 - DNA, 20 bp, Artificial Sequence
  chemically synthesized
ggaaacaagctagcaaagat

SEQ ID NO: 272784 - DNA, 20 bp, Artificial Sequence
  chemically synthesized
gaaacaagctagcaaagatt

SEQ ID NO: 272785 - DNA, 20 bp, Artificial Sequence
  chemically synthesized
aagctagcaaagattaggct

SEQ ID NO: 272786 - DNA, 20 bp, Artificial Sequence
  chemically synthesized
agctagcaaagattaggctt

SEQ ID NO: 272787 - DNA, 20 bp, Artificial Sequence
  chemically synthesized
gctagcaaagattaggcttg

SEQ ID NO: 272788 - DNA, 20 bp, Artificial Sequence
  chemically synthesized
acacacactctgcatgcccc

SEQ ID NO: 272789 - DNA, 20 bp, Artificial Sequence
  chemically synthesized
aagattaggcttggggcatg

SEQ ID NO: 272790 - DNA, 20 bp, Artificial Sequence
  chemically synthesized
gattaggcttggggcatgca

SEQ ID NO: 272791 - DNA, 20 bp, Artificial Sequence
  chemically synthesized
agtgtgtgtgcttaatttaa

SEQ ID NO: 272792 - DNA, 20 bp, Artificial Sequence
  chemically synthesized
gtctttcctcccattaaatt

SEQ ID NO: 272793 - DNA, 20 bp, Artificial Sequence
  chemically synthesized
gtgtgtgtgcttaatttaat

SEQ ID NO: 272794 - DNA, 20 bp, Artificial Sequence
  chemically synthesized
gtgtgtgcttaatttaatgg

SEQ ID NO: 272795 - DNA, 20 bp, Artificial Sequence
  chemically synthesized
tgtgtgcttaatttaatggg

SEQ ID NO: 272796 - DNA, 20 bp, Artificial Sequence
  chemically synthesized
tgcttaatttaatgggagga

SEQ ID NO: 272797 - DNA, 20 bp, Artificial Sequence
  chemically synthesized
tgggaggaaagactgaatgt

SEQ ID NO: 272798 - DNA, 20 bp, Artificial Sequence
  chemically synthesized
aattcttactaactcacatt

SEQ ID NO: 272799 - DNA, 20 bp, Artificial Sequence
  chemically synthesized
aggaaagactgaatgtgagt

SEQ ID NO: 272800 - DNA, 20 bp, Artificial Sequence
  chemically synthesized
aagactgaatgtgagttagt

SEQ ID NO: 272801 - DNA, 20 bp, Artificial Sequence
  chemically synthesized
agttagtaagaattactatc

SEQ ID NO: 272802 - DNA, 20 bp, Artificial Sequence
  chemically synthesized
gtaagaattactatctagat

SEQ ID NO: 272803 - DNA, 20 bp, Artificial Sequence
  chemically synthesized
atactaattcctcatctaga

SEQ ID NO: 272804 - DNA, 20 bp, Artificial Sequence
  chemically synthesized
taagaattactatctagatg

SEQ ID NO: 272805 - DNA, 20 bp, Artificial Sequence
  chemically synthesized
cttcatactaattcctcatc

SEQ ID NO: 272806 - DNA, 20 bp, Artificial Sequence
  chemically synthesized
ttactatctagatgaggaat

SEQ ID NO: 272807 - DNA, 20 bp, Artificial Sequence
  chemically synthesized
ctagatgaggaattagtatg

SEQ ID NO: 272808 - DNA, 20 bp, Artificial Sequence
  chemically synthesized
gaggaattagtatgaagcta

SEQ ID NO: 272809 - DNA, 20 bp, Artificial Sequence
  chemically synthesized
cactgaaacttaaggttctg

SEQ ID NO: 272810 - DNA, 20 bp, Artificial Sequence
  chemically synthesized
gtatgaagctacagaacctt

SEQ ID NO: 272811 - DNA, 20 bp, Artificial Sequence
  chemically synthesized
agctacagaaccttaagttt

SEQ ID NO: 272812 - DNA, 20 bp, Artificial Sequence
  chemically synthesized
gtgagaggcactgaaactta

SEQ ID NO: 272813 - DNA, 20 bp, Artificial Sequence
  chemically synthesized
agtgagaggcactgaaactt

SEQ ID NO: 272814 - DNA, 20 bp, Artificial Sequence
  chemically synthesized
aagggtctcttgcaagtgag

SEQ ID NO: 272815 - DNA, 20 bp, Artificial Sequence
  chemically synthesized
gaagggtctcttgcaagtga

SEQ ID NO: 272816 - DNA, 20 bp, Artificial Sequence
  chemically synthesized
tttcagtgcctctcacttgc

SEQ ID NO: 272817 - DNA, 20 bp, Artificial Sequence
  chemically synthesized
tagaagggtctcttgcaagt

SEQ ID NO: 272818 - DNA, 20 bp, Artificial Sequence
  chemically synthesized
tcagtgcctctcacttgcaa

SEQ ID NO: 272819 - DNA, 20 bp, Artificial Sequence
  chemically synthesized
tttatagaagggtctcttgc

SEQ ID NO: 272820 - DNA, 20 bp, Artificial Sequence
  chemically synthesized
ttaaatgctggtttatagaa

SEQ ID NO: 272821 - DNA, 20 bp, Artificial Sequence
  chemically synthesized
attaaatgctggtttataga

SEQ ID NO: 272822 - DNA, 20 bp, Artificial Sequence
  chemically synthesized
aattaaatgctggtttatag

SEQ ID NO: 272823 - DNA, 20 bp, Artificial Sequence
  chemically synthesized
caagagacccttctataaac

SEQ ID NO: 272824 - DNA, 20 bp, Artificial Sequence
  chemically synthesized
gaaaattaaatgctggttta

SEQ ID NO: 272825 - DNA, 20 bp, Artificial Sequence
  chemically synthesized
ataaatagaaaattaaatgc

SEQ ID NO: 272826 - DNA, 20 bp, Artificial Sequence
  chemically synthesized
ttgaaaaaaaaaattataaa

SEQ ID NO: 272827 - DNA, 20 bp, Artificial Sequence
  chemically synthesized
atttataattttttttttca

SEQ ID NO: 272828 - DNA, 20 bp, Artificial Sequence
  chemically synthesized
tttttttcaaagactgcccc

SEQ ID NO: 272829 - DNA, 20 bp, Artificial Sequence
  chemically synthesized
gcttctagaatttccagggg

SEQ ID NO: 272830 - DNA, 20 bp, Artificial Sequence
  chemically synthesized
tgagcttctagaatttccag

SEQ ID NO: 272831 - DNA, 20 bp, Artificial Sequence
  chemically synthesized
ctgagcttctagaatttcca

SEQ ID NO: 272832 - DNA, 20 bp, Artificial Sequence
  chemically synthesized
gctgagcttctagaatttcc

SEQ ID NO: 272833 - DNA, 20 bp, Artificial Sequence
  chemically synthesized
aagactgcccctggaaattc

SEQ ID NO: 272834 - DNA, 20 bp, Artificial Sequence
  chemically synthesized
tgctgagcttctagaatttc

SEQ ID NO: 272835 - DNA, 20 bp, Artificial Sequence
  chemically synthesized
actgcccctggaaattctag

SEQ ID NO: 272836 - DNA, 20 bp, Artificial Sequence
  chemically synthesized
ccctggaaattctagaagct

SEQ ID NO: 272837 - DNA, 20 bp, Artificial Sequence
  chemically synthesized
gctttgtaatgctgagcttc

SEQ ID NO: 272838 - DNA, 20 bp, Artificial Sequence
  chemically synthesized
ttgctttgctttgtaatgct

SEQ ID NO: 272839 - DNA, 20 bp, Artificial Sequence
  chemically synthesized
tctagaagctcagcattaca

SEQ ID NO: 272840 - DNA, 20 bp, Artificial Sequence
  chemically synthesized
aagctcagcattacaaagca

SEQ ID NO: 272841 - DNA, 20 bp, Artificial Sequence
  chemically synthesized
cagcattacaaagcaaagca

SEQ ID NO: 272842 - DNA, 20 bp, Artificial Sequence
  chemically synthesized
attacaaagcaaagcaaaga

SEQ ID NO: 272843 - DNA, 20 bp, Artificial Sequence
  chemically synthesized
aagcaaagcaaagatagcgt

SEQ ID NO: 272844 - DNA, 20 bp, Artificial Sequence
  chemically synthesized
cgtaagtgatcactgcaaca

SEQ ID NO: 272845 - DNA, 20 bp, Artificial Sequence
  chemically synthesized
gtaagtgatcactgcaacac

SEQ ID NO: 272846 - DNA, 20 bp, Artificial Sequence
  chemically synthesized
tatcaggaaggcctgtgttg

SEQ ID NO: 272847 - DNA, 20 bp, Artificial Sequence
  chemically synthesized
gcaacacaggccttcctgat

SEQ ID NO: 272848 - DNA, 20 bp, Artificial Sequence
  chemically synthesized
aaatgtggaacttatcagga

SEQ ID NO: 272849 - DNA, 20 bp, Artificial Sequence
  chemically synthesized
aaaatgtggaacttatcagg

SEQ ID NO: 272850 - DNA, 20 bp, Artificial Sequence
  chemically synthesized
gggaaaatgtggaacttatc

SEQ ID NO: 272851 - DNA, 20 bp, Artificial Sequence
  chemically synthesized
tgggaaaatgtggaacttat

SEQ ID NO: 272852 - DNA, 20 bp, Artificial Sequence
  chemically synthesized
atgactcatttgggaaaatg

SEQ ID NO: 272853 - DNA, 20 bp, Artificial Sequence
  chemically synthesized
agttccacattttcccaaat

SEQ ID NO: 272854 - DNA, 20 bp, Artificial Sequence
  chemically synthesized
gacaacaatatgactcattt

SEQ ID NO: 272855 - DNA, 20 bp, Artificial Sequence
  chemically synthesized
tgacaacaatatgactcatt

SEQ ID NO: 272856 - DNA, 20 bp, Artificial Sequence
  chemically synthesized
atgagtcatattgttgtcat

SEQ ID NO: 272857 - DNA, 20 bp, Artificial Sequence
  chemically synthesized
ttgtcataagtcataaataa

SEQ ID NO: 272858 - DNA, 20 bp, Artificial Sequence
  chemically synthesized
tgtcataagtcataaataat

SEQ ID NO: 272859 - DNA, 20 bp, Artificial Sequence
  chemically synthesized
ataaataataggaacaacaa

SEQ ID NO: 272860 - DNA, 20 bp, Artificial Sequence
  chemically synthesized
tcgagtgtttggttatatgt

SEQ ID NO: 272861 - DNA, 20 bp, Artificial Sequence
  chemically synthesized
acagataaaagtcgagtgtt

SEQ ID NO: 272862 - DNA, 20 bp, Artificial Sequence
  chemically synthesized
cctgccaacagataaaagtc

SEQ ID NO: 272863 - DNA, 20 bp, Artificial Sequence
  chemically synthesized
tgtcccctgccaacagataa

SEQ ID NO: 272864 - DNA, 20 bp, Artificial Sequence
  chemically synthesized
aacactcgacttttatctgt

SEQ ID NO: 272865 - DNA, 20 bp, Artificial Sequence
  chemically synthesized
actcgacttttatctgttgg

SEQ ID NO: 272866 - DNA, 20 bp, Artificial Sequence
  chemically synthesized
ctcgacttttatctgttggc

SEQ ID NO: 272867 - DNA, 20 bp, Artificial Sequence
  chemically synthesized
tcgacttttatctgttggca

SEQ ID NO: 272868 - DNA, 20 bp, Artificial Sequence
  chemically synthesized
cgacttttatctgttggcag

SEQ ID NO: 272869 - DNA, 20 bp, Artificial Sequence
  chemically synthesized
tccttcatgtcccctgccaa

SEQ ID NO: 272870 - DNA, 20 bp, Artificial Sequence
  chemically synthesized
atctgttggcaggggacatg

SEQ ID NO: 272871 - DNA, 20 bp, Artificial Sequence
  chemically synthesized
tctgttggcaggggacatga

SEQ ID NO: 272872 - DNA, 20 bp, Artificial Sequence
  chemically synthesized
ggcaggggacatgaaggacc

SEQ ID NO: 272873 - DNA, 20 bp, Artificial Sequence
  chemically synthesized
cattcctctcacaggttact

SEQ ID NO: 272874 - DNA, 20 bp, Artificial Sequence
  chemically synthesized
tgaaggaccaagtaacctgt

SEQ ID NO: 272875 - DNA, 20 bp, Artificial Sequence
  chemically synthesized
aaggaccaagtaacctgtga

SEQ ID NO: 272876 - DNA, 20 bp, Artificial Sequence
  chemically synthesized
aggaccaagtaacctgtgag

SEQ ID NO: 272877 - DNA, 20 bp, Artificial Sequence
  chemically synthesized
ttgcccaacattcctctcac

SEQ ID NO: 272878 - DNA, 20 bp, Artificial Sequence
  chemically synthesized
attgcccaacattcctctca

SEQ ID NO: 272879 - DNA, 20 bp, Artificial Sequence
  chemically synthesized
gtaacctgtgagaggaatgt

SEQ ID NO: 272880 - DNA, 20 bp, Artificial Sequence
  chemically synthesized
taacctgtgagaggaatgtt

SEQ ID NO: 272881 - DNA, 20 bp, Artificial Sequence
  chemically synthesized
gagaggaatgttgggcaatt

SEQ ID NO: 272882 - DNA, 20 bp, Artificial Sequence
  chemically synthesized
gaggaatgttgggcaatttg

SEQ ID NO: 272883 - DNA, 20 bp, Artificial Sequence
  chemically synthesized
tgttgggcaatttggagctc

SEQ ID NO: 272884 - DNA, 20 bp, Artificial Sequence
  chemically synthesized
gttgggcaatttggagctca

SEQ ID NO: 272885 - DNA, 20 bp, Artificial Sequence
  chemically synthesized
gcaatttggagctcaaggca

SEQ ID NO: 272886 - DNA, 20 bp, Artificial Sequence
  chemically synthesized
tccatggaatgctttgcctt

SEQ ID NO: 272887 - DNA, 20 bp, Artificial Sequence
  chemically synthesized
gctcaaggcaaagcattcca

SEQ ID NO: 272888 - DNA, 20 bp, Artificial Sequence
  chemically synthesized
tatgtatatttcaaattcca

SEQ ID NO: 272889 - DNA, 20 bp, Artificial Sequence
  chemically synthesized
atatacatatttccattaaa

SEQ ID NO: 272890 - DNA, 20 bp, Artificial Sequence
  chemically synthesized
cagtttttctaactatttaa

SEQ ID NO: 272891 - DNA, 20 bp, Artificial Sequence
  chemically synthesized
acatatttccattaaatagt

SEQ ID NO: 272892 - DNA, 20 bp, Artificial Sequence
  chemically synthesized
aaatagttagaaaaactgtt

SEQ ID NO: 272893 - DNA, 20 bp, Artificial Sequence
  chemically synthesized
aatagttagaaaaactgttg

SEQ ID NO: 272894 - DNA, 20 bp, Artificial Sequence
  chemically synthesized
acacagaagctcatcctcaa

SEQ ID NO: 272895 - DNA, 20 bp, Artificial Sequence
  chemically synthesized
ttagaaaaactgttgaggat

SEQ ID NO: 272896 - DNA, 20 bp, Artificial Sequence
  chemically synthesized
cgacctttctaaaaacacag

SEQ ID NO: 272897 - DNA, 20 bp, Artificial Sequence
  chemically synthesized
aggatgagcttctgtgtttt

SEQ ID NO: 272898 - DNA, 20 bp, Artificial Sequence
  chemically synthesized
tggcgacctttctaaaaaca

SEQ ID NO: 272899 - DNA, 20 bp, Artificial Sequence
  chemically synthesized
tgagcttctgtgtttttaga

SEQ ID NO: 272900 - DNA, 20 bp, Artificial Sequence
  chemically synthesized
gagcttctgtgtttttagaa

SEQ ID NO: 272901 - DNA, 20 bp, Artificial Sequence
  chemically synthesized
aatgttaataattttagtgg

SEQ ID NO: 272902 - DNA, 20 bp, Artificial Sequence
  chemically synthesized
ttcaatgttaataattttag

SEQ ID NO: 272903 - DNA, 20 bp, Artificial Sequence
  chemically synthesized
tttttcaatgttaataattt

SEQ ID NO: 272904 - DNA, 20 bp, Artificial Sequence
  chemically synthesized
catcattgaacatcatataa

SEQ ID NO: 272905 - DNA, 20 bp, Artificial Sequence
  chemically synthesized
attgaacatcatataaaagt

SEQ ID NO: 272906 - DNA, 20 bp, Artificial Sequence
  chemically synthesized
atgcctatacattatgataa

SEQ ID NO: 272907 - DNA, 20 bp, Artificial Sequence
  chemically synthesized
gagacttttatcataatgta

SEQ ID NO: 272908 - DNA, 20 bp, Artificial Sequence
  chemically synthesized
agacttttatcataatgtat

SEQ ID NO: 272909 - DNA, 20 bp, Artificial Sequence
  chemically synthesized
tcataatgtataggcatttc

SEQ ID NO: 272910 - DNA, 20 bp, Artificial Sequence
  chemically synthesized
tacaaatatgcgaatttcac

SEQ ID NO: 272911 - DNA, 20 bp, Artificial Sequence
  chemically synthesized
tagtgaaattcgcatatttg

SEQ ID NO: 272912 - DNA, 20 bp, Artificial Sequence
  chemically synthesized
tatctctaatcatattggaa

SEQ ID NO: 272913 - DNA, 20 bp, Artificial Sequence
  chemically synthesized
tagtactgttccaatatgat

SEQ ID NO: 272914 - DNA, 20 bp, Artificial Sequence
  chemically synthesized
aattttatctctaatcatat

SEQ ID NO: 272915 - DNA, 20 bp, Artificial Sequence
  chemically synthesized
gtactgttccaatatgatta

SEQ ID NO: 272916 - DNA, 20 bp, Artificial Sequence
  chemically synthesized
cataatctactcaatgcata

SEQ ID NO: 272917 - DNA, 20 bp, Artificial Sequence
  chemically synthesized
taaaattttctttatgcatt

SEQ ID NO: 272918 - DNA, 20 bp, Artificial Sequence
  chemically synthesized
aattttctttatgcattgag

SEQ ID NO: 272919 - DNA, 20 bp, Artificial Sequence
  chemically synthesized
tgagtagattatgcattaaa

SEQ ID NO: 272920 - DNA, 20 bp, Artificial Sequence
  chemically synthesized
attatgcattaaaaagaact

SEQ ID NO: 272921 - DNA, 20 bp, Artificial Sequence
  chemically synthesized
atgcattaaaaagaactcag

SEQ ID NO: 272922 - DNA, 20 bp, Artificial Sequence
  chemically synthesized
ccaaaatatgtttaaccact

SEQ ID NO: 272923 - DNA, 20 bp, Artificial Sequence
  chemically synthesized
ctcagtggttaaacatattt

SEQ ID NO: 272924 - DNA, 20 bp, Artificial Sequence
  chemically synthesized
taaacatattttggaaattg

SEQ ID NO: 272925 - DNA, 20 bp, Artificial Sequence
  chemically synthesized
atgaacatgtgtctatacca

SEQ ID NO: 272926 - DNA, 20 bp, Artificial Sequence
  chemically synthesized
ttctgagaagttctgtggta

SEQ ID NO: 272927 - DNA, 20 bp, Artificial Sequence
  chemically synthesized
aaatattctgagaagttctg

SEQ ID NO: 272928 - DNA, 20 bp, Artificial Sequence
  chemically synthesized
gtctataccacagaacttct

SEQ ID NO: 272929 - DNA, 20 bp, Artificial Sequence
  chemically synthesized
atattaataaatattctgag

SEQ ID NO: 272930 - DNA, 20 bp, Artificial Sequence
  chemically synthesized
tatatattaataaatattct

SEQ ID NO: 272931 - DNA, 20 bp, Artificial Sequence
  chemically synthesized
aatatatattgtgtatatcc

SEQ ID NO: 272932 - DNA, 20 bp, Artificial Sequence
  chemically synthesized
acaaagtgttgtatgattct

SEQ ID NO: 272933 - DNA, 20 bp, Artificial Sequence
  chemically synthesized
aagaatcatacaacactttg

SEQ ID NO: 272934 - DNA, 20 bp, Artificial Sequence
  chemically synthesized
gcaaaaggataacatctaca

SEQ ID NO: 272935 - DNA, 20 bp, Artificial Sequence
  chemically synthesized
ctctggcaaaaaaaagcaaa

SEQ ID NO: 272936 - DNA, 20 bp, Artificial Sequence
  chemically synthesized
actctggcaaaaaaaagcaa

SEQ ID NO: 272937 - DNA, 20 bp, Artificial Sequence
  chemically synthesized
tgatgcactctggcaaaaaa

SEQ ID NO: 272938 - DNA, 20 bp, Artificial Sequence
  chemically synthesized
atccttttgcttttttttgc

SEQ ID NO: 272939 - DNA, 20 bp, Artificial Sequence
  chemically synthesized
ccttttgcttttttttgcca

SEQ ID NO: 272940 - DNA, 20 bp, Artificial Sequence
  chemically synthesized
tctacttgtatgatgcactc

SEQ ID NO: 272941 - DNA, 20 bp, Artificial Sequence
  chemically synthesized
tttgccagagtgcatcatac

SEQ ID NO: 272942 - DNA, 20 bp, Artificial Sequence
  chemically synthesized
gccagagtgcatcatacaag

SEQ ID NO: 272943 - DNA, 20 bp, Artificial Sequence
  chemically synthesized
gtgcatcatacaagtagatt

SEQ ID NO: 272944 - DNA, 20 bp, Artificial Sequence
  chemically synthesized
catacaagtagatttggaaa

SEQ ID NO: 272945 - DNA, 20 bp, Artificial Sequence
  chemically synthesized
atacaagtagatttggaaaa

SEQ ID NO: 272946 - DNA, 20 bp, Artificial Sequence
  chemically synthesized
aatatgttaagtatatttga

SEQ ID NO: 272947 - DNA, 20 bp, Artificial Sequence
  chemically synthesized
ttattattaatgaatatgtt

SEQ ID NO: 272948 - DNA, 20 bp, Artificial Sequence
  chemically synthesized
gacattttattttataattt

SEQ ID NO: 272949 - DNA, 20 bp, Artificial Sequence
  chemically synthesized
tagaatcaattggaaatata

SEQ ID NO: 272950 - DNA, 20 bp, Artificial Sequence
  chemically synthesized
ttacccatagtagaatcaat

SEQ ID NO: 272951 - DNA, 20 bp, Artificial Sequence
  chemically synthesized
atttccaattgattctacta

SEQ ID NO: 272952 - DNA, 20 bp, Artificial Sequence
  chemically synthesized
tttccaattgattctactat

SEQ ID NO: 272953 - DNA, 20 bp, Artificial Sequence
  chemically synthesized
gttttacagcttacccatag

SEQ ID NO: 272954 - DNA, 20 bp, Artificial Sequence
  chemically synthesized
caattgattctactatgggt

SEQ ID NO: 272955 - DNA, 20 bp, Artificial Sequence
  chemically synthesized
catgttttacagcttaccca

SEQ ID NO: 272956 - DNA, 20 bp, Artificial Sequence
  chemically synthesized
tatgtgtcatgcatgtttta

SEQ ID NO: 272957 - DNA, 20 bp, Artificial Sequence
  chemically synthesized
catgcatgacacatatttgc

SEQ ID NO: 272958 - DNA, 20 bp, Artificial Sequence
  chemically synthesized
gaattaatgtgtaaagatgc

SEQ ID NO: 272959 - DNA, 20 bp, Artificial Sequence
  chemically synthesized
ttttgtggaattaatgtgta

SEQ ID NO: 272960 - DNA, 20 bp, Artificial Sequence
  chemically synthesized
caatttaaatgtaaattttg

SEQ ID NO: 272961 - DNA, 20 bp, Artificial Sequence
  chemically synthesized
tttaaattgtaattaacttt

SEQ ID NO: 272962 - DNA, 20 bp, Artificial Sequence
  chemically synthesized
atatcctaagtacaagctaa

SEQ ID NO: 272963 - DNA, 20 bp, Artificial Sequence
  chemically synthesized
attaacttttagcttgtact

SEQ ID NO: 272964 - DNA, 20 bp, Artificial Sequence
  chemically synthesized
ttaacttttagcttgtactt

SEQ ID NO: 272965 - DNA, 20 bp, Artificial Sequence
  chemically synthesized
gtaaaagatatcctaagtac

SEQ ID NO: 272966 - DNA, 20 bp, Artificial Sequence
  chemically synthesized
tagctggtaaaagatatcct

SEQ ID NO: 272967 - DNA, 20 bp, Artificial Sequence
  chemically synthesized
gtacttaggatatcttttac

SEQ ID NO: 272968 - DNA, 20 bp, Artificial Sequence
  chemically synthesized
ttaggtaaagtagctggtaa

SEQ ID NO: 272969 - DNA, 20 bp, Artificial Sequence
  chemically synthesized
acgaggttaggtaaagtagc

SEQ ID NO: 272970 - DNA, 20 bp, Artificial Sequence
  chemically synthesized
tctgacgaggttaggtaaag

SEQ ID NO: 272971 - DNA, 20 bp, Artificial Sequence
  chemically synthesized
agttctgacgaggttaggta

SEQ ID NO: 272972 - DNA, 20 bp, Artificial Sequence
  chemically synthesized
aatacagttctgacgaggtt

SEQ ID NO: 272973 - DNA, 20 bp, Artificial Sequence
  chemically synthesized
gctactttacctaacctcgt

SEQ ID NO: 272974 - DNA, 20 bp, Artificial Sequence
  chemically synthesized
gaatacagttctgacgaggt

SEQ ID NO: 272975 - DNA, 20 bp, Artificial Sequence
  chemically synthesized
tccagaatacagttctgacg

SEQ ID NO: 272976 - DNA, 20 bp, Artificial Sequence
  chemically synthesized
ttccagaatacagttctgac

SEQ ID NO: 272977 - DNA, 20 bp, Artificial Sequence
  chemically synthesized
acctcgtcagaactgtattc

SEQ ID NO: 272978 - DNA, 20 bp, Artificial Sequence
  chemically synthesized
acttatgtggttccagaata

SEQ ID NO: 272979 - DNA, 20 bp, Artificial Sequence
  chemically synthesized
attttttacttatgtggttc

SEQ ID NO: 272980 - DNA, 20 bp, Artificial Sequence
  chemically synthesized
actgtattctggaaccacat

SEQ ID NO: 272981 - DNA, 20 bp, Artificial Sequence
  chemically synthesized
ctaagcattttttacttatg

SEQ ID NO: 272982 - DNA, 20 bp, Artificial Sequence
  chemically synthesized
ccacataagtaaaaaatgct

SEQ ID NO: 272983 - DNA, 20 bp, Artificial Sequence
  chemically synthesized
gtaaaaaatgcttagcactt

SEQ ID NO: 272984 - DNA, 20 bp, Artificial Sequence
  chemically synthesized
taagcctgcgctaaagtgct

SEQ ID NO: 272985 - DNA, 20 bp, Artificial Sequence
  chemically synthesized
aaatgcttagcactttagcg

SEQ ID NO: 272986 - DNA, 20 bp, Artificial Sequence
  chemically synthesized
aatgcttagcactttagcgc

SEQ ID NO: 272987 - DNA, 20 bp, Artificial Sequence
  chemically synthesized
ttcacaataagcctgcgcta

SEQ ID NO: 272988 - DNA, 20 bp, Artificial Sequence
  chemically synthesized
ttacttttctatttcacaat

SEQ ID NO: 272989 - DNA, 20 bp, Artificial Sequence
  chemically synthesized
agcgcaggcttattgtgaaa

SEQ ID NO: 272990 - DNA, 20 bp, Artificial Sequence
  chemically synthesized
aggcttattgtgaaatagaa

SEQ ID NO: 272991 - DNA, 20 bp, Artificial Sequence
  chemically synthesized
taatattctgttatttgtac

SEQ ID NO: 272992 - DNA, 20 bp, Artificial Sequence
  chemically synthesized
aaagtaacttgtacaaataa

SEQ ID NO: 272993 - DNA, 20 bp, Artificial Sequence
  chemically synthesized
cagaatattattgaaacttc

SEQ ID NO: 272994 - DNA, 20 bp, Artificial Sequence
  chemically synthesized
agaatattattgaaacttct

SEQ ID NO: 272995 - DNA, 20 bp, Artificial Sequence
  chemically synthesized
atattattgaaacttctggg

SEQ ID NO: 272996 - DNA, 20 bp, Artificial Sequence
  chemically synthesized
taggagattgttcttcccag

SEQ ID NO: 272997 - DNA, 20 bp, Artificial Sequence
  chemically synthesized
acataggagattgttcttcc

SEQ ID NO: 272998 - DNA, 20 bp, Artificial Sequence
  chemically synthesized
tatgagtgatttttacatag

SEQ ID NO: 272999 - DNA, 20 bp, Artificial Sequence
  chemically synthesized
tttatgagtgatttttacat

SEQ ID NO: 273000 - DNA, 20 bp, Artificial Sequence
  chemically synthesized
ttttatgagtgatttttaca

SEQ ID NO: 273001 - DNA, 20 bp, Artificial Sequence
  chemically synthesized
gtaaaaatcactcataaaaa

SEQ ID NO: 273002 - DNA, 20 bp, Artificial Sequence
  chemically synthesized
attacattgtctttttttat

SEQ ID NO: 273003 - DNA, 20 bp, Artificial Sequence
  chemically synthesized
atattctcataatgtcaaaa

SEQ ID NO: 273004 - DNA, 20 bp, Artificial Sequence
  chemically synthesized
attttcttttttgacattat

SEQ ID NO: 273005 - DNA, 20 bp, Artificial Sequence
  chemically synthesized
acattatgagaatatgatga

SEQ ID NO: 273006 - DNA, 20 bp, Artificial Sequence
  chemically synthesized
gatgaaagaaaataaaattg

SEQ ID NO: 273007 - DNA, 20 bp, Artificial Sequence
  chemically synthesized
gaaagaaaataaaattgtgg

SEQ ID NO: 273008 - DNA, 20 bp, Artificial Sequence
  chemically synthesized
aaaattgtggaagaaaacat

SEQ ID NO: 273009 - DNA, 20 bp, Artificial Sequence
  chemically synthesized
aaattgtggaagaaaacatt

SEQ ID NO: 273010 - DNA, 20 bp, Artificial Sequence
  chemically synthesized
aattgtggaagaaaacattg

SEQ ID NO: 273011 - DNA, 20 bp, Artificial Sequence
  chemically synthesized
gtggaagaaaacattgggga

SEQ ID NO: 273012 - DNA, 20 bp, Artificial Sequence
  chemically synthesized
gaagaaaacattggggatag

SEQ ID NO: 273013 - DNA, 20 bp, Artificial Sequence
  chemically synthesized
gggatagaagattcaatctg

SEQ ID NO: 273014 - DNA, 20 bp, Artificial Sequence
  chemically synthesized
ggatagaagattcaatctga

SEQ ID NO: 273015 - DNA, 20 bp, Artificial Sequence
  chemically synthesized
gtagagagatcattttcctt

SEQ ID NO: 273016 - DNA, 20 bp, Artificial Sequence
  chemically synthesized
aaatctagtagacaagtaga

SEQ ID NO: 273017 - DNA, 20 bp, Artificial Sequence
  chemically synthesized
agaaatctagtagacaagta

SEQ ID NO: 273018 - DNA, 20 bp, Artificial Sequence
  chemically synthesized
ttagaaatctagtagacaag

SEQ ID NO: 273019 - DNA, 20 bp, Artificial Sequence
  chemically synthesized
tgatctctctacttgtctac

SEQ ID NO: 273020 - DNA, 20 bp, Artificial Sequence
  chemically synthesized
aacttagaaatctagtagac

SEQ ID NO: 273021 - DNA, 20 bp, Artificial Sequence
  chemically synthesized
aggacaacttagaaatctag

SEQ ID NO: 273022 - DNA, 20 bp, Artificial Sequence
  chemically synthesized
tacttgtctactagatttct

SEQ ID NO: 273023 - DNA, 20 bp, Artificial Sequence
  chemically synthesized
tttaggacaacttagaaatc

SEQ ID NO: 273024 - DNA, 20 bp, Artificial Sequence
  chemically synthesized
ctcacatctttaggacaact

SEQ ID NO: 273025 - DNA, 20 bp, Artificial Sequence
  chemically synthesized
tagatttctaagttgtccta

SEQ ID NO: 273026 - DNA, 20 bp, Artificial Sequence
  chemically synthesized
tatacatccctcacatcttt

SEQ ID NO: 273027 - DNA, 20 bp, Artificial Sequence
  chemically synthesized
ctaagttgtcctaaagatgt

SEQ ID NO: 273028 - DNA, 20 bp, Artificial Sequence
  chemically synthesized
ttatacatccctcacatctt

SEQ ID NO: 273029 - DNA, 20 bp, Artificial Sequence
  chemically synthesized
taagttgtcctaaagatgtg

SEQ ID NO: 273030 - DNA, 20 bp, Artificial Sequence
  chemically synthesized
aagttgtcctaaagatgtga

SEQ ID NO: 273031 - DNA, 20 bp, Artificial Sequence
  chemically synthesized
atgtgagggatgtataattt

SEQ ID NO: 273032 - DNA, 20 bp, Artificial Sequence
  chemically synthesized
tccccctagatgtatatatt

SEQ ID NO: 273033 - DNA, 20 bp, Artificial Sequence
  chemically synthesized
atccccctagatgtatatat

SEQ ID NO: 273034 - DNA, 20 bp, Artificial Sequence
  chemically synthesized
tttcacctaatatatacatc

SEQ ID NO: 273035 - DNA, 20 bp, Artificial Sequence
  chemically synthesized
ttcacctaatatatacatct

SEQ ID NO: 273036 - DNA, 20 bp, Artificial Sequence
  chemically synthesized
tcacctaatatatacatcta

SEQ ID NO: 273037 - DNA, 20 bp, Artificial Sequence
  chemically synthesized
cacctaatatatacatctag

SEQ ID NO: 273038 - DNA, 20 bp, Artificial Sequence
  chemically synthesized
acctaatatatacatctagg

SEQ ID NO: 273039 - DNA, 20 bp, Artificial Sequence
  chemically synthesized
gcttactatccatatccccc

SEQ ID NO: 273040 - DNA, 20 bp, Artificial Sequence
  chemically synthesized
tatatacatctagggggata

SEQ ID NO: 273041 - DNA, 20 bp, Artificial Sequence
  chemically synthesized
tacatctagggggatatgga

SEQ ID NO: 273042 - DNA, 20 bp, Artificial Sequence
  chemically synthesized
tctagggggatatggatagt

SEQ ID NO: 273043 - DNA, 20 bp, Artificial Sequence
  chemically synthesized
atatggatagtaagcatttg

SEQ ID NO: 273044 - DNA, 20 bp, Artificial Sequence
  chemically synthesized
agcatttgaagaaaacaaat

SEQ ID NO: 273045 - DNA, 20 bp, Artificial Sequence
  chemically synthesized
caagaatagttgtatgtggt

SEQ ID NO: 273046 - DNA, 20 bp, Artificial Sequence
  chemically synthesized
ttcacaagaatagttgtatg

SEQ ID NO: 273047 - DNA, 20 bp, Artificial Sequence
  chemically synthesized
ggctgataatttcacaagaa

SEQ ID NO: 273048 - DNA, 20 bp, Artificial Sequence
  chemically synthesized
agccaggctgataatttcac

SEQ ID NO: 273049 - DNA, 20 bp, Artificial Sequence
  chemically synthesized
aactattcttgtgaaattat

SEQ ID NO: 273050 - DNA, 20 bp, Artificial Sequence
  chemically synthesized
ttcttgtgaaattatcagcc

SEQ ID NO: 273051 - DNA, 20 bp, Artificial Sequence
  chemically synthesized
tactgattttatacgaagcc

SEQ ID NO: 273052 - DNA, 20 bp, Artificial Sequence
  chemically synthesized
ttactgattttatacgaagc

SEQ ID NO: 273053 - DNA, 20 bp, Artificial Sequence
  chemically synthesized
gagtttactgattttatacg

SEQ ID NO: 273054 - DNA, 20 bp, Artificial Sequence
  chemically synthesized
agcctggcttcgtataaaat

SEQ ID NO: 273055 - DNA, 20 bp, Artificial Sequence
  chemically synthesized
ataaaatcagtaaactctaa

SEQ ID NO: 273056 - DNA, 20 bp, Artificial Sequence
  chemically synthesized
ctctcactttgtttccatta

SEQ ID NO: 273057 - DNA, 20 bp, Artificial Sequence
  chemically synthesized
tcctctcactttgtttccat

SEQ ID NO: 273058 - DNA, 20 bp, Artificial Sequence
  chemically synthesized
agtaaactctaatggaaaca

SEQ ID NO: 273059 - DNA, 20 bp, Artificial Sequence
  chemically synthesized
aactctaatggaaacaaagt

SEQ ID NO: 273060 - DNA, 20 bp, Artificial Sequence
  chemically synthesized
ctctaatggaaacaaagtga

SEQ ID NO: 273061 - DNA, 20 bp, Artificial Sequence
  chemically synthesized
tctaatggaaacaaagtgag

SEQ ID NO: 273062 - DNA, 20 bp, Artificial Sequence
  chemically synthesized
ggaaacaaagtgagaggaca

SEQ ID NO: 273063 - DNA, 20 bp, Artificial Sequence
  chemically synthesized
tgagaggacatagcaaatca

SEQ ID NO: 273064 - DNA, 20 bp, Artificial Sequence
  chemically synthesized
gcatatgtgagtgttcacat

SEQ ID NO: 273065 - DNA, 20 bp, Artificial Sequence
  chemically synthesized
acacctcatagagcatatgt

SEQ ID NO: 273066 - DNA, 20 bp, Artificial Sequence
  chemically synthesized
aacactcacatatgctctat

SEQ ID NO: 273067 - DNA, 20 bp, Artificial Sequence
  chemically synthesized
acactcacatatgctctatg

SEQ ID NO: 273068 - DNA, 20 bp, Artificial Sequence
  chemically synthesized
tggattgagaacacctcata

SEQ ID NO: 273069 - DNA, 20 bp, Artificial Sequence
  chemically synthesized
actggattgagaacacctca

SEQ ID NO: 273070 - DNA, 20 bp, Artificial Sequence
  chemically synthesized
tctatgaggtgttctcaatc

SEQ ID NO: 273071 - DNA, 20 bp, Artificial Sequence
  chemically synthesized
attctgaaaggtactggatt

SEQ ID NO: 273072 - DNA, 20 bp, Artificial Sequence
  chemically synthesized
ctagtgattctgaaaggtac

SEQ ID NO: 273073 - DNA, 20 bp, Artificial Sequence
  chemically synthesized
gttctcaatccagtaccttt

SEQ ID NO: 273074 - DNA, 20 bp, Artificial Sequence
  chemically synthesized
gaaaatctagtgattctgaa

SEQ ID NO: 273075 - DNA, 20 bp, Artificial Sequence
  chemically synthesized
agaaaatctagtgattctga

SEQ ID NO: 273076 - DNA, 20 bp, Artificial Sequence
  chemically synthesized
ccagtacctttcagaatcac

SEQ ID NO: 273077 - DNA, 20 bp, Artificial Sequence
  chemically synthesized
tgactttgatgaagaaaatc

SEQ ID NO: 273078 - DNA, 20 bp, Artificial Sequence
  chemically synthesized
tcactagattttcttcatca

SEQ ID NO: 273079 - DNA, 20 bp, Artificial Sequence
  chemically synthesized
tatattacttgactttgatg

SEQ ID NO: 273080 - DNA, 20 bp, Artificial Sequence
  chemically synthesized
agattttcttcatcaaagtc

SEQ ID NO: 273081 - DNA, 20 bp, Artificial Sequence
  chemically synthesized
catcaaagtcaagtaatata

SEQ ID NO: 273082 - DNA, 20 bp, Artificial Sequence
  chemically synthesized
gtcttttttaatataatgga

SEQ ID NO: 273083 - DNA, 20 bp, Artificial Sequence
  chemically synthesized
aaatgtcttttttaatataa

SEQ ID NO: 273084 - DNA, 20 bp, Artificial Sequence
  chemically synthesized
atctttccattatattaaaa

SEQ ID NO: 273085 - DNA, 20 bp, Artificial Sequence
  chemically synthesized
ttatattaaaaaagacattt

SEQ ID NO: 273086 - DNA, 20 bp, Artificial Sequence
  chemically synthesized
ttataatggaatgttgagat

SEQ ID NO: 273087 - DNA, 20 bp, Artificial Sequence
  chemically synthesized
cttttttataatggaatgtt

SEQ ID NO: 273088 - DNA, 20 bp, Artificial Sequence
  chemically synthesized
ctcaaatgccttttttataa

SEQ ID NO: 273089 - DNA, 20 bp, Artificial Sequence
  chemically synthesized
ctcaacattccattataaaa

SEQ ID NO: 273090 - DNA, 20 bp, Artificial Sequence
  chemically synthesized
tcaacattccattataaaaa

SEQ ID NO: 273091 - DNA, 20 bp, Artificial Sequence
  chemically synthesized
ccattataaaaaaggcattt

SEQ ID NO: 273092 - DNA, 20 bp, Artificial Sequence
  chemically synthesized
aaaaaaggcatttgagcatg

SEQ ID NO: 273093 - DNA, 20 bp, Artificial Sequence
  chemically synthesized
gcatgcagtaactatgttca

SEQ ID NO: 273094 - DNA, 20 bp, Artificial Sequence
  chemically synthesized
aatatatagtgctgtgaaca

SEQ ID NO: 273095 - DNA, 20 bp, Artificial Sequence
  chemically synthesized
attttcctactttgaatata

SEQ ID NO: 273096 - DNA, 20 bp, Artificial Sequence
  chemically synthesized
ttcacagcactatatattca

SEQ ID NO: 273097 - DNA, 20 bp, Artificial Sequence
  chemically synthesized
acagcactatatattcaaag

SEQ ID NO: 273098 - DNA, 20 bp, Artificial Sequence
  chemically synthesized
cagcactatatattcaaagt

SEQ ID NO: 273099 - DNA, 20 bp, Artificial Sequence
  chemically synthesized
tcaaagtaggaaaataaaac

SEQ ID NO: 273100 - DNA, 20 bp, Artificial Sequence
  chemically synthesized
taccatattcaatggaaaaa

SEQ ID NO: 273101 - DNA, 20 bp, Artificial Sequence
  chemically synthesized
aaccatttttccattgaata

SEQ ID NO: 273102 - DNA, 20 bp, Artificial Sequence
  chemically synthesized
ttgccctttaccatattcaa

SEQ ID NO: 273103 - DNA, 20 bp, Artificial Sequence
  chemically synthesized
tttttccattgaatatggta

SEQ ID NO: 273104 - DNA, 20 bp, Artificial Sequence
  chemically synthesized
ttttccattgaatatggtaa

SEQ ID NO: 273105 - DNA, 20 bp, Artificial Sequence
  chemically synthesized
tttccattgaatatggtaaa

SEQ ID NO: 273106 - DNA, 20 bp, Artificial Sequence
  chemically synthesized
tatggtaaagggcaaaatta

SEQ ID NO: 273107 - DNA, 20 bp, Artificial Sequence
  chemically synthesized
ttaatgtttgaatgattttt

SEQ ID NO: 273108 - DNA, 20 bp, Artificial Sequence
  chemically synthesized
cattaatcacattttaaata

SEQ ID NO: 273109 - DNA, 20 bp, Artificial Sequence
  chemically synthesized
attaatcacattttaaatat

SEQ ID NO: 273110 - DNA, 20 bp, Artificial Sequence
  chemically synthesized
attttaaatataggacttta

SEQ ID NO: 273111 - DNA, 20 bp, Artificial Sequence
  chemically synthesized
tctctgctcagttaactgta

SEQ ID NO: 273112 - DNA, 20 bp, Artificial Sequence
  chemically synthesized
ataggactttacagttaact

SEQ ID NO: 273113 - DNA, 20 bp, Artificial Sequence
  chemically synthesized
ggactttacagttaactgag

SEQ ID NO: 273114 - DNA, 20 bp, Artificial Sequence
  chemically synthesized
actttacagttaactgagca

SEQ ID NO: 273115 - DNA, 20 bp, Artificial Sequence
  chemically synthesized
tttacagttaactgagcaga

SEQ ID NO: 273116 - DNA, 20 bp, Artificial Sequence
  chemically synthesized
aaacagccctgctctctgct

SEQ ID NO: 273117 - DNA, 20 bp, Artificial Sequence
  chemically synthesized
acagttaactgagcagagag

SEQ ID NO: 273118 - DNA, 20 bp, Artificial Sequence
  chemically synthesized
cagttaactgagcagagagc

SEQ ID NO: 273119 - DNA, 20 bp, Artificial Sequence
  chemically synthesized
agttaactgagcagagagca

SEQ ID NO: 273120 - DNA, 20 bp, Artificial Sequence
  chemically synthesized
gtaaagcaagattttaaaaa

SEQ ID NO: 273121 - DNA, 20 bp, Artificial Sequence
  chemically synthesized
atggtttgatgaggtaaagc

SEQ ID NO: 273122 - DNA, 20 bp, Artificial Sequence
  chemically synthesized
gagaatggtttgatgaggta

SEQ ID NO: 273123 - DNA, 20 bp, Artificial Sequence
  chemically synthesized
tatatgagaatggtttgatg

SEQ ID NO: 273124 - DNA, 20 bp, Artificial Sequence
  chemically synthesized
atatatgagaatggtttgat

SEQ ID NO: 273125 - DNA, 20 bp, Artificial Sequence
  chemically synthesized
tgttactatatatatgagaa

SEQ ID NO: 273126 - DNA, 20 bp, Artificial Sequence
  chemically synthesized
tcaaaccattctcatatata

SEQ ID NO: 273127 - DNA, 20 bp, Artificial Sequence
  chemically synthesized
ttttctgttactatatatat

SEQ ID NO: 273128 - DNA, 20 bp, Artificial Sequence
  chemically synthesized
cattctcatatatatagtaa

SEQ ID NO: 273129 - DNA, 20 bp, Artificial Sequence
  chemically synthesized
atatatatagtaacagaaaa

SEQ ID NO: 273130 - DNA, 20 bp, Artificial Sequence
  chemically synthesized
atatagtaacagaaaatggc

SEQ ID NO: 273131 - DNA, 20 bp, Artificial Sequence
  chemically synthesized
ctgctgcagtataattttgc

SEQ ID NO: 273132 - DNA, 20 bp, Artificial Sequence
  chemically synthesized
tggccagcaaaattatactg

SEQ ID NO: 273133 - DNA, 20 bp, Artificial Sequence
  chemically synthesized
ccagcaaaattatactgcag

SEQ ID NO: 273134 - DNA, 20 bp, Artificial Sequence
  chemically synthesized
cagcaaaattatactgcagc

SEQ ID NO: 273135 - DNA, 20 bp, Artificial Sequence
  chemically synthesized
ttaagtactttagcctgctg

SEQ ID NO: 273136 - DNA, 20 bp, Artificial Sequence
  chemically synthesized
aattatactgcagcaggcta

SEQ ID NO: 273137 - DNA, 20 bp, Artificial Sequence
  chemically synthesized
cttcattctgttaagtactt

SEQ ID NO: 273138 - DNA, 20 bp, Artificial Sequence
  chemically synthesized
cagcaggctaaagtacttaa

SEQ ID NO: 273139 - DNA, 20 bp, Artificial Sequence
  chemically synthesized
atcattttcttcattctgtt

SEQ ID NO: 273140 - DNA, 20 bp, Artificial Sequence
  chemically synthesized
ctaaagtacttaacagaatg

SEQ ID NO: 273141 - DNA, 20 bp, Artificial Sequence
  chemically synthesized
aaatgatatcaaataattat

SEQ ID NO: 273142 - DNA, 20 bp, Artificial Sequence
  chemically synthesized
atgatatcaaataattattg

SEQ ID NO: 273143 - DNA, 20 bp, Artificial Sequence
  chemically synthesized
aataattattggagtttctg

SEQ ID NO: 273144 - DNA, 20 bp, Artificial Sequence
  chemically synthesized
ttttcctttctttgacacca

SEQ ID NO: 273145 - DNA, 20 bp, Artificial Sequence
  chemically synthesized
ttggagtttctgtggtgtca

SEQ ID NO: 273146 - DNA, 20 bp, Artificial Sequence
  chemically synthesized
agtttctgtggtgtcaaaga

SEQ ID NO: 273147 - DNA, 20 bp, Artificial Sequence
  chemically synthesized
gtttctgtggtgtcaaagaa

SEQ ID NO: 273148 - DNA, 20 bp, Artificial Sequence
  chemically synthesized
tgtcaaagaaaggaaaaatt

SEQ ID NO: 273149 - DNA, 20 bp, Artificial Sequence
  chemically synthesized
tcaaagaaaggaaaaattta

SEQ ID NO: 273150 - DNA, 20 bp, Artificial Sequence
  chemically synthesized
aggaaaaatttagagaaaat

SEQ ID NO: 273151 - DNA, 20 bp, Artificial Sequence
  chemically synthesized
gagaaaataagaaaatattt

SEQ ID NO: 273152 - DNA, 20 bp, Artificial Sequence
  chemically synthesized
ataagaaaatattttagtaa

SEQ ID NO: 273153 - DNA, 20 bp, Artificial Sequence
  chemically synthesized
atattaaaatacttcatgtt

SEQ ID NO: 273154 - DNA, 20 bp, Artificial Sequence
  chemically synthesized
caatcagtagtctcaacatg

SEQ ID NO: 273155 - DNA, 20 bp, Artificial Sequence
  chemically synthesized
tacgttcctccatcaatcag

SEQ ID NO: 273156 - DNA, 20 bp, Artificial Sequence
  chemically synthesized
atgttgagactactgattga

SEQ ID NO: 273157 - DNA, 20 bp, Artificial Sequence
  chemically synthesized
gttgagactactgattgatg

SEQ ID NO: 273158 - DNA, 20 bp, Artificial Sequence
  chemically synthesized
tggtacgttcctccatcaat

SEQ ID NO: 273159 - DNA, 20 bp, Artificial Sequence
  chemically synthesized
ttgagactactgattgatgg

SEQ ID NO: 273160 - DNA, 20 bp, Artificial Sequence
  chemically synthesized
atggaggaacgtaccactgt

SEQ ID NO: 273161 - DNA, 20 bp, Artificial Sequence
  chemically synthesized
caaaattactaatctaacag

SEQ ID NO: 273162 - DNA, 20 bp, Artificial Sequence
  chemically synthesized
ggaacgtaccactgttagat

SEQ ID NO: 273163 - DNA, 20 bp, Artificial Sequence
  chemically synthesized
tttcaaaattactaatctaa

SEQ ID NO: 273164 - DNA, 20 bp, Artificial Sequence
  chemically synthesized
tgttagattagtaattttga

SEQ ID NO: 273165 - DNA, 20 bp, Artificial Sequence
  chemically synthesized
ttagattagtaattttgaaa

SEQ ID NO: 273166 - DNA, 20 bp, Artificial Sequence
  chemically synthesized
attagtaattttgaaagagc

SEQ ID NO: 273167 - DNA, 20 bp, Artificial Sequence
  chemically synthesized
aatagcaatttcaaaattac

SEQ ID NO: 273168 - DNA, 20 bp, Artificial Sequence
  chemically synthesized
attttgaaattgctattttc

SEQ ID NO: 273169 - DNA, 20 bp, Artificial Sequence
  chemically synthesized
ccatttccctttcttgaaaa

SEQ ID NO: 273170 - DNA, 20 bp, Artificial Sequence
  chemically synthesized
tgaaattgctattttcaaga

SEQ ID NO: 273171 - DNA, 20 bp, Artificial Sequence
  chemically synthesized
gaaattgctattttcaagaa

SEQ ID NO: 273172 - DNA, 20 bp, Artificial Sequence
  chemically synthesized
aaattgctattttcaagaaa

SEQ ID NO: 273173 - DNA, 20 bp, Artificial Sequence
  chemically synthesized
ctattttcaagaaagggaaa

SEQ ID NO: 273174 - DNA, 20 bp, Artificial Sequence
  chemically synthesized
ttctaagtacgtgtgatatg

SEQ ID NO: 273175 - DNA, 20 bp, Artificial Sequence
  chemically synthesized
ggccacatatcacacgtact

SEQ ID NO: 273176 - DNA, 20 bp, Artificial Sequence
  chemically synthesized
ttttgtttctttcgttttct

SEQ ID NO: 273177 - DNA, 20 bp, Artificial Sequence
  chemically synthesized
cacacgtacttagaaaacga

SEQ ID NO: 273178 - DNA, 20 bp, Artificial Sequence
  chemically synthesized
aaagaaacaaaatatatcaa

SEQ ID NO: 273179 - DNA, 20 bp, Artificial Sequence
  chemically synthesized
acaaaatatatcaaaagatt

SEQ ID NO: 273180 - DNA, 20 bp, Artificial Sequence
  chemically synthesized
caaaatatatcaaaagattt

SEQ ID NO: 273181 - DNA, 20 bp, Artificial Sequence
  chemically synthesized
gggatgatatgtactttcca

SEQ ID NO: 273182 - DNA, 20 bp, Artificial Sequence
  chemically synthesized
tgcattttcctatctttgga

SEQ ID NO: 273183 - DNA, 20 bp, Artificial Sequence
  chemically synthesized
tgatatgtactttccaaaga

SEQ ID NO: 273184 - DNA, 20 bp, Artificial Sequence
  chemically synthesized
gatatgtactttccaaagat

SEQ ID NO: 273185 - DNA, 20 bp, Artificial Sequence
  chemically synthesized
ttcttgcattttcctatctt

SEQ ID NO: 273186 - DNA, 20 bp, Artificial Sequence
  chemically synthesized
ttccaaagataggaaaatgc

SEQ ID NO: 273187 - DNA, 20 bp, Artificial Sequence
  chemically synthesized
aagaaatataattattttca

SEQ ID NO: 273188 - DNA, 20 bp, Artificial Sequence
  chemically synthesized
catagaaaaaaaatgttgaa

SEQ ID NO: 273189 - DNA, 20 bp, Artificial Sequence
  chemically synthesized
aaaaaaatgttgaaaagttt

SEQ ID NO: 273190 - DNA, 20 bp, Artificial Sequence
  chemically synthesized
aaaaaatgttgaaaagtttc

SEQ ID NO: 273191 - DNA, 20 bp, Artificial Sequence
  chemically synthesized
ttacttgttgaattattata

SEQ ID NO: 273192 - DNA, 20 bp, Artificial Sequence
  chemically synthesized
atactttataataattcaac

SEQ ID NO: 273193 - DNA, 20 bp, Artificial Sequence
  chemically synthesized
aataattcaacaagtaaaaa

SEQ ID NO: 273194 - DNA, 20 bp, Artificial Sequence
  chemically synthesized
aattcaacaagtaaaaaaag

SEQ ID NO: 273195 - DNA, 20 bp, Artificial Sequence
  chemically synthesized
aaaaaaagaagaaattcaca

SEQ ID NO: 273196 - DNA, 20 bp, Artificial Sequence
  chemically synthesized
tttaaaaaaagagtagtaca

SEQ ID NO: 273197 - DNA, 20 bp, Artificial Sequence
  chemically synthesized
gggggggtttaaaaaaagag

SEQ ID NO: 273198 - DNA, 20 bp, Artificial Sequence
  chemically synthesized
ggggggggggtttaaaaaaa

SEQ ID NO: 273199 - DNA, 20 bp, Artificial Sequence
  chemically synthesized
tgggggggggggtttaaaaa

SEQ ID NO: 273200 - DNA, 20 bp, Artificial Sequence
  chemically synthesized
gtaactctacttgggggggg

SEQ ID NO: 273201 - DNA, 20 bp, Artificial Sequence
  chemically synthesized
ttttttaaaccccccccccc

SEQ ID NO: 273202 - DNA, 20 bp, Artificial Sequence
  chemically synthesized
agtaactctacttggggggg

SEQ ID NO: 273203 - DNA, 20 bp, Artificial Sequence
  chemically synthesized
aagtaactctacttgggggg

SEQ ID NO: 273204 - DNA, 20 bp, Artificial Sequence
  chemically synthesized
taagtaactctacttggggg

SEQ ID NO: 273205 - DNA, 20 bp, Artificial Sequence
  chemically synthesized
tttaaacccccccccccaag

SEQ ID NO: 273206 - DNA, 20 bp, Artificial Sequence
  chemically synthesized
ctaagtaactctacttgggg

SEQ ID NO: 273207 - DNA, 20 bp, Artificial Sequence
  chemically synthesized
tctaagtaactctacttggg

SEQ ID NO: 273208 - DNA, 20 bp, Artificial Sequence
  chemically synthesized
taaacccccccccccaagta

SEQ ID NO: 273209 - DNA, 20 bp, Artificial Sequence
  chemically synthesized
ttctaagtaactctacttgg

SEQ ID NO: 273210 - DNA, 20 bp, Artificial Sequence
  chemically synthesized
tttctaagtaactctacttg

SEQ ID NO: 273211 - DNA, 20 bp, Artificial Sequence
  chemically synthesized
ttttctaagtaactctactt

SEQ ID NO: 273212 - DNA, 20 bp, Artificial Sequence
  chemically synthesized
tttttctaagtaactctact

SEQ ID NO: 273213 - DNA, 20 bp, Artificial Sequence
  chemically synthesized
cccccccaagtagagttact

SEQ ID NO: 273214 - DNA, 20 bp, Artificial Sequence
  chemically synthesized
tttaaaggtaatatttttct

SEQ ID NO: 273215 - DNA, 20 bp, Artificial Sequence
  chemically synthesized
gctgacaaaatttaatttaa

SEQ ID NO: 273216 - DNA, 20 bp, Artificial Sequence
  chemically synthesized
agctgacaaaatttaattta

SEQ ID NO: 273217 - DNA, 20 bp, Artificial Sequence
  chemically synthesized
acctttaaattaaattttgt

SEQ ID NO: 273218 - DNA, 20 bp, Artificial Sequence
  chemically synthesized
aaattaaattttgtcagcta

SEQ ID NO: 273219 - DNA, 20 bp, Artificial Sequence
  chemically synthesized
ttaaattttgtcagctaaag

SEQ ID NO: 273220 - DNA, 20 bp, Artificial Sequence
  chemically synthesized
gataaaagtcaaaacttctt

SEQ ID NO: 273221 - DNA, 20 bp, Artificial Sequence
  chemically synthesized
aaagaagttttgacttttat

SEQ ID NO: 273222 - DNA, 20 bp, Artificial Sequence
  chemically synthesized
ctattgcatatttctgataa

SEQ ID NO: 273223 - DNA, 20 bp, Artificial Sequence
  chemically synthesized
cttttatcagaaatatgcaa

SEQ ID NO: 273224 - DNA, 20 bp, Artificial Sequence
  chemically synthesized
ttttatcagaaatatgcaat

SEQ ID NO: 273225 - DNA, 20 bp, Artificial Sequence
  chemically synthesized
cagaaatatgcaataggcca

SEQ ID NO: 273226 - DNA, 20 bp, Artificial Sequence
  chemically synthesized
agaaatatgcaataggccaa

SEQ ID NO: 273227 - DNA, 20 bp, Artificial Sequence
  chemically synthesized
atgcaataggccaaaggaaa

SEQ ID NO: 273228 - DNA, 20 bp, Artificial Sequence
  chemically synthesized
ctgaaatagactgtttcctt

SEQ ID NO: 273229 - DNA, 20 bp, Artificial Sequence
  chemically synthesized
ccaaaggaaacagtctattt

SEQ ID NO: 273230 - DNA, 20 bp, Artificial Sequence
  chemically synthesized
atgtaggggagacactgaaa

SEQ ID NO: 273231 - DNA, 20 bp, Artificial Sequence
  chemically synthesized
tgtcaaggaacaatgtaggg

SEQ ID NO: 273232 - DNA, 20 bp, Artificial Sequence
  chemically synthesized
tatgtcaaggaacaatgtag

SEQ ID NO: 273233 - DNA, 20 bp, Artificial Sequence
  chemically synthesized
atatgtcaaggaacaatgta

SEQ ID NO: 273234 - DNA, 20 bp, Artificial Sequence
  chemically synthesized
catatgtcaaggaacaatgt

SEQ ID NO: 273235 - DNA, 20 bp, Artificial Sequence
  chemically synthesized
tcatatgtcaaggaacaatg

SEQ ID NO: 273236 - DNA, 20 bp, Artificial Sequence
  chemically synthesized
accacaaaactcatatgtca

SEQ ID NO: 273237 - DNA, 20 bp, Artificial Sequence
  chemically synthesized
tacattgttccttgacatat

SEQ ID NO: 273238 - DNA, 20 bp, Artificial Sequence
  chemically synthesized
taccacaaaactcatatgtc

SEQ ID NO: 273239 - DNA, 20 bp, Artificial Sequence
  chemically synthesized
tccttgacatatgagttttg

SEQ ID NO: 273240 - DNA, 20 bp, Artificial Sequence
  chemically synthesized
gtggtatatcaacatatttc

SEQ ID NO: 273241 - DNA, 20 bp, Artificial Sequence
  chemically synthesized
ggtatatcaacatatttctg

SEQ ID NO: 273242 - DNA, 20 bp, Artificial Sequence
  chemically synthesized
gtatatcaacatatttctgg

SEQ ID NO: 273243 - DNA, 20 bp, Artificial Sequence
  chemically synthesized
caacatatttctggaggaaa

SEQ ID NO: 273244 - DNA, 20 bp, Artificial Sequence
  chemically synthesized
gccacagacactttttcctc

SEQ ID NO: 273245 - DNA, 20 bp, Artificial Sequence
  chemically synthesized
tctggaggaaaaagtgtctg

SEQ ID NO: 273246 - DNA, 20 bp, Artificial Sequence
  chemically synthesized
ctaaatttgataagaagcca

SEQ ID NO: 273247 - DNA, 20 bp, Artificial Sequence
  chemically synthesized
tttaacctaaatttgataag

SEQ ID NO: 273248 - DNA, 20 bp, Artificial Sequence
  chemically synthesized
aagtttaacctaaatttgat

SEQ ID NO: 273249 - DNA, 20 bp, Artificial Sequence
  chemically synthesized
ctgtggcttcttatcaaatt

SEQ ID NO: 273250 - DNA, 20 bp, Artificial Sequence
  chemically synthesized
tgtggcttcttatcaaattt

SEQ ID NO: 273251 - DNA, 20 bp, Artificial Sequence
  chemically synthesized
ttttgtattttcaaaaataa

SEQ ID NO: 273252 - DNA, 20 bp, Artificial Sequence
  chemically synthesized
ttatttttgaaaatacaaaa

SEQ ID NO: 273253 - DNA, 20 bp, Artificial Sequence
  chemically synthesized
tttttgaaaatacaaaaaag

SEQ ID NO: 273254 - DNA, 20 bp, Artificial Sequence
  chemically synthesized
ttttgaaaatacaaaaaagt

SEQ ID NO: 273255 - DNA, 20 bp, Artificial Sequence
  chemically synthesized
aaaagtgggtcaaaaatctc

SEQ ID NO: 273256 - DNA, 20 bp, Artificial Sequence
  chemically synthesized
agtgggtcaaaaatctccag

SEQ ID NO: 273257 - DNA, 20 bp, Artificial Sequence
  chemically synthesized
tgggtcaaaaatctccagca

SEQ ID NO: 273258 - DNA, 20 bp, Artificial Sequence
  chemically synthesized
tatgctttacttctctgctg

SEQ ID NO: 273259 - DNA, 20 bp, Artificial Sequence
  chemically synthesized
gtcaaaaatctccagcagag

SEQ ID NO: 273260 - DNA, 20 bp, Artificial Sequence
  chemically synthesized
tatatgctttacttctctgc

SEQ ID NO: 273261 - DNA, 20 bp, Artificial Sequence
  chemically synthesized
aaatctccagcagagaagta

SEQ ID NO: 273262 - DNA, 20 bp, Artificial Sequence
  chemically synthesized
gttctgtggtcaagattacg

SEQ ID NO: 273263 - DNA, 20 bp, Artificial Sequence
  chemically synthesized
tttctgcgtaatcttgacca

SEQ ID NO: 273264 - DNA, 20 bp, Artificial Sequence
  chemically synthesized
ttttaaacggttctgtggtc

SEQ ID NO: 273265 - DNA, 20 bp, Artificial Sequence
  chemically synthesized
tttatttttaaacggttctg

SEQ ID NO: 273266 - DNA, 20 bp, Artificial Sequence
  chemically synthesized
tccaattttttatttttaaa

SEQ ID NO: 273267 - DNA, 20 bp, Artificial Sequence
  chemically synthesized
accgtttaaaaataaaaaat

SEQ ID NO: 273268 - DNA, 20 bp, Artificial Sequence
  chemically synthesized
tcgtttctcaggtatattac

SEQ ID NO: 273269 - DNA, 20 bp, Artificial Sequence
  chemically synthesized
ttattacttgtaatatacct

SEQ ID NO: 273270 - DNA, 20 bp, Artificial Sequence
  chemically synthesized
taagcgtaacatcgtttctc

SEQ ID NO: 273271 - DNA, 20 bp, Artificial Sequence
  chemically synthesized
ctaagcgtaacatcgtttct

SEQ ID NO: 273272 - DNA, 20 bp, Artificial Sequence
  chemically synthesized
ctgagaaacgatgttacgct

SEQ ID NO: 273273 - DNA, 20 bp, Artificial Sequence
  chemically synthesized
tcgttgtcgttattatgact

SEQ ID NO: 273274 - DNA, 20 bp, Artificial Sequence
  chemically synthesized
cataataacgacaacgataa

SEQ ID NO: 273275 - DNA, 20 bp, Artificial Sequence
  chemically synthesized
aataacgacaacgataatag

SEQ ID NO: 273276 - DNA, 20 bp, Artificial Sequence
  chemically synthesized
taacgacaacgataatagaa

SEQ ID NO: 273277 - DNA, 20 bp, Artificial Sequence
  chemically synthesized
taataatgtattttctaaca

SEQ ID NO: 273278 - DNA, 20 bp, Artificial Sequence
  chemically synthesized
tctgtgaagaatgtctttgt

SEQ ID NO: 273279 - DNA, 20 bp, Artificial Sequence
  chemically synthesized
tctaacaaagacattcttca

SEQ ID NO: 273280 - DNA, 20 bp, Artificial Sequence
  chemically synthesized
ttgttttttctatttctgtg

SEQ ID NO: 273281 - DNA, 20 bp, Artificial Sequence
  chemically synthesized
aaagacattcttcacagaaa

SEQ ID NO: 273282 - DNA, 20 bp, Artificial Sequence
  chemically synthesized
tgcagttccatataaatttt

SEQ ID NO: 273283 - DNA, 20 bp, Artificial Sequence
  chemically synthesized
aaacaatcttaaaatttata

SEQ ID NO: 273284 - DNA, 20 bp, Artificial Sequence
  chemically synthesized
ttaaaatttatatggaactg

SEQ ID NO: 273285 - DNA, 20 bp, Artificial Sequence
  chemically synthesized
aaatttatatggaactgcag

SEQ ID NO: 273286 - DNA, 20 bp, Artificial Sequence
  chemically synthesized
tggctattctgggtctgctg

SEQ ID NO: 273287 - DNA, 20 bp, Artificial Sequence
  chemically synthesized
atatggaactgcagcagacc

SEQ ID NO: 273288 - DNA, 20 bp, Artificial Sequence
  chemically synthesized
gaactgcagcagacccagaa

SEQ ID NO: 273289 - DNA, 20 bp, Artificial Sequence
  chemically synthesized
aggatatatttggctattct

SEQ ID NO: 273290 - DNA, 20 bp, Artificial Sequence
  chemically synthesized
taggatatatttggctattc

SEQ ID NO: 273291 - DNA, 20 bp, Artificial Sequence
  chemically synthesized
ttttttgcttaggatatatt

SEQ ID NO: 273292 - DNA, 20 bp, Artificial Sequence
  chemically synthesized
agaatagccaaatatatcct

SEQ ID NO: 273293 - DNA, 20 bp, Artificial Sequence
  chemically synthesized
agtttcattcttttttgctt

SEQ ID NO: 273294 - DNA, 20 bp, Artificial Sequence
  chemically synthesized
caaatatatcctaagcaaaa

SEQ ID NO: 273295 - DNA, 20 bp, Artificial Sequence
  chemically synthesized
cagtttcattcttttttgct

SEQ ID NO: 273296 - DNA, 20 bp, Artificial Sequence
  chemically synthesized
taagcaaaaaagaatgaaac

SEQ ID NO: 273297 - DNA, 20 bp, Artificial Sequence
  chemically synthesized
agcaaaaaagaatgaaactg

SEQ ID NO: 273298 - DNA, 20 bp, Artificial Sequence
  chemically synthesized
gcaaaaaagaatgaaactgg

SEQ ID NO: 273299 - DNA, 20 bp, Artificial Sequence
  chemically synthesized
gttaggtaaagtgattcctc

SEQ ID NO: 273300 - DNA, 20 bp, Artificial Sequence
  chemically synthesized
gtataatttaaagttaggta

SEQ ID NO: 273301 - DNA, 20 bp, Artificial Sequence
  chemically synthesized
gtgtagtataatttaaagtt

SEQ ID NO: 273302 - DNA, 20 bp, Artificial Sequence
  chemically synthesized
tgtgtagtataatttaaagt

SEQ ID NO: 273303 - DNA, 20 bp, Artificial Sequence
  chemically synthesized
tagctgtgtagtataattta

SEQ ID NO: 273304 - DNA, 20 bp, Artificial Sequence
  chemically synthesized
taactttaaattatactaca

SEQ ID NO: 273305 - DNA, 20 bp, Artificial Sequence
  chemically synthesized
tttcggttactatagctgtg

SEQ ID NO: 273306 - DNA, 20 bp, Artificial Sequence
  chemically synthesized
taaattatactacacagcta

SEQ ID NO: 273307 - DNA, 20 bp, Artificial Sequence
  chemically synthesized
ccatgctgtttcggttacta

SEQ ID NO: 273308 - DNA, 20 bp, Artificial Sequence
  chemically synthesized
cacagctatagtaaccgaaa

SEQ ID NO: 273309 - DNA, 20 bp, Artificial Sequence
  chemically synthesized
aagccagtaccatgctgttt

SEQ ID NO: 273310 - DNA, 20 bp, Artificial Sequence
  chemically synthesized
ctatagtaaccgaaacagca

SEQ ID NO: 273311 - DNA, 20 bp, Artificial Sequence
  chemically synthesized
taaccgaaacagcatggtac

SEQ ID NO: 273312 - DNA, 20 bp, Artificial Sequence
  chemically synthesized
aaacagcatggtactggctt

SEQ ID NO: 273313 - DNA, 20 bp, Artificial Sequence
  chemically synthesized
ctgtgtgtttgcgcttaagc

SEQ ID NO: 273314 - DNA, 20 bp, Artificial Sequence
  chemically synthesized
tgggctgtgtgtttgcgctt

SEQ ID NO: 273315 - DNA, 20 bp, Artificial Sequence
  chemically synthesized
ctggcttaagcgcaaacaca

SEQ ID NO: 273316 - DNA, 20 bp, Artificial Sequence
  chemically synthesized
agcgcaaacacacagcccaa

SEQ ID NO: 273317 - DNA, 20 bp, Artificial Sequence
  chemically synthesized
aaacacacagcccaatagaa

SEQ ID NO: 273318 - DNA, 20 bp, Artificial Sequence
  chemically synthesized
gttctctattctgttctatt

SEQ ID NO: 273319 - DNA, 20 bp, Artificial Sequence
  chemically synthesized
tgttctctattctgttctat

SEQ ID NO: 273320 - DNA, 20 bp, Artificial Sequence
  chemically synthesized
cacagcccaatagaacagaa

SEQ ID NO: 273321 - DNA, 20 bp, Artificial Sequence
  chemically synthesized
cagcccaatagaacagaata

SEQ ID NO: 273322 - DNA, 20 bp, Artificial Sequence
  chemically synthesized
atagaacagaatagagaaca

SEQ ID NO: 273323 - DNA, 20 bp, Artificial Sequence
  chemically synthesized
agaacagaatagagaacaca

SEQ ID NO: 273324 - DNA, 20 bp, Artificial Sequence
  chemically synthesized
attaggtccctgtagatgta

SEQ ID NO: 273325 - DNA, 20 bp, Artificial Sequence
  chemically synthesized
gagataaatccatacatcta

SEQ ID NO: 273326 - DNA, 20 bp, Artificial Sequence
  chemically synthesized
agataaatccatacatctac

SEQ ID NO: 273327 - DNA, 20 bp, Artificial Sequence
  chemically synthesized
gataaatccatacatctaca

SEQ ID NO: 273328 - DNA, 20 bp, Artificial Sequence
  chemically synthesized
tgtcaaaaattaggtccctg

SEQ ID NO: 273329 - DNA, 20 bp, Artificial Sequence
  chemically synthesized
ttggcactttgtcaaaaatt

SEQ ID NO: 273330 - DNA, 20 bp, Artificial Sequence
  chemically synthesized
cttggcactttgtcaaaaat

SEQ ID NO: 273331 - DNA, 20 bp, Artificial Sequence
  chemically synthesized
cagggacctaatttttgaca

SEQ ID NO: 273332 - DNA, 20 bp, Artificial Sequence
  chemically synthesized
ctaatttttgacaaagtgcc

SEQ ID NO: 273333 - DNA, 20 bp, Artificial Sequence
  chemically synthesized
ctttccccaaagtgtgttct

SEQ ID NO: 273334 - DNA, 20 bp, Artificial Sequence
  chemically synthesized
aaagtgccaagaacacactt

SEQ ID NO: 273335 - DNA, 20 bp, Artificial Sequence
  chemically synthesized
aagtgccaagaacacacttt

SEQ ID NO: 273336 - DNA, 20 bp, Artificial Sequence
  chemically synthesized
agtgccaagaacacactttg

SEQ ID NO: 273337 - DNA, 20 bp, Artificial Sequence
  chemically synthesized
ccaagaacacactttgggga

SEQ ID NO: 273338 - DNA, 20 bp, Artificial Sequence
  chemically synthesized
caagaacacactttggggaa

SEQ ID NO: 273339 - DNA, 20 bp, Artificial Sequence
  chemically synthesized
ttgaaggactcctttcccca

SEQ ID NO: 273340 - DNA, 20 bp, Artificial Sequence
  chemically synthesized
agaacacactttggggaaag

SEQ ID NO: 273341 - DNA, 20 bp, Artificial Sequence
  chemically synthesized
ttcccagcaccatttattga

SEQ ID NO: 273342 - DNA, 20 bp, Artificial Sequence
  chemically synthesized
gaaaggagtccttcaataaa

SEQ ID NO: 273343 - DNA, 20 bp, Artificial Sequence
  chemically synthesized
tttcccagcaccatttattg

SEQ ID NO: 273344 - DNA, 20 bp, Artificial Sequence
  chemically synthesized
agtccttcaataaatggtgc

SEQ ID NO: 273345 - DNA, 20 bp, Artificial Sequence
  chemically synthesized
gtccttcaataaatggtgct

SEQ ID NO: 273346 - DNA, 20 bp, Artificial Sequence
  chemically synthesized
ataaatggtgctgggaaaat

SEQ ID NO: 273347 - DNA, 20 bp, Artificial Sequence
  chemically synthesized
atttggatatccaattttcc

SEQ ID NO: 273348 - DNA, 20 bp, Artificial Sequence
  chemically synthesized
gaaaattggatatccaaatg

SEQ ID NO: 273349 - DNA, 20 bp, Artificial Sequence
  chemically synthesized
gtctggttttattctgcatt

SEQ ID NO: 273350 - DNA, 20 bp, Artificial Sequence
  chemically synthesized
atccaaatgcagaataaaac

SEQ ID NO: 273351 - DNA, 20 bp, Artificial Sequence
  chemically synthesized
tacggttcaagatagaggtc

SEQ ID NO: 273352 - DNA, 20 bp, Artificial Sequence
  chemically synthesized
ctgtatacggttcaagatag

SEQ ID NO: 273353 - DNA, 20 bp, Artificial Sequence
  chemically synthesized
tctgtatacggttcaagata

SEQ ID NO: 273354 - DNA, 20 bp, Artificial Sequence
  chemically synthesized
tttctgtatacggttcaaga

SEQ ID NO: 273355 - DNA, 20 bp, Artificial Sequence
  chemically synthesized
ttgatttctgtatacggttc

SEQ ID NO: 273356 - DNA, 20 bp, Artificial Sequence
  chemically synthesized
cctctatcttgaaccgtata

SEQ ID NO: 273357 - DNA, 20 bp, Artificial Sequence
  chemically synthesized
tttgatttgatttctgtata

SEQ ID NO: 273358 - DNA, 20 bp, Artificial Sequence
  chemically synthesized
atacagaaatcaaatcaaaa

SEQ ID NO: 273359 - DNA, 20 bp, Artificial Sequence
  chemically synthesized
tggattaaatacttaaatct

SEQ ID NO: 273360 - DNA, 20 bp, Artificial Sequence
  chemically synthesized
taatttgaggtcttagattt

SEQ ID NO: 273361 - DNA, 20 bp, Artificial Sequence
  chemically synthesized
agtttcataatttgaggtct

SEQ ID NO: 273362 - DNA, 20 bp, Artificial Sequence
  chemically synthesized
tgtggtagtttcataatttg

SEQ ID NO: 273363 - DNA, 20 bp, Artificial Sequence
  chemically synthesized
ttgtggtagtttcataattt

SEQ ID NO: 273364 - DNA, 20 bp, Artificial Sequence
  chemically synthesized
tcaaattatgaaactaccac

SEQ ID NO: 273365 - DNA, 20 bp, Artificial Sequence
  chemically synthesized
ctcccaaagttttcttgtgg

SEQ ID NO: 273366 - DNA, 20 bp, Artificial Sequence
  chemically synthesized
tttctcccaaagttttcttg

SEQ ID NO: 273367 - DNA, 20 bp, Artificial Sequence
  chemically synthesized
aaactaccacaagaaaactt

SEQ ID NO: 273368 - DNA, 20 bp, Artificial Sequence
  chemically synthesized
aactaccacaagaaaacttt

SEQ ID NO: 273369 - DNA, 20 bp, Artificial Sequence
  chemically synthesized
ctaccacaagaaaactttgg

SEQ ID NO: 273370 - DNA, 20 bp, Artificial Sequence
  chemically synthesized
tgttctggaggtttctccca

SEQ ID NO: 273371 - DNA, 20 bp, Artificial Sequence
  chemically synthesized
aaaactttgggagaaacctc

SEQ ID NO: 273372 - DNA, 20 bp, Artificial Sequence
  chemically synthesized
tgcctagaccaatgttctgg

SEQ ID NO: 273373 - DNA, 20 bp, Artificial Sequence
  chemically synthesized
ttgcctagaccaatgttctg

SEQ ID NO: 273374 - DNA, 20 bp, Artificial Sequence
  chemically synthesized
gggagaaacctccagaacat

SEQ ID NO: 273375 - DNA, 20 bp, Artificial Sequence
  chemically synthesized
tcttgcctagaccaatgttc

SEQ ID NO: 273376 - DNA, 20 bp, Artificial Sequence
  chemically synthesized
aaacctccagaacattggtc

SEQ ID NO: 273377 - DNA, 20 bp, Artificial Sequence
  chemically synthesized
aacctccagaacattggtct

SEQ ID NO: 273378 - DNA, 20 bp, Artificial Sequence
  chemically synthesized
tccagaacattggtctaggc

SEQ ID NO: 273379 - DNA, 20 bp, Artificial Sequence
  chemically synthesized
tggttcaagaatttcttgcc

SEQ ID NO: 273380 - DNA, 20 bp, Artificial Sequence
  chemically synthesized
gtgcttgtgtggtatggttc

SEQ ID NO: 273381 - DNA, 20 bp, Artificial Sequence
  chemically synthesized
ttgcctgtgcttgtgtggta

SEQ ID NO: 273382 - DNA, 20 bp, Artificial Sequence
  chemically synthesized
attcttgaaccataccacac

SEQ ID NO: 273383 - DNA, 20 bp, Artificial Sequence
  chemically synthesized
tttggttgcctgtgcttgtg

SEQ ID NO: 273384 - DNA, 20 bp, Artificial Sequence
  chemically synthesized
tgaaccataccacacaagca

SEQ ID NO: 273385 - DNA, 20 bp, Artificial Sequence
  chemically synthesized
gaaccataccacacaagcac

SEQ ID NO: 273386 - DNA, 20 bp, Artificial Sequence
  chemically synthesized
cacacaagcacaggcaacca

SEQ ID NO: 273387 - DNA, 20 bp, Artificial Sequence
  chemically synthesized
ccatttgtccatttttgctt

SEQ ID NO: 273388 - DNA, 20 bp, Artificial Sequence
  chemically synthesized
acaggcaaccaaagcaaaaa

SEQ ID NO: 273389 - DNA, 20 bp, Artificial Sequence
  chemically synthesized
ccaaagcaaaaatggacaaa

SEQ ID NO: 273390 - DNA, 20 bp, Artificial Sequence
  chemically synthesized
tggacaaatggtaacacacc

SEQ ID NO: 273391 - DNA, 20 bp, Artificial Sequence
  chemically synthesized
tgtgaagaagatttttaact

SEQ ID NO: 273392 - DNA, 20 bp, Artificial Sequence
  chemically synthesized
ttgtatgctttgttgtgaag

SEQ ID NO: 273393 - DNA, 20 bp, Artificial Sequence
  chemically synthesized
taaaaatcttcttcacaaca

SEQ ID NO: 273394 - DNA, 20 bp, Artificial Sequence
  chemically synthesized
gggttgtatgctttgttgtg

SEQ ID NO: 273395 - DNA, 20 bp, Artificial Sequence
  chemically synthesized
aacaaagcatacaacccaca

SEQ ID NO: 273396 - DNA, 20 bp, Artificial Sequence
  chemically synthesized
gggttgtctcttcactttgt

SEQ ID NO: 273397 - DNA, 20 bp, Artificial Sequence
  chemically synthesized
agcatacaacccacaaagtg

SEQ ID NO: 273398 - DNA, 20 bp, Artificial Sequence
  chemically synthesized
tgggttgtctcttcactttg

SEQ ID NO: 273399 - DNA, 20 bp, Artificial Sequence
  chemically synthesized
catacaacccacaaagtgaa

SEQ ID NO: 273400 - DNA, 20 bp, Artificial Sequence
  chemically synthesized
caaagtgaagagacaaccca

SEQ ID NO: 273401 - DNA, 20 bp, Artificial Sequence
  chemically synthesized
tgaagagacaacccatggaa

SEQ ID NO: 273402 - DNA, 20 bp, Artificial Sequence
  chemically synthesized
gaagagacaacccatggaat

SEQ ID NO: 273403 - DNA, 20 bp, Artificial Sequence
  chemically synthesized
aatattttctcccattccat

SEQ ID NO: 273404 - DNA, 20 bp, Artificial Sequence
  chemically synthesized
aaatattttctcccattcca

SEQ ID NO: 273405 - DNA, 20 bp, Artificial Sequence
  chemically synthesized
agagacaacccatggaatgg

SEQ ID NO: 273406 - DNA, 20 bp, Artificial Sequence
  chemically synthesized
cccttgtcagatgggtagtt

SEQ ID NO: 273407 - DNA, 20 bp, Artificial Sequence
  chemically synthesized
ttgatcccttgtcagatggg

SEQ ID NO: 273408 - DNA, 20 bp, Artificial Sequence
  chemically synthesized
ttccaaactacccatctgac

SEQ ID NO: 273409 - DNA, 20 bp, Artificial Sequence
  chemically synthesized
ttattgatcccttgtcagat

SEQ ID NO: 273410 - DNA, 20 bp, Artificial Sequence
  chemically synthesized
tccaaactacccatctgaca

SEQ ID NO: 273411 - DNA, 20 bp, Artificial Sequence
  chemically synthesized
gttattgatcccttgtcaga

SEQ ID NO: 273412 - DNA, 20 bp, Artificial Sequence
  chemically synthesized
ccaaactacccatctgacaa

SEQ ID NO: 273413 - DNA, 20 bp, Artificial Sequence
  chemically synthesized
tctagttattgatcccttgt

SEQ ID NO: 273414 - DNA, 20 bp, Artificial Sequence
  chemically synthesized
tctgacaagggatcaataac

SEQ ID NO: 273415 - DNA, 20 bp, Artificial Sequence
  chemically synthesized
tttgagctctttatatattc

SEQ ID NO: 273416 - DNA, 20 bp, Artificial Sequence
  chemically synthesized
atcaataactagaatatata

SEQ ID NO: 273417 - DNA, 20 bp, Artificial Sequence
  chemically synthesized
caataactagaatatataaa

SEQ ID NO: 273418 - DNA, 20 bp, Artificial Sequence
  chemically synthesized
tttttcctatagagttgttt

SEQ ID NO: 273419 - DNA, 20 bp, Artificial Sequence
  chemically synthesized
aaagagctcaaacaactcta

SEQ ID NO: 273420 - DNA, 20 bp, Artificial Sequence
  chemically synthesized
aagagctcaaacaactctat

SEQ ID NO: 273421 - DNA, 20 bp, Artificial Sequence
  chemically synthesized
attattagttttttcctata

SEQ ID NO: 273422 - DNA, 20 bp, Artificial Sequence
  chemically synthesized
agattattagttttttccta

SEQ ID NO: 273423 - DNA, 20 bp, Artificial Sequence
  chemically synthesized
cccatttttaatcagattat

SEQ ID NO: 273424 - DNA, 20 bp, Artificial Sequence
  chemically synthesized
atattttgcccatttttaat

SEQ ID NO: 273425 - DNA, 20 bp, Artificial Sequence
  chemically synthesized
actaataatctgattaaaaa

SEQ ID NO: 273426 - DNA, 20 bp, Artificial Sequence
  chemically synthesized
ctaataatctgattaaaaat

SEQ ID NO: 273427 - DNA, 20 bp, Artificial Sequence
  chemically synthesized
aaatgggcaaaatatctgaa

SEQ ID NO: 273428 - DNA, 20 bp, Artificial Sequence
  chemically synthesized
ctttcaaaaaaaagtctatt

SEQ ID NO: 273429 - DNA, 20 bp, Artificial Sequence
  chemically synthesized
atttatcttctttcaaaaaa

SEQ ID NO: 273430 - DNA, 20 bp, Artificial Sequence
  chemically synthesized
ctgaatagacttttttttga

SEQ ID NO: 273431 - DNA, 20 bp, Artificial Sequence
  chemically synthesized
aatagacttttttttgaaag

SEQ ID NO: 273432 - DNA, 20 bp, Artificial Sequence
  chemically synthesized
gaaagaagataaatgacaaa

SEQ ID NO: 273433 - DNA, 20 bp, Artificial Sequence
  chemically synthesized
aaagaagataaatgacaaac

SEQ ID NO: 273434 - DNA, 20 bp, Artificial Sequence
  chemically synthesized
atgacaaacgggtatatgaa

SEQ ID NO: 273435 - DNA, 20 bp, Artificial Sequence
  chemically synthesized
tgacaaacgggtatatgaaa

SEQ ID NO: 273436 - DNA, 20 bp, Artificial Sequence
  chemically synthesized
gacaaacgggtatatgaaaa

SEQ ID NO: 273437 - DNA, 20 bp, Artificial Sequence
  chemically synthesized
ctgttatgatcagtgatatt

SEQ ID NO: 273438 - DNA, 20 bp, Artificial Sequence
  chemically synthesized
ctcaatatcactgatcataa

SEQ ID NO: 273439 - DNA, 20 bp, Artificial Sequence
  chemically synthesized
atttactattctgttatgat

SEQ ID NO: 273440 - DNA, 20 bp, Artificial Sequence
  chemically synthesized
tatcactgatcataacagaa

SEQ ID NO: 273441 - DNA, 20 bp, Artificial Sequence
  chemically synthesized
agaatagtaaatcaaaacca

SEQ ID NO: 273442 - DNA, 20 bp, Artificial Sequence
  chemically synthesized
tagtaaatcaaaaccacagt

SEQ ID NO: 273443 - DNA, 20 bp, Artificial Sequence
  chemically synthesized
agtgagattatatctcactg

SEQ ID NO: 273444 - DNA, 20 bp, Artificial Sequence
  chemically synthesized
aaaaccatttgagttgaagt

SEQ ID NO: 273445 - DNA, 20 bp, Artificial Sequence
  chemically synthesized
aaataaaaccatttgagttg

SEQ ID NO: 273446 - DNA, 20 bp, Artificial Sequence
  chemically synthesized
taatctcacttcaactcaaa

SEQ ID NO: 273447 - DNA, 20 bp, Artificial Sequence
  chemically synthesized
ttttataaataaaaccattt

SEQ ID NO: 273448 - DNA, 20 bp, Artificial Sequence
  chemically synthesized
aatggttttatttataaaac

SEQ ID NO: 273449 - DNA, 20 bp, Artificial Sequence
  chemically synthesized
aaacaagcaataacaaatgt

SEQ ID NO: 273450 - DNA, 20 bp, Artificial Sequence
  chemically synthesized
aagcaataacaaatgttggc

SEQ ID NO: 273451 - DNA, 20 bp, Artificial Sequence
  chemically synthesized
agcaataacaaatgttggcg

SEQ ID NO: 273452 - DNA, 20 bp, Artificial Sequence
  chemically synthesized
aacaaatgttggcgaggata

SEQ ID NO: 273453 - DNA, 20 bp, Artificial Sequence
  chemically synthesized
caaatgttggcgaggatatg

SEQ ID NO: 273454 - DNA, 20 bp, Artificial Sequence
  chemically synthesized
gttggcgaggatatggagaa

SEQ ID NO: 273455 - DNA, 20 bp, Artificial Sequence
  chemically synthesized
ttggcgaggatatggagaaa

SEQ ID NO: 273456 - DNA, 20 bp, Artificial Sequence
  chemically synthesized
tggcgaggatatggagaaaa

SEQ ID NO: 273457 - DNA, 20 bp, Artificial Sequence
  chemically synthesized
ttcctaccagcagtgtatga

SEQ ID NO: 273458 - DNA, 20 bp, Artificial Sequence
  chemically synthesized
attcctaccagcagtgtatg

SEQ ID NO: 273459 - DNA, 20 bp, Artificial Sequence
  chemically synthesized
cattcctaccagcagtgtat

SEQ ID NO: 273460 - DNA, 20 bp, Artificial Sequence
  chemically synthesized
agggaaccctcatacactgc

SEQ ID NO: 273461 - DNA, 20 bp, Artificial Sequence
  chemically synthesized
gaaccctcatacactgctgg

SEQ ID NO: 273462 - DNA, 20 bp, Artificial Sequence
  chemically synthesized
aaccctcatacactgctggt

SEQ ID NO: 273463 - DNA, 20 bp, Artificial Sequence
  chemically synthesized
ctagtttacattcctaccag

SEQ ID NO: 273464 - DNA, 20 bp, Artificial Sequence
  chemically synthesized
gtactagtttacattcctac

SEQ ID NO: 273465 - DNA, 20 bp, Artificial Sequence
  chemically synthesized
ctgctggtaggaatgtaaac

SEQ ID NO: 273466 - DNA, 20 bp, Artificial Sequence
  chemically synthesized
gttttccatagtggttgtac

SEQ ID NO: 273467 - DNA, 20 bp, Artificial Sequence
  chemically synthesized
gtaaactagtacaaccacta

SEQ ID NO: 273468 - DNA, 20 bp, Artificial Sequence
  chemically synthesized
tcaaaacttgttttccatag

SEQ ID NO: 273469 - DNA, 20 bp, Artificial Sequence
  chemically synthesized
atctcaaaacttgttttcca

SEQ ID NO: 273470 - DNA, 20 bp, Artificial Sequence
  chemically synthesized
gtacaaccactatggaaaac

SEQ ID NO: 273471 - DNA, 20 bp, Artificial Sequence
  chemically synthesized
cactatggaaaacaagtttt

SEQ ID NO: 273472 - DNA, 20 bp, Artificial Sequence
  chemically synthesized
gctctgtttacagttttttg

SEQ ID NO: 273473 - DNA, 20 bp, Artificial Sequence
  chemically synthesized
agctctgtttacagtttttt

SEQ ID NO: 273474 - DNA, 20 bp, Artificial Sequence
  chemically synthesized
attcctcaaaaaactgtaaa

SEQ ID NO: 273475 - DNA, 20 bp, Artificial Sequence
  chemically synthesized
tcctcaaaaaactgtaaaca

SEQ ID NO: 273476 - DNA, 20 bp, Artificial Sequence
  chemically synthesized
ttgtatggtagctctgttta

SEQ ID NO: 273477 - DNA, 20 bp, Artificial Sequence
  chemically synthesized
gggattgctggattgtatgg

SEQ ID NO: 273478 - DNA, 20 bp, Artificial Sequence
  chemically synthesized
aacagagctaccatacaatc

SEQ ID NO: 273479 - DNA, 20 bp, Artificial Sequence
  chemically synthesized
agtgggattgctggattgta

SEQ ID NO: 273480 - DNA, 20 bp, Artificial Sequence
  chemically synthesized
atacacagcagtgggattgc

SEQ ID NO: 273481 - DNA, 20 bp, Artificial Sequence
  chemically synthesized
ttgggtatatacacagcagt

SEQ ID NO: 273482 - DNA, 20 bp, Artificial Sequence
  chemically synthesized
tttgggtatatacacagcag

SEQ ID NO: 273483 - DNA, 20 bp, Artificial Sequence
  chemically synthesized
tcttttgggtatatacacag

SEQ ID NO: 273484 - DNA, 20 bp, Artificial Sequence
  chemically synthesized
ctttcttttgggtatataca

SEQ ID NO: 273485 - DNA, 20 bp, Artificial Sequence
  chemically synthesized
actgctgtgtatatacccaa

SEQ ID NO: 273486 - DNA, 20 bp, Artificial Sequence
  chemically synthesized
ctgtgtatatacccaaaaga

SEQ ID NO: 273487 - DNA, 20 bp, Artificial Sequence
  chemically synthesized
gtactgattttctttctttt

SEQ ID NO: 273488 - DNA, 20 bp, Artificial Sequence
  chemically synthesized
tgtactgattttctttcttt

SEQ ID NO: 273489 - DNA, 20 bp, Artificial Sequence
  chemically synthesized
atacccaaaagaaagaaaat

SEQ ID NO: 273490 - DNA, 20 bp, Artificial Sequence
  chemically synthesized
gaaagaaaatcagtacactg

SEQ ID NO: 273491 - DNA, 20 bp, Artificial Sequence
  chemically synthesized
cgggagtacagatatttctt

SEQ ID NO: 273492 - DNA, 20 bp, Artificial Sequence
  chemically synthesized
cgcaataaaacacgggagta

SEQ ID NO: 273493 - DNA, 20 bp, Artificial Sequence
  chemically synthesized
agtgccgcaataaaacacgg

SEQ ID NO: 273494 - DNA, 20 bp, Artificial Sequence
  chemically synthesized
acagtgccgcaataaaacac

SEQ ID NO: 273495 - DNA, 20 bp, Artificial Sequence
  chemically synthesized
aacagtgccgcaataaaaca

SEQ ID NO: 273496 - DNA, 20 bp, Artificial Sequence
  chemically synthesized
tgtactcccgtgttttattg

SEQ ID NO: 273497 - DNA, 20 bp, Artificial Sequence
  chemically synthesized
tattgcggcactgttcacaa

SEQ ID NO: 273498 - DNA, 20 bp, Artificial Sequence
  chemically synthesized
caaatcttgacttttgtgaa

SEQ ID NO: 273499 - DNA, 20 bp, Artificial Sequence
  chemically synthesized
cggcactgttcacaaaagtc

SEQ ID NO: 273500 - DNA, 20 bp, Artificial Sequence
  chemically synthesized
tgttcacaaaagtcaagatt

SEQ ID NO: 273501 - DNA, 20 bp, Artificial Sequence
  chemically synthesized
tcacaaaagtcaagatttgg

SEQ ID NO: 273502 - DNA, 20 bp, Artificial Sequence
  chemically synthesized
tcgttttttaatggacattt

SEQ ID NO: 273503 - DNA, 20 bp, Artificial Sequence
  chemically synthesized
ttcgttttttaatggacatt

SEQ ID NO: 273504 - DNA, 20 bp, Artificial Sequence
  chemically synthesized
tttatccattcgttttttaa

SEQ ID NO: 273505 - DNA, 20 bp, Artificial Sequence
  chemically synthesized
aatgtccattaaaaaacgaa

SEQ ID NO: 273506 - DNA, 20 bp, Artificial Sequence
  chemically synthesized
cattaaaaaacgaatggata

SEQ ID NO: 273507 - DNA, 20 bp, Artificial Sequence
  chemically synthesized
acgaatggataaagaaaata

SEQ ID NO: 273508 - DNA, 20 bp, Artificial Sequence
  chemically synthesized
ataaagaaaatatggttttc

SEQ ID NO: 273509 - DNA, 20 bp, Artificial Sequence
  chemically synthesized
agatgacatgattgtatatc

SEQ ID NO: 273510 - DNA, 20 bp, Artificial Sequence
  chemically synthesized
acaatcatgtcatctgcaaa

SEQ ID NO: 273511 - DNA, 20 bp, Artificial Sequence
  chemically synthesized
caatcatgtcatctgcaaac

SEQ ID NO: 273512 - DNA, 20 bp, Artificial Sequence
  chemically synthesized
aatcatgtcatctgcaaaca

SEQ ID NO: 273513 - DNA, 20 bp, Artificial Sequence
  chemically synthesized
agtcaaattgtccctgtttg

SEQ ID NO: 273514 - DNA, 20 bp, Artificial Sequence
  chemically synthesized
tgttcaatcaggaaaagagg

SEQ ID NO: 273515 - DNA, 20 bp, Artificial Sequence
  chemically synthesized
gggtgttcaatcaggaaaag

SEQ ID NO: 273516 - DNA, 20 bp, Artificial Sequence
  chemically synthesized
agggtgttcaatcaggaaaa

SEQ ID NO: 273517 - DNA, 20 bp, Artificial Sequence
  chemically synthesized
aaagggtgttcaatcaggaa

SEQ ID NO: 273518 - DNA, 20 bp, Artificial Sequence
  chemically synthesized
gaaataaagggtgttcaatc

SEQ ID NO: 273519 - DNA, 20 bp, Artificial Sequence
  chemically synthesized
ggaaataaagggtgttcaat

SEQ ID NO: 273520 - DNA, 20 bp, Artificial Sequence
  chemically synthesized
aggcaggagaaggaaataaa

SEQ ID NO: 273521 - DNA, 20 bp, Artificial Sequence
  chemically synthesized
taggcaggagaaggaaataa

SEQ ID NO: 273522 - DNA, 20 bp, Artificial Sequence
  chemically synthesized
ttaggcaggagaaggaaata

SEQ ID NO: 273523 - DNA, 20 bp, Artificial Sequence
  chemically synthesized
cagggcaattaggcaggaga

SEQ ID NO: 273524 - DNA, 20 bp, Artificial Sequence
  chemically synthesized
ccagggcaattaggcaggag

SEQ ID NO: 273525 - DNA, 20 bp, Artificial Sequence
  chemically synthesized
tggccagggcaattaggcag

SEQ ID NO: 273526 - DNA, 20 bp, Artificial Sequence
  chemically synthesized
tctggccagggcaattaggc

SEQ ID NO: 273527 - DNA, 20 bp, Artificial Sequence
  chemically synthesized
ttctggccagggcaattagg

SEQ ID NO: 273528 - DNA, 20 bp, Artificial Sequence
  chemically synthesized
aagttctggccagggcaatt

SEQ ID NO: 273529 - DNA, 20 bp, Artificial Sequence
  chemically synthesized
cttctcctgcctaattgccc

SEQ ID NO: 273530 - DNA, 20 bp, Artificial Sequence
  chemically synthesized
gaagttctggccagggcaat

SEQ ID NO: 273531 - DNA, 20 bp, Artificial Sequence
  chemically synthesized
tcctgcctaattgccctggc

SEQ ID NO: 273532 - DNA, 20 bp, Artificial Sequence
  chemically synthesized
agtgttggaagttctggcca

SEQ ID NO: 273533 - DNA, 20 bp, Artificial Sequence
  chemically synthesized
tagtgttggaagttctggcc

SEQ ID NO: 273534 - DNA, 20 bp, Artificial Sequence
  chemically synthesized
atagtgttggaagttctggc

SEQ ID NO: 273535 - DNA, 20 bp, Artificial Sequence
  chemically synthesized
caacatagtgttggaagttc

SEQ ID NO: 273536 - DNA, 20 bp, Artificial Sequence
  chemically synthesized
cctattcaacatagtgttgg

SEQ ID NO: 273537 - DNA, 20 bp, Artificial Sequence
  chemically synthesized
actcctattcaacatagtgt

SEQ ID NO: 273538 - DNA, 20 bp, Artificial Sequence
  chemically synthesized
acttccaacactatgttgaa

SEQ ID NO: 273539 - DNA, 20 bp, Artificial Sequence
  chemically synthesized
ctcaccactcctattcaaca

SEQ ID NO: 273540 - DNA, 20 bp, Artificial Sequence
  chemically synthesized
cttccaacactatgttgaat

SEQ ID NO: 273541 - DNA, 20 bp, Artificial Sequence
  chemically synthesized
tccaacactatgttgaatag

SEQ ID NO: 273542 - DNA, 20 bp, Artificial Sequence
  chemically synthesized
aacactatgttgaataggag

SEQ ID NO: 273543 - DNA, 20 bp, Artificial Sequence
  chemically synthesized
ctatgttgaataggagtggt

SEQ ID NO: 273544 - DNA, 20 bp, Artificial Sequence
  chemically synthesized
atgttgaataggagtggtga

SEQ ID NO: 273545 - DNA, 20 bp, Artificial Sequence
  chemically synthesized
gttgaataggagtggtgaga

SEQ ID NO: 273546 - DNA, 20 bp, Artificial Sequence
  chemically synthesized
ttgaataggagtggtgagag

SEQ ID NO: 273547 - DNA, 20 bp, Artificial Sequence
  chemically synthesized
tgaataggagtggtgagaga

SEQ ID NO: 273548 - DNA, 20 bp, Artificial Sequence
  chemically synthesized
ttgaaaactggcacaagaca

SEQ ID NO: 273549 - DNA, 20 bp, Artificial Sequence
  chemically synthesized
tttgaaaactggcacaagac

SEQ ID NO: 273550 - DNA, 20 bp, Artificial Sequence
  chemically synthesized
ctttgaaaactggcacaaga

SEQ ID NO: 273551 - DNA, 20 bp, Artificial Sequence
  chemically synthesized
agggcatccctgtcttgtgc

SEQ ID NO: 273552 - DNA, 20 bp, Artificial Sequence
  chemically synthesized
ttccctttgaaaactggcac

SEQ ID NO: 273553 - DNA, 20 bp, Artificial Sequence
  chemically synthesized
ctgtcttgtgccagttttca

SEQ ID NO: 273554 - DNA, 20 bp, Artificial Sequence
  chemically synthesized
gaagcattccctttgaaaac

SEQ ID NO: 273555 - DNA, 20 bp, Artificial Sequence
  chemically synthesized
tgtcttgtgccagttttcaa

SEQ ID NO: 273556 - DNA, 20 bp, Artificial Sequence
  chemically synthesized
gtcttgtgccagttttcaaa

SEQ ID NO: 273557 - DNA, 20 bp, Artificial Sequence
  chemically synthesized
gttttcaaagggaatgcttc

SEQ ID NO: 273558 - DNA, 20 bp, Artificial Sequence
  chemically synthesized
actgaatgggcaaaaaccgg

SEQ ID NO: 273559 - DNA, 20 bp, Artificial Sequence
  chemically synthesized
catactgaatgggcaaaaac

SEQ ID NO: 273560 - DNA, 20 bp, Artificial Sequence
  chemically synthesized
gcttccggtttttgcccatt

SEQ ID NO: 273561 - DNA, 20 bp, Artificial Sequence
  chemically synthesized
cagccaatatcatactgaat

SEQ ID NO: 273562 - DNA, 20 bp, Artificial Sequence
  chemically synthesized
acagccaatatcatactgaa

SEQ ID NO: 273563 - DNA, 20 bp, Artificial Sequence
  chemically synthesized
ttgcccattcagtatgatat

SEQ ID NO: 273564 - DNA, 20 bp, Artificial Sequence
  chemically synthesized
attcagtatgatattggctg

SEQ ID NO: 273565 - DNA, 20 bp, Artificial Sequence
  chemically synthesized
ttcagtatgatattggctgt

SEQ ID NO: 273566 - DNA, 20 bp, Artificial Sequence
  chemically synthesized
agctatctatgacaaaccca

SEQ ID NO: 273567 - DNA, 20 bp, Artificial Sequence
  chemically synthesized
tattggctgtgggtttgtca

SEQ ID NO: 273568 - DNA, 20 bp, Artificial Sequence
  chemically synthesized
ggctgtgggtttgtcataga

SEQ ID NO: 273569 - DNA, 20 bp, Artificial Sequence
  chemically synthesized
gacgtatttcaaaataataa

SEQ ID NO: 273570 - DNA, 20 bp, Artificial Sequence
  chemically synthesized
gggacgtatttcaaaataat

SEQ ID NO: 273571 - DNA, 20 bp, Artificial Sequence
  chemically synthesized
tcaataaattaggtattgat

SEQ ID NO: 273572 - DNA, 20 bp, Artificial Sequence
  chemically synthesized
ctcaataaattaggtattga

SEQ ID NO: 273573 - DNA, 20 bp, Artificial Sequence
  chemically synthesized
ctaaaaattctcaataaatt

SEQ ID NO: 273574 - DNA, 20 bp, Artificial Sequence
  chemically synthesized
ccatcaatacctaatttatt

SEQ ID NO: 273575 - DNA, 20 bp, Artificial Sequence
  chemically synthesized
gctaaaaattctcaataaat

SEQ ID NO: 273576 - DNA, 20 bp, Artificial Sequence
  chemically synthesized
cctaatttattgagaatttt

SEQ ID NO: 273577 - DNA, 20 bp, Artificial Sequence
  chemically synthesized
tattgagaatttttagcatg

SEQ ID NO: 273578 - DNA, 20 bp, Artificial Sequence
  chemically synthesized
agcgttgttgaattttgtca

SEQ ID NO: 273579 - DNA, 20 bp, Artificial Sequence
  chemically synthesized
gcgttgttgaattttgtcaa

SEQ ID NO: 273580 - DNA, 20 bp, Artificial Sequence
  chemically synthesized
tatctcaatagatgcagaaa

SEQ ID NO: 273581 - DNA, 20 bp, Artificial Sequence
  chemically synthesized
catgattatctcaatagatg

SEQ ID NO: 273582 - DNA, 20 bp, Artificial Sequence
  chemically synthesized
aggctttttctgcatctatt

SEQ ID NO: 273583 - DNA, 20 bp, Artificial Sequence
  chemically synthesized
aaaccacatgattatctcaa

SEQ ID NO: 273584 - DNA, 20 bp, Artificial Sequence
  chemically synthesized
catctattgagataatcatg

SEQ ID NO: 273585 - DNA, 20 bp, Artificial Sequence
  chemically synthesized
aatcatgtggtttttgtctt

SEQ ID NO: 273586 - DNA, 20 bp, Artificial Sequence
  chemically synthesized
ccagcatctaaacagagcca

SEQ ID NO: 273587 - DNA, 20 bp, Artificial Sequence
  chemically synthesized
tttttgtctttggctctgtt

SEQ ID NO: 273588 - DNA, 20 bp, Artificial Sequence
  chemically synthesized
tgtaatccagcatctaaaca

SEQ ID NO: 273589 - DNA, 20 bp, Artificial Sequence
  chemically synthesized
aatgtaatccagcatctaaa

SEQ ID NO: 273590 - DNA, 20 bp, Artificial Sequence
  chemically synthesized
ctttggctctgtttagatgc

SEQ ID NO: 273591 - DNA, 20 bp, Artificial Sequence
  chemically synthesized
gcaaatcaataaatgtaatc

SEQ ID NO: 273592 - DNA, 20 bp, Artificial Sequence
  chemically synthesized
ttgatttgcatatattgaac

SEQ ID NO: 273593 - DNA, 20 bp, Artificial Sequence
  chemically synthesized
tcatccttgggatgcaaggc

SEQ ID NO: 273594 - DNA, 20 bp, Artificial Sequence
  chemically synthesized
ggcttcatccttgggatgca

SEQ ID NO: 273595 - DNA, 20 bp, Artificial Sequence
  chemically synthesized
ttgaaccagccttgcatccc

SEQ ID NO: 273596 - DNA, 20 bp, Artificial Sequence
  chemically synthesized
gggcttcatccttgggatgc

SEQ ID NO: 273597 - DNA, 20 bp, Artificial Sequence
  chemically synthesized
tgaaccagccttgcatccca

SEQ ID NO: 273598 - DNA, 20 bp, Artificial Sequence
  chemically synthesized
agccttgcatcccaaggatg

SEQ ID NO: 273599 - DNA, 20 bp, Artificial Sequence
  chemically synthesized
atcaagtgggcttcatcctt

SEQ ID NO: 273600 - DNA, 20 bp, Artificial Sequence
  chemically synthesized
gatcaagtgggcttcatcct

SEQ ID NO: 273601 - DNA, 20 bp, Artificial Sequence
  chemically synthesized
cttatccaccatgatcaagt

SEQ ID NO: 273602 - DNA, 20 bp, Artificial Sequence
  chemically synthesized
gcttatccaccatgatcaag

SEQ ID NO: 273603 - DNA, 20 bp, Artificial Sequence
  chemically synthesized
ggatgaagcccacttgatca

SEQ ID NO: 273604 - DNA, 20 bp, Artificial Sequence
  chemically synthesized
aaagcttatccaccatgatc

SEQ ID NO: 273605 - DNA, 20 bp, Artificial Sequence
  chemically synthesized
tgaagcccacttgatcatgg

SEQ ID NO: 273606 - DNA, 20 bp, Artificial Sequence
  chemically synthesized
cccacttgatcatggtggat

SEQ ID NO: 273607 - DNA, 20 bp, Artificial Sequence
  chemically synthesized
gaatccagcagcacatcaaa

SEQ ID NO: 273608 - DNA, 20 bp, Artificial Sequence
  chemically synthesized
taagctttttgatgtgctgc

SEQ ID NO: 273609 - DNA, 20 bp, Artificial Sequence
  chemically synthesized
tacttgcaaaacgaatccag

SEQ ID NO: 273610 - DNA, 20 bp, Artificial Sequence
  chemically synthesized
aaatacttgcaaaacgaatc

SEQ ID NO: 273611 - DNA, 20 bp, Artificial Sequence
  chemically synthesized
tgctgctggattcgttttgc

SEQ ID NO: 273612 - DNA, 20 bp, Artificial Sequence
  chemically synthesized
cgttttgcaagtattttatt

SEQ ID NO: 273613 - DNA, 20 bp, Artificial Sequence
  chemically synthesized
gttttgcaagtattttattg

SEQ ID NO: 273614 - DNA, 20 bp, Artificial Sequence
  chemically synthesized
ttttttcatcaatgttcatc

SEQ ID NO: 273615 - DNA, 20 bp, Artificial Sequence
  chemically synthesized
tttttcatcaatgttcatca

SEQ ID NO: 273616 - DNA, 20 bp, Artificial Sequence
  chemically synthesized
tcaatgttcatcaaggataa

SEQ ID NO: 273617 - DNA, 20 bp, Artificial Sequence
  chemically synthesized
acaaccaaaaaagagaattt

SEQ ID NO: 273618 - DNA, 20 bp, Artificial Sequence
  chemically synthesized
tggtctaaaattctcttttt

SEQ ID NO: 273619 - DNA, 20 bp, Artificial Sequence
  chemically synthesized
gcagagacacaaccaaaaaa

SEQ ID NO: 273620 - DNA, 20 bp, Artificial Sequence
  chemically synthesized
gggcagagacacaaccaaaa

SEQ ID NO: 273621 - DNA, 20 bp, Artificial Sequence
  chemically synthesized
tttttggttgtgtctctgcc

SEQ ID NO: 273622 - DNA, 20 bp, Artificial Sequence
  chemically synthesized
tctgataccaaagccgggca

SEQ ID NO: 273623 - DNA, 20 bp, Artificial Sequence
  chemically synthesized
attctgataccaaagccggg

SEQ ID NO: 273624 - DNA, 20 bp, Artificial Sequence
  chemically synthesized
gttgtgtctctgcccggctt

SEQ ID NO: 273625 - DNA, 20 bp, Artificial Sequence
  chemically synthesized
atcattctgataccaaagcc

SEQ ID NO: 273626 - DNA, 20 bp, Artificial Sequence
  chemically synthesized
catcattctgataccaaagc

SEQ ID NO: 273627 - DNA, 20 bp, Artificial Sequence
  chemically synthesized
tctctgcccggctttggtat

SEQ ID NO: 273628 - DNA, 20 bp, Artificial Sequence
  chemically synthesized
ccagcatcattctgatacca

SEQ ID NO: 273629 - DNA, 20 bp, Artificial Sequence
  chemically synthesized
ctttggtatcagaatgatgc

SEQ ID NO: 273630 - DNA, 20 bp, Artificial Sequence
  chemically synthesized
cctaactcattttatgaggc

SEQ ID NO: 273631 - DNA, 20 bp, Artificial Sequence
  chemically synthesized
cctccctaactcattttatg

SEQ ID NO: 273632 - DNA, 20 bp, Artificial Sequence
  chemically synthesized
tgatgctggcctcataaaat

SEQ ID NO: 273633 - DNA, 20 bp, Artificial Sequence
  chemically synthesized
tcctccctaactcattttat

SEQ ID NO: 273634 - DNA, 20 bp, Artificial Sequence
  chemically synthesized
gctggcctcataaaatgagt

SEQ ID NO: 273635 - DNA, 20 bp, Artificial Sequence
  chemically synthesized
ctggcctcataaaatgagtt

SEQ ID NO: 273636 - DNA, 20 bp, Artificial Sequence
  chemically synthesized
tggcctcataaaatgagtta

SEQ ID NO: 273637 - DNA, 20 bp, Artificial Sequence
  chemically synthesized
gcctcataaaatgagttagg

SEQ ID NO: 273638 - DNA, 20 bp, Artificial Sequence
  chemically synthesized
cctcataaaatgagttaggg

SEQ ID NO: 273639 - DNA, 20 bp, Artificial Sequence
  chemically synthesized
ttccaatccatagaaaaaga

SEQ ID NO: 273640 - DNA, 20 bp, Artificial Sequence
  chemically synthesized
attccaatccatagaaaaag

SEQ ID NO: 273641 - DNA, 20 bp, Artificial Sequence
  chemically synthesized
tattccaatccatagaaaaa

SEQ ID NO: 273642 - DNA, 20 bp, Artificial Sequence
  chemically synthesized
gaggattccctctttttcta

SEQ ID NO: 273643 - DNA, 20 bp, Artificial Sequence
  chemically synthesized
actattccaatccatagaaa

SEQ ID NO: 273644 - DNA, 20 bp, Artificial Sequence
  chemically synthesized
ttccctctttttctatggat

SEQ ID NO: 273645 - DNA, 20 bp, Artificial Sequence
  chemically synthesized
tctgaaactattccaatcca

SEQ ID NO: 273646 - DNA, 20 bp, Artificial Sequence
  chemically synthesized
tctttttctatggattggaa

SEQ ID NO: 273647 - DNA, 20 bp, Artificial Sequence
  chemically synthesized
tctatggattggaatagttt

SEQ ID NO: 273648 - DNA, 20 bp, Artificial Sequence
  chemically synthesized
atggattggaatagtttcag

SEQ ID NO: 273649 - DNA, 20 bp, Artificial Sequence
  chemically synthesized
tggattggaatagtttcaga

SEQ ID NO: 273650 - DNA, 20 bp, Artificial Sequence
  chemically synthesized
tggaatagtttcagaaggaa

SEQ ID NO: 273651 - DNA, 20 bp, Artificial Sequence
  chemically synthesized
agtttcagaaggaatggtat

SEQ ID NO: 273652 - DNA, 20 bp, Artificial Sequence
  chemically synthesized
ttggctgcagaggtacaagg

SEQ ID NO: 273653 - DNA, 20 bp, Artificial Sequence
  chemically synthesized
tttggctgcagaggtacaag

SEQ ID NO: 273654 - DNA, 20 bp, Artificial Sequence
  chemically synthesized
tttttggctgcagaggtaca

SEQ ID NO: 273655 - DNA, 20 bp, Artificial Sequence
  chemically synthesized
ttttttggctgcagaggtac

SEQ ID NO: 273656 - DNA, 20 bp, Artificial Sequence
  chemically synthesized
agttcctccttgtacctctg

SEQ ID NO: 273657 - DNA, 20 bp, Artificial Sequence
  chemically synthesized
catgtgttttttggctgcag

SEQ ID NO: 273658 - DNA, 20 bp, Artificial Sequence
  chemically synthesized
tcatgtgttttttggctgca

SEQ ID NO: 273659 - DNA, 20 bp, Artificial Sequence
  chemically synthesized
tttcatgtgttttttggctg

SEQ ID NO: 273660 - DNA, 20 bp, Artificial Sequence
  chemically synthesized
gcattttttcatgtgttttt

SEQ ID NO: 273661 - DNA, 20 bp, Artificial Sequence
  chemically synthesized
ctctgatggccagtgatgat

SEQ ID NO: 273662 - DNA, 20 bp, Artificial Sequence
  chemically synthesized
gaaaaaatgctcatcatcac

SEQ ID NO: 273663 - DNA, 20 bp, Artificial Sequence
  chemically synthesized
tgctcatcatcactggccat

SEQ ID NO: 273664 - DNA, 20 bp, Artificial Sequence
  chemically synthesized
ctcatcatcactggccatca

SEQ ID NO: 273665 - DNA, 20 bp, Artificial Sequence
  chemically synthesized
atttgcatttctctgatggc

SEQ ID NO: 273666 - DNA, 20 bp, Artificial Sequence
  chemically synthesized
tttgatttgcatttctctga

SEQ ID NO: 273667 - DNA, 20 bp, Artificial Sequence
  chemically synthesized
atgcaaatcaaaaccacaat

SEQ ID NO: 273668 - DNA, 20 bp, Artificial Sequence
  chemically synthesized
tgtgagatggtatctcattg

SEQ ID NO: 273669 - DNA, 20 bp, Artificial Sequence
  chemically synthesized
ccattctaactggtgtgaga

SEQ ID NO: 273670 - DNA, 20 bp, Artificial Sequence
  chemically synthesized
aatgagataccatctcacac

SEQ ID NO: 273671 - DNA, 20 bp, Artificial Sequence
  chemically synthesized
attgccattctaactggtgt

SEQ ID NO: 273672 - DNA, 20 bp, Artificial Sequence
  chemically synthesized
agataccatctcacaccagt

SEQ ID NO: 273673 - DNA, 20 bp, Artificial Sequence
  chemically synthesized
ccatctcacaccagttagaa

SEQ ID NO: 273674 - DNA, 20 bp, Artificial Sequence
  chemically synthesized
tgaatgattgccattctaac

SEQ ID NO: 273675 - DNA, 20 bp, Artificial Sequence
  chemically synthesized
ttagaatggcaatcattcaa

SEQ ID NO: 273676 - DNA, 20 bp, Artificial Sequence
  chemically synthesized
aatggcaatcattcaaaagt

SEQ ID NO: 273677 - DNA, 20 bp, Artificial Sequence
  chemically synthesized
atggcaatcattcaaaagtc

SEQ ID NO: 273678 - DNA, 20 bp, Artificial Sequence
  chemically synthesized
attcaaaagtcaggaaacaa

SEQ ID NO: 273679 - DNA, 20 bp, Artificial Sequence
  chemically synthesized
ttcaaaagtcaggaaacaac

SEQ ID NO: 273680 - DNA, 20 bp, Artificial Sequence
  chemically synthesized
agtcaggaaacaacaggtgc

SEQ ID NO: 273681 - DNA, 20 bp, Artificial Sequence
  chemically synthesized
tcaggaaacaacaggtgctg

SEQ ID NO: 273682 - DNA, 20 bp, Artificial Sequence
  chemically synthesized
aggaaacaacaggtgctgga

SEQ ID NO: 273683 - DNA, 20 bp, Artificial Sequence
  chemically synthesized
ggaaacaacaggtgctggag

SEQ ID NO: 273684 - DNA, 20 bp, Artificial Sequence
  chemically synthesized
ctatttctccacatcctctc

SEQ ID NO: 273685 - DNA, 20 bp, Artificial Sequence
  chemically synthesized
aacaggtgctggagaggatg

SEQ ID NO: 273686 - DNA, 20 bp, Artificial Sequence
  chemically synthesized
caggtgctggagaggatgtg

SEQ ID NO: 273687 - DNA, 20 bp, Artificial Sequence
  chemically synthesized
ctggagaggatgtggagaaa

SEQ ID NO: 273688 - DNA, 20 bp, Artificial Sequence
  chemically synthesized
tggagaggatgtggagaaat

SEQ ID NO: 273689 - DNA, 20 bp, Artificial Sequence
  chemically synthesized
cagtcccaccaacagtgtaa

SEQ ID NO: 273690 - DNA, 20 bp, Artificial Sequence
  chemically synthesized
taggaacacttttacactgt

SEQ ID NO: 273691 - DNA, 20 bp, Artificial Sequence
  chemically synthesized
gaacacttttacactgttgg

SEQ ID NO: 273692 - DNA, 20 bp, Artificial Sequence
  chemically synthesized
aacacttttacactgttggt

SEQ ID NO: 273693 - DNA, 20 bp, Artificial Sequence
  chemically synthesized
ccagtttacagtcccaccaa

SEQ ID NO: 273694 - DNA, 20 bp, Artificial Sequence
  chemically synthesized
ctgttggtgggactgtaaac

SEQ ID NO: 273695 - DNA, 20 bp, Artificial Sequence
  chemically synthesized
acaatggttgaaccagttta

SEQ ID NO: 273696 - DNA, 20 bp, Artificial Sequence
  chemically synthesized
gacttccacaatggttgaac

SEQ ID NO: 273697 - DNA, 20 bp, Artificial Sequence
  chemically synthesized
gtaaactggttcaaccattg

SEQ ID NO: 273698 - DNA, 20 bp, Artificial Sequence
  chemically synthesized
aactggttcaaccattgtgg

SEQ ID NO: 273699 - DNA, 20 bp, Artificial Sequence
  chemically synthesized
cgccacactgacttccacaa

SEQ ID NO: 273700 - DNA, 20 bp, Artificial Sequence
  chemically synthesized
ggttcaaccattgtggaagt

SEQ ID NO: 273701 - DNA, 20 bp, Artificial Sequence
  chemically synthesized
aaccattgtggaagtcagtg

SEQ ID NO: 273702 - DNA, 20 bp, Artificial Sequence
  chemically synthesized
aagtcagtgtggcgattcct

SEQ ID NO: 273703 - DNA, 20 bp, Artificial Sequence
  chemically synthesized
agtcagtgtggcgattcctc

SEQ ID NO: 273704 - DNA, 20 bp, Artificial Sequence
  chemically synthesized
gtcagtgtggcgattcctca

SEQ ID NO: 273705 - DNA, 20 bp, Artificial Sequence
  chemically synthesized
tttctagttctagatccctg

SEQ ID NO: 273706 - DNA, 20 bp, Artificial Sequence
  chemically synthesized
gtggcgattcctcagggatc

SEQ ID NO: 273707 - DNA, 20 bp, Artificial Sequence
  chemically synthesized
atttctagttctagatccct

SEQ ID NO: 273708 - DNA, 20 bp, Artificial Sequence
  chemically synthesized
attcctcagggatctagaac

SEQ ID NO: 273709 - DNA, 20 bp, Artificial Sequence
  chemically synthesized
tcaaatggtatttctagttc

SEQ ID NO: 273710 - DNA, 20 bp, Artificial Sequence
  chemically synthesized
gctgggtcaaatggtatttc

SEQ ID NO: 273711 - DNA, 20 bp, Artificial Sequence
  chemically synthesized
actagaaataccatttgacc

SEQ ID NO: 273712 - DNA, 20 bp, Artificial Sequence
  chemically synthesized
aatgggatggctgggtcaaa

SEQ ID NO: 273713 - DNA, 20 bp, Artificial Sequence
  chemically synthesized
tacccagtaatgggatggct

SEQ ID NO: 273714 - DNA, 20 bp, Artificial Sequence
  chemically synthesized
atacccagtaatgggatggc

SEQ ID NO: 273715 - DNA, 20 bp, Artificial Sequence
  chemically synthesized
gtatatacccagtaatggga

SEQ ID NO: 273716 - DNA, 20 bp, Artificial Sequence
  chemically synthesized
tgacccagccatcccattac

SEQ ID NO: 273717 - DNA, 20 bp, Artificial Sequence
  chemically synthesized
gacccagccatcccattact

SEQ ID NO: 273718 - DNA, 20 bp, Artificial Sequence
  chemically synthesized
ttgggtatatacccagtaat

SEQ ID NO: 273719 - DNA, 20 bp, Artificial Sequence
  chemically synthesized
tttgggtatatacccagtaa

SEQ ID NO: 273720 - DNA, 20 bp, Artificial Sequence
  chemically synthesized
tagtcctttgggtatatacc

SEQ ID NO: 273721 - DNA, 20 bp, Artificial Sequence
  chemically synthesized
cattactgggtatataccca

SEQ ID NO: 273722 - DNA, 20 bp, Artificial Sequence
  chemically synthesized
attactgggtatatacccaa

SEQ ID NO: 273723 - DNA, 20 bp, Artificial Sequence
  chemically synthesized
agcatgatttatagtccttt

SEQ ID NO: 273724 - DNA, 20 bp, Artificial Sequence
  chemically synthesized
cagcatgatttatagtcctt

SEQ ID NO: 273725 - DNA, 20 bp, Artificial Sequence
  chemically synthesized
ctttatagcagcatgattta

SEQ ID NO: 273726 - DNA, 20 bp, Artificial Sequence
  chemically synthesized
ctataaatcatgctgctata

SEQ ID NO: 273727 - DNA, 20 bp, Artificial Sequence
  chemically synthesized
gtgtgcatgtgtctttatag

SEQ ID NO: 273728 - DNA, 20 bp, Artificial Sequence
  chemically synthesized
tacgtgtgcatgtgtcttta

SEQ ID NO: 273729 - DNA, 20 bp, Artificial Sequence
  chemically synthesized
atgcacacgtatgtttattg

SEQ ID NO: 273730 - DNA, 20 bp, Artificial Sequence
  chemically synthesized
tattgcggcactattcacaa

SEQ ID NO: 273731 - DNA, 20 bp, Artificial Sequence
  chemically synthesized
caagtctttgctattgtgaa

SEQ ID NO: 273732 - DNA, 20 bp, Artificial Sequence
  chemically synthesized
cggcactattcacaatagca

SEQ ID NO: 273733 - DNA, 20 bp, Artificial Sequence
  chemically synthesized
tattcacaatagcaaagact

SEQ ID NO: 273734 - DNA, 20 bp, Artificial Sequence
  chemically synthesized
gagacatttgggttggttcc

SEQ ID NO: 273735 - DNA, 20 bp, Artificial Sequence
  chemically synthesized
tcattgtgagacatttgggt

SEQ ID NO: 273736 - DNA, 20 bp, Artificial Sequence
  chemically synthesized
tgtatcattgtgagacattt

SEQ ID NO: 273737 - DNA, 20 bp, Artificial Sequence
  chemically synthesized
ttgtatcattgtgagacatt

SEQ ID NO: 273738 - DNA, 20 bp, Artificial Sequence
  chemically synthesized
taaatccattgtatcattgt

SEQ ID NO: 273739 - DNA, 20 bp, Artificial Sequence
  chemically synthesized
aatgtctcacaatgatacaa

SEQ ID NO: 273740 - DNA, 20 bp, Artificial Sequence
  chemically synthesized
tcacaatgatacaatggatt

SEQ ID NO: 273741 - DNA, 20 bp, Artificial Sequence
  chemically synthesized
tacaatggatttagaaaatg

SEQ ID NO: 273742 - DNA, 20 bp, Artificial Sequence
  chemically synthesized
aatgtggcacatatacacct

SEQ ID NO: 273743 - DNA, 20 bp, Artificial Sequence
  chemically synthesized
tatggctgcatagtattcca

SEQ ID NO: 273744 - DNA, 20 bp, Artificial Sequence
  chemically synthesized
ttatggctgcatagtattcc

SEQ ID NO: 273745 - DNA, 20 bp, Artificial Sequence
  chemically synthesized
atacaccttggaatactatg

SEQ ID NO: 273746 - DNA, 20 bp, Artificial Sequence
  chemically synthesized
catccttttttatggctgca

SEQ ID NO: 273747 - DNA, 20 bp, Artificial Sequence
  chemically synthesized
aatactatgcagccataaaa

SEQ ID NO: 273748 - DNA, 20 bp, Artificial Sequence
  chemically synthesized
atactatgcagccataaaaa

SEQ ID NO: 273749 - DNA, 20 bp, Artificial Sequence
  chemically synthesized
catgaactcatcctttttta

SEQ ID NO: 273750 - DNA, 20 bp, Artificial Sequence
  chemically synthesized
atgcagccataaaaaaggat

SEQ ID NO: 273751 - DNA, 20 bp, Artificial Sequence
  chemically synthesized
ggatgagttcatgtcctttg

SEQ ID NO: 273752 - DNA, 20 bp, Artificial Sequence
  chemically synthesized
gatgagttcatgtcctttgt

SEQ ID NO: 273753 - DNA, 20 bp, Artificial Sequence
  chemically synthesized
atgagttcatgtcctttgta

SEQ ID NO: 273754 - DNA, 20 bp, Artificial Sequence
  chemically synthesized
cttcatccatgtccctacaa

SEQ ID NO: 273755 - DNA, 20 bp, Artificial Sequence
  chemically synthesized
gcttcatccatgtccctaca

SEQ ID NO: 273756 - DNA, 20 bp, Artificial Sequence
  chemically synthesized
tcatgtcctttgtagggaca

SEQ ID NO: 273757 - DNA, 20 bp, Artificial Sequence
  chemically synthesized
cctttgtagggacatggatg

SEQ ID NO: 273758 - DNA, 20 bp, Artificial Sequence
  chemically synthesized
tgtagggacatggatgaagc

SEQ ID NO: 273759 - DNA, 20 bp, Artificial Sequence
  chemically synthesized
ttgctgagaatggtggtttc

SEQ ID NO: 273760 - DNA, 20 bp, Artificial Sequence
  chemically synthesized
aagctggaaaccaccattct

SEQ ID NO: 273761 - DNA, 20 bp, Artificial Sequence
  chemically synthesized
agatagtttgctgagaatgg

SEQ ID NO: 273762 - DNA, 20 bp, Artificial Sequence
  chemically synthesized
ttgagatagtttgctgagaa

SEQ ID NO: 273763 - DNA, 20 bp, Artificial Sequence
  chemically synthesized
tgtccttgagatagtttgct

SEQ ID NO: 273764 - DNA, 20 bp, Artificial Sequence
  chemically synthesized
cattctcagcaaactatctc

SEQ ID NO: 273765 - DNA, 20 bp, Artificial Sequence
  chemically synthesized
attctcagcaaactatctca

SEQ ID NO: 273766 - DNA, 20 bp, Artificial Sequence
  chemically synthesized
ttggttttttgtccttgaga

SEQ ID NO: 273767 - DNA, 20 bp, Artificial Sequence
  chemically synthesized
gtgtttggttttttgtcctt

SEQ ID NO: 273768 - DNA, 20 bp, Artificial Sequence
  chemically synthesized
gagtgagaacatgcagtgtt

SEQ ID NO: 273769 - DNA, 20 bp, Artificial Sequence
  chemically synthesized
cacctatgagtgagaacatg

SEQ ID NO: 273770 - DNA, 20 bp, Artificial Sequence
  chemically synthesized
acactgcatgttctcactca

SEQ ID NO: 273771 - DNA, 20 bp, Artificial Sequence
  chemically synthesized
cactgcatgttctcactcat

SEQ ID NO: 273772 - DNA, 20 bp, Artificial Sequence
  chemically synthesized
ttcaattcccacctatgagt

SEQ ID NO: 273773 - DNA, 20 bp, Artificial Sequence
  chemically synthesized
tgcatgttctcactcatagg

SEQ ID NO: 273774 - DNA, 20 bp, Artificial Sequence
  chemically synthesized
gcatgttctcactcataggt

SEQ ID NO: 273775 - DNA, 20 bp, Artificial Sequence
  chemically synthesized
attgttcaattcccacctat

SEQ ID NO: 273776 - DNA, 20 bp, Artificial Sequence
  chemically synthesized
ataggtgggaattgaacaat

SEQ ID NO: 273777 - DNA, 20 bp, Artificial Sequence
  chemically synthesized
aggtgggaattgaacaatga

SEQ ID NO: 273778 - DNA, 20 bp, Artificial Sequence
  chemically synthesized
aattgaacaatgagagcaca

SEQ ID NO: 273779 - DNA, 20 bp, Artificial Sequence
  chemically synthesized
acaatgagagcacatggaca

SEQ ID NO: 273780 - DNA, 20 bp, Artificial Sequence
  chemically synthesized
caatgagagcacatggacac

SEQ ID NO: 273781 - DNA, 20 bp, Artificial Sequence
  chemically synthesized
tgagagcacatggacacagg

SEQ ID NO: 273782 - DNA, 20 bp, Artificial Sequence
  chemically synthesized
gagagcacatggacacagga

SEQ ID NO: 273783 - DNA, 20 bp, Artificial Sequence
  chemically synthesized
agagcacatggacacaggaa

SEQ ID NO: 273784 - DNA, 20 bp, Artificial Sequence
  chemically synthesized
gagcacatggacacaggaag

SEQ ID NO: 273785 - DNA, 20 bp, Artificial Sequence
  chemically synthesized
ggaaggggaacatcacacac

SEQ ID NO: 273786 - DNA, 20 bp, Artificial Sequence
  chemically synthesized
gaaggggaacatcacacacc

SEQ ID NO: 273787 - DNA, 20 bp, Artificial Sequence
  chemically synthesized
aaggggaacatcacacaccg

SEQ ID NO: 273788 - DNA, 20 bp, Artificial Sequence
  chemically synthesized
ccccaccccacaacagtccc

SEQ ID NO: 273789 - DNA, 20 bp, Artificial Sequence
  chemically synthesized
tcacacaccggggactgttg

SEQ ID NO: 273790 - DNA, 20 bp, Artificial Sequence
  chemically synthesized
cacacaccggggactgttgt

SEQ ID NO: 273791 - DNA, 20 bp, Artificial Sequence
  chemically synthesized
acacaccggggactgttgtg

SEQ ID NO: 273792 - DNA, 20 bp, Artificial Sequence
  chemically synthesized
cccctccccccaccccacaa

SEQ ID NO: 273793 - DNA, 20 bp, Artificial Sequence
  chemically synthesized
caccggggactgttgtgggg

SEQ ID NO: 273794 - DNA, 20 bp, Artificial Sequence
  chemically synthesized
accggggactgttgtggggt

SEQ ID NO: 273795 - DNA, 20 bp, Artificial Sequence
  chemically synthesized
ccggggactgttgtggggtg

SEQ ID NO: 273796 - DNA, 20 bp, Artificial Sequence
  chemically synthesized
cggggactgttgtggggtgg

SEQ ID NO: 273797 - DNA, 20 bp, Artificial Sequence
  chemically synthesized
ggggactgttgtggggtggg

SEQ ID NO: 273798 - DNA, 20 bp, Artificial Sequence
  chemically synthesized
ggactgttgtggggtggggg

SEQ ID NO: 273799 - DNA, 20 bp, Artificial Sequence
  chemically synthesized
gactgttgtggggtgggggg

SEQ ID NO: 273800 - DNA, 20 bp, Artificial Sequence
  chemically synthesized
actgttgtggggtgggggga

SEQ ID NO: 273801 - DNA, 20 bp, Artificial Sequence
  chemically synthesized
ctgttgtggggtggggggag

SEQ ID NO: 273802 - DNA, 20 bp, Artificial Sequence
  chemically synthesized
tgttgtggggtggggggagg

SEQ ID NO: 273803 - DNA, 20 bp, Artificial Sequence
  chemically synthesized
gttgtggggtggggggaggg

SEQ ID NO: 273804 - DNA, 20 bp, Artificial Sequence
  chemically synthesized
tgtggggtggggggaggggg

SEQ ID NO: 273805 - DNA, 20 bp, Artificial Sequence
  chemically synthesized
gtggggtggggggagggggg

SEQ ID NO: 273806 - DNA, 20 bp, Artificial Sequence
  chemically synthesized
tggggtggggggagggggga

SEQ ID NO: 273807 - DNA, 20 bp, Artificial Sequence
  chemically synthesized
gtggggggaggggggaggga

SEQ ID NO: 273808 - DNA, 20 bp, Artificial Sequence
  chemically synthesized
ggaggggggagggatagcat

SEQ ID NO: 273809 - DNA, 20 bp, Artificial Sequence
  chemically synthesized
gaggggggagggatagcatt

SEQ ID NO: 273810 - DNA, 20 bp, Artificial Sequence
  chemically synthesized
ggggggagggatagcattgg

SEQ ID NO: 273811 - DNA, 20 bp, Artificial Sequence
  chemically synthesized
ttgggagatatacctaatgc

SEQ ID NO: 273812 - DNA, 20 bp, Artificial Sequence
  chemically synthesized
ctaactcgtcatctagcatt

SEQ ID NO: 273813 - DNA, 20 bp, Artificial Sequence
  chemically synthesized
actaactcgtcatctagcat

SEQ ID NO: 273814 - DNA, 20 bp, Artificial Sequence
  chemically synthesized
tatacctaatgctagatgac

SEQ ID NO: 273815 - DNA, 20 bp, Artificial Sequence
  chemically synthesized
gcacccactaactcgtcatc

SEQ ID NO: 273816 - DNA, 20 bp, Artificial Sequence
  chemically synthesized
cctaatgctagatgacgagt

SEQ ID NO: 273817 - DNA, 20 bp, Artificial Sequence
  chemically synthesized
aatgctagatgacgagttag

SEQ ID NO: 273818 - DNA, 20 bp, Artificial Sequence
  chemically synthesized
atgctagatgacgagttagt

SEQ ID NO: 273819 - DNA, 20 bp, Artificial Sequence
  chemically synthesized
agatgacgagttagtgggtg

SEQ ID NO: 273820 - DNA, 20 bp, Artificial Sequence
  chemically synthesized
agttagtgggtgcagcgcac

SEQ ID NO: 273821 - DNA, 20 bp, Artificial Sequence
  chemically synthesized
gtgggtgcagcgcaccagca

SEQ ID NO: 273822 - DNA, 20 bp, Artificial Sequence
  chemically synthesized
tatgtatacatgtgccatgc

SEQ ID NO: 273823 - DNA, 20 bp, Artificial Sequence
  chemically synthesized
catgtgcacattgtgcaggt

SEQ ID NO: 273824 - DNA, 20 bp, Artificial Sequence
  chemically synthesized
ggtacatgtgcacattgtgc

SEQ ID NO: 273825 - DNA, 20 bp, Artificial Sequence
  chemically synthesized
gggtacatgtgcacattgtg

SEQ ID NO: 273826 - DNA, 20 bp, Artificial Sequence
  chemically synthesized
ttattatactttaagtttta

SEQ ID NO: 273827 - DNA, 20 bp, Artificial Sequence
  chemically synthesized
attattatactttaagtttt

SEQ ID NO: 273828 - DNA, 20 bp, Artificial Sequence
  chemically synthesized
cacatgtaccctaaaactta

SEQ ID NO: 273829 - DNA, 20 bp, Artificial Sequence
  chemically synthesized
tattattatactttaagttt

SEQ ID NO: 273830 - DNA, 20 bp, Artificial Sequence
  chemically synthesized
tttttttattattatacttt

SEQ ID NO: 273831 - DNA, 20 bp, Artificial Sequence
  chemically synthesized
taaagtataataataaaaaa

SEQ ID NO: 273832 - DNA, 20 bp, Artificial Sequence
  chemically synthesized
ataataaaaaaaagaaaata

SEQ ID NO: 273833 - DNA, 20 bp, Artificial Sequence
  chemically synthesized
aatagtactgtattgtgtat

SEQ ID NO: 273834 - DNA, 20 bp, Artificial Sequence
  chemically synthesized
gaatagtactgtattgtgta

SEQ ID NO: 273835 - DNA, 20 bp, Artificial Sequence
  chemically synthesized
tatggtacctatacacaata

SEQ ID NO: 273836 - DNA, 20 bp, Artificial Sequence
  chemically synthesized
atacacaatacagtactatt

SEQ ID NO: 273837 - DNA, 20 bp, Artificial Sequence
  chemically synthesized
tcattctttttatggctgaa

SEQ ID NO: 273838 - DNA, 20 bp, Artificial Sequence
  chemically synthesized
cagtactattcagccataaa

SEQ ID NO: 273839 - DNA, 20 bp, Artificial Sequence
  chemically synthesized
acaggacgtcattcttttta

SEQ ID NO: 273840 - DNA, 20 bp, Artificial Sequence
  chemically synthesized
tccatgttattgcaaatgac

SEQ ID NO: 273841 - DNA, 20 bp, Artificial Sequence
  chemically synthesized
atccatgttattgcaaatga

SEQ ID NO: 273842 - DNA, 20 bp, Artificial Sequence
  chemically synthesized
tcctgtcatttgcaataaca

SEQ ID NO: 273843 - DNA, 20 bp, Artificial Sequence
  chemically synthesized
gtcatttgcaataacatgga

SEQ ID NO: 273844 - DNA, 20 bp, Artificial Sequence
  chemically synthesized
gaattgtacgttattacgtt

SEQ ID NO: 273845 - DNA, 20 bp, Artificial Sequence
  chemically synthesized
gttattacgttaagtgaaat

SEQ ID NO: 273846 - DNA, 20 bp, Artificial Sequence
  chemically synthesized
ttacgttaagtgaaataagc

SEQ ID NO: 273847 - DNA, 20 bp, Artificial Sequence
  chemically synthesized
taagtgaaataagccagtca

SEQ ID NO: 273848 - DNA, 20 bp, Artificial Sequence
  chemically synthesized
gatgtttgtctttctgtgac

SEQ ID NO: 273849 - DNA, 20 bp, Artificial Sequence
  chemically synthesized
tgaaataagccagtcacaga

SEQ ID NO: 273850 - DNA, 20 bp, Artificial Sequence
  chemically synthesized
agacaaacatcccatgttct

SEQ ID NO: 273851 - DNA, 20 bp, Artificial Sequence
  chemically synthesized
ccacaaataactgagaacat

SEQ ID NO: 273852 - DNA, 20 bp, Artificial Sequence
  chemically synthesized
cccacaaataactgagaaca

SEQ ID NO: 273853 - DNA, 20 bp, Artificial Sequence
  chemically synthesized
tttagctcccacaaataact

SEQ ID NO: 273854 - DNA, 20 bp, Artificial Sequence
  chemically synthesized
cccatgttctcagttatttg

SEQ ID NO: 273855 - DNA, 20 bp, Artificial Sequence
  chemically synthesized
ccatgttctcagttatttgt

SEQ ID NO: 273856 - DNA, 20 bp, Artificial Sequence
  chemically synthesized
atgttctcagttatttgtgg

SEQ ID NO: 273857 - DNA, 20 bp, Artificial Sequence
  chemically synthesized
atttgtgggagctaaaaatt

SEQ ID NO: 273858 - DNA, 20 bp, Artificial Sequence
  chemically synthesized
agttcaattatcttaatttt

SEQ ID NO: 273859 - DNA, 20 bp, Artificial Sequence
  chemically synthesized
aaattaagataattgaacta

SEQ ID NO: 273860 - DNA, 20 bp, Artificial Sequence
  chemically synthesized
attaagataattgaactatg

SEQ ID NO: 273861 - DNA, 20 bp, Artificial Sequence
  chemically synthesized
agataattgaactatggaga

SEQ ID NO: 273862 - DNA, 20 bp, Artificial Sequence
  chemically synthesized
ccttctactctctatctcca

SEQ ID NO: 273863 - DNA, 20 bp, Artificial Sequence
  chemically synthesized
ataattgaactatggagata

SEQ ID NO: 273864 - DNA, 20 bp, Artificial Sequence
  chemically synthesized
aattgaactatggagataga

SEQ ID NO: 273865 - DNA, 20 bp, Artificial Sequence
  chemically synthesized
tgaactatggagatagagag

SEQ ID NO: 273866 - DNA, 20 bp, Artificial Sequence
  chemically synthesized
actatggagatagagagtag

SEQ ID NO: 273867 - DNA, 20 bp, Artificial Sequence
  chemically synthesized
ctatggagatagagagtaga

SEQ ID NO: 273868 - DNA, 20 bp, Artificial Sequence
  chemically synthesized
gagagtagaaggatccttac

SEQ ID NO: 273869 - DNA, 20 bp, Artificial Sequence
  chemically synthesized
gagtagaaggatccttacta

SEQ ID NO: 273870 - DNA, 20 bp, Artificial Sequence
  chemically synthesized
agtagaaggatccttactag

SEQ ID NO: 273871 - DNA, 20 bp, Artificial Sequence
  chemically synthesized
acccttcccagcctctagta

SEQ ID NO: 273872 - DNA, 20 bp, Artificial Sequence
  chemically synthesized
tacccttcccagcctctagt

SEQ ID NO: 273873 - DNA, 20 bp, Artificial Sequence
  chemically synthesized
gaaggatccttactagaggc

SEQ ID NO: 273874 - DNA, 20 bp, Artificial Sequence
  chemically synthesized
aaggatccttactagaggct

SEQ ID NO: 273875 - DNA, 20 bp, Artificial Sequence
  chemically synthesized
tgactacccttcccagcctc

SEQ ID NO: 273876 - DNA, 20 bp, Artificial Sequence
  chemically synthesized
gatccttactagaggctggg

SEQ ID NO: 273877 - DNA, 20 bp, Artificial Sequence
  chemically synthesized
atccttactagaggctggga

SEQ ID NO: 273878 - DNA, 20 bp, Artificial Sequence
  chemically synthesized
tccttactagaggctgggaa

SEQ ID NO: 273879 - DNA, 20 bp, Artificial Sequence
  chemically synthesized
ttactagaggctgggaaggg

SEQ ID NO: 273880 - DNA, 20 bp, Artificial Sequence
  chemically synthesized
caacccctgactacccttcc

SEQ ID NO: 273881 - DNA, 20 bp, Artificial Sequence
  chemically synthesized
tagaggctgggaagggtagt

SEQ ID NO: 273882 - DNA, 20 bp, Artificial Sequence
  chemically synthesized
agaggctgggaagggtagtc

SEQ ID NO: 273883 - DNA, 20 bp, Artificial Sequence
  chemically synthesized
gaggctgggaagggtagtca

SEQ ID NO: 273884 - DNA, 20 bp, Artificial Sequence
  chemically synthesized
aggctgggaagggtagtcag

SEQ ID NO: 273885 - DNA, 20 bp, Artificial Sequence
  chemically synthesized
tgggaagggtagtcaggggt

SEQ ID NO: 273886 - DNA, 20 bp, Artificial Sequence
  chemically synthesized
gggaagggtagtcaggggtt

SEQ ID NO: 273887 - DNA, 20 bp, Artificial Sequence
  chemically synthesized
ggaagggtagtcaggggttg

SEQ ID NO: 273888 - DNA, 20 bp, Artificial Sequence
  chemically synthesized
aagggtagtcaggggttggg

SEQ ID NO: 273889 - DNA, 20 bp, Artificial Sequence
  chemically synthesized
agggtagtcaggggttgggg

SEQ ID NO: 273890 - DNA, 20 bp, Artificial Sequence
  chemically synthesized
gtagtcaggggttggggagg

SEQ ID NO: 273891 - DNA, 20 bp, Artificial Sequence
  chemically synthesized
gtcaggggttggggaggaag

SEQ ID NO: 273892 - DNA, 20 bp, Artificial Sequence
  chemically synthesized
tcaggggttggggaggaagt

SEQ ID NO: 273893 - DNA, 20 bp, Artificial Sequence
  chemically synthesized
caggggttggggaggaagtg

SEQ ID NO: 273894 - DNA, 20 bp, Artificial Sequence
  chemically synthesized
ggttggggaggaagtgggga

SEQ ID NO: 273895 - DNA, 20 bp, Artificial Sequence
  chemically synthesized
gaggaagtggggatggttaa

SEQ ID NO: 273896 - DNA, 20 bp, Artificial Sequence
  chemically synthesized
aggaagtggggatggttaat

SEQ ID NO: 273897 - DNA, 20 bp, Artificial Sequence
  chemically synthesized
tggttaatgggtacaaaaat

SEQ ID NO: 273898 - DNA, 20 bp, Artificial Sequence
  chemically synthesized
gtacaaaaattagaaataat

SEQ ID NO: 273899 - DNA, 20 bp, Artificial Sequence
  chemically synthesized
aaaaattagaaataatgagc

SEQ ID NO: 273900 - DNA, 20 bp, Artificial Sequence
  chemically synthesized
tagaaataatgagcaagacc

SEQ ID NO: 273901 - DNA, 20 bp, Artificial Sequence
  chemically synthesized
atcctgttctagcaaatact

SEQ ID NO: 273902 - DNA, 20 bp, Artificial Sequence
  chemically synthesized
catcctgttctagcaaatac

SEQ ID NO: 273903 - DNA, 20 bp, Artificial Sequence
  chemically synthesized
gagcaagacctagtatttgc

SEQ ID NO: 273904 - DNA, 20 bp, Artificial Sequence
  chemically synthesized
agacctagtatttgctagaa

SEQ ID NO: 273905 - DNA, 20 bp, Artificial Sequence
  chemically synthesized
gacctagtatttgctagaac

SEQ ID NO: 273906 - DNA, 20 bp, Artificial Sequence
  chemically synthesized
ttattatggtcatcctgttc

SEQ ID NO: 273907 - DNA, 20 bp, Artificial Sequence
  chemically synthesized
ctcaaattacttttttatta

SEQ ID NO: 273908 - DNA, 20 bp, Artificial Sequence
  chemically synthesized
acaggatgaccataataaaa

SEQ ID NO: 273909 - DNA, 20 bp, Artificial Sequence
  chemically synthesized
ccataataaaaaagtaattt

SEQ ID NO: 273910 - DNA, 20 bp, Artificial Sequence
  chemically synthesized
ttttagtttattttaaaatg

SEQ ID NO: 273911 - DNA, 20 bp, Artificial Sequence
  chemically synthesized
tacattttaaaataaactaa

SEQ ID NO: 273912 - DNA, 20 bp, Artificial Sequence
  chemically synthesized
cattttaaaataaactaaaa

SEQ ID NO: 273913 - DNA, 20 bp, Artificial Sequence
  chemically synthesized
aaaattcagttgtactcttt

SEQ ID NO: 273914 - DNA, 20 bp, Artificial Sequence
  chemically synthesized
cctttgtgatataaaaaatt

SEQ ID NO: 273915 - DNA, 20 bp, Artificial Sequence
  chemically synthesized
actgaattttttatatcaca

SEQ ID NO: 273916 - DNA, 20 bp, Artificial Sequence
  chemically synthesized
ctgaattttttatatcacaa

SEQ ID NO: 273917 - DNA, 20 bp, Artificial Sequence
  chemically synthesized
attttttatatcacaaagga

SEQ ID NO: 273918 - DNA, 20 bp, Artificial Sequence
  chemically synthesized
atcacaaaggatagatgctt

SEQ ID NO: 273919 - DNA, 20 bp, Artificial Sequence
  chemically synthesized
tcacaaaggatagatgctta

SEQ ID NO: 273920 - DNA, 20 bp, Artificial Sequence
  chemically synthesized
aggatagatgcttaaggtga

SEQ ID NO: 273921 - DNA, 20 bp, Artificial Sequence
  chemically synthesized
aatggggtgtctatcacctt

SEQ ID NO: 273922 - DNA, 20 bp, Artificial Sequence
  chemically synthesized
caatcaaatcagggtaaatg

SEQ ID NO: 273923 - DNA, 20 bp, Artificial Sequence
  chemically synthesized
gcaatcaaatcagggtaaat

SEQ ID NO: 273924 - DNA, 20 bp, Artificial Sequence
  chemically synthesized
agcaatcaaatcagggtaaa

SEQ ID NO: 273925 - DNA, 20 bp, Artificial Sequence
  chemically synthesized
aatgcgtagcaatcaaatca

SEQ ID NO: 273926 - DNA, 20 bp, Artificial Sequence
  chemically synthesized
caatgcgtagcaatcaaatc

SEQ ID NO: 273927 - DNA, 20 bp, Artificial Sequence
  chemically synthesized
gcaatgcgtagcaatcaaat

SEQ ID NO: 273928 - DNA, 20 bp, Artificial Sequence
  chemically synthesized
tgatacaggcatgcaatgcg

SEQ ID NO: 273929 - DNA, 20 bp, Artificial Sequence
  chemically synthesized
tacatgagatattttgatac

SEQ ID NO: 273930 - DNA, 20 bp, Artificial Sequence
  chemically synthesized
ttacatgagatattttgata

SEQ ID NO: 273931 - DNA, 20 bp, Artificial Sequence
  chemically synthesized
tagatgtataaacgttacat

SEQ ID NO: 273932 - DNA, 20 bp, Artificial Sequence
  chemically synthesized
caatgtttgtaggcacgtag

SEQ ID NO: 273933 - DNA, 20 bp, Artificial Sequence
  chemically synthesized
tttcaatgtttgtaggcacg

SEQ ID NO: 273934 - DNA, 20 bp, Artificial Sequence
  chemically synthesized
tttctattttcaatgtttgt

SEQ ID NO: 273935 - DNA, 20 bp, Artificial Sequence
  chemically synthesized
atttctattttcaatgtttg

SEQ ID NO: 273936 - DNA, 20 bp, Artificial Sequence
  chemically synthesized
gtgcctacaaacattgaaaa

SEQ ID NO: 273937 - DNA, 20 bp, Artificial Sequence
  chemically synthesized
aatagaaataacgtattttc

SEQ ID NO: 273938 - DNA, 20 bp, Artificial Sequence
  chemically synthesized
aacgtattttcaagtaatta

SEQ ID NO: 273939 - DNA, 20 bp, Artificial Sequence
  chemically synthesized
attatggttacttttcaaaa

SEQ ID NO: 273940 - DNA, 20 bp, Artificial Sequence
  chemically synthesized
actcatttatctattttgaa

SEQ ID NO: 273941 - DNA, 20 bp, Artificial Sequence
  chemically synthesized
acttttcaaaatagataaat

SEQ ID NO: 273942 - DNA, 20 bp, Artificial Sequence
  chemically synthesized
taaatgagtaaatcaaactc

SEQ ID NO: 273943 - DNA, 20 bp, Artificial Sequence
  chemically synthesized
aaatgagtaaatcaaactct

SEQ ID NO: 273944 - DNA, 20 bp, Artificial Sequence
  chemically synthesized
aatgagtaaatcaaactcta

SEQ ID NO: 273945 - DNA, 20 bp, Artificial Sequence
  chemically synthesized
gcattccaaaatgttcccta

SEQ ID NO: 273946 - DNA, 20 bp, Artificial Sequence
  chemically synthesized
cagcattccaaaatgttccc

SEQ ID NO: 273947 - DNA, 20 bp, Artificial Sequence
  chemically synthesized
tcaaactctagggaacattt

SEQ ID NO: 273948 - DNA, 20 bp, Artificial Sequence
  chemically synthesized
gaacattttggaatgctgcc

SEQ ID NO: 273949 - DNA, 20 bp, Artificial Sequence
  chemically synthesized
atctcccaattatttctagg

SEQ ID NO: 273950 - DNA, 20 bp, Artificial Sequence
  chemically synthesized
acaatctcccaattatttct

SEQ ID NO: 273951 - DNA, 20 bp, Artificial Sequence
  chemically synthesized
tacaatctcccaattatttc

SEQ ID NO: 273952 - DNA, 20 bp, Artificial Sequence
  chemically synthesized
gaatgctgcctagaaataat

SEQ ID NO: 273953 - DNA, 20 bp, Artificial Sequence
  chemically synthesized
aatgctgcctagaaataatt

SEQ ID NO: 273954 - DNA, 20 bp, Artificial Sequence
  chemically synthesized
tgctgcctagaaataattgg

SEQ ID NO: 273955 - DNA, 20 bp, Artificial Sequence
  chemically synthesized
taattgggagattgtacttc

SEQ ID NO: 273956 - DNA, 20 bp, Artificial Sequence
  chemically synthesized
aattgggagattgtacttct

SEQ ID NO: 273957 - DNA, 20 bp, Artificial Sequence
  chemically synthesized
ttaagtgaaaattaacctag

SEQ ID NO: 273958 - DNA, 20 bp, Artificial Sequence
  chemically synthesized
ttattaagtgaaaattaacc

SEQ ID NO: 273959 - DNA, 20 bp, Artificial Sequence
  chemically synthesized
aggttaattttcacttaata

SEQ ID NO: 273960 - DNA, 20 bp, Artificial Sequence
  chemically synthesized
ggttaattttcacttaataa

SEQ ID NO: 273961 - DNA, 20 bp, Artificial Sequence
  chemically synthesized
gttaattttcacttaataaa

SEQ ID NO: 273962 - DNA, 20 bp, Artificial Sequence
  chemically synthesized
ttaataattagccctttatt

SEQ ID NO: 273963 - DNA, 20 bp, Artificial Sequence
  chemically synthesized
taataaagggctaattatta

SEQ ID NO: 273964 - DNA, 20 bp, Artificial Sequence
  chemically synthesized
gctttctccactttaataat

SEQ ID NO: 273965 - DNA, 20 bp, Artificial Sequence
  chemically synthesized
taaagggctaattattaaag

SEQ ID NO: 273966 - DNA, 20 bp, Artificial Sequence
  chemically synthesized
aagggctaattattaaagtg

SEQ ID NO: 273967 - DNA, 20 bp, Artificial Sequence
  chemically synthesized
gctaattattaaagtggaga

SEQ ID NO: 273968 - DNA, 20 bp, Artificial Sequence
  chemically synthesized
aattattaaagtggagaaag

SEQ ID NO: 273969 - DNA, 20 bp, Artificial Sequence
  chemically synthesized
aaagtggagaaagcagatct

SEQ ID NO: 273970 - DNA, 20 bp, Artificial Sequence
  chemically synthesized
ctgaagctgatattttaact

SEQ ID NO: 273971 - DNA, 20 bp, Artificial Sequence
  chemically synthesized
gcagatctgagttaaaatat

SEQ ID NO: 273972 - DNA, 20 bp, Artificial Sequence
  chemically synthesized
ctgagttaaaatatcagctt

SEQ ID NO: 273973 - DNA, 20 bp, Artificial Sequence
  chemically synthesized
atgctaaagcatttttactg

SEQ ID NO: 273974 - DNA, 20 bp, Artificial Sequence
  chemically synthesized
cagcttcagtaaaaatgctt

SEQ ID NO: 273975 - DNA, 20 bp, Artificial Sequence
  chemically synthesized
tttaatgaattttaatgcta

SEQ ID NO: 273976 - DNA, 20 bp, Artificial Sequence
  chemically synthesized
tagcattaaaattcattaaa

SEQ ID NO: 273977 - DNA, 20 bp, Artificial Sequence
  chemically synthesized
ttaaaattcattaaatggaa

SEQ ID NO: 273978 - DNA, 20 bp, Artificial Sequence
  chemically synthesized
atggaatagaatgtaaacaa

SEQ ID NO: 273979 - DNA, 20 bp, Artificial Sequence
  chemically synthesized
tggaatagaatgtaaacaat

SEQ ID NO: 273980 - DNA, 20 bp, Artificial Sequence
  chemically synthesized
acattatgatattactatgt

SEQ ID NO: 273981 - DNA, 20 bp, Artificial Sequence
  chemically synthesized
gatgtccgcaagatcttaca

SEQ ID NO: 273982 - DNA, 20 bp, Artificial Sequence
  chemically synthesized
tattactatgtaagatcttg

SEQ ID NO: 273983 - DNA, 20 bp, Artificial Sequence
  chemically synthesized
gatggcctactgatgtccgc

SEQ ID NO: 273984 - DNA, 20 bp, Artificial Sequence
  chemically synthesized
atgtaagatcttgcggacat

SEQ ID NO: 273985 - DNA, 20 bp, Artificial Sequence
  chemically synthesized
taagatcttgcggacatcag

SEQ ID NO: 273986 - DNA, 20 bp, Artificial Sequence
  chemically synthesized
aagatcttgcggacatcagt

SEQ ID NO: 273987 - DNA, 20 bp, Artificial Sequence
  chemically synthesized
aaatggtagatatttattga

SEQ ID NO: 273988 - DNA, 20 bp, Artificial Sequence
  chemically synthesized
tcaataaatatctaccattt

SEQ ID NO: 273989 - DNA, 20 bp, Artificial Sequence
  chemically synthesized
cctggaattaacttaaatgg

SEQ ID NO: 273990 - DNA, 20 bp, Artificial Sequence
  chemically synthesized
taacctggaattaacttaaa

SEQ ID NO: 273991 - DNA, 20 bp, Artificial Sequence
  chemically synthesized
tctaccatttaagttaattc

SEQ ID NO: 273992 - DNA, 20 bp, Artificial Sequence
  chemically synthesized
ctaccatttaagttaattcc

SEQ ID NO: 273993 - DNA, 20 bp, Artificial Sequence
  chemically synthesized
atgaatgttgttaaataacc

SEQ ID NO: 273994 - DNA, 20 bp, Artificial Sequence
  chemically synthesized
ttattttgatgcatagcaaa

SEQ ID NO: 273995 - DNA, 20 bp, Artificial Sequence
  chemically synthesized
attattttgatgcatagcaa

SEQ ID NO: 273996 - DNA, 20 bp, Artificial Sequence
  chemically synthesized
cattattttgatgcatagca

SEQ ID NO: 273997 - DNA, 20 bp, Artificial Sequence
  chemically synthesized
cactccattattttgatgca

SEQ ID NO: 273998 - DNA, 20 bp, Artificial Sequence
  chemically synthesized
tttgctatgcatcaaaataa

SEQ ID NO: 273999 - DNA, 20 bp, Artificial Sequence
  chemically synthesized
tgctatgcatcaaaataatg

SEQ ID NO: 274000 - DNA, 20 bp, Artificial Sequence
  chemically synthesized
atcaaaataatggagtgaaa

SEQ ID NO: 274001 - DNA, 20 bp, Artificial Sequence
  chemically synthesized
taatggagtgaaaaagttga

SEQ ID NO: 274002 - DNA, 20 bp, Artificial Sequence
  chemically synthesized
atatttaaaaagataattta

SEQ ID NO: 274003 - DNA, 20 bp, Artificial Sequence
  chemically synthesized
tatatttaaaaagataattt

SEQ ID NO: 274004 - DNA, 20 bp, Artificial Sequence
  chemically synthesized
attactattatatatttaaa

SEQ ID NO: 274005 - DNA, 20 bp, Artificial Sequence
  chemically synthesized
ttatctttttaaatatataa

SEQ ID NO: 274006 - DNA, 20 bp, Artificial Sequence
  chemically synthesized
ttgatatattctctattcaa

SEQ ID NO: 274007 - DNA, 20 bp, Artificial Sequence
  chemically synthesized
ttttaaaaccctattgaata

SEQ ID NO: 274008 - DNA, 20 bp, Artificial Sequence
  chemically synthesized
tgatatattctctattcaat

SEQ ID NO: 274009 - DNA, 20 bp, Artificial Sequence
  chemically synthesized
gatatattctctattcaata

SEQ ID NO: 274010 - DNA, 20 bp, Artificial Sequence
  chemically synthesized
gtttttaaaaccctattgaa

SEQ ID NO: 274011 - DNA, 20 bp, Artificial Sequence
  chemically synthesized
agggttttaaaaacaacttt

SEQ ID NO: 274012 - DNA, 20 bp, Artificial Sequence
  chemically synthesized
gggttttaaaaacaactttg

SEQ ID NO: 274013 - DNA, 20 bp, Artificial Sequence
  chemically synthesized
ggtatgtaaattgtacctca

SEQ ID NO: 274014 - DNA, 20 bp, Artificial Sequence
  chemically synthesized
tgtttaaaatgaaaatttta

SEQ ID NO: 274015 - DNA, 20 bp, Artificial Sequence
  chemically synthesized
aaattttcattttaaacata

SEQ ID NO: 274016 - DNA, 20 bp, Artificial Sequence
  chemically synthesized
aacatatagtcaatgaacaa

SEQ ID NO: 274017 - DNA, 20 bp, Artificial Sequence
  chemically synthesized
acatatagtcaatgaacaat

SEQ ID NO: 274018 - DNA, 20 bp, Artificial Sequence
  chemically synthesized
aatgaacaataggaaattta

SEQ ID NO: 274019 - DNA, 20 bp, Artificial Sequence
  chemically synthesized
tgaacaataggaaatttata

SEQ ID NO: 274020 - DNA, 20 bp, Artificial Sequence
  chemically synthesized
aatgtcctaaagttggattg

SEQ ID NO: 274021 - DNA, 20 bp, Artificial Sequence
  chemically synthesized
atatcaccacaatccaactt

SEQ ID NO: 274022 - DNA, 20 bp, Artificial Sequence
  chemically synthesized
tatcaccacaatccaacttt

SEQ ID NO: 274023 - DNA, 20 bp, Artificial Sequence
  chemically synthesized
aataaaaaatgtcctaaagt

SEQ ID NO: 274024 - DNA, 20 bp, Artificial Sequence
  chemically synthesized
ggttaataaaaaatgtccta

SEQ ID NO: 274025 - DNA, 20 bp, Artificial Sequence
  chemically synthesized
aaatggacacacaggtttag

SEQ ID NO: 274026 - DNA, 20 bp, Artificial Sequence
  chemically synthesized
aaaatggacacacaggttta

SEQ ID NO: 274027 - DNA, 20 bp, Artificial Sequence
  chemically synthesized
gaaaatggacacacaggttt

SEQ ID NO: 274028 - DNA, 20 bp, Artificial Sequence
  chemically synthesized
tgaaaatggacacacaggtt

SEQ ID NO: 274029 - DNA, 20 bp, Artificial Sequence
  chemically synthesized
gtgaatgaaaatggacacac

SEQ ID NO: 274030 - DNA, 20 bp, Artificial Sequence
  chemically synthesized
tgtgaatgaaaatggacaca

SEQ ID NO: 274031 - DNA, 20 bp, Artificial Sequence
  chemically synthesized
gaacaggatgtgaatgaaaa

SEQ ID NO: 274032 - DNA, 20 bp, Artificial Sequence
  chemically synthesized
ttgaggcatgggttgagaac

SEQ ID NO: 274033 - DNA, 20 bp, Artificial Sequence
  chemically synthesized
gttgaggcatgggttgagaa

SEQ ID NO: 274034 - DNA, 20 bp, Artificial Sequence
  chemically synthesized
gaatggttgaggcatgggtt

SEQ ID NO: 274035 - DNA, 20 bp, Artificial Sequence
  chemically synthesized
tagatgaatggttgaggcat

SEQ ID NO: 274036 - DNA, 20 bp, Artificial Sequence
  chemically synthesized
ctagatgaatggttgaggca

SEQ ID NO: 274037 - DNA, 20 bp, Artificial Sequence
  chemically synthesized
aaacactagatgaatggttg

SEQ ID NO: 274038 - DNA, 20 bp, Artificial Sequence
  chemically synthesized
aaaacactagatgaatggtt

SEQ ID NO: 274039 - DNA, 20 bp, Artificial Sequence
  chemically synthesized
ccatgcctcaaccattcatc

SEQ ID NO: 274040 - DNA, 20 bp, Artificial Sequence
  chemically synthesized
atttgaaaacactagatgaa

SEQ ID NO: 274041 - DNA, 20 bp, Artificial Sequence
  chemically synthesized
aagggaatatttgaaaacac

SEQ ID NO: 274042 - DNA, 20 bp, Artificial Sequence
  chemically synthesized
tataaaagttgtgtttaaaa

SEQ ID NO: 274043 - DNA, 20 bp, Artificial Sequence
  chemically synthesized
gtataaaagttgtgtttaaa

SEQ ID NO: 274044 - DNA, 20 bp, Artificial Sequence
  chemically synthesized
agtataaaagttgtgtttaa

SEQ ID NO: 274045 - DNA, 20 bp, Artificial Sequence
  chemically synthesized
agcagcctaatgaagtataa

SEQ ID NO: 274046 - DNA, 20 bp, Artificial Sequence
  chemically synthesized
acacaacttttatacttcat

SEQ ID NO: 274047 - DNA, 20 bp, Artificial Sequence
  chemically synthesized
cacaacttttatacttcatt

SEQ ID NO: 274048 - DNA, 20 bp, Artificial Sequence
  chemically synthesized
gtaattacagcagcctaatg

SEQ ID NO: 274049 - DNA, 20 bp, Artificial Sequence
  chemically synthesized
acgttatttggtaattacag

SEQ ID NO: 274050 - DNA, 20 bp, Artificial Sequence
  chemically synthesized
ttcacgttatttggtaatta

SEQ ID NO: 274051 - DNA, 20 bp, Artificial Sequence
  chemically synthesized
ttgaaagcattcacgttatt

SEQ ID NO: 274052 - DNA, 20 bp, Artificial Sequence
  chemically synthesized
gtgaatatctaatattttga

SEQ ID NO: 274053 - DNA, 20 bp, Artificial Sequence
  chemically synthesized
cgtgaatgctttcaaaatat

SEQ ID NO: 274054 - DNA, 20 bp, Artificial Sequence
  chemically synthesized
caaaatattagatattcaca

SEQ ID NO: 274055 - DNA, 20 bp, Artificial Sequence
  chemically synthesized
atggtataatccttaaaaac

SEQ ID NO: 274056 - DNA, 20 bp, Artificial Sequence
  chemically synthesized
tatgtattacctagttttta

SEQ ID NO: 274057 - DNA, 20 bp, Artificial Sequence
  chemically synthesized
tggtataatccttaaaaact

SEQ ID NO: 274058 - DNA, 20 bp, Artificial Sequence
  chemically synthesized
ttatgtattacctagttttt

SEQ ID NO: 274059 - DNA, 20 bp, Artificial Sequence
  chemically synthesized
tagcctctttatgtattacc

SEQ ID NO: 274060 - DNA, 20 bp, Artificial Sequence
  chemically synthesized
taaaaactaggtaatacata

SEQ ID NO: 274061 - DNA, 20 bp, Artificial Sequence
  chemically synthesized
aaaactaggtaatacataaa

SEQ ID NO: 274062 - DNA, 20 bp, Artificial Sequence
  chemically synthesized
aaactaggtaatacataaag

SEQ ID NO: 274063 - DNA, 20 bp, Artificial Sequence
  chemically synthesized
ctgatggaaaatatatattt

SEQ ID NO: 274064 - DNA, 20 bp, Artificial Sequence
  chemically synthesized
ctaaaatatatattttccat

SEQ ID NO: 274065 - DNA, 20 bp, Artificial Sequence
  chemically synthesized
acatgaaaaggaaagactga

SEQ ID NO: 274066 - DNA, 20 bp, Artificial Sequence
  chemically synthesized
aactcttcacatgaaaagga

SEQ ID NO: 274067 - DNA, 20 bp, Artificial Sequence
  chemically synthesized
atggaactcttcacatgaaa

SEQ ID NO: 274068 - DNA, 20 bp, Artificial Sequence
  chemically synthesized
aatggaactcttcacatgaa

SEQ ID NO: 274069 - DNA, 20 bp, Artificial Sequence
  chemically synthesized
cagtctttccttttcatgtg

SEQ ID NO: 274070 - DNA, 20 bp, Artificial Sequence
  chemically synthesized
gtctttccttttcatgtgaa

SEQ ID NO: 274071 - DNA, 20 bp, Artificial Sequence
  chemically synthesized
atactttgaatagtataaaa

SEQ ID NO: 274072 - DNA, 20 bp, Artificial Sequence
  chemically synthesized
gttccattttatactattca

SEQ ID NO: 274073 - DNA, 20 bp, Artificial Sequence
  chemically synthesized
cctttccaaaatactttgaa

SEQ ID NO: 274074 - DNA, 20 bp, Artificial Sequence
  chemically synthesized
ttatactattcaaagtattt

SEQ ID NO: 274075 - DNA, 20 bp, Artificial Sequence
  chemically synthesized
actattcaaagtattttgga

SEQ ID NO: 274076 - DNA, 20 bp, Artificial Sequence
  chemically synthesized
ctattcaaagtattttggaa

SEQ ID NO: 274077 - DNA, 20 bp, Artificial Sequence
  chemically synthesized
aagtattttggaaaggtttt

SEQ ID NO: 274078 - DNA, 20 bp, Artificial Sequence
  chemically synthesized
gtattttggaaaggttttca

SEQ ID NO: 274079 - DNA, 20 bp, Artificial Sequence
  chemically synthesized
gaaaggttttcagagcttca

SEQ ID NO: 274080 - DNA, 20 bp, Artificial Sequence
  chemically synthesized
ggttttcagagcttcaaagt

SEQ ID NO: 274081 - DNA, 20 bp, Artificial Sequence
  chemically synthesized
gttttcagagcttcaaagtt

SEQ ID NO: 274082 - DNA, 20 bp, Artificial Sequence
  chemically synthesized
cttatgattgcccaactttg

SEQ ID NO: 274083 - DNA, 20 bp, Artificial Sequence
  chemically synthesized
cttcaaagttgggcaatcat

SEQ ID NO: 274084 - DNA, 20 bp, Artificial Sequence
  chemically synthesized
ttcaaagttgggcaatcata

SEQ ID NO: 274085 - DNA, 20 bp, Artificial Sequence
  chemically synthesized
caatcataaggcattatgac

SEQ ID NO: 274086 - DNA, 20 bp, Artificial Sequence
  chemically synthesized
tcataaggcattatgacaag

SEQ ID NO: 274087 - DNA, 20 bp, Artificial Sequence
  chemically synthesized
tggaacttaatagtatcata

SEQ ID NO: 274088 - DNA, 20 bp, Artificial Sequence
  chemically synthesized
gaagtctttatgatactatt

SEQ ID NO: 274089 - DNA, 20 bp, Artificial Sequence
  chemically synthesized
atttttccaatggaacttaa

SEQ ID NO: 274090 - DNA, 20 bp, Artificial Sequence
  chemically synthesized
atgatactattaagttccat

SEQ ID NO: 274091 - DNA, 20 bp, Artificial Sequence
  chemically synthesized
gtgaagaaccatttttccaa

SEQ ID NO: 274092 - DNA, 20 bp, Artificial Sequence
  chemically synthesized
attaagttccattggaaaaa

SEQ ID NO: 274093 - DNA, 20 bp, Artificial Sequence
  chemically synthesized
ttacgtttaccataatagtg

SEQ ID NO: 274094 - DNA, 20 bp, Artificial Sequence
  chemically synthesized
aaaatggttcttcactatta

SEQ ID NO: 274095 - DNA, 20 bp, Artificial Sequence
  chemically synthesized
gccacttacgtttaccataa

SEQ ID NO: 274096 - DNA, 20 bp, Artificial Sequence
  chemically synthesized
ttcactattatggtaaacgt

SEQ ID NO: 274097 - DNA, 20 bp, Artificial Sequence
  chemically synthesized
actattatggtaaacgtaag

SEQ ID NO: 274098 - DNA, 20 bp, Artificial Sequence
  chemically synthesized
ttatggtaaacgtaagtggc

SEQ ID NO: 274099 - DNA, 20 bp, Artificial Sequence
  chemically synthesized
agataaaatttagaaattgc

SEQ ID NO: 274100 - DNA, 20 bp, Artificial Sequence
  chemically synthesized
caccaaagaaagataaaatt

SEQ ID NO: 274101 - DNA, 20 bp, Artificial Sequence
  chemically synthesized
ttctaaattttatctttctt

SEQ ID NO: 274102 - DNA, 20 bp, Artificial Sequence
  chemically synthesized
tcattagatagcaccaaaga

SEQ ID NO: 274103 - DNA, 20 bp, Artificial Sequence
  chemically synthesized
ccactcattagatagcacca

SEQ ID NO: 274104 - DNA, 20 bp, Artificial Sequence
  chemically synthesized
tttctttggtgctatctaat

SEQ ID NO: 274105 - DNA, 20 bp, Artificial Sequence
  chemically synthesized
ccatcttgccactcattaga

SEQ ID NO: 274106 - DNA, 20 bp, Artificial Sequence
  chemically synthesized
ctttggtgctatctaatgag

SEQ ID NO: 274107 - DNA, 20 bp, Artificial Sequence
  chemically synthesized
cttgccatcttgccactcat

SEQ ID NO: 274108 - DNA, 20 bp, Artificial Sequence
  chemically synthesized
ggtgctatctaatgagtggc

SEQ ID NO: 274109 - DNA, 20 bp, Artificial Sequence
  chemically synthesized
ctatctaatgagtggcaaga

SEQ ID NO: 274110 - DNA, 20 bp, Artificial Sequence
  chemically synthesized
ctaatgagtggcaagatggc

SEQ ID NO: 274111 - DNA, 20 bp, Artificial Sequence
  chemically synthesized
taatgagtggcaagatggca

SEQ ID NO: 274112 - DNA, 20 bp, Artificial Sequence
  chemically synthesized
caagatggcaaggaccacgt

SEQ ID NO: 274113 - DNA, 20 bp, Artificial Sequence
  chemically synthesized
aagatggcaaggaccacgtt

SEQ ID NO: 274114 - DNA, 20 bp, Artificial Sequence
  chemically synthesized
aaatgtgaataagcctaacg

SEQ ID NO: 274115 - DNA, 20 bp, Artificial Sequence
  chemically synthesized
gtaaaatttaaaatgtgaat

SEQ ID NO: 274116 - DNA, 20 bp, Artificial Sequence
  chemically synthesized
tgtcagacaaatgtgatagg

SEQ ID NO: 274117 - DNA, 20 bp, Artificial Sequence
  chemically synthesized
atgtgtcagacaaatgtgat

SEQ ID NO: 274118 - DNA, 20 bp, Artificial Sequence
  chemically synthesized
tatgtgtcagacaaatgtga

SEQ ID NO: 274119 - DNA, 20 bp, Artificial Sequence
  chemically synthesized
tttagtcactaagtatgtgt

SEQ ID NO: 274120 - DNA, 20 bp, Artificial Sequence
  chemically synthesized
acatttgtctgacacatact

SEQ ID NO: 274121 - DNA, 20 bp, Artificial Sequence
  chemically synthesized
tccactgaggtttagtcact

SEQ ID NO: 274122 - DNA, 20 bp, Artificial Sequence
  chemically synthesized
catacttagtgactaaacct

SEQ ID NO: 274123 - DNA, 20 bp, Artificial Sequence
  chemically synthesized
tattgaattccactgaggtt

SEQ ID NO: 274124 - DNA, 20 bp, Artificial Sequence
  chemically synthesized
acttagtgactaaacctcag

SEQ ID NO: 274125 - DNA, 20 bp, Artificial Sequence
  chemically synthesized
aaatttattgaattccactg

SEQ ID NO: 274126 - DNA, 20 bp, Artificial Sequence
  chemically synthesized
caaatttattgaattccact

SEQ ID NO: 274127 - DNA, 20 bp, Artificial Sequence
  chemically synthesized
gtggaattcaataaatttgc

SEQ ID NO: 274128 - DNA, 20 bp, Artificial Sequence
  chemically synthesized
gcagatttctaacaaatagc

SEQ ID NO: 274129 - DNA, 20 bp, Artificial Sequence
  chemically synthesized
taaatttgccagctatttgt

SEQ ID NO: 274130 - DNA, 20 bp, Artificial Sequence
  chemically synthesized
cccagcagatttctaacaaa

SEQ ID NO: 274131 - DNA, 20 bp, Artificial Sequence
  chemically synthesized
gctatttgttagaaatctgc

SEQ ID NO: 274132 - DNA, 20 bp, Artificial Sequence
  chemically synthesized
ctatttgttagaaatctgct

SEQ ID NO: 274133 - DNA, 20 bp, Artificial Sequence
  chemically synthesized
tttgttagaaatctgctggg

SEQ ID NO: 274134 - DNA, 20 bp, Artificial Sequence
  chemically synthesized
taagaccgtgggccacccag

SEQ ID NO: 274135 - DNA, 20 bp, Artificial Sequence
  chemically synthesized
ctgtaagaccgtgggccacc

SEQ ID NO: 274136 - DNA, 20 bp, Artificial Sequence
  chemically synthesized
gaaatctgctgggtggccca

SEQ ID NO: 274137 - DNA, 20 bp, Artificial Sequence
  chemically synthesized
aagttcagctgtaagaccgt

SEQ ID NO: 274138 - DNA, 20 bp, Artificial Sequence
  chemically synthesized
aaagttcagctgtaagaccg

SEQ ID NO: 274139 - DNA, 20 bp, Artificial Sequence
  chemically synthesized
ctgggtggcccacggtctta

SEQ ID NO: 274140 - DNA, 20 bp, Artificial Sequence
  chemically synthesized
aaccactaaagttcagctgt

SEQ ID NO: 274141 - DNA, 20 bp, Artificial Sequence
  chemically synthesized
acggtcttacagctgaactt

SEQ ID NO: 274142 - DNA, 20 bp, Artificial Sequence
  chemically synthesized
attctctaaccactaaagtt

SEQ ID NO: 274143 - DNA, 20 bp, Artificial Sequence
  chemically synthesized
gtcttacagctgaactttag

SEQ ID NO: 274144 - DNA, 20 bp, Artificial Sequence
  chemically synthesized
tacagctgaactttagtggt

SEQ ID NO: 274145 - DNA, 20 bp, Artificial Sequence
  chemically synthesized
ttcccattctctaaccacta

SEQ ID NO: 274146 - DNA, 20 bp, Artificial Sequence
  chemically synthesized
cagctgaactttagtggtta

SEQ ID NO: 274147 - DNA, 20 bp, Artificial Sequence
  chemically synthesized
gaactttagtggttagagaa

SEQ ID NO: 274148 - DNA, 20 bp, Artificial Sequence
  chemically synthesized
aactttagtggttagagaat

SEQ ID NO: 274149 - DNA, 20 bp, Artificial Sequence
  chemically synthesized
tagtggttagagaatgggaa

SEQ ID NO: 274150 - DNA, 20 bp, Artificial Sequence
  chemically synthesized
ggttagagaatgggaataga

SEQ ID NO: 274151 - DNA, 20 bp, Artificial Sequence
  chemically synthesized
gttagagaatgggaatagac

SEQ ID NO: 274152 - DNA, 20 bp, Artificial Sequence
  chemically synthesized
ttagagaatgggaatagacg

SEQ ID NO: 274153 - DNA, 20 bp, Artificial Sequence
  chemically synthesized
agacggggaaaatttttaaa

SEQ ID NO: 274154 - DNA, 20 bp, Artificial Sequence
  chemically synthesized
aatttttaaaaagcaaataa

SEQ ID NO: 274155 - DNA, 20 bp, Artificial Sequence
  chemically synthesized
acaatcacgataaacgctga

SEQ ID NO: 274156 - DNA, 20 bp, Artificial Sequence
  chemically synthesized
actatgttttatttttcttt

SEQ ID NO: 274157 - DNA, 20 bp, Artificial Sequence
  chemically synthesized
gctgaaagaaaaataaaaca

SEQ ID NO: 274158 - DNA, 20 bp, Artificial Sequence
  chemically synthesized
aaaacatagtatgttatgct

SEQ ID NO: 274159 - DNA, 20 bp, Artificial Sequence
  chemically synthesized
atgcacagccagataacact

SEQ ID NO: 274160 - DNA, 20 bp, Artificial Sequence
  chemically synthesized
atgttatgctaagtgttatc

SEQ ID NO: 274161 - DNA, 20 bp, Artificial Sequence
  chemically synthesized
atcgatctaaaatgcacagc

SEQ ID NO: 274162 - DNA, 20 bp, Artificial Sequence
  chemically synthesized
tgttatctggctgtgcattt

SEQ ID NO: 274163 - DNA, 20 bp, Artificial Sequence
  chemically synthesized
atttatcgatctaaaatgca

SEQ ID NO: 274164 - DNA, 20 bp, Artificial Sequence
  chemically synthesized
tttacttcaaagatagcaca

SEQ ID NO: 274165 - DNA, 20 bp, Artificial Sequence
  chemically synthesized
ttttctgtgtgctatctttg

SEQ ID NO: 274166 - DNA, 20 bp, Artificial Sequence
  chemically synthesized
atgaatatttacttcaaaga

SEQ ID NO: 274167 - DNA, 20 bp, Artificial Sequence
  chemically synthesized
gcaaatgaatatttacttca

SEQ ID NO: 274168 - DNA, 20 bp, Artificial Sequence
  chemically synthesized
aagtaaatattcatttgcat

SEQ ID NO: 274169 - DNA, 20 bp, Artificial Sequence
  chemically synthesized
tcatttgcataagacaaaat

SEQ ID NO: 274170 - DNA, 20 bp, Artificial Sequence
  chemically synthesized
catttgcataagacaaaatt

SEQ ID NO: 274171 - DNA, 20 bp, Artificial Sequence
  chemically synthesized
aagacaaaattgggaaataa

SEQ ID NO: 274172 - DNA, 20 bp, Artificial Sequence
  chemically synthesized
agacaaaattgggaaataat

SEQ ID NO: 274173 - DNA, 20 bp, Artificial Sequence
  chemically synthesized
gggaaataataggataaatt

SEQ ID NO: 274174 - DNA, 20 bp, Artificial Sequence
  chemically synthesized
gcaacactctgaatattttg

SEQ ID NO: 274175 - DNA, 20 bp, Artificial Sequence
  chemically synthesized
ttggatcacttcaaaatatt

SEQ ID NO: 274176 - DNA, 20 bp, Artificial Sequence
  chemically synthesized
ggatcacttcaaaatattca

SEQ ID NO: 274177 - DNA, 20 bp, Artificial Sequence
  chemically synthesized
aaatattcagagtgttgcaa

SEQ ID NO: 274178 - DNA, 20 bp, Artificial Sequence
  chemically synthesized
tgttgcaatagtgttcactg

SEQ ID NO: 274179 - DNA, 20 bp, Artificial Sequence
  chemically synthesized
aatagtgttcactgtggctg

SEQ ID NO: 274180 - DNA, 20 bp, Artificial Sequence
  chemically synthesized
ataacttcacgctacagcca

SEQ ID NO: 274181 - DNA, 20 bp, Artificial Sequence
  chemically synthesized
ttcactgtggctgtagcgtg

SEQ ID NO: 274182 - DNA, 20 bp, Artificial Sequence
  chemically synthesized
agtctaataacttcacgcta

SEQ ID NO: 274183 - DNA, 20 bp, Artificial Sequence
  chemically synthesized
tggctgtagcgtgaagttat

SEQ ID NO: 274184 - DNA, 20 bp, Artificial Sequence
  chemically synthesized
gtagcgtgaagttattagac

SEQ ID NO: 274185 - DNA, 20 bp, Artificial Sequence
  chemically synthesized
aagttattagactggtgcaa

SEQ ID NO: 274186 - DNA, 20 bp, Artificial Sequence
  chemically synthesized
aactgcaattacttttgcac

SEQ ID NO: 274187 - DNA, 20 bp, Artificial Sequence
  chemically synthesized
gactggtgcaaaagtaattg

SEQ ID NO: 274188 - DNA, 20 bp, Artificial Sequence
  chemically synthesized
gatgaaattattaaaattaa

SEQ ID NO: 274189 - DNA, 20 bp, Artificial Sequence
  chemically synthesized
aataatttcatccttatatg

SEQ ID NO: 274190 - DNA, 20 bp, Artificial Sequence
  chemically synthesized
atctacaaattctacatata

SEQ ID NO: 274191 - DNA, 20 bp, Artificial Sequence
  chemically synthesized
tatctacaaattctacatat

SEQ ID NO: 274192 - DNA, 20 bp, Artificial Sequence
  chemically synthesized
atccttatatgtagaatttg

SEQ ID NO: 274193 - DNA, 20 bp, Artificial Sequence
  chemically synthesized
ttatatgtagaatttgtaga

SEQ ID NO: 274194 - DNA, 20 bp, Artificial Sequence
  chemically synthesized
ttgtagatagatttttacaa

SEQ ID NO: 274195 - DNA, 20 bp, Artificial Sequence
  chemically synthesized
atttttacaaaagcatacta

SEQ ID NO: 274196 - DNA, 20 bp, Artificial Sequence
  chemically synthesized
ttaagactgcaattaaacta

SEQ ID NO: 274197 - DNA, 20 bp, Artificial Sequence
  chemically synthesized
agcatactatagtttaattg

SEQ ID NO: 274198 - DNA, 20 bp, Artificial Sequence
  chemically synthesized
tattttgatgtgtacatttt

SEQ ID NO: 274199 - DNA, 20 bp, Artificial Sequence
  chemically synthesized
tacacatcaaaataatatga

SEQ ID NO: 274200 - DNA, 20 bp, Artificial Sequence
  chemically synthesized
ctggctatatgataaagata

SEQ ID NO: 274201 - DNA, 20 bp, Artificial Sequence
  chemically synthesized
aaatctatatctttatcata

SEQ ID NO: 274202 - DNA, 20 bp, Artificial Sequence
  chemically synthesized
tcctcactggctatatgata

SEQ ID NO: 274203 - DNA, 20 bp, Artificial Sequence
  chemically synthesized
ctatatctttatcatatagc

SEQ ID NO: 274204 - DNA, 20 bp, Artificial Sequence
  chemically synthesized
atctttatcatatagccagt

SEQ ID NO: 274205 - DNA, 20 bp, Artificial Sequence
  chemically synthesized
tctttatcatatagccagtg

SEQ ID NO: 274206 - DNA, 20 bp, Artificial Sequence
  chemically synthesized
gtacattattatgtcctcac

SEQ ID NO: 274207 - DNA, 20 bp, Artificial Sequence
  chemically synthesized
agtgaggacataataatgta

SEQ ID NO: 274208 - DNA, 20 bp, Artificial Sequence
  chemically synthesized
gtgaggacataataatgtac

SEQ ID NO: 274209 - DNA, 20 bp, Artificial Sequence
  chemically synthesized
taataatgtacaggttgtcc

SEQ ID NO: 274210 - DNA, 20 bp, Artificial Sequence
  chemically synthesized
atgtacaggttgtccaagta

SEQ ID NO: 274211 - DNA, 20 bp, Artificial Sequence
  chemically synthesized
cacacgtcactgactgtact

SEQ ID NO: 274212 - DNA, 20 bp, Artificial Sequence
  chemically synthesized
acaggttgtccaagtacagt

SEQ ID NO: 274213 - DNA, 20 bp, Artificial Sequence
  chemically synthesized
caagtacagtcagtgacgtg

SEQ ID NO: 274214 - DNA, 20 bp, Artificial Sequence
  chemically synthesized
tacagtcagtgacgtgtggc

SEQ ID NO: 274215 - DNA, 20 bp, Artificial Sequence
  chemically synthesized
agtgacgtgtggcaagtttc

SEQ ID NO: 274216 - DNA, 20 bp, Artificial Sequence
  chemically synthesized
ttgtaggaaatgtaaaatac

SEQ ID NO: 274217 - DNA, 20 bp, Artificial Sequence
  chemically synthesized
cagtcataaacacaagttgt

SEQ ID NO: 274218 - DNA, 20 bp, Artificial Sequence
  chemically synthesized
acagtcataaacacaagttg

SEQ ID NO: 274219 - DNA, 20 bp, Artificial Sequence
  chemically synthesized
tgggaaacagtcataaacac

SEQ ID NO: 274220 - DNA, 20 bp, Artificial Sequence
  chemically synthesized
atgtttaatagtgtgggaaa

SEQ ID NO: 274221 - DNA, 20 bp, Artificial Sequence
  chemically synthesized
tttcatatgtttaatagtgt

SEQ ID NO: 274222 - DNA, 20 bp, Artificial Sequence
  chemically synthesized
gtttcatatgtttaatagtg

SEQ ID NO: 274223 - DNA, 20 bp, Artificial Sequence
  chemically synthesized
tgttagtttcatatgtttaa

SEQ ID NO: 274224 - DNA, 20 bp, Artificial Sequence
  chemically synthesized
attaaacatatgaaactaac

SEQ ID NO: 274225 - DNA, 20 bp, Artificial Sequence
  chemically synthesized
tccatttaagaataacttgt

SEQ ID NO: 274226 - DNA, 20 bp, Artificial Sequence
  chemically synthesized
actaacaagttattcttaaa

SEQ ID NO: 274227 - DNA, 20 bp, Artificial Sequence
  chemically synthesized
taacaagttattcttaaatg

SEQ ID NO: 274228 - DNA, 20 bp, Artificial Sequence
  chemically synthesized
acaagttattcttaaatgga

SEQ ID NO: 274229 - DNA, 20 bp, Artificial Sequence
  chemically synthesized
gaacttattactctccattt

SEQ ID NO: 274230 - DNA, 20 bp, Artificial Sequence
  chemically synthesized
attcttaaatggagagtaat

SEQ ID NO: 274231 - DNA, 20 bp, Artificial Sequence
  chemically synthesized
ggagagtaataagttctgta

SEQ ID NO: 274232 - DNA, 20 bp, Artificial Sequence
  chemically synthesized
cacccctatgtgttgctata

SEQ ID NO: 274233 - DNA, 20 bp, Artificial Sequence
  chemically synthesized
aagttctgtatagcaacaca

SEQ ID NO: 274234 - DNA, 20 bp, Artificial Sequence
  chemically synthesized
agttctgtatagcaacacat

SEQ ID NO: 274235 - DNA, 20 bp, Artificial Sequence
  chemically synthesized
gttctgtatagcaacacata

SEQ ID NO: 274236 - DNA, 20 bp, Artificial Sequence
  chemically synthesized
ttctgtatagcaacacatag

SEQ ID NO: 274237 - DNA, 20 bp, Artificial Sequence
  chemically synthesized
tgtatagcaacacatagggg

SEQ ID NO: 274238 - DNA, 20 bp, Artificial Sequence
  chemically synthesized
gaatctgttctaacattgaa

SEQ ID NO: 274239 - DNA, 20 bp, Artificial Sequence
  chemically synthesized
taggggtggcctttcaatgt

SEQ ID NO: 274240 - DNA, 20 bp, Artificial Sequence
  chemically synthesized
tgaatctgttctaacattga

SEQ ID NO: 274241 - DNA, 20 bp, Artificial Sequence
  chemically synthesized
gtggcctttcaatgttagaa

SEQ ID NO: 274242 - DNA, 20 bp, Artificial Sequence
  chemically synthesized
agattcaaaattaaatgcac

SEQ ID NO: 274243 - DNA, 20 bp, Artificial Sequence
  chemically synthesized
gattcaaaattaaatgcact

SEQ ID NO: 274244 - DNA, 20 bp, Artificial Sequence
  chemically synthesized
agcccagtagatggtaaacc

SEQ ID NO: 274245 - DNA, 20 bp, Artificial Sequence
  chemically synthesized
gcactaggtttaccatctac

SEQ ID NO: 274246 - DNA, 20 bp, Artificial Sequence
  chemically synthesized
cactaggtttaccatctact

SEQ ID NO: 274247 - DNA, 20 bp, Artificial Sequence
  chemically synthesized
tttttacacagcccagtaga

SEQ ID NO: 274248 - DNA, 20 bp, Artificial Sequence
  chemically synthesized
tttctttttacacagcccag

SEQ ID NO: 274249 - DNA, 20 bp, Artificial Sequence
  chemically synthesized
tattttctttttacacagcc

SEQ ID NO: 274250 - DNA, 20 bp, Artificial Sequence
  chemically synthesized
catctactgggctgtgtaaa

SEQ ID NO: 274251 - DNA, 20 bp, Artificial Sequence
  chemically synthesized
ctttttattttctttttaca

SEQ ID NO: 274252 - DNA, 20 bp, Artificial Sequence
  chemically synthesized
ctgtgtaaaaagaaaataaa

SEQ ID NO: 274253 - DNA, 20 bp, Artificial Sequence
  chemically synthesized
aaataaaaagtctacatcta

SEQ ID NO: 274254 - DNA, 20 bp, Artificial Sequence
  chemically synthesized
aacctatctagccatagatg

SEQ ID NO: 274255 - DNA, 20 bp, Artificial Sequence
  chemically synthesized
aaaaagtctacatctatggc

SEQ ID NO: 274256 - DNA, 20 bp, Artificial Sequence
  chemically synthesized
tattaaaacctatctagcca

SEQ ID NO: 274257 - DNA, 20 bp, Artificial Sequence
  chemically synthesized
agtctacatctatggctaga

SEQ ID NO: 274258 - DNA, 20 bp, Artificial Sequence
  chemically synthesized
gtctacatctatggctagat

SEQ ID NO: 274259 - DNA, 20 bp, Artificial Sequence
  chemically synthesized
ttcaaatattaaaacctatc

SEQ ID NO: 274260 - DNA, 20 bp, Artificial Sequence
  chemically synthesized
aatatttgaacccaaatctc

SEQ ID NO: 274261 - DNA, 20 bp, Artificial Sequence
  chemically synthesized
gagaactaacccagagattt

SEQ ID NO: 274262 - DNA, 20 bp, Artificial Sequence
  chemically synthesized
atatttgaacccaaatctct

SEQ ID NO: 274263 - DNA, 20 bp, Artificial Sequence
  chemically synthesized
ggagaactaacccagagatt

SEQ ID NO: 274264 - DNA, 20 bp, Artificial Sequence
  chemically synthesized
ttgaacccaaatctctgggt

SEQ ID NO: 274265 - DNA, 20 bp, Artificial Sequence
  chemically synthesized
aaaaatggagaactaaccca

SEQ ID NO: 274266 - DNA, 20 bp, Artificial Sequence
  chemically synthesized
aaaaaaatggagaactaacc

SEQ ID NO: 274267 - DNA, 20 bp, Artificial Sequence
  chemically synthesized
agtcaaagaagaaaaaaatg

SEQ ID NO: 274268 - DNA, 20 bp, Artificial Sequence
  chemically synthesized
ttagtcaaagaagaaaaaaa

SEQ ID NO: 274269 - DNA, 20 bp, Artificial Sequence
  chemically synthesized
attggataatttagtcaaag

SEQ ID NO: 274270 - DNA, 20 bp, Artificial Sequence
  chemically synthesized
gtaattggataatttagtca

SEQ ID NO: 274271 - DNA, 20 bp, Artificial Sequence
  chemically synthesized
tatgtggtaattggataatt

SEQ ID NO: 274272 - DNA, 20 bp, Artificial Sequence
  chemically synthesized
aggggaatttatgtggtaat

SEQ ID NO: 274273 - DNA, 20 bp, Artificial Sequence
  chemically synthesized
cctgcaaaggggaatttatg

SEQ ID NO: 274274 - DNA, 20 bp, Artificial Sequence
  chemically synthesized
accacataaattcccctttg

SEQ ID NO: 274275 - DNA, 20 bp, Artificial Sequence
  chemically synthesized
ccacataaattcccctttgc

SEQ ID NO: 274276 - DNA, 20 bp, Artificial Sequence
  chemically synthesized
gacagcagaaacctgcaaag

SEQ ID NO: 274277 - DNA, 20 bp, Artificial Sequence
  chemically synthesized
agacagcagaaacctgcaaa

SEQ ID NO: 274278 - DNA, 20 bp, Artificial Sequence
  chemically synthesized
tagacagcagaaacctgcaa

SEQ ID NO: 274279 - DNA, 20 bp, Artificial Sequence
  chemically synthesized
ttagacagcagaaacctgca

SEQ ID NO: 274280 - DNA, 20 bp, Artificial Sequence
  chemically synthesized
ttgatttatgagttagacag

SEQ ID NO: 274281 - DNA, 20 bp, Artificial Sequence
  chemically synthesized
ttattgatttatgagttaga

SEQ ID NO: 274282 - DNA, 20 bp, Artificial Sequence
  chemically synthesized
tgctttattgatttatgagt

SEQ ID NO: 274283 - DNA, 20 bp, Artificial Sequence
  chemically synthesized
agtctgctttattgatttat

SEQ ID NO: 274284 - DNA, 20 bp, Artificial Sequence
  chemically synthesized
gtctaactcataaatcaata

SEQ ID NO: 274285 - DNA, 20 bp, Artificial Sequence
  chemically synthesized
taactcataaatcaataaag

SEQ ID NO: 274286 - DNA, 20 bp, Artificial Sequence
  chemically synthesized
aatcaataaagcagactgta

SEQ ID NO: 274287 - DNA, 20 bp, Artificial Sequence
  chemically synthesized
cttggaacagtgtaacttta

SEQ ID NO: 274288 - DNA, 20 bp, Artificial Sequence
  chemically synthesized
ctgtaaagttacactgttcc

SEQ ID NO: 274289 - DNA, 20 bp, Artificial Sequence
  chemically synthesized
gattgccaaacgacttggaa

SEQ ID NO: 274290 - DNA, 20 bp, Artificial Sequence
  chemically synthesized
ttacactgttccaagtcgtt

SEQ ID NO: 274291 - DNA, 20 bp, Artificial Sequence
  chemically synthesized
tatttgattgccaaacgact

SEQ ID NO: 274292 - DNA, 20 bp, Artificial Sequence
  chemically synthesized
cagactcttatagtgtaaat

SEQ ID NO: 274293 - DNA, 20 bp, Artificial Sequence
  chemically synthesized
acagactcttatagtgtaaa

SEQ ID NO: 274294 - DNA, 20 bp, Artificial Sequence
  chemically synthesized
aatatgcctatttacactat

SEQ ID NO: 274295 - DNA, 20 bp, Artificial Sequence
  chemically synthesized
tatgcctatttacactataa

SEQ ID NO: 274296 - DNA, 20 bp, Artificial Sequence
  chemically synthesized
aggaataaaacagactctta

SEQ ID NO: 274297 - DNA, 20 bp, Artificial Sequence
  chemically synthesized
gatttcattaaggaataaaa

SEQ ID NO: 274298 - DNA, 20 bp, Artificial Sequence
  chemically synthesized
ttgagcttttgatttcatta

SEQ ID NO: 274299 - DNA, 20 bp, Artificial Sequence
  chemically synthesized
attgagcttttgatttcatt

SEQ ID NO: 274300 - DNA, 20 bp, Artificial Sequence
  chemically synthesized
ttattccttaatgaaatcaa

SEQ ID NO: 274301 - DNA, 20 bp, Artificial Sequence
  chemically synthesized
aaatcaaaagctcaatctga

SEQ ID NO: 274302 - DNA, 20 bp, Artificial Sequence
  chemically synthesized
agattttggtctatcagatt

SEQ ID NO: 274303 - DNA, 20 bp, Artificial Sequence
  chemically synthesized
aactgcagattttggtctat

SEQ ID NO: 274304 - DNA, 20 bp, Artificial Sequence
  chemically synthesized
atctgatagaccaaaatctg

SEQ ID NO: 274305 - DNA, 20 bp, Artificial Sequence
  chemically synthesized
aaagatataactgcagattt

SEQ ID NO: 274306 - DNA, 20 bp, Artificial Sequence
  chemically synthesized
taaaaataaagatataactg

SEQ ID NO: 274307 - DNA, 20 bp, Artificial Sequence
  chemically synthesized
gcagttatatctttattttt

SEQ ID NO: 274308 - DNA, 20 bp, Artificial Sequence
  chemically synthesized
aaatcaatggcttaaaaata

SEQ ID NO: 274309 - DNA, 20 bp, Artificial Sequence
  chemically synthesized
ttccaagctatcaaaatcaa

SEQ ID NO: 274310 - DNA, 20 bp, Artificial Sequence
  chemically synthesized
ttttaagccattgattttga

SEQ ID NO: 274311 - DNA, 20 bp, Artificial Sequence
  chemically synthesized
agccattgattttgatagct

SEQ ID NO: 274312 - DNA, 20 bp, Artificial Sequence
  chemically synthesized
tctttaaatgttaacattcc

SEQ ID NO: 274313 - DNA, 20 bp, Artificial Sequence
  chemically synthesized
gcttggaatgttaacattta

SEQ ID NO: 274314 - DNA, 20 bp, Artificial Sequence
  chemically synthesized
taactcacattaaatataat

SEQ ID NO: 274315 - DNA, 20 bp, Artificial Sequence
  chemically synthesized
tgaccgattatatttaatgt

SEQ ID NO: 274316 - DNA, 20 bp, Artificial Sequence
  chemically synthesized
ttatatttaatgtgagttat

SEQ ID NO: 274317 - DNA, 20 bp, Artificial Sequence
  chemically synthesized
ttaatgtgagttataagatt

SEQ ID NO: 274318 - DNA, 20 bp, Artificial Sequence
  chemically synthesized
tcttcccgtgtttatcaaag

SEQ ID NO: 274319 - DNA, 20 bp, Artificial Sequence
  chemically synthesized
caatcttcccgtgtttatca

SEQ ID NO: 274320 - DNA, 20 bp, Artificial Sequence
  chemically synthesized
tttagcttctttgataaaca

SEQ ID NO: 274321 - DNA, 20 bp, Artificial Sequence
  chemically synthesized
ttagcttctttgataaacac

SEQ ID NO: 274322 - DNA, 20 bp, Artificial Sequence
  chemically synthesized
gcttctttgataaacacggg

SEQ ID NO: 274323 - DNA, 20 bp, Artificial Sequence
  chemically synthesized
gcaattacgaattcttctta

SEQ ID NO: 274324 - DNA, 20 bp, Artificial Sequence
  chemically synthesized
tacgttaaatgcactttaag

SEQ ID NO: 274325 - DNA, 20 bp, Artificial Sequence
  chemically synthesized
aattacgttaaatgcacttt

SEQ ID NO: 274326 - DNA, 20 bp, Artificial Sequence
  chemically synthesized
taaagtgcatttaacgtaat

SEQ ID NO: 274327 - DNA, 20 bp, Artificial Sequence
  chemically synthesized
acgtaattagtttaaattaa

SEQ ID NO: 274328 - DNA, 20 bp, Artificial Sequence
  chemically synthesized
ggggatttttaaagcaaaga

SEQ ID NO: 274329 - DNA, 20 bp, Artificial Sequence
  chemically synthesized
aagaggggatttttaaagca

SEQ ID NO: 274330 - DNA, 20 bp, Artificial Sequence
  chemically synthesized
tagaaaagaggggattttta

SEQ ID NO: 274331 - DNA, 20 bp, Artificial Sequence
  chemically synthesized
gagtacaatttagaaaagag

SEQ ID NO: 274332 - DNA, 20 bp, Artificial Sequence
  chemically synthesized
tgagtacaatttagaaaaga

SEQ ID NO: 274333 - DNA, 20 bp, Artificial Sequence
  chemically synthesized
gtgagtacaatttagaaaag

SEQ ID NO: 274334 - DNA, 20 bp, Artificial Sequence
  chemically synthesized
tgtgagtacaatttagaaaa

SEQ ID NO: 274335 - DNA, 20 bp, Artificial Sequence
  chemically synthesized
aatgtgagtacaatttagaa

SEQ ID NO: 274336 - DNA, 20 bp, Artificial Sequence
  chemically synthesized
ttaacaatgtgagtacaatt

SEQ ID NO: 274337 - DNA, 20 bp, Artificial Sequence
  chemically synthesized
ttccctcccattaacaatgt

SEQ ID NO: 274338 - DNA, 20 bp, Artificial Sequence
  chemically synthesized
aattgtactcacattgttaa

SEQ ID NO: 274339 - DNA, 20 bp, Artificial Sequence
  chemically synthesized
attgtactcacattgttaat

SEQ ID NO: 274340 - DNA, 20 bp, Artificial Sequence
  chemically synthesized
tgtactcacattgttaatgg

SEQ ID NO: 274341 - DNA, 20 bp, Artificial Sequence
  chemically synthesized
gtactcacattgttaatggg

SEQ ID NO: 274342 - DNA, 20 bp, Artificial Sequence
  chemically synthesized
tactcacattgttaatggga

SEQ ID NO: 274343 - DNA, 20 bp, Artificial Sequence
  chemically synthesized
cattgttaatgggagggaaa

SEQ ID NO: 274344 - DNA, 20 bp, Artificial Sequence
  chemically synthesized
ttgttaatgggagggaaaaa

SEQ ID NO: 274345 - DNA, 20 bp, Artificial Sequence
  chemically synthesized
ttaatgggagggaaaaagag

SEQ ID NO: 274346 - DNA, 20 bp, Artificial Sequence
  chemically synthesized
taatgggagggaaaaagaga

SEQ ID NO: 274347 - DNA, 20 bp, Artificial Sequence
  chemically synthesized
atgggagggaaaaagagaag

SEQ ID NO: 274348 - DNA, 20 bp, Artificial Sequence
  chemically synthesized
tgggagggaaaaagagaagg

SEQ ID NO: 274349 - DNA, 20 bp, Artificial Sequence
  chemically synthesized
gagggaaaaagagaaggagg

SEQ ID NO: 274350 - DNA, 20 bp, Artificial Sequence
  chemically synthesized
aaaaagagaaggaggaagtc

SEQ ID NO: 274351 - DNA, 20 bp, Artificial Sequence
  chemically synthesized
gaaggaggaagtctggtctg

SEQ ID NO: 274352 - DNA, 20 bp, Artificial Sequence
  chemically synthesized
ttccagagtccactacagac

SEQ ID NO: 274353 - DNA, 20 bp, Artificial Sequence
  chemically synthesized
ggaggaagtctggtctgtag

SEQ ID NO: 274354 - DNA, 20 bp, Artificial Sequence
  chemically synthesized
aggtgttccagagtccacta

SEQ ID NO: 274355 - DNA, 20 bp, Artificial Sequence
  chemically synthesized
gtctggtctgtagtggactc

SEQ ID NO: 274356 - DNA, 20 bp, Artificial Sequence
  chemically synthesized
ctaggacgtcaggtgttcca

SEQ ID NO: 274357 - DNA, 20 bp, Artificial Sequence
  chemically synthesized
agctaggacgtcaggtgttc

SEQ ID NO: 274358 - DNA, 20 bp, Artificial Sequence
  chemically synthesized
ctctggaacacctgacgtcc

SEQ ID NO: 274359 - DNA, 20 bp, Artificial Sequence
  chemically synthesized
gctcaccaagctaggacgtc

SEQ ID NO: 274360 - DNA, 20 bp, Artificial Sequence
  chemically synthesized
tgctcaccaagctaggacgt

SEQ ID NO: 274361 - DNA, 20 bp, Artificial Sequence
  chemically synthesized
gaacacctgacgtcctagct

SEQ ID NO: 274362 - DNA, 20 bp, Artificial Sequence
  chemically synthesized
cgtggtttgctcaccaagct

SEQ ID NO: 274363 - DNA, 20 bp, Artificial Sequence
  chemically synthesized
acctgacgtcctagcttggt

SEQ ID NO: 274364 - DNA, 20 bp, Artificial Sequence
  chemically synthesized
ccgtggtttgctcaccaagc

SEQ ID NO: 274365 - DNA, 20 bp, Artificial Sequence
  chemically synthesized
actgccgtggtttgctcacc

SEQ ID NO: 274366 - DNA, 20 bp, Artificial Sequence
  chemically synthesized
ctagcttggtgagcaaacca

SEQ ID NO: 274367 - DNA, 20 bp, Artificial Sequence
  chemically synthesized
gcttggtgagcaaaccacgg

SEQ ID NO: 274368 - DNA, 20 bp, Artificial Sequence
  chemically synthesized
aatattgaaaaatactgccg

SEQ ID NO: 274369 - DNA, 20 bp, Artificial Sequence
  chemically synthesized
atttttcaatatttaattat

SEQ ID NO: 274370 - DNA, 20 bp, Artificial Sequence
  chemically synthesized
tttttcaatatttaattatg

SEQ ID NO: 274371 - DNA, 20 bp, Artificial Sequence
  chemically synthesized
ttatgaggcactcttctttg

SEQ ID NO: 274372 - DNA, 20 bp, Artificial Sequence
  chemically synthesized
aacaaattaccttcaaagaa

SEQ ID NO: 274373 - DNA, 20 bp, Artificial Sequence
  chemically synthesized
tatgaggcactcttctttga

SEQ ID NO: 274374 - DNA, 20 bp, Artificial Sequence
  chemically synthesized
gaaacaaattaccttcaaag

SEQ ID NO: 274375 - DNA, 20 bp, Artificial Sequence
  chemically synthesized
aaggaaacaaattaccttca

SEQ ID NO: 274376 - DNA, 20 bp, Artificial Sequence
  chemically synthesized
ttatgagcaggaatagagga

SEQ ID NO: 274377 - DNA, 20 bp, Artificial Sequence
  chemically synthesized
tttatgagcaggaatagagg

SEQ ID NO: 274378 - DNA, 20 bp, Artificial Sequence
  chemically synthesized
agatttatgagcaggaatag

SEQ ID NO: 274379 - DNA, 20 bp, Artificial Sequence
  chemically synthesized
tagatttatgagcaggaata

SEQ ID NO: 274380 - DNA, 20 bp, Artificial Sequence
  chemically synthesized
agtagatttatgagcaggaa

SEQ ID NO: 274381 - DNA, 20 bp, Artificial Sequence
  chemically synthesized
cacatagtagatttatgagc

SEQ ID NO: 274382 - DNA, 20 bp, Artificial Sequence
  chemically synthesized
ccacatagtagatttatgag

SEQ ID NO: 274383 - DNA, 20 bp, Artificial Sequence
  chemically synthesized
gtcccacatagtagatttat

SEQ ID NO: 274384 - DNA, 20 bp, Artificial Sequence
  chemically synthesized
ctgctcataaatctactatg

SEQ ID NO: 274385 - DNA, 20 bp, Artificial Sequence
  chemically synthesized
tgctcataaatctactatgt

SEQ ID NO: 274386 - DNA, 20 bp, Artificial Sequence
  chemically synthesized
taacctcgtgtcccacatag

SEQ ID NO: 274387 - DNA, 20 bp, Artificial Sequence
  chemically synthesized
ttgtaacctcgtgtcccaca

SEQ ID NO: 274388 - DNA, 20 bp, Artificial Sequence
  chemically synthesized
aaatctactatgtgggacac

SEQ ID NO: 274389 - DNA, 20 bp, Artificial Sequence
  chemically synthesized
aatctactatgtgggacacg

SEQ ID NO: 274390 - DNA, 20 bp, Artificial Sequence
  chemically synthesized
acacgaggttacaaaaaaat

SEQ ID NO: 274391 - DNA, 20 bp, Artificial Sequence
  chemically synthesized
aggttacaaaaaaatgagat

SEQ ID NO: 274392 - DNA, 20 bp, Artificial Sequence
  chemically synthesized
aaaatgagatcagaattctt

SEQ ID NO: 274393 - DNA, 20 bp, Artificial Sequence
  chemically synthesized
aaatgagatcagaattcttt

SEQ ID NO: 274394 - DNA, 20 bp, Artificial Sequence
  chemically synthesized
gttctatttgttttttccca

SEQ ID NO: 274395 - DNA, 20 bp, Artificial Sequence
  chemically synthesized
attctttgggaaaaaacaaa

SEQ ID NO: 274396 - DNA, 20 bp, Artificial Sequence
  chemically synthesized
ttgggaaaaaacaaatagaa

SEQ ID NO: 274397 - DNA, 20 bp, Artificial Sequence
  chemically synthesized
aaaaaacaaatagaacagta

SEQ ID NO: 274398 - DNA, 20 bp, Artificial Sequence
  chemically synthesized
aaatagaacagtaaagctac

SEQ ID NO: 274399 - DNA, 20 bp, Artificial Sequence
  chemically synthesized
atagaacagtaaagctactg

SEQ ID NO: 274400 - DNA, 20 bp, Artificial Sequence
  chemically synthesized
ttgcttagcagtggctccag

SEQ ID NO: 274401 - DNA, 20 bp, Artificial Sequence
  chemically synthesized
gagttgcttagcagtggctc

SEQ ID NO: 274402 - DNA, 20 bp, Artificial Sequence
  chemically synthesized
aagctactggagccactgct

SEQ ID NO: 274403 - DNA, 20 bp, Artificial Sequence
  chemically synthesized
agagcggagttgcttagcag

SEQ ID NO: 274404 - DNA, 20 bp, Artificial Sequence
  chemically synthesized
gcaagagcggagttgcttag

SEQ ID NO: 274405 - DNA, 20 bp, Artificial Sequence
  chemically synthesized
caagcaagagcggagttgct

SEQ ID NO: 274406 - DNA, 20 bp, Artificial Sequence
  chemically synthesized
aattactgcaagcaagagcg

SEQ ID NO: 274407 - DNA, 20 bp, Artificial Sequence
  chemically synthesized
taaattactgcaagcaagag

SEQ ID NO: 274408 - DNA, 20 bp, Artificial Sequence
  chemically synthesized
agcaactccgctcttgcttg

SEQ ID NO: 274409 - DNA, 20 bp, Artificial Sequence
  chemically synthesized
gcttaaattactgcaagcaa

SEQ ID NO: 274410 - DNA, 20 bp, Artificial Sequence
  chemically synthesized
ttgcttaaattactgcaagc

SEQ ID NO: 274411 - DNA, 20 bp, Artificial Sequence
  chemically synthesized
cctgttgcttaaattactgc

SEQ ID NO: 274412 - DNA, 20 bp, Artificial Sequence
  chemically synthesized
gctcttgcttgcagtaattt

SEQ ID NO: 274413 - DNA, 20 bp, Artificial Sequence
  chemically synthesized
gcttgcagtaatttaagcaa

SEQ ID NO: 274414 - DNA, 20 bp, Artificial Sequence
  chemically synthesized
cttgcagtaatttaagcaac

SEQ ID NO: 274415 - DNA, 20 bp, Artificial Sequence
  chemically synthesized
ttgcagtaatttaagcaaca

SEQ ID NO: 274416 - DNA, 20 bp, Artificial Sequence
  chemically synthesized
acattttgtaggggaaaaca

SEQ ID NO: 274417 - DNA, 20 bp, Artificial Sequence
  chemically synthesized
tgttgatgcacattttgtag

SEQ ID NO: 274418 - DNA, 20 bp, Artificial Sequence
  chemically synthesized
gtgttgatgcacattttgta

SEQ ID NO: 274419 - DNA, 20 bp, Artificial Sequence
  chemically synthesized
tgtgttgatgcacattttgt

SEQ ID NO: 274420 - DNA, 20 bp, Artificial Sequence
  chemically synthesized
atgtgttgatgcacattttg

SEQ ID NO: 274421 - DNA, 20 bp, Artificial Sequence
  chemically synthesized
caaaatgtgcatcaacacat

SEQ ID NO: 274422 - DNA, 20 bp, Artificial Sequence
  chemically synthesized
aaaatgtgcatcaacacata

SEQ ID NO: 274423 - DNA, 20 bp, Artificial Sequence
  chemically synthesized
tgcatcaacacataaggaca

SEQ ID NO: 274424 - DNA, 20 bp, Artificial Sequence
  chemically synthesized
aaggacatggtgactttcaa

SEQ ID NO: 274425 - DNA, 20 bp, Artificial Sequence
  chemically synthesized
aggacatggtgactttcaac

SEQ ID NO: 274426 - DNA, 20 bp, Artificial Sequence
  chemically synthesized
ccaacatgggcacctgttga

SEQ ID NO: 274427 - DNA, 20 bp, Artificial Sequence
  chemically synthesized
ctttcaacaggtgcccatgt

SEQ ID NO: 274428 - DNA, 20 bp, Artificial Sequence
  chemically synthesized
tttcaacaggtgcccatgtt

SEQ ID NO: 274429 - DNA, 20 bp, Artificial Sequence
  chemically synthesized
atgtaagaacaacccaacat

SEQ ID NO: 274430 - DNA, 20 bp, Artificial Sequence
  chemically synthesized
tatgtaagaacaacccaaca

SEQ ID NO: 274431 - DNA, 20 bp, Artificial Sequence
  chemically synthesized
gttttgaatctttgatatgt

SEQ ID NO: 274432 - DNA, 20 bp, Artificial Sequence
  chemically synthesized
tgggttgttcttacatatca

SEQ ID NO: 274433 - DNA, 20 bp, Artificial Sequence
  chemically synthesized
caaagattcaaaactaaaat

SEQ ID NO: 274434 - DNA, 20 bp, Artificial Sequence
  chemically synthesized
agattcaaaactaaaattag

SEQ ID NO: 274435 - DNA, 20 bp, Artificial Sequence
  chemically synthesized
ttttccttttctactaattt

SEQ ID NO: 274436 - DNA, 20 bp, Artificial Sequence
  chemically synthesized
caaaactaaaattagtagaa

SEQ ID NO: 274437 - DNA, 20 bp, Artificial Sequence
  chemically synthesized
aaaactaaaattagtagaaa

SEQ ID NO: 274438 - DNA, 20 bp, Artificial Sequence
  chemically synthesized
gaaaaaaatcatgtatgtga

SEQ ID NO: 274439 - DNA, 20 bp, Artificial Sequence
  chemically synthesized
ttgcaatttttaaaattaca

SEQ ID NO: 274440 - DNA, 20 bp, Artificial Sequence
  chemically synthesized
tttgtaattttaaaaattgc

SEQ ID NO: 274441 - DNA, 20 bp, Artificial Sequence
  chemically synthesized
ttaaaaattgcaagacattt

SEQ ID NO: 274442 - DNA, 20 bp, Artificial Sequence
  chemically synthesized
aaaattgcaagacatttaag

SEQ ID NO: 274443 - DNA, 20 bp, Artificial Sequence
  chemically synthesized
cagtgacaactatgtttaaa

SEQ ID NO: 274444 - DNA, 20 bp, Artificial Sequence
  chemically synthesized
tttaagtagctatttaaaca

SEQ ID NO: 274445 - DNA, 20 bp, Artificial Sequence
  chemically synthesized
ctcttaatcattttagggga

SEQ ID NO: 274446 - DNA, 20 bp, Artificial Sequence
  chemically synthesized
atggctcttaatcattttag

SEQ ID NO: 274447 - DNA, 20 bp, Artificial Sequence
  chemically synthesized
tatggctcttaatcatttta

SEQ ID NO: 274448 - DNA, 20 bp, Artificial Sequence
  chemically synthesized
atatggctcttaatcatttt

SEQ ID NO: 274449 - DNA, 20 bp, Artificial Sequence
  chemically synthesized
catatggctcttaatcattt

SEQ ID NO: 274450 - DNA, 20 bp, Artificial Sequence
  chemically synthesized
cactgtcccctaaaatgatt

SEQ ID NO: 274451 - DNA, 20 bp, Artificial Sequence
  chemically synthesized
ctgtcccctaaaatgattaa

SEQ ID NO: 274452 - DNA, 20 bp, Artificial Sequence
  chemically synthesized
aatgattaagagccatatgc

SEQ ID NO: 274453 - DNA, 20 bp, Artificial Sequence
  chemically synthesized
catgtcaattaacttgcata

SEQ ID NO: 274454 - DNA, 20 bp, Artificial Sequence
  chemically synthesized
ttaattgacatgttaacaaa

SEQ ID NO: 274455 - DNA, 20 bp, Artificial Sequence
  chemically synthesized
taattgacatgttaacaaat

SEQ ID NO: 274456 - DNA, 20 bp, Artificial Sequence
  chemically synthesized
aattgacatgttaacaaatg

SEQ ID NO: 274457 - DNA, 20 bp, Artificial Sequence
  chemically synthesized
gacatgttaacaaatggggt

SEQ ID NO: 274458 - DNA, 20 bp, Artificial Sequence
  chemically synthesized
ggttagaaaaaaatgaattg

SEQ ID NO: 274459 - DNA, 20 bp, Artificial Sequence
  chemically synthesized
agaaaaaaatgaattgaaga

SEQ ID NO: 274460 - DNA, 20 bp, Artificial Sequence
  chemically synthesized
aaaatgaattgaagaaagcc

SEQ ID NO: 274461 - DNA, 20 bp, Artificial Sequence
  chemically synthesized
atgaattgaagaaagccaag

SEQ ID NO: 274462 - DNA, 20 bp, Artificial Sequence
  chemically synthesized
gaattgaagaaagccaagca

SEQ ID NO: 274463 - DNA, 20 bp, Artificial Sequence
  chemically synthesized
gtttgaggctgaactctgct

SEQ ID NO: 274464 - DNA, 20 bp, Artificial Sequence
  chemically synthesized
gaagaaagccaagcagagtt

SEQ ID NO: 274465 - DNA, 20 bp, Artificial Sequence
  chemically synthesized
atgttcaatatagatgtttg

SEQ ID NO: 274466 - DNA, 20 bp, Artificial Sequence
  chemically synthesized
aatgttcaatatagatgttt

SEQ ID NO: 274467 - DNA, 20 bp, Artificial Sequence
  chemically synthesized
gacaaaaagaatgttcaata

SEQ ID NO: 274468 - DNA, 20 bp, Artificial Sequence
  chemically synthesized
caaattttaatttagacaaa

SEQ ID NO: 274469 - DNA, 20 bp, Artificial Sequence
  chemically synthesized
ctatcgcacaaattttaatt

SEQ ID NO: 274470 - DNA, 20 bp, Artificial Sequence
  chemically synthesized
ctaaattaaaatttgtgcga

SEQ ID NO: 274471 - DNA, 20 bp, Artificial Sequence
  chemically synthesized
aaaatttgtgcgatagctct

SEQ ID NO: 274472 - DNA, 20 bp, Artificial Sequence
  chemically synthesized
atggaagaaaatatagctga

SEQ ID NO: 274473 - DNA, 20 bp, Artificial Sequence
  chemically synthesized
tgatggaagaaaatatagct

SEQ ID NO: 274474 - DNA, 20 bp, Artificial Sequence
  chemically synthesized
atgggtgatggaagaaaata

SEQ ID NO: 274475 - DNA, 20 bp, Artificial Sequence
  chemically synthesized
taatggaaaatgggtgatgg

SEQ ID NO: 274476 - DNA, 20 bp, Artificial Sequence
  chemically synthesized
ctctaatggaaaatgggtga

SEQ ID NO: 274477 - DNA, 20 bp, Artificial Sequence
  chemically synthesized
tttttcctctaatggaaaat

SEQ ID NO: 274478 - DNA, 20 bp, Artificial Sequence
  chemically synthesized
ttttttcctctaatggaaaa

SEQ ID NO: 274479 - DNA, 20 bp, Artificial Sequence
  chemically synthesized
ttccatcacccattttccat

SEQ ID NO: 274480 - DNA, 20 bp, Artificial Sequence
  chemically synthesized
ccatcacccattttccatta

SEQ ID NO: 274481 - DNA, 20 bp, Artificial Sequence
  chemically synthesized
catcacccattttccattag

SEQ ID NO: 274482 - DNA, 20 bp, Artificial Sequence
  chemically synthesized
attttgattttttcctctaa

SEQ ID NO: 274483 - DNA, 20 bp, Artificial Sequence
  chemically synthesized
attagaggaaaaaatcaaaa

SEQ ID NO: 274484 - DNA, 20 bp, Artificial Sequence
  chemically synthesized
ttagaggaaaaaatcaaaat

SEQ ID NO: 274485 - DNA, 20 bp, Artificial Sequence
  chemically synthesized
agaggaaaaaatcaaaatag

SEQ ID NO: 274486 - DNA, 20 bp, Artificial Sequence
  chemically synthesized
aggaaaaaatcaaaatagga

SEQ ID NO: 274487 - DNA, 20 bp, Artificial Sequence
  chemically synthesized
aaaataggagagaatctcac

SEQ ID NO: 274488 - DNA, 20 bp, Artificial Sequence
  chemically synthesized
ataggagagaatctcaccag

SEQ ID NO: 274489 - DNA, 20 bp, Artificial Sequence
  chemically synthesized
gtggcaatcaaactactggt

SEQ ID NO: 274490 - DNA, 20 bp, Artificial Sequence
  chemically synthesized
cagagtggcaatcaaactac

SEQ ID NO: 274491 - DNA, 20 bp, Artificial Sequence
  chemically synthesized
tcaatgggagggagtcagag

SEQ ID NO: 274492 - DNA, 20 bp, Artificial Sequence
  chemically synthesized
gtttcaatgggagggagtca

SEQ ID NO: 274493 - DNA, 20 bp, Artificial Sequence
  chemically synthesized
acgtttcaatgggagggagt

SEQ ID NO: 274494 - DNA, 20 bp, Artificial Sequence
  chemically synthesized
gtcaacgtttcaatgggagg

SEQ ID NO: 274495 - DNA, 20 bp, Artificial Sequence
  chemically synthesized
gtgtcaacgtttcaatggga

SEQ ID NO: 274496 - DNA, 20 bp, Artificial Sequence
  chemically synthesized
tgtgtcaacgtttcaatggg

SEQ ID NO: 274497 - DNA, 20 bp, Artificial Sequence
  chemically synthesized
ctgtgtcaacgtttcaatgg

SEQ ID NO: 274498 - DNA, 20 bp, Artificial Sequence
  chemically synthesized
gactgtgtcaacgtttcaat

SEQ ID NO: 274499 - DNA, 20 bp, Artificial Sequence
  chemically synthesized
tgactgtgtcaacgtttcaa

SEQ ID NO: 274500 - DNA, 20 bp, Artificial Sequence
  chemically synthesized
ctcccattgaaacgttgaca

SEQ ID NO: 274501 - DNA, 20 bp, Artificial Sequence
  chemically synthesized
ttgaaacgttgacacagtca

SEQ ID NO: 274502 - DNA, 20 bp, Artificial Sequence
  chemically synthesized
aaacgttgacacagtcatag

SEQ ID NO: 274503 - DNA, 20 bp, Artificial Sequence
  chemically synthesized
acgttgacacagtcatagaa

SEQ ID NO: 274504 - DNA, 20 bp, Artificial Sequence
  chemically synthesized
gtcatagaagagaatcttta

SEQ ID NO: 274505 - DNA, 20 bp, Artificial Sequence
  chemically synthesized
atagaagagaatctttatag

SEQ ID NO: 274506 - DNA, 20 bp, Artificial Sequence
  chemically synthesized
agaagagaatctttatagaa

SEQ ID NO: 274507 - DNA, 20 bp, Artificial Sequence
  chemically synthesized
ttttctatcactcttctata

SEQ ID NO: 274508 - DNA, 20 bp, Artificial Sequence
  chemically synthesized
gaatctttatagaagagtga

SEQ ID NO: 274509 - DNA, 20 bp, Artificial Sequence
  chemically synthesized
atgtcgtatgaaaaatactc

SEQ ID NO: 274510 - DNA, 20 bp, Artificial Sequence
  chemically synthesized
gtaatgactaaattgttcca

SEQ ID NO: 274511 - DNA, 20 bp, Artificial Sequence
  chemically synthesized
tagtaatgactaaattgttc

SEQ ID NO: 274512 - DNA, 20 bp, Artificial Sequence
  chemically synthesized
aaaaatactctggaacaatt

SEQ ID NO: 274513 - DNA, 20 bp, Artificial Sequence
  chemically synthesized
tggaacaatttagtcattac

SEQ ID NO: 274514 - DNA, 20 bp, Artificial Sequence
  chemically synthesized
aacaatttagtcattactag

SEQ ID NO: 274515 - DNA, 20 bp, Artificial Sequence
  chemically synthesized
acaatttagtcattactagt

SEQ ID NO: 274516 - DNA, 20 bp, Artificial Sequence
  chemically synthesized
caatttagtcattactagta

SEQ ID NO: 274517 - DNA, 20 bp, Artificial Sequence
  chemically synthesized
ggctttggatggttccctac

SEQ ID NO: 274518 - DNA, 20 bp, Artificial Sequence
  chemically synthesized
tactagtagggaaccatcca

SEQ ID NO: 274519 - DNA, 20 bp, Artificial Sequence
  chemically synthesized
aattggagaatggctttgga

SEQ ID NO: 274520 - DNA, 20 bp, Artificial Sequence
  chemically synthesized
agctaattggagaatggctt

SEQ ID NO: 274521 - DNA, 20 bp, Artificial Sequence
  chemically synthesized
atgtgtagctaattggagaa

SEQ ID NO: 274522 - DNA, 20 bp, Artificial Sequence
  chemically synthesized
atccaaagccattctccaat

SEQ ID NO: 274523 - DNA, 20 bp, Artificial Sequence
  chemically synthesized
ttctaatgtgtagctaattg

SEQ ID NO: 274524 - DNA, 20 bp, Artificial Sequence
  chemically synthesized
cattctaatgtgtagctaat

SEQ ID NO: 274525 - DNA, 20 bp, Artificial Sequence
  chemically synthesized
ttctccaattagctacacat

SEQ ID NO: 274526 - DNA, 20 bp, Artificial Sequence
  chemically synthesized
tttttattcattctaatgtg

SEQ ID NO: 274527 - DNA, 20 bp, Artificial Sequence
  chemically synthesized
acacattagaatgaataaaa

SEQ ID NO: 274528 - DNA, 20 bp, Artificial Sequence
  chemically synthesized
gatttggtcttcagaatttt

SEQ ID NO: 274529 - DNA, 20 bp, Artificial Sequence
  chemically synthesized
aaaagtttccaaaaattctg

SEQ ID NO: 274530 - DNA, 20 bp, Artificial Sequence
  chemically synthesized
ctttaggtggatttggtctt

SEQ ID NO: 274531 - DNA, 20 bp, Artificial Sequence
  chemically synthesized
atcaaatctttaggtggatt

SEQ ID NO: 274532 - DNA, 20 bp, Artificial Sequence
  chemically synthesized
ctgaagaccaaatccaccta

SEQ ID NO: 274533 - DNA, 20 bp, Artificial Sequence
  chemically synthesized
aatcaaatcaaatctttagg

SEQ ID NO: 274534 - DNA, 20 bp, Artificial Sequence
  chemically synthesized
agcaatcaaatcaaatcttt

SEQ ID NO: 274535 - DNA, 20 bp, Artificial Sequence
  chemically synthesized
gagcaatcaaatcaaatctt

SEQ ID NO: 274536 - DNA, 20 bp, Artificial Sequence
  chemically synthesized
aagatttgatttgattgctc

SEQ ID NO: 274537 - DNA, 20 bp, Artificial Sequence
  chemically synthesized
agatttgatttgattgctcc

SEQ ID NO: 274538 - DNA, 20 bp, Artificial Sequence
  chemically synthesized
gatttgatttgattgctccg

SEQ ID NO: 274539 - DNA, 20 bp, Artificial Sequence
  chemically synthesized
gatttgattgctccggggct

SEQ ID NO: 274540 - DNA, 20 bp, Artificial Sequence
  chemically synthesized
agtaaccatgctgagccccg

SEQ ID NO: 274541 - DNA, 20 bp, Artificial Sequence
  chemically synthesized
taagtaaccatgctgagccc

SEQ ID NO: 274542 - DNA, 20 bp, Artificial Sequence
  chemically synthesized
gattgctccggggctcagca

SEQ ID NO: 274543 - DNA, 20 bp, Artificial Sequence
  chemically synthesized
acagtctaagtaaccatgct

SEQ ID NO: 274544 - DNA, 20 bp, Artificial Sequence
  chemically synthesized
cggggctcagcatggttact

SEQ ID NO: 274545 - DNA, 20 bp, Artificial Sequence
  chemically synthesized
aaatcctatagcaacagtct

SEQ ID NO: 274546 - DNA, 20 bp, Artificial Sequence
  chemically synthesized
ggttacttagactgttgcta

SEQ ID NO: 274547 - DNA, 20 bp, Artificial Sequence
  chemically synthesized
gttacttagactgttgctat

SEQ ID NO: 274548 - DNA, 20 bp, Artificial Sequence
  chemically synthesized
cacctaaaatcctatagcaa

SEQ ID NO: 274549 - DNA, 20 bp, Artificial Sequence
  chemically synthesized
ttttggcacctaaaatccta

SEQ ID NO: 274550 - DNA, 20 bp, Artificial Sequence
  chemically synthesized
agactgttgctataggattt

SEQ ID NO: 274551 - DNA, 20 bp, Artificial Sequence
  chemically synthesized
gactgttgctataggatttt

SEQ ID NO: 274552 - DNA, 20 bp, Artificial Sequence
  chemically synthesized
tgaagcacagagtttagttt

SEQ ID NO: 274553 - DNA, 20 bp, Artificial Sequence
  chemically synthesized
atatattgaagcacagagtt

SEQ ID NO: 274554 - DNA, 20 bp, Artificial Sequence
  chemically synthesized
gaactatatattgaagcaca

SEQ ID NO: 274555 - DNA, 20 bp, Artificial Sequence
  chemically synthesized
cagaactatatattgaagca

SEQ ID NO: 274556 - DNA, 20 bp, Artificial Sequence
  chemically synthesized
aaactctgtgcttcaatata

SEQ ID NO: 274557 - DNA, 20 bp, Artificial Sequence
  chemically synthesized
tttttcagaactatatattg

SEQ ID NO: 274558 - DNA, 20 bp, Artificial Sequence
  chemically synthesized
tcatttactgttcaattttt

SEQ ID NO: 274559 - DNA, 20 bp, Artificial Sequence
  chemically synthesized
tatagttctgaaaaattgaa

SEQ ID NO: 274560 - DNA, 20 bp, Artificial Sequence
  chemically synthesized
agaaacacatggaacaaatt

SEQ ID NO: 274561 - DNA, 20 bp, Artificial Sequence
  chemically synthesized
tgtgactgcaaagaaacaca

SEQ ID NO: 274562 - DNA, 20 bp, Artificial Sequence
  chemically synthesized
ttgttccatgtgtttctttg

SEQ ID NO: 274563 - DNA, 20 bp, Artificial Sequence
  chemically synthesized
cacgaaattgtgtgactgca

SEQ ID NO: 274564 - DNA, 20 bp, Artificial Sequence
  chemically synthesized
ttaattttttatttatttcc

SEQ ID NO: 274565 - DNA, 20 bp, Artificial Sequence
  chemically synthesized
taattttttatttatttcca

SEQ ID NO: 274566 - DNA, 20 bp, Artificial Sequence
  chemically synthesized
aacaacctatgcgtgttcct

SEQ ID NO: 274567 - DNA, 20 bp, Artificial Sequence
  chemically synthesized
ttatttccaaggaacacgca

SEQ ID NO: 274568 - DNA, 20 bp, Artificial Sequence
  chemically synthesized
tatttccaaggaacacgcat

SEQ ID NO: 274569 - DNA, 20 bp, Artificial Sequence
  chemically synthesized
ggttgttacatttttaatca

SEQ ID NO: 274570 - DNA, 20 bp, Artificial Sequence
  chemically synthesized
catttttaatcatagtactt

SEQ ID NO: 274571 - DNA, 20 bp, Artificial Sequence
  chemically synthesized
agaaactaggattatttcca

SEQ ID NO: 274572 - DNA, 20 bp, Artificial Sequence
  chemically synthesized
tagtactttggaaataatcc

SEQ ID NO: 274573 - DNA, 20 bp, Artificial Sequence
  chemically synthesized
tatcttagaaaacagaaact

SEQ ID NO: 274574 - DNA, 20 bp, Artificial Sequence
  chemically synthesized
atatcttagaaaacagaaac

SEQ ID NO: 274575 - DNA, 20 bp, Artificial Sequence
  chemically synthesized
aatcctagtttctgttttct

SEQ ID NO: 274576 - DNA, 20 bp, Artificial Sequence
  chemically synthesized
tggaaatatatcttagaaaa

SEQ ID NO: 274577 - DNA, 20 bp, Artificial Sequence
  chemically synthesized
ctagatatggaaatatatct

SEQ ID NO: 274578 - DNA, 20 bp, Artificial Sequence
  chemically synthesized
ctaagatatatttccatatc

SEQ ID NO: 274579 - DNA, 20 bp, Artificial Sequence
  chemically synthesized
agatatatttccatatctag

SEQ ID NO: 274580 - DNA, 20 bp, Artificial Sequence
  chemically synthesized
ggggaaaactcttctagata

SEQ ID NO: 274581 - DNA, 20 bp, Artificial Sequence
  chemically synthesized
atatatttccatatctagaa

SEQ ID NO: 274582 - DNA, 20 bp, Artificial Sequence
  chemically synthesized
gcaaatggggaaaactcttc

SEQ ID NO: 274583 - DNA, 20 bp, Artificial Sequence
  chemically synthesized
gaaacagaataaagcaaatg

SEQ ID NO: 274584 - DNA, 20 bp, Artificial Sequence
  chemically synthesized
tgaaacagaataaagcaaat

SEQ ID NO: 274585 - DNA, 20 bp, Artificial Sequence
  chemically synthesized
ttgaaacagaataaagcaaa

SEQ ID NO: 274586 - DNA, 20 bp, Artificial Sequence
  chemically synthesized
agatttattgaaacagaata

SEQ ID NO: 274587 - DNA, 20 bp, Artificial Sequence
  chemically synthesized
taagaaaagatttattgaaa

SEQ ID NO: 274588 - DNA, 20 bp, Artificial Sequence
  chemically synthesized
ttaaagtacaaaattaagaa

SEQ ID NO: 274589 - DNA, 20 bp, Artificial Sequence
  chemically synthesized
ttttattaaagtacaaaatt

SEQ ID NO: 274590 - DNA, 20 bp, Artificial Sequence
  chemically synthesized
tttaatgagagattttatta

SEQ ID NO: 274591 - DNA, 20 bp, Artificial Sequence
  chemically synthesized
agtgtcagctcatttaatga

SEQ ID NO: 274592 - DNA, 20 bp, Artificial Sequence
  chemically synthesized
aataaaatctctcattaaat

SEQ ID NO: 274593 - DNA, 20 bp, Artificial Sequence
  chemically synthesized
ccagtgtcagctcatttaat

SEQ ID NO: 274594 - DNA, 20 bp, Artificial Sequence
  chemically synthesized
ctcattaaatgagctgacac

SEQ ID NO: 274595 - DNA, 20 bp, Artificial Sequence
  chemically synthesized
tcattaaatgagctgacact

SEQ ID NO: 274596 - DNA, 20 bp, Artificial Sequence
  chemically synthesized
agcatcaatctacccagtgt

SEQ ID NO: 274597 - DNA, 20 bp, Artificial Sequence
  chemically synthesized
ttaaatgagctgacactggg

SEQ ID NO: 274598 - DNA, 20 bp, Artificial Sequence
  chemically synthesized
ggccacagcatcaatctacc

SEQ ID NO: 274599 - DNA, 20 bp, Artificial Sequence
  chemically synthesized
cactgggtagattgatgctg

SEQ ID NO: 274600 - DNA, 20 bp, Artificial Sequence
  chemically synthesized
taaattaaattatatggcca

SEQ ID NO: 274601 - DNA, 20 bp, Artificial Sequence
  chemically synthesized
cagtcttaaattaaattata

SEQ ID NO: 274602 - DNA, 20 bp, Artificial Sequence
  chemically synthesized
gtggccatataatttaattt

SEQ ID NO: 274603 - DNA, 20 bp, Artificial Sequence
  chemically synthesized
tataatttaatttaagactg

SEQ ID NO: 274604 - DNA, 20 bp, Artificial Sequence
  chemically synthesized
ttaatttaagactgtggtac

SEQ ID NO: 274605 - DNA, 20 bp, Artificial Sequence
  chemically synthesized
acagcatggtactggtacca

SEQ ID NO: 274606 - DNA, 20 bp, Artificial Sequence
  chemically synthesized
taaccaaaacagcatggtac

SEQ ID NO: 274607 - DNA, 20 bp, Artificial Sequence
  chemically synthesized
ctacagtaaccaaaacagca

SEQ ID NO: 274608 - DNA, 20 bp, Artificial Sequence
  chemically synthesized
gtaccagtaccatgctgttt

SEQ ID NO: 274609 - DNA, 20 bp, Artificial Sequence
  chemically synthesized
caaggctacagtaaccaaaa

SEQ ID NO: 274610 - DNA, 20 bp, Artificial Sequence
  chemically synthesized
ccatgctgttttggttactg

SEQ ID NO: 274611 - DNA, 20 bp, Artificial Sequence
  chemically synthesized
caaagtatactacaaggcta

SEQ ID NO: 274612 - DNA, 20 bp, Artificial Sequence
  chemically synthesized
ttttggttactgtagccttg

SEQ ID NO: 274613 - DNA, 20 bp, Artificial Sequence
  chemically synthesized
tgacttcaaagtatactaca

SEQ ID NO: 274614 - DNA, 20 bp, Artificial Sequence
  chemically synthesized
ctgacttcaaagtatactac

SEQ ID NO: 274615 - DNA, 20 bp, Artificial Sequence
  chemically synthesized
tagccttgtagtatactttg

SEQ ID NO: 274616 - DNA, 20 bp, Artificial Sequence
  chemically synthesized
cttgtagtatactttgaagt

SEQ ID NO: 274617 - DNA, 20 bp, Artificial Sequence
  chemically synthesized
ttgtagtatactttgaagtc

SEQ ID NO: 274618 - DNA, 20 bp, Artificial Sequence
  chemically synthesized
catcatgctacctgacttca

SEQ ID NO: 274619 - DNA, 20 bp, Artificial Sequence
  chemically synthesized
tagtatactttgaagtcagg

SEQ ID NO: 274620 - DNA, 20 bp, Artificial Sequence
  chemically synthesized
gtcaggtagcatgatgactc

SEQ ID NO: 274621 - DNA, 20 bp, Artificial Sequence
  chemically synthesized
aagccaaaagaataaagctg

SEQ ID NO: 274622 - DNA, 20 bp, Artificial Sequence
  chemically synthesized
ctaagccaaaagaataaagc

SEQ ID NO: 274623 - DNA, 20 bp, Artificial Sequence
  chemically synthesized
aatcctaagccaaaagaata

SEQ ID NO: 274624 - DNA, 20 bp, Artificial Sequence
  chemically synthesized
tgactccagctttattcttt

SEQ ID NO: 274625 - DNA, 20 bp, Artificial Sequence
  chemically synthesized
ccagctttattcttttggct

SEQ ID NO: 274626 - DNA, 20 bp, Artificial Sequence
  chemically synthesized
cagctttattcttttggctt

SEQ ID NO: 274627 - DNA, 20 bp, Artificial Sequence
  chemically synthesized
ccaagtcaatcctaagccaa

SEQ ID NO: 274628 - DNA, 20 bp, Artificial Sequence
  chemically synthesized
tgcatcgccaagtcaatcct

SEQ ID NO: 274629 - DNA, 20 bp, Artificial Sequence
  chemically synthesized
cttttggcttaggattgact

SEQ ID NO: 274630 - DNA, 20 bp, Artificial Sequence
  chemically synthesized
ttaggattgacttggcgatg

SEQ ID NO: 274631 - DNA, 20 bp, Artificial Sequence
  chemically synthesized
ataaaggagcctgcatcgcc

SEQ ID NO: 274632 - DNA, 20 bp, Artificial Sequence
  chemically synthesized
taggattgacttggcgatgc

SEQ ID NO: 274633 - DNA, 20 bp, Artificial Sequence
  chemically synthesized
tggcgatgcaggctccttta

SEQ ID NO: 274634 - DNA, 20 bp, Artificial Sequence
  chemically synthesized
gttcatatggaaccataaag

SEQ ID NO: 274635 - DNA, 20 bp, Artificial Sequence
  chemically synthesized
aagttcatatggaaccataa

SEQ ID NO: 274636 - DNA, 20 bp, Artificial Sequence
  chemically synthesized
aaagttcatatggaaccata

SEQ ID NO: 274637 - DNA, 20 bp, Artificial Sequence
  chemically synthesized
aaactactttaaagttcata

SEQ ID NO: 274638 - DNA, 20 bp, Artificial Sequence
  chemically synthesized
atggttccatatgaacttta

SEQ ID NO: 274639 - DNA, 20 bp, Artificial Sequence
  chemically synthesized
gttccatatgaactttaaag

SEQ ID NO: 274640 - DNA, 20 bp, Artificial Sequence
  chemically synthesized
aattggaaaaaactacttta

SEQ ID NO: 274641 - DNA, 20 bp, Artificial Sequence
  chemically synthesized
aatgcctttcttcagagaat

SEQ ID NO: 274642 - DNA, 20 bp, Artificial Sequence
  chemically synthesized
tagttttttccaattctctg

SEQ ID NO: 274643 - DNA, 20 bp, Artificial Sequence
  chemically synthesized
tttttccaattctctgaaga

SEQ ID NO: 274644 - DNA, 20 bp, Artificial Sequence
  chemically synthesized
ttttccaattctctgaagaa

SEQ ID NO: 274645 - DNA, 20 bp, Artificial Sequence
  chemically synthesized
gctaccaatgcctttcttca

SEQ ID NO: 274646 - DNA, 20 bp, Artificial Sequence
  chemically synthesized
aagctaccaatgcctttctt

SEQ ID NO: 274647 - DNA, 20 bp, Artificial Sequence
  chemically synthesized
aattctctgaagaaaggcat

SEQ ID NO: 274648 - DNA, 20 bp, Artificial Sequence
  chemically synthesized
tctctgaagaaaggcattgg

SEQ ID NO: 274649 - DNA, 20 bp, Artificial Sequence
  chemically synthesized
gaaaggcattggtagcttga

SEQ ID NO: 274650 - DNA, 20 bp, Artificial Sequence
  chemically synthesized
aaaggcattggtagcttgat

SEQ ID NO: 274651 - DNA, 20 bp, Artificial Sequence
  chemically synthesized
aaggcattggtagcttgatg

SEQ ID NO: 274652 - DNA, 20 bp, Artificial Sequence
  chemically synthesized
gattcaatgccatccccatc

SEQ ID NO: 274653 - DNA, 20 bp, Artificial Sequence
  chemically synthesized
cattggtagcttgatgggga

SEQ ID NO: 274654 - DNA, 20 bp, Artificial Sequence
  chemically synthesized
atactgcccaaggtaattta

SEQ ID NO: 274655 - DNA, 20 bp, Artificial Sequence
  chemically synthesized
attgaatctataaattacct

SEQ ID NO: 274656 - DNA, 20 bp, Artificial Sequence
  chemically synthesized
ttgaatctataaattacctt

SEQ ID NO: 274657 - DNA, 20 bp, Artificial Sequence
  chemically synthesized
aatctataaattaccttggg

SEQ ID NO: 274658 - DNA, 20 bp, Artificial Sequence
  chemically synthesized
gaaaatggccatactgccca

SEQ ID NO: 274659 - DNA, 20 bp, Artificial Sequence
  chemically synthesized
tgaaaatggccatactgccc

SEQ ID NO: 274660 - DNA, 20 bp, Artificial Sequence
  chemically synthesized
ataaattaccttgggcagta

SEQ ID NO: 274661 - DNA, 20 bp, Artificial Sequence
  chemically synthesized
aagtgtcaatatcgtgaaaa

SEQ ID NO: 274662 - DNA, 20 bp, Artificial Sequence
  chemically synthesized
attccatgctcatgggtagg

SEQ ID NO: 274663 - DNA, 20 bp, Artificial Sequence
  chemically synthesized
tattgacacttcctacccat

SEQ ID NO: 274664 - DNA, 20 bp, Artificial Sequence
  chemically synthesized
aacattccatgctcatgggt

SEQ ID NO: 274665 - DNA, 20 bp, Artificial Sequence
  chemically synthesized
gaacattccatgctcatggg

SEQ ID NO: 274666 - DNA, 20 bp, Artificial Sequence
  chemically synthesized
acacttcctacccatgagca

SEQ ID NO: 274667 - DNA, 20 bp, Artificial Sequence
  chemically synthesized
gaagaacattccatgctcat

SEQ ID NO: 274668 - DNA, 20 bp, Artificial Sequence
  chemically synthesized
ggaagaacattccatgctca

SEQ ID NO: 274669 - DNA, 20 bp, Artificial Sequence
  chemically synthesized
aagaggatacaaacaaatgg

SEQ ID NO: 274670 - DNA, 20 bp, Artificial Sequence
  chemically synthesized
taaaagaggatacaaacaaa

SEQ ID NO: 274671 - DNA, 20 bp, Artificial Sequence
  chemically synthesized
actgctcaatgaaataaaag

SEQ ID NO: 274672 - DNA, 20 bp, Artificial Sequence
  chemically synthesized
cactgctcaatgaaataaaa

SEQ ID NO: 274673 - DNA, 20 bp, Artificial Sequence
  chemically synthesized
accactgctcaatgaaataa

SEQ ID NO: 274674 - DNA, 20 bp, Artificial Sequence
  chemically synthesized
gtatcctcttttatttcatt

SEQ ID NO: 274675 - DNA, 20 bp, Artificial Sequence
  chemically synthesized
tcctcttttatttcattgag

SEQ ID NO: 274676 - DNA, 20 bp, Artificial Sequence
  chemically synthesized
tcttttatttcattgagcag

SEQ ID NO: 274677 - DNA, 20 bp, Artificial Sequence
  chemically synthesized
tttcattgagcagtggtttg

SEQ ID NO: 274678 - DNA, 20 bp, Artificial Sequence
  chemically synthesized
gtggtttgtagttctccttg

SEQ ID NO: 274679 - DNA, 20 bp, Artificial Sequence
  chemically synthesized
ggtttgtagttctccttgaa

SEQ ID NO: 274680 - DNA, 20 bp, Artificial Sequence
  chemically synthesized
gtttgtagttctccttgaag

SEQ ID NO: 274681 - DNA, 20 bp, Artificial Sequence
  chemically synthesized
atgtgaaggacctcttcaag

SEQ ID NO: 274682 - DNA, 20 bp, Artificial Sequence
  chemically synthesized
ggatgtgaaggacctcttca

SEQ ID NO: 274683 - DNA, 20 bp, Artificial Sequence
  chemically synthesized
gggatgtgaaggacctcttc

SEQ ID NO: 274684 - DNA, 20 bp, Artificial Sequence
  chemically synthesized
ccaacttacaagggatgtga

SEQ ID NO: 274685 - DNA, 20 bp, Artificial Sequence
  chemically synthesized
tccaacttacaagggatgtg

SEQ ID NO: 274686 - DNA, 20 bp, Artificial Sequence
  chemically synthesized
aggtccttcacatcccttgt

SEQ ID NO: 274687 - DNA, 20 bp, Artificial Sequence
  chemically synthesized
cctaggaatccaacttacaa

SEQ ID NO: 274688 - DNA, 20 bp, Artificial Sequence
  chemically synthesized
ccttcacatcccttgtaagt

SEQ ID NO: 274689 - DNA, 20 bp, Artificial Sequence
  chemically synthesized
acctaggaatccaacttaca

SEQ ID NO: 274690 - DNA, 20 bp, Artificial Sequence
  chemically synthesized
tacctaggaatccaacttac

SEQ ID NO: 274691 - DNA, 20 bp, Artificial Sequence
  chemically synthesized
tcccttgtaagttggattcc

SEQ ID NO: 274692 - DNA, 20 bp, Artificial Sequence
  chemically synthesized
cccttgtaagttggattcct

SEQ ID NO: 274693 - DNA, 20 bp, Artificial Sequence
  chemically synthesized
tcaaagagaataaaatacct

SEQ ID NO: 274694 - DNA, 20 bp, Artificial Sequence
  chemically synthesized
ttcaaagagaataaaatacc

SEQ ID NO: 274695 - DNA, 20 bp, Artificial Sequence
  chemically synthesized
taggtattttattctctttg

SEQ ID NO: 274696 - DNA, 20 bp, Artificial Sequence
  chemically synthesized
ccattcgcaattgcttcaaa

SEQ ID NO: 274697 - DNA, 20 bp, Artificial Sequence
  chemically synthesized
tcccattcgcaattgcttca

SEQ ID NO: 274698 - DNA, 20 bp, Artificial Sequence
  chemically synthesized
ctctttgaagcaattgcgaa

SEQ ID NO: 274699 - DNA, 20 bp, Artificial Sequence
  chemically synthesized
tctttgaagcaattgcgaat

SEQ ID NO: 274700 - DNA, 20 bp, Artificial Sequence
  chemically synthesized
tttgaagcaattgcgaatgg

SEQ ID NO: 274701 - DNA, 20 bp, Artificial Sequence
  chemically synthesized
atgggagttcactcatgatt

SEQ ID NO: 274702 - DNA, 20 bp, Artificial Sequence
  chemically synthesized
caaacagagagccaaatcat

SEQ ID NO: 274703 - DNA, 20 bp, Artificial Sequence
  chemically synthesized
accaataacagacaaacaga

SEQ ID NO: 274704 - DNA, 20 bp, Artificial Sequence
  chemically synthesized
acaccaataacagacaaaca

SEQ ID NO: 274705 - DNA, 20 bp, Artificial Sequence
  chemically synthesized
atacaccaataacagacaaa

SEQ ID NO: 274706 - DNA, 20 bp, Artificial Sequence
  chemically synthesized
gctctctgtttgtctgttat

SEQ ID NO: 274707 - DNA, 20 bp, Artificial Sequence
  chemically synthesized
gcattcttatacaccaataa

SEQ ID NO: 274708 - DNA, 20 bp, Artificial Sequence
  chemically synthesized
tttgtctgttattggtgtat

SEQ ID NO: 274709 - DNA, 20 bp, Artificial Sequence
  chemically synthesized
aatcaatgtgcaaaaatcac

SEQ ID NO: 274710 - DNA, 20 bp, Artificial Sequence
  chemically synthesized
gcacattgattttgcatgct

SEQ ID NO: 274711 - DNA, 20 bp, Artificial Sequence
  chemically synthesized
aagcaacttcagcaaagtct

SEQ ID NO: 274712 - DNA, 20 bp, Artificial Sequence
  chemically synthesized
tgcatgctgagactttgctg

SEQ ID NO: 274713 - DNA, 20 bp, Artificial Sequence
  chemically synthesized
gctgataagcaacttcagca

SEQ ID NO: 274714 - DNA, 20 bp, Artificial Sequence
  chemically synthesized
cttaagctgataagcaactt

SEQ ID NO: 274715 - DNA, 20 bp, Artificial Sequence
  chemically synthesized
actttgctgaagttgcttat

SEQ ID NO: 274716 - DNA, 20 bp, Artificial Sequence
  chemically synthesized
caaaatctccttaagctgat

SEQ ID NO: 274717 - DNA, 20 bp, Artificial Sequence
  chemically synthesized
ctgaagttgcttatcagctt

SEQ ID NO: 274718 - DNA, 20 bp, Artificial Sequence
  chemically synthesized
tgaagttgcttatcagctta

SEQ ID NO: 274719 - DNA, 20 bp, Artificial Sequence
  chemically synthesized
aagttgcttatcagcttaag

SEQ ID NO: 274720 - DNA, 20 bp, Artificial Sequence
  chemically synthesized
tctcagcccaaaatctcctt

SEQ ID NO: 274721 - DNA, 20 bp, Artificial Sequence
  chemically synthesized
ttatcagcttaaggagattt

SEQ ID NO: 274722 - DNA, 20 bp, Artificial Sequence
  chemically synthesized
tatcagcttaaggagatttt

SEQ ID NO: 274723 - DNA, 20 bp, Artificial Sequence
  chemically synthesized
gcttaaggagattttgggct

SEQ ID NO: 274724 - DNA, 20 bp, Artificial Sequence
  chemically synthesized
gagattttgggctgagacaa

SEQ ID NO: 274725 - DNA, 20 bp, Artificial Sequence
  chemically synthesized
agattttgggctgagacaat

SEQ ID NO: 274726 - DNA, 20 bp, Artificial Sequence
  chemically synthesized
tctagaaaaccccattgtct

SEQ ID NO: 274727 - DNA, 20 bp, Artificial Sequence
  chemically synthesized
gattttgggctgagacaatg

SEQ ID NO: 274728 - DNA, 20 bp, Artificial Sequence
  chemically synthesized
gctgagacaatggggttttc

SEQ ID NO: 274729 - DNA, 20 bp, Artificial Sequence
  chemically synthesized
agatgacatgattgtatatc

SEQ ID NO: 274730 - DNA, 20 bp, Artificial Sequence
  chemically synthesized
acaatcatgtcatctgcaaa

SEQ ID NO: 274731 - DNA, 20 bp, Artificial Sequence
  chemically synthesized
caatcatgtcatctgcaaac

SEQ ID NO: 274732 - DNA, 20 bp, Artificial Sequence
  chemically synthesized
agtcaaattgttcctgtttg

SEQ ID NO: 274733 - DNA, 20 bp, Artificial Sequence
  chemically synthesized
tattcaatcaggaaaagagg

SEQ ID NO: 274734 - DNA, 20 bp, Artificial Sequence
  chemically synthesized
gggtattcaatcaggaaaag

SEQ ID NO: 274735 - DNA, 20 bp, Artificial Sequence
  chemically synthesized
agggtattcaatcaggaaaa

SEQ ID NO: 274736 - DNA, 20 bp, Artificial Sequence
  chemically synthesized
aaagggtattcaatcaggaa

SEQ ID NO: 274737 - DNA, 20 bp, Artificial Sequence
  chemically synthesized
gaaataaagggtattcaatc

SEQ ID NO: 274738 - DNA, 20 bp, Artificial Sequence
  chemically synthesized
ggaaataaagggtattcaat

SEQ ID NO: 274739 - DNA, 20 bp, Artificial Sequence
  chemically synthesized
aggcaggagaaggaaataaa

SEQ ID NO: 274740 - DNA, 20 bp, Artificial Sequence
  chemically synthesized
taggcaggagaaggaaataa

SEQ ID NO: 274741 - DNA, 20 bp, Artificial Sequence
  chemically synthesized
ttaggcaggagaaggaaata

SEQ ID NO: 274742 - DNA, 20 bp, Artificial Sequence
  chemically synthesized
cagggcaattaggcaggaga

SEQ ID NO: 274743 - DNA, 20 bp, Artificial Sequence
  chemically synthesized
ccagggcaattaggcaggag

SEQ ID NO: 274744 - DNA, 20 bp, Artificial Sequence
  chemically synthesized
tggccagggcaattaggcag

SEQ ID NO: 274745 - DNA, 20 bp, Artificial Sequence
  chemically synthesized
tctggccagggcaattaggc

SEQ ID NO: 274746 - DNA, 20 bp, Artificial Sequence
  chemically synthesized
ttctggccagggcaattagg

SEQ ID NO: 274747 - DNA, 20 bp, Artificial Sequence
  chemically synthesized
aagttctggccagggcaatt

SEQ ID NO: 274748 - DNA, 20 bp, Artificial Sequence
  chemically synthesized
cttctcctgcctaattgccc

SEQ ID NO: 274749 - DNA, 20 bp, Artificial Sequence
  chemically synthesized
gaagttctggccagggcaat

SEQ ID NO: 274750 - DNA, 20 bp, Artificial Sequence
  chemically synthesized
tcctgcctaattgccctggc

SEQ ID NO: 274751 - DNA, 20 bp, Artificial Sequence
  chemically synthesized
actgttggaagttctggcca

SEQ ID NO: 274752 - DNA, 20 bp, Artificial Sequence
  chemically synthesized
tactgttggaagttctggcc

SEQ ID NO: 274753 - DNA, 20 bp, Artificial Sequence
  chemically synthesized
atactgttggaagttctggc

SEQ ID NO: 274754 - DNA, 20 bp, Artificial Sequence
  chemically synthesized
caacatactgttggaagttc

SEQ ID NO: 274755 - DNA, 20 bp, Artificial Sequence
  chemically synthesized
gccctggccagaacttccaa

SEQ ID NO: 274756 - DNA, 20 bp, Artificial Sequence
  chemically synthesized
cctattcaacatactgttgg

SEQ ID NO: 274757 - DNA, 20 bp, Artificial Sequence
  chemically synthesized
gctcctattcaacatactgt

SEQ ID NO: 274758 - DNA, 20 bp, Artificial Sequence
  chemically synthesized
acttccaacagtatgttgaa

SEQ ID NO: 274759 - DNA, 20 bp, Artificial Sequence
  chemically synthesized
cttccaacagtatgttgaat

SEQ ID NO: 274760 - DNA, 20 bp, Artificial Sequence
  chemically synthesized
tccaacagtatgttgaatag

SEQ ID NO: 274761 - DNA, 20 bp, Artificial Sequence
  chemically synthesized
aacagtatgttgaataggag

SEQ ID NO: 274762 - DNA, 20 bp, Artificial Sequence
  chemically synthesized
gtatgttgaataggagcagt

SEQ ID NO: 274763 - DNA, 20 bp, Artificial Sequence
  chemically synthesized
atgttgaataggagcagtga

SEQ ID NO: 274764 - DNA, 20 bp, Artificial Sequence
  chemically synthesized
gttgaataggagcagtgaga

SEQ ID NO: 274765 - DNA, 20 bp, Artificial Sequence
  chemically synthesized
ttgaataggagcagtgagag

SEQ ID NO: 274766 - DNA, 20 bp, Artificial Sequence
  chemically synthesized
tgaataggagcagtgagaga

SEQ ID NO: 274767 - DNA, 20 bp, Artificial Sequence
  chemically synthesized
tgaaaactggcacaagacag

SEQ ID NO: 274768 - DNA, 20 bp, Artificial Sequence
  chemically synthesized
ttgaaaactggcacaagaca

SEQ ID NO: 274769 - DNA, 20 bp, Artificial Sequence
  chemically synthesized
tttgaaaactggcacaagac

SEQ ID NO: 274770 - DNA, 20 bp, Artificial Sequence
  chemically synthesized
ctttgaaaactggcacaaga

SEQ ID NO: 274771 - DNA, 20 bp, Artificial Sequence
  chemically synthesized
agggcacccctgtcttgtgc

SEQ ID NO: 274772 - DNA, 20 bp, Artificial Sequence
  chemically synthesized
ttccctttgaaaactggcac

SEQ ID NO: 274773 - DNA, 20 bp, Artificial Sequence
  chemically synthesized
ctgtcttgtgccagttttca

SEQ ID NO: 274774 - DNA, 20 bp, Artificial Sequence
  chemically synthesized
gaagcattccctttgaaaac

SEQ ID NO: 274775 - DNA, 20 bp, Artificial Sequence
  chemically synthesized
tgtcttgtgccagttttcaa

SEQ ID NO: 274776 - DNA, 20 bp, Artificial Sequence
  chemically synthesized
gtcttgtgccagttttcaaa

SEQ ID NO: 274777 - DNA, 20 bp, Artificial Sequence
  chemically synthesized
gttttcaaagggaatgcttc

SEQ ID NO: 274778 - DNA, 20 bp, Artificial Sequence
  chemically synthesized
actgaatgggcaaaaactgg

SEQ ID NO: 274779 - DNA, 20 bp, Artificial Sequence
  chemically synthesized
catactgaatgggcaaaaac

SEQ ID NO: 274780 - DNA, 20 bp, Artificial Sequence
  chemically synthesized
gcttccagtttttgcccatt

SEQ ID NO: 274781 - DNA, 20 bp, Artificial Sequence
  chemically synthesized
cagccaatatcatactgaat

SEQ ID NO: 274782 - DNA, 20 bp, Artificial Sequence
  chemically synthesized
acagccaatatcatactgaa

SEQ ID NO: 274783 - DNA, 20 bp, Artificial Sequence
  chemically synthesized
ttgcccattcagtatgatat

SEQ ID NO: 274784 - DNA, 20 bp, Artificial Sequence
  chemically synthesized
attcagtatgatattggctg

SEQ ID NO: 274785 - DNA, 20 bp, Artificial Sequence
  chemically synthesized
ttcagtatgatattggctgt

SEQ ID NO: 274786 - DNA, 20 bp, Artificial Sequence
  chemically synthesized
agctatctatgatgaaccca

SEQ ID NO: 274787 - DNA, 20 bp, Artificial Sequence
  chemically synthesized
tattggctgtgggttcatca

SEQ ID NO: 274788 - DNA, 20 bp, Artificial Sequence
  chemically synthesized
ggctgtgggttcatcataga

SEQ ID NO: 274789 - DNA, 20 bp, Artificial Sequence
  chemically synthesized
gacaaatctcaaaataataa

SEQ ID NO: 274790 - DNA, 20 bp, Artificial Sequence
  chemically synthesized
gggacaaatctcaaaataat

SEQ ID NO: 274791 - DNA, 20 bp, Artificial Sequence
  chemically synthesized
tagatagctcttattatttt

SEQ ID NO: 274792 - DNA, 20 bp, Artificial Sequence
  chemically synthesized
tcaataaattaggtattgat

SEQ ID NO: 274793 - DNA, 20 bp, Artificial Sequence
  chemically synthesized
ctcaataaattaggtattga

SEQ ID NO: 274794 - DNA, 20 bp, Artificial Sequence
  chemically synthesized
ctaaaaattctcaataaatt

SEQ ID NO: 274795 - DNA, 20 bp, Artificial Sequence
  chemically synthesized
ccatcaatacctaatttatt

SEQ ID NO: 274796 - DNA, 20 bp, Artificial Sequence
  chemically synthesized
gctaaaaattctcaataaat

SEQ ID NO: 274797 - DNA, 20 bp, Artificial Sequence
  chemically synthesized
cctaatttattgagaatttt

SEQ ID NO: 274798 - DNA, 20 bp, Artificial Sequence
  chemically synthesized
ttattgagaatttttagcat

SEQ ID NO: 274799 - DNA, 20 bp, Artificial Sequence
  chemically synthesized
tattgagaatttttagcatg

SEQ ID NO: 274800 - DNA, 20 bp, Artificial Sequence
  chemically synthesized
attgagaatttttagcatga

SEQ ID NO: 274801 - DNA, 20 bp, Artificial Sequence
  chemically synthesized
ttgagaatttttagcatgag

SEQ ID NO: 274802 - DNA, 20 bp, Artificial Sequence
  chemically synthesized
agaatttttagcatgagggg

SEQ ID NO: 274803 - DNA, 20 bp, Artificial Sequence
  chemically synthesized
ggggtagttgaatattgtca

SEQ ID NO: 274804 - DNA, 20 bp, Artificial Sequence
  chemically synthesized
gggtagttgaatattgtcaa

SEQ ID NO: 274805 - DNA, 20 bp, Artificial Sequence
  chemically synthesized
atattgtcaaaggccttttc

SEQ ID NO: 274806 - DNA, 20 bp, Artificial Sequence
  chemically synthesized
tatctcaatagatccagaaa

SEQ ID NO: 274807 - DNA, 20 bp, Artificial Sequence
  chemically synthesized
ttatctcaatagatccagaa

SEQ ID NO: 274808 - DNA, 20 bp, Artificial Sequence
  chemically synthesized
catgattatctcaatagatc

SEQ ID NO: 274809 - DNA, 20 bp, Artificial Sequence
  chemically synthesized
aggccttttctggatctatt

SEQ ID NO: 274810 - DNA, 20 bp, Artificial Sequence
  chemically synthesized
ataccacatgattatctcaa

SEQ ID NO: 274811 - DNA, 20 bp, Artificial Sequence
  chemically synthesized
gatctattgagataatcatg

SEQ ID NO: 274812 - DNA, 20 bp, Artificial Sequence
  chemically synthesized
aatcatgtggtatttgtgat

SEQ ID NO: 274813 - DNA, 20 bp, Artificial Sequence
  chemically synthesized
aacgtaatccagcatataaa

SEQ ID NO: 274814 - DNA, 20 bp, Artificial Sequence
  chemically synthesized
gattggttctgtttatatgc

SEQ ID NO: 274815 - DNA, 20 bp, Artificial Sequence
  chemically synthesized
gcaaatcaataaacgtaatc

SEQ ID NO: 274816 - DNA, 20 bp, Artificial Sequence
  chemically synthesized
ttgatttgcatatattgaac

SEQ ID NO: 274817 - DNA, 20 bp, Artificial Sequence
  chemically synthesized
tcatccctgggatgcaaggc

SEQ ID NO: 274818 - DNA, 20 bp, Artificial Sequence
  chemically synthesized
attgaaccagccttgcatcc

SEQ ID NO: 274819 - DNA, 20 bp, Artificial Sequence
  chemically synthesized
ggcttcatccctgggatgca

SEQ ID NO: 274820 - DNA, 20 bp, Artificial Sequence
  chemically synthesized
ttgaaccagccttgcatccc

SEQ ID NO: 274821 - DNA, 20 bp, Artificial Sequence
  chemically synthesized
gggcttcatccctgggatgc

SEQ ID NO: 274822 - DNA, 20 bp, Artificial Sequence
  chemically synthesized
tgaaccagccttgcatccca

SEQ ID NO: 274823 - DNA, 20 bp, Artificial Sequence
  chemically synthesized
agccttgcatcccagggatg

SEQ ID NO: 274824 - DNA, 20 bp, Artificial Sequence
  chemically synthesized
accaagtgggcttcatccct

SEQ ID NO: 274825 - DNA, 20 bp, Artificial Sequence
  chemically synthesized
gaccaagtgggcttcatccc

SEQ ID NO: 274826 - DNA, 20 bp, Artificial Sequence
  chemically synthesized
tcccagggatgaagcccact

SEQ ID NO: 274827 - DNA, 20 bp, Artificial Sequence
  chemically synthesized
cttatgcaccatgaccaagt

SEQ ID NO: 274828 - DNA, 20 bp, Artificial Sequence
  chemically synthesized
gcttatgcaccatgaccaag

SEQ ID NO: 274829 - DNA, 20 bp, Artificial Sequence
  chemically synthesized
ggatgaagcccacttggtca

SEQ ID NO: 274830 - DNA, 20 bp, Artificial Sequence
  chemically synthesized
aaagcttatgcaccatgacc

SEQ ID NO: 274831 - DNA, 20 bp, Artificial Sequence
  chemically synthesized
cccacttggtcatggtgcat

SEQ ID NO: 274832 - DNA, 20 bp, Artificial Sequence
  chemically synthesized
gaatccagcagcacatcaaa

SEQ ID NO: 274833 - DNA, 20 bp, Artificial Sequence
  chemically synthesized
taagctttttgatgtgctgc

SEQ ID NO: 274834 - DNA, 20 bp, Artificial Sequence
  chemically synthesized
ttttgatgtgctgctggatt

SEQ ID NO: 274835 - DNA, 20 bp, Artificial Sequence
  chemically synthesized
tactggcaaaccgaatccag

SEQ ID NO: 274836 - DNA, 20 bp, Artificial Sequence
  chemically synthesized
aaatactggcaaaccgaatc

SEQ ID NO: 274837 - DNA, 20 bp, Artificial Sequence
  chemically synthesized
tgctgctggattcggtttgc

SEQ ID NO: 274838 - DNA, 20 bp, Artificial Sequence
  chemically synthesized
aaaaatcctcaataaaatac

SEQ ID NO: 274839 - DNA, 20 bp, Artificial Sequence
  chemically synthesized
cggtttgccagtattttatt

SEQ ID NO: 274840 - DNA, 20 bp, Artificial Sequence
  chemically synthesized
ggtttgccagtattttattg

SEQ ID NO: 274841 - DNA, 20 bp, Artificial Sequence
  chemically synthesized
atttttgcatcgatgttcat

SEQ ID NO: 274842 - DNA, 20 bp, Artificial Sequence
  chemically synthesized
tttttgcatcgatgttcatc

SEQ ID NO: 274843 - DNA, 20 bp, Artificial Sequence
  chemically synthesized
ttttgcatcgatgttcatca

SEQ ID NO: 274844 - DNA, 20 bp, Artificial Sequence
  chemically synthesized
tcgatgttcatcagggatat

SEQ ID NO: 274845 - DNA, 20 bp, Artificial Sequence
  chemically synthesized
tatacagaaaaagagaattt

SEQ ID NO: 274846 - DNA, 20 bp, Artificial Sequence
  chemically synthesized
ccttgtaatatacagaaaaa

SEQ ID NO: 274847 - DNA, 20 bp, Artificial Sequence
  chemically synthesized
agccttgtaatatacagaaa

SEQ ID NO: 274848 - DNA, 20 bp, Artificial Sequence
  chemically synthesized
tactgtagccttgtaatata

SEQ ID NO: 274849 - DNA, 20 bp, Artificial Sequence
  chemically synthesized
tctctttttctgtatattac

SEQ ID NO: 274850 - DNA, 20 bp, Artificial Sequence
  chemically synthesized
ctctttttctgtatattaca

SEQ ID NO: 274851 - DNA, 20 bp, Artificial Sequence
  chemically synthesized
ttctgtatattacaaggcta

SEQ ID NO: 274852 - DNA, 20 bp, Artificial Sequence
  chemically synthesized
ccatgctgttttggttactg

SEQ ID NO: 274853 - DNA, 20 bp, Artificial Sequence
  chemically synthesized
caaggctacagtaaccaaaa

SEQ ID NO: 274854 - DNA, 20 bp, Artificial Sequence
  chemically synthesized
gtaccagtaccatgctgttt

SEQ ID NO: 274855 - DNA, 20 bp, Artificial Sequence
  chemically synthesized
ctacagtaaccaaaacagca

SEQ ID NO: 274856 - DNA, 20 bp, Artificial Sequence
  chemically synthesized
taaccaaaacagcatggtac

SEQ ID NO: 274857 - DNA, 20 bp, Artificial Sequence
  chemically synthesized
ctatatctctgttttggtac

SEQ ID NO: 274858 - DNA, 20 bp, Artificial Sequence
  chemically synthesized
gcatggtactggtaccaaaa

SEQ ID NO: 274859 - DNA, 20 bp, Artificial Sequence
  chemically synthesized
atggtactggtaccaaaaca

SEQ ID NO: 274860 - DNA, 20 bp, Artificial Sequence
  chemically synthesized
attgatctatatctctgttt

SEQ ID NO: 274861 - DNA, 20 bp, Artificial Sequence
  chemically synthesized
ctggtaccaaaacagagata

SEQ ID NO: 274862 - DNA, 20 bp, Artificial Sequence
  chemically synthesized
aaaacagagatatagatcaa

SEQ ID NO: 274863 - DNA, 20 bp, Artificial Sequence
  chemically synthesized
agagatatagatcaatggaa

SEQ ID NO: 274864 - DNA, 20 bp, Artificial Sequence
  chemically synthesized
tagatcaatggaacagaaca

SEQ ID NO: 274865 - DNA, 20 bp, Artificial Sequence
  chemically synthesized
atatgtggcattatttatga

SEQ ID NO: 274866 - DNA, 20 bp, Artificial Sequence
  chemically synthesized
gatatgtggcattatttatg

SEQ ID NO: 274867 - DNA, 20 bp, Artificial Sequence
  chemically synthesized
agatatgtggcattatttat

SEQ ID NO: 274868 - DNA, 20 bp, Artificial Sequence
  chemically synthesized
atcagatagttgtagatatg

SEQ ID NO: 274869 - DNA, 20 bp, Artificial Sequence
  chemically synthesized
tgtcaaagatcagatagttg

SEQ ID NO: 274870 - DNA, 20 bp, Artificial Sequence
  chemically synthesized
gaggtttgtcaaagatcaga

SEQ ID NO: 274871 - DNA, 20 bp, Artificial Sequence
  chemically synthesized
ttgtgaggtttgtcaaagat

SEQ ID NO: 274872 - DNA, 20 bp, Artificial Sequence
  chemically synthesized
tgtttttgtgaggtttgtca

SEQ ID NO: 274873 - DNA, 20 bp, Artificial Sequence
  chemically synthesized
ccccatttcttgtttttgtg

SEQ ID NO: 274874 - DNA, 20 bp, Artificial Sequence
  chemically synthesized
tccccatttcttgtttttgt

SEQ ID NO: 274875 - DNA, 20 bp, Artificial Sequence
  chemically synthesized
ttgacaaacctcacaaaaac

SEQ ID NO: 274876 - DNA, 20 bp, Artificial Sequence
  chemically synthesized
aacctcacaaaaacaagaaa

SEQ ID NO: 274877 - DNA, 20 bp, Artificial Sequence
  chemically synthesized
acctcacaaaaacaagaaat

SEQ ID NO: 274878 - DNA, 20 bp, Artificial Sequence
  chemically synthesized
cctcacaaaaacaagaaatg

SEQ ID NO: 274879 - DNA, 20 bp, Artificial Sequence
  chemically synthesized
ccagcaccatttattaaata

SEQ ID NO: 274880 - DNA, 20 bp, Artificial Sequence
  chemically synthesized
cccagcaccatttattaaat

SEQ ID NO: 274881 - DNA, 20 bp, Artificial Sequence
  chemically synthesized
tcccagcaccatttattaaa

SEQ ID NO: 274882 - DNA, 20 bp, Artificial Sequence
  chemically synthesized
acgattccctatttaataaa

SEQ ID NO: 274883 - DNA, 20 bp, Artificial Sequence
  chemically synthesized
ccctatttaataaatggtgc

SEQ ID NO: 274884 - DNA, 20 bp, Artificial Sequence
  chemically synthesized
cctatttaataaatggtgct

SEQ ID NO: 274885 - DNA, 20 bp, Artificial Sequence
  chemically synthesized
ataaatggtgctgggaaaac

SEQ ID NO: 274886 - DNA, 20 bp, Artificial Sequence
  chemically synthesized
atatggctagccagttttcc

SEQ ID NO: 274887 - DNA, 20 bp, Artificial Sequence
  chemically synthesized
atggtgctgggaaaactggc

SEQ ID NO: 274888 - DNA, 20 bp, Artificial Sequence
  chemically synthesized
gctttctacatatggctagc

SEQ ID NO: 274889 - DNA, 20 bp, Artificial Sequence
  chemically synthesized
ttcagctttctacatatggc

SEQ ID NO: 274890 - DNA, 20 bp, Artificial Sequence
  chemically synthesized
gaaaactggctagccatatg

SEQ ID NO: 274891 - DNA, 20 bp, Artificial Sequence
  chemically synthesized
cagtttcagctttctacata

SEQ ID NO: 274892 - DNA, 20 bp, Artificial Sequence
  chemically synthesized
actggctagccatatgtaga

SEQ ID NO: 274893 - DNA, 20 bp, Artificial Sequence
  chemically synthesized
catatgtagaaagctgaaac

SEQ ID NO: 274894 - DNA, 20 bp, Artificial Sequence
  chemically synthesized
gtaaggaagggatccagttt

SEQ ID NO: 274895 - DNA, 20 bp, Artificial Sequence
  chemically synthesized
taaggtgtaaggaagggatc

SEQ ID NO: 274896 - DNA, 20 bp, Artificial Sequence
  chemically synthesized
tttgtataaggtgtaaggaa

SEQ ID NO: 274897 - DNA, 20 bp, Artificial Sequence
  chemically synthesized
ttttgtataaggtgtaagga

SEQ ID NO: 274898 - DNA, 20 bp, Artificial Sequence
  chemically synthesized
tttttgtataaggtgtaagg

SEQ ID NO: 274899 - DNA, 20 bp, Artificial Sequence
  chemically synthesized
taatttttgtataaggtgta

SEQ ID NO: 274900 - DNA, 20 bp, Artificial Sequence
  chemically synthesized
ttaatttttgtataaggtgt

SEQ ID NO: 274901 - DNA, 20 bp, Artificial Sequence
  chemically synthesized
cttgagttaatttttgtata

SEQ ID NO: 274902 - DNA, 20 bp, Artificial Sequence
  chemically synthesized
tcttgagttaatttttgtat

SEQ ID NO: 274903 - DNA, 20 bp, Artificial Sequence
  chemically synthesized
ccttatacaaaaattaactc

SEQ ID NO: 274904 - DNA, 20 bp, Artificial Sequence
  chemically synthesized
atacaaaaattaactcaaga

SEQ ID NO: 274905 - DNA, 20 bp, Artificial Sequence
  chemically synthesized
gtaagtctttaatccatctt

SEQ ID NO: 274906 - DNA, 20 bp, Artificial Sequence
  chemically synthesized
aattaactcaagatggatta

SEQ ID NO: 274907 - DNA, 20 bp, Artificial Sequence
  chemically synthesized
tggattaaagacttacatgt

SEQ ID NO: 274908 - DNA, 20 bp, Artificial Sequence
  chemically synthesized
tggttttaagtctaacatgt

SEQ ID NO: 274909 - DNA, 20 bp, Artificial Sequence
  chemically synthesized
tctagggtttttatggtttt

SEQ ID NO: 274910 - DNA, 20 bp, Artificial Sequence
  chemically synthesized
gttttcttctagggttttta

SEQ ID NO: 274911 - DNA, 20 bp, Artificial Sequence
  chemically synthesized
acttaaaaccataaaaaccc

SEQ ID NO: 274912 - DNA, 20 bp, Artificial Sequence
  chemically synthesized
taaaaccataaaaaccctag

SEQ ID NO: 274913 - DNA, 20 bp, Artificial Sequence
  chemically synthesized
aatgcctaggttttcttcta

SEQ ID NO: 274914 - DNA, 20 bp, Artificial Sequence
  chemically synthesized
taatgcctaggttttcttct

SEQ ID NO: 274915 - DNA, 20 bp, Artificial Sequence
  chemically synthesized
gtaatgcctaggttttcttc

SEQ ID NO: 274916 - DNA, 20 bp, Artificial Sequence
  chemically synthesized
aaaaaccctagaagaaaacc

SEQ ID NO: 274917 - DNA, 20 bp, Artificial Sequence
  chemically synthesized
aaaaccctagaagaaaacct

SEQ ID NO: 274918 - DNA, 20 bp, Artificial Sequence
  chemically synthesized
tgtcctgaatggtaatgcct

SEQ ID NO: 274919 - DNA, 20 bp, Artificial Sequence
  chemically synthesized
atgtcctgaatggtaatgcc

SEQ ID NO: 274920 - DNA, 20 bp, Artificial Sequence
  chemically synthesized
aaaacctaggcattaccatt

SEQ ID NO: 274921 - DNA, 20 bp, Artificial Sequence
  chemically synthesized
aaacctaggcattaccattc

SEQ ID NO: 274922 - DNA, 20 bp, Artificial Sequence
  chemically synthesized
gcccgtgcctatgtcctgaa

SEQ ID NO: 274923 - DNA, 20 bp, Artificial Sequence
  chemically synthesized
aggcattaccattcaggaca

SEQ ID NO: 274924 - DNA, 20 bp, Artificial Sequence
  chemically synthesized
ggcattaccattcaggacat

SEQ ID NO: 274925 - DNA, 20 bp, Artificial Sequence
  chemically synthesized
taccattcaggacataggca

SEQ ID NO: 274926 - DNA, 20 bp, Artificial Sequence
  chemically synthesized
accattcaggacataggcac

SEQ ID NO: 274927 - DNA, 20 bp, Artificial Sequence
  chemically synthesized
ttcaggacataggcacgggc

SEQ ID NO: 274928 - DNA, 20 bp, Artificial Sequence
  chemically synthesized
tcaggacataggcacgggca

SEQ ID NO: 274929 - DNA, 20 bp, Artificial Sequence
  chemically synthesized
cttttgttgttttcgtcatg

SEQ ID NO: 274930 - DNA, 20 bp, Artificial Sequence
  chemically synthesized
cttcatgacgaaaacaacaa

SEQ ID NO: 274931 - DNA, 20 bp, Artificial Sequence
  chemically synthesized
gacgaaaacaacaaaagcaa

SEQ ID NO: 274932 - DNA, 20 bp, Artificial Sequence
  chemically synthesized
aacaaaagcaatggcaacaa

SEQ ID NO: 274933 - DNA, 20 bp, Artificial Sequence
  chemically synthesized
tagatcccatttgtcaattt

SEQ ID NO: 274934 - DNA, 20 bp, Artificial Sequence
  chemically synthesized
caaaagccaaaattgacaaa

SEQ ID NO: 274935 - DNA, 20 bp, Artificial Sequence
  chemically synthesized
aaaagccaaaattgacaaat

SEQ ID NO: 274936 - DNA, 20 bp, Artificial Sequence
  chemically synthesized
cagaagctctttagtttaat

SEQ ID NO: 274937 - DNA, 20 bp, Artificial Sequence
  chemically synthesized
aatgggatctaattaaacta

SEQ ID NO: 274938 - DNA, 20 bp, Artificial Sequence
  chemically synthesized
tgggatctaattaaactaaa

SEQ ID NO: 274939 - DNA, 20 bp, Artificial Sequence
  chemically synthesized
tttgctgtgcagaagctctt

SEQ ID NO: 274940 - DNA, 20 bp, Artificial Sequence
  chemically synthesized
taaactaaagagcttctgca

SEQ ID NO: 274941 - DNA, 20 bp, Artificial Sequence
  chemically synthesized
tagtttcttttgctgtgcag

SEQ ID NO: 274942 - DNA, 20 bp, Artificial Sequence
  chemically synthesized
tggtagtttcttttgctgtg

SEQ ID NO: 274943 - DNA, 20 bp, Artificial Sequence
  chemically synthesized
aaagagcttctgcacagcaa

SEQ ID NO: 274944 - DNA, 20 bp, Artificial Sequence
  chemically synthesized
acagcaaaagaaactaccat

SEQ ID NO: 274945 - DNA, 20 bp, Artificial Sequence
  chemically synthesized
agcaaaagaaactaccatca

SEQ ID NO: 274946 - DNA, 20 bp, Artificial Sequence
  chemically synthesized
ttgcctgttcactctgatgg

SEQ ID NO: 274947 - DNA, 20 bp, Artificial Sequence
  chemically synthesized
aggttgcctgttcactctga

SEQ ID NO: 274948 - DNA, 20 bp, Artificial Sequence
  chemically synthesized
gaaactaccatcagagtgaa

SEQ ID NO: 274949 - DNA, 20 bp, Artificial Sequence
  chemically synthesized
aaactaccatcagagtgaac

SEQ ID NO: 274950 - DNA, 20 bp, Artificial Sequence
  chemically synthesized
cagagtgaacaggcaaccta

SEQ ID NO: 274951 - DNA, 20 bp, Artificial Sequence
  chemically synthesized
tgaacaggcaacctacagaa

SEQ ID NO: 274952 - DNA, 20 bp, Artificial Sequence
  chemically synthesized
gaacaggcaacctacagaat

SEQ ID NO: 274953 - DNA, 20 bp, Artificial Sequence
  chemically synthesized
aaaatcttctcccattctgt

SEQ ID NO: 274954 - DNA, 20 bp, Artificial Sequence
  chemically synthesized
gaaaatcttctcccattctg

SEQ ID NO: 274955 - DNA, 20 bp, Artificial Sequence
  chemically synthesized
acaggcaacctacagaatgg

SEQ ID NO: 274956 - DNA, 20 bp, Artificial Sequence
  chemically synthesized
ggcaacctacagaatgggag

SEQ ID NO: 274957 - DNA, 20 bp, Artificial Sequence
  chemically synthesized
tagccctttgtcagaggagt

SEQ ID NO: 274958 - DNA, 20 bp, Artificial Sequence
  chemically synthesized
ttagccctttgtcagaggag

SEQ ID NO: 274959 - DNA, 20 bp, Artificial Sequence
  chemically synthesized
atattagccctttgtcagag

SEQ ID NO: 274960 - DNA, 20 bp, Artificial Sequence
  chemically synthesized
cgcaacctactcctctgaca

SEQ ID NO: 274961 - DNA, 20 bp, Artificial Sequence
  chemically synthesized
gcaacctactcctctgacaa

SEQ ID NO: 274962 - DNA, 20 bp, Artificial Sequence
  chemically synthesized
ggatattagccctttgtcag

SEQ ID NO: 274963 - DNA, 20 bp, Artificial Sequence
  chemically synthesized
caacctactcctctgacaaa

SEQ ID NO: 274964 - DNA, 20 bp, Artificial Sequence
  chemically synthesized
tggatattagccctttgtca

SEQ ID NO: 274965 - DNA, 20 bp, Artificial Sequence
  chemically synthesized
tctggatattagccctttgt

SEQ ID NO: 274966 - DNA, 20 bp, Artificial Sequence
  chemically synthesized
tctgacaaagggctaatatc

SEQ ID NO: 274967 - DNA, 20 bp, Artificial Sequence
  chemically synthesized
tcattgtagattctggatat

SEQ ID NO: 274968 - DNA, 20 bp, Artificial Sequence
  chemically synthesized
tttgagttcattgtagattc

SEQ ID NO: 274969 - DNA, 20 bp, Artificial Sequence
  chemically synthesized
acatttgtttgagttcattg

SEQ ID NO: 274970 - DNA, 20 bp, Artificial Sequence
  chemically synthesized
tttttcttgtacatttgttt

SEQ ID NO: 274971 - DNA, 20 bp, Artificial Sequence
  chemically synthesized
atgaactcaaacaaatgtac

SEQ ID NO: 274972 - DNA, 20 bp, Artificial Sequence
  chemically synthesized
caaacaaatgtacaagaaaa

SEQ ID NO: 274973 - DNA, 20 bp, Artificial Sequence
  chemically synthesized
aagcaaacaaccccatcaac

SEQ ID NO: 274974 - DNA, 20 bp, Artificial Sequence
  chemically synthesized
ccttcacccacttgttgatg

SEQ ID NO: 274975 - DNA, 20 bp, Artificial Sequence
  chemically synthesized
tccttcacccacttgttgat

SEQ ID NO: 274976 - DNA, 20 bp, Artificial Sequence
  chemically synthesized
atccttcacccacttgttga

SEQ ID NO: 274977 - DNA, 20 bp, Artificial Sequence
  chemically synthesized
caaacaaccccatcaacaag

SEQ ID NO: 274978 - DNA, 20 bp, Artificial Sequence
  chemically synthesized
aaacaaccccatcaacaagt

SEQ ID NO: 274979 - DNA, 20 bp, Artificial Sequence
  chemically synthesized
accccatcaacaagtgggtg

SEQ ID NO: 274980 - DNA, 20 bp, Artificial Sequence
  chemically synthesized
ccccatcaacaagtgggtga

SEQ ID NO: 274981 - DNA, 20 bp, Artificial Sequence
  chemically synthesized
aagtgggtgaaggatatgaa

SEQ ID NO: 274982 - DNA, 20 bp, Artificial Sequence
  chemically synthesized
tatgaacagacacttctcaa

SEQ ID NO: 274983 - DNA, 20 bp, Artificial Sequence
  chemically synthesized
cataaatgtcttcttttgag

SEQ ID NO: 274984 - DNA, 20 bp, Artificial Sequence
  chemically synthesized
gaacagacacttctcaaaag

SEQ ID NO: 274985 - DNA, 20 bp, Artificial Sequence
  chemically synthesized
ctgcataaatgtcttctttt

SEQ ID NO: 274986 - DNA, 20 bp, Artificial Sequence
  chemically synthesized
ctcaaaagaagacatttatg

SEQ ID NO: 274987 - DNA, 20 bp, Artificial Sequence
  chemically synthesized
gaagacatttatgcagccaa

SEQ ID NO: 274988 - DNA, 20 bp, Artificial Sequence
  chemically synthesized
gcatttttttatgtgtcttt

SEQ ID NO: 274989 - DNA, 20 bp, Artificial Sequence
  chemically synthesized
ctctgatggccagtgatgat

SEQ ID NO: 274990 - DNA, 20 bp, Artificial Sequence
  chemically synthesized
aaaaaaatgctcatcatcac

SEQ ID NO: 274991 - DNA, 20 bp, Artificial Sequence
  chemically synthesized
tgctcatcatcactggccat

SEQ ID NO: 274992 - DNA, 20 bp, Artificial Sequence
  chemically synthesized
ctcatcatcactggccatca

SEQ ID NO: 274993 - DNA, 20 bp, Artificial Sequence
  chemically synthesized
atttgcatttctctgatggc

SEQ ID NO: 274994 - DNA, 20 bp, Artificial Sequence
  chemically synthesized
tttgatttgcatttctctga

SEQ ID NO: 274995 - DNA, 20 bp, Artificial Sequence
  chemically synthesized
gaaatgcaaatcaaaacaac

SEQ ID NO: 274996 - DNA, 20 bp, Artificial Sequence
  chemically synthesized
ccattctaactggtgtgaga

SEQ ID NO: 274997 - DNA, 20 bp, Artificial Sequence
  chemically synthesized
aacgagataccatctcacac

SEQ ID NO: 274998 - DNA, 20 bp, Artificial Sequence
  chemically synthesized
atcgccattctaactggtgt

SEQ ID NO: 274999 - DNA, 20 bp, Artificial Sequence
  chemically synthesized
agataccatctcacaccagt

SEQ ID NO: 275000 - DNA, 20 bp, Artificial Sequence
  chemically synthesized
ccatctcacaccagttagaa

SEQ ID NO: 275001 - DNA, 20 bp, Artificial Sequence
  chemically synthesized
ttaatgatcgccattctaac

SEQ ID NO: 275002 - DNA, 20 bp, Artificial Sequence
  chemically synthesized
ttagaatggcgatcattaaa

SEQ ID NO: 275003 - DNA, 20 bp, Artificial Sequence
  chemically synthesized
aatggcgatcattaaaaagt

SEQ ID NO: 275004 - DNA, 20 bp, Artificial Sequence
  chemically synthesized
atggcgatcattaaaaagtc

SEQ ID NO: 275005 - DNA, 20 bp, Artificial Sequence
  chemically synthesized
attaaaaagtcaggaaacaa

SEQ ID NO: 275006 - DNA, 20 bp, Artificial Sequence
  chemically synthesized
ttaaaaagtcaggaaacaac

SEQ ID NO: 275007 - DNA, 20 bp, Artificial Sequence
  chemically synthesized
agtcaggaaacaacaggtgc

SEQ ID NO: 275008 - DNA, 20 bp, Artificial Sequence
  chemically synthesized
tcaggaaacaacaggtgctg

SEQ ID NO: 275009 - DNA, 20 bp, Artificial Sequence
  chemically synthesized
aggaaacaacaggtgctgga

SEQ ID NO: 275010 - DNA, 20 bp, Artificial Sequence
  chemically synthesized
ggaaacaacaggtgctggag

SEQ ID NO: 275011 - DNA, 20 bp, Artificial Sequence
  chemically synthesized
ctatttctccacatcctctc

SEQ ID NO: 275012 - DNA, 20 bp, Artificial Sequence
  chemically synthesized
aacaggtgctggagaggatg

SEQ ID NO: 275013 - DNA, 20 bp, Artificial Sequence
  chemically synthesized
caggtgctggagaggatgtg

SEQ ID NO: 275014 - DNA, 20 bp, Artificial Sequence
  chemically synthesized
ctggagaggatgtggagaaa

SEQ ID NO: 275015 - DNA, 20 bp, Artificial Sequence
  chemically synthesized
tggagaggatgtggagaaat

SEQ ID NO: 275016 - DNA, 20 bp, Artificial Sequence
  chemically synthesized
cagtcccaccaacagtgtaa

SEQ ID NO: 275017 - DNA, 20 bp, Artificial Sequence
  chemically synthesized
taggaacacttttacactgt

SEQ ID NO: 275018 - DNA, 20 bp, Artificial Sequence
  chemically synthesized
gaacacttttacactgttgg

SEQ ID NO: 275019 - DNA, 20 bp, Artificial Sequence
  chemically synthesized
aacacttttacactgttggt

SEQ ID NO: 275020 - DNA, 20 bp, Artificial Sequence
  chemically synthesized
ctagtttacagtcccaccaa

SEQ ID NO: 275021 - DNA, 20 bp, Artificial Sequence
  chemically synthesized
ctgttggtgggactgtaaac

SEQ ID NO: 275022 - DNA, 20 bp, Artificial Sequence
  chemically synthesized
acaatggttgaactagttta

SEQ ID NO: 275023 - DNA, 20 bp, Artificial Sequence
  chemically synthesized
gacttccacaatggttgaac

SEQ ID NO: 275024 - DNA, 20 bp, Artificial Sequence
  chemically synthesized
gtaaactagttcaaccattg

SEQ ID NO: 275025 - DNA, 20 bp, Artificial Sequence
  chemically synthesized
aactagttcaaccattgtgg

SEQ ID NO: 275026 - DNA, 20 bp, Artificial Sequence
  chemically synthesized
cgccacagtgacttccacaa

SEQ ID NO: 275027 - DNA, 20 bp, Artificial Sequence
  chemically synthesized
aaccattgtggaagtcactg

SEQ ID NO: 275028 - DNA, 20 bp, Artificial Sequence
  chemically synthesized
agatccctgaggaatcgcca

SEQ ID NO: 275029 - DNA, 20 bp, Artificial Sequence
  chemically synthesized
aagtcactgtggcgattcct

SEQ ID NO: 275030 - DNA, 20 bp, Artificial Sequence
  chemically synthesized
agtcactgtggcgattcctc

SEQ ID NO: 275031 - DNA, 20 bp, Artificial Sequence
  chemically synthesized
gtcactgtggcgattcctca

SEQ ID NO: 275032 - DNA, 20 bp, Artificial Sequence
  chemically synthesized
tttctagttctagatccctg

SEQ ID NO: 275033 - DNA, 20 bp, Artificial Sequence
  chemically synthesized
gtggcgattcctcagggatc

SEQ ID NO: 275034 - DNA, 20 bp, Artificial Sequence
  chemically synthesized
atttctagttctagatccct

SEQ ID NO: 275035 - DNA, 20 bp, Artificial Sequence
  chemically synthesized
attcctcagggatctagaac

SEQ ID NO: 275036 - DNA, 20 bp, Artificial Sequence
  chemically synthesized
tcaaatggtatttctagttc

SEQ ID NO: 275037 - DNA, 20 bp, Artificial Sequence
  chemically synthesized
gctgggtcaaatggtatttc

SEQ ID NO: 275038 - DNA, 20 bp, Artificial Sequence
  chemically synthesized
actagaaataccatttgacc

SEQ ID NO: 275039 - DNA, 20 bp, Artificial Sequence
  chemically synthesized
aacgggatggctgggtcaaa

SEQ ID NO: 275040 - DNA, 20 bp, Artificial Sequence
  chemically synthesized
tacccagtaacgggatggct

SEQ ID NO: 275041 - DNA, 20 bp, Artificial Sequence
  chemically synthesized
atacccagtaacgggatggc

SEQ ID NO: 275042 - DNA, 20 bp, Artificial Sequence
  chemically synthesized
gtatatacccagtaacggga

SEQ ID NO: 275043 - DNA, 20 bp, Artificial Sequence
  chemically synthesized
tgacccagccatcccgttac

SEQ ID NO: 275044 - DNA, 20 bp, Artificial Sequence
  chemically synthesized
gacccagccatcccgttact

SEQ ID NO: 275045 - DNA, 20 bp, Artificial Sequence
  chemically synthesized
ttgggtatatacccagtaac

SEQ ID NO: 275046 - DNA, 20 bp, Artificial Sequence
  chemically synthesized
tttgggtatatacccagtaa

SEQ ID NO: 275047 - DNA, 20 bp, Artificial Sequence
  chemically synthesized
taatcctttgggtatatacc

SEQ ID NO: 275048 - DNA, 20 bp, Artificial Sequence
  chemically synthesized
cgttactgggtatataccca

SEQ ID NO: 275049 - DNA, 20 bp, Artificial Sequence
  chemically synthesized
gttactgggtatatacccaa

SEQ ID NO: 275050 - DNA, 20 bp, Artificial Sequence
  chemically synthesized
agcatgatttataatccttt

SEQ ID NO: 275051 - DNA, 20 bp, Artificial Sequence
  chemically synthesized
cagcatgatttataatcctt

SEQ ID NO: 275052 - DNA, 20 bp, Artificial Sequence
  chemically synthesized
ttataaatcatgctgctata

SEQ ID NO: 275053 - DNA, 20 bp, Artificial Sequence
  chemically synthesized
gtgtgcatgtgtctttatag

SEQ ID NO: 275054 - DNA, 20 bp, Artificial Sequence
  chemically synthesized
tacgtgtgcatgtgtcttta

SEQ ID NO: 275055 - DNA, 20 bp, Artificial Sequence
  chemically synthesized
atgcacacgtatgtttattg

SEQ ID NO: 275056 - DNA, 20 bp, Artificial Sequence
  chemically synthesized
tattgcggcactattctcaa

SEQ ID NO: 275057 - DNA, 20 bp, Artificial Sequence
  chemically synthesized
caagtctttgctattgagaa

SEQ ID NO: 275058 - DNA, 20 bp, Artificial Sequence
  chemically synthesized
cggcactattctcaatagca

SEQ ID NO: 275059 - DNA, 20 bp, Artificial Sequence
  chemically synthesized
ggttccaagtctttgctatt

SEQ ID NO: 275060 - DNA, 20 bp, Artificial Sequence
  chemically synthesized
tattctcaatagcaaagact

SEQ ID NO: 275061 - DNA, 20 bp, Artificial Sequence
  chemically synthesized
gagacatttgggttggttcc

SEQ ID NO: 275062 - DNA, 20 bp, Artificial Sequence
  chemically synthesized
tcattgtgagacatttgggt

SEQ ID NO: 275063 - DNA, 20 bp, Artificial Sequence
  chemically synthesized
tgtatcattgtgagacattt

SEQ ID NO: 275064 - DNA, 20 bp, Artificial Sequence
  chemically synthesized
ttgtatcattgtgagacatt

SEQ ID NO: 275065 - DNA, 20 bp, Artificial Sequence
  chemically synthesized
taaatccattgtatcattgt

SEQ ID NO: 275066 - DNA, 20 bp, Artificial Sequence
  chemically synthesized
aatgtctcacaatgatacaa

SEQ ID NO: 275067 - DNA, 20 bp, Artificial Sequence
  chemically synthesized
tcacaatgatacaatggatt

SEQ ID NO: 275068 - DNA, 20 bp, Artificial Sequence
  chemically synthesized
tacaatggatttagaaaatg

SEQ ID NO: 275069 - DNA, 20 bp, Artificial Sequence
  chemically synthesized
aatgtggcacatatacacct

SEQ ID NO: 275070 - DNA, 20 bp, Artificial Sequence
  chemically synthesized
tatggctgcatagtattcca

SEQ ID NO: 275071 - DNA, 20 bp, Artificial Sequence
  chemically synthesized
ttatggctgcatagtattcc

SEQ ID NO: 275072 - DNA, 20 bp, Artificial Sequence
  chemically synthesized
atacaccttggaatactatg

SEQ ID NO: 275073 - DNA, 20 bp, Artificial Sequence
  chemically synthesized
catccttttttatggctgca

SEQ ID NO: 275074 - DNA, 20 bp, Artificial Sequence
  chemically synthesized
aatactatgcagccataaaa

SEQ ID NO: 275075 - DNA, 20 bp, Artificial Sequence
  chemically synthesized
atactatgcagccataaaaa

SEQ ID NO: 275076 - DNA, 20 bp, Artificial Sequence
  chemically synthesized
catgaactcatcctttttta

SEQ ID NO: 275077 - DNA, 20 bp, Artificial Sequence
  chemically synthesized
atgcagccataaaaaaggat

SEQ ID NO: 275078 - DNA, 20 bp, Artificial Sequence
  chemically synthesized
ggatgagttcatgtcctttg

SEQ ID NO: 275079 - DNA, 20 bp, Artificial Sequence
  chemically synthesized
gatgagttcatgtcctttgt

SEQ ID NO: 275080 - DNA, 20 bp, Artificial Sequence
  chemically synthesized
atgagttcatgtcctttgta

SEQ ID NO: 275081 - DNA, 20 bp, Artificial Sequence
  chemically synthesized
cttcatccatgtccctacaa

SEQ ID NO: 275082 - DNA, 20 bp, Artificial Sequence
  chemically synthesized
gcttcatccatgtccctaca

SEQ ID NO: 275083 - DNA, 20 bp, Artificial Sequence
  chemically synthesized
tcatgtcctttgtagggaca

SEQ ID NO: 275084 - DNA, 20 bp, Artificial Sequence
  chemically synthesized
cctttgtagggacatggatg

SEQ ID NO: 275085 - DNA, 20 bp, Artificial Sequence
  chemically synthesized
tgtagggacatggatgaagc

SEQ ID NO: 275086 - DNA, 20 bp, Artificial Sequence
  chemically synthesized
ttgctgagaatgatggtttc

SEQ ID NO: 275087 - DNA, 20 bp, Artificial Sequence
  chemically synthesized
aagctggaaaccatcattct

SEQ ID NO: 275088 - DNA, 20 bp, Artificial Sequence
  chemically synthesized
cgatagtttgctgagaatga

SEQ ID NO: 275089 - DNA, 20 bp, Artificial Sequence
  chemically synthesized
tgtccttgcgatagtttgct

SEQ ID NO: 275090 - DNA, 20 bp, Artificial Sequence
  chemically synthesized
cattctcagcaaactatcgc

SEQ ID NO: 275091 - DNA, 20 bp, Artificial Sequence
  chemically synthesized
attctcagcaaactatcgca

SEQ ID NO: 275092 - DNA, 20 bp, Artificial Sequence
  chemically synthesized
ttggttttttgtccttgcga

SEQ ID NO: 275093 - DNA, 20 bp, Artificial Sequence
  chemically synthesized
gagtgagaacatgcggtgtt

SEQ ID NO: 275094 - DNA, 20 bp, Artificial Sequence
  chemically synthesized
cacctatgagtgagaacatg

SEQ ID NO: 275095 - DNA, 20 bp, Artificial Sequence
  chemically synthesized
acaccgcatgttctcactca

SEQ ID NO: 275096 - DNA, 20 bp, Artificial Sequence
  chemically synthesized
caccgcatgttctcactcat

SEQ ID NO: 275097 - DNA, 20 bp, Artificial Sequence
  chemically synthesized
ttcaattcccacctatgagt

SEQ ID NO: 275098 - DNA, 20 bp, Artificial Sequence
  chemically synthesized
cgcatgttctcactcatagg

SEQ ID NO: 275099 - DNA, 20 bp, Artificial Sequence
  chemically synthesized
gcatgttctcactcataggt

SEQ ID NO: 275100 - DNA, 20 bp, Artificial Sequence
  chemically synthesized
attgttcaattcccacctat

SEQ ID NO: 275101 - DNA, 20 bp, Artificial Sequence
  chemically synthesized
ataggtgggaattgaacaat

SEQ ID NO: 275102 - DNA, 20 bp, Artificial Sequence
  chemically synthesized
aattgaacaatgagaacaca

SEQ ID NO: 275103 - DNA, 20 bp, Artificial Sequence
  chemically synthesized
acaatgagaacacatggaca

SEQ ID NO: 275104 - DNA, 20 bp, Artificial Sequence
  chemically synthesized
caatgagaacacatggacac

SEQ ID NO: 275105 - DNA, 20 bp, Artificial Sequence
  chemically synthesized
tgagaacacatggacacagg

SEQ ID NO: 275106 - DNA, 20 bp, Artificial Sequence
  chemically synthesized
gagaacacatggacacagga

SEQ ID NO: 275107 - DNA, 20 bp, Artificial Sequence
  chemically synthesized
agaacacatggacacaggaa

SEQ ID NO: 275108 - DNA, 20 bp, Artificial Sequence
  chemically synthesized
gaacacatggacacaggaag

SEQ ID NO: 275109 - DNA, 20 bp, Artificial Sequence
  chemically synthesized
ggaaggggaacatcacacac

SEQ ID NO: 275110 - DNA, 20 bp, Artificial Sequence
  chemically synthesized
gaaggggaacatcacacacc

SEQ ID NO: 275111 - DNA, 20 bp, Artificial Sequence
  chemically synthesized
aaggggaacatcacacacca

SEQ ID NO: 275112 - DNA, 20 bp, Artificial Sequence
  chemically synthesized
ccccaccccacaacattccc

SEQ ID NO: 275113 - DNA, 20 bp, Artificial Sequence
  chemically synthesized
tcacacaccagggaatgttg

SEQ ID NO: 275114 - DNA, 20 bp, Artificial Sequence
  chemically synthesized
cacacaccagggaatgttgt

SEQ ID NO: 275115 - DNA, 20 bp, Artificial Sequence
  chemically synthesized
acacaccagggaatgttgtg

SEQ ID NO: 275116 - DNA, 20 bp, Artificial Sequence
  chemically synthesized
caccagggaatgttgtgggg

SEQ ID NO: 275117 - DNA, 20 bp, Artificial Sequence
  chemically synthesized
accagggaatgttgtggggt

SEQ ID NO: 275118 - DNA, 20 bp, Artificial Sequence
  chemically synthesized
ccagggaatgttgtggggtg

SEQ ID NO: 275119 - DNA, 20 bp, Artificial Sequence
  chemically synthesized
cagggaatgttgtggggtgg

SEQ ID NO: 275120 - DNA, 20 bp, Artificial Sequence
  chemically synthesized
agggaatgttgtggggtggg

SEQ ID NO: 275121 - DNA, 20 bp, Artificial Sequence
  chemically synthesized
ggaatgttgtggggtggggg

SEQ ID NO: 275122 - DNA, 20 bp, Artificial Sequence
  chemically synthesized
gaatgttgtggggtgggggg

SEQ ID NO: 275123 - DNA, 20 bp, Artificial Sequence
  chemically synthesized
aatgttgtggggtgggggga

SEQ ID NO: 275124 - DNA, 20 bp, Artificial Sequence
  chemically synthesized
atgttgtggggtggggggag

SEQ ID NO: 275125 - DNA, 20 bp, Artificial Sequence
  chemically synthesized
tgttgtggggtggggggagg

SEQ ID NO: 275126 - DNA, 20 bp, Artificial Sequence
  chemically synthesized
gttgtggggtggggggaggg

SEQ ID NO: 275127 - DNA, 20 bp, Artificial Sequence
  chemically synthesized
tgtggggtggggggaggggg

SEQ ID NO: 275128 - DNA, 20 bp, Artificial Sequence
  chemically synthesized
gtggggtggggggagggggg

SEQ ID NO: 275129 - DNA, 20 bp, Artificial Sequence
  chemically synthesized
tggggtggggggagggggga

SEQ ID NO: 275130 - DNA, 20 bp, Artificial Sequence
  chemically synthesized
gtggggggaggggggaggga

SEQ ID NO: 275131 - DNA, 20 bp, Artificial Sequence
  chemically synthesized
ggaggggggagggatagcat

SEQ ID NO: 275132 - DNA, 20 bp, Artificial Sequence
  chemically synthesized
gaggggggagggatagcatt

SEQ ID NO: 275133 - DNA, 20 bp, Artificial Sequence
  chemically synthesized
ggggggagggatagcattag

SEQ ID NO: 275134 - DNA, 20 bp, Artificial Sequence
  chemically synthesized
ttaactcgtcatttaacatt

SEQ ID NO: 275135 - DNA, 20 bp, Artificial Sequence
  chemically synthesized
attaactcgtcatttaacat

SEQ ID NO: 275136 - DNA, 20 bp, Artificial Sequence
  chemically synthesized
tatacctaatgttaaatgac

SEQ ID NO: 275137 - DNA, 20 bp, Artificial Sequence
  chemically synthesized
aatgttaaatgacgagttaa

SEQ ID NO: 275138 - DNA, 20 bp, Artificial Sequence
  chemically synthesized
atgttaaatgacgagttaat

SEQ ID NO: 275139 - DNA, 20 bp, Artificial Sequence
  chemically synthesized
aaatgacgagttaatgggtg

SEQ ID NO: 275140 - DNA, 20 bp, Artificial Sequence
  chemically synthesized
atgggtgtagcacaccaaca

SEQ ID NO: 275141 - DNA, 20 bp, Artificial Sequence
  chemically synthesized
tatgtatacatgtgccatgt

SEQ ID NO: 275142 - DNA, 20 bp, Artificial Sequence
  chemically synthesized
catgtgcacaacgtgcaggt

SEQ ID NO: 275143 - DNA, 20 bp, Artificial Sequence
  chemically synthesized
ggtacatgtgcacaacgtgc

SEQ ID NO: 275144 - DNA, 20 bp, Artificial Sequence
  chemically synthesized
gggtacatgtgcacaacgtg

SEQ ID NO: 275145 - DNA, 20 bp, Artificial Sequence
  chemically synthesized
ttttaatactttaagtttta

SEQ ID NO: 275146 - DNA, 20 bp, Artificial Sequence
  chemically synthesized
tttttaatactttaagtttt

SEQ ID NO: 275147 - DNA, 20 bp, Artificial Sequence
  chemically synthesized
cacatgtaccctaaaactta

SEQ ID NO: 275148 - DNA, 20 bp, Artificial Sequence
  chemically synthesized
ttttttaatactttaagttt

SEQ ID NO: 275149 - DNA, 20 bp, Artificial Sequence
  chemically synthesized
gtctttttttttaatacttt

SEQ ID NO: 275150 - DNA, 20 bp, Artificial Sequence
  chemically synthesized
aacttaaagtattaaaaaaa

SEQ ID NO: 275151 - DNA, 20 bp, Artificial Sequence
  chemically synthesized
taaaaaaaaagactgtgaat

SEQ ID NO: 275152 - DNA, 20 bp, Artificial Sequence
  chemically synthesized
gataacacttagccaattca

SEQ ID NO: 275153 - DNA, 20 bp, Artificial Sequence
  chemically synthesized
aaaaagactgtgaattggct

SEQ ID NO: 275154 - DNA, 20 bp, Artificial Sequence
  chemically synthesized
ttatttcaaaagataacact

SEQ ID NO: 275155 - DNA, 20 bp, Artificial Sequence
  chemically synthesized
ctaggagtattttatttcaa

SEQ ID NO: 275156 - DNA, 20 bp, Artificial Sequence
  chemically synthesized
cttttgaaataaaatactcc

SEQ ID NO: 275157 - DNA, 20 bp, Artificial Sequence
  chemically synthesized
ttttgaaataaaatactcct

SEQ ID NO: 275158 - DNA, 20 bp, Artificial Sequence
  chemically synthesized
aacagcatgtgttgacctag

SEQ ID NO: 275159 - DNA, 20 bp, Artificial Sequence
  chemically synthesized
gtaacagcatgtgttgacct

SEQ ID NO: 275160 - DNA, 20 bp, Artificial Sequence
  chemically synthesized
tgtaacagcatgtgttgacc

SEQ ID NO: 275161 - DNA, 20 bp, Artificial Sequence
  chemically synthesized
tgcatgctgccaggatgtaa

SEQ ID NO: 275162 - DNA, 20 bp, Artificial Sequence
  chemically synthesized
caacacatgctgttacatcc

SEQ ID NO: 275163 - DNA, 20 bp, Artificial Sequence
  chemically synthesized
cacatgctgttacatcctgg

SEQ ID NO: 275164 - DNA, 20 bp, Artificial Sequence
  chemically synthesized
aaataaagctgcatgctgcc

SEQ ID NO: 275165 - DNA, 20 bp, Artificial Sequence
  chemically synthesized
aaaataaagctgcatgctgc

SEQ ID NO: 275166 - DNA, 20 bp, Artificial Sequence
  chemically synthesized
tgttacatcctggcagcatg

SEQ ID NO: 275167 - DNA, 20 bp, Artificial Sequence
  chemically synthesized
gcttacacttttagaaaata

SEQ ID NO: 275168 - DNA, 20 bp, Artificial Sequence
  chemically synthesized
catgcagctttattttctaa

SEQ ID NO: 275169 - DNA, 20 bp, Artificial Sequence
  chemically synthesized
gctttattttctaaaagtgt

SEQ ID NO: 275170 - DNA, 20 bp, Artificial Sequence
  chemically synthesized
agaagcaaagcttacacttt

SEQ ID NO: 275171 - DNA, 20 bp, Artificial Sequence
  chemically synthesized
tgagcttacctacagaagca

SEQ ID NO: 275172 - DNA, 20 bp, Artificial Sequence
  chemically synthesized
aagtgtaagctttgcttctg

SEQ ID NO: 275173 - DNA, 20 bp, Artificial Sequence
  chemically synthesized
agtgtaagctttgcttctgt

SEQ ID NO: 275174 - DNA, 20 bp, Artificial Sequence
  chemically synthesized
tgacatgagcttacctacag

SEQ ID NO: 275175 - DNA, 20 bp, Artificial Sequence
  chemically synthesized
taagctttgcttctgtaggt

SEQ ID NO: 275176 - DNA, 20 bp, Artificial Sequence
  chemically synthesized
tagtgacatgagcttaccta

SEQ ID NO: 275177 - DNA, 20 bp, Artificial Sequence
  chemically synthesized
gttacttattttagtgacat

SEQ ID NO: 275178 - DNA, 20 bp, Artificial Sequence
  chemically synthesized
taagctcatgtcactaaaat

SEQ ID NO: 275179 - DNA, 20 bp, Artificial Sequence
  chemically synthesized
taaaattatgttacttattt

SEQ ID NO: 275180 - DNA, 20 bp, Artificial Sequence
  chemically synthesized
acataattttaaatccaatt

SEQ ID NO: 275181 - DNA, 20 bp, Artificial Sequence
  chemically synthesized
tgggccctcagattctgaat

SEQ ID NO: 275182 - DNA, 20 bp, Artificial Sequence
  chemically synthesized
ttaaatccaattcagaatct

SEQ ID NO: 275183 - DNA, 20 bp, Artificial Sequence
  chemically synthesized
taaatccaattcagaatctg

SEQ ID NO: 275184 - DNA, 20 bp, Artificial Sequence
  chemically synthesized
aaatccaattcagaatctga

SEQ ID NO: 275185 - DNA, 20 bp, Artificial Sequence
  chemically synthesized
caattcagaatctgagggcc

SEQ ID NO: 275186 - DNA, 20 bp, Artificial Sequence
  chemically synthesized
cagttatttctctgggccct

SEQ ID NO: 275187 - DNA, 20 bp, Artificial Sequence
  chemically synthesized
attcagaatctgagggccca

SEQ ID NO: 275188 - DNA, 20 bp, Artificial Sequence
  chemically synthesized
aattgatcagttatttctct

SEQ ID NO: 275189 - DNA, 20 bp, Artificial Sequence
  chemically synthesized
taattgatcagttatttctc

SEQ ID NO: 275190 - DNA, 20 bp, Artificial Sequence
  chemically synthesized
tccttagtgtgttaattgat

SEQ ID NO: 275191 - DNA, 20 bp, Artificial Sequence
  chemically synthesized
aactgatcaattaacacact

SEQ ID NO: 275192 - DNA, 20 bp, Artificial Sequence
  chemically synthesized
actgatcaattaacacacta

SEQ ID NO: 275193 - DNA, 20 bp, Artificial Sequence
  chemically synthesized
gatcaattaacacactaagg

SEQ ID NO: 275194 - DNA, 20 bp, Artificial Sequence
  chemically synthesized
aattaacacactaaggaagt

SEQ ID NO: 275195 - DNA, 20 bp, Artificial Sequence
  chemically synthesized
aaaagagctgctcacttcct

SEQ ID NO: 275196 - DNA, 20 bp, Artificial Sequence
  chemically synthesized
taacacactaaggaagtgag

SEQ ID NO: 275197 - DNA, 20 bp, Artificial Sequence
  chemically synthesized
tattactataggaaagaaaa

SEQ ID NO: 275198 - DNA, 20 bp, Artificial Sequence
  chemically synthesized
tttattactataggaaagaa

SEQ ID NO: 275199 - DNA, 20 bp, Artificial Sequence
  chemically synthesized
agcagctcttttctttccta

SEQ ID NO: 275200 - DNA, 20 bp, Artificial Sequence
  chemically synthesized
tggcatttattactatagga

SEQ ID NO: 275201 - DNA, 20 bp, Artificial Sequence
  chemically synthesized
acattggcatttattactat

SEQ ID NO: 275202 - DNA, 20 bp, Artificial Sequence
  chemically synthesized
cacattggcatttattacta

SEQ ID NO: 275203 - DNA, 20 bp, Artificial Sequence
  chemically synthesized
atgcttctttacattcacat

SEQ ID NO: 275204 - DNA, 20 bp, Artificial Sequence
  chemically synthesized
taaatgccaatgtgaatgta

SEQ ID NO: 275205 - DNA, 20 bp, Artificial Sequence
  chemically synthesized
atgccaatgtgaatgtaaag

SEQ ID NO: 275206 - DNA, 20 bp, Artificial Sequence
  chemically synthesized
tataaaagtagatgtagatc

SEQ ID NO: 275207 - DNA, 20 bp, Artificial Sequence
  chemically synthesized
atataaaagtagatgtagat

SEQ ID NO: 275208 - DNA, 20 bp, Artificial Sequence
  chemically synthesized
gttatatataaaagtagatg

SEQ ID NO: 275209 - DNA, 20 bp, Artificial Sequence
  chemically synthesized
actcttgttatatataaaag

SEQ ID NO: 275210 - DNA, 20 bp, Artificial Sequence
  chemically synthesized
catactcttgttatatataa

SEQ ID NO: 275211 - DNA, 20 bp, Artificial Sequence
  chemically synthesized
catctacttttatatataac

SEQ ID NO: 275212 - DNA, 20 bp, Artificial Sequence
  chemically synthesized
tctacttttatatataacaa

SEQ ID NO: 275213 - DNA, 20 bp, Artificial Sequence
  chemically synthesized
ttttatatataacaagagta

SEQ ID NO: 275214 - DNA, 20 bp, Artificial Sequence
  chemically synthesized
tataacaagagtatggttgt

SEQ ID NO: 275215 - DNA, 20 bp, Artificial Sequence
  chemically synthesized
acaagagtatggttgtcaga

SEQ ID NO: 275216 - DNA, 20 bp, Artificial Sequence
  chemically synthesized
ttgtcagaaagttgtacata

SEQ ID NO: 275217 - DNA, 20 bp, Artificial Sequence
  chemically synthesized
acatacagtatgcatttcct

SEQ ID NO: 275218 - DNA, 20 bp, Artificial Sequence
  chemically synthesized
atataaaagctatggcacta

SEQ ID NO: 275219 - DNA, 20 bp, Artificial Sequence
  chemically synthesized
tatgcatttccttagtgcca

SEQ ID NO: 275220 - DNA, 20 bp, Artificial Sequence
  chemically synthesized
gatataaaagctatggcact

SEQ ID NO: 275221 - DNA, 20 bp, Artificial Sequence
  chemically synthesized
atcctcagatataaaagcta

SEQ ID NO: 275222 - DNA, 20 bp, Artificial Sequence
  chemically synthesized
tttgagatcctcagatataa

SEQ ID NO: 275223 - DNA, 20 bp, Artificial Sequence
  chemically synthesized
gtgccatagcttttatatct

SEQ ID NO: 275224 - DNA, 20 bp, Artificial Sequence
  chemically synthesized
tgccatagcttttatatctg

SEQ ID NO: 275225 - DNA, 20 bp, Artificial Sequence
  chemically synthesized
ttaagatcgtttgagatcct

SEQ ID NO: 275226 - DNA, 20 bp, Artificial Sequence
  chemically synthesized
tctgcattttaagatcgttt

SEQ ID NO: 275227 - DNA, 20 bp, Artificial Sequence
  chemically synthesized
tctcaaacgatcttaaaatg

SEQ ID NO: 275228 - DNA, 20 bp, Artificial Sequence
  chemically synthesized
cattattttttctgcatttt

SEQ ID NO: 275229 - DNA, 20 bp, Artificial Sequence
  chemically synthesized
cagaaaaaataatgctctaa

SEQ ID NO: 275230 - DNA, 20 bp, Artificial Sequence
  chemically synthesized
tagttaatttgaatctttta

SEQ ID NO: 275231 - DNA, 20 bp, Artificial Sequence
  chemically synthesized
gctagttaatttgaatcttt

SEQ ID NO: 275232 - DNA, 20 bp, Artificial Sequence
  chemically synthesized
tctaaaagattcaaattaac

SEQ ID NO: 275233 - DNA, 20 bp, Artificial Sequence
  chemically synthesized
tggtgcactgagagttttgc

SEQ ID NO: 275234 - DNA, 20 bp, Artificial Sequence
  chemically synthesized
aaattaactagcaaaactct

SEQ ID NO: 275235 - DNA, 20 bp, Artificial Sequence
  chemically synthesized
tccaccgtgtggtgcactga

SEQ ID NO: 275236 - DNA, 20 bp, Artificial Sequence
  chemically synthesized
actccaccgtgtggtgcact

SEQ ID NO: 275237 - DNA, 20 bp, Artificial Sequence
  chemically synthesized
aaaactctcagtgcaccaca

SEQ ID NO: 275238 - DNA, 20 bp, Artificial Sequence
  chemically synthesized
actctcagtgcaccacacgg

SEQ ID NO: 275239 - DNA, 20 bp, Artificial Sequence
  chemically synthesized
tctcagtgcaccacacggtg

SEQ ID NO: 275240 - DNA, 20 bp, Artificial Sequence
  chemically synthesized
gggtgtctgactccaccgtg

SEQ ID NO: 275241 - DNA, 20 bp, Artificial Sequence
  chemically synthesized
agtgcaccacacggtggagt

SEQ ID NO: 275242 - DNA, 20 bp, Artificial Sequence
  chemically synthesized
tactggtcacgcagatttgt

SEQ ID NO: 275243 - DNA, 20 bp, Artificial Sequence
  chemically synthesized
atactggtcacgcagatttg

SEQ ID NO: 275244 - DNA, 20 bp, Artificial Sequence
  chemically synthesized
cacccacaaatctgcgtgac

SEQ ID NO: 275245 - DNA, 20 bp, Artificial Sequence
  chemically synthesized
tctgtcatatactggtcacg

SEQ ID NO: 275246 - DNA, 20 bp, Artificial Sequence
  chemically synthesized
tcagattttctgtcatatac

SEQ ID NO: 275247 - DNA, 20 bp, Artificial Sequence
  chemically synthesized
tctgcgtgaccagtatatga

SEQ ID NO: 275248 - DNA, 20 bp, Artificial Sequence
  chemically synthesized
cagtatatgacagaaaatct

SEQ ID NO: 275249 - DNA, 20 bp, Artificial Sequence
  chemically synthesized
tatatgacagaaaatctgag

SEQ ID NO: 275250 - DNA, 20 bp, Artificial Sequence
  chemically synthesized
atatgacagaaaatctgagc

SEQ ID NO: 275251 - DNA, 20 bp, Artificial Sequence
  chemically synthesized
tcctctttgaaatacctgct

SEQ ID NO: 275252 - DNA, 20 bp, Artificial Sequence
  chemically synthesized
aaatctgagcaggtatttca

SEQ ID NO: 275253 - DNA, 20 bp, Artificial Sequence
  chemically synthesized
atctgagcaggtatttcaaa

SEQ ID NO: 275254 - DNA, 20 bp, Artificial Sequence
  chemically synthesized
tctgagcaggtatttcaaag

SEQ ID NO: 275255 - DNA, 20 bp, Artificial Sequence
  chemically synthesized
atttcaaagaggacttaata

SEQ ID NO: 275256 - DNA, 20 bp, Artificial Sequence
  chemically synthesized
atgtatgaagttaccatatt

SEQ ID NO: 275257 - DNA, 20 bp, Artificial Sequence
  chemically synthesized
gaagcaggaaaaaatgtatg

SEQ ID NO: 275258 - DNA, 20 bp, Artificial Sequence
  chemically synthesized
ttaattcatcacggagaagc

SEQ ID NO: 275259 - DNA, 20 bp, Artificial Sequence
  chemically synthesized
cttaattcatcacggagaag

SEQ ID NO: 275260 - DNA, 20 bp, Artificial Sequence
  chemically synthesized
tagcttaattcatcacggag

SEQ ID NO: 275261 - DNA, 20 bp, Artificial Sequence
  chemically synthesized
atttagcttaattcatcacg

SEQ ID NO: 275262 - DNA, 20 bp, Artificial Sequence
  chemically synthesized
atatttagcttaattcatca

SEQ ID NO: 275263 - DNA, 20 bp, Artificial Sequence
  chemically synthesized
ctgcttctccgtgatgaatt

SEQ ID NO: 275264 - DNA, 20 bp, Artificial Sequence
  chemically synthesized
tttctcataaatggtatatt

SEQ ID NO: 275265 - DNA, 20 bp, Artificial Sequence
  chemically synthesized
aagctaaatataccatttat

SEQ ID NO: 275266 - DNA, 20 bp, Artificial Sequence
  chemically synthesized
ataatttcttttctcataaa

SEQ ID NO: 275267 - DNA, 20 bp, Artificial Sequence
  chemically synthesized
aaatataccatttatgagaa

SEQ ID NO: 275268 - DNA, 20 bp, Artificial Sequence
  chemically synthesized
atttatgagaaaagaaatta

SEQ ID NO: 275269 - DNA, 20 bp, Artificial Sequence
  chemically synthesized
gttattgctaattaaaatat

SEQ ID NO: 275270 - DNA, 20 bp, Artificial Sequence
  chemically synthesized
tagtgcactaatattttaat

SEQ ID NO: 275271 - DNA, 20 bp, Artificial Sequence
  chemically synthesized
atttgcacttaaagataaaa

SEQ ID NO: 275272 - DNA, 20 bp, Artificial Sequence
  chemically synthesized
aatttgcacttaaagataaa

SEQ ID NO: 275273 - DNA, 20 bp, Artificial Sequence
  chemically synthesized
gcaataacctttttatcttt

SEQ ID NO: 275274 - DNA, 20 bp, Artificial Sequence
  chemically synthesized
tttctataaatttgcactta

SEQ ID NO: 275275 - DNA, 20 bp, Artificial Sequence
  chemically synthesized
tatctttaagtgcaaattta

SEQ ID NO: 275276 - DNA, 20 bp, Artificial Sequence
  chemically synthesized
tttgttaatacaatgcattg

SEQ ID NO: 275277 - DNA, 20 bp, Artificial Sequence
  chemically synthesized
ttaatacaatgcattgaagt

SEQ ID NO: 275278 - DNA, 20 bp, Artificial Sequence
  chemically synthesized
gaaaagaaaggaatagaata

SEQ ID NO: 275279 - DNA, 20 bp, Artificial Sequence
  chemically synthesized
agaaaagaaaggaatagaat

SEQ ID NO: 275280 - DNA, 20 bp, Artificial Sequence
  chemically synthesized
aagaaaagaaaggaatagaa

SEQ ID NO: 275281 - DNA, 20 bp, Artificial Sequence
  chemically synthesized
aaagaaagaaaagaaaggaa

SEQ ID NO: 275282 - DNA, 20 bp, Artificial Sequence
  chemically synthesized
agatgaaagaaagaaaagaa

SEQ ID NO: 275283 - DNA, 20 bp, Artificial Sequence
  chemically synthesized
tagatgaaagaaagaaaaga

SEQ ID NO: 275284 - DNA, 20 bp, Artificial Sequence
  chemically synthesized
tagatagatgaaagaaagaa

SEQ ID NO: 275285 - DNA, 20 bp, Artificial Sequence
  chemically synthesized
atagatagatagatgaaaga

SEQ ID NO: 275286 - DNA, 20 bp, Artificial Sequence
  chemically synthesized
atagatagatagatagatga

SEQ ID NO: 275287 - DNA, 20 bp, Artificial Sequence
  chemically synthesized
tagatagatagatagataga

SEQ ID NO: 275288 - DNA, 20 bp, Artificial Sequence
  chemically synthesized
tagatagatagatagataga

SEQ ID NO: 275289 - DNA, 20 bp, Artificial Sequence
  chemically synthesized
tagatagatagatagataga

SEQ ID NO: 275290 - DNA, 20 bp, Artificial Sequence
  chemically synthesized
tagatagatagatagataga

SEQ ID NO: 275291 - DNA, 20 bp, Artificial Sequence
  chemically synthesized
tagatagatagatagataga

SEQ ID NO: 275292 - DNA, 20 bp, Artificial Sequence
  chemically synthesized
tagatagatagatagataga

SEQ ID NO: 275293 - DNA, 20 bp, Artificial Sequence
  chemically synthesized
tggatagatagatagataga

SEQ ID NO: 275294 - DNA, 20 bp, Artificial Sequence
  chemically synthesized
tggatggatagatagataga

SEQ ID NO: 275295 - DNA, 20 bp, Artificial Sequence
  chemically synthesized
ttgatggatggatagataga

SEQ ID NO: 275296 - DNA, 20 bp, Artificial Sequence
  chemically synthesized
tggattgatggatggataga

SEQ ID NO: 275297 - DNA, 20 bp, Artificial Sequence
  chemically synthesized
tgtatggattgatggatgga

SEQ ID NO: 275298 - DNA, 20 bp, Artificial Sequence
  chemically synthesized
tggatgtatggattgatgga

SEQ ID NO: 275299 - DNA, 20 bp, Artificial Sequence
  chemically synthesized
tggatggatgtatggattga

SEQ ID NO: 275300 - DNA, 20 bp, Artificial Sequence
  chemically synthesized
tggatagatggatggatgta

SEQ ID NO: 275301 - DNA, 20 bp, Artificial Sequence
  chemically synthesized
agatggggtggatagatgga

SEQ ID NO: 275302 - DNA, 20 bp, Artificial Sequence
  chemically synthesized
atagagatggggtggataga

SEQ ID NO: 275303 - DNA, 20 bp, Artificial Sequence
  chemically synthesized
aaatatagagatggggtgga

SEQ ID NO: 275304 - DNA, 20 bp, Artificial Sequence
  chemically synthesized
ttttaaatatagagatgggg

SEQ ID NO: 275305 - DNA, 20 bp, Artificial Sequence
  chemically synthesized
acattttaaatatagagatg

SEQ ID NO: 275306 - DNA, 20 bp, Artificial Sequence
  chemically synthesized
gacattttaaatatagagat

SEQ ID NO: 275307 - DNA, 20 bp, Artificial Sequence
  chemically synthesized
tgacattttaaatatagaga

SEQ ID NO: 275308 - DNA, 20 bp, Artificial Sequence
  chemically synthesized
aaaatgacattttaaatata

SEQ ID NO: 275309 - DNA, 20 bp, Artificial Sequence
  chemically synthesized
ccaaaatgacattttaaata

SEQ ID NO: 275310 - DNA, 20 bp, Artificial Sequence
  chemically synthesized
ctatatttaaaatgtcattt

SEQ ID NO: 275311 - DNA, 20 bp, Artificial Sequence
  chemically synthesized
tatttaaaatgtcattttgg

SEQ ID NO: 275312 - DNA, 20 bp, Artificial Sequence
  chemically synthesized
tgtcattttggtggcattct

SEQ ID NO: 275313 - DNA, 20 bp, Artificial Sequence
  chemically synthesized
cattttggtggcattcttag

SEQ ID NO: 275314 - DNA, 20 bp, Artificial Sequence
  chemically synthesized
tgtaagatgaaggatccact

SEQ ID NO: 275315 - DNA, 20 bp, Artificial Sequence
  chemically synthesized
aagcacagtgtgtaagatga

SEQ ID NO: 275316 - DNA, 20 bp, Artificial Sequence
  chemically synthesized
taagcacagtgtgtaagatg

SEQ ID NO: 275317 - DNA, 20 bp, Artificial Sequence
  chemically synthesized
ataacataagcacagtgtgt

SEQ ID NO: 275318 - DNA, 20 bp, Artificial Sequence
  chemically synthesized
atagtgaaataacataagca

SEQ ID NO: 275319 - DNA, 20 bp, Artificial Sequence
  chemically synthesized
gttagatagtgaaataacat

SEQ ID NO: 275320 - DNA, 20 bp, Artificial Sequence
  chemically synthesized
atagagagtcaaaagttaga

SEQ ID NO: 275321 - DNA, 20 bp, Artificial Sequence
  chemically synthesized
taaaatagagagtcaaaagt

SEQ ID NO: 275322 - DNA, 20 bp, Artificial Sequence
  chemically synthesized
gaaataaaatagagagtcaa

SEQ ID NO: 275323 - DNA, 20 bp, Artificial Sequence
  chemically synthesized
ttcccatgaaataaaataga

SEQ ID NO: 275324 - DNA, 20 bp, Artificial Sequence
  chemically synthesized
aattcccatgaaataaaata

SEQ ID NO: 275325 - DNA, 20 bp, Artificial Sequence
  chemically synthesized
gaaattcccatgaaataaaa

SEQ ID NO: 275326 - DNA, 20 bp, Artificial Sequence
  chemically synthesized
tgactctctattttatttca

SEQ ID NO: 275327 - DNA, 20 bp, Artificial Sequence
  chemically synthesized
gactctctattttatttcat

SEQ ID NO: 275328 - DNA, 20 bp, Artificial Sequence
  chemically synthesized
ttttatttcatgggaatttc

SEQ ID NO: 275329 - DNA, 20 bp, Artificial Sequence
  chemically synthesized
gggaatttcgagctgctttt

SEQ ID NO: 275330 - DNA, 20 bp, Artificial Sequence
  chemically synthesized
ggaatttcgagctgcttttc

SEQ ID NO: 275331 - DNA, 20 bp, Artificial Sequence
  chemically synthesized
ggattatatttcctgaaaag

SEQ ID NO: 275332 - DNA, 20 bp, Artificial Sequence
  chemically synthesized
caaggattatatttcctgaa

SEQ ID NO: 275333 - DNA, 20 bp, Artificial Sequence
  chemically synthesized
ttcaggaaatataatccttg

SEQ ID NO: 275334 - DNA, 20 bp, Artificial Sequence
  chemically synthesized
aggtactcagatttgcttca

SEQ ID NO: 275335 - DNA, 20 bp, Artificial Sequence
  chemically synthesized
caggtactcagatttgcttc

SEQ ID NO: 275336 - DNA, 20 bp, Artificial Sequence
  chemically synthesized
ataatccttgaagcaaatct

SEQ ID NO: 275337 - DNA, 20 bp, Artificial Sequence
  chemically synthesized
tgaagcaaatctgagtacct

SEQ ID NO: 275338 - DNA, 20 bp, Artificial Sequence
  chemically synthesized
gaacagagttctcaggtact

SEQ ID NO: 275339 - DNA, 20 bp, Artificial Sequence
  chemically synthesized
ttttctagaacagagttctc

SEQ ID NO: 275340 - DNA, 20 bp, Artificial Sequence
  chemically synthesized
gttttctagaacagagttct

SEQ ID NO: 275341 - DNA, 20 bp, Artificial Sequence
  chemically synthesized
agtacctgagaactctgttc

SEQ ID NO: 275342 - DNA, 20 bp, Artificial Sequence
  chemically synthesized
gtgaattgttttctagaaca

SEQ ID NO: 275343 - DNA, 20 bp, Artificial Sequence
  chemically synthesized
aagtgaattgttttctagaa

SEQ ID NO: 275344 - DNA, 20 bp, Artificial Sequence
  chemically synthesized
gcagtaagtgaattgttttc

SEQ ID NO: 275345 - DNA, 20 bp, Artificial Sequence
  chemically synthesized
ttttattttaatatggcagt

SEQ ID NO: 275346 - DNA, 20 bp, Artificial Sequence
  chemically synthesized
agggttttattttaatatgg

SEQ ID NO: 275347 - DNA, 20 bp, Artificial Sequence
  chemically synthesized
tccagggttttattttaata

SEQ ID NO: 275348 - DNA, 20 bp, Artificial Sequence
  chemically synthesized
gccatattaaaataaaaccc

SEQ ID NO: 275349 - DNA, 20 bp, Artificial Sequence
  chemically synthesized
catattaaaataaaaccctg

SEQ ID NO: 275350 - DNA, 20 bp, Artificial Sequence
  chemically synthesized
attaaaataaaaccctggag

SEQ ID NO: 275351 - DNA, 20 bp, Artificial Sequence
  chemically synthesized
taaaacattcttctgctcca

SEQ ID NO: 275352 - DNA, 20 bp, Artificial Sequence
  chemically synthesized
aaaataaaaccctggagcag

SEQ ID NO: 275353 - DNA, 20 bp, Artificial Sequence
  chemically synthesized
ttaaaacattcttctgctcc

SEQ ID NO: 275354 - DNA, 20 bp, Artificial Sequence
  chemically synthesized
cttaaaacattcttctgctc

SEQ ID NO: 275355 - DNA, 20 bp, Artificial Sequence
  chemically synthesized
ctggagcagaagaatgtttt

SEQ ID NO: 275356 - DNA, 20 bp, Artificial Sequence
  chemically synthesized
ggagcagaagaatgttttaa

SEQ ID NO: 275357 - DNA, 20 bp, Artificial Sequence
  chemically synthesized
aagaatgttttaagagcttt

SEQ ID NO: 275358 - DNA, 20 bp, Artificial Sequence
  chemically synthesized
atgttttaagagctttcaga

SEQ ID NO: 275359 - DNA, 20 bp, Artificial Sequence
  chemically synthesized
ggagaatacaagccatctga

SEQ ID NO: 275360 - DNA, 20 bp, Artificial Sequence
  chemically synthesized
tacataatattggagaatac

SEQ ID NO: 275361 - DNA, 20 bp, Artificial Sequence
  chemically synthesized
aatggtaatacataatattg

SEQ ID NO: 275362 - DNA, 20 bp, Artificial Sequence
  chemically synthesized
ccaatggtaatacataatat

SEQ ID NO: 275363 - DNA, 20 bp, Artificial Sequence
  chemically synthesized
ccaatattatgtattaccat

SEQ ID NO: 275364 - DNA, 20 bp, Artificial Sequence
  chemically synthesized
caatattatgtattaccatt

SEQ ID NO: 275365 - DNA, 20 bp, Artificial Sequence
  chemically synthesized
aatattatgtattaccattg

SEQ ID NO: 275366 - DNA, 20 bp, Artificial Sequence
  chemically synthesized
tattatgtattaccattggg

SEQ ID NO: 275367 - DNA, 20 bp, Artificial Sequence
  chemically synthesized
ttgacattgagtctccccaa

SEQ ID NO: 275368 - DNA, 20 bp, Artificial Sequence
  chemically synthesized
cattggggagactcaatgtc

SEQ ID NO: 275369 - DNA, 20 bp, Artificial Sequence
  chemically synthesized
tcaacatagttcttgacatt

SEQ ID NO: 275370 - DNA, 20 bp, Artificial Sequence
  chemically synthesized
tcacacctgcattatcaaca

SEQ ID NO: 275371 - DNA, 20 bp, Artificial Sequence
  chemically synthesized
caagaactatgttgataatg

SEQ ID NO: 275372 - DNA, 20 bp, Artificial Sequence
  chemically synthesized
aagaactatgttgataatgc

SEQ ID NO: 275373 - DNA, 20 bp, Artificial Sequence
  chemically synthesized
atctattttccatgcatttc

SEQ ID NO: 275374 - DNA, 20 bp, Artificial Sequence
  chemically synthesized
caggtgtgacctgaaatgca

SEQ ID NO: 275375 - DNA, 20 bp, Artificial Sequence
  chemically synthesized
aatctattttccatgcattt

SEQ ID NO: 275376 - DNA, 20 bp, Artificial Sequence
  chemically synthesized
gacctgaaatgcatggaaaa

SEQ ID NO: 275377 - DNA, 20 bp, Artificial Sequence
  chemically synthesized
agaaagagattttgggcatt

SEQ ID NO: 275378 - DNA, 20 bp, Artificial Sequence
  chemically synthesized
tacttcaagaaagagatttt

SEQ ID NO: 275379 - DNA, 20 bp, Artificial Sequence
  chemically synthesized
ctacttcaagaaagagattt

SEQ ID NO: 275380 - DNA, 20 bp, Artificial Sequence
  chemically synthesized
tgcccaaaatctctttcttg

SEQ ID NO: 275381 - DNA, 20 bp, Artificial Sequence
  chemically synthesized
ttcagatctacttcaagaaa

SEQ ID NO: 275382 - DNA, 20 bp, Artificial Sequence
  chemically synthesized
atttcagatctacttcaaga

SEQ ID NO: 275383 - DNA, 20 bp, Artificial Sequence
  chemically synthesized
ccaaaatctctttcttgaag

SEQ ID NO: 275384 - DNA, 20 bp, Artificial Sequence
  chemically synthesized
tgaaatttcagatctacttc

SEQ ID NO: 275385 - DNA, 20 bp, Artificial Sequence
  chemically synthesized
acagataaattatgaaattt

SEQ ID NO: 275386 - DNA, 20 bp, Artificial Sequence
  chemically synthesized
tactagtaaacagcagaaca

SEQ ID NO: 275387 - DNA, 20 bp, Artificial Sequence
  chemically synthesized
agaaaagtactagtaaacag

SEQ ID NO: 275388 - DNA, 20 bp, Artificial Sequence
  chemically synthesized
atctgtgttctgctgtttac

SEQ ID NO: 275389 - DNA, 20 bp, Artificial Sequence
  chemically synthesized
agtagaaaagtactagtaaa

SEQ ID NO: 275390 - DNA, 20 bp, Artificial Sequence
  chemically synthesized
ctacatcagtagaaaagtac

SEQ ID NO: 275391 - DNA, 20 bp, Artificial Sequence
  chemically synthesized
tattaactacatcagtagaa

SEQ ID NO: 275392 - DNA, 20 bp, Artificial Sequence
  chemically synthesized
ctagtacttttctactgatg

SEQ ID NO: 275393 - DNA, 20 bp, Artificial Sequence
  chemically synthesized
aatgttattaactacatcag

SEQ ID NO: 275394 - DNA, 20 bp, Artificial Sequence
  chemically synthesized
aaaaatgttattaactacat

SEQ ID NO: 275395 - DNA, 20 bp, Artificial Sequence
  chemically synthesized
agttaataacatttttattg

SEQ ID NO: 275396 - DNA, 20 bp, Artificial Sequence
  chemically synthesized
tttttattgtagtatttttt

SEQ ID NO: 275397 - DNA, 20 bp, Artificial Sequence
  chemically synthesized
agtatttttttagaaaaacc

SEQ ID NO: 275398 - DNA, 20 bp, Artificial Sequence
  chemically synthesized
taatagcaaaatattttgct

SEQ ID NO: 275399 - DNA, 20 bp, Artificial Sequence
  chemically synthesized
taaacattacttgtttttaa

SEQ ID NO: 275400 - DNA, 20 bp, Artificial Sequence
  chemically synthesized
aatattttgctattaaaaac

SEQ ID NO: 275401 - DNA, 20 bp, Artificial Sequence
  chemically synthesized
tcttatttagaaatggattc

SEQ ID NO: 275402 - DNA, 20 bp, Artificial Sequence
  chemically synthesized
ttcttatttagaaatggatt

SEQ ID NO: 275403 - DNA, 20 bp, Artificial Sequence
  chemically synthesized
tgttttttcttatttagaaa

SEQ ID NO: 275404 - DNA, 20 bp, Artificial Sequence
  chemically synthesized
tcctgaatccatttctaaat

SEQ ID NO: 275405 - DNA, 20 bp, Artificial Sequence
  chemically synthesized
actgtgtgttttttcttatt

SEQ ID NO: 275406 - DNA, 20 bp, Artificial Sequence
  chemically synthesized
tctaaataagaaaaaacaca

SEQ ID NO: 275407 - DNA, 20 bp, Artificial Sequence
  chemically synthesized
gttgaacaggttgtgataag

SEQ ID NO: 275408 - DNA, 20 bp, Artificial Sequence
  chemically synthesized
agttgaacaggttgtgataa

SEQ ID NO: 275409 - DNA, 20 bp, Artificial Sequence
  chemically synthesized
tagttgaacaggttgtgata

SEQ ID NO: 275410 - DNA, 20 bp, Artificial Sequence
  chemically synthesized
ttagttgaacaggttgtgat

SEQ ID NO: 275411 - DNA, 20 bp, Artificial Sequence
  chemically synthesized
cgaagcatctttagttgaac

SEQ ID NO: 275412 - DNA, 20 bp, Artificial Sequence
  chemically synthesized
gcgaagcatctttagttgaa

SEQ ID NO: 275413 - DNA, 20 bp, Artificial Sequence
  chemically synthesized
tatcacaacctgttcaacta

SEQ ID NO: 275414 - DNA, 20 bp, Artificial Sequence
  chemically synthesized
cttttagggcgaagcatctt

SEQ ID NO: 275415 - DNA, 20 bp, Artificial Sequence
  chemically synthesized
aaattggagcttttagggcg

SEQ ID NO: 275416 - DNA, 20 bp, Artificial Sequence
  chemically synthesized
ctaaagatgcttcgccctaa

SEQ ID NO: 275417 - DNA, 20 bp, Artificial Sequence
  chemically synthesized
aaggaaaattggagctttta

SEQ ID NO: 275418 - DNA, 20 bp, Artificial Sequence
  chemically synthesized
caaggaaaattggagctttt

SEQ ID NO: 275419 - DNA, 20 bp, Artificial Sequence
  chemically synthesized
tcaaggaaaattggagcttt

SEQ ID NO: 275420 - DNA, 20 bp, Artificial Sequence
  chemically synthesized
ttgtctttcaaggaaaattg

SEQ ID NO: 275421 - DNA, 20 bp, Artificial Sequence
  chemically synthesized
tattgtctttcaaggaaaat

SEQ ID NO: 275422 - DNA, 20 bp, Artificial Sequence
  chemically synthesized
aaagctccaattttccttga

SEQ ID NO: 275423 - DNA, 20 bp, Artificial Sequence
  chemically synthesized
tattatactattgtctttca

SEQ ID NO: 275424 - DNA, 20 bp, Artificial Sequence
  chemically synthesized
ctattatactattgtctttc

SEQ ID NO: 275425 - DNA, 20 bp, Artificial Sequence
  chemically synthesized
caattttccttgaaagacaa

SEQ ID NO: 275426 - DNA, 20 bp, Artificial Sequence
  chemically synthesized
cttgaaagacaatagtataa

SEQ ID NO: 275427 - DNA, 20 bp, Artificial Sequence
  chemically synthesized
agtagcaaatttgataggca

SEQ ID NO: 275428 - DNA, 20 bp, Artificial Sequence
  chemically synthesized
ttatgagtagcaaatttgat

SEQ ID NO: 275429 - DNA, 20 bp, Artificial Sequence
  chemically synthesized
attatgagtagcaaatttga

SEQ ID NO: 275430 - DNA, 20 bp, Artificial Sequence
  chemically synthesized
ttgcggaatgaaattatgag

SEQ ID NO: 275431 - DNA, 20 bp, Artificial Sequence
  chemically synthesized
gacttgcggaatgaaattat

SEQ ID NO: 275432 - DNA, 20 bp, Artificial Sequence
  chemically synthesized
tactcataatttcattccgc

SEQ ID NO: 275433 - DNA, 20 bp, Artificial Sequence
  chemically synthesized
attactttgtgacagacttg

SEQ ID NO: 275434 - DNA, 20 bp, Artificial Sequence
  chemically synthesized
cattccgcaagtctgtcaca

SEQ ID NO: 275435 - DNA, 20 bp, Artificial Sequence
  chemically synthesized
cataaagaattactttgtga

SEQ ID NO: 275436 - DNA, 20 bp, Artificial Sequence
  chemically synthesized
tttgtacttcaaaatgcata

SEQ ID NO: 275437 - DNA, 20 bp, Artificial Sequence
  chemically synthesized
gtaattctttatgcattttg

SEQ ID NO: 275438 - DNA, 20 bp, Artificial Sequence
  chemically synthesized
atactagacattaatattgc

SEQ ID NO: 275439 - DNA, 20 bp, Artificial Sequence
  chemically synthesized
aaacttgcaatattaatgtc

SEQ ID NO: 275440 - DNA, 20 bp, Artificial Sequence
  chemically synthesized
aatttgagcagtatgaatac

SEQ ID NO: 275441 - DNA, 20 bp, Artificial Sequence
  chemically synthesized
gaattaaggaaaaatttgag

SEQ ID NO: 275442 - DNA, 20 bp, Artificial Sequence
  chemically synthesized
atggaattaaggaaaaattt

SEQ ID NO: 275443 - DNA, 20 bp, Artificial Sequence
  chemically synthesized
tgacgttctgaatggaatta

SEQ ID NO: 275444 - DNA, 20 bp, Artificial Sequence
  chemically synthesized
gtgacgttctgaatggaatt

SEQ ID NO: 275445 - DNA, 20 bp, Artificial Sequence
  chemically synthesized
aatttttccttaattccatt

SEQ ID NO: 275446 - DNA, 20 bp, Artificial Sequence
  chemically synthesized
aatgcttgtgacgttctgaa

SEQ ID NO: 275447 - DNA, 20 bp, Artificial Sequence
  chemically synthesized
aattccattcagaacgtcac

SEQ ID NO: 275448 - DNA, 20 bp, Artificial Sequence
  chemically synthesized
actaatgacatgagttttga

SEQ ID NO: 275449 - DNA, 20 bp, Artificial Sequence
  chemically synthesized
aactaatgacatgagttttg

SEQ ID NO: 275450 - DNA, 20 bp, Artificial Sequence
  chemically synthesized
tccttcaaaactcatgtcat

SEQ ID NO: 275451 - DNA, 20 bp, Artificial Sequence
  chemically synthesized
ttcatttaaactaatgacat

SEQ ID NO: 275452 - DNA, 20 bp, Artificial Sequence
  chemically synthesized
catgtcattagtttaaatga

SEQ ID NO: 275453 - DNA, 20 bp, Artificial Sequence
  chemically synthesized
gtcattagtttaaatgaaag

SEQ ID NO: 275454 - DNA, 20 bp, Artificial Sequence
  chemically synthesized
actataaatgaaatacagag

SEQ ID NO: 275455 - DNA, 20 bp, Artificial Sequence
  chemically synthesized
atgactataaatgaaataca

SEQ ID NO: 275456 - DNA, 20 bp, Artificial Sequence
  chemically synthesized
acatgactataaatgaaata

SEQ ID NO: 275457 - DNA, 20 bp, Artificial Sequence
  chemically synthesized
tctactctgtatttcattta

SEQ ID NO: 275458 - DNA, 20 bp, Artificial Sequence
  chemically synthesized
gtatttcatttatagtcatg

SEQ ID NO: 275459 - DNA, 20 bp, Artificial Sequence
  chemically synthesized
tcatgtagttcttctcaatt

SEQ ID NO: 275460 - DNA, 20 bp, Artificial Sequence
  chemically synthesized
gtaattgtttctgaattgag

SEQ ID NO: 275461 - DNA, 20 bp, Artificial Sequence
  chemically synthesized
tgagtaattgtttctgaatt

SEQ ID NO: 275462 - DNA, 20 bp, Artificial Sequence
  chemically synthesized
gtaaaatgcatgataggaat

SEQ ID NO: 275463 - DNA, 20 bp, Artificial Sequence
  chemically synthesized
ggtttagtaaaatgcatgat

SEQ ID NO: 275464 - DNA, 20 bp, Artificial Sequence
  chemically synthesized
gggtttagtaaaatgcatga

SEQ ID NO: 275465 - DNA, 20 bp, Artificial Sequence
  chemically synthesized
gtgtctaccacggcagggtt

SEQ ID NO: 275466 - DNA, 20 bp, Artificial Sequence
  chemically synthesized
cattttactaaaccctgccg

SEQ ID NO: 275467 - DNA, 20 bp, Artificial Sequence
  chemically synthesized
ttagtgtgtctaccacggca

SEQ ID NO: 275468 - DNA, 20 bp, Artificial Sequence
  chemically synthesized
tttactaaaccctgccgtgg

SEQ ID NO: 275469 - DNA, 20 bp, Artificial Sequence
  chemically synthesized
tttagtgtgtctaccacggc

SEQ ID NO: 275470 - DNA, 20 bp, Artificial Sequence
  chemically synthesized
atttagtgtgtctaccacgg

SEQ ID NO: 275471 - DNA, 20 bp, Artificial Sequence
  chemically synthesized
ggtatttagtgtgtctacca

SEQ ID NO: 275472 - DNA, 20 bp, Artificial Sequence
  chemically synthesized
aatgatcaagtcagggtatt

SEQ ID NO: 275473 - DNA, 20 bp, Artificial Sequence
  chemically synthesized
aaagtgtaatgatcaagtca

SEQ ID NO: 275474 - DNA, 20 bp, Artificial Sequence
  chemically synthesized
gaaagtgtaatgatcaagtc

SEQ ID NO: 275475 - DNA, 20 bp, Artificial Sequence
  chemically synthesized
agaaagtgtaatgatcaagt

SEQ ID NO: 275476 - DNA, 20 bp, Artificial Sequence
  chemically synthesized
gtatagaaagtgtaatgatc

SEQ ID NO: 275477 - DNA, 20 bp, Artificial Sequence
  chemically synthesized
tattttcttacatgtataga

SEQ ID NO: 275478 - DNA, 20 bp, Artificial Sequence
  chemically synthesized
attacactttctatacatgt

SEQ ID NO: 275479 - DNA, 20 bp, Artificial Sequence
  chemically synthesized
gtaatattttcttacatgta

SEQ ID NO: 275480 - DNA, 20 bp, Artificial Sequence
  chemically synthesized
aaaatatttatacatattta

SEQ ID NO: 275481 - DNA, 20 bp, Artificial Sequence
  chemically synthesized
agtttgagtcataatgaaaa

SEQ ID NO: 275482 - DNA, 20 bp, Artificial Sequence
  chemically synthesized
cagtttgagtcataatgaaa

SEQ ID NO: 275483 - DNA, 20 bp, Artificial Sequence
  chemically synthesized
tttttcattatgactcaaac

SEQ ID NO: 275484 - DNA, 20 bp, Artificial Sequence
  chemically synthesized
ttttcattatgactcaaact

SEQ ID NO: 275485 - DNA, 20 bp, Artificial Sequence
  chemically synthesized
tcctaagtccgtcccagttt

SEQ ID NO: 275486 - DNA, 20 bp, Artificial Sequence
  chemically synthesized
cattatgactcaaactggga

SEQ ID NO: 275487 - DNA, 20 bp, Artificial Sequence
  chemically synthesized
aactattcctaagtccgtcc

SEQ ID NO: 275488 - DNA, 20 bp, Artificial Sequence
  chemically synthesized
gactcaaactgggacggact

SEQ ID NO: 275489 - DNA, 20 bp, Artificial Sequence
  chemically synthesized
actcaaactgggacggactt

SEQ ID NO: 275490 - DNA, 20 bp, Artificial Sequence
  chemically synthesized
aactgggacggacttaggaa

SEQ ID NO: 275491 - DNA, 20 bp, Artificial Sequence
  chemically synthesized
ctctagaattaactattcct

SEQ ID NO: 275492 - DNA, 20 bp, Artificial Sequence
  chemically synthesized
gacttaggaatagttaattc

SEQ ID NO: 275493 - DNA, 20 bp, Artificial Sequence
  chemically synthesized
cttaggaatagttaattcta

SEQ ID NO: 275494 - DNA, 20 bp, Artificial Sequence
  chemically synthesized
atagttaattctagagaacc

SEQ ID NO: 275495 - DNA, 20 bp, Artificial Sequence
  chemically synthesized
cttacacaagccaggttctc

SEQ ID NO: 275496 - DNA, 20 bp, Artificial Sequence
  chemically synthesized
ttttcaaacttacacaagcc

SEQ ID NO: 275497 - DNA, 20 bp, Artificial Sequence
  chemically synthesized
tttttcaaacttacacaagc

SEQ ID NO: 275498 - DNA, 20 bp, Artificial Sequence
  chemically synthesized
ctagagaacctggcttgtgt

SEQ ID NO: 275499 - DNA, 20 bp, Artificial Sequence
  chemically synthesized
tatatttttcaaacttacac

SEQ ID NO: 275500 - DNA, 20 bp, Artificial Sequence
  chemically synthesized
agtttgaaaaatatatatac

SEQ ID NO: 275501 - DNA, 20 bp, Artificial Sequence
  chemically synthesized
tttgaaaaatatatatactg

SEQ ID NO: 275502 - DNA, 20 bp, Artificial Sequence
  chemically synthesized
gaaaaatatatatactggag

SEQ ID NO: 275503 - DNA, 20 bp, Artificial Sequence
  chemically synthesized
aaaaatatatatactggagt

SEQ ID NO: 275504 - DNA, 20 bp, Artificial Sequence
  chemically synthesized
aggtttatacaaacctactc

SEQ ID NO: 275505 - DNA, 20 bp, Artificial Sequence
  chemically synthesized
ttttagagggtaagtgtgat

SEQ ID NO: 275506 - DNA, 20 bp, Artificial Sequence
  chemically synthesized
attttagagggtaagtgtga

SEQ ID NO: 275507 - DNA, 20 bp, Artificial Sequence
  chemically synthesized
ttgtacatattttagagggt

SEQ ID NO: 275508 - DNA, 20 bp, Artificial Sequence
  chemically synthesized
atgattgtacatattttaga

SEQ ID NO: 275509 - DNA, 20 bp, Artificial Sequence
  chemically synthesized
aatgattgtacatattttag

SEQ ID NO: 275510 - DNA, 20 bp, Artificial Sequence
  chemically synthesized
taatgattgtacatatttta

SEQ ID NO: 275511 - DNA, 20 bp, Artificial Sequence
  chemically synthesized
tataatgattgtacatattt

SEQ ID NO: 275512 - DNA, 20 bp, Artificial Sequence
  chemically synthesized
atgtacaatcattatatatc

SEQ ID NO: 275513 - DNA, 20 bp, Artificial Sequence
  chemically synthesized
aaattaaaaattgaatcctc

SEQ ID NO: 275514 - DNA, 20 bp, Artificial Sequence
  chemically synthesized
gataatagtaaacatacttg

SEQ ID NO: 275515 - DNA, 20 bp, Artificial Sequence
  chemically synthesized
ggataatagtaaacatactt

SEQ ID NO: 275516 - DNA, 20 bp, Artificial Sequence
  chemically synthesized
gtagtagaagtgagggataa

SEQ ID NO: 275517 - DNA, 20 bp, Artificial Sequence
  chemically synthesized
aaatattgtagtagaagtga

SEQ ID NO: 275518 - DNA, 20 bp, Artificial Sequence
  chemically synthesized
taaatattgtagtagaagtg

SEQ ID NO: 275519 - DNA, 20 bp, Artificial Sequence
  chemically synthesized
gtaaatattgtagtagaagt

SEQ ID NO: 275520 - DNA, 20 bp, Artificial Sequence
  chemically synthesized
aagagtaaatattgtagtag

SEQ ID NO: 275521 - DNA, 20 bp, Artificial Sequence
  chemically synthesized
aacaagagtaaatattgtag

SEQ ID NO: 275522 - DNA, 20 bp, Artificial Sequence
  chemically synthesized
ggcaacaagagtaaatattg

SEQ ID NO: 275523 - DNA, 20 bp, Artificial Sequence
  chemically synthesized
agttttccactgggcaacaa

SEQ ID NO: 275524 - DNA, 20 bp, Artificial Sequence
  chemically synthesized
caatatttactcttgttgcc

SEQ ID NO: 275525 - DNA, 20 bp, Artificial Sequence
  chemically synthesized
atagttttccactgggcaac

SEQ ID NO: 275526 - DNA, 20 bp, Artificial Sequence
  chemically synthesized
tatttactcttgttgcccag

SEQ ID NO: 275527 - DNA, 20 bp, Artificial Sequence
  chemically synthesized
cctcatcatagttttccact

SEQ ID NO: 275528 - DNA, 20 bp, Artificial Sequence
  chemically synthesized
tcctcatcatagttttccac

SEQ ID NO: 275529 - DNA, 20 bp, Artificial Sequence
  chemically synthesized
gcccagtggaaaactatgat

SEQ ID NO: 275530 - DNA, 20 bp, Artificial Sequence
  chemically synthesized
cccagtggaaaactatgatg

SEQ ID NO: 275531 - DNA, 20 bp, Artificial Sequence
  chemically synthesized
tgatgataaaatcctcatca

SEQ ID NO: 275532 - DNA, 20 bp, Artificial Sequence
  chemically synthesized
tatgatgaggattttatcat

SEQ ID NO: 275533 - DNA, 20 bp, Artificial Sequence
  chemically synthesized
atgatgaggattttatcatc

SEQ ID NO: 275534 - DNA, 20 bp, Artificial Sequence
  chemically synthesized
tgaagaaagagaattttggg

SEQ ID NO: 275535 - DNA, 20 bp, Artificial Sequence
  chemically synthesized
gatgaagaaagagaattttg

SEQ ID NO: 275536 - DNA, 20 bp, Artificial Sequence
  chemically synthesized
ggatgaagaaagagaatttt

SEQ ID NO: 275537 - DNA, 20 bp, Artificial Sequence
  chemically synthesized
tggatgaagaaagagaattt

SEQ ID NO: 275538 - DNA, 20 bp, Artificial Sequence
  chemically synthesized
tgcaatagtggatgaagaaa

SEQ ID NO: 275539 - DNA, 20 bp, Artificial Sequence
  chemically synthesized
attgcaatagtggatgaaga

SEQ ID NO: 275540 - DNA, 20 bp, Artificial Sequence
  chemically synthesized
tacaattgcaatagtggatg

SEQ ID NO: 275541 - DNA, 20 bp, Artificial Sequence
  chemically synthesized
agtgcatacaattgcaatag

SEQ ID NO: 275542 - DNA, 20 bp, Artificial Sequence
  chemically synthesized
tggagtgcatacaattgcaa

SEQ ID NO: 275543 - DNA, 20 bp, Artificial Sequence
  chemically synthesized
tgcaattgtatgcactccat

SEQ ID NO: 275544 - DNA, 20 bp, Artificial Sequence
  chemically synthesized
gcaattgtatgcactccata

SEQ ID NO: 275545 - DNA, 20 bp, Artificial Sequence
  chemically synthesized
gggaatattatttccttatg

SEQ ID NO: 275546 - DNA, 20 bp, Artificial Sequence
  chemically synthesized
cagggaatattatttcctta

SEQ ID NO: 275547 - DNA, 20 bp, Artificial Sequence
  chemically synthesized
cataaggaaataatattccc

SEQ ID NO: 275548 - DNA, 20 bp, Artificial Sequence
  chemically synthesized
tgataggcttaaaaagtcca

SEQ ID NO: 275549 - DNA, 20 bp, Artificial Sequence
  chemically synthesized
ttgataggcttaaaaagtcc

SEQ ID NO: 275550 - DNA, 20 bp, Artificial Sequence
  chemically synthesized
tttgataggcttaaaaagtc

SEQ ID NO: 275551 - DNA, 20 bp, Artificial Sequence
  chemically synthesized
taatattccctggacttttt

SEQ ID NO: 275552 - DNA, 20 bp, Artificial Sequence
  chemically synthesized
gtagttttgataggcttaaa

SEQ ID NO: 275553 - DNA, 20 bp, Artificial Sequence
  chemically synthesized
agagtataggtagttttgat

SEQ ID NO: 275554 - DNA, 20 bp, Artificial Sequence
  chemically synthesized
cagagtataggtagttttga

SEQ ID NO: 275555 - DNA, 20 bp, Artificial Sequence
  chemically synthesized
aatatgtggcagagtatagg

SEQ ID NO: 275556 - DNA, 20 bp, Artificial Sequence
  chemically synthesized
gataatatgtggcagagtat

SEQ ID NO: 275557 - DNA, 20 bp, Artificial Sequence
  chemically synthesized
tgataatatgtggcagagta

SEQ ID NO: 275558 - DNA, 20 bp, Artificial Sequence
  chemically synthesized
gtccctgataatatgtggca

SEQ ID NO: 275559 - DNA, 20 bp, Artificial Sequence
  chemically synthesized
atgtccctgataatatgtgg

SEQ ID NO: 275560 - DNA, 20 bp, Artificial Sequence
  chemically synthesized
agaatgtccctgataatatg

SEQ ID NO: 275561 - DNA, 20 bp, Artificial Sequence
  chemically synthesized
tatactctgccacatattat

SEQ ID NO: 275562 - DNA, 20 bp, Artificial Sequence
  chemically synthesized
atactctgccacatattatc

SEQ ID NO: 275563 - DNA, 20 bp, Artificial Sequence
  chemically synthesized
tactctgccacatattatca

SEQ ID NO: 275564 - DNA, 20 bp, Artificial Sequence
  chemically synthesized
catattatcagggacattct

SEQ ID NO: 275565 - DNA, 20 bp, Artificial Sequence
  chemically synthesized
atcagggacattcttggtca

SEQ ID NO: 275566 - DNA, 20 bp, Artificial Sequence
  chemically synthesized
catattgtctaactttgacc

SEQ ID NO: 275567 - DNA, 20 bp, Artificial Sequence
  chemically synthesized
gggacattcttggtcaaagt

SEQ ID NO: 275568 - DNA, 20 bp, Artificial Sequence
  chemically synthesized
ttggtcaaagttagacaata

SEQ ID NO: 275569 - DNA, 20 bp, Artificial Sequence
  chemically synthesized
aacagtatacacaatagcat

SEQ ID NO: 275570 - DNA, 20 bp, Artificial Sequence
  chemically synthesized
ctgggcaacagtatacacaa

SEQ ID NO: 275571 - DNA, 20 bp, Artificial Sequence
  chemically synthesized
ctattgtgtatactgttgcc

SEQ ID NO: 275572 - DNA, 20 bp, Artificial Sequence
  chemically synthesized
ttaataggtgttctgggcaa

SEQ ID NO: 275573 - DNA, 20 bp, Artificial Sequence
  chemically synthesized
tcaccgttaataggtgttct

SEQ ID NO: 275574 - DNA, 20 bp, Artificial Sequence
  chemically synthesized
atcaccgttaataggtgttc

SEQ ID NO: 275575 - DNA, 20 bp, Artificial Sequence
  chemically synthesized
ttgcccagaacacctattaa

SEQ ID NO: 275576 - DNA, 20 bp, Artificial Sequence
  chemically synthesized
gttaatgaatcaccgttaat

SEQ ID NO: 275577 - DNA, 20 bp, Artificial Sequence
  chemically synthesized
agttaatgaatcaccgttaa

SEQ ID NO: 275578 - DNA, 20 bp, Artificial Sequence
  chemically synthesized
tcatggttacaatgcaatta

SEQ ID NO: 275579 - DNA, 20 bp, Artificial Sequence
  chemically synthesized
tatattagatttgtagatca

SEQ ID NO: 275580 - DNA, 20 bp, Artificial Sequence
  chemically synthesized
ggggtgatatattagatttg

SEQ ID NO: 275581 - DNA, 20 bp, Artificial Sequence
  chemically synthesized
tgaatttgggggtgatatat

SEQ ID NO: 275582 - DNA, 20 bp, Artificial Sequence
  chemically synthesized
tcactttaaaatgaatttgg

SEQ ID NO: 275583 - DNA, 20 bp, Artificial Sequence
  chemically synthesized
ttcactttaaaatgaatttg

SEQ ID NO: 275584 - DNA, 20 bp, Artificial Sequence
  chemically synthesized
tttcactttaaaatgaattt

SEQ ID NO: 275585 - DNA, 20 bp, Artificial Sequence
  chemically synthesized
ttttcactttaaaatgaatt

SEQ ID NO: 275586 - DNA, 20 bp, Artificial Sequence
  chemically synthesized
tcacccccaaattcatttta

SEQ ID NO: 275587 - DNA, 20 bp, Artificial Sequence
  chemically synthesized
cattttaaagtgaaaaactt

SEQ ID NO: 275588 - DNA, 20 bp, Artificial Sequence
  chemically synthesized
ccagttggtgaagatgtctg

SEQ ID NO: 275589 - DNA, 20 bp, Artificial Sequence
  chemically synthesized
cttcagacatcttcaccaac

SEQ ID NO: 275590 - DNA, 20 bp, Artificial Sequence
  chemically synthesized
cttctccctgccagttggtg

SEQ ID NO: 275591 - DNA, 20 bp, Artificial Sequence
  chemically synthesized
cagacatcttcaccaactgg

SEQ ID NO: 275592 - DNA, 20 bp, Artificial Sequence
  chemically synthesized
agacatcttcaccaactggc

SEQ ID NO: 275593 - DNA, 20 bp, Artificial Sequence
  chemically synthesized
gacatcttcaccaactggca

SEQ ID NO: 275594 - DNA, 20 bp, Artificial Sequence
  chemically synthesized
aaagccttctccctgccagt

SEQ ID NO: 275595 - DNA, 20 bp, Artificial Sequence
  chemically synthesized
catcttcaccaactggcagg

SEQ ID NO: 275596 - DNA, 20 bp, Artificial Sequence
  chemically synthesized
tctcaaagccttctccctgc

SEQ ID NO: 275597 - DNA, 20 bp, Artificial Sequence
  chemically synthesized
cttcaccaactggcagggag

SEQ ID NO: 275598 - DNA, 20 bp, Artificial Sequence
  chemically synthesized
ttcaccaactggcagggaga

SEQ ID NO: 275599 - DNA, 20 bp, Artificial Sequence
  chemically synthesized
actggcagggagaaggcttt

SEQ ID NO: 275600 - DNA, 20 bp, Artificial Sequence
  chemically synthesized
aaggttagctgcaaatctca

SEQ ID NO: 275601 - DNA, 20 bp, Artificial Sequence
  chemically synthesized
ggagaaggctttgagatttg

SEQ ID NO: 275602 - DNA, 20 bp, Artificial Sequence
  chemically synthesized
gagatttgcagctaaccttc

SEQ ID NO: 275603 - DNA, 20 bp, Artificial Sequence
  chemically synthesized
tgagaggagcactagaaggt

SEQ ID NO: 275604 - DNA, 20 bp, Artificial Sequence
  chemically synthesized
atgatgagaggagcactaga

SEQ ID NO: 275605 - DNA, 20 bp, Artificial Sequence
  chemically synthesized
tatgatgagaggagcactag

SEQ ID NO: 275606 - DNA, 20 bp, Artificial Sequence
  chemically synthesized
tgctatgatgagaggagcac

SEQ ID NO: 275607 - DNA, 20 bp, Artificial Sequence
  chemically synthesized
agtccatgctatgatgagag

SEQ ID NO: 275608 - DNA, 20 bp, Artificial Sequence
  chemically synthesized
ttctagtgctcctctcatca

SEQ ID NO: 275609 - DNA, 20 bp, Artificial Sequence
  chemically synthesized
caagtccatgctatgatgag

SEQ ID NO: 275610 - DNA, 20 bp, Artificial Sequence
  chemically synthesized
ccaagtccatgctatgatga

SEQ ID NO: 275611 - DNA, 20 bp, Artificial Sequence
  chemically synthesized
caccaagtccatgctatgat

SEQ ID NO: 275612 - DNA, 20 bp, Artificial Sequence
  chemically synthesized
gtgctcctctcatcatagca

SEQ ID NO: 275613 - DNA, 20 bp, Artificial Sequence
  chemically synthesized
ctctcatcatagcatggact

SEQ ID NO: 275614 - DNA, 20 bp, Artificial Sequence
  chemically synthesized
catagcatggacttggtgat

SEQ ID NO: 275615 - DNA, 20 bp, Artificial Sequence
  chemically synthesized
atagcatggacttggtgatt

SEQ ID NO: 275616 - DNA, 20 bp, Artificial Sequence
  chemically synthesized
atgttgtgaacccaatcacc

SEQ ID NO: 275617 - DNA, 20 bp, Artificial Sequence
  chemically synthesized
tgggttcacaacatgtatat

SEQ ID NO: 275618 - DNA, 20 bp, Artificial Sequence
  chemically synthesized
acatgtatataagatttgaa

SEQ ID NO: 275619 - DNA, 20 bp, Artificial Sequence
  chemically synthesized
tgtatataagatttgaaaag

SEQ ID NO: 275620 - DNA, 20 bp, Artificial Sequence
  chemically synthesized
taagatttgaaaagcagatc

SEQ ID NO: 275621 - DNA, 20 bp, Artificial Sequence
  chemically synthesized
ggttgtgtgatcgcaattac

SEQ ID NO: 275622 - DNA, 20 bp, Artificial Sequence
  chemically synthesized
attgcgatcacacaacccta

SEQ ID NO: 275623 - DNA, 20 bp, Artificial Sequence
  chemically synthesized
tatttattcaaaagtcttta

SEQ ID NO: 275624 - DNA, 20 bp, Artificial Sequence
  chemically synthesized
ttatttattcaaaagtcttt

SEQ ID NO: 275625 - DNA, 20 bp, Artificial Sequence
  chemically synthesized
attatttattcaaaagtctt

SEQ ID NO: 275626 - DNA, 20 bp, Artificial Sequence
  chemically synthesized
cataggtattatttattcaa

SEQ ID NO: 275627 - DNA, 20 bp, Artificial Sequence
  chemically synthesized
aacatatgtgaagttatcat

SEQ ID NO: 275628 - DNA, 20 bp, Artificial Sequence
  chemically synthesized
aaacatatgtgaagttatca

SEQ ID NO: 275629 - DNA, 20 bp, Artificial Sequence
  chemically synthesized
ttaacatttaaacatatgtg

SEQ ID NO: 275630 - DNA, 20 bp, Artificial Sequence
  chemically synthesized
ttaaatgttaattaaaaaat

SEQ ID NO: 275631 - DNA, 20 bp, Artificial Sequence
  chemically synthesized
tgttaattaaaaaatgagaa

SEQ ID NO: 275632 - DNA, 20 bp, Artificial Sequence
  chemically synthesized
cattttaaaaatacttctta

SEQ ID NO: 275633 - DNA, 20 bp, Artificial Sequence
  chemically synthesized
aaatttacattcactgtaag

SEQ ID NO: 275634 - DNA, 20 bp, Artificial Sequence
  chemically synthesized
actaaatttacattcactgt

SEQ ID NO: 275635 - DNA, 20 bp, Artificial Sequence
  chemically synthesized
tcttacagtgaatgtaaatt

SEQ ID NO: 275636 - DNA, 20 bp, Artificial Sequence
  chemically synthesized
agtgaatgtaaatttagtta

SEQ ID NO: 275637 - DNA, 20 bp, Artificial Sequence
  chemically synthesized
cttttaaatgagtaaatttt

SEQ ID NO: 275638 - DNA, 20 bp, Artificial Sequence
  chemically synthesized
acttttaaatgagtaaattt

SEQ ID NO: 275639 - DNA, 20 bp, Artificial Sequence
  chemically synthesized
cctaaaatttactcatttaa

SEQ ID NO: 275640 - DNA, 20 bp, Artificial Sequence
  chemically synthesized
atctgagttgacttttaaat

SEQ ID NO: 275641 - DNA, 20 bp, Artificial Sequence
  chemically synthesized
tactcatttaaaagtcaact

SEQ ID NO: 275642 - DNA, 20 bp, Artificial Sequence
  chemically synthesized
atagtgttgaaaataaatct

SEQ ID NO: 275643 - DNA, 20 bp, Artificial Sequence
  chemically synthesized
ttctagaatgagaattaaaa

SEQ ID NO: 275644 - DNA, 20 bp, Artificial Sequence
  chemically synthesized
cactattttaattctcattc

SEQ ID NO: 275645 - DNA, 20 bp, Artificial Sequence
  chemically synthesized
tttacctgtttttctagaat

SEQ ID NO: 275646 - DNA, 20 bp, Artificial Sequence
  chemically synthesized
taattctcattctagaaaaa

SEQ ID NO: 275647 - DNA, 20 bp, Artificial Sequence
  chemically synthesized
aattctcattctagaaaaac

SEQ ID NO: 275648 - DNA, 20 bp, Artificial Sequence
  chemically synthesized
aacgtgtttacctgtttttc

SEQ ID NO: 275649 - DNA, 20 bp, Artificial Sequence
  chemically synthesized
tttatattttcgtttgaatg

SEQ ID NO: 275650 - DNA, 20 bp, Artificial Sequence
  chemically synthesized
attttcgtttgaatgaagca

SEQ ID NO: 275651 - DNA, 20 bp, Artificial Sequence
  chemically synthesized
ttttcgtttgaatgaagcat

SEQ ID NO: 275652 - DNA, 20 bp, Artificial Sequence
  chemically synthesized
ttcgtttgaatgaagcatgg

SEQ ID NO: 275653 - DNA, 20 bp, Artificial Sequence
  chemically synthesized
tttgaatgaagcatgggagt

SEQ ID NO: 275654 - DNA, 20 bp, Artificial Sequence
  chemically synthesized
agcatgggagtgagtgcatg

SEQ ID NO: 275655 - DNA, 20 bp, Artificial Sequence
  chemically synthesized
tgagtgcatgtagctatatt

SEQ ID NO: 275656 - DNA, 20 bp, Artificial Sequence
  chemically synthesized
attaatgatcatgctcaata

SEQ ID NO: 275657 - DNA, 20 bp, Artificial Sequence
  chemically synthesized
gagcatgatcattaataatt

SEQ ID NO: 275658 - DNA, 20 bp, Artificial Sequence
  chemically synthesized
agcatgatcattaataattg

SEQ ID NO: 275659 - DNA, 20 bp, Artificial Sequence
  chemically synthesized
atgtgttagttacaagcagt

SEQ ID NO: 275660 - DNA, 20 bp, Artificial Sequence
  chemically synthesized
aaaaatgtgttagttacaag

SEQ ID NO: 275661 - DNA, 20 bp, Artificial Sequence
  chemically synthesized
tataaaaatgtgttagttac

SEQ ID NO: 275662 - DNA, 20 bp, Artificial Sequence
  chemically synthesized
attgttttataaaaatgtgt

SEQ ID NO: 275663 - DNA, 20 bp, Artificial Sequence
  chemically synthesized
cacatttttataaaacaata

SEQ ID NO: 275664 - DNA, 20 bp, Artificial Sequence
  chemically synthesized
aaactcctcgtttagtcaca

SEQ ID NO: 275665 - DNA, 20 bp, Artificial Sequence
  chemically synthesized
tatagaccatgtgactaaac

SEQ ID NO: 275666 - DNA, 20 bp, Artificial Sequence
  chemically synthesized
atagaccatgtgactaaacg

SEQ ID NO: 275667 - DNA, 20 bp, Artificial Sequence
  chemically synthesized
agaccatgtgactaaacgag

SEQ ID NO: 275668 - DNA, 20 bp, Artificial Sequence
  chemically synthesized
tttattataaactcctcgtt

SEQ ID NO: 275669 - DNA, 20 bp, Artificial Sequence
  chemically synthesized
gagtttataataaaatgttt

SEQ ID NO: 275670 - DNA, 20 bp, Artificial Sequence
  chemically synthesized
tctatggcattgttggaaag

SEQ ID NO: 275671 - DNA, 20 bp, Artificial Sequence
  chemically synthesized
ttttctatggcattgttgga

SEQ ID NO: 275672 - DNA, 20 bp, Artificial Sequence
  chemically synthesized
aatattttctatggcattgt

SEQ ID NO: 275673 - DNA, 20 bp, Artificial Sequence
  chemically synthesized
actgctttccaacaatgcca

SEQ ID NO: 275674 - DNA, 20 bp, Artificial Sequence
  chemically synthesized
aaaaaagaaaatattttcta

SEQ ID NO: 275675 - DNA, 20 bp, Artificial Sequence
  chemically synthesized
ctatcttataaaaagaaaaa

SEQ ID NO: 275676 - DNA, 20 bp, Artificial Sequence
  chemically synthesized
ttttctttttttctttttat

SEQ ID NO: 275677 - DNA, 20 bp, Artificial Sequence
  chemically synthesized
gcgagactctatcttataaa

SEQ ID NO: 275678 - DNA, 20 bp, Artificial Sequence
  chemically synthesized
ctttttttctttttataaga

SEQ ID NO: 275679 - DNA, 20 bp, Artificial Sequence
  chemically synthesized
ttttttctttttataagata

SEQ ID NO: 275680 - DNA, 20 bp, Artificial Sequence
  chemically synthesized
actccagcctggaacagagc

SEQ ID NO: 275681 - DNA, 20 bp, Artificial Sequence
  chemically synthesized
gatagagtctcgctctgttc

SEQ ID NO: 275682 - DNA, 20 bp, Artificial Sequence
  chemically synthesized
atagagtctcgctctgttcc

SEQ ID NO: 275683 - DNA, 20 bp, Artificial Sequence
  chemically synthesized
ctgtactccagcctggaaca

SEQ ID NO: 275684 - DNA, 20 bp, Artificial Sequence
  chemically synthesized
cactgtactccagcctggaa

SEQ ID NO: 275685 - DNA, 20 bp, Artificial Sequence
  chemically synthesized
agtctcgctctgttccaggc

SEQ ID NO: 275686 - DNA, 20 bp, Artificial Sequence
  chemically synthesized
tctcgctctgttccaggctg

SEQ ID NO: 275687 - DNA, 20 bp, Artificial Sequence
  chemically synthesized
tgcaccactgtactccagcc

SEQ ID NO: 275688 - DNA, 20 bp, Artificial Sequence
  chemically synthesized
ctctgttccaggctggagta

SEQ ID NO: 275689 - DNA, 20 bp, Artificial Sequence
  chemically synthesized
gagattgcaccactgtactc

SEQ ID NO: 275690 - DNA, 20 bp, Artificial Sequence
  chemically synthesized
tgttccaggctggagtacag

SEQ ID NO: 275691 - DNA, 20 bp, Artificial Sequence
  chemically synthesized
ggagtacagtggtgcaatct

SEQ ID NO: 275692 - DNA, 20 bp, Artificial Sequence
  chemically synthesized
ggcggaggttgcagtgagcc

SEQ ID NO: 275693 - DNA, 20 bp, Artificial Sequence
  chemically synthesized
cgggaggcggaggttgcagt

SEQ ID NO: 275694 - DNA, 20 bp, Artificial Sequence
  chemically synthesized
aacacgggaggcggaggttg

SEQ ID NO: 275695 - DNA, 20 bp, Artificial Sequence
  chemically synthesized
cacttgaacacgggaggcgg

SEQ ID NO: 275696 - DNA, 20 bp, Artificial Sequence
  chemically synthesized
tcacttgaacacgggaggcg

SEQ ID NO: 275697 - DNA, 20 bp, Artificial Sequence
  chemically synthesized
aatcacttgaacacgggagg

SEQ ID NO: 275698 - DNA, 20 bp, Artificial Sequence
  chemically synthesized
gagaatcacttgaacacggg

SEQ ID NO: 275699 - DNA, 20 bp, Artificial Sequence
  chemically synthesized
ggagaatcacttgaacacgg

SEQ ID NO: 275700 - DNA, 20 bp, Artificial Sequence
  chemically synthesized
aacctccgcctcccgtgttc

SEQ ID NO: 275701 - DNA, 20 bp, Artificial Sequence
  chemically synthesized
caggagaatcacttgaacac

SEQ ID NO: 275702 - DNA, 20 bp, Artificial Sequence
  chemically synthesized
gcaggagaatcacttgaaca

SEQ ID NO: 275703 - DNA, 20 bp, Artificial Sequence
  chemically synthesized
ttcaagtgattctcctgcct

SEQ ID NO: 275704 - DNA, 20 bp, Artificial Sequence
  chemically synthesized
tactcgggaggctgaggcag

SEQ ID NO: 275705 - DNA, 20 bp, Artificial Sequence
  chemically synthesized
gctactcgggaggctgaggc

SEQ ID NO: 275706 - DNA, 20 bp, Artificial Sequence
  chemically synthesized
agctactcgggaggctgagg

SEQ ID NO: 275707 - DNA, 20 bp, Artificial Sequence
  chemically synthesized
cccagctactcgggaggctg

SEQ ID NO: 275708 - DNA, 20 bp, Artificial Sequence
  chemically synthesized
tcccagctactcgggaggct

SEQ ID NO: 275709 - DNA, 20 bp, Artificial Sequence
  chemically synthesized
ttctcctgcctcagcctccc

SEQ ID NO: 275710 - DNA, 20 bp, Artificial Sequence
  chemically synthesized
tcctgcctcagcctcccgag

SEQ ID NO: 275711 - DNA, 20 bp, Artificial Sequence
  chemically synthesized
tgtaatcccagctactcggg

SEQ ID NO: 275712 - DNA, 20 bp, Artificial Sequence
  chemically synthesized
ctgtaatcccagctactcgg

SEQ ID NO: 275713 - DNA, 20 bp, Artificial Sequence
  chemically synthesized
gcctcagcctcccgagtagc

SEQ ID NO: 275714 - DNA, 20 bp, Artificial Sequence
  chemically synthesized
gcctgtaatcccagctactc

SEQ ID NO: 275715 - DNA, 20 bp, Artificial Sequence
  chemically synthesized
cctcagcctcccgagtagct

SEQ ID NO: 275716 - DNA, 20 bp, Artificial Sequence
  chemically synthesized
cgcctgtaatcccagctact

SEQ ID NO: 275717 - DNA, 20 bp, Artificial Sequence
  chemically synthesized
ctcccgagtagctgggatta

SEQ ID NO: 275718 - DNA, 20 bp, Artificial Sequence
  chemically synthesized
tcccgagtagctgggattac

SEQ ID NO: 275719 - DNA, 20 bp, Artificial Sequence
  chemically synthesized
ttggcacgcgcctgtaatcc

SEQ ID NO: 275720 - DNA, 20 bp, Artificial Sequence
  chemically synthesized
caggcgcgtgccaacaaacc

SEQ ID NO: 275721 - DNA, 20 bp, Artificial Sequence
  chemically synthesized
caaaaattagccaggtttgt

SEQ ID NO: 275722 - DNA, 20 bp, Artificial Sequence
  chemically synthesized
taaaaatacaaaaattagcc

SEQ ID NO: 275723 - DNA, 20 bp, Artificial Sequence
  chemically synthesized
ctaaaaatacaaaaattagc

SEQ ID NO: 275724 - DNA, 20 bp, Artificial Sequence
  chemically synthesized
tctactaaaaatacaaaaat

SEQ ID NO: 275725 - DNA, 20 bp, Artificial Sequence
  chemically synthesized
ctggctaatttttgtatttt

SEQ ID NO: 275726 - DNA, 20 bp, Artificial Sequence
  chemically synthesized
gctaatttttgtatttttag

SEQ ID NO: 275727 - DNA, 20 bp, Artificial Sequence
  chemically synthesized
taatttttgtatttttagta

SEQ ID NO: 275728 - DNA, 20 bp, Artificial Sequence
  chemically synthesized
ttttgtatttttagtagaga

SEQ ID NO: 275729 - DNA, 20 bp, Artificial Sequence
  chemically synthesized
tttgtatttttagtagagac

SEQ ID NO: 275730 - DNA, 20 bp, Artificial Sequence
  chemically synthesized
ttgtatttttagtagagaca

SEQ ID NO: 275731 - DNA, 20 bp, Artificial Sequence
  chemically synthesized
gagacagggtttcaccatgt

SEQ ID NO: 275732 - DNA, 20 bp, Artificial Sequence
  chemically synthesized
cagggtttcaccatgttggc

SEQ ID NO: 275733 - DNA, 20 bp, Artificial Sequence
  chemically synthesized
caagaccagcctggccaaca

SEQ ID NO: 275734 - DNA, 20 bp, Artificial Sequence
  chemically synthesized
agggtttcaccatgttggcc

SEQ ID NO: 275735 - DNA, 20 bp, Artificial Sequence
  chemically synthesized
tttcaccatgttggccaggc

SEQ ID NO: 275736 - DNA, 20 bp, Artificial Sequence
  chemically synthesized
tcaggagttcaagaccagcc

SEQ ID NO: 275737 - DNA, 20 bp, Artificial Sequence
  chemically synthesized
caatgtcaggagttcaagac

SEQ ID NO: 275738 - DNA, 20 bp, Artificial Sequence
  chemically synthesized
aatcacaatgtcaggagttc

SEQ ID NO: 275739 - DNA, 20 bp, Artificial Sequence
  chemically synthesized
cccacgaatcacaatgtcag

SEQ ID NO: 275740 - DNA, 20 bp, Artificial Sequence
  chemically synthesized
ggcccacgaatcacaatgtc

SEQ ID NO: 275741 - DNA, 20 bp, Artificial Sequence
  chemically synthesized
aggcccacgaatcacaatgt

SEQ ID NO: 275742 - DNA, 20 bp, Artificial Sequence
  chemically synthesized
actcctgacattgtgattcg

SEQ ID NO: 275743 - DNA, 20 bp, Artificial Sequence
  chemically synthesized
ctcctgacattgtgattcgt

SEQ ID NO: 275744 - DNA, 20 bp, Artificial Sequence
  chemically synthesized
acattgtgattcgtgggcct

SEQ ID NO: 275745 - DNA, 20 bp, Artificial Sequence
  chemically synthesized
cccagccctttgggatgctg

SEQ ID NO: 275746 - DNA, 20 bp, Artificial Sequence
  chemically synthesized
tcccagccctttgggatgct

SEQ ID NO: 275747 - DNA, 20 bp, Artificial Sequence
  chemically synthesized
tcgtgggcctcagcatccca

SEQ ID NO: 275748 - DNA, 20 bp, Artificial Sequence
  chemically synthesized
cgtgggcctcagcatcccaa

SEQ ID NO: 275749 - DNA, 20 bp, Artificial Sequence
  chemically synthesized
gtgggcctcagcatcccaaa

SEQ ID NO: 275750 - DNA, 20 bp, Artificial Sequence
  chemically synthesized
gcctcagcatcccaaagggc

SEQ ID NO: 275751 - DNA, 20 bp, Artificial Sequence
  chemically synthesized
acctgtaatcccagcccttt

SEQ ID NO: 275752 - DNA, 20 bp, Artificial Sequence
  chemically synthesized
cctcagcatcccaaagggct

SEQ ID NO: 275753 - DNA, 20 bp, Artificial Sequence
  chemically synthesized
cacctgtaatcccagccctt

SEQ ID NO: 275754 - DNA, 20 bp, Artificial Sequence
  chemically synthesized
atcccaaagggctgggatta

SEQ ID NO: 275755 - DNA, 20 bp, Artificial Sequence
  chemically synthesized
tcccaaagggctgggattac

SEQ ID NO: 275756 - DNA, 20 bp, Artificial Sequence
  chemically synthesized
gtggctcacacctgtaatcc

SEQ ID NO: 275757 - DNA, 20 bp, Artificial Sequence
  chemically synthesized
agggctgggattacaggtgt

SEQ ID NO: 275758 - DNA, 20 bp, Artificial Sequence
  chemically synthesized
caggtgtgagccaccacacc

SEQ ID NO: 275759 - DNA, 20 bp, Artificial Sequence
  chemically synthesized
tgttttttggccgggtgtgg

SEQ ID NO: 275760 - DNA, 20 bp, Artificial Sequence
  chemically synthesized
aaatgttttttggccgggtg

SEQ ID NO: 275761 - DNA, 20 bp, Artificial Sequence
  chemically synthesized
aaagaaaatgttttttggcc

SEQ ID NO: 275762 - DNA, 20 bp, Artificial Sequence
  chemically synthesized
taaagaaaatgttttttggc

SEQ ID NO: 275763 - DNA, 20 bp, Artificial Sequence
  chemically synthesized
atggtaaagaaaatgttttt

SEQ ID NO: 275764 - DNA, 20 bp, Artificial Sequence
  chemically synthesized
ccataggatagtaaatggta

SEQ ID NO: 275765 - DNA, 20 bp, Artificial Sequence
  chemically synthesized
taaaaccataggatagtaaa

SEQ ID NO: 275766 - DNA, 20 bp, Artificial Sequence
  chemically synthesized
ctttaccatttactatccta

SEQ ID NO: 275767 - DNA, 20 bp, Artificial Sequence
  chemically synthesized
gctagagtaaaaccatagga

SEQ ID NO: 275768 - DNA, 20 bp, Artificial Sequence
  chemically synthesized
aaaagctagagtaaaaccat

SEQ ID NO: 275769 - DNA, 20 bp, Artificial Sequence
  chemically synthesized
taaaagctagagtaaaacca

SEQ ID NO: 275770 - DNA, 20 bp, Artificial Sequence
  chemically synthesized
actatcctatggttttactc

SEQ ID NO: 275771 - DNA, 20 bp, Artificial Sequence
  chemically synthesized
tatggttttactctagcttt

SEQ ID NO: 275772 - DNA, 20 bp, Artificial Sequence
  chemically synthesized
tcaaactatactaaaagcta

SEQ ID NO: 275773 - DNA, 20 bp, Artificial Sequence
  chemically synthesized
cttcaaactatactaaaagc

SEQ ID NO: 275774 - DNA, 20 bp, Artificial Sequence
  chemically synthesized
ttttactctagcttttagta

SEQ ID NO: 275775 - DNA, 20 bp, Artificial Sequence
  chemically synthesized
ctgacttcaaactatactaa

SEQ ID NO: 275776 - DNA, 20 bp, Artificial Sequence
  chemically synthesized
ctagcttttagtatagtttg

SEQ ID NO: 275777 - DNA, 20 bp, Artificial Sequence
  chemically synthesized
cttttagtatagtttgaagt

SEQ ID NO: 275778 - DNA, 20 bp, Artificial Sequence
  chemically synthesized
tagtttgaagtcagaaacac

SEQ ID NO: 275779 - DNA, 20 bp, Artificial Sequence
  chemically synthesized
aagacaggagcaatacgttc

SEQ ID NO: 275780 - DNA, 20 bp, Artificial Sequence
  chemically synthesized
taaagacatttcaaagacag

SEQ ID NO: 275781 - DNA, 20 bp, Artificial Sequence
  chemically synthesized
aataaagacatttcaaagac

SEQ ID NO: 275782 - DNA, 20 bp, Artificial Sequence
  chemically synthesized
aaataaagacatttcaaaga

SEQ ID NO: 275783 - DNA, 20 bp, Artificial Sequence
  chemically synthesized
tttgaaataaagacatttca

SEQ ID NO: 275784 - DNA, 20 bp, Artificial Sequence
  chemically synthesized
taatggaggaatttgaaata

SEQ ID NO: 275785 - DNA, 20 bp, Artificial Sequence
  chemically synthesized
tttttttaaggatgtaatgg

SEQ ID NO: 275786 - DNA, 20 bp, Artificial Sequence
  chemically synthesized
atttttttaaggatgtaatg

SEQ ID NO: 275787 - DNA, 20 bp, Artificial Sequence
  chemically synthesized
ttatttttttaaggatgtaa

SEQ ID NO: 275788 - DNA, 20 bp, Artificial Sequence
  chemically synthesized
gtctaagatttattttttta

SEQ ID NO: 275789 - DNA, 20 bp, Artificial Sequence
  chemically synthesized
agtctaagatttattttttt

SEQ ID NO: 275790 - DNA, 20 bp, Artificial Sequence
  chemically synthesized
atccttaaaaaaataaatct

SEQ ID NO: 275791 - DNA, 20 bp, Artificial Sequence
  chemically synthesized
ggggtctagatcattagtct

SEQ ID NO: 275792 - DNA, 20 bp, Artificial Sequence
  chemically synthesized
taaatcttagactaatgatc

SEQ ID NO: 275793 - DNA, 20 bp, Artificial Sequence
  chemically synthesized
gaaaagggggtctagatcat

SEQ ID NO: 275794 - DNA, 20 bp, Artificial Sequence
  chemically synthesized
ggtaggaagaaaagggggtc

SEQ ID NO: 275795 - DNA, 20 bp, Artificial Sequence
  chemically synthesized
aggtaggtaggaagaaaagg

SEQ ID NO: 275796 - DNA, 20 bp, Artificial Sequence
  chemically synthesized
gaggtaggtaggaagaaaag

SEQ ID NO: 275797 - DNA, 20 bp, Artificial Sequence
  chemically synthesized
ggaggtaggtaggaagaaaa

SEQ ID NO: 275798 - DNA, 20 bp, Artificial Sequence
  chemically synthesized
tggaggtaggtaggaagaaa

SEQ ID NO: 275799 - DNA, 20 bp, Artificial Sequence
  chemically synthesized
ttggaggtaggtaggaagaa

SEQ ID NO: 275800 - DNA, 20 bp, Artificial Sequence
  chemically synthesized
actatttggaggtaggtagg

SEQ ID NO: 275801 - DNA, 20 bp, Artificial Sequence
  chemically synthesized
ttgactatttggaggtaggt

SEQ ID NO: 275802 - DNA, 20 bp, Artificial Sequence
  chemically synthesized
tttgactatttggaggtagg

SEQ ID NO: 275803 - DNA, 20 bp, Artificial Sequence
  chemically synthesized
tgatttgactatttggaggt

SEQ ID NO: 275804 - DNA, 20 bp, Artificial Sequence
  chemically synthesized
ctgatttgactatttggagg

SEQ ID NO: 275805 - DNA, 20 bp, Artificial Sequence
  chemically synthesized
tcttcctacctacctccaaa

SEQ ID NO: 275806 - DNA, 20 bp, Artificial Sequence
  chemically synthesized
tcactgatttgactatttgg

SEQ ID NO: 275807 - DNA, 20 bp, Artificial Sequence
  chemically synthesized
ttcactgatttgactatttg

SEQ ID NO: 275808 - DNA, 20 bp, Artificial Sequence
  chemically synthesized
gattcactgatttgactatt

SEQ ID NO: 275809 - DNA, 20 bp, Artificial Sequence
  chemically synthesized
ctacctccaaatagtcaaat

SEQ ID NO: 275810 - DNA, 20 bp, Artificial Sequence
  chemically synthesized
agtgaatcaaaacaacccca

SEQ ID NO: 275811 - DNA, 20 bp, Artificial Sequence
  chemically synthesized
tattcaactagttttccatg

SEQ ID NO: 275812 - DNA, 20 bp, Artificial Sequence
  chemically synthesized
ttattcaactagttttccat

SEQ ID NO: 275813 - DNA, 20 bp, Artificial Sequence
  chemically synthesized
tttattcaactagttttcca

SEQ ID NO: 275814 - DNA, 20 bp, Artificial Sequence
  chemically synthesized
aaaacaaccccatggaaaac

SEQ ID NO: 275815 - DNA, 20 bp, Artificial Sequence
  chemically synthesized
taactttaaatttattcaac

SEQ ID NO: 275816 - DNA, 20 bp, Artificial Sequence
  chemically synthesized
aaactagttgaataaattta

SEQ ID NO: 275817 - DNA, 20 bp, Artificial Sequence
  chemically synthesized
tagttgaataaatttaaagt

SEQ ID NO: 275818 - DNA, 20 bp, Artificial Sequence
  chemically synthesized
attacttcaacaaaatgttg

SEQ ID NO: 275819 - DNA, 20 bp, Artificial Sequence
  chemically synthesized
aacactgcaacattttgttg

SEQ ID NO: 275820 - DNA, 20 bp, Artificial Sequence
  chemically synthesized
tgttgaagtaataaaaacaa

SEQ ID NO: 275821 - DNA, 20 bp, Artificial Sequence
  chemically synthesized
aagtaataaaaacaaaagaa

SEQ ID NO: 275822 - DNA, 20 bp, Artificial Sequence
  chemically synthesized
taataaaaacaaaagaatgg

SEQ ID NO: 275823 - DNA, 20 bp, Artificial Sequence
  chemically synthesized
aaagaatggaagctgattcc

SEQ ID NO: 275824 - DNA, 20 bp, Artificial Sequence
  chemically synthesized
aggcaagtacatctgggaat

SEQ ID NO: 275825 - DNA, 20 bp, Artificial Sequence
  chemically synthesized
aagcccaggcaagtacatct

SEQ ID NO: 275826 - DNA, 20 bp, Artificial Sequence
  chemically synthesized
gaagcccaggcaagtacatc

SEQ ID NO: 275827 - DNA, 20 bp, Artificial Sequence
  chemically synthesized
gattcccagatgtacttgcc

SEQ ID NO: 275828 - DNA, 20 bp, Artificial Sequence
  chemically synthesized
attcccagatgtacttgcct

SEQ ID NO: 275829 - DNA, 20 bp, Artificial Sequence
  chemically synthesized
atgcctcaggaagcccaggc

SEQ ID NO: 275830 - DNA, 20 bp, Artificial Sequence
  chemically synthesized
tcaaatgcctcaggaagccc

SEQ ID NO: 275831 - DNA, 20 bp, Artificial Sequence
  chemically synthesized
ctcaaatgcctcaggaagcc

SEQ ID NO: 275832 - DNA, 20 bp, Artificial Sequence
  chemically synthesized
tgtacttgcctgggcttcct

SEQ ID NO: 275833 - DNA, 20 bp, Artificial Sequence
  chemically synthesized
gtacttgcctgggcttcctg

SEQ ID NO: 275834 - DNA, 20 bp, Artificial Sequence
  chemically synthesized
cgcagctcaaatgcctcagg

SEQ ID NO: 275835 - DNA, 20 bp, Artificial Sequence
  chemically synthesized
ggacgcagctcaaatgcctc

SEQ ID NO: 275836 - DNA, 20 bp, Artificial Sequence
  chemically synthesized
tggacgcagctcaaatgcct

SEQ ID NO: 275837 - DNA, 20 bp, Artificial Sequence
  chemically synthesized
ctgggcttcctgaggcattt

SEQ ID NO: 275838 - DNA, 20 bp, Artificial Sequence
  chemically synthesized
tattgcagacaaggtggacg

SEQ ID NO: 275839 - DNA, 20 bp, Artificial Sequence
  chemically synthesized
agcttatattgcagacaagg

SEQ ID NO: 275840 - DNA, 20 bp, Artificial Sequence
  chemically synthesized
ggcagcttatattgcagaca

SEQ ID NO: 275841 - DNA, 20 bp, Artificial Sequence
  chemically synthesized
tggcagcttatattgcagac

SEQ ID NO: 275842 - DNA, 20 bp, Artificial Sequence
  chemically synthesized
gtccaccttgtctgcaatat

SEQ ID NO: 275843 - DNA, 20 bp, Artificial Sequence
  chemically synthesized
gcagttggcagcttatattg

SEQ ID NO: 275844 - DNA, 20 bp, Artificial Sequence
  chemically synthesized
attcattgacaagcagttgg

SEQ ID NO: 275845 - DNA, 20 bp, Artificial Sequence
  chemically synthesized
cacattcattgacaagcagt

SEQ ID NO: 275846 - DNA, 20 bp, Artificial Sequence
  chemically synthesized
ccctcacattcattgacaag

SEQ ID NO: 275847 - DNA, 20 bp, Artificial Sequence
  chemically synthesized
agtccctcacattcattgac

SEQ ID NO: 275848 - DNA, 20 bp, Artificial Sequence
  chemically synthesized
aactgcttgtcaatgaatgt

SEQ ID NO: 275849 - DNA, 20 bp, Artificial Sequence
  chemically synthesized
actgcttgtcaatgaatgtg

SEQ ID NO: 275850 - DNA, 20 bp, Artificial Sequence
  chemically synthesized
ctgcttgtcaatgaatgtga

SEQ ID NO: 275851 - DNA, 20 bp, Artificial Sequence
  chemically synthesized
caatgaatgtgagggactcc

SEQ ID NO: 275852 - DNA, 20 bp, Artificial Sequence
  chemically synthesized
atgtgagggactcctggatt

SEQ ID NO: 275853 - DNA, 20 bp, Artificial Sequence
  chemically synthesized
aatccttacacttaatccag

SEQ ID NO: 275854 - DNA, 20 bp, Artificial Sequence
  chemically synthesized
aaaatccttacacttaatcc

SEQ ID NO: 275855 - DNA, 20 bp, Artificial Sequence
  chemically synthesized
aaaaatccttacacttaatc

SEQ ID NO: 275856 - DNA, 20 bp, Artificial Sequence
  chemically synthesized
gggactcctggattaagtgt

SEQ ID NO: 275857 - DNA, 20 bp, Artificial Sequence
  chemically synthesized
ggactcctggattaagtgta

SEQ ID NO: 275858 - DNA, 20 bp, Artificial Sequence
  chemically synthesized
gattaagtgtaaggattttt

SEQ ID NO: 275859 - DNA, 20 bp, Artificial Sequence
  chemically synthesized
gtaaggatttttcagtctcc

SEQ ID NO: 275860 - DNA, 20 bp, Artificial Sequence
  chemically synthesized
taaggatttttcagtctcct

SEQ ID NO: 275861 - DNA, 20 bp, Artificial Sequence
  chemically synthesized
ggatttttcagtctcctggg

SEQ ID NO: 275862 - DNA, 20 bp, Artificial Sequence
  chemically synthesized
agagcatccagtctgcccag

SEQ ID NO: 275863 - DNA, 20 bp, Artificial Sequence
  chemically synthesized
acagagcatccagtctgccc

SEQ ID NO: 275864 - DNA, 20 bp, Artificial Sequence
  chemically synthesized
tttcagtctcctgggcagac

SEQ ID NO: 275865 - DNA, 20 bp, Artificial Sequence
  chemically synthesized
aacagagcatccagtctgcc

SEQ ID NO: 275866 - DNA, 20 bp, Artificial Sequence
  chemically synthesized
agttgcttgaacagagcatc

SEQ ID NO: 275867 - DNA, 20 bp, Artificial Sequence
  chemically synthesized
gcagactggatgctctgttc

SEQ ID NO: 275868 - DNA, 20 bp, Artificial Sequence
  chemically synthesized
aggcaaaagttgcttgaaca

SEQ ID NO: 275869 - DNA, 20 bp, Artificial Sequence
  chemically synthesized
ggaggcaaaagttgcttgaa

SEQ ID NO: 275870 - DNA, 20 bp, Artificial Sequence
  chemically synthesized
tttaggctgtaaggaggcaa

SEQ ID NO: 275871 - DNA, 20 bp, Artificial Sequence
  chemically synthesized
aagcaacttttgcctcctta

SEQ ID NO: 275872 - DNA, 20 bp, Artificial Sequence
  chemically synthesized
cttctttttaggctgtaagg

SEQ ID NO: 275873 - DNA, 20 bp, Artificial Sequence
  chemically synthesized
ccttctttttaggctgtaag

SEQ ID NO: 275874 - DNA, 20 bp, Artificial Sequence
  chemically synthesized
ttccttctttttaggctgta

SEQ ID NO: 275875 - DNA, 20 bp, Artificial Sequence
  chemically synthesized
attccttctttttaggctgt

SEQ ID NO: 275876 - DNA, 20 bp, Artificial Sequence
  chemically synthesized
ttgcctccttacagcctaaa

SEQ ID NO: 275877 - DNA, 20 bp, Artificial Sequence
  chemically synthesized
cctccttacagcctaaaaag

SEQ ID NO: 275878 - DNA, 20 bp, Artificial Sequence
  chemically synthesized
ctccttacagcctaaaaaga

SEQ ID NO: 275879 - DNA, 20 bp, Artificial Sequence
  chemically synthesized
cactcttattccttcttttt

SEQ ID NO: 275880 - DNA, 20 bp, Artificial Sequence
  chemically synthesized
acactcttattccttctttt

SEQ ID NO: 275881 - DNA, 20 bp, Artificial Sequence
  chemically synthesized
acagcctaaaaagaaggaat

SEQ ID NO: 275882 - DNA, 20 bp, Artificial Sequence
  chemically synthesized
agcctaaaaagaaggaataa

SEQ ID NO: 275883 - DNA, 20 bp, Artificial Sequence
  chemically synthesized
aagaaggaataagagtgtat

SEQ ID NO: 275884 - DNA, 20 bp, Artificial Sequence
  chemically synthesized
agttaaatgtttactcttga

SEQ ID NO: 275885 - DNA, 20 bp, Artificial Sequence
  chemically synthesized
gattacagaaaagctatcaa

SEQ ID NO: 275886 - DNA, 20 bp, Artificial Sequence
  chemically synthesized
aggattacagaaaagctatc

SEQ ID NO: 275887 - DNA, 20 bp, Artificial Sequence
  chemically synthesized
tgttcagcaggattacagaa

SEQ ID NO: 275888 - DNA, 20 bp, Artificial Sequence
  chemically synthesized
tttattgttcagcaggatta

SEQ ID NO: 275889 - DNA, 20 bp, Artificial Sequence
  chemically synthesized
atcttcatttattgttcagc

SEQ ID NO: 275890 - DNA, 20 bp, Artificial Sequence
  chemically synthesized
aatcttcatttattgttcag

SEQ ID NO: 275891 - DNA, 20 bp, Artificial Sequence
  chemically synthesized
tagaatcttcatttattgtt

SEQ ID NO: 275892 - DNA, 20 bp, Artificial Sequence
  chemically synthesized
atcctgctgaacaataaatg

SEQ ID NO: 275893 - DNA, 20 bp, Artificial Sequence
  chemically synthesized
tgaacaataaatgaagattc

SEQ ID NO: 275894 - DNA, 20 bp, Artificial Sequence
  chemically synthesized
aaggtgattgtggaagagtc

SEQ ID NO: 275895 - DNA, 20 bp, Artificial Sequence
  chemically synthesized
acaaaaaggtgattgtggaa

SEQ ID NO: 275896 - DNA, 20 bp, Artificial Sequence
  chemically synthesized
ttacaaaaaggtgattgtgg

SEQ ID NO: 275897 - DNA, 20 bp, Artificial Sequence
  chemically synthesized
gtcttacaaaaaggtgattg

SEQ ID NO: 275898 - DNA, 20 bp, Artificial Sequence
  chemically synthesized
ttccacaatcacctttttgt

SEQ ID NO: 275899 - DNA, 20 bp, Artificial Sequence
  chemically synthesized
gcgaaatctgtcttacaaaa

SEQ ID NO: 275900 - DNA, 20 bp, Artificial Sequence
  chemically synthesized
tgcgaaatctgtcttacaaa

SEQ ID NO: 275901 - DNA, 20 bp, Artificial Sequence
  chemically synthesized
acaatcacctttttgtaaga

SEQ ID NO: 275902 - DNA, 20 bp, Artificial Sequence
  chemically synthesized
tttttgtaagacagatttcg

SEQ ID NO: 275903 - DNA, 20 bp, Artificial Sequence
  chemically synthesized
agacagatttcgcagcttcc

SEQ ID NO: 275904 - DNA, 20 bp, Artificial Sequence
  chemically synthesized
agagctgaatgagtgccagg

SEQ ID NO: 275905 - DNA, 20 bp, Artificial Sequence
  chemically synthesized
aacagagctgaatgagtgcc

SEQ ID NO: 275906 - DNA, 20 bp, Artificial Sequence
  chemically synthesized
caacagagctgaatgagtgc

SEQ ID NO: 275907 - DNA, 20 bp, Artificial Sequence
  chemically synthesized
gcagcttcctggcactcatt

SEQ ID NO: 275908 - DNA, 20 bp, Artificial Sequence
  chemically synthesized
ttctatcaacagagctgaat

SEQ ID NO: 275909 - DNA, 20 bp, Artificial Sequence
  chemically synthesized
cactcattcagctctgttga

SEQ ID NO: 275910 - DNA, 20 bp, Artificial Sequence
  chemically synthesized
acattttttttctatcaaca

SEQ ID NO: 275911 - DNA, 20 bp, Artificial Sequence
  chemically synthesized
tcacattttttttctatcaa

SEQ ID NO: 275912 - DNA, 20 bp, Artificial Sequence
  chemically synthesized
gttgatagaaaaaaaatgtg

SEQ ID NO: 275913 - DNA, 20 bp, Artificial Sequence
  chemically synthesized
ttgatagaaaaaaaatgtga

SEQ ID NO: 275914 - DNA, 20 bp, Artificial Sequence
  chemically synthesized
gatagaaaaaaaatgtgaag

SEQ ID NO: 275915 - DNA, 20 bp, Artificial Sequence
  chemically synthesized
atgtgaaggagaaaaataaa

SEQ ID NO: 275916 - DNA, 20 bp, Artificial Sequence
  chemically synthesized
ataaatagcaaacaaaacta

SEQ ID NO: 275917 - DNA, 20 bp, Artificial Sequence
  chemically synthesized
taaatagcaaacaaaactat

SEQ ID NO: 275918 - DNA, 20 bp, Artificial Sequence
  chemically synthesized
agcaaacaaaactataggat

SEQ ID NO: 275919 - DNA, 20 bp, Artificial Sequence
  chemically synthesized
gcaaacaaaactataggatc

SEQ ID NO: 275920 - DNA, 20 bp, Artificial Sequence
  chemically synthesized
tgcagagatccctgatccta

SEQ ID NO: 275921 - DNA, 20 bp, Artificial Sequence
  chemically synthesized
caaacaaaactataggatca

SEQ ID NO: 275922 - DNA, 20 bp, Artificial Sequence
  chemically synthesized
ttgtgattgattttcatgca

SEQ ID NO: 275923 - DNA, 20 bp, Artificial Sequence
  chemically synthesized
tattgtgattgattttcatg

SEQ ID NO: 275924 - DNA, 20 bp, Artificial Sequence
  chemically synthesized
atcacaatatcacgtacatt

SEQ ID NO: 275925 - DNA, 20 bp, Artificial Sequence
  chemically synthesized
tcacaatatcacgtacatta

SEQ ID NO: 275926 - DNA, 20 bp, Artificial Sequence
  chemically synthesized
tatcacgtacattaaggaaa

SEQ ID NO: 275927 - DNA, 20 bp, Artificial Sequence
  chemically synthesized
atcacgtacattaaggaaat

SEQ ID NO: 275928 - DNA, 20 bp, Artificial Sequence
  chemically synthesized
cgtacattaaggaaataggc

SEQ ID NO: 275929 - DNA, 20 bp, Artificial Sequence
  chemically synthesized
gattttgctaattttttttc

SEQ ID NO: 275930 - DNA, 20 bp, Artificial Sequence
  chemically synthesized
aaataggctggaaaaaaaat

SEQ ID NO: 275931 - DNA, 20 bp, Artificial Sequence
  chemically synthesized
aaaaattagcaaaatcatct

SEQ ID NO: 275932 - DNA, 20 bp, Artificial Sequence
  chemically synthesized
aaagacagattgcaatgact

SEQ ID NO: 275933 - DNA, 20 bp, Artificial Sequence
  chemically synthesized
tcattgcaatctgtctttct

SEQ ID NO: 275934 - DNA, 20 bp, Artificial Sequence
  chemically synthesized
aacattcgacctgagaaaga

SEQ ID NO: 275935 - DNA, 20 bp, Artificial Sequence
  chemically synthesized
cattgcaatctgtctttctc

SEQ ID NO: 275936 - DNA, 20 bp, Artificial Sequence
  chemically synthesized
gaggaacattcgacctgaga

SEQ ID NO: 275937 - DNA, 20 bp, Artificial Sequence
  chemically synthesized
tcaggaggaacattcgacct

SEQ ID NO: 275938 - DNA, 20 bp, Artificial Sequence
  chemically synthesized
aactatataatgagatcagg

SEQ ID NO: 275939 - DNA, 20 bp, Artificial Sequence
  chemically synthesized
gaactatataatgagatcag

SEQ ID NO: 275940 - DNA, 20 bp, Artificial Sequence
  chemically synthesized
ttgaactatataatgagatc

SEQ ID NO: 275941 - DNA, 20 bp, Artificial Sequence
  chemically synthesized
cttgaactatataatgagat

SEQ ID NO: 275942 - DNA, 20 bp, Artificial Sequence
  chemically synthesized
ttcctcctgatctcattata

SEQ ID NO: 275943 - DNA, 20 bp, Artificial Sequence
  chemically synthesized
aatctcttgaactatataat

SEQ ID NO: 275944 - DNA, 20 bp, Artificial Sequence
  chemically synthesized
ctgatctcattatatagttc

SEQ ID NO: 275945 - DNA, 20 bp, Artificial Sequence
  chemically synthesized
gatctcattatatagttcaa

SEQ ID NO: 275946 - DNA, 20 bp, Artificial Sequence
  chemically synthesized
attatatagttcaagagatt

SEQ ID NO: 275947 - DNA, 20 bp, Artificial Sequence
  chemically synthesized
ttcaagagatttggtttgct

SEQ ID NO: 275948 - DNA, 20 bp, Artificial Sequence
  chemically synthesized
gagatttggtttgcttagaa

SEQ ID NO: 275949 - DNA, 20 bp, Artificial Sequence
  chemically synthesized
agatttggtttgcttagaat

SEQ ID NO: 275950 - DNA, 20 bp, Artificial Sequence
  chemically synthesized
gatttggtttgcttagaata

SEQ ID NO: 275951 - DNA, 20 bp, Artificial Sequence
  chemically synthesized
gatgacgatgaccctattct

SEQ ID NO: 275952 - DNA, 20 bp, Artificial Sequence
  chemically synthesized
tcgtcatcacaatccaattc

SEQ ID NO: 275953 - DNA, 20 bp, Artificial Sequence
  chemically synthesized
gcagattatctgtcttgaat

SEQ ID NO: 275954 - DNA, 20 bp, Artificial Sequence
  chemically synthesized
catcacaatccaattcaaga

SEQ ID NO: 275955 - DNA, 20 bp, Artificial Sequence
  chemically synthesized
gacagataatctgcttccac

SEQ ID NO: 275956 - DNA, 20 bp, Artificial Sequence
  chemically synthesized
atgtatctcactggtggaag

SEQ ID NO: 275957 - DNA, 20 bp, Artificial Sequence
  chemically synthesized
tacatgtatctcactggtgg

SEQ ID NO: 275958 - DNA, 20 bp, Artificial Sequence
  chemically synthesized
gataatctgcttccaccagt

SEQ ID NO: 275959 - DNA, 20 bp, Artificial Sequence
  chemically synthesized
ttgtacatgtatctcactgg

SEQ ID NO: 275960 - DNA, 20 bp, Artificial Sequence
  chemically synthesized
agattgtacatgtatctcac

SEQ ID NO: 275961 - DNA, 20 bp, Artificial Sequence
  chemically synthesized
agatacatgtacaatctgtt

SEQ ID NO: 275962 - DNA, 20 bp, Artificial Sequence
  chemically synthesized
gacaaggagctgattctgaa

SEQ ID NO: 275963 - DNA, 20 bp, Artificial Sequence
  chemically synthesized
atgtacaatctgttcagaat

SEQ ID NO: 275964 - DNA, 20 bp, Artificial Sequence
  chemically synthesized
aaaattctgtttttgacaag

SEQ ID NO: 275965 - DNA, 20 bp, Artificial Sequence
  chemically synthesized
ctaaaattctgtttttgaca

SEQ ID NO: 275966 - DNA, 20 bp, Artificial Sequence
  chemically synthesized
tctaaaattctgtttttgac

SEQ ID NO: 275967 - DNA, 20 bp, Artificial Sequence
  chemically synthesized
aatcagctccttgtcaaaaa

SEQ ID NO: 275968 - DNA, 20 bp, Artificial Sequence
  chemically synthesized
ccttgtcaaaaacagaattt

SEQ ID NO: 275969 - DNA, 20 bp, Artificial Sequence
  chemically synthesized
aaaaacagaattttagataa

SEQ ID NO: 275970 - DNA, 20 bp, Artificial Sequence
  chemically synthesized
cagaattttagataacagtc

SEQ ID NO: 275971 - DNA, 20 bp, Artificial Sequence
  chemically synthesized
tttagataacagtctggtta

SEQ ID NO: 275972 - DNA, 20 bp, Artificial Sequence
  chemically synthesized
attcaaaataaatctttaac

SEQ ID NO: 275973 - DNA, 20 bp, Artificial Sequence
  chemically synthesized
attttgaatactatttcaac

SEQ ID NO: 275974 - DNA, 20 bp, Artificial Sequence
  chemically synthesized
tcatgcaaagctggttgaaa

SEQ ID NO: 275975 - DNA, 20 bp, Artificial Sequence
  chemically synthesized
gaaaaaagatcatgcaaagc

SEQ ID NO: 275976 - DNA, 20 bp, Artificial Sequence
  chemically synthesized
gggagaaaaaagatcatgca

SEQ ID NO: 275977 - DNA, 20 bp, Artificial Sequence
  chemically synthesized
gaaagaaagtagggagaaaa

SEQ ID NO: 275978 - DNA, 20 bp, Artificial Sequence
  chemically synthesized
aaattgtgaaagaaagtagg

SEQ ID NO: 275979 - DNA, 20 bp, Artificial Sequence
  chemically synthesized
ccaaattgtgaaagaaagta

SEQ ID NO: 275980 - DNA, 20 bp, Artificial Sequence
  chemically synthesized
tccaaattgtgaaagaaagt

SEQ ID NO: 275981 - DNA, 20 bp, Artificial Sequence
  chemically synthesized
atccaaattgtgaaagaaag

SEQ ID NO: 275982 - DNA, 20 bp, Artificial Sequence
  chemically synthesized
gtaatccaaattgtgaaaga

SEQ ID NO: 275983 - DNA, 20 bp, Artificial Sequence
  chemically synthesized
ttctgtaatccaaattgtga

SEQ ID NO: 275984 - DNA, 20 bp, Artificial Sequence
  chemically synthesized
ccctactttctttcacaatt

SEQ ID NO: 275985 - DNA, 20 bp, Artificial Sequence
  chemically synthesized
ttctttcacaatttggatta

SEQ ID NO: 275986 - DNA, 20 bp, Artificial Sequence
  chemically synthesized
acagaaattgtttgtacaat

SEQ ID NO: 275987 - DNA, 20 bp, Artificial Sequence
  chemically synthesized
cagaaattgtttgtacaatt

SEQ ID NO: 275988 - DNA, 20 bp, Artificial Sequence
  chemically synthesized
ttgggtttatgttactgctg

SEQ ID NO: 275989 - DNA, 20 bp, Artificial Sequence
  chemically synthesized
ggtttatgttactgctgaag

SEQ ID NO: 275990 - DNA, 20 bp, Artificial Sequence
  chemically synthesized
tattattttttctacttcag

SEQ ID NO: 275991 - DNA, 20 bp, Artificial Sequence
  chemically synthesized
acttattattttttctactt

SEQ ID NO: 275992 - DNA, 20 bp, Artificial Sequence
  chemically synthesized
gctgaagtagaaaaaataat

SEQ ID NO: 275993 - DNA, 20 bp, Artificial Sequence
  chemically synthesized
aataataagtaatcctaata

SEQ ID NO: 275994 - DNA, 20 bp, Artificial Sequence
  chemically synthesized
agattaattgcagctatatt

SEQ ID NO: 275995 - DNA, 20 bp, Artificial Sequence
  chemically synthesized
aagattaattgcagctatat

SEQ ID NO: 275996 - DNA, 20 bp, Artificial Sequence
  chemically synthesized
gttacaatcaagattaattg

SEQ ID NO: 275997 - DNA, 20 bp, Artificial Sequence
  chemically synthesized
tcatacttatagttacaatc

SEQ ID NO: 275998 - DNA, 20 bp, Artificial Sequence
  chemically synthesized
ttaatcttgattgtaactat

SEQ ID NO: 275999 - DNA, 20 bp, Artificial Sequence
  chemically synthesized
aattatcctaatcatactta

SEQ ID NO: 276000 - DNA, 20 bp, Artificial Sequence
  chemically synthesized
attgtaactataagtatgat

SEQ ID NO: 276001 - DNA, 20 bp, Artificial Sequence
  chemically synthesized
ttgtaactataagtatgatt

SEQ ID NO: 276002 - DNA, 20 bp, Artificial Sequence
  chemically synthesized
aggataattcaataatgttc

SEQ ID NO: 276003 - DNA, 20 bp, Artificial Sequence
  chemically synthesized
agtataaataccatgctgca

SEQ ID NO: 276004 - DNA, 20 bp, Artificial Sequence
  chemically synthesized
actttccaatctgtgcagca

SEQ ID NO: 276005 - DNA, 20 bp, Artificial Sequence
  chemically synthesized
aaataccatgctgcacagat

SEQ ID NO: 276006 - DNA, 20 bp, Artificial Sequence
  chemically synthesized
gggagactttccaatctgtg

SEQ ID NO: 276007 - DNA, 20 bp, Artificial Sequence
  chemically synthesized
accatgctgcacagattgga

SEQ ID NO: 276008 - DNA, 20 bp, Artificial Sequence
  chemically synthesized
agattggaaagtctcccttc

SEQ ID NO: 276009 - DNA, 20 bp, Artificial Sequence
  chemically synthesized
gattggaaagtctcccttca

SEQ ID NO: 276010 - DNA, 20 bp, Artificial Sequence
  chemically synthesized
agtgaacagatccttgaagg

SEQ ID NO: 276011 - DNA, 20 bp, Artificial Sequence
  chemically synthesized
aaagtgaacagatccttgaa

SEQ ID NO: 276012 - DNA, 20 bp, Artificial Sequence
  chemically synthesized
aaaagtgaacagatccttga

SEQ ID NO: 276013 - DNA, 20 bp, Artificial Sequence
  chemically synthesized
taaaagtgaacagatccttg

SEQ ID NO: 276014 - DNA, 20 bp, Artificial Sequence
  chemically synthesized
actactctgttaaaagtgaa

SEQ ID NO: 276015 - DNA, 20 bp, Artificial Sequence
  chemically synthesized
aaggatctgttcacttttaa

SEQ ID NO: 276016 - DNA, 20 bp, Artificial Sequence
  chemically synthesized
ggatctgttcacttttaaca

SEQ ID NO: 276017 - DNA, 20 bp, Artificial Sequence
  chemically synthesized
ttttacaactactctgttaa

SEQ ID NO: 276018 - DNA, 20 bp, Artificial Sequence
  chemically synthesized
tctgttcacttttaacagag

SEQ ID NO: 276019 - DNA, 20 bp, Artificial Sequence
  chemically synthesized
ttttaacagagtagttgtaa

SEQ ID NO: 276020 - DNA, 20 bp, Artificial Sequence
  chemically synthesized
aacagagtagttgtaaaagt

SEQ ID NO: 276021 - DNA, 20 bp, Artificial Sequence
  chemically synthesized
gtagttgtaaaagtaagaaa

SEQ ID NO: 276022 - DNA, 20 bp, Artificial Sequence
  chemically synthesized
tagttgtaaaagtaagaaat

SEQ ID NO: 276023 - DNA, 20 bp, Artificial Sequence
  chemically synthesized
agttgtaaaagtaagaaata

SEQ ID NO: 276024 - DNA, 20 bp, Artificial Sequence
  chemically synthesized
tgtaaaagtaagaaataggg

SEQ ID NO: 276025 - DNA, 20 bp, Artificial Sequence
  chemically synthesized
gtaaaagtaagaaatagggc

SEQ ID NO: 276026 - DNA, 20 bp, Artificial Sequence
  chemically synthesized
aaatagggcaggcaacttat

SEQ ID NO: 276027 - DNA, 20 bp, Artificial Sequence
  chemically synthesized
aatagggcaggcaacttatt

SEQ ID NO: 276028 - DNA, 20 bp, Artificial Sequence
  chemically synthesized
acacataatgaattcccaat

SEQ ID NO: 276029 - DNA, 20 bp, Artificial Sequence
  chemically synthesized
tgcctttacattgtatatta

SEQ ID NO: 276030 - DNA, 20 bp, Artificial Sequence
  chemically synthesized
atgcctttacattgtatatt

SEQ ID NO: 276031 - DNA, 20 bp, Artificial Sequence
  chemically synthesized
tttccttaatatacaatgta

SEQ ID NO: 276032 - DNA, 20 bp, Artificial Sequence
  chemically synthesized
ttccttaatatacaatgtaa

SEQ ID NO: 276033 - DNA, 20 bp, Artificial Sequence
  chemically synthesized
caatgtaaaggcatgattat

SEQ ID NO: 276034 - DNA, 20 bp, Artificial Sequence
  chemically synthesized
aatgtaaaggcatgattatc

SEQ ID NO: 276035 - DNA, 20 bp, Artificial Sequence
  chemically synthesized
gtcatgctctgtgggaaaga

SEQ ID NO: 276036 - DNA, 20 bp, Artificial Sequence
  chemically synthesized
caatataactttctttccca

SEQ ID NO: 276037 - DNA, 20 bp, Artificial Sequence
  chemically synthesized
atataactttctttcccaca

SEQ ID NO: 276038 - DNA, 20 bp, Artificial Sequence
  chemically synthesized
ctcagtcatgctctgtggga

SEQ ID NO: 276039 - DNA, 20 bp, Artificial Sequence
  chemically synthesized
aaacctcagtcatgctctgt

SEQ ID NO: 276040 - DNA, 20 bp, Artificial Sequence
  chemically synthesized
aaaacctcagtcatgctctg

SEQ ID NO: 276041 - DNA, 20 bp, Artificial Sequence
  chemically synthesized
ctttcccacagagcatgact

SEQ ID NO: 276042 - DNA, 20 bp, Artificial Sequence
  chemically synthesized
tttcccacagagcatgactg

SEQ ID NO: 276043 - DNA, 20 bp, Artificial Sequence
  chemically synthesized
cagagcatgactgaggtttt

SEQ ID NO: 276044 - DNA, 20 bp, Artificial Sequence
  chemically synthesized
ccaagatcatcttaaaacct

SEQ ID NO: 276045 - DNA, 20 bp, Artificial Sequence
  chemically synthesized
ctgaggttttaagatgatct

SEQ ID NO: 276046 - DNA, 20 bp, Artificial Sequence
  chemically synthesized
ctatatataatataaaaacc

SEQ ID NO: 276047 - DNA, 20 bp, Artificial Sequence
  chemically synthesized
cttggtttttatattatata

SEQ ID NO: 276048 - DNA, 20 bp, Artificial Sequence
  chemically synthesized
ttatattatatatagaatat

SEQ ID NO: 276049 - DNA, 20 bp, Artificial Sequence
  chemically synthesized
tttttaaagcttaaaaagta

SEQ ID NO: 276050 - DNA, 20 bp, Artificial Sequence
  chemically synthesized
acataaatactatacttttt

SEQ ID NO: 276051 - DNA, 20 bp, Artificial Sequence
  chemically synthesized
taatatttttaaagcttaaa

SEQ ID NO: 276052 - DNA, 20 bp, Artificial Sequence
  chemically synthesized
tgacatcactaatattttta

SEQ ID NO: 276053 - DNA, 20 bp, Artificial Sequence
  chemically synthesized
tttttaagctttaaaaatat

SEQ ID NO: 276054 - DNA, 20 bp, Artificial Sequence
  chemically synthesized
ttagtgatgtcattattctt

SEQ ID NO: 276055 - DNA, 20 bp, Artificial Sequence
  chemically synthesized
gatgtcattattcttcagtg

SEQ ID NO: 276056 - DNA, 20 bp, Artificial Sequence
  chemically synthesized
gttataggctggcttcactg

SEQ ID NO: 276057 - DNA, 20 bp, Artificial Sequence
  chemically synthesized
tcattattcttcagtgaagc

SEQ ID NO: 276058 - DNA, 20 bp, Artificial Sequence
  chemically synthesized
ggcaaagctgtgttataggc

SEQ ID NO: 276059 - DNA, 20 bp, Artificial Sequence
  chemically synthesized
agtgaagccagcctataaca

SEQ ID NO: 276060 - DNA, 20 bp, Artificial Sequence
  chemically synthesized
cttgggcaaagctgtgttat

SEQ ID NO: 276061 - DNA, 20 bp, Artificial Sequence
  chemically synthesized
acttgggcaaagctgtgtta

SEQ ID NO: 276062 - DNA, 20 bp, Artificial Sequence
  chemically synthesized
cctataacacagctttgccc

SEQ ID NO: 276063 - DNA, 20 bp, Artificial Sequence
  chemically synthesized
actgtagttttacttgggca

SEQ ID NO: 276064 - DNA, 20 bp, Artificial Sequence
  chemically synthesized
ctttaactgtagttttactt

SEQ ID NO: 276065 - DNA, 20 bp, Artificial Sequence
  chemically synthesized
cctttaactgtagttttact

SEQ ID NO: 276066 - DNA, 20 bp, Artificial Sequence
  chemically synthesized
gctttgcccaagtaaaacta

SEQ ID NO: 276067 - DNA, 20 bp, Artificial Sequence
  chemically synthesized
cccaagtaaaactacagtta

SEQ ID NO: 276068 - DNA, 20 bp, Artificial Sequence
  chemically synthesized
ccaagtaaaactacagttaa

SEQ ID NO: 276069 - DNA, 20 bp, Artificial Sequence
  chemically synthesized
agtctagatgcctttaactg

SEQ ID NO: 276070 - DNA, 20 bp, Artificial Sequence
  chemically synthesized
aaactacagttaaaggcatc

SEQ ID NO: 276071 - DNA, 20 bp, Artificial Sequence
  chemically synthesized
cagttaaaggcatctagact

SEQ ID NO: 276072 - DNA, 20 bp, Artificial Sequence
  chemically synthesized
agttaaaggcatctagacta

SEQ ID NO: 276073 - DNA, 20 bp, Artificial Sequence
  chemically synthesized
cctgttcttttgccttagtc

SEQ ID NO: 276074 - DNA, 20 bp, Artificial Sequence
  chemically synthesized
aggcatctagactaaggcaa

SEQ ID NO: 276075 - DNA, 20 bp, Artificial Sequence
  chemically synthesized
aacttcctgttcttttgcct

SEQ ID NO: 276076 - DNA, 20 bp, Artificial Sequence
  chemically synthesized
tctagactaaggcaaaagaa

SEQ ID NO: 276077 - DNA, 20 bp, Artificial Sequence
  chemically synthesized
ctagactaaggcaaaagaac

SEQ ID NO: 276078 - DNA, 20 bp, Artificial Sequence
  chemically synthesized
gactaaggcaaaagaacagg

SEQ ID NO: 276079 - DNA, 20 bp, Artificial Sequence
  chemically synthesized
aggcaaaagaacaggaagtt

SEQ ID NO: 276080 - DNA, 20 bp, Artificial Sequence
  chemically synthesized
caggaagtttagtgatgctg

SEQ ID NO: 276081 - DNA, 20 bp, Artificial Sequence
  chemically synthesized
aggaagtttagtgatgctgc

SEQ ID NO: 276082 - DNA, 20 bp, Artificial Sequence
  chemically synthesized
aagtttagtgatgctgcagg

SEQ ID NO: 276083 - DNA, 20 bp, Artificial Sequence
  chemically synthesized
gtttagtgatgctgcaggaa

SEQ ID NO: 276084 - DNA, 20 bp, Artificial Sequence
  chemically synthesized
tttagtgatgctgcaggaag

SEQ ID NO: 276085 - DNA, 20 bp, Artificial Sequence
  chemically synthesized
gaaagccttccctcttcctg

SEQ ID NO: 276086 - DNA, 20 bp, Artificial Sequence
  chemically synthesized
ttagtgatgctgcaggaaga

SEQ ID NO: 276087 - DNA, 20 bp, Artificial Sequence
  chemically synthesized
gtgatgctgcaggaagaggg

SEQ ID NO: 276088 - DNA, 20 bp, Artificial Sequence
  chemically synthesized
tgatgctgcaggaagaggga

SEQ ID NO: 276089 - DNA, 20 bp, Artificial Sequence
  chemically synthesized
aggaagagggaaggctttcc

SEQ ID NO: 276090 - DNA, 20 bp, Artificial Sequence
  chemically synthesized
tacagggagaagtactggga

SEQ ID NO: 276091 - DNA, 20 bp, Artificial Sequence
  chemically synthesized
atggtacagggagaagtact

SEQ ID NO: 276092 - DNA, 20 bp, Artificial Sequence
  chemically synthesized
tatggtacagggagaagtac

SEQ ID NO: 276093 - DNA, 20 bp, Artificial Sequence
  chemically synthesized
aaaatttatggtacagggag

SEQ ID NO: 276094 - DNA, 20 bp, Artificial Sequence
  chemically synthesized
gtcaaaatttatggtacagg

SEQ ID NO: 276095 - DNA, 20 bp, Artificial Sequence
  chemically synthesized
gagtcaaaatttatggtaca

SEQ ID NO: 276096 - DNA, 20 bp, Artificial Sequence
  chemically synthesized
ggagtcaaaatttatggtac

SEQ ID NO: 276097 - DNA, 20 bp, Artificial Sequence
  chemically synthesized
tggagtcaaaatttatggta

SEQ ID NO: 276098 - DNA, 20 bp, Artificial Sequence
  chemically synthesized
cttaatggagtcaaaattta

SEQ ID NO: 276099 - DNA, 20 bp, Artificial Sequence
  chemically synthesized
ccataaattttgactccatt

SEQ ID NO: 276100 - DNA, 20 bp, Artificial Sequence
  chemically synthesized
cccaggataaaatcttaatg

SEQ ID NO: 276101 - DNA, 20 bp, Artificial Sequence
  chemically synthesized
agcccaggataaaatcttaa

SEQ ID NO: 276102 - DNA, 20 bp, Artificial Sequence
  chemically synthesized
actccattaagattttatcc

SEQ ID NO: 276103 - DNA, 20 bp, Artificial Sequence
  chemically synthesized
ctccattaagattttatcct

SEQ ID NO: 276104 - DNA, 20 bp, Artificial Sequence
  chemically synthesized
atgagaagaaaggaaagccc

SEQ ID NO: 276105 - DNA, 20 bp, Artificial Sequence
  chemically synthesized
aatgagaagaaaggaaagcc

SEQ ID NO: 276106 - DNA, 20 bp, Artificial Sequence
  chemically synthesized
ggtagaatgagaagaaagga

SEQ ID NO: 276107 - DNA, 20 bp, Artificial Sequence
  chemically synthesized
tatgggtagaatgagaagaa

SEQ ID NO: 276108 - DNA, 20 bp, Artificial Sequence
  chemically synthesized
gtatgggtagaatgagaaga

SEQ ID NO: 276109 - DNA, 20 bp, Artificial Sequence
  chemically synthesized
taaggtatgggtagaatgag

SEQ ID NO: 276110 - DNA, 20 bp, Artificial Sequence
  chemically synthesized
agttaaggtatgggtagaat

SEQ ID NO: 276111 - DNA, 20 bp, Artificial Sequence
  chemically synthesized
aattgaagttaaggtatggg

SEQ ID NO: 276112 - DNA, 20 bp, Artificial Sequence
  chemically synthesized
aggaattgaagttaaggtat

SEQ ID NO: 276113 - DNA, 20 bp, Artificial Sequence
  chemically synthesized
gaggaattgaagttaaggta

SEQ ID NO: 276114 - DNA, 20 bp, Artificial Sequence
  chemically synthesized
gtgaggaggaattgaagtta

SEQ ID NO: 276115 - DNA, 20 bp, Artificial Sequence
  chemically synthesized
tgtgaggaggaattgaagtt

SEQ ID NO: 276116 - DNA, 20 bp, Artificial Sequence
  chemically synthesized
cagaatgtgaggaggaattg

SEQ ID NO: 276117 - DNA, 20 bp, Artificial Sequence
  chemically synthesized
agagttgtcagaatgtgagg

SEQ ID NO: 276118 - DNA, 20 bp, Artificial Sequence
  chemically synthesized
gagagttgtcagaatgtgag

SEQ ID NO: 276119 - DNA, 20 bp, Artificial Sequence
  chemically synthesized
ttgagagttgtcagaatgtg

SEQ ID NO: 276120 - DNA, 20 bp, Artificial Sequence
  chemically synthesized
gttgagagttgtcagaatgt

SEQ ID NO: 276121 - DNA, 20 bp, Artificial Sequence
  chemically synthesized
gatgtagagttgagagttgt

SEQ ID NO: 276122 - DNA, 20 bp, Artificial Sequence
  chemically synthesized
cttgagagatgtagagttga

SEQ ID NO: 276123 - DNA, 20 bp, Artificial Sequence
  chemically synthesized
gacttgagagatgtagagtt

SEQ ID NO: 276124 - DNA, 20 bp, Artificial Sequence
  chemically synthesized
atctggacttgagagatgta

SEQ ID NO: 276125 - DNA, 20 bp, Artificial Sequence
  chemically synthesized
agatctggacttgagagatg

SEQ ID NO: 276126 - DNA, 20 bp, Artificial Sequence
  chemically synthesized
ctctcaactctacatctctc

SEQ ID NO: 276127 - DNA, 20 bp, Artificial Sequence
  chemically synthesized
aactctacatctctcaagtc

SEQ ID NO: 276128 - DNA, 20 bp, Artificial Sequence
  chemically synthesized
aaggggagatctggacttga

SEQ ID NO: 276129 - DNA, 20 bp, Artificial Sequence
  chemically synthesized
tcaaggggagatctggactt

SEQ ID NO: 276130 - DNA, 20 bp, Artificial Sequence
  chemically synthesized
atggagatcaaggggagatc

SEQ ID NO: 276131 - DNA, 20 bp, Artificial Sequence
  chemically synthesized
gcaagtatggagatcaaggg

SEQ ID NO: 276132 - DNA, 20 bp, Artificial Sequence
  chemically synthesized
atgcaagtatggagatcaag

SEQ ID NO: 276133 - DNA, 20 bp, Artificial Sequence
  chemically synthesized
catgcaagtatggagatcaa

SEQ ID NO: 276134 - DNA, 20 bp, Artificial Sequence
  chemically synthesized
acatgcaagtatggagatca

SEQ ID NO: 276135 - DNA, 20 bp, Artificial Sequence
  chemically synthesized
aacatgcaagtatggagatc

SEQ ID NO: 276136 - DNA, 20 bp, Artificial Sequence
  chemically synthesized
tgagataacatgcaagtatg

SEQ ID NO: 276137 - DNA, 20 bp, Artificial Sequence
  chemically synthesized
ggtgagataacatgcaagta

SEQ ID NO: 276138 - DNA, 20 bp, Artificial Sequence
  chemically synthesized
aatagggtgagataacatgc

SEQ ID NO: 276139 - DNA, 20 bp, Artificial Sequence
  chemically synthesized
tgcatgttatctcaccctat

SEQ ID NO: 276140 - DNA, 20 bp, Artificial Sequence
  chemically synthesized
gaggagatgtccaatagggt

SEQ ID NO: 276141 - DNA, 20 bp, Artificial Sequence
  chemically synthesized
tcatgaggagatgtccaata

SEQ ID NO: 276142 - DNA, 20 bp, Artificial Sequence
  chemically synthesized
ttcatgaggagatgtccaat

SEQ ID NO: 276143 - DNA, 20 bp, Artificial Sequence
  chemically synthesized
attcatgaggagatgtccaa

SEQ ID NO: 276144 - DNA, 20 bp, Artificial Sequence
  chemically synthesized
ggttgcagaatattcatgag

SEQ ID NO: 276145 - DNA, 20 bp, Artificial Sequence
  chemically synthesized
gtggttgcagaatattcatg

SEQ ID NO: 276146 - DNA, 20 bp, Artificial Sequence
  chemically synthesized
ggtggttgcagaatattcat

SEQ ID NO: 276147 - DNA, 20 bp, Artificial Sequence
  chemically synthesized
gtgttagcttttggtggttg

SEQ ID NO: 276148 - DNA, 20 bp, Artificial Sequence
  chemically synthesized
gaatattctgcaaccaccaa

SEQ ID NO: 276149 - DNA, 20 bp, Artificial Sequence
  chemically synthesized
gtgggagtgttagcttttgg

SEQ ID NO: 276150 - DNA, 20 bp, Artificial Sequence
  chemically synthesized
tgtgtgggagtgttagcttt

SEQ ID NO: 276151 - DNA, 20 bp, Artificial Sequence
  chemically synthesized
gagttcatgtgtgggagtgt

SEQ ID NO: 276152 - DNA, 20 bp, Artificial Sequence
  chemically synthesized
tgcaaggagttcatgtgtgg

SEQ ID NO: 276153 - DNA, 20 bp, Artificial Sequence
  chemically synthesized
tatgcaaggagttcatgtgt

SEQ ID NO: 276154 - DNA, 20 bp, Artificial Sequence
  chemically synthesized
atatgcaaggagttcatgtg

SEQ ID NO: 276155 - DNA, 20 bp, Artificial Sequence
  chemically synthesized
gtgagaagagtatatgcaag

SEQ ID NO: 276156 - DNA, 20 bp, Artificial Sequence
  chemically synthesized
aggtgagaagagtatatgca

SEQ ID NO: 276157 - DNA, 20 bp, Artificial Sequence
  chemically synthesized
taggtgagaagagtatatgc

SEQ ID NO: 276158 - DNA, 20 bp, Artificial Sequence
  chemically synthesized
agttgagaagtaggtgagaa

SEQ ID NO: 276159 - DNA, 20 bp, Artificial Sequence
  chemically synthesized
ggagttgagaagtaggtgag

SEQ ID NO: 276160 - DNA, 20 bp, Artificial Sequence
  chemically synthesized
tggggagttgagaagtaggt

SEQ ID NO: 276161 - DNA, 20 bp, Artificial Sequence
  chemically synthesized
aagttggggagttgagaagt

SEQ ID NO: 276162 - DNA, 20 bp, Artificial Sequence
  chemically synthesized
caagttggggagttgagaag

SEQ ID NO: 276163 - DNA, 20 bp, Artificial Sequence
  chemically synthesized
aagcaagttggggagttgag

SEQ ID NO: 276164 - DNA, 20 bp, Artificial Sequence
  chemically synthesized
gaaaagcaagttggggagtt

SEQ ID NO: 276165 - DNA, 20 bp, Artificial Sequence
  chemically synthesized
aggaggaaaagcaagttggg

SEQ ID NO: 276166 - DNA, 20 bp, Artificial Sequence
  chemically synthesized
gaaggaggaaaagcaagttg

SEQ ID NO: 276167 - DNA, 20 bp, Artificial Sequence
  chemically synthesized
agaaggaggaaaagcaagtt

SEQ ID NO: 276168 - DNA, 20 bp, Artificial Sequence
  chemically synthesized
gagaaggaggaaaagcaagt

SEQ ID NO: 276169 - DNA, 20 bp, Artificial Sequence
  chemically synthesized
tacagagaaggaggaaaagc

SEQ ID NO: 276170 - DNA, 20 bp, Artificial Sequence
  chemically synthesized
aaaatacagagaaggaggaa

SEQ ID NO: 276171 - DNA, 20 bp, Artificial Sequence
  chemically synthesized
cggaaaaaatacagagaagg

SEQ ID NO: 276172 - DNA, 20 bp, Artificial Sequence
  chemically synthesized
ccggaaaaaatacagagaag

SEQ ID NO: 276173 - DNA, 20 bp, Artificial Sequence
  chemically synthesized
aaccggaaaaaatacagaga

SEQ ID NO: 276174 - DNA, 20 bp, Artificial Sequence
  chemically synthesized
aaaccggaaaaaatacagag

SEQ ID NO: 276175 - DNA, 20 bp, Artificial Sequence
  chemically synthesized
ctgaaaccggaaaaaataca

SEQ ID NO: 276176 - DNA, 20 bp, Artificial Sequence
  chemically synthesized
cgctgaaaccggaaaaaata

SEQ ID NO: 276177 - DNA, 20 bp, Artificial Sequence
  chemically synthesized
ctccttctctgtattttttc

SEQ ID NO: 276178 - DNA, 20 bp, Artificial Sequence
  chemically synthesized
ctctgtattttttccggttt

SEQ ID NO: 276179 - DNA, 20 bp, Artificial Sequence
  chemically synthesized
tatttgtttttcgctgaaac

SEQ ID NO: 276180 - DNA, 20 bp, Artificial Sequence
  chemically synthesized
caaataatgattccctttat

SEQ ID NO: 276181 - DNA, 20 bp, Artificial Sequence
  chemically synthesized
ctagaattacatctaataaa

SEQ ID NO: 276182 - DNA, 20 bp, Artificial Sequence
  chemically synthesized
tctagaattacatctaataa

SEQ ID NO: 276183 - DNA, 20 bp, Artificial Sequence
  chemically synthesized
atctagaattacatctaata

SEQ ID NO: 276184 - DNA, 20 bp, Artificial Sequence
  chemically synthesized
ccctttattagatgtaattc

SEQ ID NO: 276185 - DNA, 20 bp, Artificial Sequence
  chemically synthesized
atagaggaagtagaaatatc

SEQ ID NO: 276186 - DNA, 20 bp, Artificial Sequence
  chemically synthesized
gaaggacatgatagaggaag

SEQ ID NO: 276187 - DNA, 20 bp, Artificial Sequence
  chemically synthesized
gatgaaggacatgatagagg

SEQ ID NO: 276188 - DNA, 20 bp, Artificial Sequence
  chemically synthesized
catgatgaaggacatgatag

SEQ ID NO: 276189 - DNA, 20 bp, Artificial Sequence
  chemically synthesized
acatgatgaaggacatgata

SEQ ID NO: 276190 - DNA, 20 bp, Artificial Sequence
  chemically synthesized
caacatgatgaaggacatga

SEQ ID NO: 276191 - DNA, 20 bp, Artificial Sequence
  chemically synthesized
gattagatgcaacatgatga

SEQ ID NO: 276192 - DNA, 20 bp, Artificial Sequence
  chemically synthesized
tgattagatgcaacatgatg

SEQ ID NO: 276193 - DNA, 20 bp, Artificial Sequence
  chemically synthesized
ttcatcatgttgcatctaat

SEQ ID NO: 276194 - DNA, 20 bp, Artificial Sequence
  chemically synthesized
ataattagtgattgactgat

SEQ ID NO: 276195 - DNA, 20 bp, Artificial Sequence
  chemically synthesized
tagaaggtataataaataat

SEQ ID NO: 276196 - DNA, 20 bp, Artificial Sequence
  chemically synthesized
tatttattataccttctaaa

SEQ ID NO: 276197 - DNA, 20 bp, Artificial Sequence
  chemically synthesized
ggaatcaagaactatttaga

SEQ ID NO: 276198 - DNA, 20 bp, Artificial Sequence
  chemically synthesized
tggaatcaagaactatttag

SEQ ID NO: 276199 - DNA, 20 bp, Artificial Sequence
  chemically synthesized
gattggaatcaagaactatt

SEQ ID NO: 276200 - DNA, 20 bp, Artificial Sequence
  chemically synthesized
agagagaaaagattggaatc

SEQ ID NO: 276201 - DNA, 20 bp, Artificial Sequence
  chemically synthesized
tggagagagagagaaaagat

SEQ ID NO: 276202 - DNA, 20 bp, Artificial Sequence
  chemically synthesized
gacaatggagagagagagaa

SEQ ID NO: 276203 - DNA, 20 bp, Artificial Sequence
  chemically synthesized
gtaaagacaatggagagaga

SEQ ID NO: 276204 - DNA, 20 bp, Artificial Sequence
  chemically synthesized
gagtaaagacaatggagaga

SEQ ID NO: 276205 - DNA, 20 bp, Artificial Sequence
  chemically synthesized
tagagtaaagacaatggaga

SEQ ID NO: 276206 - DNA, 20 bp, Artificial Sequence
  chemically synthesized
actagagtaaagacaatgga

SEQ ID NO: 276207 - DNA, 20 bp, Artificial Sequence
  chemically synthesized
taactagagtaaagacaatg

SEQ ID NO: 276208 - DNA, 20 bp, Artificial Sequence
  chemically synthesized
tttaactagagtaaagacaa

SEQ ID NO: 276209 - DNA, 20 bp, Artificial Sequence
  chemically synthesized
tctctccattgtctttactc

SEQ ID NO: 276210 - DNA, 20 bp, Artificial Sequence
  chemically synthesized
taatgattttaactagagta

SEQ ID NO: 276211 - DNA, 20 bp, Artificial Sequence
  chemically synthesized
tatagtaatgattttaacta

SEQ ID NO: 276212 - DNA, 20 bp, Artificial Sequence
  chemically synthesized
gatatagtaatgattttaac

SEQ ID NO: 276213 - DNA, 20 bp, Artificial Sequence
  chemically synthesized
agcatatttgaggtaagata

SEQ ID NO: 276214 - DNA, 20 bp, Artificial Sequence
  chemically synthesized
actgatagcatatttgaggt

SEQ ID NO: 276215 - DNA, 20 bp, Artificial Sequence
  chemically synthesized
agaaactgatagcatatttg

SEQ ID NO: 276216 - DNA, 20 bp, Artificial Sequence
  chemically synthesized
aagaaactgatagcatattt

SEQ ID NO: 276217 - DNA, 20 bp, Artificial Sequence
  chemically synthesized
tcttacctcaaatatgctat

SEQ ID NO: 276218 - DNA, 20 bp, Artificial Sequence
  chemically synthesized
aatgccagtgaagaaactga

SEQ ID NO: 276219 - DNA, 20 bp, Artificial Sequence
  chemically synthesized
tatgctatcagtttcttcac

SEQ ID NO: 276220 - DNA, 20 bp, Artificial Sequence
  chemically synthesized
ggcagagtaaaatgccagtg

SEQ ID NO: 276221 - DNA, 20 bp, Artificial Sequence
  chemically synthesized
gatgtggcagagtaaaatgc

SEQ ID NO: 276222 - DNA, 20 bp, Artificial Sequence
  chemically synthesized
tttacaggtgggatgtggca

SEQ ID NO: 276223 - DNA, 20 bp, Artificial Sequence
  chemically synthesized
gctttacaggtgggatgtgg

SEQ ID NO: 276224 - DNA, 20 bp, Artificial Sequence
  chemically synthesized
gctgctttacaggtgggatg

SEQ ID NO: 276225 - DNA, 20 bp, Artificial Sequence
  chemically synthesized
tctgccacatcccacctgta

SEQ ID NO: 276226 - DNA, 20 bp, Artificial Sequence
  chemically synthesized
attgcagctgctttacaggt

SEQ ID NO: 276227 - DNA, 20 bp, Artificial Sequence
  chemically synthesized
cattgcagctgctttacagg

SEQ ID NO: 276228 - DNA, 20 bp, Artificial Sequence
  chemically synthesized
gccacatcccacctgtaaag

SEQ ID NO: 276229 - DNA, 20 bp, Artificial Sequence
  chemically synthesized
acacattgcagctgctttac

SEQ ID NO: 276230 - DNA, 20 bp, Artificial Sequence
  chemically synthesized
aacacattgcagctgcttta

SEQ ID NO: 276231 - DNA, 20 bp, Artificial Sequence
  chemically synthesized
gttattgagagaacacattg

SEQ ID NO: 276232 - DNA, 20 bp, Artificial Sequence
  chemically synthesized
aagccccaattcgttattga

SEQ ID NO: 276233 - DNA, 20 bp, Artificial Sequence
  chemically synthesized
ggaagccccaattcgttatt

SEQ ID NO: 276234 - DNA, 20 bp, Artificial Sequence
  chemically synthesized
gtgttctctcaataacgaat

SEQ ID NO: 276235 - DNA, 20 bp, Artificial Sequence
  chemically synthesized
tgttctctcaataacgaatt

SEQ ID NO: 276236 - DNA, 20 bp, Artificial Sequence
  chemically synthesized
gttctctcaataacgaattg

SEQ ID NO: 276237 - DNA, 20 bp, Artificial Sequence
  chemically synthesized
actagagaattttagacagg

SEQ ID NO: 276238 - DNA, 20 bp, Artificial Sequence
  chemically synthesized
atcactagagaattttagac

SEQ ID NO: 276239 - DNA, 20 bp, Artificial Sequence
  chemically synthesized
aatcactagagaattttaga

SEQ ID NO: 276240 - DNA, 20 bp, Artificial Sequence
  chemically synthesized
aaagaatcactagagaattt

SEQ ID NO: 276241 - DNA, 20 bp, Artificial Sequence
  chemically synthesized
gcttcctgtctaaaattctc

SEQ ID NO: 276242 - DNA, 20 bp, Artificial Sequence
  chemically synthesized
aggacagtaaagaatcacta

SEQ ID NO: 276243 - DNA, 20 bp, Artificial Sequence
  chemically synthesized
gaaggacagtaaagaatcac

SEQ ID NO: 276244 - DNA, 20 bp, Artificial Sequence
  chemically synthesized
cttttatttgaaggacagta

SEQ ID NO: 276245 - DNA, 20 bp, Artificial Sequence
  chemically synthesized
tagagcttttatttgaagga

SEQ ID NO: 276246 - DNA, 20 bp, Artificial Sequence
  chemically synthesized
agaatagagcttttatttga

SEQ ID NO: 276247 - DNA, 20 bp, Artificial Sequence
  chemically synthesized
ctttactgtccttcaaataa

SEQ ID NO: 276248 - DNA, 20 bp, Artificial Sequence
  chemically synthesized
aagaatagagcttttatttg

SEQ ID NO: 276249 - DNA, 20 bp, Artificial Sequence
  chemically synthesized
aaaaaaaaaaaaaaagaata

SEQ ID NO: 276250 - DNA, 20 bp, Artificial Sequence
  chemically synthesized
aaaaaaaaaaaaaaaaagaa

SEQ ID NO: 276251 - DNA, 20 bp, Artificial Sequence
  chemically synthesized
aaaaaaaaaaaaaaaaaaaa

SEQ ID NO: 276252 - DNA, 20 bp, Artificial Sequence
  chemically synthesized
tttttttttttttttttttt

SEQ ID NO: 276253 - DNA, 20 bp, Artificial Sequence
  chemically synthesized
ttttttttttttttttgaga

SEQ ID NO: 276254 - DNA, 20 bp, Artificial Sequence
  chemically synthesized
ttttttttttttttgagatg

SEQ ID NO: 276255 - DNA, 20 bp, Artificial Sequence
  chemically synthesized
tttttttttttttgagatgg

SEQ ID NO: 276256 - DNA, 20 bp, Artificial Sequence
  chemically synthesized
ttttttttttgagatggagg

SEQ ID NO: 276257 - DNA, 20 bp, Artificial Sequence
  chemically synthesized
ttttttttgagatggaggcg

SEQ ID NO: 276258 - DNA, 20 bp, Artificial Sequence
  chemically synthesized
tccagtctgggtgacagaga

SEQ ID NO: 276259 - DNA, 20 bp, Artificial Sequence
  chemically synthesized
actccagtctgggtgacaga

SEQ ID NO: 276260 - DNA, 20 bp, Artificial Sequence
  chemically synthesized
cggagtctctctctgtcacc

SEQ ID NO: 276261 - DNA, 20 bp, Artificial Sequence
  chemically synthesized
gcactccagtctgggtgaca

SEQ ID NO: 276262 - DNA, 20 bp, Artificial Sequence
  chemically synthesized
ctgcactccagtctgggtga

SEQ ID NO: 276263 - DNA, 20 bp, Artificial Sequence
  chemically synthesized
tctctctctgtcacccagac

SEQ ID NO: 276264 - DNA, 20 bp, Artificial Sequence
  chemically synthesized
tctctctgtcacccagactg

SEQ ID NO: 276265 - DNA, 20 bp, Artificial Sequence
  chemically synthesized
gtgccactgcactccagtct

SEQ ID NO: 276266 - DNA, 20 bp, Artificial Sequence
  chemically synthesized
tgtgccactgcactccagtc

SEQ ID NO: 276267 - DNA, 20 bp, Artificial Sequence
  chemically synthesized
ctgtcacccagactggagtg

SEQ ID NO: 276268 - DNA, 20 bp, Artificial Sequence
  chemically synthesized
gagattgtgccactgcactc

SEQ ID NO: 276269 - DNA, 20 bp, Artificial Sequence
  chemically synthesized
tcacccagactggagtgcag

SEQ ID NO: 276270 - DNA, 20 bp, Artificial Sequence
  chemically synthesized
ggcagaggttgcagtgagca

SEQ ID NO: 276271 - DNA, 20 bp, Artificial Sequence
  chemically synthesized
gaggcagaggttgcagtgag

SEQ ID NO: 276272 - DNA, 20 bp, Artificial Sequence
  chemically synthesized
agggaggcagaggttgcagt

SEQ ID NO: 276273 - DNA, 20 bp, Artificial Sequence
  chemically synthesized
aaccagggaggcagaggttg

SEQ ID NO: 276274 - DNA, 20 bp, Artificial Sequence
  chemically synthesized
cacttgaaccagggaggcag

SEQ ID NO: 276275 - DNA, 20 bp, Artificial Sequence
  chemically synthesized
tcacttgaaccagggaggca

SEQ ID NO: 276276 - DNA, 20 bp, Artificial Sequence
  chemically synthesized
cactgcaacctctgcctccc

SEQ ID NO: 276277 - DNA, 20 bp, Artificial Sequence
  chemically synthesized
aatcacttgaaccagggagg

SEQ ID NO: 276278 - DNA, 20 bp, Artificial Sequence
  chemically synthesized
gagaatcacttgaaccaggg

SEQ ID NO: 276279 - DNA, 20 bp, Artificial Sequence
  chemically synthesized
ggagaatcacttgaaccagg

SEQ ID NO: 276280 - DNA, 20 bp, Artificial Sequence
  chemically synthesized
aacctctgcctccctggttc

SEQ ID NO: 276281 - DNA, 20 bp, Artificial Sequence
  chemically synthesized
caggagaatcacttgaacca

SEQ ID NO: 276282 - DNA, 20 bp, Artificial Sequence
  chemically synthesized
gcaggagaatcacttgaacc

SEQ ID NO: 276283 - DNA, 20 bp, Artificial Sequence
  chemically synthesized
ggcaggagaatcacttgaac

SEQ ID NO: 276284 - DNA, 20 bp, Artificial Sequence
  chemically synthesized
ttcaagtgattctcctgcct

SEQ ID NO: 276285 - DNA, 20 bp, Artificial Sequence
  chemically synthesized
tacttgagaggctgaggcag

SEQ ID NO: 276286 - DNA, 20 bp, Artificial Sequence
  chemically synthesized
gctacttgagaggctgaggc

SEQ ID NO: 276287 - DNA, 20 bp, Artificial Sequence
  chemically synthesized
agctacttgagaggctgagg

SEQ ID NO: 276288 - DNA, 20 bp, Artificial Sequence
  chemically synthesized
cccagctacttgagaggctg

SEQ ID NO: 276289 - DNA, 20 bp, Artificial Sequence
  chemically synthesized
tcccagctacttgagaggct

SEQ ID NO: 276290 - DNA, 20 bp, Artificial Sequence
  chemically synthesized
ttctcctgcctcagcctctc

SEQ ID NO: 276291 - DNA, 20 bp, Artificial Sequence
  chemically synthesized
tcctgcctcagcctctcaag

SEQ ID NO: 276292 - DNA, 20 bp, Artificial Sequence
  chemically synthesized
tgtaatcccagctacttgag

SEQ ID NO: 276293 - DNA, 20 bp, Artificial Sequence
  chemically synthesized
ctgtaatcccagctacttga

SEQ ID NO: 276294 - DNA, 20 bp, Artificial Sequence
  chemically synthesized
gcctcagcctctcaagtagc

SEQ ID NO: 276295 - DNA, 20 bp, Artificial Sequence
  chemically synthesized
acctgtaatcccagctactt

SEQ ID NO: 276296 - DNA, 20 bp, Artificial Sequence
  chemically synthesized
cctcagcctctcaagtagct

SEQ ID NO: 276297 - DNA, 20 bp, Artificial Sequence
  chemically synthesized
ctctcaagtagctgggatta

SEQ ID NO: 276298 - DNA, 20 bp, Artificial Sequence
  chemically synthesized
tctcaagtagctgggattac

SEQ ID NO: 276299 - DNA, 20 bp, Artificial Sequence
  chemically synthesized
gtggcaggtacctgtaatcc

SEQ ID NO: 276300 - DNA, 20 bp, Artificial Sequence
  chemically synthesized
aattcgccaggcatggtggc

SEQ ID NO: 276301 - DNA, 20 bp, Artificial Sequence
  chemically synthesized
aaattcgccaggcatggtgg

SEQ ID NO: 276302 - DNA, 20 bp, Artificial Sequence
  chemically synthesized
caggtacctgccaccatgcc

SEQ ID NO: 276303 - DNA, 20 bp, Artificial Sequence
  chemically synthesized
caaaaattcgccaggcatgg

SEQ ID NO: 276304 - DNA, 20 bp, Artificial Sequence
  chemically synthesized
atacaaaaattcgccaggca

SEQ ID NO: 276305 - DNA, 20 bp, Artificial Sequence
  chemically synthesized
taaaaatacaaaaattcgcc

SEQ ID NO: 276306 - DNA, 20 bp, Artificial Sequence
  chemically synthesized
ctaaaaatacaaaaattcgc

SEQ ID NO: 276307 - DNA, 20 bp, Artificial Sequence
  chemically synthesized
ctggcgaatttttgtatttt

SEQ ID NO: 276308 - DNA, 20 bp, Artificial Sequence
  chemically synthesized
gcgaatttttgtatttttag

SEQ ID NO: 276309 - DNA, 20 bp, Artificial Sequence
  chemically synthesized
gaatttttgtatttttagta

SEQ ID NO: 276310 - DNA, 20 bp, Artificial Sequence
  chemically synthesized
ttttgtatttttagtagaga

SEQ ID NO: 276311 - DNA, 20 bp, Artificial Sequence
  chemically synthesized
tttgtatttttagtagagac

SEQ ID NO: 276312 - DNA, 20 bp, Artificial Sequence
  chemically synthesized
ttgtatttttagtagagaca

SEQ ID NO: 276313 - DNA, 20 bp, Artificial Sequence
  chemically synthesized
cagggtttcaccaatttgcc

SEQ ID NO: 276314 - DNA, 20 bp, Artificial Sequence
  chemically synthesized
tgagaccagcctgggcaaat

SEQ ID NO: 276315 - DNA, 20 bp, Artificial Sequence
  chemically synthesized
agggtttcaccaatttgccc

SEQ ID NO: 276316 - DNA, 20 bp, Artificial Sequence
  chemically synthesized
tttcaccaatttgcccaggc

SEQ ID NO: 276317 - DNA, 20 bp, Artificial Sequence
  chemically synthesized
caggagtttgagaccagcct

SEQ ID NO: 276318 - DNA, 20 bp, Artificial Sequence
  chemically synthesized
tcaggagtttgagaccagcc

SEQ ID NO: 276319 - DNA, 20 bp, Artificial Sequence
  chemically synthesized
ttaggtcaggagtttgagac

SEQ ID NO: 276320 - DNA, 20 bp, Artificial Sequence
  chemically synthesized
tcatcttaggtcaggagttt

SEQ ID NO: 276321 - DNA, 20 bp, Artificial Sequence
  chemically synthesized
tggtctcaaactcctgacct

SEQ ID NO: 276322 - DNA, 20 bp, Artificial Sequence
  chemically synthesized
ggtggatcatcttaggtcag

SEQ ID NO: 276323 - DNA, 20 bp, Artificial Sequence
  chemically synthesized
tgggtggatcatcttaggtc

SEQ ID NO: 276324 - DNA, 20 bp, Artificial Sequence
  chemically synthesized
gtgggtggatcatcttaggt

SEQ ID NO: 276325 - DNA, 20 bp, Artificial Sequence
  chemically synthesized
cgaggtgggtggatcatctt

SEQ ID NO: 276326 - DNA, 20 bp, Artificial Sequence
  chemically synthesized
ccgaggtgggtggatcatct

SEQ ID NO: 276327 - DNA, 20 bp, Artificial Sequence
  chemically synthesized
ctaagatgatccacccacct

SEQ ID NO: 276328 - DNA, 20 bp, Artificial Sequence
  chemically synthesized
cttagggaggccgaggtggg

SEQ ID NO: 276329 - DNA, 20 bp, Artificial Sequence
  chemically synthesized
gcacttagggaggccgaggt

SEQ ID NO: 276330 - DNA, 20 bp, Artificial Sequence
  chemically synthesized
agcacttagggaggccgagg

SEQ ID NO: 276331 - DNA, 20 bp, Artificial Sequence
  chemically synthesized
cccagcacttagggaggccg

SEQ ID NO: 276332 - DNA, 20 bp, Artificial Sequence
  chemically synthesized
tcccagcacttagggaggcc

SEQ ID NO: 276333 - DNA, 20 bp, Artificial Sequence
  chemically synthesized
ccacccacctcggcctccct

SEQ ID NO: 276334 - DNA, 20 bp, Artificial Sequence
  chemically synthesized
tataatcccagcacttaggg

SEQ ID NO: 276335 - DNA, 20 bp, Artificial Sequence
  chemically synthesized
ctataatcccagcacttagg

SEQ ID NO: 276336 - DNA, 20 bp, Artificial Sequence
  chemically synthesized
acctcggcctccctaagtgc

SEQ ID NO: 276337 - DNA, 20 bp, Artificial Sequence
  chemically synthesized
gcctataatcccagcactta

SEQ ID NO: 276338 - DNA, 20 bp, Artificial Sequence
  chemically synthesized
cctcggcctccctaagtgct

SEQ ID NO: 276339 - DNA, 20 bp, Artificial Sequence
  chemically synthesized
cgcctataatcccagcactt

SEQ ID NO: 276340 - DNA, 20 bp, Artificial Sequence
  chemically synthesized
acgcctataatcccagcact

SEQ ID NO: 276341 - DNA, 20 bp, Artificial Sequence
  chemically synthesized
ctccctaagtgctgggatta

SEQ ID NO: 276342 - DNA, 20 bp, Artificial Sequence
  chemically synthesized
tccctaagtgctgggattat

SEQ ID NO: 276343 - DNA, 20 bp, Artificial Sequence
  chemically synthesized
atgtctcacgcctataatcc

SEQ ID NO: 276344 - DNA, 20 bp, Artificial Sequence
  chemically synthesized
agtgctgggattataggcgt

SEQ ID NO: 276345 - DNA, 20 bp, Artificial Sequence
  chemically synthesized
taggcgtgagacattgcgcg

SEQ ID NO: 276346 - DNA, 20 bp, Artificial Sequence
  chemically synthesized
gagacattgcgcgcagccaa

SEQ ID NO: 276347 - DNA, 20 bp, Artificial Sequence
  chemically synthesized
cacattaaggataaagcttt

SEQ ID NO: 276348 - DNA, 20 bp, Artificial Sequence
  chemically synthesized
tttaagccacattaaggata

SEQ ID NO: 276349 - DNA, 20 bp, Artificial Sequence
  chemically synthesized
caaaagctttatccttaatg

SEQ ID NO: 276350 - DNA, 20 bp, Artificial Sequence
  chemically synthesized
gggacttttaagccacatta

SEQ ID NO: 276351 - DNA, 20 bp, Artificial Sequence
  chemically synthesized
agggacttttaagccacatt

SEQ ID NO: 276352 - DNA, 20 bp, Artificial Sequence
  chemically synthesized
ttatccttaatgtggcttaa

SEQ ID NO: 276353 - DNA, 20 bp, Artificial Sequence
  chemically synthesized
tatattatgaagggactttt

SEQ ID NO: 276354 - DNA, 20 bp, Artificial Sequence
  chemically synthesized
agcaggacttatattatgaa

SEQ ID NO: 276355 - DNA, 20 bp, Artificial Sequence
  chemically synthesized
cagcaggacttatattatga

SEQ ID NO: 276356 - DNA, 20 bp, Artificial Sequence
  chemically synthesized
ccagcaggacttatattatg

SEQ ID NO: 276357 - DNA, 20 bp, Artificial Sequence
  chemically synthesized
taaaagtcccttcataatat

SEQ ID NO: 276358 - DNA, 20 bp, Artificial Sequence
  chemically synthesized
cttcataatataagtcctgc

SEQ ID NO: 276359 - DNA, 20 bp, Artificial Sequence
  chemically synthesized
agggagtaaaagacaccagc

SEQ ID NO: 276360 - DNA, 20 bp, Artificial Sequence
  chemically synthesized
cagggagtaaaagacaccag

SEQ ID NO: 276361 - DNA, 20 bp, Artificial Sequence
  chemically synthesized
gagcagggagtaaaagacac

SEQ ID NO: 276362 - DNA, 20 bp, Artificial Sequence
  chemically synthesized
atagctagagcagggagtaa

SEQ ID NO: 276363 - DNA, 20 bp, Artificial Sequence
  chemically synthesized
gtgtcttttactccctgctc

SEQ ID NO: 276364 - DNA, 20 bp, Artificial Sequence
  chemically synthesized
ttctgtatagctagagcagg

SEQ ID NO: 276365 - DNA, 20 bp, Artificial Sequence
  chemically synthesized
atttctgtatagctagagca

SEQ ID NO: 276366 - DNA, 20 bp, Artificial Sequence
  chemically synthesized
aatttctgtatagctagagc

SEQ ID NO: 276367 - DNA, 20 bp, Artificial Sequence
  chemically synthesized
aaatttctgtatagctagag

SEQ ID NO: 276368 - DNA, 20 bp, Artificial Sequence
  chemically synthesized
ataaaatttctgtatagcta

SEQ ID NO: 276369 - DNA, 20 bp, Artificial Sequence
  chemically synthesized
tactccctgctctagctata

SEQ ID NO: 276370 - DNA, 20 bp, Artificial Sequence
  chemically synthesized
aaataaaatttctgtatagc

SEQ ID NO: 276371 - DNA, 20 bp, Artificial Sequence
  chemically synthesized
taaaaaataaaatttctgta

SEQ ID NO: 276372 - DNA, 20 bp, Artificial Sequence
  chemically synthesized
agagggccacagtgtaggtt

SEQ ID NO: 276373 - DNA, 20 bp, Artificial Sequence
  chemically synthesized
aagagggccacagtgtaggt

SEQ ID NO: 276374 - DNA, 20 bp, Artificial Sequence
  chemically synthesized
ttatttcccaacctacactg

SEQ ID NO: 276375 - DNA, 20 bp, Artificial Sequence
  chemically synthesized
aatcaagagggccacagtgt

SEQ ID NO: 276376 - DNA, 20 bp, Artificial Sequence
  chemically synthesized
gaatcaagagggccacagtg

SEQ ID NO: 276377 - DNA, 20 bp, Artificial Sequence
  chemically synthesized
gccaagaatcaagagggcca

SEQ ID NO: 276378 - DNA, 20 bp, Artificial Sequence
  chemically synthesized
tttaaggccaagaatcaaga

SEQ ID NO: 276379 - DNA, 20 bp, Artificial Sequence
  chemically synthesized
gtttaaggccaagaatcaag

SEQ ID NO: 276380 - DNA, 20 bp, Artificial Sequence
  chemically synthesized
tgtttaaggccaagaatcaa

SEQ ID NO: 276381 - DNA, 20 bp, Artificial Sequence
  chemically synthesized
actgtggccctcttgattct

SEQ ID NO: 276382 - DNA, 20 bp, Artificial Sequence
  chemically synthesized
catgtttaaggccaagaatc

SEQ ID NO: 276383 - DNA, 20 bp, Artificial Sequence
  chemically synthesized
ggaacaacatgtttaaggcc

SEQ ID NO: 276384 - DNA, 20 bp, Artificial Sequence
  chemically synthesized
aaaagggaacaacatgttta

SEQ ID NO: 276385 - DNA, 20 bp, Artificial Sequence
  chemically synthesized
taaaagggaacaacatgttt

SEQ ID NO: 276386 - DNA, 20 bp, Artificial Sequence
  chemically synthesized
aacatgttgttcccttttac

SEQ ID NO: 276387 - DNA, 20 bp, Artificial Sequence
  chemically synthesized
ttgagattatgccagtaaaa

SEQ ID NO: 276388 - DNA, 20 bp, Artificial Sequence
  chemically synthesized
attgagattatgccagtaaa

SEQ ID NO: 276389 - DNA, 20 bp, Artificial Sequence
  chemically synthesized
aattgagattatgccagtaa

SEQ ID NO: 276390 - DNA, 20 bp, Artificial Sequence
  chemically synthesized
agtcagaattgagattatgc

SEQ ID NO: 276391 - DNA, 20 bp, Artificial Sequence
  chemically synthesized
aataaaaggaagtcagaatt

SEQ ID NO: 276392 - DNA, 20 bp, Artificial Sequence
  chemically synthesized
attagccaataaaaggaagt

SEQ ID NO: 276393 - DNA, 20 bp, Artificial Sequence
  chemically synthesized
gtaaattagccaataaaagg

SEQ ID NO: 276394 - DNA, 20 bp, Artificial Sequence
  chemically synthesized
caattctgacttccttttat

SEQ ID NO: 276395 - DNA, 20 bp, Artificial Sequence
  chemically synthesized
aatgtaaattagccaataaa

SEQ ID NO: 276396 - DNA, 20 bp, Artificial Sequence
  chemically synthesized
aaatgtaaattagccaataa

SEQ ID NO: 276397 - DNA, 20 bp, Artificial Sequence
  chemically synthesized
ttaagaagataaatgtaaat

SEQ ID NO: 276398 - DNA, 20 bp, Artificial Sequence
  chemically synthesized
ttacatttatcttcttaatg

SEQ ID NO: 276399 - DNA, 20 bp, Artificial Sequence
  chemically synthesized
gagatgtccactacattaag

SEQ ID NO: 276400 - DNA, 20 bp, Artificial Sequence
  chemically synthesized
catttatcttcttaatgtag

SEQ ID NO: 276401 - DNA, 20 bp, Artificial Sequence
  chemically synthesized
gaagagatgtccactacatt

SEQ ID NO: 276402 - DNA, 20 bp, Artificial Sequence
  chemically synthesized
atgtagtggacatctcttcc

SEQ ID NO: 276403 - DNA, 20 bp, Artificial Sequence
  chemically synthesized
tagtggacatctcttccaag

SEQ ID NO: 276404 - DNA, 20 bp, Artificial Sequence
  chemically synthesized
ccagaggtagccacttggaa

SEQ ID NO: 276405 - DNA, 20 bp, Artificial Sequence
  chemically synthesized
tgccagaggtagccacttgg

SEQ ID NO: 276406 - DNA, 20 bp, Artificial Sequence
  chemically synthesized
aggtgccagaggtagccact

SEQ ID NO: 276407 - DNA, 20 bp, Artificial Sequence
  chemically synthesized
ctcttccaagtggctacctc

SEQ ID NO: 276408 - DNA, 20 bp, Artificial Sequence
  chemically synthesized
aacttagaaggtgccagagg

SEQ ID NO: 276409 - DNA, 20 bp, Artificial Sequence
  chemically synthesized
ctgaacttagaaggtgccag

SEQ ID NO: 276410 - DNA, 20 bp, Artificial Sequence
  chemically synthesized
cctgaacttagaaggtgcca

SEQ ID NO: 276411 - DNA, 20 bp, Artificial Sequence
  chemically synthesized
tccctgaacttagaaggtgc

SEQ ID NO: 276412 - DNA, 20 bp, Artificial Sequence
  chemically synthesized
ggctacctctggcaccttct

SEQ ID NO: 276413 - DNA, 20 bp, Artificial Sequence
  chemically synthesized
attacctccctgaacttaga

SEQ ID NO: 276414 - DNA, 20 bp, Artificial Sequence
  chemically synthesized
cctctggcaccttctaagtt

SEQ ID NO: 276415 - DNA, 20 bp, Artificial Sequence
  chemically synthesized
aattacctccctgaacttag

SEQ ID NO: 276416 - DNA, 20 bp, Artificial Sequence
  chemically synthesized
ctctggcaccttctaagttc

SEQ ID NO: 276417 - DNA, 20 bp, Artificial Sequence
  chemically synthesized
tctggcaccttctaagttca

SEQ ID NO: 276418 - DNA, 20 bp, Artificial Sequence
  chemically synthesized
aagaattacctccctgaact

SEQ ID NO: 276419 - DNA, 20 bp, Artificial Sequence
  chemically synthesized
tggcaccttctaagttcagg

SEQ ID NO: 276420 - DNA, 20 bp, Artificial Sequence
  chemically synthesized
ggcaccttctaagttcaggg

SEQ ID NO: 276421 - DNA, 20 bp, Artificial Sequence
  chemically synthesized
acaaaattcaaagaacatgc

SEQ ID NO: 276422 - DNA, 20 bp, Artificial Sequence
  chemically synthesized
tcaaaaaaatacaaaattca

SEQ ID NO: 276423 - DNA, 20 bp, Artificial Sequence
  chemically synthesized
ttgtatttttttgatttgac

SEQ ID NO: 276424 - DNA, 20 bp, Artificial Sequence
  chemically synthesized
tgacaagtaaaaattctatc

SEQ ID NO: 276425 - DNA, 20 bp, Artificial Sequence
  chemically synthesized
aagtaaaaattctatcaagt

SEQ ID NO: 276426 - DNA, 20 bp, Artificial Sequence
  chemically synthesized
tgttacgtgctctaacttga

SEQ ID NO: 276427 - DNA, 20 bp, Artificial Sequence
  chemically synthesized
gtaaaaattctatcaagtta

SEQ ID NO: 276428 - DNA, 20 bp, Artificial Sequence
  chemically synthesized
tttaatatatgaatatgtta

SEQ ID NO: 276429 - DNA, 20 bp, Artificial Sequence
  chemically synthesized
ttaatatatgaatatgttac

SEQ ID NO: 276430 - DNA, 20 bp, Artificial Sequence
  chemically synthesized
tatatgaatatgttacggga

SEQ ID NO: 276431 - DNA, 20 bp, Artificial Sequence
  chemically synthesized
tgttacgggatggctaaatt

SEQ ID NO: 276432 - DNA, 20 bp, Artificial Sequence
  chemically synthesized
aatgcataaatagcttaatt

SEQ ID NO: 276433 - DNA, 20 bp, Artificial Sequence
  chemically synthesized
catgtgagggaatgcataaa

SEQ ID NO: 276434 - DNA, 20 bp, Artificial Sequence
  chemically synthesized
aagaacataatgtcatgtga

SEQ ID NO: 276435 - DNA, 20 bp, Artificial Sequence
  chemically synthesized
aaagaacataatgtcatgtg

SEQ ID NO: 276436 - DNA, 20 bp, Artificial Sequence
  chemically synthesized
gaaagaacataatgtcatgt

SEQ ID NO: 276437 - DNA, 20 bp, Artificial Sequence
  chemically synthesized
ggcacatacaaagtgcaaga

SEQ ID NO: 276438 - DNA, 20 bp, Artificial Sequence
  chemically synthesized
ttatggcacatacaaagtgc

SEQ ID NO: 276439 - DNA, 20 bp, Artificial Sequence
  chemically synthesized
aatatgttatggcacataca

SEQ ID NO: 276440 - DNA, 20 bp, Artificial Sequence
  chemically synthesized
atgggagattaaatatgtta

SEQ ID NO: 276441 - DNA, 20 bp, Artificial Sequence
  chemically synthesized
catatttaatctcccattaa

SEQ ID NO: 276442 - DNA, 20 bp, Artificial Sequence
  chemically synthesized
taaatgcagaccattaatgg

SEQ ID NO: 276443 - DNA, 20 bp, Artificial Sequence
  chemically synthesized
agtaaatgcagaccattaat

SEQ ID NO: 276444 - DNA, 20 bp, Artificial Sequence
  chemically synthesized
aagtaaatgcagaccattaa

SEQ ID NO: 276445 - DNA, 20 bp, Artificial Sequence
  chemically synthesized
ttgatagtctaaagtaaatg

SEQ ID NO: 276446 - DNA, 20 bp, Artificial Sequence
  chemically synthesized
ttaatggtctgcatttactt

SEQ ID NO: 276447 - DNA, 20 bp, Artificial Sequence
  chemically synthesized
tcattagagttgatagtcta

SEQ ID NO: 276448 - DNA, 20 bp, Artificial Sequence
  chemically synthesized
cttgaactcattagagttga

SEQ ID NO: 276449 - DNA, 20 bp, Artificial Sequence
  chemically synthesized
tttagactatcaactctaat

SEQ ID NO: 276450 - DNA, 20 bp, Artificial Sequence
  chemically synthesized
cgtaatccttgaactcatta

SEQ ID NO: 276451 - DNA, 20 bp, Artificial Sequence
  chemically synthesized
gccgtaatccttgaactcat

SEQ ID NO: 276452 - DNA, 20 bp, Artificial Sequence
  chemically synthesized
ctatcaactctaatgagttc

SEQ ID NO: 276453 - DNA, 20 bp, Artificial Sequence
  chemically synthesized
tatcaactctaatgagttca

SEQ ID NO: 276454 - DNA, 20 bp, Artificial Sequence
  chemically synthesized
tctaatgagttcaaggatta

SEQ ID NO: 276455 - DNA, 20 bp, Artificial Sequence
  chemically synthesized
gtattgagcaatgaacagga

SEQ ID NO: 276456 - DNA, 20 bp, Artificial Sequence
  chemically synthesized
actggtattgagcaatgaac

SEQ ID NO: 276457 - DNA, 20 bp, Artificial Sequence
  chemically synthesized
aactggtattgagcaatgaa

SEQ ID NO: 276458 - DNA, 20 bp, Artificial Sequence
  chemically synthesized
tcctgttcattgctcaatac

SEQ ID NO: 276459 - DNA, 20 bp, Artificial Sequence
  chemically synthesized
tcattctaggaactggtatt

SEQ ID NO: 276460 - DNA, 20 bp, Artificial Sequence
  chemically synthesized
cattgctcaataccagttcc

SEQ ID NO: 276461 - DNA, 20 bp, Artificial Sequence
  chemically synthesized
ttgggcttcattctaggaac

SEQ ID NO: 276462 - DNA, 20 bp, Artificial Sequence
  chemically synthesized
caataccagttcctagaatg

SEQ ID NO: 276463 - DNA, 20 bp, Artificial Sequence
  chemically synthesized
aagctattgggcttcattct

SEQ ID NO: 276464 - DNA, 20 bp, Artificial Sequence
  chemically synthesized
aaagctattgggcttcattc

SEQ ID NO: 276465 - DNA, 20 bp, Artificial Sequence
  chemically synthesized
gttcctagaatgaagcccaa

SEQ ID NO: 276466 - DNA, 20 bp, Artificial Sequence
  chemically synthesized
cagtcataaataaagctatt

SEQ ID NO: 276467 - DNA, 20 bp, Artificial Sequence
  chemically synthesized
ccagtcataaataaagctat

SEQ ID NO: 276468 - DNA, 20 bp, Artificial Sequence
  chemically synthesized
ttttcacccagtcataaata

SEQ ID NO: 276469 - DNA, 20 bp, Artificial Sequence
  chemically synthesized
ccaatagctttatttatgac

SEQ ID NO: 276470 - DNA, 20 bp, Artificial Sequence
  chemically synthesized
caatagctttatttatgact

SEQ ID NO: 276471 - DNA, 20 bp, Artificial Sequence
  chemically synthesized
tttatttatgactgggtgaa

SEQ ID NO: 276472 - DNA, 20 bp, Artificial Sequence
  chemically synthesized
ttctccttatacttttcacc

SEQ ID NO: 276473 - DNA, 20 bp, Artificial Sequence
  chemically synthesized
tatgactgggtgaaaagtat

SEQ ID NO: 276474 - DNA, 20 bp, Artificial Sequence
  chemically synthesized
atgactgggtgaaaagtata

SEQ ID NO: 276475 - DNA, 20 bp, Artificial Sequence
  chemically synthesized
gactgggtgaaaagtataag

SEQ ID NO: 276476 - DNA, 20 bp, Artificial Sequence
  chemically synthesized
gtataaggagaaattttaat

SEQ ID NO: 276477 - DNA, 20 bp, Artificial Sequence
  chemically synthesized
agaaattttaatgagaaaaa

SEQ ID NO: 276478 - DNA, 20 bp, Artificial Sequence
  chemically synthesized
gaaaaacagaaaactttaaa

SEQ ID NO: 276479 - DNA, 20 bp, Artificial Sequence
  chemically synthesized
ttttcgtctttgactattta

SEQ ID NO: 276480 - DNA, 20 bp, Artificial Sequence
  chemically synthesized
cagaaaactttaaatagtca

SEQ ID NO: 276481 - DNA, 20 bp, Artificial Sequence
  chemically synthesized
taaatagtcaaagacgaaaa

SEQ ID NO: 276482 - DNA, 20 bp, Artificial Sequence
  chemically synthesized
caaagacgaaaatggattta

SEQ ID NO: 276483 - DNA, 20 bp, Artificial Sequence
  chemically synthesized
agacgaaaatggatttacag

SEQ ID NO: 276484 - DNA, 20 bp, Artificial Sequence
  chemically synthesized
tacagaagaaattgtaaaca

SEQ ID NO: 276485 - DNA, 20 bp, Artificial Sequence
  chemically synthesized
acagaagaaattgtaaacaa

SEQ ID NO: 276486 - DNA, 20 bp, Artificial Sequence
  chemically synthesized
aaacaaaggtcaccactgct

SEQ ID NO: 276487 - DNA, 20 bp, Artificial Sequence
  chemically synthesized
acaaaggtcaccactgctca

SEQ ID NO: 276488 - DNA, 20 bp, Artificial Sequence
  chemically synthesized
aaagatacatctctgagcag

SEQ ID NO: 276489 - DNA, 20 bp, Artificial Sequence
  chemically synthesized
ccaaaagatacatctctgag

SEQ ID NO: 276490 - DNA, 20 bp, Artificial Sequence
  chemically synthesized
tgtccaaaagatacatctct

SEQ ID NO: 276491 - DNA, 20 bp, Artificial Sequence
  chemically synthesized
ctgctcagagatgtatcttt

SEQ ID NO: 276492 - DNA, 20 bp, Artificial Sequence
  chemically synthesized
cagatagatttattgtccaa

SEQ ID NO: 276493 - DNA, 20 bp, Artificial Sequence
  chemically synthesized
acttttaatacaaaaacaga

SEQ ID NO: 276494 - DNA, 20 bp, Artificial Sequence
  chemically synthesized
tgacacttttaatacaaaaa

SEQ ID NO: 276495 - DNA, 20 bp, Artificial Sequence
  chemically synthesized
tctatctgtttttgtattaa

SEQ ID NO: 276496 - DNA, 20 bp, Artificial Sequence
  chemically synthesized
tgtttttgtattaaaagtgt

SEQ ID NO: 276497 - DNA, 20 bp, Artificial Sequence
  chemically synthesized
ttgtattaaaagtgtcagaa

SEQ ID NO: 276498 - DNA, 20 bp, Artificial Sequence
  chemically synthesized
tgtattaaaagtgtcagaat

SEQ ID NO: 276499 - DNA, 20 bp, Artificial Sequence
  chemically synthesized
gtattaaaagtgtcagaatg

SEQ ID NO: 276500 - DNA, 20 bp, Artificial Sequence
  chemically synthesized
tattaaaagtgtcagaatgg

SEQ ID NO: 276501 - DNA, 20 bp, Artificial Sequence
  chemically synthesized
taaaagtgtcagaatggggg

SEQ ID NO: 276502 - DNA, 20 bp, Artificial Sequence
  chemically synthesized
aaaagtgtcagaatgggggt

SEQ ID NO: 276503 - DNA, 20 bp, Artificial Sequence
  chemically synthesized
aatgggggtgggacattatt

SEQ ID NO: 276504 - DNA, 20 bp, Artificial Sequence
  chemically synthesized
tgggggtgggacattatttg

SEQ ID NO: 276505 - DNA, 20 bp, Artificial Sequence
  chemically synthesized
atacagaattttaatagaaa

SEQ ID NO: 276506 - DNA, 20 bp, Artificial Sequence
  chemically synthesized
ggatacagaattttaataga

SEQ ID NO: 276507 - DNA, 20 bp, Artificial Sequence
  chemically synthesized
tcttggatacagaattttaa

SEQ ID NO: 276508 - DNA, 20 bp, Artificial Sequence
  chemically synthesized
tctattaaaattctgtatcc

SEQ ID NO: 276509 - DNA, 20 bp, Artificial Sequence
  chemically synthesized
tcggtcaccaatcttggata

SEQ ID NO: 276510 - DNA, 20 bp, Artificial Sequence
  chemically synthesized
taaaattctgtatccaagat

SEQ ID NO: 276511 - DNA, 20 bp, Artificial Sequence
  chemically synthesized
aaagcctcggtcaccaatct

SEQ ID NO: 276512 - DNA, 20 bp, Artificial Sequence
  chemically synthesized
tgtatccaagattggtgacc

SEQ ID NO: 276513 - DNA, 20 bp, Artificial Sequence
  chemically synthesized
gtatccaagattggtgaccg

SEQ ID NO: 276514 - DNA, 20 bp, Artificial Sequence
  chemically synthesized
tggaatatagggcaaagcct

SEQ ID NO: 276515 - DNA, 20 bp, Artificial Sequence
  chemically synthesized
ttgaattggaatatagggca

SEQ ID NO: 276516 - DNA, 20 bp, Artificial Sequence
  chemically synthesized
tatgtttgaattggaatata

SEQ ID NO: 276517 - DNA, 20 bp, Artificial Sequence
  chemically synthesized
ctatgtttgaattggaatat

SEQ ID NO: 276518 - DNA, 20 bp, Artificial Sequence
  chemically synthesized
gctatgtttgaattggaata

SEQ ID NO: 276519 - DNA, 20 bp, Artificial Sequence
  chemically synthesized
aaaggaagctatgtttgaat

SEQ ID NO: 276520 - DNA, 20 bp, Artificial Sequence
  chemically synthesized
cctatattccaattcaaaca

SEQ ID NO: 276521 - DNA, 20 bp, Artificial Sequence
  chemically synthesized
ttttgactgagaacaaaagg

SEQ ID NO: 276522 - DNA, 20 bp, Artificial Sequence
  chemically synthesized
aaattttgactgagaacaaa

SEQ ID NO: 276523 - DNA, 20 bp, Artificial Sequence
  chemically synthesized
acatagcttccttttgttct

SEQ ID NO: 276524 - DNA, 20 bp, Artificial Sequence
  chemically synthesized
gaaattttgactgagaacaa

SEQ ID NO: 276525 - DNA, 20 bp, Artificial Sequence
  chemically synthesized
ttttagttgaaattttgact

SEQ ID NO: 276526 - DNA, 20 bp, Artificial Sequence
  chemically synthesized
aaattacctgatgtaaattt

SEQ ID NO: 276527 - DNA, 20 bp, Artificial Sequence
  chemically synthesized
atttcaactaaaatttacat

SEQ ID NO: 276528 - DNA, 20 bp, Artificial Sequence
  chemically synthesized
tttcaactaaaatttacatc

SEQ ID NO: 276529 - DNA, 20 bp, Artificial Sequence
  chemically synthesized
catcaggtaatttactattt

SEQ ID NO: 276530 - DNA, 20 bp, Artificial Sequence
  chemically synthesized
ctgaacactgttatctgaaa

SEQ ID NO: 276531 - DNA, 20 bp, Artificial Sequence
  chemically synthesized
taatttactatttcagataa

SEQ ID NO: 276532 - DNA, 20 bp, Artificial Sequence
  chemically synthesized
ctatttcagataacagtgtt

SEQ ID NO: 276533 - DNA, 20 bp, Artificial Sequence
  chemically synthesized
tatttcagataacagtgttc

SEQ ID NO: 276534 - DNA, 20 bp, Artificial Sequence
  chemically synthesized
atttcagataacagtgttca

SEQ ID NO: 276535 - DNA, 20 bp, Artificial Sequence
  chemically synthesized
acagtgttcagggctataat

SEQ ID NO: 276536 - DNA, 20 bp, Artificial Sequence
  chemically synthesized
agtgttcagggctataatca

SEQ ID NO: 276537 - DNA, 20 bp, Artificial Sequence
  chemically synthesized
tgcaatagaggctctgatta

SEQ ID NO: 276538 - DNA, 20 bp, Artificial Sequence
  chemically synthesized
tataatcagagcctctattg

SEQ ID NO: 276539 - DNA, 20 bp, Artificial Sequence
  chemically synthesized
gccagtctcctctgcaatag

SEQ ID NO: 276540 - DNA, 20 bp, Artificial Sequence
  chemically synthesized
taatcagagcctctattgca

SEQ ID NO: 276541 - DNA, 20 bp, Artificial Sequence
  chemically synthesized
agccagtctcctctgcaata

SEQ ID NO: 276542 - DNA, 20 bp, Artificial Sequence
  chemically synthesized
aatcagagcctctattgcag

SEQ ID NO: 276543 - DNA, 20 bp, Artificial Sequence
  chemically synthesized
gcagccagtctcctctgcaa

SEQ ID NO: 276544 - DNA, 20 bp, Artificial Sequence
  chemically synthesized
tcagagcctctattgcagag

SEQ ID NO: 276545 - DNA, 20 bp, Artificial Sequence
  chemically synthesized
gcctctattgcagaggagac

SEQ ID NO: 276546 - DNA, 20 bp, Artificial Sequence
  chemically synthesized
attgcagaggagactggctg

SEQ ID NO: 276547 - DNA, 20 bp, Artificial Sequence
  chemically synthesized
agctgtgggtaggctgcagc

SEQ ID NO: 276548 - DNA, 20 bp, Artificial Sequence
  chemically synthesized
gaagagctgtgggtaggctg

SEQ ID NO: 276549 - DNA, 20 bp, Artificial Sequence
  chemically synthesized
gactggctgcagcctaccca

SEQ ID NO: 276550 - DNA, 20 bp, Artificial Sequence
  chemically synthesized
tctttggaagagctgtgggt

SEQ ID NO: 276551 - DNA, 20 bp, Artificial Sequence
  chemically synthesized
ttctttggaagagctgtggg

SEQ ID NO: 276552 - DNA, 20 bp, Artificial Sequence
  chemically synthesized
catttctttggaagagctgt

SEQ ID NO: 276553 - DNA, 20 bp, Artificial Sequence
  chemically synthesized
ccatttctttggaagagctg

SEQ ID NO: 276554 - DNA, 20 bp, Artificial Sequence
  chemically synthesized
gcctacccacagctcttcca

SEQ ID NO: 276555 - DNA, 20 bp, Artificial Sequence
  chemically synthesized
agagatccatttctttggaa

SEQ ID NO: 276556 - DNA, 20 bp, Artificial Sequence
  chemically synthesized
ctagagatccatttctttgg

SEQ ID NO: 276557 - DNA, 20 bp, Artificial Sequence
  chemically synthesized
ccacagctcttccaaagaaa

SEQ ID NO: 276558 - DNA, 20 bp, Artificial Sequence
  chemically synthesized
tcactagagatccatttctt

SEQ ID NO: 276559 - DNA, 20 bp, Artificial Sequence
  chemically synthesized
cttccaaagaaatggatctc

SEQ ID NO: 276560 - DNA, 20 bp, Artificial Sequence
  chemically synthesized
atgctgaaattttatcacta

SEQ ID NO: 276561 - DNA, 20 bp, Artificial Sequence
  chemically synthesized
caatgctgaaattttatcac

SEQ ID NO: 276562 - DNA, 20 bp, Artificial Sequence
  chemically synthesized
gatctctagtgataaaattt

SEQ ID NO: 276563 - DNA, 20 bp, Artificial Sequence
  chemically synthesized
ataaaatttcagcattgtga

SEQ ID NO: 276564 - DNA, 20 bp, Artificial Sequence
  chemically synthesized
taaaatttcagcattgtgac

SEQ ID NO: 276565 - DNA, 20 bp, Artificial Sequence
  chemically synthesized
aatttcagcattgtgacagg

SEQ ID NO: 276566 - DNA, 20 bp, Artificial Sequence
  chemically synthesized
tcagcattgtgacaggtggt

SEQ ID NO: 276567 - DNA, 20 bp, Artificial Sequence
  chemically synthesized
agcattgtgacaggtggttg

SEQ ID NO: 276568 - DNA, 20 bp, Artificial Sequence
  chemically synthesized
ttggagaaaacttccaatca

SEQ ID NO: 276569 - DNA, 20 bp, Artificial Sequence
  chemically synthesized
ttattacacgctgtgattgg

SEQ ID NO: 276570 - DNA, 20 bp, Artificial Sequence
  chemically synthesized
caattattacacgctgtgat

SEQ ID NO: 276571 - DNA, 20 bp, Artificial Sequence
  chemically synthesized
cacagcgtgtaataattgcc

SEQ ID NO: 276572 - DNA, 20 bp, Artificial Sequence
  chemically synthesized
gcgtgtaataattgcctagc

SEQ ID NO: 276573 - DNA, 20 bp, Artificial Sequence
  chemically synthesized
cgtgtaataattgcctagcc

SEQ ID NO: 276574 - DNA, 20 bp, Artificial Sequence
  chemically synthesized
accaaatttaatacctggct

SEQ ID NO: 276575 - DNA, 20 bp, Artificial Sequence
  chemically synthesized
gaccaaatttaatacctggc

SEQ ID NO: 276576 - DNA, 20 bp, Artificial Sequence
  chemically synthesized
gaaggaccaaatttaatacc

SEQ ID NO: 276577 - DNA, 20 bp, Artificial Sequence
  chemically synthesized
gcctagccaggtattaaatt

SEQ ID NO: 276578 - DNA, 20 bp, Artificial Sequence
  chemically synthesized
attaaatttggtccttcctc

SEQ ID NO: 276579 - DNA, 20 bp, Artificial Sequence
  chemically synthesized
ttttgcctttagccagagga

SEQ ID NO: 276580 - DNA, 20 bp, Artificial Sequence
  chemically synthesized
tttttgcctttagccagagg

SEQ ID NO: 276581 - DNA, 20 bp, Artificial Sequence
  chemically synthesized
tttggtccttcctctggcta

SEQ ID NO: 276582 - DNA, 20 bp, Artificial Sequence
  chemically synthesized
ctgtttttgcctttagccag

SEQ ID NO: 276583 - DNA, 20 bp, Artificial Sequence
  chemically synthesized
ttggtccttcctctggctaa

SEQ ID NO: 276584 - DNA, 20 bp, Artificial Sequence
  chemically synthesized
actgtttttgcctttagcca

SEQ ID NO: 276585 - DNA, 20 bp, Artificial Sequence
  chemically synthesized
acactgtttttgcctttagc

SEQ ID NO: 276586 - DNA, 20 bp, Artificial Sequence
  chemically synthesized
gagtacactgtttttgcctt

SEQ ID NO: 276587 - DNA, 20 bp, Artificial Sequence
  chemically synthesized
cctctggctaaaggcaaaaa

SEQ ID NO: 276588 - DNA, 20 bp, Artificial Sequence
  chemically synthesized
gcaaaaacagtgtactctac

SEQ ID NO: 276589 - DNA, 20 bp, Artificial Sequence
  chemically synthesized
caaaaacagtgtactctaca

SEQ ID NO: 276590 - DNA, 20 bp, Artificial Sequence
  chemically synthesized
atctacagatgtgccttgta

SEQ ID NO: 276591 - DNA, 20 bp, Artificial Sequence
  chemically synthesized
aaatctacagatgtgccttg

SEQ ID NO: 276592 - DNA, 20 bp, Artificial Sequence
  chemically synthesized
tactctacaaggcacatctg

SEQ ID NO: 276593 - DNA, 20 bp, Artificial Sequence
  chemically synthesized
tcctatacaattaaaatcta

SEQ ID NO: 276594 - DNA, 20 bp, Artificial Sequence
  chemically synthesized
atctgtagattttaattgta

SEQ ID NO: 276595 - DNA, 20 bp, Artificial Sequence
  chemically synthesized
tctgtagattttaattgtat

SEQ ID NO: 276596 - DNA, 20 bp, Artificial Sequence
  chemically synthesized
taattgtataggatgtaata

SEQ ID NO: 276597 - DNA, 20 bp, Artificial Sequence
  chemically synthesized
ataacattaaaccacatatc

SEQ ID NO: 276598 - DNA, 20 bp, Artificial Sequence
  chemically synthesized
gaattttgaggctagatatg

SEQ ID NO: 276599 - DNA, 20 bp, Artificial Sequence
  chemically synthesized
tctaaaaagaattttgaggc

SEQ ID NO: 276600 - DNA, 20 bp, Artificial Sequence
  chemically synthesized
ggtttctaaaaagaattttg

SEQ ID NO: 276601 - DNA, 20 bp, Artificial Sequence
  chemically synthesized
aggtttctaaaaagaatttt

SEQ ID NO: 276602 - DNA, 20 bp, Artificial Sequence
  chemically synthesized
tctagcctcaaaattctttt

SEQ ID NO: 276603 - DNA, 20 bp, Artificial Sequence
  chemically synthesized
gaaaaagttaggtttctaaa

SEQ ID NO: 276604 - DNA, 20 bp, Artificial Sequence
  chemically synthesized
tctcatgaatagaaaaagtt

SEQ ID NO: 276605 - DNA, 20 bp, Artificial Sequence
  chemically synthesized
atctcatgaatagaaaaagt

SEQ ID NO: 276606 - DNA, 20 bp, Artificial Sequence
  chemically synthesized
tagaatctcatgaatagaaa

SEQ ID NO: 276607 - DNA, 20 bp, Artificial Sequence
  chemically synthesized
acctaactttttctattcat

SEQ ID NO: 276608 - DNA, 20 bp, Artificial Sequence
  chemically synthesized
agctcatagaatctcatgaa

SEQ ID NO: 276609 - DNA, 20 bp, Artificial Sequence
  chemically synthesized
ttctattcatgagattctat

SEQ ID NO: 276610 - DNA, 20 bp, Artificial Sequence
  chemically synthesized
acactgttcctttcagctca

SEQ ID NO: 276611 - DNA, 20 bp, Artificial Sequence
  chemically synthesized
catgagattctatgagctga

SEQ ID NO: 276612 - DNA, 20 bp, Artificial Sequence
  chemically synthesized
atgagattctatgagctgaa

SEQ ID NO: 276613 - DNA, 20 bp, Artificial Sequence
  chemically synthesized
attctatgagctgaaaggaa

SEQ ID NO: 276614 - DNA, 20 bp, Artificial Sequence
  chemically synthesized
ttaagccacactgttccttt

SEQ ID NO: 276615 - DNA, 20 bp, Artificial Sequence
  chemically synthesized
atgagctgaaaggaacagtg

SEQ ID NO: 276616 - DNA, 20 bp, Artificial Sequence
  chemically synthesized
tgaaaggaacagtgtggctt

SEQ ID NO: 276617 - DNA, 20 bp, Artificial Sequence
  chemically synthesized
caactctgccatcatttctt

SEQ ID NO: 276618 - DNA, 20 bp, Artificial Sequence
  chemically synthesized
cagtgtggcttaagaaatga

SEQ ID NO: 276619 - DNA, 20 bp, Artificial Sequence
  chemically synthesized
tgtggcttaagaaatgatgg

SEQ ID NO: 276620 - DNA, 20 bp, Artificial Sequence
  chemically synthesized
tggcttaagaaatgatggca

SEQ ID NO: 276621 - DNA, 20 bp, Artificial Sequence
  chemically synthesized
aatgatggcagagttgactt

SEQ ID NO: 276622 - DNA, 20 bp, Artificial Sequence
  chemically synthesized
atgatggcagagttgacttc

SEQ ID NO: 276623 - DNA, 20 bp, Artificial Sequence
  chemically synthesized
atggcagagttgacttcggg

SEQ ID NO: 276624 - DNA, 20 bp, Artificial Sequence
  chemically synthesized
tggcagagttgacttcgggt

SEQ ID NO: 276625 - DNA, 20 bp, Artificial Sequence
  chemically synthesized
gaaaagagccaacccacccg

SEQ ID NO: 276626 - DNA, 20 bp, Artificial Sequence
  chemically synthesized
agagttgacttcgggtgggt

SEQ ID NO: 276627 - DNA, 20 bp, Artificial Sequence
  chemically synthesized
gggtgggttggctcttttcc

SEQ ID NO: 276628 - DNA, 20 bp, Artificial Sequence
  chemically synthesized
tgactgtcaggccaggaaaa

SEQ ID NO: 276629 - DNA, 20 bp, Artificial Sequence
  chemically synthesized
attgactgtcaggccaggaa

SEQ ID NO: 276630 - DNA, 20 bp, Artificial Sequence
  chemically synthesized
tggctcttttcctggcctga

SEQ ID NO: 276631 - DNA, 20 bp, Artificial Sequence
  chemically synthesized
ctcttattgactgtcaggcc

SEQ ID NO: 276632 - DNA, 20 bp, Artificial Sequence
  chemically synthesized
tctcttattgactgtcaggc

SEQ ID NO: 276633 - DNA, 20 bp, Artificial Sequence
  chemically synthesized
agcctctcttattgactgtc

SEQ ID NO: 276634 - DNA, 20 bp, Artificial Sequence
  chemically synthesized
cagcctctcttattgactgt

SEQ ID NO: 276635 - DNA, 20 bp, Artificial Sequence
  chemically synthesized
ttcctggcctgacagtcaat

SEQ ID NO: 276636 - DNA, 20 bp, Artificial Sequence
  chemically synthesized
cctggcctgacagtcaataa

SEQ ID NO: 276637 - DNA, 20 bp, Artificial Sequence
  chemically synthesized
tggcctgacagtcaataaga

SEQ ID NO: 276638 - DNA, 20 bp, Artificial Sequence
  chemically synthesized
ggcctgacagtcaataagag

SEQ ID NO: 276639 - DNA, 20 bp, Artificial Sequence
  chemically synthesized
ataagagaggctgatttaca

SEQ ID NO: 276640 - DNA, 20 bp, Artificial Sequence
  chemically synthesized
atcaaggaatctgtgtaaat

SEQ ID NO: 276641 - DNA, 20 bp, Artificial Sequence
  chemically synthesized
ttcaatgactgagataatca

SEQ ID NO: 276642 - DNA, 20 bp, Artificial Sequence
  chemically synthesized
tttcaatgactgagataatc

SEQ ID NO: 276643 - DNA, 20 bp, Artificial Sequence
  chemically synthesized
cacagattccttgattatct

SEQ ID NO: 276644 - DNA, 20 bp, Artificial Sequence
  chemically synthesized
atgaggtcttttcaatgact

SEQ ID NO: 276645 - DNA, 20 bp, Artificial Sequence
  chemically synthesized
tgattatctcagtcattgaa

SEQ ID NO: 276646 - DNA, 20 bp, Artificial Sequence
  chemically synthesized
tgcaagcttgcattgacatg

SEQ ID NO: 276647 - DNA, 20 bp, Artificial Sequence
  chemically synthesized
ctgcaagcttgcattgacat

SEQ ID NO: 276648 - DNA, 20 bp, Artificial Sequence
  chemically synthesized
aaaagacctcatgtcaatgc

SEQ ID NO: 276649 - DNA, 20 bp, Artificial Sequence
  chemically synthesized
ctcatgtcaatgcaagcttg

SEQ ID NO: 276650 - DNA, 20 bp, Artificial Sequence
  chemically synthesized
actagttgaaagaattctgc

SEQ ID NO: 276651 - DNA, 20 bp, Artificial Sequence
  chemically synthesized
gcttgcagaattctttcaac

SEQ ID NO: 276652 - DNA, 20 bp, Artificial Sequence
  chemically synthesized
cttatgccatgactagttga

SEQ ID NO: 276653 - DNA, 20 bp, Artificial Sequence
  chemically synthesized
agaattctttcaactagtca

SEQ ID NO: 276654 - DNA, 20 bp, Artificial Sequence
  chemically synthesized
aaggcagcttatgccatgac

SEQ ID NO: 276655 - DNA, 20 bp, Artificial Sequence
  chemically synthesized
ctttcaactagtcatggcat

SEQ ID NO: 276656 - DNA, 20 bp, Artificial Sequence
  chemically synthesized
agatgtttagaaatagaagg

SEQ ID NO: 276657 - DNA, 20 bp, Artificial Sequence
  chemically synthesized
atcagatgtttagaaataga

SEQ ID NO: 276658 - DNA, 20 bp, Artificial Sequence
  chemically synthesized
aatcagatgtttagaaatag

SEQ ID NO: 276659 - DNA, 20 bp, Artificial Sequence
  chemically synthesized
cctaatcagatgtttagaaa

SEQ ID NO: 276660 - DNA, 20 bp, Artificial Sequence
  chemically synthesized
ggtgcgcctaatcagatgtt

SEQ ID NO: 276661 - DNA, 20 bp, Artificial Sequence
  chemically synthesized
tctatttctaaacatctgat

SEQ ID NO: 276662 - DNA, 20 bp, Artificial Sequence
  chemically synthesized
ctatttctaaacatctgatt

SEQ ID NO: 276663 - DNA, 20 bp, Artificial Sequence
  chemically synthesized
tccatcagggtgcgcctaat

SEQ ID NO: 276664 - DNA, 20 bp, Artificial Sequence
  chemically synthesized
tctgattaggcgcaccctga

SEQ ID NO: 276665 - DNA, 20 bp, Artificial Sequence
  chemically synthesized
ataagcctgacattccatca

SEQ ID NO: 276666 - DNA, 20 bp, Artificial Sequence
  chemically synthesized
cataagcctgacattccatc

SEQ ID NO: 276667 - DNA, 20 bp, Artificial Sequence
  chemically synthesized
tcataagcctgacattccat

SEQ ID NO: 276668 - DNA, 20 bp, Artificial Sequence
  chemically synthesized
ggcgcaccctgatggaatgt

SEQ ID NO: 276669 - DNA, 20 bp, Artificial Sequence
  chemically synthesized
gcgcaccctgatggaatgtc

SEQ ID NO: 276670 - DNA, 20 bp, Artificial Sequence
  chemically synthesized
cagaaagtcagaaaattcat

SEQ ID NO: 276671 - DNA, 20 bp, Artificial Sequence
  chemically synthesized
aggtcaagcgggcagaaagt

SEQ ID NO: 276672 - DNA, 20 bp, Artificial Sequence
  chemically synthesized
gcacaggtcaagcgggcaga

SEQ ID NO: 276673 - DNA, 20 bp, Artificial Sequence
  chemically synthesized
gacagcacaggtcaagcggg

SEQ ID NO: 276674 - DNA, 20 bp, Artificial Sequence
  chemically synthesized
tgagacagcacaggtcaagc

SEQ ID NO: 276675 - DNA, 20 bp, Artificial Sequence
  chemically synthesized
atgagacagcacaggtcaag

SEQ ID NO: 276676 - DNA, 20 bp, Artificial Sequence
  chemically synthesized
tcaatgagacagcacaggtc

SEQ ID NO: 276677 - DNA, 20 bp, Artificial Sequence
  chemically synthesized
ttcattcaatgagacagcac

SEQ ID NO: 276678 - DNA, 20 bp, Artificial Sequence
  chemically synthesized
cttcattcaatgagacagca

SEQ ID NO: 276679 - DNA, 20 bp, Artificial Sequence
  chemically synthesized
acaaacttcattcaatgaga

SEQ ID NO: 276680 - DNA, 20 bp, Artificial Sequence
  chemically synthesized
ttctacaaacttcattcaat

SEQ ID NO: 276681 - DNA, 20 bp, Artificial Sequence
  chemically synthesized
ctgtgctgtctcattgaatg

SEQ ID NO: 276682 - DNA, 20 bp, Artificial Sequence
  chemically synthesized
gtctcattgaatgaagtttg

SEQ ID NO: 276683 - DNA, 20 bp, Artificial Sequence
  chemically synthesized
cattgaatgaagtttgtaga

SEQ ID NO: 276684 - DNA, 20 bp, Artificial Sequence
  chemically synthesized
aaaaaatcagattatggttg

SEQ ID NO: 276685 - DNA, 20 bp, Artificial Sequence
  chemically synthesized
aacaacaaaaaatcagatta

SEQ ID NO: 276686 - DNA, 20 bp, Artificial Sequence
  chemically synthesized
ctggaacaacaacaaaaaat

SEQ ID NO: 276687 - DNA, 20 bp, Artificial Sequence
  chemically synthesized
ctgattttttgttgttgttc

SEQ ID NO: 276688 - DNA, 20 bp, Artificial Sequence
  chemically synthesized
acaacagcggaacagtattc

SEQ ID NO: 276689 - DNA, 20 bp, Artificial Sequence
  chemically synthesized
attttaaaacaacagcggaa

SEQ ID NO: 276690 - DNA, 20 bp, Artificial Sequence
  chemically synthesized
ataacattttaaaacaacag

SEQ ID NO: 276691 - DNA, 20 bp, Artificial Sequence
  chemically synthesized
gaaataacattttaaaacaa

SEQ ID NO: 276692 - DNA, 20 bp, Artificial Sequence
  chemically synthesized
aaaatgttatttcatgtctt

SEQ ID NO: 276693 - DNA, 20 bp, Artificial Sequence
  chemically synthesized
actgctaagtggattagcta

SEQ ID NO: 276694 - DNA, 20 bp, Artificial Sequence
  chemically synthesized
atgtctttagctaatccact

SEQ ID NO: 276695 - DNA, 20 bp, Artificial Sequence
  chemically synthesized
cctcttactgctaagtggat

SEQ ID NO: 276696 - DNA, 20 bp, Artificial Sequence
  chemically synthesized
tctttagctaatccacttag

SEQ ID NO: 276697 - DNA, 20 bp, Artificial Sequence
  chemically synthesized
taattcctcttactgctaag

SEQ ID NO: 276698 - DNA, 20 bp, Artificial Sequence
  chemically synthesized
tagctaatccacttagcagt

SEQ ID NO: 276699 - DNA, 20 bp, Artificial Sequence
  chemically synthesized
atataattcctcttactgct

SEQ ID NO: 276700 - DNA, 20 bp, Artificial Sequence
  chemically synthesized
gctaatccacttagcagtaa

SEQ ID NO: 276701 - DNA, 20 bp, Artificial Sequence
  chemically synthesized
ctaatccacttagcagtaag

SEQ ID NO: 276702 - DNA, 20 bp, Artificial Sequence
  chemically synthesized
tagcagtaagaggaattata

SEQ ID NO: 276703 - DNA, 20 bp, Artificial Sequence
  chemically synthesized
agtaagaggaattatatagc

SEQ ID NO: 276704 - DNA, 20 bp, Artificial Sequence
  chemically synthesized
agaggaattatatagctaga

SEQ ID NO: 276705 - DNA, 20 bp, Artificial Sequence
  chemically synthesized
ttatatttgctgtttctgtc

SEQ ID NO: 276706 - DNA, 20 bp, Artificial Sequence
  chemically synthesized
attatatagctagacagaaa

SEQ ID NO: 276707 - DNA, 20 bp, Artificial Sequence
  chemically synthesized
tagacagaaacagcaaatat

SEQ ID NO: 276708 - DNA, 20 bp, Artificial Sequence
  chemically synthesized
agacagaaacagcaaatata

SEQ ID NO: 276709 - DNA, 20 bp, Artificial Sequence
  chemically synthesized
agaaacagcaaatataagga

SEQ ID NO: 276710 - DNA, 20 bp, Artificial Sequence
  chemically synthesized
acagcaaatataaggaaagt

SEQ ID NO: 276711 - DNA, 20 bp, Artificial Sequence
  chemically synthesized
caaatataaggaaagttaga

SEQ ID NO: 276712 - DNA, 20 bp, Artificial Sequence
  chemically synthesized
cattgatcgccagttattaa

SEQ ID NO: 276713 - DNA, 20 bp, Artificial Sequence
  chemically synthesized
gaaagacatcttttaataac

SEQ ID NO: 276714 - DNA, 20 bp, Artificial Sequence
  chemically synthesized
atatttttgtcattgatcgc

SEQ ID NO: 276715 - DNA, 20 bp, Artificial Sequence
  chemically synthesized
caatgacaaaaatataaaaa

SEQ ID NO: 276716 - DNA, 20 bp, Artificial Sequence
  chemically synthesized
ataaaaatagaaaacaatcc

SEQ ID NO: 276717 - DNA, 20 bp, Artificial Sequence
  chemically synthesized
atagaaaacaatcctagtaa

SEQ ID NO: 276718 - DNA, 20 bp, Artificial Sequence
  chemically synthesized
ttttcttggtaaccattact

SEQ ID NO: 276719 - DNA, 20 bp, Artificial Sequence
  chemically synthesized
tttttcttggtaaccattac

SEQ ID NO: 276720 - DNA, 20 bp, Artificial Sequence
  chemically synthesized
caatcctagtaatggttacc

SEQ ID NO: 276721 - DNA, 20 bp, Artificial Sequence
  chemically synthesized
aatatattatgtgtttttct

SEQ ID NO: 276722 - DNA, 20 bp, Artificial Sequence
  chemically synthesized
acacataatatattttaacc

SEQ ID NO: 276723 - DNA, 20 bp, Artificial Sequence
  chemically synthesized
tttaattttcattgaaaact

SEQ ID NO: 276724 - DNA, 20 bp, Artificial Sequence
  chemically synthesized
ttttaattttcattgaaaac

SEQ ID NO: 276725 - DNA, 20 bp, Artificial Sequence
  chemically synthesized
tttcaatgaaaattaaaact

SEQ ID NO: 276726 - DNA, 20 bp, Artificial Sequence
  chemically synthesized
tgaaaattaaaactaagtaa

SEQ ID NO: 276727 - DNA, 20 bp, Artificial Sequence
  chemically synthesized
aatttgtgttaacttttact

SEQ ID NO: 276728 - DNA, 20 bp, Artificial Sequence
  chemically synthesized
ttaattattttatatcttta

SEQ ID NO: 276729 - DNA, 20 bp, Artificial Sequence
  chemically synthesized
tatatttccatagtacttta

SEQ ID NO: 276730 - DNA, 20 bp, Artificial Sequence
  chemically synthesized
tttatatctttaaagtacta

SEQ ID NO: 276731 - DNA, 20 bp, Artificial Sequence
  chemically synthesized
aaacttattttatatttcca

SEQ ID NO: 276732 - DNA, 20 bp, Artificial Sequence
  chemically synthesized
gtactatggaaatataaaat

SEQ ID NO: 276733 - DNA, 20 bp, Artificial Sequence
  chemically synthesized
tggaaatataaaataagttt

SEQ ID NO: 276734 - DNA, 20 bp, Artificial Sequence
  chemically synthesized
tataaaataagtttaagaaa

SEQ ID NO: 276735 - DNA, 20 bp, Artificial Sequence
  chemically synthesized
taagtttaagaaaaagtttt

SEQ ID NO: 276736 - DNA, 20 bp, Artificial Sequence
  chemically synthesized
agtttaagaaaaagttttaa

SEQ ID NO: 276737 - DNA, 20 bp, Artificial Sequence
  chemically synthesized
aaaagttttaagagtttaat

SEQ ID NO: 276738 - DNA, 20 bp, Artificial Sequence
  chemically synthesized
aagagtttaatgagttttgc

SEQ ID NO: 276739 - DNA, 20 bp, Artificial Sequence
  chemically synthesized
tagagatgactttacattgc

SEQ ID NO: 276740 - DNA, 20 bp, Artificial Sequence
  chemically synthesized
tgagttttgctggcaatgta

SEQ ID NO: 276741 - DNA, 20 bp, Artificial Sequence
  chemically synthesized
gaaactgtcaattcattgta

SEQ ID NO: 276742 - DNA, 20 bp, Artificial Sequence
  chemically synthesized
gagaaactgtcaattcattg

SEQ ID NO: 276743 - DNA, 20 bp, Artificial Sequence
  chemically synthesized
tcatctctacaatgaattga

SEQ ID NO: 276744 - DNA, 20 bp, Artificial Sequence
  chemically synthesized
tatttttaaaatggaaatgt

SEQ ID NO: 276745 - DNA, 20 bp, Artificial Sequence
  chemically synthesized
ttagtacattatttttaaaa

SEQ ID NO: 276746 - DNA, 20 bp, Artificial Sequence
  chemically synthesized
taatattgtggtacaaaggt

SEQ ID NO: 276747 - DNA, 20 bp, Artificial Sequence
  chemically synthesized
tttgtaatattgtggtacaa

SEQ ID NO: 276748 - DNA, 20 bp, Artificial Sequence
  chemically synthesized
gtttgtaatattgtggtaca

SEQ ID NO: 276749 - DNA, 20 bp, Artificial Sequence
  chemically synthesized
tttatgtgtttgtaatattg

SEQ ID NO: 276750 - DNA, 20 bp, Artificial Sequence
  chemically synthesized
tattacaaacacataaatca

SEQ ID NO: 276751 - DNA, 20 bp, Artificial Sequence
  chemically synthesized
caaacacataaatcaaagtg

SEQ ID NO: 276752 - DNA, 20 bp, Artificial Sequence
  chemically synthesized
aatcaaagtgtagcatgtct

SEQ ID NO: 276753 - DNA, 20 bp, Artificial Sequence
  chemically synthesized
ttttctcttccagagtttct

SEQ ID NO: 276754 - DNA, 20 bp, Artificial Sequence
  chemically synthesized
gtagcatgtctaagaaactc

SEQ ID NO: 276755 - DNA, 20 bp, Artificial Sequence
  chemically synthesized
gcatgtctaagaaactctgg

SEQ ID NO: 276756 - DNA, 20 bp, Artificial Sequence
  chemically synthesized
atgtctaagaaactctggaa

SEQ ID NO: 276757 - DNA, 20 bp, Artificial Sequence
  chemically synthesized
atgcagagttttctcttcca

SEQ ID NO: 276758 - DNA, 20 bp, Artificial Sequence
  chemically synthesized
acatgcagagttttctcttc

SEQ ID NO: 276759 - DNA, 20 bp, Artificial Sequence
  chemically synthesized
ggttttttatttcacatgca

SEQ ID NO: 276760 - DNA, 20 bp, Artificial Sequence
  chemically synthesized
tcggttttttatttcacatg

SEQ ID NO: 276761 - DNA, 20 bp, Artificial Sequence
  chemically synthesized
cattttttggtttcaatatt

SEQ ID NO: 276762 - DNA, 20 bp, Artificial Sequence
  chemically synthesized
catatgttaaatacattttt

SEQ ID NO: 276763 - DNA, 20 bp, Artificial Sequence
  chemically synthesized
atatgaatgcatgctttaaa

SEQ ID NO: 276764 - DNA, 20 bp, Artificial Sequence
  chemically synthesized
ttttctaatttggcttttta

SEQ ID NO: 276765 - DNA, 20 bp, Artificial Sequence
  chemically synthesized
catgctttaaaaagccaaat

SEQ ID NO: 276766 - DNA, 20 bp, Artificial Sequence
  chemically synthesized
aaatgattttttttctaatt

SEQ ID NO: 276767 - DNA, 20 bp, Artificial Sequence
  chemically synthesized
tacaaaaaacacattcatta

SEQ ID NO: 276768 - DNA, 20 bp, Artificial Sequence
  chemically synthesized
acaaaaaacacattcattaa

SEQ ID NO: 276769 - DNA, 20 bp, Artificial Sequence
  chemically synthesized
aaaaaacacattcattaaag

SEQ ID NO: 276770 - DNA, 20 bp, Artificial Sequence
  chemically synthesized
aacacattcattaaaggagc

SEQ ID NO: 276771 - DNA, 20 bp, Artificial Sequence
  chemically synthesized
acacattcattaaaggagct

SEQ ID NO: 276772 - DNA, 20 bp, Artificial Sequence
  chemically synthesized
taagtatagtataggatacc

SEQ ID NO: 276773 - DNA, 20 bp, Artificial Sequence
  chemically synthesized
gagtttaataagtatagtat

SEQ ID NO: 276774 - DNA, 20 bp, Artificial Sequence
  chemically synthesized
tgagtttaataagtatagta

SEQ ID NO: 276775 - DNA, 20 bp, Artificial Sequence
  chemically synthesized
tgtattgagtttaataagta

SEQ ID NO: 276776 - DNA, 20 bp, Artificial Sequence
  chemically synthesized
ctttttgtattgagtttaat

SEQ ID NO: 276777 - DNA, 20 bp, Artificial Sequence
  chemically synthesized
gtaaaattgctttttgtatt

SEQ ID NO: 276778 - DNA, 20 bp, Artificial Sequence
  chemically synthesized
cttattaaactcaatacaaa

SEQ ID NO: 276779 - DNA, 20 bp, Artificial Sequence
  chemically synthesized
agcaattttactgcatttat

SEQ ID NO: 276780 - DNA, 20 bp, Artificial Sequence
  chemically synthesized
tacccatcacctcataaatg

SEQ ID NO: 276781 - DNA, 20 bp, Artificial Sequence
  chemically synthesized
gcaattttactgcatttatg

SEQ ID NO: 276782 - DNA, 20 bp, Artificial Sequence
  chemically synthesized
ttactgcatttatgaggtga

SEQ ID NO: 276783 - DNA, 20 bp, Artificial Sequence
  chemically synthesized
tactgcatttatgaggtgat

SEQ ID NO: 276784 - DNA, 20 bp, Artificial Sequence
  chemically synthesized
gcatttatgaggtgatgggt

SEQ ID NO: 276785 - DNA, 20 bp, Artificial Sequence
  chemically synthesized
cttaatccatttgcaagcat

SEQ ID NO: 276786 - DNA, 20 bp, Artificial Sequence
  chemically synthesized
ggtaagcttatgcttgcaaa

SEQ ID NO: 276787 - DNA, 20 bp, Artificial Sequence
  chemically synthesized
cacattcttaatccatttgc

SEQ ID NO: 276788 - DNA, 20 bp, Artificial Sequence
  chemically synthesized
cttatgcttgcaaatggatt

SEQ ID NO: 276789 - DNA, 20 bp, Artificial Sequence
  chemically synthesized
ttgcaaatggattaagaatg

SEQ ID NO: 276790 - DNA, 20 bp, Artificial Sequence
  chemically synthesized
tgcaaatggattaagaatgt

SEQ ID NO: 276791 - DNA, 20 bp, Artificial Sequence
  chemically synthesized
tattacgagatgattgtaaa

SEQ ID NO: 276792 - DNA, 20 bp, Artificial Sequence
  chemically synthesized
gtttacaatcatctcgtaat

SEQ ID NO: 276793 - DNA, 20 bp, Artificial Sequence
  chemically synthesized
aaataaaagtgtcttattac

SEQ ID NO: 276794 - DNA, 20 bp, Artificial Sequence
  chemically synthesized
taataagacacttttatttt

SEQ ID NO: 276795 - DNA, 20 bp, Artificial Sequence
  chemically synthesized
tatttaaacaccaaaaataa

SEQ ID NO: 276796 - DNA, 20 bp, Artificial Sequence
  chemically synthesized
acaatgatgaatacaatgat

SEQ ID NO: 276797 - DNA, 20 bp, Artificial Sequence
  chemically synthesized
ttgtattcatcattgtgatg

SEQ ID NO: 276798 - DNA, 20 bp, Artificial Sequence
  chemically synthesized
atgtaaaacatttcaatttc

SEQ ID NO: 276799 - DNA, 20 bp, Artificial Sequence
  chemically synthesized
taaaacatttcaatttccag

SEQ ID NO: 276800 - DNA, 20 bp, Artificial Sequence
  chemically synthesized
aagaaaatatttaaaactgc

SEQ ID NO: 276801 - DNA, 20 bp, Artificial Sequence
  chemically synthesized
agttttaaatattttcttct

SEQ ID NO: 276802 - DNA, 20 bp, Artificial Sequence
  chemically synthesized
taaatattttcttctgagta

SEQ ID NO: 276803 - DNA, 20 bp, Artificial Sequence
  chemically synthesized
aaaaatccttctttactcag

SEQ ID NO: 276804 - DNA, 20 bp, Artificial Sequence
  chemically synthesized
atattttcttctgagtaaag

SEQ ID NO: 276805 - DNA, 20 bp, Artificial Sequence
  chemically synthesized
ggcaaaaatccttctttact

SEQ ID NO: 276806 - DNA, 20 bp, Artificial Sequence
  chemically synthesized
tattttcttctgagtaaaga

SEQ ID NO: 276807 - DNA, 20 bp, Artificial Sequence
  chemically synthesized
tgagggctttattttgacat

SEQ ID NO: 276808 - DNA, 20 bp, Artificial Sequence
  chemically synthesized
tttttgccaatgtcaaaata

SEQ ID NO: 276809 - DNA, 20 bp, Artificial Sequence
  chemically synthesized
aaaatcactcataaaaatga

SEQ ID NO: 276810 - DNA, 20 bp, Artificial Sequence
  chemically synthesized
taaaatcactcataaaaatg

SEQ ID NO: 276811 - DNA, 20 bp, Artificial Sequence
  chemically synthesized
ctaaaatcactcataaaaat

SEQ ID NO: 276812 - DNA, 20 bp, Artificial Sequence
  chemically synthesized
aataaagccctcatttttat

SEQ ID NO: 276813 - DNA, 20 bp, Artificial Sequence
  chemically synthesized
ctcatttttatgagtgattt

SEQ ID NO: 276814 - DNA, 20 bp, Artificial Sequence
  chemically synthesized
atttttatgagtgattttag

SEQ ID NO: 276815 - DNA, 20 bp, Artificial Sequence
  chemically synthesized
atttgggatttagttttcgt

SEQ ID NO: 276816 - DNA, 20 bp, Artificial Sequence
  chemically synthesized
ttgaattggaatttgggatt

SEQ ID NO: 276817 - DNA, 20 bp, Artificial Sequence
  chemically synthesized
ctttatttgaattggaattt

SEQ ID NO: 276818 - DNA, 20 bp, Artificial Sequence
  chemically synthesized
gctttatttgaattggaatt

SEQ ID NO: 276819 - DNA, 20 bp, Artificial Sequence
  chemically synthesized
ttgctttgctttatttgaat

SEQ ID NO: 276820 - DNA, 20 bp, Artificial Sequence
  chemically synthesized
cccaaattccaattcaaata

SEQ ID NO: 276821 - DNA, 20 bp, Artificial Sequence
  chemically synthesized
attccaattcaaataaagca

SEQ ID NO: 276822 - DNA, 20 bp, Artificial Sequence
  chemically synthesized
aataaagcaaagcaacgaca

SEQ ID NO: 276823 - DNA, 20 bp, Artificial Sequence
  chemically synthesized
aaagcaacgacaaagtcttg

SEQ ID NO: 276824 - DNA, 20 bp, Artificial Sequence
  chemically synthesized
ctaccctaagcagaaacttc

SEQ ID NO: 276825 - DNA, 20 bp, Artificial Sequence
  chemically synthesized
aaagtcttgaagtttctgct

SEQ ID NO: 276826 - DNA, 20 bp, Artificial Sequence
  chemically synthesized
aagtcttgaagtttctgctt

SEQ ID NO: 276827 - DNA, 20 bp, Artificial Sequence
  chemically synthesized
agtcttgaagtttctgctta

SEQ ID NO: 276828 - DNA, 20 bp, Artificial Sequence
  chemically synthesized
cttgaagtttctgcttaggg

SEQ ID NO: 276829 - DNA, 20 bp, Artificial Sequence
  chemically synthesized
aattaatgcactaccctaag

SEQ ID NO: 276830 - DNA, 20 bp, Artificial Sequence
  chemically synthesized
gccaattaatgcactaccct

SEQ ID NO: 276831 - DNA, 20 bp, Artificial Sequence
  chemically synthesized
gcttagggtagtgcattaat

SEQ ID NO: 276832 - DNA, 20 bp, Artificial Sequence
  chemically synthesized
aggtacggacagtcaggttg

SEQ ID NO: 276833 - DNA, 20 bp, Artificial Sequence
  chemically synthesized
aaggtacggacagtcaggtt

SEQ ID NO: 276834 - DNA, 20 bp, Artificial Sequence
  chemically synthesized
caaggtacggacagtcaggt

SEQ ID NO: 276835 - DNA, 20 bp, Artificial Sequence
  chemically synthesized
tctgcaaggtacggacagtc

SEQ ID NO: 276836 - DNA, 20 bp, Artificial Sequence
  chemically synthesized
ttctgcaaggtacggacagt

SEQ ID NO: 276837 - DNA, 20 bp, Artificial Sequence
  chemically synthesized
tactttctgcaaggtacgga

SEQ ID NO: 276838 - DNA, 20 bp, Artificial Sequence
  chemically synthesized
acctgactgtccgtaccttg

SEQ ID NO: 276839 - DNA, 20 bp, Artificial Sequence
  chemically synthesized
gctctactttctgcaaggta

SEQ ID NO: 276840 - DNA, 20 bp, Artificial Sequence
  chemically synthesized
gactgtccgtaccttgcaga

SEQ ID NO: 276841 - DNA, 20 bp, Artificial Sequence
  chemically synthesized
atattgctctactttctgca

SEQ ID NO: 276842 - DNA, 20 bp, Artificial Sequence
  chemically synthesized
catattgctctactttctgc

SEQ ID NO: 276843 - DNA, 20 bp, Artificial Sequence
  chemically synthesized
tgtccgtaccttgcagaaag

SEQ ID NO: 276844 - DNA, 20 bp, Artificial Sequence
  chemically synthesized
tccgtaccttgcagaaagta

SEQ ID NO: 276845 - DNA, 20 bp, Artificial Sequence
  chemically synthesized
ttgcagaaagtagagcaata

SEQ ID NO: 276846 - DNA, 20 bp, Artificial Sequence
  chemically synthesized
atggaatatgttttatttta

SEQ ID NO: 276847 - DNA, 20 bp, Artificial Sequence
  chemically synthesized
aatatgttttattttataga

SEQ ID NO: 276848 - DNA, 20 bp, Artificial Sequence
  chemically synthesized
ttattttatagaaagtgtct

SEQ ID NO: 276849 - DNA, 20 bp, Artificial Sequence
  chemically synthesized
tattttatagaaagtgtctt

SEQ ID NO: 276850 - DNA, 20 bp, Artificial Sequence
  chemically synthesized
ttatagaaagtgtcttggga

SEQ ID NO: 276851 - DNA, 20 bp, Artificial Sequence
  chemically synthesized
tatagaaagtgtcttgggat

SEQ ID NO: 276852 - DNA, 20 bp, Artificial Sequence
  chemically synthesized
tagaaagtgtcttgggatag

SEQ ID NO: 276853 - DNA, 20 bp, Artificial Sequence
  chemically synthesized
tcttgcaggactcctatccc

SEQ ID NO: 276854 - DNA, 20 bp, Artificial Sequence
  chemically synthesized
tcttgggataggagtcctgc

SEQ ID NO: 276855 - DNA, 20 bp, Artificial Sequence
  chemically synthesized
ttgggataggagtcctgcaa

SEQ ID NO: 276856 - DNA, 20 bp, Artificial Sequence
  chemically synthesized
ggttttagcacatctcttgc

SEQ ID NO: 276857 - DNA, 20 bp, Artificial Sequence
  chemically synthesized
tggttttagcacatctcttg

SEQ ID NO: 276858 - DNA, 20 bp, Artificial Sequence
  chemically synthesized
ggttgagtaggatttggttt

SEQ ID NO: 276859 - DNA, 20 bp, Artificial Sequence
  chemically synthesized
agggcaggttgagtaggatt

SEQ ID NO: 276860 - DNA, 20 bp, Artificial Sequence
  chemically synthesized
ttctgaagggcaggttgagt

SEQ ID NO: 276861 - DNA, 20 bp, Artificial Sequence
  chemically synthesized
tttctgaagggcaggttgag

SEQ ID NO: 276862 - DNA, 20 bp, Artificial Sequence
  chemically synthesized
tagtttctgaagggcaggtt

SEQ ID NO: 276863 - DNA, 20 bp, Artificial Sequence
  chemically synthesized
atcctactcaacctgccctt

SEQ ID NO: 276864 - DNA, 20 bp, Artificial Sequence
  chemically synthesized
cactgtagtttctgaagggc

SEQ ID NO: 276865 - DNA, 20 bp, Artificial Sequence
  chemically synthesized
ccactgtagtttctgaaggg

SEQ ID NO: 276866 - DNA, 20 bp, Artificial Sequence
  chemically synthesized
tctccactgtagtttctgaa

SEQ ID NO: 276867 - DNA, 20 bp, Artificial Sequence
  chemically synthesized
gtctccactgtagtttctga

SEQ ID NO: 276868 - DNA, 20 bp, Artificial Sequence
  chemically synthesized
ggtctccactgtagtttctg

SEQ ID NO: 276869 - DNA, 20 bp, Artificial Sequence
  chemically synthesized
aacctgcccttcagaaacta

SEQ ID NO: 276870 - DNA, 20 bp, Artificial Sequence
  chemically synthesized
ctgcccttcagaaactacag

SEQ ID NO: 276871 - DNA, 20 bp, Artificial Sequence
  chemically synthesized
gcccttcagaaactacagtg

SEQ ID NO: 276872 - DNA, 20 bp, Artificial Sequence
  chemically synthesized
cctctcatgggtctccactg

SEQ ID NO: 276873 - DNA, 20 bp, Artificial Sequence
  chemically synthesized
aaactacagtggagacccat

SEQ ID NO: 276874 - DNA, 20 bp, Artificial Sequence
  chemically synthesized
actacagtggagacccatga

SEQ ID NO: 276875 - DNA, 20 bp, Artificial Sequence
  chemically synthesized
ctacagtggagacccatgag

SEQ ID NO: 276876 - DNA, 20 bp, Artificial Sequence
  chemically synthesized
ggagattaatgtcctctcat

SEQ ID NO: 276877 - DNA, 20 bp, Artificial Sequence
  chemically synthesized
tggagattaatgtcctctca

SEQ ID NO: 276878 - DNA, 20 bp, Artificial Sequence
  chemically synthesized
tgaagcgtggttgtcaaatg

SEQ ID NO: 276879 - DNA, 20 bp, Artificial Sequence
  chemically synthesized
agtgaagcgtggttgtcaaa

SEQ ID NO: 276880 - DNA, 20 bp, Artificial Sequence
  chemically synthesized
aaactctgtgaagtgaagcg

SEQ ID NO: 276881 - DNA, 20 bp, Artificial Sequence
  chemically synthesized
gacaaccacgcttcacttca

SEQ ID NO: 276882 - DNA, 20 bp, Artificial Sequence
  chemically synthesized
ctggtaaactctgtgaagtg

SEQ ID NO: 276883 - DNA, 20 bp, Artificial Sequence
  chemically synthesized
caaccacgcttcacttcaca

SEQ ID NO: 276884 - DNA, 20 bp, Artificial Sequence
  chemically synthesized
cttgactggtaaactctgtg

SEQ ID NO: 276885 - DNA, 20 bp, Artificial Sequence
  chemically synthesized
cttcacttcacagagtttac

SEQ ID NO: 276886 - DNA, 20 bp, Artificial Sequence
  chemically synthesized
cttcacagagtttaccagtc

SEQ ID NO: 276887 - DNA, 20 bp, Artificial Sequence
  chemically synthesized
tctgggaaagaaaacttgac

SEQ ID NO: 276888 - DNA, 20 bp, Artificial Sequence
  chemically synthesized
accagtcaagttttctttcc

SEQ ID NO: 276889 - DNA, 20 bp, Artificial Sequence
  chemically synthesized
cagtcaagttttctttccca

SEQ ID NO: 276890 - DNA, 20 bp, Artificial Sequence
  chemically synthesized
ctgaagttgagactctggga

SEQ ID NO: 276891 - DNA, 20 bp, Artificial Sequence
  chemically synthesized
tccactgaagttgagactct

SEQ ID NO: 276892 - DNA, 20 bp, Artificial Sequence
  chemically synthesized
gtccactgaagttgagactc

SEQ ID NO: 276893 - DNA, 20 bp, Artificial Sequence
  chemically synthesized
ctttcccagagtctcaactt

SEQ ID NO: 276894 - DNA, 20 bp, Artificial Sequence
  chemically synthesized
ttgcttggtccactgaagtt

SEQ ID NO: 276895 - DNA, 20 bp, Artificial Sequence
  chemically synthesized
tcccagagtctcaacttcag

SEQ ID NO: 276896 - DNA, 20 bp, Artificial Sequence
  chemically synthesized
aagtgttgcttggtccactg

SEQ ID NO: 276897 - DNA, 20 bp, Artificial Sequence
  chemically synthesized
agtctcaacttcagtggacc

SEQ ID NO: 276898 - DNA, 20 bp, Artificial Sequence
  chemically synthesized
ccactgaagcaagtgttgct

SEQ ID NO: 276899 - DNA, 20 bp, Artificial Sequence
  chemically synthesized
ggaccaagcaacacttgctt

SEQ ID NO: 276900 - DNA, 20 bp, Artificial Sequence
  chemically synthesized
ccaagcaacacttgcttcag

SEQ ID NO: 276901 - DNA, 20 bp, Artificial Sequence
  chemically synthesized
attgcttgatccactgaagc

SEQ ID NO: 276902 - DNA, 20 bp, Artificial Sequence
  chemically synthesized
aactattgcttgatccactg

SEQ ID NO: 276903 - DNA, 20 bp, Artificial Sequence
  chemically synthesized
aacacttgcttcagtggatc

SEQ ID NO: 276904 - DNA, 20 bp, Artificial Sequence
  chemically synthesized
tgcttcagtggatcaagcaa

SEQ ID NO: 276905 - DNA, 20 bp, Artificial Sequence
  chemically synthesized
cagtggatcaagcaatagtt

SEQ ID NO: 276906 - DNA, 20 bp, Artificial Sequence
  chemically synthesized
tggatcaagcaatagttcag

SEQ ID NO: 276907 - DNA, 20 bp, Artificial Sequence
  chemically synthesized
aaacactaaaaggaaatagt

SEQ ID NO: 276908 - DNA, 20 bp, Artificial Sequence
  chemically synthesized
aaagaaacactaaaaggaaa

SEQ ID NO: 276909 - DNA, 20 bp, Artificial Sequence
  chemically synthesized
gtggtccaactatttccttt

SEQ ID NO: 276910 - DNA, 20 bp, Artificial Sequence
  chemically synthesized
ggtaaaaaagaaacactaaa

SEQ ID NO: 276911 - DNA, 20 bp, Artificial Sequence
  chemically synthesized
aggtaaaaaagaaacactaa

SEQ ID NO: 276912 - DNA, 20 bp, Artificial Sequence
  chemically synthesized
caacctgttagtaggtaaaa

SEQ ID NO: 276913 - DNA, 20 bp, Artificial Sequence
  chemically synthesized
gtttcttttttacctactaa

SEQ ID NO: 276914 - DNA, 20 bp, Artificial Sequence
  chemically synthesized
tttcttttttacctactaac

SEQ ID NO: 276915 - DNA, 20 bp, Artificial Sequence
  chemically synthesized
acaaattgcaacctgttagt

SEQ ID NO: 276916 - DNA, 20 bp, Artificial Sequence
  chemically synthesized
aacaaattgcaacctgttag

SEQ ID NO: 276917 - DNA, 20 bp, Artificial Sequence
  chemically synthesized
ttgaacaaattgcaacctgt

SEQ ID NO: 276918 - DNA, 20 bp, Artificial Sequence
  chemically synthesized
taacaggttgcaatttgttc

SEQ ID NO: 276919 - DNA, 20 bp, Artificial Sequence
  chemically synthesized
ttgcaatttgttcaagtgcc

SEQ ID NO: 276920 - DNA, 20 bp, Artificial Sequence
  chemically synthesized
ttgttcaagtgccaagtact

SEQ ID NO: 276921 - DNA, 20 bp, Artificial Sequence
  chemically synthesized
ccaccagtattcttagtact

SEQ ID NO: 276922 - DNA, 20 bp, Artificial Sequence
  chemically synthesized
gtgccaagtactaagaatac

SEQ ID NO: 276923 - DNA, 20 bp, Artificial Sequence
  chemically synthesized
tatacacccaccagtattct

SEQ ID NO: 276924 - DNA, 20 bp, Artificial Sequence
  chemically synthesized
ccaagtactaagaatactgg

SEQ ID NO: 276925 - DNA, 20 bp, Artificial Sequence
  chemically synthesized
caagtactaagaatactggt

SEQ ID NO: 276926 - DNA, 20 bp, Artificial Sequence
  chemically synthesized
caaaaatgatatacacccac

SEQ ID NO: 276927 - DNA, 20 bp, Artificial Sequence
  chemically synthesized
agagttaggtcaggaggaaa

SEQ ID NO: 276928 - DNA, 20 bp, Artificial Sequence
  chemically synthesized
aatagaagagttaggtcagg

SEQ ID NO: 276929 - DNA, 20 bp, Artificial Sequence
  chemically synthesized
aaatagaagagttaggtcag

SEQ ID NO: 276930 - DNA, 20 bp, Artificial Sequence
  chemically synthesized
ttaaatagaagagttaggtc

SEQ ID NO: 276931 - DNA, 20 bp, Artificial Sequence
  chemically synthesized
gttaaatagaagagttaggt

SEQ ID NO: 276932 - DNA, 20 bp, Artificial Sequence
  chemically synthesized
ttaagttaaatagaagagtt

SEQ ID NO: 276933 - DNA, 20 bp, Artificial Sequence
  chemically synthesized
cttaagttaaatagaagagt

SEQ ID NO: 276934 - DNA, 20 bp, Artificial Sequence
  chemically synthesized
tgctcttaagttaaatagaa

SEQ ID NO: 276935 - DNA, 20 bp, Artificial Sequence
  chemically synthesized
cttgctcttaagttaaatag

SEQ ID NO: 276936 - DNA, 20 bp, Artificial Sequence
  chemically synthesized
acacttgctcttaagttaaa

SEQ ID NO: 276937 - DNA, 20 bp, Artificial Sequence
  chemically synthesized
ctaactcttctatttaactt

SEQ ID NO: 276938 - DNA, 20 bp, Artificial Sequence
  chemically synthesized
aactcttctatttaacttaa

SEQ ID NO: 276939 - DNA, 20 bp, Artificial Sequence
  chemically synthesized
cttctatttaacttaagagc

SEQ ID NO: 276940 - DNA, 20 bp, Artificial Sequence
  chemically synthesized
acagtttcacacttgctctt

SEQ ID NO: 276941 - DNA, 20 bp, Artificial Sequence
  chemically synthesized
caagtgtgaaactgtcacta

SEQ ID NO: 276942 - DNA, 20 bp, Artificial Sequence
  chemically synthesized
tgcattcatatccatagtga

SEQ ID NO: 276943 - DNA, 20 bp, Artificial Sequence
  chemically synthesized
attcaatgcattcatatcca

SEQ ID NO: 276944 - DNA, 20 bp, Artificial Sequence
  chemically synthesized
caaaattctaagacaacaga

SEQ ID NO: 276945 - DNA, 20 bp, Artificial Sequence
  chemically synthesized
ttgaattctatctgttgtct

SEQ ID NO: 276946 - DNA, 20 bp, Artificial Sequence
  chemically synthesized
tacccaaaattctaagacaa

SEQ ID NO: 276947 - DNA, 20 bp, Artificial Sequence
  chemically synthesized
tatctgttgtcttagaattt

SEQ ID NO: 276948 - DNA, 20 bp, Artificial Sequence
  chemically synthesized
aagactatacccaaaattct

SEQ ID NO: 276949 - DNA, 20 bp, Artificial Sequence
  chemically synthesized
atctgttgtcttagaatttt

SEQ ID NO: 276950 - DNA, 20 bp, Artificial Sequence
  chemically synthesized
ttgtcttagaattttgggta

SEQ ID NO: 276951 - DNA, 20 bp, Artificial Sequence
  chemically synthesized
ttacttgttattttcagttt

SEQ ID NO: 276952 - DNA, 20 bp, Artificial Sequence
  chemically synthesized
gacttattacttgttatttt

SEQ ID NO: 276953 - DNA, 20 bp, Artificial Sequence
  chemically synthesized
agtcttaaactgaaaataac

SEQ ID NO: 276954 - DNA, 20 bp, Artificial Sequence
  chemically synthesized
aactgaaaataacaagtaat

SEQ ID NO: 276955 - DNA, 20 bp, Artificial Sequence
  chemically synthesized
ttccatctcttagaatgaga

SEQ ID NO: 276956 - DNA, 20 bp, Artificial Sequence
  chemically synthesized
taataagtctctctcattct

SEQ ID NO: 276957 - DNA, 20 bp, Artificial Sequence
  chemically synthesized
atttccatctcttagaatga

SEQ ID NO: 276958 - DNA, 20 bp, Artificial Sequence
  chemically synthesized
ataagtctctctcattctaa

SEQ ID NO: 276959 - DNA, 20 bp, Artificial Sequence
  chemically synthesized
ctatttccatctcttagaat

SEQ ID NO: 276960 - DNA, 20 bp, Artificial Sequence
  chemically synthesized
gtctctctcattctaagaga

SEQ ID NO: 276961 - DNA, 20 bp, Artificial Sequence
  chemically synthesized
gccctgctatttccatctct

SEQ ID NO: 276962 - DNA, 20 bp, Artificial Sequence
  chemically synthesized
ctcattctaagagatggaaa

SEQ ID NO: 276963 - DNA, 20 bp, Artificial Sequence
  chemically synthesized
attctaagagatggaaatag

SEQ ID NO: 276964 - DNA, 20 bp, Artificial Sequence
  chemically synthesized
ttctaagagatggaaatagc

SEQ ID NO: 276965 - DNA, 20 bp, Artificial Sequence
  chemically synthesized
tctaagagatggaaatagca

SEQ ID NO: 276966 - DNA, 20 bp, Artificial Sequence
  chemically synthesized
gagatggaaatagcagggca

SEQ ID NO: 276967 - DNA, 20 bp, Artificial Sequence
  chemically synthesized
ggaaatagcagggcatagca

SEQ ID NO: 276968 - DNA, 20 bp, Artificial Sequence
  chemically synthesized
gaaatagcagggcatagcaa

SEQ ID NO: 276969 - DNA, 20 bp, Artificial Sequence
  chemically synthesized
aaatagcagggcatagcaaa

SEQ ID NO: 276970 - DNA, 20 bp, Artificial Sequence
  chemically synthesized
gcatagcaaagggcttacaa

SEQ ID NO: 276971 - DNA, 20 bp, Artificial Sequence
  chemically synthesized
atagcaaagggcttacaaaa

SEQ ID NO: 276972 - DNA, 20 bp, Artificial Sequence
  chemically synthesized
agttttcccagctcttttgt

SEQ ID NO: 276973 - DNA, 20 bp, Artificial Sequence
  chemically synthesized
caaagggcttacaaaagagc

SEQ ID NO: 276974 - DNA, 20 bp, Artificial Sequence
  chemically synthesized
aaagggcttacaaaagagct

SEQ ID NO: 276975 - DNA, 20 bp, Artificial Sequence
  chemically synthesized
tacaaaagagctgggaaaac

SEQ ID NO: 276976 - DNA, 20 bp, Artificial Sequence
  chemically synthesized
aaaggcagggccagttttcc

SEQ ID NO: 276977 - DNA, 20 bp, Artificial Sequence
  chemically synthesized
tggagcaacaaaggcagggc

SEQ ID NO: 276978 - DNA, 20 bp, Artificial Sequence
  chemically synthesized
atggtggagcaacaaaggca

SEQ ID NO: 276979 - DNA, 20 bp, Artificial Sequence
  chemically synthesized
tatggtggagcaacaaaggc

SEQ ID NO: 276980 - DNA, 20 bp, Artificial Sequence
  chemically synthesized
gtatggtggagcaacaaagg

SEQ ID NO: 276981 - DNA, 20 bp, Artificial Sequence
  chemically synthesized
tgggtatggtggagcaacaa

SEQ ID NO: 276982 - DNA, 20 bp, Artificial Sequence
  chemically synthesized
gtgggtatggtggagcaaca

SEQ ID NO: 276983 - DNA, 20 bp, Artificial Sequence
  chemically synthesized
tagtataagtgggtatggtg

SEQ ID NO: 276984 - DNA, 20 bp, Artificial Sequence
  chemically synthesized
tttagtataagtgggtatgg

SEQ ID NO: 276985 - DNA, 20 bp, Artificial Sequence
  chemically synthesized
agttttagtataagtgggta

SEQ ID NO: 276986 - DNA, 20 bp, Artificial Sequence
  chemically synthesized
cagagagttttagtataagt

SEQ ID NO: 276987 - DNA, 20 bp, Artificial Sequence
  chemically synthesized
tcagagagttttagtataag

SEQ ID NO: 276988 - DNA, 20 bp, Artificial Sequence
  chemically synthesized
ccttcagagagttttagtat

SEQ ID NO: 276989 - DNA, 20 bp, Artificial Sequence
  chemically synthesized
ctaaaaccttcagagagttt

SEQ ID NO: 276990 - DNA, 20 bp, Artificial Sequence
  chemically synthesized
acttatactaaaactctctg

SEQ ID NO: 276991 - DNA, 20 bp, Artificial Sequence
  chemically synthesized
cttatactaaaactctctga

SEQ ID NO: 276992 - DNA, 20 bp, Artificial Sequence
  chemically synthesized
ttctttctaaaaccttcaga

SEQ ID NO: 276993 - DNA, 20 bp, Artificial Sequence
  chemically synthesized
gattctttctaaaaccttca

SEQ ID NO: 276994 - DNA, 20 bp, Artificial Sequence
  chemically synthesized
ctaaaactctctgaaggttt

SEQ ID NO: 276995 - DNA, 20 bp, Artificial Sequence
  chemically synthesized
ccgattctttctaaaacctt

SEQ ID NO: 276996 - DNA, 20 bp, Artificial Sequence
  chemically synthesized
aactctctgaaggttttaga

SEQ ID NO: 276997 - DNA, 20 bp, Artificial Sequence
  chemically synthesized
ctgaaggttttagaaagaat

SEQ ID NO: 276998 - DNA, 20 bp, Artificial Sequence
  chemically synthesized
cctctgggccatgaattcag

SEQ ID NO: 276999 - DNA, 20 bp, Artificial Sequence
  chemically synthesized
gaatcggtcttctgaattca

SEQ ID NO: 277000 - DNA, 20 bp, Artificial Sequence
  chemically synthesized
ctccctctgggccatgaatt

SEQ ID NO: 277001 - DNA, 20 bp, Artificial Sequence
  chemically synthesized
ggtcttctgaattcatggcc

SEQ ID NO: 277002 - DNA, 20 bp, Artificial Sequence
  chemically synthesized
tcttctgaattcatggccca

SEQ ID NO: 277003 - DNA, 20 bp, Artificial Sequence
  chemically synthesized
cttctgaattcatggcccag

SEQ ID NO: 277004 - DNA, 20 bp, Artificial Sequence
  chemically synthesized
ttctgaattcatggcccaga

SEQ ID NO: 277005 - DNA, 20 bp, Artificial Sequence
  chemically synthesized
ctgaattcatggcccagagg

SEQ ID NO: 277006 - DNA, 20 bp, Artificial Sequence
  chemically synthesized
gaattcatggcccagaggga

SEQ ID NO: 277007 - DNA, 20 bp, Artificial Sequence
  chemically synthesized
gccatccctactctccctct

SEQ ID NO: 277008 - DNA, 20 bp, Artificial Sequence
  chemically synthesized
agccatccctactctccctc

SEQ ID NO: 277009 - DNA, 20 bp, Artificial Sequence
  chemically synthesized
ttcatggcccagagggagag

SEQ ID NO: 277010 - DNA, 20 bp, Artificial Sequence
  chemically synthesized
tcatggcccagagggagagt

SEQ ID NO: 277011 - DNA, 20 bp, Artificial Sequence
  chemically synthesized
catggcccagagggagagta

SEQ ID NO: 277012 - DNA, 20 bp, Artificial Sequence
  chemically synthesized
gcccagagggagagtaggga

SEQ ID NO: 277013 - DNA, 20 bp, Artificial Sequence
  chemically synthesized
ccttacggaataaacagagg

SEQ ID NO: 277014 - DNA, 20 bp, Artificial Sequence
  chemically synthesized
ccccttacggaataaacaga

SEQ ID NO: 277015 - DNA, 20 bp, Artificial Sequence
  chemically synthesized
cccccttacggaataaacag

SEQ ID NO: 277016 - DNA, 20 bp, Artificial Sequence
  chemically synthesized
tcccccttacggaataaaca

SEQ ID NO: 277017 - DNA, 20 bp, Artificial Sequence
  chemically synthesized
tttcccccttacggaataaa

SEQ ID NO: 277018 - DNA, 20 bp, Artificial Sequence
  chemically synthesized
gctccctctgtttattccgt

SEQ ID NO: 277019 - DNA, 20 bp, Artificial Sequence
  chemically synthesized
ctccctctgtttattccgta

SEQ ID NO: 277020 - DNA, 20 bp, Artificial Sequence
  chemically synthesized
tccctctgtttattccgtaa

SEQ ID NO: 277021 - DNA, 20 bp, Artificial Sequence
  chemically synthesized
ccctctgtttattccgtaag

SEQ ID NO: 277022 - DNA, 20 bp, Artificial Sequence
  chemically synthesized
cctctgtttattccgtaagg

SEQ ID NO: 277023 - DNA, 20 bp, Artificial Sequence
  chemically synthesized
ccatcttcttttccccctta

SEQ ID NO: 277024 - DNA, 20 bp, Artificial Sequence
  chemically synthesized
gtttattccgtaagggggaa

SEQ ID NO: 277025 - DNA, 20 bp, Artificial Sequence
  chemically synthesized
tattccgtaagggggaaaag

SEQ ID NO: 277026 - DNA, 20 bp, Artificial Sequence
  chemically synthesized
ccgtaagggggaaaagaaga

SEQ ID NO: 277027 - DNA, 20 bp, Artificial Sequence
  chemically synthesized
tgcatgggacaaaaaggttg

SEQ ID NO: 277028 - DNA, 20 bp, Artificial Sequence
  chemically synthesized
cttacttgcatgggacaaaa

SEQ ID NO: 277029 - DNA, 20 bp, Artificial Sequence
  chemically synthesized
acttacttgcatgggacaaa

SEQ ID NO: 277030 - DNA, 20 bp, Artificial Sequence
  chemically synthesized
tcaacctttttgtcccatgc

SEQ ID NO: 277031 - DNA, 20 bp, Artificial Sequence
  chemically synthesized
ggagctccacttacttgcat

SEQ ID NO: 277032 - DNA, 20 bp, Artificial Sequence
  chemically synthesized
cctttttgtcccatgcaagt

SEQ ID NO: 277033 - DNA, 20 bp, Artificial Sequence
  chemically synthesized
tggagctccacttacttgca

SEQ ID NO: 277034 - DNA, 20 bp, Artificial Sequence
  chemically synthesized
ttttgtcccatgcaagtaag

SEQ ID NO: 277035 - DNA, 20 bp, Artificial Sequence
  chemically synthesized
ttgtcccatgcaagtaagtg

SEQ ID NO: 277036 - DNA, 20 bp, Artificial Sequence
  chemically synthesized
atgcaagtaagtggagctcc

SEQ ID NO: 277037 - DNA, 20 bp, Artificial Sequence
  chemically synthesized
ccctgtgatcagtggtcttg

SEQ ID NO: 277038 - DNA, 20 bp, Artificial Sequence
  chemically synthesized
gaccctgtgatcagtggtct

SEQ ID NO: 277039 - DNA, 20 bp, Artificial Sequence
  chemically synthesized
agctccaagaccactgatca

SEQ ID NO: 277040 - DNA, 20 bp, Artificial Sequence
  chemically synthesized
ctcccagaccctgtgatcag

SEQ ID NO: 277041 - DNA, 20 bp, Artificial Sequence
  chemically synthesized
gctccaagaccactgatcac

SEQ ID NO: 277042 - DNA, 20 bp, Artificial Sequence
  chemically synthesized
ctccaagaccactgatcaca

SEQ ID NO: 277043 - DNA, 20 bp, Artificial Sequence
  chemically synthesized
ggactcccagaccctgtgat

SEQ ID NO: 277044 - DNA, 20 bp, Artificial Sequence
  chemically synthesized
agaccactgatcacagggtc

SEQ ID NO: 277045 - DNA, 20 bp, Artificial Sequence
  chemically synthesized
gaccactgatcacagggtct

SEQ ID NO: 277046 - DNA, 20 bp, Artificial Sequence
  chemically synthesized
ccactgatcacagggtctgg

SEQ ID NO: 277047 - DNA, 20 bp, Artificial Sequence
  chemically synthesized
gatcacagggtctgggagtc

SEQ ID NO: 277048 - DNA, 20 bp, Artificial Sequence
  chemically synthesized
ccctatctactctggactcc

SEQ ID NO: 277049 - DNA, 20 bp, Artificial Sequence
  chemically synthesized
tcacagggtctgggagtcca

SEQ ID NO: 277050 - DNA, 20 bp, Artificial Sequence
  chemically synthesized
cagggtctgggagtccagag

SEQ ID NO: 277051 - DNA, 20 bp, Artificial Sequence
  chemically synthesized
gtctgggagtccagagtaga

SEQ ID NO: 277052 - DNA, 20 bp, Artificial Sequence
  chemically synthesized
ggtgtcatccctatctactc

SEQ ID NO: 277053 - DNA, 20 bp, Artificial Sequence
  chemically synthesized
tctgggagtccagagtagat

SEQ ID NO: 277054 - DNA, 20 bp, Artificial Sequence
  chemically synthesized
ctgggagtccagagtagata

SEQ ID NO: 277055 - DNA, 20 bp, Artificial Sequence
  chemically synthesized
cagaagcagagttggtaatt

SEQ ID NO: 277056 - DNA, 20 bp, Artificial Sequence
  chemically synthesized
tcagaagcagagttggtaat

SEQ ID NO: 277057 - DNA, 20 bp, Artificial Sequence
  chemically synthesized
gacatcttcagaagcagagt

SEQ ID NO: 277058 - DNA, 20 bp, Artificial Sequence
  chemically synthesized
agcagacatcttcagaagca

SEQ ID NO: 277059 - DNA, 20 bp, Artificial Sequence
  chemically synthesized
aattaccaactctgcttctg

SEQ ID NO: 277060 - DNA, 20 bp, Artificial Sequence
  chemically synthesized
gaagcagacatcttcagaag

SEQ ID NO: 277061 - DNA, 20 bp, Artificial Sequence
  chemically synthesized
tctgaagcagacatcttcag

SEQ ID NO: 277062 - DNA, 20 bp, Artificial Sequence
  chemically synthesized
atttctgaagcagacatctt

SEQ ID NO: 277063 - DNA, 20 bp, Artificial Sequence
  chemically synthesized
gcttctgaagatgtctgctt

SEQ ID NO: 277064 - DNA, 20 bp, Artificial Sequence
  chemically synthesized
taggcatataatttctgaag

SEQ ID NO: 277065 - DNA, 20 bp, Artificial Sequence
  chemically synthesized
aagtaggcatataatttctg

SEQ ID NO: 277066 - DNA, 20 bp, Artificial Sequence
  chemically synthesized
gaaattatatgcctacttga

SEQ ID NO: 277067 - DNA, 20 bp, Artificial Sequence
  chemically synthesized
aaattatatgcctacttgat

SEQ ID NO: 277068 - DNA, 20 bp, Artificial Sequence
  chemically synthesized
tcattttttacctatcaagt

SEQ ID NO: 277069 - DNA, 20 bp, Artificial Sequence
  chemically synthesized
ttcattttttacctatcaag

SEQ ID NO: 277070 - DNA, 20 bp, Artificial Sequence
  chemically synthesized
tcattcattttttacctatc

SEQ ID NO: 277071 - DNA, 20 bp, Artificial Sequence
  chemically synthesized
ttgataggtaaaaaatgaat

SEQ ID NO: 277072 - DNA, 20 bp, Artificial Sequence
  chemically synthesized
aaaatgaatgagaaatgata

SEQ ID NO: 277073 - DNA, 20 bp, Artificial Sequence
  chemically synthesized
gaatgagaaatgatacagtg

SEQ ID NO: 277074 - DNA, 20 bp, Artificial Sequence
  chemically synthesized
tgagaaatgatacagtgaag

SEQ ID NO: 277075 - DNA, 20 bp, Artificial Sequence
  chemically synthesized
gagaaatgatacagtgaaga

SEQ ID NO: 277076 - DNA, 20 bp, Artificial Sequence
  chemically synthesized
agaaatgatacagtgaagaa

SEQ ID NO: 277077 - DNA, 20 bp, Artificial Sequence
  chemically synthesized
gaaatgatacagtgaagaag

SEQ ID NO: 277078 - DNA, 20 bp, Artificial Sequence
  chemically synthesized
aaatgatacagtgaagaagg

SEQ ID NO: 277079 - DNA, 20 bp, Artificial Sequence
  chemically synthesized
aatgatacagtgaagaaggg

SEQ ID NO: 277080 - DNA, 20 bp, Artificial Sequence
  chemically synthesized
gatacagtgaagaagggggg

SEQ ID NO: 277081 - DNA, 20 bp, Artificial Sequence
  chemically synthesized
caccaagcactggggagtac

SEQ ID NO: 277082 - DNA, 20 bp, Artificial Sequence
  chemically synthesized
ggggggcagcctgtactccc

SEQ ID NO: 277083 - DNA, 20 bp, Artificial Sequence
  chemically synthesized
acaccaagcactggggagta

SEQ ID NO: 277084 - DNA, 20 bp, Artificial Sequence
  chemically synthesized
ttgccacaccaagcactggg

SEQ ID NO: 277085 - DNA, 20 bp, Artificial Sequence
  chemically synthesized
agcctgtactccccagtgct

SEQ ID NO: 277086 - DNA, 20 bp, Artificial Sequence
  chemically synthesized
gtttgccacaccaagcactg

SEQ ID NO: 277087 - DNA, 20 bp, Artificial Sequence
  chemically synthesized
cgtttgccacaccaagcact

SEQ ID NO: 277088 - DNA, 20 bp, Artificial Sequence
  chemically synthesized
acgtttgccacaccaagcac

SEQ ID NO: 277089 - DNA, 20 bp, Artificial Sequence
  chemically synthesized
gtactccccagtgcttggtg

SEQ ID NO: 277090 - DNA, 20 bp, Artificial Sequence
  chemically synthesized
tgagaaacgtttgccacacc

SEQ ID NO: 277091 - DNA, 20 bp, Artificial Sequence
  chemically synthesized
gtgtggcaaacgtttctcaa

SEQ ID NO: 277092 - DNA, 20 bp, Artificial Sequence
  chemically synthesized
tgtggcaaacgtttctcaat

SEQ ID NO: 277093 - DNA, 20 bp, Artificial Sequence
  chemically synthesized
ccacgttcacttgacctatt

SEQ ID NO: 277094 - DNA, 20 bp, Artificial Sequence
  chemically synthesized
caaacgtttctcaataggtc

SEQ ID NO: 277095 - DNA, 20 bp, Artificial Sequence
  chemically synthesized
ctcaataggtcaagtgaacg

SEQ ID NO: 277096 - DNA, 20 bp, Artificial Sequence
  chemically synthesized
aataggtcaagtgaacgtgg

SEQ ID NO: 277097 - DNA, 20 bp, Artificial Sequence
  chemically synthesized
aggtcaagtgaacgtggaag

SEQ ID NO: 277098 - DNA, 20 bp, Artificial Sequence
  chemically synthesized
caagtgaacgtggaagaaga

SEQ ID NO: 277099 - DNA, 20 bp, Artificial Sequence
  chemically synthesized
ggaagaagacagccatgttt

SEQ ID NO: 277100 - DNA, 20 bp, Artificial Sequence
  chemically synthesized
cctggtagatagctcaaaca

SEQ ID NO: 277101 - DNA, 20 bp, Artificial Sequence
  chemically synthesized
gccatgtttgagctatctac

SEQ ID NO: 277102 - DNA, 20 bp, Artificial Sequence
  chemically synthesized
ccatgtttgagctatctacc

SEQ ID NO: 277103 - DNA, 20 bp, Artificial Sequence
  chemically synthesized
taaagagtgttcctggtaga

SEQ ID NO: 277104 - DNA, 20 bp, Artificial Sequence
  chemically synthesized
tccataaagagtgttcctgg

SEQ ID NO: 277105 - DNA, 20 bp, Artificial Sequence
  chemically synthesized
tgctccataaagagtgttcc

SEQ ID NO: 277106 - DNA, 20 bp, Artificial Sequence
  chemically synthesized
tctaccaggaacactcttta

SEQ ID NO: 277107 - DNA, 20 bp, Artificial Sequence
  chemically synthesized
taccaggaacactctttatg

SEQ ID NO: 277108 - DNA, 20 bp, Artificial Sequence
  chemically synthesized
aggtactcttgctccataaa

SEQ ID NO: 277109 - DNA, 20 bp, Artificial Sequence
  chemically synthesized
tgaggtactcttgctccata

SEQ ID NO: 277110 - DNA, 20 bp, Artificial Sequence
  chemically synthesized
aggaacactctttatggagc

SEQ ID NO: 277111 - DNA, 20 bp, Artificial Sequence
  chemically synthesized
gaacactctttatggagcaa

SEQ ID NO: 277112 - DNA, 20 bp, Artificial Sequence
  chemically synthesized
tttatggagcaagagtacct

SEQ ID NO: 277113 - DNA, 20 bp, Artificial Sequence
  chemically synthesized
ttatggagcaagagtacctc

SEQ ID NO: 277114 - DNA, 20 bp, Artificial Sequence
  chemically synthesized
agcaagagtacctcaggatc

SEQ ID NO: 277115 - DNA, 20 bp, Artificial Sequence
  chemically synthesized
cttcaagcctcttgatcctg

SEQ ID NO: 277116 - DNA, 20 bp, Artificial Sequence
  chemically synthesized
tcttcaagcctcttgatcct

SEQ ID NO: 277117 - DNA, 20 bp, Artificial Sequence
  chemically synthesized
caagagtacctcaggatcaa

SEQ ID NO: 277118 - DNA, 20 bp, Artificial Sequence
  chemically synthesized
aagagtacctcaggatcaag

SEQ ID NO: 277119 - DNA, 20 bp, Artificial Sequence
  chemically synthesized
cctcaggatcaagaggcttg

SEQ ID NO: 277120 - DNA, 20 bp, Artificial Sequence
  chemically synthesized
tgctctataaaaacatcttc

SEQ ID NO: 277121 - DNA, 20 bp, Artificial Sequence
  chemically synthesized
gaggcttgaagatgttttta

SEQ ID NO: 277122 - DNA, 20 bp, Artificial Sequence
  chemically synthesized
ggcttgaagatgtttttata

SEQ ID NO: 277123 - DNA, 20 bp, Artificial Sequence
  chemically synthesized
agagcatattttccttctta

SEQ ID NO: 277124 - DNA, 20 bp, Artificial Sequence
  chemically synthesized
tgttttccccatctttaaga

SEQ ID NO: 277125 - DNA, 20 bp, Artificial Sequence
  chemically synthesized
ttgttttccccatctttaag

SEQ ID NO: 277126 - DNA, 20 bp, Artificial Sequence
  chemically synthesized
catattttccttcttaaaga

SEQ ID NO: 277127 - DNA, 20 bp, Artificial Sequence
  chemically synthesized
atattttccttcttaaagat

SEQ ID NO: 277128 - DNA, 20 bp, Artificial Sequence
  chemically synthesized
tattttccttcttaaagatg

SEQ ID NO: 277129 - DNA, 20 bp, Artificial Sequence
  chemically synthesized
cttttgttttccccatcttt

SEQ ID NO: 277130 - DNA, 20 bp, Artificial Sequence
  chemically synthesized
cttaaagatggggaaaacaa

SEQ ID NO: 277131 - DNA, 20 bp, Artificial Sequence
  chemically synthesized
taaagatggggaaaacaaaa

SEQ ID NO: 277132 - DNA, 20 bp, Artificial Sequence
  chemically synthesized
gaaaacaaaagagcttctgc

SEQ ID NO: 277133 - DNA, 20 bp, Artificial Sequence
  chemically synthesized
atctttaagaagtcttgcag

SEQ ID NO: 277134 - DNA, 20 bp, Artificial Sequence
  chemically synthesized
gggatctttaagaagtcttg

SEQ ID NO: 277135 - DNA, 20 bp, Artificial Sequence
  chemically synthesized
agcttctgcaagacttctta

SEQ ID NO: 277136 - DNA, 20 bp, Artificial Sequence
  chemically synthesized
acaagtatgggatctttaag

SEQ ID NO: 277137 - DNA, 20 bp, Artificial Sequence
  chemically synthesized
ggtacaagtatgggatcttt

SEQ ID NO: 277138 - DNA, 20 bp, Artificial Sequence
  chemically synthesized
tttatttggggtacaagtat

SEQ ID NO: 277139 - DNA, 20 bp, Artificial Sequence
  chemically synthesized
gtttatttggggtacaagta

SEQ ID NO: 277140 - DNA, 20 bp, Artificial Sequence
  chemically synthesized
ttcgggtttatttggggtac

SEQ ID NO: 277141 - DNA, 20 bp, Artificial Sequence
  chemically synthesized
acaaagttcgggtttatttg

SEQ ID NO: 277142 - DNA, 20 bp, Artificial Sequence
  chemically synthesized
tacaaagttcgggtttattt

SEQ ID NO: 277143 - DNA, 20 bp, Artificial Sequence
  chemically synthesized
atacaaagttcgggtttatt

SEQ ID NO: 277144 - DNA, 20 bp, Artificial Sequence
  chemically synthesized
gtaacagagatacaaagttc

SEQ ID NO: 277145 - DNA, 20 bp, Artificial Sequence
  chemically synthesized
tgtaacagagatacaaagtt

SEQ ID NO: 277146 - DNA, 20 bp, Artificial Sequence
  chemically synthesized
gtgtgtgtaacagagataca

SEQ ID NO: 277147 - DNA, 20 bp, Artificial Sequence
  chemically synthesized
gtgtgtgtgtgtgtgtaaca

SEQ ID NO: 277148 - DNA, 20 bp, Artificial Sequence
  chemically synthesized
gtgtgtgtgtgtgtgtgtaa

SEQ ID NO: 277149 - DNA, 20 bp, Artificial Sequence
  chemically synthesized
acacacaaatcataaactca

SEQ ID NO: 277150 - DNA, 20 bp, Artificial Sequence
  chemically synthesized
aactagctatttgtagcttt

SEQ ID NO: 277151 - DNA, 20 bp, Artificial Sequence
  chemically synthesized
cataaactcaaagctacaaa

SEQ ID NO: 277152 - DNA, 20 bp, Artificial Sequence
  chemically synthesized
tcctgttaactagctatttg

SEQ ID NO: 277153 - DNA, 20 bp, Artificial Sequence
  chemically synthesized
aactcaaagctacaaatagc

SEQ ID NO: 277154 - DNA, 20 bp, Artificial Sequence
  chemically synthesized
agctacaaatagctagttaa

SEQ ID NO: 277155 - DNA, 20 bp, Artificial Sequence
  chemically synthesized
gctacaaatagctagttaac

SEQ ID NO: 277156 - DNA, 20 bp, Artificial Sequence
  chemically synthesized
ggcaaatgtctcctgttaac

SEQ ID NO: 277157 - DNA, 20 bp, Artificial Sequence
  chemically synthesized
tacaaatagctagttaacag

SEQ ID NO: 277158 - DNA, 20 bp, Artificial Sequence
  chemically synthesized
aagtaggagttaaggaaaat

SEQ ID NO: 277159 - DNA, 20 bp, Artificial Sequence
  chemically synthesized
gaagtaggagttaaggaaaa

SEQ ID NO: 277160 - DNA, 20 bp, Artificial Sequence
  chemically synthesized
gtcttgggaagtaggagtta

SEQ ID NO: 277161 - DNA, 20 bp, Artificial Sequence
  chemically synthesized
tgtcttgggaagtaggagtt

SEQ ID NO: 277162 - DNA, 20 bp, Artificial Sequence
  chemically synthesized
tccaatgtcttgggaagtag

SEQ ID NO: 277163 - DNA, 20 bp, Artificial Sequence
  chemically synthesized
ttccttaactcctacttccc

SEQ ID NO: 277164 - DNA, 20 bp, Artificial Sequence
  chemically synthesized
tctccaatgtcttgggaagt

SEQ ID NO: 277165 - DNA, 20 bp, Artificial Sequence
  chemically synthesized
ttctccaatgtcttgggaag

SEQ ID NO: 277166 - DNA, 20 bp, Artificial Sequence
  chemically synthesized
ttattctccaatgtcttggg

SEQ ID NO: 277167 - DNA, 20 bp, Artificial Sequence
  chemically synthesized
actcctacttcccaagacat

SEQ ID NO: 277168 - DNA, 20 bp, Artificial Sequence
  chemically synthesized
atattattctccaatgtctt

SEQ ID NO: 277169 - DNA, 20 bp, Artificial Sequence
  chemically synthesized
tatattattctccaatgtct

SEQ ID NO: 277170 - DNA, 20 bp, Artificial Sequence
  chemically synthesized
tcctacttcccaagacattg

SEQ ID NO: 277171 - DNA, 20 bp, Artificial Sequence
  chemically synthesized
attggagaataatataactg

SEQ ID NO: 277172 - DNA, 20 bp, Artificial Sequence
  chemically synthesized
agaataatataactgaagtg

SEQ ID NO: 277173 - DNA, 20 bp, Artificial Sequence
  chemically synthesized
ttttttttttaactgcactt

SEQ ID NO: 277174 - DNA, 20 bp, Artificial Sequence
  chemically synthesized
gtgcagttaaaaaaaaaaaa

SEQ ID NO: 277175 - DNA, 20 bp, Artificial Sequence
  chemically synthesized
ttaaaaaaaaaaaaaagaaa

SEQ ID NO: 277176 - DNA, 20 bp, Artificial Sequence
  chemically synthesized
aaaaaaaaaaaaaagaaaaa

SEQ ID NO: 277177 - DNA, 20 bp, Artificial Sequence
  chemically synthesized
aaaaaaaaaaaaagaaaaag

SEQ ID NO: 277178 - DNA, 20 bp, Artificial Sequence
  chemically synthesized
aaaaaaaaaagaaaaagagg

SEQ ID NO: 277179 - DNA, 20 bp, Artificial Sequence
  chemically synthesized
aaaaaaagaaaaagaggcag

SEQ ID NO: 277180 - DNA, 20 bp, Artificial Sequence
  chemically synthesized
aaaaagaaaaagaggcagtg

SEQ ID NO: 277181 - DNA, 20 bp, Artificial Sequence
  chemically synthesized
aaaagaaaaagaggcagtgg

SEQ ID NO: 277182 - DNA, 20 bp, Artificial Sequence
  chemically synthesized
aaaagaggcagtggaggtgt

SEQ ID NO: 277183 - DNA, 20 bp, Artificial Sequence
  chemically synthesized
gaggcagtggaggtgtaaga

SEQ ID NO: 277184 - DNA, 20 bp, Artificial Sequence
  chemically synthesized
ctctggaaggcaagtgtggt

SEQ ID NO: 277185 - DNA, 20 bp, Artificial Sequence
  chemically synthesized
ctttctctggaaggcaagtg

SEQ ID NO: 277186 - DNA, 20 bp, Artificial Sequence
  chemically synthesized
atctaaccacacttgccttc

SEQ ID NO: 277187 - DNA, 20 bp, Artificial Sequence
  chemically synthesized
aaagactttctctggaaggc

SEQ ID NO: 277188 - DNA, 20 bp, Artificial Sequence
  chemically synthesized
ctaaccacacttgccttcca

SEQ ID NO: 277189 - DNA, 20 bp, Artificial Sequence
  chemically synthesized
tctaaaagactttctctgga

SEQ ID NO: 277190 - DNA, 20 bp, Artificial Sequence
  chemically synthesized
ccacacttgccttccagaga

SEQ ID NO: 277191 - DNA, 20 bp, Artificial Sequence
  chemically synthesized
gtctaaaagactttctctgg

SEQ ID NO: 277192 - DNA, 20 bp, Artificial Sequence
  chemically synthesized
atggtctaaaagactttctc

SEQ ID NO: 277193 - DNA, 20 bp, Artificial Sequence
  chemically synthesized
gccttccagagaaagtcttt

SEQ ID NO: 277194 - DNA, 20 bp, Artificial Sequence
  chemically synthesized
aagcttaagccatggtctaa

SEQ ID NO: 277195 - DNA, 20 bp, Artificial Sequence
  chemically synthesized
agagaaagtcttttagacca

SEQ ID NO: 277196 - DNA, 20 bp, Artificial Sequence
  chemically synthesized
agtcttttagaccatggctt

SEQ ID NO: 277197 - DNA, 20 bp, Artificial Sequence
  chemically synthesized
tccagctcaagcttaagcca

SEQ ID NO: 277198 - DNA, 20 bp, Artificial Sequence
  chemically synthesized
ttagaccatggcttaagctt

SEQ ID NO: 277199 - DNA, 20 bp, Artificial Sequence
  chemically synthesized
cttgtttccagctcaagctt

SEQ ID NO: 277200 - DNA, 20 bp, Artificial Sequence
  chemically synthesized
accatggcttaagcttgagc

SEQ ID NO: 277201 - DNA, 20 bp, Artificial Sequence
  chemically synthesized
tgcttccttgtttccagctc

SEQ ID NO: 277202 - DNA, 20 bp, Artificial Sequence
  chemically synthesized
cttaagcttgagctggaaac

SEQ ID NO: 277203 - DNA, 20 bp, Artificial Sequence
  chemically synthesized
ttaagcttgagctggaaaca

SEQ ID NO: 277204 - DNA, 20 bp, Artificial Sequence
  chemically synthesized
ttaatatgcttccttgtttc

SEQ ID NO: 277205 - DNA, 20 bp, Artificial Sequence
  chemically synthesized
agcttgagctggaaacaagg

SEQ ID NO: 277206 - DNA, 20 bp, Artificial Sequence
  chemically synthesized
attaaattaaatatgacatt

SEQ ID NO: 277207 - DNA, 20 bp, Artificial Sequence
  chemically synthesized
aaatatgacattgagatttt

SEQ ID NO: 277208 - DNA, 20 bp, Artificial Sequence
  chemically synthesized
gacttaaatctaattgggtt

SEQ ID NO: 277209 - DNA, 20 bp, Artificial Sequence
  chemically synthesized
gattttaagctgaacccaat

SEQ ID NO: 277210 - DNA, 20 bp, Artificial Sequence
  chemically synthesized
ataaagacttaaatctaatt

SEQ ID NO: 277211 - DNA, 20 bp, Artificial Sequence
  chemically synthesized
aataaagacttaaatctaat

SEQ ID NO: 277212 - DNA, 20 bp, Artificial Sequence
  chemically synthesized
agctgaacccaattagattt

SEQ ID NO: 277213 - DNA, 20 bp, Artificial Sequence
  chemically synthesized
ttctggcctctgaggtaata

SEQ ID NO: 277214 - DNA, 20 bp, Artificial Sequence
  chemically synthesized
gatttaagtctttattacct

SEQ ID NO: 277215 - DNA, 20 bp, Artificial Sequence
  chemically synthesized
tttaagtctttattacctca

SEQ ID NO: 277216 - DNA, 20 bp, Artificial Sequence
  chemically synthesized
ttaagtctttattacctcag

SEQ ID NO: 277217 - DNA, 20 bp, Artificial Sequence
  chemically synthesized
gtctttattacctcagaggc

SEQ ID NO: 277218 - DNA, 20 bp, Artificial Sequence
  chemically synthesized
cctttgctttctggcctctg

SEQ ID NO: 277219 - DNA, 20 bp, Artificial Sequence
  chemically synthesized
ccctttgctttctggcctct

SEQ ID NO: 277220 - DNA, 20 bp, Artificial Sequence
  chemically synthesized
ttattacctcagaggccaga

SEQ ID NO: 277221 - DNA, 20 bp, Artificial Sequence
  chemically synthesized
acctcagaggccagaaagca

SEQ ID NO: 277222 - DNA, 20 bp, Artificial Sequence
  chemically synthesized
gaatagatccctttgctttc

SEQ ID NO: 277223 - DNA, 20 bp, Artificial Sequence
  chemically synthesized
cctcagaggccagaaagcaa

SEQ ID NO: 277224 - DNA, 20 bp, Artificial Sequence
  chemically synthesized
ctcagaggccagaaagcaaa

SEQ ID NO: 277225 - DNA, 20 bp, Artificial Sequence
  chemically synthesized
aaagcaaagggatctattca

SEQ ID NO: 277226 - DNA, 20 bp, Artificial Sequence
  chemically synthesized
caggtagatggcgccatgaa

SEQ ID NO: 277227 - DNA, 20 bp, Artificial Sequence
  chemically synthesized
tattcatggcgccatctacc

SEQ ID NO: 277228 - DNA, 20 bp, Artificial Sequence
  chemically synthesized
ttttacatcatccaggtaga

SEQ ID NO: 277229 - DNA, 20 bp, Artificial Sequence
  chemically synthesized
atgcttttacatcatccagg

SEQ ID NO: 277230 - DNA, 20 bp, Artificial Sequence
  chemically synthesized
gaaatgcttttacatcatcc

SEQ ID NO: 277231 - DNA, 20 bp, Artificial Sequence
  chemically synthesized
tgaaatgcttttacatcatc

SEQ ID NO: 277232 - DNA, 20 bp, Artificial Sequence
  chemically synthesized
catctacctggatgatgtaa

SEQ ID NO: 277233 - DNA, 20 bp, Artificial Sequence
  chemically synthesized
tttcatgtttctgatctatc

SEQ ID NO: 277234 - DNA, 20 bp, Artificial Sequence
  chemically synthesized
gtagtttcagccagatagat

SEQ ID NO: 277235 - DNA, 20 bp, Artificial Sequence
  chemically synthesized
gatgcgtagtttcagccaga

SEQ ID NO: 277236 - DNA, 20 bp, Artificial Sequence
  chemically synthesized
gtttgatgcgtagtttcagc

SEQ ID NO: 277237 - DNA, 20 bp, Artificial Sequence
  chemically synthesized
agtagtttgatgcgtagttt

SEQ ID NO: 277238 - DNA, 20 bp, Artificial Sequence
  chemically synthesized
tgtgttagtagtttgatgcg

SEQ ID NO: 277239 - DNA, 20 bp, Artificial Sequence
  chemically synthesized
tacgcatcaaactactaaca

SEQ ID NO: 277240 - DNA, 20 bp, Artificial Sequence
  chemically synthesized
gaattcgtggactgtgttag

SEQ ID NO: 277241 - DNA, 20 bp, Artificial Sequence
  chemically synthesized
gctgaattcgtggactgtgt

SEQ ID NO: 277242 - DNA, 20 bp, Artificial Sequence
  chemically synthesized
actaacacagtccacgaatt

SEQ ID NO: 277243 - DNA, 20 bp, Artificial Sequence
  chemically synthesized
ttgagtaagtgctgaattcg

SEQ ID NO: 277244 - DNA, 20 bp, Artificial Sequence
  chemically synthesized
tgcctttgctttatttgagt

SEQ ID NO: 277245 - DNA, 20 bp, Artificial Sequence
  chemically synthesized
attcagcacttactcaaata

SEQ ID NO: 277246 - DNA, 20 bp, Artificial Sequence
  chemically synthesized
cctttgcctttgctttattt

SEQ ID NO: 277247 - DNA, 20 bp, Artificial Sequence
  chemically synthesized
gcacttactcaaataaagca

SEQ ID NO: 277248 - DNA, 20 bp, Artificial Sequence
  chemically synthesized
cacttactcaaataaagcaa

SEQ ID NO: 277249 - DNA, 20 bp, Artificial Sequence
  chemically synthesized
actcaaataaagcaaaggca

SEQ ID NO: 277250 - DNA, 20 bp, Artificial Sequence
  chemically synthesized
ctcaaataaagcaaaggcaa

SEQ ID NO: 277251 - DNA, 20 bp, Artificial Sequence
  chemically synthesized
caaataaagcaaaggcaaag

SEQ ID NO: 277252 - DNA, 20 bp, Artificial Sequence
  chemically synthesized
gcaaaggcaaaggagaatga

SEQ ID NO: 277253 - DNA, 20 bp, Artificial Sequence
  chemically synthesized
aaaggagaatgatagacatc

SEQ ID NO: 277254 - DNA, 20 bp, Artificial Sequence
  chemically synthesized
tgatagacatccagatcatc

SEQ ID NO: 277255 - DNA, 20 bp, Artificial Sequence
  chemically synthesized
ggaccacattctagatgatc

SEQ ID NO: 277256 - DNA, 20 bp, Artificial Sequence
  chemically synthesized
catccagatcatctagaatg

SEQ ID NO: 277257 - DNA, 20 bp, Artificial Sequence
  chemically synthesized
tcttctgctggaccacattc

SEQ ID NO: 277258 - DNA, 20 bp, Artificial Sequence
  chemically synthesized
agatcatctagaatgtggtc

SEQ ID NO: 277259 - DNA, 20 bp, Artificial Sequence
  chemically synthesized
tcatctagaatgtggtccag

SEQ ID NO: 277260 - DNA, 20 bp, Artificial Sequence
  chemically synthesized
tctagaatgtggtccagcag

SEQ ID NO: 277261 - DNA, 20 bp, Artificial Sequence
  chemically synthesized
aaccattttctgtcttctgc

SEQ ID NO: 277262 - DNA, 20 bp, Artificial Sequence
  chemically synthesized
gaatgtggtccagcagaaga

SEQ ID NO: 277263 - DNA, 20 bp, Artificial Sequence
  chemically synthesized
gtccagcagaagacagaaaa

SEQ ID NO: 277264 - DNA, 20 bp, Artificial Sequence
  chemically synthesized
agaagacagaaaatggttta

SEQ ID NO: 277265 - DNA, 20 bp, Artificial Sequence
  chemically synthesized
gaagacagaaaatggtttac

SEQ ID NO: 277266 - DNA, 20 bp, Artificial Sequence
  chemically synthesized
agacagaaaatggtttacgg

SEQ ID NO: 277267 - DNA, 20 bp, Artificial Sequence
  chemically synthesized
gacagaaaatggtttacggg

SEQ ID NO: 277268 - DNA, 20 bp, Artificial Sequence
  chemically synthesized
aatggtttacgggaggtctg

SEQ ID NO: 277269 - DNA, 20 bp, Artificial Sequence
  chemically synthesized
tggtttacgggaggtctgaa

SEQ ID NO: 277270 - DNA, 20 bp, Artificial Sequence
  chemically synthesized
tcttaagttctttatctctt

SEQ ID NO: 277271 - DNA, 20 bp, Artificial Sequence
  chemically synthesized
acgggaggtctgaagagata

SEQ ID NO: 277272 - DNA, 20 bp, Artificial Sequence
  chemically synthesized
tctgaagagataaagaactt

SEQ ID NO: 277273 - DNA, 20 bp, Artificial Sequence
  chemically synthesized
atttttcacagatatttctt

SEQ ID NO: 277274 - DNA, 20 bp, Artificial Sequence
  chemically synthesized
taagaaatatctgtgaaaaa

SEQ ID NO: 277275 - DNA, 20 bp, Artificial Sequence
  chemically synthesized
ctataatgctccatttttca

SEQ ID NO: 277276 - DNA, 20 bp, Artificial Sequence
  chemically synthesized
agaaatatctgtgaaaaatg

SEQ ID NO: 277277 - DNA, 20 bp, Artificial Sequence
  chemically synthesized
ctgtgaaaaatggagcatta

SEQ ID NO: 277278 - DNA, 20 bp, Artificial Sequence
  chemically synthesized
tgaaaaatggagcattatag

SEQ ID NO: 277279 - DNA, 20 bp, Artificial Sequence
  chemically synthesized
agtagtatcacatgattgaa

SEQ ID NO: 277280 - DNA, 20 bp, Artificial Sequence
  chemically synthesized
tatcacatgattgaaaagct

SEQ ID NO: 277281 - DNA, 20 bp, Artificial Sequence
  chemically synthesized
acatgattgaaaagctaaga

SEQ ID NO: 277282 - DNA, 20 bp, Artificial Sequence
  chemically synthesized
aagcatcaacatatctatct

SEQ ID NO: 277283 - DNA, 20 bp, Artificial Sequence
  chemically synthesized
cttgcagttgcatgagacaa

SEQ ID NO: 277284 - DNA, 20 bp, Artificial Sequence
  chemically synthesized
catgcaacttgcagttgcat

SEQ ID NO: 277285 - DNA, 20 bp, Artificial Sequence
  chemically synthesized
cttttgtctcatgcaactgc

SEQ ID NO: 277286 - DNA, 20 bp, Artificial Sequence
  chemically synthesized
gatataaaacatgcaacttg

SEQ ID NO: 277287 - DNA, 20 bp, Artificial Sequence
  chemically synthesized
tattcatgtatgttggtaga

SEQ ID NO: 277288 - DNA, 20 bp, Artificial Sequence
  chemically synthesized
tttatattcatgtatgttgg

SEQ ID NO: 277289 - DNA, 20 bp, Artificial Sequence
  chemically synthesized
ttatttatattcatgtatgt

SEQ ID NO: 277290 - DNA, 20 bp, Artificial Sequence
  chemically synthesized
caggagcaatagttttcacg

SEQ ID NO: 277291 - DNA, 20 bp, Artificial Sequence
  chemically synthesized
gttgcatttgacaggagcaa

SEQ ID NO: 277292 - DNA, 20 bp, Artificial Sequence
  chemically synthesized
caagttgttgcatttgacag

SEQ ID NO: 277293 - DNA, 20 bp, Artificial Sequence
  chemically synthesized
ggcaagttgttgcatttgac

SEQ ID NO: 277294 - DNA, 20 bp, Artificial Sequence
  chemically synthesized
aggcaagttgttgcatttga

SEQ ID NO: 277295 - DNA, 20 bp, Artificial Sequence
  chemically synthesized
aaagttaccaatcagtaggc

SEQ ID NO: 277296 - DNA, 20 bp, Artificial Sequence
  chemically synthesized
gcaacaacttgcctactgat

SEQ ID NO: 277297 - DNA, 20 bp, Artificial Sequence
  chemically synthesized
cagcaaagttaccaatcagt

SEQ ID NO: 277298 - DNA, 20 bp, Artificial Sequence
  chemically synthesized
tcagcaaagttaccaatcag

SEQ ID NO: 277299 - DNA, 20 bp, Artificial Sequence
  chemically synthesized
tgttcagcaaagttaccaat

SEQ ID NO: 277300 - DNA, 20 bp, Artificial Sequence
  chemically synthesized
tttaaattggttgttcagca

SEQ ID NO: 277301 - DNA, 20 bp, Artificial Sequence
  chemically synthesized
aggaatttaaattggttgtt

SEQ ID NO: 277302 - DNA, 20 bp, Artificial Sequence
  chemically synthesized
tatgcttcaggaatttaaat

SEQ ID NO: 277303 - DNA, 20 bp, Artificial Sequence
  chemically synthesized
acaaccaatttaaattcctg

SEQ ID NO: 277304 - DNA, 20 bp, Artificial Sequence
  chemically synthesized
agaccttagaattatgcttc

SEQ ID NO: 277305 - DNA, 20 bp, Artificial Sequence
  chemically synthesized
aagaccttagaattatgctt

SEQ ID NO: 277306 - DNA, 20 bp, Artificial Sequence
  chemically synthesized
aattcctgaagcataattct

SEQ ID NO: 277307 - DNA, 20 bp, Artificial Sequence
  chemically synthesized
attcctgaagcataattcta

SEQ ID NO: 277308 - DNA, 20 bp, Artificial Sequence
  chemically synthesized
gcatgcttctttaaagacct

SEQ ID NO: 277309 - DNA, 20 bp, Artificial Sequence
  chemically synthesized
gcataattctaaggtcttta

SEQ ID NO: 277310 - DNA, 20 bp, Artificial Sequence
  chemically synthesized
taattctaaggtctttaaag

SEQ ID NO: 277311 - DNA, 20 bp, Artificial Sequence
  chemically synthesized
ttttatggcatgcttcttta

SEQ ID NO: 277312 - DNA, 20 bp, Artificial Sequence
  chemically synthesized
tttaaagaagcatgccataa

SEQ ID NO: 277313 - DNA, 20 bp, Artificial Sequence
  chemically synthesized
aataattcctgatactttta

SEQ ID NO: 277314 - DNA, 20 bp, Artificial Sequence
  chemically synthesized
gaagcatgccataaaagtat

SEQ ID NO: 277315 - DNA, 20 bp, Artificial Sequence
  chemically synthesized
aagcatgccataaaagtatc

SEQ ID NO: 277316 - DNA, 20 bp, Artificial Sequence
  chemically synthesized
aaaagtatcaggaattattt

SEQ ID NO: 277317 - DNA, 20 bp, Artificial Sequence
  chemically synthesized
aaagtatcaggaattattta

SEQ ID NO: 277318 - DNA, 20 bp, Artificial Sequence
  chemically synthesized
ggaattatttaaggaccact

SEQ ID NO: 277319 - DNA, 20 bp, Artificial Sequence
  chemically synthesized
gacaaatagaacattcttag

SEQ ID NO: 277320 - DNA, 20 bp, Artificial Sequence
  chemically synthesized
tgagacaaatagaacattct

SEQ ID NO: 277321 - DNA, 20 bp, Artificial Sequence
  chemically synthesized
taagaatgttctatttgtct

SEQ ID NO: 277322 - DNA, 20 bp, Artificial Sequence
  chemically synthesized
gaaccaatttctgagacaaa

SEQ ID NO: 277323 - DNA, 20 bp, Artificial Sequence
  chemically synthesized
gttctatttgtctcagaaat

SEQ ID NO: 277324 - DNA, 20 bp, Artificial Sequence
  chemically synthesized
aattgtaagaaccaatttct

SEQ ID NO: 277325 - DNA, 20 bp, Artificial Sequence
  chemically synthesized
tctaaacaactaaaaattgt

SEQ ID NO: 277326 - DNA, 20 bp, Artificial Sequence
  chemically synthesized
aaattggttcttacaatttt

SEQ ID NO: 277327 - DNA, 20 bp, Artificial Sequence
  chemically synthesized
tcttacaatttttagttgtt

SEQ ID NO: 277328 - DNA, 20 bp, Artificial Sequence
  chemically synthesized
aatttttagttgtttagaac

SEQ ID NO: 277329 - DNA, 20 bp, Artificial Sequence
  chemically synthesized
tttagttgtttagaaccggc

SEQ ID NO: 277330 - DNA, 20 bp, Artificial Sequence
  chemically synthesized
ctttaaggctgtcatcttgc

SEQ ID NO: 277331 - DNA, 20 bp, Artificial Sequence
  chemically synthesized
gtttagaaccggcaagatga

SEQ ID NO: 277332 - DNA, 20 bp, Artificial Sequence
  chemically synthesized
ccggcaagatgacagcctta

SEQ ID NO: 277333 - DNA, 20 bp, Artificial Sequence
  chemically synthesized
gcaagatgacagccttaaag

SEQ ID NO: 277334 - DNA, 20 bp, Artificial Sequence
  chemically synthesized
ctgaagtgtcaacttcttta

SEQ ID NO: 277335 - DNA, 20 bp, Artificial Sequence
  chemically synthesized
cctgaagtgtcaacttcttt

SEQ ID NO: 277336 - DNA, 20 bp, Artificial Sequence
  chemically synthesized
ccttaaagaagttgacactt

SEQ ID NO: 277337 - DNA, 20 bp, Artificial Sequence
  chemically synthesized
cttaaagaagttgacacttc

SEQ ID NO: 277338 - DNA, 20 bp, Artificial Sequence
  chemically synthesized
taaagaagttgacacttcag

SEQ ID NO: 277339 - DNA, 20 bp, Artificial Sequence
  chemically synthesized
aggatggtttcgatctcctg

SEQ ID NO: 277340 - DNA, 20 bp, Artificial Sequence
  chemically synthesized
tcaggagatcgaaaccatcc

SEQ ID NO: 277341 - DNA, 20 bp, Artificial Sequence
  chemically synthesized
tttcaccgtgtcagccagga

SEQ ID NO: 277342 - DNA, 20 bp, Artificial Sequence
  chemically synthesized
agggtttcaccgtgtcagcc

SEQ ID NO: 277343 - DNA, 20 bp, Artificial Sequence
  chemically synthesized
cgaaaccatcctggctgaca

SEQ ID NO: 277344 - DNA, 20 bp, Artificial Sequence
  chemically synthesized
cagggtttcaccgtgtcagc

SEQ ID NO: 277345 - DNA, 20 bp, Artificial Sequence
  chemically synthesized
gaaacagggtttcaccgtgt

SEQ ID NO: 277346 - DNA, 20 bp, Artificial Sequence
  chemically synthesized
ttgtatttttagtagaaaca

SEQ ID NO: 277347 - DNA, 20 bp, Artificial Sequence
  chemically synthesized
tttgtatttttagtagaaac

SEQ ID NO: 277348 - DNA, 20 bp, Artificial Sequence
  chemically synthesized
ttttgtatttttagtagaaa

SEQ ID NO: 277349 - DNA, 20 bp, Artificial Sequence
  chemically synthesized
ctaattttttgtatttttag

SEQ ID NO: 277350 - DNA, 20 bp, Artificial Sequence
  chemically synthesized
aggctaattttttgtatttt

SEQ ID NO: 277351 - DNA, 20 bp, Artificial Sequence
  chemically synthesized
ctactaaaaatacaaaaaat

SEQ ID NO: 277352 - DNA, 20 bp, Artificial Sequence
  chemically synthesized
aaaaatacaaaaaattagcc

SEQ ID NO: 277353 - DNA, 20 bp, Artificial Sequence
  chemically synthesized
tacaaaaaattagcctggca

SEQ ID NO: 277354 - DNA, 20 bp, Artificial Sequence
  chemically synthesized
aaaaaattagcctggcatgg

SEQ ID NO: 277355 - DNA, 20 bp, Artificial Sequence
  chemically synthesized
caggcgcctgccaccatgcc

SEQ ID NO: 277356 - DNA, 20 bp, Artificial Sequence
  chemically synthesized
acaggcgcctgccaccatgc

SEQ ID NO: 277357 - DNA, 20 bp, Artificial Sequence
  chemically synthesized
aaattagcctggcatggtgg

SEQ ID NO: 277358 - DNA, 20 bp, Artificial Sequence
  chemically synthesized
aattagcctggcatggtggc

SEQ ID NO: 277359 - DNA, 20 bp, Artificial Sequence
  chemically synthesized
ggcatggtggcaggcgcctg

SEQ ID NO: 277360 - DNA, 20 bp, Artificial Sequence
  chemically synthesized
gtggcaggcgcctgtagtcc

SEQ ID NO: 277361 - DNA, 20 bp, Artificial Sequence
  chemically synthesized
tcctgcgtagctgggactac

SEQ ID NO: 277362 - DNA, 20 bp, Artificial Sequence
  chemically synthesized
ctcctgcgtagctgggacta

SEQ ID NO: 277363 - DNA, 20 bp, Artificial Sequence
  chemically synthesized
cgcctgtagtcccagctacg

SEQ ID NO: 277364 - DNA, 20 bp, Artificial Sequence
  chemically synthesized
cctcagcctcctgcgtagct

SEQ ID NO: 277365 - DNA, 20 bp, Artificial Sequence
  chemically synthesized
gcctgtagtcccagctacgc

SEQ ID NO: 277366 - DNA, 20 bp, Artificial Sequence
  chemically synthesized
gcctcagcctcctgcgtagc

SEQ ID NO: 277367 - DNA, 20 bp, Artificial Sequence
  chemically synthesized
ctgtagtcccagctacgcag

SEQ ID NO: 277368 - DNA, 20 bp, Artificial Sequence
  chemically synthesized
tgtagtcccagctacgcagg

SEQ ID NO: 277369 - DNA, 20 bp, Artificial Sequence
  chemically synthesized
tcctgcctcagcctcctgcg

SEQ ID NO: 277370 - DNA, 20 bp, Artificial Sequence
  chemically synthesized
tcccagctacgcaggaggct

SEQ ID NO: 277371 - DNA, 20 bp, Artificial Sequence
  chemically synthesized
cccagctacgcaggaggctg

SEQ ID NO: 277372 - DNA, 20 bp, Artificial Sequence
  chemically synthesized
agctacgcaggaggctgagg

SEQ ID NO: 277373 - DNA, 20 bp, Artificial Sequence
  chemically synthesized
gctacgcaggaggctgaggc

SEQ ID NO: 277374 - DNA, 20 bp, Artificial Sequence
  chemically synthesized
tacgcaggaggctgaggcag

SEQ ID NO: 277375 - DNA, 20 bp, Artificial Sequence
  chemically synthesized
ttcacaccattctcctgcct

SEQ ID NO: 277376 - DNA, 20 bp, Artificial Sequence
  chemically synthesized
aggaggctgaggcaggagaa

SEQ ID NO: 277377 - DNA, 20 bp, Artificial Sequence
  chemically synthesized
gcaggagaatggtgtgaacc

SEQ ID NO: 277378 - DNA, 20 bp, Artificial Sequence
  chemically synthesized
caggagaatggtgtgaaccc

SEQ ID NO: 277379 - DNA, 20 bp, Artificial Sequence
  chemically synthesized
ggagaatggtgtgaacccgg

SEQ ID NO: 277380 - DNA, 20 bp, Artificial Sequence
  chemically synthesized
gagaatggtgtgaacccggg

SEQ ID NO: 277381 - DNA, 20 bp, Artificial Sequence
  chemically synthesized
aatggtgtgaacccgggagg

SEQ ID NO: 277382 - DNA, 20 bp, Artificial Sequence
  chemically synthesized
cactgccagctctacctccc

SEQ ID NO: 277383 - DNA, 20 bp, Artificial Sequence
  chemically synthesized
tggtgtgaacccgggaggta

SEQ ID NO: 277384 - DNA, 20 bp, Artificial Sequence
  chemically synthesized
tcactgccagctctacctcc

SEQ ID NO: 277385 - DNA, 20 bp, Artificial Sequence
  chemically synthesized
gtgaacccgggaggtagagc

SEQ ID NO: 277386 - DNA, 20 bp, Artificial Sequence
  chemically synthesized
aacccgggaggtagagctgg

SEQ ID NO: 277387 - DNA, 20 bp, Artificial Sequence
  chemically synthesized
cgggaggtagagctggcagt

SEQ ID NO: 277388 - DNA, 20 bp, Artificial Sequence
  chemically synthesized
gcacgatctcagctcactgc

SEQ ID NO: 277389 - DNA, 20 bp, Artificial Sequence
  chemically synthesized
ggtagagctggcagtgagct

SEQ ID NO: 277390 - DNA, 20 bp, Artificial Sequence
  chemically synthesized
gtagtgcaatggcacgatct

SEQ ID NO: 277391 - DNA, 20 bp, Artificial Sequence
  chemically synthesized
tcacccagactgtagtgcaa

SEQ ID NO: 277392 - DNA, 20 bp, Artificial Sequence
  chemically synthesized
gagatcgtgccattgcacta

SEQ ID NO: 277393 - DNA, 20 bp, Artificial Sequence
  chemically synthesized
cgtgccattgcactacagtc

SEQ ID NO: 277394 - DNA, 20 bp, Artificial Sequence
  chemically synthesized
gtgccattgcactacagtct

SEQ ID NO: 277395 - DNA, 20 bp, Artificial Sequence
  chemically synthesized
tcactctgtcacccagactg

SEQ ID NO: 277396 - DNA, 20 bp, Artificial Sequence
  chemically synthesized
ttgcactacagtctgggtga

SEQ ID NO: 277397 - DNA, 20 bp, Artificial Sequence
  chemically synthesized
gcactacagtctgggtgaca

SEQ ID NO: 277398 - DNA, 20 bp, Artificial Sequence
  chemically synthesized
cagagtctcactctgtcacc

SEQ ID NO: 277399 - DNA, 20 bp, Artificial Sequence
  chemically synthesized
tacagtctgggtgacagagt

SEQ ID NO: 277400 - DNA, 20 bp, Artificial Sequence
  chemically synthesized
ttttttttttttttgagaca

SEQ ID NO: 277401 - DNA, 20 bp, Artificial Sequence
  chemically synthesized
ttttttttttttttttgaga

SEQ ID NO: 277402 - DNA, 20 bp, Artificial Sequence
  chemically synthesized
tttttttttttttttttttt

SEQ ID NO: 277403 - DNA, 20 bp, Artificial Sequence
  chemically synthesized
aaaaaaaaaaaaaaaaaaaa

SEQ ID NO: 277404 - DNA, 20 bp, Artificial Sequence
  chemically synthesized
aaaaaaaaaaaaaaaaaaag

SEQ ID NO: 277405 - DNA, 20 bp, Artificial Sequence
  chemically synthesized
aaaaaagaagctgacacttg

SEQ ID NO: 277406 - DNA, 20 bp, Artificial Sequence
  chemically synthesized
acaatgtgtgcttcaagtgt

SEQ ID NO: 277407 - DNA, 20 bp, Artificial Sequence
  chemically synthesized
tacaatacaatgtgtgcttc

SEQ ID NO: 277408 - DNA, 20 bp, Artificial Sequence
  chemically synthesized
atcaatctcaaagatttttc

SEQ ID NO: 277409 - DNA, 20 bp, Artificial Sequence
  chemically synthesized
tgtacacttgaaaaatcttt

SEQ ID NO: 277410 - DNA, 20 bp, Artificial Sequence
  chemically synthesized
ttcctatctaatcaatctca

SEQ ID NO: 277411 - DNA, 20 bp, Artificial Sequence
  chemically synthesized
gaaaaatctttgagattgat

SEQ ID NO: 277412 - DNA, 20 bp, Artificial Sequence
  chemically synthesized
aatctttgagattgattaga

SEQ ID NO: 277413 - DNA, 20 bp, Artificial Sequence
  chemically synthesized
atctttgagattgattagat

SEQ ID NO: 277414 - DNA, 20 bp, Artificial Sequence
  chemically synthesized
atatgaaattatggaaaata

SEQ ID NO: 277415 - DNA, 20 bp, Artificial Sequence
  chemically synthesized
cttaacaccatatgaaatta

SEQ ID NO: 277416 - DNA, 20 bp, Artificial Sequence
  chemically synthesized
ttattttccataatttcata

SEQ ID NO: 277417 - DNA, 20 bp, Artificial Sequence
  chemically synthesized
ccataatttcatatggtgtt

SEQ ID NO: 277418 - DNA, 20 bp, Artificial Sequence
  chemically synthesized
tttcatatggtgttaagtaa

SEQ ID NO: 277419 - DNA, 20 bp, Artificial Sequence
  chemically synthesized
ttaagtaatagatcctttaa

SEQ ID NO: 277420 - DNA, 20 bp, Artificial Sequence
  chemically synthesized
aatttttgtataacttttaa

SEQ ID NO: 277421 - DNA, 20 bp, Artificial Sequence
  chemically synthesized
aaatttttgtataactttta

SEQ ID NO: 277422 - DNA, 20 bp, Artificial Sequence
  chemically synthesized
aaaagttatacaaaaatttc

SEQ ID NO: 277423 - DNA, 20 bp, Artificial Sequence
  chemically synthesized
tacaaaaatttccagatgtc

SEQ ID NO: 277424 - DNA, 20 bp, Artificial Sequence
  chemically synthesized
tataagcatatctagacatc

SEQ ID NO: 277425 - DNA, 20 bp, Artificial Sequence
  chemically synthesized
taagctggtataagcatatc

SEQ ID NO: 277426 - DNA, 20 bp, Artificial Sequence
  chemically synthesized
atgtctagatatgcttatac

SEQ ID NO: 277427 - DNA, 20 bp, Artificial Sequence
  chemically synthesized
acatttcattaagctggtat

SEQ ID NO: 277428 - DNA, 20 bp, Artificial Sequence
  chemically synthesized
tggaaaacatttcattaagc

SEQ ID NO: 277429 - DNA, 20 bp, Artificial Sequence
  chemically synthesized
tttttggaaaacatttcatt

SEQ ID NO: 277430 - DNA, 20 bp, Artificial Sequence
  chemically synthesized
ttaatgaaatgttttccaaa

SEQ ID NO: 277431 - DNA, 20 bp, Artificial Sequence
  chemically synthesized
gaaatgttttccaaaaagaa

SEQ ID NO: 277432 - DNA, 20 bp, Artificial Sequence
  chemically synthesized
aatcctaactctattctttt

SEQ ID NO: 277433 - DNA, 20 bp, Artificial Sequence
  chemically synthesized
aatgttttccaaaaagaata

SEQ ID NO: 277434 - DNA, 20 bp, Artificial Sequence
  chemically synthesized
ttttccaaaaagaatagagt

SEQ ID NO: 277435 - DNA, 20 bp, Artificial Sequence
  chemically synthesized
tttccaaaaagaatagagtt

SEQ ID NO: 277436 - DNA, 20 bp, Artificial Sequence
  chemically synthesized
aatagagttaggattttgaa

SEQ ID NO: 277437 - DNA, 20 bp, Artificial Sequence
  chemically synthesized
atagagttaggattttgaaa

SEQ ID NO: 277438 - DNA, 20 bp, Artificial Sequence
  chemically synthesized
tagagttaggattttgaaaa

SEQ ID NO: 277439 - DNA, 20 bp, Artificial Sequence
  chemically synthesized
attttgaaaagggaattaaa

SEQ ID NO: 277440 - DNA, 20 bp, Artificial Sequence
  chemically synthesized
tttgaaaagggaattaaatg

SEQ ID NO: 277441 - DNA, 20 bp, Artificial Sequence
  chemically synthesized
aagggaattaaatggagatt

SEQ ID NO: 277442 - DNA, 20 bp, Artificial Sequence
  chemically synthesized
gggaattaaatggagattaa

SEQ ID NO: 277443 - DNA, 20 bp, Artificial Sequence
  chemically synthesized
ttaaatggagattaagagaa

SEQ ID NO: 277444 - DNA, 20 bp, Artificial Sequence
  chemically synthesized
aatggagattaagagaaaag

SEQ ID NO: 277445 - DNA, 20 bp, Artificial Sequence
  chemically synthesized
tggagattaagagaaaagca

SEQ ID NO: 277446 - DNA, 20 bp, Artificial Sequence
  chemically synthesized
ggagattaagagaaaagcag

SEQ ID NO: 277447 - DNA, 20 bp, Artificial Sequence
  chemically synthesized
gagattaagagaaaagcaga

SEQ ID NO: 277448 - DNA, 20 bp, Artificial Sequence
  chemically synthesized
gattaagagaaaagcagagg

SEQ ID NO: 277449 - DNA, 20 bp, Artificial Sequence
  chemically synthesized
taagagaaaagcagagggag

SEQ ID NO: 277450 - DNA, 20 bp, Artificial Sequence
  chemically synthesized
agagaaaagcagagggagaa

SEQ ID NO: 277451 - DNA, 20 bp, Artificial Sequence
  chemically synthesized
gagaaaagcagagggagaag

SEQ ID NO: 277452 - DNA, 20 bp, Artificial Sequence
  chemically synthesized
gagaagaggataatttacaa

SEQ ID NO: 277453 - DNA, 20 bp, Artificial Sequence
  chemically synthesized
aagaggataatttacaacag

SEQ ID NO: 277454 - DNA, 20 bp, Artificial Sequence
  chemically synthesized
aaataatttaccaatgctca

SEQ ID NO: 277455 - DNA, 20 bp, Artificial Sequence
  chemically synthesized
ttgtgatgagctatgagcat

SEQ ID NO: 277456 - DNA, 20 bp, Artificial Sequence
  chemically synthesized
tgaatcttgtgatgagctat

SEQ ID NO: 277457 - DNA, 20 bp, Artificial Sequence
  chemically synthesized
caatgctcatagctcatcac

SEQ ID NO: 277458 - DNA, 20 bp, Artificial Sequence
  chemically synthesized
aacaaagtgaatcttgtgat

SEQ ID NO: 277459 - DNA, 20 bp, Artificial Sequence
  chemically synthesized
tgaaaacaaagaaagcaaca

SEQ ID NO: 277460 - DNA, 20 bp, Artificial Sequence
  chemically synthesized
aactaatttgaaaacaaaga

SEQ ID NO: 277461 - DNA, 20 bp, Artificial Sequence
  chemically synthesized
gatgaactaatttgaaaaca

SEQ ID NO: 277462 - DNA, 20 bp, Artificial Sequence
  chemically synthesized
tgctttctttgttttcaaat

SEQ ID NO: 277463 - DNA, 20 bp, Artificial Sequence
  chemically synthesized
tcctttctttaggaaaaaat

SEQ ID NO: 277464 - DNA, 20 bp, Artificial Sequence
  chemically synthesized
ctcctttctttaggaaaaaa

SEQ ID NO: 277465 - DNA, 20 bp, Artificial Sequence
  chemically synthesized
gttcatcctattttttccta

SEQ ID NO: 277466 - DNA, 20 bp, Artificial Sequence
  chemically synthesized
atcctattttttcctaaaga

SEQ ID NO: 277467 - DNA, 20 bp, Artificial Sequence
  chemically synthesized
tcctattttttcctaaagaa

SEQ ID NO: 277468 - DNA, 20 bp, Artificial Sequence
  chemically synthesized
gtgtgagacctcctttcttt

SEQ ID NO: 277469 - DNA, 20 bp, Artificial Sequence
  chemically synthesized
ctattttttcctaaagaaag

SEQ ID NO: 277470 - DNA, 20 bp, Artificial Sequence
  chemically synthesized
agtgtgagacctcctttctt

SEQ ID NO: 277471 - DNA, 20 bp, Artificial Sequence
  chemically synthesized
tattttttcctaaagaaagg

SEQ ID NO: 277472 - DNA, 20 bp, Artificial Sequence
  chemically synthesized
ttgtccaaggaacacagtgt

SEQ ID NO: 277473 - DNA, 20 bp, Artificial Sequence
  chemically synthesized
aggtctcacactgtgttcct

SEQ ID NO: 277474 - DNA, 20 bp, Artificial Sequence
  chemically synthesized
tctttcttgtccaaggaaca

SEQ ID NO: 277475 - DNA, 20 bp, Artificial Sequence
  chemically synthesized
tcacactgtgttccttggac

SEQ ID NO: 277476 - DNA, 20 bp, Artificial Sequence
  chemically synthesized
tacttagtctttcttgtcca

SEQ ID NO: 277477 - DNA, 20 bp, Artificial Sequence
  chemically synthesized
ttacttagtctttcttgtcc

SEQ ID NO: 277478 - DNA, 20 bp, Artificial Sequence
  chemically synthesized
actgtgttccttggacaaga

SEQ ID NO: 277479 - DNA, 20 bp, Artificial Sequence
  chemically synthesized
ttccttggacaagaaagact

SEQ ID NO: 277480 - DNA, 20 bp, Artificial Sequence
  chemically synthesized
caacatggttttaatttact

SEQ ID NO: 277481 - DNA, 20 bp, Artificial Sequence
  chemically synthesized
taaagtgggttaaagcaaca

SEQ ID NO: 277482 - DNA, 20 bp, Artificial Sequence
  chemically synthesized
gttatatttaaagtgggtta

SEQ ID NO: 277483 - DNA, 20 bp, Artificial Sequence
  chemically synthesized
acaagagttatatttaaagt

SEQ ID NO: 277484 - DNA, 20 bp, Artificial Sequence
  chemically synthesized
cacaagagttatatttaaag

SEQ ID NO: 277485 - DNA, 20 bp, Artificial Sequence
  chemically synthesized
cctcacaagagttatattta

SEQ ID NO: 277486 - DNA, 20 bp, Artificial Sequence
  chemically synthesized
actttaaatataactcttgt

SEQ ID NO: 277487 - DNA, 20 bp, Artificial Sequence
  chemically synthesized
ctttaaatataactcttgtg

SEQ ID NO: 277488 - DNA, 20 bp, Artificial Sequence
  chemically synthesized
tttaaatataactcttgtga

SEQ ID NO: 277489 - DNA, 20 bp, Artificial Sequence
  chemically synthesized
ttaaatataactcttgtgag

SEQ ID NO: 277490 - DNA, 20 bp, Artificial Sequence
  chemically synthesized
tgtaccaaagcccctcacaa

SEQ ID NO: 277491 - DNA, 20 bp, Artificial Sequence
  chemically synthesized
actgtaccaaagcccctcac

SEQ ID NO: 277492 - DNA, 20 bp, Artificial Sequence
  chemically synthesized
ataactcttgtgaggggctt

SEQ ID NO: 277493 - DNA, 20 bp, Artificial Sequence
  chemically synthesized
tcttgtgaggggctttggta

SEQ ID NO: 277494 - DNA, 20 bp, Artificial Sequence
  chemically synthesized
caggaaaaaccactgtacca

SEQ ID NO: 277495 - DNA, 20 bp, Artificial Sequence
  chemically synthesized
tgtgaggggctttggtacag

SEQ ID NO: 277496 - DNA, 20 bp, Artificial Sequence
  chemically synthesized
tggtacagtggtttttcctg

SEQ ID NO: 277497 - DNA, 20 bp, Artificial Sequence
  chemically synthesized
tacattaacaaatatgccac

SEQ ID NO: 277498 - DNA, 20 bp, Artificial Sequence
  chemically synthesized
atacattaacaaatatgcca

SEQ ID NO: 277499 - DNA, 20 bp, Artificial Sequence
  chemically synthesized
atatttgttaatgtatttaa

SEQ ID NO: 277500 - DNA, 20 bp, Artificial Sequence
  chemically synthesized
tatttgttaatgtatttaat

SEQ ID NO: 277501 - DNA, 20 bp, Artificial Sequence
  chemically synthesized
atttgttaatgtatttaata

SEQ ID NO: 277502 - DNA, 20 bp, Artificial Sequence
  chemically synthesized
taatgtatttaatagggata

SEQ ID NO: 277503 - DNA, 20 bp, Artificial Sequence
  chemically synthesized
aatgtatttaatagggatat

SEQ ID NO: 277504 - DNA, 20 bp, Artificial Sequence
  chemically synthesized
gtatttaatagggatatagg

SEQ ID NO: 277505 - DNA, 20 bp, Artificial Sequence
  chemically synthesized
ataggcggtaaataattaca

SEQ ID NO: 277506 - DNA, 20 bp, Artificial Sequence
  chemically synthesized
atatttaaaggatatatatg

SEQ ID NO: 277507 - DNA, 20 bp, Artificial Sequence
  chemically synthesized
cttctttattttatatttaa

SEQ ID NO: 277508 - DNA, 20 bp, Artificial Sequence
  chemically synthesized
ccttctttattttatattta

SEQ ID NO: 277509 - DNA, 20 bp, Artificial Sequence
  chemically synthesized
tatcctttaaatataaaata

SEQ ID NO: 277510 - DNA, 20 bp, Artificial Sequence
  chemically synthesized
cctttaaatataaaataaag

SEQ ID NO: 277511 - DNA, 20 bp, Artificial Sequence
  chemically synthesized
ctttaaatataaaataaaga

SEQ ID NO: 277512 - DNA, 20 bp, Artificial Sequence
  chemically synthesized
gaaggttacattattcacga

SEQ ID NO: 277513 - DNA, 20 bp, Artificial Sequence
  chemically synthesized
aaggttacattattcacgaa

SEQ ID NO: 277514 - DNA, 20 bp, Artificial Sequence
  chemically synthesized
cattattcacgaaaggcttc

SEQ ID NO: 277515 - DNA, 20 bp, Artificial Sequence
  chemically synthesized
ttaacaaaacataaatctag

SEQ ID NO: 277516 - DNA, 20 bp, Artificial Sequence
  chemically synthesized
acattaacaaaacataaatc

SEQ ID NO: 277517 - DNA, 20 bp, Artificial Sequence
  chemically synthesized
ttatgttttgttaatgtcac

SEQ ID NO: 277518 - DNA, 20 bp, Artificial Sequence
  chemically synthesized
tatgttttgttaatgtcact

SEQ ID NO: 277519 - DNA, 20 bp, Artificial Sequence
  chemically synthesized
ctcccaggtgtgttcaaacc

SEQ ID NO: 277520 - DNA, 20 bp, Artificial Sequence
  chemically synthesized
tcactaggtttgaacacacc

SEQ ID NO: 277521 - DNA, 20 bp, Artificial Sequence
  chemically synthesized
cactaggtttgaacacacct

SEQ ID NO: 277522 - DNA, 20 bp, Artificial Sequence
  chemically synthesized
ctaggtttgaacacacctgg

SEQ ID NO: 277523 - DNA, 20 bp, Artificial Sequence
  chemically synthesized
cggcttttgagttttctccc

SEQ ID NO: 277524 - DNA, 20 bp, Artificial Sequence
  chemically synthesized
acggcttttgagttttctcc

SEQ ID NO: 277525 - DNA, 20 bp, Artificial Sequence
  chemically synthesized
acacctgggagaaaactcaa

SEQ ID NO: 277526 - DNA, 20 bp, Artificial Sequence
  chemically synthesized
gctccatgctcacggctttt

SEQ ID NO: 277527 - DNA, 20 bp, Artificial Sequence
  chemically synthesized
ggagaaaactcaaaagccgt

SEQ ID NO: 277528 - DNA, 20 bp, Artificial Sequence
  chemically synthesized
aaactcaaaagccgtgagca

SEQ ID NO: 277529 - DNA, 20 bp, Artificial Sequence
  chemically synthesized
ttataggagctccatgctca

SEQ ID NO: 277530 - DNA, 20 bp, Artificial Sequence
  chemically synthesized
actcaaaagccgtgagcatg

SEQ ID NO: 277531 - DNA, 20 bp, Artificial Sequence
  chemically synthesized
cctggtaaagaaaattatag

SEQ ID NO: 277532 - DNA, 20 bp, Artificial Sequence
  chemically synthesized
ttcctggtaaagaaaattat

SEQ ID NO: 277533 - DNA, 20 bp, Artificial Sequence
  chemically synthesized
tttcctggtaaagaaaatta

SEQ ID NO: 277534 - DNA, 20 bp, Artificial Sequence
  chemically synthesized
gctcctataattttctttac

SEQ ID NO: 277535 - DNA, 20 bp, Artificial Sequence
  chemically synthesized
ctcctataattttctttacc

SEQ ID NO: 277536 - DNA, 20 bp, Artificial Sequence
  chemically synthesized
atttatattctttcctggta

SEQ ID NO: 277537 - DNA, 20 bp, Artificial Sequence
  chemically synthesized
tataattttctttaccagga

SEQ ID NO: 277538 - DNA, 20 bp, Artificial Sequence
  chemically synthesized
ttcacatttatattctttcc

SEQ ID NO: 277539 - DNA, 20 bp, Artificial Sequence
  chemically synthesized
aatataaatgtgaaaactct

SEQ ID NO: 277540 - DNA, 20 bp, Artificial Sequence
  chemically synthesized
cctattaaccatgacaccaa

SEQ ID NO: 277541 - DNA, 20 bp, Artificial Sequence
  chemically synthesized
tgtgaaaactcttggtgtca

SEQ ID NO: 277542 - DNA, 20 bp, Artificial Sequence
  chemically synthesized
ttcctattaaccatgacacc

SEQ ID NO: 277543 - DNA, 20 bp, Artificial Sequence
  chemically synthesized
actcttggtgtcatggttaa

SEQ ID NO: 277544 - DNA, 20 bp, Artificial Sequence
  chemically synthesized
ctcttggtgtcatggttaat

SEQ ID NO: 277545 - DNA, 20 bp, Artificial Sequence
  chemically synthesized
gctaaaacctaaaacaggtg

SEQ ID NO: 277546 - DNA, 20 bp, Artificial Sequence
  chemically synthesized
aataggaacttcacctgttt

SEQ ID NO: 277547 - DNA, 20 bp, Artificial Sequence
  chemically synthesized
ataggaacttcacctgtttt

SEQ ID NO: 277548 - DNA, 20 bp, Artificial Sequence
  chemically synthesized
aacctgctaaaacctaaaac

SEQ ID NO: 277549 - DNA, 20 bp, Artificial Sequence
  chemically synthesized
taacctgctaaaacctaaaa

SEQ ID NO: 277550 - DNA, 20 bp, Artificial Sequence
  chemically synthesized
acttcacctgttttaggttt

SEQ ID NO: 277551 - DNA, 20 bp, Artificial Sequence
  chemically synthesized
tcacctgttttaggttttag

SEQ ID NO: 277552 - DNA, 20 bp, Artificial Sequence
  chemically synthesized
cacctgttttaggttttagc

SEQ ID NO: 277553 - DNA, 20 bp, Artificial Sequence
  chemically synthesized
taggttttagcaggttactg

SEQ ID NO: 277554 - DNA, 20 bp, Artificial Sequence
  chemically synthesized
cagaggtcacagaagaactt

SEQ ID NO: 277555 - DNA, 20 bp, Artificial Sequence
  chemically synthesized
gcttccttcagaggtcacag

SEQ ID NO: 277556 - DNA, 20 bp, Artificial Sequence
  chemically synthesized
tatgcttccttcagaggtca

SEQ ID NO: 277557 - DNA, 20 bp, Artificial Sequence
  chemically synthesized
aagttcttctgtgacctctg

SEQ ID NO: 277558 - DNA, 20 bp, Artificial Sequence
  chemically synthesized
agttcttctgtgacctctga

SEQ ID NO: 277559 - DNA, 20 bp, Artificial Sequence
  chemically synthesized
tcttctgtgacctctgaagg

SEQ ID NO: 277560 - DNA, 20 bp, Artificial Sequence
  chemically synthesized
ttcaagtatgcttccttcag

SEQ ID NO: 277561 - DNA, 20 bp, Artificial Sequence
  chemically synthesized
tttcaagtatgcttccttca

SEQ ID NO: 277562 - DNA, 20 bp, Artificial Sequence
  chemically synthesized
actttcaagtatgcttcctt

SEQ ID NO: 277563 - DNA, 20 bp, Artificial Sequence
  chemically synthesized
tctgaaggaagcatacttga

SEQ ID NO: 277564 - DNA, 20 bp, Artificial Sequence
  chemically synthesized
gattcccaaacgttactttc

SEQ ID NO: 277565 - DNA, 20 bp, Artificial Sequence
  chemically synthesized
gcatacttgaaagtaacgtt

SEQ ID NO: 277566 - DNA, 20 bp, Artificial Sequence
  chemically synthesized
catacttgaaagtaacgttt

SEQ ID NO: 277567 - DNA, 20 bp, Artificial Sequence
  chemically synthesized
tttgggaatcattttatcaa

SEQ ID NO: 277568 - DNA, 20 bp, Artificial Sequence
  chemically synthesized
ttatcaatggaacttgacat

SEQ ID NO: 277569 - DNA, 20 bp, Artificial Sequence
  chemically synthesized
agtgatggctatctgatgtc

SEQ ID NO: 277570 - DNA, 20 bp, Artificial Sequence
  chemically synthesized
caatggaacttgacatcaga

SEQ ID NO: 277571 - DNA, 20 bp, Artificial Sequence
  chemically synthesized
aatgctttacttgaaagtga

SEQ ID NO: 277572 - DNA, 20 bp, Artificial Sequence
  chemically synthesized
atcagatagccatcactttc

SEQ ID NO: 277573 - DNA, 20 bp, Artificial Sequence
  chemically synthesized
atagccatcactttcaagta

SEQ ID NO: 277574 - DNA, 20 bp, Artificial Sequence
  chemically synthesized
atgctcaatgctttacttga

SEQ ID NO: 277575 - DNA, 20 bp, Artificial Sequence
  chemically synthesized
tcactttcaagtaaagcatt

SEQ ID NO: 277576 - DNA, 20 bp, Artificial Sequence
  chemically synthesized
agtaaagcattgagcattga

SEQ ID NO: 277577 - DNA, 20 bp, Artificial Sequence
  chemically synthesized
agcattgagcattgatagaa

SEQ ID NO: 277578 - DNA, 20 bp, Artificial Sequence
  chemically synthesized
gcattgatagaatggtcaat

SEQ ID NO: 277579 - DNA, 20 bp, Artificial Sequence
  chemically synthesized
atagaatggtcaatgagcta

SEQ ID NO: 277580 - DNA, 20 bp, Artificial Sequence
  chemically synthesized
agaatggtcaatgagctata

SEQ ID NO: 277581 - DNA, 20 bp, Artificial Sequence
  chemically synthesized
gtcttagatatattactcta

SEQ ID NO: 277582 - DNA, 20 bp, Artificial Sequence
  chemically synthesized
agctatagagtaatatatct

SEQ ID NO: 277583 - DNA, 20 bp, Artificial Sequence
  chemically synthesized
gcaagaatccagaaatgtct

SEQ ID NO: 277584 - DNA, 20 bp, Artificial Sequence
  chemically synthesized
taatatatctaagacatttc

SEQ ID NO: 277585 - DNA, 20 bp, Artificial Sequence
  chemically synthesized
aaatggatgcagcaagaatc

SEQ ID NO: 277586 - DNA, 20 bp, Artificial Sequence
  chemically synthesized
tgaggataaatggatgcagc

SEQ ID NO: 277587 - DNA, 20 bp, Artificial Sequence
  chemically synthesized
cccatgaggataaatggatg

SEQ ID NO: 277588 - DNA, 20 bp, Artificial Sequence
  chemically synthesized
tgtctacccatgaggataaa

SEQ ID NO: 277589 - DNA, 20 bp, Artificial Sequence
  chemically synthesized
gctgcatccatttatcctca

SEQ ID NO: 277590 - DNA, 20 bp, Artificial Sequence
  chemically synthesized
ctgcatccatttatcctcat

SEQ ID NO: 277591 - DNA, 20 bp, Artificial Sequence
  chemically synthesized
catccatttatcctcatggg

SEQ ID NO: 277592 - DNA, 20 bp, Artificial Sequence
  chemically synthesized
atttcacttgtctacccatg

SEQ ID NO: 277593 - DNA, 20 bp, Artificial Sequence
  chemically synthesized
aatttcacttgtctacccat

SEQ ID NO: 277594 - DNA, 20 bp, Artificial Sequence
  chemically synthesized
atttatcctcatgggtagac

SEQ ID NO: 277595 - DNA, 20 bp, Artificial Sequence
  chemically synthesized
catgggtagacaagtgaaat

SEQ ID NO: 277596 - DNA, 20 bp, Artificial Sequence
  chemically synthesized
gtttgctcctgtcagggcag

SEQ ID NO: 277597 - DNA, 20 bp, Artificial Sequence
  chemically synthesized
aaattggtcttctgccctga

SEQ ID NO: 277598 - DNA, 20 bp, Artificial Sequence
  chemically synthesized
aattggtcttctgccctgac

SEQ ID NO: 277599 - DNA, 20 bp, Artificial Sequence
  chemically synthesized
tcagtttgctcctgtcaggg

SEQ ID NO: 277600 - DNA, 20 bp, Artificial Sequence
  chemically synthesized
ttggtcttctgccctgacag

SEQ ID NO: 277601 - DNA, 20 bp, Artificial Sequence
  chemically synthesized
gcatcagtttgctcctgtca

SEQ ID NO: 277602 - DNA, 20 bp, Artificial Sequence
  chemically synthesized
agcatcagtttgctcctgtc

SEQ ID NO: 277603 - DNA, 20 bp, Artificial Sequence
  chemically synthesized
aagcatcagtttgctcctgt

SEQ ID NO: 277604 - DNA, 20 bp, Artificial Sequence
  chemically synthesized
ttgaagcttaaataaagcat

SEQ ID NO: 277605 - DNA, 20 bp, Artificial Sequence
  chemically synthesized
agcaaactgatgctttattt

SEQ ID NO: 277606 - DNA, 20 bp, Artificial Sequence
  chemically synthesized
ttctttttgaagcttaaata

SEQ ID NO: 277607 - DNA, 20 bp, Artificial Sequence
  chemically synthesized
tgctttatttaagcttcaaa

SEQ ID NO: 277608 - DNA, 20 bp, Artificial Sequence
  chemically synthesized
cttcattcactttctttttg

SEQ ID NO: 277609 - DNA, 20 bp, Artificial Sequence
  chemically synthesized
ttatttaagcttcaaaaaga

SEQ ID NO: 277610 - DNA, 20 bp, Artificial Sequence
  chemically synthesized
cttcaaaaagaaagtgaatg

SEQ ID NO: 277611 - DNA, 20 bp, Artificial Sequence
  chemically synthesized
aaagtgaatgaagcattatt

SEQ ID NO: 277612 - DNA, 20 bp, Artificial Sequence
  chemically synthesized
ttattcagtaaacataaaat

SEQ ID NO: 277613 - DNA, 20 bp, Artificial Sequence
  chemically synthesized
gtaaacataaaataagtcta

SEQ ID NO: 277614 - DNA, 20 bp, Artificial Sequence
  chemically synthesized
taaacataaaataagtctac

SEQ ID NO: 277615 - DNA, 20 bp, Artificial Sequence
  chemically synthesized
cttggatatgatgaatcctg

SEQ ID NO: 277616 - DNA, 20 bp, Artificial Sequence
  chemically synthesized
ctacaggattcatcatatcc

SEQ ID NO: 277617 - DNA, 20 bp, Artificial Sequence
  chemically synthesized
gaaggtaccttgagaaagct

SEQ ID NO: 277618 - DNA, 20 bp, Artificial Sequence
  chemically synthesized
catcatatccaagctttctc

SEQ ID NO: 277619 - DNA, 20 bp, Artificial Sequence
  chemically synthesized
atcatatccaagctttctca

SEQ ID NO: 277620 - DNA, 20 bp, Artificial Sequence
  chemically synthesized
ctcctgaaggtaccttgaga

SEQ ID NO: 277621 - DNA, 20 bp, Artificial Sequence
  chemically synthesized
gtggctcctgaaggtacctt

SEQ ID NO: 277622 - DNA, 20 bp, Artificial Sequence
  chemically synthesized
aagctttctcaaggtacctt

SEQ ID NO: 277623 - DNA, 20 bp, Artificial Sequence
  chemically synthesized
agctttctcaaggtaccttc

SEQ ID NO: 277624 - DNA, 20 bp, Artificial Sequence
  chemically synthesized
ctttctcaaggtaccttcag

SEQ ID NO: 277625 - DNA, 20 bp, Artificial Sequence
  chemically synthesized
tgacttagggtggctcctga

SEQ ID NO: 277626 - DNA, 20 bp, Artificial Sequence
  chemically synthesized
ctgacttagggtggctcctg

SEQ ID NO: 277627 - DNA, 20 bp, Artificial Sequence
  chemically synthesized
gtaccttcaggagccaccct

SEQ ID NO: 277628 - DNA, 20 bp, Artificial Sequence
  chemically synthesized
aaaatttcactgacttaggg

SEQ ID NO: 277629 - DNA, 20 bp, Artificial Sequence
  chemically synthesized
cttcaggagccaccctaagt

SEQ ID NO: 277630 - DNA, 20 bp, Artificial Sequence
  chemically synthesized
ggaaaaatttcactgactta

SEQ ID NO: 277631 - DNA, 20 bp, Artificial Sequence
  chemically synthesized
cggaaaaatttcactgactt

SEQ ID NO: 277632 - DNA, 20 bp, Artificial Sequence
  chemically synthesized
ccggaaaaatttcactgact

SEQ ID NO: 277633 - DNA, 20 bp, Artificial Sequence
  chemically synthesized
ctaagtcagtgaaatttttc

SEQ ID NO: 277634 - DNA, 20 bp, Artificial Sequence
  chemically synthesized
gtgaaatttttccggcccaa

SEQ ID NO: 277635 - DNA, 20 bp, Artificial Sequence
  chemically synthesized
agagtacctcgccattgggc

SEQ ID NO: 277636 - DNA, 20 bp, Artificial Sequence
  chemically synthesized
aatttttccggcccaatggc

SEQ ID NO: 277637 - DNA, 20 bp, Artificial Sequence
  chemically synthesized
atttttccggcccaatggcg

SEQ ID NO: 277638 - DNA, 20 bp, Artificial Sequence
  chemically synthesized
tcaaagagtacctcgccatt

SEQ ID NO: 277639 - DNA, 20 bp, Artificial Sequence
  chemically synthesized
gtcaaagagtacctcgccat

SEQ ID NO: 277640 - DNA, 20 bp, Artificial Sequence
  chemically synthesized
tgaacacatgtgcagtcaaa

SEQ ID NO: 277641 - DNA, 20 bp, Artificial Sequence
  chemically synthesized
tatgaacacatgtgcagtca

SEQ ID NO: 277642 - DNA, 20 bp, Artificial Sequence
  chemically synthesized
taataatatgaacacatgtg

SEQ ID NO: 277643 - DNA, 20 bp, Artificial Sequence
  chemically synthesized
cacatgtgttcatattatta

SEQ ID NO: 277644 - DNA, 20 bp, Artificial Sequence
  chemically synthesized
tattattaaagtctaaactt

SEQ ID NO: 277645 - DNA, 20 bp, Artificial Sequence
  chemically synthesized
attattaaagtctaaacttt

SEQ ID NO: 277646 - DNA, 20 bp, Artificial Sequence
  chemically synthesized
attattcactgcctaaagtt

SEQ ID NO: 277647 - DNA, 20 bp, Artificial Sequence
  chemically synthesized
attaaagtctaaactttagg

SEQ ID NO: 277648 - DNA, 20 bp, Artificial Sequence
  chemically synthesized
aataaattattcactgccta

SEQ ID NO: 277649 - DNA, 20 bp, Artificial Sequence
  chemically synthesized
cagtgaataatttattgata

SEQ ID NO: 277650 - DNA, 20 bp, Artificial Sequence
  chemically synthesized
agtgaataatttattgatac

SEQ ID NO: 277651 - DNA, 20 bp, Artificial Sequence
  chemically synthesized
aggaaataattaaaatattt

SEQ ID NO: 277652 - DNA, 20 bp, Artificial Sequence
  chemically synthesized
cactattccatatcaggaga

SEQ ID NO: 277653 - DNA, 20 bp, Artificial Sequence
  chemically synthesized
taagtcgctgtctcctgata

SEQ ID NO: 277654 - DNA, 20 bp, Artificial Sequence
  chemically synthesized
gtctcactattccatatcag

SEQ ID NO: 277655 - DNA, 20 bp, Artificial Sequence
  chemically synthesized
ctgtctcactattccatatc

SEQ ID NO: 277656 - DNA, 20 bp, Artificial Sequence
  chemically synthesized
tctgtctcactattccatat

SEQ ID NO: 277657 - DNA, 20 bp, Artificial Sequence
  chemically synthesized
cgctgtctcctgatatggaa

SEQ ID NO: 277658 - DNA, 20 bp, Artificial Sequence
  chemically synthesized
gtctcctgatatggaatagt

SEQ ID NO: 277659 - DNA, 20 bp, Artificial Sequence
  chemically synthesized
cctgatatggaatagtgaga

SEQ ID NO: 277660 - DNA, 20 bp, Artificial Sequence
  chemically synthesized
atggaatagtgagacagaat

SEQ ID NO: 277661 - DNA, 20 bp, Artificial Sequence
  chemically synthesized
agtgagacagaatcagattc

SEQ ID NO: 277662 - DNA, 20 bp, Artificial Sequence
  chemically synthesized
gtgagacagaatcagattct

SEQ ID NO: 277663 - DNA, 20 bp, Artificial Sequence
  chemically synthesized
tgagacagaatcagattcta

SEQ ID NO: 277664 - DNA, 20 bp, Artificial Sequence
  chemically synthesized
aatgctgaccaagtcatccc

SEQ ID NO: 277665 - DNA, 20 bp, Artificial Sequence
  chemically synthesized
atcagattctagggatgact

SEQ ID NO: 277666 - DNA, 20 bp, Artificial Sequence
  chemically synthesized
gattctagggatgacttggt

SEQ ID NO: 277667 - DNA, 20 bp, Artificial Sequence
  chemically synthesized
atgtggtctcaatgctgacc

SEQ ID NO: 277668 - DNA, 20 bp, Artificial Sequence
  chemically synthesized
gggatgacttggtcagcatt

SEQ ID NO: 277669 - DNA, 20 bp, Artificial Sequence
  chemically synthesized
agcattgagaccacatgttc

SEQ ID NO: 277670 - DNA, 20 bp, Artificial Sequence
  chemically synthesized
ttatattttgcttgaacatg

SEQ ID NO: 277671 - DNA, 20 bp, Artificial Sequence
  chemically synthesized
acatgttcaagcaaaatata

SEQ ID NO: 277672 - DNA, 20 bp, Artificial Sequence
  chemically synthesized
aaaatataaagtttatacat

SEQ ID NO: 277673 - DNA, 20 bp, Artificial Sequence
  chemically synthesized
aaagtttatacatgagacaa

SEQ ID NO: 277674 - DNA, 20 bp, Artificial Sequence
  chemically synthesized
atgagacaaaagtccaaatc

SEQ ID NO: 277675 - DNA, 20 bp, Artificial Sequence
  chemically synthesized
tgagacaaaagtccaaatct

SEQ ID NO: 277676 - DNA, 20 bp, Artificial Sequence
  chemically synthesized
gagacaaaagtccaaatctg

SEQ ID NO: 277677 - DNA, 20 bp, Artificial Sequence
  chemically synthesized
cttgattttatccccagatt

SEQ ID NO: 277678 - DNA, 20 bp, Artificial Sequence
  chemically synthesized
ttccaacttgattttatccc

SEQ ID NO: 277679 - DNA, 20 bp, Artificial Sequence
  chemically synthesized
ccaaatctggggataaaatc

SEQ ID NO: 277680 - DNA, 20 bp, Artificial Sequence
  chemically synthesized
atctggggataaaatcaagt

SEQ ID NO: 277681 - DNA, 20 bp, Artificial Sequence
  chemically synthesized
gggataaaatcaagttggaa

SEQ ID NO: 277682 - DNA, 20 bp, Artificial Sequence
  chemically synthesized
aaaatcaagttggaaaagat

SEQ ID NO: 277683 - DNA, 20 bp, Artificial Sequence
  chemically synthesized
atcaagttggaaaagatgag

SEQ ID NO: 277684 - DNA, 20 bp, Artificial Sequence
  chemically synthesized
aaaagatgagaagtcaaaat

SEQ ID NO: 277685 - DNA, 20 bp, Artificial Sequence
  chemically synthesized
agtcaaaattagaaaaaatg

SEQ ID NO: 277686 - DNA, 20 bp, Artificial Sequence
  chemically synthesized
aaaattagaaaaaatgtagc

SEQ ID NO: 277687 - DNA, 20 bp, Artificial Sequence
  chemically synthesized
accacttggcttagaagcac

SEQ ID NO: 277688 - DNA, 20 bp, Artificial Sequence
  chemically synthesized
aaaatgtagctggtgcttct

SEQ ID NO: 277689 - DNA, 20 bp, Artificial Sequence
  chemically synthesized
gtagctggtgcttctaagcc

SEQ ID NO: 277690 - DNA, 20 bp, Artificial Sequence
  chemically synthesized
acctataccacttggcttag

SEQ ID NO: 277691 - DNA, 20 bp, Artificial Sequence
  chemically synthesized
gctggtgcttctaagccaag

SEQ ID NO: 277692 - DNA, 20 bp, Artificial Sequence
  chemically synthesized
ttaacctataccacttggct

SEQ ID NO: 277693 - DNA, 20 bp, Artificial Sequence
  chemically synthesized
tgcttctaagccaagtggta

SEQ ID NO: 277694 - DNA, 20 bp, Artificial Sequence
  chemically synthesized
gctaattaacctataccact

SEQ ID NO: 277695 - DNA, 20 bp, Artificial Sequence
  chemically synthesized
gcttctaagccaagtggtat

SEQ ID NO: 277696 - DNA, 20 bp, Artificial Sequence
  chemically synthesized
gccaagtggtataggttaat

SEQ ID NO: 277697 - DNA, 20 bp, Artificial Sequence
  chemically synthesized
ataggttaattagccaaata

SEQ ID NO: 277698 - DNA, 20 bp, Artificial Sequence
  chemically synthesized
ggttaattagccaaatacag

SEQ ID NO: 277699 - DNA, 20 bp, Artificial Sequence
  chemically synthesized
cacttgggtacttctgtatt

SEQ ID NO: 277700 - DNA, 20 bp, Artificial Sequence
  chemically synthesized
agccaaatacagaagtaccc

SEQ ID NO: 277701 - DNA, 20 bp, Artificial Sequence
  chemically synthesized
aaatacagaagtacccaagt

SEQ ID NO: 277702 - DNA, 20 bp, Artificial Sequence
  chemically synthesized
atacagaagtacccaagtga

SEQ ID NO: 277703 - DNA, 20 bp, Artificial Sequence
  chemically synthesized
cagtatgctctctctcactt

SEQ ID NO: 277704 - DNA, 20 bp, Artificial Sequence
  chemically synthesized
acagaagtacccaagtgaga

SEQ ID NO: 277705 - DNA, 20 bp, Artificial Sequence
  chemically synthesized
tcagtatgctctctctcact

SEQ ID NO: 277706 - DNA, 20 bp, Artificial Sequence
  chemically synthesized
agaagtacccaagtgagaga

SEQ ID NO: 277707 - DNA, 20 bp, Artificial Sequence
  chemically synthesized
caagtgagagagagcatact

SEQ ID NO: 277708 - DNA, 20 bp, Artificial Sequence
  chemically synthesized
aagtgagagagagcatactg

SEQ ID NO: 277709 - DNA, 20 bp, Artificial Sequence
  chemically synthesized
aacctatctgtaattggcct

SEQ ID NO: 277710 - DNA, 20 bp, Artificial Sequence
  chemically synthesized
gagcatactgaggccaatta

SEQ ID NO: 277711 - DNA, 20 bp, Artificial Sequence
  chemically synthesized
accaccaacctatctgtaat

SEQ ID NO: 277712 - DNA, 20 bp, Artificial Sequence
  chemically synthesized
atactgaggccaattacaga

SEQ ID NO: 277713 - DNA, 20 bp, Artificial Sequence
  chemically synthesized
tactgaggccaattacagat

SEQ ID NO: 277714 - DNA, 20 bp, Artificial Sequence
  chemically synthesized
gaggccaattacagataggt

SEQ ID NO: 277715 - DNA, 20 bp, Artificial Sequence
  chemically synthesized
gccaattacagataggttgg

SEQ ID NO: 277716 - DNA, 20 bp, Artificial Sequence
  chemically synthesized
acagataggttggtggttgt

SEQ ID NO: 277717 - DNA, 20 bp, Artificial Sequence
  chemically synthesized
gttggtggttgtgagcaaac

SEQ ID NO: 277718 - DNA, 20 bp, Artificial Sequence
  chemically synthesized
ttcatctacattgtaaggac

SEQ ID NO: 277719 - DNA, 20 bp, Artificial Sequence
  chemically synthesized
gcaaactagtccttacaatg

SEQ ID NO: 277720 - DNA, 20 bp, Artificial Sequence
  chemically synthesized
gctagttcatctacattgta

SEQ ID NO: 277721 - DNA, 20 bp, Artificial Sequence
  chemically synthesized
ggctagttcatctacattgt

SEQ ID NO: 277722 - DNA, 20 bp, Artificial Sequence
  chemically synthesized
tccttacaatgtagatgaac

SEQ ID NO: 277723 - DNA, 20 bp, Artificial Sequence
  chemically synthesized
tacaatgtagatgaactagc

SEQ ID NO: 277724 - DNA, 20 bp, Artificial Sequence
  chemically synthesized
taagaggactatcaactggc

SEQ ID NO: 277725 - DNA, 20 bp, Artificial Sequence
  chemically synthesized
tagatgaactagccagttga

SEQ ID NO: 277726 - DNA, 20 bp, Artificial Sequence
  chemically synthesized
tatttaagaggactatcaac

SEQ ID NO: 277727 - DNA, 20 bp, Artificial Sequence
  chemically synthesized
agttgatagtcctcttaaat

SEQ ID NO: 277728 - DNA, 20 bp, Artificial Sequence
  chemically synthesized
tatcactgaccttatttaag

SEQ ID NO: 277729 - DNA, 20 bp, Artificial Sequence
  chemically synthesized
gttgatagtcctcttaaata

SEQ ID NO: 277730 - DNA, 20 bp, Artificial Sequence
  chemically synthesized
atatcactgaccttatttaa

SEQ ID NO: 277731 - DNA, 20 bp, Artificial Sequence
  chemically synthesized
ggatatcactgaccttattt

SEQ ID NO: 277732 - DNA, 20 bp, Artificial Sequence
  chemically synthesized
atagtcctcttaaataaggt

SEQ ID NO: 277733 - DNA, 20 bp, Artificial Sequence
  chemically synthesized
taaataaggtcagtgatatc

SEQ ID NO: 277734 - DNA, 20 bp, Artificial Sequence
  chemically synthesized
taaggtcagtgatatccagt

SEQ ID NO: 277735 - DNA, 20 bp, Artificial Sequence
  chemically synthesized
tcagtgatatccagtcagta

SEQ ID NO: 277736 - DNA, 20 bp, Artificial Sequence
  chemically synthesized
tgtcacactactgtactgac

SEQ ID NO: 277737 - DNA, 20 bp, Artificial Sequence
  chemically synthesized
gtgatatccagtcagtacag

SEQ ID NO: 277738 - DNA, 20 bp, Artificial Sequence
  chemically synthesized
gtcagtacagtagtgtgaca

SEQ ID NO: 277739 - DNA, 20 bp, Artificial Sequence
  chemically synthesized
cagtagtgtgacaaagatct

SEQ ID NO: 277740 - DNA, 20 bp, Artificial Sequence
  chemically synthesized
gtagtgtgacaaagatctca

SEQ ID NO: 277741 - DNA, 20 bp, Artificial Sequence
  chemically synthesized
tgacaaagatctcagagtga

SEQ ID NO: 277742 - DNA, 20 bp, Artificial Sequence
  chemically synthesized
ttccaaagttctttcactct

SEQ ID NO: 277743 - DNA, 20 bp, Artificial Sequence
  chemically synthesized
atctcagagtgaaagaactt

SEQ ID NO: 277744 - DNA, 20 bp, Artificial Sequence
  chemically synthesized
agagggactaacgagttcca

SEQ ID NO: 277745 - DNA, 20 bp, Artificial Sequence
  chemically synthesized
gaaagaactttggaactcgt

SEQ ID NO: 277746 - DNA, 20 bp, Artificial Sequence
  chemically synthesized
tcctaagtagagggactaac

SEQ ID NO: 277747 - DNA, 20 bp, Artificial Sequence
  chemically synthesized
aactcgttagtccctctact

SEQ ID NO: 277748 - DNA, 20 bp, Artificial Sequence
  chemically synthesized
actcgttagtccctctactt

SEQ ID NO: 277749 - DNA, 20 bp, Artificial Sequence
  chemically synthesized
agtctgaattcctaagtaga

SEQ ID NO: 277750 - DNA, 20 bp, Artificial Sequence
  chemically synthesized
gagtctgaattcctaagtag

SEQ ID NO: 277751 - DNA, 20 bp, Artificial Sequence
  chemically synthesized
agagtctgaattcctaagta

SEQ ID NO: 277752 - DNA, 20 bp, Artificial Sequence
  chemically synthesized
tgagagtctgaattcctaag

SEQ ID NO: 277753 - DNA, 20 bp, Artificial Sequence
  chemically synthesized
agtccctctacttaggaatt

SEQ ID NO: 277754 - DNA, 20 bp, Artificial Sequence
  chemically synthesized
tcctgagagtctgaattcct

SEQ ID NO: 277755 - DNA, 20 bp, Artificial Sequence
  chemically synthesized
tacttaggaattcagactct

SEQ ID NO: 277756 - DNA, 20 bp, Artificial Sequence
  chemically synthesized
acttaggaattcagactctc

SEQ ID NO: 277757 - DNA, 20 bp, Artificial Sequence
  chemically synthesized
aggaattcagactctcagga

SEQ ID NO: 277758 - DNA, 20 bp, Artificial Sequence
  chemically synthesized
gtgttgagtttctttcctga

SEQ ID NO: 277759 - DNA, 20 bp, Artificial Sequence
  chemically synthesized
ctgtgttgagtttctttcct

SEQ ID NO: 277760 - DNA, 20 bp, Artificial Sequence
  chemically synthesized
ctcaggaaagaaactcaaca

SEQ ID NO: 277761 - DNA, 20 bp, Artificial Sequence
  chemically synthesized
aaagccagagatgctgtgtt

SEQ ID NO: 277762 - DNA, 20 bp, Artificial Sequence
  chemically synthesized
gaaactcaacacagcatctc

SEQ ID NO: 277763 - DNA, 20 bp, Artificial Sequence
  chemically synthesized
atattaagtccagaaagcca

SEQ ID NO: 277764 - DNA, 20 bp, Artificial Sequence
  chemically synthesized
acacagcatctctggctttc

SEQ ID NO: 277765 - DNA, 20 bp, Artificial Sequence
  chemically synthesized
tcatattaagtccagaaagc

SEQ ID NO: 277766 - DNA, 20 bp, Artificial Sequence
  chemically synthesized
tacatcatattaagtccaga

SEQ ID NO: 277767 - DNA, 20 bp, Artificial Sequence
  chemically synthesized
cccatacatcatattaagtc

SEQ ID NO: 277768 - DNA, 20 bp, Artificial Sequence
  chemically synthesized
tgcttcccatacatcatatt

SEQ ID NO: 277769 - DNA, 20 bp, Artificial Sequence
  chemically synthesized
tctggacttaatatgatgta

SEQ ID NO: 277770 - DNA, 20 bp, Artificial Sequence
  chemically synthesized
ctggacttaatatgatgtat

SEQ ID NO: 277771 - DNA, 20 bp, Artificial Sequence
  chemically synthesized
gacttaatatgatgtatggg

SEQ ID NO: 277772 - DNA, 20 bp, Artificial Sequence
  chemically synthesized
attcatcacacttcctttta

SEQ ID NO: 277773 - DNA, 20 bp, Artificial Sequence
  chemically synthesized
cttacctggtctataaaagg

SEQ ID NO: 277774 - DNA, 20 bp, Artificial Sequence
  chemically synthesized
atccttacctggtctataaa

SEQ ID NO: 277775 - DNA, 20 bp, Artificial Sequence
  chemically synthesized
catccttacctggtctataa

SEQ ID NO: 277776 - DNA, 20 bp, Artificial Sequence
  chemically synthesized
tcacacttccttttatagac

SEQ ID NO: 277777 - DNA, 20 bp, Artificial Sequence
  chemically synthesized
cacacttccttttatagacc

SEQ ID NO: 277778 - DNA, 20 bp, Artificial Sequence
  chemically synthesized
cttccttttatagaccaggt

SEQ ID NO: 277779 - DNA, 20 bp, Artificial Sequence
  chemically synthesized
ttccttttatagaccaggta

SEQ ID NO: 277780 - DNA, 20 bp, Artificial Sequence
  chemically synthesized
cctgtgtggccatccttacc

SEQ ID NO: 277781 - DNA, 20 bp, Artificial Sequence
  chemically synthesized
ttttatagaccaggtaagga

SEQ ID NO: 277782 - DNA, 20 bp, Artificial Sequence
  chemically synthesized
accaggtaaggatggccaca

SEQ ID NO: 277783 - DNA, 20 bp, Artificial Sequence
  chemically synthesized
ccaggtaaggatggccacac

SEQ ID NO: 277784 - DNA, 20 bp, Artificial Sequence
  chemically synthesized
ttattcataggcaacctgtg

SEQ ID NO: 277785 - DNA, 20 bp, Artificial Sequence
  chemically synthesized
ttggaaactattttattcat

SEQ ID NO: 277786 - DNA, 20 bp, Artificial Sequence
  chemically synthesized
attggaaactattttattca

SEQ ID NO: 277787 - DNA, 20 bp, Artificial Sequence
  chemically synthesized
caggttgcctatgaataaaa

SEQ ID NO: 277788 - DNA, 20 bp, Artificial Sequence
  chemically synthesized
ataaaatagtttccaatctt

SEQ ID NO: 277789 - DNA, 20 bp, Artificial Sequence
  chemically synthesized
cacactgcttgactgaagat

SEQ ID NO: 277790 - DNA, 20 bp, Artificial Sequence
  chemically synthesized
atagtttccaatcttcagtc

SEQ ID NO: 277791 - DNA, 20 bp, Artificial Sequence
  chemically synthesized
tatttcacactgcttgactg

SEQ ID NO: 277792 - DNA, 20 bp, Artificial Sequence
  chemically synthesized
gtttccaatcttcagtcaag

SEQ ID NO: 277793 - DNA, 20 bp, Artificial Sequence
  chemically synthesized
cagtcaagcagtgtgaaata

SEQ ID NO: 277794 - DNA, 20 bp, Artificial Sequence
  chemically synthesized
tgaaatacagccttgataac

SEQ ID NO: 277795 - DNA, 20 bp, Artificial Sequence
  chemically synthesized
agcaccatttctagttatca

SEQ ID NO: 277796 - DNA, 20 bp, Artificial Sequence
  chemically synthesized
aagcaccatttctagttatc

SEQ ID NO: 277797 - DNA, 20 bp, Artificial Sequence
  chemically synthesized
acagccttgataactagaaa

SEQ ID NO: 277798 - DNA, 20 bp, Artificial Sequence
  chemically synthesized
catcagaaaagcaccatttc

SEQ ID NO: 277799 - DNA, 20 bp, Artificial Sequence
  chemically synthesized
atctctaatgcacatcagaa

SEQ ID NO: 277800 - DNA, 20 bp, Artificial Sequence
  chemically synthesized
cagagatctctaatgcacat

SEQ ID NO: 277801 - DNA, 20 bp, Artificial Sequence
  chemically synthesized
ggtgcttttctgatgtgcat

SEQ ID NO: 277802 - DNA, 20 bp, Artificial Sequence
  chemically synthesized
tgcttttctgatgtgcatta

SEQ ID NO: 277803 - DNA, 20 bp, Artificial Sequence
  chemically synthesized
tgtgcattagagatctctgc

SEQ ID NO: 277804 - DNA, 20 bp, Artificial Sequence
  chemically synthesized
acagtagaaggaatccagca

SEQ ID NO: 277805 - DNA, 20 bp, Artificial Sequence
  chemically synthesized
tcacagtagaaggaatccag

SEQ ID NO: 277806 - DNA, 20 bp, Artificial Sequence
  chemically synthesized
acatcacagtagaaggaatc

SEQ ID NO: 277807 - DNA, 20 bp, Artificial Sequence
  chemically synthesized
tgagcctacatcacagtaga

SEQ ID NO: 277808 - DNA, 20 bp, Artificial Sequence
  chemically synthesized
atgagcctacatcacagtag

SEQ ID NO: 277809 - DNA, 20 bp, Artificial Sequence
  chemically synthesized
attatgagcctacatcacag

SEQ ID NO: 277810 - DNA, 20 bp, Artificial Sequence
  chemically synthesized
ggattccttctactgtgatg

SEQ ID NO: 277811 - DNA, 20 bp, Artificial Sequence
  chemically synthesized
gattccttctactgtgatgt

SEQ ID NO: 277812 - DNA, 20 bp, Artificial Sequence
  chemically synthesized
agtattatgagcctacatca

SEQ ID NO: 277813 - DNA, 20 bp, Artificial Sequence
  chemically synthesized
cactggccttagagtattat

SEQ ID NO: 277814 - DNA, 20 bp, Artificial Sequence
  chemically synthesized
atgtaggctcataatactct

SEQ ID NO: 277815 - DNA, 20 bp, Artificial Sequence
  chemically synthesized
tgtaggctcataatactcta

SEQ ID NO: 277816 - DNA, 20 bp, Artificial Sequence
  chemically synthesized
ggctcataatactctaaggc

SEQ ID NO: 277817 - DNA, 20 bp, Artificial Sequence
  chemically synthesized
gaacctgaacactggcctta

SEQ ID NO: 277818 - DNA, 20 bp, Artificial Sequence
  chemically synthesized
gagaacctgaacactggcct

SEQ ID NO: 277819 - DNA, 20 bp, Artificial Sequence
  chemically synthesized
aatactctaaggccagtgtt

SEQ ID NO: 277820 - DNA, 20 bp, Artificial Sequence
  chemically synthesized
atactctaaggccagtgttc

SEQ ID NO: 277821 - DNA, 20 bp, Artificial Sequence
  chemically synthesized
gtccaagagaacctgaacac

SEQ ID NO: 277822 - DNA, 20 bp, Artificial Sequence
  chemically synthesized
ggccagtgttcaggttctct

SEQ ID NO: 277823 - DNA, 20 bp, Artificial Sequence
  chemically synthesized
tccatggcactgtagtccaa

SEQ ID NO: 277824 - DNA, 20 bp, Artificial Sequence
  chemically synthesized
gttcaggttctcttggacta

SEQ ID NO: 277825 - DNA, 20 bp, Artificial Sequence
  chemically synthesized
aatccatggcactgtagtcc

SEQ ID NO: 277826 - DNA, 20 bp, Artificial Sequence
  chemically synthesized
cggcaaaatccatggcactg

SEQ ID NO: 277827 - DNA, 20 bp, Artificial Sequence
  chemically synthesized
tctcttggactacagtgcca

SEQ ID NO: 277828 - DNA, 20 bp, Artificial Sequence
  chemically synthesized
acagaggccggcaaaatcca

SEQ ID NO: 277829 - DNA, 20 bp, Artificial Sequence
  chemically synthesized
tacagtgccatggattttgc

SEQ ID NO: 277830 - DNA, 20 bp, Artificial Sequence
  chemically synthesized
atggattttgccggcctctg

SEQ ID NO: 277831 - DNA, 20 bp, Artificial Sequence
  chemically synthesized
ttacagttgaccacagaggc

SEQ ID NO: 277832 - DNA, 20 bp, Artificial Sequence
  chemically synthesized
tgaattacagttgaccacag

SEQ ID NO: 277833 - DNA, 20 bp, Artificial Sequence
  chemically synthesized
atgaattacagttgaccaca

SEQ ID NO: 277834 - DNA, 20 bp, Artificial Sequence
  chemically synthesized
atatgaattacagttgacca

SEQ ID NO: 277835 - DNA, 20 bp, Artificial Sequence
  chemically synthesized
gttcgaaccaatatgaatta

SEQ ID NO: 277836 - DNA, 20 bp, Artificial Sequence
  chemically synthesized
tggtcaactgtaattcatat

SEQ ID NO: 277837 - DNA, 20 bp, Artificial Sequence
  chemically synthesized
agttgctcagatacaatttc

SEQ ID NO: 277838 - DNA, 20 bp, Artificial Sequence
  chemically synthesized
tcgaacttgaaattgtatct

SEQ ID NO: 277839 - DNA, 20 bp, Artificial Sequence
  chemically synthesized
tgaaattgtatctgagcaac

SEQ ID NO: 277840 - DNA, 20 bp, Artificial Sequence
  chemically synthesized
ggagcatttttccagttgct

SEQ ID NO: 277841 - DNA, 20 bp, Artificial Sequence
  chemically synthesized
aggagagaggagcatttttc

SEQ ID NO: 277842 - DNA, 20 bp, Artificial Sequence
  chemically synthesized
ccagacatcccaggagagag

SEQ ID NO: 277843 - DNA, 20 bp, Artificial Sequence
  chemically synthesized
ggaaaaatgctcctctctcc

SEQ ID NO: 277844 - DNA, 20 bp, Artificial Sequence
  chemically synthesized
gaaaaatgctcctctctcct

SEQ ID NO: 277845 - DNA, 20 bp, Artificial Sequence
  chemically synthesized
tcccagacatcccaggagag

SEQ ID NO: 277846 - DNA, 20 bp, Artificial Sequence
  chemically synthesized
gtcccagacatcccaggaga

SEQ ID NO: 277847 - DNA, 20 bp, Artificial Sequence
  chemically synthesized
tcgtcccagacatcccagga

SEQ ID NO: 277848 - DNA, 20 bp, Artificial Sequence
  chemically synthesized
agtcgtcccagacatcccag

SEQ ID NO: 277849 - DNA, 20 bp, Artificial Sequence
  chemically synthesized
ccagtcgtcccagacatccc

SEQ ID NO: 277850 - DNA, 20 bp, Artificial Sequence
  chemically synthesized
ctcctctctcctgggatgtc

SEQ ID NO: 277851 - DNA, 20 bp, Artificial Sequence
  chemically synthesized
accagtcgtcccagacatcc

SEQ ID NO: 277852 - DNA, 20 bp, Artificial Sequence
  chemically synthesized
tcctctctcctgggatgtct

SEQ ID NO: 277853 - DNA, 20 bp, Artificial Sequence
  chemically synthesized
cctgggatgtctgggacgac

SEQ ID NO: 277854 - DNA, 20 bp, Artificial Sequence
  chemically synthesized
tgaaaaaggaccagtcgtcc

SEQ ID NO: 277855 - DNA, 20 bp, Artificial Sequence
  chemically synthesized
tgggtaggatgaaaaaggac

SEQ ID NO: 277856 - DNA, 20 bp, Artificial Sequence
  chemically synthesized
gtaattgggtaggatgaaaa

SEQ ID NO: 277857 - DNA, 20 bp, Artificial Sequence
  chemically synthesized
tgtaattgggtaggatgaaa

SEQ ID NO: 277858 - DNA, 20 bp, Artificial Sequence
  chemically synthesized
taatcttcatgtaattgggt

SEQ ID NO: 277859 - DNA, 20 bp, Artificial Sequence
  chemically synthesized
ttaatcttcatgtaattggg

SEQ ID NO: 277860 - DNA, 20 bp, Artificial Sequence
  chemically synthesized
ttgttaatcttcatgtaatt

SEQ ID NO: 277861 - DNA, 20 bp, Artificial Sequence
  chemically synthesized
attgttaatcttcatgtaat

SEQ ID NO: 277862 - DNA, 20 bp, Artificial Sequence
  chemically synthesized
tcatcctacccaattacatg

SEQ ID NO: 277863 - DNA, 20 bp, Artificial Sequence
  chemically synthesized
tttatttatcacaaatactc

SEQ ID NO: 277864 - DNA, 20 bp, Artificial Sequence
  chemically synthesized
agagccatgacaatcatctg

SEQ ID NO: 277865 - DNA, 20 bp, Artificial Sequence
  chemically synthesized
ccagagccatgacaatcatc

SEQ ID NO: 277866 - DNA, 20 bp, Artificial Sequence
  chemically synthesized
aatactccagatgattgtca

SEQ ID NO: 277867 - DNA, 20 bp, Artificial Sequence
  chemically synthesized
ccagatgattgtcatggctc

SEQ ID NO: 277868 - DNA, 20 bp, Artificial Sequence
  chemically synthesized
agatgattgtcatggctctg

SEQ ID NO: 277869 - DNA, 20 bp, Artificial Sequence
  chemically synthesized
tgattgtcatggctctggag

SEQ ID NO: 277870 - DNA, 20 bp, Artificial Sequence
  chemically synthesized
cttgcacatcaacttctcca

SEQ ID NO: 277871 - DNA, 20 bp, Artificial Sequence
  chemically synthesized
gccttgcacatcaacttctc

SEQ ID NO: 277872 - DNA, 20 bp, Artificial Sequence
  chemically synthesized
ctctggagaagttgatgtgc

SEQ ID NO: 277873 - DNA, 20 bp, Artificial Sequence
  chemically synthesized
tctggagaagttgatgtgca

SEQ ID NO: 277874 - DNA, 20 bp, Artificial Sequence
  chemically synthesized
agaagttgatgtgcaaggca

SEQ ID NO: 277875 - DNA, 20 bp, Artificial Sequence
  chemically synthesized
tgcaaggcacagtatgctta

SEQ ID NO: 277876 - DNA, 20 bp, Artificial Sequence
  chemically synthesized
gtaagatgacaggaagccat

SEQ ID NO: 277877 - DNA, 20 bp, Artificial Sequence
  chemically synthesized
tggataagtaagatgacagg

SEQ ID NO: 277878 - DNA, 20 bp, Artificial Sequence
  chemically synthesized
gtgtggataagtaagatgac

SEQ ID NO: 277879 - DNA, 20 bp, Artificial Sequence
  chemically synthesized
agtgtggataagtaagatga

SEQ ID NO: 277880 - DNA, 20 bp, Artificial Sequence
  chemically synthesized
tcaatgtagtgtggataagt

SEQ ID NO: 277881 - DNA, 20 bp, Artificial Sequence
  chemically synthesized
tttttcaatgtagtgtggat

SEQ ID NO: 277882 - DNA, 20 bp, Artificial Sequence
  chemically synthesized
aggactttttcaatgtagtg

SEQ ID NO: 277883 - DNA, 20 bp, Artificial Sequence
  chemically synthesized
acctgaggactttttcaatg

SEQ ID NO: 277884 - DNA, 20 bp, Artificial Sequence
  chemically synthesized
ttatccacactacattgaaa

SEQ ID NO: 277885 - DNA, 20 bp, Artificial Sequence
  chemically synthesized
cactacattgaaaaagtcct

SEQ ID NO: 277886 - DNA, 20 bp, Artificial Sequence
  chemically synthesized
actacattgaaaaagtcctc

SEQ ID NO: 277887 - DNA, 20 bp, Artificial Sequence
  chemically synthesized
attgaaaaagtcctcaggtc

SEQ ID NO: 277888 - DNA, 20 bp, Artificial Sequence
  chemically synthesized
tactgactgagctagacctg

SEQ ID NO: 277889 - DNA, 20 bp, Artificial Sequence
  chemically synthesized
atactgactgagctagacct

SEQ ID NO: 277890 - DNA, 20 bp, Artificial Sequence
  chemically synthesized
aaaagtcctcaggtctagct

SEQ ID NO: 277891 - DNA, 20 bp, Artificial Sequence
  chemically synthesized
gtcctcaggtctagctcagt

SEQ ID NO: 277892 - DNA, 20 bp, Artificial Sequence
  chemically synthesized
aatgtagatactgactgagc

SEQ ID NO: 277893 - DNA, 20 bp, Artificial Sequence
  chemically synthesized
caataatgtagatactgact

SEQ ID NO: 277894 - DNA, 20 bp, Artificial Sequence
  chemically synthesized
aaccttaggacacaataatg

SEQ ID NO: 277895 - DNA, 20 bp, Artificial Sequence
  chemically synthesized
tatctacattattgtgtcct

SEQ ID NO: 277896 - DNA, 20 bp, Artificial Sequence
  chemically synthesized
atctacattattgtgtccta

SEQ ID NO: 277897 - DNA, 20 bp, Artificial Sequence
  chemically synthesized
gaaaaccttgtaataacctt

SEQ ID NO: 277898 - DNA, 20 bp, Artificial Sequence
  chemically synthesized
agaaaaccttgtaataacct

SEQ ID NO: 277899 - DNA, 20 bp, Artificial Sequence
  chemically synthesized
ttgtgtcctaaggttattac

SEQ ID NO: 277900 - DNA, 20 bp, Artificial Sequence
  chemically synthesized
tgtgtcctaaggttattaca

SEQ ID NO: 277901 - DNA, 20 bp, Artificial Sequence
  chemically synthesized
caacttggaggacaaaatat

SEQ ID NO: 277902 - DNA, 20 bp, Artificial Sequence
  chemically synthesized
tttctaatattttgtcctcc

SEQ ID NO: 277903 - DNA, 20 bp, Artificial Sequence
  chemically synthesized
tgtctatcctaacaacttgg

SEQ ID NO: 277904 - DNA, 20 bp, Artificial Sequence
  chemically synthesized
ttgtctatcctaacaacttg

SEQ ID NO: 277905 - DNA, 20 bp, Artificial Sequence
  chemically synthesized
tattttgtcctccaagttgt

SEQ ID NO: 277906 - DNA, 20 bp, Artificial Sequence
  chemically synthesized
attttgtcctccaagttgtt

SEQ ID NO: 277907 - DNA, 20 bp, Artificial Sequence
  chemically synthesized
tcttgtctatcctaacaact

SEQ ID NO: 277908 - DNA, 20 bp, Artificial Sequence
  chemically synthesized
tgtcctccaagttgttagga

SEQ ID NO: 277909 - DNA, 20 bp, Artificial Sequence
  chemically synthesized
tccaagttgttaggatagac

SEQ ID NO: 277910 - DNA, 20 bp, Artificial Sequence
  chemically synthesized
tgttaggatagacaagactg

SEQ ID NO: 277911 - DNA, 20 bp, Artificial Sequence
  chemically synthesized
agttcttttctacaaaactg

SEQ ID NO: 277912 - DNA, 20 bp, Artificial Sequence
  chemically synthesized
tagacaagactgcagttttg

SEQ ID NO: 277913 - DNA, 20 bp, Artificial Sequence
  chemically synthesized
aagactgcagttttgtagaa

SEQ ID NO: 277914 - DNA, 20 bp, Artificial Sequence
  chemically synthesized
ttgtagaaaagaactcctac

SEQ ID NO: 277915 - DNA, 20 bp, Artificial Sequence
  chemically synthesized
tgtagaaaagaactcctacc

SEQ ID NO: 277916 - DNA, 20 bp, Artificial Sequence
  chemically synthesized
agagccaaagatcctggtag

SEQ ID NO: 277917 - DNA, 20 bp, Artificial Sequence
  chemically synthesized
tcagagccaaagatcctggt

SEQ ID NO: 277918 - DNA, 20 bp, Artificial Sequence
  chemically synthesized
atcagagccaaagatcctgg

SEQ ID NO: 277919 - DNA, 20 bp, Artificial Sequence
  chemically synthesized
agaactcctaccaggatctt

SEQ ID NO: 277920 - DNA, 20 bp, Artificial Sequence
  chemically synthesized
catatcagagccaaagatcc

SEQ ID NO: 277921 - DNA, 20 bp, Artificial Sequence
  chemically synthesized
aatgaatcatatcagagcca

SEQ ID NO: 277922 - DNA, 20 bp, Artificial Sequence
  chemically synthesized
catccaaatgaatcatatca

SEQ ID NO: 277923 - DNA, 20 bp, Artificial Sequence
  chemically synthesized
cccatccaaatgaatcatat

SEQ ID NO: 277924 - DNA, 20 bp, Artificial Sequence
  chemically synthesized
tggctctgatatgattcatt

SEQ ID NO: 277925 - DNA, 20 bp, Artificial Sequence
  chemically synthesized
tctgatatgattcatttgga

SEQ ID NO: 277926 - DNA, 20 bp, Artificial Sequence
  chemically synthesized
ctgatatgattcatttggat

SEQ ID NO: 277927 - DNA, 20 bp, Artificial Sequence
  chemically synthesized
gatgggatgtgcaccttgaa

SEQ ID NO: 277928 - DNA, 20 bp, Artificial Sequence
  chemically synthesized
gggatgtgcaccttgaacag

SEQ ID NO: 277929 - DNA, 20 bp, Artificial Sequence
  chemically synthesized
caccatgttcctgctgttca

SEQ ID NO: 277930 - DNA, 20 bp, Artificial Sequence
  chemically synthesized
ggatgtgcaccttgaacagc

SEQ ID NO: 277931 - DNA, 20 bp, Artificial Sequence
  chemically synthesized
acaccatgttcctgctgttc

SEQ ID NO: 277932 - DNA, 20 bp, Artificial Sequence
  chemically synthesized
caccttgaacagcaggaaca

SEQ ID NO: 277933 - DNA, 20 bp, Artificial Sequence
  chemically synthesized
aacagcaggaacatggtgta

SEQ ID NO: 277934 - DNA, 20 bp, Artificial Sequence
  chemically synthesized
caggaacatggtgtatggaa

SEQ ID NO: 277935 - DNA, 20 bp, Artificial Sequence
  chemically synthesized
ttcgaaagcagaaggaaaag

SEQ ID NO: 277936 - DNA, 20 bp, Artificial Sequence
  chemically synthesized
tgtttcgaaagcagaaggaa

SEQ ID NO: 277937 - DNA, 20 bp, Artificial Sequence
  chemically synthesized
cagaatgtttcgaaagcaga

SEQ ID NO: 277938 - DNA, 20 bp, Artificial Sequence
  chemically synthesized
acagaatgtttcgaaagcag

SEQ ID NO: 277939 - DNA, 20 bp, Artificial Sequence
  chemically synthesized
tatacagaatgtttcgaaag

SEQ ID NO: 277940 - DNA, 20 bp, Artificial Sequence
  chemically synthesized
cactatacagaatgtttcga

SEQ ID NO: 277941 - DNA, 20 bp, Artificial Sequence
  chemically synthesized
tgctttcgaaacattctgta

SEQ ID NO: 277942 - DNA, 20 bp, Artificial Sequence
  chemically synthesized
cctactcctaaagcactata

SEQ ID NO: 277943 - DNA, 20 bp, Artificial Sequence
  chemically synthesized
aaacattctgtatagtgctt

SEQ ID NO: 277944 - DNA, 20 bp, Artificial Sequence
  chemically synthesized
aacattctgtatagtgcttt

SEQ ID NO: 277945 - DNA, 20 bp, Artificial Sequence
  chemically synthesized
cattctgtatagtgctttag

SEQ ID NO: 277946 - DNA, 20 bp, Artificial Sequence
  chemically synthesized
tctgtatagtgctttaggag

SEQ ID NO: 277947 - DNA, 20 bp, Artificial Sequence
  chemically synthesized
ctgtatagtgctttaggagt

SEQ ID NO: 277948 - DNA, 20 bp, Artificial Sequence
  chemically synthesized
gcactcccaacctactccta

SEQ ID NO: 277949 - DNA, 20 bp, Artificial Sequence
  chemically synthesized
atagtgctttaggagtaggt

SEQ ID NO: 277950 - DNA, 20 bp, Artificial Sequence
  chemically synthesized
tagtgctttaggagtaggtt

SEQ ID NO: 277951 - DNA, 20 bp, Artificial Sequence
  chemically synthesized
gtgctttaggagtaggttgg

SEQ ID NO: 277952 - DNA, 20 bp, Artificial Sequence
  chemically synthesized
ttaggagtaggttgggagtg

SEQ ID NO: 277953 - DNA, 20 bp, Artificial Sequence
  chemically synthesized
gagtaggttgggagtgcaga

SEQ ID NO: 277954 - DNA, 20 bp, Artificial Sequence
  chemically synthesized
ctatgctcatataaacacac

SEQ ID NO: 277955 - DNA, 20 bp, Artificial Sequence
  chemically synthesized
gatgactcgtgtgtttatat

SEQ ID NO: 277956 - DNA, 20 bp, Artificial Sequence
  chemically synthesized
ctcgtgtgtttatatgagca

SEQ ID NO: 277957 - DNA, 20 bp, Artificial Sequence
  chemically synthesized
tcgtgtgtttatatgagcat

SEQ ID NO: 277958 - DNA, 20 bp, Artificial Sequence
  chemically synthesized
cgtgtgtttatatgagcata

SEQ ID NO: 277959 - DNA, 20 bp, Artificial Sequence
  chemically synthesized
gtttatatgagcatagggaa

SEQ ID NO: 277960 - DNA, 20 bp, Artificial Sequence
  chemically synthesized
catagggaacagataaacac

SEQ ID NO: 277961 - DNA, 20 bp, Artificial Sequence
  chemically synthesized
agggaacagataaacactgg

SEQ ID NO: 277962 - DNA, 20 bp, Artificial Sequence
  chemically synthesized
attgtaatgcatcattctgc

SEQ ID NO: 277963 - DNA, 20 bp, Artificial Sequence
  chemically synthesized
ttacaatcgattccttgtta

SEQ ID NO: 277964 - DNA, 20 bp, Artificial Sequence
  chemically synthesized
gatgaccctagtctgtaaca

SEQ ID NO: 277965 - DNA, 20 bp, Artificial Sequence
  chemically synthesized
agatgaccctagtctgtaac

SEQ ID NO: 277966 - DNA, 20 bp, Artificial Sequence
  chemically synthesized
atcgattccttgttacagac

SEQ ID NO: 277967 - DNA, 20 bp, Artificial Sequence
  chemically synthesized
tcgattccttgttacagact

SEQ ID NO: 277968 - DNA, 20 bp, Artificial Sequence
  chemically synthesized
cgattccttgttacagacta

SEQ ID NO: 277969 - DNA, 20 bp, Artificial Sequence
  chemically synthesized
cattttgtggcagatgaccc

SEQ ID NO: 277970 - DNA, 20 bp, Artificial Sequence
  chemically synthesized
attgtaagaacattttgtgg

SEQ ID NO: 277971 - DNA, 20 bp, Artificial Sequence
  chemically synthesized
tgtattgtaagaacattttg

SEQ ID NO: 277972 - DNA, 20 bp, Artificial Sequence
  chemically synthesized
cagcaagcttaatgtattgt

SEQ ID NO: 277973 - DNA, 20 bp, Artificial Sequence
  chemically synthesized
aaatgttcttacaatacatt

SEQ ID NO: 277974 - DNA, 20 bp, Artificial Sequence
  chemically synthesized
atacattaagcttgctgaaa

SEQ ID NO: 277975 - DNA, 20 bp, Artificial Sequence
  chemically synthesized
cagtttatttctatttcagc

SEQ ID NO: 277976 - DNA, 20 bp, Artificial Sequence
  chemically synthesized
gaaccagtttatttctattt

SEQ ID NO: 277977 - DNA, 20 bp, Artificial Sequence
  chemically synthesized
ttgctgaaatagaaataaac

SEQ ID NO: 277978 - DNA, 20 bp, Artificial Sequence
  chemically synthesized
gaagagaggaagtttggaac

SEQ ID NO: 277979 - DNA, 20 bp, Artificial Sequence
  chemically synthesized
catagagaagagaggaagtt

SEQ ID NO: 277980 - DNA, 20 bp, Artificial Sequence
  chemically synthesized
gaggacatagagaagagagg

SEQ ID NO: 277981 - DNA, 20 bp, Artificial Sequence
  chemically synthesized
ggtgaggacatagagaagag

SEQ ID NO: 277982 - DNA, 20 bp, Artificial Sequence
  chemically synthesized
gggtgaggacatagagaaga

SEQ ID NO: 277983 - DNA, 20 bp, Artificial Sequence
  chemically synthesized
tggggtgaggacatagagaa

SEQ ID NO: 277984 - DNA, 20 bp, Artificial Sequence
  chemically synthesized
tgtggggtgaggacatagag

SEQ ID NO: 277985 - DNA, 20 bp, Artificial Sequence
  chemically synthesized
cattgtggggtgaggacata

SEQ ID NO: 277986 - DNA, 20 bp, Artificial Sequence
  chemically synthesized
gccattgtggggtgaggaca

SEQ ID NO: 277987 - DNA, 20 bp, Artificial Sequence
  chemically synthesized
gaagatgccattgtggggtg

SEQ ID NO: 277988 - DNA, 20 bp, Artificial Sequence
  chemically synthesized
agaagatgccattgtggggt

SEQ ID NO: 277989 - DNA, 20 bp, Artificial Sequence
  chemically synthesized
tctatgtcctcaccccacaa

SEQ ID NO: 277990 - DNA, 20 bp, Artificial Sequence
  chemically synthesized
gatgagaagatgccattgtg

SEQ ID NO: 277991 - DNA, 20 bp, Artificial Sequence
  chemically synthesized
cgatgagaagatgccattgt

SEQ ID NO: 277992 - DNA, 20 bp, Artificial Sequence
  chemically synthesized
acgatgagaagatgccattg

SEQ ID NO: 277993 - DNA, 20 bp, Artificial Sequence
  chemically synthesized
tttcatctatagacgatgag

SEQ ID NO: 277994 - DNA, 20 bp, Artificial Sequence
  chemically synthesized
gggtttcatctatagacgat

SEQ ID NO: 277995 - DNA, 20 bp, Artificial Sequence
  chemically synthesized
tggcatcttctcatcgtcta

SEQ ID NO: 277996 - DNA, 20 bp, Artificial Sequence
  chemically synthesized
agcacgatgggtttcatcta

SEQ ID NO: 277997 - DNA, 20 bp, Artificial Sequence
  chemically synthesized
atagatgaaacccatcgtgc

SEQ ID NO: 277998 - DNA, 20 bp, Artificial Sequence
  chemically synthesized
ccaaataattccagcacgat

SEQ ID NO: 277999 - DNA, 20 bp, Artificial Sequence
  chemically synthesized
gccaaataattccagcacga

SEQ ID NO: 278000 - DNA, 20 bp, Artificial Sequence
  chemically synthesized
tctcccatgccaaataattc

SEQ ID NO: 278001 - DNA, 20 bp, Artificial Sequence
  chemically synthesized
cccatcgtgctggaattatt

SEQ ID NO: 278002 - DNA, 20 bp, Artificial Sequence
  chemically synthesized
cgtgctggaattatttggca

SEQ ID NO: 278003 - DNA, 20 bp, Artificial Sequence
  chemically synthesized
gtgctggaattatttggcat

SEQ ID NO: 278004 - DNA, 20 bp, Artificial Sequence
  chemically synthesized
gctggaattatttggcatgg

SEQ ID NO: 278005 - DNA, 20 bp, Artificial Sequence
  chemically synthesized
ggaattatttggcatgggag

SEQ ID NO: 278006 - DNA, 20 bp, Artificial Sequence
  chemically synthesized
tggcatgggagaagaataaa

SEQ ID NO: 278007 - DNA, 20 bp, Artificial Sequence
  chemically synthesized
ggcatgggagaagaataaac

SEQ ID NO: 278008 - DNA, 20 bp, Artificial Sequence
  chemically synthesized
gagaagaataaacaggtttc

SEQ ID NO: 278009 - DNA, 20 bp, Artificial Sequence
  chemically synthesized
tacaagttaaagcgtcacac

SEQ ID NO: 278010 - DNA, 20 bp, Artificial Sequence
  chemically synthesized
cggtgtgacgctttaacttg

SEQ ID NO: 278011 - DNA, 20 bp, Artificial Sequence
  chemically synthesized
tttaacaatcctacaagtta

SEQ ID NO: 278012 - DNA, 20 bp, Artificial Sequence
  chemically synthesized
ggtgtgacgctttaacttgt

SEQ ID NO: 278013 - DNA, 20 bp, Artificial Sequence
  chemically synthesized
gacaagtttaacaatcctac

SEQ ID NO: 278014 - DNA, 20 bp, Artificial Sequence
  chemically synthesized
agctatatctgaggtatgac

SEQ ID NO: 278015 - DNA, 20 bp, Artificial Sequence
  chemically synthesized
ttgttaaacttgtcatacct

SEQ ID NO: 278016 - DNA, 20 bp, Artificial Sequence
  chemically synthesized
aacttgtcatacctcagata

SEQ ID NO: 278017 - DNA, 20 bp, Artificial Sequence
  chemically synthesized
ttaatcttcagctatatctg

SEQ ID NO: 278018 - DNA, 20 bp, Artificial Sequence
  chemically synthesized
cttaatcttcagctatatct

SEQ ID NO: 278019 - DNA, 20 bp, Artificial Sequence
  chemically synthesized
tcatacctcagatatagctg

SEQ ID NO: 278020 - DNA, 20 bp, Artificial Sequence
  chemically synthesized
ctcagatatagctgaagatt

SEQ ID NO: 278021 - DNA, 20 bp, Artificial Sequence
  chemically synthesized
attgtccacatcttaatctt

SEQ ID NO: 278022 - DNA, 20 bp, Artificial Sequence
  chemically synthesized
tatagctgaagattaagatg

SEQ ID NO: 278023 - DNA, 20 bp, Artificial Sequence
  chemically synthesized
taagatgtggacaatgccta

SEQ ID NO: 278024 - DNA, 20 bp, Artificial Sequence
  chemically synthesized
aagcagtcctgcatggctgt

SEQ ID NO: 278025 - DNA, 20 bp, Artificial Sequence
  chemically synthesized
taagcagtcctgcatggctg

SEQ ID NO: 278026 - DNA, 20 bp, Artificial Sequence
  chemically synthesized
ggacaatgcctacagccatg

SEQ ID NO: 278027 - DNA, 20 bp, Artificial Sequence
  chemically synthesized
gacaatgcctacagccatgc

SEQ ID NO: 278028 - DNA, 20 bp, Artificial Sequence
  chemically synthesized
agatgctaagcagtcctgca

SEQ ID NO: 278029 - DNA, 20 bp, Artificial Sequence
  chemically synthesized
tacagccatgcaggactgct

SEQ ID NO: 278030 - DNA, 20 bp, Artificial Sequence
  chemically synthesized
cctgtggggaagatgctaag

SEQ ID NO: 278031 - DNA, 20 bp, Artificial Sequence
  chemically synthesized
cttcctgtggggaagatgct

SEQ ID NO: 278032 - DNA, 20 bp, Artificial Sequence
  chemically synthesized
actgcttagcatcttcccca

SEQ ID NO: 278033 - DNA, 20 bp, Artificial Sequence
  chemically synthesized
ctgcttagcatcttccccac

SEQ ID NO: 278034 - DNA, 20 bp, Artificial Sequence
  chemically synthesized
aacagatacttcctgtgggg

SEQ ID NO: 278035 - DNA, 20 bp, Artificial Sequence
  chemically synthesized
cttagcatcttccccacagg

SEQ ID NO: 278036 - DNA, 20 bp, Artificial Sequence
  chemically synthesized
cggaacagatacttcctgtg

SEQ ID NO: 278037 - DNA, 20 bp, Artificial Sequence
  chemically synthesized
acggaacagatacttcctgt

SEQ ID NO: 278038 - DNA, 20 bp, Artificial Sequence
  chemically synthesized
gacggaacagatacttcctg

SEQ ID NO: 278039 - DNA, 20 bp, Artificial Sequence
  chemically synthesized
gaaccacaatgttgacggaa

SEQ ID NO: 278040 - DNA, 20 bp, Artificial Sequence
  chemically synthesized
cacccgaaccacaatgttga

SEQ ID NO: 278041 - DNA, 20 bp, Artificial Sequence
  chemically synthesized
tatctgttccgtcaacattg

SEQ ID NO: 278042 - DNA, 20 bp, Artificial Sequence
  chemically synthesized
gttccgtcaacattgtggtt

SEQ ID NO: 278043 - DNA, 20 bp, Artificial Sequence
  chemically synthesized
ttccgtcaacattgtggttc

SEQ ID NO: 278044 - DNA, 20 bp, Artificial Sequence
  chemically synthesized
gtcaacattgtggttcgggt

SEQ ID NO: 278045 - DNA, 20 bp, Artificial Sequence
  chemically synthesized
tcaacattgtggttcgggtg

SEQ ID NO: 278046 - DNA, 20 bp, Artificial Sequence
  chemically synthesized
caacattgtggttcgggtga

SEQ ID NO: 278047 - DNA, 20 bp, Artificial Sequence
  chemically synthesized
acattgtggttcgggtgagg

SEQ ID NO: 278048 - DNA, 20 bp, Artificial Sequence
  chemically synthesized
attgtggttcgggtgaggga

SEQ ID NO: 278049 - DNA, 20 bp, Artificial Sequence
  chemically synthesized
tgtggttcgggtgagggaga

SEQ ID NO: 278050 - DNA, 20 bp, Artificial Sequence
  chemically synthesized
gtggttcgggtgagggagag

SEQ ID NO: 278051 - DNA, 20 bp, Artificial Sequence
  chemically synthesized
ggagagaggtaatatataat

SEQ ID NO: 278052 - DNA, 20 bp, Artificial Sequence
  chemically synthesized
gagagaggtaatatataatg

SEQ ID NO: 278053 - DNA, 20 bp, Artificial Sequence
  chemically synthesized
gtaatatataatgaggatcc

SEQ ID NO: 278054 - DNA, 20 bp, Artificial Sequence
  chemically synthesized
gacacggaaagggcatcact

SEQ ID NO: 278055 - DNA, 20 bp, Artificial Sequence
  chemically synthesized
tgacacggaaagggcatcac

SEQ ID NO: 278056 - DNA, 20 bp, Artificial Sequence
  chemically synthesized
gatttttgatgacacggaaa

SEQ ID NO: 278057 - DNA, 20 bp, Artificial Sequence
  chemically synthesized
agatttttgatgacacggaa

SEQ ID NO: 278058 - DNA, 20 bp, Artificial Sequence
  chemically synthesized
cagatttttgatgacacgga

SEQ ID NO: 278059 - DNA, 20 bp, Artificial Sequence
  chemically synthesized
gcagcagatttttgatgaca

SEQ ID NO: 278060 - DNA, 20 bp, Artificial Sequence
  chemically synthesized
gtgtcatcaaaaatctgctg

SEQ ID NO: 278061 - DNA, 20 bp, Artificial Sequence
  chemically synthesized
cgctttctaggaaactgcag

SEQ ID NO: 278062 - DNA, 20 bp, Artificial Sequence
  chemically synthesized
gaacgctttctaggaaactg

SEQ ID NO: 278063 - DNA, 20 bp, Artificial Sequence
  chemically synthesized
aaaaatctgctgcagtttcc

SEQ ID NO: 278064 - DNA, 20 bp, Artificial Sequence
  chemically synthesized
atctgctgcagtttcctaga

SEQ ID NO: 278065 - DNA, 20 bp, Artificial Sequence
  chemically synthesized
aagtagaatgaacgctttct

SEQ ID NO: 278066 - DNA, 20 bp, Artificial Sequence
  chemically synthesized
gaagtagaatgaacgctttc

SEQ ID NO: 278067 - DNA, 20 bp, Artificial Sequence
  chemically synthesized
agaaagcgttcattctactt

SEQ ID NO: 278068 - DNA, 20 bp, Artificial Sequence
  chemically synthesized
aagcgttcattctacttcag

SEQ ID NO: 278069 - DNA, 20 bp, Artificial Sequence
  chemically synthesized
agcgttcattctacttcagc

SEQ ID NO: 278070 - DNA, 20 bp, Artificial Sequence
  chemically synthesized
gccatagttccctgctgaag

SEQ ID NO: 278071 - DNA, 20 bp, Artificial Sequence
  chemically synthesized
gcgttcattctacttcagca

SEQ ID NO: 278072 - DNA, 20 bp, Artificial Sequence
  chemically synthesized
acagccatagttccctgctg

SEQ ID NO: 278073 - DNA, 20 bp, Artificial Sequence
  chemically synthesized
tctacttcagcagggaacta

SEQ ID NO: 278074 - DNA, 20 bp, Artificial Sequence
  chemically synthesized
gtggttttccttcacagcca

SEQ ID NO: 278075 - DNA, 20 bp, Artificial Sequence
  chemically synthesized
agcagggaactatggctgtg

SEQ ID NO: 278076 - DNA, 20 bp, Artificial Sequence
  chemically synthesized
gcagggaactatggctgtga

SEQ ID NO: 278077 - DNA, 20 bp, Artificial Sequence
  chemically synthesized
gaaaaagtggttttccttca

SEQ ID NO: 278078 - DNA, 20 bp, Artificial Sequence
  chemically synthesized
aaaccaagcagaggaaaaag

SEQ ID NO: 278079 - DNA, 20 bp, Artificial Sequence
  chemically synthesized
actaaaccaagcagaggaaa

SEQ ID NO: 278080 - DNA, 20 bp, Artificial Sequence
  chemically synthesized
aaaccactttttcctctgct

SEQ ID NO: 278081 - DNA, 20 bp, Artificial Sequence
  chemically synthesized
tcaacaactaaaccaagcag

SEQ ID NO: 278082 - DNA, 20 bp, Artificial Sequence
  chemically synthesized
ctcaacaactaaaccaagca

SEQ ID NO: 278083 - DNA, 20 bp, Artificial Sequence
  chemically synthesized
actttttcctctgcttggtt

SEQ ID NO: 278084 - DNA, 20 bp, Artificial Sequence
  chemically synthesized
tcctcaacaactaaaccaag

SEQ ID NO: 278085 - DNA, 20 bp, Artificial Sequence
  chemically synthesized
aattcctcaacaactaaacc

SEQ ID NO: 278086 - DNA, 20 bp, Artificial Sequence
  chemically synthesized
ctctgcttggtttagttgtt

SEQ ID NO: 278087 - DNA, 20 bp, Artificial Sequence
  chemically synthesized
tctgcttggtttagttgttg

SEQ ID NO: 278088 - DNA, 20 bp, Artificial Sequence
  chemically synthesized
tggtttagttgttgaggaat

SEQ ID NO: 278089 - DNA, 20 bp, Artificial Sequence
  chemically synthesized
ttagttgttgaggaattgga

SEQ ID NO: 278090 - DNA, 20 bp, Artificial Sequence
  chemically synthesized
tagttgttgaggaattggaa

SEQ ID NO: 278091 - DNA, 20 bp, Artificial Sequence
  chemically synthesized
gttgttgaggaattggaaag

SEQ ID NO: 278092 - DNA, 20 bp, Artificial Sequence
  chemically synthesized
ttggaaaggagcttcatttc

SEQ ID NO: 278093 - DNA, 20 bp, Artificial Sequence
  chemically synthesized
atctctgtattccagaaatg

SEQ ID NO: 278094 - DNA, 20 bp, Artificial Sequence
  chemically synthesized
ggagcttcatttctggaata

SEQ ID NO: 278095 - DNA, 20 bp, Artificial Sequence
  chemically synthesized
agcttcatttctggaataca

SEQ ID NO: 278096 - DNA, 20 bp, Artificial Sequence
  chemically synthesized
gatagatgatctctgtattc

SEQ ID NO: 278097 - DNA, 20 bp, Artificial Sequence
  chemically synthesized
caaccactgctcatgacaga

SEQ ID NO: 278098 - DNA, 20 bp, Artificial Sequence
  chemically synthesized
agagatcatctatctgtcat

SEQ ID NO: 278099 - DNA, 20 bp, Artificial Sequence
  chemically synthesized
gatcatctatctgtcatgag

SEQ ID NO: 278100 - DNA, 20 bp, Artificial Sequence
  chemically synthesized
tgcccaaccactgctcatga

SEQ ID NO: 278101 - DNA, 20 bp, Artificial Sequence
  chemically synthesized
catctatctgtcatgagcag

SEQ ID NO: 278102 - DNA, 20 bp, Artificial Sequence
  chemically synthesized
tatctgtcatgagcagtggt

SEQ ID NO: 278103 - DNA, 20 bp, Artificial Sequence
  chemically synthesized
atctgtcatgagcagtggtt

SEQ ID NO: 278104 - DNA, 20 bp, Artificial Sequence
  chemically synthesized
gtcatgagcagtggttgggc

SEQ ID NO: 278105 - DNA, 20 bp, Artificial Sequence
  chemically synthesized
gttgggcaagaataaattac

SEQ ID NO: 278106 - DNA, 20 bp, Artificial Sequence
  chemically synthesized
aagaataaattactggtcca

SEQ ID NO: 278107 - DNA, 20 bp, Artificial Sequence
  chemically synthesized
ggttcattcccactgtggac

SEQ ID NO: 278108 - DNA, 20 bp, Artificial Sequence
  chemically synthesized
aataaattactggtccacag

SEQ ID NO: 278109 - DNA, 20 bp, Artificial Sequence
  chemically synthesized
ataaattactggtccacagt

SEQ ID NO: 278110 - DNA, 20 bp, Artificial Sequence
  chemically synthesized
tgtcaggttcattcccactg

SEQ ID NO: 278111 - DNA, 20 bp, Artificial Sequence
  chemically synthesized
gctaaggtgcattatgtgtc

SEQ ID NO: 278112 - DNA, 20 bp, Artificial Sequence
  chemically synthesized
tgctaaggtgcattatgtgt

SEQ ID NO: 278113 - DNA, 20 bp, Artificial Sequence
  chemically synthesized
acctgacacataatgcacct

SEQ ID NO: 278114 - DNA, 20 bp, Artificial Sequence
  chemically synthesized
acacataatgcaccttagca

SEQ ID NO: 278115 - DNA, 20 bp, Artificial Sequence
  chemically synthesized
gtataaggtgcactttgcta

SEQ ID NO: 278116 - DNA, 20 bp, Artificial Sequence
  chemically synthesized
tgtataaggtgcactttgct

SEQ ID NO: 278117 - DNA, 20 bp, Artificial Sequence
  chemically synthesized
cctttatcagcacatgtata

SEQ ID NO: 278118 - DNA, 20 bp, Artificial Sequence
  chemically synthesized
acctttatcagcacatgtat

SEQ ID NO: 278119 - DNA, 20 bp, Artificial Sequence
  chemically synthesized
accttatacatgtgctgata

SEQ ID NO: 278120 - DNA, 20 bp, Artificial Sequence
  chemically synthesized
ccttatacatgtgctgataa

SEQ ID NO: 278121 - DNA, 20 bp, Artificial Sequence
  chemically synthesized
cagtctagatagacctttat

SEQ ID NO: 278122 - DNA, 20 bp, Artificial Sequence
  chemically synthesized
tgtgctgataaaggtctatc

SEQ ID NO: 278123 - DNA, 20 bp, Artificial Sequence
  chemically synthesized
tgataaaggtctatctagac

SEQ ID NO: 278124 - DNA, 20 bp, Artificial Sequence
  chemically synthesized
tttgtgaaccccagtctaga

SEQ ID NO: 278125 - DNA, 20 bp, Artificial Sequence
  chemically synthesized
gataaaggtctatctagact

SEQ ID NO: 278126 - DNA, 20 bp, Artificial Sequence
  chemically synthesized
ataaaggtctatctagactg

SEQ ID NO: 278127 - DNA, 20 bp, Artificial Sequence
  chemically synthesized
caggtttgtgaaccccagtc

SEQ ID NO: 278128 - DNA, 20 bp, Artificial Sequence
  chemically synthesized
ttattcaggtttgtgaaccc

SEQ ID NO: 278129 - DNA, 20 bp, Artificial Sequence
  chemically synthesized
gttcattctgatgattattc

SEQ ID NO: 278130 - DNA, 20 bp, Artificial Sequence
  chemically synthesized
agttcattctgatgattatt

SEQ ID NO: 278131 - DNA, 20 bp, Artificial Sequence
  chemically synthesized
tcacaaacctgaataatcat

SEQ ID NO: 278132 - DNA, 20 bp, Artificial Sequence
  chemically synthesized
gctgagaactgtatttggaa

SEQ ID NO: 278133 - DNA, 20 bp, Artificial Sequence
  chemically synthesized
agaatgaacttttccaaata

SEQ ID NO: 278134 - DNA, 20 bp, Artificial Sequence
  chemically synthesized
ttgaggctgagaactgtatt

SEQ ID NO: 278135 - DNA, 20 bp, Artificial Sequence
  chemically synthesized
acttttccaaatacagttct

SEQ ID NO: 278136 - DNA, 20 bp, Artificial Sequence
  chemically synthesized
agtagattttaattgaggct

SEQ ID NO: 278137 - DNA, 20 bp, Artificial Sequence
  chemically synthesized
aatttagtagattttaattg

SEQ ID NO: 278138 - DNA, 20 bp, Artificial Sequence
  chemically synthesized
taatttagtagattttaatt

SEQ ID NO: 278139 - DNA, 20 bp, Artificial Sequence
  chemically synthesized
tcaattaaaatctactaaat

SEQ ID NO: 278140 - DNA, 20 bp, Artificial Sequence
  chemically synthesized
cctctgattttctaatttag

SEQ ID NO: 278141 - DNA, 20 bp, Artificial Sequence
  chemically synthesized
ctccctctgattttctaatt

SEQ ID NO: 278142 - DNA, 20 bp, Artificial Sequence
  chemically synthesized
aatctactaaattagaaaat

SEQ ID NO: 278143 - DNA, 20 bp, Artificial Sequence
  chemically synthesized
tctactaaattagaaaatca

SEQ ID NO: 278144 - DNA, 20 bp, Artificial Sequence
  chemically synthesized
ctactaaattagaaaatcag

SEQ ID NO: 278145 - DNA, 20 bp, Artificial Sequence
  chemically synthesized
tactaaattagaaaatcaga

SEQ ID NO: 278146 - DNA, 20 bp, Artificial Sequence
  chemically synthesized
ctaaattagaaaatcagagg

SEQ ID NO: 278147 - DNA, 20 bp, Artificial Sequence
  chemically synthesized
agaaaatcagagggagtcaa

SEQ ID NO: 278148 - DNA, 20 bp, Artificial Sequence
  chemically synthesized
aaatcagagggagtcaaaag

SEQ ID NO: 278149 - DNA, 20 bp, Artificial Sequence
  chemically synthesized
aatcagagggagtcaaaagt

SEQ ID NO: 278150 - DNA, 20 bp, Artificial Sequence
  chemically synthesized
aagtgggtatgtgtacacca

SEQ ID NO: 278151 - DNA, 20 bp, Artificial Sequence
  chemically synthesized
atagaagaatatagggactt

SEQ ID NO: 278152 - DNA, 20 bp, Artificial Sequence
  chemically synthesized
tacacagatagaagaatata

SEQ ID NO: 278153 - DNA, 20 bp, Artificial Sequence
  chemically synthesized
ttacacagatagaagaatat

SEQ ID NO: 278154 - DNA, 20 bp, Artificial Sequence
  chemically synthesized
attacacagatagaagaata

SEQ ID NO: 278155 - DNA, 20 bp, Artificial Sequence
  chemically synthesized
caccaaaattacacagatag

SEQ ID NO: 278156 - DNA, 20 bp, Artificial Sequence
  chemically synthesized
catcaccaaaattacacaga

SEQ ID NO: 278157 - DNA, 20 bp, Artificial Sequence
  chemically synthesized
agctcatcaccaaaattaca

SEQ ID NO: 278158 - DNA, 20 bp, Artificial Sequence
  chemically synthesized
ttcttctatctgtgtaattt

SEQ ID NO: 278159 - DNA, 20 bp, Artificial Sequence
  chemically synthesized
atctgtgtaattttggtgat

SEQ ID NO: 278160 - DNA, 20 bp, Artificial Sequence
  chemically synthesized
tttggtgatgagctgaaatt

SEQ ID NO: 278161 - DNA, 20 bp, Artificial Sequence
  chemically synthesized
ttcatagaccttctcaattt

SEQ ID NO: 278162 - DNA, 20 bp, Artificial Sequence
  chemically synthesized
ggtgatgagctgaaattgag

SEQ ID NO: 278163 - DNA, 20 bp, Artificial Sequence
  chemically synthesized
gtgatgagctgaaattgaga

SEQ ID NO: 278164 - DNA, 20 bp, Artificial Sequence
  chemically synthesized
tgaaattgagaaggtctatg

SEQ ID NO: 278165 - DNA, 20 bp, Artificial Sequence
  chemically synthesized
ctttctaacttcggtcttca

SEQ ID NO: 278166 - DNA, 20 bp, Artificial Sequence
  chemically synthesized
gagaaggtctatgaagaccg

SEQ ID NO: 278167 - DNA, 20 bp, Artificial Sequence
  chemically synthesized
aggtctatgaagaccgaagt

SEQ ID NO: 278168 - DNA, 20 bp, Artificial Sequence
  chemically synthesized
acatcttttctttctaactt

SEQ ID NO: 278169 - DNA, 20 bp, Artificial Sequence
  chemically synthesized
ctatgaagaccgaagttaga

SEQ ID NO: 278170 - DNA, 20 bp, Artificial Sequence
  chemically synthesized
aagaccgaagttagaaagaa

SEQ ID NO: 278171 - DNA, 20 bp, Artificial Sequence
  chemically synthesized
atttttcgttgttgttattt

SEQ ID NO: 278172 - DNA, 20 bp, Artificial Sequence
  chemically synthesized
ataacaacaacgaaaaataa

SEQ ID NO: 278173 - DNA, 20 bp, Artificial Sequence
  chemically synthesized
taacaacaacgaaaaataac

SEQ ID NO: 278174 - DNA, 20 bp, Artificial Sequence
  chemically synthesized
aacaacgaaaaataacaggt

SEQ ID NO: 278175 - DNA, 20 bp, Artificial Sequence
  chemically synthesized
aacaggtaagaaaatgcaat

SEQ ID NO: 278176 - DNA, 20 bp, Artificial Sequence
  chemically synthesized
ggtaagaaaatgcaatcagt

SEQ ID NO: 278177 - DNA, 20 bp, Artificial Sequence
  chemically synthesized
gtaagaaaatgcaatcagtt

SEQ ID NO: 278178 - DNA, 20 bp, Artificial Sequence
  chemically synthesized
aatgcaatcagttgggctta

SEQ ID NO: 278179 - DNA, 20 bp, Artificial Sequence
  chemically synthesized
tgttcgctcttttttgctgt

SEQ ID NO: 278180 - DNA, 20 bp, Artificial Sequence
  chemically synthesized
cagttgggcttacagcaaaa

SEQ ID NO: 278181 - DNA, 20 bp, Artificial Sequence
  chemically synthesized
gttgggcttacagcaaaaaa

SEQ ID NO: 278182 - DNA, 20 bp, Artificial Sequence
  chemically synthesized
ttacagcaaaaaagagcgaa

SEQ ID NO: 278183 - DNA, 20 bp, Artificial Sequence
  chemically synthesized
cagcaaaaaagagcgaacag

SEQ ID NO: 278184 - DNA, 20 bp, Artificial Sequence
  chemically synthesized
gcaaaaaagagcgaacagta

SEQ ID NO: 278185 - DNA, 20 bp, Artificial Sequence
  chemically synthesized
acagtagagtgctatgaaat

SEQ ID NO: 278186 - DNA, 20 bp, Artificial Sequence
  chemically synthesized
cagcattaataccaatttca

SEQ ID NO: 278187 - DNA, 20 bp, Artificial Sequence
  chemically synthesized
tatgaaattggtattaatgc

SEQ ID NO: 278188 - DNA, 20 bp, Artificial Sequence
  chemically synthesized
aaattggtattaatgctggt

SEQ ID NO: 278189 - DNA, 20 bp, Artificial Sequence
  chemically synthesized
tatgtttcgtatattctgac

SEQ ID NO: 278190 - DNA, 20 bp, Artificial Sequence
  chemically synthesized
tggtcagaatatacgaaaca

SEQ ID NO: 278191 - DNA, 20 bp, Artificial Sequence
  chemically synthesized
cagaatatacgaaacatagt

SEQ ID NO: 278192 - DNA, 20 bp, Artificial Sequence
  chemically synthesized
agaatatacgaaacatagtg

SEQ ID NO: 278193 - DNA, 20 bp, Artificial Sequence
  chemically synthesized
atatacgaaacatagtgagg

SEQ ID NO: 278194 - DNA, 20 bp, Artificial Sequence
  chemically synthesized
gaaacatagtgaggtagaaa

SEQ ID NO: 278195 - DNA, 20 bp, Artificial Sequence
  chemically synthesized
catagtgaggtagaaacagt

SEQ ID NO: 278196 - DNA, 20 bp, Artificial Sequence
  chemically synthesized
atagtgaggtagaaacagta

SEQ ID NO: 278197 - DNA, 20 bp, Artificial Sequence
  chemically synthesized
gaaagtatcaaagaaaattg

SEQ ID NO: 278198 - DNA, 20 bp, Artificial Sequence
  chemically synthesized
ttgaaagtatcaaagaaaat

SEQ ID NO: 278199 - DNA, 20 bp, Artificial Sequence
  chemically synthesized
atttttcattgaaagtatca

SEQ ID NO: 278200 - DNA, 20 bp, Artificial Sequence
  chemically synthesized
tattagtaatttttcattga

SEQ ID NO: 278201 - DNA, 20 bp, Artificial Sequence
  chemically synthesized
cataaaatgcatatatttat

SEQ ID NO: 278202 - DNA, 20 bp, Artificial Sequence
  chemically synthesized
atatgcattttatgatttaa

SEQ ID NO: 278203 - DNA, 20 bp, Artificial Sequence
  chemically synthesized
gcattttatgatttaaaaga

SEQ ID NO: 278204 - DNA, 20 bp, Artificial Sequence
  chemically synthesized
gaggaataaaaatatttttc

SEQ ID NO: 278205 - DNA, 20 bp, Artificial Sequence
  chemically synthesized
cagtgtccctagatggaatg

SEQ ID NO: 278206 - DNA, 20 bp, Artificial Sequence
  chemically synthesized
ccagtgtccctagatggaat

SEQ ID NO: 278207 - DNA, 20 bp, Artificial Sequence
  chemically synthesized
tttttattcctcattccatc

SEQ ID NO: 278208 - DNA, 20 bp, Artificial Sequence
  chemically synthesized
ttttattcctcattccatct

SEQ ID NO: 278209 - DNA, 20 bp, Artificial Sequence
  chemically synthesized
tttattcctcattccatcta

SEQ ID NO: 278210 - DNA, 20 bp, Artificial Sequence
  chemically synthesized
tgtattccagtgtccctaga

SEQ ID NO: 278211 - DNA, 20 bp, Artificial Sequence
  chemically synthesized
ctcattccatctagggacac

SEQ ID NO: 278212 - DNA, 20 bp, Artificial Sequence
  chemically synthesized
gcagtgtattccagtgtccc

SEQ ID NO: 278213 - DNA, 20 bp, Artificial Sequence
  chemically synthesized
catttctttgcagtgtattc

SEQ ID NO: 278214 - DNA, 20 bp, Artificial Sequence
  chemically synthesized
ggacactggaatacactgca

SEQ ID NO: 278215 - DNA, 20 bp, Artificial Sequence
  chemically synthesized
tgttaaacaacatttctttg

SEQ ID NO: 278216 - DNA, 20 bp, Artificial Sequence
  chemically synthesized
aaaaaatgataaatggaaaa

SEQ ID NO: 278217 - DNA, 20 bp, Artificial Sequence
  chemically synthesized
aaaaaaatgataaatggaaa

SEQ ID NO: 278218 - DNA, 20 bp, Artificial Sequence
  chemically synthesized
aaaaaaaatgataaatggaa

SEQ ID NO: 278219 - DNA, 20 bp, Artificial Sequence
  chemically synthesized
tttttaaaaaaaatgataaa

SEQ ID NO: 278220 - DNA, 20 bp, Artificial Sequence
  chemically synthesized
tttaaaaaaataaacatttt

SEQ ID NO: 278221 - DNA, 20 bp, Artificial Sequence
  chemically synthesized
aataaacattttcagaaatt

SEQ ID NO: 278222 - DNA, 20 bp, Artificial Sequence
  chemically synthesized
aaatctgttatttaatattc

SEQ ID NO: 278223 - DNA, 20 bp, Artificial Sequence
  chemically synthesized
caaatctgttatttaatatt

SEQ ID NO: 278224 - DNA, 20 bp, Artificial Sequence
  chemically synthesized
ttggcctgaatattaaataa

SEQ ID NO: 278225 - DNA, 20 bp, Artificial Sequence
  chemically synthesized
agatttgattattcaatctc

SEQ ID NO: 278226 - DNA, 20 bp, Artificial Sequence
  chemically synthesized
aagctacttcatagattctt

SEQ ID NO: 278227 - DNA, 20 bp, Artificial Sequence
  chemically synthesized
ttcaatctcaagaatctatg

SEQ ID NO: 278228 - DNA, 20 bp, Artificial Sequence
  chemically synthesized
aatctcaagaatctatgaag

SEQ ID NO: 278229 - DNA, 20 bp, Artificial Sequence
  chemically synthesized
tttctttgcaagctacttca

SEQ ID NO: 278230 - DNA, 20 bp, Artificial Sequence
  chemically synthesized
aatctatgaagtagcttgca

SEQ ID NO: 278231 - DNA, 20 bp, Artificial Sequence
  chemically synthesized
tttaaaaccgttttctttgc

SEQ ID NO: 278232 - DNA, 20 bp, Artificial Sequence
  chemically synthesized
gaagtagcttgcaaagaaaa

SEQ ID NO: 278233 - DNA, 20 bp, Artificial Sequence
  chemically synthesized
gcaaagaaaacggttttaaa

SEQ ID NO: 278234 - DNA, 20 bp, Artificial Sequence
  chemically synthesized
gaaaacggttttaaaaagtt

SEQ ID NO: 278235 - DNA, 20 bp, Artificial Sequence
  chemically synthesized
aaacggttttaaaaagttga

SEQ ID NO: 278236 - DNA, 20 bp, Artificial Sequence
  chemically synthesized
cggttttaaaaagttgagag

SEQ ID NO: 278237 - DNA, 20 bp, Artificial Sequence
  chemically synthesized
agttgagagtggtaaaacgt

SEQ ID NO: 278238 - DNA, 20 bp, Artificial Sequence
  chemically synthesized
agtggtaaaacgtaagatga

SEQ ID NO: 278239 - DNA, 20 bp, Artificial Sequence
  chemically synthesized
tggtaaaacgtaagatgaaa

SEQ ID NO: 278240 - DNA, 20 bp, Artificial Sequence
  chemically synthesized
gtaaaacgtaagatgaaaga

SEQ ID NO: 278241 - DNA, 20 bp, Artificial Sequence
  chemically synthesized
aaaacgtaagatgaaagaga

SEQ ID NO: 278242 - DNA, 20 bp, Artificial Sequence
  chemically synthesized
gagagatgaatatgtaccct

SEQ ID NO: 278243 - DNA, 20 bp, Artificial Sequence
  chemically synthesized
atgaatatgtaccctcagaa

SEQ ID NO: 278244 - DNA, 20 bp, Artificial Sequence
  chemically synthesized
aacacacaatactgttctga

SEQ ID NO: 278245 - DNA, 20 bp, Artificial Sequence
  chemically synthesized
taacacacaatactgttctg

SEQ ID NO: 278246 - DNA, 20 bp, Artificial Sequence
  chemically synthesized
ataacacacaatactgttct

SEQ ID NO: 278247 - DNA, 20 bp, Artificial Sequence
  chemically synthesized
cagaacagtattgtgtgtta

SEQ ID NO: 278248 - DNA, 20 bp, Artificial Sequence
  chemically synthesized
tattgtgtgttatagaaatt

SEQ ID NO: 278249 - DNA, 20 bp, Artificial Sequence
  chemically synthesized
gtgttatagaaattaagtat

SEQ ID NO: 278250 - DNA, 20 bp, Artificial Sequence
  chemically synthesized
gtattagttgtcaatcatca

SEQ ID NO: 278251 - DNA, 20 bp, Artificial Sequence
  chemically synthesized
tcaatcatcatagataatta

SEQ ID NO: 278252 - DNA, 20 bp, Artificial Sequence
  chemically synthesized
agataattaaagttattgac

SEQ ID NO: 278253 - DNA, 20 bp, Artificial Sequence
  chemically synthesized
tgacaagtttcattaacata

SEQ ID NO: 278254 - DNA, 20 bp, Artificial Sequence
  chemically synthesized
taacataaagatataaactc

SEQ ID NO: 278255 - DNA, 20 bp, Artificial Sequence
  chemically synthesized
aacataaagatataaactcg

SEQ ID NO: 278256 - DNA, 20 bp, Artificial Sequence
  chemically synthesized
ccttttcagaaaaattcctc

SEQ ID NO: 278257 - DNA, 20 bp, Artificial Sequence
  chemically synthesized
actcgaggaatttttctgaa

SEQ ID NO: 278258 - DNA, 20 bp, Artificial Sequence
  chemically synthesized
ctcgaggaatttttctgaaa

SEQ ID NO: 278259 - DNA, 20 bp, Artificial Sequence
  chemically synthesized
agtttatcaatgtacctttt

SEQ ID NO: 278260 - DNA, 20 bp, Artificial Sequence
  chemically synthesized
aggtacattgataaacttaa

SEQ ID NO: 278261 - DNA, 20 bp, Artificial Sequence
  chemically synthesized
gtacattgataaacttaaaa

SEQ ID NO: 278262 - DNA, 20 bp, Artificial Sequence
  chemically synthesized
tggattgaagtttctctttt

SEQ ID NO: 278263 - DNA, 20 bp, Artificial Sequence
  chemically synthesized
agtgataaatttttggattg

SEQ ID NO: 278264 - DNA, 20 bp, Artificial Sequence
  chemically synthesized
gcattttagtgataaatttt

SEQ ID NO: 278265 - DNA, 20 bp, Artificial Sequence
  chemically synthesized
ggattgataaagtagcattt

SEQ ID NO: 278266 - DNA, 20 bp, Artificial Sequence
  chemically synthesized
agtagtatggattgataaag

SEQ ID NO: 278267 - DNA, 20 bp, Artificial Sequence
  chemically synthesized
atcagtagtatggattgata

SEQ ID NO: 278268 - DNA, 20 bp, Artificial Sequence
  chemically synthesized
taaaagctaaatcagtagta

SEQ ID NO: 278269 - DNA, 20 bp, Artificial Sequence
  chemically synthesized
atcaatccatactactgatt

SEQ ID NO: 278270 - DNA, 20 bp, Artificial Sequence
  chemically synthesized
agttgtaaaagctaaatcag

SEQ ID NO: 278271 - DNA, 20 bp, Artificial Sequence
  chemically synthesized
atcagttgtaaaagctaaat

SEQ ID NO: 278272 - DNA, 20 bp, Artificial Sequence
  chemically synthesized
gaaaaactaatcagttgtaa

SEQ ID NO: 278273 - DNA, 20 bp, Artificial Sequence
  chemically synthesized
atttagcttttacaactgat

SEQ ID NO: 278274 - DNA, 20 bp, Artificial Sequence
  chemically synthesized
attaaggccgaaaaactaat

SEQ ID NO: 278275 - DNA, 20 bp, Artificial Sequence
  chemically synthesized
tttacaactgattagttttt

SEQ ID NO: 278276 - DNA, 20 bp, Artificial Sequence
  chemically synthesized
gattagtttttcggccttaa

SEQ ID NO: 278277 - DNA, 20 bp, Artificial Sequence
  chemically synthesized
tacataaaggaaaaccatta

SEQ ID NO: 278278 - DNA, 20 bp, Artificial Sequence
  chemically synthesized
atacataaaggaaaaccatt

SEQ ID NO: 278279 - DNA, 20 bp, Artificial Sequence
  chemically synthesized
aagagggagttaatacataa

SEQ ID NO: 278280 - DNA, 20 bp, Artificial Sequence
  chemically synthesized
aaagagggagttaatacata

SEQ ID NO: 278281 - DNA, 20 bp, Artificial Sequence
  chemically synthesized
agttggaataacaaaagagg

SEQ ID NO: 278282 - DNA, 20 bp, Artificial Sequence
  chemically synthesized
aaagttggaataacaaaaga

SEQ ID NO: 278283 - DNA, 20 bp, Artificial Sequence
  chemically synthesized
taaagttggaataacaaaag

SEQ ID NO: 278284 - DNA, 20 bp, Artificial Sequence
  chemically synthesized
ataaagttggaataacaaaa

SEQ ID NO: 278285 - DNA, 20 bp, Artificial Sequence
  chemically synthesized
taataaagttggaataacaa

SEQ ID NO: 278286 - DNA, 20 bp, Artificial Sequence
  chemically synthesized
aaaaaaaagaataataaagt

SEQ ID NO: 278287 - DNA, 20 bp, Artificial Sequence
  chemically synthesized
aaaaaaaaaaaagaataata

SEQ ID NO: 278288 - DNA, 20 bp, Artificial Sequence
  chemically synthesized
gcctaccaaaaaaaaaaaaa

SEQ ID NO: 278289 - DNA, 20 bp, Artificial Sequence
  chemically synthesized
ttattctttttttttttttt

SEQ ID NO: 278290 - DNA, 20 bp, Artificial Sequence
  chemically synthesized
ttctttttttttttttttgg

SEQ ID NO: 278291 - DNA, 20 bp, Artificial Sequence
  chemically synthesized
tctttttttttttttttggt

SEQ ID NO: 278292 - DNA, 20 bp, Artificial Sequence
  chemically synthesized
ttttttttggtaggcccttg

SEQ ID NO: 278293 - DNA, 20 bp, Artificial Sequence
  chemically synthesized
ttggaatagcttttctacaa

SEQ ID NO: 278294 - DNA, 20 bp, Artificial Sequence
  chemically synthesized
tttggtaggcccttgtagaa

SEQ ID NO: 278295 - DNA, 20 bp, Artificial Sequence
  chemically synthesized
gttggaatagcttttctaca

SEQ ID NO: 278296 - DNA, 20 bp, Artificial Sequence
  chemically synthesized
agttggaatagcttttctac

SEQ ID NO: 278297 - DNA, 20 bp, Artificial Sequence
  chemically synthesized
tatttcttctgaagttggaa

SEQ ID NO: 278298 - DNA, 20 bp, Artificial Sequence
  chemically synthesized
tagaaaagctattccaactt

SEQ ID NO: 278299 - DNA, 20 bp, Artificial Sequence
  chemically synthesized
aaaagctattccaacttcag

SEQ ID NO: 278300 - DNA, 20 bp, Artificial Sequence
  chemically synthesized
tgagttatttcttctgaagt

SEQ ID NO: 278301 - DNA, 20 bp, Artificial Sequence
  chemically synthesized
tagttgagttatttcttctg

SEQ ID NO: 278302 - DNA, 20 bp, Artificial Sequence
  chemically synthesized
tatctcataatttgatagtt

SEQ ID NO: 278303 - DNA, 20 bp, Artificial Sequence
  chemically synthesized
tcaaatatctcataatttga

SEQ ID NO: 278304 - DNA, 20 bp, Artificial Sequence
  chemically synthesized
taactcaactatcaaattat

SEQ ID NO: 278305 - DNA, 20 bp, Artificial Sequence
  chemically synthesized
atcaaattatgagatatttg

SEQ ID NO: 278306 - DNA, 20 bp, Artificial Sequence
  chemically synthesized
attatgagatatttgaagac

SEQ ID NO: 278307 - DNA, 20 bp, Artificial Sequence
  chemically synthesized
gaagacaagataccattaaa

SEQ ID NO: 278308 - DNA, 20 bp, Artificial Sequence
  chemically synthesized
gtgttaacatatccatttaa

SEQ ID NO: 278309 - DNA, 20 bp, Artificial Sequence
  chemically synthesized
tatgttaacactcattcaca

SEQ ID NO: 278310 - DNA, 20 bp, Artificial Sequence
  chemically synthesized
gcattaatatctttgtgaat

SEQ ID NO: 278311 - DNA, 20 bp, Artificial Sequence
  chemically synthesized
caaagatattaatgccctcc

SEQ ID NO: 278312 - DNA, 20 bp, Artificial Sequence
  chemically synthesized
aagatattaatgccctccaa

SEQ ID NO: 278313 - DNA, 20 bp, Artificial Sequence
  chemically synthesized
aaattatgtttgctcttgga

SEQ ID NO: 278314 - DNA, 20 bp, Artificial Sequence
  chemically synthesized
caaattatgtttgctcttgg

SEQ ID NO: 278315 - DNA, 20 bp, Artificial Sequence
  chemically synthesized
acaaattatgtttgctcttg

SEQ ID NO: 278316 - DNA, 20 bp, Artificial Sequence
  chemically synthesized
agacaaattatgtttgctct

SEQ ID NO: 278317 - DNA, 20 bp, Artificial Sequence
  chemically synthesized
aagagcaaacataatttgtc

SEQ ID NO: 278318 - DNA, 20 bp, Artificial Sequence
  chemically synthesized
gagcaaacataatttgtcta

SEQ ID NO: 278319 - DNA, 20 bp, Artificial Sequence
  chemically synthesized
taagtatttaatattcactc

SEQ ID NO: 278320 - DNA, 20 bp, Artificial Sequence
  chemically synthesized
tcaatatatgattaatattt

SEQ ID NO: 278321 - DNA, 20 bp, Artificial Sequence
  chemically synthesized
attaatcatatattgaaatg

SEQ ID NO: 278322 - DNA, 20 bp, Artificial Sequence
  chemically synthesized
atttatatatacatgtatat

SEQ ID NO: 278323 - DNA, 20 bp, Artificial Sequence
  chemically synthesized
atgtatatataaatacatgc

SEQ ID NO: 278324 - DNA, 20 bp, Artificial Sequence
  chemically synthesized
ttttggggtccagacacaaa

SEQ ID NO: 278325 - DNA, 20 bp, Artificial Sequence
  chemically synthesized
tttgtgtgtccctttgtgtc

SEQ ID NO: 278326 - DNA, 20 bp, Artificial Sequence
  chemically synthesized
tttttggggtccagacacaa

SEQ ID NO: 278327 - DNA, 20 bp, Artificial Sequence
  chemically synthesized
atttttggggtccagacaca

SEQ ID NO: 278328 - DNA, 20 bp, Artificial Sequence
  chemically synthesized
atattagcatttttggggtc

SEQ ID NO: 278329 - DNA, 20 bp, Artificial Sequence
  chemically synthesized
atagaatattagcatttttg

SEQ ID NO: 278330 - DNA, 20 bp, Artificial Sequence
  chemically synthesized
tatagaatattagcattttt

SEQ ID NO: 278331 - DNA, 20 bp, Artificial Sequence
  chemically synthesized
ttatagaatattagcatttt

SEQ ID NO: 278332 - DNA, 20 bp, Artificial Sequence
  chemically synthesized
gtatgcctattatagaatat

SEQ ID NO: 278333 - DNA, 20 bp, Artificial Sequence
  chemically synthesized
aaaatgctaatattctataa

SEQ ID NO: 278334 - DNA, 20 bp, Artificial Sequence
  chemically synthesized
aaatgctaatattctataat

SEQ ID NO: 278335 - DNA, 20 bp, Artificial Sequence
  chemically synthesized
gttcgtctgtatgcctatta

SEQ ID NO: 278336 - DNA, 20 bp, Artificial Sequence
  chemically synthesized
aatattctataataggcata

SEQ ID NO: 278337 - DNA, 20 bp, Artificial Sequence
  chemically synthesized
cgaaatattatataaaacag

SEQ ID NO: 278338 - DNA, 20 bp, Artificial Sequence
  chemically synthesized
ttccgaaatattatataaaa

SEQ ID NO: 278339 - DNA, 20 bp, Artificial Sequence
  chemically synthesized
tactgttttatataatattt

SEQ ID NO: 278340 - DNA, 20 bp, Artificial Sequence
  chemically synthesized
ttttatataatatttcggaa

SEQ ID NO: 278341 - DNA, 20 bp, Artificial Sequence
  chemically synthesized
aaaagtaaatatgactgtcc

SEQ ID NO: 278342 - DNA, 20 bp, Artificial Sequence
  chemically synthesized
aaagtaaatatgactgtcca

SEQ ID NO: 278343 - DNA, 20 bp, Artificial Sequence
  chemically synthesized
atcaataatgtttccttgga

SEQ ID NO: 278344 - DNA, 20 bp, Artificial Sequence
  chemically synthesized
ttcaatcaataatgtttcct

SEQ ID NO: 278345 - DNA, 20 bp, Artificial Sequence
  chemically synthesized
caaggaaacattattgattg

SEQ ID NO: 278346 - DNA, 20 bp, Artificial Sequence
  chemically synthesized
ggaaacattattgattgaag

SEQ ID NO: 278347 - DNA, 20 bp, Artificial Sequence
  chemically synthesized
gaaacattattgattgaagt

SEQ ID NO: 278348 - DNA, 20 bp, Artificial Sequence
  chemically synthesized
aaacattattgattgaagta

SEQ ID NO: 278349 - DNA, 20 bp, Artificial Sequence
  chemically synthesized
taaattatatctaaaaataa

SEQ ID NO: 278350 - DNA, 20 bp, Artificial Sequence
  chemically synthesized
agtagtaattccattatttt

SEQ ID NO: 278351 - DNA, 20 bp, Artificial Sequence
  chemically synthesized
taatggaattactacttaca

SEQ ID NO: 278352 - DNA, 20 bp, Artificial Sequence
  chemically synthesized
atggattttttctttgtaag

SEQ ID NO: 278353 - DNA, 20 bp, Artificial Sequence
  chemically synthesized
atcatggattttttctttgt

SEQ ID NO: 278354 - DNA, 20 bp, Artificial Sequence
  chemically synthesized
aagaaaaaatccatgattca

SEQ ID NO: 278355 - DNA, 20 bp, Artificial Sequence
  chemically synthesized
attttaatcaccatgaatca

SEQ ID NO: 278356 - DNA, 20 bp, Artificial Sequence
  chemically synthesized
tgattcatggtgattaaaat

SEQ ID NO: 278357 - DNA, 20 bp, Artificial Sequence
  chemically synthesized
agaattaaacacattcacca

SEQ ID NO: 278358 - DNA, 20 bp, Artificial Sequence
  chemically synthesized
agccttcacaaaagggtctg

SEQ ID NO: 278359 - DNA, 20 bp, Artificial Sequence
  chemically synthesized
tcaccacagacccttttgtg

SEQ ID NO: 278360 - DNA, 20 bp, Artificial Sequence
  chemically synthesized
agtacatagccttcacaaaa

SEQ ID NO: 278361 - DNA, 20 bp, Artificial Sequence
  chemically synthesized
caccacagacccttttgtga

SEQ ID NO: 278362 - DNA, 20 bp, Artificial Sequence
  chemically synthesized
gagtacatagccttcacaaa

SEQ ID NO: 278363 - DNA, 20 bp, Artificial Sequence
  chemically synthesized
agagtacatagccttcacaa

SEQ ID NO: 278364 - DNA, 20 bp, Artificial Sequence
  chemically synthesized
acaggaactgaaagagtaca

SEQ ID NO: 278365 - DNA, 20 bp, Artificial Sequence
  chemically synthesized
gtgaaggctatgtactcttt

SEQ ID NO: 278366 - DNA, 20 bp, Artificial Sequence
  chemically synthesized
tatagctacaggaactgaaa

SEQ ID NO: 278367 - DNA, 20 bp, Artificial Sequence
  chemically synthesized
tttatagctacaggaactga

SEQ ID NO: 278368 - DNA, 20 bp, Artificial Sequence
  chemically synthesized
atgtactctttcagttcctg

SEQ ID NO: 278369 - DNA, 20 bp, Artificial Sequence
  chemically synthesized
accctctattttatagctac

SEQ ID NO: 278370 - DNA, 20 bp, Artificial Sequence
  chemically synthesized
taccctctattttatagcta

SEQ ID NO: 278371 - DNA, 20 bp, Artificial Sequence
  chemically synthesized
cagttcctgtagctataaaa

SEQ ID NO: 278372 - DNA, 20 bp, Artificial Sequence
  chemically synthesized
gttcctgtagctataaaata

SEQ ID NO: 278373 - DNA, 20 bp, Artificial Sequence
  chemically synthesized
tgtagttaccctctatttta

SEQ ID NO: 278374 - DNA, 20 bp, Artificial Sequence
  chemically synthesized
ttcctgtagctataaaatag

SEQ ID NO: 278375 - DNA, 20 bp, Artificial Sequence
  chemically synthesized
tcctgtagctataaaataga

SEQ ID NO: 278376 - DNA, 20 bp, Artificial Sequence
  chemically synthesized
tacatcttgtattttaaatg

SEQ ID NO: 278377 - DNA, 20 bp, Artificial Sequence
  chemically synthesized
ggtaactacatttaaaatac

SEQ ID NO: 278378 - DNA, 20 bp, Artificial Sequence
  chemically synthesized
tttaaaatattattaaaaac

SEQ ID NO: 278379 - DNA, 20 bp, Artificial Sequence
  chemically synthesized
tattattaaaaacaagaatc

SEQ ID NO: 278380 - DNA, 20 bp, Artificial Sequence
  chemically synthesized
attattaaaaacaagaatca

SEQ ID NO: 278381 - DNA, 20 bp, Artificial Sequence
  chemically synthesized
tgtcctaccatcaattgtgt

SEQ ID NO: 278382 - DNA, 20 bp, Artificial Sequence
  chemically synthesized
aaggtaactcacacaattga

SEQ ID NO: 278383 - DNA, 20 bp, Artificial Sequence
  chemically synthesized
gtaactcacacaattgatgg

SEQ ID NO: 278384 - DNA, 20 bp, Artificial Sequence
  chemically synthesized
taactcacacaattgatggt

SEQ ID NO: 278385 - DNA, 20 bp, Artificial Sequence
  chemically synthesized
cacacaattgatggtaggac

SEQ ID NO: 278386 - DNA, 20 bp, Artificial Sequence
  chemically synthesized
ttcttttgttatttgagaaa

SEQ ID NO: 278387 - DNA, 20 bp, Artificial Sequence
  chemically synthesized
cttcttttgttatttgagaa

SEQ ID NO: 278388 - DNA, 20 bp, Artificial Sequence
  chemically synthesized
tcttcttttgttatttgaga

SEQ ID NO: 278389 - DNA, 20 bp, Artificial Sequence
  chemically synthesized
tgtatcttcttttgttattt

SEQ ID NO: 278390 - DNA, 20 bp, Artificial Sequence
  chemically synthesized
atccctttctcaaataacaa

SEQ ID NO: 278391 - DNA, 20 bp, Artificial Sequence
  chemically synthesized
cctttctcaaataacaaaag

SEQ ID NO: 278392 - DNA, 20 bp, Artificial Sequence
  chemically synthesized
acaaaagaagatacatgaaa

SEQ ID NO: 278393 - DNA, 20 bp, Artificial Sequence
  chemically synthesized
aaaagaagatacatgaaata

SEQ ID NO: 278394 - DNA, 20 bp, Artificial Sequence
  chemically synthesized
agaagatacatgaaatagag

SEQ ID NO: 278395 - DNA, 20 bp, Artificial Sequence
  chemically synthesized
gaagatacatgaaatagaga

SEQ ID NO: 278396 - DNA, 20 bp, Artificial Sequence
  chemically synthesized
ggaaaaatttctaatttaca

SEQ ID NO: 278397 - DNA, 20 bp, Artificial Sequence
  chemically synthesized
atgctattttctttgtaaat

SEQ ID NO: 278398 - DNA, 20 bp, Artificial Sequence
  chemically synthesized
tttctaatttacaaagaaaa

SEQ ID NO: 278399 - DNA, 20 bp, Artificial Sequence
  chemically synthesized
cctctttaatgtaagaaaaa

SEQ ID NO: 278400 - DNA, 20 bp, Artificial Sequence
  chemically synthesized
tgtctatttttcttacatta

SEQ ID NO: 278401 - DNA, 20 bp, Artificial Sequence
  chemically synthesized
agcccagacctctttaatgt

SEQ ID NO: 278402 - DNA, 20 bp, Artificial Sequence
  chemically synthesized
tctatttttcttacattaaa

SEQ ID NO: 278403 - DNA, 20 bp, Artificial Sequence
  chemically synthesized
ctatttttcttacattaaag

SEQ ID NO: 278404 - DNA, 20 bp, Artificial Sequence
  chemically synthesized
tttcttacattaaagaggtc

SEQ ID NO: 278405 - DNA, 20 bp, Artificial Sequence
  chemically synthesized
ttcttacattaaagaggtct

SEQ ID NO: 278406 - DNA, 20 bp, Artificial Sequence
  chemically synthesized
ttaaagaggtctgggctatt

SEQ ID NO: 278407 - DNA, 20 bp, Artificial Sequence
  chemically synthesized
agataataaactcaatagcc

SEQ ID NO: 278408 - DNA, 20 bp, Artificial Sequence
  chemically synthesized
cacatagataataaactcaa

SEQ ID NO: 278409 - DNA, 20 bp, Artificial Sequence
  chemically synthesized
acttgtgtaatatttacaca

SEQ ID NO: 278410 - DNA, 20 bp, Artificial Sequence
  chemically synthesized
tctatgtgtaaatattacac

SEQ ID NO: 278411 - DNA, 20 bp, Artificial Sequence
  chemically synthesized
atgtgtaaatattacacaag

SEQ ID NO: 278412 - DNA, 20 bp, Artificial Sequence
  chemically synthesized
tgtgtaaatattacacaagt

SEQ ID NO: 278413 - DNA, 20 bp, Artificial Sequence
  chemically synthesized
agtgattacattttgagggg

SEQ ID NO: 278414 - DNA, 20 bp, Artificial Sequence
  chemically synthesized
aagagtgattacattttgag

SEQ ID NO: 278415 - DNA, 20 bp, Artificial Sequence
  chemically synthesized
caagagtgattacattttga

SEQ ID NO: 278416 - DNA, 20 bp, Artificial Sequence
  chemically synthesized
tcaagagtgattacattttg

SEQ ID NO: 278417 - DNA, 20 bp, Artificial Sequence
  chemically synthesized
gtcaagagtgattacatttt

SEQ ID NO: 278418 - DNA, 20 bp, Artificial Sequence
  chemically synthesized
ttaattgaataaatggtcaa

SEQ ID NO: 278419 - DNA, 20 bp, Artificial Sequence
  chemically synthesized
tattaattgaataaatggtc

SEQ ID NO: 278420 - DNA, 20 bp, Artificial Sequence
  chemically synthesized
aataatattaattgaataaa

SEQ ID NO: 278421 - DNA, 20 bp, Artificial Sequence
  chemically synthesized
tattcaattaatattattat

SEQ ID NO: 278422 - DNA, 20 bp, Artificial Sequence
  chemically synthesized
attaatattattatgagaac

SEQ ID NO: 278423 - DNA, 20 bp, Artificial Sequence
  chemically synthesized
tattatgagaacaagttgca

SEQ ID NO: 278424 - DNA, 20 bp, Artificial Sequence
  chemically synthesized
aagttgcatagtccaccact

SEQ ID NO: 278425 - DNA, 20 bp, Artificial Sequence
  chemically synthesized
tgcaattttcagctgagtgg

SEQ ID NO: 278426 - DNA, 20 bp, Artificial Sequence
  chemically synthesized
gactgcaattttcagctgag

SEQ ID NO: 278427 - DNA, 20 bp, Artificial Sequence
  chemically synthesized
ggtgactgcaattttcagct

SEQ ID NO: 278428 - DNA, 20 bp, Artificial Sequence
  chemically synthesized
caccactcagctgaaaattg

SEQ ID NO: 278429 - DNA, 20 bp, Artificial Sequence
  chemically synthesized
ttcaaggtgactgcaatttt

SEQ ID NO: 278430 - DNA, 20 bp, Artificial Sequence
  chemically synthesized
aattgcagtcaccttgaaca

SEQ ID NO: 278431 - DNA, 20 bp, Artificial Sequence
  chemically synthesized
atggcagacctctgtgttca

SEQ ID NO: 278432 - DNA, 20 bp, Artificial Sequence
  chemically synthesized
ttgcagtcaccttgaacaca

SEQ ID NO: 278433 - DNA, 20 bp, Artificial Sequence
  chemically synthesized
tatggcagacctctgtgttc

SEQ ID NO: 278434 - DNA, 20 bp, Artificial Sequence
  chemically synthesized
tgcagtcaccttgaacacag

SEQ ID NO: 278435 - DNA, 20 bp, Artificial Sequence
  chemically synthesized
aacacagaggtctgccataa

SEQ ID NO: 278436 - DNA, 20 bp, Artificial Sequence
  chemically synthesized
ctgcaagcagactattatgg

SEQ ID NO: 278437 - DNA, 20 bp, Artificial Sequence
  chemically synthesized
gcactgcaagcagactatta

SEQ ID NO: 278438 - DNA, 20 bp, Artificial Sequence
  chemically synthesized
ctgccataatagtctgcttg

SEQ ID NO: 278439 - DNA, 20 bp, Artificial Sequence
  chemically synthesized
tataaaaattgcactgcaag

SEQ ID NO: 278440 - DNA, 20 bp, Artificial Sequence
  chemically synthesized
ttatataaaaattgcactgc

SEQ ID NO: 278441 - DNA, 20 bp, Artificial Sequence
  chemically synthesized
tgcagtgcaatttttatata

SEQ ID NO: 278442 - DNA, 20 bp, Artificial Sequence
  chemically synthesized
gcaatttttatataaagaca

SEQ ID NO: 278443 - DNA, 20 bp, Artificial Sequence
  chemically synthesized
caatttttatataaagacaa

SEQ ID NO: 278444 - DNA, 20 bp, Artificial Sequence
  chemically synthesized
ataaagacaaaggttttttg

SEQ ID NO: 278445 - DNA, 20 bp, Artificial Sequence
  chemically synthesized
aaagacaaaggttttttgca

SEQ ID NO: 278446 - DNA, 20 bp, Artificial Sequence
  chemically synthesized
tttttgcagagcattcaacc

SEQ ID NO: 278447 - DNA, 20 bp, Artificial Sequence
  chemically synthesized
ttttgcagagcattcaacct

SEQ ID NO: 278448 - DNA, 20 bp, Artificial Sequence
  chemically synthesized
ttgcagagcattcaacctag

SEQ ID NO: 278449 - DNA, 20 bp, Artificial Sequence
  chemically synthesized
cagagcattcaacctaggag

SEQ ID NO: 278450 - DNA, 20 bp, Artificial Sequence
  chemically synthesized
cttgaatcttgacttctcct

SEQ ID NO: 278451 - DNA, 20 bp, Artificial Sequence
  chemically synthesized
tcttgaatcttgacttctcc

SEQ ID NO: 278452 - DNA, 20 bp, Artificial Sequence
  chemically synthesized
cattcaacctaggagaagtc

SEQ ID NO: 278453 - DNA, 20 bp, Artificial Sequence
  chemically synthesized
cctaggagaagtcaagattc

SEQ ID NO: 278454 - DNA, 20 bp, Artificial Sequence
  chemically synthesized
ttaagtagtaaaaaggatat

SEQ ID NO: 278455 - DNA, 20 bp, Artificial Sequence
  chemically synthesized
tctttccttaagtagtaaaa

SEQ ID NO: 278456 - DNA, 20 bp, Artificial Sequence
  chemically synthesized
ttctttccttaagtagtaaa

SEQ ID NO: 278457 - DNA, 20 bp, Artificial Sequence
  chemically synthesized
caatatcctttttactactt

SEQ ID NO: 278458 - DNA, 20 bp, Artificial Sequence
  chemically synthesized
aatatcctttttactactta

SEQ ID NO: 278459 - DNA, 20 bp, Artificial Sequence
  chemically synthesized
cagggctttctttccttaag

SEQ ID NO: 278460 - DNA, 20 bp, Artificial Sequence
  chemically synthesized
tcctttttactacttaagga

SEQ ID NO: 278461 - DNA, 20 bp, Artificial Sequence
  chemically synthesized
attcagggctttctttcctt

SEQ ID NO: 278462 - DNA, 20 bp, Artificial Sequence
  chemically synthesized
ttttactacttaaggaaaga

SEQ ID NO: 278463 - DNA, 20 bp, Artificial Sequence
  chemically synthesized
ctttccatactttgaattca

SEQ ID NO: 278464 - DNA, 20 bp, Artificial Sequence
  chemically synthesized
gaaagaaagccctgaattca

SEQ ID NO: 278465 - DNA, 20 bp, Artificial Sequence
  chemically synthesized
tctttccatactttgaattc

SEQ ID NO: 278466 - DNA, 20 bp, Artificial Sequence
  chemically synthesized
atctttccatactttgaatt

SEQ ID NO: 278467 - DNA, 20 bp, Artificial Sequence
  chemically synthesized
aaagccctgaattcaaagta

SEQ ID NO: 278468 - DNA, 20 bp, Artificial Sequence
  chemically synthesized
ccctgaattcaaagtatgga

SEQ ID NO: 278469 - DNA, 20 bp, Artificial Sequence
  chemically synthesized
agtatggaaagatgtaaacc

SEQ ID NO: 278470 - DNA, 20 bp, Artificial Sequence
  chemically synthesized
atggaaagatgtaaacctag

SEQ ID NO: 278471 - DNA, 20 bp, Artificial Sequence
  chemically synthesized
taataatggatatagcttct

SEQ ID NO: 278472 - DNA, 20 bp, Artificial Sequence
  chemically synthesized
ttaataatggatatagcttc

SEQ ID NO: 278473 - DNA, 20 bp, Artificial Sequence
  chemically synthesized
tagtgtgttaataatggata

SEQ ID NO: 278474 - DNA, 20 bp, Artificial Sequence
  chemically synthesized
tattcttagtgtgttaataa

SEQ ID NO: 278475 - DNA, 20 bp, Artificial Sequence
  chemically synthesized
atatccattattaacacact

SEQ ID NO: 278476 - DNA, 20 bp, Artificial Sequence
  chemically synthesized
attattaacacactaagaat

SEQ ID NO: 278477 - DNA, 20 bp, Artificial Sequence
  chemically synthesized
gtgaaatttaatcttattct

SEQ ID NO: 278478 - DNA, 20 bp, Artificial Sequence
  chemically synthesized
aaatgctttaatatttagaa

SEQ ID NO: 278479 - DNA, 20 bp, Artificial Sequence
  chemically synthesized
taaatgctttaatatttaga

SEQ ID NO: 278480 - DNA, 20 bp, Artificial Sequence
  chemically synthesized
tttcacctttctaaatatta

SEQ ID NO: 278481 - DNA, 20 bp, Artificial Sequence
  chemically synthesized
acaataaatgctttaatatt

SEQ ID NO: 278482 - DNA, 20 bp, Artificial Sequence
  chemically synthesized
tacttgaaaatatttcattg

SEQ ID NO: 278483 - DNA, 20 bp, Artificial Sequence
  chemically synthesized
ttacttgaaaatatttcatt

SEQ ID NO: 278484 - DNA, 20 bp, Artificial Sequence
  chemically synthesized
atcctcaatgaaatattttc

SEQ ID NO: 278485 - DNA, 20 bp, Artificial Sequence
  chemically synthesized
caagtaatgataatctataa

SEQ ID NO: 278486 - DNA, 20 bp, Artificial Sequence
  chemically synthesized
taatgataatctataaaagt

SEQ ID NO: 278487 - DNA, 20 bp, Artificial Sequence
  chemically synthesized
acaatttaggctcactttta

SEQ ID NO: 278488 - DNA, 20 bp, Artificial Sequence
  chemically synthesized
ggtttgggagttaacaattt

SEQ ID NO: 278489 - DNA, 20 bp, Artificial Sequence
  chemically synthesized
aggtttgggagttaacaatt

SEQ ID NO: 278490 - DNA, 20 bp, Artificial Sequence
  chemically synthesized
atgcttttgataaggtttgg

SEQ ID NO: 278491 - DNA, 20 bp, Artificial Sequence
  chemically synthesized
aaatgcttttgataaggttt

SEQ ID NO: 278492 - DNA, 20 bp, Artificial Sequence
  chemically synthesized
gaaatgcttttgataaggtt

SEQ ID NO: 278493 - DNA, 20 bp, Artificial Sequence
  chemically synthesized
taactcccaaaccttatcaa

SEQ ID NO: 278494 - DNA, 20 bp, Artificial Sequence
  chemically synthesized
cacctgaaatgcttttgata

SEQ ID NO: 278495 - DNA, 20 bp, Artificial Sequence
  chemically synthesized
acacctgaaatgcttttgat

SEQ ID NO: 278496 - DNA, 20 bp, Artificial Sequence
  chemically synthesized
aaaccttatcaaaagcattt

SEQ ID NO: 278497 - DNA, 20 bp, Artificial Sequence
  chemically synthesized
aaccttatcaaaagcatttc

SEQ ID NO: 278498 - DNA, 20 bp, Artificial Sequence
  chemically synthesized
gtacaaataaccaaatgtat

SEQ ID NO: 278499 - DNA, 20 bp, Artificial Sequence
  chemically synthesized
cgggtgtcatcttatacatt

SEQ ID NO: 278500 - DNA, 20 bp, Artificial Sequence
  chemically synthesized
tataagatgacacccgaaat

SEQ ID NO: 278501 - DNA, 20 bp, Artificial Sequence
  chemically synthesized
atggctttgaagccaatttc

SEQ ID NO: 278502 - DNA, 20 bp, Artificial Sequence
  chemically synthesized
catggctttgaagccaattt

SEQ ID NO: 278503 - DNA, 20 bp, Artificial Sequence
  chemically synthesized
gacacccgaaattggcttca

SEQ ID NO: 278504 - DNA, 20 bp, Artificial Sequence
  chemically synthesized
gcacaggttgcatggctttg

SEQ ID NO: 278505 - DNA, 20 bp, Artificial Sequence
  chemically synthesized
gcataactgcacaggttgca

SEQ ID NO: 278506 - DNA, 20 bp, Artificial Sequence
  chemically synthesized
tcaaagccatgcaacctgtg

SEQ ID NO: 278507 - DNA, 20 bp, Artificial Sequence
  chemically synthesized
gagttactgcataactgcac

SEQ ID NO: 278508 - DNA, 20 bp, Artificial Sequence
  chemically synthesized
tgagttactgcataactgca

SEQ ID NO: 278509 - DNA, 20 bp, Artificial Sequence
  chemically synthesized
atgcaacctgtgcagttatg

SEQ ID NO: 278510 - DNA, 20 bp, Artificial Sequence
  chemically synthesized
gttatgcagtaactcatgct

SEQ ID NO: 278511 - DNA, 20 bp, Artificial Sequence
  chemically synthesized
ttatgcagtaactcatgctt

SEQ ID NO: 278512 - DNA, 20 bp, Artificial Sequence
  chemically synthesized
gcatgggctctcctaagcat

SEQ ID NO: 278513 - DNA, 20 bp, Artificial Sequence
  chemically synthesized
atgcagtaactcatgcttag

SEQ ID NO: 278514 - DNA, 20 bp, Artificial Sequence
  chemically synthesized
gcagtaactcatgcttagga

SEQ ID NO: 278515 - DNA, 20 bp, Artificial Sequence
  chemically synthesized
aaccaagcatgggctctcct

SEQ ID NO: 278516 - DNA, 20 bp, Artificial Sequence
  chemically synthesized
tgcttaggagagcccatgct

SEQ ID NO: 278517 - DNA, 20 bp, Artificial Sequence
  chemically synthesized
cagagcattaaaccaagcat

SEQ ID NO: 278518 - DNA, 20 bp, Artificial Sequence
  chemically synthesized
gcagagcattaaaccaagca

SEQ ID NO: 278519 - DNA, 20 bp, Artificial Sequence
  chemically synthesized
caacagcagagcattaaacc

SEQ ID NO: 278520 - DNA, 20 bp, Artificial Sequence
  chemically synthesized
attgtaagatggcaacagca

SEQ ID NO: 278521 - DNA, 20 bp, Artificial Sequence
  chemically synthesized
gcattgtaagatggcaacag

SEQ ID NO: 278522 - DNA, 20 bp, Artificial Sequence
  chemically synthesized
taagcattgtaagatggcaa

SEQ ID NO: 278523 - DNA, 20 bp, Artificial Sequence
  chemically synthesized
aaaaattaagcattgtaaga

SEQ ID NO: 278524 - DNA, 20 bp, Artificial Sequence
  chemically synthesized
actcaaaaattaagcattgt

SEQ ID NO: 278525 - DNA, 20 bp, Artificial Sequence
  chemically synthesized
tcttacaatgcttaattttt

SEQ ID NO: 278526 - DNA, 20 bp, Artificial Sequence
  chemically synthesized
gggtcccatactcaaaaatt

SEQ ID NO: 278527 - DNA, 20 bp, Artificial Sequence
  chemically synthesized
caatgcttaatttttgagta

SEQ ID NO: 278528 - DNA, 20 bp, Artificial Sequence
  chemically synthesized
aatgcttaatttttgagtat

SEQ ID NO: 278529 - DNA, 20 bp, Artificial Sequence
  chemically synthesized
taatttttgagtatgggacc

SEQ ID NO: 278530 - DNA, 20 bp, Artificial Sequence
  chemically synthesized
cagggaagaaagaaaatact

SEQ ID NO: 278531 - DNA, 20 bp, Artificial Sequence
  chemically synthesized
tcagggaagaaagaaaatac

SEQ ID NO: 278532 - DNA, 20 bp, Artificial Sequence
  chemically synthesized
tttgggggactcagggaaga

SEQ ID NO: 278533 - DNA, 20 bp, Artificial Sequence
  chemically synthesized
cagtattttctttcttccct

SEQ ID NO: 278534 - DNA, 20 bp, Artificial Sequence
  chemically synthesized
ataatttgggggactcaggg

SEQ ID NO: 278535 - DNA, 20 bp, Artificial Sequence
  chemically synthesized
tccataatttgggggactca

SEQ ID NO: 278536 - DNA, 20 bp, Artificial Sequence
  chemically synthesized
ctccataatttgggggactc

SEQ ID NO: 278537 - DNA, 20 bp, Artificial Sequence
  chemically synthesized
gctccataatttgggggact

SEQ ID NO: 278538 - DNA, 20 bp, Artificial Sequence
  chemically synthesized
ggatcggctccataatttgg

SEQ ID NO: 278539 - DNA, 20 bp, Artificial Sequence
  chemically synthesized
tccctgagtcccccaaatta

SEQ ID NO: 278540 - DNA, 20 bp, Artificial Sequence
  chemically synthesized
aggatcggctccataatttg

SEQ ID NO: 278541 - DNA, 20 bp, Artificial Sequence
  chemically synthesized
caggatcggctccataattt

SEQ ID NO: 278542 - DNA, 20 bp, Artificial Sequence
  chemically synthesized
cctgagtcccccaaattatg

SEQ ID NO: 278543 - DNA, 20 bp, Artificial Sequence
  chemically synthesized
tcaggatcggctccataatt

SEQ ID NO: 278544 - DNA, 20 bp, Artificial Sequence
  chemically synthesized
ttttcccaaaatgtcaggat

SEQ ID NO: 278545 - DNA, 20 bp, Artificial Sequence
  chemically synthesized
tggagccgatcctgacattt

SEQ ID NO: 278546 - DNA, 20 bp, Artificial Sequence
  chemically synthesized
gctgtttttcccaaaatgtc

SEQ ID NO: 278547 - DNA, 20 bp, Artificial Sequence
  chemically synthesized
ggagccgatcctgacatttt

SEQ ID NO: 278548 - DNA, 20 bp, Artificial Sequence
  chemically synthesized
ggctgtttttcccaaaatgt

SEQ ID NO: 278549 - DNA, 20 bp, Artificial Sequence
  chemically synthesized
tcctgacattttgggaaaaa

SEQ ID NO: 278550 - DNA, 20 bp, Artificial Sequence
  chemically synthesized
attttgggaaaaacagccaa

SEQ ID NO: 278551 - DNA, 20 bp, Artificial Sequence
  chemically synthesized
tatgtcagtcttttagctgt

SEQ ID NO: 278552 - DNA, 20 bp, Artificial Sequence
  chemically synthesized
gaaaaacagccaacagctaa

SEQ ID NO: 278553 - DNA, 20 bp, Artificial Sequence
  chemically synthesized
agatttttatgtcagtcttt

SEQ ID NO: 278554 - DNA, 20 bp, Artificial Sequence
  chemically synthesized
tttaattcagatttttatgt

SEQ ID NO: 278555 - DNA, 20 bp, Artificial Sequence
  chemically synthesized
ctaacttaaccaatttaatt

SEQ ID NO: 278556 - DNA, 20 bp, Artificial Sequence
  chemically synthesized
cataaaaatctgaattaaat

SEQ ID NO: 278557 - DNA, 20 bp, Artificial Sequence
  chemically synthesized
aaatctgaattaaattggtt

SEQ ID NO: 278558 - DNA, 20 bp, Artificial Sequence
  chemically synthesized
ctgaattaaattggttaagt

SEQ ID NO: 278559 - DNA, 20 bp, Artificial Sequence
  chemically synthesized
gaattaaattggttaagtta

SEQ ID NO: 278560 - DNA, 20 bp, Artificial Sequence
  chemically synthesized
attaaattggttaagttaga

SEQ ID NO: 278561 - DNA, 20 bp, Artificial Sequence
  chemically synthesized
gaaattcacatttgacatac

SEQ ID NO: 278562 - DNA, 20 bp, Artificial Sequence
  chemically synthesized
attcacatttgacatactgg

SEQ ID NO: 278563 - DNA, 20 bp, Artificial Sequence
  chemically synthesized
gtcattcatctggttaccgc

SEQ ID NO: 278564 - DNA, 20 bp, Artificial Sequence
  chemically synthesized
tttgacatactggcggtaac

SEQ ID NO: 278565 - DNA, 20 bp, Artificial Sequence
  chemically synthesized
atatttgcaagtcattcatc

SEQ ID NO: 278566 - DNA, 20 bp, Artificial Sequence
  chemically synthesized
ccaactatattcatatttgc

SEQ ID NO: 278567 - DNA, 20 bp, Artificial Sequence
  chemically synthesized
atgacttgcaaatatgaata

SEQ ID NO: 278568 - DNA, 20 bp, Artificial Sequence
  chemically synthesized
cttgcaaatatgaatatagt

SEQ ID NO: 278569 - DNA, 20 bp, Artificial Sequence
  chemically synthesized
gcaaatatgaatatagttgg

SEQ ID NO: 278570 - DNA, 20 bp, Artificial Sequence
  chemically synthesized
aatatgaatatagttggaag

SEQ ID NO: 278571 - DNA, 20 bp, Artificial Sequence
  chemically synthesized
atagttggaagaagatactt

SEQ ID NO: 278572 - DNA, 20 bp, Artificial Sequence
  chemically synthesized
tggaagaagatacttcagac

SEQ ID NO: 278573 - DNA, 20 bp, Artificial Sequence
  chemically synthesized
acaactaggattctagtctg

SEQ ID NO: 278574 - DNA, 20 bp, Artificial Sequence
  chemically synthesized
gatacttcagactagaatcc

SEQ ID NO: 278575 - DNA, 20 bp, Artificial Sequence
  chemically synthesized
ttctgaaacaactaggattc

SEQ ID NO: 278576 - DNA, 20 bp, Artificial Sequence
  chemically synthesized
gattatattctgaaacaact

SEQ ID NO: 278577 - DNA, 20 bp, Artificial Sequence
  chemically synthesized
gactagaatcctagttgttt

SEQ ID NO: 278578 - DNA, 20 bp, Artificial Sequence
  chemically synthesized
tgattatattctgaaacaac

SEQ ID NO: 278579 - DNA, 20 bp, Artificial Sequence
  chemically synthesized
gaatataatcaaatacaacc

SEQ ID NO: 278580 - DNA, 20 bp, Artificial Sequence
  chemically synthesized
atataatcaaatacaacctg

SEQ ID NO: 278581 - DNA, 20 bp, Artificial Sequence
  chemically synthesized
tatctttgattagcatctcc

SEQ ID NO: 278582 - DNA, 20 bp, Artificial Sequence
  chemically synthesized
ttatctttgattagcatctc

SEQ ID NO: 278583 - DNA, 20 bp, Artificial Sequence
  chemically synthesized
caacctggagatgctaatca

SEQ ID NO: 278584 - DNA, 20 bp, Artificial Sequence
  chemically synthesized
ttctttgcgttatctttgat

SEQ ID NO: 278585 - DNA, 20 bp, Artificial Sequence
  chemically synthesized
tgctaatcaaagataacgca

SEQ ID NO: 278586 - DNA, 20 bp, Artificial Sequence
  chemically synthesized
catagaaaatcaaaagcgaa

SEQ ID NO: 278587 - DNA, 20 bp, Artificial Sequence
  chemically synthesized
gcatagaaaatcaaaagcga

SEQ ID NO: 278588 - DNA, 20 bp, Artificial Sequence
  chemically synthesized
cgcatagaaaatcaaaagcg

SEQ ID NO: 278589 - DNA, 20 bp, Artificial Sequence
  chemically synthesized
acagccgcatagaaaatcaa

SEQ ID NO: 278590 - DNA, 20 bp, Artificial Sequence
  chemically synthesized
ttcgcttttgattttctatg

SEQ ID NO: 278591 - DNA, 20 bp, Artificial Sequence
  chemically synthesized
accacacacatacagccgca

SEQ ID NO: 278592 - DNA, 20 bp, Artificial Sequence
  chemically synthesized
tatttagaaccacacacata

SEQ ID NO: 278593 - DNA, 20 bp, Artificial Sequence
  chemically synthesized
tctatgcggctgtatgtgtg

SEQ ID NO: 278594 - DNA, 20 bp, Artificial Sequence
  chemically synthesized
ttctgcaaaataattttatt

SEQ ID NO: 278595 - DNA, 20 bp, Artificial Sequence
  chemically synthesized
ttctaaataaaattattttg

SEQ ID NO: 278596 - DNA, 20 bp, Artificial Sequence
  chemically synthesized
aattattttgcagaaaatta

SEQ ID NO: 278597 - DNA, 20 bp, Artificial Sequence
  chemically synthesized
attattttgcagaaaattac

SEQ ID NO: 278598 - DNA, 20 bp, Artificial Sequence
  chemically synthesized
tattttgcagaaaattacgg

SEQ ID NO: 278599 - DNA, 20 bp, Artificial Sequence
  chemically synthesized
ttgcagaaaattacgggaga

SEQ ID NO: 278600 - DNA, 20 bp, Artificial Sequence
  chemically synthesized
agaaaattacgggagaaagt

SEQ ID NO: 278601 - DNA, 20 bp, Artificial Sequence
  chemically synthesized
ttattcgcaatggaaataat

SEQ ID NO: 278602 - DNA, 20 bp, Artificial Sequence
  chemically synthesized
gccaatgaagttattcgcaa

SEQ ID NO: 278603 - DNA, 20 bp, Artificial Sequence
  chemically synthesized
tccattgcgaataacttcat

SEQ ID NO: 278604 - DNA, 20 bp, Artificial Sequence
  chemically synthesized
ggactcagtagtagccaatg

SEQ ID NO: 278605 - DNA, 20 bp, Artificial Sequence
  chemically synthesized
taacttcattggctactact

SEQ ID NO: 278606 - DNA, 20 bp, Artificial Sequence
  chemically synthesized
taatatcgtggactcagtag

SEQ ID NO: 278607 - DNA, 20 bp, Artificial Sequence
  chemically synthesized
gaataatatcgtggactcag

SEQ ID NO: 278608 - DNA, 20 bp, Artificial Sequence
  chemically synthesized
agagaataatatcgtggact

SEQ ID NO: 278609 - DNA, 20 bp, Artificial Sequence
  chemically synthesized
agtgttagagaataatatcg

SEQ ID NO: 278610 - DNA, 20 bp, Artificial Sequence
  chemically synthesized
taaaatcaggagaagtgtta

SEQ ID NO: 278611 - DNA, 20 bp, Artificial Sequence
  chemically synthesized
tttaaaatcaggagaagtgt

SEQ ID NO: 278612 - DNA, 20 bp, Artificial Sequence
  chemically synthesized
gattcgtttaaaatcaggag

SEQ ID NO: 278613 - DNA, 20 bp, Artificial Sequence
  chemically synthesized
aaagattcgtttaaaatcag

SEQ ID NO: 278614 - DNA, 20 bp, Artificial Sequence
  chemically synthesized
ttaaagattcgtttaaaatc

SEQ ID NO: 278615 - DNA, 20 bp, Artificial Sequence
  chemically synthesized
tttaaagattcgtttaaaat

SEQ ID NO: 278616 - DNA, 20 bp, Artificial Sequence
  chemically synthesized
ataggagctcttttgtttta

SEQ ID NO: 278617 - DNA, 20 bp, Artificial Sequence
  chemically synthesized
taaacgaatctttaaaacaa

SEQ ID NO: 278618 - DNA, 20 bp, Artificial Sequence
  chemically synthesized
aacgaatctttaaaacaaaa

SEQ ID NO: 278619 - DNA, 20 bp, Artificial Sequence
  chemically synthesized
gtgaaaagtatttggaatag

SEQ ID NO: 278620 - DNA, 20 bp, Artificial Sequence
  chemically synthesized
gagtgaaaagtatttggaat

SEQ ID NO: 278621 - DNA, 20 bp, Artificial Sequence
  chemically synthesized
agagtgaaaagtatttggaa

SEQ ID NO: 278622 - DNA, 20 bp, Artificial Sequence
  chemically synthesized
aaatgagagtgaaaagtatt

SEQ ID NO: 278623 - DNA, 20 bp, Artificial Sequence
  chemically synthesized
attgaggaaatgagagtgaa

SEQ ID NO: 278624 - DNA, 20 bp, Artificial Sequence
  chemically synthesized
tggtgtcattgaggaaatga

SEQ ID NO: 278625 - DNA, 20 bp, Artificial Sequence
  chemically synthesized
actggtgtcattgaggaaat

SEQ ID NO: 278626 - DNA, 20 bp, Artificial Sequence
  chemically synthesized
aaggagaactggtgtcattg

SEQ ID NO: 278627 - DNA, 20 bp, Artificial Sequence
  chemically synthesized
aaaggagaactggtgtcatt

SEQ ID NO: 278628 - DNA, 20 bp, Artificial Sequence
  chemically synthesized
tctcatttcctcaatgacac

SEQ ID NO: 278629 - DNA, 20 bp, Artificial Sequence
  chemically synthesized
gggttgggagaaaggagaac

SEQ ID NO: 278630 - DNA, 20 bp, Artificial Sequence
  chemically synthesized
taaagggggttgggagaaag

SEQ ID NO: 278631 - DNA, 20 bp, Artificial Sequence
  chemically synthesized
ggtaaagggggttgggagaa

SEQ ID NO: 278632 - DNA, 20 bp, Artificial Sequence
  chemically synthesized
cggtaaagggggttgggaga

SEQ ID NO: 278633 - DNA, 20 bp, Artificial Sequence
  chemically synthesized
tgcacggtaaagggggttgg

SEQ ID NO: 278634 - DNA, 20 bp, Artificial Sequence
  chemically synthesized
tctgcacggtaaagggggtt

SEQ ID NO: 278635 - DNA, 20 bp, Artificial Sequence
  chemically synthesized
ctctgcacggtaaagggggt

SEQ ID NO: 278636 - DNA, 20 bp, Artificial Sequence
  chemically synthesized
aggactctgcacggtaaagg

SEQ ID NO: 278637 - DNA, 20 bp, Artificial Sequence
  chemically synthesized
taggactctgcacggtaaag

SEQ ID NO: 278638 - DNA, 20 bp, Artificial Sequence
  chemically synthesized
ttaggactctgcacggtaaa

SEQ ID NO: 278639 - DNA, 20 bp, Artificial Sequence
  chemically synthesized
tttaggactctgcacggtaa

SEQ ID NO: 278640 - DNA, 20 bp, Artificial Sequence
  chemically synthesized
tcccaaccccctttaccgtg

SEQ ID NO: 278641 - DNA, 20 bp, Artificial Sequence
  chemically synthesized
gtttaggactctgcacggta

SEQ ID NO: 278642 - DNA, 20 bp, Artificial Sequence
  chemically synthesized
ccaaccccctttaccgtgca

SEQ ID NO: 278643 - DNA, 20 bp, Artificial Sequence
  chemically synthesized
aggttgtttaggactctgca

SEQ ID NO: 278644 - DNA, 20 bp, Artificial Sequence
  chemically synthesized
actctgttttcaggttgttt

SEQ ID NO: 278645 - DNA, 20 bp, Artificial Sequence
  chemically synthesized
aactctgttttcaggttgtt

SEQ ID NO: 278646 - DNA, 20 bp, Artificial Sequence
  chemically synthesized
agtcctaaacaacctgaaaa

SEQ ID NO: 278647 - DNA, 20 bp, Artificial Sequence
  chemically synthesized
tcctaaacaacctgaaaaca

SEQ ID NO: 278648 - DNA, 20 bp, Artificial Sequence
  chemically synthesized
aagtaggtaactctgttttc

SEQ ID NO: 278649 - DNA, 20 bp, Artificial Sequence
  chemically synthesized
gaagtaggtaactctgtttt

SEQ ID NO: 278650 - DNA, 20 bp, Artificial Sequence
  chemically synthesized
aaacagagttacctacttct

SEQ ID NO: 278651 - DNA, 20 bp, Artificial Sequence
  chemically synthesized
aacagagttacctacttctc

SEQ ID NO: 278652 - DNA, 20 bp, Artificial Sequence
  chemically synthesized
taaatttatccctgagaagt

SEQ ID NO: 278653 - DNA, 20 bp, Artificial Sequence
  chemically synthesized
acagagttacctacttctca

SEQ ID NO: 278654 - DNA, 20 bp, Artificial Sequence
  chemically synthesized
ataaatttatccctgagaag

SEQ ID NO: 278655 - DNA, 20 bp, Artificial Sequence
  chemically synthesized
aggataaatttatccctgag

SEQ ID NO: 278656 - DNA, 20 bp, Artificial Sequence
  chemically synthesized
ccaaggataaatttatccct

SEQ ID NO: 278657 - DNA, 20 bp, Artificial Sequence
  chemically synthesized
ctcagggataaatttatcct

SEQ ID NO: 278658 - DNA, 20 bp, Artificial Sequence
  chemically synthesized
agggataaatttatccttgg

SEQ ID NO: 278659 - DNA, 20 bp, Artificial Sequence
  chemically synthesized
ttgagaaagtttatccacca

SEQ ID NO: 278660 - DNA, 20 bp, Artificial Sequence
  chemically synthesized
tttgagaaagtttatccacc

SEQ ID NO: 278661 - DNA, 20 bp, Artificial Sequence
  chemically synthesized
ggagagtagtaagtttgaga

SEQ ID NO: 278662 - DNA, 20 bp, Artificial Sequence
  chemically synthesized
aggtggagagtagtaagttt

SEQ ID NO: 278663 - DNA, 20 bp, Artificial Sequence
  chemically synthesized
gttctgaggtggagagtagt

SEQ ID NO: 278664 - DNA, 20 bp, Artificial Sequence
  chemically synthesized
ggaggttctgaggtggagag

SEQ ID NO: 278665 - DNA, 20 bp, Artificial Sequence
  chemically synthesized
aaacttactactctccacct

SEQ ID NO: 278666 - DNA, 20 bp, Artificial Sequence
  chemically synthesized
caaggaggttctgaggtgga

SEQ ID NO: 278667 - DNA, 20 bp, Artificial Sequence
  chemically synthesized
tacaaggaggttctgaggtg

SEQ ID NO: 278668 - DNA, 20 bp, Artificial Sequence
  chemically synthesized
aatacaaggaggttctgagg

SEQ ID NO: 278669 - DNA, 20 bp, Artificial Sequence
  chemically synthesized
gataatacaaggaggttctg

SEQ ID NO: 278670 - DNA, 20 bp, Artificial Sequence
  chemically synthesized
agataatacaaggaggttct

SEQ ID NO: 278671 - DNA, 20 bp, Artificial Sequence
  chemically synthesized
aaaattgagataatacaagg

SEQ ID NO: 278672 - DNA, 20 bp, Artificial Sequence
  chemically synthesized
gaaaattgagataatacaag

SEQ ID NO: 278673 - DNA, 20 bp, Artificial Sequence
  chemically synthesized
gagaaaattgagataataca

SEQ ID NO: 278674 - DNA, 20 bp, Artificial Sequence
  chemically synthesized
agagaaaattgagataatac

SEQ ID NO: 278675 - DNA, 20 bp, Artificial Sequence
  chemically synthesized
gaagtgggaaagagaaaatt

SEQ ID NO: 278676 - DNA, 20 bp, Artificial Sequence
  chemically synthesized
ttgactttggaagtgggaaa

SEQ ID NO: 278677 - DNA, 20 bp, Artificial Sequence
  chemically synthesized
gattgactttggaagtggga

SEQ ID NO: 278678 - DNA, 20 bp, Artificial Sequence
  chemically synthesized
ttttctctttcccacttcca

SEQ ID NO: 278679 - DNA, 20 bp, Artificial Sequence
  chemically synthesized
gaaggattgactttggaagt

SEQ ID NO: 278680 - DNA, 20 bp, Artificial Sequence
  chemically synthesized
ggaaggattgactttggaag

SEQ ID NO: 278681 - DNA, 20 bp, Artificial Sequence
  chemically synthesized
aatggaaggattgactttgg

SEQ ID NO: 278682 - DNA, 20 bp, Artificial Sequence
  chemically synthesized
aaaaatggaaggattgactt

SEQ ID NO: 278683 - DNA, 20 bp, Artificial Sequence
  chemically synthesized
acacgagcaaaaaaaatgga

SEQ ID NO: 278684 - DNA, 20 bp, Artificial Sequence
  chemically synthesized
tacacgagcaaaaaaaatgg

SEQ ID NO: 278685 - DNA, 20 bp, Artificial Sequence
  chemically synthesized
ggatacacgagcaaaaaaaa

SEQ ID NO: 278686 - DNA, 20 bp, Artificial Sequence
  chemically synthesized
tcttacaagataggatacac

SEQ ID NO: 278687 - DNA, 20 bp, Artificial Sequence
  chemically synthesized
gctcgtgtatcctatcttgt

SEQ ID NO: 278688 - DNA, 20 bp, Artificial Sequence
  chemically synthesized
agagcaaagtcttacaagat

SEQ ID NO: 278689 - DNA, 20 bp, Artificial Sequence
  chemically synthesized
aagagcaaagtcttacaaga

SEQ ID NO: 278690 - DNA, 20 bp, Artificial Sequence
  chemically synthesized
atataagagcaaagtcttac

SEQ ID NO: 278691 - DNA, 20 bp, Artificial Sequence
  chemically synthesized
agacataatatataagagca

SEQ ID NO: 278692 - DNA, 20 bp, Artificial Sequence
  chemically synthesized
tagaaagacataatatataa

SEQ ID NO: 278693 - DNA, 20 bp, Artificial Sequence
  chemically synthesized
aatagaaagacataatatat

SEQ ID NO: 278694 - DNA, 20 bp, Artificial Sequence
  chemically synthesized
tatatattatgtctttctat

SEQ ID NO: 278695 - DNA, 20 bp, Artificial Sequence
  chemically synthesized
ataagggaagatccaataga

SEQ ID NO: 278696 - DNA, 20 bp, Artificial Sequence
  chemically synthesized
tagtataagggaagatccaa

SEQ ID NO: 278697 - DNA, 20 bp, Artificial Sequence
  chemically synthesized
gcatgtttgtagtataaggg

SEQ ID NO: 278698 - DNA, 20 bp, Artificial Sequence
  chemically synthesized
taagcatgtttgtagtataa

SEQ ID NO: 278699 - DNA, 20 bp, Artificial Sequence
  chemically synthesized
ttaagcatgtttgtagtata

SEQ ID NO: 278700 - DNA, 20 bp, Artificial Sequence
  chemically synthesized
tttaagcatgtttgtagtat

SEQ ID NO: 278701 - DNA, 20 bp, Artificial Sequence
  chemically synthesized
taaaaatttaagcatgtttg

SEQ ID NO: 278702 - DNA, 20 bp, Artificial Sequence
  chemically synthesized
tttcaggataataaaaattt

SEQ ID NO: 278703 - DNA, 20 bp, Artificial Sequence
  chemically synthesized
aagatgtgttgttgattttc

SEQ ID NO: 278704 - DNA, 20 bp, Artificial Sequence
  chemically synthesized
aaagatgtgttgttgatttt

SEQ ID NO: 278705 - DNA, 20 bp, Artificial Sequence
  chemically synthesized
tgaatagtaatagggcagaa

SEQ ID NO: 278706 - DNA, 20 bp, Artificial Sequence
  chemically synthesized
gaaattgaatagtaataggg

SEQ ID NO: 278707 - DNA, 20 bp, Artificial Sequence
  chemically synthesized
actgaaattgaatagtaata

SEQ ID NO: 278708 - DNA, 20 bp, Artificial Sequence
  chemically synthesized
aactgaaattgaatagtaat

SEQ ID NO: 278709 - DNA, 20 bp, Artificial Sequence
  chemically synthesized
taactgaaattgaatagtaa

SEQ ID NO: 278710 - DNA, 20 bp, Artificial Sequence
  chemically synthesized
ggccagtaactgaaattgaa

SEQ ID NO: 278711 - DNA, 20 bp, Artificial Sequence
  chemically synthesized
gccctattactattcaattt

SEQ ID NO: 278712 - DNA, 20 bp, Artificial Sequence
  chemically synthesized
tactattcaatttcagttac

SEQ ID NO: 278713 - DNA, 20 bp, Artificial Sequence
  chemically synthesized
aaaaaatgagaaagaaaggc

SEQ ID NO: 278714 - DNA, 20 bp, Artificial Sequence
  chemically synthesized
gatgaaaaaatgagaaagaa

SEQ ID NO: 278715 - DNA, 20 bp, Artificial Sequence
  chemically synthesized
tgatgaaaaaatgagaaaga

SEQ ID NO: 278716 - DNA, 20 bp, Artificial Sequence
  chemically synthesized
gtgatgatgaaaaaatgaga

SEQ ID NO: 278717 - DNA, 20 bp, Artificial Sequence
  chemically synthesized
atctgtgatgatgaaaaaat

SEQ ID NO: 278718 - DNA, 20 bp, Artificial Sequence
  chemically synthesized
ttctcattttttcatcatca

SEQ ID NO: 278719 - DNA, 20 bp, Artificial Sequence
  chemically synthesized
gaaaatgagcagggcaaata

SEQ ID NO: 278720 - DNA, 20 bp, Artificial Sequence
  chemically synthesized
gagaaaatgagcagggcaaa

SEQ ID NO: 278721 - DNA, 20 bp, Artificial Sequence
  chemically synthesized
ggtaaaagagaaaatgagca

SEQ ID NO: 278722 - DNA, 20 bp, Artificial Sequence
  chemically synthesized
tggtaaaagagaaaatgagc

SEQ ID NO: 278723 - DNA, 20 bp, Artificial Sequence
  chemically synthesized
ttggtaaaagagaaaatgag

SEQ ID NO: 278724 - DNA, 20 bp, Artificial Sequence
  chemically synthesized
gatttggtaaaagagaaaat

SEQ ID NO: 278725 - DNA, 20 bp, Artificial Sequence
  chemically synthesized
gagattaagatttggtaaaa

SEQ ID NO: 278726 - DNA, 20 bp, Artificial Sequence
  chemically synthesized
gtgagattaagatttggtaa

SEQ ID NO: 278727 - DNA, 20 bp, Artificial Sequence
  chemically synthesized
acaactgtgagattaagatt

SEQ ID NO: 278728 - DNA, 20 bp, Artificial Sequence
  chemically synthesized
tttaccaaatcttaatctca

SEQ ID NO: 278729 - DNA, 20 bp, Artificial Sequence
  chemically synthesized
ggaggaacaactgtgagatt

SEQ ID NO: 278730 - DNA, 20 bp, Artificial Sequence
  chemically synthesized
aagtgaggaggaacaactgt

SEQ ID NO: 278731 - DNA, 20 bp, Artificial Sequence
  chemically synthesized
ctctgtgttccaaagtgagg

SEQ ID NO: 278732 - DNA, 20 bp, Artificial Sequence
  chemically synthesized
acagttgttcctcctcactt

SEQ ID NO: 278733 - DNA, 20 bp, Artificial Sequence
  chemically synthesized
tctctgtgttccaaagtgag

SEQ ID NO: 278734 - DNA, 20 bp, Artificial Sequence
  chemically synthesized
agtctctgtgttccaaagtg

SEQ ID NO: 278735 - DNA, 20 bp, Artificial Sequence
  chemically synthesized
tagtctctgtgttccaaagt

SEQ ID NO: 278736 - DNA, 20 bp, Artificial Sequence
  chemically synthesized
ttcctcctcactttggaaca

SEQ ID NO: 278737 - DNA, 20 bp, Artificial Sequence
  chemically synthesized
aatatagtctctgtgttcca

SEQ ID NO: 278738 - DNA, 20 bp, Artificial Sequence
  chemically synthesized
cctcctcactttggaacaca

SEQ ID NO: 278739 - DNA, 20 bp, Artificial Sequence
  chemically synthesized
gctccttctctcattaaata

SEQ ID NO: 278740 - DNA, 20 bp, Artificial Sequence
  chemically synthesized
acacagagactatatttaat

SEQ ID NO: 278741 - DNA, 20 bp, Artificial Sequence
  chemically synthesized
acagagactatatttaatga

SEQ ID NO: 278742 - DNA, 20 bp, Artificial Sequence
  chemically synthesized
gagactatatttaatgagag

SEQ ID NO: 278743 - DNA, 20 bp, Artificial Sequence
  chemically synthesized
agactatatttaatgagaga

SEQ ID NO: 278744 - DNA, 20 bp, Artificial Sequence
  chemically synthesized
actatatttaatgagagaag

SEQ ID NO: 278745 - DNA, 20 bp, Artificial Sequence
  chemically synthesized
atttaatgagagaaggagca

SEQ ID NO: 278746 - DNA, 20 bp, Artificial Sequence
  chemically synthesized
agagaaggagcaaagaaata

SEQ ID NO: 278747 - DNA, 20 bp, Artificial Sequence
  chemically synthesized
aaggagcaaagaaatacagc

SEQ ID NO: 278748 - DNA, 20 bp, Artificial Sequence
  chemically synthesized
gagcaaagaaatacagctag

SEQ ID NO: 278749 - DNA, 20 bp, Artificial Sequence
  chemically synthesized
gcaaagaaatacagctagtg

SEQ ID NO: 278750 - DNA, 20 bp, Artificial Sequence
  chemically synthesized
caaagaaatacagctagtgg

SEQ ID NO: 278751 - DNA, 20 bp, Artificial Sequence
  chemically synthesized
agctaacatgatgcctccac

SEQ ID NO: 278752 - DNA, 20 bp, Artificial Sequence
  chemically synthesized
agctagtggaggcatcatgt

SEQ ID NO: 278753 - DNA, 20 bp, Artificial Sequence
  chemically synthesized
actgtagtatagtttgaagt

SEQ ID NO: 278754 - DNA, 20 bp, Artificial Sequence
  chemically synthesized
tagcactgtagtatagtttg

SEQ ID NO: 278755 - DNA, 20 bp, Artificial Sequence
  chemically synthesized
gctgacttcaaactatacta

SEQ ID NO: 278756 - DNA, 20 bp, Artificial Sequence
  chemically synthesized
gttactgtagcactgtagta

SEQ ID NO: 278757 - DNA, 20 bp, Artificial Sequence
  chemically synthesized
ttttggttactgtagcactg

SEQ ID NO: 278758 - DNA, 20 bp, Artificial Sequence
  chemically synthesized
caaactatactacagtgcta

SEQ ID NO: 278759 - DNA, 20 bp, Artificial Sequence
  chemically synthesized
ctgtgttgttttggttactg

SEQ ID NO: 278760 - DNA, 20 bp, Artificial Sequence
  chemically synthesized
gtaccagtactgtgttgttt

SEQ ID NO: 278761 - DNA, 20 bp, Artificial Sequence
  chemically synthesized
ctacagtaaccaaaacaaca

SEQ ID NO: 278762 - DNA, 20 bp, Artificial Sequence
  chemically synthesized
taaccaaaacaacacagtac

SEQ ID NO: 278763 - DNA, 20 bp, Artificial Sequence
  chemically synthesized
ctatgtgactgtttttgtac

SEQ ID NO: 278764 - DNA, 20 bp, Artificial Sequence
  chemically synthesized
acacagtactggtacaaaaa

SEQ ID NO: 278765 - DNA, 20 bp, Artificial Sequence
  chemically synthesized
ctggtacaaaaacagtcaca

SEQ ID NO: 278766 - DNA, 20 bp, Artificial Sequence
  chemically synthesized
agtcacatagaccaatgaaa

SEQ ID NO: 278767 - DNA, 20 bp, Artificial Sequence
  chemically synthesized
ggctttccattctgtttcat

SEQ ID NO: 278768 - DNA, 20 bp, Artificial Sequence
  chemically synthesized
catagaccaatgaaacagaa

SEQ ID NO: 278769 - DNA, 20 bp, Artificial Sequence
  chemically synthesized
gaccaatgaaacagaatgga

SEQ ID NO: 278770 - DNA, 20 bp, Artificial Sequence
  chemically synthesized
atgaaacagaatggaaagcc

SEQ ID NO: 278771 - DNA, 20 bp, Artificial Sequence
  chemically synthesized
aggtgtgtggcattatttct

SEQ ID NO: 278772 - DNA, 20 bp, Artificial Sequence
  chemically synthesized
taggtgtgtggcattatttc

SEQ ID NO: 278773 - DNA, 20 bp, Artificial Sequence
  chemically synthesized
atcagaagggtataggtgtg

SEQ ID NO: 278774 - DNA, 20 bp, Artificial Sequence
  chemically synthesized
gtcgaagatcagaagggtat

SEQ ID NO: 278775 - DNA, 20 bp, Artificial Sequence
  chemically synthesized
tgtcgaagatcagaagggta

SEQ ID NO: 278776 - DNA, 20 bp, Artificial Sequence
  chemically synthesized
ggctttgtcgaagatcagaa

SEQ ID NO: 278777 - DNA, 20 bp, Artificial Sequence
  chemically synthesized
cggctttgtcgaagatcaga

SEQ ID NO: 278778 - DNA, 20 bp, Artificial Sequence
  chemically synthesized
tcggctttgtcgaagatcag

SEQ ID NO: 278779 - DNA, 20 bp, Artificial Sequence
  chemically synthesized
ttgtcggctttgtcgaagat

SEQ ID NO: 278780 - DNA, 20 bp, Artificial Sequence
  chemically synthesized
tacccttctgatcttcgaca

SEQ ID NO: 278781 - DNA, 20 bp, Artificial Sequence
  chemically synthesized
tgcttttgtcggctttgtcg

SEQ ID NO: 278782 - DNA, 20 bp, Artificial Sequence
  chemically synthesized
atcttcgacaaagccgacaa

SEQ ID NO: 278783 - DNA, 20 bp, Artificial Sequence
  chemically synthesized
tcctcattgcttgcttttgt

SEQ ID NO: 278784 - DNA, 20 bp, Artificial Sequence
  chemically synthesized
tcgacaaagccgacaaaagc

SEQ ID NO: 278785 - DNA, 20 bp, Artificial Sequence
  chemically synthesized
agccgacaaaagcaagcaat

SEQ ID NO: 278786 - DNA, 20 bp, Artificial Sequence
  chemically synthesized
gccgacaaaagcaagcaatg

SEQ ID NO: 278787 - DNA, 20 bp, Artificial Sequence
  chemically synthesized
acaaaagcaagcaatgagga

SEQ ID NO: 278788 - DNA, 20 bp, Artificial Sequence
  chemically synthesized
caaaagcaagcaatgaggaa

SEQ ID NO: 278789 - DNA, 20 bp, Artificial Sequence
  chemically synthesized
agcaccatttatggaatagg

SEQ ID NO: 278790 - DNA, 20 bp, Artificial Sequence
  chemically synthesized
ccagcaccatttatggaata

SEQ ID NO: 278791 - DNA, 20 bp, Artificial Sequence
  chemically synthesized
cccagcaccatttatggaat

SEQ ID NO: 278792 - DNA, 20 bp, Artificial Sequence
  chemically synthesized
tcccagcaccatttatggaa

SEQ ID NO: 278793 - DNA, 20 bp, Artificial Sequence
  chemically synthesized
aggactccctattccataaa

SEQ ID NO: 278794 - DNA, 20 bp, Artificial Sequence
  chemically synthesized
agttatcccagcaccattta

SEQ ID NO: 278795 - DNA, 20 bp, Artificial Sequence
  chemically synthesized
ccctattccataaatggtgc

SEQ ID NO: 278796 - DNA, 20 bp, Artificial Sequence
  chemically synthesized
cctattccataaatggtgct

SEQ ID NO: 278797 - DNA, 20 bp, Artificial Sequence
  chemically synthesized
ataaatggtgctgggataac

SEQ ID NO: 278798 - DNA, 20 bp, Artificial Sequence
  chemically synthesized
atacggttagccagttatcc

SEQ ID NO: 278799 - DNA, 20 bp, Artificial Sequence
  chemically synthesized
ttcttctgtatacggttagc

SEQ ID NO: 278800 - DNA, 20 bp, Artificial Sequence
  chemically synthesized
tttattcttctgtatacggt

SEQ ID NO: 278801 - DNA, 20 bp, Artificial Sequence
  chemically synthesized
gataactggctaaccgtata

SEQ ID NO: 278802 - DNA, 20 bp, Artificial Sequence
  chemically synthesized
aactggctaaccgtatacag

SEQ ID NO: 278803 - DNA, 20 bp, Artificial Sequence
  chemically synthesized
aggttttattcttctgtata

SEQ ID NO: 278804 - DNA, 20 bp, Artificial Sequence
  chemically synthesized
tgatttttgtatatggtgta

SEQ ID NO: 278805 - DNA, 20 bp, Artificial Sequence
  chemically synthesized
ttgatttttgtatatggtgt

SEQ ID NO: 278806 - DNA, 20 bp, Artificial Sequence
  chemically synthesized
cttgagttgatttttgtata

SEQ ID NO: 278807 - DNA, 20 bp, Artificial Sequence
  chemically synthesized
ccatatacaaaaatcaactc

SEQ ID NO: 278808 - DNA, 20 bp, Artificial Sequence
  chemically synthesized
ttaagtctttcattcatctt

SEQ ID NO: 278809 - DNA, 20 bp, Artificial Sequence
  chemically synthesized
aatcaactcaagatgaatga

SEQ ID NO: 278810 - DNA, 20 bp, Artificial Sequence
  chemically synthesized
aagttttgctttgacatttt

SEQ ID NO: 278811 - DNA, 20 bp, Artificial Sequence
  chemically synthesized
atgaaagacttaaaatgtca

SEQ ID NO: 278812 - DNA, 20 bp, Artificial Sequence
  chemically synthesized
gttatcctccagggttttta

SEQ ID NO: 278813 - DNA, 20 bp, Artificial Sequence
  chemically synthesized
aagcaaaactttaaaaaccc

SEQ ID NO: 278814 - DNA, 20 bp, Artificial Sequence
  chemically synthesized
gcaaaactttaaaaaccctg

SEQ ID NO: 278815 - DNA, 20 bp, Artificial Sequence
  chemically synthesized
caaaactttaaaaaccctgg

SEQ ID NO: 278816 - DNA, 20 bp, Artificial Sequence
  chemically synthesized
attgcctaggttatcctcca

SEQ ID NO: 278817 - DNA, 20 bp, Artificial Sequence
  chemically synthesized
tattgcctaggttatcctcc

SEQ ID NO: 278818 - DNA, 20 bp, Artificial Sequence
  chemically synthesized
gtattgcctaggttatcctc

SEQ ID NO: 278819 - DNA, 20 bp, Artificial Sequence
  chemically synthesized
aaaaaccctggaggataacc

SEQ ID NO: 278820 - DNA, 20 bp, Artificial Sequence
  chemically synthesized
aaaaccctggaggataacct

SEQ ID NO: 278821 - DNA, 20 bp, Artificial Sequence
  chemically synthesized
tgtccaggatggtattgcct

SEQ ID NO: 278822 - DNA, 20 bp, Artificial Sequence
  chemically synthesized
atgtccaggatggtattgcc

SEQ ID NO: 278823 - DNA, 20 bp, Artificial Sequence
  chemically synthesized
taacctaggcaataccatcc

SEQ ID NO: 278824 - DNA, 20 bp, Artificial Sequence
  chemically synthesized
tcccattcctatgtccagga

SEQ ID NO: 278825 - DNA, 20 bp, Artificial Sequence
  chemically synthesized
aggcaataccatcctggaca

SEQ ID NO: 278826 - DNA, 20 bp, Artificial Sequence
  chemically synthesized
ggcaataccatcctggacat

SEQ ID NO: 278827 - DNA, 20 bp, Artificial Sequence
  chemically synthesized
cttttcccattcctatgtcc

SEQ ID NO: 278828 - DNA, 20 bp, Artificial Sequence
  chemically synthesized
tcttttcccattcctatgtc

SEQ ID NO: 278829 - DNA, 20 bp, Artificial Sequence
  chemically synthesized
taccatcctggacataggaa

SEQ ID NO: 278830 - DNA, 20 bp, Artificial Sequence
  chemically synthesized
accatcctggacataggaat

SEQ ID NO: 278831 - DNA, 20 bp, Artificial Sequence
  chemically synthesized
cctggacataggaatgggaa

SEQ ID NO: 278832 - DNA, 20 bp, Artificial Sequence
  chemically synthesized
agatgtaatgatgatgtcaa

SEQ ID NO: 278833 - DNA, 20 bp, Artificial Sequence
  chemically synthesized
gtcaaaagcaattgcaacaa

SEQ ID NO: 278834 - DNA, 20 bp, Artificial Sequence
  chemically synthesized
aaaagcaaacactgacaaat

SEQ ID NO: 278835 - DNA, 20 bp, Artificial Sequence
  chemically synthesized
tttaattaggtctcatttgt

SEQ ID NO: 278836 - DNA, 20 bp, Artificial Sequence
  chemically synthesized
ggaagttgtgtaatttaatt

SEQ ID NO: 278837 - DNA, 20 bp, Artificial Sequence
  chemically synthesized
aggaagttgtgtaatttaat

SEQ ID NO: 278838 - DNA, 20 bp, Artificial Sequence
  chemically synthesized
taaattacacaacttcctca

SEQ ID NO: 278839 - DNA, 20 bp, Artificial Sequence
  chemically synthesized
aattacacaacttcctcaca

SEQ ID NO: 278840 - DNA, 20 bp, Artificial Sequence
  chemically synthesized
aacagaggaactctgtgagg

SEQ ID NO: 278841 - DNA, 20 bp, Artificial Sequence
  chemically synthesized
ttcaacagaggaactctgtg

SEQ ID NO: 278842 - DNA, 20 bp, Artificial Sequence
  chemically synthesized
gttcaacagaggaactctgt

SEQ ID NO: 278843 - DNA, 20 bp, Artificial Sequence
  chemically synthesized
ctgttgacagagttcaacag

SEQ ID NO: 278844 - DNA, 20 bp, Artificial Sequence
  chemically synthesized
tctgttgacagagttcaaca

SEQ ID NO: 278845 - DNA, 20 bp, Artificial Sequence
  chemically synthesized
actctgttgacagagttcaa

SEQ ID NO: 278846 - DNA, 20 bp, Artificial Sequence
  chemically synthesized
cctctgttgaactctgtcaa

SEQ ID NO: 278847 - DNA, 20 bp, Artificial Sequence
  chemically synthesized
gtctgtttactctgttgaca

SEQ ID NO: 278848 - DNA, 20 bp, Artificial Sequence
  chemically synthesized
tctgttgaactctgtcaaca

SEQ ID NO: 278849 - DNA, 20 bp, Artificial Sequence
  chemically synthesized
ttgtctgtttactctgttga

SEQ ID NO: 278850 - DNA, 20 bp, Artificial Sequence
  chemically synthesized
aactctgtcaacagagtaaa

SEQ ID NO: 278851 - DNA, 20 bp, Artificial Sequence
  chemically synthesized
cagagtaaacagacaaacta

SEQ ID NO: 278852 - DNA, 20 bp, Artificial Sequence
  chemically synthesized
taaacagacaaactacagaa

SEQ ID NO: 278853 - DNA, 20 bp, Artificial Sequence
  chemically synthesized
aaacagacaaactacagaac

SEQ ID NO: 278854 - DNA, 20 bp, Artificial Sequence
  chemically synthesized
aaaatatttctcccgttctg

SEQ ID NO: 278855 - DNA, 20 bp, Artificial Sequence
  chemically synthesized
acagacaaactacagaacgg

SEQ ID NO: 278856 - DNA, 20 bp, Artificial Sequence
  chemically synthesized
ttaaacctttatcagattca

SEQ ID NO: 278857 - DNA, 20 bp, Artificial Sequence
  chemically synthesized
tgcaaactgtgaatctgata

SEQ ID NO: 278858 - DNA, 20 bp, Artificial Sequence
  chemically synthesized
gcaaactgtgaatctgataa

SEQ ID NO: 278859 - DNA, 20 bp, Artificial Sequence
  chemically synthesized
tctggatgttaaacctttat

SEQ ID NO: 278860 - DNA, 20 bp, Artificial Sequence
  chemically synthesized
tctgataaaggtttaacatc

SEQ ID NO: 278861 - DNA, 20 bp, Artificial Sequence
  chemically synthesized
tttaagttacttagagattc

SEQ ID NO: 278862 - DNA, 20 bp, Artificial Sequence
  chemically synthesized
gtttaacatccagaatctct

SEQ ID NO: 278863 - DNA, 20 bp, Artificial Sequence
  chemically synthesized
aaatttgtttaagttactta

SEQ ID NO: 278864 - DNA, 20 bp, Artificial Sequence
  chemically synthesized
ataaatttgtttaagttact

SEQ ID NO: 278865 - DNA, 20 bp, Artificial Sequence
  chemically synthesized
tttttaaaataaatttgttt

SEQ ID NO: 278866 - DNA, 20 bp, Artificial Sequence
  chemically synthesized
tgcccatttttaatggagta

SEQ ID NO: 278867 - DNA, 20 bp, Artificial Sequence
  chemically synthesized
tttgcccatttttaatggag

SEQ ID NO: 278868 - DNA, 20 bp, Artificial Sequence
  chemically synthesized
tcctttgcccatttttaatg

SEQ ID NO: 278869 - DNA, 20 bp, Artificial Sequence
  chemically synthesized
aaactctactccattaaaaa

SEQ ID NO: 278870 - DNA, 20 bp, Artificial Sequence
  chemically synthesized
tgtcctttgcccatttttaa

SEQ ID NO: 278871 - DNA, 20 bp, Artificial Sequence
  chemically synthesized
aactctactccattaaaaat

SEQ ID NO: 278872 - DNA, 20 bp, Artificial Sequence
  chemically synthesized
tactccattaaaaatgggca

SEQ ID NO: 278873 - DNA, 20 bp, Artificial Sequence
  chemically synthesized
actccattaaaaatgggcaa

SEQ ID NO: 278874 - DNA, 20 bp, Artificial Sequence
  chemically synthesized
catgaacacacatttttcac

SEQ ID NO: 278875 - DNA, 20 bp, Artificial Sequence
  chemically synthesized
ttcacaagacgacacacatg

SEQ ID NO: 278876 - DNA, 20 bp, Artificial Sequence
  chemically synthesized
agcattttttttcatattgt

SEQ ID NO: 278877 - DNA, 20 bp, Artificial Sequence
  chemically synthesized
ctctaatggttggtgatatt

SEQ ID NO: 278878 - DNA, 20 bp, Artificial Sequence
  chemically synthesized
tgctcaatatcaccaaccat

SEQ ID NO: 278879 - DNA, 20 bp, Artificial Sequence
  chemically synthesized
ctcaatatcaccaaccatta

SEQ ID NO: 278880 - DNA, 20 bp, Artificial Sequence
  chemically synthesized
atgtgcacttctctaatggt

SEQ ID NO: 278881 - DNA, 20 bp, Artificial Sequence
  chemically synthesized
aatatcaccaaccattagag

SEQ ID NO: 278882 - DNA, 20 bp, Artificial Sequence
  chemically synthesized
tttaatgtgcacttctctaa

SEQ ID NO: 278883 - DNA, 20 bp, Artificial Sequence
  chemically synthesized
gtgcacattaaaaccacgat

SEQ ID NO: 278884 - DNA, 20 bp, Artificial Sequence
  chemically synthesized
tgcgagatggcatcttatcg

SEQ ID NO: 278885 - DNA, 20 bp, Artificial Sequence
  chemically synthesized
ccattttgactggtgcgaga

SEQ ID NO: 278886 - DNA, 20 bp, Artificial Sequence
  chemically synthesized
gataagatgccatctcgcac

SEQ ID NO: 278887 - DNA, 20 bp, Artificial Sequence
  chemically synthesized
atagccattttgactggtgc

SEQ ID NO: 278888 - DNA, 20 bp, Artificial Sequence
  chemically synthesized
ccatctcgcaccagtcaaaa

SEQ ID NO: 278889 - DNA, 20 bp, Artificial Sequence
  chemically synthesized
ttaataatagccattttgac

SEQ ID NO: 278890 - DNA, 20 bp, Artificial Sequence
  chemically synthesized
attttttgacattttaataa

SEQ ID NO: 278891 - DNA, 20 bp, Artificial Sequence
  chemically synthesized
attaaaatgtcaaaaaataa

SEQ ID NO: 278892 - DNA, 20 bp, Artificial Sequence
  chemically synthesized
caaaaaataacagatgctgt

SEQ ID NO: 278893 - DNA, 20 bp, Artificial Sequence
  chemically synthesized
aaaaaataacagatgctgtt

SEQ ID NO: 278894 - DNA, 20 bp, Artificial Sequence
  chemically synthesized
aataacagatgctgttggga

SEQ ID NO: 278895 - DNA, 20 bp, Artificial Sequence
  chemically synthesized
tgttttctctgccatcccaa

SEQ ID NO: 278896 - DNA, 20 bp, Artificial Sequence
  chemically synthesized
aacagatgctgttgggatgg

SEQ ID NO: 278897 - DNA, 20 bp, Artificial Sequence
  chemically synthesized
cagatgctgttgggatggca

SEQ ID NO: 278898 - DNA, 20 bp, Artificial Sequence
  chemically synthesized
tgttgggatggcagagaaaa

SEQ ID NO: 278899 - DNA, 20 bp, Artificial Sequence
  chemically synthesized
acagaacatttatacactgc

SEQ ID NO: 278900 - DNA, 20 bp, Artificial Sequence
  chemically synthesized
gaacatttatacactgctgg

SEQ ID NO: 278901 - DNA, 20 bp, Artificial Sequence
  chemically synthesized
aacatttatacactgctggt

SEQ ID NO: 278902 - DNA, 20 bp, Artificial Sequence
  chemically synthesized
acatttatacactgctggtg

SEQ ID NO: 278903 - DNA, 20 bp, Artificial Sequence
  chemically synthesized
catttatacactgctggtgg

SEQ ID NO: 278904 - DNA, 20 bp, Artificial Sequence
  chemically synthesized
ctaatttacacccccaccag

SEQ ID NO: 278905 - DNA, 20 bp, Artificial Sequence
  chemically synthesized
caactaatttacacccccac

SEQ ID NO: 278906 - DNA, 20 bp, Artificial Sequence
  chemically synthesized
ctgctggtgggggtgtaaat

SEQ ID NO: 278907 - DNA, 20 bp, Artificial Sequence
  chemically synthesized
ggtgggggtgtaaattagtt

SEQ ID NO: 278908 - DNA, 20 bp, Artificial Sequence
  chemically synthesized
gtaaattagttgagcccttg

SEQ ID NO: 278909 - DNA, 20 bp, Artificial Sequence
  chemically synthesized
attagttgagcccttgtgga

SEQ ID NO: 278910 - DNA, 20 bp, Artificial Sequence
  chemically synthesized
tgccaaactgctttccacaa

SEQ ID NO: 278911 - DNA, 20 bp, Artificial Sequence
  chemically synthesized
ctgccaaactgctttccaca

SEQ ID NO: 278912 - DNA, 20 bp, Artificial Sequence
  chemically synthesized
tctgccaaactgctttccac

SEQ ID NO: 278913 - DNA, 20 bp, Artificial Sequence
  chemically synthesized
agttgagcccttgtggaaag

SEQ ID NO: 278914 - DNA, 20 bp, Artificial Sequence
  chemically synthesized
agcccttgtggaaagcagtt

SEQ ID NO: 278915 - DNA, 20 bp, Artificial Sequence
  chemically synthesized
ccttgtggaaagcagtttgg

SEQ ID NO: 278916 - DNA, 20 bp, Artificial Sequence
  chemically synthesized
ttgtggaaagcagtttggca

SEQ ID NO: 278917 - DNA, 20 bp, Artificial Sequence
  chemically synthesized
cagtttggcagagctaaaaa

SEQ ID NO: 278918 - DNA, 20 bp, Artificial Sequence
  chemically synthesized
gggttgctgtgttctgtttt

SEQ ID NO: 278919 - DNA, 20 bp, Artificial Sequence
  chemically synthesized
gcagagctaaaaacagaaca

SEQ ID NO: 278920 - DNA, 20 bp, Artificial Sequence
  chemically synthesized
gaacacagcaaccccattac

SEQ ID NO: 278921 - DNA, 20 bp, Artificial Sequence
  chemically synthesized
aacacagcaaccccattacc

SEQ ID NO: 278922 - DNA, 20 bp, Artificial Sequence
  chemically synthesized
tggctatacacccggtaatg

SEQ ID NO: 278923 - DNA, 20 bp, Artificial Sequence
  chemically synthesized
ttggctatacacccggtaat

SEQ ID NO: 278924 - DNA, 20 bp, Artificial Sequence
  chemically synthesized
tttggctatacacccggtaa

SEQ ID NO: 278925 - DNA, 20 bp, Artificial Sequence
  chemically synthesized
caaccccattaccgggtgta

SEQ ID NO: 278926 - DNA, 20 bp, Artificial Sequence
  chemically synthesized
tattcctttggctatacacc

SEQ ID NO: 278927 - DNA, 20 bp, Artificial Sequence
  chemically synthesized
cattaccgggtgtatagcca

SEQ ID NO: 278928 - DNA, 20 bp, Artificial Sequence
  chemically synthesized
attaccgggtgtatagccaa

SEQ ID NO: 278929 - DNA, 20 bp, Artificial Sequence
  chemically synthesized
tagaacaatttgtattcctt

SEQ ID NO: 278930 - DNA, 20 bp, Artificial Sequence
  chemically synthesized
atacaaattgttctaccaca

SEQ ID NO: 278931 - DNA, 20 bp, Artificial Sequence
  chemically synthesized
gtgtgcatgtgtctttgtgg

SEQ ID NO: 278932 - DNA, 20 bp, Artificial Sequence
  chemically synthesized
tatgtgtgcatgtgtctttg

SEQ ID NO: 278933 - DNA, 20 bp, Artificial Sequence
  chemically synthesized
cattgcaacactattcacaa

SEQ ID NO: 278934 - DNA, 20 bp, Artificial Sequence
  chemically synthesized
tgtatctttgctattgtgaa

SEQ ID NO: 278935 - DNA, 20 bp, Artificial Sequence
  chemically synthesized
caacactattcacaatagca

SEQ ID NO: 278936 - DNA, 20 bp, Artificial Sequence
  chemically synthesized
tattcacaatagcaaagata

SEQ ID NO: 278937 - DNA, 20 bp, Artificial Sequence
  chemically synthesized
gtctaccatggagggcattt

SEQ ID NO: 278938 - DNA, 20 bp, Artificial Sequence
  chemically synthesized
agtctaccatggagggcatt

SEQ ID NO: 278939 - DNA, 20 bp, Artificial Sequence
  chemically synthesized
atcaacctaaatgccctcca

SEQ ID NO: 278940 - DNA, 20 bp, Artificial Sequence
  chemically synthesized
aacctaaatgccctccatgg

SEQ ID NO: 278941 - DNA, 20 bp, Artificial Sequence
  chemically synthesized
tttatctagtctaccatgga

SEQ ID NO: 278942 - DNA, 20 bp, Artificial Sequence
  chemically synthesized
ctttatctagtctaccatgg

SEQ ID NO: 278943 - DNA, 20 bp, Artificial Sequence
  chemically synthesized
tctttatctagtctaccatg

SEQ ID NO: 278944 - DNA, 20 bp, Artificial Sequence
  chemically synthesized
tttctttatctagtctacca

SEQ ID NO: 278945 - DNA, 20 bp, Artificial Sequence
  chemically synthesized
aaatgccctccatggtagac

SEQ ID NO: 278946 - DNA, 20 bp, Artificial Sequence
  chemically synthesized
cctccatggtagactagata

SEQ ID NO: 278947 - DNA, 20 bp, Artificial Sequence
  chemically synthesized
tgcaccacattttctttatc

SEQ ID NO: 278948 - DNA, 20 bp, Artificial Sequence
  chemically synthesized
tagactagataaagaaaatg

SEQ ID NO: 278949 - DNA, 20 bp, Artificial Sequence
  chemically synthesized
aatgtggtgcatatacacca

SEQ ID NO: 278950 - DNA, 20 bp, Artificial Sequence
  chemically synthesized
tgtggctgcgtagtgttcca

SEQ ID NO: 278951 - DNA, 20 bp, Artificial Sequence
  chemically synthesized
atacaccatggaacactacg

SEQ ID NO: 278952 - DNA, 20 bp, Artificial Sequence
  chemically synthesized
tccttctttttgtggctgcg

SEQ ID NO: 278953 - DNA, 20 bp, Artificial Sequence
  chemically synthesized
gaacactacgcagccacaaa

SEQ ID NO: 278954 - DNA, 20 bp, Artificial Sequence
  chemically synthesized
cactacgcagccacaaaaag

SEQ ID NO: 278955 - DNA, 20 bp, Artificial Sequence
  chemically synthesized
acacgaactccttctttttg

SEQ ID NO: 278956 - DNA, 20 bp, Artificial Sequence
  chemically synthesized
actacgcagccacaaaaaga

SEQ ID NO: 278957 - DNA, 20 bp, Artificial Sequence
  chemically synthesized
tacgcagccacaaaaagaag

SEQ ID NO: 278958 - DNA, 20 bp, Artificial Sequence
  chemically synthesized
gaaggagttcgtgtcctttg

SEQ ID NO: 278959 - DNA, 20 bp, Artificial Sequence
  chemically synthesized
aaggagttcgtgtcctttgc

SEQ ID NO: 278960 - DNA, 20 bp, Artificial Sequence
  chemically synthesized
ctccctccatgttcctgcaa

SEQ ID NO: 278961 - DNA, 20 bp, Artificial Sequence
  chemically synthesized
gctccctccatgttcctgca

SEQ ID NO: 278962 - DNA, 20 bp, Artificial Sequence
  chemically synthesized
tcgtgtcctttgcaggaaca

SEQ ID NO: 278963 - DNA, 20 bp, Artificial Sequence
  chemically synthesized
gtgtcctttgcaggaacatg

SEQ ID NO: 278964 - DNA, 20 bp, Artificial Sequence
  chemically synthesized
tgtcctttgcaggaacatgg

SEQ ID NO: 278965 - DNA, 20 bp, Artificial Sequence
  chemically synthesized
gtcctttgcaggaacatgga

SEQ ID NO: 278966 - DNA, 20 bp, Artificial Sequence
  chemically synthesized
cctttgcaggaacatggagg

SEQ ID NO: 278967 - DNA, 20 bp, Artificial Sequence
  chemically synthesized
tgcaggaacatggagggagc

SEQ ID NO: 278968 - DNA, 20 bp, Artificial Sequence
  chemically synthesized
caggaacatggagggagctg

SEQ ID NO: 278969 - DNA, 20 bp, Artificial Sequence
  chemically synthesized
ttgctaagtagaatggtctc

SEQ ID NO: 278970 - DNA, 20 bp, Artificial Sequence
  chemically synthesized
gagctggagaccattctact

SEQ ID NO: 278971 - DNA, 20 bp, Artificial Sequence
  chemically synthesized
cattagtttgctaagtagaa

SEQ ID NO: 278972 - DNA, 20 bp, Artificial Sequence
  chemically synthesized
tcctgcattagtttgctaag

SEQ ID NO: 278973 - DNA, 20 bp, Artificial Sequence
  chemically synthesized
tgttcctgcattagtttgct

SEQ ID NO: 278974 - DNA, 20 bp, Artificial Sequence
  chemically synthesized
ttctacttagcaaactaatg

SEQ ID NO: 278975 - DNA, 20 bp, Artificial Sequence
  chemically synthesized
tctacttagcaaactaatgc

SEQ ID NO: 278976 - DNA, 20 bp, Artificial Sequence
  chemically synthesized
ttagttgtctgttcctgcat

SEQ ID NO: 278977 - DNA, 20 bp, Artificial Sequence
  chemically synthesized
ttagcaaactaatgcaggaa

SEQ ID NO: 278978 - DNA, 20 bp, Artificial Sequence
  chemically synthesized
aagtgagaacatgtgatatt

SEQ ID NO: 278979 - DNA, 20 bp, Artificial Sequence
  chemically synthesized
tatcacatgttctcacttat

SEQ ID NO: 278980 - DNA, 20 bp, Artificial Sequence
  chemically synthesized
tttagctcccacttataagt

SEQ ID NO: 278981 - DNA, 20 bp, Artificial Sequence
  chemically synthesized
cacatgttctcacttataag

SEQ ID NO: 278982 - DNA, 20 bp, Artificial Sequence
  chemically synthesized
acatgttctcacttataagt

SEQ ID NO: 278983 - DNA, 20 bp, Artificial Sequence
  chemically synthesized
attatttagctcccacttat

SEQ ID NO: 278984 - DNA, 20 bp, Artificial Sequence
  chemically synthesized
atgttctcacttataagtgg

SEQ ID NO: 278985 - DNA, 20 bp, Artificial Sequence
  chemically synthesized
ataagtgggagctaaataat

SEQ ID NO: 278986 - DNA, 20 bp, Artificial Sequence
  chemically synthesized
gtccatgtattctcattatt

SEQ ID NO: 278987 - DNA, 20 bp, Artificial Sequence
  chemically synthesized
agctaaataatgagaataca

SEQ ID NO: 278988 - DNA, 20 bp, Artificial Sequence
  chemically synthesized
tgagaatacatggacacaat

SEQ ID NO: 278989 - DNA, 20 bp, Artificial Sequence
  chemically synthesized
gagaatacatggacacaatg

SEQ ID NO: 278990 - DNA, 20 bp, Artificial Sequence
  chemically synthesized
agaatacatggacacaatga

SEQ ID NO: 278991 - DNA, 20 bp, Artificial Sequence
  chemically synthesized
acatggacacaatgagggaa

SEQ ID NO: 278992 - DNA, 20 bp, Artificial Sequence
  chemically synthesized
cacaatgagggaacagacac

SEQ ID NO: 278993 - DNA, 20 bp, Artificial Sequence
  chemically synthesized
acaatgagggaacagacact

SEQ ID NO: 278994 - DNA, 20 bp, Artificial Sequence
  chemically synthesized
ctctatcctcaagtaggacc

SEQ ID NO: 278995 - DNA, 20 bp, Artificial Sequence
  chemically synthesized
acagacactgggtcctactt

SEQ ID NO: 278996 - DNA, 20 bp, Artificial Sequence
  chemically synthesized
cagacactgggtcctacttg

SEQ ID NO: 278997 - DNA, 20 bp, Artificial Sequence
  chemically synthesized
cccattctctatcctcaagt

SEQ ID NO: 278998 - DNA, 20 bp, Artificial Sequence
  chemically synthesized
tcccattctctatcctcaag

SEQ ID NO: 278999 - DNA, 20 bp, Artificial Sequence
  chemically synthesized
cactgggtcctacttgagga

SEQ ID NO: 279000 - DNA, 20 bp, Artificial Sequence
  chemically synthesized
ctgggtcctacttgaggata

SEQ ID NO: 279001 - DNA, 20 bp, Artificial Sequence
  chemically synthesized
tcctcccattctctatcctc

SEQ ID NO: 279002 - DNA, 20 bp, Artificial Sequence
  chemically synthesized
tcctacttgaggatagagaa

SEQ ID NO: 279003 - DNA, 20 bp, Artificial Sequence
  chemically synthesized
cctacttgaggatagagaat

SEQ ID NO: 279004 - DNA, 20 bp, Artificial Sequence
  chemically synthesized
tacttgaggatagagaatgg

SEQ ID NO: 279005 - DNA, 20 bp, Artificial Sequence
  chemically synthesized
acttgaggatagagaatggg

SEQ ID NO: 279006 - DNA, 20 bp, Artificial Sequence
  chemically synthesized
tgaggatagagaatgggagg

SEQ ID NO: 279007 - DNA, 20 bp, Artificial Sequence
  chemically synthesized
gaggatagagaatgggagga

SEQ ID NO: 279008 - DNA, 20 bp, Artificial Sequence
  chemically synthesized
aggatagagaatgggaggaa

SEQ ID NO: 279009 - DNA, 20 bp, Artificial Sequence
  chemically synthesized
ggatagagaatgggaggaag

SEQ ID NO: 279010 - DNA, 20 bp, Artificial Sequence
  chemically synthesized
atagagaatgggaggaaggg

SEQ ID NO: 279011 - DNA, 20 bp, Artificial Sequence
  chemically synthesized
tagagaatgggaggaagggg

SEQ ID NO: 279012 - DNA, 20 bp, Artificial Sequence
  chemically synthesized
aatgggaggaaggggaggat

SEQ ID NO: 279013 - DNA, 20 bp, Artificial Sequence
  chemically synthesized
ggatcagaaaaaatacctat

SEQ ID NO: 279014 - DNA, 20 bp, Artificial Sequence
  chemically synthesized
gatcagaaaaaatacctatc

SEQ ID NO: 279015 - DNA, 20 bp, Artificial Sequence
  chemically synthesized
cagaaaaaatacctatcagg

SEQ ID NO: 279016 - DNA, 20 bp, Artificial Sequence
  chemically synthesized
taataagcatactacctgat

SEQ ID NO: 279017 - DNA, 20 bp, Artificial Sequence
  chemically synthesized
gtaataagcatactacctga

SEQ ID NO: 279018 - DNA, 20 bp, Artificial Sequence
  chemically synthesized
caggtagtatgcttattacc

SEQ ID NO: 279019 - DNA, 20 bp, Artificial Sequence
  chemically synthesized
aggtagtatgcttattacct

SEQ ID NO: 279020 - DNA, 20 bp, Artificial Sequence
  chemically synthesized
tatttcatcacccaggtaat

SEQ ID NO: 279021 - DNA, 20 bp, Artificial Sequence
  chemically synthesized
tacagattatttcatcaccc

SEQ ID NO: 279022 - DNA, 20 bp, Artificial Sequence
  chemically synthesized
gtacagattatttcatcacc

SEQ ID NO: 279023 - DNA, 20 bp, Artificial Sequence
  chemically synthesized
tgtcatggggggttggtgta

SEQ ID NO: 279024 - DNA, 20 bp, Artificial Sequence
  chemically synthesized
aacagtgtgtcatggggggt

SEQ ID NO: 279025 - DNA, 20 bp, Artificial Sequence
  chemically synthesized
ggtaaacagtgtgtcatggg

SEQ ID NO: 279026 - DNA, 20 bp, Artificial Sequence
  chemically synthesized
aggtaaacagtgtgtcatgg

SEQ ID NO: 279027 - DNA, 20 bp, Artificial Sequence
  chemically synthesized
caggtaaacagtgtgtcatg

SEQ ID NO: 279028 - DNA, 20 bp, Artificial Sequence
  chemically synthesized
acaggtaaacagtgtgtcat

SEQ ID NO: 279029 - DNA, 20 bp, Artificial Sequence
  chemically synthesized
tacaggtaaacagtgtgtca

SEQ ID NO: 279030 - DNA, 20 bp, Artificial Sequence
  chemically synthesized
aggtttgttatacaggtaaa

SEQ ID NO: 279031 - DNA, 20 bp, Artificial Sequence
  chemically synthesized
tatatgcaggtttgttatac

SEQ ID NO: 279032 - DNA, 20 bp, Artificial Sequence
  chemically synthesized
atatatgcaggtttgttata

SEQ ID NO: 279033 - DNA, 20 bp, Artificial Sequence
  chemically synthesized
tatgttctgggtatatatgc

SEQ ID NO: 279034 - DNA, 20 bp, Artificial Sequence
  chemically synthesized
ttatgttctgggtatatatg

SEQ ID NO: 279035 - DNA, 20 bp, Artificial Sequence
  chemically synthesized
aacaaacctgcatatatacc

SEQ ID NO: 279036 - DNA, 20 bp, Artificial Sequence
  chemically synthesized
ttgttttacttttatgttct

SEQ ID NO: 279037 - DNA, 20 bp, Artificial Sequence
  chemically synthesized
gttgttttacttttatgttc

SEQ ID NO: 279038 - DNA, 20 bp, Artificial Sequence
  chemically synthesized
catatatacccagaacataa

SEQ ID NO: 279039 - DNA, 20 bp, Artificial Sequence
  chemically synthesized
agaacataaaagtaaaacaa

SEQ ID NO: 279040 - DNA, 20 bp, Artificial Sequence
  chemically synthesized
cataaaagtaaaacaacagc

SEQ ID NO: 279041 - DNA, 20 bp, Artificial Sequence
  chemically synthesized
aaagatggtctcaacagatc

SEQ ID NO: 279042 - DNA, 20 bp, Artificial Sequence
  chemically synthesized
aaacaacagctagatctgtt

SEQ ID NO: 279043 - DNA, 20 bp, Artificial Sequence
  chemically synthesized
gatctgaaagatggtctcaa

SEQ ID NO: 279044 - DNA, 20 bp, Artificial Sequence
  chemically synthesized
gatctgttgagaccatcttt

SEQ ID NO: 279045 - DNA, 20 bp, Artificial Sequence
  chemically synthesized
ctcttagcagatctgaaaga

SEQ ID NO: 279046 - DNA, 20 bp, Artificial Sequence
  chemically synthesized
ctttctcttagcagatctga

SEQ ID NO: 279047 - DNA, 20 bp, Artificial Sequence
  chemically synthesized
gaccatctttcagatctgct

SEQ ID NO: 279048 - DNA, 20 bp, Artificial Sequence
  chemically synthesized
ccatctttcagatctgctaa

SEQ ID NO: 279049 - DNA, 20 bp, Artificial Sequence
  chemically synthesized
tttaccagcctttctcttag

SEQ ID NO: 279050 - DNA, 20 bp, Artificial Sequence
  chemically synthesized
ctttcagatctgctaagaga

SEQ ID NO: 279051 - DNA, 20 bp, Artificial Sequence
  chemically synthesized
tttcagatctgctaagagaa

SEQ ID NO: 279052 - DNA, 20 bp, Artificial Sequence
  chemically synthesized
ttctttaccagcctttctct

SEQ ID NO: 279053 - DNA, 20 bp, Artificial Sequence
  chemically synthesized
agatctgctaagagaaaggc

SEQ ID NO: 279054 - DNA, 20 bp, Artificial Sequence
  chemically synthesized
tgctaagagaaaggctggta

SEQ ID NO: 279055 - DNA, 20 bp, Artificial Sequence
  chemically synthesized
aagagaaaggctggtaaaga

SEQ ID NO: 279056 - DNA, 20 bp, Artificial Sequence
  chemically synthesized
tgattcttgtctttctttac

SEQ ID NO: 279057 - DNA, 20 bp, Artificial Sequence
  chemically synthesized
aaaggctggtaaagaaagac

SEQ ID NO: 279058 - DNA, 20 bp, Artificial Sequence
  chemically synthesized
gtaaagaaagacaagaatca

SEQ ID NO: 279059 - DNA, 20 bp, Artificial Sequence
  chemically synthesized
agaatcaaagttcattttaa

SEQ ID NO: 279060 - DNA, 20 bp, Artificial Sequence
  chemically synthesized
aaagttcattttaaaagttt

SEQ ID NO: 279061 - DNA, 20 bp, Artificial Sequence
  chemically synthesized
cattttaaaagttttggtat

SEQ ID NO: 279062 - DNA, 20 bp, Artificial Sequence
  chemically synthesized
agttttggtatgagaaattt

SEQ ID NO: 279063 - DNA, 20 bp, Artificial Sequence
  chemically synthesized
gttttggtatgagaaatttc

SEQ ID NO: 279064 - DNA, 20 bp, Artificial Sequence
  chemically synthesized
gtatgagaaatttcaggaat

SEQ ID NO: 279065 - DNA, 20 bp, Artificial Sequence
  chemically synthesized
gagaaatttcaggaatgaga

SEQ ID NO: 279066 - DNA, 20 bp, Artificial Sequence
  chemically synthesized
caggaatgagatggcattaa

SEQ ID NO: 279067 - DNA, 20 bp, Artificial Sequence
  chemically synthesized
ggaatgagatggcattaaca

SEQ ID NO: 279068 - DNA, 20 bp, Artificial Sequence
  chemically synthesized
gaatgagatggcattaacag

SEQ ID NO: 279069 - DNA, 20 bp, Artificial Sequence
  chemically synthesized
tgagatggcattaacagagg

SEQ ID NO: 279070 - DNA, 20 bp, Artificial Sequence
  chemically synthesized
agatggcattaacagaggtg

SEQ ID NO: 279071 - DNA, 20 bp, Artificial Sequence
  chemically synthesized
attaacagaggtggagaaaa

SEQ ID NO: 279072 - DNA, 20 bp, Artificial Sequence
  chemically synthesized
agaggtggagaaaacggtgt

SEQ ID NO: 279073 - DNA, 20 bp, Artificial Sequence
  chemically synthesized
gaggtggagaaaacggtgtt

SEQ ID NO: 279074 - DNA, 20 bp, Artificial Sequence
  chemically synthesized
gtggagaaaacggtgttggg

SEQ ID NO: 279075 - DNA, 20 bp, Artificial Sequence
  chemically synthesized
acggtgttgggtagctttga

SEQ ID NO: 279076 - DNA, 20 bp, Artificial Sequence
  chemically synthesized
cggtgttgggtagctttgat

SEQ ID NO: 279077 - DNA, 20 bp, Artificial Sequence
  chemically synthesized
gtgttgggtagctttgatag

SEQ ID NO: 279078 - DNA, 20 bp, Artificial Sequence
  chemically synthesized
tcagatgacagctcctatca

SEQ ID NO: 279079 - DNA, 20 bp, Artificial Sequence
  chemically synthesized
tttgataggagctgtcatct

SEQ ID NO: 279080 - DNA, 20 bp, Artificial Sequence
  chemically synthesized
aacttaacatactcagatga

SEQ ID NO: 279081 - DNA, 20 bp, Artificial Sequence
  chemically synthesized
ctactcaaacttaacatact

SEQ ID NO: 279082 - DNA, 20 bp, Artificial Sequence
  chemically synthesized
agctgtcatctgagtatgtt

SEQ ID NO: 279083 - DNA, 20 bp, Artificial Sequence
  chemically synthesized
catctgagtatgttaagttt

SEQ ID NO: 279084 - DNA, 20 bp, Artificial Sequence
  chemically synthesized
ctgagtatgttaagtttgag

SEQ ID NO: 279085 - DNA, 20 bp, Artificial Sequence
  chemically synthesized
gttaagtttgagtagcctat

SEQ ID NO: 279086 - DNA, 20 bp, Artificial Sequence
  chemically synthesized
tttctctttggatatctcat

SEQ ID NO: 279087 - DNA, 20 bp, Artificial Sequence
  chemically synthesized
ttttctctttggatatctca

SEQ ID NO: 279088 - DNA, 20 bp, Artificial Sequence
  chemically synthesized
agtagcctatgagatatcca

SEQ ID NO: 279089 - DNA, 20 bp, Artificial Sequence
  chemically synthesized
tagcctatgagatatccaaa

SEQ ID NO: 279090 - DNA, 20 bp, Artificial Sequence
  chemically synthesized
ctattgtgtatttttctctt

SEQ ID NO: 279091 - DNA, 20 bp, Artificial Sequence
  chemically synthesized
ccaaagagaaaaatacacaa

SEQ ID NO: 279092 - DNA, 20 bp, Artificial Sequence
  chemically synthesized
aagagaaaaatacacaatag

SEQ ID NO: 279093 - DNA, 20 bp, Artificial Sequence
  chemically synthesized
agagaaaaatacacaataga

SEQ ID NO: 279094 - DNA, 20 bp, Artificial Sequence
  chemically synthesized
aaaaatacacaatagaaggc

SEQ ID NO: 279095 - DNA, 20 bp, Artificial Sequence
  chemically synthesized
acaatagaaggctggatata

SEQ ID NO: 279096 - DNA, 20 bp, Artificial Sequence
  chemically synthesized
ttaacttcagaccatatatc

SEQ ID NO: 279097 - DNA, 20 bp, Artificial Sequence
  chemically synthesized
aaggctggatatatggtctg

SEQ ID NO: 279098 - DNA, 20 bp, Artificial Sequence
  chemically synthesized
tggatatatggtctgaagtt

SEQ ID NO: 279099 - DNA, 20 bp, Artificial Sequence
  chemically synthesized
ggatatatggtctgaagtta

SEQ ID NO: 279100 - DNA, 20 bp, Artificial Sequence
  chemically synthesized
gatatatggtctgaagttaa

SEQ ID NO: 279101 - DNA, 20 bp, Artificial Sequence
  chemically synthesized
cagacttttgcccttaactt

SEQ ID NO: 279102 - DNA, 20 bp, Artificial Sequence
  chemically synthesized
tggtctgaagttaagggcaa

SEQ ID NO: 279103 - DNA, 20 bp, Artificial Sequence
  chemically synthesized
ttaagggcaaaagtctgtgc

SEQ ID NO: 279104 - DNA, 20 bp, Artificial Sequence
  chemically synthesized
aagggcaaaagtctgtgcca

SEQ ID NO: 279105 - DNA, 20 bp, Artificial Sequence
  chemically synthesized
ccaaaatattatctctggca

SEQ ID NO: 279106 - DNA, 20 bp, Artificial Sequence
  chemically synthesized
tattcccaaaatattatctc

SEQ ID NO: 279107 - DNA, 20 bp, Artificial Sequence
  chemically synthesized
ctgtgccagagataatattt

SEQ ID NO: 279108 - DNA, 20 bp, Artificial Sequence
  chemically synthesized
tgtgccagagataatatttt

SEQ ID NO: 279109 - DNA, 20 bp, Artificial Sequence
  chemically synthesized
gataatattttgggaataat

SEQ ID NO: 279110 - DNA, 20 bp, Artificial Sequence
  chemically synthesized
tagcatgtaaattttattta

SEQ ID NO: 279111 - DNA, 20 bp, Artificial Sequence
  chemically synthesized
taatactttatgcagtgtca

SEQ ID NO: 279112 - DNA, 20 bp, Artificial Sequence
  chemically synthesized
taaagccatgacactgcata

SEQ ID NO: 279113 - DNA, 20 bp, Artificial Sequence
  chemically synthesized
actctttataatactttatg

SEQ ID NO: 279114 - DNA, 20 bp, Artificial Sequence
  chemically synthesized
acactgcataaagtattata

SEQ ID NO: 279115 - DNA, 20 bp, Artificial Sequence
  chemically synthesized
actgcataaagtattataaa

SEQ ID NO: 279116 - DNA, 20 bp, Artificial Sequence
  chemically synthesized
agtattataaagagtgaata

SEQ ID NO: 279117 - DNA, 20 bp, Artificial Sequence
  chemically synthesized
ttataaagagtgaatataga

SEQ ID NO: 279118 - DNA, 20 bp, Artificial Sequence
  chemically synthesized
tataaagagtgaatatagaa

SEQ ID NO: 279119 - DNA, 20 bp, Artificial Sequence
  chemically synthesized
aagagtgaatatagaaagga

SEQ ID NO: 279120 - DNA, 20 bp, Artificial Sequence
  chemically synthesized
agagtgaatatagaaaggaa

SEQ ID NO: 279121 - DNA, 20 bp, Artificial Sequence
  chemically synthesized
gagtgaatatagaaaggaaa

SEQ ID NO: 279122 - DNA, 20 bp, Artificial Sequence
  chemically synthesized
gtgaatatagaaaggaaagg

SEQ ID NO: 279123 - DNA, 20 bp, Artificial Sequence
  chemically synthesized
gaaaggaaagggagaacatt

SEQ ID NO: 279124 - DNA, 20 bp, Artificial Sequence
  chemically synthesized
gtgtgtatgaaacagtgttt

SEQ ID NO: 279125 - DNA, 20 bp, Artificial Sequence
  chemically synthesized
ggatccaagtgtgtatgaaa

SEQ ID NO: 279126 - DNA, 20 bp, Artificial Sequence
  chemically synthesized
aacactgtttcatacacact

SEQ ID NO: 279127 - DNA, 20 bp, Artificial Sequence
  chemically synthesized
gtttcatacacacttggatc

SEQ ID NO: 279128 - DNA, 20 bp, Artificial Sequence
  chemically synthesized
attattggccaactggatcc

SEQ ID NO: 279129 - DNA, 20 bp, Artificial Sequence
  chemically synthesized
catacacacttggatccagt

SEQ ID NO: 279130 - DNA, 20 bp, Artificial Sequence
  chemically synthesized
gaaacaaattattggccaac

SEQ ID NO: 279131 - DNA, 20 bp, Artificial Sequence
  chemically synthesized
aaagttctgaaacaaattat

SEQ ID NO: 279132 - DNA, 20 bp, Artificial Sequence
  chemically synthesized
agttggccaataatttgttt

SEQ ID NO: 279133 - DNA, 20 bp, Artificial Sequence
  chemically synthesized
agtcataaattaataaggaa

SEQ ID NO: 279134 - DNA, 20 bp, Artificial Sequence
  chemically synthesized
atttcagtcataaattaata

SEQ ID NO: 279135 - DNA, 20 bp, Artificial Sequence
  chemically synthesized
aatttcagtcataaattaat

SEQ ID NO: 279136 - DNA, 20 bp, Artificial Sequence
  chemically synthesized
tattaatttatgactgaaat

SEQ ID NO: 279137 - DNA, 20 bp, Artificial Sequence
  chemically synthesized
ggaaaaccccatgccaattt

SEQ ID NO: 279138 - DNA, 20 bp, Artificial Sequence
  chemically synthesized
atttatgactgaaattggca

SEQ ID NO: 279139 - DNA, 20 bp, Artificial Sequence
  chemically synthesized
tttatgactgaaattggcat

SEQ ID NO: 279140 - DNA, 20 bp, Artificial Sequence
  chemically synthesized
ttatgactgaaattggcatg

SEQ ID NO: 279141 - DNA, 20 bp, Artificial Sequence
  chemically synthesized
cagacaaaaatgaaacagga

SEQ ID NO: 279142 - DNA, 20 bp, Artificial Sequence
  chemically synthesized
tcagacaaaaatgaaacagg

SEQ ID NO: 279143 - DNA, 20 bp, Artificial Sequence
  chemically synthesized
aaatcagacaaaaatgaaac

SEQ ID NO: 279144 - DNA, 20 bp, Artificial Sequence
  chemically synthesized
aaaatcagacaaaaatgaaa

SEQ ID NO: 279145 - DNA, 20 bp, Artificial Sequence
  chemically synthesized
gtttcatttttgtctgattt

SEQ ID NO: 279146 - DNA, 20 bp, Artificial Sequence
  chemically synthesized
ttttttttttttaccaaaat

SEQ ID NO: 279147 - DNA, 20 bp, Artificial Sequence
  chemically synthesized
atgtctggaaaatataaggt

SEQ ID NO: 279148 - DNA, 20 bp, Artificial Sequence
  chemically synthesized
atacatgtctggaaaatata

SEQ ID NO: 279149 - DNA, 20 bp, Artificial Sequence
  chemically synthesized
tatacatgtctggaaaatat

SEQ ID NO: 279150 - DNA, 20 bp, Artificial Sequence
  chemically synthesized
ttttctaaccttatattttc

SEQ ID NO: 279151 - DNA, 20 bp, Artificial Sequence
  chemically synthesized
tacaaggcaatatacatgtc

SEQ ID NO: 279152 - DNA, 20 bp, Artificial Sequence
  chemically synthesized
caaactcagtagaacataca

SEQ ID NO: 279153 - DNA, 20 bp, Artificial Sequence
  chemically synthesized
acaaactcagtagaacatac

SEQ ID NO: 279154 - DNA, 20 bp, Artificial Sequence
  chemically synthesized
attgccttgtatgttctact

SEQ ID NO: 279155 - DNA, 20 bp, Artificial Sequence
  chemically synthesized
ccagtcatcaacaaactcag

SEQ ID NO: 279156 - DNA, 20 bp, Artificial Sequence
  chemically synthesized
attccagtcatcaacaaact

SEQ ID NO: 279157 - DNA, 20 bp, Artificial Sequence
  chemically synthesized
ctactgagtttgttgatgac

SEQ ID NO: 279158 - DNA, 20 bp, Artificial Sequence
  chemically synthesized
tttctaggaatagataattc

SEQ ID NO: 279159 - DNA, 20 bp, Artificial Sequence
  chemically synthesized
tgactggaattatctattcc

SEQ ID NO: 279160 - DNA, 20 bp, Artificial Sequence
  chemically synthesized
ttgaacacactttctaggaa

SEQ ID NO: 279161 - DNA, 20 bp, Artificial Sequence
  chemically synthesized
tggaattatctattcctaga

SEQ ID NO: 279162 - DNA, 20 bp, Artificial Sequence
  chemically synthesized
caaatttgaacacactttct

SEQ ID NO: 279163 - DNA, 20 bp, Artificial Sequence
  chemically synthesized
tcaaatttgaacacactttc

SEQ ID NO: 279164 - DNA, 20 bp, Artificial Sequence
  chemically synthesized
atttgaatgtaaaataattt

SEQ ID NO: 279165 - DNA, 20 bp, Artificial Sequence
  chemically synthesized
aaaataatttcagtctaata

SEQ ID NO: 279166 - DNA, 20 bp, Artificial Sequence
  chemically synthesized
tcttcctacaaagactatat

SEQ ID NO: 279167 - DNA, 20 bp, Artificial Sequence
  chemically synthesized
tcagtctaatatagtctttg

SEQ ID NO: 279168 - DNA, 20 bp, Artificial Sequence
  chemically synthesized
cagtctaatatagtctttgt

SEQ ID NO: 279169 - DNA, 20 bp, Artificial Sequence
  chemically synthesized
tctaatatagtctttgtagg

SEQ ID NO: 279170 - DNA, 20 bp, Artificial Sequence
  chemically synthesized
aaattaaaagtcttcctaca

SEQ ID NO: 279171 - DNA, 20 bp, Artificial Sequence
  chemically synthesized
gaaatttaatcacaaattaa

SEQ ID NO: 279172 - DNA, 20 bp, Artificial Sequence
  chemically synthesized
tgattaaatttctgtctcct

SEQ ID NO: 279173 - DNA, 20 bp, Artificial Sequence
  chemically synthesized
gattaaatttctgtctcctc

SEQ ID NO: 279174 - DNA, 20 bp, Artificial Sequence
  chemically synthesized
atatagaaagcctgaggaga

SEQ ID NO: 279175 - DNA, 20 bp, Artificial Sequence
  chemically synthesized
ggggatatagaaagcctgag

SEQ ID NO: 279176 - DNA, 20 bp, Artificial Sequence
  chemically synthesized
aaggggatatagaaagcctg

SEQ ID NO: 279177 - DNA, 20 bp, Artificial Sequence
  chemically synthesized
gaaggggatatagaaagcct

SEQ ID NO: 279178 - DNA, 20 bp, Artificial Sequence
  chemically synthesized
atgatggaaggggatataga

SEQ ID NO: 279179 - DNA, 20 bp, Artificial Sequence
  chemically synthesized
aaaaatgatggaaggggata

SEQ ID NO: 279180 - DNA, 20 bp, Artificial Sequence
  chemically synthesized
tgctacaaaaatgatggaag

SEQ ID NO: 279181 - DNA, 20 bp, Artificial Sequence
  chemically synthesized
ttgctacaaaaatgatggaa

SEQ ID NO: 279182 - DNA, 20 bp, Artificial Sequence
  chemically synthesized
attgctacaaaaatgatgga

SEQ ID NO: 279183 - DNA, 20 bp, Artificial Sequence
  chemically synthesized
tattgctacaaaaatgatgg

SEQ ID NO: 279184 - DNA, 20 bp, Artificial Sequence
  chemically synthesized
gaatattgctacaaaaatga

SEQ ID NO: 279185 - DNA, 20 bp, Artificial Sequence
  chemically synthesized
atccccttccatcatttttg

SEQ ID NO: 279186 - DNA, 20 bp, Artificial Sequence
  chemically synthesized
tttttgtagcaatattctcc

SEQ ID NO: 279187 - DNA, 20 bp, Artificial Sequence
  chemically synthesized
tgaaatggatgaatttctag

SEQ ID NO: 279188 - DNA, 20 bp, Artificial Sequence
  chemically synthesized
catgaaatggatgaatttct

SEQ ID NO: 279189 - DNA, 20 bp, Artificial Sequence
  chemically synthesized
acatgaaatggatgaatttc

SEQ ID NO: 279190 - DNA, 20 bp, Artificial Sequence
  chemically synthesized
gtttagaaacttacatgaaa

SEQ ID NO: 279191 - DNA, 20 bp, Artificial Sequence
  chemically synthesized
gaaattcatccatttcatgt

SEQ ID NO: 279192 - DNA, 20 bp, Artificial Sequence
  chemically synthesized
aaaagctatgcaaataagtt

SEQ ID NO: 279193 - DNA, 20 bp, Artificial Sequence
  chemically synthesized
agtttctaaacttatttgca

SEQ ID NO: 279194 - DNA, 20 bp, Artificial Sequence
  chemically synthesized
atactaaaagctatgcaaat

SEQ ID NO: 279195 - DNA, 20 bp, Artificial Sequence
  chemically synthesized
aaacttatttgcatagcttt

SEQ ID NO: 279196 - DNA, 20 bp, Artificial Sequence
  chemically synthesized
taaaatacagaaaatactaa

SEQ ID NO: 279197 - DNA, 20 bp, Artificial Sequence
  chemically synthesized
tataatatatttttaaaata

SEQ ID NO: 279198 - DNA, 20 bp, Artificial Sequence
  chemically synthesized
ttaaaaatatattataactg

SEQ ID NO: 279199 - DNA, 20 bp, Artificial Sequence
  chemically synthesized
ggatgaaaatgttataacta

SEQ ID NO: 279200 - DNA, 20 bp, Artificial Sequence
  chemically synthesized
gttataacattttcatcctt

SEQ ID NO: 279201 - DNA, 20 bp, Artificial Sequence
  chemically synthesized
aaaacaaatataaaatctta

SEQ ID NO: 279202 - DNA, 20 bp, Artificial Sequence
  chemically synthesized
aaaaacaaatataaaatctt

SEQ ID NO: 279203 - DNA, 20 bp, Artificial Sequence
  chemically synthesized
atttgtttttacttccctct

SEQ ID NO: 279204 - DNA, 20 bp, Artificial Sequence
  chemically synthesized
agacaaatcaactgagaggg

SEQ ID NO: 279205 - DNA, 20 bp, Artificial Sequence
  chemically synthesized
attagacaaatcaactgaga

SEQ ID NO: 279206 - DNA, 20 bp, Artificial Sequence
  chemically synthesized
aattagacaaatcaactgag

SEQ ID NO: 279207 - DNA, 20 bp, Artificial Sequence
  chemically synthesized
taattagacaaatcaactga

SEQ ID NO: 279208 - DNA, 20 bp, Artificial Sequence
  chemically synthesized
tttaattagacaaatcaact

SEQ ID NO: 279209 - DNA, 20 bp, Artificial Sequence
  chemically synthesized
gcccatattcatgttttaat

SEQ ID NO: 279210 - DNA, 20 bp, Artificial Sequence
  chemically synthesized
gtctaattaaaacatgaata

SEQ ID NO: 279211 - DNA, 20 bp, Artificial Sequence
  chemically synthesized
tctaattaaaacatgaatat

SEQ ID NO: 279212 - DNA, 20 bp, Artificial Sequence
  chemically synthesized
agaaataaataaaaacaaca

SEQ ID NO: 279213 - DNA, 20 bp, Artificial Sequence
  chemically synthesized
gaaagagaagaattcaagag

SEQ ID NO: 279214 - DNA, 20 bp, Artificial Sequence
  chemically synthesized
atggaaagagaagaattcaa

SEQ ID NO: 279215 - DNA, 20 bp, Artificial Sequence
  chemically synthesized
aaatggaaagagaagaattc

SEQ ID NO: 279216 - DNA, 20 bp, Artificial Sequence
  chemically synthesized
gagaaagtaaatggaaagag

SEQ ID NO: 279217 - DNA, 20 bp, Artificial Sequence
  chemically synthesized
gcagagaaagtaaatggaaa

SEQ ID NO: 279218 - DNA, 20 bp, Artificial Sequence
  chemically synthesized
atgcagagaaagtaaatgga

SEQ ID NO: 279219 - DNA, 20 bp, Artificial Sequence
  chemically synthesized
ataaatgcagagaaagtaaa

SEQ ID NO: 279220 - DNA, 20 bp, Artificial Sequence
  chemically synthesized
aagtataataaatgcagaga

SEQ ID NO: 279221 - DNA, 20 bp, Artificial Sequence
  chemically synthesized
ggaaaagtataataaatgca

SEQ ID NO: 279222 - DNA, 20 bp, Artificial Sequence
  chemically synthesized
agggaaaagtataataaatg

SEQ ID NO: 279223 - DNA, 20 bp, Artificial Sequence
  chemically synthesized
catctcaagaaaatagggaa

SEQ ID NO: 279224 - DNA, 20 bp, Artificial Sequence
  chemically synthesized
ctgcccatctcaagaaaata

SEQ ID NO: 279225 - DNA, 20 bp, Artificial Sequence
  chemically synthesized
actgcccatctcaagaaaat

SEQ ID NO: 279226 - DNA, 20 bp, Artificial Sequence
  chemically synthesized
atacttttccctattttctt

SEQ ID NO: 279227 - DNA, 20 bp, Artificial Sequence
  chemically synthesized
aactgcccatctcaagaaaa

SEQ ID NO: 279228 - DNA, 20 bp, Artificial Sequence
  chemically synthesized
ttttccctattttcttgaga

SEQ ID NO: 279229 - DNA, 20 bp, Artificial Sequence
  chemically synthesized
tttccctattttcttgagat

SEQ ID NO: 279230 - DNA, 20 bp, Artificial Sequence
  chemically synthesized
gtgagctaactgcccatctc

SEQ ID NO: 279231 - DNA, 20 bp, Artificial Sequence
  chemically synthesized
ccctattttcttgagatggg

SEQ ID NO: 279232 - DNA, 20 bp, Artificial Sequence
  chemically synthesized
attttcttgagatgggcagt

SEQ ID NO: 279233 - DNA, 20 bp, Artificial Sequence
  chemically synthesized
gagatgggcagttagctcac

SEQ ID NO: 279234 - DNA, 20 bp, Artificial Sequence
  chemically synthesized
cggaagggctgaaaactagt

SEQ ID NO: 279235 - DNA, 20 bp, Artificial Sequence
  chemically synthesized
gcagttagctcactagtttt

SEQ ID NO: 279236 - DNA, 20 bp, Artificial Sequence
  chemically synthesized
gagacggaagggctgaaaac

SEQ ID NO: 279237 - DNA, 20 bp, Artificial Sequence
  chemically synthesized
tttttgtagaagagacggaa

SEQ ID NO: 279238 - DNA, 20 bp, Artificial Sequence
  chemically synthesized
atttttgtagaagagacgga

SEQ ID NO: 279239 - DNA, 20 bp, Artificial Sequence
  chemically synthesized
aatttttgtagaagagacgg

SEQ ID NO: 279240 - DNA, 20 bp, Artificial Sequence
  chemically synthesized
gttaatttttgtagaagaga

SEQ ID NO: 279241 - DNA, 20 bp, Artificial Sequence
  chemically synthesized
tcctgttaatttttgtagaa

SEQ ID NO: 279242 - DNA, 20 bp, Artificial Sequence
  chemically synthesized
gttcctgttaatttttgtag

SEQ ID NO: 279243 - DNA, 20 bp, Artificial Sequence
  chemically synthesized
ttggttcctgttaatttttg

SEQ ID NO: 279244 - DNA, 20 bp, Artificial Sequence
  chemically synthesized
gtctcttctacaaaaattaa

SEQ ID NO: 279245 - DNA, 20 bp, Artificial Sequence
  chemically synthesized
tctcttctacaaaaattaac

SEQ ID NO: 279246 - DNA, 20 bp, Artificial Sequence
  chemically synthesized
aaaaattaacaggaaccaat

SEQ ID NO: 279247 - DNA, 20 bp, Artificial Sequence
  chemically synthesized
aaataaaaattaaaactaat

SEQ ID NO: 279248 - DNA, 20 bp, Artificial Sequence
  chemically synthesized
tttttatttttattatcact

SEQ ID NO: 279249 - DNA, 20 bp, Artificial Sequence
  chemically synthesized
tggttaaaattcatagaacc

SEQ ID NO: 279250 - DNA, 20 bp, Artificial Sequence
  chemically synthesized
aaatggatggttaaaattca

SEQ ID NO: 279251 - DNA, 20 bp, Artificial Sequence
  chemically synthesized
aaagatgaattcaaaatgga

SEQ ID NO: 279252 - DNA, 20 bp, Artificial Sequence
  chemically synthesized
gatcaaagatgaattcaaaa

SEQ ID NO: 279253 - DNA, 20 bp, Artificial Sequence
  chemically synthesized
agtaaataatttgtggatca

SEQ ID NO: 279254 - DNA, 20 bp, Artificial Sequence
  chemically synthesized
tgactaaagtaaataatttg

SEQ ID NO: 279255 - DNA, 20 bp, Artificial Sequence
  chemically synthesized
gatccacaaattatttactt

SEQ ID NO: 279256 - DNA, 20 bp, Artificial Sequence
  chemically synthesized
acaaattatttactttagtc

SEQ ID NO: 279257 - DNA, 20 bp, Artificial Sequence
  chemically synthesized
caatagtaaaaacttgacta

SEQ ID NO: 279258 - DNA, 20 bp, Artificial Sequence
  chemically synthesized
caagtttttactattgattc

SEQ ID NO: 279259 - DNA, 20 bp, Artificial Sequence
  chemically synthesized
ttgtaacaagctagaatcaa

SEQ ID NO: 279260 - DNA, 20 bp, Artificial Sequence
  chemically synthesized
ctcttaaatttgtaacaagc

SEQ ID NO: 279261 - DNA, 20 bp, Artificial Sequence
  chemically synthesized
aatactcttaaatttgtaac

SEQ ID NO: 279262 - DNA, 20 bp, Artificial Sequence
  chemically synthesized
ttctagcttgttacaaattt

SEQ ID NO: 279263 - DNA, 20 bp, Artificial Sequence
  chemically synthesized
ctagcttgttacaaatttaa

SEQ ID NO: 279264 - DNA, 20 bp, Artificial Sequence
  chemically synthesized
tcacatatttggtattatta

SEQ ID NO: 279265 - DNA, 20 bp, Artificial Sequence
  chemically synthesized
ttcacatatttggtattatt

SEQ ID NO: 279266 - DNA, 20 bp, Artificial Sequence
  chemically synthesized
tttcacatatttggtattat

SEQ ID NO: 279267 - DNA, 20 bp, Artificial Sequence
  chemically synthesized
gtcaatacatttcacatatt

SEQ ID NO: 279268 - DNA, 20 bp, Artificial Sequence
  chemically synthesized
attgacatttccatgtactt

SEQ ID NO: 279269 - DNA, 20 bp, Artificial Sequence
  chemically synthesized
taaatttcatctgaagtaca

SEQ ID NO: 279270 - DNA, 20 bp, Artificial Sequence
  chemically synthesized
cagagtgtaaatttcatctg

SEQ ID NO: 279271 - DNA, 20 bp, Artificial Sequence
  chemically synthesized
atgaaatttacactctgatt

SEQ ID NO: 279272 - DNA, 20 bp, Artificial Sequence
  chemically synthesized
tgaaatttacactctgattt

SEQ ID NO: 279273 - DNA, 20 bp, Artificial Sequence
  chemically synthesized
gaaatttacactctgatttg

SEQ ID NO: 279274 - DNA, 20 bp, Artificial Sequence
  chemically synthesized
gtatagagaaccccaaatca

SEQ ID NO: 279275 - DNA, 20 bp, Artificial Sequence
  chemically synthesized
ctgtatagagaaccccaaat

SEQ ID NO: 279276 - DNA, 20 bp, Artificial Sequence
  chemically synthesized
ctgatttggggttctctata

SEQ ID NO: 279277 - DNA, 20 bp, Artificial Sequence
  chemically synthesized
gtggatataaagactgtata

SEQ ID NO: 279278 - DNA, 20 bp, Artificial Sequence
  chemically synthesized
aggtggatataaagactgta

SEQ ID NO: 279279 - DNA, 20 bp, Artificial Sequence
  chemically synthesized
cagttgataaggtggatata

SEQ ID NO: 279280 - DNA, 20 bp, Artificial Sequence
  chemically synthesized
atgattaacagttgataagg

SEQ ID NO: 279281 - DNA, 20 bp, Artificial Sequence
  chemically synthesized
gtgatgattaacagttgata

SEQ ID NO: 279282 - DNA, 20 bp, Artificial Sequence
  chemically synthesized
agtgatgattaacagttgat

SEQ ID NO: 279283 - DNA, 20 bp, Artificial Sequence
  chemically synthesized
gtgaagatagtgatgattaa

SEQ ID NO: 279284 - DNA, 20 bp, Artificial Sequence
  chemically synthesized
cagacaaaagttagtgaaga

SEQ ID NO: 279285 - DNA, 20 bp, Artificial Sequence
  chemically synthesized
acaccagacaaaagttagtg

SEQ ID NO: 279286 - DNA, 20 bp, Artificial Sequence
  chemically synthesized
tcaagacaccagacaaaagt

SEQ ID NO: 279287 - DNA, 20 bp, Artificial Sequence
  chemically synthesized
tatcttcactaacttttgtc

SEQ ID NO: 279288 - DNA, 20 bp, Artificial Sequence
  chemically synthesized
tctttcaagacaccagacaa

SEQ ID NO: 279289 - DNA, 20 bp, Artificial Sequence
  chemically synthesized
gcctctttctttcaagacac

SEQ ID NO: 279290 - DNA, 20 bp, Artificial Sequence
  chemically synthesized
acttttgtctggtgtcttga

SEQ ID NO: 279291 - DNA, 20 bp, Artificial Sequence
  chemically synthesized
ttgtctggtgtcttgaaaga

SEQ ID NO: 279292 - DNA, 20 bp, Artificial Sequence
  chemically synthesized
tcataatgcctctttctttc

SEQ ID NO: 279293 - DNA, 20 bp, Artificial Sequence
  chemically synthesized
gtctggtgtcttgaaagaaa

SEQ ID NO: 279294 - DNA, 20 bp, Artificial Sequence
  chemically synthesized
tctggtgtcttgaaagaaag

SEQ ID NO: 279295 - DNA, 20 bp, Artificial Sequence
  chemically synthesized
caactatatcagcatggtgg

SEQ ID NO: 279296 - DNA, 20 bp, Artificial Sequence
  chemically synthesized
cacaactatatcagcatggt

SEQ ID NO: 279297 - DNA, 20 bp, Artificial Sequence
  chemically synthesized
acacaactatatcagcatgg

SEQ ID NO: 279298 - DNA, 20 bp, Artificial Sequence
  chemically synthesized
aatacacaactatatcagca

SEQ ID NO: 279299 - DNA, 20 bp, Artificial Sequence
  chemically synthesized
aatctcccaccatgctgata

SEQ ID NO: 279300 - DNA, 20 bp, Artificial Sequence
  chemically synthesized
gaagaaatacacaactatat

SEQ ID NO: 279301 - DNA, 20 bp, Artificial Sequence
  chemically synthesized
aaaatccacagaataacaag

SEQ ID NO: 279302 - DNA, 20 bp, Artificial Sequence
  chemically synthesized
gcaaaaatccacagaataac

SEQ ID NO: 279303 - DNA, 20 bp, Artificial Sequence
  chemically synthesized
tatttcttcttgttattctg

SEQ ID NO: 279304 - DNA, 20 bp, Artificial Sequence
  chemically synthesized
acacgtaaagcaaaaatcca

SEQ ID NO: 279305 - DNA, 20 bp, Artificial Sequence
  chemically synthesized
aaatacctttaaaacacgta

SEQ ID NO: 279306 - DNA, 20 bp, Artificial Sequence
  chemically synthesized
tttttgctttacgtgtttta

SEQ ID NO: 279307 - DNA, 20 bp, Artificial Sequence
  chemically synthesized
ttttgctttacgtgttttaa

SEQ ID NO: 279308 - DNA, 20 bp, Artificial Sequence
  chemically synthesized
gtgttttaaaggtattttcc

SEQ ID NO: 279309 - DNA, 20 bp, Artificial Sequence
  chemically synthesized
tgttttaaaggtattttccc

SEQ ID NO: 279310 - DNA, 20 bp, Artificial Sequence
  chemically synthesized
aaaaaatctcgtacatacct

SEQ ID NO: 279311 - DNA, 20 bp, Artificial Sequence
  chemically synthesized
aaaaaaatctcgtacatacc

SEQ ID NO: 279312 - DNA, 20 bp, Artificial Sequence
  chemically synthesized
gtattttcccaggtatgtac

SEQ ID NO: 279313 - DNA, 20 bp, Artificial Sequence
  chemically synthesized
gatttttttgtttcttttga

SEQ ID NO: 279314 - DNA, 20 bp, Artificial Sequence
  chemically synthesized
tttttttgtttcttttgaca

SEQ ID NO: 279315 - DNA, 20 bp, Artificial Sequence
  chemically synthesized
acggagtgagactctgtcaa

SEQ ID NO: 279316 - DNA, 20 bp, Artificial Sequence
  chemically synthesized
tccagcctgggttacggagt

SEQ ID NO: 279317 - DNA, 20 bp, Artificial Sequence
  chemically synthesized
cagagtctcactccgtaacc

SEQ ID NO: 279318 - DNA, 20 bp, Artificial Sequence
  chemically synthesized
ccactccagcctgggttacg

SEQ ID NO: 279319 - DNA, 20 bp, Artificial Sequence
  chemically synthesized
agagtctcactccgtaaccc

SEQ ID NO: 279320 - DNA, 20 bp, Artificial Sequence
  chemically synthesized
ctccactccagcctgggtta

SEQ ID NO: 279321 - DNA, 20 bp, Artificial Sequence
  chemically synthesized
tctcactccgtaacccaggc

SEQ ID NO: 279322 - DNA, 20 bp, Artificial Sequence
  chemically synthesized
tcactccgtaacccaggctg

SEQ ID NO: 279323 - DNA, 20 bp, Artificial Sequence
  chemically synthesized
tgcagtctccactccagcct

SEQ ID NO: 279324 - DNA, 20 bp, Artificial Sequence
  chemically synthesized
ttgcagtctccactccagcc

SEQ ID NO: 279325 - DNA, 20 bp, Artificial Sequence
  chemically synthesized
ctccgtaacccaggctggag

SEQ ID NO: 279326 - DNA, 20 bp, Artificial Sequence
  chemically synthesized
ccgtaacccaggctggagtg

SEQ ID NO: 279327 - DNA, 20 bp, Artificial Sequence
  chemically synthesized
tgagattgcagtctccactc

SEQ ID NO: 279328 - DNA, 20 bp, Artificial Sequence
  chemically synthesized
tggagtggagactgcaatct

SEQ ID NO: 279329 - DNA, 20 bp, Artificial Sequence
  chemically synthesized
gttgcagtgagctgagattg

SEQ ID NO: 279330 - DNA, 20 bp, Artificial Sequence
  chemically synthesized
ggcagaggttgcagtgagct

SEQ ID NO: 279331 - DNA, 20 bp, Artificial Sequence
  chemically synthesized
tgggaggcagaggttgcagt

SEQ ID NO: 279332 - DNA, 20 bp, Artificial Sequence
  chemically synthesized
aatctgggaggcagaggttg

SEQ ID NO: 279333 - DNA, 20 bp, Artificial Sequence
  chemically synthesized
tgcttgaatctgggaggcag

SEQ ID NO: 279334 - DNA, 20 bp, Artificial Sequence
  chemically synthesized
tcactgcaacctctgcctcc

SEQ ID NO: 279335 - DNA, 20 bp, Artificial Sequence
  chemically synthesized
ttgcttgaatctgggaggca

SEQ ID NO: 279336 - DNA, 20 bp, Artificial Sequence
  chemically synthesized
aattgcttgaatctgggagg

SEQ ID NO: 279337 - DNA, 20 bp, Artificial Sequence
  chemically synthesized
gagaattgcttgaatctggg

SEQ ID NO: 279338 - DNA, 20 bp, Artificial Sequence
  chemically synthesized
ggagaattgcttgaatctgg

SEQ ID NO: 279339 - DNA, 20 bp, Artificial Sequence
  chemically synthesized
aacctctgcctcccagattc

SEQ ID NO: 279340 - DNA, 20 bp, Artificial Sequence
  chemically synthesized
tgggagaattgcttgaatct

SEQ ID NO: 279341 - DNA, 20 bp, Artificial Sequence
  chemically synthesized
gtgggagaattgcttgaatc

SEQ ID NO: 279342 - DNA, 20 bp, Artificial Sequence
  chemically synthesized
ttcaagcaattctcccacct

SEQ ID NO: 279343 - DNA, 20 bp, Artificial Sequence
  chemically synthesized
tgcttgggaggctgaggtgg

SEQ ID NO: 279344 - DNA, 20 bp, Artificial Sequence
  chemically synthesized
gctgcttgggaggctgaggt

SEQ ID NO: 279345 - DNA, 20 bp, Artificial Sequence
  chemically synthesized
agctgcttgggaggctgagg

SEQ ID NO: 279346 - DNA, 20 bp, Artificial Sequence
  chemically synthesized
cccagctgcttgggaggctg

SEQ ID NO: 279347 - DNA, 20 bp, Artificial Sequence
  chemically synthesized
tcccagctgcttgggaggct

SEQ ID NO: 279348 - DNA, 20 bp, Artificial Sequence
  chemically synthesized
ttctcccacctcagcctccc

SEQ ID NO: 279349 - DNA, 20 bp, Artificial Sequence
  chemically synthesized
tcccacctcagcctcccaag

SEQ ID NO: 279350 - DNA, 20 bp, Artificial Sequence
  chemically synthesized
tgtagtcccagctgcttggg

SEQ ID NO: 279351 - DNA, 20 bp, Artificial Sequence
  chemically synthesized
ctgtagtcccagctgcttgg

SEQ ID NO: 279352 - DNA, 20 bp, Artificial Sequence
  chemically synthesized
acctcagcctcccaagcagc

SEQ ID NO: 279353 - DNA, 20 bp, Artificial Sequence
  chemically synthesized
gcctgtagtcccagctgctt

SEQ ID NO: 279354 - DNA, 20 bp, Artificial Sequence
  chemically synthesized
cctcagcctcccaagcagct

SEQ ID NO: 279355 - DNA, 20 bp, Artificial Sequence
  chemically synthesized
cgcctgtagtcccagctgct

SEQ ID NO: 279356 - DNA, 20 bp, Artificial Sequence
  chemically synthesized
ctcccaagcagctgggacta

SEQ ID NO: 279357 - DNA, 20 bp, Artificial Sequence
  chemically synthesized
tcccaagcagctgggactac

SEQ ID NO: 279358 - DNA, 20 bp, Artificial Sequence
  chemically synthesized
gtggtgcacgcctgtagtcc

SEQ ID NO: 279359 - DNA, 20 bp, Artificial Sequence
  chemically synthesized
gctgtggtggtgcacgcctg

SEQ ID NO: 279360 - DNA, 20 bp, Artificial Sequence
  chemically synthesized
actacaggcgtgcaccacca

SEQ ID NO: 279361 - DNA, 20 bp, Artificial Sequence
  chemically synthesized
caggcgtgcaccaccacagc

SEQ ID NO: 279362 - DNA, 20 bp, Artificial Sequence
  chemically synthesized
caaaaattaaccagctgtgg

SEQ ID NO: 279363 - DNA, 20 bp, Artificial Sequence
  chemically synthesized
atacaaaaattaaccagctg

SEQ ID NO: 279364 - DNA, 20 bp, Artificial Sequence
  chemically synthesized
ctaaaaatacaaaaattaac

SEQ ID NO: 279365 - DNA, 20 bp, Artificial Sequence
  chemically synthesized
ctggttaatttttgtatttt

SEQ ID NO: 279366 - DNA, 20 bp, Artificial Sequence
  chemically synthesized
gttaatttttgtatttttag

SEQ ID NO: 279367 - DNA, 20 bp, Artificial Sequence
  chemically synthesized
taatttttgtatttttagca

SEQ ID NO: 279368 - DNA, 20 bp, Artificial Sequence
  chemically synthesized
ttttgtatttttagcagaga

SEQ ID NO: 279369 - DNA, 20 bp, Artificial Sequence
  chemically synthesized
tttgtatttttagcagagac

SEQ ID NO: 279370 - DNA, 20 bp, Artificial Sequence
  chemically synthesized
ttgtatttttagcagagacg

SEQ ID NO: 279371 - DNA, 20 bp, Artificial Sequence
  chemically synthesized
cggggtttcaccatgctgcc

SEQ ID NO: 279372 - DNA, 20 bp, Artificial Sequence
  chemically synthesized
cgagaccaatctgggcagca

SEQ ID NO: 279373 - DNA, 20 bp, Artificial Sequence
  chemically synthesized
tttcaccatgctgcccagat

SEQ ID NO: 279374 - DNA, 20 bp, Artificial Sequence
  chemically synthesized
gagttcgagaccaatctggg

SEQ ID NO: 279375 - DNA, 20 bp, Artificial Sequence
  chemically synthesized
caggagttcgagaccaatct

SEQ ID NO: 279376 - DNA, 20 bp, Artificial Sequence
  chemically synthesized
tcaggagttcgagaccaatc

SEQ ID NO: 279377 - DNA, 20 bp, Artificial Sequence
  chemically synthesized
tcacctgaggtcaggagttc

SEQ ID NO: 279378 - DNA, 20 bp, Artificial Sequence
  chemically synthesized
tggtctcgaactcctgacct

SEQ ID NO: 279379 - DNA, 20 bp, Artificial Sequence
  chemically synthesized
ggtggctcacctgaggtcag

SEQ ID NO: 279380 - DNA, 20 bp, Artificial Sequence
  chemically synthesized
ggtctcgaactcctgacctc

SEQ ID NO: 279381 - DNA, 20 bp, Artificial Sequence
  chemically synthesized
tgggtggctcacctgaggtc

SEQ ID NO: 279382 - DNA, 20 bp, Artificial Sequence
  chemically synthesized
gtgggtggctcacctgaggt

SEQ ID NO: 279383 - DNA, 20 bp, Artificial Sequence
  chemically synthesized
tcgaactcctgacctcaggt

SEQ ID NO: 279384 - DNA, 20 bp, Artificial Sequence
  chemically synthesized
cgaggtgggtggctcacctg

SEQ ID NO: 279385 - DNA, 20 bp, Artificial Sequence
  chemically synthesized
ccgaggtgggtggctcacct

SEQ ID NO: 279386 - DNA, 20 bp, Artificial Sequence
  chemically synthesized
ctcaggtgagccacccacct

SEQ ID NO: 279387 - DNA, 20 bp, Artificial Sequence
  chemically synthesized
ctttgagaggccgaggtggg

SEQ ID NO: 279388 - DNA, 20 bp, Artificial Sequence
  chemically synthesized
gcactttgagaggccgaggt

SEQ ID NO: 279389 - DNA, 20 bp, Artificial Sequence
  chemically synthesized
agcactttgagaggccgagg

SEQ ID NO: 279390 - DNA, 20 bp, Artificial Sequence
  chemically synthesized
cccagcactttgagaggccg

SEQ ID NO: 279391 - DNA, 20 bp, Artificial Sequence
  chemically synthesized
tcccagcactttgagaggcc

SEQ ID NO: 279392 - DNA, 20 bp, Artificial Sequence
  chemically synthesized
ccacccacctcggcctctca

SEQ ID NO: 279393 - DNA, 20 bp, Artificial Sequence
  chemically synthesized
tctaatcccagcactttgag

SEQ ID NO: 279394 - DNA, 20 bp, Artificial Sequence
  chemically synthesized
ctctaatcccagcactttga

SEQ ID NO: 279395 - DNA, 20 bp, Artificial Sequence
  chemically synthesized
acctcggcctctcaaagtgc

SEQ ID NO: 279396 - DNA, 20 bp, Artificial Sequence
  chemically synthesized
gcctctaatcccagcacttt

SEQ ID NO: 279397 - DNA, 20 bp, Artificial Sequence
  chemically synthesized
cctcggcctctcaaagtgct

SEQ ID NO: 279398 - DNA, 20 bp, Artificial Sequence
  chemically synthesized
gcctctcaaagtgctgggat

SEQ ID NO: 279399 - DNA, 20 bp, Artificial Sequence
  chemically synthesized
ctctcaaagtgctgggatta

SEQ ID NO: 279400 - DNA, 20 bp, Artificial Sequence
  chemically synthesized
tctcaaagtgctgggattag

SEQ ID NO: 279401 - DNA, 20 bp, Artificial Sequence
  chemically synthesized
gtggctcacgcctctaatcc

SEQ ID NO: 279402 - DNA, 20 bp, Artificial Sequence
  chemically synthesized
agtgctgggattagaggcgt

SEQ ID NO: 279403 - DNA, 20 bp, Artificial Sequence
  chemically synthesized
gaggcgtgagccaccatgcc

SEQ ID NO: 279404 - DNA, 20 bp, Artificial Sequence
  chemically synthesized
acatacctggccgggcatgg

SEQ ID NO: 279405 - DNA, 20 bp, Artificial Sequence
  chemically synthesized
tgtacatacctggccgggca

SEQ ID NO: 279406 - DNA, 20 bp, Artificial Sequence
  chemically synthesized
cgtgagccaccatgcccggc

SEQ ID NO: 279407 - DNA, 20 bp, Artificial Sequence
  chemically synthesized
gtgagccaccatgcccggcc

SEQ ID NO: 279408 - DNA, 20 bp, Artificial Sequence
  chemically synthesized
aaacttgtacatacctggcc

SEQ ID NO: 279409 - DNA, 20 bp, Artificial Sequence
  chemically synthesized
aaaacttgtacatacctggc

SEQ ID NO: 279410 - DNA, 20 bp, Artificial Sequence
  chemically synthesized
ttctaaaacttgtacatacc

SEQ ID NO: 279411 - DNA, 20 bp, Artificial Sequence
  chemically synthesized
atgcccggccaggtatgtac

SEQ ID NO: 279412 - DNA, 20 bp, Artificial Sequence
  chemically synthesized
ggccaggtatgtacaagttt

SEQ ID NO: 279413 - DNA, 20 bp, Artificial Sequence
  chemically synthesized
aaaaatggagtaaaatataa

SEQ ID NO: 279414 - DNA, 20 bp, Artificial Sequence
  chemically synthesized
tcattattaggcaaaaaatg

SEQ ID NO: 279415 - DNA, 20 bp, Artificial Sequence
  chemically synthesized
tatcattattaggcaaaaaa

SEQ ID NO: 279416 - DNA, 20 bp, Artificial Sequence
  chemically synthesized
ttatggtcattatcattatt

SEQ ID NO: 279417 - DNA, 20 bp, Artificial Sequence
  chemically synthesized
attatggtcattatcattat

SEQ ID NO: 279418 - DNA, 20 bp, Artificial Sequence
  chemically synthesized
ttccagcaaaatagacatta

SEQ ID NO: 279419 - DNA, 20 bp, Artificial Sequence
  chemically synthesized
gaccataatgtctattttgc

SEQ ID NO: 279420 - DNA, 20 bp, Artificial Sequence
  chemically synthesized
ctaatttatttccagcaaaa

SEQ ID NO: 279421 - DNA, 20 bp, Artificial Sequence
  chemically synthesized
ttagacacctaatttatttc

SEQ ID NO: 279422 - DNA, 20 bp, Artificial Sequence
  chemically synthesized
ctattttgctggaaataaat

SEQ ID NO: 279423 - DNA, 20 bp, Artificial Sequence
  chemically synthesized
tattttgctggaaataaatt

SEQ ID NO: 279424 - DNA, 20 bp, Artificial Sequence
  chemically synthesized
tggaaataaattaggtgtct

SEQ ID NO: 279425 - DNA, 20 bp, Artificial Sequence
  chemically synthesized
ggattaatcaataaaaagct

SEQ ID NO: 279426 - DNA, 20 bp, Artificial Sequence
  chemically synthesized
gaaaaggattaatcaataaa

SEQ ID NO: 279427 - DNA, 20 bp, Artificial Sequence
  chemically synthesized
ttttattgattaatcctttt

SEQ ID NO: 279428 - DNA, 20 bp, Artificial Sequence
  chemically synthesized
tggaaacagattttccgaaa

SEQ ID NO: 279429 - DNA, 20 bp, Artificial Sequence
  chemically synthesized
atggaaacagattttccgaa

SEQ ID NO: 279430 - DNA, 20 bp, Artificial Sequence
  chemically synthesized
acatatatcgaaaatggaaa

SEQ ID NO: 279431 - DNA, 20 bp, Artificial Sequence
  chemically synthesized
aaagacacatatatcgaaaa

SEQ ID NO: 279432 - DNA, 20 bp, Artificial Sequence
  chemically synthesized
ttgtttttaagaaatacata

SEQ ID NO: 279433 - DNA, 20 bp, Artificial Sequence
  chemically synthesized
attcaaaatacattgttttt

SEQ ID NO: 279434 - DNA, 20 bp, Artificial Sequence
  chemically synthesized
atgtagaaattttcagaata

SEQ ID NO: 279435 - DNA, 20 bp, Artificial Sequence
  chemically synthesized
tatataaatgtagaaatttt

SEQ ID NO: 279436 - DNA, 20 bp, Artificial Sequence
  chemically synthesized
atacatttaatatataaatg

SEQ ID NO: 279437 - DNA, 20 bp, Artificial Sequence
  chemically synthesized
atttatatattaaatgtatt

SEQ ID NO: 279438 - DNA, 20 bp, Artificial Sequence
  chemically synthesized
tattaaatgtattgagcaaa

SEQ ID NO: 279439 - DNA, 20 bp, Artificial Sequence
  chemically synthesized
atgtattgagcaaatagttc

SEQ ID NO: 279440 - DNA, 20 bp, Artificial Sequence
  chemically synthesized
tgtattgagcaaatagttct

SEQ ID NO: 279441 - DNA, 20 bp, Artificial Sequence
  chemically synthesized
agcaaatagttctaggacta

SEQ ID NO: 279442 - DNA, 20 bp, Artificial Sequence
  chemically synthesized
aaaaaatacatctgtagtcc

SEQ ID NO: 279443 - DNA, 20 bp, Artificial Sequence
  chemically synthesized
agaaaaaaaaaatacatctg

SEQ ID NO: 279444 - DNA, 20 bp, Artificial Sequence
  chemically synthesized
aaaaaaggaaagaaaagaaa

SEQ ID NO: 279445 - DNA, 20 bp, Artificial Sequence
  chemically synthesized
aaaaaaaaaaaaggaaagaa

SEQ ID NO: 279446 - DNA, 20 bp, Artificial Sequence
  chemically synthesized
aaaaaaaaaaaaaaaaagga

SEQ ID NO: 279447 - DNA, 20 bp, Artificial Sequence
  chemically synthesized
ctcaaaaaaaaaaaaaaaaa

SEQ ID NO: 279448 - DNA, 20 bp, Artificial Sequence
  chemically synthesized
cctcaaaaaaaaaaaaaaaa

SEQ ID NO: 279449 - DNA, 20 bp, Artificial Sequence
  chemically synthesized
cctttttttttttttttttt

SEQ ID NO: 279450 - DNA, 20 bp, Artificial Sequence
  chemically synthesized
cttttttttttttttttttg

SEQ ID NO: 279451 - DNA, 20 bp, Artificial Sequence
  chemically synthesized
ttttttttttttttttgagg

SEQ ID NO: 279452 - DNA, 20 bp, Artificial Sequence
  chemically synthesized
ttttttttttttttgaggca

SEQ ID NO: 279453 - DNA, 20 bp, Artificial Sequence
  chemically synthesized
cagagttttgctctttcacc

SEQ ID NO: 279454 - DNA, 20 bp, Artificial Sequence
  chemically synthesized
tcactccagactgggtgaaa

SEQ ID NO: 279455 - DNA, 20 bp, Artificial Sequence
  chemically synthesized
tttcactccagactgggtga

SEQ ID NO: 279456 - DNA, 20 bp, Artificial Sequence
  chemically synthesized
ttttgctctttcacccagtc

SEQ ID NO: 279457 - DNA, 20 bp, Artificial Sequence
  chemically synthesized
ttgctctttcacccagtctg

SEQ ID NO: 279458 - DNA, 20 bp, Artificial Sequence
  chemically synthesized
atgccatttcactccagact

SEQ ID NO: 279459 - DNA, 20 bp, Artificial Sequence
  chemically synthesized
catgccatttcactccagac

SEQ ID NO: 279460 - DNA, 20 bp, Artificial Sequence
  chemically synthesized
gagatcatgccatttcactc

SEQ ID NO: 279461 - DNA, 20 bp, Artificial Sequence
  chemically synthesized
tcacccagtctggagtgaaa

SEQ ID NO: 279462 - DNA, 20 bp, Artificial Sequence
  chemically synthesized
ggagtgaaatggcatgatct

SEQ ID NO: 279463 - DNA, 20 bp, Artificial Sequence
  chemically synthesized
aacggaagttgcagtgagct

SEQ ID NO: 279464 - DNA, 20 bp, Artificial Sequence
  chemically synthesized
cagggaacggaagttgcagt

SEQ ID NO: 279465 - DNA, 20 bp, Artificial Sequence
  chemically synthesized
aacccagggaacggaagttg

SEQ ID NO: 279466 - DNA, 20 bp, Artificial Sequence
  chemically synthesized
cacttgaacccagggaacgg

SEQ ID NO: 279467 - DNA, 20 bp, Artificial Sequence
  chemically synthesized
tcactgcaacttccgttccc

SEQ ID NO: 279468 - DNA, 20 bp, Artificial Sequence
  chemically synthesized
cactgcaacttccgttccct

SEQ ID NO: 279469 - DNA, 20 bp, Artificial Sequence
  chemically synthesized
aatcacttgaacccagggaa

SEQ ID NO: 279470 - DNA, 20 bp, Artificial Sequence
  chemically synthesized
aacttccgttccctgggttc

SEQ ID NO: 279471 - DNA, 20 bp, Artificial Sequence
  chemically synthesized
aggagaatcacttgaaccca

SEQ ID NO: 279472 - DNA, 20 bp, Artificial Sequence
  chemically synthesized
caggagaatcacttgaaccc

SEQ ID NO: 279473 - DNA, 20 bp, Artificial Sequence
  chemically synthesized
acaggagaatcacttgaacc

SEQ ID NO: 279474 - DNA, 20 bp, Artificial Sequence
  chemically synthesized
ttcaagtgattctcctgtct

SEQ ID NO: 279475 - DNA, 20 bp, Artificial Sequence
  chemically synthesized
tactcgggaggctgagacag

SEQ ID NO: 279476 - DNA, 20 bp, Artificial Sequence
  chemically synthesized
actactcgggaggctgagac

SEQ ID NO: 279477 - DNA, 20 bp, Artificial Sequence
  chemically synthesized
aactactcgggaggctgaga

SEQ ID NO: 279478 - DNA, 20 bp, Artificial Sequence
  chemically synthesized
tcccaactactcgggaggct

SEQ ID NO: 279479 - DNA, 20 bp, Artificial Sequence
  chemically synthesized
ttctcctgtctcagcctccc

SEQ ID NO: 279480 - DNA, 20 bp, Artificial Sequence
  chemically synthesized
tcctgtctcagcctcccgag

SEQ ID NO: 279481 - DNA, 20 bp, Artificial Sequence
  chemically synthesized
tataatcccaactactcggg

SEQ ID NO: 279482 - DNA, 20 bp, Artificial Sequence
  chemically synthesized
ctataatcccaactactcgg

SEQ ID NO: 279483 - DNA, 20 bp, Artificial Sequence
  chemically synthesized
gtctcagcctcccgagtagt

SEQ ID NO: 279484 - DNA, 20 bp, Artificial Sequence
  chemically synthesized
gcctataatcccaactactc

SEQ ID NO: 279485 - DNA, 20 bp, Artificial Sequence
  chemically synthesized
tctcagcctcccgagtagtt

SEQ ID NO: 279486 - DNA, 20 bp, Artificial Sequence
  chemically synthesized
tgcctataatcccaactact

SEQ ID NO: 279487 - DNA, 20 bp, Artificial Sequence
  chemically synthesized
ctcccgagtagttgggatta

SEQ ID NO: 279488 - DNA, 20 bp, Artificial Sequence
  chemically synthesized
tcccgagtagttgggattat

SEQ ID NO: 279489 - DNA, 20 bp, Artificial Sequence
  chemically synthesized
gattataggcacccaccacc

SEQ ID NO: 279490 - DNA, 20 bp, Artificial Sequence
  chemically synthesized
aagtatccaggcttggtggt

SEQ ID NO: 279491 - DNA, 20 bp, Artificial Sequence
  chemically synthesized
aaagtatccaggcttggtgg

SEQ ID NO: 279492 - DNA, 20 bp, Artificial Sequence
  chemically synthesized
taggcacccaccaccaagcc

SEQ ID NO: 279493 - DNA, 20 bp, Artificial Sequence
  chemically synthesized
aaaaaagtatccaggcttgg

SEQ ID NO: 279494 - DNA, 20 bp, Artificial Sequence
  chemically synthesized
caaaaaaaagtatccaggct

SEQ ID NO: 279495 - DNA, 20 bp, Artificial Sequence
  chemically synthesized
aaacccaaaaaaaagtatcc

SEQ ID NO: 279496 - DNA, 20 bp, Artificial Sequence
  chemically synthesized
aaaacccaaaaaaaagtatc

SEQ ID NO: 279497 - DNA, 20 bp, Artificial Sequence
  chemically synthesized
caagcctggatacttttttt

SEQ ID NO: 279498 - DNA, 20 bp, Artificial Sequence
  chemically synthesized
aagcctggatactttttttt

SEQ ID NO: 279499 - DNA, 20 bp, Artificial Sequence
  chemically synthesized
aaaaaaaaaaacccaaaaaa

SEQ ID NO: 279500 - DNA, 20 bp, Artificial Sequence
  chemically synthesized
tttttttttttttgtatttg

SEQ ID NO: 279501 - DNA, 20 bp, Artificial Sequence
  chemically synthesized
ttttttttttgtatttgtgg

SEQ ID NO: 279502 - DNA, 20 bp, Artificial Sequence
  chemically synthesized
ttttttttgtatttgtggta

SEQ ID NO: 279503 - DNA, 20 bp, Artificial Sequence
  chemically synthesized
tttgtatttgtggtagagac

SEQ ID NO: 279504 - DNA, 20 bp, Artificial Sequence
  chemically synthesized
ttgtatttgtggtagagacc

SEQ ID NO: 279505 - DNA, 20 bp, Artificial Sequence
  chemically synthesized
gctgccaacaaggtgatacc

SEQ ID NO: 279506 - DNA, 20 bp, Artificial Sequence
  chemically synthesized
gagaccaggtatcaccttgt

SEQ ID NO: 279507 - DNA, 20 bp, Artificial Sequence
  chemically synthesized
accaggtatcaccttgttgg

SEQ ID NO: 279508 - DNA, 20 bp, Artificial Sequence
  chemically synthesized
ggcagaccaggctgccaaca

SEQ ID NO: 279509 - DNA, 20 bp, Artificial Sequence
  chemically synthesized
aggcagaccaggctgccaac

SEQ ID NO: 279510 - DNA, 20 bp, Artificial Sequence
  chemically synthesized
gtatcaccttgttggcagcc

SEQ ID NO: 279511 - DNA, 20 bp, Artificial Sequence
  chemically synthesized
gaggccaaggcaggcagacc

SEQ ID NO: 279512 - DNA, 20 bp, Artificial Sequence
  chemically synthesized
ggaggccaaggcaggcagac

SEQ ID NO: 279513 - DNA, 20 bp, Artificial Sequence
  chemically synthesized
gcagcctggtctgcctgcct

SEQ ID NO: 279514 - DNA, 20 bp, Artificial Sequence
  chemically synthesized
ctttgggaggccaaggcagg

SEQ ID NO: 279515 - DNA, 20 bp, Artificial Sequence
  chemically synthesized
gcactttgggaggccaaggc

SEQ ID NO: 279516 - DNA, 20 bp, Artificial Sequence
  chemically synthesized
agcactttgggaggccaagg

SEQ ID NO: 279517 - DNA, 20 bp, Artificial Sequence
  chemically synthesized
cccagcactttgggaggcca

SEQ ID NO: 279518 - DNA, 20 bp, Artificial Sequence
  chemically synthesized
tcccagcactttgggaggcc

SEQ ID NO: 279519 - DNA, 20 bp, Artificial Sequence
  chemically synthesized
ctgcctgccttggcctccca

SEQ ID NO: 279520 - DNA, 20 bp, Artificial Sequence
  chemically synthesized
cttaatcccagcactttggg

SEQ ID NO: 279521 - DNA, 20 bp, Artificial Sequence
  chemically synthesized
ccttaatcccagcactttgg

SEQ ID NO: 279522 - DNA, 20 bp, Artificial Sequence
  chemically synthesized
gccttggcctcccaaagtgc

SEQ ID NO: 279523 - DNA, 20 bp, Artificial Sequence
  chemically synthesized
tgccttaatcccagcacttt

SEQ ID NO: 279524 - DNA, 20 bp, Artificial Sequence
  chemically synthesized
ccttggcctcccaaagtgct

SEQ ID NO: 279525 - DNA, 20 bp, Artificial Sequence
  chemically synthesized
atgccttaatcccagcactt

SEQ ID NO: 279526 - DNA, 20 bp, Artificial Sequence
  chemically synthesized
cctcccaaagtgctgggatt

SEQ ID NO: 279527 - DNA, 20 bp, Artificial Sequence
  chemically synthesized
ctcccaaagtgctgggatta

SEQ ID NO: 279528 - DNA, 20 bp, Artificial Sequence
  chemically synthesized
ggtagctcatgccttaatcc

SEQ ID NO: 279529 - DNA, 20 bp, Artificial Sequence
  chemically synthesized
aagtgctgggattaaggcat

SEQ ID NO: 279530 - DNA, 20 bp, Artificial Sequence
  chemically synthesized
aaggcatgagctaccacgcc

SEQ ID NO: 279531 - DNA, 20 bp, Artificial Sequence
  chemically synthesized
ataccagcggccgggcgtgg

SEQ ID NO: 279532 - DNA, 20 bp, Artificial Sequence
  chemically synthesized
aaaataccagcggccgggcg

SEQ ID NO: 279533 - DNA, 20 bp, Artificial Sequence
  chemically synthesized
gagctaccacgcccggccgc

SEQ ID NO: 279534 - DNA, 20 bp, Artificial Sequence
  chemically synthesized
gtagaaaaataccagcggcc

SEQ ID NO: 279535 - DNA, 20 bp, Artificial Sequence
  chemically synthesized
ggtagaaaaataccagcggc

SEQ ID NO: 279536 - DNA, 20 bp, Artificial Sequence
  chemically synthesized
agatggtagaaaaataccag

SEQ ID NO: 279537 - DNA, 20 bp, Artificial Sequence
  chemically synthesized
aatagatggtagaaaaatac

SEQ ID NO: 279538 - DNA, 20 bp, Artificial Sequence
  chemically synthesized
aaatagaaaaaaatagatgg

SEQ ID NO: 279539 - DNA, 20 bp, Artificial Sequence
  chemically synthesized
tagaaatagaaaaaaataga

SEQ ID NO: 279540 - DNA, 20 bp, Artificial Sequence
  chemically synthesized
aaaatagaaatagaaaaaaa

SEQ ID NO: 279541 - DNA, 20 bp, Artificial Sequence
  chemically synthesized
agatggtagaaaaatagaaa

SEQ ID NO: 279542 - DNA, 20 bp, Artificial Sequence
  chemically synthesized
aagaaaagatggtagaaaaa

SEQ ID NO: 279543 - DNA, 20 bp, Artificial Sequence
  chemically synthesized
taaaataaaagaaaagatgg

SEQ ID NO: 279544 - DNA, 20 bp, Artificial Sequence
  chemically synthesized
gcataaaataaaagaaaaga

SEQ ID NO: 279545 - DNA, 20 bp, Artificial Sequence
  chemically synthesized
atgagcataaaataaaagaa

SEQ ID NO: 279546 - DNA, 20 bp, Artificial Sequence
  chemically synthesized
gtgagatgagcataaaataa

SEQ ID NO: 279547 - DNA, 20 bp, Artificial Sequence
  chemically synthesized
aaaacagaaaaatgtgagat

SEQ ID NO: 279548 - DNA, 20 bp, Artificial Sequence
  chemically synthesized
aaaacaaaacagaaaaatgt

SEQ ID NO: 279549 - DNA, 20 bp, Artificial Sequence
  chemically synthesized
aagaaagaaggaaaacaaaa

SEQ ID NO: 279550 - DNA, 20 bp, Artificial Sequence
  chemically synthesized
acgcagtaaagcaagaaaga

SEQ ID NO: 279551 - DNA, 20 bp, Artificial Sequence
  chemically synthesized
tacgcagtaaagcaagaaag

SEQ ID NO: 279552 - DNA, 20 bp, Artificial Sequence
  chemically synthesized
cagtacgcagtaaagcaaga

SEQ ID NO: 279553 - DNA, 20 bp, Artificial Sequence
  chemically synthesized
caatcagtacgcagtaaagc

SEQ ID NO: 279554 - DNA, 20 bp, Artificial Sequence
  chemically synthesized
ttctcaatcagtacgcagta

SEQ ID NO: 279555 - DNA, 20 bp, Artificial Sequence
  chemically synthesized
aacagttctcaatcagtacg

SEQ ID NO: 279556 - DNA, 20 bp, Artificial Sequence
  chemically synthesized
tgctttactgcgtactgatt

SEQ ID NO: 279557 - DNA, 20 bp, Artificial Sequence
  chemically synthesized
taaaaggaacagttctcaat

SEQ ID NO: 279558 - DNA, 20 bp, Artificial Sequence
  chemically synthesized
tcaaagaatgataaaaggaa

SEQ ID NO: 279559 - DNA, 20 bp, Artificial Sequence
  chemically synthesized
aacaatcaaagaatgataaa

SEQ ID NO: 279560 - DNA, 20 bp, Artificial Sequence
  chemically synthesized
aaacaatcaaagaatgataa

SEQ ID NO: 279561 - DNA, 20 bp, Artificial Sequence
  chemically synthesized
atccacctgggaaacaatca

SEQ ID NO: 279562 - DNA, 20 bp, Artificial Sequence
  chemically synthesized
atcattctttgattgtttcc

SEQ ID NO: 279563 - DNA, 20 bp, Artificial Sequence
  chemically synthesized
tcattctttgattgtttccc

SEQ ID NO: 279564 - DNA, 20 bp, Artificial Sequence
  chemically synthesized
ttctttgattgtttcccagg

SEQ ID NO: 279565 - DNA, 20 bp, Artificial Sequence
  chemically synthesized
cactaatggagcatccacct

SEQ ID NO: 279566 - DNA, 20 bp, Artificial Sequence
  chemically synthesized
ccactaatggagcatccacc

SEQ ID NO: 279567 - DNA, 20 bp, Artificial Sequence
  chemically synthesized
ttcccaggtggatgctccat

SEQ ID NO: 279568 - DNA, 20 bp, Artificial Sequence
  chemically synthesized
ccaggtggatgctccattag

SEQ ID NO: 279569 - DNA, 20 bp, Artificial Sequence
  chemically synthesized
gtcaaggataaccactaatg

SEQ ID NO: 279570 - DNA, 20 bp, Artificial Sequence
  chemically synthesized
ttgtcaaggataaccactaa

SEQ ID NO: 279571 - DNA, 20 bp, Artificial Sequence
  chemically synthesized
tatgctgtaataaattgtca

SEQ ID NO: 279572 - DNA, 20 bp, Artificial Sequence
  chemically synthesized
ttatgctgtaataaattgtc

SEQ ID NO: 279573 - DNA, 20 bp, Artificial Sequence
  chemically synthesized
ttatccttgacaatttatta

SEQ ID NO: 279574 - DNA, 20 bp, Artificial Sequence
  chemically synthesized
tgacaatttattacagcata

SEQ ID NO: 279575 - DNA, 20 bp, Artificial Sequence
  chemically synthesized
atttagaaagagggtagaga

SEQ ID NO: 279576 - DNA, 20 bp, Artificial Sequence
  chemically synthesized
ttttatttagaaagagggta

SEQ ID NO: 279577 - DNA, 20 bp, Artificial Sequence
  chemically synthesized
ccttttatttagaaagaggg

SEQ ID NO: 279578 - DNA, 20 bp, Artificial Sequence
  chemically synthesized
agcccttttatttagaaaga

SEQ ID NO: 279579 - DNA, 20 bp, Artificial Sequence
  chemically synthesized
aagcccttttatttagaaag

SEQ ID NO: 279580 - DNA, 20 bp, Artificial Sequence
  chemically synthesized
caagcccttttatttagaaa

SEQ ID NO: 279581 - DNA, 20 bp, Artificial Sequence
  chemically synthesized
cacaagcccttttatttaga

SEQ ID NO: 279582 - DNA, 20 bp, Artificial Sequence
  chemically synthesized
tctaccctctttctaaataa

SEQ ID NO: 279583 - DNA, 20 bp, Artificial Sequence
  chemically synthesized
ctaccctctttctaaataaa

SEQ ID NO: 279584 - DNA, 20 bp, Artificial Sequence
  chemically synthesized
taccctctttctaaataaaa

SEQ ID NO: 279585 - DNA, 20 bp, Artificial Sequence
  chemically synthesized
cagccacaagcccttttatt

SEQ ID NO: 279586 - DNA, 20 bp, Artificial Sequence
  chemically synthesized
tttctaaataaaagggcttg

SEQ ID NO: 279587 - DNA, 20 bp, Artificial Sequence
  chemically synthesized
tggaggggagttacagccac

SEQ ID NO: 279588 - DNA, 20 bp, Artificial Sequence
  chemically synthesized
aacaatatggaggggagtta

SEQ ID NO: 279589 - DNA, 20 bp, Artificial Sequence
  chemically synthesized
attaaaaacaatatggaggg

SEQ ID NO: 279590 - DNA, 20 bp, Artificial Sequence
  chemically synthesized
agattaaaaacaatatggag

SEQ ID NO: 279591 - DNA, 20 bp, Artificial Sequence
  chemically synthesized
tagattaaaaacaatatgga

SEQ ID NO: 279592 - DNA, 20 bp, Artificial Sequence
  chemically synthesized
ctagattaaaaacaatatgg

SEQ ID NO: 279593 - DNA, 20 bp, Artificial Sequence
  chemically synthesized
actagattaaaaacaatatg

SEQ ID NO: 279594 - DNA, 20 bp, Artificial Sequence
  chemically synthesized
atactagattaaaaacaata

SEQ ID NO: 279595 - DNA, 20 bp, Artificial Sequence
  chemically synthesized
cctccatattgtttttaatc

SEQ ID NO: 279596 - DNA, 20 bp, Artificial Sequence
  chemically synthesized
ttgtttttaatctagtattt

SEQ ID NO: 279597 - DNA, 20 bp, Artificial Sequence
  chemically synthesized
ataatgttgatctaaaatac

SEQ ID NO: 279598 - DNA, 20 bp, Artificial Sequence
  chemically synthesized
aacattattttaaatgaaat

SEQ ID NO: 279599 - DNA, 20 bp, Artificial Sequence
  chemically synthesized
atttgttgcaaaaaatatat

SEQ ID NO: 279600 - DNA, 20 bp, Artificial Sequence
  chemically synthesized
gttaagcttttaaatacaaa

SEQ ID NO: 279601 - DNA, 20 bp, Artificial Sequence
  chemically synthesized
agttaagcttttaaatacaa

SEQ ID NO: 279602 - DNA, 20 bp, Artificial Sequence
  chemically synthesized
caaatgccttttgtatttaa

SEQ ID NO: 279603 - DNA, 20 bp, Artificial Sequence
  chemically synthesized
agtatgatgaaaaaatagtt

SEQ ID NO: 279604 - DNA, 20 bp, Artificial Sequence
  chemically synthesized
caataagtatgatgaaaaaa

SEQ ID NO: 279605 - DNA, 20 bp, Artificial Sequence
  chemically synthesized
ttaaaggttttagatgcaat

SEQ ID NO: 279606 - DNA, 20 bp, Artificial Sequence
  chemically synthesized
aaaataagttttaaaggttt

SEQ ID NO: 279607 - DNA, 20 bp, Artificial Sequence
  chemically synthesized
agtagaaaaataagttttaa

SEQ ID NO: 279608 - DNA, 20 bp, Artificial Sequence
  chemically synthesized
tagtagaaaaataagtttta

SEQ ID NO: 279609 - DNA, 20 bp, Artificial Sequence
  chemically synthesized
attagaagtagtagaaaaat

SEQ ID NO: 279610 - DNA, 20 bp, Artificial Sequence
  chemically synthesized
gtatgaagaattagaagtag

SEQ ID NO: 279611 - DNA, 20 bp, Artificial Sequence
  chemically synthesized
taagtatgaagaattagaag

SEQ ID NO: 279612 - DNA, 20 bp, Artificial Sequence
  chemically synthesized
aaataagtatgaagaattag

SEQ ID NO: 279613 - DNA, 20 bp, Artificial Sequence
  chemically synthesized
ctaaaataagtatgaagaat

SEQ ID NO: 279614 - DNA, 20 bp, Artificial Sequence
  chemically synthesized
aaatgtctaaaataagtatg

SEQ ID NO: 279615 - DNA, 20 bp, Artificial Sequence
  chemically synthesized
ctaattcttcatacttattt

SEQ ID NO: 279616 - DNA, 20 bp, Artificial Sequence
  chemically synthesized
actataaaaatgtctaaaat

SEQ ID NO: 279617 - DNA, 20 bp, Artificial Sequence
  chemically synthesized
acttattttagacattttta

SEQ ID NO: 279618 - DNA, 20 bp, Artificial Sequence
  chemically synthesized
attttagacatttttatagt

SEQ ID NO: 279619 - DNA, 20 bp, Artificial Sequence
  chemically synthesized
ttttagacatttttatagta

SEQ ID NO: 279620 - DNA, 20 bp, Artificial Sequence
  chemically synthesized
tttagacatttttatagtaa

SEQ ID NO: 279621 - DNA, 20 bp, Artificial Sequence
  chemically synthesized
tttttatagtaagggtctat

SEQ ID NO: 279622 - DNA, 20 bp, Artificial Sequence
  chemically synthesized
ttttatagtaagggtctatt

SEQ ID NO: 279623 - DNA, 20 bp, Artificial Sequence
  chemically synthesized
tttatagtaagggtctattg

SEQ ID NO: 279624 - DNA, 20 bp, Artificial Sequence
  chemically synthesized
aaagtgaaattttaccccaa

SEQ ID NO: 279625 - DNA, 20 bp, Artificial Sequence
  chemically synthesized
acattatcagagtgaaaaaa

SEQ ID NO: 279626 - DNA, 20 bp, Artificial Sequence
  chemically synthesized
gaggaaattagacattatca

SEQ ID NO: 279627 - DNA, 20 bp, Artificial Sequence
  chemically synthesized
aagaggaaattagacattat

SEQ ID NO: 279628 - DNA, 20 bp, Artificial Sequence
  chemically synthesized
tcttcagagtaagaggaaat

SEQ ID NO: 279629 - DNA, 20 bp, Artificial Sequence
  chemically synthesized
aattagttcttcagagtaag

SEQ ID NO: 279630 - DNA, 20 bp, Artificial Sequence
  chemically synthesized
aaattagttcttcagagtaa

SEQ ID NO: 279631 - DNA, 20 bp, Artificial Sequence
  chemically synthesized
tctaatttcctcttactctg

SEQ ID NO: 279632 - DNA, 20 bp, Artificial Sequence
  chemically synthesized
caaaattagttcttcagagt

SEQ ID NO: 279633 - DNA, 20 bp, Artificial Sequence
  chemically synthesized
tcaacaaaattagttcttca

SEQ ID NO: 279634 - DNA, 20 bp, Artificial Sequence
  chemically synthesized
actcaacaaaattagttctt

SEQ ID NO: 279635 - DNA, 20 bp, Artificial Sequence
  chemically synthesized
aattctgaactcaacaaaat

SEQ ID NO: 279636 - DNA, 20 bp, Artificial Sequence
  chemically synthesized
tctgaagaactaattttgtt

SEQ ID NO: 279637 - DNA, 20 bp, Artificial Sequence
  chemically synthesized
agaactaattttgttgagtt

SEQ ID NO: 279638 - DNA, 20 bp, Artificial Sequence
  chemically synthesized
ttttgttgagttcagaattc

SEQ ID NO: 279639 - DNA, 20 bp, Artificial Sequence
  chemically synthesized
tttgttgagttcagaattct

SEQ ID NO: 279640 - DNA, 20 bp, Artificial Sequence
  chemically synthesized
agttcagaattctaggttga

SEQ ID NO: 279641 - DNA, 20 bp, Artificial Sequence
  chemically synthesized
tgaaaaaattaccgtcaacc

SEQ ID NO: 279642 - DNA, 20 bp, Artificial Sequence
  chemically synthesized
aagcaatggaaaatattttc

SEQ ID NO: 279643 - DNA, 20 bp, Artificial Sequence
  chemically synthesized
gaataagaataaaaaagcaa

SEQ ID NO: 279644 - DNA, 20 bp, Artificial Sequence
  chemically synthesized
aacaatgaataagaataaaa

SEQ ID NO: 279645 - DNA, 20 bp, Artificial Sequence
  chemically synthesized
tcttatctacaacaatgaat

SEQ ID NO: 279646 - DNA, 20 bp, Artificial Sequence
  chemically synthesized
tttattcttattcattgttg

SEQ ID NO: 279647 - DNA, 20 bp, Artificial Sequence
  chemically synthesized
tcttattcattgttgtagat

SEQ ID NO: 279648 - DNA, 20 bp, Artificial Sequence
  chemically synthesized
tattcattgttgtagataag

SEQ ID NO: 279649 - DNA, 20 bp, Artificial Sequence
  chemically synthesized
gtagataagaagtctaatga

SEQ ID NO: 279650 - DNA, 20 bp, Artificial Sequence
  chemically synthesized
aattaaatttaggctgtcat

SEQ ID NO: 279651 - DNA, 20 bp, Artificial Sequence
  chemically synthesized
cctacaaagcaattaaattt

SEQ ID NO: 279652 - DNA, 20 bp, Artificial Sequence
  chemically synthesized
acctacaaagcaattaaatt

SEQ ID NO: 279653 - DNA, 20 bp, Artificial Sequence
  chemically synthesized
gcctaaatttaattgctttg

SEQ ID NO: 279654 - DNA, 20 bp, Artificial Sequence
  chemically synthesized
cctaaatttaattgctttgt

SEQ ID NO: 279655 - DNA, 20 bp, Artificial Sequence
  chemically synthesized
ggtgagatggataacctaca

SEQ ID NO: 279656 - DNA, 20 bp, Artificial Sequence
  chemically synthesized
attagcagctagaggtgaga

SEQ ID NO: 279657 - DNA, 20 bp, Artificial Sequence
  chemically synthesized
taggttatccatctcacctc

SEQ ID NO: 279658 - DNA, 20 bp, Artificial Sequence
  chemically synthesized
ttatattagcagctagaggt

SEQ ID NO: 279659 - DNA, 20 bp, Artificial Sequence
  chemically synthesized
aaatttatattagcagctag

SEQ ID NO: 279660 - DNA, 20 bp, Artificial Sequence
  chemically synthesized
caaatttatattagcagcta

SEQ ID NO: 279661 - DNA, 20 bp, Artificial Sequence
  chemically synthesized
gacaaatttatattagcagc

SEQ ID NO: 279662 - DNA, 20 bp, Artificial Sequence
  chemically synthesized
caaagacaaatttatattag

SEQ ID NO: 279663 - DNA, 20 bp, Artificial Sequence
  chemically synthesized
atccaaagacaaatttatat

SEQ ID NO: 279664 - DNA, 20 bp, Artificial Sequence
  chemically synthesized
tgctaatataaatttgtctt

SEQ ID NO: 279665 - DNA, 20 bp, Artificial Sequence
  chemically synthesized
agtgaaagtgcagaaatcca

SEQ ID NO: 279666 - DNA, 20 bp, Artificial Sequence
  chemically synthesized
gacatatcacagtgaaagtg

SEQ ID NO: 279667 - DNA, 20 bp, Artificial Sequence
  chemically synthesized
tctcagacatatcacagtga

SEQ ID NO: 279668 - DNA, 20 bp, Artificial Sequence
  chemically synthesized
atccaatctcagacatatca

SEQ ID NO: 279669 - DNA, 20 bp, Artificial Sequence
  chemically synthesized
actttcactgtgatatgtct

SEQ ID NO: 279670 - DNA, 20 bp, Artificial Sequence
  chemically synthesized
cactgtgatatgtctgagat

SEQ ID NO: 279671 - DNA, 20 bp, Artificial Sequence
  chemically synthesized
aataaatagaaatccaatct

SEQ ID NO: 279672 - DNA, 20 bp, Artificial Sequence
  chemically synthesized
taacaggcaaagtaaataaa

SEQ ID NO: 279673 - DNA, 20 bp, Artificial Sequence
  chemically synthesized
agcacattatataacaggca

SEQ ID NO: 279674 - DNA, 20 bp, Artificial Sequence
  chemically synthesized
cagaaagcacattatataac

SEQ ID NO: 279675 - DNA, 20 bp, Artificial Sequence
  chemically synthesized
acagaaagcacattatataa

SEQ ID NO: 279676 - DNA, 20 bp, Artificial Sequence
  chemically synthesized
atataatgtgctttctgttt

SEQ ID NO: 279677 - DNA, 20 bp, Artificial Sequence
  chemically synthesized
acataaaccacttaaacaga

SEQ ID NO: 279678 - DNA, 20 bp, Artificial Sequence
  chemically synthesized
taatgtgctttctgtttaag

SEQ ID NO: 279679 - DNA, 20 bp, Artificial Sequence
  chemically synthesized
agtgacataaaccacttaaa

SEQ ID NO: 279680 - DNA, 20 bp, Artificial Sequence
  chemically synthesized
gtttaagtggtttatgtcac

SEQ ID NO: 279681 - DNA, 20 bp, Artificial Sequence
  chemically synthesized
tggtttatgtcactggctct

SEQ ID NO: 279682 - DNA, 20 bp, Artificial Sequence
  chemically synthesized
aaaggaaagtttccaagagc

SEQ ID NO: 279683 - DNA, 20 bp, Artificial Sequence
  chemically synthesized
tattaaaggaaagtttccaa

SEQ ID NO: 279684 - DNA, 20 bp, Artificial Sequence
  chemically synthesized
gatattaaaggaaagtttcc

SEQ ID NO: 279685 - DNA, 20 bp, Artificial Sequence
  chemically synthesized
atatgaaggatattaaagga

SEQ ID NO: 279686 - DNA, 20 bp, Artificial Sequence
  chemically synthesized
taatatatgaaggatattaa

SEQ ID NO: 279687 - DNA, 20 bp, Artificial Sequence
  chemically synthesized
gtaatatatgaaggatatta

SEQ ID NO: 279688 - DNA, 20 bp, Artificial Sequence
  chemically synthesized
ggagatggagtaatatatga

SEQ ID NO: 279689 - DNA, 20 bp, Artificial Sequence
  chemically synthesized
tggagatggagtaatatatg

SEQ ID NO: 279690 - DNA, 20 bp, Artificial Sequence
  chemically synthesized
ttttttgagaaatggagatg

SEQ ID NO: 279691 - DNA, 20 bp, Artificial Sequence
  chemically synthesized
atttttttgagaaatggaga

SEQ ID NO: 279692 - DNA, 20 bp, Artificial Sequence
  chemically synthesized
cataatttttttgagaaatg

SEQ ID NO: 279693 - DNA, 20 bp, Artificial Sequence
  chemically synthesized
gtcataatttttttgagaaa

SEQ ID NO: 279694 - DNA, 20 bp, Artificial Sequence
  chemically synthesized
ttgtatgtcataattttttt

SEQ ID NO: 279695 - DNA, 20 bp, Artificial Sequence
  chemically synthesized
tcaaaaaaattatgacatac

SEQ ID NO: 279696 - DNA, 20 bp, Artificial Sequence
  chemically synthesized
aaaaattatgacatacaaga

SEQ ID NO: 279697 - DNA, 20 bp, Artificial Sequence
  chemically synthesized
ttgtgtatgttaattatata

SEQ ID NO: 279698 - DNA, 20 bp, Artificial Sequence
  chemically synthesized
tgtatataattaacatacac

SEQ ID NO: 279699 - DNA, 20 bp, Artificial Sequence
  chemically synthesized
attaacatacacaagttgct

SEQ ID NO: 279700 - DNA, 20 bp, Artificial Sequence
  chemically synthesized
catacacaagttgctgagtt

SEQ ID NO: 279701 - DNA, 20 bp, Artificial Sequence
  chemically synthesized
tacacaagttgctgagtttg

SEQ ID NO: 279702 - DNA, 20 bp, Artificial Sequence
  chemically synthesized
tgtatatttatctccaaact

SEQ ID NO: 279703 - DNA, 20 bp, Artificial Sequence
  chemically synthesized
gattgaggtaatgtttttat

SEQ ID NO: 279704 - DNA, 20 bp, Artificial Sequence
  chemically synthesized
taggtttatgtcatagattg

SEQ ID NO: 279705 - DNA, 20 bp, Artificial Sequence
  chemically synthesized
ataggtttatgtcatagatt

SEQ ID NO: 279706 - DNA, 20 bp, Artificial Sequence
  chemically synthesized
tgatgaataggtttatgtca

SEQ ID NO: 279707 - DNA, 20 bp, Artificial Sequence
  chemically synthesized
aagttttggagatgatgaat

SEQ ID NO: 279708 - DNA, 20 bp, Artificial Sequence
  chemically synthesized
aaagttttggagatgatgaa

SEQ ID NO: 279709 - DNA, 20 bp, Artificial Sequence
  chemically synthesized
agaataggaggaaagttttg

SEQ ID NO: 279710 - DNA, 20 bp, Artificial Sequence
  chemically synthesized
ttagaataggaggaaagttt

SEQ ID NO: 279711 - DNA, 20 bp, Artificial Sequence
  chemically synthesized
ataatattagaataggagga

SEQ ID NO: 279712 - DNA, 20 bp, Artificial Sequence
  chemically synthesized
aataataatattagaatagg

SEQ ID NO: 279713 - DNA, 20 bp, Artificial Sequence
  chemically synthesized
taataataatattagaatag

SEQ ID NO: 279714 - DNA, 20 bp, Artificial Sequence
  chemically synthesized
aataataataatattagaat

SEQ ID NO: 279715 - DNA, 20 bp, Artificial Sequence
  chemically synthesized
gaataataataatattagaa

SEQ ID NO: 279716 - DNA, 20 bp, Artificial Sequence
  chemically synthesized
ttacagaataataataatat

SEQ ID NO: 279717 - DNA, 20 bp, Artificial Sequence
  chemically synthesized
atattattattattctgtaa

SEQ ID NO: 279718 - DNA, 20 bp, Artificial Sequence
  chemically synthesized
ttatgttaagtgttctgtta

SEQ ID NO: 279719 - DNA, 20 bp, Artificial Sequence
  chemically synthesized
tgtaacagaacacttaacat

SEQ ID NO: 279720 - DNA, 20 bp, Artificial Sequence
  chemically synthesized
gtaacagaacacttaacata

SEQ ID NO: 279721 - DNA, 20 bp, Artificial Sequence
  chemically synthesized
aagaggatagaccttatgtt

SEQ ID NO: 279722 - DNA, 20 bp, Artificial Sequence
  chemically synthesized
taacataaggtctatcctct

SEQ ID NO: 279723 - DNA, 20 bp, Artificial Sequence
  chemically synthesized
cttaaactttgctaagagga

SEQ ID NO: 279724 - DNA, 20 bp, Artificial Sequence
  chemically synthesized
taaggtctatcctcttagca

SEQ ID NO: 279725 - DNA, 20 bp, Artificial Sequence
  chemically synthesized
tttacttaaactttgctaag

SEQ ID NO: 279726 - DNA, 20 bp, Artificial Sequence
  chemically synthesized
atttacttaaactttgctaa

SEQ ID NO: 279727 - DNA, 20 bp, Artificial Sequence
  chemically synthesized
ctatttacttaaactttgct

SEQ ID NO: 279728 - DNA, 20 bp, Artificial Sequence
  chemically synthesized
ctatcctcttagcaaagttt

SEQ ID NO: 279729 - DNA, 20 bp, Artificial Sequence
  chemically synthesized
cttagcaaagtttaagtaaa

SEQ ID NO: 279730 - DNA, 20 bp, Artificial Sequence
  chemically synthesized
ttaagtaaatagactaacta

SEQ ID NO: 279731 - DNA, 20 bp, Artificial Sequence
  chemically synthesized
taagtaaatagactaactat

SEQ ID NO: 279732 - DNA, 20 bp, Artificial Sequence
  chemically synthesized
taaagcatattgcctatagt

SEQ ID NO: 279733 - DNA, 20 bp, Artificial Sequence
  chemically synthesized
actgtaaagcatattgccta

SEQ ID NO: 279734 - DNA, 20 bp, Artificial Sequence
  chemically synthesized
actataggcaatatgcttta

SEQ ID NO: 279735 - DNA, 20 bp, Artificial Sequence
  chemically synthesized
ataggcaatatgctttacag

SEQ ID NO: 279736 - DNA, 20 bp, Artificial Sequence
  chemically synthesized
attcctagagatctactgta

SEQ ID NO: 279737 - DNA, 20 bp, Artificial Sequence
  chemically synthesized
tatgctttacagtagatctc

SEQ ID NO: 279738 - DNA, 20 bp, Artificial Sequence
  chemically synthesized
atgctttacagtagatctct

SEQ ID NO: 279739 - DNA, 20 bp, Artificial Sequence
  chemically synthesized
tacaatatagataattccta

SEQ ID NO: 279740 - DNA, 20 bp, Artificial Sequence
  chemically synthesized
tatacaatatagataattcc

SEQ ID NO: 279741 - DNA, 20 bp, Artificial Sequence
  chemically synthesized
aatgtttaggttatacaata

SEQ ID NO: 279742 - DNA, 20 bp, Artificial Sequence
  chemically synthesized
tgtaaaagggtacaatgttt

SEQ ID NO: 279743 - DNA, 20 bp, Artificial Sequence
  chemically synthesized
ttgtaaaagggtacaatgtt

SEQ ID NO: 279744 - DNA, 20 bp, Artificial Sequence
  chemically synthesized
atggagagatatttgtaaaa

SEQ ID NO: 279745 - DNA, 20 bp, Artificial Sequence
  chemically synthesized
aatggagagatatttgtaaa

SEQ ID NO: 279746 - DNA, 20 bp, Artificial Sequence
  chemically synthesized
aaatggagagatatttgtaa

SEQ ID NO: 279747 - DNA, 20 bp, Artificial Sequence
  chemically synthesized
taggggaagggaaaaatgga

SEQ ID NO: 279748 - DNA, 20 bp, Artificial Sequence
  chemically synthesized
gctaggggaagggaaaaatg

SEQ ID NO: 279749 - DNA, 20 bp, Artificial Sequence
  chemically synthesized
gggctaggggaagggaaaaa

SEQ ID NO: 279750 - DNA, 20 bp, Artificial Sequence
  chemically synthesized
tctccatttttcccttcccc

SEQ ID NO: 279751 - DNA, 20 bp, Artificial Sequence
  chemically synthesized
cctgccaggggctaggggaa

SEQ ID NO: 279752 - DNA, 20 bp, Artificial Sequence
  chemically synthesized
tcctgccaggggctagggga

SEQ ID NO: 279753 - DNA, 20 bp, Artificial Sequence
  chemically synthesized
ttcctgccaggggctagggg

SEQ ID NO: 279754 - DNA, 20 bp, Artificial Sequence
  chemically synthesized
tgcttcctgccaggggctag

SEQ ID NO: 279755 - DNA, 20 bp, Artificial Sequence
  chemically synthesized
ttttcccttcccctagcccc

SEQ ID NO: 279756 - DNA, 20 bp, Artificial Sequence
  chemically synthesized
atgcttcctgccaggggcta

SEQ ID NO: 279757 - DNA, 20 bp, Artificial Sequence
  chemically synthesized
aatgcttcctgccaggggct

SEQ ID NO: 279758 - DNA, 20 bp, Artificial Sequence
  chemically synthesized
gaatgcttcctgccaggggc

SEQ ID NO: 279759 - DNA, 20 bp, Artificial Sequence
  chemically synthesized
tcccttcccctagcccctgg

SEQ ID NO: 279760 - DNA, 20 bp, Artificial Sequence
  chemically synthesized
cccttcccctagcccctggc

SEQ ID NO: 279761 - DNA, 20 bp, Artificial Sequence
  chemically synthesized
tgtggaatgcttcctgccag

SEQ ID NO: 279762 - DNA, 20 bp, Artificial Sequence
  chemically synthesized
ttcccctagcccctggcagg

SEQ ID NO: 279763 - DNA, 20 bp, Artificial Sequence
  chemically synthesized
atgtggaatgcttcctgcca

SEQ ID NO: 279764 - DNA, 20 bp, Artificial Sequence
  chemically synthesized
aatgtggaatgcttcctgcc

SEQ ID NO: 279765 - DNA, 20 bp, Artificial Sequence
  chemically synthesized
gaatgtggaatgcttcctgc

SEQ ID NO: 279766 - DNA, 20 bp, Artificial Sequence
  chemically synthesized
aaactaatggaaggagaatg

SEQ ID NO: 279767 - DNA, 20 bp, Artificial Sequence
  chemically synthesized
attccacattctccttccat

SEQ ID NO: 279768 - DNA, 20 bp, Artificial Sequence
  chemically synthesized
tacagtcaaactaatggaag

SEQ ID NO: 279769 - DNA, 20 bp, Artificial Sequence
  chemically synthesized
aatacagtcaaactaatgga

SEQ ID NO: 279770 - DNA, 20 bp, Artificial Sequence
  chemically synthesized
taatacagtcaaactaatgg

SEQ ID NO: 279771 - DNA, 20 bp, Artificial Sequence
  chemically synthesized
atctaatacagtcaaactaa

SEQ ID NO: 279772 - DNA, 20 bp, Artificial Sequence
  chemically synthesized
ttccattagtttgactgtat

SEQ ID NO: 279773 - DNA, 20 bp, Artificial Sequence
  chemically synthesized
atcatattatgaatctaata

SEQ ID NO: 279774 - DNA, 20 bp, Artificial Sequence
  chemically synthesized
tattagattcataatatgat

SEQ ID NO: 279775 - DNA, 20 bp, Artificial Sequence
  chemically synthesized
attagattcataatatgatt

SEQ ID NO: 279776 - DNA, 20 bp, Artificial Sequence
  chemically synthesized
tgaagtaagccagacataga

SEQ ID NO: 279777 - DNA, 20 bp, Artificial Sequence
  chemically synthesized
attatttgtctttctatgtc

SEQ ID NO: 279778 - DNA, 20 bp, Artificial Sequence
  chemically synthesized
tacatgaagtaagccagaca

SEQ ID NO: 279779 - DNA, 20 bp, Artificial Sequence
  chemically synthesized
ttatgctacatgaagtaagc

SEQ ID NO: 279780 - DNA, 20 bp, Artificial Sequence
  chemically synthesized
gacattatgctacatgaagt

SEQ ID NO: 279781 - DNA, 20 bp, Artificial Sequence
  chemically synthesized
tatgtctggcttacttcatg

SEQ ID NO: 279782 - DNA, 20 bp, Artificial Sequence
  chemically synthesized
ggaggacattatgctacatg

SEQ ID NO: 279783 - DNA, 20 bp, Artificial Sequence
  chemically synthesized
tcatgtagcataatgtcctc

SEQ ID NO: 279784 - DNA, 20 bp, Artificial Sequence
  chemically synthesized
catgtagcataatgtcctcc

SEQ ID NO: 279785 - DNA, 20 bp, Artificial Sequence
  chemically synthesized
aacaacatggataaacctgg

SEQ ID NO: 279786 - DNA, 20 bp, Artificial Sequence
  chemically synthesized
taacaacatggataaacctg

SEQ ID NO: 279787 - DNA, 20 bp, Artificial Sequence
  chemically synthesized
tgtaacaacatggataaacc

SEQ ID NO: 279788 - DNA, 20 bp, Artificial Sequence
  chemically synthesized
accatttcgctgtaacaaca

SEQ ID NO: 279789 - DNA, 20 bp, Artificial Sequence
  chemically synthesized
caggtttatccatgttgtta

SEQ ID NO: 279790 - DNA, 20 bp, Artificial Sequence
  chemically synthesized
tccatgttgttacagcgaaa

SEQ ID NO: 279791 - DNA, 20 bp, Artificial Sequence
  chemically synthesized
atgttgttacagcgaaatgg

SEQ ID NO: 279792 - DNA, 20 bp, Artificial Sequence
  chemically synthesized
tgttgttacagcgaaatggt

SEQ ID NO: 279793 - DNA, 20 bp, Artificial Sequence
  chemically synthesized
gtaggatttgcttatttttt

SEQ ID NO: 279794 - DNA, 20 bp, Artificial Sequence
  chemically synthesized
ttattcagcccttaaaaaat

SEQ ID NO: 279795 - DNA, 20 bp, Artificial Sequence
  chemically synthesized
taggatttgcttatttttta

SEQ ID NO: 279796 - DNA, 20 bp, Artificial Sequence
  chemically synthesized
aggatttgcttattttttaa

SEQ ID NO: 279797 - DNA, 20 bp, Artificial Sequence
  chemically synthesized
acatacaatgaaatattatt

SEQ ID NO: 279798 - DNA, 20 bp, Artificial Sequence
  chemically synthesized
cattgacaggtgaaaggaaa

SEQ ID NO: 279799 - DNA, 20 bp, Artificial Sequence
  chemically synthesized
aatgtccattgacaggtgaa

SEQ ID NO: 279800 - DNA, 20 bp, Artificial Sequence
  chemically synthesized
aaatgtccattgacaggtga

SEQ ID NO: 279801 - DNA, 20 bp, Artificial Sequence
  chemically synthesized
tttttcctttcacctgtcaa

SEQ ID NO: 279802 - DNA, 20 bp, Artificial Sequence
  chemically synthesized
caacctaaatgtccattgac

SEQ ID NO: 279803 - DNA, 20 bp, Artificial Sequence
  chemically synthesized
acaacctaaatgtccattga

SEQ ID NO: 279804 - DNA, 20 bp, Artificial Sequence
  chemically synthesized
ttcacctgtcaatggacatt

SEQ ID NO: 279805 - DNA, 20 bp, Artificial Sequence
  chemically synthesized
tcacctgtcaatggacattt

SEQ ID NO: 279806 - DNA, 20 bp, Artificial Sequence
  chemically synthesized
tttacaatagcaaagatata

SEQ ID NO: 279807 - DNA, 20 bp, Artificial Sequence
  chemically synthesized
tatttacaatagcaaagata

SEQ ID NO: 279808 - DNA, 20 bp, Artificial Sequence
  chemically synthesized
cagcattatttacaatagca

SEQ ID NO: 279809 - DNA, 20 bp, Artificial Sequence
  chemically synthesized
tattgcagcattatttacaa

SEQ ID NO: 279810 - DNA, 20 bp, Artificial Sequence
  chemically synthesized
ctgcactctattgtttattg

SEQ ID NO: 279811 - DNA, 20 bp, Artificial Sequence
  chemically synthesized
aataatgctgcaataaacaa

SEQ ID NO: 279812 - DNA, 20 bp, Artificial Sequence
  chemically synthesized
taatgctgcaataaacaata

SEQ ID NO: 279813 - DNA, 20 bp, Artificial Sequence
  chemically synthesized
ctgcaataaacaatagagtg

SEQ ID NO: 279814 - DNA, 20 bp, Artificial Sequence
  chemically synthesized
aattgaatgagaatcacaag

SEQ ID NO: 279815 - DNA, 20 bp, Artificial Sequence
  chemically synthesized
gaaattgaatgagaatcaca

SEQ ID NO: 279816 - DNA, 20 bp, Artificial Sequence
  chemically synthesized
ggaaattgaatgagaatcac

SEQ ID NO: 279817 - DNA, 20 bp, Artificial Sequence
  chemically synthesized
atatccaaaggaaattgaat

SEQ ID NO: 279818 - DNA, 20 bp, Artificial Sequence
  chemically synthesized
gattctcattcaatttcctt

SEQ ID NO: 279819 - DNA, 20 bp, Artificial Sequence
  chemically synthesized
acttctagggatatatccaa

SEQ ID NO: 279820 - DNA, 20 bp, Artificial Sequence
  chemically synthesized
cacttctagggatatatcca

SEQ ID NO: 279821 - DNA, 20 bp, Artificial Sequence
  chemically synthesized
atttcctttggatatatccc

SEQ ID NO: 279822 - DNA, 20 bp, Artificial Sequence
  chemically synthesized
tcctttggatatatccctag

SEQ ID NO: 279823 - DNA, 20 bp, Artificial Sequence
  chemically synthesized
tttggatatatccctagaag

SEQ ID NO: 279824 - DNA, 20 bp, Artificial Sequence
  chemically synthesized
atccagcaattccacttcta

SEQ ID NO: 279825 - DNA, 20 bp, Artificial Sequence
  chemically synthesized
gatccagcaattccacttct

SEQ ID NO: 279826 - DNA, 20 bp, Artificial Sequence
  chemically synthesized
tgatccagcaattccacttc

SEQ ID NO: 279827 - DNA, 20 bp, Artificial Sequence
  chemically synthesized
atccctagaagtggaattgc

SEQ ID NO: 279828 - DNA, 20 bp, Artificial Sequence
  chemically synthesized
agtggaattgctggatcata

SEQ ID NO: 279829 - DNA, 20 bp, Artificial Sequence
  chemically synthesized
aatagaattactatatgatc

SEQ ID NO: 279830 - DNA, 20 bp, Artificial Sequence
  chemically synthesized
ctcaaaaaaaaaattaaaaa

SEQ ID NO: 279831 - DNA, 20 bp, Artificial Sequence
  chemically synthesized
ctatttttaatttttttttt

SEQ ID NO: 279832 - DNA, 20 bp, Artificial Sequence
  chemically synthesized
tatttttaattttttttttg

SEQ ID NO: 279833 - DNA, 20 bp, Artificial Sequence
  chemically synthesized
acactatggaaaacagtatg

SEQ ID NO: 279834 - DNA, 20 bp, Artificial Sequence
  chemically synthesized
tgacactatggaaaacagta

SEQ ID NO: 279835 - DNA, 20 bp, Artificial Sequence
  chemically synthesized
aatctccatactgttttcca

SEQ ID NO: 279836 - DNA, 20 bp, Artificial Sequence
  chemically synthesized
catgctgacactatggaaaa

SEQ ID NO: 279837 - DNA, 20 bp, Artificial Sequence
  chemically synthesized
catactgttttccatagtgt

SEQ ID NO: 279838 - DNA, 20 bp, Artificial Sequence
  chemically synthesized
gttaattcatgctgacacta

SEQ ID NO: 279839 - DNA, 20 bp, Artificial Sequence
  chemically synthesized
tgaattaacattcctgccat

SEQ ID NO: 279840 - DNA, 20 bp, Artificial Sequence
  chemically synthesized
gaattaacattcctgccatc

SEQ ID NO: 279841 - DNA, 20 bp, Artificial Sequence
  chemically synthesized
aattaacattcctgccatca

SEQ ID NO: 279842 - DNA, 20 bp, Artificial Sequence
  chemically synthesized
gccccttgtaccctgatggc

SEQ ID NO: 279843 - DNA, 20 bp, Artificial Sequence
  chemically synthesized
ggccccttgtaccctgatgg

SEQ ID NO: 279844 - DNA, 20 bp, Artificial Sequence
  chemically synthesized
aagggccccttgtaccctga

SEQ ID NO: 279845 - DNA, 20 bp, Artificial Sequence
  chemically synthesized
cattcctgccatcagggtac

SEQ ID NO: 279846 - DNA, 20 bp, Artificial Sequence
  chemically synthesized
attcctgccatcagggtaca

SEQ ID NO: 279847 - DNA, 20 bp, Artificial Sequence
  chemically synthesized
ttcctgccatcagggtacaa

SEQ ID NO: 279848 - DNA, 20 bp, Artificial Sequence
  chemically synthesized
tcctgccatcagggtacaag

SEQ ID NO: 279849 - DNA, 20 bp, Artificial Sequence
  chemically synthesized
tggcaagaatgtggagaaaa

SEQ ID NO: 279850 - DNA, 20 bp, Artificial Sequence
  chemically synthesized
ttggcaagaatgtggagaaa

SEQ ID NO: 279851 - DNA, 20 bp, Artificial Sequence
  chemically synthesized
tttggcaagaatgtggagaa

SEQ ID NO: 279852 - DNA, 20 bp, Artificial Sequence
  chemically synthesized
acaagtttggcaagaatgtg

SEQ ID NO: 279853 - DNA, 20 bp, Artificial Sequence
  chemically synthesized
tgacaagtttggcaagaatg

SEQ ID NO: 279854 - DNA, 20 bp, Artificial Sequence
  chemically synthesized
caagagatgacaagtttggc

SEQ ID NO: 279855 - DNA, 20 bp, Artificial Sequence
  chemically synthesized
aaatcaagagatgacaagtt

SEQ ID NO: 279856 - DNA, 20 bp, Artificial Sequence
  chemically synthesized
aaagaaaatcaagagatgac

SEQ ID NO: 279857 - DNA, 20 bp, Artificial Sequence
  chemically synthesized
ttacttaaaaagaaaatcaa

SEQ ID NO: 279858 - DNA, 20 bp, Artificial Sequence
  chemically synthesized
agttacttaaaaagaaaatc

SEQ ID NO: 279859 - DNA, 20 bp, Artificial Sequence
  chemically synthesized
catctcttgattttcttttt

SEQ ID NO: 279860 - DNA, 20 bp, Artificial Sequence
  chemically synthesized
tagaatggcagttacttaaa

SEQ ID NO: 279861 - DNA, 20 bp, Artificial Sequence
  chemically synthesized
cttcacatctgttagaatgg

SEQ ID NO: 279862 - DNA, 20 bp, Artificial Sequence
  chemically synthesized
ttaagtaactgccattctaa

SEQ ID NO: 279863 - DNA, 20 bp, Artificial Sequence
  chemically synthesized
tgtcttcacatctgttagaa

SEQ ID NO: 279864 - DNA, 20 bp, Artificial Sequence
  chemically synthesized
atatatgtcttcacatctgt

SEQ ID NO: 279865 - DNA, 20 bp, Artificial Sequence
  chemically synthesized
ctgccattctaacagatgtg

SEQ ID NO: 279866 - DNA, 20 bp, Artificial Sequence
  chemically synthesized
tgtgaagacatatatcattg

SEQ ID NO: 279867 - DNA, 20 bp, Artificial Sequence
  chemically synthesized
cattgtggttttgatttaca

SEQ ID NO: 279868 - DNA, 20 bp, Artificial Sequence
  chemically synthesized
ctcaaactcattaatcatca

SEQ ID NO: 279869 - DNA, 20 bp, Artificial Sequence
  chemically synthesized
gctcaaactcattaatcatc

SEQ ID NO: 279870 - DNA, 20 bp, Artificial Sequence
  chemically synthesized
tgctcaaactcattaatcat

SEQ ID NO: 279871 - DNA, 20 bp, Artificial Sequence
  chemically synthesized
acatagccctgatgattaat

SEQ ID NO: 279872 - DNA, 20 bp, Artificial Sequence
  chemically synthesized
ccctgatgattaatgagttt

SEQ ID NO: 279873 - DNA, 20 bp, Artificial Sequence
  chemically synthesized
tggccaacatatatatgaaa

SEQ ID NO: 279874 - DNA, 20 bp, Artificial Sequence
  chemically synthesized
atggccaacatatatatgaa

SEQ ID NO: 279875 - DNA, 20 bp, Artificial Sequence
  chemically synthesized
gcaccttttcatatatatgt

SEQ ID NO: 279876 - DNA, 20 bp, Artificial Sequence
  chemically synthesized
atatatatgttggccatatg

SEQ ID NO: 279877 - DNA, 20 bp, Artificial Sequence
  chemically synthesized
tatatatgttggccatatgt

SEQ ID NO: 279878 - DNA, 20 bp, Artificial Sequence
  chemically synthesized
cttcaatgaagacctacata

SEQ ID NO: 279879 - DNA, 20 bp, Artificial Sequence
  chemically synthesized
ccatatgtaggtcttcattg

SEQ ID NO: 279880 - DNA, 20 bp, Artificial Sequence
  chemically synthesized
caaaaggcatttcttcaatg

SEQ ID NO: 279881 - DNA, 20 bp, Artificial Sequence
  chemically synthesized
tcattgaagaaatgcctttt

SEQ ID NO: 279882 - DNA, 20 bp, Artificial Sequence
  chemically synthesized
aatgagcagttgagctcaaa

SEQ ID NO: 279883 - DNA, 20 bp, Artificial Sequence
  chemically synthesized
aaatgagcagttgagctcaa

SEQ ID NO: 279884 - DNA, 20 bp, Artificial Sequence
  chemically synthesized
caatttaaaaatgagcagtt

SEQ ID NO: 279885 - DNA, 20 bp, Artificial Sequence
  chemically synthesized
taacccaatttaaaaatgag

SEQ ID NO: 279886 - DNA, 20 bp, Artificial Sequence
  chemically synthesized
atataacccaatttaaaaat

SEQ ID NO: 279887 - DNA, 20 bp, Artificial Sequence
  chemically synthesized
tcaactgctcatttttaaat

SEQ ID NO: 279888 - DNA, 20 bp, Artificial Sequence
  chemically synthesized
caactgctcatttttaaatt

SEQ ID NO: 279889 - DNA, 20 bp, Artificial Sequence
  chemically synthesized
agaggagaataaagaaaatg

SEQ ID NO: 279890 - DNA, 20 bp, Artificial Sequence
  chemically synthesized
aaagaggagaataaagaaaa

SEQ ID NO: 279891 - DNA, 20 bp, Artificial Sequence
  chemically synthesized
agttttcaaagaggagaata

SEQ ID NO: 279892 - DNA, 20 bp, Artificial Sequence
  chemically synthesized
caatgggagttttcaaagag

SEQ ID NO: 279893 - DNA, 20 bp, Artificial Sequence
  chemically synthesized
ctcaatgggagttttcaaag

SEQ ID NO: 279894 - DNA, 20 bp, Artificial Sequence
  chemically synthesized
tctcaatgggagttttcaaa

SEQ ID NO: 279895 - DNA, 20 bp, Artificial Sequence
  chemically synthesized
tatctcaatgggagttttca

SEQ ID NO: 279896 - DNA, 20 bp, Artificial Sequence
  chemically synthesized
cctctttgaaaactcccatt

SEQ ID NO: 279897 - DNA, 20 bp, Artificial Sequence
  chemically synthesized
catataacttatctcaatgg

SEQ ID NO: 279898 - DNA, 20 bp, Artificial Sequence
  chemically synthesized
aacatataacttatctcaat

SEQ ID NO: 279899 - DNA, 20 bp, Artificial Sequence
  chemically synthesized
ttgaaaactcccattgagat

SEQ ID NO: 279900 - DNA, 20 bp, Artificial Sequence
  chemically synthesized
gaacatataacttatctcaa

SEQ ID NO: 279901 - DNA, 20 bp, Artificial Sequence
  chemically synthesized
atagatacaggggtggggag

SEQ ID NO: 279902 - DNA, 20 bp, Artificial Sequence
  chemically synthesized
gtaatagatacaggggtggg

SEQ ID NO: 279903 - DNA, 20 bp, Artificial Sequence
  chemically synthesized
aggtaatagatacaggggtg

SEQ ID NO: 279904 - DNA, 20 bp, Artificial Sequence
  chemically synthesized
taggtaatagatacaggggt

SEQ ID NO: 279905 - DNA, 20 bp, Artificial Sequence
  chemically synthesized
ataggtaatagatacagggg

SEQ ID NO: 279906 - DNA, 20 bp, Artificial Sequence
  chemically synthesized
acaataggtaatagatacag

SEQ ID NO: 279907 - DNA, 20 bp, Artificial Sequence
  chemically synthesized
aacaataggtaatagataca

SEQ ID NO: 279908 - DNA, 20 bp, Artificial Sequence
  chemically synthesized
gaacaataggtaatagatac

SEQ ID NO: 279909 - DNA, 20 bp, Artificial Sequence
  chemically synthesized
tgaacaataggtaatagata

SEQ ID NO: 279910 - DNA, 20 bp, Artificial Sequence
  chemically synthesized
aagatgtgaacaataggtaa

SEQ ID NO: 279911 - DNA, 20 bp, Artificial Sequence
  chemically synthesized
aggtggaagatgtgaacaat

SEQ ID NO: 279912 - DNA, 20 bp, Artificial Sequence
  chemically synthesized
gaggtggaagatgtgaacaa

SEQ ID NO: 279913 - DNA, 20 bp, Artificial Sequence
  chemically synthesized
accaaaaactaaggaggtgg

SEQ ID NO: 279914 - DNA, 20 bp, Artificial Sequence
  chemically synthesized
gttcacatcttccacctcct

SEQ ID NO: 279915 - DNA, 20 bp, Artificial Sequence
  chemically synthesized
gttaccaaaaactaaggagg

SEQ ID NO: 279916 - DNA, 20 bp, Artificial Sequence
  chemically synthesized
tgtgttaccaaaaactaagg

SEQ ID NO: 279917 - DNA, 20 bp, Artificial Sequence
  chemically synthesized
ctgtgttaccaaaaactaag

SEQ ID NO: 279918 - DNA, 20 bp, Artificial Sequence
  chemically synthesized
tcttccacctccttagtttt

SEQ ID NO: 279919 - DNA, 20 bp, Artificial Sequence
  chemically synthesized
gactgtgttaccaaaaacta

SEQ ID NO: 279920 - DNA, 20 bp, Artificial Sequence
  chemically synthesized
agactgtgttaccaaaaact

SEQ ID NO: 279921 - DNA, 20 bp, Artificial Sequence
  chemically synthesized
ctccttagtttttggtaaca

SEQ ID NO: 279922 - DNA, 20 bp, Artificial Sequence
  chemically synthesized
gaaaactaaaagagaatgta

SEQ ID NO: 279923 - DNA, 20 bp, Artificial Sequence
  chemically synthesized
acagtctgtacattctcttt

SEQ ID NO: 279924 - DNA, 20 bp, Artificial Sequence
  chemically synthesized
gatttaaaagaaaactaaaa

SEQ ID NO: 279925 - DNA, 20 bp, Artificial Sequence
  chemically synthesized
atgatttaaaagaaaactaa

SEQ ID NO: 279926 - DNA, 20 bp, Artificial Sequence
  chemically synthesized
agttgaaagaaatgatttaa

SEQ ID NO: 279927 - DNA, 20 bp, Artificial Sequence
  chemically synthesized
tatataaacatattagttga

SEQ ID NO: 279928 - DNA, 20 bp, Artificial Sequence
  chemically synthesized
tatatcatatataaacatat

SEQ ID NO: 279929 - DNA, 20 bp, Artificial Sequence
  chemically synthesized
aaacaactacaattaaaaat

SEQ ID NO: 279930 - DNA, 20 bp, Artificial Sequence
  chemically synthesized
cattttctaatttttaattg

SEQ ID NO: 279931 - DNA, 20 bp, Artificial Sequence
  chemically synthesized
aacattgtaaaaatggaata

SEQ ID NO: 279932 - DNA, 20 bp, Artificial Sequence
  chemically synthesized
aaaagaaaacattgtaaaaa

SEQ ID NO: 279933 - DNA, 20 bp, Artificial Sequence
  chemically synthesized
atgttattgaagttataaaa

SEQ ID NO: 279934 - DNA, 20 bp, Artificial Sequence
  chemically synthesized
tatagaaataaatgttattg

SEQ ID NO: 279935 - DNA, 20 bp, Artificial Sequence
  chemically synthesized
aataaataggtaaaatatta

SEQ ID NO: 279936 - DNA, 20 bp, Artificial Sequence
  chemically synthesized
atgtatagtataaaataaat

SEQ ID NO: 279937 - DNA, 20 bp, Artificial Sequence
  chemically synthesized
gatgtatagtataaaataaa

SEQ ID NO: 279938 - DNA, 20 bp, Artificial Sequence
  chemically synthesized
tattagaattgcaagatgta

SEQ ID NO: 279939 - DNA, 20 bp, Artificial Sequence
  chemically synthesized
attccggatattagaattgc

SEQ ID NO: 279940 - DNA, 20 bp, Artificial Sequence
  chemically synthesized
catcttgcaattctaatatc

SEQ ID NO: 279941 - DNA, 20 bp, Artificial Sequence
  chemically synthesized
acttctagaattccggatat

SEQ ID NO: 279942 - DNA, 20 bp, Artificial Sequence
  chemically synthesized
aattctaatatccggaattc

SEQ ID NO: 279943 - DNA, 20 bp, Artificial Sequence
  chemically synthesized
tgagtttacttctagaattc

SEQ ID NO: 279944 - DNA, 20 bp, Artificial Sequence
  chemically synthesized
tctaatatccggaattctag

SEQ ID NO: 279945 - DNA, 20 bp, Artificial Sequence
  chemically synthesized
acgaacggtgagtttacttc

SEQ ID NO: 279946 - DNA, 20 bp, Artificial Sequence
  chemically synthesized
cagcctatacaacgaacggt

SEQ ID NO: 279947 - DNA, 20 bp, Artificial Sequence
  chemically synthesized
cagtcagcctatacaacgaa

SEQ ID NO: 279948 - DNA, 20 bp, Artificial Sequence
  chemically synthesized
taaactcaccgttcgttgta

SEQ ID NO: 279949 - DNA, 20 bp, Artificial Sequence
  chemically synthesized
aaactcaccgttcgttgtat

SEQ ID NO: 279950 - DNA, 20 bp, Artificial Sequence
  chemically synthesized
aagccctcatgaagcacagt

SEQ ID NO: 279951 - DNA, 20 bp, Artificial Sequence
  chemically synthesized
agaaaagccctcatgaagca

SEQ ID NO: 279952 - DNA, 20 bp, Artificial Sequence
  chemically synthesized
ataggctgactgtgcttcat

SEQ ID NO: 279953 - DNA, 20 bp, Artificial Sequence
  chemically synthesized
taggctgactgtgcttcatg

SEQ ID NO: 279954 - DNA, 20 bp, Artificial Sequence
  chemically synthesized
aggctgactgtgcttcatga

SEQ ID NO: 279955 - DNA, 20 bp, Artificial Sequence
  chemically synthesized
gcacaagaaaagccctcatg

SEQ ID NO: 279956 - DNA, 20 bp, Artificial Sequence
  chemically synthesized
ctcactcacacgcacaagaa

SEQ ID NO: 279957 - DNA, 20 bp, Artificial Sequence
  chemically synthesized
acacactcactcacacgcac

SEQ ID NO: 279958 - DNA, 20 bp, Artificial Sequence
  chemically synthesized
agggcttttcttgtgcgtgt

SEQ ID NO: 279959 - DNA, 20 bp, Artificial Sequence
  chemically synthesized
cttttcttgtgcgtgtgagt

SEQ ID NO: 279960 - DNA, 20 bp, Artificial Sequence
  chemically synthesized
ttgagctcatcataaacaca

SEQ ID NO: 279961 - DNA, 20 bp, Artificial Sequence
  chemically synthesized
tatgtctatgtgtttatgat

SEQ ID NO: 279962 - DNA, 20 bp, Artificial Sequence
  chemically synthesized
tatgtgtttatgatgagctc

SEQ ID NO: 279963 - DNA, 20 bp, Artificial Sequence
  chemically synthesized
gattaaactcaggggaactt

SEQ ID NO: 279964 - DNA, 20 bp, Artificial Sequence
  chemically synthesized
tgatgagctcaagttcccct

SEQ ID NO: 279965 - DNA, 20 bp, Artificial Sequence
  chemically synthesized
tcctcacagattaaactcag

SEQ ID NO: 279966 - DNA, 20 bp, Artificial Sequence
  chemically synthesized
gtcctcacagattaaactca

SEQ ID NO: 279967 - DNA, 20 bp, Artificial Sequence
  chemically synthesized
tgtcctcacagattaaactc

SEQ ID NO: 279968 - DNA, 20 bp, Artificial Sequence
  chemically synthesized
gtgtcctcacagattaaact

SEQ ID NO: 279969 - DNA, 20 bp, Artificial Sequence
  chemically synthesized
ttcccctgagtttaatctgt

SEQ ID NO: 279970 - DNA, 20 bp, Artificial Sequence
  chemically synthesized
tcccctgagtttaatctgtg

SEQ ID NO: 279971 - DNA, 20 bp, Artificial Sequence
  chemically synthesized
aagtgccctcagtgtcctca

SEQ ID NO: 279972 - DNA, 20 bp, Artificial Sequence
  chemically synthesized
gtttaatctgtgaggacact

SEQ ID NO: 279973 - DNA, 20 bp, Artificial Sequence
  chemically synthesized
tttaatctgtgaggacactg

SEQ ID NO: 279974 - DNA, 20 bp, Artificial Sequence
  chemically synthesized
ttaatctgtgaggacactga

SEQ ID NO: 279975 - DNA, 20 bp, Artificial Sequence
  chemically synthesized
tttaccatgaaaagtgccct

SEQ ID NO: 279976 - DNA, 20 bp, Artificial Sequence
  chemically synthesized
gacactgagggcacttttca

SEQ ID NO: 279977 - DNA, 20 bp, Artificial Sequence
  chemically synthesized
tgcaaattgtttaccatgaa

SEQ ID NO: 279978 - DNA, 20 bp, Artificial Sequence
  chemically synthesized
agcgtcctagcattagttag

SEQ ID NO: 279979 - DNA, 20 bp, Artificial Sequence
  chemically synthesized
aggagcgtcctagcattagt

SEQ ID NO: 279980 - DNA, 20 bp, Artificial Sequence
  chemically synthesized
catttgcttctaactaatgc

SEQ ID NO: 279981 - DNA, 20 bp, Artificial Sequence
  chemically synthesized
atttgcttctaactaatgct

SEQ ID NO: 279982 - DNA, 20 bp, Artificial Sequence
  chemically synthesized
ggttaggagcgtcctagcat

SEQ ID NO: 279983 - DNA, 20 bp, Artificial Sequence
  chemically synthesized
gcaccaggttaggagcgtcc

SEQ ID NO: 279984 - DNA, 20 bp, Artificial Sequence
  chemically synthesized
atgctaggacgctcctaacc

SEQ ID NO: 279985 - DNA, 20 bp, Artificial Sequence
  chemically synthesized
tcagggtagcaccaggttag

SEQ ID NO: 279986 - DNA, 20 bp, Artificial Sequence
  chemically synthesized
agtcagggtagcaccaggtt

SEQ ID NO: 279987 - DNA, 20 bp, Artificial Sequence
  chemically synthesized
aagtcagggtagcaccaggt

SEQ ID NO: 279988 - DNA, 20 bp, Artificial Sequence
  chemically synthesized
gattaagtcagggtagcacc

SEQ ID NO: 279989 - DNA, 20 bp, Artificial Sequence
  chemically synthesized
tgattaagtcagggtagcac

SEQ ID NO: 279990 - DNA, 20 bp, Artificial Sequence
  chemically synthesized
aacaagtgattaagtcaggg

SEQ ID NO: 279991 - DNA, 20 bp, Artificial Sequence
  chemically synthesized
ccaaacaagtgattaagtca

SEQ ID NO: 279992 - DNA, 20 bp, Artificial Sequence
  chemically synthesized
tccaaacaagtgattaagtc

SEQ ID NO: 279993 - DNA, 20 bp, Artificial Sequence
  chemically synthesized
atccaaacaagtgattaagt

SEQ ID NO: 279994 - DNA, 20 bp, Artificial Sequence
  chemically synthesized
aaatatccaaacaagtgatt

SEQ ID NO: 279995 - DNA, 20 bp, Artificial Sequence
  chemically synthesized
ccctgacttaatcacttgtt

SEQ ID NO: 279996 - DNA, 20 bp, Artificial Sequence
  chemically synthesized
gggtaaagaaatatccaaac

SEQ ID NO: 279997 - DNA, 20 bp, Artificial Sequence
  chemically synthesized
gtatattatcacaaagggta

SEQ ID NO: 279998 - DNA, 20 bp, Artificial Sequence
  chemically synthesized
tgagtgtatattatcacaaa

SEQ ID NO: 279999 - DNA, 20 bp, Artificial Sequence
  chemically synthesized
ttgagtgtatattatcacaa

SEQ ID NO: 280000 - DNA, 20 bp, Artificial Sequence
  chemically synthesized
cttgagtgtatattatcaca

SEQ ID NO: 280001 - DNA, 20 bp, Artificial Sequence
  chemically synthesized
ctttgtgataatatacactc

SEQ ID NO: 280002 - DNA, 20 bp, Artificial Sequence
  chemically synthesized
ttgtgataatatacactcaa

SEQ ID NO: 280003 - DNA, 20 bp, Artificial Sequence
  chemically synthesized
ttgtaaggtgaggaactctt

SEQ ID NO: 280004 - DNA, 20 bp, Artificial Sequence
  chemically synthesized
tggcctattcttgtaaggtg

SEQ ID NO: 280005 - DNA, 20 bp, Artificial Sequence
  chemically synthesized
tcaagagttcctcaccttac

SEQ ID NO: 280006 - DNA, 20 bp, Artificial Sequence
  chemically synthesized
ttggcctattcttgtaaggt

SEQ ID NO: 280007 - DNA, 20 bp, Artificial Sequence
  chemically synthesized
tgtgttggcctattcttgta

SEQ ID NO: 280008 - DNA, 20 bp, Artificial Sequence
  chemically synthesized
agttcctcaccttacaagaa

SEQ ID NO: 280009 - DNA, 20 bp, Artificial Sequence
  chemically synthesized
gtgtgttggcctattcttgt

SEQ ID NO: 280010 - DNA, 20 bp, Artificial Sequence
  chemically synthesized
gttcctcaccttacaagaat

SEQ ID NO: 280011 - DNA, 20 bp, Artificial Sequence
  chemically synthesized
tgtcacctgaaaatgtgtgt

SEQ ID NO: 280012 - DNA, 20 bp, Artificial Sequence
  chemically synthesized
aataggccaacacacatttt

SEQ ID NO: 280013 - DNA, 20 bp, Artificial Sequence
  chemically synthesized
ataggccaacacacattttc

SEQ ID NO: 280014 - DNA, 20 bp, Artificial Sequence
  chemically synthesized
tcactgtgagtgcaaagtaa

SEQ ID NO: 280015 - DNA, 20 bp, Artificial Sequence
  chemically synthesized
gtcttctcactgtgagtgca

SEQ ID NO: 280016 - DNA, 20 bp, Artificial Sequence
  chemically synthesized
attctattactttgcactca

SEQ ID NO: 280017 - DNA, 20 bp, Artificial Sequence
  chemically synthesized
tattactttgcactcacagt

SEQ ID NO: 280018 - DNA, 20 bp, Artificial Sequence
  chemically synthesized
gacatctgtcttctcactgt

SEQ ID NO: 280019 - DNA, 20 bp, Artificial Sequence
  chemically synthesized
tactttgcactcacagtgag

SEQ ID NO: 280020 - DNA, 20 bp, Artificial Sequence
  chemically synthesized
ttgcactcacagtgagaaga

SEQ ID NO: 280021 - DNA, 20 bp, Artificial Sequence
  chemically synthesized
gcagagagaacaaacataaa

SEQ ID NO: 280022 - DNA, 20 bp, Artificial Sequence
  chemically synthesized
ttttatgtttgttctctctg

SEQ ID NO: 280023 - DNA, 20 bp, Artificial Sequence
  chemically synthesized
gagagaattctatctgcaga

SEQ ID NO: 280024 - DNA, 20 bp, Artificial Sequence
  chemically synthesized
atgtttgttctctctgcaga

SEQ ID NO: 280025 - DNA, 20 bp, Artificial Sequence
  chemically synthesized
cagagagaattctatctgca

SEQ ID NO: 280026 - DNA, 20 bp, Artificial Sequence
  chemically synthesized
ggcagagagaattctatctg

SEQ ID NO: 280027 - DNA, 20 bp, Artificial Sequence
  chemically synthesized
tcagtaagataatgggcaga

SEQ ID NO: 280028 - DNA, 20 bp, Artificial Sequence
  chemically synthesized
tatcagtaagataatgggca

SEQ ID NO: 280029 - DNA, 20 bp, Artificial Sequence
  chemically synthesized
tctatcagtaagataatggg

SEQ ID NO: 280030 - DNA, 20 bp, Artificial Sequence
  chemically synthesized
ggttctatcagtaagataat

SEQ ID NO: 280031 - DNA, 20 bp, Artificial Sequence
  chemically synthesized
gggttctatcagtaagataa

SEQ ID NO: 280032 - DNA, 20 bp, Artificial Sequence
  chemically synthesized
tctgcccattatcttactga

SEQ ID NO: 280033 - DNA, 20 bp, Artificial Sequence
  chemically synthesized
aaaactggggttctatcagt

SEQ ID NO: 280034 - DNA, 20 bp, Artificial Sequence
  chemically synthesized
acataaaactggggttctat

SEQ ID NO: 280035 - DNA, 20 bp, Artificial Sequence
  chemically synthesized
ttatcttactgatagaaccc

SEQ ID NO: 280036 - DNA, 20 bp, Artificial Sequence
  chemically synthesized
acagattccacataaaactg

SEQ ID NO: 280037 - DNA, 20 bp, Artificial Sequence
  chemically synthesized
cacagattccacataaaact

SEQ ID NO: 280038 - DNA, 20 bp, Artificial Sequence
  chemically synthesized
acacagattccacataaaac

SEQ ID NO: 280039 - DNA, 20 bp, Artificial Sequence
  chemically synthesized
gatagaaccccagttttatg

SEQ ID NO: 280040 - DNA, 20 bp, Artificial Sequence
  chemically synthesized
ttttatgtggaatctgtgtt

SEQ ID NO: 280041 - DNA, 20 bp, Artificial Sequence
  chemically synthesized
gaaaatggtggagctaaaca

SEQ ID NO: 280042 - DNA, 20 bp, Artificial Sequence
  chemically synthesized
tctggctcacgaaaatggtg

SEQ ID NO: 280043 - DNA, 20 bp, Artificial Sequence
  chemically synthesized
cctctggctcacgaaaatgg

SEQ ID NO: 280044 - DNA, 20 bp, Artificial Sequence
  chemically synthesized
tttagctccaccattttcgt

SEQ ID NO: 280045 - DNA, 20 bp, Artificial Sequence
  chemically synthesized
gatcctctggctcacgaaaa

SEQ ID NO: 280046 - DNA, 20 bp, Artificial Sequence
  chemically synthesized
gctccaccattttcgtgagc

SEQ ID NO: 280047 - DNA, 20 bp, Artificial Sequence
  chemically synthesized
tccaccattttcgtgagcca

SEQ ID NO: 280048 - DNA, 20 bp, Artificial Sequence
  chemically synthesized
ccaccattttcgtgagccag

SEQ ID NO: 280049 - DNA, 20 bp, Artificial Sequence
  chemically synthesized
ggaaaagaaatatgatcctc

SEQ ID NO: 280050 - DNA, 20 bp, Artificial Sequence
  chemically synthesized
aattaagtcatttgatggaa

SEQ ID NO: 280051 - DNA, 20 bp, Artificial Sequence
  chemically synthesized
aggtgaattaagtcatttga

SEQ ID NO: 280052 - DNA, 20 bp, Artificial Sequence
  chemically synthesized
accccaattttaggtgaatt

SEQ ID NO: 280053 - DNA, 20 bp, Artificial Sequence
  chemically synthesized
tgacttaattcacctaaaat

SEQ ID NO: 280054 - DNA, 20 bp, Artificial Sequence
  chemically synthesized
gacttaattcacctaaaatt

SEQ ID NO: 280055 - DNA, 20 bp, Artificial Sequence
  chemically synthesized
acttaattcacctaaaattg

SEQ ID NO: 280056 - DNA, 20 bp, Artificial Sequence
  chemically synthesized
agactgggaaccccaatttt

SEQ ID NO: 280057 - DNA, 20 bp, Artificial Sequence
  chemically synthesized
aagactgggaaccccaattt

SEQ ID NO: 280058 - DNA, 20 bp, Artificial Sequence
  chemically synthesized
tcacctaaaattggggttcc

SEQ ID NO: 280059 - DNA, 20 bp, Artificial Sequence
  chemically synthesized
aaaattggggttcccagtct

SEQ ID NO: 280060 - DNA, 20 bp, Artificial Sequence
  chemically synthesized
tggagataaaagctaagact

SEQ ID NO: 280061 - DNA, 20 bp, Artificial Sequence
  chemically synthesized
gtggagataaaagctaagac

SEQ ID NO: 280062 - DNA, 20 bp, Artificial Sequence
  chemically synthesized
gtatggtggagataaaagct

SEQ ID NO: 280063 - DNA, 20 bp, Artificial Sequence
  chemically synthesized
catttgtatggtggagataa

SEQ ID NO: 280064 - DNA, 20 bp, Artificial Sequence
  chemically synthesized
ccactgacatttgtatggtg

SEQ ID NO: 280065 - DNA, 20 bp, Artificial Sequence
  chemically synthesized
gaccactgacatttgtatgg

SEQ ID NO: 280066 - DNA, 20 bp, Artificial Sequence
  chemically synthesized
tatgaccactgacatttgta

SEQ ID NO: 280067 - DNA, 20 bp, Artificial Sequence
  chemically synthesized
tatctccaccatacaaatgt

SEQ ID NO: 280068 - DNA, 20 bp, Artificial Sequence
  chemically synthesized
ctccaccatacaaatgtcag

SEQ ID NO: 280069 - DNA, 20 bp, Artificial Sequence
  chemically synthesized
catacaaatgtcagtggtca

SEQ ID NO: 280070 - DNA, 20 bp, Artificial Sequence
  chemically synthesized
atacaaatgtcagtggtcat

SEQ ID NO: 280071 - DNA, 20 bp, Artificial Sequence
  chemically synthesized
cagtggtcataggcatgtta

SEQ ID NO: 280072 - DNA, 20 bp, Artificial Sequence
  chemically synthesized
ggcatgttacggcatgactt

SEQ ID NO: 280073 - DNA, 20 bp, Artificial Sequence
  chemically synthesized
aaaaaaatcagatgaaactg

SEQ ID NO: 280074 - DNA, 20 bp, Artificial Sequence
  chemically synthesized
ttaaaggctaggaaaaaaat

SEQ ID NO: 280075 - DNA, 20 bp, Artificial Sequence
  chemically synthesized
gtttcatctgatttttttcc

SEQ ID NO: 280076 - DNA, 20 bp, Artificial Sequence
  chemically synthesized
taagtaaacctttaaaggct

SEQ ID NO: 280077 - DNA, 20 bp, Artificial Sequence
  chemically synthesized
gatttttttcctagccttta

SEQ ID NO: 280078 - DNA, 20 bp, Artificial Sequence
  chemically synthesized
ataagtaaacctttaaaggc

SEQ ID NO: 280079 - DNA, 20 bp, Artificial Sequence
  chemically synthesized
atttttttcctagcctttaa

SEQ ID NO: 280080 - DNA, 20 bp, Artificial Sequence
  chemically synthesized
aagtataagtaaacctttaa

SEQ ID NO: 280081 - DNA, 20 bp, Artificial Sequence
  chemically synthesized
gaagtataagtaaaccttta

SEQ ID NO: 280082 - DNA, 20 bp, Artificial Sequence
  chemically synthesized
tgttgctttcaaagaagtat

SEQ ID NO: 280083 - DNA, 20 bp, Artificial Sequence
  chemically synthesized
gtttacttatacttctttga

SEQ ID NO: 280084 - DNA, 20 bp, Artificial Sequence
  chemically synthesized
attttatgttgctttcaaag

SEQ ID NO: 280085 - DNA, 20 bp, Artificial Sequence
  chemically synthesized
tgtattttatgttgctttca

SEQ ID NO: 280086 - DNA, 20 bp, Artificial Sequence
  chemically synthesized
gcaacataaaatacaactac

SEQ ID NO: 280087 - DNA, 20 bp, Artificial Sequence
  chemically synthesized
ggatgctggaaaatgtctag

SEQ ID NO: 280088 - DNA, 20 bp, Artificial Sequence
  chemically synthesized
ctaggatgctggaaaatgtc

SEQ ID NO: 280089 - DNA, 20 bp, Artificial Sequence
  chemically synthesized
tacaactactagacattttc

SEQ ID NO: 280090 - DNA, 20 bp, Artificial Sequence
  chemically synthesized
ctagacattttccagcatcc

SEQ ID NO: 280091 - DNA, 20 bp, Artificial Sequence
  chemically synthesized
tctggaaagcactaggatgc

SEQ ID NO: 280092 - DNA, 20 bp, Artificial Sequence
  chemically synthesized
aatgccctctggaaagcact

SEQ ID NO: 280093 - DNA, 20 bp, Artificial Sequence
  chemically synthesized
taatgccctctggaaagcac

SEQ ID NO: 280094 - DNA, 20 bp, Artificial Sequence
  chemically synthesized
tccagcatcctagtgctttc

SEQ ID NO: 280095 - DNA, 20 bp, Artificial Sequence
  chemically synthesized
cagcatcctagtgctttcca

SEQ ID NO: 280096 - DNA, 20 bp, Artificial Sequence
  chemically synthesized
agcatcctagtgctttccag

SEQ ID NO: 280097 - DNA, 20 bp, Artificial Sequence
  chemically synthesized
gcatcctagtgctttccaga

SEQ ID NO: 280098 - DNA, 20 bp, Artificial Sequence
  chemically synthesized
cttctgtaatgccctctgga

SEQ ID NO: 280099 - DNA, 20 bp, Artificial Sequence
  chemically synthesized
aagtcttctgtaatgccctc

SEQ ID NO: 280100 - DNA, 20 bp, Artificial Sequence
  chemically synthesized
gtgctttccagagggcatta

SEQ ID NO: 280101 - DNA, 20 bp, Artificial Sequence
  chemically synthesized
ctttccagagggcattacag

SEQ ID NO: 280102 - DNA, 20 bp, Artificial Sequence
  chemically synthesized
agagggcattacagaagact

SEQ ID NO: 280103 - DNA, 20 bp, Artificial Sequence
  chemically synthesized
tctcaagggctaggacagct

SEQ ID NO: 280104 - DNA, 20 bp, Artificial Sequence
  chemically synthesized
tacagaagacttagctgtcc

SEQ ID NO: 280105 - DNA, 20 bp, Artificial Sequence
  chemically synthesized
tctgttctcaagggctagga

SEQ ID NO: 280106 - DNA, 20 bp, Artificial Sequence
  chemically synthesized
acttagctgtcctagccctt

SEQ ID NO: 280107 - DNA, 20 bp, Artificial Sequence
  chemically synthesized
gacttctgttctcaagggct

SEQ ID NO: 280108 - DNA, 20 bp, Artificial Sequence
  chemically synthesized
tgacttctgttctcaagggc

SEQ ID NO: 280109 - DNA, 20 bp, Artificial Sequence
  chemically synthesized
gctgtcctagcccttgagaa

SEQ ID NO: 280110 - DNA, 20 bp, Artificial Sequence
  chemically synthesized
gggctgacttctgttctcaa

SEQ ID NO: 280111 - DNA, 20 bp, Artificial Sequence
  chemically synthesized
agggctgacttctgttctca

SEQ ID NO: 280112 - DNA, 20 bp, Artificial Sequence
  chemically synthesized
tagggctgacttctgttctc

SEQ ID NO: 280113 - DNA, 20 bp, Artificial Sequence
  chemically synthesized
gtcctagcccttgagaacag

SEQ ID NO: 280114 - DNA, 20 bp, Artificial Sequence
  chemically synthesized
tagcccttgagaacagaagt

SEQ ID NO: 280115 - DNA, 20 bp, Artificial Sequence
  chemically synthesized
acttcacagttgttgtgata

SEQ ID NO: 280116 - DNA, 20 bp, Artificial Sequence
  chemically synthesized
tacttcacagttgttgtgat

SEQ ID NO: 280117 - DNA, 20 bp, Artificial Sequence
  chemically synthesized
ttacttcacagttgttgtga

SEQ ID NO: 280118 - DNA, 20 bp, Artificial Sequence
  chemically synthesized
gccctatcacaacaactgtg

SEQ ID NO: 280119 - DNA, 20 bp, Artificial Sequence
  chemically synthesized
tatcacaacaactgtgaagt

SEQ ID NO: 280120 - DNA, 20 bp, Artificial Sequence
  chemically synthesized
gatttgattagcttacttca

SEQ ID NO: 280121 - DNA, 20 bp, Artificial Sequence
  chemically synthesized
ctttatgaaatagatttgat

SEQ ID NO: 280122 - DNA, 20 bp, Artificial Sequence
  chemically synthesized
ctaatcaaatctatttcata

SEQ ID NO: 280123 - DNA, 20 bp, Artificial Sequence
  chemically synthesized
cccacatttgctttatgaaa

SEQ ID NO: 280124 - DNA, 20 bp, Artificial Sequence
  chemically synthesized
tctatttcataaagcaaatg

SEQ ID NO: 280125 - DNA, 20 bp, Artificial Sequence
  chemically synthesized
ctatttcataaagcaaatgt

SEQ ID NO: 280126 - DNA, 20 bp, Artificial Sequence
  chemically synthesized
ataaagcaaatgtgggattt

SEQ ID NO: 280127 - DNA, 20 bp, Artificial Sequence
  chemically synthesized
aagtttgatgttgcttctaa

SEQ ID NO: 280128 - DNA, 20 bp, Artificial Sequence
  chemically synthesized
tccttttgctaagccgttag

SEQ ID NO: 280129 - DNA, 20 bp, Artificial Sequence
  chemically synthesized
tgatgttgcttctaacggct

SEQ ID NO: 280130 - DNA, 20 bp, Artificial Sequence
  chemically synthesized
cagtccttttgctaagccgt

SEQ ID NO: 280131 - DNA, 20 bp, Artificial Sequence
  chemically synthesized
tgcttctaacggcttagcaa

SEQ ID NO: 280132 - DNA, 20 bp, Artificial Sequence
  chemically synthesized
gcttctaacggcttagcaaa

SEQ ID NO: 280133 - DNA, 20 bp, Artificial Sequence
  chemically synthesized
tttacgtcagtccttttgct

SEQ ID NO: 280134 - DNA, 20 bp, Artificial Sequence
  chemically synthesized
ttttgagcacagttttacgt

SEQ ID NO: 280135 - DNA, 20 bp, Artificial Sequence
  chemically synthesized
aagccattactttttgagca

SEQ ID NO: 280136 - DNA, 20 bp, Artificial Sequence
  chemically synthesized
gacgtaaaactgtgctcaaa

SEQ ID NO: 280137 - DNA, 20 bp, Artificial Sequence
  chemically synthesized
agtaaaagccattacttttt

SEQ ID NO: 280138 - DNA, 20 bp, Artificial Sequence
  chemically synthesized
aaactgtgctcaaaaagtaa

SEQ ID NO: 280139 - DNA, 20 bp, Artificial Sequence
  chemically synthesized
tctgtctataataatagtaa

SEQ ID NO: 280140 - DNA, 20 bp, Artificial Sequence
  chemically synthesized
aatggcttttactattatta

SEQ ID NO: 280141 - DNA, 20 bp, Artificial Sequence
  chemically synthesized
acaatatctgtctataataa

SEQ ID NO: 280142 - DNA, 20 bp, Artificial Sequence
  chemically synthesized
gcttttactattattataga

SEQ ID NO: 280143 - DNA, 20 bp, Artificial Sequence
  chemically synthesized
taatttgtcaatatgttttg

SEQ ID NO: 280144 - DNA, 20 bp, Artificial Sequence
  chemically synthesized
aacatattgacaaattaata

SEQ ID NO: 280145 - DNA, 20 bp, Artificial Sequence
  chemically synthesized
aagtaatctaggaaaataag

SEQ ID NO: 280146 - DNA, 20 bp, Artificial Sequence
  chemically synthesized
taatatgccacttattttcc

SEQ ID NO: 280147 - DNA, 20 bp, Artificial Sequence
  chemically synthesized
ataaagtaatctaggaaaat

SEQ ID NO: 280148 - DNA, 20 bp, Artificial Sequence
  chemically synthesized
ggaagactataaagtaatct

SEQ ID NO: 280149 - DNA, 20 bp, Artificial Sequence
  chemically synthesized
aggaagactataaagtaatc

SEQ ID NO: 280150 - DNA, 20 bp, Artificial Sequence
  chemically synthesized
tattttcctagattacttta

SEQ ID NO: 280151 - DNA, 20 bp, Artificial Sequence
  chemically synthesized
ttgcttgaaggaagactata

SEQ ID NO: 280152 - DNA, 20 bp, Artificial Sequence
  chemically synthesized
ttactttatagtcttccttc

SEQ ID NO: 280153 - DNA, 20 bp, Artificial Sequence
  chemically synthesized
ggaagaacattgcttgaagg

SEQ ID NO: 280154 - DNA, 20 bp, Artificial Sequence
  chemically synthesized
aacggaagaacattgcttga

SEQ ID NO: 280155 - DNA, 20 bp, Artificial Sequence
  chemically synthesized
gaacggaagaacattgcttg

SEQ ID NO: 280156 - DNA, 20 bp, Artificial Sequence
  chemically synthesized
caagcaatgttcttccgttc

SEQ ID NO: 280157 - DNA, 20 bp, Artificial Sequence
  chemically synthesized
gcatagatagaccagaacgg

SEQ ID NO: 280158 - DNA, 20 bp, Artificial Sequence
  chemically synthesized
ttagcatagatagaccagaa

SEQ ID NO: 280159 - DNA, 20 bp, Artificial Sequence
  chemically synthesized
ctaccttagcatagatagac

SEQ ID NO: 280160 - DNA, 20 bp, Artificial Sequence
  chemically synthesized
cacatctaccttagcataga

SEQ ID NO: 280161 - DNA, 20 bp, Artificial Sequence
  chemically synthesized
cgttctggtctatctatgct

SEQ ID NO: 280162 - DNA, 20 bp, Artificial Sequence
  chemically synthesized
gttctggtctatctatgcta

SEQ ID NO: 280163 - DNA, 20 bp, Artificial Sequence
  chemically synthesized
gtgtcacatctaccttagca

SEQ ID NO: 280164 - DNA, 20 bp, Artificial Sequence
  chemically synthesized
ctggtctatctatgctaagg

SEQ ID NO: 280165 - DNA, 20 bp, Artificial Sequence
  chemically synthesized
cctcagtgtcacatctacct

SEQ ID NO: 280166 - DNA, 20 bp, Artificial Sequence
  chemically synthesized
gctaaggtagatgtgacact

SEQ ID NO: 280167 - DNA, 20 bp, Artificial Sequence
  chemically synthesized
ctaaggtagatgtgacactg

SEQ ID NO: 280168 - DNA, 20 bp, Artificial Sequence
  chemically synthesized
taaggtagatgtgacactga

SEQ ID NO: 280169 - DNA, 20 bp, Artificial Sequence
  chemically synthesized
atgactttgaatttttccct

SEQ ID NO: 280170 - DNA, 20 bp, Artificial Sequence
  chemically synthesized
gacactgagggaaaaattca

SEQ ID NO: 280171 - DNA, 20 bp, Artificial Sequence
  chemically synthesized
aaattcaaagtcataattac

SEQ ID NO: 280172 - DNA, 20 bp, Artificial Sequence
  chemically synthesized
aattcaaagtcataattacc

SEQ ID NO: 280173 - DNA, 20 bp, Artificial Sequence
  chemically synthesized
agggccgtattaatttttcc

SEQ ID NO: 280174 - DNA, 20 bp, Artificial Sequence
  chemically synthesized
attaccaggaaaaattaata

SEQ ID NO: 280175 - DNA, 20 bp, Artificial Sequence
  chemically synthesized
aaattaatacggccctctct

SEQ ID NO: 280176 - DNA, 20 bp, Artificial Sequence
  chemically synthesized
atttatgatagactcagaga

SEQ ID NO: 280177 - DNA, 20 bp, Artificial Sequence
  chemically synthesized
catttatgatagactcagag

SEQ ID NO: 280178 - DNA, 20 bp, Artificial Sequence
  chemically synthesized
acatttatgatagactcaga

SEQ ID NO: 280179 - DNA, 20 bp, Artificial Sequence
  chemically synthesized
taacatttatgatagactca

SEQ ID NO: 280180 - DNA, 20 bp, Artificial Sequence
  chemically synthesized
agtaacatttatgatagact

SEQ ID NO: 280181 - DNA, 20 bp, Artificial Sequence
  chemically synthesized
tgtaatagtaacatttatga

SEQ ID NO: 280182 - DNA, 20 bp, Artificial Sequence
  chemically synthesized
tatcataaatgttactatta

SEQ ID NO: 280183 - DNA, 20 bp, Artificial Sequence
  chemically synthesized
cataaatgttactattacag

SEQ ID NO: 280184 - DNA, 20 bp, Artificial Sequence
  chemically synthesized
attggttaattcttctgtaa

SEQ ID NO: 280185 - DNA, 20 bp, Artificial Sequence
  chemically synthesized
tacagaagaattaaccaatt

SEQ ID NO: 280186 - DNA, 20 bp, Artificial Sequence
  chemically synthesized
gaaagggacaaaatctaaat

SEQ ID NO: 280187 - DNA, 20 bp, Artificial Sequence
  chemically synthesized
aatttagattttgtcccttt

SEQ ID NO: 280188 - DNA, 20 bp, Artificial Sequence
  chemically synthesized
aaatagcaaatttactgaaa

SEQ ID NO: 280189 - DNA, 20 bp, Artificial Sequence
  chemically synthesized
gaaatagcaaatttactgaa

SEQ ID NO: 280190 - DNA, 20 bp, Artificial Sequence
  chemically synthesized
tgaaatagcaaatttactga

SEQ ID NO: 280191 - DNA, 20 bp, Artificial Sequence
  chemically synthesized
ttgttatgcctgacatgaaa

SEQ ID NO: 280192 - DNA, 20 bp, Artificial Sequence
  chemically synthesized
gtaaatttgctatttcatgt

SEQ ID NO: 280193 - DNA, 20 bp, Artificial Sequence
  chemically synthesized
taaatttgctatttcatgtc

SEQ ID NO: 280194 - DNA, 20 bp, Artificial Sequence
  chemically synthesized
atgtcaggcataacaactta

SEQ ID NO: 280195 - DNA, 20 bp, Artificial Sequence
  chemically synthesized
tccctttcaaagatgtctgt

SEQ ID NO: 280196 - DNA, 20 bp, Artificial Sequence
  chemically synthesized
caacttacagacatctttga

SEQ ID NO: 280197 - DNA, 20 bp, Artificial Sequence
  chemically synthesized
aacttacagacatctttgaa

SEQ ID NO: 280198 - DNA, 20 bp, Artificial Sequence
  chemically synthesized
acttacagacatctttgaaa

SEQ ID NO: 280199 - DNA, 20 bp, Artificial Sequence
  chemically synthesized
ccgtatttcagtccctttca

SEQ ID NO: 280200 - DNA, 20 bp, Artificial Sequence
  chemically synthesized
ctttgaaagggactgaaata

SEQ ID NO: 280201 - DNA, 20 bp, Artificial Sequence
  chemically synthesized
tttgaaagggactgaaatac

SEQ ID NO: 280202 - DNA, 20 bp, Artificial Sequence
  chemically synthesized
gcttattaatgcccgtattt

SEQ ID NO: 280203 - DNA, 20 bp, Artificial Sequence
  chemically synthesized
actgaaatacgggcattaat

SEQ ID NO: 280204 - DNA, 20 bp, Artificial Sequence
  chemically synthesized
cgggcattaataagccacga

SEQ ID NO: 280205 - DNA, 20 bp, Artificial Sequence
  chemically synthesized
ggcattaataagccacgaaa

SEQ ID NO: 280206 - DNA, 20 bp, Artificial Sequence
  chemically synthesized
gcattaataagccacgaaag

SEQ ID NO: 280207 - DNA, 20 bp, Artificial Sequence
  chemically synthesized
tgattatttcacctctttcg

SEQ ID NO: 280208 - DNA, 20 bp, Artificial Sequence
  chemically synthesized
aggtgaaataatcactcatc

SEQ ID NO: 280209 - DNA, 20 bp, Artificial Sequence
  chemically synthesized
gtgaaataatcactcatcaa

SEQ ID NO: 280210 - DNA, 20 bp, Artificial Sequence
  chemically synthesized
cctttaccacttctcttgat

SEQ ID NO: 280211 - DNA, 20 bp, Artificial Sequence
  chemically synthesized
aaataatcactcatcaagag

SEQ ID NO: 280212 - DNA, 20 bp, Artificial Sequence
  chemically synthesized
taatcactcatcaagagaag

SEQ ID NO: 280213 - DNA, 20 bp, Artificial Sequence
  chemically synthesized
actcatcaagagaagtggta

SEQ ID NO: 280214 - DNA, 20 bp, Artificial Sequence
  chemically synthesized
ctcatcaagagaagtggtaa

SEQ ID NO: 280215 - DNA, 20 bp, Artificial Sequence
  chemically synthesized
aagagaagtggtaaaggctt

SEQ ID NO: 280216 - DNA, 20 bp, Artificial Sequence
  chemically synthesized
gtcacacattgagaagtcca

SEQ ID NO: 280217 - DNA, 20 bp, Artificial Sequence
  chemically synthesized
tattaaagtcacacattgag

SEQ ID NO: 280218 - DNA, 20 bp, Artificial Sequence
  chemically synthesized
aaatattaaagtcacacatt

SEQ ID NO: 280219 - DNA, 20 bp, Artificial Sequence
  chemically synthesized
atttagagtcttaaatatta

SEQ ID NO: 280220 - DNA, 20 bp, Artificial Sequence
  chemically synthesized
aatgtgtgactttaatattt

SEQ ID NO: 280221 - DNA, 20 bp, Artificial Sequence
  chemically synthesized
actaattaaaataaaattta

SEQ ID NO: 280222 - DNA, 20 bp, Artificial Sequence
  chemically synthesized
tgactaattaaaataaaatt

SEQ ID NO: 280223 - DNA, 20 bp, Artificial Sequence
  chemically synthesized
actctaaattttattttaat

SEQ ID NO: 280224 - DNA, 20 bp, Artificial Sequence
  chemically synthesized
taaattttattttaattagt

SEQ ID NO: 280225 - DNA, 20 bp, Artificial Sequence
  chemically synthesized
acatggccttaaaagtatta

SEQ ID NO: 280226 - DNA, 20 bp, Artificial Sequence
  chemically synthesized
tagtcagccataatactttt

SEQ ID NO: 280227 - DNA, 20 bp, Artificial Sequence
  chemically synthesized
agtcagccataatactttta

SEQ ID NO: 280228 - DNA, 20 bp, Artificial Sequence
  chemically synthesized
agcttaaaacatggccttaa

SEQ ID NO: 280229 - DNA, 20 bp, Artificial Sequence
  chemically synthesized
tacttttaaggccatgtttt

SEQ ID NO: 280230 - DNA, 20 bp, Artificial Sequence
  chemically synthesized
tttaaggaaagcttaaaaca

SEQ ID NO: 280231 - DNA, 20 bp, Artificial Sequence
  chemically synthesized
agtttccccgtttttaagga

SEQ ID NO: 280232 - DNA, 20 bp, Artificial Sequence
  chemically synthesized
ttttaagctttccttaaaaa

SEQ ID NO: 280233 - DNA, 20 bp, Artificial Sequence
  chemically synthesized
tttaagctttccttaaaaac

SEQ ID NO: 280234 - DNA, 20 bp, Artificial Sequence
  chemically synthesized
aacgagtttccccgttttta

SEQ ID NO: 280235 - DNA, 20 bp, Artificial Sequence
  chemically synthesized
ttaagctttccttaaaaacg

SEQ ID NO: 280236 - DNA, 20 bp, Artificial Sequence
  chemically synthesized
taacgagtttccccgttttt

SEQ ID NO: 280237 - DNA, 20 bp, Artificial Sequence
  chemically synthesized
aagtgaatatggcaattaac

SEQ ID NO: 280238 - DNA, 20 bp, Artificial Sequence
  chemically synthesized
actctgctaataagtgaata

SEQ ID NO: 280239 - DNA, 20 bp, Artificial Sequence
  chemically synthesized
taattgccatattcacttat

SEQ ID NO: 280240 - DNA, 20 bp, Artificial Sequence
  chemically synthesized
ttgccatattcacttattag

SEQ ID NO: 280241 - DNA, 20 bp, Artificial Sequence
  chemically synthesized
gccatattcacttattagca

SEQ ID NO: 280242 - DNA, 20 bp, Artificial Sequence
  chemically synthesized
aaaataaaaactctgctaat

SEQ ID NO: 280243 - DNA, 20 bp, Artificial Sequence
  chemically synthesized
ttttatttttaatatatgaa

SEQ ID NO: 280244 - DNA, 20 bp, Artificial Sequence
  chemically synthesized
tttatttttaatatatgaaa

SEQ ID NO: 280245 - DNA, 20 bp, Artificial Sequence
  chemically synthesized
ttatttttaatatatgaaaa

SEQ ID NO: 280246 - DNA, 20 bp, Artificial Sequence
  chemically synthesized
ttaatatatgaaaagggtca

SEQ ID NO: 280247 - DNA, 20 bp, Artificial Sequence
  chemically synthesized
aatatatgaaaagggtcaca

SEQ ID NO: 280248 - DNA, 20 bp, Artificial Sequence
  chemically synthesized
atgaaaagggtcacagagat

SEQ ID NO: 280249 - DNA, 20 bp, Artificial Sequence
  chemically synthesized
gaaaagggtcacagagattg

SEQ ID NO: 280250 - DNA, 20 bp, Artificial Sequence
  chemically synthesized
aaaagggtcacagagattgg

SEQ ID NO: 280251 - DNA, 20 bp, Artificial Sequence
  chemically synthesized
agggtcacagagattggagg

SEQ ID NO: 280252 - DNA, 20 bp, Artificial Sequence
  chemically synthesized
cacagagattggaggtagtg

SEQ ID NO: 280253 - DNA, 20 bp, Artificial Sequence
  chemically synthesized
ttggaggtagtgtagccaaa

SEQ ID NO: 280254 - DNA, 20 bp, Artificial Sequence
  chemically synthesized
agcctaggcacgtgaccatt

SEQ ID NO: 280255 - DNA, 20 bp, Artificial Sequence
  chemically synthesized
tagccaaatggtcacgtgcc

SEQ ID NO: 280256 - DNA, 20 bp, Artificial Sequence
  chemically synthesized
agccaaatggtcacgtgcct

SEQ ID NO: 280257 - DNA, 20 bp, Artificial Sequence
  chemically synthesized
tggtcacgtgcctaggcttc

SEQ ID NO: 280258 - DNA, 20 bp, Artificial Sequence
  chemically synthesized
tctctttacacttgaagcct

SEQ ID NO: 280259 - DNA, 20 bp, Artificial Sequence
  chemically synthesized
atctctttacacttgaagcc

SEQ ID NO: 280260 - DNA, 20 bp, Artificial Sequence
  chemically synthesized
gacccatctctttacacttg

SEQ ID NO: 280261 - DNA, 20 bp, Artificial Sequence
  chemically synthesized
gtgcctaggcttcaagtgta

SEQ ID NO: 280262 - DNA, 20 bp, Artificial Sequence
  chemically synthesized
gcctaggcttcaagtgtaaa

SEQ ID NO: 280263 - DNA, 20 bp, Artificial Sequence
  chemically synthesized
aggcttcaagtgtaaagaga

SEQ ID NO: 280264 - DNA, 20 bp, Artificial Sequence
  chemically synthesized
ggcttcaagtgtaaagagat

SEQ ID NO: 280265 - DNA, 20 bp, Artificial Sequence
  chemically synthesized
ggaaaaagctattgagcatt

SEQ ID NO: 280266 - DNA, 20 bp, Artificial Sequence
  chemically synthesized
agatgggtctaaatgctcaa

SEQ ID NO: 280267 - DNA, 20 bp, Artificial Sequence
  chemically synthesized
ggccctaggaaaaagctatt

SEQ ID NO: 280268 - DNA, 20 bp, Artificial Sequence
  chemically synthesized
aatgctcaatagctttttcc

SEQ ID NO: 280269 - DNA, 20 bp, Artificial Sequence
  chemically synthesized
atgctcaatagctttttcct

SEQ ID NO: 280270 - DNA, 20 bp, Artificial Sequence
  chemically synthesized
tgctcaatagctttttccta

SEQ ID NO: 280271 - DNA, 20 bp, Artificial Sequence
  chemically synthesized
atattaaaggccctaggaaa

SEQ ID NO: 280272 - DNA, 20 bp, Artificial Sequence
  chemically synthesized
gaaaggatattaaaggccct

SEQ ID NO: 280273 - DNA, 20 bp, Artificial Sequence
  chemically synthesized
tgaaaggatattaaaggccc

SEQ ID NO: 280274 - DNA, 20 bp, Artificial Sequence
  chemically synthesized
agaaattgaaaggatattaa

SEQ ID NO: 280275 - DNA, 20 bp, Artificial Sequence
  chemically synthesized
cagaaattgaaaggatatta

SEQ ID NO: 280276 - DNA, 20 bp, Artificial Sequence
  chemically synthesized
cccattctacagaaattgaa

SEQ ID NO: 280277 - DNA, 20 bp, Artificial Sequence
  chemically synthesized
tcccattctacagaaattga

SEQ ID NO: 280278 - DNA, 20 bp, Artificial Sequence
  chemically synthesized
taatatcctttcaatttctg

SEQ ID NO: 280279 - DNA, 20 bp, Artificial Sequence
  chemically synthesized
tcctttcaatttctgtagaa

SEQ ID NO: 280280 - DNA, 20 bp, Artificial Sequence
  chemically synthesized
cctttcaatttctgtagaat

SEQ ID NO: 280281 - DNA, 20 bp, Artificial Sequence
  chemically synthesized
tttttcatattcccattcta

SEQ ID NO: 280282 - DNA, 20 bp, Artificial Sequence
  chemically synthesized
gaatatgaaaaaccatatat

SEQ ID NO: 280283 - DNA, 20 bp, Artificial Sequence
  chemically synthesized
caccgcatccggccgatata

SEQ ID NO: 280284 - DNA, 20 bp, Artificial Sequence
  chemically synthesized
atgaaaaaccatatatcggc

SEQ ID NO: 280285 - DNA, 20 bp, Artificial Sequence
  chemically synthesized
aaccatatatcggccggatg

SEQ ID NO: 280286 - DNA, 20 bp, Artificial Sequence
  chemically synthesized
catatatcggccggatgcgg

SEQ ID NO: 280287 - DNA, 20 bp, Artificial Sequence
  chemically synthesized
caggcgtgagccaccgcatc

SEQ ID NO: 280288 - DNA, 20 bp, Artificial Sequence
  chemically synthesized
agtgcttgaattacaggcgt

SEQ ID NO: 280289 - DNA, 20 bp, Artificial Sequence
  chemically synthesized
gtggctcacgcctgtaattc

SEQ ID NO: 280290 - DNA, 20 bp, Artificial Sequence
  chemically synthesized
tcccaaagtgcttgaattac

SEQ ID NO: 280291 - DNA, 20 bp, Artificial Sequence
  chemically synthesized
ctcccaaagtgcttgaatta

SEQ ID NO: 280292 - DNA, 20 bp, Artificial Sequence
  chemically synthesized
cgcctgtaattcaagcactt

SEQ ID NO: 280293 - DNA, 20 bp, Artificial Sequence
  chemically synthesized
gcctgtaattcaagcacttt

SEQ ID NO: 280294 - DNA, 20 bp, Artificial Sequence
  chemically synthesized
ctgtaattcaagcactttgg

SEQ ID NO: 280295 - DNA, 20 bp, Artificial Sequence
  chemically synthesized
tgtaattcaagcactttggg

SEQ ID NO: 280296 - DNA, 20 bp, Artificial Sequence
  chemically synthesized
ccgcccgcctcggcctccca

SEQ ID NO: 280297 - DNA, 20 bp, Artificial Sequence
  chemically synthesized
ttcaagcactttgggaggcc

SEQ ID NO: 280298 - DNA, 20 bp, Artificial Sequence
  chemically synthesized
tcaagcactttgggaggccg

SEQ ID NO: 280299 - DNA, 20 bp, Artificial Sequence
  chemically synthesized
agcactttgggaggccgagg

SEQ ID NO: 280300 - DNA, 20 bp, Artificial Sequence
  chemically synthesized
gcactttgggaggccgaggc

SEQ ID NO: 280301 - DNA, 20 bp, Artificial Sequence
  chemically synthesized
ctttgggaggccgaggcggg

SEQ ID NO: 280302 - DNA, 20 bp, Artificial Sequence
  chemically synthesized
ctcaggttatccgcccgcct

SEQ ID NO: 280303 - DNA, 20 bp, Artificial Sequence
  chemically synthesized
ccgaggcgggcggataacct

SEQ ID NO: 280304 - DNA, 20 bp, Artificial Sequence
  chemically synthesized
cgaggcgggcggataacctg

SEQ ID NO: 280305 - DNA, 20 bp, Artificial Sequence
  chemically synthesized
gcgggcggataacctgaggt

SEQ ID NO: 280306 - DNA, 20 bp, Artificial Sequence
  chemically synthesized
cgggcggataacctgaggtc

SEQ ID NO: 280307 - DNA, 20 bp, Artificial Sequence
  chemically synthesized
ggcctcaaacacctgacctc

SEQ ID NO: 280308 - DNA, 20 bp, Artificial Sequence
  chemically synthesized
tggcctcaaacacctgacct

SEQ ID NO: 280309 - DNA, 20 bp, Artificial Sequence
  chemically synthesized
taacctgaggtcaggtgttt

SEQ ID NO: 280310 - DNA, 20 bp, Artificial Sequence
  chemically synthesized
aacctgaggtcaggtgtttg

SEQ ID NO: 280311 - DNA, 20 bp, Artificial Sequence
  chemically synthesized
tgaggtcaggtgtttgaggc

SEQ ID NO: 280312 - DNA, 20 bp, Artificial Sequence
  chemically synthesized
tcaggtgtttgaggccagcc

SEQ ID NO: 280313 - DNA, 20 bp, Artificial Sequence
  chemically synthesized
cttcaccatgttggccaggc

SEQ ID NO: 280314 - DNA, 20 bp, Artificial Sequence
  chemically synthesized
ggagcttcaccatgttggcc

SEQ ID NO: 280315 - DNA, 20 bp, Artificial Sequence
  chemically synthesized
tgaggccagcctggccaaca

SEQ ID NO: 280316 - DNA, 20 bp, Artificial Sequence
  chemically synthesized
tggagcttcaccatgttggc

SEQ ID NO: 280317 - DNA, 20 bp, Artificial Sequence
  chemically synthesized
gagatggagcttcaccatgt

SEQ ID NO: 280318 - DNA, 20 bp, Artificial Sequence
  chemically synthesized
ccagcctggccaacatggtg

SEQ ID NO: 280319 - DNA, 20 bp, Artificial Sequence
  chemically synthesized
ttgtatttttagtagagatg

SEQ ID NO: 280320 - DNA, 20 bp, Artificial Sequence
  chemically synthesized
ttttgtatttttagtagaga

SEQ ID NO: 280321 - DNA, 20 bp, Artificial Sequence
  chemically synthesized
taatttttgtatttttagta

SEQ ID NO: 280322 - DNA, 20 bp, Artificial Sequence
  chemically synthesized
gctaatttttgtatttttag

SEQ ID NO: 280323 - DNA, 20 bp, Artificial Sequence
  chemically synthesized
caggctaatttttgtatttt

SEQ ID NO: 280324 - DNA, 20 bp, Artificial Sequence
  chemically synthesized
tctactaaaaatacaaaaat

SEQ ID NO: 280325 - DNA, 20 bp, Artificial Sequence
  chemically synthesized
taaaaatacaaaaattagcc

SEQ ID NO: 280326 - DNA, 20 bp, Artificial Sequence
  chemically synthesized
atacaaaaattagcctggcg

SEQ ID NO: 280327 - DNA, 20 bp, Artificial Sequence
  chemically synthesized
caaaaattagcctggcgtag

SEQ ID NO: 280328 - DNA, 20 bp, Artificial Sequence
  chemically synthesized
ctggcacatgccactacgcc

SEQ ID NO: 280329 - DNA, 20 bp, Artificial Sequence
  chemically synthesized
actggcacatgccactacgc

SEQ ID NO: 280330 - DNA, 20 bp, Artificial Sequence
  chemically synthesized
cctggcgtagtggcatgtgc

SEQ ID NO: 280331 - DNA, 20 bp, Artificial Sequence
  chemically synthesized
gtggcatgtgccagtaatcc

SEQ ID NO: 280332 - DNA, 20 bp, Artificial Sequence
  chemically synthesized
tcccgagtagctgggattac

SEQ ID NO: 280333 - DNA, 20 bp, Artificial Sequence
  chemically synthesized
tgccagtaatcccagctact

SEQ ID NO: 280334 - DNA, 20 bp, Artificial Sequence
  chemically synthesized
cctcagcctcccgagtagct

SEQ ID NO: 280335 - DNA, 20 bp, Artificial Sequence
  chemically synthesized
gccagtaatcccagctactc

SEQ ID NO: 280336 - DNA, 20 bp, Artificial Sequence
  chemically synthesized
gcctcagcctcccgagtagc

SEQ ID NO: 280337 - DNA, 20 bp, Artificial Sequence
  chemically synthesized
cagtaatcccagctactcgg

SEQ ID NO: 280338 - DNA, 20 bp, Artificial Sequence
  chemically synthesized
agtaatcccagctactcggg

SEQ ID NO: 280339 - DNA, 20 bp, Artificial Sequence
  chemically synthesized
tcttgcctcagcctcccgag

SEQ ID NO: 280340 - DNA, 20 bp, Artificial Sequence
  chemically synthesized
ttatcttgcctcagcctccc

SEQ ID NO: 280341 - DNA, 20 bp, Artificial Sequence
  chemically synthesized
tcccagctactcgggaggct

SEQ ID NO: 280342 - DNA, 20 bp, Artificial Sequence
  chemically synthesized
cccagctactcgggaggctg

SEQ ID NO: 280343 - DNA, 20 bp, Artificial Sequence
  chemically synthesized
gctactcgggaggctgaggc

SEQ ID NO: 280344 - DNA, 20 bp, Artificial Sequence
  chemically synthesized
ttcaagcgattatcttgcct

SEQ ID NO: 280345 - DNA, 20 bp, Artificial Sequence
  chemically synthesized
gcaagataatcgcttgaacc

SEQ ID NO: 280346 - DNA, 20 bp, Artificial Sequence
  chemically synthesized
caagataatcgcttgaaccc

SEQ ID NO: 280347 - DNA, 20 bp, Artificial Sequence
  chemically synthesized
aacctcctcctcccgggttc

SEQ ID NO: 280348 - DNA, 20 bp, Artificial Sequence
  chemically synthesized
agataatcgcttgaacccgg

SEQ ID NO: 280349 - DNA, 20 bp, Artificial Sequence
  chemically synthesized
gataatcgcttgaacccggg

SEQ ID NO: 280350 - DNA, 20 bp, Artificial Sequence
  chemically synthesized
taatcgcttgaacccgggag

SEQ ID NO: 280351 - DNA, 20 bp, Artificial Sequence
  chemically synthesized
aatcgcttgaacccgggagg

SEQ ID NO: 280352 - DNA, 20 bp, Artificial Sequence
  chemically synthesized
cactgcaacctcctcctccc

SEQ ID NO: 280353 - DNA, 20 bp, Artificial Sequence
  chemically synthesized
tcgcttgaacccgggaggag

SEQ ID NO: 280354 - DNA, 20 bp, Artificial Sequence
  chemically synthesized
tcactgcaacctcctcctcc

SEQ ID NO: 280355 - DNA, 20 bp, Artificial Sequence
  chemically synthesized
cgcttgaacccgggaggagg

SEQ ID NO: 280356 - DNA, 20 bp, Artificial Sequence
  chemically synthesized
aacccgggaggaggaggttg

SEQ ID NO: 280357 - DNA, 20 bp, Artificial Sequence
  chemically synthesized
cgggaggaggaggttgcagt

SEQ ID NO: 280358 - DNA, 20 bp, Artificial Sequence
  chemically synthesized
ggaggaggttgcagtgagct

SEQ ID NO: 280359 - DNA, 20 bp, Artificial Sequence
  chemically synthesized
agagtacaagggtgcaatct

SEQ ID NO: 280360 - DNA, 20 bp, Artificial Sequence
  chemically synthesized
ttgcccaggctagagtacaa

SEQ ID NO: 280361 - DNA, 20 bp, Artificial Sequence
  chemically synthesized
gagattgcacccttgtactc

SEQ ID NO: 280362 - DNA, 20 bp, Artificial Sequence
  chemically synthesized
gttgcccaggctagagtaca

SEQ ID NO: 280363 - DNA, 20 bp, Artificial Sequence
  chemically synthesized
tgttgcccaggctagagtac

SEQ ID NO: 280364 - DNA, 20 bp, Artificial Sequence
  chemically synthesized
tgcacccttgtactctagcc

SEQ ID NO: 280365 - DNA, 20 bp, Artificial Sequence
  chemically synthesized
gcacccttgtactctagcct

SEQ ID NO: 280366 - DNA, 20 bp, Artificial Sequence
  chemically synthesized
tttccctgttgcccaggcta

SEQ ID NO: 280367 - DNA, 20 bp, Artificial Sequence
  chemically synthesized
tctttccctgttgcccaggc

SEQ ID NO: 280368 - DNA, 20 bp, Artificial Sequence
  chemically synthesized
ttgtactctagcctgggcaa

SEQ ID NO: 280369 - DNA, 20 bp, Artificial Sequence
  chemically synthesized
tgtactctagcctgggcaac

SEQ ID NO: 280370 - DNA, 20 bp, Artificial Sequence
  chemically synthesized
ggagtctttccctgttgccc

SEQ ID NO: 280371 - DNA, 20 bp, Artificial Sequence
  chemically synthesized
gtactctagcctgggcaaca

SEQ ID NO: 280372 - DNA, 20 bp, Artificial Sequence
  chemically synthesized
tggagtctttccctgttgcc

SEQ ID NO: 280373 - DNA, 20 bp, Artificial Sequence
  chemically synthesized
tctagcctgggcaacaggga

SEQ ID NO: 280374 - DNA, 20 bp, Artificial Sequence
  chemically synthesized
ttttttctttttttgagatg

SEQ ID NO: 280375 - DNA, 20 bp, Artificial Sequence
  chemically synthesized
tgttttttctttttttgaga

SEQ ID NO: 280376 - DNA, 20 bp, Artificial Sequence
  chemically synthesized
gaaagactccatctcaaaaa

SEQ ID NO: 280377 - DNA, 20 bp, Artificial Sequence
  chemically synthesized
tttttgttttttcttttttt

SEQ ID NO: 280378 - DNA, 20 bp, Artificial Sequence
  chemically synthesized
aatagccttatgatacatgg

SEQ ID NO: 280379 - DNA, 20 bp, Artificial Sequence
  chemically synthesized
cacaatagccttatgataca

SEQ ID NO: 280380 - DNA, 20 bp, Artificial Sequence
  chemically synthesized
caaaaaccaccatgtatcat

SEQ ID NO: 280381 - DNA, 20 bp, Artificial Sequence
  chemically synthesized
aaaaaccaccatgtatcata

SEQ ID NO: 280382 - DNA, 20 bp, Artificial Sequence
  chemically synthesized
atgtatcataaggctattgt

SEQ ID NO: 280383 - DNA, 20 bp, Artificial Sequence
  chemically synthesized
ttctcatttagttctcacaa

SEQ ID NO: 280384 - DNA, 20 bp, Artificial Sequence
  chemically synthesized
ggctattgtgagaactaaat

SEQ ID NO: 280385 - DNA, 20 bp, Artificial Sequence
  chemically synthesized
cagatatgcattttctcatt

SEQ ID NO: 280386 - DNA, 20 bp, Artificial Sequence
  chemically synthesized
tcaggtacccttttaattgt

SEQ ID NO: 280387 - DNA, 20 bp, Artificial Sequence
  chemically synthesized
aatgcatatctgacaattaa

SEQ ID NO: 280388 - DNA, 20 bp, Artificial Sequence
  chemically synthesized
atgcatatctgacaattaaa

SEQ ID NO: 280389 - DNA, 20 bp, Artificial Sequence
  chemically synthesized
tgcatatctgacaattaaaa

SEQ ID NO: 280390 - DNA, 20 bp, Artificial Sequence
  chemically synthesized
tgacaattaaaagggtacct

SEQ ID NO: 280391 - DNA, 20 bp, Artificial Sequence
  chemically synthesized
gtatttggttacagaggctc

SEQ ID NO: 280392 - DNA, 20 bp, Artificial Sequence
  chemically synthesized
agtatttggttacagaggct

SEQ ID NO: 280393 - DNA, 20 bp, Artificial Sequence
  chemically synthesized
gtaatagtatttggttacag

SEQ ID NO: 280394 - DNA, 20 bp, Artificial Sequence
  chemically synthesized
ggtaatagtatttggttaca

SEQ ID NO: 280395 - DNA, 20 bp, Artificial Sequence
  chemically synthesized
ttggtaatagtatttggtta

SEQ ID NO: 280396 - DNA, 20 bp, Artificial Sequence
  chemically synthesized
ataatattggtaatagtatt

SEQ ID NO: 280397 - DNA, 20 bp, Artificial Sequence
  chemically synthesized
atgaataataatattggtaa

SEQ ID NO: 280398 - DNA, 20 bp, Artificial Sequence
  chemically synthesized
aacaaaatgaataataatat

SEQ ID NO: 280399 - DNA, 20 bp, Artificial Sequence
  chemically synthesized
ccaagcagcagaagatgatt

SEQ ID NO: 280400 - DNA, 20 bp, Artificial Sequence
  chemically synthesized
acagggtaaccaagcagcag

SEQ ID NO: 280401 - DNA, 20 bp, Artificial Sequence
  chemically synthesized
ctaaatcatcttctgctgct

SEQ ID NO: 280402 - DNA, 20 bp, Artificial Sequence
  chemically synthesized
ctaacagggtaaccaagcag

SEQ ID NO: 280403 - DNA, 20 bp, Artificial Sequence
  chemically synthesized
tctctaacagggtaaccaag

SEQ ID NO: 280404 - DNA, 20 bp, Artificial Sequence
  chemically synthesized
tattctctaacagggtaacc

SEQ ID NO: 280405 - DNA, 20 bp, Artificial Sequence
  chemically synthesized
ctgctgcttggttaccctgt

SEQ ID NO: 280406 - DNA, 20 bp, Artificial Sequence
  chemically synthesized
gctgcttggttaccctgtta

SEQ ID NO: 280407 - DNA, 20 bp, Artificial Sequence
  chemically synthesized
aatagctttattctctaaca

SEQ ID NO: 280408 - DNA, 20 bp, Artificial Sequence
  chemically synthesized
taatagctttattctctaac

SEQ ID NO: 280409 - DNA, 20 bp, Artificial Sequence
  chemically synthesized
gtaatagctttattctctaa

SEQ ID NO: 280410 - DNA, 20 bp, Artificial Sequence
  chemically synthesized
ggttaccctgttagagaata

SEQ ID NO: 280411 - DNA, 20 bp, Artificial Sequence
  chemically synthesized
agagaataaagctattacaa

SEQ ID NO: 280412 - DNA, 20 bp, Artificial Sequence
  chemically synthesized
catttttacaactattgtaa

SEQ ID NO: 280413 - DNA, 20 bp, Artificial Sequence
  chemically synthesized
gttgtaaaaatgatatgatt

SEQ ID NO: 280414 - DNA, 20 bp, Artificial Sequence
  chemically synthesized
atatgatttggtacgtctgt

SEQ ID NO: 280415 - DNA, 20 bp, Artificial Sequence
  chemically synthesized
atgatttggtacgtctgttg

SEQ ID NO: 280416 - DNA, 20 bp, Artificial Sequence
  chemically synthesized
aaaccaggcaacatctccaa

SEQ ID NO: 280417 - DNA, 20 bp, Artificial Sequence
  chemically synthesized
cgtctgttggagatgttgcc

SEQ ID NO: 280418 - DNA, 20 bp, Artificial Sequence
  chemically synthesized
tgaaagatggttagcaaacc

SEQ ID NO: 280419 - DNA, 20 bp, Artificial Sequence
  chemically synthesized
ttgaaagatggttagcaaac

SEQ ID NO: 280420 - DNA, 20 bp, Artificial Sequence
  chemically synthesized
gtaatgatttgaaagatggt

SEQ ID NO: 280421 - DNA, 20 bp, Artificial Sequence
  chemically synthesized
cacagtaatgatttgaaaga

SEQ ID NO: 280422 - DNA, 20 bp, Artificial Sequence
  chemically synthesized
tactcacagtaatgatttga

SEQ ID NO: 280423 - DNA, 20 bp, Artificial Sequence
  chemically synthesized
atctttcaaatcattactgt

SEQ ID NO: 280424 - DNA, 20 bp, Artificial Sequence
  chemically synthesized
tttcaaatcattactgtgag

SEQ ID NO: 280425 - DNA, 20 bp, Artificial Sequence
  chemically synthesized
agcactatattttctactca

SEQ ID NO: 280426 - DNA, 20 bp, Artificial Sequence
  chemically synthesized
attactgtgagtagaaaata

SEQ ID NO: 280427 - DNA, 20 bp, Artificial Sequence
  chemically synthesized
tttcattcttgataatcata

SEQ ID NO: 280428 - DNA, 20 bp, Artificial Sequence
  chemically synthesized
tatagtgctatatgattatc

SEQ ID NO: 280429 - DNA, 20 bp, Artificial Sequence
  chemically synthesized
tatatgattatcaagaatga

SEQ ID NO: 280430 - DNA, 20 bp, Artificial Sequence
  chemically synthesized
agaatgaaagatgccttttg

SEQ ID NO: 280431 - DNA, 20 bp, Artificial Sequence
  chemically synthesized
attatttccatcacttcaaa

SEQ ID NO: 280432 - DNA, 20 bp, Artificial Sequence
  chemically synthesized
aattatttccatcacttcaa

SEQ ID NO: 280433 - DNA, 20 bp, Artificial Sequence
  chemically synthesized
aaagatgccttttgaagtga

SEQ ID NO: 280434 - DNA, 20 bp, Artificial Sequence
  chemically synthesized
gtgtgagtttgcattcaaat

SEQ ID NO: 280435 - DNA, 20 bp, Artificial Sequence
  chemically synthesized
catccctaatttcagagtgt

SEQ ID NO: 280436 - DNA, 20 bp, Artificial Sequence
  chemically synthesized
gcaaactcacactctgaaat

SEQ ID NO: 280437 - DNA, 20 bp, Artificial Sequence
  chemically synthesized
caaactcacactctgaaatt

SEQ ID NO: 280438 - DNA, 20 bp, Artificial Sequence
  chemically synthesized
agatcccatccctaatttca

SEQ ID NO: 280439 - DNA, 20 bp, Artificial Sequence
  chemically synthesized
aaactcacactctgaaatta

SEQ ID NO: 280440 - DNA, 20 bp, Artificial Sequence
  chemically synthesized
ctagatcccatccctaattt

SEQ ID NO: 280441 - DNA, 20 bp, Artificial Sequence
  chemically synthesized
tcacactctgaaattaggga

SEQ ID NO: 280442 - DNA, 20 bp, Artificial Sequence
  chemically synthesized
cacactctgaaattagggat

SEQ ID NO: 280443 - DNA, 20 bp, Artificial Sequence
  chemically synthesized
ctgaaattagggatgggatc

SEQ ID NO: 280444 - DNA, 20 bp, Artificial Sequence
  chemically synthesized
aatatttaaaagagatttgc

SEQ ID NO: 280445 - DNA, 20 bp, Artificial Sequence
  chemically synthesized
ttgcctatgaatatttaaaa

SEQ ID NO: 280446 - DNA, 20 bp, Artificial Sequence
  chemically synthesized
tattgcctatgaatatttaa

SEQ ID NO: 280447 - DNA, 20 bp, Artificial Sequence
  chemically synthesized
aaatctcttttaaatattca

SEQ ID NO: 280448 - DNA, 20 bp, Artificial Sequence
  chemically synthesized
aatctcttttaaatattcat

SEQ ID NO: 280449 - DNA, 20 bp, Artificial Sequence
  chemically synthesized
taaatattcataggcaataa

SEQ ID NO: 280450 - DNA, 20 bp, Artificial Sequence
  chemically synthesized
attcataggcaataaaagtc

SEQ ID NO: 280451 - DNA, 20 bp, Artificial Sequence
  chemically synthesized
tgttaaatcagtcaaacagc

SEQ ID NO: 280452 - DNA, 20 bp, Artificial Sequence
  chemically synthesized
tgcctgttaaatcagtcaaa

SEQ ID NO: 280453 - DNA, 20 bp, Artificial Sequence
  chemically synthesized
tggctgtttgactgatttaa

SEQ ID NO: 280454 - DNA, 20 bp, Artificial Sequence
  chemically synthesized
ggctgtttgactgatttaac

SEQ ID NO: 280455 - DNA, 20 bp, Artificial Sequence
  chemically synthesized
cattcaattgcctgttaaat

SEQ ID NO: 280456 - DNA, 20 bp, Artificial Sequence
  chemically synthesized
caggcaattgaatgttacct

SEQ ID NO: 280457 - DNA, 20 bp, Artificial Sequence
  chemically synthesized
gctgcaattatgcagaacta

SEQ ID NO: 280458 - DNA, 20 bp, Artificial Sequence
  chemically synthesized
agctgcaattatgcagaact

SEQ ID NO: 280459 - DNA, 20 bp, Artificial Sequence
  chemically synthesized
ttcttatagctgcaattatg

SEQ ID NO: 280460 - DNA, 20 bp, Artificial Sequence
  chemically synthesized
accttagttctgcataattg

SEQ ID NO: 280461 - DNA, 20 bp, Artificial Sequence
  chemically synthesized
ttctgcataattgcagctat

SEQ ID NO: 280462 - DNA, 20 bp, Artificial Sequence
  chemically synthesized
cacctacctaatgtttctta

SEQ ID NO: 280463 - DNA, 20 bp, Artificial Sequence
  chemically synthesized
attgcagctataagaaacat

SEQ ID NO: 280464 - DNA, 20 bp, Artificial Sequence
  chemically synthesized
ttgcagctataagaaacatt

SEQ ID NO: 280465 - DNA, 20 bp, Artificial Sequence
  chemically synthesized
cagctataagaaacattagg

SEQ ID NO: 280466 - DNA, 20 bp, Artificial Sequence
  chemically synthesized
agctataagaaacattaggt

SEQ ID NO: 280467 - DNA, 20 bp, Artificial Sequence
  chemically synthesized
gcctatgtcagaggtttgtg

SEQ ID NO: 280468 - DNA, 20 bp, Artificial Sequence
  chemically synthesized
tgcctatgtcagaggtttgt

SEQ ID NO: 280469 - DNA, 20 bp, Artificial Sequence
  chemically synthesized
aacctcacaaacctctgaca

SEQ ID NO: 280470 - DNA, 20 bp, Artificial Sequence
  chemically synthesized
acctcacaaacctctgacat

SEQ ID NO: 280471 - DNA, 20 bp, Artificial Sequence
  chemically synthesized
caattaagtgcctatgtcag

SEQ ID NO: 280472 - DNA, 20 bp, Artificial Sequence
  chemically synthesized
tcaattaagtgcctatgtca

SEQ ID NO: 280473 - DNA, 20 bp, Artificial Sequence
  chemically synthesized
aatcaattaagtgcctatgt

SEQ ID NO: 280474 - DNA, 20 bp, Artificial Sequence
  chemically synthesized
cctattttttaaaatcaatt

SEQ ID NO: 280475 - DNA, 20 bp, Artificial Sequence
  chemically synthesized
acttaattgattttaaaaaa

SEQ ID NO: 280476 - DNA, 20 bp, Artificial Sequence
  chemically synthesized
cttaattgattttaaaaaat

SEQ ID NO: 280477 - DNA, 20 bp, Artificial Sequence
  chemically synthesized
ttgattttaaaaaataggtt

SEQ ID NO: 280478 - DNA, 20 bp, Artificial Sequence
  chemically synthesized
tgattttaaaaaataggtta

SEQ ID NO: 280479 - DNA, 20 bp, Artificial Sequence
  chemically synthesized
gtgccttttaatttgaagat

SEQ ID NO: 280480 - DNA, 20 bp, Artificial Sequence
  chemically synthesized
acaaagtgccttttaatttg

SEQ ID NO: 280481 - DNA, 20 bp, Artificial Sequence
  chemically synthesized
aaggctcatcttcaaattaa

SEQ ID NO: 280482 - DNA, 20 bp, Artificial Sequence
  chemically synthesized
aggctcatcttcaaattaaa

SEQ ID NO: 280483 - DNA, 20 bp, Artificial Sequence
  chemically synthesized
agatttgctattaataaaca

SEQ ID NO: 280484 - DNA, 20 bp, Artificial Sequence
  chemically synthesized
aaaggcactttgtttattaa

SEQ ID NO: 280485 - DNA, 20 bp, Artificial Sequence
  chemically synthesized
ttgtttattaatagcaaatc

SEQ ID NO: 280486 - DNA, 20 bp, Artificial Sequence
  chemically synthesized
tattaatagcaaatctggct

SEQ ID NO: 280487 - DNA, 20 bp, Artificial Sequence
  chemically synthesized
attaatagcaaatctggctg

SEQ ID NO: 280488 - DNA, 20 bp, Artificial Sequence
  chemically synthesized
aatagcaaatctggctgagg

SEQ ID NO: 280489 - DNA, 20 bp, Artificial Sequence
  chemically synthesized
agcaattctcctgcctcagc

SEQ ID NO: 280490 - DNA, 20 bp, Artificial Sequence
  chemically synthesized
atagcaaatctggctgaggc

SEQ ID NO: 280491 - DNA, 20 bp, Artificial Sequence
  chemically synthesized
agcaaatctggctgaggcag

SEQ ID NO: 280492 - DNA, 20 bp, Artificial Sequence
  chemically synthesized
ttcaagcaattctcctgcct

SEQ ID NO: 280493 - DNA, 20 bp, Artificial Sequence
  chemically synthesized
gcaggagaattgcttgaacc

SEQ ID NO: 280494 - DNA, 20 bp, Artificial Sequence
  chemically synthesized
caggagaattgcttgaaccc

SEQ ID NO: 280495 - DNA, 20 bp, Artificial Sequence
  chemically synthesized
aacctctgcctcctgggttc

SEQ ID NO: 280496 - DNA, 20 bp, Artificial Sequence
  chemically synthesized
ggagaattgcttgaacccag

SEQ ID NO: 280497 - DNA, 20 bp, Artificial Sequence
  chemically synthesized
gagaattgcttgaacccagg

SEQ ID NO: 280498 - DNA, 20 bp, Artificial Sequence
  chemically synthesized
aattgcttgaacccaggagg

SEQ ID NO: 280499 - DNA, 20 bp, Artificial Sequence
  chemically synthesized
cactgcaacctctgcctcct

SEQ ID NO: 280500 - DNA, 20 bp, Artificial Sequence
  chemically synthesized
ttgcttgaacccaggaggca

SEQ ID NO: 280501 - DNA, 20 bp, Artificial Sequence
  chemically synthesized
tcactgcaacctctgcctcc

SEQ ID NO: 280502 - DNA, 20 bp, Artificial Sequence
  chemically synthesized
tgcttgaacccaggaggcag

SEQ ID NO: 280503 - DNA, 20 bp, Artificial Sequence
  chemically synthesized
aacccaggaggcagaggttg

SEQ ID NO: 280504 - DNA, 20 bp, Artificial Sequence
  chemically synthesized
caggaggcagaggttgcagt

SEQ ID NO: 280505 - DNA, 20 bp, Artificial Sequence
  chemically synthesized
ggcagaggttgcagtgagcc

SEQ ID NO: 280506 - DNA, 20 bp, Artificial Sequence
  chemically synthesized
ggagtgcaatggcacgatct

SEQ ID NO: 280507 - DNA, 20 bp, Artificial Sequence
  chemically synthesized
aagcccaggctggagtgcaa

SEQ ID NO: 280508 - DNA, 20 bp, Artificial Sequence
  chemically synthesized
aagatcgtgccattgcactc

SEQ ID NO: 280509 - DNA, 20 bp, Artificial Sequence
  chemically synthesized
cgtgccattgcactccagcc

SEQ ID NO: 280510 - DNA, 20 bp, Artificial Sequence
  chemically synthesized
gtgccattgcactccagcct

SEQ ID NO: 280511 - DNA, 20 bp, Artificial Sequence
  chemically synthesized
tctccctgaagcccaggctg

SEQ ID NO: 280512 - DNA, 20 bp, Artificial Sequence
  chemically synthesized
tctctccctgaagcccaggc

SEQ ID NO: 280513 - DNA, 20 bp, Artificial Sequence
  chemically synthesized
ttgcactccagcctgggctt

SEQ ID NO: 280514 - DNA, 20 bp, Artificial Sequence
  chemically synthesized
tgcactccagcctgggcttc

SEQ ID NO: 280515 - DNA, 20 bp, Artificial Sequence
  chemically synthesized
agagtctctccctgaagccc

SEQ ID NO: 280516 - DNA, 20 bp, Artificial Sequence
  chemically synthesized
gcactccagcctgggcttca

SEQ ID NO: 280517 - DNA, 20 bp, Artificial Sequence
  chemically synthesized
cagagtctctccctgaagcc

SEQ ID NO: 280518 - DNA, 20 bp, Artificial Sequence
  chemically synthesized
actccagcctgggcttcagg

SEQ ID NO: 280519 - DNA, 20 bp, Artificial Sequence
  chemically synthesized
tccagcctgggcttcaggga

SEQ ID NO: 280520 - DNA, 20 bp, Artificial Sequence
  chemically synthesized
tgagacagagtctctccctg

SEQ ID NO: 280521 - DNA, 20 bp, Artificial Sequence
  chemically synthesized
tattttatttttttgagaca

SEQ ID NO: 280522 - DNA, 20 bp, Artificial Sequence
  chemically synthesized
tttattttatttttttgaga

SEQ ID NO: 280523 - DNA, 20 bp, Artificial Sequence
  chemically synthesized
ttattttattttattttttt

SEQ ID NO: 280524 - DNA, 20 bp, Artificial Sequence
  chemically synthesized
aaaataaaataaaataaaaa

SEQ ID NO: 280525 - DNA, 20 bp, Artificial Sequence
  chemically synthesized
acaaaaaagtttttattttg

SEQ ID NO: 280526 - DNA, 20 bp, Artificial Sequence
  chemically synthesized
ttttggttggttaaacaaaa

SEQ ID NO: 280527 - DNA, 20 bp, Artificial Sequence
  chemically synthesized
tgattctcttgatttttggt

SEQ ID NO: 280528 - DNA, 20 bp, Artificial Sequence
  chemically synthesized
tgtttaaccaaccaaaaatc

SEQ ID NO: 280529 - DNA, 20 bp, Artificial Sequence
  chemically synthesized
gccatgattctcttgatttt

SEQ ID NO: 280530 - DNA, 20 bp, Artificial Sequence
  chemically synthesized
tttaaccaaccaaaaatcaa

SEQ ID NO: 280531 - DNA, 20 bp, Artificial Sequence
  chemically synthesized
accaaaaatcaagagaatca

SEQ ID NO: 280532 - DNA, 20 bp, Artificial Sequence
  chemically synthesized
aagaattctgaatttgtttt

SEQ ID NO: 280533 - DNA, 20 bp, Artificial Sequence
  chemically synthesized
caagaattctgaatttgttt

SEQ ID NO: 280534 - DNA, 20 bp, Artificial Sequence
  chemically synthesized
atcatggcctaaaacaaatt

SEQ ID NO: 280535 - DNA, 20 bp, Artificial Sequence
  chemically synthesized
tacattaatgtgttataatc

SEQ ID NO: 280536 - DNA, 20 bp, Artificial Sequence
  chemically synthesized
ataacacattaatgtacaac

SEQ ID NO: 280537 - DNA, 20 bp, Artificial Sequence
  chemically synthesized
tttaaattgatttaaaaact

SEQ ID NO: 280538 - DNA, 20 bp, Artificial Sequence
  chemically synthesized
acaaaatgattacagtaact

SEQ ID NO: 280539 - DNA, 20 bp, Artificial Sequence
  chemically synthesized
ctgaagaaacaaaatgatta

SEQ ID NO: 280540 - DNA, 20 bp, Artificial Sequence
  chemically synthesized
ctgtaatcattttgtttctt

SEQ ID NO: 280541 - DNA, 20 bp, Artificial Sequence
  chemically synthesized
ataaattatctgagaggctg

SEQ ID NO: 280542 - DNA, 20 bp, Artificial Sequence
  chemically synthesized
attttgtttcttcagcctct

SEQ ID NO: 280543 - DNA, 20 bp, Artificial Sequence
  chemically synthesized
cttgggataaattatctgag

SEQ ID NO: 280544 - DNA, 20 bp, Artificial Sequence
  chemically synthesized
ccttgggataaattatctga

SEQ ID NO: 280545 - DNA, 20 bp, Artificial Sequence
  chemically synthesized
agccttgggataaattatct

SEQ ID NO: 280546 - DNA, 20 bp, Artificial Sequence
  chemically synthesized
cctctcagataatttatccc

SEQ ID NO: 280547 - DNA, 20 bp, Artificial Sequence
  chemically synthesized
ctctcagataatttatccca

SEQ ID NO: 280548 - DNA, 20 bp, Artificial Sequence
  chemically synthesized
gatgcagtagaataagcctt

SEQ ID NO: 280549 - DNA, 20 bp, Artificial Sequence
  chemically synthesized
cgatgcagtagaataagcct

SEQ ID NO: 280550 - DNA, 20 bp, Artificial Sequence
  chemically synthesized
ttgtttcgatgcagtagaat

SEQ ID NO: 280551 - DNA, 20 bp, Artificial Sequence
  chemically synthesized
agactgttgtttcgatgcag

SEQ ID NO: 280552 - DNA, 20 bp, Artificial Sequence
  chemically synthesized
aaaagactgttgtttcgatg

SEQ ID NO: 280553 - DNA, 20 bp, Artificial Sequence
  chemically synthesized
attctactgcatcgaaacaa

SEQ ID NO: 280554 - DNA, 20 bp, Artificial Sequence
  chemically synthesized
gaaacaacagtctttttaac

SEQ ID NO: 280555 - DNA, 20 bp, Artificial Sequence
  chemically synthesized
atttccactatctagttaaa

SEQ ID NO: 280556 - DNA, 20 bp, Artificial Sequence
  chemically synthesized
caacagtctttttaactaga

SEQ ID NO: 280557 - DNA, 20 bp, Artificial Sequence
  chemically synthesized
cagtctttttaactagatag

SEQ ID NO: 280558 - DNA, 20 bp, Artificial Sequence
  chemically synthesized
ctttggatatttccactatc

SEQ ID NO: 280559 - DNA, 20 bp, Artificial Sequence
  chemically synthesized
ctagatagtggaaatatcca

SEQ ID NO: 280560 - DNA, 20 bp, Artificial Sequence
  chemically synthesized
tagatagtggaaatatccaa

SEQ ID NO: 280561 - DNA, 20 bp, Artificial Sequence
  chemically synthesized
tattagctaaatcaatcctt

SEQ ID NO: 280562 - DNA, 20 bp, Artificial Sequence
  chemically synthesized
aaatatccaaaggattgatt

SEQ ID NO: 280563 - DNA, 20 bp, Artificial Sequence
  chemically synthesized
agacacacctaataatttat

SEQ ID NO: 280564 - DNA, 20 bp, Artificial Sequence
  chemically synthesized
tgatttagctaataaattat

SEQ ID NO: 280565 - DNA, 20 bp, Artificial Sequence
  chemically synthesized
gatttagctaataaattatt

SEQ ID NO: 280566 - DNA, 20 bp, Artificial Sequence
  chemically synthesized
ttcaaactacttaggtaaaa

SEQ ID NO: 280567 - DNA, 20 bp, Artificial Sequence
  chemically synthesized
taggtgtgtcttttttacct

SEQ ID NO: 280568 - DNA, 20 bp, Artificial Sequence
  chemically synthesized
gtgtgtcttttttacctaag

SEQ ID NO: 280569 - DNA, 20 bp, Artificial Sequence
  chemically synthesized
tgatcaatttcaaactactt

SEQ ID NO: 280570 - DNA, 20 bp, Artificial Sequence
  chemically synthesized
ttgatcaatttcaaactact

SEQ ID NO: 280571 - DNA, 20 bp, Artificial Sequence
  chemically synthesized
aagtagtttgaaattgatca

SEQ ID NO: 280572 - DNA, 20 bp, Artificial Sequence
  chemically synthesized
ttgaaattgatcaaagtgct

SEQ ID NO: 280573 - DNA, 20 bp, Artificial Sequence
  chemically synthesized
attgatcaaagtgctgagca

SEQ ID NO: 280574 - DNA, 20 bp, Artificial Sequence
  chemically synthesized
tgtatttctcaggctttgct

SEQ ID NO: 280575 - DNA, 20 bp, Artificial Sequence
  chemically synthesized
caaagtgctgagcaaagcct

SEQ ID NO: 280576 - DNA, 20 bp, Artificial Sequence
  chemically synthesized
ataggacttttgtatttctc

SEQ ID NO: 280577 - DNA, 20 bp, Artificial Sequence
  chemically synthesized
aataggacttttgtatttct

SEQ ID NO: 280578 - DNA, 20 bp, Artificial Sequence
  chemically synthesized
gcaaagcctgagaaatacaa

SEQ ID NO: 280579 - DNA, 20 bp, Artificial Sequence
  chemically synthesized
ttaaaacaatgtgtagtaat

SEQ ID NO: 280580 - DNA, 20 bp, Artificial Sequence
  chemically synthesized
attaaaacaatgtgtagtaa

SEQ ID NO: 280581 - DNA, 20 bp, Artificial Sequence
  chemically synthesized
tgttaaattaaaacaatgtg

SEQ ID NO: 280582 - DNA, 20 bp, Artificial Sequence
  chemically synthesized
taatttaacattgtatcttt

SEQ ID NO: 280583 - DNA, 20 bp, Artificial Sequence
  chemically synthesized
aatttaacattgtatctttc

SEQ ID NO: 280584 - DNA, 20 bp, Artificial Sequence
  chemically synthesized
gataagctgattagacctga

SEQ ID NO: 280585 - DNA, 20 bp, Artificial Sequence
  chemically synthesized
ttgtatctttcaggtctaat

SEQ ID NO: 280586 - DNA, 20 bp, Artificial Sequence
  chemically synthesized
tcagcctgtgataagctgat

SEQ ID NO: 280587 - DNA, 20 bp, Artificial Sequence
  chemically synthesized
caggtctaatcagcttatca

SEQ ID NO: 280588 - DNA, 20 bp, Artificial Sequence
  chemically synthesized
aggtctaatcagcttatcac

SEQ ID NO: 280589 - DNA, 20 bp, Artificial Sequence
  chemically synthesized
ctgttgtatcagcctgtgat

SEQ ID NO: 280590 - DNA, 20 bp, Artificial Sequence
  chemically synthesized
cttatcacaggctgatacaa

SEQ ID NO: 280591 - DNA, 20 bp, Artificial Sequence
  chemically synthesized
cttctcaaattctgttgtat

SEQ ID NO: 280592 - DNA, 20 bp, Artificial Sequence
  chemically synthesized
aggctgatacaacagaattt

SEQ ID NO: 280593 - DNA, 20 bp, Artificial Sequence
  chemically synthesized
ctgatacaacagaatttgag

SEQ ID NO: 280594 - DNA, 20 bp, Artificial Sequence
  chemically synthesized
tgatacaacagaatttgaga

SEQ ID NO: 280595 - DNA, 20 bp, Artificial Sequence
  chemically synthesized
atattatgtttaacatgatg

SEQ ID NO: 280596 - DNA, 20 bp, Artificial Sequence
  chemically synthesized
acatgatgtggttttcatga

SEQ ID NO: 280597 - DNA, 20 bp, Artificial Sequence
  chemically synthesized
taaagcatatttagttttta

SEQ ID NO: 280598 - DNA, 20 bp, Artificial Sequence
  chemically synthesized
caatgaaaataaagcatatt

SEQ ID NO: 280599 - DNA, 20 bp, Artificial Sequence
  chemically synthesized
gttatttgacaatgaaaata

SEQ ID NO: 280600 - DNA, 20 bp, Artificial Sequence
  chemically synthesized
tttcattgtcaaataactcc

SEQ ID NO: 280601 - DNA, 20 bp, Artificial Sequence
  chemically synthesized
ttcattgtcaaataactccc

SEQ ID NO: 280602 - DNA, 20 bp, Artificial Sequence
  chemically synthesized
tttggccagtaataacctgg

SEQ ID NO: 280603 - DNA, 20 bp, Artificial Sequence
  chemically synthesized
tatttggccagtaataacct

SEQ ID NO: 280604 - DNA, 20 bp, Artificial Sequence
  chemically synthesized
atatttggccagtaataacc

SEQ ID NO: 280605 - DNA, 20 bp, Artificial Sequence
  chemically synthesized
aataactcccaggttattac

SEQ ID NO: 280606 - DNA, 20 bp, Artificial Sequence
  chemically synthesized
gtttatattacatatttggc

SEQ ID NO: 280607 - DNA, 20 bp, Artificial Sequence
  chemically synthesized
ctgtgtttatattacatatt

SEQ ID NO: 280608 - DNA, 20 bp, Artificial Sequence
  chemically synthesized
ccaaatatgtaatataaaca

SEQ ID NO: 280609 - DNA, 20 bp, Artificial Sequence
  chemically synthesized
atatgtaatataaacacagc

SEQ ID NO: 280610 - DNA, 20 bp, Artificial Sequence
  chemically synthesized
tatgtaatataaacacagct

SEQ ID NO: 280611 - DNA, 20 bp, Artificial Sequence
  chemically synthesized
cttgaaactattatcagtcc

SEQ ID NO: 280612 - DNA, 20 bp, Artificial Sequence
  chemically synthesized
aacacagctaggactgataa

SEQ ID NO: 280613 - DNA, 20 bp, Artificial Sequence
  chemically synthesized
agtaaacttgaaactattat

SEQ ID NO: 280614 - DNA, 20 bp, Artificial Sequence
  chemically synthesized
ctaggactgataatagtttc

SEQ ID NO: 280615 - DNA, 20 bp, Artificial Sequence
  chemically synthesized
agtttcaagtttacttattt

SEQ ID NO: 280616 - DNA, 20 bp, Artificial Sequence
  chemically synthesized
aataacaataaatctaaaat

SEQ ID NO: 280617 - DNA, 20 bp, Artificial Sequence
  chemically synthesized
tgtacctcaatgattaagca

SEQ ID NO: 280618 - DNA, 20 bp, Artificial Sequence
  chemically synthesized
cttgtacctcaatgattaag

SEQ ID NO: 280619 - DNA, 20 bp, Artificial Sequence
  chemically synthesized
taacactctgcttaatcatt

SEQ ID NO: 280620 - DNA, 20 bp, Artificial Sequence
  chemically synthesized
ccacttgtacctcaatgatt

SEQ ID NO: 280621 - DNA, 20 bp, Artificial Sequence
  chemically synthesized
aacactctgcttaatcattg

SEQ ID NO: 280622 - DNA, 20 bp, Artificial Sequence
  chemically synthesized
ctgcttaatcattgaggtac

SEQ ID NO: 280623 - DNA, 20 bp, Artificial Sequence
  chemically synthesized
cttaatcattgaggtacaag

SEQ ID NO: 280624 - DNA, 20 bp, Artificial Sequence
  chemically synthesized
taatcattgaggtacaagtg

SEQ ID NO: 280625 - DNA, 20 bp, Artificial Sequence
  chemically synthesized
atcattgaggtacaagtgga

SEQ ID NO: 280626 - DNA, 20 bp, Artificial Sequence
  chemically synthesized
cctctaagtcttaaaatcag

SEQ ID NO: 280627 - DNA, 20 bp, Artificial Sequence
  chemically synthesized
agtggagagcttctgatttt

SEQ ID NO: 280628 - DNA, 20 bp, Artificial Sequence
  chemically synthesized
caccctctaagtcttaaaat

SEQ ID NO: 280629 - DNA, 20 bp, Artificial Sequence
  chemically synthesized
gagcttctgattttaagact

SEQ ID NO: 280630 - DNA, 20 bp, Artificial Sequence
  chemically synthesized
gcttctgattttaagactta

SEQ ID NO: 280631 - DNA, 20 bp, Artificial Sequence
  chemically synthesized
cttctgattttaagacttag

SEQ ID NO: 280632 - DNA, 20 bp, Artificial Sequence
  chemically synthesized
ttctgattttaagacttaga

SEQ ID NO: 280633 - DNA, 20 bp, Artificial Sequence
  chemically synthesized
aaggatttttatcaccctct

SEQ ID NO: 280634 - DNA, 20 bp, Artificial Sequence
  chemically synthesized
aaatgtgaagacagataaaa

SEQ ID NO: 280635 - DNA, 20 bp, Artificial Sequence
  chemically synthesized
aaaatgtgaagacagataaa

SEQ ID NO: 280636 - DNA, 20 bp, Artificial Sequence
  chemically synthesized
agttaaataaaatgtgaaga

SEQ ID NO: 280637 - DNA, 20 bp, Artificial Sequence
  chemically synthesized
cattagttaaataaaatgtg

SEQ ID NO: 280638 - DNA, 20 bp, Artificial Sequence
  chemically synthesized
ttcacattttatttaactaa

SEQ ID NO: 280639 - DNA, 20 bp, Artificial Sequence
  chemically synthesized
cacattttatttaactaatg

SEQ ID NO: 280640 - DNA, 20 bp, Artificial Sequence
  chemically synthesized
acattttatttaactaatgg

SEQ ID NO: 280641 - DNA, 20 bp, Artificial Sequence
  chemically synthesized
tgaaatgcacatgcctccat

SEQ ID NO: 280642 - DNA, 20 bp, Artificial Sequence
  chemically synthesized
gattggtaaataaatgcaga

SEQ ID NO: 280643 - DNA, 20 bp, Artificial Sequence
  chemically synthesized
cagtgattggtaaataaatg

SEQ ID NO: 280644 - DNA, 20 bp, Artificial Sequence
  chemically synthesized
atcccactgagggcagtgat

SEQ ID NO: 280645 - DNA, 20 bp, Artificial Sequence
  chemically synthesized
tatttaccaatcactgccct

SEQ ID NO: 280646 - DNA, 20 bp, Artificial Sequence
  chemically synthesized
ttaccaatcactgccctcag

SEQ ID NO: 280647 - DNA, 20 bp, Artificial Sequence
  chemically synthesized
tatatatatcccactgaggg

SEQ ID NO: 280648 - DNA, 20 bp, Artificial Sequence
  chemically synthesized
taccaatcactgccctcagt

SEQ ID NO: 280649 - DNA, 20 bp, Artificial Sequence
  chemically synthesized
atatatatatatcccactga

SEQ ID NO: 280650 - DNA, 20 bp, Artificial Sequence
  chemically synthesized
catatatatatatcccactg

SEQ ID NO: 280651 - DNA, 20 bp, Artificial Sequence
  chemically synthesized
acatatatatatatcccact

SEQ ID NO: 280652 - DNA, 20 bp, Artificial Sequence
  chemically synthesized
atatatatatatatatatgt

SEQ ID NO: 280653 - DNA, 20 bp, Artificial Sequence
  chemically synthesized
ttgtgtgtgtgtgtttgtat

SEQ ID NO: 280654 - DNA, 20 bp, Artificial Sequence
  chemically synthesized
attgtgtgtgtgtgtttgta

SEQ ID NO: 280655 - DNA, 20 bp, Artificial Sequence
  chemically synthesized
aacacacacacacaattttt

SEQ ID NO: 280656 - DNA, 20 bp, Artificial Sequence
  chemically synthesized
acacacacacacaatttttg

SEQ ID NO: 280657 - DNA, 20 bp, Artificial Sequence
  chemically synthesized
cacacacacacaatttttga

SEQ ID NO: 280658 - DNA, 20 bp, Artificial Sequence
  chemically synthesized
atttttgagggctgatactc

SEQ ID NO: 280659 - DNA, 20 bp, Artificial Sequence
  chemically synthesized
tagatgatattctagagtat

SEQ ID NO: 280660 - DNA, 20 bp, Artificial Sequence
  chemically synthesized
tttgactagatgatattcta

SEQ ID NO: 280661 - DNA, 20 bp, Artificial Sequence
  chemically synthesized
attttgactagatgatattc

SEQ ID NO: 280662 - DNA, 20 bp, Artificial Sequence
  chemically synthesized
tgatactctagaatatcatc

SEQ ID NO: 280663 - DNA, 20 bp, Artificial Sequence
  chemically synthesized
atcagcctttttattttgac

SEQ ID NO: 280664 - DNA, 20 bp, Artificial Sequence
  chemically synthesized
tatcatctagtcaaaataaa

SEQ ID NO: 280665 - DNA, 20 bp, Artificial Sequence
  chemically synthesized
atcatctagtcaaaataaaa

SEQ ID NO: 280666 - DNA, 20 bp, Artificial Sequence
  chemically synthesized
caataaatttaatacatgat

SEQ ID NO: 280667 - DNA, 20 bp, Artificial Sequence
  chemically synthesized
ttgaatatgtactgtgttcc

SEQ ID NO: 280668 - DNA, 20 bp, Artificial Sequence
  chemically synthesized
gtactatggttccaggaaca

SEQ ID NO: 280669 - DNA, 20 bp, Artificial Sequence
  chemically synthesized
gtactgtgttcctggaacca

SEQ ID NO: 280670 - DNA, 20 bp, Artificial Sequence
  chemically synthesized
acttaaagtactatggttcc

SEQ ID NO: 280671 - DNA, 20 bp, Artificial Sequence
  chemically synthesized
cacttaaagtactatggttc

SEQ ID NO: 280672 - DNA, 20 bp, Artificial Sequence
  chemically synthesized
atacggcacttaaagtacta

SEQ ID NO: 280673 - DNA, 20 bp, Artificial Sequence
  chemically synthesized
tcctggaaccatagtacttt

SEQ ID NO: 280674 - DNA, 20 bp, Artificial Sequence
  chemically synthesized
aatataaaatacggcactta

SEQ ID NO: 280675 - DNA, 20 bp, Artificial Sequence
  chemically synthesized
tgtgagcaaaatataaaata

SEQ ID NO: 280676 - DNA, 20 bp, Artificial Sequence
  chemically synthesized
tcatagggggttttttttgt

SEQ ID NO: 280677 - DNA, 20 bp, Artificial Sequence
  chemically synthesized
tcctcatcctgtttcatagg

SEQ ID NO: 280678 - DNA, 20 bp, Artificial Sequence
  chemically synthesized
ttcctcatcctgtttcatag

SEQ ID NO: 280679 - DNA, 20 bp, Artificial Sequence
  chemically synthesized
aaaaaaaaccccctatgaaa

SEQ ID NO: 280680 - DNA, 20 bp, Artificial Sequence
  chemically synthesized
tttcctcatcctgtttcata

SEQ ID NO: 280681 - DNA, 20 bp, Artificial Sequence
  chemically synthesized
aaaaaaaccccctatgaaac

SEQ ID NO: 280682 - DNA, 20 bp, Artificial Sequence
  chemically synthesized
gtttcctcatcctgtttcat

SEQ ID NO: 280683 - DNA, 20 bp, Artificial Sequence
  chemically synthesized
cgtttcctcatcctgtttca

SEQ ID NO: 280684 - DNA, 20 bp, Artificial Sequence
  chemically synthesized
aaccccctatgaaacaggat

SEQ ID NO: 280685 - DNA, 20 bp, Artificial Sequence
  chemically synthesized
accccctatgaaacaggatg

SEQ ID NO: 280686 - DNA, 20 bp, Artificial Sequence
  chemically synthesized
gaaacaggatgaggaaacgt

SEQ ID NO: 280687 - DNA, 20 bp, Artificial Sequence
  chemically synthesized
ggctatgtgattttgagtaa

SEQ ID NO: 280688 - DNA, 20 bp, Artificial Sequence
  chemically synthesized
ttcactggctatgtgatttt

SEQ ID NO: 280689 - DNA, 20 bp, Artificial Sequence
  chemically synthesized
aactgttactcaaaatcaca

SEQ ID NO: 280690 - DNA, 20 bp, Artificial Sequence
  chemically synthesized
gttactcaaaatcacatagc

SEQ ID NO: 280691 - DNA, 20 bp, Artificial Sequence
  chemically synthesized
caaatccctctgtaattcac

SEQ ID NO: 280692 - DNA, 20 bp, Artificial Sequence
  chemically synthesized
atcacatagccagtgaatta

SEQ ID NO: 280693 - DNA, 20 bp, Artificial Sequence
  chemically synthesized
cacatagccagtgaattaca

SEQ ID NO: 280694 - DNA, 20 bp, Artificial Sequence
  chemically synthesized
acatagccagtgaattacag

SEQ ID NO: 280695 - DNA, 20 bp, Artificial Sequence
  chemically synthesized
catagccagtgaattacaga

SEQ ID NO: 280696 - DNA, 20 bp, Artificial Sequence
  chemically synthesized
tgaattacagagggatttgc

SEQ ID NO: 280697 - DNA, 20 bp, Artificial Sequence
  chemically synthesized
aaaggcaaaaaattgataac

SEQ ID NO: 280698 - DNA, 20 bp, Artificial Sequence
  chemically synthesized
aaaaacaggatcatgttgaa

SEQ ID NO: 280699 - DNA, 20 bp, Artificial Sequence
  chemically synthesized
caaaaacaggatcatgttga

SEQ ID NO: 280700 - DNA, 20 bp, Artificial Sequence
  chemically synthesized
aatgttcccgtgtcaaaaac

SEQ ID NO: 280701 - DNA, 20 bp, Artificial Sequence
  chemically synthesized
aaatgttcccgtgtcaaaaa

SEQ ID NO: 280702 - DNA, 20 bp, Artificial Sequence
  chemically synthesized
acatgatcctgtttttgaca

SEQ ID NO: 280703 - DNA, 20 bp, Artificial Sequence
  chemically synthesized
catgatcctgtttttgacac

SEQ ID NO: 280704 - DNA, 20 bp, Artificial Sequence
  chemically synthesized
gggaacatttctccccttgc

SEQ ID NO: 280705 - DNA, 20 bp, Artificial Sequence
  chemically synthesized
atcatgtcagctggcaaggg

SEQ ID NO: 280706 - DNA, 20 bp, Artificial Sequence
  chemically synthesized
atatcatgtcagctggcaag

SEQ ID NO: 280707 - DNA, 20 bp, Artificial Sequence
  chemically synthesized
aatatcatgtcagctggcaa

SEQ ID NO: 280708 - DNA, 20 bp, Artificial Sequence
  chemically synthesized
taatatcatgtcagctggca

SEQ ID NO: 280709 - DNA, 20 bp, Artificial Sequence
  chemically synthesized
ttaatatcatgtcagctggc

SEQ ID NO: 280710 - DNA, 20 bp, Artificial Sequence
  chemically synthesized
gaacttaatatcatgtcagc

SEQ ID NO: 280711 - DNA, 20 bp, Artificial Sequence
  chemically synthesized
gacagaacttaatatcatgt

SEQ ID NO: 280712 - DNA, 20 bp, Artificial Sequence
  chemically synthesized
ttgccagctgacatgatatt

SEQ ID NO: 280713 - DNA, 20 bp, Artificial Sequence
  chemically synthesized
gacatgatattaagttctgt

SEQ ID NO: 280714 - DNA, 20 bp, Artificial Sequence
  chemically synthesized
gatattaagttctgtcagta

SEQ ID NO: 280715 - DNA, 20 bp, Artificial Sequence
  chemically synthesized
atattaagttctgtcagtaa

SEQ ID NO: 280716 - DNA, 20 bp, Artificial Sequence
  chemically synthesized
actccagcatcctttactga

SEQ ID NO: 280717 - DNA, 20 bp, Artificial Sequence
  chemically synthesized
gttctgtcagtaaaggatgc

SEQ ID NO: 280718 - DNA, 20 bp, Artificial Sequence
  chemically synthesized
tctgtcagtaaaggatgctg

SEQ ID NO: 280719 - DNA, 20 bp, Artificial Sequence
  chemically synthesized
tacctcccccattgtcactc

SEQ ID NO: 280720 - DNA, 20 bp, Artificial Sequence
  chemically synthesized
aaaggatgctggagtgacaa

SEQ ID NO: 280721 - DNA, 20 bp, Artificial Sequence
  chemically synthesized
aaggatgctggagtgacaat

SEQ ID NO: 280722 - DNA, 20 bp, Artificial Sequence
  chemically synthesized
aggatgctggagtgacaatg

SEQ ID NO: 280723 - DNA, 20 bp, Artificial Sequence
  chemically synthesized
ggatgctggagtgacaatgg

SEQ ID NO: 280724 - DNA, 20 bp, Artificial Sequence
  chemically synthesized
atgctggagtgacaatgggg

SEQ ID NO: 280725 - DNA, 20 bp, Artificial Sequence
  chemically synthesized
tgctggagtgacaatggggg

SEQ ID NO: 280726 - DNA, 20 bp, Artificial Sequence
  chemically synthesized
tggagtgacaatgggggagg

SEQ ID NO: 280727 - DNA, 20 bp, Artificial Sequence
  chemically synthesized
gagtgacaatgggggaggta

SEQ ID NO: 280728 - DNA, 20 bp, Artificial Sequence
  chemically synthesized
agtgacaatgggggaggtag

SEQ ID NO: 280729 - DNA, 20 bp, Artificial Sequence
  chemically synthesized
aggtagaggtttgtctgtcc

SEQ ID NO: 280730 - DNA, 20 bp, Artificial Sequence
  chemically synthesized
gaattaaaagcacactggga

SEQ ID NO: 280731 - DNA, 20 bp, Artificial Sequence
  chemically synthesized
aaaagaattaaaagcacact

SEQ ID NO: 280732 - DNA, 20 bp, Artificial Sequence
  chemically synthesized
aaaaagaattaaaagcacac

SEQ ID NO: 280733 - DNA, 20 bp, Artificial Sequence
  chemically synthesized
caggtttgaaaaagaattaa

SEQ ID NO: 280734 - DNA, 20 bp, Artificial Sequence
  chemically synthesized
ccagagtcacaggtttgaaa

SEQ ID NO: 280735 - DNA, 20 bp, Artificial Sequence
  chemically synthesized
ctttttcaaacctgtgactc

SEQ ID NO: 280736 - DNA, 20 bp, Artificial Sequence
  chemically synthesized
ataggccagcccagagtcac

SEQ ID NO: 280737 - DNA, 20 bp, Artificial Sequence
  chemically synthesized
tttttcaaacctgtgactct

SEQ ID NO: 280738 - DNA, 20 bp, Artificial Sequence
  chemically synthesized
cataggccagcccagagtca

SEQ ID NO: 280739 - DNA, 20 bp, Artificial Sequence
  chemically synthesized
tcaaacctgtgactctgggc

SEQ ID NO: 280740 - DNA, 20 bp, Artificial Sequence
  chemically synthesized
gcattccataggccagccca

SEQ ID NO: 280741 - DNA, 20 bp, Artificial Sequence
  chemically synthesized
gggcattccataggccagcc

SEQ ID NO: 280742 - DNA, 20 bp, Artificial Sequence
  chemically synthesized
tgtgactctgggctggccta

SEQ ID NO: 280743 - DNA, 20 bp, Artificial Sequence
  chemically synthesized
ttactgggcattccataggc

SEQ ID NO: 280744 - DNA, 20 bp, Artificial Sequence
  chemically synthesized
agccttactgggcattccat

SEQ ID NO: 280745 - DNA, 20 bp, Artificial Sequence
  chemically synthesized
gagccttactgggcattcca

SEQ ID NO: 280746 - DNA, 20 bp, Artificial Sequence
  chemically synthesized
gggctggcctatggaatgcc

SEQ ID NO: 280747 - DNA, 20 bp, Artificial Sequence
  chemically synthesized
tggcctatggaatgcccagt

SEQ ID NO: 280748 - DNA, 20 bp, Artificial Sequence
  chemically synthesized
ggcctatggaatgcccagta

SEQ ID NO: 280749 - DNA, 20 bp, Artificial Sequence
  chemically synthesized
tggatgaggtgagccttact

SEQ ID NO: 280750 - DNA, 20 bp, Artificial Sequence
  chemically synthesized
gtggatgaggtgagccttac

SEQ ID NO: 280751 - DNA, 20 bp, Artificial Sequence
  chemically synthesized
taaagtggggtggatgaggt

SEQ ID NO: 280752 - DNA, 20 bp, Artificial Sequence
  chemically synthesized
tgggtaaagtggggtggatg

SEQ ID NO: 280753 - DNA, 20 bp, Artificial Sequence
  chemically synthesized
ctgggtaaagtggggtggat

SEQ ID NO: 280754 - DNA, 20 bp, Artificial Sequence
  chemically synthesized
gtcttctgggtaaagtgggg

SEQ ID NO: 280755 - DNA, 20 bp, Artificial Sequence
  chemically synthesized
aaagtcttctgggtaaagtg

SEQ ID NO: 280756 - DNA, 20 bp, Artificial Sequence
  chemically synthesized
gaaagtcttctgggtaaagt

SEQ ID NO: 280757 - DNA, 20 bp, Artificial Sequence
  chemically synthesized
ctcatccaccccactttacc

SEQ ID NO: 280758 - DNA, 20 bp, Artificial Sequence
  chemically synthesized
tgaaagtcttctgggtaaag

SEQ ID NO: 280759 - DNA, 20 bp, Artificial Sequence
  chemically synthesized
atccaccccactttacccag

SEQ ID NO: 280760 - DNA, 20 bp, Artificial Sequence
  chemically synthesized
tgctgaaagtcttctgggta

SEQ ID NO: 280761 - DNA, 20 bp, Artificial Sequence
  chemically synthesized
agtgttgctgaaagtcttct

SEQ ID NO: 280762 - DNA, 20 bp, Artificial Sequence
  chemically synthesized
tagtgttgctgaaagtcttc

SEQ ID NO: 280763 - DNA, 20 bp, Artificial Sequence
  chemically synthesized
cactttacccagaagacttt

SEQ ID NO: 280764 - DNA, 20 bp, Artificial Sequence
  chemically synthesized
acgacccatagtgttgctga

SEQ ID NO: 280765 - DNA, 20 bp, Artificial Sequence
  chemically synthesized
gaagactttcagcaacacta

SEQ ID NO: 280766 - DNA, 20 bp, Artificial Sequence
  chemically synthesized
aagactttcagcaacactat

SEQ ID NO: 280767 - DNA, 20 bp, Artificial Sequence
  chemically synthesized
aacttgtcaaacacgaccca

SEQ ID NO: 280768 - DNA, 20 bp, Artificial Sequence
  chemically synthesized
cactatgggtcgtgtttgac

SEQ ID NO: 280769 - DNA, 20 bp, Artificial Sequence
  chemically synthesized
gtcgtgtttgacaagttcta

SEQ ID NO: 280770 - DNA, 20 bp, Artificial Sequence
  chemically synthesized
tcgtgtttgacaagttctat

SEQ ID NO: 280771 - DNA, 20 bp, Artificial Sequence
  chemically synthesized
atttgcttattgggtaccca

SEQ ID NO: 280772 - DNA, 20 bp, Artificial Sequence
  chemically synthesized
aagttctatgggtacccaat

SEQ ID NO: 280773 - DNA, 20 bp, Artificial Sequence
  chemically synthesized
ccatcctcaatttgcttatt

SEQ ID NO: 280774 - DNA, 20 bp, Artificial Sequence
  chemically synthesized
cccatcctcaatttgcttat

SEQ ID NO: 280775 - DNA, 20 bp, Artificial Sequence
  chemically synthesized
gggtacccaataagcaaatt

SEQ ID NO: 280776 - DNA, 20 bp, Artificial Sequence
  chemically synthesized
ggtacccaataagcaaattg

SEQ ID NO: 280777 - DNA, 20 bp, Artificial Sequence
  chemically synthesized
cccaataagcaaattgagga

SEQ ID NO: 280778 - DNA, 20 bp, Artificial Sequence
  chemically synthesized
ccaataagcaaattgaggat

SEQ ID NO: 280779 - DNA, 20 bp, Artificial Sequence
  chemically synthesized
ataagcaaattgaggatggg

SEQ ID NO: 280780 - DNA, 20 bp, Artificial Sequence
  chemically synthesized
gaggatgggtggcaaatcca

SEQ ID NO: 280781 - DNA, 20 bp, Artificial Sequence
  chemically synthesized
aggatgggtggcaaatccat

SEQ ID NO: 280782 - DNA, 20 bp, Artificial Sequence
  chemically synthesized
atgggtggcaaatccatagg

SEQ ID NO: 280783 - DNA, 20 bp, Artificial Sequence
  chemically synthesized
gggctccaggaagctgccta

SEQ ID NO: 280784 - DNA, 20 bp, Artificial Sequence
  chemically synthesized
caaatccataggcagcttcc

SEQ ID NO: 280785 - DNA, 20 bp, Artificial Sequence
  chemically synthesized
aatccataggcagcttcctg

SEQ ID NO: 280786 - DNA, 20 bp, Artificial Sequence
  chemically synthesized
aaatgaggtggggctccagg

SEQ ID NO: 280787 - DNA, 20 bp, Artificial Sequence
  chemically synthesized
aggaaatgaggtggggctcc

SEQ ID NO: 280788 - DNA, 20 bp, Artificial Sequence
  chemically synthesized
gaggaaatgaggtggggctc

SEQ ID NO: 280789 - DNA, 20 bp, Artificial Sequence
  chemically synthesized
aaacttgaggaaatgaggtg

SEQ ID NO: 280790 - DNA, 20 bp, Artificial Sequence
  chemically synthesized
taaacttgaggaaatgaggt

SEQ ID NO: 280791 - DNA, 20 bp, Artificial Sequence
  chemically synthesized
ctaaacttgaggaaatgagg

SEQ ID NO: 280792 - DNA, 20 bp, Artificial Sequence
  chemically synthesized
ctactaaacttgaggaaatg

SEQ ID NO: 280793 - DNA, 20 bp, Artificial Sequence
  chemically synthesized
gctactaaacttgaggaaat

SEQ ID NO: 280794 - DNA, 20 bp, Artificial Sequence
  chemically synthesized
gagccccacctcatttcctc

SEQ ID NO: 280795 - DNA, 20 bp, Artificial Sequence
  chemically synthesized
ccacctcatttcctcaagtt

SEQ ID NO: 280796 - DNA, 20 bp, Artificial Sequence
  chemically synthesized
agtggatgctactaaacttg

SEQ ID NO: 280797 - DNA, 20 bp, Artificial Sequence
  chemically synthesized
tagtggatgctactaaactt

SEQ ID NO: 280798 - DNA, 20 bp, Artificial Sequence
  chemically synthesized
cctcatttcctcaagtttag

SEQ ID NO: 280799 - DNA, 20 bp, Artificial Sequence
  chemically synthesized
aagtttagtagcatccacta

SEQ ID NO: 280800 - DNA, 20 bp, Artificial Sequence
  chemically synthesized
agtttagtagcatccactac

SEQ ID NO: 280801 - DNA, 20 bp, Artificial Sequence
  chemically synthesized
ttagtagcatccactacagg

SEQ ID NO: 280802 - DNA, 20 bp, Artificial Sequence
  chemically synthesized
tggtgggaaactacctgtag

SEQ ID NO: 280803 - DNA, 20 bp, Artificial Sequence
  chemically synthesized
acatggtgggaaactacctg

SEQ ID NO: 280804 - DNA, 20 bp, Artificial Sequence
  chemically synthesized
gtgtattcattggacatggt

SEQ ID NO: 280805 - DNA, 20 bp, Artificial Sequence
  chemically synthesized
ggtgtattcattggacatgg

SEQ ID NO: 280806 - DNA, 20 bp, Artificial Sequence
  chemically synthesized
tctggtgtattcattggaca

SEQ ID NO: 280807 - DNA, 20 bp, Artificial Sequence
  chemically synthesized
aagctgtctggtgtattcat

SEQ ID NO: 280808 - DNA, 20 bp, Artificial Sequence
  chemically synthesized
accatgtccaatgaatacac

SEQ ID NO: 280809 - DNA, 20 bp, Artificial Sequence
  chemically synthesized
tgtccaatgaatacaccaga

SEQ ID NO: 280810 - DNA, 20 bp, Artificial Sequence
  chemically synthesized
gaatttgctagaaagctgtc

SEQ ID NO: 280811 - DNA, 20 bp, Artificial Sequence
  chemically synthesized
gaatacaccagacagctttc

SEQ ID NO: 280812 - DNA, 20 bp, Artificial Sequence
  chemically synthesized
gaaccattgaatttgctaga

SEQ ID NO: 280813 - DNA, 20 bp, Artificial Sequence
  chemically synthesized
tggggaaccattgaatttgc

SEQ ID NO: 280814 - DNA, 20 bp, Artificial Sequence
  chemically synthesized
cagctttctagcaaattcaa

SEQ ID NO: 280815 - DNA, 20 bp, Artificial Sequence
  chemically synthesized
aattcaatggttccccacca

SEQ ID NO: 280816 - DNA, 20 bp, Artificial Sequence
  chemically synthesized
attcaatggttccccaccat

SEQ ID NO: 280817 - DNA, 20 bp, Artificial Sequence
  chemically synthesized
cagggaagtagcctatggtg

SEQ ID NO: 280818 - DNA, 20 bp, Artificial Sequence
  chemically synthesized
acagggaagtagcctatggt

SEQ ID NO: 280819 - DNA, 20 bp, Artificial Sequence
  chemically synthesized
cacagggaagtagcctatgg

SEQ ID NO: 280820 - DNA, 20 bp, Artificial Sequence
  chemically synthesized
attcacagggaagtagccta

SEQ ID NO: 280821 - DNA, 20 bp, Artificial Sequence
  chemically synthesized
tgacaaaattcacagggaag

SEQ ID NO: 280822 - DNA, 20 bp, Artificial Sequence
  chemically synthesized
tgctgacaaaattcacaggg

SEQ ID NO: 280823 - DNA, 20 bp, Artificial Sequence
  chemically synthesized
gaatgctgacaaaattcaca

SEQ ID NO: 280824 - DNA, 20 bp, Artificial Sequence
  chemically synthesized
ggaatgctgacaaaattcac

SEQ ID NO: 280825 - DNA, 20 bp, Artificial Sequence
  chemically synthesized
gggaatgctgacaaaattca

SEQ ID NO: 280826 - DNA, 20 bp, Artificial Sequence
  chemically synthesized
tacttccctgtgaattttgt

SEQ ID NO: 280827 - DNA, 20 bp, Artificial Sequence
  chemically synthesized
gtgtgaagagaatattggag

SEQ ID NO: 280828 - DNA, 20 bp, Artificial Sequence
  chemically synthesized
agtgtgaagagaatattgga

SEQ ID NO: 280829 - DNA, 20 bp, Artificial Sequence
  chemically synthesized
tagtgtgaagagaatattgg

SEQ ID NO: 280830 - DNA, 20 bp, Artificial Sequence
  chemically synthesized
ctagtgtgaagagaatattg

SEQ ID NO: 280831 - DNA, 20 bp, Artificial Sequence
  chemically synthesized
agctagtgtgaagagaatat

SEQ ID NO: 280832 - DNA, 20 bp, Artificial Sequence
  chemically synthesized
ctccaatattctcttcacac

SEQ ID NO: 280833 - DNA, 20 bp, Artificial Sequence
  chemically synthesized
tgagctgaagctagtgtgaa

SEQ ID NO: 280834 - DNA, 20 bp, Artificial Sequence
  chemically synthesized
agtgagctgaagctagtgtg

SEQ ID NO: 280835 - DNA, 20 bp, Artificial Sequence
  chemically synthesized
tattctcttcacactagctt

SEQ ID NO: 280836 - DNA, 20 bp, Artificial Sequence
  chemically synthesized
tatagccagtgagctgaagc

SEQ ID NO: 280837 - DNA, 20 bp, Artificial Sequence
  chemically synthesized
agtctatagccagtgagctg

SEQ ID NO: 280838 - DNA, 20 bp, Artificial Sequence
  chemically synthesized
tcacactagcttcagctcac

SEQ ID NO: 280839 - DNA, 20 bp, Artificial Sequence
  chemically synthesized
agaacaagtctatagccagt

SEQ ID NO: 280840 - DNA, 20 bp, Artificial Sequence
  chemically synthesized
tagcttcagctcactggcta

SEQ ID NO: 280841 - DNA, 20 bp, Artificial Sequence
  chemically synthesized
atccagaacaagtctatagc

SEQ ID NO: 280842 - DNA, 20 bp, Artificial Sequence
  chemically synthesized
cccaatccagaacaagtcta

SEQ ID NO: 280843 - DNA, 20 bp, Artificial Sequence
  chemically synthesized
cactggctatagacttgttc

SEQ ID NO: 280844 - DNA, 20 bp, Artificial Sequence
  chemically synthesized
tcattgacccaatccagaac

SEQ ID NO: 280845 - DNA, 20 bp, Artificial Sequence
  chemically synthesized
gctatagacttgttctggat

SEQ ID NO: 280846 - DNA, 20 bp, Artificial Sequence
  chemically synthesized
ctatagacttgttctggatt

SEQ ID NO: 280847 - DNA, 20 bp, Artificial Sequence
  chemically synthesized
tttccttcattgacccaatc

SEQ ID NO: 280848 - DNA, 20 bp, Artificial Sequence
  chemically synthesized
tgttctggattgggtcaatg

SEQ ID NO: 280849 - DNA, 20 bp, Artificial Sequence
  chemically synthesized
gttctggattgggtcaatga

SEQ ID NO: 280850 - DNA, 20 bp, Artificial Sequence
  chemically synthesized
cctcccatgggatgacagag

SEQ ID NO: 280851 - DNA, 20 bp, Artificial Sequence
  chemically synthesized
ctgcctcccatgggatgaca

SEQ ID NO: 280852 - DNA, 20 bp, Artificial Sequence
  chemically synthesized
gtctgcctcccatgggatga

SEQ ID NO: 280853 - DNA, 20 bp, Artificial Sequence
  chemically synthesized
gaaacttctctgtcatccca

SEQ ID NO: 280854 - DNA, 20 bp, Artificial Sequence
  chemically synthesized
aaacttctctgtcatcccat

SEQ ID NO: 280855 - DNA, 20 bp, Artificial Sequence
  chemically synthesized
acttctctgtcatcccatgg

SEQ ID NO: 280856 - DNA, 20 bp, Artificial Sequence
  chemically synthesized
cttctctgtcatcccatggg

SEQ ID NO: 280857 - DNA, 20 bp, Artificial Sequence
  chemically synthesized
agtgtgtgtctgcctcccat

SEQ ID NO: 280858 - DNA, 20 bp, Artificial Sequence
  chemically synthesized
ctctgtcatcccatgggagg

SEQ ID NO: 280859 - DNA, 20 bp, Artificial Sequence
  chemically synthesized
aagtgtgtgtctgcctccca

SEQ ID NO: 280860 - DNA, 20 bp, Artificial Sequence
  chemically synthesized
aggcagacacacactttcta

SEQ ID NO: 280861 - DNA, 20 bp, Artificial Sequence
  chemically synthesized
cagacacacactttctaaag

SEQ ID NO: 280862 - DNA, 20 bp, Artificial Sequence
  chemically synthesized
tggattcaaacttctttaga

SEQ ID NO: 280863 - DNA, 20 bp, Artificial Sequence
  chemically synthesized
aggctggattcaaacttctt

SEQ ID NO: 280864 - DNA, 20 bp, Artificial Sequence
  chemically synthesized
tttctaaagaagtttgaatc

SEQ ID NO: 280865 - DNA, 20 bp, Artificial Sequence
  chemically synthesized
aagaagtttgaatccagcct

SEQ ID NO: 280866 - DNA, 20 bp, Artificial Sequence
  chemically synthesized
agaagtttgaatccagcctt

SEQ ID NO: 280867 - DNA, 20 bp, Artificial Sequence
  chemically synthesized
ataggagctcaacccaaggc

SEQ ID NO: 280868 - DNA, 20 bp, Artificial Sequence
  chemically synthesized
tttgaatccagccttgggtt

SEQ ID NO: 280869 - DNA, 20 bp, Artificial Sequence
  chemically synthesized
aaagataggagctcaaccca

SEQ ID NO: 280870 - DNA, 20 bp, Artificial Sequence
  chemically synthesized
gaaagataggagctcaaccc

SEQ ID NO: 280871 - DNA, 20 bp, Artificial Sequence
  chemically synthesized
gaactaatatggaaagatag

SEQ ID NO: 280872 - DNA, 20 bp, Artificial Sequence
  chemically synthesized
aggaactaatatggaaagat

SEQ ID NO: 280873 - DNA, 20 bp, Artificial Sequence
  chemically synthesized
aaggaactaatatggaaaga

SEQ ID NO: 280874 - DNA, 20 bp, Artificial Sequence
  chemically synthesized
gagctcctatctttccatat

SEQ ID NO: 280875 - DNA, 20 bp, Artificial Sequence
  chemically synthesized
aaacaaggaactaatatgga

SEQ ID NO: 280876 - DNA, 20 bp, Artificial Sequence
  chemically synthesized
acacaaacaaggaactaata

SEQ ID NO: 280877 - DNA, 20 bp, Artificial Sequence
  chemically synthesized
tgaggaatagtacacaaaca

SEQ ID NO: 280878 - DNA, 20 bp, Artificial Sequence
  chemically synthesized
ctgaggaatagtacacaaac

SEQ ID NO: 280879 - DNA, 20 bp, Artificial Sequence
  chemically synthesized
cttgtttgtgtactattcct

SEQ ID NO: 280880 - DNA, 20 bp, Artificial Sequence
  chemically synthesized
ttgtttgtgtactattcctc

SEQ ID NO: 280881 - DNA, 20 bp, Artificial Sequence
  chemically synthesized
aataccttaagcctgaggaa

SEQ ID NO: 280882 - DNA, 20 bp, Artificial Sequence
  chemically synthesized
gtgtactattcctcaggctt

SEQ ID NO: 280883 - DNA, 20 bp, Artificial Sequence
  chemically synthesized
taaagaataccttaagcctg

SEQ ID NO: 280884 - DNA, 20 bp, Artificial Sequence
  chemically synthesized
tgtactattcctcaggctta

SEQ ID NO: 280885 - DNA, 20 bp, Artificial Sequence
  chemically synthesized
ctaaagaataccttaagcct

SEQ ID NO: 280886 - DNA, 20 bp, Artificial Sequence
  chemically synthesized
agatctctaaagaatacctt

SEQ ID NO: 280887 - DNA, 20 bp, Artificial Sequence
  chemically synthesized
ctcaggcttaaggtattctt

SEQ ID NO: 280888 - DNA, 20 bp, Artificial Sequence
  chemically synthesized
caggcttaaggtattcttta

SEQ ID NO: 280889 - DNA, 20 bp, Artificial Sequence
  chemically synthesized
ggaaataaaagagatctcta

SEQ ID NO: 280890 - DNA, 20 bp, Artificial Sequence
  chemically synthesized
atttttaataggaaataaaa

SEQ ID NO: 280891 - DNA, 20 bp, Artificial Sequence
  chemically synthesized
taatttttaataggaaataa

SEQ ID NO: 280892 - DNA, 20 bp, Artificial Sequence
  chemically synthesized
actggaaattaatttttaat

SEQ ID NO: 280893 - DNA, 20 bp, Artificial Sequence
  chemically synthesized
tactggaaattaatttttaa

SEQ ID NO: 280894 - DNA, 20 bp, Artificial Sequence
  chemically synthesized
tcctattaaaaattaatttc

SEQ ID NO: 280895 - DNA, 20 bp, Artificial Sequence
  chemically synthesized
attaaaaattaatttccagt

SEQ ID NO: 280896 - DNA, 20 bp, Artificial Sequence
  chemically synthesized
aaaaattaatttccagtaag

SEQ ID NO: 280897 - DNA, 20 bp, Artificial Sequence
  chemically synthesized
aataagtattaactacttac

SEQ ID NO: 280898 - DNA, 20 bp, Artificial Sequence
  chemically synthesized
agagatggtttaacacaaat

SEQ ID NO: 280899 - DNA, 20 bp, Artificial Sequence
  chemically synthesized
ctcagtcacttaaacagaga

SEQ ID NO: 280900 - DNA, 20 bp, Artificial Sequence
  chemically synthesized
gtgttaaaccatctctgttt

SEQ ID NO: 280901 - DNA, 20 bp, Artificial Sequence
  chemically synthesized
accactcagtcacttaaaca

SEQ ID NO: 280902 - DNA, 20 bp, Artificial Sequence
  chemically synthesized
aaaccactcagtcacttaaa

SEQ ID NO: 280903 - DNA, 20 bp, Artificial Sequence
  chemically synthesized
ccatctctgtttaagtgact

SEQ ID NO: 280904 - DNA, 20 bp, Artificial Sequence
  chemically synthesized
tctctgtttaagtgactgag

SEQ ID NO: 280905 - DNA, 20 bp, Artificial Sequence
  chemically synthesized
gacagggcacagaaaccact

SEQ ID NO: 280906 - DNA, 20 bp, Artificial Sequence
  chemically synthesized
gtcagggtccagacagggca

SEQ ID NO: 280907 - DNA, 20 bp, Artificial Sequence
  chemically synthesized
agtggtttctgtgccctgtc

SEQ ID NO: 280908 - DNA, 20 bp, Artificial Sequence
  chemically synthesized
tagtagtcagggtccagaca

SEQ ID NO: 280909 - DNA, 20 bp, Artificial Sequence
  chemically synthesized
ttagtagtcagggtccagac

SEQ ID NO: 280910 - DNA, 20 bp, Artificial Sequence
  chemically synthesized
attagtagtcagggtccaga

SEQ ID NO: 280911 - DNA, 20 bp, Artificial Sequence
  chemically synthesized
ttgtattagtagtcagggtc

SEQ ID NO: 280912 - DNA, 20 bp, Artificial Sequence
  chemically synthesized
acaccttgtattagtagtca

SEQ ID NO: 280913 - DNA, 20 bp, Artificial Sequence
  chemically synthesized
aacaccttgtattagtagtc

SEQ ID NO: 280914 - DNA, 20 bp, Artificial Sequence
  chemically synthesized
taacaccttgtattagtagt

SEQ ID NO: 280915 - DNA, 20 bp, Artificial Sequence
  chemically synthesized
tggaccctgactactaatac

SEQ ID NO: 280916 - DNA, 20 bp, Artificial Sequence
  chemically synthesized
agaataacaccttgtattag

SEQ ID NO: 280917 - DNA, 20 bp, Artificial Sequence
  chemically synthesized
ggaccctgactactaataca

SEQ ID NO: 280918 - DNA, 20 bp, Artificial Sequence
  chemically synthesized
gctagaataacaccttgtat

SEQ ID NO: 280919 - DNA, 20 bp, Artificial Sequence
  chemically synthesized
actaatacaaggtgttattc

SEQ ID NO: 280920 - DNA, 20 bp, Artificial Sequence
  chemically synthesized
acaaggtgttattctagccc

SEQ ID NO: 280921 - DNA, 20 bp, Artificial Sequence
  chemically synthesized
aaaatacttgaaacttgggc

SEQ ID NO: 280922 - DNA, 20 bp, Artificial Sequence
  chemically synthesized
gttattctagcccaagtttc

SEQ ID NO: 280923 - DNA, 20 bp, Artificial Sequence
  chemically synthesized
taagaaaatacttgaaactt

SEQ ID NO: 280924 - DNA, 20 bp, Artificial Sequence
  chemically synthesized
ataagaaaatacttgaaact

SEQ ID NO: 280925 - DNA, 20 bp, Artificial Sequence
  chemically synthesized
tcaagtattttcttattcaa

SEQ ID NO: 280926 - DNA, 20 bp, Artificial Sequence
  chemically synthesized
taaagcataaacttttgaat

SEQ ID NO: 280927 - DNA, 20 bp, Artificial Sequence
  chemically synthesized
ttttctggactgagttttta

SEQ ID NO: 280928 - DNA, 20 bp, Artificial Sequence
  chemically synthesized
aagtttatgctttaaaaact

SEQ ID NO: 280929 - DNA, 20 bp, Artificial Sequence
  chemically synthesized
tatgctttaaaaactcagtc

SEQ ID NO: 280930 - DNA, 20 bp, Artificial Sequence
  chemically synthesized
attatcttattttctggact

SEQ ID NO: 280931 - DNA, 20 bp, Artificial Sequence
  chemically synthesized
aaaaactcagtccagaaaat

SEQ ID NO: 280932 - DNA, 20 bp, Artificial Sequence
  chemically synthesized
acacgtattatcttattttc

SEQ ID NO: 280933 - DNA, 20 bp, Artificial Sequence
  chemically synthesized
taagataatacgtgttgaat

SEQ ID NO: 280934 - DNA, 20 bp, Artificial Sequence
  chemically synthesized
aagataatacgtgttgaatc

SEQ ID NO: 280935 - DNA, 20 bp, Artificial Sequence
  chemically synthesized
agataatacgtgttgaatca

SEQ ID NO: 280936 - DNA, 20 bp, Artificial Sequence
  chemically synthesized
aaagaaaaaataattcattt

SEQ ID NO: 280937 - DNA, 20 bp, Artificial Sequence
  chemically synthesized
gaaatgaattattttttctt

SEQ ID NO: 280938 - DNA, 20 bp, Artificial Sequence
  chemically synthesized
aaatgaattattttttcttt

SEQ ID NO: 280939 - DNA, 20 bp, Artificial Sequence
  chemically synthesized
aatgaattattttttctttg

SEQ ID NO: 280940 - DNA, 20 bp, Artificial Sequence
  chemically synthesized
atgaattattttttctttgg

SEQ ID NO: 280941 - DNA, 20 bp, Artificial Sequence
  chemically synthesized
aaaccctgacatttccccca

SEQ ID NO: 280942 - DNA, 20 bp, Artificial Sequence
  chemically synthesized
tttttctttgggggaaatgt

SEQ ID NO: 280943 - DNA, 20 bp, Artificial Sequence
  chemically synthesized
ttttctttgggggaaatgtc

SEQ ID NO: 280944 - DNA, 20 bp, Artificial Sequence
  chemically synthesized
tttctttgggggaaatgtca

SEQ ID NO: 280945 - DNA, 20 bp, Artificial Sequence
  chemically synthesized
ccttctattttaaaggtttt

SEQ ID NO: 280946 - DNA, 20 bp, Artificial Sequence
  chemically synthesized
tataccaaaaacctttaaaa

SEQ ID NO: 280947 - DNA, 20 bp, Artificial Sequence
  chemically synthesized
cttataaccttctattttaa

SEQ ID NO: 280948 - DNA, 20 bp, Artificial Sequence
  chemically synthesized
acttataaccttctatttta

SEQ ID NO: 280949 - DNA, 20 bp, Artificial Sequence
  chemically synthesized
accaaaaacctttaaaatag

SEQ ID NO: 280950 - DNA, 20 bp, Artificial Sequence
  chemically synthesized
ccaaaaacctttaaaataga

SEQ ID NO: 280951 - DNA, 20 bp, Artificial Sequence
  chemically synthesized
cctttaaaatagaaggttat

SEQ ID NO: 280952 - DNA, 20 bp, Artificial Sequence
  chemically synthesized
ttaaaatagaaggttataag

SEQ ID NO: 280953 - DNA, 20 bp, Artificial Sequence
  chemically synthesized
taagtagttttgtgttaata

SEQ ID NO: 280954 - DNA, 20 bp, Artificial Sequence
  chemically synthesized
aagtagttttgtgttaataa

SEQ ID NO: 280955 - DNA, 20 bp, Artificial Sequence
  chemically synthesized
ttgcaatataattacattaa

SEQ ID NO: 280956 - DNA, 20 bp, Artificial Sequence
  chemically synthesized
gcaatataattacattaata

SEQ ID NO: 280957 - DNA, 20 bp, Artificial Sequence
  chemically synthesized
acattaatagagttaatacc

SEQ ID NO: 280958 - DNA, 20 bp, Artificial Sequence
  chemically synthesized
atagagttaataccaagatc

SEQ ID NO: 280959 - DNA, 20 bp, Artificial Sequence
  chemically synthesized
cttactctctaacttgatct

SEQ ID NO: 280960 - DNA, 20 bp, Artificial Sequence
  chemically synthesized
agttaataccaagatcaagt

SEQ ID NO: 280961 - DNA, 20 bp, Artificial Sequence
  chemically synthesized
ttaataccaagatcaagtta

SEQ ID NO: 280962 - DNA, 20 bp, Artificial Sequence
  chemically synthesized
aataccaagatcaagttaga

SEQ ID NO: 280963 - DNA, 20 bp, Artificial Sequence
  chemically synthesized
ccaagatcaagttagagagt

SEQ ID NO: 280964 - DNA, 20 bp, Artificial Sequence
  chemically synthesized
ttagagagtaagctattcct

SEQ ID NO: 280965 - DNA, 20 bp, Artificial Sequence
  chemically synthesized
tagagagtaagctattccta

SEQ ID NO: 280966 - DNA, 20 bp, Artificial Sequence
  chemically synthesized
atctattctgtccttaggaa

SEQ ID NO: 280967 - DNA, 20 bp, Artificial Sequence
  chemically synthesized
gagtaagctattcctaagga

SEQ ID NO: 280968 - DNA, 20 bp, Artificial Sequence
  chemically synthesized
tactcatctattctgtcctt

SEQ ID NO: 280969 - DNA, 20 bp, Artificial Sequence
  chemically synthesized
gtactcatctattctgtcct

SEQ ID NO: 280970 - DNA, 20 bp, Artificial Sequence
  chemically synthesized
agctattcctaaggacagaa

SEQ ID NO: 280971 - DNA, 20 bp, Artificial Sequence
  chemically synthesized
ttcctaaggacagaatagat

SEQ ID NO: 280972 - DNA, 20 bp, Artificial Sequence
  chemically synthesized
cttcagtgtttgacattttt

SEQ ID NO: 280973 - DNA, 20 bp, Artificial Sequence
  chemically synthesized
ctgaaaaatgtcaaacactg

SEQ ID NO: 280974 - DNA, 20 bp, Artificial Sequence
  chemically synthesized
aaaatgtcaaacactgaagt

SEQ ID NO: 280975 - DNA, 20 bp, Artificial Sequence
  chemically synthesized
acctggccaagatccaactt

SEQ ID NO: 280976 - DNA, 20 bp, Artificial Sequence
  chemically synthesized
caaacactgaagttggatct

SEQ ID NO: 280977 - DNA, 20 bp, Artificial Sequence
  chemically synthesized
cactgaagttggatcttggc

SEQ ID NO: 280978 - DNA, 20 bp, Artificial Sequence
  chemically synthesized
actgaagttggatcttggcc

SEQ ID NO: 280979 - DNA, 20 bp, Artificial Sequence
  chemically synthesized
gctgggagatacacctggcc

SEQ ID NO: 280980 - DNA, 20 bp, Artificial Sequence
  chemically synthesized
aaagtgctgggagatacacc

SEQ ID NO: 280981 - DNA, 20 bp, Artificial Sequence
  chemically synthesized
tcttggccaggtgtatctcc

SEQ ID NO: 280982 - DNA, 20 bp, Artificial Sequence
  chemically synthesized
ttggcctcccaaagtgctgg

SEQ ID NO: 280983 - DNA, 20 bp, Artificial Sequence
  chemically synthesized
aggtgtatctcccagcactt

SEQ ID NO: 280984 - DNA, 20 bp, Artificial Sequence
  chemically synthesized
ccttggcctcccaaagtgct

SEQ ID NO: 280985 - DNA, 20 bp, Artificial Sequence
  chemically synthesized
ggtgtatctcccagcacttt

SEQ ID NO: 280986 - DNA, 20 bp, Artificial Sequence
  chemically synthesized
gccttggcctcccaaagtgc

SEQ ID NO: 280987 - DNA, 20 bp, Artificial Sequence
  chemically synthesized
tgtatctcccagcactttgg

SEQ ID NO: 280988 - DNA, 20 bp, Artificial Sequence
  chemically synthesized
gtatctcccagcactttggg

SEQ ID NO: 280989 - DNA, 20 bp, Artificial Sequence
  chemically synthesized
ccacttgccttggcctccca

SEQ ID NO: 280990 - DNA, 20 bp, Artificial Sequence
  chemically synthesized
tcccagcactttgggaggcc

SEQ ID NO: 280991 - DNA, 20 bp, Artificial Sequence
  chemically synthesized
cccagcactttgggaggcca

SEQ ID NO: 280992 - DNA, 20 bp, Artificial Sequence
  chemically synthesized
gcactttgggaggccaaggc

SEQ ID NO: 280993 - DNA, 20 bp, Artificial Sequence
  chemically synthesized
ctttgggaggccaaggcaag

SEQ ID NO: 280994 - DNA, 20 bp, Artificial Sequence
  chemically synthesized
ctcaagctatccacttgcct

SEQ ID NO: 280995 - DNA, 20 bp, Artificial Sequence
  chemically synthesized
gggaggccaaggcaagtgga

SEQ ID NO: 280996 - DNA, 20 bp, Artificial Sequence
  chemically synthesized
ccaaggcaagtggatagctt

SEQ ID NO: 280997 - DNA, 20 bp, Artificial Sequence
  chemically synthesized
gcaagtggatagcttgagcc

SEQ ID NO: 280998 - DNA, 20 bp, Artificial Sequence
  chemically synthesized
caagtggatagcttgagccc

SEQ ID NO: 280999 - DNA, 20 bp, Artificial Sequence
  chemically synthesized
ggtcttgaactcccgggctc

SEQ ID NO: 281000 - DNA, 20 bp, Artificial Sequence
  chemically synthesized
agtggatagcttgagcccgg

SEQ ID NO: 281001 - DNA, 20 bp, Artificial Sequence
  chemically synthesized
caggctggtcttgaactccc

SEQ ID NO: 281002 - DNA, 20 bp, Artificial Sequence
  chemically synthesized
tagcttgagcccgggagttc

SEQ ID NO: 281003 - DNA, 20 bp, Artificial Sequence
  chemically synthesized
ccaggctggtcttgaactcc

SEQ ID NO: 281004 - DNA, 20 bp, Artificial Sequence
  chemically synthesized
tgagcccgggagttcaagac

SEQ ID NO: 281005 - DNA, 20 bp, Artificial Sequence
  chemically synthesized
ccgggagttcaagaccagcc

SEQ ID NO: 281006 - DNA, 20 bp, Artificial Sequence
  chemically synthesized
ttttgccatgttgtccaggc

SEQ ID NO: 281007 - DNA, 20 bp, Artificial Sequence
  chemically synthesized
gttgttttgccatgttgtcc

SEQ ID NO: 281008 - DNA, 20 bp, Artificial Sequence
  chemically synthesized
caagaccagcctggacaaca

SEQ ID NO: 281009 - DNA, 20 bp, Artificial Sequence
  chemically synthesized
tgttgttttgccatgttgtc

SEQ ID NO: 281010 - DNA, 20 bp, Artificial Sequence
  chemically synthesized
gttatttgtgtgtgtgtgtg

SEQ ID NO: 281011 - DNA, 20 bp, Artificial Sequence
  chemically synthesized
cacacacacacacaaataac

SEQ ID NO: 281012 - DNA, 20 bp, Artificial Sequence
  chemically synthesized
acacacacacacaaataacc

SEQ ID NO: 281013 - DNA, 20 bp, Artificial Sequence
  chemically synthesized
acacacacacaaataaccgg

SEQ ID NO: 281014 - DNA, 20 bp, Artificial Sequence
  chemically synthesized
cacacacaaataaccgggag

SEQ ID NO: 281015 - DNA, 20 bp, Artificial Sequence
  chemically synthesized
acacaaataaccgggagtgg

SEQ ID NO: 281016 - DNA, 20 bp, Artificial Sequence
  chemically synthesized
caggtgcatgctgccactcc

SEQ ID NO: 281017 - DNA, 20 bp, Artificial Sequence
  chemically synthesized
ggagtggcagcatgcacctg

SEQ ID NO: 281018 - DNA, 20 bp, Artificial Sequence
  chemically synthesized
gcagcatgcacctgtagtcc

SEQ ID NO: 281019 - DNA, 20 bp, Artificial Sequence
  chemically synthesized
tcctgagtagctgggactac

SEQ ID NO: 281020 - DNA, 20 bp, Artificial Sequence
  chemically synthesized
ctcctgagtagctgggacta

SEQ ID NO: 281021 - DNA, 20 bp, Artificial Sequence
  chemically synthesized
cacctgtagtcccagctact

SEQ ID NO: 281022 - DNA, 20 bp, Artificial Sequence
  chemically synthesized
cctcagcctcctgagtagct

SEQ ID NO: 281023 - DNA, 20 bp, Artificial Sequence
  chemically synthesized
acctgtagtcccagctactc

SEQ ID NO: 281024 - DNA, 20 bp, Artificial Sequence
  chemically synthesized
acctcagcctcctgagtagc

SEQ ID NO: 281025 - DNA, 20 bp, Artificial Sequence
  chemically synthesized
ctgtagtcccagctactcag

SEQ ID NO: 281026 - DNA, 20 bp, Artificial Sequence
  chemically synthesized
tgtagtcccagctactcagg

SEQ ID NO: 281027 - DNA, 20 bp, Artificial Sequence
  chemically synthesized
tcccacctcagcctcctgag

SEQ ID NO: 281028 - DNA, 20 bp, Artificial Sequence
  chemically synthesized
tcttcccacctcagcctcct

SEQ ID NO: 281029 - DNA, 20 bp, Artificial Sequence
  chemically synthesized
tcccagctactcaggaggct

SEQ ID NO: 281030 - DNA, 20 bp, Artificial Sequence
  chemically synthesized
cccagctactcaggaggctg

SEQ ID NO: 281031 - DNA, 20 bp, Artificial Sequence
  chemically synthesized
agctactcaggaggctgagg

SEQ ID NO: 281032 - DNA, 20 bp, Artificial Sequence
  chemically synthesized
gctactcaggaggctgaggt

SEQ ID NO: 281033 - DNA, 20 bp, Artificial Sequence
  chemically synthesized
actcaggaggctgaggtggg

SEQ ID NO: 281034 - DNA, 20 bp, Artificial Sequence
  chemically synthesized
ctcaggtgatcttcccacct

SEQ ID NO: 281035 - DNA, 20 bp, Artificial Sequence
  chemically synthesized
ctgaggtgggaagatcacct

SEQ ID NO: 281036 - DNA, 20 bp, Artificial Sequence
  chemically synthesized
gtgggaagatcacctgagcc

SEQ ID NO: 281037 - DNA, 20 bp, Artificial Sequence
  chemically synthesized
tgggaagatcacctgagccc

SEQ ID NO: 281038 - DNA, 20 bp, Artificial Sequence
  chemically synthesized
gggaagatcacctgagccca

SEQ ID NO: 281039 - DNA, 20 bp, Artificial Sequence
  chemically synthesized
gcctcgacctccctgggctc

SEQ ID NO: 281040 - DNA, 20 bp, Artificial Sequence
  chemically synthesized
agcctcgacctccctgggct

SEQ ID NO: 281041 - DNA, 20 bp, Artificial Sequence
  chemically synthesized
gaagatcacctgagcccagg

SEQ ID NO: 281042 - DNA, 20 bp, Artificial Sequence
  chemically synthesized
aagatcacctgagcccaggg

SEQ ID NO: 281043 - DNA, 20 bp, Artificial Sequence
  chemically synthesized
actgtagcctcgacctccct

SEQ ID NO: 281044 - DNA, 20 bp, Artificial Sequence
  chemically synthesized
cactgtagcctcgacctccc

SEQ ID NO: 281045 - DNA, 20 bp, Artificial Sequence
  chemically synthesized
cacctgagcccagggaggtc

SEQ ID NO: 281046 - DNA, 20 bp, Artificial Sequence
  chemically synthesized
acctgagcccagggaggtcg

SEQ ID NO: 281047 - DNA, 20 bp, Artificial Sequence
  chemically synthesized
gcccagggaggtcgaggcta

SEQ ID NO: 281048 - DNA, 20 bp, Artificial Sequence
  chemically synthesized
agggaggtcgaggctacagt

SEQ ID NO: 281049 - DNA, 20 bp, Artificial Sequence
  chemically synthesized
ggcatgatcgtggctcactg

SEQ ID NO: 281050 - DNA, 20 bp, Artificial Sequence
  chemically synthesized
ggagtgcagtggcatgatcg

SEQ ID NO: 281051 - DNA, 20 bp, Artificial Sequence
  chemically synthesized
tccctgagactggagtgcag

SEQ ID NO: 281052 - DNA, 20 bp, Artificial Sequence
  chemically synthesized
acgatcatgccactgcactc

SEQ ID NO: 281053 - DNA, 20 bp, Artificial Sequence
  chemically synthesized
ctgtccctgagactggagtg

SEQ ID NO: 281054 - DNA, 20 bp, Artificial Sequence
  chemically synthesized
atgccactgcactccagtct

SEQ ID NO: 281055 - DNA, 20 bp, Artificial Sequence
  chemically synthesized
tgccactgcactccagtctc

SEQ ID NO: 281056 - DNA, 20 bp, Artificial Sequence
  chemically synthesized
ttgctctgtccctgagactg

SEQ ID NO: 281057 - DNA, 20 bp, Artificial Sequence
  chemically synthesized
gccactgcactccagtctca

SEQ ID NO: 281058 - DNA, 20 bp, Artificial Sequence
  chemically synthesized
tcttgctctgtccctgagac

SEQ ID NO: 281059 - DNA, 20 bp, Artificial Sequence
  chemically synthesized
ctgcactccagtctcaggga

SEQ ID NO: 281060 - DNA, 20 bp, Artificial Sequence
  chemically synthesized
gcactccagtctcagggaca

SEQ ID NO: 281061 - DNA, 20 bp, Artificial Sequence
  chemically synthesized
cagggtcttgctctgtccct

SEQ ID NO: 281062 - DNA, 20 bp, Artificial Sequence
  chemically synthesized
tccagtctcagggacagagc

SEQ ID NO: 281063 - DNA, 20 bp, Artificial Sequence
  chemically synthesized
tttttttttttttaaagaca

SEQ ID NO: 281064 - DNA, 20 bp, Artificial Sequence
  chemically synthesized
atttttttttttttaaagac

SEQ ID NO: 281065 - DNA, 20 bp, Artificial Sequence
  chemically synthesized
aatttttttttttttaaaga

SEQ ID NO: 281066 - DNA, 20 bp, Artificial Sequence
  chemically synthesized
ctcaaattttttttttttta

SEQ ID NO: 281067 - DNA, 20 bp, Artificial Sequence
  chemically synthesized
ctttaaaaaaaaaaaaattt

SEQ ID NO: 281068 - DNA, 20 bp, Artificial Sequence
  chemically synthesized
aaaaaatttgagtcttttca

SEQ ID NO: 281069 - DNA, 20 bp, Artificial Sequence
  chemically synthesized
gaccttggcttagctgtgaa

SEQ ID NO: 281070 - DNA, 20 bp, Artificial Sequence
  chemically synthesized
atttgagtcttttcacagct

SEQ ID NO: 281071 - DNA, 20 bp, Artificial Sequence
  chemically synthesized
agtcttttcacagctaagcc

SEQ ID NO: 281072 - DNA, 20 bp, Artificial Sequence
  chemically synthesized
gtcttttcacagctaagcca

SEQ ID NO: 281073 - DNA, 20 bp, Artificial Sequence
  chemically synthesized
ttgtgaaactgaccttggct

SEQ ID NO: 281074 - DNA, 20 bp, Artificial Sequence
  chemically synthesized
tttcacagctaagccaaggt

SEQ ID NO: 281075 - DNA, 20 bp, Artificial Sequence
  chemically synthesized
agtcattgtgaaactgacct

SEQ ID NO: 281076 - DNA, 20 bp, Artificial Sequence
  chemically synthesized
cagttgcatcaaaaaattaa

SEQ ID NO: 281077 - DNA, 20 bp, Artificial Sequence
  chemically synthesized
cagtgtcaggtaggagacag

SEQ ID NO: 281078 - DNA, 20 bp, Artificial Sequence
  chemically synthesized
tatcagtgtcaggtaggaga

SEQ ID NO: 281079 - DNA, 20 bp, Artificial Sequence
  chemically synthesized
tgaatatcagtgtcaggtag

SEQ ID NO: 281080 - DNA, 20 bp, Artificial Sequence
  chemically synthesized
tttgaatatcagtgtcaggt

SEQ ID NO: 281081 - DNA, 20 bp, Artificial Sequence
  chemically synthesized
atttgaatatcagtgtcagg

SEQ ID NO: 281082 - DNA, 20 bp, Artificial Sequence
  chemically synthesized
tctatttgaatatcagtgtc

SEQ ID NO: 281083 - DNA, 20 bp, Artificial Sequence
  chemically synthesized
ttctatttgaatatcagtgt

SEQ ID NO: 281084 - DNA, 20 bp, Artificial Sequence
  chemically synthesized
ttttatttctatttgaatat

SEQ ID NO: 281085 - DNA, 20 bp, Artificial Sequence
  chemically synthesized
acctgacactgatattcaaa

SEQ ID NO: 281086 - DNA, 20 bp, Artificial Sequence
  chemically synthesized
tgtgggttgtgatatggaat

SEQ ID NO: 281087 - DNA, 20 bp, Artificial Sequence
  chemically synthesized
tttcaatgtgggttgtgata

SEQ ID NO: 281088 - DNA, 20 bp, Artificial Sequence
  chemically synthesized
attgaagatcatttcaatgt

SEQ ID NO: 281089 - DNA, 20 bp, Artificial Sequence
  chemically synthesized
aattgaagatcatttcaatg

SEQ ID NO: 281090 - DNA, 20 bp, Artificial Sequence
  chemically synthesized
gctatgtggcaagtaaattg

SEQ ID NO: 281091 - DNA, 20 bp, Artificial Sequence
  chemically synthesized
tcttcaatttacttgccaca

SEQ ID NO: 281092 - DNA, 20 bp, Artificial Sequence
  chemically synthesized
aatagatattgctatgtggc

SEQ ID NO: 281093 - DNA, 20 bp, Artificial Sequence
  chemically synthesized
gtcaaatagatattgctatg

SEQ ID NO: 281094 - DNA, 20 bp, Artificial Sequence
  chemically synthesized
atagcaatatctatttgact

SEQ ID NO: 281095 - DNA, 20 bp, Artificial Sequence
  chemically synthesized
attgctggatctgagtcaaa

SEQ ID NO: 281096 - DNA, 20 bp, Artificial Sequence
  chemically synthesized
atatctatttgactcagatc

SEQ ID NO: 281097 - DNA, 20 bp, Artificial Sequence
  chemically synthesized
gttgcactattgctggatct

SEQ ID NO: 281098 - DNA, 20 bp, Artificial Sequence
  chemically synthesized
atttgactcagatccagcaa

SEQ ID NO: 281099 - DNA, 20 bp, Artificial Sequence
  chemically synthesized
catcattgttgcactattgc

SEQ ID NO: 281100 - DNA, 20 bp, Artificial Sequence
  chemically synthesized
gcaatagtgcaacaatgatg

SEQ ID NO: 281101 - DNA, 20 bp, Artificial Sequence
  chemically synthesized
caatagtgcaacaatgatga

SEQ ID NO: 281102 - DNA, 20 bp, Artificial Sequence
  chemically synthesized
gtgcaacaatgatgaaggac

SEQ ID NO: 281103 - DNA, 20 bp, Artificial Sequence
  chemically synthesized
gcaacaatgatgaaggacca

SEQ ID NO: 281104 - DNA, 20 bp, Artificial Sequence
  chemically synthesized
ggggaattccaaacaatctc

SEQ ID NO: 281105 - DNA, 20 bp, Artificial Sequence
  chemically synthesized
atgaaggaccagagattgtt

SEQ ID NO: 281106 - DNA, 20 bp, Artificial Sequence
  chemically synthesized
ggaattggggattggaaaag

SEQ ID NO: 281107 - DNA, 20 bp, Artificial Sequence
  chemically synthesized
aggaattggggattggaaaa

SEQ ID NO: 281108 - DNA, 20 bp, Artificial Sequence
  chemically synthesized
aaggaattggggattggaaa

SEQ ID NO: 281109 - DNA, 20 bp, Artificial Sequence
  chemically synthesized
taaggaattggggattggaa

SEQ ID NO: 281110 - DNA, 20 bp, Artificial Sequence
  chemically synthesized
caacataaggaattggggat

SEQ ID NO: 281111 - DNA, 20 bp, Artificial Sequence
  chemically synthesized
caaatcaacataaggaattg

SEQ ID NO: 281112 - DNA, 20 bp, Artificial Sequence
  chemically synthesized
ccaaatcaacataaggaatt

SEQ ID NO: 281113 - DNA, 20 bp, Artificial Sequence
  chemically synthesized
tccaaatcaacataaggaat

SEQ ID NO: 281114 - DNA, 20 bp, Artificial Sequence
  chemically synthesized
attttatccaaatcaacata

SEQ ID NO: 281115 - DNA, 20 bp, Artificial Sequence
  chemically synthesized
tattttatccaaatcaacat

SEQ ID NO: 281116 - DNA, 20 bp, Artificial Sequence
  chemically synthesized
cccaattccttatgttgatt

SEQ ID NO: 281117 - DNA, 20 bp, Artificial Sequence
  chemically synthesized
atgttgatttggataaaata

SEQ ID NO: 281118 - DNA, 20 bp, Artificial Sequence
  chemically synthesized
taaaatatggatatgccacc

SEQ ID NO: 281119 - DNA, 20 bp, Artificial Sequence
  chemically synthesized
aaaatatggatatgccaccc

SEQ ID NO: 281120 - DNA, 20 bp, Artificial Sequence
  chemically synthesized
ctccagtcttgaatcctggg

SEQ ID NO: 281121 - DNA, 20 bp, Artificial Sequence
  chemically synthesized
ggatatgccacccaggattc

SEQ ID NO: 281122 - DNA, 20 bp, Artificial Sequence
  chemically synthesized
cacctccagtcttgaatcct

SEQ ID NO: 281123 - DNA, 20 bp, Artificial Sequence
  chemically synthesized
gcacctccagtcttgaatcc

SEQ ID NO: 281124 - DNA, 20 bp, Artificial Sequence
  chemically synthesized
tgccacccaggattcaagac

SEQ ID NO: 281125 - DNA, 20 bp, Artificial Sequence
  chemically synthesized
ccacccaggattcaagactg

SEQ ID NO: 281126 - DNA, 20 bp, Artificial Sequence
  chemically synthesized
cacccaggattcaagactgg

SEQ ID NO: 281127 - DNA, 20 bp, Artificial Sequence
  chemically synthesized
aaatgtaccagcagcacctc

SEQ ID NO: 281128 - DNA, 20 bp, Artificial Sequence
  chemically synthesized
ttcaagactggaggtgctgc

SEQ ID NO: 281129 - DNA, 20 bp, Artificial Sequence
  chemically synthesized
gatatctgcaaatgtaccag

SEQ ID NO: 281130 - DNA, 20 bp, Artificial Sequence
  chemically synthesized
gcagatatctgcaaatgtac

SEQ ID NO: 281131 - DNA, 20 bp, Artificial Sequence
  chemically synthesized
aggtgctgctggtacatttg

SEQ ID NO: 281132 - DNA, 20 bp, Artificial Sequence
  chemically synthesized
agaagtatgtgagggtaggg

SEQ ID NO: 281133 - DNA, 20 bp, Artificial Sequence
  chemically synthesized
aagagaagtatgtgagggta

SEQ ID NO: 281134 - DNA, 20 bp, Artificial Sequence
  chemically synthesized
gaagagaagtatgtgagggt

SEQ ID NO: 281135 - DNA, 20 bp, Artificial Sequence
  chemically synthesized
tgaagagaagtatgtgaggg

SEQ ID NO: 281136 - DNA, 20 bp, Artificial Sequence
  chemically synthesized
ttctgaagagaagtatgtga

SEQ ID NO: 281137 - DNA, 20 bp, Artificial Sequence
  chemically synthesized
attctgaagagaagtatgtg

SEQ ID NO: 281138 - DNA, 20 bp, Artificial Sequence
  chemically synthesized
aattctgaagagaagtatgt

SEQ ID NO: 281139 - DNA, 20 bp, Artificial Sequence
  chemically synthesized
taccctcacatacttctctt

SEQ ID NO: 281140 - DNA, 20 bp, Artificial Sequence
  chemically synthesized
ctctatccaattctgaagag

SEQ ID NO: 281141 - DNA, 20 bp, Artificial Sequence
  chemically synthesized
cttctctatccaattctgaa

SEQ ID NO: 281142 - DNA, 20 bp, Artificial Sequence
  chemically synthesized
cacatacttctcttcagaat

SEQ ID NO: 281143 - DNA, 20 bp, Artificial Sequence
  chemically synthesized
ctcttctctatccaattctg

SEQ ID NO: 281144 - DNA, 20 bp, Artificial Sequence
  chemically synthesized
tacttctcttcagaattgga

SEQ ID NO: 281145 - DNA, 20 bp, Artificial Sequence
  chemically synthesized
cttctcttcagaattggata

SEQ ID NO: 281146 - DNA, 20 bp, Artificial Sequence
  chemically synthesized
ctcttcagaattggatagag

SEQ ID NO: 281147 - DNA, 20 bp, Artificial Sequence
  chemically synthesized
cttcagaattggatagagaa

SEQ ID NO: 281148 - DNA, 20 bp, Artificial Sequence
  chemically synthesized
ttcagaattggatagagaag

SEQ ID NO: 281149 - DNA, 20 bp, Artificial Sequence
  chemically synthesized
gagaagaggttttcctactc

SEQ ID NO: 281150 - DNA, 20 bp, Artificial Sequence
  chemically synthesized
agaagaggttttcctactca

SEQ ID NO: 281151 - DNA, 20 bp, Artificial Sequence
  chemically synthesized
tgaaaaggaacgccttgagt

SEQ ID NO: 281152 - DNA, 20 bp, Artificial Sequence
  chemically synthesized
ttgaaaaggaacgccttgag

SEQ ID NO: 281153 - DNA, 20 bp, Artificial Sequence
  chemically synthesized
agattgaaaaggaacgcctt

SEQ ID NO: 281154 - DNA, 20 bp, Artificial Sequence
  chemically synthesized
gacatgcttacagattgaaa

SEQ ID NO: 281155 - DNA, 20 bp, Artificial Sequence
  chemically synthesized
tgacatgcttacagattgaa

SEQ ID NO: 281156 - DNA, 20 bp, Artificial Sequence
  chemically synthesized
ggcgttccttttcaatctgt

SEQ ID NO: 281157 - DNA, 20 bp, Artificial Sequence
  chemically synthesized
gggaccttttgacatgctta

SEQ ID NO: 281158 - DNA, 20 bp, Artificial Sequence
  chemically synthesized
tcaatctgtaagcatgtcaa

SEQ ID NO: 281159 - DNA, 20 bp, Artificial Sequence
  chemically synthesized
caatctgtaagcatgtcaaa

SEQ ID NO: 281160 - DNA, 20 bp, Artificial Sequence
  chemically synthesized
ttattgaatagtcaatgtcg

SEQ ID NO: 281161 - DNA, 20 bp, Artificial Sequence
  chemically synthesized
cttattgaatagtcaatgtc

SEQ ID NO: 281162 - DNA, 20 bp, Artificial Sequence
  chemically synthesized
acttattgaatagtcaatgt

SEQ ID NO: 281163 - DNA, 20 bp, Artificial Sequence
  chemically synthesized
cccgacattgactattcaat

SEQ ID NO: 281164 - DNA, 20 bp, Artificial Sequence
  chemically synthesized
ttgactaatgacttattgaa

SEQ ID NO: 281165 - DNA, 20 bp, Artificial Sequence
  chemically synthesized
ttgactattcaataagtcat

SEQ ID NO: 281166 - DNA, 20 bp, Artificial Sequence
  chemically synthesized
ttcaataagtcattagtcaa

SEQ ID NO: 281167 - DNA, 20 bp, Artificial Sequence
  chemically synthesized
tggtttcatgcatactaccc

SEQ ID NO: 281168 - DNA, 20 bp, Artificial Sequence
  chemically synthesized
agggggggtagtaactaggg

SEQ ID NO: 281169 - DNA, 20 bp, Artificial Sequence
  chemically synthesized
ataagggggggtagtaacta

SEQ ID NO: 281170 - DNA, 20 bp, Artificial Sequence
  chemically synthesized
aataagggggggtagtaact

SEQ ID NO: 281171 - DNA, 20 bp, Artificial Sequence
  chemically synthesized
gaataagggggggtagtaac

SEQ ID NO: 281172 - DNA, 20 bp, Artificial Sequence
  chemically synthesized
aaaaagagaataaggggggg

SEQ ID NO: 281173 - DNA, 20 bp, Artificial Sequence
  chemically synthesized
agaaaaaagagaataagggg

SEQ ID NO: 281174 - DNA, 20 bp, Artificial Sequence
  chemically synthesized
gagaaaaaagagaataaggg

SEQ ID NO: 281175 - DNA, 20 bp, Artificial Sequence
  chemically synthesized
agagaaaaaagagaataagg

SEQ ID NO: 281176 - DNA, 20 bp, Artificial Sequence
  chemically synthesized
aagagaaaaaagagaataag

SEQ ID NO: 281177 - DNA, 20 bp, Artificial Sequence
  chemically synthesized
gaagagaaaaaagagaataa

SEQ ID NO: 281178 - DNA, 20 bp, Artificial Sequence
  chemically synthesized
tgaagagaaaaaagagaata

SEQ ID NO: 281179 - DNA, 20 bp, Artificial Sequence
  chemically synthesized
atgaagagaaaaaagagaat

SEQ ID NO: 281180 - DNA, 20 bp, Artificial Sequence
  chemically synthesized
taacgtatgaagagaaaaaa

SEQ ID NO: 281181 - DNA, 20 bp, Artificial Sequence
  chemically synthesized
tataacgtatgaagagaaaa

SEQ ID NO: 281182 - DNA, 20 bp, Artificial Sequence
  chemically synthesized
caaataatataacgtatgaa

SEQ ID NO: 281183 - DNA, 20 bp, Artificial Sequence
  chemically synthesized
aacaaataatataacgtatg

SEQ ID NO: 281184 - DNA, 20 bp, Artificial Sequence
  chemically synthesized
actgatttcctagaatgtgc

SEQ ID NO: 281185 - DNA, 20 bp, Artificial Sequence
  chemically synthesized
tttttatgtcttgcacattc

SEQ ID NO: 281186 - DNA, 20 bp, Artificial Sequence
  chemically synthesized
ttttatgtcttgcacattct

SEQ ID NO: 281187 - DNA, 20 bp, Artificial Sequence
  chemically synthesized
tcttgcacattctaggaaat

SEQ ID NO: 281188 - DNA, 20 bp, Artificial Sequence
  chemically synthesized
aggaagagttactgatttcc

SEQ ID NO: 281189 - DNA, 20 bp, Artificial Sequence
  chemically synthesized
aacattggttagttaaggaa

SEQ ID NO: 281190 - DNA, 20 bp, Artificial Sequence
  chemically synthesized
aaaacattggttagttaagg

SEQ ID NO: 281191 - DNA, 20 bp, Artificial Sequence
  chemically synthesized
ttaaaaacattggttagtta

SEQ ID NO: 281192 - DNA, 20 bp, Artificial Sequence
  chemically synthesized
cttaaaaacattggttagtt

SEQ ID NO: 281193 - DNA, 20 bp, Artificial Sequence
  chemically synthesized
cataacttaaaaacattggt

SEQ ID NO: 281194 - DNA, 20 bp, Artificial Sequence
  chemically synthesized
ccttcataacttaaaaacat

SEQ ID NO: 281195 - DNA, 20 bp, Artificial Sequence
  chemically synthesized
cttaactaaccaatgttttt

SEQ ID NO: 281196 - DNA, 20 bp, Artificial Sequence
  chemically synthesized
accaatgtttttaagttatg

SEQ ID NO: 281197 - DNA, 20 bp, Artificial Sequence
  chemically synthesized
ccaatgtttttaagttatga

SEQ ID NO: 281198 - DNA, 20 bp, Artificial Sequence
  chemically synthesized
tgtttttaagttatgaaggt

SEQ ID NO: 281199 - DNA, 20 bp, Artificial Sequence
  chemically synthesized
ggttctatggtttgatgagt

SEQ ID NO: 281200 - DNA, 20 bp, Artificial Sequence
  chemically synthesized
tggttctatggtttgatgag

SEQ ID NO: 281201 - DNA, 20 bp, Artificial Sequence
  chemically synthesized
atatggttctatggtttgat

SEQ ID NO: 281202 - DNA, 20 bp, Artificial Sequence
  chemically synthesized
ttttcctactcatcaaacca

SEQ ID NO: 281203 - DNA, 20 bp, Artificial Sequence
  chemically synthesized
acatgtgagatatggttcta

SEQ ID NO: 281204 - DNA, 20 bp, Artificial Sequence
  chemically synthesized
catctactacatgtgagata

SEQ ID NO: 281205 - DNA, 20 bp, Artificial Sequence
  chemically synthesized
atagaaccatatctcacatg

SEQ ID NO: 281206 - DNA, 20 bp, Artificial Sequence
  chemically synthesized
tgagtacatctactacatgt

SEQ ID NO: 281207 - DNA, 20 bp, Artificial Sequence
  chemically synthesized
gaaccatatctcacatgtag

SEQ ID NO: 281208 - DNA, 20 bp, Artificial Sequence
  chemically synthesized
tcacatgtagtagatgtact

SEQ ID NO: 281209 - DNA, 20 bp, Artificial Sequence
  chemically synthesized
atgtagtagatgtactcagt

SEQ ID NO: 281210 - DNA, 20 bp, Artificial Sequence
  chemically synthesized
tagttttatattcacttact

SEQ ID NO: 281211 - DNA, 20 bp, Artificial Sequence
  chemically synthesized
acccattttataatgatgtt

SEQ ID NO: 281212 - DNA, 20 bp, Artificial Sequence
  chemically synthesized
aactaaacatcattataaaa

SEQ ID NO: 281213 - DNA, 20 bp, Artificial Sequence
  chemically synthesized
actaaacatcattataaaat

SEQ ID NO: 281214 - DNA, 20 bp, Artificial Sequence
  chemically synthesized
agaatggattatttgtcaag

SEQ ID NO: 281215 - DNA, 20 bp, Artificial Sequence
  chemically synthesized
ctaagaatggattatttgtc

SEQ ID NO: 281216 - DNA, 20 bp, Artificial Sequence
  chemically synthesized
cttgacaaataatccattct

SEQ ID NO: 281217 - DNA, 20 bp, Artificial Sequence
  chemically synthesized
ttgacaaataatccattctt

SEQ ID NO: 281218 - DNA, 20 bp, Artificial Sequence
  chemically synthesized
gacaaataatccattcttag

SEQ ID NO: 281219 - DNA, 20 bp, Artificial Sequence
  chemically synthesized
tgcatactatctcctaagaa

SEQ ID NO: 281220 - DNA, 20 bp, Artificial Sequence
  chemically synthesized
aataatccattcttaggaga

SEQ ID NO: 281221 - DNA, 20 bp, Artificial Sequence
  chemically synthesized
tgttttgcatactatctcct

SEQ ID NO: 281222 - DNA, 20 bp, Artificial Sequence
  chemically synthesized
atagtatgcaaaacactgac

SEQ ID NO: 281223 - DNA, 20 bp, Artificial Sequence
  chemically synthesized
tagtatgcaaaacactgact

SEQ ID NO: 281224 - DNA, 20 bp, Artificial Sequence
  chemically synthesized
gtatgcaaaacactgactag

SEQ ID NO: 281225 - DNA, 20 bp, Artificial Sequence
  chemically synthesized
aatagcaaatttctcctagt

SEQ ID NO: 281226 - DNA, 20 bp, Artificial Sequence
  chemically synthesized
acaaaatagcaaatttctcc

SEQ ID NO: 281227 - DNA, 20 bp, Artificial Sequence
  chemically synthesized
aaatcaaaactaaaacaaaa

SEQ ID NO: 281228 - DNA, 20 bp, Artificial Sequence
  chemically synthesized
agaaatttgctattttgttt

SEQ ID NO: 281229 - DNA, 20 bp, Artificial Sequence
  chemically synthesized
aaattttcatatatcacaca

SEQ ID NO: 281230 - DNA, 20 bp, Artificial Sequence
  chemically synthesized
atatatgaaaatttatctat

SEQ ID NO: 281231 - DNA, 20 bp, Artificial Sequence
  chemically synthesized
aaataacactacatttctta

SEQ ID NO: 281232 - DNA, 20 bp, Artificial Sequence
  chemically synthesized
aaatttatctataagaaatg

SEQ ID NO: 281233 - DNA, 20 bp, Artificial Sequence
  chemically synthesized
gaaatgtagtgttatttatg

SEQ ID NO: 281234 - DNA, 20 bp, Artificial Sequence
  chemically synthesized
tttatgaagaataaataata

SEQ ID NO: 281235 - DNA, 20 bp, Artificial Sequence
  chemically synthesized
ttatgaagaataaataatat

SEQ ID NO: 281236 - DNA, 20 bp, Artificial Sequence
  chemically synthesized
tatgaagaataaataatatg

SEQ ID NO: 281237 - DNA, 20 bp, Artificial Sequence
  chemically synthesized
taaataatatggggtactaa

SEQ ID NO: 281238 - DNA, 20 bp, Artificial Sequence
  chemically synthesized
aataatacatgcaattctgt

SEQ ID NO: 281239 - DNA, 20 bp, Artificial Sequence
  chemically synthesized
aacagaattgcatgtattat

SEQ ID NO: 281240 - DNA, 20 bp, Artificial Sequence
  chemically synthesized
agaattgcatgtattattag

SEQ ID NO: 281241 - DNA, 20 bp, Artificial Sequence
  chemically synthesized
tgtgacataacaaatgtgtg

SEQ ID NO: 281242 - DNA, 20 bp, Artificial Sequence
  chemically synthesized
cataacaaatgtgtgtggaa

SEQ ID NO: 281243 - DNA, 20 bp, Artificial Sequence
  chemically synthesized
taacaaatgtgtgtggaatg

SEQ ID NO: 281244 - DNA, 20 bp, Artificial Sequence
  chemically synthesized
aacaaatgtgtgtggaatgg

SEQ ID NO: 281245 - DNA, 20 bp, Artificial Sequence
  chemically synthesized
acaaatgtgtgtggaatgga

SEQ ID NO: 281246 - DNA, 20 bp, Artificial Sequence
  chemically synthesized
aaatgtgtgtggaatggagg

SEQ ID NO: 281247 - DNA, 20 bp, Artificial Sequence
  chemically synthesized
atgtgtgtggaatggaggga

SEQ ID NO: 281248 - DNA, 20 bp, Artificial Sequence
  chemically synthesized
tgtgtgtggaatggagggag

SEQ ID NO: 281249 - DNA, 20 bp, Artificial Sequence
  chemically synthesized
tggagggagaggaataaaat

SEQ ID NO: 281250 - DNA, 20 bp, Artificial Sequence
  chemically synthesized
gggagaggaataaaatgaga

SEQ ID NO: 281251 - DNA, 20 bp, Artificial Sequence
  chemically synthesized
gaggaataaaatgagacagc

SEQ ID NO: 281252 - DNA, 20 bp, Artificial Sequence
  chemically synthesized
ggaataaaatgagacagcga

SEQ ID NO: 281253 - DNA, 20 bp, Artificial Sequence
  chemically synthesized
aataaaatgagacagcgaga

SEQ ID NO: 281254 - DNA, 20 bp, Artificial Sequence
  chemically synthesized
aaatgagacagcgagagaga

SEQ ID NO: 281255 - DNA, 20 bp, Artificial Sequence
  chemically synthesized
aatgagacagcgagagagaa

SEQ ID NO: 281256 - DNA, 20 bp, Artificial Sequence
  chemically synthesized
caagatagaccagtatgtgt

SEQ ID NO: 281257 - DNA, 20 bp, Artificial Sequence
  chemically synthesized
gaaaggatacccacacatac

SEQ ID NO: 281258 - DNA, 20 bp, Artificial Sequence
  chemically synthesized
tcaagatagaccagtatgtg

SEQ ID NO: 281259 - DNA, 20 bp, Artificial Sequence
  chemically synthesized
tttccttactcaagatagac

SEQ ID NO: 281260 - DNA, 20 bp, Artificial Sequence
  chemically synthesized
cacacatactggtctatctt

SEQ ID NO: 281261 - DNA, 20 bp, Artificial Sequence
  chemically synthesized
gttcttttccttactcaaga

SEQ ID NO: 281262 - DNA, 20 bp, Artificial Sequence
  chemically synthesized
catactggtctatcttgagt

SEQ ID NO: 281263 - DNA, 20 bp, Artificial Sequence
  chemically synthesized
atactggtctatcttgagta

SEQ ID NO: 281264 - DNA, 20 bp, Artificial Sequence
  chemically synthesized
cagagttcttttccttactc

SEQ ID NO: 281265 - DNA, 20 bp, Artificial Sequence
  chemically synthesized
ggtctatcttgagtaaggaa

SEQ ID NO: 281266 - DNA, 20 bp, Artificial Sequence
  chemically synthesized
gagtaaggaaaagaactctg

SEQ ID NO: 281267 - DNA, 20 bp, Artificial Sequence
  chemically synthesized
aaggaaaagaactctgtggt

SEQ ID NO: 281268 - DNA, 20 bp, Artificial Sequence
  chemically synthesized
agaaggttactctgaccaca

SEQ ID NO: 281269 - DNA, 20 bp, Artificial Sequence
  chemically synthesized
ggaaaagaactctgtggtca

SEQ ID NO: 281270 - DNA, 20 bp, Artificial Sequence
  chemically synthesized
caagaaggttactctgacca

SEQ ID NO: 281271 - DNA, 20 bp, Artificial Sequence
  chemically synthesized
tgtggtcagagtaaccttct

SEQ ID NO: 281272 - DNA, 20 bp, Artificial Sequence
  chemically synthesized
gtggtcagagtaaccttctt

SEQ ID NO: 281273 - DNA, 20 bp, Artificial Sequence
  chemically synthesized
gcaactgagacatcccaaga

SEQ ID NO: 281274 - DNA, 20 bp, Artificial Sequence
  chemically synthesized
ggcaactgagacatcccaag

SEQ ID NO: 281275 - DNA, 20 bp, Artificial Sequence
  chemically synthesized
aaaggcaactgagacatccc

SEQ ID NO: 281276 - DNA, 20 bp, Artificial Sequence
  chemically synthesized
gtaaccttcttgggatgtct

SEQ ID NO: 281277 - DNA, 20 bp, Artificial Sequence
  chemically synthesized
aggattcttaaaaggcaact

SEQ ID NO: 281278 - DNA, 20 bp, Artificial Sequence
  chemically synthesized
ggatgtctcagttgcctttt

SEQ ID NO: 281279 - DNA, 20 bp, Artificial Sequence
  chemically synthesized
tgtaagttaggattcttaaa

SEQ ID NO: 281280 - DNA, 20 bp, Artificial Sequence
  chemically synthesized
ttgtaagttaggattcttaa

SEQ ID NO: 281281 - DNA, 20 bp, Artificial Sequence
  chemically synthesized
tcacaaaaacattgtaagtt

SEQ ID NO: 281282 - DNA, 20 bp, Artificial Sequence
  chemically synthesized
ttcacaaaaacattgtaagt

SEQ ID NO: 281283 - DNA, 20 bp, Artificial Sequence
  chemically synthesized
tgatttcacaaaaacattgt

SEQ ID NO: 281284 - DNA, 20 bp, Artificial Sequence
  chemically synthesized
aattctttacatgtgtatta

SEQ ID NO: 281285 - DNA, 20 bp, Artificial Sequence
  chemically synthesized
catgctataatacacatgta

SEQ ID NO: 281286 - DNA, 20 bp, Artificial Sequence
  chemically synthesized
acacatgtaaagaatttacc

SEQ ID NO: 281287 - DNA, 20 bp, Artificial Sequence
  chemically synthesized
taaagaatttacccagtgtc

SEQ ID NO: 281288 - DNA, 20 bp, Artificial Sequence
  chemically synthesized
acaatccaatgccagacact

SEQ ID NO: 281289 - DNA, 20 bp, Artificial Sequence
  chemically synthesized
gacaatccaatgccagacac

SEQ ID NO: 281290 - DNA, 20 bp, Artificial Sequence
  chemically synthesized
atttacccagtgtctggcat

SEQ ID NO: 281291 - DNA, 20 bp, Artificial Sequence
  chemically synthesized
tttcagagacaatccaatgc

SEQ ID NO: 281292 - DNA, 20 bp, Artificial Sequence
  chemically synthesized
agctcagctttcaggtttca

SEQ ID NO: 281293 - DNA, 20 bp, Artificial Sequence
  chemically synthesized
ttagctcagctttcaggttt

SEQ ID NO: 281294 - DNA, 20 bp, Artificial Sequence
  chemically synthesized
ggattgtctctgaaacctga

SEQ ID NO: 281295 - DNA, 20 bp, Artificial Sequence
  chemically synthesized
gtctctgaaacctgaaagct

SEQ ID NO: 281296 - DNA, 20 bp, Artificial Sequence
  chemically synthesized
taaatattagctcagctttc

SEQ ID NO: 281297 - DNA, 20 bp, Artificial Sequence
  chemically synthesized
ttaaatattagctcagcttt

SEQ ID NO: 281298 - DNA, 20 bp, Artificial Sequence
  chemically synthesized
caatagtttaaatattagct

SEQ ID NO: 281299 - DNA, 20 bp, Artificial Sequence
  chemically synthesized
atgagcaatagtttaaatat

SEQ ID NO: 281300 - DNA, 20 bp, Artificial Sequence
  chemically synthesized
ctctcagataaaatgagcaa

SEQ ID NO: 281301 - DNA, 20 bp, Artificial Sequence
  chemically synthesized
acaggcctctcagataaaat

SEQ ID NO: 281302 - DNA, 20 bp, Artificial Sequence
  chemically synthesized
aactattgctcattttatct

SEQ ID NO: 281303 - DNA, 20 bp, Artificial Sequence
  chemically synthesized
ctattgctcattttatctga

SEQ ID NO: 281304 - DNA, 20 bp, Artificial Sequence
  chemically synthesized
tattgctcattttatctgag

SEQ ID NO: 281305 - DNA, 20 bp, Artificial Sequence
  chemically synthesized
tatagcagatacaggcctct

SEQ ID NO: 281306 - DNA, 20 bp, Artificial Sequence
  chemically synthesized
cattaatgtatagcagatac

SEQ ID NO: 281307 - DNA, 20 bp, Artificial Sequence
  chemically synthesized
gcattaatgtatagcagata

SEQ ID NO: 281308 - DNA, 20 bp, Artificial Sequence
  chemically synthesized
taatttgcattaatgtatag

SEQ ID NO: 281309 - DNA, 20 bp, Artificial Sequence
  chemically synthesized
atctaatttgcattaatgta

SEQ ID NO: 281310 - DNA, 20 bp, Artificial Sequence
  chemically synthesized
tgctatacattaatgcaaat

SEQ ID NO: 281311 - DNA, 20 bp, Artificial Sequence
  chemically synthesized
cattaatgcaaattagatta

SEQ ID NO: 281312 - DNA, 20 bp, Artificial Sequence
  chemically synthesized
ttaatgcaaattagattaaa

SEQ ID NO: 281313 - DNA, 20 bp, Artificial Sequence
  chemically synthesized
acatgaagaggtatgaagat

SEQ ID NO: 281314 - DNA, 20 bp, Artificial Sequence
  chemically synthesized
gaactacatgaagaggtatg

SEQ ID NO: 281315 - DNA, 20 bp, Artificial Sequence
  chemically synthesized
tatcttcatacctcttcatg

SEQ ID NO: 281316 - DNA, 20 bp, Artificial Sequence
  chemically synthesized
ttggagggaactacatgaag

SEQ ID NO: 281317 - DNA, 20 bp, Artificial Sequence
  chemically synthesized
gttggagggaactacatgaa

SEQ ID NO: 281318 - DNA, 20 bp, Artificial Sequence
  chemically synthesized
tcgttggagggaactacatg

SEQ ID NO: 281319 - DNA, 20 bp, Artificial Sequence
  chemically synthesized
ttcatgtagttccctccaac

SEQ ID NO: 281320 - DNA, 20 bp, Artificial Sequence
  chemically synthesized
gacatttaattctcgttgga

SEQ ID NO: 281321 - DNA, 20 bp, Artificial Sequence
  chemically synthesized
agacatttaattctcgttgg

SEQ ID NO: 281322 - DNA, 20 bp, Artificial Sequence
  chemically synthesized
gagacatttaattctcgttg

SEQ ID NO: 281323 - DNA, 20 bp, Artificial Sequence
  chemically synthesized
ttgagacatttaattctcgt

SEQ ID NO: 281324 - DNA, 20 bp, Artificial Sequence
  chemically synthesized
caacgagaattaaatgtctc

SEQ ID NO: 281325 - DNA, 20 bp, Artificial Sequence
  chemically synthesized
agctaatcaatgaggaactt

SEQ ID NO: 281326 - DNA, 20 bp, Artificial Sequence
  chemically synthesized
gtctcaagttcctcattgat

SEQ ID NO: 281327 - DNA, 20 bp, Artificial Sequence
  chemically synthesized
catggatgagctaatcaatg

SEQ ID NO: 281328 - DNA, 20 bp, Artificial Sequence
  chemically synthesized
tcatggatgagctaatcaat

SEQ ID NO: 281329 - DNA, 20 bp, Artificial Sequence
  chemically synthesized
cagatggcggagtcatggat

SEQ ID NO: 281330 - DNA, 20 bp, Artificial Sequence
  chemically synthesized
cctaacagatggcggagtca

SEQ ID NO: 281331 - DNA, 20 bp, Artificial Sequence
  chemically synthesized
acagaccctaacagatggcg

SEQ ID NO: 281332 - DNA, 20 bp, Artificial Sequence
  chemically synthesized
gcacagaccctaacagatgg

SEQ ID NO: 281333 - DNA, 20 bp, Artificial Sequence
  chemically synthesized
tccatgactccgccatctgt

SEQ ID NO: 281334 - DNA, 20 bp, Artificial Sequence
  chemically synthesized
ccatgactccgccatctgtt

SEQ ID NO: 281335 - DNA, 20 bp, Artificial Sequence
  chemically synthesized
catgactccgccatctgtta

SEQ ID NO: 281336 - DNA, 20 bp, Artificial Sequence
  chemically synthesized
ttggcacagaccctaacaga

SEQ ID NO: 281337 - DNA, 20 bp, Artificial Sequence
  chemically synthesized
catattggcacagaccctaa

SEQ ID NO: 281338 - DNA, 20 bp, Artificial Sequence
  chemically synthesized
atcagattcgcatattggca

SEQ ID NO: 281339 - DNA, 20 bp, Artificial Sequence
  chemically synthesized
cccaaatcagattcgcatat

SEQ ID NO: 281340 - DNA, 20 bp, Artificial Sequence
  chemically synthesized
gccaatatgcgaatctgatt

SEQ ID NO: 281341 - DNA, 20 bp, Artificial Sequence
  chemically synthesized
ccaatatgcgaatctgattt

SEQ ID NO: 281342 - DNA, 20 bp, Artificial Sequence
  chemically synthesized
attcagaggataacccaaat

SEQ ID NO: 281343 - DNA, 20 bp, Artificial Sequence
  chemically synthesized
aaatttgatgcgacattcag

SEQ ID NO: 281344 - DNA, 20 bp, Artificial Sequence
  chemically synthesized
aaaatttgatgcgacattca

SEQ ID NO: 281345 - DNA, 20 bp, Artificial Sequence
  chemically synthesized
tgaaaatttgatgcgacatt

SEQ ID NO: 281346 - DNA, 20 bp, Artificial Sequence
  chemically synthesized
gaatgtcgcatcaaattttc

SEQ ID NO: 281347 - DNA, 20 bp, Artificial Sequence
  chemically synthesized
taattattgcaaatgtgttt

SEQ ID NO: 281348 - DNA, 20 bp, Artificial Sequence
  chemically synthesized
tttagaaaaaaaaggagaaa

SEQ ID NO: 281349 - DNA, 20 bp, Artificial Sequence
  chemically synthesized
aatgtatttagaaaaaaaag

SEQ ID NO: 281350 - DNA, 20 bp, Artificial Sequence
  chemically synthesized
ccaatgtatttagaaaaaaa

SEQ ID NO: 281351 - DNA, 20 bp, Artificial Sequence
  chemically synthesized
tccaatgtatttagaaaaaa

SEQ ID NO: 281352 - DNA, 20 bp, Artificial Sequence
  chemically synthesized
ccttttttttctaaatacat

SEQ ID NO: 281353 - DNA, 20 bp, Artificial Sequence
  chemically synthesized
tgctgataatccaatgtatt

SEQ ID NO: 281354 - DNA, 20 bp, Artificial Sequence
  chemically synthesized
ttctaaatacattggattat

SEQ ID NO: 281355 - DNA, 20 bp, Artificial Sequence
  chemically synthesized
ttggattatcagcaaatgct

SEQ ID NO: 281356 - DNA, 20 bp, Artificial Sequence
  chemically synthesized
tatgtaaatcagaagatact

SEQ ID NO: 281357 - DNA, 20 bp, Artificial Sequence
  chemically synthesized
cttaattatatgtaaatcag

SEQ ID NO: 281358 - DNA, 20 bp, Artificial Sequence
  chemically synthesized
tgacttaattatatgtaaat

SEQ ID NO: 281359 - DNA, 20 bp, Artificial Sequence
  chemically synthesized
cttctgatttacatataatt

SEQ ID NO: 281360 - DNA, 20 bp, Artificial Sequence
  chemically synthesized
attaagtcataatcaattta

SEQ ID NO: 281361 - DNA, 20 bp, Artificial Sequence
  chemically synthesized
aatttaaagcaaattttaat

SEQ ID NO: 281362 - DNA, 20 bp, Artificial Sequence
  chemically synthesized
atttaaagcaaattttaatt

SEQ ID NO: 281363 - DNA, 20 bp, Artificial Sequence
  chemically synthesized
taattgggattaaaaacacc

SEQ ID NO: 281364 - DNA, 20 bp, Artificial Sequence
  chemically synthesized
aattgggattaaaaacacca

SEQ ID NO: 281365 - DNA, 20 bp, Artificial Sequence
  chemically synthesized
ttgggattaaaaacaccaag

SEQ ID NO: 281366 - DNA, 20 bp, Artificial Sequence
  chemically synthesized
tttgaagcaaaaatgctcct

SEQ ID NO: 281367 - DNA, 20 bp, Artificial Sequence
  chemically synthesized
agcatttttgcttcaaaaaa

SEQ ID NO: 281368 - DNA, 20 bp, Artificial Sequence
  chemically synthesized
gaatgacatcctattttttg

SEQ ID NO: 281369 - DNA, 20 bp, Artificial Sequence
  chemically synthesized
gcatttttgcttcaaaaaat

SEQ ID NO: 281370 - DNA, 20 bp, Artificial Sequence
  chemically synthesized
taatcccatgaagattcata

SEQ ID NO: 281371 - DNA, 20 bp, Artificial Sequence
  chemically synthesized
tcattctatatgaatcttca

SEQ ID NO: 281372 - DNA, 20 bp, Artificial Sequence
  chemically synthesized
cattctatatgaatcttcat

SEQ ID NO: 281373 - DNA, 20 bp, Artificial Sequence
  chemically synthesized
aacactgtcataatcccatg

SEQ ID NO: 281374 - DNA, 20 bp, Artificial Sequence
  chemically synthesized
gaatcttcatgggattatga

SEQ ID NO: 281375 - DNA, 20 bp, Artificial Sequence
  chemically synthesized
atgggattatgacagtgttg

SEQ ID NO: 281376 - DNA, 20 bp, Artificial Sequence
  chemically synthesized
ttatgacagtgttgcggact

SEQ ID NO: 281377 - DNA, 20 bp, Artificial Sequence
  chemically synthesized
tgaatcaagttttaagttct

SEQ ID NO: 281378 - DNA, 20 bp, Artificial Sequence
  chemically synthesized
gtggttgtgaatcaagtttt

SEQ ID NO: 281379 - DNA, 20 bp, Artificial Sequence
  chemically synthesized
gaaaaaggtggttgtgaatc

SEQ ID NO: 281380 - DNA, 20 bp, Artificial Sequence
  chemically synthesized
ggggacgtcaaggaaaaagg

SEQ ID NO: 281381 - DNA, 20 bp, Artificial Sequence
  chemically synthesized
ttaggggacgtcaaggaaaa

SEQ ID NO: 281382 - DNA, 20 bp, Artificial Sequence
  chemically synthesized
gttaggggacgtcaaggaaa

SEQ ID NO: 281383 - DNA, 20 bp, Artificial Sequence
  chemically synthesized
tttagagttaggggacgtca

SEQ ID NO: 281384 - DNA, 20 bp, Artificial Sequence
  chemically synthesized
ttttagagttaggggacgtc

SEQ ID NO: 281385 - DNA, 20 bp, Artificial Sequence
  chemically synthesized
tcttctggttttagagttag

SEQ ID NO: 281386 - DNA, 20 bp, Artificial Sequence
  chemically synthesized
ctcttctggttttagagtta

SEQ ID NO: 281387 - DNA, 20 bp, Artificial Sequence
  chemically synthesized
cctcttctggttttagagtt

SEQ ID NO: 281388 - DNA, 20 bp, Artificial Sequence
  chemically synthesized
acctcttctggttttagagt

SEQ ID NO: 281389 - DNA, 20 bp, Artificial Sequence
  chemically synthesized
acgtcccctaactctaaaac

SEQ ID NO: 281390 - DNA, 20 bp, Artificial Sequence
  chemically synthesized
ttttacctcttctggtttta

SEQ ID NO: 281391 - DNA, 20 bp, Artificial Sequence
  chemically synthesized
tcccctaactctaaaaccag

SEQ ID NO: 281392 - DNA, 20 bp, Artificial Sequence
  chemically synthesized
tgttttacctcttctggttt

SEQ ID NO: 281393 - DNA, 20 bp, Artificial Sequence
  chemically synthesized
ccctaactctaaaaccagaa

SEQ ID NO: 281394 - DNA, 20 bp, Artificial Sequence
  chemically synthesized
cctaactctaaaaccagaag

SEQ ID NO: 281395 - DNA, 20 bp, Artificial Sequence
  chemically synthesized
atttagtgttttacctcttc

SEQ ID NO: 281396 - DNA, 20 bp, Artificial Sequence
  chemically synthesized
atcagagaagttgagaaatt

SEQ ID NO: 281397 - DNA, 20 bp, Artificial Sequence
  chemically synthesized
cactagctatcagagaagtt

SEQ ID NO: 281398 - DNA, 20 bp, Artificial Sequence
  chemically synthesized
aaatttctcaacttctctga

SEQ ID NO: 281399 - DNA, 20 bp, Artificial Sequence
  chemically synthesized
gacaccactagctatcagag

SEQ ID NO: 281400 - DNA, 20 bp, Artificial Sequence
  chemically synthesized
ttctcaacttctctgatagc

SEQ ID NO: 281401 - DNA, 20 bp, Artificial Sequence
  chemically synthesized
gtggacaccactagctatca

SEQ ID NO: 281402 - DNA, 20 bp, Artificial Sequence
  chemically synthesized
acgtggacaccactagctat

SEQ ID NO: 281403 - DNA, 20 bp, Artificial Sequence
  chemically synthesized
tcaacttctctgatagctag

SEQ ID NO: 281404 - DNA, 20 bp, Artificial Sequence
  chemically synthesized
ttgtgtcacgtggacaccac

SEQ ID NO: 281405 - DNA, 20 bp, Artificial Sequence
  chemically synthesized
tttttcagaattgtgtcacg

SEQ ID NO: 281406 - DNA, 20 bp, Artificial Sequence
  chemically synthesized
cacgtgacacaattctgaaa

SEQ ID NO: 281407 - DNA, 20 bp, Artificial Sequence
  chemically synthesized
cgtgacacaattctgaaaaa

SEQ ID NO: 281408 - DNA, 20 bp, Artificial Sequence
  chemically synthesized
cttgagagagtactcttttt

SEQ ID NO: 281409 - DNA, 20 bp, Artificial Sequence
  chemically synthesized
ctgaaaaagagtactctctc

SEQ ID NO: 281410 - DNA, 20 bp, Artificial Sequence
  chemically synthesized
aaaaagagtactctctcaag

SEQ ID NO: 281411 - DNA, 20 bp, Artificial Sequence
  chemically synthesized
caaaaggattcttcttgaga

SEQ ID NO: 281412 - DNA, 20 bp, Artificial Sequence
  chemically synthesized
ggcaaaaggattcttcttga

SEQ ID NO: 281413 - DNA, 20 bp, Artificial Sequence
  chemically synthesized
agggcaaaaggattcttctt

SEQ ID NO: 281414 - DNA, 20 bp, Artificial Sequence
  chemically synthesized
aaaaaagtaggaagggcaaa

SEQ ID NO: 281415 - DNA, 20 bp, Artificial Sequence
  chemically synthesized
caaaaaagtaggaagggcaa

SEQ ID NO: 281416 - DNA, 20 bp, Artificial Sequence
  chemically synthesized
tatgtgcaaaaaagtaggaa

SEQ ID NO: 281417 - DNA, 20 bp, Artificial Sequence
  chemically synthesized
gtatgtgcaaaaaagtagga

SEQ ID NO: 281418 - DNA, 20 bp, Artificial Sequence
  chemically synthesized
tgtatgtgcaaaaaagtagg

SEQ ID NO: 281419 - DNA, 20 bp, Artificial Sequence
  chemically synthesized
ccatgtatgtgcaaaaaagt

SEQ ID NO: 281420 - DNA, 20 bp, Artificial Sequence
  chemically synthesized
gccatgtatgtgcaaaaaag

SEQ ID NO: 281421 - DNA, 20 bp, Artificial Sequence
  chemically synthesized
caggccatgtatgtgcaaaa

SEQ ID NO: 281422 - DNA, 20 bp, Artificial Sequence
  chemically synthesized
cctacttttttgcacataca

SEQ ID NO: 281423 - DNA, 20 bp, Artificial Sequence
  chemically synthesized
ttttttgcacatacatggcc

SEQ ID NO: 281424 - DNA, 20 bp, Artificial Sequence
  chemically synthesized
ttttgcacatacatggcctg

SEQ ID NO: 281425 - DNA, 20 bp, Artificial Sequence
  chemically synthesized
tttgcacatacatggcctgg

SEQ ID NO: 281426 - DNA, 20 bp, Artificial Sequence
  chemically synthesized
aagatgattgttatacctcc

SEQ ID NO: 281427 - DNA, 20 bp, Artificial Sequence
  chemically synthesized
aaagatgattgttatacctc

SEQ ID NO: 281428 - DNA, 20 bp, Artificial Sequence
  chemically synthesized
tataacaatcatctttgcac

SEQ ID NO: 281429 - DNA, 20 bp, Artificial Sequence
  chemically synthesized
ataacaatcatctttgcact

SEQ ID NO: 281430 - DNA, 20 bp, Artificial Sequence
  chemically synthesized
agtcattgcctcccagtgca

SEQ ID NO: 281431 - DNA, 20 bp, Artificial Sequence
  chemically synthesized
aacaatcatctttgcactgg

SEQ ID NO: 281432 - DNA, 20 bp, Artificial Sequence
  chemically synthesized
acaatcatctttgcactggg

SEQ ID NO: 281433 - DNA, 20 bp, Artificial Sequence
  chemically synthesized
cactcaaagtcattgcctcc

SEQ ID NO: 281434 - DNA, 20 bp, Artificial Sequence
  chemically synthesized
cactgggaggcaatgacttt

SEQ ID NO: 281435 - DNA, 20 bp, Artificial Sequence
  chemically synthesized
gaggcaatgactttgagtgt

SEQ ID NO: 281436 - DNA, 20 bp, Artificial Sequence
  chemically synthesized
catgaaggacctcacactca

SEQ ID NO: 281437 - DNA, 20 bp, Artificial Sequence
  chemically synthesized
aggcaatgactttgagtgtg

SEQ ID NO: 281438 - DNA, 20 bp, Artificial Sequence
  chemically synthesized
agtgtgaggtccttcatgct

SEQ ID NO: 281439 - DNA, 20 bp, Artificial Sequence
  chemically synthesized
ctctctcttcctgagcatga

SEQ ID NO: 281440 - DNA, 20 bp, Artificial Sequence
  chemically synthesized
gtgtgaggtccttcatgctc

SEQ ID NO: 281441 - DNA, 20 bp, Artificial Sequence
  chemically synthesized
gctctctcttcctgagcatg

SEQ ID NO: 281442 - DNA, 20 bp, Artificial Sequence
  chemically synthesized
tgaggtccttcatgctcagg

SEQ ID NO: 281443 - DNA, 20 bp, Artificial Sequence
  chemically synthesized
aggtccttcatgctcaggaa

SEQ ID NO: 281444 - DNA, 20 bp, Artificial Sequence
  chemically synthesized
gtccttcatgctcaggaaga

SEQ ID NO: 281445 - DNA, 20 bp, Artificial Sequence
  chemically synthesized
actctctgctctctcttcct

SEQ ID NO: 281446 - DNA, 20 bp, Artificial Sequence
  chemically synthesized
ccttcatgctcaggaagaga

SEQ ID NO: 281447 - DNA, 20 bp, Artificial Sequence
  chemically synthesized
tcatgctcaggaagagagag

SEQ ID NO: 281448 - DNA, 20 bp, Artificial Sequence
  chemically synthesized
atgctcaggaagagagagca

SEQ ID NO: 281449 - DNA, 20 bp, Artificial Sequence
  chemically synthesized
gctcaggaagagagagcaga

SEQ ID NO: 281450 - DNA, 20 bp, Artificial Sequence
  chemically synthesized
agccatattatgaggcgagt

SEQ ID NO: 281451 - DNA, 20 bp, Artificial Sequence
  chemically synthesized
cagccatattatgaggcgag

SEQ ID NO: 281452 - DNA, 20 bp, Artificial Sequence
  chemically synthesized
gttcagccatattatgaggc

SEQ ID NO: 281453 - DNA, 20 bp, Artificial Sequence
  chemically synthesized
tgcctactcgcctcataata

SEQ ID NO: 281454 - DNA, 20 bp, Artificial Sequence
  chemically synthesized
gatggttcagccatattatg

SEQ ID NO: 281455 - DNA, 20 bp, Artificial Sequence
  chemically synthesized
ggatggttcagccatattat

SEQ ID NO: 281456 - DNA, 20 bp, Artificial Sequence
  chemically synthesized
actcagggttgaggatggtt

SEQ ID NO: 281457 - DNA, 20 bp, Artificial Sequence
  chemically synthesized
aggttactcagggttgagga

SEQ ID NO: 281458 - DNA, 20 bp, Artificial Sequence
  chemically synthesized
gctgaaccatcctcaaccct

SEQ ID NO: 281459 - DNA, 20 bp, Artificial Sequence
  chemically synthesized
agggaggttactcagggttg

SEQ ID NO: 281460 - DNA, 20 bp, Artificial Sequence
  chemically synthesized
aagggaggttactcagggtt

SEQ ID NO: 281461 - DNA, 20 bp, Artificial Sequence
  chemically synthesized
tagtgaagggaggttactca

SEQ ID NO: 281462 - DNA, 20 bp, Artificial Sequence
  chemically synthesized
atagtgaagggaggttactc

SEQ ID NO: 281463 - DNA, 20 bp, Artificial Sequence
  chemically synthesized
aatagtgaagggaggttact

SEQ ID NO: 281464 - DNA, 20 bp, Artificial Sequence
  chemically synthesized
acgaaaagaatagtgaaggg

SEQ ID NO: 281465 - DNA, 20 bp, Artificial Sequence
  chemically synthesized
cacgaaaagaatagtgaagg

SEQ ID NO: 281466 - DNA, 20 bp, Artificial Sequence
  chemically synthesized
accacgaaaagaatagtgaa

SEQ ID NO: 281467 - DNA, 20 bp, Artificial Sequence
  chemically synthesized
caccacgaaaagaatagtga

SEQ ID NO: 281468 - DNA, 20 bp, Artificial Sequence
  chemically synthesized
tcaccacgaaaagaatagtg

SEQ ID NO: 281469 - DNA, 20 bp, Artificial Sequence
  chemically synthesized
ttttctcaccacgaaaagaa

SEQ ID NO: 281470 - DNA, 20 bp, Artificial Sequence
  chemically synthesized
tcccttcactattcttttcg

SEQ ID NO: 281471 - DNA, 20 bp, Artificial Sequence
  chemically synthesized
tgatcttttctcaccacgaa

SEQ ID NO: 281472 - DNA, 20 bp, Artificial Sequence
  chemically synthesized
ttcactattcttttcgtggt

SEQ ID NO: 281473 - DNA, 20 bp, Artificial Sequence
  chemically synthesized
tattcttttcgtggtgagaa

SEQ ID NO: 281474 - DNA, 20 bp, Artificial Sequence
  chemically synthesized
gtgagaaaagatcattttgt

SEQ ID NO: 281475 - DNA, 20 bp, Artificial Sequence
  chemically synthesized
agagaatcagacaacggttt

SEQ ID NO: 281476 - DNA, 20 bp, Artificial Sequence
  chemically synthesized
cgtaacagagaatcagacaa

SEQ ID NO: 281477 - DNA, 20 bp, Artificial Sequence
  chemically synthesized
ggatgtacgtaacagagaat

SEQ ID NO: 281478 - DNA, 20 bp, Artificial Sequence
  chemically synthesized
ttattgggatgtacgtaaca

SEQ ID NO: 281479 - DNA, 20 bp, Artificial Sequence
  chemically synthesized
tattattgggatgtacgtaa

SEQ ID NO: 281480 - DNA, 20 bp, Artificial Sequence
  chemically synthesized
tataggagatgggtattatt

SEQ ID NO: 281481 - DNA, 20 bp, Artificial Sequence
  chemically synthesized
gtataggagatgggtattat

SEQ ID NO: 281482 - DNA, 20 bp, Artificial Sequence
  chemically synthesized
ttttgagcagtataggagat

SEQ ID NO: 281483 - DNA, 20 bp, Artificial Sequence
  chemically synthesized
attttgagcagtataggaga

SEQ ID NO: 281484 - DNA, 20 bp, Artificial Sequence
  chemically synthesized
gtcaattttgagcagtatag

SEQ ID NO: 281485 - DNA, 20 bp, Artificial Sequence
  chemically synthesized
ttgtcaattttgagcagtat

SEQ ID NO: 281486 - DNA, 20 bp, Artificial Sequence
  chemically synthesized
tttgtcaattttgagcagta

SEQ ID NO: 281487 - DNA, 20 bp, Artificial Sequence
  chemically synthesized
gcaactttgtcaattttgag

SEQ ID NO: 281488 - DNA, 20 bp, Artificial Sequence
  chemically synthesized
caggcaactttgtcaatttt

SEQ ID NO: 281489 - DNA, 20 bp, Artificial Sequence
  chemically synthesized
tatactgctcaaaattgaca

SEQ ID NO: 281490 - DNA, 20 bp, Artificial Sequence
  chemically synthesized
tcaaaattgacaaagttgcc

SEQ ID NO: 281491 - DNA, 20 bp, Artificial Sequence
  chemically synthesized
aattgacaaagttgcctggc

SEQ ID NO: 281492 - DNA, 20 bp, Artificial Sequence
  chemically synthesized
tttcatcatattatctagcc

SEQ ID NO: 281493 - DNA, 20 bp, Artificial Sequence
  chemically synthesized
ctttcatcatattatctagc

SEQ ID NO: 281494 - DNA, 20 bp, Artificial Sequence
  chemically synthesized
ttcactttcatcatattatc

SEQ ID NO: 281495 - DNA, 20 bp, Artificial Sequence
  chemically synthesized
ctggctagataatatgatga

SEQ ID NO: 281496 - DNA, 20 bp, Artificial Sequence
  chemically synthesized
aatatgatgaaagtgaatct

SEQ ID NO: 281497 - DNA, 20 bp, Artificial Sequence
  chemically synthesized
gaaagtgaatctcagtgtca

SEQ ID NO: 281498 - DNA, 20 bp, Artificial Sequence
  chemically synthesized
tctggcatgcctatgacact

SEQ ID NO: 281499 - DNA, 20 bp, Artificial Sequence
  chemically synthesized
aaagtgaatctcagtgtcat

SEQ ID NO: 281500 - DNA, 20 bp, Artificial Sequence
  chemically synthesized
tctcagtgtcataggcatgc

SEQ ID NO: 281501 - DNA, 20 bp, Artificial Sequence
  chemically synthesized
tcataggcatgccagaaaac

SEQ ID NO: 281502 - DNA, 20 bp, Artificial Sequence
  chemically synthesized
cataggcatgccagaaaaca

SEQ ID NO: 281503 - DNA, 20 bp, Artificial Sequence
  chemically synthesized
aaattgaatcccttgttttc

SEQ ID NO: 281504 - DNA, 20 bp, Artificial Sequence
  chemically synthesized
ataggcatgccagaaaacaa

SEQ ID NO: 281505 - DNA, 20 bp, Artificial Sequence
  chemically synthesized
gggattcaatttcatcttac

SEQ ID NO: 281506 - DNA, 20 bp, Artificial Sequence
  chemically synthesized
agatatgtttgaggtccagt

SEQ ID NO: 281507 - DNA, 20 bp, Artificial Sequence
  chemically synthesized
ttatagatatgtttgaggtc

SEQ ID NO: 281508 - DNA, 20 bp, Artificial Sequence
  chemically synthesized
ttattttatagatatgtttg

SEQ ID NO: 281509 - DNA, 20 bp, Artificial Sequence
  chemically synthesized
cttattttatagatatgttt

SEQ ID NO: 281510 - DNA, 20 bp, Artificial Sequence
  chemically synthesized
ctcaaacatatctataaaat

SEQ ID NO: 281511 - DNA, 20 bp, Artificial Sequence
  chemically synthesized
tatgcccatcacttatttta

SEQ ID NO: 281512 - DNA, 20 bp, Artificial Sequence
  chemically synthesized
catatctataaaataagtga

SEQ ID NO: 281513 - DNA, 20 bp, Artificial Sequence
  chemically synthesized
atatctataaaataagtgat

SEQ ID NO: 281514 - DNA, 20 bp, Artificial Sequence
  chemically synthesized
agaagatttaataaatttgt

SEQ ID NO: 281515 - DNA, 20 bp, Artificial Sequence
  chemically synthesized
ttttaaaacaaggaaaacag

SEQ ID NO: 281516 - DNA, 20 bp, Artificial Sequence
  chemically synthesized
tttttttaaaacaaggaaaa

SEQ ID NO: 281517 - DNA, 20 bp, Artificial Sequence
  chemically synthesized
attttcatttttttaaaaca

SEQ ID NO: 281518 - DNA, 20 bp, Artificial Sequence
  chemically synthesized
gattttcatttttttaaaac

SEQ ID NO: 281519 - DNA, 20 bp, Artificial Sequence
  chemically synthesized
aaattacaaatatgtattgg

SEQ ID NO: 281520 - DNA, 20 bp, Artificial Sequence
  chemically synthesized
gaaaaattacaaatatgtat

SEQ ID NO: 281521 - DNA, 20 bp, Artificial Sequence
  chemically synthesized
ttcaagaaaaatacataaac

SEQ ID NO: 281522 - DNA, 20 bp, Artificial Sequence
  chemically synthesized
attcaagaaaaatacataaa

SEQ ID NO: 281523 - DNA, 20 bp, Artificial Sequence
  chemically synthesized
atgtatttttcttgaatttt

SEQ ID NO: 281524 - DNA, 20 bp, Artificial Sequence
  chemically synthesized
attgagtttgctcaaaattc

SEQ ID NO: 281525 - DNA, 20 bp, Artificial Sequence
  chemically synthesized
acttaataggacaatgtatt

SEQ ID NO: 281526 - DNA, 20 bp, Artificial Sequence
  chemically synthesized
actcaatacattgtcctatt

SEQ ID NO: 281527 - DNA, 20 bp, Artificial Sequence
  chemically synthesized
ttattttcttgaaacttaat

SEQ ID NO: 281528 - DNA, 20 bp, Artificial Sequence
  chemically synthesized
tttattttcttgaaacttaa

SEQ ID NO: 281529 - DNA, 20 bp, Artificial Sequence
  chemically synthesized
acattgtcctattaagtttc

SEQ ID NO: 281530 - DNA, 20 bp, Artificial Sequence
  chemically synthesized
tattaagtttcaagaaaata

SEQ ID NO: 281531 - DNA, 20 bp, Artificial Sequence
  chemically synthesized
ttaagtttcaagaaaataaa

SEQ ID NO: 281532 - DNA, 20 bp, Artificial Sequence
  chemically synthesized
ttaatataaatgtatttagg

SEQ ID NO: 281533 - DNA, 20 bp, Artificial Sequence
  chemically synthesized
tttttaatataaatgtattt

SEQ ID NO: 281534 - DNA, 20 bp, Artificial Sequence
  chemically synthesized
ttttttaatataaatgtatt

SEQ ID NO: 281535 - DNA, 20 bp, Artificial Sequence
  chemically synthesized
ttaaagtattttacaggtta

SEQ ID NO: 281536 - DNA, 20 bp, Artificial Sequence
  chemically synthesized
tggcttttaaagtattttac

SEQ ID NO: 281537 - DNA, 20 bp, Artificial Sequence
  chemically synthesized
atggcttttaaagtatttta

SEQ ID NO: 281538 - DNA, 20 bp, Artificial Sequence
  chemically synthesized
taacctgtaaaatactttaa

SEQ ID NO: 281539 - DNA, 20 bp, Artificial Sequence
  chemically synthesized
caaaaatttgatggctttta

SEQ ID NO: 281540 - DNA, 20 bp, Artificial Sequence
  chemically synthesized
tgttctactcaaaaatttga

SEQ ID NO: 281541 - DNA, 20 bp, Artificial Sequence
  chemically synthesized
ttaaaagccatcaaattttt

SEQ ID NO: 281542 - DNA, 20 bp, Artificial Sequence
  chemically synthesized
aaagccatcaaatttttgag

SEQ ID NO: 281543 - DNA, 20 bp, Artificial Sequence
  chemically synthesized
aataaggaatataaattatt

SEQ ID NO: 281544 - DNA, 20 bp, Artificial Sequence
  chemically synthesized
taataaggaatataaattat

SEQ ID NO: 281545 - DNA, 20 bp, Artificial Sequence
  chemically synthesized
aagatttgttagaagtaata

SEQ ID NO: 281546 - DNA, 20 bp, Artificial Sequence
  chemically synthesized
taagatttgttagaagtaat

SEQ ID NO: 281547 - DNA, 20 bp, Artificial Sequence
  chemically synthesized
acaaaattaagatttgttag

SEQ ID NO: 281548 - DNA, 20 bp, Artificial Sequence
  chemically synthesized
tttacaaaattaagatttgt

SEQ ID NO: 281549 - DNA, 20 bp, Artificial Sequence
  chemically synthesized
aaataaatatttacaaaatt

SEQ ID NO: 281550 - DNA, 20 bp, Artificial Sequence
  chemically synthesized
gtaaatatttatttgcaaaa

SEQ ID NO: 281551 - DNA, 20 bp, Artificial Sequence
  chemically synthesized
atggatataaataattttaa

SEQ ID NO: 281552 - DNA, 20 bp, Artificial Sequence
  chemically synthesized
taatggatacattattttat

SEQ ID NO: 281553 - DNA, 20 bp, Artificial Sequence
  chemically synthesized
ttattttataagtcttaaca

SEQ ID NO: 281554 - DNA, 20 bp, Artificial Sequence
  chemically synthesized
aacaaggtatatactttgtt

SEQ ID NO: 281555 - DNA, 20 bp, Artificial Sequence
  chemically synthesized
acctttaaaaaaatttaaca

SEQ ID NO: 281556 - DNA, 20 bp, Artificial Sequence
  chemically synthesized
cacctttaaaaaaatttaac

SEQ ID NO: 281557 - DNA, 20 bp, Artificial Sequence
  chemically synthesized
taccttgttaaattttttta

SEQ ID NO: 281558 - DNA, 20 bp, Artificial Sequence
  chemically synthesized
accttgttaaatttttttaa

SEQ ID NO: 281559 - DNA, 20 bp, Artificial Sequence
  chemically synthesized
ttgttaaatttttttaaagg

SEQ ID NO: 281560 - DNA, 20 bp, Artificial Sequence
  chemically synthesized
tttttttaaaggtggatgaa

SEQ ID NO: 281561 - DNA, 20 bp, Artificial Sequence
  chemically synthesized
aaggtggatgaaaagcaaca

SEQ ID NO: 281562 - DNA, 20 bp, Artificial Sequence
  chemically synthesized
aaaagcaacaaagcaaaatt

SEQ ID NO: 281563 - DNA, 20 bp, Artificial Sequence
  chemically synthesized
aaagcaacaaagcaaaatta

SEQ ID NO: 281564 - DNA, 20 bp, Artificial Sequence
  chemically synthesized
aagcaacaaagcaaaattaa

SEQ ID NO: 281565 - DNA, 20 bp, Artificial Sequence
  chemically synthesized
acaaagcaaaattaagggat

SEQ ID NO: 281566 - DNA, 20 bp, Artificial Sequence
  chemically synthesized
ggatcagttataaatatctt

SEQ ID NO: 281567 - DNA, 20 bp, Artificial Sequence
  chemically synthesized
ttataaatatcttgagttgc

SEQ ID NO: 281568 - DNA, 20 bp, Artificial Sequence
  chemically synthesized
tctaggttttcttgcaactc

SEQ ID NO: 281569 - DNA, 20 bp, Artificial Sequence
  chemically synthesized
tcttgagttgcaagaaaacc

SEQ ID NO: 281570 - DNA, 20 bp, Artificial Sequence
  chemically synthesized
tgagttgcaagaaaacctag

SEQ ID NO: 281571 - DNA, 20 bp, Artificial Sequence
  chemically synthesized
agaaaaactgcacgacttct

SEQ ID NO: 281572 - DNA, 20 bp, Artificial Sequence
  chemically synthesized
tagaaaaactgcacgacttc

SEQ ID NO: 281573 - DNA, 20 bp, Artificial Sequence
  chemically synthesized
aagaaaacctagaagtcgtg

SEQ ID NO: 281574 - DNA, 20 bp, Artificial Sequence
  chemically synthesized
agatcaccacgtatcaagga

SEQ ID NO: 281575 - DNA, 20 bp, Artificial Sequence
  chemically synthesized
gtttttctatccttgatacg

SEQ ID NO: 281576 - DNA, 20 bp, Artificial Sequence
  chemically synthesized
ggctagatcaccacgtatca

SEQ ID NO: 281577 - DNA, 20 bp, Artificial Sequence
  chemically synthesized
gggctagatcaccacgtatc

SEQ ID NO: 281578 - DNA, 20 bp, Artificial Sequence
  chemically synthesized
atccttgatacgtggtgatc

SEQ ID NO: 281579 - DNA, 20 bp, Artificial Sequence
  chemically synthesized
acattttgagtgaaaagggc

SEQ ID NO: 281580 - DNA, 20 bp, Artificial Sequence
  chemically synthesized
gaggacattttgagtgaaaa

SEQ ID NO: 281581 - DNA, 20 bp, Artificial Sequence
  chemically synthesized
ggaggacattttgagtgaaa

SEQ ID NO: 281582 - DNA, 20 bp, Artificial Sequence
  chemically synthesized
aggaggacattttgagtgaa

SEQ ID NO: 281583 - DNA, 20 bp, Artificial Sequence
  chemically synthesized
cttatccaggaggacatttt

SEQ ID NO: 281584 - DNA, 20 bp, Artificial Sequence
  chemically synthesized
tttcactcaaaatgtcctcc

SEQ ID NO: 281585 - DNA, 20 bp, Artificial Sequence
  chemically synthesized
ctcaaaatgtcctcctggat

SEQ ID NO: 281586 - DNA, 20 bp, Artificial Sequence
  chemically synthesized
gttgctgatgcttatccagg

SEQ ID NO: 281587 - DNA, 20 bp, Artificial Sequence
  chemically synthesized
tgttgctgatgcttatccag

SEQ ID NO: 281588 - DNA, 20 bp, Artificial Sequence
  chemically synthesized
agtgttgctgatgcttatcc

SEQ ID NO: 281589 - DNA, 20 bp, Artificial Sequence
  chemically synthesized
tagtgttgctgatgcttatc

SEQ ID NO: 281590 - DNA, 20 bp, Artificial Sequence
  chemically synthesized
atgtcctcctggataagcat

SEQ ID NO: 281591 - DNA, 20 bp, Artificial Sequence
  chemically synthesized
aagcatcagcaacactacca

SEQ ID NO: 281592 - DNA, 20 bp, Artificial Sequence
  chemically synthesized
gcatcagcaacactaccaaa

SEQ ID NO: 281593 - DNA, 20 bp, Artificial Sequence
  chemically synthesized
acataaaattggctctttgg

SEQ ID NO: 281594 - DNA, 20 bp, Artificial Sequence
  chemically synthesized
catacataaaattggctctt

SEQ ID NO: 281595 - DNA, 20 bp, Artificial Sequence
  chemically synthesized
aataaatacatacataaaat

SEQ ID NO: 281596 - DNA, 20 bp, Artificial Sequence
  chemically synthesized
atttatttattttttcactg

SEQ ID NO: 281597 - DNA, 20 bp, Artificial Sequence
  chemically synthesized
agccaataaatgaaattcca

SEQ ID NO: 281598 - DNA, 20 bp, Artificial Sequence
  chemically synthesized
cactgtggaatttcatttat

SEQ ID NO: 281599 - DNA, 20 bp, Artificial Sequence
  chemically synthesized
tgttcctaattcagataatg

SEQ ID NO: 281600 - DNA, 20 bp, Artificial Sequence
  chemically synthesized
attgttcctaattcagataa

SEQ ID NO: 281601 - DNA, 20 bp, Artificial Sequence
  chemically synthesized
attggctccattatctgaat

SEQ ID NO: 281602 - DNA, 20 bp, Artificial Sequence
  chemically synthesized
ttggctccattatctgaatt

SEQ ID NO: 281603 - DNA, 20 bp, Artificial Sequence
  chemically synthesized
atttcaaattgttcctaatt

SEQ ID NO: 281604 - DNA, 20 bp, Artificial Sequence
  chemically synthesized
ttgaaattatgaccacaaca

SEQ ID NO: 281605 - DNA, 20 bp, Artificial Sequence
  chemically synthesized
tatcttttatttctatgttg

SEQ ID NO: 281606 - DNA, 20 bp, Artificial Sequence
  chemically synthesized
tgaccacaacatagaaataa

SEQ ID NO: 281607 - DNA, 20 bp, Artificial Sequence
  chemically synthesized
acaacatagaaataaaagat

SEQ ID NO: 281608 - DNA, 20 bp, Artificial Sequence
  chemically synthesized
aacatagaaataaaagataa

SEQ ID NO: 281609 - DNA, 20 bp, Artificial Sequence
  chemically synthesized
gcagggaggaggaaaattgc

SEQ ID NO: 281610 - DNA, 20 bp, Artificial Sequence
  chemically synthesized
aacacagacaagcagggagg

SEQ ID NO: 281611 - DNA, 20 bp, Artificial Sequence
  chemically synthesized
caacacagacaagcagggag

SEQ ID NO: 281612 - DNA, 20 bp, Artificial Sequence
  chemically synthesized
cacaacacagacaagcaggg

SEQ ID NO: 281613 - DNA, 20 bp, Artificial Sequence
  chemically synthesized
ccacaacacagacaagcagg

SEQ ID NO: 281614 - DNA, 20 bp, Artificial Sequence
  chemically synthesized
gcccacaacacagacaagca

SEQ ID NO: 281615 - DNA, 20 bp, Artificial Sequence
  chemically synthesized
tgcccacaacacagacaagc

SEQ ID NO: 281616 - DNA, 20 bp, Artificial Sequence
  chemically synthesized
atgcccacaacacagacaag

SEQ ID NO: 281617 - DNA, 20 bp, Artificial Sequence
  chemically synthesized
acaatgcccacaacacagac

SEQ ID NO: 281618 - DNA, 20 bp, Artificial Sequence
  chemically synthesized
ctccctgcttgtctgtgttg

SEQ ID NO: 281619 - DNA, 20 bp, Artificial Sequence
  chemically synthesized
tccctgcttgtctgtgttgt

SEQ ID NO: 281620 - DNA, 20 bp, Artificial Sequence
  chemically synthesized
ccctcacaatgcccacaaca

SEQ ID NO: 281621 - DNA, 20 bp, Artificial Sequence
  chemically synthesized
gtctgtgttgtgggcattgt

SEQ ID NO: 281622 - DNA, 20 bp, Artificial Sequence
  chemically synthesized
tctgtgttgtgggcattgtg

SEQ ID NO: 281623 - DNA, 20 bp, Artificial Sequence
  chemically synthesized
ctgtgttgtgggcattgtga

SEQ ID NO: 281624 - DNA, 20 bp, Artificial Sequence
  chemically synthesized
actatttactattttagacg

SEQ ID NO: 281625 - DNA, 20 bp, Artificial Sequence
  chemically synthesized
tactatttactattttagac

SEQ ID NO: 281626 - DNA, 20 bp, Artificial Sequence
  chemically synthesized
tgtgagggcctcgtctaaaa

SEQ ID NO: 281627 - DNA, 20 bp, Artificial Sequence
  chemically synthesized
accattactatttactattt

SEQ ID NO: 281628 - DNA, 20 bp, Artificial Sequence
  chemically synthesized
gcctcgtctaaaatagtaaa

SEQ ID NO: 281629 - DNA, 20 bp, Artificial Sequence
  chemically synthesized
tctaaaatagtaaatagtaa

SEQ ID NO: 281630 - DNA, 20 bp, Artificial Sequence
  chemically synthesized
aaatagtaaatagtaatggt

SEQ ID NO: 281631 - DNA, 20 bp, Artificial Sequence
  chemically synthesized
aagagcatttagaaaagatg

SEQ ID NO: 281632 - DNA, 20 bp, Artificial Sequence
  chemically synthesized
gaagagcatttagaaaagat

SEQ ID NO: 281633 - DNA, 20 bp, Artificial Sequence
  chemically synthesized
tgaagagcatttagaaaaga

SEQ ID NO: 281634 - DNA, 20 bp, Artificial Sequence
  chemically synthesized
ataatgaagagcatttagaa

SEQ ID NO: 281635 - DNA, 20 bp, Artificial Sequence
  chemically synthesized
aagccataatgaagagcatt

SEQ ID NO: 281636 - DNA, 20 bp, Artificial Sequence
  chemically synthesized
tttctaaatgctcttcatta

SEQ ID NO: 281637 - DNA, 20 bp, Artificial Sequence
  chemically synthesized
aaatttgaagccataatgaa

SEQ ID NO: 281638 - DNA, 20 bp, Artificial Sequence
  chemically synthesized
gaaaatttgaagccataatg

SEQ ID NO: 281639 - DNA, 20 bp, Artificial Sequence
  chemically synthesized
aaggaaagagagaaaatttg

SEQ ID NO: 281640 - DNA, 20 bp, Artificial Sequence
  chemically synthesized
aaaggaatgttaaggaaaga

SEQ ID NO: 281641 - DNA, 20 bp, Artificial Sequence
  chemically synthesized
acaaaggaatgttaaggaaa

SEQ ID NO: 281642 - DNA, 20 bp, Artificial Sequence
  chemically synthesized
tcacaaaggaatgttaagga

SEQ ID NO: 281643 - DNA, 20 bp, Artificial Sequence
  chemically synthesized
atgttcacaaaggaatgtta

SEQ ID NO: 281644 - DNA, 20 bp, Artificial Sequence
  chemically synthesized
catgttcacaaaggaatgtt

SEQ ID NO: 281645 - DNA, 20 bp, Artificial Sequence
  chemically synthesized
aaactagggcatgttcacaa

SEQ ID NO: 281646 - DNA, 20 bp, Artificial Sequence
  chemically synthesized
aaaactagggcatgttcaca

SEQ ID NO: 281647 - DNA, 20 bp, Artificial Sequence
  chemically synthesized
attcctttgtgaacatgccc

SEQ ID NO: 281648 - DNA, 20 bp, Artificial Sequence
  chemically synthesized
agtgatgtgctgaaaaacta

SEQ ID NO: 281649 - DNA, 20 bp, Artificial Sequence
  chemically synthesized
gtgaacatgccctagttttt

SEQ ID NO: 281650 - DNA, 20 bp, Artificial Sequence
  chemically synthesized
cagtgatgtgctgaaaaact

SEQ ID NO: 281651 - DNA, 20 bp, Artificial Sequence
  chemically synthesized
tcagtgatgtgctgaaaaac

SEQ ID NO: 281652 - DNA, 20 bp, Artificial Sequence
  chemically synthesized
cagcacatcactgaaactgt

SEQ ID NO: 281653 - DNA, 20 bp, Artificial Sequence
  chemically synthesized
aattcttgctctcacagttt

SEQ ID NO: 281654 - DNA, 20 bp, Artificial Sequence
  chemically synthesized
gcacatcactgaaactgtga

SEQ ID NO: 281655 - DNA, 20 bp, Artificial Sequence
  chemically synthesized
atcactgaaactgtgagagc

SEQ ID NO: 281656 - DNA, 20 bp, Artificial Sequence
  chemically synthesized
atgctaaattcttgctctca

SEQ ID NO: 281657 - DNA, 20 bp, Artificial Sequence
  chemically synthesized
aaactgtgagagcaagaatt

SEQ ID NO: 281658 - DNA, 20 bp, Artificial Sequence
  chemically synthesized
gtgagagcaagaatttagca

SEQ ID NO: 281659 - DNA, 20 bp, Artificial Sequence
  chemically synthesized
aaattgtcaaatcgtacatg

SEQ ID NO: 281660 - DNA, 20 bp, Artificial Sequence
  chemically synthesized
tgaaattgtcaaatcgtaca

SEQ ID NO: 281661 - DNA, 20 bp, Artificial Sequence
  chemically synthesized
tgtacgatttgacaatttca

SEQ ID NO: 281662 - DNA, 20 bp, Artificial Sequence
  chemically synthesized
gtacgatttgacaatttcat

SEQ ID NO: 281663 - DNA, 20 bp, Artificial Sequence
  chemically synthesized
ttgacaatttcataggctaa

SEQ ID NO: 281664 - DNA, 20 bp, Artificial Sequence
  chemically synthesized
agaagataggatgatgctgt

SEQ ID NO: 281665 - DNA, 20 bp, Artificial Sequence
  chemically synthesized
cagtggccagaacagaagat

SEQ ID NO: 281666 - DNA, 20 bp, Artificial Sequence
  chemically synthesized
acagtggccagaacagaaga

SEQ ID NO: 281667 - DNA, 20 bp, Artificial Sequence
  chemically synthesized
catcatcctatcttctgttc

SEQ ID NO: 281668 - DNA, 20 bp, Artificial Sequence
  chemically synthesized
aaggacagtggccagaacag

SEQ ID NO: 281669 - DNA, 20 bp, Artificial Sequence
  chemically synthesized
taaaaggacagtggccagaa

SEQ ID NO: 281670 - DNA, 20 bp, Artificial Sequence
  chemically synthesized
attaataaaaggacagtggc

SEQ ID NO: 281671 - DNA, 20 bp, Artificial Sequence
  chemically synthesized
gcacattaataaaaggacag

SEQ ID NO: 281672 - DNA, 20 bp, Artificial Sequence
  chemically synthesized
acagcacattaataaaagga

SEQ ID NO: 281673 - DNA, 20 bp, Artificial Sequence
  chemically synthesized
atttacagcacattaataaa

SEQ ID NO: 281674 - DNA, 20 bp, Artificial Sequence
  chemically synthesized
aatttacagcacattaataa

SEQ ID NO: 281675 - DNA, 20 bp, Artificial Sequence
  chemically synthesized
gaaaagttgcagcaaattta

SEQ ID NO: 281676 - DNA, 20 bp, Artificial Sequence
  chemically synthesized
tacatgttctagaaaagttg

SEQ ID NO: 281677 - DNA, 20 bp, Artificial Sequence
  chemically synthesized
taaatttgctgcaacttttc

SEQ ID NO: 281678 - DNA, 20 bp, Artificial Sequence
  chemically synthesized
atgtgttacatgttctagaa

SEQ ID NO: 281679 - DNA, 20 bp, Artificial Sequence
  chemically synthesized
cagcaatgtgttacatgttc

SEQ ID NO: 281680 - DNA, 20 bp, Artificial Sequence
  chemically synthesized
gtaacacattgctgattcac

SEQ ID NO: 281681 - DNA, 20 bp, Artificial Sequence
  chemically synthesized
accaaacatttcttgtgaat

SEQ ID NO: 281682 - DNA, 20 bp, Artificial Sequence
  chemically synthesized
gctgattcacaagaaatgtt

SEQ ID NO: 281683 - DNA, 20 bp, Artificial Sequence
  chemically synthesized
taaatttgtcgtattcagag

SEQ ID NO: 281684 - DNA, 20 bp, Artificial Sequence
  chemically synthesized
ctataaatttgtcgtattca

SEQ ID NO: 281685 - DNA, 20 bp, Artificial Sequence
  chemically synthesized
gactataaatttgtcgtatt

SEQ ID NO: 281686 - DNA, 20 bp, Artificial Sequence
  chemically synthesized
ctctgaatacgacaaattta

SEQ ID NO: 281687 - DNA, 20 bp, Artificial Sequence
  chemically synthesized
atacgacaaatttatagtca

SEQ ID NO: 281688 - DNA, 20 bp, Artificial Sequence
  chemically synthesized
gacaaatttatagtcatagt

SEQ ID NO: 281689 - DNA, 20 bp, Artificial Sequence
  chemically synthesized
aatttatagtcatagtcaga

SEQ ID NO: 281690 - DNA, 20 bp, Artificial Sequence
  chemically synthesized
tttatagtcatagtcagata

SEQ ID NO: 281691 - DNA, 20 bp, Artificial Sequence
  chemically synthesized
gtcagatagagccaaaatta

SEQ ID NO: 281692 - DNA, 20 bp, Artificial Sequence
  chemically synthesized
tctccagtggactttaattt

SEQ ID NO: 281693 - DNA, 20 bp, Artificial Sequence
  chemically synthesized
gagccaaaattaaagtccac

SEQ ID NO: 281694 - DNA, 20 bp, Artificial Sequence
  chemically synthesized
gccaaaattaaagtccactg

SEQ ID NO: 281695 - DNA, 20 bp, Artificial Sequence
  chemically synthesized
acaatgaagtagatctccag

SEQ ID NO: 281696 - DNA, 20 bp, Artificial Sequence
  chemically synthesized
agtacaatgaagtagatctc

SEQ ID NO: 281697 - DNA, 20 bp, Artificial Sequence
  chemically synthesized
gatattaaagtacaatgaag

SEQ ID NO: 281698 - DNA, 20 bp, Artificial Sequence
  chemically synthesized
aaagatattaaagtacaatg

SEQ ID NO: 281699 - DNA, 20 bp, Artificial Sequence
  chemically synthesized
taaaacctgaaaagatatta

SEQ ID NO: 281700 - DNA, 20 bp, Artificial Sequence
  chemically synthesized
attgtactttaatatctttt

SEQ ID NO: 281701 - DNA, 20 bp, Artificial Sequence
  chemically synthesized
ttgtactttaatatcttttc

SEQ ID NO: 281702 - DNA, 20 bp, Artificial Sequence
  chemically synthesized
aggaaattataaaacctgaa

SEQ ID NO: 281703 - DNA, 20 bp, Artificial Sequence
  chemically synthesized
ccaacttcctaattttcaaa

SEQ ID NO: 281704 - DNA, 20 bp, Artificial Sequence
  chemically synthesized
tccaacttcctaattttcaa

SEQ ID NO: 281705 - DNA, 20 bp, Artificial Sequence
  chemically synthesized
tataatttccttttgaaaat

SEQ ID NO: 281706 - DNA, 20 bp, Artificial Sequence
  chemically synthesized
ataatttccttttgaaaatt

SEQ ID NO: 281707 - DNA, 20 bp, Artificial Sequence
  chemically synthesized
atttccttttgaaaattagg

SEQ ID NO: 281708 - DNA, 20 bp, Artificial Sequence
  chemically synthesized
ccttttgaaaattaggaagt

SEQ ID NO: 281709 - DNA, 20 bp, Artificial Sequence
  chemically synthesized
aagttggataaaatgatcta

SEQ ID NO: 281710 - DNA, 20 bp, Artificial Sequence
  chemically synthesized
agttggataaaatgatctat

SEQ ID NO: 281711 - DNA, 20 bp, Artificial Sequence
  chemically synthesized
aacatcagagtagacaccta

SEQ ID NO: 281712 - DNA, 20 bp, Artificial Sequence
  chemically synthesized
gtaatcctagaacatcagag

SEQ ID NO: 281713 - DNA, 20 bp, Artificial Sequence
  chemically synthesized
tttgtaatcctagaacatca

SEQ ID NO: 281714 - DNA, 20 bp, Artificial Sequence
  chemically synthesized
aggtgtctactctgatgttc

SEQ ID NO: 281715 - DNA, 20 bp, Artificial Sequence
  chemically synthesized
ggtgtctactctgatgttct

SEQ ID NO: 281716 - DNA, 20 bp, Artificial Sequence
  chemically synthesized
aatttgtaatcctagaacat

SEQ ID NO: 281717 - DNA, 20 bp, Artificial Sequence
  chemically synthesized
cagaatagaatttgtaatcc

SEQ ID NO: 281718 - DNA, 20 bp, Artificial Sequence
  chemically synthesized
aggtatttctttagacagaa

SEQ ID NO: 281719 - DNA, 20 bp, Artificial Sequence
  chemically synthesized
tacaaattctattctgtcta

SEQ ID NO: 281720 - DNA, 20 bp, Artificial Sequence
  chemically synthesized
atgtaaggtatttctttaga

SEQ ID NO: 281721 - DNA, 20 bp, Artificial Sequence
  chemically synthesized
gaaaatgtaaggtatttctt

SEQ ID NO: 281722 - DNA, 20 bp, Artificial Sequence
  chemically synthesized
caagatgtgaagaaaatgta

SEQ ID NO: 281723 - DNA, 20 bp, Artificial Sequence
  chemically synthesized
tcaagatgtgaagaaaatgt

SEQ ID NO: 281724 - DNA, 20 bp, Artificial Sequence
  chemically synthesized
cataaattattcaagatgtg

SEQ ID NO: 281725 - DNA, 20 bp, Artificial Sequence
  chemically synthesized
ataaggagcataaattattc

SEQ ID NO: 281726 - DNA, 20 bp, Artificial Sequence
  chemically synthesized
ctgtaaatctataaaataag

SEQ ID NO: 281727 - DNA, 20 bp, Artificial Sequence
  chemically synthesized
aatttatgctccttatttta

SEQ ID NO: 281728 - DNA, 20 bp, Artificial Sequence
  chemically synthesized
ctctgtaaatctataaaata

SEQ ID NO: 281729 - DNA, 20 bp, Artificial Sequence
  chemically synthesized
cctctgtaaatctataaaat

SEQ ID NO: 281730 - DNA, 20 bp, Artificial Sequence
  chemically synthesized
ctccttattttatagattta

SEQ ID NO: 281731 - DNA, 20 bp, Artificial Sequence
  chemically synthesized
ccttattttatagatttaca

SEQ ID NO: 281732 - DNA, 20 bp, Artificial Sequence
  chemically synthesized
cttattttatagatttacag

SEQ ID NO: 281733 - DNA, 20 bp, Artificial Sequence
  chemically synthesized
ttattttatagatttacaga

SEQ ID NO: 281734 - DNA, 20 bp, Artificial Sequence
  chemically synthesized
tattttatagatttacagag

SEQ ID NO: 281735 - DNA, 20 bp, Artificial Sequence
  chemically synthesized
acgtaaagctataagtagta

SEQ ID NO: 281736 - DNA, 20 bp, Artificial Sequence
  chemically synthesized
cagaggggctatactactta

SEQ ID NO: 281737 - DNA, 20 bp, Artificial Sequence
  chemically synthesized
tatgtacgtaaagctataag

SEQ ID NO: 281738 - DNA, 20 bp, Artificial Sequence
  chemically synthesized
atatatgtacgtaaagctat

SEQ ID NO: 281739 - DNA, 20 bp, Artificial Sequence
  chemically synthesized
atatgtaatatatgtacgta

SEQ ID NO: 281740 - DNA, 20 bp, Artificial Sequence
  chemically synthesized
atgtaatgaatatgttgttt

SEQ ID NO: 281741 - DNA, 20 bp, Artificial Sequence
  chemically synthesized
aacaacatattcattacata

SEQ ID NO: 281742 - DNA, 20 bp, Artificial Sequence
  chemically synthesized
catattcattacatatagat

SEQ ID NO: 281743 - DNA, 20 bp, Artificial Sequence
  chemically synthesized
attacatatagataagtcaa

SEQ ID NO: 281744 - DNA, 20 bp, Artificial Sequence
  chemically synthesized
caaaagtacactaaaatgca

SEQ ID NO: 281745 - DNA, 20 bp, Artificial Sequence
  chemically synthesized
cattcaagctctatgcattt

SEQ ID NO: 281746 - DNA, 20 bp, Artificial Sequence
  chemically synthesized
aaagtacactaaaatgcata

SEQ ID NO: 281747 - DNA, 20 bp, Artificial Sequence
  chemically synthesized
cttctgacatttaatcattc

SEQ ID NO: 281748 - DNA, 20 bp, Artificial Sequence
  chemically synthesized
gagcttgaatgattaaatgt

SEQ ID NO: 281749 - DNA, 20 bp, Artificial Sequence
  chemically synthesized
cttgaatgattaaatgtcag

SEQ ID NO: 281750 - DNA, 20 bp, Artificial Sequence
  chemically synthesized
tgattaaatgtcagaagtta

SEQ ID NO: 281751 - DNA, 20 bp, Artificial Sequence
  chemically synthesized
aaatgtcagaagttaaagtc

SEQ ID NO: 281752 - DNA, 20 bp, Artificial Sequence
  chemically synthesized
gagactttcaataattaaat

SEQ ID NO: 281753 - DNA, 20 bp, Artificial Sequence
  chemically synthesized
caaactcatttaattattga

SEQ ID NO: 281754 - DNA, 20 bp, Artificial Sequence
  chemically synthesized
ttaattattgaaagtctcca

SEQ ID NO: 281755 - DNA, 20 bp, Artificial Sequence
  chemically synthesized
catttttaagttttactttg

SEQ ID NO: 281756 - DNA, 20 bp, Artificial Sequence
  chemically synthesized
tacatttttaagttttactt

SEQ ID NO: 281757 - DNA, 20 bp, Artificial Sequence
  chemically synthesized
taaaatgtaagtacattttt

SEQ ID NO: 281758 - DNA, 20 bp, Artificial Sequence
  chemically synthesized
ttaaagtattcataaaatgt

SEQ ID NO: 281759 - DNA, 20 bp, Artificial Sequence
  chemically synthesized
tacattttatgaatacttta

SEQ ID NO: 281760 - DNA, 20 bp, Artificial Sequence
  chemically synthesized
atattggaaatatatcttta

SEQ ID NO: 281761 - DNA, 20 bp, Artificial Sequence
  chemically synthesized
aagatatatttccaatatta

SEQ ID NO: 281762 - DNA, 20 bp, Artificial Sequence
  chemically synthesized
aaatggatatgctttaatat

SEQ ID NO: 281763 - DNA, 20 bp, Artificial Sequence
  chemically synthesized
gaatgttttgagttattaaa

SEQ ID NO: 281764 - DNA, 20 bp, Artificial Sequence
  chemically synthesized
tacaccttacggaatgtttt

SEQ ID NO: 281765 - DNA, 20 bp, Artificial Sequence
  chemically synthesized
aataactcaaaacattccgt

SEQ ID NO: 281766 - DNA, 20 bp, Artificial Sequence
  chemically synthesized
ataactcaaaacattccgta

SEQ ID NO: 281767 - DNA, 20 bp, Artificial Sequence
  chemically synthesized
aatcacaaatttacacctta

SEQ ID NO: 281768 - DNA, 20 bp, Artificial Sequence
  chemically synthesized
aggtgtaaatttgtgatttt

SEQ ID NO: 281769 - DNA, 20 bp, Artificial Sequence
  chemically synthesized
gtaaatttgtgattttaagt

SEQ ID NO: 281770 - DNA, 20 bp, Artificial Sequence
  chemically synthesized
gattttaagtaagtataaaa

SEQ ID NO: 281771 - DNA, 20 bp, Artificial Sequence
  chemically synthesized
attttaagtaagtataaaat

SEQ ID NO: 281772 - DNA, 20 bp, Artificial Sequence
  chemically synthesized
aaaagctgcacgtattgaat

SEQ ID NO: 281773 - DNA, 20 bp, Artificial Sequence
  chemically synthesized
aggttccaattcaatacgtg

SEQ ID NO: 281774 - DNA, 20 bp, Artificial Sequence
  chemically synthesized
aatacgtgcagcttttaaac

SEQ ID NO: 281775 - DNA, 20 bp, Artificial Sequence
  chemically synthesized
aaatattatttccagtttaa

SEQ ID NO: 281776 - DNA, 20 bp, Artificial Sequence
  chemically synthesized
ataatatgaaatattatttc

SEQ ID NO: 281777 - DNA, 20 bp, Artificial Sequence
  chemically synthesized
tttcatattatcatcccgat

SEQ ID NO: 281778 - DNA, 20 bp, Artificial Sequence
  chemically synthesized
tcactgctttagggctaatc

SEQ ID NO: 281779 - DNA, 20 bp, Artificial Sequence
  chemically synthesized
ctcactgctttagggctaat

SEQ ID NO: 281780 - DNA, 20 bp, Artificial Sequence
  chemically synthesized
tatcatcccgattagcccta

SEQ ID NO: 281781 - DNA, 20 bp, Artificial Sequence
  chemically synthesized
catcccgattagccctaaag

SEQ ID NO: 281782 - DNA, 20 bp, Artificial Sequence
  chemically synthesized
taaacaaactcactgcttta

SEQ ID NO: 281783 - DNA, 20 bp, Artificial Sequence
  chemically synthesized
ataaacaaactcactgcttt

SEQ ID NO: 281784 - DNA, 20 bp, Artificial Sequence
  chemically synthesized
ccgattagccctaaagcagt

SEQ ID NO: 281785 - DNA, 20 bp, Artificial Sequence
  chemically synthesized
aataaacaaactcactgctt

SEQ ID NO: 281786 - DNA, 20 bp, Artificial Sequence
  chemically synthesized
gtttattcacactgtctttg

SEQ ID NO: 281787 - DNA, 20 bp, Artificial Sequence
  chemically synthesized
tttattcacactgtctttgc

SEQ ID NO: 281788 - DNA, 20 bp, Artificial Sequence
  chemically synthesized
gtaccacaaacctgcaaaga

SEQ ID NO: 281789 - DNA, 20 bp, Artificial Sequence
  chemically synthesized
aaatgtaccacaaacctgca

SEQ ID NO: 281790 - DNA, 20 bp, Artificial Sequence
  chemically synthesized
acactgtctttgcaggtttg

SEQ ID NO: 281791 - DNA, 20 bp, Artificial Sequence
  chemically synthesized
aggtttgtggtacatttaat

SEQ ID NO: 281792 - DNA, 20 bp, Artificial Sequence
  chemically synthesized
ggtttgtggtacatttaatt

SEQ ID NO: 281793 - DNA, 20 bp, Artificial Sequence
  chemically synthesized
gtggtacatttaattaggtg

SEQ ID NO: 281794 - DNA, 20 bp, Artificial Sequence
  chemically synthesized
aattaggtgaagcatctatg

SEQ ID NO: 281795 - DNA, 20 bp, Artificial Sequence
  chemically synthesized
ttatatcactaagttctaca

SEQ ID NO: 281796 - DNA, 20 bp, Artificial Sequence
  chemically synthesized
tgaagcatctatgtagaact

SEQ ID NO: 281797 - DNA, 20 bp, Artificial Sequence
  chemically synthesized
tttgcctttattatatcact

SEQ ID NO: 281798 - DNA, 20 bp, Artificial Sequence
  chemically synthesized
tagaacttagtgatataata

SEQ ID NO: 281799 - DNA, 20 bp, Artificial Sequence
  chemically synthesized
agaacttagtgatataataa

SEQ ID NO: 281800 - DNA, 20 bp, Artificial Sequence
  chemically synthesized
taaaggcaaatttcctctgt

SEQ ID NO: 281801 - DNA, 20 bp, Artificial Sequence
  chemically synthesized
aggcaaatttcctctgtgag

SEQ ID NO: 281802 - DNA, 20 bp, Artificial Sequence
  chemically synthesized
gtttaaatggcttctcacag

SEQ ID NO: 281803 - DNA, 20 bp, Artificial Sequence
  chemically synthesized
ggtttaaatggcttctcaca

SEQ ID NO: 281804 - DNA, 20 bp, Artificial Sequence
  chemically synthesized
agggtttaaatggcttctca

SEQ ID NO: 281805 - DNA, 20 bp, Artificial Sequence
  chemically synthesized
gattttgcaaagggtttaaa

SEQ ID NO: 281806 - DNA, 20 bp, Artificial Sequence
  chemically synthesized
aggtcacaagattttgcaaa

SEQ ID NO: 281807 - DNA, 20 bp, Artificial Sequence
  chemically synthesized
taggtcacaagattttgcaa

SEQ ID NO: 281808 - DNA, 20 bp, Artificial Sequence
  chemically synthesized
ctaggtcacaagattttgca

SEQ ID NO: 281809 - DNA, 20 bp, Artificial Sequence
  chemically synthesized
ctttgcaaaatcttgtgacc

SEQ ID NO: 281810 - DNA, 20 bp, Artificial Sequence
  chemically synthesized
ctaataaccttctaggtcac

SEQ ID NO: 281811 - DNA, 20 bp, Artificial Sequence
  chemically synthesized
tgcaaaatcttgtgacctag

SEQ ID NO: 281812 - DNA, 20 bp, Artificial Sequence
  chemically synthesized
gcaaaatcttgtgacctaga

SEQ ID NO: 281813 - DNA, 20 bp, Artificial Sequence
  chemically synthesized
gttccccctaataaccttct

SEQ ID NO: 281814 - DNA, 20 bp, Artificial Sequence
  chemically synthesized
tgttccccctaataaccttc

SEQ ID NO: 281815 - DNA, 20 bp, Artificial Sequence
  chemically synthesized
cttgtgacctagaaggttat

SEQ ID NO: 281816 - DNA, 20 bp, Artificial Sequence
  chemically synthesized
ttgtgacctagaaggttatt

SEQ ID NO: 281817 - DNA, 20 bp, Artificial Sequence
  chemically synthesized
tgtgacctagaaggttatta

SEQ ID NO: 281818 - DNA, 20 bp, Artificial Sequence
  chemically synthesized
gtgacctagaaggttattag

SEQ ID NO: 281819 - DNA, 20 bp, Artificial Sequence
  chemically synthesized
tgacctagaaggttattagg

SEQ ID NO: 281820 - DNA, 20 bp, Artificial Sequence
  chemically synthesized
gaaggttattagggggaaca

SEQ ID NO: 281821 - DNA, 20 bp, Artificial Sequence
  chemically synthesized
aaggttattagggggaacaa

SEQ ID NO: 281822 - DNA, 20 bp, Artificial Sequence
  chemically synthesized
gggaacaaaggctttatcca

SEQ ID NO: 281823 - DNA, 20 bp, Artificial Sequence
  chemically synthesized
cagcactggtactttggata

SEQ ID NO: 281824 - DNA, 20 bp, Artificial Sequence
  chemically synthesized
aaaggctttatccaaagtac

SEQ ID NO: 281825 - DNA, 20 bp, Artificial Sequence
  chemically synthesized
atcactcagcactggtactt

SEQ ID NO: 281826 - DNA, 20 bp, Artificial Sequence
  chemically synthesized
ttatccaaagtaccagtgct

SEQ ID NO: 281827 - DNA, 20 bp, Artificial Sequence
  chemically synthesized
actatgttatcactcagcac

SEQ ID NO: 281828 - DNA, 20 bp, Artificial Sequence
  chemically synthesized
ataattactatgttatcact

SEQ ID NO: 281829 - DNA, 20 bp, Artificial Sequence
  chemically synthesized
accagtgctgagtgataaca

SEQ ID NO: 281830 - DNA, 20 bp, Artificial Sequence
  chemically synthesized
acatagtaattatactctct

SEQ ID NO: 281831 - DNA, 20 bp, Artificial Sequence
  chemically synthesized
catagtaattatactctctt

SEQ ID NO: 281832 - DNA, 20 bp, Artificial Sequence
  chemically synthesized
ccaaagaaaacaacccaaga

SEQ ID NO: 281833 - DNA, 20 bp, Artificial Sequence
  chemically synthesized
atccaaagaaaacaacccaa

SEQ ID NO: 281834 - DNA, 20 bp, Artificial Sequence
  chemically synthesized
aaatccaaagaaaacaaccc

SEQ ID NO: 281835 - DNA, 20 bp, Artificial Sequence
  chemically synthesized
ctctcttgggttgttttctt

SEQ ID NO: 281836 - DNA, 20 bp, Artificial Sequence
  chemically synthesized
ccaaatagaagacaaatcca

SEQ ID NO: 281837 - DNA, 20 bp, Artificial Sequence
  chemically synthesized
ctttggatttgtcttctatt

SEQ ID NO: 281838 - DNA, 20 bp, Artificial Sequence
  chemically synthesized
agaggtcaagtaccaaatag

SEQ ID NO: 281839 - DNA, 20 bp, Artificial Sequence
  chemically synthesized
aaaagaggtcaagtaccaaa

SEQ ID NO: 281840 - DNA, 20 bp, Artificial Sequence
  chemically synthesized
atgcagtattaaaagaggtc

SEQ ID NO: 281841 - DNA, 20 bp, Artificial Sequence
  chemically synthesized
tttatatgcagtattaaaag

SEQ ID NO: 281842 - DNA, 20 bp, Artificial Sequence
  chemically synthesized
atttatatgcagtattaaaa

SEQ ID NO: 281843 - DNA, 20 bp, Artificial Sequence
  chemically synthesized
taatttatatgcagtattaa

SEQ ID NO: 281844 - DNA, 20 bp, Artificial Sequence
  chemically synthesized
aaatgatgataatttatatg

SEQ ID NO: 281845 - DNA, 20 bp, Artificial Sequence
  chemically synthesized
gcatataaattatcatcatt

SEQ ID NO: 281846 - DNA, 20 bp, Artificial Sequence
  chemically synthesized
ctagatgtaagttgtaaatt

SEQ ID NO: 281847 - DNA, 20 bp, Artificial Sequence
  chemically synthesized
cttaatttacaacttacatc

SEQ ID NO: 281848 - DNA, 20 bp, Artificial Sequence
  chemically synthesized
atctctgaggtgctagatgt

SEQ ID NO: 281849 - DNA, 20 bp, Artificial Sequence
  chemically synthesized
acaacttacatctagcacct

SEQ ID NO: 281850 - DNA, 20 bp, Artificial Sequence
  chemically synthesized
tgaggaaatctctgaggtgc

SEQ ID NO: 281851 - DNA, 20 bp, Artificial Sequence
  chemically synthesized
aacttacatctagcacctca

SEQ ID NO: 281852 - DNA, 20 bp, Artificial Sequence
  chemically synthesized
cggagctgaggaaatctctg

SEQ ID NO: 281853 - DNA, 20 bp, Artificial Sequence
  chemically synthesized
gcggagctgaggaaatctct

SEQ ID NO: 281854 - DNA, 20 bp, Artificial Sequence
  chemically synthesized
tagcacctcagagatttcct

SEQ ID NO: 281855 - DNA, 20 bp, Artificial Sequence
  chemically synthesized
aaacattcctggcggagctg

SEQ ID NO: 281856 - DNA, 20 bp, Artificial Sequence
  chemically synthesized
aaaacattcctggcggagct

SEQ ID NO: 281857 - DNA, 20 bp, Artificial Sequence
  chemically synthesized
agagatttcctcagctccgc

SEQ ID NO: 281858 - DNA, 20 bp, Artificial Sequence
  chemically synthesized
gagatttcctcagctccgcc

SEQ ID NO: 281859 - DNA, 20 bp, Artificial Sequence
  chemically synthesized
cactgaaaacattcctggcg

SEQ ID NO: 281860 - DNA, 20 bp, Artificial Sequence
  chemically synthesized
accactgaaaacattcctgg

SEQ ID NO: 281861 - DNA, 20 bp, Artificial Sequence
  chemically synthesized
aaaaccactgaaaacattcc

SEQ ID NO: 281862 - DNA, 20 bp, Artificial Sequence
  chemically synthesized
agctccgccaggaatgtttt

SEQ ID NO: 281863 - DNA, 20 bp, Artificial Sequence
  chemically synthesized
tccgccaggaatgttttcag

SEQ ID NO: 281864 - DNA, 20 bp, Artificial Sequence
  chemically synthesized
ggaatgttttcagtggtttt

SEQ ID NO: 281865 - DNA, 20 bp, Artificial Sequence
  chemically synthesized
agtttaaattctacttcatt

SEQ ID NO: 281866 - DNA, 20 bp, Artificial Sequence
  chemically synthesized
aaacaagtggctaaatgaag

SEQ ID NO: 281867 - DNA, 20 bp, Artificial Sequence
  chemically synthesized
agcaaacaagtggctaaatg

SEQ ID NO: 281868 - DNA, 20 bp, Artificial Sequence
  chemically synthesized
acttggagaaagcaaacaag

SEQ ID NO: 281869 - DNA, 20 bp, Artificial Sequence
  chemically synthesized
catacttggagaaagcaaac

SEQ ID NO: 281870 - DNA, 20 bp, Artificial Sequence
  chemically synthesized
gccacttgtttgctttctcc

SEQ ID NO: 281871 - DNA, 20 bp, Artificial Sequence
  chemically synthesized
gttattgtcatacttggaga

SEQ ID NO: 281872 - DNA, 20 bp, Artificial Sequence
  chemically synthesized
atgagttattgtcatacttg

SEQ ID NO: 281873 - DNA, 20 bp, Artificial Sequence
  chemically synthesized
gcatgagttattgtcatact

SEQ ID NO: 281874 - DNA, 20 bp, Artificial Sequence
  chemically synthesized
aagtttgggcatgttggcat

SEQ ID NO: 281875 - DNA, 20 bp, Artificial Sequence
  chemically synthesized
cttaggaagtttgggcatgt

SEQ ID NO: 281876 - DNA, 20 bp, Artificial Sequence
  chemically synthesized
atttctttcttaggaagttt

SEQ ID NO: 281877 - DNA, 20 bp, Artificial Sequence
  chemically synthesized
tatttctttcttaggaagtt

SEQ ID NO: 281878 - DNA, 20 bp, Artificial Sequence
  chemically synthesized
ccaacatgcccaaacttcct

SEQ ID NO: 281879 - DNA, 20 bp, Artificial Sequence
  chemically synthesized
catgcccaaacttcctaaga

SEQ ID NO: 281880 - DNA, 20 bp, Artificial Sequence
  chemically synthesized
atatatatttctttcttagg

SEQ ID NO: 281881 - DNA, 20 bp, Artificial Sequence
  chemically synthesized
gtgatatatatttctttctt

SEQ ID NO: 281882 - DNA, 20 bp, Artificial Sequence
  chemically synthesized
tgtgatatatatttctttct

SEQ ID NO: 281883 - DNA, 20 bp, Artificial Sequence
  chemically synthesized
taagaaagaaatatatatca

SEQ ID NO: 281884 - DNA, 20 bp, Artificial Sequence
  chemically synthesized
atatcacagattaaatatta

SEQ ID NO: 281885 - DNA, 20 bp, Artificial Sequence
  chemically synthesized
tcacagattaaatattatgg

SEQ ID NO: 281886 - DNA, 20 bp, Artificial Sequence
  chemically synthesized
gattaaatattatggtagaa

SEQ ID NO: 281887 - DNA, 20 bp, Artificial Sequence
  chemically synthesized
cagaagttttaataatgaaa

SEQ ID NO: 281888 - DNA, 20 bp, Artificial Sequence
  chemically synthesized
acaaagtgttatattttcag

SEQ ID NO: 281889 - DNA, 20 bp, Artificial Sequence
  chemically synthesized
aatacaaagtgttatatttt

SEQ ID NO: 281890 - DNA, 20 bp, Artificial Sequence
  chemically synthesized
aagtaaaggtgaaaaataca

SEQ ID NO: 281891 - DNA, 20 bp, Artificial Sequence
  chemically synthesized
aattacctgctacaaagtaa

SEQ ID NO: 281892 - DNA, 20 bp, Artificial Sequence
  chemically synthesized
tatttttcacctttactttg

SEQ ID NO: 281893 - DNA, 20 bp, Artificial Sequence
  chemically synthesized
gaattacctgctacaaagta

SEQ ID NO: 281894 - DNA, 20 bp, Artificial Sequence
  chemically synthesized
ttttcacctttactttgtag

SEQ ID NO: 281895 - DNA, 20 bp, Artificial Sequence
  chemically synthesized
tttcacctttactttgtagc

SEQ ID NO: 281896 - DNA, 20 bp, Artificial Sequence
  chemically synthesized
attttgaattacctgctaca

SEQ ID NO: 281897 - DNA, 20 bp, Artificial Sequence
  chemically synthesized
gtagcaggtaattcaaaatg

SEQ ID NO: 281898 - DNA, 20 bp, Artificial Sequence
  chemically synthesized
caggtaattcaaaatgcagc

SEQ ID NO: 281899 - DNA, 20 bp, Artificial Sequence
  chemically synthesized
taattcaaaatgcagctaga

SEQ ID NO: 281900 - DNA, 20 bp, Artificial Sequence
  chemically synthesized
tattagatgatgaaactgtc

SEQ ID NO: 281901 - DNA, 20 bp, Artificial Sequence
  chemically synthesized
acttttgattgtagaggtat

SEQ ID NO: 281902 - DNA, 20 bp, Artificial Sequence
  chemically synthesized
ttaatgacttttgattgtag

SEQ ID NO: 281903 - DNA, 20 bp, Artificial Sequence
  chemically synthesized
cttaatgacttttgattgta

SEQ ID NO: 281904 - DNA, 20 bp, Artificial Sequence
  chemically synthesized
tctaatacctctacaatcaa

SEQ ID NO: 281905 - DNA, 20 bp, Artificial Sequence
  chemically synthesized
ttcttaatgacttttgattg

SEQ ID NO: 281906 - DNA, 20 bp, Artificial Sequence
  chemically synthesized
ctctacaatcaaaagtcatt

SEQ ID NO: 281907 - DNA, 20 bp, Artificial Sequence
  chemically synthesized
tgaataatgaataaattcaa

SEQ ID NO: 281908 - DNA, 20 bp, Artificial Sequence
  chemically synthesized
taatgaataaattcaaaaga

SEQ ID NO: 281909 - DNA, 20 bp, Artificial Sequence
  chemically synthesized
gtgcttatttttattttaaa

SEQ ID NO: 281910 - DNA, 20 bp, Artificial Sequence
  chemically synthesized
ttactttttaaaataaaaat

SEQ ID NO: 281911 - DNA, 20 bp, Artificial Sequence
  chemically synthesized
aaaaataagcaccaacattg

SEQ ID NO: 281912 - DNA, 20 bp, Artificial Sequence
  chemically synthesized
tgtttcccagactgcaatgt

SEQ ID NO: 281913 - DNA, 20 bp, Artificial Sequence
  chemically synthesized
taagcaccaacattgcagtc

SEQ ID NO: 281914 - DNA, 20 bp, Artificial Sequence
  chemically synthesized
aagcaccaacattgcagtct

SEQ ID NO: 281915 - DNA, 20 bp, Artificial Sequence
  chemically synthesized
caacattgcagtctgggaaa

SEQ ID NO: 281916 - DNA, 20 bp, Artificial Sequence
  chemically synthesized
gcttttatttttctgtttcc

SEQ ID NO: 281917 - DNA, 20 bp, Artificial Sequence
  chemically synthesized
tctgggaaacagaaaaataa

SEQ ID NO: 281918 - DNA, 20 bp, Artificial Sequence
  chemically synthesized
acagtgatgtgtgagggagt

SEQ ID NO: 281919 - DNA, 20 bp, Artificial Sequence
  chemically synthesized
ggtaacagtgatgtgtgagg

SEQ ID NO: 281920 - DNA, 20 bp, Artificial Sequence
  chemically synthesized
ctggtaacagtgatgtgtga

SEQ ID NO: 281921 - DNA, 20 bp, Artificial Sequence
  chemically synthesized
actggtaacagtgatgtgtg

SEQ ID NO: 281922 - DNA, 20 bp, Artificial Sequence
  chemically synthesized
tactggtaacagtgatgtgt

SEQ ID NO: 281923 - DNA, 20 bp, Artificial Sequence
  chemically synthesized
ccctcacacatcactgttac

SEQ ID NO: 281924 - DNA, 20 bp, Artificial Sequence
  chemically synthesized
aggtcacagaatactggtaa

SEQ ID NO: 281925 - DNA, 20 bp, Artificial Sequence
  chemically synthesized
cagaggaggtcacagaatac

SEQ ID NO: 281926 - DNA, 20 bp, Artificial Sequence
  chemically synthesized
ataaatttcagaggaggtca

SEQ ID NO: 281927 - DNA, 20 bp, Artificial Sequence
  chemically synthesized
tatatgataaatttcagagg

SEQ ID NO: 281928 - DNA, 20 bp, Artificial Sequence
  chemically synthesized
atatatgataaatttcagag

SEQ ID NO: 281929 - DNA, 20 bp, Artificial Sequence
  chemically synthesized
ttatatatgataaatttcag

SEQ ID NO: 281930 - DNA, 20 bp, Artificial Sequence
  chemically synthesized
attatatatgataaatttca

SEQ ID NO: 281931 - DNA, 20 bp, Artificial Sequence
  chemically synthesized
aaattatatatgataaattt

SEQ ID NO: 281932 - DNA, 20 bp, Artificial Sequence
  chemically synthesized
atttatcatatataatttga

SEQ ID NO: 281933 - DNA, 20 bp, Artificial Sequence
  chemically synthesized
taatttgatagttaaaattt

SEQ ID NO: 281934 - DNA, 20 bp, Artificial Sequence
  chemically synthesized
ttgatagttaaaatttaagt

SEQ ID NO: 281935 - DNA, 20 bp, Artificial Sequence
  chemically synthesized
aatttaagtgagtttaacta

SEQ ID NO: 281936 - DNA, 20 bp, Artificial Sequence
  chemically synthesized
gtttagtgaaaagagagcta

SEQ ID NO: 281937 - DNA, 20 bp, Artificial Sequence
  chemically synthesized
tataatgtttagtgaaaaga

SEQ ID NO: 281938 - DNA, 20 bp, Artificial Sequence
  chemically synthesized
gatataatgtttagtgaaaa

SEQ ID NO: 281939 - DNA, 20 bp, Artificial Sequence
  chemically synthesized
atgatataatgtttagtgaa

SEQ ID NO: 281940 - DNA, 20 bp, Artificial Sequence
  chemically synthesized
aaatggtatgatataatgtt

SEQ ID NO: 281941 - DNA, 20 bp, Artificial Sequence
  chemically synthesized
cttcttagtaatacagaaaa

SEQ ID NO: 281942 - DNA, 20 bp, Artificial Sequence
  chemically synthesized
ataccattttctgtattact

SEQ ID NO: 281943 - DNA, 20 bp, Artificial Sequence
  chemically synthesized
aatatgtcttcttagtaata

SEQ ID NO: 281944 - DNA, 20 bp, Artificial Sequence
  chemically synthesized
ccattttctgtattactaag

SEQ ID NO: 281945 - DNA, 20 bp, Artificial Sequence
  chemically synthesized
tcattaaaaatatgtcttct

SEQ ID NO: 281946 - DNA, 20 bp, Artificial Sequence
  chemically synthesized
catatttttaatgaaaatct

SEQ ID NO: 281947 - DNA, 20 bp, Artificial Sequence
  chemically synthesized
gagccactttaaagaagtct

SEQ ID NO: 281948 - DNA, 20 bp, Artificial Sequence
  chemically synthesized
gaaaatctaagacttcttta

SEQ ID NO: 281949 - DNA, 20 bp, Artificial Sequence
  chemically synthesized
aagatagagccactttaaag

SEQ ID NO: 281950 - DNA, 20 bp, Artificial Sequence
  chemically synthesized
aatctaagacttctttaaag

SEQ ID NO: 281951 - DNA, 20 bp, Artificial Sequence
  chemically synthesized
actaagatagagccacttta

SEQ ID NO: 281952 - DNA, 20 bp, Artificial Sequence
  chemically synthesized
tctttaaagtggctctatct

SEQ ID NO: 281953 - DNA, 20 bp, Artificial Sequence
  chemically synthesized
gaaattgctaaactaagata

SEQ ID NO: 281954 - DNA, 20 bp, Artificial Sequence
  chemically synthesized
aggaaattgctaaactaaga

SEQ ID NO: 281955 - DNA, 20 bp, Artificial Sequence
  chemically synthesized
aaagtggctctatcttagtt

SEQ ID NO: 281956 - DNA, 20 bp, Artificial Sequence
  chemically synthesized
aaaaaggaaattgctaaact

SEQ ID NO: 281957 - DNA, 20 bp, Artificial Sequence
  chemically synthesized
gtttagcaatttcctttttt

SEQ ID NO: 281958 - DNA, 20 bp, Artificial Sequence
  chemically synthesized
aaagtagtctatctaaaaaa

SEQ ID NO: 281959 - DNA, 20 bp, Artificial Sequence
  chemically synthesized
aaaagtagtctatctaaaaa

SEQ ID NO: 281960 - DNA, 20 bp, Artificial Sequence
  chemically synthesized
agcaatttcctttttttaga

SEQ ID NO: 281961 - DNA, 20 bp, Artificial Sequence
  chemically synthesized
ttttttagatagactacttt

SEQ ID NO: 281962 - DNA, 20 bp, Artificial Sequence
  chemically synthesized
atagcaaacaaaactaaaag

SEQ ID NO: 281963 - DNA, 20 bp, Artificial Sequence
  chemically synthesized
ataatagcaaacaaaactaa

SEQ ID NO: 281964 - DNA, 20 bp, Artificial Sequence
  chemically synthesized
tgtttaccataaatttataa

SEQ ID NO: 281965 - DNA, 20 bp, Artificial Sequence
  chemically synthesized
tgtttgctattataaattta

SEQ ID NO: 281966 - DNA, 20 bp, Artificial Sequence
  chemically synthesized
ggtaaacatcatcgtgaata

SEQ ID NO: 281967 - DNA, 20 bp, Artificial Sequence
  chemically synthesized
ataataagaatgtggaaaaa

SEQ ID NO: 281968 - DNA, 20 bp, Artificial Sequence
  chemically synthesized
tcaaggaaataataagaatg

SEQ ID NO: 281969 - DNA, 20 bp, Artificial Sequence
  chemically synthesized
atatacctcaaggaaataat

SEQ ID NO: 281970 - DNA, 20 bp, Artificial Sequence
  chemically synthesized
cacattcttattatttcctt

SEQ ID NO: 281971 - DNA, 20 bp, Artificial Sequence
  chemically synthesized
acattcttattatttccttg

SEQ ID NO: 281972 - DNA, 20 bp, Artificial Sequence
  chemically synthesized
atttccgataatatacctca

SEQ ID NO: 281973 - DNA, 20 bp, Artificial Sequence
  chemically synthesized
tatttccgataatatacctc

SEQ ID NO: 281974 - DNA, 20 bp, Artificial Sequence
  chemically synthesized
atttccttgaggtatattat

SEQ ID NO: 281975 - DNA, 20 bp, Artificial Sequence
  chemically synthesized
taatcaaacctttgaattag

SEQ ID NO: 281976 - DNA, 20 bp, Artificial Sequence
  chemically synthesized
gaaatattaccactaattca

SEQ ID NO: 281977 - DNA, 20 bp, Artificial Sequence
  chemically synthesized
aaatattaccactaattcaa

SEQ ID NO: 281978 - DNA, 20 bp, Artificial Sequence
  chemically synthesized
aaataatcaaacctttgaat

SEQ ID NO: 281979 - DNA, 20 bp, Artificial Sequence
  chemically synthesized
aaaggtttgattattttaaa

SEQ ID NO: 281980 - DNA, 20 bp, Artificial Sequence
  chemically synthesized
agtttcataatacaaattaa

SEQ ID NO: 281981 - DNA, 20 bp, Artificial Sequence
  chemically synthesized
gagtacttctgtgtataaat

SEQ ID NO: 281982 - DNA, 20 bp, Artificial Sequence
  chemically synthesized
ttatgaaactgatttataca

SEQ ID NO: 281983 - DNA, 20 bp, Artificial Sequence
  chemically synthesized
tgaaactgatttatacacag

SEQ ID NO: 281984 - DNA, 20 bp, Artificial Sequence
  chemically synthesized
acacagaagtactcataaaa

SEQ ID NO: 281985 - DNA, 20 bp, Artificial Sequence
  chemically synthesized
ttaaagttctgcttttttat

SEQ ID NO: 281986 - DNA, 20 bp, Artificial Sequence
  chemically synthesized
cagaagtactcataaaaaag

SEQ ID NO: 281987 - DNA, 20 bp, Artificial Sequence
  chemically synthesized
attttcttgtagaaatttta

SEQ ID NO: 281988 - DNA, 20 bp, Artificial Sequence
  chemically synthesized
cagaactttaaaatttctac

SEQ ID NO: 281989 - DNA, 20 bp, Artificial Sequence
  chemically synthesized
ttttcttctatattttcttg

SEQ ID NO: 281990 - DNA, 20 bp, Artificial Sequence
  chemically synthesized
aaaatttctacaagaaaata

SEQ ID NO: 281991 - DNA, 20 bp, Artificial Sequence
  chemically synthesized
atttctacaagaaaatatag

SEQ ID NO: 281992 - DNA, 20 bp, Artificial Sequence
  chemically synthesized
gaagaaaatatttctgactt

SEQ ID NO: 281993 - DNA, 20 bp, Artificial Sequence
  chemically synthesized
attcttctctatgccaaagt

SEQ ID NO: 281994 - DNA, 20 bp, Artificial Sequence
  chemically synthesized
aaatatttctgactttggca

SEQ ID NO: 281995 - DNA, 20 bp, Artificial Sequence
  chemically synthesized
atatttctgactttggcata

SEQ ID NO: 281996 - DNA, 20 bp, Artificial Sequence
  chemically synthesized
agatattcttctctatgcca

SEQ ID NO: 281997 - DNA, 20 bp, Artificial Sequence
  chemically synthesized
tttctgactttggcatagag

SEQ ID NO: 281998 - DNA, 20 bp, Artificial Sequence
  chemically synthesized
ggcatagagaagaatatctt

SEQ ID NO: 281999 - DNA, 20 bp, Artificial Sequence
  chemically synthesized
tagagaagaatatcttaagt

SEQ ID NO: 282000 - DNA, 20 bp, Artificial Sequence
  chemically synthesized
ttttacgagatgtcttactt

SEQ ID NO: 282001 - DNA, 20 bp, Artificial Sequence
  chemically synthesized
tcttacggtcagttttttac

SEQ ID NO: 282002 - DNA, 20 bp, Artificial Sequence
  chemically synthesized
tctcgtaaaaaactgaccgt

SEQ ID NO: 282003 - DNA, 20 bp, Artificial Sequence
  chemically synthesized
catctcttttttcttacggt

SEQ ID NO: 282004 - DNA, 20 bp, Artificial Sequence
  chemically synthesized
tattcatctcttttttctta

SEQ ID NO: 282005 - DNA, 20 bp, Artificial Sequence
  chemically synthesized
aaaaactgaccgtaagaaaa

SEQ ID NO: 282006 - DNA, 20 bp, Artificial Sequence
  chemically synthesized
aaactgaccgtaagaaaaaa

SEQ ID NO: 282007 - DNA, 20 bp, Artificial Sequence
  chemically synthesized
agaaggtcctaattttaatg

SEQ ID NO: 282008 - DNA, 20 bp, Artificial Sequence
  chemically synthesized
acattcgactacattaaaat

SEQ ID NO: 282009 - DNA, 20 bp, Artificial Sequence
  chemically synthesized
cattcgactacattaaaatt

SEQ ID NO: 282010 - DNA, 20 bp, Artificial Sequence
  chemically synthesized
ggtgtcctttgatgaataga

SEQ ID NO: 282011 - DNA, 20 bp, Artificial Sequence
  chemically synthesized
tggtgtcctttgatgaatag

SEQ ID NO: 282012 - DNA, 20 bp, Artificial Sequence
  chemically synthesized
ttaggaccttctattcatca

SEQ ID NO: 282013 - DNA, 20 bp, Artificial Sequence
  chemically synthesized
tgatggtgtcctttgatgaa

SEQ ID NO: 282014 - DNA, 20 bp, Artificial Sequence
  chemically synthesized
taggaccttctattcatcaa

SEQ ID NO: 282015 - DNA, 20 bp, Artificial Sequence
  chemically synthesized
attcatcaaaggacaccatc

SEQ ID NO: 282016 - DNA, 20 bp, Artificial Sequence
  chemically synthesized
tctgtttttcaattacttga

SEQ ID NO: 282017 - DNA, 20 bp, Artificial Sequence
  chemically synthesized
accatcaagtaattgaaaaa

SEQ ID NO: 282018 - DNA, 20 bp, Artificial Sequence
  chemically synthesized
attgaaaaacagactcaaaa

SEQ ID NO: 282019 - DNA, 20 bp, Artificial Sequence
  chemically synthesized
gaaaaacagactcaaaatag

SEQ ID NO: 282020 - DNA, 20 bp, Artificial Sequence
  chemically synthesized
cagttgttttcttctatttt

SEQ ID NO: 282021 - DNA, 20 bp, Artificial Sequence
  chemically synthesized
cttatgtgttacagatgttg

SEQ ID NO: 282022 - DNA, 20 bp, Artificial Sequence
  chemically synthesized
tttcatattcttatgtgtta

SEQ ID NO: 282023 - DNA, 20 bp, Artificial Sequence
  chemically synthesized
ctgcaacatctgtaacacat

SEQ ID NO: 282024 - DNA, 20 bp, Artificial Sequence
  chemically synthesized
cataagaatatgaaaaatgc

SEQ ID NO: 282025 - DNA, 20 bp, Artificial Sequence
  chemically synthesized
agaatatgaaaaatgccagc

SEQ ID NO: 282026 - DNA, 20 bp, Artificial Sequence
  chemically synthesized
tcatcttctatttgacttgc

SEQ ID NO: 282027 - DNA, 20 bp, Artificial Sequence
  chemically synthesized
aaaaatgccagcaagtcaaa

SEQ ID NO: 282028 - DNA, 20 bp, Artificial Sequence
  chemically synthesized
aatgccagcaagtcaaatag

SEQ ID NO: 282029 - DNA, 20 bp, Artificial Sequence
  chemically synthesized
ttttcttttcattatcgatt

SEQ ID NO: 282030 - DNA, 20 bp, Artificial Sequence
  chemically synthesized
gttttcttttcattatcgat

SEQ ID NO: 282031 - DNA, 20 bp, Artificial Sequence
  chemically synthesized
ataacccaatcgataatgaa

SEQ ID NO: 282032 - DNA, 20 bp, Artificial Sequence
  chemically synthesized
tctctttaagattttggttc

SEQ ID NO: 282033 - DNA, 20 bp, Artificial Sequence
  chemically synthesized
ttctctttaagattttggtt

SEQ ID NO: 282034 - DNA, 20 bp, Artificial Sequence
  chemically synthesized
catatttctctttaagattt

SEQ ID NO: 282035 - DNA, 20 bp, Artificial Sequence
  chemically synthesized
aaacctgaaccaaaatctta

SEQ ID NO: 282036 - DNA, 20 bp, Artificial Sequence
  chemically synthesized
acctgaaccaaaatcttaaa

SEQ ID NO: 282037 - DNA, 20 bp, Artificial Sequence
  chemically synthesized
gtatatacatatttctcttt

SEQ ID NO: 282038 - DNA, 20 bp, Artificial Sequence
  chemically synthesized
atgtatatacattaaacatg

SEQ ID NO: 282039 - DNA, 20 bp, Artificial Sequence
  chemically synthesized
gaagatatgttcaatctcat

SEQ ID NO: 282040 - DNA, 20 bp, Artificial Sequence
  chemically synthesized
acatgtccttgattactaat

SEQ ID NO: 282041 - DNA, 20 bp, Artificial Sequence
  chemically synthesized
gttcaatctcattagtaatc

SEQ ID NO: 282042 - DNA, 20 bp, Artificial Sequence
  chemically synthesized
ttcaatctcattagtaatca

SEQ ID NO: 282043 - DNA, 20 bp, Artificial Sequence
  chemically synthesized
cattagtaatcaaggacatg

SEQ ID NO: 282044 - DNA, 20 bp, Artificial Sequence
  chemically synthesized
attagtaatcaaggacatgt

SEQ ID NO: 282045 - DNA, 20 bp, Artificial Sequence
  chemically synthesized
gtaatcaaggacatgtaggc

SEQ ID NO: 282046 - DNA, 20 bp, Artificial Sequence
  chemically synthesized
taatcaaggacatgtaggcc

SEQ ID NO: 282047 - DNA, 20 bp, Artificial Sequence
  chemically synthesized
atggtatctcattgtaatcc

SEQ ID NO: 282048 - DNA, 20 bp, Artificial Sequence
  chemically synthesized
atgtaggccaggattacaat

SEQ ID NO: 282049 - DNA, 20 bp, Artificial Sequence
  chemically synthesized
ctcatttgtgtcaatcaaca

SEQ ID NO: 282050 - DNA, 20 bp, Artificial Sequence
  chemically synthesized
ccatgttgattgacacaaat

SEQ ID NO: 282051 - DNA, 20 bp, Artificial Sequence
  chemically synthesized
tgttgattgacacaaatgag

SEQ ID NO: 282052 - DNA, 20 bp, Artificial Sequence
  chemically synthesized
agtttgacaattccacgtgt

SEQ ID NO: 282053 - DNA, 20 bp, Artificial Sequence
  chemically synthesized
tttgacaattccacgtgtga

SEQ ID NO: 282054 - DNA, 20 bp, Artificial Sequence
  chemically synthesized
tgtatatcttctctcacacg

SEQ ID NO: 282055 - DNA, 20 bp, Artificial Sequence
  chemically synthesized
gacaattccacgtgtgagag

SEQ ID NO: 282056 - DNA, 20 bp, Artificial Sequence
  chemically synthesized
caaaaatttgtatttattgt

SEQ ID NO: 282057 - DNA, 20 bp, Artificial Sequence
  chemically synthesized
aaatttgtatttattgttgg

SEQ ID NO: 282058 - DNA, 20 bp, Artificial Sequence
  chemically synthesized
aatttgtatttattgttggt

SEQ ID NO: 282059 - DNA, 20 bp, Artificial Sequence
  chemically synthesized
ggtgggtgtgtgtactgaaa

SEQ ID NO: 282060 - DNA, 20 bp, Artificial Sequence
  chemically synthesized
gttttctgaaatggccattt

SEQ ID NO: 282061 - DNA, 20 bp, Artificial Sequence
  chemically synthesized
gtgtactgaaatggccattt

SEQ ID NO: 282062 - DNA, 20 bp, Artificial Sequence
  chemically synthesized
taacaaattgttttctgaaa

SEQ ID NO: 282063 - DNA, 20 bp, Artificial Sequence
  chemically synthesized
aacaatttgttattctcaat

SEQ ID NO: 282064 - DNA, 20 bp, Artificial Sequence
  chemically synthesized
acaatttgttattctcaata

SEQ ID NO: 282065 - DNA, 20 bp, Artificial Sequence
  chemically synthesized
atgtgaatgttcaccttatt

SEQ ID NO: 282066 - DNA, 20 bp, Artificial Sequence
  chemically synthesized
tgaacattcacatacccatc

SEQ ID NO: 282067 - DNA, 20 bp, Artificial Sequence
  chemically synthesized
agtggagttgttgtcttgat

SEQ ID NO: 282068 - DNA, 20 bp, Artificial Sequence
  chemically synthesized
aagtggagttgttgtcttga

SEQ ID NO: 282069 - DNA, 20 bp, Artificial Sequence
  chemically synthesized
gatgcacatatcaaaaagtg

SEQ ID NO: 282070 - DNA, 20 bp, Artificial Sequence
  chemically synthesized
aggatgcacatatcaaaaag

SEQ ID NO: 282071 - DNA, 20 bp, Artificial Sequence
  chemically synthesized
ctgaggatgcacatatcaaa

SEQ ID NO: 282072 - DNA, 20 bp, Artificial Sequence
  chemically synthesized
ctttttgatatgtgcatcct

SEQ ID NO: 282073 - DNA, 20 bp, Artificial Sequence
  chemically synthesized
ttttgatatgtgcatcctca

SEQ ID NO: 282074 - DNA, 20 bp, Artificial Sequence
  chemically synthesized
catgttaaacagtttctctg

SEQ ID NO: 282075 - DNA, 20 bp, Artificial Sequence
  chemically synthesized
ccatgttaaacagtttctct

SEQ ID NO: 282076 - DNA, 20 bp, Artificial Sequence
  chemically synthesized
ctcagagaaactgtttaaca

SEQ ID NO: 282077 - DNA, 20 bp, Artificial Sequence
  chemically synthesized
gtcttgttatccatgttaaa

SEQ ID NO: 282078 - DNA, 20 bp, Artificial Sequence
  chemically synthesized
aactgtttaacatggataac

SEQ ID NO: 282079 - DNA, 20 bp, Artificial Sequence
  chemically synthesized
tgaaatgatcattgttgtaa

SEQ ID NO: 282080 - DNA, 20 bp, Artificial Sequence
  chemically synthesized
tgttacaacaatgatcattt

SEQ ID NO: 282081 - DNA, 20 bp, Artificial Sequence
  chemically synthesized
gatcatttcagccctttttg

SEQ ID NO: 282082 - DNA, 20 bp, Artificial Sequence
  chemically synthesized
ttttttgattactacaaaaa

SEQ ID NO: 282083 - DNA, 20 bp, Artificial Sequence
  chemically synthesized
tttttttgattactacaaaa

SEQ ID NO: 282084 - DNA, 20 bp, Artificial Sequence
  chemically synthesized
ttttttttgattactacaaa

SEQ ID NO: 282085 - DNA, 20 bp, Artificial Sequence
  chemically synthesized
tttttgtagtaatcaaaaaa

SEQ ID NO: 282086 - DNA, 20 bp, Artificial Sequence
  chemically synthesized
ttttgtagtaatcaaaaaaa

SEQ ID NO: 282087 - DNA, 20 bp, Artificial Sequence
  chemically synthesized
aaggaaataatgtccactgc

SEQ ID NO: 282088 - DNA, 20 bp, Artificial Sequence
  chemically synthesized
aggaaataatgtccactgca

SEQ ID NO: 282089 - DNA, 20 bp, Artificial Sequence
  chemically synthesized
gaaataatgtccactgcaag

SEQ ID NO: 282090 - DNA, 20 bp, Artificial Sequence
  chemically synthesized
tttttccattctccttgcag

SEQ ID NO: 282091 - DNA, 20 bp, Artificial Sequence
  chemically synthesized
atatttttccattctccttg

SEQ ID NO: 282092 - DNA, 20 bp, Artificial Sequence
  chemically synthesized
aatgtccactgcaaggagaa

SEQ ID NO: 282093 - DNA, 20 bp, Artificial Sequence
  chemically synthesized
tattctctgtttaaagatga

SEQ ID NO: 282094 - DNA, 20 bp, Artificial Sequence
  chemically synthesized
aatataccgtcatctttaaa

SEQ ID NO: 282095 - DNA, 20 bp, Artificial Sequence
  chemically synthesized
tataccgtcatctttaaaca

SEQ ID NO: 282096 - DNA, 20 bp, Artificial Sequence
  chemically synthesized
acgtctgtattctctgttta

SEQ ID NO: 282097 - DNA, 20 bp, Artificial Sequence
  chemically synthesized
tcatctttaaacagagaata

SEQ ID NO: 282098 - DNA, 20 bp, Artificial Sequence
  chemically synthesized
caatgaaaaatctcatcaaa

SEQ ID NO: 282099 - DNA, 20 bp, Artificial Sequence
  chemically synthesized
ttcttatggttctttttgat

SEQ ID NO: 282100 - DNA, 20 bp, Artificial Sequence
  chemically synthesized
atctcatcaaaaagaaccat

SEQ ID NO: 282101 - DNA, 20 bp, Artificial Sequence
  chemically synthesized
gtgtctgagattcattctta

SEQ ID NO: 282102 - DNA, 20 bp, Artificial Sequence
  chemically synthesized
agaaccataagaatgaatct

SEQ ID NO: 282103 - DNA, 20 bp, Artificial Sequence
  chemically synthesized
cacccaacatatttgtgtct

SEQ ID NO: 282104 - DNA, 20 bp, Artificial Sequence
  chemically synthesized
aatctcagacacaaatatgt

SEQ ID NO: 282105 - DNA, 20 bp, Artificial Sequence
  chemically synthesized
atctcagacacaaatatgtt

SEQ ID NO: 282106 - DNA, 20 bp, Artificial Sequence
  chemically synthesized
gacacaaatatgttgggtga

SEQ ID NO: 282107 - DNA, 20 bp, Artificial Sequence
  chemically synthesized
aatatgttgggtgaaagaca

SEQ ID NO: 282108 - DNA, 20 bp, Artificial Sequence
  chemically synthesized
actataatatagttttttta

SEQ ID NO: 282109 - DNA, 20 bp, Artificial Sequence
  chemically synthesized
aactataatatagttttttt

SEQ ID NO: 282110 - DNA, 20 bp, Artificial Sequence
  chemically synthesized
aaactataatatagtttttt

SEQ ID NO: 282111 - DNA, 20 bp, Artificial Sequence
  chemically synthesized
gccctaaaaaaactatatta

SEQ ID NO: 282112 - DNA, 20 bp, Artificial Sequence
  chemically synthesized
agtaatggtaaactataata

SEQ ID NO: 282113 - DNA, 20 bp, Artificial Sequence
  chemically synthesized
taatttcagtattacagtaa

SEQ ID NO: 282114 - DNA, 20 bp, Artificial Sequence
  chemically synthesized
tgtgcttaatttcagtatta

SEQ ID NO: 282115 - DNA, 20 bp, Artificial Sequence
  chemically synthesized
attactgtaatactgaaatt

SEQ ID NO: 282116 - DNA, 20 bp, Artificial Sequence
  chemically synthesized
aaaacaattgtgcttaattt

SEQ ID NO: 282117 - DNA, 20 bp, Artificial Sequence
  chemically synthesized
aaaaaaatccacacacatat

SEQ ID NO: 282118 - DNA, 20 bp, Artificial Sequence
  chemically synthesized
ttttttcactcatatgtgtg

SEQ ID NO: 282119 - DNA, 20 bp, Artificial Sequence
  chemically synthesized
gtgtggattttttttaaaca

SEQ ID NO: 282120 - DNA, 20 bp, Artificial Sequence
  chemically synthesized
tgtggattttttttaaacaa

SEQ ID NO: 282121 - DNA, 20 bp, Artificial Sequence
  chemically synthesized
ttttaaacaaaggaataaca

SEQ ID NO: 282122 - DNA, 20 bp, Artificial Sequence
  chemically synthesized
tttaaacaaaggaataacaa

SEQ ID NO: 282123 - DNA, 20 bp, Artificial Sequence
  chemically synthesized
aaacaaaggaataacaaagg

SEQ ID NO: 282124 - DNA, 20 bp, Artificial Sequence
  chemically synthesized
gaataacaaaggtagctttc

SEQ ID NO: 282125 - DNA, 20 bp, Artificial Sequence
  chemically synthesized
aacaaaggtagctttctaga

SEQ ID NO: 282126 - DNA, 20 bp, Artificial Sequence
  chemically synthesized
agacataatcaccatctaga

SEQ ID NO: 282127 - DNA, 20 bp, Artificial Sequence
  chemically synthesized
caatagacataatcaccatc

SEQ ID NO: 282128 - DNA, 20 bp, Artificial Sequence
  chemically synthesized
tagatggtgattatgtctat

SEQ ID NO: 282129 - DNA, 20 bp, Artificial Sequence
  chemically synthesized
agatggtgattatgtctatt

SEQ ID NO: 282130 - DNA, 20 bp, Artificial Sequence
  chemically synthesized
gatggtgattatgtctattg

SEQ ID NO: 282131 - DNA, 20 bp, Artificial Sequence
  chemically synthesized
tcttcctatcttttccccaa

SEQ ID NO: 282132 - DNA, 20 bp, Artificial Sequence
  chemically synthesized
tgattatgtctattggggaa

SEQ ID NO: 282133 - DNA, 20 bp, Artificial Sequence
  chemically synthesized
tatgtctattggggaaaaga

SEQ ID NO: 282134 - DNA, 20 bp, Artificial Sequence
  chemically synthesized
atgtctattggggaaaagat

SEQ ID NO: 282135 - DNA, 20 bp, Artificial Sequence
  chemically synthesized
tctattggggaaaagatagg

SEQ ID NO: 282136 - DNA, 20 bp, Artificial Sequence
  chemically synthesized
gggaaaagataggaagatgc

SEQ ID NO: 282137 - DNA, 20 bp, Artificial Sequence
  chemically synthesized
gaaaagataggaagatgcga

SEQ ID NO: 282138 - DNA, 20 bp, Artificial Sequence
  chemically synthesized
aaagataggaagatgcgaga

SEQ ID NO: 282139 - DNA, 20 bp, Artificial Sequence
  chemically synthesized
aagataggaagatgcgagag

SEQ ID NO: 282140 - DNA, 20 bp, Artificial Sequence
  chemically synthesized
aggaagatgcgagagaggat

SEQ ID NO: 282141 - DNA, 20 bp, Artificial Sequence
  chemically synthesized
agaggataagaatgtaacaa

SEQ ID NO: 282142 - DNA, 20 bp, Artificial Sequence
  chemically synthesized
taacaacggtcattttctgt

SEQ ID NO: 282143 - DNA, 20 bp, Artificial Sequence
  chemically synthesized
ttcaacagttacaaagctaa

SEQ ID NO: 282144 - DNA, 20 bp, Artificial Sequence
  chemically synthesized
aggttcattcaacagttaca

SEQ ID NO: 282145 - DNA, 20 bp, Artificial Sequence
  chemically synthesized
gtacttataggttcattcaa

SEQ ID NO: 282146 - DNA, 20 bp, Artificial Sequence
  chemically synthesized
taactgttgaatgaacctat

SEQ ID NO: 282147 - DNA, 20 bp, Artificial Sequence
  chemically synthesized
gttgaatgaacctataagta

SEQ ID NO: 282148 - DNA, 20 bp, Artificial Sequence
  chemically synthesized
attgtgtttactgtacttat

SEQ ID NO: 282149 - DNA, 20 bp, Artificial Sequence
  chemically synthesized
cattgtgtttactgtactta

SEQ ID NO: 282150 - DNA, 20 bp, Artificial Sequence
  chemically synthesized
taagtacagtaaacacaatg

SEQ ID NO: 282151 - DNA, 20 bp, Artificial Sequence
  chemically synthesized
cgggggcaggtggtagtaag

SEQ ID NO: 282152 - DNA, 20 bp, Artificial Sequence
  chemically synthesized
aggcgggggcaggtggtagt

SEQ ID NO: 282153 - DNA, 20 bp, Artificial Sequence
  chemically synthesized
agtgaggcgggggcaggtgg

SEQ ID NO: 282154 - DNA, 20 bp, Artificial Sequence
  chemically synthesized
ggtagtgaggcgggggcagg

SEQ ID NO: 282155 - DNA, 20 bp, Artificial Sequence
  chemically synthesized
ggtggtagtgaggcgggggc

SEQ ID NO: 282156 - DNA, 20 bp, Artificial Sequence
  chemically synthesized
tggtggtagtgaggcggggg

SEQ ID NO: 282157 - DNA, 20 bp, Artificial Sequence
  chemically synthesized
ttttggtggtagtgaggcgg

SEQ ID NO: 282158 - DNA, 20 bp, Artificial Sequence
  chemically synthesized
attttggtggtagtgaggcg

SEQ ID NO: 282159 - DNA, 20 bp, Artificial Sequence
  chemically synthesized
aattttggtggtagtgaggc

SEQ ID NO: 282160 - DNA, 20 bp, Artificial Sequence
  chemically synthesized
taattttggtggtagtgagg

SEQ ID NO: 282161 - DNA, 20 bp, Artificial Sequence
  chemically synthesized
ctttaattttggtggtagtg

SEQ ID NO: 282162 - DNA, 20 bp, Artificial Sequence
  chemically synthesized
cctttaattttggtggtagt

SEQ ID NO: 282163 - DNA, 20 bp, Artificial Sequence
  chemically synthesized
caagcctttaattttggtgg

SEQ ID NO: 282164 - DNA, 20 bp, Artificial Sequence
  chemically synthesized
tttcaagcctttaattttgg

SEQ ID NO: 282165 - DNA, 20 bp, Artificial Sequence
  chemically synthesized
cctcactaccaccaaaatta

SEQ ID NO: 282166 - DNA, 20 bp, Artificial Sequence
  chemically synthesized
ctcactaccaccaaaattaa

SEQ ID NO: 282167 - DNA, 20 bp, Artificial Sequence
  chemically synthesized
tcctttcaagcctttaattt

SEQ ID NO: 282168 - DNA, 20 bp, Artificial Sequence
  chemically synthesized
caccaaaattaaaggcttga

SEQ ID NO: 282169 - DNA, 20 bp, Artificial Sequence
  chemically synthesized
accaaaattaaaggcttgaa

SEQ ID NO: 282170 - DNA, 20 bp, Artificial Sequence
  chemically synthesized
aaaattaaaggcttgaaagg

SEQ ID NO: 282171 - DNA, 20 bp, Artificial Sequence
  chemically synthesized
ctgaaataaatcttcctttc

SEQ ID NO: 282172 - DNA, 20 bp, Artificial Sequence
  chemically synthesized
cttgaaaggaagatttattt

SEQ ID NO: 282173 - DNA, 20 bp, Artificial Sequence
  chemically synthesized
gaaaggaagatttatttcag

SEQ ID NO: 282174 - DNA, 20 bp, Artificial Sequence
  chemically synthesized
aaaggaagatttatttcaga

SEQ ID NO: 282175 - DNA, 20 bp, Artificial Sequence
  chemically synthesized
gggaaatctgattaattttt

SEQ ID NO: 282176 - DNA, 20 bp, Artificial Sequence
  chemically synthesized
gaaggatctaaaaaattaat

SEQ ID NO: 282177 - DNA, 20 bp, Artificial Sequence
  chemically synthesized
aaaattaatcagatttccca

SEQ ID NO: 282178 - DNA, 20 bp, Artificial Sequence
  chemically synthesized
ctatgaacatagagaacttt

SEQ ID NO: 282179 - DNA, 20 bp, Artificial Sequence
  chemically synthesized
gctatgaacatagagaactt

SEQ ID NO: 282180 - DNA, 20 bp, Artificial Sequence
  chemically synthesized
ttctaagggctatgaacata

SEQ ID NO: 282181 - DNA, 20 bp, Artificial Sequence
  chemically synthesized
cccaaagttctctatgttca

SEQ ID NO: 282182 - DNA, 20 bp, Artificial Sequence
  chemically synthesized
cattctaagggctatgaaca

SEQ ID NO: 282183 - DNA, 20 bp, Artificial Sequence
  chemically synthesized
ttctctatgttcatagccct

SEQ ID NO: 282184 - DNA, 20 bp, Artificial Sequence
  chemically synthesized
aatactctgtgtcattctaa

SEQ ID NO: 282185 - DNA, 20 bp, Artificial Sequence
  chemically synthesized
gaatactctgtgtcattcta

SEQ ID NO: 282186 - DNA, 20 bp, Artificial Sequence
  chemically synthesized
cgaatactctgtgtcattct

SEQ ID NO: 282187 - DNA, 20 bp, Artificial Sequence
  chemically synthesized
tcatagcccttagaatgaca

SEQ ID NO: 282188 - DNA, 20 bp, Artificial Sequence
  chemically synthesized
atagcccttagaatgacaca

SEQ ID NO: 282189 - DNA, 20 bp, Artificial Sequence
  chemically synthesized
ctgatacttttcatcagata

SEQ ID NO: 282190 - DNA, 20 bp, Artificial Sequence
  chemically synthesized
gactgatacttttcatcaga

SEQ ID NO: 282191 - DNA, 20 bp, Artificial Sequence
  chemically synthesized
ttcgatctctatctgatgaa

SEQ ID NO: 282192 - DNA, 20 bp, Artificial Sequence
  chemically synthesized
gtgagactgatacttttcat

SEQ ID NO: 282193 - DNA, 20 bp, Artificial Sequence
  chemically synthesized
ctctatctgatgaaaagtat

SEQ ID NO: 282194 - DNA, 20 bp, Artificial Sequence
  chemically synthesized
aagtatcagtctcacctgct

SEQ ID NO: 282195 - DNA, 20 bp, Artificial Sequence
  chemically synthesized
ggtacgtttgccaagcaggt

SEQ ID NO: 282196 - DNA, 20 bp, Artificial Sequence
  chemically synthesized
ggttggtacgtttgccaagc

SEQ ID NO: 282197 - DNA, 20 bp, Artificial Sequence
  chemically synthesized
aggttggtacgtttgccaag

SEQ ID NO: 282198 - DNA, 20 bp, Artificial Sequence
  chemically synthesized
gaaaggttggtacgtttgcc

SEQ ID NO: 282199 - DNA, 20 bp, Artificial Sequence
  chemically synthesized
atcaagcaggtatgaaaggt

SEQ ID NO: 282200 - DNA, 20 bp, Artificial Sequence
  chemically synthesized
agatatcaagcaggtatgaa

SEQ ID NO: 282201 - DNA, 20 bp, Artificial Sequence
  chemically synthesized
aagatatcaagcaggtatga

SEQ ID NO: 282202 - DNA, 20 bp, Artificial Sequence
  chemically synthesized
ctgtacataagatatcaagc

SEQ ID NO: 282203 - DNA, 20 bp, Artificial Sequence
  chemically synthesized
actgtacataagatatcaag

SEQ ID NO: 282204 - DNA, 20 bp, Artificial Sequence
  chemically synthesized
taaactgtacataagatatc

SEQ ID NO: 282205 - DNA, 20 bp, Artificial Sequence
  chemically synthesized
cctgcttgatatcttatgta

SEQ ID NO: 282206 - DNA, 20 bp, Artificial Sequence
  chemically synthesized
ttttgcaataaactgtacat

SEQ ID NO: 282207 - DNA, 20 bp, Artificial Sequence
  chemically synthesized
tatgtacagtttattgcaaa

SEQ ID NO: 282208 - DNA, 20 bp, Artificial Sequence
  chemically synthesized
ttattgcaaaaagtgaaatt

SEQ ID NO: 282209 - DNA, 20 bp, Artificial Sequence
  chemically synthesized
aattaagtgttttgctttaa

SEQ ID NO: 282210 - DNA, 20 bp, Artificial Sequence
  chemically synthesized
attaagtgttttgctttaaa

SEQ ID NO: 282211 - DNA, 20 bp, Artificial Sequence
  chemically synthesized
tagatttctatcacctttta

SEQ ID NO: 282212 - DNA, 20 bp, Artificial Sequence
  chemically synthesized
tgttttgctttaaaaggtga

SEQ ID NO: 282213 - DNA, 20 bp, Artificial Sequence
  chemically synthesized
ggtgatagaaatctaaaatc

SEQ ID NO: 282214 - DNA, 20 bp, Artificial Sequence
  chemically synthesized
gtgatagaaatctaaaatct

SEQ ID NO: 282215 - DNA, 20 bp, Artificial Sequence
  chemically synthesized
gctggaaatgacccagattt

SEQ ID NO: 282216 - DNA, 20 bp, Artificial Sequence
  chemically synthesized
agcaggagctggaaatgacc

SEQ ID NO: 282217 - DNA, 20 bp, Artificial Sequence
  chemically synthesized
tctaaaatctgggtcatttc

SEQ ID NO: 282218 - DNA, 20 bp, Artificial Sequence
  chemically synthesized
gcctgtagtccagcaggagc

SEQ ID NO: 282219 - DNA, 20 bp, Artificial Sequence
  chemically synthesized
gggtcatttccagctcctgc

SEQ ID NO: 282220 - DNA, 20 bp, Artificial Sequence
  chemically synthesized
gacagcctgtagtccagcag

SEQ ID NO: 282221 - DNA, 20 bp, Artificial Sequence
  chemically synthesized
aagacagcctgtagtccagc

SEQ ID NO: 282222 - DNA, 20 bp, Artificial Sequence
  chemically synthesized
gaagacagcctgtagtccag

SEQ ID NO: 282223 - DNA, 20 bp, Artificial Sequence
  chemically synthesized
ttccagctcctgctggacta

SEQ ID NO: 282224 - DNA, 20 bp, Artificial Sequence
  chemically synthesized
tccagctcctgctggactac

SEQ ID NO: 282225 - DNA, 20 bp, Artificial Sequence
  chemically synthesized
aatgaagacagcctgtagtc

SEQ ID NO: 282226 - DNA, 20 bp, Artificial Sequence
  chemically synthesized
cccagaatgaagacagcctg

SEQ ID NO: 282227 - DNA, 20 bp, Artificial Sequence
  chemically synthesized
atctttgcccagaatgaaga

SEQ ID NO: 282228 - DNA, 20 bp, Artificial Sequence
  chemically synthesized
actacaggctgtcttcattc

SEQ ID NO: 282229 - DNA, 20 bp, Artificial Sequence
  chemically synthesized
ctacaggctgtcttcattct

SEQ ID NO: 282230 - DNA, 20 bp, Artificial Sequence
  chemically synthesized
tgggatctttgcccagaatg

SEQ ID NO: 282231 - DNA, 20 bp, Artificial Sequence
  chemically synthesized
ggctgtcttcattctgggca

SEQ ID NO: 282232 - DNA, 20 bp, Artificial Sequence
  chemically synthesized
ttcccactgggatctttgcc

SEQ ID NO: 282233 - DNA, 20 bp, Artificial Sequence
  chemically synthesized
ttcattctgggcaaagatcc

SEQ ID NO: 282234 - DNA, 20 bp, Artificial Sequence
  chemically synthesized
attctgggcaaagatcccag

SEQ ID NO: 282235 - DNA, 20 bp, Artificial Sequence
  chemically synthesized
ttctgggcaaagatcccagt

SEQ ID NO: 282236 - DNA, 20 bp, Artificial Sequence
  chemically synthesized
gatatttatattttcccact

SEQ ID NO: 282237 - DNA, 20 bp, Artificial Sequence
  chemically synthesized
agatatttatattttcccac

SEQ ID NO: 282238 - DNA, 20 bp, Artificial Sequence
  chemically synthesized
ggtaccctcgggtatttaag

SEQ ID NO: 282239 - DNA, 20 bp, Artificial Sequence
  chemically synthesized
taaggtaccctcgggtattt

SEQ ID NO: 282240 - DNA, 20 bp, Artificial Sequence
  chemically synthesized
aaatatcttcttaaataccc

SEQ ID NO: 282241 - DNA, 20 bp, Artificial Sequence
  chemically synthesized
aatatcttcttaaatacccg

SEQ ID NO: 282242 - DNA, 20 bp, Artificial Sequence
  chemically synthesized
atatcttcttaaatacccga

SEQ ID NO: 282243 - DNA, 20 bp, Artificial Sequence
  chemically synthesized
caaagctctaaggtaccctc

SEQ ID NO: 282244 - DNA, 20 bp, Artificial Sequence
  chemically synthesized
tcaaagctctaaggtaccct

SEQ ID NO: 282245 - DNA, 20 bp, Artificial Sequence
  chemically synthesized
ttaaatacccgagggtacct

SEQ ID NO: 282246 - DNA, 20 bp, Artificial Sequence
  chemically synthesized
aaatacccgagggtacctta

SEQ ID NO: 282247 - DNA, 20 bp, Artificial Sequence
  chemically synthesized
tccttgtcttcaaagctcta

SEQ ID NO: 282248 - DNA, 20 bp, Artificial Sequence
  chemically synthesized
ctccttgtcttcaaagctct

SEQ ID NO: 282249 - DNA, 20 bp, Artificial Sequence
  chemically synthesized
gagggtaccttagagctttg

SEQ ID NO: 282250 - DNA, 20 bp, Artificial Sequence
  chemically synthesized
taccttagagctttgaagac

SEQ ID NO: 282251 - DNA, 20 bp, Artificial Sequence
  chemically synthesized
atcacgtctccttgtcttca

SEQ ID NO: 282252 - DNA, 20 bp, Artificial Sequence
  chemically synthesized
accttagagctttgaagaca

SEQ ID NO: 282253 - DNA, 20 bp, Artificial Sequence
  chemically synthesized
cttagagctttgaagacaag

SEQ ID NO: 282254 - DNA, 20 bp, Artificial Sequence
  chemically synthesized
tgaagacaaggagacgtgat

SEQ ID NO: 282255 - DNA, 20 bp, Artificial Sequence
  chemically synthesized
caatctgcaccaaagttaat

SEQ ID NO: 282256 - DNA, 20 bp, Artificial Sequence
  chemically synthesized
gtaatgtgtcttattaactt

SEQ ID NO: 282257 - DNA, 20 bp, Artificial Sequence
  chemically synthesized
gtgtcttattaactttggtg

SEQ ID NO: 282258 - DNA, 20 bp, Artificial Sequence
  chemically synthesized
cattacctcaatctgcacca

SEQ ID NO: 282259 - DNA, 20 bp, Artificial Sequence
  chemically synthesized
tattaactttggtgcagatt

SEQ ID NO: 282260 - DNA, 20 bp, Artificial Sequence
  chemically synthesized
attaactttggtgcagattg

SEQ ID NO: 282261 - DNA, 20 bp, Artificial Sequence
  chemically synthesized
tgacagttaaatcagcaagg

SEQ ID NO: 282262 - DNA, 20 bp, Artificial Sequence
  chemically synthesized
ttctgacagttaaatcagca

SEQ ID NO: 282263 - DNA, 20 bp, Artificial Sequence
  chemically synthesized
attctgacagttaaatcagc

SEQ ID NO: 282264 - DNA, 20 bp, Artificial Sequence
  chemically synthesized
atccattctgacagttaaat

SEQ ID NO: 282265 - DNA, 20 bp, Artificial Sequence
  chemically synthesized
taccttgctgatttaactgt

SEQ ID NO: 282266 - DNA, 20 bp, Artificial Sequence
  chemically synthesized
tgctgatttaactgtcagaa

SEQ ID NO: 282267 - DNA, 20 bp, Artificial Sequence
  chemically synthesized
gaagaagctatccattctga

SEQ ID NO: 282268 - DNA, 20 bp, Artificial Sequence
  chemically synthesized
gatttaactgtcagaatgga

SEQ ID NO: 282269 - DNA, 20 bp, Artificial Sequence
  chemically synthesized
agatgcattgaggacagaag

SEQ ID NO: 282270 - DNA, 20 bp, Artificial Sequence
  chemically synthesized
ttcagatgcattgaggacag

SEQ ID NO: 282271 - DNA, 20 bp, Artificial Sequence
  chemically synthesized
tccttcagatgcattgagga

SEQ ID NO: 282272 - DNA, 20 bp, Artificial Sequence
  chemically synthesized
tgtgtccttcagatgcattg

SEQ ID NO: 282273 - DNA, 20 bp, Artificial Sequence
  chemically synthesized
ctgtgtccttcagatgcatt

SEQ ID NO: 282274 - DNA, 20 bp, Artificial Sequence
  chemically synthesized
ttctgtcctcaatgcatctg

SEQ ID NO: 282275 - DNA, 20 bp, Artificial Sequence
  chemically synthesized
tctgtcctcaatgcatctga

SEQ ID NO: 282276 - DNA, 20 bp, Artificial Sequence
  chemically synthesized
ctcaatgcatctgaaggaca

SEQ ID NO: 282277 - DNA, 20 bp, Artificial Sequence
  chemically synthesized
gcctctccagctgtgtcctt

SEQ ID NO: 282278 - DNA, 20 bp, Artificial Sequence
  chemically synthesized
atgcatctgaaggacacagc

SEQ ID NO: 282279 - DNA, 20 bp, Artificial Sequence
  chemically synthesized
gcatctgaaggacacagctg

SEQ ID NO: 282280 - DNA, 20 bp, Artificial Sequence
  chemically synthesized
atctgaaggacacagctgga

SEQ ID NO: 282281 - DNA, 20 bp, Artificial Sequence
  chemically synthesized
tctgaaggacacagctggag

SEQ ID NO: 282282 - DNA, 20 bp, Artificial Sequence
  chemically synthesized
gctggtacattcagcctctc

SEQ ID NO: 282283 - DNA, 20 bp, Artificial Sequence
  chemically synthesized
gctggagaggctgaatgtac

SEQ ID NO: 282284 - DNA, 20 bp, Artificial Sequence
  chemically synthesized
acctgtaaagctggtacatt

SEQ ID NO: 282285 - DNA, 20 bp, Artificial Sequence
  chemically synthesized
ggctgaatgtaccagcttta

SEQ ID NO: 282286 - DNA, 20 bp, Artificial Sequence
  chemically synthesized
gctgaatgtaccagctttac

SEQ ID NO: 282287 - DNA, 20 bp, Artificial Sequence
  chemically synthesized
gcaaaggtgacctgtaaagc

SEQ ID NO: 282288 - DNA, 20 bp, Artificial Sequence
  chemically synthesized
ttttgcaaaggtgacctgta

SEQ ID NO: 282289 - DNA, 20 bp, Artificial Sequence
  chemically synthesized
gactatattttattttgcaa

SEQ ID NO: 282290 - DNA, 20 bp, Artificial Sequence
  chemically synthesized
agactatattttattttgca

SEQ ID NO: 282291 - DNA, 20 bp, Artificial Sequence
  chemically synthesized
cacctttgcaaaataaaata

SEQ ID NO: 282292 - DNA, 20 bp, Artificial Sequence
  chemically synthesized
caaaataaaatatagtcttg

SEQ ID NO: 282293 - DNA, 20 bp, Artificial Sequence
  chemically synthesized
ttagctccaattcgggcttc

SEQ ID NO: 282294 - DNA, 20 bp, Artificial Sequence
  chemically synthesized
tatagtcttgaagcccgaat

SEQ ID NO: 282295 - DNA, 20 bp, Artificial Sequence
  chemically synthesized
tagtcttgaagcccgaattg

SEQ ID NO: 282296 - DNA, 20 bp, Artificial Sequence
  chemically synthesized
gtggcttttagctccaattc

SEQ ID NO: 282297 - DNA, 20 bp, Artificial Sequence
  chemically synthesized
agtggcttttagctccaatt

SEQ ID NO: 282298 - DNA, 20 bp, Artificial Sequence
  chemically synthesized
gaagcccgaattggagctaa

SEQ ID NO: 282299 - DNA, 20 bp, Artificial Sequence
  chemically synthesized
cagttattctaagtggcttt

SEQ ID NO: 282300 - DNA, 20 bp, Artificial Sequence
  chemically synthesized
aattggagctaaaagccact

SEQ ID NO: 282301 - DNA, 20 bp, Artificial Sequence
  chemically synthesized
agcttaacagttattctaag

SEQ ID NO: 282302 - DNA, 20 bp, Artificial Sequence
  chemically synthesized
ttaagcttaacagttattct

SEQ ID NO: 282303 - DNA, 20 bp, Artificial Sequence
  chemically synthesized
agccacttagaataactgtt

SEQ ID NO: 282304 - DNA, 20 bp, Artificial Sequence
  chemically synthesized
atccaaactgttaagcttaa

SEQ ID NO: 282305 - DNA, 20 bp, Artificial Sequence
  chemically synthesized
agaataactgttaagcttaa

SEQ ID NO: 282306 - DNA, 20 bp, Artificial Sequence
  chemically synthesized
aactgttaagcttaacagtt

SEQ ID NO: 282307 - DNA, 20 bp, Artificial Sequence
  chemically synthesized
attttaagatccaaactgtt

SEQ ID NO: 282308 - DNA, 20 bp, Artificial Sequence
  chemically synthesized
tgtgatttcaaagtaatttt

SEQ ID NO: 282309 - DNA, 20 bp, Artificial Sequence
  chemically synthesized
ctttggattctgtgatttca

SEQ ID NO: 282310 - DNA, 20 bp, Artificial Sequence
  chemically synthesized
ttaaaattactttgaaatca

SEQ ID NO: 282311 - DNA, 20 bp, Artificial Sequence
  chemically synthesized
ctttgaaatcacagaatcca

SEQ ID NO: 282312 - DNA, 20 bp, Artificial Sequence
  chemically synthesized
tgaaatcacagaatccaaag

SEQ ID NO: 282313 - DNA, 20 bp, Artificial Sequence
  chemically synthesized
actttccttcaaagccactt

SEQ ID NO: 282314 - DNA, 20 bp, Artificial Sequence
  chemically synthesized
cagaatccaaagtggctttg

SEQ ID NO: 282315 - DNA, 20 bp, Artificial Sequence
  chemically synthesized
agaatccaaagtggctttga

SEQ ID NO: 282316 - DNA, 20 bp, Artificial Sequence
  chemically synthesized
tccaaagtggctttgaagga

SEQ ID NO: 282317 - DNA, 20 bp, Artificial Sequence
  chemically synthesized
tttatttgtactttccttca

SEQ ID NO: 282318 - DNA, 20 bp, Artificial Sequence
  chemically synthesized
tactattttgaacagaagtt

SEQ ID NO: 282319 - DNA, 20 bp, Artificial Sequence
  chemically synthesized
ccatctactattttgaacag

SEQ ID NO: 282320 - DNA, 20 bp, Artificial Sequence
  chemically synthesized
aactaaacttctgttcaaaa

SEQ ID NO: 282321 - DNA, 20 bp, Artificial Sequence
  chemically synthesized
gctccatctactattttgaa

SEQ ID NO: 282322 - DNA, 20 bp, Artificial Sequence
  chemically synthesized
taaacttctgttcaaaatag

SEQ ID NO: 282323 - DNA, 20 bp, Artificial Sequence
  chemically synthesized
cttctgttcaaaatagtaga

SEQ ID NO: 282324 - DNA, 20 bp, Artificial Sequence
  chemically synthesized
tctgttcaaaatagtagatg

SEQ ID NO: 282325 - DNA, 20 bp, Artificial Sequence
  chemically synthesized
aaatagtagatggagctgat

SEQ ID NO: 282326 - DNA, 20 bp, Artificial Sequence
  chemically synthesized
aatagtagatggagctgatg

SEQ ID NO: 282327 - DNA, 20 bp, Artificial Sequence
  chemically synthesized
tatgttgggagttacctcat

SEQ ID NO: 282328 - DNA, 20 bp, Artificial Sequence
  chemically synthesized
actgaagcaggatatgttgg

SEQ ID NO: 282329 - DNA, 20 bp, Artificial Sequence
  chemically synthesized
taactgaagcaggatatgtt

SEQ ID NO: 282330 - DNA, 20 bp, Artificial Sequence
  chemically synthesized
ataactgaagcaggatatgt

SEQ ID NO: 282331 - DNA, 20 bp, Artificial Sequence
  chemically synthesized
actcccaacatatcctgctt

SEQ ID NO: 282332 - DNA, 20 bp, Artificial Sequence
  chemically synthesized
tattttggtataactgaagc

SEQ ID NO: 282333 - DNA, 20 bp, Artificial Sequence
  chemically synthesized
gtattttggtataactgaag

SEQ ID NO: 282334 - DNA, 20 bp, Artificial Sequence
  chemically synthesized
catgtattttggtataactg

SEQ ID NO: 282335 - DNA, 20 bp, Artificial Sequence
  chemically synthesized
ttgtattttaacatgtattt

SEQ ID NO: 282336 - DNA, 20 bp, Artificial Sequence
  chemically synthesized
aaaatacatgttaaaataca

SEQ ID NO: 282337 - DNA, 20 bp, Artificial Sequence
  chemically synthesized
aaatacatgttaaaatacaa

SEQ ID NO: 282338 - DNA, 20 bp, Artificial Sequence
  chemically synthesized
aaggaaacatttttaattca

SEQ ID NO: 282339 - DNA, 20 bp, Artificial Sequence
  chemically synthesized
tatatacatgttttacagat

SEQ ID NO: 282340 - DNA, 20 bp, Artificial Sequence
  chemically synthesized
ggttctatatacatgtttta

SEQ ID NO: 282341 - DNA, 20 bp, Artificial Sequence
  chemically synthesized
tgatctgtaaaacatgtata

SEQ ID NO: 282342 - DNA, 20 bp, Artificial Sequence
  chemically synthesized
aaaacatgtatatagaacct

SEQ ID NO: 282343 - DNA, 20 bp, Artificial Sequence
  chemically synthesized
aaacatgtatatagaacctc

SEQ ID NO: 282344 - DNA, 20 bp, Artificial Sequence
  chemically synthesized
gtatatagaacctcaggtgt

SEQ ID NO: 282345 - DNA, 20 bp, Artificial Sequence
  chemically synthesized
ctttttctttctcacacctg

SEQ ID NO: 282346 - DNA, 20 bp, Artificial Sequence
  chemically synthesized
tctttttctttctcacacct

SEQ ID NO: 282347 - DNA, 20 bp, Artificial Sequence
  chemically synthesized
atagaacctcaggtgtgaga

SEQ ID NO: 282348 - DNA, 20 bp, Artificial Sequence
  chemically synthesized
cctcaggtgtgagaaagaaa

SEQ ID NO: 282349 - DNA, 20 bp, Artificial Sequence
  chemically synthesized
tcaggtgtgagaaagaaaaa

SEQ ID NO: 282350 - DNA, 20 bp, Artificial Sequence
  chemically synthesized
caggtgtgagaaagaaaaag

SEQ ID NO: 282351 - DNA, 20 bp, Artificial Sequence
  chemically synthesized
aggtgtgagaaagaaaaaga

SEQ ID NO: 282352 - DNA, 20 bp, Artificial Sequence
  chemically synthesized
aaagaaaaagagggaaatga

SEQ ID NO: 282353 - DNA, 20 bp, Artificial Sequence
  chemically synthesized
gaaaaagagggaaatgaaag

SEQ ID NO: 282354 - DNA, 20 bp, Artificial Sequence
  chemically synthesized
aagagggaaatgaaagtaga

SEQ ID NO: 282355 - DNA, 20 bp, Artificial Sequence
  chemically synthesized
agggaaatgaaagtagaaag

SEQ ID NO: 282356 - DNA, 20 bp, Artificial Sequence
  chemically synthesized
aaagtagaaagtggaaaatc

SEQ ID NO: 282357 - DNA, 20 bp, Artificial Sequence
  chemically synthesized
tgatacgccagtatttttat

SEQ ID NO: 282358 - DNA, 20 bp, Artificial Sequence
  chemically synthesized
aatcaagcttataaaaatac

SEQ ID NO: 282359 - DNA, 20 bp, Artificial Sequence
  chemically synthesized
ttataaaaatactggcgtat

SEQ ID NO: 282360 - DNA, 20 bp, Artificial Sequence
  chemically synthesized
tataccctgttctgatacgc

SEQ ID NO: 282361 - DNA, 20 bp, Artificial Sequence
  chemically synthesized
aaaatactggcgtatcagaa

SEQ ID NO: 282362 - DNA, 20 bp, Artificial Sequence
  chemically synthesized
aaatactggcgtatcagaac

SEQ ID NO: 282363 - DNA, 20 bp, Artificial Sequence
  chemically synthesized
aatactggcgtatcagaaca

SEQ ID NO: 282364 - DNA, 20 bp, Artificial Sequence
  chemically synthesized
gaacagggtatacgacatca

SEQ ID NO: 282365 - DNA, 20 bp, Artificial Sequence
  chemically synthesized
agggtatacgacatcaaagc

SEQ ID NO: 282366 - DNA, 20 bp, Artificial Sequence
  chemically synthesized
gggtatacgacatcaaagct

SEQ ID NO: 282367 - DNA, 20 bp, Artificial Sequence
  chemically synthesized
ggtatacgacatcaaagctg

SEQ ID NO: 282368 - DNA, 20 bp, Artificial Sequence
  chemically synthesized
caagttagtgttaaatgccc

SEQ ID NO: 282369 - DNA, 20 bp, Artificial Sequence
  chemically synthesized
ggggcatttaacactaactt

SEQ ID NO: 282370 - DNA, 20 bp, Artificial Sequence
  chemically synthesized
cctcatttcccatctcaagt

SEQ ID NO: 282371 - DNA, 20 bp, Artificial Sequence
  chemically synthesized
catttaacactaacttgaga

SEQ ID NO: 282372 - DNA, 20 bp, Artificial Sequence
  chemically synthesized
atttaacactaacttgagat

SEQ ID NO: 282373 - DNA, 20 bp, Artificial Sequence
  chemically synthesized
cttgcctcatttcccatctc

SEQ ID NO: 282374 - DNA, 20 bp, Artificial Sequence
  chemically synthesized
actaacttgagatgggaaat

SEQ ID NO: 282375 - DNA, 20 bp, Artificial Sequence
  chemically synthesized
ctaacttgagatgggaaatg

SEQ ID NO: 282376 - DNA, 20 bp, Artificial Sequence
  chemically synthesized
cttgagatgggaaatgaggc

SEQ ID NO: 282377 - DNA, 20 bp, Artificial Sequence
  chemically synthesized
agatgggaaatgaggcaagc

SEQ ID NO: 282378 - DNA, 20 bp, Artificial Sequence
  chemically synthesized
gatgggaaatgaggcaagcc

SEQ ID NO: 282379 - DNA, 20 bp, Artificial Sequence
  chemically synthesized
atgggaaatgaggcaagcca

SEQ ID NO: 282380 - DNA, 20 bp, Artificial Sequence
  chemically synthesized
aatgaggcaagccagggaaa

SEQ ID NO: 282381 - DNA, 20 bp, Artificial Sequence
  chemically synthesized
atgaggcaagccagggaaat

SEQ ID NO: 282382 - DNA, 20 bp, Artificial Sequence
  chemically synthesized
ttcattctttcccatttccc

SEQ ID NO: 282383 - DNA, 20 bp, Artificial Sequence
  chemically synthesized
ggcaagccagggaaatggga

SEQ ID NO: 282384 - DNA, 20 bp, Artificial Sequence
  chemically synthesized
cagggaaatgggaaagaatg

SEQ ID NO: 282385 - DNA, 20 bp, Artificial Sequence
  chemically synthesized
ggaaatgggaaagaatgaag

SEQ ID NO: 282386 - DNA, 20 bp, Artificial Sequence
  chemically synthesized
cttcttccttacagggtgga

SEQ ID NO: 282387 - DNA, 20 bp, Artificial Sequence
  chemically synthesized
cagtgtgccatccaccctgt

SEQ ID NO: 282388 - DNA, 20 bp, Artificial Sequence
  chemically synthesized
agtgtgccatccaccctgta

SEQ ID NO: 282389 - DNA, 20 bp, Artificial Sequence
  chemically synthesized
tctacttcttccttacaggg

SEQ ID NO: 282390 - DNA, 20 bp, Artificial Sequence
  chemically synthesized
gtgccatccaccctgtaagg

SEQ ID NO: 282391 - DNA, 20 bp, Artificial Sequence
  chemically synthesized
tgttctacttcttccttaca

SEQ ID NO: 282392 - DNA, 20 bp, Artificial Sequence
  chemically synthesized
atgttctacttcttccttac

SEQ ID NO: 282393 - DNA, 20 bp, Artificial Sequence
  chemically synthesized
gatgttctacttcttcctta

SEQ ID NO: 282394 - DNA, 20 bp, Artificial Sequence
  chemically synthesized
ccatccaccctgtaaggaag

SEQ ID NO: 282395 - DNA, 20 bp, Artificial Sequence
  chemically synthesized
tccaccctgtaaggaagaag

SEQ ID NO: 282396 - DNA, 20 bp, Artificial Sequence
  chemically synthesized
aggaagaagtagaacatccc

SEQ ID NO: 282397 - DNA, 20 bp, Artificial Sequence
  chemically synthesized
agtagaacatccctagccat

SEQ ID NO: 282398 - DNA, 20 bp, Artificial Sequence
  chemically synthesized
tcataatattccaatggcta

SEQ ID NO: 282399 - DNA, 20 bp, Artificial Sequence
  chemically synthesized
atcataatattccaatggct

SEQ ID NO: 282400 - DNA, 20 bp, Artificial Sequence
  chemically synthesized
aatcataatattccaatggc

SEQ ID NO: 282401 - DNA, 20 bp, Artificial Sequence
  chemically synthesized
gctaaatcataatattccaa

SEQ ID NO: 282402 - DNA, 20 bp, Artificial Sequence
  chemically synthesized
gccattggaatattatgatt

SEQ ID NO: 282403 - DNA, 20 bp, Artificial Sequence
  chemically synthesized
ttggaatattatgatttagc

SEQ ID NO: 282404 - DNA, 20 bp, Artificial Sequence
  chemically synthesized
tggaatattatgatttagca

SEQ ID NO: 282405 - DNA, 20 bp, Artificial Sequence
  chemically synthesized
tttagcaaggaaactattgt

SEQ ID NO: 282406 - DNA, 20 bp, Artificial Sequence
  chemically synthesized
ttagcaaggaaactattgtt

SEQ ID NO: 282407 - DNA, 20 bp, Artificial Sequence
  chemically synthesized
tagcaaggaaactattgttg

SEQ ID NO: 282408 - DNA, 20 bp, Artificial Sequence
  chemically synthesized
agcaaggaaactattgttgg

SEQ ID NO: 282409 - DNA, 20 bp, Artificial Sequence
  chemically synthesized
agcccaaaatcccccaacaa

SEQ ID NO: 282410 - DNA, 20 bp, Artificial Sequence
  chemically synthesized
aaactattgttgggggattt

SEQ ID NO: 282411 - DNA, 20 bp, Artificial Sequence
  chemically synthesized
aactattgttgggggatttt

SEQ ID NO: 282412 - DNA, 20 bp, Artificial Sequence
  chemically synthesized
ggattttgggctgaaaaata

SEQ ID NO: 282413 - DNA, 20 bp, Artificial Sequence
  chemically synthesized
atgggtggatctttattttt

SEQ ID NO: 282414 - DNA, 20 bp, Artificial Sequence
  chemically synthesized
aagtttccgtttgttatggg

SEQ ID NO: 282415 - DNA, 20 bp, Artificial Sequence
  chemically synthesized
cttaagtttccgtttgttat

SEQ ID NO: 282416 - DNA, 20 bp, Artificial Sequence
  chemically synthesized
aaagatccacccataacaaa

SEQ ID NO: 282417 - DNA, 20 bp, Artificial Sequence
  chemically synthesized
gcttaagtttccgtttgtta

SEQ ID NO: 282418 - DNA, 20 bp, Artificial Sequence
  chemically synthesized
cccataacaaacggaaactt

SEQ ID NO: 282419 - DNA, 20 bp, Artificial Sequence
  chemically synthesized
ctcatgtgtgatacaagctt

SEQ ID NO: 282420 - DNA, 20 bp, Artificial Sequence
  chemically synthesized
tctgccctcatgtgtgatac

SEQ ID NO: 282421 - DNA, 20 bp, Artificial Sequence
  chemically synthesized
cttaagcttgtatcacacat

SEQ ID NO: 282422 - DNA, 20 bp, Artificial Sequence
  chemically synthesized
ttaagcttgtatcacacatg

SEQ ID NO: 282423 - DNA, 20 bp, Artificial Sequence
  chemically synthesized
taagcttgtatcacacatga

SEQ ID NO: 282424 - DNA, 20 bp, Artificial Sequence
  chemically synthesized
gcttgtatcacacatgaggg

SEQ ID NO: 282425 - DNA, 20 bp, Artificial Sequence
  chemically synthesized
ttgtatcacacatgagggca

SEQ ID NO: 282426 - DNA, 20 bp, Artificial Sequence
  chemically synthesized
ttgttgccatcaggattgta

SEQ ID NO: 282427 - DNA, 20 bp, Artificial Sequence
  chemically synthesized
tattgttgccatcaggattg

SEQ ID NO: 282428 - DNA, 20 bp, Artificial Sequence
  chemically synthesized
taaaatctctacaatcctga

SEQ ID NO: 282429 - DNA, 20 bp, Artificial Sequence
  chemically synthesized
gtttttgtattgttgccatc

SEQ ID NO: 282430 - DNA, 20 bp, Artificial Sequence
  chemically synthesized
agtttttgtattgttgccat

SEQ ID NO: 282431 - DNA, 20 bp, Artificial Sequence
  chemically synthesized
gcaacaatacaaaaactcaa

SEQ ID NO: 282432 - DNA, 20 bp, Artificial Sequence
  chemically synthesized
aatacaaaaactcaatagcc

SEQ ID NO: 282433 - DNA, 20 bp, Artificial Sequence
  chemically synthesized
ttttttttctctgggctatt

SEQ ID NO: 282434 - DNA, 20 bp, Artificial Sequence
  chemically synthesized
tacaaaaactcaatagccca

SEQ ID NO: 282435 - DNA, 20 bp, Artificial Sequence
  chemically synthesized
ttttgtctttttttttctct

SEQ ID NO: 282436 - DNA, 20 bp, Artificial Sequence
  chemically synthesized
tttttgtctttttttttctc

SEQ ID NO: 282437 - DNA, 20 bp, Artificial Sequence
  chemically synthesized
caatagcccagagaaaaaaa

SEQ ID NO: 282438 - DNA, 20 bp, Artificial Sequence
  chemically synthesized
aaaaaaaaagacaaaaattc

SEQ ID NO: 282439 - DNA, 20 bp, Artificial Sequence
  chemically synthesized
aaaagacaaaaattccagta

SEQ ID NO: 282440 - DNA, 20 bp, Artificial Sequence
  chemically synthesized
aaagacaaaaattccagtaa

SEQ ID NO: 282441 - DNA, 20 bp, Artificial Sequence
  chemically synthesized
ataataggaattgcctttac

SEQ ID NO: 282442 - DNA, 20 bp, Artificial Sequence
  chemically synthesized
agtaaaggcaattcctatta

SEQ ID NO: 282443 - DNA, 20 bp, Artificial Sequence
  chemically synthesized
tttgcgagctcatctataat

SEQ ID NO: 282444 - DNA, 20 bp, Artificial Sequence
  chemically synthesized
atttgcgagctcatctataa

SEQ ID NO: 282445 - DNA, 20 bp, Artificial Sequence
  chemically synthesized
aggcaattcctattatagat

SEQ ID NO: 282446 - DNA, 20 bp, Artificial Sequence
  chemically synthesized
ttgtttatttgtttatttgc

SEQ ID NO: 282447 - DNA, 20 bp, Artificial Sequence
  chemically synthesized
taaacaaacaaaaaccttac

SEQ ID NO: 282448 - DNA, 20 bp, Artificial Sequence
  chemically synthesized
atttccccatgtggctagta

SEQ ID NO: 282449 - DNA, 20 bp, Artificial Sequence
  chemically synthesized
aatttccccatgtggctagt

SEQ ID NO: 282450 - DNA, 20 bp, Artificial Sequence
  chemically synthesized
caaaaaccttactagccaca

SEQ ID NO: 282451 - DNA, 20 bp, Artificial Sequence
  chemically synthesized
aaaaaccttactagccacat

SEQ ID NO: 282452 - DNA, 20 bp, Artificial Sequence
  chemically synthesized
agtgaatttccccatgtggc

SEQ ID NO: 282453 - DNA, 20 bp, Artificial Sequence
  chemically synthesized
aaaaccttactagccacatg

SEQ ID NO: 282454 - DNA, 20 bp, Artificial Sequence
  chemically synthesized
tggaagtgaatttccccatg

SEQ ID NO: 282455 - DNA, 20 bp, Artificial Sequence
  chemically synthesized
atggggaaattcacttccat

SEQ ID NO: 282456 - DNA, 20 bp, Artificial Sequence
  chemically synthesized
ggggaaattcacttccatta

SEQ ID NO: 282457 - DNA, 20 bp, Artificial Sequence
  chemically synthesized
gggaaattcacttccattag

SEQ ID NO: 282458 - DNA, 20 bp, Artificial Sequence
  chemically synthesized
ctaatgactccctctaatgg

SEQ ID NO: 282459 - DNA, 20 bp, Artificial Sequence
  chemically synthesized
ggaaattcacttccattaga

SEQ ID NO: 282460 - DNA, 20 bp, Artificial Sequence
  chemically synthesized
aaattcacttccattagagg

SEQ ID NO: 282461 - DNA, 20 bp, Artificial Sequence
  chemically synthesized
caactaatgactccctctaa

SEQ ID NO: 282462 - DNA, 20 bp, Artificial Sequence
  chemically synthesized
cttccattagagggagtcat

SEQ ID NO: 282463 - DNA, 20 bp, Artificial Sequence
  chemically synthesized
gagtcattagttgtaacaaa

SEQ ID NO: 282464 - DNA, 20 bp, Artificial Sequence
  chemically synthesized
tcattagttgtaacaaatgg

SEQ ID NO: 282465 - DNA, 20 bp, Artificial Sequence
  chemically synthesized
tatctttatgtcataaggta

SEQ ID NO: 282466 - DNA, 20 bp, Artificial Sequence
  chemically synthesized
tctattatctttatgtcata

SEQ ID NO: 282467 - DNA, 20 bp, Artificial Sequence
  chemically synthesized
ttctattatctttatgtcat

SEQ ID NO: 282468 - DNA, 20 bp, Artificial Sequence
  chemically synthesized
aatccataccttatgacata

SEQ ID NO: 282469 - DNA, 20 bp, Artificial Sequence
  chemically synthesized
accttatgacataaagataa

SEQ ID NO: 282470 - DNA, 20 bp, Artificial Sequence
  chemically synthesized
taaagataatagaacaattt

SEQ ID NO: 282471 - DNA, 20 bp, Artificial Sequence
  chemically synthesized
aagataatagaacaattttg

SEQ ID NO: 282472 - DNA, 20 bp, Artificial Sequence
  chemically synthesized
ggctaggcatatttattgta

SEQ ID NO: 282473 - DNA, 20 bp, Artificial Sequence
  chemically synthesized
aactgtacaataaatatgcc

SEQ ID NO: 282474 - DNA, 20 bp, Artificial Sequence
  chemically synthesized
aataaatatgcctagcctca

SEQ ID NO: 282475 - DNA, 20 bp, Artificial Sequence
  chemically synthesized
gaaacatacaccatgaggct

SEQ ID NO: 282476 - DNA, 20 bp, Artificial Sequence
  chemically synthesized
ggaaacatacaccatgaggc

SEQ ID NO: 282477 - DNA, 20 bp, Artificial Sequence
  chemically synthesized
tatgggaaacatacaccatg

SEQ ID NO: 282478 - DNA, 20 bp, Artificial Sequence
  chemically synthesized
ctatgggaaacatacaccat

SEQ ID NO: 282479 - DNA, 20 bp, Artificial Sequence
  chemically synthesized
ctcatggtgtatgtttccca

SEQ ID NO: 282480 - DNA, 20 bp, Artificial Sequence
  chemically synthesized
catggtgtatgtttcccata

SEQ ID NO: 282481 - DNA, 20 bp, Artificial Sequence
  chemically synthesized
ctcaagcaaataaactctat

SEQ ID NO: 282482 - DNA, 20 bp, Artificial Sequence
  chemically synthesized
tctcaagcaaataaactcta

SEQ ID NO: 282483 - DNA, 20 bp, Artificial Sequence
  chemically synthesized
cccatagagtttatttgctt

SEQ ID NO: 282484 - DNA, 20 bp, Artificial Sequence
  chemically synthesized
agagtttatttgcttgagac

SEQ ID NO: 282485 - DNA, 20 bp, Artificial Sequence
  chemically synthesized
gaattccacttgccagtctc

SEQ ID NO: 282486 - DNA, 20 bp, Artificial Sequence
  chemically synthesized
tttatttgcttgagactggc

SEQ ID NO: 282487 - DNA, 20 bp, Artificial Sequence
  chemically synthesized
atttgcttgagactggcaag

SEQ ID NO: 282488 - DNA, 20 bp, Artificial Sequence
  chemically synthesized
taggtgtgaattccacttgc

SEQ ID NO: 282489 - DNA, 20 bp, Artificial Sequence
  chemically synthesized
ggcaagtggaattcacacct

SEQ ID NO: 282490 - DNA, 20 bp, Artificial Sequence
  chemically synthesized
tggaattcacacctaagaaa

SEQ ID NO: 282491 - DNA, 20 bp, Artificial Sequence
  chemically synthesized
ggaattcacacctaagaaaa

SEQ ID NO: 282492 - DNA, 20 bp, Artificial Sequence
  chemically synthesized
gcaaccaagccctttttctt

SEQ ID NO: 282493 - DNA, 20 bp, Artificial Sequence
  chemically synthesized
gaattcacacctaagaaaaa

SEQ ID NO: 282494 - DNA, 20 bp, Artificial Sequence
  chemically synthesized
ggcaaccaagccctttttct

SEQ ID NO: 282495 - DNA, 20 bp, Artificial Sequence
  chemically synthesized
cacacctaagaaaaagggct

SEQ ID NO: 282496 - DNA, 20 bp, Artificial Sequence
  chemically synthesized
aaaatgaaatgtaggcaacc

SEQ ID NO: 282497 - DNA, 20 bp, Artificial Sequence
  chemically synthesized
gatctcccaaaatgaaatgt

SEQ ID NO: 282498 - DNA, 20 bp, Artificial Sequence
  chemically synthesized
tgatctcccaaaatgaaatg

SEQ ID NO: 282499 - DNA, 20 bp, Artificial Sequence
  chemically synthesized
tggttgcctacatttcattt

SEQ ID NO: 282500 - DNA, 20 bp, Artificial Sequence
  chemically synthesized
ggttgcctacatttcatttt

SEQ ID NO: 282501 - DNA, 20 bp, Artificial Sequence
  chemically synthesized
ttgcctacatttcattttgg

SEQ ID NO: 282502 - DNA, 20 bp, Artificial Sequence
  chemically synthesized
gggcttgtgaaaacaagaaa

SEQ ID NO: 282503 - DNA, 20 bp, Artificial Sequence
  chemically synthesized
cagggcttgtgaaaacaaga

SEQ ID NO: 282504 - DNA, 20 bp, Artificial Sequence
  chemically synthesized
aaaccagggcttgtgaaaac

SEQ ID NO: 282505 - DNA, 20 bp, Artificial Sequence
  chemically synthesized
catctctttcttgttttcac

SEQ ID NO: 282506 - DNA, 20 bp, Artificial Sequence
  chemically synthesized
tttcttgttttcacaagccc

SEQ ID NO: 282507 - DNA, 20 bp, Artificial Sequence
  chemically synthesized
agctctctctgtttaaacca

SEQ ID NO: 282508 - DNA, 20 bp, Artificial Sequence
  chemically synthesized
cagctctctctgtttaaacc

SEQ ID NO: 282509 - DNA, 20 bp, Artificial Sequence
  chemically synthesized
ttcacaagccctggtttaaa

SEQ ID NO: 282510 - DNA, 20 bp, Artificial Sequence
  chemically synthesized
tcagctctctctgtttaaac

SEQ ID NO: 282511 - DNA, 20 bp, Artificial Sequence
  chemically synthesized
cacaagccctggtttaaaca

SEQ ID NO: 282512 - DNA, 20 bp, Artificial Sequence
  chemically synthesized
caagccctggtttaaacaga

SEQ ID NO: 282513 - DNA, 20 bp, Artificial Sequence
  chemically synthesized
agccctggtttaaacagaga

SEQ ID NO: 282514 - DNA, 20 bp, Artificial Sequence
  chemically synthesized
gtttaaacagagagagctga

SEQ ID NO: 282515 - DNA, 20 bp, Artificial Sequence
  chemically synthesized
ttaaacagagagagctgacg

SEQ ID NO: 282516 - DNA, 20 bp, Artificial Sequence
  chemically synthesized
cactcccctcaagtctccgt

SEQ ID NO: 282517 - DNA, 20 bp, Artificial Sequence
  chemically synthesized
gagagagctgacggagactt

SEQ ID NO: 282518 - DNA, 20 bp, Artificial Sequence
  chemically synthesized
agagagctgacggagacttg

SEQ ID NO: 282519 - DNA, 20 bp, Artificial Sequence
  chemically synthesized
gagagctgacggagacttga

SEQ ID NO: 282520 - DNA, 20 bp, Artificial Sequence
  chemically synthesized
agagctgacggagacttgag

SEQ ID NO: 282521 - DNA, 20 bp, Artificial Sequence
  chemically synthesized
agctgacggagacttgaggg

SEQ ID NO: 282522 - DNA, 20 bp, Artificial Sequence
  chemically synthesized
ctcttcacctcactcccctc

SEQ ID NO: 282523 - DNA, 20 bp, Artificial Sequence
  chemically synthesized
gacggagacttgaggggagt

SEQ ID NO: 282524 - DNA, 20 bp, Artificial Sequence
  chemically synthesized
acggagacttgaggggagtg

SEQ ID NO: 282525 - DNA, 20 bp, Artificial Sequence
  chemically synthesized
gacttgaggggagtgaggtg

SEQ ID NO: 282526 - DNA, 20 bp, Artificial Sequence
  chemically synthesized
cttgaggggagtgaggtgaa

SEQ ID NO: 282527 - DNA, 20 bp, Artificial Sequence
  chemically synthesized
tgaggggagtgaggtgaaga

SEQ ID NO: 282528 - DNA, 20 bp, Artificial Sequence
  chemically synthesized
tgaggtgaagagagtttgaa

SEQ ID NO: 282529 - DNA, 20 bp, Artificial Sequence
  chemically synthesized
gtgaagagagtttgaatagt

SEQ ID NO: 282530 - DNA, 20 bp, Artificial Sequence
  chemically synthesized
tgaagagagtttgaatagtt

SEQ ID NO: 282531 - DNA, 20 bp, Artificial Sequence
  chemically synthesized
cccataaaagggtgagaaag

SEQ ID NO: 282532 - DNA, 20 bp, Artificial Sequence
  chemically synthesized
atccccataaaagggtgaga

SEQ ID NO: 282533 - DNA, 20 bp, Artificial Sequence
  chemically synthesized
acctatccccataaaagggt

SEQ ID NO: 282534 - DNA, 20 bp, Artificial Sequence
  chemically synthesized
tcttctttctcaccctttta

SEQ ID NO: 282535 - DNA, 20 bp, Artificial Sequence
  chemically synthesized
cttctttctcacccttttat

SEQ ID NO: 282536 - DNA, 20 bp, Artificial Sequence
  chemically synthesized
ttctttctcacccttttatg

SEQ ID NO: 282537 - DNA, 20 bp, Artificial Sequence
  chemically synthesized
ccctacctatccccataaaa

SEQ ID NO: 282538 - DNA, 20 bp, Artificial Sequence
  chemically synthesized
accctacctatccccataaa

SEQ ID NO: 282539 - DNA, 20 bp, Artificial Sequence
  chemically synthesized
taccctacctatccccataa

SEQ ID NO: 282540 - DNA, 20 bp, Artificial Sequence
  chemically synthesized
ttctcacccttttatgggga

SEQ ID NO: 282541 - DNA, 20 bp, Artificial Sequence
  chemically synthesized
tctcacccttttatggggat

SEQ ID NO: 282542 - DNA, 20 bp, Artificial Sequence
  chemically synthesized
cacccttttatggggatagg

SEQ ID NO: 282543 - DNA, 20 bp, Artificial Sequence
  chemically synthesized
acccttttatggggataggt

SEQ ID NO: 282544 - DNA, 20 bp, Artificial Sequence
  chemically synthesized
cccttttatggggataggta

SEQ ID NO: 282545 - DNA, 20 bp, Artificial Sequence
  chemically synthesized
gtaaataaaatgattcagat

SEQ ID NO: 282546 - DNA, 20 bp, Artificial Sequence
  chemically synthesized
atcctgtaaataaaatgatt

SEQ ID NO: 282547 - DNA, 20 bp, Artificial Sequence
  chemically synthesized
catctgaatcattttattta

SEQ ID NO: 282548 - DNA, 20 bp, Artificial Sequence
  chemically synthesized
atctgaatcattttatttac

SEQ ID NO: 282549 - DNA, 20 bp, Artificial Sequence
  chemically synthesized
gtagatgagtggttttgttt

SEQ ID NO: 282550 - DNA, 20 bp, Artificial Sequence
  chemically synthesized
atatccacccagtagatgag

SEQ ID NO: 282551 - DNA, 20 bp, Artificial Sequence
  chemically synthesized
aaacaaaaccactcatctac

SEQ ID NO: 282552 - DNA, 20 bp, Artificial Sequence
  chemically synthesized
aacaaaaccactcatctact

SEQ ID NO: 282553 - DNA, 20 bp, Artificial Sequence
  chemically synthesized
aatatatccacccagtagat

SEQ ID NO: 282554 - DNA, 20 bp, Artificial Sequence
  chemically synthesized
aaaaccactcatctactggg

SEQ ID NO: 282555 - DNA, 20 bp, Artificial Sequence
  chemically synthesized
tcctgaatatatccacccag

SEQ ID NO: 282556 - DNA, 20 bp, Artificial Sequence
  chemically synthesized
ccttcctgaatatatccacc

SEQ ID NO: 282557 - DNA, 20 bp, Artificial Sequence
  chemically synthesized
atctactgggtggatatatt

SEQ ID NO: 282558 - DNA, 20 bp, Artificial Sequence
  chemically synthesized
tctactgggtggatatattc

SEQ ID NO: 282559 - DNA, 20 bp, Artificial Sequence
  chemically synthesized
actgggtggatatattcagg

SEQ ID NO: 282560 - DNA, 20 bp, Artificial Sequence
  chemically synthesized
ctgggtggatatattcagga

SEQ ID NO: 282561 - DNA, 20 bp, Artificial Sequence
  chemically synthesized
tgggtggatatattcaggaa

SEQ ID NO: 282562 - DNA, 20 bp, Artificial Sequence
  chemically synthesized
gggtggatatattcaggaag

SEQ ID NO: 282563 - DNA, 20 bp, Artificial Sequence
  chemically synthesized
tggatatattcaggaagggg

SEQ ID NO: 282564 - DNA, 20 bp, Artificial Sequence
  chemically synthesized
tatattcaggaaggggtggt

SEQ ID NO: 282565 - DNA, 20 bp, Artificial Sequence
  chemically synthesized
gttggtattcatttcctgtt

SEQ ID NO: 282566 - DNA, 20 bp, Artificial Sequence
  chemically synthesized
ggccataccaacagctcaac

SEQ ID NO: 282567 - DNA, 20 bp, Artificial Sequence
  chemically synthesized
tggccataccaacagctcaa

SEQ ID NO: 282568 - DNA, 20 bp, Artificial Sequence
  chemically synthesized
ttcatttcctgttgagctgt

SEQ ID NO: 282569 - DNA, 20 bp, Artificial Sequence
  chemically synthesized
ttcctgttgagctgttggta

SEQ ID NO: 282570 - DNA, 20 bp, Artificial Sequence
  chemically synthesized
ttccttcttggccataccaa

SEQ ID NO: 282571 - DNA, 20 bp, Artificial Sequence
  chemically synthesized
gttgagctgttggtatggcc

SEQ ID NO: 282572 - DNA, 20 bp, Artificial Sequence
  chemically synthesized
gagctgttggtatggccaag

SEQ ID NO: 282573 - DNA, 20 bp, Artificial Sequence
  chemically synthesized
agctgttggtatggccaaga

SEQ ID NO: 282574 - DNA, 20 bp, Artificial Sequence
  chemically synthesized
agttgtttttgattccttct

SEQ ID NO: 282575 - DNA, 20 bp, Artificial Sequence
  chemically synthesized
caggaatgagaagtttgaaa

SEQ ID NO: 282576 - DNA, 20 bp, Artificial Sequence
  chemically synthesized
ttcaggaatgagaagtttga

SEQ ID NO: 282577 - DNA, 20 bp, Artificial Sequence
  chemically synthesized
ccgtacctttcaggaatgag

SEQ ID NO: 282578 - DNA, 20 bp, Artificial Sequence
  chemically synthesized
actccgtacctttcaggaat

SEQ ID NO: 282579 - DNA, 20 bp, Artificial Sequence
  chemically synthesized
ttcaaacttctcattcctga

SEQ ID NO: 282580 - DNA, 20 bp, Artificial Sequence
  chemically synthesized
tcaaacttctcattcctgaa

SEQ ID NO: 282581 - DNA, 20 bp, Artificial Sequence
  chemically synthesized
acctatactccgtacctttc

SEQ ID NO: 282582 - DNA, 20 bp, Artificial Sequence
  chemically synthesized
cttctcattcctgaaaggta

SEQ ID NO: 282583 - DNA, 20 bp, Artificial Sequence
  chemically synthesized
tacctatactccgtaccttt

SEQ ID NO: 282584 - DNA, 20 bp, Artificial Sequence
  chemically synthesized
tctcattcctgaaaggtacg

SEQ ID NO: 282585 - DNA, 20 bp, Artificial Sequence
  chemically synthesized
ttcctgaaaggtacggagta

SEQ ID NO: 282586 - DNA, 20 bp, Artificial Sequence
  chemically synthesized
tcctgaaaggtacggagtat

SEQ ID NO: 282587 - DNA, 20 bp, Artificial Sequence
  chemically synthesized
gtacggagtataggtacttc

SEQ ID NO: 282588 - DNA, 20 bp, Artificial Sequence
  chemically synthesized
tcagagcctatgggcactgg

SEQ ID NO: 282589 - DNA, 20 bp, Artificial Sequence
  chemically synthesized
ataggtacttccagtgccca

SEQ ID NO: 282590 - DNA, 20 bp, Artificial Sequence
  chemically synthesized
aactcagagcctatgggcac

SEQ ID NO: 282591 - DNA, 20 bp, Artificial Sequence
  chemically synthesized
taggtacttccagtgcccat

SEQ ID NO: 282592 - DNA, 20 bp, Artificial Sequence
  chemically synthesized
tatctcaactcagagcctat

SEQ ID NO: 282593 - DNA, 20 bp, Artificial Sequence
  chemically synthesized
atatctcaactcagagccta

SEQ ID NO: 282594 - DNA, 20 bp, Artificial Sequence
  chemically synthesized
ttccagtgcccataggctct

SEQ ID NO: 282595 - DNA, 20 bp, Artificial Sequence
  chemically synthesized
gtgcccataggctctgagtt

SEQ ID NO: 282596 - DNA, 20 bp, Artificial Sequence
  chemically synthesized
acctaccatatctcaactca

SEQ ID NO: 282597 - DNA, 20 bp, Artificial Sequence
  chemically synthesized
ttacctaccatatctcaact

SEQ ID NO: 282598 - DNA, 20 bp, Artificial Sequence
  chemically synthesized
ataggctctgagttgagata

SEQ ID NO: 282599 - DNA, 20 bp, Artificial Sequence
  chemically synthesized
ggctctgagttgagatatgg

SEQ ID NO: 282600 - DNA, 20 bp, Artificial Sequence
  chemically synthesized
gctctgagttgagatatggt

SEQ ID NO: 282601 - DNA, 20 bp, Artificial Sequence
  chemically synthesized
ttgagatatggtaggtaaat

SEQ ID NO: 282602 - DNA, 20 bp, Artificial Sequence
  chemically synthesized
atggtaggtaaattagactc

SEQ ID NO: 282603 - DNA, 20 bp, Artificial Sequence
  chemically synthesized
tggtaggtaaattagactcc

SEQ ID NO: 282604 - DNA, 20 bp, Artificial Sequence
  chemically synthesized
ggtaggtaaattagactcca

SEQ ID NO: 282605 - DNA, 20 bp, Artificial Sequence
  chemically synthesized
aatgctttagtgatgccctg

SEQ ID NO: 282606 - DNA, 20 bp, Artificial Sequence
  chemically synthesized
ccaatgctttagtgatgccc

SEQ ID NO: 282607 - DNA, 20 bp, Artificial Sequence
  chemically synthesized
tagactccagggcatcacta

SEQ ID NO: 282608 - DNA, 20 bp, Artificial Sequence
  chemically synthesized
ccagggcatcactaaagcat

SEQ ID NO: 282609 - DNA, 20 bp, Artificial Sequence
  chemically synthesized
tgtctttttaaccaatgctt

SEQ ID NO: 282610 - DNA, 20 bp, Artificial Sequence
  chemically synthesized
tcactaaagcattggttaaa

SEQ ID NO: 282611 - DNA, 20 bp, Artificial Sequence
  chemically synthesized
gttaaaaagacataatattc

SEQ ID NO: 282612 - DNA, 20 bp, Artificial Sequence
  chemically synthesized
taaaaagacataatattcaa

SEQ ID NO: 282613 - DNA, 20 bp, Artificial Sequence
  chemically synthesized
aaagacataatattcaagag

SEQ ID NO: 282614 - DNA, 20 bp, Artificial Sequence
  chemically synthesized
attcaagagcagtttgtgta

SEQ ID NO: 282615 - DNA, 20 bp, Artificial Sequence
  chemically synthesized
gtttgtgtaaagctgttgac

SEQ ID NO: 282616 - DNA, 20 bp, Artificial Sequence
  chemically synthesized
ttcaagctgacgcttgtcaa

SEQ ID NO: 282617 - DNA, 20 bp, Artificial Sequence
  chemically synthesized
gtaaagctgttgacaagcgt

SEQ ID NO: 282618 - DNA, 20 bp, Artificial Sequence
  chemically synthesized
tagtgtttaacaagaatttc

SEQ ID NO: 282619 - DNA, 20 bp, Artificial Sequence
  chemically synthesized
agtacctcgtagtgtttaac

SEQ ID NO: 282620 - DNA, 20 bp, Artificial Sequence
  chemically synthesized
aaattcttgttaaacactac

SEQ ID NO: 282621 - DNA, 20 bp, Artificial Sequence
  chemically synthesized
aattcttgttaaacactacg

SEQ ID NO: 282622 - DNA, 20 bp, Artificial Sequence
  chemically synthesized
taggcttttatagtacctcg

SEQ ID NO: 282623 - DNA, 20 bp, Artificial Sequence
  chemically synthesized
aacactacgaggtactataa

SEQ ID NO: 282624 - DNA, 20 bp, Artificial Sequence
  chemically synthesized
aaagatctcctaggctttta

SEQ ID NO: 282625 - DNA, 20 bp, Artificial Sequence
  chemically synthesized
tacgaggtactataaaagcc

SEQ ID NO: 282626 - DNA, 20 bp, Artificial Sequence
  chemically synthesized
acgaggtactataaaagcct

SEQ ID NO: 282627 - DNA, 20 bp, Artificial Sequence
  chemically synthesized
gaggtactataaaagcctag

SEQ ID NO: 282628 - DNA, 20 bp, Artificial Sequence
  chemically synthesized
ccccccaaaaaagatctcct

SEQ ID NO: 282629 - DNA, 20 bp, Artificial Sequence
  chemically synthesized
accccccaaaaaagatctcc

SEQ ID NO: 282630 - DNA, 20 bp, Artificial Sequence
  chemically synthesized
aaagcctaggagatcttttt

SEQ ID NO: 282631 - DNA, 20 bp, Artificial Sequence
  chemically synthesized
aagcctaggagatctttttt

SEQ ID NO: 282632 - DNA, 20 bp, Artificial Sequence
  chemically synthesized
agcctaggagatcttttttg

SEQ ID NO: 282633 - DNA, 20 bp, Artificial Sequence
  chemically synthesized
gcctaggagatcttttttgg

SEQ ID NO: 282634 - DNA, 20 bp, Artificial Sequence
  chemically synthesized
cctaggagatcttttttggg

SEQ ID NO: 282635 - DNA, 20 bp, Artificial Sequence
  chemically synthesized
gagctttgaaccccccaaaa

SEQ ID NO: 282636 - DNA, 20 bp, Artificial Sequence
  chemically synthesized
gatcttttttggggggttca

SEQ ID NO: 282637 - DNA, 20 bp, Artificial Sequence
  chemically synthesized
cagattggccttattcatat

SEQ ID NO: 282638 - DNA, 20 bp, Artificial Sequence
  chemically synthesized
ggttcaaagctcatatgaat

SEQ ID NO: 282639 - DNA, 20 bp, Artificial Sequence
  chemically synthesized
gttcaaagctcatatgaata

SEQ ID NO: 282640 - DNA, 20 bp, Artificial Sequence
  chemically synthesized
tcatatgaataaggccaatc

SEQ ID NO: 282641 - DNA, 20 bp, Artificial Sequence
  chemically synthesized
gctctgttgaggatccagat

SEQ ID NO: 282642 - DNA, 20 bp, Artificial Sequence
  chemically synthesized
gattcgctctgttgaggatc

SEQ ID NO: 282643 - DNA, 20 bp, Artificial Sequence
  chemically synthesized
aggccaatctggatcctcaa

SEQ ID NO: 282644 - DNA, 20 bp, Artificial Sequence
  chemically synthesized
gccaatctggatcctcaaca

SEQ ID NO: 282645 - DNA, 20 bp, Artificial Sequence
  chemically synthesized
agacttgattcgctctgttg

SEQ ID NO: 282646 - DNA, 20 bp, Artificial Sequence
  chemically synthesized
tagacttgattcgctctgtt

SEQ ID NO: 282647 - DNA, 20 bp, Artificial Sequence
  chemically synthesized
gatcctcaacagagcgaatc

SEQ ID NO: 282648 - DNA, 20 bp, Artificial Sequence
  chemically synthesized
aacagagcgaatcaagtcta

SEQ ID NO: 282649 - DNA, 20 bp, Artificial Sequence
  chemically synthesized
cagagcgaatcaagtctata

SEQ ID NO: 282650 - DNA, 20 bp, Artificial Sequence
  chemically synthesized
ctgacctggctcgttctcta

SEQ ID NO: 282651 - DNA, 20 bp, Artificial Sequence
  chemically synthesized
gaatcaagtctatagagaac

SEQ ID NO: 282652 - DNA, 20 bp, Artificial Sequence
  chemically synthesized
caagtctatagagaacgagc

SEQ ID NO: 282653 - DNA, 20 bp, Artificial Sequence
  chemically synthesized
aagtctatagagaacgagcc

SEQ ID NO: 282654 - DNA, 20 bp, Artificial Sequence
  chemically synthesized
ctatagagaacgagccaggt

SEQ ID NO: 282655 - DNA, 20 bp, Artificial Sequence
  chemically synthesized
tagagaacgagccaggtcag

SEQ ID NO: 282656 - DNA, 20 bp, Artificial Sequence
  chemically synthesized
atatattatcaccactgacc

SEQ ID NO: 282657 - DNA, 20 bp, Artificial Sequence
  chemically synthesized
aggtcagtggtgataatata

SEQ ID NO: 282658 - DNA, 20 bp, Artificial Sequence
  chemically synthesized
tcagtggtgataatatatag

SEQ ID NO: 282659 - DNA, 20 bp, Artificial Sequence
  chemically synthesized
agtggtgataatatatagaa

SEQ ID NO: 282660 - DNA, 20 bp, Artificial Sequence
  chemically synthesized
gtggtgataatatatagaag

SEQ ID NO: 282661 - DNA, 20 bp, Artificial Sequence
  chemically synthesized
tggtgataatatatagaaga

SEQ ID NO: 282662 - DNA, 20 bp, Artificial Sequence
  chemically synthesized
aatatatagaagagggacaa

SEQ ID NO: 282663 - DNA, 20 bp, Artificial Sequence
  chemically synthesized
atagaagagggacaacagac

SEQ ID NO: 282664 - DNA, 20 bp, Artificial Sequence
  chemically synthesized
tagaagagggacaacagact

SEQ ID NO: 282665 - DNA, 20 bp, Artificial Sequence
  chemically synthesized
ggacaacagactaggcatta

SEQ ID NO: 282666 - DNA, 20 bp, Artificial Sequence
  chemically synthesized
ccacacacatctataatgcc

SEQ ID NO: 282667 - DNA, 20 bp, Artificial Sequence
  chemically synthesized
ctaggcattatagatgtgtg

SEQ ID NO: 282668 - DNA, 20 bp, Artificial Sequence
  chemically synthesized
taggcattatagatgtgtgt

SEQ ID NO: 282669 - DNA, 20 bp, Artificial Sequence
  chemically synthesized
atgtgtgtgggttttaacaa

SEQ ID NO: 282670 - DNA, 20 bp, Artificial Sequence
  chemically synthesized
tgtgtgtgggttttaacaaa

SEQ ID NO: 282671 - DNA, 20 bp, Artificial Sequence
  chemically synthesized
gtgtgtgggttttaacaaaa

SEQ ID NO: 282672 - DNA, 20 bp, Artificial Sequence
  chemically synthesized
tgggttttaacaaaagggaa

SEQ ID NO: 282673 - DNA, 20 bp, Artificial Sequence
  chemically synthesized
gttttaacaaaagggaacag

SEQ ID NO: 282674 - DNA, 20 bp, Artificial Sequence
  chemically synthesized
caaaagggaacagcagttgt

SEQ ID NO: 282675 - DNA, 20 bp, Artificial Sequence
  chemically synthesized
aagggaacagcagttgtgag

SEQ ID NO: 282676 - DNA, 20 bp, Artificial Sequence
  chemically synthesized
gcagttgtgagcagcaaaaa

SEQ ID NO: 282677 - DNA, 20 bp, Artificial Sequence
  chemically synthesized
cagttgtgagcagcaaaaaa

SEQ ID NO: 282678 - DNA, 20 bp, Artificial Sequence
  chemically synthesized
aaaaaaaggactttcacatg

SEQ ID NO: 282679 - DNA, 20 bp, Artificial Sequence
  chemically synthesized
aaaatactctcttcatgtga

SEQ ID NO: 282680 - DNA, 20 bp, Artificial Sequence
  chemically synthesized
aaaaaggactttcacatgaa

SEQ ID NO: 282681 - DNA, 20 bp, Artificial Sequence
  chemically synthesized
aaaggactttcacatgaaga

SEQ ID NO: 282682 - DNA, 20 bp, Artificial Sequence
  chemically synthesized
gatataagggagggtgaaga

SEQ ID NO: 282683 - DNA, 20 bp, Artificial Sequence
  chemically synthesized
cgatataagggagggtgaag

SEQ ID NO: 282684 - DNA, 20 bp, Artificial Sequence
  chemically synthesized
tcgatataagggagggtgaa

SEQ ID NO: 282685 - DNA, 20 bp, Artificial Sequence
  chemically synthesized
tgtcgatataagggagggtg

SEQ ID NO: 282686 - DNA, 20 bp, Artificial Sequence
  chemically synthesized
tctactgtcgatataaggga

SEQ ID NO: 282687 - DNA, 20 bp, Artificial Sequence
  chemically synthesized
atctactgtcgatataaggg

SEQ ID NO: 282688 - DNA, 20 bp, Artificial Sequence
  chemically synthesized
gatctactgtcgatataagg

SEQ ID NO: 282689 - DNA, 20 bp, Artificial Sequence
  chemically synthesized
cagatctactgtcgatataa

SEQ ID NO: 282690 - DNA, 20 bp, Artificial Sequence
  chemically synthesized
acagatctactgtcgatata

SEQ ID NO: 282691 - DNA, 20 bp, Artificial Sequence
  chemically synthesized
ttcaccctcccttatatcga

SEQ ID NO: 282692 - DNA, 20 bp, Artificial Sequence
  chemically synthesized
tacagatctactgtcgatat

SEQ ID NO: 282693 - DNA, 20 bp, Artificial Sequence
  chemically synthesized
accctcccttatatcgacag

SEQ ID NO: 282694 - DNA, 20 bp, Artificial Sequence
  chemically synthesized
atcgacagtagatctgtatc

SEQ ID NO: 282695 - DNA, 20 bp, Artificial Sequence
  chemically synthesized
tccatcccagtttctggata

SEQ ID NO: 282696 - DNA, 20 bp, Artificial Sequence
  chemically synthesized
gtagatctgtatccagaaac

SEQ ID NO: 282697 - DNA, 20 bp, Artificial Sequence
  chemically synthesized
tagatctgtatccagaaact

SEQ ID NO: 282698 - DNA, 20 bp, Artificial Sequence
  chemically synthesized
tcctcctccatcccagtttc

SEQ ID NO: 282699 - DNA, 20 bp, Artificial Sequence
  chemically synthesized
tctgtatccagaaactggga

SEQ ID NO: 282700 - DNA, 20 bp, Artificial Sequence
  chemically synthesized
tgtatccagaaactgggatg

SEQ ID NO: 282701 - DNA, 20 bp, Artificial Sequence
  chemically synthesized
gtatccagaaactgggatgg

SEQ ID NO: 282702 - DNA, 20 bp, Artificial Sequence
  chemically synthesized
cacagtctcctcctccatcc

SEQ ID NO: 282703 - DNA, 20 bp, Artificial Sequence
  chemically synthesized
atccagaaactgggatggag

SEQ ID NO: 282704 - DNA, 20 bp, Artificial Sequence
  chemically synthesized
tccagaaactgggatggagg

SEQ ID NO: 282705 - DNA, 20 bp, Artificial Sequence
  chemically synthesized
cagaaactgggatggaggag

SEQ ID NO: 282706 - DNA, 20 bp, Artificial Sequence
  chemically synthesized
gggatggaggaggagactgt

SEQ ID NO: 282707 - DNA, 20 bp, Artificial Sequence
  chemically synthesized
agtgagaataaatggtctca

SEQ ID NO: 282708 - DNA, 20 bp, Artificial Sequence
  chemically synthesized
gacgcaggagtgagaataaa

SEQ ID NO: 282709 - DNA, 20 bp, Artificial Sequence
  chemically synthesized
atttatacagacgcaggagt

SEQ ID NO: 282710 - DNA, 20 bp, Artificial Sequence
  chemically synthesized
agcaatttatacagacgcag

SEQ ID NO: 282711 - DNA, 20 bp, Artificial Sequence
  chemically synthesized
tcagcaatttatacagacgc

SEQ ID NO: 282712 - DNA, 20 bp, Artificial Sequence
  chemically synthesized
ttcagcaatttatacagacg

SEQ ID NO: 282713 - DNA, 20 bp, Artificial Sequence
  chemically synthesized
tgttgcttcagcaatttata

SEQ ID NO: 282714 - DNA, 20 bp, Artificial Sequence
  chemically synthesized
tgcgtctgtataaattgctg

SEQ ID NO: 282715 - DNA, 20 bp, Artificial Sequence
  chemically synthesized
tgtataaattgctgaagcaa

SEQ ID NO: 282716 - DNA, 20 bp, Artificial Sequence
  chemically synthesized
tttagattaatctgttgctt

SEQ ID NO: 282717 - DNA, 20 bp, Artificial Sequence
  chemically synthesized
aatcaaatatttcacaagtt

SEQ ID NO: 282718 - DNA, 20 bp, Artificial Sequence
  chemically synthesized
aacttaatcaaatatttcac

SEQ ID NO: 282719 - DNA, 20 bp, Artificial Sequence
  chemically synthesized
aacttgtgaaatatttgatt

SEQ ID NO: 282720 - DNA, 20 bp, Artificial Sequence
  chemically synthesized
tatgatatttaaatttaaat

SEQ ID NO: 282721 - DNA, 20 bp, Artificial Sequence
  chemically synthesized
tgatatttaaatttaaatta

SEQ ID NO: 282722 - DNA, 20 bp, Artificial Sequence
  chemically synthesized
gagtacattttaataactaa

SEQ ID NO: 282723 - DNA, 20 bp, Artificial Sequence
  chemically synthesized
cattactttttattcacttt

SEQ ID NO: 282724 - DNA, 20 bp, Artificial Sequence
  chemically synthesized
aataactaaaagtgaataaa

SEQ ID NO: 282725 - DNA, 20 bp, Artificial Sequence
  chemically synthesized
aaaagtgaataaaaagtaat

SEQ ID NO: 282726 - DNA, 20 bp, Artificial Sequence
  chemically synthesized
aataaaaagtaatgagatcc

SEQ ID NO: 282727 - DNA, 20 bp, Artificial Sequence
  chemically synthesized
taaaaagtaatgagatccca

SEQ ID NO: 282728 - DNA, 20 bp, Artificial Sequence
  chemically synthesized
ttctttaacaatatttctct

SEQ ID NO: 282729 - DNA, 20 bp, Artificial Sequence
  chemically synthesized
cttctttaacaatatttctc

SEQ ID NO: 282730 - DNA, 20 bp, Artificial Sequence
  chemically synthesized
atcccagagaaatattgtta

SEQ ID NO: 282731 - DNA, 20 bp, Artificial Sequence
  chemically synthesized
ccagagaaatattgttaaag

SEQ ID NO: 282732 - DNA, 20 bp, Artificial Sequence
  chemically synthesized
ttgttaaagaagccaactac

SEQ ID NO: 282733 - DNA, 20 bp, Artificial Sequence
  chemically synthesized
tgttaaagaagccaactacc

SEQ ID NO: 282734 - DNA, 20 bp, Artificial Sequence
  chemically synthesized
ttcaccttctgcctggtagt

SEQ ID NO: 282735 - DNA, 20 bp, Artificial Sequence
  chemically synthesized
taaagaagccaactaccagg

SEQ ID NO: 282736 - DNA, 20 bp, Artificial Sequence
  chemically synthesized
aaatttcaccttctgcctgg

SEQ ID NO: 282737 - DNA, 20 bp, Artificial Sequence
  chemically synthesized
agaagccaactaccaggcag

SEQ ID NO: 282738 - DNA, 20 bp, Artificial Sequence
  chemically synthesized
gaagccaactaccaggcaga

SEQ ID NO: 282739 - DNA, 20 bp, Artificial Sequence
  chemically synthesized
gtcaaatttcaccttctgcc

SEQ ID NO: 282740 - DNA, 20 bp, Artificial Sequence
  chemically synthesized
aggcagaaggtgaaatttga

SEQ ID NO: 282741 - DNA, 20 bp, Artificial Sequence
  chemically synthesized
gcagaaggtgaaatttgaca

SEQ ID NO: 282742 - DNA, 20 bp, Artificial Sequence
  chemically synthesized
aaggtgaaatttgacagagt

SEQ ID NO: 282743 - DNA, 20 bp, Artificial Sequence
  chemically synthesized
aggtgaaatttgacagagtt

SEQ ID NO: 282744 - DNA, 20 bp, Artificial Sequence
  chemically synthesized
aaatttgacagagttgggtg

SEQ ID NO: 282745 - DNA, 20 bp, Artificial Sequence
  chemically synthesized
acagagttgggtgtagttat

SEQ ID NO: 282746 - DNA, 20 bp, Artificial Sequence
  chemically synthesized
ggtgtagttattggaaaaat

SEQ ID NO: 282747 - DNA, 20 bp, Artificial Sequence
  chemically synthesized
tagttattggaaaaataaga

SEQ ID NO: 282748 - DNA, 20 bp, Artificial Sequence
  chemically synthesized
tgtcatgtttattactcatt

SEQ ID NO: 282749 - DNA, 20 bp, Artificial Sequence
  chemically synthesized
ctgaaatgtttcaacttaat

SEQ ID NO: 282750 - DNA, 20 bp, Artificial Sequence
  chemically synthesized
ctcattaagttgaaacattt

SEQ ID NO: 282751 - DNA, 20 bp, Artificial Sequence
  chemically synthesized
gttgaaacatttcagtcaaa

SEQ ID NO: 282752 - DNA, 20 bp, Artificial Sequence
  chemically synthesized
aaacatttcagtcaaacaga

SEQ ID NO: 282753 - DNA, 20 bp, Artificial Sequence
  chemically synthesized
caaacagatggtatctgttt

SEQ ID NO: 282754 - DNA, 20 bp, Artificial Sequence
  chemically synthesized
attcctttaaacaacttaaa

SEQ ID NO: 282755 - DNA, 20 bp, Artificial Sequence
  chemically synthesized
gtatctgtttaagttgttta

SEQ ID NO: 282756 - DNA, 20 bp, Artificial Sequence
  chemically synthesized
tatctgtttaagttgtttaa

SEQ ID NO: 282757 - DNA, 20 bp, Artificial Sequence
  chemically synthesized
aagttgtttaaaggaataca

SEQ ID NO: 282758 - DNA, 20 bp, Artificial Sequence
  chemically synthesized
acatagaattaatcacaaaa

SEQ ID NO: 282759 - DNA, 20 bp, Artificial Sequence
  chemically synthesized
tagaattaatcacaaaaaag

SEQ ID NO: 282760 - DNA, 20 bp, Artificial Sequence
  chemically synthesized
aaaagaagaaaaccataaca

SEQ ID NO: 282761 - DNA, 20 bp, Artificial Sequence
  chemically synthesized
cacaaatctgttctttgtta

SEQ ID NO: 282762 - DNA, 20 bp, Artificial Sequence
  chemically synthesized
aagaaaaccataacaaagaa

SEQ ID NO: 282763 - DNA, 20 bp, Artificial Sequence
  chemically synthesized
ccatttctcaatattttatt

SEQ ID NO: 282764 - DNA, 20 bp, Artificial Sequence
  chemically synthesized
aaacaactcaataaaatatt

SEQ ID NO: 282765 - DNA, 20 bp, Artificial Sequence
  chemically synthesized
ctcaataaaatattgagaaa

SEQ ID NO: 282766 - DNA, 20 bp, Artificial Sequence
  chemically synthesized
taaacacacatacataaatg

SEQ ID NO: 282767 - DNA, 20 bp, Artificial Sequence
  chemically synthesized
aacacacatacataaatgta

SEQ ID NO: 282768 - DNA, 20 bp, Artificial Sequence
  chemically synthesized
cacacatacataaatgtaga

SEQ ID NO: 282769 - DNA, 20 bp, Artificial Sequence
  chemically synthesized
tagagagataaatatatata

SEQ ID NO: 282770 - DNA, 20 bp, Artificial Sequence
  chemically synthesized
gataaatatatatacagaca

SEQ ID NO: 282771 - DNA, 20 bp, Artificial Sequence
  chemically synthesized
atatatatacagacaaagat

SEQ ID NO: 282772 - DNA, 20 bp, Artificial Sequence
  chemically synthesized
tttatccttcaatagagaaa

SEQ ID NO: 282773 - DNA, 20 bp, Artificial Sequence
  chemically synthesized
atgagactatttctctattg

SEQ ID NO: 282774 - DNA, 20 bp, Artificial Sequence
  chemically synthesized
tgagactatttctctattga

SEQ ID NO: 282775 - DNA, 20 bp, Artificial Sequence
  chemically synthesized
gcgtaatttatccttcaata

SEQ ID NO: 282776 - DNA, 20 bp, Artificial Sequence
  chemically synthesized
tggcgtaatttatccttcaa

SEQ ID NO: 282777 - DNA, 20 bp, Artificial Sequence
  chemically synthesized
ttgaaggataaattacgcca

SEQ ID NO: 282778 - DNA, 20 bp, Artificial Sequence
  chemically synthesized
tgaaggataaattacgccac

SEQ ID NO: 282779 - DNA, 20 bp, Artificial Sequence
  chemically synthesized
aggataaattacgccacagg

SEQ ID NO: 282780 - DNA, 20 bp, Artificial Sequence
  chemically synthesized
attctcgcttcagctgcctg

SEQ ID NO: 282781 - DNA, 20 bp, Artificial Sequence
  chemically synthesized
aattacgccacaggcagctg

SEQ ID NO: 282782 - DNA, 20 bp, Artificial Sequence
  chemically synthesized
acgccacaggcagctgaagc

SEQ ID NO: 282783 - DNA, 20 bp, Artificial Sequence
  chemically synthesized
caactctcaaattctcgctt

SEQ ID NO: 282784 - DNA, 20 bp, Artificial Sequence
  chemically synthesized
ggcagctgaagcgagaattt

SEQ ID NO: 282785 - DNA, 20 bp, Artificial Sequence
  chemically synthesized
cagctgaagcgagaatttga

SEQ ID NO: 282786 - DNA, 20 bp, Artificial Sequence
  chemically synthesized
tgaagcgagaatttgagagt

SEQ ID NO: 282787 - DNA, 20 bp, Artificial Sequence
  chemically synthesized
agcgagaatttgagagttgg

SEQ ID NO: 282788 - DNA, 20 bp, Artificial Sequence
  chemically synthesized
agaatttgagagttggaaga

SEQ ID NO: 282789 - DNA, 20 bp, Artificial Sequence
  chemically synthesized
gagagttggaagacagattt

SEQ ID NO: 282790 - DNA, 20 bp, Artificial Sequence
  chemically synthesized
ttggaagacagattttagaa

SEQ ID NO: 282791 - DNA, 20 bp, Artificial Sequence
  chemically synthesized
ttagaaaagtatccaaaatt

SEQ ID NO: 282792 - DNA, 20 bp, Artificial Sequence
  chemically synthesized
tatctctatctgctcaattt

SEQ ID NO: 282793 - DNA, 20 bp, Artificial Sequence
  chemically synthesized
gaaaagtatccaaaattgag

SEQ ID NO: 282794 - DNA, 20 bp, Artificial Sequence
  chemically synthesized
agtatccaaaattgagcaga

SEQ ID NO: 282795 - DNA, 20 bp, Artificial Sequence
  chemically synthesized
tatccaaaattgagcagata

SEQ ID NO: 282796 - DNA, 20 bp, Artificial Sequence
  chemically synthesized
aaaattgagcagatagagat

SEQ ID NO: 282797 - DNA, 20 bp, Artificial Sequence
  chemically synthesized
agcagatagagataagaata

SEQ ID NO: 282798 - DNA, 20 bp, Artificial Sequence
  chemically synthesized
taagaatatagaaaatatta

SEQ ID NO: 282799 - DNA, 20 bp, Artificial Sequence
  chemically synthesized
aagaatatagaaaatattaa

SEQ ID NO: 282800 - DNA, 20 bp, Artificial Sequence
  chemically synthesized
agaatatagaaaatattaaa

SEQ ID NO: 282801 - DNA, 20 bp, Artificial Sequence
  chemically synthesized
agaaaatattaaagggaaac

SEQ ID NO: 282802 - DNA, 20 bp, Artificial Sequence
  chemically synthesized
attaaagggaaaccagtaac

SEQ ID NO: 282803 - DNA, 20 bp, Artificial Sequence
  chemically synthesized
ccttcttatattccagttac

SEQ ID NO: 282804 - DNA, 20 bp, Artificial Sequence
  chemically synthesized
gaaaccagtaactggaatat

SEQ ID NO: 282805 - DNA, 20 bp, Artificial Sequence
  chemically synthesized
actatccccttcttatattc

SEQ ID NO: 282806 - DNA, 20 bp, Artificial Sequence
  chemically synthesized
accagtaactggaatataag

SEQ ID NO: 282807 - DNA, 20 bp, Artificial Sequence
  chemically synthesized
ccagtaactggaatataaga

SEQ ID NO: 282808 - DNA, 20 bp, Artificial Sequence
  chemically synthesized
cagtaactggaatataagaa

SEQ ID NO: 282809 - DNA, 20 bp, Artificial Sequence
  chemically synthesized
agtaactggaatataagaag

SEQ ID NO: 282810 - DNA, 20 bp, Artificial Sequence
  chemically synthesized
actggaatataagaagggga

SEQ ID NO: 282811 - DNA, 20 bp, Artificial Sequence
  chemically synthesized
taagaaggggatagtcttaa

SEQ ID NO: 282812 - DNA, 20 bp, Artificial Sequence
  chemically synthesized
aaaactttcttagagctatt

SEQ ID NO: 282813 - DNA, 20 bp, Artificial Sequence
  chemically synthesized
gggatagtcttaatagctct

SEQ ID NO: 282814 - DNA, 20 bp, Artificial Sequence
  chemically synthesized
tagtcttaatagctctaaga

SEQ ID NO: 282815 - DNA, 20 bp, Artificial Sequence
  chemically synthesized
cctaagggaaaactttctta

SEQ ID NO: 282816 - DNA, 20 bp, Artificial Sequence
  chemically synthesized
ttcctaagggaaaactttct

SEQ ID NO: 282817 - DNA, 20 bp, Artificial Sequence
  chemically synthesized
gctctaagaaagttttccct

SEQ ID NO: 282818 - DNA, 20 bp, Artificial Sequence
  chemically synthesized
ctctaagaaagttttccctt

SEQ ID NO: 282819 - DNA, 20 bp, Artificial Sequence
  chemically synthesized
taagaaagttttcccttagg

SEQ ID NO: 282820 - DNA, 20 bp, Artificial Sequence
  chemically synthesized
aagaaagttttcccttagga

SEQ ID NO: 282821 - DNA, 20 bp, Artificial Sequence
  chemically synthesized
atctcttcattccttcctaa

SEQ ID NO: 282822 - DNA, 20 bp, Artificial Sequence
  chemically synthesized
aatctcttcattccttccta

SEQ ID NO: 282823 - DNA, 20 bp, Artificial Sequence
  chemically synthesized
caatctcttcattccttcct

SEQ ID NO: 282824 - DNA, 20 bp, Artificial Sequence
  chemically synthesized
ttttcccttaggaaggaatg

SEQ ID NO: 282825 - DNA, 20 bp, Artificial Sequence
  chemically synthesized
ttcccttaggaaggaatgaa

SEQ ID NO: 282826 - DNA, 20 bp, Artificial Sequence
  chemically synthesized
ttaggaaggaatgaagagat

SEQ ID NO: 282827 - DNA, 20 bp, Artificial Sequence
  chemically synthesized
taggaaggaatgaagagatt

SEQ ID NO: 282828 - DNA, 20 bp, Artificial Sequence
  chemically synthesized
ggaatgaagagattgggaaa

SEQ ID NO: 282829 - DNA, 20 bp, Artificial Sequence
  chemically synthesized
ggaaaaagaaaatcttcaca

SEQ ID NO: 282830 - DNA, 20 bp, Artificial Sequence
  chemically synthesized
ggttctgcattgtctttgtg

SEQ ID NO: 282831 - DNA, 20 bp, Artificial Sequence
  chemically synthesized
aaatcttcacaaagacaatg

SEQ ID NO: 282832 - DNA, 20 bp, Artificial Sequence
  chemically synthesized
aagacaatgcagaaccacta

SEQ ID NO: 282833 - DNA, 20 bp, Artificial Sequence
  chemically synthesized
cagatacgttatttctttag

SEQ ID NO: 282834 - DNA, 20 bp, Artificial Sequence
  chemically synthesized
gaacagatacgttatttctt

SEQ ID NO: 282835 - DNA, 20 bp, Artificial Sequence
  chemically synthesized
acctggtgtgttaattagaa

SEQ ID NO: 282836 - DNA, 20 bp, Artificial Sequence
  chemically synthesized
ttgtcacctggtgtgttaat

SEQ ID NO: 282837 - DNA, 20 bp, Artificial Sequence
  chemically synthesized
atctgttctaattaacacac

SEQ ID NO: 282838 - DNA, 20 bp, Artificial Sequence
  chemically synthesized
tctgttctaattaacacacc

SEQ ID NO: 282839 - DNA, 20 bp, Artificial Sequence
  chemically synthesized
aattaacacaccaggtgaca

SEQ ID NO: 282840 - DNA, 20 bp, Artificial Sequence
  chemically synthesized
ttcatttatactttgtcacc

SEQ ID NO: 282841 - DNA, 20 bp, Artificial Sequence
  chemically synthesized
aggtgacaaagtataaatga

SEQ ID NO: 282842 - DNA, 20 bp, Artificial Sequence
  chemically synthesized
aatgaaagcaaatttacaca

SEQ ID NO: 282843 - DNA, 20 bp, Artificial Sequence
  chemically synthesized
agcaaatttacacacagaca

SEQ ID NO: 282844 - DNA, 20 bp, Artificial Sequence
  chemically synthesized
atttacacacagacaaagtt

SEQ ID NO: 282845 - DNA, 20 bp, Artificial Sequence
  chemically synthesized
gacaaagttgagtgaaactg

SEQ ID NO: 282846 - DNA, 20 bp, Artificial Sequence
  chemically synthesized
aaagttgagtgaaactgtag

SEQ ID NO: 282847 - DNA, 20 bp, Artificial Sequence
  chemically synthesized
tcaccctattttgtcttcta

SEQ ID NO: 282848 - DNA, 20 bp, Artificial Sequence
  chemically synthesized
tgaaactgtagaagacaaaa

SEQ ID NO: 282849 - DNA, 20 bp, Artificial Sequence
  chemically synthesized
gaaactgtagaagacaaaat

SEQ ID NO: 282850 - DNA, 20 bp, Artificial Sequence
  chemically synthesized
aaactgtagaagacaaaata

SEQ ID NO: 282851 - DNA, 20 bp, Artificial Sequence
  chemically synthesized
gacaaaatagggtgaaactg

SEQ ID NO: 282852 - DNA, 20 bp, Artificial Sequence
  chemically synthesized
caaaatagggtgaaactgca

SEQ ID NO: 282853 - DNA, 20 bp, Artificial Sequence
  chemically synthesized
aatagggtgaaactgcagag

SEQ ID NO: 282854 - DNA, 20 bp, Artificial Sequence
  chemically synthesized
tcttcgtcctgtctgctctg

SEQ ID NO: 282855 - DNA, 20 bp, Artificial Sequence
  chemically synthesized
gggtgaaactgcagagcaga

SEQ ID NO: 282856 - DNA, 20 bp, Artificial Sequence
  chemically synthesized
ggtgaaactgcagagcagac

SEQ ID NO: 282857 - DNA, 20 bp, Artificial Sequence
  chemically synthesized
actgcagagcagacaggacg

SEQ ID NO: 282858 - DNA, 20 bp, Artificial Sequence
  chemically synthesized
tgcagagcagacaggacgaa

SEQ ID NO: 282859 - DNA, 20 bp, Artificial Sequence
  chemically synthesized
caggacgaagagaaaattta

SEQ ID NO: 282860 - DNA, 20 bp, Artificial Sequence
  chemically synthesized
aggacgaagagaaaatttaa

SEQ ID NO: 282861 - DNA, 20 bp, Artificial Sequence
  chemically synthesized
aagagaaaatttaaaggtac

SEQ ID NO: 282862 - DNA, 20 bp, Artificial Sequence
  chemically synthesized
gagaaaatttaaaggtacca

SEQ ID NO: 282863 - DNA, 20 bp, Artificial Sequence
  chemically synthesized
tgtttctttatcattttctc

SEQ ID NO: 282864 - DNA, 20 bp, Artificial Sequence
  chemically synthesized
aggtaccagagaaaatgata

SEQ ID NO: 282865 - DNA, 20 bp, Artificial Sequence
  chemically synthesized
ataaagaaacaataacttga

SEQ ID NO: 282866 - DNA, 20 bp, Artificial Sequence
  chemically synthesized
aagaaacaataacttgacag

SEQ ID NO: 282867 - DNA, 20 bp, Artificial Sequence
  chemically synthesized
cctttaggaaatctgctgtc

SEQ ID NO: 282868 - DNA, 20 bp, Artificial Sequence
  chemically synthesized
acttgacagcagatttccta

SEQ ID NO: 282869 - DNA, 20 bp, Artificial Sequence
  chemically synthesized
cttgacagcagatttcctaa

SEQ ID NO: 282870 - DNA, 20 bp, Artificial Sequence
  chemically synthesized
ttttgaaattttttgccttt

SEQ ID NO: 282871 - DNA, 20 bp, Artificial Sequence
  chemically synthesized
cttttgaaattttttgcctt

SEQ ID NO: 282872 - DNA, 20 bp, Artificial Sequence
  chemically synthesized
ctaaaggcaaaaaatttcaa

SEQ ID NO: 282873 - DNA, 20 bp, Artificial Sequence
  chemically synthesized
caaaagacaaataatatttt

SEQ ID NO: 282874 - DNA, 20 bp, Artificial Sequence
  chemically synthesized
aaataatattttcagtgttg

SEQ ID NO: 282875 - DNA, 20 bp, Artificial Sequence
  chemically synthesized
aataatattttcagtgttgt

SEQ ID NO: 282876 - DNA, 20 bp, Artificial Sequence
  chemically synthesized
gcaggaaattatgtaaggac

SEQ ID NO: 282877 - DNA, 20 bp, Artificial Sequence
  chemically synthesized
agcaggaaattatgtaagga

SEQ ID NO: 282878 - DNA, 20 bp, Artificial Sequence
  chemically synthesized
gttgagcaggaaattatgta

SEQ ID NO: 282879 - DNA, 20 bp, Artificial Sequence
  chemically synthesized
agttgagcaggaaattatgt

SEQ ID NO: 282880 - DNA, 20 bp, Artificial Sequence
  chemically synthesized
ggataatgatgcagttgagc

SEQ ID NO: 282881 - DNA, 20 bp, Artificial Sequence
  chemically synthesized
tggataatgatgcagttgag

SEQ ID NO: 282882 - DNA, 20 bp, Artificial Sequence
  chemically synthesized
tattggataatgatgcagtt

SEQ ID NO: 282883 - DNA, 20 bp, Artificial Sequence
  chemically synthesized
ctgagtattggataatgatg

SEQ ID NO: 282884 - DNA, 20 bp, Artificial Sequence
  chemically synthesized
ctgcatcattatccaatact

SEQ ID NO: 282885 - DNA, 20 bp, Artificial Sequence
  chemically synthesized
tgcatcattatccaatactc

SEQ ID NO: 282886 - DNA, 20 bp, Artificial Sequence
  chemically synthesized
gcatcattatccaatactca

SEQ ID NO: 282887 - DNA, 20 bp, Artificial Sequence
  chemically synthesized
ctttattttgccctgagtat

SEQ ID NO: 282888 - DNA, 20 bp, Artificial Sequence
  chemically synthesized
aaatgcctttattttgccct

SEQ ID NO: 282889 - DNA, 20 bp, Artificial Sequence
  chemically synthesized
ccaatactcagggcaaaata

SEQ ID NO: 282890 - DNA, 20 bp, Artificial Sequence
  chemically synthesized
caatactcagggcaaaataa

SEQ ID NO: 282891 - DNA, 20 bp, Artificial Sequence
  chemically synthesized
gtgtgagtagcaaatgtgtt

SEQ ID NO: 282892 - DNA, 20 bp, Artificial Sequence
  chemically synthesized
gctctttccttgagtgtgag

SEQ ID NO: 282893 - DNA, 20 bp, Artificial Sequence
  chemically synthesized
cacatttgctactcacactc

SEQ ID NO: 282894 - DNA, 20 bp, Artificial Sequence
  chemically synthesized
acatttgctactcacactca

SEQ ID NO: 282895 - DNA, 20 bp, Artificial Sequence
  chemically synthesized
cttgctctttccttgagtgt

SEQ ID NO: 282896 - DNA, 20 bp, Artificial Sequence
  chemically synthesized
ttgctactcacactcaagga

SEQ ID NO: 282897 - DNA, 20 bp, Artificial Sequence
  chemically synthesized
gctactcacactcaaggaaa

SEQ ID NO: 282898 - DNA, 20 bp, Artificial Sequence
  chemically synthesized
ttctttcttgctctttcctt

SEQ ID NO: 282899 - DNA, 20 bp, Artificial Sequence
  chemically synthesized
ctcacactcaaggaaagagc

SEQ ID NO: 282900 - DNA, 20 bp, Artificial Sequence
  chemically synthesized
cactcaaggaaagagcaaga

SEQ ID NO: 282901 - DNA, 20 bp, Artificial Sequence
  chemically synthesized
agcaagaaagaaactgaaca

SEQ ID NO: 282902 - DNA, 20 bp, Artificial Sequence
  chemically synthesized
aagaaagaaactgaacacag

SEQ ID NO: 282903 - DNA, 20 bp, Artificial Sequence
  chemically synthesized
cttccctttgcttctgtgtt

SEQ ID NO: 282904 - DNA, 20 bp, Artificial Sequence
  chemically synthesized
agaaactgaacacagaagca

SEQ ID NO: 282905 - DNA, 20 bp, Artificial Sequence
  chemically synthesized
gaaactgaacacagaagcaa

SEQ ID NO: 282906 - DNA, 20 bp, Artificial Sequence
  chemically synthesized
aaactgaacacagaagcaaa

SEQ ID NO: 282907 - DNA, 20 bp, Artificial Sequence
  chemically synthesized
ctgaacacagaagcaaaggg

SEQ ID NO: 282908 - DNA, 20 bp, Artificial Sequence
  chemically synthesized
agaagcaaagggaagaacaa

SEQ ID NO: 282909 - DNA, 20 bp, Artificial Sequence
  chemically synthesized
gaagcaaagggaagaacaaa

SEQ ID NO: 282910 - DNA, 20 bp, Artificial Sequence
  chemically synthesized
attttcccagtttttgtgat

SEQ ID NO: 282911 - DNA, 20 bp, Artificial Sequence
  chemically synthesized
gcaaaactgatcacaaaaac

SEQ ID NO: 282912 - DNA, 20 bp, Artificial Sequence
  chemically synthesized
caaaactgatcacaaaaact

SEQ ID NO: 282913 - DNA, 20 bp, Artificial Sequence
  chemically synthesized
gatcacaaaaactgggaaaa

SEQ ID NO: 282914 - DNA, 20 bp, Artificial Sequence
  chemically synthesized
atttaccgatgctattttcc

SEQ ID NO: 282915 - DNA, 20 bp, Artificial Sequence
  chemically synthesized
aaaaactgggaaaatagcat

SEQ ID NO: 282916 - DNA, 20 bp, Artificial Sequence
  chemically synthesized
tatttcatataatatttatt

SEQ ID NO: 282917 - DNA, 20 bp, Artificial Sequence
  chemically synthesized
taaataaatattatatgaaa

SEQ ID NO: 282918 - DNA, 20 bp, Artificial Sequence
  chemically synthesized
atatgaaatagttaaaacaa

SEQ ID NO: 282919 - DNA, 20 bp, Artificial Sequence
  chemically synthesized
tgaaatagttaaaacaacag

SEQ ID NO: 282920 - DNA, 20 bp, Artificial Sequence
  chemically synthesized
aatagttaaaacaacagcag

SEQ ID NO: 282921 - DNA, 20 bp, Artificial Sequence
  chemically synthesized
taaaacaacagcagcagcaa

SEQ ID NO: 282922 - DNA, 20 bp, Artificial Sequence
  chemically synthesized
cagcagcaacagcaattata

SEQ ID NO: 282923 - DNA, 20 bp, Artificial Sequence
  chemically synthesized
agcaattatatggactaatt

SEQ ID NO: 282924 - DNA, 20 bp, Artificial Sequence
  chemically synthesized
gcaattatatggactaattt

SEQ ID NO: 282925 - DNA, 20 bp, Artificial Sequence
  chemically synthesized
caattatatggactaatttg

SEQ ID NO: 282926 - DNA, 20 bp, Artificial Sequence
  chemically synthesized
aattatatggactaatttgg

SEQ ID NO: 282927 - DNA, 20 bp, Artificial Sequence
  chemically synthesized
tcaccttatttcccccaaat

SEQ ID NO: 282928 - DNA, 20 bp, Artificial Sequence
  chemically synthesized
tggactaatttgggggaaat

SEQ ID NO: 282929 - DNA, 20 bp, Artificial Sequence
  chemically synthesized
ggactaatttgggggaaata

SEQ ID NO: 282930 - DNA, 20 bp, Artificial Sequence
  chemically synthesized
ataaggtgaaaatgaaatat

SEQ ID NO: 282931 - DNA, 20 bp, Artificial Sequence
  chemically synthesized
taaggtgaaaatgaaatatg

SEQ ID NO: 282932 - DNA, 20 bp, Artificial Sequence
  chemically synthesized
aatatgaggcaacaataacg

SEQ ID NO: 282933 - DNA, 20 bp, Artificial Sequence
  chemically synthesized
ggcaacaataacgcggaaaa

SEQ ID NO: 282934 - DNA, 20 bp, Artificial Sequence
  chemically synthesized
aacaataacgcggaaaacgg

SEQ ID NO: 282935 - DNA, 20 bp, Artificial Sequence
  chemically synthesized
caataacgcggaaaacggaa

SEQ ID NO: 282936 - DNA, 20 bp, Artificial Sequence
  chemically synthesized
aataacgcggaaaacggaag

SEQ ID NO: 282937 - DNA, 20 bp, Artificial Sequence
  chemically synthesized
aacgcggaaaacggaagagg

SEQ ID NO: 282938 - DNA, 20 bp, Artificial Sequence
  chemically synthesized
acgcggaaaacggaagaggt

SEQ ID NO: 282939 - DNA, 20 bp, Artificial Sequence
  chemically synthesized
gaaaacggaagaggtaggtt

SEQ ID NO: 282940 - DNA, 20 bp, Artificial Sequence
  chemically synthesized
aaacggaagaggtaggttca

SEQ ID NO: 282941 - DNA, 20 bp, Artificial Sequence
  chemically synthesized
atatggtggaaacattagca

SEQ ID NO: 282942 - DNA, 20 bp, Artificial Sequence
  chemically synthesized
caataatatggtggaaacat

SEQ ID NO: 282943 - DNA, 20 bp, Artificial Sequence
  chemically synthesized
cctctctaacaataatatgg

SEQ ID NO: 282944 - DNA, 20 bp, Artificial Sequence
  chemically synthesized
atacctctctaacaataata

SEQ ID NO: 282945 - DNA, 20 bp, Artificial Sequence
  chemically synthesized
tgtttccaccatattattgt

SEQ ID NO: 282946 - DNA, 20 bp, Artificial Sequence
  chemically synthesized
tttccaccatattattgtta

SEQ ID NO: 282947 - DNA, 20 bp, Artificial Sequence
  chemically synthesized
tccaccatattattgttaga

SEQ ID NO: 282948 - DNA, 20 bp, Artificial Sequence
  chemically synthesized
ccaccatattattgttagag

SEQ ID NO: 282949 - DNA, 20 bp, Artificial Sequence
  chemically synthesized
atattattgttagagaggta

SEQ ID NO: 282950 - DNA, 20 bp, Artificial Sequence
  chemically synthesized
attattgttagagaggtata

SEQ ID NO: 282951 - DNA, 20 bp, Artificial Sequence
  chemically synthesized
aggtatagagaaatatttat

SEQ ID NO: 282952 - DNA, 20 bp, Artificial Sequence
  chemically synthesized
aatatttataagataaaata

SEQ ID NO: 282953 - DNA, 20 bp, Artificial Sequence
  chemically synthesized
ataaagtacatattccaaac

SEQ ID NO: 282954 - DNA, 20 bp, Artificial Sequence
  chemically synthesized
ttagtcctttttcactggtt

SEQ ID NO: 282955 - DNA, 20 bp, Artificial Sequence
  chemically synthesized
catattccaaaccagtgaaa

SEQ ID NO: 282956 - DNA, 20 bp, Artificial Sequence
  chemically synthesized
atattccaaaccagtgaaaa

SEQ ID NO: 282957 - DNA, 20 bp, Artificial Sequence
  chemically synthesized
ccattttagtcctttttcac

SEQ ID NO: 282958 - DNA, 20 bp, Artificial Sequence
  chemically synthesized
ccagtgaaaaaggactaaaa

SEQ ID NO: 282959 - DNA, 20 bp, Artificial Sequence
  chemically synthesized
caaattattgagttccattt

SEQ ID NO: 282960 - DNA, 20 bp, Artificial Sequence
  chemically synthesized
attgaagttatcaaattatt

SEQ ID NO: 282961 - DNA, 20 bp, Artificial Sequence
  chemically synthesized
aacattccctattcatattg

SEQ ID NO: 282962 - DNA, 20 bp, Artificial Sequence
  chemically synthesized
tttgataacttcaatatgaa

SEQ ID NO: 282963 - DNA, 20 bp, Artificial Sequence
  chemically synthesized
ttgataacttcaatatgaat

SEQ ID NO: 282964 - DNA, 20 bp, Artificial Sequence
  chemically synthesized
tgataacttcaatatgaata

SEQ ID NO: 282965 - DNA, 20 bp, Artificial Sequence
  chemically synthesized
tcaatatgaatagggaatgt

SEQ ID NO: 282966 - DNA, 20 bp, Artificial Sequence
  chemically synthesized
ttagaaatgttattatacat

SEQ ID NO: 282967 - DNA, 20 bp, Artificial Sequence
  chemically synthesized
gaaatgttattatacatgag

SEQ ID NO: 282968 - DNA, 20 bp, Artificial Sequence
  chemically synthesized
aaatgttattatacatgaga

SEQ ID NO: 282969 - DNA, 20 bp, Artificial Sequence
  chemically synthesized
tattatacatgagaaggaaa

SEQ ID NO: 282970 - DNA, 20 bp, Artificial Sequence
  chemically synthesized
tggaaaaataatccaataat

SEQ ID NO: 282971 - DNA, 20 bp, Artificial Sequence
  chemically synthesized
aacttttcaagaccaattat

SEQ ID NO: 282972 - DNA, 20 bp, Artificial Sequence
  chemically synthesized
atccaataattggtcttgaa

SEQ ID NO: 282973 - DNA, 20 bp, Artificial Sequence
  chemically synthesized
gtattaataacaaacttttc

SEQ ID NO: 282974 - DNA, 20 bp, Artificial Sequence
  chemically synthesized
tgttattaatacgaaaactt

SEQ ID NO: 282975 - DNA, 20 bp, Artificial Sequence
  chemically synthesized
ttttccgaagggattttctt

SEQ ID NO: 282976 - DNA, 20 bp, Artificial Sequence
  chemically synthesized
aaaacttaagaaaatccctt

SEQ ID NO: 282977 - DNA, 20 bp, Artificial Sequence
  chemically synthesized
attggagtacattttccgaa

SEQ ID NO: 282978 - DNA, 20 bp, Artificial Sequence
  chemically synthesized
tattggagtacattttccga

SEQ ID NO: 282979 - DNA, 20 bp, Artificial Sequence
  chemically synthesized
atattggagtacattttccg

SEQ ID NO: 282980 - DNA, 20 bp, Artificial Sequence
  chemically synthesized
ttcattagaaatttatattg

SEQ ID NO: 282981 - DNA, 20 bp, Artificial Sequence
  chemically synthesized
gattcattagaaatttatat

SEQ ID NO: 282982 - DNA, 20 bp, Artificial Sequence
  chemically synthesized
aatgatactccgtgattcat

SEQ ID NO: 282983 - DNA, 20 bp, Artificial Sequence
  chemically synthesized
tataaatttctaatgaatca

SEQ ID NO: 282984 - DNA, 20 bp, Artificial Sequence
  chemically synthesized
taaatttctaatgaatcacg

SEQ ID NO: 282985 - DNA, 20 bp, Artificial Sequence
  chemically synthesized
taaatgaacaacatgaataa

SEQ ID NO: 282986 - DNA, 20 bp, Artificial Sequence
  chemically synthesized
aaatgaacaacatgaataat

SEQ ID NO: 282987 - DNA, 20 bp, Artificial Sequence
  chemically synthesized
aatgaacaacatgaataata

SEQ ID NO: 282988 - DNA, 20 bp, Artificial Sequence
  chemically synthesized
gggaacaatgatgcttattt

SEQ ID NO: 282989 - DNA, 20 bp, Artificial Sequence
  chemically synthesized
ggaacaatgatgcttattta

SEQ ID NO: 282990 - DNA, 20 bp, Artificial Sequence
  chemically synthesized
tgttcttaatgtccttaaat

SEQ ID NO: 282991 - DNA, 20 bp, Artificial Sequence
  chemically synthesized
gatgcttatttaaggacatt

SEQ ID NO: 282992 - DNA, 20 bp, Artificial Sequence
  chemically synthesized
tttaaggacattaagaacat

SEQ ID NO: 282993 - DNA, 20 bp, Artificial Sequence
  chemically synthesized
aggacattaagaacataaga

SEQ ID NO: 282994 - DNA, 20 bp, Artificial Sequence
  chemically synthesized
ttaagaacataagaaagtaa

SEQ ID NO: 282995 - DNA, 20 bp, Artificial Sequence
  chemically synthesized
agaacataagaaagtaatag

SEQ ID NO: 282996 - DNA, 20 bp, Artificial Sequence
  chemically synthesized
gaacataagaaagtaatagt

SEQ ID NO: 282997 - DNA, 20 bp, Artificial Sequence
  chemically synthesized
gtgttttatttaaacattgt

SEQ ID NO: 282998 - DNA, 20 bp, Artificial Sequence
  chemically synthesized
tttatttaaacattgtcaga

SEQ ID NO: 282999 - DNA, 20 bp, Artificial Sequence
  chemically synthesized
cattgtcagaaagcatttcc

SEQ ID NO: 283000 - DNA, 20 bp, Artificial Sequence
  chemically synthesized
attgtcagaaagcatttcct

SEQ ID NO: 283001 - DNA, 20 bp, Artificial Sequence
  chemically synthesized
gggagggactttttgtaccc

SEQ ID NO: 283002 - DNA, 20 bp, Artificial Sequence
  chemically synthesized
agggagggactttttgtacc

SEQ ID NO: 283003 - DNA, 20 bp, Artificial Sequence
  chemically synthesized
aagcatttcctgggtacaaa

SEQ ID NO: 283004 - DNA, 20 bp, Artificial Sequence
  chemically synthesized
ctaacatgttacaataggga

SEQ ID NO: 283005 - DNA, 20 bp, Artificial Sequence
  chemically synthesized
actaacatgttacaataggg

SEQ ID NO: 283006 - DNA, 20 bp, Artificial Sequence
  chemically synthesized
cactaacatgttacaatagg

SEQ ID NO: 283007 - DNA, 20 bp, Artificial Sequence
  chemically synthesized
ttcactaacatgttacaata

SEQ ID NO: 283008 - DNA, 20 bp, Artificial Sequence
  chemically synthesized
attcactaacatgttacaat

SEQ ID NO: 283009 - DNA, 20 bp, Artificial Sequence
  chemically synthesized
aattcactaacatgttacaa

SEQ ID NO: 283010 - DNA, 20 bp, Artificial Sequence
  chemically synthesized
ccctccctattgtaacatgt

SEQ ID NO: 283011 - DNA, 20 bp, Artificial Sequence
  chemically synthesized
acatgttagtgaattaattg

SEQ ID NO: 283012 - DNA, 20 bp, Artificial Sequence
  chemically synthesized
gaattaattgtggttttctt

SEQ ID NO: 283013 - DNA, 20 bp, Artificial Sequence
  chemically synthesized
gatggcactgtacatgtctc

SEQ ID NO: 283014 - DNA, 20 bp, Artificial Sequence
  chemically synthesized
tggttttcttgagacatgta

SEQ ID NO: 283015 - DNA, 20 bp, Artificial Sequence
  chemically synthesized
tgagacatgtacagtgccat

SEQ ID NO: 283016 - DNA, 20 bp, Artificial Sequence
  chemically synthesized
tgggaagggaagggatctga

SEQ ID NO: 283017 - DNA, 20 bp, Artificial Sequence
  chemically synthesized
aacaaagaatgggaagggaa

SEQ ID NO: 283018 - DNA, 20 bp, Artificial Sequence
  chemically synthesized
taacaaagaatgggaaggga

SEQ ID NO: 283019 - DNA, 20 bp, Artificial Sequence
  chemically synthesized
ataacaaagaatgggaaggg

SEQ ID NO: 283020 - DNA, 20 bp, Artificial Sequence
  chemically synthesized
aatataacaaagaatgggaa

SEQ ID NO: 283021 - DNA, 20 bp, Artificial Sequence
  chemically synthesized
aaatataacaaagaatggga

SEQ ID NO: 283022 - DNA, 20 bp, Artificial Sequence
  chemically synthesized
aaaatataacaaagaatggg

SEQ ID NO: 283023 - DNA, 20 bp, Artificial Sequence
  chemically synthesized
tataaaatataacaaagaat

SEQ ID NO: 283024 - DNA, 20 bp, Artificial Sequence
  chemically synthesized
atataaaatataacaaagaa

SEQ ID NO: 283025 - DNA, 20 bp, Artificial Sequence
  chemically synthesized
gtgctatataaaatataaca

SEQ ID NO: 283026 - DNA, 20 bp, Artificial Sequence
  chemically synthesized
attctttgttatattttata

SEQ ID NO: 283027 - DNA, 20 bp, Artificial Sequence
  chemically synthesized
cttatgtatcagtgttatgt

SEQ ID NO: 283028 - DNA, 20 bp, Artificial Sequence
  chemically synthesized
ctcacataacactgatacat

SEQ ID NO: 283029 - DNA, 20 bp, Artificial Sequence
  chemically synthesized
taatgacgtatcttatgtat

SEQ ID NO: 283030 - DNA, 20 bp, Artificial Sequence
  chemically synthesized
aagatacgtcattatatcct

SEQ ID NO: 283031 - DNA, 20 bp, Artificial Sequence
  chemically synthesized
aggaaatattacagtttctg

SEQ ID NO: 283032 - DNA, 20 bp, Artificial Sequence
  chemically synthesized
caggaaatattacagtttct

SEQ ID NO: 283033 - DNA, 20 bp, Artificial Sequence
  chemically synthesized
ctatatgtcaggaaatatta

SEQ ID NO: 283034 - DNA, 20 bp, Artificial Sequence
  chemically synthesized
ctgtaatatttcctgacata

SEQ ID NO: 283035 - DNA, 20 bp, Artificial Sequence
  chemically synthesized
aaaagtgccttctatatgtc

SEQ ID NO: 283036 - DNA, 20 bp, Artificial Sequence
  chemically synthesized
gaaaagtgccttctatatgt

SEQ ID NO: 283037 - DNA, 20 bp, Artificial Sequence
  chemically synthesized
taatatttcctgacatatag

SEQ ID NO: 283038 - DNA, 20 bp, Artificial Sequence
  chemically synthesized
aatatttcctgacatataga

SEQ ID NO: 283039 - DNA, 20 bp, Artificial Sequence
  chemically synthesized
acatatagaaggcacttttc

SEQ ID NO: 283040 - DNA, 20 bp, Artificial Sequence
  chemically synthesized
atatagaaggcacttttcaa

SEQ ID NO: 283041 - DNA, 20 bp, Artificial Sequence
  chemically synthesized
tcactcctcagactcttgaa

SEQ ID NO: 283042 - DNA, 20 bp, Artificial Sequence
  chemically synthesized
aaggcacttttcaagagtct

SEQ ID NO: 283043 - DNA, 20 bp, Artificial Sequence
  chemically synthesized
aggcacttttcaagagtctg

SEQ ID NO: 283044 - DNA, 20 bp, Artificial Sequence
  chemically synthesized
gcacttttcaagagtctgag

SEQ ID NO: 283045 - DNA, 20 bp, Artificial Sequence
  chemically synthesized
tttaaatgcaattcactcct

SEQ ID NO: 283046 - DNA, 20 bp, Artificial Sequence
  chemically synthesized
gaggagtgaattgcatttaa

SEQ ID NO: 283047 - DNA, 20 bp, Artificial Sequence
  chemically synthesized
gtgaattgcatttaaaagaa

SEQ ID NO: 283048 - DNA, 20 bp, Artificial Sequence
  chemically synthesized
tgcatttaaaagaaaagaat

SEQ ID NO: 283049 - DNA, 20 bp, Artificial Sequence
  chemically synthesized
gcatttaaaagaaaagaata

SEQ ID NO: 283050 - DNA, 20 bp, Artificial Sequence
  chemically synthesized
taaaagaaaagaataaggat

SEQ ID NO: 283051 - DNA, 20 bp, Artificial Sequence
  chemically synthesized
gaaaagaataaggatgagta

SEQ ID NO: 283052 - DNA, 20 bp, Artificial Sequence
  chemically synthesized
aagaataaggatgagtaaag

SEQ ID NO: 283053 - DNA, 20 bp, Artificial Sequence
  chemically synthesized
gaataaggatgagtaaagaa

SEQ ID NO: 283054 - DNA, 20 bp, Artificial Sequence
  chemically synthesized
aggatgagtaaagaagagct

SEQ ID NO: 283055 - DNA, 20 bp, Artificial Sequence
  chemically synthesized
gtttctccattatcagttct

SEQ ID NO: 283056 - DNA, 20 bp, Artificial Sequence
  chemically synthesized
gaagagcttagaactgataa

SEQ ID NO: 283057 - DNA, 20 bp, Artificial Sequence
  chemically synthesized
agagcttagaactgataatg

SEQ ID NO: 283058 - DNA, 20 bp, Artificial Sequence
  chemically synthesized
gatccgagtttctccattat

SEQ ID NO: 283059 - DNA, 20 bp, Artificial Sequence
  chemically synthesized
gaactgataatggagaaact

SEQ ID NO: 283060 - DNA, 20 bp, Artificial Sequence
  chemically synthesized
ccaattgtaaaatgtgatcc

SEQ ID NO: 283061 - DNA, 20 bp, Artificial Sequence
  chemically synthesized
ctcggatcacattttacaat

SEQ ID NO: 283062 - DNA, 20 bp, Artificial Sequence
  chemically synthesized
ggaaaatgataatactgtat

SEQ ID NO: 283063 - DNA, 20 bp, Artificial Sequence
  chemically synthesized
gaaaatgataatactgtatt

SEQ ID NO: 283064 - DNA, 20 bp, Artificial Sequence
  chemically synthesized
taccccatatattcccaata

SEQ ID NO: 283065 - DNA, 20 bp, Artificial Sequence
  chemically synthesized
aatactgtattgggaatata

SEQ ID NO: 283066 - DNA, 20 bp, Artificial Sequence
  chemically synthesized
atactgtattgggaatatat

SEQ ID NO: 283067 - DNA, 20 bp, Artificial Sequence
  chemically synthesized
tactgtattgggaatatatg

SEQ ID NO: 283068 - DNA, 20 bp, Artificial Sequence
  chemically synthesized
tgggaatatatggggtactt

SEQ ID NO: 283069 - DNA, 20 bp, Artificial Sequence
  chemically synthesized
ttaaaatgtatttgtagcta

SEQ ID NO: 283070 - DNA, 20 bp, Artificial Sequence
  chemically synthesized
aatattttaaaatgtatttg

SEQ ID NO: 283071 - DNA, 20 bp, Artificial Sequence
  chemically synthesized
tacattttaaaatattttta

SEQ ID NO: 283072 - DNA, 20 bp, Artificial Sequence
  chemically synthesized
acattttaaaatatttttaa

SEQ ID NO: 283073 - DNA, 20 bp, Artificial Sequence
  chemically synthesized
tacgattcagatcaataata

SEQ ID NO: 283074 - DNA, 20 bp, Artificial Sequence
  chemically synthesized
atttaaagaaagatacgatt

SEQ ID NO: 283075 - DNA, 20 bp, Artificial Sequence
  chemically synthesized
gagggtttgatatttaaaga

SEQ ID NO: 283076 - DNA, 20 bp, Artificial Sequence
  chemically synthesized
tgttgagggtttgatattta

SEQ ID NO: 283077 - DNA, 20 bp, Artificial Sequence
  chemically synthesized
taaatatcaaaccctcaaca

SEQ ID NO: 283078 - DNA, 20 bp, Artificial Sequence
  chemically synthesized
aaatatcaaaccctcaacat

SEQ ID NO: 283079 - DNA, 20 bp, Artificial Sequence
  chemically synthesized
tagtttgcttcctatgttga

SEQ ID NO: 283080 - DNA, 20 bp, Artificial Sequence
  chemically synthesized
ttagtttgcttcctatgttg

SEQ ID NO: 283081 - DNA, 20 bp, Artificial Sequence
  chemically synthesized
tttagtttgcttcctatgtt

SEQ ID NO: 283082 - DNA, 20 bp, Artificial Sequence
  chemically synthesized
tatcaaaccctcaacatagg

SEQ ID NO: 283083 - DNA, 20 bp, Artificial Sequence
  chemically synthesized
tacttttgaaaaacattatt

SEQ ID NO: 283084 - DNA, 20 bp, Artificial Sequence
  chemically synthesized
aactaaataatgtttttcaa

SEQ ID NO: 283085 - DNA, 20 bp, Artificial Sequence
  chemically synthesized
aataatgtttttcaaaagta

SEQ ID NO: 283086 - DNA, 20 bp, Artificial Sequence
  chemically synthesized
taatgtttttcaaaagtaaa

SEQ ID NO: 283087 - DNA, 20 bp, Artificial Sequence
  chemically synthesized
aatgtttttcaaaagtaaag

SEQ ID NO: 283088 - DNA, 20 bp, Artificial Sequence
  chemically synthesized
atatggttaataaagtgttc

SEQ ID NO: 283089 - DNA, 20 bp, Artificial Sequence
  chemically synthesized
aatatggttaataaagtgtt

SEQ ID NO: 283090 - DNA, 20 bp, Artificial Sequence
  chemically synthesized
tttggtgaatatggttaata

SEQ ID NO: 283091 - DNA, 20 bp, Artificial Sequence
  chemically synthesized
ctgagttattttggtgaata

SEQ ID NO: 283092 - DNA, 20 bp, Artificial Sequence
  chemically synthesized
tcacacagactgagttattt

SEQ ID NO: 283093 - DNA, 20 bp, Artificial Sequence
  chemically synthesized
ccatattcaccaaaataact

SEQ ID NO: 283094 - DNA, 20 bp, Artificial Sequence
  chemically synthesized
ccccttccctcacacagact

SEQ ID NO: 283095 - DNA, 20 bp, Artificial Sequence
  chemically synthesized
caaaataactcagtctgtgt

SEQ ID NO: 283096 - DNA, 20 bp, Artificial Sequence
  chemically synthesized
aaaataactcagtctgtgtg

SEQ ID NO: 283097 - DNA, 20 bp, Artificial Sequence
  chemically synthesized
aaataactcagtctgtgtga

SEQ ID NO: 283098 - DNA, 20 bp, Artificial Sequence
  chemically synthesized
ttaagcccccttccctcaca

SEQ ID NO: 283099 - DNA, 20 bp, Artificial Sequence
  chemically synthesized
taactcagtctgtgtgaggg

SEQ ID NO: 283100 - DNA, 20 bp, Artificial Sequence
  chemically synthesized
aactcagtctgtgtgaggga

SEQ ID NO: 283101 - DNA, 20 bp, Artificial Sequence
  chemically synthesized
actcagtctgtgtgagggaa

SEQ ID NO: 283102 - DNA, 20 bp, Artificial Sequence
  chemically synthesized
ctcagtctgtgtgagggaag

SEQ ID NO: 283103 - DNA, 20 bp, Artificial Sequence
  chemically synthesized
tcagtctgtgtgagggaagg

SEQ ID NO: 283104 - DNA, 20 bp, Artificial Sequence
  chemically synthesized
gtgtgagggaagggggctta

SEQ ID NO: 283105 - DNA, 20 bp, Artificial Sequence
  chemically synthesized
ttgcacatgagttggacttt

SEQ ID NO: 283106 - DNA, 20 bp, Artificial Sequence
  chemically synthesized
gccagacattgcacatgagt

SEQ ID NO: 283107 - DNA, 20 bp, Artificial Sequence
  chemically synthesized
tgctgccagacattgcacat

SEQ ID NO: 283108 - DNA, 20 bp, Artificial Sequence
  chemically synthesized
tccaactcatgtgcaatgtc

SEQ ID NO: 283109 - DNA, 20 bp, Artificial Sequence
  chemically synthesized
aactcatgtgcaatgtctgg

SEQ ID NO: 283110 - DNA, 20 bp, Artificial Sequence
  chemically synthesized
tgtgcaatgtctggcagcat

SEQ ID NO: 283111 - DNA, 20 bp, Artificial Sequence
  chemically synthesized
actacaaatgctgatgctgc

SEQ ID NO: 283112 - DNA, 20 bp, Artificial Sequence
  chemically synthesized
tctggcagcatcagcatttg

SEQ ID NO: 283113 - DNA, 20 bp, Artificial Sequence
  chemically synthesized
ggcagcatcagcatttgtag

SEQ ID NO: 283114 - DNA, 20 bp, Artificial Sequence
  chemically synthesized
atcagcatttgtagtggata

SEQ ID NO: 283115 - DNA, 20 bp, Artificial Sequence
  chemically synthesized
ggataaagttttgtgcccct

SEQ ID NO: 283116 - DNA, 20 bp, Artificial Sequence
  chemically synthesized
aagttttgtgccccttggca

SEQ ID NO: 283117 - DNA, 20 bp, Artificial Sequence
  chemically synthesized
tatgaaaatactgtgccaag

SEQ ID NO: 283118 - DNA, 20 bp, Artificial Sequence
  chemically synthesized
ttatgaaaatactgtgccaa

SEQ ID NO: 283119 - DNA, 20 bp, Artificial Sequence
  chemically synthesized
cttatgaaaatactgtgcca

SEQ ID NO: 283120 - DNA, 20 bp, Artificial Sequence
  chemically synthesized
tcttatgaaaatactgtgcc

SEQ ID NO: 283121 - DNA, 20 bp, Artificial Sequence
  chemically synthesized
ccttggcacagtattttcat

SEQ ID NO: 283122 - DNA, 20 bp, Artificial Sequence
  chemically synthesized
ggcacagtattttcataaga

SEQ ID NO: 283123 - DNA, 20 bp, Artificial Sequence
  chemically synthesized
gcacagtattttcataagaa

SEQ ID NO: 283124 - DNA, 20 bp, Artificial Sequence
  chemically synthesized
tattttcataagaaaggtca

SEQ ID NO: 283125 - DNA, 20 bp, Artificial Sequence
  chemically synthesized
catgtaattgcatcaaaaat

SEQ ID NO: 283126 - DNA, 20 bp, Artificial Sequence
  chemically synthesized
ttatttttgatgcaattaca

SEQ ID NO: 283127 - DNA, 20 bp, Artificial Sequence
  chemically synthesized
caattacatggccatcattt

SEQ ID NO: 283128 - DNA, 20 bp, Artificial Sequence
  chemically synthesized
aattacatggccatcatttg

SEQ ID NO: 283129 - DNA, 20 bp, Artificial Sequence
  chemically synthesized
aaagcaggtgcctcaaatga

SEQ ID NO: 283130 - DNA, 20 bp, Artificial Sequence
  chemically synthesized
tgaatttagataaagaaagc

SEQ ID NO: 283131 - DNA, 20 bp, Artificial Sequence
  chemically synthesized
ctgaatttagataaagaaag

SEQ ID NO: 283132 - DNA, 20 bp, Artificial Sequence
  chemically synthesized
tatctgaatttagataaaga

SEQ ID NO: 283133 - DNA, 20 bp, Artificial Sequence
  chemically synthesized
tgcttatctgaatttagata

SEQ ID NO: 283134 - DNA, 20 bp, Artificial Sequence
  chemically synthesized
ctgctttctttatctaaatt

SEQ ID NO: 283135 - DNA, 20 bp, Artificial Sequence
  chemically synthesized
agattatgcttatctgaatt

SEQ ID NO: 283136 - DNA, 20 bp, Artificial Sequence
  chemically synthesized
ttctttatctaaattcagat

SEQ ID NO: 283137 - DNA, 20 bp, Artificial Sequence
  chemically synthesized
aaattcagataagcataatc

SEQ ID NO: 283138 - DNA, 20 bp, Artificial Sequence
  chemically synthesized
tcagataagcataatctaga

SEQ ID NO: 283139 - DNA, 20 bp, Artificial Sequence
  chemically synthesized
ataagcataatctagacagt

SEQ ID NO: 283140 - DNA, 20 bp, Artificial Sequence
  chemically synthesized
taagcataatctagacagta

SEQ ID NO: 283141 - DNA, 20 bp, Artificial Sequence
  chemically synthesized
tatggatgggccttactgtc

SEQ ID NO: 283142 - DNA, 20 bp, Artificial Sequence
  chemically synthesized
ctgctttaacttttatggat

SEQ ID NO: 283143 - DNA, 20 bp, Artificial Sequence
  chemically synthesized
acagtaaggcccatccataa

SEQ ID NO: 283144 - DNA, 20 bp, Artificial Sequence
  chemically synthesized
tctgctttaacttttatgga

SEQ ID NO: 283145 - DNA, 20 bp, Artificial Sequence
  chemically synthesized
aacttctgctttaactttta

SEQ ID NO: 283146 - DNA, 20 bp, Artificial Sequence
  chemically synthesized
aggcccatccataaaagtta

SEQ ID NO: 283147 - DNA, 20 bp, Artificial Sequence
  chemically synthesized
cccatccataaaagttaaag

SEQ ID NO: 283148 - DNA, 20 bp, Artificial Sequence
  chemically synthesized
atccataaaagttaaagcag

SEQ ID NO: 283149 - DNA, 20 bp, Artificial Sequence
  chemically synthesized
accagctctatattttttga

SEQ ID NO: 283150 - DNA, 20 bp, Artificial Sequence
  chemically synthesized
atgcaaaccatcaaaaaata

SEQ ID NO: 283151 - DNA, 20 bp, Artificial Sequence
  chemically synthesized
gcaaaccatcaaaaaatata

SEQ ID NO: 283152 - DNA, 20 bp, Artificial Sequence
  chemically synthesized
accatcaaaaaatatagagc

SEQ ID NO: 283153 - DNA, 20 bp, Artificial Sequence
  chemically synthesized
tcaaaaaatatagagctggt

SEQ ID NO: 283154 - DNA, 20 bp, Artificial Sequence
  chemically synthesized
caaaaaatatagagctggtt

SEQ ID NO: 283155 - DNA, 20 bp, Artificial Sequence
  chemically synthesized
tgttagacatgttacctaac

SEQ ID NO: 283156 - DNA, 20 bp, Artificial Sequence
  chemically synthesized
gttaggtaacatgtctaaca

SEQ ID NO: 283157 - DNA, 20 bp, Artificial Sequence
  chemically synthesized
tgccccatagagttctttgt

SEQ ID NO: 283158 - DNA, 20 bp, Artificial Sequence
  chemically synthesized
atgtctaacaaagaactcta

SEQ ID NO: 283159 - DNA, 20 bp, Artificial Sequence
  chemically synthesized
tgtctaacaaagaactctat

SEQ ID NO: 283160 - DNA, 20 bp, Artificial Sequence
  chemically synthesized
gtctaacaaagaactctatg

SEQ ID NO: 283161 - DNA, 20 bp, Artificial Sequence
  chemically synthesized
agtaattgccgtgccccata

SEQ ID NO: 283162 - DNA, 20 bp, Artificial Sequence
  chemically synthesized
acaaagaactctatggggca

SEQ ID NO: 283163 - DNA, 20 bp, Artificial Sequence
  chemically synthesized
ttagtaattgccgtgcccca

SEQ ID NO: 283164 - DNA, 20 bp, Artificial Sequence
  chemically synthesized
atggggcacggcaattacta

SEQ ID NO: 283165 - DNA, 20 bp, Artificial Sequence
  chemically synthesized
gtttttactacaattgtctt

SEQ ID NO: 283166 - DNA, 20 bp, Artificial Sequence
  chemically synthesized
gcaattactaaagacaattg

SEQ ID NO: 283167 - DNA, 20 bp, Artificial Sequence
  chemically synthesized
agtaaaaacatacttctcta

SEQ ID NO: 283168 - DNA, 20 bp, Artificial Sequence
  chemically synthesized
gggaaaagcattctgtagag

SEQ ID NO: 283169 - DNA, 20 bp, Artificial Sequence
  chemically synthesized
ttggggaaaagcattctgta

SEQ ID NO: 283170 - DNA, 20 bp, Artificial Sequence
  chemically synthesized
ctttggggaaaagcattctg

SEQ ID NO: 283171 - DNA, 20 bp, Artificial Sequence
  chemically synthesized
ctacagaatgcttttcccca

SEQ ID NO: 283172 - DNA, 20 bp, Artificial Sequence
  chemically synthesized
atttaagtatctttggggaa

SEQ ID NO: 283173 - DNA, 20 bp, Artificial Sequence
  chemically synthesized
aacttatttaagtatctttg

SEQ ID NO: 283174 - DNA, 20 bp, Artificial Sequence
  chemically synthesized
aaacttatttaagtatcttt

SEQ ID NO: 283175 - DNA, 20 bp, Artificial Sequence
  chemically synthesized
taaacttatttaagtatctt

SEQ ID NO: 283176 - DNA, 20 bp, Artificial Sequence
  chemically synthesized
ttccccaaagatacttaaat

SEQ ID NO: 283177 - DNA, 20 bp, Artificial Sequence
  chemically synthesized
gtatgtacataaacttattt

SEQ ID NO: 283178 - DNA, 20 bp, Artificial Sequence
  chemically synthesized
gtttatgtacatacaaaaat

SEQ ID NO: 283179 - DNA, 20 bp, Artificial Sequence
  chemically synthesized
tacaaaaataagaaaaaata

SEQ ID NO: 283180 - DNA, 20 bp, Artificial Sequence
  chemically synthesized
aagatcattgtctataaatc

SEQ ID NO: 283181 - DNA, 20 bp, Artificial Sequence
  chemically synthesized
ataaattttctccagattta

SEQ ID NO: 283182 - DNA, 20 bp, Artificial Sequence
  chemically synthesized
gatcattgtctataaatctg

SEQ ID NO: 283183 - DNA, 20 bp, Artificial Sequence
  chemically synthesized
aaaatcctataaattttctc

SEQ ID NO: 283184 - DNA, 20 bp, Artificial Sequence
  chemically synthesized
ataaatctggagaaaattta

SEQ ID NO: 283185 - DNA, 20 bp, Artificial Sequence
  chemically synthesized
taaatctggagaaaatttat

SEQ ID NO: 283186 - DNA, 20 bp, Artificial Sequence
  chemically synthesized
aggattttatgacctaataa

SEQ ID NO: 283187 - DNA, 20 bp, Artificial Sequence
  chemically synthesized
taattctcattactattatt

SEQ ID NO: 283188 - DNA, 20 bp, Artificial Sequence
  chemically synthesized
ctaattctcattactattat

SEQ ID NO: 283189 - DNA, 20 bp, Artificial Sequence
  chemically synthesized
tatgacctaataatagtaat

SEQ ID NO: 283190 - DNA, 20 bp, Artificial Sequence
  chemically synthesized
ctaataatagtaatgagaat

SEQ ID NO: 283191 - DNA, 20 bp, Artificial Sequence
  chemically synthesized
ataatagtaatgagaattag

SEQ ID NO: 283192 - DNA, 20 bp, Artificial Sequence
  chemically synthesized
agtaatgagaattagaagca

SEQ ID NO: 283193 - DNA, 20 bp, Artificial Sequence
  chemically synthesized
tagtactcaatatatgtgag

SEQ ID NO: 283194 - DNA, 20 bp, Artificial Sequence
  chemically synthesized
gcctagtactcaatatatgt

SEQ ID NO: 283195 - DNA, 20 bp, Artificial Sequence
  chemically synthesized
catagctactcacatatatt

SEQ ID NO: 283196 - DNA, 20 bp, Artificial Sequence
  chemically synthesized
tactcacatatattgagtac

SEQ ID NO: 283197 - DNA, 20 bp, Artificial Sequence
  chemically synthesized
actcacatatattgagtact

SEQ ID NO: 283198 - DNA, 20 bp, Artificial Sequence
  chemically synthesized
catatattgagtactaggct

SEQ ID NO: 283199 - DNA, 20 bp, Artificial Sequence
  chemically synthesized
atattgagtactaggctaag

SEQ ID NO: 283200 - DNA, 20 bp, Artificial Sequence
  chemically synthesized
tctctttaaactacttagcc

SEQ ID NO: 283201 - DNA, 20 bp, Artificial Sequence
  chemically synthesized
gctattctctttaaactact

SEQ ID NO: 283202 - DNA, 20 bp, Artificial Sequence
  chemically synthesized
gtactaggctaagtagttta

SEQ ID NO: 283203 - DNA, 20 bp, Artificial Sequence
  chemically synthesized
actaggctaagtagtttaaa

SEQ ID NO: 283204 - DNA, 20 bp, Artificial Sequence
  chemically synthesized
gctaagtagtttaaagagaa

SEQ ID NO: 283205 - DNA, 20 bp, Artificial Sequence
  chemically synthesized
agttgttgagaaaattaaat

SEQ ID NO: 283206 - DNA, 20 bp, Artificial Sequence
  chemically synthesized
tacataattcataagttgtt

SEQ ID NO: 283207 - DNA, 20 bp, Artificial Sequence
  chemically synthesized
agacataatacataattcat

SEQ ID NO: 283208 - DNA, 20 bp, Artificial Sequence
  chemically synthesized
tatgaattatgtattatgtc

SEQ ID NO: 283209 - DNA, 20 bp, Artificial Sequence
  chemically synthesized
tatgtattatgtctagttga

SEQ ID NO: 283210 - DNA, 20 bp, Artificial Sequence
  chemically synthesized
cctgttttcaatctgtcaac

SEQ ID NO: 283211 - DNA, 20 bp, Artificial Sequence
  chemically synthesized
tctagttgacagattgaaaa

SEQ ID NO: 283212 - DNA, 20 bp, Artificial Sequence
  chemically synthesized
ctagttgacagattgaaaac

SEQ ID NO: 283213 - DNA, 20 bp, Artificial Sequence
  chemically synthesized
gattgaaaacaggtttacac

SEQ ID NO: 283214 - DNA, 20 bp, Artificial Sequence
  chemically synthesized
aaaacaggtttacacaagtt

SEQ ID NO: 283215 - DNA, 20 bp, Artificial Sequence
  chemically synthesized
gtttacacaagttaagcaaa

SEQ ID NO: 283216 - DNA, 20 bp, Artificial Sequence
  chemically synthesized
caagttaagcaaatggccca

SEQ ID NO: 283217 - DNA, 20 bp, Artificial Sequence
  chemically synthesized
cttataagttgtatgacttt

SEQ ID NO: 283218 - DNA, 20 bp, Artificial Sequence
  chemically synthesized
acttataagttgtatgactt

SEQ ID NO: 283219 - DNA, 20 bp, Artificial Sequence
  chemically synthesized
cccaaagtcatacaacttat

SEQ ID NO: 283220 - DNA, 20 bp, Artificial Sequence
  chemically synthesized
ttcctcattcaggcacttat

SEQ ID NO: 283221 - DNA, 20 bp, Artificial Sequence
  chemically synthesized
caacttataagtgcctgaat

SEQ ID NO: 283222 - DNA, 20 bp, Artificial Sequence
  chemically synthesized
aacttataagtgcctgaatg

SEQ ID NO: 283223 - DNA, 20 bp, Artificial Sequence
  chemically synthesized
ttggcttgaattcctcattc

SEQ ID NO: 283224 - DNA, 20 bp, Artificial Sequence
  chemically synthesized
tttggcttgaattcctcatt

SEQ ID NO: 283225 - DNA, 20 bp, Artificial Sequence
  chemically synthesized
agtgcctgaatgaggaattc

SEQ ID NO: 283226 - DNA, 20 bp, Artificial Sequence
  chemically synthesized
tgaatgaggaattcaagcca

SEQ ID NO: 283227 - DNA, 20 bp, Artificial Sequence
  chemically synthesized
ataccagtgcaaaacaactt

SEQ ID NO: 283228 - DNA, 20 bp, Artificial Sequence
  chemically synthesized
aagccaaagttgttttgcac

SEQ ID NO: 283229 - DNA, 20 bp, Artificial Sequence
  chemically synthesized
gtggttaagaacatggatac

SEQ ID NO: 283230 - DNA, 20 bp, Artificial Sequence
  chemically synthesized
aggcatagtggttaagaaca

SEQ ID NO: 283231 - DNA, 20 bp, Artificial Sequence
  chemically synthesized
atatgtgaggcatagtggtt

SEQ ID NO: 283232 - DNA, 20 bp, Artificial Sequence
  chemically synthesized
tggtcatatgtgaggcatag

SEQ ID NO: 283233 - DNA, 20 bp, Artificial Sequence
  chemically synthesized
acatggtcatatgtgaggca

SEQ ID NO: 283234 - DNA, 20 bp, Artificial Sequence
  chemically synthesized
tcaatacatggtcatatgtg

SEQ ID NO: 283235 - DNA, 20 bp, Artificial Sequence
  chemically synthesized
gtcaatacatggtcatatgt

SEQ ID NO: 283236 - DNA, 20 bp, Artificial Sequence
  chemically synthesized
gtcaatgatatgtcaataca

SEQ ID NO: 283237 - DNA, 20 bp, Artificial Sequence
  chemically synthesized
gtattgacatatcattgaca

SEQ ID NO: 283238 - DNA, 20 bp, Artificial Sequence
  chemically synthesized
acatatcattgacaaagacc

SEQ ID NO: 283239 - DNA, 20 bp, Artificial Sequence
  chemically synthesized
tcattgacaaagaccaagaa

SEQ ID NO: 283240 - DNA, 20 bp, Artificial Sequence
  chemically synthesized
tggaagtcagttgcttttct

SEQ ID NO: 283241 - DNA, 20 bp, Artificial Sequence
  chemically synthesized
agaaaagcaactgacttcca

SEQ ID NO: 283242 - DNA, 20 bp, Artificial Sequence
  chemically synthesized
aaatgcaagactttggaagt

SEQ ID NO: 283243 - DNA, 20 bp, Artificial Sequence
  chemically synthesized
tgggaaatgcaagactttgg

SEQ ID NO: 283244 - DNA, 20 bp, Artificial Sequence
  chemically synthesized
gaatgggaaatgcaagactt

SEQ ID NO: 283245 - DNA, 20 bp, Artificial Sequence
  chemically synthesized
ctaggctgaatgggaaatgc

SEQ ID NO: 283246 - DNA, 20 bp, Artificial Sequence
  chemically synthesized
aaagtcttgcatttcccatt

SEQ ID NO: 283247 - DNA, 20 bp, Artificial Sequence
  chemically synthesized
ggctctgcactaggctgaat

SEQ ID NO: 283248 - DNA, 20 bp, Artificial Sequence
  chemically synthesized
cttgcatttcccattcagcc

SEQ ID NO: 283249 - DNA, 20 bp, Artificial Sequence
  chemically synthesized
tggctctgcactaggctgaa

SEQ ID NO: 283250 - DNA, 20 bp, Artificial Sequence
  chemically synthesized
atttcccattcagcctagtg

SEQ ID NO: 283251 - DNA, 20 bp, Artificial Sequence
  chemically synthesized
ttcccattcagcctagtgca

SEQ ID NO: 283252 - DNA, 20 bp, Artificial Sequence
  chemically synthesized
actaccagtggctctgcact

SEQ ID NO: 283253 - DNA, 20 bp, Artificial Sequence
  chemically synthesized
aactaccagtggctctgcac

SEQ ID NO: 283254 - DNA, 20 bp, Artificial Sequence
  chemically synthesized
tcagcctagtgcagagccac

SEQ ID NO: 283255 - DNA, 20 bp, Artificial Sequence
  chemically synthesized
gcctagtgcagagccactgg

SEQ ID NO: 283256 - DNA, 20 bp, Artificial Sequence
  chemically synthesized
ctctaaccaccaactaccag

SEQ ID NO: 283257 - DNA, 20 bp, Artificial Sequence
  chemically synthesized
agtgcagagccactggtagt

SEQ ID NO: 283258 - DNA, 20 bp, Artificial Sequence
  chemically synthesized
aaactctaaccaccaactac

SEQ ID NO: 283259 - DNA, 20 bp, Artificial Sequence
  chemically synthesized
gcagagccactggtagttgg

SEQ ID NO: 283260 - DNA, 20 bp, Artificial Sequence
  chemically synthesized
agccactggtagttggtggt

SEQ ID NO: 283261 - DNA, 20 bp, Artificial Sequence
  chemically synthesized
ccactggtagttggtggtta

SEQ ID NO: 283262 - DNA, 20 bp, Artificial Sequence
  chemically synthesized
tagttggtggttagagtttc

SEQ ID NO: 283263 - DNA, 20 bp, Artificial Sequence
  chemically synthesized
gagtttcaagttcctttttt

SEQ ID NO: 283264 - DNA, 20 bp, Artificial Sequence
  chemically synthesized
agtttcaagttcctttttta

SEQ ID NO: 283265 - DNA, 20 bp, Artificial Sequence
  chemically synthesized
agcacaagaggccttaaaaa

SEQ ID NO: 283266 - DNA, 20 bp, Artificial Sequence
  chemically synthesized
tagcacaagaggccttaaaa

SEQ ID NO: 283267 - DNA, 20 bp, Artificial Sequence
  chemically synthesized
agctccacctgtagcacaag

SEQ ID NO: 283268 - DNA, 20 bp, Artificial Sequence
  chemically synthesized
aagctccacctgtagcacaa

SEQ ID NO: 283269 - DNA, 20 bp, Artificial Sequence
  chemically synthesized
ttttaaggcctcttgtgcta

SEQ ID NO: 283270 - DNA, 20 bp, Artificial Sequence
  chemically synthesized
tttaaggcctcttgtgctac

SEQ ID NO: 283271 - DNA, 20 bp, Artificial Sequence
  chemically synthesized
tcaagctccacctgtagcac

SEQ ID NO: 283272 - DNA, 20 bp, Artificial Sequence
  chemically synthesized
aaggcctcttgtgctacagg

SEQ ID NO: 283273 - DNA, 20 bp, Artificial Sequence
  chemically synthesized
ggcctcttgtgctacaggtg

SEQ ID NO: 283274 - DNA, 20 bp, Artificial Sequence
  chemically synthesized
catagctcaagctccacctg

SEQ ID NO: 283275 - DNA, 20 bp, Artificial Sequence
  chemically synthesized
ttgtgctacaggtggagctt

SEQ ID NO: 283276 - DNA, 20 bp, Artificial Sequence
  chemically synthesized
tgtaaatagtgtcatagctc

SEQ ID NO: 283277 - DNA, 20 bp, Artificial Sequence
  chemically synthesized
tgagtctgtaaatagtgtca

SEQ ID NO: 283278 - DNA, 20 bp, Artificial Sequence
  chemically synthesized
ttgagctatgacactattta

SEQ ID NO: 283279 - DNA, 20 bp, Artificial Sequence
  chemically synthesized
ctccttactgagtctgtaaa

SEQ ID NO: 283280 - DNA, 20 bp, Artificial Sequence
  chemically synthesized
tatgacactatttacagact

SEQ ID NO: 283281 - DNA, 20 bp, Artificial Sequence
  chemically synthesized
acactatttacagactcagt

SEQ ID NO: 283282 - DNA, 20 bp, Artificial Sequence
  chemically synthesized
cactatttacagactcagta

SEQ ID NO: 283283 - DNA, 20 bp, Artificial Sequence
  chemically synthesized
ctatttacagactcagtaag

SEQ ID NO: 283284 - DNA, 20 bp, Artificial Sequence
  chemically synthesized
cgaaagtgaaactccttact

SEQ ID NO: 283285 - DNA, 20 bp, Artificial Sequence
  chemically synthesized
ggcccaacaaaaagaagcga

SEQ ID NO: 283286 - DNA, 20 bp, Artificial Sequence
  chemically synthesized
agaagaggcccaacaaaaag

SEQ ID NO: 283287 - DNA, 20 bp, Artificial Sequence
  chemically synthesized
tcactttcgcttctttttgt

SEQ ID NO: 283288 - DNA, 20 bp, Artificial Sequence
  chemically synthesized
cactttcgcttctttttgtt

SEQ ID NO: 283289 - DNA, 20 bp, Artificial Sequence
  chemically synthesized
taaagaagaggcccaacaaa

SEQ ID NO: 283290 - DNA, 20 bp, Artificial Sequence
  chemically synthesized
tttttgttgggcctcttctt

SEQ ID NO: 283291 - DNA, 20 bp, Artificial Sequence
  chemically synthesized
ttttcagagagctaaagaag

SEQ ID NO: 283292 - DNA, 20 bp, Artificial Sequence
  chemically synthesized
tttttcagagagctaaagaa

SEQ ID NO: 283293 - DNA, 20 bp, Artificial Sequence
  chemically synthesized
tatttttcagagagctaaag

SEQ ID NO: 283294 - DNA, 20 bp, Artificial Sequence
  chemically synthesized
ctttatttttcagagagcta

SEQ ID NO: 283295 - DNA, 20 bp, Artificial Sequence
  chemically synthesized
agcattctttatttttcaga

SEQ ID NO: 283296 - DNA, 20 bp, Artificial Sequence
  chemically synthesized
agagcattctttatttttca

SEQ ID NO: 283297 - DNA, 20 bp, Artificial Sequence
  chemically synthesized
ctttagctctctgaaaaata

SEQ ID NO: 283298 - DNA, 20 bp, Artificial Sequence
  chemically synthesized
agagagcattctttattttt

SEQ ID NO: 283299 - DNA, 20 bp, Artificial Sequence
  chemically synthesized
aataaagaatgctctcttaa

SEQ ID NO: 283300 - DNA, 20 bp, Artificial Sequence
  chemically synthesized
ttattttcatgctattaaga

SEQ ID NO: 283301 - DNA, 20 bp, Artificial Sequence
  chemically synthesized
agttattttcatgctattaa

SEQ ID NO: 283302 - DNA, 20 bp, Artificial Sequence
  chemically synthesized
aaagttattttcatgctatt

SEQ ID NO: 283303 - DNA, 20 bp, Artificial Sequence
  chemically synthesized
agaaatgcattttggatgta

SEQ ID NO: 283304 - DNA, 20 bp, Artificial Sequence
  chemically synthesized
tgattcatagaaatgcattt

SEQ ID NO: 283305 - DNA, 20 bp, Artificial Sequence
  chemically synthesized
gaaagaaattatatgattca

SEQ ID NO: 283306 - DNA, 20 bp, Artificial Sequence
  chemically synthesized
ctaactgggatgttgtgaga

SEQ ID NO: 283307 - DNA, 20 bp, Artificial Sequence
  chemically synthesized
cattctaactgggatgttgt

SEQ ID NO: 283308 - DNA, 20 bp, Artificial Sequence
  chemically synthesized
atttctttctcacaacatcc

SEQ ID NO: 283309 - DNA, 20 bp, Artificial Sequence
  chemically synthesized
ctttctcacaacatcccagt

SEQ ID NO: 283310 - DNA, 20 bp, Artificial Sequence
  chemically synthesized
ttgtaattctcattctaact

SEQ ID NO: 283311 - DNA, 20 bp, Artificial Sequence
  chemically synthesized
tttgtaattctcattctaac

SEQ ID NO: 283312 - DNA, 20 bp, Artificial Sequence
  chemically synthesized
cacaacatcccagttagaat

SEQ ID NO: 283313 - DNA, 20 bp, Artificial Sequence
  chemically synthesized
gaagagactggagttcatat

SEQ ID NO: 283314 - DNA, 20 bp, Artificial Sequence
  chemically synthesized
aataaatctaatatgaactc

SEQ ID NO: 283315 - DNA, 20 bp, Artificial Sequence
  chemically synthesized
taaatttatggaagagactg

SEQ ID NO: 283316 - DNA, 20 bp, Artificial Sequence
  chemically synthesized
cttaaatttatggaagagac

SEQ ID NO: 283317 - DNA, 20 bp, Artificial Sequence
  chemically synthesized
ctaaacttaaatttatggaa

SEQ ID NO: 283318 - DNA, 20 bp, Artificial Sequence
  chemically synthesized
aactaaacttaaatttatgg

SEQ ID NO: 283319 - DNA, 20 bp, Artificial Sequence
  chemically synthesized
ccagtctcttccataaattt

SEQ ID NO: 283320 - DNA, 20 bp, Artificial Sequence
  chemically synthesized
ttcaactaaacttaaattta

SEQ ID NO: 283321 - DNA, 20 bp, Artificial Sequence
  chemically synthesized
ctcttccataaatttaagtt

SEQ ID NO: 283322 - DNA, 20 bp, Artificial Sequence
  chemically synthesized
aatttaagtttagttgaaat

SEQ ID NO: 283323 - DNA, 20 bp, Artificial Sequence
  chemically synthesized
taagtttagttgaaattgga

SEQ ID NO: 283324 - DNA, 20 bp, Artificial Sequence
  chemically synthesized
tagttgaaattggaaagtta

SEQ ID NO: 283325 - DNA, 20 bp, Artificial Sequence
  chemically synthesized
ttaaagaaataatttattat

SEQ ID NO: 283326 - DNA, 20 bp, Artificial Sequence
  chemically synthesized
aatttattataagaatacaa

SEQ ID NO: 283327 - DNA, 20 bp, Artificial Sequence
  chemically synthesized
gaatacaacagatctgtaac

SEQ ID NO: 283328 - DNA, 20 bp, Artificial Sequence
  chemically synthesized
ttttcagtctattcttgtta

SEQ ID NO: 283329 - DNA, 20 bp, Artificial Sequence
  chemically synthesized
caacagatctgtaacaagaa

SEQ ID NO: 283330 - DNA, 20 bp, Artificial Sequence
  chemically synthesized
tgtaacaagaatagactgaa

SEQ ID NO: 283331 - DNA, 20 bp, Artificial Sequence
  chemically synthesized
aacaagaatagactgaaaag

SEQ ID NO: 283332 - DNA, 20 bp, Artificial Sequence
  chemically synthesized
cctccatgcagactactttt

SEQ ID NO: 283333 - DNA, 20 bp, Artificial Sequence
  chemically synthesized
agactgaaaagtagtctgca

SEQ ID NO: 283334 - DNA, 20 bp, Artificial Sequence
  chemically synthesized
actgaaaagtagtctgcatg

SEQ ID NO: 283335 - DNA, 20 bp, Artificial Sequence
  chemically synthesized
ctgaaaagtagtctgcatgg

SEQ ID NO: 283336 - DNA, 20 bp, Artificial Sequence
  chemically synthesized
cacaaatccatacctccatg

SEQ ID NO: 283337 - DNA, 20 bp, Artificial Sequence
  chemically synthesized
aagtagtctgcatggaggta

SEQ ID NO: 283338 - DNA, 20 bp, Artificial Sequence
  chemically synthesized
tgcatggaggtatggatttg

SEQ ID NO: 283339 - DNA, 20 bp, Artificial Sequence
  chemically synthesized
ttgatataaatacaattgtt

SEQ ID NO: 283340 - DNA, 20 bp, Artificial Sequence
  chemically synthesized
ataaatacaattgtttggaa

SEQ ID NO: 283341 - DNA, 20 bp, Artificial Sequence
  chemically synthesized
taaatacaattgtttggaaa

SEQ ID NO: 283342 - DNA, 20 bp, Artificial Sequence
  chemically synthesized
tacaattgtttggaaaaggc

SEQ ID NO: 283343 - DNA, 20 bp, Artificial Sequence
  chemically synthesized
acaaatatttcaatattaac

SEQ ID NO: 283344 - DNA, 20 bp, Artificial Sequence
  chemically synthesized
caaatatttcaatattaact

SEQ ID NO: 283345 - DNA, 20 bp, Artificial Sequence
  chemically synthesized
ctgccaaatattttttaacc

SEQ ID NO: 283346 - DNA, 20 bp, Artificial Sequence
  chemically synthesized
taactaggttaaaaaatatt

SEQ ID NO: 283347 - DNA, 20 bp, Artificial Sequence
  chemically synthesized
ctaggttaaaaaatatttgg

SEQ ID NO: 283348 - DNA, 20 bp, Artificial Sequence
  chemically synthesized
ttaaaaaatatttggcagtc

SEQ ID NO: 283349 - DNA, 20 bp, Artificial Sequence
  chemically synthesized
tttataagtgatttcaattc

SEQ ID NO: 283350 - DNA, 20 bp, Artificial Sequence
  chemically synthesized
tattcatccaagtaatttat

SEQ ID NO: 283351 - DNA, 20 bp, Artificial Sequence
  chemically synthesized
gaaatcacttataaattact

SEQ ID NO: 283352 - DNA, 20 bp, Artificial Sequence
  chemically synthesized
ggtttcaatattattcatcc

SEQ ID NO: 283353 - DNA, 20 bp, Artificial Sequence
  chemically synthesized
ttaaataatgatatttgtga

SEQ ID NO: 283354 - DNA, 20 bp, Artificial Sequence
  chemically synthesized
catcacaaatatcattattt

SEQ ID NO: 283355 - DNA, 20 bp, Artificial Sequence
  chemically synthesized
aaatatcattatttaagtta

SEQ ID NO: 283356 - DNA, 20 bp, Artificial Sequence
  chemically synthesized
aatatcattatttaagttaa

SEQ ID NO: 283357 - DNA, 20 bp, Artificial Sequence
  chemically synthesized
aagttaaaggatacttaaca

SEQ ID NO: 283358 - DNA, 20 bp, Artificial Sequence
  chemically synthesized
caaggggacctttctatgtt

SEQ ID NO: 283359 - DNA, 20 bp, Artificial Sequence
  chemically synthesized
taaaggatacttaacataga

SEQ ID NO: 283360 - DNA, 20 bp, Artificial Sequence
  chemically synthesized
aaaggatacttaacatagaa

SEQ ID NO: 283361 - DNA, 20 bp, Artificial Sequence
  chemically synthesized
ttcctaaatatagcatcaag

SEQ ID NO: 283362 - DNA, 20 bp, Artificial Sequence
  chemically synthesized
gttcctaaatatagcatcaa

SEQ ID NO: 283363 - DNA, 20 bp, Artificial Sequence
  chemically synthesized
tgttcctaaatatagcatca

SEQ ID NO: 283364 - DNA, 20 bp, Artificial Sequence
  chemically synthesized
atgttcctaaatatagcatc

SEQ ID NO: 283365 - DNA, 20 bp, Artificial Sequence
  chemically synthesized
ggtccccttgatgctatatt

SEQ ID NO: 283366 - DNA, 20 bp, Artificial Sequence
  chemically synthesized
gtccccttgatgctatattt

SEQ ID NO: 283367 - DNA, 20 bp, Artificial Sequence
  chemically synthesized
tcaaaatatgttcctaaata

SEQ ID NO: 283368 - DNA, 20 bp, Artificial Sequence
  chemically synthesized
ttaggaacatattttgataa

SEQ ID NO: 283369 - DNA, 20 bp, Artificial Sequence
  chemically synthesized
gaacatattttgataaaaga

SEQ ID NO: 283370 - DNA, 20 bp, Artificial Sequence
  chemically synthesized
gataaaagaaagtttcgttc

SEQ ID NO: 283371 - DNA, 20 bp, Artificial Sequence
  chemically synthesized
ttcgagaattgaaaacacat

SEQ ID NO: 283372 - DNA, 20 bp, Artificial Sequence
  chemically synthesized
cgagaattgaaaacacatga

SEQ ID NO: 283373 - DNA, 20 bp, Artificial Sequence
  chemically synthesized
aattgaaaacacatgagaga

SEQ ID NO: 283374 - DNA, 20 bp, Artificial Sequence
  chemically synthesized
ttgaaaacacatgagagaaa

SEQ ID NO: 283375 - DNA, 20 bp, Artificial Sequence
  chemically synthesized
gagagaaagagaaaccaaaa

SEQ ID NO: 283376 - DNA, 20 bp, Artificial Sequence
  chemically synthesized
agagaaagagaaaccaaaaa

SEQ ID NO: 283377 - DNA, 20 bp, Artificial Sequence
  chemically synthesized
agaaagagaaaccaaaaaag

SEQ ID NO: 283378 - DNA, 20 bp, Artificial Sequence
  chemically synthesized
gatatcagcagctccttttt

SEQ ID NO: 283379 - DNA, 20 bp, Artificial Sequence
  chemically synthesized
aaaaaaggagctgctgatat

SEQ ID NO: 283380 - DNA, 20 bp, Artificial Sequence
  chemically synthesized
aggccagcttctgatatcag

SEQ ID NO: 283381 - DNA, 20 bp, Artificial Sequence
  chemically synthesized
aaaggagctgctgatatcag

SEQ ID NO: 283382 - DNA, 20 bp, Artificial Sequence
  chemically synthesized
gtcaggccagcttctgatat

SEQ ID NO: 283383 - DNA, 20 bp, Artificial Sequence
  chemically synthesized
gagctgctgatatcagaagc

SEQ ID NO: 283384 - DNA, 20 bp, Artificial Sequence
  chemically synthesized
ggcatagctgggtgtcaggc

SEQ ID NO: 283385 - DNA, 20 bp, Artificial Sequence
  chemically synthesized
tcagaagctggcctgacacc

SEQ ID NO: 283386 - DNA, 20 bp, Artificial Sequence
  chemically synthesized
ccaaggcatagctgggtgtc

SEQ ID NO: 283387 - DNA, 20 bp, Artificial Sequence
  chemically synthesized
accaaggcatagctgggtgt

SEQ ID NO: 283388 - DNA, 20 bp, Artificial Sequence
  chemically synthesized
gagaagaccaaggcatagct

SEQ ID NO: 283389 - DNA, 20 bp, Artificial Sequence
  chemically synthesized
tgagaagaccaaggcatagc

SEQ ID NO: 283390 - DNA, 20 bp, Artificial Sequence
  chemically synthesized
cctgacacccagctatgcct

SEQ ID NO: 283391 - DNA, 20 bp, Artificial Sequence
  chemically synthesized
cacttgagaagaccaaggca

SEQ ID NO: 283392 - DNA, 20 bp, Artificial Sequence
  chemically synthesized
ttttccacttgagaagacca

SEQ ID NO: 283393 - DNA, 20 bp, Artificial Sequence
  chemically synthesized
attttccacttgagaagacc

SEQ ID NO: 283394 - DNA, 20 bp, Artificial Sequence
  chemically synthesized
agctatgccttggtcttctc

SEQ ID NO: 283395 - DNA, 20 bp, Artificial Sequence
  chemically synthesized
tatgccttggtcttctcaag

SEQ ID NO: 283396 - DNA, 20 bp, Artificial Sequence
  chemically synthesized
cagtttattttccacttgag

SEQ ID NO: 283397 - DNA, 20 bp, Artificial Sequence
  chemically synthesized
aaacagtttattttccactt

SEQ ID NO: 283398 - DNA, 20 bp, Artificial Sequence
  chemically synthesized
gtggaaaataaactgtttca

SEQ ID NO: 283399 - DNA, 20 bp, Artificial Sequence
  chemically synthesized
aatgttgaaattctgtgaaa

SEQ ID NO: 283400 - DNA, 20 bp, Artificial Sequence
  chemically synthesized
gtttcacagaatttcaacat

SEQ ID NO: 283401 - DNA, 20 bp, Artificial Sequence
  chemically synthesized
acagaatttcaacattggaa

SEQ ID NO: 283402 - DNA, 20 bp, Artificial Sequence
  chemically synthesized
cagaatttcaacattggaaa

SEQ ID NO: 283403 - DNA, 20 bp, Artificial Sequence
  chemically synthesized
gatccattatggaaacaaag

SEQ ID NO: 283404 - DNA, 20 bp, Artificial Sequence
  chemically synthesized
cttgatccattatggaaaca

SEQ ID NO: 283405 - DNA, 20 bp, Artificial Sequence
  chemically synthesized
aggccactttgtttccataa

SEQ ID NO: 283406 - DNA, 20 bp, Artificial Sequence
  chemically synthesized
gtcatggtcttgatccatta

SEQ ID NO: 283407 - DNA, 20 bp, Artificial Sequence
  chemically synthesized
ctttgtttccataatggatc

SEQ ID NO: 283408 - DNA, 20 bp, Artificial Sequence
  chemically synthesized
taatggatcaagaccatgac

SEQ ID NO: 283409 - DNA, 20 bp, Artificial Sequence
  chemically synthesized
attatggaatgatcttgtca

SEQ ID NO: 283410 - DNA, 20 bp, Artificial Sequence
  chemically synthesized
tctggattcagacatgatta

SEQ ID NO: 283411 - DNA, 20 bp, Artificial Sequence
  chemically synthesized
tccataatcatgtctgaatc

SEQ ID NO: 283412 - DNA, 20 bp, Artificial Sequence
  chemically synthesized
ttgatgtttttgtctggatt

SEQ ID NO: 283413 - DNA, 20 bp, Artificial Sequence
  chemically synthesized
gtaatgttgatgtttttgtc

SEQ ID NO: 283414 - DNA, 20 bp, Artificial Sequence
  chemically synthesized
tgttgggcgttttgtggttt

SEQ ID NO: 283415 - DNA, 20 bp, Artificial Sequence
  chemically synthesized
gtgttgggcgttttgtggtt

SEQ ID NO: 283416 - DNA, 20 bp, Artificial Sequence
  chemically synthesized
ggagagtgttgggcgttttg

SEQ ID NO: 283417 - DNA, 20 bp, Artificial Sequence
  chemically synthesized
aaccaggataggagagtgtt

SEQ ID NO: 283418 - DNA, 20 bp, Artificial Sequence
  chemically synthesized
taaccaggataggagagtgt

SEQ ID NO: 283419 - DNA, 20 bp, Artificial Sequence
  chemically synthesized
tcatattaaccaggatagga

SEQ ID NO: 283420 - DNA, 20 bp, Artificial Sequence
  chemically synthesized
cgcccaacactctcctatcc

SEQ ID NO: 283421 - DNA, 20 bp, Artificial Sequence
  chemically synthesized
gttcatattaaccaggatag

SEQ ID NO: 283422 - DNA, 20 bp, Artificial Sequence
  chemically synthesized
tcgttcatattaaccaggat

SEQ ID NO: 283423 - DNA, 20 bp, Artificial Sequence
  chemically synthesized
ttcgttcatattaaccagga

SEQ ID NO: 283424 - DNA, 20 bp, Artificial Sequence
  chemically synthesized
ggcgttcgttcatattaacc

SEQ ID NO: 283425 - DNA, 20 bp, Artificial Sequence
  chemically synthesized
cggcgttcgttcatattaac

SEQ ID NO: 283426 - DNA, 20 bp, Artificial Sequence
  chemically synthesized
agttgcaattaataaagaaa

SEQ ID NO: 283427 - DNA, 20 bp, Artificial Sequence
  chemically synthesized
ggctaaagttgcaattaata

SEQ ID NO: 283428 - DNA, 20 bp, Artificial Sequence
  chemically synthesized
ttctttattaattgcaactt

SEQ ID NO: 283429 - DNA, 20 bp, Artificial Sequence
  chemically synthesized
agaagaccagaatgaggcta

SEQ ID NO: 283430 - DNA, 20 bp, Artificial Sequence
  chemically synthesized
ttgcaactttagcctcattc

SEQ ID NO: 283431 - DNA, 20 bp, Artificial Sequence
  chemically synthesized
aaggagagaagaccagaatg

SEQ ID NO: 283432 - DNA, 20 bp, Artificial Sequence
  chemically synthesized
gaaggagagaagaccagaat

SEQ ID NO: 283433 - DNA, 20 bp, Artificial Sequence
  chemically synthesized
tgtccagaaggagagaagac

SEQ ID NO: 283434 - DNA, 20 bp, Artificial Sequence
  chemically synthesized
tatcttgtccagaaggagag

SEQ ID NO: 283435 - DNA, 20 bp, Artificial Sequence
  chemically synthesized
attctggtcttctctccttc

SEQ ID NO: 283436 - DNA, 20 bp, Artificial Sequence
  chemically synthesized
tcgtatcttgtccagaagga

SEQ ID NO: 283437 - DNA, 20 bp, Artificial Sequence
  chemically synthesized
tatcgtatcttgtccagaag

SEQ ID NO: 283438 - DNA, 20 bp, Artificial Sequence
  chemically synthesized
ggtcttctctccttctggac

SEQ ID NO: 283439 - DNA, 20 bp, Artificial Sequence
  chemically synthesized
ggtatcgtatcttgtccaga

SEQ ID NO: 283440 - DNA, 20 bp, Artificial Sequence
  chemically synthesized
gggtatcgtatcttgtccag

SEQ ID NO: 283441 - DNA, 20 bp, Artificial Sequence
  chemically synthesized
tatgggtatcgtatcttgtc

SEQ ID NO: 283442 - DNA, 20 bp, Artificial Sequence
  chemically synthesized
gacaagatacgatacccata

SEQ ID NO: 283443 - DNA, 20 bp, Artificial Sequence
  chemically synthesized
gtgtgtagggatagctatat

SEQ ID NO: 283444 - DNA, 20 bp, Artificial Sequence
  chemically synthesized
agtgtgtagggatagctata

SEQ ID NO: 283445 - DNA, 20 bp, Artificial Sequence
  chemically synthesized
ttgtcattagtgtgtaggga

SEQ ID NO: 283446 - DNA, 20 bp, Artificial Sequence
  chemically synthesized
ttgcttgtcattagtgtgta

SEQ ID NO: 283447 - DNA, 20 bp, Artificial Sequence
  chemically synthesized
attgcttgtcattagtgtgt

SEQ ID NO: 283448 - DNA, 20 bp, Artificial Sequence
  chemically synthesized
gattgcttgtcattagtgtg

SEQ ID NO: 283449 - DNA, 20 bp, Artificial Sequence
  chemically synthesized
tatccctacacactaatgac

SEQ ID NO: 283450 - DNA, 20 bp, Artificial Sequence
  chemically synthesized
tactttggattgcttgtcat

SEQ ID NO: 283451 - DNA, 20 bp, Artificial Sequence
  chemically synthesized
cactaatgacaagcaatcca

SEQ ID NO: 283452 - DNA, 20 bp, Artificial Sequence
  chemically synthesized
atgacaagcaatccaaagta

SEQ ID NO: 283453 - DNA, 20 bp, Artificial Sequence
  chemically synthesized
agggtttaaaagctttactt

SEQ ID NO: 283454 - DNA, 20 bp, Artificial Sequence
  chemically synthesized
ggatttgagggagggtttaa

SEQ ID NO: 283455 - DNA, 20 bp, Artificial Sequence
  chemically synthesized
gtgttaggggatttgaggga

SEQ ID NO: 283456 - DNA, 20 bp, Artificial Sequence
  chemically synthesized
tgtgttaggggatttgaggg

SEQ ID NO: 283457 - DNA, 20 bp, Artificial Sequence
  chemically synthesized
ttgtgttaggggatttgagg

SEQ ID NO: 283458 - DNA, 20 bp, Artificial Sequence
  chemically synthesized
gcttgtgttaggggatttga

SEQ ID NO: 283459 - DNA, 20 bp, Artificial Sequence
  chemically synthesized
tgcttgtgttaggggatttg

SEQ ID NO: 283460 - DNA, 20 bp, Artificial Sequence
  chemically synthesized
gtgcttgtgttaggggattt

SEQ ID NO: 283461 - DNA, 20 bp, Artificial Sequence
  chemically synthesized
tccctcaaatcccctaacac

SEQ ID NO: 283462 - DNA, 20 bp, Artificial Sequence
  chemically synthesized
aggatttgtgcttgtgttag

SEQ ID NO: 283463 - DNA, 20 bp, Artificial Sequence
  chemically synthesized
taggatttgtgcttgtgtta

SEQ ID NO: 283464 - DNA, 20 bp, Artificial Sequence
  chemically synthesized
gtaggatttgtgcttgtgtt

SEQ ID NO: 283465 - DNA, 20 bp, Artificial Sequence
  chemically synthesized
tgtaggatttgtgcttgtgt

SEQ ID NO: 283466 - DNA, 20 bp, Artificial Sequence
  chemically synthesized
aaaaaaaaaaaaaacattgt

SEQ ID NO: 283467 - DNA, 20 bp, Artificial Sequence
  chemically synthesized
gaaaaaaaaaaaaaacattg

SEQ ID NO: 283468 - DNA, 20 bp, Artificial Sequence
  chemically synthesized
tggaggccagggggtgcgtg

SEQ ID NO: 283469 - DNA, 20 bp, Artificial Sequence
  chemically synthesized
tttcatccacacgcaccccc

SEQ ID NO: 283470 - DNA, 20 bp, Artificial Sequence
  chemically synthesized
tacacaacatggaggccagg

SEQ ID NO: 283471 - DNA, 20 bp, Artificial Sequence
  chemically synthesized
atacacaacatggaggccag

SEQ ID NO: 283472 - DNA, 20 bp, Artificial Sequence
  chemically synthesized
aatacacaacatggaggcca

SEQ ID NO: 283473 - DNA, 20 bp, Artificial Sequence
  chemically synthesized
gaatacacaacatggaggcc

SEQ ID NO: 283474 - DNA, 20 bp, Artificial Sequence
  chemically synthesized
agaatacacaacatggaggc

SEQ ID NO: 283475 - DNA, 20 bp, Artificial Sequence
  chemically synthesized
agggagaatacacaacatgg

SEQ ID NO: 283476 - DNA, 20 bp, Artificial Sequence
  chemically synthesized
gagggagaatacacaacatg

SEQ ID NO: 283477 - DNA, 20 bp, Artificial Sequence
  chemically synthesized
atgagggagaatacacaaca

SEQ ID NO: 283478 - DNA, 20 bp, Artificial Sequence
  chemically synthesized
cattattttttgcaatgagg

SEQ ID NO: 283479 - DNA, 20 bp, Artificial Sequence
  chemically synthesized
ttcattattttttgcaatga

SEQ ID NO: 283480 - DNA, 20 bp, Artificial Sequence
  chemically synthesized
gttcattattttttgcaatg

SEQ ID NO: 283481 - DNA, 20 bp, Artificial Sequence
  chemically synthesized
ggttcattattttttgcaat

SEQ ID NO: 283482 - DNA, 20 bp, Artificial Sequence
  chemically synthesized
ctcttgtagctgaacaagtt

SEQ ID NO: 283483 - DNA, 20 bp, Artificial Sequence
  chemically synthesized
aataatgaacccaacttgtt

SEQ ID NO: 283484 - DNA, 20 bp, Artificial Sequence
  chemically synthesized
tctcttgtagctgaacaagt

SEQ ID NO: 283485 - DNA, 20 bp, Artificial Sequence
  chemically synthesized
caactctcttgtagctgaac

SEQ ID NO: 283486 - DNA, 20 bp, Artificial Sequence
  chemically synthesized
aacccaacttgttcagctac

SEQ ID NO: 283487 - DNA, 20 bp, Artificial Sequence
  chemically synthesized
cccaacttgttcagctacaa

SEQ ID NO: 283488 - DNA, 20 bp, Artificial Sequence
  chemically synthesized
caacttgttcagctacaaga

SEQ ID NO: 283489 - DNA, 20 bp, Artificial Sequence
  chemically synthesized
gaccaccaccaactctcttg

SEQ ID NO: 283490 - DNA, 20 bp, Artificial Sequence
  chemically synthesized
ttgttcagctacaagagagt

SEQ ID NO: 283491 - DNA, 20 bp, Artificial Sequence
  chemically synthesized
ttcagctacaagagagttgg

SEQ ID NO: 283492 - DNA, 20 bp, Artificial Sequence
  chemically synthesized
agctacaagagagttggtgg

SEQ ID NO: 283493 - DNA, 20 bp, Artificial Sequence
  chemically synthesized
agagagttggtggtggtctt

SEQ ID NO: 283494 - DNA, 20 bp, Artificial Sequence
  chemically synthesized
agttggtggtggtcttcggt

SEQ ID NO: 283495 - DNA, 20 bp, Artificial Sequence
  chemically synthesized
gttggtggtggtcttcggtt

SEQ ID NO: 283496 - DNA, 20 bp, Artificial Sequence
  chemically synthesized
tggtggtggtcttcggttgg

SEQ ID NO: 283497 - DNA, 20 bp, Artificial Sequence
  chemically synthesized
gtgtaaatgtctcccaaccg

SEQ ID NO: 283498 - DNA, 20 bp, Artificial Sequence
  chemically synthesized
tgtacgcatttgaagttaag

SEQ ID NO: 283499 - DNA, 20 bp, Artificial Sequence
  chemically synthesized
catgtacgcatttgaagtta

SEQ ID NO: 283500 - DNA, 20 bp, Artificial Sequence
  chemically synthesized
acatgtacgcatttgaagtt

SEQ ID NO: 283501 - DNA, 20 bp, Artificial Sequence
  chemically synthesized
aaaatacatgtacgcatttg

SEQ ID NO: 283502 - DNA, 20 bp, Artificial Sequence
  chemically synthesized
tcaaatgcgtacatgtattt

SEQ ID NO: 283503 - DNA, 20 bp, Artificial Sequence
  chemically synthesized
acacatacacactgtatctt

SEQ ID NO: 283504 - DNA, 20 bp, Artificial Sequence
  chemically synthesized
aggaacacagactaaagata

SEQ ID NO: 283505 - DNA, 20 bp, Artificial Sequence
  chemically synthesized
ccctggaggaacacagacta

SEQ ID NO: 283506 - DNA, 20 bp, Artificial Sequence
  chemically synthesized
gtttgacccctggaggaaca

SEQ ID NO: 283507 - DNA, 20 bp, Artificial Sequence
  chemically synthesized
atctttagtctgtgttcctc

SEQ ID NO: 283508 - DNA, 20 bp, Artificial Sequence
  chemically synthesized
tctttagtctgtgttcctcc

SEQ ID NO: 283509 - DNA, 20 bp, Artificial Sequence
  chemically synthesized
ctttagtctgtgttcctcca

SEQ ID NO: 283510 - DNA, 20 bp, Artificial Sequence
  chemically synthesized
tttagtctgtgttcctccag

SEQ ID NO: 283511 - DNA, 20 bp, Artificial Sequence
  chemically synthesized
atgtcaggtttgacccctgg

SEQ ID NO: 283512 - DNA, 20 bp, Artificial Sequence
  chemically synthesized
aatgtcaggtttgacccctg

SEQ ID NO: 283513 - DNA, 20 bp, Artificial Sequence
  chemically synthesized
ctaatgtcaggtttgacccc

SEQ ID NO: 283514 - DNA, 20 bp, Artificial Sequence
  chemically synthesized
ccaggggtcaaacctgacat

SEQ ID NO: 283515 - DNA, 20 bp, Artificial Sequence
  chemically synthesized
tatatttgaaagctaatgtc

SEQ ID NO: 283516 - DNA, 20 bp, Artificial Sequence
  chemically synthesized
ttatatttgaaagctaatgt

SEQ ID NO: 283517 - DNA, 20 bp, Artificial Sequence
  chemically synthesized
aataaactacttatatttga

SEQ ID NO: 283518 - DNA, 20 bp, Artificial Sequence
  chemically synthesized
tgacattagctttcaaatat

SEQ ID NO: 283519 - DNA, 20 bp, Artificial Sequence
  chemically synthesized
cattagctttcaaatataag

SEQ ID NO: 283520 - DNA, 20 bp, Artificial Sequence
  chemically synthesized
tatttatgtgtgccatgtaa

SEQ ID NO: 283521 - DNA, 20 bp, Artificial Sequence
  chemically synthesized
ctaccagaatttcttttaca

SEQ ID NO: 283522 - DNA, 20 bp, Artificial Sequence
  chemically synthesized
gtgccatgtaaaagaaattc

SEQ ID NO: 283523 - DNA, 20 bp, Artificial Sequence
  chemically synthesized
ccatgtaaaagaaattctgg

SEQ ID NO: 283524 - DNA, 20 bp, Artificial Sequence
  chemically synthesized
tcaattccccattcagctac

SEQ ID NO: 283525 - DNA, 20 bp, Artificial Sequence
  chemically synthesized
aagaaattctggtagctgaa

SEQ ID NO: 283526 - DNA, 20 bp, Artificial Sequence
  chemically synthesized
agaaattctggtagctgaat

SEQ ID NO: 283527 - DNA, 20 bp, Artificial Sequence
  chemically synthesized
gaaattctggtagctgaatg

SEQ ID NO: 283528 - DNA, 20 bp, Artificial Sequence
  chemically synthesized
tcttgtctcaattccccatt

SEQ ID NO: 283529 - DNA, 20 bp, Artificial Sequence
  chemically synthesized
tggtagctgaatggggaatt

SEQ ID NO: 283530 - DNA, 20 bp, Artificial Sequence
  chemically synthesized
gctgaatggggaattgagac

SEQ ID NO: 283531 - DNA, 20 bp, Artificial Sequence
  chemically synthesized
aatggggaattgagacaaga

SEQ ID NO: 283532 - DNA, 20 bp, Artificial Sequence
  chemically synthesized
atggggaattgagacaagaa

SEQ ID NO: 283533 - DNA, 20 bp, Artificial Sequence
  chemically synthesized
tggggaattgagacaagaaa

SEQ ID NO: 283534 - DNA, 20 bp, Artificial Sequence
  chemically synthesized
ggaattgagacaagaaaggg

SEQ ID NO: 283535 - DNA, 20 bp, Artificial Sequence
  chemically synthesized
aattgagacaagaaagggaa

SEQ ID NO: 283536 - DNA, 20 bp, Artificial Sequence
  chemically synthesized
aaagggaagagacatccata

SEQ ID NO: 283537 - DNA, 20 bp, Artificial Sequence
  chemically synthesized
aagggaagagacatccatat

SEQ ID NO: 283538 - DNA, 20 bp, Artificial Sequence
  chemically synthesized
gattaataagtatgcccata

SEQ ID NO: 283539 - DNA, 20 bp, Artificial Sequence
  chemically synthesized
cagtgtttgctgggattaat

SEQ ID NO: 283540 - DNA, 20 bp, Artificial Sequence
  chemically synthesized
atgggcatacttattaatcc

SEQ ID NO: 283541 - DNA, 20 bp, Artificial Sequence
  chemically synthesized
agtcattaacagtgtttgct

SEQ ID NO: 283542 - DNA, 20 bp, Artificial Sequence
  chemically synthesized
tagtcattaacagtgtttgc

SEQ ID NO: 283543 - DNA, 20 bp, Artificial Sequence
  chemically synthesized
gattaaactctagtcattaa

SEQ ID NO: 283544 - DNA, 20 bp, Artificial Sequence
  chemically synthesized
cagcaaacactgttaatgac

SEQ ID NO: 283545 - DNA, 20 bp, Artificial Sequence
  chemically synthesized
gcaaacactgttaatgacta

SEQ ID NO: 283546 - DNA, 20 bp, Artificial Sequence
  chemically synthesized
tttctaacaggattaaactc

SEQ ID NO: 283547 - DNA, 20 bp, Artificial Sequence
  chemically synthesized
tgactagagtttaatcctgt

SEQ ID NO: 283548 - DNA, 20 bp, Artificial Sequence
  chemically synthesized
tagagtttaatcctgttaga

SEQ ID NO: 283549 - DNA, 20 bp, Artificial Sequence
  chemically synthesized
atttctcagggctttctaac

SEQ ID NO: 283550 - DNA, 20 bp, Artificial Sequence
  chemically synthesized
tatttctcagggctttctaa

SEQ ID NO: 283551 - DNA, 20 bp, Artificial Sequence
  chemically synthesized
taatcctgttagaaagccct

SEQ ID NO: 283552 - DNA, 20 bp, Artificial Sequence
  chemically synthesized
ccgcaggcatatatttctca

SEQ ID NO: 283553 - DNA, 20 bp, Artificial Sequence
  chemically synthesized
cccgcaggcatatatttctc

SEQ ID NO: 283554 - DNA, 20 bp, Artificial Sequence
  chemically synthesized
acccgcaggcatatatttct

SEQ ID NO: 283555 - DNA, 20 bp, Artificial Sequence
  chemically synthesized
ccctgagaaatatatgcctg

SEQ ID NO: 283556 - DNA, 20 bp, Artificial Sequence
  chemically synthesized
cctgagaaatatatgcctgc

SEQ ID NO: 283557 - DNA, 20 bp, Artificial Sequence
  chemically synthesized
ccctgaatgggataacccgc

SEQ ID NO: 283558 - DNA, 20 bp, Artificial Sequence
  chemically synthesized
cccctgaatgggataacccg

SEQ ID NO: 283559 - DNA, 20 bp, Artificial Sequence
  chemically synthesized
tgcctgcgggttatcccatt

SEQ ID NO: 283560 - DNA, 20 bp, Artificial Sequence
  chemically synthesized
gcctgcgggttatcccattc

SEQ ID NO: 283561 - DNA, 20 bp, Artificial Sequence
  chemically synthesized
cctgcgggttatcccattca

SEQ ID NO: 283562 - DNA, 20 bp, Artificial Sequence
  chemically synthesized
ctgcgggttatcccattcag

SEQ ID NO: 283563 - DNA, 20 bp, Artificial Sequence
  chemically synthesized
caatttcttcacccctgaat

SEQ ID NO: 283564 - DNA, 20 bp, Artificial Sequence
  chemically synthesized
ccaatttcttcacccctgaa

SEQ ID NO: 283565 - DNA, 20 bp, Artificial Sequence
  chemically synthesized
ggttatcccattcaggggtg

SEQ ID NO: 283566 - DNA, 20 bp, Artificial Sequence
  chemically synthesized
ccattcaggggtgaagaaat

SEQ ID NO: 283567 - DNA, 20 bp, Artificial Sequence
  chemically synthesized
cattcaggggtgaagaaatt

SEQ ID NO: 283568 - DNA, 20 bp, Artificial Sequence
  chemically synthesized
attcaggggtgaagaaattg

SEQ ID NO: 283569 - DNA, 20 bp, Artificial Sequence
  chemically synthesized
aacaattagggaagatgata

SEQ ID NO: 283570 - DNA, 20 bp, Artificial Sequence
  chemically synthesized
acagcctttaacaattaggg

SEQ ID NO: 283571 - DNA, 20 bp, Artificial Sequence
  chemically synthesized
ccaacagcctttaacaatta

SEQ ID NO: 283572 - DNA, 20 bp, Artificial Sequence
  chemically synthesized
cccaacagcctttaacaatt

SEQ ID NO: 283573 - DNA, 20 bp, Artificial Sequence
  chemically synthesized
atcatcttccctaattgtta

SEQ ID NO: 283574 - DNA, 20 bp, Artificial Sequence
  chemically synthesized
ccccaacagcctttaacaat

SEQ ID NO: 283575 - DNA, 20 bp, Artificial Sequence
  chemically synthesized
tcatcttccctaattgttaa

SEQ ID NO: 283576 - DNA, 20 bp, Artificial Sequence
  chemically synthesized
ccctaattgttaaaggctgt

SEQ ID NO: 283577 - DNA, 20 bp, Artificial Sequence
  chemically synthesized
cctaattgttaaaggctgtt

SEQ ID NO: 283578 - DNA, 20 bp, Artificial Sequence
  chemically synthesized
ctaattgttaaaggctgttg

SEQ ID NO: 283579 - DNA, 20 bp, Artificial Sequence
  chemically synthesized
ggaaattaacatttccccaa

SEQ ID NO: 283580 - DNA, 20 bp, Artificial Sequence
  chemically synthesized
ttggggaaatgttaatttcc

SEQ ID NO: 283581 - DNA, 20 bp, Artificial Sequence
  chemically synthesized
gtggtaggcttgcaagtact

SEQ ID NO: 283582 - DNA, 20 bp, Artificial Sequence
  chemically synthesized
tgtggtaggcttgcaagtac

SEQ ID NO: 283583 - DNA, 20 bp, Artificial Sequence
  chemically synthesized
gttaatttcccagtacttgc

SEQ ID NO: 283584 - DNA, 20 bp, Artificial Sequence
  chemically synthesized
cacttgtgtggtaggcttgc

SEQ ID NO: 283585 - DNA, 20 bp, Artificial Sequence
  chemically synthesized
tacttgcaagcctaccacac

SEQ ID NO: 283586 - DNA, 20 bp, Artificial Sequence
  chemically synthesized
cacttttgcacttgtgtggt

SEQ ID NO: 283587 - DNA, 20 bp, Artificial Sequence
  chemically synthesized
ccacttttgcacttgtgtgg

SEQ ID NO: 283588 - DNA, 20 bp, Artificial Sequence
  chemically synthesized
atcccacttttgcacttgtg

SEQ ID NO: 283589 - DNA, 20 bp, Artificial Sequence
  chemically synthesized
agcctaccacacaagtgcaa

SEQ ID NO: 283590 - DNA, 20 bp, Artificial Sequence
  chemically synthesized
ctaccacacaagtgcaaaag

SEQ ID NO: 283591 - DNA, 20 bp, Artificial Sequence
  chemically synthesized
taccacacaagtgcaaaagt

SEQ ID NO: 283592 - DNA, 20 bp, Artificial Sequence
  chemically synthesized
acaagtgcaaaagtgggatt

SEQ ID NO: 283593 - DNA, 20 bp, Artificial Sequence
  chemically synthesized
agtgcaaaagtgggattcag

SEQ ID NO: 283594 - DNA, 20 bp, Artificial Sequence
  chemically synthesized
aaagtgggattcagtggcca

SEQ ID NO: 283595 - DNA, 20 bp, Artificial Sequence
  chemically synthesized
tgggattcagtggccacaga

SEQ ID NO: 283596 - DNA, 20 bp, Artificial Sequence
  chemically synthesized
ctttacttgagggctttctg

SEQ ID NO: 283597 - DNA, 20 bp, Artificial Sequence
  chemically synthesized
agtggccacagaaagccctc

SEQ ID NO: 283598 - DNA, 20 bp, Artificial Sequence
  chemically synthesized
ccacagaaagccctcaagta

SEQ ID NO: 283599 - DNA, 20 bp, Artificial Sequence
  chemically synthesized
acctgagttcctttacttga

SEQ ID NO: 283600 - DNA, 20 bp, Artificial Sequence
  chemically synthesized
cacagaaagccctcaagtaa

SEQ ID NO: 283601 - DNA, 20 bp, Artificial Sequence
  chemically synthesized
aacctgagttcctttacttg

SEQ ID NO: 283602 - DNA, 20 bp, Artificial Sequence
  chemically synthesized
gaacctgagttcctttactt

SEQ ID NO: 283603 - DNA, 20 bp, Artificial Sequence
  chemically synthesized
agccctcaagtaaaggaact

SEQ ID NO: 283604 - DNA, 20 bp, Artificial Sequence
  chemically synthesized
gccctcaagtaaaggaactc

SEQ ID NO: 283605 - DNA, 20 bp, Artificial Sequence
  chemically synthesized
acttctacattatagaacct

SEQ ID NO: 283606 - DNA, 20 bp, Artificial Sequence
  chemically synthesized
ggaactcaggttctataatg

SEQ ID NO: 283607 - DNA, 20 bp, Artificial Sequence
  chemically synthesized
caggcccaacttctacatta

SEQ ID NO: 283608 - DNA, 20 bp, Artificial Sequence
  chemically synthesized
actcaggttctataatgtag

SEQ ID NO: 283609 - DNA, 20 bp, Artificial Sequence
  chemically synthesized
aggttctataatgtagaagt

SEQ ID NO: 283610 - DNA, 20 bp, Artificial Sequence
  chemically synthesized
ggttctataatgtagaagtt

SEQ ID NO: 283611 - DNA, 20 bp, Artificial Sequence
  chemically synthesized
ttaaccaccgcattgtatgc

SEQ ID NO: 283612 - DNA, 20 bp, Artificial Sequence
  chemically synthesized
cttaaccaccgcattgtatg

SEQ ID NO: 283613 - DNA, 20 bp, Artificial Sequence
  chemically synthesized
agttgggcctgcatacaatg

SEQ ID NO: 283614 - DNA, 20 bp, Artificial Sequence
  chemically synthesized
tgggcctgcatacaatgcgg

SEQ ID NO: 283615 - DNA, 20 bp, Artificial Sequence
  chemically synthesized
ctgcatacaatgcggtggtt

SEQ ID NO: 283616 - DNA, 20 bp, Artificial Sequence
  chemically synthesized
tgcatacaatgcggtggtta

SEQ ID NO: 283617 - DNA, 20 bp, Artificial Sequence
  chemically synthesized
tacaatgcggtggttaaggt

SEQ ID NO: 283618 - DNA, 20 bp, Artificial Sequence
  chemically synthesized
acaatgcggtggttaaggta

SEQ ID NO: 283619 - DNA, 20 bp, Artificial Sequence
  chemically synthesized
caatgcggtggttaaggtaa

SEQ ID NO: 283620 - DNA, 20 bp, Artificial Sequence
  chemically synthesized
tggttaaggtaagggcttat

SEQ ID NO: 283621 - DNA, 20 bp, Artificial Sequence
  chemically synthesized
ttaaggtaagggcttattgg

SEQ ID NO: 283622 - DNA, 20 bp, Artificial Sequence
  chemically synthesized
taaggtaagggcttattggc

SEQ ID NO: 283623 - DNA, 20 bp, Artificial Sequence
  chemically synthesized
cttatccatatcctgccaat

SEQ ID NO: 283624 - DNA, 20 bp, Artificial Sequence
  chemically synthesized
aagggcttattggcaggata

SEQ ID NO: 283625 - DNA, 20 bp, Artificial Sequence
  chemically synthesized
cttattggcaggatatggat

SEQ ID NO: 283626 - DNA, 20 bp, Artificial Sequence
  chemically synthesized
ttattggcaggatatggata

SEQ ID NO: 283627 - DNA, 20 bp, Artificial Sequence
  chemically synthesized
tggcaggatatggataaggt

SEQ ID NO: 283628 - DNA, 20 bp, Artificial Sequence
  chemically synthesized
acacatacaaaggcatttta

SEQ ID NO: 283629 - DNA, 20 bp, Artificial Sequence
  chemically synthesized
gattatgctgacacatacaa

SEQ ID NO: 283630 - DNA, 20 bp, Artificial Sequence
  chemically synthesized
tgattatgctgacacataca

SEQ ID NO: 283631 - DNA, 20 bp, Artificial Sequence
  chemically synthesized
taaaatgcctttgtatgtgt

SEQ ID NO: 283632 - DNA, 20 bp, Artificial Sequence
  chemically synthesized
ggactaaatccaaaggagta

SEQ ID NO: 283633 - DNA, 20 bp, Artificial Sequence
  chemically synthesized
gcataatcaccctactcctt

SEQ ID NO: 283634 - DNA, 20 bp, Artificial Sequence
  chemically synthesized
gggactaaatccaaaggagt

SEQ ID NO: 283635 - DNA, 20 bp, Artificial Sequence
  chemically synthesized
tgggactaaatccaaaggag

SEQ ID NO: 283636 - DNA, 20 bp, Artificial Sequence
  chemically synthesized
ttgtgggactaaatccaaag

SEQ ID NO: 283637 - DNA, 20 bp, Artificial Sequence
  chemically synthesized
tcaccctactcctttggatt

SEQ ID NO: 283638 - DNA, 20 bp, Artificial Sequence
  chemically synthesized
aattgtgggactaaatccaa

SEQ ID NO: 283639 - DNA, 20 bp, Artificial Sequence
  chemically synthesized
gaattgtgggactaaatcca

SEQ ID NO: 283640 - DNA, 20 bp, Artificial Sequence
  chemically synthesized
gcatacttttaaggaattgt

SEQ ID NO: 283641 - DNA, 20 bp, Artificial Sequence
  chemically synthesized
tgcatacttttaaggaattg

SEQ ID NO: 283642 - DNA, 20 bp, Artificial Sequence
  chemically synthesized
ttagtcccacaattccttaa

SEQ ID NO: 283643 - DNA, 20 bp, Artificial Sequence
  chemically synthesized
tgacataatgcatactttta

SEQ ID NO: 283644 - DNA, 20 bp, Artificial Sequence
  chemically synthesized
ctgacataatgcatactttt

SEQ ID NO: 283645 - DNA, 20 bp, Artificial Sequence
  chemically synthesized
cttaaaagtatgcattatgt

SEQ ID NO: 283646 - DNA, 20 bp, Artificial Sequence
  chemically synthesized
aatgcaaattgttttgtcta

SEQ ID NO: 283647 - DNA, 20 bp, Artificial Sequence
  chemically synthesized
cggtgaagttaagcattcta

SEQ ID NO: 283648 - DNA, 20 bp, Artificial Sequence
  chemically synthesized
caattaaaatcggtgaagtt

SEQ ID NO: 283649 - DNA, 20 bp, Artificial Sequence
  chemically synthesized
tcaatcaattaaaatcggtg

SEQ ID NO: 283650 - DNA, 20 bp, Artificial Sequence
  chemically synthesized
agatttcaatcaattaaaat

SEQ ID NO: 283651 - DNA, 20 bp, Artificial Sequence
  chemically synthesized
ttttaattgattgaaatctt

SEQ ID NO: 283652 - DNA, 20 bp, Artificial Sequence
  chemically synthesized
ttatttagaatattgaacta

SEQ ID NO: 283653 - DNA, 20 bp, Artificial Sequence
  chemically synthesized
gttcaatattctaaataaat

SEQ ID NO: 283654 - DNA, 20 bp, Artificial Sequence
  chemically synthesized
tgccaaaaagctgatttatt

SEQ ID NO: 283655 - DNA, 20 bp, Artificial Sequence
  chemically synthesized
ttctaaataaatcagctttt

SEQ ID NO: 283656 - DNA, 20 bp, Artificial Sequence
  chemically synthesized
ctatgctcagtgatgccaaa

SEQ ID NO: 283657 - DNA, 20 bp, Artificial Sequence
  chemically synthesized
atcagctttttggcatcact

SEQ ID NO: 283658 - DNA, 20 bp, Artificial Sequence
  chemically synthesized
ctttttggcatcactgagca

SEQ ID NO: 283659 - DNA, 20 bp, Artificial Sequence
  chemically synthesized
ttttggcatcactgagcata

SEQ ID NO: 283660 - DNA, 20 bp, Artificial Sequence
  chemically synthesized
gtaaaaacaatctctatgct

SEQ ID NO: 283661 - DNA, 20 bp, Artificial Sequence
  chemically synthesized
cacaaattgcattttgactt

SEQ ID NO: 283662 - DNA, 20 bp, Artificial Sequence
  chemically synthesized
tgattatactataattacta

SEQ ID NO: 283663 - DNA, 20 bp, Artificial Sequence
  chemically synthesized
cattttgactttagtaatta

SEQ ID NO: 283664 - DNA, 20 bp, Artificial Sequence
  chemically synthesized
gtaattatagtataatcaac

SEQ ID NO: 283665 - DNA, 20 bp, Artificial Sequence
  chemically synthesized
agcacatattaaatgatgaa

SEQ ID NO: 283666 - DNA, 20 bp, Artificial Sequence
  chemically synthesized
atggctggcacagaacacag

SEQ ID NO: 283667 - DNA, 20 bp, Artificial Sequence
  chemically synthesized
gacatggctggcacagaaca

SEQ ID NO: 283668 - DNA, 20 bp, Artificial Sequence
  chemically synthesized
tgtgctactgtgttctgtgc

SEQ ID NO: 283669 - DNA, 20 bp, Artificial Sequence
  chemically synthesized
cacttatgacatggctggca

SEQ ID NO: 283670 - DNA, 20 bp, Artificial Sequence
  chemically synthesized
ggtagcacttatgacatggc

SEQ ID NO: 283671 - DNA, 20 bp, Artificial Sequence
  chemically synthesized
ttctgtgccagccatgtcat

SEQ ID NO: 283672 - DNA, 20 bp, Artificial Sequence
  chemically synthesized
atgaggtagcacttatgaca

SEQ ID NO: 283673 - DNA, 20 bp, Artificial Sequence
  chemically synthesized
tgtcataagtgctacctcat

SEQ ID NO: 283674 - DNA, 20 bp, Artificial Sequence
  chemically synthesized
tgggtaaagatctaatgagg

SEQ ID NO: 283675 - DNA, 20 bp, Artificial Sequence
  chemically synthesized
gtttgggtaaagatctaatg

SEQ ID NO: 283676 - DNA, 20 bp, Artificial Sequence
  chemically synthesized
ggtttgggtaaagatctaat

SEQ ID NO: 283677 - DNA, 20 bp, Artificial Sequence
  chemically synthesized
catccgagaaggtttgggta

SEQ ID NO: 283678 - DNA, 20 bp, Artificial Sequence
  chemically synthesized
aaacacatccgagaaggttt

SEQ ID NO: 283679 - DNA, 20 bp, Artificial Sequence
  chemically synthesized
aaaacacatccgagaaggtt

SEQ ID NO: 283680 - DNA, 20 bp, Artificial Sequence
  chemically synthesized
gatctttacccaaaccttct

SEQ ID NO: 283681 - DNA, 20 bp, Artificial Sequence
  chemically synthesized
gtaacaaaacacatccgaga

SEQ ID NO: 283682 - DNA, 20 bp, Artificial Sequence
  chemically synthesized
ggtaacaaaacacatccgag

SEQ ID NO: 283683 - DNA, 20 bp, Artificial Sequence
  chemically synthesized
agaggtaacaaaacacatcc

SEQ ID NO: 283684 - DNA, 20 bp, Artificial Sequence
  chemically synthesized
gtgttttgttacctctatat

SEQ ID NO: 283685 - DNA, 20 bp, Artificial Sequence
  chemically synthesized
ttttctaatgtccaatatag

SEQ ID NO: 283686 - DNA, 20 bp, Artificial Sequence
  chemically synthesized
gttttctaatgtccaatata

SEQ ID NO: 283687 - DNA, 20 bp, Artificial Sequence
  chemically synthesized
cagttttctaatgtccaata

SEQ ID NO: 283688 - DNA, 20 bp, Artificial Sequence
  chemically synthesized
gttacctctatattggacat

SEQ ID NO: 283689 - DNA, 20 bp, Artificial Sequence
  chemically synthesized
atattggacattagaaaact

SEQ ID NO: 283690 - DNA, 20 bp, Artificial Sequence
  chemically synthesized
tattggacattagaaaactg

SEQ ID NO: 283691 - DNA, 20 bp, Artificial Sequence
  chemically synthesized
gacattagaaaactgaggtt

SEQ ID NO: 283692 - DNA, 20 bp, Artificial Sequence
  chemically synthesized
cattagaaaactgaggttca

SEQ ID NO: 283693 - DNA, 20 bp, Artificial Sequence
  chemically synthesized
tccttaaactctctgaacct

SEQ ID NO: 283694 - DNA, 20 bp, Artificial Sequence
  chemically synthesized
ttagaaaactgaggttcaga

SEQ ID NO: 283695 - DNA, 20 bp, Artificial Sequence
  chemically synthesized
aactgaggttcagagagttt

SEQ ID NO: 283696 - DNA, 20 bp, Artificial Sequence
  chemically synthesized
actgaggttcagagagttta

SEQ ID NO: 283697 - DNA, 20 bp, Artificial Sequence
  chemically synthesized
gagtttaaggaaatcatcct

SEQ ID NO: 283698 - DNA, 20 bp, Artificial Sequence
  chemically synthesized
gtttaaggaaatcatcctca

SEQ ID NO: 283699 - DNA, 20 bp, Artificial Sequence
  chemically synthesized
aaagagaggatataactctg

SEQ ID NO: 283700 - DNA, 20 bp, Artificial Sequence
  chemically synthesized
gaaagagaggatataactct

SEQ ID NO: 283701 - DNA, 20 bp, Artificial Sequence
  chemically synthesized
acagaaactatgagaaagag

SEQ ID NO: 283702 - DNA, 20 bp, Artificial Sequence
  chemically synthesized
aacagaaactatgagaaaga

SEQ ID NO: 283703 - DNA, 20 bp, Artificial Sequence
  chemically synthesized
gttatatcctctctttctca

SEQ ID NO: 283704 - DNA, 20 bp, Artificial Sequence
  chemically synthesized
ttaacagaaactatgagaaa

SEQ ID NO: 283705 - DNA, 20 bp, Artificial Sequence
  chemically synthesized
gcttaacagaaactatgaga

SEQ ID NO: 283706 - DNA, 20 bp, Artificial Sequence
  chemically synthesized
acccgcttaacagaaactat

SEQ ID NO: 283707 - DNA, 20 bp, Artificial Sequence
  chemically synthesized
tctttctcatagtttctgtt

SEQ ID NO: 283708 - DNA, 20 bp, Artificial Sequence
  chemically synthesized
ttctcatagtttctgttaag

SEQ ID NO: 283709 - DNA, 20 bp, Artificial Sequence
  chemically synthesized
tctcatagtttctgttaagc

SEQ ID NO: 283710 - DNA, 20 bp, Artificial Sequence
  chemically synthesized
aacatttgagacccgcttaa

SEQ ID NO: 283711 - DNA, 20 bp, Artificial Sequence
  chemically synthesized
cttcagctcatggaacattt

SEQ ID NO: 283712 - DNA, 20 bp, Artificial Sequence
  chemically synthesized
gcgggtctcaaatgttccat

SEQ ID NO: 283713 - DNA, 20 bp, Artificial Sequence
  chemically synthesized
ctcaaatgttccatgagctg

SEQ ID NO: 283714 - DNA, 20 bp, Artificial Sequence
  chemically synthesized
catgctccttcttcagctca

SEQ ID NO: 283715 - DNA, 20 bp, Artificial Sequence
  chemically synthesized
aaatgttccatgagctgaag

SEQ ID NO: 283716 - DNA, 20 bp, Artificial Sequence
  chemically synthesized
aatgttccatgagctgaaga

SEQ ID NO: 283717 - DNA, 20 bp, Artificial Sequence
  chemically synthesized
tgttccatgagctgaagaag

SEQ ID NO: 283718 - DNA, 20 bp, Artificial Sequence
  chemically synthesized
actacagcatgctccttctt

SEQ ID NO: 283719 - DNA, 20 bp, Artificial Sequence
  chemically synthesized
gctgaagaaggagcatgctg

SEQ ID NO: 283720 - DNA, 20 bp, Artificial Sequence
  chemically synthesized
aagaaggagcatgctgtagt

SEQ ID NO: 283721 - DNA, 20 bp, Artificial Sequence
  chemically synthesized
tttattcattagactgacta

SEQ ID NO: 283722 - DNA, 20 bp, Artificial Sequence
  chemically synthesized
taaattgtaattttattcat

SEQ ID NO: 283723 - DNA, 20 bp, Artificial Sequence
  chemically synthesized
ttgcttgggttatttataat

SEQ ID NO: 283724 - DNA, 20 bp, Artificial Sequence
  chemically synthesized
atgctcattataaataaccc

SEQ ID NO: 283725 - DNA, 20 bp, Artificial Sequence
  chemically synthesized
acatttttatatagttgctt

SEQ ID NO: 283726 - DNA, 20 bp, Artificial Sequence
  chemically synthesized
tacatttttatatagttgct

SEQ ID NO: 283727 - DNA, 20 bp, Artificial Sequence
  chemically synthesized
cttcattctacatttttata

SEQ ID NO: 283728 - DNA, 20 bp, Artificial Sequence
  chemically synthesized
caagcaactatataaaaatg

SEQ ID NO: 283729 - DNA, 20 bp, Artificial Sequence
  chemically synthesized
ctatataaaaatgtagaatg

SEQ ID NO: 283730 - DNA, 20 bp, Artificial Sequence
  chemically synthesized
atgaagaacacttctttcca

SEQ ID NO: 283731 - DNA, 20 bp, Artificial Sequence
  chemically synthesized
agtctaaaaaccatggaaag

SEQ ID NO: 283732 - DNA, 20 bp, Artificial Sequence
  chemically synthesized
tgaagtctaaaaaccatgga

SEQ ID NO: 283733 - DNA, 20 bp, Artificial Sequence
  chemically synthesized
acacttctttccatggtttt

SEQ ID NO: 283734 - DNA, 20 bp, Artificial Sequence
  chemically synthesized
tatatgaagtctaaaaacca

SEQ ID NO: 283735 - DNA, 20 bp, Artificial Sequence
  chemically synthesized
tattaaaccaagaatatatg

SEQ ID NO: 283736 - DNA, 20 bp, Artificial Sequence
  chemically synthesized
ttttagacttcatatattct

SEQ ID NO: 283737 - DNA, 20 bp, Artificial Sequence
  chemically synthesized
tctgagcctcttattaaacc

SEQ ID NO: 283738 - DNA, 20 bp, Artificial Sequence
  chemically synthesized
tcatatattcttggtttaat

SEQ ID NO: 283739 - DNA, 20 bp, Artificial Sequence
  chemically synthesized
atatattcttggtttaataa

SEQ ID NO: 283740 - DNA, 20 bp, Artificial Sequence
  chemically synthesized
tatattcttggtttaataag

SEQ ID NO: 283741 - DNA, 20 bp, Artificial Sequence
  chemically synthesized
tcttggtttaataagaggct

SEQ ID NO: 283742 - DNA, 20 bp, Artificial Sequence
  chemically synthesized
ttaataagaggctcagatct

SEQ ID NO: 283743 - DNA, 20 bp, Artificial Sequence
  chemically synthesized
taataagaggctcagatctt

SEQ ID NO: 283744 - DNA, 20 bp, Artificial Sequence
  chemically synthesized
tcgaacctttcccaagatct

SEQ ID NO: 283745 - DNA, 20 bp, Artificial Sequence
  chemically synthesized
aagaggctcagatcttggga

SEQ ID NO: 283746 - DNA, 20 bp, Artificial Sequence
  chemically synthesized
agaggctcagatcttgggaa

SEQ ID NO: 283747 - DNA, 20 bp, Artificial Sequence
  chemically synthesized
ttgttcttcgaacctttccc

SEQ ID NO: 283748 - DNA, 20 bp, Artificial Sequence
  chemically synthesized
cagatcttgggaaaggttcg

SEQ ID NO: 283749 - DNA, 20 bp, Artificial Sequence
  chemically synthesized
ggaaaggttcgaagaacaaa

SEQ ID NO: 283750 - DNA, 20 bp, Artificial Sequence
  chemically synthesized
aacagcaaaatttattaatc

SEQ ID NO: 283751 - DNA, 20 bp, Artificial Sequence
  chemically synthesized
acagcaaaatttattaatcc

SEQ ID NO: 283752 - DNA, 20 bp, Artificial Sequence
  chemically synthesized
cttctttcctcatatgtacc

SEQ ID NO: 283753 - DNA, 20 bp, Artificial Sequence
  chemically synthesized
ttattaatccaggtacatat

SEQ ID NO: 283754 - DNA, 20 bp, Artificial Sequence
  chemically synthesized
tattaatccaggtacatatg

SEQ ID NO: 283755 - DNA, 20 bp, Artificial Sequence
  chemically synthesized
aatccaggtacatatgagga

SEQ ID NO: 283756 - DNA, 20 bp, Artificial Sequence
  chemically synthesized
ccaggtacatatgaggaaag

SEQ ID NO: 283757 - DNA, 20 bp, Artificial Sequence
  chemically synthesized
atgatgatgaatttctctac

SEQ ID NO: 283758 - DNA, 20 bp, Artificial Sequence
  chemically synthesized
tgatgatgaatttctctact

SEQ ID NO: 283759 - DNA, 20 bp, Artificial Sequence
  chemically synthesized
atgatgaatttctctactag

SEQ ID NO: 283760 - DNA, 20 bp, Artificial Sequence
  chemically synthesized
ttctaccttttctcctagta

SEQ ID NO: 283761 - DNA, 20 bp, Artificial Sequence
  chemically synthesized
ctttctaccttttctcctag

SEQ ID NO: 283762 - DNA, 20 bp, Artificial Sequence
  chemically synthesized
gaatttctctactaggagaa

SEQ ID NO: 283763 - DNA, 20 bp, Artificial Sequence
  chemically synthesized
aatttctctactaggagaaa

SEQ ID NO: 283764 - DNA, 20 bp, Artificial Sequence
  chemically synthesized
tagctttctaccttttctcc

SEQ ID NO: 283765 - DNA, 20 bp, Artificial Sequence
  chemically synthesized
ttctctactaggagaaaagg

SEQ ID NO: 283766 - DNA, 20 bp, Artificial Sequence
  chemically synthesized
ctactaggagaaaaggtaga

SEQ ID NO: 283767 - DNA, 20 bp, Artificial Sequence
  chemically synthesized
aaggtagaaagctaaatgac

SEQ ID NO: 283768 - DNA, 20 bp, Artificial Sequence
  chemically synthesized
tagaaactgtaccagtcatt

SEQ ID NO: 283769 - DNA, 20 bp, Artificial Sequence
  chemically synthesized
agaaagctaaatgactggta

SEQ ID NO: 283770 - DNA, 20 bp, Artificial Sequence
  chemically synthesized
gatttgtatagaaactgtac

SEQ ID NO: 283771 - DNA, 20 bp, Artificial Sequence
  chemically synthesized
cgtttttatgaggatttgta

SEQ ID NO: 283772 - DNA, 20 bp, Artificial Sequence
  chemically synthesized
caagagccaccgtttttatg

SEQ ID NO: 283773 - DNA, 20 bp, Artificial Sequence
  chemically synthesized
tatacaaatcctcataaaaa

SEQ ID NO: 283774 - DNA, 20 bp, Artificial Sequence
  chemically synthesized
acaagagccaccgtttttat

SEQ ID NO: 283775 - DNA, 20 bp, Artificial Sequence
  chemically synthesized
acaaatcctcataaaaacgg

SEQ ID NO: 283776 - DNA, 20 bp, Artificial Sequence
  chemically synthesized
agattcatggaaagaaacaa

SEQ ID NO: 283777 - DNA, 20 bp, Artificial Sequence
  chemically synthesized
ttagattcatggaaagaaac

SEQ ID NO: 283778 - DNA, 20 bp, Artificial Sequence
  chemically synthesized
atcatagttagattcatgga

SEQ ID NO: 283779 - DNA, 20 bp, Artificial Sequence
  chemically synthesized
gcatatcatagttagattca

SEQ ID NO: 283780 - DNA, 20 bp, Artificial Sequence
  chemically synthesized
atggcagagcatatcatagt

SEQ ID NO: 283781 - DNA, 20 bp, Artificial Sequence
  chemically synthesized
aaagatggcagagcatatca

SEQ ID NO: 283782 - DNA, 20 bp, Artificial Sequence
  chemically synthesized
cctagcaatgaaagatggca

SEQ ID NO: 283783 - DNA, 20 bp, Artificial Sequence
  chemically synthesized
atcctagcaatgaaagatgg

SEQ ID NO: 283784 - DNA, 20 bp, Artificial Sequence
  chemically synthesized
gaaatcctagcaatgaaaga

SEQ ID NO: 283785 - DNA, 20 bp, Artificial Sequence
  chemically synthesized
gctctgccatctttcattgc

SEQ ID NO: 283786 - DNA, 20 bp, Artificial Sequence
  chemically synthesized
gtgtgaaatcctagcaatga

SEQ ID NO: 283787 - DNA, 20 bp, Artificial Sequence
  chemically synthesized
ctctgccatctttcattgct

SEQ ID NO: 283788 - DNA, 20 bp, Artificial Sequence
  chemically synthesized
gaagcacgggtgtgaaatcc

SEQ ID NO: 283789 - DNA, 20 bp, Artificial Sequence
  chemically synthesized
gtgctcactttaagaagcac

SEQ ID NO: 283790 - DNA, 20 bp, Artificial Sequence
  chemically synthesized
ggtgctcactttaagaagca

SEQ ID NO: 283791 - DNA, 20 bp, Artificial Sequence
  chemically synthesized
tttcacacccgtgcttctta

SEQ ID NO: 283792 - DNA, 20 bp, Artificial Sequence
  chemically synthesized
ccaagggtgctcactttaag

SEQ ID NO: 283793 - DNA, 20 bp, Artificial Sequence
  chemically synthesized
acacccgtgcttcttaaagt

SEQ ID NO: 283794 - DNA, 20 bp, Artificial Sequence
  chemically synthesized
attccaagggtgctcacttt

SEQ ID NO: 283795 - DNA, 20 bp, Artificial Sequence
  chemically synthesized
cttcttaaagtgagcaccct

SEQ ID NO: 283796 - DNA, 20 bp, Artificial Sequence
  chemically synthesized
aagttgcagagtgattccaa

SEQ ID NO: 283797 - DNA, 20 bp, Artificial Sequence
  chemically synthesized
caagttgcagagtgattcca

SEQ ID NO: 283798 - DNA, 20 bp, Artificial Sequence
  chemically synthesized
acaagttgcagagtgattcc

SEQ ID NO: 283799 - DNA, 20 bp, Artificial Sequence
  chemically synthesized
ataccaaagaacaagttgca

SEQ ID NO: 283800 - DNA, 20 bp, Artificial Sequence
  chemically synthesized
tgataccaaagaacaagttg

SEQ ID NO: 283801 - DNA, 20 bp, Artificial Sequence
  chemically synthesized
tcactctgcaacttgttctt

SEQ ID NO: 283802 - DNA, 20 bp, Artificial Sequence
  chemically synthesized
tgagtttgataccaaagaac

SEQ ID NO: 283803 - DNA, 20 bp, Artificial Sequence
  chemically synthesized
caagtttgagtttgatacca

SEQ ID NO: 283804 - DNA, 20 bp, Artificial Sequence
  chemically synthesized
ttttcatttttaacaagttt

SEQ ID NO: 283805 - DNA, 20 bp, Artificial Sequence
  chemically synthesized
tgtagtttttcatttttaac

SEQ ID NO: 283806 - DNA, 20 bp, Artificial Sequence
  chemically synthesized
ttgttaaaaatgaaaaacta

SEQ ID NO: 283807 - DNA, 20 bp, Artificial Sequence
  chemically synthesized
tgttaaaaatgaaaaactac

SEQ ID NO: 283808 - DNA, 20 bp, Artificial Sequence
  chemically synthesized
tgagtcttgggtgaggcctg

SEQ ID NO: 283809 - DNA, 20 bp, Artificial Sequence
  chemically synthesized
aaaaactacaggcctcaccc

SEQ ID NO: 283810 - DNA, 20 bp, Artificial Sequence
  chemically synthesized
gattcagtgagtcttgggtg

SEQ ID NO: 283811 - DNA, 20 bp, Artificial Sequence
  chemically synthesized
tgattcagtgagtcttgggt

SEQ ID NO: 283812 - DNA, 20 bp, Artificial Sequence
  chemically synthesized
tttctgattcagtgagtctt

SEQ ID NO: 283813 - DNA, 20 bp, Artificial Sequence
  chemically synthesized
atttctgattcagtgagtct

SEQ ID NO: 283814 - DNA, 20 bp, Artificial Sequence
  chemically synthesized
tcacccaagactcactgaat

SEQ ID NO: 283815 - DNA, 20 bp, Artificial Sequence
  chemically synthesized
cccagaatttctgattcagt

SEQ ID NO: 283816 - DNA, 20 bp, Artificial Sequence
  chemically synthesized
tgaccccagaatttctgatt

SEQ ID NO: 283817 - DNA, 20 bp, Artificial Sequence
  chemically synthesized
actcactgaatcagaaattc

SEQ ID NO: 283818 - DNA, 20 bp, Artificial Sequence
  chemically synthesized
ctcactgaatcagaaattct

SEQ ID NO: 283819 - DNA, 20 bp, Artificial Sequence
  chemically synthesized
tcactgaatcagaaattctg

SEQ ID NO: 283820 - DNA, 20 bp, Artificial Sequence
  chemically synthesized
tgaatcagaaattctggggt

SEQ ID NO: 283821 - DNA, 20 bp, Artificial Sequence
  chemically synthesized
gaatcagaaattctggggtc

SEQ ID NO: 283822 - DNA, 20 bp, Artificial Sequence
  chemically synthesized
aatcagaaattctggggtca

SEQ ID NO: 283823 - DNA, 20 bp, Artificial Sequence
  chemically synthesized
agagtgctgggccctgaccc

SEQ ID NO: 283824 - DNA, 20 bp, Artificial Sequence
  chemically synthesized
gaaattctggggtcagggcc

SEQ ID NO: 283825 - DNA, 20 bp, Artificial Sequence
  chemically synthesized
tgtttaatacacagagtgct

SEQ ID NO: 283826 - DNA, 20 bp, Artificial Sequence
  chemically synthesized
ttgtttaatacacagagtgc

SEQ ID NO: 283827 - DNA, 20 bp, Artificial Sequence
  chemically synthesized
gaagtcttgtttaatacaca

SEQ ID NO: 283828 - DNA, 20 bp, Artificial Sequence
  chemically synthesized
tggaagtcttgtttaataca

SEQ ID NO: 283829 - DNA, 20 bp, Artificial Sequence
  chemically synthesized
cagcactctgtgtattaaac

SEQ ID NO: 283830 - DNA, 20 bp, Artificial Sequence
  chemically synthesized
tgtgtattaaacaagacttc

SEQ ID NO: 283831 - DNA, 20 bp, Artificial Sequence
  chemically synthesized
gtgtattaaacaagacttcc

SEQ ID NO: 283832 - DNA, 20 bp, Artificial Sequence
  chemically synthesized
tggacatcagaatcacctgg

SEQ ID NO: 283833 - DNA, 20 bp, Artificial Sequence
  chemically synthesized
gaatggacatcagaatcacc

SEQ ID NO: 283834 - DNA, 20 bp, Artificial Sequence
  chemically synthesized
tcctgcatctgaatggacat

SEQ ID NO: 283835 - DNA, 20 bp, Artificial Sequence
  chemically synthesized
aggtgattctgatgtccatt

SEQ ID NO: 283836 - DNA, 20 bp, Artificial Sequence
  chemically synthesized
cagtgattcctgcatctgaa

SEQ ID NO: 283837 - DNA, 20 bp, Artificial Sequence
  chemically synthesized
ttctgatgtccattcagatg

SEQ ID NO: 283838 - DNA, 20 bp, Artificial Sequence
  chemically synthesized
tctgatgtccattcagatgc

SEQ ID NO: 283839 - DNA, 20 bp, Artificial Sequence
  chemically synthesized
agatgcaggaatcactgctg

SEQ ID NO: 283840 - DNA, 20 bp, Artificial Sequence
  chemically synthesized
aatttgtataatcactacag

SEQ ID NO: 283841 - DNA, 20 bp, Artificial Sequence
  chemically synthesized
ataaatttgtataatcacta

SEQ ID NO: 283842 - DNA, 20 bp, Artificial Sequence
  chemically synthesized
acttacacataaagtgagaa

SEQ ID NO: 283843 - DNA, 20 bp, Artificial Sequence
  chemically synthesized
ccagaacttacacataaagt

SEQ ID NO: 283844 - DNA, 20 bp, Artificial Sequence
  chemically synthesized
actattctcactttatgtgt

SEQ ID NO: 283845 - DNA, 20 bp, Artificial Sequence
  chemically synthesized
cttaccagaacttacacata

SEQ ID NO: 283846 - DNA, 20 bp, Artificial Sequence
  chemically synthesized
ctcactttatgtgtaagttc

SEQ ID NO: 283847 - DNA, 20 bp, Artificial Sequence
  chemically synthesized
ctttatgtgtaagttctggt

SEQ ID NO: 283848 - DNA, 20 bp, Artificial Sequence
  chemically synthesized
actctagtactagtgcttac

SEQ ID NO: 283849 - DNA, 20 bp, Artificial Sequence
  chemically synthesized
gtgtaagttctggtaagcac

SEQ ID NO: 283850 - DNA, 20 bp, Artificial Sequence
  chemically synthesized
gttctggtaagcactagtac

SEQ ID NO: 283851 - DNA, 20 bp, Artificial Sequence
  chemically synthesized
tctggtaagcactagtacta

SEQ ID NO: 283852 - DNA, 20 bp, Artificial Sequence
  chemically synthesized
ctctattataactctagtac

SEQ ID NO: 283853 - DNA, 20 bp, Artificial Sequence
  chemically synthesized
tttttactctattataactc

SEQ ID NO: 283854 - DNA, 20 bp, Artificial Sequence
  chemically synthesized
cactagtactagagttataa

SEQ ID NO: 283855 - DNA, 20 bp, Artificial Sequence
  chemically synthesized
ctagtactagagttataata

SEQ ID NO: 283856 - DNA, 20 bp, Artificial Sequence
  chemically synthesized
aaattaaaaaaaaataaaac

SEQ ID NO: 283857 - DNA, 20 bp, Artificial Sequence
  chemically synthesized
cactctggaaagttattaac

SEQ ID NO: 283858 - DNA, 20 bp, Artificial Sequence
  chemically synthesized
aaaaccagttaataactttc

SEQ ID NO: 283859 - DNA, 20 bp, Artificial Sequence
  chemically synthesized
aaccagttaataactttcca

SEQ ID NO: 283860 - DNA, 20 bp, Artificial Sequence
  chemically synthesized
cctttgaaaaacactctgga

SEQ ID NO: 283861 - DNA, 20 bp, Artificial Sequence
  chemically synthesized
aaaccctttgaaaaacactc

SEQ ID NO: 283862 - DNA, 20 bp, Artificial Sequence
  chemically synthesized
actttccagagtgtttttca

SEQ ID NO: 283863 - DNA, 20 bp, Artificial Sequence
  chemically synthesized
ctttccagagtgtttttcaa

SEQ ID NO: 283864 - DNA, 20 bp, Artificial Sequence
  chemically synthesized
tttccagagtgtttttcaaa

SEQ ID NO: 283865 - DNA, 20 bp, Artificial Sequence
  chemically synthesized
gagtgtttttcaaagggttt

SEQ ID NO: 283866 - DNA, 20 bp, Artificial Sequence
  chemically synthesized
tttcaaagggttttagtata

SEQ ID NO: 283867 - DNA, 20 bp, Artificial Sequence
  chemically synthesized
tagtataaagttttaccata

SEQ ID NO: 283868 - DNA, 20 bp, Artificial Sequence
  chemically synthesized
ggagatcagcaatcactata

SEQ ID NO: 283869 - DNA, 20 bp, Artificial Sequence
  chemically synthesized
tttaaaacttttatggagat

SEQ ID NO: 283870 - DNA, 20 bp, Artificial Sequence
  chemically synthesized
gtgattgctgatctccataa

SEQ ID NO: 283871 - DNA, 20 bp, Artificial Sequence
  chemically synthesized
ctgactttaaaacttttatg

SEQ ID NO: 283872 - DNA, 20 bp, Artificial Sequence
  chemically synthesized
ctctgactttaaaactttta

SEQ ID NO: 283873 - DNA, 20 bp, Artificial Sequence
  chemically synthesized
tgatctccataaaagtttta

SEQ ID NO: 283874 - DNA, 20 bp, Artificial Sequence
  chemically synthesized
ctccataaaagttttaaagt

SEQ ID NO: 283875 - DNA, 20 bp, Artificial Sequence
  chemically synthesized
ccataaaagttttaaagtca

SEQ ID NO: 283876 - DNA, 20 bp, Artificial Sequence
  chemically synthesized
cataaaagttttaaagtcag

SEQ ID NO: 283877 - DNA, 20 bp, Artificial Sequence
  chemically synthesized
ttgtttatcaaactgtaccc

SEQ ID NO: 283878 - DNA, 20 bp, Artificial Sequence
  chemically synthesized
tgtttatcaaactgtaccct

SEQ ID NO: 283879 - DNA, 20 bp, Artificial Sequence
  chemically synthesized
acataaaagaacccagggta

SEQ ID NO: 283880 - DNA, 20 bp, Artificial Sequence
  chemically synthesized
ttttgacataaaagaaccca

SEQ ID NO: 283881 - DNA, 20 bp, Artificial Sequence
  chemically synthesized
tttttgacataaaagaaccc

SEQ ID NO: 283882 - DNA, 20 bp, Artificial Sequence
  chemically synthesized
ttttttgacataaaagaacc

SEQ ID NO: 283883 - DNA, 20 bp, Artificial Sequence
  chemically synthesized
ggaaagtttttttgacataa

SEQ ID NO: 283884 - DNA, 20 bp, Artificial Sequence
  chemically synthesized
gtcaaaaaaactttcctttt

SEQ ID NO: 283885 - DNA, 20 bp, Artificial Sequence
  chemically synthesized
tatttttcccctgaaaagga

SEQ ID NO: 283886 - DNA, 20 bp, Artificial Sequence
  chemically synthesized
tcaaaaaaactttccttttc

SEQ ID NO: 283887 - DNA, 20 bp, Artificial Sequence
  chemically synthesized
caaaaaaactttccttttca

SEQ ID NO: 283888 - DNA, 20 bp, Artificial Sequence
  chemically synthesized
aaaaaaactttccttttcag

SEQ ID NO: 283889 - DNA, 20 bp, Artificial Sequence
  chemically synthesized
aacttatttttcccctgaaa

SEQ ID NO: 283890 - DNA, 20 bp, Artificial Sequence
  chemically synthesized
taacttatttttcccctgaa

SEQ ID NO: 283891 - DNA, 20 bp, Artificial Sequence
  chemically synthesized
ttccttttcaggggaaaaat

SEQ ID NO: 283892 - DNA, 20 bp, Artificial Sequence
  chemically synthesized
ggaaaaataagttattaaaa

SEQ ID NO: 283893 - DNA, 20 bp, Artificial Sequence
  chemically synthesized
taaaacagcacttccatttt

SEQ ID NO: 283894 - DNA, 20 bp, Artificial Sequence
  chemically synthesized
tgtgttttacctgaaaatgg

SEQ ID NO: 283895 - DNA, 20 bp, Artificial Sequence
  chemically synthesized
aaaacagcacttccattttc

SEQ ID NO: 283896 - DNA, 20 bp, Artificial Sequence
  chemically synthesized
tcctgtgttttacctgaaaa

SEQ ID NO: 283897 - DNA, 20 bp, Artificial Sequence
  chemically synthesized
ttccattttcaggtaaaaca

SEQ ID NO: 283898 - DNA, 20 bp, Artificial Sequence
  chemically synthesized
tccattttcaggtaaaacac

SEQ ID NO: 283899 - DNA, 20 bp, Artificial Sequence
  chemically synthesized
ttttcaggtaaaacacagga

SEQ ID NO: 283900 - DNA, 20 bp, Artificial Sequence
  chemically synthesized
aacacaggaaagaacataaa

SEQ ID NO: 283901 - DNA, 20 bp, Artificial Sequence
  chemically synthesized
acaggaaagaacataaacag

SEQ ID NO: 283902 - DNA, 20 bp, Artificial Sequence
  chemically synthesized
caggaaagaacataaacaga

SEQ ID NO: 283903 - DNA, 20 bp, Artificial Sequence
  chemically synthesized
aggaaagaacataaacagaa

SEQ ID NO: 283904 - DNA, 20 bp, Artificial Sequence
  chemically synthesized
ggaaagaacataaacagaag

SEQ ID NO: 283905 - DNA, 20 bp, Artificial Sequence
  chemically synthesized
gaaagaacataaacagaagg

SEQ ID NO: 283906 - DNA, 20 bp, Artificial Sequence
  chemically synthesized
aaagaacataaacagaaggg

SEQ ID NO: 283907 - DNA, 20 bp, Artificial Sequence
  chemically synthesized
aagaacataaacagaagggg

SEQ ID NO: 283908 - DNA, 20 bp, Artificial Sequence
  chemically synthesized
tgatactcaaagaagaaata

SEQ ID NO: 283909 - DNA, 20 bp, Artificial Sequence
  chemically synthesized
cctgatactcaaagaagaaa

SEQ ID NO: 283910 - DNA, 20 bp, Artificial Sequence
  chemically synthesized
ggggtctctatttcttcttt

SEQ ID NO: 283911 - DNA, 20 bp, Artificial Sequence
  chemically synthesized
tctctccctgatactcaaag

SEQ ID NO: 283912 - DNA, 20 bp, Artificial Sequence
  chemically synthesized
tctatttcttctttgagtat

SEQ ID NO: 283913 - DNA, 20 bp, Artificial Sequence
  chemically synthesized
acatctctccctgatactca

SEQ ID NO: 283914 - DNA, 20 bp, Artificial Sequence
  chemically synthesized
ctatttcttctttgagtatc

SEQ ID NO: 283915 - DNA, 20 bp, Artificial Sequence
  chemically synthesized
tatttcttctttgagtatca

SEQ ID NO: 283916 - DNA, 20 bp, Artificial Sequence
  chemically synthesized
tttcttctttgagtatcagg

SEQ ID NO: 283917 - DNA, 20 bp, Artificial Sequence
  chemically synthesized
tcttctttgagtatcaggga

SEQ ID NO: 283918 - DNA, 20 bp, Artificial Sequence
  chemically synthesized
atcagggagagatgtcaaaa

SEQ ID NO: 283919 - DNA, 20 bp, Artificial Sequence
  chemically synthesized
tcagggagagatgtcaaaat

SEQ ID NO: 283920 - DNA, 20 bp, Artificial Sequence
  chemically synthesized
agatgtcaaaataggtctgt

SEQ ID NO: 283921 - DNA, 20 bp, Artificial Sequence
  chemically synthesized
ttattgtcagaagatactaa

SEQ ID NO: 283922 - DNA, 20 bp, Artificial Sequence
  chemically synthesized
taatttttctttattgtcag

SEQ ID NO: 283923 - DNA, 20 bp, Artificial Sequence
  chemically synthesized
gttagtatcttctgacaata

SEQ ID NO: 283924 - DNA, 20 bp, Artificial Sequence
  chemically synthesized
agctaatttttctttattgt

SEQ ID NO: 283925 - DNA, 20 bp, Artificial Sequence
  chemically synthesized
ttctgacaataaagaaaaat

SEQ ID NO: 283926 - DNA, 20 bp, Artificial Sequence
  chemically synthesized
agaaaaattagctatcaaat

SEQ ID NO: 283927 - DNA, 20 bp, Artificial Sequence
  chemically synthesized
ttctacctgtgctcatttga

SEQ ID NO: 283928 - DNA, 20 bp, Artificial Sequence
  chemically synthesized
aattagctatcaaatgagca

SEQ ID NO: 283929 - DNA, 20 bp, Artificial Sequence
  chemically synthesized
attagctatcaaatgagcac

SEQ ID NO: 283930 - DNA, 20 bp, Artificial Sequence
  chemically synthesized
agctatcaaatgagcacagg

SEQ ID NO: 283931 - DNA, 20 bp, Artificial Sequence
  chemically synthesized
tatcaaatgagcacaggtag

SEQ ID NO: 283932 - DNA, 20 bp, Artificial Sequence
  chemically synthesized
aatgagcacaggtagaagtc

SEQ ID NO: 283933 - DNA, 20 bp, Artificial Sequence
  chemically synthesized
gcacaggtagaagtctggac

SEQ ID NO: 283934 - DNA, 20 bp, Artificial Sequence
  chemically synthesized
cacaggtagaagtctggaca

SEQ ID NO: 283935 - DNA, 20 bp, Artificial Sequence
  chemically synthesized
gttagcaatagtaccttgtc

SEQ ID NO: 283936 - DNA, 20 bp, Artificial Sequence
  chemically synthesized
cactacctggaggttagcaa

SEQ ID NO: 283937 - DNA, 20 bp, Artificial Sequence
  chemically synthesized
aaggtactattgctaacctc

SEQ ID NO: 283938 - DNA, 20 bp, Artificial Sequence
  chemically synthesized
aggtactattgctaacctcc

SEQ ID NO: 283939 - DNA, 20 bp, Artificial Sequence
  chemically synthesized
caacttcactacctggaggt

SEQ ID NO: 283940 - DNA, 20 bp, Artificial Sequence
  chemically synthesized
tactattgctaacctccagg

SEQ ID NO: 283941 - DNA, 20 bp, Artificial Sequence
  chemically synthesized
aaggcaacttcactacctgg

SEQ ID NO: 283942 - DNA, 20 bp, Artificial Sequence
  chemically synthesized
taaggcaacttcactacctg

SEQ ID NO: 283943 - DNA, 20 bp, Artificial Sequence
  chemically synthesized
ttgctaacctccaggtagtg

SEQ ID NO: 283944 - DNA, 20 bp, Artificial Sequence
  chemically synthesized
tttaaggcaacttcactacc

SEQ ID NO: 283945 - DNA, 20 bp, Artificial Sequence
  chemically synthesized
caggtagtgaagttgcctta

SEQ ID NO: 283946 - DNA, 20 bp, Artificial Sequence
  chemically synthesized
tactcaagacagtttcttta

SEQ ID NO: 283947 - DNA, 20 bp, Artificial Sequence
  chemically synthesized
ctactcaagacagtttcttt

SEQ ID NO: 283948 - DNA, 20 bp, Artificial Sequence
  chemically synthesized
tgccttaaagaaactgtctt

SEQ ID NO: 283949 - DNA, 20 bp, Artificial Sequence
  chemically synthesized
cttaaagaaactgtcttgag

SEQ ID NO: 283950 - DNA, 20 bp, Artificial Sequence
  chemically synthesized
tttcagcctgctactcaaga

SEQ ID NO: 283951 - DNA, 20 bp, Artificial Sequence
  chemically synthesized
aaagaaactgtcttgagtag

SEQ ID NO: 283952 - DNA, 20 bp, Artificial Sequence
  chemically synthesized
aagaaactgtcttgagtagc

SEQ ID NO: 283953 - DNA, 20 bp, Artificial Sequence
  chemically synthesized
gagttttcagcctgctactc

SEQ ID NO: 283954 - DNA, 20 bp, Artificial Sequence
  chemically synthesized
gagtagcaggctgaaaactc

SEQ ID NO: 283955 - DNA, 20 bp, Artificial Sequence
  chemically synthesized
gatttcatttcttgagtttt

SEQ ID NO: 283956 - DNA, 20 bp, Artificial Sequence
  chemically synthesized
gcaggaagatttcatttctt

SEQ ID NO: 283957 - DNA, 20 bp, Artificial Sequence
  chemically synthesized
ccactggaagagttggcagg

SEQ ID NO: 283958 - DNA, 20 bp, Artificial Sequence
  chemically synthesized
caaccactggaagagttggc

SEQ ID NO: 283959 - DNA, 20 bp, Artificial Sequence
  chemically synthesized
acaaccactggaagagttgg

SEQ ID NO: 283960 - DNA, 20 bp, Artificial Sequence
  chemically synthesized
aatcttcctgccaactcttc

SEQ ID NO: 283961 - DNA, 20 bp, Artificial Sequence
  chemically synthesized
gcaacaaccactggaagagt

SEQ ID NO: 283962 - DNA, 20 bp, Artificial Sequence
  chemically synthesized
cttcctgccaactcttccag

SEQ ID NO: 283963 - DNA, 20 bp, Artificial Sequence
  chemically synthesized
tctggcaacaaccactggaa

SEQ ID NO: 283964 - DNA, 20 bp, Artificial Sequence
  chemically synthesized
cctctggcaacaaccactgg

SEQ ID NO: 283965 - DNA, 20 bp, Artificial Sequence
  chemically synthesized
aagcctctggcaacaaccac

SEQ ID NO: 283966 - DNA, 20 bp, Artificial Sequence
  chemically synthesized
actcttccagtggttgttgc

SEQ ID NO: 283967 - DNA, 20 bp, Artificial Sequence
  chemically synthesized
tcttccagtggttgttgcca

SEQ ID NO: 283968 - DNA, 20 bp, Artificial Sequence
  chemically synthesized
cttccagtggttgttgccag

SEQ ID NO: 283969 - DNA, 20 bp, Artificial Sequence
  chemically synthesized
aggtaaactctggaagcctc

SEQ ID NO: 283970 - DNA, 20 bp, Artificial Sequence
  chemically synthesized
tggttgttgccagaggcttc

SEQ ID NO: 283971 - DNA, 20 bp, Artificial Sequence
  chemically synthesized
gttgttgccagaggcttcca

SEQ ID NO: 283972 - DNA, 20 bp, Artificial Sequence
  chemically synthesized
taaaaagaggtaaactctgg

SEQ ID NO: 283973 - DNA, 20 bp, Artificial Sequence
  chemically synthesized
tagtaaaaagaggtaaactc

SEQ ID NO: 283974 - DNA, 20 bp, Artificial Sequence
  chemically synthesized
atgggggtgatagtaaaaag

SEQ ID NO: 283975 - DNA, 20 bp, Artificial Sequence
  chemically synthesized
tatgggggtgatagtaaaaa

SEQ ID NO: 283976 - DNA, 20 bp, Artificial Sequence
  chemically synthesized
agtatgggggtgatagtaaa

SEQ ID NO: 283977 - DNA, 20 bp, Artificial Sequence
  chemically synthesized
ttggtttagtatgggggtga

SEQ ID NO: 283978 - DNA, 20 bp, Artificial Sequence
  chemically synthesized
acaaaattggtttagtatgg

SEQ ID NO: 283979 - DNA, 20 bp, Artificial Sequence
  chemically synthesized
tacaaaattggtttagtatg

SEQ ID NO: 283980 - DNA, 20 bp, Artificial Sequence
  chemically synthesized
ctacaaaattggtttagtat

SEQ ID NO: 283981 - DNA, 20 bp, Artificial Sequence
  chemically synthesized
gctacaaaattggtttagta

SEQ ID NO: 283982 - DNA, 20 bp, Artificial Sequence
  chemically synthesized
gtctagctacaaaattggtt

SEQ ID NO: 283983 - DNA, 20 bp, Artificial Sequence
  chemically synthesized
cccatactaaaccaattttg

SEQ ID NO: 283984 - DNA, 20 bp, Artificial Sequence
  chemically synthesized
aattggtctagctacaaaat

SEQ ID NO: 283985 - DNA, 20 bp, Artificial Sequence
  chemically synthesized
tactaaaccaattttgtagc

SEQ ID NO: 283986 - DNA, 20 bp, Artificial Sequence
  chemically synthesized
acatgttttgataattggtc

SEQ ID NO: 283987 - DNA, 20 bp, Artificial Sequence
  chemically synthesized
gattgacatgttttgataat

SEQ ID NO: 283988 - DNA, 20 bp, Artificial Sequence
  chemically synthesized
tcaaaacatgtcaatcaatg

SEQ ID NO: 283989 - DNA, 20 bp, Artificial Sequence
  chemically synthesized
atcaatgtagacaaatttgt

SEQ ID NO: 283990 - DNA, 20 bp, Artificial Sequence
  chemically synthesized
tttgttggaacactcatttc

SEQ ID NO: 283991 - DNA, 20 bp, Artificial Sequence
  chemically synthesized
ttgttggaacactcatttca

SEQ ID NO: 283992 - DNA, 20 bp, Artificial Sequence
  chemically synthesized
ttgaaaaccatccttgaaat

SEQ ID NO: 283993 - DNA, 20 bp, Artificial Sequence
  chemically synthesized
tggaacactcatttcaagga

SEQ ID NO: 283994 - DNA, 20 bp, Artificial Sequence
  chemically synthesized
ttttcaaattttaaaaattt

SEQ ID NO: 283995 - DNA, 20 bp, Artificial Sequence
  chemically synthesized
caaattttaaaaatttgaga

SEQ ID NO: 283996 - DNA, 20 bp, Artificial Sequence
  chemically synthesized
aaatttgagacagtttactc

SEQ ID NO: 283997 - DNA, 20 bp, Artificial Sequence
  chemically synthesized
atttgagacagtttactcta

SEQ ID NO: 283998 - DNA, 20 bp, Artificial Sequence
  chemically synthesized
agacagtttactctagagca

SEQ ID NO: 283999 - DNA, 20 bp, Artificial Sequence
  chemically synthesized
tcttattttcctgtgctcta

SEQ ID NO: 284000 - DNA, 20 bp, Artificial Sequence
  chemically synthesized
gacagtttactctagagcac

SEQ ID NO: 284001 - DNA, 20 bp, Artificial Sequence
  chemically synthesized
tctcttattttcctgtgctc

SEQ ID NO: 284002 - DNA, 20 bp, Artificial Sequence
  chemically synthesized
actctagagcacaggaaaat

SEQ ID NO: 284003 - DNA, 20 bp, Artificial Sequence
  chemically synthesized
tctagagcacaggaaaataa

SEQ ID NO: 284004 - DNA, 20 bp, Artificial Sequence
  chemically synthesized
tagagcacaggaaaataaga

SEQ ID NO: 284005 - DNA, 20 bp, Artificial Sequence
  chemically synthesized
gaaaataagagagatctgac

SEQ ID NO: 284006 - DNA, 20 bp, Artificial Sequence
  chemically synthesized
aaaataagagagatctgact

SEQ ID NO: 284007 - DNA, 20 bp, Artificial Sequence
  chemically synthesized
tatgtcaccaacaacccagt

SEQ ID NO: 284008 - DNA, 20 bp, Artificial Sequence
  chemically synthesized
gagagatctgactgggttgt

SEQ ID NO: 284009 - DNA, 20 bp, Artificial Sequence
  chemically synthesized
tgcctatgtcaccaacaacc

SEQ ID NO: 284010 - DNA, 20 bp, Artificial Sequence
  chemically synthesized
tgactgggttgttggtgaca

SEQ ID NO: 284011 - DNA, 20 bp, Artificial Sequence
  chemically synthesized
gactgggttgttggtgacat

SEQ ID NO: 284012 - DNA, 20 bp, Artificial Sequence
  chemically synthesized
tgacataggcaaatcgctca

SEQ ID NO: 284013 - DNA, 20 bp, Artificial Sequence
  chemically synthesized
gacataggcaaatcgctcat

SEQ ID NO: 284014 - DNA, 20 bp, Artificial Sequence
  chemically synthesized
acataggcaaatcgctcata

SEQ ID NO: 284015 - DNA, 20 bp, Artificial Sequence
  chemically synthesized
ataggcaaatcgctcatagg

SEQ ID NO: 284016 - DNA, 20 bp, Artificial Sequence
  chemically synthesized
aggcaaatcgctcataggga

SEQ ID NO: 284017 - DNA, 20 bp, Artificial Sequence
  chemically synthesized
gccctcttccctctccctat

SEQ ID NO: 284018 - DNA, 20 bp, Artificial Sequence
  chemically synthesized
ggcaaatcgctcatagggag

SEQ ID NO: 284019 - DNA, 20 bp, Artificial Sequence
  chemically synthesized
gcaaatcgctcatagggaga

SEQ ID NO: 284020 - DNA, 20 bp, Artificial Sequence
  chemically synthesized
aatcgctcatagggagaggg

SEQ ID NO: 284021 - DNA, 20 bp, Artificial Sequence
  chemically synthesized
tcgctcatagggagagggaa

SEQ ID NO: 284022 - DNA, 20 bp, Artificial Sequence
  chemically synthesized
cgctcatagggagagggaag

SEQ ID NO: 284023 - DNA, 20 bp, Artificial Sequence
  chemically synthesized
gctcatagggagagggaaga

SEQ ID NO: 284024 - DNA, 20 bp, Artificial Sequence
  chemically synthesized
atagggagagggaagagggc

SEQ ID NO: 284025 - DNA, 20 bp, Artificial Sequence
  chemically synthesized
gggagagggaagagggccag

SEQ ID NO: 284026 - DNA, 20 bp, Artificial Sequence
  chemically synthesized
gagagggaagagggccagaa

SEQ ID NO: 284027 - DNA, 20 bp, Artificial Sequence
  chemically synthesized
agagggaagagggccagaag

SEQ ID NO: 284028 - DNA, 20 bp, Artificial Sequence
  chemically synthesized
ctttggttcagtgcctcttc

SEQ ID NO: 284029 - DNA, 20 bp, Artificial Sequence
  chemically synthesized
ccagaagaggcactgaacca

SEQ ID NO: 284030 - DNA, 20 bp, Artificial Sequence
  chemically synthesized
cagaagaggcactgaaccaa

SEQ ID NO: 284031 - DNA, 20 bp, Artificial Sequence
  chemically synthesized
atccctgggttcctttggtt

SEQ ID NO: 284032 - DNA, 20 bp, Artificial Sequence
  chemically synthesized
tgattatccctgggttcctt

SEQ ID NO: 284033 - DNA, 20 bp, Artificial Sequence
  chemically synthesized
ggcactgaaccaaaggaacc

SEQ ID NO: 284034 - DNA, 20 bp, Artificial Sequence
  chemically synthesized
gcactgaaccaaaggaaccc

SEQ ID NO: 284035 - DNA, 20 bp, Artificial Sequence
  chemically synthesized
cactgaaccaaaggaaccca

SEQ ID NO: 284036 - DNA, 20 bp, Artificial Sequence
  chemically synthesized
cagctgctctgattatccct

SEQ ID NO: 284037 - DNA, 20 bp, Artificial Sequence
  chemically synthesized
tcagctgctctgattatccc

SEQ ID NO: 284038 - DNA, 20 bp, Artificial Sequence
  chemically synthesized
caaaggaacccagggataat

SEQ ID NO: 284039 - DNA, 20 bp, Artificial Sequence
  chemically synthesized
aaggaacccagggataatca

SEQ ID NO: 284040 - DNA, 20 bp, Artificial Sequence
  chemically synthesized
gaacccagggataatcagag

SEQ ID NO: 284041 - DNA, 20 bp, Artificial Sequence
  chemically synthesized
actatagagtcatttgtgtt

SEQ ID NO: 284042 - DNA, 20 bp, Artificial Sequence
  chemically synthesized
gctgaacacaaatgactcta

SEQ ID NO: 284043 - DNA, 20 bp, Artificial Sequence
  chemically synthesized
atccgtaagtagatactata

SEQ ID NO: 284044 - DNA, 20 bp, Artificial Sequence
  chemically synthesized
agatccgtaagtagatacta

SEQ ID NO: 284045 - DNA, 20 bp, Artificial Sequence
  chemically synthesized
gactctatagtatctactta

SEQ ID NO: 284046 - DNA, 20 bp, Artificial Sequence
  chemically synthesized
cactacctcagatccgtaag

SEQ ID NO: 284047 - DNA, 20 bp, Artificial Sequence
  chemically synthesized
ggccactacctcagatccgt

SEQ ID NO: 284048 - DNA, 20 bp, Artificial Sequence
  chemically synthesized
tagtatctacttacggatct

SEQ ID NO: 284049 - DNA, 20 bp, Artificial Sequence
  chemically synthesized
agtatctacttacggatctg

SEQ ID NO: 284050 - DNA, 20 bp, Artificial Sequence
  chemically synthesized
atctacttacggatctgagg

SEQ ID NO: 284051 - DNA, 20 bp, Artificial Sequence
  chemically synthesized
tacttacggatctgaggtag

SEQ ID NO: 284052 - DNA, 20 bp, Artificial Sequence
  chemically synthesized
tttatatatggccactacct

SEQ ID NO: 284053 - DNA, 20 bp, Artificial Sequence
  chemically synthesized
tcactgcgtctatttatata

SEQ ID NO: 284054 - DNA, 20 bp, Artificial Sequence
  chemically synthesized
aggtagtggccatatataaa

SEQ ID NO: 284055 - DNA, 20 bp, Artificial Sequence
  chemically synthesized
tggccatatataaatagacg

SEQ ID NO: 284056 - DNA, 20 bp, Artificial Sequence
  chemically synthesized
catatataaatagacgcagt

SEQ ID NO: 284057 - DNA, 20 bp, Artificial Sequence
  chemically synthesized
tataaatagacgcagtgaga

SEQ ID NO: 284058 - DNA, 20 bp, Artificial Sequence
  chemically synthesized
ataaatagacgcagtgagaa

SEQ ID NO: 284059 - DNA, 20 bp, Artificial Sequence
  chemically synthesized
gacgcagtgagaaaggaatt

SEQ ID NO: 284060 - DNA, 20 bp, Artificial Sequence
  chemically synthesized
tgagaaaggaattgagatac

SEQ ID NO: 284061 - DNA, 20 bp, Artificial Sequence
  chemically synthesized
agaaaggaattgagatacaa

SEQ ID NO: 284062 - DNA, 20 bp, Artificial Sequence
  chemically synthesized
ggaattgagatacaagagaa

SEQ ID NO: 284063 - DNA, 20 bp, Artificial Sequence
  chemically synthesized
gaattgagatacaagagaaa

SEQ ID NO: 284064 - DNA, 20 bp, Artificial Sequence
  chemically synthesized
tacaagagaaaaggccatat

SEQ ID NO: 284065 - DNA, 20 bp, Artificial Sequence
  chemically synthesized
tccattgtgtgtcactcata

SEQ ID NO: 284066 - DNA, 20 bp, Artificial Sequence
  chemically synthesized
gccatatgagtgacacacaa

SEQ ID NO: 284067 - DNA, 20 bp, Artificial Sequence
  chemically synthesized
atgagtgacacacaatggaa

SEQ ID NO: 284068 - DNA, 20 bp, Artificial Sequence
  chemically synthesized
gtgacacacaatggaaaaga

SEQ ID NO: 284069 - DNA, 20 bp, Artificial Sequence
  chemically synthesized
tgacacacaatggaaaagaa

SEQ ID NO: 284070 - DNA, 20 bp, Artificial Sequence
  chemically synthesized
acacaatggaaaagaaagga

SEQ ID NO: 284071 - DNA, 20 bp, Artificial Sequence
  chemically synthesized
cacaatggaaaagaaaggaa

SEQ ID NO: 284072 - DNA, 20 bp, Artificial Sequence
  chemically synthesized
tggaaaagaaaggaaaggaa

SEQ ID NO: 284073 - DNA, 20 bp, Artificial Sequence
  chemically synthesized
ggaaaagaaaggaaaggaaa

SEQ ID NO: 284074 - DNA, 20 bp, Artificial Sequence
  chemically synthesized
aagaaaggaaaggaaaagga

SEQ ID NO: 284075 - DNA, 20 bp, Artificial Sequence
  chemically synthesized
agaaaggaaaggaaaaggaa

SEQ ID NO: 284076 - DNA, 20 bp, Artificial Sequence
  chemically synthesized
gaaaggaaaggaaaaggaaa

SEQ ID NO: 284077 - DNA, 20 bp, Artificial Sequence
  chemically synthesized
ggaaaggaaaaggaaaggga

SEQ ID NO: 284078 - DNA, 20 bp, Artificial Sequence
  chemically synthesized
gaaaaggaaagggaaagtga

SEQ ID NO: 284079 - DNA, 20 bp, Artificial Sequence
  chemically synthesized
gaaagggaaagtgaaagtga

SEQ ID NO: 284080 - DNA, 20 bp, Artificial Sequence
  chemically synthesized
gaaagtgaaagtgaaagtga

SEQ ID NO: 284081 - DNA, 20 bp, Artificial Sequence
  chemically synthesized
gaaagtgaaagtgaaagtga

SEQ ID NO: 284082 - DNA, 20 bp, Artificial Sequence
  chemically synthesized
gaaagtgaaagtgaaagtga

SEQ ID NO: 284083 - DNA, 20 bp, Artificial Sequence
  chemically synthesized
aaagtgaaagtgaaagtgaa

SEQ ID NO: 284084 - DNA, 20 bp, Artificial Sequence
  chemically synthesized
aagtgaaagtgaaagtgaaa

SEQ ID NO: 284085 - DNA, 20 bp, Artificial Sequence
  chemically synthesized
gaaagtgaaagtgaaaggga

SEQ ID NO: 284086 - DNA, 20 bp, Artificial Sequence
  chemically synthesized
aaagtgaaagtgaaagggaa

SEQ ID NO: 284087 - DNA, 20 bp, Artificial Sequence
  chemically synthesized
aagtgaaagtgaaagggaaa

SEQ ID NO: 284088 - DNA, 20 bp, Artificial Sequence
  chemically synthesized
gaaagtgaaagggaaaggga

SEQ ID NO: 284089 - DNA, 20 bp, Artificial Sequence
  chemically synthesized
aaagtgaaagggaaagggaa

SEQ ID NO: 284090 - DNA, 20 bp, Artificial Sequence
  chemically synthesized
aagtgaaagggaaagggaaa

SEQ ID NO: 284091 - DNA, 20 bp, Artificial Sequence
  chemically synthesized
gaaagggaaagggaaaggga

SEQ ID NO: 284092 - DNA, 20 bp, Artificial Sequence
  chemically synthesized
aaagggaaagggaaagggaa

SEQ ID NO: 284093 - DNA, 20 bp, Artificial Sequence
  chemically synthesized
aagggaaagggaaagggaaa

SEQ ID NO: 284094 - DNA, 20 bp, Artificial Sequence
  chemically synthesized
gaaagggaaagggaaaggga

SEQ ID NO: 284095 - DNA, 20 bp, Artificial Sequence
  chemically synthesized
aaagggaaagggaaagggaa

SEQ ID NO: 284096 - DNA, 20 bp, Artificial Sequence
  chemically synthesized
aagggaaagggaaagggaaa

SEQ ID NO: 284097 - DNA, 20 bp, Artificial Sequence
  chemically synthesized
gaaagggaaagggaaaggga

SEQ ID NO: 284098 - DNA, 20 bp, Artificial Sequence
  chemically synthesized
aaagggaaagggaaagggaa

SEQ ID NO: 284099 - DNA, 20 bp, Artificial Sequence
  chemically synthesized
aagggaaagggaaagggaaa

SEQ ID NO: 284100 - DNA, 20 bp, Artificial Sequence
  chemically synthesized
gaaagggaaagggaaaggga

SEQ ID NO: 284101 - DNA, 20 bp, Artificial Sequence
  chemically synthesized
aaagggaaagggaaagggaa

SEQ ID NO: 284102 - DNA, 20 bp, Artificial Sequence
  chemically synthesized
aagggaaagggaaagggaaa

SEQ ID NO: 284103 - DNA, 20 bp, Artificial Sequence
  chemically synthesized
gaaagggaaagggaaaggga

SEQ ID NO: 284104 - DNA, 20 bp, Artificial Sequence
  chemically synthesized
aaagggaaagggaaagggaa

SEQ ID NO: 284105 - DNA, 20 bp, Artificial Sequence
  chemically synthesized
aagggaaagggaaagggaaa

SEQ ID NO: 284106 - DNA, 20 bp, Artificial Sequence
  chemically synthesized
gaaagggaaagggaaaggga

SEQ ID NO: 284107 - DNA, 20 bp, Artificial Sequence
  chemically synthesized
aaagggaaagggaaagggaa

SEQ ID NO: 284108 - DNA, 20 bp, Artificial Sequence
  chemically synthesized
aagggaaagggaaagggaaa

SEQ ID NO: 284109 - DNA, 20 bp, Artificial Sequence
  chemically synthesized
gaaagggaaagggaaaggga

SEQ ID NO: 284110 - DNA, 20 bp, Artificial Sequence
  chemically synthesized
aaagggaaagggaaagggaa

SEQ ID NO: 284111 - DNA, 20 bp, Artificial Sequence
  chemically synthesized
aagggaaagggaaagggaaa

SEQ ID NO: 284112 - DNA, 20 bp, Artificial Sequence
  chemically synthesized
ggaaagggaaagggaaaggg

SEQ ID NO: 284113 - DNA, 20 bp, Artificial Sequence
  chemically synthesized
gaaagggaaagggaaaggga

SEQ ID NO: 284114 - DNA, 20 bp, Artificial Sequence
  chemically synthesized
aaagggaaagggaaagggaa

SEQ ID NO: 284115 - DNA, 20 bp, Artificial Sequence
  chemically synthesized
ggaaagggaaagggaaggga

SEQ ID NO: 284116 - DNA, 20 bp, Artificial Sequence
  chemically synthesized
gaaagggaaagggaagggaa

SEQ ID NO: 284117 - DNA, 20 bp, Artificial Sequence
  chemically synthesized
gggaaagggaagggaaagga

SEQ ID NO: 284118 - DNA, 20 bp, Artificial Sequence
  chemically synthesized
ggaaagggaagggaaaggaa

SEQ ID NO: 284119 - DNA, 20 bp, Artificial Sequence
  chemically synthesized
gaaagggaagggaaaggaaa

SEQ ID NO: 284120 - DNA, 20 bp, Artificial Sequence
  chemically synthesized
gggaagggaaaggaaaggga

SEQ ID NO: 284121 - DNA, 20 bp, Artificial Sequence
  chemically synthesized
ggaagggaaaggaaagggaa

SEQ ID NO: 284122 - DNA, 20 bp, Artificial Sequence
  chemically synthesized
gaagggaaaggaaagggaaa

SEQ ID NO: 284123 - DNA, 20 bp, Artificial Sequence
  chemically synthesized
ggaaaggaaagggaaaggga

SEQ ID NO: 284124 - DNA, 20 bp, Artificial Sequence
  chemically synthesized
gaaaggaaagggaaagggaa

SEQ ID NO: 284125 - DNA, 20 bp, Artificial Sequence
  chemically synthesized
aaaggaaagggaaagggaaa

SEQ ID NO: 284126 - DNA, 20 bp, Artificial Sequence
  chemically synthesized
gaaagggaaagggaaaggga

SEQ ID NO: 284127 - DNA, 20 bp, Artificial Sequence
  chemically synthesized
aaagggaaagggaaagggaa

SEQ ID NO: 284128 - DNA, 20 bp, Artificial Sequence
  chemically synthesized
aagggaaagggaaagggaaa

SEQ ID NO: 284129 - DNA, 20 bp, Artificial Sequence
  chemically synthesized
gaaagggaaagggaaaggga

SEQ ID NO: 284130 - DNA, 20 bp, Artificial Sequence
  chemically synthesized
aaagggaaagggaaagggaa

SEQ ID NO: 284131 - DNA, 20 bp, Artificial Sequence
  chemically synthesized
aagggaaagggaaagggaaa

SEQ ID NO: 284132 - DNA, 20 bp, Artificial Sequence
  chemically synthesized
gaaagggaaagggaaaggga

SEQ ID NO: 284133 - DNA, 20 bp, Artificial Sequence
  chemically synthesized
aaagggaaagggaaagggaa

SEQ ID NO: 284134 - DNA, 20 bp, Artificial Sequence
  chemically synthesized
aagggaaagggaaagggaaa

SEQ ID NO: 284135 - DNA, 20 bp, Artificial Sequence
  chemically synthesized
gaaagggaaagggaaaggga

SEQ ID NO: 284136 - DNA, 20 bp, Artificial Sequence
  chemically synthesized
aaagggaaagggaaagggaa

SEQ ID NO: 284137 - DNA, 20 bp, Artificial Sequence
  chemically synthesized
ggaaagggaaagggaaagga

SEQ ID NO: 284138 - DNA, 20 bp, Artificial Sequence
  chemically synthesized
gaaagggaaagggaaaggaa

SEQ ID NO: 284139 - DNA, 20 bp, Artificial Sequence
  chemically synthesized
gggaaagggaaaggaaagga

SEQ ID NO: 284140 - DNA, 20 bp, Artificial Sequence
  chemically synthesized
ggaaagggaaaggaaaggaa

SEQ ID NO: 284141 - DNA, 20 bp, Artificial Sequence
  chemically synthesized
agggaaaggaaaggaaagga

SEQ ID NO: 284142 - DNA, 20 bp, Artificial Sequence
  chemically synthesized
gggaaaggaaaggaaaggaa

SEQ ID NO: 284143 - DNA, 20 bp, Artificial Sequence
  chemically synthesized
aaggaaaggaaaggaaagga

SEQ ID NO: 284144 - DNA, 20 bp, Artificial Sequence
  chemically synthesized
aggaaaggaaaggaaaggaa

SEQ ID NO: 284145 - DNA, 20 bp, Artificial Sequence
  chemically synthesized
aaggaaaggaaaggaaagga

SEQ ID NO: 284146 - DNA, 20 bp, Artificial Sequence
  chemically synthesized
aggaaaggaaaggaaaggaa

SEQ ID NO: 284147 - DNA, 20 bp, Artificial Sequence
  chemically synthesized
aaggaaaggaaaggaaagga

SEQ ID NO: 284148 - DNA, 20 bp, Artificial Sequence
  chemically synthesized
aggaaaggaaaggaaaggaa

SEQ ID NO: 284149 - DNA, 20 bp, Artificial Sequence
  chemically synthesized
aaggaaaggaaaggaaagga

SEQ ID NO: 284150 - DNA, 20 bp, Artificial Sequence
  chemically synthesized
aggaaaggaaaggaaaggaa

SEQ ID NO: 284151 - DNA, 20 bp, Artificial Sequence
  chemically synthesized
aaggaaaggaaaggaaagga

SEQ ID NO: 284152 - DNA, 20 bp, Artificial Sequence
  chemically synthesized
aggaaaggaaaggaaaggaa

SEQ ID NO: 284153 - DNA, 20 bp, Artificial Sequence
  chemically synthesized
aaggaaaggaaaggaaagga

SEQ ID NO: 284154 - DNA, 20 bp, Artificial Sequence
  chemically synthesized
aggaaaggaaaggaaaggaa

SEQ ID NO: 284155 - DNA, 20 bp, Artificial Sequence
  chemically synthesized
aaggaaaggaaaggaaagga

SEQ ID NO: 284156 - DNA, 20 bp, Artificial Sequence
  chemically synthesized
aggaaaggaaaggaaaggaa

SEQ ID NO: 284157 - DNA, 20 bp, Artificial Sequence
  chemically synthesized
aaggaaaggaaaggaaagga

SEQ ID NO: 284158 - DNA, 20 bp, Artificial Sequence
  chemically synthesized
aggaaaggaaaggaaaggaa

SEQ ID NO: 284159 - DNA, 20 bp, Artificial Sequence
  chemically synthesized
aaggaaaggaaaggaaagga

SEQ ID NO: 284160 - DNA, 20 bp, Artificial Sequence
  chemically synthesized
aggaaaggaaaggaaaggaa

SEQ ID NO: 284161 - DNA, 20 bp, Artificial Sequence
  chemically synthesized
aaggaaaggaaaggaaagga

SEQ ID NO: 284162 - DNA, 20 bp, Artificial Sequence
  chemically synthesized
aggaaaggaaaggaaaggaa

SEQ ID NO: 284163 - DNA, 20 bp, Artificial Sequence
  chemically synthesized
aaggaaaggaaaggaaagga

SEQ ID NO: 284164 - DNA, 20 bp, Artificial Sequence
  chemically synthesized
aggaaaggaaaggaaaggaa

SEQ ID NO: 284165 - DNA, 20 bp, Artificial Sequence
  chemically synthesized
aaggaaaggaaaggaaagga

SEQ ID NO: 284166 - DNA, 20 bp, Artificial Sequence
  chemically synthesized
aggaaaggaaaggaaaggaa

SEQ ID NO: 284167 - DNA, 20 bp, Artificial Sequence
  chemically synthesized
gaaaggaaaggaaaggaaaa

SEQ ID NO: 284168 - DNA, 20 bp, Artificial Sequence
  chemically synthesized
aaggaaaggaaaggaaaaaa

SEQ ID NO: 284169 - DNA, 20 bp, Artificial Sequence
  chemically synthesized
aaaggaaaaaagagatgaaa

SEQ ID NO: 284170 - DNA, 20 bp, Artificial Sequence
  chemically synthesized
ggtagagcccacaggattga

SEQ ID NO: 284171 - DNA, 20 bp, Artificial Sequence
  chemically synthesized
tggtagagcccacaggattg

SEQ ID NO: 284172 - DNA, 20 bp, Artificial Sequence
  chemically synthesized
ataaaataccttcaatcctg

SEQ ID NO: 284173 - DNA, 20 bp, Artificial Sequence
  chemically synthesized
taaaataccttcaatcctgt

SEQ ID NO: 284174 - DNA, 20 bp, Artificial Sequence
  chemically synthesized
ttatttgtggtagagcccac

SEQ ID NO: 284175 - DNA, 20 bp, Artificial Sequence
  chemically synthesized
tttatttgtggtagagccca

SEQ ID NO: 284176 - DNA, 20 bp, Artificial Sequence
  chemically synthesized
cacagactttatttgtggta

SEQ ID NO: 284177 - DNA, 20 bp, Artificial Sequence
  chemically synthesized
gtcacagactttatttgtgg

SEQ ID NO: 284178 - DNA, 20 bp, Artificial Sequence
  chemically synthesized
tgtgggctctaccacaaata

SEQ ID NO: 284179 - DNA, 20 bp, Artificial Sequence
  chemically synthesized
atagtcacagactttatttg

SEQ ID NO: 284180 - DNA, 20 bp, Artificial Sequence
  chemically synthesized
acaaataaagtctgtgacta

SEQ ID NO: 284181 - DNA, 20 bp, Artificial Sequence
  chemically synthesized
aaatgatttagccatagtca

SEQ ID NO: 284182 - DNA, 20 bp, Artificial Sequence
  chemically synthesized
taggtcaaatgatttagcca

SEQ ID NO: 284183 - DNA, 20 bp, Artificial Sequence
  chemically synthesized
cccagataggtcaaatgatt

SEQ ID NO: 284184 - DNA, 20 bp, Artificial Sequence
  chemically synthesized
gctaaatcatttgacctatc

SEQ ID NO: 284185 - DNA, 20 bp, Artificial Sequence
  chemically synthesized
ctaaatcatttgacctatct

SEQ ID NO: 284186 - DNA, 20 bp, Artificial Sequence
  chemically synthesized
gaaaactgcaattcccagat

SEQ ID NO: 284187 - DNA, 20 bp, Artificial Sequence
  chemically synthesized
agaaaactgcaattcccaga

SEQ ID NO: 284188 - DNA, 20 bp, Artificial Sequence
  chemically synthesized
tttgacctatctgggaattg

SEQ ID NO: 284189 - DNA, 20 bp, Artificial Sequence
  chemically synthesized
tatcagaaaactgcaattcc

SEQ ID NO: 284190 - DNA, 20 bp, Artificial Sequence
  chemically synthesized
gggaattgcagttttctgat

SEQ ID NO: 284191 - DNA, 20 bp, Artificial Sequence
  chemically synthesized
aattgcagttttctgataag

SEQ ID NO: 284192 - DNA, 20 bp, Artificial Sequence
  chemically synthesized
ttgcagttttctgataagca

SEQ ID NO: 284193 - DNA, 20 bp, Artificial Sequence
  chemically synthesized
acacttctctctctgcttat

SEQ ID NO: 284194 - DNA, 20 bp, Artificial Sequence
  chemically synthesized
gcagttttctgataagcaga

SEQ ID NO: 284195 - DNA, 20 bp, Artificial Sequence
  chemically synthesized
agttttctgataagcagaga

SEQ ID NO: 284196 - DNA, 20 bp, Artificial Sequence
  chemically synthesized
tttctgataagcagagagag

SEQ ID NO: 284197 - DNA, 20 bp, Artificial Sequence
  chemically synthesized
gagagaagtgtgaattacac

SEQ ID NO: 284198 - DNA, 20 bp, Artificial Sequence
  chemically synthesized
tgtgaattacacaagtttca

SEQ ID NO: 284199 - DNA, 20 bp, Artificial Sequence
  chemically synthesized
acaagtttcaaagtaccttc

SEQ ID NO: 284200 - DNA, 20 bp, Artificial Sequence
  chemically synthesized
atcagaatgtgagagctaga

SEQ ID NO: 284201 - DNA, 20 bp, Artificial Sequence
  chemically synthesized
tatcagaatgtgagagctag

SEQ ID NO: 284202 - DNA, 20 bp, Artificial Sequence
  chemically synthesized
ctttatcagaatgtgagagc

SEQ ID NO: 284203 - DNA, 20 bp, Artificial Sequence
  chemically synthesized
aaaactttatcagaatgtga

SEQ ID NO: 284204 - DNA, 20 bp, Artificial Sequence
  chemically synthesized
ggaaaactttatcagaatgt

SEQ ID NO: 284205 - DNA, 20 bp, Artificial Sequence
  chemically synthesized
ctagctctcacattctgata

SEQ ID NO: 284206 - DNA, 20 bp, Artificial Sequence
  chemically synthesized
acccctgaggaaaactttat

SEQ ID NO: 284207 - DNA, 20 bp, Artificial Sequence
  chemically synthesized
cattctgataaagttttcct

SEQ ID NO: 284208 - DNA, 20 bp, Artificial Sequence
  chemically synthesized
attctgataaagttttcctc

SEQ ID NO: 284209 - DNA, 20 bp, Artificial Sequence
  chemically synthesized
ttctgataaagttttcctca

SEQ ID NO: 284210 - DNA, 20 bp, Artificial Sequence
  chemically synthesized
tctgataaagttttcctcag

SEQ ID NO: 284211 - DNA, 20 bp, Artificial Sequence
  chemically synthesized
ctttggggaggtcacccctg

SEQ ID NO: 284212 - DNA, 20 bp, Artificial Sequence
  chemically synthesized
actttggggaggtcacccct

SEQ ID NO: 284213 - DNA, 20 bp, Artificial Sequence
  chemically synthesized
cctcaggggtgacctcccca

SEQ ID NO: 284214 - DNA, 20 bp, Artificial Sequence
  chemically synthesized
tttaaaatttgactttgggg

SEQ ID NO: 284215 - DNA, 20 bp, Artificial Sequence
  chemically synthesized
atttaaaatttgactttggg

SEQ ID NO: 284216 - DNA, 20 bp, Artificial Sequence
  chemically synthesized
taatttaaaatttgactttg

SEQ ID NO: 284217 - DNA, 20 bp, Artificial Sequence
  chemically synthesized
ataatttaaaatttgacttt

SEQ ID NO: 284218 - DNA, 20 bp, Artificial Sequence
  chemically synthesized
aataatttaaaatttgactt

SEQ ID NO: 284219 - DNA, 20 bp, Artificial Sequence
  chemically synthesized
agtcaaattttaaattattt

SEQ ID NO: 284220 - DNA, 20 bp, Artificial Sequence
  chemically synthesized
aaaccattggagtatttcaa

SEQ ID NO: 284221 - DNA, 20 bp, Artificial Sequence
  chemically synthesized
ggtcttttgaaatactccaa

SEQ ID NO: 284222 - DNA, 20 bp, Artificial Sequence
  chemically synthesized
atggacaagaaaaaccattg

SEQ ID NO: 284223 - DNA, 20 bp, Artificial Sequence
  chemically synthesized
aaatggacaagaaaaaccat

SEQ ID NO: 284224 - DNA, 20 bp, Artificial Sequence
  chemically synthesized
aatggtttttcttgtccatt

SEQ ID NO: 284225 - DNA, 20 bp, Artificial Sequence
  chemically synthesized
agtttttattctaaatggac

SEQ ID NO: 284226 - DNA, 20 bp, Artificial Sequence
  chemically synthesized
atcacagtttttattctaaa

SEQ ID NO: 284227 - DNA, 20 bp, Artificial Sequence
  chemically synthesized
cgggttttgttagagtatca

SEQ ID NO: 284228 - DNA, 20 bp, Artificial Sequence
  chemically synthesized
ttaacaaacgggttttgtta

SEQ ID NO: 284229 - DNA, 20 bp, Artificial Sequence
  chemically synthesized
tgttaacaaacgggttttgt

SEQ ID NO: 284230 - DNA, 20 bp, Artificial Sequence
  chemically synthesized
gcaaatatctgttaacaaac

SEQ ID NO: 284231 - DNA, 20 bp, Artificial Sequence
  chemically synthesized
ggcaaatatctgttaacaaa

SEQ ID NO: 284232 - DNA, 20 bp, Artificial Sequence
  chemically synthesized
taacaaaacccgtttgttaa

SEQ ID NO: 284233 - DNA, 20 bp, Artificial Sequence
  chemically synthesized
cagatatttgcccacctcct

SEQ ID NO: 284234 - DNA, 20 bp, Artificial Sequence
  chemically synthesized
tcagataagtcttaggaggt

SEQ ID NO: 284235 - DNA, 20 bp, Artificial Sequence
  chemically synthesized
ctcagataagtcttaggagg

SEQ ID NO: 284236 - DNA, 20 bp, Artificial Sequence
  chemically synthesized
tacctcagataagtcttagg

SEQ ID NO: 284237 - DNA, 20 bp, Artificial Sequence
  chemically synthesized
ttacctcagataagtcttag

SEQ ID NO: 284238 - DNA, 20 bp, Artificial Sequence
  chemically synthesized
aattacctcagataagtctt

SEQ ID NO: 284239 - DNA, 20 bp, Artificial Sequence
  chemically synthesized
aaattacctcagataagtct

SEQ ID NO: 284240 - DNA, 20 bp, Artificial Sequence
  chemically synthesized
ccacctcctaagacttatct

SEQ ID NO: 284241 - DNA, 20 bp, Artificial Sequence
  chemically synthesized
cacctcctaagacttatctg

SEQ ID NO: 284242 - DNA, 20 bp, Artificial Sequence
  chemically synthesized
gggataaaattacctcagat

SEQ ID NO: 284243 - DNA, 20 bp, Artificial Sequence
  chemically synthesized
aaaatgggataaaattacct

SEQ ID NO: 284244 - DNA, 20 bp, Artificial Sequence
  chemically synthesized
ctgcctgaaggaaggaaaat

SEQ ID NO: 284245 - DNA, 20 bp, Artificial Sequence
  chemically synthesized
tctgcctgaaggaaggaaaa

SEQ ID NO: 284246 - DNA, 20 bp, Artificial Sequence
  chemically synthesized
ttatcccattttccttcctt

SEQ ID NO: 284247 - DNA, 20 bp, Artificial Sequence
  chemically synthesized
tatcccattttccttccttc

SEQ ID NO: 284248 - DNA, 20 bp, Artificial Sequence
  chemically synthesized
aaagaaatctgcctgaagga

SEQ ID NO: 284249 - DNA, 20 bp, Artificial Sequence
  chemically synthesized
gaaagaaatctgcctgaagg

SEQ ID NO: 284250 - DNA, 20 bp, Artificial Sequence
  chemically synthesized
cccattttccttccttcagg

SEQ ID NO: 284251 - DNA, 20 bp, Artificial Sequence
  chemically synthesized
agagaaagaaatctgcctga

SEQ ID NO: 284252 - DNA, 20 bp, Artificial Sequence
  chemically synthesized
aagagaaagaaatctgcctg

SEQ ID NO: 284253 - DNA, 20 bp, Artificial Sequence
  chemically synthesized
tgaagctaattgggaagaga

SEQ ID NO: 284254 - DNA, 20 bp, Artificial Sequence
  chemically synthesized
accctgaagctaattgggaa

SEQ ID NO: 284255 - DNA, 20 bp, Artificial Sequence
  chemically synthesized
gatttctttctcttcccaat

SEQ ID NO: 284256 - DNA, 20 bp, Artificial Sequence
  chemically synthesized
agaccctgaagctaattggg

SEQ ID NO: 284257 - DNA, 20 bp, Artificial Sequence
  chemically synthesized
caaagaccctgaagctaatt

SEQ ID NO: 284258 - DNA, 20 bp, Artificial Sequence
  chemically synthesized
gcaaagaccctgaagctaat

SEQ ID NO: 284259 - DNA, 20 bp, Artificial Sequence
  chemically synthesized
tttctcttcccaattagctt

SEQ ID NO: 284260 - DNA, 20 bp, Artificial Sequence
  chemically synthesized
ttctcttcccaattagcttc

SEQ ID NO: 284261 - DNA, 20 bp, Artificial Sequence
  chemically synthesized
tctcttcccaattagcttca

SEQ ID NO: 284262 - DNA, 20 bp, Artificial Sequence
  chemically synthesized
tagcttctgcaaagaccctg

SEQ ID NO: 284263 - DNA, 20 bp, Artificial Sequence
  chemically synthesized
aattagcttcagggtctttg

SEQ ID NO: 284264 - DNA, 20 bp, Artificial Sequence
  chemically synthesized
tagcttcagggtctttgcag

SEQ ID NO: 284265 - DNA, 20 bp, Artificial Sequence
  chemically synthesized
cagagagcatagcttctgca

SEQ ID NO: 284266 - DNA, 20 bp, Artificial Sequence
  chemically synthesized
cacattctattcagagagca

SEQ ID NO: 284267 - DNA, 20 bp, Artificial Sequence
  chemically synthesized
cagaagctatgctctctgaa

SEQ ID NO: 284268 - DNA, 20 bp, Artificial Sequence
  chemically synthesized
ggaaacacattctattcaga

SEQ ID NO: 284269 - DNA, 20 bp, Artificial Sequence
  chemically synthesized
atggaaacacattctattca

SEQ ID NO: 284270 - DNA, 20 bp, Artificial Sequence
  chemically synthesized
ttatggaaacacattctatt

SEQ ID NO: 284271 - DNA, 20 bp, Artificial Sequence
  chemically synthesized
gaatagaatgtgtttccata

SEQ ID NO: 284272 - DNA, 20 bp, Artificial Sequence
  chemically synthesized
accacttaaaaaaatcttta

SEQ ID NO: 284273 - DNA, 20 bp, Artificial Sequence
  chemically synthesized
gtttccataaagattttttt

SEQ ID NO: 284274 - DNA, 20 bp, Artificial Sequence
  chemically synthesized
tccataaagatttttttaag

SEQ ID NO: 284275 - DNA, 20 bp, Artificial Sequence
  chemically synthesized
taaagatttttttaagtggt

SEQ ID NO: 284276 - DNA, 20 bp, Artificial Sequence
  chemically synthesized
gagaactgaatcataaggaa

SEQ ID NO: 284277 - DNA, 20 bp, Artificial Sequence
  chemically synthesized
gttggcttttccttatgatt

SEQ ID NO: 284278 - DNA, 20 bp, Artificial Sequence
  chemically synthesized
tatgagagaactgaatcata

SEQ ID NO: 284279 - DNA, 20 bp, Artificial Sequence
  chemically synthesized
atatgagagaactgaatcat

SEQ ID NO: 284280 - DNA, 20 bp, Artificial Sequence
  chemically synthesized
aagaattgtatgtaatatga

SEQ ID NO: 284281 - DNA, 20 bp, Artificial Sequence
  chemically synthesized
tgaagaattgtatgtaatat

SEQ ID NO: 284282 - DNA, 20 bp, Artificial Sequence
  chemically synthesized
tgacttatagagcatttatg

SEQ ID NO: 284283 - DNA, 20 bp, Artificial Sequence
  chemically synthesized
attcttcataaatgctctat

SEQ ID NO: 284284 - DNA, 20 bp, Artificial Sequence
  chemically synthesized
ttagaaaaacttgacttata

SEQ ID NO: 284285 - DNA, 20 bp, Artificial Sequence
  chemically synthesized
tcataaatgctctataagtc

SEQ ID NO: 284286 - DNA, 20 bp, Artificial Sequence
  chemically synthesized
ttttagaaaaacttgactta

SEQ ID NO: 284287 - DNA, 20 bp, Artificial Sequence
  chemically synthesized
taagtcaagtttttctaaaa

SEQ ID NO: 284288 - DNA, 20 bp, Artificial Sequence
  chemically synthesized
agggtggtaggatgctattt

SEQ ID NO: 284289 - DNA, 20 bp, Artificial Sequence
  chemically synthesized
aggcaggatttgagggtggt

SEQ ID NO: 284290 - DNA, 20 bp, Artificial Sequence
  chemically synthesized
caggcaggatttgagggtgg

SEQ ID NO: 284291 - DNA, 20 bp, Artificial Sequence
  chemically synthesized
gttcaggcaggatttgaggg

SEQ ID NO: 284292 - DNA, 20 bp, Artificial Sequence
  chemically synthesized
aatgttcaggcaggatttga

SEQ ID NO: 284293 - DNA, 20 bp, Artificial Sequence
  chemically synthesized
taatgttcaggcaggatttg

SEQ ID NO: 284294 - DNA, 20 bp, Artificial Sequence
  chemically synthesized
ataatgttcaggcaggattt

SEQ ID NO: 284295 - DNA, 20 bp, Artificial Sequence
  chemically synthesized
agaatgaataatgttcaggc

SEQ ID NO: 284296 - DNA, 20 bp, Artificial Sequence
  chemically synthesized
aagaatgaataatgttcagg

SEQ ID NO: 284297 - DNA, 20 bp, Artificial Sequence
  chemically synthesized
atcaagaatgaataatgttc

SEQ ID NO: 284298 - DNA, 20 bp, Artificial Sequence
  chemically synthesized
aatcaagaatgaataatgtt

SEQ ID NO: 284299 - DNA, 20 bp, Artificial Sequence
  chemically synthesized
taaacatggattttgaaatc

SEQ ID NO: 284300 - DNA, 20 bp, Artificial Sequence
  chemically synthesized
aatttgcctagaagtaaaca

SEQ ID NO: 284301 - DNA, 20 bp, Artificial Sequence
  chemically synthesized
tcaaaatccatgtttacttc

SEQ ID NO: 284302 - DNA, 20 bp, Artificial Sequence
  chemically synthesized
caaaatccatgtttacttct

SEQ ID NO: 284303 - DNA, 20 bp, Artificial Sequence
  chemically synthesized
aatcatgataatttgcctag

SEQ ID NO: 284304 - DNA, 20 bp, Artificial Sequence
  chemically synthesized
tgaaatcatgataatttgcc

SEQ ID NO: 284305 - DNA, 20 bp, Artificial Sequence
  chemically synthesized
ggtgaggagcaggcaataaa

SEQ ID NO: 284306 - DNA, 20 bp, Artificial Sequence
  chemically synthesized
tctagcgtgtggtgaggagc

SEQ ID NO: 284307 - DNA, 20 bp, Artificial Sequence
  chemically synthesized
ttctagcgtgtggtgaggag

SEQ ID NO: 284308 - DNA, 20 bp, Artificial Sequence
  chemically synthesized
gtgttctagcgtgtggtgag

SEQ ID NO: 284309 - DNA, 20 bp, Artificial Sequence
  chemically synthesized
tagtgttctagcgtgtggtg

SEQ ID NO: 284310 - DNA, 20 bp, Artificial Sequence
  chemically synthesized
ctagtgttctagcgtgtggt

SEQ ID NO: 284311 - DNA, 20 bp, Artificial Sequence
  chemically synthesized
gcctgctcctcaccacacgc

SEQ ID NO: 284312 - DNA, 20 bp, Artificial Sequence
  chemically synthesized
cattctagtgttctagcgtg

SEQ ID NO: 284313 - DNA, 20 bp, Artificial Sequence
  chemically synthesized
ctcaccacacgctagaacac

SEQ ID NO: 284314 - DNA, 20 bp, Artificial Sequence
  chemically synthesized
gaatttacattctagtgttc

SEQ ID NO: 284315 - DNA, 20 bp, Artificial Sequence
  chemically synthesized
ctgccttggaatttacattc

SEQ ID NO: 284316 - DNA, 20 bp, Artificial Sequence
  chemically synthesized
aacactagaatgtaaattcc

SEQ ID NO: 284317 - DNA, 20 bp, Artificial Sequence
  chemically synthesized
acactagaatgtaaattcca

SEQ ID NO: 284318 - DNA, 20 bp, Artificial Sequence
  chemically synthesized
ctagaatgtaaattccaagg

SEQ ID NO: 284319 - DNA, 20 bp, Artificial Sequence
  chemically synthesized
gaatgtaaattccaaggcag

SEQ ID NO: 284320 - DNA, 20 bp, Artificial Sequence
  chemically synthesized
ggtgagcaagaccactgcct

SEQ ID NO: 284321 - DNA, 20 bp, Artificial Sequence
  chemically synthesized
gaatatagagggtggtgagc

SEQ ID NO: 284322 - DNA, 20 bp, Artificial Sequence
  chemically synthesized
tactgaatatagagggtggt

SEQ ID NO: 284323 - DNA, 20 bp, Artificial Sequence
  chemically synthesized
tggctactgaatatagaggg

SEQ ID NO: 284324 - DNA, 20 bp, Artificial Sequence
  chemically synthesized
ctctggctactgaatataga

SEQ ID NO: 284325 - DNA, 20 bp, Artificial Sequence
  chemically synthesized
tgctcaccaccctctatatt

SEQ ID NO: 284326 - DNA, 20 bp, Artificial Sequence
  chemically synthesized
cctctggctactgaatatag

SEQ ID NO: 284327 - DNA, 20 bp, Artificial Sequence
  chemically synthesized
ccctctggctactgaatata

SEQ ID NO: 284328 - DNA, 20 bp, Artificial Sequence
  chemically synthesized
tcaccaccctctatattcag

SEQ ID NO: 284329 - DNA, 20 bp, Artificial Sequence
  chemically synthesized
caccctctggctactgaata

SEQ ID NO: 284330 - DNA, 20 bp, Artificial Sequence
  chemically synthesized
caccctctatattcagtagc

SEQ ID NO: 284331 - DNA, 20 bp, Artificial Sequence
  chemically synthesized
ccctctatattcagtagcca

SEQ ID NO: 284332 - DNA, 20 bp, Artificial Sequence
  chemically synthesized
cctctatattcagtagccag

SEQ ID NO: 284333 - DNA, 20 bp, Artificial Sequence
  chemically synthesized
ctctatattcagtagccaga

SEQ ID NO: 284334 - DNA, 20 bp, Artificial Sequence
  chemically synthesized
actgtgtgccaaacaccctc

SEQ ID NO: 284335 - DNA, 20 bp, Artificial Sequence
  chemically synthesized
ttcagtagccagagggtgtt

SEQ ID NO: 284336 - DNA, 20 bp, Artificial Sequence
  chemically synthesized
gccagagggtgtttggcaca

SEQ ID NO: 284337 - DNA, 20 bp, Artificial Sequence
  chemically synthesized
gagggtgtttggcacacagt

SEQ ID NO: 284338 - DNA, 20 bp, Artificial Sequence
  chemically synthesized
gcacacagtaagtatgcaat

SEQ ID NO: 284339 - DNA, 20 bp, Artificial Sequence
  chemically synthesized
agtaagtatgcaataagttt

SEQ ID NO: 284340 - DNA, 20 bp, Artificial Sequence
  chemically synthesized
gttgataaatatgctattgc

SEQ ID NO: 284341 - DNA, 20 bp, Artificial Sequence
  chemically synthesized
gaattattctaatctagcaa

SEQ ID NO: 284342 - DNA, 20 bp, Artificial Sequence
  chemically synthesized
taaatatgctattgctagat

SEQ ID NO: 284343 - DNA, 20 bp, Artificial Sequence
  chemically synthesized
aacacagaattattctaatc

SEQ ID NO: 284344 - DNA, 20 bp, Artificial Sequence
  chemically synthesized
tttctagagtattaaaaaca

SEQ ID NO: 284345 - DNA, 20 bp, Artificial Sequence
  chemically synthesized
attctgtgtttttaatactc

SEQ ID NO: 284346 - DNA, 20 bp, Artificial Sequence
  chemically synthesized
aattagtataatcatttcta

SEQ ID NO: 284347 - DNA, 20 bp, Artificial Sequence
  chemically synthesized
aaaattagtataatcatttc

SEQ ID NO: 284348 - DNA, 20 bp, Artificial Sequence
  chemically synthesized
aactataatgaagaaaaaat

SEQ ID NO: 284349 - DNA, 20 bp, Artificial Sequence
  chemically synthesized
tactaattttttcttcatta

SEQ ID NO: 284350 - DNA, 20 bp, Artificial Sequence
  chemically synthesized
gtgtgtataaaactataatg

SEQ ID NO: 284351 - DNA, 20 bp, Artificial Sequence
  chemically synthesized
ataatatttatacatattta

SEQ ID NO: 284352 - DNA, 20 bp, Artificial Sequence
  chemically synthesized
aatatttatacatatttatg

SEQ ID NO: 284353 - DNA, 20 bp, Artificial Sequence
  chemically synthesized
tacatatttatggagtatat

SEQ ID NO: 284354 - DNA, 20 bp, Artificial Sequence
  chemically synthesized
cggctttagtcaaatgttga

SEQ ID NO: 284355 - DNA, 20 bp, Artificial Sequence
  chemically synthesized
ttactttcaacatttgacta

SEQ ID NO: 284356 - DNA, 20 bp, Artificial Sequence
  chemically synthesized
tcgaatctgtcatacggctt

SEQ ID NO: 284357 - DNA, 20 bp, Artificial Sequence
  chemically synthesized
atttgactaaagccgtatga

SEQ ID NO: 284358 - DNA, 20 bp, Artificial Sequence
  chemically synthesized
taaatatcgaatctgtcata

SEQ ID NO: 284359 - DNA, 20 bp, Artificial Sequence
  chemically synthesized
gattcgatatttaaacatct

SEQ ID NO: 284360 - DNA, 20 bp, Artificial Sequence
  chemically synthesized
aagtaactcacatgaaaact

SEQ ID NO: 284361 - DNA, 20 bp, Artificial Sequence
  chemically synthesized
aaacatctgagttttcatgt

SEQ ID NO: 284362 - DNA, 20 bp, Artificial Sequence
  chemically synthesized
ctattatagttaatagcaga

SEQ ID NO: 284363 - DNA, 20 bp, Artificial Sequence
  chemically synthesized
atatctattatagttaatag

SEQ ID NO: 284364 - DNA, 20 bp, Artificial Sequence
  chemically synthesized
gaaatatctattatagttaa

SEQ ID NO: 284365 - DNA, 20 bp, Artificial Sequence
  chemically synthesized
ctttctgctattaactataa

SEQ ID NO: 284366 - DNA, 20 bp, Artificial Sequence
  chemically synthesized
taattcagaaatatctatta

SEQ ID NO: 284367 - DNA, 20 bp, Artificial Sequence
  chemically synthesized
tatataattaaatggtaatt

SEQ ID NO: 284368 - DNA, 20 bp, Artificial Sequence
  chemically synthesized
taaaaaattatataattaaa

SEQ ID NO: 284369 - DNA, 20 bp, Artificial Sequence
  chemically synthesized
ttatataattttttaccatg

SEQ ID NO: 284370 - DNA, 20 bp, Artificial Sequence
  chemically synthesized
ttaattgtgaaagggccaca

SEQ ID NO: 284371 - DNA, 20 bp, Artificial Sequence
  chemically synthesized
ttattattttaattgtgaaa

SEQ ID NO: 284372 - DNA, 20 bp, Artificial Sequence
  chemically synthesized
tttattattttaattgtgaa

SEQ ID NO: 284373 - DNA, 20 bp, Artificial Sequence
  chemically synthesized
atttattattttaattgtga

SEQ ID NO: 284374 - DNA, 20 bp, Artificial Sequence
  chemically synthesized
caattaaaataataaataat

SEQ ID NO: 284375 - DNA, 20 bp, Artificial Sequence
  chemically synthesized
aaataataaataatgagtca

SEQ ID NO: 284376 - DNA, 20 bp, Artificial Sequence
  chemically synthesized
catggtcatttatactgtgc

SEQ ID NO: 284377 - DNA, 20 bp, Artificial Sequence
  chemically synthesized
atggtcatttatactgtgct

SEQ ID NO: 284378 - DNA, 20 bp, Artificial Sequence
  chemically synthesized
ttctaacacaatgcctagca

SEQ ID NO: 284379 - DNA, 20 bp, Artificial Sequence
  chemically synthesized
gaaatttctaacacaatgcc

SEQ ID NO: 284380 - DNA, 20 bp, Artificial Sequence
  chemically synthesized
tactgtgctaggcattgtgt

SEQ ID NO: 284381 - DNA, 20 bp, Artificial Sequence
  chemically synthesized
ctgctttcagaatcattaga

SEQ ID NO: 284382 - DNA, 20 bp, Artificial Sequence
  chemically synthesized
tctgctttcagaatcattag

SEQ ID NO: 284383 - DNA, 20 bp, Artificial Sequence
  chemically synthesized
gtctgctttcagaatcatta

SEQ ID NO: 284384 - DNA, 20 bp, Artificial Sequence
  chemically synthesized
atgtctgctttcagaatcat

SEQ ID NO: 284385 - DNA, 20 bp, Artificial Sequence
  chemically synthesized
catccctctaatgattctga

SEQ ID NO: 284386 - DNA, 20 bp, Artificial Sequence
  chemically synthesized
ccctctaatgattctgaaag

SEQ ID NO: 284387 - DNA, 20 bp, Artificial Sequence
  chemically synthesized
ggtatcagaatgtctgcttt

SEQ ID NO: 284388 - DNA, 20 bp, Artificial Sequence
  chemically synthesized
aaagcagacattctgatacc

SEQ ID NO: 284389 - DNA, 20 bp, Artificial Sequence
  chemically synthesized
ttcgtttgtgaactgggtat

SEQ ID NO: 284390 - DNA, 20 bp, Artificial Sequence
  chemically synthesized
aattccttcgtttgtgaact

SEQ ID NO: 284391 - DNA, 20 bp, Artificial Sequence
  chemically synthesized
aaattccttcgtttgtgaac

SEQ ID NO: 284392 - DNA, 20 bp, Artificial Sequence
  chemically synthesized
tgatacccagttcacaaacg

SEQ ID NO: 284393 - DNA, 20 bp, Artificial Sequence
  chemically synthesized
gatacccagttcacaaacga

SEQ ID NO: 284394 - DNA, 20 bp, Artificial Sequence
  chemically synthesized
agttcacaaacgaaggaatt

SEQ ID NO: 284395 - DNA, 20 bp, Artificial Sequence
  chemically synthesized
acaaacgaaggaatttggct

SEQ ID NO: 284396 - DNA, 20 bp, Artificial Sequence
  chemically synthesized
acgaaggaatttggctcagt

SEQ ID NO: 284397 - DNA, 20 bp, Artificial Sequence
  chemically synthesized
gtgagttacatgagcttact

SEQ ID NO: 284398 - DNA, 20 bp, Artificial Sequence
  chemically synthesized
taaattggggtgagttacat

SEQ ID NO: 284399 - DNA, 20 bp, Artificial Sequence
  chemically synthesized
ccaactgtataaattggggt

SEQ ID NO: 284400 - DNA, 20 bp, Artificial Sequence
  chemically synthesized
catgccaactgtataaattg

SEQ ID NO: 284401 - DNA, 20 bp, Artificial Sequence
  chemically synthesized
ccatgccaactgtataaatt

SEQ ID NO: 284402 - DNA, 20 bp, Artificial Sequence
  chemically synthesized
gtaactcaccccaatttata

SEQ ID NO: 284403 - DNA, 20 bp, Artificial Sequence
  chemically synthesized
cccatgccaactgtataaat

SEQ ID NO: 284404 - DNA, 20 bp, Artificial Sequence
  chemically synthesized
ctcaccccaatttatacagt

SEQ ID NO: 284405 - DNA, 20 bp, Artificial Sequence
  chemically synthesized
cccaatttatacagttggca

SEQ ID NO: 284406 - DNA, 20 bp, Artificial Sequence
  chemically synthesized
ccaatttatacagttggcat

SEQ ID NO: 284407 - DNA, 20 bp, Artificial Sequence
  chemically synthesized
caatttatacagttggcatg

SEQ ID NO: 284408 - DNA, 20 bp, Artificial Sequence
  chemically synthesized
agttggcatggggccgaact

SEQ ID NO: 284409 - DNA, 20 bp, Artificial Sequence
  chemically synthesized
cttgagtttaaaacttagtt

SEQ ID NO: 284410 - DNA, 20 bp, Artificial Sequence
  chemically synthesized
agatacttgagtttaaaact

SEQ ID NO: 284411 - DNA, 20 bp, Artificial Sequence
  chemically synthesized
ccgaactaagttttaaactc

SEQ ID NO: 284412 - DNA, 20 bp, Artificial Sequence
  chemically synthesized
aagttttaaactcaagtatc

SEQ ID NO: 284413 - DNA, 20 bp, Artificial Sequence
  chemically synthesized
caatgtggagccagatactt

SEQ ID NO: 284414 - DNA, 20 bp, Artificial Sequence
  chemically synthesized
aggaaaaatcaatgtggagc

SEQ ID NO: 284415 - DNA, 20 bp, Artificial Sequence
  chemically synthesized
gacaaggaaaaatcaatgtg

SEQ ID NO: 284416 - DNA, 20 bp, Artificial Sequence
  chemically synthesized
gtgacaaggaaaaatcaatg

SEQ ID NO: 284417 - DNA, 20 bp, Artificial Sequence
  chemically synthesized
ttggttcaaggattgtgaca

SEQ ID NO: 284418 - DNA, 20 bp, Artificial Sequence
  chemically synthesized
tttggttcaaggattgtgac

SEQ ID NO: 284419 - DNA, 20 bp, Artificial Sequence
  chemically synthesized
gtagatctttttttggttca

SEQ ID NO: 284420 - DNA, 20 bp, Artificial Sequence
  chemically synthesized
tgtagatctttttttggttc

SEQ ID NO: 284421 - DNA, 20 bp, Artificial Sequence
  chemically synthesized
cacaatccttgaaccaaaaa

SEQ ID NO: 284422 - DNA, 20 bp, Artificial Sequence
  chemically synthesized
taatactgtagatctttttt

SEQ ID NO: 284423 - DNA, 20 bp, Artificial Sequence
  chemically synthesized
ttgaaccaaaaaaagatcta

SEQ ID NO: 284424 - DNA, 20 bp, Artificial Sequence
  chemically synthesized
gacttgaaatattaatactg

SEQ ID NO: 284425 - DNA, 20 bp, Artificial Sequence
  chemically synthesized
atctacagtattaatatttc

SEQ ID NO: 284426 - DNA, 20 bp, Artificial Sequence
  chemically synthesized
aatatttcaagtcattctct

SEQ ID NO: 284427 - DNA, 20 bp, Artificial Sequence
  chemically synthesized
tatgtgctagcaagaactta

SEQ ID NO: 284428 - DNA, 20 bp, Artificial Sequence
  chemically synthesized
tttatgtgctagcaagaact

SEQ ID NO: 284429 - DNA, 20 bp, Artificial Sequence
  chemically synthesized
gtcattctctaagttcttgc

SEQ ID NO: 284430 - DNA, 20 bp, Artificial Sequence
  chemically synthesized
tattatttttatgtgctagc

SEQ ID NO: 284431 - DNA, 20 bp, Artificial Sequence
  chemically synthesized
taattattatttttatgtgc

SEQ ID NO: 284432 - DNA, 20 bp, Artificial Sequence
  chemically synthesized
aaaaataataattatgatta

SEQ ID NO: 284433 - DNA, 20 bp, Artificial Sequence
  chemically synthesized
tatgattatagctactaatt

SEQ ID NO: 284434 - DNA, 20 bp, Artificial Sequence
  chemically synthesized
cagagttggtgctcaattag

SEQ ID NO: 284435 - DNA, 20 bp, Artificial Sequence
  chemically synthesized
actcagagttggtgctcaat

SEQ ID NO: 284436 - DNA, 20 bp, Artificial Sequence
  chemically synthesized
actaattgagcaccaactct

SEQ ID NO: 284437 - DNA, 20 bp, Artificial Sequence
  chemically synthesized
taaattgcctaactcagagt

SEQ ID NO: 284438 - DNA, 20 bp, Artificial Sequence
  chemically synthesized
attgagcaccaactctgagt

SEQ ID NO: 284439 - DNA, 20 bp, Artificial Sequence
  chemically synthesized
ttgagcaccaactctgagtt

SEQ ID NO: 284440 - DNA, 20 bp, Artificial Sequence
  chemically synthesized
tgagtaaattgcctaactca

SEQ ID NO: 284441 - DNA, 20 bp, Artificial Sequence
  chemically synthesized
tgtgagtaaattgcctaact

SEQ ID NO: 284442 - DNA, 20 bp, Artificial Sequence
  chemically synthesized
agttaggcaatttactcaca

SEQ ID NO: 284443 - DNA, 20 bp, Artificial Sequence
  chemically synthesized
taggcaatttactcacatgg

SEQ ID NO: 284444 - DNA, 20 bp, Artificial Sequence
  chemically synthesized
gttgattgtaactaccatgt

SEQ ID NO: 284445 - DNA, 20 bp, Artificial Sequence
  chemically synthesized
cacatggtagttacaatcaa

SEQ ID NO: 284446 - DNA, 20 bp, Artificial Sequence
  chemically synthesized
aatcaacagttcatacattc

SEQ ID NO: 284447 - DNA, 20 bp, Artificial Sequence
  chemically synthesized
aacagttcatacattcaagt

SEQ ID NO: 284448 - DNA, 20 bp, Artificial Sequence
  chemically synthesized
acagttcatacattcaagtg

SEQ ID NO: 284449 - DNA, 20 bp, Artificial Sequence
  chemically synthesized
gttcatacattcaagtgagg

SEQ ID NO: 284450 - DNA, 20 bp, Artificial Sequence
  chemically synthesized
atgatataaacatgataaaa

SEQ ID NO: 284451 - DNA, 20 bp, Artificial Sequence
  chemically synthesized
gatataaacatgataaaaca

SEQ ID NO: 284452 - DNA, 20 bp, Artificial Sequence
  chemically synthesized
atataaacatgataaaacag

SEQ ID NO: 284453 - DNA, 20 bp, Artificial Sequence
  chemically synthesized
ggccttgggcaacaatataa

SEQ ID NO: 284454 - DNA, 20 bp, Artificial Sequence
  chemically synthesized
tgactattatattgttgccc

SEQ ID NO: 284455 - DNA, 20 bp, Artificial Sequence
  chemically synthesized
gactattatattgttgccca

SEQ ID NO: 284456 - DNA, 20 bp, Artificial Sequence
  chemically synthesized
gtggcatttcgtatggcctt

SEQ ID NO: 284457 - DNA, 20 bp, Artificial Sequence
  chemically synthesized
agtggcatttcgtatggcct

SEQ ID NO: 284458 - DNA, 20 bp, Artificial Sequence
  chemically synthesized
ctacatagtggcatttcgta

SEQ ID NO: 284459 - DNA, 20 bp, Artificial Sequence
  chemically synthesized
ccatacgaaatgccactatg

SEQ ID NO: 284460 - DNA, 20 bp, Artificial Sequence
  chemically synthesized
catacgaaatgccactatgt

SEQ ID NO: 284461 - DNA, 20 bp, Artificial Sequence
  chemically synthesized
ctggacttgaacctacatag

SEQ ID NO: 284462 - DNA, 20 bp, Artificial Sequence
  chemically synthesized
agcctggacttgaacctaca

SEQ ID NO: 284463 - DNA, 20 bp, Artificial Sequence
  chemically synthesized
aaatgccactatgtaggttc

SEQ ID NO: 284464 - DNA, 20 bp, Artificial Sequence
  chemically synthesized
ccactatgtaggttcaagtc

SEQ ID NO: 284465 - DNA, 20 bp, Artificial Sequence
  chemically synthesized
cactatgtaggttcaagtcc

SEQ ID NO: 284466 - DNA, 20 bp, Artificial Sequence
  chemically synthesized
atggatttggaggtgaagcc

SEQ ID NO: 284467 - DNA, 20 bp, Artificial Sequence
  chemically synthesized
gtagtatggatttggaggtg

SEQ ID NO: 284468 - DNA, 20 bp, Artificial Sequence
  chemically synthesized
agtatgtagtatggatttgg

SEQ ID NO: 284469 - DNA, 20 bp, Artificial Sequence
  chemically synthesized
tagtatgtagtatggatttg

SEQ ID NO: 284470 - DNA, 20 bp, Artificial Sequence
  chemically synthesized
tgtagtatgtagtatggatt

SEQ ID NO: 284471 - DNA, 20 bp, Artificial Sequence
  chemically synthesized
ctggtatgtagtatgtagta

SEQ ID NO: 284472 - DNA, 20 bp, Artificial Sequence
  chemically synthesized
ggaaactggtatgtagtatg

SEQ ID NO: 284473 - DNA, 20 bp, Artificial Sequence
  chemically synthesized
ccatactacatactacatac

SEQ ID NO: 284474 - DNA, 20 bp, Artificial Sequence
  chemically synthesized
ttacgaaggaaactggtatg

SEQ ID NO: 284475 - DNA, 20 bp, Artificial Sequence
  chemically synthesized
tgacttattacgaaggaaac

SEQ ID NO: 284476 - DNA, 20 bp, Artificial Sequence
  chemically synthesized
ataccagtttccttcgtaat

SEQ ID NO: 284477 - DNA, 20 bp, Artificial Sequence
  chemically synthesized
ataacattgacttattacga

SEQ ID NO: 284478 - DNA, 20 bp, Artificial Sequence
  chemically synthesized
tataacattgacttattacg

SEQ ID NO: 284479 - DNA, 20 bp, Artificial Sequence
  chemically synthesized
tgtacttttcttgaaacaat

SEQ ID NO: 284480 - DNA, 20 bp, Artificial Sequence
  chemically synthesized
atattttgtcctattgtttc

SEQ ID NO: 284481 - DNA, 20 bp, Artificial Sequence
  chemically synthesized
atgtacttttcttgaaacaa

SEQ ID NO: 284482 - DNA, 20 bp, Artificial Sequence
  chemically synthesized
ttgtcctattgtttcaagaa

SEQ ID NO: 284483 - DNA, 20 bp, Artificial Sequence
  chemically synthesized
aagaaaagtacatgtaaact

SEQ ID NO: 284484 - DNA, 20 bp, Artificial Sequence
  chemically synthesized
taatatggatagaaaggact

SEQ ID NO: 284485 - DNA, 20 bp, Artificial Sequence
  chemically synthesized
agcctttaatatggatagaa

SEQ ID NO: 284486 - DNA, 20 bp, Artificial Sequence
  chemically synthesized
tagcctttaatatggataga

SEQ ID NO: 284487 - DNA, 20 bp, Artificial Sequence
  chemically synthesized
cccgtagcctttaatatgga

SEQ ID NO: 284488 - DNA, 20 bp, Artificial Sequence
  chemically synthesized
agtcctttctatccatatta

SEQ ID NO: 284489 - DNA, 20 bp, Artificial Sequence
  chemically synthesized
gtcctttctatccatattaa

SEQ ID NO: 284490 - DNA, 20 bp, Artificial Sequence
  chemically synthesized
tgaacccgtagcctttaata

SEQ ID NO: 284491 - DNA, 20 bp, Artificial Sequence
  chemically synthesized
tctatccatattaaaggcta

SEQ ID NO: 284492 - DNA, 20 bp, Artificial Sequence
  chemically synthesized
ctatccatattaaaggctac

SEQ ID NO: 284493 - DNA, 20 bp, Artificial Sequence
  chemically synthesized
acactaaatatttgaacccg

SEQ ID NO: 284494 - DNA, 20 bp, Artificial Sequence
  chemically synthesized
aggctacgggttcaaatatt

SEQ ID NO: 284495 - DNA, 20 bp, Artificial Sequence
  chemically synthesized
atttagtgtttccaaattct

SEQ ID NO: 284496 - DNA, 20 bp, Artificial Sequence
  chemically synthesized
tgaaggcatttctgagaatt

SEQ ID NO: 284497 - DNA, 20 bp, Artificial Sequence
  chemically synthesized
ggtagtttgaaggcatttct

SEQ ID NO: 284498 - DNA, 20 bp, Artificial Sequence
  chemically synthesized
gtgttaatttggtagtttga

SEQ ID NO: 284499 - DNA, 20 bp, Artificial Sequence
  chemically synthesized
tgtgttaatttggtagtttg

SEQ ID NO: 284500 - DNA, 20 bp, Artificial Sequence
  chemically synthesized
aacaaactgtgttaatttgg

SEQ ID NO: 284501 - DNA, 20 bp, Artificial Sequence
  chemically synthesized
gtcaacaaactgtgttaatt

SEQ ID NO: 284502 - DNA, 20 bp, Artificial Sequence
  chemically synthesized
ttcaaactaccaaattaaca

SEQ ID NO: 284503 - DNA, 20 bp, Artificial Sequence
  chemically synthesized
gaaaagacaaatttataatg

SEQ ID NO: 284504 - DNA, 20 bp, Artificial Sequence
  chemically synthesized
cattataaatttgtcttttc

SEQ ID NO: 284505 - DNA, 20 bp, Artificial Sequence
  chemically synthesized
tgtgcaaaagtattcttgaa

SEQ ID NO: 284506 - DNA, 20 bp, Artificial Sequence
  chemically synthesized
ttttcaagaatacttttgca

SEQ ID NO: 284507 - DNA, 20 bp, Artificial Sequence
  chemically synthesized
tgtacgttgaaactgtgcaa

SEQ ID NO: 284508 - DNA, 20 bp, Artificial Sequence
  chemically synthesized
gtttcaacgtacatttacat

SEQ ID NO: 284509 - DNA, 20 bp, Artificial Sequence
  chemically synthesized
acgtacatttacatcagcta

SEQ ID NO: 284510 - DNA, 20 bp, Artificial Sequence
  chemically synthesized
acatttacatcagctacaga

SEQ ID NO: 284511 - DNA, 20 bp, Artificial Sequence
  chemically synthesized
ctcatttcattaactgtctg

SEQ ID NO: 284512 - DNA, 20 bp, Artificial Sequence
  chemically synthesized
ctacagacagttaatgaaat

SEQ ID NO: 284513 - DNA, 20 bp, Artificial Sequence
  chemically synthesized
atcatgtagtattaagagag

SEQ ID NO: 284514 - DNA, 20 bp, Artificial Sequence
  chemically synthesized
gaaatcatgtagtattaaga

SEQ ID NO: 284515 - DNA, 20 bp, Artificial Sequence
  chemically synthesized
ttgaaatcatgtagtattaa

SEQ ID NO: 284516 - DNA, 20 bp, Artificial Sequence
  chemically synthesized
ccttgaaatcatgtagtatt

SEQ ID NO: 284517 - DNA, 20 bp, Artificial Sequence
  chemically synthesized
aattttcccttgaaatcatg

SEQ ID NO: 284518 - DNA, 20 bp, Artificial Sequence
  chemically synthesized
tcttaatactacatgatttc

SEQ ID NO: 284519 - DNA, 20 bp, Artificial Sequence
  chemically synthesized
cttaatactacatgatttca

SEQ ID NO: 284520 - DNA, 20 bp, Artificial Sequence
  chemically synthesized
ttaatactacatgatttcaa

SEQ ID NO: 284521 - DNA, 20 bp, Artificial Sequence
  chemically synthesized
tgtttaattttaatgcattg

SEQ ID NO: 284522 - DNA, 20 bp, Artificial Sequence
  chemically synthesized
cacaatgcattaaaattaaa

SEQ ID NO: 284523 - DNA, 20 bp, Artificial Sequence
  chemically synthesized
gcattaaaattaaacagttt

SEQ ID NO: 284524 - DNA, 20 bp, Artificial Sequence
  chemically synthesized
cattaaaattaaacagttta

SEQ ID NO: 284525 - DNA, 20 bp, Artificial Sequence
  chemically synthesized
taaaatgtatattaaacttg

SEQ ID NO: 284526 - DNA, 20 bp, Artificial Sequence
  chemically synthesized
aataattttaatttagcttc

SEQ ID NO: 284527 - DNA, 20 bp, Artificial Sequence
  chemically synthesized
tttaattaataattttaatt

SEQ ID NO: 284528 - DNA, 20 bp, Artificial Sequence
  chemically synthesized
taaaaatcaacctcttctct

SEQ ID NO: 284529 - DNA, 20 bp, Artificial Sequence
  chemically synthesized
tttcctggttctaagagaag

SEQ ID NO: 284530 - DNA, 20 bp, Artificial Sequence
  chemically synthesized
ctttcctggttctaagagaa

SEQ ID NO: 284531 - DNA, 20 bp, Artificial Sequence
  chemically synthesized
ctctttcctggttctaagag

SEQ ID NO: 284532 - DNA, 20 bp, Artificial Sequence
  chemically synthesized
tcaacctcttctcttagaac

SEQ ID NO: 284533 - DNA, 20 bp, Artificial Sequence
  chemically synthesized
ctgctctttcctggttctaa

SEQ ID NO: 284534 - DNA, 20 bp, Artificial Sequence
  chemically synthesized
caacctcttctcttagaacc

SEQ ID NO: 284535 - DNA, 20 bp, Artificial Sequence
  chemically synthesized
gtctgctctttcctggttct

SEQ ID NO: 284536 - DNA, 20 bp, Artificial Sequence
  chemically synthesized
ctcttctcttagaaccagga

SEQ ID NO: 284537 - DNA, 20 bp, Artificial Sequence
  chemically synthesized
cttctcttagaaccaggaaa

SEQ ID NO: 284538 - DNA, 20 bp, Artificial Sequence
  chemically synthesized
gtatacagtctgctctttcc

SEQ ID NO: 284539 - DNA, 20 bp, Artificial Sequence
  chemically synthesized
ctcttagaaccaggaaagag

SEQ ID NO: 284540 - DNA, 20 bp, Artificial Sequence
  chemically synthesized
acaatgcttgaagttgtata

SEQ ID NO: 284541 - DNA, 20 bp, Artificial Sequence
  chemically synthesized
agcagactgtatacaacttc

SEQ ID NO: 284542 - DNA, 20 bp, Artificial Sequence
  chemically synthesized
aagaaatgcaacaatgcttg

SEQ ID NO: 284543 - DNA, 20 bp, Artificial Sequence
  chemically synthesized
aggaaataaatggaaaaaga

SEQ ID NO: 284544 - DNA, 20 bp, Artificial Sequence
  chemically synthesized
acaaaggaaataaatggaaa

SEQ ID NO: 284545 - DNA, 20 bp, Artificial Sequence
  chemically synthesized
agtaaaacaaaggaaataaa

SEQ ID NO: 284546 - DNA, 20 bp, Artificial Sequence
  chemically synthesized
agaaaaactaagtaaaacaa

SEQ ID NO: 284547 - DNA, 20 bp, Artificial Sequence
  chemically synthesized
aagaaaaactaagtaaaaca

SEQ ID NO: 284548 - DNA, 20 bp, Artificial Sequence
  chemically synthesized
tttatttcctttgttttact

SEQ ID NO: 284549 - DNA, 20 bp, Artificial Sequence
  chemically synthesized
aaaaaaaaaaaagaaaaact

SEQ ID NO: 284550 - DNA, 20 bp, Artificial Sequence
  chemically synthesized
gatgaaggtaaaaaaaaaaa

SEQ ID NO: 284551 - DNA, 20 bp, Artificial Sequence
  chemically synthesized
gaaagcagttgaagagatga

SEQ ID NO: 284552 - DNA, 20 bp, Artificial Sequence
  chemically synthesized
agaaagcagttgaagagatg

SEQ ID NO: 284553 - DNA, 20 bp, Artificial Sequence
  chemically synthesized
aattacagaaagcagttgaa

SEQ ID NO: 284554 - DNA, 20 bp, Artificial Sequence
  chemically synthesized
tgaattacagaaagcagttg

SEQ ID NO: 284555 - DNA, 20 bp, Artificial Sequence
  chemically synthesized
tccagatgaattacagaaag

SEQ ID NO: 284556 - DNA, 20 bp, Artificial Sequence
  chemically synthesized
aactccagatgaattacaga

SEQ ID NO: 284557 - DNA, 20 bp, Artificial Sequence
  chemically synthesized
ataaaactccagatgaatta

SEQ ID NO: 284558 - DNA, 20 bp, Artificial Sequence
  chemically synthesized
actgctttctgtaattcatc

SEQ ID NO: 284559 - DNA, 20 bp, Artificial Sequence
  chemically synthesized
tgctttctgtaattcatctg

SEQ ID NO: 284560 - DNA, 20 bp, Artificial Sequence
  chemically synthesized
agattttgaatataaaactc

SEQ ID NO: 284561 - DNA, 20 bp, Artificial Sequence
  chemically synthesized
ttatattcaaaatctctctc

SEQ ID NO: 284562 - DNA, 20 bp, Artificial Sequence
  chemically synthesized
tgaagaagagtatcttgaga

SEQ ID NO: 284563 - DNA, 20 bp, Artificial Sequence
  chemically synthesized
gctgaagaagagtatcttga

SEQ ID NO: 284564 - DNA, 20 bp, Artificial Sequence
  chemically synthesized
aagctgaagaagagtatctt

SEQ ID NO: 284565 - DNA, 20 bp, Artificial Sequence
  chemically synthesized
tctctcaagatactcttctt

SEQ ID NO: 284566 - DNA, 20 bp, Artificial Sequence
  chemically synthesized
ggatgacacaagctgaagaa

SEQ ID NO: 284567 - DNA, 20 bp, Artificial Sequence
  chemically synthesized
atggatgacacaagctgaag

SEQ ID NO: 284568 - DNA, 20 bp, Artificial Sequence
  chemically synthesized
cgaatggatgacacaagctg

SEQ ID NO: 284569 - DNA, 20 bp, Artificial Sequence
  chemically synthesized
gatgcacgaatggatgacac

SEQ ID NO: 284570 - DNA, 20 bp, Artificial Sequence
  chemically synthesized
atctatcagagatgcacgaa

SEQ ID NO: 284571 - DNA, 20 bp, Artificial Sequence
  chemically synthesized
atccattcgtgcatctctga

SEQ ID NO: 284572 - DNA, 20 bp, Artificial Sequence
  chemically synthesized
gcctccagaaagatctatca

SEQ ID NO: 284573 - DNA, 20 bp, Artificial Sequence
  chemically synthesized
aagcctccagaaagatctat

SEQ ID NO: 284574 - DNA, 20 bp, Artificial Sequence
  chemically synthesized
gcatctctgatagatctttc

SEQ ID NO: 284575 - DNA, 20 bp, Artificial Sequence
  chemically synthesized
atctctgatagatctttctg

SEQ ID NO: 284576 - DNA, 20 bp, Artificial Sequence
  chemically synthesized
tctctgatagatctttctgg

SEQ ID NO: 284577 - DNA, 20 bp, Artificial Sequence
  chemically synthesized
gaaaactgtaagcctccaga

SEQ ID NO: 284578 - DNA, 20 bp, Artificial Sequence
  chemically synthesized
tggagaaaactgtaagcctc

SEQ ID NO: 284579 - DNA, 20 bp, Artificial Sequence
  chemically synthesized
tagatctttctggaggctta

SEQ ID NO: 284580 - DNA, 20 bp, Artificial Sequence
  chemically synthesized
ggaggtttggagaaaactgt

SEQ ID NO: 284581 - DNA, 20 bp, Artificial Sequence
  chemically synthesized
aggccttgaagggaggtttg

SEQ ID NO: 284582 - DNA, 20 bp, Artificial Sequence
  chemically synthesized
ggaggccttgaagggaggtt

SEQ ID NO: 284583 - DNA, 20 bp, Artificial Sequence
  chemically synthesized
ttttctccaaacctcccttc

SEQ ID NO: 284584 - DNA, 20 bp, Artificial Sequence
  chemically synthesized
tttctccaaacctcccttca

SEQ ID NO: 284585 - DNA, 20 bp, Artificial Sequence
  chemically synthesized
agaaaggaggccttgaaggg

SEQ ID NO: 284586 - DNA, 20 bp, Artificial Sequence
  chemically synthesized
cagaaaggaggccttgaagg

SEQ ID NO: 284587 - DNA, 20 bp, Artificial Sequence
  chemically synthesized
gccagaaaggaggccttgaa

SEQ ID NO: 284588 - DNA, 20 bp, Artificial Sequence
  chemically synthesized
tgccagaaaggaggccttga

SEQ ID NO: 284589 - DNA, 20 bp, Artificial Sequence
  chemically synthesized
atgccagaaaggaggccttg

SEQ ID NO: 284590 - DNA, 20 bp, Artificial Sequence
  chemically synthesized
tcccttcaaggcctcctttc

SEQ ID NO: 284591 - DNA, 20 bp, Artificial Sequence
  chemically synthesized
gaaggtctatgccagaaagg

SEQ ID NO: 284592 - DNA, 20 bp, Artificial Sequence
  chemically synthesized
ggaaggtctatgccagaaag

SEQ ID NO: 284593 - DNA, 20 bp, Artificial Sequence
  chemically synthesized
gtggaaggtctatgccagaa

SEQ ID NO: 284594 - DNA, 20 bp, Artificial Sequence
  chemically synthesized
tcaaggcctcctttctggca

SEQ ID NO: 284595 - DNA, 20 bp, Artificial Sequence
  chemically synthesized
tgtggaaggtctatgccaga

SEQ ID NO: 284596 - DNA, 20 bp, Artificial Sequence
  chemically synthesized
gttttgtggaaggtctatgc

SEQ ID NO: 284597 - DNA, 20 bp, Artificial Sequence
  chemically synthesized
ttgtttgtttgttttgtgga

SEQ ID NO: 284598 - DNA, 20 bp, Artificial Sequence
  chemically synthesized
tttgtttgtttgttttgtgg

SEQ ID NO: 284599 - DNA, 20 bp, Artificial Sequence
  chemically synthesized
tgttttgtttgtttgttttg

SEQ ID NO: 284600 - DNA, 20 bp, Artificial Sequence
  chemically synthesized
aaacaaaacacgattattga

SEQ ID NO: 284601 - DNA, 20 bp, Artificial Sequence
  chemically synthesized
ttattattatattatttcat

SEQ ID NO: 284602 - DNA, 20 bp, Artificial Sequence
  chemically synthesized
tttcatcagtatgtaaataa

SEQ ID NO: 284603 - DNA, 20 bp, Artificial Sequence
  chemically synthesized
atcagtatgtaaataacaga

SEQ ID NO: 284604 - DNA, 20 bp, Artificial Sequence
  chemically synthesized
tatgtaaataacagaaagct

SEQ ID NO: 284605 - DNA, 20 bp, Artificial Sequence
  chemically synthesized
taaataacagaaagcttaga

SEQ ID NO: 284606 - DNA, 20 bp, Artificial Sequence
  chemically synthesized
cttctttatcattactatct

SEQ ID NO: 284607 - DNA, 20 bp, Artificial Sequence
  chemically synthesized
aagcttagatagtaatgata

SEQ ID NO: 284608 - DNA, 20 bp, Artificial Sequence
  chemically synthesized
cttagatagtaatgataaag

SEQ ID NO: 284609 - DNA, 20 bp, Artificial Sequence
  chemically synthesized
agtaatgataaagaagtaaa

SEQ ID NO: 284610 - DNA, 20 bp, Artificial Sequence
  chemically synthesized
agttattttcttatgcatat

SEQ ID NO: 284611 - DNA, 20 bp, Artificial Sequence
  chemically synthesized
agtaaaaagcttatatgcat

SEQ ID NO: 284612 - DNA, 20 bp, Artificial Sequence
  chemically synthesized
atgcataagaaaataactca

SEQ ID NO: 284613 - DNA, 20 bp, Artificial Sequence
  chemically synthesized
tgcataagaaaataactcat

SEQ ID NO: 284614 - DNA, 20 bp, Artificial Sequence
  chemically synthesized
gcataagaaaataactcatg

SEQ ID NO: 284615 - DNA, 20 bp, Artificial Sequence
  chemically synthesized
tgagtgtatctgatccccat

SEQ ID NO: 284616 - DNA, 20 bp, Artificial Sequence
  chemically synthesized
agaaaataactcatggggat

SEQ ID NO: 284617 - DNA, 20 bp, Artificial Sequence
  chemically synthesized
tttcacacttatgggaaatt

SEQ ID NO: 284618 - DNA, 20 bp, Artificial Sequence
  chemically synthesized
agatacactcaatttcccat

SEQ ID NO: 284619 - DNA, 20 bp, Artificial Sequence
  chemically synthesized
tgtcttattttcacacttat

SEQ ID NO: 284620 - DNA, 20 bp, Artificial Sequence
  chemically synthesized
atgtcttattttcacactta

SEQ ID NO: 284621 - DNA, 20 bp, Artificial Sequence
  chemically synthesized
tttcccataagtgtgaaaat

SEQ ID NO: 284622 - DNA, 20 bp, Artificial Sequence
  chemically synthesized
ataagacatgtctgtttatt

SEQ ID NO: 284623 - DNA, 20 bp, Artificial Sequence
  chemically synthesized
tattaagtatgccaaataaa

SEQ ID NO: 284624 - DNA, 20 bp, Artificial Sequence
  chemically synthesized
ggcaatacgttcattttatt

SEQ ID NO: 284625 - DNA, 20 bp, Artificial Sequence
  chemically synthesized
acagctgaattatcatcatc

SEQ ID NO: 284626 - DNA, 20 bp, Artificial Sequence
  chemically synthesized
aacagctgaattatcatcat

SEQ ID NO: 284627 - DNA, 20 bp, Artificial Sequence
  chemically synthesized
attgcccgatgatgataatt

SEQ ID NO: 284628 - DNA, 20 bp, Artificial Sequence
  chemically synthesized
gaaaagcattgtcacacaaa

SEQ ID NO: 284629 - DNA, 20 bp, Artificial Sequence
  chemically synthesized
gtttttctccattcacagaa

SEQ ID NO: 284630 - DNA, 20 bp, Artificial Sequence
  chemically synthesized
tgacaatgcttttctgtgaa

SEQ ID NO: 284631 - DNA, 20 bp, Artificial Sequence
  chemically synthesized
acaatgcttttctgtgaatg

SEQ ID NO: 284632 - DNA, 20 bp, Artificial Sequence
  chemically synthesized
gccttgtttttctccattca

SEQ ID NO: 284633 - DNA, 20 bp, Artificial Sequence
  chemically synthesized
ttctgtgaatggagaaaaac

SEQ ID NO: 284634 - DNA, 20 bp, Artificial Sequence
  chemically synthesized
tctgtgaatggagaaaaaca

SEQ ID NO: 284635 - DNA, 20 bp, Artificial Sequence
  chemically synthesized
ctgaaacatattattttaaa

SEQ ID NO: 284636 - DNA, 20 bp, Artificial Sequence
  chemically synthesized
ctttttaaaataatatgttt

SEQ ID NO: 284637 - DNA, 20 bp, Artificial Sequence
  chemically synthesized
ttaaaataatatgtttcagt

SEQ ID NO: 284638 - DNA, 20 bp, Artificial Sequence
  chemically synthesized
ataatatgtttcagttggaa

SEQ ID NO: 284639 - DNA, 20 bp, Artificial Sequence
  chemically synthesized
agttggaaaagtaattttat

SEQ ID NO: 284640 - DNA, 20 bp, Artificial Sequence
  chemically synthesized
agtaattttattggcataca

SEQ ID NO: 284641 - DNA, 20 bp, Artificial Sequence
  chemically synthesized
tttattggcatacatagaaa

SEQ ID NO: 284642 - DNA, 20 bp, Artificial Sequence
  chemically synthesized
aaacattatgaaagaacaca

SEQ ID NO: 284643 - DNA, 20 bp, Artificial Sequence
  chemically synthesized
aaaatagtaaaacattatga

SEQ ID NO: 284644 - DNA, 20 bp, Artificial Sequence
  chemically synthesized
agttcttagaatatttaaaa

SEQ ID NO: 284645 - DNA, 20 bp, Artificial Sequence
  chemically synthesized
tttactattttaaatattct

SEQ ID NO: 284646 - DNA, 20 bp, Artificial Sequence
  chemically synthesized
atacatgattatgaagttct

SEQ ID NO: 284647 - DNA, 20 bp, Artificial Sequence
  chemically synthesized
tctgtagatacatgattatg

SEQ ID NO: 284648 - DNA, 20 bp, Artificial Sequence
  chemically synthesized
acttcataatcatgtatcta

SEQ ID NO: 284649 - DNA, 20 bp, Artificial Sequence
  chemically synthesized
ttaatttatgagagtttctg

SEQ ID NO: 284650 - DNA, 20 bp, Artificial Sequence
  chemically synthesized
tttttctttttaatttatga

SEQ ID NO: 284651 - DNA, 20 bp, Artificial Sequence
  chemically synthesized
gttttttctttttaatttat

SEQ ID NO: 284652 - DNA, 20 bp, Artificial Sequence
  chemically synthesized
agaaactctcataaattaaa

SEQ ID NO: 284653 - DNA, 20 bp, Artificial Sequence
  chemically synthesized
aattaaaaagaaaaaacgaa

SEQ ID NO: 284654 - DNA, 20 bp, Artificial Sequence
  chemically synthesized
aacgaaaagtgcataaaacg

SEQ ID NO: 284655 - DNA, 20 bp, Artificial Sequence
  chemically synthesized
aaagtgcataaaacgtagtt

SEQ ID NO: 284656 - DNA, 20 bp, Artificial Sequence
  chemically synthesized
acgtagtttggcaattcaca

SEQ ID NO: 284657 - DNA, 20 bp, Artificial Sequence
  chemically synthesized
tagtttggcaattcacaaag

SEQ ID NO: 284658 - DNA, 20 bp, Artificial Sequence
  chemically synthesized
ttcacaaagaagataatata

SEQ ID NO: 284659 - DNA, 20 bp, Artificial Sequence
  chemically synthesized
atggcaatacatgtatataa

SEQ ID NO: 284660 - DNA, 20 bp, Artificial Sequence
  chemically synthesized
catttaactataaatggtat

SEQ ID NO: 284661 - DNA, 20 bp, Artificial Sequence
  chemically synthesized
agatgttctaataccattta

SEQ ID NO: 284662 - DNA, 20 bp, Artificial Sequence
  chemically synthesized
tgcaatcatttaactataaa

SEQ ID NO: 284663 - DNA, 20 bp, Artificial Sequence
  chemically synthesized
agttaaatgattgcaaatcg

SEQ ID NO: 284664 - DNA, 20 bp, Artificial Sequence
  chemically synthesized
ttaatgcattttcacatgtt

SEQ ID NO: 284665 - DNA, 20 bp, Artificial Sequence
  chemically synthesized
tgcattttcacatgttaaga

SEQ ID NO: 284666 - DNA, 20 bp, Artificial Sequence
  chemically synthesized
gcattttcacatgttaagac

SEQ ID NO: 284667 - DNA, 20 bp, Artificial Sequence
  chemically synthesized
cattttcacatgttaagaca

SEQ ID NO: 284668 - DNA, 20 bp, Artificial Sequence
  chemically synthesized
gggaaaaataataattaata

SEQ ID NO: 284669 - DNA, 20 bp, Artificial Sequence
  chemically synthesized
gaaaaataataattaataaa

SEQ ID NO: 284670 - DNA, 20 bp, Artificial Sequence
  chemically synthesized
aattaataaagagcccattt

SEQ ID NO: 284671 - DNA, 20 bp, Artificial Sequence
  chemically synthesized
attaataaagagcccatttt

SEQ ID NO: 284672 - DNA, 20 bp, Artificial Sequence
  chemically synthesized
cccacatccctgcccaaaat

SEQ ID NO: 284673 - DNA, 20 bp, Artificial Sequence
  chemically synthesized
aataaagagcccattttggg

SEQ ID NO: 284674 - DNA, 20 bp, Artificial Sequence
  chemically synthesized
tcccacatccctgcccaaaa

SEQ ID NO: 284675 - DNA, 20 bp, Artificial Sequence
  chemically synthesized
ataaagagcccattttgggc

SEQ ID NO: 284676 - DNA, 20 bp, Artificial Sequence
  chemically synthesized
taaagagcccattttgggca

SEQ ID NO: 284677 - DNA, 20 bp, Artificial Sequence
  chemically synthesized
gcccattttgggcagggatg

SEQ ID NO: 284678 - DNA, 20 bp, Artificial Sequence
  chemically synthesized
cccattttgggcagggatgt

SEQ ID NO: 284679 - DNA, 20 bp, Artificial Sequence
  chemically synthesized
gcagggatgtgggaaaatca

SEQ ID NO: 284680 - DNA, 20 bp, Artificial Sequence
  chemically synthesized
tcaaagtttttatacttgtt

SEQ ID NO: 284681 - DNA, 20 bp, Artificial Sequence
  chemically synthesized
caaagtttttatacttgttg

SEQ ID NO: 284682 - DNA, 20 bp, Artificial Sequence
  chemically synthesized
aaagtttttatacttgttga

SEQ ID NO: 284683 - DNA, 20 bp, Artificial Sequence
  chemically synthesized
tgttggatatttccctcaac

SEQ ID NO: 284684 - DNA, 20 bp, Artificial Sequence
  chemically synthesized
tctaaaaggttgtattatgt

SEQ ID NO: 284685 - DNA, 20 bp, Artificial Sequence
  chemically synthesized
tccaacataatacaaccttt

SEQ ID NO: 284686 - DNA, 20 bp, Artificial Sequence
  chemically synthesized
acataatacaaccttttaga

SEQ ID NO: 284687 - DNA, 20 bp, Artificial Sequence
  chemically synthesized
ttgccatcttactatctaaa

SEQ ID NO: 284688 - DNA, 20 bp, Artificial Sequence
  chemically synthesized
tttgccatcttactatctaa

SEQ ID NO: 284689 - DNA, 20 bp, Artificial Sequence
  chemically synthesized
aatacaaccttttagatagt

SEQ ID NO: 284690 - DNA, 20 bp, Artificial Sequence
  chemically synthesized
caaccttttagatagtaaga

SEQ ID NO: 284691 - DNA, 20 bp, Artificial Sequence
  chemically synthesized
atgttaatgtccacgaatct

SEQ ID NO: 284692 - DNA, 20 bp, Artificial Sequence
  chemically synthesized
gagcagttgactcagattcg

SEQ ID NO: 284693 - DNA, 20 bp, Artificial Sequence
  chemically synthesized
aaaaaatggagcagttgact

SEQ ID NO: 284694 - DNA, 20 bp, Artificial Sequence
  chemically synthesized
ttcactctcaaaaaatggag

SEQ ID NO: 284695 - DNA, 20 bp, Artificial Sequence
  chemically synthesized
tgattcactctcaaaaaatg

SEQ ID NO: 284696 - DNA, 20 bp, Artificial Sequence
  chemically synthesized
agtcaactgctccatttttt

SEQ ID NO: 284697 - DNA, 20 bp, Artificial Sequence
  chemically synthesized
catgattcactctcaaaaaa

SEQ ID NO: 284698 - DNA, 20 bp, Artificial Sequence
  chemically synthesized
tcaactgctccattttttga

SEQ ID NO: 284699 - DNA, 20 bp, Artificial Sequence
  chemically synthesized
agagtgaatcatgccaacca

SEQ ID NO: 284700 - DNA, 20 bp, Artificial Sequence
  chemically synthesized
gttagtctctacactttggt

SEQ ID NO: 284701 - DNA, 20 bp, Artificial Sequence
  chemically synthesized
gaatcatgccaaccaaagtg

SEQ ID NO: 284702 - DNA, 20 bp, Artificial Sequence
  chemically synthesized
atcatgccaaccaaagtgta

SEQ ID NO: 284703 - DNA, 20 bp, Artificial Sequence
  chemically synthesized
acatgttagtctctacactt

SEQ ID NO: 284704 - DNA, 20 bp, Artificial Sequence
  chemically synthesized
gaattaaatattgtacatgt

SEQ ID NO: 284705 - DNA, 20 bp, Artificial Sequence
  chemically synthesized
aacatgtacaatatttaatt

SEQ ID NO: 284706 - DNA, 20 bp, Artificial Sequence
  chemically synthesized
caatatttaattcagcttta

SEQ ID NO: 284707 - DNA, 20 bp, Artificial Sequence
  chemically synthesized
ttcaagatgtttggtcttta

SEQ ID NO: 284708 - DNA, 20 bp, Artificial Sequence
  chemically synthesized
gggtttgttttcaagatgtt

SEQ ID NO: 284709 - DNA, 20 bp, Artificial Sequence
  chemically synthesized
gcacctttgggtttgttttc

SEQ ID NO: 284710 - DNA, 20 bp, Artificial Sequence
  chemically synthesized
acatcttgaaaacaaaccca

SEQ ID NO: 284711 - DNA, 20 bp, Artificial Sequence
  chemically synthesized
catcttgaaaacaaacccaa

SEQ ID NO: 284712 - DNA, 20 bp, Artificial Sequence
  chemically synthesized
tctctcatgaaagcaccttt

SEQ ID NO: 284713 - DNA, 20 bp, Artificial Sequence
  chemically synthesized
atctctcatgaaagcacctt

SEQ ID NO: 284714 - DNA, 20 bp, Artificial Sequence
  chemically synthesized
aaacccaaaggtgctttcat

SEQ ID NO: 284715 - DNA, 20 bp, Artificial Sequence
  chemically synthesized
acccaaaggtgctttcatga

SEQ ID NO: 284716 - DNA, 20 bp, Artificial Sequence
  chemically synthesized
cataatttaatctctcatga

SEQ ID NO: 284717 - DNA, 20 bp, Artificial Sequence
  chemically synthesized
attatgacatatatatacta

SEQ ID NO: 284718 - DNA, 20 bp, Artificial Sequence
  chemically synthesized
ttatgacatatatatactat

SEQ ID NO: 284719 - DNA, 20 bp, Artificial Sequence
  chemically synthesized
ttgtgatgcacagtatccca

SEQ ID NO: 284720 - DNA, 20 bp, Artificial Sequence
  chemically synthesized
aaagatgtatttgtgatgca

SEQ ID NO: 284721 - DNA, 20 bp, Artificial Sequence
  chemically synthesized
agccacttttcatttcagta

SEQ ID NO: 284722 - DNA, 20 bp, Artificial Sequence
  chemically synthesized
tacatctttactgaaatgaa

SEQ ID NO: 284723 - DNA, 20 bp, Artificial Sequence
  chemically synthesized
tattgagccacttttcattt

SEQ ID NO: 284724 - DNA, 20 bp, Artificial Sequence
  chemically synthesized
atctttactgaaatgaaaag

SEQ ID NO: 284725 - DNA, 20 bp, Artificial Sequence
  chemically synthesized
atgaaaagtggctcaatata

SEQ ID NO: 284726 - DNA, 20 bp, Artificial Sequence
  chemically synthesized
tacacgtaaaactttatatt

SEQ ID NO: 284727 - DNA, 20 bp, Artificial Sequence
  chemically synthesized
aagttttacgtgtaaaatgc

SEQ ID NO: 284728 - DNA, 20 bp, Artificial Sequence
  chemically synthesized
gtgtaaaatgcaagttgcaa

SEQ ID NO: 284729 - DNA, 20 bp, Artificial Sequence
  chemically synthesized
gtaaaatgcaagttgcaaaa

SEQ ID NO: 284730 - DNA, 20 bp, Artificial Sequence
  chemically synthesized
gttgcaaaagagtctgtctg

SEQ ID NO: 284731 - DNA, 20 bp, Artificial Sequence
  chemically synthesized
atgttttctataaccacaga

SEQ ID NO: 284732 - DNA, 20 bp, Artificial Sequence
  chemically synthesized
aaagagtctgtctgtggtta

SEQ ID NO: 284733 - DNA, 20 bp, Artificial Sequence
  chemically synthesized
gcagatgttttctataacca

SEQ ID NO: 284734 - DNA, 20 bp, Artificial Sequence
  chemically synthesized
tagaaaacatctgctattta

SEQ ID NO: 284735 - DNA, 20 bp, Artificial Sequence
  chemically synthesized
atgcgtgaggctttaaatag

SEQ ID NO: 284736 - DNA, 20 bp, Artificial Sequence
  chemically synthesized
aaaatgcgtgaggctttaaa

SEQ ID NO: 284737 - DNA, 20 bp, Artificial Sequence
  chemically synthesized
ttagttttcaaaaatgcgtg

SEQ ID NO: 284738 - DNA, 20 bp, Artificial Sequence
  chemically synthesized
tttagttttcaaaaatgcgt

SEQ ID NO: 284739 - DNA, 20 bp, Artificial Sequence
  chemically synthesized
gagtccattgtagaaagttt

SEQ ID NO: 284740 - DNA, 20 bp, Artificial Sequence
  chemically synthesized
aaaactaaaactttctacaa

SEQ ID NO: 284741 - DNA, 20 bp, Artificial Sequence
  chemically synthesized
gtaatggagtccattgtaga

SEQ ID NO: 284742 - DNA, 20 bp, Artificial Sequence
  chemically synthesized
atgagtaatggagtccattg

SEQ ID NO: 284743 - DNA, 20 bp, Artificial Sequence
  chemically synthesized
tttctggttaatgagtaatg

SEQ ID NO: 284744 - DNA, 20 bp, Artificial Sequence
  chemically synthesized
tttttctggttaatgagtaa

SEQ ID NO: 284745 - DNA, 20 bp, Artificial Sequence
  chemically synthesized
ggactccattactcattaac

SEQ ID NO: 284746 - DNA, 20 bp, Artificial Sequence
  chemically synthesized
tttgcatttttctggttaat

SEQ ID NO: 284747 - DNA, 20 bp, Artificial Sequence
  chemically synthesized
ttttaagttttgcatttttc

SEQ ID NO: 284748 - DNA, 20 bp, Artificial Sequence
  chemically synthesized
gattttcttttagatgtttt

SEQ ID NO: 284749 - DNA, 20 bp, Artificial Sequence
  chemically synthesized
gcaaaacttaaaacatctaa

SEQ ID NO: 284750 - DNA, 20 bp, Artificial Sequence
  chemically synthesized
caaggtgtatgattttcttt

SEQ ID NO: 284751 - DNA, 20 bp, Artificial Sequence
  chemically synthesized
aaaatcatacaccttgttac

SEQ ID NO: 284752 - DNA, 20 bp, Artificial Sequence
  chemically synthesized
aaatcatacaccttgttaca

SEQ ID NO: 284753 - DNA, 20 bp, Artificial Sequence
  chemically synthesized
ctatagagtgccttgtaaca

SEQ ID NO: 284754 - DNA, 20 bp, Artificial Sequence
  chemically synthesized
actatagagtgccttgtaac

SEQ ID NO: 284755 - DNA, 20 bp, Artificial Sequence
  chemically synthesized
ccttgttacaaggcactcta

SEQ ID NO: 284756 - DNA, 20 bp, Artificial Sequence
  chemically synthesized
ataatgattgtaatactata

SEQ ID NO: 284757 - DNA, 20 bp, Artificial Sequence
  chemically synthesized
gtataatgattgtaatacta

SEQ ID NO: 284758 - DNA, 20 bp, Artificial Sequence
  chemically synthesized
agtattacaatcattataca

SEQ ID NO: 284759 - DNA, 20 bp, Artificial Sequence
  chemically synthesized
agagttactttttaaagtaa

SEQ ID NO: 284760 - DNA, 20 bp, Artificial Sequence
  chemically synthesized
catagtgcttttactttaaa

SEQ ID NO: 284761 - DNA, 20 bp, Artificial Sequence
  chemically synthesized
ttgaatagagttacttttta

SEQ ID NO: 284762 - DNA, 20 bp, Artificial Sequence
  chemically synthesized
taaaaagtaactctattcaa

SEQ ID NO: 284763 - DNA, 20 bp, Artificial Sequence
  chemically synthesized
agaataccatcttttgaata

SEQ ID NO: 284764 - DNA, 20 bp, Artificial Sequence
  chemically synthesized
gaagaataccatcttttgaa

SEQ ID NO: 284765 - DNA, 20 bp, Artificial Sequence
  chemically synthesized
aagtaactctattcaaaaga

SEQ ID NO: 284766 - DNA, 20 bp, Artificial Sequence
  chemically synthesized
aaagatggtattcttctctc

SEQ ID NO: 284767 - DNA, 20 bp, Artificial Sequence
  chemically synthesized
atgttgtttcaaccagagag

SEQ ID NO: 284768 - DNA, 20 bp, Artificial Sequence
  chemically synthesized
ataatgttgtttcaaccaga

SEQ ID NO: 284769 - DNA, 20 bp, Artificial Sequence
  chemically synthesized
gtataatgttgtttcaacca

SEQ ID NO: 284770 - DNA, 20 bp, Artificial Sequence
  chemically synthesized
atgtataatgttgtttcaac

SEQ ID NO: 284771 - DNA, 20 bp, Artificial Sequence
  chemically synthesized
gaaacaacattatacatttt

SEQ ID NO: 284772 - DNA, 20 bp, Artificial Sequence
  chemically synthesized
acattatacattttaagtaa

SEQ ID NO: 284773 - DNA, 20 bp, Artificial Sequence
  chemically synthesized
attatacattttaagtaaca

SEQ ID NO: 284774 - DNA, 20 bp, Artificial Sequence
  chemically synthesized
tttaagtaacagagttttca

SEQ ID NO: 284775 - DNA, 20 bp, Artificial Sequence
  chemically synthesized
tagtattaatatataatgca

SEQ ID NO: 284776 - DNA, 20 bp, Artificial Sequence
  chemically synthesized
taatatataatgcacagttt

SEQ ID NO: 284777 - DNA, 20 bp, Artificial Sequence
  chemically synthesized
tgcacagttttagtaaaatg

SEQ ID NO: 284778 - DNA, 20 bp, Artificial Sequence
  chemically synthesized
ttagtaaaatgaagtgttca

SEQ ID NO: 284779 - DNA, 20 bp, Artificial Sequence
  chemically synthesized
gttcatggtactttgcccaa

SEQ ID NO: 284780 - DNA, 20 bp, Artificial Sequence
  chemically synthesized
cacatatttactattgggca

SEQ ID NO: 284781 - DNA, 20 bp, Artificial Sequence
  chemically synthesized
ttctacacatatttactatt

SEQ ID NO: 284782 - DNA, 20 bp, Artificial Sequence
  chemically synthesized
attctacacatatttactat

SEQ ID NO: 284783 - DNA, 20 bp, Artificial Sequence
  chemically synthesized
tgcccaatagtaaatatgtg

SEQ ID NO: 284784 - DNA, 20 bp, Artificial Sequence
  chemically synthesized
tataaggaaaatcaatgcga

SEQ ID NO: 284785 - DNA, 20 bp, Artificial Sequence
  chemically synthesized
caaaatggttgtaaattata

SEQ ID NO: 284786 - DNA, 20 bp, Artificial Sequence
  chemically synthesized
tcaaaatggttgtaaattat

SEQ ID NO: 284787 - DNA, 20 bp, Artificial Sequence
  chemically synthesized
ttataatttacaaccatttt

SEQ ID NO: 284788 - DNA, 20 bp, Artificial Sequence
  chemically synthesized
tatctatattaggctcaaaa

SEQ ID NO: 284789 - DNA, 20 bp, Artificial Sequence
  chemically synthesized
caaccattttgagcctaata

SEQ ID NO: 284790 - DNA, 20 bp, Artificial Sequence
  chemically synthesized
aatgaagtattatctatatt

SEQ ID NO: 284791 - DNA, 20 bp, Artificial Sequence
  chemically synthesized
aaatgaagtattatctatat

SEQ ID NO: 284792 - DNA, 20 bp, Artificial Sequence
  chemically synthesized
atatagataatacttcattt

SEQ ID NO: 284793 - DNA, 20 bp, Artificial Sequence
  chemically synthesized
tatagataatacttcatttt

SEQ ID NO: 284794 - DNA, 20 bp, Artificial Sequence
  chemically synthesized
taagtaaagaacctaaaatg

SEQ ID NO: 284795 - DNA, 20 bp, Artificial Sequence
  chemically synthesized
tacatttacctaggtaagta

SEQ ID NO: 284796 - DNA, 20 bp, Artificial Sequence
  chemically synthesized
ttttaggttctttacttacc

SEQ ID NO: 284797 - DNA, 20 bp, Artificial Sequence
  chemically synthesized
tttaggttctttacttacct

SEQ ID NO: 284798 - DNA, 20 bp, Artificial Sequence
  chemically synthesized
agtactacatttacctaggt

SEQ ID NO: 284799 - DNA, 20 bp, Artificial Sequence
  chemically synthesized
atcaagtactacatttacct

SEQ ID NO: 284800 - DNA, 20 bp, Artificial Sequence
  chemically synthesized
gatcaagtactacatttacc

SEQ ID NO: 284801 - DNA, 20 bp, Artificial Sequence
  chemically synthesized
tttacttacctaggtaaatg

SEQ ID NO: 284802 - DNA, 20 bp, Artificial Sequence
  chemically synthesized
tatttacattgtagtagatc

SEQ ID NO: 284803 - DNA, 20 bp, Artificial Sequence
  chemically synthesized
aacatttatttacattgtag

SEQ ID NO: 284804 - DNA, 20 bp, Artificial Sequence
  chemically synthesized
tgaaacatttatttacattg

SEQ ID NO: 284805 - DNA, 20 bp, Artificial Sequence
  chemically synthesized
atattgttctagatgtgtta

SEQ ID NO: 284806 - DNA, 20 bp, Artificial Sequence
  chemically synthesized
catattgttctagatgtgtt

SEQ ID NO: 284807 - DNA, 20 bp, Artificial Sequence
  chemically synthesized
atgtttcaccctaacacatc

SEQ ID NO: 284808 - DNA, 20 bp, Artificial Sequence
  chemically synthesized
acatattgttctagatgtgt

SEQ ID NO: 284809 - DNA, 20 bp, Artificial Sequence
  chemically synthesized
aattgcaagacatattgttc

SEQ ID NO: 284810 - DNA, 20 bp, Artificial Sequence
  chemically synthesized
accttttctagtacaattgc

SEQ ID NO: 284811 - DNA, 20 bp, Artificial Sequence
  chemically synthesized
aatatgtcttgcaattgtac

SEQ ID NO: 284812 - DNA, 20 bp, Artificial Sequence
  chemically synthesized
gtcttgcaattgtactagaa

SEQ ID NO: 284813 - DNA, 20 bp, Artificial Sequence
  chemically synthesized
tcttgcaattgtactagaaa

SEQ ID NO: 284814 - DNA, 20 bp, Artificial Sequence
  chemically synthesized
aataacatttataccttttc

SEQ ID NO: 284815 - DNA, 20 bp, Artificial Sequence
  chemically synthesized
ggtataaatgttattttgtg

SEQ ID NO: 284816 - DNA, 20 bp, Artificial Sequence
  chemically synthesized
tgttttcttaagtttattat

SEQ ID NO: 284817 - DNA, 20 bp, Artificial Sequence
  chemically synthesized
atgttttcttaagtttatta

SEQ ID NO: 284818 - DNA, 20 bp, Artificial Sequence
  chemically synthesized
aatgaacctataataaactt

SEQ ID NO: 284819 - DNA, 20 bp, Artificial Sequence
  chemically synthesized
aaatagcagcatgttttctt

SEQ ID NO: 284820 - DNA, 20 bp, Artificial Sequence
  chemically synthesized
ttataaaatagcaaaaatag

SEQ ID NO: 284821 - DNA, 20 bp, Artificial Sequence
  chemically synthesized
aatttataaaatagcaaaaa

SEQ ID NO: 284822 - DNA, 20 bp, Artificial Sequence
  chemically synthesized
ggatttcttaatttataaaa

SEQ ID NO: 284823 - DNA, 20 bp, Artificial Sequence
  chemically synthesized
tttttgctattttataaatt

SEQ ID NO: 284824 - DNA, 20 bp, Artificial Sequence
  chemically synthesized
ctaagtagaaatttagcagc

SEQ ID NO: 284825 - DNA, 20 bp, Artificial Sequence
  chemically synthesized
tctaagtagaaatttagcag

SEQ ID NO: 284826 - DNA, 20 bp, Artificial Sequence
  chemically synthesized
gtttctaagtagaaatttag

SEQ ID NO: 284827 - DNA, 20 bp, Artificial Sequence
  chemically synthesized
agagtttctaagtagaaatt

SEQ ID NO: 284828 - DNA, 20 bp, Artificial Sequence
  chemically synthesized
cctgctgctaaatttctact

SEQ ID NO: 284829 - DNA, 20 bp, Artificial Sequence
  chemically synthesized
aacagagcagagtttctaag

SEQ ID NO: 284830 - DNA, 20 bp, Artificial Sequence
  chemically synthesized
tataacagagcagagtttct

SEQ ID NO: 284831 - DNA, 20 bp, Artificial Sequence
  chemically synthesized
taaaagattataacagagca

SEQ ID NO: 284832 - DNA, 20 bp, Artificial Sequence
  chemically synthesized
cttaaaagattataacagag

SEQ ID NO: 284833 - DNA, 20 bp, Artificial Sequence
  chemically synthesized
tgccttaaaagattataaca

SEQ ID NO: 284834 - DNA, 20 bp, Artificial Sequence
  chemically synthesized
actgccttaaaagattataa

SEQ ID NO: 284835 - DNA, 20 bp, Artificial Sequence
  chemically synthesized
ctgctctgttataatctttt

SEQ ID NO: 284836 - DNA, 20 bp, Artificial Sequence
  chemically synthesized
tgctctgttataatctttta

SEQ ID NO: 284837 - DNA, 20 bp, Artificial Sequence
  chemically synthesized
tctgttataatcttttaagg

SEQ ID NO: 284838 - DNA, 20 bp, Artificial Sequence
  chemically synthesized
agcttcaccaactgccttaa

SEQ ID NO: 284839 - DNA, 20 bp, Artificial Sequence
  chemically synthesized
ttataatcttttaaggcagt

SEQ ID NO: 284840 - DNA, 20 bp, Artificial Sequence
  chemically synthesized
atcttttaaggcagttggtg

SEQ ID NO: 284841 - DNA, 20 bp, Artificial Sequence
  chemically synthesized
tagtccctctaatatttttg

SEQ ID NO: 284842 - DNA, 20 bp, Artificial Sequence
  chemically synthesized
tggtgaagctacaaaaatat

SEQ ID NO: 284843 - DNA, 20 bp, Artificial Sequence
  chemically synthesized
gtgaagctacaaaaatatta

SEQ ID NO: 284844 - DNA, 20 bp, Artificial Sequence
  chemically synthesized
tgaagctacaaaaatattag

SEQ ID NO: 284845 - DNA, 20 bp, Artificial Sequence
  chemically synthesized
gaagctacaaaaatattaga

SEQ ID NO: 284846 - DNA, 20 bp, Artificial Sequence
  chemically synthesized
aaaaatattagagggactaa

SEQ ID NO: 284847 - DNA, 20 bp, Artificial Sequence
  chemically synthesized
aagtcttggctgaattccat

SEQ ID NO: 284848 - DNA, 20 bp, Artificial Sequence
  chemically synthesized
ttagagggactaatggaatt

SEQ ID NO: 284849 - DNA, 20 bp, Artificial Sequence
  chemically synthesized
gggactaatggaattcagcc

SEQ ID NO: 284850 - DNA, 20 bp, Artificial Sequence
  chemically synthesized
tggaattcagccaagacttc

SEQ ID NO: 284851 - DNA, 20 bp, Artificial Sequence
  chemically synthesized
atagtttttactagaagtct

SEQ ID NO: 284852 - DNA, 20 bp, Artificial Sequence
  chemically synthesized
gaatgtatagtttttactag

SEQ ID NO: 284853 - DNA, 20 bp, Artificial Sequence
  chemically synthesized
tgtgaatgtatagtttttac

SEQ ID NO: 284854 - DNA, 20 bp, Artificial Sequence
  chemically synthesized
aaagtatgtatgtgaatgta

SEQ ID NO: 284855 - DNA, 20 bp, Artificial Sequence
  chemically synthesized
cacacacacacacacacaca

SEQ ID NO: 284856 - DNA, 20 bp, Artificial Sequence
  chemically synthesized
gtgtgtgtgtgcacgtgctc

SEQ ID NO: 284857 - DNA, 20 bp, Artificial Sequence
  chemically synthesized
tgtgtgcacgtgctcaagta

SEQ ID NO: 284858 - DNA, 20 bp, Artificial Sequence
  chemically synthesized
aacaatatctcaccatactt

SEQ ID NO: 284859 - DNA, 20 bp, Artificial Sequence
  chemically synthesized
tgcacgtgctcaagtatggt

SEQ ID NO: 284860 - DNA, 20 bp, Artificial Sequence
  chemically synthesized
caagtatggtgagatattgt

SEQ ID NO: 284861 - DNA, 20 bp, Artificial Sequence
  chemically synthesized
ggtgagatattgttggatcc

SEQ ID NO: 284862 - DNA, 20 bp, Artificial Sequence
  chemically synthesized
tttttgccttcaaaatttcc

SEQ ID NO: 284863 - DNA, 20 bp, Artificial Sequence
  chemically synthesized
gtttttgccttcaaaatttc

SEQ ID NO: 284864 - DNA, 20 bp, Artificial Sequence
  chemically synthesized
gttggatcctggaaattttg

SEQ ID NO: 284865 - DNA, 20 bp, Artificial Sequence
  chemically synthesized
ttggatcctggaaattttga

SEQ ID NO: 284866 - DNA, 20 bp, Artificial Sequence
  chemically synthesized
aattttgaaggcaaaaacga

SEQ ID NO: 284867 - DNA, 20 bp, Artificial Sequence
  chemically synthesized
aaggcaaaaacgacagcatt

SEQ ID NO: 284868 - DNA, 20 bp, Artificial Sequence
  chemically synthesized
aaaacgacagcatttggtga

SEQ ID NO: 284869 - DNA, 20 bp, Artificial Sequence
  chemically synthesized
ttggtgatagatttgatgtt

SEQ ID NO: 284870 - DNA, 20 bp, Artificial Sequence
  chemically synthesized
tagatttgatgttcggctgt

SEQ ID NO: 284871 - DNA, 20 bp, Artificial Sequence
  chemically synthesized
gatttgatgttcggctgtaa

SEQ ID NO: 284872 - DNA, 20 bp, Artificial Sequence
  chemically synthesized
tgtctcctatatttctctta

SEQ ID NO: 284873 - DNA, 20 bp, Artificial Sequence
  chemically synthesized
gttcggctgtaagagaaata

SEQ ID NO: 284874 - DNA, 20 bp, Artificial Sequence
  chemically synthesized
ttcggctgtaagagaaatat

SEQ ID NO: 284875 - DNA, 20 bp, Artificial Sequence
  chemically synthesized
cggctgtaagagaaatatag

SEQ ID NO: 284876 - DNA, 20 bp, Artificial Sequence
  chemically synthesized
gtaagagaaatataggagac

SEQ ID NO: 284877 - DNA, 20 bp, Artificial Sequence
  chemically synthesized
taggagacaagaaaatctcg

SEQ ID NO: 284878 - DNA, 20 bp, Artificial Sequence
  chemically synthesized
aggagacaagaaaatctcgt

SEQ ID NO: 284879 - DNA, 20 bp, Artificial Sequence
  chemically synthesized
ttattcaagccaaatcccac

SEQ ID NO: 284880 - DNA, 20 bp, Artificial Sequence
  chemically synthesized
caagaaaatctcgtgggatt

SEQ ID NO: 284881 - DNA, 20 bp, Artificial Sequence
  chemically synthesized
tcgtgggatttggcttgaat

SEQ ID NO: 284882 - DNA, 20 bp, Artificial Sequence
  chemically synthesized
tgggatttggcttgaataag

SEQ ID NO: 284883 - DNA, 20 bp, Artificial Sequence
  chemically synthesized
ctccatctttccacttattc

SEQ ID NO: 284884 - DNA, 20 bp, Artificial Sequence
  chemically synthesized
atttggcttgaataagtgga

SEQ ID NO: 284885 - DNA, 20 bp, Artificial Sequence
  chemically synthesized
ggcttgaataagtggaaaga

SEQ ID NO: 284886 - DNA, 20 bp, Artificial Sequence
  chemically synthesized
cttgaataagtggaaagatg

SEQ ID NO: 284887 - DNA, 20 bp, Artificial Sequence
  chemically synthesized
ttgaataagtggaaagatgg

SEQ ID NO: 284888 - DNA, 20 bp, Artificial Sequence
  chemically synthesized
aatttgcctgttattacaaa

SEQ ID NO: 284889 - DNA, 20 bp, Artificial Sequence
  chemically synthesized
ggaggtgccatttgtaataa

SEQ ID NO: 284890 - DNA, 20 bp, Artificial Sequence
  chemically synthesized
gaggtgccatttgtaataac

SEQ ID NO: 284891 - DNA, 20 bp, Artificial Sequence
  chemically synthesized
tgtaataacaggcaaatttc

SEQ ID NO: 284892 - DNA, 20 bp, Artificial Sequence
  chemically synthesized
gtaataacaggcaaatttct

SEQ ID NO: 284893 - DNA, 20 bp, Artificial Sequence
  chemically synthesized
taataacaggcaaatttcta

SEQ ID NO: 284894 - DNA, 20 bp, Artificial Sequence
  chemically synthesized
taacaggcaaatttctaggg

SEQ ID NO: 284895 - DNA, 20 bp, Artificial Sequence
  chemically synthesized
caggcaaatttctagggtag

SEQ ID NO: 284896 - DNA, 20 bp, Artificial Sequence
  chemically synthesized
tataccccagtctactaccc

SEQ ID NO: 284897 - DNA, 20 bp, Artificial Sequence
  chemically synthesized
aaatttctagggtagtagac

SEQ ID NO: 284898 - DNA, 20 bp, Artificial Sequence
  chemically synthesized
aatttctagggtagtagact

SEQ ID NO: 284899 - DNA, 20 bp, Artificial Sequence
  chemically synthesized
atttctagggtagtagactg

SEQ ID NO: 284900 - DNA, 20 bp, Artificial Sequence
  chemically synthesized
aaaattcctgatgtataccc

SEQ ID NO: 284901 - DNA, 20 bp, Artificial Sequence
  chemically synthesized
tagtagactggggtatacat

SEQ ID NO: 284902 - DNA, 20 bp, Artificial Sequence
  chemically synthesized
agtagactggggtatacatc

SEQ ID NO: 284903 - DNA, 20 bp, Artificial Sequence
  chemically synthesized
ggaattttgttttaacatgt

SEQ ID NO: 284904 - DNA, 20 bp, Artificial Sequence
  chemically synthesized
cctccacatcaattaataat

SEQ ID NO: 284905 - DNA, 20 bp, Artificial Sequence
  chemically synthesized
acctccacatcaattaataa

SEQ ID NO: 284906 - DNA, 20 bp, Artificial Sequence
  chemically synthesized
atgcctattattaattgatg

SEQ ID NO: 284907 - DNA, 20 bp, Artificial Sequence
  chemically synthesized
gcctattattaattgatgtg

SEQ ID NO: 284908 - DNA, 20 bp, Artificial Sequence
  chemically synthesized
cctattattaattgatgtgg

SEQ ID NO: 284909 - DNA, 20 bp, Artificial Sequence
  chemically synthesized
ttaattgatgtggaggtgtt

SEQ ID NO: 284910 - DNA, 20 bp, Artificial Sequence
  chemically synthesized
attgatgtggaggtgttgag

SEQ ID NO: 284911 - DNA, 20 bp, Artificial Sequence
  chemically synthesized
ttgatgtggaggtgttgagt

SEQ ID NO: 284912 - DNA, 20 bp, Artificial Sequence
  chemically synthesized
ggaggtgttgagtgggcaaa

SEQ ID NO: 284913 - DNA, 20 bp, Artificial Sequence
  chemically synthesized
gaggtgttgagtgggcaaat

SEQ ID NO: 284914 - DNA, 20 bp, Artificial Sequence
  chemically synthesized
tgagtgggcaaatgggtatg

SEQ ID NO: 284915 - DNA, 20 bp, Artificial Sequence
  chemically synthesized
gagtgggcaaatgggtatgc

SEQ ID NO: 284916 - DNA, 20 bp, Artificial Sequence
  chemically synthesized
ggcaaatgggtatgcaggtc

SEQ ID NO: 284917 - DNA, 20 bp, Artificial Sequence
  chemically synthesized
gcaaatgggtatgcaggtct

SEQ ID NO: 284918 - DNA, 20 bp, Artificial Sequence
  chemically synthesized
gtatgcaggtctaggatcat

SEQ ID NO: 284919 - DNA, 20 bp, Artificial Sequence
  chemically synthesized
tggaccctttctaatgatcc

SEQ ID NO: 284920 - DNA, 20 bp, Artificial Sequence
  chemically synthesized
gcaggtctaggatcattaga

SEQ ID NO: 284921 - DNA, 20 bp, Artificial Sequence
  chemically synthesized
caggtctaggatcattagaa

SEQ ID NO: 284922 - DNA, 20 bp, Artificial Sequence
  chemically synthesized
aggtctaggatcattagaaa

SEQ ID NO: 284923 - DNA, 20 bp, Artificial Sequence
  chemically synthesized
taggatcattagaaagggtc

SEQ ID NO: 284924 - DNA, 20 bp, Artificial Sequence
  chemically synthesized
tttttttttttttaacaatc

SEQ ID NO: 284925 - DNA, 20 bp, Artificial Sequence
  chemically synthesized
aaaaaaaaaaaaaaaactta

SEQ ID NO: 284926 - DNA, 20 bp, Artificial Sequence
  chemically synthesized
aaaaaaaaaaaaacttacag

SEQ ID NO: 284927 - DNA, 20 bp, Artificial Sequence
  chemically synthesized
aaaaaaaaaaaacttacagc

SEQ ID NO: 284928 - DNA, 20 bp, Artificial Sequence
  chemically synthesized
ctgtaagttgttcctgctgt

SEQ ID NO: 284929 - DNA, 20 bp, Artificial Sequence
  chemically synthesized
cttacagcaggaacaactta

SEQ ID NO: 284930 - DNA, 20 bp, Artificial Sequence
  chemically synthesized
tagttttaaatgtaatctgt

SEQ ID NO: 284931 - DNA, 20 bp, Artificial Sequence
  chemically synthesized
acagattacatttaaaacta

SEQ ID NO: 284932 - DNA, 20 bp, Artificial Sequence
  chemically synthesized
agattacatttaaaactatg

SEQ ID NO: 284933 - DNA, 20 bp, Artificial Sequence
  chemically synthesized
ggtcaacttatcaagctcca

SEQ ID NO: 284934 - DNA, 20 bp, Artificial Sequence
  chemically synthesized
ttaaaactatggagcttgat

SEQ ID NO: 284935 - DNA, 20 bp, Artificial Sequence
  chemically synthesized
actctccgggtcaacttatc

SEQ ID NO: 284936 - DNA, 20 bp, Artificial Sequence
  chemically synthesized
tggagcttgataagttgacc

SEQ ID NO: 284937 - DNA, 20 bp, Artificial Sequence
  chemically synthesized
gagcttgataagttgacccg

SEQ ID NO: 284938 - DNA, 20 bp, Artificial Sequence
  chemically synthesized
gcttgataagttgacccgga

SEQ ID NO: 284939 - DNA, 20 bp, Artificial Sequence
  chemically synthesized
tgataagttgacccggagag

SEQ ID NO: 284940 - DNA, 20 bp, Artificial Sequence
  chemically synthesized
gataagttgacccggagagt

SEQ ID NO: 284941 - DNA, 20 bp, Artificial Sequence
  chemically synthesized
cctattaccacccactctcc

SEQ ID NO: 284942 - DNA, 20 bp, Artificial Sequence
  chemically synthesized
ccctattaccacccactctc

SEQ ID NO: 284943 - DNA, 20 bp, Artificial Sequence
  chemically synthesized
aagttgacccggagagtggg

SEQ ID NO: 284944 - DNA, 20 bp, Artificial Sequence
  chemically synthesized
acccggagagtgggtggtaa

SEQ ID NO: 284945 - DNA, 20 bp, Artificial Sequence
  chemically synthesized
cccggagagtgggtggtaat

SEQ ID NO: 284946 - DNA, 20 bp, Artificial Sequence
  chemically synthesized
ccggagagtgggtggtaata

SEQ ID NO: 284947 - DNA, 20 bp, Artificial Sequence
  chemically synthesized
cggagagtgggtggtaatag

SEQ ID NO: 284948 - DNA, 20 bp, Artificial Sequence
  chemically synthesized
ggagagtgggtggtaatagg

SEQ ID NO: 284949 - DNA, 20 bp, Artificial Sequence
  chemically synthesized
ggtaatagggggaaaaaaaa

SEQ ID NO: 284950 - DNA, 20 bp, Artificial Sequence
  chemically synthesized
gtaatagggggaaaaaaaaa

SEQ ID NO: 284951 - DNA, 20 bp, Artificial Sequence
  chemically synthesized
aatagggggaaaaaaaaaag

SEQ ID NO: 284952 - DNA, 20 bp, Artificial Sequence
  chemically synthesized
ggaaaaaaaaaaggagtcca

SEQ ID NO: 284953 - DNA, 20 bp, Artificial Sequence
  chemically synthesized
aaaaaaggagtccacagact

SEQ ID NO: 284954 - DNA, 20 bp, Artificial Sequence
  chemically synthesized
gtgttccagggctcagtctg

SEQ ID NO: 284955 - DNA, 20 bp, Artificial Sequence
  chemically synthesized
ggagtccacagactgagccc

SEQ ID NO: 284956 - DNA, 20 bp, Artificial Sequence
  chemically synthesized
tttgaaagtgttccagggct

SEQ ID NO: 284957 - DNA, 20 bp, Artificial Sequence
  chemically synthesized
ctaaatttgaaagtgttcca

SEQ ID NO: 284958 - DNA, 20 bp, Artificial Sequence
  chemically synthesized
actaaatttgaaagtgttcc

SEQ ID NO: 284959 - DNA, 20 bp, Artificial Sequence
  chemically synthesized
cactaaatttgaaagtgttc

SEQ ID NO: 284960 - DNA, 20 bp, Artificial Sequence
  chemically synthesized
ccctggaacactttcaaatt

SEQ ID NO: 284961 - DNA, 20 bp, Artificial Sequence
  chemically synthesized
gccctgaccactaaatttga

SEQ ID NO: 284962 - DNA, 20 bp, Artificial Sequence
  chemically synthesized
tggaacactttcaaatttag

SEQ ID NO: 284963 - DNA, 20 bp, Artificial Sequence
  chemically synthesized
acactttcaaatttagtggt

SEQ ID NO: 284964 - DNA, 20 bp, Artificial Sequence
  chemically synthesized
cactttcaaatttagtggtc

SEQ ID NO: 284965 - DNA, 20 bp, Artificial Sequence
  chemically synthesized
actttcaaatttagtggtca

SEQ ID NO: 284966 - DNA, 20 bp, Artificial Sequence
  chemically synthesized
aaatttagtggtcagggcaa

SEQ ID NO: 284967 - DNA, 20 bp, Artificial Sequence
  chemically synthesized
gtcagggcaatagaaccacc

SEQ ID NO: 284968 - DNA, 20 bp, Artificial Sequence
  chemically synthesized
tcagggcaatagaaccacca

SEQ ID NO: 284969 - DNA, 20 bp, Artificial Sequence
  chemically synthesized
accactgtcaatatccttgg

SEQ ID NO: 284970 - DNA, 20 bp, Artificial Sequence
  chemically synthesized
ctgaccactgtcaatatcct

SEQ ID NO: 284971 - DNA, 20 bp, Artificial Sequence
  chemically synthesized
agaaccaccaaggatattga

SEQ ID NO: 284972 - DNA, 20 bp, Artificial Sequence
  chemically synthesized
accaccaaggatattgacag

SEQ ID NO: 284973 - DNA, 20 bp, Artificial Sequence
  chemically synthesized
ccaaggatattgacagtggt

SEQ ID NO: 284974 - DNA, 20 bp, Artificial Sequence
  chemically synthesized
caaggatattgacagtggtc

SEQ ID NO: 284975 - DNA, 20 bp, Artificial Sequence
  chemically synthesized
aaggatattgacagtggtca

SEQ ID NO: 284976 - DNA, 20 bp, Artificial Sequence
  chemically synthesized
gacagtggtcagggaaaact

SEQ ID NO: 284977 - DNA, 20 bp, Artificial Sequence
  chemically synthesized
cagtggtcagggaaaactaa

SEQ ID NO: 284978 - DNA, 20 bp, Artificial Sequence
  chemically synthesized
attctttcttaattatctct

SEQ ID NO: 284979 - DNA, 20 bp, Artificial Sequence
  chemically synthesized
gggaaaactaagagataatt

SEQ ID NO: 284980 - DNA, 20 bp, Artificial Sequence
  chemically synthesized
aaactaagagataattaaga

SEQ ID NO: 284981 - DNA, 20 bp, Artificial Sequence
  chemically synthesized
attaagaaagaatgatgaca

SEQ ID NO: 284982 - DNA, 20 bp, Artificial Sequence
  chemically synthesized
aagaaagaatgatgacacag

SEQ ID NO: 284983 - DNA, 20 bp, Artificial Sequence
  chemically synthesized
actaaatcgctaaattcagt

SEQ ID NO: 284984 - DNA, 20 bp, Artificial Sequence
  chemically synthesized
acacagaagccaactgaatt

SEQ ID NO: 284985 - DNA, 20 bp, Artificial Sequence
  chemically synthesized
tattactaaatcgctaaatt

SEQ ID NO: 284986 - DNA, 20 bp, Artificial Sequence
  chemically synthesized
gccaactgaatttagcgatt

SEQ ID NO: 284987 - DNA, 20 bp, Artificial Sequence
  chemically synthesized
gcagattttgtcagggtcat

SEQ ID NO: 284988 - DNA, 20 bp, Artificial Sequence
  chemically synthesized
tattaaagcagattttgtca

SEQ ID NO: 284989 - DNA, 20 bp, Artificial Sequence
  chemically synthesized
ctattaaagcagattttgtc

SEQ ID NO: 284990 - DNA, 20 bp, Artificial Sequence
  chemically synthesized
tctattaaagcagattttgt

SEQ ID NO: 284991 - DNA, 20 bp, Artificial Sequence
  chemically synthesized
cctgacaaaatctgctttaa

SEQ ID NO: 284992 - DNA, 20 bp, Artificial Sequence
  chemically synthesized
tcctcactattctattaaag

SEQ ID NO: 284993 - DNA, 20 bp, Artificial Sequence
  chemically synthesized
ttatcctcactattctatta

SEQ ID NO: 284994 - DNA, 20 bp, Artificial Sequence
  chemically synthesized
caaaatctgctttaatagaa

SEQ ID NO: 284995 - DNA, 20 bp, Artificial Sequence
  chemically synthesized
atctgctttaatagaatagt

SEQ ID NO: 284996 - DNA, 20 bp, Artificial Sequence
  chemically synthesized
tctgctttaatagaatagtg

SEQ ID NO: 284997 - DNA, 20 bp, Artificial Sequence
  chemically synthesized
taatagaatagtgaggataa

SEQ ID NO: 284998 - DNA, 20 bp, Artificial Sequence
  chemically synthesized
agtgaggataacagtttgat

SEQ ID NO: 284999 - DNA, 20 bp, Artificial Sequence
  chemically synthesized
gtttgattagctctcttaat

SEQ ID NO: 285000 - DNA, 20 bp, Artificial Sequence
  chemically synthesized
tctcttgatgccaattaaga

SEQ ID NO: 285001 - DNA, 20 bp, Artificial Sequence
  chemically synthesized
tctctcttgatgccaattaa

SEQ ID NO: 285002 - DNA, 20 bp, Artificial Sequence
  chemically synthesized
cttctctcttgatgccaatt

SEQ ID NO: 285003 - DNA, 20 bp, Artificial Sequence
  chemically synthesized
tagctctcttaattggcatc

SEQ ID NO: 285004 - DNA, 20 bp, Artificial Sequence
  chemically synthesized
gctctcttaattggcatcaa

SEQ ID NO: 285005 - DNA, 20 bp, Artificial Sequence
  chemically synthesized
tctcttaattggcatcaaga

SEQ ID NO: 285006 - DNA, 20 bp, Artificial Sequence
  chemically synthesized
cttaattggcatcaagagag

SEQ ID NO: 285007 - DNA, 20 bp, Artificial Sequence
  chemically synthesized
ttaattggcatcaagagaga

SEQ ID NO: 285008 - DNA, 20 bp, Artificial Sequence
  chemically synthesized
taattggcatcaagagagaa

SEQ ID NO: 285009 - DNA, 20 bp, Artificial Sequence
  chemically synthesized
ttggcatcaagagagaaggg

SEQ ID NO: 285010 - DNA, 20 bp, Artificial Sequence
  chemically synthesized
tggcatcaagagagaaggga

SEQ ID NO: 285011 - DNA, 20 bp, Artificial Sequence
  chemically synthesized
gcatcaagagagaagggaag

SEQ ID NO: 285012 - DNA, 20 bp, Artificial Sequence
  chemically synthesized
agagaagggaaggagtgaaa

SEQ ID NO: 285013 - DNA, 20 bp, Artificial Sequence
  chemically synthesized
agaagggaaggagtgaaatg

SEQ ID NO: 285014 - DNA, 20 bp, Artificial Sequence
  chemically synthesized
aagggaaggagtgaaatgga

SEQ ID NO: 285015 - DNA, 20 bp, Artificial Sequence
  chemically synthesized
gaaggagtgaaatggagaga

SEQ ID NO: 285016 - DNA, 20 bp, Artificial Sequence
  chemically synthesized
aaggagtgaaatggagagaa

SEQ ID NO: 285017 - DNA, 20 bp, Artificial Sequence
  chemically synthesized
gagagaaaggaatgtctgta

SEQ ID NO: 285018 - DNA, 20 bp, Artificial Sequence
  chemically synthesized
agagaaaggaatgtctgtaa

SEQ ID NO: 285019 - DNA, 20 bp, Artificial Sequence
  chemically synthesized
gagaaaggaatgtctgtaaa

SEQ ID NO: 285020 - DNA, 20 bp, Artificial Sequence
  chemically synthesized
tccattcccgtttcccttta

SEQ ID NO: 285021 - DNA, 20 bp, Artificial Sequence
  chemically synthesized
ggaatgtctgtaaagggaaa

SEQ ID NO: 285022 - DNA, 20 bp, Artificial Sequence
  chemically synthesized
gaatgtctgtaaagggaaac

SEQ ID NO: 285023 - DNA, 20 bp, Artificial Sequence
  chemically synthesized
tctgtaaagggaaacgggaa

SEQ ID NO: 285024 - DNA, 20 bp, Artificial Sequence
  chemically synthesized
tgtaaagggaaacgggaatg

SEQ ID NO: 285025 - DNA, 20 bp, Artificial Sequence
  chemically synthesized
taaagggaaacgggaatgga

SEQ ID NO: 285026 - DNA, 20 bp, Artificial Sequence
  chemically synthesized
aaagggaaacgggaatggag

SEQ ID NO: 285027 - DNA, 20 bp, Artificial Sequence
  chemically synthesized
aacgggaatggagaggttgc

SEQ ID NO: 285028 - DNA, 20 bp, Artificial Sequence
  chemically synthesized
cgggaatggagaggttgcta

SEQ ID NO: 285029 - DNA, 20 bp, Artificial Sequence
  chemically synthesized
ggaatggagaggttgctaga

SEQ ID NO: 285030 - DNA, 20 bp, Artificial Sequence
  chemically synthesized
caattggacaacaatctctc

SEQ ID NO: 285031 - DNA, 20 bp, Artificial Sequence
  chemically synthesized
agagagattgttgtccaatt

SEQ ID NO: 285032 - DNA, 20 bp, Artificial Sequence
  chemically synthesized
gagagattgttgtccaattg

SEQ ID NO: 285033 - DNA, 20 bp, Artificial Sequence
  chemically synthesized
catttaaaagaatcctcaat

SEQ ID NO: 285034 - DNA, 20 bp, Artificial Sequence
  chemically synthesized
taatatctcctgtcatttaa

SEQ ID NO: 285035 - DNA, 20 bp, Artificial Sequence
  chemically synthesized
ttgaggattcttttaaatga

SEQ ID NO: 285036 - DNA, 20 bp, Artificial Sequence
  chemically synthesized
tgaggattcttttaaatgac

SEQ ID NO: 285037 - DNA, 20 bp, Artificial Sequence
  chemically synthesized
aggattcttttaaatgacag

SEQ ID NO: 285038 - DNA, 20 bp, Artificial Sequence
  chemically synthesized
ttaaatgacaggagatatta

SEQ ID NO: 285039 - DNA, 20 bp, Artificial Sequence
  chemically synthesized
acagaataattctctactga

SEQ ID NO: 285040 - DNA, 20 bp, Artificial Sequence
  chemically synthesized
cagaataattctctactgat

SEQ ID NO: 285041 - DNA, 20 bp, Artificial Sequence
  chemically synthesized
tcccatcattcccatcagta

SEQ ID NO: 285042 - DNA, 20 bp, Artificial Sequence
  chemically synthesized
attcccatcattcccatcag

SEQ ID NO: 285043 - DNA, 20 bp, Artificial Sequence
  chemically synthesized
atcattcccatcattcccat

SEQ ID NO: 285044 - DNA, 20 bp, Artificial Sequence
  chemically synthesized
ttctctactgatgggaatga

SEQ ID NO: 285045 - DNA, 20 bp, Artificial Sequence
  chemically synthesized
tctctactgatgggaatgat

SEQ ID NO: 285046 - DNA, 20 bp, Artificial Sequence
  chemically synthesized
tgggaatgatgggaatgatg

SEQ ID NO: 285047 - DNA, 20 bp, Artificial Sequence
  chemically synthesized
atgatgggaatgatgtagcg

SEQ ID NO: 285048 - DNA, 20 bp, Artificial Sequence
  chemically synthesized
gatgggaatgatgtagcgtg

SEQ ID NO: 285049 - DNA, 20 bp, Artificial Sequence
  chemically synthesized
gggaatgatgtagcgtggag

SEQ ID NO: 285050 - DNA, 20 bp, Artificial Sequence
  chemically synthesized
gatgtagcgtggagaagatg

SEQ ID NO: 285051 - DNA, 20 bp, Artificial Sequence
  chemically synthesized
atgtagcgtggagaagatgt

SEQ ID NO: 285052 - DNA, 20 bp, Artificial Sequence
  chemically synthesized
gtagcgtggagaagatgtag

SEQ ID NO: 285053 - DNA, 20 bp, Artificial Sequence
  chemically synthesized
tagcgtggagaagatgtagg

SEQ ID NO: 285054 - DNA, 20 bp, Artificial Sequence
  chemically synthesized
cgtggagaagatgtaggagg

SEQ ID NO: 285055 - DNA, 20 bp, Artificial Sequence
  chemically synthesized
tggagaagatgtaggaggta

SEQ ID NO: 285056 - DNA, 20 bp, Artificial Sequence
  chemically synthesized
ggagaagatgtaggaggtag

SEQ ID NO: 285057 - DNA, 20 bp, Artificial Sequence
  chemically synthesized
gagaagatgtaggaggtaga

SEQ ID NO: 285058 - DNA, 20 bp, Artificial Sequence
  chemically synthesized
ggaggtagagggctgttcat

SEQ ID NO: 285059 - DNA, 20 bp, Artificial Sequence
  chemically synthesized
acattgtaacagctaatgaa

SEQ ID NO: 285060 - DNA, 20 bp, Artificial Sequence
  chemically synthesized
tctgcacaaggacattgtaa

SEQ ID NO: 285061 - DNA, 20 bp, Artificial Sequence
  chemically synthesized
gctgttacaatgtccttgtg

SEQ ID NO: 285062 - DNA, 20 bp, Artificial Sequence
  chemically synthesized
tgttacaatgtccttgtgca

SEQ ID NO: 285063 - DNA, 20 bp, Artificial Sequence
  chemically synthesized
ctttcccttgtctctgcaca

SEQ ID NO: 285064 - DNA, 20 bp, Artificial Sequence
  chemically synthesized
cctttcccttgtctctgcac

SEQ ID NO: 285065 - DNA, 20 bp, Artificial Sequence
  chemically synthesized
caatgtccttgtgcagagac

SEQ ID NO: 285066 - DNA, 20 bp, Artificial Sequence
  chemically synthesized
aatgtccttgtgcagagaca

SEQ ID NO: 285067 - DNA, 20 bp, Artificial Sequence
  chemically synthesized
atgtccttgtgcagagacaa

SEQ ID NO: 285068 - DNA, 20 bp, Artificial Sequence
  chemically synthesized
ccttgtgcagagacaaggga

SEQ ID NO: 285069 - DNA, 20 bp, Artificial Sequence
  chemically synthesized
cttgtgcagagacaagggaa

SEQ ID NO: 285070 - DNA, 20 bp, Artificial Sequence
  chemically synthesized
ttgtgcagagacaagggaaa

SEQ ID NO: 285071 - DNA, 20 bp, Artificial Sequence
  chemically synthesized
agagacaagggaaagggatc

SEQ ID NO: 285072 - DNA, 20 bp, Artificial Sequence
  chemically synthesized
gagacaagggaaagggatcc

SEQ ID NO: 285073 - DNA, 20 bp, Artificial Sequence
  chemically synthesized
ggaaagggatccaggtacgt

SEQ ID NO: 285074 - DNA, 20 bp, Artificial Sequence
  chemically synthesized
agcttttccacttacgtacc

SEQ ID NO: 285075 - DNA, 20 bp, Artificial Sequence
  chemically synthesized
aagggatccaggtacgtaag

SEQ ID NO: 285076 - DNA, 20 bp, Artificial Sequence
  chemically synthesized
atccaggtacgtaagtggaa

SEQ ID NO: 285077 - DNA, 20 bp, Artificial Sequence
  chemically synthesized
aggtacgtaagtggaaaagc

SEQ ID NO: 285078 - DNA, 20 bp, Artificial Sequence
  chemically synthesized
gtaagtggaaaagctggcct

SEQ ID NO: 285079 - DNA, 20 bp, Artificial Sequence
  chemically synthesized
tctgtgcttttgtctaaggc

SEQ ID NO: 285080 - DNA, 20 bp, Artificial Sequence
  chemically synthesized
gaaaagctggccttagacaa

SEQ ID NO: 285081 - DNA, 20 bp, Artificial Sequence
  chemically synthesized
actttctgtgcttttgtcta

SEQ ID NO: 285082 - DNA, 20 bp, Artificial Sequence
  chemically synthesized
aactttctgtgcttttgtct

SEQ ID NO: 285083 - DNA, 20 bp, Artificial Sequence
  chemically synthesized
gctggccttagacaaaagca

SEQ ID NO: 285084 - DNA, 20 bp, Artificial Sequence
  chemically synthesized
gccttagacaaaagcacaga

SEQ ID NO: 285085 - DNA, 20 bp, Artificial Sequence
  chemically synthesized
ctactttccctttgtttaca

SEQ ID NO: 285086 - DNA, 20 bp, Artificial Sequence
  chemically synthesized
aaagttcatctatgtaaaca

SEQ ID NO: 285087 - DNA, 20 bp, Artificial Sequence
  chemically synthesized
aagttcatctatgtaaacaa

SEQ ID NO: 285088 - DNA, 20 bp, Artificial Sequence
  chemically synthesized
agttcatctatgtaaacaaa

SEQ ID NO: 285089 - DNA, 20 bp, Artificial Sequence
  chemically synthesized
catctatgtaaacaaaggga

SEQ ID NO: 285090 - DNA, 20 bp, Artificial Sequence
  chemically synthesized
ctatgtaaacaaagggaaag

SEQ ID NO: 285091 - DNA, 20 bp, Artificial Sequence
  chemically synthesized
atgtaaacaaagggaaagta

SEQ ID NO: 285092 - DNA, 20 bp, Artificial Sequence
  chemically synthesized
aaagggaaagtagagtctgt

SEQ ID NO: 285093 - DNA, 20 bp, Artificial Sequence
  chemically synthesized
ctgacctgcatataagctca

SEQ ID NO: 285094 - DNA, 20 bp, Artificial Sequence
  chemically synthesized
agagtctgtgagcttatatg

SEQ ID NO: 285095 - DNA, 20 bp, Artificial Sequence
  chemically synthesized
gagtctgtgagcttatatgc

SEQ ID NO: 285096 - DNA, 20 bp, Artificial Sequence
  chemically synthesized
actcccactgacctgcatat

SEQ ID NO: 285097 - DNA, 20 bp, Artificial Sequence
  chemically synthesized
ctgtgagcttatatgcaggt

SEQ ID NO: 285098 - DNA, 20 bp, Artificial Sequence
  chemically synthesized
tgagcttatatgcaggtcag

SEQ ID NO: 285099 - DNA, 20 bp, Artificial Sequence
  chemically synthesized
gagcttatatgcaggtcagt

SEQ ID NO: 285100 - DNA, 20 bp, Artificial Sequence
  chemically synthesized
gcttatatgcaggtcagtgg

SEQ ID NO: 285101 - DNA, 20 bp, Artificial Sequence
  chemically synthesized
agcaatcagaatagaagttg

SEQ ID NO: 285102 - DNA, 20 bp, Artificial Sequence
  chemically synthesized
aatataagcaatcagaatag

SEQ ID NO: 285103 - DNA, 20 bp, Artificial Sequence
  chemically synthesized
gaaaatataagcaatcagaa

SEQ ID NO: 285104 - DNA, 20 bp, Artificial Sequence
  chemically synthesized
accgagaaaatataagcaat

SEQ ID NO: 285105 - DNA, 20 bp, Artificial Sequence
  chemically synthesized
ttgttttaccgagaaaatat

SEQ ID NO: 285106 - DNA, 20 bp, Artificial Sequence
  chemically synthesized
tctgattgcttatattttct

SEQ ID NO: 285107 - DNA, 20 bp, Artificial Sequence
  chemically synthesized
aactagcttcttgttttacc

SEQ ID NO: 285108 - DNA, 20 bp, Artificial Sequence
  chemically synthesized
ttatattttctcggtaaaac

SEQ ID NO: 285109 - DNA, 20 bp, Artificial Sequence
  chemically synthesized
tattttctcggtaaaacaag

SEQ ID NO: 285110 - DNA, 20 bp, Artificial Sequence
  chemically synthesized
ttctcggtaaaacaagaagc

SEQ ID NO: 285111 - DNA, 20 bp, Artificial Sequence
  chemically synthesized
tccatctttctgcaaaaaac

SEQ ID NO: 285112 - DNA, 20 bp, Artificial Sequence
  chemically synthesized
aacaagaagctagttttttg

SEQ ID NO: 285113 - DNA, 20 bp, Artificial Sequence
  chemically synthesized
agaagctagttttttgcaga

SEQ ID NO: 285114 - DNA, 20 bp, Artificial Sequence
  chemically synthesized
gctagttttttgcagaaaga

SEQ ID NO: 285115 - DNA, 20 bp, Artificial Sequence
  chemically synthesized
tttgcagaaagatggaaaaa

SEQ ID NO: 285116 - DNA, 20 bp, Artificial Sequence
  chemically synthesized
aagatggaaaaacagactgt

SEQ ID NO: 285117 - DNA, 20 bp, Artificial Sequence
  chemically synthesized
gatggaaaaacagactgtta

SEQ ID NO: 285118 - DNA, 20 bp, Artificial Sequence
  chemically synthesized
ctctttcgtcagatctctaa

SEQ ID NO: 285119 - DNA, 20 bp, Artificial Sequence
  chemically synthesized
gactgttagagatctgacga

SEQ ID NO: 285120 - DNA, 20 bp, Artificial Sequence
  chemically synthesized
ctgttagagatctgacgaaa

SEQ ID NO: 285121 - DNA, 20 bp, Artificial Sequence
  chemically synthesized
gatccccagatctctttcgt

SEQ ID NO: 285122 - DNA, 20 bp, Artificial Sequence
  chemically synthesized
gagatctgacgaaagagatc

SEQ ID NO: 285123 - DNA, 20 bp, Artificial Sequence
  chemically synthesized
agatctgacgaaagagatct

SEQ ID NO: 285124 - DNA, 20 bp, Artificial Sequence
  chemically synthesized
gatctgacgaaagagatctg

SEQ ID NO: 285125 - DNA, 20 bp, Artificial Sequence
  chemically synthesized
tctttgggtgtagtgatccc

SEQ ID NO: 285126 - DNA, 20 bp, Artificial Sequence
  chemically synthesized
tctggggatcactacaccca

SEQ ID NO: 285127 - DNA, 20 bp, Artificial Sequence
  chemically synthesized
gtcagtatactctttgggtg

SEQ ID NO: 285128 - DNA, 20 bp, Artificial Sequence
  chemically synthesized
tggggatcactacacccaaa

SEQ ID NO: 285129 - DNA, 20 bp, Artificial Sequence
  chemically synthesized
tctgggtcagtatactcttt

SEQ ID NO: 285130 - DNA, 20 bp, Artificial Sequence
  chemically synthesized
ctctgggtcagtatactctt

SEQ ID NO: 285131 - DNA, 20 bp, Artificial Sequence
  chemically synthesized
acccaaagagtatactgacc

SEQ ID NO: 285132 - DNA, 20 bp, Artificial Sequence
  chemically synthesized
ccaaagagtatactgaccca

SEQ ID NO: 285133 - DNA, 20 bp, Artificial Sequence
  chemically synthesized
atcattgtctttctctgggt

SEQ ID NO: 285134 - DNA, 20 bp, Artificial Sequence
  chemically synthesized
agagtatactgacccagaga

SEQ ID NO: 285135 - DNA, 20 bp, Artificial Sequence
  chemically synthesized
gcagatcattgtctttctct

SEQ ID NO: 285136 - DNA, 20 bp, Artificial Sequence
  chemically synthesized
tgcagatcattgtctttctc

SEQ ID NO: 285137 - DNA, 20 bp, Artificial Sequence
  chemically synthesized
agagaaagacaatgatctgc

SEQ ID NO: 285138 - DNA, 20 bp, Artificial Sequence
  chemically synthesized
aaagacaatgatctgcaagc

SEQ ID NO: 285139 - DNA, 20 bp, Artificial Sequence
  chemically synthesized
gatgtctttctgccagcttg

SEQ ID NO: 285140 - DNA, 20 bp, Artificial Sequence
  chemically synthesized
gacaatgatctgcaagctgg

SEQ ID NO: 285141 - DNA, 20 bp, Artificial Sequence
  chemically synthesized
atgatctgcaagctggcaga

SEQ ID NO: 285142 - DNA, 20 bp, Artificial Sequence
  chemically synthesized
ttacgtggatgtctttctgc

SEQ ID NO: 285143 - DNA, 20 bp, Artificial Sequence
  chemically synthesized
aatgggatttagaggttacg

SEQ ID NO: 285144 - DNA, 20 bp, Artificial Sequence
  chemically synthesized
tatcaataaatgggatttag

SEQ ID NO: 285145 - DNA, 20 bp, Artificial Sequence
  chemically synthesized
ttatcaataaatgggattta

SEQ ID NO: 285146 - DNA, 20 bp, Artificial Sequence
  chemically synthesized
agttatcaataaatgggatt

SEQ ID NO: 285147 - DNA, 20 bp, Artificial Sequence
  chemically synthesized
gtaaatagttatcaataaat

SEQ ID NO: 285148 - DNA, 20 bp, Artificial Sequence
  chemically synthesized
agtaaatagttatcaataaa

SEQ ID NO: 285149 - DNA, 20 bp, Artificial Sequence
  chemically synthesized
ggctttaaatttatagtaaa

SEQ ID NO: 285150 - DNA, 20 bp, Artificial Sequence
  chemically synthesized
tattagtggctttaaattta

SEQ ID NO: 285151 - DNA, 20 bp, Artificial Sequence
  chemically synthesized
aactatttactataaattta

SEQ ID NO: 285152 - DNA, 20 bp, Artificial Sequence
  chemically synthesized
ttatatattttaattattag

SEQ ID NO: 285153 - DNA, 20 bp, Artificial Sequence
  chemically synthesized
tggttatatattttaattat

SEQ ID NO: 285154 - DNA, 20 bp, Artificial Sequence
  chemically synthesized
ctttctaagtaaataatata

SEQ ID NO: 285155 - DNA, 20 bp, Artificial Sequence
  chemically synthesized
ataaccatatattatttact

SEQ ID NO: 285156 - DNA, 20 bp, Artificial Sequence
  chemically synthesized
ccatatattatttacttaga

SEQ ID NO: 285157 - DNA, 20 bp, Artificial Sequence
  chemically synthesized
ataaaacatgtatactttct

SEQ ID NO: 285158 - DNA, 20 bp, Artificial Sequence
  chemically synthesized
gttttataattctatatatg

SEQ ID NO: 285159 - DNA, 20 bp, Artificial Sequence
  chemically synthesized
ttttataattctatatatgt

SEQ ID NO: 285160 - DNA, 20 bp, Artificial Sequence
  chemically synthesized
caaatagaaacctacatata

SEQ ID NO: 285161 - DNA, 20 bp, Artificial Sequence
  chemically synthesized
tttgttagatagaaaacaaa

SEQ ID NO: 285162 - DNA, 20 bp, Artificial Sequence
  chemically synthesized
cactgtacatgtttgttaga

SEQ ID NO: 285163 - DNA, 20 bp, Artificial Sequence
  chemically synthesized
taatcactgtacatgtttgt

SEQ ID NO: 285164 - DNA, 20 bp, Artificial Sequence
  chemically synthesized
ttctatctaacaaacatgta

SEQ ID NO: 285165 - DNA, 20 bp, Artificial Sequence
  chemically synthesized
aacatgtacagtgattaatc

SEQ ID NO: 285166 - DNA, 20 bp, Artificial Sequence
  chemically synthesized
acatgtacagtgattaatct

SEQ ID NO: 285167 - DNA, 20 bp, Artificial Sequence
  chemically synthesized
gtacagtgattaatctaggt

SEQ ID NO: 285168 - DNA, 20 bp, Artificial Sequence
  chemically synthesized
gtatagagcctcatctaacc

SEQ ID NO: 285169 - DNA, 20 bp, Artificial Sequence
  chemically synthesized
gtgattaatctaggttagat

SEQ ID NO: 285170 - DNA, 20 bp, Artificial Sequence
  chemically synthesized
tgattaatctaggttagatg

SEQ ID NO: 285171 - DNA, 20 bp, Artificial Sequence
  chemically synthesized
tcatcttttcaaggtgtata

SEQ ID NO: 285172 - DNA, 20 bp, Artificial Sequence
  chemically synthesized
attcatcttttcaaggtgta

SEQ ID NO: 285173 - DNA, 20 bp, Artificial Sequence
  chemically synthesized
gaggctctatacaccttgaa

SEQ ID NO: 285174 - DNA, 20 bp, Artificial Sequence
  chemically synthesized
taaatgaattcatcttttca

SEQ ID NO: 285175 - DNA, 20 bp, Artificial Sequence
  chemically synthesized
ttaaatgaattcatcttttc

SEQ ID NO: 285176 - DNA, 20 bp, Artificial Sequence
  chemically synthesized
gatattaatacataattcat

SEQ ID NO: 285177 - DNA, 20 bp, Artificial Sequence
  chemically synthesized
attaatatcatcacatttta

SEQ ID NO: 285178 - DNA, 20 bp, Artificial Sequence
  chemically synthesized
tatcatcacattttaaagat

SEQ ID NO: 285179 - DNA, 20 bp, Artificial Sequence
  chemically synthesized
atcatcacattttaaagatt

SEQ ID NO: 285180 - DNA, 20 bp, Artificial Sequence
  chemically synthesized
catcacattttaaagattgg

SEQ ID NO: 285181 - DNA, 20 bp, Artificial Sequence
  chemically synthesized
ttttaaagattgggagactc

SEQ ID NO: 285182 - DNA, 20 bp, Artificial Sequence
  chemically synthesized
tgtttaacctttttgtgctt

SEQ ID NO: 285183 - DNA, 20 bp, Artificial Sequence
  chemically synthesized
ttgggagactcaagcacaaa

SEQ ID NO: 285184 - DNA, 20 bp, Artificial Sequence
  chemically synthesized
tgggagactcaagcacaaaa

SEQ ID NO: 285185 - DNA, 20 bp, Artificial Sequence
  chemically synthesized
aaaaggttaaacaacttttc

SEQ ID NO: 285186 - DNA, 20 bp, Artificial Sequence
  chemically synthesized
ctgcctgtgtgattctagaa

SEQ ID NO: 285187 - DNA, 20 bp, Artificial Sequence
  chemically synthesized
ataaactgcctgtgtgattc

SEQ ID NO: 285188 - DNA, 20 bp, Artificial Sequence
  chemically synthesized
acaacttttctagaatcaca

SEQ ID NO: 285189 - DNA, 20 bp, Artificial Sequence
  chemically synthesized
caacttttctagaatcacac

SEQ ID NO: 285190 - DNA, 20 bp, Artificial Sequence
  chemically synthesized
cttttctagaatcacacagg

SEQ ID NO: 285191 - DNA, 20 bp, Artificial Sequence
  chemically synthesized
cacacaggcagtttatgatg

SEQ ID NO: 285192 - DNA, 20 bp, Artificial Sequence
  chemically synthesized
caggcagtttatgatgtgga

SEQ ID NO: 285193 - DNA, 20 bp, Artificial Sequence
  chemically synthesized
gatgtggatagacttaaacc

SEQ ID NO: 285194 - DNA, 20 bp, Artificial Sequence
  chemically synthesized
atgtggatagacttaaaccc

SEQ ID NO: 285195 - DNA, 20 bp, Artificial Sequence
  chemically synthesized
agatcagatcgcctgggttt

SEQ ID NO: 285196 - DNA, 20 bp, Artificial Sequence
  chemically synthesized
gctctgagatcagatcgcct

SEQ ID NO: 285197 - DNA, 20 bp, Artificial Sequence
  chemically synthesized
agctctgagatcagatcgcc

SEQ ID NO: 285198 - DNA, 20 bp, Artificial Sequence
  chemically synthesized
aaacccaggcgatctgatct

SEQ ID NO: 285199 - DNA, 20 bp, Artificial Sequence
  chemically synthesized
acccaggcgatctgatctca

SEQ ID NO: 285200 - DNA, 20 bp, Artificial Sequence
  chemically synthesized
aagaccagaagctctgagat

SEQ ID NO: 285201 - DNA, 20 bp, Artificial Sequence
  chemically synthesized
tgtgtaagaccagaagctct

SEQ ID NO: 285202 - DNA, 20 bp, Artificial Sequence
  chemically synthesized
cgatctgatctcagagcttc

SEQ ID NO: 285203 - DNA, 20 bp, Artificial Sequence
  chemically synthesized
ggcacagtgtgtaagaccag

SEQ ID NO: 285204 - DNA, 20 bp, Artificial Sequence
  chemically synthesized
aaaggcacagtgtgtaagac

SEQ ID NO: 285205 - DNA, 20 bp, Artificial Sequence
  chemically synthesized
gatggaaaggcacagtgtgt

SEQ ID NO: 285206 - DNA, 20 bp, Artificial Sequence
  chemically synthesized
tttttgtggatggaaaggca

SEQ ID NO: 285207 - DNA, 20 bp, Artificial Sequence
  chemically synthesized
tattttttttgtggatggaa

SEQ ID NO: 285208 - DNA, 20 bp, Artificial Sequence
  chemically synthesized
atattttttttgtggatgga

SEQ ID NO: 285209 - DNA, 20 bp, Artificial Sequence
  chemically synthesized
gagaatattttttttgtgga

SEQ ID NO: 285210 - DNA, 20 bp, Artificial Sequence
  chemically synthesized
actggagaatattttttttg

SEQ ID NO: 285211 - DNA, 20 bp, Artificial Sequence
  chemically synthesized
tccacaaaaaaaatattctc

SEQ ID NO: 285212 - DNA, 20 bp, Artificial Sequence
  chemically synthesized
acacacgcggtcaaatactg

SEQ ID NO: 285213 - DNA, 20 bp, Artificial Sequence
  chemically synthesized
agacacacgcggtcaaatac

SEQ ID NO: 285214 - DNA, 20 bp, Artificial Sequence
  chemically synthesized
tgaaataaaccagacacacg

SEQ ID NO: 285215 - DNA, 20 bp, Artificial Sequence
  chemically synthesized
agtatttgaccgcgtgtgtc

SEQ ID NO: 285216 - DNA, 20 bp, Artificial Sequence
  chemically synthesized
gtatgctaagtgaaataaac

SEQ ID NO: 285217 - DNA, 20 bp, Artificial Sequence
  chemically synthesized
tgtgtctggtttatttcact

SEQ ID NO: 285218 - DNA, 20 bp, Artificial Sequence
  chemically synthesized
aacttggaggatagtatgct

SEQ ID NO: 285219 - DNA, 20 bp, Artificial Sequence
  chemically synthesized
cacttagcatactatcctcc

SEQ ID NO: 285220 - DNA, 20 bp, Artificial Sequence
  chemically synthesized
gcatagatgaacttggagga

SEQ ID NO: 285221 - DNA, 20 bp, Artificial Sequence
  chemically synthesized
agcagcatagatgaacttgg

SEQ ID NO: 285222 - DNA, 20 bp, Artificial Sequence
  chemically synthesized
cagcagcatagatgaacttg

SEQ ID NO: 285223 - DNA, 20 bp, Artificial Sequence
  chemically synthesized
tgcagcagcatagatgaact

SEQ ID NO: 285224 - DNA, 20 bp, Artificial Sequence
  chemically synthesized
ttcttccatttgcagcagca

SEQ ID NO: 285225 - DNA, 20 bp, Artificial Sequence
  chemically synthesized
ttcatctatgctgctgcaaa

SEQ ID NO: 285226 - DNA, 20 bp, Artificial Sequence
  chemically synthesized
gaaaattcttccatttgcag

SEQ ID NO: 285227 - DNA, 20 bp, Artificial Sequence
  chemically synthesized
atctatgctgctgcaaatgg

SEQ ID NO: 285228 - DNA, 20 bp, Artificial Sequence
  chemically synthesized
aaagaaaattcttccatttg

SEQ ID NO: 285229 - DNA, 20 bp, Artificial Sequence
  chemically synthesized
tggaagaattttctttttta

SEQ ID NO: 285230 - DNA, 20 bp, Artificial Sequence
  chemically synthesized
aatattatgtagctttaaaa

SEQ ID NO: 285231 - DNA, 20 bp, Artificial Sequence
  chemically synthesized
gcatataacggaatattatg

SEQ ID NO: 285232 - DNA, 20 bp, Artificial Sequence
  chemically synthesized
aacatggtatatgcatataa

SEQ ID NO: 285233 - DNA, 20 bp, Artificial Sequence
  chemically synthesized
attgtcaaataaataaaaca

SEQ ID NO: 285234 - DNA, 20 bp, Artificial Sequence
  chemically synthesized
tttatttgacaatatacatt

SEQ ID NO: 285235 - DNA, 20 bp, Artificial Sequence
  chemically synthesized
tttagattgtttccatgtct

SEQ ID NO: 285236 - DNA, 20 bp, Artificial Sequence
  chemically synthesized
tatttacaatagccaagaca

SEQ ID NO: 285237 - DNA, 20 bp, Artificial Sequence
  chemically synthesized
cagcaatatttacaatagcc

SEQ ID NO: 285238 - DNA, 20 bp, Artificial Sequence
  chemically synthesized
tacagcagcaatatttacaa

SEQ ID NO: 285239 - DNA, 20 bp, Artificial Sequence
  chemically synthesized
ctgcacccctatgtttacag

SEQ ID NO: 285240 - DNA, 20 bp, Artificial Sequence
  chemically synthesized
aaatattgctgctgtaaaca

SEQ ID NO: 285241 - DNA, 20 bp, Artificial Sequence
  chemically synthesized
aatattgctgctgtaaacat

SEQ ID NO: 285242 - DNA, 20 bp, Artificial Sequence
  chemically synthesized
tatctgcacccctatgttta

SEQ ID NO: 285243 - DNA, 20 bp, Artificial Sequence
  chemically synthesized
atattgctgctgtaaacata

SEQ ID NO: 285244 - DNA, 20 bp, Artificial Sequence
  chemically synthesized
tattgctgctgtaaacatag

SEQ ID NO: 285245 - DNA, 20 bp, Artificial Sequence
  chemically synthesized
ctgctgtaaacataggggtg

SEQ ID NO: 285246 - DNA, 20 bp, Artificial Sequence
  chemically synthesized
aggggtgcagatacctcctt

SEQ ID NO: 285247 - DNA, 20 bp, Artificial Sequence
  chemically synthesized
ataaaatcaggatctcaagg

SEQ ID NO: 285248 - DNA, 20 bp, Artificial Sequence
  chemically synthesized
aataaaatcaggatctcaag

SEQ ID NO: 285249 - DNA, 20 bp, Artificial Sequence
  chemically synthesized
gaaataaaatcaggatctca

SEQ ID NO: 285250 - DNA, 20 bp, Artificial Sequence
  chemically synthesized
ggaaataaaatcaggatctc

SEQ ID NO: 285251 - DNA, 20 bp, Artificial Sequence
  chemically synthesized
tatccaaaggaaataaaatc

SEQ ID NO: 285252 - DNA, 20 bp, Artificial Sequence
  chemically synthesized
atatccaaaggaaataaaat

SEQ ID NO: 285253 - DNA, 20 bp, Artificial Sequence
  chemically synthesized
gatcctgattttatttcctt

SEQ ID NO: 285254 - DNA, 20 bp, Artificial Sequence
  chemically synthesized
gcttctggatatatatccaa

SEQ ID NO: 285255 - DNA, 20 bp, Artificial Sequence
  chemically synthesized
cgcttctggatatatatcca

SEQ ID NO: 285256 - DNA, 20 bp, Artificial Sequence
  chemically synthesized
atttcctttggatatatatc

SEQ ID NO: 285257 - DNA, 20 bp, Artificial Sequence
  chemically synthesized
tcctttggatatatatccag

SEQ ID NO: 285258 - DNA, 20 bp, Artificial Sequence
  chemically synthesized
tttggatatatatccagaag

SEQ ID NO: 285259 - DNA, 20 bp, Artificial Sequence
  chemically synthesized
ttggatatatatccagaagc

SEQ ID NO: 285260 - DNA, 20 bp, Artificial Sequence
  chemically synthesized
tgattcaccaatcccgcttc

SEQ ID NO: 285261 - DNA, 20 bp, Artificial Sequence
  chemically synthesized
tatatatccagaagcgggat

SEQ ID NO: 285262 - DNA, 20 bp, Artificial Sequence
  chemically synthesized
agcgggattggtgaatcaaa

SEQ ID NO: 285263 - DNA, 20 bp, Artificial Sequence
  chemically synthesized
gcgggattggtgaatcaaat

SEQ ID NO: 285264 - DNA, 20 bp, Artificial Sequence
  chemically synthesized
gttcctcaaaaaattacaaa

SEQ ID NO: 285265 - DNA, 20 bp, Artificial Sequence
  chemically synthesized
aattctatttgtaatttttt

SEQ ID NO: 285266 - DNA, 20 bp, Artificial Sequence
  chemically synthesized
attctatttgtaattttttg

SEQ ID NO: 285267 - DNA, 20 bp, Artificial Sequence
  chemically synthesized
catttgggagaacagtttgg

SEQ ID NO: 285268 - DNA, 20 bp, Artificial Sequence
  chemically synthesized
ccatttgggagaacagtttg

SEQ ID NO: 285269 - DNA, 20 bp, Artificial Sequence
  chemically synthesized
agccatttgggagaacagtt

SEQ ID NO: 285270 - DNA, 20 bp, Artificial Sequence
  chemically synthesized
ggtgcagccatttgggagaa

SEQ ID NO: 285271 - DNA, 20 bp, Artificial Sequence
  chemically synthesized
ctccaaactgttctcccaaa

SEQ ID NO: 285272 - DNA, 20 bp, Artificial Sequence
  chemically synthesized
aaattggtgcagccatttgg

SEQ ID NO: 285273 - DNA, 20 bp, Artificial Sequence
  chemically synthesized
gtaaattggtgcagccattt

SEQ ID NO: 285274 - DNA, 20 bp, Artificial Sequence
  chemically synthesized
tgtaaattggtgcagccatt

SEQ ID NO: 285275 - DNA, 20 bp, Artificial Sequence
  chemically synthesized
ggttggaatgtaaattggtg

SEQ ID NO: 285276 - DNA, 20 bp, Artificial Sequence
  chemically synthesized
gtgttggttggaatgtaaat

SEQ ID NO: 285277 - DNA, 20 bp, Artificial Sequence
  chemically synthesized
aattcttttatggtgttggt

SEQ ID NO: 285278 - DNA, 20 bp, Artificial Sequence
  chemically synthesized
agggaattcttttatggtgt

SEQ ID NO: 285279 - DNA, 20 bp, Artificial Sequence
  chemically synthesized
cattccaaccaacaccataa

SEQ ID NO: 285280 - DNA, 20 bp, Artificial Sequence
  chemically synthesized
gagaaaagggaattctttta

SEQ ID NO: 285281 - DNA, 20 bp, Artificial Sequence
  chemically synthesized
tggcaagaatgtggagaaaa

SEQ ID NO: 285282 - DNA, 20 bp, Artificial Sequence
  chemically synthesized
ttggcaagaatgtggagaaa

SEQ ID NO: 285283 - DNA, 20 bp, Artificial Sequence
  chemically synthesized
gttggcaagaatgtggagaa

SEQ ID NO: 285284 - DNA, 20 bp, Artificial Sequence
  chemically synthesized
taagtgttggcaagaatgtg

SEQ ID NO: 285285 - DNA, 20 bp, Artificial Sequence
  chemically synthesized
actaagtgttggcaagaatg

SEQ ID NO: 285286 - DNA, 20 bp, Artificial Sequence
  chemically synthesized
aaaagatactaagtgttggc

SEQ ID NO: 285287 - DNA, 20 bp, Artificial Sequence
  chemically synthesized
tccacattcttgccaacact

SEQ ID NO: 285288 - DNA, 20 bp, Artificial Sequence
  chemically synthesized
aagcaaaagatactaagtgt

SEQ ID NO: 285289 - DNA, 20 bp, Artificial Sequence
  chemically synthesized
aaaacaaagcaaaagatact

SEQ ID NO: 285290 - DNA, 20 bp, Artificial Sequence
  chemically synthesized
atcagaacaaaacaaagcaa

SEQ ID NO: 285291 - DNA, 20 bp, Artificial Sequence
  chemically synthesized
gctattatcagaacaaaaca

SEQ ID NO: 285292 - DNA, 20 bp, Artificial Sequence
  chemically synthesized
gctttgttttgttctgataa

SEQ ID NO: 285293 - DNA, 20 bp, Artificial Sequence
  chemically synthesized
cctgttagggtggctattat

SEQ ID NO: 285294 - DNA, 20 bp, Artificial Sequence
  chemically synthesized
tctgataatagccaccctaa

SEQ ID NO: 285295 - DNA, 20 bp, Artificial Sequence
  chemically synthesized
ctgataatagccaccctaac

SEQ ID NO: 285296 - DNA, 20 bp, Artificial Sequence
  chemically synthesized
cctcttcatacctgttaggg

SEQ ID NO: 285297 - DNA, 20 bp, Artificial Sequence
  chemically synthesized
gaacctcttcatacctgtta

SEQ ID NO: 285298 - DNA, 20 bp, Artificial Sequence
  chemically synthesized
agaacctcttcatacctgtt

SEQ ID NO: 285299 - DNA, 20 bp, Artificial Sequence
  chemically synthesized
aagaacctcttcatacctgt

SEQ ID NO: 285300 - DNA, 20 bp, Artificial Sequence
  chemically synthesized
tagccaccctaacaggtatg

SEQ ID NO: 285301 - DNA, 20 bp, Artificial Sequence
  chemically synthesized
gccaccctaacaggtatgaa

SEQ ID NO: 285302 - DNA, 20 bp, Artificial Sequence
  chemically synthesized
ccaccctaacaggtatgaag

SEQ ID NO: 285303 - DNA, 20 bp, Artificial Sequence
  chemically synthesized
caggtatgaagaggttcttg

SEQ ID NO: 285304 - DNA, 20 bp, Artificial Sequence
  chemically synthesized
aaaatgcagttaaaagccac

SEQ ID NO: 285305 - DNA, 20 bp, Artificial Sequence
  chemically synthesized
catctgaaaaatgcagttaa

SEQ ID NO: 285306 - DNA, 20 bp, Artificial Sequence
  chemically synthesized
tggcttttaactgcattttt

SEQ ID NO: 285307 - DNA, 20 bp, Artificial Sequence
  chemically synthesized
cactaatcatctgaaaaatg

SEQ ID NO: 285308 - DNA, 20 bp, Artificial Sequence
  chemically synthesized
aactgcatttttcagatgat

SEQ ID NO: 285309 - DNA, 20 bp, Artificial Sequence
  chemically synthesized
tgaccaacaggtatatgaaa

SEQ ID NO: 285310 - DNA, 20 bp, Artificial Sequence
  chemically synthesized
atgaccaacaggtatatgaa

SEQ ID NO: 285311 - DNA, 20 bp, Artificial Sequence
  chemically synthesized
gcaccttttcatatacctgt

SEQ ID NO: 285312 - DNA, 20 bp, Artificial Sequence
  chemically synthesized
aatacgtagaaatgaccaac

SEQ ID NO: 285313 - DNA, 20 bp, Artificial Sequence
  chemically synthesized
gaatacgtagaaatgaccaa

SEQ ID NO: 285314 - DNA, 20 bp, Artificial Sequence
  chemically synthesized
tcatttctctaaagaatacg

SEQ ID NO: 285315 - DNA, 20 bp, Artificial Sequence
  chemically synthesized
ggtcatttctacgtattctt

SEQ ID NO: 285316 - DNA, 20 bp, Artificial Sequence
  chemically synthesized
tcatttctacgtattcttta

SEQ ID NO: 285317 - DNA, 20 bp, Artificial Sequence
  chemically synthesized
cttgaatagtcatttctcta

SEQ ID NO: 285318 - DNA, 20 bp, Artificial Sequence
  chemically synthesized
ctttagagaaatgactattc

SEQ ID NO: 285319 - DNA, 20 bp, Artificial Sequence
  chemically synthesized
aaatgagcacaggacttgaa

SEQ ID NO: 285320 - DNA, 20 bp, Artificial Sequence
  chemically synthesized
acctgattaaaaatgagcac

SEQ ID NO: 285321 - DNA, 20 bp, Artificial Sequence
  chemically synthesized
aacctgattaaaaatgagca

SEQ ID NO: 285322 - DNA, 20 bp, Artificial Sequence
  chemically synthesized
aaaataacctgattaaaaat

SEQ ID NO: 285323 - DNA, 20 bp, Artificial Sequence
  chemically synthesized
gtcctgtgctcatttttaat

SEQ ID NO: 285324 - DNA, 20 bp, Artificial Sequence
  chemically synthesized
tcctgtgctcatttttaatc

SEQ ID NO: 285325 - DNA, 20 bp, Artificial Sequence
  chemically synthesized
tttttaatcaggttattttt

SEQ ID NO: 285326 - DNA, 20 bp, Artificial Sequence
  chemically synthesized
aaggaacttctaaaattcaa

SEQ ID NO: 285327 - DNA, 20 bp, Artificial Sequence
  chemically synthesized
ttatttttgctattgaattt

SEQ ID NO: 285328 - DNA, 20 bp, Artificial Sequence
  chemically synthesized
tttttgctattgaattttag

SEQ ID NO: 285329 - DNA, 20 bp, Artificial Sequence
  chemically synthesized
attaatatccaaaatatata

SEQ ID NO: 285330 - DNA, 20 bp, Artificial Sequence
  chemically synthesized
gattaatatccaaaatatat

SEQ ID NO: 285331 - DNA, 20 bp, Artificial Sequence
  chemically synthesized
tagaagttccttatatattt

SEQ ID NO: 285332 - DNA, 20 bp, Artificial Sequence
  chemically synthesized
tttggatattaatcatttgc

SEQ ID NO: 285333 - DNA, 20 bp, Artificial Sequence
  chemically synthesized
atattcacaaatcatatgtc

SEQ ID NO: 285334 - DNA, 20 bp, Artificial Sequence
  chemically synthesized
tttagattctagggaatgga

SEQ ID NO: 285335 - DNA, 20 bp, Artificial Sequence
  chemically synthesized
ttttagattctagggaatgg

SEQ ID NO: 285336 - DNA, 20 bp, Artificial Sequence
  chemically synthesized
gaatatttccttccattccc

SEQ ID NO: 285337 - DNA, 20 bp, Artificial Sequence
  chemically synthesized
ctattttagattctagggaa

SEQ ID NO: 285338 - DNA, 20 bp, Artificial Sequence
  chemically synthesized
tttgactattttagattcta

SEQ ID NO: 285339 - DNA, 20 bp, Artificial Sequence
  chemically synthesized
gtttgactattttagattct

SEQ ID NO: 285340 - DNA, 20 bp, Artificial Sequence
  chemically synthesized
agtttgactattttagattc

SEQ ID NO: 285341 - DNA, 20 bp, Artificial Sequence
  chemically synthesized
ccattccctagaatctaaaa

SEQ ID NO: 285342 - DNA, 20 bp, Artificial Sequence
  chemically synthesized
ttctgtgagtttgactattt

SEQ ID NO: 285343 - DNA, 20 bp, Artificial Sequence
  chemically synthesized
atctaaaatagtcaaactca

SEQ ID NO: 285344 - DNA, 20 bp, Artificial Sequence
  chemically synthesized
aatagtcaaactcacagaac

SEQ ID NO: 285345 - DNA, 20 bp, Artificial Sequence
  chemically synthesized
attctactctctagttctgt

SEQ ID NO: 285346 - DNA, 20 bp, Artificial Sequence
  chemically synthesized
tagtcaaactcacagaacta

SEQ ID NO: 285347 - DNA, 20 bp, Artificial Sequence
  chemically synthesized
gtcaaactcacagaactaga

SEQ ID NO: 285348 - DNA, 20 bp, Artificial Sequence
  chemically synthesized
aaactcacagaactagagag

SEQ ID NO: 285349 - DNA, 20 bp, Artificial Sequence
  chemically synthesized
gaaaccactattctactctc

SEQ ID NO: 285350 - DNA, 20 bp, Artificial Sequence
  chemically synthesized
cacagaactagagagtagaa

SEQ ID NO: 285351 - DNA, 20 bp, Artificial Sequence
  chemically synthesized
agaactagagagtagaatag

SEQ ID NO: 285352 - DNA, 20 bp, Artificial Sequence
  chemically synthesized
gagtagaatagtggtttcca

SEQ ID NO: 285353 - DNA, 20 bp, Artificial Sequence
  chemically synthesized
agtagaatagtggtttccaa

SEQ ID NO: 285354 - DNA, 20 bp, Artificial Sequence
  chemically synthesized
aatagtggtttccaaaggct

SEQ ID NO: 285355 - DNA, 20 bp, Artificial Sequence
  chemically synthesized
ttttcccctctctcagcctt

SEQ ID NO: 285356 - DNA, 20 bp, Artificial Sequence
  chemically synthesized
tagtggtttccaaaggctga

SEQ ID NO: 285357 - DNA, 20 bp, Artificial Sequence
  chemically synthesized
gtggtttccaaaggctgaga

SEQ ID NO: 285358 - DNA, 20 bp, Artificial Sequence
  chemically synthesized
tggtttccaaaggctgagag

SEQ ID NO: 285359 - DNA, 20 bp, Artificial Sequence
  chemically synthesized
ggtttccaaaggctgagaga

SEQ ID NO: 285360 - DNA, 20 bp, Artificial Sequence
  chemically synthesized
gtttccaaaggctgagagag

SEQ ID NO: 285361 - DNA, 20 bp, Artificial Sequence
  chemically synthesized
tttgccattttcccctctct

SEQ ID NO: 285362 - DNA, 20 bp, Artificial Sequence
  chemically synthesized
aaggctgagagaggggaaaa

SEQ ID NO: 285363 - DNA, 20 bp, Artificial Sequence
  chemically synthesized
aaatggcaaaatgatgccca

SEQ ID NO: 285364 - DNA, 20 bp, Artificial Sequence
  chemically synthesized
aatggcaaaatgatgcccaa

SEQ ID NO: 285365 - DNA, 20 bp, Artificial Sequence
  chemically synthesized
actgaagctttgtatccttt

SEQ ID NO: 285366 - DNA, 20 bp, Artificial Sequence
  chemically synthesized
aactgaagctttgtatcctt

SEQ ID NO: 285367 - DNA, 20 bp, Artificial Sequence
  chemically synthesized
aatgatgcccaaaggataca

SEQ ID NO: 285368 - DNA, 20 bp, Artificial Sequence
  chemically synthesized
gcccaaaggatacaaagctt

SEQ ID NO: 285369 - DNA, 20 bp, Artificial Sequence
  chemically synthesized
taattcatcttgcataactg

SEQ ID NO: 285370 - DNA, 20 bp, Artificial Sequence
  chemically synthesized
atacaaagcttcagttatgc

SEQ ID NO: 285371 - DNA, 20 bp, Artificial Sequence
  chemically synthesized
ttcagttatgcaagatgaat

SEQ ID NO: 285372 - DNA, 20 bp, Artificial Sequence
  chemically synthesized
tgcaagatgaattagctctg

SEQ ID NO: 285373 - DNA, 20 bp, Artificial Sequence
  chemically synthesized
tgttgtacagtagatctgca

SEQ ID NO: 285374 - DNA, 20 bp, Artificial Sequence
  chemically synthesized
aatgttgtacagtagatctg

SEQ ID NO: 285375 - DNA, 20 bp, Artificial Sequence
  chemically synthesized
ataggcccaatgttgtacag

SEQ ID NO: 285376 - DNA, 20 bp, Artificial Sequence
  chemically synthesized
actataggcccaatgttgta

SEQ ID NO: 285377 - DNA, 20 bp, Artificial Sequence
  chemically synthesized
gcagatctactgtacaacat

SEQ ID NO: 285378 - DNA, 20 bp, Artificial Sequence
  chemically synthesized
cagatctactgtacaacatt

SEQ ID NO: 285379 - DNA, 20 bp, Artificial Sequence
  chemically synthesized
actgtacaacattgggccta

SEQ ID NO: 285380 - DNA, 20 bp, Artificial Sequence
  chemically synthesized
aatacagtatttttaactat

SEQ ID NO: 285381 - DNA, 20 bp, Artificial Sequence
  chemically synthesized
caatacagtatttttaacta

SEQ ID NO: 285382 - DNA, 20 bp, Artificial Sequence
  chemically synthesized
ttggaatatttttaacaata

SEQ ID NO: 285383 - DNA, 20 bp, Artificial Sequence
  chemically synthesized
tgtattgttaaaaatattcc

SEQ ID NO: 285384 - DNA, 20 bp, Artificial Sequence
  chemically synthesized
tattgttaaaaatattccaa

SEQ ID NO: 285385 - DNA, 20 bp, Artificial Sequence
  chemically synthesized
attgttaaaaatattccaag

SEQ ID NO: 285386 - DNA, 20 bp, Artificial Sequence
  chemically synthesized
ttaaaaatattccaagagga

SEQ ID NO: 285387 - DNA, 20 bp, Artificial Sequence
  chemically synthesized
gctcctaagatctatcctct

SEQ ID NO: 285388 - DNA, 20 bp, Artificial Sequence
  chemically synthesized
tattccaagaggatagatct

SEQ ID NO: 285389 - DNA, 20 bp, Artificial Sequence
  chemically synthesized
attccaagaggatagatctt

SEQ ID NO: 285390 - DNA, 20 bp, Artificial Sequence
  chemically synthesized
tccaagaggatagatcttag

SEQ ID NO: 285391 - DNA, 20 bp, Artificial Sequence
  chemically synthesized
gttttgtgataagagctcct

SEQ ID NO: 285392 - DNA, 20 bp, Artificial Sequence
  chemically synthesized
ttttttttgttttgtgataa

SEQ ID NO: 285393 - DNA, 20 bp, Artificial Sequence
  chemically synthesized
tattttttttgttttgtgat

SEQ ID NO: 285394 - DNA, 20 bp, Artificial Sequence
  chemically synthesized
acaaaaaaaataaataaatt

SEQ ID NO: 285395 - DNA, 20 bp, Artificial Sequence
  chemically synthesized
caaaaaaaataaataaatta

SEQ ID NO: 285396 - DNA, 20 bp, Artificial Sequence
  chemically synthesized
aaaaaaaataaataaattaa

SEQ ID NO: 285397 - DNA, 20 bp, Artificial Sequence
  chemically synthesized
aaaaaaataaataaattaag

SEQ ID NO: 285398 - DNA, 20 bp, Artificial Sequence
  chemically synthesized
aaaataaataaattaagggg

SEQ ID NO: 285399 - DNA, 20 bp, Artificial Sequence
  chemically synthesized
ataaataaattaaggggcag

SEQ ID NO: 285400 - DNA, 20 bp, Artificial Sequence
  chemically synthesized
taaataaattaaggggcaga

SEQ ID NO: 285401 - DNA, 20 bp, Artificial Sequence
  chemically synthesized
aaggggcagaaggaaacttt

SEQ ID NO: 285402 - DNA, 20 bp, Artificial Sequence
  chemically synthesized
ggggcagaaggaaacttttg

SEQ ID NO: 285403 - DNA, 20 bp, Artificial Sequence
  chemically synthesized
gggcagaaggaaacttttgg

SEQ ID NO: 285404 - DNA, 20 bp, Artificial Sequence
  chemically synthesized
aacttacctatcacctccaa

SEQ ID NO: 285405 - DNA, 20 bp, Artificial Sequence
  chemically synthesized
aaggaaacttttggaggtga

SEQ ID NO: 285406 - DNA, 20 bp, Artificial Sequence
  chemically synthesized
aggaaacttttggaggtgat

SEQ ID NO: 285407 - DNA, 20 bp, Artificial Sequence
  chemically synthesized
aacttttggaggtgataggt

SEQ ID NO: 285408 - DNA, 20 bp, Artificial Sequence
  chemically synthesized
taagtttatcatcttgaatg

SEQ ID NO: 285409 - DNA, 20 bp, Artificial Sequence
  chemically synthesized
tgagacttattaccacattc

SEQ ID NO: 285410 - DNA, 20 bp, Artificial Sequence
  chemically synthesized
atcatcttgaatgtggtaat

SEQ ID NO: 285411 - DNA, 20 bp, Artificial Sequence
  chemically synthesized
gaatgtggtaataagtctca

SEQ ID NO: 285412 - DNA, 20 bp, Artificial Sequence
  chemically synthesized
aatgtggtaataagtctcat

SEQ ID NO: 285413 - DNA, 20 bp, Artificial Sequence
  chemically synthesized
ggggataagcgtatacccat

SEQ ID NO: 285414 - DNA, 20 bp, Artificial Sequence
  chemically synthesized
aacttgattagtttggggat

SEQ ID NO: 285415 - DNA, 20 bp, Artificial Sequence
  chemically synthesized
tatacaacttgattagtttg

SEQ ID NO: 285416 - DNA, 20 bp, Artificial Sequence
  chemically synthesized
ttatacaacttgattagttt

SEQ ID NO: 285417 - DNA, 20 bp, Artificial Sequence
  chemically synthesized
tttatacaacttgattagtt

SEQ ID NO: 285418 - DNA, 20 bp, Artificial Sequence
  chemically synthesized
cgcttatccccaaactaatc

SEQ ID NO: 285419 - DNA, 20 bp, Artificial Sequence
  chemically synthesized
tttaatttatacaacttgat

SEQ ID NO: 285420 - DNA, 20 bp, Artificial Sequence
  chemically synthesized
ttgtataaattaaatatgta

SEQ ID NO: 285421 - DNA, 20 bp, Artificial Sequence
  chemically synthesized
aattaaatatgtacagcttt

SEQ ID NO: 285422 - DNA, 20 bp, Artificial Sequence
  chemically synthesized
aggtatgactgacataccaa

SEQ ID NO: 285423 - DNA, 20 bp, Artificial Sequence
  chemically synthesized
atgtacagcttttggtatgt

SEQ ID NO: 285424 - DNA, 20 bp, Artificial Sequence
  chemically synthesized
atgtcagtcatacctcaaca

SEQ ID NO: 285425 - DNA, 20 bp, Artificial Sequence
  chemically synthesized
ttgtttaaaccactttgttg

SEQ ID NO: 285426 - DNA, 20 bp, Artificial Sequence
  chemically synthesized
tcagtcatacctcaacaaag

SEQ ID NO: 285427 - DNA, 20 bp, Artificial Sequence
  chemically synthesized
tttgtttaaaccactttgtt

SEQ ID NO: 285428 - DNA, 20 bp, Artificial Sequence
  chemically synthesized
caaagtggtttaaacaaaaa

SEQ ID NO: 285429 - DNA, 20 bp, Artificial Sequence
  chemically synthesized
gtaaactcttagagatggaa

SEQ ID NO: 285430 - DNA, 20 bp, Artificial Sequence
  chemically synthesized
tcgtaaactcttagagatgg

SEQ ID NO: 285431 - DNA, 20 bp, Artificial Sequence
  chemically synthesized
atagattctcttccatctct

SEQ ID NO: 285432 - DNA, 20 bp, Artificial Sequence
  chemically synthesized
agattctcttccatctctaa

SEQ ID NO: 285433 - DNA, 20 bp, Artificial Sequence
  chemically synthesized
aattcgtaaactcttagaga

SEQ ID NO: 285434 - DNA, 20 bp, Artificial Sequence
  chemically synthesized
ggataattcgtaaactctta

SEQ ID NO: 285435 - DNA, 20 bp, Artificial Sequence
  chemically synthesized
ttggataattcgtaaactct

SEQ ID NO: 285436 - DNA, 20 bp, Artificial Sequence
  chemically synthesized
cctaaaatgcttggtcaaat

SEQ ID NO: 285437 - DNA, 20 bp, Artificial Sequence
  chemically synthesized
acgaattatccaatttgacc

SEQ ID NO: 285438 - DNA, 20 bp, Artificial Sequence
  chemically synthesized
tccaatttgaccaagcattt

SEQ ID NO: 285439 - DNA, 20 bp, Artificial Sequence
  chemically synthesized
gctcccatccctaaaatgct

SEQ ID NO: 285440 - DNA, 20 bp, Artificial Sequence
  chemically synthesized
ccaatttgaccaagcatttt

SEQ ID NO: 285441 - DNA, 20 bp, Artificial Sequence
  chemically synthesized
caatttgaccaagcatttta

SEQ ID NO: 285442 - DNA, 20 bp, Artificial Sequence
  chemically synthesized
ttgaccaagcattttaggga

SEQ ID NO: 285443 - DNA, 20 bp, Artificial Sequence
  chemically synthesized
tgaccaagcattttagggat

SEQ ID NO: 285444 - DNA, 20 bp, Artificial Sequence
  chemically synthesized
accaagcattttagggatgg

SEQ ID NO: 285445 - DNA, 20 bp, Artificial Sequence
  chemically synthesized
gcattttagggatgggagca

SEQ ID NO: 285446 - DNA, 20 bp, Artificial Sequence
  chemically synthesized
cattttagggatgggagcat

SEQ ID NO: 285447 - DNA, 20 bp, Artificial Sequence
  chemically synthesized
attttagggatgggagcatg

SEQ ID NO: 285448 - DNA, 20 bp, Artificial Sequence
  chemically synthesized
gcatggggaaatcttctcaa

SEQ ID NO: 285449 - DNA, 20 bp, Artificial Sequence
  chemically synthesized
catggggaaatcttctcaat

SEQ ID NO: 285450 - DNA, 20 bp, Artificial Sequence
  chemically synthesized
actgtttcttgcctattgag

SEQ ID NO: 285451 - DNA, 20 bp, Artificial Sequence
  chemically synthesized
gggaaatcttctcaataggc

SEQ ID NO: 285452 - DNA, 20 bp, Artificial Sequence
  chemically synthesized
gatactgtttcttgcctatt

SEQ ID NO: 285453 - DNA, 20 bp, Artificial Sequence
  chemically synthesized
tcttctcaataggcaagaaa

SEQ ID NO: 285454 - DNA, 20 bp, Artificial Sequence
  chemically synthesized
aataaagataacatgtatat

SEQ ID NO: 285455 - DNA, 20 bp, Artificial Sequence
  chemically synthesized
aaacgaggtacataaaaata

SEQ ID NO: 285456 - DNA, 20 bp, Artificial Sequence
  chemically synthesized
tcaaactgggcatataaacg

SEQ ID NO: 285457 - DNA, 20 bp, Artificial Sequence
  chemically synthesized
ttcaaactgggcatataaac

SEQ ID NO: 285458 - DNA, 20 bp, Artificial Sequence
  chemically synthesized
atgtacctcgtttatatgcc

SEQ ID NO: 285459 - DNA, 20 bp, Artificial Sequence
  chemically synthesized
tcaagtacacttttcaaact

SEQ ID NO: 285460 - DNA, 20 bp, Artificial Sequence
  chemically synthesized
gtttatatgcccagtttgaa

SEQ ID NO: 285461 - DNA, 20 bp, Artificial Sequence
  chemically synthesized
gtcaagtacacttttcaaac

SEQ ID NO: 285462 - DNA, 20 bp, Artificial Sequence
  chemically synthesized
tgaaaagtgtacttgacttc

SEQ ID NO: 285463 - DNA, 20 bp, Artificial Sequence
  chemically synthesized
cagacatgtatctggaagtc

SEQ ID NO: 285464 - DNA, 20 bp, Artificial Sequence
  chemically synthesized
acaatcagacatgtatctgg

SEQ ID NO: 285465 - DNA, 20 bp, Artificial Sequence
  chemically synthesized
aagacaatcagacatgtatc

SEQ ID NO: 285466 - DNA, 20 bp, Artificial Sequence
  chemically synthesized
atttcggagaaaaagacaat

SEQ ID NO: 285467 - DNA, 20 bp, Artificial Sequence
  chemically synthesized
ccatatttatttcggagaaa

SEQ ID NO: 285468 - DNA, 20 bp, Artificial Sequence
  chemically synthesized
tcttagccatatttatttcg

SEQ ID NO: 285469 - DNA, 20 bp, Artificial Sequence
  chemically synthesized
catcttagccatatttattt

SEQ ID NO: 285470 - DNA, 20 bp, Artificial Sequence
  chemically synthesized
ctttttctccgaaataaata

SEQ ID NO: 285471 - DNA, 20 bp, Artificial Sequence
  chemically synthesized
tctccgaaataaatatggct

SEQ ID NO: 285472 - DNA, 20 bp, Artificial Sequence
  chemically synthesized
cgaaataaatatggctaaga

SEQ ID NO: 285473 - DNA, 20 bp, Artificial Sequence
  chemically synthesized
agtgactagcggttccatct

SEQ ID NO: 285474 - DNA, 20 bp, Artificial Sequence
  chemically synthesized
tatggctaagatggaaccgc

SEQ ID NO: 285475 - DNA, 20 bp, Artificial Sequence
  chemically synthesized
tagcttactagagtgactag

SEQ ID NO: 285476 - DNA, 20 bp, Artificial Sequence
  chemically synthesized
gatggaaccgctagtcactc

SEQ ID NO: 285477 - DNA, 20 bp, Artificial Sequence
  chemically synthesized
gaatagcttactagagtgac

SEQ ID NO: 285478 - DNA, 20 bp, Artificial Sequence
  chemically synthesized
gaaccgctagtcactctagt

SEQ ID NO: 285479 - DNA, 20 bp, Artificial Sequence
  chemically synthesized
caaaatggaatagcttacta

SEQ ID NO: 285480 - DNA, 20 bp, Artificial Sequence
  chemically synthesized
aacaaaatggaatagcttac

SEQ ID NO: 285481 - DNA, 20 bp, Artificial Sequence
  chemically synthesized
aagagaagaacaaaatggaa

SEQ ID NO: 285482 - DNA, 20 bp, Artificial Sequence
  chemically synthesized
gtactaagagaagaacaaaa

SEQ ID NO: 285483 - DNA, 20 bp, Artificial Sequence
  chemically synthesized
attccattttgttcttctct

SEQ ID NO: 285484 - DNA, 20 bp, Artificial Sequence
  chemically synthesized
gaaagagtgggtactaagag

SEQ ID NO: 285485 - DNA, 20 bp, Artificial Sequence
  chemically synthesized
aaagaaagagtgggtactaa

SEQ ID NO: 285486 - DNA, 20 bp, Artificial Sequence
  chemically synthesized
ttaaagaaagagtgggtact

SEQ ID NO: 285487 - DNA, 20 bp, Artificial Sequence
  chemically synthesized
tgtgattttaaagaaagagt

SEQ ID NO: 285488 - DNA, 20 bp, Artificial Sequence
  chemically synthesized
ttgtgattttaaagaaagag

SEQ ID NO: 285489 - DNA, 20 bp, Artificial Sequence
  chemically synthesized
tcattgtgattttaaagaaa

SEQ ID NO: 285490 - DNA, 20 bp, Artificial Sequence
  chemically synthesized
ggtcattgtgattttaaaga

SEQ ID NO: 285491 - DNA, 20 bp, Artificial Sequence
  chemically synthesized
tgtaggtcattgtgatttta

SEQ ID NO: 285492 - DNA, 20 bp, Artificial Sequence
  chemically synthesized
aatcacaatgacctacaatg

SEQ ID NO: 285493 - DNA, 20 bp, Artificial Sequence
  chemically synthesized
tctgttatgagctacattgt

SEQ ID NO: 285494 - DNA, 20 bp, Artificial Sequence
  chemically synthesized
ttctgttatgagctacattg

SEQ ID NO: 285495 - DNA, 20 bp, Artificial Sequence
  chemically synthesized
acctacaatgtagctcataa

SEQ ID NO: 285496 - DNA, 20 bp, Artificial Sequence
  chemically synthesized
ttcagatatatttctgttat

SEQ ID NO: 285497 - DNA, 20 bp, Artificial Sequence
  chemically synthesized
gggaagaatcaaagtgtttt

SEQ ID NO: 285498 - DNA, 20 bp, Artificial Sequence
  chemically synthesized
gaagaatgagggaagaatca

SEQ ID NO: 285499 - DNA, 20 bp, Artificial Sequence
  chemically synthesized
gtctagaggaagaatgaggg

SEQ ID NO: 285500 - DNA, 20 bp, Artificial Sequence
  chemically synthesized
atagtctagaggaagaatga

SEQ ID NO: 285501 - DNA, 20 bp, Artificial Sequence
  chemically synthesized
gatagtctagaggaagaatg

SEQ ID NO: 285502 - DNA, 20 bp, Artificial Sequence
  chemically synthesized
tgatagtctagaggaagaat

SEQ ID NO: 285503 - DNA, 20 bp, Artificial Sequence
  chemically synthesized
ttcttccctcattcttcctc

SEQ ID NO: 285504 - DNA, 20 bp, Artificial Sequence
  chemically synthesized
gtttgttgatagtctagagg

SEQ ID NO: 285505 - DNA, 20 bp, Artificial Sequence
  chemically synthesized
agtgtttgttgatagtctag

SEQ ID NO: 285506 - DNA, 20 bp, Artificial Sequence
  chemically synthesized
gagtgtttgttgatagtcta

SEQ ID NO: 285507 - DNA, 20 bp, Artificial Sequence
  chemically synthesized
gagagtgtttgttgatagtc

SEQ ID NO: 285508 - DNA, 20 bp, Artificial Sequence
  chemically synthesized
tgaaggagagtgtttgttga

SEQ ID NO: 285509 - DNA, 20 bp, Artificial Sequence
  chemically synthesized
tatcaacaaacactctcctt

SEQ ID NO: 285510 - DNA, 20 bp, Artificial Sequence
  chemically synthesized
tggcagtacttgctgaagga

SEQ ID NO: 285511 - DNA, 20 bp, Artificial Sequence
  chemically synthesized
aacaaacactctccttcagc

SEQ ID NO: 285512 - DNA, 20 bp, Artificial Sequence
  chemically synthesized
tctggcagtacttgctgaag

SEQ ID NO: 285513 - DNA, 20 bp, Artificial Sequence
  chemically synthesized
gatctggcagtacttgctga

SEQ ID NO: 285514 - DNA, 20 bp, Artificial Sequence
  chemically synthesized
agatctggcagtacttgctg

SEQ ID NO: 285515 - DNA, 20 bp, Artificial Sequence
  chemically synthesized
tctccttcagcaagtactgc

SEQ ID NO: 285516 - DNA, 20 bp, Artificial Sequence
  chemically synthesized
acagatcccattagatctgg

SEQ ID NO: 285517 - DNA, 20 bp, Artificial Sequence
  chemically synthesized
gcaagtactgccagatctaa

SEQ ID NO: 285518 - DNA, 20 bp, Artificial Sequence
  chemically synthesized
ttaacagatcccattagatc

SEQ ID NO: 285519 - DNA, 20 bp, Artificial Sequence
  chemically synthesized
caagtactgccagatctaat

SEQ ID NO: 285520 - DNA, 20 bp, Artificial Sequence
  chemically synthesized
ttctttttaacagatcccat

SEQ ID NO: 285521 - DNA, 20 bp, Artificial Sequence
  chemically synthesized
atctaatgggatctgttaaa

SEQ ID NO: 285522 - DNA, 20 bp, Artificial Sequence
  chemically synthesized
cattcctttattctttttaa

SEQ ID NO: 285523 - DNA, 20 bp, Artificial Sequence
  chemically synthesized
gggatctgttaaaaagaata

SEQ ID NO: 285524 - DNA, 20 bp, Artificial Sequence
  chemically synthesized
ggatctgttaaaaagaataa

SEQ ID NO: 285525 - DNA, 20 bp, Artificial Sequence
  chemically synthesized
aataaaggaatgtgtcatgt

SEQ ID NO: 285526 - DNA, 20 bp, Artificial Sequence
  chemically synthesized
ataaaggaatgtgtcatgtt

SEQ ID NO: 285527 - DNA, 20 bp, Artificial Sequence
  chemically synthesized
aggaatgtgtcatgttagga

SEQ ID NO: 285528 - DNA, 20 bp, Artificial Sequence
  chemically synthesized
ggaatgtgtcatgttaggat

SEQ ID NO: 285529 - DNA, 20 bp, Artificial Sequence
  chemically synthesized
taggataggaataatacttc

SEQ ID NO: 285530 - DNA, 20 bp, Artificial Sequence
  chemically synthesized
aggataggaataatacttct

SEQ ID NO: 285531 - DNA, 20 bp, Artificial Sequence
  chemically synthesized
ataggaataatacttctggg

SEQ ID NO: 285532 - DNA, 20 bp, Artificial Sequence
  chemically synthesized
tcacacttacatctacccag

SEQ ID NO: 285533 - DNA, 20 bp, Artificial Sequence
  chemically synthesized
ctttcacacttacatctacc

SEQ ID NO: 285534 - DNA, 20 bp, Artificial Sequence
  chemically synthesized
taatacttctgggtagatgt

SEQ ID NO: 285535 - DNA, 20 bp, Artificial Sequence
  chemically synthesized
ctgggtagatgtaagtgtga

SEQ ID NO: 285536 - DNA, 20 bp, Artificial Sequence
  chemically synthesized
tcctcattacatttttgatg

SEQ ID NO: 285537 - DNA, 20 bp, Artificial Sequence
  chemically synthesized
atcctcattacatttttgat

SEQ ID NO: 285538 - DNA, 20 bp, Artificial Sequence
  chemically synthesized
gtcctcatcaaaaatgtaat

SEQ ID NO: 285539 - DNA, 20 bp, Artificial Sequence
  chemically synthesized
tcctcatcaaaaatgtaatg

SEQ ID NO: 285540 - DNA, 20 bp, Artificial Sequence
  chemically synthesized
ctactcatccaacagaggat

SEQ ID NO: 285541 - DNA, 20 bp, Artificial Sequence
  chemically synthesized
tgaggatactaatcctctgt

SEQ ID NO: 285542 - DNA, 20 bp, Artificial Sequence
  chemically synthesized
gcaaactactcatccaacag

SEQ ID NO: 285543 - DNA, 20 bp, Artificial Sequence
  chemically synthesized
tgcaaactactcatccaaca

SEQ ID NO: 285544 - DNA, 20 bp, Artificial Sequence
  chemically synthesized
atactaatcctctgttggat

SEQ ID NO: 285545 - DNA, 20 bp, Artificial Sequence
  chemically synthesized
tttgcaaactactcatccaa

SEQ ID NO: 285546 - DNA, 20 bp, Artificial Sequence
  chemically synthesized
ctaatcctctgttggatgag

SEQ ID NO: 285547 - DNA, 20 bp, Artificial Sequence
  chemically synthesized
aaatattttttcccattctg

SEQ ID NO: 285548 - DNA, 20 bp, Artificial Sequence
  chemically synthesized
gaaaagacaatccacagaat

SEQ ID NO: 285549 - DNA, 20 bp, Artificial Sequence
  chemically synthesized
tgaaaagacaatccacagaa

SEQ ID NO: 285550 - DNA, 20 bp, Artificial Sequence
  chemically synthesized
cagaatgaaaagacaatcca

SEQ ID NO: 285551 - DNA, 20 bp, Artificial Sequence
  chemically synthesized
gaaacagtaaacagaatgaa

SEQ ID NO: 285552 - DNA, 20 bp, Artificial Sequence
  chemically synthesized
acagcaaaggaaacagtaaa

SEQ ID NO: 285553 - DNA, 20 bp, Artificial Sequence
  chemically synthesized
cttctgcacagcaaaggaaa

SEQ ID NO: 285554 - DNA, 20 bp, Artificial Sequence
  chemically synthesized
ttctagcttctgcacagcaa

SEQ ID NO: 285555 - DNA, 20 bp, Artificial Sequence
  chemically synthesized
ttactgtttcctttgctgtg

SEQ ID NO: 285556 - DNA, 20 bp, Artificial Sequence
  chemically synthesized
tttctagcttctgcacagca

SEQ ID NO: 285557 - DNA, 20 bp, Artificial Sequence
  chemically synthesized
ctgtttcctttgctgtgcag

SEQ ID NO: 285558 - DNA, 20 bp, Artificial Sequence
  chemically synthesized
ctgagtttctagcttctgca

SEQ ID NO: 285559 - DNA, 20 bp, Artificial Sequence
  chemically synthesized
ttcctttgctgtgcagaagc

SEQ ID NO: 285560 - DNA, 20 bp, Artificial Sequence
  chemically synthesized
ctgtgcagaagctagaaact

SEQ ID NO: 285561 - DNA, 20 bp, Artificial Sequence
  chemically synthesized
ttttatgatatctgagtttc

SEQ ID NO: 285562 - DNA, 20 bp, Artificial Sequence
  chemically synthesized
tttttctttttatgatatct

SEQ ID NO: 285563 - DNA, 20 bp, Artificial Sequence
  chemically synthesized
agaaactcagatatcataaa

SEQ ID NO: 285564 - DNA, 20 bp, Artificial Sequence
  chemically synthesized
ataaaacatcatatcatatg

SEQ ID NO: 285565 - DNA, 20 bp, Artificial Sequence
  chemically synthesized
catatcatatgtggatgtga

SEQ ID NO: 285566 - DNA, 20 bp, Artificial Sequence
  chemically synthesized
atatcatatgtggatgtgat

SEQ ID NO: 285567 - DNA, 20 bp, Artificial Sequence
  chemically synthesized
gatgtgatgggattcaaaaa

SEQ ID NO: 285568 - DNA, 20 bp, Artificial Sequence
  chemically synthesized
atgtgatgggattcaaaaat

SEQ ID NO: 285569 - DNA, 20 bp, Artificial Sequence
  chemically synthesized
aaatgggcaaataatctgaa

SEQ ID NO: 285570 - DNA, 20 bp, Artificial Sequence
  chemically synthesized
ttcttttggaaataactgtt

SEQ ID NO: 285571 - DNA, 20 bp, Artificial Sequence
  chemically synthesized
atctgaacagttatttccaa

SEQ ID NO: 285572 - DNA, 20 bp, Artificial Sequence
  chemically synthesized
tgaacagttatttccaaaag

SEQ ID NO: 285573 - DNA, 20 bp, Artificial Sequence
  chemically synthesized
tggccatttttttcttcttt

SEQ ID NO: 285574 - DNA, 20 bp, Artificial Sequence
  chemically synthesized
tttccaaaagaagaaaaaaa

SEQ ID NO: 285575 - DNA, 20 bp, Artificial Sequence
  chemically synthesized
tttttttttcatatattaat

SEQ ID NO: 285576 - DNA, 20 bp, Artificial Sequence
  chemically synthesized
atgaaaaaaaaattccacat

SEQ ID NO: 285577 - DNA, 20 bp, Artificial Sequence
  chemically synthesized
ttatttgatgattaccgatg

SEQ ID NO: 285578 - DNA, 20 bp, Artificial Sequence
  chemically synthesized
gtgatacctcattgtggttt

SEQ ID NO: 285579 - DNA, 20 bp, Artificial Sequence
  chemically synthesized
atgcaaaccaaaaccacaat

SEQ ID NO: 285580 - DNA, 20 bp, Artificial Sequence
  chemically synthesized
tgcaaaccaaaaccacaatg

SEQ ID NO: 285581 - DNA, 20 bp, Artificial Sequence
  chemically synthesized
ggtgaggtgatacctcattg

SEQ ID NO: 285582 - DNA, 20 bp, Artificial Sequence
  chemically synthesized
aatgaggtatcacctcaccc

SEQ ID NO: 285583 - DNA, 20 bp, Artificial Sequence
  chemically synthesized
tatacatcctagctggggtg

SEQ ID NO: 285584 - DNA, 20 bp, Artificial Sequence
  chemically synthesized
atatacatcctagctggggt

SEQ ID NO: 285585 - DNA, 20 bp, Artificial Sequence
  chemically synthesized
aggtatcacctcaccccagc

SEQ ID NO: 285586 - DNA, 20 bp, Artificial Sequence
  chemically synthesized
ggtatcacctcaccccagct

SEQ ID NO: 285587 - DNA, 20 bp, Artificial Sequence
  chemically synthesized
ggcaatatacatcctagctg

SEQ ID NO: 285588 - DNA, 20 bp, Artificial Sequence
  chemically synthesized
tggcaatatacatcctagct

SEQ ID NO: 285589 - DNA, 20 bp, Artificial Sequence
  chemically synthesized
ttggcaatatacatcctagc

SEQ ID NO: 285590 - DNA, 20 bp, Artificial Sequence
  chemically synthesized
ctttttggcaatatacatcc

SEQ ID NO: 285591 - DNA, 20 bp, Artificial Sequence
  chemically synthesized
ctaggatgtatattgccaaa

SEQ ID NO: 285592 - DNA, 20 bp, Artificial Sequence
  chemically synthesized
acaattattttttgtctttt

SEQ ID NO: 285593 - DNA, 20 bp, Artificial Sequence
  chemically synthesized
aaaagacaaaaaataattgt

SEQ ID NO: 285594 - DNA, 20 bp, Artificial Sequence
  chemically synthesized
acaaaaaataattgttggca

SEQ ID NO: 285595 - DNA, 20 bp, Artificial Sequence
  chemically synthesized
aataattgttggcacggatg

SEQ ID NO: 285596 - DNA, 20 bp, Artificial Sequence
  chemically synthesized
ttggcacggatgcagataaa

SEQ ID NO: 285597 - DNA, 20 bp, Artificial Sequence
  chemically synthesized
tggcacggatgcagataaaa

SEQ ID NO: 285598 - DNA, 20 bp, Artificial Sequence
  chemically synthesized
ttcccactaacagtgtagtg

SEQ ID NO: 285599 - DNA, 20 bp, Artificial Sequence
  chemically synthesized
aaggaactacactacactgt

SEQ ID NO: 285600 - DNA, 20 bp, Artificial Sequence
  chemically synthesized
ttatattcccactaacagtg

SEQ ID NO: 285601 - DNA, 20 bp, Artificial Sequence
  chemically synthesized
gaactacactacactgttag

SEQ ID NO: 285602 - DNA, 20 bp, Artificial Sequence
  chemically synthesized
aactacactacactgttagt

SEQ ID NO: 285603 - DNA, 20 bp, Artificial Sequence
  chemically synthesized
accatttatattcccactaa

SEQ ID NO: 285604 - DNA, 20 bp, Artificial Sequence
  chemically synthesized
actgttagtgggaatataaa

SEQ ID NO: 285605 - DNA, 20 bp, Artificial Sequence
  chemically synthesized
tagtgggaatataaatggta

SEQ ID NO: 285606 - DNA, 20 bp, Artificial Sequence
  chemically synthesized
tataaatggtacagtcactg

SEQ ID NO: 285607 - DNA, 20 bp, Artificial Sequence
  chemically synthesized
taaatggtacagtcactgta

SEQ ID NO: 285608 - DNA, 20 bp, Artificial Sequence
  chemically synthesized
ggtacagtcactgtagagaa

SEQ ID NO: 285609 - DNA, 20 bp, Artificial Sequence
  chemically synthesized
aacctccatgctgttctcta

SEQ ID NO: 285610 - DNA, 20 bp, Artificial Sequence
  chemically synthesized
agtcactgtagagaacagca

SEQ ID NO: 285611 - DNA, 20 bp, Artificial Sequence
  chemically synthesized
tcactgtagagaacagcatg

SEQ ID NO: 285612 - DNA, 20 bp, Artificial Sequence
  chemically synthesized
cactgtagagaacagcatgg

SEQ ID NO: 285613 - DNA, 20 bp, Artificial Sequence
  chemically synthesized
agaacagcatggaggttcct

SEQ ID NO: 285614 - DNA, 20 bp, Artificial Sequence
  chemically synthesized
gtggatattgtagttttctg

SEQ ID NO: 285615 - DNA, 20 bp, Artificial Sequence
  chemically synthesized
tgtggatattgtagttttct

SEQ ID NO: 285616 - DNA, 20 bp, Artificial Sequence
  chemically synthesized
ggggatatttgtggatattg

SEQ ID NO: 285617 - DNA, 20 bp, Artificial Sequence
  chemically synthesized
caggaaaaaggggatatttg

SEQ ID NO: 285618 - DNA, 20 bp, Artificial Sequence
  chemically synthesized
aaaaaacaggcaggaaaaag

SEQ ID NO: 285619 - DNA, 20 bp, Artificial Sequence
  chemically synthesized
aaaaaaacaggcaggaaaaa

SEQ ID NO: 285620 - DNA, 20 bp, Artificial Sequence
  chemically synthesized
aaaaaaaacaggcaggaaaa

SEQ ID NO: 285621 - DNA, 20 bp, Artificial Sequence
  chemically synthesized
aaaaaaaaacaggcaggaaa

SEQ ID NO: 285622 - DNA, 20 bp, Artificial Sequence
  chemically synthesized
ggtagaaaaaaaaaacaggc

SEQ ID NO: 285623 - DNA, 20 bp, Artificial Sequence
  chemically synthesized
aggtagaaaaaaaaaacagg

SEQ ID NO: 285624 - DNA, 20 bp, Artificial Sequence
  chemically synthesized
tccaggtagaaaaaaaaaac

SEQ ID NO: 285625 - DNA, 20 bp, Artificial Sequence
  chemically synthesized
gtccaggtagaaaaaaaaaa

SEQ ID NO: 285626 - DNA, 20 bp, Artificial Sequence
  chemically synthesized
gcctgttttttttttctacc

SEQ ID NO: 285627 - DNA, 20 bp, Artificial Sequence
  chemically synthesized
agggattgcaattgtccagg

SEQ ID NO: 285628 - DNA, 20 bp, Artificial Sequence
  chemically synthesized
ggtagggattgcaattgtcc

SEQ ID NO: 285629 - DNA, 20 bp, Artificial Sequence
  chemically synthesized
aggtagggattgcaattgtc

SEQ ID NO: 285630 - DNA, 20 bp, Artificial Sequence
  chemically synthesized
ggctgaagtggaagcaggta

SEQ ID NO: 285631 - DNA, 20 bp, Artificial Sequence
  chemically synthesized
gggctgaagtggaagcaggt

SEQ ID NO: 285632 - DNA, 20 bp, Artificial Sequence
  chemically synthesized
agggctgaagtggaagcagg

SEQ ID NO: 285633 - DNA, 20 bp, Artificial Sequence
  chemically synthesized
aaaagggctgaagtggaagc

SEQ ID NO: 285634 - DNA, 20 bp, Artificial Sequence
  chemically synthesized
caaaagggctgaagtggaag

SEQ ID NO: 285635 - DNA, 20 bp, Artificial Sequence
  chemically synthesized
atccctacctgcttccactt

SEQ ID NO: 285636 - DNA, 20 bp, Artificial Sequence
  chemically synthesized
aatcaaaagggctgaagtgg

SEQ ID NO: 285637 - DNA, 20 bp, Artificial Sequence
  chemically synthesized
ataaatcaaaagggctgaag

SEQ ID NO: 285638 - DNA, 20 bp, Artificial Sequence
  chemically synthesized
agaataaatcaaaagggctg

SEQ ID NO: 285639 - DNA, 20 bp, Artificial Sequence
  chemically synthesized
agaagaagaataaatcaaaa

SEQ ID NO: 285640 - DNA, 20 bp, Artificial Sequence
  chemically synthesized
tagaagaagaataaatcaaa

SEQ ID NO: 285641 - DNA, 20 bp, Artificial Sequence
  chemically synthesized
ttagaagaagaataaatcaa

SEQ ID NO: 285642 - DNA, 20 bp, Artificial Sequence
  chemically synthesized
ttgatttattcttcttctaa

SEQ ID NO: 285643 - DNA, 20 bp, Artificial Sequence
  chemically synthesized
ctgcatattcctattagaag

SEQ ID NO: 285644 - DNA, 20 bp, Artificial Sequence
  chemically synthesized
tgatttattcttcttctaat

SEQ ID NO: 285645 - DNA, 20 bp, Artificial Sequence
  chemically synthesized
ttgctgcatattcctattag

SEQ ID NO: 285646 - DNA, 20 bp, Artificial Sequence
  chemically synthesized
agtttgctgcatattcctat

SEQ ID NO: 285647 - DNA, 20 bp, Artificial Sequence
  chemically synthesized
cttcttctaataggaatatg

SEQ ID NO: 285648 - DNA, 20 bp, Artificial Sequence
  chemically synthesized
tcatttaaaatggttgtttt

SEQ ID NO: 285649 - DNA, 20 bp, Artificial Sequence
  chemically synthesized
tcatttcatttcatttaaaa

SEQ ID NO: 285650 - DNA, 20 bp, Artificial Sequence
  chemically synthesized
ctgacttttaagcataggag

SEQ ID NO: 285651 - DNA, 20 bp, Artificial Sequence
  chemically synthesized
catctgacttttaagcatag

SEQ ID NO: 285652 - DNA, 20 bp, Artificial Sequence
  chemically synthesized
gtcatctgacttttaagcat

SEQ ID NO: 285653 - DNA, 20 bp, Artificial Sequence
  chemically synthesized
gatgccactcctatgcttaa

SEQ ID NO: 285654 - DNA, 20 bp, Artificial Sequence
  chemically synthesized
agtcatctgacttttaagca

SEQ ID NO: 285655 - DNA, 20 bp, Artificial Sequence
  chemically synthesized
ccactcctatgcttaaaagt

SEQ ID NO: 285656 - DNA, 20 bp, Artificial Sequence
  chemically synthesized
tggaaagtcatctgactttt

SEQ ID NO: 285657 - DNA, 20 bp, Artificial Sequence
  chemically synthesized
aaaagtcagatgactttcca

SEQ ID NO: 285658 - DNA, 20 bp, Artificial Sequence
  chemically synthesized
attatgtcaagtactttgga

SEQ ID NO: 285659 - DNA, 20 bp, Artificial Sequence
  chemically synthesized
agtcattatgtcaagtactt

SEQ ID NO: 285660 - DNA, 20 bp, Artificial Sequence
  chemically synthesized
gatgatttagtcattatgtc

SEQ ID NO: 285661 - DNA, 20 bp, Artificial Sequence
  chemically synthesized
tggaagccacagtgatgatt

SEQ ID NO: 285662 - DNA, 20 bp, Artificial Sequence
  chemically synthesized
taatgactaaatcatcactg

SEQ ID NO: 285663 - DNA, 20 bp, Artificial Sequence
  chemically synthesized
agaaaggaatatggaagcca

SEQ ID NO: 285664 - DNA, 20 bp, Artificial Sequence
  chemically synthesized
tgagtcagaaaggaatatgg

SEQ ID NO: 285665 - DNA, 20 bp, Artificial Sequence
  chemically synthesized
aaatgagtcagaaaggaata

SEQ ID NO: 285666 - DNA, 20 bp, Artificial Sequence
  chemically synthesized
agtgggaaaatgagtcagaa

SEQ ID NO: 285667 - DNA, 20 bp, Artificial Sequence
  chemically synthesized
gagtgggaaaatgagtcaga

SEQ ID NO: 285668 - DNA, 20 bp, Artificial Sequence
  chemically synthesized
aaaagagtgggaaaatgagt

SEQ ID NO: 285669 - DNA, 20 bp, Artificial Sequence
  chemically synthesized
gagaaaaagagtgggaaaat

SEQ ID NO: 285670 - DNA, 20 bp, Artificial Sequence
  chemically synthesized
gaagccaggagaaaaagagt

SEQ ID NO: 285671 - DNA, 20 bp, Artificial Sequence
  chemically synthesized
ggaagccaggagaaaaagag

SEQ ID NO: 285672 - DNA, 20 bp, Artificial Sequence
  chemically synthesized
aaaggaagccaggagaaaaa

SEQ ID NO: 285673 - DNA, 20 bp, Artificial Sequence
  chemically synthesized
ttttcccactctttttctcc

SEQ ID NO: 285674 - DNA, 20 bp, Artificial Sequence
  chemically synthesized
tcaaaggaagccaggagaaa

SEQ ID NO: 285675 - DNA, 20 bp, Artificial Sequence
  chemically synthesized
aggagctcaaaggaagccag

SEQ ID NO: 285676 - DNA, 20 bp, Artificial Sequence
  chemically synthesized
tgaggagctcaaaggaagcc

SEQ ID NO: 285677 - DNA, 20 bp, Artificial Sequence
  chemically synthesized
ttgaggagctcaaaggaagc

SEQ ID NO: 285678 - DNA, 20 bp, Artificial Sequence
  chemically synthesized
tttttctcctggcttccttt

SEQ ID NO: 285679 - DNA, 20 bp, Artificial Sequence
  chemically synthesized
atgtttgaggagctcaaagg

SEQ ID NO: 285680 - DNA, 20 bp, Artificial Sequence
  chemically synthesized
agcatgtttgaggagctcaa

SEQ ID NO: 285681 - DNA, 20 bp, Artificial Sequence
  chemically synthesized
tagcatgtttgaggagctca

SEQ ID NO: 285682 - DNA, 20 bp, Artificial Sequence
  chemically synthesized
gagggcttagcatgtttgag

SEQ ID NO: 285683 - DNA, 20 bp, Artificial Sequence
  chemically synthesized
gagagggcttagcatgtttg

SEQ ID NO: 285684 - DNA, 20 bp, Artificial Sequence
  chemically synthesized
agagagggcttagcatgttt

SEQ ID NO: 285685 - DNA, 20 bp, Artificial Sequence
  chemically synthesized
ttgagctcctcaaacatgct

SEQ ID NO: 285686 - DNA, 20 bp, Artificial Sequence
  chemically synthesized
atctgaggcaagagagggct

SEQ ID NO: 285687 - DNA, 20 bp, Artificial Sequence
  chemically synthesized
aaaacatctgaggcaagaga

SEQ ID NO: 285688 - DNA, 20 bp, Artificial Sequence
  chemically synthesized
gaaaacatctgaggcaagag

SEQ ID NO: 285689 - DNA, 20 bp, Artificial Sequence
  chemically synthesized
agaaaacatctgaggcaaga

SEQ ID NO: 285690 - DNA, 20 bp, Artificial Sequence
  chemically synthesized
tgctaagccctctcttgcct

SEQ ID NO: 285691 - DNA, 20 bp, Artificial Sequence
  chemically synthesized
ggagaaaacatctgaggcaa

SEQ ID NO: 285692 - DNA, 20 bp, Artificial Sequence
  chemically synthesized
gtggagaaaacatctgaggc

SEQ ID NO: 285693 - DNA, 20 bp, Artificial Sequence
  chemically synthesized
tgaagtggagaaaacatctg

SEQ ID NO: 285694 - DNA, 20 bp, Artificial Sequence
  chemically synthesized
atgaagtggagaaaacatct

SEQ ID NO: 285695 - DNA, 20 bp, Artificial Sequence
  chemically synthesized
ttctgccagaaaatgaagtg

SEQ ID NO: 285696 - DNA, 20 bp, Artificial Sequence
  chemically synthesized
aattctgccagaaaatgaag

SEQ ID NO: 285697 - DNA, 20 bp, Artificial Sequence
  chemically synthesized
gttttctccacttcattttc

SEQ ID NO: 285698 - DNA, 20 bp, Artificial Sequence
  chemically synthesized
aggaattctgccagaaaatg

SEQ ID NO: 285699 - DNA, 20 bp, Artificial Sequence
  chemically synthesized
ttctccacttcattttctgg

SEQ ID NO: 285700 - DNA, 20 bp, Artificial Sequence
  chemically synthesized
gttgtgtcaaggaattctgc

SEQ ID NO: 285701 - DNA, 20 bp, Artificial Sequence
  chemically synthesized
cttgacaatttgttgtgtca

SEQ ID NO: 285702 - DNA, 20 bp, Artificial Sequence
  chemically synthesized
acttgacaatttgttgtgtc

SEQ ID NO: 285703 - DNA, 20 bp, Artificial Sequence
  chemically synthesized
ccttgacacaacaaattgtc

SEQ ID NO: 285704 - DNA, 20 bp, Artificial Sequence
  chemically synthesized
attgtcaagttcctactact

SEQ ID NO: 285705 - DNA, 20 bp, Artificial Sequence
  chemically synthesized
ttgtcaagttcctactactc

SEQ ID NO: 285706 - DNA, 20 bp, Artificial Sequence
  chemically synthesized
aaagctgatacccgagtagt

SEQ ID NO: 285707 - DNA, 20 bp, Artificial Sequence
  chemically synthesized
taaagctgatacccgagtag

SEQ ID NO: 285708 - DNA, 20 bp, Artificial Sequence
  chemically synthesized
aattaaagctgatacccgag

SEQ ID NO: 285709 - DNA, 20 bp, Artificial Sequence
  chemically synthesized
agttcctactactcgggtat

SEQ ID NO: 285710 - DNA, 20 bp, Artificial Sequence
  chemically synthesized
cgaaattaaagctgataccc

SEQ ID NO: 285711 - DNA, 20 bp, Artificial Sequence
  chemically synthesized
tttctgaagaggcgaaatta

SEQ ID NO: 285712 - DNA, 20 bp, Artificial Sequence
  chemically synthesized
cagctttaatttcgcctctt

SEQ ID NO: 285713 - DNA, 20 bp, Artificial Sequence
  chemically synthesized
cagtagagtgttttctgaag

SEQ ID NO: 285714 - DNA, 20 bp, Artificial Sequence
  chemically synthesized
tcagtagagtgttttctgaa

SEQ ID NO: 285715 - DNA, 20 bp, Artificial Sequence
  chemically synthesized
agtcagtagagtgttttctg

SEQ ID NO: 285716 - DNA, 20 bp, Artificial Sequence
  chemically synthesized
tttctattgggtagtcagta

SEQ ID NO: 285717 - DNA, 20 bp, Artificial Sequence
  chemically synthesized
actttctattgggtagtcag

SEQ ID NO: 285718 - DNA, 20 bp, Artificial Sequence
  chemically synthesized
actactttctattgggtagt

SEQ ID NO: 285719 - DNA, 20 bp, Artificial Sequence
  chemically synthesized
acactctactgactacccaa

SEQ ID NO: 285720 - DNA, 20 bp, Artificial Sequence
  chemically synthesized
gaaaactactttctattggg

SEQ ID NO: 285721 - DNA, 20 bp, Artificial Sequence
  chemically synthesized
tctactgactacccaataga

SEQ ID NO: 285722 - DNA, 20 bp, Artificial Sequence
  chemically synthesized
caggaaaactactttctatt

SEQ ID NO: 285723 - DNA, 20 bp, Artificial Sequence
  chemically synthesized
gcaggaaaactactttctat

SEQ ID NO: 285724 - DNA, 20 bp, Artificial Sequence
  chemically synthesized
actgactacccaatagaaag

SEQ ID NO: 285725 - DNA, 20 bp, Artificial Sequence
  chemically synthesized
taaatgagagtgacaggagc

SEQ ID NO: 285726 - DNA, 20 bp, Artificial Sequence
  chemically synthesized
ttaaatgagagtgacaggag

SEQ ID NO: 285727 - DNA, 20 bp, Artificial Sequence
  chemically synthesized
cctttaaatgagagtgacag

SEQ ID NO: 285728 - DNA, 20 bp, Artificial Sequence
  chemically synthesized
accctttaaatgagagtgac

SEQ ID NO: 285729 - DNA, 20 bp, Artificial Sequence
  chemically synthesized
aaccctttaaatgagagtga

SEQ ID NO: 285730 - DNA, 20 bp, Artificial Sequence
  chemically synthesized
gctcctgtcactctcattta

SEQ ID NO: 285731 - DNA, 20 bp, Artificial Sequence
  chemically synthesized
aataagaaccctttaaatga

SEQ ID NO: 285732 - DNA, 20 bp, Artificial Sequence
  chemically synthesized
ctcctgtcactctcatttaa

SEQ ID NO: 285733 - DNA, 20 bp, Artificial Sequence
  chemically synthesized
tcctgtcactctcatttaaa

SEQ ID NO: 285734 - DNA, 20 bp, Artificial Sequence
  chemically synthesized
gcaataagaaccctttaaat

SEQ ID NO: 285735 - DNA, 20 bp, Artificial Sequence
  chemically synthesized
tacactctgaatgtagcaat

SEQ ID NO: 285736 - DNA, 20 bp, Artificial Sequence
  chemically synthesized
agggttcttattgctacatt

SEQ ID NO: 285737 - DNA, 20 bp, Artificial Sequence
  chemically synthesized
ggttcttattgctacattca

SEQ ID NO: 285738 - DNA, 20 bp, Artificial Sequence
  chemically synthesized
tcttgcttacactctgaatg

SEQ ID NO: 285739 - DNA, 20 bp, Artificial Sequence
  chemically synthesized
tattgctacattcagagtgt

SEQ ID NO: 285740 - DNA, 20 bp, Artificial Sequence
  chemically synthesized
gctacattcagagtgtaagc

SEQ ID NO: 285741 - DNA, 20 bp, Artificial Sequence
  chemically synthesized
gtgtaagcaagacttcaaac

SEQ ID NO: 285742 - DNA, 20 bp, Artificial Sequence
  chemically synthesized
tcacaacaatgtcttgtttg

SEQ ID NO: 285743 - DNA, 20 bp, Artificial Sequence
  chemically synthesized
ggtgaaaatggaaagtaaat

SEQ ID NO: 285744 - DNA, 20 bp, Artificial Sequence
  chemically synthesized
tggtgaaaatggaaagtaaa

SEQ ID NO: 285745 - DNA, 20 bp, Artificial Sequence
  chemically synthesized
agtttagtggtgaaaatgga

SEQ ID NO: 285746 - DNA, 20 bp, Artificial Sequence
  chemically synthesized
taatagtttagtggtgaaaa

SEQ ID NO: 285747 - DNA, 20 bp, Artificial Sequence
  chemically synthesized
tcacggagataatagtttag

SEQ ID NO: 285748 - DNA, 20 bp, Artificial Sequence
  chemically synthesized
ccttcacggagataatagtt

SEQ ID NO: 285749 - DNA, 20 bp, Artificial Sequence
  chemically synthesized
agttaccttcacggagataa

SEQ ID NO: 285750 - DNA, 20 bp, Artificial Sequence
  chemically synthesized
actaaactattatctccgtg

SEQ ID NO: 285751 - DNA, 20 bp, Artificial Sequence
  chemically synthesized
ctaaactattatctccgtga

SEQ ID NO: 285752 - DNA, 20 bp, Artificial Sequence
  chemically synthesized
acattgtagttaccttcacg

SEQ ID NO: 285753 - DNA, 20 bp, Artificial Sequence
  chemically synthesized
agacattgtagttaccttca

SEQ ID NO: 285754 - DNA, 20 bp, Artificial Sequence
  chemically synthesized
agggaataaaatagacattg

SEQ ID NO: 285755 - DNA, 20 bp, Artificial Sequence
  chemically synthesized
atataagtgagggaataaaa

SEQ ID NO: 285756 - DNA, 20 bp, Artificial Sequence
  chemically synthesized
aaatgatcagatataagtga

SEQ ID NO: 285757 - DNA, 20 bp, Artificial Sequence
  chemically synthesized
aaaatgatcagatataagtg

SEQ ID NO: 285758 - DNA, 20 bp, Artificial Sequence
  chemically synthesized
aaaaatgatcagatataagt

SEQ ID NO: 285759 - DNA, 20 bp, Artificial Sequence
  chemically synthesized
ctaaaaaaatgatcagatat

SEQ ID NO: 285760 - DNA, 20 bp, Artificial Sequence
  chemically synthesized
gctatttctaaaaaaatgat

SEQ ID NO: 285761 - DNA, 20 bp, Artificial Sequence
  chemically synthesized
cttatatctgatcatttttt

SEQ ID NO: 285762 - DNA, 20 bp, Artificial Sequence
  chemically synthesized
tctgatcatttttttagaaa

SEQ ID NO: 285763 - DNA, 20 bp, Artificial Sequence
  chemically synthesized
atcatttttttagaaatagc

SEQ ID NO: 285764 - DNA, 20 bp, Artificial Sequence
  chemically synthesized
ttttagaaatagctagaatc

SEQ ID NO: 285765 - DNA, 20 bp, Artificial Sequence
  chemically synthesized
aagtttaaaaatctagattc

SEQ ID NO: 285766 - DNA, 20 bp, Artificial Sequence
  chemically synthesized
tgtatataagtttaaaaatc

SEQ ID NO: 285767 - DNA, 20 bp, Artificial Sequence
  chemically synthesized
attttaaagggtatgtatat

SEQ ID NO: 285768 - DNA, 20 bp, Artificial Sequence
  chemically synthesized
ttattattttaaattttaaa

SEQ ID NO: 285769 - DNA, 20 bp, Artificial Sequence
  chemically synthesized
gttattattttaaattttaa

SEQ ID NO: 285770 - DNA, 20 bp, Artificial Sequence
  chemically synthesized
ggttattattttaaatttta

SEQ ID NO: 285771 - DNA, 20 bp, Artificial Sequence
  chemically synthesized
ctaattttgggtatataaaa

SEQ ID NO: 285772 - DNA, 20 bp, Artificial Sequence
  chemically synthesized
ccattttatatacccaaaat

SEQ ID NO: 285773 - DNA, 20 bp, Artificial Sequence
  chemically synthesized
acatcccatgatctaatttt

SEQ ID NO: 285774 - DNA, 20 bp, Artificial Sequence
  chemically synthesized
cacatcccatgatctaattt

SEQ ID NO: 285775 - DNA, 20 bp, Artificial Sequence
  chemically synthesized
atatacccaaaattagatca

SEQ ID NO: 285776 - DNA, 20 bp, Artificial Sequence
  chemically synthesized
tatacccaaaattagatcat

SEQ ID NO: 285777 - DNA, 20 bp, Artificial Sequence
  chemically synthesized
aattagatcatgggatgtga

SEQ ID NO: 285778 - DNA, 20 bp, Artificial Sequence
  chemically synthesized
ccaaatatctgatacatttg

SEQ ID NO: 285779 - DNA, 20 bp, Artificial Sequence
  chemically synthesized
gaaagcatcttcaaatgtat

SEQ ID NO: 285780 - DNA, 20 bp, Artificial Sequence
  chemically synthesized
cttcaaatgtatcagatatt

SEQ ID NO: 285781 - DNA, 20 bp, Artificial Sequence
  chemically synthesized
tcaaattatttatgttttcg

SEQ ID NO: 285782 - DNA, 20 bp, Artificial Sequence
  chemically synthesized
atttatgttttcgcagacat

SEQ ID NO: 285783 - DNA, 20 bp, Artificial Sequence
  chemically synthesized
ttttcgcagacattggcatc

SEQ ID NO: 285784 - DNA, 20 bp, Artificial Sequence
  chemically synthesized
gataattccttttttgtcac

SEQ ID NO: 285785 - DNA, 20 bp, Artificial Sequence
  chemically synthesized
attggcatctggtgacaaaa

SEQ ID NO: 285786 - DNA, 20 bp, Artificial Sequence
  chemically synthesized
ttggcatctggtgacaaaaa

SEQ ID NO: 285787 - DNA, 20 bp, Artificial Sequence
  chemically synthesized
tgatacactcttttgggtta

SEQ ID NO: 285788 - DNA, 20 bp, Artificial Sequence
  chemically synthesized
aggaattatctttaacccaa

SEQ ID NO: 285789 - DNA, 20 bp, Artificial Sequence
  chemically synthesized
gaattatctttaacccaaaa

SEQ ID NO: 285790 - DNA, 20 bp, Artificial Sequence
  chemically synthesized
agtgtgtgatacactctttt

SEQ ID NO: 285791 - DNA, 20 bp, Artificial Sequence
  chemically synthesized
aagtgtgtgatacactcttt

SEQ ID NO: 285792 - DNA, 20 bp, Artificial Sequence
  chemically synthesized
gaaatatctacagacaaaat

SEQ ID NO: 285793 - DNA, 20 bp, Artificial Sequence
  chemically synthesized
tcacacacttattttgtctg

SEQ ID NO: 285794 - DNA, 20 bp, Artificial Sequence
  chemically synthesized
atgcattacagaaatatcta

SEQ ID NO: 285795 - DNA, 20 bp, Artificial Sequence
  chemically synthesized
gtagatatttctgtaatgca

SEQ ID NO: 285796 - DNA, 20 bp, Artificial Sequence
  chemically synthesized
aagtgtaaatctatgcatta

SEQ ID NO: 285797 - DNA, 20 bp, Artificial Sequence
  chemically synthesized
cagagagaataatggaaatg

SEQ ID NO: 285798 - DNA, 20 bp, Artificial Sequence
  chemically synthesized
cagcattccagagagaataa

SEQ ID NO: 285799 - DNA, 20 bp, Artificial Sequence
  chemically synthesized
ttcatttccattattctctc

SEQ ID NO: 285800 - DNA, 20 bp, Artificial Sequence
  chemically synthesized
taccaattcagcattccaga

SEQ ID NO: 285801 - DNA, 20 bp, Artificial Sequence
  chemically synthesized
gttaccaattcagcattcca

SEQ ID NO: 285802 - DNA, 20 bp, Artificial Sequence
  chemically synthesized
ttgttaccaattcagcattc

SEQ ID NO: 285803 - DNA, 20 bp, Artificial Sequence
  chemically synthesized
ttctctctggaatgctgaat

SEQ ID NO: 285804 - DNA, 20 bp, Artificial Sequence
  chemically synthesized
tgtgaatattgttaccaatt

SEQ ID NO: 285805 - DNA, 20 bp, Artificial Sequence
  chemically synthesized
ttggtaacaatattcacata

SEQ ID NO: 285806 - DNA, 20 bp, Artificial Sequence
  chemically synthesized
acgatgcggtaaaaacaagg

SEQ ID NO: 285807 - DNA, 20 bp, Artificial Sequence
  chemically synthesized
aagacgatgcggtaaaaaca

SEQ ID NO: 285808 - DNA, 20 bp, Artificial Sequence
  chemically synthesized
gaagacgatgcggtaaaaac

SEQ ID NO: 285809 - DNA, 20 bp, Artificial Sequence
  chemically synthesized
aggagaagaagaagacgatg

SEQ ID NO: 285810 - DNA, 20 bp, Artificial Sequence
  chemically synthesized
tggcgctcaaggagaagaag

SEQ ID NO: 285811 - DNA, 20 bp, Artificial Sequence
  chemically synthesized
caatggcgctcaaggagaag

SEQ ID NO: 285812 - DNA, 20 bp, Artificial Sequence
  chemically synthesized
atcgtcttcttcttctcctt

SEQ ID NO: 285813 - DNA, 20 bp, Artificial Sequence
  chemically synthesized
gaacaatggcgctcaaggag

SEQ ID NO: 285814 - DNA, 20 bp, Artificial Sequence
  chemically synthesized
aaggaacaatggcgctcaag

SEQ ID NO: 285815 - DNA, 20 bp, Artificial Sequence
  chemically synthesized
ggaaggaacaatggcgctca

SEQ ID NO: 285816 - DNA, 20 bp, Artificial Sequence
  chemically synthesized
aggaaggaacaatggcgctc

SEQ ID NO: 285817 - DNA, 20 bp, Artificial Sequence
  chemically synthesized
gttgtaaaaggaaggaacaa

SEQ ID NO: 285818 - DNA, 20 bp, Artificial Sequence
  chemically synthesized
tgagttaggttgtaaaagga

SEQ ID NO: 285819 - DNA, 20 bp, Artificial Sequence
  chemically synthesized
atgagttaggttgtaaaagg

SEQ ID NO: 285820 - DNA, 20 bp, Artificial Sequence
  chemically synthesized
caaatgagttaggttgtaaa

SEQ ID NO: 285821 - DNA, 20 bp, Artificial Sequence
  chemically synthesized
ccaaatgagttaggttgtaa

SEQ ID NO: 285822 - DNA, 20 bp, Artificial Sequence
  chemically synthesized
actttgtagccaaatgagtt

SEQ ID NO: 285823 - DNA, 20 bp, Artificial Sequence
  chemically synthesized
cttttacaacctaactcatt

SEQ ID NO: 285824 - DNA, 20 bp, Artificial Sequence
  chemically synthesized
gactttgtagccaaatgagt

SEQ ID NO: 285825 - DNA, 20 bp, Artificial Sequence
  chemically synthesized
ttctgactttgtagccaaat

SEQ ID NO: 285826 - DNA, 20 bp, Artificial Sequence
  chemically synthesized
acctaactcatttggctaca

SEQ ID NO: 285827 - DNA, 20 bp, Artificial Sequence
  chemically synthesized
aactcatttggctacaaagt

SEQ ID NO: 285828 - DNA, 20 bp, Artificial Sequence
  chemically synthesized
ctggccatgttctgactttg

SEQ ID NO: 285829 - DNA, 20 bp, Artificial Sequence
  chemically synthesized
ttggctacaaagtcagaaca

SEQ ID NO: 285830 - DNA, 20 bp, Artificial Sequence
  chemically synthesized
ctacaaagtcagaacatggc

SEQ ID NO: 285831 - DNA, 20 bp, Artificial Sequence
  chemically synthesized
acaaagtcagaacatggcca

SEQ ID NO: 285832 - DNA, 20 bp, Artificial Sequence
  chemically synthesized
ttttcctacaagtatcactc

SEQ ID NO: 285833 - DNA, 20 bp, Artificial Sequence
  chemically synthesized
catggccagagtgatacttg

SEQ ID NO: 285834 - DNA, 20 bp, Artificial Sequence
  chemically synthesized
atggccagagtgatacttgt

SEQ ID NO: 285835 - DNA, 20 bp, Artificial Sequence
  chemically synthesized
cagagtgatacttgtaggaa

SEQ ID NO: 285836 - DNA, 20 bp, Artificial Sequence
  chemically synthesized
tgtatctgtgcttttcctac

SEQ ID NO: 285837 - DNA, 20 bp, Artificial Sequence
  chemically synthesized
tgatacttgtaggaaaagca

SEQ ID NO: 285838 - DNA, 20 bp, Artificial Sequence
  chemically synthesized
acagatacatataatattct

SEQ ID NO: 285839 - DNA, 20 bp, Artificial Sequence
  chemically synthesized
tacatataatattctaagat

SEQ ID NO: 285840 - DNA, 20 bp, Artificial Sequence
  chemically synthesized
tgatctccattttctaatct

SEQ ID NO: 285841 - DNA, 20 bp, Artificial Sequence
  chemically synthesized
aatattctaagattagaaaa

SEQ ID NO: 285842 - DNA, 20 bp, Artificial Sequence
  chemically synthesized
tattctaagattagaaaatg

SEQ ID NO: 285843 - DNA, 20 bp, Artificial Sequence
  chemically synthesized
taagattagaaaatggagat

SEQ ID NO: 285844 - DNA, 20 bp, Artificial Sequence
  chemically synthesized
agaaaatggagatcagaaca

SEQ ID NO: 285845 - DNA, 20 bp, Artificial Sequence
  chemically synthesized
atggagatcagaacatagct

SEQ ID NO: 285846 - DNA, 20 bp, Artificial Sequence
  chemically synthesized
cagaacatagcttggatcta

SEQ ID NO: 285847 - DNA, 20 bp, Artificial Sequence
  chemically synthesized
agcaaaaaagctatagatcc

SEQ ID NO: 285848 - DNA, 20 bp, Artificial Sequence
  chemically synthesized
gttgcatagcaaaaaagcta

SEQ ID NO: 285849 - DNA, 20 bp, Artificial Sequence
  chemically synthesized
tcatctgttgcatagcaaaa

SEQ ID NO: 285850 - DNA, 20 bp, Artificial Sequence
  chemically synthesized
atagcttttttgctatgcaa

SEQ ID NO: 285851 - DNA, 20 bp, Artificial Sequence
  chemically synthesized
aaacacactcatctgttgca

SEQ ID NO: 285852 - DNA, 20 bp, Artificial Sequence
  chemically synthesized
ttttttgctatgcaacagat

SEQ ID NO: 285853 - DNA, 20 bp, Artificial Sequence
  chemically synthesized
actaagaatttgttgttcaa

SEQ ID NO: 285854 - DNA, 20 bp, Artificial Sequence
  chemically synthesized
gtactaagaatttgttgttc

SEQ ID NO: 285855 - DNA, 20 bp, Artificial Sequence
  chemically synthesized
tctcttgaacaacaaattct

SEQ ID NO: 285856 - DNA, 20 bp, Artificial Sequence
  chemically synthesized
ttatgtctgttatatgtact

SEQ ID NO: 285857 - DNA, 20 bp, Artificial Sequence
  chemically synthesized
caaattcttagtacatataa

SEQ ID NO: 285858 - DNA, 20 bp, Artificial Sequence
  chemically synthesized
ttagtacatataacagacat

SEQ ID NO: 285859 - DNA, 20 bp, Artificial Sequence
  chemically synthesized
tagtacatataacagacata

SEQ ID NO: 285860 - DNA, 20 bp, Artificial Sequence
  chemically synthesized
tataacagacataaggtctt

SEQ ID NO: 285861 - DNA, 20 bp, Artificial Sequence
  chemically synthesized
cagacataaggtcttaagca

SEQ ID NO: 285862 - DNA, 20 bp, Artificial Sequence
  chemically synthesized
ctctaaaaatgtctttgctt

SEQ ID NO: 285863 - DNA, 20 bp, Artificial Sequence
  chemically synthesized
gtcttaagcaaagacatttt

SEQ ID NO: 285864 - DNA, 20 bp, Artificial Sequence
  chemically synthesized
cttaagcaaagacattttta

SEQ ID NO: 285865 - DNA, 20 bp, Artificial Sequence
  chemically synthesized
taagcaaagacatttttaga

SEQ ID NO: 285866 - DNA, 20 bp, Artificial Sequence
  chemically synthesized
tacaggagtacaatttgtaa

SEQ ID NO: 285867 - DNA, 20 bp, Artificial Sequence
  chemically synthesized
ttacaggagtacaatttgta

SEQ ID NO: 285868 - DNA, 20 bp, Artificial Sequence
  chemically synthesized
aaggtttttacattttacag

SEQ ID NO: 285869 - DNA, 20 bp, Artificial Sequence
  chemically synthesized
tcaaggtttttacattttac

SEQ ID NO: 285870 - DNA, 20 bp, Artificial Sequence
  chemically synthesized
ctcaaggtttttacatttta

SEQ ID NO: 285871 - DNA, 20 bp, Artificial Sequence
  chemically synthesized
ctgtaaaatgtaaaaacctt

SEQ ID NO: 285872 - DNA, 20 bp, Artificial Sequence
  chemically synthesized
tgtaaaatgtaaaaaccttg

SEQ ID NO: 285873 - DNA, 20 bp, Artificial Sequence
  chemically synthesized
acaatattactaaaacctca

SEQ ID NO: 285874 - DNA, 20 bp, Artificial Sequence
  chemically synthesized
atgtaaaaaccttgaggttt

SEQ ID NO: 285875 - DNA, 20 bp, Artificial Sequence
  chemically synthesized
aacaatattactaaaacctc

SEQ ID NO: 285876 - DNA, 20 bp, Artificial Sequence
  chemically synthesized
tgaggttttagtaatattgt

SEQ ID NO: 285877 - DNA, 20 bp, Artificial Sequence
  chemically synthesized
aaacatcagccaaaaaaaaa

SEQ ID NO: 285878 - DNA, 20 bp, Artificial Sequence
  chemically synthesized
ggttttatactttttttttt

SEQ ID NO: 285879 - DNA, 20 bp, Artificial Sequence
  chemically synthesized
gtagagcaaggggaaaacat

SEQ ID NO: 285880 - DNA, 20 bp, Artificial Sequence
  chemically synthesized
accaatttatgtagagcaag

SEQ ID NO: 285881 - DNA, 20 bp, Artificial Sequence
  chemically synthesized
caccaatttatgtagagcaa

SEQ ID NO: 285882 - DNA, 20 bp, Artificial Sequence
  chemically synthesized
tcaccaatttatgtagagca

SEQ ID NO: 285883 - DNA, 20 bp, Artificial Sequence
  chemically synthesized
atcaccaatttatgtagagc

SEQ ID NO: 285884 - DNA, 20 bp, Artificial Sequence
  chemically synthesized
gaacatcaccaatttatgta

SEQ ID NO: 285885 - DNA, 20 bp, Artificial Sequence
  chemically synthesized
tccccttgctctacataaat

SEQ ID NO: 285886 - DNA, 20 bp, Artificial Sequence
  chemically synthesized
aagaacatcaccaatttatg

SEQ ID NO: 285887 - DNA, 20 bp, Artificial Sequence
  chemically synthesized
gttcttaatggatgaataaa

SEQ ID NO: 285888 - DNA, 20 bp, Artificial Sequence
  chemically synthesized
gttctttttattcatccatt

SEQ ID NO: 285889 - DNA, 20 bp, Artificial Sequence
  chemically synthesized
tgtttgttgaatgttcttaa

SEQ ID NO: 285890 - DNA, 20 bp, Artificial Sequence
  chemically synthesized
aaaacaaatacctttcacac

SEQ ID NO: 285891 - DNA, 20 bp, Artificial Sequence
  chemically synthesized
tcctggaaggccagtgtgaa

SEQ ID NO: 285892 - DNA, 20 bp, Artificial Sequence
  chemically synthesized
ttcctggaaggccagtgtga

SEQ ID NO: 285893 - DNA, 20 bp, Artificial Sequence
  chemically synthesized
tacctttcacactggccttc

SEQ ID NO: 285894 - DNA, 20 bp, Artificial Sequence
  chemically synthesized
acctttcacactggccttcc

SEQ ID NO: 285895 - DNA, 20 bp, Artificial Sequence
  chemically synthesized
ttgatgttttcctggaaggc

SEQ ID NO: 285896 - DNA, 20 bp, Artificial Sequence
  chemically synthesized
accattgatgttttcctgga

SEQ ID NO: 285897 - DNA, 20 bp, Artificial Sequence
  chemically synthesized
taccattgatgttttcctgg

SEQ ID NO: 285898 - DNA, 20 bp, Artificial Sequence
  chemically synthesized
ttataccattgatgttttcc

SEQ ID NO: 285899 - DNA, 20 bp, Artificial Sequence
  chemically synthesized
gccttccaggaaaacatcaa

SEQ ID NO: 285900 - DNA, 20 bp, Artificial Sequence
  chemically synthesized
aatggtataatctattattt

SEQ ID NO: 285901 - DNA, 20 bp, Artificial Sequence
  chemically synthesized
aaaaaatattacttaaataa

SEQ ID NO: 285902 - DNA, 20 bp, Artificial Sequence
  chemically synthesized
cagtgctagaagagttgttt

SEQ ID NO: 285903 - DNA, 20 bp, Artificial Sequence
  chemically synthesized
tcagtgctagaagagttgtt

SEQ ID NO: 285904 - DNA, 20 bp, Artificial Sequence
  chemically synthesized
tttttcctaaacaactcttc

SEQ ID NO: 285905 - DNA, 20 bp, Artificial Sequence
  chemically synthesized
gaagtaagtcagtgctagaa

SEQ ID NO: 285906 - DNA, 20 bp, Artificial Sequence
  chemically synthesized
ctgaagtaagtcagtgctag

SEQ ID NO: 285907 - DNA, 20 bp, Artificial Sequence
  chemically synthesized
ctcctgaagtaagtcagtgc

SEQ ID NO: 285908 - DNA, 20 bp, Artificial Sequence
  chemically synthesized
attcttctcctgaagtaagt

SEQ ID NO: 285909 - DNA, 20 bp, Artificial Sequence
  chemically synthesized
cttctagcactgacttactt

SEQ ID NO: 285910 - DNA, 20 bp, Artificial Sequence
  chemically synthesized
ttctagcactgacttacttc

SEQ ID NO: 285911 - DNA, 20 bp, Artificial Sequence
  chemically synthesized
ctagcactgacttacttcag

SEQ ID NO: 285912 - DNA, 20 bp, Artificial Sequence
  chemically synthesized
tcacattcttctcctgaagt

SEQ ID NO: 285913 - DNA, 20 bp, Artificial Sequence
  chemically synthesized
gcactgacttacttcaggag

SEQ ID NO: 285914 - DNA, 20 bp, Artificial Sequence
  chemically synthesized
tagctcacattcttctcctg

SEQ ID NO: 285915 - DNA, 20 bp, Artificial Sequence
  chemically synthesized
ttacttcaggagaagaatgt

SEQ ID NO: 285916 - DNA, 20 bp, Artificial Sequence
  chemically synthesized
ttcaggagaagaatgtgagc

SEQ ID NO: 285917 - DNA, 20 bp, Artificial Sequence
  chemically synthesized
agaatgtgagctagctgacc

SEQ ID NO: 285918 - DNA, 20 bp, Artificial Sequence
  chemically synthesized
tgagctgtccctgggtcagc

SEQ ID NO: 285919 - DNA, 20 bp, Artificial Sequence
  chemically synthesized
gaatgtgagctagctgaccc

SEQ ID NO: 285920 - DNA, 20 bp, Artificial Sequence
  chemically synthesized
aatgtgagctagctgaccca

SEQ ID NO: 285921 - DNA, 20 bp, Artificial Sequence
  chemically synthesized
cagatgagctgtccctgggt

SEQ ID NO: 285922 - DNA, 20 bp, Artificial Sequence
  chemically synthesized
tgagctagctgacccaggga

SEQ ID NO: 285923 - DNA, 20 bp, Artificial Sequence
  chemically synthesized
ttcacagatgagctgtccct

SEQ ID NO: 285924 - DNA, 20 bp, Artificial Sequence
  chemically synthesized
attcacagatgagctgtccc

SEQ ID NO: 285925 - DNA, 20 bp, Artificial Sequence
  chemically synthesized
ggttctgttaattcacagat

SEQ ID NO: 285926 - DNA, 20 bp, Artificial Sequence
  chemically synthesized
tcattggttctgttaattca

SEQ ID NO: 285927 - DNA, 20 bp, Artificial Sequence
  chemically synthesized
acagctcatctgtgaattaa

SEQ ID NO: 285928 - DNA, 20 bp, Artificial Sequence
  chemically synthesized
aatcactgacaagtgttcat

SEQ ID NO: 285929 - DNA, 20 bp, Artificial Sequence
  chemically synthesized
cagaaccaatgaacacttgt

SEQ ID NO: 285930 - DNA, 20 bp, Artificial Sequence
  chemically synthesized
cagctaatacaatcactgac

SEQ ID NO: 285931 - DNA, 20 bp, Artificial Sequence
  chemically synthesized
acacttgtcagtgattgtat

SEQ ID NO: 285932 - DNA, 20 bp, Artificial Sequence
  chemically synthesized
tgtcagtgattgtattagct

SEQ ID NO: 285933 - DNA, 20 bp, Artificial Sequence
  chemically synthesized
aaaagtcaagggaaatcact

SEQ ID NO: 285934 - DNA, 20 bp, Artificial Sequence
  chemically synthesized
aaaaaaattagaaaagtcaa

SEQ ID NO: 285935 - DNA, 20 bp, Artificial Sequence
  chemically synthesized
aaaaaaaattagaaaagtca

SEQ ID NO: 285936 - DNA, 20 bp, Artificial Sequence
  chemically synthesized
aaaaaaaaattagaaaagtc

SEQ ID NO: 285937 - DNA, 20 bp, Artificial Sequence
  chemically synthesized
aatgaaaaaaaaaattagaa

SEQ ID NO: 285938 - DNA, 20 bp, Artificial Sequence
  chemically synthesized
ttgaaaatgaaaaaaaaaat

SEQ ID NO: 285939 - DNA, 20 bp, Artificial Sequence
  chemically synthesized
ttttttttcattttcaaatg

SEQ ID NO: 285940 - DNA, 20 bp, Artificial Sequence
  chemically synthesized
gaagtaatgtcaaaaggcaa

SEQ ID NO: 285941 - DNA, 20 bp, Artificial Sequence
  chemically synthesized
agaaaagaagtaatgtcaaa

SEQ ID NO: 285942 - DNA, 20 bp, Artificial Sequence
  chemically synthesized
tagaaaagaagtaatgtcaa

SEQ ID NO: 285943 - DNA, 20 bp, Artificial Sequence
  chemically synthesized
aaactttcaaaatagaaaag

SEQ ID NO: 285944 - DNA, 20 bp, Artificial Sequence
  chemically synthesized
agtaaactttcaaaatagaa

SEQ ID NO: 285945 - DNA, 20 bp, Artificial Sequence
  chemically synthesized
ttacttcttttctattttga

SEQ ID NO: 285946 - DNA, 20 bp, Artificial Sequence
  chemically synthesized
tgctaagtaaactttcaaaa

SEQ ID NO: 285947 - DNA, 20 bp, Artificial Sequence
  chemically synthesized
ttctattttgaaagtttact

SEQ ID NO: 285948 - DNA, 20 bp, Artificial Sequence
  chemically synthesized
tattttgaaagtttacttag

SEQ ID NO: 285949 - DNA, 20 bp, Artificial Sequence
  chemically synthesized
gttggtctttggttactgct

SEQ ID NO: 285950 - DNA, 20 bp, Artificial Sequence
  chemically synthesized
agtttacttagcagtaacca

SEQ ID NO: 285951 - DNA, 20 bp, Artificial Sequence
  chemically synthesized
tgttagaggcagttggtctt

SEQ ID NO: 285952 - DNA, 20 bp, Artificial Sequence
  chemically synthesized
atttacgtgttagaggcagt

SEQ ID NO: 285953 - DNA, 20 bp, Artificial Sequence
  chemically synthesized
ttcaatttacgtgttagagg

SEQ ID NO: 285954 - DNA, 20 bp, Artificial Sequence
  chemically synthesized
ggtttcaatttacgtgttag

SEQ ID NO: 285955 - DNA, 20 bp, Artificial Sequence
  chemically synthesized
gggtttcaatttacgtgtta

SEQ ID NO: 285956 - DNA, 20 bp, Artificial Sequence
  chemically synthesized
aggggtttcaatttacgtgt

SEQ ID NO: 285957 - DNA, 20 bp, Artificial Sequence
  chemically synthesized
cctttttggaaattaataag

SEQ ID NO: 285958 - DNA, 20 bp, Artificial Sequence
  chemically synthesized
acctttttggaaattaataa

SEQ ID NO: 285959 - DNA, 20 bp, Artificial Sequence
  chemically synthesized
tacctttttggaaattaata

SEQ ID NO: 285960 - DNA, 20 bp, Artificial Sequence
  chemically synthesized
gtacctttttggaaattaat

SEQ ID NO: 285961 - DNA, 20 bp, Artificial Sequence
  chemically synthesized
accccttattaatttccaaa

SEQ ID NO: 285962 - DNA, 20 bp, Artificial Sequence
  chemically synthesized
ccccttattaatttccaaaa

SEQ ID NO: 285963 - DNA, 20 bp, Artificial Sequence
  chemically synthesized
agggaactactgtacctttt

SEQ ID NO: 285964 - DNA, 20 bp, Artificial Sequence
  chemically synthesized
tattaatttccaaaaaggta

SEQ ID NO: 285965 - DNA, 20 bp, Artificial Sequence
  chemically synthesized
taatttccaaaaaggtacag

SEQ ID NO: 285966 - DNA, 20 bp, Artificial Sequence
  chemically synthesized
catatcttccaaagatacaa

SEQ ID NO: 285967 - DNA, 20 bp, Artificial Sequence
  chemically synthesized
acatatcttccaaagataca

SEQ ID NO: 285968 - DNA, 20 bp, Artificial Sequence
  chemically synthesized
cagtagttcccttgtatctt

SEQ ID NO: 285969 - DNA, 20 bp, Artificial Sequence
  chemically synthesized
aacatatcttccaaagatac

SEQ ID NO: 285970 - DNA, 20 bp, Artificial Sequence
  chemically synthesized
tagttcccttgtatctttgg

SEQ ID NO: 285971 - DNA, 20 bp, Artificial Sequence
  chemically synthesized
tggtatgaacatatcttcca

SEQ ID NO: 285972 - DNA, 20 bp, Artificial Sequence
  chemically synthesized
ttggaagatatgttcatacc

SEQ ID NO: 285973 - DNA, 20 bp, Artificial Sequence
  chemically synthesized
caggcatctattggaggtct

SEQ ID NO: 285974 - DNA, 20 bp, Artificial Sequence
  chemically synthesized
gttcataccaagacctccaa

SEQ ID NO: 285975 - DNA, 20 bp, Artificial Sequence
  chemically synthesized
tggtttcaggcatctattgg

SEQ ID NO: 285976 - DNA, 20 bp, Artificial Sequence
  chemically synthesized
atggtttcaggcatctattg

SEQ ID NO: 285977 - DNA, 20 bp, Artificial Sequence
  chemically synthesized
ctatggtttcaggcatctat

SEQ ID NO: 285978 - DNA, 20 bp, Artificial Sequence
  chemically synthesized
ccaatagatgcctgaaacca

SEQ ID NO: 285979 - DNA, 20 bp, Artificial Sequence
  chemically synthesized
taggtatcatctatggtttc

SEQ ID NO: 285980 - DNA, 20 bp, Artificial Sequence
  chemically synthesized
ttaggtatcatctatggttt

SEQ ID NO: 285981 - DNA, 20 bp, Artificial Sequence
  chemically synthesized
atagggttaggtatcatcta

SEQ ID NO: 285982 - DNA, 20 bp, Artificial Sequence
  chemically synthesized
aatctagtgtatatagggtt

SEQ ID NO: 285983 - DNA, 20 bp, Artificial Sequence
  chemically synthesized
aaatctagtgtatatagggt

SEQ ID NO: 285984 - DNA, 20 bp, Artificial Sequence
  chemically synthesized
gaaaaaatctagtgtatata

SEQ ID NO: 285985 - DNA, 20 bp, Artificial Sequence
  chemically synthesized
ggaaaaaatctagtgtatat

SEQ ID NO: 285986 - DNA, 20 bp, Artificial Sequence
  chemically synthesized
atacctaaccctatatacac

SEQ ID NO: 285987 - DNA, 20 bp, Artificial Sequence
  chemically synthesized
aggaaaaaatctagtgtata

SEQ ID NO: 285988 - DNA, 20 bp, Artificial Sequence
  chemically synthesized
tgtatgagtaggaaaaaatc

SEQ ID NO: 285989 - DNA, 20 bp, Artificial Sequence
  chemically synthesized
ttttataggtatgtatgagt

SEQ ID NO: 285990 - DNA, 20 bp, Artificial Sequence
  chemically synthesized
attttataggtatgtatgag

SEQ ID NO: 285991 - DNA, 20 bp, Artificial Sequence
  chemically synthesized
taaattttataggtatgtat

SEQ ID NO: 285992 - DNA, 20 bp, Artificial Sequence
  chemically synthesized
atttataaattaaattttat

SEQ ID NO: 285993 - DNA, 20 bp, Artificial Sequence
  chemically synthesized
aatttataaattaaatttta

SEQ ID NO: 285994 - DNA, 20 bp, Artificial Sequence
  chemically synthesized
ataaaatttaatttataaat

SEQ ID NO: 285995 - DNA, 20 bp, Artificial Sequence
  chemically synthesized
taaaatttaatttataaatt

SEQ ID NO: 285996 - DNA, 20 bp, Artificial Sequence
  chemically synthesized
tttaatttataaattaggca

SEQ ID NO: 285997 - DNA, 20 bp, Artificial Sequence
  chemically synthesized
atttataaattaggcatagt

SEQ ID NO: 285998 - DNA, 20 bp, Artificial Sequence
  chemically synthesized
ttataaattaggcatagtaa

SEQ ID NO: 285999 - DNA, 20 bp, Artificial Sequence
  chemically synthesized
gagattaacaactaataaaa

SEQ ID NO: 286000 - DNA, 20 bp, Artificial Sequence
  chemically synthesized
gataacttgttctattttat

SEQ ID NO: 286001 - DNA, 20 bp, Artificial Sequence
  chemically synthesized
aacaactaataaaatagaac

SEQ ID NO: 286002 - DNA, 20 bp, Artificial Sequence
  chemically synthesized
ttttgagagggagaagaaga

SEQ ID NO: 286003 - DNA, 20 bp, Artificial Sequence
  chemically synthesized
tattttgagagggagaagaa

SEQ ID NO: 286004 - DNA, 20 bp, Artificial Sequence
  chemically synthesized
gatattttgagagggagaag

SEQ ID NO: 286005 - DNA, 20 bp, Artificial Sequence
  chemically synthesized
taagatattttgagagggag

SEQ ID NO: 286006 - DNA, 20 bp, Artificial Sequence
  chemically synthesized
aaataagatattttgagagg

SEQ ID NO: 286007 - DNA, 20 bp, Artificial Sequence
  chemically synthesized
taaaataagatattttgaga

SEQ ID NO: 286008 - DNA, 20 bp, Artificial Sequence
  chemically synthesized
gtaaaataagatattttgag

SEQ ID NO: 286009 - DNA, 20 bp, Artificial Sequence
  chemically synthesized
agtaaaataagatattttga

SEQ ID NO: 286010 - DNA, 20 bp, Artificial Sequence
  chemically synthesized
acagtaaaataagatatttt

SEQ ID NO: 286011 - DNA, 20 bp, Artificial Sequence
  chemically synthesized
atcggtgagcacagtaaaat

SEQ ID NO: 286012 - DNA, 20 bp, Artificial Sequence
  chemically synthesized
aatcctaaaatcggtgagca

SEQ ID NO: 286013 - DNA, 20 bp, Artificial Sequence
  chemically synthesized
attggaatcctaaaatcggt

SEQ ID NO: 286014 - DNA, 20 bp, Artificial Sequence
  chemically synthesized
tttactgtgctcaccgattt

SEQ ID NO: 286015 - DNA, 20 bp, Artificial Sequence
  chemically synthesized
ttactgtgctcaccgatttt

SEQ ID NO: 286016 - DNA, 20 bp, Artificial Sequence
  chemically synthesized
gtcaattggaatcctaaaat

SEQ ID NO: 286017 - DNA, 20 bp, Artificial Sequence
  chemically synthesized
ttcaaatgcttgtggtcaat

SEQ ID NO: 286018 - DNA, 20 bp, Artificial Sequence
  chemically synthesized
ttaggattccaattgaccac

SEQ ID NO: 286019 - DNA, 20 bp, Artificial Sequence
  chemically synthesized
tccctggtttcaaatgcttg

SEQ ID NO: 286020 - DNA, 20 bp, Artificial Sequence
  chemically synthesized
tgaccacaagcatttgaaac

SEQ ID NO: 286021 - DNA, 20 bp, Artificial Sequence
  chemically synthesized
gaccacaagcatttgaaacc

SEQ ID NO: 286022 - DNA, 20 bp, Artificial Sequence
  chemically synthesized
accacaagcatttgaaacca

SEQ ID NO: 286023 - DNA, 20 bp, Artificial Sequence
  chemically synthesized
caagcatttgaaaccaggga

SEQ ID NO: 286024 - DNA, 20 bp, Artificial Sequence
  chemically synthesized
atctgcagttttgctttccc

SEQ ID NO: 286025 - DNA, 20 bp, Artificial Sequence
  chemically synthesized
aaccagggaaagcaaaactg

SEQ ID NO: 286026 - DNA, 20 bp, Artificial Sequence
  chemically synthesized
cattagtccccgatcatctg

SEQ ID NO: 286027 - DNA, 20 bp, Artificial Sequence
  chemically synthesized
aaagcaaaactgcagatgat

SEQ ID NO: 286028 - DNA, 20 bp, Artificial Sequence
  chemically synthesized
aagcaaaactgcagatgatc

SEQ ID NO: 286029 - DNA, 20 bp, Artificial Sequence
  chemically synthesized
agcaaaactgcagatgatcg

SEQ ID NO: 286030 - DNA, 20 bp, Artificial Sequence
  chemically synthesized
atgatcggggactaatgtat

SEQ ID NO: 286031 - DNA, 20 bp, Artificial Sequence
  chemically synthesized
ttttaagttcaccaatacat

SEQ ID NO: 286032 - DNA, 20 bp, Artificial Sequence
  chemically synthesized
taatgtattggtgaacttaa

SEQ ID NO: 286033 - DNA, 20 bp, Artificial Sequence
  chemically synthesized
ctaaagcaatgaatactttt

SEQ ID NO: 286034 - DNA, 20 bp, Artificial Sequence
  chemically synthesized
cttaaaagtattcattgctt

SEQ ID NO: 286035 - DNA, 20 bp, Artificial Sequence
  chemically synthesized
aaagataaaattttgaacta

SEQ ID NO: 286036 - DNA, 20 bp, Artificial Sequence
  chemically synthesized
caaaattttatctttcgaac

SEQ ID NO: 286037 - DNA, 20 bp, Artificial Sequence
  chemically synthesized
atcaaatacttcttgttcga

SEQ ID NO: 286038 - DNA, 20 bp, Artificial Sequence
  chemically synthesized
aattttatctttcgaacaag

SEQ ID NO: 286039 - DNA, 20 bp, Artificial Sequence
  chemically synthesized
tagtaagatatattcaaaaa

SEQ ID NO: 286040 - DNA, 20 bp, Artificial Sequence
  chemically synthesized
aatattcaattacggatagt

SEQ ID NO: 286041 - DNA, 20 bp, Artificial Sequence
  chemically synthesized
tttaaatattcaattacgga

SEQ ID NO: 286042 - DNA, 20 bp, Artificial Sequence
  chemically synthesized
tatatttaaatattcaatta

SEQ ID NO: 286043 - DNA, 20 bp, Artificial Sequence
  chemically synthesized
gtaattgaatatttaaatat

SEQ ID NO: 286044 - DNA, 20 bp, Artificial Sequence
  chemically synthesized
aattgaatatttaaatataa

SEQ ID NO: 286045 - DNA, 20 bp, Artificial Sequence
  chemically synthesized
ttgaatatttaaatataaga

SEQ ID NO: 286046 - DNA, 20 bp, Artificial Sequence
  chemically synthesized
ttctacagaagaatatttta

SEQ ID NO: 286047 - DNA, 20 bp, Artificial Sequence
  chemically synthesized
atctataaaatattcttctg

SEQ ID NO: 286048 - DNA, 20 bp, Artificial Sequence
  chemically synthesized
agtttctcatttttctacag

SEQ ID NO: 286049 - DNA, 20 bp, Artificial Sequence
  chemically synthesized
ttgagtttctcatttttcta

SEQ ID NO: 286050 - DNA, 20 bp, Artificial Sequence
  chemically synthesized
atattcttctgtagaaaaat

SEQ ID NO: 286051 - DNA, 20 bp, Artificial Sequence
  chemically synthesized
aaaatgagaaactcaaatat

SEQ ID NO: 286052 - DNA, 20 bp, Artificial Sequence
  chemically synthesized
atgactgtacactcatattt

SEQ ID NO: 286053 - DNA, 20 bp, Artificial Sequence
  chemically synthesized
gaaactcaaatatgagtgta

SEQ ID NO: 286054 - DNA, 20 bp, Artificial Sequence
  chemically synthesized
gtgtgtttttttttgaaatt

SEQ ID NO: 286055 - DNA, 20 bp, Artificial Sequence
  chemically synthesized
tgaaattcagctattcttaa

SEQ ID NO: 286056 - DNA, 20 bp, Artificial Sequence
  chemically synthesized
gattcagtaaccattaagaa

SEQ ID NO: 286057 - DNA, 20 bp, Artificial Sequence
  chemically synthesized
attaagattcagtaaccatt

SEQ ID NO: 286058 - DNA, 20 bp, Artificial Sequence
  chemically synthesized
tttaaataacaattaagatt

SEQ ID NO: 286059 - DNA, 20 bp, Artificial Sequence
  chemically synthesized
tctagttttaaataacaatt

SEQ ID NO: 286060 - DNA, 20 bp, Artificial Sequence
  chemically synthesized
tcttaattgttatttaaaac

SEQ ID NO: 286061 - DNA, 20 bp, Artificial Sequence
  chemically synthesized
tgttatttaaaactagatgt

SEQ ID NO: 286062 - DNA, 20 bp, Artificial Sequence
  chemically synthesized
taccacacctggctgacatc

SEQ ID NO: 286063 - DNA, 20 bp, Artificial Sequence
  chemically synthesized
atttaaaactagatgtcagc

SEQ ID NO: 286064 - DNA, 20 bp, Artificial Sequence
  chemically synthesized
tttaaaactagatgtcagcc

SEQ ID NO: 286065 - DNA, 20 bp, Artificial Sequence
  chemically synthesized
aactagatgtcagccaggtg

SEQ ID NO: 286066 - DNA, 20 bp, Artificial Sequence
  chemically synthesized
taggtgtgagttaccacacc

SEQ ID NO: 286067 - DNA, 20 bp, Artificial Sequence
  chemically synthesized
aatgctggaattataggtgt

SEQ ID NO: 286068 - DNA, 20 bp, Artificial Sequence
  chemically synthesized
gtaactcacacctataattc

SEQ ID NO: 286069 - DNA, 20 bp, Artificial Sequence
  chemically synthesized
tcccaaaatgctggaattat

SEQ ID NO: 286070 - DNA, 20 bp, Artificial Sequence
  chemically synthesized
ctcccaaaatgctggaatta

SEQ ID NO: 286071 - DNA, 20 bp, Artificial Sequence
  chemically synthesized
cacctataattccagcattt

SEQ ID NO: 286072 - DNA, 20 bp, Artificial Sequence
  chemically synthesized
acctataattccagcatttt

SEQ ID NO: 286073 - DNA, 20 bp, Artificial Sequence
  chemically synthesized
tccttggcctcccaaaatgc

SEQ ID NO: 286074 - DNA, 20 bp, Artificial Sequence
  chemically synthesized
ctataattccagcattttgg

SEQ ID NO: 286075 - DNA, 20 bp, Artificial Sequence
  chemically synthesized
tataattccagcattttggg

SEQ ID NO: 286076 - DNA, 20 bp, Artificial Sequence
  chemically synthesized
ttccagcattttgggaggcc

SEQ ID NO: 286077 - DNA, 20 bp, Artificial Sequence
  chemically synthesized
tccagcattttgggaggcca

SEQ ID NO: 286078 - DNA, 20 bp, Artificial Sequence
  chemically synthesized
gcattttgggaggccaagga

SEQ ID NO: 286079 - DNA, 20 bp, Artificial Sequence
  chemically synthesized
attttgggaggccaaggaaa

SEQ ID NO: 286080 - DNA, 20 bp, Artificial Sequence
  chemically synthesized
ctcaaacaatgctctttcct

SEQ ID NO: 286081 - DNA, 20 bp, Artificial Sequence
  chemically synthesized
ccaaggaaagagcattgttt

SEQ ID NO: 286082 - DNA, 20 bp, Artificial Sequence
  chemically synthesized
gaaagagcattgtttgagcc

SEQ ID NO: 286083 - DNA, 20 bp, Artificial Sequence
  chemically synthesized
aaagagcattgtttgagccc

SEQ ID NO: 286084 - DNA, 20 bp, Artificial Sequence
  chemically synthesized
caggctggttttgaattcct

SEQ ID NO: 286085 - DNA, 20 bp, Artificial Sequence
  chemically synthesized
ccaggctggttttgaattcc

SEQ ID NO: 286086 - DNA, 20 bp, Artificial Sequence
  chemically synthesized
tgagcccaggaattcaaaac

SEQ ID NO: 286087 - DNA, 20 bp, Artificial Sequence
  chemically synthesized
ccaggaattcaaaaccagcc

SEQ ID NO: 286088 - DNA, 20 bp, Artificial Sequence
  chemically synthesized
caggaattcaaaaccagcct

SEQ ID NO: 286089 - DNA, 20 bp, Artificial Sequence
  chemically synthesized
tcttgctgtgtttcccaggc

SEQ ID NO: 286090 - DNA, 20 bp, Artificial Sequence
  chemically synthesized
agggtcttgctgtgtttccc

SEQ ID NO: 286091 - DNA, 20 bp, Artificial Sequence
  chemically synthesized
caaaaccagcctgggaaaca

SEQ ID NO: 286092 - DNA, 20 bp, Artificial Sequence
  chemically synthesized
cagggtcttgctgtgtttcc

SEQ ID NO: 286093 - DNA, 20 bp, Artificial Sequence
  chemically synthesized
accagcctgggaaacacagc

SEQ ID NO: 286094 - DNA, 20 bp, Artificial Sequence
  chemically synthesized
gttattttttggtagagaca

SEQ ID NO: 286095 - DNA, 20 bp, Artificial Sequence
  chemically synthesized
tgttattttttggtagagac

SEQ ID NO: 286096 - DNA, 20 bp, Artificial Sequence
  chemically synthesized
ttgttattttttggtagaga

SEQ ID NO: 286097 - DNA, 20 bp, Artificial Sequence
  chemically synthesized
ttttttgttattttttggta

SEQ ID NO: 286098 - DNA, 20 bp, Artificial Sequence
  chemically synthesized
aattttttgttattttttgg

SEQ ID NO: 286099 - DNA, 20 bp, Artificial Sequence
  chemically synthesized
gctaattttttgttattttt

SEQ ID NO: 286100 - DNA, 20 bp, Artificial Sequence
  chemically synthesized
accaaaaaataacaaaaaat

SEQ ID NO: 286101 - DNA, 20 bp, Artificial Sequence
  chemically synthesized
aaaaataacaaaaaattagc

SEQ ID NO: 286102 - DNA, 20 bp, Artificial Sequence
  chemically synthesized
aaaataacaaaaaattagcc

SEQ ID NO: 286103 - DNA, 20 bp, Artificial Sequence
  chemically synthesized
aacaaaaaattagccaggca

SEQ ID NO: 286104 - DNA, 20 bp, Artificial Sequence
  chemically synthesized
aaaaaattagccaggcatgg

SEQ ID NO: 286105 - DNA, 20 bp, Artificial Sequence
  chemically synthesized
caggtgtgtgccaccatgcc

SEQ ID NO: 286106 - DNA, 20 bp, Artificial Sequence
  chemically synthesized
gtggcacacacctgtacttc

SEQ ID NO: 286107 - DNA, 20 bp, Artificial Sequence
  chemically synthesized
ccacaagtagctagaagtac

SEQ ID NO: 286108 - DNA, 20 bp, Artificial Sequence
  chemically synthesized
cccacaagtagctagaagta

SEQ ID NO: 286109 - DNA, 20 bp, Artificial Sequence
  chemically synthesized
cagtccccacaagtagctag

SEQ ID NO: 286110 - DNA, 20 bp, Artificial Sequence
  chemically synthesized
tctcagtccccacaagtagc

SEQ ID NO: 286111 - DNA, 20 bp, Artificial Sequence
  chemically synthesized
cctgtacttctagctacttg

SEQ ID NO: 286112 - DNA, 20 bp, Artificial Sequence
  chemically synthesized
ctgtacttctagctacttgt

SEQ ID NO: 286113 - DNA, 20 bp, Artificial Sequence
  chemically synthesized
tgtacttctagctacttgtg

SEQ ID NO: 286114 - DNA, 20 bp, Artificial Sequence
  chemically synthesized
cccatctcagtccccacaag

SEQ ID NO: 286115 - DNA, 20 bp, Artificial Sequence
  chemically synthesized
tctcccatctcagtccccac

SEQ ID NO: 286116 - DNA, 20 bp, Artificial Sequence
  chemically synthesized
tctagctacttgtggggact

SEQ ID NO: 286117 - DNA, 20 bp, Artificial Sequence
  chemically synthesized
gctacttgtggggactgaga

SEQ ID NO: 286118 - DNA, 20 bp, Artificial Sequence
  chemically synthesized
ctacttgtggggactgagat

SEQ ID NO: 286119 - DNA, 20 bp, Artificial Sequence
  chemically synthesized
acttgtggggactgagatgg

SEQ ID NO: 286120 - DNA, 20 bp, Artificial Sequence
  chemically synthesized
ctcaagcaattctcccatct

SEQ ID NO: 286121 - DNA, 20 bp, Artificial Sequence
  chemically synthesized
ctgagatgggagaattgctt

SEQ ID NO: 286122 - DNA, 20 bp, Artificial Sequence
  chemically synthesized
atgggagaattgcttgagcc

SEQ ID NO: 286123 - DNA, 20 bp, Artificial Sequence
  chemically synthesized
tgggagaattgcttgagccc

SEQ ID NO: 286124 - DNA, 20 bp, Artificial Sequence
  chemically synthesized
agcctcaacctcctgggctc

SEQ ID NO: 286125 - DNA, 20 bp, Artificial Sequence
  chemically synthesized
ggagaattgcttgagcccag

SEQ ID NO: 286126 - DNA, 20 bp, Artificial Sequence
  chemically synthesized
gagaattgcttgagcccagg

SEQ ID NO: 286127 - DNA, 20 bp, Artificial Sequence
  chemically synthesized
cactgcagcctcaacctcct

SEQ ID NO: 286128 - DNA, 20 bp, Artificial Sequence
  chemically synthesized
ttgcttgagcccaggaggtt

SEQ ID NO: 286129 - DNA, 20 bp, Artificial Sequence
  chemically synthesized
tcactgcagcctcaacctcc

SEQ ID NO: 286130 - DNA, 20 bp, Artificial Sequence
  chemically synthesized
tgcttgagcccaggaggttg

SEQ ID NO: 286131 - DNA, 20 bp, Artificial Sequence
  chemically synthesized
agcccaggaggttgaggctg

SEQ ID NO: 286132 - DNA, 20 bp, Artificial Sequence
  chemically synthesized
caggaggttgaggctgcagt

SEQ ID NO: 286133 - DNA, 20 bp, Artificial Sequence
  chemically synthesized
ggtgtgaactcggctcactg

SEQ ID NO: 286134 - DNA, 20 bp, Artificial Sequence
  chemically synthesized
ggttgaggctgcagtgagcc

SEQ ID NO: 286135 - DNA, 20 bp, Artificial Sequence
  chemically synthesized
ggagtgcagtggtgtgaact

SEQ ID NO: 286136 - DNA, 20 bp, Artificial Sequence
  chemically synthesized
tcacccaggctggagtgcag

SEQ ID NO: 286137 - DNA, 20 bp, Artificial Sequence
  chemically synthesized
gagttcacaccactgcactc

SEQ ID NO: 286138 - DNA, 20 bp, Artificial Sequence
  chemically synthesized
ctgtcacccaggctggagtg

SEQ ID NO: 286139 - DNA, 20 bp, Artificial Sequence
  chemically synthesized
cacaccactgcactccagcc

SEQ ID NO: 286140 - DNA, 20 bp, Artificial Sequence
  chemically synthesized
acaccactgcactccagcct

SEQ ID NO: 286141 - DNA, 20 bp, Artificial Sequence
  chemically synthesized
tccctctgtcacccaggctg

SEQ ID NO: 286142 - DNA, 20 bp, Artificial Sequence
  chemically synthesized
tctccctctgtcacccaggc

SEQ ID NO: 286143 - DNA, 20 bp, Artificial Sequence
  chemically synthesized
ctgcactccagcctgggtga

SEQ ID NO: 286144 - DNA, 20 bp, Artificial Sequence
  chemically synthesized
agggtctccctctgtcaccc

SEQ ID NO: 286145 - DNA, 20 bp, Artificial Sequence
  chemically synthesized
gcactccagcctgggtgaca

SEQ ID NO: 286146 - DNA, 20 bp, Artificial Sequence
  chemically synthesized
cagggtctccctctgtcacc

SEQ ID NO: 286147 - DNA, 20 bp, Artificial Sequence
  chemically synthesized
cactccagcctgggtgacag

SEQ ID NO: 286148 - DNA, 20 bp, Artificial Sequence
  chemically synthesized
actccagcctgggtgacaga

SEQ ID NO: 286149 - DNA, 20 bp, Artificial Sequence
  chemically synthesized
tccagcctgggtgacagagg

SEQ ID NO: 286150 - DNA, 20 bp, Artificial Sequence
  chemically synthesized
ttattttattttttgggaca

SEQ ID NO: 286151 - DNA, 20 bp, Artificial Sequence
  chemically synthesized
tttattttattttttgggac

SEQ ID NO: 286152 - DNA, 20 bp, Artificial Sequence
  chemically synthesized
atttattttattttttggga

SEQ ID NO: 286153 - DNA, 20 bp, Artificial Sequence
  chemically synthesized
atttatttattttatttttt

SEQ ID NO: 286154 - DNA, 20 bp, Artificial Sequence
  chemically synthesized
tatttatttattttattttt

SEQ ID NO: 286155 - DNA, 20 bp, Artificial Sequence
  chemically synthesized
aataaataataaatgtgtcg

SEQ ID NO: 286156 - DNA, 20 bp, Artificial Sequence
  chemically synthesized
taaataataaatgtgtcgaa

SEQ ID NO: 286157 - DNA, 20 bp, Artificial Sequence
  chemically synthesized
aaataataaatgtgtcgaag

SEQ ID NO: 286158 - DNA, 20 bp, Artificial Sequence
  chemically synthesized
tgtgtcgaagaggccaaact

SEQ ID NO: 286159 - DNA, 20 bp, Artificial Sequence
  chemically synthesized
tcgattaacatttccaagtt

SEQ ID NO: 286160 - DNA, 20 bp, Artificial Sequence
  chemically synthesized
aactttcgattaacatttcc

SEQ ID NO: 286161 - DNA, 20 bp, Artificial Sequence
  chemically synthesized
aacttggaaatgttaatcga

SEQ ID NO: 286162 - DNA, 20 bp, Artificial Sequence
  chemically synthesized
atatatgtgtatgtagaaat

SEQ ID NO: 286163 - DNA, 20 bp, Artificial Sequence
  chemically synthesized
aatatatgtgtatgtagaaa

SEQ ID NO: 286164 - DNA, 20 bp, Artificial Sequence
  chemically synthesized
atggctaatatatgtgtatg

SEQ ID NO: 286165 - DNA, 20 bp, Artificial Sequence
  chemically synthesized
atttctacatacacatatat

SEQ ID NO: 286166 - DNA, 20 bp, Artificial Sequence
  chemically synthesized
ttggtacaaaataaaatgca

SEQ ID NO: 286167 - DNA, 20 bp, Artificial Sequence
  chemically synthesized
atttgttacacggagatatt

SEQ ID NO: 286168 - DNA, 20 bp, Artificial Sequence
  chemically synthesized
taagaaaaatttgttacacg

SEQ ID NO: 286169 - DNA, 20 bp, Artificial Sequence
  chemically synthesized
attaagaaaaatttgttaca

SEQ ID NO: 286170 - DNA, 20 bp, Artificial Sequence
  chemically synthesized
tgtataataataatgggatt

SEQ ID NO: 286171 - DNA, 20 bp, Artificial Sequence
  chemically synthesized
cataaatgtataataataat

SEQ ID NO: 286172 - DNA, 20 bp, Artificial Sequence
  chemically synthesized
acataaatgtataataataa

SEQ ID NO: 286173 - DNA, 20 bp, Artificial Sequence
  chemically synthesized
tattatacatttatgttctg

SEQ ID NO: 286174 - DNA, 20 bp, Artificial Sequence
  chemically synthesized
tttccaatccatgttttctt

SEQ ID NO: 286175 - DNA, 20 bp, Artificial Sequence
  chemically synthesized
tttatgttctgaagaaaaca

SEQ ID NO: 286176 - DNA, 20 bp, Artificial Sequence
  chemically synthesized
gttctgaagaaaacatggat

SEQ ID NO: 286177 - DNA, 20 bp, Artificial Sequence
  chemically synthesized
atggattggaaataatgact

SEQ ID NO: 286178 - DNA, 20 bp, Artificial Sequence
  chemically synthesized
ttggaaataatgactaagaa

SEQ ID NO: 286179 - DNA, 20 bp, Artificial Sequence
  chemically synthesized
tggaaataatgactaagaat

SEQ ID NO: 286180 - DNA, 20 bp, Artificial Sequence
  chemically synthesized
aaaaaatgaaatcctattct

SEQ ID NO: 286181 - DNA, 20 bp, Artificial Sequence
  chemically synthesized
aagaataggatttcattttt

SEQ ID NO: 286182 - DNA, 20 bp, Artificial Sequence
  chemically synthesized
gatttcattttttagtatga

SEQ ID NO: 286183 - DNA, 20 bp, Artificial Sequence
  chemically synthesized
ttagtatgacagttgtgttc

SEQ ID NO: 286184 - DNA, 20 bp, Artificial Sequence
  chemically synthesized
tatgacagttgtgttcaaga

SEQ ID NO: 286185 - DNA, 20 bp, Artificial Sequence
  chemically synthesized
tgtgttcaagaaagtcattt

SEQ ID NO: 286186 - DNA, 20 bp, Artificial Sequence
  chemically synthesized
gtgttcaagaaagtcatttt

SEQ ID NO: 286187 - DNA, 20 bp, Artificial Sequence
  chemically synthesized
agtcattttaggatcaaaat

SEQ ID NO: 286188 - DNA, 20 bp, Artificial Sequence
  chemically synthesized
ttcatggtatatattttaaa

SEQ ID NO: 286189 - DNA, 20 bp, Artificial Sequence
  chemically synthesized
agcatatctaaatattttca

SEQ ID NO: 286190 - DNA, 20 bp, Artificial Sequence
  chemically synthesized
atatataccatgaaaatatt

SEQ ID NO: 286191 - DNA, 20 bp, Artificial Sequence
  chemically synthesized
atgaaaatatttagatatgc

SEQ ID NO: 286192 - DNA, 20 bp, Artificial Sequence
  chemically synthesized
tatttagatatgctagaaaa

SEQ ID NO: 286193 - DNA, 20 bp, Artificial Sequence
  chemically synthesized
tgacaaattaatcttttttc

SEQ ID NO: 286194 - DNA, 20 bp, Artificial Sequence
  chemically synthesized
tagaaaaaagattaatttgt

SEQ ID NO: 286195 - DNA, 20 bp, Artificial Sequence
  chemically synthesized
tcagaattaattgtgcttta

SEQ ID NO: 286196 - DNA, 20 bp, Artificial Sequence
  chemically synthesized
gttcctatgtttttgcttta

SEQ ID NO: 286197 - DNA, 20 bp, Artificial Sequence
  chemically synthesized
tgtgctttaaagcaaaaaca

SEQ ID NO: 286198 - DNA, 20 bp, Artificial Sequence
  chemically synthesized
gtgctttaaagcaaaaacat

SEQ ID NO: 286199 - DNA, 20 bp, Artificial Sequence
  chemically synthesized
aaagcaaaaacataggaaca

SEQ ID NO: 286200 - DNA, 20 bp, Artificial Sequence
  chemically synthesized
aggaacaaagccttaaccaa

SEQ ID NO: 286201 - DNA, 20 bp, Artificial Sequence
  chemically synthesized
ttcaccgttacttttggtta

SEQ ID NO: 286202 - DNA, 20 bp, Artificial Sequence
  chemically synthesized
cttcaccgttacttttggtt

SEQ ID NO: 286203 - DNA, 20 bp, Artificial Sequence
  chemically synthesized
aaagccttaaccaaaagtaa

SEQ ID NO: 286204 - DNA, 20 bp, Artificial Sequence
  chemically synthesized
tctcccttcaccgttacttt

SEQ ID NO: 286205 - DNA, 20 bp, Artificial Sequence
  chemically synthesized
cttaaccaaaagtaacggtg

SEQ ID NO: 286206 - DNA, 20 bp, Artificial Sequence
  chemically synthesized
ttaaccaaaagtaacggtga

SEQ ID NO: 286207 - DNA, 20 bp, Artificial Sequence
  chemically synthesized
taaccaaaagtaacggtgaa

SEQ ID NO: 286208 - DNA, 20 bp, Artificial Sequence
  chemically synthesized
accaaaagtaacggtgaagg

SEQ ID NO: 286209 - DNA, 20 bp, Artificial Sequence
  chemically synthesized
gtaacggtgaagggagacat

SEQ ID NO: 286210 - DNA, 20 bp, Artificial Sequence
  chemically synthesized
taacggtgaagggagacatt

SEQ ID NO: 286211 - DNA, 20 bp, Artificial Sequence
  chemically synthesized
agggagacattaggaaatct

SEQ ID NO: 286212 - DNA, 20 bp, Artificial Sequence
  chemically synthesized
gacattaggaaatcttagtt

SEQ ID NO: 286213 - DNA, 20 bp, Artificial Sequence
  chemically synthesized
ttgcctcaacgtacttaact

SEQ ID NO: 286214 - DNA, 20 bp, Artificial Sequence
  chemically synthesized
aaatcttagttaagtacgtt

SEQ ID NO: 286215 - DNA, 20 bp, Artificial Sequence
  chemically synthesized
aatcttagttaagtacgttg

SEQ ID NO: 286216 - DNA, 20 bp, Artificial Sequence
  chemically synthesized
ttagttaagtacgttgaggc

SEQ ID NO: 286217 - DNA, 20 bp, Artificial Sequence
  chemically synthesized
aagtacgttgaggcaagcca

SEQ ID NO: 286218 - DNA, 20 bp, Artificial Sequence
  chemically synthesized
gttgaggcaagccacagtga

SEQ ID NO: 286219 - DNA, 20 bp, Artificial Sequence
  chemically synthesized
atagacaatctctttcactg

SEQ ID NO: 286220 - DNA, 20 bp, Artificial Sequence
  chemically synthesized
tgaggcaagccacagtgaaa

SEQ ID NO: 286221 - DNA, 20 bp, Artificial Sequence
  chemically synthesized
aagagattgtctatacctgt

SEQ ID NO: 286222 - DNA, 20 bp, Artificial Sequence
  chemically synthesized
atcacatgtgccaacaggta

SEQ ID NO: 286223 - DNA, 20 bp, Artificial Sequence
  chemically synthesized
gtgggatcacatgtgccaac

SEQ ID NO: 286224 - DNA, 20 bp, Artificial Sequence
  chemically synthesized
agtgggatcacatgtgccaa

SEQ ID NO: 286225 - DNA, 20 bp, Artificial Sequence
  chemically synthesized
ttggcacatgtgatcccact

SEQ ID NO: 286226 - DNA, 20 bp, Artificial Sequence
  chemically synthesized
caaagaacttaacactcagt

SEQ ID NO: 286227 - DNA, 20 bp, Artificial Sequence
  chemically synthesized
tcaaagaacttaacactcag

SEQ ID NO: 286228 - DNA, 20 bp, Artificial Sequence
  chemically synthesized
atgtgatcccactgagtgtt

SEQ ID NO: 286229 - DNA, 20 bp, Artificial Sequence
  chemically synthesized
aactcaaagaacttaacact

SEQ ID NO: 286230 - DNA, 20 bp, Artificial Sequence
  chemically synthesized
cactgagtgttaagttcttt

SEQ ID NO: 286231 - DNA, 20 bp, Artificial Sequence
  chemically synthesized
gagacttgagacagaactca

SEQ ID NO: 286232 - DNA, 20 bp, Artificial Sequence
  chemically synthesized
agttctttgagttctgtctc

SEQ ID NO: 286233 - DNA, 20 bp, Artificial Sequence
  chemically synthesized
gtttgcttcgagacttgaga

SEQ ID NO: 286234 - DNA, 20 bp, Artificial Sequence
  chemically synthesized
cagagtttgcttcgagactt

SEQ ID NO: 286235 - DNA, 20 bp, Artificial Sequence
  chemically synthesized
gagttctgtctcaagtctcg

SEQ ID NO: 286236 - DNA, 20 bp, Artificial Sequence
  chemically synthesized
gcagagccagagtttgcttc

SEQ ID NO: 286237 - DNA, 20 bp, Artificial Sequence
  chemically synthesized
tcaagtctcgaagcaaactc

SEQ ID NO: 286238 - DNA, 20 bp, Artificial Sequence
  chemically synthesized
taaagaatgaagcagagcca

SEQ ID NO: 286239 - DNA, 20 bp, Artificial Sequence
  chemically synthesized
gataaagaatgaagcagagc

SEQ ID NO: 286240 - DNA, 20 bp, Artificial Sequence
  chemically synthesized
agaagataaagaatgaagca

SEQ ID NO: 286241 - DNA, 20 bp, Artificial Sequence
  chemically synthesized
gcagaagataaagaatgaag

SEQ ID NO: 286242 - DNA, 20 bp, Artificial Sequence
  chemically synthesized
tgggcagaagataaagaatg

SEQ ID NO: 286243 - DNA, 20 bp, Artificial Sequence
  chemically synthesized
atgaaggtgggcagaagata

SEQ ID NO: 286244 - DNA, 20 bp, Artificial Sequence
  chemically synthesized
gtgtcaatgaaggtgggcag

SEQ ID NO: 286245 - DNA, 20 bp, Artificial Sequence
  chemically synthesized
acagtgtcaatgaaggtggg

SEQ ID NO: 286246 - DNA, 20 bp, Artificial Sequence
  chemically synthesized
taaacagtgtcaatgaaggt

SEQ ID NO: 286247 - DNA, 20 bp, Artificial Sequence
  chemically synthesized
ctaaacagtgtcaatgaagg

SEQ ID NO: 286248 - DNA, 20 bp, Artificial Sequence
  chemically synthesized
agtctaaacagtgtcaatga

SEQ ID NO: 286249 - DNA, 20 bp, Artificial Sequence
  chemically synthesized
cagtctaaacagtgtcaatg

SEQ ID NO: 286250 - DNA, 20 bp, Artificial Sequence
  chemically synthesized
ccaccttcattgacactgtt

SEQ ID NO: 286251 - DNA, 20 bp, Artificial Sequence
  chemically synthesized
ttcattgacactgtttagac

SEQ ID NO: 286252 - DNA, 20 bp, Artificial Sequence
  chemically synthesized
acaattcagcccagtctaaa

SEQ ID NO: 286253 - DNA, 20 bp, Artificial Sequence
  chemically synthesized
tcattgacactgtttagact

SEQ ID NO: 286254 - DNA, 20 bp, Artificial Sequence
  chemically synthesized
gatattcagacaattcagcc

SEQ ID NO: 286255 - DNA, 20 bp, Artificial Sequence
  chemically synthesized
tcagtgatattcagacaatt

SEQ ID NO: 286256 - DNA, 20 bp, Artificial Sequence
  chemically synthesized
agcttttagtcagtgatatt

SEQ ID NO: 286257 - DNA, 20 bp, Artificial Sequence
  chemically synthesized
gtctgaatatcactgactaa

SEQ ID NO: 286258 - DNA, 20 bp, Artificial Sequence
  chemically synthesized
ttattttcttagcttttagt

SEQ ID NO: 286259 - DNA, 20 bp, Artificial Sequence
  chemically synthesized
aatatcactgactaaaagct

SEQ ID NO: 286260 - DNA, 20 bp, Artificial Sequence
  chemically synthesized
tgatttattttcttagcttt

SEQ ID NO: 286261 - DNA, 20 bp, Artificial Sequence
  chemically synthesized
cttaaattgatttattttct

SEQ ID NO: 286262 - DNA, 20 bp, Artificial Sequence
  chemically synthesized
ctaagaaaataaatcaattt

SEQ ID NO: 286263 - DNA, 20 bp, Artificial Sequence
  chemically synthesized
gaaaataaatcaatttaagc

SEQ ID NO: 286264 - DNA, 20 bp, Artificial Sequence
  chemically synthesized
tggcagtaatttttttcagc

SEQ ID NO: 286265 - DNA, 20 bp, Artificial Sequence
  chemically synthesized
tatgtggcagtaattttttt

SEQ ID NO: 286266 - DNA, 20 bp, Artificial Sequence
  chemically synthesized
gtttcatatctaatatgtgg

SEQ ID NO: 286267 - DNA, 20 bp, Artificial Sequence
  chemically synthesized
aaaaaattactgccacatat

SEQ ID NO: 286268 - DNA, 20 bp, Artificial Sequence
  chemically synthesized
tatgtttcatatctaatatg

SEQ ID NO: 286269 - DNA, 20 bp, Artificial Sequence
  chemically synthesized
cacatattagatatgaaaca

SEQ ID NO: 286270 - DNA, 20 bp, Artificial Sequence
  chemically synthesized
tattagatatgaaacatagc

SEQ ID NO: 286271 - DNA, 20 bp, Artificial Sequence
  chemically synthesized
agtcccaattttacattttc

SEQ ID NO: 286272 - DNA, 20 bp, Artificial Sequence
  chemically synthesized
atagctagaaaatgtaaaat

SEQ ID NO: 286273 - DNA, 20 bp, Artificial Sequence
  chemically synthesized
tagctagaaaatgtaaaatt

SEQ ID NO: 286274 - DNA, 20 bp, Artificial Sequence
  chemically synthesized
aaatgtaaaattgggactga

SEQ ID NO: 286275 - DNA, 20 bp, Artificial Sequence
  chemically synthesized
aaatccatatgcaatgccat

SEQ ID NO: 286276 - DNA, 20 bp, Artificial Sequence
  chemically synthesized
gggactgatggcattgcata

SEQ ID NO: 286277 - DNA, 20 bp, Artificial Sequence
  chemically synthesized
ctctgtatctcagattttaa

SEQ ID NO: 286278 - DNA, 20 bp, Artificial Sequence
  chemically synthesized
atttttgtcttttaaaatct

SEQ ID NO: 286279 - DNA, 20 bp, Artificial Sequence
  chemically synthesized
gtcttttaaaatctgagata

SEQ ID NO: 286280 - DNA, 20 bp, Artificial Sequence
  chemically synthesized
cttttaaaatctgagataca

SEQ ID NO: 286281 - DNA, 20 bp, Artificial Sequence
  chemically synthesized
atatcaatatctctgtatct

SEQ ID NO: 286282 - DNA, 20 bp, Artificial Sequence
  chemically synthesized
gagatacagagatattgata

SEQ ID NO: 286283 - DNA, 20 bp, Artificial Sequence
  chemically synthesized
tgatatagatgactgcctaa

SEQ ID NO: 286284 - DNA, 20 bp, Artificial Sequence
  chemically synthesized
atttttgcaagactgttagg

SEQ ID NO: 286285 - DNA, 20 bp, Artificial Sequence
  chemically synthesized
aacatttttgcaagactgtt

SEQ ID NO: 286286 - DNA, 20 bp, Artificial Sequence
  chemically synthesized
gaacatttttgcaagactgt

SEQ ID NO: 286287 - DNA, 20 bp, Artificial Sequence
  chemically synthesized
taaccattgaacatttttgc

SEQ ID NO: 286288 - DNA, 20 bp, Artificial Sequence
  chemically synthesized
agtcttgcaaaaatgttcaa

SEQ ID NO: 286289 - DNA, 20 bp, Artificial Sequence
  chemically synthesized
aaaatgttcaatggttatta

SEQ ID NO: 286290 - DNA, 20 bp, Artificial Sequence
  chemically synthesized
tggttattatggcatgaatc

SEQ ID NO: 286291 - DNA, 20 bp, Artificial Sequence
  chemically synthesized
ttattatggcatgaatccag

SEQ ID NO: 286292 - DNA, 20 bp, Artificial Sequence
  chemically synthesized
tattatggcatgaatccagt

SEQ ID NO: 286293 - DNA, 20 bp, Artificial Sequence
  chemically synthesized
attatggcatgaatccagtg

SEQ ID NO: 286294 - DNA, 20 bp, Artificial Sequence
  chemically synthesized
gaatacaaataattccccac

SEQ ID NO: 286295 - DNA, 20 bp, Artificial Sequence
  chemically synthesized
tatttgtattctacttatat

SEQ ID NO: 286296 - DNA, 20 bp, Artificial Sequence
  chemically synthesized
ccttttgtttctgatataag

SEQ ID NO: 286297 - DNA, 20 bp, Artificial Sequence
  chemically synthesized
tttccttttgtttctgatat

SEQ ID NO: 286298 - DNA, 20 bp, Artificial Sequence
  chemically synthesized
tctacttatatcagaaacaa

SEQ ID NO: 286299 - DNA, 20 bp, Artificial Sequence
  chemically synthesized
ctacttatatcagaaacaaa

SEQ ID NO: 286300 - DNA, 20 bp, Artificial Sequence
  chemically synthesized
ggaaataaatttaatatttc

SEQ ID NO: 286301 - DNA, 20 bp, Artificial Sequence
  chemically synthesized
ataaatttaatatttctggt

SEQ ID NO: 286302 - DNA, 20 bp, Artificial Sequence
  chemically synthesized
ttttcacacatttttctaac

SEQ ID NO: 286303 - DNA, 20 bp, Artificial Sequence
  chemically synthesized
agaaaaatgtgtgaaaatga

SEQ ID NO: 286304 - DNA, 20 bp, Artificial Sequence
  chemically synthesized
gaaaaatgtgtgaaaatgat

SEQ ID NO: 286305 - DNA, 20 bp, Artificial Sequence
  chemically synthesized
aacaaagataataaagtatg

SEQ ID NO: 286306 - DNA, 20 bp, Artificial Sequence
  chemically synthesized
aaatactaacaaagataata

SEQ ID NO: 286307 - DNA, 20 bp, Artificial Sequence
  chemically synthesized
tcatactttattatctttgt

SEQ ID NO: 286308 - DNA, 20 bp, Artificial Sequence
  chemically synthesized
tgaaaatgaaaatactaaca

SEQ ID NO: 286309 - DNA, 20 bp, Artificial Sequence
  chemically synthesized
agtattttcattttcaaaca

SEQ ID NO: 286310 - DNA, 20 bp, Artificial Sequence
  chemically synthesized
gtattttcattttcaaacac

SEQ ID NO: 286311 - DNA, 20 bp, Artificial Sequence
  chemically synthesized
ttttcaaacacaggatactg

SEQ ID NO: 286312 - DNA, 20 bp, Artificial Sequence
  chemically synthesized
tacactgtaaacaatttctg

SEQ ID NO: 286313 - DNA, 20 bp, Artificial Sequence
  chemically synthesized
gatactgcagaaattgttta

SEQ ID NO: 286314 - DNA, 20 bp, Artificial Sequence
  chemically synthesized
agaaattgtttacagtgtaa

SEQ ID NO: 286315 - DNA, 20 bp, Artificial Sequence
  chemically synthesized
gaaattgtttacagtgtaat

SEQ ID NO: 286316 - DNA, 20 bp, Artificial Sequence
  chemically synthesized
tttacagtgtaatgggtgtg

SEQ ID NO: 286317 - DNA, 20 bp, Artificial Sequence
  chemically synthesized
ttacagtgtaatgggtgtga

SEQ ID NO: 286318 - DNA, 20 bp, Artificial Sequence
  chemically synthesized
tgggtgtgaaggttatttgt

SEQ ID NO: 286319 - DNA, 20 bp, Artificial Sequence
  chemically synthesized
gggtgtgaaggttatttgtg

SEQ ID NO: 286320 - DNA, 20 bp, Artificial Sequence
  chemically synthesized
tgtgaaggttatttgtgagg

SEQ ID NO: 286321 - DNA, 20 bp, Artificial Sequence
  chemically synthesized
gtgaggtggatttgcttttt

SEQ ID NO: 286322 - DNA, 20 bp, Artificial Sequence
  chemically synthesized
ttttacaatacaagctaaaa

SEQ ID NO: 286323 - DNA, 20 bp, Artificial Sequence
  chemically synthesized
aggaaatttttttacaatac

SEQ ID NO: 286324 - DNA, 20 bp, Artificial Sequence
  chemically synthesized
attgtaaaaaaatttcctta

SEQ ID NO: 286325 - DNA, 20 bp, Artificial Sequence
  chemically synthesized
tgtaaaaaaatttccttaaa

SEQ ID NO: 286326 - DNA, 20 bp, Artificial Sequence
  chemically synthesized
gaaaacaatcttgctcttta

SEQ ID NO: 286327 - DNA, 20 bp, Artificial Sequence
  chemically synthesized
aaaaaatttccttaaagagc

SEQ ID NO: 286328 - DNA, 20 bp, Artificial Sequence
  chemically synthesized
agaaaacaatcttgctcttt

SEQ ID NO: 286329 - DNA, 20 bp, Artificial Sequence
  chemically synthesized
taccattgtcatgcagcagg

SEQ ID NO: 286330 - DNA, 20 bp, Artificial Sequence
  chemically synthesized
ttataccattgtcatgcagc

SEQ ID NO: 286331 - DNA, 20 bp, Artificial Sequence
  chemically synthesized
attataccattgtcatgcag

SEQ ID NO: 286332 - DNA, 20 bp, Artificial Sequence
  chemically synthesized
ttcattataccattgtcatg

SEQ ID NO: 286333 - DNA, 20 bp, Artificial Sequence
  chemically synthesized
ttcttcctgctgcatgacaa

SEQ ID NO: 286334 - DNA, 20 bp, Artificial Sequence
  chemically synthesized
cactgtactataatataaca

SEQ ID NO: 286335 - DNA, 20 bp, Artificial Sequence
  chemically synthesized
atgcatactgtgttatatta

SEQ ID NO: 286336 - DNA, 20 bp, Artificial Sequence
  chemically synthesized
tactgtgttatattatagta

SEQ ID NO: 286337 - DNA, 20 bp, Artificial Sequence
  chemically synthesized
tattatagtacagtgcatta

SEQ ID NO: 286338 - DNA, 20 bp, Artificial Sequence
  chemically synthesized
agtacagtgcattatagatg

SEQ ID NO: 286339 - DNA, 20 bp, Artificial Sequence
  chemically synthesized
tacagtgcattatagatgaa

SEQ ID NO: 286340 - DNA, 20 bp, Artificial Sequence
  chemically synthesized
tatagatgaagagaacaaca

SEQ ID NO: 286341 - DNA, 20 bp, Artificial Sequence
  chemically synthesized
agagaacaacacagtatgaa

SEQ ID NO: 286342 - DNA, 20 bp, Artificial Sequence
  chemically synthesized
tatgaatagtaatttatcat

SEQ ID NO: 286343 - DNA, 20 bp, Artificial Sequence
  chemically synthesized
aatttatcataagaaataac

SEQ ID NO: 286344 - DNA, 20 bp, Artificial Sequence
  chemically synthesized
ttatcataagaaataacaag

SEQ ID NO: 286345 - DNA, 20 bp, Artificial Sequence
  chemically synthesized
aagaaataacaagtagctca

SEQ ID NO: 286346 - DNA, 20 bp, Artificial Sequence
  chemically synthesized
agaaataacaagtagctcaa

SEQ ID NO: 286347 - DNA, 20 bp, Artificial Sequence
  chemically synthesized
ttaaaggtaaagaatccttt

SEQ ID NO: 286348 - DNA, 20 bp, Artificial Sequence
  chemically synthesized
tgcagtataatttaaaggta

SEQ ID NO: 286349 - DNA, 20 bp, Artificial Sequence
  chemically synthesized
taaaatgcagtataatttaa

SEQ ID NO: 286350 - DNA, 20 bp, Artificial Sequence
  chemically synthesized
ataaaatgcagtataattta

SEQ ID NO: 286351 - DNA, 20 bp, Artificial Sequence
  chemically synthesized
ttaaattatactgcatttta

SEQ ID NO: 286352 - DNA, 20 bp, Artificial Sequence
  chemically synthesized
cattattttactataaaatg

SEQ ID NO: 286353 - DNA, 20 bp, Artificial Sequence
  chemically synthesized
gtaaaataatgttatcaaat

SEQ ID NO: 286354 - DNA, 20 bp, Artificial Sequence
  chemically synthesized
taaaataatgttatcaaatg

SEQ ID NO: 286355 - DNA, 20 bp, Artificial Sequence
  chemically synthesized
taatgttatcaaatgaggtt

SEQ ID NO: 286356 - DNA, 20 bp, Artificial Sequence
  chemically synthesized
tatcaaatgaggttgagtac

SEQ ID NO: 286357 - DNA, 20 bp, Artificial Sequence
  chemically synthesized
atcaaatgaggttgagtaca

SEQ ID NO: 286358 - DNA, 20 bp, Artificial Sequence
  chemically synthesized
agtacaaggcaatgttttgt

SEQ ID NO: 286359 - DNA, 20 bp, Artificial Sequence
  chemically synthesized
aaccctgggttgagtaaatg

SEQ ID NO: 286360 - DNA, 20 bp, Artificial Sequence
  chemically synthesized
aaaccctgggttgagtaaat

SEQ ID NO: 286361 - DNA, 20 bp, Artificial Sequence
  chemically synthesized
agttcctcatttactcaacc

SEQ ID NO: 286362 - DNA, 20 bp, Artificial Sequence
  chemically synthesized
gttcctcatttactcaaccc

SEQ ID NO: 286363 - DNA, 20 bp, Artificial Sequence
  chemically synthesized
ttcctcatttactcaaccca

SEQ ID NO: 286364 - DNA, 20 bp, Artificial Sequence
  chemically synthesized
atgttgagaaaccctgggtt

SEQ ID NO: 286365 - DNA, 20 bp, Artificial Sequence
  chemically synthesized
tgccaatgttgagaaaccct

SEQ ID NO: 286366 - DNA, 20 bp, Artificial Sequence
  chemically synthesized
gtgccaatgttgagaaaccc

SEQ ID NO: 286367 - DNA, 20 bp, Artificial Sequence
  chemically synthesized
aacccagggtttctcaacat

SEQ ID NO: 286368 - DNA, 20 bp, Artificial Sequence
  chemically synthesized
atgtcactagtgccaatgtt

SEQ ID NO: 286369 - DNA, 20 bp, Artificial Sequence
  chemically synthesized
gggtttctcaacattggcac

SEQ ID NO: 286370 - DNA, 20 bp, Artificial Sequence
  chemically synthesized
tgcacaatctaaaatgtcac

SEQ ID NO: 286371 - DNA, 20 bp, Artificial Sequence
  chemically synthesized
cattggcactagtgacattt

SEQ ID NO: 286372 - DNA, 20 bp, Artificial Sequence
  chemically synthesized
tagtgacattttagattgtg

SEQ ID NO: 286373 - DNA, 20 bp, Artificial Sequence
  chemically synthesized
gattgtgcagttccttgttc

SEQ ID NO: 286374 - DNA, 20 bp, Artificial Sequence
  chemically synthesized
ttgtgcagttccttgttctg

SEQ ID NO: 286375 - DNA, 20 bp, Artificial Sequence
  chemically synthesized
tagaacattcctccagaaca

SEQ ID NO: 286376 - DNA, 20 bp, Artificial Sequence
  chemically synthesized
tgtgcagttccttgttctgg

SEQ ID NO: 286377 - DNA, 20 bp, Artificial Sequence
  chemically synthesized
atagaacattcctccagaac

SEQ ID NO: 286378 - DNA, 20 bp, Artificial Sequence
  chemically synthesized
cagtccatagaacattcctc

SEQ ID NO: 286379 - DNA, 20 bp, Artificial Sequence
  chemically synthesized
tgttctggaggaatgttcta

SEQ ID NO: 286380 - DNA, 20 bp, Artificial Sequence
  chemically synthesized
gctaaatatcgtacagtcca

SEQ ID NO: 286381 - DNA, 20 bp, Artificial Sequence
  chemically synthesized
agatgctgctaaatatcgta

SEQ ID NO: 286382 - DNA, 20 bp, Artificial Sequence
  chemically synthesized
tctatggactgtacgatatt

SEQ ID NO: 286383 - DNA, 20 bp, Artificial Sequence
  chemically synthesized
atggactgtacgatatttag

SEQ ID NO: 286384 - DNA, 20 bp, Artificial Sequence
  chemically synthesized
tgtctaataggtagaggaga

SEQ ID NO: 286385 - DNA, 20 bp, Artificial Sequence
  chemically synthesized
ggtgtctaataggtagagga

SEQ ID NO: 286386 - DNA, 20 bp, Artificial Sequence
  chemically synthesized
ctggtgtctaataggtagag

SEQ ID NO: 286387 - DNA, 20 bp, Artificial Sequence
  chemically synthesized
tactggtgtctaataggtag

SEQ ID NO: 286388 - DNA, 20 bp, Artificial Sequence
  chemically synthesized
catctctctcctctacctat

SEQ ID NO: 286389 - DNA, 20 bp, Artificial Sequence
  chemically synthesized
ctactggtgtctaataggta

SEQ ID NO: 286390 - DNA, 20 bp, Artificial Sequence
  chemically synthesized
tgctactggtgtctaatagg

SEQ ID NO: 286391 - DNA, 20 bp, Artificial Sequence
  chemically synthesized
agatgctactggtgtctaat

SEQ ID NO: 286392 - DNA, 20 bp, Artificial Sequence
  chemically synthesized
tagatgctactggtgtctaa

SEQ ID NO: 286393 - DNA, 20 bp, Artificial Sequence
  chemically synthesized
ctcctctacctattagacac

SEQ ID NO: 286394 - DNA, 20 bp, Artificial Sequence
  chemically synthesized
ctctacctattagacaccag

SEQ ID NO: 286395 - DNA, 20 bp, Artificial Sequence
  chemically synthesized
gggtggtggttagatgctac

SEQ ID NO: 286396 - DNA, 20 bp, Artificial Sequence
  chemically synthesized
gctgggttgggggtggtggt

SEQ ID NO: 286397 - DNA, 20 bp, Artificial Sequence
  chemically synthesized
cacagctgggttgggggtgg

SEQ ID NO: 286398 - DNA, 20 bp, Artificial Sequence
  chemically synthesized
tgtcacagctgggttggggg

SEQ ID NO: 286399 - DNA, 20 bp, Artificial Sequence
  chemically synthesized
tctaaccaccacccccaacc

SEQ ID NO: 286400 - DNA, 20 bp, Artificial Sequence
  chemically synthesized
gattgtcacagctgggttgg

SEQ ID NO: 286401 - DNA, 20 bp, Artificial Sequence
  chemically synthesized
tgattgtcacagctgggttg

SEQ ID NO: 286402 - DNA, 20 bp, Artificial Sequence
  chemically synthesized
ttgattgtcacagctgggtt

SEQ ID NO: 286403 - DNA, 20 bp, Artificial Sequence
  chemically synthesized
tttgattgtcacagctgggt

SEQ ID NO: 286404 - DNA, 20 bp, Artificial Sequence
  chemically synthesized
cgtttttgattgtcacagct

SEQ ID NO: 286405 - DNA, 20 bp, Artificial Sequence
  chemically synthesized
acgtttttgattgtcacagc

SEQ ID NO: 286406 - DNA, 20 bp, Artificial Sequence
  chemically synthesized
ctagacgtttttgattgtca

SEQ ID NO: 286407 - DNA, 20 bp, Artificial Sequence
  chemically synthesized
ctgtgacaatcaaaaacgtc

SEQ ID NO: 286408 - DNA, 20 bp, Artificial Sequence
  chemically synthesized
tggattttttttaatgtttc

SEQ ID NO: 286409 - DNA, 20 bp, Artificial Sequence
  chemically synthesized
aaacattaaaaaaaatccac

SEQ ID NO: 286410 - DNA, 20 bp, Artificial Sequence
  chemically synthesized
aacattaaaaaaaatccact

SEQ ID NO: 286411 - DNA, 20 bp, Artificial Sequence
  chemically synthesized
acattaaaaaaaatccactg

SEQ ID NO: 286412 - DNA, 20 bp, Artificial Sequence
  chemically synthesized
attaaaaaaaatccactggg

SEQ ID NO: 286413 - DNA, 20 bp, Artificial Sequence
  chemically synthesized
taaaaaaaatccactgggga

SEQ ID NO: 286414 - DNA, 20 bp, Artificial Sequence
  chemically synthesized
ttttgctctcctctccccag

SEQ ID NO: 286415 - DNA, 20 bp, Artificial Sequence
  chemically synthesized
aaaaaaaatccactggggag

SEQ ID NO: 286416 - DNA, 20 bp, Artificial Sequence
  chemically synthesized
aaaaaatccactggggagag

SEQ ID NO: 286417 - DNA, 20 bp, Artificial Sequence
  chemically synthesized
ggattttgctctcctctccc

SEQ ID NO: 286418 - DNA, 20 bp, Artificial Sequence
  chemically synthesized
aaaatccactggggagagga

SEQ ID NO: 286419 - DNA, 20 bp, Artificial Sequence
  chemically synthesized
gaggagagcaaaatccaccc

SEQ ID NO: 286420 - DNA, 20 bp, Artificial Sequence
  chemically synthesized
tcagtgttttacagctgggg

SEQ ID NO: 286421 - DNA, 20 bp, Artificial Sequence
  chemically synthesized
agatcagtgttttacagctg

SEQ ID NO: 286422 - DNA, 20 bp, Artificial Sequence
  chemically synthesized
tagatcagtgttttacagct

SEQ ID NO: 286423 - DNA, 20 bp, Artificial Sequence
  chemically synthesized
ttagatcagtgttttacagc

SEQ ID NO: 286424 - DNA, 20 bp, Artificial Sequence
  chemically synthesized
ttggttagatcagtgtttta

SEQ ID NO: 286425 - DNA, 20 bp, Artificial Sequence
  chemically synthesized
tgaatattatttggttagat

SEQ ID NO: 286426 - DNA, 20 bp, Artificial Sequence
  chemically synthesized
ttgtatgaatattatttggt

SEQ ID NO: 286427 - DNA, 20 bp, Artificial Sequence
  chemically synthesized
aattttgtatgaatattatt

SEQ ID NO: 286428 - DNA, 20 bp, Artificial Sequence
  chemically synthesized
atacaaaattattcatatta

SEQ ID NO: 286429 - DNA, 20 bp, Artificial Sequence
  chemically synthesized
tacaaaattattcatattaa

SEQ ID NO: 286430 - DNA, 20 bp, Artificial Sequence
  chemically synthesized
cagctgaaacagtgcagagt

SEQ ID NO: 286431 - DNA, 20 bp, Artificial Sequence
  chemically synthesized
aaagcagctgaaacagtgca

SEQ ID NO: 286432 - DNA, 20 bp, Artificial Sequence
  chemically synthesized
aaaaagcagctgaaacagtg

SEQ ID NO: 286433 - DNA, 20 bp, Artificial Sequence
  chemically synthesized
aatcttactctgcactgttt

SEQ ID NO: 286434 - DNA, 20 bp, Artificial Sequence
  chemically synthesized
ttctaaaaaagcagctgaaa

SEQ ID NO: 286435 - DNA, 20 bp, Artificial Sequence
  chemically synthesized
cactgtttcagctgcttttt

SEQ ID NO: 286436 - DNA, 20 bp, Artificial Sequence
  chemically synthesized
attcagaaattctaaaaaag

SEQ ID NO: 286437 - DNA, 20 bp, Artificial Sequence
  chemically synthesized
gggattcagaaattctaaaa

SEQ ID NO: 286438 - DNA, 20 bp, Artificial Sequence
  chemically synthesized
tttagaatttctgaatcccc

SEQ ID NO: 286439 - DNA, 20 bp, Artificial Sequence
  chemically synthesized
atggcctgcccttggggatt

SEQ ID NO: 286440 - DNA, 20 bp, Artificial Sequence
  chemically synthesized
ttagaatttctgaatcccca

SEQ ID NO: 286441 - DNA, 20 bp, Artificial Sequence
  chemically synthesized
tagaatttctgaatccccaa

SEQ ID NO: 286442 - DNA, 20 bp, Artificial Sequence
  chemically synthesized
aatttctgaatccccaaggg

SEQ ID NO: 286443 - DNA, 20 bp, Artificial Sequence
  chemically synthesized
atttctgaatccccaagggc

SEQ ID NO: 286444 - DNA, 20 bp, Artificial Sequence
  chemically synthesized
ggaggaatggcctgcccttg

SEQ ID NO: 286445 - DNA, 20 bp, Artificial Sequence
  chemically synthesized
aggaggaatggcctgccctt

SEQ ID NO: 286446 - DNA, 20 bp, Artificial Sequence
  chemically synthesized
aaggaggaatggcctgccct

SEQ ID NO: 286447 - DNA, 20 bp, Artificial Sequence
  chemically synthesized
atgtttttctgaaggaggaa

SEQ ID NO: 286448 - DNA, 20 bp, Artificial Sequence
  chemically synthesized
agggcaggccattcctcctt

SEQ ID NO: 286449 - DNA, 20 bp, Artificial Sequence
  chemically synthesized
agttgatgtttttctgaagg

SEQ ID NO: 286450 - DNA, 20 bp, Artificial Sequence
  chemically synthesized
aagttgatgtttttctgaag

SEQ ID NO: 286451 - DNA, 20 bp, Artificial Sequence
  chemically synthesized
tgaagttgatgtttttctga

SEQ ID NO: 286452 - DNA, 20 bp, Artificial Sequence
  chemically synthesized
ctgaagttgatgtttttctg

SEQ ID NO: 286453 - DNA, 20 bp, Artificial Sequence
  chemically synthesized
cttcagaaaaacatcaactt

SEQ ID NO: 286454 - DNA, 20 bp, Artificial Sequence
  chemically synthesized
cctgaagaaatggatggctg

SEQ ID NO: 286455 - DNA, 20 bp, Artificial Sequence
  chemically synthesized
acaaaccctgaagaaatgga

SEQ ID NO: 286456 - DNA, 20 bp, Artificial Sequence
  chemically synthesized
acttcagccatccatttctt

SEQ ID NO: 286457 - DNA, 20 bp, Artificial Sequence
  chemically synthesized
cttcagccatccatttcttc

SEQ ID NO: 286458 - DNA, 20 bp, Artificial Sequence
  chemically synthesized
acatacaaaccctgaagaaa

SEQ ID NO: 286459 - DNA, 20 bp, Artificial Sequence
  chemically synthesized
ttcagccatccatttcttca

SEQ ID NO: 286460 - DNA, 20 bp, Artificial Sequence
  chemically synthesized
agaatcacatacaaaccctg

SEQ ID NO: 286461 - DNA, 20 bp, Artificial Sequence
  chemically synthesized
tttgtatgtgattctgaaac

SEQ ID NO: 286462 - DNA, 20 bp, Artificial Sequence
  chemically synthesized
ccttataacgggtctcgttt

SEQ ID NO: 286463 - DNA, 20 bp, Artificial Sequence
  chemically synthesized
tctgaaacgagacccgttat

SEQ ID NO: 286464 - DNA, 20 bp, Artificial Sequence
  chemically synthesized
ctgaaacgagacccgttata

SEQ ID NO: 286465 - DNA, 20 bp, Artificial Sequence
  chemically synthesized
caccagtaatgccttataac

SEQ ID NO: 286466 - DNA, 20 bp, Artificial Sequence
  chemically synthesized
acaccagtaatgccttataa

SEQ ID NO: 286467 - DNA, 20 bp, Artificial Sequence
  chemically synthesized
gacccgttataaggcattac

SEQ ID NO: 286468 - DNA, 20 bp, Artificial Sequence
  chemically synthesized
gttaaaagtaatcagcacac

SEQ ID NO: 286469 - DNA, 20 bp, Artificial Sequence
  chemically synthesized
tgaattgtgttaaaagtaat

SEQ ID NO: 286470 - DNA, 20 bp, Artificial Sequence
  chemically synthesized
acaatgatgaattgtgttaa

SEQ ID NO: 286471 - DNA, 20 bp, Artificial Sequence
  chemically synthesized
cattgtgttatgtctaaaca

SEQ ID NO: 286472 - DNA, 20 bp, Artificial Sequence
  chemically synthesized
attgtgttatgtctaaacac

SEQ ID NO: 286473 - DNA, 20 bp, Artificial Sequence
  chemically synthesized
attgtttttgggcctgtgtt

SEQ ID NO: 286474 - DNA, 20 bp, Artificial Sequence
  chemically synthesized
taaacatgggaattgttttt

SEQ ID NO: 286475 - DNA, 20 bp, Artificial Sequence
  chemically synthesized
ttaaacatgggaattgtttt

SEQ ID NO: 286476 - DNA, 20 bp, Artificial Sequence
  chemically synthesized
aaaaacaattcccatgttta

SEQ ID NO: 286477 - DNA, 20 bp, Artificial Sequence
  chemically synthesized
tagagacatcctttaaacat

SEQ ID NO: 286478 - DNA, 20 bp, Artificial Sequence
  chemically synthesized
aaaacaattcccatgtttaa

SEQ ID NO: 286479 - DNA, 20 bp, Artificial Sequence
  chemically synthesized
ttagagacatcctttaaaca

SEQ ID NO: 286480 - DNA, 20 bp, Artificial Sequence
  chemically synthesized
catgtttaaaggatgtctct

SEQ ID NO: 286481 - DNA, 20 bp, Artificial Sequence
  chemically synthesized
gtttaaaggatgtctctaag

SEQ ID NO: 286482 - DNA, 20 bp, Artificial Sequence
  chemically synthesized
tttgcctcaagaactactta

SEQ ID NO: 286483 - DNA, 20 bp, Artificial Sequence
  chemically synthesized
tctttgcctcaagaactact

SEQ ID NO: 286484 - DNA, 20 bp, Artificial Sequence
  chemically synthesized
gatgtctctaagtagttctt

SEQ ID NO: 286485 - DNA, 20 bp, Artificial Sequence
  chemically synthesized
atgtctctaagtagttcttg

SEQ ID NO: 286486 - DNA, 20 bp, Artificial Sequence
  chemically synthesized
tctaagtagttcttgaggca

SEQ ID NO: 286487 - DNA, 20 bp, Artificial Sequence
  chemically synthesized
gtaaaaatattctttgcctc

SEQ ID NO: 286488 - DNA, 20 bp, Artificial Sequence
  chemically synthesized
aggcaaagaatatttttact

SEQ ID NO: 286489 - DNA, 20 bp, Artificial Sequence
  chemically synthesized
agaccataaaaatgcagtct

SEQ ID NO: 286490 - DNA, 20 bp, Artificial Sequence
  chemically synthesized
tacagtagaccataaaaatg

SEQ ID NO: 286491 - DNA, 20 bp, Artificial Sequence
  chemically synthesized
ttactaagactgcattttta

SEQ ID NO: 286492 - DNA, 20 bp, Artificial Sequence
  chemically synthesized
atttttatggtctactgtat

SEQ ID NO: 286493 - DNA, 20 bp, Artificial Sequence
  chemically synthesized
acacaccagtgctcatacag

SEQ ID NO: 286494 - DNA, 20 bp, Artificial Sequence
  chemically synthesized
ttcacacaccagtgctcata

SEQ ID NO: 286495 - DNA, 20 bp, Artificial Sequence
  chemically synthesized
atggtctactgtatgagcac

SEQ ID NO: 286496 - DNA, 20 bp, Artificial Sequence
  chemically synthesized
tgtatgagcactggtgtgtg

SEQ ID NO: 286497 - DNA, 20 bp, Artificial Sequence
  chemically synthesized
caatagcagacttcacacac

SEQ ID NO: 286498 - DNA, 20 bp, Artificial Sequence
  chemically synthesized
ttttgtatttttaacaatag

SEQ ID NO: 286499 - DNA, 20 bp, Artificial Sequence
  chemically synthesized
taattttgtatttttaacaa

SEQ ID NO: 286500 - DNA, 20 bp, Artificial Sequence
  chemically synthesized
tacaaaattactaccaaatg

SEQ ID NO: 286501 - DNA, 20 bp, Artificial Sequence
  chemically synthesized
catcataaaaccacatttgg

SEQ ID NO: 286502 - DNA, 20 bp, Artificial Sequence
  chemically synthesized
taacatcataaaaccacatt

SEQ ID NO: 286503 - DNA, 20 bp, Artificial Sequence
  chemically synthesized
ggttttatgatgttactctc

SEQ ID NO: 286504 - DNA, 20 bp, Artificial Sequence
  chemically synthesized
atatgatttaatgttctcga

SEQ ID NO: 286505 - DNA, 20 bp, Artificial Sequence
  chemically synthesized
ggatatgatttaatgttctc

SEQ ID NO: 286506 - DNA, 20 bp, Artificial Sequence
  chemically synthesized
cattaaatcatatccccctc

SEQ ID NO: 286507 - DNA, 20 bp, Artificial Sequence
  chemically synthesized
ttaaatcatatccccctcta

SEQ ID NO: 286508 - DNA, 20 bp, Artificial Sequence
  chemically synthesized
acttaaaatttctctagagg

SEQ ID NO: 286509 - DNA, 20 bp, Artificial Sequence
  chemically synthesized
aacttaaaatttctctagag

SEQ ID NO: 286510 - DNA, 20 bp, Artificial Sequence
  chemically synthesized
taacttaaaatttctctaga

SEQ ID NO: 286511 - DNA, 20 bp, Artificial Sequence
  chemically synthesized
gtaacttaaaatttctctag

SEQ ID NO: 286512 - DNA, 20 bp, Artificial Sequence
  chemically synthesized
tgtaacttaaaatttctcta

SEQ ID NO: 286513 - DNA, 20 bp, Artificial Sequence
  chemically synthesized
tttgtaacttaaaatttctc

SEQ ID NO: 286514 - DNA, 20 bp, Artificial Sequence
  chemically synthesized
tccccctctagagaaatttt

SEQ ID NO: 286515 - DNA, 20 bp, Artificial Sequence
  chemically synthesized
taagttacaaaacaactcat

SEQ ID NO: 286516 - DNA, 20 bp, Artificial Sequence
  chemically synthesized
cacatttttagtattctcat

SEQ ID NO: 286517 - DNA, 20 bp, Artificial Sequence
  chemically synthesized
gtactgtaaggacacatttt

SEQ ID NO: 286518 - DNA, 20 bp, Artificial Sequence
  chemically synthesized
atactaaaaatgtgtcctta

SEQ ID NO: 286519 - DNA, 20 bp, Artificial Sequence
  chemically synthesized
agtttgttttatgtactgta

SEQ ID NO: 286520 - DNA, 20 bp, Artificial Sequence
  chemically synthesized
tagtttgttttatgtactgt

SEQ ID NO: 286521 - DNA, 20 bp, Artificial Sequence
  chemically synthesized
tacattgagtttattgttca

SEQ ID NO: 286522 - DNA, 20 bp, Artificial Sequence
  chemically synthesized
gaacaataaactcaatgtaa

SEQ ID NO: 286523 - DNA, 20 bp, Artificial Sequence
  chemically synthesized
tataaagacaccattacatt

SEQ ID NO: 286524 - DNA, 20 bp, Artificial Sequence
  chemically synthesized
tcaatgtaatggtgtcttta

SEQ ID NO: 286525 - DNA, 20 bp, Artificial Sequence
  chemically synthesized
tcgggtttagggaggctata

SEQ ID NO: 286526 - DNA, 20 bp, Artificial Sequence
  chemically synthesized
gtgaaagttcgggtttaggg

SEQ ID NO: 286527 - DNA, 20 bp, Artificial Sequence
  chemically synthesized
tgtgaaagttcgggtttagg

SEQ ID NO: 286528 - DNA, 20 bp, Artificial Sequence
  chemically synthesized
tttgtgaaagttcgggttta

SEQ ID NO: 286529 - DNA, 20 bp, Artificial Sequence
  chemically synthesized
atttgtgaaagttcgggttt

SEQ ID NO: 286530 - DNA, 20 bp, Artificial Sequence
  chemically synthesized
aatttgtgaaagttcgggtt

SEQ ID NO: 286531 - DNA, 20 bp, Artificial Sequence
  chemically synthesized
aaaataatttgtgaaagttc

SEQ ID NO: 286532 - DNA, 20 bp, Artificial Sequence
  chemically synthesized
gaaaataatttgtgaaagtt

SEQ ID NO: 286533 - DNA, 20 bp, Artificial Sequence
  chemically synthesized
ctgtagaaaataatttgtga

SEQ ID NO: 286534 - DNA, 20 bp, Artificial Sequence
  chemically synthesized
ctttcacaaattattttcta

SEQ ID NO: 286535 - DNA, 20 bp, Artificial Sequence
  chemically synthesized
aaattattttctacagatga

SEQ ID NO: 286536 - DNA, 20 bp, Artificial Sequence
  chemically synthesized
actatttaaactgtcatctg

SEQ ID NO: 286537 - DNA, 20 bp, Artificial Sequence
  chemically synthesized
tctacagatgacagtttaaa

SEQ ID NO: 286538 - DNA, 20 bp, Artificial Sequence
  chemically synthesized
gacagtttaaatagtccttc

SEQ ID NO: 286539 - DNA, 20 bp, Artificial Sequence
  chemically synthesized
gtttaaatagtccttccagt

SEQ ID NO: 286540 - DNA, 20 bp, Artificial Sequence
  chemically synthesized
tttaaatagtccttccagtt

SEQ ID NO: 286541 - DNA, 20 bp, Artificial Sequence
  chemically synthesized
tccaaaagttcccaactgga

SEQ ID NO: 286542 - DNA, 20 bp, Artificial Sequence
  chemically synthesized
gtccaaaagttcccaactgg

SEQ ID NO: 286543 - DNA, 20 bp, Artificial Sequence
  chemically synthesized
ttagtccaaaagttcccaac

SEQ ID NO: 286544 - DNA, 20 bp, Artificial Sequence
  chemically synthesized
tccttccagttgggaacttt

SEQ ID NO: 286545 - DNA, 20 bp, Artificial Sequence
  chemically synthesized
atgacaaaatattagtccaa

SEQ ID NO: 286546 - DNA, 20 bp, Artificial Sequence
  chemically synthesized
ctttgaagatgacaaaatat

SEQ ID NO: 286547 - DNA, 20 bp, Artificial Sequence
  chemically synthesized
ctaatattttgtcatcttca

SEQ ID NO: 286548 - DNA, 20 bp, Artificial Sequence
  chemically synthesized
tattttgtcatcttcaaaga

SEQ ID NO: 286549 - DNA, 20 bp, Artificial Sequence
  chemically synthesized
aagcaaaagctctgtctttg

SEQ ID NO: 286550 - DNA, 20 bp, Artificial Sequence
  chemically synthesized
ttttgtcatcttcaaagaca

SEQ ID NO: 286551 - DNA, 20 bp, Artificial Sequence
  chemically synthesized
ggtcagacaaataaaagcaa

SEQ ID NO: 286552 - DNA, 20 bp, Artificial Sequence
  chemically synthesized
cgtactggtcagacaaataa

SEQ ID NO: 286553 - DNA, 20 bp, Artificial Sequence
  chemically synthesized
tttgcttttatttgtctgac

SEQ ID NO: 286554 - DNA, 20 bp, Artificial Sequence
  chemically synthesized
gatcattacttcgtactggt

SEQ ID NO: 286555 - DNA, 20 bp, Artificial Sequence
  chemically synthesized
ttatttgtctgaccagtacg

SEQ ID NO: 286556 - DNA, 20 bp, Artificial Sequence
  chemically synthesized
acctgatcattacttcgtac

SEQ ID NO: 286557 - DNA, 20 bp, Artificial Sequence
  chemically synthesized
gaccagtacgaagtaatgat

SEQ ID NO: 286558 - DNA, 20 bp, Artificial Sequence
  chemically synthesized
accagtacgaagtaatgatc

SEQ ID NO: 286559 - DNA, 20 bp, Artificial Sequence
  chemically synthesized
tggctatttataaatgataa

SEQ ID NO: 286560 - DNA, 20 bp, Artificial Sequence
  chemically synthesized
catcttttatcatttataaa

SEQ ID NO: 286561 - DNA, 20 bp, Artificial Sequence
  chemically synthesized
ttttatcatttataaatagc

SEQ ID NO: 286562 - DNA, 20 bp, Artificial Sequence
  chemically synthesized
gaatcatgggtgagagatac

SEQ ID NO: 286563 - DNA, 20 bp, Artificial Sequence
  chemically synthesized
cgggaaagaatcatgggtga

SEQ ID NO: 286564 - DNA, 20 bp, Artificial Sequence
  chemically synthesized
tacgggaaagaatcatgggt

SEQ ID NO: 286565 - DNA, 20 bp, Artificial Sequence
  chemically synthesized
gtaatacgggaaagaatcat

SEQ ID NO: 286566 - DNA, 20 bp, Artificial Sequence
  chemically synthesized
ggtaatacgggaaagaatca

SEQ ID NO: 286567 - DNA, 20 bp, Artificial Sequence
  chemically synthesized
gaaaaaaaggtaatacggga

SEQ ID NO: 286568 - DNA, 20 bp, Artificial Sequence
  chemically synthesized
agcagaaaaaaaggtaatac

SEQ ID NO: 286569 - DNA, 20 bp, Artificial Sequence
  chemically synthesized
cagcagaaaaaaaggtaata

SEQ ID NO: 286570 - DNA, 20 bp, Artificial Sequence
  chemically synthesized
tggcaaaacagcagaaaaaa

SEQ ID NO: 286571 - DNA, 20 bp, Artificial Sequence
  chemically synthesized
gtggcaaaacagcagaaaaa

SEQ ID NO: 286572 - DNA, 20 bp, Artificial Sequence
  chemically synthesized
ttttagaagtggcaaaacag

SEQ ID NO: 286573 - DNA, 20 bp, Artificial Sequence
  chemically synthesized
actttttagaagtggcaaaa

SEQ ID NO: 286574 - DNA, 20 bp, Artificial Sequence
  chemically synthesized
tgaatcatactttttagaag

SEQ ID NO: 286575 - DNA, 20 bp, Artificial Sequence
  chemically synthesized
gctgttttgccacttctaaa

SEQ ID NO: 286576 - DNA, 20 bp, Artificial Sequence
  chemically synthesized
agttgaatcatactttttag

SEQ ID NO: 286577 - DNA, 20 bp, Artificial Sequence
  chemically synthesized
catagttgaatcatactttt

SEQ ID NO: 286578 - DNA, 20 bp, Artificial Sequence
  chemically synthesized
aataacacatgtagacagca

SEQ ID NO: 286579 - DNA, 20 bp, Artificial Sequence
  chemically synthesized
aagaaaataacacatgtaga

SEQ ID NO: 286580 - DNA, 20 bp, Artificial Sequence
  chemically synthesized
acagaagaaaataacacatg

SEQ ID NO: 286581 - DNA, 20 bp, Artificial Sequence
  chemically synthesized
tgtaaatttaagtaaaacag

SEQ ID NO: 286582 - DNA, 20 bp, Artificial Sequence
  chemically synthesized
caatgtaaatttaagtaaaa

SEQ ID NO: 286583 - DNA, 20 bp, Artificial Sequence
  chemically synthesized
catattttcaatgtaaattt

SEQ ID NO: 286584 - DNA, 20 bp, Artificial Sequence
  chemically synthesized
cattgaaaatatgtgctcca

SEQ ID NO: 286585 - DNA, 20 bp, Artificial Sequence
  chemically synthesized
gaaaatatgtgctccacaga

SEQ ID NO: 286586 - DNA, 20 bp, Artificial Sequence
  chemically synthesized
taaaggggaaactttctgtg

SEQ ID NO: 286587 - DNA, 20 bp, Artificial Sequence
  chemically synthesized
attaaaggggaaactttctg

SEQ ID NO: 286588 - DNA, 20 bp, Artificial Sequence
  chemically synthesized
tattaataatcacattaaag

SEQ ID NO: 286589 - DNA, 20 bp, Artificial Sequence
  chemically synthesized
ttattaataatcacattaaa

SEQ ID NO: 286590 - DNA, 20 bp, Artificial Sequence
  chemically synthesized
attattaataatcacattaa

SEQ ID NO: 286591 - DNA, 20 bp, Artificial Sequence
  chemically synthesized
tattattaataatcacatta

SEQ ID NO: 286592 - DNA, 20 bp, Artificial Sequence
  chemically synthesized
aatttttaaactatttatct

SEQ ID NO: 286593 - DNA, 20 bp, Artificial Sequence
  chemically synthesized
ttgaagttctcttagataaa

SEQ ID NO: 286594 - DNA, 20 bp, Artificial Sequence
  chemically synthesized
tttttaaactatttatctaa

SEQ ID NO: 286595 - DNA, 20 bp, Artificial Sequence
  chemically synthesized
tgatcgtcttgaagttctct

SEQ ID NO: 286596 - DNA, 20 bp, Artificial Sequence
  chemically synthesized
tatttatctaagagaacttc

SEQ ID NO: 286597 - DNA, 20 bp, Artificial Sequence
  chemically synthesized
acagcaaggtgatcgtcttg

SEQ ID NO: 286598 - DNA, 20 bp, Artificial Sequence
  chemically synthesized
agacttgaaagataacagca

SEQ ID NO: 286599 - DNA, 20 bp, Artificial Sequence
  chemically synthesized
tagacttgaaagataacagc

SEQ ID NO: 286600 - DNA, 20 bp, Artificial Sequence
  chemically synthesized
aatgtagacttgaaagataa

SEQ ID NO: 286601 - DNA, 20 bp, Artificial Sequence
  chemically synthesized
tcaccttgctgttatctttc

SEQ ID NO: 286602 - DNA, 20 bp, Artificial Sequence
  chemically synthesized
aagaacaaatgtagacttga

SEQ ID NO: 286603 - DNA, 20 bp, Artificial Sequence
  chemically synthesized
atgtgaaataagaacaaatg

SEQ ID NO: 286604 - DNA, 20 bp, Artificial Sequence
  chemically synthesized
ggacagtgaagatgtgaaat

SEQ ID NO: 286605 - DNA, 20 bp, Artificial Sequence
  chemically synthesized
agacctgaacaaggacagtg

SEQ ID NO: 286606 - DNA, 20 bp, Artificial Sequence
  chemically synthesized
aaaaaagacctgaacaagga

SEQ ID NO: 286607 - DNA, 20 bp, Artificial Sequence
  chemically synthesized
acatcttcactgtccttgtt

SEQ ID NO: 286608 - DNA, 20 bp, Artificial Sequence
  chemically synthesized
catcttcactgtccttgttc

SEQ ID NO: 286609 - DNA, 20 bp, Artificial Sequence
  chemically synthesized
aaaaaaaaaagacctgaaca

SEQ ID NO: 286610 - DNA, 20 bp, Artificial Sequence
  chemically synthesized
aaaaaaaaaaagacctgaac

SEQ ID NO: 286611 - DNA, 20 bp, Artificial Sequence
  chemically synthesized
aaaaaacaaacaaaaaaaaa

SEQ ID NO: 286612 - DNA, 20 bp, Artificial Sequence
  chemically synthesized
tttttttttttttttttttt

SEQ ID NO: 286613 - DNA, 20 bp, Artificial Sequence
  chemically synthesized
ttttttttttttttttgaga

SEQ ID NO: 286614 - DNA, 20 bp, Artificial Sequence
  chemically synthesized
ttttttttttttttgagatg

SEQ ID NO: 286615 - DNA, 20 bp, Artificial Sequence
  chemically synthesized
tccagcctgggcgacagagc

SEQ ID NO: 286616 - DNA, 20 bp, Artificial Sequence
  chemically synthesized
tggagtcttgctctgtcgcc

SEQ ID NO: 286617 - DNA, 20 bp, Artificial Sequence
  chemically synthesized
tcactccagcctgggcgaca

SEQ ID NO: 286618 - DNA, 20 bp, Artificial Sequence
  chemically synthesized
ggagtcttgctctgtcgccc

SEQ ID NO: 286619 - DNA, 20 bp, Artificial Sequence
  chemically synthesized
cttcactccagcctgggcga

SEQ ID NO: 286620 - DNA, 20 bp, Artificial Sequence
  chemically synthesized
tcttgctctgtcgcccaggc

SEQ ID NO: 286621 - DNA, 20 bp, Artificial Sequence
  chemically synthesized
ttgctctgtcgcccaggctg

SEQ ID NO: 286622 - DNA, 20 bp, Artificial Sequence
  chemically synthesized
gtgccacttcactccagcct

SEQ ID NO: 286623 - DNA, 20 bp, Artificial Sequence
  chemically synthesized
tgtgccacttcactccagcc

SEQ ID NO: 286624 - DNA, 20 bp, Artificial Sequence
  chemically synthesized
ctgtcgcccaggctggagtg

SEQ ID NO: 286625 - DNA, 20 bp, Artificial Sequence
  chemically synthesized
aagattgtgccacttcactc

SEQ ID NO: 286626 - DNA, 20 bp, Artificial Sequence
  chemically synthesized
tcgcccaggctggagtgaag

SEQ ID NO: 286627 - DNA, 20 bp, Artificial Sequence
  chemically synthesized
ggagtgaagtggcacaatct

SEQ ID NO: 286628 - DNA, 20 bp, Artificial Sequence
  chemically synthesized
ggtggaggctgcagtgagcc

SEQ ID NO: 286629 - DNA, 20 bp, Artificial Sequence
  chemically synthesized
ggcacaatcttggctcactg

SEQ ID NO: 286630 - DNA, 20 bp, Artificial Sequence
  chemically synthesized
tgggaggtggaggctgcagt

SEQ ID NO: 286631 - DNA, 20 bp, Artificial Sequence
  chemically synthesized
aacctgggaggtggaggctg

SEQ ID NO: 286632 - DNA, 20 bp, Artificial Sequence
  chemically synthesized
ggcgtgaacctgggaggtgg

SEQ ID NO: 286633 - DNA, 20 bp, Artificial Sequence
  chemically synthesized
tcactgcagcctccacctcc

SEQ ID NO: 286634 - DNA, 20 bp, Artificial Sequence
  chemically synthesized
tggcgtgaacctgggaggtg

SEQ ID NO: 286635 - DNA, 20 bp, Artificial Sequence
  chemically synthesized
cactgcagcctccacctccc

SEQ ID NO: 286636 - DNA, 20 bp, Artificial Sequence
  chemically synthesized
aatggcgtgaacctgggagg

SEQ ID NO: 286637 - DNA, 20 bp, Artificial Sequence
  chemically synthesized
gagaatggcgtgaacctggg

SEQ ID NO: 286638 - DNA, 20 bp, Artificial Sequence
  chemically synthesized
ggagaatggcgtgaacctgg

SEQ ID NO: 286639 - DNA, 20 bp, Artificial Sequence
  chemically synthesized
caggagaatggcgtgaacct

SEQ ID NO: 286640 - DNA, 20 bp, Artificial Sequence
  chemically synthesized
gcaggagaatggcgtgaacc

SEQ ID NO: 286641 - DNA, 20 bp, Artificial Sequence
  chemically synthesized
gggaggctgaggcaggagaa

SEQ ID NO: 286642 - DNA, 20 bp, Artificial Sequence
  chemically synthesized
ttcacgccattctcctgcct

SEQ ID NO: 286643 - DNA, 20 bp, Artificial Sequence
  chemically synthesized
tacttgggaggctgaggcag

SEQ ID NO: 286644 - DNA, 20 bp, Artificial Sequence
  chemically synthesized
gctacttgggaggctgaggc

SEQ ID NO: 286645 - DNA, 20 bp, Artificial Sequence
  chemically synthesized
agctacttgggaggctgagg

SEQ ID NO: 286646 - DNA, 20 bp, Artificial Sequence
  chemically synthesized
cccagctacttgggaggctg

SEQ ID NO: 286647 - DNA, 20 bp, Artificial Sequence
  chemically synthesized
tcccagctacttgggaggct

SEQ ID NO: 286648 - DNA, 20 bp, Artificial Sequence
  chemically synthesized
ttctcctgcctcagcctccc

SEQ ID NO: 286649 - DNA, 20 bp, Artificial Sequence
  chemically synthesized
tcctgcctcagcctcccaag

SEQ ID NO: 286650 - DNA, 20 bp, Artificial Sequence
  chemically synthesized
tgtaatcccagctacttggg

SEQ ID NO: 286651 - DNA, 20 bp, Artificial Sequence
  chemically synthesized
ctgtaatcccagctacttgg

SEQ ID NO: 286652 - DNA, 20 bp, Artificial Sequence
  chemically synthesized
gcctcagcctcccaagtagc

SEQ ID NO: 286653 - DNA, 20 bp, Artificial Sequence
  chemically synthesized
gcctgtaatcccagctactt

SEQ ID NO: 286654 - DNA, 20 bp, Artificial Sequence
  chemically synthesized
cctcagcctcccaagtagct

SEQ ID NO: 286655 - DNA, 20 bp, Artificial Sequence
  chemically synthesized
cgcctgtaatcccagctact

SEQ ID NO: 286656 - DNA, 20 bp, Artificial Sequence
  chemically synthesized
ctcccaagtagctgggatta

SEQ ID NO: 286657 - DNA, 20 bp, Artificial Sequence
  chemically synthesized
tcccaagtagctgggattac

SEQ ID NO: 286658 - DNA, 20 bp, Artificial Sequence
  chemically synthesized
gtagtgcacgcctgtaatcc

SEQ ID NO: 286659 - DNA, 20 bp, Artificial Sequence
  chemically synthesized
caggcgtgcactaccatgcc

SEQ ID NO: 286660 - DNA, 20 bp, Artificial Sequence
  chemically synthesized
caaaaattagctgggcatgg

SEQ ID NO: 286661 - DNA, 20 bp, Artificial Sequence
  chemically synthesized
acacaaaaattagctgggca

SEQ ID NO: 286662 - DNA, 20 bp, Artificial Sequence
  chemically synthesized
taaaaacacaaaaattagct

SEQ ID NO: 286663 - DNA, 20 bp, Artificial Sequence
  chemically synthesized
ctaaaaacacaaaaattagc

SEQ ID NO: 286664 - DNA, 20 bp, Artificial Sequence
  chemically synthesized
tctactaaaaacacaaaaat

SEQ ID NO: 286665 - DNA, 20 bp, Artificial Sequence
  chemically synthesized
ccagctaatttttgtgtttt

SEQ ID NO: 286666 - DNA, 20 bp, Artificial Sequence
  chemically synthesized
gctaatttttgtgtttttag

SEQ ID NO: 286667 - DNA, 20 bp, Artificial Sequence
  chemically synthesized
taatttttgtgtttttagta

SEQ ID NO: 286668 - DNA, 20 bp, Artificial Sequence
  chemically synthesized
ttttgtgtttttagtagaga

SEQ ID NO: 286669 - DNA, 20 bp, Artificial Sequence
  chemically synthesized
tttgtgtttttagtagagac

SEQ ID NO: 286670 - DNA, 20 bp, Artificial Sequence
  chemically synthesized
ttgtgtttttagtagagaca

SEQ ID NO: 286671 - DNA, 20 bp, Artificial Sequence
  chemically synthesized
gagacagggtttcgccatgt

SEQ ID NO: 286672 - DNA, 20 bp, Artificial Sequence
  chemically synthesized
cagggtttcgccatgttggc

SEQ ID NO: 286673 - DNA, 20 bp, Artificial Sequence
  chemically synthesized
caagaccatgctggccaaca

SEQ ID NO: 286674 - DNA, 20 bp, Artificial Sequence
  chemically synthesized
tttcgccatgttggccagca

SEQ ID NO: 286675 - DNA, 20 bp, Artificial Sequence
  chemically synthesized
tcaagagatcaagaccatgc

SEQ ID NO: 286676 - DNA, 20 bp, Artificial Sequence
  chemically synthesized
gatcacgaggtcaagagatc

SEQ ID NO: 286677 - DNA, 20 bp, Artificial Sequence
  chemically synthesized
caggtagatcacgaggtcaa

SEQ ID NO: 286678 - DNA, 20 bp, Artificial Sequence
  chemically synthesized
ggcaggtagatcacgaggtc

SEQ ID NO: 286679 - DNA, 20 bp, Artificial Sequence
  chemically synthesized
gctgaggcaggtagatcacg

SEQ ID NO: 286680 - DNA, 20 bp, Artificial Sequence
  chemically synthesized
agctgaggcaggtagatcac

SEQ ID NO: 286681 - DNA, 20 bp, Artificial Sequence
  chemically synthesized
acctcgtgatctacctgcct

SEQ ID NO: 286682 - DNA, 20 bp, Artificial Sequence
  chemically synthesized
ctctgggcagctgaggcagg

SEQ ID NO: 286683 - DNA, 20 bp, Artificial Sequence
  chemically synthesized
gcactctgggcagctgaggc

SEQ ID NO: 286684 - DNA, 20 bp, Artificial Sequence
  chemically synthesized
agcactctgggcagctgagg

SEQ ID NO: 286685 - DNA, 20 bp, Artificial Sequence
  chemically synthesized
cccagcactctgggcagctg

SEQ ID NO: 286686 - DNA, 20 bp, Artificial Sequence
  chemically synthesized
atctacctgcctcagctgcc

SEQ ID NO: 286687 - DNA, 20 bp, Artificial Sequence
  chemically synthesized
tcccagcactctgggcagct

SEQ ID NO: 286688 - DNA, 20 bp, Artificial Sequence
  chemically synthesized
ctacctgcctcagctgccca

SEQ ID NO: 286689 - DNA, 20 bp, Artificial Sequence
  chemically synthesized
tataatcccagcactctggg

SEQ ID NO: 286690 - DNA, 20 bp, Artificial Sequence
  chemically synthesized
gcctcagctgcccagagtgc

SEQ ID NO: 286691 - DNA, 20 bp, Artificial Sequence
  chemically synthesized
gcctataatcccagcactct

SEQ ID NO: 286692 - DNA, 20 bp, Artificial Sequence
  chemically synthesized
cctcagctgcccagagtgct

SEQ ID NO: 286693 - DNA, 20 bp, Artificial Sequence
  chemically synthesized
tgcctataatcccagcactc

SEQ ID NO: 286694 - DNA, 20 bp, Artificial Sequence
  chemically synthesized
tgcccagagtgctgggatta

SEQ ID NO: 286695 - DNA, 20 bp, Artificial Sequence
  chemically synthesized
gcccagagtgctgggattat

SEQ ID NO: 286696 - DNA, 20 bp, Artificial Sequence
  chemically synthesized
gtggctcatgcctataatcc

SEQ ID NO: 286697 - DNA, 20 bp, Artificial Sequence
  chemically synthesized
agtgctgggattataggcat

SEQ ID NO: 286698 - DNA, 20 bp, Artificial Sequence
  chemically synthesized
taggcatgagccactacgcc

SEQ ID NO: 286699 - DNA, 20 bp, Artificial Sequence
  chemically synthesized
cctgaacagcccaggcgtag

SEQ ID NO: 286700 - DNA, 20 bp, Artificial Sequence
  chemically synthesized
aggcatgagccactacgcct

SEQ ID NO: 286701 - DNA, 20 bp, Artificial Sequence
  chemically synthesized
agacctgaacagcccaggcg

SEQ ID NO: 286702 - DNA, 20 bp, Artificial Sequence
  chemically synthesized
taatgagacctgaacagccc

SEQ ID NO: 286703 - DNA, 20 bp, Artificial Sequence
  chemically synthesized
gccactacgcctgggctgtt

SEQ ID NO: 286704 - DNA, 20 bp, Artificial Sequence
  chemically synthesized
ctaatgagacctgaacagcc

SEQ ID NO: 286705 - DNA, 20 bp, Artificial Sequence
  chemically synthesized
ccactacgcctgggctgttc

SEQ ID NO: 286706 - DNA, 20 bp, Artificial Sequence
  chemically synthesized
agtcactaatgagacctgaa

SEQ ID NO: 286707 - DNA, 20 bp, Artificial Sequence
  chemically synthesized
ctgggctgttcaggtctcat

SEQ ID NO: 286708 - DNA, 20 bp, Artificial Sequence
  chemically synthesized
gcattaatggagtcactaat

SEQ ID NO: 286709 - DNA, 20 bp, Artificial Sequence
  chemically synthesized
aacgagccagtgcattaatg

SEQ ID NO: 286710 - DNA, 20 bp, Artificial Sequence
  chemically synthesized
aaaacgagccagtgcattaa

SEQ ID NO: 286711 - DNA, 20 bp, Artificial Sequence
  chemically synthesized
tagtgactccattaatgcac

SEQ ID NO: 286712 - DNA, 20 bp, Artificial Sequence
  chemically synthesized
aggcagatatcaaaacgagc

SEQ ID NO: 286713 - DNA, 20 bp, Artificial Sequence
  chemically synthesized
accgaggcagatatcaaaac

SEQ ID NO: 286714 - DNA, 20 bp, Artificial Sequence
  chemically synthesized
gctcgttttgatatctgcct

SEQ ID NO: 286715 - DNA, 20 bp, Artificial Sequence
  chemically synthesized
agaatgaggtgagaccgagg

SEQ ID NO: 286716 - DNA, 20 bp, Artificial Sequence
  chemically synthesized
attagaatgaggtgagaccg

SEQ ID NO: 286717 - DNA, 20 bp, Artificial Sequence
  chemically synthesized
aattagaatgaggtgagacc

SEQ ID NO: 286718 - DNA, 20 bp, Artificial Sequence
  chemically synthesized
atcagtaattagaatgaggt

SEQ ID NO: 286719 - DNA, 20 bp, Artificial Sequence
  chemically synthesized
gtagatcagtaattagaatg

SEQ ID NO: 286720 - DNA, 20 bp, Artificial Sequence
  chemically synthesized
tgtagatcagtaattagaat

SEQ ID NO: 286721 - DNA, 20 bp, Artificial Sequence
  chemically synthesized
catcactgtagatcagtaat

SEQ ID NO: 286722 - DNA, 20 bp, Artificial Sequence
  chemically synthesized
tcattctaattactgatcta

SEQ ID NO: 286723 - DNA, 20 bp, Artificial Sequence
  chemically synthesized
ttactggcatcactgtagat

SEQ ID NO: 286724 - DNA, 20 bp, Artificial Sequence
  chemically synthesized
ggagattactggcatcactg

SEQ ID NO: 286725 - DNA, 20 bp, Artificial Sequence
  chemically synthesized
ttactgatctacagtgatgc

SEQ ID NO: 286726 - DNA, 20 bp, Artificial Sequence
  chemically synthesized
gaaggaggagaggagattac

SEQ ID NO: 286727 - DNA, 20 bp, Artificial Sequence
  chemically synthesized
gatgagaggaaggaggagag

SEQ ID NO: 286728 - DNA, 20 bp, Artificial Sequence
  chemically synthesized
aagatgagaggaaggaggag

SEQ ID NO: 286729 - DNA, 20 bp, Artificial Sequence
  chemically synthesized
caagatgagaggaaggagga

SEQ ID NO: 286730 - DNA, 20 bp, Artificial Sequence
  chemically synthesized
cccaagatgagaggaaggag

SEQ ID NO: 286731 - DNA, 20 bp, Artificial Sequence
  chemically synthesized
ttcccaagatgagaggaagg

SEQ ID NO: 286732 - DNA, 20 bp, Artificial Sequence
  chemically synthesized
attcccaagatgagaggaag

SEQ ID NO: 286733 - DNA, 20 bp, Artificial Sequence
  chemically synthesized
acattcccaagatgagagga

SEQ ID NO: 286734 - DNA, 20 bp, Artificial Sequence
  chemically synthesized
aacattcccaagatgagagg

SEQ ID NO: 286735 - DNA, 20 bp, Artificial Sequence
  chemically synthesized
tctcctccttcctctcatct

SEQ ID NO: 286736 - DNA, 20 bp, Artificial Sequence
  chemically synthesized
caaaacattcccaagatgag

SEQ ID NO: 286737 - DNA, 20 bp, Artificial Sequence
  chemically synthesized
ctcctccttcctctcatctt

SEQ ID NO: 286738 - DNA, 20 bp, Artificial Sequence
  chemically synthesized
tcaaaacattcccaagatga

SEQ ID NO: 286739 - DNA, 20 bp, Artificial Sequence
  chemically synthesized
tttcaaaacattcccaagat

SEQ ID NO: 286740 - DNA, 20 bp, Artificial Sequence
  chemically synthesized
tgtgttttcaaaacattccc

SEQ ID NO: 286741 - DNA, 20 bp, Artificial Sequence
  chemically synthesized
tgggaatgttttgaaaacac

SEQ ID NO: 286742 - DNA, 20 bp, Artificial Sequence
  chemically synthesized
gaatgttttgaaaacacaag

SEQ ID NO: 286743 - DNA, 20 bp, Artificial Sequence
  chemically synthesized
aaactgctattggttaaaga

SEQ ID NO: 286744 - DNA, 20 bp, Artificial Sequence
  chemically synthesized
aaaactgctattggttaaag

SEQ ID NO: 286745 - DNA, 20 bp, Artificial Sequence
  chemically synthesized
aaaaactgctattggttaaa

SEQ ID NO: 286746 - DNA, 20 bp, Artificial Sequence
  chemically synthesized
ttatttccctctttaaccaa

SEQ ID NO: 286747 - DNA, 20 bp, Artificial Sequence
  chemically synthesized
gaaaaaactgctattggtta

SEQ ID NO: 286748 - DNA, 20 bp, Artificial Sequence
  chemically synthesized
tttccctctttaaccaatag

SEQ ID NO: 286749 - DNA, 20 bp, Artificial Sequence
  chemically synthesized
taataagaaaaaactgctat

SEQ ID NO: 286750 - DNA, 20 bp, Artificial Sequence
  chemically synthesized
aatagcagttttttcttatt

SEQ ID NO: 286751 - DNA, 20 bp, Artificial Sequence
  chemically synthesized
aataacaataaaaacttaat

SEQ ID NO: 286752 - DNA, 20 bp, Artificial Sequence
  chemically synthesized
gtttttattgttattattat

SEQ ID NO: 286753 - DNA, 20 bp, Artificial Sequence
  chemically synthesized
agttttaatctagtggtgat

SEQ ID NO: 286754 - DNA, 20 bp, Artificial Sequence
  chemically synthesized
attatcagtcccatcaccac

SEQ ID NO: 286755 - DNA, 20 bp, Artificial Sequence
  chemically synthesized
gagttttaatctagtggtga

SEQ ID NO: 286756 - DNA, 20 bp, Artificial Sequence
  chemically synthesized
caatctgagttttaatctag

SEQ ID NO: 286757 - DNA, 20 bp, Artificial Sequence
  chemically synthesized
ttacaatctgagttttaatc

SEQ ID NO: 286758 - DNA, 20 bp, Artificial Sequence
  chemically synthesized
atcaccactagattaaaact

SEQ ID NO: 286759 - DNA, 20 bp, Artificial Sequence
  chemically synthesized
gatgctatgttttacaatct

SEQ ID NO: 286760 - DNA, 20 bp, Artificial Sequence
  chemically synthesized
aaaactcagattgtaaaaca

SEQ ID NO: 286761 - DNA, 20 bp, Artificial Sequence
  chemically synthesized
gattgtaaaacatagcatcc

SEQ ID NO: 286762 - DNA, 20 bp, Artificial Sequence
  chemically synthesized
attgtaaaacatagcatcca

SEQ ID NO: 286763 - DNA, 20 bp, Artificial Sequence
  chemically synthesized
gagtagacagtgaatgtcct

SEQ ID NO: 286764 - DNA, 20 bp, Artificial Sequence
  chemically synthesized
aaaactggattgagagtaga

SEQ ID NO: 286765 - DNA, 20 bp, Artificial Sequence
  chemically synthesized
ttggaaaactggattgagag

SEQ ID NO: 286766 - DNA, 20 bp, Artificial Sequence
  chemically synthesized
ttcactgtctactctcaatc

SEQ ID NO: 286767 - DNA, 20 bp, Artificial Sequence
  chemically synthesized
tggttggaaaactggattga

SEQ ID NO: 286768 - DNA, 20 bp, Artificial Sequence
  chemically synthesized
tatggttggaaaactggatt

SEQ ID NO: 286769 - DNA, 20 bp, Artificial Sequence
  chemically synthesized
aaatattatggttggaaaac

SEQ ID NO: 286770 - DNA, 20 bp, Artificial Sequence
  chemically synthesized
gattaataaaatattatggt

SEQ ID NO: 286771 - DNA, 20 bp, Artificial Sequence
  chemically synthesized
tggggattaataaaatatta

SEQ ID NO: 286772 - DNA, 20 bp, Artificial Sequence
  chemically synthesized
ctgggtagacaatatatatg

SEQ ID NO: 286773 - DNA, 20 bp, Artificial Sequence
  chemically synthesized
actgggtagacaatatatat

SEQ ID NO: 286774 - DNA, 20 bp, Artificial Sequence
  chemically synthesized
cactgggtagacaatatata

SEQ ID NO: 286775 - DNA, 20 bp, Artificial Sequence
  chemically synthesized
ccccatatatattgtctacc

SEQ ID NO: 286776 - DNA, 20 bp, Artificial Sequence
  chemically synthesized
gatataagttcaacactggg

SEQ ID NO: 286777 - DNA, 20 bp, Artificial Sequence
  chemically synthesized
aatgatataagttcaacact

SEQ ID NO: 286778 - DNA, 20 bp, Artificial Sequence
  chemically synthesized
aaatgatataagttcaacac

SEQ ID NO: 286779 - DNA, 20 bp, Artificial Sequence
  chemically synthesized
cattttcagttaaatgatat

SEQ ID NO: 286780 - DNA, 20 bp, Artificial Sequence
  chemically synthesized
agaaagcatagcagcatttt

SEQ ID NO: 286781 - DNA, 20 bp, Artificial Sequence
  chemically synthesized
gagttcttgagaaagcatag

SEQ ID NO: 286782 - DNA, 20 bp, Artificial Sequence
  chemically synthesized
aaagagttcttgagaaagca

SEQ ID NO: 286783 - DNA, 20 bp, Artificial Sequence
  chemically synthesized
aaatgctgctatgctttctc

SEQ ID NO: 286784 - DNA, 20 bp, Artificial Sequence
  chemically synthesized
gaaagaaagagttcttgaga

SEQ ID NO: 286785 - DNA, 20 bp, Artificial Sequence
  chemically synthesized
ccgagaaagaaagagttctt

SEQ ID NO: 286786 - DNA, 20 bp, Artificial Sequence
  chemically synthesized
agctaataccgagaaagaaa

SEQ ID NO: 286787 - DNA, 20 bp, Artificial Sequence
  chemically synthesized
ctcaagaactctttctttct

SEQ ID NO: 286788 - DNA, 20 bp, Artificial Sequence
  chemically synthesized
ttagctaataccgagaaaga

SEQ ID NO: 286789 - DNA, 20 bp, Artificial Sequence
  chemically synthesized
ttagttagctaataccgaga

SEQ ID NO: 286790 - DNA, 20 bp, Artificial Sequence
  chemically synthesized
aactctttctttctcggtat

SEQ ID NO: 286791 - DNA, 20 bp, Artificial Sequence
  chemically synthesized
gaatttagttagctaatacc

SEQ ID NO: 286792 - DNA, 20 bp, Artificial Sequence
  chemically synthesized
ttaaataggtagaatttagt

SEQ ID NO: 286793 - DNA, 20 bp, Artificial Sequence
  chemically synthesized
tagattaaataggtagaatt

SEQ ID NO: 286794 - DNA, 20 bp, Artificial Sequence
  chemically synthesized
tctgctatagattaaatagg

SEQ ID NO: 286795 - DNA, 20 bp, Artificial Sequence
  chemically synthesized
gtctctgctatagattaaat

SEQ ID NO: 286796 - DNA, 20 bp, Artificial Sequence
  chemically synthesized
tgtctctgctatagattaaa

SEQ ID NO: 286797 - DNA, 20 bp, Artificial Sequence
  chemically synthesized
aattctacctatttaatcta

SEQ ID NO: 286798 - DNA, 20 bp, Artificial Sequence
  chemically synthesized
tctacctatttaatctatag

SEQ ID NO: 286799 - DNA, 20 bp, Artificial Sequence
  chemically synthesized
tacctatttaatctatagca

SEQ ID NO: 286800 - DNA, 20 bp, Artificial Sequence
  chemically synthesized
aacataggttgtctctgcta

SEQ ID NO: 286801 - DNA, 20 bp, Artificial Sequence
  chemically synthesized
atgaaatattatcggaacat

SEQ ID NO: 286802 - DNA, 20 bp, Artificial Sequence
  chemically synthesized
tatgaaatattatcggaaca

SEQ ID NO: 286803 - DNA, 20 bp, Artificial Sequence
  chemically synthesized
aaaggattatgaaatattat

SEQ ID NO: 286804 - DNA, 20 bp, Artificial Sequence
  chemically synthesized
tatttcataatcctttttcc

SEQ ID NO: 286805 - DNA, 20 bp, Artificial Sequence
  chemically synthesized
tccaacataaactaggaaaa

SEQ ID NO: 286806 - DNA, 20 bp, Artificial Sequence
  chemically synthesized
atccaacataaactaggaaa

SEQ ID NO: 286807 - DNA, 20 bp, Artificial Sequence
  chemically synthesized
aaggaaatccaacataaact

SEQ ID NO: 286808 - DNA, 20 bp, Artificial Sequence
  chemically synthesized
gaaggaaatccaacataaac

SEQ ID NO: 286809 - DNA, 20 bp, Artificial Sequence
  chemically synthesized
tcctttttcctagtttatgt

SEQ ID NO: 286810 - DNA, 20 bp, Artificial Sequence
  chemically synthesized
ggttgtcacagtaggcagga

SEQ ID NO: 286811 - DNA, 20 bp, Artificial Sequence
  chemically synthesized
aggttgtcacagtaggcagg

SEQ ID NO: 286812 - DNA, 20 bp, Artificial Sequence
  chemically synthesized
gaaaggttgtcacagtaggc

SEQ ID NO: 286813 - DNA, 20 bp, Artificial Sequence
  chemically synthesized
ggaaaggttgtcacagtagg

SEQ ID NO: 286814 - DNA, 20 bp, Artificial Sequence
  chemically synthesized
atgggaaaggttgtcacagt

SEQ ID NO: 286815 - DNA, 20 bp, Artificial Sequence
  chemically synthesized
tatgggaaaggttgtcacag

SEQ ID NO: 286816 - DNA, 20 bp, Artificial Sequence
  chemically synthesized
cagtatgggaaaggttgtca

SEQ ID NO: 286817 - DNA, 20 bp, Artificial Sequence
  chemically synthesized
taaattaaacagtatgggaa

SEQ ID NO: 286818 - DNA, 20 bp, Artificial Sequence
  chemically synthesized
ataaattaaacagtatggga

SEQ ID NO: 286819 - DNA, 20 bp, Artificial Sequence
  chemically synthesized
gtaaataaattaaacagtat

SEQ ID NO: 286820 - DNA, 20 bp, Artificial Sequence
  chemically synthesized
ggtaaataaattaaacagta

SEQ ID NO: 286821 - DNA, 20 bp, Artificial Sequence
  chemically synthesized
tgcatggtaaataaattaaa

SEQ ID NO: 286822 - DNA, 20 bp, Artificial Sequence
  chemically synthesized
gtttaatttatttaccatgc

SEQ ID NO: 286823 - DNA, 20 bp, Artificial Sequence
  chemically synthesized
tttaatttatttaccatgca

SEQ ID NO: 286824 - DNA, 20 bp, Artificial Sequence
  chemically synthesized
tagcattattcagccttgca

SEQ ID NO: 286825 - DNA, 20 bp, Artificial Sequence
  chemically synthesized
atcttgggggtagcattatt

SEQ ID NO: 286826 - DNA, 20 bp, Artificial Sequence
  chemically synthesized
ggctgaataatgctaccccc

SEQ ID NO: 286827 - DNA, 20 bp, Artificial Sequence
  chemically synthesized
gggtgaggacatcttggggg

SEQ ID NO: 286828 - DNA, 20 bp, Artificial Sequence
  chemically synthesized
ttagggtgaggacatcttgg

SEQ ID NO: 286829 - DNA, 20 bp, Artificial Sequence
  chemically synthesized
attagggtgaggacatcttg

SEQ ID NO: 286830 - DNA, 20 bp, Artificial Sequence
  chemically synthesized
gattagggtgaggacatctt

SEQ ID NO: 286831 - DNA, 20 bp, Artificial Sequence
  chemically synthesized
agattagggtgaggacatct

SEQ ID NO: 286832 - DNA, 20 bp, Artificial Sequence
  chemically synthesized
aggtttcagagattagggtg

SEQ ID NO: 286833 - DNA, 20 bp, Artificial Sequence
  chemically synthesized
caggtttcagagattagggt

SEQ ID NO: 286834 - DNA, 20 bp, Artificial Sequence
  chemically synthesized
ctcacaggtttcagagatta

SEQ ID NO: 286835 - DNA, 20 bp, Artificial Sequence
  chemically synthesized
actcacaggtttcagagatt

SEQ ID NO: 286836 - DNA, 20 bp, Artificial Sequence
  chemically synthesized
tactcacaggtttcagagat

SEQ ID NO: 286837 - DNA, 20 bp, Artificial Sequence
  chemically synthesized
taatatactcacaggtttca

SEQ ID NO: 286838 - DNA, 20 bp, Artificial Sequence
  chemically synthesized
ggtaatatactcacaggttt

SEQ ID NO: 286839 - DNA, 20 bp, Artificial Sequence
  chemically synthesized
ccctaatctctgaaacctgt

SEQ ID NO: 286840 - DNA, 20 bp, Artificial Sequence
  chemically synthesized
ctttctggtaatatactcac

SEQ ID NO: 286841 - DNA, 20 bp, Artificial Sequence
  chemically synthesized
cctttctggtaatatactca

SEQ ID NO: 286842 - DNA, 20 bp, Artificial Sequence
  chemically synthesized
gaaacctgtgagtatattac

SEQ ID NO: 286843 - DNA, 20 bp, Artificial Sequence
  chemically synthesized
cctgtgagtatattaccaga

SEQ ID NO: 286844 - DNA, 20 bp, Artificial Sequence
  chemically synthesized
ctgtgagtatattaccagaa

SEQ ID NO: 286845 - DNA, 20 bp, Artificial Sequence
  chemically synthesized
cacatctgcaaagtcctttc

SEQ ID NO: 286846 - DNA, 20 bp, Artificial Sequence
  chemically synthesized
tattaccagaaaggactttg

SEQ ID NO: 286847 - DNA, 20 bp, Artificial Sequence
  chemically synthesized
ttaatgtaatcacatctgca

SEQ ID NO: 286848 - DNA, 20 bp, Artificial Sequence
  chemically synthesized
tttgcagatgtgattacatt

SEQ ID NO: 286849 - DNA, 20 bp, Artificial Sequence
  chemically synthesized
ttgcagatgtgattacatta

SEQ ID NO: 286850 - DNA, 20 bp, Artificial Sequence
  chemically synthesized
gtgattacattaaggattct

SEQ ID NO: 286851 - DNA, 20 bp, Artificial Sequence
  chemically synthesized
ttacattaaggattctgaga

SEQ ID NO: 286852 - DNA, 20 bp, Artificial Sequence
  chemically synthesized
tacattaaggattctgagat

SEQ ID NO: 286853 - DNA, 20 bp, Artificial Sequence
  chemically synthesized
acattaaggattctgagatg

SEQ ID NO: 286854 - DNA, 20 bp, Artificial Sequence
  chemically synthesized
attaaggattctgagatggg

SEQ ID NO: 286855 - DNA, 20 bp, Artificial Sequence
  chemically synthesized
ccagtataatctccccatct

SEQ ID NO: 286856 - DNA, 20 bp, Artificial Sequence
  chemically synthesized
ctgagatggggagattatac

SEQ ID NO: 286857 - DNA, 20 bp, Artificial Sequence
  chemically synthesized
ttatgccctggtggatgatc

SEQ ID NO: 286858 - DNA, 20 bp, Artificial Sequence
  chemically synthesized
gattatactggatcatccac

SEQ ID NO: 286859 - DNA, 20 bp, Artificial Sequence
  chemically synthesized
attatactggatcatccacc

SEQ ID NO: 286860 - DNA, 20 bp, Artificial Sequence
  chemically synthesized
ttatactggatcatccacca

SEQ ID NO: 286861 - DNA, 20 bp, Artificial Sequence
  chemically synthesized
gtgattacattatgccctgg

SEQ ID NO: 286862 - DNA, 20 bp, Artificial Sequence
  chemically synthesized
tttgtgattacattatgccc

SEQ ID NO: 286863 - DNA, 20 bp, Artificial Sequence
  chemically synthesized
cagggcataatgtaatcaca

SEQ ID NO: 286864 - DNA, 20 bp, Artificial Sequence
  chemically synthesized
agggcataatgtaatcacaa

SEQ ID NO: 286865 - DNA, 20 bp, Artificial Sequence
  chemically synthesized
atcacaaaggtcctaattaa

SEQ ID NO: 286866 - DNA, 20 bp, Artificial Sequence
  chemically synthesized
tcacaaaggtcctaattaaa

SEQ ID NO: 286867 - DNA, 20 bp, Artificial Sequence
  chemically synthesized
gtgttgacttccttttaatt

SEQ ID NO: 286868 - DNA, 20 bp, Artificial Sequence
  chemically synthesized
tgtgttgacttccttttaat

SEQ ID NO: 286869 - DNA, 20 bp, Artificial Sequence
  chemically synthesized
caaaggtcctaattaaaagg

SEQ ID NO: 286870 - DNA, 20 bp, Artificial Sequence
  chemically synthesized
taattaaaaggaagtcaaca

SEQ ID NO: 286871 - DNA, 20 bp, Artificial Sequence
  chemically synthesized
aattaaaaggaagtcaacac

SEQ ID NO: 286872 - DNA, 20 bp, Artificial Sequence
  chemically synthesized
attaaaaggaagtcaacaca

SEQ ID NO: 286873 - DNA, 20 bp, Artificial Sequence
  chemically synthesized
aaggaagtcaacacagggaa

SEQ ID NO: 286874 - DNA, 20 bp, Artificial Sequence
  chemically synthesized
aggaagtcaacacagggaac

SEQ ID NO: 286875 - DNA, 20 bp, Artificial Sequence
  chemically synthesized
agtcaacacagggaacagga

SEQ ID NO: 286876 - DNA, 20 bp, Artificial Sequence
  chemically synthesized
gtcaacacagggaacaggat

SEQ ID NO: 286877 - DNA, 20 bp, Artificial Sequence
  chemically synthesized
tcaacacagggaacaggata

SEQ ID NO: 286878 - DNA, 20 bp, Artificial Sequence
  chemically synthesized
cacagggaacaggataggga

SEQ ID NO: 286879 - DNA, 20 bp, Artificial Sequence
  chemically synthesized
acagggaacaggatagggaa

SEQ ID NO: 286880 - DNA, 20 bp, Artificial Sequence
  chemically synthesized
gggaacaggatagggaaagg

SEQ ID NO: 286881 - DNA, 20 bp, Artificial Sequence
  chemically synthesized
ggaacaggatagggaaagga

SEQ ID NO: 286882 - DNA, 20 bp, Artificial Sequence
  chemically synthesized
caggatagggaaaggaaggt

SEQ ID NO: 286883 - DNA, 20 bp, Artificial Sequence
  chemically synthesized
gatagggaaaggaaggtgag

SEQ ID NO: 286884 - DNA, 20 bp, Artificial Sequence
  chemically synthesized
atagggaaaggaaggtgaga

SEQ ID NO: 286885 - DNA, 20 bp, Artificial Sequence
  chemically synthesized
agggaaaggaaggtgagaag

SEQ ID NO: 286886 - DNA, 20 bp, Artificial Sequence
  chemically synthesized
ggaaaggaaggtgagaagga

SEQ ID NO: 286887 - DNA, 20 bp, Artificial Sequence
  chemically synthesized
gaaaggaaggtgagaaggag

SEQ ID NO: 286888 - DNA, 20 bp, Artificial Sequence
  chemically synthesized
aggaaggtgagaaggagagg

SEQ ID NO: 286889 - DNA, 20 bp, Artificial Sequence
  chemically synthesized
aggtgagaaggagaggtaga

SEQ ID NO: 286890 - DNA, 20 bp, Artificial Sequence
  chemically synthesized
gtgagaaggagaggtagaaa

SEQ ID NO: 286891 - DNA, 20 bp, Artificial Sequence
  chemically synthesized
gagaaggagaggtagaaaga

SEQ ID NO: 286892 - DNA, 20 bp, Artificial Sequence
  chemically synthesized
agaaggagaggtagaaagag

SEQ ID NO: 286893 - DNA, 20 bp, Artificial Sequence
  chemically synthesized
gaaggagaggtagaaagaga

SEQ ID NO: 286894 - DNA, 20 bp, Artificial Sequence
  chemically synthesized
aggagaggtagaaagagagg

SEQ ID NO: 286895 - DNA, 20 bp, Artificial Sequence
  chemically synthesized
gagaggtagaaagagaggga

SEQ ID NO: 286896 - DNA, 20 bp, Artificial Sequence
  chemically synthesized
agaggtagaaagagagggag

SEQ ID NO: 286897 - DNA, 20 bp, Artificial Sequence
  chemically synthesized
gaggtagaaagagagggaga

SEQ ID NO: 286898 - DNA, 20 bp, Artificial Sequence
  chemically synthesized
ggtagaaagagagggagagg

SEQ ID NO: 286899 - DNA, 20 bp, Artificial Sequence
  chemically synthesized
gaaagagagggagagggaga

SEQ ID NO: 286900 - DNA, 20 bp, Artificial Sequence
  chemically synthesized
gagagggagagggagataga

SEQ ID NO: 286901 - DNA, 20 bp, Artificial Sequence
  chemically synthesized
agagggagagggagatagac

SEQ ID NO: 286902 - DNA, 20 bp, Artificial Sequence
  chemically synthesized
gagggagagggagatagaca

SEQ ID NO: 286903 - DNA, 20 bp, Artificial Sequence
  chemically synthesized
gggagagggagatagacagg

SEQ ID NO: 286904 - DNA, 20 bp, Artificial Sequence
  chemically synthesized
gagagggagatagacaggga

SEQ ID NO: 286905 - DNA, 20 bp, Artificial Sequence
  chemically synthesized
gagggagatagacagggaga

SEQ ID NO: 286906 - DNA, 20 bp, Artificial Sequence
  chemically synthesized
agggagagagaaattgacac

SEQ ID NO: 286907 - DNA, 20 bp, Artificial Sequence
  chemically synthesized
gtcagcagtgtaacatcatc

SEQ ID NO: 286908 - DNA, 20 bp, Artificial Sequence
  chemically synthesized
tcctccatcttcaaagtcag

SEQ ID NO: 286909 - DNA, 20 bp, Artificial Sequence
  chemically synthesized
atgttacactgctgactttg

SEQ ID NO: 286910 - DNA, 20 bp, Artificial Sequence
  chemically synthesized
ccatcctccatcttcaaagt

SEQ ID NO: 286911 - DNA, 20 bp, Artificial Sequence
  chemically synthesized
tacactgctgactttgaaga

SEQ ID NO: 286912 - DNA, 20 bp, Artificial Sequence
  chemically synthesized
gtccccatcctccatcttca

SEQ ID NO: 286913 - DNA, 20 bp, Artificial Sequence
  chemically synthesized
cactgctgactttgaagatg

SEQ ID NO: 286914 - DNA, 20 bp, Artificial Sequence
  chemically synthesized
actgctgactttgaagatgg

SEQ ID NO: 286915 - DNA, 20 bp, Artificial Sequence
  chemically synthesized
ctgactttgaagatggagga

SEQ ID NO: 286916 - DNA, 20 bp, Artificial Sequence
  chemically synthesized
tgactttgaagatggaggat

SEQ ID NO: 286917 - DNA, 20 bp, Artificial Sequence
  chemically synthesized
gactttgaagatggaggatg

SEQ ID NO: 286918 - DNA, 20 bp, Artificial Sequence
  chemically synthesized
aagatggaggatggggacat

SEQ ID NO: 286919 - DNA, 20 bp, Artificial Sequence
  chemically synthesized
ggaggatggggacatgagac

SEQ ID NO: 286920 - DNA, 20 bp, Artificial Sequence
  chemically synthesized
gaggatggggacatgagaca

SEQ ID NO: 286921 - DNA, 20 bp, Artificial Sequence
  chemically synthesized
catgagacaaggaatgcttc

SEQ ID NO: 286922 - DNA, 20 bp, Artificial Sequence
  chemically synthesized
gagacaaggaatgcttctag

SEQ ID NO: 286923 - DNA, 20 bp, Artificial Sequence
  chemically synthesized
ttggcatttttagcttctag

SEQ ID NO: 286924 - DNA, 20 bp, Artificial Sequence
  chemically synthesized
ttattggcatttttagcttc

SEQ ID NO: 286925 - DNA, 20 bp, Artificial Sequence
  chemically synthesized
gtctgttttattggcatttt

SEQ ID NO: 286926 - DNA, 20 bp, Artificial Sequence
  chemically synthesized
agctaaaaatgccaataaaa

SEQ ID NO: 286927 - DNA, 20 bp, Artificial Sequence
  chemically synthesized
tgcgacagagtctgttttat

SEQ ID NO: 286928 - DNA, 20 bp, Artificial Sequence
  chemically synthesized
ataaaacagactctgtcgca

SEQ ID NO: 286929 - DNA, 20 bp, Artificial Sequence
  chemically synthesized
gttttggaggctttgcgaca

SEQ ID NO: 286930 - DNA, 20 bp, Artificial Sequence
  chemically synthesized
ctgttttggaggctttgcga

SEQ ID NO: 286931 - DNA, 20 bp, Artificial Sequence
  chemically synthesized
ctgtcgcaaagcctccaaaa

SEQ ID NO: 286932 - DNA, 20 bp, Artificial Sequence
  chemically synthesized
caggactttgtctgttttgg

SEQ ID NO: 286933 - DNA, 20 bp, Artificial Sequence
  chemically synthesized
gcaggactttgtctgttttg

SEQ ID NO: 286934 - DNA, 20 bp, Artificial Sequence
  chemically synthesized
cagcaggactttgtctgttt

SEQ ID NO: 286935 - DNA, 20 bp, Artificial Sequence
  chemically synthesized
caaagcctccaaaacagaca

SEQ ID NO: 286936 - DNA, 20 bp, Artificial Sequence
  chemically synthesized
gctaaaattaaggtgtcagc

SEQ ID NO: 286937 - DNA, 20 bp, Artificial Sequence
  chemically synthesized
ggctaaaattaaggtgtcag

SEQ ID NO: 286938 - DNA, 20 bp, Artificial Sequence
  chemically synthesized
gtgggctaaaattaaggtgt

SEQ ID NO: 286939 - DNA, 20 bp, Artificial Sequence
  chemically synthesized
tcctgctgacaccttaattt

SEQ ID NO: 286940 - DNA, 20 bp, Artificial Sequence
  chemically synthesized
gtctcagtgggctaaaatta

SEQ ID NO: 286941 - DNA, 20 bp, Artificial Sequence
  chemically synthesized
agtctcagtgggctaaaatt

SEQ ID NO: 286942 - DNA, 20 bp, Artificial Sequence
  chemically synthesized
caccttaattttagcccact

SEQ ID NO: 286943 - DNA, 20 bp, Artificial Sequence
  chemically synthesized
agttcaggattagtctcagt

SEQ ID NO: 286944 - DNA, 20 bp, Artificial Sequence
  chemically synthesized
aagttcaggattagtctcag

SEQ ID NO: 286945 - DNA, 20 bp, Artificial Sequence
  chemically synthesized
caaaagttcaggattagtct

SEQ ID NO: 286946 - DNA, 20 bp, Artificial Sequence
  chemically synthesized
ggaagtcaaaagttcaggat

SEQ ID NO: 286947 - DNA, 20 bp, Artificial Sequence
  chemically synthesized
gttctggaagtcaaaagttc

SEQ ID NO: 286948 - DNA, 20 bp, Artificial Sequence
  chemically synthesized
agttctggaagtcaaaagtt

SEQ ID NO: 286949 - DNA, 20 bp, Artificial Sequence
  chemically synthesized
attagagttctggaagtcaa

SEQ ID NO: 286950 - DNA, 20 bp, Artificial Sequence
  chemically synthesized
aatcctgaacttttgacttc

SEQ ID NO: 286951 - DNA, 20 bp, Artificial Sequence
  chemically synthesized
caaatttattagagttctgg

SEQ ID NO: 286952 - DNA, 20 bp, Artificial Sequence
  chemically synthesized
acacaaatttattagagttc

SEQ ID NO: 286953 - DNA, 20 bp, Artificial Sequence
  chemically synthesized
caagcaacacaaatttatta

SEQ ID NO: 286954 - DNA, 20 bp, Artificial Sequence
  chemically synthesized
ttcaagcaacacaaatttat

SEQ ID NO: 286955 - DNA, 20 bp, Artificial Sequence
  chemically synthesized
taataaatttgtgttgcttg

SEQ ID NO: 286956 - DNA, 20 bp, Artificial Sequence
  chemically synthesized
gccggaaatttaataacttc

SEQ ID NO: 286957 - DNA, 20 bp, Artificial Sequence
  chemically synthesized
gcttgaagttattaaatttc

SEQ ID NO: 286958 - DNA, 20 bp, Artificial Sequence
  chemically synthesized
tggcactcctaacaaattgc

SEQ ID NO: 286959 - DNA, 20 bp, Artificial Sequence
  chemically synthesized
ttaaatttccggcaatttgt

SEQ ID NO: 286960 - DNA, 20 bp, Artificial Sequence
  chemically synthesized
taaatttccggcaatttgtt

SEQ ID NO: 286961 - DNA, 20 bp, Artificial Sequence
  chemically synthesized
aatttccggcaatttgttag

SEQ ID NO: 286962 - DNA, 20 bp, Artificial Sequence
  chemically synthesized
gcaatttgttaggagtgcca

SEQ ID NO: 286963 - DNA, 20 bp, Artificial Sequence
  chemically synthesized
caatttgttaggagtgccat

SEQ ID NO: 286964 - DNA, 20 bp, Artificial Sequence
  chemically synthesized
gtaggtgtattcatttccta

SEQ ID NO: 286965 - DNA, 20 bp, Artificial Sequence
  chemically synthesized
ttctagtgaaggaggaaggt

SEQ ID NO: 286966 - DNA, 20 bp, Artificial Sequence
  chemically synthesized
attctagtgaaggaggaagg

SEQ ID NO: 286967 - DNA, 20 bp, Artificial Sequence
  chemically synthesized
cacattctagtgaaggagga

SEQ ID NO: 286968 - DNA, 20 bp, Artificial Sequence
  chemically synthesized
ccacattctagtgaaggagg

SEQ ID NO: 286969 - DNA, 20 bp, Artificial Sequence
  chemically synthesized
cacctaccttcctccttcac

SEQ ID NO: 286970 - DNA, 20 bp, Artificial Sequence
  chemically synthesized
agcccacattctagtgaagg

SEQ ID NO: 286971 - DNA, 20 bp, Artificial Sequence
  chemically synthesized
gagcccacattctagtgaag

SEQ ID NO: 286972 - DNA, 20 bp, Artificial Sequence
  chemically synthesized
aggagcccacattctagtga

SEQ ID NO: 286973 - DNA, 20 bp, Artificial Sequence
  chemically synthesized
aaggagcccacattctagtg

SEQ ID NO: 286974 - DNA, 20 bp, Artificial Sequence
  chemically synthesized
cttcctccttcactagaatg

SEQ ID NO: 286975 - DNA, 20 bp, Artificial Sequence
  chemically synthesized
ttcctccttcactagaatgt

SEQ ID NO: 286976 - DNA, 20 bp, Artificial Sequence
  chemically synthesized
ttatcaaggagcccacattc

SEQ ID NO: 286977 - DNA, 20 bp, Artificial Sequence
  chemically synthesized
acatggctcttgttatcaag

SEQ ID NO: 286978 - DNA, 20 bp, Artificial Sequence
  chemically synthesized
aatgtgggctccttgataac

SEQ ID NO: 286979 - DNA, 20 bp, Artificial Sequence
  chemically synthesized
ttacatggctcttgttatca

SEQ ID NO: 286980 - DNA, 20 bp, Artificial Sequence
  chemically synthesized
attacatggctcttgttatc

SEQ ID NO: 286981 - DNA, 20 bp, Artificial Sequence
  chemically synthesized
tgtgggctccttgataacaa

SEQ ID NO: 286982 - DNA, 20 bp, Artificial Sequence
  chemically synthesized
cctaagagggcacaattaca

SEQ ID NO: 286983 - DNA, 20 bp, Artificial Sequence
  chemically synthesized
gccatgtaattgtgccctct

SEQ ID NO: 286984 - DNA, 20 bp, Artificial Sequence
  chemically synthesized
ccatgtaattgtgccctctt

SEQ ID NO: 286985 - DNA, 20 bp, Artificial Sequence
  chemically synthesized
tcaagaccagtggcctaaga

SEQ ID NO: 286986 - DNA, 20 bp, Artificial Sequence
  chemically synthesized
gtcaagaccagtggcctaag

SEQ ID NO: 286987 - DNA, 20 bp, Artificial Sequence
  chemically synthesized
tgtcaagaccagtggcctaa

SEQ ID NO: 286988 - DNA, 20 bp, Artificial Sequence
  chemically synthesized
attgtgccctcttaggccac

SEQ ID NO: 286989 - DNA, 20 bp, Artificial Sequence
  chemically synthesized
tttgtcaagaccagtggcct

SEQ ID NO: 286990 - DNA, 20 bp, Artificial Sequence
  chemically synthesized
ctattatttgtcaagaccag

SEQ ID NO: 286991 - DNA, 20 bp, Artificial Sequence
  chemically synthesized
tatctattatttgtcaagac

SEQ ID NO: 286992 - DNA, 20 bp, Artificial Sequence
  chemically synthesized
gaaaatatctattatttgtc

SEQ ID NO: 286993 - DNA, 20 bp, Artificial Sequence
  chemically synthesized
ccactggtcttgacaaataa

SEQ ID NO: 286994 - DNA, 20 bp, Artificial Sequence
  chemically synthesized
aaataatagatattttcatg

SEQ ID NO: 286995 - DNA, 20 bp, Artificial Sequence
  chemically synthesized
attttcatgcagtatttaca

SEQ ID NO: 286996 - DNA, 20 bp, Artificial Sequence
  chemically synthesized
ttttcatgcagtatttacat

SEQ ID NO: 286997 - DNA, 20 bp, Artificial Sequence
  chemically synthesized
gcatgtacacatatgtttat

SEQ ID NO: 286998 - DNA, 20 bp, Artificial Sequence
  chemically synthesized
tacacatatgtttataagta

SEQ ID NO: 286999 - DNA, 20 bp, Artificial Sequence
  chemically synthesized
ctaaaacattttttaatgca

SEQ ID NO: 287000 - DNA, 20 bp, Artificial Sequence
  chemically synthesized
ctatgcattaaaaaatgttt

SEQ ID NO: 287001 - DNA, 20 bp, Artificial Sequence
  chemically synthesized
tatgcattaaaaaatgtttt

SEQ ID NO: 287002 - DNA, 20 bp, Artificial Sequence
  chemically synthesized
aaaaatgttttaggtttgct

SEQ ID NO: 287003 - DNA, 20 bp, Artificial Sequence
  chemically synthesized
tttaggtttgcttagtgctt

SEQ ID NO: 287004 - DNA, 20 bp, Artificial Sequence
  chemically synthesized
cttttacaaaccaaagcact

SEQ ID NO: 287005 - DNA, 20 bp, Artificial Sequence
  chemically synthesized
tgcttaccttttacaaacca

SEQ ID NO: 287006 - DNA, 20 bp, Artificial Sequence
  chemically synthesized
cttagtgctttggtttgtaa

SEQ ID NO: 287007 - DNA, 20 bp, Artificial Sequence
  chemically synthesized
ttagtgctttggtttgtaaa

SEQ ID NO: 287008 - DNA, 20 bp, Artificial Sequence
  chemically synthesized
tgctttggtttgtaaaaggt

SEQ ID NO: 287009 - DNA, 20 bp, Artificial Sequence
  chemically synthesized
aaaaggtaagcacaaaaact

SEQ ID NO: 287010 - DNA, 20 bp, Artificial Sequence
  chemically synthesized
aggtaagcacaaaaactaag

SEQ ID NO: 287011 - DNA, 20 bp, Artificial Sequence
  chemically synthesized
aagcacaaaaactaagcagc

SEQ ID NO: 287012 - DNA, 20 bp, Artificial Sequence
  chemically synthesized
taaatcccagtctagctgct

SEQ ID NO: 287013 - DNA, 20 bp, Artificial Sequence
  chemically synthesized
caaaaactaagcagctagac

SEQ ID NO: 287014 - DNA, 20 bp, Artificial Sequence
  chemically synthesized
aaaaactaagcagctagact

SEQ ID NO: 287015 - DNA, 20 bp, Artificial Sequence
  chemically synthesized
cctggatttaaatcccagtc

SEQ ID NO: 287016 - DNA, 20 bp, Artificial Sequence
  chemically synthesized
atgctcctggatttaaatcc

SEQ ID NO: 287017 - DNA, 20 bp, Artificial Sequence
  chemically synthesized
gctagactgggatttaaatc

SEQ ID NO: 287018 - DNA, 20 bp, Artificial Sequence
  chemically synthesized
ctagactgggatttaaatcc

SEQ ID NO: 287019 - DNA, 20 bp, Artificial Sequence
  chemically synthesized
agactgggatttaaatccag

SEQ ID NO: 287020 - DNA, 20 bp, Artificial Sequence
  chemically synthesized
acattgcaacaatatgctcc

SEQ ID NO: 287021 - DNA, 20 bp, Artificial Sequence
  chemically synthesized
tcgaaaacgttatggtatga

SEQ ID NO: 287022 - DNA, 20 bp, Artificial Sequence
  chemically synthesized
aggaaatgtcgaaaacgtta

SEQ ID NO: 287023 - DNA, 20 bp, Artificial Sequence
  chemically synthesized
cgttttcgacatttccttcc

SEQ ID NO: 287024 - DNA, 20 bp, Artificial Sequence
  chemically synthesized
gacaaatgttaatgctggga

SEQ ID NO: 287025 - DNA, 20 bp, Artificial Sequence
  chemically synthesized
tgacaaatgttaatgctggg

SEQ ID NO: 287026 - DNA, 20 bp, Artificial Sequence
  chemically synthesized
ttgtgacaaatgttaatgct

SEQ ID NO: 287027 - DNA, 20 bp, Artificial Sequence
  chemically synthesized
attgtgacaaatgttaatgc

SEQ ID NO: 287028 - DNA, 20 bp, Artificial Sequence
  chemically synthesized
gtcacaataattgaccactc

SEQ ID NO: 287029 - DNA, 20 bp, Artificial Sequence
  chemically synthesized
tcacaataattgaccactca

SEQ ID NO: 287030 - DNA, 20 bp, Artificial Sequence
  chemically synthesized
cacaataattgaccactcaa

SEQ ID NO: 287031 - DNA, 20 bp, Artificial Sequence
  chemically synthesized
taagtaatgtgtcccttgag

SEQ ID NO: 287032 - DNA, 20 bp, Artificial Sequence
  chemically synthesized
aggtaagtaatgtgtccctt

SEQ ID NO: 287033 - DNA, 20 bp, Artificial Sequence
  chemically synthesized
cctaaaatattcaataaggt

SEQ ID NO: 287034 - DNA, 20 bp, Artificial Sequence
  chemically synthesized
aaagcctaaaatattcaata

SEQ ID NO: 287035 - DNA, 20 bp, Artificial Sequence
  chemically synthesized
aaaagcctaaaatattcaat

SEQ ID NO: 287036 - DNA, 20 bp, Artificial Sequence
  chemically synthesized
acttaccttattgaatattt

SEQ ID NO: 287037 - DNA, 20 bp, Artificial Sequence
  chemically synthesized
cttaccttattgaatatttt

SEQ ID NO: 287038 - DNA, 20 bp, Artificial Sequence
  chemically synthesized
tattgaatattttaggcttt

SEQ ID NO: 287039 - DNA, 20 bp, Artificial Sequence
  chemically synthesized
acaattgcattaaggtctaa

SEQ ID NO: 287040 - DNA, 20 bp, Artificial Sequence
  chemically synthesized
gtaaaccaacaattgcatta

SEQ ID NO: 287041 - DNA, 20 bp, Artificial Sequence
  chemically synthesized
agtaaaccaacaattgcatt

SEQ ID NO: 287042 - DNA, 20 bp, Artificial Sequence
  chemically synthesized
ttagaccttaatgcaattgt

SEQ ID NO: 287043 - DNA, 20 bp, Artificial Sequence
  chemically synthesized
ccactcaagctaaagaaaaa

SEQ ID NO: 287044 - DNA, 20 bp, Artificial Sequence
  chemically synthesized
gttggtttactgtttttctt

SEQ ID NO: 287045 - DNA, 20 bp, Artificial Sequence
  chemically synthesized
ttactgtttttctttagctt

SEQ ID NO: 287046 - DNA, 20 bp, Artificial Sequence
  chemically synthesized
actaataaccactcaagcta

SEQ ID NO: 287047 - DNA, 20 bp, Artificial Sequence
  chemically synthesized
ctgtttttctttagcttgag

SEQ ID NO: 287048 - DNA, 20 bp, Artificial Sequence
  chemically synthesized
caccatactaataaccactc

SEQ ID NO: 287049 - DNA, 20 bp, Artificial Sequence
  chemically synthesized
tctttagcttgagtggttat

SEQ ID NO: 287050 - DNA, 20 bp, Artificial Sequence
  chemically synthesized
agcttgagtggttattagta

SEQ ID NO: 287051 - DNA, 20 bp, Artificial Sequence
  chemically synthesized
ttgagtggttattagtatgg

SEQ ID NO: 287052 - DNA, 20 bp, Artificial Sequence
  chemically synthesized
cttgacttaatttgtttgaa

SEQ ID NO: 287053 - DNA, 20 bp, Artificial Sequence
  chemically synthesized
tggcactattcaaacaaatt

SEQ ID NO: 287054 - DNA, 20 bp, Artificial Sequence
  chemically synthesized
ctattcaaacaaattaagtc

SEQ ID NO: 287055 - DNA, 20 bp, Artificial Sequence
  chemically synthesized
tattcaaacaaattaagtca

SEQ ID NO: 287056 - DNA, 20 bp, Artificial Sequence
  chemically synthesized
attcaaacaaattaagtcaa

SEQ ID NO: 287057 - DNA, 20 bp, Artificial Sequence
  chemically synthesized
caaattaagtcaagggaatt

SEQ ID NO: 287058 - DNA, 20 bp, Artificial Sequence
  chemically synthesized
aagtcaagggaatttggttt

SEQ ID NO: 287059 - DNA, 20 bp, Artificial Sequence
  chemically synthesized
agtcaagggaatttggtttc

SEQ ID NO: 287060 - DNA, 20 bp, Artificial Sequence
  chemically synthesized
caagggaatttggtttcagg

SEQ ID NO: 287061 - DNA, 20 bp, Artificial Sequence
  chemically synthesized
gggaatttggtttcaggaag

SEQ ID NO: 287062 - DNA, 20 bp, Artificial Sequence
  chemically synthesized
ggaatttggtttcaggaaga

SEQ ID NO: 287063 - DNA, 20 bp, Artificial Sequence
  chemically synthesized
gtttcaggaagaaggtgatg

SEQ ID NO: 287064 - DNA, 20 bp, Artificial Sequence
  chemically synthesized
aaggtgatgtggtaaaattt

SEQ ID NO: 287065 - DNA, 20 bp, Artificial Sequence
  chemically synthesized
atataattacaaattcgata

SEQ ID NO: 287066 - DNA, 20 bp, Artificial Sequence
  chemically synthesized
attcgatatggtgataaaat

SEQ ID NO: 287067 - DNA, 20 bp, Artificial Sequence
  chemically synthesized
aatgttacatatgtaatata

SEQ ID NO: 287068 - DNA, 20 bp, Artificial Sequence
  chemically synthesized
acattaatatacatatacaa

SEQ ID NO: 287069 - DNA, 20 bp, Artificial Sequence
  chemically synthesized
cattaatatacatatacaac

SEQ ID NO: 287070 - DNA, 20 bp, Artificial Sequence
  chemically synthesized
atatgtgatatatattacat

SEQ ID NO: 287071 - DNA, 20 bp, Artificial Sequence
  chemically synthesized
atatatatatacgtgtataa

SEQ ID NO: 287072 - DNA, 20 bp, Artificial Sequence
  chemically synthesized
tatatatatacatatatata

SEQ ID NO: 287073 - DNA, 20 bp, Artificial Sequence
  chemically synthesized
atatatacatatatatatgg

SEQ ID NO: 287074 - DNA, 20 bp, Artificial Sequence
  chemically synthesized
atgtgtgttattggcatttt

SEQ ID NO: 287075 - DNA, 20 bp, Artificial Sequence
  chemically synthesized
tgaaagagaatgtgtgttat

SEQ ID NO: 287076 - DNA, 20 bp, Artificial Sequence
  chemically synthesized
ataacacacattctctttca

SEQ ID NO: 287077 - DNA, 20 bp, Artificial Sequence
  chemically synthesized
ctgttttggagactttgaaa

SEQ ID NO: 287078 - DNA, 20 bp, Artificial Sequence
  chemically synthesized
gtctgttttggagactttga

SEQ ID NO: 287079 - DNA, 20 bp, Artificial Sequence
  chemically synthesized
ctctttcaaagtctccaaaa

SEQ ID NO: 287080 - DNA, 20 bp, Artificial Sequence
  chemically synthesized
gcagaactgtgtctgttttg

SEQ ID NO: 287081 - DNA, 20 bp, Artificial Sequence
  chemically synthesized
tagcagaactgtgtctgttt

SEQ ID NO: 287082 - DNA, 20 bp, Artificial Sequence
  chemically synthesized
caaagtctccaaaacagaca

SEQ ID NO: 287083 - DNA, 20 bp, Artificial Sequence
  chemically synthesized
ggctaaaattaaggtgttag

SEQ ID NO: 287084 - DNA, 20 bp, Artificial Sequence
  chemically synthesized
gtgggctaaaattaaggtgt

SEQ ID NO: 287085 - DNA, 20 bp, Artificial Sequence
  chemically synthesized
ttctgctaacaccttaattt

SEQ ID NO: 287086 - DNA, 20 bp, Artificial Sequence
  chemically synthesized
atctctgtgggctaaaatta

SEQ ID NO: 287087 - DNA, 20 bp, Artificial Sequence
  chemically synthesized
aatctctgtgggctaaaatt

SEQ ID NO: 287088 - DNA, 20 bp, Artificial Sequence
  chemically synthesized
aacaccttaattttagccca

SEQ ID NO: 287089 - DNA, 20 bp, Artificial Sequence
  chemically synthesized
caccttaattttagcccaca

SEQ ID NO: 287090 - DNA, 20 bp, Artificial Sequence
  chemically synthesized
agttcagaattaatctctgt

SEQ ID NO: 287091 - DNA, 20 bp, Artificial Sequence
  chemically synthesized
aagttcagaattaatctctg

SEQ ID NO: 287092 - DNA, 20 bp, Artificial Sequence
  chemically synthesized
tgttctggaggtcagaagtt

SEQ ID NO: 287093 - DNA, 20 bp, Artificial Sequence
  chemically synthesized
attactgttctggaggtcag

SEQ ID NO: 287094 - DNA, 20 bp, Artificial Sequence
  chemically synthesized
aattctgaacttctgacctc

SEQ ID NO: 287095 - DNA, 20 bp, Artificial Sequence
  chemically synthesized
tacattactgttctggaggt

SEQ ID NO: 287096 - DNA, 20 bp, Artificial Sequence
  chemically synthesized
tgaacttctgacctccagaa

SEQ ID NO: 287097 - DNA, 20 bp, Artificial Sequence
  chemically synthesized
ttattacattactgttctgg

SEQ ID NO: 287098 - DNA, 20 bp, Artificial Sequence
  chemically synthesized
tttattacattactgttctg

SEQ ID NO: 287099 - DNA, 20 bp, Artificial Sequence
  chemically synthesized
aatttattacattactgttc

SEQ ID NO: 287100 - DNA, 20 bp, Artificial Sequence
  chemically synthesized
taataaatttgtgttgtttg

SEQ ID NO: 287101 - DNA, 20 bp, Artificial Sequence
  chemically synthesized
agaaattagcagaaatttaa

SEQ ID NO: 287102 - DNA, 20 bp, Artificial Sequence
  chemically synthesized
tgatactcctaagaaattag

SEQ ID NO: 287103 - DNA, 20 bp, Artificial Sequence
  chemically synthesized
ttaaatttctgctaatttct

SEQ ID NO: 287104 - DNA, 20 bp, Artificial Sequence
  chemically synthesized
taaatttctgctaatttctt

SEQ ID NO: 287105 - DNA, 20 bp, Artificial Sequence
  chemically synthesized
ctatgatactcctaagaaat

SEQ ID NO: 287106 - DNA, 20 bp, Artificial Sequence
  chemically synthesized
aatttctgctaatttcttag

SEQ ID NO: 287107 - DNA, 20 bp, Artificial Sequence
  chemically synthesized
taatgtcctatgatactcct

SEQ ID NO: 287108 - DNA, 20 bp, Artificial Sequence
  chemically synthesized
ctaatttcttaggagtatca

SEQ ID NO: 287109 - DNA, 20 bp, Artificial Sequence
  chemically synthesized
taatttcttaggagtatcat

SEQ ID NO: 287110 - DNA, 20 bp, Artificial Sequence
  chemically synthesized
tatatgtgcagtagaaatgt

SEQ ID NO: 287111 - DNA, 20 bp, Artificial Sequence
  chemically synthesized
gtatatgtgcagtagaaatg

SEQ ID NO: 287112 - DNA, 20 bp, Artificial Sequence
  chemically synthesized
ccatatatgtatatgtgcag

SEQ ID NO: 287113 - DNA, 20 bp, Artificial Sequence
  chemically synthesized
actccatatatgtatatgtg

SEQ ID NO: 287114 - DNA, 20 bp, Artificial Sequence
  chemically synthesized
ctactgcacatatacatata

SEQ ID NO: 287115 - DNA, 20 bp, Artificial Sequence
  chemically synthesized
actgcacatatacatatatg

SEQ ID NO: 287116 - DNA, 20 bp, Artificial Sequence
  chemically synthesized
atatatggagttatacataa

SEQ ID NO: 287117 - DNA, 20 bp, Artificial Sequence
  chemically synthesized
tatatggagttatacataat

SEQ ID NO: 287118 - DNA, 20 bp, Artificial Sequence
  chemically synthesized
gtgctattatatataaaata

SEQ ID NO: 287119 - DNA, 20 bp, Artificial Sequence
  chemically synthesized
tcaccatattttatatataa

SEQ ID NO: 287120 - DNA, 20 bp, Artificial Sequence
  chemically synthesized
tttatatataatagcacata

SEQ ID NO: 287121 - DNA, 20 bp, Artificial Sequence
  chemically synthesized
tatataatagcacatataga

SEQ ID NO: 287122 - DNA, 20 bp, Artificial Sequence
  chemically synthesized
aatagcacatatagacagca

SEQ ID NO: 287123 - DNA, 20 bp, Artificial Sequence
  chemically synthesized
ttgctacttataaaaagtag

SEQ ID NO: 287124 - DNA, 20 bp, Artificial Sequence
  chemically synthesized
ttttgctacttataaaaagt

SEQ ID NO: 287125 - DNA, 20 bp, Artificial Sequence
  chemically synthesized
gttttgctacttataaaaag

SEQ ID NO: 287126 - DNA, 20 bp, Artificial Sequence
  chemically synthesized
agttgactcctactttttat

SEQ ID NO: 287127 - DNA, 20 bp, Artificial Sequence
  chemically synthesized
gctgttttgctacttataaa

SEQ ID NO: 287128 - DNA, 20 bp, Artificial Sequence
  chemically synthesized
tgactcctactttttataag

SEQ ID NO: 287129 - DNA, 20 bp, Artificial Sequence
  chemically synthesized
actttttataagtagcaaaa

SEQ ID NO: 287130 - DNA, 20 bp, Artificial Sequence
  chemically synthesized
ttttataagtagcaaaacag

SEQ ID NO: 287131 - DNA, 20 bp, Artificial Sequence
  chemically synthesized
tagcaaaacagcagaaatga

SEQ ID NO: 287132 - DNA, 20 bp, Artificial Sequence
  chemically synthesized
agcaaaacagcagaaatgaa

SEQ ID NO: 287133 - DNA, 20 bp, Artificial Sequence
  chemically synthesized
agcagaaatgaaaggtaata

SEQ ID NO: 287134 - DNA, 20 bp, Artificial Sequence
  chemically synthesized
gcagaaatgaaaggtaatat

SEQ ID NO: 287135 - DNA, 20 bp, Artificial Sequence
  chemically synthesized
cattttatatatataatgta

SEQ ID NO: 287136 - DNA, 20 bp, Artificial Sequence
  chemically synthesized
tgtatatatacattatacag

SEQ ID NO: 287137 - DNA, 20 bp, Artificial Sequence
  chemically synthesized
atgtatatatacattataca

SEQ ID NO: 287138 - DNA, 20 bp, Artificial Sequence
  chemically synthesized
ttatgtatatatacattata

SEQ ID NO: 287139 - DNA, 20 bp, Artificial Sequence
  chemically synthesized
atatatacataacttttttc

SEQ ID NO: 287140 - DNA, 20 bp, Artificial Sequence
  chemically synthesized
tttagcttatgactagaaaa

SEQ ID NO: 287141 - DNA, 20 bp, Artificial Sequence
  chemically synthesized
cataacttttttctagtcat

SEQ ID NO: 287142 - DNA, 20 bp, Artificial Sequence
  chemically synthesized
gtaatcatttagcttatgac

SEQ ID NO: 287143 - DNA, 20 bp, Artificial Sequence
  chemically synthesized
ttaagatacgggtaatcatt

SEQ ID NO: 287144 - DNA, 20 bp, Artificial Sequence
  chemically synthesized
ctggttgtcttttaagatac

SEQ ID NO: 287145 - DNA, 20 bp, Artificial Sequence
  chemically synthesized
tctggttgtcttttaagata

SEQ ID NO: 287146 - DNA, 20 bp, Artificial Sequence
  chemically synthesized
aatgattacccgtatcttaa

SEQ ID NO: 287147 - DNA, 20 bp, Artificial Sequence
  chemically synthesized
atttagtctggttgtctttt

SEQ ID NO: 287148 - DNA, 20 bp, Artificial Sequence
  chemically synthesized
cccgtatcttaaaagacaac

SEQ ID NO: 287149 - DNA, 20 bp, Artificial Sequence
  chemically synthesized
taaaagacaaccagactaaa

SEQ ID NO: 287150 - DNA, 20 bp, Artificial Sequence
  chemically synthesized
aaccaatcatccatttagtc

SEQ ID NO: 287151 - DNA, 20 bp, Artificial Sequence
  chemically synthesized
ttcaaaaccaatcatccatt

SEQ ID NO: 287152 - DNA, 20 bp, Artificial Sequence
  chemically synthesized
aaccagactaaatggatgat

SEQ ID NO: 287153 - DNA, 20 bp, Artificial Sequence
  chemically synthesized
ataggaattaaacatgtttt

SEQ ID NO: 287154 - DNA, 20 bp, Artificial Sequence
  chemically synthesized
aaaacatgtttaattcctat

SEQ ID NO: 287155 - DNA, 20 bp, Artificial Sequence
  chemically synthesized
ctattttcaccattaccaat

SEQ ID NO: 287156 - DNA, 20 bp, Artificial Sequence
  chemically synthesized
tgtttaattcctattggtaa

SEQ ID NO: 287157 - DNA, 20 bp, Artificial Sequence
  chemically synthesized
tctattttcaccattaccaa

SEQ ID NO: 287158 - DNA, 20 bp, Artificial Sequence
  chemically synthesized
cctattggtaatggtgaaaa

SEQ ID NO: 287159 - DNA, 20 bp, Artificial Sequence
  chemically synthesized
aggagttttctcagtgtttt

SEQ ID NO: 287160 - DNA, 20 bp, Artificial Sequence
  chemically synthesized
aaattcattctaaaaacact

SEQ ID NO: 287161 - DNA, 20 bp, Artificial Sequence
  chemically synthesized
gaaaagaataggagttttct

SEQ ID NO: 287162 - DNA, 20 bp, Artificial Sequence
  chemically synthesized
tccttctaggaaaagaatag

SEQ ID NO: 287163 - DNA, 20 bp, Artificial Sequence
  chemically synthesized
attccttctaggaaaagaat

SEQ ID NO: 287164 - DNA, 20 bp, Artificial Sequence
  chemically synthesized
tattccttctaggaaaagaa

SEQ ID NO: 287165 - DNA, 20 bp, Artificial Sequence
  chemically synthesized
gaaaactcctattcttttcc

SEQ ID NO: 287166 - DNA, 20 bp, Artificial Sequence
  chemically synthesized
aactcctattcttttcctag

SEQ ID NO: 287167 - DNA, 20 bp, Artificial Sequence
  chemically synthesized
ttgcttattccttctaggaa

SEQ ID NO: 287168 - DNA, 20 bp, Artificial Sequence
  chemically synthesized
actcctattcttttcctaga

SEQ ID NO: 287169 - DNA, 20 bp, Artificial Sequence
  chemically synthesized
gcgatttgcttattccttct

SEQ ID NO: 287170 - DNA, 20 bp, Artificial Sequence
  chemically synthesized
ggcgatttgcttattccttc

SEQ ID NO: 287171 - DNA, 20 bp, Artificial Sequence
  chemically synthesized
attcttttcctagaaggaat

SEQ ID NO: 287172 - DNA, 20 bp, Artificial Sequence
  chemically synthesized
catgagtcttttacaaagga

SEQ ID NO: 287173 - DNA, 20 bp, Artificial Sequence
  chemically synthesized
caaatcgccatcctttgtaa

SEQ ID NO: 287174 - DNA, 20 bp, Artificial Sequence
  chemically synthesized
aagacatgagtcttttacaa

SEQ ID NO: 287175 - DNA, 20 bp, Artificial Sequence
  chemically synthesized
aaagacatgagtcttttaca

SEQ ID NO: 287176 - DNA, 20 bp, Artificial Sequence
  chemically synthesized
gtgagaagatgaaaagacat

SEQ ID NO: 287177 - DNA, 20 bp, Artificial Sequence
  chemically synthesized
aaagttagtgagaagatgaa

SEQ ID NO: 287178 - DNA, 20 bp, Artificial Sequence
  chemically synthesized
catctttcaaagttagtgag

SEQ ID NO: 287179 - DNA, 20 bp, Artificial Sequence
  chemically synthesized
cagcatctttcaaagttagt

SEQ ID NO: 287180 - DNA, 20 bp, Artificial Sequence
  chemically synthesized
catcttctcactaactttga

SEQ ID NO: 287181 - DNA, 20 bp, Artificial Sequence
  chemically synthesized
ccttcagcatctttcaaagt

SEQ ID NO: 287182 - DNA, 20 bp, Artificial Sequence
  chemically synthesized
ttgaccttcagcatctttca

SEQ ID NO: 287183 - DNA, 20 bp, Artificial Sequence
  chemically synthesized
actaactttgaaagatgctg

SEQ ID NO: 287184 - DNA, 20 bp, Artificial Sequence
  chemically synthesized
ctaactttgaaagatgctga

SEQ ID NO: 287185 - DNA, 20 bp, Artificial Sequence
  chemically synthesized
gtacataagcatttgacctt

SEQ ID NO: 287186 - DNA, 20 bp, Artificial Sequence
  chemically synthesized
tgtaaactgtaaaggtacat

SEQ ID NO: 287187 - DNA, 20 bp, Artificial Sequence
  chemically synthesized
caaatgcttatgtaccttta

SEQ ID NO: 287188 - DNA, 20 bp, Artificial Sequence
  chemically synthesized
cgatacactgtaaactgtaa

SEQ ID NO: 287189 - DNA, 20 bp, Artificial Sequence
  chemically synthesized
acgatacactgtaaactgta

SEQ ID NO: 287190 - DNA, 20 bp, Artificial Sequence
  chemically synthesized
ttatgtacctttacagttta

SEQ ID NO: 287191 - DNA, 20 bp, Artificial Sequence
  chemically synthesized
tacagtttacagtgtatcgt

SEQ ID NO: 287192 - DNA, 20 bp, Artificial Sequence
  chemically synthesized
acagtttacagtgtatcgtt

SEQ ID NO: 287193 - DNA, 20 bp, Artificial Sequence
  chemically synthesized
cagtttacagtgtatcgtta

SEQ ID NO: 287194 - DNA, 20 bp, Artificial Sequence
  chemically synthesized
tgtatcgttagggaaaaaac

SEQ ID NO: 287195 - DNA, 20 bp, Artificial Sequence
  chemically synthesized
aaaaacaagtaaataaaaat

SEQ ID NO: 287196 - DNA, 20 bp, Artificial Sequence
  chemically synthesized
aaaacaagtaaataaaaatg

SEQ ID NO: 287197 - DNA, 20 bp, Artificial Sequence
  chemically synthesized
aaacaagtaaataaaaatga

SEQ ID NO: 287198 - DNA, 20 bp, Artificial Sequence
  chemically synthesized
caagtaaataaaaatgaggg

SEQ ID NO: 287199 - DNA, 20 bp, Artificial Sequence
  chemically synthesized
taaataaaaatgagggtaga

SEQ ID NO: 287200 - DNA, 20 bp, Artificial Sequence
  chemically synthesized
ccgaaaaattcaggtaattc

SEQ ID NO: 287201 - DNA, 20 bp, Artificial Sequence
  chemically synthesized
gaataaactccgaaaaattc

SEQ ID NO: 287202 - DNA, 20 bp, Artificial Sequence
  chemically synthesized
cttgaattacctgaattttt

SEQ ID NO: 287203 - DNA, 20 bp, Artificial Sequence
  chemically synthesized
tgaataaactccgaaaaatt

SEQ ID NO: 287204 - DNA, 20 bp, Artificial Sequence
  chemically synthesized
tgaattacctgaatttttcg

SEQ ID NO: 287205 - DNA, 20 bp, Artificial Sequence
  chemically synthesized
agtttattcatttgctcctc

SEQ ID NO: 287206 - DNA, 20 bp, Artificial Sequence
  chemically synthesized
agcattgtcaaaagctagag

SEQ ID NO: 287207 - DNA, 20 bp, Artificial Sequence
  chemically synthesized
tgagcattgtcaaaagctag

SEQ ID NO: 287208 - DNA, 20 bp, Artificial Sequence
  chemically synthesized
ttgagcattgtcaaaagcta

SEQ ID NO: 287209 - DNA, 20 bp, Artificial Sequence
  chemically synthesized
ggttgagcattgtcaaaagc

SEQ ID NO: 287210 - DNA, 20 bp, Artificial Sequence
  chemically synthesized
agctggttgagcattgtcaa

SEQ ID NO: 287211 - DNA, 20 bp, Artificial Sequence
  chemically synthesized
agcttttgacaatgctcaac

SEQ ID NO: 287212 - DNA, 20 bp, Artificial Sequence
  chemically synthesized
tttgacaatgctcaaccagc

SEQ ID NO: 287213 - DNA, 20 bp, Artificial Sequence
  chemically synthesized
agctctcctcccagctggtt

SEQ ID NO: 287214 - DNA, 20 bp, Artificial Sequence
  chemically synthesized
ttgacaatgctcaaccagct

SEQ ID NO: 287215 - DNA, 20 bp, Artificial Sequence
  chemically synthesized
gacaatgctcaaccagctgg

SEQ ID NO: 287216 - DNA, 20 bp, Artificial Sequence
  chemically synthesized
acaatgctcaaccagctggg

SEQ ID NO: 287217 - DNA, 20 bp, Artificial Sequence
  chemically synthesized
gaagaagctctcctcccagc

SEQ ID NO: 287218 - DNA, 20 bp, Artificial Sequence
  chemically synthesized
aatgctcaaccagctgggag

SEQ ID NO: 287219 - DNA, 20 bp, Artificial Sequence
  chemically synthesized
tgctcaaccagctgggagga

SEQ ID NO: 287220 - DNA, 20 bp, Artificial Sequence
  chemically synthesized
gctggaagaagctctcctcc

SEQ ID NO: 287221 - DNA, 20 bp, Artificial Sequence
  chemically synthesized
gctgggaggagagcttcttc

SEQ ID NO: 287222 - DNA, 20 bp, Artificial Sequence
  chemically synthesized
aaattgagggacgctggaag

SEQ ID NO: 287223 - DNA, 20 bp, Artificial Sequence
  chemically synthesized
aagaaattgagggacgctgg

SEQ ID NO: 287224 - DNA, 20 bp, Artificial Sequence
  chemically synthesized
ttgaagaaattgagggacgc

SEQ ID NO: 287225 - DNA, 20 bp, Artificial Sequence
  chemically synthesized
tcagaatttgaagaaattga

SEQ ID NO: 287226 - DNA, 20 bp, Artificial Sequence
  chemically synthesized
atcagaatttgaagaaattg

SEQ ID NO: 287227 - DNA, 20 bp, Artificial Sequence
  chemically synthesized
aatcagaatttgaagaaatt

SEQ ID NO: 287228 - DNA, 20 bp, Artificial Sequence
  chemically synthesized
gaaatatcaatcagaatttg

SEQ ID NO: 287229 - DNA, 20 bp, Artificial Sequence
  chemically synthesized
aattagccggaaatatcaat

SEQ ID NO: 287230 - DNA, 20 bp, Artificial Sequence
  chemically synthesized
caaattctgattgatatttc

SEQ ID NO: 287231 - DNA, 20 bp, Artificial Sequence
  chemically synthesized
aagcgccctctgaaattagc

SEQ ID NO: 287232 - DNA, 20 bp, Artificial Sequence
  chemically synthesized
ttgatatttccggctaattt

SEQ ID NO: 287233 - DNA, 20 bp, Artificial Sequence
  chemically synthesized
gatatttccggctaatttca

SEQ ID NO: 287234 - DNA, 20 bp, Artificial Sequence
  chemically synthesized
atatttccggctaatttcag

SEQ ID NO: 287235 - DNA, 20 bp, Artificial Sequence
  chemically synthesized
aagaaagcgccctctgaaat

SEQ ID NO: 287236 - DNA, 20 bp, Artificial Sequence
  chemically synthesized
tatttccggctaatttcaga

SEQ ID NO: 287237 - DNA, 20 bp, Artificial Sequence
  chemically synthesized
tgtgaaagagatgtcgaaga

SEQ ID NO: 287238 - DNA, 20 bp, Artificial Sequence
  chemically synthesized
ccactgtgaaagagatgtcg

SEQ ID NO: 287239 - DNA, 20 bp, Artificial Sequence
  chemically synthesized
tttcttcgacatctctttca

SEQ ID NO: 287240 - DNA, 20 bp, Artificial Sequence
  chemically synthesized
atctcagcaccactgtgaaa

SEQ ID NO: 287241 - DNA, 20 bp, Artificial Sequence
  chemically synthesized
cttcgacatctctttcacag

SEQ ID NO: 287242 - DNA, 20 bp, Artificial Sequence
  chemically synthesized
ctatctcagcaccactgtga

SEQ ID NO: 287243 - DNA, 20 bp, Artificial Sequence
  chemically synthesized
atctctttcacagtggtgct

SEQ ID NO: 287244 - DNA, 20 bp, Artificial Sequence
  chemically synthesized
ctttcacagtggtgctgaga

SEQ ID NO: 287245 - DNA, 20 bp, Artificial Sequence
  chemically synthesized
caaagtggcctatactatct

SEQ ID NO: 287246 - DNA, 20 bp, Artificial Sequence
  chemically synthesized
acagtggtgctgagatagta

SEQ ID NO: 287247 - DNA, 20 bp, Artificial Sequence
  chemically synthesized
cagtggtgctgagatagtat

SEQ ID NO: 287248 - DNA, 20 bp, Artificial Sequence
  chemically synthesized
tctctgcaagagcaacaaag

SEQ ID NO: 287249 - DNA, 20 bp, Artificial Sequence
  chemically synthesized
agttctctgcaagagcaaca

SEQ ID NO: 287250 - DNA, 20 bp, Artificial Sequence
  chemically synthesized
aggccactttgttgctcttg

SEQ ID NO: 287251 - DNA, 20 bp, Artificial Sequence
  chemically synthesized
gccactttgttgctcttgca

SEQ ID NO: 287252 - DNA, 20 bp, Artificial Sequence
  chemically synthesized
ctttacaaagttctctgcaa

SEQ ID NO: 287253 - DNA, 20 bp, Artificial Sequence
  chemically synthesized
ggctttacaaagttctctgc

SEQ ID NO: 287254 - DNA, 20 bp, Artificial Sequence
  chemically synthesized
ctcttgcagagaactttgta

SEQ ID NO: 287255 - DNA, 20 bp, Artificial Sequence
  chemically synthesized
attgttttttaggctttaca

SEQ ID NO: 287256 - DNA, 20 bp, Artificial Sequence
  chemically synthesized
tatttaaaaaattgtttttt

SEQ ID NO: 287257 - DNA, 20 bp, Artificial Sequence
  chemically synthesized
gtatttaaaaaattgttttt

SEQ ID NO: 287258 - DNA, 20 bp, Artificial Sequence
  chemically synthesized
caattattattcatcaatta

SEQ ID NO: 287259 - DNA, 20 bp, Artificial Sequence
  chemically synthesized
tcaattattattcatcaatt

SEQ ID NO: 287260 - DNA, 20 bp, Artificial Sequence
  chemically synthesized
atcaattattattcatcaat

SEQ ID NO: 287261 - DNA, 20 bp, Artificial Sequence
  chemically synthesized
attgatgaataataattgat

SEQ ID NO: 287262 - DNA, 20 bp, Artificial Sequence
  chemically synthesized
gaataataattgatgagttt

SEQ ID NO: 287263 - DNA, 20 bp, Artificial Sequence
  chemically synthesized
aatcatatagatttcaagta

SEQ ID NO: 287264 - DNA, 20 bp, Artificial Sequence
  chemically synthesized
gtttgaatcatatagatttc

SEQ ID NO: 287265 - DNA, 20 bp, Artificial Sequence
  chemically synthesized
gtttacatgtttgaatcata

SEQ ID NO: 287266 - DNA, 20 bp, Artificial Sequence
  chemically synthesized
atgattcaaacatgtaaaca

SEQ ID NO: 287267 - DNA, 20 bp, Artificial Sequence
  chemically synthesized
attcaaacatgtaaacaaag

SEQ ID NO: 287268 - DNA, 20 bp, Artificial Sequence
  chemically synthesized
caaagtagatgatcttctat

SEQ ID NO: 287269 - DNA, 20 bp, Artificial Sequence
  chemically synthesized
tagaagtttataactgatag

SEQ ID NO: 287270 - DNA, 20 bp, Artificial Sequence
  chemically synthesized
cactagaagtttataactga

SEQ ID NO: 287271 - DNA, 20 bp, Artificial Sequence
  chemically synthesized
ttctatcagttataaacttc

SEQ ID NO: 287272 - DNA, 20 bp, Artificial Sequence
  chemically synthesized
tatcagttataaacttctag

SEQ ID NO: 287273 - DNA, 20 bp, Artificial Sequence
  chemically synthesized
aaaatttaaattaccactag

SEQ ID NO: 287274 - DNA, 20 bp, Artificial Sequence
  chemically synthesized
tgtaaaatttaaattaccac

SEQ ID NO: 287275 - DNA, 20 bp, Artificial Sequence
  chemically synthesized
taaattttacatattatcct

SEQ ID NO: 287276 - DNA, 20 bp, Artificial Sequence
  chemically synthesized
aattttacatattatcctaa

SEQ ID NO: 287277 - DNA, 20 bp, Artificial Sequence
  chemically synthesized
ataatattcaagttactctt

SEQ ID NO: 287278 - DNA, 20 bp, Artificial Sequence
  chemically synthesized
aataatattcaagttactct

SEQ ID NO: 287279 - DNA, 20 bp, Artificial Sequence
  chemically synthesized
aataccactaaataatattc

SEQ ID NO: 287280 - DNA, 20 bp, Artificial Sequence
  chemically synthesized
agagtaacttgaatattatt

SEQ ID NO: 287281 - DNA, 20 bp, Artificial Sequence
  chemically synthesized
gtaacttgaatattatttag

SEQ ID NO: 287282 - DNA, 20 bp, Artificial Sequence
  chemically synthesized
tgttcagaaaaatacatatg

SEQ ID NO: 287283 - DNA, 20 bp, Artificial Sequence
  chemically synthesized
attgttcagaaaaatacata

SEQ ID NO: 287284 - DNA, 20 bp, Artificial Sequence
  chemically synthesized
gagatatatttgacattgtt

SEQ ID NO: 287285 - DNA, 20 bp, Artificial Sequence
  chemically synthesized
gctctgtaagatatagtttt

SEQ ID NO: 287286 - DNA, 20 bp, Artificial Sequence
  chemically synthesized
tatctcaaaactatatctta

SEQ ID NO: 287287 - DNA, 20 bp, Artificial Sequence
  chemically synthesized
ctttttggctctgtaagata

SEQ ID NO: 287288 - DNA, 20 bp, Artificial Sequence
  chemically synthesized
tctcaaaactatatcttaca

SEQ ID NO: 287289 - DNA, 20 bp, Artificial Sequence
  chemically synthesized
ccaaaactttttggctctgt

SEQ ID NO: 287290 - DNA, 20 bp, Artificial Sequence
  chemically synthesized
ctatatcttacagagccaaa

SEQ ID NO: 287291 - DNA, 20 bp, Artificial Sequence
  chemically synthesized
ttagatgcaccaaaactttt

SEQ ID NO: 287292 - DNA, 20 bp, Artificial Sequence
  chemically synthesized
cttacagagccaaaaagttt

SEQ ID NO: 287293 - DNA, 20 bp, Artificial Sequence
  chemically synthesized
tatacttaattcagtaaaat

SEQ ID NO: 287294 - DNA, 20 bp, Artificial Sequence
  chemically synthesized
gcatctaattttactgaatt

SEQ ID NO: 287295 - DNA, 20 bp, Artificial Sequence
  chemically synthesized
attaatatatatacttaatt

SEQ ID NO: 287296 - DNA, 20 bp, Artificial Sequence
  chemically synthesized
cattaactgtatcacaaatg

SEQ ID NO: 287297 - DNA, 20 bp, Artificial Sequence
  chemically synthesized
taataactgcatttgtgata

SEQ ID NO: 287298 - DNA, 20 bp, Artificial Sequence
  chemically synthesized
tgcatttgtgatacagttaa

SEQ ID NO: 287299 - DNA, 20 bp, Artificial Sequence
  chemically synthesized
catttgtgatacagttaatg

SEQ ID NO: 287300 - DNA, 20 bp, Artificial Sequence
  chemically synthesized
gagttgaaattaattatact

SEQ ID NO: 287301 - DNA, 20 bp, Artificial Sequence
  chemically synthesized
aattaattatactgagcttt

SEQ ID NO: 287302 - DNA, 20 bp, Artificial Sequence
  chemically synthesized
attaattatactgagctttc

SEQ ID NO: 287303 - DNA, 20 bp, Artificial Sequence
  chemically synthesized
agtttactttcctgaaagct

SEQ ID NO: 287304 - DNA, 20 bp, Artificial Sequence
  chemically synthesized
attatactgagctttcagga

SEQ ID NO: 287305 - DNA, 20 bp, Artificial Sequence
  chemically synthesized
tgtagagtttactttcctga

SEQ ID NO: 287306 - DNA, 20 bp, Artificial Sequence
  chemically synthesized
attagctatagttttatgta

SEQ ID NO: 287307 - DNA, 20 bp, Artificial Sequence
  chemically synthesized
ttattagctatagttttatg

SEQ ID NO: 287308 - DNA, 20 bp, Artificial Sequence
  chemically synthesized
gtaaactctacataaaacta

SEQ ID NO: 287309 - DNA, 20 bp, Artificial Sequence
  chemically synthesized
tatatcaatattattagcta

SEQ ID NO: 287310 - DNA, 20 bp, Artificial Sequence
  chemically synthesized
attccatatatcaatattat

SEQ ID NO: 287311 - DNA, 20 bp, Artificial Sequence
  chemically synthesized
tagctaataatattgatata

SEQ ID NO: 287312 - DNA, 20 bp, Artificial Sequence
  chemically synthesized
aataatattgatatatggaa

SEQ ID NO: 287313 - DNA, 20 bp, Artificial Sequence
  chemically synthesized
aagtacatagattgttcaat

SEQ ID NO: 287314 - DNA, 20 bp, Artificial Sequence
  chemically synthesized
ttgaaaatatattaagtaca

SEQ ID NO: 287315 - DNA, 20 bp, Artificial Sequence
  chemically synthesized
acattttttgaaaatatatt

SEQ ID NO: 287316 - DNA, 20 bp, Artificial Sequence
  chemically synthesized
aaaaatgttattctgttatg

SEQ ID NO: 287317 - DNA, 20 bp, Artificial Sequence
  chemically synthesized
cccaccataatactacataa

SEQ ID NO: 287318 - DNA, 20 bp, Artificial Sequence
  chemically synthesized
tattctgttatgtagtatta

SEQ ID NO: 287319 - DNA, 20 bp, Artificial Sequence
  chemically synthesized
tctgttatgtagtattatgg

SEQ ID NO: 287320 - DNA, 20 bp, Artificial Sequence
  chemically synthesized
ctgttatgtagtattatggt

SEQ ID NO: 287321 - DNA, 20 bp, Artificial Sequence
  chemically synthesized
gtagtattatggtgggattc

SEQ ID NO: 287322 - DNA, 20 bp, Artificial Sequence
  chemically synthesized
tagtattatggtgggattca

SEQ ID NO: 287323 - DNA, 20 bp, Artificial Sequence
  chemically synthesized
attatggtgggattcaagga

SEQ ID NO: 287324 - DNA, 20 bp, Artificial Sequence
  chemically synthesized
gggattcaaggatagttttg

SEQ ID NO: 287325 - DNA, 20 bp, Artificial Sequence
  chemically synthesized
gattcaaggatagttttgtg

SEQ ID NO: 287326 - DNA, 20 bp, Artificial Sequence
  chemically synthesized
ttacatgtgttatacagaat

SEQ ID NO: 287327 - DNA, 20 bp, Artificial Sequence
  chemically synthesized
aagaaattacatgtgttata

SEQ ID NO: 287328 - DNA, 20 bp, Artificial Sequence
  chemically synthesized
ataacacatgtaatttctta

SEQ ID NO: 287329 - DNA, 20 bp, Artificial Sequence
  chemically synthesized
acacatgtaatttcttacag

SEQ ID NO: 287330 - DNA, 20 bp, Artificial Sequence
  chemically synthesized
cacatgtaatttcttacagt

SEQ ID NO: 287331 - DNA, 20 bp, Artificial Sequence
  chemically synthesized
taaagttatgatcctactgt

SEQ ID NO: 287332 - DNA, 20 bp, Artificial Sequence
  chemically synthesized
ttacagtaggatcataactt

SEQ ID NO: 287333 - DNA, 20 bp, Artificial Sequence
  chemically synthesized
tattgaacaggggaagtcta

SEQ ID NO: 287334 - DNA, 20 bp, Artificial Sequence
  chemically synthesized
aagtaaatattgaacagggg

SEQ ID NO: 287335 - DNA, 20 bp, Artificial Sequence
  chemically synthesized
ttaaagtaaatattgaacag

SEQ ID NO: 287336 - DNA, 20 bp, Artificial Sequence
  chemically synthesized
attaaagtaaatattgaaca

SEQ ID NO: 287337 - DNA, 20 bp, Artificial Sequence
  chemically synthesized
cattaaagtaaatattgaac

SEQ ID NO: 287338 - DNA, 20 bp, Artificial Sequence
  chemically synthesized
acattaaagtaaatattgaa

SEQ ID NO: 287339 - DNA, 20 bp, Artificial Sequence
  chemically synthesized
ataaagtaaaagtaacatta

SEQ ID NO: 287340 - DNA, 20 bp, Artificial Sequence
  chemically synthesized
tttattattttataaagtaa

SEQ ID NO: 287341 - DNA, 20 bp, Artificial Sequence
  chemically synthesized
tgagcctttattattttata

SEQ ID NO: 287342 - DNA, 20 bp, Artificial Sequence
  chemically synthesized
ttttactttataaaataata

SEQ ID NO: 287343 - DNA, 20 bp, Artificial Sequence
  chemically synthesized
tttactttataaaataataa

SEQ ID NO: 287344 - DNA, 20 bp, Artificial Sequence
  chemically synthesized
tttttttccatttttgtcat

SEQ ID NO: 287345 - DNA, 20 bp, Artificial Sequence
  chemically synthesized
ataaaggctcatgacaaaaa

SEQ ID NO: 287346 - DNA, 20 bp, Artificial Sequence
  chemically synthesized
acaaaaatggaaaaaaaaac

SEQ ID NO: 287347 - DNA, 20 bp, Artificial Sequence
  chemically synthesized
gaaaaaaaaaccagaactac

SEQ ID NO: 287348 - DNA, 20 bp, Artificial Sequence
  chemically synthesized
atataaagtactagtagttc

SEQ ID NO: 287349 - DNA, 20 bp, Artificial Sequence
  chemically synthesized
aaatttatataaagtactag

SEQ ID NO: 287350 - DNA, 20 bp, Artificial Sequence
  chemically synthesized
tgaaaatttatataaagtac

SEQ ID NO: 287351 - DNA, 20 bp, Artificial Sequence
  chemically synthesized
acaaattgaaaatttatata

SEQ ID NO: 287352 - DNA, 20 bp, Artificial Sequence
  chemically synthesized
ttttcaatttgttctatgta

SEQ ID NO: 287353 - DNA, 20 bp, Artificial Sequence
  chemically synthesized
atttaatatttagctataca

SEQ ID NO: 287354 - DNA, 20 bp, Artificial Sequence
  chemically synthesized
atgatcatatatttaatatt

SEQ ID NO: 287355 - DNA, 20 bp, Artificial Sequence
  chemically synthesized
atcatgtatgcacatataaa

SEQ ID NO: 287356 - DNA, 20 bp, Artificial Sequence
  chemically synthesized
ataggtcacattatagggga

SEQ ID NO: 287357 - DNA, 20 bp, Artificial Sequence
  chemically synthesized
tgatataggtcacattatag

SEQ ID NO: 287358 - DNA, 20 bp, Artificial Sequence
  chemically synthesized
ttgatataggtcacattata

SEQ ID NO: 287359 - DNA, 20 bp, Artificial Sequence
  chemically synthesized
gttgatataggtcacattat

SEQ ID NO: 287360 - DNA, 20 bp, Artificial Sequence
  chemically synthesized
ggttgatataggtcacatta

SEQ ID NO: 287361 - DNA, 20 bp, Artificial Sequence
  chemically synthesized
gacaaattttgggttgatat

SEQ ID NO: 287362 - DNA, 20 bp, Artificial Sequence
  chemically synthesized
tgacaaattttgggttgata

SEQ ID NO: 287363 - DNA, 20 bp, Artificial Sequence
  chemically synthesized
ttagatatttgacaaatttt

SEQ ID NO: 287364 - DNA, 20 bp, Artificial Sequence
  chemically synthesized
cttagatatttgacaaattt

SEQ ID NO: 287365 - DNA, 20 bp, Artificial Sequence
  chemically synthesized
ccaaaatttgtcaaatatct

SEQ ID NO: 287366 - DNA, 20 bp, Artificial Sequence
  chemically synthesized
tgtcaaatatctaagtttta

SEQ ID NO: 287367 - DNA, 20 bp, Artificial Sequence
  chemically synthesized
tactatgaaactataaaact

SEQ ID NO: 287368 - DNA, 20 bp, Artificial Sequence
  chemically synthesized
atctaagttttatagtttca

SEQ ID NO: 287369 - DNA, 20 bp, Artificial Sequence
  chemically synthesized
aagtaccaccaaataggcat

SEQ ID NO: 287370 - DNA, 20 bp, Artificial Sequence
  chemically synthesized
taagtaccaccaaataggca

SEQ ID NO: 287371 - DNA, 20 bp, Artificial Sequence
  chemically synthesized
catagtatcctatgcctatt

SEQ ID NO: 287372 - DNA, 20 bp, Artificial Sequence
  chemically synthesized
agtatcctatgcctatttgg

SEQ ID NO: 287373 - DNA, 20 bp, Artificial Sequence
  chemically synthesized
caaattaagtaccaccaaat

SEQ ID NO: 287374 - DNA, 20 bp, Artificial Sequence
  chemically synthesized
acaaattaagtaccaccaaa

SEQ ID NO: 287375 - DNA, 20 bp, Artificial Sequence
  chemically synthesized
gtaaagtaaaaaaacaaatt

SEQ ID NO: 287376 - DNA, 20 bp, Artificial Sequence
  chemically synthesized
gaaataaacttaaaaaagta

SEQ ID NO: 287377 - DNA, 20 bp, Artificial Sequence
  chemically synthesized
tttttttactttactttttt

SEQ ID NO: 287378 - DNA, 20 bp, Artificial Sequence
  chemically synthesized
aaagtgaaataaacttaaaa

SEQ ID NO: 287379 - DNA, 20 bp, Artificial Sequence
  chemically synthesized
cataggggaacaatttgaaa

SEQ ID NO: 287380 - DNA, 20 bp, Artificial Sequence
  chemically synthesized
gtctaaataatcagtcatag

SEQ ID NO: 287381 - DNA, 20 bp, Artificial Sequence
  chemically synthesized
tgtctaaataatcagtcata

SEQ ID NO: 287382 - DNA, 20 bp, Artificial Sequence
  chemically synthesized
ttgtctaaataatcagtcat

SEQ ID NO: 287383 - DNA, 20 bp, Artificial Sequence
  chemically synthesized
attgtctaaataatcagtca

SEQ ID NO: 287384 - DNA, 20 bp, Artificial Sequence
  chemically synthesized
ttcccctatgactgattatt

SEQ ID NO: 287385 - DNA, 20 bp, Artificial Sequence
  chemically synthesized
ctagatattgtctaaataat

SEQ ID NO: 287386 - DNA, 20 bp, Artificial Sequence
  chemically synthesized
ctgattatttagacaatatc

SEQ ID NO: 287387 - DNA, 20 bp, Artificial Sequence
  chemically synthesized
ctcaaagtgtagttatatgc

SEQ ID NO: 287388 - DNA, 20 bp, Artificial Sequence
  chemically synthesized
ctagcatataactacacttt

SEQ ID NO: 287389 - DNA, 20 bp, Artificial Sequence
  chemically synthesized
aaaacacctagctcaaagtg

SEQ ID NO: 287390 - DNA, 20 bp, Artificial Sequence
  chemically synthesized
catataactacactttgagc

SEQ ID NO: 287391 - DNA, 20 bp, Artificial Sequence
  chemically synthesized
atataactacactttgagct

SEQ ID NO: 287392 - DNA, 20 bp, Artificial Sequence
  chemically synthesized
acactaaaacacctagctca

SEQ ID NO: 287393 - DNA, 20 bp, Artificial Sequence
  chemically synthesized
acactttgagctaggtgttt

SEQ ID NO: 287394 - DNA, 20 bp, Artificial Sequence
  chemically synthesized
aatgctcacactaaaacacc

SEQ ID NO: 287395 - DNA, 20 bp, Artificial Sequence
  chemically synthesized
tgagctaggtgttttagtgt

SEQ ID NO: 287396 - DNA, 20 bp, Artificial Sequence
  chemically synthesized
aaaaaataattatttgacat

SEQ ID NO: 287397 - DNA, 20 bp, Artificial Sequence
  chemically synthesized
gaaaaaataattatttgaca

SEQ ID NO: 287398 - DNA, 20 bp, Artificial Sequence
  chemically synthesized
ttcaaaaacaaaaattgtaa

SEQ ID NO: 287399 - DNA, 20 bp, Artificial Sequence
  chemically synthesized
aaaaattgtaatggcttttc

SEQ ID NO: 287400 - DNA, 20 bp, Artificial Sequence
  chemically synthesized
tggaaattgttgaactagaa

SEQ ID NO: 287401 - DNA, 20 bp, Artificial Sequence
  chemically synthesized
aataatggaaattgttgaac

SEQ ID NO: 287402 - DNA, 20 bp, Artificial Sequence
  chemically synthesized
agttcaacaatttccattat

SEQ ID NO: 287403 - DNA, 20 bp, Artificial Sequence
  chemically synthesized
tgaatgtgtagaactaataa

SEQ ID NO: 287404 - DNA, 20 bp, Artificial Sequence
  chemically synthesized
gaaaactagaaatgaatgtg

SEQ ID NO: 287405 - DNA, 20 bp, Artificial Sequence
  chemically synthesized
tagttctacacattcatttc

SEQ ID NO: 287406 - DNA, 20 bp, Artificial Sequence
  chemically synthesized
aatttacaggagtggaaaac

SEQ ID NO: 287407 - DNA, 20 bp, Artificial Sequence
  chemically synthesized
ataaacataatttacaggag

SEQ ID NO: 287408 - DNA, 20 bp, Artificial Sequence
  chemically synthesized
gagataaacataatttacag

SEQ ID NO: 287409 - DNA, 20 bp, Artificial Sequence
  chemically synthesized
tagagataaacataatttac

SEQ ID NO: 287410 - DNA, 20 bp, Artificial Sequence
  chemically synthesized
atagagataaacataattta

SEQ ID NO: 287411 - DNA, 20 bp, Artificial Sequence
  chemically synthesized
attagataggtaggtagata

SEQ ID NO: 287412 - DNA, 20 bp, Artificial Sequence
  chemically synthesized
ggattagataggtaggtaga

SEQ ID NO: 287413 - DNA, 20 bp, Artificial Sequence
  chemically synthesized
ggatggattagataggtagg

SEQ ID NO: 287414 - DNA, 20 bp, Artificial Sequence
  chemically synthesized
gatggatggattagataggt

SEQ ID NO: 287415 - DNA, 20 bp, Artificial Sequence
  chemically synthesized
ggatggatggattagatagg

SEQ ID NO: 287416 - DNA, 20 bp, Artificial Sequence
  chemically synthesized
gatggatggatggattagat

SEQ ID NO: 287417 - DNA, 20 bp, Artificial Sequence
  chemically synthesized
ggatggatggatggattaga

SEQ ID NO: 287418 - DNA, 20 bp, Artificial Sequence
  chemically synthesized
tgagggatggatggatggat

SEQ ID NO: 287419 - DNA, 20 bp, Artificial Sequence
  chemically synthesized
ttgattgagggatggatgga

SEQ ID NO: 287420 - DNA, 20 bp, Artificial Sequence
  chemically synthesized
ttgattgattgagggatgga

SEQ ID NO: 287421 - DNA, 20 bp, Artificial Sequence
  chemically synthesized
gatattgattgattgaggga

SEQ ID NO: 287422 - DNA, 20 bp, Artificial Sequence
  chemically synthesized
ataggatattgattgattga

SEQ ID NO: 287423 - DNA, 20 bp, Artificial Sequence
  chemically synthesized
gataggatattgattgattg

SEQ ID NO: 287424 - DNA, 20 bp, Artificial Sequence
  chemically synthesized
agataggatattgattgatt

SEQ ID NO: 287425 - DNA, 20 bp, Artificial Sequence
  chemically synthesized
aaatggaactggagatagat

SEQ ID NO: 287426 - DNA, 20 bp, Artificial Sequence
  chemically synthesized
taaatggaactggagataga

SEQ ID NO: 287427 - DNA, 20 bp, Artificial Sequence
  chemically synthesized
atcaatatcctatctatctc

SEQ ID NO: 287428 - DNA, 20 bp, Artificial Sequence
  chemically synthesized
gatgtaaatggaactggaga

SEQ ID NO: 287429 - DNA, 20 bp, Artificial Sequence
  chemically synthesized
caaagatgtaaatggaactg

SEQ ID NO: 287430 - DNA, 20 bp, Artificial Sequence
  chemically synthesized
ctcaaagatgtaaatggaac

SEQ ID NO: 287431 - DNA, 20 bp, Artificial Sequence
  chemically synthesized
aatacactcaaagatgtaaa

SEQ ID NO: 287432 - DNA, 20 bp, Artificial Sequence
  chemically synthesized
ccagttccatttacatcttt

SEQ ID NO: 287433 - DNA, 20 bp, Artificial Sequence
  chemically synthesized
aaataatcagaatacactca

SEQ ID NO: 287434 - DNA, 20 bp, Artificial Sequence
  chemically synthesized
ctgtatctgatggaaataat

SEQ ID NO: 287435 - DNA, 20 bp, Artificial Sequence
  chemically synthesized
tgtattctgattatttccat

SEQ ID NO: 287436 - DNA, 20 bp, Artificial Sequence
  chemically synthesized
ctgattatttccatcagata

SEQ ID NO: 287437 - DNA, 20 bp, Artificial Sequence
  chemically synthesized
tccatgaaatctgtatctga

SEQ ID NO: 287438 - DNA, 20 bp, Artificial Sequence
  chemically synthesized
tccatcagatacagatttca

SEQ ID NO: 287439 - DNA, 20 bp, Artificial Sequence
  chemically synthesized
atattaatgttgtatgttat

SEQ ID NO: 287440 - DNA, 20 bp, Artificial Sequence
  chemically synthesized
tattaatgttgtatgttatt

SEQ ID NO: 287441 - DNA, 20 bp, Artificial Sequence
  chemically synthesized
tatgttattaggatgcactg

SEQ ID NO: 287442 - DNA, 20 bp, Artificial Sequence
  chemically synthesized
tgttattaggatgcactgaa

SEQ ID NO: 287443 - DNA, 20 bp, Artificial Sequence
  chemically synthesized
ttttactgaggttaactctt

SEQ ID NO: 287444 - DNA, 20 bp, Artificial Sequence
  chemically synthesized
atgcactgaagagttaacct

SEQ ID NO: 287445 - DNA, 20 bp, Artificial Sequence
  chemically synthesized
attcaatatgaattttactg

SEQ ID NO: 287446 - DNA, 20 bp, Artificial Sequence
  chemically synthesized
aattcaatatgaattttact

SEQ ID NO: 287447 - DNA, 20 bp, Artificial Sequence
  chemically synthesized
tcatattgaatttacatttc

SEQ ID NO: 287448 - DNA, 20 bp, Artificial Sequence
  chemically synthesized
tattgaatttacatttccag

SEQ ID NO: 287449 - DNA, 20 bp, Artificial Sequence
  chemically synthesized
gaatttacatttccagcagt

SEQ ID NO: 287450 - DNA, 20 bp, Artificial Sequence
  chemically synthesized
atttacatttccagcagtaa

SEQ ID NO: 287451 - DNA, 20 bp, Artificial Sequence
  chemically synthesized
taaaaattgtctcttactgc

SEQ ID NO: 287452 - DNA, 20 bp, Artificial Sequence
  chemically synthesized
tataagtaccaatttgcaag

SEQ ID NO: 287453 - DNA, 20 bp, Artificial Sequence
  chemically synthesized
ttatttcaccacttgcaaat

SEQ ID NO: 287454 - DNA, 20 bp, Artificial Sequence
  chemically synthesized
agatataagtaccaatttgc

SEQ ID NO: 287455 - DNA, 20 bp, Artificial Sequence
  chemically synthesized
tgcatacacacaaaagatat

SEQ ID NO: 287456 - DNA, 20 bp, Artificial Sequence
  chemically synthesized
actaaattgcatacacacaa

SEQ ID NO: 287457 - DNA, 20 bp, Artificial Sequence
  chemically synthesized
tcttttgtgtgtatgcaatt

SEQ ID NO: 287458 - DNA, 20 bp, Artificial Sequence
  chemically synthesized
aagtaaaaaaattacaagat

SEQ ID NO: 287459 - DNA, 20 bp, Artificial Sequence
  chemically synthesized
ggaagaagtaaaaaaattac

SEQ ID NO: 287460 - DNA, 20 bp, Artificial Sequence
  chemically synthesized
aacttaaattgtaaaggaag

SEQ ID NO: 287461 - DNA, 20 bp, Artificial Sequence
  chemically synthesized
tgtaacttaaattgtaaagg

SEQ ID NO: 287462 - DNA, 20 bp, Artificial Sequence
  chemically synthesized
aattgtaacttaaattgtaa

SEQ ID NO: 287463 - DNA, 20 bp, Artificial Sequence
  chemically synthesized
taattgtaacttaaattgta

SEQ ID NO: 287464 - DNA, 20 bp, Artificial Sequence
  chemically synthesized
tacttcttcctttacaattt

SEQ ID NO: 287465 - DNA, 20 bp, Artificial Sequence
  chemically synthesized
atttaagttacaattattca

SEQ ID NO: 287466 - DNA, 20 bp, Artificial Sequence
  chemically synthesized
tttaagttacaattattcat

SEQ ID NO: 287467 - DNA, 20 bp, Artificial Sequence
  chemically synthesized
tattcatatatgtctctttt

SEQ ID NO: 287468 - DNA, 20 bp, Artificial Sequence
  chemically synthesized
ttcatatatgtctctttttg

SEQ ID NO: 287469 - DNA, 20 bp, Artificial Sequence
  chemically synthesized
tcatatatgtctctttttgg

SEQ ID NO: 287470 - DNA, 20 bp, Artificial Sequence
  chemically synthesized
agtaaggtatcctccaaaaa

SEQ ID NO: 287471 - DNA, 20 bp, Artificial Sequence
  chemically synthesized
tgagtaaggtatcctccaaa

SEQ ID NO: 287472 - DNA, 20 bp, Artificial Sequence
  chemically synthesized
ttttggaggataccttactc

SEQ ID NO: 287473 - DNA, 20 bp, Artificial Sequence
  chemically synthesized
aaggaagaaagtcttgagta

SEQ ID NO: 287474 - DNA, 20 bp, Artificial Sequence
  chemically synthesized
taaggaagaaagtcttgagt

SEQ ID NO: 287475 - DNA, 20 bp, Artificial Sequence
  chemically synthesized
tgagtaaggaagaaagtctt

SEQ ID NO: 287476 - DNA, 20 bp, Artificial Sequence
  chemically synthesized
ttttctgtgagtaaggaaga

SEQ ID NO: 287477 - DNA, 20 bp, Artificial Sequence
  chemically synthesized
ttttttttctgtgagtaagg

SEQ ID NO: 287478 - DNA, 20 bp, Artificial Sequence
  chemically synthesized
aagactttcttccttactca

SEQ ID NO: 287479 - DNA, 20 bp, Artificial Sequence
  chemically synthesized
tctttttttttctgtgagta

SEQ ID NO: 287480 - DNA, 20 bp, Artificial Sequence
  chemically synthesized
atctttttttttctgtgagt

SEQ ID NO: 287481 - DNA, 20 bp, Artificial Sequence
  chemically synthesized
aggaatctttttttttctgt

SEQ ID NO: 287482 - DNA, 20 bp, Artificial Sequence
  chemically synthesized
tccttactcacagaaaaaaa

SEQ ID NO: 287483 - DNA, 20 bp, Artificial Sequence
  chemically synthesized
acagaaaaaaaaagattcct

SEQ ID NO: 287484 - DNA, 20 bp, Artificial Sequence
  chemically synthesized
tttaaagaaatatgatacca

SEQ ID NO: 287485 - DNA, 20 bp, Artificial Sequence
  chemically synthesized
ttttaaagaaatatgatacc

SEQ ID NO: 287486 - DNA, 20 bp, Artificial Sequence
  chemically synthesized
aaacaccagagacaatttta

SEQ ID NO: 287487 - DNA, 20 bp, Artificial Sequence
  chemically synthesized
tatttctttaaaattgtctc

SEQ ID NO: 287488 - DNA, 20 bp, Artificial Sequence
  chemically synthesized
caaacattgtaaaaacacca

SEQ ID NO: 287489 - DNA, 20 bp, Artificial Sequence
  chemically synthesized
cacaaacattgtaaaaacac

SEQ ID NO: 287490 - DNA, 20 bp, Artificial Sequence
  chemically synthesized
tggagaagcataaaaatcga

SEQ ID NO: 287491 - DNA, 20 bp, Artificial Sequence
  chemically synthesized
ttataaaaatttaggtggag

SEQ ID NO: 287492 - DNA, 20 bp, Artificial Sequence
  chemically synthesized
atgttataaaaatttaggtg

SEQ ID NO: 287493 - DNA, 20 bp, Artificial Sequence
  chemically synthesized
taatgttataaaaatttagg

SEQ ID NO: 287494 - DNA, 20 bp, Artificial Sequence
  chemically synthesized
taataatgttataaaaattt

SEQ ID NO: 287495 - DNA, 20 bp, Artificial Sequence
  chemically synthesized
ataataatgttataaaaatt

SEQ ID NO: 287496 - DNA, 20 bp, Artificial Sequence
  chemically synthesized
tttaaatattttccaaaatt

SEQ ID NO: 287497 - DNA, 20 bp, Artificial Sequence
  chemically synthesized
ttaaatattttccaaaattt

SEQ ID NO: 287498 - DNA, 20 bp, Artificial Sequence
  chemically synthesized
atgtggggaagcccaaattt

SEQ ID NO: 287499 - DNA, 20 bp, Artificial Sequence
  chemically synthesized
aatgttcaaaaaatgtgggg

SEQ ID NO: 287500 - DNA, 20 bp, Artificial Sequence
  chemically synthesized
taaaatgttcaaaaaatgtg

SEQ ID NO: 287501 - DNA, 20 bp, Artificial Sequence
  chemically synthesized
ataaaatgttcaaaaaatgt

SEQ ID NO: 287502 - DNA, 20 bp, Artificial Sequence
  chemically synthesized
aataaaatgttcaaaaaatg

SEQ ID NO: 287503 - DNA, 20 bp, Artificial Sequence
  chemically synthesized
tttgaacattttattgtatg

SEQ ID NO: 287504 - DNA, 20 bp, Artificial Sequence
  chemically synthesized
attgtatgtggtttttattt

SEQ ID NO: 287505 - DNA, 20 bp, Artificial Sequence
  chemically synthesized
tttttattttggtgtaactt

SEQ ID NO: 287506 - DNA, 20 bp, Artificial Sequence
  chemically synthesized
ttttattttggtgtaacttt

SEQ ID NO: 287507 - DNA, 20 bp, Artificial Sequence
  chemically synthesized
tttattttggtgtaactttg

SEQ ID NO: 287508 - DNA, 20 bp, Artificial Sequence
  chemically synthesized
ttattttggtgtaactttgg

SEQ ID NO: 287509 - DNA, 20 bp, Artificial Sequence
  chemically synthesized
agatatgaacatttccccca

SEQ ID NO: 287510 - DNA, 20 bp, Artificial Sequence
  chemically synthesized
aatgttcatatctttttttt

SEQ ID NO: 287511 - DNA, 20 bp, Artificial Sequence
  chemically synthesized
gtattaactaactaaaaaaa

SEQ ID NO: 287512 - DNA, 20 bp, Artificial Sequence
  chemically synthesized
ttcatatctttttttttagt

SEQ ID NO: 287513 - DNA, 20 bp, Artificial Sequence
  chemically synthesized
aattgttcataaatattatt

SEQ ID NO: 287514 - DNA, 20 bp, Artificial Sequence
  chemically synthesized
taattgttcataaatattat

SEQ ID NO: 287515 - DNA, 20 bp, Artificial Sequence
  chemically synthesized
ttccactgaaaaagatagga

SEQ ID NO: 287516 - DNA, 20 bp, Artificial Sequence
  chemically synthesized
ctatttccactgaaaaagat

SEQ ID NO: 287517 - DNA, 20 bp, Artificial Sequence
  chemically synthesized
attttctttcctatcttttt

SEQ ID NO: 287518 - DNA, 20 bp, Artificial Sequence
  chemically synthesized
actatttccactgaaaaaga

SEQ ID NO: 287519 - DNA, 20 bp, Artificial Sequence
  chemically synthesized
ttctttcctatctttttcag

SEQ ID NO: 287520 - DNA, 20 bp, Artificial Sequence
  chemically synthesized
agagactatttccactgaaa

SEQ ID NO: 287521 - DNA, 20 bp, Artificial Sequence
  chemically synthesized
cctatctttttcagtggaaa

SEQ ID NO: 287522 - DNA, 20 bp, Artificial Sequence
  chemically synthesized
aggcagttagatgagcagaa

SEQ ID NO: 287523 - DNA, 20 bp, Artificial Sequence
  chemically synthesized
aaaggcagttagatgagcag

SEQ ID NO: 287524 - DNA, 20 bp, Artificial Sequence
  chemically synthesized
agaaaaggcagttagatgag

SEQ ID NO: 287525 - DNA, 20 bp, Artificial Sequence
  chemically synthesized
acaagaaaaggcagttagat

SEQ ID NO: 287526 - DNA, 20 bp, Artificial Sequence
  chemically synthesized
aaaacacaagaaaaggcagt

SEQ ID NO: 287527 - DNA, 20 bp, Artificial Sequence
  chemically synthesized
ggagaaaacacaagaaaagg

SEQ ID NO: 287528 - DNA, 20 bp, Artificial Sequence
  chemically synthesized
agtggagaaaacacaagaaa

SEQ ID NO: 287529 - DNA, 20 bp, Artificial Sequence
  chemically synthesized
gagtggagaaaacacaagaa

SEQ ID NO: 287530 - DNA, 20 bp, Artificial Sequence
  chemically synthesized
aataagagtggagaaaacac

SEQ ID NO: 287531 - DNA, 20 bp, Artificial Sequence
  chemically synthesized
aatgtgcaagaataagagtg

SEQ ID NO: 287532 - DNA, 20 bp, Artificial Sequence
  chemically synthesized
aaaatgtgcaagaataagag

SEQ ID NO: 287533 - DNA, 20 bp, Artificial Sequence
  chemically synthesized
ataaaaatgtgcaagaataa

SEQ ID NO: 287534 - DNA, 20 bp, Artificial Sequence
  chemically synthesized
gaataaaaatgtgcaagaat

SEQ ID NO: 287535 - DNA, 20 bp, Artificial Sequence
  chemically synthesized
acataagaataaaaatgtgc

SEQ ID NO: 287536 - DNA, 20 bp, Artificial Sequence
  chemically synthesized
actagtaaacttttaaacat

SEQ ID NO: 287537 - DNA, 20 bp, Artificial Sequence
  chemically synthesized
atttttattcttatgtttaa

SEQ ID NO: 287538 - DNA, 20 bp, Artificial Sequence
  chemically synthesized
tcttatgtttaaaagtttac

SEQ ID NO: 287539 - DNA, 20 bp, Artificial Sequence
  chemically synthesized
taaaagtttactagttctat

SEQ ID NO: 287540 - DNA, 20 bp, Artificial Sequence
  chemically synthesized
aatgtgttgcctaatagaac

SEQ ID NO: 287541 - DNA, 20 bp, Artificial Sequence
  chemically synthesized
aaaagtttactagttctatt

SEQ ID NO: 287542 - DNA, 20 bp, Artificial Sequence
  chemically synthesized
tggaaaaatgtgttgcctaa

SEQ ID NO: 287543 - DNA, 20 bp, Artificial Sequence
  chemically synthesized
tattaggcaacacatttttc

SEQ ID NO: 287544 - DNA, 20 bp, Artificial Sequence
  chemically synthesized
aggcaacacatttttccaga

SEQ ID NO: 287545 - DNA, 20 bp, Artificial Sequence
  chemically synthesized
taatgattccaaagtctatc

SEQ ID NO: 287546 - DNA, 20 bp, Artificial Sequence
  chemically synthesized
acatttttccagatagactt

SEQ ID NO: 287547 - DNA, 20 bp, Artificial Sequence
  chemically synthesized
tgcttggcataatgattcca

SEQ ID NO: 287548 - DNA, 20 bp, Artificial Sequence
  chemically synthesized
gactttggaatcattatgcc

SEQ ID NO: 287549 - DNA, 20 bp, Artificial Sequence
  chemically synthesized
ttgttgtggtttttaatgct

SEQ ID NO: 287550 - DNA, 20 bp, Artificial Sequence
  chemically synthesized
agcattaaaaaccacaacaa

SEQ ID NO: 287551 - DNA, 20 bp, Artificial Sequence
  chemically synthesized
gcattaaaaaccacaacaaa

SEQ ID NO: 287552 - DNA, 20 bp, Artificial Sequence
  chemically synthesized
ttttttgtttccttttgttg

SEQ ID NO: 287553 - DNA, 20 bp, Artificial Sequence
  chemically synthesized
cacaacaaaaggaaacaaaa

SEQ ID NO: 287554 - DNA, 20 bp, Artificial Sequence
  chemically synthesized
acaacaaaaggaaacaaaaa

SEQ ID NO: 287555 - DNA, 20 bp, Artificial Sequence
  chemically synthesized
aggaaacaaaaaaggtgaaa

SEQ ID NO: 287556 - DNA, 20 bp, Artificial Sequence
  chemically synthesized
aaggtgaaacagctaccatt

SEQ ID NO: 287557 - DNA, 20 bp, Artificial Sequence
  chemically synthesized
tctactacaataccaaatgg

SEQ ID NO: 287558 - DNA, 20 bp, Artificial Sequence
  chemically synthesized
tattctactacaataccaaa

SEQ ID NO: 287559 - DNA, 20 bp, Artificial Sequence
  chemically synthesized
acagctaccatttggtattg

SEQ ID NO: 287560 - DNA, 20 bp, Artificial Sequence
  chemically synthesized
gctaccatttggtattgtag

SEQ ID NO: 287561 - DNA, 20 bp, Artificial Sequence
  chemically synthesized
tagtagaataaatatctaaa

SEQ ID NO: 287562 - DNA, 20 bp, Artificial Sequence
  chemically synthesized
agtagaataaatatctaaat

SEQ ID NO: 287563 - DNA, 20 bp, Artificial Sequence
  chemically synthesized
tcattatgtattgtcctatt

SEQ ID NO: 287564 - DNA, 20 bp, Artificial Sequence
  chemically synthesized
aataggacaatacataatga

SEQ ID NO: 287565 - DNA, 20 bp, Artificial Sequence
  chemically synthesized
tttttgaagtaatgtattca

SEQ ID NO: 287566 - DNA, 20 bp, Artificial Sequence
  chemically synthesized
gataattaaatatttttttg

SEQ ID NO: 287567 - DNA, 20 bp, Artificial Sequence
  chemically synthesized
ttatcacatagaattttttt

SEQ ID NO: 287568 - DNA, 20 bp, Artificial Sequence
  chemically synthesized
aaaaaaaattctatgtgata

SEQ ID NO: 287569 - DNA, 20 bp, Artificial Sequence
  chemically synthesized
caaatttaaactttatcaca

SEQ ID NO: 287570 - DNA, 20 bp, Artificial Sequence
  chemically synthesized
tgagataatatgtgcatttt

SEQ ID NO: 287571 - DNA, 20 bp, Artificial Sequence
  chemically synthesized
ttaaaatgcacatattatct

SEQ ID NO: 287572 - DNA, 20 bp, Artificial Sequence
  chemically synthesized
attagttatatttagaagct

SEQ ID NO: 287573 - DNA, 20 bp, Artificial Sequence
  chemically synthesized
aacgtattagttatatttag

SEQ ID NO: 287574 - DNA, 20 bp, Artificial Sequence
  chemically synthesized
gaaaacgtattagttatatt

SEQ ID NO: 287575 - DNA, 20 bp, Artificial Sequence
  chemically synthesized
ctgaagacatgaaaacgtat

SEQ ID NO: 287576 - DNA, 20 bp, Artificial Sequence
  chemically synthesized
ctaatacgttttcatgtctt

SEQ ID NO: 287577 - DNA, 20 bp, Artificial Sequence
  chemically synthesized
tcaataactttttatttctg

SEQ ID NO: 287578 - DNA, 20 bp, Artificial Sequence
  chemically synthesized
ttcatgtcttcagaaataaa

SEQ ID NO: 287579 - DNA, 20 bp, Artificial Sequence
  chemically synthesized
aagttattgaacatataatg

SEQ ID NO: 287580 - DNA, 20 bp, Artificial Sequence
  chemically synthesized
ataatgtagtattttataat

SEQ ID NO: 287581 - DNA, 20 bp, Artificial Sequence
  chemically synthesized
atgtagtattttataataag

SEQ ID NO: 287582 - DNA, 20 bp, Artificial Sequence
  chemically synthesized
tgtagtattttataataagt

SEQ ID NO: 287583 - DNA, 20 bp, Artificial Sequence
  chemically synthesized
tattttataataagtaggaa

SEQ ID NO: 287584 - DNA, 20 bp, Artificial Sequence
  chemically synthesized
attttataataagtaggaaa

SEQ ID NO: 287585 - DNA, 20 bp, Artificial Sequence
  chemically synthesized
ttttataataagtaggaaaa

SEQ ID NO: 287586 - DNA, 20 bp, Artificial Sequence
  chemically synthesized
ataataagtaggaaaagggc

SEQ ID NO: 287587 - DNA, 20 bp, Artificial Sequence
  chemically synthesized
taataagtaggaaaagggct

SEQ ID NO: 287588 - DNA, 20 bp, Artificial Sequence
  chemically synthesized
agtaggaaaagggctgggcg

SEQ ID NO: 287589 - DNA, 20 bp, Artificial Sequence
  chemically synthesized
aggaaaagggctgggcgcag

SEQ ID NO: 287590 - DNA, 20 bp, Artificial Sequence
  chemically synthesized
caggtgtgagccactgcgcc

SEQ ID NO: 287591 - DNA, 20 bp, Artificial Sequence
  chemically synthesized
agtgctgggattacaggtgt

SEQ ID NO: 287592 - DNA, 20 bp, Artificial Sequence
  chemically synthesized
gtggctcacacctgtaatcc

SEQ ID NO: 287593 - DNA, 20 bp, Artificial Sequence
  chemically synthesized
tcccaaagtgctgggattac

SEQ ID NO: 287594 - DNA, 20 bp, Artificial Sequence
  chemically synthesized
ctcccaaagtgctgggatta

SEQ ID NO: 287595 - DNA, 20 bp, Artificial Sequence
  chemically synthesized
cacctgtaatcccagcactt

SEQ ID NO: 287596 - DNA, 20 bp, Artificial Sequence
  chemically synthesized
cctcagcctcccaaagtgct

SEQ ID NO: 287597 - DNA, 20 bp, Artificial Sequence
  chemically synthesized
acctgtaatcccagcacttt

SEQ ID NO: 287598 - DNA, 20 bp, Artificial Sequence
  chemically synthesized
gcctcagcctcccaaagtgc

SEQ ID NO: 287599 - DNA, 20 bp, Artificial Sequence
  chemically synthesized
ctgtaatcccagcactttgg

SEQ ID NO: 287600 - DNA, 20 bp, Artificial Sequence
  chemically synthesized
tgtaatcccagcactttggg

SEQ ID NO: 287601 - DNA, 20 bp, Artificial Sequence
  chemically synthesized
ctgcctgcctcagcctccca

SEQ ID NO: 287602 - DNA, 20 bp, Artificial Sequence
  chemically synthesized
tcccagcactttgggaggct

SEQ ID NO: 287603 - DNA, 20 bp, Artificial Sequence
  chemically synthesized
cccagcactttgggaggctg

SEQ ID NO: 287604 - DNA, 20 bp, Artificial Sequence
  chemically synthesized
agcactttgggaggctgagg

SEQ ID NO: 287605 - DNA, 20 bp, Artificial Sequence
  chemically synthesized
gcactttgggaggctgaggc

SEQ ID NO: 287606 - DNA, 20 bp, Artificial Sequence
  chemically synthesized
ctttgggaggctgaggcagg

SEQ ID NO: 287607 - DNA, 20 bp, Artificial Sequence
  chemically synthesized
ctcagatgatctgcctgcct

SEQ ID NO: 287608 - DNA, 20 bp, Artificial Sequence
  chemically synthesized
ctgaggcaggcagatcatct

SEQ ID NO: 287609 - DNA, 20 bp, Artificial Sequence
  chemically synthesized
tgaggcaggcagatcatctg

SEQ ID NO: 287610 - DNA, 20 bp, Artificial Sequence
  chemically synthesized
gcaggcagatcatctgaggt

SEQ ID NO: 287611 - DNA, 20 bp, Artificial Sequence
  chemically synthesized
caggcagatcatctgaggtc

SEQ ID NO: 287612 - DNA, 20 bp, Artificial Sequence
  chemically synthesized
ggcagatcatctgaggtcag

SEQ ID NO: 287613 - DNA, 20 bp, Artificial Sequence
  chemically synthesized
tggtctcaaactcctgacct

SEQ ID NO: 287614 - DNA, 20 bp, Artificial Sequence
  chemically synthesized
tcatctgaggtcaggagttt

SEQ ID NO: 287615 - DNA, 20 bp, Artificial Sequence
  chemically synthesized
tgaggtcaggagtttgagac

SEQ ID NO: 287616 - DNA, 20 bp, Artificial Sequence
  chemically synthesized
tcaggagtttgagaccagca

SEQ ID NO: 287617 - DNA, 20 bp, Artificial Sequence
  chemically synthesized
tttcaccatcttggccatgc

SEQ ID NO: 287618 - DNA, 20 bp, Artificial Sequence
  chemically synthesized
agtttgagaccagcatggcc

SEQ ID NO: 287619 - DNA, 20 bp, Artificial Sequence
  chemically synthesized
tgagaccagcatggccaaga

SEQ ID NO: 287620 - DNA, 20 bp, Artificial Sequence
  chemically synthesized
aagatggggtttcaccatct

SEQ ID NO: 287621 - DNA, 20 bp, Artificial Sequence
  chemically synthesized
gtatttttaaagtaaagatg

SEQ ID NO: 287622 - DNA, 20 bp, Artificial Sequence
  chemically synthesized
tgtatttttaaagtaaagat

SEQ ID NO: 287623 - DNA, 20 bp, Artificial Sequence
  chemically synthesized
ttgtatttttaaagtaaaga

SEQ ID NO: 287624 - DNA, 20 bp, Artificial Sequence
  chemically synthesized
atttttgtatttttaaagta

SEQ ID NO: 287625 - DNA, 20 bp, Artificial Sequence
  chemically synthesized
ggctaatttttgtattttta

SEQ ID NO: 287626 - DNA, 20 bp, Artificial Sequence
  chemically synthesized
tactttaaaaatacaaaaat

SEQ ID NO: 287627 - DNA, 20 bp, Artificial Sequence
  chemically synthesized
ttaaaaatacaaaaattagc

SEQ ID NO: 287628 - DNA, 20 bp, Artificial Sequence
  chemically synthesized
taaaaatacaaaaattagcc

SEQ ID NO: 287629 - DNA, 20 bp, Artificial Sequence
  chemically synthesized
caaaaattagccaggcgtga

SEQ ID NO: 287630 - DNA, 20 bp, Artificial Sequence
  chemically synthesized
atagtgcgtgccatcacgcc

SEQ ID NO: 287631 - DNA, 20 bp, Artificial Sequence
  chemically synthesized
gatggcacgcactataatcc

SEQ ID NO: 287632 - DNA, 20 bp, Artificial Sequence
  chemically synthesized
ctcctgagtagctgggatta

SEQ ID NO: 287633 - DNA, 20 bp, Artificial Sequence
  chemically synthesized
gcactataatcccagctact

SEQ ID NO: 287634 - DNA, 20 bp, Artificial Sequence
  chemically synthesized
ccttagcctcctgagtagct

SEQ ID NO: 287635 - DNA, 20 bp, Artificial Sequence
  chemically synthesized
cactataatcccagctactc

SEQ ID NO: 287636 - DNA, 20 bp, Artificial Sequence
  chemically synthesized
gccttagcctcctgagtagc

SEQ ID NO: 287637 - DNA, 20 bp, Artificial Sequence
  chemically synthesized
ctataatcccagctactcag

SEQ ID NO: 287638 - DNA, 20 bp, Artificial Sequence
  chemically synthesized
tataatcccagctactcagg

SEQ ID NO: 287639 - DNA, 20 bp, Artificial Sequence
  chemically synthesized
tcctgccttagcctcctgag

SEQ ID NO: 287640 - DNA, 20 bp, Artificial Sequence
  chemically synthesized
ttctcctgccttagcctcct

SEQ ID NO: 287641 - DNA, 20 bp, Artificial Sequence
  chemically synthesized
tcccagctactcaggaggct

SEQ ID NO: 287642 - DNA, 20 bp, Artificial Sequence
  chemically synthesized
cccagctactcaggaggcta

SEQ ID NO: 287643 - DNA, 20 bp, Artificial Sequence
  chemically synthesized
agctactcaggaggctaagg

SEQ ID NO: 287644 - DNA, 20 bp, Artificial Sequence
  chemically synthesized
gctactcaggaggctaaggc

SEQ ID NO: 287645 - DNA, 20 bp, Artificial Sequence
  chemically synthesized
tactcaggaggctaaggcag

SEQ ID NO: 287646 - DNA, 20 bp, Artificial Sequence
  chemically synthesized
ttcaagtgattctcctgcct

SEQ ID NO: 287647 - DNA, 20 bp, Artificial Sequence
  chemically synthesized
gcaggagaatcacttgaacc

SEQ ID NO: 287648 - DNA, 20 bp, Artificial Sequence
  chemically synthesized
caggagaatcacttgaaccc

SEQ ID NO: 287649 - DNA, 20 bp, Artificial Sequence
  chemically synthesized
aacctacgcctcccgggttc

SEQ ID NO: 287650 - DNA, 20 bp, Artificial Sequence
  chemically synthesized
ggagaatcacttgaacccgg

SEQ ID NO: 287651 - DNA, 20 bp, Artificial Sequence
  chemically synthesized
gagaatcacttgaacccggg

SEQ ID NO: 287652 - DNA, 20 bp, Artificial Sequence
  chemically synthesized
cactgcaacctacgcctccc

SEQ ID NO: 287653 - DNA, 20 bp, Artificial Sequence
  chemically synthesized
tcacttgaacccgggaggcg

SEQ ID NO: 287654 - DNA, 20 bp, Artificial Sequence
  chemically synthesized
tcactgcaacctacgcctcc

SEQ ID NO: 287655 - DNA, 20 bp, Artificial Sequence
  chemically synthesized
cacttgaacccgggaggcgt

SEQ ID NO: 287656 - DNA, 20 bp, Artificial Sequence
  chemically synthesized
aacccgggaggcgtaggttg

SEQ ID NO: 287657 - DNA, 20 bp, Artificial Sequence
  chemically synthesized
cgggaggcgtaggttgcagt

SEQ ID NO: 287658 - DNA, 20 bp, Artificial Sequence
  chemically synthesized
ggcgtaggttgcagtgagcc

SEQ ID NO: 287659 - DNA, 20 bp, Artificial Sequence
  chemically synthesized
taggttgcagtgagccgaga

SEQ ID NO: 287660 - DNA, 20 bp, Artificial Sequence
  chemically synthesized
ggagtgcagcagtgctatct

SEQ ID NO: 287661 - DNA, 20 bp, Artificial Sequence
  chemically synthesized
ttgcccaggctggagtgcag

SEQ ID NO: 287662 - DNA, 20 bp, Artificial Sequence
  chemically synthesized
gagatagcactgctgcactc

SEQ ID NO: 287663 - DNA, 20 bp, Artificial Sequence
  chemically synthesized
ttgttgcccaggctggagtg

SEQ ID NO: 287664 - DNA, 20 bp, Artificial Sequence
  chemically synthesized
agcactgctgcactccagcc

SEQ ID NO: 287665 - DNA, 20 bp, Artificial Sequence
  chemically synthesized
gcactgctgcactccagcct

SEQ ID NO: 287666 - DNA, 20 bp, Artificial Sequence
  chemically synthesized
cattcttgttgcccaggctg

SEQ ID NO: 287667 - DNA, 20 bp, Artificial Sequence
  chemically synthesized
ttcattcttgttgcccaggc

SEQ ID NO: 287668 - DNA, 20 bp, Artificial Sequence
  chemically synthesized
tgcactccagcctgggcaac

SEQ ID NO: 287669 - DNA, 20 bp, Artificial Sequence
  chemically synthesized
gagtttcattcttgttgccc

SEQ ID NO: 287670 - DNA, 20 bp, Artificial Sequence
  chemically synthesized
ggagtttcattcttgttgcc

SEQ ID NO: 287671 - DNA, 20 bp, Artificial Sequence
  chemically synthesized
ctttattttatttttagacg

SEQ ID NO: 287672 - DNA, 20 bp, Artificial Sequence
  chemically synthesized
tactttattttatttttaga

SEQ ID NO: 287673 - DNA, 20 bp, Artificial Sequence
  chemically synthesized
ttcctactttattttatttt

SEQ ID NO: 287674 - DNA, 20 bp, Artificial Sequence
  chemically synthesized
ctccgtctaaaaataaaata

SEQ ID NO: 287675 - DNA, 20 bp, Artificial Sequence
  chemically synthesized
cgtctaaaaataaaataaag

SEQ ID NO: 287676 - DNA, 20 bp, Artificial Sequence
  chemically synthesized
gtctaaaaataaaataaagt

SEQ ID NO: 287677 - DNA, 20 bp, Artificial Sequence
  chemically synthesized
aaaataaaataaagtaggaa

SEQ ID NO: 287678 - DNA, 20 bp, Artificial Sequence
  chemically synthesized
atgaaagaaataatttgtaa

SEQ ID NO: 287679 - DNA, 20 bp, Artificial Sequence
  chemically synthesized
aaatgaaagaaataatttgt

SEQ ID NO: 287680 - DNA, 20 bp, Artificial Sequence
  chemically synthesized
tatactaatatgggaaatga

SEQ ID NO: 287681 - DNA, 20 bp, Artificial Sequence
  chemically synthesized
atttctttcatttcccatat

SEQ ID NO: 287682 - DNA, 20 bp, Artificial Sequence
  chemically synthesized
caggaaagatatactaatat

SEQ ID NO: 287683 - DNA, 20 bp, Artificial Sequence
  chemically synthesized
tcaggaaagatatactaata

SEQ ID NO: 287684 - DNA, 20 bp, Artificial Sequence
  chemically synthesized
tattagtatatctttcctga

SEQ ID NO: 287685 - DNA, 20 bp, Artificial Sequence
  chemically synthesized
ttaacatccttctatcagga

SEQ ID NO: 287686 - DNA, 20 bp, Artificial Sequence
  chemically synthesized
tagtatatctttcctgatag

SEQ ID NO: 287687 - DNA, 20 bp, Artificial Sequence
  chemically synthesized
agtatatctttcctgataga

SEQ ID NO: 287688 - DNA, 20 bp, Artificial Sequence
  chemically synthesized
ttttttaacatccttctatc

SEQ ID NO: 287689 - DNA, 20 bp, Artificial Sequence
  chemically synthesized
tttttttaacatccttctat

SEQ ID NO: 287690 - DNA, 20 bp, Artificial Sequence
  chemically synthesized
agaaggatgttaaaaaaatg

SEQ ID NO: 287691 - DNA, 20 bp, Artificial Sequence
  chemically synthesized
tgttaaaaaaatgtagctat

SEQ ID NO: 287692 - DNA, 20 bp, Artificial Sequence
  chemically synthesized
atgagacatttgaattctaa

SEQ ID NO: 287693 - DNA, 20 bp, Artificial Sequence
  chemically synthesized
ttaattttctgtaatgtaat

SEQ ID NO: 287694 - DNA, 20 bp, Artificial Sequence
  chemically synthesized
tcaaatgtctcattacatta

SEQ ID NO: 287695 - DNA, 20 bp, Artificial Sequence
  chemically synthesized
gctggctatatttataaaat

SEQ ID NO: 287696 - DNA, 20 bp, Artificial Sequence
  chemically synthesized
ttaaaccaattttataaata

SEQ ID NO: 287697 - DNA, 20 bp, Artificial Sequence
  chemically synthesized
accaattttataaatatagc

SEQ ID NO: 287698 - DNA, 20 bp, Artificial Sequence
  chemically synthesized
aatccacaaatatggagggc

SEQ ID NO: 287699 - DNA, 20 bp, Artificial Sequence
  chemically synthesized
tcagaatccacaaatatgga

SEQ ID NO: 287700 - DNA, 20 bp, Artificial Sequence
  chemically synthesized
ttcagaatccacaaatatgg

SEQ ID NO: 287701 - DNA, 20 bp, Artificial Sequence
  chemically synthesized
attcagaatccacaaatatg

SEQ ID NO: 287702 - DNA, 20 bp, Artificial Sequence
  chemically synthesized
tagccagccctccatatttg

SEQ ID NO: 287703 - DNA, 20 bp, Artificial Sequence
  chemically synthesized
tcattcagaatccacaaata

SEQ ID NO: 287704 - DNA, 20 bp, Artificial Sequence
  chemically synthesized
catatttgtggattctgaat

SEQ ID NO: 287705 - DNA, 20 bp, Artificial Sequence
  chemically synthesized
atttgtggattctgaatgag

SEQ ID NO: 287706 - DNA, 20 bp, Artificial Sequence
  chemically synthesized
gttgactgaatccactcatt

SEQ ID NO: 287707 - DNA, 20 bp, Artificial Sequence
  chemically synthesized
ggattctgaatgagtggatt

SEQ ID NO: 287708 - DNA, 20 bp, Artificial Sequence
  chemically synthesized
tggattcagtcaactactaa

SEQ ID NO: 287709 - DNA, 20 bp, Artificial Sequence
  chemically synthesized
tgtcaaatattatctattag

SEQ ID NO: 287710 - DNA, 20 bp, Artificial Sequence
  chemically synthesized
ttttgtcaaatattatctat

SEQ ID NO: 287711 - DNA, 20 bp, Artificial Sequence
  chemically synthesized
ttacatgtttagtacagatg

SEQ ID NO: 287712 - DNA, 20 bp, Artificial Sequence
  chemically synthesized
aaagtcttacatgtttagta

SEQ ID NO: 287713 - DNA, 20 bp, Artificial Sequence
  chemically synthesized
tacatctgtactaaacatgt

SEQ ID NO: 287714 - DNA, 20 bp, Artificial Sequence
  chemically synthesized
atgaaaaagtcttacatgtt

SEQ ID NO: 287715 - DNA, 20 bp, Artificial Sequence
  chemically synthesized
aggaagtagtgacaatgaaa

SEQ ID NO: 287716 - DNA, 20 bp, Artificial Sequence
  chemically synthesized
atactgtattatttaggaag

SEQ ID NO: 287717 - DNA, 20 bp, Artificial Sequence
  chemically synthesized
gttatactgtattatttagg

SEQ ID NO: 287718 - DNA, 20 bp, Artificial Sequence
  chemically synthesized
tgtgttatactgtattattt

SEQ ID NO: 287719 - DNA, 20 bp, Artificial Sequence
  chemically synthesized
tcactacttcctaaataata

SEQ ID NO: 287720 - DNA, 20 bp, Artificial Sequence
  chemically synthesized
atgtgttatactgtattatt

SEQ ID NO: 287721 - DNA, 20 bp, Artificial Sequence
  chemically synthesized
tcataatatttacattgtat

SEQ ID NO: 287722 - DNA, 20 bp, Artificial Sequence
  chemically synthesized
cataatatttacattgtatt

SEQ ID NO: 287723 - DNA, 20 bp, Artificial Sequence
  chemically synthesized
tacattgtattaggcattat

SEQ ID NO: 287724 - DNA, 20 bp, Artificial Sequence
  chemically synthesized
attaggcattataagtaatc

SEQ ID NO: 287725 - DNA, 20 bp, Artificial Sequence
  chemically synthesized
taggcattataagtaatcca

SEQ ID NO: 287726 - DNA, 20 bp, Artificial Sequence
  chemically synthesized
attataagtaatccagagat

SEQ ID NO: 287727 - DNA, 20 bp, Artificial Sequence
  chemically synthesized
catatactttaactcatctc

SEQ ID NO: 287728 - DNA, 20 bp, Artificial Sequence
  chemically synthesized
agtaatccagagatgagtta

SEQ ID NO: 287729 - DNA, 20 bp, Artificial Sequence
  chemically synthesized
cagagatgagttaaagtata

SEQ ID NO: 287730 - DNA, 20 bp, Artificial Sequence
  chemically synthesized
agagatgagttaaagtatat

SEQ ID NO: 287731 - DNA, 20 bp, Artificial Sequence
  chemically synthesized
agatgagttaaagtatatgg

SEQ ID NO: 287732 - DNA, 20 bp, Artificial Sequence
  chemically synthesized
gtatatgggagcatgttcat

SEQ ID NO: 287733 - DNA, 20 bp, Artificial Sequence
  chemically synthesized
gttcaagtcctttatatgaa

SEQ ID NO: 287734 - DNA, 20 bp, Artificial Sequence
  chemically synthesized
aatattacaccattcatata

SEQ ID NO: 287735 - DNA, 20 bp, Artificial Sequence
  chemically synthesized
atattacaccattcatataa

SEQ ID NO: 287736 - DNA, 20 bp, Artificial Sequence
  chemically synthesized
atcagaattcacagatgttc

SEQ ID NO: 287737 - DNA, 20 bp, Artificial Sequence
  chemically synthesized
cctatgaatatcagaattca

SEQ ID NO: 287738 - DNA, 20 bp, Artificial Sequence
  chemically synthesized
tctgtgaattctgatattca

SEQ ID NO: 287739 - DNA, 20 bp, Artificial Sequence
  chemically synthesized
ccaggaactcctatgaatat

SEQ ID NO: 287740 - DNA, 20 bp, Artificial Sequence
  chemically synthesized
ctgtgaattctgatattcat

SEQ ID NO: 287741 - DNA, 20 bp, Artificial Sequence
  chemically synthesized
gtgaattctgatattcatag

SEQ ID NO: 287742 - DNA, 20 bp, Artificial Sequence
  chemically synthesized
ctgatattcataggagttcc

SEQ ID NO: 287743 - DNA, 20 bp, Artificial Sequence
  chemically synthesized
atccatggggaagtggttcc

SEQ ID NO: 287744 - DNA, 20 bp, Artificial Sequence
  chemically synthesized
tatccatggggaagtggttc

SEQ ID NO: 287745 - DNA, 20 bp, Artificial Sequence
  chemically synthesized
ccttcgtatccatggggaag

SEQ ID NO: 287746 - DNA, 20 bp, Artificial Sequence
  chemically synthesized
ttcctggaaccacttcccca

SEQ ID NO: 287747 - DNA, 20 bp, Artificial Sequence
  chemically synthesized
atcccttcgtatccatgggg

SEQ ID NO: 287748 - DNA, 20 bp, Artificial Sequence
  chemically synthesized
gtcatcccttcgtatccatg

SEQ ID NO: 287749 - DNA, 20 bp, Artificial Sequence
  chemically synthesized
agtcatcccttcgtatccat

SEQ ID NO: 287750 - DNA, 20 bp, Artificial Sequence
  chemically synthesized
cagtcatcccttcgtatcca

SEQ ID NO: 287751 - DNA, 20 bp, Artificial Sequence
  chemically synthesized
accacttccccatggatacg

SEQ ID NO: 287752 - DNA, 20 bp, Artificial Sequence
  chemically synthesized
ccacttccccatggatacga

SEQ ID NO: 287753 - DNA, 20 bp, Artificial Sequence
  chemically synthesized
cacttccccatggatacgaa

SEQ ID NO: 287754 - DNA, 20 bp, Artificial Sequence
  chemically synthesized
tggtgggtaaaatcagtgta

SEQ ID NO: 287755 - DNA, 20 bp, Artificial Sequence
  chemically synthesized
ctcaaactggtgggtaaaat

SEQ ID NO: 287756 - DNA, 20 bp, Artificial Sequence
  chemically synthesized
tgtacactgattttacccac

SEQ ID NO: 287757 - DNA, 20 bp, Artificial Sequence
  chemically synthesized
tgtcacattctcaaactggt

SEQ ID NO: 287758 - DNA, 20 bp, Artificial Sequence
  chemically synthesized
ctgattttacccaccagttt

SEQ ID NO: 287759 - DNA, 20 bp, Artificial Sequence
  chemically synthesized
ctgtcacattctcaaactgg

SEQ ID NO: 287760 - DNA, 20 bp, Artificial Sequence
  chemically synthesized
ctcctgtcacattctcaaac

SEQ ID NO: 287761 - DNA, 20 bp, Artificial Sequence
  chemically synthesized
ccaccagtttgagaatgtga

SEQ ID NO: 287762 - DNA, 20 bp, Artificial Sequence
  chemically synthesized
caccagtttgagaatgtgac

SEQ ID NO: 287763 - DNA, 20 bp, Artificial Sequence
  chemically synthesized
ccagtttgagaatgtgacag

SEQ ID NO: 287764 - DNA, 20 bp, Artificial Sequence
  chemically synthesized
tgtgacaggagttacaaata

SEQ ID NO: 287765 - DNA, 20 bp, Artificial Sequence
  chemically synthesized
gacaggagttacaaataaag

SEQ ID NO: 287766 - DNA, 20 bp, Artificial Sequence
  chemically synthesized
gagttacaaataaagaagca

SEQ ID NO: 287767 - DNA, 20 bp, Artificial Sequence
  chemically synthesized
agttacaaataaagaagcaa

SEQ ID NO: 287768 - DNA, 20 bp, Artificial Sequence
  chemically synthesized
tacaaataaagaagcaaagg

SEQ ID NO: 287769 - DNA, 20 bp, Artificial Sequence
  chemically synthesized
acaaataaagaagcaaaggt

SEQ ID NO: 287770 - DNA, 20 bp, Artificial Sequence
  chemically synthesized
caaataaagaagcaaaggtg

SEQ ID NO: 287771 - DNA, 20 bp, Artificial Sequence
  chemically synthesized
aaaggtggggaataaaacaa

SEQ ID NO: 287772 - DNA, 20 bp, Artificial Sequence
  chemically synthesized
gatgtattgattttgattat

SEQ ID NO: 287773 - DNA, 20 bp, Artificial Sequence
  chemically synthesized
tttaatttagcatgcatttt

SEQ ID NO: 287774 - DNA, 20 bp, Artificial Sequence
  chemically synthesized
tatgaagtatatttttaatt

SEQ ID NO: 287775 - DNA, 20 bp, Artificial Sequence
  chemically synthesized
ttaaaaatatacttcataaa

SEQ ID NO: 287776 - DNA, 20 bp, Artificial Sequence
  chemically synthesized
aattgtatgatctatttatg

SEQ ID NO: 287777 - DNA, 20 bp, Artificial Sequence
  chemically synthesized
catacaattgttttcaaaaa

SEQ ID NO: 287778 - DNA, 20 bp, Artificial Sequence
  chemically synthesized
atctatggatatatatgtat

SEQ ID NO: 287779 - DNA, 20 bp, Artificial Sequence
  chemically synthesized
tatctatggatatatatgta

SEQ ID NO: 287780 - DNA, 20 bp, Artificial Sequence
  chemically synthesized
tgcccatacatatatatcca

SEQ ID NO: 287781 - DNA, 20 bp, Artificial Sequence
  chemically synthesized
catacatatatatccataga

SEQ ID NO: 287782 - DNA, 20 bp, Artificial Sequence
  chemically synthesized
tacatatatatccatagata

SEQ ID NO: 287783 - DNA, 20 bp, Artificial Sequence
  chemically synthesized
ttatgcatatactctatcta

SEQ ID NO: 287784 - DNA, 20 bp, Artificial Sequence
  chemically synthesized
tatgcataaataatactgta

SEQ ID NO: 287785 - DNA, 20 bp, Artificial Sequence
  chemically synthesized
caaatgaaaatgagacttta

SEQ ID NO: 287786 - DNA, 20 bp, Artificial Sequence
  chemically synthesized
cccattgagcaaatgaaaat

SEQ ID NO: 287787 - DNA, 20 bp, Artificial Sequence
  chemically synthesized
tctcattttcatttgctcaa

SEQ ID NO: 287788 - DNA, 20 bp, Artificial Sequence
  chemically synthesized
ctcattttcatttgctcaat

SEQ ID NO: 287789 - DNA, 20 bp, Artificial Sequence
  chemically synthesized
agtatggtagtttgcccatt

SEQ ID NO: 287790 - DNA, 20 bp, Artificial Sequence
  chemically synthesized
agtcattctgacaagtatgg

SEQ ID NO: 287791 - DNA, 20 bp, Artificial Sequence
  chemically synthesized
gggcaaactaccatacttgt

SEQ ID NO: 287792 - DNA, 20 bp, Artificial Sequence
  chemically synthesized
ttaagtcattctgacaagta

SEQ ID NO: 287793 - DNA, 20 bp, Artificial Sequence
  chemically synthesized
agaatttaagtcattctgac

SEQ ID NO: 287794 - DNA, 20 bp, Artificial Sequence
  chemically synthesized
tttaaataatattagaattt

SEQ ID NO: 287795 - DNA, 20 bp, Artificial Sequence
  chemically synthesized
atataacctttaaataatat

SEQ ID NO: 287796 - DNA, 20 bp, Artificial Sequence
  chemically synthesized
ttaaattctaatattattta

SEQ ID NO: 287797 - DNA, 20 bp, Artificial Sequence
  chemically synthesized
taaattctaatattatttaa

SEQ ID NO: 287798 - DNA, 20 bp, Artificial Sequence
  chemically synthesized
tatcaatgtgaatgcttgat

SEQ ID NO: 287799 - DNA, 20 bp, Artificial Sequence
  chemically synthesized
aacaataaagcacgcttatc

SEQ ID NO: 287800 - DNA, 20 bp, Artificial Sequence
  chemically synthesized
atttgaatgtcaaaacaata

SEQ ID NO: 287801 - DNA, 20 bp, Artificial Sequence
  chemically synthesized
ttttgacattcaaatattca

SEQ ID NO: 287802 - DNA, 20 bp, Artificial Sequence
  chemically synthesized
gcagagactcggggaattgc

SEQ ID NO: 287803 - DNA, 20 bp, Artificial Sequence
  chemically synthesized
agcagagactcggggaattg

SEQ ID NO: 287804 - DNA, 20 bp, Artificial Sequence
  chemically synthesized
tcacagacctgcaattcccc

SEQ ID NO: 287805 - DNA, 20 bp, Artificial Sequence
  chemically synthesized
aatcatggagcagagactcg

SEQ ID NO: 287806 - DNA, 20 bp, Artificial Sequence
  chemically synthesized
aaatcatggagcagagactc

SEQ ID NO: 287807 - DNA, 20 bp, Artificial Sequence
  chemically synthesized
gaaatcatggagcagagact

SEQ ID NO: 287808 - DNA, 20 bp, Artificial Sequence
  chemically synthesized
gactatgaaatcatggagca

SEQ ID NO: 287809 - DNA, 20 bp, Artificial Sequence
  chemically synthesized
ccgactatgaaatcatggag

SEQ ID NO: 287810 - DNA, 20 bp, Artificial Sequence
  chemically synthesized
tcaccgactatgaaatcatg

SEQ ID NO: 287811 - DNA, 20 bp, Artificial Sequence
  chemically synthesized
tgtcaccgactatgaaatca

SEQ ID NO: 287812 - DNA, 20 bp, Artificial Sequence
  chemically synthesized
gtctctgctccatgatttca

SEQ ID NO: 287813 - DNA, 20 bp, Artificial Sequence
  chemically synthesized
ctgctccatgatttcatagt

SEQ ID NO: 287814 - DNA, 20 bp, Artificial Sequence
  chemically synthesized
atttcatagtcggtgacact

SEQ ID NO: 287815 - DNA, 20 bp, Artificial Sequence
  chemically synthesized
atagtcggtgacactaagtt

SEQ ID NO: 287816 - DNA, 20 bp, Artificial Sequence
  chemically synthesized
tagtcggtgacactaagttg

SEQ ID NO: 287817 - DNA, 20 bp, Artificial Sequence
  chemically synthesized
aaactctccatacctcaact

SEQ ID NO: 287818 - DNA, 20 bp, Artificial Sequence
  chemically synthesized
ggtgacactaagttgaggta

SEQ ID NO: 287819 - DNA, 20 bp, Artificial Sequence
  chemically synthesized
tgacactaagttgaggtatg

SEQ ID NO: 287820 - DNA, 20 bp, Artificial Sequence
  chemically synthesized
acactaagttgaggtatgga

SEQ ID NO: 287821 - DNA, 20 bp, Artificial Sequence
  chemically synthesized
aagttgaggtatggagagtt

SEQ ID NO: 287822 - DNA, 20 bp, Artificial Sequence
  chemically synthesized
agagtttggtttctgactgc

SEQ ID NO: 287823 - DNA, 20 bp, Artificial Sequence
  chemically synthesized
caggacatgggtccagcagt

SEQ ID NO: 287824 - DNA, 20 bp, Artificial Sequence
  chemically synthesized
ccatcaggacatgggtccag

SEQ ID NO: 287825 - DNA, 20 bp, Artificial Sequence
  chemically synthesized
gtgccatcaggacatgggtc

SEQ ID NO: 287826 - DNA, 20 bp, Artificial Sequence
  chemically synthesized
catgagtgccatcaggacat

SEQ ID NO: 287827 - DNA, 20 bp, Artificial Sequence
  chemically synthesized
ccatgagtgccatcaggaca

SEQ ID NO: 287828 - DNA, 20 bp, Artificial Sequence
  chemically synthesized
ctgctggacccatgtcctga

SEQ ID NO: 287829 - DNA, 20 bp, Artificial Sequence
  chemically synthesized
aggagaccatgagtgccatc

SEQ ID NO: 287830 - DNA, 20 bp, Artificial Sequence
  chemically synthesized
caggagaccatgagtgccat

SEQ ID NO: 287831 - DNA, 20 bp, Artificial Sequence
  chemically synthesized
ccatgtcctgatggcactca

SEQ ID NO: 287832 - DNA, 20 bp, Artificial Sequence
  chemically synthesized
atgcgctatcaggagaccat

SEQ ID NO: 287833 - DNA, 20 bp, Artificial Sequence
  chemically synthesized
tggcactcatggtctcctga

SEQ ID NO: 287834 - DNA, 20 bp, Artificial Sequence
  chemically synthesized
tgccaccaatgcgctatcag

SEQ ID NO: 287835 - DNA, 20 bp, Artificial Sequence
  chemically synthesized
tttgccaccaatgcgctatc

SEQ ID NO: 287836 - DNA, 20 bp, Artificial Sequence
  chemically synthesized
ctttgccaccaatgcgctat

SEQ ID NO: 287837 - DNA, 20 bp, Artificial Sequence
  chemically synthesized
atggtctcctgatagcgcat

SEQ ID NO: 287838 - DNA, 20 bp, Artificial Sequence
  chemically synthesized
gtctcctgatagcgcattgg

SEQ ID NO: 287839 - DNA, 20 bp, Artificial Sequence
  chemically synthesized
ctgatagcgcattggtggca

SEQ ID NO: 287840 - DNA, 20 bp, Artificial Sequence
  chemically synthesized
agtgtcaaaaactttatcaa

SEQ ID NO: 287841 - DNA, 20 bp, Artificial Sequence
  chemically synthesized
gtgtcaaaaactttatcaaa

SEQ ID NO: 287842 - DNA, 20 bp, Artificial Sequence
  chemically synthesized
ttcttttttcccttttgata

SEQ ID NO: 287843 - DNA, 20 bp, Artificial Sequence
  chemically synthesized
tgtcaaaaactttatcaaaa

SEQ ID NO: 287844 - DNA, 20 bp, Artificial Sequence
  chemically synthesized
aactttatcaaaagggaaaa

SEQ ID NO: 287845 - DNA, 20 bp, Artificial Sequence
  chemically synthesized
atcaaaagggaaaaaagaat

SEQ ID NO: 287846 - DNA, 20 bp, Artificial Sequence
  chemically synthesized
tggcaaagtgtgaaacaatt

SEQ ID NO: 287847 - DNA, 20 bp, Artificial Sequence
  chemically synthesized
caatttaggaaaacatggca

SEQ ID NO: 287848 - DNA, 20 bp, Artificial Sequence
  chemically synthesized
gctgacaatttaggaaaaca

SEQ ID NO: 287849 - DNA, 20 bp, Artificial Sequence
  chemically synthesized
gccatgttttcctaaattgt

SEQ ID NO: 287850 - DNA, 20 bp, Artificial Sequence
  chemically synthesized
attgagtttgctgacaattt

SEQ ID NO: 287851 - DNA, 20 bp, Artificial Sequence
  chemically synthesized
aattgagtttgctgacaatt

SEQ ID NO: 287852 - DNA, 20 bp, Artificial Sequence
  chemically synthesized
ttgaaactagtaatataatt

SEQ ID NO: 287853 - DNA, 20 bp, Artificial Sequence
  chemically synthesized
agcaaactcaattatattac

SEQ ID NO: 287854 - DNA, 20 bp, Artificial Sequence
  chemically synthesized
attttgttaatatttgaaac

SEQ ID NO: 287855 - DNA, 20 bp, Artificial Sequence
  chemically synthesized
gtttcaaatattaacaaaat

SEQ ID NO: 287856 - DNA, 20 bp, Artificial Sequence
  chemically synthesized
atcatattaaatatattttt

SEQ ID NO: 287857 - DNA, 20 bp, Artificial Sequence
  chemically synthesized
atatatttaatatgattatg

SEQ ID NO: 287858 - DNA, 20 bp, Artificial Sequence
  chemically synthesized
tggcatattacacatgtagc

SEQ ID NO: 287859 - DNA, 20 bp, Artificial Sequence
  chemically synthesized
ctggcatattacacatgtag

SEQ ID NO: 287860 - DNA, 20 bp, Artificial Sequence
  chemically synthesized
tccctggcatattacacatg

SEQ ID NO: 287861 - DNA, 20 bp, Artificial Sequence
  chemically synthesized
ctgctacatgtgtaatatgc

SEQ ID NO: 287862 - DNA, 20 bp, Artificial Sequence
  chemically synthesized
tgctacatgtgtaatatgcc

SEQ ID NO: 287863 - DNA, 20 bp, Artificial Sequence
  chemically synthesized
gctacatgtgtaatatgcca

SEQ ID NO: 287864 - DNA, 20 bp, Artificial Sequence
  chemically synthesized
tgtaatatgtgtaaggtccc

SEQ ID NO: 287865 - DNA, 20 bp, Artificial Sequence
  chemically synthesized
aatttaatgtaatatgtgta

SEQ ID NO: 287866 - DNA, 20 bp, Artificial Sequence
  chemically synthesized
gaatttaatgtaatatgtgt

SEQ ID NO: 287867 - DNA, 20 bp, Artificial Sequence
  chemically synthesized
attacattaaattcacaaat

SEQ ID NO: 287868 - DNA, 20 bp, Artificial Sequence
  chemically synthesized
ttgaacaatatagattttac

SEQ ID NO: 287869 - DNA, 20 bp, Artificial Sequence
  chemically synthesized
attgaacaatatagatttta

SEQ ID NO: 287870 - DNA, 20 bp, Artificial Sequence
  chemically synthesized
ataaaacgaattgaacaata

SEQ ID NO: 287871 - DNA, 20 bp, Artificial Sequence
  chemically synthesized
tattgttcaattcgttttat

SEQ ID NO: 287872 - DNA, 20 bp, Artificial Sequence
  chemically synthesized
attgttcaattcgttttata

SEQ ID NO: 287873 - DNA, 20 bp, Artificial Sequence
  chemically synthesized
ttcaattcgttttataaggt

SEQ ID NO: 287874 - DNA, 20 bp, Artificial Sequence
  chemically synthesized
tcaattcgttttataaggtc

SEQ ID NO: 287875 - DNA, 20 bp, Artificial Sequence
  chemically synthesized
cgttttataaggtcaggaaa

SEQ ID NO: 287876 - DNA, 20 bp, Artificial Sequence
  chemically synthesized
aaggtcaggaaacagaaaaa

SEQ ID NO: 287877 - DNA, 20 bp, Artificial Sequence
  chemically synthesized
caggaaacagaaaaacagat

SEQ ID NO: 287878 - DNA, 20 bp, Artificial Sequence
  chemically synthesized
aggaaacagaaaaacagata

SEQ ID NO: 287879 - DNA, 20 bp, Artificial Sequence
  chemically synthesized
ggaaacagaaaaacagataa

SEQ ID NO: 287880 - DNA, 20 bp, Artificial Sequence
  chemically synthesized
aacagaaaaacagataaggg

SEQ ID NO: 287881 - DNA, 20 bp, Artificial Sequence
  chemically synthesized
acagaaaaacagataagggc

SEQ ID NO: 287882 - DNA, 20 bp, Artificial Sequence
  chemically synthesized
aaacagataagggcaggaaa

SEQ ID NO: 287883 - DNA, 20 bp, Artificial Sequence
  chemically synthesized
aagggcaggaaacagaaaaa

SEQ ID NO: 287884 - DNA, 20 bp, Artificial Sequence
  chemically synthesized
gggcaggaaacagaaaaaca

SEQ ID NO: 287885 - DNA, 20 bp, Artificial Sequence
  chemically synthesized
caggaaacagaaaaacagag

SEQ ID NO: 287886 - DNA, 20 bp, Artificial Sequence
  chemically synthesized
aacagaaaaacagagaagct

SEQ ID NO: 287887 - DNA, 20 bp, Artificial Sequence
  chemically synthesized
atcaccttgggcaatttact

SEQ ID NO: 287888 - DNA, 20 bp, Artificial Sequence
  chemically synthesized
agaagctaagtaaattgccc

SEQ ID NO: 287889 - DNA, 20 bp, Artificial Sequence
  chemically synthesized
gaagctaagtaaattgccca

SEQ ID NO: 287890 - DNA, 20 bp, Artificial Sequence
  chemically synthesized
aataccatctgtatcacctt

SEQ ID NO: 287891 - DNA, 20 bp, Artificial Sequence
  chemically synthesized
aaataccatctgtatcacct

SEQ ID NO: 287892 - DNA, 20 bp, Artificial Sequence
  chemically synthesized
gtaaattgcccaaggtgata

SEQ ID NO: 287893 - DNA, 20 bp, Artificial Sequence
  chemically synthesized
attgcccaaggtgatacaga

SEQ ID NO: 287894 - DNA, 20 bp, Artificial Sequence
  chemically synthesized
ggtgatacagatggtatttg

SEQ ID NO: 287895 - DNA, 20 bp, Artificial Sequence
  chemically synthesized
agatggtatttgcagaaacc

SEQ ID NO: 287896 - DNA, 20 bp, Artificial Sequence
  chemically synthesized
tggtatttgcagaaaccgag

SEQ ID NO: 287897 - DNA, 20 bp, Artificial Sequence
  chemically synthesized
ggtatttgcagaaaccgagc

SEQ ID NO: 287898 - DNA, 20 bp, Artificial Sequence
  chemically synthesized
gtatttgcagaaaccgagca

SEQ ID NO: 287899 - DNA, 20 bp, Artificial Sequence
  chemically synthesized
agatacaattggaccctgct

SEQ ID NO: 287900 - DNA, 20 bp, Artificial Sequence
  chemically synthesized
ctttcagtatcagatacaat

SEQ ID NO: 287901 - DNA, 20 bp, Artificial Sequence
  chemically synthesized
ccaattgtatctgatactga

SEQ ID NO: 287902 - DNA, 20 bp, Artificial Sequence
  chemically synthesized
agagagtagcctttcagtat

SEQ ID NO: 287903 - DNA, 20 bp, Artificial Sequence
  chemically synthesized
caattgtatctgatactgaa

SEQ ID NO: 287904 - DNA, 20 bp, Artificial Sequence
  chemically synthesized
actgagagagagtagccttt

SEQ ID NO: 287905 - DNA, 20 bp, Artificial Sequence
  chemically synthesized
atgataacactgagagagag

SEQ ID NO: 287906 - DNA, 20 bp, Artificial Sequence
  chemically synthesized
actgaaaggctactctctct

SEQ ID NO: 287907 - DNA, 20 bp, Artificial Sequence
  chemically synthesized
caaatgataacactgagaga

SEQ ID NO: 287908 - DNA, 20 bp, Artificial Sequence
  chemically synthesized
ggcaaatgataacactgaga

SEQ ID NO: 287909 - DNA, 20 bp, Artificial Sequence
  chemically synthesized
aaggcaaatgataacactga

SEQ ID NO: 287910 - DNA, 20 bp, Artificial Sequence
  chemically synthesized
ccaaggcaaatgataacact

SEQ ID NO: 287911 - DNA, 20 bp, Artificial Sequence
  chemically synthesized
ctcagtgttatcatttgcct

SEQ ID NO: 287912 - DNA, 20 bp, Artificial Sequence
  chemically synthesized
atgatactattttttttcca

SEQ ID NO: 287913 - DNA, 20 bp, Artificial Sequence
  chemically synthesized
aatgatactattttttttcc

SEQ ID NO: 287914 - DNA, 20 bp, Artificial Sequence
  chemically synthesized
catttgccttggaaaaaaaa

SEQ ID NO: 287915 - DNA, 20 bp, Artificial Sequence
  chemically synthesized
aaaaatagtatcattatccg

SEQ ID NO: 287916 - DNA, 20 bp, Artificial Sequence
  chemically synthesized
aatttaaaaatcaaggtctt

SEQ ID NO: 287917 - DNA, 20 bp, Artificial Sequence
  chemically synthesized
atgatataatttaaaaatca

SEQ ID NO: 287918 - DNA, 20 bp, Artificial Sequence
  chemically synthesized
catgatataatttaaaaatc

SEQ ID NO: 287919 - DNA, 20 bp, Artificial Sequence
  chemically synthesized
gggtgttctttcagtaaaat

SEQ ID NO: 287920 - DNA, 20 bp, Artificial Sequence
  chemically synthesized
gtcatgtctaattttactga

SEQ ID NO: 287921 - DNA, 20 bp, Artificial Sequence
  chemically synthesized
tgcgtacatgggtgttcttt

SEQ ID NO: 287922 - DNA, 20 bp, Artificial Sequence
  chemically synthesized
tatactaagcatgcgtacat

SEQ ID NO: 287923 - DNA, 20 bp, Artificial Sequence
  chemically synthesized
atatactaagcatgcgtaca

SEQ ID NO: 287924 - DNA, 20 bp, Artificial Sequence
  chemically synthesized
aacacccatgtacgcatgct

SEQ ID NO: 287925 - DNA, 20 bp, Artificial Sequence
  chemically synthesized
gagttcttgatacatatact

SEQ ID NO: 287926 - DNA, 20 bp, Artificial Sequence
  chemically synthesized
gcatgcttagtatatgtatc

SEQ ID NO: 287927 - DNA, 20 bp, Artificial Sequence
  chemically synthesized
agtatatgtatcaagaactc

SEQ ID NO: 287928 - DNA, 20 bp, Artificial Sequence
  chemically synthesized
tatttatggggttattacta

SEQ ID NO: 287929 - DNA, 20 bp, Artificial Sequence
  chemically synthesized
aatatttatggggttattac

SEQ ID NO: 287930 - DNA, 20 bp, Artificial Sequence
  chemically synthesized
taagaatgataatatttatg

SEQ ID NO: 287931 - DNA, 20 bp, Artificial Sequence
  chemically synthesized
ttaagaatgataatatttat

SEQ ID NO: 287932 - DNA, 20 bp, Artificial Sequence
  chemically synthesized
attaagaatgataatattta

SEQ ID NO: 287933 - DNA, 20 bp, Artificial Sequence
  chemically synthesized
acaggtttattataagaatt

SEQ ID NO: 287934 - DNA, 20 bp, Artificial Sequence
  chemically synthesized
atgtctcacaggtttattat

SEQ ID NO: 287935 - DNA, 20 bp, Artificial Sequence
  chemically synthesized
aattcttataataaacctgt

SEQ ID NO: 287936 - DNA, 20 bp, Artificial Sequence
  chemically synthesized
taacaatgtatatgtctcac

SEQ ID NO: 287937 - DNA, 20 bp, Artificial Sequence
  chemically synthesized
ttaacaatgtatatgtctca

SEQ ID NO: 287938 - DNA, 20 bp, Artificial Sequence
  chemically synthesized
ctgttttctcaattgcaatt

SEQ ID NO: 287939 - DNA, 20 bp, Artificial Sequence
  chemically synthesized
cctgttttctcaattgcaat

SEQ ID NO: 287940 - DNA, 20 bp, Artificial Sequence
  chemically synthesized
tgttaatcccaattgcaatt

SEQ ID NO: 287941 - DNA, 20 bp, Artificial Sequence
  chemically synthesized
cccaattgcaattgagaaaa

SEQ ID NO: 287942 - DNA, 20 bp, Artificial Sequence
  chemically synthesized
ccaattgcaattgagaaaac

SEQ ID NO: 287943 - DNA, 20 bp, Artificial Sequence
  chemically synthesized
attgagaaaacaggctatta

SEQ ID NO: 287944 - DNA, 20 bp, Artificial Sequence
  chemically synthesized
tgagaaaacaggctattaaa

SEQ ID NO: 287945 - DNA, 20 bp, Artificial Sequence
  chemically synthesized
gagaaaacaggctattaaag

SEQ ID NO: 287946 - DNA, 20 bp, Artificial Sequence
  chemically synthesized
atacacatatgcctctttaa

SEQ ID NO: 287947 - DNA, 20 bp, Artificial Sequence
  chemically synthesized
taatataattatacatataa

SEQ ID NO: 287948 - DNA, 20 bp, Artificial Sequence
  chemically synthesized
ttttatatgtataattatat

SEQ ID NO: 287949 - DNA, 20 bp, Artificial Sequence
  chemically synthesized
tttatatgtataattatatt

SEQ ID NO: 287950 - DNA, 20 bp, Artificial Sequence
  chemically synthesized
ttatatgtataattatatta

SEQ ID NO: 287951 - DNA, 20 bp, Artificial Sequence
  chemically synthesized
atgtataattatattaggga

SEQ ID NO: 287952 - DNA, 20 bp, Artificial Sequence
  chemically synthesized
atattagggaaagtattata

SEQ ID NO: 287953 - DNA, 20 bp, Artificial Sequence
  chemically synthesized
attagggaaagtattatata

SEQ ID NO: 287954 - DNA, 20 bp, Artificial Sequence
  chemically synthesized
aagtattatatagagatata

SEQ ID NO: 287955 - DNA, 20 bp, Artificial Sequence
  chemically synthesized
tacagtatgtatatacaaac

SEQ ID NO: 287956 - DNA, 20 bp, Artificial Sequence
  chemically synthesized
aaacaagtttatacgtttta

SEQ ID NO: 287957 - DNA, 20 bp, Artificial Sequence
  chemically synthesized
atatatatgaaatgtgactt

SEQ ID NO: 287958 - DNA, 20 bp, Artificial Sequence
  chemically synthesized
tatatgaaatgtgacttaag

SEQ ID NO: 287959 - DNA, 20 bp, Artificial Sequence
  chemically synthesized
tatagtccatgtggctgctt

SEQ ID NO: 287960 - DNA, 20 bp, Artificial Sequence
  chemically synthesized
atgtgacttaagcagccaca

SEQ ID NO: 287961 - DNA, 20 bp, Artificial Sequence
  chemically synthesized
ctctttcaatatagtccatg

SEQ ID NO: 287962 - DNA, 20 bp, Artificial Sequence
  chemically synthesized
agccacatggactatattga

SEQ ID NO: 287963 - DNA, 20 bp, Artificial Sequence
  chemically synthesized
gtgtctaatctctttcaata

SEQ ID NO: 287964 - DNA, 20 bp, Artificial Sequence
  chemically synthesized
ccacatggactatattgaaa

SEQ ID NO: 287965 - DNA, 20 bp, Artificial Sequence
  chemically synthesized
tggactatattgaaagagat

SEQ ID NO: 287966 - DNA, 20 bp, Artificial Sequence
  chemically synthesized
tattgaaagagattagacac

SEQ ID NO: 287967 - DNA, 20 bp, Artificial Sequence
  chemically synthesized
aagagattagacacaagatt

SEQ ID NO: 287968 - DNA, 20 bp, Artificial Sequence
  chemically synthesized
acacaagattgagaacgctg

SEQ ID NO: 287969 - DNA, 20 bp, Artificial Sequence
  chemically synthesized
acaagattgagaacgctgca

SEQ ID NO: 287970 - DNA, 20 bp, Artificial Sequence
  chemically synthesized
ttatggtttacagttctctg

SEQ ID NO: 287971 - DNA, 20 bp, Artificial Sequence
  chemically synthesized
tatgtcctttttatggttta

SEQ ID NO: 287972 - DNA, 20 bp, Artificial Sequence
  chemically synthesized
agagaactgtaaaccataaa

SEQ ID NO: 287973 - DNA, 20 bp, Artificial Sequence
  chemically synthesized
gagaactgtaaaccataaaa

SEQ ID NO: 287974 - DNA, 20 bp, Artificial Sequence
  chemically synthesized
aatatgttatgtccttttta

SEQ ID NO: 287975 - DNA, 20 bp, Artificial Sequence
  chemically synthesized
aaaaaggacataacatattt

SEQ ID NO: 287976 - DNA, 20 bp, Artificial Sequence
  chemically synthesized
aaaaggacataacatatttt

SEQ ID NO: 287977 - DNA, 20 bp, Artificial Sequence
  chemically synthesized
aaaggacataacatatttta

SEQ ID NO: 287978 - DNA, 20 bp, Artificial Sequence
  chemically synthesized
atattttagggataatccaa

SEQ ID NO: 287979 - DNA, 20 bp, Artificial Sequence
  chemically synthesized
tttaattctagaatttcttt

SEQ ID NO: 287980 - DNA, 20 bp, Artificial Sequence
  chemically synthesized
ggataatccaaaagaaattc

SEQ ID NO: 287981 - DNA, 20 bp, Artificial Sequence
  chemically synthesized
acttactgtatttttaattc

SEQ ID NO: 287982 - DNA, 20 bp, Artificial Sequence
  chemically synthesized
aaattctagaattaaaaata

SEQ ID NO: 287983 - DNA, 20 bp, Artificial Sequence
  chemically synthesized
tctagaattaaaaatacagt

SEQ ID NO: 287984 - DNA, 20 bp, Artificial Sequence
  chemically synthesized
aaatacagtaagtgaaaaat

SEQ ID NO: 287985 - DNA, 20 bp, Artificial Sequence
  chemically synthesized
gtaagtgaaaaataagaatt

SEQ ID NO: 287986 - DNA, 20 bp, Artificial Sequence
  chemically synthesized
aaaaataagaattaagtgca

SEQ ID NO: 287987 - DNA, 20 bp, Artificial Sequence
  chemically synthesized
aaaataagaattaagtgcat

SEQ ID NO: 287988 - DNA, 20 bp, Artificial Sequence
  chemically synthesized
aattaagtgcatgggtttaa

SEQ ID NO: 287989 - DNA, 20 bp, Artificial Sequence
  chemically synthesized
gggtttaacagcaaatttga

SEQ ID NO: 287990 - DNA, 20 bp, Artificial Sequence
  chemically synthesized
ggtttaacagcaaatttgac

SEQ ID NO: 287991 - DNA, 20 bp, Artificial Sequence
  chemically synthesized
gtttaacagcaaatttgaca

SEQ ID NO: 287992 - DNA, 20 bp, Artificial Sequence
  chemically synthesized
tttaacagcaaatttgacag

SEQ ID NO: 287993 - DNA, 20 bp, Artificial Sequence
  chemically synthesized
gcaaatttgacaggggtaaa

SEQ ID NO: 287994 - DNA, 20 bp, Artificial Sequence
  chemically synthesized
atagaaaattactaaatctt

SEQ ID NO: 287995 - DNA, 20 bp, Artificial Sequence
  chemically synthesized
tccttctgaatcttaagatt

SEQ ID NO: 287996 - DNA, 20 bp, Artificial Sequence
  chemically synthesized
aattactaaatcttaagatt

SEQ ID NO: 287997 - DNA, 20 bp, Artificial Sequence
  chemically synthesized
ggtatttccttctgaatctt

SEQ ID NO: 287998 - DNA, 20 bp, Artificial Sequence
  chemically synthesized
tactaaatcttaagattcag

SEQ ID NO: 287999 - DNA, 20 bp, Artificial Sequence
  chemically synthesized
actaaatcttaagattcaga

SEQ ID NO: 288000 - DNA, 20 bp, Artificial Sequence
  chemically synthesized
aagattcagaaggaaatacc

SEQ ID NO: 288001 - DNA, 20 bp, Artificial Sequence
  chemically synthesized
agaaggaaatacctggaatg

SEQ ID NO: 288002 - DNA, 20 bp, Artificial Sequence
  chemically synthesized
gtgtctccatgcttcattcc

SEQ ID NO: 288003 - DNA, 20 bp, Artificial Sequence
  chemically synthesized
tgtgtctccatgcttcattc

SEQ ID NO: 288004 - DNA, 20 bp, Artificial Sequence
  chemically synthesized
gaaatacctggaatgaagca

SEQ ID NO: 288005 - DNA, 20 bp, Artificial Sequence
  chemically synthesized
aatacctggaatgaagcatg

SEQ ID NO: 288006 - DNA, 20 bp, Artificial Sequence
  chemically synthesized
atgaagcatggagacacaaa

SEQ ID NO: 288007 - DNA, 20 bp, Artificial Sequence
  chemically synthesized
agcatggagacacaaaaaga

SEQ ID NO: 288008 - DNA, 20 bp, Artificial Sequence
  chemically synthesized
catggagacacaaaaagata

SEQ ID NO: 288009 - DNA, 20 bp, Artificial Sequence
  chemically synthesized
acacaaaaagatagagaaca

SEQ ID NO: 288010 - DNA, 20 bp, Artificial Sequence
  chemically synthesized
agatagagaacacagtaaaa

SEQ ID NO: 288011 - DNA, 20 bp, Artificial Sequence
  chemically synthesized
attctgggatgcatatatat

SEQ ID NO: 288012 - DNA, 20 bp, Artificial Sequence
  chemically synthesized
ggtctaatatatatgcatcc

SEQ ID NO: 288013 - DNA, 20 bp, Artificial Sequence
  chemically synthesized
tatatatgcatcccagaatg

SEQ ID NO: 288014 - DNA, 20 bp, Artificial Sequence
  chemically synthesized
tatggcttctgccacattct

SEQ ID NO: 288015 - DNA, 20 bp, Artificial Sequence
  chemically synthesized
atatggcttctgccacattc

SEQ ID NO: 288016 - DNA, 20 bp, Artificial Sequence
  chemically synthesized
atatgcatcccagaatgtgg

SEQ ID NO: 288017 - DNA, 20 bp, Artificial Sequence
  chemically synthesized
tgcatcccagaatgtggcag

SEQ ID NO: 288018 - DNA, 20 bp, Artificial Sequence
  chemically synthesized
agccattatctgtttaaata

SEQ ID NO: 288019 - DNA, 20 bp, Artificial Sequence
  chemically synthesized
tggcagaagccatatttaaa

SEQ ID NO: 288020 - DNA, 20 bp, Artificial Sequence
  chemically synthesized
agccatatttaaacagataa

SEQ ID NO: 288021 - DNA, 20 bp, Artificial Sequence
  chemically synthesized
catgtatttagaaacattat

SEQ ID NO: 288022 - DNA, 20 bp, Artificial Sequence
  chemically synthesized
gcagtgtgatttcatgtatt

SEQ ID NO: 288023 - DNA, 20 bp, Artificial Sequence
  chemically synthesized
atacatgaaatcacactgca

SEQ ID NO: 288024 - DNA, 20 bp, Artificial Sequence
  chemically synthesized
tgatataaaccaggactttg

SEQ ID NO: 288025 - DNA, 20 bp, Artificial Sequence
  chemically synthesized
gaaatcacactgcaaagtcc

SEQ ID NO: 288026 - DNA, 20 bp, Artificial Sequence
  chemically synthesized
ttgatgtggtgatataaacc

SEQ ID NO: 288027 - DNA, 20 bp, Artificial Sequence
  chemically synthesized
tttgatgtggtgatataaac

SEQ ID NO: 288028 - DNA, 20 bp, Artificial Sequence
  chemically synthesized
ttagataatgttatttgatg

SEQ ID NO: 288029 - DNA, 20 bp, Artificial Sequence
  chemically synthesized
gcaattaaaataatatgatt

SEQ ID NO: 288030 - DNA, 20 bp, Artificial Sequence
  chemically synthesized
aatcatattattttaattgc

SEQ ID NO: 288031 - DNA, 20 bp, Artificial Sequence
  chemically synthesized
atcatattattttaattgct

SEQ ID NO: 288032 - DNA, 20 bp, Artificial Sequence
  chemically synthesized
ttgaaatgacattcatatcc

SEQ ID NO: 288033 - DNA, 20 bp, Artificial Sequence
  chemically synthesized
tcatttagtgtagaaggaat

SEQ ID NO: 288034 - DNA, 20 bp, Artificial Sequence
  chemically synthesized
ttcttctcatttagtgtaga

SEQ ID NO: 288035 - DNA, 20 bp, Artificial Sequence
  chemically synthesized
attcttctcatttagtgtag

SEQ ID NO: 288036 - DNA, 20 bp, Artificial Sequence
  chemically synthesized
tatattcttctcatttagtg

SEQ ID NO: 288037 - DNA, 20 bp, Artificial Sequence
  chemically synthesized
caattccttctacactaaat

SEQ ID NO: 288038 - DNA, 20 bp, Artificial Sequence
  chemically synthesized
ttccttctacactaaatgag

SEQ ID NO: 288039 - DNA, 20 bp, Artificial Sequence
  chemically synthesized
tttcctatattcttctcatt

SEQ ID NO: 288040 - DNA, 20 bp, Artificial Sequence
  chemically synthesized
tacactaaatgagaagaata

SEQ ID NO: 288041 - DNA, 20 bp, Artificial Sequence
  chemically synthesized
acactaaatgagaagaatat

SEQ ID NO: 288042 - DNA, 20 bp, Artificial Sequence
  chemically synthesized
taaatgagaagaatatagga

SEQ ID NO: 288043 - DNA, 20 bp, Artificial Sequence
  chemically synthesized
tattttgcatgtatttaatg

SEQ ID NO: 288044 - DNA, 20 bp, Artificial Sequence
  chemically synthesized
catgtatttaatgtagtatt

SEQ ID NO: 288045 - DNA, 20 bp, Artificial Sequence
  chemically synthesized
tatttaatgtagtattcaga

SEQ ID NO: 288046 - DNA, 20 bp, Artificial Sequence
  chemically synthesized
tcagatggttgcgataatct

SEQ ID NO: 288047 - DNA, 20 bp, Artificial Sequence
  chemically synthesized
agatggttgcgataatctta

SEQ ID NO: 288048 - DNA, 20 bp, Artificial Sequence
  chemically synthesized
atggttgcgataatcttaga

SEQ ID NO: 288049 - DNA, 20 bp, Artificial Sequence
  chemically synthesized
ccattgccaacacactctct

SEQ ID NO: 288050 - DNA, 20 bp, Artificial Sequence
  chemically synthesized
gataatcttagagagtgtgt

SEQ ID NO: 288051 - DNA, 20 bp, Artificial Sequence
  chemically synthesized
cttagagagtgtgttggcaa

SEQ ID NO: 288052 - DNA, 20 bp, Artificial Sequence
  chemically synthesized
ggcaatggatgctgaaatgt

SEQ ID NO: 288053 - DNA, 20 bp, Artificial Sequence
  chemically synthesized
attatccatttctaacattt

SEQ ID NO: 288054 - DNA, 20 bp, Artificial Sequence
  chemically synthesized
ggatgctgaaatgttagaaa

SEQ ID NO: 288055 - DNA, 20 bp, Artificial Sequence
  chemically synthesized
atgtttatattgcatttatt

SEQ ID NO: 288056 - DNA, 20 bp, Artificial Sequence
  chemically synthesized
tgtttatattgcatttattt

SEQ ID NO: 288057 - DNA, 20 bp, Artificial Sequence
  chemically synthesized
taatctcttaacatttttat

SEQ ID NO: 288058 - DNA, 20 bp, Artificial Sequence
  chemically synthesized
tgggaactcataaaaatgtt

SEQ ID NO: 288059 - DNA, 20 bp, Artificial Sequence
  chemically synthesized
ggaactcataaaaatgttaa

SEQ ID NO: 288060 - DNA, 20 bp, Artificial Sequence
  chemically synthesized
taagagattatatttaatct

SEQ ID NO: 288061 - DNA, 20 bp, Artificial Sequence
  chemically synthesized
aataagaaatcagaagtgct

SEQ ID NO: 288062 - DNA, 20 bp, Artificial Sequence
  chemically synthesized
atcttttaataagaaatcag

SEQ ID NO: 288063 - DNA, 20 bp, Artificial Sequence
  chemically synthesized
aatatcttttaataagaaat

SEQ ID NO: 288064 - DNA, 20 bp, Artificial Sequence
  chemically synthesized
cacttctgatttcttattaa

SEQ ID NO: 288065 - DNA, 20 bp, Artificial Sequence
  chemically synthesized
tactacaaatatcttttaat

SEQ ID NO: 288066 - DNA, 20 bp, Artificial Sequence
  chemically synthesized
ttcttattaaaagatatttg

SEQ ID NO: 288067 - DNA, 20 bp, Artificial Sequence
  chemically synthesized
tgtaaattaaaacagatttt

SEQ ID NO: 288068 - DNA, 20 bp, Artificial Sequence
  chemically synthesized
attatttatgtaaattaaaa

SEQ ID NO: 288069 - DNA, 20 bp, Artificial Sequence
  chemically synthesized
ataaatgcatcaggttaata

SEQ ID NO: 288070 - DNA, 20 bp, Artificial Sequence
  chemically synthesized
aaataaatgcatcaggttaa

SEQ ID NO: 288071 - DNA, 20 bp, Artificial Sequence
  chemically synthesized
aaataaaaaataaatgcatc

SEQ ID NO: 288072 - DNA, 20 bp, Artificial Sequence
  chemically synthesized
aaaataaaaaataaatgcat

SEQ ID NO: 288073 - DNA, 20 bp, Artificial Sequence
  chemically synthesized
tttattttttatttttccat

SEQ ID NO: 288074 - DNA, 20 bp, Artificial Sequence
  chemically synthesized
cctttacccccaataactta

SEQ ID NO: 288075 - DNA, 20 bp, Artificial Sequence
  chemically synthesized
tttatttttccataagttat

SEQ ID NO: 288076 - DNA, 20 bp, Artificial Sequence
  chemically synthesized
ttatttttccataagttatt

SEQ ID NO: 288077 - DNA, 20 bp, Artificial Sequence
  chemically synthesized
tatttttccataagttattg

SEQ ID NO: 288078 - DNA, 20 bp, Artificial Sequence
  chemically synthesized
atttttccataagttattgg

SEQ ID NO: 288079 - DNA, 20 bp, Artificial Sequence
  chemically synthesized
tccataagttattgggggta

SEQ ID NO: 288080 - DNA, 20 bp, Artificial Sequence
  chemically synthesized
ccataagttattgggggtaa

SEQ ID NO: 288081 - DNA, 20 bp, Artificial Sequence
  chemically synthesized
taagttattgggggtaaagg

SEQ ID NO: 288082 - DNA, 20 bp, Artificial Sequence
  chemically synthesized
ttgggggtaaaggtggtatt

SEQ ID NO: 288083 - DNA, 20 bp, Artificial Sequence
  chemically synthesized
aaggtggtatttggttacat

SEQ ID NO: 288084 - DNA, 20 bp, Artificial Sequence
  chemically synthesized
tggtatttggttacatgagt

SEQ ID NO: 288085 - DNA, 20 bp, Artificial Sequence
  chemically synthesized
ggttacatgagtaagttctt

SEQ ID NO: 288086 - DNA, 20 bp, Artificial Sequence
  chemically synthesized
tacatgagtaagttctttag

SEQ ID NO: 288087 - DNA, 20 bp, Artificial Sequence
  chemically synthesized
aatctcacaaatcaccacta

SEQ ID NO: 288088 - DNA, 20 bp, Artificial Sequence
  chemically synthesized
gttctttagtggtgatttgt

SEQ ID NO: 288089 - DNA, 20 bp, Artificial Sequence
  chemically synthesized
agtggtgatttgtgagattt

SEQ ID NO: 288090 - DNA, 20 bp, Artificial Sequence
  chemically synthesized
ttttggtgcacccatcacct

SEQ ID NO: 288091 - DNA, 20 bp, Artificial Sequence
  chemically synthesized
gtgtatactgcttaggtgat

SEQ ID NO: 288092 - DNA, 20 bp, Artificial Sequence
  chemically synthesized
agtgtatactgcttaggtga

SEQ ID NO: 288093 - DNA, 20 bp, Artificial Sequence
  chemically synthesized
tggtgcacccatcacctaag

SEQ ID NO: 288094 - DNA, 20 bp, Artificial Sequence
  chemically synthesized
gggtacagtgtatactgctt

SEQ ID NO: 288095 - DNA, 20 bp, Artificial Sequence
  chemically synthesized
agggtacagtgtatactgct

SEQ ID NO: 288096 - DNA, 20 bp, Artificial Sequence
  chemically synthesized
aaaagactacaaatagggta

SEQ ID NO: 288097 - DNA, 20 bp, Artificial Sequence
  chemically synthesized
tatacactgtaccctatttg

SEQ ID NO: 288098 - DNA, 20 bp, Artificial Sequence
  chemically synthesized
gagagaaaagactacaaata

SEQ ID NO: 288099 - DNA, 20 bp, Artificial Sequence
  chemically synthesized
agagagaaaagactacaaat

SEQ ID NO: 288100 - DNA, 20 bp, Artificial Sequence
  chemically synthesized
gagagagaaaagactacaaa

SEQ ID NO: 288101 - DNA, 20 bp, Artificial Sequence
  chemically synthesized
aaggttggggggagagagaa

SEQ ID NO: 288102 - DNA, 20 bp, Artificial Sequence
  chemically synthesized
tggggaaggttggggggaga

SEQ ID NO: 288103 - DNA, 20 bp, Artificial Sequence
  chemically synthesized
tgtggggaaggttgggggga

SEQ ID NO: 288104 - DNA, 20 bp, Artificial Sequence
  chemically synthesized
cttgtggggaaggttggggg

SEQ ID NO: 288105 - DNA, 20 bp, Artificial Sequence
  chemically synthesized
aacttgtggggaaggttggg

SEQ ID NO: 288106 - DNA, 20 bp, Artificial Sequence
  chemically synthesized
gaacttgtggggaaggttgg

SEQ ID NO: 288107 - DNA, 20 bp, Artificial Sequence
  chemically synthesized
ggaacttgtggggaaggttg

SEQ ID NO: 288108 - DNA, 20 bp, Artificial Sequence
  chemically synthesized
gggaacttgtggggaaggtt

SEQ ID NO: 288109 - DNA, 20 bp, Artificial Sequence
  chemically synthesized
tgggaacttgtggggaaggt

SEQ ID NO: 288110 - DNA, 20 bp, Artificial Sequence
  chemically synthesized
ctccccccaaccttccccac

SEQ ID NO: 288111 - DNA, 20 bp, Artificial Sequence
  chemically synthesized
actttgggaacttgtgggga

SEQ ID NO: 288112 - DNA, 20 bp, Artificial Sequence
  chemically synthesized
gactttgggaacttgtgggg

SEQ ID NO: 288113 - DNA, 20 bp, Artificial Sequence
  chemically synthesized
atggactttgggaacttgtg

SEQ ID NO: 288114 - DNA, 20 bp, Artificial Sequence
  chemically synthesized
aatggactttgggaacttgt

SEQ ID NO: 288115 - DNA, 20 bp, Artificial Sequence
  chemically synthesized
taatggactttgggaacttg

SEQ ID NO: 288116 - DNA, 20 bp, Artificial Sequence
  chemically synthesized
accttccccacaagttccca

SEQ ID NO: 288117 - DNA, 20 bp, Artificial Sequence
  chemically synthesized
agaatgatataatggacttt

SEQ ID NO: 288118 - DNA, 20 bp, Artificial Sequence
  chemically synthesized
tagaatgatataatggactt

SEQ ID NO: 288119 - DNA, 20 bp, Artificial Sequence
  chemically synthesized
caggcattagaatgatataa

SEQ ID NO: 288120 - DNA, 20 bp, Artificial Sequence
  chemically synthesized
ctatgaggacacacaggcat

SEQ ID NO: 288121 - DNA, 20 bp, Artificial Sequence
  chemically synthesized
gataatctatgaggacacac

SEQ ID NO: 288122 - DNA, 20 bp, Artificial Sequence
  chemically synthesized
agataatctatgaggacaca

SEQ ID NO: 288123 - DNA, 20 bp, Artificial Sequence
  chemically synthesized
ctaatgcctgtgtgtcctca

SEQ ID NO: 288124 - DNA, 20 bp, Artificial Sequence
  chemically synthesized
tatgtgggagataatctatg

SEQ ID NO: 288125 - DNA, 20 bp, Artificial Sequence
  chemically synthesized
atatgtgggagataatctat

SEQ ID NO: 288126 - DNA, 20 bp, Artificial Sequence
  chemically synthesized
atgttctcactgatatgtgg

SEQ ID NO: 288127 - DNA, 20 bp, Artificial Sequence
  chemically synthesized
atagattatctcccacatat

SEQ ID NO: 288128 - DNA, 20 bp, Artificial Sequence
  chemically synthesized
gtatgttctcactgatatgt

SEQ ID NO: 288129 - DNA, 20 bp, Artificial Sequence
  chemically synthesized
tgtatgttctcactgatatg

SEQ ID NO: 288130 - DNA, 20 bp, Artificial Sequence
  chemically synthesized
attatctcccacatatcagt

SEQ ID NO: 288131 - DNA, 20 bp, Artificial Sequence
  chemically synthesized
cagtgagaacatacaatgtt

SEQ ID NO: 288132 - DNA, 20 bp, Artificial Sequence
  chemically synthesized
atgtttggttttccattcct

SEQ ID NO: 288133 - DNA, 20 bp, Artificial Sequence
  chemically synthesized
taagtgaagtaactcaggaa

SEQ ID NO: 288134 - DNA, 20 bp, Artificial Sequence
  chemically synthesized
tattctaagtgaagtaactc

SEQ ID NO: 288135 - DNA, 20 bp, Artificial Sequence
  chemically synthesized
ttattctaagtgaagtaact

SEQ ID NO: 288136 - DNA, 20 bp, Artificial Sequence
  chemically synthesized
cattcctgagttacttcact

SEQ ID NO: 288137 - DNA, 20 bp, Artificial Sequence
  chemically synthesized
ggagactattattctaagtg

SEQ ID NO: 288138 - DNA, 20 bp, Artificial Sequence
  chemically synthesized
agttacttcacttagaataa

SEQ ID NO: 288139 - DNA, 20 bp, Artificial Sequence
  chemically synthesized
agattggagactattattct

SEQ ID NO: 288140 - DNA, 20 bp, Artificial Sequence
  chemically synthesized
cagtgacctgaatgagattg

SEQ ID NO: 288141 - DNA, 20 bp, Artificial Sequence
  chemically synthesized
tgcagtgacctgaatgagat

SEQ ID NO: 288142 - DNA, 20 bp, Artificial Sequence
  chemically synthesized
taatagtctccaatctcatt

SEQ ID NO: 288143 - DNA, 20 bp, Artificial Sequence
  chemically synthesized
aatagtctccaatctcattc

SEQ ID NO: 288144 - DNA, 20 bp, Artificial Sequence
  chemically synthesized
gcatttgcagtgacctgaat

SEQ ID NO: 288145 - DNA, 20 bp, Artificial Sequence
  chemically synthesized
gaatgaattaacagcatttg

SEQ ID NO: 288146 - DNA, 20 bp, Artificial Sequence
  chemically synthesized
cataaaaatgaatgaattaa

SEQ ID NO: 288147 - DNA, 20 bp, Artificial Sequence
  chemically synthesized
attcattcatttttatgact

SEQ ID NO: 288148 - DNA, 20 bp, Artificial Sequence
  chemically synthesized
cattcatttttatgactgag

SEQ ID NO: 288149 - DNA, 20 bp, Artificial Sequence
  chemically synthesized
atatatgatggaatactact

SEQ ID NO: 288150 - DNA, 20 bp, Artificial Sequence
  chemically synthesized
atgtatgtatgtatatatga

SEQ ID NO: 288151 - DNA, 20 bp, Artificial Sequence
  chemically synthesized
acacacacacacactcacca

SEQ ID NO: 288152 - DNA, 20 bp, Artificial Sequence
  chemically synthesized
gtggttaaagaaactgtggt

SEQ ID NO: 288153 - DNA, 20 bp, Artificial Sequence
  chemically synthesized
atgagtggttaaagaaactg

SEQ ID NO: 288154 - DNA, 20 bp, Artificial Sequence
  chemically synthesized
catcactgaatgagtggtta

SEQ ID NO: 288155 - DNA, 20 bp, Artificial Sequence
  chemically synthesized
agtttctttaaccactcatt

SEQ ID NO: 288156 - DNA, 20 bp, Artificial Sequence
  chemically synthesized
aatgcccatcactgaatgag

SEQ ID NO: 288157 - DNA, 20 bp, Artificial Sequence
  chemically synthesized
ccaaatgcccatcactgaat

SEQ ID NO: 288158 - DNA, 20 bp, Artificial Sequence
  chemically synthesized
tttaaccactcattcagtga

SEQ ID NO: 288159 - DNA, 20 bp, Artificial Sequence
  chemically synthesized
ttaaccactcattcagtgat

SEQ ID NO: 288160 - DNA, 20 bp, Artificial Sequence
  chemically synthesized
ctcattcagtgatgggcatt

SEQ ID NO: 288161 - DNA, 20 bp, Artificial Sequence
  chemically synthesized
tcagtgatgggcatttggat

SEQ ID NO: 288162 - DNA, 20 bp, Artificial Sequence
  chemically synthesized
agttcacaccagcacaatcg

SEQ ID NO: 288163 - DNA, 20 bp, Artificial Sequence
  chemically synthesized
gattggttccacgattgtgc

SEQ ID NO: 288164 - DNA, 20 bp, Artificial Sequence
  chemically synthesized
tatagcagcacagttcacac

SEQ ID NO: 288165 - DNA, 20 bp, Artificial Sequence
  chemically synthesized
catgcatgtttatagcagca

SEQ ID NO: 288166 - DNA, 20 bp, Artificial Sequence
  chemically synthesized
ttgcacatgcatgtttatag

SEQ ID NO: 288167 - DNA, 20 bp, Artificial Sequence
  chemically synthesized
tacttgcacatgcatgttta

SEQ ID NO: 288168 - DNA, 20 bp, Artificial Sequence
  chemically synthesized
tgctataaacatgcatgtgc

SEQ ID NO: 288169 - DNA, 20 bp, Artificial Sequence
  chemically synthesized
aaaaaagtcattattcaaaa

SEQ ID NO: 288170 - DNA, 20 bp, Artificial Sequence
  chemically synthesized
gtatctacccagaggaaaaa

SEQ ID NO: 288171 - DNA, 20 bp, Artificial Sequence
  chemically synthesized
aataatgactttttttcctc

SEQ ID NO: 288172 - DNA, 20 bp, Artificial Sequence
  chemically synthesized
ataatgactttttttcctct

SEQ ID NO: 288173 - DNA, 20 bp, Artificial Sequence
  chemically synthesized
atgactttttttcctctggg

SEQ ID NO: 288174 - DNA, 20 bp, Artificial Sequence
  chemically synthesized
attactgggtatctacccag

SEQ ID NO: 288175 - DNA, 20 bp, Artificial Sequence
  chemically synthesized
cattactgggtatctaccca

SEQ ID NO: 288176 - DNA, 20 bp, Artificial Sequence
  chemically synthesized
cccattactgggtatctacc

SEQ ID NO: 288177 - DNA, 20 bp, Artificial Sequence
  chemically synthesized
ttttcctctgggtagatacc

SEQ ID NO: 288178 - DNA, 20 bp, Artificial Sequence
  chemically synthesized
tctgggtagatacccagtaa

SEQ ID NO: 288179 - DNA, 20 bp, Artificial Sequence
  chemically synthesized
ctgggtagatacccagtaat

SEQ ID NO: 288180 - DNA, 20 bp, Artificial Sequence
  chemically synthesized
gatccagcaatcccattact

SEQ ID NO: 288181 - DNA, 20 bp, Artificial Sequence
  chemically synthesized
cgatccagcaatcccattac

SEQ ID NO: 288182 - DNA, 20 bp, Artificial Sequence
  chemically synthesized
atacccagtaatgggattgc

SEQ ID NO: 288183 - DNA, 20 bp, Artificial Sequence
  chemically synthesized
agtaatgggattgctggatc

SEQ ID NO: 288184 - DNA, 20 bp, Artificial Sequence
  chemically synthesized
aatgggattgctggatcgag

SEQ ID NO: 288185 - DNA, 20 bp, Artificial Sequence
  chemically synthesized
agtagaactaccactcgatc

SEQ ID NO: 288186 - DNA, 20 bp, Artificial Sequence
  chemically synthesized
gggattgctggatcgagtgg

SEQ ID NO: 288187 - DNA, 20 bp, Artificial Sequence
  chemically synthesized
tcgagtggtagttctacttt

SEQ ID NO: 288188 - DNA, 20 bp, Artificial Sequence
  chemically synthesized
ggagattccttaactaaaag

SEQ ID NO: 288189 - DNA, 20 bp, Artificial Sequence
  chemically synthesized
tggtagttctacttttagtt

SEQ ID NO: 288190 - DNA, 20 bp, Artificial Sequence
  chemically synthesized
ggtagttctacttttagtta

SEQ ID NO: 288191 - DNA, 20 bp, Artificial Sequence
  chemically synthesized
tgtggagattccttaactaa

SEQ ID NO: 288192 - DNA, 20 bp, Artificial Sequence
  chemically synthesized
ccactatggaaaagagtgtg

SEQ ID NO: 288193 - DNA, 20 bp, Artificial Sequence
  chemically synthesized
agccactatggaaaagagtg

SEQ ID NO: 288194 - DNA, 20 bp, Artificial Sequence
  chemically synthesized
aatctccacactcttttcca

SEQ ID NO: 288195 - DNA, 20 bp, Artificial Sequence
  chemically synthesized
agtacagccactatggaaaa

SEQ ID NO: 288196 - DNA, 20 bp, Artificial Sequence
  chemically synthesized
caagtacagccactatggaa

SEQ ID NO: 288197 - DNA, 20 bp, Artificial Sequence
  chemically synthesized
ctccacactcttttccatag

SEQ ID NO: 288198 - DNA, 20 bp, Artificial Sequence
  chemically synthesized
ttaaacaagtacagccacta

SEQ ID NO: 288199 - DNA, 20 bp, Artificial Sequence
  chemically synthesized
gatggggatttaaacaagta

SEQ ID NO: 288200 - DNA, 20 bp, Artificial Sequence
  chemically synthesized
ctgctgatggggatttaaac

SEQ ID NO: 288201 - DNA, 20 bp, Artificial Sequence
  chemically synthesized
gtacttgtttaaatccccat

SEQ ID NO: 288202 - DNA, 20 bp, Artificial Sequence
  chemically synthesized
cttgtttaaatccccatcag

SEQ ID NO: 288203 - DNA, 20 bp, Artificial Sequence
  chemically synthesized
acacttctacactgctgatg

SEQ ID NO: 288204 - DNA, 20 bp, Artificial Sequence
  chemically synthesized
aacacttctacactgctgat

SEQ ID NO: 288205 - DNA, 20 bp, Artificial Sequence
  chemically synthesized
taacacttctacactgctga

SEQ ID NO: 288206 - DNA, 20 bp, Artificial Sequence
  chemically synthesized
ttaaatccccatcagcagtg

SEQ ID NO: 288207 - DNA, 20 bp, Artificial Sequence
  chemically synthesized
aatccccatcagcagtgtag

SEQ ID NO: 288208 - DNA, 20 bp, Artificial Sequence
  chemically synthesized
tttgcgtggatgtggtgatc

SEQ ID NO: 288209 - DNA, 20 bp, Artificial Sequence
  chemically synthesized
gtttgcgtggatgtggtgat

SEQ ID NO: 288210 - DNA, 20 bp, Artificial Sequence
  chemically synthesized
agtacatgtttgcgtggatg

SEQ ID NO: 288211 - DNA, 20 bp, Artificial Sequence
  chemically synthesized
ttaaaaagtacatgtttgcg

SEQ ID NO: 288212 - DNA, 20 bp, Artificial Sequence
  chemically synthesized
ataatcaaaaaaattttaaa

SEQ ID NO: 288213 - DNA, 20 bp, Artificial Sequence
  chemically synthesized
ttttaaaatttttttgatta

SEQ ID NO: 288214 - DNA, 20 bp, Artificial Sequence
  chemically synthesized
ttgattatggtcattcttgc

SEQ ID NO: 288215 - DNA, 20 bp, Artificial Sequence
  chemically synthesized
gattatggtcattcttgcaa

SEQ ID NO: 288216 - DNA, 20 bp, Artificial Sequence
  chemically synthesized
tgataccaccttactcttgc

SEQ ID NO: 288217 - DNA, 20 bp, Artificial Sequence
  chemically synthesized
atggtcattcttgcaagagt

SEQ ID NO: 288218 - DNA, 20 bp, Artificial Sequence
  chemically synthesized
tggtcattcttgcaagagta

SEQ ID NO: 288219 - DNA, 20 bp, Artificial Sequence
  chemically synthesized
tcattcttgcaagagtaagg

SEQ ID NO: 288220 - DNA, 20 bp, Artificial Sequence
  chemically synthesized
aagagtaaggtggtatcaca

SEQ ID NO: 288221 - DNA, 20 bp, Artificial Sequence
  chemically synthesized
agtaaggtggtatcacatgg

SEQ ID NO: 288222 - DNA, 20 bp, Artificial Sequence
  chemically synthesized
gctaacattatgaatgatca

SEQ ID NO: 288223 - DNA, 20 bp, Artificial Sequence
  chemically synthesized
tgctaacattatgaatgatc

SEQ ID NO: 288224 - DNA, 20 bp, Artificial Sequence
  chemically synthesized
atgctaacattatgaatgat

SEQ ID NO: 288225 - DNA, 20 bp, Artificial Sequence
  chemically synthesized
tccctgatcattcataatgt

SEQ ID NO: 288226 - DNA, 20 bp, Artificial Sequence
  chemically synthesized
taatgttagcattttttcat

SEQ ID NO: 288227 - DNA, 20 bp, Artificial Sequence
  chemically synthesized
ctcaaaaggagatatacaaa

SEQ ID NO: 288228 - DNA, 20 bp, Artificial Sequence
  chemically synthesized
ccatttgtatatctcctttt

SEQ ID NO: 288229 - DNA, 20 bp, Artificial Sequence
  chemically synthesized
gaatagacagttctcaaaag

SEQ ID NO: 288230 - DNA, 20 bp, Artificial Sequence
  chemically synthesized
atgaatagacagttctcaaa

SEQ ID NO: 288231 - DNA, 20 bp, Artificial Sequence
  chemically synthesized
catgaatagacagttctcaa

SEQ ID NO: 288232 - DNA, 20 bp, Artificial Sequence
  chemically synthesized
gggctaaggacatgaataga

SEQ ID NO: 288233 - DNA, 20 bp, Artificial Sequence
  chemically synthesized
aagtgggctaaggacatgaa

SEQ ID NO: 288234 - DNA, 20 bp, Artificial Sequence
  chemically synthesized
gaactgtctattcatgtcct

SEQ ID NO: 288235 - DNA, 20 bp, Artificial Sequence
  chemically synthesized
tcccatcaaaaagtgggcta

SEQ ID NO: 288236 - DNA, 20 bp, Artificial Sequence
  chemically synthesized
atcccatcaaaaagtgggct

SEQ ID NO: 288237 - DNA, 20 bp, Artificial Sequence
  chemically synthesized
atacaatcccatcaaaaagt

SEQ ID NO: 288238 - DNA, 20 bp, Artificial Sequence
  chemically synthesized
aatacaatcccatcaaaaag

SEQ ID NO: 288239 - DNA, 20 bp, Artificial Sequence
  chemically synthesized
gtccttagcccactttttga

SEQ ID NO: 288240 - DNA, 20 bp, Artificial Sequence
  chemically synthesized
tccttagcccactttttgat

SEQ ID NO: 288241 - DNA, 20 bp, Artificial Sequence
  chemically synthesized
aaaaatacaatcccatcaaa

SEQ ID NO: 288242 - DNA, 20 bp, Artificial Sequence
  chemically synthesized
tacaacaaactcaaatcagt

SEQ ID NO: 288243 - DNA, 20 bp, Artificial Sequence
  chemically synthesized
tgtatttttcttactgattt

SEQ ID NO: 288244 - DNA, 20 bp, Artificial Sequence
  chemically synthesized
aatctacaacaaactcaaat

SEQ ID NO: 288245 - DNA, 20 bp, Artificial Sequence
  chemically synthesized
ttactgatttgagtttgttg

SEQ ID NO: 288246 - DNA, 20 bp, Artificial Sequence
  chemically synthesized
tttgagtttgttgtagattc

SEQ ID NO: 288247 - DNA, 20 bp, Artificial Sequence
  chemically synthesized
ttgttgtagattctggatat

SEQ ID NO: 288248 - DNA, 20 bp, Artificial Sequence
  chemically synthesized
tctgacaaaggactaatatc

SEQ ID NO: 288249 - DNA, 20 bp, Artificial Sequence
  chemically synthesized
tctggatattagtcctttgt

SEQ ID NO: 288250 - DNA, 20 bp, Artificial Sequence
  chemically synthesized
acaatctatacatctgacaa

SEQ ID NO: 288251 - DNA, 20 bp, Artificial Sequence
  chemically synthesized
cacaatctatacatctgaca

SEQ ID NO: 288252 - DNA, 20 bp, Artificial Sequence
  chemically synthesized
ttagtcctttgtcagatgta

SEQ ID NO: 288253 - DNA, 20 bp, Artificial Sequence
  chemically synthesized
tgtcagatgtatagattgtg

SEQ ID NO: 288254 - DNA, 20 bp, Artificial Sequence
  chemically synthesized
gaagattttatcccactcca

SEQ ID NO: 288255 - DNA, 20 bp, Artificial Sequence
  chemically synthesized
aagattttatcccactccat

SEQ ID NO: 288256 - DNA, 20 bp, Artificial Sequence
  chemically synthesized
aaacaggcaacccatggagt

SEQ ID NO: 288257 - DNA, 20 bp, Artificial Sequence
  chemically synthesized
caaacaggcaacccatggag

SEQ ID NO: 288258 - DNA, 20 bp, Artificial Sequence
  chemically synthesized
cagcaaacaggcaacccatg

SEQ ID NO: 288259 - DNA, 20 bp, Artificial Sequence
  chemically synthesized
cacagcaaacaggcaaccca

SEQ ID NO: 288260 - DNA, 20 bp, Artificial Sequence
  chemically synthesized
gaacaatcagcacagcaaac

SEQ ID NO: 288261 - DNA, 20 bp, Artificial Sequence
  chemically synthesized
ggaacaatcagcacagcaaa

SEQ ID NO: 288262 - DNA, 20 bp, Artificial Sequence
  chemically synthesized
agcaaaaggaacaatcagca

SEQ ID NO: 288263 - DNA, 20 bp, Artificial Sequence
  chemically synthesized
tgcacagcaaaaggaacaat

SEQ ID NO: 288264 - DNA, 20 bp, Artificial Sequence
  chemically synthesized
aaaagcttttgcacagcaaa

SEQ ID NO: 288265 - DNA, 20 bp, Artificial Sequence
  chemically synthesized
aaaaagcttttgcacagcaa

SEQ ID NO: 288266 - DNA, 20 bp, Artificial Sequence
  chemically synthesized
ttgttccttttgctgtgcaa

SEQ ID NO: 288267 - DNA, 20 bp, Artificial Sequence
  chemically synthesized
taaattaaaaagcttttgca

SEQ ID NO: 288268 - DNA, 20 bp, Artificial Sequence
  chemically synthesized
ggtacctaatttaaattaaa

SEQ ID NO: 288269 - DNA, 20 bp, Artificial Sequence
  chemically synthesized
aaaagctttttaatttaaat

SEQ ID NO: 288270 - DNA, 20 bp, Artificial Sequence
  chemically synthesized
aaagctttttaatttaaatt

SEQ ID NO: 288271 - DNA, 20 bp, Artificial Sequence
  chemically synthesized
ttttaatttaaattaggtac

SEQ ID NO: 288272 - DNA, 20 bp, Artificial Sequence
  chemically synthesized
taaaaacaaagataaatagc

SEQ ID NO: 288273 - DNA, 20 bp, Artificial Sequence
  chemically synthesized
gtaataaaaacaaagataaa

SEQ ID NO: 288274 - DNA, 20 bp, Artificial Sequence
  chemically synthesized
aagcaaatgtaataaaaaca

SEQ ID NO: 288275 - DNA, 20 bp, Artificial Sequence
  chemically synthesized
gtttttattacatttgcttt

SEQ ID NO: 288276 - DNA, 20 bp, Artificial Sequence
  chemically synthesized
tttttattacatttgctttt

SEQ ID NO: 288277 - DNA, 20 bp, Artificial Sequence
  chemically synthesized
tttcatgaccaggaacccaa

SEQ ID NO: 288278 - DNA, 20 bp, Artificial Sequence
  chemically synthesized
tacatttgcttttgggttcc

SEQ ID NO: 288279 - DNA, 20 bp, Artificial Sequence
  chemically synthesized
taggcaaggatttcatgacc

SEQ ID NO: 288280 - DNA, 20 bp, Artificial Sequence
  chemically synthesized
ttaggcaaggatttcatgac

SEQ ID NO: 288281 - DNA, 20 bp, Artificial Sequence
  chemically synthesized
tggtcatgaaatccttgcct

SEQ ID NO: 288282 - DNA, 20 bp, Artificial Sequence
  chemically synthesized
tctagacattggcttaggca

SEQ ID NO: 288283 - DNA, 20 bp, Artificial Sequence
  chemically synthesized
ttctagacattggcttaggc

SEQ ID NO: 288284 - DNA, 20 bp, Artificial Sequence
  chemically synthesized
aactttctagacattggctt

SEQ ID NO: 288285 - DNA, 20 bp, Artificial Sequence
  chemically synthesized
aaactttctagacattggct

SEQ ID NO: 288286 - DNA, 20 bp, Artificial Sequence
  chemically synthesized
tccttgcctaagccaatgtc

SEQ ID NO: 288287 - DNA, 20 bp, Artificial Sequence
  chemically synthesized
ggaaaaaactttctagacat

SEQ ID NO: 288288 - DNA, 20 bp, Artificial Sequence
  chemically synthesized
tgcctaagccaatgtctaga

SEQ ID NO: 288289 - DNA, 20 bp, Artificial Sequence
  chemically synthesized
taacattggaaaaaactttc

SEQ ID NO: 288290 - DNA, 20 bp, Artificial Sequence
  chemically synthesized
aaaattctagaagataacat

SEQ ID NO: 288291 - DNA, 20 bp, Artificial Sequence
  chemically synthesized
ttttttccaatgttatcttc

SEQ ID NO: 288292 - DNA, 20 bp, Artificial Sequence
  chemically synthesized
tgaaactataaaaattctag

SEQ ID NO: 288293 - DNA, 20 bp, Artificial Sequence
  chemically synthesized
acctgaaactataaaaattc

SEQ ID NO: 288294 - DNA, 20 bp, Artificial Sequence
  chemically synthesized
gttatcttctagaattttta

SEQ ID NO: 288295 - DNA, 20 bp, Artificial Sequence
  chemically synthesized
ttctagaatttttatagttt

SEQ ID NO: 288296 - DNA, 20 bp, Artificial Sequence
  chemically synthesized
tctagaatttttatagtttc

SEQ ID NO: 288297 - DNA, 20 bp, Artificial Sequence
  chemically synthesized
atttttatagtttcaggtct

SEQ ID NO: 288298 - DNA, 20 bp, Artificial Sequence
  chemically synthesized
tttttatagtttcaggtctt

SEQ ID NO: 288299 - DNA, 20 bp, Artificial Sequence
  chemically synthesized
tagtttcaggtcttaggttt

SEQ ID NO: 288300 - DNA, 20 bp, Artificial Sequence
  chemically synthesized
tggtttaaagacttaaacct

SEQ ID NO: 288301 - DNA, 20 bp, Artificial Sequence
  chemically synthesized
aaccaactaaagatggttta

SEQ ID NO: 288302 - DNA, 20 bp, Artificial Sequence
  chemically synthesized
ttaagtctttaaaccatctt

SEQ ID NO: 288303 - DNA, 20 bp, Artificial Sequence
  chemically synthesized
atacaaaaaccaactaaaga

SEQ ID NO: 288304 - DNA, 20 bp, Artificial Sequence
  chemically synthesized
gtctttaaaccatctttagt

SEQ ID NO: 288305 - DNA, 20 bp, Artificial Sequence
  chemically synthesized
cattatacaaaaaccaacta

SEQ ID NO: 288306 - DNA, 20 bp, Artificial Sequence
  chemically synthesized
agttggtttttgtataatgt

SEQ ID NO: 288307 - DNA, 20 bp, Artificial Sequence
  chemically synthesized
ttggtttttgtataatgtga

SEQ ID NO: 288308 - DNA, 20 bp, Artificial Sequence
  chemically synthesized
ttttgtataatgtgagagat

SEQ ID NO: 288309 - DNA, 20 bp, Artificial Sequence
  chemically synthesized
tttgtataatgtgagagatg

SEQ ID NO: 288310 - DNA, 20 bp, Artificial Sequence
  chemically synthesized
tgtataatgtgagagatgag

SEQ ID NO: 288311 - DNA, 20 bp, Artificial Sequence
  chemically synthesized
gagagatgaggagccaattt

SEQ ID NO: 288312 - DNA, 20 bp, Artificial Sequence
  chemically synthesized
cacatgtgggagactgaaat

SEQ ID NO: 288313 - DNA, 20 bp, Artificial Sequence
  chemically synthesized
caatttcagtctcccacatg

SEQ ID NO: 288314 - DNA, 20 bp, Artificial Sequence
  chemically synthesized
aattggctagccacatgtgg

SEQ ID NO: 288315 - DNA, 20 bp, Artificial Sequence
  chemically synthesized
ataattggctagccacatgt

SEQ ID NO: 288316 - DNA, 20 bp, Artificial Sequence
  chemically synthesized
gataattggctagccacatg

SEQ ID NO: 288317 - DNA, 20 bp, Artificial Sequence
  chemically synthesized
ttcagtctcccacatgtggc

SEQ ID NO: 288318 - DNA, 20 bp, Artificial Sequence
  chemically synthesized
atggtgctgggataattggc

SEQ ID NO: 288319 - DNA, 20 bp, Artificial Sequence
  chemically synthesized
atgtggctagccaattatcc

SEQ ID NO: 288320 - DNA, 20 bp, Artificial Sequence
  chemically synthesized
tcaaatggtgctgggataat

SEQ ID NO: 288321 - DNA, 20 bp, Artificial Sequence
  chemically synthesized
ccttttcatcaaatggtgct

SEQ ID NO: 288322 - DNA, 20 bp, Artificial Sequence
  chemically synthesized
cccttttcatcaaatggtgc

SEQ ID NO: 288323 - DNA, 20 bp, Artificial Sequence
  chemically synthesized
aggacacccttttcatcaaa

SEQ ID NO: 288324 - DNA, 20 bp, Artificial Sequence
  chemically synthesized
tcccagcaccatttgatgaa

SEQ ID NO: 288325 - DNA, 20 bp, Artificial Sequence
  chemically synthesized
cccagcaccatttgatgaaa

SEQ ID NO: 288326 - DNA, 20 bp, Artificial Sequence
  chemically synthesized
ccagcaccatttgatgaaaa

SEQ ID NO: 288327 - DNA, 20 bp, Artificial Sequence
  chemically synthesized
caaaaacatacagtaaagaa

SEQ ID NO: 288328 - DNA, 20 bp, Artificial Sequence
  chemically synthesized
acaaaaacatacagtaaaga

SEQ ID NO: 288329 - DNA, 20 bp, Artificial Sequence
  chemically synthesized
gcaaacaaaaacatacagta

SEQ ID NO: 288330 - DNA, 20 bp, Artificial Sequence
  chemically synthesized
acaaagcaaacaaaaacata

SEQ ID NO: 288331 - DNA, 20 bp, Artificial Sequence
  chemically synthesized
tgtttttgtttgctttgttg

SEQ ID NO: 288332 - DNA, 20 bp, Artificial Sequence
  chemically synthesized
acacaaactgatcttcaaca

SEQ ID NO: 288333 - DNA, 20 bp, Artificial Sequence
  chemically synthesized
ttgtttgctttgttgaagat

SEQ ID NO: 288334 - DNA, 20 bp, Artificial Sequence
  chemically synthesized
tgttgaagatcagtttgtgt

SEQ ID NO: 288335 - DNA, 20 bp, Artificial Sequence
  chemically synthesized
atcagtttgtgtaagtattt

SEQ ID NO: 288336 - DNA, 20 bp, Artificial Sequence
  chemically synthesized
taagtattttggtttatttc

SEQ ID NO: 288337 - DNA, 20 bp, Artificial Sequence
  chemically synthesized
aagtattttggtttatttct

SEQ ID NO: 288338 - DNA, 20 bp, Artificial Sequence
  chemically synthesized
acagaacagaatagagaacc

SEQ ID NO: 288339 - DNA, 20 bp, Artificial Sequence
  chemically synthesized
tagaccaacagaacagaata

SEQ ID NO: 288340 - DNA, 20 bp, Artificial Sequence
  chemically synthesized
catagaccaacagaacagaa

SEQ ID NO: 288341 - DNA, 20 bp, Artificial Sequence
  chemically synthesized
ggttctctattctgttctgt

SEQ ID NO: 288342 - DNA, 20 bp, Artificial Sequence
  chemically synthesized
aggcacatagaccaacagaa

SEQ ID NO: 288343 - DNA, 20 bp, Artificial Sequence
  chemically synthesized
aatataggcacatagaccaa

SEQ ID NO: 288344 - DNA, 20 bp, Artificial Sequence
  chemically synthesized
ctggtataaatataggcaca

SEQ ID NO: 288345 - DNA, 20 bp, Artificial Sequence
  chemically synthesized
catggtactggtataaatat

SEQ ID NO: 288346 - DNA, 20 bp, Artificial Sequence
  chemically synthesized
gcatggtactggtataaata

SEQ ID NO: 288347 - DNA, 20 bp, Artificial Sequence
  chemically synthesized
ctatgtgcctatatttatac

SEQ ID NO: 288348 - DNA, 20 bp, Artificial Sequence
  chemically synthesized
tcaccaaaacagcatggtac

SEQ ID NO: 288349 - DNA, 20 bp, Artificial Sequence
  chemically synthesized
ccatagtcaccaaaacagca

SEQ ID NO: 288350 - DNA, 20 bp, Artificial Sequence
  chemically synthesized
ataccagtaccatgctgttt

SEQ ID NO: 288351 - DNA, 20 bp, Artificial Sequence
  chemically synthesized
taaggccatagtcaccaaaa

SEQ ID NO: 288352 - DNA, 20 bp, Artificial Sequence
  chemically synthesized
ccatgctgttttggtgacta

SEQ ID NO: 288353 - DNA, 20 bp, Artificial Sequence
  chemically synthesized
caaactatactataaggcca

SEQ ID NO: 288354 - DNA, 20 bp, Artificial Sequence
  chemically synthesized
ttttggtgactatggcctta

SEQ ID NO: 288355 - DNA, 20 bp, Artificial Sequence
  chemically synthesized
gtgactatggccttatagta

SEQ ID NO: 288356 - DNA, 20 bp, Artificial Sequence
  chemically synthesized
tgatttcaaactatactata

SEQ ID NO: 288357 - DNA, 20 bp, Artificial Sequence
  chemically synthesized
ctgatttcaaactatactat

SEQ ID NO: 288358 - DNA, 20 bp, Artificial Sequence
  chemically synthesized
cttatagtatagtttgaaat

SEQ ID NO: 288359 - DNA, 20 bp, Artificial Sequence
  chemically synthesized
ttatagtatagtttgaaatc

SEQ ID NO: 288360 - DNA, 20 bp, Artificial Sequence
  chemically synthesized
tagtatagtttgaaatcagg

SEQ ID NO: 288361 - DNA, 20 bp, Artificial Sequence
  chemically synthesized
atcaggtagtgtgatgcctc

SEQ ID NO: 288362 - DNA, 20 bp, Artificial Sequence
  chemically synthesized
agcaaaaagaacaaatctgg

SEQ ID NO: 288363 - DNA, 20 bp, Artificial Sequence
  chemically synthesized
aagcaaaaagaacaaatctg

SEQ ID NO: 288364 - DNA, 20 bp, Artificial Sequence
  chemically synthesized
ctaagcaaaaagaacaaatc

SEQ ID NO: 288365 - DNA, 20 bp, Artificial Sequence
  chemically synthesized
ccagatttgttctttttgct

SEQ ID NO: 288366 - DNA, 20 bp, Artificial Sequence
  chemically synthesized
ccaaagcaagactaagcaaa

SEQ ID NO: 288367 - DNA, 20 bp, Artificial Sequence
  chemically synthesized
tgcacagccaaagcaagact

SEQ ID NO: 288368 - DNA, 20 bp, Artificial Sequence
  chemically synthesized
ctttttgcttagtcttgctt

SEQ ID NO: 288369 - DNA, 20 bp, Artificial Sequence
  chemically synthesized
ggagcctgcacagccaaagc

SEQ ID NO: 288370 - DNA, 20 bp, Artificial Sequence
  chemically synthesized
aaaaggagcctgcacagcca

SEQ ID NO: 288371 - DNA, 20 bp, Artificial Sequence
  chemically synthesized
ttagtcttgctttggctgtg

SEQ ID NO: 288372 - DNA, 20 bp, Artificial Sequence
  chemically synthesized
tagtcttgctttggctgtgc

SEQ ID NO: 288373 - DNA, 20 bp, Artificial Sequence
  chemically synthesized
gaaccaaaaaggagcctgca

SEQ ID NO: 288374 - DNA, 20 bp, Artificial Sequence
  chemically synthesized
tggctgtgcaggctcctttt

SEQ ID NO: 288375 - DNA, 20 bp, Artificial Sequence
  chemically synthesized
attaatatggaaccaaaaag

SEQ ID NO: 288376 - DNA, 20 bp, Artificial Sequence
  chemically synthesized
aaattaatatggaaccaaaa

SEQ ID NO: 288377 - DNA, 20 bp, Artificial Sequence
  chemically synthesized
aaaattaatatggaaccaaa

SEQ ID NO: 288378 - DNA, 20 bp, Artificial Sequence
  chemically synthesized
aaaaaattctaaaattaata

SEQ ID NO: 288379 - DNA, 20 bp, Artificial Sequence
  chemically synthesized
ttttggttccatattaattt

SEQ ID NO: 288380 - DNA, 20 bp, Artificial Sequence
  chemically synthesized
agcatcattcttcacagaat

SEQ ID NO: 288381 - DNA, 20 bp, Artificial Sequence
  chemically synthesized
attttttttctaattctgtg

SEQ ID NO: 288382 - DNA, 20 bp, Artificial Sequence
  chemically synthesized
aataacagcatcattcttca

SEQ ID NO: 288383 - DNA, 20 bp, Artificial Sequence
  chemically synthesized
tgcaatccccatcaaaataa

SEQ ID NO: 288384 - DNA, 20 bp, Artificial Sequence
  chemically synthesized
gaatgatgctgttattttga

SEQ ID NO: 288385 - DNA, 20 bp, Artificial Sequence
  chemically synthesized
aatgatgctgttattttgat

SEQ ID NO: 288386 - DNA, 20 bp, Artificial Sequence
  chemically synthesized
atgatgctgttattttgatg

SEQ ID NO: 288387 - DNA, 20 bp, Artificial Sequence
  chemically synthesized
tggggattgcactgaatttg

SEQ ID NO: 288388 - DNA, 20 bp, Artificial Sequence
  chemically synthesized
ccaaaggcaatctacaaatt

SEQ ID NO: 288389 - DNA, 20 bp, Artificial Sequence
  chemically synthesized
ctgaatttgtagattgcctt

SEQ ID NO: 288390 - DNA, 20 bp, Artificial Sequence
  chemically synthesized
aatttgtagattgcctttgg

SEQ ID NO: 288391 - DNA, 20 bp, Artificial Sequence
  chemically synthesized
gaaaatgaccatactgccaa

SEQ ID NO: 288392 - DNA, 20 bp, Artificial Sequence
  chemically synthesized
tgaaaatgaccatactgcca

SEQ ID NO: 288393 - DNA, 20 bp, Artificial Sequence
  chemically synthesized
gtagattgcctttggcagta

SEQ ID NO: 288394 - DNA, 20 bp, Artificial Sequence
  chemically synthesized
tagtcgtggatgggtacaat

SEQ ID NO: 288395 - DNA, 20 bp, Artificial Sequence
  chemically synthesized
cacatcccatagtcgtggat

SEQ ID NO: 288396 - DNA, 20 bp, Artificial Sequence
  chemically synthesized
acacatcccatagtcgtgga

SEQ ID NO: 288397 - DNA, 20 bp, Artificial Sequence
  chemically synthesized
attgtacccatccacgacta

SEQ ID NO: 288398 - DNA, 20 bp, Artificial Sequence
  chemically synthesized
ttgtacccatccacgactat

SEQ ID NO: 288399 - DNA, 20 bp, Artificial Sequence
  chemically synthesized
gaaaacacatcccatagtcg

SEQ ID NO: 288400 - DNA, 20 bp, Artificial Sequence
  chemically synthesized
acaaatgaaaacacatccca

SEQ ID NO: 288401 - DNA, 20 bp, Artificial Sequence
  chemically synthesized
aacactgctgaaagaaatca

SEQ ID NO: 288402 - DNA, 20 bp, Artificial Sequence
  chemically synthesized
gtgtcatctatgatttcttt

SEQ ID NO: 288403 - DNA, 20 bp, Artificial Sequence
  chemically synthesized
tcatctatgatttctttcag

SEQ ID NO: 288404 - DNA, 20 bp, Artificial Sequence
  chemically synthesized
aaactaccaaacactgctga

SEQ ID NO: 288405 - DNA, 20 bp, Artificial Sequence
  chemically synthesized
tgatttctttcagcagtgtt

SEQ ID NO: 288406 - DNA, 20 bp, Artificial Sequence
  chemically synthesized
tttctttcagcagtgtttgg

SEQ ID NO: 288407 - DNA, 20 bp, Artificial Sequence
  chemically synthesized
cagtgtttggtagttttcct

SEQ ID NO: 288408 - DNA, 20 bp, Artificial Sequence
  chemically synthesized
gtgtttggtagttttccttg

SEQ ID NO: 288409 - DNA, 20 bp, Artificial Sequence
  chemically synthesized
gtttggtagttttccttgga

SEQ ID NO: 288410 - DNA, 20 bp, Artificial Sequence
  chemically synthesized
tttggtagttttccttggag

SEQ ID NO: 288411 - DNA, 20 bp, Artificial Sequence
  chemically synthesized
ggagtcgaaagacctctcca

SEQ ID NO: 288412 - DNA, 20 bp, Artificial Sequence
  chemically synthesized
aggagtcgaaagacctctcc

SEQ ID NO: 288413 - DNA, 20 bp, Artificial Sequence
  chemically synthesized
atacctaaccaaggagtcga

SEQ ID NO: 288414 - DNA, 20 bp, Artificial Sequence
  chemically synthesized
ggagaggtctttcgactcct

SEQ ID NO: 288415 - DNA, 20 bp, Artificial Sequence
  chemically synthesized
aggtctttcgactccttggt

SEQ ID NO: 288416 - DNA, 20 bp, Artificial Sequence
  chemically synthesized
ggtctttcgactccttggtt

SEQ ID NO: 288417 - DNA, 20 bp, Artificial Sequence
  chemically synthesized
taggaatatacctaaccaag

SEQ ID NO: 288418 - DNA, 20 bp, Artificial Sequence
  chemically synthesized
cttaggaatatacctaacca

SEQ ID NO: 288419 - DNA, 20 bp, Artificial Sequence
  chemically synthesized
acttaggaatatacctaacc

SEQ ID NO: 288420 - DNA, 20 bp, Artificial Sequence
  chemically synthesized
ccttggttaggtatattcct

SEQ ID NO: 288421 - DNA, 20 bp, Artificial Sequence
  chemically synthesized
acaacaacaacaaaaaactt

SEQ ID NO: 288422 - DNA, 20 bp, Artificial Sequence
  chemically synthesized
aacaacaacaacaaaaaact

SEQ ID NO: 288423 - DNA, 20 bp, Artificial Sequence
  chemically synthesized
ttattttattttattttttg

SEQ ID NO: 288424 - DNA, 20 bp, Artificial Sequence
  chemically synthesized
attttttgcagctattgtaa

SEQ ID NO: 288425 - DNA, 20 bp, Artificial Sequence
  chemically synthesized
ttttttgcagctattgtaaa

SEQ ID NO: 288426 - DNA, 20 bp, Artificial Sequence
  chemically synthesized
gaactcaaccccttttacaa

SEQ ID NO: 288427 - DNA, 20 bp, Artificial Sequence
  chemically synthesized
tttttgcagctattgtaaaa

SEQ ID NO: 288428 - DNA, 20 bp, Artificial Sequence
  chemically synthesized
ttttgcagctattgtaaaag

SEQ ID NO: 288429 - DNA, 20 bp, Artificial Sequence
  chemically synthesized
cagctattgtaaaaggggtt

SEQ ID NO: 288430 - DNA, 20 bp, Artificial Sequence
  chemically synthesized
accaagcagagaatcaaatt

SEQ ID NO: 288431 - DNA, 20 bp, Artificial Sequence
  chemically synthesized
tcttaatttgattctctgct

SEQ ID NO: 288432 - DNA, 20 bp, Artificial Sequence
  chemically synthesized
ataccaacaacgaccaagca

SEQ ID NO: 288433 - DNA, 20 bp, Artificial Sequence
  chemically synthesized
gtataccaacaacgaccaag

SEQ ID NO: 288434 - DNA, 20 bp, Artificial Sequence
  chemically synthesized
tctgtataccaacaacgacc

SEQ ID NO: 288435 - DNA, 20 bp, Artificial Sequence
  chemically synthesized
attctctgcttggtcgttgt

SEQ ID NO: 288436 - DNA, 20 bp, Artificial Sequence
  chemically synthesized
gcttggtcgttgttggtata

SEQ ID NO: 288437 - DNA, 20 bp, Artificial Sequence
  chemically synthesized
tggtcgttgttggtatacag

SEQ ID NO: 288438 - DNA, 20 bp, Artificial Sequence
  chemically synthesized
gtcgttgttggtatacagaa

SEQ ID NO: 288439 - DNA, 20 bp, Artificial Sequence
  chemically synthesized
gattaatgtacaaaaatcag

SEQ ID NO: 288440 - DNA, 20 bp, Artificial Sequence
  chemically synthesized
caagattaatgtacaaaaat

SEQ ID NO: 288441 - DNA, 20 bp, Artificial Sequence
  chemically synthesized
ttgtacattaatcttgtatc

SEQ ID NO: 288442 - DNA, 20 bp, Artificial Sequence
  chemically synthesized
tcagcaacatttccagatac

SEQ ID NO: 288443 - DNA, 20 bp, Artificial Sequence
  chemically synthesized
aaataattcagcaacatttc

SEQ ID NO: 288444 - DNA, 20 bp, Artificial Sequence
  chemically synthesized
ctagaactgataaaataatt

SEQ ID NO: 288445 - DNA, 20 bp, Artificial Sequence
  chemically synthesized
atgttgctgaattattttat

SEQ ID NO: 288446 - DNA, 20 bp, Artificial Sequence
  chemically synthesized
ctgaattattttatcagttc

SEQ ID NO: 288447 - DNA, 20 bp, Artificial Sequence
  chemically synthesized
ggattcctccagaaagtttc

SEQ ID NO: 288448 - DNA, 20 bp, Artificial Sequence
  chemically synthesized
tatcagttctagaaactttc

SEQ ID NO: 288449 - DNA, 20 bp, Artificial Sequence
  chemically synthesized
tcagttctagaaactttctg

SEQ ID NO: 288450 - DNA, 20 bp, Artificial Sequence
  chemically synthesized
cagttctagaaactttctgg

SEQ ID NO: 288451 - DNA, 20 bp, Artificial Sequence
  chemically synthesized
accctaaggattcctccaga

SEQ ID NO: 288452 - DNA, 20 bp, Artificial Sequence
  chemically synthesized
caaaaccctaaggattcctc

SEQ ID NO: 288453 - DNA, 20 bp, Artificial Sequence
  chemically synthesized
aaactttctggaggaatcct

SEQ ID NO: 288454 - DNA, 20 bp, Artificial Sequence
  chemically synthesized
aactttctggaggaatcctt

SEQ ID NO: 288455 - DNA, 20 bp, Artificial Sequence
  chemically synthesized
actttctggaggaatcctta

SEQ ID NO: 288456 - DNA, 20 bp, Artificial Sequence
  chemically synthesized
catttaccttcaaaacccta

SEQ ID NO: 288457 - DNA, 20 bp, Artificial Sequence
  chemically synthesized
tcatttaccttcaaaaccct

SEQ ID NO: 288458 - DNA, 20 bp, Artificial Sequence
  chemically synthesized
gaggaatccttagggttttg

SEQ ID NO: 288459 - DNA, 20 bp, Artificial Sequence
  chemically synthesized
aggaatccttagggttttga

SEQ ID NO: 288460 - DNA, 20 bp, Artificial Sequence
  chemically synthesized
tttgaaggtaaatgatcata

SEQ ID NO: 288461 - DNA, 20 bp, Artificial Sequence
  chemically synthesized
aaggtaaatgatcatatagt

SEQ ID NO: 288462 - DNA, 20 bp, Artificial Sequence
  chemically synthesized
atatagtcggcaaacactga

SEQ ID NO: 288463 - DNA, 20 bp, Artificial Sequence
  chemically synthesized
taaagaggaagtcaaactgt

SEQ ID NO: 288464 - DNA, 20 bp, Artificial Sequence
  chemically synthesized
catccaaatcggtaaagagg

SEQ ID NO: 288465 - DNA, 20 bp, Artificial Sequence
  chemically synthesized
gggcatccaaatcggtaaag

SEQ ID NO: 288466 - DNA, 20 bp, Artificial Sequence
  chemically synthesized
agggcatccaaatcggtaaa

SEQ ID NO: 288467 - DNA, 20 bp, Artificial Sequence
  chemically synthesized
aaagggcatccaaatcggta

SEQ ID NO: 288468 - DNA, 20 bp, Artificial Sequence
  chemically synthesized
tgacttcctctttaccgatt

SEQ ID NO: 288469 - DNA, 20 bp, Artificial Sequence
  chemically synthesized
gaaataaagggcatccaaat

SEQ ID NO: 288470 - DNA, 20 bp, Artificial Sequence
  chemically synthesized
agacaagagaaagaaataaa

SEQ ID NO: 288471 - DNA, 20 bp, Artificial Sequence
  chemically synthesized
cagacaagagaaagaaataa

SEQ ID NO: 288472 - DNA, 20 bp, Artificial Sequence
  chemically synthesized
tcagacaagagaaagaaata

SEQ ID NO: 288473 - DNA, 20 bp, Artificial Sequence
  chemically synthesized
cagagcagtcagacaagaga

SEQ ID NO: 288474 - DNA, 20 bp, Artificial Sequence
  chemically synthesized
tagccagagcagtcagacaa

SEQ ID NO: 288475 - DNA, 20 bp, Artificial Sequence
  chemically synthesized
cctagccagagcagtcagac

SEQ ID NO: 288476 - DNA, 20 bp, Artificial Sequence
  chemically synthesized
tttctcttgtctgactgctc

SEQ ID NO: 288477 - DNA, 20 bp, Artificial Sequence
  chemically synthesized
gaagtcctagccagagcagt

SEQ ID NO: 288478 - DNA, 20 bp, Artificial Sequence
  chemically synthesized
tcttgtctgactgctctggc

SEQ ID NO: 288479 - DNA, 20 bp, Artificial Sequence
  chemically synthesized
actagaagtcctagccagag

SEQ ID NO: 288480 - DNA, 20 bp, Artificial Sequence
  chemically synthesized
cttgtctgactgctctggct

SEQ ID NO: 288481 - DNA, 20 bp, Artificial Sequence
  chemically synthesized
agtactagaagtcctagcca

SEQ ID NO: 288482 - DNA, 20 bp, Artificial Sequence
  chemically synthesized
atagtactagaagtcctagc

SEQ ID NO: 288483 - DNA, 20 bp, Artificial Sequence
  chemically synthesized
actgctctggctaggacttc

SEQ ID NO: 288484 - DNA, 20 bp, Artificial Sequence
  chemically synthesized
cagcatagtactagaagtcc

SEQ ID NO: 288485 - DNA, 20 bp, Artificial Sequence
  chemically synthesized
cctcttcagcatagtactag

SEQ ID NO: 288486 - DNA, 20 bp, Artificial Sequence
  chemically synthesized
actcctcttcagcatagtac

SEQ ID NO: 288487 - DNA, 20 bp, Artificial Sequence
  chemically synthesized
ggacttctagtactatgctg

SEQ ID NO: 288488 - DNA, 20 bp, Artificial Sequence
  chemically synthesized
acttctagtactatgctgaa

SEQ ID NO: 288489 - DNA, 20 bp, Artificial Sequence
  chemically synthesized
cttgccactcctcttcagca

SEQ ID NO: 288490 - DNA, 20 bp, Artificial Sequence
  chemically synthesized
cttctagtactatgctgaag

SEQ ID NO: 288491 - DNA, 20 bp, Artificial Sequence
  chemically synthesized
tctagtactatgctgaagag

SEQ ID NO: 288492 - DNA, 20 bp, Artificial Sequence
  chemically synthesized
ccactcttgccactcctctt

SEQ ID NO: 288493 - DNA, 20 bp, Artificial Sequence
  chemically synthesized
agtactatgctgaagaggag

SEQ ID NO: 288494 - DNA, 20 bp, Artificial Sequence
  chemically synthesized
ctatgctgaagaggagtggc

SEQ ID NO: 288495 - DNA, 20 bp, Artificial Sequence
  chemically synthesized
atgctgaagaggagtggcaa

SEQ ID NO: 288496 - DNA, 20 bp, Artificial Sequence
  chemically synthesized
ctgaagaggagtggcaagag

SEQ ID NO: 288497 - DNA, 20 bp, Artificial Sequence
  chemically synthesized
atatgcatttatttgaattc

SEQ ID NO: 288498 - DNA, 20 bp, Artificial Sequence
  chemically synthesized
tttgtttattaataatcatc

SEQ ID NO: 288499 - DNA, 20 bp, Artificial Sequence
  chemically synthesized
tattaataaacaaaatccaa

SEQ ID NO: 288500 - DNA, 20 bp, Artificial Sequence
  chemically synthesized
attaataaacaaaatccaaa

SEQ ID NO: 288501 - DNA, 20 bp, Artificial Sequence
  chemically synthesized
ttaataaacaaaatccaaaa

SEQ ID NO: 288502 - DNA, 20 bp, Artificial Sequence
  chemically synthesized
gctatttataaggtcccttt

SEQ ID NO: 288503 - DNA, 20 bp, Artificial Sequence
  chemically synthesized
tccaaaagggaccttataaa

SEQ ID NO: 288504 - DNA, 20 bp, Artificial Sequence
  chemically synthesized
ttacttcactgctatttata

SEQ ID NO: 288505 - DNA, 20 bp, Artificial Sequence
  chemically synthesized
tttacttcactgctatttat

SEQ ID NO: 288506 - DNA, 20 bp, Artificial Sequence
  chemically synthesized
aaaagggaccttataaatag

SEQ ID NO: 288507 - DNA, 20 bp, Artificial Sequence
  chemically synthesized
ggaccttataaatagcagtg

SEQ ID NO: 288508 - DNA, 20 bp, Artificial Sequence
  chemically synthesized
ttataaatagcagtgaagta

SEQ ID NO: 288509 - DNA, 20 bp, Artificial Sequence
  chemically synthesized
ataaatagcagtgaagtaaa

SEQ ID NO: 288510 - DNA, 20 bp, Artificial Sequence
  chemically synthesized
taaatagcagtgaagtaaag

SEQ ID NO: 288511 - DNA, 20 bp, Artificial Sequence
  chemically synthesized
cagtgaagtaaagaggtatt

SEQ ID NO: 288512 - DNA, 20 bp, Artificial Sequence
  chemically synthesized
agaggtatttagttacaatg

SEQ ID NO: 288513 - DNA, 20 bp, Artificial Sequence
  chemically synthesized
tgaagcaaatgattgtgtct

SEQ ID NO: 288514 - DNA, 20 bp, Artificial Sequence
  chemically synthesized
catttgctgaaatgacatct

SEQ ID NO: 288515 - DNA, 20 bp, Artificial Sequence
  chemically synthesized
ttgtgtctgagatgtcattt

SEQ ID NO: 288516 - DNA, 20 bp, Artificial Sequence
  chemically synthesized
tgtcatttcagcaaatgatc

SEQ ID NO: 288517 - DNA, 20 bp, Artificial Sequence
  chemically synthesized
catttcagcaaatgatctag

SEQ ID NO: 288518 - DNA, 20 bp, Artificial Sequence
  chemically synthesized
atttcagcaaatgatctaga

SEQ ID NO: 288519 - DNA, 20 bp, Artificial Sequence
  chemically synthesized
ttcagcaaatgatctagaag

SEQ ID NO: 288520 - DNA, 20 bp, Artificial Sequence
  chemically synthesized
cagcaaatgatctagaagga

SEQ ID NO: 288521 - DNA, 20 bp, Artificial Sequence
  chemically synthesized
agcaaatgatctagaaggag

SEQ ID NO: 288522 - DNA, 20 bp, Artificial Sequence
  chemically synthesized
cccatagtcccctctccttc

SEQ ID NO: 288523 - DNA, 20 bp, Artificial Sequence
  chemically synthesized
gcaaatgatctagaaggaga

SEQ ID NO: 288524 - DNA, 20 bp, Artificial Sequence
  chemically synthesized
caaatgatctagaaggagag

SEQ ID NO: 288525 - DNA, 20 bp, Artificial Sequence
  chemically synthesized
tctagaaggagaggggacta

SEQ ID NO: 288526 - DNA, 20 bp, Artificial Sequence
  chemically synthesized
ctagaaggagaggggactat

SEQ ID NO: 288527 - DNA, 20 bp, Artificial Sequence
  chemically synthesized
gaaggagaggggactatggg

SEQ ID NO: 288528 - DNA, 20 bp, Artificial Sequence
  chemically synthesized
taccgccatgtgtctgccca

SEQ ID NO: 288529 - DNA, 20 bp, Artificial Sequence
  chemically synthesized
ggggactatgggcagacaca

SEQ ID NO: 288530 - DNA, 20 bp, Artificial Sequence
  chemically synthesized
gactatgggcagacacatgg

SEQ ID NO: 288531 - DNA, 20 bp, Artificial Sequence
  chemically synthesized
gcagacacatggcggtatgt

SEQ ID NO: 288532 - DNA, 20 bp, Artificial Sequence
  chemically synthesized
cggtatgttggatgaatcat

SEQ ID NO: 288533 - DNA, 20 bp, Artificial Sequence
  chemically synthesized
caattaaaccaaattttatg

SEQ ID NO: 288534 - DNA, 20 bp, Artificial Sequence
  chemically synthesized
atcataagcttcataaaatt

SEQ ID NO: 288535 - DNA, 20 bp, Artificial Sequence
  chemically synthesized
gttaaagaggagacatgttc

SEQ ID NO: 288536 - DNA, 20 bp, Artificial Sequence
  chemically synthesized
accagaaagaagttaaagag

SEQ ID NO: 288537 - DNA, 20 bp, Artificial Sequence
  chemically synthesized
agaccagaaagaagttaaag

SEQ ID NO: 288538 - DNA, 20 bp, Artificial Sequence
  chemically synthesized
aagaccagaaagaagttaaa

SEQ ID NO: 288539 - DNA, 20 bp, Artificial Sequence
  chemically synthesized
gaaagaccagaaagaagtta

SEQ ID NO: 288540 - DNA, 20 bp, Artificial Sequence
  chemically synthesized
tctcctctttaacttctttc

SEQ ID NO: 288541 - DNA, 20 bp, Artificial Sequence
  chemically synthesized
taaacagaaagaccagaaag

SEQ ID NO: 288542 - DNA, 20 bp, Artificial Sequence
  chemically synthesized
cattaaacagaaagaccaga

SEQ ID NO: 288543 - DNA, 20 bp, Artificial Sequence
  chemically synthesized
ttttcattaaacagaaagac

SEQ ID NO: 288544 - DNA, 20 bp, Artificial Sequence
  chemically synthesized
ttcagttttcattaaacaga

SEQ ID NO: 288545 - DNA, 20 bp, Artificial Sequence
  chemically synthesized
gtgtttcagttttcattaaa

SEQ ID NO: 288546 - DNA, 20 bp, Artificial Sequence
  chemically synthesized
attcagagactgaagtgttt

SEQ ID NO: 288547 - DNA, 20 bp, Artificial Sequence
  chemically synthesized
taatgaaaactgaaacactt

SEQ ID NO: 288548 - DNA, 20 bp, Artificial Sequence
  chemically synthesized
gatcaataattcagagactg

SEQ ID NO: 288549 - DNA, 20 bp, Artificial Sequence
  chemically synthesized
agaaaaagatcaataattca

SEQ ID NO: 288550 - DNA, 20 bp, Artificial Sequence
  chemically synthesized
acagaaaaagatcaataatt

SEQ ID NO: 288551 - DNA, 20 bp, Artificial Sequence
  chemically synthesized
gatcagaagttatacagaaa

SEQ ID NO: 288552 - DNA, 20 bp, Artificial Sequence
  chemically synthesized
tggacagatcagaagttata

SEQ ID NO: 288553 - DNA, 20 bp, Artificial Sequence
  chemically synthesized
tcagttgttggacagatcag

SEQ ID NO: 288554 - DNA, 20 bp, Artificial Sequence
  chemically synthesized
gattcagttgttggacagat

SEQ ID NO: 288555 - DNA, 20 bp, Artificial Sequence
  chemically synthesized
tgtgagattcagttgttgga

SEQ ID NO: 288556 - DNA, 20 bp, Artificial Sequence
  chemically synthesized
ttcctgtgagattcagttgt

SEQ ID NO: 288557 - DNA, 20 bp, Artificial Sequence
  chemically synthesized
tgtccaacaactgaatctca

SEQ ID NO: 288558 - DNA, 20 bp, Artificial Sequence
  chemically synthesized
gaagtgattcctgtgagatt

SEQ ID NO: 288559 - DNA, 20 bp, Artificial Sequence
  chemically synthesized
gtccaacaactgaatctcac

SEQ ID NO: 288560 - DNA, 20 bp, Artificial Sequence
  chemically synthesized
caatatgaagtgattcctgt

SEQ ID NO: 288561 - DNA, 20 bp, Artificial Sequence
  chemically synthesized
tcacaggaatcacttcatat

SEQ ID NO: 288562 - DNA, 20 bp, Artificial Sequence
  chemically synthesized
aattatagtttaccaatatg

SEQ ID NO: 288563 - DNA, 20 bp, Artificial Sequence
  chemically synthesized
aaatatgcatgttttaatta

SEQ ID NO: 288564 - DNA, 20 bp, Artificial Sequence
  chemically synthesized
atgagggttggaatgcaagg

SEQ ID NO: 288565 - DNA, 20 bp, Artificial Sequence
  chemically synthesized
gatgagggttggaatgcaag

SEQ ID NO: 288566 - DNA, 20 bp, Artificial Sequence
  chemically synthesized
aggatgagggttggaatgca

SEQ ID NO: 288567 - DNA, 20 bp, Artificial Sequence
  chemically synthesized
taggatgagggttggaatgc

SEQ ID NO: 288568 - DNA, 20 bp, Artificial Sequence
  chemically synthesized
tacaaaactaggatgagggt

SEQ ID NO: 288569 - DNA, 20 bp, Artificial Sequence
  chemically synthesized
ttgcattccaaccctcatcc

SEQ ID NO: 288570 - DNA, 20 bp, Artificial Sequence
  chemically synthesized
ttaatacaaaactaggatga

SEQ ID NO: 288571 - DNA, 20 bp, Artificial Sequence
  chemically synthesized
tttaatacaaaactaggatg

SEQ ID NO: 288572 - DNA, 20 bp, Artificial Sequence
  chemically synthesized
atttaatacaaaactaggat

SEQ ID NO: 288573 - DNA, 20 bp, Artificial Sequence
  chemically synthesized
aatgaatttaatacaaaact

SEQ ID NO: 288574 - DNA, 20 bp, Artificial Sequence
  chemically synthesized
aaatgaatttaatacaaaac

SEQ ID NO: 288575 - DNA, 20 bp, Artificial Sequence
  chemically synthesized
gtattaaattcatttgaaac

SEQ ID NO: 288576 - DNA, 20 bp, Artificial Sequence
  chemically synthesized
attagattttttgaaatgac

SEQ ID NO: 288577 - DNA, 20 bp, Artificial Sequence
  chemically synthesized
tttcaaaaaatctaatctct

SEQ ID NO: 288578 - DNA, 20 bp, Artificial Sequence
  chemically synthesized
caaaagaatttccaagagat

SEQ ID NO: 288579 - DNA, 20 bp, Artificial Sequence
  chemically synthesized
agctacaaaagaatttccaa

SEQ ID NO: 288580 - DNA, 20 bp, Artificial Sequence
  chemically synthesized
aaagctacaaaagaatttcc

SEQ ID NO: 288581 - DNA, 20 bp, Artificial Sequence
  chemically synthesized
atctcttggaaattcttttg

SEQ ID NO: 288582 - DNA, 20 bp, Artificial Sequence
  chemically synthesized
tttatttcttaaagctacaa

SEQ ID NO: 288583 - DNA, 20 bp, Artificial Sequence
  chemically synthesized
ggaaattcttttgtagcttt

SEQ ID NO: 288584 - DNA, 20 bp, Artificial Sequence
  chemically synthesized
ctttggaagtttatttctta

SEQ ID NO: 288585 - DNA, 20 bp, Artificial Sequence
  chemically synthesized
ctttaagaaataaacttcca

SEQ ID NO: 288586 - DNA, 20 bp, Artificial Sequence
  chemically synthesized
gttcccaaaccaatctttgg

SEQ ID NO: 288587 - DNA, 20 bp, Artificial Sequence
  chemically synthesized
agaaataaacttccaaagat

SEQ ID NO: 288588 - DNA, 20 bp, Artificial Sequence
  chemically synthesized
caagttcccaaaccaatctt

SEQ ID NO: 288589 - DNA, 20 bp, Artificial Sequence
  chemically synthesized
taaacttccaaagattggtt

SEQ ID NO: 288590 - DNA, 20 bp, Artificial Sequence
  chemically synthesized
aaacttccaaagattggttt

SEQ ID NO: 288591 - DNA, 20 bp, Artificial Sequence
  chemically synthesized
acaaactatattagatggac

SEQ ID NO: 288592 - DNA, 20 bp, Artificial Sequence
  chemically synthesized
gggaacttgtccatctaata

SEQ ID NO: 288593 - DNA, 20 bp, Artificial Sequence
  chemically synthesized
gcctcacaaactatattaga

SEQ ID NO: 288594 - DNA, 20 bp, Artificial Sequence
  chemically synthesized
gcttgcctcacaaactatat

SEQ ID NO: 288595 - DNA, 20 bp, Artificial Sequence
  chemically synthesized
gtccatctaatatagtttgt

SEQ ID NO: 288596 - DNA, 20 bp, Artificial Sequence
  chemically synthesized
tccatctaatatagtttgtg

SEQ ID NO: 288597 - DNA, 20 bp, Artificial Sequence
  chemically synthesized
tctaatatagtttgtgaggc

SEQ ID NO: 288598 - DNA, 20 bp, Artificial Sequence
  chemically synthesized
atatagtttgtgaggcaagc

SEQ ID NO: 288599 - DNA, 20 bp, Artificial Sequence
  chemically synthesized
taggtgtgtatttttttttc

SEQ ID NO: 288600 - DNA, 20 bp, Artificial Sequence
  chemically synthesized
attgtgatatttatgttagt

SEQ ID NO: 288601 - DNA, 20 bp, Artificial Sequence
  chemically synthesized
aattgtgatatttatgttag

SEQ ID NO: 288602 - DNA, 20 bp, Artificial Sequence
  chemically synthesized
agaaattgtgatatttatgt

SEQ ID NO: 288603 - DNA, 20 bp, Artificial Sequence
  chemically synthesized
ccacataagaaaatcagaaa

SEQ ID NO: 288604 - DNA, 20 bp, Artificial Sequence
  chemically synthesized
tacattccacataagaaaat

SEQ ID NO: 288605 - DNA, 20 bp, Artificial Sequence
  chemically synthesized
ctttttctgattttcttatg

SEQ ID NO: 288606 - DNA, 20 bp, Artificial Sequence
  chemically synthesized
agtgtcattacattccacat

SEQ ID NO: 288607 - DNA, 20 bp, Artificial Sequence
  chemically synthesized
caattactgctgtcattaca

SEQ ID NO: 288608 - DNA, 20 bp, Artificial Sequence
  chemically synthesized
gtaatgacactatgtaatga

SEQ ID NO: 288609 - DNA, 20 bp, Artificial Sequence
  chemically synthesized
atgacactatgtaatgacag

SEQ ID NO: 288610 - DNA, 20 bp, Artificial Sequence
  chemically synthesized
tgacagcagtaattgctatc

SEQ ID NO: 288611 - DNA, 20 bp, Artificial Sequence
  chemically synthesized
gacagcagtaattgctatca

SEQ ID NO: 288612 - DNA, 20 bp, Artificial Sequence
  chemically synthesized
aagcatttcctgaaccttga

SEQ ID NO: 288613 - DNA, 20 bp, Artificial Sequence
  chemically synthesized
cagtaattgctatcaaggtt

SEQ ID NO: 288614 - DNA, 20 bp, Artificial Sequence
  chemically synthesized
agtaattgctatcaaggttc

SEQ ID NO: 288615 - DNA, 20 bp, Artificial Sequence
  chemically synthesized
tataccgttgcaaatttgtc

SEQ ID NO: 288616 - DNA, 20 bp, Artificial Sequence
  chemically synthesized
aatgcttgacaaatttgcaa

SEQ ID NO: 288617 - DNA, 20 bp, Artificial Sequence
  chemically synthesized
ttgacaaatttgcaacggta

SEQ ID NO: 288618 - DNA, 20 bp, Artificial Sequence
  chemically synthesized
gacaaatttgcaacggtata

SEQ ID NO: 288619 - DNA, 20 bp, Artificial Sequence
  chemically synthesized
ctggcctgcatggtttaaat

SEQ ID NO: 288620 - DNA, 20 bp, Artificial Sequence
  chemically synthesized
agtatctcatttaaaccatg

SEQ ID NO: 288621 - DNA, 20 bp, Artificial Sequence
  chemically synthesized
gtatctcatttaaaccatgc

SEQ ID NO: 288622 - DNA, 20 bp, Artificial Sequence
  chemically synthesized
ctcatttaaaccatgcaggc

SEQ ID NO: 288623 - DNA, 20 bp, Artificial Sequence
  chemically synthesized
ctggcattccctggcctgca

SEQ ID NO: 288624 - DNA, 20 bp, Artificial Sequence
  chemically synthesized
tcatttaaaccatgcaggcc

SEQ ID NO: 288625 - DNA, 20 bp, Artificial Sequence
  chemically synthesized
catttaaaccatgcaggcca

SEQ ID NO: 288626 - DNA, 20 bp, Artificial Sequence
  chemically synthesized
aattcttcactggcattccc

SEQ ID NO: 288627 - DNA, 20 bp, Artificial Sequence
  chemically synthesized
ccatgcaggccagggaatgc

SEQ ID NO: 288628 - DNA, 20 bp, Artificial Sequence
  chemically synthesized
caggccagggaatgccagtg

SEQ ID NO: 288629 - DNA, 20 bp, Artificial Sequence
  chemically synthesized
acagatttagaattcttcac

SEQ ID NO: 288630 - DNA, 20 bp, Artificial Sequence
  chemically synthesized
cttcttatctgaaacagatt

SEQ ID NO: 288631 - DNA, 20 bp, Artificial Sequence
  chemically synthesized
gaagaattctaaatctgttt

SEQ ID NO: 288632 - DNA, 20 bp, Artificial Sequence
  chemically synthesized
ttctttcttcttatctgaaa

SEQ ID NO: 288633 - DNA, 20 bp, Artificial Sequence
  chemically synthesized
attctaaatctgtttcagat

SEQ ID NO: 288634 - DNA, 20 bp, Artificial Sequence
  chemically synthesized
ctaaatctgtttcagataag

SEQ ID NO: 288635 - DNA, 20 bp, Artificial Sequence
  chemically synthesized
atctgtttcagataagaaga

SEQ ID NO: 288636 - DNA, 20 bp, Artificial Sequence
  chemically synthesized
ttcagataagaagaaagaaa

SEQ ID NO: 288637 - DNA, 20 bp, Artificial Sequence
  chemically synthesized
aagaaagaaaaagtcttata

SEQ ID NO: 288638 - DNA, 20 bp, Artificial Sequence
  chemically synthesized
aaagaaaaagtcttatacag

SEQ ID NO: 288639 - DNA, 20 bp, Artificial Sequence
  chemically synthesized
gggtacattagcttctgtat

SEQ ID NO: 288640 - DNA, 20 bp, Artificial Sequence
  chemically synthesized
gtgtttgcccttgggtacat

SEQ ID NO: 288641 - DNA, 20 bp, Artificial Sequence
  chemically synthesized
atacagaagctaatgtaccc

SEQ ID NO: 288642 - DNA, 20 bp, Artificial Sequence
  chemically synthesized
tacagaagctaatgtaccca

SEQ ID NO: 288643 - DNA, 20 bp, Artificial Sequence
  chemically synthesized
acagaagctaatgtacccaa

SEQ ID NO: 288644 - DNA, 20 bp, Artificial Sequence
  chemically synthesized
ctcatactgtgtttgccctt

SEQ ID NO: 288645 - DNA, 20 bp, Artificial Sequence
  chemically synthesized
gctcatactgtgtttgccct

SEQ ID NO: 288646 - DNA, 20 bp, Artificial Sequence
  chemically synthesized
aatgtacccaagggcaaaca

SEQ ID NO: 288647 - DNA, 20 bp, Artificial Sequence
  chemically synthesized
cccaagggcaaacacagtat

SEQ ID NO: 288648 - DNA, 20 bp, Artificial Sequence
  chemically synthesized
tcaccagctagtaggtgggg

SEQ ID NO: 288649 - DNA, 20 bp, Artificial Sequence
  chemically synthesized
gtatgagctgccccacctac

SEQ ID NO: 288650 - DNA, 20 bp, Artificial Sequence
  chemically synthesized
atctcaccagctagtaggtg

SEQ ID NO: 288651 - DNA, 20 bp, Artificial Sequence
  chemically synthesized
tatctcaccagctagtaggt

SEQ ID NO: 288652 - DNA, 20 bp, Artificial Sequence
  chemically synthesized
atatctcaccagctagtagg

SEQ ID NO: 288653 - DNA, 20 bp, Artificial Sequence
  chemically synthesized
gagctgccccacctactagc

SEQ ID NO: 288654 - DNA, 20 bp, Artificial Sequence
  chemically synthesized
cagatatctcaccagctagt

SEQ ID NO: 288655 - DNA, 20 bp, Artificial Sequence
  chemically synthesized
acagatatctcaccagctag

SEQ ID NO: 288656 - DNA, 20 bp, Artificial Sequence
  chemically synthesized
tgccccacctactagctggt

SEQ ID NO: 288657 - DNA, 20 bp, Artificial Sequence
  chemically synthesized
tctacagatatctcaccagc

SEQ ID NO: 288658 - DNA, 20 bp, Artificial Sequence
  chemically synthesized
agcatctacagatatctcac

SEQ ID NO: 288659 - DNA, 20 bp, Artificial Sequence
  chemically synthesized
actagctggtgagatatctg

SEQ ID NO: 288660 - DNA, 20 bp, Artificial Sequence
  chemically synthesized
gatcacaagggcagcatcta

SEQ ID NO: 288661 - DNA, 20 bp, Artificial Sequence
  chemically synthesized
ctatgttgggatcacaaggg

SEQ ID NO: 288662 - DNA, 20 bp, Artificial Sequence
  chemically synthesized
ctcctatgttgggatcacaa

SEQ ID NO: 288663 - DNA, 20 bp, Artificial Sequence
  chemically synthesized
gctcctatgttgggatcaca

SEQ ID NO: 288664 - DNA, 20 bp, Artificial Sequence
  chemically synthesized
tgctcctatgttgggatcac

SEQ ID NO: 288665 - DNA, 20 bp, Artificial Sequence
  chemically synthesized
ctgcccttgtgatcccaaca

SEQ ID NO: 288666 - DNA, 20 bp, Artificial Sequence
  chemically synthesized
tgcccttgtgatcccaacat

SEQ ID NO: 288667 - DNA, 20 bp, Artificial Sequence
  chemically synthesized
cccttgtgatcccaacatag

SEQ ID NO: 288668 - DNA, 20 bp, Artificial Sequence
  chemically synthesized
tctatttctgctcctatgtt

SEQ ID NO: 288669 - DNA, 20 bp, Artificial Sequence
  chemically synthesized
gtctatttctgctcctatgt

SEQ ID NO: 288670 - DNA, 20 bp, Artificial Sequence
  chemically synthesized
ttgtgatcccaacataggag

SEQ ID NO: 288671 - DNA, 20 bp, Artificial Sequence
  chemically synthesized
tcccaacataggagcagaaa

SEQ ID NO: 288672 - DNA, 20 bp, Artificial Sequence
  chemically synthesized
acataggagcagaaatagac

SEQ ID NO: 288673 - DNA, 20 bp, Artificial Sequence
  chemically synthesized
tgagtttccgtagatggagc

SEQ ID NO: 288674 - DNA, 20 bp, Artificial Sequence
  chemically synthesized
aaatagaccagctccatcta

SEQ ID NO: 288675 - DNA, 20 bp, Artificial Sequence
  chemically synthesized
aaagtgagtttccgtagatg

SEQ ID NO: 288676 - DNA, 20 bp, Artificial Sequence
  chemically synthesized
aaaaagtgagtttccgtaga

SEQ ID NO: 288677 - DNA, 20 bp, Artificial Sequence
  chemically synthesized
ggaaaaaaagtgagtttccg

SEQ ID NO: 288678 - DNA, 20 bp, Artificial Sequence
  chemically synthesized
tacataaaaggaaaaaaagt

SEQ ID NO: 288679 - DNA, 20 bp, Artificial Sequence
  chemically synthesized
tttctacataaaaggaaaaa

SEQ ID NO: 288680 - DNA, 20 bp, Artificial Sequence
  chemically synthesized
tcactttttttccttttatg

SEQ ID NO: 288681 - DNA, 20 bp, Artificial Sequence
  chemically synthesized
aatctctatttctacataaa

SEQ ID NO: 288682 - DNA, 20 bp, Artificial Sequence
  chemically synthesized
taatctctatttctacataa

SEQ ID NO: 288683 - DNA, 20 bp, Artificial Sequence
  chemically synthesized
tttttccttttatgtagaaa

SEQ ID NO: 288684 - DNA, 20 bp, Artificial Sequence
  chemically synthesized
tttccttttatgtagaaata

SEQ ID NO: 288685 - DNA, 20 bp, Artificial Sequence
  chemically synthesized
aatagagattaataatccaa

SEQ ID NO: 288686 - DNA, 20 bp, Artificial Sequence
  chemically synthesized
agattaataatccaacagat

SEQ ID NO: 288687 - DNA, 20 bp, Artificial Sequence
  chemically synthesized
gtaaagataaacttatctgt

SEQ ID NO: 288688 - DNA, 20 bp, Artificial Sequence
  chemically synthesized
gataagtttatctttactga

SEQ ID NO: 288689 - DNA, 20 bp, Artificial Sequence
  chemically synthesized
ttgtcttattgctgtcagta

SEQ ID NO: 288690 - DNA, 20 bp, Artificial Sequence
  chemically synthesized
gtttattgtcttattgctgt

SEQ ID NO: 288691 - DNA, 20 bp, Artificial Sequence
  chemically synthesized
ttatctttactgacagcaat

SEQ ID NO: 288692 - DNA, 20 bp, Artificial Sequence
  chemically synthesized
aagatggtaggttattagat

SEQ ID NO: 288693 - DNA, 20 bp, Artificial Sequence
  chemically synthesized
cttttaagatggtaggttat

SEQ ID NO: 288694 - DNA, 20 bp, Artificial Sequence
  chemically synthesized
tcgaggtcttttaagatggt

SEQ ID NO: 288695 - DNA, 20 bp, Artificial Sequence
  chemically synthesized
ctcgaggtcttttaagatgg

SEQ ID NO: 288696 - DNA, 20 bp, Artificial Sequence
  chemically synthesized
ctaataacctaccatcttaa

SEQ ID NO: 288697 - DNA, 20 bp, Artificial Sequence
  chemically synthesized
actctcgaggtcttttaaga

SEQ ID NO: 288698 - DNA, 20 bp, Artificial Sequence
  chemically synthesized
tagaactctcgaggtctttt

SEQ ID NO: 288699 - DNA, 20 bp, Artificial Sequence
  chemically synthesized
ctaccatcttaaaagacctc

SEQ ID NO: 288700 - DNA, 20 bp, Artificial Sequence
  chemically synthesized
accatcttaaaagacctcga

SEQ ID NO: 288701 - DNA, 20 bp, Artificial Sequence
  chemically synthesized
tgatgtcagtagaactctcg

SEQ ID NO: 288702 - DNA, 20 bp, Artificial Sequence
  chemically synthesized
atgatgtcagtagaactctc

SEQ ID NO: 288703 - DNA, 20 bp, Artificial Sequence
  chemically synthesized
gctgagtctaatgatgtcag

SEQ ID NO: 288704 - DNA, 20 bp, Artificial Sequence
  chemically synthesized
gagagttctactgacatcat

SEQ ID NO: 288705 - DNA, 20 bp, Artificial Sequence
  chemically synthesized
tgtgctgagtctaatgatgt

SEQ ID NO: 288706 - DNA, 20 bp, Artificial Sequence
  chemically synthesized
tctactgacatcattagact

SEQ ID NO: 288707 - DNA, 20 bp, Artificial Sequence
  chemically synthesized
tgacatcattagactcagca

SEQ ID NO: 288708 - DNA, 20 bp, Artificial Sequence
  chemically synthesized
atttttcctgagtctgtgct

SEQ ID NO: 288709 - DNA, 20 bp, Artificial Sequence
  chemically synthesized
cattagactcagcacagact

SEQ ID NO: 288710 - DNA, 20 bp, Artificial Sequence
  chemically synthesized
attagactcagcacagactc

SEQ ID NO: 288711 - DNA, 20 bp, Artificial Sequence
  chemically synthesized
cttcaggccatatttttcct

SEQ ID NO: 288712 - DNA, 20 bp, Artificial Sequence
  chemically synthesized
gcacagactcaggaaaaata

SEQ ID NO: 288713 - DNA, 20 bp, Artificial Sequence
  chemically synthesized
ctcaggaaaaatatggcctg

SEQ ID NO: 288714 - DNA, 20 bp, Artificial Sequence
  chemically synthesized
tggctaaacgttaaatcttc

SEQ ID NO: 288715 - DNA, 20 bp, Artificial Sequence
  chemically synthesized
ttggctaaacgttaaatctt

SEQ ID NO: 288716 - DNA, 20 bp, Artificial Sequence
  chemically synthesized
tggcctgaagatttaacgtt

SEQ ID NO: 288717 - DNA, 20 bp, Artificial Sequence
  chemically synthesized
catatttataagcaatatat

SEQ ID NO: 288718 - DNA, 20 bp, Artificial Sequence
  chemically synthesized
gaaaaaagttacatatttat

SEQ ID NO: 288719 - DNA, 20 bp, Artificial Sequence
  chemically synthesized
aatactttctttagagaaaa

SEQ ID NO: 288720 - DNA, 20 bp, Artificial Sequence
  chemically synthesized
atatgtaacttttttctcta

SEQ ID NO: 288721 - DNA, 20 bp, Artificial Sequence
  chemically synthesized
gtaacttttttctctaaaga

SEQ ID NO: 288722 - DNA, 20 bp, Artificial Sequence
  chemically synthesized
tcataggaatactttcttta

SEQ ID NO: 288723 - DNA, 20 bp, Artificial Sequence
  chemically synthesized
tgtcataggaatactttctt

SEQ ID NO: 288724 - DNA, 20 bp, Artificial Sequence
  chemically synthesized
taaagaaagtattcctatga

SEQ ID NO: 288725 - DNA, 20 bp, Artificial Sequence
  chemically synthesized
cgaatagtagaaactgtcat

SEQ ID NO: 288726 - DNA, 20 bp, Artificial Sequence
  chemically synthesized
ccgaatagtagaaactgtca

SEQ ID NO: 288727 - DNA, 20 bp, Artificial Sequence
  chemically synthesized
ctatgacagtttctactatt

SEQ ID NO: 288728 - DNA, 20 bp, Artificial Sequence
  chemically synthesized
gtcctttagcagccgaatag

SEQ ID NO: 288729 - DNA, 20 bp, Artificial Sequence
  chemically synthesized
gtggtcctttagcagccgaa

SEQ ID NO: 288730 - DNA, 20 bp, Artificial Sequence
  chemically synthesized
tttctactattcggctgcta

SEQ ID NO: 288731 - DNA, 20 bp, Artificial Sequence
  chemically synthesized
ttctactattcggctgctaa

SEQ ID NO: 288732 - DNA, 20 bp, Artificial Sequence
  chemically synthesized
tttttaaagtggtcctttag

SEQ ID NO: 288733 - DNA, 20 bp, Artificial Sequence
  chemically synthesized
gcatttttaaagtggtcctt

SEQ ID NO: 288734 - DNA, 20 bp, Artificial Sequence
  chemically synthesized
agatatctgcatttttaaag

SEQ ID NO: 288735 - DNA, 20 bp, Artificial Sequence
  chemically synthesized
aaaagatatctgcattttta

SEQ ID NO: 288736 - DNA, 20 bp, Artificial Sequence
  chemically synthesized
aaaggaccactttaaaaatg

SEQ ID NO: 288737 - DNA, 20 bp, Artificial Sequence
  chemically synthesized
taaaaatgcagatatctttt

SEQ ID NO: 288738 - DNA, 20 bp, Artificial Sequence
  chemically synthesized
atttcactaataaaaccaaa

SEQ ID NO: 288739 - DNA, 20 bp, Artificial Sequence
  chemically synthesized
agatatctttttggttttat

SEQ ID NO: 288740 - DNA, 20 bp, Artificial Sequence
  chemically synthesized
aacaaaatgaaaatcaatat

SEQ ID NO: 288741 - DNA, 20 bp, Artificial Sequence
  chemically synthesized
aaatcaatataagtgattgc

SEQ ID NO: 288742 - DNA, 20 bp, Artificial Sequence
  chemically synthesized
aatataagtgattgcaagct

SEQ ID NO: 288743 - DNA, 20 bp, Artificial Sequence
  chemically synthesized
ataagtgattgcaagcttgg

SEQ ID NO: 288744 - DNA, 20 bp, Artificial Sequence
  chemically synthesized
aatttacagcacgtgcttcc

SEQ ID NO: 288745 - DNA, 20 bp, Artificial Sequence
  chemically synthesized
tttattttcccaataattta

SEQ ID NO: 288746 - DNA, 20 bp, Artificial Sequence
  chemically synthesized
aagcacgtgctgtaaattat

SEQ ID NO: 288747 - DNA, 20 bp, Artificial Sequence
  chemically synthesized
agcacgtgctgtaaattatt

SEQ ID NO: 288748 - DNA, 20 bp, Artificial Sequence
  chemically synthesized
ttattgggaaaataaaaatt

SEQ ID NO: 288749 - DNA, 20 bp, Artificial Sequence
  chemically synthesized
tattgggaaaataaaaatta

SEQ ID NO: 288750 - DNA, 20 bp, Artificial Sequence
  chemically synthesized
attgggaaaataaaaattaa

SEQ ID NO: 288751 - DNA, 20 bp, Artificial Sequence
  chemically synthesized
taaacagtagtgcaggatag

SEQ ID NO: 288752 - DNA, 20 bp, Artificial Sequence
  chemically synthesized
gataaacagtagtgcaggat

SEQ ID NO: 288753 - DNA, 20 bp, Artificial Sequence
  chemically synthesized
agataaacagtagtgcagga

SEQ ID NO: 288754 - DNA, 20 bp, Artificial Sequence
  chemically synthesized
ttcaagataaacagtagtgc

SEQ ID NO: 288755 - DNA, 20 bp, Artificial Sequence
  chemically synthesized
tttcaagataaacagtagtg

SEQ ID NO: 288756 - DNA, 20 bp, Artificial Sequence
  chemically synthesized
ttacttttcaagataaacag

SEQ ID NO: 288757 - DNA, 20 bp, Artificial Sequence
  chemically synthesized
tttttacttttcaagataaa

SEQ ID NO: 288758 - DNA, 20 bp, Artificial Sequence
  chemically synthesized
gcactactgtttatcttgaa

SEQ ID NO: 288759 - DNA, 20 bp, Artificial Sequence
  chemically synthesized
aatttttttttttacttttc

SEQ ID NO: 288760 - DNA, 20 bp, Artificial Sequence
  chemically synthesized
attaaatgtctagatattaa

SEQ ID NO: 288761 - DNA, 20 bp, Artificial Sequence
  chemically synthesized
aaaaaaattccattaatatc

SEQ ID NO: 288762 - DNA, 20 bp, Artificial Sequence
  chemically synthesized
acatggctatattaaatgtc

SEQ ID NO: 288763 - DNA, 20 bp, Artificial Sequence
  chemically synthesized
taatatctagacatttaata

SEQ ID NO: 288764 - DNA, 20 bp, Artificial Sequence
  chemically synthesized
gacatttaatatagccatgt

SEQ ID NO: 288765 - DNA, 20 bp, Artificial Sequence
  chemically synthesized
acatttaatatagccatgtg

SEQ ID NO: 288766 - DNA, 20 bp, Artificial Sequence
  chemically synthesized
catttaatatagccatgtga

SEQ ID NO: 288767 - DNA, 20 bp, Artificial Sequence
  chemically synthesized
tatcacttccatccctcaca

SEQ ID NO: 288768 - DNA, 20 bp, Artificial Sequence
  chemically synthesized
taatatagccatgtgaggga

SEQ ID NO: 288769 - DNA, 20 bp, Artificial Sequence
  chemically synthesized
tatagccatgtgagggatgg

SEQ ID NO: 288770 - DNA, 20 bp, Artificial Sequence
  chemically synthesized
tgtgagggatggaagtgata

SEQ ID NO: 288771 - DNA, 20 bp, Artificial Sequence
  chemically synthesized
gggatggaagtgataaagta

SEQ ID NO: 288772 - DNA, 20 bp, Artificial Sequence
  chemically synthesized
ggatggaagtgataaagtat

SEQ ID NO: 288773 - DNA, 20 bp, Artificial Sequence
  chemically synthesized
tttactataattttagatgt

SEQ ID NO: 288774 - DNA, 20 bp, Artificial Sequence
  chemically synthesized
caaactgacatctaaaatta

SEQ ID NO: 288775 - DNA, 20 bp, Artificial Sequence
  chemically synthesized
gtattcctttactataattt

SEQ ID NO: 288776 - DNA, 20 bp, Artificial Sequence
  chemically synthesized
tgacatctaaaattatagta

SEQ ID NO: 288777 - DNA, 20 bp, Artificial Sequence
  chemically synthesized
gacatctaaaattatagtaa

SEQ ID NO: 288778 - DNA, 20 bp, Artificial Sequence
  chemically synthesized
tatagtaaaggaatacaaaa

SEQ ID NO: 288779 - DNA, 20 bp, Artificial Sequence
  chemically synthesized
agtaaaggaatacaaaaaag

SEQ ID NO: 288780 - DNA, 20 bp, Artificial Sequence
  chemically synthesized
cagtttttaaacaaaaggtg

SEQ ID NO: 288781 - DNA, 20 bp, Artificial Sequence
  chemically synthesized
acaagcagtttttaaacaaa

SEQ ID NO: 288782 - DNA, 20 bp, Artificial Sequence
  chemically synthesized
gacaagcagtttttaaacaa

SEQ ID NO: 288783 - DNA, 20 bp, Artificial Sequence
  chemically synthesized
ttttaagagttaaagacaag

SEQ ID NO: 288784 - DNA, 20 bp, Artificial Sequence
  chemically synthesized
ctcttttaagagttaaagac

SEQ ID NO: 288785 - DNA, 20 bp, Artificial Sequence
  chemically synthesized
cctccctcttttaagagtta

SEQ ID NO: 288786 - DNA, 20 bp, Artificial Sequence
  chemically synthesized
tgcttgtctttaactcttaa

SEQ ID NO: 288787 - DNA, 20 bp, Artificial Sequence
  chemically synthesized
cttgtctttaactcttaaaa

SEQ ID NO: 288788 - DNA, 20 bp, Artificial Sequence
  chemically synthesized
ttgtctttaactcttaaaag

SEQ ID NO: 288789 - DNA, 20 bp, Artificial Sequence
  chemically synthesized
ttagcccctccctcttttaa

SEQ ID NO: 288790 - DNA, 20 bp, Artificial Sequence
  chemically synthesized
tgtctttaactcttaaaaga

SEQ ID NO: 288791 - DNA, 20 bp, Artificial Sequence
  chemically synthesized
ctttagcccctccctctttt

SEQ ID NO: 288792 - DNA, 20 bp, Artificial Sequence
  chemically synthesized
tctttaactcttaaaagagg

SEQ ID NO: 288793 - DNA, 20 bp, Artificial Sequence
  chemically synthesized
ctttaactcttaaaagaggg

SEQ ID NO: 288794 - DNA, 20 bp, Artificial Sequence
  chemically synthesized
tttaactcttaaaagaggga

SEQ ID NO: 288795 - DNA, 20 bp, Artificial Sequence
  chemically synthesized
ttaactcttaaaagagggag

SEQ ID NO: 288796 - DNA, 20 bp, Artificial Sequence
  chemically synthesized
cttaaaagagggaggggcta

SEQ ID NO: 288797 - DNA, 20 bp, Artificial Sequence
  chemically synthesized
ttaaaagagggaggggctaa

SEQ ID NO: 288798 - DNA, 20 bp, Artificial Sequence
  chemically synthesized
taaaagagggaggggctaaa

SEQ ID NO: 288799 - DNA, 20 bp, Artificial Sequence
  chemically synthesized
gagggaggggctaaagggaa

SEQ ID NO: 288800 - DNA, 20 bp, Artificial Sequence
  chemically synthesized
tttctctcttcttttccctt

SEQ ID NO: 288801 - DNA, 20 bp, Artificial Sequence
  chemically synthesized
ggaggggctaaagggaaaag

SEQ ID NO: 288802 - DNA, 20 bp, Artificial Sequence
  chemically synthesized
aggggctaaagggaaaagaa

SEQ ID NO: 288803 - DNA, 20 bp, Artificial Sequence
  chemically synthesized
gggctaaagggaaaagaaga

SEQ ID NO: 288804 - DNA, 20 bp, Artificial Sequence
  chemically synthesized
agggaaaagaagagagaaaa

SEQ ID NO: 288805 - DNA, 20 bp, Artificial Sequence
  chemically synthesized
gggaaaagaagagagaaaaa

SEQ ID NO: 288806 - DNA, 20 bp, Artificial Sequence
  chemically synthesized
gaaaagaagagagaaaaaag

SEQ ID NO: 288807 - DNA, 20 bp, Artificial Sequence
  chemically synthesized
aaagaagagagaaaaaagga

SEQ ID NO: 288808 - DNA, 20 bp, Artificial Sequence
  chemically synthesized
agagagaaaaaaggagagca

SEQ ID NO: 288809 - DNA, 20 bp, Artificial Sequence
  chemically synthesized
gagagaaaaaaggagagcaa

SEQ ID NO: 288810 - DNA, 20 bp, Artificial Sequence
  chemically synthesized
gaaaaaaggagagcaaagga

SEQ ID NO: 288811 - DNA, 20 bp, Artificial Sequence
  chemically synthesized
aggagagcaaaggacagacc

SEQ ID NO: 288812 - DNA, 20 bp, Artificial Sequence
  chemically synthesized
gagagcaaaggacagaccaa

SEQ ID NO: 288813 - DNA, 20 bp, Artificial Sequence
  chemically synthesized
gagcaaaggacagaccaaga

SEQ ID NO: 288814 - DNA, 20 bp, Artificial Sequence
  chemically synthesized
agcaaaggacagaccaagag

SEQ ID NO: 288815 - DNA, 20 bp, Artificial Sequence
  chemically synthesized
gaatcttgctttgcctctct

SEQ ID NO: 288816 - DNA, 20 bp, Artificial Sequence
  chemically synthesized
aggacagaccaagagaggca

SEQ ID NO: 288817 - DNA, 20 bp, Artificial Sequence
  chemically synthesized
cagaccaagagaggcaaagc

SEQ ID NO: 288818 - DNA, 20 bp, Artificial Sequence
  chemically synthesized
tagctcttttgttatcacaa

SEQ ID NO: 288819 - DNA, 20 bp, Artificial Sequence
  chemically synthesized
agattcttttgtgataacaa

SEQ ID NO: 288820 - DNA, 20 bp, Artificial Sequence
  chemically synthesized
attcttttgtgataacaaaa

SEQ ID NO: 288821 - DNA, 20 bp, Artificial Sequence
  chemically synthesized
tttgtgataacaaaagagct

SEQ ID NO: 288822 - DNA, 20 bp, Artificial Sequence
  chemically synthesized
gtagcatctaatttcatact

SEQ ID NO: 288823 - DNA, 20 bp, Artificial Sequence
  chemically synthesized
aaaagagctaagtatgaaat

SEQ ID NO: 288824 - DNA, 20 bp, Artificial Sequence
  chemically synthesized
ctcatgtgtattagaaaatg

SEQ ID NO: 288825 - DNA, 20 bp, Artificial Sequence
  chemically synthesized
tgacatagactcatgtgtat

SEQ ID NO: 288826 - DNA, 20 bp, Artificial Sequence
  chemically synthesized
ctacattttctaatacacat

SEQ ID NO: 288827 - DNA, 20 bp, Artificial Sequence
  chemically synthesized
aatacacatgagtctatgtc

SEQ ID NO: 288828 - DNA, 20 bp, Artificial Sequence
  chemically synthesized
atacacatgagtctatgtca

SEQ ID NO: 288829 - DNA, 20 bp, Artificial Sequence
  chemically synthesized
tacacatgagtctatgtcaa

SEQ ID NO: 288830 - DNA, 20 bp, Artificial Sequence
  chemically synthesized
aaagtggtttgcccttgaca

SEQ ID NO: 288831 - DNA, 20 bp, Artificial Sequence
  chemically synthesized
caagggcaaaccactttaac

SEQ ID NO: 288832 - DNA, 20 bp, Artificial Sequence
  chemically synthesized
actttgctttccagttaaag

SEQ ID NO: 288833 - DNA, 20 bp, Artificial Sequence
  chemically synthesized
tttactttgctttccagtta

SEQ ID NO: 288834 - DNA, 20 bp, Artificial Sequence
  chemically synthesized
ggcaaaccactttaactgga

SEQ ID NO: 288835 - DNA, 20 bp, Artificial Sequence
  chemically synthesized
accactttaactggaaagca

SEQ ID NO: 288836 - DNA, 20 bp, Artificial Sequence
  chemically synthesized
tctctgtttactttgctttc

SEQ ID NO: 288837 - DNA, 20 bp, Artificial Sequence
  chemically synthesized
taactggaaagcaaagtaaa

SEQ ID NO: 288838 - DNA, 20 bp, Artificial Sequence
  chemically synthesized
actggaaagcaaagtaaaca

SEQ ID NO: 288839 - DNA, 20 bp, Artificial Sequence
  chemically synthesized
ggaaagcaaagtaaacagag

SEQ ID NO: 288840 - DNA, 20 bp, Artificial Sequence
  chemically synthesized
agaagtatattgaaaattct

SEQ ID NO: 288841 - DNA, 20 bp, Artificial Sequence
  chemically synthesized
aagtatattgaaaattctga

SEQ ID NO: 288842 - DNA, 20 bp, Artificial Sequence
  chemically synthesized
atctcgatagttatgtctct

SEQ ID NO: 288843 - DNA, 20 bp, Artificial Sequence
  chemically synthesized
ttctgagagacataactatc

SEQ ID NO: 288844 - DNA, 20 bp, Artificial Sequence
  chemically synthesized
ctggtatctctttatctcga

SEQ ID NO: 288845 - DNA, 20 bp, Artificial Sequence
  chemically synthesized
gagacataactatcgagata

SEQ ID NO: 288846 - DNA, 20 bp, Artificial Sequence
  chemically synthesized
gacataactatcgagataaa

SEQ ID NO: 288847 - DNA, 20 bp, Artificial Sequence
  chemically synthesized
ctatcgagataaagagatac

SEQ ID NO: 288848 - DNA, 20 bp, Artificial Sequence
  chemically synthesized
atcgagataaagagatacca

SEQ ID NO: 288849 - DNA, 20 bp, Artificial Sequence
  chemically synthesized
taaagagataccagagcaat

SEQ ID NO: 288850 - DNA, 20 bp, Artificial Sequence
  chemically synthesized
ttatatataaccgattgctc

SEQ ID NO: 288851 - DNA, 20 bp, Artificial Sequence
  chemically synthesized
agagattttttttttcagta

SEQ ID NO: 288852 - DNA, 20 bp, Artificial Sequence
  chemically synthesized
agaggagagatttttttttt

SEQ ID NO: 288853 - DNA, 20 bp, Artificial Sequence
  chemically synthesized
agttctatttttcaagagga

SEQ ID NO: 288854 - DNA, 20 bp, Artificial Sequence
  chemically synthesized
gtagttctatttttcaagag

SEQ ID NO: 288855 - DNA, 20 bp, Artificial Sequence
  chemically synthesized
gagtagttctatttttcaag

SEQ ID NO: 288856 - DNA, 20 bp, Artificial Sequence
  chemically synthesized
tgagtagttctatttttcaa

SEQ ID NO: 288857 - DNA, 20 bp, Artificial Sequence
  chemically synthesized
aaatctctcctcttgaaaaa

SEQ ID NO: 288858 - DNA, 20 bp, Artificial Sequence
  chemically synthesized
tctgagtagttctatttttc

SEQ ID NO: 288859 - DNA, 20 bp, Artificial Sequence
  chemically synthesized
tcttgaaaaatagaactact

SEQ ID NO: 288860 - DNA, 20 bp, Artificial Sequence
  chemically synthesized
ttaagtgcctattttctgag

SEQ ID NO: 288861 - DNA, 20 bp, Artificial Sequence
  chemically synthesized
aaatagaactactcagaaaa

SEQ ID NO: 288862 - DNA, 20 bp, Artificial Sequence
  chemically synthesized
aatagaactactcagaaaat

SEQ ID NO: 288863 - DNA, 20 bp, Artificial Sequence
  chemically synthesized
tgcttaagtgcctattttct

SEQ ID NO: 288864 - DNA, 20 bp, Artificial Sequence
  chemically synthesized
tactcagaaaataggcactt

SEQ ID NO: 288865 - DNA, 20 bp, Artificial Sequence
  chemically synthesized
gaaaataggcacttaagcat

SEQ ID NO: 288866 - DNA, 20 bp, Artificial Sequence
  chemically synthesized
ttgtacattctctgatgctt

SEQ ID NO: 288867 - DNA, 20 bp, Artificial Sequence
  chemically synthesized
aaataggcacttaagcatca

SEQ ID NO: 288868 - DNA, 20 bp, Artificial Sequence
  chemically synthesized
aagcatcagagaatgtacaa

SEQ ID NO: 288869 - DNA, 20 bp, Artificial Sequence
  chemically synthesized
gcatcagagaatgtacaata

SEQ ID NO: 288870 - DNA, 20 bp, Artificial Sequence
  chemically synthesized
atcagagaatgtacaataga

SEQ ID NO: 288871 - DNA, 20 bp, Artificial Sequence
  chemically synthesized
agagaatgtacaatagagag

SEQ ID NO: 288872 - DNA, 20 bp, Artificial Sequence
  chemically synthesized
gagaatgtacaatagagaga

SEQ ID NO: 288873 - DNA, 20 bp, Artificial Sequence
  chemically synthesized
aatgtacaatagagagaagg

SEQ ID NO: 288874 - DNA, 20 bp, Artificial Sequence
  chemically synthesized
tgctaccttattggttggca

SEQ ID NO: 288875 - DNA, 20 bp, Artificial Sequence
  chemically synthesized
acgtaactgtgccaaccaat

SEQ ID NO: 288876 - DNA, 20 bp, Artificial Sequence
  chemically synthesized
cgtaactgtgccaaccaata

SEQ ID NO: 288877 - DNA, 20 bp, Artificial Sequence
  chemically synthesized
ccagttgctaccttattggt

SEQ ID NO: 288878 - DNA, 20 bp, Artificial Sequence
  chemically synthesized
aactgtgccaaccaataagg

SEQ ID NO: 288879 - DNA, 20 bp, Artificial Sequence
  chemically synthesized
gtagccagttgctaccttat

SEQ ID NO: 288880 - DNA, 20 bp, Artificial Sequence
  chemically synthesized
ccaaccaataaggtagcaac

SEQ ID NO: 288881 - DNA, 20 bp, Artificial Sequence
  chemically synthesized
gtgcttaacggacgggtagc

SEQ ID NO: 288882 - DNA, 20 bp, Artificial Sequence
  chemically synthesized
tcaagtgcttaacggacggg

SEQ ID NO: 288883 - DNA, 20 bp, Artificial Sequence
  chemically synthesized
caactggctacccgtccgtt

SEQ ID NO: 288884 - DNA, 20 bp, Artificial Sequence
  chemically synthesized
gtttcaagtgcttaacggac

SEQ ID NO: 288885 - DNA, 20 bp, Artificial Sequence
  chemically synthesized
cgtttcaagtgcttaacgga

SEQ ID NO: 288886 - DNA, 20 bp, Artificial Sequence
  chemically synthesized
gccacgtttcaagtgcttaa

SEQ ID NO: 288887 - DNA, 20 bp, Artificial Sequence
  chemically synthesized
tccgttaagcacttgaaacg

SEQ ID NO: 288888 - DNA, 20 bp, Artificial Sequence
  chemically synthesized
actcaaactggccacgtttc

SEQ ID NO: 288889 - DNA, 20 bp, Artificial Sequence
  chemically synthesized
ttaagcacttgaaacgtggc

SEQ ID NO: 288890 - DNA, 20 bp, Artificial Sequence
  chemically synthesized
acttgaaacgtggccagttt

SEQ ID NO: 288891 - DNA, 20 bp, Artificial Sequence
  chemically synthesized
caaaacatctcaactcaaac

SEQ ID NO: 288892 - DNA, 20 bp, Artificial Sequence
  chemically synthesized
aaacgtggccagtttgagtt

SEQ ID NO: 288893 - DNA, 20 bp, Artificial Sequence
  chemically synthesized
tgagatgttttgtatatata

SEQ ID NO: 288894 - DNA, 20 bp, Artificial Sequence
  chemically synthesized
ttgtatatataaagacacac

SEQ ID NO: 288895 - DNA, 20 bp, Artificial Sequence
  chemically synthesized
tataaagacacaccagatat

SEQ ID NO: 288896 - DNA, 20 bp, Artificial Sequence
  chemically synthesized
tgtatgaactgtccaatatc

SEQ ID NO: 288897 - DNA, 20 bp, Artificial Sequence
  chemically synthesized
aagacacaccagatattgga

SEQ ID NO: 288898 - DNA, 20 bp, Artificial Sequence
  chemically synthesized
tattggacagttcatacaaa

SEQ ID NO: 288899 - DNA, 20 bp, Artificial Sequence
  chemically synthesized
gttcatacaaaaagaatgta

SEQ ID NO: 288900 - DNA, 20 bp, Artificial Sequence
  chemically synthesized
aaaattttaaaatgtggaaa

SEQ ID NO: 288901 - DNA, 20 bp, Artificial Sequence
  chemically synthesized
agaattaaaattttaaaatg

SEQ ID NO: 288902 - DNA, 20 bp, Artificial Sequence
  chemically synthesized
cattttaaaattttaattct

SEQ ID NO: 288903 - DNA, 20 bp, Artificial Sequence
  chemically synthesized
ttgaaaatattgtttcatct

SEQ ID NO: 288904 - DNA, 20 bp, Artificial Sequence
  chemically synthesized
attaacagatcaacaggtaa

SEQ ID NO: 288905 - DNA, 20 bp, Artificial Sequence
  chemically synthesized
aaccacattaacagatcaac

SEQ ID NO: 288906 - DNA, 20 bp, Artificial Sequence
  chemically synthesized
aaaccacattaacagatcaa

SEQ ID NO: 288907 - DNA, 20 bp, Artificial Sequence
  chemically synthesized
tacctgttgatctgttaatg

SEQ ID NO: 288908 - DNA, 20 bp, Artificial Sequence
  chemically synthesized
tgttctagaaaccacattaa

SEQ ID NO: 288909 - DNA, 20 bp, Artificial Sequence
  chemically synthesized
tgatctgttaatgtggtttc

SEQ ID NO: 288910 - DNA, 20 bp, Artificial Sequence
  chemically synthesized
atatttaattttaaatgttc

SEQ ID NO: 288911 - DNA, 20 bp, Artificial Sequence
  chemically synthesized
aacatttaaaattaaatata

SEQ ID NO: 288912 - DNA, 20 bp, Artificial Sequence
  chemically synthesized
atccaacagaaaaataatgt

SEQ ID NO: 288913 - DNA, 20 bp, Artificial Sequence
  chemically synthesized
ggctcacattatttttctgt

SEQ ID NO: 288914 - DNA, 20 bp, Artificial Sequence
  chemically synthesized
cacattatttttctgttgga

SEQ ID NO: 288915 - DNA, 20 bp, Artificial Sequence
  chemically synthesized
tctatctaagcactatccaa

SEQ ID NO: 288916 - DNA, 20 bp, Artificial Sequence
  chemically synthesized
tttttctgttggatagtgct

SEQ ID NO: 288917 - DNA, 20 bp, Artificial Sequence
  chemically synthesized
tctgttggatagtgcttaga

SEQ ID NO: 288918 - DNA, 20 bp, Artificial Sequence
  chemically synthesized
gttggatagtgcttagatag

SEQ ID NO: 288919 - DNA, 20 bp, Artificial Sequence
  chemically synthesized
gccttttccagcttctatct

SEQ ID NO: 288920 - DNA, 20 bp, Artificial Sequence
  chemically synthesized
gatagtgcttagatagaagc

SEQ ID NO: 288921 - DNA, 20 bp, Artificial Sequence
  chemically synthesized
tgcttagatagaagctggaa

SEQ ID NO: 288922 - DNA, 20 bp, Artificial Sequence
  chemically synthesized
gcttagatagaagctggaaa

SEQ ID NO: 288923 - DNA, 20 bp, Artificial Sequence
  chemically synthesized
gattacatgggtgccttttc

SEQ ID NO: 288924 - DNA, 20 bp, Artificial Sequence
  chemically synthesized
tccccctaaatggattacat

SEQ ID NO: 288925 - DNA, 20 bp, Artificial Sequence
  chemically synthesized
ctccccctaaatggattaca

SEQ ID NO: 288926 - DNA, 20 bp, Artificial Sequence
  chemically synthesized
aggcacccatgtaatccatt

SEQ ID NO: 288927 - DNA, 20 bp, Artificial Sequence
  chemically synthesized
ggcacccatgtaatccattt

SEQ ID NO: 288928 - DNA, 20 bp, Artificial Sequence
  chemically synthesized
gcacccatgtaatccattta

SEQ ID NO: 288929 - DNA, 20 bp, Artificial Sequence
  chemically synthesized
cacccatgtaatccatttag

SEQ ID NO: 288930 - DNA, 20 bp, Artificial Sequence
  chemically synthesized
acccatgtaatccatttagg

SEQ ID NO: 288931 - DNA, 20 bp, Artificial Sequence
  chemically synthesized
catctctttctccccctaaa

SEQ ID NO: 288932 - DNA, 20 bp, Artificial Sequence
  chemically synthesized
ccatgtaatccatttagggg

SEQ ID NO: 288933 - DNA, 20 bp, Artificial Sequence
  chemically synthesized
gtaatccatttagggggaga

SEQ ID NO: 288934 - DNA, 20 bp, Artificial Sequence
  chemically synthesized
aatccatttagggggagaaa

SEQ ID NO: 288935 - DNA, 20 bp, Artificial Sequence
  chemically synthesized
gggagaaagagatgatatgt

SEQ ID NO: 288936 - DNA, 20 bp, Artificial Sequence
  chemically synthesized
agaaagagatgatatgttag

SEQ ID NO: 288937 - DNA, 20 bp, Artificial Sequence
  chemically synthesized
ttttaaatgctgtcaatatt

SEQ ID NO: 288938 - DNA, 20 bp, Artificial Sequence
  chemically synthesized
gttagtagtcttaatattga

SEQ ID NO: 288939 - DNA, 20 bp, Artificial Sequence
  chemically synthesized
ttgacagcatttaaaaacat

SEQ ID NO: 288940 - DNA, 20 bp, Artificial Sequence
  chemically synthesized
acagcatttaaaaacattag

SEQ ID NO: 288941 - DNA, 20 bp, Artificial Sequence
  chemically synthesized
ctcgatttcatattcacaac

SEQ ID NO: 288942 - DNA, 20 bp, Artificial Sequence
  chemically synthesized
actcgatttcatattcacaa

SEQ ID NO: 288943 - DNA, 20 bp, Artificial Sequence
  chemically synthesized
cctgttgtgaatatgaaatc

SEQ ID NO: 288944 - DNA, 20 bp, Artificial Sequence
  chemically synthesized
taataatggggaattcaaat

SEQ ID NO: 288945 - DNA, 20 bp, Artificial Sequence
  chemically synthesized
tttccccacaggtaataatg

SEQ ID NO: 288946 - DNA, 20 bp, Artificial Sequence
  chemically synthesized
ttttccccacaggtaataat

SEQ ID NO: 288947 - DNA, 20 bp, Artificial Sequence
  chemically synthesized
tttttccccacaggtaataa

SEQ ID NO: 288948 - DNA, 20 bp, Artificial Sequence
  chemically synthesized
gaattccccattattacctg

SEQ ID NO: 288949 - DNA, 20 bp, Artificial Sequence
  chemically synthesized
aattccccattattacctgt

SEQ ID NO: 288950 - DNA, 20 bp, Artificial Sequence
  chemically synthesized
attccccattattacctgtg

SEQ ID NO: 288951 - DNA, 20 bp, Artificial Sequence
  chemically synthesized
cagtgcatttttttccccac

SEQ ID NO: 288952 - DNA, 20 bp, Artificial Sequence
  chemically synthesized
gcagtgcatttttttcccca

SEQ ID NO: 288953 - DNA, 20 bp, Artificial Sequence
  chemically synthesized
tcagcttcttcacacatgtg

SEQ ID NO: 288954 - DNA, 20 bp, Artificial Sequence
  chemically synthesized
aaatgcactgcacatgtgtg

SEQ ID NO: 288955 - DNA, 20 bp, Artificial Sequence
  chemically synthesized
tgcactgcacatgtgtgaag

SEQ ID NO: 288956 - DNA, 20 bp, Artificial Sequence
  chemically synthesized
gtaggtatatgtcattagtt

SEQ ID NO: 288957 - DNA, 20 bp, Artificial Sequence
  chemically synthesized
ccgaagtaggtatatgtcat

SEQ ID NO: 288958 - DNA, 20 bp, Artificial Sequence
  chemically synthesized
ctaatgacatatacctactt

SEQ ID NO: 288959 - DNA, 20 bp, Artificial Sequence
  chemically synthesized
gttgagcattttgccgaagt

SEQ ID NO: 288960 - DNA, 20 bp, Artificial Sequence
  chemically synthesized
agttgagcattttgccgaag

SEQ ID NO: 288961 - DNA, 20 bp, Artificial Sequence
  chemically synthesized
tcaagttgagcattttgccg

SEQ ID NO: 288962 - DNA, 20 bp, Artificial Sequence
  chemically synthesized
ttcggcaaaatgctcaactt

SEQ ID NO: 288963 - DNA, 20 bp, Artificial Sequence
  chemically synthesized
tggaattaaaggctcaagtt

SEQ ID NO: 288964 - DNA, 20 bp, Artificial Sequence
  chemically synthesized
tggcatggaattaaaggctc

SEQ ID NO: 288965 - DNA, 20 bp, Artificial Sequence
  chemically synthesized
tctggttggcatggaattaa

SEQ ID NO: 288966 - DNA, 20 bp, Artificial Sequence
  chemically synthesized
atctggttggcatggaatta

SEQ ID NO: 288967 - DNA, 20 bp, Artificial Sequence
  chemically synthesized
gcctttaattccatgccaac

SEQ ID NO: 288968 - DNA, 20 bp, Artificial Sequence
  chemically synthesized
aaggtgggatctggttggca

SEQ ID NO: 288969 - DNA, 20 bp, Artificial Sequence
  chemically synthesized
ggaaaaaggtgggatctggt

SEQ ID NO: 288970 - DNA, 20 bp, Artificial Sequence
  chemically synthesized
atgaggaaaaaggtgggatc

SEQ ID NO: 288971 - DNA, 20 bp, Artificial Sequence
  chemically synthesized
tggggaatgaggaaaaaggt

SEQ ID NO: 288972 - DNA, 20 bp, Artificial Sequence
  chemically synthesized
atggggaatgaggaaaaagg

SEQ ID NO: 288973 - DNA, 20 bp, Artificial Sequence
  chemically synthesized
atcatggggaatgaggaaaa

SEQ ID NO: 288974 - DNA, 20 bp, Artificial Sequence
  chemically synthesized
gatcatggggaatgaggaaa

SEQ ID NO: 288975 - DNA, 20 bp, Artificial Sequence
  chemically synthesized
tagattgatcatggggaatg

SEQ ID NO: 288976 - DNA, 20 bp, Artificial Sequence
  chemically synthesized
ttagattgatcatggggaat

SEQ ID NO: 288977 - DNA, 20 bp, Artificial Sequence
  chemically synthesized
ttgactttagattgatcatg

SEQ ID NO: 288978 - DNA, 20 bp, Artificial Sequence
  chemically synthesized
cttgactttagattgatcat

SEQ ID NO: 288979 - DNA, 20 bp, Artificial Sequence
  chemically synthesized
ccttgactttagattgatca

SEQ ID NO: 288980 - DNA, 20 bp, Artificial Sequence
  chemically synthesized
cattccccatgatcaatcta

SEQ ID NO: 288981 - DNA, 20 bp, Artificial Sequence
  chemically synthesized
cccatgatcaatctaaagtc

SEQ ID NO: 288982 - DNA, 20 bp, Artificial Sequence
  chemically synthesized
ccatgatcaatctaaagtca

SEQ ID NO: 288983 - DNA, 20 bp, Artificial Sequence
  chemically synthesized
ttgcattatctccttgactt

SEQ ID NO: 288984 - DNA, 20 bp, Artificial Sequence
  chemically synthesized
atgatcaatctaaagtcaag

SEQ ID NO: 288985 - DNA, 20 bp, Artificial Sequence
  chemically synthesized
agtcaaggagataatgcaat

SEQ ID NO: 288986 - DNA, 20 bp, Artificial Sequence
  chemically synthesized
aggagataatgcaatcagca

SEQ ID NO: 288987 - DNA, 20 bp, Artificial Sequence
  chemically synthesized
ggagataatgcaatcagcaa

SEQ ID NO: 288988 - DNA, 20 bp, Artificial Sequence
  chemically synthesized
atgttatttaataaagtttg

SEQ ID NO: 288989 - DNA, 20 bp, Artificial Sequence
  chemically synthesized
ctatgttatttaataaagtt

SEQ ID NO: 288990 - DNA, 20 bp, Artificial Sequence
  chemically synthesized
atggtctatgttatttaata

SEQ ID NO: 288991 - DNA, 20 bp, Artificial Sequence
  chemically synthesized
ccaaactttattaaataaca

SEQ ID NO: 288992 - DNA, 20 bp, Artificial Sequence
  chemically synthesized
aataacatagaccatgacaa

SEQ ID NO: 288993 - DNA, 20 bp, Artificial Sequence
  chemically synthesized
agaaatgcttacttttgtca

SEQ ID NO: 288994 - DNA, 20 bp, Artificial Sequence
  chemically synthesized
acatagaccatgacaaaagt

SEQ ID NO: 288995 - DNA, 20 bp, Artificial Sequence
  chemically synthesized
ttgtcagtgttcacatttta

SEQ ID NO: 288996 - DNA, 20 bp, Artificial Sequence
  chemically synthesized
ctttgtcagtgttcacattt

SEQ ID NO: 288997 - DNA, 20 bp, Artificial Sequence
  chemically synthesized
ctaaaatgtgaacactgaca

SEQ ID NO: 288998 - DNA, 20 bp, Artificial Sequence
  chemically synthesized
taaaatgtgaacactgacaa

SEQ ID NO: 288999 - DNA, 20 bp, Artificial Sequence
  chemically synthesized
gtatttcttgacacctttgt

SEQ ID NO: 289000 - DNA, 20 bp, Artificial Sequence
  chemically synthesized
tgaacactgacaaaggtgtc

SEQ ID NO: 289001 - DNA, 20 bp, Artificial Sequence
  chemically synthesized
aaaggtgtcaagaaatacaa

SEQ ID NO: 289002 - DNA, 20 bp, Artificial Sequence
  chemically synthesized
aaggtgtcaagaaatacaac

SEQ ID NO: 289003 - DNA, 20 bp, Artificial Sequence
  chemically synthesized
aatcatcatatatcatgcat

SEQ ID NO: 289004 - DNA, 20 bp, Artificial Sequence
  chemically synthesized
taatcatcatatatcatgca

SEQ ID NO: 289005 - DNA, 20 bp, Artificial Sequence
  chemically synthesized
atatatgatgattaacatac

SEQ ID NO: 289006 - DNA, 20 bp, Artificial Sequence
  chemically synthesized
tatatgatgattaacatact

SEQ ID NO: 289007 - DNA, 20 bp, Artificial Sequence
  chemically synthesized
gatgattaacatactaggaa

SEQ ID NO: 289008 - DNA, 20 bp, Artificial Sequence
  chemically synthesized
attatctgaaggaccattcc

SEQ ID NO: 289009 - DNA, 20 bp, Artificial Sequence
  chemically synthesized
acatactaggaatggtcctt

SEQ ID NO: 289010 - DNA, 20 bp, Artificial Sequence
  chemically synthesized
ttgcacttgtaattatctga

SEQ ID NO: 289011 - DNA, 20 bp, Artificial Sequence
  chemically synthesized
cttgcacttgtaattatctg

SEQ ID NO: 289012 - DNA, 20 bp, Artificial Sequence
  chemically synthesized
atggtccttcagataattac

SEQ ID NO: 289013 - DNA, 20 bp, Artificial Sequence
  chemically synthesized
cttcagataattacaagtgc

SEQ ID NO: 289014 - DNA, 20 bp, Artificial Sequence
  chemically synthesized
ttcagataattacaagtgca

SEQ ID NO: 289015 - DNA, 20 bp, Artificial Sequence
  chemically synthesized
agataattacaagtgcaagg

SEQ ID NO: 289016 - DNA, 20 bp, Artificial Sequence
  chemically synthesized
ttacaagtgcaaggaagtct

SEQ ID NO: 289017 - DNA, 20 bp, Artificial Sequence
  chemically synthesized
ttagaaattcaagttatact

SEQ ID NO: 289018 - DNA, 20 bp, Artificial Sequence
  chemically synthesized
tatattgacattagaaattc

SEQ ID NO: 289019 - DNA, 20 bp, Artificial Sequence
  chemically synthesized
aacaacttatatattgacat

SEQ ID NO: 289020 - DNA, 20 bp, Artificial Sequence
  chemically synthesized
aatttctaatgtcaatatat

SEQ ID NO: 289021 - DNA, 20 bp, Artificial Sequence
  chemically synthesized
caatatataagttgtttcct

SEQ ID NO: 289022 - DNA, 20 bp, Artificial Sequence
  chemically synthesized
gatccttgtatttcaaacta

SEQ ID NO: 289023 - DNA, 20 bp, Artificial Sequence
  chemically synthesized
agatccttgtatttcaaact

SEQ ID NO: 289024 - DNA, 20 bp, Artificial Sequence
  chemically synthesized
gtttccttagtttgaaatac

SEQ ID NO: 289025 - DNA, 20 bp, Artificial Sequence
  chemically synthesized
tttccttagtttgaaataca

SEQ ID NO: 289026 - DNA, 20 bp, Artificial Sequence
  chemically synthesized
aatacaaggatctttgtgat

SEQ ID NO: 289027 - DNA, 20 bp, Artificial Sequence
  chemically synthesized
atacaaggatctttgtgatt

SEQ ID NO: 289028 - DNA, 20 bp, Artificial Sequence
  chemically synthesized
tgattgaattcccaatcaca

SEQ ID NO: 289029 - DNA, 20 bp, Artificial Sequence
  chemically synthesized
tgggaattcaatcaacattt

SEQ ID NO: 289030 - DNA, 20 bp, Artificial Sequence
  chemically synthesized
attgattttgataggaaatt

SEQ ID NO: 289031 - DNA, 20 bp, Artificial Sequence
  chemically synthesized
tattgattttgataggaaat

SEQ ID NO: 289032 - DNA, 20 bp, Artificial Sequence
  chemically synthesized
gatagaatattgattttgat

SEQ ID NO: 289033 - DNA, 20 bp, Artificial Sequence
  chemically synthesized
ggatagaatattgattttga

SEQ ID NO: 289034 - DNA, 20 bp, Artificial Sequence
  chemically synthesized
aaaatcaatattctatcctc

SEQ ID NO: 289035 - DNA, 20 bp, Artificial Sequence
  chemically synthesized
ggcatattttgactggagga

SEQ ID NO: 289036 - DNA, 20 bp, Artificial Sequence
  chemically synthesized
aaaaggcatattttgactgg

SEQ ID NO: 289037 - DNA, 20 bp, Artificial Sequence
  chemically synthesized
taaaaggcatattttgactg

SEQ ID NO: 289038 - DNA, 20 bp, Artificial Sequence
  chemically synthesized
attaaaaggcatattttgac

SEQ ID NO: 289039 - DNA, 20 bp, Artificial Sequence
  chemically synthesized
aaaggcgtgaagtaattaaa

SEQ ID NO: 289040 - DNA, 20 bp, Artificial Sequence
  chemically synthesized
aaaaggcgtgaagtaattaa

SEQ ID NO: 289041 - DNA, 20 bp, Artificial Sequence
  chemically synthesized
tgcataagcaaaaaggcgtg

SEQ ID NO: 289042 - DNA, 20 bp, Artificial Sequence
  chemically synthesized
agcaagttgcataagcaaaa

SEQ ID NO: 289043 - DNA, 20 bp, Artificial Sequence
  chemically synthesized
gagcaagttgcataagcaaa

SEQ ID NO: 289044 - DNA, 20 bp, Artificial Sequence
  chemically synthesized
ttcagcagagcaagttgcat

SEQ ID NO: 289045 - DNA, 20 bp, Artificial Sequence
  chemically synthesized
gcagcgactttcagcagagc

SEQ ID NO: 289046 - DNA, 20 bp, Artificial Sequence
  chemically synthesized
tatgcaacttgctctgctga

SEQ ID NO: 289047 - DNA, 20 bp, Artificial Sequence
  chemically synthesized
agcagcagcgactttcagca

SEQ ID NO: 289048 - DNA, 20 bp, Artificial Sequence
  chemically synthesized
tgagcagcagcgactttcag

SEQ ID NO: 289049 - DNA, 20 bp, Artificial Sequence
  chemically synthesized
gcctgagcagcagcgacttt

SEQ ID NO: 289050 - DNA, 20 bp, Artificial Sequence
  chemically synthesized
tgctgaaagtcgctgctgct

SEQ ID NO: 289051 - DNA, 20 bp, Artificial Sequence
  chemically synthesized
gctgaaagtcgctgctgctc

SEQ ID NO: 289052 - DNA, 20 bp, Artificial Sequence
  chemically synthesized
tgagaatggagcctgagcag

SEQ ID NO: 289053 - DNA, 20 bp, Artificial Sequence
  chemically synthesized
ttgtgagaatggagcctgag

SEQ ID NO: 289054 - DNA, 20 bp, Artificial Sequence
  chemically synthesized
cctttgtgagaatggagcct

SEQ ID NO: 289055 - DNA, 20 bp, Artificial Sequence
  chemically synthesized
aagtgccctttgtgagaatg

SEQ ID NO: 289056 - DNA, 20 bp, Artificial Sequence
  chemically synthesized
ccaagtgccctttgtgagaa

SEQ ID NO: 289057 - DNA, 20 bp, Artificial Sequence
  chemically synthesized
gctcaggctccattctcaca

SEQ ID NO: 289058 - DNA, 20 bp, Artificial Sequence
  chemically synthesized
ctcaggctccattctcacaa

SEQ ID NO: 289059 - DNA, 20 bp, Artificial Sequence
  chemically synthesized
tcaggctccattctcacaaa

SEQ ID NO: 289060 - DNA, 20 bp, Artificial Sequence
  chemically synthesized
ccacaccaagtgccctttgt

SEQ ID NO: 289061 - DNA, 20 bp, Artificial Sequence
  chemically synthesized
ccattctcacaaagggcact

SEQ ID NO: 289062 - DNA, 20 bp, Artificial Sequence
  chemically synthesized
ctcacaaagggcacttggtg

SEQ ID NO: 289063 - DNA, 20 bp, Artificial Sequence
  chemically synthesized
cactcatgtcagaccacacc

SEQ ID NO: 289064 - DNA, 20 bp, Artificial Sequence
  chemically synthesized
cacttggtgtggtctgacat

SEQ ID NO: 289065 - DNA, 20 bp, Artificial Sequence
  chemically synthesized
cccatctatttcactcatgt

SEQ ID NO: 289066 - DNA, 20 bp, Artificial Sequence
  chemically synthesized
gtggtctgacatgagtgaaa

SEQ ID NO: 289067 - DNA, 20 bp, Artificial Sequence
  chemically synthesized
tctgacatgagtgaaataga

SEQ ID NO: 289068 - DNA, 20 bp, Artificial Sequence
  chemically synthesized
ctgacatgagtgaaatagat

SEQ ID NO: 289069 - DNA, 20 bp, Artificial Sequence
  chemically synthesized
gagtgaaatagatgggttta

SEQ ID NO: 289070 - DNA, 20 bp, Artificial Sequence
  chemically synthesized
agtgaaatagatgggtttat

SEQ ID NO: 289071 - DNA, 20 bp, Artificial Sequence
  chemically synthesized
ggtttataggaattttatct

SEQ ID NO: 289072 - DNA, 20 bp, Artificial Sequence
  chemically synthesized
aacaaattctatggtgatct

SEQ ID NO: 289073 - DNA, 20 bp, Artificial Sequence
  chemically synthesized
aattttatctaagatcacca

SEQ ID NO: 289074 - DNA, 20 bp, Artificial Sequence
  chemically synthesized
gacttataaaacaaattcta

SEQ ID NO: 289075 - DNA, 20 bp, Artificial Sequence
  chemically synthesized
caccatagaatttgttttat

SEQ ID NO: 289076 - DNA, 20 bp, Artificial Sequence
  chemically synthesized
caatttcagttggttcattg

SEQ ID NO: 289077 - DNA, 20 bp, Artificial Sequence
  chemically synthesized
cccaatttcagttggttcat

SEQ ID NO: 289078 - DNA, 20 bp, Artificial Sequence
  chemically synthesized
aaaatgaccccaatttcagt

SEQ ID NO: 289079 - DNA, 20 bp, Artificial Sequence
  chemically synthesized
tccaatgaaccaactgaaat

SEQ ID NO: 289080 - DNA, 20 bp, Artificial Sequence
  chemically synthesized
ccaatgaaccaactgaaatt

SEQ ID NO: 289081 - DNA, 20 bp, Artificial Sequence
  chemically synthesized
caatgaaccaactgaaattg

SEQ ID NO: 289082 - DNA, 20 bp, Artificial Sequence
  chemically synthesized
tatgaaaatgaccccaattt

SEQ ID NO: 289083 - DNA, 20 bp, Artificial Sequence
  chemically synthesized
ccaggaggtgaataatagag

SEQ ID NO: 289084 - DNA, 20 bp, Artificial Sequence
  chemically synthesized
tgtccaggaggtgaataata

SEQ ID NO: 289085 - DNA, 20 bp, Artificial Sequence
  chemically synthesized
gttgtccaggaggtgaataa

SEQ ID NO: 289086 - DNA, 20 bp, Artificial Sequence
  chemically synthesized
ctgctctattattcacctcc

SEQ ID NO: 289087 - DNA, 20 bp, Artificial Sequence
  chemically synthesized
aaataaatcagttgtccagg

SEQ ID NO: 289088 - DNA, 20 bp, Artificial Sequence
  chemically synthesized
aaaataaatcagttgtccag

SEQ ID NO: 289089 - DNA, 20 bp, Artificial Sequence
  chemically synthesized
ggaaaataaatcagttgtcc

SEQ ID NO: 289090 - DNA, 20 bp, Artificial Sequence
  chemically synthesized
tggaaaataaatcagttgtc

SEQ ID NO: 289091 - DNA, 20 bp, Artificial Sequence
  chemically synthesized
gacttacctggaaaataaat

SEQ ID NO: 289092 - DNA, 20 bp, Artificial Sequence
  chemically synthesized
tggacaactgatttattttc

SEQ ID NO: 289093 - DNA, 20 bp, Artificial Sequence
  chemically synthesized
ggacaactgatttattttcc

SEQ ID NO: 289094 - DNA, 20 bp, Artificial Sequence
  chemically synthesized
aactgatttattttccaggt

SEQ ID NO: 289095 - DNA, 20 bp, Artificial Sequence
  chemically synthesized
tcagaaaaatgagacttacc

SEQ ID NO: 289096 - DNA, 20 bp, Artificial Sequence
  chemically synthesized
acaaagttggtcagaaaaat

SEQ ID NO: 289097 - DNA, 20 bp, Artificial Sequence
  chemically synthesized
tatacttacacaaagttggt

SEQ ID NO: 289098 - DNA, 20 bp, Artificial Sequence
  chemically synthesized
agtttatacttacacaaagt

SEQ ID NO: 289099 - DNA, 20 bp, Artificial Sequence
  chemically synthesized
ttttctgaccaactttgtgt

SEQ ID NO: 289100 - DNA, 20 bp, Artificial Sequence
  chemically synthesized
tggtagtttatacttacaca

SEQ ID NO: 289101 - DNA, 20 bp, Artificial Sequence
  chemically synthesized
taaatatttctgtagtgtgg

SEQ ID NO: 289102 - DNA, 20 bp, Artificial Sequence
  chemically synthesized
aagtataaactaccacacta

SEQ ID NO: 289103 - DNA, 20 bp, Artificial Sequence
  chemically synthesized
taataaatatttctgtagtg

SEQ ID NO: 289104 - DNA, 20 bp, Artificial Sequence
  chemically synthesized
aattctaataaatatttctg

SEQ ID NO: 289105 - DNA, 20 bp, Artificial Sequence
  chemically synthesized
cacactacagaaatatttat

SEQ ID NO: 289106 - DNA, 20 bp, Artificial Sequence
  chemically synthesized
agaaatatttattagaattt

SEQ ID NO: 289107 - DNA, 20 bp, Artificial Sequence
  chemically synthesized
aaatatttattagaatttaa

SEQ ID NO: 289108 - DNA, 20 bp, Artificial Sequence
  chemically synthesized
aaaaagggaaaattcagcaa

SEQ ID NO: 289109 - DNA, 20 bp, Artificial Sequence
  chemically synthesized
ttttagaaaaagggaaaatt

SEQ ID NO: 289110 - DNA, 20 bp, Artificial Sequence
  chemically synthesized
tagagctgcttttagaaaaa

SEQ ID NO: 289111 - DNA, 20 bp, Artificial Sequence
  chemically synthesized
atagagctgcttttagaaaa

SEQ ID NO: 289112 - DNA, 20 bp, Artificial Sequence
  chemically synthesized
tgaattttccctttttctaa

SEQ ID NO: 289113 - DNA, 20 bp, Artificial Sequence
  chemically synthesized
gatagagctgcttttagaaa

SEQ ID NO: 289114 - DNA, 20 bp, Artificial Sequence
  chemically synthesized
attttccctttttctaaaag

SEQ ID NO: 289115 - DNA, 20 bp, Artificial Sequence
  chemically synthesized
taagtggatagagctgcttt

SEQ ID NO: 289116 - DNA, 20 bp, Artificial Sequence
  chemically synthesized
ataggattgctaagtggata

SEQ ID NO: 289117 - DNA, 20 bp, Artificial Sequence
  chemically synthesized
taaaagcagctctatccact

SEQ ID NO: 289118 - DNA, 20 bp, Artificial Sequence
  chemically synthesized
aaataggattgctaagtgga

SEQ ID NO: 289119 - DNA, 20 bp, Artificial Sequence
  chemically synthesized
ttgaaaataggattgctaag

SEQ ID NO: 289120 - DNA, 20 bp, Artificial Sequence
  chemically synthesized
attttgaaaataggattgct

SEQ ID NO: 289121 - DNA, 20 bp, Artificial Sequence
  chemically synthesized
taacatgatattttgaaaat

SEQ ID NO: 289122 - DNA, 20 bp, Artificial Sequence
  chemically synthesized
ttaacatgatattttgaaaa

SEQ ID NO: 289123 - DNA, 20 bp, Artificial Sequence
  chemically synthesized
tttgttagttaaatatgaaa

SEQ ID NO: 289124 - DNA, 20 bp, Artificial Sequence
  chemically synthesized
tacacataattattatttgt

SEQ ID NO: 289125 - DNA, 20 bp, Artificial Sequence
  chemically synthesized
ataataattatgtgtattta

SEQ ID NO: 289126 - DNA, 20 bp, Artificial Sequence
  chemically synthesized
taataattatgtgtatttat

SEQ ID NO: 289127 - DNA, 20 bp, Artificial Sequence
  chemically synthesized
aataattatgtgtatttatg

SEQ ID NO: 289128 - DNA, 20 bp, Artificial Sequence
  chemically synthesized
aatattttacaatgcataca

SEQ ID NO: 289129 - DNA, 20 bp, Artificial Sequence
  chemically synthesized
tgcattgtaaaatattcact

SEQ ID NO: 289130 - DNA, 20 bp, Artificial Sequence
  chemically synthesized
gcattgtaaaatattcactc

SEQ ID NO: 289131 - DNA, 20 bp, Artificial Sequence
  chemically synthesized
attaatatgttaattaacct

SEQ ID NO: 289132 - DNA, 20 bp, Artificial Sequence
  chemically synthesized
caaaaaaagataagttggtg

SEQ ID NO: 289133 - DNA, 20 bp, Artificial Sequence
  chemically synthesized
acaaaaaaagataagttggt

SEQ ID NO: 289134 - DNA, 20 bp, Artificial Sequence
  chemically synthesized
catcacaaaaaaagataagt

SEQ ID NO: 289135 - DNA, 20 bp, Artificial Sequence
  chemically synthesized
tccgcatcacaaaaaaagat

SEQ ID NO: 289136 - DNA, 20 bp, Artificial Sequence
  chemically synthesized
taatatccgcatcacaaaaa

SEQ ID NO: 289137 - DNA, 20 bp, Artificial Sequence
  chemically synthesized
acttatctttttttgtgatg

SEQ ID NO: 289138 - DNA, 20 bp, Artificial Sequence
  chemically synthesized
tttcaaaattggtaaaagaa

SEQ ID NO: 289139 - DNA, 20 bp, Artificial Sequence
  chemically synthesized
ctatgtttcaaaattggtaa

SEQ ID NO: 289140 - DNA, 20 bp, Artificial Sequence
  chemically synthesized
aaaaatctatgtttcaaaat

SEQ ID NO: 289141 - DNA, 20 bp, Artificial Sequence
  chemically synthesized
cttttaccaattttgaaaca

SEQ ID NO: 289142 - DNA, 20 bp, Artificial Sequence
  chemically synthesized
ctagtactgcgtggtggaca

SEQ ID NO: 289143 - DNA, 20 bp, Artificial Sequence
  chemically synthesized
tattaactgtgtccaccacg

SEQ ID NO: 289144 - DNA, 20 bp, Artificial Sequence
  chemically synthesized
cgatctctagtactgcgtgg

SEQ ID NO: 289145 - DNA, 20 bp, Artificial Sequence
  chemically synthesized
tagcgatctctagtactgcg

SEQ ID NO: 289146 - DNA, 20 bp, Artificial Sequence
  chemically synthesized
ctgtgtccaccacgcagtac

SEQ ID NO: 289147 - DNA, 20 bp, Artificial Sequence
  chemically synthesized
gtgtccaccacgcagtacta

SEQ ID NO: 289148 - DNA, 20 bp, Artificial Sequence
  chemically synthesized
gaataaattgtagcgatctc

SEQ ID NO: 289149 - DNA, 20 bp, Artificial Sequence
  chemically synthesized
tagactggaggaataaattg

SEQ ID NO: 289150 - DNA, 20 bp, Artificial Sequence
  chemically synthesized
atcgctacaatttattcctc

SEQ ID NO: 289151 - DNA, 20 bp, Artificial Sequence
  chemically synthesized
gaaagtttcagttagactgg

SEQ ID NO: 289152 - DNA, 20 bp, Artificial Sequence
  chemically synthesized
agaaagtttcagttagactg

SEQ ID NO: 289153 - DNA, 20 bp, Artificial Sequence
  chemically synthesized
atagaaagtttcagttagac

SEQ ID NO: 289154 - DNA, 20 bp, Artificial Sequence
  chemically synthesized
aaatgatagaaagtttcagt

SEQ ID NO: 289155 - DNA, 20 bp, Artificial Sequence
  chemically synthesized
gatcaaatgatagaaagttt

SEQ ID NO: 289156 - DNA, 20 bp, Artificial Sequence
  chemically synthesized
ggtgttgatcaaatgataga

SEQ ID NO: 289157 - DNA, 20 bp, Artificial Sequence
  chemically synthesized
ggaaggtgttgatcaaatga

SEQ ID NO: 289158 - DNA, 20 bp, Artificial Sequence
  chemically synthesized
gaggaaggttgggaaaggga

SEQ ID NO: 289159 - DNA, 20 bp, Artificial Sequence
  chemically synthesized
agaggaaggttgggaaaggg

SEQ ID NO: 289160 - DNA, 20 bp, Artificial Sequence
  chemically synthesized
ggaagaggaaggttgggaaa

SEQ ID NO: 289161 - DNA, 20 bp, Artificial Sequence
  chemically synthesized
gggaagaggaaggttgggaa

SEQ ID NO: 289162 - DNA, 20 bp, Artificial Sequence
  chemically synthesized
ggggaagaggaaggttggga

SEQ ID NO: 289163 - DNA, 20 bp, Artificial Sequence
  chemically synthesized
ctggggggaagaggaaggtt

SEQ ID NO: 289164 - DNA, 20 bp, Artificial Sequence
  chemically synthesized
actggggggaagaggaaggt

SEQ ID NO: 289165 - DNA, 20 bp, Artificial Sequence
  chemically synthesized
agagactggggggaagagga

SEQ ID NO: 289166 - DNA, 20 bp, Artificial Sequence
  chemically synthesized
cagagactggggggaagagg

SEQ ID NO: 289167 - DNA, 20 bp, Artificial Sequence
  chemically synthesized
taccagagactggggggaag

SEQ ID NO: 289168 - DNA, 20 bp, Artificial Sequence
  chemically synthesized
cccaaccttcctcttccccc

SEQ ID NO: 289169 - DNA, 20 bp, Artificial Sequence
  chemically synthesized
ttaccagagactggggggaa

SEQ ID NO: 289170 - DNA, 20 bp, Artificial Sequence
  chemically synthesized
agttaccagagactgggggg

SEQ ID NO: 289171 - DNA, 20 bp, Artificial Sequence
  chemically synthesized
ggtagttaccagagactggg

SEQ ID NO: 289172 - DNA, 20 bp, Artificial Sequence
  chemically synthesized
aggtagttaccagagactgg

SEQ ID NO: 289173 - DNA, 20 bp, Artificial Sequence
  chemically synthesized
ttcctcttccccccagtctc

SEQ ID NO: 289174 - DNA, 20 bp, Artificial Sequence
  chemically synthesized
aaggtagttaccagagactg

SEQ ID NO: 289175 - DNA, 20 bp, Artificial Sequence
  chemically synthesized
aaaggtagttaccagagact

SEQ ID NO: 289176 - DNA, 20 bp, Artificial Sequence
  chemically synthesized
gaaaggtagttaccagagac

SEQ ID NO: 289177 - DNA, 20 bp, Artificial Sequence
  chemically synthesized
aaatagaaaggtagttacca

SEQ ID NO: 289178 - DNA, 20 bp, Artificial Sequence
  chemically synthesized
gaaaatagaaaggtagttac

SEQ ID NO: 289179 - DNA, 20 bp, Artificial Sequence
  chemically synthesized
agaaacagaaaatagaaagg

SEQ ID NO: 289180 - DNA, 20 bp, Artificial Sequence
  chemically synthesized
tatagaaacagaaaatagaa

SEQ ID NO: 289181 - DNA, 20 bp, Artificial Sequence
  chemically synthesized
ttatagaaacagaaaataga

SEQ ID NO: 289182 - DNA, 20 bp, Artificial Sequence
  chemically synthesized
caaattatagaaacagaaaa

SEQ ID NO: 289183 - DNA, 20 bp, Artificial Sequence
  chemically synthesized
aaaaagtcaaattatagaaa

SEQ ID NO: 289184 - DNA, 20 bp, Artificial Sequence
  chemically synthesized
tccaaaaaaaagtcaaatta

SEQ ID NO: 289185 - DNA, 20 bp, Artificial Sequence
  chemically synthesized
tctataatttgacttttttt

SEQ ID NO: 289186 - DNA, 20 bp, Artificial Sequence
  chemically synthesized
tatatgagaaatccaaaaaa

SEQ ID NO: 289187 - DNA, 20 bp, Artificial Sequence
  chemically synthesized
tttttttggatttctcatat

SEQ ID NO: 289188 - DNA, 20 bp, Artificial Sequence
  chemically synthesized
ctgtatgatctcacttatat

SEQ ID NO: 289189 - DNA, 20 bp, Artificial Sequence
  chemically synthesized
tttggatttctcatataagt

SEQ ID NO: 289190 - DNA, 20 bp, Artificial Sequence
  chemically synthesized
ctcatataagtgagatcata

SEQ ID NO: 289191 - DNA, 20 bp, Artificial Sequence
  chemically synthesized
tgaaatgagccaggcaaaga

SEQ ID NO: 289192 - DNA, 20 bp, Artificial Sequence
  chemically synthesized
agtatttgtctttctttgcc

SEQ ID NO: 289193 - DNA, 20 bp, Artificial Sequence
  chemically synthesized
tagctgaaatgagccaggca

SEQ ID NO: 289194 - DNA, 20 bp, Artificial Sequence
  chemically synthesized
taggctagctgaaatgagcc

SEQ ID NO: 289195 - DNA, 20 bp, Artificial Sequence
  chemically synthesized
ttaggctagctgaaatgagc

SEQ ID NO: 289196 - DNA, 20 bp, Artificial Sequence
  chemically synthesized
tttctttgcctggctcattt

SEQ ID NO: 289197 - DNA, 20 bp, Artificial Sequence
  chemically synthesized
gacattaggctagctgaaat

SEQ ID NO: 289198 - DNA, 20 bp, Artificial Sequence
  chemically synthesized
tttgcctggctcatttcagc

SEQ ID NO: 289199 - DNA, 20 bp, Artificial Sequence
  chemically synthesized
agaactggcggacattaggc

SEQ ID NO: 289200 - DNA, 20 bp, Artificial Sequence
  chemically synthesized
agatagaactggcggacatt

SEQ ID NO: 289201 - DNA, 20 bp, Artificial Sequence
  chemically synthesized
tagatagaactggcggacat

SEQ ID NO: 289202 - DNA, 20 bp, Artificial Sequence
  chemically synthesized
tcagctagcctaatgtccgc

SEQ ID NO: 289203 - DNA, 20 bp, Artificial Sequence
  chemically synthesized
caccatgtagatagaactgg

SEQ ID NO: 289204 - DNA, 20 bp, Artificial Sequence
  chemically synthesized
tgccaccatgtagatagaac

SEQ ID NO: 289205 - DNA, 20 bp, Artificial Sequence
  chemically synthesized
gtccgccagttctatctaca

SEQ ID NO: 289206 - DNA, 20 bp, Artificial Sequence
  chemically synthesized
gtcatttgccaccatgtaga

SEQ ID NO: 289207 - DNA, 20 bp, Artificial Sequence
  chemically synthesized
cgccagttctatctacatgg

SEQ ID NO: 289208 - DNA, 20 bp, Artificial Sequence
  chemically synthesized
ttctgtcatttgccaccatg

SEQ ID NO: 289209 - DNA, 20 bp, Artificial Sequence
  chemically synthesized
atctacatggtggcaaatga

SEQ ID NO: 289210 - DNA, 20 bp, Artificial Sequence
  chemically synthesized
ctatacagtctttaaaagga

SEQ ID NO: 289211 - DNA, 20 bp, Artificial Sequence
  chemically synthesized
acagaaattccttcctttta

SEQ ID NO: 289212 - DNA, 20 bp, Artificial Sequence
  chemically synthesized
actatacagtctttaaaagg

SEQ ID NO: 289213 - DNA, 20 bp, Artificial Sequence
  chemically synthesized
aatactatacagtctttaaa

SEQ ID NO: 289214 - DNA, 20 bp, Artificial Sequence
  chemically synthesized
gaatactatacagtctttaa

SEQ ID NO: 289215 - DNA, 20 bp, Artificial Sequence
  chemically synthesized
ccttccttttaaagactgta

SEQ ID NO: 289216 - DNA, 20 bp, Artificial Sequence
  chemically synthesized
atatgcaatggaatactata

SEQ ID NO: 289217 - DNA, 20 bp, Artificial Sequence
  chemically synthesized
tatatgatatatatatgcaa

SEQ ID NO: 289218 - DNA, 20 bp, Artificial Sequence
  chemically synthesized
ttgcatatatatatcatata

SEQ ID NO: 289219 - DNA, 20 bp, Artificial Sequence
  chemically synthesized
tatatatcatatatagacac

SEQ ID NO: 289220 - DNA, 20 bp, Artificial Sequence
  chemically synthesized
atatagtgataaatatattc

SEQ ID NO: 289221 - DNA, 20 bp, Artificial Sequence
  chemically synthesized
tatatagtgacatatatata

SEQ ID NO: 289222 - DNA, 20 bp, Artificial Sequence
  chemically synthesized
atatatgtcactatatatat

SEQ ID NO: 289223 - DNA, 20 bp, Artificial Sequence
  chemically synthesized
gatatatatactgatatata

SEQ ID NO: 289224 - DNA, 20 bp, Artificial Sequence
  chemically synthesized
gtatatatatctctatatat

SEQ ID NO: 289225 - DNA, 20 bp, Artificial Sequence
  chemically synthesized
tttatatatactgatatata

SEQ ID NO: 289226 - DNA, 20 bp, Artificial Sequence
  chemically synthesized
gatttatatatactgatata

SEQ ID NO: 289227 - DNA, 20 bp, Artificial Sequence
  chemically synthesized
tgcatagtggtagatatata

SEQ ID NO: 289228 - DNA, 20 bp, Artificial Sequence
  chemically synthesized
tagtgatatatgcatagtgg

SEQ ID NO: 289229 - DNA, 20 bp, Artificial Sequence
  chemically synthesized
atatagtgatatatgcatag

SEQ ID NO: 289230 - DNA, 20 bp, Artificial Sequence
  chemically synthesized
tatatatagtgatatatgca

SEQ ID NO: 289231 - DNA, 20 bp, Artificial Sequence
  chemically synthesized
taaagaaaatgtgatatata

SEQ ID NO: 289232 - DNA, 20 bp, Artificial Sequence
  chemically synthesized
tattacaggacgaatggata

SEQ ID NO: 289233 - DNA, 20 bp, Artificial Sequence
  chemically synthesized
aatgtctattacaggacgaa

SEQ ID NO: 289234 - DNA, 20 bp, Artificial Sequence
  chemically synthesized
tttatccattcgtcctgtaa

SEQ ID NO: 289235 - DNA, 20 bp, Artificial Sequence
  chemically synthesized
acaacctaaatgtctattac

SEQ ID NO: 289236 - DNA, 20 bp, Artificial Sequence
  chemically synthesized
aacaacctaaatgtctatta

SEQ ID NO: 289237 - DNA, 20 bp, Artificial Sequence
  chemically synthesized
ttcgtcctgtaatagacatt

SEQ ID NO: 289238 - DNA, 20 bp, Artificial Sequence
  chemically synthesized
tcgtcctgtaatagacattt

SEQ ID NO: 289239 - DNA, 20 bp, Artificial Sequence
  chemically synthesized
tttaggttgtttccgtatct

SEQ ID NO: 289240 - DNA, 20 bp, Artificial Sequence
  chemically synthesized
tattcataacagccaagata

SEQ ID NO: 289241 - DNA, 20 bp, Artificial Sequence
  chemically synthesized
gagcattattcataacagcc

SEQ ID NO: 289242 - DNA, 20 bp, Artificial Sequence
  chemically synthesized
catttgagcattattcataa

SEQ ID NO: 289243 - DNA, 20 bp, Artificial Sequence
  chemically synthesized
tgttatgaataatgctcaaa

SEQ ID NO: 289244 - DNA, 20 bp, Artificial Sequence
  chemically synthesized
tgcccatgccatatccattt

SEQ ID NO: 289245 - DNA, 20 bp, Artificial Sequence
  chemically synthesized
gaataatgctcaaatggata

SEQ ID NO: 289246 - DNA, 20 bp, Artificial Sequence
  chemically synthesized
atgctcaaatggatatggca

SEQ ID NO: 289247 - DNA, 20 bp, Artificial Sequence
  chemically synthesized
tgctcaaatggatatggcat

SEQ ID NO: 289248 - DNA, 20 bp, Artificial Sequence
  chemically synthesized
ggatatggcatgggcaacaa

SEQ ID NO: 289249 - DNA, 20 bp, Artificial Sequence
  chemically synthesized
atgggcaacaaaagcaaaaa

SEQ ID NO: 289250 - DNA, 20 bp, Artificial Sequence
  chemically synthesized
aaaagcaaaaatagacaaat

SEQ ID NO: 289251 - DNA, 20 bp, Artificial Sequence
  chemically synthesized
ttagattgcatcaaactaaa

SEQ ID NO: 289252 - DNA, 20 bp, Artificial Sequence
  chemically synthesized
tttcctgtgcaggagctttt

SEQ ID NO: 289253 - DNA, 20 bp, Artificial Sequence
  chemically synthesized
caaactaaaaagctcctgca

SEQ ID NO: 289254 - DNA, 20 bp, Artificial Sequence
  chemically synthesized
aaactaaaaagctcctgcac

SEQ ID NO: 289255 - DNA, 20 bp, Artificial Sequence
  chemically synthesized
tagtttcctttcctgtgcag

SEQ ID NO: 289256 - DNA, 20 bp, Artificial Sequence
  chemically synthesized
aatagtttcctttcctgtgc

SEQ ID NO: 289257 - DNA, 20 bp, Artificial Sequence
  chemically synthesized
taaaaagctcctgcacagga

SEQ ID NO: 289258 - DNA, 20 bp, Artificial Sequence
  chemically synthesized
taatagtttcctttcctgtg

SEQ ID NO: 289259 - DNA, 20 bp, Artificial Sequence
  chemically synthesized
aaaaagctcctgcacaggaa

SEQ ID NO: 289260 - DNA, 20 bp, Artificial Sequence
  chemically synthesized
acaggaaaggaaactattaa

SEQ ID NO: 289261 - DNA, 20 bp, Artificial Sequence
  chemically synthesized
aggaaaggaaactattaaca

SEQ ID NO: 289262 - DNA, 20 bp, Artificial Sequence
  chemically synthesized
ctgcctcttcactctgttaa

SEQ ID NO: 289263 - DNA, 20 bp, Artificial Sequence
  chemically synthesized
aggaaactattaacagagtg

SEQ ID NO: 289264 - DNA, 20 bp, Artificial Sequence
  chemically synthesized
gaaactattaacagagtgaa

SEQ ID NO: 289265 - DNA, 20 bp, Artificial Sequence
  chemically synthesized
aaactattaacagagtgaag

SEQ ID NO: 289266 - DNA, 20 bp, Artificial Sequence
  chemically synthesized
ctattaacagagtgaagagg

SEQ ID NO: 289267 - DNA, 20 bp, Artificial Sequence
  chemically synthesized
cagagtgaagaggcagctca

SEQ ID NO: 289268 - DNA, 20 bp, Artificial Sequence
  chemically synthesized
gaagaggcagctcacagatc

SEQ ID NO: 289269 - DNA, 20 bp, Artificial Sequence
  chemically synthesized
aatattttctcttgatctgt

SEQ ID NO: 289270 - DNA, 20 bp, Artificial Sequence
  chemically synthesized
agaggcagctcacagatcaa

SEQ ID NO: 289271 - DNA, 20 bp, Artificial Sequence
  chemically synthesized
atatttgcaaaccaaatatc

SEQ ID NO: 289272 - DNA, 20 bp, Artificial Sequence
  chemically synthesized
ttaactccttaccagatatt

SEQ ID NO: 289273 - DNA, 20 bp, Artificial Sequence
  chemically synthesized
ttgcaaaccaaatatctggt

SEQ ID NO: 289274 - DNA, 20 bp, Artificial Sequence
  chemically synthesized
tgcaaaccaaatatctggta

SEQ ID NO: 289275 - DNA, 20 bp, Artificial Sequence
  chemically synthesized
caaaccaaatatctggtaag

SEQ ID NO: 289276 - DNA, 20 bp, Artificial Sequence
  chemically synthesized
tttggatattaactccttac

SEQ ID NO: 289277 - DNA, 20 bp, Artificial Sequence
  chemically synthesized
gagttaatatccaaaatata

SEQ ID NO: 289278 - DNA, 20 bp, Artificial Sequence
  chemically synthesized
tttgaggtttctatatattt

SEQ ID NO: 289279 - DNA, 20 bp, Artificial Sequence
  chemically synthesized
tcttgctgttgagttttttg

SEQ ID NO: 289280 - DNA, 20 bp, Artificial Sequence
  chemically synthesized
ttcttgctgttgagtttttt

SEQ ID NO: 289281 - DNA, 20 bp, Artificial Sequence
  chemically synthesized
agaaacctcaaaaaactcaa

SEQ ID NO: 289282 - DNA, 20 bp, Artificial Sequence
  chemically synthesized
acctcaaaaaactcaacagc

SEQ ID NO: 289283 - DNA, 20 bp, Artificial Sequence
  chemically synthesized
ttatttgttttcttgctgtt

SEQ ID NO: 289284 - DNA, 20 bp, Artificial Sequence
  chemically synthesized
cccttgcccatttttaaatc

SEQ ID NO: 289285 - DNA, 20 bp, Artificial Sequence
  chemically synthesized
tcccttgcccatttttaaat

SEQ ID NO: 289286 - DNA, 20 bp, Artificial Sequence
  chemically synthesized
caaataacctgatttaaaaa

SEQ ID NO: 289287 - DNA, 20 bp, Artificial Sequence
  chemically synthesized
aaataacctgatttaaaaat

SEQ ID NO: 289288 - DNA, 20 bp, Artificial Sequence
  chemically synthesized
aacctgatttaaaaatgggc

SEQ ID NO: 289289 - DNA, 20 bp, Artificial Sequence
  chemically synthesized
acctgatttaaaaatgggca

SEQ ID NO: 289290 - DNA, 20 bp, Artificial Sequence
  chemically synthesized
cctgatttaaaaatgggcaa

SEQ ID NO: 289291 - DNA, 20 bp, Artificial Sequence
  chemically synthesized
aaatgggcaagggatatgaa

SEQ ID NO: 289292 - DNA, 20 bp, Artificial Sequence
  chemically synthesized
gaacagacatttctcgcaat

SEQ ID NO: 289293 - DNA, 20 bp, Artificial Sequence
  chemically synthesized
acagacatttctcgcaataa

SEQ ID NO: 289294 - DNA, 20 bp, Artificial Sequence
  chemically synthesized
ccattggtgcctcttattgc

SEQ ID NO: 289295 - DNA, 20 bp, Artificial Sequence
  chemically synthesized
cagacatttctcgcaataag

SEQ ID NO: 289296 - DNA, 20 bp, Artificial Sequence
  chemically synthesized
ctcgcaataagaggcaccaa

SEQ ID NO: 289297 - DNA, 20 bp, Artificial Sequence
  chemically synthesized
ttcacatatctgttggccat

SEQ ID NO: 289298 - DNA, 20 bp, Artificial Sequence
  chemically synthesized
taagaggcaccaatggccaa

SEQ ID NO: 289299 - DNA, 20 bp, Artificial Sequence
  chemically synthesized
gcattttttcacatatctgt

SEQ ID NO: 289300 - DNA, 20 bp, Artificial Sequence
  chemically synthesized
ttctgatgtttagagatgtt

SEQ ID NO: 289301 - DNA, 20 bp, Artificial Sequence
  chemically synthesized
tgctcaacatctctaaacat

SEQ ID NO: 289302 - DNA, 20 bp, Artificial Sequence
  chemically synthesized
tcacatttttctgatgttta

SEQ ID NO: 289303 - DNA, 20 bp, Artificial Sequence
  chemically synthesized
tttcacatttttctgatgtt

SEQ ID NO: 289304 - DNA, 20 bp, Artificial Sequence
  chemically synthesized
tgtaaggtgacacatcattg

SEQ ID NO: 289305 - DNA, 20 bp, Artificial Sequence
  chemically synthesized
ttctaattttaacatgtgta

SEQ ID NO: 289306 - DNA, 20 bp, Artificial Sequence
  chemically synthesized
gttctaattttaacatgtgt

SEQ ID NO: 289307 - DNA, 20 bp, Artificial Sequence
  chemically synthesized
caccttacacatgttaaaat

SEQ ID NO: 289308 - DNA, 20 bp, Artificial Sequence
  chemically synthesized
tacacatgttaaaattagaa

SEQ ID NO: 289309 - DNA, 20 bp, Artificial Sequence
  chemically synthesized
atctttcatcattttgaaag

SEQ ID NO: 289310 - DNA, 20 bp, Artificial Sequence
  chemically synthesized
tttatctttcatcattttga

SEQ ID NO: 289311 - DNA, 20 bp, Artificial Sequence
  chemically synthesized
ggctactttcaaaatgatga

SEQ ID NO: 289312 - DNA, 20 bp, Artificial Sequence
  chemically synthesized
aaatgatgaaagataaatgt

SEQ ID NO: 289313 - DNA, 20 bp, Artificial Sequence
  chemically synthesized
atgatgaaagataaatgttg

SEQ ID NO: 289314 - DNA, 20 bp, Artificial Sequence
  chemically synthesized
gatgaaagataaatgttgga

SEQ ID NO: 289315 - DNA, 20 bp, Artificial Sequence
  chemically synthesized
atgaaagataaatgttggag

SEQ ID NO: 289316 - DNA, 20 bp, Artificial Sequence
  chemically synthesized
gataaatgttggagaggctg

SEQ ID NO: 289317 - DNA, 20 bp, Artificial Sequence
  chemically synthesized
taaatgttggagaggctgtg

SEQ ID NO: 289318 - DNA, 20 bp, Artificial Sequence
  chemically synthesized
gttggagaggctgtggagaa

SEQ ID NO: 289319 - DNA, 20 bp, Artificial Sequence
  chemically synthesized
tgtaagtgtacttttctcca

SEQ ID NO: 289320 - DNA, 20 bp, Artificial Sequence
  chemically synthesized
cattcccaccaacaatgtgt

SEQ ID NO: 289321 - DNA, 20 bp, Artificial Sequence
  chemically synthesized
aaagtacacttacacattgt

SEQ ID NO: 289322 - DNA, 20 bp, Artificial Sequence
  chemically synthesized
gtacacttacacattgttgg

SEQ ID NO: 289323 - DNA, 20 bp, Artificial Sequence
  chemically synthesized
tacacttacacattgttggt

SEQ ID NO: 289324 - DNA, 20 bp, Artificial Sequence
  chemically synthesized
ttgttggtgggaatgtaaat

SEQ ID NO: 289325 - DNA, 20 bp, Artificial Sequence
  chemically synthesized
ggtgggaatgtaaattagta

SEQ ID NO: 289326 - DNA, 20 bp, Artificial Sequence
  chemically synthesized
gtaaattagtacagccattt

SEQ ID NO: 289327 - DNA, 20 bp, Artificial Sequence
  chemically synthesized
cctcatactattttccaaaa

SEQ ID NO: 289328 - DNA, 20 bp, Artificial Sequence
  chemically synthesized
agtacagccattttggaaaa

SEQ ID NO: 289329 - DNA, 20 bp, Artificial Sequence
  chemically synthesized
gccattttggaaaatagtat

SEQ ID NO: 289330 - DNA, 20 bp, Artificial Sequence
  chemically synthesized
ccattttggaaaatagtatg

SEQ ID NO: 289331 - DNA, 20 bp, Artificial Sequence
  chemically synthesized
atttataaaatttatgtgac

SEQ ID NO: 289332 - DNA, 20 bp, Artificial Sequence
  chemically synthesized
catttataaaatttatgtga

SEQ ID NO: 289333 - DNA, 20 bp, Artificial Sequence
  chemically synthesized
atactgtgtatatacacatg

SEQ ID NO: 289334 - DNA, 20 bp, Artificial Sequence
  chemically synthesized
tgtctacatgtgtatataca

SEQ ID NO: 289335 - DNA, 20 bp, Artificial Sequence
  chemically synthesized
atactgtgtatgtacacaca

SEQ ID NO: 289336 - DNA, 20 bp, Artificial Sequence
  chemically synthesized
tgtctatgtgtgtacataca

SEQ ID NO: 289337 - DNA, 20 bp, Artificial Sequence
  chemically synthesized
atactgtgtatgtacacacg

SEQ ID NO: 289338 - DNA, 20 bp, Artificial Sequence
  chemically synthesized
tgtctacgtgtgtacataca

SEQ ID NO: 289339 - DNA, 20 bp, Artificial Sequence
  chemically synthesized
attctgtgtatataaacacg

SEQ ID NO: 289340 - DNA, 20 bp, Artificial Sequence
  chemically synthesized
tgtctacgtgtttatataca

SEQ ID NO: 289341 - DNA, 20 bp, Artificial Sequence
  chemically synthesized
atactgtgtatatacacacg

SEQ ID NO: 289342 - DNA, 20 bp, Artificial Sequence
  chemically synthesized
tgtctacgtgtgtatataca

SEQ ID NO: 289343 - DNA, 20 bp, Artificial Sequence
  chemically synthesized
atattgtgtatatacacacg

SEQ ID NO: 289344 - DNA, 20 bp, Artificial Sequence
  chemically synthesized
tacacaatatttgcctacgt

SEQ ID NO: 289345 - DNA, 20 bp, Artificial Sequence
  chemically synthesized
tactgtgtaaatactcacgt

SEQ ID NO: 289346 - DNA, 20 bp, Artificial Sequence
  chemically synthesized
atactgtgtaaatactcacg

SEQ ID NO: 289347 - DNA, 20 bp, Artificial Sequence
  chemically synthesized
tgcctacgtgagtatttaca

SEQ ID NO: 289348 - DNA, 20 bp, Artificial Sequence
  chemically synthesized
atactgtgtatgtacacaca

SEQ ID NO: 289349 - DNA, 20 bp, Artificial Sequence
  chemically synthesized
tgtctgtgtgtgtacataca

SEQ ID NO: 289350 - DNA, 20 bp, Artificial Sequence
  chemically synthesized
acatatacgtatatgtacac

SEQ ID NO: 289351 - DNA, 20 bp, Artificial Sequence
  chemically synthesized
catatacgtatatgtacaca

SEQ ID NO: 289352 - DNA, 20 bp, Artificial Sequence
  chemically synthesized
cgtgtgtatatatatatgta

SEQ ID NO: 289353 - DNA, 20 bp, Artificial Sequence
  chemically synthesized
atatatgtatagctttaact

SEQ ID NO: 289354 - DNA, 20 bp, Artificial Sequence
  chemically synthesized
actcgctaaatgccaagtta

SEQ ID NO: 289355 - DNA, 20 bp, Artificial Sequence
  chemically synthesized
tatagctttaacttggcatt

SEQ ID NO: 289356 - DNA, 20 bp, Artificial Sequence
  chemically synthesized
gggaaaactcgctaaatgcc

SEQ ID NO: 289357 - DNA, 20 bp, Artificial Sequence
  chemically synthesized
gctttaacttggcatttagc

SEQ ID NO: 289358 - DNA, 20 bp, Artificial Sequence
  chemically synthesized
tccctgacctcaagaatcat

SEQ ID NO: 289359 - DNA, 20 bp, Artificial Sequence
  chemically synthesized
ttccctgacctcaagaatca

SEQ ID NO: 289360 - DNA, 20 bp, Artificial Sequence
  chemically synthesized
cgagttttcccatgattctt

SEQ ID NO: 289361 - DNA, 20 bp, Artificial Sequence
  chemically synthesized
gagttttcccatgattcttg

SEQ ID NO: 289362 - DNA, 20 bp, Artificial Sequence
  chemically synthesized
tttcccatgattcttgaggt

SEQ ID NO: 289363 - DNA, 20 bp, Artificial Sequence
  chemically synthesized
ttcccatgattcttgaggtc

SEQ ID NO: 289364 - DNA, 20 bp, Artificial Sequence
  chemically synthesized
tcccatgattcttgaggtca

SEQ ID NO: 289365 - DNA, 20 bp, Artificial Sequence
  chemically synthesized
aagaattgttccctgacctc

SEQ ID NO: 289366 - DNA, 20 bp, Artificial Sequence
  chemically synthesized
atgtgcttattgtgagataa

SEQ ID NO: 289367 - DNA, 20 bp, Artificial Sequence
  chemically synthesized
caattcttttatctcacaat

SEQ ID NO: 289368 - DNA, 20 bp, Artificial Sequence
  chemically synthesized
gcaagctatgtgcttattgt

SEQ ID NO: 289369 - DNA, 20 bp, Artificial Sequence
  chemically synthesized
tttatctcacaataagcaca

SEQ ID NO: 289370 - DNA, 20 bp, Artificial Sequence
  chemically synthesized
gcagacatgtttatttaagc

SEQ ID NO: 289371 - DNA, 20 bp, Artificial Sequence
  chemically synthesized
catagcagacatgtttattt

SEQ ID NO: 289372 - DNA, 20 bp, Artificial Sequence
  chemically synthesized
accatcaagagcaagcatag

SEQ ID NO: 289373 - DNA, 20 bp, Artificial Sequence
  chemically synthesized
aataccatcaagagcaagca

SEQ ID NO: 289374 - DNA, 20 bp, Artificial Sequence
  chemically synthesized
ttatcaataccatcaagagc

SEQ ID NO: 289375 - DNA, 20 bp, Artificial Sequence
  chemically synthesized
tctgctatgcttgctcttga

SEQ ID NO: 289376 - DNA, 20 bp, Artificial Sequence
  chemically synthesized
atttttatcaataccatcaa

SEQ ID NO: 289377 - DNA, 20 bp, Artificial Sequence
  chemically synthesized
ttatttttatcaataccatc

SEQ ID NO: 289378 - DNA, 20 bp, Artificial Sequence
  chemically synthesized
aaaaataacacaatttttaa

SEQ ID NO: 289379 - DNA, 20 bp, Artificial Sequence
  chemically synthesized
aaaataacacaatttttaaa

SEQ ID NO: 289380 - DNA, 20 bp, Artificial Sequence
  chemically synthesized
ttaaaaggaacatttacaaa

SEQ ID NO: 289381 - DNA, 20 bp, Artificial Sequence
  chemically synthesized
acatttacaaacagtttacc

SEQ ID NO: 289382 - DNA, 20 bp, Artificial Sequence
  chemically synthesized
caaacagtttacctagtttc

SEQ ID NO: 289383 - DNA, 20 bp, Artificial Sequence
  chemically synthesized
gctccttcactccagaaact

SEQ ID NO: 289384 - DNA, 20 bp, Artificial Sequence
  chemically synthesized
aacagtttacctagtttctg

SEQ ID NO: 289385 - DNA, 20 bp, Artificial Sequence
  chemically synthesized
tgctccttcactccagaaac

SEQ ID NO: 289386 - DNA, 20 bp, Artificial Sequence
  chemically synthesized
tttacctagtttctggagtg

SEQ ID NO: 289387 - DNA, 20 bp, Artificial Sequence
  chemically synthesized
ttacctagtttctggagtga

SEQ ID NO: 289388 - DNA, 20 bp, Artificial Sequence
  chemically synthesized
gttgcattgctccttcactc

SEQ ID NO: 289389 - DNA, 20 bp, Artificial Sequence
  chemically synthesized
acctagtttctggagtgaag

SEQ ID NO: 289390 - DNA, 20 bp, Artificial Sequence
  chemically synthesized
ggagtgaaggagcaatgcaa

SEQ ID NO: 289391 - DNA, 20 bp, Artificial Sequence
  chemically synthesized
gcaacagattatgtgtctac

SEQ ID NO: 289392 - DNA, 20 bp, Artificial Sequence
  chemically synthesized
aaaggaatgttttgttccag

SEQ ID NO: 289393 - DNA, 20 bp, Artificial Sequence
  chemically synthesized
ggcaaaggaatgttttgttc

SEQ ID NO: 289394 - DNA, 20 bp, Artificial Sequence
  chemically synthesized
gaacaaaacattcctttgcc

SEQ ID NO: 289395 - DNA, 20 bp, Artificial Sequence
  chemically synthesized
tttttaatacatctaggcaa

SEQ ID NO: 289396 - DNA, 20 bp, Artificial Sequence
  chemically synthesized
atttttaatacatctaggca

SEQ ID NO: 289397 - DNA, 20 bp, Artificial Sequence
  chemically synthesized
attttatttttaatacatct

SEQ ID NO: 289398 - DNA, 20 bp, Artificial Sequence
  chemically synthesized
aattttatttttaatacatc

SEQ ID NO: 289399 - DNA, 20 bp, Artificial Sequence
  chemically synthesized
aaaaatttaaaattttaata

SEQ ID NO: 289400 - DNA, 20 bp, Artificial Sequence
  chemically synthesized
aaaattttaataaagtaaat

SEQ ID NO: 289401 - DNA, 20 bp, Artificial Sequence
  chemically synthesized
aaattttaataaagtaaatt

SEQ ID NO: 289402 - DNA, 20 bp, Artificial Sequence
  chemically synthesized
taggtcaatttcctgaactg

SEQ ID NO: 289403 - DNA, 20 bp, Artificial Sequence
  chemically synthesized
aactcttctagctgcagttc

SEQ ID NO: 289404 - DNA, 20 bp, Artificial Sequence
  chemically synthesized
taactcttctagctgcagtt

SEQ ID NO: 289405 - DNA, 20 bp, Artificial Sequence
  chemically synthesized
tcaatttcctgaactgcagc

SEQ ID NO: 289406 - DNA, 20 bp, Artificial Sequence
  chemically synthesized
atttcctgaactgcagctag

SEQ ID NO: 289407 - DNA, 20 bp, Artificial Sequence
  chemically synthesized
tgaggtaactcttctagctg

SEQ ID NO: 289408 - DNA, 20 bp, Artificial Sequence
  chemically synthesized
ttcctgaactgcagctagaa

SEQ ID NO: 289409 - DNA, 20 bp, Artificial Sequence
  chemically synthesized
ttgatgtgaggtaactcttc

SEQ ID NO: 289410 - DNA, 20 bp, Artificial Sequence
  chemically synthesized
ttaaaacaaagtttgatgtg

SEQ ID NO: 289411 - DNA, 20 bp, Artificial Sequence
  chemically synthesized
attaaaacaaagtttgatgt

SEQ ID NO: 289412 - DNA, 20 bp, Artificial Sequence
  chemically synthesized
tgagactgggaattaaaaca

SEQ ID NO: 289413 - DNA, 20 bp, Artificial Sequence
  chemically synthesized
tcaaactttgttttaattcc

SEQ ID NO: 289414 - DNA, 20 bp, Artificial Sequence
  chemically synthesized
tttgttttaattcccagtct

SEQ ID NO: 289415 - DNA, 20 bp, Artificial Sequence
  chemically synthesized
cctgttaggatgctgagact

SEQ ID NO: 289416 - DNA, 20 bp, Artificial Sequence
  chemically synthesized
ccctgttaggatgctgagac

SEQ ID NO: 289417 - DNA, 20 bp, Artificial Sequence
  chemically synthesized
cccctccctgttaggatgct

SEQ ID NO: 289418 - DNA, 20 bp, Artificial Sequence
  chemically synthesized
tcccagtctcagcatcctaa

SEQ ID NO: 289419 - DNA, 20 bp, Artificial Sequence
  chemically synthesized
cccagtctcagcatcctaac

SEQ ID NO: 289420 - DNA, 20 bp, Artificial Sequence
  chemically synthesized
ccagtctcagcatcctaaca

SEQ ID NO: 289421 - DNA, 20 bp, Artificial Sequence
  chemically synthesized
agtctcagcatcctaacagg

SEQ ID NO: 289422 - DNA, 20 bp, Artificial Sequence
  chemically synthesized
gtctcagcatcctaacaggg

SEQ ID NO: 289423 - DNA, 20 bp, Artificial Sequence
  chemically synthesized
agtctctacccctccctgtt

SEQ ID NO: 289424 - DNA, 20 bp, Artificial Sequence
  chemically synthesized
tctcagcatcctaacaggga

SEQ ID NO: 289425 - DNA, 20 bp, Artificial Sequence
  chemically synthesized
tagtctctacccctccctgt

SEQ ID NO: 289426 - DNA, 20 bp, Artificial Sequence
  chemically synthesized
ctcagcatcctaacagggag

SEQ ID NO: 289427 - DNA, 20 bp, Artificial Sequence
  chemically synthesized
agcatcctaacagggagggg

SEQ ID NO: 289428 - DNA, 20 bp, Artificial Sequence
  chemically synthesized
catcctaacagggaggggta

SEQ ID NO: 289429 - DNA, 20 bp, Artificial Sequence
  chemically synthesized
ggaggggtagagactaacca

SEQ ID NO: 289430 - DNA, 20 bp, Artificial Sequence
  chemically synthesized
aggggtagagactaaccata

SEQ ID NO: 289431 - DNA, 20 bp, Artificial Sequence
  chemically synthesized
acaatttcaagctctatggt

SEQ ID NO: 289432 - DNA, 20 bp, Artificial Sequence
  chemically synthesized
ggccacaatttcaagctcta

SEQ ID NO: 289433 - DNA, 20 bp, Artificial Sequence
  chemically synthesized
aaccatagagcttgaaattg

SEQ ID NO: 289434 - DNA, 20 bp, Artificial Sequence
  chemically synthesized
ctctccatggccacaatttc

SEQ ID NO: 289435 - DNA, 20 bp, Artificial Sequence
  chemically synthesized
agagcttgaaattgtggcca

SEQ ID NO: 289436 - DNA, 20 bp, Artificial Sequence
  chemically synthesized
agcttgaaattgtggccatg

SEQ ID NO: 289437 - DNA, 20 bp, Artificial Sequence
  chemically synthesized
cttgaaattgtggccatgga

SEQ ID NO: 289438 - DNA, 20 bp, Artificial Sequence
  chemically synthesized
gccagcaaggatgctctcca

SEQ ID NO: 289439 - DNA, 20 bp, Artificial Sequence
  chemically synthesized
gccatggagagcatccttgc

SEQ ID NO: 289440 - DNA, 20 bp, Artificial Sequence
  chemically synthesized
aattttaagggtagccagca

SEQ ID NO: 289441 - DNA, 20 bp, Artificial Sequence
  chemically synthesized
aaattttaagggtagccagc

SEQ ID NO: 289442 - DNA, 20 bp, Artificial Sequence
  chemically synthesized
aagaaaattttaagggtagc

SEQ ID NO: 289443 - DNA, 20 bp, Artificial Sequence
  chemically synthesized
gtagaagaaaattttaaggg

SEQ ID NO: 289444 - DNA, 20 bp, Artificial Sequence
  chemically synthesized
acagtagaagaaaattttaa

SEQ ID NO: 289445 - DNA, 20 bp, Artificial Sequence
  chemically synthesized
gacagtagaagaaaatttta

SEQ ID NO: 289446 - DNA, 20 bp, Artificial Sequence
  chemically synthesized
agacagtagaagaaaatttt

SEQ ID NO: 289447 - DNA, 20 bp, Artificial Sequence
  chemically synthesized
acctcttacagagacagtag

SEQ ID NO: 289448 - DNA, 20 bp, Artificial Sequence
  chemically synthesized
tttacctcttacagagacag

SEQ ID NO: 289449 - DNA, 20 bp, Artificial Sequence
  chemically synthesized
ttttcttctactgtctctgt

SEQ ID NO: 289450 - DNA, 20 bp, Artificial Sequence
  chemically synthesized
acttttacctcttacagaga

SEQ ID NO: 289451 - DNA, 20 bp, Artificial Sequence
  chemically synthesized
ttcttctactgtctctgtaa

SEQ ID NO: 289452 - DNA, 20 bp, Artificial Sequence
  chemically synthesized
tcttctactgtctctgtaag

SEQ ID NO: 289453 - DNA, 20 bp, Artificial Sequence
  chemically synthesized
aataacttttacctcttaca

SEQ ID NO: 289454 - DNA, 20 bp, Artificial Sequence
  chemically synthesized
aaaataacttttacctctta

SEQ ID NO: 289455 - DNA, 20 bp, Artificial Sequence
  chemically synthesized
actgtctctgtaagaggtaa

SEQ ID NO: 289456 - DNA, 20 bp, Artificial Sequence
  chemically synthesized
aagttattttctttcaattc

SEQ ID NO: 289457 - DNA, 20 bp, Artificial Sequence
  chemically synthesized
gatattcttgccagaattga

SEQ ID NO: 289458 - DNA, 20 bp, Artificial Sequence
  chemically synthesized
tattttctttcaattctggc

SEQ ID NO: 289459 - DNA, 20 bp, Artificial Sequence
  chemically synthesized
agcacagaagatattcttgc

SEQ ID NO: 289460 - DNA, 20 bp, Artificial Sequence
  chemically synthesized
tctggggaggtgtagcacag

SEQ ID NO: 289461 - DNA, 20 bp, Artificial Sequence
  chemically synthesized
tgatctggggaggtgtagca

SEQ ID NO: 289462 - DNA, 20 bp, Artificial Sequence
  chemically synthesized
ggtgatgatctggggaggtg

SEQ ID NO: 289463 - DNA, 20 bp, Artificial Sequence
  chemically synthesized
tcttctgtgctacacctccc

SEQ ID NO: 289464 - DNA, 20 bp, Artificial Sequence
  chemically synthesized
gaagaggtgatgatctgggg

SEQ ID NO: 289465 - DNA, 20 bp, Artificial Sequence
  chemically synthesized
tgaagaggtgatgatctggg

SEQ ID NO: 289466 - DNA, 20 bp, Artificial Sequence
  chemically synthesized
cttgaagaggtgatgatctg

SEQ ID NO: 289467 - DNA, 20 bp, Artificial Sequence
  chemically synthesized
ccttgaagaggtgatgatct

SEQ ID NO: 289468 - DNA, 20 bp, Artificial Sequence
  chemically synthesized
cccttgaagaggtgatgatc

SEQ ID NO: 289469 - DNA, 20 bp, Artificial Sequence
  chemically synthesized
ccccagatcatcacctcttc

SEQ ID NO: 289470 - DNA, 20 bp, Artificial Sequence
  chemically synthesized
cccagatcatcacctcttca

SEQ ID NO: 289471 - DNA, 20 bp, Artificial Sequence
  chemically synthesized
ccagatcatcacctcttcaa

SEQ ID NO: 289472 - DNA, 20 bp, Artificial Sequence
  chemically synthesized
aatcatttcaacccttgaag

SEQ ID NO: 289473 - DNA, 20 bp, Artificial Sequence
  chemically synthesized
aaatcatttcaacccttgaa

SEQ ID NO: 289474 - DNA, 20 bp, Artificial Sequence
  chemically synthesized
aaaaatcatttcaacccttg

SEQ ID NO: 289475 - DNA, 20 bp, Artificial Sequence
  chemically synthesized
actacagttgtgataagata

SEQ ID NO: 289476 - DNA, 20 bp, Artificial Sequence
  chemically synthesized
ccttaaactacagttgtgat

SEQ ID NO: 289477 - DNA, 20 bp, Artificial Sequence
  chemically synthesized
tctttatcttatcacaactg

SEQ ID NO: 289478 - DNA, 20 bp, Artificial Sequence
  chemically synthesized
tcttatcacaactgtagttt

SEQ ID NO: 289479 - DNA, 20 bp, Artificial Sequence
  chemically synthesized
cttatcacaactgtagttta

SEQ ID NO: 289480 - DNA, 20 bp, Artificial Sequence
  chemically synthesized
gtccattgaaccttaaacta

SEQ ID NO: 289481 - DNA, 20 bp, Artificial Sequence
  chemically synthesized
aactgtagtttaaggttcaa

SEQ ID NO: 289482 - DNA, 20 bp, Artificial Sequence
  chemically synthesized
aagaatagccacacagagga

SEQ ID NO: 289483 - DNA, 20 bp, Artificial Sequence
  chemically synthesized
tcaatggactctcctctgtg

SEQ ID NO: 289484 - DNA, 20 bp, Artificial Sequence
  chemically synthesized
gaaagaatagccacacagag

SEQ ID NO: 289485 - DNA, 20 bp, Artificial Sequence
  chemically synthesized
tggaaagaatagccacacag

SEQ ID NO: 289486 - DNA, 20 bp, Artificial Sequence
  chemically synthesized
gtggaaagaatagccacaca

SEQ ID NO: 289487 - DNA, 20 bp, Artificial Sequence
  chemically synthesized
ttgtggaaagaatagccaca

SEQ ID NO: 289488 - DNA, 20 bp, Artificial Sequence
  chemically synthesized
aggaagacttgtggaaagaa

SEQ ID NO: 289489 - DNA, 20 bp, Artificial Sequence
  chemically synthesized
tgtgtggctattctttccac

SEQ ID NO: 289490 - DNA, 20 bp, Artificial Sequence
  chemically synthesized
gaagcaggaagacttgtgga

SEQ ID NO: 289491 - DNA, 20 bp, Artificial Sequence
  chemically synthesized
aggagaagcaggaagacttg

SEQ ID NO: 289492 - DNA, 20 bp, Artificial Sequence
  chemically synthesized
caagtctgaggagaagcagg

SEQ ID NO: 289493 - DNA, 20 bp, Artificial Sequence
  chemically synthesized
atacaagtctgaggagaagc

SEQ ID NO: 289494 - DNA, 20 bp, Artificial Sequence
  chemically synthesized
aatacaagtctgaggagaag

SEQ ID NO: 289495 - DNA, 20 bp, Artificial Sequence
  chemically synthesized
caagtcttcctgcttctcct

SEQ ID NO: 289496 - DNA, 20 bp, Artificial Sequence
  chemically synthesized
tgcaatacaagtctgaggag

SEQ ID NO: 289497 - DNA, 20 bp, Artificial Sequence
  chemically synthesized
aaatgcaatacaagtctgag

SEQ ID NO: 289498 - DNA, 20 bp, Artificial Sequence
  chemically synthesized
agaaatgcaatacaagtctg

SEQ ID NO: 289499 - DNA, 20 bp, Artificial Sequence
  chemically synthesized
aagaaatgcaatacaagtct

SEQ ID NO: 289500 - DNA, 20 bp, Artificial Sequence
  chemically synthesized
gtgaagaagaaatgcaatac

SEQ ID NO: 289501 - DNA, 20 bp, Artificial Sequence
  chemically synthesized
cctctagctggtatgtgaag

SEQ ID NO: 289502 - DNA, 20 bp, Artificial Sequence
  chemically synthesized
tgcatttcttcttcacatac

SEQ ID NO: 289503 - DNA, 20 bp, Artificial Sequence
  chemically synthesized
caccctctagctggtatgtg

SEQ ID NO: 289504 - DNA, 20 bp, Artificial Sequence
  chemically synthesized
tttcttcttcacataccagc

SEQ ID NO: 289505 - DNA, 20 bp, Artificial Sequence
  chemically synthesized
tcttcttcacataccagcta

SEQ ID NO: 289506 - DNA, 20 bp, Artificial Sequence
  chemically synthesized
cttcttcacataccagctag

SEQ ID NO: 289507 - DNA, 20 bp, Artificial Sequence
  chemically synthesized
ttcttcacataccagctaga

SEQ ID NO: 289508 - DNA, 20 bp, Artificial Sequence
  chemically synthesized
ttcaaaactcaccctctagc

SEQ ID NO: 289509 - DNA, 20 bp, Artificial Sequence
  chemically synthesized
tcacataccagctagagggt

SEQ ID NO: 289510 - DNA, 20 bp, Artificial Sequence
  chemically synthesized
ttttttcaaaactcaccctc

SEQ ID NO: 289511 - DNA, 20 bp, Artificial Sequence
  chemically synthesized
agttttgaaaaaatacaact

SEQ ID NO: 289512 - DNA, 20 bp, Artificial Sequence
  chemically synthesized
gttttgaaaaaatacaacta

SEQ ID NO: 289513 - DNA, 20 bp, Artificial Sequence
  chemically synthesized
ttttgaaaaaatacaactaa

SEQ ID NO: 289514 - DNA, 20 bp, Artificial Sequence
  chemically synthesized
ttgaggaaattaagtaccct

SEQ ID NO: 289515 - DNA, 20 bp, Artificial Sequence
  chemically synthesized
gaatttcaattgaggaaatt

SEQ ID NO: 289516 - DNA, 20 bp, Artificial Sequence
  chemically synthesized
ttccgaaagaatttcaattg

SEQ ID NO: 289517 - DNA, 20 bp, Artificial Sequence
  chemically synthesized
tttccgaaagaatttcaatt

SEQ ID NO: 289518 - DNA, 20 bp, Artificial Sequence
  chemically synthesized
ttcctcaattgaaattcttt

SEQ ID NO: 289519 - DNA, 20 bp, Artificial Sequence
  chemically synthesized
agagcagtagacatttccga

SEQ ID NO: 289520 - DNA, 20 bp, Artificial Sequence
  chemically synthesized
ggtttggattttaagagcag

SEQ ID NO: 289521 - DNA, 20 bp, Artificial Sequence
  chemically synthesized
acaggtttggattttaagag

SEQ ID NO: 289522 - DNA, 20 bp, Artificial Sequence
  chemically synthesized
ataacaggtttggattttaa

SEQ ID NO: 289523 - DNA, 20 bp, Artificial Sequence
  chemically synthesized
ctataacaggtttggatttt

SEQ ID NO: 289524 - DNA, 20 bp, Artificial Sequence
  chemically synthesized
tagaacttctataacaggtt

SEQ ID NO: 289525 - DNA, 20 bp, Artificial Sequence
  chemically synthesized
cttaaaatccaaacctgtta

SEQ ID NO: 289526 - DNA, 20 bp, Artificial Sequence
  chemically synthesized
aaaatccaaacctgttatag

SEQ ID NO: 289527 - DNA, 20 bp, Artificial Sequence
  chemically synthesized
tcttatagaacttctataac

SEQ ID NO: 289528 - DNA, 20 bp, Artificial Sequence
  chemically synthesized
ctcttatagaacttctataa

SEQ ID NO: 289529 - DNA, 20 bp, Artificial Sequence
  chemically synthesized
acctgttatagaagttctat

SEQ ID NO: 289530 - DNA, 20 bp, Artificial Sequence
  chemically synthesized
ctgttatagaagttctataa

SEQ ID NO: 289531 - DNA, 20 bp, Artificial Sequence
  chemically synthesized
tgagggtagaattgctctta

SEQ ID NO: 289532 - DNA, 20 bp, Artificial Sequence
  chemically synthesized
agattaggacaagatgaggg

SEQ ID NO: 289533 - DNA, 20 bp, Artificial Sequence
  chemically synthesized
gaaagattaggacaagatga

SEQ ID NO: 289534 - DNA, 20 bp, Artificial Sequence
  chemically synthesized
tgaaagattaggacaagatg

SEQ ID NO: 289535 - DNA, 20 bp, Artificial Sequence
  chemically synthesized
atgaaagattaggacaagat

SEQ ID NO: 289536 - DNA, 20 bp, Artificial Sequence
  chemically synthesized
aatcaatgaaagattaggac

SEQ ID NO: 289537 - DNA, 20 bp, Artificial Sequence
  chemically synthesized
taacaaatcaatgaaagatt

SEQ ID NO: 289538 - DNA, 20 bp, Artificial Sequence
  chemically synthesized
gtaacaaatcaatgaaagat

SEQ ID NO: 289539 - DNA, 20 bp, Artificial Sequence
  chemically synthesized
ggaatgtaacaaatcaatga

SEQ ID NO: 289540 - DNA, 20 bp, Artificial Sequence
  chemically synthesized
ttcattgatttgttacattc

SEQ ID NO: 289541 - DNA, 20 bp, Artificial Sequence
  chemically synthesized
ttgttacattccagcctttc

SEQ ID NO: 289542 - DNA, 20 bp, Artificial Sequence
  chemically synthesized
ataagggaggccagaaaggc

SEQ ID NO: 289543 - DNA, 20 bp, Artificial Sequence
  chemically synthesized
agacataagggaggccagaa

SEQ ID NO: 289544 - DNA, 20 bp, Artificial Sequence
  chemically synthesized
aagacataagggaggccaga

SEQ ID NO: 289545 - DNA, 20 bp, Artificial Sequence
  chemically synthesized
ccagaagacataagggaggc

SEQ ID NO: 289546 - DNA, 20 bp, Artificial Sequence
  chemically synthesized
atgtccagaagacataaggg

SEQ ID NO: 289547 - DNA, 20 bp, Artificial Sequence
  chemically synthesized
catgtccagaagacataagg

SEQ ID NO: 289548 - DNA, 20 bp, Artificial Sequence
  chemically synthesized
ggcatgtccagaagacataa

SEQ ID NO: 289549 - DNA, 20 bp, Artificial Sequence
  chemically synthesized
tggcatgtccagaagacata

SEQ ID NO: 289550 - DNA, 20 bp, Artificial Sequence
  chemically synthesized
ttggcatgtccagaagacat

SEQ ID NO: 289551 - DNA, 20 bp, Artificial Sequence
  chemically synthesized
ctggcctcccttatgtcttc

SEQ ID NO: 289552 - DNA, 20 bp, Artificial Sequence
  chemically synthesized
tgagggcttggcatgtccag

SEQ ID NO: 289553 - DNA, 20 bp, Artificial Sequence
  chemically synthesized
gaatgagggcttggcatgtc

SEQ ID NO: 289554 - DNA, 20 bp, Artificial Sequence
  chemically synthesized
ttatgtcttctggacatgcc

SEQ ID NO: 289555 - DNA, 20 bp, Artificial Sequence
  chemically synthesized
aaaggtgaagaatgagggct

SEQ ID NO: 289556 - DNA, 20 bp, Artificial Sequence
  chemically synthesized
ttgccaaaggtgaagaatga

SEQ ID NO: 289557 - DNA, 20 bp, Artificial Sequence
  chemically synthesized
attgccaaaggtgaagaatg

SEQ ID NO: 289558 - DNA, 20 bp, Artificial Sequence
  chemically synthesized
aattgccaaaggtgaagaat

SEQ ID NO: 289559 - DNA, 20 bp, Artificial Sequence
  chemically synthesized
aagccctcattcttcacctt

SEQ ID NO: 289560 - DNA, 20 bp, Artificial Sequence
  chemically synthesized
aacacaaattgccaaaggtg

SEQ ID NO: 289561 - DNA, 20 bp, Artificial Sequence
  chemically synthesized
aaagaaacacaaattgccaa

SEQ ID NO: 289562 - DNA, 20 bp, Artificial Sequence
  chemically synthesized
aaaagaaacacaaattgcca

SEQ ID NO: 289563 - DNA, 20 bp, Artificial Sequence
  chemically synthesized
aggacattaggagaaatgaa

SEQ ID NO: 289564 - DNA, 20 bp, Artificial Sequence
  chemically synthesized
agttggagaaaggacattag

SEQ ID NO: 289565 - DNA, 20 bp, Artificial Sequence
  chemically synthesized
taagttggagaaaggacatt

SEQ ID NO: 289566 - DNA, 20 bp, Artificial Sequence
  chemically synthesized
ataagttggagaaaggacat

SEQ ID NO: 289567 - DNA, 20 bp, Artificial Sequence
  chemically synthesized
ctatatgataagttggagaa

SEQ ID NO: 289568 - DNA, 20 bp, Artificial Sequence
  chemically synthesized
gctatatgataagttggaga

SEQ ID NO: 289569 - DNA, 20 bp, Artificial Sequence
  chemically synthesized
gccagctatatgataagttg

SEQ ID NO: 289570 - DNA, 20 bp, Artificial Sequence
  chemically synthesized
gtgccagctatatgataagt

SEQ ID NO: 289571 - DNA, 20 bp, Artificial Sequence
  chemically synthesized
cctttctccaacttatcata

SEQ ID NO: 289572 - DNA, 20 bp, Artificial Sequence
  chemically synthesized
gcaggtgccagctatatgat

SEQ ID NO: 289573 - DNA, 20 bp, Artificial Sequence
  chemically synthesized
tctccaacttatcatatagc

SEQ ID NO: 289574 - DNA, 20 bp, Artificial Sequence
  chemically synthesized
cctggagaatgtgcaggtgc

SEQ ID NO: 289575 - DNA, 20 bp, Artificial Sequence
  chemically synthesized
accaaacctggagaatgtgc

SEQ ID NO: 289576 - DNA, 20 bp, Artificial Sequence
  chemically synthesized
aaccaaacctggagaatgtg

SEQ ID NO: 289577 - DNA, 20 bp, Artificial Sequence
  chemically synthesized
gctggcacctgcacattctc

SEQ ID NO: 289578 - DNA, 20 bp, Artificial Sequence
  chemically synthesized
ctggcacctgcacattctcc

SEQ ID NO: 289579 - DNA, 20 bp, Artificial Sequence
  chemically synthesized
acctgcacattctccaggtt

SEQ ID NO: 289580 - DNA, 20 bp, Artificial Sequence
  chemically synthesized
tgatgttagaaccaaacctg

SEQ ID NO: 289581 - DNA, 20 bp, Artificial Sequence
  chemically synthesized
gatgatgttagaaccaaacc

SEQ ID NO: 289582 - DNA, 20 bp, Artificial Sequence
  chemically synthesized
tgattctggggagatgatgt

SEQ ID NO: 289583 - DNA, 20 bp, Artificial Sequence
  chemically synthesized
tggttctaacatcatctccc

SEQ ID NO: 289584 - DNA, 20 bp, Artificial Sequence
  chemically synthesized
tctgaaaccgtgattctggg

SEQ ID NO: 289585 - DNA, 20 bp, Artificial Sequence
  chemically synthesized
cgtctgaaaccgtgattctg

SEQ ID NO: 289586 - DNA, 20 bp, Artificial Sequence
  chemically synthesized
acatcatctccccagaatca

SEQ ID NO: 289587 - DNA, 20 bp, Artificial Sequence
  chemically synthesized
gcgtctgaaaccgtgattct

SEQ ID NO: 289588 - DNA, 20 bp, Artificial Sequence
  chemically synthesized
ggcgtctgaaaccgtgattc

SEQ ID NO: 289589 - DNA, 20 bp, Artificial Sequence
  chemically synthesized
tctccccagaatcacggttt

SEQ ID NO: 289590 - DNA, 20 bp, Artificial Sequence
  chemically synthesized
aatcacggtttcagacgcca

SEQ ID NO: 289591 - DNA, 20 bp, Artificial Sequence
  chemically synthesized
attgcagattataattactt

SEQ ID NO: 289592 - DNA, 20 bp, Artificial Sequence
  chemically synthesized
tgaatatctgaatattattg

SEQ ID NO: 289593 - DNA, 20 bp, Artificial Sequence
  chemically synthesized
ttataatctgcaataatatt

SEQ ID NO: 289594 - DNA, 20 bp, Artificial Sequence
  chemically synthesized
tcatggagcttattgaaaga

SEQ ID NO: 289595 - DNA, 20 bp, Artificial Sequence
  chemically synthesized
tttattatctttctttcaat

SEQ ID NO: 289596 - DNA, 20 bp, Artificial Sequence
  chemically synthesized
gtcttcatggagcttattga

SEQ ID NO: 289597 - DNA, 20 bp, Artificial Sequence
  chemically synthesized
ttctttcaataagctccatg

SEQ ID NO: 289598 - DNA, 20 bp, Artificial Sequence
  chemically synthesized
aagagcaatatgtcttcatg

SEQ ID NO: 289599 - DNA, 20 bp, Artificial Sequence
  chemically synthesized
tcaagagcaatatgtcttca

SEQ ID NO: 289600 - DNA, 20 bp, Artificial Sequence
  chemically synthesized
tacatggtggagaaaatcaa

SEQ ID NO: 289601 - DNA, 20 bp, Artificial Sequence
  chemically synthesized
tatacatggtggagaaaatc

SEQ ID NO: 289602 - DNA, 20 bp, Artificial Sequence
  chemically synthesized
actaggtaatatacatggtg

SEQ ID NO: 289603 - DNA, 20 bp, Artificial Sequence
  chemically synthesized
gcactaggtaatatacatgg

SEQ ID NO: 289604 - DNA, 20 bp, Artificial Sequence
  chemically synthesized
tgggcactaggtaatataca

SEQ ID NO: 289605 - DNA, 20 bp, Artificial Sequence
  chemically synthesized
tctccaccatgtatattacc

SEQ ID NO: 289606 - DNA, 20 bp, Artificial Sequence
  chemically synthesized
catgtatattacctagtgcc

SEQ ID NO: 289607 - DNA, 20 bp, Artificial Sequence
  chemically synthesized
ccgtaaaagtgctgggcact

SEQ ID NO: 289608 - DNA, 20 bp, Artificial Sequence
  chemically synthesized
gccgtaaaagtgctgggcac

SEQ ID NO: 289609 - DNA, 20 bp, Artificial Sequence
  chemically synthesized
gtatatgccgtaaaagtgct

SEQ ID NO: 289610 - DNA, 20 bp, Artificial Sequence
  chemically synthesized
ggtatatgccgtaaaagtgc

SEQ ID NO: 289611 - DNA, 20 bp, Artificial Sequence
  chemically synthesized
cctagtgcccagcactttta

SEQ ID NO: 289612 - DNA, 20 bp, Artificial Sequence
  chemically synthesized
acacctggtatatgccgtaa

SEQ ID NO: 289613 - DNA, 20 bp, Artificial Sequence
  chemically synthesized
agcacttttacggcatatac

SEQ ID NO: 289614 - DNA, 20 bp, Artificial Sequence
  chemically synthesized
gcacttttacggcatatacc

SEQ ID NO: 289615 - DNA, 20 bp, Artificial Sequence
  chemically synthesized
aagaaatatttttgaacacc

SEQ ID NO: 289616 - DNA, 20 bp, Artificial Sequence
  chemically synthesized
actttttcactaataaattc

SEQ ID NO: 289617 - DNA, 20 bp, Artificial Sequence
  chemically synthesized
aaaatatttcttgaatttat

SEQ ID NO: 289618 - DNA, 20 bp, Artificial Sequence
  chemically synthesized
tcttgaatttattagtgaaa

SEQ ID NO: 289619 - DNA, 20 bp, Artificial Sequence
  chemically synthesized
gaatttattagtgaaaaagt

SEQ ID NO: 289620 - DNA, 20 bp, Artificial Sequence
  chemically synthesized
ttattagtgaaaaagtgagc

SEQ ID NO: 289621 - DNA, 20 bp, Artificial Sequence
  chemically synthesized
attagattgctttcagaaca

SEQ ID NO: 289622 - DNA, 20 bp, Artificial Sequence
  chemically synthesized
tgagcaagactctgttctga

SEQ ID NO: 289623 - DNA, 20 bp, Artificial Sequence
  chemically synthesized
ccattagattgctttcagaa

SEQ ID NO: 289624 - DNA, 20 bp, Artificial Sequence
  chemically synthesized
ctacaccattagattgcttt

SEQ ID NO: 289625 - DNA, 20 bp, Artificial Sequence
  chemically synthesized
ctgttctgaaagcaatctaa

SEQ ID NO: 289626 - DNA, 20 bp, Artificial Sequence
  chemically synthesized
ctgaaagcaatctaatggtg

SEQ ID NO: 289627 - DNA, 20 bp, Artificial Sequence
  chemically synthesized
tctcttctgttctacaccat

SEQ ID NO: 289628 - DNA, 20 bp, Artificial Sequence
  chemically synthesized
agcaatctaatggtgtagaa

SEQ ID NO: 289629 - DNA, 20 bp, Artificial Sequence
  chemically synthesized
aatctaatggtgtagaacag

SEQ ID NO: 289630 - DNA, 20 bp, Artificial Sequence
  chemically synthesized
tctaatggtgtagaacagaa

SEQ ID NO: 289631 - DNA, 20 bp, Artificial Sequence
  chemically synthesized
agagaatcattttgaaactt

SEQ ID NO: 289632 - DNA, 20 bp, Artificial Sequence
  chemically synthesized
atcattttgaaactttagaa

SEQ ID NO: 289633 - DNA, 20 bp, Artificial Sequence
  chemically synthesized
ccagtgttttgactgttcta

SEQ ID NO: 289634 - DNA, 20 bp, Artificial Sequence
  chemically synthesized
ctttagaacagtcaaaacac

SEQ ID NO: 289635 - DNA, 20 bp, Artificial Sequence
  chemically synthesized
attattagttatgacaaagc

SEQ ID NO: 289636 - DNA, 20 bp, Artificial Sequence
  chemically synthesized
tgacattattagttatgaca

SEQ ID NO: 289637 - DNA, 20 bp, Artificial Sequence
  chemically synthesized
aatggagaaagtgacattat

SEQ ID NO: 289638 - DNA, 20 bp, Artificial Sequence
  chemically synthesized
tagttttgcaaaaatggaga

SEQ ID NO: 289639 - DNA, 20 bp, Artificial Sequence
  chemically synthesized
ggtttagttttgcaaaaatg

SEQ ID NO: 289640 - DNA, 20 bp, Artificial Sequence
  chemically synthesized
ttggtttagttttgcaaaaa

SEQ ID NO: 289641 - DNA, 20 bp, Artificial Sequence
  chemically synthesized
gggattttattggtttggtt

SEQ ID NO: 289642 - DNA, 20 bp, Artificial Sequence
  chemically synthesized
tattagggattttattggtt

SEQ ID NO: 289643 - DNA, 20 bp, Artificial Sequence
  chemically synthesized
ataattattagggattttat

SEQ ID NO: 289644 - DNA, 20 bp, Artificial Sequence
  chemically synthesized
tcatgttaaaataattatta

SEQ ID NO: 289645 - DNA, 20 bp, Artificial Sequence
  chemically synthesized
atcatgttaaaataattatt

SEQ ID NO: 289646 - DNA, 20 bp, Artificial Sequence
  chemically synthesized
aatcatgttaaaataattat

SEQ ID NO: 289647 - DNA, 20 bp, Artificial Sequence
  chemically synthesized
agtttatttcattaacaatt

SEQ ID NO: 289648 - DNA, 20 bp, Artificial Sequence
  chemically synthesized
aaagattggtcatataattt

SEQ ID NO: 289649 - DNA, 20 bp, Artificial Sequence
  chemically synthesized
atgtaaagaaggaaaaagat

SEQ ID NO: 289650 - DNA, 20 bp, Artificial Sequence
  chemically synthesized
tcttaatgtaaagaaggaaa

SEQ ID NO: 289651 - DNA, 20 bp, Artificial Sequence
  chemically synthesized
cttatttcttaatgtaaaga

SEQ ID NO: 289652 - DNA, 20 bp, Artificial Sequence
  chemically synthesized
ccttatttcttaatgtaaag

SEQ ID NO: 289653 - DNA, 20 bp, Artificial Sequence
  chemically synthesized
tctttttccttctttacatt

SEQ ID NO: 289654 - DNA, 20 bp, Artificial Sequence
  chemically synthesized
aaaccttatttcttaatgta

SEQ ID NO: 289655 - DNA, 20 bp, Artificial Sequence
  chemically synthesized
ccttctttacattaagaaat

SEQ ID NO: 289656 - DNA, 20 bp, Artificial Sequence
  chemically synthesized
cttctttacattaagaaata

SEQ ID NO: 289657 - DNA, 20 bp, Artificial Sequence
  chemically synthesized
tgtagataattgtttcaaca

SEQ ID NO: 289658 - DNA, 20 bp, Artificial Sequence
  chemically synthesized
gttgaaacaattatctacaa

SEQ ID NO: 289659 - DNA, 20 bp, Artificial Sequence
  chemically synthesized
acacagcatctagtctgttg

SEQ ID NO: 289660 - DNA, 20 bp, Artificial Sequence
  chemically synthesized
aacaattatctacaacagac

SEQ ID NO: 289661 - DNA, 20 bp, Artificial Sequence
  chemically synthesized
gaatatagaaacacagcatc

SEQ ID NO: 289662 - DNA, 20 bp, Artificial Sequence
  chemically synthesized
gctagatgaatatagaaaca

SEQ ID NO: 289663 - DNA, 20 bp, Artificial Sequence
  chemically synthesized
tgttatatgctagatgaata

SEQ ID NO: 289664 - DNA, 20 bp, Artificial Sequence
  chemically synthesized
gctgtgtttctatattcatc

SEQ ID NO: 289665 - DNA, 20 bp, Artificial Sequence
  chemically synthesized
agtaaactcatgttatatgc

SEQ ID NO: 289666 - DNA, 20 bp, Artificial Sequence
  chemically synthesized
attcatctagcatataacat

SEQ ID NO: 289667 - DNA, 20 bp, Artificial Sequence
  chemically synthesized
agcatataacatgagtttac

SEQ ID NO: 289668 - DNA, 20 bp, Artificial Sequence
  chemically synthesized
aacatgagtttactggtttt

SEQ ID NO: 289669 - DNA, 20 bp, Artificial Sequence
  chemically synthesized
cttttctagagactgaaaac

SEQ ID NO: 289670 - DNA, 20 bp, Artificial Sequence
  chemically synthesized
gtttactggttttcagtctc

SEQ ID NO: 289671 - DNA, 20 bp, Artificial Sequence
  chemically synthesized
ctggttttcagtctctagaa

SEQ ID NO: 289672 - DNA, 20 bp, Artificial Sequence
  chemically synthesized
gttgataaaatacttttcta

SEQ ID NO: 289673 - DNA, 20 bp, Artificial Sequence
  chemically synthesized
cagttgataaaatacttttc

SEQ ID NO: 289674 - DNA, 20 bp, Artificial Sequence
  chemically synthesized
aagtattttatcaactgtca

SEQ ID NO: 289675 - DNA, 20 bp, Artificial Sequence
  chemically synthesized
agtattttatcaactgtcat

SEQ ID NO: 289676 - DNA, 20 bp, Artificial Sequence
  chemically synthesized
ggtggaattgtttcccatga

SEQ ID NO: 289677 - DNA, 20 bp, Artificial Sequence
  chemically synthesized
ggtctgggaggatgaggggg

SEQ ID NO: 289678 - DNA, 20 bp, Artificial Sequence
  chemically synthesized
ctaggtctgggaggatgagg

SEQ ID NO: 289679 - DNA, 20 bp, Artificial Sequence
  chemically synthesized
cctaggtctgggaggatgag

SEQ ID NO: 289680 - DNA, 20 bp, Artificial Sequence
  chemically synthesized
gcctaggtctgggaggatga

SEQ ID NO: 289681 - DNA, 20 bp, Artificial Sequence
  chemically synthesized
tgcctaggtctgggaggatg

SEQ ID NO: 289682 - DNA, 20 bp, Artificial Sequence
  chemically synthesized
attccaccccctcatcctcc

SEQ ID NO: 289683 - DNA, 20 bp, Artificial Sequence
  chemically synthesized
ttgcctaggtctgggaggat

SEQ ID NO: 289684 - DNA, 20 bp, Artificial Sequence
  chemically synthesized
agtggttgcctaggtctggg

SEQ ID NO: 289685 - DNA, 20 bp, Artificial Sequence
  chemically synthesized
ccccctcatcctcccagacc

SEQ ID NO: 289686 - DNA, 20 bp, Artificial Sequence
  chemically synthesized
tagtggttgcctaggtctgg

SEQ ID NO: 289687 - DNA, 20 bp, Artificial Sequence
  chemically synthesized
cccctcatcctcccagacct

SEQ ID NO: 289688 - DNA, 20 bp, Artificial Sequence
  chemically synthesized
attagtggttgcctaggtct

SEQ ID NO: 289689 - DNA, 20 bp, Artificial Sequence
  chemically synthesized
gattagtggttgcctaggtc

SEQ ID NO: 289690 - DNA, 20 bp, Artificial Sequence
  chemically synthesized
aataagattagtggttgcct

SEQ ID NO: 289691 - DNA, 20 bp, Artificial Sequence
  chemically synthesized
aaataagattagtggttgcc

SEQ ID NO: 289692 - DNA, 20 bp, Artificial Sequence
  chemically synthesized
acaggcagaaataagattag

SEQ ID NO: 289693 - DNA, 20 bp, Artificial Sequence
  chemically synthesized
tgtacaggcagaaataagat

SEQ ID NO: 289694 - DNA, 20 bp, Artificial Sequence
  chemically synthesized
aaatctgtacaggcagaaat

SEQ ID NO: 289695 - DNA, 20 bp, Artificial Sequence
  chemically synthesized
taatcttatttctgcctgta

SEQ ID NO: 289696 - DNA, 20 bp, Artificial Sequence
  chemically synthesized
aataggcaaatctgtacagg

SEQ ID NO: 289697 - DNA, 20 bp, Artificial Sequence
  chemically synthesized
cacaataggcaaatctgtac

SEQ ID NO: 289698 - DNA, 20 bp, Artificial Sequence
  chemically synthesized
ccacaataggcaaatctgta

SEQ ID NO: 289699 - DNA, 20 bp, Artificial Sequence
  chemically synthesized
ctgtacagatttgcctattg

SEQ ID NO: 289700 - DNA, 20 bp, Artificial Sequence
  chemically synthesized
tgatataaaatggccacaat

SEQ ID NO: 289701 - DNA, 20 bp, Artificial Sequence
  chemically synthesized
ttgatataaaatggccacaa

SEQ ID NO: 289702 - DNA, 20 bp, Artificial Sequence
  chemically synthesized
atgagtctcttgatataaaa

SEQ ID NO: 289703 - DNA, 20 bp, Artificial Sequence
  chemically synthesized
tattgtggccattttatatc

SEQ ID NO: 289704 - DNA, 20 bp, Artificial Sequence
  chemically synthesized
ttgtggccattttatatcaa

SEQ ID NO: 289705 - DNA, 20 bp, Artificial Sequence
  chemically synthesized
caaaagatcatatgttatat

SEQ ID NO: 289706 - DNA, 20 bp, Artificial Sequence
  chemically synthesized
aacatatgatcttttgtgac

SEQ ID NO: 289707 - DNA, 20 bp, Artificial Sequence
  chemically synthesized
gtgaaagaagccagtcacaa

SEQ ID NO: 289708 - DNA, 20 bp, Artificial Sequence
  chemically synthesized
ttatgctgagtgaaagaagc

SEQ ID NO: 289709 - DNA, 20 bp, Artificial Sequence
  chemically synthesized
gacattatgctgagtgaaag

SEQ ID NO: 289710 - DNA, 20 bp, Artificial Sequence
  chemically synthesized
tgtgactggcttctttcact

SEQ ID NO: 289711 - DNA, 20 bp, Artificial Sequence
  chemically synthesized
gaagacattatgctgagtga

SEQ ID NO: 289712 - DNA, 20 bp, Artificial Sequence
  chemically synthesized
acccttgaagacattatgct

SEQ ID NO: 289713 - DNA, 20 bp, Artificial Sequence
  chemically synthesized
tcactcagcataatgtcttc

SEQ ID NO: 289714 - DNA, 20 bp, Artificial Sequence
  chemically synthesized
cactcagcataatgtcttca

SEQ ID NO: 289715 - DNA, 20 bp, Artificial Sequence
  chemically synthesized
actcagcataatgtcttcaa

SEQ ID NO: 289716 - DNA, 20 bp, Artificial Sequence
  chemically synthesized
tacagcatggagtacccttg

SEQ ID NO: 289717 - DNA, 20 bp, Artificial Sequence
  chemically synthesized
ttcaagggtactccatgctg

SEQ ID NO: 289718 - DNA, 20 bp, Artificial Sequence
  chemically synthesized
ctgatacatgctacagcatg

SEQ ID NO: 289719 - DNA, 20 bp, Artificial Sequence
  chemically synthesized
tactgatacatgctacagca

SEQ ID NO: 289720 - DNA, 20 bp, Artificial Sequence
  chemically synthesized
gaaagtactgatacatgcta

SEQ ID NO: 289721 - DNA, 20 bp, Artificial Sequence
  chemically synthesized
ctccatgctgtagcatgtat

SEQ ID NO: 289722 - DNA, 20 bp, Artificial Sequence
  chemically synthesized
ctgagcaataaaaagggaga

SEQ ID NO: 289723 - DNA, 20 bp, Artificial Sequence
  chemically synthesized
gttactgagcaataaaaagg

SEQ ID NO: 289724 - DNA, 20 bp, Artificial Sequence
  chemically synthesized
gtgttactgagcaataaaaa

SEQ ID NO: 289725 - DNA, 20 bp, Artificial Sequence
  chemically synthesized
agtgttactgagcaataaaa

SEQ ID NO: 289726 - DNA, 20 bp, Artificial Sequence
  chemically synthesized
cagtgttactgagcaataaa

SEQ ID NO: 289727 - DNA, 20 bp, Artificial Sequence
  chemically synthesized
ctttctccctttttattgct

SEQ ID NO: 289728 - DNA, 20 bp, Artificial Sequence
  chemically synthesized
ccatacaaggcagtgttact

SEQ ID NO: 289729 - DNA, 20 bp, Artificial Sequence
  chemically synthesized
ctcagtaacactgccttgta

SEQ ID NO: 289730 - DNA, 20 bp, Artificial Sequence
  chemically synthesized
atgggcacatccatacaagg

SEQ ID NO: 289731 - DNA, 20 bp, Artificial Sequence
  chemically synthesized
aaaatgggcacatccataca

SEQ ID NO: 289732 - DNA, 20 bp, Artificial Sequence
  chemically synthesized
gaaaatgggcacatccatac

SEQ ID NO: 289733 - DNA, 20 bp, Artificial Sequence
  chemically synthesized
gatgactatatgaagaaaat

SEQ ID NO: 289734 - DNA, 20 bp, Artificial Sequence
  chemically synthesized
tgatgactatatgaagaaaa

SEQ ID NO: 289735 - DNA, 20 bp, Artificial Sequence
  chemically synthesized
atgtgcccattttcttcata

SEQ ID NO: 289736 - DNA, 20 bp, Artificial Sequence
  chemically synthesized
catccagtgatgactatatg

SEQ ID NO: 289737 - DNA, 20 bp, Artificial Sequence
  chemically synthesized
tttcttcatatagtcatcac

SEQ ID NO: 289738 - DNA, 20 bp, Artificial Sequence
  chemically synthesized
ttcatatagtcatcactgga

SEQ ID NO: 289739 - DNA, 20 bp, Artificial Sequence
  chemically synthesized
aagaaacccacatgtccatc

SEQ ID NO: 289740 - DNA, 20 bp, Artificial Sequence
  chemically synthesized
gtcatcactggatggacatg

SEQ ID NO: 289741 - DNA, 20 bp, Artificial Sequence
  chemically synthesized
tcatcactggatggacatgt

SEQ ID NO: 289742 - DNA, 20 bp, Artificial Sequence
  chemically synthesized
tcataatagccaaaacgtag

SEQ ID NO: 289743 - DNA, 20 bp, Artificial Sequence
  chemically synthesized
tgtgggtttcttctacgttt

SEQ ID NO: 289744 - DNA, 20 bp, Artificial Sequence
  chemically synthesized
tattcataatagccaaaacg

SEQ ID NO: 289745 - DNA, 20 bp, Artificial Sequence
  chemically synthesized
cataacaacattattcataa

SEQ ID NO: 289746 - DNA, 20 bp, Artificial Sequence
  chemically synthesized
tattatgaataatgttgtta

SEQ ID NO: 289747 - DNA, 20 bp, Artificial Sequence
  chemically synthesized
ggacattcgtgtatacgatc

SEQ ID NO: 289748 - DNA, 20 bp, Artificial Sequence
  chemically synthesized
tgtatacgatctagttctta

SEQ ID NO: 289749 - DNA, 20 bp, Artificial Sequence
  chemically synthesized
atatgggatgctgtaagaac

SEQ ID NO: 289750 - DNA, 20 bp, Artificial Sequence
  chemically synthesized
gcatggatatgggatgctgt

SEQ ID NO: 289751 - DNA, 20 bp, Artificial Sequence
  chemically synthesized
ataactaaaagcatggatat

SEQ ID NO: 289752 - DNA, 20 bp, Artificial Sequence
  chemically synthesized
aataactaaaagcatggata

SEQ ID NO: 289753 - DNA, 20 bp, Artificial Sequence
  chemically synthesized
gcatcccatatccatgcttt

SEQ ID NO: 289754 - DNA, 20 bp, Artificial Sequence
  chemically synthesized
ggtttgaataactaaaagca

SEQ ID NO: 289755 - DNA, 20 bp, Artificial Sequence
  chemically synthesized
aatggggtttgaataactaa

SEQ ID NO: 289756 - DNA, 20 bp, Artificial Sequence
  chemically synthesized
tttagttattcaaaccccat

SEQ ID NO: 289757 - DNA, 20 bp, Artificial Sequence
  chemically synthesized
atatcacaagtaagctaatg

SEQ ID NO: 289758 - DNA, 20 bp, Artificial Sequence
  chemically synthesized
tatatcacaagtaagctaat

SEQ ID NO: 289759 - DNA, 20 bp, Artificial Sequence
  chemically synthesized
ctatatcacaagtaagctaa

SEQ ID NO: 289760 - DNA, 20 bp, Artificial Sequence
  chemically synthesized
attacaactatatcacaagt

SEQ ID NO: 289761 - DNA, 20 bp, Artificial Sequence
  chemically synthesized
ccattagcttacttgtgata

SEQ ID NO: 289762 - DNA, 20 bp, Artificial Sequence
  chemically synthesized
tgttattacaactatatcac

SEQ ID NO: 289763 - DNA, 20 bp, Artificial Sequence
  chemically synthesized
ccctcagagagaaacacatt

SEQ ID NO: 289764 - DNA, 20 bp, Artificial Sequence
  chemically synthesized
tactcaatgtgtttctctct

SEQ ID NO: 289765 - DNA, 20 bp, Artificial Sequence
  chemically synthesized
actcaatgtgtttctctctg

SEQ ID NO: 289766 - DNA, 20 bp, Artificial Sequence
  chemically synthesized
ctcaatgtgtttctctctga

SEQ ID NO: 289767 - DNA, 20 bp, Artificial Sequence
  chemically synthesized
cattttacctaaccctcaga

SEQ ID NO: 289768 - DNA, 20 bp, Artificial Sequence
  chemically synthesized
atgtgtttctctctgagggt

SEQ ID NO: 289769 - DNA, 20 bp, Artificial Sequence
  chemically synthesized
atcattttacctaaccctca

SEQ ID NO: 289770 - DNA, 20 bp, Artificial Sequence
  chemically synthesized
tgtgtttctctctgagggtt

SEQ ID NO: 289771 - DNA, 20 bp, Artificial Sequence
  chemically synthesized
acatcattttacctaaccct

SEQ ID NO: 289772 - DNA, 20 bp, Artificial Sequence
  chemically synthesized
aggtaaaatgatgtataaat

SEQ ID NO: 289773 - DNA, 20 bp, Artificial Sequence
  chemically synthesized
atgtataaattagttatgca

SEQ ID NO: 289774 - DNA, 20 bp, Artificial Sequence
  chemically synthesized
gtataaattagttatgcata

SEQ ID NO: 289775 - DNA, 20 bp, Artificial Sequence
  chemically synthesized
ttagttatgcatagagtaaa

SEQ ID NO: 289776 - DNA, 20 bp, Artificial Sequence
  chemically synthesized
agtaaaaagtgctttgaaaa

SEQ ID NO: 289777 - DNA, 20 bp, Artificial Sequence
  chemically synthesized
aagataaaattctattttca

SEQ ID NO: 289778 - DNA, 20 bp, Artificial Sequence
  chemically synthesized
atagaagaaaataatataaa

SEQ ID NO: 289779 - DNA, 20 bp, Artificial Sequence
  chemically synthesized
ttacctgacataagtgatag

SEQ ID NO: 289780 - DNA, 20 bp, Artificial Sequence
  chemically synthesized
ttgttacctgacataagtga

SEQ ID NO: 289781 - DNA, 20 bp, Artificial Sequence
  chemically synthesized
ttttcttctatcacttatgt

SEQ ID NO: 289782 - DNA, 20 bp, Artificial Sequence
  chemically synthesized
tttcttctatcacttatgtc

SEQ ID NO: 289783 - DNA, 20 bp, Artificial Sequence
  chemically synthesized
tggtagttgttacctgacat

SEQ ID NO: 289784 - DNA, 20 bp, Artificial Sequence
  chemically synthesized
aaaatggcataaggaattgg

SEQ ID NO: 289785 - DNA, 20 bp, Artificial Sequence
  chemically synthesized
tggaaaatggcataaggaat

SEQ ID NO: 289786 - DNA, 20 bp, Artificial Sequence
  chemically synthesized
cagtgttggaaaatggcata

SEQ ID NO: 289787 - DNA, 20 bp, Artificial Sequence
  chemically synthesized
tcagtgttggaaaatggcat

SEQ ID NO: 289788 - DNA, 20 bp, Artificial Sequence
  chemically synthesized
atactatcagtgttggaaaa

SEQ ID NO: 289789 - DNA, 20 bp, Artificial Sequence
  chemically synthesized
atgccattttccaacactga

SEQ ID NO: 289790 - DNA, 20 bp, Artificial Sequence
  chemically synthesized
ttaaaatatactatcagtgt

SEQ ID NO: 289791 - DNA, 20 bp, Artificial Sequence
  chemically synthesized
tggcttttaaaatatactat

SEQ ID NO: 289792 - DNA, 20 bp, Artificial Sequence
  chemically synthesized
acactgatagtatattttaa

SEQ ID NO: 289793 - DNA, 20 bp, Artificial Sequence
  chemically synthesized
tgatagtatattttaaaagc

SEQ ID NO: 289794 - DNA, 20 bp, Artificial Sequence
  chemically synthesized
gatagtatattttaaaagcc

SEQ ID NO: 289795 - DNA, 20 bp, Artificial Sequence
  chemically synthesized
tgctttttcacacaaaaacc

SEQ ID NO: 289796 - DNA, 20 bp, Artificial Sequence
  chemically synthesized
agccaggtttttgtgtgaaa

SEQ ID NO: 289797 - DNA, 20 bp, Artificial Sequence
  chemically synthesized
aggtttttgtgtgaaaaagc

SEQ ID NO: 289798 - DNA, 20 bp, Artificial Sequence
  chemically synthesized
gtgaaaaagcaagtttaaaa

SEQ ID NO: 289799 - DNA, 20 bp, Artificial Sequence
  chemically synthesized
aaagcaagtttaaaaaagta

SEQ ID NO: 289800 - DNA, 20 bp, Artificial Sequence
  chemically synthesized
agcaagtttaaaaaagtaaa

SEQ ID NO: 289801 - DNA, 20 bp, Artificial Sequence
  chemically synthesized
gcaagtttaaaaaagtaaag

SEQ ID NO: 289802 - DNA, 20 bp, Artificial Sequence
  chemically synthesized
aaaaagtaaagaggaaataa

SEQ ID NO: 289803 - DNA, 20 bp, Artificial Sequence
  chemically synthesized
agtaaagaggaaataaaagt

SEQ ID NO: 289804 - DNA, 20 bp, Artificial Sequence
  chemically synthesized
agaggaaataaaagtcagta

SEQ ID NO: 289805 - DNA, 20 bp, Artificial Sequence
  chemically synthesized
taaaagtcagtatggatgcc

SEQ ID NO: 289806 - DNA, 20 bp, Artificial Sequence
  chemically synthesized
aaaagtcagtatggatgcct

SEQ ID NO: 289807 - DNA, 20 bp, Artificial Sequence
  chemically synthesized
aagagctaacagaagtgcct

SEQ ID NO: 289808 - DNA, 20 bp, Artificial Sequence
  chemically synthesized
taagagctaacagaagtgcc

SEQ ID NO: 289809 - DNA, 20 bp, Artificial Sequence
  chemically synthesized
ggatgcctaggcacttctgt

SEQ ID NO: 289810 - DNA, 20 bp, Artificial Sequence
  chemically synthesized
caggaaataagagctaacag

SEQ ID NO: 289811 - DNA, 20 bp, Artificial Sequence
  chemically synthesized
atgcaggaaataagagctaa

SEQ ID NO: 289812 - DNA, 20 bp, Artificial Sequence
  chemically synthesized
attaagtatgcaggaaataa

SEQ ID NO: 289813 - DNA, 20 bp, Artificial Sequence
  chemically synthesized
gtattaagtatgcaggaaat

SEQ ID NO: 289814 - DNA, 20 bp, Artificial Sequence
  chemically synthesized
tttggacgtattaagtatgc

SEQ ID NO: 289815 - DNA, 20 bp, Artificial Sequence
  chemically synthesized
ctttggacgtattaagtatg

SEQ ID NO: 289816 - DNA, 20 bp, Artificial Sequence
  chemically synthesized
cacagtactttggacgtatt

SEQ ID NO: 289817 - DNA, 20 bp, Artificial Sequence
  chemically synthesized
ctgcatacttaatacgtcca

SEQ ID NO: 289818 - DNA, 20 bp, Artificial Sequence
  chemically synthesized
tgtattcctccacagtactt

SEQ ID NO: 289819 - DNA, 20 bp, Artificial Sequence
  chemically synthesized
ttaatacgtccaaagtactg

SEQ ID NO: 289820 - DNA, 20 bp, Artificial Sequence
  chemically synthesized
aatacgtccaaagtactgtg

SEQ ID NO: 289821 - DNA, 20 bp, Artificial Sequence
  chemically synthesized
atacgtccaaagtactgtgg

SEQ ID NO: 289822 - DNA, 20 bp, Artificial Sequence
  chemically synthesized
tcatttcttgtattcctcca

SEQ ID NO: 289823 - DNA, 20 bp, Artificial Sequence
  chemically synthesized
aaagtactgtggaggaatac

SEQ ID NO: 289824 - DNA, 20 bp, Artificial Sequence
  chemically synthesized
tgtggaggaatacaagaaat

SEQ ID NO: 289825 - DNA, 20 bp, Artificial Sequence
  chemically synthesized
aagaaatgagatttactccc

SEQ ID NO: 289826 - DNA, 20 bp, Artificial Sequence
  chemically synthesized
atatccgaactggcaccagg

SEQ ID NO: 289827 - DNA, 20 bp, Artificial Sequence
  chemically synthesized
tgagatttactccctggtgc

SEQ ID NO: 289828 - DNA, 20 bp, Artificial Sequence
  chemically synthesized
ttatatccgaactggcacca

SEQ ID NO: 289829 - DNA, 20 bp, Artificial Sequence
  chemically synthesized
attatatccgaactggcacc

SEQ ID NO: 289830 - DNA, 20 bp, Artificial Sequence
  chemically synthesized
cattatatccgaactggcac

SEQ ID NO: 289831 - DNA, 20 bp, Artificial Sequence
  chemically synthesized
tttactccctggtgccagtt

SEQ ID NO: 289832 - DNA, 20 bp, Artificial Sequence
  chemically synthesized
tgtatgcattatatccgaac

SEQ ID NO: 289833 - DNA, 20 bp, Artificial Sequence
  chemically synthesized
tagcatatgaaattacatag

SEQ ID NO: 289834 - DNA, 20 bp, Artificial Sequence
  chemically synthesized
atgtagcatatgaaattaca

SEQ ID NO: 289835 - DNA, 20 bp, Artificial Sequence
  chemically synthesized
tatatatggaatgaaaaatg

SEQ ID NO: 289836 - DNA, 20 bp, Artificial Sequence
  chemically synthesized
tgtatatatatatatatata

SEQ ID NO: 289837 - DNA, 20 bp, Artificial Sequence
  chemically synthesized
aataaccctttaattaaata

SEQ ID NO: 289838 - DNA, 20 bp, Artificial Sequence
  chemically synthesized
atatacaccatatttaatta

SEQ ID NO: 289839 - DNA, 20 bp, Artificial Sequence
  chemically synthesized
tatacaccatatttaattaa

SEQ ID NO: 289840 - DNA, 20 bp, Artificial Sequence
  chemically synthesized
atacaccatatttaattaaa

SEQ ID NO: 289841 - DNA, 20 bp, Artificial Sequence
  chemically synthesized
taaagggttatttattaatc

SEQ ID NO: 289842 - DNA, 20 bp, Artificial Sequence
  chemically synthesized
ggttatttattaatctagac

SEQ ID NO: 289843 - DNA, 20 bp, Artificial Sequence
  chemically synthesized
acccttttggaatgcttgtc

SEQ ID NO: 289844 - DNA, 20 bp, Artificial Sequence
  chemically synthesized
aatctagacaagcattccaa

SEQ ID NO: 289845 - DNA, 20 bp, Artificial Sequence
  chemically synthesized
atctagacaagcattccaaa

SEQ ID NO: 289846 - DNA, 20 bp, Artificial Sequence
  chemically synthesized
tctagacaagcattccaaaa

SEQ ID NO: 289847 - DNA, 20 bp, Artificial Sequence
  chemically synthesized
aattttactattcacccttt

SEQ ID NO: 289848 - DNA, 20 bp, Artificial Sequence
  chemically synthesized
aagcattccaaaagggtgaa

SEQ ID NO: 289849 - DNA, 20 bp, Artificial Sequence
  chemically synthesized
aagggtgaatagtaaaatta

SEQ ID NO: 289850 - DNA, 20 bp, Artificial Sequence
  chemically synthesized
atagtaaaattaaagatgtg

SEQ ID NO: 289851 - DNA, 20 bp, Artificial Sequence
  chemically synthesized
aaattaaagatgtgtagcta

SEQ ID NO: 289852 - DNA, 20 bp, Artificial Sequence
  chemically synthesized
ttaaagatgtgtagctacag

SEQ ID NO: 289853 - DNA, 20 bp, Artificial Sequence
  chemically synthesized
aagatgtgtagctacagtgg

SEQ ID NO: 289854 - DNA, 20 bp, Artificial Sequence
  chemically synthesized
aattgtccccacttccactg

SEQ ID NO: 289855 - DNA, 20 bp, Artificial Sequence
  chemically synthesized
atgtgtagctacagtggaag

SEQ ID NO: 289856 - DNA, 20 bp, Artificial Sequence
  chemically synthesized
tgtgtagctacagtggaagt

SEQ ID NO: 289857 - DNA, 20 bp, Artificial Sequence
  chemically synthesized
gtgtagctacagtggaagtg

SEQ ID NO: 289858 - DNA, 20 bp, Artificial Sequence
  chemically synthesized
gacaatttgtttacatataa

SEQ ID NO: 289859 - DNA, 20 bp, Artificial Sequence
  chemically synthesized
aatttgtttacatataatag

SEQ ID NO: 289860 - DNA, 20 bp, Artificial Sequence
  chemically synthesized
tacatataatagcagtgaaa

SEQ ID NO: 289861 - DNA, 20 bp, Artificial Sequence
  chemically synthesized
tataatagcagtgaaaaagt

SEQ ID NO: 289862 - DNA, 20 bp, Artificial Sequence
  chemically synthesized
ataatagcagtgaaaaagtt

SEQ ID NO: 289863 - DNA, 20 bp, Artificial Sequence
  chemically synthesized
atagcagtgaaaaagttagg

SEQ ID NO: 289864 - DNA, 20 bp, Artificial Sequence
  chemically synthesized
ttataaacaatcatcgtttg

SEQ ID NO: 289865 - DNA, 20 bp, Artificial Sequence
  chemically synthesized
tataaacaatcatcgtttgt

SEQ ID NO: 289866 - DNA, 20 bp, Artificial Sequence
  chemically synthesized
tgtaggtatgaaatttaaaa

SEQ ID NO: 289867 - DNA, 20 bp, Artificial Sequence
  chemically synthesized
taggtatgaaatttaaaaaa

SEQ ID NO: 289868 - DNA, 20 bp, Artificial Sequence
  chemically synthesized
gtatgaaatttaaaaaagag

SEQ ID NO: 289869 - DNA, 20 bp, Artificial Sequence
  chemically synthesized
gaaatttaaaaaagagaaga

SEQ ID NO: 289870 - DNA, 20 bp, Artificial Sequence
  chemically synthesized
aaaaaagagaagaaagatga

SEQ ID NO: 289871 - DNA, 20 bp, Artificial Sequence
  chemically synthesized
aaaaagagaagaaagatgat

SEQ ID NO: 289872 - DNA, 20 bp, Artificial Sequence
  chemically synthesized
aaaagagaagaaagatgata

SEQ ID NO: 289873 - DNA, 20 bp, Artificial Sequence
  chemically synthesized
gagaagaaagatgataggga

SEQ ID NO: 289874 - DNA, 20 bp, Artificial Sequence
  chemically synthesized
agaaagatgatagggatgga

SEQ ID NO: 289875 - DNA, 20 bp, Artificial Sequence
  chemically synthesized
agatgatagggatggatgga

SEQ ID NO: 289876 - DNA, 20 bp, Artificial Sequence
  chemically synthesized
gatagggatggatggatgga

SEQ ID NO: 289877 - DNA, 20 bp, Artificial Sequence
  chemically synthesized
tagggatggatggatggatg

SEQ ID NO: 289878 - DNA, 20 bp, Artificial Sequence
  chemically synthesized
gggatggatggatggatgga

SEQ ID NO: 289879 - DNA, 20 bp, Artificial Sequence
  chemically synthesized
tggatggagagctgtatgaa

SEQ ID NO: 289880 - DNA, 20 bp, Artificial Sequence
  chemically synthesized
atatatagtctctattcata

SEQ ID NO: 289881 - DNA, 20 bp, Artificial Sequence
  chemically synthesized
gatggagagctgtatgaata

SEQ ID NO: 289882 - DNA, 20 bp, Artificial Sequence
  chemically synthesized
tataaatacgtaataatata

SEQ ID NO: 289883 - DNA, 20 bp, Artificial Sequence
  chemically synthesized
gtatttatattgtaacatca

SEQ ID NO: 289884 - DNA, 20 bp, Artificial Sequence
  chemically synthesized
gtaacatcatagacaaatct

SEQ ID NO: 289885 - DNA, 20 bp, Artificial Sequence
  chemically synthesized
aatagcaatgtttgataact

SEQ ID NO: 289886 - DNA, 20 bp, Artificial Sequence
  chemically synthesized
tactttaaagatgttcagaa

SEQ ID NO: 289887 - DNA, 20 bp, Artificial Sequence
  chemically synthesized
tcatttactttaaagatgtt

SEQ ID NO: 289888 - DNA, 20 bp, Artificial Sequence
  chemically synthesized
tgctattctgaacatcttta

SEQ ID NO: 289889 - DNA, 20 bp, Artificial Sequence
  chemically synthesized
actttttatcatttacttta

SEQ ID NO: 289890 - DNA, 20 bp, Artificial Sequence
  chemically synthesized
tctttaaagtaaatgataaa

SEQ ID NO: 289891 - DNA, 20 bp, Artificial Sequence
  chemically synthesized
tatacctcttaatcatatta

SEQ ID NO: 289892 - DNA, 20 bp, Artificial Sequence
  chemically synthesized
agttgaactttaatatgatt

SEQ ID NO: 289893 - DNA, 20 bp, Artificial Sequence
  chemically synthesized
ttgaactttaatatgattaa

SEQ ID NO: 289894 - DNA, 20 bp, Artificial Sequence
  chemically synthesized
tgaactttaatatgattaag

SEQ ID NO: 289895 - DNA, 20 bp, Artificial Sequence
  chemically synthesized
atatgattaagaggtatata

SEQ ID NO: 289896 - DNA, 20 bp, Artificial Sequence
  chemically synthesized
taagaggtatatacagatta

SEQ ID NO: 289897 - DNA, 20 bp, Artificial Sequence
  chemically synthesized
tacagattaaagtaaatttc

SEQ ID NO: 289898 - DNA, 20 bp, Artificial Sequence
  chemically synthesized
aaagtaaatttccagtgaaa

SEQ ID NO: 289899 - DNA, 20 bp, Artificial Sequence
  chemically synthesized
gtgcaaaggagccatttcac

SEQ ID NO: 289900 - DNA, 20 bp, Artificial Sequence
  chemically synthesized
gcagcaattgttgtgcaaag

SEQ ID NO: 289901 - DNA, 20 bp, Artificial Sequence
  chemically synthesized
atgcagcaattgttgtgcaa

SEQ ID NO: 289902 - DNA, 20 bp, Artificial Sequence
  chemically synthesized
tatgcagcaattgttgtgca

SEQ ID NO: 289903 - DNA, 20 bp, Artificial Sequence
  chemically synthesized
tttgcacaacaattgctgca

SEQ ID NO: 289904 - DNA, 20 bp, Artificial Sequence
  chemically synthesized
aaatacatttagtggctatg

SEQ ID NO: 289905 - DNA, 20 bp, Artificial Sequence
  chemically synthesized
ttaaagttaaatacatttag

SEQ ID NO: 289906 - DNA, 20 bp, Artificial Sequence
  chemically synthesized
cccttaaagttaaatacatt

SEQ ID NO: 289907 - DNA, 20 bp, Artificial Sequence
  chemically synthesized
cactaaatgtatttaacttt

SEQ ID NO: 289908 - DNA, 20 bp, Artificial Sequence
  chemically synthesized
actaaatgtatttaacttta

SEQ ID NO: 289909 - DNA, 20 bp, Artificial Sequence
  chemically synthesized
ctaaatgtatttaactttaa

SEQ ID NO: 289910 - DNA, 20 bp, Artificial Sequence
  chemically synthesized
taaatgtatttaactttaag

SEQ ID NO: 289911 - DNA, 20 bp, Artificial Sequence
  chemically synthesized
aaatgtatttaactttaagg

SEQ ID NO: 289912 - DNA, 20 bp, Artificial Sequence
  chemically synthesized
atgtatttaactttaagggg

SEQ ID NO: 289913 - DNA, 20 bp, Artificial Sequence
  chemically synthesized
acatacataactccccctta

SEQ ID NO: 289914 - DNA, 20 bp, Artificial Sequence
  chemically synthesized
ggagttatgtatgtaatgac

SEQ ID NO: 289915 - DNA, 20 bp, Artificial Sequence
  chemically synthesized
tatgtcaatatttgaaaatc

SEQ ID NO: 289916 - DNA, 20 bp, Artificial Sequence
  chemically synthesized
atgtcaatatttgaaaatct

SEQ ID NO: 289917 - DNA, 20 bp, Artificial Sequence
  chemically synthesized
ggaaaatattttaaatgtcc

SEQ ID NO: 289918 - DNA, 20 bp, Artificial Sequence
  chemically synthesized
tgcctctgcaaaatcaattt

SEQ ID NO: 289919 - DNA, 20 bp, Artificial Sequence
  chemically synthesized
gtgcctctgcaaaatcaatt

SEQ ID NO: 289920 - DNA, 20 bp, Artificial Sequence
  chemically synthesized
attttcccaaattgattttg

SEQ ID NO: 289921 - DNA, 20 bp, Artificial Sequence
  chemically synthesized
tttcccaaattgattttgca

SEQ ID NO: 289922 - DNA, 20 bp, Artificial Sequence
  chemically synthesized
ttcccaaattgattttgcag

SEQ ID NO: 289923 - DNA, 20 bp, Artificial Sequence
  chemically synthesized
aaattgattttgcagaggca

SEQ ID NO: 289924 - DNA, 20 bp, Artificial Sequence
  chemically synthesized
ttttgcagaggcacagtaac

SEQ ID NO: 289925 - DNA, 20 bp, Artificial Sequence
  chemically synthesized
cagctccctctagtggattt

SEQ ID NO: 289926 - DNA, 20 bp, Artificial Sequence
  chemically synthesized
acaagtatactgaaatccac

SEQ ID NO: 289927 - DNA, 20 bp, Artificial Sequence
  chemically synthesized
aagtatactgaaatccacta

SEQ ID NO: 289928 - DNA, 20 bp, Artificial Sequence
  chemically synthesized
agtatactgaaatccactag

SEQ ID NO: 289929 - DNA, 20 bp, Artificial Sequence
  chemically synthesized
gtatactgaaatccactaga

SEQ ID NO: 289930 - DNA, 20 bp, Artificial Sequence
  chemically synthesized
atactgaaatccactagagg

SEQ ID NO: 289931 - DNA, 20 bp, Artificial Sequence
  chemically synthesized
atagtatcagctccctctag

SEQ ID NO: 289932 - DNA, 20 bp, Artificial Sequence
  chemically synthesized
taaatagtatcagctccctc

SEQ ID NO: 289933 - DNA, 20 bp, Artificial Sequence
  chemically synthesized
taaaactttataaatagtat

SEQ ID NO: 289934 - DNA, 20 bp, Artificial Sequence
  chemically synthesized
gggagctgatactatttata

SEQ ID NO: 289935 - DNA, 20 bp, Artificial Sequence
  chemically synthesized
aggtagtaaaactttataaa

SEQ ID NO: 289936 - DNA, 20 bp, Artificial Sequence
  chemically synthesized
ataaagttttactacctgta

SEQ ID NO: 289937 - DNA, 20 bp, Artificial Sequence
  chemically synthesized
taaagttttactacctgtac

SEQ ID NO: 289938 - DNA, 20 bp, Artificial Sequence
  chemically synthesized
ggtttattttcctgtacagg

SEQ ID NO: 289939 - DNA, 20 bp, Artificial Sequence
  chemically synthesized
aggggtttattttcctgtac

SEQ ID NO: 289940 - DNA, 20 bp, Artificial Sequence
  chemically synthesized
aaggggtttattttcctgta

SEQ ID NO: 289941 - DNA, 20 bp, Artificial Sequence
  chemically synthesized
gtacaggaaaataaacccct

SEQ ID NO: 289942 - DNA, 20 bp, Artificial Sequence
  chemically synthesized
tcagagtcgtttttgctaag

SEQ ID NO: 289943 - DNA, 20 bp, Artificial Sequence
  chemically synthesized
ttcagagtcgtttttgctaa

SEQ ID NO: 289944 - DNA, 20 bp, Artificial Sequence
  chemically synthesized
cttcagagtcgtttttgcta

SEQ ID NO: 289945 - DNA, 20 bp, Artificial Sequence
  chemically synthesized
acttcagagtcgtttttgct

SEQ ID NO: 289946 - DNA, 20 bp, Artificial Sequence
  chemically synthesized
ccttagcaaaaacgactctg

SEQ ID NO: 289947 - DNA, 20 bp, Artificial Sequence
  chemically synthesized
ttttttttttttgtacttca

SEQ ID NO: 289948 - DNA, 20 bp, Artificial Sequence
  chemically synthesized
ttttttttttttttgtactt

SEQ ID NO: 289949 - DNA, 20 bp, Artificial Sequence
  chemically synthesized
aaaaaaaaaaaaaaaaaaaa

SEQ ID NO: 289950 - DNA, 20 bp, Artificial Sequence
  chemically synthesized
aaatgagctaaataaagcaa

SEQ ID NO: 289951 - DNA, 20 bp, Artificial Sequence
  chemically synthesized
gaaatgagctaaataaagca

SEQ ID NO: 289952 - DNA, 20 bp, Artificial Sequence
  chemically synthesized
tatttatcctttgctttatt

SEQ ID NO: 289953 - DNA, 20 bp, Artificial Sequence
  chemically synthesized
aaaatgaaatgagctaaata

SEQ ID NO: 289954 - DNA, 20 bp, Artificial Sequence
  chemically synthesized
attttttacaaaaatgaaat

SEQ ID NO: 289955 - DNA, 20 bp, Artificial Sequence
  chemically synthesized
tcatttttgtaaaaaatgaa

SEQ ID NO: 289956 - DNA, 20 bp, Artificial Sequence
  chemically synthesized
ttttgtaaaaaatgaaaagc

SEQ ID NO: 289957 - DNA, 20 bp, Artificial Sequence
  chemically synthesized
tttgtaaaaaatgaaaagct

SEQ ID NO: 289958 - DNA, 20 bp, Artificial Sequence
  chemically synthesized
aaaatgaaaagctgggaaat

SEQ ID NO: 289959 - DNA, 20 bp, Artificial Sequence
  chemically synthesized
acaacgcttttctcatttcc

SEQ ID NO: 289960 - DNA, 20 bp, Artificial Sequence
  chemically synthesized
gaaaagctgggaaatgagaa

SEQ ID NO: 289961 - DNA, 20 bp, Artificial Sequence
  chemically synthesized
tatcatttccagaattaatg

SEQ ID NO: 289962 - DNA, 20 bp, Artificial Sequence
  chemically synthesized
gtgtatcactacattaattc

SEQ ID NO: 289963 - DNA, 20 bp, Artificial Sequence
  chemically synthesized
tcaccatataatatcatttc

SEQ ID NO: 289964 - DNA, 20 bp, Artificial Sequence
  chemically synthesized
attctggaaatgatattata

SEQ ID NO: 289965 - DNA, 20 bp, Artificial Sequence
  chemically synthesized
cttttctttgtaaatattta

SEQ ID NO: 289966 - DNA, 20 bp, Artificial Sequence
  chemically synthesized
gaattctttaaatatttaca

SEQ ID NO: 289967 - DNA, 20 bp, Artificial Sequence
  chemically synthesized
ctttaaatatttacaaagaa

SEQ ID NO: 289968 - DNA, 20 bp, Artificial Sequence
  chemically synthesized
atatttacaaagaaaagcaa

SEQ ID NO: 289969 - DNA, 20 bp, Artificial Sequence
  chemically synthesized
tatttacaaagaaaagcaat

SEQ ID NO: 289970 - DNA, 20 bp, Artificial Sequence
  chemically synthesized
ctactaaaacttaaattagt

SEQ ID NO: 289971 - DNA, 20 bp, Artificial Sequence
  chemically synthesized
atatattttccaactaattt

SEQ ID NO: 289972 - DNA, 20 bp, Artificial Sequence
  chemically synthesized
tttactactaaaacttaaat

SEQ ID NO: 289973 - DNA, 20 bp, Artificial Sequence
  chemically synthesized
tttccaactaatttaagttt

SEQ ID NO: 289974 - DNA, 20 bp, Artificial Sequence
  chemically synthesized
ccaactaatttaagttttag

SEQ ID NO: 289975 - DNA, 20 bp, Artificial Sequence
  chemically synthesized
aaatttgtcatgagaagcac

SEQ ID NO: 289976 - DNA, 20 bp, Artificial Sequence
  chemically synthesized
caaatttgtcatgagaagca

SEQ ID NO: 289977 - DNA, 20 bp, Artificial Sequence
  chemically synthesized
tgtcccaaatttgtcatgag

SEQ ID NO: 289978 - DNA, 20 bp, Artificial Sequence
  chemically synthesized
ctctgtcccaaatttgtcat

SEQ ID NO: 289979 - DNA, 20 bp, Artificial Sequence
  chemically synthesized
tgtgcttctcatgacaaatt

SEQ ID NO: 289980 - DNA, 20 bp, Artificial Sequence
  chemically synthesized
gtgcttctcatgacaaattt

SEQ ID NO: 289981 - DNA, 20 bp, Artificial Sequence
  chemically synthesized
ttctcatgacaaatttggga

SEQ ID NO: 289982 - DNA, 20 bp, Artificial Sequence
  chemically synthesized
ctcatgacaaatttgggaca

SEQ ID NO: 289983 - DNA, 20 bp, Artificial Sequence
  chemically synthesized
atttgggacagagatttttt

SEQ ID NO: 289984 - DNA, 20 bp, Artificial Sequence
  chemically synthesized
gtttgaaggcattaagataa

SEQ ID NO: 289985 - DNA, 20 bp, Artificial Sequence
  chemically synthesized
aaatcgggtttgaaggcatt

SEQ ID NO: 289986 - DNA, 20 bp, Artificial Sequence
  chemically synthesized
ttgagtaaaatcgggtttga

SEQ ID NO: 289987 - DNA, 20 bp, Artificial Sequence
  chemically synthesized
attgagtaaaatcgggtttg

SEQ ID NO: 289988 - DNA, 20 bp, Artificial Sequence
  chemically synthesized
aggaattattgagtaaaatc

SEQ ID NO: 289989 - DNA, 20 bp, Artificial Sequence
  chemically synthesized
aaggaattattgagtaaaat

SEQ ID NO: 289990 - DNA, 20 bp, Artificial Sequence
  chemically synthesized
tgcacacaaaaggaattatt

SEQ ID NO: 289991 - DNA, 20 bp, Artificial Sequence
  chemically synthesized
tgtgttcatgtgcacacaaa

SEQ ID NO: 289992 - DNA, 20 bp, Artificial Sequence
  chemically synthesized
atgtgttcatgtgcacacaa

SEQ ID NO: 289993 - DNA, 20 bp, Artificial Sequence
  chemically synthesized
aacacatatatgcatgtata

SEQ ID NO: 289994 - DNA, 20 bp, Artificial Sequence
  chemically synthesized
cctttaagaaatagtaaatg

SEQ ID NO: 289995 - DNA, 20 bp, Artificial Sequence
  chemically synthesized
acctttaagaaatagtaaat

SEQ ID NO: 289996 - DNA, 20 bp, Artificial Sequence
  chemically synthesized
cacctttaagaaatagtaaa

SEQ ID NO: 289997 - DNA, 20 bp, Artificial Sequence
  chemically synthesized
accccatttactatttctta

SEQ ID NO: 289998 - DNA, 20 bp, Artificial Sequence
  chemically synthesized
gaatgaccacctttaagaaa

SEQ ID NO: 289999 - DNA, 20 bp, Artificial Sequence
  chemically synthesized
ccccatttactatttcttaa

SEQ ID NO: 290000 - DNA, 20 bp, Artificial Sequence
  chemically synthesized
catttactatttcttaaagg

SEQ ID NO: 290001 - DNA, 20 bp, Artificial Sequence
  chemically synthesized
acagatgaatgaccaccttt

SEQ ID NO: 290002 - DNA, 20 bp, Artificial Sequence
  chemically synthesized
acaaaaattcttttcagaga

SEQ ID NO: 290003 - DNA, 20 bp, Artificial Sequence
  chemically synthesized
gtcattcatctgtctctgaa

SEQ ID NO: 290004 - DNA, 20 bp, Artificial Sequence
  chemically synthesized
taagacaaaaattcttttca

SEQ ID NO: 290005 - DNA, 20 bp, Artificial Sequence
  chemically synthesized
tttaagacaaaaattctttt

SEQ ID NO: 290006 - DNA, 20 bp, Artificial Sequence
  chemically synthesized
agaatttttgtcttaaaact

SEQ ID NO: 290007 - DNA, 20 bp, Artificial Sequence
  chemically synthesized
ctactcatcaacttagtttt

SEQ ID NO: 290008 - DNA, 20 bp, Artificial Sequence
  chemically synthesized
tgtcttaaaactaagttgat

SEQ ID NO: 290009 - DNA, 20 bp, Artificial Sequence
  chemically synthesized
aatatctctactcatcaact

SEQ ID NO: 290010 - DNA, 20 bp, Artificial Sequence
  chemically synthesized
cttaaaactaagttgatgag

SEQ ID NO: 290011 - DNA, 20 bp, Artificial Sequence
  chemically synthesized
taaaactaagttgatgagta

SEQ ID NO: 290012 - DNA, 20 bp, Artificial Sequence
  chemically synthesized
gttgatgagtagagatattt

SEQ ID NO: 290013 - DNA, 20 bp, Artificial Sequence
  chemically synthesized
tgatgagtagagatattttg

SEQ ID NO: 290014 - DNA, 20 bp, Artificial Sequence
  chemically synthesized
tgagtagagatattttggag

SEQ ID NO: 290015 - DNA, 20 bp, Artificial Sequence
  chemically synthesized
aataagatgatgttaataca

SEQ ID NO: 290016 - DNA, 20 bp, Artificial Sequence
  chemically synthesized
gtattaacatcatcttatta

SEQ ID NO: 290017 - DNA, 20 bp, Artificial Sequence
  chemically synthesized
tcttcctgaattgctttaat

SEQ ID NO: 290018 - DNA, 20 bp, Artificial Sequence
  chemically synthesized
atcatcttattaaagcaatt

SEQ ID NO: 290019 - DNA, 20 bp, Artificial Sequence
  chemically synthesized
tcatcttattaaagcaattc

SEQ ID NO: 290020 - DNA, 20 bp, Artificial Sequence
  chemically synthesized
tcttattaaagcaattcagg

SEQ ID NO: 290021 - DNA, 20 bp, Artificial Sequence
  chemically synthesized
ttattaaagcaattcaggaa

SEQ ID NO: 290022 - DNA, 20 bp, Artificial Sequence
  chemically synthesized
agcaattcaggaagagacaa

SEQ ID NO: 290023 - DNA, 20 bp, Artificial Sequence
  chemically synthesized
atgcgactagcaaatttttc

SEQ ID NO: 290024 - DNA, 20 bp, Artificial Sequence
  chemically synthesized
aaacatcttgaaaaatttgc

SEQ ID NO: 290025 - DNA, 20 bp, Artificial Sequence
  chemically synthesized
tgaaaaatttgctagtcgca

SEQ ID NO: 290026 - DNA, 20 bp, Artificial Sequence
  chemically synthesized
gcaaattcatgccatgcgac

SEQ ID NO: 290027 - DNA, 20 bp, Artificial Sequence
  chemically synthesized
gatgataaaagataaaagtg

SEQ ID NO: 290028 - DNA, 20 bp, Artificial Sequence
  chemically synthesized
ttgatgataaaagataaaag

SEQ ID NO: 290029 - DNA, 20 bp, Artificial Sequence
  chemically synthesized
cctttgatgataaaagataa

SEQ ID NO: 290030 - DNA, 20 bp, Artificial Sequence
  chemically synthesized
attttttcctttgatgataa

SEQ ID NO: 290031 - DNA, 20 bp, Artificial Sequence
  chemically synthesized
acttttatcttttatcatca

SEQ ID NO: 290032 - DNA, 20 bp, Artificial Sequence
  chemically synthesized
cttttatcttttatcatcaa

SEQ ID NO: 290033 - DNA, 20 bp, Artificial Sequence
  chemically synthesized
tttatcatcaaaggaaaaaa

SEQ ID NO: 290034 - DNA, 20 bp, Artificial Sequence
  chemically synthesized
ttatcatcaaaggaaaaaat

SEQ ID NO: 290035 - DNA, 20 bp, Artificial Sequence
  chemically synthesized
aaataggatttatgtaatta

SEQ ID NO: 290036 - DNA, 20 bp, Artificial Sequence
  chemically synthesized
tttatgtaattatagtgatc

SEQ ID NO: 290037 - DNA, 20 bp, Artificial Sequence
  chemically synthesized
atgtaattatagtgatccag

SEQ ID NO: 290038 - DNA, 20 bp, Artificial Sequence
  chemically synthesized
tttgggctacattttactac

SEQ ID NO: 290039 - DNA, 20 bp, Artificial Sequence
  chemically synthesized
agtgatccagtagtaaaatg

SEQ ID NO: 290040 - DNA, 20 bp, Artificial Sequence
  chemically synthesized
cagtagtaaaatgtagccca

SEQ ID NO: 290041 - DNA, 20 bp, Artificial Sequence
  chemically synthesized
caaaggacaaattattcttt

SEQ ID NO: 290042 - DNA, 20 bp, Artificial Sequence
  chemically synthesized
gcaaaggacaaattattctt

SEQ ID NO: 290043 - DNA, 20 bp, Artificial Sequence
  chemically synthesized
agaataatttgtcctttgct

SEQ ID NO: 290044 - DNA, 20 bp, Artificial Sequence
  chemically synthesized
tggcaactgaaactcagcaa

SEQ ID NO: 290045 - DNA, 20 bp, Artificial Sequence
  chemically synthesized
gtggcaactgaaactcagca

SEQ ID NO: 290046 - DNA, 20 bp, Artificial Sequence
  chemically synthesized
atttgtcctttgctgagttt

SEQ ID NO: 290047 - DNA, 20 bp, Artificial Sequence
  chemically synthesized
tacatgtggcaactgaaact

SEQ ID NO: 290048 - DNA, 20 bp, Artificial Sequence
  chemically synthesized
ttatagctttagcatacatg

SEQ ID NO: 290049 - DNA, 20 bp, Artificial Sequence
  chemically synthesized
cagttgccacatgtatgcta

SEQ ID NO: 290050 - DNA, 20 bp, Artificial Sequence
  chemically synthesized
tctgaagagtattatagctt

SEQ ID NO: 290051 - DNA, 20 bp, Artificial Sequence
  chemically synthesized
aatttatctgaagagtatta

SEQ ID NO: 290052 - DNA, 20 bp, Artificial Sequence
  chemically synthesized
gctaaagctataatactctt

SEQ ID NO: 290053 - DNA, 20 bp, Artificial Sequence
  chemically synthesized
tttctgtcaatttatctgaa

SEQ ID NO: 290054 - DNA, 20 bp, Artificial Sequence
  chemically synthesized
tatttctgtcaatttatctg

SEQ ID NO: 290055 - DNA, 20 bp, Artificial Sequence
  chemically synthesized
atactcttcagataaattga

SEQ ID NO: 290056 - DNA, 20 bp, Artificial Sequence
  chemically synthesized
agataaattgacagaaatat

SEQ ID NO: 290057 - DNA, 20 bp, Artificial Sequence
  chemically synthesized
taaattgacagaaatattag

SEQ ID NO: 290058 - DNA, 20 bp, Artificial Sequence
  chemically synthesized
cagaaatattagaagatgcc

SEQ ID NO: 290059 - DNA, 20 bp, Artificial Sequence
  chemically synthesized
tatatacaaggatatttgct

SEQ ID NO: 290060 - DNA, 20 bp, Artificial Sequence
  chemically synthesized
gtatatacaaggatatttgc

SEQ ID NO: 290061 - DNA, 20 bp, Artificial Sequence
  chemically synthesized
tctggctcgctgtatataca

SEQ ID NO: 290062 - DNA, 20 bp, Artificial Sequence
  chemically synthesized
agcaaatatccttgtatata

SEQ ID NO: 290063 - DNA, 20 bp, Artificial Sequence
  chemically synthesized
gtctggctcgctgtatatac

SEQ ID NO: 290064 - DNA, 20 bp, Artificial Sequence
  chemically synthesized
aatatccttgtatatacagc

SEQ ID NO: 290065 - DNA, 20 bp, Artificial Sequence
  chemically synthesized
tccttgtatatacagcgagc

SEQ ID NO: 290066 - DNA, 20 bp, Artificial Sequence
  chemically synthesized
gaatacacttcaattaagtc

SEQ ID NO: 290067 - DNA, 20 bp, Artificial Sequence
  chemically synthesized
cagcgagccagacttaattg

SEQ ID NO: 290068 - DNA, 20 bp, Artificial Sequence
  chemically synthesized
catatgaatacacttcaatt

SEQ ID NO: 290069 - DNA, 20 bp, Artificial Sequence
  chemically synthesized
agaaaataaaagagcagttg

SEQ ID NO: 290070 - DNA, 20 bp, Artificial Sequence
  chemically synthesized
aagaaaataaaagagcagtt

SEQ ID NO: 290071 - DNA, 20 bp, Artificial Sequence
  chemically synthesized
tatagaagaaaataaaagag

SEQ ID NO: 290072 - DNA, 20 bp, Artificial Sequence
  chemically synthesized
gaatatagaagaaaataaaa

SEQ ID NO: 290073 - DNA, 20 bp, Artificial Sequence
  chemically synthesized
ttgaatatagaagaaaataa

SEQ ID NO: 290074 - DNA, 20 bp, Artificial Sequence
  chemically synthesized
atcagatgttttgaatatag

SEQ ID NO: 290075 - DNA, 20 bp, Artificial Sequence
  chemically synthesized
aaaatcagatgttttgaata

SEQ ID NO: 290076 - DNA, 20 bp, Artificial Sequence
  chemically synthesized
gggattgtagatttcaaaat

SEQ ID NO: 290077 - DNA, 20 bp, Artificial Sequence
  chemically synthesized
agcttctccttgggggattg

SEQ ID NO: 290078 - DNA, 20 bp, Artificial Sequence
  chemically synthesized
tttgaaatctacaatccccc

SEQ ID NO: 290079 - DNA, 20 bp, Artificial Sequence
  chemically synthesized
ttgaaatctacaatccccca

SEQ ID NO: 290080 - DNA, 20 bp, Artificial Sequence
  chemically synthesized
gaaatctacaatcccccaag

SEQ ID NO: 290081 - DNA, 20 bp, Artificial Sequence
  chemically synthesized
tgggaatagcttctccttgg

SEQ ID NO: 290082 - DNA, 20 bp, Artificial Sequence
  chemically synthesized
atctacaatcccccaaggag

SEQ ID NO: 290083 - DNA, 20 bp, Artificial Sequence
  chemically synthesized
atgggaatagcttctccttg

SEQ ID NO: 290084 - DNA, 20 bp, Artificial Sequence
  chemically synthesized
tatgggaatagcttctcctt

SEQ ID NO: 290085 - DNA, 20 bp, Artificial Sequence
  chemically synthesized
gtatgggaatagcttctcct

SEQ ID NO: 290086 - DNA, 20 bp, Artificial Sequence
  chemically synthesized
aaacatgttttgtatgggaa

SEQ ID NO: 290087 - DNA, 20 bp, Artificial Sequence
  chemically synthesized
aaacaaaacatgttttgtat

SEQ ID NO: 290088 - DNA, 20 bp, Artificial Sequence
  chemically synthesized
gaaacaaaacatgttttgta

SEQ ID NO: 290089 - DNA, 20 bp, Artificial Sequence
  chemically synthesized
aaaacatgttttgtttctca

SEQ ID NO: 290090 - DNA, 20 bp, Artificial Sequence
  chemically synthesized
cataataattttgtgacttt

SEQ ID NO: 290091 - DNA, 20 bp, Artificial Sequence
  chemically synthesized
caaagtcacaaaattattat

SEQ ID NO: 290092 - DNA, 20 bp, Artificial Sequence
  chemically synthesized
aaagtcacaaaattattatg

SEQ ID NO: 290093 - DNA, 20 bp, Artificial Sequence
  chemically synthesized
tatgaggacaaaaaaatcta

SEQ ID NO: 290094 - DNA, 20 bp, Artificial Sequence
  chemically synthesized
aggacaaaaaaatctacaga

SEQ ID NO: 290095 - DNA, 20 bp, Artificial Sequence
  chemically synthesized
tgtaacagataagctgtctg

SEQ ID NO: 290096 - DNA, 20 bp, Artificial Sequence
  chemically synthesized
gaaatactggtgtaacagat

SEQ ID NO: 290097 - DNA, 20 bp, Artificial Sequence
  chemically synthesized
agacagcttatctgttacac

SEQ ID NO: 290098 - DNA, 20 bp, Artificial Sequence
  chemically synthesized
ggaacgaaatactggtgtaa

SEQ ID NO: 290099 - DNA, 20 bp, Artificial Sequence
  chemically synthesized
attaacaaggaacgaaatac

SEQ ID NO: 290100 - DNA, 20 bp, Artificial Sequence
  chemically synthesized
ccctacaacctgtattaaca

SEQ ID NO: 290101 - DNA, 20 bp, Artificial Sequence
  chemically synthesized
tatttcgttccttgttaata

SEQ ID NO: 290102 - DNA, 20 bp, Artificial Sequence
  chemically synthesized
tccctacaacctgtattaac

SEQ ID NO: 290103 - DNA, 20 bp, Artificial Sequence
  chemically synthesized
atttcgttccttgttaatac

SEQ ID NO: 290104 - DNA, 20 bp, Artificial Sequence
  chemically synthesized
ttccttgttaatacaggttg

SEQ ID NO: 290105 - DNA, 20 bp, Artificial Sequence
  chemically synthesized
tccttgttaatacaggttgt

SEQ ID NO: 290106 - DNA, 20 bp, Artificial Sequence
  chemically synthesized
ccttgttaatacaggttgta

SEQ ID NO: 290107 - DNA, 20 bp, Artificial Sequence
  chemically synthesized
ttgttaatacaggttgtagg

SEQ ID NO: 290108 - DNA, 20 bp, Artificial Sequence
  chemically synthesized
aatacaggttgtagggagaa

SEQ ID NO: 290109 - DNA, 20 bp, Artificial Sequence
  chemically synthesized
agggagaatggttccattta

SEQ ID NO: 290110 - DNA, 20 bp, Artificial Sequence
  chemically synthesized
gaaacaataatttctgtaaa

SEQ ID NO: 290111 - DNA, 20 bp, Artificial Sequence
  chemically synthesized
cagaaattattgtttcatgt

SEQ ID NO: 290112 - DNA, 20 bp, Artificial Sequence
  chemically synthesized
tgtttcatgttagtaccttc

SEQ ID NO: 290113 - DNA, 20 bp, Artificial Sequence
  chemically synthesized
tatttgtggggaaatccaga

SEQ ID NO: 290114 - DNA, 20 bp, Artificial Sequence
  chemically synthesized
ttatttgtggggaaatccag

SEQ ID NO: 290115 - DNA, 20 bp, Artificial Sequence
  chemically synthesized
tggttatttgtggggaaatc

SEQ ID NO: 290116 - DNA, 20 bp, Artificial Sequence
  chemically synthesized
ttccaaaatggttatttgtg

SEQ ID NO: 290117 - DNA, 20 bp, Artificial Sequence
  chemically synthesized
tttccaaaatggttatttgt

SEQ ID NO: 290118 - DNA, 20 bp, Artificial Sequence
  chemically synthesized
ttttccaaaatggttatttg

SEQ ID NO: 290119 - DNA, 20 bp, Artificial Sequence
  chemically synthesized
ttccccacaaataaccattt

SEQ ID NO: 290120 - DNA, 20 bp, Artificial Sequence
  chemically synthesized
taacttgacattttccaaaa

SEQ ID NO: 290121 - DNA, 20 bp, Artificial Sequence
  chemically synthesized
taaccattttggaaaatgtc

SEQ ID NO: 290122 - DNA, 20 bp, Artificial Sequence
  chemically synthesized
cattttggaaaatgtcaagt

SEQ ID NO: 290123 - DNA, 20 bp, Artificial Sequence
  chemically synthesized
aaatgtcaagttagccattt

SEQ ID NO: 290124 - DNA, 20 bp, Artificial Sequence
  chemically synthesized
aatgtcaagttagccatttt

SEQ ID NO: 290125 - DNA, 20 bp, Artificial Sequence
  chemically synthesized
agtaagtaaaaagcctaaaa

SEQ ID NO: 290126 - DNA, 20 bp, Artificial Sequence
  chemically synthesized
gctacagacaagtaagtaaa

SEQ ID NO: 290127 - DNA, 20 bp, Artificial Sequence
  chemically synthesized
agaaagagctacagacaagt

SEQ ID NO: 290128 - DNA, 20 bp, Artificial Sequence
  chemically synthesized
gctttttacttacttgtctg

SEQ ID NO: 290129 - DNA, 20 bp, Artificial Sequence
  chemically synthesized
agagagaaagagctacagac

SEQ ID NO: 290130 - DNA, 20 bp, Artificial Sequence
  chemically synthesized
aggccagagagaaagagcta

SEQ ID NO: 290131 - DNA, 20 bp, Artificial Sequence
  chemically synthesized
atgtgcaggccagagagaaa

SEQ ID NO: 290132 - DNA, 20 bp, Artificial Sequence
  chemically synthesized
tgtctgtagctctttctctc

SEQ ID NO: 290133 - DNA, 20 bp, Artificial Sequence
  chemically synthesized
tgatgtgcaggccagagaga

SEQ ID NO: 290134 - DNA, 20 bp, Artificial Sequence
  chemically synthesized
tttctgatgtgcaggccaga

SEQ ID NO: 290135 - DNA, 20 bp, Artificial Sequence
  chemically synthesized
cttttctgatgtgcaggcca

SEQ ID NO: 290136 - DNA, 20 bp, Artificial Sequence
  chemically synthesized
gtcttttctgatgtgcaggc

SEQ ID NO: 290137 - DNA, 20 bp, Artificial Sequence
  chemically synthesized
tttctctctggcctgcacat

SEQ ID NO: 290138 - DNA, 20 bp, Artificial Sequence
  chemically synthesized
gcaagtcttttctgatgtgc

SEQ ID NO: 290139 - DNA, 20 bp, Artificial Sequence
  chemically synthesized
agcaagtcttttctgatgtg

SEQ ID NO: 290140 - DNA, 20 bp, Artificial Sequence
  chemically synthesized
ctctggcctgcacatcagaa

SEQ ID NO: 290141 - DNA, 20 bp, Artificial Sequence
  chemically synthesized
ctttacaaatcattttaagc

SEQ ID NO: 290142 - DNA, 20 bp, Artificial Sequence
  chemically synthesized
tggcctttacaaatcatttt

SEQ ID NO: 290143 - DNA, 20 bp, Artificial Sequence
  chemically synthesized
cttgcttaaaatgatttgta

SEQ ID NO: 290144 - DNA, 20 bp, Artificial Sequence
  chemically synthesized
ttgcttaaaatgatttgtaa

SEQ ID NO: 290145 - DNA, 20 bp, Artificial Sequence
  chemically synthesized
aatgatttgtaaaggccaca

SEQ ID NO: 290146 - DNA, 20 bp, Artificial Sequence
  chemically synthesized
gttcctggatgcagactttg

SEQ ID NO: 290147 - DNA, 20 bp, Artificial Sequence
  chemically synthesized
aaggccacaaagtctgcatc

SEQ ID NO: 290148 - DNA, 20 bp, Artificial Sequence
  chemically synthesized
aggccacaaagtctgcatcc

SEQ ID NO: 290149 - DNA, 20 bp, Artificial Sequence
  chemically synthesized
aggacccatgttcctggatg

SEQ ID NO: 290150 - DNA, 20 bp, Artificial Sequence
  chemically synthesized
aaagtctgcatccaggaaca

SEQ ID NO: 290151 - DNA, 20 bp, Artificial Sequence
  chemically synthesized
aagtctgcatccaggaacat

SEQ ID NO: 290152 - DNA, 20 bp, Artificial Sequence
  chemically synthesized
aggacaaggacccatgttcc

SEQ ID NO: 290153 - DNA, 20 bp, Artificial Sequence
  chemically synthesized
gccctgaaagagaaaggaca

SEQ ID NO: 290154 - DNA, 20 bp, Artificial Sequence
  chemically synthesized
agccctgaaagagaaaggac

SEQ ID NO: 290155 - DNA, 20 bp, Artificial Sequence
  chemically synthesized
agcatagccctgaaagagaa

SEQ ID NO: 290156 - DNA, 20 bp, Artificial Sequence
  chemically synthesized
ggtccttgtcctttctcttt

SEQ ID NO: 290157 - DNA, 20 bp, Artificial Sequence
  chemically synthesized
aagcatagccctgaaagaga

SEQ ID NO: 290158 - DNA, 20 bp, Artificial Sequence
  chemically synthesized
gtccttgtcctttctctttc

SEQ ID NO: 290159 - DNA, 20 bp, Artificial Sequence
  chemically synthesized
tccttgtcctttctctttca

SEQ ID NO: 290160 - DNA, 20 bp, Artificial Sequence
  chemically synthesized
ttcaaagcatagccctgaaa

SEQ ID NO: 290161 - DNA, 20 bp, Artificial Sequence
  chemically synthesized
aattcaaagcatagccctga

SEQ ID NO: 290162 - DNA, 20 bp, Artificial Sequence
  chemically synthesized
acgattaaaaattcaaagca

SEQ ID NO: 290163 - DNA, 20 bp, Artificial Sequence
  chemically synthesized
attgaacgattaaaaattca

SEQ ID NO: 290164 - DNA, 20 bp, Artificial Sequence
  chemically synthesized
aatttttaatcgttcaattt

SEQ ID NO: 290165 - DNA, 20 bp, Artificial Sequence
  chemically synthesized
atttttaatcgttcaatttg

SEQ ID NO: 290166 - DNA, 20 bp, Artificial Sequence
  chemically synthesized
aatcgttcaatttgaggttg

SEQ ID NO: 290167 - DNA, 20 bp, Artificial Sequence
  chemically synthesized
atttgaggttgaagacctga

SEQ ID NO: 290168 - DNA, 20 bp, Artificial Sequence
  chemically synthesized
gaggttgaagacctgatagc

SEQ ID NO: 290169 - DNA, 20 bp, Artificial Sequence
  chemically synthesized
gatgaagtcaaccggctatc

SEQ ID NO: 290170 - DNA, 20 bp, Artificial Sequence
  chemically synthesized
ggatgaagtcaaccggctat

SEQ ID NO: 290171 - DNA, 20 bp, Artificial Sequence
  chemically synthesized
tggcacaggatgaagtcaac

SEQ ID NO: 290172 - DNA, 20 bp, Artificial Sequence
  chemically synthesized
atactctatggcacaggatg

SEQ ID NO: 290173 - DNA, 20 bp, Artificial Sequence
  chemically synthesized
gttgacttcatcctgtgcca

SEQ ID NO: 290174 - DNA, 20 bp, Artificial Sequence
  chemically synthesized
ctttccatactctatggcac

SEQ ID NO: 290175 - DNA, 20 bp, Artificial Sequence
  chemically synthesized
tgacttcatcctgtgccata

SEQ ID NO: 290176 - DNA, 20 bp, Artificial Sequence
  chemically synthesized
actttccatactctatggca

SEQ ID NO: 290177 - DNA, 20 bp, Artificial Sequence
  chemically synthesized
tcatcctgtgccatagagta

SEQ ID NO: 290178 - DNA, 20 bp, Artificial Sequence
  chemically synthesized
tacttactttccatactcta

SEQ ID NO: 290179 - DNA, 20 bp, Artificial Sequence
  chemically synthesized
cctgtgccatagagtatgga

SEQ ID NO: 290180 - DNA, 20 bp, Artificial Sequence
  chemically synthesized
tgccatagagtatggaaagt

SEQ ID NO: 290181 - DNA, 20 bp, Artificial Sequence
  chemically synthesized
tgcaaaatgtaatgtatgca

SEQ ID NO: 290182 - DNA, 20 bp, Artificial Sequence
  chemically synthesized
gcatacattacattttgcaa

SEQ ID NO: 290183 - DNA, 20 bp, Artificial Sequence
  chemically synthesized
tacattacattttgcaaaag

SEQ ID NO: 290184 - DNA, 20 bp, Artificial Sequence
  chemically synthesized
acattacattttgcaaaaga

SEQ ID NO: 290185 - DNA, 20 bp, Artificial Sequence
  chemically synthesized
ttgcaaaagaaggtattaaa

SEQ ID NO: 290186 - DNA, 20 bp, Artificial Sequence
  chemically synthesized
caaaagaaggtattaaaaag

SEQ ID NO: 290187 - DNA, 20 bp, Artificial Sequence
  chemically synthesized
agaaggtattaaaaagcagt

SEQ ID NO: 290188 - DNA, 20 bp, Artificial Sequence
  chemically synthesized
gaaggtattaaaaagcagta

SEQ ID NO: 290189 - DNA, 20 bp, Artificial Sequence
  chemically synthesized
gtattaaaaagcagtaaggc

SEQ ID NO: 290190 - DNA, 20 bp, Artificial Sequence
  chemically synthesized
aaaaagcagtaaggcaagtt

SEQ ID NO: 290191 - DNA, 20 bp, Artificial Sequence
  chemically synthesized
agatatttgtgaagggtatt

SEQ ID NO: 290192 - DNA, 20 bp, Artificial Sequence
  chemically synthesized
tcttatcagatatttgtgaa

SEQ ID NO: 290193 - DNA, 20 bp, Artificial Sequence
  chemically synthesized
ttcttatcagatatttgtga

SEQ ID NO: 290194 - DNA, 20 bp, Artificial Sequence
  chemically synthesized
tttcttatcagatatttgtg

SEQ ID NO: 290195 - DNA, 20 bp, Artificial Sequence
  chemically synthesized
acccttcacaaatatctgat

SEQ ID NO: 290196 - DNA, 20 bp, Artificial Sequence
  chemically synthesized
ctgtcatggatgtttcttat

SEQ ID NO: 290197 - DNA, 20 bp, Artificial Sequence
  chemically synthesized
ctgataagaaacatccatga

SEQ ID NO: 290198 - DNA, 20 bp, Artificial Sequence
  chemically synthesized
gaggcttgtctatactgtca

SEQ ID NO: 290199 - DNA, 20 bp, Artificial Sequence
  chemically synthesized
aagaaacatccatgacagta

SEQ ID NO: 290200 - DNA, 20 bp, Artificial Sequence
  chemically synthesized
acatccatgacagtatagac

SEQ ID NO: 290201 - DNA, 20 bp, Artificial Sequence
  chemically synthesized
tatagacaagcctctatcac

SEQ ID NO: 290202 - DNA, 20 bp, Artificial Sequence
  chemically synthesized
aaatgtatggctggtgatag

SEQ ID NO: 290203 - DNA, 20 bp, Artificial Sequence
  chemically synthesized
taaatgtatggctggtgata

SEQ ID NO: 290204 - DNA, 20 bp, Artificial Sequence
  chemically synthesized
cttaaatgtatggctggtga

SEQ ID NO: 290205 - DNA, 20 bp, Artificial Sequence
  chemically synthesized
ggtatccttaaatgtatggc

SEQ ID NO: 290206 - DNA, 20 bp, Artificial Sequence
  chemically synthesized
ctatcaccagccatacattt

SEQ ID NO: 290207 - DNA, 20 bp, Artificial Sequence
  chemically synthesized
ccaaggtatccttaaatgta

SEQ ID NO: 290208 - DNA, 20 bp, Artificial Sequence
  chemically synthesized
tatcaccagccatacattta

SEQ ID NO: 290209 - DNA, 20 bp, Artificial Sequence
  chemically synthesized
ccatacatttaaggatacct

SEQ ID NO: 290210 - DNA, 20 bp, Artificial Sequence
  chemically synthesized
acatattgaacaaagagcca

SEQ ID NO: 290211 - DNA, 20 bp, Artificial Sequence
  chemically synthesized
tacatattgaacaaagagcc

SEQ ID NO: 290212 - DNA, 20 bp, Artificial Sequence
  chemically synthesized
gatgatacatattgaacaaa

SEQ ID NO: 290213 - DNA, 20 bp, Artificial Sequence
  chemically synthesized
aggatgatacatattgaaca

SEQ ID NO: 290214 - DNA, 20 bp, Artificial Sequence
  chemically synthesized
aaatttaaatatcattatat

SEQ ID NO: 290215 - DNA, 20 bp, Artificial Sequence
  chemically synthesized
gaaatttaaatatcattata

SEQ ID NO: 290216 - DNA, 20 bp, Artificial Sequence
  chemically synthesized
tataatgatatttaaatttc

SEQ ID NO: 290217 - DNA, 20 bp, Artificial Sequence
  chemically synthesized
aatttcaagatgacataatt

SEQ ID NO: 290218 - DNA, 20 bp, Artificial Sequence
  chemically synthesized
tttcaagatgacataattta

SEQ ID NO: 290219 - DNA, 20 bp, Artificial Sequence
  chemically synthesized
gacataatttagagcattaa

SEQ ID NO: 290220 - DNA, 20 bp, Artificial Sequence
  chemically synthesized
acataatttagagcattaat

SEQ ID NO: 290221 - DNA, 20 bp, Artificial Sequence
  chemically synthesized
ttaatgggtatgaatgcgta

SEQ ID NO: 290222 - DNA, 20 bp, Artificial Sequence
  chemically synthesized
atgggtatgaatgcgtacag

SEQ ID NO: 290223 - DNA, 20 bp, Artificial Sequence
  chemically synthesized
aaaggatttaaggtcatgca

SEQ ID NO: 290224 - DNA, 20 bp, Artificial Sequence
  chemically synthesized
tgatttatggaaaggattta

SEQ ID NO: 290225 - DNA, 20 bp, Artificial Sequence
  chemically synthesized
ttgatttatggaaaggattt

SEQ ID NO: 290226 - DNA, 20 bp, Artificial Sequence
  chemically synthesized
cctatatttgatttatggaa

SEQ ID NO: 290227 - DNA, 20 bp, Artificial Sequence
  chemically synthesized
acctatatttgatttatgga

SEQ ID NO: 290228 - DNA, 20 bp, Artificial Sequence
  chemically synthesized
aaacacctatatttgattta

SEQ ID NO: 290229 - DNA, 20 bp, Artificial Sequence
  chemically synthesized
tcctttccataaatcaaata

SEQ ID NO: 290230 - DNA, 20 bp, Artificial Sequence
  chemically synthesized
cctttccataaatcaaatat

SEQ ID NO: 290231 - DNA, 20 bp, Artificial Sequence
  chemically synthesized
ataaatcaaatataggtgtt

SEQ ID NO: 290232 - DNA, 20 bp, Artificial Sequence
  chemically synthesized
attttgatataagaggggtg

SEQ ID NO: 290233 - DNA, 20 bp, Artificial Sequence
  chemically synthesized
acatcattttgatataagag

SEQ ID NO: 290234 - DNA, 20 bp, Artificial Sequence
  chemically synthesized
cacatcattttgatataaga

SEQ ID NO: 290235 - DNA, 20 bp, Artificial Sequence
  chemically synthesized
gcacatcattttgatataag

SEQ ID NO: 290236 - DNA, 20 bp, Artificial Sequence
  chemically synthesized
cgcacatcattttgatataa

SEQ ID NO: 290237 - DNA, 20 bp, Artificial Sequence
  chemically synthesized
agcgcacatcattttgatat

SEQ ID NO: 290238 - DNA, 20 bp, Artificial Sequence
  chemically synthesized
gtgagcttaaaatttgaagc

SEQ ID NO: 290239 - DNA, 20 bp, Artificial Sequence
  chemically synthesized
ttgagtgagcttaaaatttg

SEQ ID NO: 290240 - DNA, 20 bp, Artificial Sequence
  chemically synthesized
gtgcgcttgcttcaaatttt

SEQ ID NO: 290241 - DNA, 20 bp, Artificial Sequence
  chemically synthesized
gaaaatattgttcattgagt

SEQ ID NO: 290242 - DNA, 20 bp, Artificial Sequence
  chemically synthesized
aagagaaaatattgttcatt

SEQ ID NO: 290243 - DNA, 20 bp, Artificial Sequence
  chemically synthesized
tatattttgcagaaatgaaa

SEQ ID NO: 290244 - DNA, 20 bp, Artificial Sequence
  chemically synthesized
tttatattttgcagaaatga

SEQ ID NO: 290245 - DNA, 20 bp, Artificial Sequence
  chemically synthesized
tatatgtaatttatattttg

SEQ ID NO: 290246 - DNA, 20 bp, Artificial Sequence
  chemically synthesized
atacacatatacatatatgt

SEQ ID NO: 290247 - DNA, 20 bp, Artificial Sequence
  chemically synthesized
tatacacatatacatatatg

SEQ ID NO: 290248 - DNA, 20 bp, Artificial Sequence
  chemically synthesized
tcaaaatatatttataatta

SEQ ID NO: 290249 - DNA, 20 bp, Artificial Sequence
  chemically synthesized
tatattttgatacaattata

SEQ ID NO: 290250 - DNA, 20 bp, Artificial Sequence
  chemically synthesized
acatatgtataagtattata

SEQ ID NO: 290251 - DNA, 20 bp, Artificial Sequence
  chemically synthesized
gtgtgtacatacatatgtat

SEQ ID NO: 290252 - DNA, 20 bp, Artificial Sequence
  chemically synthesized
atagatatatttttatattt

SEQ ID NO: 290253 - DNA, 20 bp, Artificial Sequence
  chemically synthesized
tatagatatatttttatatt

SEQ ID NO: 290254 - DNA, 20 bp, Artificial Sequence
  chemically synthesized
atacaaaacatagaagatta

SEQ ID NO: 290255 - DNA, 20 bp, Artificial Sequence
  chemically synthesized
tgagaccatacaaaacatag

SEQ ID NO: 290256 - DNA, 20 bp, Artificial Sequence
  chemically synthesized
taatgagaccatacaaaaca

SEQ ID NO: 290257 - DNA, 20 bp, Artificial Sequence
  chemically synthesized
ataatcttctatgttttgta

SEQ ID NO: 290258 - DNA, 20 bp, Artificial Sequence
  chemically synthesized
gtttggtcaggagaagtaat

SEQ ID NO: 290259 - DNA, 20 bp, Artificial Sequence
  chemically synthesized
gttgcctgtttggtcaggag

SEQ ID NO: 290260 - DNA, 20 bp, Artificial Sequence
  chemically synthesized
gtggttgcctgtttggtcag

SEQ ID NO: 290261 - DNA, 20 bp, Artificial Sequence
  chemically synthesized
cattacttctcctgaccaaa

SEQ ID NO: 290262 - DNA, 20 bp, Artificial Sequence
  chemically synthesized
cagtggttgcctgtttggtc

SEQ ID NO: 290263 - DNA, 20 bp, Artificial Sequence
  chemically synthesized
attacttctcctgaccaaac

SEQ ID NO: 290264 - DNA, 20 bp, Artificial Sequence
  chemically synthesized
gcagtggttgcctgtttggt

SEQ ID NO: 290265 - DNA, 20 bp, Artificial Sequence
  chemically synthesized
aaaagcagtggttgcctgtt

SEQ ID NO: 290266 - DNA, 20 bp, Artificial Sequence
  chemically synthesized
aaaaaaaaaaaaaaaagcag

SEQ ID NO: 290267 - DNA, 20 bp, Artificial Sequence
  chemically synthesized
aaaaaaaaaaaaaaaaaaag

SEQ ID NO: 290268 - DNA, 20 bp, Artificial Sequence
  chemically synthesized
aaaaaaaaaaaaaaaaaaaa

SEQ ID NO: 290269 - DNA, 20 bp, Artificial Sequence
  chemically synthesized
tttttttttttttttttttt

SEQ ID NO: 290270 - DNA, 20 bp, Artificial Sequence
  chemically synthesized
tttttttttttttttttttt

SEQ ID NO: 290271 - DNA, 20 bp, Artificial Sequence
  chemically synthesized
ttttttttttttttttggga

SEQ ID NO: 290272 - DNA, 20 bp, Artificial Sequence
  chemically synthesized
ttttttttttttttgggaca

SEQ ID NO: 290273 - DNA, 20 bp, Artificial Sequence
  chemically synthesized
ccagcctgggcaacaagagc

SEQ ID NO: 290274 - DNA, 20 bp, Artificial Sequence
  chemically synthesized
cactccagcctgggcaacaa

SEQ ID NO: 290275 - DNA, 20 bp, Artificial Sequence
  chemically synthesized
agagtctcgctcttgttgcc

SEQ ID NO: 290276 - DNA, 20 bp, Artificial Sequence
  chemically synthesized
gagtctcgctcttgttgccc

SEQ ID NO: 290277 - DNA, 20 bp, Artificial Sequence
  chemically synthesized
tgcactccagcctgggcaac

SEQ ID NO: 290278 - DNA, 20 bp, Artificial Sequence
  chemically synthesized
ctcgctcttgttgcccaggc

SEQ ID NO: 290279 - DNA, 20 bp, Artificial Sequence
  chemically synthesized
cgctcttgttgcccaggctg

SEQ ID NO: 290280 - DNA, 20 bp, Artificial Sequence
  chemically synthesized
gcgtcattgcactccagcct

SEQ ID NO: 290281 - DNA, 20 bp, Artificial Sequence
  chemically synthesized
cgcgtcattgcactccagcc

SEQ ID NO: 290282 - DNA, 20 bp, Artificial Sequence
  chemically synthesized
aagatcgcgtcattgcactc

SEQ ID NO: 290283 - DNA, 20 bp, Artificial Sequence
  chemically synthesized
ggagtgcaatgacgcgatct

SEQ ID NO: 290284 - DNA, 20 bp, Artificial Sequence
  chemically synthesized
tgtgaaggttgcatttggcc

SEQ ID NO: 290285 - DNA, 20 bp, Artificial Sequence
  chemically synthesized
tggaatgtgaaggttgcatt

SEQ ID NO: 290286 - DNA, 20 bp, Artificial Sequence
  chemically synthesized
cgcttgaacctggaatgtga

SEQ ID NO: 290287 - DNA, 20 bp, Artificial Sequence
  chemically synthesized
caaatgcaaccttcacattc

SEQ ID NO: 290288 - DNA, 20 bp, Artificial Sequence
  chemically synthesized
tcgcttgaacctggaatgtg

SEQ ID NO: 290289 - DNA, 20 bp, Artificial Sequence
  chemically synthesized
aaatgcaaccttcacattcc

SEQ ID NO: 290290 - DNA, 20 bp, Artificial Sequence
  chemically synthesized
aaccttcacattccaggttc

SEQ ID NO: 290291 - DNA, 20 bp, Artificial Sequence
  chemically synthesized
gcagaagaatcgcttgaacc

SEQ ID NO: 290292 - DNA, 20 bp, Artificial Sequence
  chemically synthesized
ttcaagcgattcttctgcct

SEQ ID NO: 290293 - DNA, 20 bp, Artificial Sequence
  chemically synthesized
tactcaggaggctgaggcag

SEQ ID NO: 290294 - DNA, 20 bp, Artificial Sequence
  chemically synthesized
agctactcaggaggctgagg

SEQ ID NO: 290295 - DNA, 20 bp, Artificial Sequence
  chemically synthesized
cccagctactcaggaggctg

SEQ ID NO: 290296 - DNA, 20 bp, Artificial Sequence
  chemically synthesized
tcccagctactcaggaggct

SEQ ID NO: 290297 - DNA, 20 bp, Artificial Sequence
  chemically synthesized
ttcttctgcctcagcctcct

SEQ ID NO: 290298 - DNA, 20 bp, Artificial Sequence
  chemically synthesized
ttctgcctcagcctcctgag

SEQ ID NO: 290299 - DNA, 20 bp, Artificial Sequence
  chemically synthesized
tgtaatcccagctactcagg

SEQ ID NO: 290300 - DNA, 20 bp, Artificial Sequence
  chemically synthesized
ctgtaatcccagctactcag

SEQ ID NO: 290301 - DNA, 20 bp, Artificial Sequence
  chemically synthesized
gcctcagcctcctgagtagc

SEQ ID NO: 290302 - DNA, 20 bp, Artificial Sequence
  chemically synthesized
acctgtaatcccagctactc

SEQ ID NO: 290303 - DNA, 20 bp, Artificial Sequence
  chemically synthesized
cctcagcctcctgagtagct

SEQ ID NO: 290304 - DNA, 20 bp, Artificial Sequence
  chemically synthesized
cacctgtaatcccagctact

SEQ ID NO: 290305 - DNA, 20 bp, Artificial Sequence
  chemically synthesized
ctcctgagtagctgggatta

SEQ ID NO: 290306 - DNA, 20 bp, Artificial Sequence
  chemically synthesized
tcctgagtagctgggattac

SEQ ID NO: 290307 - DNA, 20 bp, Artificial Sequence
  chemically synthesized
gtagcgggcacctgtaatcc

SEQ ID NO: 290308 - DNA, 20 bp, Artificial Sequence
  chemically synthesized
aatttgctggacacggtagc

SEQ ID NO: 290309 - DNA, 20 bp, Artificial Sequence
  chemically synthesized
aaatttgctggacacggtag

SEQ ID NO: 290310 - DNA, 20 bp, Artificial Sequence
  chemically synthesized
caggtgcccgctaccgtgtc

SEQ ID NO: 290311 - DNA, 20 bp, Artificial Sequence
  chemically synthesized
aaaaaatttgctggacacgg

SEQ ID NO: 290312 - DNA, 20 bp, Artificial Sequence
  chemically synthesized
taaaaaaaatttgctggaca

SEQ ID NO: 290313 - DNA, 20 bp, Artificial Sequence
  chemically synthesized
taaaaataaaaaaaatttgc

SEQ ID NO: 290314 - DNA, 20 bp, Artificial Sequence
  chemically synthesized
cagcaaattttttttatttt

SEQ ID NO: 290315 - DNA, 20 bp, Artificial Sequence
  chemically synthesized
caaattttttttatttttag

SEQ ID NO: 290316 - DNA, 20 bp, Artificial Sequence
  chemically synthesized
aattttttttatttttagta

SEQ ID NO: 290317 - DNA, 20 bp, Artificial Sequence
  chemically synthesized
ttttttatttttagtagaga

SEQ ID NO: 290318 - DNA, 20 bp, Artificial Sequence
  chemically synthesized
ttttatttttagtagagatg

SEQ ID NO: 290319 - DNA, 20 bp, Artificial Sequence
  chemically synthesized
tagagatggagtttcactgt

SEQ ID NO: 290320 - DNA, 20 bp, Artificial Sequence
  chemically synthesized
gatggagtttcactgttggc

SEQ ID NO: 290321 - DNA, 20 bp, Artificial Sequence
  chemically synthesized
atggagtttcactgttggcc

SEQ ID NO: 290322 - DNA, 20 bp, Artificial Sequence
  chemically synthesized
tttgagaccagcctggccaa

SEQ ID NO: 290323 - DNA, 20 bp, Artificial Sequence
  chemically synthesized
agtttcactgttggccaggc

SEQ ID NO: 290324 - DNA, 20 bp, Artificial Sequence
  chemically synthesized
tcagcagtttgagaccagcc

SEQ ID NO: 290325 - DNA, 20 bp, Artificial Sequence
  chemically synthesized
tgaggtcagcagtttgagac

SEQ ID NO: 290326 - DNA, 20 bp, Artificial Sequence
  chemically synthesized
gatcatgaggtcagcagttt

SEQ ID NO: 290327 - DNA, 20 bp, Artificial Sequence
  chemically synthesized
tgggtggatcatgaggtcag

SEQ ID NO: 290328 - DNA, 20 bp, Artificial Sequence
  chemically synthesized
aggtgggtggatcatgaggt

SEQ ID NO: 290329 - DNA, 20 bp, Artificial Sequence
  chemically synthesized
gccaaggtgggtggatcatg

SEQ ID NO: 290330 - DNA, 20 bp, Artificial Sequence
  chemically synthesized
ggccaaggtgggtggatcat

SEQ ID NO: 290331 - DNA, 20 bp, Artificial Sequence
  chemically synthesized
acctcatgatccacccacct

SEQ ID NO: 290332 - DNA, 20 bp, Artificial Sequence
  chemically synthesized
ctttgggaggccaaggtggg

SEQ ID NO: 290333 - DNA, 20 bp, Artificial Sequence
  chemically synthesized
gcactttgggaggccaaggt

SEQ ID NO: 290334 - DNA, 20 bp, Artificial Sequence
  chemically synthesized
agcactttgggaggccaagg

SEQ ID NO: 290335 - DNA, 20 bp, Artificial Sequence
  chemically synthesized
cccagcactttgggaggcca

SEQ ID NO: 290336 - DNA, 20 bp, Artificial Sequence
  chemically synthesized
tcccagcactttgggaggcc

SEQ ID NO: 290337 - DNA, 20 bp, Artificial Sequence
  chemically synthesized
ccacccaccttggcctccca

SEQ ID NO: 290338 - DNA, 20 bp, Artificial Sequence
  chemically synthesized
tgtaatcccagcactttggg

SEQ ID NO: 290339 - DNA, 20 bp, Artificial Sequence
  chemically synthesized
ctgtaatcccagcactttgg

SEQ ID NO: 290340 - DNA, 20 bp, Artificial Sequence
  chemically synthesized
accttggcctcccaaagtgc

SEQ ID NO: 290341 - DNA, 20 bp, Artificial Sequence
  chemically synthesized
acctgtaatcccagcacttt

SEQ ID NO: 290342 - DNA, 20 bp, Artificial Sequence
  chemically synthesized
ccttggcctcccaaagtgct

SEQ ID NO: 290343 - DNA, 20 bp, Artificial Sequence
  chemically synthesized
cacctgtaatcccagcactt

SEQ ID NO: 290344 - DNA, 20 bp, Artificial Sequence
  chemically synthesized
ctcccaaagtgctgggatta

SEQ ID NO: 290345 - DNA, 20 bp, Artificial Sequence
  chemically synthesized
tcccaaagtgctgggattac

SEQ ID NO: 290346 - DNA, 20 bp, Artificial Sequence
  chemically synthesized
gtggctcacacctgtaatcc

SEQ ID NO: 290347 - DNA, 20 bp, Artificial Sequence
  chemically synthesized
agtgctgggattacaggtgt

SEQ ID NO: 290348 - DNA, 20 bp, Artificial Sequence
  chemically synthesized
caggtgtgagccaccgcgcc

SEQ ID NO: 290349 - DNA, 20 bp, Artificial Sequence
  chemically synthesized
tggcaattggctgggcgcgg

SEQ ID NO: 290350 - DNA, 20 bp, Artificial Sequence
  chemically synthesized
aagtggcaattggctgggcg

SEQ ID NO: 290351 - DNA, 20 bp, Artificial Sequence
  chemically synthesized
ttaaaaagtggcaattggct

SEQ ID NO: 290352 - DNA, 20 bp, Artificial Sequence
  chemically synthesized
tttaaaaagtggcaattggc

SEQ ID NO: 290353 - DNA, 20 bp, Artificial Sequence
  chemically synthesized
gtaatttaaaaagtggcaat

SEQ ID NO: 290354 - DNA, 20 bp, Artificial Sequence
  chemically synthesized
agccaccgtaatttaaaaag

SEQ ID NO: 290355 - DNA, 20 bp, Artificial Sequence
  chemically synthesized
gacagccaccgtaatttaaa

SEQ ID NO: 290356 - DNA, 20 bp, Artificial Sequence
  chemically synthesized
aattgccactttttaaatta

SEQ ID NO: 290357 - DNA, 20 bp, Artificial Sequence
  chemically synthesized
tgccactttttaaattacgg

SEQ ID NO: 290358 - DNA, 20 bp, Artificial Sequence
  chemically synthesized
tttaaattacggtggctgtc

SEQ ID NO: 290359 - DNA, 20 bp, Artificial Sequence
  chemically synthesized
ttaaattacggtggctgtcc

SEQ ID NO: 290360 - DNA, 20 bp, Artificial Sequence
  chemically synthesized
acaacaagaggaaacctgga

SEQ ID NO: 290361 - DNA, 20 bp, Artificial Sequence
  chemically synthesized
caggacaacaagaggaaacc

SEQ ID NO: 290362 - DNA, 20 bp, Artificial Sequence
  chemically synthesized
aattatgccaggacaacaag

SEQ ID NO: 290363 - DNA, 20 bp, Artificial Sequence
  chemically synthesized
taattatgccaggacaacaa

SEQ ID NO: 290364 - DNA, 20 bp, Artificial Sequence
  chemically synthesized
caggtttcctcttgttgtcc

SEQ ID NO: 290365 - DNA, 20 bp, Artificial Sequence
  chemically synthesized
aataattatgccaggacaac

SEQ ID NO: 290366 - DNA, 20 bp, Artificial Sequence
  chemically synthesized
gtgctactaataattatgcc

SEQ ID NO: 290367 - DNA, 20 bp, Artificial Sequence
  chemically synthesized
ggtgctactaataattatgc

SEQ ID NO: 290368 - DNA, 20 bp, Artificial Sequence
  chemically synthesized
tgttgtcctggcataattat

SEQ ID NO: 290369 - DNA, 20 bp, Artificial Sequence
  chemically synthesized
tgtcctggcataattattag

SEQ ID NO: 290370 - DNA, 20 bp, Artificial Sequence
  chemically synthesized
gtactactgagagtgaaaca

SEQ ID NO: 290371 - DNA, 20 bp, Artificial Sequence
  chemically synthesized
ggtactactgagagtgaaac

SEQ ID NO: 290372 - DNA, 20 bp, Artificial Sequence
  chemically synthesized
gggtactactgagagtgaaa

SEQ ID NO: 290373 - DNA, 20 bp, Artificial Sequence
  chemically synthesized
gtagcaccctgtttcactct

SEQ ID NO: 290374 - DNA, 20 bp, Artificial Sequence
  chemically synthesized
gcaccctgtttcactctcag

SEQ ID NO: 290375 - DNA, 20 bp, Artificial Sequence
  chemically synthesized
acaaaccagggtactactga

SEQ ID NO: 290376 - DNA, 20 bp, Artificial Sequence
  chemically synthesized
atacaaaccagggtactact

SEQ ID NO: 290377 - DNA, 20 bp, Artificial Sequence
  chemically synthesized
tttcactctcagtagtaccc

SEQ ID NO: 290378 - DNA, 20 bp, Artificial Sequence
  chemically synthesized
tgattttatcatacaaacca

SEQ ID NO: 290379 - DNA, 20 bp, Artificial Sequence
  chemically synthesized
gtgattttatcatacaaacc

SEQ ID NO: 290380 - DNA, 20 bp, Artificial Sequence
  chemically synthesized
tgtgattttatcatacaaac

SEQ ID NO: 290381 - DNA, 20 bp, Artificial Sequence
  chemically synthesized
atgagctagtgacagtacag

SEQ ID NO: 290382 - DNA, 20 bp, Artificial Sequence
  chemically synthesized
cacatgagctagtgacagta

SEQ ID NO: 290383 - DNA, 20 bp, Artificial Sequence
  chemically synthesized
gaacactgctgtactgtcac

SEQ ID NO: 290384 - DNA, 20 bp, Artificial Sequence
  chemically synthesized
gttgccacatgagctagtga

SEQ ID NO: 290385 - DNA, 20 bp, Artificial Sequence
  chemically synthesized
tgtactgtcactagctcatg

SEQ ID NO: 290386 - DNA, 20 bp, Artificial Sequence
  chemically synthesized
tgcccagttgccacatgagc

SEQ ID NO: 290387 - DNA, 20 bp, Artificial Sequence
  chemically synthesized
caggtgcccagttgccacat

SEQ ID NO: 290388 - DNA, 20 bp, Artificial Sequence
  chemically synthesized
tcactagctcatgtggcaac

SEQ ID NO: 290389 - DNA, 20 bp, Artificial Sequence
  chemically synthesized
cactagctcatgtggcaact

SEQ ID NO: 290390 - DNA, 20 bp, Artificial Sequence
  chemically synthesized
ccagccacatttcaggtgcc

SEQ ID NO: 290391 - DNA, 20 bp, Artificial Sequence
  chemically synthesized
gcaactgggcacctgaaatg

SEQ ID NO: 290392 - DNA, 20 bp, Artificial Sequence
  chemically synthesized
atttggaccagccacatttc

SEQ ID NO: 290393 - DNA, 20 bp, Artificial Sequence
  chemically synthesized
aatttggaccagccacattt

SEQ ID NO: 290394 - DNA, 20 bp, Artificial Sequence
  chemically synthesized
ctgggcacctgaaatgtggc

SEQ ID NO: 290395 - DNA, 20 bp, Artificial Sequence
  chemically synthesized
tcatgcatctaaatttggac

SEQ ID NO: 290396 - DNA, 20 bp, Artificial Sequence
  chemically synthesized
aaatgtggctggtccaaatt

SEQ ID NO: 290397 - DNA, 20 bp, Artificial Sequence
  chemically synthesized
taatttcatgcatctaaatt

SEQ ID NO: 290398 - DNA, 20 bp, Artificial Sequence
  chemically synthesized
cttcagaattaaacatattt

SEQ ID NO: 290399 - DNA, 20 bp, Artificial Sequence
  chemically synthesized
ccaaaatatgtttaattctg

SEQ ID NO: 290400 - DNA, 20 bp, Artificial Sequence
  chemically synthesized
tatgtttaattctgaagatt

SEQ ID NO: 290401 - DNA, 20 bp, Artificial Sequence
  chemically synthesized
tcttagcttttcttaatctt

SEQ ID NO: 290402 - DNA, 20 bp, Artificial Sequence
  chemically synthesized
ttaattctgaagattaagaa

SEQ ID NO: 290403 - DNA, 20 bp, Artificial Sequence
  chemically synthesized
tctgaagattaagaaaagct

SEQ ID NO: 290404 - DNA, 20 bp, Artificial Sequence
  chemically synthesized
aaactttgagattatgttct

SEQ ID NO: 290405 - DNA, 20 bp, Artificial Sequence
  chemically synthesized
aagctaagaacataatctca

SEQ ID NO: 290406 - DNA, 20 bp, Artificial Sequence
  chemically synthesized
aatcagtatttaaaaacttt

SEQ ID NO: 290407 - DNA, 20 bp, Artificial Sequence
  chemically synthesized
atattatttgaaagtgtaat

SEQ ID NO: 290408 - DNA, 20 bp, Artificial Sequence
  chemically synthesized
tcatcaaaaatattatttga

SEQ ID NO: 290409 - DNA, 20 bp, Artificial Sequence
  chemically synthesized
aaataatatttttgatgaat

SEQ ID NO: 290410 - DNA, 20 bp, Artificial Sequence
  chemically synthesized
aataatatttttgatgaatc

SEQ ID NO: 290411 - DNA, 20 bp, Artificial Sequence
  chemically synthesized
aaacggtaattgaatttcaa

SEQ ID NO: 290412 - DNA, 20 bp, Artificial Sequence
  chemically synthesized
attaggaaaggaaaaagaaa

SEQ ID NO: 290413 - DNA, 20 bp, Artificial Sequence
  chemically synthesized
aactatattaggaaaggaaa

SEQ ID NO: 290414 - DNA, 20 bp, Artificial Sequence
  chemically synthesized
tctagaaactatattaggaa

SEQ ID NO: 290415 - DNA, 20 bp, Artificial Sequence
  chemically synthesized
gtctagaaactatattagga

SEQ ID NO: 290416 - DNA, 20 bp, Artificial Sequence
  chemically synthesized
ttctttttcctttcctaata

SEQ ID NO: 290417 - DNA, 20 bp, Artificial Sequence
  chemically synthesized
aatggtctagaaactatatt

SEQ ID NO: 290418 - DNA, 20 bp, Artificial Sequence
  chemically synthesized
aaatggtctagaaactatat

SEQ ID NO: 290419 - DNA, 20 bp, Artificial Sequence
  chemically synthesized
tcctttcctaatatagtttc

SEQ ID NO: 290420 - DNA, 20 bp, Artificial Sequence
  chemically synthesized
atatgtaatttaaaatggtc

SEQ ID NO: 290421 - DNA, 20 bp, Artificial Sequence
  chemically synthesized
gccacatatgtaatttaaaa

SEQ ID NO: 290422 - DNA, 20 bp, Artificial Sequence
  chemically synthesized
accattttaaattacatatg

SEQ ID NO: 290423 - DNA, 20 bp, Artificial Sequence
  chemically synthesized
acatatgtggcttgaatttg

SEQ ID NO: 290424 - DNA, 20 bp, Artificial Sequence
  chemically synthesized
acagtgctagccacaaattc

SEQ ID NO: 290425 - DNA, 20 bp, Artificial Sequence
  chemically synthesized
atgtggcttgaatttgtggc

SEQ ID NO: 290426 - DNA, 20 bp, Artificial Sequence
  chemically synthesized
gtccaaaagaaatacagtgc

SEQ ID NO: 290427 - DNA, 20 bp, Artificial Sequence
  chemically synthesized
gtcattgtccaaaagaaata

SEQ ID NO: 290428 - DNA, 20 bp, Artificial Sequence
  chemically synthesized
ggctagcactgtatttcttt

SEQ ID NO: 290429 - DNA, 20 bp, Artificial Sequence
  chemically synthesized
tgaagaaagtcattgtccaa

SEQ ID NO: 290430 - DNA, 20 bp, Artificial Sequence
  chemically synthesized
ttggacaatgactttcttca

SEQ ID NO: 290431 - DNA, 20 bp, Artificial Sequence
  chemically synthesized
tttttccaattctgtgaaga

SEQ ID NO: 290432 - DNA, 20 bp, Artificial Sequence
  chemically synthesized
tagttttttccaattctgtg

SEQ ID NO: 290433 - DNA, 20 bp, Artificial Sequence
  chemically synthesized
aatgactttcttcacagaat

SEQ ID NO: 290434 - DNA, 20 bp, Artificial Sequence
  chemically synthesized
aattggaaaaaactacttta

SEQ ID NO: 290435 - DNA, 20 bp, Artificial Sequence
  chemically synthesized
gttccatatgaactttaaag

SEQ ID NO: 290436 - DNA, 20 bp, Artificial Sequence
  chemically synthesized
ttggttccatatgaacttta

SEQ ID NO: 290437 - DNA, 20 bp, Artificial Sequence
  chemically synthesized
aaactactttaaagttcata

SEQ ID NO: 290438 - DNA, 20 bp, Artificial Sequence
  chemically synthesized
aagttcatatggaaccaaaa

SEQ ID NO: 290439 - DNA, 20 bp, Artificial Sequence
  chemically synthesized
gttcatatggaaccaaaaaa

SEQ ID NO: 290440 - DNA, 20 bp, Artificial Sequence
  chemically synthesized
tggcgatgcgggctcttttt

SEQ ID NO: 290441 - DNA, 20 bp, Artificial Sequence
  chemically synthesized
taggattgacttggcgatgc

SEQ ID NO: 290442 - DNA, 20 bp, Artificial Sequence
  chemically synthesized
aaaaaagagcccgcatcgcc

SEQ ID NO: 290443 - DNA, 20 bp, Artificial Sequence
  chemically synthesized
ttaggattgacttggcgatg

SEQ ID NO: 290444 - DNA, 20 bp, Artificial Sequence
  chemically synthesized
ctgttggcttaggattgact

SEQ ID NO: 290445 - DNA, 20 bp, Artificial Sequence
  chemically synthesized
cgcatcgccaagtcaatcct

SEQ ID NO: 290446 - DNA, 20 bp, Artificial Sequence
  chemically synthesized
ccaagtcaatcctaagccaa

SEQ ID NO: 290447 - DNA, 20 bp, Artificial Sequence
  chemically synthesized
cagctttgtcctgttggctt

SEQ ID NO: 290448 - DNA, 20 bp, Artificial Sequence
  chemically synthesized
caagtcaatcctaagccaac

SEQ ID NO: 290449 - DNA, 20 bp, Artificial Sequence
  chemically synthesized
ccagctttgtcctgttggct

SEQ ID NO: 290450 - DNA, 20 bp, Artificial Sequence
  chemically synthesized
tgcctccagctttgtcctgt

SEQ ID NO: 290451 - DNA, 20 bp, Artificial Sequence
  chemically synthesized
aatcctaagccaacaggaca

SEQ ID NO: 290452 - DNA, 20 bp, Artificial Sequence
  chemically synthesized
ctaagccaacaggacaaagc

SEQ ID NO: 290453 - DNA, 20 bp, Artificial Sequence
  chemically synthesized
aagccaacaggacaaagctg

SEQ ID NO: 290454 - DNA, 20 bp, Artificial Sequence
  chemically synthesized
agccaacaggacaaagctgg

SEQ ID NO: 290455 - DNA, 20 bp, Artificial Sequence
  chemically synthesized
gtcaggtagtgtgatgcctc

SEQ ID NO: 290456 - DNA, 20 bp, Artificial Sequence
  chemically synthesized
tagtatagtttgaagtcagg

SEQ ID NO: 290457 - DNA, 20 bp, Artificial Sequence
  chemically synthesized
ttgtagtatagtttgaagtc

SEQ ID NO: 290458 - DNA, 20 bp, Artificial Sequence
  chemically synthesized
cttgtagtatagtttgaagt

SEQ ID NO: 290459 - DNA, 20 bp, Artificial Sequence
  chemically synthesized
tagccttgtagtatagtttg

SEQ ID NO: 290460 - DNA, 20 bp, Artificial Sequence
  chemically synthesized
ctgacttcaaactatactac

SEQ ID NO: 290461 - DNA, 20 bp, Artificial Sequence
  chemically synthesized
tgacttcaaactatactaca

SEQ ID NO: 290462 - DNA, 20 bp, Artificial Sequence
  chemically synthesized
gttactgtagccttgtagta

SEQ ID NO: 290463 - DNA, 20 bp, Artificial Sequence
  chemically synthesized
ttttggttactgtagccttg

SEQ ID NO: 290464 - DNA, 20 bp, Artificial Sequence
  chemically synthesized
caaactatactacaaggcta

SEQ ID NO: 290465 - DNA, 20 bp, Artificial Sequence
  chemically synthesized
ccatgctgttttggttactg

SEQ ID NO: 290466 - DNA, 20 bp, Artificial Sequence
  chemically synthesized
caaggctacagtaaccaaaa

SEQ ID NO: 290467 - DNA, 20 bp, Artificial Sequence
  chemically synthesized
gtaccagtaccatgctgttt

SEQ ID NO: 290468 - DNA, 20 bp, Artificial Sequence
  chemically synthesized
ctacagtaaccaaaacagca

SEQ ID NO: 290469 - DNA, 20 bp, Artificial Sequence
  chemically synthesized
taaccaaaacagcatggtac

SEQ ID NO: 290470 - DNA, 20 bp, Artificial Sequence
  chemically synthesized
ctatatctctgttttggtac

SEQ ID NO: 290471 - DNA, 20 bp, Artificial Sequence
  chemically synthesized
gcatggtactggtaccaaaa

SEQ ID NO: 290472 - DNA, 20 bp, Artificial Sequence
  chemically synthesized
atggtactggtaccaaaaca

SEQ ID NO: 290473 - DNA, 20 bp, Artificial Sequence
  chemically synthesized
attgatctatatctctgttt

SEQ ID NO: 290474 - DNA, 20 bp, Artificial Sequence
  chemically synthesized
ctggtaccaaaacagagata

SEQ ID NO: 290475 - DNA, 20 bp, Artificial Sequence
  chemically synthesized
aaaacagagatatagatcaa

SEQ ID NO: 290476 - DNA, 20 bp, Artificial Sequence
  chemically synthesized
agagatatagatcaatggaa

SEQ ID NO: 290477 - DNA, 20 bp, Artificial Sequence
  chemically synthesized
tatagatcaatggaacagaa

SEQ ID NO: 290478 - DNA, 20 bp, Artificial Sequence
  chemically synthesized
tagatcaatggaacagaaca

SEQ ID NO: 290479 - DNA, 20 bp, Artificial Sequence
  chemically synthesized
atggaacagaacagagccct

SEQ ID NO: 290480 - DNA, 20 bp, Artificial Sequence
  chemically synthesized
gtatgcggcgttatttctga

SEQ ID NO: 290481 - DNA, 20 bp, Artificial Sequence
  chemically synthesized
ggtatgcggcgttatttctg

SEQ ID NO: 290482 - DNA, 20 bp, Artificial Sequence
  chemically synthesized
aggtatgcggcgttatttct

SEQ ID NO: 290483 - DNA, 20 bp, Artificial Sequence
  chemically synthesized
atcagatagttgtaggtatg

SEQ ID NO: 290484 - DNA, 20 bp, Artificial Sequence
  chemically synthesized
gtcaaagatcagatagttgt

SEQ ID NO: 290485 - DNA, 20 bp, Artificial Sequence
  chemically synthesized
tgtcaaagatcagatagttg

SEQ ID NO: 290486 - DNA, 20 bp, Artificial Sequence
  chemically synthesized
caggtttgtcaaagatcaga

SEQ ID NO: 290487 - DNA, 20 bp, Artificial Sequence
  chemically synthesized
ttgtcaggtttgtcaaagat

SEQ ID NO: 290488 - DNA, 20 bp, Artificial Sequence
  chemically synthesized
tgtttttgtcaggtttgtca

SEQ ID NO: 290489 - DNA, 20 bp, Artificial Sequence
  chemically synthesized
ccccattgcttgtttttgtc

SEQ ID NO: 290490 - DNA, 20 bp, Artificial Sequence
  chemically synthesized
tccccattgcttgtttttgt

SEQ ID NO: 290491 - DNA, 20 bp, Artificial Sequence
  chemically synthesized
ttgacaaacctgacaaaaac

SEQ ID NO: 290492 - DNA, 20 bp, Artificial Sequence
  chemically synthesized
aacctgacaaaaacaagcaa

SEQ ID NO: 290493 - DNA, 20 bp, Artificial Sequence
  chemically synthesized
acctgacaaaaacaagcaat

SEQ ID NO: 290494 - DNA, 20 bp, Artificial Sequence
  chemically synthesized
cctgacaaaaacaagcaatg

SEQ ID NO: 290495 - DNA, 20 bp, Artificial Sequence
  chemically synthesized
acaaaaacaagcaatgggga

SEQ ID NO: 290496 - DNA, 20 bp, Artificial Sequence
  chemically synthesized
caaaaacaagcaatggggaa

SEQ ID NO: 290497 - DNA, 20 bp, Artificial Sequence
  chemically synthesized
ccagcaccatttattaaata

SEQ ID NO: 290498 - DNA, 20 bp, Artificial Sequence
  chemically synthesized
cccagcaccatttattaaat

SEQ ID NO: 290499 - DNA, 20 bp, Artificial Sequence
  chemically synthesized
tcccagcaccatttattaaa

SEQ ID NO: 290500 - DNA, 20 bp, Artificial Sequence
  chemically synthesized
aggattccctatttaataaa

SEQ ID NO: 290501 - DNA, 20 bp, Artificial Sequence
  chemically synthesized
ccctatttaataaatggtgc

SEQ ID NO: 290502 - DNA, 20 bp, Artificial Sequence
  chemically synthesized
cctatttaataaatggtgct

SEQ ID NO: 290503 - DNA, 20 bp, Artificial Sequence
  chemically synthesized
ataaatggtgctgggaaaac

SEQ ID NO: 290504 - DNA, 20 bp, Artificial Sequence
  chemically synthesized
atatggctagccagttttcc

SEQ ID NO: 290505 - DNA, 20 bp, Artificial Sequence
  chemically synthesized
atggtgctgggaaaactggc

SEQ ID NO: 290506 - DNA, 20 bp, Artificial Sequence
  chemically synthesized
gctttctacatatggctagc

SEQ ID NO: 290507 - DNA, 20 bp, Artificial Sequence
  chemically synthesized
ttcagctttctacatatggc

SEQ ID NO: 290508 - DNA, 20 bp, Artificial Sequence
  chemically synthesized
gaaaactggctagccatatg

SEQ ID NO: 290509 - DNA, 20 bp, Artificial Sequence
  chemically synthesized
cagtttcagctttctacata

SEQ ID NO: 290510 - DNA, 20 bp, Artificial Sequence
  chemically synthesized
actggctagccatatgtaga

SEQ ID NO: 290511 - DNA, 20 bp, Artificial Sequence
  chemically synthesized
catatgtagaaagctgaaac

SEQ ID NO: 290512 - DNA, 20 bp, Artificial Sequence
  chemically synthesized
gtaaggaagggatccagttt

SEQ ID NO: 290513 - DNA, 20 bp, Artificial Sequence
  chemically synthesized
taagttgtaaggaagggatc

SEQ ID NO: 290514 - DNA, 20 bp, Artificial Sequence
  chemically synthesized
tttgtataagttgtaaggaa

SEQ ID NO: 290515 - DNA, 20 bp, Artificial Sequence
  chemically synthesized
ttttgtataagttgtaagga

SEQ ID NO: 290516 - DNA, 20 bp, Artificial Sequence
  chemically synthesized
tttttgtataagttgtaagg

SEQ ID NO: 290517 - DNA, 20 bp, Artificial Sequence
  chemically synthesized
tgatttttgtataagttgta

SEQ ID NO: 290518 - DNA, 20 bp, Artificial Sequence
  chemically synthesized
ttgatttttgtataagttgt

SEQ ID NO: 290519 - DNA, 20 bp, Artificial Sequence
  chemically synthesized
tcttgaattgatttttgtat

SEQ ID NO: 290520 - DNA, 20 bp, Artificial Sequence
  chemically synthesized
acttatacaaaaatcaattc

SEQ ID NO: 290521 - DNA, 20 bp, Artificial Sequence
  chemically synthesized
atacaaaaatcaattcaaga

SEQ ID NO: 290522 - DNA, 20 bp, Artificial Sequence
  chemically synthesized
aatcaattcaagatggatta

SEQ ID NO: 290523 - DNA, 20 bp, Artificial Sequence
  chemically synthesized
tggattaaagatttaaacgt

SEQ ID NO: 290524 - DNA, 20 bp, Artificial Sequence
  chemically synthesized
tctagggtttttatggtttt

SEQ ID NO: 290525 - DNA, 20 bp, Artificial Sequence
  chemically synthesized
ttctagggtttttatggttt

SEQ ID NO: 290526 - DNA, 20 bp, Artificial Sequence
  chemically synthesized
gttttcttctagggttttta

SEQ ID NO: 290527 - DNA, 20 bp, Artificial Sequence
  chemically synthesized
acctaaaaccataaaaaccc

SEQ ID NO: 290528 - DNA, 20 bp, Artificial Sequence
  chemically synthesized
taaaaccataaaaaccctag

SEQ ID NO: 290529 - DNA, 20 bp, Artificial Sequence
  chemically synthesized
attgcctaggttttcttcta

SEQ ID NO: 290530 - DNA, 20 bp, Artificial Sequence
  chemically synthesized
tattgcctaggttttcttct

SEQ ID NO: 290531 - DNA, 20 bp, Artificial Sequence
  chemically synthesized
gtattgcctaggttttcttc

SEQ ID NO: 290532 - DNA, 20 bp, Artificial Sequence
  chemically synthesized
aaaaaccctagaagaaaacc

SEQ ID NO: 290533 - DNA, 20 bp, Artificial Sequence
  chemically synthesized
aaaaccctagaagaaaacct

SEQ ID NO: 290534 - DNA, 20 bp, Artificial Sequence
  chemically synthesized
tgccctgaatggtattgcct

SEQ ID NO: 290535 - DNA, 20 bp, Artificial Sequence
  chemically synthesized
atgccctgaatggtattgcc

SEQ ID NO: 290536 - DNA, 20 bp, Artificial Sequence
  chemically synthesized
aaaacctaggcaataccatt

SEQ ID NO: 290537 - DNA, 20 bp, Artificial Sequence
  chemically synthesized
aaacctaggcaataccattc

SEQ ID NO: 290538 - DNA, 20 bp, Artificial Sequence
  chemically synthesized
aacctaggcaataccattca

SEQ ID NO: 290539 - DNA, 20 bp, Artificial Sequence
  chemically synthesized
gcccatgcctatgccctgaa

SEQ ID NO: 290540 - DNA, 20 bp, Artificial Sequence
  chemically synthesized
aggcaataccattcagggca

SEQ ID NO: 290541 - DNA, 20 bp, Artificial Sequence
  chemically synthesized
ggcaataccattcagggcat

SEQ ID NO: 290542 - DNA, 20 bp, Artificial Sequence
  chemically synthesized
taccattcagggcataggca

SEQ ID NO: 290543 - DNA, 20 bp, Artificial Sequence
  chemically synthesized
accattcagggcataggcat

SEQ ID NO: 290544 - DNA, 20 bp, Artificial Sequence
  chemically synthesized
ttcagggcataggcatgggc

SEQ ID NO: 290545 - DNA, 20 bp, Artificial Sequence
  chemically synthesized
tcagggcataggcatgggca

SEQ ID NO: 290546 - DNA, 20 bp, Artificial Sequence
  chemically synthesized
cttttggtgttttggacatg

SEQ ID NO: 290547 - DNA, 20 bp, Artificial Sequence
  chemically synthesized
tgccattgcttttggtgttt

SEQ ID NO: 290548 - DNA, 20 bp, Artificial Sequence
  chemically synthesized
cttcatgtccaaaacaccaa

SEQ ID NO: 290549 - DNA, 20 bp, Artificial Sequence
  chemically synthesized
gtccaaaacaccaaaagcaa

SEQ ID NO: 290550 - DNA, 20 bp, Artificial Sequence
  chemically synthesized
tcttttgttgccattgcttt

SEQ ID NO: 290551 - DNA, 20 bp, Artificial Sequence
  chemically synthesized
accaaaagcaatggcaacaa

SEQ ID NO: 290552 - DNA, 20 bp, Artificial Sequence
  chemically synthesized
acaaaagacaaattgacaaa

SEQ ID NO: 290553 - DNA, 20 bp, Artificial Sequence
  chemically synthesized
caaaagacaaattgacaaat

SEQ ID NO: 290554 - DNA, 20 bp, Artificial Sequence
  chemically synthesized
cagaagctctttagtttaat

SEQ ID NO: 290555 - DNA, 20 bp, Artificial Sequence
  chemically synthesized
aatgggatctaattaaacta

SEQ ID NO: 290556 - DNA, 20 bp, Artificial Sequence
  chemically synthesized
tgggatctaattaaactaaa

SEQ ID NO: 290557 - DNA, 20 bp, Artificial Sequence
  chemically synthesized
tttgctgtgcagaagctctt

SEQ ID NO: 290558 - DNA, 20 bp, Artificial Sequence
  chemically synthesized
taaactaaagagcttctgca

SEQ ID NO: 290559 - DNA, 20 bp, Artificial Sequence
  chemically synthesized
tagtttcttttgctgtgcag

SEQ ID NO: 290560 - DNA, 20 bp, Artificial Sequence
  chemically synthesized
tggtagtttcttttgctgtg

SEQ ID NO: 290561 - DNA, 20 bp, Artificial Sequence
  chemically synthesized
aaagagcttctgcacagcaa

SEQ ID NO: 290562 - DNA, 20 bp, Artificial Sequence
  chemically synthesized
acagcaaaagaaactaccat

SEQ ID NO: 290563 - DNA, 20 bp, Artificial Sequence
  chemically synthesized
agcaaaagaaactaccatca

SEQ ID NO: 290564 - DNA, 20 bp, Artificial Sequence
  chemically synthesized
ttgcctgttcactctgatgg

SEQ ID NO: 290565 - DNA, 20 bp, Artificial Sequence
  chemically synthesized
aggttgcctgttcactctga

SEQ ID NO: 290566 - DNA, 20 bp, Artificial Sequence
  chemically synthesized
gaaactaccatcagagtgaa

SEQ ID NO: 290567 - DNA, 20 bp, Artificial Sequence
  chemically synthesized
aaactaccatcagagtgaac

SEQ ID NO: 290568 - DNA, 20 bp, Artificial Sequence
  chemically synthesized
tgaacaggcaacctacaaaa

SEQ ID NO: 290569 - DNA, 20 bp, Artificial Sequence
  chemically synthesized
gaacaggcaacctacaaaat

SEQ ID NO: 290570 - DNA, 20 bp, Artificial Sequence
  chemically synthesized
aaaattttctcccattttgt

SEQ ID NO: 290571 - DNA, 20 bp, Artificial Sequence
  chemically synthesized
aaaaattttctcccattttg

SEQ ID NO: 290572 - DNA, 20 bp, Artificial Sequence
  chemically synthesized
acaggcaacctacaaaatgg

SEQ ID NO: 290573 - DNA, 20 bp, Artificial Sequence
  chemically synthesized
tagccctttgtcagatgagt

SEQ ID NO: 290574 - DNA, 20 bp, Artificial Sequence
  chemically synthesized
ttagccctttgtcagatgag

SEQ ID NO: 290575 - DNA, 20 bp, Artificial Sequence
  chemically synthesized
atattagccctttgtcagat

SEQ ID NO: 290576 - DNA, 20 bp, Artificial Sequence
  chemically synthesized
tgcaacctactcatctgaca

SEQ ID NO: 290577 - DNA, 20 bp, Artificial Sequence
  chemically synthesized
gcaacctactcatctgacaa

SEQ ID NO: 290578 - DNA, 20 bp, Artificial Sequence
  chemically synthesized
caacctactcatctgacaaa

SEQ ID NO: 290579 - DNA, 20 bp, Artificial Sequence
  chemically synthesized
tctggatattagccctttgt

SEQ ID NO: 290580 - DNA, 20 bp, Artificial Sequence
  chemically synthesized
tctgacaaagggctaatatc

SEQ ID NO: 290581 - DNA, 20 bp, Artificial Sequence
  chemically synthesized
tcgttgtagattctggatat

SEQ ID NO: 290582 - DNA, 20 bp, Artificial Sequence
  chemically synthesized
tttgagttcgttgtagattc

SEQ ID NO: 290583 - DNA, 20 bp, Artificial Sequence
  chemically synthesized
aaatttttttgagttcgttg

SEQ ID NO: 290584 - DNA, 20 bp, Artificial Sequence
  chemically synthesized
tttttcttgtaaattttttt

SEQ ID NO: 290585 - DNA, 20 bp, Artificial Sequence
  chemically synthesized
acgaactcaaaaaaatttac

SEQ ID NO: 290586 - DNA, 20 bp, Artificial Sequence
  chemically synthesized
aaacaaacaaccccatcaaa

SEQ ID NO: 290587 - DNA, 20 bp, Artificial Sequence
  chemically synthesized
ccttcgcccactttttgatg

SEQ ID NO: 290588 - DNA, 20 bp, Artificial Sequence
  chemically synthesized
cccttcgcccactttttgat

SEQ ID NO: 290589 - DNA, 20 bp, Artificial Sequence
  chemically synthesized
gcccttcgcccactttttga

SEQ ID NO: 290590 - DNA, 20 bp, Artificial Sequence
  chemically synthesized
caaacaaccccatcaaaaag

SEQ ID NO: 290591 - DNA, 20 bp, Artificial Sequence
  chemically synthesized
aaacaaccccatcaaaaagt

SEQ ID NO: 290592 - DNA, 20 bp, Artificial Sequence
  chemically synthesized
accccatcaaaaagtgggcg

SEQ ID NO: 290593 - DNA, 20 bp, Artificial Sequence
  chemically synthesized
ccccatcaaaaagtgggcga

SEQ ID NO: 290594 - DNA, 20 bp, Artificial Sequence
  chemically synthesized
cccatcaaaaagtgggcgaa

SEQ ID NO: 290595 - DNA, 20 bp, Artificial Sequence
  chemically synthesized
gaaaacatttatgtagagaa

SEQ ID NO: 290596 - DNA, 20 bp, Artificial Sequence
  chemically synthesized
aacatgaaaacatttatgta

SEQ ID NO: 290597 - DNA, 20 bp, Artificial Sequence
  chemically synthesized
agaacatgaaaacatttatg

SEQ ID NO: 290598 - DNA, 20 bp, Artificial Sequence
  chemically synthesized
tgttttcatgttcttgtttc

SEQ ID NO: 290599 - DNA, 20 bp, Artificial Sequence
  chemically synthesized
attccaacttcactggaaac

SEQ ID NO: 290600 - DNA, 20 bp, Artificial Sequence
  chemically synthesized
tcatgttcttgtttccagtg

SEQ ID NO: 290601 - DNA, 20 bp, Artificial Sequence
  chemically synthesized
gttcttgtttccagtgaagt

SEQ ID NO: 290602 - DNA, 20 bp, Artificial Sequence
  chemically synthesized
cgaaacaattccaacttcac

SEQ ID NO: 290603 - DNA, 20 bp, Artificial Sequence
  chemically synthesized
acatatataatttgaactca

SEQ ID NO: 290604 - DNA, 20 bp, Artificial Sequence
  chemically synthesized
aaaagggcagtgaaaacttt

SEQ ID NO: 290605 - DNA, 20 bp, Artificial Sequence
  chemically synthesized
aataacacttttaaaaaggg

SEQ ID NO: 290606 - DNA, 20 bp, Artificial Sequence
  chemically synthesized
gttttcactgccctttttaa

SEQ ID NO: 290607 - DNA, 20 bp, Artificial Sequence
  chemically synthesized
gataataacacttttaaaaa

SEQ ID NO: 290608 - DNA, 20 bp, Artificial Sequence
  chemically synthesized
tgataataacacttttaaaa

SEQ ID NO: 290609 - DNA, 20 bp, Artificial Sequence
  chemically synthesized
atgataataacacttttaaa

SEQ ID NO: 290610 - DNA, 20 bp, Artificial Sequence
  chemically synthesized
ttttaaaagtgttattatca

SEQ ID NO: 290611 - DNA, 20 bp, Artificial Sequence
  chemically synthesized
atatatgaattgtaagtaag

SEQ ID NO: 290612 - DNA, 20 bp, Artificial Sequence
  chemically synthesized
catatatatgaattgtaagt

SEQ ID NO: 290613 - DNA, 20 bp, Artificial Sequence
  chemically synthesized
acagcatatatatgaattgt

SEQ ID NO: 290614 - DNA, 20 bp, Artificial Sequence
  chemically synthesized
attcatatatatgctgtctt

SEQ ID NO: 290615 - DNA, 20 bp, Artificial Sequence
  chemically synthesized
caagtatttttttctaaaga

SEQ ID NO: 290616 - DNA, 20 bp, Artificial Sequence
  chemically synthesized
ccctcaagtatttttttcta

SEQ ID NO: 290617 - DNA, 20 bp, Artificial Sequence
  chemically synthesized
gtctttagaaaaaaatactt

SEQ ID NO: 290618 - DNA, 20 bp, Artificial Sequence
  chemically synthesized
tctttagaaaaaaatacttg

SEQ ID NO: 290619 - DNA, 20 bp, Artificial Sequence
  chemically synthesized
ctttagaaaaaaatacttga

SEQ ID NO: 290620 - DNA, 20 bp, Artificial Sequence
  chemically synthesized
agaaaaaaatacttgagggt

SEQ ID NO: 290621 - DNA, 20 bp, Artificial Sequence
  chemically synthesized
ttaaatagtaactaaccctc

SEQ ID NO: 290622 - DNA, 20 bp, Artificial Sequence
  chemically synthesized
tcctgttgttacatattaaa

SEQ ID NO: 290623 - DNA, 20 bp, Artificial Sequence
  chemically synthesized
tactatttaatatgtaacaa

SEQ ID NO: 290624 - DNA, 20 bp, Artificial Sequence
  chemically synthesized
actatttaatatgtaacaac

SEQ ID NO: 290625 - DNA, 20 bp, Artificial Sequence
  chemically synthesized
gaaaattgaaatttaaaaat

SEQ ID NO: 290626 - DNA, 20 bp, Artificial Sequence
  chemically synthesized
aaatttaaaaattggaacat

SEQ ID NO: 290627 - DNA, 20 bp, Artificial Sequence
  chemically synthesized
aaattggaacatgagcccat

SEQ ID NO: 290628 - DNA, 20 bp, Artificial Sequence
  chemically synthesized
ttggaacatgagcccattag

SEQ ID NO: 290629 - DNA, 20 bp, Artificial Sequence
  chemically synthesized
cattttctctttcttctaat

SEQ ID NO: 290630 - DNA, 20 bp, Artificial Sequence
  chemically synthesized
ccattttctctttcttctaa

SEQ ID NO: 290631 - DNA, 20 bp, Artificial Sequence
  chemically synthesized
aacatgagcccattagaaga

SEQ ID NO: 290632 - DNA, 20 bp, Artificial Sequence
  chemically synthesized
catgagcccattagaagaaa

SEQ ID NO: 290633 - DNA, 20 bp, Artificial Sequence
  chemically synthesized
ccattagaagaaagagaaaa

SEQ ID NO: 290634 - DNA, 20 bp, Artificial Sequence
  chemically synthesized
tagaagaaagagaaaatgga

SEQ ID NO: 290635 - DNA, 20 bp, Artificial Sequence
  chemically synthesized
gatttcaattcgttcagaat

SEQ ID NO: 290636 - DNA, 20 bp, Artificial Sequence
  chemically synthesized
agctcagatttcaattcgtt

SEQ ID NO: 290637 - DNA, 20 bp, Artificial Sequence
  chemically synthesized
ttctgaacgaattgaaatct

SEQ ID NO: 290638 - DNA, 20 bp, Artificial Sequence
  chemically synthesized
actttgattttcaggaagct

SEQ ID NO: 290639 - DNA, 20 bp, Artificial Sequence
  chemically synthesized
ttttcactttgattttcagg

SEQ ID NO: 290640 - DNA, 20 bp, Artificial Sequence
  chemically synthesized
gccttttcactttgattttc

SEQ ID NO: 290641 - DNA, 20 bp, Artificial Sequence
  chemically synthesized
tctgagcttcctgaaaatca

SEQ ID NO: 290642 - DNA, 20 bp, Artificial Sequence
  chemically synthesized
tgccttttcactttgatttt

SEQ ID NO: 290643 - DNA, 20 bp, Artificial Sequence
  chemically synthesized
ttcctgaaaatcaaagtgaa

SEQ ID NO: 290644 - DNA, 20 bp, Artificial Sequence
  chemically synthesized
tcctgaaaatcaaagtgaaa

SEQ ID NO: 290645 - DNA, 20 bp, Artificial Sequence
  chemically synthesized
aaagtgaaaaggcaaaaaaa

SEQ ID NO: 290646 - DNA, 20 bp, Artificial Sequence
  chemically synthesized
aaaaaaaaagttaatattta

SEQ ID NO: 290647 - DNA, 20 bp, Artificial Sequence
  chemically synthesized
aaaaaaagttaatatttatg

SEQ ID NO: 290648 - DNA, 20 bp, Artificial Sequence
  chemically synthesized
aaaaaagttaatatttatgg

SEQ ID NO: 290649 - DNA, 20 bp, Artificial Sequence
  chemically synthesized
atggaggcattcatactctt

SEQ ID NO: 290650 - DNA, 20 bp, Artificial Sequence
  chemically synthesized
tggaggcattcatactcttt

SEQ ID NO: 290651 - DNA, 20 bp, Artificial Sequence
  chemically synthesized
gaggcattcatactctttgg

SEQ ID NO: 290652 - DNA, 20 bp, Artificial Sequence
  chemically synthesized
ggcattcatactctttggga

SEQ ID NO: 290653 - DNA, 20 bp, Artificial Sequence
  chemically synthesized
aaaagttactctctcccaaa

SEQ ID NO: 290654 - DNA, 20 bp, Artificial Sequence
  chemically synthesized
cattcatactctttgggaga

SEQ ID NO: 290655 - DNA, 20 bp, Artificial Sequence
  chemically synthesized
acaaaagttactctctccca

SEQ ID NO: 290656 - DNA, 20 bp, Artificial Sequence
  chemically synthesized
ggagagagtaacttttgtat

SEQ ID NO: 290657 - DNA, 20 bp, Artificial Sequence
  chemically synthesized
gagagagtaacttttgtatt

SEQ ID NO: 290658 - DNA, 20 bp, Artificial Sequence
  chemically synthesized
ctcagcctctcctaatacaa

SEQ ID NO: 290659 - DNA, 20 bp, Artificial Sequence
  chemically synthesized
gagagtaacttttgtattag

SEQ ID NO: 290660 - DNA, 20 bp, Artificial Sequence
  chemically synthesized
gagtaacttttgtattagga

SEQ ID NO: 290661 - DNA, 20 bp, Artificial Sequence
  chemically synthesized
agtaacttttgtattaggag

SEQ ID NO: 290662 - DNA, 20 bp, Artificial Sequence
  chemically synthesized
cttttgtattaggagaggct

SEQ ID NO: 290663 - DNA, 20 bp, Artificial Sequence
  chemically synthesized
aatttatgtgataaatttct

SEQ ID NO: 290664 - DNA, 20 bp, Artificial Sequence
  chemically synthesized
ttatcacataaattctgtca

SEQ ID NO: 290665 - DNA, 20 bp, Artificial Sequence
  chemically synthesized
cattagtcttgcaaccatga

SEQ ID NO: 290666 - DNA, 20 bp, Artificial Sequence
  chemically synthesized
ataaattctgtcatggttgc

SEQ ID NO: 290667 - DNA, 20 bp, Artificial Sequence
  chemically synthesized
gaataagtggcattgtacat

SEQ ID NO: 290668 - DNA, 20 bp, Artificial Sequence
  chemically synthesized
gtttttttaatgagaataag

SEQ ID NO: 290669 - DNA, 20 bp, Artificial Sequence
  chemically synthesized
tatgtttttttaatgagaat

SEQ ID NO: 290670 - DNA, 20 bp, Artificial Sequence
  chemically synthesized
tgtatttatgtttttttaat

SEQ ID NO: 290671 - DNA, 20 bp, Artificial Sequence
  chemically synthesized
tcattaaaaaaacataaata

SEQ ID NO: 290672 - DNA, 20 bp, Artificial Sequence
  chemically synthesized
aaaaacataaatacagcttt

SEQ ID NO: 290673 - DNA, 20 bp, Artificial Sequence
  chemically synthesized
aaacataaatacagctttca

SEQ ID NO: 290674 - DNA, 20 bp, Artificial Sequence
  chemically synthesized
aacataaatacagctttcag

SEQ ID NO: 290675 - DNA, 20 bp, Artificial Sequence
  chemically synthesized
acataaacacattcctctga

SEQ ID NO: 290676 - DNA, 20 bp, Artificial Sequence
  chemically synthesized
ttcagaggaatgtgtttatg

SEQ ID NO: 290677 - DNA, 20 bp, Artificial Sequence
  chemically synthesized
atgtgtttatgtggttataa

SEQ ID NO: 290678 - DNA, 20 bp, Artificial Sequence
  chemically synthesized
ttatgtggttataatggtat

SEQ ID NO: 290679 - DNA, 20 bp, Artificial Sequence
  chemically synthesized
tataatggtatgagctgatt

SEQ ID NO: 290680 - DNA, 20 bp, Artificial Sequence
  chemically synthesized
ataatggtatgagctgattc

SEQ ID NO: 290681 - DNA, 20 bp, Artificial Sequence
  chemically synthesized
agagattattttacctgaat

SEQ ID NO: 290682 - DNA, 20 bp, Artificial Sequence
  chemically synthesized
ccaaaacgattgaatcgtca

SEQ ID NO: 290683 - DNA, 20 bp, Artificial Sequence
  chemically synthesized
caccaaaacgattgaatcgt

SEQ ID NO: 290684 - DNA, 20 bp, Artificial Sequence
  chemically synthesized
ctctgacgattcaatcgttt

SEQ ID NO: 290685 - DNA, 20 bp, Artificial Sequence
  chemically synthesized
tgacgattcaatcgttttgg

SEQ ID NO: 290686 - DNA, 20 bp, Artificial Sequence
  chemically synthesized
gacgattcaatcgttttggt

SEQ ID NO: 290687 - DNA, 20 bp, Artificial Sequence
  chemically synthesized
ttcaatcgttttggtgggtg

SEQ ID NO: 290688 - DNA, 20 bp, Artificial Sequence
  chemically synthesized
gttttggtgggtgaagatta

SEQ ID NO: 290689 - DNA, 20 bp, Artificial Sequence
  chemically synthesized
gggtgaagattaaagacgtt

SEQ ID NO: 290690 - DNA, 20 bp, Artificial Sequence
  chemically synthesized
attaaagacgtttagcaaaa

SEQ ID NO: 290691 - DNA, 20 bp, Artificial Sequence
  chemically synthesized
aaagacgtttagcaaaatgg

SEQ ID NO: 290692 - DNA, 20 bp, Artificial Sequence
  chemically synthesized
aagacgtttagcaaaatgga

SEQ ID NO: 290693 - DNA, 20 bp, Artificial Sequence
  chemically synthesized
tatatttgaaagagaaatat

SEQ ID NO: 290694 - DNA, 20 bp, Artificial Sequence
  chemically synthesized
ttatatttgaaagagaaata

SEQ ID NO: 290695 - DNA, 20 bp, Artificial Sequence
  chemically synthesized
gagaggatttatatttgaaa

SEQ ID NO: 290696 - DNA, 20 bp, Artificial Sequence
  chemically synthesized
ttgagaggatttatatttga

SEQ ID NO: 290697 - DNA, 20 bp, Artificial Sequence
  chemically synthesized
aaatataaatcctctcaaac

SEQ ID NO: 290698 - DNA, 20 bp, Artificial Sequence
  chemically synthesized
ctttctagcactggtttgag

SEQ ID NO: 290699 - DNA, 20 bp, Artificial Sequence
  chemically synthesized
actttctagcactggtttga

SEQ ID NO: 290700 - DNA, 20 bp, Artificial Sequence
  chemically synthesized
caactttctagcactggttt

SEQ ID NO: 290701 - DNA, 20 bp, Artificial Sequence
  chemically synthesized
aaatcctctcaaaccagtgc

SEQ ID NO: 290702 - DNA, 20 bp, Artificial Sequence
  chemically synthesized
atataccaactttctagcac

SEQ ID NO: 290703 - DNA, 20 bp, Artificial Sequence
  chemically synthesized
cctctcaaaccagtgctaga

SEQ ID NO: 290704 - DNA, 20 bp, Artificial Sequence
  chemically synthesized
tcaaaccagtgctagaaagt

SEQ ID NO: 290705 - DNA, 20 bp, Artificial Sequence
  chemically synthesized
atggatatataccaactttc

SEQ ID NO: 290706 - DNA, 20 bp, Artificial Sequence
  chemically synthesized
agaaagttggtatatatcca

SEQ ID NO: 290707 - DNA, 20 bp, Artificial Sequence
  chemically synthesized
gttggtatatatccatggat

SEQ ID NO: 290708 - DNA, 20 bp, Artificial Sequence
  chemically synthesized
cttgtcttatttcttatcca

SEQ ID NO: 290709 - DNA, 20 bp, Artificial Sequence
  chemically synthesized
tatatccatggataagaaat

SEQ ID NO: 290710 - DNA, 20 bp, Artificial Sequence
  chemically synthesized
ccatggataagaaataagac

SEQ ID NO: 290711 - DNA, 20 bp, Artificial Sequence
  chemically synthesized
atggataagaaataagacaa

SEQ ID NO: 290712 - DNA, 20 bp, Artificial Sequence
  chemically synthesized
tggataagaaataagacaag

SEQ ID NO: 290713 - DNA, 20 bp, Artificial Sequence
  chemically synthesized
aagaaataagacaagaggta

SEQ ID NO: 290714 - DNA, 20 bp, Artificial Sequence
  chemically synthesized
agaaataagacaagaggtaa

SEQ ID NO: 290715 - DNA, 20 bp, Artificial Sequence
  chemically synthesized
gaaataagacaagaggtaaa

SEQ ID NO: 290716 - DNA, 20 bp, Artificial Sequence
  chemically synthesized
agggtaatattctgtattta

SEQ ID NO: 290717 - DNA, 20 bp, Artificial Sequence
  chemically synthesized
atatttctgtactataaata

SEQ ID NO: 290718 - DNA, 20 bp, Artificial Sequence
  chemically synthesized
aatattctgtatttatagta

SEQ ID NO: 290719 - DNA, 20 bp, Artificial Sequence
  chemically synthesized
tatacaaataatttgtatgc

SEQ ID NO: 290720 - DNA, 20 bp, Artificial Sequence
  chemically synthesized
aatgctgccatttgtaaatc

SEQ ID NO: 290721 - DNA, 20 bp, Artificial Sequence
  chemically synthesized
ttgtatgctagatttacaaa

SEQ ID NO: 290722 - DNA, 20 bp, Artificial Sequence
  chemically synthesized
tatgctagatttacaaatgg

SEQ ID NO: 290723 - DNA, 20 bp, Artificial Sequence
  chemically synthesized
agatttacaaatggcagcat

SEQ ID NO: 290724 - DNA, 20 bp, Artificial Sequence
  chemically synthesized
aggttcttaatggttcacag

SEQ ID NO: 290725 - DNA, 20 bp, Artificial Sequence
  chemically synthesized
atcaggttcttaatggttca

SEQ ID NO: 290726 - DNA, 20 bp, Artificial Sequence
  chemically synthesized
ggcatctactgtgaaccatt

SEQ ID NO: 290727 - DNA, 20 bp, Artificial Sequence
  chemically synthesized
aatataaatcaggttcttaa

SEQ ID NO: 290728 - DNA, 20 bp, Artificial Sequence
  chemically synthesized
catctggccaaatataaatc

SEQ ID NO: 290729 - DNA, 20 bp, Artificial Sequence
  chemically synthesized
ccatctggccaaatataaat

SEQ ID NO: 290730 - DNA, 20 bp, Artificial Sequence
  chemically synthesized
ttaagaacctgatttatatt

SEQ ID NO: 290731 - DNA, 20 bp, Artificial Sequence
  chemically synthesized
gaacctgatttatatttggc

SEQ ID NO: 290732 - DNA, 20 bp, Artificial Sequence
  chemically synthesized
ctgatttatatttggccaga

SEQ ID NO: 290733 - DNA, 20 bp, Artificial Sequence
  chemically synthesized
gatttatatttggccagatg

SEQ ID NO: 290734 - DNA, 20 bp, Artificial Sequence
  chemically synthesized
atttatatttggccagatgg

SEQ ID NO: 290735 - DNA, 20 bp, Artificial Sequence
  chemically synthesized
tttatatttggccagatgga

SEQ ID NO: 290736 - DNA, 20 bp, Artificial Sequence
  chemically synthesized
aaaaatggcagccctccatc

SEQ ID NO: 290737 - DNA, 20 bp, Artificial Sequence
  chemically synthesized
cccctgaacgggaaaaatgg

SEQ ID NO: 290738 - DNA, 20 bp, Artificial Sequence
  chemically synthesized
agccccctgaacgggaaaaa

SEQ ID NO: 290739 - DNA, 20 bp, Artificial Sequence
  chemically synthesized
gggctgccatttttcccgtt

SEQ ID NO: 290740 - DNA, 20 bp, Artificial Sequence
  chemically synthesized
ggctgccatttttcccgttc

SEQ ID NO: 290741 - DNA, 20 bp, Artificial Sequence
  chemically synthesized
gctgccatttttcccgttca

SEQ ID NO: 290742 - DNA, 20 bp, Artificial Sequence
  chemically synthesized
ctgccatttttcccgttcag

SEQ ID NO: 290743 - DNA, 20 bp, Artificial Sequence
  chemically synthesized
tgccatttttcccgttcagg

SEQ ID NO: 290744 - DNA, 20 bp, Artificial Sequence
  chemically synthesized
ctttctatagccccctgaac

SEQ ID NO: 290745 - DNA, 20 bp, Artificial Sequence
  chemically synthesized
tctttctatagccccctgaa

SEQ ID NO: 290746 - DNA, 20 bp, Artificial Sequence
  chemically synthesized
ttttcccgttcagggggcta

SEQ ID NO: 290747 - DNA, 20 bp, Artificial Sequence
  chemically synthesized
cccgttcagggggctataga

SEQ ID NO: 290748 - DNA, 20 bp, Artificial Sequence
  chemically synthesized
cgttcagggggctatagaaa

SEQ ID NO: 290749 - DNA, 20 bp, Artificial Sequence
  chemically synthesized
tataatgttggctctttcta

SEQ ID NO: 290750 - DNA, 20 bp, Artificial Sequence
  chemically synthesized
tatagaaagagccaacatta

SEQ ID NO: 290751 - DNA, 20 bp, Artificial Sequence
  chemically synthesized
agcacacttggctataatgt

SEQ ID NO: 290752 - DNA, 20 bp, Artificial Sequence
  chemically synthesized
aaagagccaacattatagcc

SEQ ID NO: 290753 - DNA, 20 bp, Artificial Sequence
  chemically synthesized
tttgtttttcagagcacact

SEQ ID NO: 290754 - DNA, 20 bp, Artificial Sequence
  chemically synthesized
aaagtcccctttgtttttca

SEQ ID NO: 290755 - DNA, 20 bp, Artificial Sequence
  chemically synthesized
caagtgtgctctgaaaaaca

SEQ ID NO: 290756 - DNA, 20 bp, Artificial Sequence
  chemically synthesized
tcaaagtcccctttgttttt

SEQ ID NO: 290757 - DNA, 20 bp, Artificial Sequence
  chemically synthesized
aagtgtgctctgaaaaacaa

SEQ ID NO: 290758 - DNA, 20 bp, Artificial Sequence
  chemically synthesized
agtgtgctctgaaaaacaaa

SEQ ID NO: 290759 - DNA, 20 bp, Artificial Sequence
  chemically synthesized
gtgtgctctgaaaaacaaag

SEQ ID NO: 290760 - DNA, 20 bp, Artificial Sequence
  chemically synthesized
caaatgttttattagtttca

SEQ ID NO: 290761 - DNA, 20 bp, Artificial Sequence
  chemically synthesized
catttgcccaaatgttttat

SEQ ID NO: 290762 - DNA, 20 bp, Artificial Sequence
  chemically synthesized
tttgaaactaataaaacatt

SEQ ID NO: 290763 - DNA, 20 bp, Artificial Sequence
  chemically synthesized
ttgaaactaataaaacattt

SEQ ID NO: 290764 - DNA, 20 bp, Artificial Sequence
  chemically synthesized
aaaacatttgggcaaatgtt

SEQ ID NO: 290765 - DNA, 20 bp, Artificial Sequence
  chemically synthesized
atttgggcaaatgttcagtt

SEQ ID NO: 290766 - DNA, 20 bp, Artificial Sequence
  chemically synthesized
gatttattctcagaacatta

SEQ ID NO: 290767 - DNA, 20 bp, Artificial Sequence
  chemically synthesized
tgatttattctcagaacatt

SEQ ID NO: 290768 - DNA, 20 bp, Artificial Sequence
  chemically synthesized
agttgagaccttaatgttct

SEQ ID NO: 290769 - DNA, 20 bp, Artificial Sequence
  chemically synthesized
tctcttctatgatttattct

SEQ ID NO: 290770 - DNA, 20 bp, Artificial Sequence
  chemically synthesized
aatgttctgagaataaatca

SEQ ID NO: 290771 - DNA, 20 bp, Artificial Sequence
  chemically synthesized
gttctgagaataaatcatag

SEQ ID NO: 290772 - DNA, 20 bp, Artificial Sequence
  chemically synthesized
tctgagaataaatcatagaa

SEQ ID NO: 290773 - DNA, 20 bp, Artificial Sequence
  chemically synthesized
cacagaatacttcagttgaa

SEQ ID NO: 290774 - DNA, 20 bp, Artificial Sequence
  chemically synthesized
gaagagatacttttcaactg

SEQ ID NO: 290775 - DNA, 20 bp, Artificial Sequence
  chemically synthesized
tttttaaacacagaatactt

SEQ ID NO: 290776 - DNA, 20 bp, Artificial Sequence
  chemically synthesized
tgttcacatctttttaaaca

SEQ ID NO: 290777 - DNA, 20 bp, Artificial Sequence
  chemically synthesized
tgaagtattctgtgtttaaa

SEQ ID NO: 290778 - DNA, 20 bp, Artificial Sequence
  chemically synthesized
tttaaaaagatgtgaacaat

SEQ ID NO: 290779 - DNA, 20 bp, Artificial Sequence
  chemically synthesized
aaatccttttatggaaataa

SEQ ID NO: 290780 - DNA, 20 bp, Artificial Sequence
  chemically synthesized
attagccattatttccataa

SEQ ID NO: 290781 - DNA, 20 bp, Artificial Sequence
  chemically synthesized
ttagccattatttccataaa

SEQ ID NO: 290782 - DNA, 20 bp, Artificial Sequence
  chemically synthesized
aactaaaccaaatcctttta

SEQ ID NO: 290783 - DNA, 20 bp, Artificial Sequence
  chemically synthesized
attatttccataaaaggatt

SEQ ID NO: 290784 - DNA, 20 bp, Artificial Sequence
  chemically synthesized
ttccataaaaggatttggtt

SEQ ID NO: 290785 - DNA, 20 bp, Artificial Sequence
  chemically synthesized
ataaaaggatttggtttagt

SEQ ID NO: 290786 - DNA, 20 bp, Artificial Sequence
  chemically synthesized
atttggtttagttggtcctc

SEQ ID NO: 290787 - DNA, 20 bp, Artificial Sequence
  chemically synthesized
ttggtttagttggtcctcca

SEQ ID NO: 290788 - DNA, 20 bp, Artificial Sequence
  chemically synthesized
aaggagataccatactctgg

SEQ ID NO: 290789 - DNA, 20 bp, Artificial Sequence
  chemically synthesized
ttagttggtcctccagagta

SEQ ID NO: 290790 - DNA, 20 bp, Artificial Sequence
  chemically synthesized
aaaggagataccatactctg

SEQ ID NO: 290791 - DNA, 20 bp, Artificial Sequence
  chemically synthesized
tcaaaggagataccatactc

SEQ ID NO: 290792 - DNA, 20 bp, Artificial Sequence
  chemically synthesized
cagagtatggtatctccttt

SEQ ID NO: 290793 - DNA, 20 bp, Artificial Sequence
  chemically synthesized
aagaataaacagactcaaag

SEQ ID NO: 290794 - DNA, 20 bp, Artificial Sequence
  chemically synthesized
taaagaataaacagactcaa

SEQ ID NO: 290795 - DNA, 20 bp, Artificial Sequence
  chemically synthesized
ttaaagaataaacagactca

SEQ ID NO: 290796 - DNA, 20 bp, Artificial Sequence
  chemically synthesized
atataattttaaagaataaa

SEQ ID NO: 290797 - DNA, 20 bp, Artificial Sequence
  chemically synthesized
gagataagcatataatttta

SEQ ID NO: 290798 - DNA, 20 bp, Artificial Sequence
  chemically synthesized
aaaattatatgcttatctca

SEQ ID NO: 290799 - DNA, 20 bp, Artificial Sequence
  chemically synthesized
tacaaaagcttccatgagat

SEQ ID NO: 290800 - DNA, 20 bp, Artificial Sequence
  chemically synthesized
attatatgcttatctcatgg

SEQ ID NO: 290801 - DNA, 20 bp, Artificial Sequence
  chemically synthesized
aaaaatacaaaagcttccat

SEQ ID NO: 290802 - DNA, 20 bp, Artificial Sequence
  chemically synthesized
ctttcctgtgaaaaatacaa

SEQ ID NO: 290803 - DNA, 20 bp, Artificial Sequence
  chemically synthesized
ggaagcttttgtatttttca

SEQ ID NO: 290804 - DNA, 20 bp, Artificial Sequence
  chemically synthesized
gaagcttttgtatttttcac

SEQ ID NO: 290805 - DNA, 20 bp, Artificial Sequence
  chemically synthesized
cttttgtatttttcacagga

SEQ ID NO: 290806 - DNA, 20 bp, Artificial Sequence
  chemically synthesized
ttttgtatttttcacaggaa

SEQ ID NO: 290807 - DNA, 20 bp, Artificial Sequence
  chemically synthesized
tttgtatttttcacaggaaa

SEQ ID NO: 290808 - DNA, 20 bp, Artificial Sequence
  chemically synthesized
ttagagagccttatcagaat

SEQ ID NO: 290809 - DNA, 20 bp, Artificial Sequence
  chemically synthesized
gaattttttccaattctgat

SEQ ID NO: 290810 - DNA, 20 bp, Artificial Sequence
  chemically synthesized
aattttttccaattctgata

SEQ ID NO: 290811 - DNA, 20 bp, Artificial Sequence
  chemically synthesized
tgggggttagagagccttat

SEQ ID NO: 290812 - DNA, 20 bp, Artificial Sequence
  chemically synthesized
ttaatattgtgggggttaga

SEQ ID NO: 290813 - DNA, 20 bp, Artificial Sequence
  chemically synthesized
ttttaatattgtgggggtta

SEQ ID NO: 290814 - DNA, 20 bp, Artificial Sequence
  chemically synthesized
gtttttaatattgtgggggt

SEQ ID NO: 290815 - DNA, 20 bp, Artificial Sequence
  chemically synthesized
actggtttttaatattgtgg

SEQ ID NO: 290816 - DNA, 20 bp, Artificial Sequence
  chemically synthesized
aactggtttttaatattgtg

SEQ ID NO: 290817 - DNA, 20 bp, Artificial Sequence
  chemically synthesized
gaactggtttttaatattgt

SEQ ID NO: 290818 - DNA, 20 bp, Artificial Sequence
  chemically synthesized
agaactggtttttaatattg

SEQ ID NO: 290819 - DNA, 20 bp, Artificial Sequence
  chemically synthesized
acccccacaatattaaaaac

SEQ ID NO: 290820 - DNA, 20 bp, Artificial Sequence
  chemically synthesized
attctaatgatcggcagaac

SEQ ID NO: 290821 - DNA, 20 bp, Artificial Sequence
  chemically synthesized
gctcatattctaatgatcgg

SEQ ID NO: 290822 - DNA, 20 bp, Artificial Sequence
  chemically synthesized
aaaccagttctgccgatcat

SEQ ID NO: 290823 - DNA, 20 bp, Artificial Sequence
  chemically synthesized
ttagctcatattctaatgat

SEQ ID NO: 290824 - DNA, 20 bp, Artificial Sequence
  chemically synthesized
tctgccgatcattagaatat

SEQ ID NO: 290825 - DNA, 20 bp, Artificial Sequence
  chemically synthesized
ataacattagagcgcatatt

SEQ ID NO: 290826 - DNA, 20 bp, Artificial Sequence
  chemically synthesized
ggagaagttttataacatta

SEQ ID NO: 290827 - DNA, 20 bp, Artificial Sequence
  chemically synthesized
ttggagaagttttataacat

SEQ ID NO: 290828 - DNA, 20 bp, Artificial Sequence
  chemically synthesized
gcgttttattttatttggag

SEQ ID NO: 290829 - DNA, 20 bp, Artificial Sequence
  chemically synthesized
tcagcgttttattttatttg

SEQ ID NO: 290830 - DNA, 20 bp, Artificial Sequence
  chemically synthesized
tctcagcgttttattttatt

SEQ ID NO: 290831 - DNA, 20 bp, Artificial Sequence
  chemically synthesized
tccaaataaaataaaacgct

SEQ ID NO: 290832 - DNA, 20 bp, Artificial Sequence
  chemically synthesized
ataaattataacatgtttct

SEQ ID NO: 290833 - DNA, 20 bp, Artificial Sequence
  chemically synthesized
gttctgctgagattagtgat

SEQ ID NO: 290834 - DNA, 20 bp, Artificial Sequence
  chemically synthesized
tgttctgctgagattagtga

SEQ ID NO: 290835 - DNA, 20 bp, Artificial Sequence
  chemically synthesized
tatttacctatcactaatct

SEQ ID NO: 290836 - DNA, 20 bp, Artificial Sequence
  chemically synthesized
ttacctatcactaatctcag

SEQ ID NO: 290837 - DNA, 20 bp, Artificial Sequence
  chemically synthesized
atatactgttctgctgagat

SEQ ID NO: 290838 - DNA, 20 bp, Artificial Sequence
  chemically synthesized
tatcactaatctcagcagaa

SEQ ID NO: 290839 - DNA, 20 bp, Artificial Sequence
  chemically synthesized
aatatatatactgttctgct

SEQ ID NO: 290840 - DNA, 20 bp, Artificial Sequence
  chemically synthesized
gcttaatattattcatacaa

SEQ ID NO: 290841 - DNA, 20 bp, Artificial Sequence
  chemically synthesized
agcttaatattattcataca

SEQ ID NO: 290842 - DNA, 20 bp, Artificial Sequence
  chemically synthesized
aagcttaatattattcatac

SEQ ID NO: 290843 - DNA, 20 bp, Artificial Sequence
  chemically synthesized
gcccttgtatgaataatatt

SEQ ID NO: 290844 - DNA, 20 bp, Artificial Sequence
  chemically synthesized
ggtaaaatatttagcaagat

SEQ ID NO: 290845 - DNA, 20 bp, Artificial Sequence
  chemically synthesized
ctttaggtaaaatatttagc

SEQ ID NO: 290846 - DNA, 20 bp, Artificial Sequence
  chemically synthesized
atcactttaggtaaaatatt

SEQ ID NO: 290847 - DNA, 20 bp, Artificial Sequence
  chemically synthesized
cttgctaaatattttaccta

SEQ ID NO: 290848 - DNA, 20 bp, Artificial Sequence
  chemically synthesized
ttaatttgaagaatcacttt

SEQ ID NO: 290849 - DNA, 20 bp, Artificial Sequence
  chemically synthesized
attaatttgaagaatcactt

SEQ ID NO: 290850 - DNA, 20 bp, Artificial Sequence
  chemically synthesized
cattggtgtctattaatttg

SEQ ID NO: 290851 - DNA, 20 bp, Artificial Sequence
  chemically synthesized
aaagtgattcttcaaattaa

SEQ ID NO: 290852 - DNA, 20 bp, Artificial Sequence
  chemically synthesized
ttcaaattaatagacaccaa

SEQ ID NO: 290853 - DNA, 20 bp, Artificial Sequence
  chemically synthesized
tcaaattaatagacaccaat

SEQ ID NO: 290854 - DNA, 20 bp, Artificial Sequence
  chemically synthesized
actctttctctcagacccat

SEQ ID NO: 290855 - DNA, 20 bp, Artificial Sequence
  chemically synthesized
taatagacaccaatgggtct

SEQ ID NO: 290856 - DNA, 20 bp, Artificial Sequence
  chemically synthesized
atagacaccaatgggtctga

SEQ ID NO: 290857 - DNA, 20 bp, Artificial Sequence
  chemically synthesized
acaccaatgggtctgagaga

SEQ ID NO: 290858 - DNA, 20 bp, Artificial Sequence
  chemically synthesized
accaatgggtctgagagaaa

SEQ ID NO: 290859 - DNA, 20 bp, Artificial Sequence
  chemically synthesized
tcaccccttactctttctct

SEQ ID NO: 290860 - DNA, 20 bp, Artificial Sequence
  chemically synthesized
atgggtctgagagaaagagt

SEQ ID NO: 290861 - DNA, 20 bp, Artificial Sequence
  chemically synthesized
tgggtctgagagaaagagta

SEQ ID NO: 290862 - DNA, 20 bp, Artificial Sequence
  chemically synthesized
gggtctgagagaaagagtaa

SEQ ID NO: 290863 - DNA, 20 bp, Artificial Sequence
  chemically synthesized
ggtctgagagaaagagtaag

SEQ ID NO: 290864 - DNA, 20 bp, Artificial Sequence
  chemically synthesized
gagaaagagtaaggggtgat

SEQ ID NO: 290865 - DNA, 20 bp, Artificial Sequence
  chemically synthesized
agaaagagtaaggggtgata

SEQ ID NO: 290866 - DNA, 20 bp, Artificial Sequence
  chemically synthesized
aaagagtaaggggtgataag

SEQ ID NO: 290867 - DNA, 20 bp, Artificial Sequence
  chemically synthesized
aagagtaaggggtgataagg

SEQ ID NO: 290868 - DNA, 20 bp, Artificial Sequence
  chemically synthesized
gggtgataaggaggtgacaa

SEQ ID NO: 290869 - DNA, 20 bp, Artificial Sequence
  chemically synthesized
aaggaggtgacaacggaatt

SEQ ID NO: 290870 - DNA, 20 bp, Artificial Sequence
  chemically synthesized
gtgacaacggaatttggatg

SEQ ID NO: 290871 - DNA, 20 bp, Artificial Sequence
  chemically synthesized
caacggaatttggatgcagt

SEQ ID NO: 290872 - DNA, 20 bp, Artificial Sequence
  chemically synthesized
acggaatttggatgcagtaa

SEQ ID NO: 290873 - DNA, 20 bp, Artificial Sequence
  chemically synthesized
gaatttggatgcagtaagag

SEQ ID NO: 290874 - DNA, 20 bp, Artificial Sequence
  chemically synthesized
gtaagagaagtattttccct

SEQ ID NO: 290875 - DNA, 20 bp, Artificial Sequence
  chemically synthesized
taagagaagtattttccctt

SEQ ID NO: 290876 - DNA, 20 bp, Artificial Sequence
  chemically synthesized
ggttgaggaagtcatcctaa

SEQ ID NO: 290877 - DNA, 20 bp, Artificial Sequence
  chemically synthesized
aggttgaggaagtcatccta

SEQ ID NO: 290878 - DNA, 20 bp, Artificial Sequence
  chemically synthesized
gaggttgaggaagtcatcct

SEQ ID NO: 290879 - DNA, 20 bp, Artificial Sequence
  chemically synthesized
atattgtctggaggttgagg

SEQ ID NO: 290880 - DNA, 20 bp, Artificial Sequence
  chemically synthesized
aggatgacttcctcaacctc

SEQ ID NO: 290881 - DNA, 20 bp, Artificial Sequence
  chemically synthesized
taaatattgtctggaggttg

SEQ ID NO: 290882 - DNA, 20 bp, Artificial Sequence
  chemically synthesized
ttaaatattgtctggaggtt

SEQ ID NO: 290883 - DNA, 20 bp, Artificial Sequence
  chemically synthesized
atatattaaatattgtctgg

SEQ ID NO: 290884 - DNA, 20 bp, Artificial Sequence
  chemically synthesized
tatatattaaatattgtctg

SEQ ID NO: 290885 - DNA, 20 bp, Artificial Sequence
  chemically synthesized
tttatatattaaatattgtc

SEQ ID NO: 290886 - DNA, 20 bp, Artificial Sequence
  chemically synthesized
tatttaatatataaaacctc

SEQ ID NO: 290887 - DNA, 20 bp, Artificial Sequence
  chemically synthesized
gaacaaatggagatcaccag

SEQ ID NO: 290888 - DNA, 20 bp, Artificial Sequence
  chemically synthesized
ggaacaaatggagatcacca

SEQ ID NO: 290889 - DNA, 20 bp, Artificial Sequence
  chemically synthesized
gaggaacaaatggagatcac

SEQ ID NO: 290890 - DNA, 20 bp, Artificial Sequence
  chemically synthesized
cttgatttgaggaacaaatg

SEQ ID NO: 290891 - DNA, 20 bp, Artificial Sequence
  chemically synthesized
gtcttgatttgaggaacaaa

SEQ ID NO: 290892 - DNA, 20 bp, Artificial Sequence
  chemically synthesized
ctccatttgttcctcaaatc

SEQ ID NO: 290893 - DNA, 20 bp, Artificial Sequence
  chemically synthesized
agtatcttggtcttgatttg

SEQ ID NO: 290894 - DNA, 20 bp, Artificial Sequence
  chemically synthesized
tagtatcttggtcttgattt

SEQ ID NO: 290895 - DNA, 20 bp, Artificial Sequence
  chemically synthesized
ttgttcctcaaatcaagacc

SEQ ID NO: 290896 - DNA, 20 bp, Artificial Sequence
  chemically synthesized
tcaaatcaagaccaagatac

SEQ ID NO: 290897 - DNA, 20 bp, Artificial Sequence
  chemically synthesized
tctgggacctgctagtatct

SEQ ID NO: 290898 - DNA, 20 bp, Artificial Sequence
  chemically synthesized
aatcaagaccaagatactag

SEQ ID NO: 290899 - DNA, 20 bp, Artificial Sequence
  chemically synthesized
atcaagaccaagatactagc

SEQ ID NO: 290900 - DNA, 20 bp, Artificial Sequence
  chemically synthesized
caatgacttctgggacctgc

SEQ ID NO: 290901 - DNA, 20 bp, Artificial Sequence
  chemically synthesized
accaagatactagcaggtcc

SEQ ID NO: 290902 - DNA, 20 bp, Artificial Sequence
  chemically synthesized
aagatactagcaggtcccag

SEQ ID NO: 290903 - DNA, 20 bp, Artificial Sequence
  chemically synthesized
gagacaaaccaatgacttct

SEQ ID NO: 290904 - DNA, 20 bp, Artificial Sequence
  chemically synthesized
ggagacaaaccaatgacttc

SEQ ID NO: 290905 - DNA, 20 bp, Artificial Sequence
  chemically synthesized
tagcaggtcccagaagtcat

SEQ ID NO: 290906 - DNA, 20 bp, Artificial Sequence
  chemically synthesized
ggaatcagtcaggtatatag

SEQ ID NO: 290907 - DNA, 20 bp, Artificial Sequence
  chemically synthesized
caggaatcagtcaggtatat

SEQ ID NO: 290908 - DNA, 20 bp, Artificial Sequence
  chemically synthesized
acaggaatcagtcaggtata

SEQ ID NO: 290909 - DNA, 20 bp, Artificial Sequence
  chemically synthesized
gagacaaacaggaatcagtc

SEQ ID NO: 290910 - DNA, 20 bp, Artificial Sequence
  chemically synthesized
agagacaaacaggaatcagt

SEQ ID NO: 290911 - DNA, 20 bp, Artificial Sequence
  chemically synthesized
gaggagagacaaacaggaat

SEQ ID NO: 290912 - DNA, 20 bp, Artificial Sequence
  chemically synthesized
gaatgagaggagagacaaac

SEQ ID NO: 290913 - DNA, 20 bp, Artificial Sequence
  chemically synthesized
tgaatgagaggagagacaaa

SEQ ID NO: 290914 - DNA, 20 bp, Artificial Sequence
  chemically synthesized
ggggcagatgaatgagagga

SEQ ID NO: 290915 - DNA, 20 bp, Artificial Sequence
  chemically synthesized
gaggggcagatgaatgagag

SEQ ID NO: 290916 - DNA, 20 bp, Artificial Sequence
  chemically synthesized
tagaggggcagatgaatgag

SEQ ID NO: 290917 - DNA, 20 bp, Artificial Sequence
  chemically synthesized
atagaggggcagatgaatga

SEQ ID NO: 290918 - DNA, 20 bp, Artificial Sequence
  chemically synthesized
acatagaggggcagatgaat

SEQ ID NO: 290919 - DNA, 20 bp, Artificial Sequence
  chemically synthesized
aaatgctgaacatagagggg

SEQ ID NO: 290920 - DNA, 20 bp, Artificial Sequence
  chemically synthesized
tgtaaatgctgaacatagag

SEQ ID NO: 290921 - DNA, 20 bp, Artificial Sequence
  chemically synthesized
ttgtaaatgctgaacataga

SEQ ID NO: 290922 - DNA, 20 bp, Artificial Sequence
  chemically synthesized
ttcatctgcccctctatgtt

SEQ ID NO: 290923 - DNA, 20 bp, Artificial Sequence
  chemically synthesized
attgtaaatgctgaacatag

SEQ ID NO: 290924 - DNA, 20 bp, Artificial Sequence
  chemically synthesized
cattgtaaatgctgaacata

SEQ ID NO: 290925 - DNA, 20 bp, Artificial Sequence
  chemically synthesized
accattgtaaatgctgaaca

SEQ ID NO: 290926 - DNA, 20 bp, Artificial Sequence
  chemically synthesized
tctatgttcagcatttacaa

SEQ ID NO: 290927 - DNA, 20 bp, Artificial Sequence
  chemically synthesized
catttacaatggtcttcatt

SEQ ID NO: 290928 - DNA, 20 bp, Artificial Sequence
  chemically synthesized
atttacaatggtcttcattc

SEQ ID NO: 290929 - DNA, 20 bp, Artificial Sequence
  chemically synthesized
aaaggccaagcacctgaatg

SEQ ID NO: 290930 - DNA, 20 bp, Artificial Sequence
  chemically synthesized
atggtcttcattcaggtgct

SEQ ID NO: 290931 - DNA, 20 bp, Artificial Sequence
  chemically synthesized
aagagggagcaataaaggcc

SEQ ID NO: 290932 - DNA, 20 bp, Artificial Sequence
  chemically synthesized
atggcaagagggagcaataa

SEQ ID NO: 290933 - DNA, 20 bp, Artificial Sequence
  chemically synthesized
catggcaagagggagcaata

SEQ ID NO: 290934 - DNA, 20 bp, Artificial Sequence
  chemically synthesized
agaaggaacatggcaagagg

SEQ ID NO: 290935 - DNA, 20 bp, Artificial Sequence
  chemically synthesized
gcagaaggaacatggcaaga

SEQ ID NO: 290936 - DNA, 20 bp, Artificial Sequence
  chemically synthesized
ggcagaaggaacatggcaag

SEQ ID NO: 290937 - DNA, 20 bp, Artificial Sequence
  chemically synthesized
aggcagaaggaacatggcaa

SEQ ID NO: 290938 - DNA, 20 bp, Artificial Sequence
  chemically synthesized
ccaggcagaaggaacatggc

SEQ ID NO: 290939 - DNA, 20 bp, Artificial Sequence
  chemically synthesized
gattccaggcagaaggaaca

SEQ ID NO: 290940 - DNA, 20 bp, Artificial Sequence
  chemically synthesized
cttgccatgttccttctgcc

SEQ ID NO: 290941 - DNA, 20 bp, Artificial Sequence
  chemically synthesized
taagcaagattccaggcaga

SEQ ID NO: 290942 - DNA, 20 bp, Artificial Sequence
  chemically synthesized
ttaagcaagattccaggcag

SEQ ID NO: 290943 - DNA, 20 bp, Artificial Sequence
  chemically synthesized
cagttaagcaagattccagg

SEQ ID NO: 290944 - DNA, 20 bp, Artificial Sequence
  chemically synthesized
gaacagttaagcaagattcc

SEQ ID NO: 290945 - DNA, 20 bp, Artificial Sequence
  chemically synthesized
agaacagttaagcaagattc

SEQ ID NO: 290946 - DNA, 20 bp, Artificial Sequence
  chemically synthesized
aggtaagagaacagttaagc

SEQ ID NO: 290947 - DNA, 20 bp, Artificial Sequence
  chemically synthesized
aattaggtaagagaacagtt

SEQ ID NO: 290948 - DNA, 20 bp, Artificial Sequence
  chemically synthesized
gttagaattaggtaagagaa

SEQ ID NO: 290949 - DNA, 20 bp, Artificial Sequence
  chemically synthesized
gataagttagaattaggtaa

SEQ ID NO: 290950 - DNA, 20 bp, Artificial Sequence
  chemically synthesized
gtgataagttagaattaggt

SEQ ID NO: 290951 - DNA, 20 bp, Artificial Sequence
  chemically synthesized
ttttgtgataagttagaatt

SEQ ID NO: 290952 - DNA, 20 bp, Artificial Sequence
  chemically synthesized
cttttgtgataagttagaat

SEQ ID NO: 290953 - DNA, 20 bp, Artificial Sequence
  chemically synthesized
ttgagacttttgtgataagt

SEQ ID NO: 290954 - DNA, 20 bp, Artificial Sequence
  chemically synthesized
ctaattctaacttatcacaa

SEQ ID NO: 290955 - DNA, 20 bp, Artificial Sequence
  chemically synthesized
tgagttgagacttttgtgat

SEQ ID NO: 290956 - DNA, 20 bp, Artificial Sequence
  chemically synthesized
gagggaggaacatttgagtt

SEQ ID NO: 290957 - DNA, 20 bp, Artificial Sequence
  chemically synthesized
tccttgagggaggaacattt

SEQ ID NO: 290958 - DNA, 20 bp, Artificial Sequence
  chemically synthesized
aactcaaatgttcctccctc

SEQ ID NO: 290959 - DNA, 20 bp, Artificial Sequence
  chemically synthesized
actcaaatgttcctccctca

SEQ ID NO: 290960 - DNA, 20 bp, Artificial Sequence
  chemically synthesized
aagggcatcttccttgaggg

SEQ ID NO: 290961 - DNA, 20 bp, Artificial Sequence
  chemically synthesized
caagggcatcttccttgagg

SEQ ID NO: 290962 - DNA, 20 bp, Artificial Sequence
  chemically synthesized
caaatgttcctccctcaagg

SEQ ID NO: 290963 - DNA, 20 bp, Artificial Sequence
  chemically synthesized
accaagggcatcttccttga

SEQ ID NO: 290964 - DNA, 20 bp, Artificial Sequence
  chemically synthesized
caccaagggcatcttccttg

SEQ ID NO: 290965 - DNA, 20 bp, Artificial Sequence
  chemically synthesized
ccaccaagggcatcttcctt

SEQ ID NO: 290966 - DNA, 20 bp, Artificial Sequence
  chemically synthesized
tccctcaaggaagatgccct

SEQ ID NO: 290967 - DNA, 20 bp, Artificial Sequence
  chemically synthesized
ctcaaggaagatgcccttgg

SEQ ID NO: 290968 - DNA, 20 bp, Artificial Sequence
  chemically synthesized
gaacctgatacagccaccaa

SEQ ID NO: 290969 - DNA, 20 bp, Artificial Sequence
  chemically synthesized
cgaacctgatacagccacca

SEQ ID NO: 290970 - DNA, 20 bp, Artificial Sequence
  chemically synthesized
acgaacctgatacagccacc

SEQ ID NO: 290971 - DNA, 20 bp, Artificial Sequence
  chemically synthesized
gatgcccttggtggctgtat

SEQ ID NO: 290972 - DNA, 20 bp, Artificial Sequence
  chemically synthesized
atgcccttggtggctgtatc

SEQ ID NO: 290973 - DNA, 20 bp, Artificial Sequence
  chemically synthesized
agggaaaaacgaacctgata

SEQ ID NO: 290974 - DNA, 20 bp, Artificial Sequence
  chemically synthesized
ctttgggagaatgagtaaca

SEQ ID NO: 290975 - DNA, 20 bp, Artificial Sequence
  chemically synthesized
gctttgggagaatgagtaac

SEQ ID NO: 290976 - DNA, 20 bp, Artificial Sequence
  chemically synthesized
agctttgggagaatgagtaa

SEQ ID NO: 290977 - DNA, 20 bp, Artificial Sequence
  chemically synthesized
atgcaaagctttgggagaat

SEQ ID NO: 290978 - DNA, 20 bp, Artificial Sequence
  chemically synthesized
ccctgttactcattctccca

SEQ ID NO: 290979 - DNA, 20 bp, Artificial Sequence
  chemically synthesized
actaagatgcaaagctttgg

SEQ ID NO: 290980 - DNA, 20 bp, Artificial Sequence
  chemically synthesized
aaactaagatgcaaagcttt

SEQ ID NO: 290981 - DNA, 20 bp, Artificial Sequence
  chemically synthesized
taaactaagatgcaaagctt

SEQ ID NO: 290982 - DNA, 20 bp, Artificial Sequence
  chemically synthesized
tctcccaaagctttgcatct

SEQ ID NO: 290983 - DNA, 20 bp, Artificial Sequence
  chemically synthesized
gtggtttaaactaagatgca

SEQ ID NO: 290984 - DNA, 20 bp, Artificial Sequence
  chemically synthesized
taggaacagtggtttaaact

SEQ ID NO: 290985 - DNA, 20 bp, Artificial Sequence
  chemically synthesized
ttagtttaaaccactgttcc

SEQ ID NO: 290986 - DNA, 20 bp, Artificial Sequence
  chemically synthesized
aaatttcctgctaggaacag

SEQ ID NO: 290987 - DNA, 20 bp, Artificial Sequence
  chemically synthesized
gtttaaaccactgttcctag

SEQ ID NO: 290988 - DNA, 20 bp, Artificial Sequence
  chemically synthesized
tttaaatttcctgctaggaa

SEQ ID NO: 290989 - DNA, 20 bp, Artificial Sequence
  chemically synthesized
tttaaaccactgttcctagc

SEQ ID NO: 290990 - DNA, 20 bp, Artificial Sequence
  chemically synthesized
atatttttaaatttcctgct

SEQ ID NO: 290991 - DNA, 20 bp, Artificial Sequence
  chemically synthesized
aatatttttaaatttcctgc

SEQ ID NO: 290992 - DNA, 20 bp, Artificial Sequence
  chemically synthesized
agaagagagatatgaaacaa

SEQ ID NO: 290993 - DNA, 20 bp, Artificial Sequence
  chemically synthesized
tttacggaaagcagagaaga

SEQ ID NO: 290994 - DNA, 20 bp, Artificial Sequence
  chemically synthesized
tatttacggaaagcagagaa

SEQ ID NO: 290995 - DNA, 20 bp, Artificial Sequence
  chemically synthesized
tgtatttacggaaagcagag

SEQ ID NO: 290996 - DNA, 20 bp, Artificial Sequence
  chemically synthesized
tattgtatttacggaaagca

SEQ ID NO: 290997 - DNA, 20 bp, Artificial Sequence
  chemically synthesized
tttattgtatttacggaaag

SEQ ID NO: 290998 - DNA, 20 bp, Artificial Sequence
  chemically synthesized
gcttttattgtatttacgga

SEQ ID NO: 290999 - DNA, 20 bp, Artificial Sequence
  chemically synthesized
ctctgcttttattgtattta

SEQ ID NO: 291000 - DNA, 20 bp, Artificial Sequence
  chemically synthesized
gctttccgtaaatacaataa

SEQ ID NO: 291001 - DNA, 20 bp, Artificial Sequence
  chemically synthesized
ttccgtaaatacaataaaag

SEQ ID NO: 291002 - DNA, 20 bp, Artificial Sequence
  chemically synthesized
ccgtaaatacaataaaagca

SEQ ID NO: 291003 - DNA, 20 bp, Artificial Sequence
  chemically synthesized
aatattagagtgggcattca

SEQ ID NO: 291004 - DNA, 20 bp, Artificial Sequence
  chemically synthesized
agttttgggaatattagagt

SEQ ID NO: 291005 - DNA, 20 bp, Artificial Sequence
  chemically synthesized
aagttttgggaatattagag

SEQ ID NO: 291006 - DNA, 20 bp, Artificial Sequence
  chemically synthesized
actaagttttgggaatatta

SEQ ID NO: 291007 - DNA, 20 bp, Artificial Sequence
  chemically synthesized
gcactaagttttgggaatat

SEQ ID NO: 291008 - DNA, 20 bp, Artificial Sequence
  chemically synthesized
actctaatattcccaaaact

SEQ ID NO: 291009 - DNA, 20 bp, Artificial Sequence
  chemically synthesized
agcccatagcactaagtttt

SEQ ID NO: 291010 - DNA, 20 bp, Artificial Sequence
  chemically synthesized
cagcccatagcactaagttt

SEQ ID NO: 291011 - DNA, 20 bp, Artificial Sequence
  chemically synthesized
attcccaaaacttagtgcta

SEQ ID NO: 291012 - DNA, 20 bp, Artificial Sequence
  chemically synthesized
acaattcagcccatagcact

SEQ ID NO: 291013 - DNA, 20 bp, Artificial Sequence
  chemically synthesized
ttcccaaaacttagtgctat

SEQ ID NO: 291014 - DNA, 20 bp, Artificial Sequence
  chemically synthesized
ggaagacacaattcagccca

SEQ ID NO: 291015 - DNA, 20 bp, Artificial Sequence
  chemically synthesized
gaattttggaagacacaatt

SEQ ID NO: 291016 - DNA, 20 bp, Artificial Sequence
  chemically synthesized
cttcaacatgtgaattttgg

SEQ ID NO: 291017 - DNA, 20 bp, Artificial Sequence
  chemically synthesized
ggacttcaacatgtgaattt

SEQ ID NO: 291018 - DNA, 20 bp, Artificial Sequence
  chemically synthesized
cttccaaaattcacatgttg

SEQ ID NO: 291019 - DNA, 20 bp, Artificial Sequence
  chemically synthesized
catgttgaagtcctaaccat

SEQ ID NO: 291020 - DNA, 20 bp, Artificial Sequence
  chemically synthesized
aaatagtctcaccaatggtt

SEQ ID NO: 291021 - DNA, 20 bp, Artificial Sequence
  chemically synthesized
caaatagtctcaccaatggt

SEQ ID NO: 291022 - DNA, 20 bp, Artificial Sequence
  chemically synthesized
ttgaagtcctaaccattggt

SEQ ID NO: 291023 - DNA, 20 bp, Artificial Sequence
  chemically synthesized
tcaccaaatagtctcaccaa

SEQ ID NO: 291024 - DNA, 20 bp, Artificial Sequence
  chemically synthesized
taaccattggtgagactatt

SEQ ID NO: 291025 - DNA, 20 bp, Artificial Sequence
  chemically synthesized
ttaaaagtcctatcaccaaa

SEQ ID NO: 291026 - DNA, 20 bp, Artificial Sequence
  chemically synthesized
ttggtgagactatttggtga

SEQ ID NO: 291027 - DNA, 20 bp, Artificial Sequence
  chemically synthesized
tggtgagactatttggtgat

SEQ ID NO: 291028 - DNA, 20 bp, Artificial Sequence
  chemically synthesized
tatttggtgataggactttt

SEQ ID NO: 291029 - DNA, 20 bp, Artificial Sequence
  chemically synthesized
tttggtgataggacttttaa

SEQ ID NO: 291030 - DNA, 20 bp, Artificial Sequence
  chemically synthesized
ttggtgataggacttttaag

SEQ ID NO: 291031 - DNA, 20 bp, Artificial Sequence
  chemically synthesized
taaacatcattacctcttaa

SEQ ID NO: 291032 - DNA, 20 bp, Artificial Sequence
  chemically synthesized
tgatgtttatatgacgtcat

SEQ ID NO: 291033 - DNA, 20 bp, Artificial Sequence
  chemically synthesized
gatgtttatatgacgtcatc

SEQ ID NO: 291034 - DNA, 20 bp, Artificial Sequence
  chemically synthesized
atgtttatatgacgtcatca

SEQ ID NO: 291035 - DNA, 20 bp, Artificial Sequence
  chemically synthesized
ttatatgacgtcatcagggt

SEQ ID NO: 291036 - DNA, 20 bp, Artificial Sequence
  chemically synthesized
tatatgacgtcatcagggtt

SEQ ID NO: 291037 - DNA, 20 bp, Artificial Sequence
  chemically synthesized
tgacgtcatcagggttgggt

SEQ ID NO: 291038 - DNA, 20 bp, Artificial Sequence
  chemically synthesized
gacgtcatcagggttgggta

SEQ ID NO: 291039 - DNA, 20 bp, Artificial Sequence
  chemically synthesized
acgtcatcagggttgggtaa

SEQ ID NO: 291040 - DNA, 20 bp, Artificial Sequence
  chemically synthesized
tcatcagggttgggtaaggg

SEQ ID NO: 291041 - DNA, 20 bp, Artificial Sequence
  chemically synthesized
tcagggttgggtaagggtgg

SEQ ID NO: 291042 - DNA, 20 bp, Artificial Sequence
  chemically synthesized
cagggttgggtaagggtggc

SEQ ID NO: 291043 - DNA, 20 bp, Artificial Sequence
  chemically synthesized
agggttgggtaagggtggcg

SEQ ID NO: 291044 - DNA, 20 bp, Artificial Sequence
  chemically synthesized
gttgggtaagggtggcgggg

SEQ ID NO: 291045 - DNA, 20 bp, Artificial Sequence
  chemically synthesized
ttgggtaagggtggcggggt

SEQ ID NO: 291046 - DNA, 20 bp, Artificial Sequence
  chemically synthesized
tgggtaagggtggcggggtg

SEQ ID NO: 291047 - DNA, 20 bp, Artificial Sequence
  chemically synthesized
gggtaagggtggcggggtgg

SEQ ID NO: 291048 - DNA, 20 bp, Artificial Sequence
  chemically synthesized
ggtaagggtggcggggtggg

SEQ ID NO: 291049 - DNA, 20 bp, Artificial Sequence
  chemically synthesized
ggggtggggggctaatccct

SEQ ID NO: 291050 - DNA, 20 bp, Artificial Sequence
  chemically synthesized
gggtggggggctaatccctt

SEQ ID NO: 291051 - DNA, 20 bp, Artificial Sequence
  chemically synthesized
gccaccaatccctaagggat

SEQ ID NO: 291052 - DNA, 20 bp, Artificial Sequence
  chemically synthesized
ggtggggggctaatccctta

SEQ ID NO: 291053 - DNA, 20 bp, Artificial Sequence
  chemically synthesized
ataaagccaccaatccctaa

SEQ ID NO: 291054 - DNA, 20 bp, Artificial Sequence
  chemically synthesized
ggggctaatcccttagggat

SEQ ID NO: 291055 - DNA, 20 bp, Artificial Sequence
  chemically synthesized
tataaagccaccaatcccta

SEQ ID NO: 291056 - DNA, 20 bp, Artificial Sequence
  chemically synthesized
ttataaagccaccaatccct

SEQ ID NO: 291057 - DNA, 20 bp, Artificial Sequence
  chemically synthesized
gctaatcccttagggattgg

SEQ ID NO: 291058 - DNA, 20 bp, Artificial Sequence
  chemically synthesized
agggattggtggctttataa

SEQ ID NO: 291059 - DNA, 20 bp, Artificial Sequence
  chemically synthesized
gggattggtggctttataaa

SEQ ID NO: 291060 - DNA, 20 bp, Artificial Sequence
  chemically synthesized
tatctctgcctccttttata

SEQ ID NO: 291061 - DNA, 20 bp, Artificial Sequence
  chemically synthesized
gattggtggctttataaaag

SEQ ID NO: 291062 - DNA, 20 bp, Artificial Sequence
  chemically synthesized
attggtggctttataaaagg

SEQ ID NO: 291063 - DNA, 20 bp, Artificial Sequence
  chemically synthesized
ggtggctttataaaaggagg

SEQ ID NO: 291064 - DNA, 20 bp, Artificial Sequence
  chemically synthesized
tggctttataaaaggaggca

SEQ ID NO: 291065 - DNA, 20 bp, Artificial Sequence
  chemically synthesized
tataaaaggaggcagagata

SEQ ID NO: 291066 - DNA, 20 bp, Artificial Sequence
  chemically synthesized
taaaaggaggcagagataaa

SEQ ID NO: 291067 - DNA, 20 bp, Artificial Sequence
  chemically synthesized
aaaggaggcagagataaaga

SEQ ID NO: 291068 - DNA, 20 bp, Artificial Sequence
  chemically synthesized
aggaggcagagataaagaga

SEQ ID NO: 291069 - DNA, 20 bp, Artificial Sequence
  chemically synthesized
gaggcagagataaagagaga

SEQ ID NO: 291070 - DNA, 20 bp, Artificial Sequence
  chemically synthesized
cagagataaagagagagaga

SEQ ID NO: 291071 - DNA, 20 bp, Artificial Sequence
  chemically synthesized
aagagagagagaaagaaaaa

SEQ ID NO: 291072 - DNA, 20 bp, Artificial Sequence
  chemically synthesized
catgcagagagagagaatga

SEQ ID NO: 291073 - DNA, 20 bp, Artificial Sequence
  chemically synthesized
acatgcagagagagagaatg

SEQ ID NO: 291074 - DNA, 20 bp, Artificial Sequence
  chemically synthesized
tacatgcagagagagagaat

SEQ ID NO: 291075 - DNA, 20 bp, Artificial Sequence
  chemically synthesized
tgtgtatacatgcagagaga

SEQ ID NO: 291076 - DNA, 20 bp, Artificial Sequence
  chemically synthesized
tgtgtgtatacatgcagaga

SEQ ID NO: 291077 - DNA, 20 bp, Artificial Sequence
  chemically synthesized
tctgtgtgtatacatgcaga

SEQ ID NO: 291078 - DNA, 20 bp, Artificial Sequence
  chemically synthesized
cctctgtgtgtatacatgca

SEQ ID NO: 291079 - DNA, 20 bp, Artificial Sequence
  chemically synthesized
ttcctctgtgtgtatacatg

SEQ ID NO: 291080 - DNA, 20 bp, Artificial Sequence
  chemically synthesized
tctctctgcatgtatacaca

SEQ ID NO: 291081 - DNA, 20 bp, Artificial Sequence
  chemically synthesized
tctctgcatgtatacacaca

SEQ ID NO: 291082 - DNA, 20 bp, Artificial Sequence
  chemically synthesized
ctctgcatgtatacacacag

SEQ ID NO: 291083 - DNA, 20 bp, Artificial Sequence
  chemically synthesized
gcatgtatacacacagagga

SEQ ID NO: 291084 - DNA, 20 bp, Artificial Sequence
  chemically synthesized
cacacagaggaaagccatgt

SEQ ID NO: 291085 - DNA, 20 bp, Artificial Sequence
  chemically synthesized
acacagaggaaagccatgtg

SEQ ID NO: 291086 - DNA, 20 bp, Artificial Sequence
  chemically synthesized
cttctcactctgtcctcaca

SEQ ID NO: 291087 - DNA, 20 bp, Artificial Sequence
  chemically synthesized
agaggaaagccatgtgagga

SEQ ID NO: 291088 - DNA, 20 bp, Artificial Sequence
  chemically synthesized
aggaaagccatgtgaggaca

SEQ ID NO: 291089 - DNA, 20 bp, Artificial Sequence
  chemically synthesized
aagccatgtgaggacagagt

SEQ ID NO: 291090 - DNA, 20 bp, Artificial Sequence
  chemically synthesized
ccatgtgaggacagagtgag

SEQ ID NO: 291091 - DNA, 20 bp, Artificial Sequence
  chemically synthesized
gtgaggacagagtgagaagt

SEQ ID NO: 291092 - DNA, 20 bp, Artificial Sequence
  chemically synthesized
gtgagaagttggttatctgc

SEQ ID NO: 291093 - DNA, 20 bp, Artificial Sequence
  chemically synthesized
gaagttggttatctgcaagc

SEQ ID NO: 291094 - DNA, 20 bp, Artificial Sequence
  chemically synthesized
aagttggttatctgcaagcc

SEQ ID NO: 291095 - DNA, 20 bp, Artificial Sequence
  chemically synthesized
aaggctgtcttcctggcttg

SEQ ID NO: 291096 - DNA, 20 bp, Artificial Sequence
  chemically synthesized
ttggttatctgcaagccagg

SEQ ID NO: 291097 - DNA, 20 bp, Artificial Sequence
  chemically synthesized
ttatctgcaagccaggaaga

SEQ ID NO: 291098 - DNA, 20 bp, Artificial Sequence
  chemically synthesized
tctggtgaaggctgtcttcc

SEQ ID NO: 291099 - DNA, 20 bp, Artificial Sequence
  chemically synthesized
gccaggaagacagccttcac

SEQ ID NO: 291100 - DNA, 20 bp, Artificial Sequence
  chemically synthesized
aggaagacagccttcaccag

SEQ ID NO: 291101 - DNA, 20 bp, Artificial Sequence
  chemically synthesized
tcagcttcatcttctggtga

SEQ ID NO: 291102 - DNA, 20 bp, Artificial Sequence
  chemically synthesized
ttcagcttcatcttctggtg

SEQ ID NO: 291103 - DNA, 20 bp, Artificial Sequence
  chemically synthesized
acagccttcaccagaagatg

SEQ ID NO: 291104 - DNA, 20 bp, Artificial Sequence
  chemically synthesized
tagggttcagcttcatcttc

SEQ ID NO: 291105 - DNA, 20 bp, Artificial Sequence
  chemically synthesized
gatcaaggtttggtagggtt

SEQ ID NO: 291106 - DNA, 20 bp, Artificial Sequence
  chemically synthesized
tccaggatcaaggtttggta

SEQ ID NO: 291107 - DNA, 20 bp, Artificial Sequence
  chemically synthesized
gtccaggatcaaggtttggt

SEQ ID NO: 291108 - DNA, 20 bp, Artificial Sequence
  chemically synthesized
agtccaggatcaaggtttgg

SEQ ID NO: 291109 - DNA, 20 bp, Artificial Sequence
  chemically synthesized
gaaagtccaggatcaaggtt

SEQ ID NO: 291110 - DNA, 20 bp, Artificial Sequence
  chemically synthesized
accctaccaaaccttgatcc

SEQ ID NO: 291111 - DNA, 20 bp, Artificial Sequence
  chemically synthesized
tgagagaaagtccaggatca

SEQ ID NO: 291112 - DNA, 20 bp, Artificial Sequence
  chemically synthesized
gtgagagaaagtccaggatc

SEQ ID NO: 291113 - DNA, 20 bp, Artificial Sequence
  chemically synthesized
ctagaagtgagagaaagtcc

SEQ ID NO: 291114 - DNA, 20 bp, Artificial Sequence
  chemically synthesized
tctagaagtgagagaaagtc

SEQ ID NO: 291115 - DNA, 20 bp, Artificial Sequence
  chemically synthesized
agagttctagaagtgagaga

SEQ ID NO: 291116 - DNA, 20 bp, Artificial Sequence
  chemically synthesized
cctggactttctctcacttc

SEQ ID NO: 291117 - DNA, 20 bp, Artificial Sequence
  chemically synthesized
tctgagagttctagaagtga

SEQ ID NO: 291118 - DNA, 20 bp, Artificial Sequence
  chemically synthesized
tttctgagagttctagaagt

SEQ ID NO: 291119 - DNA, 20 bp, Artificial Sequence
  chemically synthesized
ttattttctgagagttctag

SEQ ID NO: 291120 - DNA, 20 bp, Artificial Sequence
  chemically synthesized
tctctcacttctagaactct

SEQ ID NO: 291121 - DNA, 20 bp, Artificial Sequence
  chemically synthesized
ggtttattttctgagagttc

SEQ ID NO: 291122 - DNA, 20 bp, Artificial Sequence
  chemically synthesized
aacacaggtttattttctga

SEQ ID NO: 291123 - DNA, 20 bp, Artificial Sequence
  chemically synthesized
acaacacaggtttattttct

SEQ ID NO: 291124 - DNA, 20 bp, Artificial Sequence
  chemically synthesized
ctcggtggcttaaacaacac

SEQ ID NO: 291125 - DNA, 20 bp, Artificial Sequence
  chemically synthesized
actcggtggcttaaacaaca

SEQ ID NO: 291126 - DNA, 20 bp, Artificial Sequence
  chemically synthesized
aaaataaacctgtgttgttt

SEQ ID NO: 291127 - DNA, 20 bp, Artificial Sequence
  chemically synthesized
cctgtgttgtttaagccacc

SEQ ID NO: 291128 - DNA, 20 bp, Artificial Sequence
  chemically synthesized
aataaataccacagactcgg

SEQ ID NO: 291129 - DNA, 20 bp, Artificial Sequence
  chemically synthesized
tgtttaagccaccgagtctg

SEQ ID NO: 291130 - DNA, 20 bp, Artificial Sequence
  chemically synthesized
cacaataaataccacagact

SEQ ID NO: 291131 - DNA, 20 bp, Artificial Sequence
  chemically synthesized
gtctgccacaataaatacca

SEQ ID NO: 291132 - DNA, 20 bp, Artificial Sequence
  chemically synthesized
cgagtctgtggtatttattg

SEQ ID NO: 291133 - DNA, 20 bp, Artificial Sequence
  chemically synthesized
gtctgtggtatttattgtgg

SEQ ID NO: 291134 - DNA, 20 bp, Artificial Sequence
  chemically synthesized
ggtatttattgtggcagact

SEQ ID NO: 291135 - DNA, 20 bp, Artificial Sequence
  chemically synthesized
actgagtgtattaatcagct

SEQ ID NO: 291136 - DNA, 20 bp, Artificial Sequence
  chemically synthesized
atgctactgagtgtattaat

SEQ ID NO: 291137 - DNA, 20 bp, Artificial Sequence
  chemically synthesized
actcagctgattaatacact

SEQ ID NO: 291138 - DNA, 20 bp, Artificial Sequence
  chemically synthesized
cagctgattaatacactcag

SEQ ID NO: 291139 - DNA, 20 bp, Artificial Sequence
  chemically synthesized
atgtgtttaagaatgctact

SEQ ID NO: 291140 - DNA, 20 bp, Artificial Sequence
  chemically synthesized
taagtgtctctaatgtgttt

SEQ ID NO: 291141 - DNA, 20 bp, Artificial Sequence
  chemically synthesized
agtagcattcttaaacacat

SEQ ID NO: 291142 - DNA, 20 bp, Artificial Sequence
  chemically synthesized
tagcattcttaaacacatta

SEQ ID NO: 291143 - DNA, 20 bp, Artificial Sequence
  chemically synthesized
atgcataaaatatatacatt

SEQ ID NO: 291144 - DNA, 20 bp, Artificial Sequence
  chemically synthesized
ttatgcatgaatgtactgtg

SEQ ID NO: 291145 - DNA, 20 bp, Artificial Sequence
  chemically synthesized
tatgcatgaatgtactgtgt

SEQ ID NO: 291146 - DNA, 20 bp, Artificial Sequence
  chemically synthesized
agttagtaatagtacctaca

SEQ ID NO: 291147 - DNA, 20 bp, Artificial Sequence
  chemically synthesized
tcagatatagtagttagtaa

SEQ ID NO: 291148 - DNA, 20 bp, Artificial Sequence
  chemically synthesized
tgagattcagatatagtagt

SEQ ID NO: 291149 - DNA, 20 bp, Artificial Sequence
  chemically synthesized
ttcttgagattcagatatag

SEQ ID NO: 291150 - DNA, 20 bp, Artificial Sequence
  chemically synthesized
cgattcttgagattcagata

SEQ ID NO: 291151 - DNA, 20 bp, Artificial Sequence
  chemically synthesized
aactactatatctgaatctc

SEQ ID NO: 291152 - DNA, 20 bp, Artificial Sequence
  chemically synthesized
cttatccgattcttgagatt

SEQ ID NO: 291153 - DNA, 20 bp, Artificial Sequence
  chemically synthesized
tatatctgaatctcaagaat

SEQ ID NO: 291154 - DNA, 20 bp, Artificial Sequence
  chemically synthesized
tgttaccttatccgattctt

SEQ ID NO: 291155 - DNA, 20 bp, Artificial Sequence
  chemically synthesized
ctgaatctcaagaatcggat

SEQ ID NO: 291156 - DNA, 20 bp, Artificial Sequence
  chemically synthesized
tgaatctcaagaatcggata

SEQ ID NO: 291157 - DNA, 20 bp, Artificial Sequence
  chemically synthesized
agaatcggataaggtaacat

SEQ ID NO: 291158 - DNA, 20 bp, Artificial Sequence
  chemically synthesized
aaggtaacatcagatttttg

SEQ ID NO: 291159 - DNA, 20 bp, Artificial Sequence
  chemically synthesized
taacatcagatttttgtggc

SEQ ID NO: 291160 - DNA, 20 bp, Artificial Sequence
  chemically synthesized
gtggcaagaaataatgtatt

SEQ ID NO: 291161 - DNA, 20 bp, Artificial Sequence
  chemically synthesized
ccgcttttcctgtgaatcag

SEQ ID NO: 291162 - DNA, 20 bp, Artificial Sequence
  chemically synthesized
tggattattcctctgattca

SEQ ID NO: 291163 - DNA, 20 bp, Artificial Sequence
  chemically synthesized
gccgcttttcctgtgaatca

SEQ ID NO: 291164 - DNA, 20 bp, Artificial Sequence
  chemically synthesized
ggattattcctctgattcac

SEQ ID NO: 291165 - DNA, 20 bp, Artificial Sequence
  chemically synthesized
atgccgcttttcctgtgaat

SEQ ID NO: 291166 - DNA, 20 bp, Artificial Sequence
  chemically synthesized
attcctctgattcacaggaa

SEQ ID NO: 291167 - DNA, 20 bp, Artificial Sequence
  chemically synthesized
cctctgattcacaggaaaag

SEQ ID NO: 291168 - DNA, 20 bp, Artificial Sequence
  chemically synthesized
attcacaggaaaagcggcat

SEQ ID NO: 291169 - DNA, 20 bp, Artificial Sequence
  chemically synthesized
tgcattttgtaatttaagaa

SEQ ID NO: 291170 - DNA, 20 bp, Artificial Sequence
  chemically synthesized
tgagatgcattttgtaattt

SEQ ID NO: 291171 - DNA, 20 bp, Artificial Sequence
  chemically synthesized
ttacaaaatgcatctcaatg

SEQ ID NO: 291172 - DNA, 20 bp, Artificial Sequence
  chemically synthesized
atctaaggaatttctacatt

SEQ ID NO: 291173 - DNA, 20 bp, Artificial Sequence
  chemically synthesized
atctcaatgtagaaattcct

SEQ ID NO: 291174 - DNA, 20 bp, Artificial Sequence
  chemically synthesized
taggcaaatacacacatcta

SEQ ID NO: 291175 - DNA, 20 bp, Artificial Sequence
  chemically synthesized
ttaggcaaatacacacatct

SEQ ID NO: 291176 - DNA, 20 bp, Artificial Sequence
  chemically synthesized
gatgtgtgtatttgcctaac

SEQ ID NO: 291177 - DNA, 20 bp, Artificial Sequence
  chemically synthesized
gataaggcacttgacttgtt

SEQ ID NO: 291178 - DNA, 20 bp, Artificial Sequence
  chemically synthesized
gtgtatttgcctaacaagtc

SEQ ID NO: 291179 - DNA, 20 bp, Artificial Sequence
  chemically synthesized
ggataaggcacttgacttgt

SEQ ID NO: 291180 - DNA, 20 bp, Artificial Sequence
  chemically synthesized
acaagtcaagtgccttatcc

SEQ ID NO: 291181 - DNA, 20 bp, Artificial Sequence
  chemically synthesized
caagtcaagtgccttatcca

SEQ ID NO: 291182 - DNA, 20 bp, Artificial Sequence
  chemically synthesized
gataaagaataccttggata

SEQ ID NO: 291183 - DNA, 20 bp, Artificial Sequence
  chemically synthesized
ggataaagaataccttggat

SEQ ID NO: 291184 - DNA, 20 bp, Artificial Sequence
  chemically synthesized
cttttggataaagaatacct

SEQ ID NO: 291185 - DNA, 20 bp, Artificial Sequence
  chemically synthesized
ccaaggtattctttatccaa

SEQ ID NO: 291186 - DNA, 20 bp, Artificial Sequence
  chemically synthesized
agaaagtatacttttggata

SEQ ID NO: 291187 - DNA, 20 bp, Artificial Sequence
  chemically synthesized
aaactcagaaagtatacttt

SEQ ID NO: 291188 - DNA, 20 bp, Artificial Sequence
  chemically synthesized
tatccaaaagtatactttct

SEQ ID NO: 291189 - DNA, 20 bp, Artificial Sequence
  chemically synthesized
gctgaggaaataaactcaga

SEQ ID NO: 291190 - DNA, 20 bp, Artificial Sequence
  chemically synthesized
gtttgctgaggaaataaact

SEQ ID NO: 291191 - DNA, 20 bp, Artificial Sequence
  chemically synthesized
actttctgagtttatttcct

SEQ ID NO: 291192 - DNA, 20 bp, Artificial Sequence
  chemically synthesized
gttcttgtgttagtttgctg

SEQ ID NO: 291193 - DNA, 20 bp, Artificial Sequence
  chemically synthesized
tgttcttgtgttagtttgct

SEQ ID NO: 291194 - DNA, 20 bp, Artificial Sequence
  chemically synthesized
tttcctcagcaaactaacac

SEQ ID NO: 291195 - DNA, 20 bp, Artificial Sequence
  chemically synthesized
taggttttctgttcttgtgt

SEQ ID NO: 291196 - DNA, 20 bp, Artificial Sequence
  chemically synthesized
tcagcaaactaacacaagaa

SEQ ID NO: 291197 - DNA, 20 bp, Artificial Sequence
  chemically synthesized
atcggacctgtagcattatt

SEQ ID NO: 291198 - DNA, 20 bp, Artificial Sequence
  chemically synthesized
tatcggacctgtagcattat

SEQ ID NO: 291199 - DNA, 20 bp, Artificial Sequence
  chemically synthesized
cagaaaacctaataatgcta

SEQ ID NO: 291200 - DNA, 20 bp, Artificial Sequence
  chemically synthesized
agaaaacctaataatgctac

SEQ ID NO: 291201 - DNA, 20 bp, Artificial Sequence
  chemically synthesized
ttcttcaaatatcggacctg

SEQ ID NO: 291202 - DNA, 20 bp, Artificial Sequence
  chemically synthesized
tgctacaggtccgatatttg

SEQ ID NO: 291203 - DNA, 20 bp, Artificial Sequence
  chemically synthesized
cttaatggttcttcaaatat

SEQ ID NO: 291204 - DNA, 20 bp, Artificial Sequence
  chemically synthesized
ccgatatttgaagaaccatt

SEQ ID NO: 291205 - DNA, 20 bp, Artificial Sequence
  chemically synthesized
aaaacaattgaaggacttaa

SEQ ID NO: 291206 - DNA, 20 bp, Artificial Sequence
  chemically synthesized
ttgaagagaaaaacaattga

SEQ ID NO: 291207 - DNA, 20 bp, Artificial Sequence
  chemically synthesized
tttgaagagaaaaacaattg

SEQ ID NO: 291208 - DNA, 20 bp, Artificial Sequence
  chemically synthesized
aattgtttttctcttcaaaa

SEQ ID NO: 291209 - DNA, 20 bp, Artificial Sequence
  chemically synthesized
aaattcaaagctattttgaa

SEQ ID NO: 291210 - DNA, 20 bp, Artificial Sequence
  chemically synthesized
agaaattcaaagctattttg

SEQ ID NO: 291211 - DNA, 20 bp, Artificial Sequence
  chemically synthesized
aaaaagtgatgagaaattca

SEQ ID NO: 291212 - DNA, 20 bp, Artificial Sequence
  chemically synthesized
tattggacccaaaaagtgat

SEQ ID NO: 291213 - DNA, 20 bp, Artificial Sequence
  chemically synthesized
ttgaatttctcatcactttt

SEQ ID NO: 291214 - DNA, 20 bp, Artificial Sequence
  chemically synthesized
tgaatttctcatcacttttt

SEQ ID NO: 291215 - DNA, 20 bp, Artificial Sequence
  chemically synthesized
gaaaaggtattggacccaaa

SEQ ID NO: 291216 - DNA, 20 bp, Artificial Sequence
  chemically synthesized
ggttgatttagaaaaggtat

SEQ ID NO: 291217 - DNA, 20 bp, Artificial Sequence
  chemically synthesized
tgacaaggttgatttagaaa

SEQ ID NO: 291218 - DNA, 20 bp, Artificial Sequence
  chemically synthesized
gtgacaaggttgatttagaa

SEQ ID NO: 291219 - DNA, 20 bp, Artificial Sequence
  chemically synthesized
gaaaggtgacaaggttgatt

SEQ ID NO: 291220 - DNA, 20 bp, Artificial Sequence
  chemically synthesized
atagacatggaaaggtgaca

SEQ ID NO: 291221 - DNA, 20 bp, Artificial Sequence
  chemically synthesized
aatagacatggaaaggtgac

SEQ ID NO: 291222 - DNA, 20 bp, Artificial Sequence
  chemically synthesized
aaggtagaatagacatggaa

SEQ ID NO: 291223 - DNA, 20 bp, Artificial Sequence
  chemically synthesized
aaaggtagaatagacatgga

SEQ ID NO: 291224 - DNA, 20 bp, Artificial Sequence
  chemically synthesized
aaataaaggtagaatagaca

SEQ ID NO: 291225 - DNA, 20 bp, Artificial Sequence
  chemically synthesized
tggcttaaataaaggtagaa

SEQ ID NO: 291226 - DNA, 20 bp, Artificial Sequence
  chemically synthesized
aagaatggcttaaataaagg

SEQ ID NO: 291227 - DNA, 20 bp, Artificial Sequence
  chemically synthesized
tgtctattctacctttattt

SEQ ID NO: 291228 - DNA, 20 bp, Artificial Sequence
  chemically synthesized
aaaaagaatggcttaaataa

SEQ ID NO: 291229 - DNA, 20 bp, Artificial Sequence
  chemically synthesized
aaaaaagaatggcttaaata

SEQ ID NO: 291230 - DNA, 20 bp, Artificial Sequence
  chemically synthesized
ttgcatactgtaaaaaagaa

SEQ ID NO: 291231 - DNA, 20 bp, Artificial Sequence
  chemically synthesized
atttaagccattctttttta

SEQ ID NO: 291232 - DNA, 20 bp, Artificial Sequence
  chemically synthesized
ttcatttgcatactgtaaaa

SEQ ID NO: 291233 - DNA, 20 bp, Artificial Sequence
  chemically synthesized
aatacaaaaggcaaggagtg

SEQ ID NO: 291234 - DNA, 20 bp, Artificial Sequence
  chemically synthesized
ttaatacaaaaggcaaggag

SEQ ID NO: 291235 - DNA, 20 bp, Artificial Sequence
  chemically synthesized
catttaatacaaaaggcaag

SEQ ID NO: 291236 - DNA, 20 bp, Artificial Sequence
  chemically synthesized
tacatttaatacaaaaggca

SEQ ID NO: 291237 - DNA, 20 bp, Artificial Sequence
  chemically synthesized
ttacatttaatacaaaaggc

SEQ ID NO: 291238 - DNA, 20 bp, Artificial Sequence
  chemically synthesized
atgattacatttaatacaaa

SEQ ID NO: 291239 - DNA, 20 bp, Artificial Sequence
  chemically synthesized
gatgattacatttaatacaa

SEQ ID NO: 291240 - DNA, 20 bp, Artificial Sequence
  chemically synthesized
tgaacgtttagtgatagatc

SEQ ID NO: 291241 - DNA, 20 bp, Artificial Sequence
  chemically synthesized
ccaggatgaacgtttagtga

SEQ ID NO: 291242 - DNA, 20 bp, Artificial Sequence
  chemically synthesized
acgtttccaggatgaacgtt

SEQ ID NO: 291243 - DNA, 20 bp, Artificial Sequence
  chemically synthesized
ctatcactaaacgttcatcc

SEQ ID NO: 291244 - DNA, 20 bp, Artificial Sequence
  chemically synthesized
ggatggactaaaacgtttcc

SEQ ID NO: 291245 - DNA, 20 bp, Artificial Sequence
  chemically synthesized
aggatggactaaaacgtttc

SEQ ID NO: 291246 - DNA, 20 bp, Artificial Sequence
  chemically synthesized
cgttcatcctggaaacgttt

SEQ ID NO: 291247 - DNA, 20 bp, Artificial Sequence
  chemically synthesized
atgagaaactgattagagga

SEQ ID NO: 291248 - DNA, 20 bp, Artificial Sequence
  chemically synthesized
gttttagtccatcctctaat

SEQ ID NO: 291249 - DNA, 20 bp, Artificial Sequence
  chemically synthesized
gggaatgagaaactgattag

SEQ ID NO: 291250 - DNA, 20 bp, Artificial Sequence
  chemically synthesized
ggggaatgagaaactgatta

SEQ ID NO: 291251 - DNA, 20 bp, Artificial Sequence
  chemically synthesized
gcggggaatgagaaactgat

SEQ ID NO: 291252 - DNA, 20 bp, Artificial Sequence
  chemically synthesized
atgtgcttttcgcggggaat

SEQ ID NO: 291253 - DNA, 20 bp, Artificial Sequence
  chemically synthesized
agtttctcattccccgcgaa

SEQ ID NO: 291254 - DNA, 20 bp, Artificial Sequence
  chemically synthesized
tgagctatgtgcttttcgcg

SEQ ID NO: 291255 - DNA, 20 bp, Artificial Sequence
  chemically synthesized
atgagctatgtgcttttcgc

SEQ ID NO: 291256 - DNA, 20 bp, Artificial Sequence
  chemically synthesized
tatgagctatgtgcttttcg

SEQ ID NO: 291257 - DNA, 20 bp, Artificial Sequence
  chemically synthesized
cattccccgcgaaaagcaca

SEQ ID NO: 291258 - DNA, 20 bp, Artificial Sequence
  chemically synthesized
cgcgaaaagcacatagctca

SEQ ID NO: 291259 - DNA, 20 bp, Artificial Sequence
  chemically synthesized
actgttttcattgttactat

SEQ ID NO: 291260 - DNA, 20 bp, Artificial Sequence
  chemically synthesized
gctcatagtaacaatgaaaa

SEQ ID NO: 291261 - DNA, 20 bp, Artificial Sequence
  chemically synthesized
tagtaacaatgaaaacagtt

SEQ ID NO: 291262 - DNA, 20 bp, Artificial Sequence
  chemically synthesized
agtaacaatgaaaacagttt

SEQ ID NO: 291263 - DNA, 20 bp, Artificial Sequence
  chemically synthesized
gagctgtataataatgaaaa

SEQ ID NO: 291264 - DNA, 20 bp, Artificial Sequence
  chemically synthesized
aggctattttcattattata

SEQ ID NO: 291265 - DNA, 20 bp, Artificial Sequence
  chemically synthesized
cttcaagtgtaagaaaacaa

SEQ ID NO: 291266 - DNA, 20 bp, Artificial Sequence
  chemically synthesized
gccttcaagtgtaagaaaac

SEQ ID NO: 291267 - DNA, 20 bp, Artificial Sequence
  chemically synthesized
ctcttgttttcttacacttg

SEQ ID NO: 291268 - DNA, 20 bp, Artificial Sequence
  chemically synthesized
aggattatgccttcaagtgt

SEQ ID NO: 291269 - DNA, 20 bp, Artificial Sequence
  chemically synthesized
tcttgttttcttacacttga

SEQ ID NO: 291270 - DNA, 20 bp, Artificial Sequence
  chemically synthesized
gatgaaaggattatgccttc

SEQ ID NO: 291271 - DNA, 20 bp, Artificial Sequence
  chemically synthesized
gggcctgagaaagagatgaa

SEQ ID NO: 291272 - DNA, 20 bp, Artificial Sequence
  chemically synthesized
agggcctgagaaagagatga

SEQ ID NO: 291273 - DNA, 20 bp, Artificial Sequence
  chemically synthesized
taatcctttcatctctttct

SEQ ID NO: 291274 - DNA, 20 bp, Artificial Sequence
  chemically synthesized
aatcctttcatctctttctc

SEQ ID NO: 291275 - DNA, 20 bp, Artificial Sequence
  chemically synthesized
ggacaaaagggcctgagaaa

SEQ ID NO: 291276 - DNA, 20 bp, Artificial Sequence
  chemically synthesized
gtggacaaaagggcctgaga

SEQ ID NO: 291277 - DNA, 20 bp, Artificial Sequence
  chemically synthesized
gtaagtggacaaaagggcct

SEQ ID NO: 291278 - DNA, 20 bp, Artificial Sequence
  chemically synthesized
caagatgtaagtggacaaaa

SEQ ID NO: 291279 - DNA, 20 bp, Artificial Sequence
  chemically synthesized
acaagatgtaagtggacaaa

SEQ ID NO: 291280 - DNA, 20 bp, Artificial Sequence
  chemically synthesized
aacaagatgtaagtggacaa

SEQ ID NO: 291281 - DNA, 20 bp, Artificial Sequence
  chemically synthesized
aggggcaaacaagatgtaag

SEQ ID NO: 291282 - DNA, 20 bp, Artificial Sequence
  chemically synthesized
tggaggggcaaacaagatgt

SEQ ID NO: 291283 - DNA, 20 bp, Artificial Sequence
  chemically synthesized
gtggatctggaggggcaaac

SEQ ID NO: 291284 - DNA, 20 bp, Artificial Sequence
  chemically synthesized
ttacatcttgtttgcccctc

SEQ ID NO: 291285 - DNA, 20 bp, Artificial Sequence
  chemically synthesized
agcggacagtggatctggag

SEQ ID NO: 291286 - DNA, 20 bp, Artificial Sequence
  chemically synthesized
gagcggacagtggatctgga

SEQ ID NO: 291287 - DNA, 20 bp, Artificial Sequence
  chemically synthesized
agagcggacagtggatctgg

SEQ ID NO: 291288 - DNA, 20 bp, Artificial Sequence
  chemically synthesized
aagagcggacagtggatctg

SEQ ID NO: 291289 - DNA, 20 bp, Artificial Sequence
  chemically synthesized
agaagagcggacagtggatc

SEQ ID NO: 291290 - DNA, 20 bp, Artificial Sequence
  chemically synthesized
aacaggagaagagcggacag

SEQ ID NO: 291291 - DNA, 20 bp, Artificial Sequence
  chemically synthesized
ggtaacaggagaagagcgga

SEQ ID NO: 291292 - DNA, 20 bp, Artificial Sequence
  chemically synthesized
cctgggtaacaggagaagag

SEQ ID NO: 291293 - DNA, 20 bp, Artificial Sequence
  chemically synthesized
tctcctgggtaacaggagaa

SEQ ID NO: 291294 - DNA, 20 bp, Artificial Sequence
  chemically synthesized
agtctcctgggtaacaggag

SEQ ID NO: 291295 - DNA, 20 bp, Artificial Sequence
  chemically synthesized
atcagtctcctgggtaacag

SEQ ID NO: 291296 - DNA, 20 bp, Artificial Sequence
  chemically synthesized
tccgctcttctcctgttacc

SEQ ID NO: 291297 - DNA, 20 bp, Artificial Sequence
  chemically synthesized
ccgctcttctcctgttaccc

SEQ ID NO: 291298 - DNA, 20 bp, Artificial Sequence
  chemically synthesized
atatcagtctcctgggtaac

SEQ ID NO: 291299 - DNA, 20 bp, Artificial Sequence
  chemically synthesized
aatatcagtctcctgggtaa

SEQ ID NO: 291300 - DNA, 20 bp, Artificial Sequence
  chemically synthesized
gctcttctcctgttacccag

SEQ ID NO: 291301 - DNA, 20 bp, Artificial Sequence
  chemically synthesized
tctgtaaatatcagtctcct

SEQ ID NO: 291302 - DNA, 20 bp, Artificial Sequence
  chemically synthesized
atctgtaaatatcagtctcc

SEQ ID NO: 291303 - DNA, 20 bp, Artificial Sequence
  chemically synthesized
acccaggagactgatattta

SEQ ID NO: 291304 - DNA, 20 bp, Artificial Sequence
  chemically synthesized
gaaccgtcatctgtaaatat

SEQ ID NO: 291305 - DNA, 20 bp, Artificial Sequence
  chemically synthesized
agactgatatttacagatga

SEQ ID NO: 291306 - DNA, 20 bp, Artificial Sequence
  chemically synthesized
taatcgtaagacaaaggaca

SEQ ID NO: 291307 - DNA, 20 bp, Artificial Sequence
  chemically synthesized
ttaatcgtaagacaaaggac

SEQ ID NO: 291308 - DNA, 20 bp, Artificial Sequence
  chemically synthesized
taaacttaatcgtaagacaa

SEQ ID NO: 291309 - DNA, 20 bp, Artificial Sequence
  chemically synthesized
ctaaacttaatcgtaagaca

SEQ ID NO: 291310 - DNA, 20 bp, Artificial Sequence
  chemically synthesized
ttgtcctttgtcttacgatt

SEQ ID NO: 291311 - DNA, 20 bp, Artificial Sequence
  chemically synthesized
cactgactaaacttaatcgt

SEQ ID NO: 291312 - DNA, 20 bp, Artificial Sequence
  chemically synthesized
ctttgtcttacgattaagtt

SEQ ID NO: 291313 - DNA, 20 bp, Artificial Sequence
  chemically synthesized
gtcttacgattaagtttagt

SEQ ID NO: 291314 - DNA, 20 bp, Artificial Sequence
  chemically synthesized
tacgattaagtttagtcagt

SEQ ID NO: 291315 - DNA, 20 bp, Artificial Sequence
  chemically synthesized
acgattaagtttagtcagtg

SEQ ID NO: 291316 - DNA, 20 bp, Artificial Sequence
  chemically synthesized
gattaagtttagtcagtgag

SEQ ID NO: 291317 - DNA, 20 bp, Artificial Sequence
  chemically synthesized
agtcagtgaggagccctgac

SEQ ID NO: 291318 - DNA, 20 bp, Artificial Sequence
  chemically synthesized
ctgcctccagaatcttgtca

SEQ ID NO: 291319 - DNA, 20 bp, Artificial Sequence
  chemically synthesized
cctgcctccagaatcttgtc

SEQ ID NO: 291320 - DNA, 20 bp, Artificial Sequence
  chemically synthesized
ccctgcctccagaatcttgt

SEQ ID NO: 291321 - DNA, 20 bp, Artificial Sequence
  chemically synthesized
gaggagccctgacaagattc

SEQ ID NO: 291322 - DNA, 20 bp, Artificial Sequence
  chemically synthesized
ggagccctgacaagattctg

SEQ ID NO: 291323 - DNA, 20 bp, Artificial Sequence
  chemically synthesized
gagccctgacaagattctgg

SEQ ID NO: 291324 - DNA, 20 bp, Artificial Sequence
  chemically synthesized
ccctgacaagattctggagg

SEQ ID NO: 291325 - DNA, 20 bp, Artificial Sequence
  chemically synthesized
cctgacaagattctggaggc

SEQ ID NO: 291326 - DNA, 20 bp, Artificial Sequence
  chemically synthesized
ctgacaagattctggaggca

SEQ ID NO: 291327 - DNA, 20 bp, Artificial Sequence
  chemically synthesized
ttcacttttttccctgcctc

SEQ ID NO: 291328 - DNA, 20 bp, Artificial Sequence
  chemically synthesized
gattctggaggcagggaaaa

SEQ ID NO: 291329 - DNA, 20 bp, Artificial Sequence
  chemically synthesized
tggaggcagggaaaaaagtg

SEQ ID NO: 291330 - DNA, 20 bp, Artificial Sequence
  chemically synthesized
aggcagggaaaaaagtgaag

SEQ ID NO: 291331 - DNA, 20 bp, Artificial Sequence
  chemically synthesized
ggcagggaaaaaagtgaagt

SEQ ID NO: 291332 - DNA, 20 bp, Artificial Sequence
  chemically synthesized
gcagggaaaaaagtgaagtg

SEQ ID NO: 291333 - DNA, 20 bp, Artificial Sequence
  chemically synthesized
aatcctcatagaaatggagt

SEQ ID NO: 291334 - DNA, 20 bp, Artificial Sequence
  chemically synthesized
aaggaatcctcatagaaatg

SEQ ID NO: 291335 - DNA, 20 bp, Artificial Sequence
  chemically synthesized
ttgtctgactccatttctat

SEQ ID NO: 291336 - DNA, 20 bp, Artificial Sequence
  chemically synthesized
ttaaggaatcctcatagaaa

SEQ ID NO: 291337 - DNA, 20 bp, Artificial Sequence
  chemically synthesized
tgtctgactccatttctatg

SEQ ID NO: 291338 - DNA, 20 bp, Artificial Sequence
  chemically synthesized
gccggcttaaggaatcctca

SEQ ID NO: 291339 - DNA, 20 bp, Artificial Sequence
  chemically synthesized
catttctatgaggattcctt

SEQ ID NO: 291340 - DNA, 20 bp, Artificial Sequence
  chemically synthesized
tctatgaggattccttaagc

SEQ ID NO: 291341 - DNA, 20 bp, Artificial Sequence
  chemically synthesized
aaagcagcatggccggctta

SEQ ID NO: 291342 - DNA, 20 bp, Artificial Sequence
  chemically synthesized
aaaagcagcatggccggctt

SEQ ID NO: 291343 - DNA, 20 bp, Artificial Sequence
  chemically synthesized
catggtaaaagcagcatggc

SEQ ID NO: 291344 - DNA, 20 bp, Artificial Sequence
  chemically synthesized
tcctcatggtaaaagcagca

SEQ ID NO: 291345 - DNA, 20 bp, Artificial Sequence
  chemically synthesized
tcagatcctcatggtaaaag

SEQ ID NO: 291346 - DNA, 20 bp, Artificial Sequence
  chemically synthesized
ggccatgctgcttttaccat

SEQ ID NO: 291347 - DNA, 20 bp, Artificial Sequence
  chemically synthesized
cagtcagatcctcatggtaa

SEQ ID NO: 291348 - DNA, 20 bp, Artificial Sequence
  chemically synthesized
gccatgctgcttttaccatg

SEQ ID NO: 291349 - DNA, 20 bp, Artificial Sequence
  chemically synthesized
aggagacagtcagatcctca

SEQ ID NO: 291350 - DNA, 20 bp, Artificial Sequence
  chemically synthesized
gaaactcagaaggagacagt

SEQ ID NO: 291351 - DNA, 20 bp, Artificial Sequence
  chemically synthesized
tatagaaactcagaaggaga

SEQ ID NO: 291352 - DNA, 20 bp, Artificial Sequence
  chemically synthesized
ggatctgactgtctccttct

SEQ ID NO: 291353 - DNA, 20 bp, Artificial Sequence
  chemically synthesized
cagttatagaaactcagaag

SEQ ID NO: 291354 - DNA, 20 bp, Artificial Sequence
  chemically synthesized
agcagttatagaaactcaga

SEQ ID NO: 291355 - DNA, 20 bp, Artificial Sequence
  chemically synthesized
gagcagttatagaaactcag

SEQ ID NO: 291356 - DNA, 20 bp, Artificial Sequence
  chemically synthesized
agagagcagttatagaaact

SEQ ID NO: 291357 - DNA, 20 bp, Artificial Sequence
  chemically synthesized
gatcagtgagagagcagtta

SEQ ID NO: 291358 - DNA, 20 bp, Artificial Sequence
  chemically synthesized
agaaaggatcagtgagagag

SEQ ID NO: 291359 - DNA, 20 bp, Artificial Sequence
  chemically synthesized
tccagaaaggatcagtgaga

SEQ ID NO: 291360 - DNA, 20 bp, Artificial Sequence
  chemically synthesized
agtccagaaaggatcagtga

SEQ ID NO: 291361 - DNA, 20 bp, Artificial Sequence
  chemically synthesized
ttagtccagaaaggatcagt

SEQ ID NO: 291362 - DNA, 20 bp, Artificial Sequence
  chemically synthesized
ccttttagtccagaaaggat

SEQ ID NO: 291363 - DNA, 20 bp, Artificial Sequence
  chemically synthesized
gctctctcactgatcctttc

SEQ ID NO: 291364 - DNA, 20 bp, Artificial Sequence
  chemically synthesized
ttaccccttttagtccagaa

SEQ ID NO: 291365 - DNA, 20 bp, Artificial Sequence
  chemically synthesized
cttaccccttttagtccaga

SEQ ID NO: 291366 - DNA, 20 bp, Artificial Sequence
  chemically synthesized
actgatcctttctggactaa

SEQ ID NO: 291367 - DNA, 20 bp, Artificial Sequence
  chemically synthesized
ctgatcctttctggactaaa

SEQ ID NO: 291368 - DNA, 20 bp, Artificial Sequence
  chemically synthesized
agttcttaccccttttagtc

SEQ ID NO: 291369 - DNA, 20 bp, Artificial Sequence
  chemically synthesized
tgatcctttctggactaaaa

SEQ ID NO: 291370 - DNA, 20 bp, Artificial Sequence
  chemically synthesized
gatcctttctggactaaaag

SEQ ID NO: 291371 - DNA, 20 bp, Artificial Sequence
  chemically synthesized
atcagagttcttaccccttt

SEQ ID NO: 291372 - DNA, 20 bp, Artificial Sequence
  chemically synthesized
ctttctggactaaaaggggt

SEQ ID NO: 291373 - DNA, 20 bp, Artificial Sequence
  chemically synthesized
aggggtaagaactctgatgc

SEQ ID NO: 291374 - DNA, 20 bp, Artificial Sequence
  chemically synthesized
ggggtaagaactctgatgct

SEQ ID NO: 291375 - DNA, 20 bp, Artificial Sequence
  chemically synthesized
agtgtagtaacccagcatca

SEQ ID NO: 291376 - DNA, 20 bp, Artificial Sequence
  chemically synthesized
atagtgtagtaacccagcat

SEQ ID NO: 291377 - DNA, 20 bp, Artificial Sequence
  chemically synthesized
caccggatagtgtagtaacc

SEQ ID NO: 291378 - DNA, 20 bp, Artificial Sequence
  chemically synthesized
tgctgggttactacactatc

SEQ ID NO: 291379 - DNA, 20 bp, Artificial Sequence
  chemically synthesized
aggaaccacaccggatagtg

SEQ ID NO: 291380 - DNA, 20 bp, Artificial Sequence
  chemically synthesized
ggttactacactatccggtg

SEQ ID NO: 291381 - DNA, 20 bp, Artificial Sequence
  chemically synthesized
tacagaggaaccacaccgga

SEQ ID NO: 291382 - DNA, 20 bp, Artificial Sequence
  chemically synthesized
ggagtacagaggaaccacac

SEQ ID NO: 291383 - DNA, 20 bp, Artificial Sequence
  chemically synthesized
aaaatgtagctggagtacag

SEQ ID NO: 291384 - DNA, 20 bp, Artificial Sequence
  chemically synthesized
ggtgtggttcctctgtactc

SEQ ID NO: 291385 - DNA, 20 bp, Artificial Sequence
  chemically synthesized
taaaatgtagctggagtaca

SEQ ID NO: 291386 - DNA, 20 bp, Artificial Sequence
  chemically synthesized
tttaaaatgtagctggagta

SEQ ID NO: 291387 - DNA, 20 bp, Artificial Sequence
  chemically synthesized
atatttttaaaatgtagctg

SEQ ID NO: 291388 - DNA, 20 bp, Artificial Sequence
  chemically synthesized
agatatttttaaaatgtagc

SEQ ID NO: 291389 - DNA, 20 bp, Artificial Sequence
  chemically synthesized
aaaaagatatttttaaaatg

SEQ ID NO: 291390 - DNA, 20 bp, Artificial Sequence
  chemically synthesized
tttaaaaatatctttttgta

SEQ ID NO: 291391 - DNA, 20 bp, Artificial Sequence
  chemically synthesized
gaggaaggtttctttacaaa

SEQ ID NO: 291392 - DNA, 20 bp, Artificial Sequence
  chemically synthesized
aaattacgataatttgagga

SEQ ID NO: 291393 - DNA, 20 bp, Artificial Sequence
  chemically synthesized
caaattacgataatttgagg

SEQ ID NO: 291394 - DNA, 20 bp, Artificial Sequence
  chemically synthesized
tctcaaattacgataatttg

SEQ ID NO: 291395 - DNA, 20 bp, Artificial Sequence
  chemically synthesized
ctctcaaattacgataattt

SEQ ID NO: 291396 - DNA, 20 bp, Artificial Sequence
  chemically synthesized
tcctcaaattatcgtaattt

SEQ ID NO: 291397 - DNA, 20 bp, Artificial Sequence
  chemically synthesized
ctcaaattatcgtaatttga

SEQ ID NO: 291398 - DNA, 20 bp, Artificial Sequence
  chemically synthesized
tcaaattatcgtaatttgag

SEQ ID NO: 291399 - DNA, 20 bp, Artificial Sequence
  chemically synthesized
tcgtaatttgagaggtccat

SEQ ID NO: 291400 - DNA, 20 bp, Artificial Sequence
  chemically synthesized
aggaaaatatttaaaactga

SEQ ID NO: 291401 - DNA, 20 bp, Artificial Sequence
  chemically synthesized
gcagtataactagatacata

SEQ ID NO: 291402 - DNA, 20 bp, Artificial Sequence
  chemically synthesized
aaatattttccttatgtatc

SEQ ID NO: 291403 - DNA, 20 bp, Artificial Sequence
  chemically synthesized
tgcagtataactagatacat

SEQ ID NO: 291404 - DNA, 20 bp, Artificial Sequence
  chemically synthesized
aagcttggatgcagtataac

SEQ ID NO: 291405 - DNA, 20 bp, Artificial Sequence
  chemically synthesized
tatctagttatactgcatcc

SEQ ID NO: 291406 - DNA, 20 bp, Artificial Sequence
  chemically synthesized
gtcaacaacaagcttggatg

SEQ ID NO: 291407 - DNA, 20 bp, Artificial Sequence
  chemically synthesized
acacgggtcaacaacaagct

SEQ ID NO: 291408 - DNA, 20 bp, Artificial Sequence
  chemically synthesized
tagaaacacgggtcaacaac

SEQ ID NO: 291409 - DNA, 20 bp, Artificial Sequence
  chemically synthesized
atggaaatagttagaaacac

SEQ ID NO: 291410 - DNA, 20 bp, Artificial Sequence
  chemically synthesized
catggaaatagttagaaaca

SEQ ID NO: 291411 - DNA, 20 bp, Artificial Sequence
  chemically synthesized
gtggaatccatggaaatagt

SEQ ID NO: 291412 - DNA, 20 bp, Artificial Sequence
  chemically synthesized
cgtgtttctaactatttcca

SEQ ID NO: 291413 - DNA, 20 bp, Artificial Sequence
  chemically synthesized
aaaagtggaatccatggaaa

SEQ ID NO: 291414 - DNA, 20 bp, Artificial Sequence
  chemically synthesized
ttttgaaaaagtggaatcca

SEQ ID NO: 291415 - DNA, 20 bp, Artificial Sequence
  chemically synthesized
acatagtcattttgaaaaag

SEQ ID NO: 291416 - DNA, 20 bp, Artificial Sequence
  chemically synthesized
gaaacatagtcattttgaaa

SEQ ID NO: 291417 - DNA, 20 bp, Artificial Sequence
  chemically synthesized
tctttgtgacgagtgaaaca

SEQ ID NO: 291418 - DNA, 20 bp, Artificial Sequence
  chemically synthesized
actatgtttcactcgtcaca

SEQ ID NO: 291419 - DNA, 20 bp, Artificial Sequence
  chemically synthesized
tggaactctttctttgtgac

SEQ ID NO: 291420 - DNA, 20 bp, Artificial Sequence
  chemically synthesized
tgtttcactcgtcacaaaga

SEQ ID NO: 291421 - DNA, 20 bp, Artificial Sequence
  chemically synthesized
tttcactcgtcacaaagaaa

SEQ ID NO: 291422 - DNA, 20 bp, Artificial Sequence
  chemically synthesized
gtcacaaagaaagagttcca

SEQ ID NO: 291423 - DNA, 20 bp, Artificial Sequence
  chemically synthesized
caaagaaagagttccaaagt

SEQ ID NO: 291424 - DNA, 20 bp, Artificial Sequence
  chemically synthesized
aagaaagagttccaaagtga

SEQ ID NO: 291425 - DNA, 20 bp, Artificial Sequence
  chemically synthesized
agaaagagttccaaagtgag

SEQ ID NO: 291426 - DNA, 20 bp, Artificial Sequence
  chemically synthesized
taaaaaatggcctctcactt

SEQ ID NO: 291427 - DNA, 20 bp, Artificial Sequence
  chemically synthesized
aagtgagaggccatttttta

SEQ ID NO: 291428 - DNA, 20 bp, Artificial Sequence
  chemically synthesized
cacatgtatcctgtaaaaaa

SEQ ID NO: 291429 - DNA, 20 bp, Artificial Sequence
  chemically synthesized
agtgagaggccattttttac

SEQ ID NO: 291430 - DNA, 20 bp, Artificial Sequence
  chemically synthesized
cattttttacaggatacatg

SEQ ID NO: 291431 - DNA, 20 bp, Artificial Sequence
  chemically synthesized
catgaggcagtttaggagtg

SEQ ID NO: 291432 - DNA, 20 bp, Artificial Sequence
  chemically synthesized
gtaagcatgaggcagtttag

SEQ ID NO: 291433 - DNA, 20 bp, Artificial Sequence
  chemically synthesized
gcgtaagcatgaggcagttt

SEQ ID NO: 291434 - DNA, 20 bp, Artificial Sequence
  chemically synthesized
tgcgtaagcatgaggcagtt

SEQ ID NO: 291435 - DNA, 20 bp, Artificial Sequence
  chemically synthesized
cggtttgcgtaagcatgagg

SEQ ID NO: 291436 - DNA, 20 bp, Artificial Sequence
  chemically synthesized
tgtcggtttgcgtaagcatg

SEQ ID NO: 291437 - DNA, 20 bp, Artificial Sequence
  chemically synthesized
gtgtcggtttgcgtaagcat

SEQ ID NO: 291438 - DNA, 20 bp, Artificial Sequence
  chemically synthesized
ttgattgtgtcggtttgcgt

SEQ ID NO: 291439 - DNA, 20 bp, Artificial Sequence
  chemically synthesized
acagcgctaattgattgtgt

SEQ ID NO: 291440 - DNA, 20 bp, Artificial Sequence
  chemically synthesized
cgcaaaccgacacaatcaat

SEQ ID NO: 291441 - DNA, 20 bp, Artificial Sequence
  chemically synthesized
ttgtatttggcgtagttaca

SEQ ID NO: 291442 - DNA, 20 bp, Artificial Sequence
  chemically synthesized
ttctaaaattgtatttggcg

SEQ ID NO: 291443 - DNA, 20 bp, Artificial Sequence
  chemically synthesized
ccggattctaaaattgtatt

SEQ ID NO: 291444 - DNA, 20 bp, Artificial Sequence
  chemically synthesized
aactacgccaaatacaattt

SEQ ID NO: 291445 - DNA, 20 bp, Artificial Sequence
  chemically synthesized
ccaaatacaattttagaatc

SEQ ID NO: 291446 - DNA, 20 bp, Artificial Sequence
  chemically synthesized
caaatacaattttagaatcc

SEQ ID NO: 291447 - DNA, 20 bp, Artificial Sequence
  chemically synthesized
atatgtaagacgtagatacc

SEQ ID NO: 291448 - DNA, 20 bp, Artificial Sequence
  chemically synthesized
ctgtttaaatatgtaagacg

SEQ ID NO: 291449 - DNA, 20 bp, Artificial Sequence
  chemically synthesized
agaaatctgtttaaatatgt

SEQ ID NO: 291450 - DNA, 20 bp, Artificial Sequence
  chemically synthesized
ctacgtcttacatatttaaa

SEQ ID NO: 291451 - DNA, 20 bp, Artificial Sequence
  chemically synthesized
aaagttcaaaatgtaagcaa

SEQ ID NO: 291452 - DNA, 20 bp, Artificial Sequence
  chemically synthesized
cgcaataaagttcaaaatgt

SEQ ID NO: 291453 - DNA, 20 bp, Artificial Sequence
  chemically synthesized
ggatttagctaagcgcaata

SEQ ID NO: 291454 - DNA, 20 bp, Artificial Sequence
  chemically synthesized
attttgaactttattgcgct

SEQ ID NO: 291455 - DNA, 20 bp, Artificial Sequence
  chemically synthesized
caccttctaaggatttagct

SEQ ID NO: 291456 - DNA, 20 bp, Artificial Sequence
  chemically synthesized
attgcgcttagctaaatcct

SEQ ID NO: 291457 - DNA, 20 bp, Artificial Sequence
  chemically synthesized
acgttcaccttctaaggatt

SEQ ID NO: 291458 - DNA, 20 bp, Artificial Sequence
  chemically synthesized
gcgcttagctaaatccttag

SEQ ID NO: 291459 - DNA, 20 bp, Artificial Sequence
  chemically synthesized
cgcttagctaaatccttaga

SEQ ID NO: 291460 - DNA, 20 bp, Artificial Sequence
  chemically synthesized
aatgaaacgttcaccttcta

SEQ ID NO: 291461 - DNA, 20 bp, Artificial Sequence
  chemically synthesized
taatgaaacgttcaccttct

SEQ ID NO: 291462 - DNA, 20 bp, Artificial Sequence
  chemically synthesized
gaagacagtaacaaattatt

SEQ ID NO: 291463 - DNA, 20 bp, Artificial Sequence
  chemically synthesized
ataatttgttactgtcttct

SEQ ID NO: 291464 - DNA, 20 bp, Artificial Sequence
  chemically synthesized
cttggcaatttccaagaaga

SEQ ID NO: 291465 - DNA, 20 bp, Artificial Sequence
  chemically synthesized
atttcttggcaatttccaag

SEQ ID NO: 291466 - DNA, 20 bp, Artificial Sequence
  chemically synthesized
ggtatttcttggcaatttcc

SEQ ID NO: 291467 - DNA, 20 bp, Artificial Sequence
  chemically synthesized
ctgtcttcttggaaattgcc

SEQ ID NO: 291468 - DNA, 20 bp, Artificial Sequence
  chemically synthesized
cataatcaataggtatttct

SEQ ID NO: 291469 - DNA, 20 bp, Artificial Sequence
  chemically synthesized
ccatttggagcataatcaat

SEQ ID NO: 291470 - DNA, 20 bp, Artificial Sequence
  chemically synthesized
tccatttggagcataatcaa

SEQ ID NO: 291471 - DNA, 20 bp, Artificial Sequence
  chemically synthesized
cctattgattatgctccaaa

SEQ ID NO: 291472 - DNA, 20 bp, Artificial Sequence
  chemically synthesized
attgattatgctccaaatgg

SEQ ID NO: 291473 - DNA, 20 bp, Artificial Sequence
  chemically synthesized
atctcttctccttccatttg

SEQ ID NO: 291474 - DNA, 20 bp, Artificial Sequence
  chemically synthesized
ttgattatgctccaaatgga

SEQ ID NO: 291475 - DNA, 20 bp, Artificial Sequence
  chemically synthesized
gaatctcttctccttccatt

SEQ ID NO: 291476 - DNA, 20 bp, Artificial Sequence
  chemically synthesized
gattatgctccaaatggaag

SEQ ID NO: 291477 - DNA, 20 bp, Artificial Sequence
  chemically synthesized
tatgctccaaatggaaggag

SEQ ID NO: 291478 - DNA, 20 bp, Artificial Sequence
  chemically synthesized
tgctccaaatggaaggagaa

SEQ ID NO: 291479 - DNA, 20 bp, Artificial Sequence
  chemically synthesized
cagttaaaaatttgtaaggt

SEQ ID NO: 291480 - DNA, 20 bp, Artificial Sequence
  chemically synthesized
aagtcagttaaaaatttgta

SEQ ID NO: 291481 - DNA, 20 bp, Artificial Sequence
  chemically synthesized
aaagtcagttaaaaatttgt

SEQ ID NO: 291482 - DNA, 20 bp, Artificial Sequence
  chemically synthesized
agccaacagcaattaaaagt

SEQ ID NO: 291483 - DNA, 20 bp, Artificial Sequence
  chemically synthesized
tcagagccaacagcaattaa

SEQ ID NO: 291484 - DNA, 20 bp, Artificial Sequence
  chemically synthesized
aactgacttttaattgctgt

SEQ ID NO: 291485 - DNA, 20 bp, Artificial Sequence
  chemically synthesized
caccaccccatcagagccaa

SEQ ID NO: 291486 - DNA, 20 bp, Artificial Sequence
  chemically synthesized
ttaattgctgttggctctga

SEQ ID NO: 291487 - DNA, 20 bp, Artificial Sequence
  chemically synthesized
taattgctgttggctctgat

SEQ ID NO: 291488 - DNA, 20 bp, Artificial Sequence
  chemically synthesized
aattgctgttggctctgatg

SEQ ID NO: 291489 - DNA, 20 bp, Artificial Sequence
  chemically synthesized
tccaacccaccaccccatca

SEQ ID NO: 291490 - DNA, 20 bp, Artificial Sequence
  chemically synthesized
tgctgttggctctgatgggg

SEQ ID NO: 291491 - DNA, 20 bp, Artificial Sequence
  chemically synthesized
aatccaacccaccaccccat

SEQ ID NO: 291492 - DNA, 20 bp, Artificial Sequence
  chemically synthesized
tgttggctctgatggggtgg

SEQ ID NO: 291493 - DNA, 20 bp, Artificial Sequence
  chemically synthesized
gttggctctgatggggtggt

SEQ ID NO: 291494 - DNA, 20 bp, Artificial Sequence
  chemically synthesized
gctctgatggggtggtgggt

SEQ ID NO: 291495 - DNA, 20 bp, Artificial Sequence
  chemically synthesized
tggtgggttggattttcaac

SEQ ID NO: 291496 - DNA, 20 bp, Artificial Sequence
  chemically synthesized
ttggattttcaaccagtttt

SEQ ID NO: 291497 - DNA, 20 bp, Artificial Sequence
  chemically synthesized
tgacaactactgctgaaaac

SEQ ID NO: 291498 - DNA, 20 bp, Artificial Sequence
  chemically synthesized
gattttcaaccagttttcag

SEQ ID NO: 291499 - DNA, 20 bp, Artificial Sequence
  chemically synthesized
tttcaaccagttttcagcag

SEQ ID NO: 291500 - DNA, 20 bp, Artificial Sequence
  chemically synthesized
atcagctacaacaattggag

SEQ ID NO: 291501 - DNA, 20 bp, Artificial Sequence
  chemically synthesized
ataatcagctacaacaattg

SEQ ID NO: 291502 - DNA, 20 bp, Artificial Sequence
  chemically synthesized
gtcatctgctccaattgttg

SEQ ID NO: 291503 - DNA, 20 bp, Artificial Sequence
  chemically synthesized
ctataatcagctacaacaat

SEQ ID NO: 291504 - DNA, 20 bp, Artificial Sequence
  chemically synthesized
ccaattgttgtagctgatta

SEQ ID NO: 291505 - DNA, 20 bp, Artificial Sequence
  chemically synthesized
acatcatcgctttctataat

SEQ ID NO: 291506 - DNA, 20 bp, Artificial Sequence
  chemically synthesized
ttgttgtagctgattataga

SEQ ID NO: 291507 - DNA, 20 bp, Artificial Sequence
  chemically synthesized
atgatgttgttctgatactc

SEQ ID NO: 291508 - DNA, 20 bp, Artificial Sequence
  chemically synthesized
gacttaactggctggagtat

SEQ ID NO: 291509 - DNA, 20 bp, Artificial Sequence
  chemically synthesized
tgttgttctgatactccagc

SEQ ID NO: 291510 - DNA, 20 bp, Artificial Sequence
  chemically synthesized
gtgagagacttaactggctg

SEQ ID NO: 291511 - DNA, 20 bp, Artificial Sequence
  chemically synthesized
ttctgatactccagccagtt

SEQ ID NO: 291512 - DNA, 20 bp, Artificial Sequence
  chemically synthesized
aagtgagagacttaactggc

SEQ ID NO: 291513 - DNA, 20 bp, Artificial Sequence
  chemically synthesized
tgctaagtgagagacttaac

SEQ ID NO: 291514 - DNA, 20 bp, Artificial Sequence
  chemically synthesized
agccagttaagtctctcact

SEQ ID NO: 291515 - DNA, 20 bp, Artificial Sequence
  chemically synthesized
ttctgccagttgctaagtga

SEQ ID NO: 291516 - DNA, 20 bp, Artificial Sequence
  chemically synthesized
aattctgccagttgctaagt

SEQ ID NO: 291517 - DNA, 20 bp, Artificial Sequence
  chemically synthesized
taagtctctcacttagcaac

SEQ ID NO: 291518 - DNA, 20 bp, Artificial Sequence
  chemically synthesized
atcgaattctgccagttgct

SEQ ID NO: 291519 - DNA, 20 bp, Artificial Sequence
  chemically synthesized
gtctctcacttagcaactgg

SEQ ID NO: 291520 - DNA, 20 bp, Artificial Sequence
  chemically synthesized
gccggtggatcgaattctgc

SEQ ID NO: 291521 - DNA, 20 bp, Artificial Sequence
  chemically synthesized
actggcagaattcgatccac

SEQ ID NO: 291522 - DNA, 20 bp, Artificial Sequence
  chemically synthesized
cagaacaactgaacagccgg

SEQ ID NO: 291523 - DNA, 20 bp, Artificial Sequence
  chemically synthesized
aattcgatccaccggctgtt

SEQ ID NO: 291524 - DNA, 20 bp, Artificial Sequence
  chemically synthesized
cctcagaacaactgaacagc

SEQ ID NO: 291525 - DNA, 20 bp, Artificial Sequence
  chemically synthesized
caagcctcagaacaactgaa

SEQ ID NO: 291526 - DNA, 20 bp, Artificial Sequence
  chemically synthesized
accggctgttcagttgttct

SEQ ID NO: 291527 - DNA, 20 bp, Artificial Sequence
  chemically synthesized
ccggctgttcagttgttctg

SEQ ID NO: 291528 - DNA, 20 bp, Artificial Sequence
  chemically synthesized
agatagcatcaaacaagcct

SEQ ID NO: 291529 - DNA, 20 bp, Artificial Sequence
  chemically synthesized
taatgcagatagcatcaaac

SEQ ID NO: 291530 - DNA, 20 bp, Artificial Sequence
  chemically synthesized
ctagagggtgttaatgcaga

SEQ ID NO: 291531 - DNA, 20 bp, Artificial Sequence
  chemically synthesized
ctttctagagggtgttaatg

SEQ ID NO: 291532 - DNA, 20 bp, Artificial Sequence
  chemically synthesized
ctatctgcattaacaccctc

SEQ ID NO: 291533 - DNA, 20 bp, Artificial Sequence
  chemically synthesized
ctgcattaacaccctctaga

SEQ ID NO: 291534 - DNA, 20 bp, Artificial Sequence
  chemically synthesized
attatttttttctttctaga

SEQ ID NO: 291535 - DNA, 20 bp, Artificial Sequence
  chemically synthesized
aattatttttttctttctag

SEQ ID NO: 291536 - DNA, 20 bp, Artificial Sequence
  chemically synthesized
taattatttttttctttcta

SEQ ID NO: 291537 - DNA, 20 bp, Artificial Sequence
  chemically synthesized
tttaattatttttttctttc

SEQ ID NO: 291538 - DNA, 20 bp, Artificial Sequence
  chemically synthesized
ctttcagtctgtgggttcag

SEQ ID NO: 291539 - DNA, 20 bp, Artificial Sequence
  chemically synthesized
tctttcagtctgtgggttca

SEQ ID NO: 291540 - DNA, 20 bp, Artificial Sequence
  chemically synthesized
aaatatatcccctgaaccca

SEQ ID NO: 291541 - DNA, 20 bp, Artificial Sequence
  chemically synthesized
ttctttcagtctgtgggttc

SEQ ID NO: 291542 - DNA, 20 bp, Artificial Sequence
  chemically synthesized
tttctttcagtctgtgggtt

SEQ ID NO: 291543 - DNA, 20 bp, Artificial Sequence
  chemically synthesized
gatcatttctttcagtctgt

SEQ ID NO: 291544 - DNA, 20 bp, Artificial Sequence
  chemically synthesized
agatcatttctttcagtctg

SEQ ID NO: 291545 - DNA, 20 bp, Artificial Sequence
  chemically synthesized
cccctgaacccacagactga

SEQ ID NO: 291546 - DNA, 20 bp, Artificial Sequence
  chemically synthesized
ggctttcagatcatttcttt

SEQ ID NO: 291547 - DNA, 20 bp, Artificial Sequence
  chemically synthesized
gactgaaagaaatgatctga

SEQ ID NO: 291548 - DNA, 20 bp, Artificial Sequence
  chemically synthesized
aattaggatgtgttggcttt

SEQ ID NO: 291549 - DNA, 20 bp, Artificial Sequence
  chemically synthesized
cttttataattaggatgtgt

SEQ ID NO: 291550 - DNA, 20 bp, Artificial Sequence
  chemically synthesized
tggtgaatacttttataatt

SEQ ID NO: 291551 - DNA, 20 bp, Artificial Sequence
  chemically synthesized
ccaacacatcctaattataa

SEQ ID NO: 291552 - DNA, 20 bp, Artificial Sequence
  chemically synthesized
gtggtgaatacttttataat

SEQ ID NO: 291553 - DNA, 20 bp, Artificial Sequence
  chemically synthesized
ctggtttgaaatcattcatg

SEQ ID NO: 291554 - DNA, 20 bp, Artificial Sequence
  chemically synthesized
ccacatgaatgatttcaaac

SEQ ID NO: 291555 - DNA, 20 bp, Artificial Sequence
  chemically synthesized
atcttagaaaataattgatc

SEQ ID NO: 291556 - DNA, 20 bp, Artificial Sequence
  chemically synthesized
aaccagatcaattattttct

SEQ ID NO: 291557 - DNA, 20 bp, Artificial Sequence
  chemically synthesized
atatttacacatttatatct

SEQ ID NO: 291558 - DNA, 20 bp, Artificial Sequence
  chemically synthesized
taaatgtgtaaatatgattt

SEQ ID NO: 291559 - DNA, 20 bp, Artificial Sequence
  chemically synthesized
gattattcaatgtgaattat

SEQ ID NO: 291560 - DNA, 20 bp, Artificial Sequence
  chemically synthesized
gatattcattgttgtgacgc

SEQ ID NO: 291561 - DNA, 20 bp, Artificial Sequence
  chemically synthesized
caatgaatatcaatgccatc

SEQ ID NO: 291562 - DNA, 20 bp, Artificial Sequence
  chemically synthesized
tcttatgtcttattacttga

SEQ ID NO: 291563 - DNA, 20 bp, Artificial Sequence
  chemically synthesized
tatcaatgccatcaagtaat

SEQ ID NO: 291564 - DNA, 20 bp, Artificial Sequence
  chemically synthesized
gccatcaagtaataagacat

SEQ ID NO: 291565 - DNA, 20 bp, Artificial Sequence
  chemically synthesized
aagtaataagacataagatg

SEQ ID NO: 291566 - DNA, 20 bp, Artificial Sequence
  chemically synthesized
agacataagatgtagaaaat

SEQ ID NO: 291567 - DNA, 20 bp, Artificial Sequence
  chemically synthesized
gagcacttttgtttttattt

SEQ ID NO: 291568 - DNA, 20 bp, Artificial Sequence
  chemically synthesized
aaaaacttaaataaaaacaa

SEQ ID NO: 291569 - DNA, 20 bp, Artificial Sequence
  chemically synthesized
aataaaaacaaaagtgctca

SEQ ID NO: 291570 - DNA, 20 bp, Artificial Sequence
  chemically synthesized
ccagctcccatcagagcttt

SEQ ID NO: 291571 - DNA, 20 bp, Artificial Sequence
  chemically synthesized
aaaagtgctcaaagctctga

SEQ ID NO: 291572 - DNA, 20 bp, Artificial Sequence
  chemically synthesized
aaagtgctcaaagctctgat

SEQ ID NO: 291573 - DNA, 20 bp, Artificial Sequence
  chemically synthesized
agtgctcaaagctctgatgg

SEQ ID NO: 291574 - DNA, 20 bp, Artificial Sequence
  chemically synthesized
cagccttccagctcccatca

SEQ ID NO: 291575 - DNA, 20 bp, Artificial Sequence
  chemically synthesized
tgcagccttccagctcccat

SEQ ID NO: 291576 - DNA, 20 bp, Artificial Sequence
  chemically synthesized
ctcaaagctctgatgggagc

SEQ ID NO: 291577 - DNA, 20 bp, Artificial Sequence
  chemically synthesized
aaagctctgatgggagctgg

SEQ ID NO: 291578 - DNA, 20 bp, Artificial Sequence
  chemically synthesized
aagctctgatgggagctgga

SEQ ID NO: 291579 - DNA, 20 bp, Artificial Sequence
  chemically synthesized
tacttgttcatgcagccttc

SEQ ID NO: 291580 - DNA, 20 bp, Artificial Sequence
  chemically synthesized
agctggaaggctgcatgaac

SEQ ID NO: 291581 - DNA, 20 bp, Artificial Sequence
  chemically synthesized
caaaatgttacttgttcatg

SEQ ID NO: 291582 - DNA, 20 bp, Artificial Sequence
  chemically synthesized
tgcatgaacaagtaacattt

SEQ ID NO: 291583 - DNA, 20 bp, Artificial Sequence
  chemically synthesized
agtaacattttggatgtttt

SEQ ID NO: 291584 - DNA, 20 bp, Artificial Sequence
  chemically synthesized
tagtttggggaagtatattt

SEQ ID NO: 291585 - DNA, 20 bp, Artificial Sequence
  chemically synthesized
aaatgtaagttagtttgggg

SEQ ID NO: 291586 - DNA, 20 bp, Artificial Sequence
  chemically synthesized
taaaaatgtaagttagtttg

SEQ ID NO: 291587 - DNA, 20 bp, Artificial Sequence
  chemically synthesized
ttaaaaatgtaagttagttt

SEQ ID NO: 291588 - DNA, 20 bp, Artificial Sequence
  chemically synthesized
attaaaaatgtaagttagtt

SEQ ID NO: 291589 - DNA, 20 bp, Artificial Sequence
  chemically synthesized
ttaaaattaaaaatgtaagt

SEQ ID NO: 291590 - DNA, 20 bp, Artificial Sequence
  chemically synthesized
atttttaaaattaaaaatgt

SEQ ID NO: 291591 - DNA, 20 bp, Artificial Sequence
  chemically synthesized
tacatttttaattttaaaaa

SEQ ID NO: 291592 - DNA, 20 bp, Artificial Sequence
  chemically synthesized
acatttttaattttaaaaat

SEQ ID NO: 291593 - DNA, 20 bp, Artificial Sequence
  chemically synthesized
tttaattttaaaaatgggct

SEQ ID NO: 291594 - DNA, 20 bp, Artificial Sequence
  chemically synthesized
ttaaaaatgggcttggaaat

SEQ ID NO: 291595 - DNA, 20 bp, Artificial Sequence
  chemically synthesized
tactatttaaactaatttcc

SEQ ID NO: 291596 - DNA, 20 bp, Artificial Sequence
  chemically synthesized
ggcttggaaattagtttaaa

SEQ ID NO: 291597 - DNA, 20 bp, Artificial Sequence
  chemically synthesized
tagtttaaatagtattttca

SEQ ID NO: 291598 - DNA, 20 bp, Artificial Sequence
  chemically synthesized
agtattttcatagttttaaa

SEQ ID NO: 291599 - DNA, 20 bp, Artificial Sequence
  chemically synthesized
tattttcatagttttaaaaa

SEQ ID NO: 291600 - DNA, 20 bp, Artificial Sequence
  chemically synthesized
attttcatagttttaaaaag

SEQ ID NO: 291601 - DNA, 20 bp, Artificial Sequence
  chemically synthesized
aaaaagaggaaaaaaaatcc

SEQ ID NO: 291602 - DNA, 20 bp, Artificial Sequence
  chemically synthesized
aatgaaataaagaataatct

SEQ ID NO: 291603 - DNA, 20 bp, Artificial Sequence
  chemically synthesized
aatcttctgtaaatgaaata

SEQ ID NO: 291604 - DNA, 20 bp, Artificial Sequence
  chemically synthesized
attattctttatttcattta

SEQ ID NO: 291605 - DNA, 20 bp, Artificial Sequence
  chemically synthesized
attctttatttcatttacag

SEQ ID NO: 291606 - DNA, 20 bp, Artificial Sequence
  chemically synthesized
ttatttcatttacagaagat

SEQ ID NO: 291607 - DNA, 20 bp, Artificial Sequence
  chemically synthesized
tacagaagattagaaataaa

SEQ ID NO: 291608 - DNA, 20 bp, Artificial Sequence
  chemically synthesized
attagaaataaacagattgt

SEQ ID NO: 291609 - DNA, 20 bp, Artificial Sequence
  chemically synthesized
gaaataaacagattgtcggc

SEQ ID NO: 291610 - DNA, 20 bp, Artificial Sequence
  chemically synthesized
aaataaacagattgtcggct

SEQ ID NO: 291611 - DNA, 20 bp, Artificial Sequence
  chemically synthesized
aacagattgtcggctgggca

SEQ ID NO: 291612 - DNA, 20 bp, Artificial Sequence
  chemically synthesized
agattgtcggctgggcacgg

SEQ ID NO: 291613 - DNA, 20 bp, Artificial Sequence
  chemically synthesized
taggcatgagccaccgtgcc

SEQ ID NO: 291614 - DNA, 20 bp, Artificial Sequence
  chemically synthesized
agtgttggaattataggcat

SEQ ID NO: 291615 - DNA, 20 bp, Artificial Sequence
  chemically synthesized
tcccaaagtgttggaattat

SEQ ID NO: 291616 - DNA, 20 bp, Artificial Sequence
  chemically synthesized
ctcccaaagtgttggaatta

SEQ ID NO: 291617 - DNA, 20 bp, Artificial Sequence
  chemically synthesized
tgcctataattccaacactt

SEQ ID NO: 291618 - DNA, 20 bp, Artificial Sequence
  chemically synthesized
gcctataattccaacacttt

SEQ ID NO: 291619 - DNA, 20 bp, Artificial Sequence
  chemically synthesized
acctcggcctcccaaagtgt

SEQ ID NO: 291620 - DNA, 20 bp, Artificial Sequence
  chemically synthesized
ctataattccaacactttgg

SEQ ID NO: 291621 - DNA, 20 bp, Artificial Sequence
  chemically synthesized
tataattccaacactttggg

SEQ ID NO: 291622 - DNA, 20 bp, Artificial Sequence
  chemically synthesized
tcccccacctcggcctccca

SEQ ID NO: 291623 - DNA, 20 bp, Artificial Sequence
  chemically synthesized
ttccaacactttgggaggcc

SEQ ID NO: 291624 - DNA, 20 bp, Artificial Sequence
  chemically synthesized
tccaacactttgggaggccg

SEQ ID NO: 291625 - DNA, 20 bp, Artificial Sequence
  chemically synthesized
aacactttgggaggccgagg

SEQ ID NO: 291626 - DNA, 20 bp, Artificial Sequence
  chemically synthesized
acactttgggaggccgaggt

SEQ ID NO: 291627 - DNA, 20 bp, Artificial Sequence
  chemically synthesized
cactttgggaggccgaggtg

SEQ ID NO: 291628 - DNA, 20 bp, Artificial Sequence
  chemically synthesized
actttgggaggccgaggtgg

SEQ ID NO: 291629 - DNA, 20 bp, Artificial Sequence
  chemically synthesized
gatgccgtgatcccccacct

SEQ ID NO: 291630 - DNA, 20 bp, Artificial Sequence
  chemically synthesized
gaggccgaggtgggggatca

SEQ ID NO: 291631 - DNA, 20 bp, Artificial Sequence
  chemically synthesized
gaggtgggggatcacggcat

SEQ ID NO: 291632 - DNA, 20 bp, Artificial Sequence
  chemically synthesized
aggtgggggatcacggcatc

SEQ ID NO: 291633 - DNA, 20 bp, Artificial Sequence
  chemically synthesized
gtgggggatcacggcatcgg

SEQ ID NO: 291634 - DNA, 20 bp, Artificial Sequence
  chemically synthesized
gatcacggcatcgggagatc

SEQ ID NO: 291635 - DNA, 20 bp, Artificial Sequence
  chemically synthesized
tcgggagatcaagaccatcc

SEQ ID NO: 291636 - DNA, 20 bp, Artificial Sequence
  chemically synthesized
tttcaccgtgttagccagga

SEQ ID NO: 291637 - DNA, 20 bp, Artificial Sequence
  chemically synthesized
ggggtttcaccgtgttagcc

SEQ ID NO: 291638 - DNA, 20 bp, Artificial Sequence
  chemically synthesized
caagaccatcctggctaaca

SEQ ID NO: 291639 - DNA, 20 bp, Artificial Sequence
  chemically synthesized
cggggtttcaccgtgttagc

SEQ ID NO: 291640 - DNA, 20 bp, Artificial Sequence
  chemically synthesized
gagacggggtttcaccgtgt

SEQ ID NO: 291641 - DNA, 20 bp, Artificial Sequence
  chemically synthesized
ttgtatttttagtagagacg

SEQ ID NO: 291642 - DNA, 20 bp, Artificial Sequence
  chemically synthesized
tttgtatttttagtagagac

SEQ ID NO: 291643 - DNA, 20 bp, Artificial Sequence
  chemically synthesized
ttttgtatttttagtagaga

SEQ ID NO: 291644 - DNA, 20 bp, Artificial Sequence
  chemically synthesized
aattttttgtatttttagta

SEQ ID NO: 291645 - DNA, 20 bp, Artificial Sequence
  chemically synthesized
ctaattttttgtatttttag

SEQ ID NO: 291646 - DNA, 20 bp, Artificial Sequence
  chemically synthesized
cggctaattttttgtatttt

SEQ ID NO: 291647 - DNA, 20 bp, Artificial Sequence
  chemically synthesized
ctactaaaaatacaaaaaat

SEQ ID NO: 291648 - DNA, 20 bp, Artificial Sequence
  chemically synthesized
taaaaatacaaaaaattagc

SEQ ID NO: 291649 - DNA, 20 bp, Artificial Sequence
  chemically synthesized
aaaaatacaaaaaattagcc

SEQ ID NO: 291650 - DNA, 20 bp, Artificial Sequence
  chemically synthesized
tacaaaaaattagccgggcg

SEQ ID NO: 291651 - DNA, 20 bp, Artificial Sequence
  chemically synthesized
aaaaaattagccgggcgtgg

SEQ ID NO: 291652 - DNA, 20 bp, Artificial Sequence
  chemically synthesized
caggcgcccgccaccacgcc

SEQ ID NO: 291653 - DNA, 20 bp, Artificial Sequence
  chemically synthesized
aaattagccgggcgtggtgg

SEQ ID NO: 291654 - DNA, 20 bp, Artificial Sequence
  chemically synthesized
aattagccgggcgtggtggc

SEQ ID NO: 291655 - DNA, 20 bp, Artificial Sequence
  chemically synthesized
cgggcgtggtggcgggcgcc

SEQ ID NO: 291656 - DNA, 20 bp, Artificial Sequence
  chemically synthesized
gggcgtggtggcgggcgcct

SEQ ID NO: 291657 - DNA, 20 bp, Artificial Sequence
  chemically synthesized
ggcgtggtggcgggcgcctg

SEQ ID NO: 291658 - DNA, 20 bp, Artificial Sequence
  chemically synthesized
gtggcgggcgcctggggttc

SEQ ID NO: 291659 - DNA, 20 bp, Artificial Sequence
  chemically synthesized
tcccgagtagctggaacccc

SEQ ID NO: 291660 - DNA, 20 bp, Artificial Sequence
  chemically synthesized
ctcccgagtagctggaaccc

SEQ ID NO: 291661 - DNA, 20 bp, Artificial Sequence
  chemically synthesized
cgcctggggttccagctact

SEQ ID NO: 291662 - DNA, 20 bp, Artificial Sequence
  chemically synthesized
gcctggggttccagctactc

SEQ ID NO: 291663 - DNA, 20 bp, Artificial Sequence
  chemically synthesized
gcctcagcctcccgagtagc

SEQ ID NO: 291664 - DNA, 20 bp, Artificial Sequence
  chemically synthesized
ctggggttccagctactcgg

SEQ ID NO: 291665 - DNA, 20 bp, Artificial Sequence
  chemically synthesized
tggggttccagctactcggg

SEQ ID NO: 291666 - DNA, 20 bp, Artificial Sequence
  chemically synthesized
tcctgcctcagcctcccgag

SEQ ID NO: 291667 - DNA, 20 bp, Artificial Sequence
  chemically synthesized
ttctcctgcctcagcctccc

SEQ ID NO: 291668 - DNA, 20 bp, Artificial Sequence
  chemically synthesized
ttccagctactcgggaggct

SEQ ID NO: 291669 - DNA, 20 bp, Artificial Sequence
  chemically synthesized
tccagctactcgggaggctg

SEQ ID NO: 291670 - DNA, 20 bp, Artificial Sequence
  chemically synthesized
agctactcgggaggctgagg

SEQ ID NO: 291671 - DNA, 20 bp, Artificial Sequence
  chemically synthesized
gctactcgggaggctgaggc

SEQ ID NO: 291672 - DNA, 20 bp, Artificial Sequence
  chemically synthesized
tactcgggaggctgaggcag

SEQ ID NO: 291673 - DNA, 20 bp, Artificial Sequence
  chemically synthesized
ttcacgccattctcctgcct

SEQ ID NO: 291674 - DNA, 20 bp, Artificial Sequence
  chemically synthesized
gggaggctgaggcaggagaa

SEQ ID NO: 291675 - DNA, 20 bp, Artificial Sequence
  chemically synthesized
gcaggagaatggcgtgaacc

SEQ ID NO: 291676 - DNA, 20 bp, Artificial Sequence
  chemically synthesized
caggagaatggcgtgaaccc

SEQ ID NO: 291677 - DNA, 20 bp, Artificial Sequence
  chemically synthesized
ggagaatggcgtgaacccgg

SEQ ID NO: 291678 - DNA, 20 bp, Artificial Sequence
  chemically synthesized
gagaatggcgtgaacccggg

SEQ ID NO: 291679 - DNA, 20 bp, Artificial Sequence
  chemically synthesized
aatggcgtgaacccgggagg

SEQ ID NO: 291680 - DNA, 20 bp, Artificial Sequence
  chemically synthesized
cactgcaagctccgcctccc

SEQ ID NO: 291681 - DNA, 20 bp, Artificial Sequence
  chemically synthesized
tggcgtgaacccgggaggcg

SEQ ID NO: 291682 - DNA, 20 bp, Artificial Sequence
  chemically synthesized
tcactgcaagctccgcctcc

SEQ ID NO: 291683 - DNA, 20 bp, Artificial Sequence
  chemically synthesized
aacccgggaggcggagcttg

SEQ ID NO: 291684 - DNA, 20 bp, Artificial Sequence
  chemically synthesized
cgggaggcggagcttgcagt

SEQ ID NO: 291685 - DNA, 20 bp, Artificial Sequence
  chemically synthesized
gcgcgatctccgctcactgc

SEQ ID NO: 291686 - DNA, 20 bp, Artificial Sequence
  chemically synthesized
gaggcggagcttgcagtgag

SEQ ID NO: 291687 - DNA, 20 bp, Artificial Sequence
  chemically synthesized
ggcggagcttgcagtgagcg

SEQ ID NO: 291688 - DNA, 20 bp, Artificial Sequence
  chemically synthesized
tcacccaggctggagtgcag

SEQ ID NO: 291689 - DNA, 20 bp, Artificial Sequence
  chemically synthesized
gagatcgcgccactgcactc

SEQ ID NO: 291690 - DNA, 20 bp, Artificial Sequence
  chemically synthesized
ctgtcacccaggctggagtg

SEQ ID NO: 291691 - DNA, 20 bp, Artificial Sequence
  chemically synthesized
cgcgccactgcactccagcc

SEQ ID NO: 291692 - DNA, 20 bp, Artificial Sequence
  chemically synthesized
gcgccactgcactccagcct

SEQ ID NO: 291693 - DNA, 20 bp, Artificial Sequence
  chemically synthesized
tcgctctgtcacccaggctg

SEQ ID NO: 291694 - DNA, 20 bp, Artificial Sequence
  chemically synthesized
tctcgctctgtcacccaggc

SEQ ID NO: 291695 - DNA, 20 bp, Artificial Sequence
  chemically synthesized
ctgcactccagcctgggtga

SEQ ID NO: 291696 - DNA, 20 bp, Artificial Sequence
  chemically synthesized
agagtctcgctctgtcaccc

SEQ ID NO: 291697 - DNA, 20 bp, Artificial Sequence
  chemically synthesized
gcactccagcctgggtgaca

SEQ ID NO: 291698 - DNA, 20 bp, Artificial Sequence
  chemically synthesized
cagagtctcgctctgtcacc

SEQ ID NO: 291699 - DNA, 20 bp, Artificial Sequence
  chemically synthesized
tccagcctgggtgacagagc

SEQ ID NO: 291700 - DNA, 20 bp, Artificial Sequence
  chemically synthesized
tccatggacaatatgagaca

SEQ ID NO: 291701 - DNA, 20 bp, Artificial Sequence
  chemically synthesized
catccatggacaatatgaga

SEQ ID NO: 291702 - DNA, 20 bp, Artificial Sequence
  chemically synthesized
ctcgcatccatggacaatat

SEQ ID NO: 291703 - DNA, 20 bp, Artificial Sequence
  chemically synthesized
actctgtctcatattgtcca

SEQ ID NO: 291704 - DNA, 20 bp, Artificial Sequence
  chemically synthesized
ctcatattgtccatggatgc

SEQ ID NO: 291705 - DNA, 20 bp, Artificial Sequence
  chemically synthesized
gtttttcttcctcgcatcca

SEQ ID NO: 291706 - DNA, 20 bp, Artificial Sequence
  chemically synthesized
tcatattgtccatggatgcg

SEQ ID NO: 291707 - DNA, 20 bp, Artificial Sequence
  chemically synthesized
tattgtccatggatgcgagg

SEQ ID NO: 291708 - DNA, 20 bp, Artificial Sequence
  chemically synthesized
tggatgcgaggaagaaaaac

SEQ ID NO: 291709 - DNA, 20 bp, Artificial Sequence
  chemically synthesized
cgaggaagaaaaacaagtac

SEQ ID NO: 291710 - DNA, 20 bp, Artificial Sequence
  chemically synthesized
gaggaagaaaaacaagtact

SEQ ID NO: 291711 - DNA, 20 bp, Artificial Sequence
  chemically synthesized
attagaaagattatttttcc

SEQ ID NO: 291712 - DNA, 20 bp, Artificial Sequence
  chemically synthesized
taaaaatgtttcacattaga

SEQ ID NO: 291713 - DNA, 20 bp, Artificial Sequence
  chemically synthesized
aatttaaaaatgtttcacat

SEQ ID NO: 291714 - DNA, 20 bp, Artificial Sequence
  chemically synthesized
catttttaaatttataaatg

SEQ ID NO: 291715 - DNA, 20 bp, Artificial Sequence
  chemically synthesized
ttttaaatttataaatgtag

SEQ ID NO: 291716 - DNA, 20 bp, Artificial Sequence
  chemically synthesized
aaatgtagaagttgatctca

SEQ ID NO: 291717 - DNA, 20 bp, Artificial Sequence
  chemically synthesized
acagatgattttaaaacttt

SEQ ID NO: 291718 - DNA, 20 bp, Artificial Sequence
  chemically synthesized
caaagttttaaaatcatctg

SEQ ID NO: 291719 - DNA, 20 bp, Artificial Sequence
  chemically synthesized
ttctgggtttggtattacta

SEQ ID NO: 291720 - DNA, 20 bp, Artificial Sequence
  chemically synthesized
atctgtagtaataccaaacc

SEQ ID NO: 291721 - DNA, 20 bp, Artificial Sequence
  chemically synthesized
ttgataaagttttctgggtt

SEQ ID NO: 291722 - DNA, 20 bp, Artificial Sequence
  chemically synthesized
ttcccttgataaagttttct

SEQ ID NO: 291723 - DNA, 20 bp, Artificial Sequence
  chemically synthesized
tttcccttgataaagttttc

SEQ ID NO: 291724 - DNA, 20 bp, Artificial Sequence
  chemically synthesized
caaacccagaaaactttatc

SEQ ID NO: 291725 - DNA, 20 bp, Artificial Sequence
  chemically synthesized
aaacccagaaaactttatca

SEQ ID NO: 291726 - DNA, 20 bp, Artificial Sequence
  chemically synthesized
aacccagaaaactttatcaa

SEQ ID NO: 291727 - DNA, 20 bp, Artificial Sequence
  chemically synthesized
tttccatttttcccttgata

SEQ ID NO: 291728 - DNA, 20 bp, Artificial Sequence
  chemically synthesized
aaactttatcaagggaaaaa

SEQ ID NO: 291729 - DNA, 20 bp, Artificial Sequence
  chemically synthesized
caagggaaaaatggaaacac

SEQ ID NO: 291730 - DNA, 20 bp, Artificial Sequence
  chemically synthesized
taggtactccagaatggtaa

SEQ ID NO: 291731 - DNA, 20 bp, Artificial Sequence
  chemically synthesized
cattatcaccattaccattc

SEQ ID NO: 291732 - DNA, 20 bp, Artificial Sequence
  chemically synthesized
ttatcaccattaccattctg

SEQ ID NO: 291733 - DNA, 20 bp, Artificial Sequence
  chemically synthesized
acatagtaggtactccagaa

SEQ ID NO: 291734 - DNA, 20 bp, Artificial Sequence
  chemically synthesized
atggtacatagtaggtactc

SEQ ID NO: 291735 - DNA, 20 bp, Artificial Sequence
  chemically synthesized
catattccatggtacatagt

SEQ ID NO: 291736 - DNA, 20 bp, Artificial Sequence
  chemically synthesized
gcatattccatggtacatag

SEQ ID NO: 291737 - DNA, 20 bp, Artificial Sequence
  chemically synthesized
ggagtacctactatgtacca

SEQ ID NO: 291738 - DNA, 20 bp, Artificial Sequence
  chemically synthesized
atagcatattccatggtaca

SEQ ID NO: 291739 - DNA, 20 bp, Artificial Sequence
  chemically synthesized
aaatgacatagcatattcca

SEQ ID NO: 291740 - DNA, 20 bp, Artificial Sequence
  chemically synthesized
tcgtcatatatgaaatgaca

SEQ ID NO: 291741 - DNA, 20 bp, Artificial Sequence
  chemically synthesized
atttcatatatgacgaacgc

SEQ ID NO: 291742 - DNA, 20 bp, Artificial Sequence
  chemically synthesized
tatatgacgaacgccagtcc

SEQ ID NO: 291743 - DNA, 20 bp, Artificial Sequence
  chemically synthesized
ggaataatatgtacttggac

SEQ ID NO: 291744 - DNA, 20 bp, Artificial Sequence
  chemically synthesized
tgtatggaataatatgtact

SEQ ID NO: 291745 - DNA, 20 bp, Artificial Sequence
  chemically synthesized
agtacatattattccataca

SEQ ID NO: 291746 - DNA, 20 bp, Artificial Sequence
  chemically synthesized
ccatgctttcatgctatgta

SEQ ID NO: 291747 - DNA, 20 bp, Artificial Sequence
  chemically synthesized
ttattccatacatagcatga

SEQ ID NO: 291748 - DNA, 20 bp, Artificial Sequence
  chemically synthesized
ccatacatagcatgaaagca

SEQ ID NO: 291749 - DNA, 20 bp, Artificial Sequence
  chemically synthesized
ggcaacatcacgctgtgcta

SEQ ID NO: 291750 - DNA, 20 bp, Artificial Sequence
  chemically synthesized
gcaacatcacgctgtgctat

SEQ ID NO: 291751 - DNA, 20 bp, Artificial Sequence
  chemically synthesized
gaatattttaacccatagca

SEQ ID NO: 291752 - DNA, 20 bp, Artificial Sequence
  chemically synthesized
agtttgaatattttaaccca

SEQ ID NO: 291753 - DNA, 20 bp, Artificial Sequence
  chemically synthesized
taaaatattcaaactctcta

SEQ ID NO: 291754 - DNA, 20 bp, Artificial Sequence
  chemically synthesized
ttttgtaaactaactttaga

SEQ ID NO: 291755 - DNA, 20 bp, Artificial Sequence
  chemically synthesized
atattcaaactctctaaagt

SEQ ID NO: 291756 - DNA, 20 bp, Artificial Sequence
  chemically synthesized
aattttgtaaactaacttta

SEQ ID NO: 291757 - DNA, 20 bp, Artificial Sequence
  chemically synthesized
taaattttgtaaactaactt

SEQ ID NO: 291758 - DNA, 20 bp, Artificial Sequence
  chemically synthesized
taaagttagtttacaaaatt

SEQ ID NO: 291759 - DNA, 20 bp, Artificial Sequence
  chemically synthesized
ttacaaaatttagactttct

SEQ ID NO: 291760 - DNA, 20 bp, Artificial Sequence
  chemically synthesized
ataagctaataaatctaaga

SEQ ID NO: 291761 - DNA, 20 bp, Artificial Sequence
  chemically synthesized
ctatataagctaataaatct

SEQ ID NO: 291762 - DNA, 20 bp, Artificial Sequence
  chemically synthesized
ttagactttcttagatttat

SEQ ID NO: 291763 - DNA, 20 bp, Artificial Sequence
  chemically synthesized
cttagatttattagcttata

SEQ ID NO: 291764 - DNA, 20 bp, Artificial Sequence
  chemically synthesized
tgtcattaagaaaactatat

SEQ ID NO: 291765 - DNA, 20 bp, Artificial Sequence
  chemically synthesized
ttatatagttttcttaatga

SEQ ID NO: 291766 - DNA, 20 bp, Artificial Sequence
  chemically synthesized
ctcttttatattctgtcatt

SEQ ID NO: 291767 - DNA, 20 bp, Artificial Sequence
  chemically synthesized
ttcttaatgacagaatataa

SEQ ID NO: 291768 - DNA, 20 bp, Artificial Sequence
  chemically synthesized
cttaatgacagaatataaaa

SEQ ID NO: 291769 - DNA, 20 bp, Artificial Sequence
  chemically synthesized
atatcatgcatttttaaaca

SEQ ID NO: 291770 - DNA, 20 bp, Artificial Sequence
  chemically synthesized
atttttaaacatagctacat

SEQ ID NO: 291771 - DNA, 20 bp, Artificial Sequence
  chemically synthesized
gaaagttatcagtgctaatg

SEQ ID NO: 291772 - DNA, 20 bp, Artificial Sequence
  chemically synthesized
ccaaagtataagaaagttat

SEQ ID NO: 291773 - DNA, 20 bp, Artificial Sequence
  chemically synthesized
agtatttccaaagtataaga

SEQ ID NO: 291774 - DNA, 20 bp, Artificial Sequence
  chemically synthesized
ctgataactttcttatactt

SEQ ID NO: 291775 - DNA, 20 bp, Artificial Sequence
  chemically synthesized
attcagtatttccaaagtat

SEQ ID NO: 291776 - DNA, 20 bp, Artificial Sequence
  chemically synthesized
ttaaatattcagtatttcca

SEQ ID NO: 291777 - DNA, 20 bp, Artificial Sequence
  chemically synthesized
acataaaacatttaaatatt

SEQ ID NO: 291778 - DNA, 20 bp, Artificial Sequence
  chemically synthesized
agatctctgtaggtacatga

SEQ ID NO: 291779 - DNA, 20 bp, Artificial Sequence
  chemically synthesized
gagatctctgtaggtacatg

SEQ ID NO: 291780 - DNA, 20 bp, Artificial Sequence
  chemically synthesized
tgagatctctgtaggtacat

SEQ ID NO: 291781 - DNA, 20 bp, Artificial Sequence
  chemically synthesized
tatgttccctcatgtaccta

SEQ ID NO: 291782 - DNA, 20 bp, Artificial Sequence
  chemically synthesized
tgttccctcatgtacctaca

SEQ ID NO: 291783 - DNA, 20 bp, Artificial Sequence
  chemically synthesized
tgttcttttgagatctctgt

SEQ ID NO: 291784 - DNA, 20 bp, Artificial Sequence
  chemically synthesized
atgttcttttgagatctctg

SEQ ID NO: 291785 - DNA, 20 bp, Artificial Sequence
  chemically synthesized
tgtacctacagagatctcaa

SEQ ID NO: 291786 - DNA, 20 bp, Artificial Sequence
  chemically synthesized
cagtgagtttatgttctttt

SEQ ID NO: 291787 - DNA, 20 bp, Artificial Sequence
  chemically synthesized
aaagaacataaactcactgt

SEQ ID NO: 291788 - DNA, 20 bp, Artificial Sequence
  chemically synthesized
aagaacataaactcactgta

SEQ ID NO: 291789 - DNA, 20 bp, Artificial Sequence
  chemically synthesized
tagagaaagaaccttacagt

SEQ ID NO: 291790 - DNA, 20 bp, Artificial Sequence
  chemically synthesized
aacctagagaaagaacctta

SEQ ID NO: 291791 - DNA, 20 bp, Artificial Sequence
  chemically synthesized
tcactgtaaggttctttctc

SEQ ID NO: 291792 - DNA, 20 bp, Artificial Sequence
  chemically synthesized
cactgtaaggttctttctct

SEQ ID NO: 291793 - DNA, 20 bp, Artificial Sequence
  chemically synthesized
taggtattttaacctagaga

SEQ ID NO: 291794 - DNA, 20 bp, Artificial Sequence
  chemically synthesized
cttttaggtattttaaccta

SEQ ID NO: 291795 - DNA, 20 bp, Artificial Sequence
  chemically synthesized
aacttttaggtattttaacc

SEQ ID NO: 291796 - DNA, 20 bp, Artificial Sequence
  chemically synthesized
ctctaggttaaaatacctaa

SEQ ID NO: 291797 - DNA, 20 bp, Artificial Sequence
  chemically synthesized
aaactactcttcgaactttt

SEQ ID NO: 291798 - DNA, 20 bp, Artificial Sequence
  chemically synthesized
caaactactcttcgaacttt

SEQ ID NO: 291799 - DNA, 20 bp, Artificial Sequence
  chemically synthesized
ttaaaatacctaaaagttcg

SEQ ID NO: 291800 - DNA, 20 bp, Artificial Sequence
  chemically synthesized
aaaatacctaaaagttcgaa

SEQ ID NO: 291801 - DNA, 20 bp, Artificial Sequence
  chemically synthesized
atacctaaaagttcgaagag

SEQ ID NO: 291802 - DNA, 20 bp, Artificial Sequence
  chemically synthesized
taaaagttcgaagagtagtt

SEQ ID NO: 291803 - DNA, 20 bp, Artificial Sequence
  chemically synthesized
aagttcgaagagtagtttgg

SEQ ID NO: 291804 - DNA, 20 bp, Artificial Sequence
  chemically synthesized
ttcgaagagtagtttggtag

SEQ ID NO: 291805 - DNA, 20 bp, Artificial Sequence
  chemically synthesized
cgaagagtagtttggtagaa

SEQ ID NO: 291806 - DNA, 20 bp, Artificial Sequence
  chemically synthesized
agagtagtttggtagaagag

SEQ ID NO: 291807 - DNA, 20 bp, Artificial Sequence
  chemically synthesized
gagtagtttggtagaagagt

SEQ ID NO: 291808 - DNA, 20 bp, Artificial Sequence
  chemically synthesized
ggtagaagagtaggttgcct

SEQ ID NO: 291809 - DNA, 20 bp, Artificial Sequence
  chemically synthesized
ttataaaagtagattatctt

SEQ ID NO: 291810 - DNA, 20 bp, Artificial Sequence
  chemically synthesized
tttataaaagtagattatct

SEQ ID NO: 291811 - DNA, 20 bp, Artificial Sequence
  chemically synthesized
aaaatgaacatttataaaag

SEQ ID NO: 291812 - DNA, 20 bp, Artificial Sequence
  chemically synthesized
agtaaaatgaacatttataa

SEQ ID NO: 291813 - DNA, 20 bp, Artificial Sequence
  chemically synthesized
gttcattttacttaattttc

SEQ ID NO: 291814 - DNA, 20 bp, Artificial Sequence
  chemically synthesized
aattatattaccagaaaatt

SEQ ID NO: 291815 - DNA, 20 bp, Artificial Sequence
  chemically synthesized
ctttaactaaattatattac

SEQ ID NO: 291816 - DNA, 20 bp, Artificial Sequence
  chemically synthesized
aattttctggtaatataatt

SEQ ID NO: 291817 - DNA, 20 bp, Artificial Sequence
  chemically synthesized
ctggtaatataatttagtta

SEQ ID NO: 291818 - DNA, 20 bp, Artificial Sequence
  chemically synthesized
tggtaatataatttagttaa

SEQ ID NO: 291819 - DNA, 20 bp, Artificial Sequence
  chemically synthesized
ggtaatataatttagttaaa

SEQ ID NO: 291820 - DNA, 20 bp, Artificial Sequence
  chemically synthesized
aatataatttagttaaaggg

SEQ ID NO: 291821 - DNA, 20 bp, Artificial Sequence
  chemically synthesized
aatttagttaaagggaagct

SEQ ID NO: 291822 - DNA, 20 bp, Artificial Sequence
  chemically synthesized
cttcagactttttaagaact

SEQ ID NO: 291823 - DNA, 20 bp, Artificial Sequence
  chemically synthesized
agggaagctaagttcttaaa

SEQ ID NO: 291824 - DNA, 20 bp, Artificial Sequence
  chemically synthesized
agacgttcttcagacttttt

SEQ ID NO: 291825 - DNA, 20 bp, Artificial Sequence
  chemically synthesized
ctaagttcttaaaaagtctg

SEQ ID NO: 291826 - DNA, 20 bp, Artificial Sequence
  chemically synthesized
atgtttctagagacgttctt

SEQ ID NO: 291827 - DNA, 20 bp, Artificial Sequence
  chemically synthesized
aaaagtctgaagaacgtctc

SEQ ID NO: 291828 - DNA, 20 bp, Artificial Sequence
  chemically synthesized
ccacaggccttatgtttcta

SEQ ID NO: 291829 - DNA, 20 bp, Artificial Sequence
  chemically synthesized
aagaacgtctctagaaacat

SEQ ID NO: 291830 - DNA, 20 bp, Artificial Sequence
  chemically synthesized
aaccacaggccttatgtttc

SEQ ID NO: 291831 - DNA, 20 bp, Artificial Sequence
  chemically synthesized
agaacgtctctagaaacata

SEQ ID NO: 291832 - DNA, 20 bp, Artificial Sequence
  chemically synthesized
ctctagaaacataaggcctg

SEQ ID NO: 291833 - DNA, 20 bp, Artificial Sequence
  chemically synthesized
gtgcaagttagcaaaaccac

SEQ ID NO: 291834 - DNA, 20 bp, Artificial Sequence
  chemically synthesized
tgtgcaagttagcaaaacca

SEQ ID NO: 291835 - DNA, 20 bp, Artificial Sequence
  chemically synthesized
agtgggaggcatgtgcaagt

SEQ ID NO: 291836 - DNA, 20 bp, Artificial Sequence
  chemically synthesized
ataaagtgggaggcatgtgc

SEQ ID NO: 291837 - DNA, 20 bp, Artificial Sequence
  chemically synthesized
tttaaaaaggataaagtggg

SEQ ID NO: 291838 - DNA, 20 bp, Artificial Sequence
  chemically synthesized
ctttaaaaaggataaagtgg

SEQ ID NO: 291839 - DNA, 20 bp, Artificial Sequence
  chemically synthesized
gtctttaaaaaggataaagt

SEQ ID NO: 291840 - DNA, 20 bp, Artificial Sequence
  chemically synthesized
agtctttaaaaaggataaag

SEQ ID NO: 291841 - DNA, 20 bp, Artificial Sequence
  chemically synthesized
tttagtctttaaaaaggata

SEQ ID NO: 291842 - DNA, 20 bp, Artificial Sequence
  chemically synthesized
ctcccactttatccttttta

SEQ ID NO: 291843 - DNA, 20 bp, Artificial Sequence
  chemically synthesized
attttttttagtctttaaaa

SEQ ID NO: 291844 - DNA, 20 bp, Artificial Sequence
  chemically synthesized
tattttttttagtctttaaa

SEQ ID NO: 291845 - DNA, 20 bp, Artificial Sequence
  chemically synthesized
attcacatctatattttttt

SEQ ID NO: 291846 - DNA, 20 bp, Artificial Sequence
  chemically synthesized
tttaaagactaaaaaaaata

SEQ ID NO: 291847 - DNA, 20 bp, Artificial Sequence
  chemically synthesized
tgaaagaggataaaataata

SEQ ID NO: 291848 - DNA, 20 bp, Artificial Sequence
  chemically synthesized
agggcagagggaagtgaaag

SEQ ID NO: 291849 - DNA, 20 bp, Artificial Sequence
  chemically synthesized
cagggcagagggaagtgaaa

SEQ ID NO: 291850 - DNA, 20 bp, Artificial Sequence
  chemically synthesized
atcagggcagagggaagtga

SEQ ID NO: 291851 - DNA, 20 bp, Artificial Sequence
  chemically synthesized
tagactatcagggcagaggg

SEQ ID NO: 291852 - DNA, 20 bp, Artificial Sequence
  chemically synthesized
cattagactatcagggcaga

SEQ ID NO: 291853 - DNA, 20 bp, Artificial Sequence
  chemically synthesized
acattagactatcagggcag

SEQ ID NO: 291854 - DNA, 20 bp, Artificial Sequence
  chemically synthesized
aacattagactatcagggca

SEQ ID NO: 291855 - DNA, 20 bp, Artificial Sequence
  chemically synthesized
ttcacttccctctgccctga

SEQ ID NO: 291856 - DNA, 20 bp, Artificial Sequence
  chemically synthesized
agaacattagactatcaggg

SEQ ID NO: 291857 - DNA, 20 bp, Artificial Sequence
  chemically synthesized
aatagaacattagactatca

SEQ ID NO: 291858 - DNA, 20 bp, Artificial Sequence
  chemically synthesized
aaatagaacattagactatc

SEQ ID NO: 291859 - DNA, 20 bp, Artificial Sequence
  chemically synthesized
caaatagaacattagactat

SEQ ID NO: 291860 - DNA, 20 bp, Artificial Sequence
  chemically synthesized
cattatgacaaatagaacat

SEQ ID NO: 291861 - DNA, 20 bp, Artificial Sequence
  chemically synthesized
attaatatcattatgacaaa

SEQ ID NO: 291862 - DNA, 20 bp, Artificial Sequence
  chemically synthesized
aattgagggacatggtttgg

SEQ ID NO: 291863 - DNA, 20 bp, Artificial Sequence
  chemically synthesized
atgaattgagggacatggtt

SEQ ID NO: 291864 - DNA, 20 bp, Artificial Sequence
  chemically synthesized
ttcaaatgaattgagggaca

SEQ ID NO: 291865 - DNA, 20 bp, Artificial Sequence
  chemically synthesized
ttgtgtttcaaatgaattga

SEQ ID NO: 291866 - DNA, 20 bp, Artificial Sequence
  chemically synthesized
gttgtgtttcaaatgaattg

SEQ ID NO: 291867 - DNA, 20 bp, Artificial Sequence
  chemically synthesized
agttgtgtttcaaatgaatt

SEQ ID NO: 291868 - DNA, 20 bp, Artificial Sequence
  chemically synthesized
ctttgaaattagtgaagtta

SEQ ID NO: 291869 - DNA, 20 bp, Artificial Sequence
  chemically synthesized
attatgctttgaaattagtg

SEQ ID NO: 291870 - DNA, 20 bp, Artificial Sequence
  chemically synthesized
ctgtaacttcactaatttca

SEQ ID NO: 291871 - DNA, 20 bp, Artificial Sequence
  chemically synthesized
gtagcattatgctttgaaat

SEQ ID NO: 291872 - DNA, 20 bp, Artificial Sequence
  chemically synthesized
tttcaaagcataatgctact

SEQ ID NO: 291873 - DNA, 20 bp, Artificial Sequence
  chemically synthesized
ttcaaagcataatgctactc

SEQ ID NO: 291874 - DNA, 20 bp, Artificial Sequence
  chemically synthesized
aagcataatgctactcagga

SEQ ID NO: 291875 - DNA, 20 bp, Artificial Sequence
  chemically synthesized
tccttcaccgccatcctgag

SEQ ID NO: 291876 - DNA, 20 bp, Artificial Sequence
  chemically synthesized
cataatgctactcaggatgg

SEQ ID NO: 291877 - DNA, 20 bp, Artificial Sequence
  chemically synthesized
gtctccttcaccgccatcct

SEQ ID NO: 291878 - DNA, 20 bp, Artificial Sequence
  chemically synthesized
tgctactcaggatggcggtg

SEQ ID NO: 291879 - DNA, 20 bp, Artificial Sequence
  chemically synthesized
gctactcaggatggcggtga

SEQ ID NO: 291880 - DNA, 20 bp, Artificial Sequence
  chemically synthesized
tactcaggatggcggtgaag

SEQ ID NO: 291881 - DNA, 20 bp, Artificial Sequence
  chemically synthesized
agttgacgataatatttgca

SEQ ID NO: 291882 - DNA, 20 bp, Artificial Sequence
  chemically synthesized
agggaagaaggaggggaaaa

SEQ ID NO: 291883 - DNA, 20 bp, Artificial Sequence
  chemically synthesized
atatatcagggaagaaggag

SEQ ID NO: 291884 - DNA, 20 bp, Artificial Sequence
  chemically synthesized
aatatatcagggaagaagga

SEQ ID NO: 291885 - DNA, 20 bp, Artificial Sequence
  chemically synthesized
aaatatatcagggaagaagg

SEQ ID NO: 291886 - DNA, 20 bp, Artificial Sequence
  chemically synthesized
aaaatatatcagggaagaag

SEQ ID NO: 291887 - DNA, 20 bp, Artificial Sequence
  chemically synthesized
taaaaatatatcagggaaga

SEQ ID NO: 291888 - DNA, 20 bp, Artificial Sequence
  chemically synthesized
ttaaaaatatatcagggaag

SEQ ID NO: 291889 - DNA, 20 bp, Artificial Sequence
  chemically synthesized
tcattaaaaatatatcaggg

SEQ ID NO: 291890 - DNA, 20 bp, Artificial Sequence
  chemically synthesized
atctcattaaaaatatatca

SEQ ID NO: 291891 - DNA, 20 bp, Artificial Sequence
  chemically synthesized
tatctcattaaaaatatatc

SEQ ID NO: 291892 - DNA, 20 bp, Artificial Sequence
  chemically synthesized
gtatctcattaaaaatatat

SEQ ID NO: 291893 - DNA, 20 bp, Artificial Sequence
  chemically synthesized
ttccctgatatatttttaat

SEQ ID NO: 291894 - DNA, 20 bp, Artificial Sequence
  chemically synthesized
atatttttaatgagatacaa

SEQ ID NO: 291895 - DNA, 20 bp, Artificial Sequence
  chemically synthesized
atgagatacaatggaaataa

SEQ ID NO: 291896 - DNA, 20 bp, Artificial Sequence
  chemically synthesized
tggaaataatagaatgtaaa

SEQ ID NO: 291897 - DNA, 20 bp, Artificial Sequence
  chemically synthesized
atgtaaaaagaatatataca

SEQ ID NO: 291898 - DNA, 20 bp, Artificial Sequence
  chemically synthesized
cttttatacttagatatatg

SEQ ID NO: 291899 - DNA, 20 bp, Artificial Sequence
  chemically synthesized
atacatggctccatatatct

SEQ ID NO: 291900 - DNA, 20 bp, Artificial Sequence
  chemically synthesized
ttcttttatacttagatata

SEQ ID NO: 291901 - DNA, 20 bp, Artificial Sequence
  chemically synthesized
ctccatatatctaagtataa

SEQ ID NO: 291902 - DNA, 20 bp, Artificial Sequence
  chemically synthesized
ccacggacttcttttatact

SEQ ID NO: 291903 - DNA, 20 bp, Artificial Sequence
  chemically synthesized
catatatctaagtataaaag

SEQ ID NO: 291904 - DNA, 20 bp, Artificial Sequence
  chemically synthesized
ctaagtataaaagaagtccg

SEQ ID NO: 291905 - DNA, 20 bp, Artificial Sequence
  chemically synthesized
taaaagaagtccgtggccta

SEQ ID NO: 291906 - DNA, 20 bp, Artificial Sequence
  chemically synthesized
tatgtagctcctgtaggcca

SEQ ID NO: 291907 - DNA, 20 bp, Artificial Sequence
  chemically synthesized
aaaagaagtccgtggcctac

SEQ ID NO: 291908 - DNA, 20 bp, Artificial Sequence
  chemically synthesized
aagaagtccgtggcctacag

SEQ ID NO: 291909 - DNA, 20 bp, Artificial Sequence
  chemically synthesized
ttagaatatgtagctcctgt

SEQ ID NO: 291910 - DNA, 20 bp, Artificial Sequence
  chemically synthesized
attagaatatgtagctcctg

SEQ ID NO: 291911 - DNA, 20 bp, Artificial Sequence
  chemically synthesized
taggaggatattagaatatg

SEQ ID NO: 291912 - DNA, 20 bp, Artificial Sequence
  chemically synthesized
cttaagcattaggaggatat

SEQ ID NO: 291913 - DNA, 20 bp, Artificial Sequence
  chemically synthesized
ttgcttccttaagcattagg

SEQ ID NO: 291914 - DNA, 20 bp, Artificial Sequence
  chemically synthesized
attgcttccttaagcattag

SEQ ID NO: 291915 - DNA, 20 bp, Artificial Sequence
  chemically synthesized
ctaatatcctcctaatgctt

SEQ ID NO: 291916 - DNA, 20 bp, Artificial Sequence
  chemically synthesized
caattgcttccttaagcatt

SEQ ID NO: 291917 - DNA, 20 bp, Artificial Sequence
  chemically synthesized
taatatcctcctaatgctta

SEQ ID NO: 291918 - DNA, 20 bp, Artificial Sequence
  chemically synthesized
acaattgcttccttaagcat

SEQ ID NO: 291919 - DNA, 20 bp, Artificial Sequence
  chemically synthesized
tatcctcctaatgcttaagg

SEQ ID NO: 291920 - DNA, 20 bp, Artificial Sequence
  chemically synthesized
catgtcacaattgcttcctt

SEQ ID NO: 291921 - DNA, 20 bp, Artificial Sequence
  chemically synthesized
caaaatctaacgatcaaaaa

SEQ ID NO: 291922 - DNA, 20 bp, Artificial Sequence
  chemically synthesized
gacatgctgtttttgatcgt

SEQ ID NO: 291923 - DNA, 20 bp, Artificial Sequence
  chemically synthesized
gtttttgatcgttagatttt

SEQ ID NO: 291924 - DNA, 20 bp, Artificial Sequence
  chemically synthesized
tttttgatcgttagattttg

SEQ ID NO: 291925 - DNA, 20 bp, Artificial Sequence
  chemically synthesized
tttgatcgttagattttgag

SEQ ID NO: 291926 - DNA, 20 bp, Artificial Sequence
  chemically synthesized
gcatcgcttaacaaatattt

SEQ ID NO: 291927 - DNA, 20 bp, Artificial Sequence
  chemically synthesized
attgtaccaaaatatttgtt

SEQ ID NO: 291928 - DNA, 20 bp, Artificial Sequence
  chemically synthesized
atttgttaagcgatgcgatt

SEQ ID NO: 291929 - DNA, 20 bp, Artificial Sequence
  chemically synthesized
atgtggtcattttataacaa

SEQ ID NO: 291930 - DNA, 20 bp, Artificial Sequence
  chemically synthesized
tgttataaaatgaccacatt

SEQ ID NO: 291931 - DNA, 20 bp, Artificial Sequence
  chemically synthesized
cttacactttataccaaatg

SEQ ID NO: 291932 - DNA, 20 bp, Artificial Sequence
  chemically synthesized
aaatgaccacatttggtata

SEQ ID NO: 291933 - DNA, 20 bp, Artificial Sequence
  chemically synthesized
ccacatttggtataaagtgt

SEQ ID NO: 291934 - DNA, 20 bp, Artificial Sequence
  chemically synthesized
acatttggtataaagtgtaa

SEQ ID NO: 291935 - DNA, 20 bp, Artificial Sequence
  chemically synthesized
tttggtataaagtgtaagag

SEQ ID NO: 291936 - DNA, 20 bp, Artificial Sequence
  chemically synthesized
acggagtgctcatacgattg

SEQ ID NO: 291937 - DNA, 20 bp, Artificial Sequence
  chemically synthesized
atatgaaacttcaatcgtat

SEQ ID NO: 291938 - DNA, 20 bp, Artificial Sequence
  chemically synthesized
cataatacttttttcaaacg

SEQ ID NO: 291939 - DNA, 20 bp, Artificial Sequence
  chemically synthesized
atcataatacttttttcaaa

SEQ ID NO: 291940 - DNA, 20 bp, Artificial Sequence
  chemically synthesized
atgagcactccgtttgaaaa

SEQ ID NO: 291941 - DNA, 20 bp, Artificial Sequence
  chemically synthesized
tgataaaacgttaacatttc

SEQ ID NO: 291942 - DNA, 20 bp, Artificial Sequence
  chemically synthesized
ctaattatctttttattttc

SEQ ID NO: 291943 - DNA, 20 bp, Artificial Sequence
  chemically synthesized
taacatttctggaaaataaa

SEQ ID NO: 291944 - DNA, 20 bp, Artificial Sequence
  chemically synthesized
ctggaaaataaaaagataat

SEQ ID NO: 291945 - DNA, 20 bp, Artificial Sequence
  chemically synthesized
aagataattagaaaatatac

SEQ ID NO: 291946 - DNA, 20 bp, Artificial Sequence
  chemically synthesized
taattagaaaatatactgga

SEQ ID NO: 291947 - DNA, 20 bp, Artificial Sequence
  chemically synthesized
cataatttaaaaattctgtc

SEQ ID NO: 291948 - DNA, 20 bp, Artificial Sequence
  chemically synthesized
tatgttaataacaaaaaatg

SEQ ID NO: 291949 - DNA, 20 bp, Artificial Sequence
  chemically synthesized
taataacaaaaaatgtggca

SEQ ID NO: 291950 - DNA, 20 bp, Artificial Sequence
  chemically synthesized
gtggcatggatctaaatgat

SEQ ID NO: 291951 - DNA, 20 bp, Artificial Sequence
  chemically synthesized
ctcctaaatatctgatcatt

SEQ ID NO: 291952 - DNA, 20 bp, Artificial Sequence
  chemically synthesized
gatctaaatgatcagatatt

SEQ ID NO: 291953 - DNA, 20 bp, Artificial Sequence
  chemically synthesized
atctaaatgatcagatattt

SEQ ID NO: 291954 - DNA, 20 bp, Artificial Sequence
  chemically synthesized
ctaaatgatcagatatttag

SEQ ID NO: 291955 - DNA, 20 bp, Artificial Sequence
  chemically synthesized
atatttaggagaaatatttt

SEQ ID NO: 291956 - DNA, 20 bp, Artificial Sequence
  chemically synthesized
agcatatgttgaacttgaac

SEQ ID NO: 291957 - DNA, 20 bp, Artificial Sequence
  chemically synthesized
atatgttgaacttgaacaag

SEQ ID NO: 291958 - DNA, 20 bp, Artificial Sequence
  chemically synthesized
ggacttctaactgcttgttc

SEQ ID NO: 291959 - DNA, 20 bp, Artificial Sequence
  chemically synthesized
gttgaacttgaacaagcagt

SEQ ID NO: 291960 - DNA, 20 bp, Artificial Sequence
  chemically synthesized
gaacttgaacaagcagttag

SEQ ID NO: 291961 - DNA, 20 bp, Artificial Sequence
  chemically synthesized
caagcagttagaagtccatg

SEQ ID NO: 291962 - DNA, 20 bp, Artificial Sequence
  chemically synthesized
aagcagttagaagtccatga

SEQ ID NO: 291963 - DNA, 20 bp, Artificial Sequence
  chemically synthesized
agcagttagaagtccatgaa

SEQ ID NO: 291964 - DNA, 20 bp, Artificial Sequence
  chemically synthesized
tgttgacgtttcacccttca

SEQ ID NO: 291965 - DNA, 20 bp, Artificial Sequence
  chemically synthesized
ggtgaaacgtcaacatgaac

SEQ ID NO: 291966 - DNA, 20 bp, Artificial Sequence
  chemically synthesized
gtgaaacgtcaacatgaacc

SEQ ID NO: 291967 - DNA, 20 bp, Artificial Sequence
  chemically synthesized
ttttttgcctgtttaatacc

SEQ ID NO: 291968 - DNA, 20 bp, Artificial Sequence
  chemically synthesized
aacatgaaccaggtattaaa

SEQ ID NO: 291969 - DNA, 20 bp, Artificial Sequence
  chemically synthesized
acatgaaccaggtattaaac

SEQ ID NO: 291970 - DNA, 20 bp, Artificial Sequence
  chemically synthesized
caggtattaaacaggcaaaa

SEQ ID NO: 291971 - DNA, 20 bp, Artificial Sequence
  chemically synthesized
aaaaaagaaatgctaaatta

SEQ ID NO: 291972 - DNA, 20 bp, Artificial Sequence
  chemically synthesized
aaaaagaaatgctaaattaa

SEQ ID NO: 291973 - DNA, 20 bp, Artificial Sequence
  chemically synthesized
aaaagaaatgctaaattaaa

SEQ ID NO: 291974 - DNA, 20 bp, Artificial Sequence
  chemically synthesized
gtctatcggtccctttaatt

SEQ ID NO: 291975 - DNA, 20 bp, Artificial Sequence
  chemically synthesized
tgctaaattaaagggaccga

SEQ ID NO: 291976 - DNA, 20 bp, Artificial Sequence
  chemically synthesized
tcaatccagcatcagtctat

SEQ ID NO: 291977 - DNA, 20 bp, Artificial Sequence
  chemically synthesized
agggaccgatagactgatgc

SEQ ID NO: 291978 - DNA, 20 bp, Artificial Sequence
  chemically synthesized
aataagactcaatccagcat

SEQ ID NO: 291979 - DNA, 20 bp, Artificial Sequence
  chemically synthesized
cgatagactgatgctggatt

SEQ ID NO: 291980 - DNA, 20 bp, Artificial Sequence
  chemically synthesized
atgttgaataagactcaatc

SEQ ID NO: 291981 - DNA, 20 bp, Artificial Sequence
  chemically synthesized
catttagacaaatgttgaat

SEQ ID NO: 291982 - DNA, 20 bp, Artificial Sequence
  chemically synthesized
tattcaacatttgtctaaat

SEQ ID NO: 291983 - DNA, 20 bp, Artificial Sequence
  chemically synthesized
caacatttgtctaaatgaga

SEQ ID NO: 291984 - DNA, 20 bp, Artificial Sequence
  chemically synthesized
ctctgtgttcccgtctcatt

SEQ ID NO: 291985 - DNA, 20 bp, Artificial Sequence
  chemically synthesized
aacatttgtctaaatgagac

SEQ ID NO: 291986 - DNA, 20 bp, Artificial Sequence
  chemically synthesized
gtctaaatgagacgggaaca

SEQ ID NO: 291987 - DNA, 20 bp, Artificial Sequence
  chemically synthesized
ctaaatgagacgggaacaca

SEQ ID NO: 291988 - DNA, 20 bp, Artificial Sequence
  chemically synthesized
aaatgagacgggaacacaga

SEQ ID NO: 291989 - DNA, 20 bp, Artificial Sequence
  chemically synthesized
tgacctttctcagggacaca

SEQ ID NO: 291990 - DNA, 20 bp, Artificial Sequence
  chemically synthesized
agaaatcactttgtgtccct

SEQ ID NO: 291991 - DNA, 20 bp, Artificial Sequence
  chemically synthesized
atcactttgtgtccctgaga

SEQ ID NO: 291992 - DNA, 20 bp, Artificial Sequence
  chemically synthesized
tcactttgtgtccctgagaa

SEQ ID NO: 291993 - DNA, 20 bp, Artificial Sequence
  chemically synthesized
tgtatggttgacctttctca

SEQ ID NO: 291994 - DNA, 20 bp, Artificial Sequence
  chemically synthesized
ttgtatggttgacctttctc

SEQ ID NO: 291995 - DNA, 20 bp, Artificial Sequence
  chemically synthesized
tttgtatggttgacctttct

SEQ ID NO: 291996 - DNA, 20 bp, Artificial Sequence
  chemically synthesized
ttcatttgctacgatttgta

SEQ ID NO: 291997 - DNA, 20 bp, Artificial Sequence
  chemically synthesized
aaggtcaaccatacaaatcg

SEQ ID NO: 291998 - DNA, 20 bp, Artificial Sequence
  chemically synthesized
aaatgaaaaaatgaaactat

SEQ ID NO: 291999 - DNA, 20 bp, Artificial Sequence
  chemically synthesized
ccatattgaaaatcaactta

SEQ ID NO: 292000 - DNA, 20 bp, Artificial Sequence
  chemically synthesized
ctataagttgattttcaata

SEQ ID NO: 292001 - DNA, 20 bp, Artificial Sequence
  chemically synthesized
tttgttaaatgataaaacta

SEQ ID NO: 292002 - DNA, 20 bp, Artificial Sequence
  chemically synthesized
taaatgataaaactacagtg

SEQ ID NO: 292003 - DNA, 20 bp, Artificial Sequence
  chemically synthesized
agcctattggtacttcactg

SEQ ID NO: 292004 - DNA, 20 bp, Artificial Sequence
  chemically synthesized
aaactacagtgaagtaccaa

SEQ ID NO: 292005 - DNA, 20 bp, Artificial Sequence
  chemically synthesized
aactacagtgaagtaccaat

SEQ ID NO: 292006 - DNA, 20 bp, Artificial Sequence
  chemically synthesized
acggatactgcagagcctat

SEQ ID NO: 292007 - DNA, 20 bp, Artificial Sequence
  chemically synthesized
tgaagtaccaataggctctg

SEQ ID NO: 292008 - DNA, 20 bp, Artificial Sequence
  chemically synthesized
agattttaacggatactgca

SEQ ID NO: 292009 - DNA, 20 bp, Artificial Sequence
  chemically synthesized
ctagattttaacggatactg

SEQ ID NO: 292010 - DNA, 20 bp, Artificial Sequence
  chemically synthesized
aacctgtccctagattttaa

SEQ ID NO: 292011 - DNA, 20 bp, Artificial Sequence
  chemically synthesized
ctgcagtatccgttaaaatc

SEQ ID NO: 292012 - DNA, 20 bp, Artificial Sequence
  chemically synthesized
tgcagtatccgttaaaatct

SEQ ID NO: 292013 - DNA, 20 bp, Artificial Sequence
  chemically synthesized
gcagtatccgttaaaatcta

SEQ ID NO: 292014 - DNA, 20 bp, Artificial Sequence
  chemically synthesized
tatccgttaaaatctaggga

SEQ ID NO: 292015 - DNA, 20 bp, Artificial Sequence
  chemically synthesized
atccgttaaaatctagggac

SEQ ID NO: 292016 - DNA, 20 bp, Artificial Sequence
  chemically synthesized
gactcattaaaacctgtccc

SEQ ID NO: 292017 - DNA, 20 bp, Artificial Sequence
  chemically synthesized
atctagggacaggttttaat

SEQ ID NO: 292018 - DNA, 20 bp, Artificial Sequence
  chemically synthesized
tttttggggggcaaaacata

SEQ ID NO: 292019 - DNA, 20 bp, Artificial Sequence
  chemically synthesized
attttttggggggcaaaaca

SEQ ID NO: 292020 - DNA, 20 bp, Artificial Sequence
  chemically synthesized
atattgcaacattttttggg

SEQ ID NO: 292021 - DNA, 20 bp, Artificial Sequence
  chemically synthesized
tatattgcaacattttttgg

SEQ ID NO: 292022 - DNA, 20 bp, Artificial Sequence
  chemically synthesized
atatattgcaacattttttg

SEQ ID NO: 292023 - DNA, 20 bp, Artificial Sequence
  chemically synthesized
gatatattgcaacatttttt

SEQ ID NO: 292024 - DNA, 20 bp, Artificial Sequence
  chemically synthesized
tgatatattgcaacattttt

SEQ ID NO: 292025 - DNA, 20 bp, Artificial Sequence
  chemically synthesized
gttgcaatatatcactgtaa

SEQ ID NO: 292026 - DNA, 20 bp, Artificial Sequence
  chemically synthesized
caccatttaaatttctttta

SEQ ID NO: 292027 - DNA, 20 bp, Artificial Sequence
  chemically synthesized
cactgtaaaagaaatttaaa

SEQ ID NO: 292028 - DNA, 20 bp, Artificial Sequence
  chemically synthesized
taaaagaaatttaaatggtg

SEQ ID NO: 292029 - DNA, 20 bp, Artificial Sequence
  chemically synthesized
gaaatttaaatggtgaagaa

SEQ ID NO: 292030 - DNA, 20 bp, Artificial Sequence
  chemically synthesized
tttaaatggtgaagaaaagt

SEQ ID NO: 292031 - DNA, 20 bp, Artificial Sequence
  chemically synthesized
cagtgttatgaatttgtaca

SEQ ID NO: 292032 - DNA, 20 bp, Artificial Sequence
  chemically synthesized
atagagcgtattataaattt

SEQ ID NO: 292033 - DNA, 20 bp, Artificial Sequence
  chemically synthesized
gatcaatatgcaaataaata

SEQ ID NO: 292034 - DNA, 20 bp, Artificial Sequence
  chemically synthesized
aagatcaatatgcaaataaa

SEQ ID NO: 292035 - DNA, 20 bp, Artificial Sequence
  chemically synthesized
attgcctgcattcagttata

SEQ ID NO: 292036 - DNA, 20 bp, Artificial Sequence
  chemically synthesized
ttgatctttataactgaatg

SEQ ID NO: 292037 - DNA, 20 bp, Artificial Sequence
  chemically synthesized
tgatctttataactgaatgc

SEQ ID NO: 292038 - DNA, 20 bp, Artificial Sequence
  chemically synthesized
gcattttcattgcctgcatt

SEQ ID NO: 292039 - DNA, 20 bp, Artificial Sequence
  chemically synthesized
gaatgcaggcaatgaaaatg

SEQ ID NO: 292040 - DNA, 20 bp, Artificial Sequence
  chemically synthesized
aggcaatgaaaatgcagtga

SEQ ID NO: 292041 - DNA, 20 bp, Artificial Sequence
  chemically synthesized
ggcaatgaaaatgcagtgat

SEQ ID NO: 292042 - DNA, 20 bp, Artificial Sequence
  chemically synthesized
gaaaatgcagtgataggtaa

SEQ ID NO: 292043 - DNA, 20 bp, Artificial Sequence
  chemically synthesized
taaaagaacgacatctataa

SEQ ID NO: 292044 - DNA, 20 bp, Artificial Sequence
  chemically synthesized
cctccccctttttgctatta

SEQ ID NO: 292045 - DNA, 20 bp, Artificial Sequence
  chemically synthesized
acgacatctataatagcaaa

SEQ ID NO: 292046 - DNA, 20 bp, Artificial Sequence
  chemically synthesized
cgacatctataatagcaaaa

SEQ ID NO: 292047 - DNA, 20 bp, Artificial Sequence
  chemically synthesized
gacatctataatagcaaaaa

SEQ ID NO: 292048 - DNA, 20 bp, Artificial Sequence
  chemically synthesized
acatctataatagcaaaaag

SEQ ID NO: 292049 - DNA, 20 bp, Artificial Sequence
  chemically synthesized
catctataatagcaaaaagg

SEQ ID NO: 292050 - DNA, 20 bp, Artificial Sequence
  chemically synthesized
tctataatagcaaaaagggg

SEQ ID NO: 292051 - DNA, 20 bp, Artificial Sequence
  chemically synthesized
ctataatagcaaaaaggggg

SEQ ID NO: 292052 - DNA, 20 bp, Artificial Sequence
  chemically synthesized
taatagcaaaaagggggagg

SEQ ID NO: 292053 - DNA, 20 bp, Artificial Sequence
  chemically synthesized
aatagcaaaaagggggaggc

SEQ ID NO: 292054 - DNA, 20 bp, Artificial Sequence
  chemically synthesized
agcaaaaagggggaggcagg

SEQ ID NO: 292055 - DNA, 20 bp, Artificial Sequence
  chemically synthesized
aaaagggggaggcaggcaga

SEQ ID NO: 292056 - DNA, 20 bp, Artificial Sequence
  chemically synthesized
aaagggggaggcaggcagaa

SEQ ID NO: 292057 - DNA, 20 bp, Artificial Sequence
  chemically synthesized
gggggaggcaggcagaaagg

SEQ ID NO: 292058 - DNA, 20 bp, Artificial Sequence
  chemically synthesized
gggaggcaggcagaaaggca

SEQ ID NO: 292059 - DNA, 20 bp, Artificial Sequence
  chemically synthesized
cagaaaggcagagaaatgac

SEQ ID NO: 292060 - DNA, 20 bp, Artificial Sequence
  chemically synthesized
aaggcagagaaatgaccggt

SEQ ID NO: 292061 - DNA, 20 bp, Artificial Sequence
  chemically synthesized
tttaacgccagaattctcac

SEQ ID NO: 292062 - DNA, 20 bp, Artificial Sequence
  chemically synthesized
gaaatgaccggtgagaattc

SEQ ID NO: 292063 - DNA, 20 bp, Artificial Sequence
  chemically synthesized
cggtgagaattctggcgtta

SEQ ID NO: 292064 - DNA, 20 bp, Artificial Sequence
  chemically synthesized
aactccggtctctttaacgc

SEQ ID NO: 292065 - DNA, 20 bp, Artificial Sequence
  chemically synthesized
gtgagaattctggcgttaaa

SEQ ID NO: 292066 - DNA, 20 bp, Artificial Sequence
  chemically synthesized
aattctggcgttaaagagac

SEQ ID NO: 292067 - DNA, 20 bp, Artificial Sequence
  chemically synthesized
ttctggcgttaaagagaccg

SEQ ID NO: 292068 - DNA, 20 bp, Artificial Sequence
  chemically synthesized
ggggcatcaaatttgaactc

SEQ ID NO: 292069 - DNA, 20 bp, Artificial Sequence
  chemically synthesized
tcaaatttgatgccccttac

SEQ ID NO: 292070 - DNA, 20 bp, Artificial Sequence
  chemically synthesized
catttcacacatctagtaag

SEQ ID NO: 292071 - DNA, 20 bp, Artificial Sequence
  chemically synthesized
ccatttcacacatctagtaa

SEQ ID NO: 292072 - DNA, 20 bp, Artificial Sequence
  chemically synthesized
cccatttcacacatctagta

SEQ ID NO: 292073 - DNA, 20 bp, Artificial Sequence
  chemically synthesized
acccatttcacacatctagt

SEQ ID NO: 292074 - DNA, 20 bp, Artificial Sequence
  chemically synthesized
ctgaacccatttcacacatc

SEQ ID NO: 292075 - DNA, 20 bp, Artificial Sequence
  chemically synthesized
cccttactagatgtgtgaaa

SEQ ID NO: 292076 - DNA, 20 bp, Artificial Sequence
  chemically synthesized
ccttactagatgtgtgaaat

SEQ ID NO: 292077 - DNA, 20 bp, Artificial Sequence
  chemically synthesized
ctagatgtgtgaaatgggtt

SEQ ID NO: 292078 - DNA, 20 bp, Artificial Sequence
  chemically synthesized
aaacaagatccagtgaaatt

SEQ ID NO: 292079 - DNA, 20 bp, Artificial Sequence
  chemically synthesized
gttcagttacttaatttcac

SEQ ID NO: 292080 - DNA, 20 bp, Artificial Sequence
  chemically synthesized
tggatgagaaaaacaagatc

SEQ ID NO: 292081 - DNA, 20 bp, Artificial Sequence
  chemically synthesized
atttcatggatgagaaaaac

SEQ ID NO: 292082 - DNA, 20 bp, Artificial Sequence
  chemically synthesized
ttaatcctcatttcatggat

SEQ ID NO: 292083 - DNA, 20 bp, Artificial Sequence
  chemically synthesized
gtttttctcatccatgaaat

SEQ ID NO: 292084 - DNA, 20 bp, Artificial Sequence
  chemically synthesized
tttttctcatccatgaaatg

SEQ ID NO: 292085 - DNA, 20 bp, Artificial Sequence
  chemically synthesized
tatttttaatcctcatttca

SEQ ID NO: 292086 - DNA, 20 bp, Artificial Sequence
  chemically synthesized
catgaaatgaggattaaaaa

SEQ ID NO: 292087 - DNA, 20 bp, Artificial Sequence
  chemically synthesized
taaaaatagaatcgacctca

SEQ ID NO: 292088 - DNA, 20 bp, Artificial Sequence
  chemically synthesized
aaaaatagaatcgacctcat

SEQ ID NO: 292089 - DNA, 20 bp, Artificial Sequence
  chemically synthesized
actttggtaagtatcctatg

SEQ ID NO: 292090 - DNA, 20 bp, Artificial Sequence
  chemically synthesized
aactttggtaagtatcctat

SEQ ID NO: 292091 - DNA, 20 bp, Artificial Sequence
  chemically synthesized
acctcataggatacttacca

SEQ ID NO: 292092 - DNA, 20 bp, Artificial Sequence
  chemically synthesized
tgttaactcagaactttggt

SEQ ID NO: 292093 - DNA, 20 bp, Artificial Sequence
  chemically synthesized
aggatacttaccaaagttct

SEQ ID NO: 292094 - DNA, 20 bp, Artificial Sequence
  chemically synthesized
tatatgttaactcagaactt

SEQ ID NO: 292095 - DNA, 20 bp, Artificial Sequence
  chemically synthesized
gtaagttatatatgttaact

SEQ ID NO: 292096 - DNA, 20 bp, Artificial Sequence
  chemically synthesized
tgtcagcatttgttataagt

SEQ ID NO: 292097 - DNA, 20 bp, Artificial Sequence
  chemically synthesized
tatgtgtcagcatttgttat

SEQ ID NO: 292098 - DNA, 20 bp, Artificial Sequence
  chemically synthesized
ctttgttgcctagtatgtgt

SEQ ID NO: 292099 - DNA, 20 bp, Artificial Sequence
  chemically synthesized
taacaaatgctgacacatac

SEQ ID NO: 292100 - DNA, 20 bp, Artificial Sequence
  chemically synthesized
aacaaatgctgacacatact

SEQ ID NO: 292101 - DNA, 20 bp, Artificial Sequence
  chemically synthesized
ctgacacatactaggcaaca

SEQ ID NO: 292102 - DNA, 20 bp, Artificial Sequence
  chemically synthesized
tctaatatgtctttgttgcc

SEQ ID NO: 292103 - DNA, 20 bp, Artificial Sequence
  chemically synthesized
actaggcaacaaagacatat

SEQ ID NO: 292104 - DNA, 20 bp, Artificial Sequence
  chemically synthesized
acatattagacaatgccata

SEQ ID NO: 292105 - DNA, 20 bp, Artificial Sequence
  chemically synthesized
atattagacaatgccatata

SEQ ID NO: 292106 - DNA, 20 bp, Artificial Sequence
  chemically synthesized
tattagacaatgccatatag

SEQ ID NO: 292107 - DNA, 20 bp, Artificial Sequence
  chemically synthesized
tctttttcatttcctctata

SEQ ID NO: 292108 - DNA, 20 bp, Artificial Sequence
  chemically synthesized
gccatatagaggaaatgaaa

SEQ ID NO: 292109 - DNA, 20 bp, Artificial Sequence
  chemically synthesized
aggaaatgaaaaagaatatt

SEQ ID NO: 292110 - DNA, 20 bp, Artificial Sequence
  chemically synthesized
aaaaagaatattcagaaaac

SEQ ID NO: 292111 - DNA, 20 bp, Artificial Sequence
  chemically synthesized
aaaagaatattcagaaaaca

SEQ ID NO: 292112 - DNA, 20 bp, Artificial Sequence
  chemically synthesized
aaagaatattcagaaaacaa

SEQ ID NO: 292113 - DNA, 20 bp, Artificial Sequence
  chemically synthesized
atattcagaaaacaagggac

SEQ ID NO: 292114 - DNA, 20 bp, Artificial Sequence
  chemically synthesized
taattttcacacaagagagc

SEQ ID NO: 292115 - DNA, 20 bp, Artificial Sequence
  chemically synthesized
cccctaattttcacacaaga

SEQ ID NO: 292116 - DNA, 20 bp, Artificial Sequence
  chemically synthesized
tccccctaattttcacacaa

SEQ ID NO: 292117 - DNA, 20 bp, Artificial Sequence
  chemically synthesized
tctccccctaattttcacac

SEQ ID NO: 292118 - DNA, 20 bp, Artificial Sequence
  chemically synthesized
cagctctcttgtgtgaaaat

SEQ ID NO: 292119 - DNA, 20 bp, Artificial Sequence
  chemically synthesized
agctctcttgtgtgaaaatt

SEQ ID NO: 292120 - DNA, 20 bp, Artificial Sequence
  chemically synthesized
gctctcttgtgtgaaaatta

SEQ ID NO: 292121 - DNA, 20 bp, Artificial Sequence
  chemically synthesized
ctctcttgtgtgaaaattag

SEQ ID NO: 292122 - DNA, 20 bp, Artificial Sequence
  chemically synthesized
tctcttgtgtgaaaattagg

SEQ ID NO: 292123 - DNA, 20 bp, Artificial Sequence
  chemically synthesized
tcttgtgtgaaaattagggg

SEQ ID NO: 292124 - DNA, 20 bp, Artificial Sequence
  chemically synthesized
ttgtgtgaaaattaggggga

SEQ ID NO: 292125 - DNA, 20 bp, Artificial Sequence
  chemically synthesized
tgtgtgaaaattagggggag

SEQ ID NO: 292126 - DNA, 20 bp, Artificial Sequence
  chemically synthesized
gtgaaaattagggggagagg

SEQ ID NO: 292127 - DNA, 20 bp, Artificial Sequence
  chemically synthesized
gtcctgtttcagtcattaag

SEQ ID NO: 292128 - DNA, 20 bp, Artificial Sequence
  chemically synthesized
catgtcctgtttcagtcatt

SEQ ID NO: 292129 - DNA, 20 bp, Artificial Sequence
  chemically synthesized
agtcttcttaatgactgaaa

SEQ ID NO: 292130 - DNA, 20 bp, Artificial Sequence
  chemically synthesized
gtcttcttaatgactgaaac

SEQ ID NO: 292131 - DNA, 20 bp, Artificial Sequence
  chemically synthesized
tttttatacatgtcctgttt

SEQ ID NO: 292132 - DNA, 20 bp, Artificial Sequence
  chemically synthesized
tgaaacaggacatgtataaa

SEQ ID NO: 292133 - DNA, 20 bp, Artificial Sequence
  chemically synthesized
aattaggactaattttaaaa

SEQ ID NO: 292134 - DNA, 20 bp, Artificial Sequence
  chemically synthesized
taataatactattttaaaat

SEQ ID NO: 292135 - DNA, 20 bp, Artificial Sequence
  chemically synthesized
gtcatatattatataaaatt

SEQ ID NO: 292136 - DNA, 20 bp, Artificial Sequence
  chemically synthesized
agtcatatattatataaaat

SEQ ID NO: 292137 - DNA, 20 bp, Artificial Sequence
  chemically synthesized
tatataatatatgactaata

SEQ ID NO: 292138 - DNA, 20 bp, Artificial Sequence
  chemically synthesized
atataatatatgactaatat

SEQ ID NO: 292139 - DNA, 20 bp, Artificial Sequence
  chemically synthesized
acaccttctatatcccatat

SEQ ID NO: 292140 - DNA, 20 bp, Artificial Sequence
  chemically synthesized
tatatgactaatatgggata

SEQ ID NO: 292141 - DNA, 20 bp, Artificial Sequence
  chemically synthesized
atgactaatatgggatatag

SEQ ID NO: 292142 - DNA, 20 bp, Artificial Sequence
  chemically synthesized
tgactaatatgggatataga

SEQ ID NO: 292143 - DNA, 20 bp, Artificial Sequence
  chemically synthesized
gtgtatttatacatttttta

SEQ ID NO: 292144 - DNA, 20 bp, Artificial Sequence
  chemically synthesized
tatttatacattttttaaag

SEQ ID NO: 292145 - DNA, 20 bp, Artificial Sequence
  chemically synthesized
aaagaagttttatcaataac

SEQ ID NO: 292146 - DNA, 20 bp, Artificial Sequence
  chemically synthesized
aagaagttttatcaataacc

SEQ ID NO: 292147 - DNA, 20 bp, Artificial Sequence
  chemically synthesized
agaagttttatcaataacca

SEQ ID NO: 292148 - DNA, 20 bp, Artificial Sequence
  chemically synthesized
tcctggtctcaaaggatccc

SEQ ID NO: 292149 - DNA, 20 bp, Artificial Sequence
  chemically synthesized
tcaataaccagggatccttt

SEQ ID NO: 292150 - DNA, 20 bp, Artificial Sequence
  chemically synthesized
aaccagggatcctttgagac

SEQ ID NO: 292151 - DNA, 20 bp, Artificial Sequence
  chemically synthesized
cctcgaactcctggtctcaa

SEQ ID NO: 292152 - DNA, 20 bp, Artificial Sequence
  chemically synthesized
accagggatcctttgagacc

SEQ ID NO: 292153 - DNA, 20 bp, Artificial Sequence
  chemically synthesized
gcctcgaactcctggtctca

SEQ ID NO: 292154 - DNA, 20 bp, Artificial Sequence
  chemically synthesized
cagggatcctttgagaccag

SEQ ID NO: 292155 - DNA, 20 bp, Artificial Sequence
  chemically synthesized
tcctttgagaccaggagttc

SEQ ID NO: 292156 - DNA, 20 bp, Artificial Sequence
  chemically synthesized
tcagtgcagcctcgaactcc

SEQ ID NO: 292157 - DNA, 20 bp, Artificial Sequence
  chemically synthesized
cctttgagaccaggagttcg

SEQ ID NO: 292158 - DNA, 20 bp, Artificial Sequence
  chemically synthesized
caggagttcgaggctgcact

SEQ ID NO: 292159 - DNA, 20 bp, Artificial Sequence
  chemically synthesized
gatgcaatcatagctcagtg

SEQ ID NO: 292160 - DNA, 20 bp, Artificial Sequence
  chemically synthesized
acagtgatgcaatcatagct

SEQ ID NO: 292161 - DNA, 20 bp, Artificial Sequence
  chemically synthesized
agaatacagtgatgcaatca

SEQ ID NO: 292162 - DNA, 20 bp, Artificial Sequence
  chemically synthesized
atgattgcatcactgtattc

SEQ ID NO: 292163 - DNA, 20 bp, Artificial Sequence
  chemically synthesized
ctgttgcccaggctagaata

SEQ ID NO: 292164 - DNA, 20 bp, Artificial Sequence
  chemically synthesized
tgcatcactgtattctagcc

SEQ ID NO: 292165 - DNA, 20 bp, Artificial Sequence
  chemically synthesized
gcatcactgtattctagcct

SEQ ID NO: 292166 - DNA, 20 bp, Artificial Sequence
  chemically synthesized
tcttgctctgttgcccaggc

SEQ ID NO: 292167 - DNA, 20 bp, Artificial Sequence
  chemically synthesized
ctgtattctagcctgggcaa

SEQ ID NO: 292168 - DNA, 20 bp, Artificial Sequence
  chemically synthesized
aggctcttgctctgttgccc

SEQ ID NO: 292169 - DNA, 20 bp, Artificial Sequence
  chemically synthesized
gtattctagcctgggcaaca

SEQ ID NO: 292170 - DNA, 20 bp, Artificial Sequence
  chemically synthesized
caggctcttgctctgttgcc

SEQ ID NO: 292171 - DNA, 20 bp, Artificial Sequence
  chemically synthesized
tctagcctgggcaacagagc

SEQ ID NO: 292172 - DNA, 20 bp, Artificial Sequence
  chemically synthesized
tagcctgggcaacagagcaa

SEQ ID NO: 292173 - DNA, 20 bp, Artificial Sequence
  chemically synthesized
tttttattttagttggtgac

SEQ ID NO: 292174 - DNA, 20 bp, Artificial Sequence
  chemically synthesized
atttttattttagttggtga

SEQ ID NO: 292175 - DNA, 20 bp, Artificial Sequence
  chemically synthesized
ctttttatttttattttagt

SEQ ID NO: 292176 - DNA, 20 bp, Artificial Sequence
  chemically synthesized
aactctttttatttttattt

SEQ ID NO: 292177 - DNA, 20 bp, Artificial Sequence
  chemically synthesized
ccaactaaaataaaaataaa

SEQ ID NO: 292178 - DNA, 20 bp, Artificial Sequence
  chemically synthesized
aactaaaataaaaataaaaa

SEQ ID NO: 292179 - DNA, 20 bp, Artificial Sequence
  chemically synthesized
aaaaataaaaagagtttatt

SEQ ID NO: 292180 - DNA, 20 bp, Artificial Sequence
  chemically synthesized
aaaataaaaagagtttattt

SEQ ID NO: 292181 - DNA, 20 bp, Artificial Sequence
  chemically synthesized
aagagtttatttgggaatcc

SEQ ID NO: 292182 - DNA, 20 bp, Artificial Sequence
  chemically synthesized
taaatgtggcagaatattcc

SEQ ID NO: 292183 - DNA, 20 bp, Artificial Sequence
  chemically synthesized
ataaatgtggcagaatattc

SEQ ID NO: 292184 - DNA, 20 bp, Artificial Sequence
  chemically synthesized
tcacatgattataaatgtgg

SEQ ID NO: 292185 - DNA, 20 bp, Artificial Sequence
  chemically synthesized
atctcacatgattataaatg

SEQ ID NO: 292186 - DNA, 20 bp, Artificial Sequence
  chemically synthesized
tgccacatttataatcatgt

SEQ ID NO: 292187 - DNA, 20 bp, Artificial Sequence
  chemically synthesized
tttataatcatgtgagattg

SEQ ID NO: 292188 - DNA, 20 bp, Artificial Sequence
  chemically synthesized
catgtgagattgaagttata

SEQ ID NO: 292189 - DNA, 20 bp, Artificial Sequence
  chemically synthesized
aaaacatttcaaaaaaaacg

SEQ ID NO: 292190 - DNA, 20 bp, Artificial Sequence
  chemically synthesized
aaaaaaaacgtggaaatttc

SEQ ID NO: 292191 - DNA, 20 bp, Artificial Sequence
  chemically synthesized
atgtcttttctagtaacatc

SEQ ID NO: 292192 - DNA, 20 bp, Artificial Sequence
  chemically synthesized
tggaaatttctagatgttac

SEQ ID NO: 292193 - DNA, 20 bp, Artificial Sequence
  chemically synthesized
atttctagatgttactagaa

SEQ ID NO: 292194 - DNA, 20 bp, Artificial Sequence
  chemically synthesized
gcccaacattatgtcttttc

SEQ ID NO: 292195 - DNA, 20 bp, Artificial Sequence
  chemically synthesized
tactagaaaagacataatgt

SEQ ID NO: 292196 - DNA, 20 bp, Artificial Sequence
  chemically synthesized
actagaaaagacataatgtt

SEQ ID NO: 292197 - DNA, 20 bp, Artificial Sequence
  chemically synthesized
aaaagacataatgttgggca

SEQ ID NO: 292198 - DNA, 20 bp, Artificial Sequence
  chemically synthesized
taatgttgggcacagaaaat

SEQ ID NO: 292199 - DNA, 20 bp, Artificial Sequence
  chemically synthesized
tgttgggcacagaaaatcag

SEQ ID NO: 292200 - DNA, 20 bp, Artificial Sequence
  chemically synthesized
aaatcagaagtcttgctatg

SEQ ID NO: 292201 - DNA, 20 bp, Artificial Sequence
  chemically synthesized
aatcagaagtcttgctatga

SEQ ID NO: 292202 - DNA, 20 bp, Artificial Sequence
  chemically synthesized
gcatacaaatccttcatagc

SEQ ID NO: 292203 - DNA, 20 bp, Artificial Sequence
  chemically synthesized
gtttgcatacaaatccttca

SEQ ID NO: 292204 - DNA, 20 bp, Artificial Sequence
  chemically synthesized
ttatgcccttgttgagcagg

SEQ ID NO: 292205 - DNA, 20 bp, Artificial Sequence
  chemically synthesized
gaatatgctgcctgctcaac

SEQ ID NO: 292206 - DNA, 20 bp, Artificial Sequence
  chemically synthesized
agtttatgcccttgttgagc

SEQ ID NO: 292207 - DNA, 20 bp, Artificial Sequence
  chemically synthesized
aatatgctgcctgctcaaca

SEQ ID NO: 292208 - DNA, 20 bp, Artificial Sequence
  chemically synthesized
cagtttatgcccttgttgag

SEQ ID NO: 292209 - DNA, 20 bp, Artificial Sequence
  chemically synthesized
atatgctgcctgctcaacaa

SEQ ID NO: 292210 - DNA, 20 bp, Artificial Sequence
  chemically synthesized
ggacagtttatgcccttgtt

SEQ ID NO: 292211 - DNA, 20 bp, Artificial Sequence
  chemically synthesized
gagtttatagtttagaagga

SEQ ID NO: 292212 - DNA, 20 bp, Artificial Sequence
  chemically synthesized
ataggagtttatagtttaga

SEQ ID NO: 292213 - DNA, 20 bp, Artificial Sequence
  chemically synthesized
tataggagtttatagtttag

SEQ ID NO: 292214 - DNA, 20 bp, Artificial Sequence
  chemically synthesized
tcctataggagtttatagtt

SEQ ID NO: 292215 - DNA, 20 bp, Artificial Sequence
  chemically synthesized
acatttcctataggagttta

SEQ ID NO: 292216 - DNA, 20 bp, Artificial Sequence
  chemically synthesized
ttctaaactataaactccta

SEQ ID NO: 292217 - DNA, 20 bp, Artificial Sequence
  chemically synthesized
tctaaactataaactcctat

SEQ ID NO: 292218 - DNA, 20 bp, Artificial Sequence
  chemically synthesized
agtggagacatttcctatag

SEQ ID NO: 292219 - DNA, 20 bp, Artificial Sequence
  chemically synthesized
ccagtggagacatttcctat

SEQ ID NO: 292220 - DNA, 20 bp, Artificial Sequence
  chemically synthesized
gccagtggagacatttccta

SEQ ID NO: 292221 - DNA, 20 bp, Artificial Sequence
  chemically synthesized
cctataggaaatgtctccac

SEQ ID NO: 292222 - DNA, 20 bp, Artificial Sequence
  chemically synthesized
ataggaaatgtctccactgg

SEQ ID NO: 292223 - DNA, 20 bp, Artificial Sequence
  chemically synthesized
tctattagatactgccagtg

SEQ ID NO: 292224 - DNA, 20 bp, Artificial Sequence
  chemically synthesized
attctattagatactgccag

SEQ ID NO: 292225 - DNA, 20 bp, Artificial Sequence
  chemically synthesized
agaattctattagatactgc

SEQ ID NO: 292226 - DNA, 20 bp, Artificial Sequence
  chemically synthesized
tctccactggcagtatctaa

SEQ ID NO: 292227 - DNA, 20 bp, Artificial Sequence
  chemically synthesized
ctccaagctgagaattctat

SEQ ID NO: 292228 - DNA, 20 bp, Artificial Sequence
  chemically synthesized
gcagtatctaatagaattct

SEQ ID NO: 292229 - DNA, 20 bp, Artificial Sequence
  chemically synthesized
atctaatagaattctcagct

SEQ ID NO: 292230 - DNA, 20 bp, Artificial Sequence
  chemically synthesized
ctaatagaattctcagcttg

SEQ ID NO: 292231 - DNA, 20 bp, Artificial Sequence
  chemically synthesized
tactctttctactccaagct

SEQ ID NO: 292232 - DNA, 20 bp, Artificial Sequence
  chemically synthesized
atagaattctcagcttggag

SEQ ID NO: 292233 - DNA, 20 bp, Artificial Sequence
  chemically synthesized
agttatactctttctactcc

SEQ ID NO: 292234 - DNA, 20 bp, Artificial Sequence
  chemically synthesized
aattctcagcttggagtaga

SEQ ID NO: 292235 - DNA, 20 bp, Artificial Sequence
  chemically synthesized
ttctcagcttggagtagaaa

SEQ ID NO: 292236 - DNA, 20 bp, Artificial Sequence
  chemically synthesized
atgagttcatgagtacagtg

SEQ ID NO: 292237 - DNA, 20 bp, Artificial Sequence
  chemically synthesized
attgaatgagttcatgagta

SEQ ID NO: 292238 - DNA, 20 bp, Artificial Sequence
  chemically synthesized
ttggtattgaatgagttcat

SEQ ID NO: 292239 - DNA, 20 bp, Artificial Sequence
  chemically synthesized
ctattgatttggtattgaat

SEQ ID NO: 292240 - DNA, 20 bp, Artificial Sequence
  chemically synthesized
ctcattcaataccaaatcaa

SEQ ID NO: 292241 - DNA, 20 bp, Artificial Sequence
  chemically synthesized
tatagagtacactattgatt

SEQ ID NO: 292242 - DNA, 20 bp, Artificial Sequence
  chemically synthesized
ataatttttatattcatata

SEQ ID NO: 292243 - DNA, 20 bp, Artificial Sequence
  chemically synthesized
tcataatttttatattcata

SEQ ID NO: 292244 - DNA, 20 bp, Artificial Sequence
  chemically synthesized
tatatgaatataaaaattat

SEQ ID NO: 292245 - DNA, 20 bp, Artificial Sequence
  chemically synthesized
cttttggcttcagtgtacat

SEQ ID NO: 292246 - DNA, 20 bp, Artificial Sequence
  chemically synthesized
tatgagaccaatgtacactg

SEQ ID NO: 292247 - DNA, 20 bp, Artificial Sequence
  chemically synthesized
ccaatgtacactgaagccaa

SEQ ID NO: 292248 - DNA, 20 bp, Artificial Sequence
  chemically synthesized
ttgtgtatggcttttggctt

SEQ ID NO: 292249 - DNA, 20 bp, Artificial Sequence
  chemically synthesized
gcttgtttgtgtatggcttt

SEQ ID NO: 292250 - DNA, 20 bp, Artificial Sequence
  chemically synthesized
attgtgtgcttgtttgtgta

SEQ ID NO: 292251 - DNA, 20 bp, Artificial Sequence
  chemically synthesized
gccaaaagccatacacaaac

SEQ ID NO: 292252 - DNA, 20 bp, Artificial Sequence
  chemically synthesized
aaagcaaatttgatacaaga

SEQ ID NO: 292253 - DNA, 20 bp, Artificial Sequence
  chemically synthesized
ttaaagcaaatttgatacaa

SEQ ID NO: 292254 - DNA, 20 bp, Artificial Sequence
  chemically synthesized
ttttaaagcaaatttgatac

SEQ ID NO: 292255 - DNA, 20 bp, Artificial Sequence
  chemically synthesized
tcccctgcccaagtatttta

SEQ ID NO: 292256 - DNA, 20 bp, Artificial Sequence
  chemically synthesized
caaatttgctttaaaatact

SEQ ID NO: 292257 - DNA, 20 bp, Artificial Sequence
  chemically synthesized
aaatttgctttaaaatactt

SEQ ID NO: 292258 - DNA, 20 bp, Artificial Sequence
  chemically synthesized
tttgctttaaaatacttggg

SEQ ID NO: 292259 - DNA, 20 bp, Artificial Sequence
  chemically synthesized
ttgctttaaaatacttgggc

SEQ ID NO: 292260 - DNA, 20 bp, Artificial Sequence
  chemically synthesized
tgctttaaaatacttgggca

SEQ ID NO: 292261 - DNA, 20 bp, Artificial Sequence
  chemically synthesized
gctttaaaatacttgggcag

SEQ ID NO: 292262 - DNA, 20 bp, Artificial Sequence
  chemically synthesized
atcctctccatcccctgccc

SEQ ID NO: 292263 - DNA, 20 bp, Artificial Sequence
  chemically synthesized
taaaatacttgggcagggga

SEQ ID NO: 292264 - DNA, 20 bp, Artificial Sequence
  chemically synthesized
aaatacttgggcaggggatg

SEQ ID NO: 292265 - DNA, 20 bp, Artificial Sequence
  chemically synthesized
atacttgggcaggggatgga

SEQ ID NO: 292266 - DNA, 20 bp, Artificial Sequence
  chemically synthesized
tacttgggcaggggatggag

SEQ ID NO: 292267 - DNA, 20 bp, Artificial Sequence
  chemically synthesized
tgggcaggggatggagagga

SEQ ID NO: 292268 - DNA, 20 bp, Artificial Sequence
  chemically synthesized
attaacgtgacagtgtcagt

SEQ ID NO: 292269 - DNA, 20 bp, Artificial Sequence
  chemically synthesized
ggttattaacgtgacagtgt

SEQ ID NO: 292270 - DNA, 20 bp, Artificial Sequence
  chemically synthesized
agtgtcggttattaacgtga

SEQ ID NO: 292271 - DNA, 20 bp, Artificial Sequence
  chemically synthesized
attaagtaatgtgacagtgt

SEQ ID NO: 292272 - DNA, 20 bp, Artificial Sequence
  chemically synthesized
aggtacattaagtaatgtga

SEQ ID NO: 292273 - DNA, 20 bp, Artificial Sequence
  chemically synthesized
taattgaagagaggtacatt

SEQ ID NO: 292274 - DNA, 20 bp, Artificial Sequence
  chemically synthesized
ttctcattttaattgaagag

SEQ ID NO: 292275 - DNA, 20 bp, Artificial Sequence
  chemically synthesized
tttctcattttaattgaaga

SEQ ID NO: 292276 - DNA, 20 bp, Artificial Sequence
  chemically synthesized
catttctcattttaattgaa

SEQ ID NO: 292277 - DNA, 20 bp, Artificial Sequence
  chemically synthesized
agcatttctcattttaattg

SEQ ID NO: 292278 - DNA, 20 bp, Artificial Sequence
  chemically synthesized
tacctctcttcaattaaaat

SEQ ID NO: 292279 - DNA, 20 bp, Artificial Sequence
  chemically synthesized
aattcataaagttgaagtaa

SEQ ID NO: 292280 - DNA, 20 bp, Artificial Sequence
  chemically synthesized
tcaattaattcataaagttg

SEQ ID NO: 292281 - DNA, 20 bp, Artificial Sequence
  chemically synthesized
agatggtcaattaattcata

SEQ ID NO: 292282 - DNA, 20 bp, Artificial Sequence
  chemically synthesized
cagtagttctggcatttaga

SEQ ID NO: 292283 - DNA, 20 bp, Artificial Sequence
  chemically synthesized
ttaattgaccatctaaatgc

SEQ ID NO: 292284 - DNA, 20 bp, Artificial Sequence
  chemically synthesized
tcaacagtagttctggcatt

SEQ ID NO: 292285 - DNA, 20 bp, Artificial Sequence
  chemically synthesized
tagaaaatcaacagtagttc

SEQ ID NO: 292286 - DNA, 20 bp, Artificial Sequence
  chemically synthesized
ctttcttagaaaatcaacag

SEQ ID NO: 292287 - DNA, 20 bp, Artificial Sequence
  chemically synthesized
ggactttcttagaaaatcaa

SEQ ID NO: 292288 - DNA, 20 bp, Artificial Sequence
  chemically synthesized
agaactactgttgattttct

SEQ ID NO: 292289 - DNA, 20 bp, Artificial Sequence
  chemically synthesized
ctactgttgattttctaaga

SEQ ID NO: 292290 - DNA, 20 bp, Artificial Sequence
  chemically synthesized
aaggttttaatggactttct

SEQ ID NO: 292291 - DNA, 20 bp, Artificial Sequence
  chemically synthesized
tcattctagaaaggttttaa

SEQ ID NO: 292292 - DNA, 20 bp, Artificial Sequence
  chemically synthesized
aaagtccattaaaacctttc

SEQ ID NO: 292293 - DNA, 20 bp, Artificial Sequence
  chemically synthesized
aaccctttttcattctagaa

SEQ ID NO: 292294 - DNA, 20 bp, Artificial Sequence
  chemically synthesized
gaaccctttttcattctaga

SEQ ID NO: 292295 - DNA, 20 bp, Artificial Sequence
  chemically synthesized
ctttgaaccctttttcattc

SEQ ID NO: 292296 - DNA, 20 bp, Artificial Sequence
  chemically synthesized
aaaacctttctagaatgaaa

SEQ ID NO: 292297 - DNA, 20 bp, Artificial Sequence
  chemically synthesized
aaacctttctagaatgaaaa

SEQ ID NO: 292298 - DNA, 20 bp, Artificial Sequence
  chemically synthesized
aacctttctagaatgaaaaa

SEQ ID NO: 292299 - DNA, 20 bp, Artificial Sequence
  chemically synthesized
ctagaatgaaaaagggttca

SEQ ID NO: 292300 - DNA, 20 bp, Artificial Sequence
  chemically synthesized
aagggttcaaagcgttatcc

SEQ ID NO: 292301 - DNA, 20 bp, Artificial Sequence
  chemically synthesized
tccatatgcaaatatttact

SEQ ID NO: 292302 - DNA, 20 bp, Artificial Sequence
  chemically synthesized
tccaagtaaatatttgcata

SEQ ID NO: 292303 - DNA, 20 bp, Artificial Sequence
  chemically synthesized
attgttttatatgtattcca

SEQ ID NO: 292304 - DNA, 20 bp, Artificial Sequence
  chemically synthesized
agtcaaggagcataattcta

SEQ ID NO: 292305 - DNA, 20 bp, Artificial Sequence
  chemically synthesized
aaattttccattgagtcaag

SEQ ID NO: 292306 - DNA, 20 bp, Artificial Sequence
  chemically synthesized
taaaattttccattgagtca

SEQ ID NO: 292307 - DNA, 20 bp, Artificial Sequence
  chemically synthesized
aattatgctccttgactcaa

SEQ ID NO: 292308 - DNA, 20 bp, Artificial Sequence
  chemically synthesized
ttaaaattttccattgagtc

SEQ ID NO: 292309 - DNA, 20 bp, Artificial Sequence
  chemically synthesized
aaaagttaaaattttccatt

SEQ ID NO: 292310 - DNA, 20 bp, Artificial Sequence
  chemically synthesized
tggaaaattttaacttttct

SEQ ID NO: 292311 - DNA, 20 bp, Artificial Sequence
  chemically synthesized
gaaaattttaacttttctaa

SEQ ID NO: 292312 - DNA, 20 bp, Artificial Sequence
  chemically synthesized
acacttacaaactcttagaa

SEQ ID NO: 292313 - DNA, 20 bp, Artificial Sequence
  chemically synthesized
tatttacacttacaaactct

SEQ ID NO: 292314 - DNA, 20 bp, Artificial Sequence
  chemically synthesized
taacttttctaagagtttgt

SEQ ID NO: 292315 - DNA, 20 bp, Artificial Sequence
  chemically synthesized
tgtaagtgtaaatatctgaa

SEQ ID NO: 292316 - DNA, 20 bp, Artificial Sequence
  chemically synthesized
gattgatacttaaaactttt

SEQ ID NO: 292317 - DNA, 20 bp, Artificial Sequence
  chemically synthesized
gtaaatatctgaaaagtttt

SEQ ID NO: 292318 - DNA, 20 bp, Artificial Sequence
  chemically synthesized
gttttaagtatcaatcatct

SEQ ID NO: 292319 - DNA, 20 bp, Artificial Sequence
  chemically synthesized
aaaattagaaaacagatgct

SEQ ID NO: 292320 - DNA, 20 bp, Artificial Sequence
  chemically synthesized
gctaacacaaaattagaaaa

SEQ ID NO: 292321 - DNA, 20 bp, Artificial Sequence
  chemically synthesized
ttaaatagctaacacaaaat

SEQ ID NO: 292322 - DNA, 20 bp, Artificial Sequence
  chemically synthesized
tctgttttctaattttgtgt

SEQ ID NO: 292323 - DNA, 20 bp, Artificial Sequence
  chemically synthesized
taattttgtgttagctattt

SEQ ID NO: 292324 - DNA, 20 bp, Artificial Sequence
  chemically synthesized
ttagtatttgtattcttaaa

SEQ ID NO: 292325 - DNA, 20 bp, Artificial Sequence
  chemically synthesized
gaatacaaatactaacacac

SEQ ID NO: 292326 - DNA, 20 bp, Artificial Sequence
  chemically synthesized
aatacaaatactaacacacc

SEQ ID NO: 292327 - DNA, 20 bp, Artificial Sequence
  chemically synthesized
gctcataatgcctggtgtgt

SEQ ID NO: 292328 - DNA, 20 bp, Artificial Sequence
  chemically synthesized
taagtattgctcataatgcc

SEQ ID NO: 292329 - DNA, 20 bp, Artificial Sequence
  chemically synthesized
actaacacaccaggcattat

SEQ ID NO: 292330 - DNA, 20 bp, Artificial Sequence
  chemically synthesized
ggcattatgagcaatactta

SEQ ID NO: 292331 - DNA, 20 bp, Artificial Sequence
  chemically synthesized
tacaacaaaatggtttccat

SEQ ID NO: 292332 - DNA, 20 bp, Artificial Sequence
  chemically synthesized
tctaatgtgctacaacaaaa

SEQ ID NO: 292333 - DNA, 20 bp, Artificial Sequence
  chemically synthesized
ttatggaaaccattttgttg

SEQ ID NO: 292334 - DNA, 20 bp, Artificial Sequence
  chemically synthesized
accattttgttgtagcacat

SEQ ID NO: 292335 - DNA, 20 bp, Artificial Sequence
  chemically synthesized
gttgtagcacattagaatct

SEQ ID NO: 292336 - DNA, 20 bp, Artificial Sequence
  chemically synthesized
ttgtagcacattagaatctc

SEQ ID NO: 292337 - DNA, 20 bp, Artificial Sequence
  chemically synthesized
tgtagcacattagaatctca

SEQ ID NO: 292338 - DNA, 20 bp, Artificial Sequence
  chemically synthesized
gattatgatccattatccct

SEQ ID NO: 292339 - DNA, 20 bp, Artificial Sequence
  chemically synthesized
cattagaatctcagggataa

SEQ ID NO: 292340 - DNA, 20 bp, Artificial Sequence
  chemically synthesized
tttagaatatgagatgtgaa

SEQ ID NO: 292341 - DNA, 20 bp, Artificial Sequence
  chemically synthesized
tcaggggttgtttagaatat

SEQ ID NO: 292342 - DNA, 20 bp, Artificial Sequence
  chemically synthesized
agactatttcaggggttgtt

SEQ ID NO: 292343 - DNA, 20 bp, Artificial Sequence
  chemically synthesized
attctaaacaacccctgaaa

SEQ ID NO: 292344 - DNA, 20 bp, Artificial Sequence
  chemically synthesized
ttattcacagactatttcag

SEQ ID NO: 292345 - DNA, 20 bp, Artificial Sequence
  chemically synthesized
tttattcacagactatttca

SEQ ID NO: 292346 - DNA, 20 bp, Artificial Sequence
  chemically synthesized
atttattcacagactatttc

SEQ ID NO: 292347 - DNA, 20 bp, Artificial Sequence
  chemically synthesized
tatttattcacagactattt

SEQ ID NO: 292348 - DNA, 20 bp, Artificial Sequence
  chemically synthesized
gggtgcaatatatttattca

SEQ ID NO: 292349 - DNA, 20 bp, Artificial Sequence
  chemically synthesized
gtgaataaatatattgcacc

SEQ ID NO: 292350 - DNA, 20 bp, Artificial Sequence
  chemically synthesized
gaataaatatattgcaccca

SEQ ID NO: 292351 - DNA, 20 bp, Artificial Sequence
  chemically synthesized
aataaatatattgcacccag

SEQ ID NO: 292352 - DNA, 20 bp, Artificial Sequence
  chemically synthesized
agtaatgatccatttcctct

SEQ ID NO: 292353 - DNA, 20 bp, Artificial Sequence
  chemically synthesized
tatattgcacccagaggaaa

SEQ ID NO: 292354 - DNA, 20 bp, Artificial Sequence
  chemically synthesized
aagtaatgatccatttcctc

SEQ ID NO: 292355 - DNA, 20 bp, Artificial Sequence
  chemically synthesized
aggaaatggatcattacttg

SEQ ID NO: 292356 - DNA, 20 bp, Artificial Sequence
  chemically synthesized
aaaattaatggatacacttc

SEQ ID NO: 292357 - DNA, 20 bp, Artificial Sequence
  chemically synthesized
tacacaagtaataaaattaa

SEQ ID NO: 292358 - DNA, 20 bp, Artificial Sequence
  chemically synthesized
ttaattttattacttgtgta

SEQ ID NO: 292359 - DNA, 20 bp, Artificial Sequence
  chemically synthesized
gtctgttatgcactgtacac

SEQ ID NO: 292360 - DNA, 20 bp, Artificial Sequence
  chemically synthesized
tacttgtgtacagtgcataa

SEQ ID NO: 292361 - DNA, 20 bp, Artificial Sequence
  chemically synthesized
tacagtgcataacagactgt

SEQ ID NO: 292362 - DNA, 20 bp, Artificial Sequence
  chemically synthesized
cacatttaacattattctaa

SEQ ID NO: 292363 - DNA, 20 bp, Artificial Sequence
  chemically synthesized
tgaagtacttgcatggaagg

SEQ ID NO: 292364 - DNA, 20 bp, Artificial Sequence
  chemically synthesized
atgtgcaccaccttccatgc

SEQ ID NO: 292365 - DNA, 20 bp, Artificial Sequence
  chemically synthesized
ttctgaagtacttgcatgga

SEQ ID NO: 292366 - DNA, 20 bp, Artificial Sequence
  chemically synthesized
gttctgaagtacttgcatgg

SEQ ID NO: 292367 - DNA, 20 bp, Artificial Sequence
  chemically synthesized
gcagttctgaagtacttgca

SEQ ID NO: 292368 - DNA, 20 bp, Artificial Sequence
  chemically synthesized
caccttccatgcaagtactt

SEQ ID NO: 292369 - DNA, 20 bp, Artificial Sequence
  chemically synthesized
cactttaagtggcagttctg

SEQ ID NO: 292370 - DNA, 20 bp, Artificial Sequence
  chemically synthesized
tacttcagaactgccactta

SEQ ID NO: 292371 - DNA, 20 bp, Artificial Sequence
  chemically synthesized
gaatacttcactttaagtgg

SEQ ID NO: 292372 - DNA, 20 bp, Artificial Sequence
  chemically synthesized
gaggaatacttcactttaag

SEQ ID NO: 292373 - DNA, 20 bp, Artificial Sequence
  chemically synthesized
cagaactgccacttaaagtg

SEQ ID NO: 292374 - DNA, 20 bp, Artificial Sequence
  chemically synthesized
gatgaggaatacttcacttt

SEQ ID NO: 292375 - DNA, 20 bp, Artificial Sequence
  chemically synthesized
aaagtgaagtattcctcatc

SEQ ID NO: 292376 - DNA, 20 bp, Artificial Sequence
  chemically synthesized
aatgatgaatatacttgatg

SEQ ID NO: 292377 - DNA, 20 bp, Artificial Sequence
  chemically synthesized
taatgatgaatatacttgat

SEQ ID NO: 292378 - DNA, 20 bp, Artificial Sequence
  chemically synthesized
tcatcaagtatattcatcat

SEQ ID NO: 292379 - DNA, 20 bp, Artificial Sequence
  chemically synthesized
tatattcatcattagccatg

SEQ ID NO: 292380 - DNA, 20 bp, Artificial Sequence
  chemically synthesized
ttcatcattagccatgaagc

SEQ ID NO: 292381 - DNA, 20 bp, Artificial Sequence
  chemically synthesized
tcatcattagccatgaagcc

SEQ ID NO: 292382 - DNA, 20 bp, Artificial Sequence
  chemically synthesized
gttattctaccctggcttca

SEQ ID NO: 292383 - DNA, 20 bp, Artificial Sequence
  chemically synthesized
catcattagccatgaagcca

SEQ ID NO: 292384 - DNA, 20 bp, Artificial Sequence
  chemically synthesized
cattagccatgaagccaggg

SEQ ID NO: 292385 - DNA, 20 bp, Artificial Sequence
  chemically synthesized
tgttttgtgttattctaccc

SEQ ID NO: 292386 - DNA, 20 bp, Artificial Sequence
  chemically synthesized
agggtagaataacacaaaac

SEQ ID NO: 292387 - DNA, 20 bp, Artificial Sequence
  chemically synthesized
taacacaaaacaagtgtttc

SEQ ID NO: 292388 - DNA, 20 bp, Artificial Sequence
  chemically synthesized
acacaaaacaagtgtttcca

SEQ ID NO: 292389 - DNA, 20 bp, Artificial Sequence
  chemically synthesized
ttcttttaattcaagagctc

SEQ ID NO: 292390 - DNA, 20 bp, Artificial Sequence
  chemically synthesized
caaatattcttttaattcaa

SEQ ID NO: 292391 - DNA, 20 bp, Artificial Sequence
  chemically synthesized
ttccagagctcttgaattaa

SEQ ID NO: 292392 - DNA, 20 bp, Artificial Sequence
  chemically synthesized
tccaaatattcttttaattc

SEQ ID NO: 292393 - DNA, 20 bp, Artificial Sequence
  chemically synthesized
tcttgaattaaaagaatatt

SEQ ID NO: 292394 - DNA, 20 bp, Artificial Sequence
  chemically synthesized
aattaaaagaatatttggaa

SEQ ID NO: 292395 - DNA, 20 bp, Artificial Sequence
  chemically synthesized
tggaatagaaacttaaaata

SEQ ID NO: 292396 - DNA, 20 bp, Artificial Sequence
  chemically synthesized
tttattagcagctttatttt

SEQ ID NO: 292397 - DNA, 20 bp, Artificial Sequence
  chemically synthesized
aataggagactgtttattag

SEQ ID NO: 292398 - DNA, 20 bp, Artificial Sequence
  chemically synthesized
aaaataaagctgctaataaa

SEQ ID NO: 292399 - DNA, 20 bp, Artificial Sequence
  chemically synthesized
aaaaataggagactgtttat

SEQ ID NO: 292400 - DNA, 20 bp, Artificial Sequence
  chemically synthesized
ttaaagttcagcaaaaatag

SEQ ID NO: 292401 - DNA, 20 bp, Artificial Sequence
  chemically synthesized
acttaaagttcagcaaaaat

SEQ ID NO: 292402 - DNA, 20 bp, Artificial Sequence
  chemically synthesized
cacttaaagttcagcaaaaa

SEQ ID NO: 292403 - DNA, 20 bp, Artificial Sequence
  chemically synthesized
tcctatttttgctgaacttt

SEQ ID NO: 292404 - DNA, 20 bp, Artificial Sequence
  chemically synthesized
aataaccctcacttaaagtt

SEQ ID NO: 292405 - DNA, 20 bp, Artificial Sequence
  chemically synthesized
atttttgctgaactttaagt

SEQ ID NO: 292406 - DNA, 20 bp, Artificial Sequence
  chemically synthesized
tttttgctgaactttaagtg

SEQ ID NO: 292407 - DNA, 20 bp, Artificial Sequence
  chemically synthesized
ttttgctgaactttaagtga

SEQ ID NO: 292408 - DNA, 20 bp, Artificial Sequence
  chemically synthesized
cttgtaataaccctcactta

SEQ ID NO: 292409 - DNA, 20 bp, Artificial Sequence
  chemically synthesized
ctttaagtgagggttattac

SEQ ID NO: 292410 - DNA, 20 bp, Artificial Sequence
  chemically synthesized
agggttattacaagtccatt

SEQ ID NO: 292411 - DNA, 20 bp, Artificial Sequence
  chemically synthesized
ctattacattgaatgctaaa

SEQ ID NO: 292412 - DNA, 20 bp, Artificial Sequence
  chemically synthesized
ccatttagcattcaatgtaa

SEQ ID NO: 292413 - DNA, 20 bp, Artificial Sequence
  chemically synthesized
aatatctctatattacattt

SEQ ID NO: 292414 - DNA, 20 bp, Artificial Sequence
  chemically synthesized
taatagtctaaaatgtaata

SEQ ID NO: 292415 - DNA, 20 bp, Artificial Sequence
  chemically synthesized
atagtctaaaatgtaatata

SEQ ID NO: 292416 - DNA, 20 bp, Artificial Sequence
  chemically synthesized
agagatattcaaaacctgtg

SEQ ID NO: 292417 - DNA, 20 bp, Artificial Sequence
  chemically synthesized
gcctcagaacttgtcttcac

SEQ ID NO: 292418 - DNA, 20 bp, Artificial Sequence
  chemically synthesized
tattcaaaacctgtgaagac

SEQ ID NO: 292419 - DNA, 20 bp, Artificial Sequence
  chemically synthesized
agcctcagaacttgtcttca

SEQ ID NO: 292420 - DNA, 20 bp, Artificial Sequence
  chemically synthesized
aacctgtgaagacaagttct

SEQ ID NO: 292421 - DNA, 20 bp, Artificial Sequence
  chemically synthesized
acctgtgaagacaagttctg

SEQ ID NO: 292422 - DNA, 20 bp, Artificial Sequence
  chemically synthesized
aaacctctaaaatttagcct

SEQ ID NO: 292423 - DNA, 20 bp, Artificial Sequence
  chemically synthesized
caagttctgaggctaaattt

SEQ ID NO: 292424 - DNA, 20 bp, Artificial Sequence
  chemically synthesized
agttctgaggctaaatttta

SEQ ID NO: 292425 - DNA, 20 bp, Artificial Sequence
  chemically synthesized
tcacagaaacctctaaaatt

SEQ ID NO: 292426 - DNA, 20 bp, Artificial Sequence
  chemically synthesized
gttctgaggctaaattttag

SEQ ID NO: 292427 - DNA, 20 bp, Artificial Sequence
  chemically synthesized
actttaagtcagtgtggtca

SEQ ID NO: 292428 - DNA, 20 bp, Artificial Sequence
  chemically synthesized
gctattactttaagtcagtg

SEQ ID NO: 292429 - DNA, 20 bp, Artificial Sequence
  chemically synthesized
tctgtgaccacactgactta

SEQ ID NO: 292430 - DNA, 20 bp, Artificial Sequence
  chemically synthesized
taaaagctattactttaagt

SEQ ID NO: 292431 - DNA, 20 bp, Artificial Sequence
  chemically synthesized
accacactgacttaaagtaa

SEQ ID NO: 292432 - DNA, 20 bp, Artificial Sequence
  chemically synthesized
tttttaaaagctattacttt

SEQ ID NO: 292433 - DNA, 20 bp, Artificial Sequence
  chemically synthesized
tatatactattaatttttaa

SEQ ID NO: 292434 - DNA, 20 bp, Artificial Sequence
  chemically synthesized
taatagcttttaaaaattaa

SEQ ID NO: 292435 - DNA, 20 bp, Artificial Sequence
  chemically synthesized
aaaattaatagtatatataa

SEQ ID NO: 292436 - DNA, 20 bp, Artificial Sequence
  chemically synthesized
atatataaaagtaatacccc

SEQ ID NO: 292437 - DNA, 20 bp, Artificial Sequence
  chemically synthesized
ataaaagtaatacccctagt

SEQ ID NO: 292438 - DNA, 20 bp, Artificial Sequence
  chemically synthesized
taaaagtaatacccctagtg

SEQ ID NO: 292439 - DNA, 20 bp, Artificial Sequence
  chemically synthesized
aaaagtaatacccctagtga

SEQ ID NO: 292440 - DNA, 20 bp, Artificial Sequence
  chemically synthesized
atttatattgccctcactag

SEQ ID NO: 292441 - DNA, 20 bp, Artificial Sequence
  chemically synthesized
aatttatattgccctcacta

SEQ ID NO: 292442 - DNA, 20 bp, Artificial Sequence
  chemically synthesized
aaatttatattgccctcact

SEQ ID NO: 292443 - DNA, 20 bp, Artificial Sequence
  chemically synthesized
aaaatttatattgccctcac

SEQ ID NO: 292444 - DNA, 20 bp, Artificial Sequence
  chemically synthesized
caatataaattttactaata

SEQ ID NO: 292445 - DNA, 20 bp, Artificial Sequence
  chemically synthesized
aaaacgcaaaagggctatat

SEQ ID NO: 292446 - DNA, 20 bp, Artificial Sequence
  chemically synthesized
ttgaaaataaaaacgcaaaa

SEQ ID NO: 292447 - DNA, 20 bp, Artificial Sequence
  chemically synthesized
tttgaaaataaaaacgcaaa

SEQ ID NO: 292448 - DNA, 20 bp, Artificial Sequence
  chemically synthesized
gtttgaaaataaaaacgcaa

SEQ ID NO: 292449 - DNA, 20 bp, Artificial Sequence
  chemically synthesized
aaacatcataaaattaaaaa

SEQ ID NO: 292450 - DNA, 20 bp, Artificial Sequence
  chemically synthesized
atcataaaattaaaaaaagt

SEQ ID NO: 292451 - DNA, 20 bp, Artificial Sequence
  chemically synthesized
tgagtggccaaaacaaatat

SEQ ID NO: 292452 - DNA, 20 bp, Artificial Sequence
  chemically synthesized
atttttactcatatttgttt

SEQ ID NO: 292453 - DNA, 20 bp, Artificial Sequence
  chemically synthesized
ctgttgttgtgggaaatgag

SEQ ID NO: 292454 - DNA, 20 bp, Artificial Sequence
  chemically synthesized
tcactgttgttgtgggaaat

SEQ ID NO: 292455 - DNA, 20 bp, Artificial Sequence
  chemically synthesized
ccactcatttcccacaacaa

SEQ ID NO: 292456 - DNA, 20 bp, Artificial Sequence
  chemically synthesized
gttgttgtcactgttgttgt

SEQ ID NO: 292457 - DNA, 20 bp, Artificial Sequence
  chemically synthesized
tgttgttgtcactgttgttg

SEQ ID NO: 292458 - DNA, 20 bp, Artificial Sequence
  chemically synthesized
cacaacaacagtgacaacaa

SEQ ID NO: 292459 - DNA, 20 bp, Artificial Sequence
  chemically synthesized
gtccatgtgtgtgaaagaaa

SEQ ID NO: 292460 - DNA, 20 bp, Artificial Sequence
  chemically synthesized
gtgtccatgtgtgtgaaaga

SEQ ID NO: 292461 - DNA, 20 bp, Artificial Sequence
  chemically synthesized
gtgtgtgtccatgtgtgtga

SEQ ID NO: 292462 - DNA, 20 bp, Artificial Sequence
  chemically synthesized
gtctctttctttcacacaca

SEQ ID NO: 292463 - DNA, 20 bp, Artificial Sequence
  chemically synthesized
acgcacatgtctgcgcatgc

SEQ ID NO: 292464 - DNA, 20 bp, Artificial Sequence
  chemically synthesized
cacgggtgaactcgcatgcg

SEQ ID NO: 292465 - DNA, 20 bp, Artificial Sequence
  chemically synthesized
tgagcacggcgtgcatgcac

SEQ ID NO: 292466 - DNA, 20 bp, Artificial Sequence
  chemically synthesized
gtgagcacggcgtgcatgca

SEQ ID NO: 292467 - DNA, 20 bp, Artificial Sequence
  chemically synthesized
tctgtgggtgtgtgtgagca

SEQ ID NO: 292468 - DNA, 20 bp, Artificial Sequence
  chemically synthesized
gagcctctgtgggtgtgtgt

SEQ ID NO: 292469 - DNA, 20 bp, Artificial Sequence
  chemically synthesized
gccgtgctcacacacaccca

SEQ ID NO: 292470 - DNA, 20 bp, Artificial Sequence
  chemically synthesized
cgtgctcacacacacccaca

SEQ ID NO: 292471 - DNA, 20 bp, Artificial Sequence
  chemically synthesized
gtgctcacacacacccacag

SEQ ID NO: 292472 - DNA, 20 bp, Artificial Sequence
  chemically synthesized
ccaaaaggaagagcctctgt

SEQ ID NO: 292473 - DNA, 20 bp, Artificial Sequence
  chemically synthesized
tccaaaaggaagagcctctg

SEQ ID NO: 292474 - DNA, 20 bp, Artificial Sequence
  chemically synthesized
cccacagaggctcttccttt

SEQ ID NO: 292475 - DNA, 20 bp, Artificial Sequence
  chemically synthesized
agtctaatctccaaaaggaa

SEQ ID NO: 292476 - DNA, 20 bp, Artificial Sequence
  chemically synthesized
cacagaggctcttccttttg

SEQ ID NO: 292477 - DNA, 20 bp, Artificial Sequence
  chemically synthesized
taagtctaatctccaaaagg

SEQ ID NO: 292478 - DNA, 20 bp, Artificial Sequence
  chemically synthesized
gtttaagtctaatctccaaa

SEQ ID NO: 292479 - DNA, 20 bp, Artificial Sequence
  chemically synthesized
cgtttaagtctaatctccaa

SEQ ID NO: 292480 - DNA, 20 bp, Artificial Sequence
  chemically synthesized
aggctcttccttttggagat

SEQ ID NO: 292481 - DNA, 20 bp, Artificial Sequence
  chemically synthesized
ttggagattagacttaaacg

SEQ ID NO: 292482 - DNA, 20 bp, Artificial Sequence
  chemically synthesized
aggcacatttttcttcgttt

SEQ ID NO: 292483 - DNA, 20 bp, Artificial Sequence
  chemically synthesized
aataaatgtttttaattgac

SEQ ID NO: 292484 - DNA, 20 bp, Artificial Sequence
  chemically synthesized
caataaatgtttttaattga

SEQ ID NO: 292485 - DNA, 20 bp, Artificial Sequence
  chemically synthesized
tattgaatgtgaactctgtg

SEQ ID NO: 292486 - DNA, 20 bp, Artificial Sequence
  chemically synthesized
ttgaatgtgaactctgtgta

SEQ ID NO: 292487 - DNA, 20 bp, Artificial Sequence
  chemically synthesized
ttagtataatgctctacaca

SEQ ID NO: 292488 - DNA, 20 bp, Artificial Sequence
  chemically synthesized
acttagtataatgctctaca

SEQ ID NO: 292489 - DNA, 20 bp, Artificial Sequence
  chemically synthesized
tctgtgtagagcattatact

SEQ ID NO: 292490 - DNA, 20 bp, Artificial Sequence
  chemically synthesized
ttctttctccacatgacact

SEQ ID NO: 292491 - DNA, 20 bp, Artificial Sequence
  chemically synthesized
gcattatactaagtgtcatg

SEQ ID NO: 292492 - DNA, 20 bp, Artificial Sequence
  chemically synthesized
attatactaagtgtcatgtg

SEQ ID NO: 292493 - DNA, 20 bp, Artificial Sequence
  chemically synthesized
tactaagtgtcatgtggaga

SEQ ID NO: 292494 - DNA, 20 bp, Artificial Sequence
  chemically synthesized
taagtgtcatgtggagaaag

SEQ ID NO: 292495 - DNA, 20 bp, Artificial Sequence
  chemically synthesized
gaaatataaatcaaactgcc

SEQ ID NO: 292496 - DNA, 20 bp, Artificial Sequence
  chemically synthesized
attccttcctcagtactggg

SEQ ID NO: 292497 - DNA, 20 bp, Artificial Sequence
  chemically synthesized
aaatcaaactgcccagtact

SEQ ID NO: 292498 - DNA, 20 bp, Artificial Sequence
  chemically synthesized
aatcaaactgcccagtactg

SEQ ID NO: 292499 - DNA, 20 bp, Artificial Sequence
  chemically synthesized
cttattccttcctcagtact

SEQ ID NO: 292500 - DNA, 20 bp, Artificial Sequence
  chemically synthesized
tcttattccttcctcagtac

SEQ ID NO: 292501 - DNA, 20 bp, Artificial Sequence
  chemically synthesized
caaactgcccagtactgagg

SEQ ID NO: 292502 - DNA, 20 bp, Artificial Sequence
  chemically synthesized
aaactgcccagtactgagga

SEQ ID NO: 292503 - DNA, 20 bp, Artificial Sequence
  chemically synthesized
ctcttctcttattccttcct

SEQ ID NO: 292504 - DNA, 20 bp, Artificial Sequence
  chemically synthesized
cccagtactgaggaaggaat

SEQ ID NO: 292505 - DNA, 20 bp, Artificial Sequence
  chemically synthesized
cagtactgaggaaggaataa

SEQ ID NO: 292506 - DNA, 20 bp, Artificial Sequence
  chemically synthesized
tactgaggaaggaataagag

SEQ ID NO: 292507 - DNA, 20 bp, Artificial Sequence
  chemically synthesized
ctgaggaaggaataagagaa

SEQ ID NO: 292508 - DNA, 20 bp, Artificial Sequence
  chemically synthesized
tgaggaaggaataagagaag

SEQ ID NO: 292509 - DNA, 20 bp, Artificial Sequence
  chemically synthesized
agaggaaatatatgcaactg

SEQ ID NO: 292510 - DNA, 20 bp, Artificial Sequence
  chemically synthesized
ggaaatatatgcaactgtgg

SEQ ID NO: 292511 - DNA, 20 bp, Artificial Sequence
  chemically synthesized
gaaatatatgcaactgtgga

SEQ ID NO: 292512 - DNA, 20 bp, Artificial Sequence
  chemically synthesized
catgaatgagtagccttcca

SEQ ID NO: 292513 - DNA, 20 bp, Artificial Sequence
  chemically synthesized
gccccttcatcatgaatgag

SEQ ID NO: 292514 - DNA, 20 bp, Artificial Sequence
  chemically synthesized
ccagccccttcatcatgaat

SEQ ID NO: 292515 - DNA, 20 bp, Artificial Sequence
  chemically synthesized
aaggctactcattcatgatg

SEQ ID NO: 292516 - DNA, 20 bp, Artificial Sequence
  chemically synthesized
aggctactcattcatgatga

SEQ ID NO: 292517 - DNA, 20 bp, Artificial Sequence
  chemically synthesized
ggctactcattcatgatgaa

SEQ ID NO: 292518 - DNA, 20 bp, Artificial Sequence
  chemically synthesized
gctactcattcatgatgaag

SEQ ID NO: 292519 - DNA, 20 bp, Artificial Sequence
  chemically synthesized
ctcattcatgatgaaggggc

SEQ ID NO: 292520 - DNA, 20 bp, Artificial Sequence
  chemically synthesized
tcattcatgatgaaggggct

SEQ ID NO: 292521 - DNA, 20 bp, Artificial Sequence
  chemically synthesized
ctgtaccacttgtagtagcc

SEQ ID NO: 292522 - DNA, 20 bp, Artificial Sequence
  chemically synthesized
tgaaggggctgggctactac

SEQ ID NO: 292523 - DNA, 20 bp, Artificial Sequence
  chemically synthesized
aggggctgggctactacaag

SEQ ID NO: 292524 - DNA, 20 bp, Artificial Sequence
  chemically synthesized
ggagactgtaccacttgtag

SEQ ID NO: 292525 - DNA, 20 bp, Artificial Sequence
  chemically synthesized
catggagactgtaccacttg

SEQ ID NO: 292526 - DNA, 20 bp, Artificial Sequence
  chemically synthesized
ctgggctactacaagtggta

SEQ ID NO: 292527 - DNA, 20 bp, Artificial Sequence
  chemically synthesized
ctgtatacaaatgtggcatg

SEQ ID NO: 292528 - DNA, 20 bp, Artificial Sequence
  chemically synthesized
gtctgtatacaaatgtggca

SEQ ID NO: 292529 - DNA, 20 bp, Artificial Sequence
  chemically synthesized
aaatagtctgtatacaaatg

SEQ ID NO: 292530 - DNA, 20 bp, Artificial Sequence
  chemically synthesized
ctccatgccacatttgtata

SEQ ID NO: 292531 - DNA, 20 bp, Artificial Sequence
  chemically synthesized
atggcaagacatattgcaaa

SEQ ID NO: 292532 - DNA, 20 bp, Artificial Sequence
  chemically synthesized
taatcatatattttaatggc

SEQ ID NO: 292533 - DNA, 20 bp, Artificial Sequence
  chemically synthesized
cttctaatcatatattttaa

SEQ ID NO: 292534 - DNA, 20 bp, Artificial Sequence
  chemically synthesized
ttgccattaaaatatatgat

SEQ ID NO: 292535 - DNA, 20 bp, Artificial Sequence
  chemically synthesized
ccattaaaatatatgattag

SEQ ID NO: 292536 - DNA, 20 bp, Artificial Sequence
  chemically synthesized
gaaaaactttcagtagcagc

SEQ ID NO: 292537 - DNA, 20 bp, Artificial Sequence
  chemically synthesized
agaagacttgctgctactga

SEQ ID NO: 292538 - DNA, 20 bp, Artificial Sequence
  chemically synthesized
actggaaaaactttcagtag

SEQ ID NO: 292539 - DNA, 20 bp, Artificial Sequence
  chemically synthesized
atcactggaaaaactttcag

SEQ ID NO: 292540 - DNA, 20 bp, Artificial Sequence
  chemically synthesized
atgatcactggaaaaacttt

SEQ ID NO: 292541 - DNA, 20 bp, Artificial Sequence
  chemically synthesized
gctgctactgaaagtttttc

SEQ ID NO: 292542 - DNA, 20 bp, Artificial Sequence
  chemically synthesized
gctaaaactctcatgatcac

SEQ ID NO: 292543 - DNA, 20 bp, Artificial Sequence
  chemically synthesized
aaagtttttccagtgatcat

SEQ ID NO: 292544 - DNA, 20 bp, Artificial Sequence
  chemically synthesized
agtttttccagtgatcatga

SEQ ID NO: 292545 - DNA, 20 bp, Artificial Sequence
  chemically synthesized
tccagtgatcatgagagttt

SEQ ID NO: 292546 - DNA, 20 bp, Artificial Sequence
  chemically synthesized
atcatgagagttttagcttt

SEQ ID NO: 292547 - DNA, 20 bp, Artificial Sequence
  chemically synthesized
gagagttttagctttgagat

SEQ ID NO: 292548 - DNA, 20 bp, Artificial Sequence
  chemically synthesized
ggtcagtctggctcatctca

SEQ ID NO: 292549 - DNA, 20 bp, Artificial Sequence
  chemically synthesized
gttttagctttgagatgagc

SEQ ID NO: 292550 - DNA, 20 bp, Artificial Sequence
  chemically synthesized
ggtagggattatggtcagtc

SEQ ID NO: 292551 - DNA, 20 bp, Artificial Sequence
  chemically synthesized
gtgagggtagggattatggt

SEQ ID NO: 292552 - DNA, 20 bp, Artificial Sequence
  chemically synthesized
atgggtgagggtagggatta

SEQ ID NO: 292553 - DNA, 20 bp, Artificial Sequence
  chemically synthesized
ttgtcagatgggtgagggta

SEQ ID NO: 292554 - DNA, 20 bp, Artificial Sequence
  chemically synthesized
tttgtcagatgggtgagggt

SEQ ID NO: 292555 - DNA, 20 bp, Artificial Sequence
  chemically synthesized
ttttgtcagatgggtgaggg

SEQ ID NO: 292556 - DNA, 20 bp, Artificial Sequence
  chemically synthesized
agattttgtcagatgggtga

SEQ ID NO: 292557 - DNA, 20 bp, Artificial Sequence
  chemically synthesized
cagattttgtcagatgggtg

SEQ ID NO: 292558 - DNA, 20 bp, Artificial Sequence
  chemically synthesized
ccagattttgtcagatgggt

SEQ ID NO: 292559 - DNA, 20 bp, Artificial Sequence
  chemically synthesized
gcaaccagattttgtcagat

SEQ ID NO: 292560 - DNA, 20 bp, Artificial Sequence
  chemically synthesized
ggcaaccagattttgtcaga

SEQ ID NO: 292561 - DNA, 20 bp, Artificial Sequence
  chemically synthesized
ggtgggcaaccagattttgt

SEQ ID NO: 292562 - DNA, 20 bp, Artificial Sequence
  chemically synthesized
ctcacccatctgacaaaatc

SEQ ID NO: 292563 - DNA, 20 bp, Artificial Sequence
  chemically synthesized
tgttatttgaggtgggcaac

SEQ ID NO: 292564 - DNA, 20 bp, Artificial Sequence
  chemically synthesized
tgaattatgttatttgaggt

SEQ ID NO: 292565 - DNA, 20 bp, Artificial Sequence
  chemically synthesized
atgaattatgttatttgagg

SEQ ID NO: 292566 - DNA, 20 bp, Artificial Sequence
  chemically synthesized
cacatgaattatgttatttg

SEQ ID NO: 292567 - DNA, 20 bp, Artificial Sequence
  chemically synthesized
tcacatgaattatgttattt

SEQ ID NO: 292568 - DNA, 20 bp, Artificial Sequence
  chemically synthesized
ttcatgtgaaattatctaat

SEQ ID NO: 292569 - DNA, 20 bp, Artificial Sequence
  chemically synthesized
tattttggttcatagctcat

SEQ ID NO: 292570 - DNA, 20 bp, Artificial Sequence
  chemically synthesized
ttttcttgtattttggttca

SEQ ID NO: 292571 - DNA, 20 bp, Artificial Sequence
  chemically synthesized
tgagctatgaaccaaaatac

SEQ ID NO: 292572 - DNA, 20 bp, Artificial Sequence
  chemically synthesized
tatctttttttcttgtattt

SEQ ID NO: 292573 - DNA, 20 bp, Artificial Sequence
  chemically synthesized
gaaccaaaatacaagaaaaa

SEQ ID NO: 292574 - DNA, 20 bp, Artificial Sequence
  chemically synthesized
caaaatacaagaaaaaaaga

SEQ ID NO: 292575 - DNA, 20 bp, Artificial Sequence
  chemically synthesized
aagaaaaaaagatagttact

SEQ ID NO: 292576 - DNA, 20 bp, Artificial Sequence
  chemically synthesized
tcttatccataacattaacc

SEQ ID NO: 292577 - DNA, 20 bp, Artificial Sequence
  chemically synthesized
tagttacttggttaatgtta

SEQ ID NO: 292578 - DNA, 20 bp, Artificial Sequence
  chemically synthesized
acttggttaatgttatggat

SEQ ID NO: 292579 - DNA, 20 bp, Artificial Sequence
  chemically synthesized
tggttaatgttatggataag

SEQ ID NO: 292580 - DNA, 20 bp, Artificial Sequence
  chemically synthesized
gttaatgttatggataagaa

SEQ ID NO: 292581 - DNA, 20 bp, Artificial Sequence
  chemically synthesized
tggataagaagagctctcgt

SEQ ID NO: 292582 - DNA, 20 bp, Artificial Sequence
  chemically synthesized
cagaatgataacactgacga

SEQ ID NO: 292583 - DNA, 20 bp, Artificial Sequence
  chemically synthesized
cacagaatgataacactgac

SEQ ID NO: 292584 - DNA, 20 bp, Artificial Sequence
  chemically synthesized
actgttgtaattaaatggca

SEQ ID NO: 292585 - DNA, 20 bp, Artificial Sequence
  chemically synthesized
tgctaactgttgtaattaaa

SEQ ID NO: 292586 - DNA, 20 bp, Artificial Sequence
  chemically synthesized
tctgtgccatttaattacaa

SEQ ID NO: 292587 - DNA, 20 bp, Artificial Sequence
  chemically synthesized
tgccatttaattacaacagt

SEQ ID NO: 292588 - DNA, 20 bp, Artificial Sequence
  chemically synthesized
acagttagcatacttattat

SEQ ID NO: 292589 - DNA, 20 bp, Artificial Sequence
  chemically synthesized
cagttagcatacttattatc

SEQ ID NO: 292590 - DNA, 20 bp, Artificial Sequence
  chemically synthesized
ttaaggtgatacctgataat

SEQ ID NO: 292591 - DNA, 20 bp, Artificial Sequence
  chemically synthesized
gtgctagattatagtgttta

SEQ ID NO: 292592 - DNA, 20 bp, Artificial Sequence
  chemically synthesized
agtgctagattatagtgttt

SEQ ID NO: 292593 - DNA, 20 bp, Artificial Sequence
  chemically synthesized
tcaccttaaacactataatc

SEQ ID NO: 292594 - DNA, 20 bp, Artificial Sequence
  chemically synthesized
attccctgagtgctagatta

SEQ ID NO: 292595 - DNA, 20 bp, Artificial Sequence
  chemically synthesized
aaacactataatctagcact

SEQ ID NO: 292596 - DNA, 20 bp, Artificial Sequence
  chemically synthesized
aacactataatctagcactc

SEQ ID NO: 292597 - DNA, 20 bp, Artificial Sequence
  chemically synthesized
acactataatctagcactca

SEQ ID NO: 292598 - DNA, 20 bp, Artificial Sequence
  chemically synthesized
aactatcattccctgagtgc

SEQ ID NO: 292599 - DNA, 20 bp, Artificial Sequence
  chemically synthesized
tctcaaaactatcattccct

SEQ ID NO: 292600 - DNA, 20 bp, Artificial Sequence
  chemically synthesized
atctagcactcagggaatga

SEQ ID NO: 292601 - DNA, 20 bp, Artificial Sequence
  chemically synthesized
actcagggaatgatagtttt

SEQ ID NO: 292602 - DNA, 20 bp, Artificial Sequence
  chemically synthesized
gatagttttgagatgttctt

SEQ ID NO: 292603 - DNA, 20 bp, Artificial Sequence
  chemically synthesized
attattagtatattagacta

SEQ ID NO: 292604 - DNA, 20 bp, Artificial Sequence
  chemically synthesized
agtagtaattattagtatat

SEQ ID NO: 292605 - DNA, 20 bp, Artificial Sequence
  chemically synthesized
taaataaaagtagtaattat

SEQ ID NO: 292606 - DNA, 20 bp, Artificial Sequence
  chemically synthesized
aggacatgtttaaataaaag

SEQ ID NO: 292607 - DNA, 20 bp, Artificial Sequence
  chemically synthesized
tcaaggacatgtttaaataa

SEQ ID NO: 292608 - DNA, 20 bp, Artificial Sequence
  chemically synthesized
gtctaaggacagtcacatca

SEQ ID NO: 292609 - DNA, 20 bp, Artificial Sequence
  chemically synthesized
agtctaaggacagtcacatc

SEQ ID NO: 292610 - DNA, 20 bp, Artificial Sequence
  chemically synthesized
gtccttgatgtgactgtcct

SEQ ID NO: 292611 - DNA, 20 bp, Artificial Sequence
  chemically synthesized
gttaattaagagtctaagga

SEQ ID NO: 292612 - DNA, 20 bp, Artificial Sequence
  chemically synthesized
gtgtgttaattaagagtcta

SEQ ID NO: 292613 - DNA, 20 bp, Artificial Sequence
  chemically synthesized
tgtgtgttaattaagagtct

SEQ ID NO: 292614 - DNA, 20 bp, Artificial Sequence
  chemically synthesized
gttttctgtgtgttaattaa

SEQ ID NO: 292615 - DNA, 20 bp, Artificial Sequence
  chemically synthesized
tagttttctgtgtgttaatt

SEQ ID NO: 292616 - DNA, 20 bp, Artificial Sequence
  chemically synthesized
ttagactcttaattaacaca

SEQ ID NO: 292617 - DNA, 20 bp, Artificial Sequence
  chemically synthesized
aacacacagaaaactacaaa

SEQ ID NO: 292618 - DNA, 20 bp, Artificial Sequence
  chemically synthesized
tcattttcaatttctatttg

SEQ ID NO: 292619 - DNA, 20 bp, Artificial Sequence
  chemically synthesized
ctataattatgtaatagggt

SEQ ID NO: 292620 - DNA, 20 bp, Artificial Sequence
  chemically synthesized
gatactataattatgtaata

SEQ ID NO: 292621 - DNA, 20 bp, Artificial Sequence
  chemically synthesized
agatactataattatgtaat

SEQ ID NO: 292622 - DNA, 20 bp, Artificial Sequence
  chemically synthesized
gagatactataattatgtaa

SEQ ID NO: 292623 - DNA, 20 bp, Artificial Sequence
  chemically synthesized
ctaaccctattacataatta

SEQ ID NO: 292624 - DNA, 20 bp, Artificial Sequence
  chemically synthesized
cataattatagtatctcctc

SEQ ID NO: 292625 - DNA, 20 bp, Artificial Sequence
  chemically synthesized
tttcaccataatttctagag

SEQ ID NO: 292626 - DNA, 20 bp, Artificial Sequence
  chemically synthesized
cctttcaccataatttctag

SEQ ID NO: 292627 - DNA, 20 bp, Artificial Sequence
  chemically synthesized
tcctttcaccataatttcta

SEQ ID NO: 292628 - DNA, 20 bp, Artificial Sequence
  chemically synthesized
agtatctcctctagaaatta

SEQ ID NO: 292629 - DNA, 20 bp, Artificial Sequence
  chemically synthesized
gatcctttcaccataatttc

SEQ ID NO: 292630 - DNA, 20 bp, Artificial Sequence
  chemically synthesized
tcctctagaaattatggtga

SEQ ID NO: 292631 - DNA, 20 bp, Artificial Sequence
  chemically synthesized
cctctagaaattatggtgaa

SEQ ID NO: 292632 - DNA, 20 bp, Artificial Sequence
  chemically synthesized
aaattatggtgaaaggatct

SEQ ID NO: 292633 - DNA, 20 bp, Artificial Sequence
  chemically synthesized
attatggtgaaaggatctta

SEQ ID NO: 292634 - DNA, 20 bp, Artificial Sequence
  chemically synthesized
gttctcgttctttagtctct

SEQ ID NO: 292635 - DNA, 20 bp, Artificial Sequence
  chemically synthesized
tgaaaggatcttagagacta

SEQ ID NO: 292636 - DNA, 20 bp, Artificial Sequence
  chemically synthesized
gatcttagagactaaagaac

SEQ ID NO: 292637 - DNA, 20 bp, Artificial Sequence
  chemically synthesized
tagctcaggttctcgttctt

SEQ ID NO: 292638 - DNA, 20 bp, Artificial Sequence
  chemically synthesized
agactaaagaacgagaacct

SEQ ID NO: 292639 - DNA, 20 bp, Artificial Sequence
  chemically synthesized
aacatatgtaggcgtagctc

SEQ ID NO: 292640 - DNA, 20 bp, Artificial Sequence
  chemically synthesized
aaacatatgtaggcgtagct

SEQ ID NO: 292641 - DNA, 20 bp, Artificial Sequence
  chemically synthesized
tttgaaaacatatgtaggcg

SEQ ID NO: 292642 - DNA, 20 bp, Artificial Sequence
  chemically synthesized
atttatttgaaaacatatgt

SEQ ID NO: 292643 - DNA, 20 bp, Artificial Sequence
  chemically synthesized
catttatttgaaaacatatg

SEQ ID NO: 292644 - DNA, 20 bp, Artificial Sequence
  chemically synthesized
ttcaaataaatgttttgata

SEQ ID NO: 292645 - DNA, 20 bp, Artificial Sequence
  chemically synthesized
gttttgatatggtcatcttt

SEQ ID NO: 292646 - DNA, 20 bp, Artificial Sequence
  chemically synthesized
attaatactgaaattaccaa

SEQ ID NO: 292647 - DNA, 20 bp, Artificial Sequence
  chemically synthesized
tggtcatcttttggtaattt

SEQ ID NO: 292648 - DNA, 20 bp, Artificial Sequence
  chemically synthesized
tggtaatttcagtattaata

SEQ ID NO: 292649 - DNA, 20 bp, Artificial Sequence
  chemically synthesized
tcagtattaatatggaaaac

SEQ ID NO: 292650 - DNA, 20 bp, Artificial Sequence
  chemically synthesized
aaagcctagtttagataaac

SEQ ID NO: 292651 - DNA, 20 bp, Artificial Sequence
  chemically synthesized
gaaaaccagtttatctaaac

SEQ ID NO: 292652 - DNA, 20 bp, Artificial Sequence
  chemically synthesized
aaaaccagtttatctaaact

SEQ ID NO: 292653 - DNA, 20 bp, Artificial Sequence
  chemically synthesized
taacacaaaaaagcctagtt

SEQ ID NO: 292654 - DNA, 20 bp, Artificial Sequence
  chemically synthesized
aggcataacacaaaaaagcc

SEQ ID NO: 292655 - DNA, 20 bp, Artificial Sequence
  chemically synthesized
caatcaggcataacacaaaa

SEQ ID NO: 292656 - DNA, 20 bp, Artificial Sequence
  chemically synthesized
ttgtgttatgcctgattgat

SEQ ID NO: 292657 - DNA, 20 bp, Artificial Sequence
  chemically synthesized
tacatacagtctcatcaatc

SEQ ID NO: 292658 - DNA, 20 bp, Artificial Sequence
  chemically synthesized
gtacatacagtctcatcaat

SEQ ID NO: 292659 - DNA, 20 bp, Artificial Sequence
  chemically synthesized
tgttctcgcatgagtacata

SEQ ID NO: 292660 - DNA, 20 bp, Artificial Sequence
  chemically synthesized
gagactgtatgtactcatgc

SEQ ID NO: 292661 - DNA, 20 bp, Artificial Sequence
  chemically synthesized
gtaaaacagtgttctcgcat

SEQ ID NO: 292662 - DNA, 20 bp, Artificial Sequence
  chemically synthesized
acgtaatcctttttgtaaaa

SEQ ID NO: 292663 - DNA, 20 bp, Artificial Sequence
  chemically synthesized
cgagaacactgttttacaaa

SEQ ID NO: 292664 - DNA, 20 bp, Artificial Sequence
  chemically synthesized
gagaacactgttttacaaaa

SEQ ID NO: 292665 - DNA, 20 bp, Artificial Sequence
  chemically synthesized
tgtttttatctatttaggat

SEQ ID NO: 292666 - DNA, 20 bp, Artificial Sequence
  chemically synthesized
ggattacgtctaatcctaaa

SEQ ID NO: 292667 - DNA, 20 bp, Artificial Sequence
  chemically synthesized
atgtctgtttttatctattt

SEQ ID NO: 292668 - DNA, 20 bp, Artificial Sequence
  chemically synthesized
tatgtctgtttttatctatt

SEQ ID NO: 292669 - DNA, 20 bp, Artificial Sequence
  chemically synthesized
taatcctaaatagataaaaa

SEQ ID NO: 292670 - DNA, 20 bp, Artificial Sequence
  chemically synthesized
gataaaaacagacatatgtt

SEQ ID NO: 292671 - DNA, 20 bp, Artificial Sequence
  chemically synthesized
ataaaaacagacatatgttt

SEQ ID NO: 292672 - DNA, 20 bp, Artificial Sequence
  chemically synthesized
taatcatatgtatattattt

SEQ ID NO: 292673 - DNA, 20 bp, Artificial Sequence
  chemically synthesized
tatgtatattattttagccc

SEQ ID NO: 292674 - DNA, 20 bp, Artificial Sequence
  chemically synthesized
atgtatattattttagccct

SEQ ID NO: 292675 - DNA, 20 bp, Artificial Sequence
  chemically synthesized
tggagttttaggacaaccta

SEQ ID NO: 292676 - DNA, 20 bp, Artificial Sequence
  chemically synthesized
gtggagttttaggacaacct

SEQ ID NO: 292677 - DNA, 20 bp, Artificial Sequence
  chemically synthesized
tgtggagttttaggacaacc

SEQ ID NO: 292678 - DNA, 20 bp, Artificial Sequence
  chemically synthesized
tattgagattgtggagtttt

SEQ ID NO: 292679 - DNA, 20 bp, Artificial Sequence
  chemically synthesized
ttattgagattgtggagttt

SEQ ID NO: 292680 - DNA, 20 bp, Artificial Sequence
  chemically synthesized
agtgtattattgagattgtg

SEQ ID NO: 292681 - DNA, 20 bp, Artificial Sequence
  chemically synthesized
tcagtgtattattgagattg

SEQ ID NO: 292682 - DNA, 20 bp, Artificial Sequence
  chemically synthesized
aggcctttcagtgtattatt

SEQ ID NO: 292683 - DNA, 20 bp, Artificial Sequence
  chemically synthesized
caatctcaataatacactga

SEQ ID NO: 292684 - DNA, 20 bp, Artificial Sequence
  chemically synthesized
aatctcaataatacactgaa

SEQ ID NO: 292685 - DNA, 20 bp, Artificial Sequence
  chemically synthesized
ctttcatgaccaaggccttt

SEQ ID NO: 292686 - DNA, 20 bp, Artificial Sequence
  chemically synthesized
aataatacactgaaaggcct

SEQ ID NO: 292687 - DNA, 20 bp, Artificial Sequence
  chemically synthesized
actgatgcctttcatgacca

SEQ ID NO: 292688 - DNA, 20 bp, Artificial Sequence
  chemically synthesized
aactgatgcctttcatgacc

SEQ ID NO: 292689 - DNA, 20 bp, Artificial Sequence
  chemically synthesized
ctgaaaggccttggtcatga

SEQ ID NO: 292690 - DNA, 20 bp, Artificial Sequence
  chemically synthesized
tgaaaggccttggtcatgaa

SEQ ID NO: 292691 - DNA, 20 bp, Artificial Sequence
  chemically synthesized
gccttggtcatgaaaggcat

SEQ ID NO: 292692 - DNA, 20 bp, Artificial Sequence
  chemically synthesized
tcatgaaaggcatcagttta

SEQ ID NO: 292693 - DNA, 20 bp, Artificial Sequence
  chemically synthesized
ttctaagattttaatttgaa

SEQ ID NO: 292694 - DNA, 20 bp, Artificial Sequence
  chemically synthesized
gactgttcaaattaaaatct

SEQ ID NO: 292695 - DNA, 20 bp, Artificial Sequence
  chemically synthesized
ctaactaataatggttttct

SEQ ID NO: 292696 - DNA, 20 bp, Artificial Sequence
  chemically synthesized
aaatcttagaaaaccattat

SEQ ID NO: 292697 - DNA, 20 bp, Artificial Sequence
  chemically synthesized
ataatattgctaactaataa

SEQ ID NO: 292698 - DNA, 20 bp, Artificial Sequence
  chemically synthesized
cttagaaaaccattattagt

SEQ ID NO: 292699 - DNA, 20 bp, Artificial Sequence
  chemically synthesized
attagttagcaatattatta

SEQ ID NO: 292700 - DNA, 20 bp, Artificial Sequence
  chemically synthesized
tagcaatattattaaagcat

SEQ ID NO: 292701 - DNA, 20 bp, Artificial Sequence
  chemically synthesized
aatattattaaagcattaga

SEQ ID NO: 292702 - DNA, 20 bp, Artificial Sequence
  chemically synthesized
atttagccattaaatatagt

SEQ ID NO: 292703 - DNA, 20 bp, Artificial Sequence
  chemically synthesized
agattacttactatatttaa

SEQ ID NO: 292704 - DNA, 20 bp, Artificial Sequence
  chemically synthesized
aaaaatttagccattaaata

SEQ ID NO: 292705 - DNA, 20 bp, Artificial Sequence
  chemically synthesized
tttagaaatttagaaaaatt

SEQ ID NO: 292706 - DNA, 20 bp, Artificial Sequence
  chemically synthesized
ttataaataatttagaaatt

SEQ ID NO: 292707 - DNA, 20 bp, Artificial Sequence
  chemically synthesized
acaaaatgttataaataatt

SEQ ID NO: 292708 - DNA, 20 bp, Artificial Sequence
  chemically synthesized
taacattttgtatttaaatt

SEQ ID NO: 292709 - DNA, 20 bp, Artificial Sequence
  chemically synthesized
aaatgtaaaaataaacctta

SEQ ID NO: 292710 - DNA, 20 bp, Artificial Sequence
  chemically synthesized
aaagatgtgatataacttta

SEQ ID NO: 292711 - DNA, 20 bp, Artificial Sequence
  chemically synthesized
gaaagatgtgatataacttt

SEQ ID NO: 292712 - DNA, 20 bp, Artificial Sequence
  chemically synthesized
tatatcacatctttcttaaa

SEQ ID NO: 292713 - DNA, 20 bp, Artificial Sequence
  chemically synthesized
ctttattttactttttaaga

SEQ ID NO: 292714 - DNA, 20 bp, Artificial Sequence
  chemically synthesized
aattctttattttacttttt

SEQ ID NO: 292715 - DNA, 20 bp, Artificial Sequence
  chemically synthesized
ctttcttaaaaagtaaaata

SEQ ID NO: 292716 - DNA, 20 bp, Artificial Sequence
  chemically synthesized
aaaaagtaaaataaagaatt

SEQ ID NO: 292717 - DNA, 20 bp, Artificial Sequence
  chemically synthesized
agctgtgcatattgaaaagg

SEQ ID NO: 292718 - DNA, 20 bp, Artificial Sequence
  chemically synthesized
gtagctgtgcatattgaaaa

SEQ ID NO: 292719 - DNA, 20 bp, Artificial Sequence
  chemically synthesized
tgtagctgtgcatattgaaa

SEQ ID NO: 292720 - DNA, 20 bp, Artificial Sequence
  chemically synthesized
atgtagctgtgcatattgaa

SEQ ID NO: 292721 - DNA, 20 bp, Artificial Sequence
  chemically synthesized
aactcccttttcaatatgca

SEQ ID NO: 292722 - DNA, 20 bp, Artificial Sequence
  chemically synthesized
gatgtatttatatattcatg

SEQ ID NO: 292723 - DNA, 20 bp, Artificial Sequence
  chemically synthesized
tgaatatataaatacatcac

SEQ ID NO: 292724 - DNA, 20 bp, Artificial Sequence
  chemically synthesized
taaatacatcactagatacc

SEQ ID NO: 292725 - DNA, 20 bp, Artificial Sequence
  chemically synthesized
gagaggctagaccaggtatc

SEQ ID NO: 292726 - DNA, 20 bp, Artificial Sequence
  chemically synthesized
acatcactagatacctggtc

SEQ ID NO: 292727 - DNA, 20 bp, Artificial Sequence
  chemically synthesized
ggcaagtgagaggctagacc

SEQ ID NO: 292728 - DNA, 20 bp, Artificial Sequence
  chemically synthesized
gggcaagtgagaggctagac

SEQ ID NO: 292729 - DNA, 20 bp, Artificial Sequence
  chemically synthesized
aatgagggcaagtgagaggc

SEQ ID NO: 292730 - DNA, 20 bp, Artificial Sequence
  chemically synthesized
acttaatgagggcaagtgag

SEQ ID NO: 292731 - DNA, 20 bp, Artificial Sequence
  chemically synthesized
aacttaatgagggcaagtga

SEQ ID NO: 292732 - DNA, 20 bp, Artificial Sequence
  chemically synthesized
ttaacttaatgagggcaagt

SEQ ID NO: 292733 - DNA, 20 bp, Artificial Sequence
  chemically synthesized
actgttaacttaatgagggc

SEQ ID NO: 292734 - DNA, 20 bp, Artificial Sequence
  chemically synthesized
gcctctcacttgccctcatt

SEQ ID NO: 292735 - DNA, 20 bp, Artificial Sequence
  chemically synthesized
ggaaactgttaacttaatga

SEQ ID NO: 292736 - DNA, 20 bp, Artificial Sequence
  chemically synthesized
aggaaactgttaacttaatg

SEQ ID NO: 292737 - DNA, 20 bp, Artificial Sequence
  chemically synthesized
caggaaactgttaacttaat

SEQ ID NO: 292738 - DNA, 20 bp, Artificial Sequence
  chemically synthesized
acttgccctcattaagttaa

SEQ ID NO: 292739 - DNA, 20 bp, Artificial Sequence
  chemically synthesized
cattaagttaacagtttcct

SEQ ID NO: 292740 - DNA, 20 bp, Artificial Sequence
  chemically synthesized
agttaacagtttcctgagac

SEQ ID NO: 292741 - DNA, 20 bp, Artificial Sequence
  chemically synthesized
gttaacagtttcctgagacc

SEQ ID NO: 292742 - DNA, 20 bp, Artificial Sequence
  chemically synthesized
ttaacagtttcctgagacca

SEQ ID NO: 292743 - DNA, 20 bp, Artificial Sequence
  chemically synthesized
tggatcataaccctggtctc

SEQ ID NO: 292744 - DNA, 20 bp, Artificial Sequence
  chemically synthesized
ttggatcataaccctggtct

SEQ ID NO: 292745 - DNA, 20 bp, Artificial Sequence
  chemically synthesized
taagctttggatcataaccc

SEQ ID NO: 292746 - DNA, 20 bp, Artificial Sequence
  chemically synthesized
gagaccagggttatgatcca

SEQ ID NO: 292747 - DNA, 20 bp, Artificial Sequence
  chemically synthesized
taccgtcaatatgtaagctt

SEQ ID NO: 292748 - DNA, 20 bp, Artificial Sequence
  chemically synthesized
gcagcttaccgtcaatatgt

SEQ ID NO: 292749 - DNA, 20 bp, Artificial Sequence
  chemically synthesized
atccaaagcttacatattga

SEQ ID NO: 292750 - DNA, 20 bp, Artificial Sequence
  chemically synthesized
aaagcttacatattgacggt

SEQ ID NO: 292751 - DNA, 20 bp, Artificial Sequence
  chemically synthesized
ggatagctgtaattttcatg

SEQ ID NO: 292752 - DNA, 20 bp, Artificial Sequence
  chemically synthesized
ggtaagctgcatgaaaatta

SEQ ID NO: 292753 - DNA, 20 bp, Artificial Sequence
  chemically synthesized
ttactagagacatttttgga

SEQ ID NO: 292754 - DNA, 20 bp, Artificial Sequence
  chemically synthesized
ctttttactagagacatttt

SEQ ID NO: 292755 - DNA, 20 bp, Artificial Sequence
  chemically synthesized
cagctatccaaaaatgtctc

SEQ ID NO: 292756 - DNA, 20 bp, Artificial Sequence
  chemically synthesized
ccaaaaatgtctctagtaaa

SEQ ID NO: 292757 - DNA, 20 bp, Artificial Sequence
  chemically synthesized
caaagtacctctttttacta

SEQ ID NO: 292758 - DNA, 20 bp, Artificial Sequence
  chemically synthesized
aaaaatgtctctagtaaaaa

SEQ ID NO: 292759 - DNA, 20 bp, Artificial Sequence
  chemically synthesized
tgcaaagtacctctttttac

SEQ ID NO: 292760 - DNA, 20 bp, Artificial Sequence
  chemically synthesized
aaaatgtctctagtaaaaag

SEQ ID NO: 292761 - DNA, 20 bp, Artificial Sequence
  chemically synthesized
acagaatattggatggtgca

SEQ ID NO: 292762 - DNA, 20 bp, Artificial Sequence
  chemically synthesized
aaatgtgacagaatattgga

SEQ ID NO: 292763 - DNA, 20 bp, Artificial Sequence
  chemically synthesized
ggataaatgtgacagaatat

SEQ ID NO: 292764 - DNA, 20 bp, Artificial Sequence
  chemically synthesized
aattggttggataaatgtga

SEQ ID NO: 292765 - DNA, 20 bp, Artificial Sequence
  chemically synthesized
ttatgtcagcattaattggt

SEQ ID NO: 292766 - DNA, 20 bp, Artificial Sequence
  chemically synthesized
gttcttatgtcagcattaat

SEQ ID NO: 292767 - DNA, 20 bp, Artificial Sequence
  chemically synthesized
caaccaattaatgctgacat

SEQ ID NO: 292768 - DNA, 20 bp, Artificial Sequence
  chemically synthesized
ttaatttactgttcttatgt

SEQ ID NO: 292769 - DNA, 20 bp, Artificial Sequence
  chemically synthesized
aattaatgctgacataagaa

SEQ ID NO: 292770 - DNA, 20 bp, Artificial Sequence
  chemically synthesized
cagtaaattaattttaatgt

SEQ ID NO: 292771 - DNA, 20 bp, Artificial Sequence
  chemically synthesized
gttagttcaaacaaaaaata

SEQ ID NO: 292772 - DNA, 20 bp, Artificial Sequence
  chemically synthesized
ttcaaacaaaaaatacagct

SEQ ID NO: 292773 - DNA, 20 bp, Artificial Sequence
  chemically synthesized
aacaaaaaatacagctaaga

SEQ ID NO: 292774 - DNA, 20 bp, Artificial Sequence
  chemically synthesized
caaaaaatacagctaagata

SEQ ID NO: 292775 - DNA, 20 bp, Artificial Sequence
  chemically synthesized
taactgatttatctctatct

SEQ ID NO: 292776 - DNA, 20 bp, Artificial Sequence
  chemically synthesized
cagctaagatagagataaat

SEQ ID NO: 292777 - DNA, 20 bp, Artificial Sequence
  chemically synthesized
ggcattttggcatgaaattt

SEQ ID NO: 292778 - DNA, 20 bp, Artificial Sequence
  chemically synthesized
aaaatttcatgccaaaatgc

SEQ ID NO: 292779 - DNA, 20 bp, Artificial Sequence
  chemically synthesized
aaatcacgtttctggcattt

SEQ ID NO: 292780 - DNA, 20 bp, Artificial Sequence
  chemically synthesized
aaaaaaaaaaatcacgtttc

SEQ ID NO: 292781 - DNA, 20 bp, Artificial Sequence
  chemically synthesized
agaaacgtgatttttttttt

SEQ ID NO: 292782 - DNA, 20 bp, Artificial Sequence
  chemically synthesized
tttagttaacactctccttt

SEQ ID NO: 292783 - DNA, 20 bp, Artificial Sequence
  chemically synthesized
aagagaagctactaaaagga

SEQ ID NO: 292784 - DNA, 20 bp, Artificial Sequence
  chemically synthesized
agttaacactctccttttag

SEQ ID NO: 292785 - DNA, 20 bp, Artificial Sequence
  chemically synthesized
aaaagagaagctactaaaag

SEQ ID NO: 292786 - DNA, 20 bp, Artificial Sequence
  chemically synthesized
taaaaagagaagctactaaa

SEQ ID NO: 292787 - DNA, 20 bp, Artificial Sequence
  chemically synthesized
ctaaaaagagaagctactaa

SEQ ID NO: 292788 - DNA, 20 bp, Artificial Sequence
  chemically synthesized
cttttagtagcttctctttt

SEQ ID NO: 292789 - DNA, 20 bp, Artificial Sequence
  chemically synthesized
cgatcatagactaaaaagag

SEQ ID NO: 292790 - DNA, 20 bp, Artificial Sequence
  chemically synthesized
tcacgatcatagactaaaaa

SEQ ID NO: 292791 - DNA, 20 bp, Artificial Sequence
  chemically synthesized
tttcacgatcatagactaaa

SEQ ID NO: 292792 - DNA, 20 bp, Artificial Sequence
  chemically synthesized
gaagtgatctttcacgatca

SEQ ID NO: 292793 - DNA, 20 bp, Artificial Sequence
  chemically synthesized
tttttagtctatgatcgtga

SEQ ID NO: 292794 - DNA, 20 bp, Artificial Sequence
  chemically synthesized
agttcttttggtcagagtag

SEQ ID NO: 292795 - DNA, 20 bp, Artificial Sequence
  chemically synthesized
tccagttcttttggtcagag

SEQ ID NO: 292796 - DNA, 20 bp, Artificial Sequence
  chemically synthesized
atcacttctactctgaccaa

SEQ ID NO: 292797 - DNA, 20 bp, Artificial Sequence
  chemically synthesized
tgttccagttcttttggtca

SEQ ID NO: 292798 - DNA, 20 bp, Artificial Sequence
  chemically synthesized
gatgttccagttcttttggt

SEQ ID NO: 292799 - DNA, 20 bp, Artificial Sequence
  chemically synthesized
tctactctgaccaaaagaac

SEQ ID NO: 292800 - DNA, 20 bp, Artificial Sequence
  chemically synthesized
tatggatgttccagttcttt

SEQ ID NO: 292801 - DNA, 20 bp, Artificial Sequence
  chemically synthesized
cgttttccttatggatgttc

SEQ ID NO: 292802 - DNA, 20 bp, Artificial Sequence
  chemically synthesized
aaaagaactggaacatccat

SEQ ID NO: 292803 - DNA, 20 bp, Artificial Sequence
  chemically synthesized
aaagaactggaacatccata

SEQ ID NO: 292804 - DNA, 20 bp, Artificial Sequence
  chemically synthesized
atacatggacgttttcctta

SEQ ID NO: 292805 - DNA, 20 bp, Artificial Sequence
  chemically synthesized
ataaggaaaacgtccatgta

SEQ ID NO: 292806 - DNA, 20 bp, Artificial Sequence
  chemically synthesized
gcctgctttaaaactataca

SEQ ID NO: 292807 - DNA, 20 bp, Artificial Sequence
  chemically synthesized
aacgtccatgtatagtttta

SEQ ID NO: 292808 - DNA, 20 bp, Artificial Sequence
  chemically synthesized
gtccatgtatagttttaaag

SEQ ID NO: 292809 - DNA, 20 bp, Artificial Sequence
  chemically synthesized
tccatgtatagttttaaagc

SEQ ID NO: 292810 - DNA, 20 bp, Artificial Sequence
  chemically synthesized
tgtatagttttaaagcaggc

SEQ ID NO: 292811 - DNA, 20 bp, Artificial Sequence
  chemically synthesized
gtatagttttaaagcaggca

SEQ ID NO: 292812 - DNA, 20 bp, Artificial Sequence
  chemically synthesized
tttaaagcaggcaaggaatt

SEQ ID NO: 292813 - DNA, 20 bp, Artificial Sequence
  chemically synthesized
ttttaaccaaagaaatgagt

SEQ ID NO: 292814 - DNA, 20 bp, Artificial Sequence
  chemically synthesized
atttggccaactcatttctt

SEQ ID NO: 292815 - DNA, 20 bp, Artificial Sequence
  chemically synthesized
gaatttttaaccaaagaaat

SEQ ID NO: 292816 - DNA, 20 bp, Artificial Sequence
  chemically synthesized
ttatttggaatttttaacca

SEQ ID NO: 292817 - DNA, 20 bp, Artificial Sequence
  chemically synthesized
gttaaaaattccaaataaat

SEQ ID NO: 292818 - DNA, 20 bp, Artificial Sequence
  chemically synthesized
gagattcttactaatttatt

SEQ ID NO: 292819 - DNA, 20 bp, Artificial Sequence
  chemically synthesized
aaaattccaaataaattagt

SEQ ID NO: 292820 - DNA, 20 bp, Artificial Sequence
  chemically synthesized
aaattagtaagaatctctta

SEQ ID NO: 292821 - DNA, 20 bp, Artificial Sequence
  chemically synthesized
taagagtttattgaccgtaa

SEQ ID NO: 292822 - DNA, 20 bp, Artificial Sequence
  chemically synthesized
attaagagtttattgaccgt

SEQ ID NO: 292823 - DNA, 20 bp, Artificial Sequence
  chemically synthesized
agcaataatttgtatattaa

SEQ ID NO: 292824 - DNA, 20 bp, Artificial Sequence
  chemically synthesized
acagcaataatttgtatatt

SEQ ID NO: 292825 - DNA, 20 bp, Artificial Sequence
  chemically synthesized
taaccatatcattaatttta

SEQ ID NO: 292826 - DNA, 20 bp, Artificial Sequence
  chemically synthesized
ttgctgtaaaattaatgata

SEQ ID NO: 292827 - DNA, 20 bp, Artificial Sequence
  chemically synthesized
ttgtatgcagaattttaaaa

SEQ ID NO: 292828 - DNA, 20 bp, Artificial Sequence
  chemically synthesized
caaatgtgaagagttgtatg

SEQ ID NO: 292829 - DNA, 20 bp, Artificial Sequence
  chemically synthesized
tgtattttatcaaatgtgaa

SEQ ID NO: 292830 - DNA, 20 bp, Artificial Sequence
  chemically synthesized
actgtattttatcaaatgtg

SEQ ID NO: 292831 - DNA, 20 bp, Artificial Sequence
  chemically synthesized
tcttcacatttgataaaata

SEQ ID NO: 292832 - DNA, 20 bp, Artificial Sequence
  chemically synthesized
taaaatacagtgaaaataaa

SEQ ID NO: 292833 - DNA, 20 bp, Artificial Sequence
  chemically synthesized
caagttttatgatcaattgg

SEQ ID NO: 292834 - DNA, 20 bp, Artificial Sequence
  chemically synthesized
atacaagttttatgatcaat

SEQ ID NO: 292835 - DNA, 20 bp, Artificial Sequence
  chemically synthesized
agtttttcagtgtcacatac

SEQ ID NO: 292836 - DNA, 20 bp, Artificial Sequence
  chemically synthesized
gtaacatatgtacagttttt

SEQ ID NO: 292837 - DNA, 20 bp, Artificial Sequence
  chemically synthesized
tatgtctagtaacatatgta

SEQ ID NO: 292838 - DNA, 20 bp, Artificial Sequence
  chemically synthesized
aaaaactgtacatatgttac

SEQ ID NO: 292839 - DNA, 20 bp, Artificial Sequence
  chemically synthesized
cgttctagaaacagtatgtc

SEQ ID NO: 292840 - DNA, 20 bp, Artificial Sequence
  chemically synthesized
gttactagacatactgtttc

SEQ ID NO: 292841 - DNA, 20 bp, Artificial Sequence
  chemically synthesized
tcagttgtacgttctagaaa

SEQ ID NO: 292842 - DNA, 20 bp, Artificial Sequence
  chemically synthesized
taaaaatcagttgtacgttc

SEQ ID NO: 292843 - DNA, 20 bp, Artificial Sequence
  chemically synthesized
tgcaaagtattgttaaaaat

SEQ ID NO: 292844 - DNA, 20 bp, Artificial Sequence
  chemically synthesized
gaacctcatttgatggtgca

SEQ ID NO: 292845 - DNA, 20 bp, Artificial Sequence
  chemically synthesized
aatactttgcaccatcaaat

SEQ ID NO: 292846 - DNA, 20 bp, Artificial Sequence
  chemically synthesized
atactttgcaccatcaaatg

SEQ ID NO: 292847 - DNA, 20 bp, Artificial Sequence
  chemically synthesized
tagaagggaacctcatttga

SEQ ID NO: 292848 - DNA, 20 bp, Artificial Sequence
  chemically synthesized
accatggttacaatgtagaa

SEQ ID NO: 292849 - DNA, 20 bp, Artificial Sequence
  chemically synthesized
taccatggttacaatgtaga

SEQ ID NO: 292850 - DNA, 20 bp, Artificial Sequence
  chemically synthesized
ttaccatggttacaatgtag

SEQ ID NO: 292851 - DNA, 20 bp, Artificial Sequence
  chemically synthesized
aatttaccatggttacaatg

SEQ ID NO: 292852 - DNA, 20 bp, Artificial Sequence
  chemically synthesized
tcccttctacattgtaacca

SEQ ID NO: 292853 - DNA, 20 bp, Artificial Sequence
  chemically synthesized
tgaaagtacaaaatttacca

SEQ ID NO: 292854 - DNA, 20 bp, Artificial Sequence
  chemically synthesized
tagggtgttaaggttgttga

SEQ ID NO: 292855 - DNA, 20 bp, Artificial Sequence
  chemically synthesized
gaagacaggatagggtgtta

SEQ ID NO: 292856 - DNA, 20 bp, Artificial Sequence
  chemically synthesized
agaagacaggatagggtgtt

SEQ ID NO: 292857 - DNA, 20 bp, Artificial Sequence
  chemically synthesized
tatgctgagaagacaggata

SEQ ID NO: 292858 - DNA, 20 bp, Artificial Sequence
  chemically synthesized
atatgctgagaagacaggat

SEQ ID NO: 292859 - DNA, 20 bp, Artificial Sequence
  chemically synthesized
catatgctgagaagacagga

SEQ ID NO: 292860 - DNA, 20 bp, Artificial Sequence
  chemically synthesized
aacaccctatcctgtcttct

SEQ ID NO: 292861 - DNA, 20 bp, Artificial Sequence
  chemically synthesized
aagacatatgctgagaagac

SEQ ID NO: 292862 - DNA, 20 bp, Artificial Sequence
  chemically synthesized
taagacatatgctgagaaga

SEQ ID NO: 292863 - DNA, 20 bp, Artificial Sequence
  chemically synthesized
aatttaagacatatgctgag

SEQ ID NO: 292864 - DNA, 20 bp, Artificial Sequence
  chemically synthesized
aggaatttaagacatatgct

SEQ ID NO: 292865 - DNA, 20 bp, Artificial Sequence
  chemically synthesized
gcaatttgttgaaggaattt

SEQ ID NO: 292866 - DNA, 20 bp, Artificial Sequence
  chemically synthesized
tcctgaaggcaatttgttga

SEQ ID NO: 292867 - DNA, 20 bp, Artificial Sequence
  chemically synthesized
gtcctgaaggcaatttgttg

SEQ ID NO: 292868 - DNA, 20 bp, Artificial Sequence
  chemically synthesized
ttccttcaacaaattgcctt

SEQ ID NO: 292869 - DNA, 20 bp, Artificial Sequence
  chemically synthesized
tccttcaacaaattgccttc

SEQ ID NO: 292870 - DNA, 20 bp, Artificial Sequence
  chemically synthesized
acaaaatctgtttgtcctga

SEQ ID NO: 292871 - DNA, 20 bp, Artificial Sequence
  chemically synthesized
aacaaaatctgtttgtcctg

SEQ ID NO: 292872 - DNA, 20 bp, Artificial Sequence
  chemically synthesized
caaattgccttcaggacaaa

SEQ ID NO: 292873 - DNA, 20 bp, Artificial Sequence
  chemically synthesized
tcaacatcacttaagtaatg

SEQ ID NO: 292874 - DNA, 20 bp, Artificial Sequence
  chemically synthesized
ttttgttttctgcattactt

SEQ ID NO: 292875 - DNA, 20 bp, Artificial Sequence
  chemically synthesized
ttgaagattcaacatcactt

SEQ ID NO: 292876 - DNA, 20 bp, Artificial Sequence
  chemically synthesized
taaatgtctatgaagcattg

SEQ ID NO: 292877 - DNA, 20 bp, Artificial Sequence
  chemically synthesized
gttgaatcttcaatgcttca

SEQ ID NO: 292878 - DNA, 20 bp, Artificial Sequence
  chemically synthesized
tccgtttctaaatgtctatg

SEQ ID NO: 292879 - DNA, 20 bp, Artificial Sequence
  chemically synthesized
ttcaatgcttcatagacatt

SEQ ID NO: 292880 - DNA, 20 bp, Artificial Sequence
  chemically synthesized
gcttcatagacatttagaaa

SEQ ID NO: 292881 - DNA, 20 bp, Artificial Sequence
  chemically synthesized
catagacatttagaaacgga

SEQ ID NO: 292882 - DNA, 20 bp, Artificial Sequence
  chemically synthesized
agaaacggacagaaatcatt

SEQ ID NO: 292883 - DNA, 20 bp, Artificial Sequence
  chemically synthesized
tttgacctgaaatggtacat

SEQ ID NO: 292884 - DNA, 20 bp, Artificial Sequence
  chemically synthesized
atatgtctgatgtaccattt

SEQ ID NO: 292885 - DNA, 20 bp, Artificial Sequence
  chemically synthesized
tatgtctgatgtaccatttc

SEQ ID NO: 292886 - DNA, 20 bp, Artificial Sequence
  chemically synthesized
acttcagttttgacctgaaa

SEQ ID NO: 292887 - DNA, 20 bp, Artificial Sequence
  chemically synthesized
accatttcaggtcaaaactg

SEQ ID NO: 292888 - DNA, 20 bp, Artificial Sequence
  chemically synthesized
tcataacttaaattttactt

SEQ ID NO: 292889 - DNA, 20 bp, Artificial Sequence
  chemically synthesized
tcaaaactgaagtaaaattt

SEQ ID NO: 292890 - DNA, 20 bp, Artificial Sequence
  chemically synthesized
tgaagtaaaatttaagttat

SEQ ID NO: 292891 - DNA, 20 bp, Artificial Sequence
  chemically synthesized
agaaattattttttccatct

SEQ ID NO: 292892 - DNA, 20 bp, Artificial Sequence
  chemically synthesized
tttagaatgaaattccaaga

SEQ ID NO: 292893 - DNA, 20 bp, Artificial Sequence
  chemically synthesized
tgcttttagaatgaaattcc

SEQ ID NO: 292894 - DNA, 20 bp, Artificial Sequence
  chemically synthesized
atcttggaatttcattctaa

SEQ ID NO: 292895 - DNA, 20 bp, Artificial Sequence
  chemically synthesized
gtaattcatcagtttgcttt

SEQ ID NO: 292896 - DNA, 20 bp, Artificial Sequence
  chemically synthesized
agaataattttgtaattcat

SEQ ID NO: 292897 - DNA, 20 bp, Artificial Sequence
  chemically synthesized
taaactactttttaaaaatt

SEQ ID NO: 292898 - DNA, 20 bp, Artificial Sequence
  chemically synthesized
aattattctaaatttttaaa

SEQ ID NO: 292899 - DNA, 20 bp, Artificial Sequence
  chemically synthesized
tattctaaatttttaaaaag

SEQ ID NO: 292900 - DNA, 20 bp, Artificial Sequence
  chemically synthesized
tttaaaaagtagtttaatct

SEQ ID NO: 292901 - DNA, 20 bp, Artificial Sequence
  chemically synthesized
ttaaaaagtagtttaatctt

SEQ ID NO: 292902 - DNA, 20 bp, Artificial Sequence
  chemically synthesized
taaaaagtagtttaatctta

SEQ ID NO: 292903 - DNA, 20 bp, Artificial Sequence
  chemically synthesized
tacttaaaataatttgccct

SEQ ID NO: 292904 - DNA, 20 bp, Artificial Sequence
  chemically synthesized
atcttagggcaaattatttt

SEQ ID NO: 292905 - DNA, 20 bp, Artificial Sequence
  chemically synthesized
ttagggcaaattattttaag

SEQ ID NO: 292906 - DNA, 20 bp, Artificial Sequence
  chemically synthesized
attattttaagtagaaaatt

SEQ ID NO: 292907 - DNA, 20 bp, Artificial Sequence
  chemically synthesized
tatctatactggtatatgca

SEQ ID NO: 292908 - DNA, 20 bp, Artificial Sequence
  chemically synthesized
tcagtttgctatgcatatac

SEQ ID NO: 292909 - DNA, 20 bp, Artificial Sequence
  chemically synthesized
ttgctatgcatataccagta

SEQ ID NO: 292910 - DNA, 20 bp, Artificial Sequence
  chemically synthesized
tattttatatgtatctatac

SEQ ID NO: 292911 - DNA, 20 bp, Artificial Sequence
  chemically synthesized
gtatagatacatataaaata

SEQ ID NO: 292912 - DNA, 20 bp, Artificial Sequence
  chemically synthesized
tacatataaaatatagttca

SEQ ID NO: 292913 - DNA, 20 bp, Artificial Sequence
  chemically synthesized
gaattttttaaaatctataa

SEQ ID NO: 292914 - DNA, 20 bp, Artificial Sequence
  chemically synthesized
tagcataagtatagctatta

SEQ ID NO: 292915 - DNA, 20 bp, Artificial Sequence
  chemically synthesized
tatgtagaatagcataagta

SEQ ID NO: 292916 - DNA, 20 bp, Artificial Sequence
  chemically synthesized
aaaaatatgtagaatagcat

SEQ ID NO: 292917 - DNA, 20 bp, Artificial Sequence
  chemically synthesized
tagtgtaaaaatatgtagaa

SEQ ID NO: 292918 - DNA, 20 bp, Artificial Sequence
  chemically synthesized
attcatagtgtaaaaatatg

SEQ ID NO: 292919 - DNA, 20 bp, Artificial Sequence
  chemically synthesized
aaatatttaacatatattca

SEQ ID NO: 292920 - DNA, 20 bp, Artificial Sequence
  chemically synthesized
tatgttaaatattttcactg

SEQ ID NO: 292921 - DNA, 20 bp, Artificial Sequence
  chemically synthesized
ttaaatattttcactgtggt

SEQ ID NO: 292922 - DNA, 20 bp, Artificial Sequence
  chemically synthesized
aatttgatgtgtgcttacca

SEQ ID NO: 292923 - DNA, 20 bp, Artificial Sequence
  chemically synthesized
atatacgcacatatttttat

SEQ ID NO: 292924 - DNA, 20 bp, Artificial Sequence
  chemically synthesized
tacgcacatatttttattag

SEQ ID NO: 292925 - DNA, 20 bp, Artificial Sequence
  chemically synthesized
tattagtggcataataatat

SEQ ID NO: 292926 - DNA, 20 bp, Artificial Sequence
  chemically synthesized
tagtggcataataatatgag

SEQ ID NO: 292927 - DNA, 20 bp, Artificial Sequence
  chemically synthesized
ataatatgagtggtttatac

SEQ ID NO: 292928 - DNA, 20 bp, Artificial Sequence
  chemically synthesized
aatatgagtggtttatacaa

SEQ ID NO: 292929 - DNA, 20 bp, Artificial Sequence
  chemically synthesized
atgagtggtttatacaagag

SEQ ID NO: 292930 - DNA, 20 bp, Artificial Sequence
  chemically synthesized
tttcctcagaagttaagata

SEQ ID NO: 292931 - DNA, 20 bp, Artificial Sequence
  chemically synthesized
tcatctttatcttaacttct

SEQ ID NO: 292932 - DNA, 20 bp, Artificial Sequence
  chemically synthesized
gtatagtttcctcagaagtt

SEQ ID NO: 292933 - DNA, 20 bp, Artificial Sequence
  chemically synthesized
catctttatcttaacttctg

SEQ ID NO: 292934 - DNA, 20 bp, Artificial Sequence
  chemically synthesized
accacgtatagtttcctcag

SEQ ID NO: 292935 - DNA, 20 bp, Artificial Sequence
  chemically synthesized
ttaaccacgtatagtttcct

SEQ ID NO: 292936 - DNA, 20 bp, Artificial Sequence
  chemically synthesized
acttctgaggaaactatacg

SEQ ID NO: 292937 - DNA, 20 bp, Artificial Sequence
  chemically synthesized
ctgttcctcttaaccacgta

SEQ ID NO: 292938 - DNA, 20 bp, Artificial Sequence
  chemically synthesized
tgaggaaactatacgtggtt

SEQ ID NO: 292939 - DNA, 20 bp, Artificial Sequence
  chemically synthesized
aggaaactatacgtggttaa

SEQ ID NO: 292940 - DNA, 20 bp, Artificial Sequence
  chemically synthesized
ggaaactatacgtggttaag

SEQ ID NO: 292941 - DNA, 20 bp, Artificial Sequence
  chemically synthesized
ctatacgtggttaagaggaa

SEQ ID NO: 292942 - DNA, 20 bp, Artificial Sequence
  chemically synthesized
agaggaacagccatttacat

SEQ ID NO: 292943 - DNA, 20 bp, Artificial Sequence
  chemically synthesized
catttaggacctcatgtaaa

SEQ ID NO: 292944 - DNA, 20 bp, Artificial Sequence
  chemically synthesized
gaggaacagccatttacatg

SEQ ID NO: 292945 - DNA, 20 bp, Artificial Sequence
  chemically synthesized
tttacatgaggtcctaaatg

SEQ ID NO: 292946 - DNA, 20 bp, Artificial Sequence
  chemically synthesized
tgaatcagtgtgcttcattt

SEQ ID NO: 292947 - DNA, 20 bp, Artificial Sequence
  chemically synthesized
ctgaatcagtgtgcttcatt

SEQ ID NO: 292948 - DNA, 20 bp, Artificial Sequence
  chemically synthesized
ctaaatgaagcacactgatt

SEQ ID NO: 292949 - DNA, 20 bp, Artificial Sequence
  chemically synthesized
aaggaaaatgagagctgaat

SEQ ID NO: 292950 - DNA, 20 bp, Artificial Sequence
  chemically synthesized
ttgtatagaaaggaaaatga

SEQ ID NO: 292951 - DNA, 20 bp, Artificial Sequence
  chemically synthesized
ttttgtatagaaaggaaaat

SEQ ID NO: 292952 - DNA, 20 bp, Artificial Sequence
  chemically synthesized
cttgccctttttgtatagaa

SEQ ID NO: 292953 - DNA, 20 bp, Artificial Sequence
  chemically synthesized
tcttgccctttttgtataga

SEQ ID NO: 292954 - DNA, 20 bp, Artificial Sequence
  chemically synthesized
cattttcctttctatacaaa

SEQ ID NO: 292955 - DNA, 20 bp, Artificial Sequence
  chemically synthesized
attttcctttctatacaaaa

SEQ ID NO: 292956 - DNA, 20 bp, Artificial Sequence
  chemically synthesized
acattcttgccctttttgta

SEQ ID NO: 292957 - DNA, 20 bp, Artificial Sequence
  chemically synthesized
ttttcctttctatacaaaaa

SEQ ID NO: 292958 - DNA, 20 bp, Artificial Sequence
  chemically synthesized
cctttctatacaaaaagggc

SEQ ID NO: 292959 - DNA, 20 bp, Artificial Sequence
  chemically synthesized
aagaatgtatgtgtcttacg

SEQ ID NO: 292960 - DNA, 20 bp, Artificial Sequence
  chemically synthesized
aataaatctcacaaccacgt

SEQ ID NO: 292961 - DNA, 20 bp, Artificial Sequence
  chemically synthesized
tatgtgtcttacgtggttgt

SEQ ID NO: 292962 - DNA, 20 bp, Artificial Sequence
  chemically synthesized
tgagatttattatatctcca

SEQ ID NO: 292963 - DNA, 20 bp, Artificial Sequence
  chemically synthesized
cttcccaagcttaggctatg

SEQ ID NO: 292964 - DNA, 20 bp, Artificial Sequence
  chemically synthesized
ttattatatctccatagcct

SEQ ID NO: 292965 - DNA, 20 bp, Artificial Sequence
  chemically synthesized
tccttcccaagcttaggcta

SEQ ID NO: 292966 - DNA, 20 bp, Artificial Sequence
  chemically synthesized
atatctccatagcctaagct

SEQ ID NO: 292967 - DNA, 20 bp, Artificial Sequence
  chemically synthesized
tatctccatagcctaagctt

SEQ ID NO: 292968 - DNA, 20 bp, Artificial Sequence
  chemically synthesized
gaatcttccttcccaagctt

SEQ ID NO: 292969 - DNA, 20 bp, Artificial Sequence
  chemically synthesized
agaatcttccttcccaagct

SEQ ID NO: 292970 - DNA, 20 bp, Artificial Sequence
  chemically synthesized
ctccatagcctaagcttggg

SEQ ID NO: 292971 - DNA, 20 bp, Artificial Sequence
  chemically synthesized
tccatagcctaagcttggga

SEQ ID NO: 292972 - DNA, 20 bp, Artificial Sequence
  chemically synthesized
atagcctaagcttgggaagg

SEQ ID NO: 292973 - DNA, 20 bp, Artificial Sequence
  chemically synthesized
agtccagaatcttccttccc

SEQ ID NO: 292974 - DNA, 20 bp, Artificial Sequence
  chemically synthesized
aagcttgggaaggaagattc

SEQ ID NO: 292975 - DNA, 20 bp, Artificial Sequence
  chemically synthesized
agctcttaaatttataagtc

SEQ ID NO: 292976 - DNA, 20 bp, Artificial Sequence
  chemically synthesized
attaaagctcttaaatttat

SEQ ID NO: 292977 - DNA, 20 bp, Artificial Sequence
  chemically synthesized
gattctggacttataaattt

SEQ ID NO: 292978 - DNA, 20 bp, Artificial Sequence
  chemically synthesized
ttctggacttataaatttaa

SEQ ID NO: 292979 - DNA, 20 bp, Artificial Sequence
  chemically synthesized
gtccagcaattattgcatta

SEQ ID NO: 292980 - DNA, 20 bp, Artificial Sequence
  chemically synthesized
agctttaatgcaataattgc

SEQ ID NO: 292981 - DNA, 20 bp, Artificial Sequence
  chemically synthesized
tgcaataattgctggactcc

SEQ ID NO: 292982 - DNA, 20 bp, Artificial Sequence
  chemically synthesized
ctttctgtaaactaggagtc

SEQ ID NO: 292983 - DNA, 20 bp, Artificial Sequence
  chemically synthesized
tgaagctttctgtaaactag

SEQ ID NO: 292984 - DNA, 20 bp, Artificial Sequence
  chemically synthesized
attgctggactcctagttta

SEQ ID NO: 292985 - DNA, 20 bp, Artificial Sequence
  chemically synthesized
aatgaagctttctgtaaact

SEQ ID NO: 292986 - DNA, 20 bp, Artificial Sequence
  chemically synthesized
aaatgaagctttctgtaaac

SEQ ID NO: 292987 - DNA, 20 bp, Artificial Sequence
  chemically synthesized
ctggactcctagtttacaga

SEQ ID NO: 292988 - DNA, 20 bp, Artificial Sequence
  chemically synthesized
atgaagctgaaagacaaatg

SEQ ID NO: 292989 - DNA, 20 bp, Artificial Sequence
  chemically synthesized
agaaagcttcatttgtcttt

SEQ ID NO: 292990 - DNA, 20 bp, Artificial Sequence
  chemically synthesized
ggtgtagctcatgaagctga

SEQ ID NO: 292991 - DNA, 20 bp, Artificial Sequence
  chemically synthesized
catttgtctttcagcttcat

SEQ ID NO: 292992 - DNA, 20 bp, Artificial Sequence
  chemically synthesized
gttgagtggtgtagctcatg

SEQ ID NO: 292993 - DNA, 20 bp, Artificial Sequence
  chemically synthesized
aaaagtacagttgagtggtg

SEQ ID NO: 292994 - DNA, 20 bp, Artificial Sequence
  chemically synthesized
agcccaaaagtacagttgag

SEQ ID NO: 292995 - DNA, 20 bp, Artificial Sequence
  chemically synthesized
tagagcccaaaagtacagtt

SEQ ID NO: 292996 - DNA, 20 bp, Artificial Sequence
  chemically synthesized
acaccactcaactgtacttt

SEQ ID NO: 292997 - DNA, 20 bp, Artificial Sequence
  chemically synthesized
caccactcaactgtactttt

SEQ ID NO: 292998 - DNA, 20 bp, Artificial Sequence
  chemically synthesized
tagtatagagcccaaaagta

SEQ ID NO: 292999 - DNA, 20 bp, Artificial Sequence
  chemically synthesized
tcctttagtatagagcccaa

SEQ ID NO: 293000 - DNA, 20 bp, Artificial Sequence
  chemically synthesized
tacttttgggctctatacta

SEQ ID NO: 293001 - DNA, 20 bp, Artificial Sequence
  chemically synthesized
ataatagctcctttagtata

SEQ ID NO: 293002 - DNA, 20 bp, Artificial Sequence
  chemically synthesized
acttttgggctctatactaa

SEQ ID NO: 293003 - DNA, 20 bp, Artificial Sequence
  chemically synthesized
tcataatagctcctttagta

SEQ ID NO: 293004 - DNA, 20 bp, Artificial Sequence
  chemically synthesized
ttttgggctctatactaaag

SEQ ID NO: 293005 - DNA, 20 bp, Artificial Sequence
  chemically synthesized
ctaaatcataatagctcctt

SEQ ID NO: 293006 - DNA, 20 bp, Artificial Sequence
  chemically synthesized
actgctaccctaaatcataa

SEQ ID NO: 293007 - DNA, 20 bp, Artificial Sequence
  chemically synthesized
ctaaaggagctattatgatt

SEQ ID NO: 293008 - DNA, 20 bp, Artificial Sequence
  chemically synthesized
taaaggagctattatgattt

SEQ ID NO: 293009 - DNA, 20 bp, Artificial Sequence
  chemically synthesized
aaaggagctattatgattta

SEQ ID NO: 293010 - DNA, 20 bp, Artificial Sequence
  chemically synthesized
ggagctattatgatttaggg

SEQ ID NO: 293011 - DNA, 20 bp, Artificial Sequence
  chemically synthesized
gctattatgatttagggtag

SEQ ID NO: 293012 - DNA, 20 bp, Artificial Sequence
  chemically synthesized
cccttcaggtgtatttcaga

SEQ ID NO: 293013 - DNA, 20 bp, Artificial Sequence
  chemically synthesized
ccccttcaggtgtatttcag

SEQ ID NO: 293014 - DNA, 20 bp, Artificial Sequence
  chemically synthesized
accccttcaggtgtatttca

SEQ ID NO: 293015 - DNA, 20 bp, Artificial Sequence
  chemically synthesized
gtaccccttcaggtgtattt

SEQ ID NO: 293016 - DNA, 20 bp, Artificial Sequence
  chemically synthesized
gtccctctgaaatacacctg

SEQ ID NO: 293017 - DNA, 20 bp, Artificial Sequence
  chemically synthesized
tccctctgaaatacacctga

SEQ ID NO: 293018 - DNA, 20 bp, Artificial Sequence
  chemically synthesized
ccctctgaaatacacctgaa

SEQ ID NO: 293019 - DNA, 20 bp, Artificial Sequence
  chemically synthesized
cctctgaaatacacctgaag

SEQ ID NO: 293020 - DNA, 20 bp, Artificial Sequence
  chemically synthesized
agtgcctgaagtaccccttc

SEQ ID NO: 293021 - DNA, 20 bp, Artificial Sequence
  chemically synthesized
aagtgcctgaagtacccctt

SEQ ID NO: 293022 - DNA, 20 bp, Artificial Sequence
  chemically synthesized
atacacctgaaggggtactt

SEQ ID NO: 293023 - DNA, 20 bp, Artificial Sequence
  chemically synthesized
tacacctgaaggggtacttc

SEQ ID NO: 293024 - DNA, 20 bp, Artificial Sequence
  chemically synthesized
agacacatattaagtgcctg

SEQ ID NO: 293025 - DNA, 20 bp, Artificial Sequence
  chemically synthesized
agataagctagacacatatt

SEQ ID NO: 293026 - DNA, 20 bp, Artificial Sequence
  chemically synthesized
tcaggcacttaatatgtgtc

SEQ ID NO: 293027 - DNA, 20 bp, Artificial Sequence
  chemically synthesized
gtgcaaattgtgagataagc

SEQ ID NO: 293028 - DNA, 20 bp, Artificial Sequence
  chemically synthesized
gattgtgcaaattgtgagat

SEQ ID NO: 293029 - DNA, 20 bp, Artificial Sequence
  chemically synthesized
tctgtgattgtgcaaattgt

SEQ ID NO: 293030 - DNA, 20 bp, Artificial Sequence
  chemically synthesized
tctcacaatttgcacaatca

SEQ ID NO: 293031 - DNA, 20 bp, Artificial Sequence
  chemically synthesized
tgttccgtttttgtcgttca

SEQ ID NO: 293032 - DNA, 20 bp, Artificial Sequence
  chemically synthesized
ttgttccgtttttgtcgttc

SEQ ID NO: 293033 - DNA, 20 bp, Artificial Sequence
  chemically synthesized
tgttccttgaacgacaaaaa

SEQ ID NO: 293034 - DNA, 20 bp, Artificial Sequence
  chemically synthesized
aacgacaaaaacggaacaaa

SEQ ID NO: 293035 - DNA, 20 bp, Artificial Sequence
  chemically synthesized
caaaaacggaacaaatagat

SEQ ID NO: 293036 - DNA, 20 bp, Artificial Sequence
  chemically synthesized
aacggaacaaatagataagt

SEQ ID NO: 293037 - DNA, 20 bp, Artificial Sequence
  chemically synthesized
atagataagttagaatattt

SEQ ID NO: 293038 - DNA, 20 bp, Artificial Sequence
  chemically synthesized
gttagaatatttgagccttt

SEQ ID NO: 293039 - DNA, 20 bp, Artificial Sequence
  chemically synthesized
taatttatgaaattacttaa

SEQ ID NO: 293040 - DNA, 20 bp, Artificial Sequence
  chemically synthesized
ataatttatgaaattactta

SEQ ID NO: 293041 - DNA, 20 bp, Artificial Sequence
  chemically synthesized
tcataaattattttatttaa

SEQ ID NO: 293042 - DNA, 20 bp, Artificial Sequence
  chemically synthesized
cataaattattttatttaat

SEQ ID NO: 293043 - DNA, 20 bp, Artificial Sequence
  chemically synthesized
ataaattattttatttaatg

SEQ ID NO: 293044 - DNA, 20 bp, Artificial Sequence
  chemically synthesized
tattttatttaatggggaaa

SEQ ID NO: 293045 - DNA, 20 bp, Artificial Sequence
  chemically synthesized
ttttatttaatggggaaaca

SEQ ID NO: 293046 - DNA, 20 bp, Artificial Sequence
  chemically synthesized
ttaatggggaaacagagcta

SEQ ID NO: 293047 - DNA, 20 bp, Artificial Sequence
  chemically synthesized
atgactacttaaaatgacca

SEQ ID NO: 293048 - DNA, 20 bp, Artificial Sequence
  chemically synthesized
aacagagctatggtcatttt

SEQ ID NO: 293049 - DNA, 20 bp, Artificial Sequence
  chemically synthesized
agagctatggtcattttaag

SEQ ID NO: 293050 - DNA, 20 bp, Artificial Sequence
  chemically synthesized
gtcattttaagtagtcatcc

SEQ ID NO: 293051 - DNA, 20 bp, Artificial Sequence
  chemically synthesized
ttaagtagtcatcctagtta

SEQ ID NO: 293052 - DNA, 20 bp, Artificial Sequence
  chemically synthesized
ctcaagtttgggccataact

SEQ ID NO: 293053 - DNA, 20 bp, Artificial Sequence
  chemically synthesized
gctcaagtttgggccataac

SEQ ID NO: 293054 - DNA, 20 bp, Artificial Sequence
  chemically synthesized
cctagttatggcccaaactt

SEQ ID NO: 293055 - DNA, 20 bp, Artificial Sequence
  chemically synthesized
acgtcattaggctcaagttt

SEQ ID NO: 293056 - DNA, 20 bp, Artificial Sequence
  chemically synthesized
tacgtcattaggctcaagtt

SEQ ID NO: 293057 - DNA, 20 bp, Artificial Sequence
  chemically synthesized
actgatacgtcattaggctc

SEQ ID NO: 293058 - DNA, 20 bp, Artificial Sequence
  chemically synthesized
ggtcgaactgatacgtcatt

SEQ ID NO: 293059 - DNA, 20 bp, Artificial Sequence
  chemically synthesized
tggtcgaactgatacgtcat

SEQ ID NO: 293060 - DNA, 20 bp, Artificial Sequence
  chemically synthesized
acttgagcctaatgacgtat

SEQ ID NO: 293061 - DNA, 20 bp, Artificial Sequence
  chemically synthesized
ttgttctaccagtaaagata

SEQ ID NO: 293062 - DNA, 20 bp, Artificial Sequence
  chemically synthesized
cagttcgaccatatctttac

SEQ ID NO: 293063 - DNA, 20 bp, Artificial Sequence
  chemically synthesized
ttcgaccatatctttactgg

SEQ ID NO: 293064 - DNA, 20 bp, Artificial Sequence
  chemically synthesized
acccttttgttctaccagta

SEQ ID NO: 293065 - DNA, 20 bp, Artificial Sequence
  chemically synthesized
atgctacccttttgttctac

SEQ ID NO: 293066 - DNA, 20 bp, Artificial Sequence
  chemically synthesized
tatctttactggtagaacaa

SEQ ID NO: 293067 - DNA, 20 bp, Artificial Sequence
  chemically synthesized
atctttactggtagaacaaa

SEQ ID NO: 293068 - DNA, 20 bp, Artificial Sequence
  chemically synthesized
tctttactggtagaacaaaa

SEQ ID NO: 293069 - DNA, 20 bp, Artificial Sequence
  chemically synthesized
ttactggtagaacaaaaggg

SEQ ID NO: 293070 - DNA, 20 bp, Artificial Sequence
  chemically synthesized
agcataaaatttgattaaca

SEQ ID NO: 293071 - DNA, 20 bp, Artificial Sequence
  chemically synthesized
gattaacacagtcaaccaaa

SEQ ID NO: 293072 - DNA, 20 bp, Artificial Sequence
  chemically synthesized
attaacacagtcaaccaaac

SEQ ID NO: 293073 - DNA, 20 bp, Artificial Sequence
  chemically synthesized
tgatttgagacattcctgtt

SEQ ID NO: 293074 - DNA, 20 bp, Artificial Sequence
  chemically synthesized
ggggggtaggggtgtgattt

SEQ ID NO: 293075 - DNA, 20 bp, Artificial Sequence
  chemically synthesized
cagggaacactggggggtag

SEQ ID NO: 293076 - DNA, 20 bp, Artificial Sequence
  chemically synthesized
caaatcacacccctaccccc

SEQ ID NO: 293077 - DNA, 20 bp, Artificial Sequence
  chemically synthesized
ccagggaacactggggggta

SEQ ID NO: 293078 - DNA, 20 bp, Artificial Sequence
  chemically synthesized
accagggaacactggggggt

SEQ ID NO: 293079 - DNA, 20 bp, Artificial Sequence
  chemically synthesized
taccagggaacactgggggg

SEQ ID NO: 293080 - DNA, 20 bp, Artificial Sequence
  chemically synthesized
agataccagggaacactggg

SEQ ID NO: 293081 - DNA, 20 bp, Artificial Sequence
  chemically synthesized
cagataccagggaacactgg

SEQ ID NO: 293082 - DNA, 20 bp, Artificial Sequence
  chemically synthesized
gcagataccagggaacactg

SEQ ID NO: 293083 - DNA, 20 bp, Artificial Sequence
  chemically synthesized
ggcagataccagggaacact

SEQ ID NO: 293084 - DNA, 20 bp, Artificial Sequence
  chemically synthesized
tggcagataccagggaacac

SEQ ID NO: 293085 - DNA, 20 bp, Artificial Sequence
  chemically synthesized
ccctaccccccagtgttccc

SEQ ID NO: 293086 - DNA, 20 bp, Artificial Sequence
  chemically synthesized
gctaactttggcagatacca

SEQ ID NO: 293087 - DNA, 20 bp, Artificial Sequence
  chemically synthesized
tgctaactttggcagatacc

SEQ ID NO: 293088 - DNA, 20 bp, Artificial Sequence
  chemically synthesized
atgctaactttggcagatac

SEQ ID NO: 293089 - DNA, 20 bp, Artificial Sequence
  chemically synthesized
gtgttccctggtatctgcca

SEQ ID NO: 293090 - DNA, 20 bp, Artificial Sequence
  chemically synthesized
tccctggtatctgccaaagt

SEQ ID NO: 293091 - DNA, 20 bp, Artificial Sequence
  chemically synthesized
aaggaaaatgctaactttgg

SEQ ID NO: 293092 - DNA, 20 bp, Artificial Sequence
  chemically synthesized
ctgaaggaaaatgctaactt

SEQ ID NO: 293093 - DNA, 20 bp, Artificial Sequence
  chemically synthesized
ccaaagttagcattttcctt

SEQ ID NO: 293094 - DNA, 20 bp, Artificial Sequence
  chemically synthesized
agttagcattttccttcaga

SEQ ID NO: 293095 - DNA, 20 bp, Artificial Sequence
  chemically synthesized
gaaaataataatccatctga

SEQ ID NO: 293096 - DNA, 20 bp, Artificial Sequence
  chemically synthesized
tgaaaataataatccatctg

SEQ ID NO: 293097 - DNA, 20 bp, Artificial Sequence
  chemically synthesized
ggtaataacgttggtaattt

SEQ ID NO: 293098 - DNA, 20 bp, Artificial Sequence
  chemically synthesized
agtcgttgaggtaataacgt

SEQ ID NO: 293099 - DNA, 20 bp, Artificial Sequence
  chemically synthesized
caaaattaaggcagtcgttg

SEQ ID NO: 293100 - DNA, 20 bp, Artificial Sequence
  chemically synthesized
gcaaaattaaggcagtcgtt

SEQ ID NO: 293101 - DNA, 20 bp, Artificial Sequence
  chemically synthesized
ttagaaaagcaaaattaagg

SEQ ID NO: 293102 - DNA, 20 bp, Artificial Sequence
  chemically synthesized
tgtttagaaaagcaaaatta

SEQ ID NO: 293103 - DNA, 20 bp, Artificial Sequence
  chemically synthesized
ctgtttagaaaagcaaaatt

SEQ ID NO: 293104 - DNA, 20 bp, Artificial Sequence
  chemically synthesized
cttaattttgcttttctaaa

SEQ ID NO: 293105 - DNA, 20 bp, Artificial Sequence
  chemically synthesized
tgaccagattctgtttagaa

SEQ ID NO: 293106 - DNA, 20 bp, Artificial Sequence
  chemically synthesized
ttaattgaccagattctgtt

SEQ ID NO: 293107 - DNA, 20 bp, Artificial Sequence
  chemically synthesized
ttgcttttctaaacagaatc

SEQ ID NO: 293108 - DNA, 20 bp, Artificial Sequence
  chemically synthesized
cttagtaaatattaattgac

SEQ ID NO: 293109 - DNA, 20 bp, Artificial Sequence
  chemically synthesized
ctggtcaattaatatttact

SEQ ID NO: 293110 - DNA, 20 bp, Artificial Sequence
  chemically synthesized
caggacacatagtaggtgct

SEQ ID NO: 293111 - DNA, 20 bp, Artificial Sequence
  chemically synthesized
gaaaagtcaggacacatagt

SEQ ID NO: 293112 - DNA, 20 bp, Artificial Sequence
  chemically synthesized
agaaaagtcaggacacatag

SEQ ID NO: 293113 - DNA, 20 bp, Artificial Sequence
  chemically synthesized
tgtagaaaagtcaggacaca

SEQ ID NO: 293114 - DNA, 20 bp, Artificial Sequence
  chemically synthesized
tggaggcatgtagaaaagtc

SEQ ID NO: 293115 - DNA, 20 bp, Artificial Sequence
  chemically synthesized
ttggaggcatgtagaaaagt

SEQ ID NO: 293116 - DNA, 20 bp, Artificial Sequence
  chemically synthesized
atttttggaggcatgtagaa

SEQ ID NO: 293117 - DNA, 20 bp, Artificial Sequence
  chemically synthesized
ttctaatttttggaggcatg

SEQ ID NO: 293118 - DNA, 20 bp, Artificial Sequence
  chemically synthesized
ctcatagttctaatttttgg

SEQ ID NO: 293119 - DNA, 20 bp, Artificial Sequence
  chemically synthesized
ttctacatgcctccaaaaat

SEQ ID NO: 293120 - DNA, 20 bp, Artificial Sequence
  chemically synthesized
cctcatagttctaatttttg

SEQ ID NO: 293121 - DNA, 20 bp, Artificial Sequence
  chemically synthesized
tccctcatagttctaatttt

SEQ ID NO: 293122 - DNA, 20 bp, Artificial Sequence
  chemically synthesized
cctccaaaaattagaactat

SEQ ID NO: 293123 - DNA, 20 bp, Artificial Sequence
  chemically synthesized
ctccaaaaattagaactatg

SEQ ID NO: 293124 - DNA, 20 bp, Artificial Sequence
  chemically synthesized
tccaaaaattagaactatga

SEQ ID NO: 293125 - DNA, 20 bp, Artificial Sequence
  chemically synthesized
tttcttgattatttccctca

SEQ ID NO: 293126 - DNA, 20 bp, Artificial Sequence
  chemically synthesized
gaactatgagggaaataatc

SEQ ID NO: 293127 - DNA, 20 bp, Artificial Sequence
  chemically synthesized
aagaaaattaatattctcac

SEQ ID NO: 293128 - DNA, 20 bp, Artificial Sequence
  chemically synthesized
taaatgatcgtgtgactagt

SEQ ID NO: 293129 - DNA, 20 bp, Artificial Sequence
  chemically synthesized
gatttaaatgatcgtgtgac

SEQ ID NO: 293130 - DNA, 20 bp, Artificial Sequence
  chemically synthesized
gatcatttaaatcctgcatg

SEQ ID NO: 293131 - DNA, 20 bp, Artificial Sequence
  chemically synthesized
tggtaagtaaaactacatgc

SEQ ID NO: 293132 - DNA, 20 bp, Artificial Sequence
  chemically synthesized
ttggtaagtaaaactacatg

SEQ ID NO: 293133 - DNA, 20 bp, Artificial Sequence
  chemically synthesized
aatgatttttaatttttggt

SEQ ID NO: 293134 - DNA, 20 bp, Artificial Sequence
  chemically synthesized
cgggaatgatttttaatttt

SEQ ID NO: 293135 - DNA, 20 bp, Artificial Sequence
  chemically synthesized
tttaaacatttagaaattac

SEQ ID NO: 293136 - DNA, 20 bp, Artificial Sequence
  chemically synthesized
atttaaacatttagaaatta

SEQ ID NO: 293137 - DNA, 20 bp, Artificial Sequence
  chemically synthesized
tcagaaataatttaaacatt

SEQ ID NO: 293138 - DNA, 20 bp, Artificial Sequence
  chemically synthesized
taaattatttctgattaatt

SEQ ID NO: 293139 - DNA, 20 bp, Artificial Sequence
  chemically synthesized
cttacctacactgaattaat

SEQ ID NO: 293140 - DNA, 20 bp, Artificial Sequence
  chemically synthesized
tatttctgattaattcagtg

SEQ ID NO: 293141 - DNA, 20 bp, Artificial Sequence
  chemically synthesized
atttctgattaattcagtgt

SEQ ID NO: 293142 - DNA, 20 bp, Artificial Sequence
  chemically synthesized
ctgattaattcagtgtaggt

SEQ ID NO: 293143 - DNA, 20 bp, Artificial Sequence
  chemically synthesized
tcatgtcatagttatatatc

SEQ ID NO: 293144 - DNA, 20 bp, Artificial Sequence
  chemically synthesized
ttgatatataactatgacat

SEQ ID NO: 293145 - DNA, 20 bp, Artificial Sequence
  chemically synthesized
ctttaaatggtctcatgtca

SEQ ID NO: 293146 - DNA, 20 bp, Artificial Sequence
  chemically synthesized
ctatgacatgagaccattta

SEQ ID NO: 293147 - DNA, 20 bp, Artificial Sequence
  chemically synthesized
tgcaagagctatactttaaa

SEQ ID NO: 293148 - DNA, 20 bp, Artificial Sequence
  chemically synthesized
acatgagaccatttaaagta

SEQ ID NO: 293149 - DNA, 20 bp, Artificial Sequence
  chemically synthesized
ttaaagtatagctcttgcat

SEQ ID NO: 293150 - DNA, 20 bp, Artificial Sequence
  chemically synthesized
attttaataagctgatgcaa

SEQ ID NO: 293151 - DNA, 20 bp, Artificial Sequence
  chemically synthesized
tcattttaataagctgatgc

SEQ ID NO: 293152 - DNA, 20 bp, Artificial Sequence
  chemically synthesized
tatcactttttcattttaat

SEQ ID NO: 293153 - DNA, 20 bp, Artificial Sequence
  chemically synthesized
atcagcttattaaaatgaaa

SEQ ID NO: 293154 - DNA, 20 bp, Artificial Sequence
  chemically synthesized
aaaatgaaaaagtgataata

SEQ ID NO: 293155 - DNA, 20 bp, Artificial Sequence
  chemically synthesized
aaaagtgataatacagtttc

SEQ ID NO: 293156 - DNA, 20 bp, Artificial Sequence
  chemically synthesized
aaagtgataatacagtttct

SEQ ID NO: 293157 - DNA, 20 bp, Artificial Sequence
  chemically synthesized
aagtgataatacagtttcta

SEQ ID NO: 293158 - DNA, 20 bp, Artificial Sequence
  chemically synthesized
agtgataatacagtttctag

SEQ ID NO: 293159 - DNA, 20 bp, Artificial Sequence
  chemically synthesized
gtgataatacagtttctagg

SEQ ID NO: 293160 - DNA, 20 bp, Artificial Sequence
  chemically synthesized
gttgttatgtaagttccccc

SEQ ID NO: 293161 - DNA, 20 bp, Artificial Sequence
  chemically synthesized
tattctcctagttgttatgt

SEQ ID NO: 293162 - DNA, 20 bp, Artificial Sequence
  chemically synthesized
gggggaacttacataacaac

SEQ ID NO: 293163 - DNA, 20 bp, Artificial Sequence
  chemically synthesized
ggggaacttacataacaact

SEQ ID NO: 293164 - DNA, 20 bp, Artificial Sequence
  chemically synthesized
ggaacttacataacaactag

SEQ ID NO: 293165 - DNA, 20 bp, Artificial Sequence
  chemically synthesized
gtgatctaaaaatattctcc

SEQ ID NO: 293166 - DNA, 20 bp, Artificial Sequence
  chemically synthesized
aacaactaggagaatatttt

SEQ ID NO: 293167 - DNA, 20 bp, Artificial Sequence
  chemically synthesized
tttaacatgaatatgctgtt

SEQ ID NO: 293168 - DNA, 20 bp, Artificial Sequence
  chemically synthesized
attttaactgatcaacttaa

SEQ ID NO: 293169 - DNA, 20 bp, Artificial Sequence
  chemically synthesized
gaatatgctgttaagttgat

SEQ ID NO: 293170 - DNA, 20 bp, Artificial Sequence
  chemically synthesized
gttgatcagttaaaattacc

SEQ ID NO: 293171 - DNA, 20 bp, Artificial Sequence
  chemically synthesized
ttatttagatgtatgttgct

SEQ ID NO: 293172 - DNA, 20 bp, Artificial Sequence
  chemically synthesized
aataccagtagatttttatt

SEQ ID NO: 293173 - DNA, 20 bp, Artificial Sequence
  chemically synthesized
acatctaaataaaaatctac

SEQ ID NO: 293174 - DNA, 20 bp, Artificial Sequence
  chemically synthesized
acaggtaatgaaaataccag

SEQ ID NO: 293175 - DNA, 20 bp, Artificial Sequence
  chemically synthesized
agaacaggtaatgaaaatac

SEQ ID NO: 293176 - DNA, 20 bp, Artificial Sequence
  chemically synthesized
gagtgaacaagtttaagaac

SEQ ID NO: 293177 - DNA, 20 bp, Artificial Sequence
  chemically synthesized
tgagtgaacaagtttaagaa

SEQ ID NO: 293178 - DNA, 20 bp, Artificial Sequence
  chemically synthesized
agacttgagtgaacaagttt

SEQ ID NO: 293179 - DNA, 20 bp, Artificial Sequence
  chemically synthesized
caggtgagacttgagtgaac

SEQ ID NO: 293180 - DNA, 20 bp, Artificial Sequence
  chemically synthesized
gttcttaaacttgttcactc

SEQ ID NO: 293181 - DNA, 20 bp, Artificial Sequence
  chemically synthesized
aaatataacaggtgagactt

SEQ ID NO: 293182 - DNA, 20 bp, Artificial Sequence
  chemically synthesized
aacaaacaaatataacaggt

SEQ ID NO: 293183 - DNA, 20 bp, Artificial Sequence
  chemically synthesized
tgaaaacaaacaaatataac

SEQ ID NO: 293184 - DNA, 20 bp, Artificial Sequence
  chemically synthesized
atgaaaacaaacaaatataa

SEQ ID NO: 293185 - DNA, 20 bp, Artificial Sequence
  chemically synthesized
ttttcatttttaaccaaata

SEQ ID NO: 293186 - DNA, 20 bp, Artificial Sequence
  chemically synthesized
gtcccatgactgactgtatt

SEQ ID NO: 293187 - DNA, 20 bp, Artificial Sequence
  chemically synthesized
catttttaaccaaatacagt

SEQ ID NO: 293188 - DNA, 20 bp, Artificial Sequence
  chemically synthesized
taaccaaatacagtcagtca

SEQ ID NO: 293189 - DNA, 20 bp, Artificial Sequence
  chemically synthesized
aaccaaatacagtcagtcat

SEQ ID NO: 293190 - DNA, 20 bp, Artificial Sequence
  chemically synthesized
cagtcagtcatgggactcat

SEQ ID NO: 293191 - DNA, 20 bp, Artificial Sequence
  chemically synthesized
tcagtcatgggactcattag

SEQ ID NO: 293192 - DNA, 20 bp, Artificial Sequence
  chemically synthesized
attcattttcttcttctaat

SEQ ID NO: 293193 - DNA, 20 bp, Artificial Sequence
  chemically synthesized
gtcatgggactcattagaag

SEQ ID NO: 293194 - DNA, 20 bp, Artificial Sequence
  chemically synthesized
aagaaaatgaattgattttc

SEQ ID NO: 293195 - DNA, 20 bp, Artificial Sequence
  chemically synthesized
agaaaatgaattgattttct

SEQ ID NO: 293196 - DNA, 20 bp, Artificial Sequence
  chemically synthesized
aaatgaattgattttctagg

SEQ ID NO: 293197 - DNA, 20 bp, Artificial Sequence
  chemically synthesized
caaaagttcagtggtcttcc

SEQ ID NO: 293198 - DNA, 20 bp, Artificial Sequence
  chemically synthesized
tttggcattcaaaagttcag

SEQ ID NO: 293199 - DNA, 20 bp, Artificial Sequence
  chemically synthesized
aaatttggcattcaaaagtt

SEQ ID NO: 293200 - DNA, 20 bp, Artificial Sequence
  chemically synthesized
attgcaaatttggcattcaa

SEQ ID NO: 293201 - DNA, 20 bp, Artificial Sequence
  chemically synthesized
ttttgccttaattgcaaatt

SEQ ID NO: 293202 - DNA, 20 bp, Artificial Sequence
  chemically synthesized
tgaatgccaaatttgcaatt

SEQ ID NO: 293203 - DNA, 20 bp, Artificial Sequence
  chemically synthesized
gaatgccaaatttgcaatta

SEQ ID NO: 293204 - DNA, 20 bp, Artificial Sequence
  chemically synthesized
ggcaaaaaataacttataca

SEQ ID NO: 293205 - DNA, 20 bp, Artificial Sequence
  chemically synthesized
ggggcataaattctgtgtat

SEQ ID NO: 293206 - DNA, 20 bp, Artificial Sequence
  chemically synthesized
agaatttatgccccaaaatg

SEQ ID NO: 293207 - DNA, 20 bp, Artificial Sequence
  chemically synthesized
cagaatctgcctgcattttg

SEQ ID NO: 293208 - DNA, 20 bp, Artificial Sequence
  chemically synthesized
gaatttatgccccaaaatgc

SEQ ID NO: 293209 - DNA, 20 bp, Artificial Sequence
  chemically synthesized
tcagaatctgcctgcatttt

SEQ ID NO: 293210 - DNA, 20 bp, Artificial Sequence
  chemically synthesized
ttcagaatctgcctgcattt

SEQ ID NO: 293211 - DNA, 20 bp, Artificial Sequence
  chemically synthesized
tttatgccccaaaatgcagg

SEQ ID NO: 293212 - DNA, 20 bp, Artificial Sequence
  chemically synthesized
atgcaggcagattctgaaaa

SEQ ID NO: 293213 - DNA, 20 bp, Artificial Sequence
  chemically synthesized
ttgtgcatgtcagctttttt

SEQ ID NO: 293214 - DNA, 20 bp, Artificial Sequence
  chemically synthesized
aatgtttttgttgtgcatgt

SEQ ID NO: 293215 - DNA, 20 bp, Artificial Sequence
  chemically synthesized
attttgtagaagacgtttac

SEQ ID NO: 293216 - DNA, 20 bp, Artificial Sequence
  chemically synthesized
gattatttttcattttgtag

SEQ ID NO: 293217 - DNA, 20 bp, Artificial Sequence
  chemically synthesized
taagattatttttcattttg

SEQ ID NO: 293218 - DNA, 20 bp, Artificial Sequence
  chemically synthesized
aaatgaaaaataatcttatt

SEQ ID NO: 293219 - DNA, 20 bp, Artificial Sequence
  chemically synthesized
ggataatgctatttccaaat

SEQ ID NO: 293220 - DNA, 20 bp, Artificial Sequence
  chemically synthesized
aaaataatcttatttggaaa

SEQ ID NO: 293221 - DNA, 20 bp, Artificial Sequence
  chemically synthesized
ataaaattttacgaaaatca

SEQ ID NO: 293222 - DNA, 20 bp, Artificial Sequence
  chemically synthesized
gataaaattttacgaaaatc

SEQ ID NO: 293223 - DNA, 20 bp, Artificial Sequence
  chemically synthesized
agataaaattttacgaaaat

SEQ ID NO: 293224 - DNA, 20 bp, Artificial Sequence
  chemically synthesized
gattttcgtaaaattttatc

SEQ ID NO: 293225 - DNA, 20 bp, Artificial Sequence
  chemically synthesized
taaaattttatctggaaata

SEQ ID NO: 293226 - DNA, 20 bp, Artificial Sequence
  chemically synthesized
ttgctatactactatatttc

SEQ ID NO: 293227 - DNA, 20 bp, Artificial Sequence
  chemically synthesized
aattttatctggaaatatag

SEQ ID NO: 293228 - DNA, 20 bp, Artificial Sequence
  chemically synthesized
tatctggaaatatagtagta

SEQ ID NO: 293229 - DNA, 20 bp, Artificial Sequence
  chemically synthesized
gtatagcaatgataatttga

SEQ ID NO: 293230 - DNA, 20 bp, Artificial Sequence
  chemically synthesized
tagcaatgataatttgaaag

SEQ ID NO: 293231 - DNA, 20 bp, Artificial Sequence
  chemically synthesized
agcaatgataatttgaaaga

SEQ ID NO: 293232 - DNA, 20 bp, Artificial Sequence
  chemically synthesized
tatcatgtcaatgacacatt

SEQ ID NO: 293233 - DNA, 20 bp, Artificial Sequence
  chemically synthesized
atttggtacacataactttt

SEQ ID NO: 293234 - DNA, 20 bp, Artificial Sequence
  chemically synthesized
tttggtacacataacttttg

SEQ ID NO: 293235 - DNA, 20 bp, Artificial Sequence
  chemically synthesized
tctaatactcagtgcctcaa

SEQ ID NO: 293236 - DNA, 20 bp, Artificial Sequence
  chemically synthesized
cacataacttttgaggcact

SEQ ID NO: 293237 - DNA, 20 bp, Artificial Sequence
  chemically synthesized
acttttgaggcactgagtat

SEQ ID NO: 293238 - DNA, 20 bp, Artificial Sequence
  chemically synthesized
aattaatcttttctaatact

SEQ ID NO: 293239 - DNA, 20 bp, Artificial Sequence
  chemically synthesized
tgaggcactgagtattagaa

SEQ ID NO: 293240 - DNA, 20 bp, Artificial Sequence
  chemically synthesized
attttaatttattcttgaaa

SEQ ID NO: 293241 - DNA, 20 bp, Artificial Sequence
  chemically synthesized
agtttttgtctttctttttc

SEQ ID NO: 293242 - DNA, 20 bp, Artificial Sequence
  chemically synthesized
taatttattcttgaaaaaga

SEQ ID NO: 293243 - DNA, 20 bp, Artificial Sequence
  chemically synthesized
gaaaaagaaagacaaaaact

SEQ ID NO: 293244 - DNA, 20 bp, Artificial Sequence
  chemically synthesized
aagaaagacaaaaacttggc

SEQ ID NO: 293245 - DNA, 20 bp, Artificial Sequence
  chemically synthesized
ataaaagcacaaagctagcc

SEQ ID NO: 293246 - DNA, 20 bp, Artificial Sequence
  chemically synthesized
gtgagataaaagcacaaagc

SEQ ID NO: 293247 - DNA, 20 bp, Artificial Sequence
  chemically synthesized
tagagtgagataaaagcaca

SEQ ID NO: 293248 - DNA, 20 bp, Artificial Sequence
  chemically synthesized
acttttttagagtgagataa

SEQ ID NO: 293249 - DNA, 20 bp, Artificial Sequence
  chemically synthesized
ttaagtaacttttttagagt

SEQ ID NO: 293250 - DNA, 20 bp, Artificial Sequence
  chemically synthesized
gcttttatctcactctaaaa

SEQ ID NO: 293251 - DNA, 20 bp, Artificial Sequence
  chemically synthesized
acttttaagtaactttttta

SEQ ID NO: 293252 - DNA, 20 bp, Artificial Sequence
  chemically synthesized
ttacttttaagtaacttttt

SEQ ID NO: 293253 - DNA, 20 bp, Artificial Sequence
  chemically synthesized
actctaaaaaagttacttaa

SEQ ID NO: 293254 - DNA, 20 bp, Artificial Sequence
  chemically synthesized
aaaaaagttacttaaaagta

SEQ ID NO: 293255 - DNA, 20 bp, Artificial Sequence
  chemically synthesized
tcgggataacctttactttt

SEQ ID NO: 293256 - DNA, 20 bp, Artificial Sequence
  chemically synthesized
aaaaagttacttaaaagtaa

SEQ ID NO: 293257 - DNA, 20 bp, Artificial Sequence
  chemically synthesized
taaaagtaaaggttatcccg

SEQ ID NO: 293258 - DNA, 20 bp, Artificial Sequence
  chemically synthesized
aaagtaaaggttatcccgaa

SEQ ID NO: 293259 - DNA, 20 bp, Artificial Sequence
  chemically synthesized
tttaaaaaagaagtctcttc

SEQ ID NO: 293260 - DNA, 20 bp, Artificial Sequence
  chemically synthesized
atttaaaaaagaagtctctt

SEQ ID NO: 293261 - DNA, 20 bp, Artificial Sequence
  chemically synthesized
cttcctctcatttaaaaaag

SEQ ID NO: 293262 - DNA, 20 bp, Artificial Sequence
  chemically synthesized
tcacttcctctcatttaaaa

SEQ ID NO: 293263 - DNA, 20 bp, Artificial Sequence
  chemically synthesized
aagagacttcttttttaaat

SEQ ID NO: 293264 - DNA, 20 bp, Artificial Sequence
  chemically synthesized
gagacttcttttttaaatga

SEQ ID NO: 293265 - DNA, 20 bp, Artificial Sequence
  chemically synthesized
agacttcttttttaaatgag

SEQ ID NO: 293266 - DNA, 20 bp, Artificial Sequence
  chemically synthesized
cttcttttttaaatgagagg

SEQ ID NO: 293267 - DNA, 20 bp, Artificial Sequence
  chemically synthesized
aaatgagaggaagtgataaa

SEQ ID NO: 293268 - DNA, 20 bp, Artificial Sequence
  chemically synthesized
ggaagtgataaaaagtaaca

SEQ ID NO: 293269 - DNA, 20 bp, Artificial Sequence
  chemically synthesized
tcatatatattattacaaaa

SEQ ID NO: 293270 - DNA, 20 bp, Artificial Sequence
  chemically synthesized
catatatattattacaaaac

SEQ ID NO: 293271 - DNA, 20 bp, Artificial Sequence
  chemically synthesized
ttattacaaaacaggaatga

SEQ ID NO: 293272 - DNA, 20 bp, Artificial Sequence
  chemically synthesized
ttccaaacactaaaattata

SEQ ID NO: 293273 - DNA, 20 bp, Artificial Sequence
  chemically synthesized
taaaacattccatataattt

SEQ ID NO: 293274 - DNA, 20 bp, Artificial Sequence
  chemically synthesized
ttccatataattttagtgtt

SEQ ID NO: 293275 - DNA, 20 bp, Artificial Sequence
  chemically synthesized
ttgcaaaaatgatttaaaat

SEQ ID NO: 293276 - DNA, 20 bp, Artificial Sequence
  chemically synthesized
atttaaaatcagatgatgat

SEQ ID NO: 293277 - DNA, 20 bp, Artificial Sequence
  chemically synthesized
cagaaatttgaaaacattaa

SEQ ID NO: 293278 - DNA, 20 bp, Artificial Sequence
  chemically synthesized
atttaagaaaataaggttaa

SEQ ID NO: 293279 - DNA, 20 bp, Artificial Sequence
  chemically synthesized
ccaaataatttaagaaaata

SEQ ID NO: 293280 - DNA, 20 bp, Artificial Sequence
  chemically synthesized
tccaaataatttaagaaaat

SEQ ID NO: 293281 - DNA, 20 bp, Artificial Sequence
  chemically synthesized
agaatttatccaaataattt

SEQ ID NO: 293282 - DNA, 20 bp, Artificial Sequence
  chemically synthesized
ccttattttcttaaattatt

SEQ ID NO: 293283 - DNA, 20 bp, Artificial Sequence
  chemically synthesized
taaattatttggataaattc

SEQ ID NO: 293284 - DNA, 20 bp, Artificial Sequence
  chemically synthesized
attatttggataaattctag

SEQ ID NO: 293285 - DNA, 20 bp, Artificial Sequence
  chemically synthesized
aaattttaatgcaaatctgc

SEQ ID NO: 293286 - DNA, 20 bp, Artificial Sequence
  chemically synthesized
taaaatttatttctctgcta

SEQ ID NO: 293287 - DNA, 20 bp, Artificial Sequence
  chemically synthesized
tattttatcagtctgtagca

SEQ ID NO: 293288 - DNA, 20 bp, Artificial Sequence
  chemically synthesized
aatattttatcagtctgtag

SEQ ID NO: 293289 - DNA, 20 bp, Artificial Sequence
  chemically synthesized
tagaatattttatcagtctg

SEQ ID NO: 293290 - DNA, 20 bp, Artificial Sequence
  chemically synthesized
gatgtggtagaatattttat

SEQ ID NO: 293291 - DNA, 20 bp, Artificial Sequence
  chemically synthesized
tggaagaaaatgggatgtgg

SEQ ID NO: 293292 - DNA, 20 bp, Artificial Sequence
  chemically synthesized
cattggaagaaaatgggatg

SEQ ID NO: 293293 - DNA, 20 bp, Artificial Sequence
  chemically synthesized
tgagttcattggaagaaaat

SEQ ID NO: 293294 - DNA, 20 bp, Artificial Sequence
  chemically synthesized
ttgagttcattggaagaaaa

SEQ ID NO: 293295 - DNA, 20 bp, Artificial Sequence
  chemically synthesized
ttcaactttgagttcattgg

SEQ ID NO: 293296 - DNA, 20 bp, Artificial Sequence
  chemically synthesized
aaattcaactttgagttcat

SEQ ID NO: 293297 - DNA, 20 bp, Artificial Sequence
  chemically synthesized
attttcttccaatgaactca

SEQ ID NO: 293298 - DNA, 20 bp, Artificial Sequence
  chemically synthesized
attaggagaaattcaacttt

SEQ ID NO: 293299 - DNA, 20 bp, Artificial Sequence
  chemically synthesized
aatgctaaggaaattattag

SEQ ID NO: 293300 - DNA, 20 bp, Artificial Sequence
  chemically synthesized
ttaatgctaaggaaattatt

SEQ ID NO: 293301 - DNA, 20 bp, Artificial Sequence
  chemically synthesized
tttaatgctaaggaaattat

SEQ ID NO: 293302 - DNA, 20 bp, Artificial Sequence
  chemically synthesized
atttctcctaataatttcct

SEQ ID NO: 293303 - DNA, 20 bp, Artificial Sequence
  chemically synthesized
ttattctttttttaatgcta

SEQ ID NO: 293304 - DNA, 20 bp, Artificial Sequence
  chemically synthesized
attattctttttttaatgct

SEQ ID NO: 293305 - DNA, 20 bp, Artificial Sequence
  chemically synthesized
aatttccttagcattaaaaa

SEQ ID NO: 293306 - DNA, 20 bp, Artificial Sequence
  chemically synthesized
aaatacaaatttaaattaaa

SEQ ID NO: 293307 - DNA, 20 bp, Artificial Sequence
  chemically synthesized
taaatacaaatttaaattaa

SEQ ID NO: 293308 - DNA, 20 bp, Artificial Sequence
  chemically synthesized
aatttaaatttgtatttaac

SEQ ID NO: 293309 - DNA, 20 bp, Artificial Sequence
  chemically synthesized
tcagctgaattatatcagac

SEQ ID NO: 293310 - DNA, 20 bp, Artificial Sequence
  chemically synthesized
atttatcagctgaattatat

SEQ ID NO: 293311 - DNA, 20 bp, Artificial Sequence
  chemically synthesized
agtgcttgtctgatataatt

SEQ ID NO: 293312 - DNA, 20 bp, Artificial Sequence
  chemically synthesized
acacataggttcatatttat

SEQ ID NO: 293313 - DNA, 20 bp, Artificial Sequence
  chemically synthesized
tagggatttgataaacacat

SEQ ID NO: 293314 - DNA, 20 bp, Artificial Sequence
  chemically synthesized
ttagggatttgataaacaca

SEQ ID NO: 293315 - DNA, 20 bp, Artificial Sequence
  chemically synthesized
tatgtgtttatcaaatccct

SEQ ID NO: 293316 - DNA, 20 bp, Artificial Sequence
  chemically synthesized
gtgtttatcaaatccctaag

SEQ ID NO: 293317 - DNA, 20 bp, Artificial Sequence
  chemically synthesized
tgatttagataatcttctta

SEQ ID NO: 293318 - DNA, 20 bp, Artificial Sequence
  chemically synthesized
ttgatttagataatcttctt

SEQ ID NO: 293319 - DNA, 20 bp, Artificial Sequence
  chemically synthesized
gttgatttagataatcttct

SEQ ID NO: 293320 - DNA, 20 bp, Artificial Sequence
  chemically synthesized
ggtaattacacgagttgatt

SEQ ID NO: 293321 - DNA, 20 bp, Artificial Sequence
  chemically synthesized
atggtgaatggtaattacac

SEQ ID NO: 293322 - DNA, 20 bp, Artificial Sequence
  chemically synthesized
ctggtggaacagatggtgaa

SEQ ID NO: 293323 - DNA, 20 bp, Artificial Sequence
  chemically synthesized
tcaggccctggtggaacaga

SEQ ID NO: 293324 - DNA, 20 bp, Artificial Sequence
  chemically synthesized
ccattcaccatctgttccac

SEQ ID NO: 293325 - DNA, 20 bp, Artificial Sequence
  chemically synthesized
cattcaccatctgttccacc

SEQ ID NO: 293326 - DNA, 20 bp, Artificial Sequence
  chemically synthesized
cagctcaggccctggtggaa

SEQ ID NO: 293327 - DNA, 20 bp, Artificial Sequence
  chemically synthesized
attcaccatctgttccacca

SEQ ID NO: 293328 - DNA, 20 bp, Artificial Sequence
  chemically synthesized
cagatcagctcaggccctgg

SEQ ID NO: 293329 - DNA, 20 bp, Artificial Sequence
  chemically synthesized
catctgttccaccagggcct

SEQ ID NO: 293330 - DNA, 20 bp, Artificial Sequence
  chemically synthesized
cagcagatcagctcaggccc

SEQ ID NO: 293331 - DNA, 20 bp, Artificial Sequence
  chemically synthesized
agatgccagcagatcagctc

SEQ ID NO: 293332 - DNA, 20 bp, Artificial Sequence
  chemically synthesized
aagatgccagcagatcagct

SEQ ID NO: 293333 - DNA, 20 bp, Artificial Sequence
  chemically synthesized
cagggcctgagctgatctgc

SEQ ID NO: 293334 - DNA, 20 bp, Artificial Sequence
  chemically synthesized
actgcaagatgccagcagat

SEQ ID NO: 293335 - DNA, 20 bp, Artificial Sequence
  chemically synthesized
agaaaactgcaagatgccag

SEQ ID NO: 293336 - DNA, 20 bp, Artificial Sequence
  chemically synthesized
ttcagaaaactgcaagatgc

SEQ ID NO: 293337 - DNA, 20 bp, Artificial Sequence
  chemically synthesized
gctgatctgctggcatcttg

SEQ ID NO: 293338 - DNA, 20 bp, Artificial Sequence
  chemically synthesized
tgagaagttcagaaaactgc

SEQ ID NO: 293339 - DNA, 20 bp, Artificial Sequence
  chemically synthesized
ttgcagttttctgaacttct

SEQ ID NO: 293340 - DNA, 20 bp, Artificial Sequence
  chemically synthesized
cgagaaaaagctgagaagtt

SEQ ID NO: 293341 - DNA, 20 bp, Artificial Sequence
  chemically synthesized
tagagcgagaaaaagctgag

SEQ ID NO: 293342 - DNA, 20 bp, Artificial Sequence
  chemically synthesized
ccatagagcgagaaaaagct

SEQ ID NO: 293343 - DNA, 20 bp, Artificial Sequence
  chemically synthesized
gcaggccatagagcgagaaa

SEQ ID NO: 293344 - DNA, 20 bp, Artificial Sequence
  chemically synthesized
ctcagctttttctcgctcta

SEQ ID NO: 293345 - DNA, 20 bp, Artificial Sequence
  chemically synthesized
catgctgcaggccatagagc

SEQ ID NO: 293346 - DNA, 20 bp, Artificial Sequence
  chemically synthesized
ctctcatgctgcaggccata

SEQ ID NO: 293347 - DNA, 20 bp, Artificial Sequence
  chemically synthesized
ttttctcgctctatggcctg

SEQ ID NO: 293348 - DNA, 20 bp, Artificial Sequence
  chemically synthesized
tgctctcatgctgcaggcca

SEQ ID NO: 293349 - DNA, 20 bp, Artificial Sequence
  chemically synthesized
cgctctatggcctgcagcat

SEQ ID NO: 293350 - DNA, 20 bp, Artificial Sequence
  chemically synthesized
catctttgctctcatgctgc

SEQ ID NO: 293351 - DNA, 20 bp, Artificial Sequence
  chemically synthesized
tcatctttgctctcatgctg

SEQ ID NO: 293352 - DNA, 20 bp, Artificial Sequence
  chemically synthesized
ctctatggcctgcagcatga

SEQ ID NO: 293353 - DNA, 20 bp, Artificial Sequence
  chemically synthesized
tggcctgcagcatgagagca

SEQ ID NO: 293354 - DNA, 20 bp, Artificial Sequence
  chemically synthesized
tgcagcatgagagcaaagat

SEQ ID NO: 293355 - DNA, 20 bp, Artificial Sequence
  chemically synthesized
aaagatgagtaattcaatac

SEQ ID NO: 293356 - DNA, 20 bp, Artificial Sequence
  chemically synthesized
aagatgagtaattcaataca

SEQ ID NO: 293357 - DNA, 20 bp, Artificial Sequence
  chemically synthesized
ataattattgtgtagattca

SEQ ID NO: 293358 - DNA, 20 bp, Artificial Sequence
  chemically synthesized
tagaagttataattattgtg

SEQ ID NO: 293359 - DNA, 20 bp, Artificial Sequence
  chemically synthesized
aggcttgaaagggcaagtag

SEQ ID NO: 293360 - DNA, 20 bp, Artificial Sequence
  chemically synthesized
ttaaggcttgaaagggcaag

SEQ ID NO: 293361 - DNA, 20 bp, Artificial Sequence
  chemically synthesized
atcttaaggcttgaaagggc

SEQ ID NO: 293362 - DNA, 20 bp, Artificial Sequence
  chemically synthesized
taacttctacttgccctttc

SEQ ID NO: 293363 - DNA, 20 bp, Artificial Sequence
  chemically synthesized
aaacatcttaaggcttgaaa

SEQ ID NO: 293364 - DNA, 20 bp, Artificial Sequence
  chemically synthesized
gaaacatcttaaggcttgaa

SEQ ID NO: 293365 - DNA, 20 bp, Artificial Sequence
  chemically synthesized
tgaaacatcttaaggcttga

SEQ ID NO: 293366 - DNA, 20 bp, Artificial Sequence
  chemically synthesized
tacttgccctttcaagcctt

SEQ ID NO: 293367 - DNA, 20 bp, Artificial Sequence
  chemically synthesized
tgacagagtgaaacatctta

SEQ ID NO: 293368 - DNA, 20 bp, Artificial Sequence
  chemically synthesized
ctgacagagtgaaacatctt

SEQ ID NO: 293369 - DNA, 20 bp, Artificial Sequence
  chemically synthesized
cttaagatgtttcactctgt

SEQ ID NO: 293370 - DNA, 20 bp, Artificial Sequence
  chemically synthesized
attcacgtgataagctgaca

SEQ ID NO: 293371 - DNA, 20 bp, Artificial Sequence
  chemically synthesized
agattcacgtgataagctga

SEQ ID NO: 293372 - DNA, 20 bp, Artificial Sequence
  chemically synthesized
agtctttagattcacgtgat

SEQ ID NO: 293373 - DNA, 20 bp, Artificial Sequence
  chemically synthesized
cagcttatcacgtgaatcta

SEQ ID NO: 293374 - DNA, 20 bp, Artificial Sequence
  chemically synthesized
aagtgttgagaaaaagtctt

SEQ ID NO: 293375 - DNA, 20 bp, Artificial Sequence
  chemically synthesized
atggcaaaagtgttgagaaa

SEQ ID NO: 293376 - DNA, 20 bp, Artificial Sequence
  chemically synthesized
tttttgatggcaaaagtgtt

SEQ ID NO: 293377 - DNA, 20 bp, Artificial Sequence
  chemically synthesized
tttgatgtttttgatggcaa

SEQ ID NO: 293378 - DNA, 20 bp, Artificial Sequence
  chemically synthesized
tgccattttgatgtttttga

SEQ ID NO: 293379 - DNA, 20 bp, Artificial Sequence
  chemically synthesized
tgccatcaaaaacatcaaaa

SEQ ID NO: 293380 - DNA, 20 bp, Artificial Sequence
  chemically synthesized
aaacatcaaaatggcaataa

SEQ ID NO: 293381 - DNA, 20 bp, Artificial Sequence
  chemically synthesized
caaaatggcaataaaagcat

SEQ ID NO: 293382 - DNA, 20 bp, Artificial Sequence
  chemically synthesized
gttgtagcaagtcatgaaaa

SEQ ID NO: 293383 - DNA, 20 bp, Artificial Sequence
  chemically synthesized
ttataattaaaagttgtagc

SEQ ID NO: 293384 - DNA, 20 bp, Artificial Sequence
  chemically synthesized
aatcttataattaaaagttg

SEQ ID NO: 293385 - DNA, 20 bp, Artificial Sequence
  chemically synthesized
agtagaaatcttataattaa

SEQ ID NO: 293386 - DNA, 20 bp, Artificial Sequence
  chemically synthesized
ttgctacaacttttaattat

SEQ ID NO: 293387 - DNA, 20 bp, Artificial Sequence
  chemically synthesized
ttaattataagatttctact

SEQ ID NO: 293388 - DNA, 20 bp, Artificial Sequence
  chemically synthesized
taatgtaaaaaaaagctgag

SEQ ID NO: 293389 - DNA, 20 bp, Artificial Sequence
  chemically synthesized
ctataatgtaaaaaaaagct

SEQ ID NO: 293390 - DNA, 20 bp, Artificial Sequence
  chemically synthesized
agaaactataatgtaaaaaa

SEQ ID NO: 293391 - DNA, 20 bp, Artificial Sequence
  chemically synthesized
ctcagcttttttttacatta

SEQ ID NO: 293392 - DNA, 20 bp, Artificial Sequence
  chemically synthesized
agtcttgcgttgaaatgtat

SEQ ID NO: 293393 - DNA, 20 bp, Artificial Sequence
  chemically synthesized
tttctgatacatttcaacgc

SEQ ID NO: 293394 - DNA, 20 bp, Artificial Sequence
  chemically synthesized
tttcaacgcaagactgcaaa

SEQ ID NO: 293395 - DNA, 20 bp, Artificial Sequence
  chemically synthesized
aattgcctttttactttttg

SEQ ID NO: 293396 - DNA, 20 bp, Artificial Sequence
  chemically synthesized
gcaagactgcaaaaagtaaa

SEQ ID NO: 293397 - DNA, 20 bp, Artificial Sequence
  chemically synthesized
caagactgcaaaaagtaaaa

SEQ ID NO: 293398 - DNA, 20 bp, Artificial Sequence
  chemically synthesized
aaggcaattcataacaatga

SEQ ID NO: 293399 - DNA, 20 bp, Artificial Sequence
  chemically synthesized
attcataacaatgaaagata

SEQ ID NO: 293400 - DNA, 20 bp, Artificial Sequence
  chemically synthesized
ttaaaagataaatttcattt

SEQ ID NO: 293401 - DNA, 20 bp, Artificial Sequence
  chemically synthesized
aaaatgaaatttatctttta

SEQ ID NO: 293402 - DNA, 20 bp, Artificial Sequence
  chemically synthesized
tttcaatggtgtatctttaa

SEQ ID NO: 293403 - DNA, 20 bp, Artificial Sequence
  chemically synthesized
atacttattagtaatttcaa

SEQ ID NO: 293404 - DNA, 20 bp, Artificial Sequence
  chemically synthesized
acaccattgaaattactaat

SEQ ID NO: 293405 - DNA, 20 bp, Artificial Sequence
  chemically synthesized
aataccgcctatatacttat

SEQ ID NO: 293406 - DNA, 20 bp, Artificial Sequence
  chemically synthesized
tgaaattactaataagtata

SEQ ID NO: 293407 - DNA, 20 bp, Artificial Sequence
  chemically synthesized
gaaattactaataagtatat

SEQ ID NO: 293408 - DNA, 20 bp, Artificial Sequence
  chemically synthesized
attactaataagtatatagg

SEQ ID NO: 293409 - DNA, 20 bp, Artificial Sequence
  chemically synthesized
gcggtattaaaaatcaaatt

SEQ ID NO: 293410 - DNA, 20 bp, Artificial Sequence
  chemically synthesized
taaaaatcaaattgagaatc

SEQ ID NO: 293411 - DNA, 20 bp, Artificial Sequence
  chemically synthesized
tttccatcttatatacatac

SEQ ID NO: 293412 - DNA, 20 bp, Artificial Sequence
  chemically synthesized
tgagaatccagtatgtatat

SEQ ID NO: 293413 - DNA, 20 bp, Artificial Sequence
  chemically synthesized
aatccagtatgtatataaga

SEQ ID NO: 293414 - DNA, 20 bp, Artificial Sequence
  chemically synthesized
ttctgctaaattatttatgg

SEQ ID NO: 293415 - DNA, 20 bp, Artificial Sequence
  chemically synthesized
tatttctgctaaattattta

SEQ ID NO: 293416 - DNA, 20 bp, Artificial Sequence
  chemically synthesized
ataaactaccataaataatt

SEQ ID NO: 293417 - DNA, 20 bp, Artificial Sequence
  chemically synthesized
aactaccataaataatttag

SEQ ID NO: 293418 - DNA, 20 bp, Artificial Sequence
  chemically synthesized
gtacatatatatttaaatac

SEQ ID NO: 293419 - DNA, 20 bp, Artificial Sequence
  chemically synthesized
tacatatatatttaaatacc

SEQ ID NO: 293420 - DNA, 20 bp, Artificial Sequence
  chemically synthesized
tatatttaaataccaggctg

SEQ ID NO: 293421 - DNA, 20 bp, Artificial Sequence
  chemically synthesized
atatttaaataccaggctgt

SEQ ID NO: 293422 - DNA, 20 bp, Artificial Sequence
  chemically synthesized
agaaaaattagcctacagcc

SEQ ID NO: 293423 - DNA, 20 bp, Artificial Sequence
  chemically synthesized
ttgaaagaaaaattagccta

SEQ ID NO: 293424 - DNA, 20 bp, Artificial Sequence
  chemically synthesized
attatttttgaaagaaaaat

SEQ ID NO: 293425 - DNA, 20 bp, Artificial Sequence
  chemically synthesized
agtactttgattatttttga

SEQ ID NO: 293426 - DNA, 20 bp, Artificial Sequence
  chemically synthesized
ttttctttcaaaaataatca

SEQ ID NO: 293427 - DNA, 20 bp, Artificial Sequence
  chemically synthesized
cttgtcttccttggaaatag

SEQ ID NO: 293428 - DNA, 20 bp, Artificial Sequence
  chemically synthesized
atcaaagtactcctatttcc

SEQ ID NO: 293429 - DNA, 20 bp, Artificial Sequence
  chemically synthesized
tcaaagtactcctatttcca

SEQ ID NO: 293430 - DNA, 20 bp, Artificial Sequence
  chemically synthesized
atcttgtcttccttggaaat

SEQ ID NO: 293431 - DNA, 20 bp, Artificial Sequence
  chemically synthesized
aatcttgtcttccttggaaa

SEQ ID NO: 293432 - DNA, 20 bp, Artificial Sequence
  chemically synthesized
aagtactcctatttccaagg

SEQ ID NO: 293433 - DNA, 20 bp, Artificial Sequence
  chemically synthesized
aaactcaatcttgtcttcct

SEQ ID NO: 293434 - DNA, 20 bp, Artificial Sequence
  chemically synthesized
ctcctatttccaaggaagac

SEQ ID NO: 293435 - DNA, 20 bp, Artificial Sequence
  chemically synthesized
tttccaaggaagacaagatt

SEQ ID NO: 293436 - DNA, 20 bp, Artificial Sequence
  chemically synthesized
gggaaataaaggaattcaga

SEQ ID NO: 293437 - DNA, 20 bp, Artificial Sequence
  chemically synthesized
ttaagggaaataaaggaatt

SEQ ID NO: 293438 - DNA, 20 bp, Artificial Sequence
  chemically synthesized
gtaactcttaagggaaataa

SEQ ID NO: 293439 - DNA, 20 bp, Artificial Sequence
  chemically synthesized
tgtaactcttaagggaaata

SEQ ID NO: 293440 - DNA, 20 bp, Artificial Sequence
  chemically synthesized
tgaattcctttatttccctt

SEQ ID NO: 293441 - DNA, 20 bp, Artificial Sequence
  chemically synthesized
aattcctttatttcccttaa

SEQ ID NO: 293442 - DNA, 20 bp, Artificial Sequence
  chemically synthesized
gttcaaaatgtaactcttaa

SEQ ID NO: 293443 - DNA, 20 bp, Artificial Sequence
  chemically synthesized
ggttcaaaatgtaactctta

SEQ ID NO: 293444 - DNA, 20 bp, Artificial Sequence
  chemically synthesized
tggttcaaaatgtaactctt

SEQ ID NO: 293445 - DNA, 20 bp, Artificial Sequence
  chemically synthesized
ctgaaataattttgcatttg

SEQ ID NO: 293446 - DNA, 20 bp, Artificial Sequence
  chemically synthesized
ccacaaatgcaaaattattt

SEQ ID NO: 293447 - DNA, 20 bp, Artificial Sequence
  chemically synthesized
aaaattatttcagttaacaa

SEQ ID NO: 293448 - DNA, 20 bp, Artificial Sequence
  chemically synthesized
ttatttcagttaacaatagc

SEQ ID NO: 293449 - DNA, 20 bp, Artificial Sequence
  chemically synthesized
aactcaatagtatgaaattc

SEQ ID NO: 293450 - DNA, 20 bp, Artificial Sequence
  chemically synthesized
agccagaatttcatactatt

SEQ ID NO: 293451 - DNA, 20 bp, Artificial Sequence
  chemically synthesized
gaatttcatactattgagtt

SEQ ID NO: 293452 - DNA, 20 bp, Artificial Sequence
  chemically synthesized
atattattagctaaactcaa

SEQ ID NO: 293453 - DNA, 20 bp, Artificial Sequence
  chemically synthesized
tgtctccataggaatattat

SEQ ID NO: 293454 - DNA, 20 bp, Artificial Sequence
  chemically synthesized
tttagctaataatattccta

SEQ ID NO: 293455 - DNA, 20 bp, Artificial Sequence
  chemically synthesized
tagctaataatattcctatg

SEQ ID NO: 293456 - DNA, 20 bp, Artificial Sequence
  chemically synthesized
tttaaaatttatgtctccat

SEQ ID NO: 293457 - DNA, 20 bp, Artificial Sequence
  chemically synthesized
gtttaaaatttatgtctcca

SEQ ID NO: 293458 - DNA, 20 bp, Artificial Sequence
  chemically synthesized
acataaattttaaactatga

SEQ ID NO: 293459 - DNA, 20 bp, Artificial Sequence
  chemically synthesized
ataaattttaaactatgaca

SEQ ID NO: 293460 - DNA, 20 bp, Artificial Sequence
  chemically synthesized
aatgtagttctactctgtca

SEQ ID NO: 293461 - DNA, 20 bp, Artificial Sequence
  chemically synthesized
aattttaaactatgacagag

SEQ ID NO: 293462 - DNA, 20 bp, Artificial Sequence
  chemically synthesized
tcttgatgattatagtaatg

SEQ ID NO: 293463 - DNA, 20 bp, Artificial Sequence
  chemically synthesized
tcaacacttcttgatgatta

SEQ ID NO: 293464 - DNA, 20 bp, Artificial Sequence
  chemically synthesized
actacattactataatcatc

SEQ ID NO: 293465 - DNA, 20 bp, Artificial Sequence
  chemically synthesized
acattactataatcatcaag

SEQ ID NO: 293466 - DNA, 20 bp, Artificial Sequence
  chemically synthesized
ttaggacatacacattgtta

SEQ ID NO: 293467 - DNA, 20 bp, Artificial Sequence
  chemically synthesized
tatttgaatagttatgtttt

SEQ ID NO: 293468 - DNA, 20 bp, Artificial Sequence
  chemically synthesized
ttatttgaatagttatgttt

SEQ ID NO: 293469 - DNA, 20 bp, Artificial Sequence
  chemically synthesized
ttgcgttatagttatttgaa

SEQ ID NO: 293470 - DNA, 20 bp, Artificial Sequence
  chemically synthesized
actatattttaattgcgtta

SEQ ID NO: 293471 - DNA, 20 bp, Artificial Sequence
  chemically synthesized
actataacgcaattaaaata

SEQ ID NO: 293472 - DNA, 20 bp, Artificial Sequence
  chemically synthesized
taacgcaattaaaatatagt

SEQ ID NO: 293473 - DNA, 20 bp, Artificial Sequence
  chemically synthesized
taatatgattgttaagtcac

SEQ ID NO: 293474 - DNA, 20 bp, Artificial Sequence
  chemically synthesized
ataatatgattgttaagtca

SEQ ID NO: 293475 - DNA, 20 bp, Artificial Sequence
  chemically synthesized
tttgttataatatgattgtt

SEQ ID NO: 293476 - DNA, 20 bp, Artificial Sequence
  chemically synthesized
ttaacaatcatattataaca

SEQ ID NO: 293477 - DNA, 20 bp, Artificial Sequence
  chemically synthesized
accttctgcctcaaattcaa

SEQ ID NO: 293478 - DNA, 20 bp, Artificial Sequence
  chemically synthesized
caaagatttctcttgaattt

SEQ ID NO: 293479 - DNA, 20 bp, Artificial Sequence
  chemically synthesized
aaagatttctcttgaatttg

SEQ ID NO: 293480 - DNA, 20 bp, Artificial Sequence
  chemically synthesized
taaccttctgcctcaaattc

SEQ ID NO: 293481 - DNA, 20 bp, Artificial Sequence
  chemically synthesized
gatttctcttgaatttgagg

SEQ ID NO: 293482 - DNA, 20 bp, Artificial Sequence
  chemically synthesized
ttctcttgaatttgaggcag

SEQ ID NO: 293483 - DNA, 20 bp, Artificial Sequence
  chemically synthesized
tctcttgaatttgaggcaga

SEQ ID NO: 293484 - DNA, 20 bp, Artificial Sequence
  chemically synthesized
ggcagaaggttattctacat

SEQ ID NO: 293485 - DNA, 20 bp, Artificial Sequence
  chemically synthesized
tcttaaaaaatagtctcatg

SEQ ID NO: 293486 - DNA, 20 bp, Artificial Sequence
  chemically synthesized
tctacatgagactatttttt

SEQ ID NO: 293487 - DNA, 20 bp, Artificial Sequence
  chemically synthesized
gtaaatgaagtcttaaaaaa

SEQ ID NO: 293488 - DNA, 20 bp, Artificial Sequence
  chemically synthesized
aatgcctgtggatgtaaatg

SEQ ID NO: 293489 - DNA, 20 bp, Artificial Sequence
  chemically synthesized
taagacttcatttacatcca

SEQ ID NO: 293490 - DNA, 20 bp, Artificial Sequence
  chemically synthesized
aagacttcatttacatccac

SEQ ID NO: 293491 - DNA, 20 bp, Artificial Sequence
  chemically synthesized
aatatttttttaaatgcctg

SEQ ID NO: 293492 - DNA, 20 bp, Artificial Sequence
  chemically synthesized
ggcatttaaaaaaatatttc

SEQ ID NO: 293493 - DNA, 20 bp, Artificial Sequence
  chemically synthesized
gcatttaaaaaaatatttcc

SEQ ID NO: 293494 - DNA, 20 bp, Artificial Sequence
  chemically synthesized
ctgtactccagtattttacc

SEQ ID NO: 293495 - DNA, 20 bp, Artificial Sequence
  chemically synthesized
aatatttccaggtaaaatac

SEQ ID NO: 293496 - DNA, 20 bp, Artificial Sequence
  chemically synthesized
tatttccaggtaaaatactg

SEQ ID NO: 293497 - DNA, 20 bp, Artificial Sequence
  chemically synthesized
ccaggtaaaatactggagta

SEQ ID NO: 293498 - DNA, 20 bp, Artificial Sequence
  chemically synthesized
ttgccctcccatctgtactc

SEQ ID NO: 293499 - DNA, 20 bp, Artificial Sequence
  chemically synthesized
gtaaaatactggagtacaga

SEQ ID NO: 293500 - DNA, 20 bp, Artificial Sequence
  chemically synthesized
taaaatactggagtacagat

SEQ ID NO: 293501 - DNA, 20 bp, Artificial Sequence
  chemically synthesized
aaatactggagtacagatgg

SEQ ID NO: 293502 - DNA, 20 bp, Artificial Sequence
  chemically synthesized
aatactggagtacagatggg

SEQ ID NO: 293503 - DNA, 20 bp, Artificial Sequence
  chemically synthesized
atactggagtacagatggga

SEQ ID NO: 293504 - DNA, 20 bp, Artificial Sequence
  chemically synthesized
acagatgggagggcaaataa

SEQ ID NO: 293505 - DNA, 20 bp, Artificial Sequence
  chemically synthesized
gagggcaaataacagataca

SEQ ID NO: 293506 - DNA, 20 bp, Artificial Sequence
  chemically synthesized
gcaaataacagatacatgga

SEQ ID NO: 293507 - DNA, 20 bp, Artificial Sequence
  chemically synthesized
atttatactcaacagtggtg

SEQ ID NO: 293508 - DNA, 20 bp, Artificial Sequence
  chemically synthesized
ggacagtctgcaccactgtt

SEQ ID NO: 293509 - DNA, 20 bp, Artificial Sequence
  chemically synthesized
cacaaatttatactcaacag

SEQ ID NO: 293510 - DNA, 20 bp, Artificial Sequence
  chemically synthesized
ctgcacaaatttatactcaa

SEQ ID NO: 293511 - DNA, 20 bp, Artificial Sequence
  chemically synthesized
ctgttgagtataaatttgtg

SEQ ID NO: 293512 - DNA, 20 bp, Artificial Sequence
  chemically synthesized
tgttgagtataaatttgtgc

SEQ ID NO: 293513 - DNA, 20 bp, Artificial Sequence
  chemically synthesized
gttgagtataaatttgtgca

SEQ ID NO: 293514 - DNA, 20 bp, Artificial Sequence
  chemically synthesized
agtataaatttgtgcaggga

SEQ ID NO: 293515 - DNA, 20 bp, Artificial Sequence
  chemically synthesized
catattggatgacacagata

SEQ ID NO: 293516 - DNA, 20 bp, Artificial Sequence
  chemically synthesized
ggctatcatattggatgaca

SEQ ID NO: 293517 - DNA, 20 bp, Artificial Sequence
  chemically synthesized
atctgtgtcatccaatatga

SEQ ID NO: 293518 - DNA, 20 bp, Artificial Sequence
  chemically synthesized
gtggttattggctatcatat

SEQ ID NO: 293519 - DNA, 20 bp, Artificial Sequence
  chemically synthesized
gaatacccacatgtggttat

SEQ ID NO: 293520 - DNA, 20 bp, Artificial Sequence
  chemically synthesized
tgatagccaataaccacatg

SEQ ID NO: 293521 - DNA, 20 bp, Artificial Sequence
  chemically synthesized
gatagccaataaccacatgt

SEQ ID NO: 293522 - DNA, 20 bp, Artificial Sequence
  chemically synthesized
aagtgctgaatacccacatg

SEQ ID NO: 293523 - DNA, 20 bp, Artificial Sequence
  chemically synthesized
aataaccacatgtgggtatt

SEQ ID NO: 293524 - DNA, 20 bp, Artificial Sequence
  chemically synthesized
tgtgggtattcagcacttga

SEQ ID NO: 293525 - DNA, 20 bp, Artificial Sequence
  chemically synthesized
gtgggtattcagcacttgaa

SEQ ID NO: 293526 - DNA, 20 bp, Artificial Sequence
  chemically synthesized
ggtattcagcacttgaaagg

SEQ ID NO: 293527 - DNA, 20 bp, Artificial Sequence
  chemically synthesized
agtcatgctgaccacctttc

SEQ ID NO: 293528 - DNA, 20 bp, Artificial Sequence
  chemically synthesized
ttcagcacttgaaaggtggt

SEQ ID NO: 293529 - DNA, 20 bp, Artificial Sequence
  chemically synthesized
ttaaatattcttttattttc

SEQ ID NO: 293530 - DNA, 20 bp, Artificial Sequence
  chemically synthesized
tcagcatgacttgaaaataa

SEQ ID NO: 293531 - DNA, 20 bp, Artificial Sequence
  chemically synthesized
ttatttaaaataaataaaat

SEQ ID NO: 293532 - DNA, 20 bp, Artificial Sequence
  chemically synthesized
tttaaataatttaaaattta

SEQ ID NO: 293533 - DNA, 20 bp, Artificial Sequence
  chemically synthesized
ttaaataatttaaaatttaa

SEQ ID NO: 293534 - DNA, 20 bp, Artificial Sequence
  chemically synthesized
atttaaaggttacatgtgac

SEQ ID NO: 293535 - DNA, 20 bp, Artificial Sequence
  chemically synthesized
tgtacaatcacagttaacac

SEQ ID NO: 293536 - DNA, 20 bp, Artificial Sequence
  chemically synthesized
agatctgcgctgtacaatca

SEQ ID NO: 293537 - DNA, 20 bp, Artificial Sequence
  chemically synthesized
cagtgttaactgtgattgta

SEQ ID NO: 293538 - DNA, 20 bp, Artificial Sequence
  chemically synthesized
ttaactgtgattgtacagcg

SEQ ID NO: 293539 - DNA, 20 bp, Artificial Sequence
  chemically synthesized
ttgcttttaaaggaatgtat

SEQ ID NO: 293540 - DNA, 20 bp, Artificial Sequence
  chemically synthesized
gatctaatacattcctttaa

SEQ ID NO: 293541 - DNA, 20 bp, Artificial Sequence
  chemically synthesized
tcttaactatttgcttttaa

SEQ ID NO: 293542 - DNA, 20 bp, Artificial Sequence
  chemically synthesized
ctcttaactatttgctttta

SEQ ID NO: 293543 - DNA, 20 bp, Artificial Sequence
  chemically synthesized
tacattcctttaaaagcaaa

SEQ ID NO: 293544 - DNA, 20 bp, Artificial Sequence
  chemically synthesized
tcctttaaaagcaaatagtt

SEQ ID NO: 293545 - DNA, 20 bp, Artificial Sequence
  chemically synthesized
ctttaaaagcaaatagttaa

SEQ ID NO: 293546 - DNA, 20 bp, Artificial Sequence
  chemically synthesized
aaaagcaaatagttaagaga

SEQ ID NO: 293547 - DNA, 20 bp, Artificial Sequence
  chemically synthesized
aaagcaaatagttaagagat

SEQ ID NO: 293548 - DNA, 20 bp, Artificial Sequence
  chemically synthesized
aagagataggcctgtaatcc

SEQ ID NO: 293549 - DNA, 20 bp, Artificial Sequence
  chemically synthesized
ttctgagtagctcggattac

SEQ ID NO: 293550 - DNA, 20 bp, Artificial Sequence
  chemically synthesized
cttctgagtagctcggatta

SEQ ID NO: 293551 - DNA, 20 bp, Artificial Sequence
  chemically synthesized
ggcctgtaatccgagctact

SEQ ID NO: 293552 - DNA, 20 bp, Artificial Sequence
  chemically synthesized
cccaggccttctgagtagct

SEQ ID NO: 293553 - DNA, 20 bp, Artificial Sequence
  chemically synthesized
ctgtaatccgagctactcag

SEQ ID NO: 293554 - DNA, 20 bp, Artificial Sequence
  chemically synthesized
tgtaatccgagctactcaga

SEQ ID NO: 293555 - DNA, 20 bp, Artificial Sequence
  chemically synthesized
tcctgcccaggccttctgag

SEQ ID NO: 293556 - DNA, 20 bp, Artificial Sequence
  chemically synthesized
tcttcctgcccaggccttct

SEQ ID NO: 293557 - DNA, 20 bp, Artificial Sequence
  chemically synthesized
tccgagctactcagaaggcc

SEQ ID NO: 293558 - DNA, 20 bp, Artificial Sequence
  chemically synthesized
ccgagctactcagaaggcct

SEQ ID NO: 293559 - DNA, 20 bp, Artificial Sequence
  chemically synthesized
agctactcagaaggcctggg

SEQ ID NO: 293560 - DNA, 20 bp, Artificial Sequence
  chemically synthesized
gctactcagaaggcctgggc

SEQ ID NO: 293561 - DNA, 20 bp, Artificial Sequence
  chemically synthesized
actcagaaggcctgggcagg

SEQ ID NO: 293562 - DNA, 20 bp, Artificial Sequence
  chemically synthesized
ctgaagcagtcttcctgccc

SEQ ID NO: 293563 - DNA, 20 bp, Artificial Sequence
  chemically synthesized
actgaagcagtcttcctgcc

SEQ ID NO: 293564 - DNA, 20 bp, Artificial Sequence
  chemically synthesized
cctgggcaggaagactgctt

SEQ ID NO: 293565 - DNA, 20 bp, Artificial Sequence
  chemically synthesized
ctcaaatccctggactgaag

SEQ ID NO: 293566 - DNA, 20 bp, Artificial Sequence
  chemically synthesized
gcaggaagactgcttcagtc

SEQ ID NO: 293567 - DNA, 20 bp, Artificial Sequence
  chemically synthesized
caggaagactgcttcagtcc

SEQ ID NO: 293568 - DNA, 20 bp, Artificial Sequence
  chemically synthesized
aggaagactgcttcagtcca

SEQ ID NO: 293569 - DNA, 20 bp, Artificial Sequence
  chemically synthesized
gatctcaaatccctggactg

SEQ ID NO: 293570 - DNA, 20 bp, Artificial Sequence
  chemically synthesized
ctgcttcagtccagggattt

SEQ ID NO: 293571 - DNA, 20 bp, Artificial Sequence
  chemically synthesized
ctaggctgatctcaaatccc

SEQ ID NO: 293572 - DNA, 20 bp, Artificial Sequence
  chemically synthesized
tcagtccagggatttgagat

SEQ ID NO: 293573 - DNA, 20 bp, Artificial Sequence
  chemically synthesized
ccagggatttgagatcagcc

SEQ ID NO: 293574 - DNA, 20 bp, Artificial Sequence
  chemically synthesized
cagggatttgagatcagcct

SEQ ID NO: 293575 - DNA, 20 bp, Artificial Sequence
  chemically synthesized
gaggtctctcgattttgcct

SEQ ID NO: 293576 - DNA, 20 bp, Artificial Sequence
  chemically synthesized
ggaggtctctcgattttgcc

SEQ ID NO: 293577 - DNA, 20 bp, Artificial Sequence
  chemically synthesized
agatcagcctaggcaaaatc

SEQ ID NO: 293578 - DNA, 20 bp, Artificial Sequence
  chemically synthesized
atcagcctaggcaaaatcga

SEQ ID NO: 293579 - DNA, 20 bp, Artificial Sequence
  chemically synthesized
aattgtttgtttagagatgg

SEQ ID NO: 293580 - DNA, 20 bp, Artificial Sequence
  chemically synthesized
aaattgtttgtttagagatg

SEQ ID NO: 293581 - DNA, 20 bp, Artificial Sequence
  chemically synthesized
taaaattgtttgtttagaga

SEQ ID NO: 293582 - DNA, 20 bp, Artificial Sequence
  chemically synthesized
tttttaaaattgtttgttta

SEQ ID NO: 293583 - DNA, 20 bp, Artificial Sequence
  chemically synthesized
attttttaaaattgtttgtt

SEQ ID NO: 293584 - DNA, 20 bp, Artificial Sequence
  chemically synthesized
aacaaacaattttaaaaaat

SEQ ID NO: 293585 - DNA, 20 bp, Artificial Sequence
  chemically synthesized
aacaattttaaaaaattagt

SEQ ID NO: 293586 - DNA, 20 bp, Artificial Sequence
  chemically synthesized
acaattttaaaaaattagtc

SEQ ID NO: 293587 - DNA, 20 bp, Artificial Sequence
  chemically synthesized
tttaaaaaattagtcaggcg

SEQ ID NO: 293588 - DNA, 20 bp, Artificial Sequence
  chemically synthesized
aaattagtcaggcgtggtga

SEQ ID NO: 293589 - DNA, 20 bp, Artificial Sequence
  chemically synthesized
aattagtcaggcgtggtgac

SEQ ID NO: 293590 - DNA, 20 bp, Artificial Sequence
  chemically synthesized
ttagtcaggcgtggtgacag

SEQ ID NO: 293591 - DNA, 20 bp, Artificial Sequence
  chemically synthesized
ggcgtggtgacaggagcctg

SEQ ID NO: 293592 - DNA, 20 bp, Artificial Sequence
  chemically synthesized
gtgacaggagcctgtagtcc

SEQ ID NO: 293593 - DNA, 20 bp, Artificial Sequence
  chemically synthesized
tcctgagtagctgggactac

SEQ ID NO: 293594 - DNA, 20 bp, Artificial Sequence
  chemically synthesized
ttcctgagtagctgggacta

SEQ ID NO: 293595 - DNA, 20 bp, Artificial Sequence
  chemically synthesized
agcctgtagtcccagctact

SEQ ID NO: 293596 - DNA, 20 bp, Artificial Sequence
  chemically synthesized
cctcagattcctgagtagct

SEQ ID NO: 293597 - DNA, 20 bp, Artificial Sequence
  chemically synthesized
gcctgtagtcccagctactc

SEQ ID NO: 293598 - DNA, 20 bp, Artificial Sequence
  chemically synthesized
gcctcagattcctgagtagc

SEQ ID NO: 293599 - DNA, 20 bp, Artificial Sequence
  chemically synthesized
ttctgcctcagattcctgag

SEQ ID NO: 293600 - DNA, 20 bp, Artificial Sequence
  chemically synthesized
tccttctgcctcagattcct

SEQ ID NO: 293601 - DNA, 20 bp, Artificial Sequence
  chemically synthesized
tcccagctactcaggaatct

SEQ ID NO: 293602 - DNA, 20 bp, Artificial Sequence
  chemically synthesized
cccagctactcaggaatctg

SEQ ID NO: 293603 - DNA, 20 bp, Artificial Sequence
  chemically synthesized
agctactcaggaatctgagg

SEQ ID NO: 293604 - DNA, 20 bp, Artificial Sequence
  chemically synthesized
tactcaggaatctgaggcag

SEQ ID NO: 293605 - DNA, 20 bp, Artificial Sequence
  chemically synthesized
actcaggaatctgaggcaga

SEQ ID NO: 293606 - DNA, 20 bp, Artificial Sequence
  chemically synthesized
ctcaagcagtccttctgcct

SEQ ID NO: 293607 - DNA, 20 bp, Artificial Sequence
  chemically synthesized
ctgaggcagaaggactgctt

SEQ ID NO: 293608 - DNA, 20 bp, Artificial Sequence
  chemically synthesized
ctcagactactgtgctcaag

SEQ ID NO: 293609 - DNA, 20 bp, Artificial Sequence
  chemically synthesized
gcagaaggactgcttgagca

SEQ ID NO: 293610 - DNA, 20 bp, Artificial Sequence
  chemically synthesized
ctactcagactactgtgctc

SEQ ID NO: 293611 - DNA, 20 bp, Artificial Sequence
  chemically synthesized
gaaggactgcttgagcacag

SEQ ID NO: 293612 - DNA, 20 bp, Artificial Sequence
  chemically synthesized
ctgcttgagcacagtagtct

SEQ ID NO: 293613 - DNA, 20 bp, Artificial Sequence
  chemically synthesized
cttgagcacagtagtctgag

SEQ ID NO: 293614 - DNA, 20 bp, Artificial Sequence
  chemically synthesized
ttgagcacagtagtctgagt

SEQ ID NO: 293615 - DNA, 20 bp, Artificial Sequence
  chemically synthesized
atagttcgttgcagcctact

SEQ ID NO: 293616 - DNA, 20 bp, Artificial Sequence
  chemically synthesized
ggcgcaatgatagttcgttg

SEQ ID NO: 293617 - DNA, 20 bp, Artificial Sequence
  chemically synthesized
ggagtacagtggcgcaatga

SEQ ID NO: 293618 - DNA, 20 bp, Artificial Sequence
  chemically synthesized
tcgcccaggctggagtacag

SEQ ID NO: 293619 - DNA, 20 bp, Artificial Sequence
  chemically synthesized
atcattgcgccactgtactc

SEQ ID NO: 293620 - DNA, 20 bp, Artificial Sequence
  chemically synthesized
ctgtcgcccaggctggagta

SEQ ID NO: 293621 - DNA, 20 bp, Artificial Sequence
  chemically synthesized
tgcgccactgtactccagcc

SEQ ID NO: 293622 - DNA, 20 bp, Artificial Sequence
  chemically synthesized
gcgccactgtactccagcct

SEQ ID NO: 293623 - DNA, 20 bp, Artificial Sequence
  chemically synthesized
tccctctgtcgcccaggctg

SEQ ID NO: 293624 - DNA, 20 bp, Artificial Sequence
  chemically synthesized
tttccctctgtcgcccaggc

SEQ ID NO: 293625 - DNA, 20 bp, Artificial Sequence
  chemically synthesized
ctgtactccagcctgggcga

SEQ ID NO: 293626 - DNA, 20 bp, Artificial Sequence
  chemically synthesized
agagtttccctctgtcgccc

SEQ ID NO: 293627 - DNA, 20 bp, Artificial Sequence
  chemically synthesized
gtactccagcctgggcgaca

SEQ ID NO: 293628 - DNA, 20 bp, Artificial Sequence
  chemically synthesized
aagagtttccctctgtcgcc

SEQ ID NO: 293629 - DNA, 20 bp, Artificial Sequence
  chemically synthesized
tactccagcctgggcgacag

SEQ ID NO: 293630 - DNA, 20 bp, Artificial Sequence
  chemically synthesized
actccagcctgggcgacaga

SEQ ID NO: 293631 - DNA, 20 bp, Artificial Sequence
  chemically synthesized
tattgccatattatatgaaa

SEQ ID NO: 293632 - DNA, 20 bp, Artificial Sequence
  chemically synthesized
gatattgccatattatatga

SEQ ID NO: 293633 - DNA, 20 bp, Artificial Sequence
  chemically synthesized
ggaaactctttcatataata

SEQ ID NO: 293634 - DNA, 20 bp, Artificial Sequence
  chemically synthesized
ttcatataatatggcaatat

SEQ ID NO: 293635 - DNA, 20 bp, Artificial Sequence
  chemically synthesized
taatatggcaatatcagaaa

SEQ ID NO: 293636 - DNA, 20 bp, Artificial Sequence
  chemically synthesized
ggcaatatcagaaatagttg

SEQ ID NO: 293637 - DNA, 20 bp, Artificial Sequence
  chemically synthesized
caatatcagaaatagttgca

SEQ ID NO: 293638 - DNA, 20 bp, Artificial Sequence
  chemically synthesized
cagaaatagttgcagagaaa

SEQ ID NO: 293639 - DNA, 20 bp, Artificial Sequence
  chemically synthesized
gcagagaaaaagtaatcatc

SEQ ID NO: 293640 - DNA, 20 bp, Artificial Sequence
  chemically synthesized
gcttagtaaatagtgttgtc

SEQ ID NO: 293641 - DNA, 20 bp, Artificial Sequence
  chemically synthesized
tctagacaacactatttact

SEQ ID NO: 293642 - DNA, 20 bp, Artificial Sequence
  chemically synthesized
aatttaatgtgcttagtaaa

SEQ ID NO: 293643 - DNA, 20 bp, Artificial Sequence
  chemically synthesized
tttacataatttaatgtgct

SEQ ID NO: 293644 - DNA, 20 bp, Artificial Sequence
  chemically synthesized
aaatatgtggattattgtat

SEQ ID NO: 293645 - DNA, 20 bp, Artificial Sequence
  chemically synthesized
ttcagatacataaaaatatg

SEQ ID NO: 293646 - DNA, 20 bp, Artificial Sequence
  chemically synthesized
catatttttatgtatctgaa

SEQ ID NO: 293647 - DNA, 20 bp, Artificial Sequence
  chemically synthesized
tttaaattagatagtctttt

SEQ ID NO: 293648 - DNA, 20 bp, Artificial Sequence
  chemically synthesized
agctatttctttaaattaga

SEQ ID NO: 293649 - DNA, 20 bp, Artificial Sequence
  chemically synthesized
tgaaaagactatctaattta

SEQ ID NO: 293650 - DNA, 20 bp, Artificial Sequence
  chemically synthesized
ttgtagctatttctttaaat

SEQ ID NO: 293651 - DNA, 20 bp, Artificial Sequence
  chemically synthesized
gactatctaatttaaagaaa

SEQ ID NO: 293652 - DNA, 20 bp, Artificial Sequence
  chemically synthesized
aacaaaaagctttacatttg

SEQ ID NO: 293653 - DNA, 20 bp, Artificial Sequence
  chemically synthesized
aagaaatagctacaaatgta

SEQ ID NO: 293654 - DNA, 20 bp, Artificial Sequence
  chemically synthesized
caaagagaaacaaaaacaaa

SEQ ID NO: 293655 - DNA, 20 bp, Artificial Sequence
  chemically synthesized
ttttgtttttgtttctcttt

SEQ ID NO: 293656 - DNA, 20 bp, Artificial Sequence
  chemically synthesized
gtttttgtttctctttgaga

SEQ ID NO: 293657 - DNA, 20 bp, Artificial Sequence
  chemically synthesized
gagtgagactctgtctcaaa

SEQ ID NO: 293658 - DNA, 20 bp, Artificial Sequence
  chemically synthesized
ttttgtttctctttgagaca

SEQ ID NO: 293659 - DNA, 20 bp, Artificial Sequence
  chemically synthesized
cagagtgagactctgtctca

SEQ ID NO: 293660 - DNA, 20 bp, Artificial Sequence
  chemically synthesized
tccagcctgggcgacagagt

SEQ ID NO: 293661 - DNA, 20 bp, Artificial Sequence
  chemically synthesized
cagagtctcactctgtcgcc

SEQ ID NO: 293662 - DNA, 20 bp, Artificial Sequence
  chemically synthesized
gcactccagcctgggcgaca

SEQ ID NO: 293663 - DNA, 20 bp, Artificial Sequence
  chemically synthesized
agagtctcactctgtcgccc

SEQ ID NO: 293664 - DNA, 20 bp, Artificial Sequence
  chemically synthesized
ctgcactccagcctgggcga

SEQ ID NO: 293665 - DNA, 20 bp, Artificial Sequence
  chemically synthesized
tctcactctgtcgcccaggc

SEQ ID NO: 293666 - DNA, 20 bp, Artificial Sequence
  chemically synthesized
tcactctgtcgcccaggctg

SEQ ID NO: 293667 - DNA, 20 bp, Artificial Sequence
  chemically synthesized
atgccactgcactccagcct

SEQ ID NO: 293668 - DNA, 20 bp, Artificial Sequence
  chemically synthesized
catgccactgcactccagcc

SEQ ID NO: 293669 - DNA, 20 bp, Artificial Sequence
  chemically synthesized
ctgtcgcccaggctggagtg

SEQ ID NO: 293670 - DNA, 20 bp, Artificial Sequence
  chemically synthesized
gagatcatgccactgcactc

SEQ ID NO: 293671 - DNA, 20 bp, Artificial Sequence
  chemically synthesized
tcgcccaggctggagtgcag

SEQ ID NO: 293672 - DNA, 20 bp, Artificial Sequence
  chemically synthesized
ggagtgcagtggcatgatct

SEQ ID NO: 293673 - DNA, 20 bp, Artificial Sequence
  chemically synthesized
ggcagaggttgcagtgagct

SEQ ID NO: 293674 - DNA, 20 bp, Artificial Sequence
  chemically synthesized
cgggaggcagaggttgcagt

SEQ ID NO: 293675 - DNA, 20 bp, Artificial Sequence
  chemically synthesized
aacccgggaggcagaggttg

SEQ ID NO: 293676 - DNA, 20 bp, Artificial Sequence
  chemically synthesized
tgcttgaacccgggaggcag

SEQ ID NO: 293677 - DNA, 20 bp, Artificial Sequence
  chemically synthesized
tcactgcaacctctgcctcc

SEQ ID NO: 293678 - DNA, 20 bp, Artificial Sequence
  chemically synthesized
ttgcttgaacccgggaggca

SEQ ID NO: 293679 - DNA, 20 bp, Artificial Sequence
  chemically synthesized
cactgcaacctctgcctccc

SEQ ID NO: 293680 - DNA, 20 bp, Artificial Sequence
  chemically synthesized
agttgcttgaacccgggagg

SEQ ID NO: 293681 - DNA, 20 bp, Artificial Sequence
  chemically synthesized
gagagttgcttgaacccggg

SEQ ID NO: 293682 - DNA, 20 bp, Artificial Sequence
  chemically synthesized
ggagagttgcttgaacccgg

SEQ ID NO: 293683 - DNA, 20 bp, Artificial Sequence
  chemically synthesized
aacctctgcctcccgggttc

SEQ ID NO: 293684 - DNA, 20 bp, Artificial Sequence
  chemically synthesized
caggagagttgcttgaaccc

SEQ ID NO: 293685 - DNA, 20 bp, Artificial Sequence
  chemically synthesized
gcaggagagttgcttgaacc

SEQ ID NO: 293686 - DNA, 20 bp, Artificial Sequence
  chemically synthesized
ctcgggaggctgaagcagga

SEQ ID NO: 293687 - DNA, 20 bp, Artificial Sequence
  chemically synthesized
ttcaagcaactctcctgctt

SEQ ID NO: 293688 - DNA, 20 bp, Artificial Sequence
  chemically synthesized
tactcgggaggctgaagcag

SEQ ID NO: 293689 - DNA, 20 bp, Artificial Sequence
  chemically synthesized
gctactcgggaggctgaagc

SEQ ID NO: 293690 - DNA, 20 bp, Artificial Sequence
  chemically synthesized
ggctactcgggaggctgaag

SEQ ID NO: 293691 - DNA, 20 bp, Artificial Sequence
  chemically synthesized
cccggctactcgggaggctg

SEQ ID NO: 293692 - DNA, 20 bp, Artificial Sequence
  chemically synthesized
ctctcctgcttcagcctccc

SEQ ID NO: 293693 - DNA, 20 bp, Artificial Sequence
  chemically synthesized
tcctgcttcagcctcccgag

SEQ ID NO: 293694 - DNA, 20 bp, Artificial Sequence
  chemically synthesized
tgtaatcccggctactcggg

SEQ ID NO: 293695 - DNA, 20 bp, Artificial Sequence
  chemically synthesized
ctgtaatcccggctactcgg

SEQ ID NO: 293696 - DNA, 20 bp, Artificial Sequence
  chemically synthesized
gcttcagcctcccgagtagc

SEQ ID NO: 293697 - DNA, 20 bp, Artificial Sequence
  chemically synthesized
gcctgtaatcccggctactc

SEQ ID NO: 293698 - DNA, 20 bp, Artificial Sequence
  chemically synthesized
cttcagcctcccgagtagcc

SEQ ID NO: 293699 - DNA, 20 bp, Artificial Sequence
  chemically synthesized
cgcctgtaatcccggctact

SEQ ID NO: 293700 - DNA, 20 bp, Artificial Sequence
  chemically synthesized
ctcccgagtagccgggatta

SEQ ID NO: 293701 - DNA, 20 bp, Artificial Sequence
  chemically synthesized
tcccgagtagccgggattac

SEQ ID NO: 293702 - DNA, 20 bp, Artificial Sequence
  chemically synthesized
gtggtgcacgcctgtaatcc

SEQ ID NO: 293703 - DNA, 20 bp, Artificial Sequence
  chemically synthesized
caggcgtgcaccaccacgcc

SEQ ID NO: 293704 - DNA, 20 bp, Artificial Sequence
  chemically synthesized
caaaaattagctgggcgtgg

SEQ ID NO: 293705 - DNA, 20 bp, Artificial Sequence
  chemically synthesized
atacaaaaattagctgggcg

SEQ ID NO: 293706 - DNA, 20 bp, Artificial Sequence
  chemically synthesized
taaaaatacaaaaattagct

SEQ ID NO: 293707 - DNA, 20 bp, Artificial Sequence
  chemically synthesized
ctaaaaatacaaaaattagc

SEQ ID NO: 293708 - DNA, 20 bp, Artificial Sequence
  chemically synthesized
tctactaaaaatacaaaaat

SEQ ID NO: 293709 - DNA, 20 bp, Artificial Sequence
  chemically synthesized
ccagctaatttttgtatttt

SEQ ID NO: 293710 - DNA, 20 bp, Artificial Sequence
  chemically synthesized
gctaatttttgtatttttag

SEQ ID NO: 293711 - DNA, 20 bp, Artificial Sequence
  chemically synthesized
taatttttgtatttttagta

SEQ ID NO: 293712 - DNA, 20 bp, Artificial Sequence
  chemically synthesized
ttttgtatttttagtagaga

SEQ ID NO: 293713 - DNA, 20 bp, Artificial Sequence
  chemically synthesized
tttgtatttttagtagagac

SEQ ID NO: 293714 - DNA, 20 bp, Artificial Sequence
  chemically synthesized
ttgtatttttagtagagaca

SEQ ID NO: 293715 - DNA, 20 bp, Artificial Sequence
  chemically synthesized
gagacagggtttcaccatgt

SEQ ID NO: 293716 - DNA, 20 bp, Artificial Sequence
  chemically synthesized
cagggtttcaccatgttggc

SEQ ID NO: 293717 - DNA, 20 bp, Artificial Sequence
  chemically synthesized
tgagaccagcctggccaaca

SEQ ID NO: 293718 - DNA, 20 bp, Artificial Sequence
  chemically synthesized
agggtttcaccatgttggcc

SEQ ID NO: 293719 - DNA, 20 bp, Artificial Sequence
  chemically synthesized
tttcaccatgttggccaggc

SEQ ID NO: 293720 - DNA, 20 bp, Artificial Sequence
  chemically synthesized
tcaggagtttgagaccagcc

SEQ ID NO: 293721 - DNA, 20 bp, Artificial Sequence
  chemically synthesized
tgaggtcaggagtttgagac

SEQ ID NO: 293722 - DNA, 20 bp, Artificial Sequence
  chemically synthesized
gatgatgaggtcaggagttt

SEQ ID NO: 293723 - DNA, 20 bp, Artificial Sequence
  chemically synthesized
tgggcggatgatgaggtcag

SEQ ID NO: 293724 - DNA, 20 bp, Artificial Sequence
  chemically synthesized
gctgggcggatgatgaggtc

SEQ ID NO: 293725 - DNA, 20 bp, Artificial Sequence
  chemically synthesized
agctgggcggatgatgaggt

SEQ ID NO: 293726 - DNA, 20 bp, Artificial Sequence
  chemically synthesized
actgagctgggcggatgatg

SEQ ID NO: 293727 - DNA, 20 bp, Artificial Sequence
  chemically synthesized
cactgagctgggcggatgat

SEQ ID NO: 293728 - DNA, 20 bp, Artificial Sequence
  chemically synthesized
tcctgacctcatcatccgcc

SEQ ID NO: 293729 - DNA, 20 bp, Artificial Sequence
  chemically synthesized
acctcatcatccgcccagct

SEQ ID NO: 293730 - DNA, 20 bp, Artificial Sequence
  chemically synthesized
caccccagcactgagctggg

SEQ ID NO: 293731 - DNA, 20 bp, Artificial Sequence
  chemically synthesized
ccccaccccagcactgagct

SEQ ID NO: 293732 - DNA, 20 bp, Artificial Sequence
  chemically synthesized
gccccaccccagcactgagc

SEQ ID NO: 293733 - DNA, 20 bp, Artificial Sequence
  chemically synthesized
tcatccgcccagctcagtgc

SEQ ID NO: 293734 - DNA, 20 bp, Artificial Sequence
  chemically synthesized
catccgcccagctcagtgct

SEQ ID NO: 293735 - DNA, 20 bp, Artificial Sequence
  chemically synthesized
atccgcccagctcagtgctg

SEQ ID NO: 293736 - DNA, 20 bp, Artificial Sequence
  chemically synthesized
ccccgccccaccccagcact

SEQ ID NO: 293737 - DNA, 20 bp, Artificial Sequence
  chemically synthesized
cgcccagctcagtgctgggg

SEQ ID NO: 293738 - DNA, 20 bp, Artificial Sequence
  chemically synthesized
gcccagctcagtgctggggt

SEQ ID NO: 293739 - DNA, 20 bp, Artificial Sequence
  chemically synthesized
cccagctcagtgctggggtg

SEQ ID NO: 293740 - DNA, 20 bp, Artificial Sequence
  chemically synthesized
gtaatccccccgccccaccc

SEQ ID NO: 293741 - DNA, 20 bp, Artificial Sequence
  chemically synthesized
agctcagtgctggggtgggg

SEQ ID NO: 293742 - DNA, 20 bp, Artificial Sequence
  chemically synthesized
gctcagtgctggggtggggc

SEQ ID NO: 293743 - DNA, 20 bp, Artificial Sequence
  chemically synthesized
ctcagtgctggggtggggcg

SEQ ID NO: 293744 - DNA, 20 bp, Artificial Sequence
  chemically synthesized
tcagtgctggggtggggcgg

SEQ ID NO: 293745 - DNA, 20 bp, Artificial Sequence
  chemically synthesized
cagtgctggggtggggcggg

SEQ ID NO: 293746 - DNA, 20 bp, Artificial Sequence
  chemically synthesized
ggggtggggcggggggatta

SEQ ID NO: 293747 - DNA, 20 bp, Artificial Sequence
  chemically synthesized
gggtggggcggggggattac

SEQ ID NO: 293748 - DNA, 20 bp, Artificial Sequence
  chemically synthesized
ggcggggggattacaggtgt

SEQ ID NO: 293749 - DNA, 20 bp, Artificial Sequence
  chemically synthesized
caggtgtgagccaccgtgcc

SEQ ID NO: 293750 - DNA, 20 bp, Artificial Sequence
  chemically synthesized
tttattcaggccaggcacgg

SEQ ID NO: 293751 - DNA, 20 bp, Artificial Sequence
  chemically synthesized
acctttattcaggccaggca

SEQ ID NO: 293752 - DNA, 20 bp, Artificial Sequence
  chemically synthesized
agaaaacctttattcaggcc

SEQ ID NO: 293753 - DNA, 20 bp, Artificial Sequence
  chemically synthesized
aagaaaacctttattcaggc

SEQ ID NO: 293754 - DNA, 20 bp, Artificial Sequence
  chemically synthesized
caccgtgcctggcctgaata

SEQ ID NO: 293755 - DNA, 20 bp, Artificial Sequence
  chemically synthesized
accgtgcctggcctgaataa

SEQ ID NO: 293756 - DNA, 20 bp, Artificial Sequence
  chemically synthesized
ttttaagaaaacctttattc

SEQ ID NO: 293757 - DNA, 20 bp, Artificial Sequence
  chemically synthesized
tttttaagaaaacctttatt

SEQ ID NO: 293758 - DNA, 20 bp, Artificial Sequence
  chemically synthesized
actctttaaaataaattttt

SEQ ID NO: 293759 - DNA, 20 bp, Artificial Sequence
  chemically synthesized
tttcttaaaaatttatttta

SEQ ID NO: 293760 - DNA, 20 bp, Artificial Sequence
  chemically synthesized
tcttaaaaatttattttaaa

SEQ ID NO: 293761 - DNA, 20 bp, Artificial Sequence
  chemically synthesized
tttattttaaagagtttcct

SEQ ID NO: 293762 - DNA, 20 bp, Artificial Sequence
  chemically synthesized
attttaaagagtttcctaag

SEQ ID NO: 293763 - DNA, 20 bp, Artificial Sequence
  chemically synthesized
ttttaaagagtttcctaagt

SEQ ID NO: 293764 - DNA, 20 bp, Artificial Sequence
  chemically synthesized
ttaaagagtttcctaagtgg

SEQ ID NO: 293765 - DNA, 20 bp, Artificial Sequence
  chemically synthesized
tatcgtcaggtctcccactt

SEQ ID NO: 293766 - DNA, 20 bp, Artificial Sequence
  chemically synthesized
atatcgtcaggtctcccact

SEQ ID NO: 293767 - DNA, 20 bp, Artificial Sequence
  chemically synthesized
ccttgaagtcagatatcgtc

SEQ ID NO: 293768 - DNA, 20 bp, Artificial Sequence
  chemically synthesized
gccttgaagtcagatatcgt

SEQ ID NO: 293769 - DNA, 20 bp, Artificial Sequence
  chemically synthesized
acctgacgatatctgacttc

SEQ ID NO: 293770 - DNA, 20 bp, Artificial Sequence
  chemically synthesized
cctgacgatatctgacttca

SEQ ID NO: 293771 - DNA, 20 bp, Artificial Sequence
  chemically synthesized
tttatatcaagccttgaagt

SEQ ID NO: 293772 - DNA, 20 bp, Artificial Sequence
  chemically synthesized
cagttttatatcaagccttg

SEQ ID NO: 293773 - DNA, 20 bp, Artificial Sequence
  chemically synthesized
gattactgcagttttatatc

SEQ ID NO: 293774 - DNA, 20 bp, Artificial Sequence
  chemically synthesized
caaggcttgatataaaactg

SEQ ID NO: 293775 - DNA, 20 bp, Artificial Sequence
  chemically synthesized
ttactctgtcttgattactg

SEQ ID NO: 293776 - DNA, 20 bp, Artificial Sequence
  chemically synthesized
gatataaaactgcagtaatc

SEQ ID NO: 293777 - DNA, 20 bp, Artificial Sequence
  chemically synthesized
taaaactgcagtaatcaaga

SEQ ID NO: 293778 - DNA, 20 bp, Artificial Sequence
  chemically synthesized
aaactgcagtaatcaagaca

SEQ ID NO: 293779 - DNA, 20 bp, Artificial Sequence
  chemically synthesized
taatcaagacagagtaatat

SEQ ID NO: 293780 - DNA, 20 bp, Artificial Sequence
  chemically synthesized
agacagagtaatattggcaa

SEQ ID NO: 293781 - DNA, 20 bp, Artificial Sequence
  chemically synthesized
gagtaatattggcaaaagaa

SEQ ID NO: 293782 - DNA, 20 bp, Artificial Sequence
  chemically synthesized
aatattggcaaaagaacaga

SEQ ID NO: 293783 - DNA, 20 bp, Artificial Sequence
  chemically synthesized
atattggcaaaagaacagac

SEQ ID NO: 293784 - DNA, 20 bp, Artificial Sequence
  chemically synthesized
agaacagacaggtaaatcaa

SEQ ID NO: 293785 - DNA, 20 bp, Artificial Sequence
  chemically synthesized
agacaggtaaatcaatggaa

SEQ ID NO: 293786 - DNA, 20 bp, Artificial Sequence
  chemically synthesized
ggtaaatcaatggaacagaa

SEQ ID NO: 293787 - DNA, 20 bp, Artificial Sequence
  chemically synthesized
aatcaatggaacagaataga

SEQ ID NO: 293788 - DNA, 20 bp, Artificial Sequence
  chemically synthesized
atggaacagaatagaaagct

SEQ ID NO: 293789 - DNA, 20 bp, Artificial Sequence
  chemically synthesized
cagaatagaaagctcagaaa

SEQ ID NO: 293790 - DNA, 20 bp, Artificial Sequence
  chemically synthesized
atttatgtggatctgtttct

SEQ ID NO: 293791 - DNA, 20 bp, Artificial Sequence
  chemically synthesized
atcaattgattatatttatg

SEQ ID NO: 293792 - DNA, 20 bp, Artificial Sequence
  chemically synthesized
aaatataatcaattgatttt

SEQ ID NO: 293793 - DNA, 20 bp, Artificial Sequence
  chemically synthesized
taatcaattgatttttggca

SEQ ID NO: 293794 - DNA, 20 bp, Artificial Sequence
  chemically synthesized
aatcaattgatttttggcaa

SEQ ID NO: 293795 - DNA, 20 bp, Artificial Sequence
  chemically synthesized
tgatttttggcaaaggaacc

SEQ ID NO: 293796 - DNA, 20 bp, Artificial Sequence
  chemically synthesized
gatttttggcaaaggaacca

SEQ ID NO: 293797 - DNA, 20 bp, Artificial Sequence
  chemically synthesized
ttttctccactgtattgcct

SEQ ID NO: 293798 - DNA, 20 bp, Artificial Sequence
  chemically synthesized
gcaaaggaaccaaggcaata

SEQ ID NO: 293799 - DNA, 20 bp, Artificial Sequence
  chemically synthesized
aaggaaccaaggcaatacag

SEQ ID NO: 293800 - DNA, 20 bp, Artificial Sequence
  chemically synthesized
ggaaccaaggcaatacagtg

SEQ ID NO: 293801 - DNA, 20 bp, Artificial Sequence
  chemically synthesized
aaggcaatacagtggagaaa

SEQ ID NO: 293802 - DNA, 20 bp, Artificial Sequence
  chemically synthesized
tgttcaggaccatttgttta

SEQ ID NO: 293803 - DNA, 20 bp, Artificial Sequence
  chemically synthesized
agaaaaagtctttaaacaaa

SEQ ID NO: 293804 - DNA, 20 bp, Artificial Sequence
  chemically synthesized
atgtagatgttgtgttgttc

SEQ ID NO: 293805 - DNA, 20 bp, Artificial Sequence
  chemically synthesized
catgtagatgttgtgttgtt

SEQ ID NO: 293806 - DNA, 20 bp, Artificial Sequence
  chemically synthesized
tagataaacttttttgcatg

SEQ ID NO: 293807 - DNA, 20 bp, Artificial Sequence
  chemically synthesized
cacaacatctacatgcaaaa

SEQ ID NO: 293808 - DNA, 20 bp, Artificial Sequence
  chemically synthesized
tacatgcaaaaaagtttatc

SEQ ID NO: 293809 - DNA, 20 bp, Artificial Sequence
  chemically synthesized
acatgcaaaaaagtttatct

SEQ ID NO: 293810 - DNA, 20 bp, Artificial Sequence
  chemically synthesized
aagggtgtaaggtttatgcc

SEQ ID NO: 293811 - DNA, 20 bp, Artificial Sequence
  chemically synthesized
taaaacaaaagaagggtgta

SEQ ID NO: 293812 - DNA, 20 bp, Artificial Sequence
  chemically synthesized
ttaaaacaaaagaagggtgt

SEQ ID NO: 293813 - DNA, 20 bp, Artificial Sequence
  chemically synthesized
ttgtaattaaaacaaaagaa

SEQ ID NO: 293814 - DNA, 20 bp, Artificial Sequence
  chemically synthesized
attgtaattaaaacaaaaga

SEQ ID NO: 293815 - DNA, 20 bp, Artificial Sequence
  chemically synthesized
aattgtaattaaaacaaaag

SEQ ID NO: 293816 - DNA, 20 bp, Artificial Sequence
  chemically synthesized
aataattgtaattaaaacaa

SEQ ID NO: 293817 - DNA, 20 bp, Artificial Sequence
  chemically synthesized
taacatgaaagtaaataaat

SEQ ID NO: 293818 - DNA, 20 bp, Artificial Sequence
  chemically synthesized
tgatccagtgaataacatga

SEQ ID NO: 293819 - DNA, 20 bp, Artificial Sequence
  chemically synthesized
tttactttcatgttattcac

SEQ ID NO: 293820 - DNA, 20 bp, Artificial Sequence
  chemically synthesized
aacttccaatgaagttgatc

SEQ ID NO: 293821 - DNA, 20 bp, Artificial Sequence
  chemically synthesized
attcactggatcaacttcat

SEQ ID NO: 293822 - DNA, 20 bp, Artificial Sequence
  chemically synthesized
cactggatcaacttcattgg

SEQ ID NO: 293823 - DNA, 20 bp, Artificial Sequence
  chemically synthesized
aaaagtataaacttccaatg

SEQ ID NO: 293824 - DNA, 20 bp, Artificial Sequence
  chemically synthesized
ttggaagtttatacttttga

SEQ ID NO: 293825 - DNA, 20 bp, Artificial Sequence
  chemically synthesized
gtcagatatttcaccatcaa

SEQ ID NO: 293826 - DNA, 20 bp, Artificial Sequence
  chemically synthesized
gataaaattcacaataatgt

SEQ ID NO: 293827 - DNA, 20 bp, Artificial Sequence
  chemically synthesized
tattcaatgttgaaatttta

SEQ ID NO: 293828 - DNA, 20 bp, Artificial Sequence
  chemically synthesized
agcccatgttatcatttgta

SEQ ID NO: 293829 - DNA, 20 bp, Artificial Sequence
  chemically synthesized
tatctgtacaaatgataaca

SEQ ID NO: 293830 - DNA, 20 bp, Artificial Sequence
  chemically synthesized
atctgtacaaatgataacat

SEQ ID NO: 293831 - DNA, 20 bp, Artificial Sequence
  chemically synthesized
gtacaaatgataacatgggc

SEQ ID NO: 293832 - DNA, 20 bp, Artificial Sequence
  chemically synthesized
tacaaatgataacatgggct

SEQ ID NO: 293833 - DNA, 20 bp, Artificial Sequence
  chemically synthesized
atgataacatgggctgggtg

SEQ ID NO: 293834 - DNA, 20 bp, Artificial Sequence
  chemically synthesized
ataacatgggctgggtgcag

SEQ ID NO: 293835 - DNA, 20 bp, Artificial Sequence
  chemically synthesized
caggtgtgagccactgcacc

SEQ ID NO: 293836 - DNA, 20 bp, Artificial Sequence
  chemically synthesized
agtgctgggattacaggtgt

SEQ ID NO: 293837 - DNA, 20 bp, Artificial Sequence
  chemically synthesized
gtggctcacacctgtaatcc

SEQ ID NO: 293838 - DNA, 20 bp, Artificial Sequence
  chemically synthesized
ccccaaagtgctgggattac

SEQ ID NO: 293839 - DNA, 20 bp, Artificial Sequence
  chemically synthesized
cccccaaagtgctgggatta

SEQ ID NO: 293840 - DNA, 20 bp, Artificial Sequence
  chemically synthesized
cacctgtaatcccagcactt

SEQ ID NO: 293841 - DNA, 20 bp, Artificial Sequence
  chemically synthesized
cgttggccccccaaagtgct

SEQ ID NO: 293842 - DNA, 20 bp, Artificial Sequence
  chemically synthesized
acctgtaatcccagcacttt

SEQ ID NO: 293843 - DNA, 20 bp, Artificial Sequence
  chemically synthesized
gcgttggccccccaaagtgc

SEQ ID NO: 293844 - DNA, 20 bp, Artificial Sequence
  chemically synthesized
cctgtaatcccagcactttg

SEQ ID NO: 293845 - DNA, 20 bp, Artificial Sequence
  chemically synthesized
ctgtaatcccagcactttgg

SEQ ID NO: 293846 - DNA, 20 bp, Artificial Sequence
  chemically synthesized
tgtaatcccagcactttggg

SEQ ID NO: 293847 - DNA, 20 bp, Artificial Sequence
  chemically synthesized
ccacccgcgttggcccccca

SEQ ID NO: 293848 - DNA, 20 bp, Artificial Sequence
  chemically synthesized
agcactttggggggccaacg

SEQ ID NO: 293849 - DNA, 20 bp, Artificial Sequence
  chemically synthesized
gcactttggggggccaacgc

SEQ ID NO: 293850 - DNA, 20 bp, Artificial Sequence
  chemically synthesized
ctttggggggccaacgcggg

SEQ ID NO: 293851 - DNA, 20 bp, Artificial Sequence
  chemically synthesized
ctcaggtgatccacccgcgt

SEQ ID NO: 293852 - DNA, 20 bp, Artificial Sequence
  chemically synthesized
ccaacgcgggtggatcacct

SEQ ID NO: 293853 - DNA, 20 bp, Artificial Sequence
  chemically synthesized
caacgcgggtggatcacctg

SEQ ID NO: 293854 - DNA, 20 bp, Artificial Sequence
  chemically synthesized
gcgggtggatcacctgaggt

SEQ ID NO: 293855 - DNA, 20 bp, Artificial Sequence
  chemically synthesized
cgggtggatcacctgaggtc

SEQ ID NO: 293856 - DNA, 20 bp, Artificial Sequence
  chemically synthesized
ggtctcgaactcccgacctc

SEQ ID NO: 293857 - DNA, 20 bp, Artificial Sequence
  chemically synthesized
ggtggatcacctgaggtcgg

SEQ ID NO: 293858 - DNA, 20 bp, Artificial Sequence
  chemically synthesized
tggtctcgaactcccgacct

SEQ ID NO: 293859 - DNA, 20 bp, Artificial Sequence
  chemically synthesized
tcacctgaggtcgggagttc

SEQ ID NO: 293860 - DNA, 20 bp, Artificial Sequence
  chemically synthesized
tgaggtcgggagttcgagac

SEQ ID NO: 293861 - DNA, 20 bp, Artificial Sequence
  chemically synthesized
tcgggagttcgagaccagcc

SEQ ID NO: 293862 - DNA, 20 bp, Artificial Sequence
  chemically synthesized
tttcaccatgttggccaggc

SEQ ID NO: 293863 - DNA, 20 bp, Artificial Sequence
  chemically synthesized
agggtttcaccatgttggcc

SEQ ID NO: 293864 - DNA, 20 bp, Artificial Sequence
  chemically synthesized
cgagaccagcctggccaaca

SEQ ID NO: 293865 - DNA, 20 bp, Artificial Sequence
  chemically synthesized
cagggtttcaccatgttggc

SEQ ID NO: 293866 - DNA, 20 bp, Artificial Sequence
  chemically synthesized
gagacagggtttcaccatgt

SEQ ID NO: 293867 - DNA, 20 bp, Artificial Sequence
  chemically synthesized
ttgtatttttagtagagaca

SEQ ID NO: 293868 - DNA, 20 bp, Artificial Sequence
  chemically synthesized
tttgtatttttagtagagac

SEQ ID NO: 293869 - DNA, 20 bp, Artificial Sequence
  chemically synthesized
gtttgtatttttagtagaga

SEQ ID NO: 293870 - DNA, 20 bp, Artificial Sequence
  chemically synthesized
ttatgtttgtatttttagta

SEQ ID NO: 293871 - DNA, 20 bp, Artificial Sequence
  chemically synthesized
aattatgtttgtatttttag

SEQ ID NO: 293872 - DNA, 20 bp, Artificial Sequence
  chemically synthesized
gataattatgtttgtatttt

SEQ ID NO: 293873 - DNA, 20 bp, Artificial Sequence
  chemically synthesized
aaaatacaaacataattatc

SEQ ID NO: 293874 - DNA, 20 bp, Artificial Sequence
  chemically synthesized
aaatacaaacataattatct

SEQ ID NO: 293875 - DNA, 20 bp, Artificial Sequence
  chemically synthesized
caaacataattatctgggca

SEQ ID NO: 293876 - DNA, 20 bp, Artificial Sequence
  chemically synthesized
acataattatctgggcatgg

SEQ ID NO: 293877 - DNA, 20 bp, Artificial Sequence
  chemically synthesized
taggtgcctgccaccatgcc

SEQ ID NO: 293878 - DNA, 20 bp, Artificial Sequence
  chemically synthesized
taattatctgggcatggtgg

SEQ ID NO: 293879 - DNA, 20 bp, Artificial Sequence
  chemically synthesized
aattatctgggcatggtggc

SEQ ID NO: 293880 - DNA, 20 bp, Artificial Sequence
  chemically synthesized
gtggcaggcacctataatcc

SEQ ID NO: 293881 - DNA, 20 bp, Artificial Sequence
  chemically synthesized
tccagagtagctgggattat

SEQ ID NO: 293882 - DNA, 20 bp, Artificial Sequence
  chemically synthesized
ctccagagtagctgggatta

SEQ ID NO: 293883 - DNA, 20 bp, Artificial Sequence
  chemically synthesized
cctcagcctccagagtagct

SEQ ID NO: 293884 - DNA, 20 bp, Artificial Sequence
  chemically synthesized
acctataatcccagctactc

SEQ ID NO: 293885 - DNA, 20 bp, Artificial Sequence
  chemically synthesized
gcctcagcctccagagtagc

SEQ ID NO: 293886 - DNA, 20 bp, Artificial Sequence
  chemically synthesized
ctataatcccagctactctg

SEQ ID NO: 293887 - DNA, 20 bp, Artificial Sequence
  chemically synthesized
tataatcccagctactctgg

SEQ ID NO: 293888 - DNA, 20 bp, Artificial Sequence
  chemically synthesized
tcctgcctcagcctccagag

SEQ ID NO: 293889 - DNA, 20 bp, Artificial Sequence
  chemically synthesized
ttttcctgcctcagcctcca

SEQ ID NO: 293890 - DNA, 20 bp, Artificial Sequence
  chemically synthesized
tcccagctactctggaggct

SEQ ID NO: 293891 - DNA, 20 bp, Artificial Sequence
  chemically synthesized
cccagctactctggaggctg

SEQ ID NO: 293892 - DNA, 20 bp, Artificial Sequence
  chemically synthesized
gattttcctgcctcagcctc

SEQ ID NO: 293893 - DNA, 20 bp, Artificial Sequence
  chemically synthesized
agctactctggaggctgagg

SEQ ID NO: 293894 - DNA, 20 bp, Artificial Sequence
  chemically synthesized
gctactctggaggctgaggc

SEQ ID NO: 293895 - DNA, 20 bp, Artificial Sequence
  chemically synthesized
ttcaagggattttcctgcct

SEQ ID NO: 293896 - DNA, 20 bp, Artificial Sequence
  chemically synthesized
gcaggaaaatcccttgaacc

SEQ ID NO: 293897 - DNA, 20 bp, Artificial Sequence
  chemically synthesized
cctctgcctcccgggttcaa

SEQ ID NO: 293898 - DNA, 20 bp, Artificial Sequence
  chemically synthesized
caggaaaatcccttgaaccc

SEQ ID NO: 293899 - DNA, 20 bp, Artificial Sequence
  chemically synthesized
acctctgcctcccgggttca

SEQ ID NO: 293900 - DNA, 20 bp, Artificial Sequence
  chemically synthesized
aacctctgcctcccgggttc

SEQ ID NO: 293901 - DNA, 20 bp, Artificial Sequence
  chemically synthesized
ggaaaatcccttgaacccgg

SEQ ID NO: 293902 - DNA, 20 bp, Artificial Sequence
  chemically synthesized
gaaaatcccttgaacccggg

SEQ ID NO: 293903 - DNA, 20 bp, Artificial Sequence
  chemically synthesized
aatcccttgaacccgggagg

SEQ ID NO: 293904 - DNA, 20 bp, Artificial Sequence
  chemically synthesized
cactgcaacctctgcctccc

SEQ ID NO: 293905 - DNA, 20 bp, Artificial Sequence
  chemically synthesized
tcccttgaacccgggaggca

SEQ ID NO: 293906 - DNA, 20 bp, Artificial Sequence
  chemically synthesized
tcactgcaacctctgcctcc

SEQ ID NO: 293907 - DNA, 20 bp, Artificial Sequence
  chemically synthesized
cccttgaacccgggaggcag

SEQ ID NO: 293908 - DNA, 20 bp, Artificial Sequence
  chemically synthesized
aacccgggaggcagaggttg

SEQ ID NO: 293909 - DNA, 20 bp, Artificial Sequence
  chemically synthesized
cgggaggcagaggttgcagt

SEQ ID NO: 293910 - DNA, 20 bp, Artificial Sequence
  chemically synthesized
ggcagaggttgcagtgagcc

SEQ ID NO: 293911 - DNA, 20 bp, Artificial Sequence
  chemically synthesized
ggagtgcaatggtgtgatct

SEQ ID NO: 293912 - DNA, 20 bp, Artificial Sequence
  chemically synthesized
tcacccaggctggagtgcaa

SEQ ID NO: 293913 - DNA, 20 bp, Artificial Sequence
  chemically synthesized
gagatcacaccattgcactc

SEQ ID NO: 293914 - DNA, 20 bp, Artificial Sequence
  chemically synthesized
cacaccattgcactccagcc

SEQ ID NO: 293915 - DNA, 20 bp, Artificial Sequence
  chemically synthesized
acaccattgcactccagcct

SEQ ID NO: 293916 - DNA, 20 bp, Artificial Sequence
  chemically synthesized
ttactctgtcacccaggctg

SEQ ID NO: 293917 - DNA, 20 bp, Artificial Sequence
  chemically synthesized
tcttactctgtcacccaggc

SEQ ID NO: 293918 - DNA, 20 bp, Artificial Sequence
  chemically synthesized
ttgcactccagcctgggtga

SEQ ID NO: 293919 - DNA, 20 bp, Artificial Sequence
  chemically synthesized
agagtcttactctgtcaccc

SEQ ID NO: 293920 - DNA, 20 bp, Artificial Sequence
  chemically synthesized
gcactccagcctgggtgaca

SEQ ID NO: 293921 - DNA, 20 bp, Artificial Sequence
  chemically synthesized
cagagtcttactctgtcacc

SEQ ID NO: 293922 - DNA, 20 bp, Artificial Sequence
  chemically synthesized
tccagcctgggtgacagagt

SEQ ID NO: 293923 - DNA, 20 bp, Artificial Sequence
  chemically synthesized
atttatttatttttgagaca

SEQ ID NO: 293924 - DNA, 20 bp, Artificial Sequence
  chemically synthesized
ttatttatttatttttgaga

SEQ ID NO: 293925 - DNA, 20 bp, Artificial Sequence
  chemically synthesized
tattttatttatttattttt

SEQ ID NO: 293926 - DNA, 20 bp, Artificial Sequence
  chemically synthesized
aacatgaacatatatttttg

SEQ ID NO: 293927 - DNA, 20 bp, Artificial Sequence
  chemically synthesized
acatatatttttgtggaaca

SEQ ID NO: 293928 - DNA, 20 bp, Artificial Sequence
  chemically synthesized
ttttgtggaacacagcatta

SEQ ID NO: 293929 - DNA, 20 bp, Artificial Sequence
  chemically synthesized
catgtgtatccaagaaaaca

SEQ ID NO: 293930 - DNA, 20 bp, Artificial Sequence
  chemically synthesized
ggttgaaaaccatgttttct

SEQ ID NO: 293931 - DNA, 20 bp, Artificial Sequence
  chemically synthesized
ctttatatccatgtgtatcc

SEQ ID NO: 293932 - DNA, 20 bp, Artificial Sequence
  chemically synthesized
catgttttcttggatacaca

SEQ ID NO: 293933 - DNA, 20 bp, Artificial Sequence
  chemically synthesized
cttggatacacatggatata

SEQ ID NO: 293934 - DNA, 20 bp, Artificial Sequence
  chemically synthesized
gatacacatggatataaaga

SEQ ID NO: 293935 - DNA, 20 bp, Artificial Sequence
  chemically synthesized
atacacatggatataaagat

SEQ ID NO: 293936 - DNA, 20 bp, Artificial Sequence
  chemically synthesized
atggatataaagatgggaac

SEQ ID NO: 293937 - DNA, 20 bp, Artificial Sequence
  chemically synthesized
gatgggaacaagaaacactg

SEQ ID NO: 293938 - DNA, 20 bp, Artificial Sequence
  chemically synthesized
ctccccactctagtagtccg

SEQ ID NO: 293939 - DNA, 20 bp, Artificial Sequence
  chemically synthesized
caagaaacactgcggactac

SEQ ID NO: 293940 - DNA, 20 bp, Artificial Sequence
  chemically synthesized
agaaacactgcggactacta

SEQ ID NO: 293941 - DNA, 20 bp, Artificial Sequence
  chemically synthesized
aacactgcggactactagag

SEQ ID NO: 293942 - DNA, 20 bp, Artificial Sequence
  chemically synthesized
acactgcggactactagagt

SEQ ID NO: 293943 - DNA, 20 bp, Artificial Sequence
  chemically synthesized
tcactccctccccactctag

SEQ ID NO: 293944 - DNA, 20 bp, Artificial Sequence
  chemically synthesized
cactgcggactactagagtg

SEQ ID NO: 293945 - DNA, 20 bp, Artificial Sequence
  chemically synthesized
ctgcggactactagagtggg

SEQ ID NO: 293946 - DNA, 20 bp, Artificial Sequence
  chemically synthesized
ccctcactccctccccactc

SEQ ID NO: 293947 - DNA, 20 bp, Artificial Sequence
  chemically synthesized
tgcggactactagagtgggg

SEQ ID NO: 293948 - DNA, 20 bp, Artificial Sequence
  chemically synthesized
gcggactactagagtgggga

SEQ ID NO: 293949 - DNA, 20 bp, Artificial Sequence
  chemically synthesized
ggactactagagtggggagg

SEQ ID NO: 293950 - DNA, 20 bp, Artificial Sequence
  chemically synthesized
tactagagtggggagggagt

SEQ ID NO: 293951 - DNA, 20 bp, Artificial Sequence
  chemically synthesized
actagagtggggagggagtg

SEQ ID NO: 293952 - DNA, 20 bp, Artificial Sequence
  chemically synthesized
ctagagtggggagggagtga

SEQ ID NO: 293953 - DNA, 20 bp, Artificial Sequence
  chemically synthesized
tagagtggggagggagtgag

SEQ ID NO: 293954 - DNA, 20 bp, Artificial Sequence
  chemically synthesized
tggggagggagtgaggggaa

SEQ ID NO: 293955 - DNA, 20 bp, Artificial Sequence
  chemically synthesized
ggggagggagtgaggggaaa

SEQ ID NO: 293956 - DNA, 20 bp, Artificial Sequence
  chemically synthesized
tgaggggaaaaggtccaaaa

SEQ ID NO: 293957 - DNA, 20 bp, Artificial Sequence
  chemically synthesized
ggggaaaaggtccaaaatag

SEQ ID NO: 293958 - DNA, 20 bp, Artificial Sequence
  chemically synthesized
gtatccaatagctactattt

SEQ ID NO: 293959 - DNA, 20 bp, Artificial Sequence
  chemically synthesized
aggtccaaaatagtagctat

SEQ ID NO: 293960 - DNA, 20 bp, Artificial Sequence
  chemically synthesized
gtgctgagcatagtatccaa

SEQ ID NO: 293961 - DNA, 20 bp, Artificial Sequence
  chemically synthesized
tagctattggatactatgct

SEQ ID NO: 293962 - DNA, 20 bp, Artificial Sequence
  chemically synthesized
ctgaggtttggtgctgagca

SEQ ID NO: 293963 - DNA, 20 bp, Artificial Sequence
  chemically synthesized
tgacactgaggtttggtgct

SEQ ID NO: 293964 - DNA, 20 bp, Artificial Sequence
  chemically synthesized
ctatgctcagcaccaaacct

SEQ ID NO: 293965 - DNA, 20 bp, Artificial Sequence
  chemically synthesized
tattgtgtgacactgaggtt

SEQ ID NO: 293966 - DNA, 20 bp, Artificial Sequence
  chemically synthesized
gtgtatattgtgtgacactg

SEQ ID NO: 293967 - DNA, 20 bp, Artificial Sequence
  chemically synthesized
tgtgtatattgtgtgacact

SEQ ID NO: 293968 - DNA, 20 bp, Artificial Sequence
  chemically synthesized
ggattcaagagtaaatgtgc

SEQ ID NO: 293969 - DNA, 20 bp, Artificial Sequence
  chemically synthesized
tggattcaagagtaaatgtg

SEQ ID NO: 293970 - DNA, 20 bp, Artificial Sequence
  chemically synthesized
atttcaacttttggattcaa

SEQ ID NO: 293971 - DNA, 20 bp, Artificial Sequence
  chemically synthesized
taatttcaacttttggattc

SEQ ID NO: 293972 - DNA, 20 bp, Artificial Sequence
  chemically synthesized
acatttactcttgaatccaa

SEQ ID NO: 293973 - DNA, 20 bp, Artificial Sequence
  chemically synthesized
ttttttataatttcaacttt

SEQ ID NO: 293974 - DNA, 20 bp, Artificial Sequence
  chemically synthesized
agtggaaatgtatttatttt

SEQ ID NO: 293975 - DNA, 20 bp, Artificial Sequence
  chemically synthesized
aaatacatttccactgaatt

SEQ ID NO: 293976 - DNA, 20 bp, Artificial Sequence
  chemically synthesized
acacaaatttctaaattcag

SEQ ID NO: 293977 - DNA, 20 bp, Artificial Sequence
  chemically synthesized
gttacacaaatttctaaatt

SEQ ID NO: 293978 - DNA, 20 bp, Artificial Sequence
  chemically synthesized
aaatttgtgtaactgcttga

SEQ ID NO: 293979 - DNA, 20 bp, Artificial Sequence
  chemically synthesized
acaccacaattactttcaag

SEQ ID NO: 293980 - DNA, 20 bp, Artificial Sequence
  chemically synthesized
tgaacaccacaattactttc

SEQ ID NO: 293981 - DNA, 20 bp, Artificial Sequence
  chemically synthesized
taactgcttgaaagtaattg

SEQ ID NO: 293982 - DNA, 20 bp, Artificial Sequence
  chemically synthesized
tggtgttcatataattcata

SEQ ID NO: 293983 - DNA, 20 bp, Artificial Sequence
  chemically synthesized
aattaataatgaatcaatca

SEQ ID NO: 293984 - DNA, 20 bp, Artificial Sequence
  chemically synthesized
aatgaatcaatcacagactc

SEQ ID NO: 293985 - DNA, 20 bp, Artificial Sequence
  chemically synthesized
tgaatcaatcacagactcta

SEQ ID NO: 293986 - DNA, 20 bp, Artificial Sequence
  chemically synthesized
tagttttacattttactcta

SEQ ID NO: 293987 - DNA, 20 bp, Artificial Sequence
  chemically synthesized
tatagttttacattttactc

SEQ ID NO: 293988 - DNA, 20 bp, Artificial Sequence
  chemically synthesized
gctatctgctaggagtttta

SEQ ID NO: 293989 - DNA, 20 bp, Artificial Sequence
  chemically synthesized
atgtaaaactataaaactcc

SEQ ID NO: 293990 - DNA, 20 bp, Artificial Sequence
  chemically synthesized
taaaactataaaactcctag

SEQ ID NO: 293991 - DNA, 20 bp, Artificial Sequence
  chemically synthesized
tctccactgctatctgctag

SEQ ID NO: 293992 - DNA, 20 bp, Artificial Sequence
  chemically synthesized
actataaaactcctagcaga

SEQ ID NO: 293993 - DNA, 20 bp, Artificial Sequence
  chemically synthesized
tttctccactgctatctgct

SEQ ID NO: 293994 - DNA, 20 bp, Artificial Sequence
  chemically synthesized
ttttctccactgctatctgc

SEQ ID NO: 293995 - DNA, 20 bp, Artificial Sequence
  chemically synthesized
ataaaactcctagcagatag

SEQ ID NO: 293996 - DNA, 20 bp, Artificial Sequence
  chemically synthesized
aaactcctagcagatagcag

SEQ ID NO: 293997 - DNA, 20 bp, Artificial Sequence
  chemically synthesized
actcctagcagatagcagtg

SEQ ID NO: 293998 - DNA, 20 bp, Artificial Sequence
  chemically synthesized
gcagatagcagtggagaaaa

SEQ ID NO: 293999 - DNA, 20 bp, Artificial Sequence
  chemically synthesized
agatagcagtggagaaaaca

SEQ ID NO: 294000 - DNA, 20 bp, Artificial Sequence
  chemically synthesized
gatagcagtggagaaaacag

SEQ ID NO: 294001 - DNA, 20 bp, Artificial Sequence
  chemically synthesized
gagaaaacagaggtgacttt

SEQ ID NO: 294002 - DNA, 20 bp, Artificial Sequence
  chemically synthesized
aaaaactatcaacaaactca

SEQ ID NO: 294003 - DNA, 20 bp, Artificial Sequence
  chemically synthesized
ggtgactttgagtttgttga

SEQ ID NO: 294004 - DNA, 20 bp, Artificial Sequence
  chemically synthesized
tgagtttgttgatagttttt

SEQ ID NO: 294005 - DNA, 20 bp, Artificial Sequence
  chemically synthesized
gttttttagatacaccacca

SEQ ID NO: 294006 - DNA, 20 bp, Artificial Sequence
  chemically synthesized
ttttttagatacaccaccaa

SEQ ID NO: 294007 - DNA, 20 bp, Artificial Sequence
  chemically synthesized
tttttagatacaccaccaaa

SEQ ID NO: 294008 - DNA, 20 bp, Artificial Sequence
  chemically synthesized
ttcatggatcatccctttgg

SEQ ID NO: 294009 - DNA, 20 bp, Artificial Sequence
  chemically synthesized
tctttcatggatcatccctt

SEQ ID NO: 294010 - DNA, 20 bp, Artificial Sequence
  chemically synthesized
accaaagggatgatccatga

SEQ ID NO: 294011 - DNA, 20 bp, Artificial Sequence
  chemically synthesized
aagggatgatccatgaaaga

SEQ ID NO: 294012 - DNA, 20 bp, Artificial Sequence
  chemically synthesized
cttattaattctttctttca

SEQ ID NO: 294013 - DNA, 20 bp, Artificial Sequence
  chemically synthesized
ccatgaaagaaagaattaat

SEQ ID NO: 294014 - DNA, 20 bp, Artificial Sequence
  chemically synthesized
gaaagaattaataagttgaa

SEQ ID NO: 294015 - DNA, 20 bp, Artificial Sequence
  chemically synthesized
ttaataagttgaatagtact

SEQ ID NO: 294016 - DNA, 20 bp, Artificial Sequence
  chemically synthesized
gttgaatagtactaagttaa

SEQ ID NO: 294017 - DNA, 20 bp, Artificial Sequence
  chemically synthesized
ttgaatagtactaagttaaa

SEQ ID NO: 294018 - DNA, 20 bp, Artificial Sequence
  chemically synthesized
cagagcagaaccttttaact

SEQ ID NO: 294019 - DNA, 20 bp, Artificial Sequence
  chemically synthesized
tggcagcatctttcacagag

SEQ ID NO: 294020 - DNA, 20 bp, Artificial Sequence
  chemically synthesized
taaaaggttctgctctgtga

SEQ ID NO: 294021 - DNA, 20 bp, Artificial Sequence
  chemically synthesized
ttttggcagcatctttcaca

SEQ ID NO: 294022 - DNA, 20 bp, Artificial Sequence
  chemically synthesized
tcttttggcagcatctttca

SEQ ID NO: 294023 - DNA, 20 bp, Artificial Sequence
  chemically synthesized
tctgtgaaagatgctgccaa

SEQ ID NO: 294024 - DNA, 20 bp, Artificial Sequence
  chemically synthesized
ttttcttttcgttcttttgg

SEQ ID NO: 294025 - DNA, 20 bp, Artificial Sequence
  chemically synthesized
ggcttttcttttcgttcttt

SEQ ID NO: 294026 - DNA, 20 bp, Artificial Sequence
  chemically synthesized
gatgctgccaaaagaacgaa

SEQ ID NO: 294027 - DNA, 20 bp, Artificial Sequence
  chemically synthesized
tgccaaaagaacgaaaagaa

SEQ ID NO: 294028 - DNA, 20 bp, Artificial Sequence
  chemically synthesized
aagaacgaaaagaaaagcca

SEQ ID NO: 294029 - DNA, 20 bp, Artificial Sequence
  chemically synthesized
agaacgaaaagaaaagccac

SEQ ID NO: 294030 - DNA, 20 bp, Artificial Sequence
  chemically synthesized
aaatattttctttgagcctg

SEQ ID NO: 294031 - DNA, 20 bp, Artificial Sequence
  chemically synthesized
aaagaaaagccacaggctca

SEQ ID NO: 294032 - DNA, 20 bp, Artificial Sequence
  chemically synthesized
ctttcgtaaatattttcttt

SEQ ID NO: 294033 - DNA, 20 bp, Artificial Sequence
  chemically synthesized
ctcaaagaaaatatttacga

SEQ ID NO: 294034 - DNA, 20 bp, Artificial Sequence
  chemically synthesized
atatttacgaaagacatatc

SEQ ID NO: 294035 - DNA, 20 bp, Artificial Sequence
  chemically synthesized
tttacgaaagacatatctgg

SEQ ID NO: 294036 - DNA, 20 bp, Artificial Sequence
  chemically synthesized
tacgaaagacatatctggta

SEQ ID NO: 294037 - DNA, 20 bp, Artificial Sequence
  chemically synthesized
ttcggataagaattctctac

SEQ ID NO: 294038 - DNA, 20 bp, Artificial Sequence
  chemically synthesized
gttctttgtgtatttcggat

SEQ ID NO: 294039 - DNA, 20 bp, Artificial Sequence
  chemically synthesized
taagagttctttgtgtattt

SEQ ID NO: 294040 - DNA, 20 bp, Artificial Sequence
  chemically synthesized
attcttatccgaaatacaca

SEQ ID NO: 294041 - DNA, 20 bp, Artificial Sequence
  chemically synthesized
tttttgttactgagttttaa

SEQ ID NO: 294042 - DNA, 20 bp, Artificial Sequence
  chemically synthesized
cacaaagaactcttaaaact

SEQ ID NO: 294043 - DNA, 20 bp, Artificial Sequence
  chemically synthesized
tgtttttgttactgagtttt

SEQ ID NO: 294044 - DNA, 20 bp, Artificial Sequence
  chemically synthesized
gtttgtttgtttttgttact

SEQ ID NO: 294045 - DNA, 20 bp, Artificial Sequence
  chemically synthesized
aaaacaaacaaactaaaaca

SEQ ID NO: 294046 - DNA, 20 bp, Artificial Sequence
  chemically synthesized
aaacaaacaaactaaaacat

SEQ ID NO: 294047 - DNA, 20 bp, Artificial Sequence
  chemically synthesized
aaggatttttgcccatgttt

SEQ ID NO: 294048 - DNA, 20 bp, Artificial Sequence
  chemically synthesized
acatgggcaaaaatccttaa

SEQ ID NO: 294049 - DNA, 20 bp, Artificial Sequence
  chemically synthesized
ctttggtgaggtgtctgtta

SEQ ID NO: 294050 - DNA, 20 bp, Artificial Sequence
  chemically synthesized
cctttggtgaggtgtctgtt

SEQ ID NO: 294051 - DNA, 20 bp, Artificial Sequence
  chemically synthesized
ccttaacagacacctcacca

SEQ ID NO: 294052 - DNA, 20 bp, Artificial Sequence
  chemically synthesized
cttaacagacacctcaccaa

SEQ ID NO: 294053 - DNA, 20 bp, Artificial Sequence
  chemically synthesized
tctgtatacttcctttggtg

SEQ ID NO: 294054 - DNA, 20 bp, Artificial Sequence
  chemically synthesized
atctgtatacttcctttggt

SEQ ID NO: 294055 - DNA, 20 bp, Artificial Sequence
  chemically synthesized
aacagacacctcaccaaagg

SEQ ID NO: 294056 - DNA, 20 bp, Artificial Sequence
  chemically synthesized
tgccatctgtatacttcctt

SEQ ID NO: 294057 - DNA, 20 bp, Artificial Sequence
  chemically synthesized
acctcaccaaaggaagtata

SEQ ID NO: 294058 - DNA, 20 bp, Artificial Sequence
  chemically synthesized
caccaaaggaagtatacaga

SEQ ID NO: 294059 - DNA, 20 bp, Artificial Sequence
  chemically synthesized
gaagtatacagatggcaaat

SEQ ID NO: 294060 - DNA, 20 bp, Artificial Sequence
  chemically synthesized
tgtttcacatcatatgttac

SEQ ID NO: 294061 - DNA, 20 bp, Artificial Sequence
  chemically synthesized
gtttcacatcatatgttacc

SEQ ID NO: 294062 - DNA, 20 bp, Artificial Sequence
  chemically synthesized
tttcacatcatatgttacca

SEQ ID NO: 294063 - DNA, 20 bp, Artificial Sequence
  chemically synthesized
ttgtttaatttgtaattccc

SEQ ID NO: 294064 - DNA, 20 bp, Artificial Sequence
  chemically synthesized
ggaattacaaattaaacaat

SEQ ID NO: 294065 - DNA, 20 bp, Artificial Sequence
  chemically synthesized
ccattctaataggtgtgtag

SEQ ID NO: 294066 - DNA, 20 bp, Artificial Sequence
  chemically synthesized
tggccattctaataggtgtg

SEQ ID NO: 294067 - DNA, 20 bp, Artificial Sequence
  chemically synthesized
agataccactacacacctat

SEQ ID NO: 294068 - DNA, 20 bp, Artificial Sequence
  chemically synthesized
ccactacacacctattagaa

SEQ ID NO: 294069 - DNA, 20 bp, Artificial Sequence
  chemically synthesized
tggattttggccattctaat

SEQ ID NO: 294070 - DNA, 20 bp, Artificial Sequence
  chemically synthesized
ttggattttggccattctaa

SEQ ID NO: 294071 - DNA, 20 bp, Artificial Sequence
  chemically synthesized
tattagaatggccaaaatcc

SEQ ID NO: 294072 - DNA, 20 bp, Artificial Sequence
  chemically synthesized
ttgtcagtgttcttggattt

SEQ ID NO: 294073 - DNA, 20 bp, Artificial Sequence
  chemically synthesized
tttggttttgtcagtgttct

SEQ ID NO: 294074 - DNA, 20 bp, Artificial Sequence
  chemically synthesized
ctgtcggcttttggttttgt

SEQ ID NO: 294075 - DNA, 20 bp, Artificial Sequence
  chemically synthesized
aagaacactgacaaaaccaa

SEQ ID NO: 294076 - DNA, 20 bp, Artificial Sequence
  chemically synthesized
cccatttctctgtcggcttt

SEQ ID NO: 294077 - DNA, 20 bp, Artificial Sequence
  chemically synthesized
ctgacaaaaccaaaagccga

SEQ ID NO: 294078 - DNA, 20 bp, Artificial Sequence
  chemically synthesized
gacaaaaccaaaagccgaca

SEQ ID NO: 294079 - DNA, 20 bp, Artificial Sequence
  chemically synthesized
ccattgccccatttctctgt

SEQ ID NO: 294080 - DNA, 20 bp, Artificial Sequence
  chemically synthesized
accaaaagccgacagagaaa

SEQ ID NO: 294081 - DNA, 20 bp, Artificial Sequence
  chemically synthesized
ccaaaagccgacagagaaat

SEQ ID NO: 294082 - DNA, 20 bp, Artificial Sequence
  chemically synthesized
caaaagccgacagagaaatg

SEQ ID NO: 294083 - DNA, 20 bp, Artificial Sequence
  chemically synthesized
ccgacagagaaatggggcaa

SEQ ID NO: 294084 - DNA, 20 bp, Artificial Sequence
  chemically synthesized
cgacagagaaatggggcaat

SEQ ID NO: 294085 - DNA, 20 bp, Artificial Sequence
  chemically synthesized
ttgccaccagaaatgaatga

SEQ ID NO: 294086 - DNA, 20 bp, Artificial Sequence
  chemically synthesized
cattgccaccagaaatgaat

SEQ ID NO: 294087 - DNA, 20 bp, Artificial Sequence
  chemically synthesized
tgggaactctcattcatttc

SEQ ID NO: 294088 - DNA, 20 bp, Artificial Sequence
  chemically synthesized
gaactctcattcatttctgg

SEQ ID NO: 294089 - DNA, 20 bp, Artificial Sequence
  chemically synthesized
gtgccattttgcattgccac

SEQ ID NO: 294090 - DNA, 20 bp, Artificial Sequence
  chemically synthesized
tttctggtggcaatgcaaaa

SEQ ID NO: 294091 - DNA, 20 bp, Artificial Sequence
  chemically synthesized
ggtggcaatgcaaaatggca

SEQ ID NO: 294092 - DNA, 20 bp, Artificial Sequence
  chemically synthesized
gcaaaatggcacagccactt

SEQ ID NO: 294093 - DNA, 20 bp, Artificial Sequence
  chemically synthesized
aaatggcacagccactttgg

SEQ ID NO: 294094 - DNA, 20 bp, Artificial Sequence
  chemically synthesized
ctccaaactgtcttccaaag

SEQ ID NO: 294095 - DNA, 20 bp, Artificial Sequence
  chemically synthesized
ggcacagccactttggaaga

SEQ ID NO: 294096 - DNA, 20 bp, Artificial Sequence
  chemically synthesized
aacctccaaactgtcttcca

SEQ ID NO: 294097 - DNA, 20 bp, Artificial Sequence
  chemically synthesized
agccactttggaagacagtt

SEQ ID NO: 294098 - DNA, 20 bp, Artificial Sequence
  chemically synthesized
ccactttggaagacagtttg

SEQ ID NO: 294099 - DNA, 20 bp, Artificial Sequence
  chemically synthesized
cactttggaagacagtttgg

SEQ ID NO: 294100 - DNA, 20 bp, Artificial Sequence
  chemically synthesized
agtttggaggtttcttacaa

SEQ ID NO: 294101 - DNA, 20 bp, Artificial Sequence
  chemically synthesized
agtagaatgtttacttttgt

SEQ ID NO: 294102 - DNA, 20 bp, Artificial Sequence
  chemically synthesized
atgattgctggatcatatag

SEQ ID NO: 294103 - DNA, 20 bp, Artificial Sequence
  chemically synthesized
aaacattctactatatgatc

SEQ ID NO: 294104 - DNA, 20 bp, Artificial Sequence
  chemically synthesized
tgcatgattgctggatcata

SEQ ID NO: 294105 - DNA, 20 bp, Artificial Sequence
  chemically synthesized
atgcctaagtgcatgattgc

SEQ ID NO: 294106 - DNA, 20 bp, Artificial Sequence
  chemically synthesized
tgatccagcaatcatgcact

SEQ ID NO: 294107 - DNA, 20 bp, Artificial Sequence
  chemically synthesized
gatccagcaatcatgcactt

SEQ ID NO: 294108 - DNA, 20 bp, Artificial Sequence
  chemically synthesized
actcctttgtgtaaatgcct

SEQ ID NO: 294109 - DNA, 20 bp, Artificial Sequence
  chemically synthesized
tgcacttaggcatttacaca

SEQ ID NO: 294110 - DNA, 20 bp, Artificial Sequence
  chemically synthesized
gcacttaggcatttacacaa

SEQ ID NO: 294111 - DNA, 20 bp, Artificial Sequence
  chemically synthesized
acttaggcatttacacaaag

SEQ ID NO: 294112 - DNA, 20 bp, Artificial Sequence
  chemically synthesized
ttcatgtgcaggaatttgag

SEQ ID NO: 294113 - DNA, 20 bp, Artificial Sequence
  chemically synthesized
gcattcatgtgcaggaattt

SEQ ID NO: 294114 - DNA, 20 bp, Artificial Sequence
  chemically synthesized
ctgctgcagcattcatgtgc

SEQ ID NO: 294115 - DNA, 20 bp, Artificial Sequence
  chemically synthesized
gctgctgcagcattcatgtg

SEQ ID NO: 294116 - DNA, 20 bp, Artificial Sequence
  chemically synthesized
attcctgcacatgaatgctg

SEQ ID NO: 294117 - DNA, 20 bp, Artificial Sequence
  chemically synthesized
cctgcacatgaatgctgcag

SEQ ID NO: 294118 - DNA, 20 bp, Artificial Sequence
  chemically synthesized
aaatacaaacaaagctgctg

SEQ ID NO: 294119 - DNA, 20 bp, Artificial Sequence
  chemically synthesized
agtcttggcaaatacaaaca

SEQ ID NO: 294120 - DNA, 20 bp, Artificial Sequence
  chemically synthesized
cagctttgtttgtatttgcc

SEQ ID NO: 294121 - DNA, 20 bp, Artificial Sequence
  chemically synthesized
tgtttgtatttgccaagact

SEQ ID NO: 294122 - DNA, 20 bp, Artificial Sequence
  chemically synthesized
tcttgattgtttccaagtct

SEQ ID NO: 294123 - DNA, 20 bp, Artificial Sequence
  chemically synthesized
agaacatcttgattgtttcc

SEQ ID NO: 294124 - DNA, 20 bp, Artificial Sequence
  chemically synthesized
gccaagacttggaaacaatc

SEQ ID NO: 294125 - DNA, 20 bp, Artificial Sequence
  chemically synthesized
gaaacaatcaagatgttctt

SEQ ID NO: 294126 - DNA, 20 bp, Artificial Sequence
  chemically synthesized
acaatcaagatgttcttcag

SEQ ID NO: 294127 - DNA, 20 bp, Artificial Sequence
  chemically synthesized
atttatccattcatctactg

SEQ ID NO: 294128 - DNA, 20 bp, Artificial Sequence
  chemically synthesized
gatgttcttcagtagatgaa

SEQ ID NO: 294129 - DNA, 20 bp, Artificial Sequence
  chemically synthesized
tgaatggataaataaactgt

SEQ ID NO: 294130 - DNA, 20 bp, Artificial Sequence
  chemically synthesized
tccattgtctggatgtctca

SEQ ID NO: 294131 - DNA, 20 bp, Artificial Sequence
  chemically synthesized
taaataaactgtgagacatc

SEQ ID NO: 294132 - DNA, 20 bp, Artificial Sequence
  chemically synthesized
actgtgagacatccagacaa

SEQ ID NO: 294133 - DNA, 20 bp, Artificial Sequence
  chemically synthesized
ctgaataatattccattgtc

SEQ ID NO: 294134 - DNA, 20 bp, Artificial Sequence
  chemically synthesized
ccagacaatggaatattatt

SEQ ID NO: 294135 - DNA, 20 bp, Artificial Sequence
  chemically synthesized
attattcagtgcttaaaaat

SEQ ID NO: 294136 - DNA, 20 bp, Artificial Sequence
  chemically synthesized
tggcttgatagctcattttt

SEQ ID NO: 294137 - DNA, 20 bp, Artificial Sequence
  chemically synthesized
gtgcttaaaaatgagctatc

SEQ ID NO: 294138 - DNA, 20 bp, Artificial Sequence
  chemically synthesized
catgtctttttatggcttga

SEQ ID NO: 294139 - DNA, 20 bp, Artificial Sequence
  chemically synthesized
atgagctatcaagccataaa

SEQ ID NO: 294140 - DNA, 20 bp, Artificial Sequence
  chemically synthesized
agttcttccatgtcttttta

SEQ ID NO: 294141 - DNA, 20 bp, Artificial Sequence
  chemically synthesized
tatcaagccataaaaagaca

SEQ ID NO: 294142 - DNA, 20 bp, Artificial Sequence
  chemically synthesized
caagccataaaaagacatgg

SEQ ID NO: 294143 - DNA, 20 bp, Artificial Sequence
  chemically synthesized
taacttagtaacatgcattt

SEQ ID NO: 294144 - DNA, 20 bp, Artificial Sequence
  chemically synthesized
gaacttaaatgcatgttact

SEQ ID NO: 294145 - DNA, 20 bp, Artificial Sequence
  chemically synthesized
aaatgcatgttactaagtta

SEQ ID NO: 294146 - DNA, 20 bp, Artificial Sequence
  chemically synthesized
tcagattatcttctttaact

SEQ ID NO: 294147 - DNA, 20 bp, Artificial Sequence
  chemically synthesized
tgcatgttactaagttaaag

SEQ ID NO: 294148 - DNA, 20 bp, Artificial Sequence
  chemically synthesized
gttaaagaagataatctgaa

SEQ ID NO: 294149 - DNA, 20 bp, Artificial Sequence
  chemically synthesized
ttaaagaagataatctgaaa

SEQ ID NO: 294150 - DNA, 20 bp, Artificial Sequence
  chemically synthesized
ggtaaaatatatagcctttt

SEQ ID NO: 294151 - DNA, 20 bp, Artificial Sequence
  chemically synthesized
aaatcctgcggtaaaatata

SEQ ID NO: 294152 - DNA, 20 bp, Artificial Sequence
  chemically synthesized
aaaggctatatattttaccg

SEQ ID NO: 294153 - DNA, 20 bp, Artificial Sequence
  chemically synthesized
aaggctatatattttaccgc

SEQ ID NO: 294154 - DNA, 20 bp, Artificial Sequence
  chemically synthesized
gaatctagggtgaaatcctg

SEQ ID NO: 294155 - DNA, 20 bp, Artificial Sequence
  chemically synthesized
tttaccgcaggatttcaccc

SEQ ID NO: 294156 - DNA, 20 bp, Artificial Sequence
  chemically synthesized
atattcggaattggaatcta

SEQ ID NO: 294157 - DNA, 20 bp, Artificial Sequence
  chemically synthesized
tatattcggaattggaatct

SEQ ID NO: 294158 - DNA, 20 bp, Artificial Sequence
  chemically synthesized
atatattcggaattggaatc

SEQ ID NO: 294159 - DNA, 20 bp, Artificial Sequence
  chemically synthesized
gactatcatatattcggaat

SEQ ID NO: 294160 - DNA, 20 bp, Artificial Sequence
  chemically synthesized
tttccagactatcatatatt

SEQ ID NO: 294161 - DNA, 20 bp, Artificial Sequence
  chemically synthesized
ttccaattccgaatatatga

SEQ ID NO: 294162 - DNA, 20 bp, Artificial Sequence
  chemically synthesized
attccgaatatatgatagtc

SEQ ID NO: 294163 - DNA, 20 bp, Artificial Sequence
  chemically synthesized
gaatatatgatagtctggaa

SEQ ID NO: 294164 - DNA, 20 bp, Artificial Sequence
  chemically synthesized
aatatatgatagtctggaaa

SEQ ID NO: 294165 - DNA, 20 bp, Artificial Sequence
  chemically synthesized
ttacatagttttaccttttc

SEQ ID NO: 294166 - DNA, 20 bp, Artificial Sequence
  chemically synthesized
tgattgttttgtagtttaca

SEQ ID NO: 294167 - DNA, 20 bp, Artificial Sequence
  chemically synthesized
agaaaccactgattgttttg

SEQ ID NO: 294168 - DNA, 20 bp, Artificial Sequence
  chemically synthesized
tatgtaaactacaaaacaat

SEQ ID NO: 294169 - DNA, 20 bp, Artificial Sequence
  chemically synthesized
gtaaactacaaaacaatcag

SEQ ID NO: 294170 - DNA, 20 bp, Artificial Sequence
  chemically synthesized
acaaaacaatcagtggtttc

SEQ ID NO: 294171 - DNA, 20 bp, Artificial Sequence
  chemically synthesized
aaaacaatcagtggtttcta

SEQ ID NO: 294172 - DNA, 20 bp, Artificial Sequence
  chemically synthesized
aatcagtggtttctagagat

SEQ ID NO: 294173 - DNA, 20 bp, Artificial Sequence
  chemically synthesized
atcagtggtttctagagatt

SEQ ID NO: 294174 - DNA, 20 bp, Artificial Sequence
  chemically synthesized
tacacttctctcctaatctc

SEQ ID NO: 294175 - DNA, 20 bp, Artificial Sequence
  chemically synthesized
cagtggtttctagagattag

SEQ ID NO: 294176 - DNA, 20 bp, Artificial Sequence
  chemically synthesized
gtggtttctagagattagga

SEQ ID NO: 294177 - DNA, 20 bp, Artificial Sequence
  chemically synthesized
gtttctagagattaggagag

SEQ ID NO: 294178 - DNA, 20 bp, Artificial Sequence
  chemically synthesized
tagagattaggagagaagtg

SEQ ID NO: 294179 - DNA, 20 bp, Artificial Sequence
  chemically synthesized
aggagagaagtgtagatgaa

SEQ ID NO: 294180 - DNA, 20 bp, Artificial Sequence
  chemically synthesized
ggagagaagtgtagatgaac

SEQ ID NO: 294181 - DNA, 20 bp, Artificial Sequence
  chemically synthesized
gaagtgtagatgaacgggaa

SEQ ID NO: 294182 - DNA, 20 bp, Artificial Sequence
  chemically synthesized
agatgaacgggaaaagtatt

SEQ ID NO: 294183 - DNA, 20 bp, Artificial Sequence
  chemically synthesized
gatgaacgggaaaagtattg

SEQ ID NO: 294184 - DNA, 20 bp, Artificial Sequence
  chemically synthesized
aaaagtattgaggattttta

SEQ ID NO: 294185 - DNA, 20 bp, Artificial Sequence
  chemically synthesized
agtattgaggatttttatgg

SEQ ID NO: 294186 - DNA, 20 bp, Artificial Sequence
  chemically synthesized
tttatctttagagtgttatg

SEQ ID NO: 294187 - DNA, 20 bp, Artificial Sequence
  chemically synthesized
ttacaccgcataacactcta

SEQ ID NO: 294188 - DNA, 20 bp, Artificial Sequence
  chemically synthesized
atgacatgtatttatcttta

SEQ ID NO: 294189 - DNA, 20 bp, Artificial Sequence
  chemically synthesized
caatgacatgtatttatctt

SEQ ID NO: 294190 - DNA, 20 bp, Artificial Sequence
  chemically synthesized
tgtaaatttgtttaaactca

SEQ ID NO: 294191 - DNA, 20 bp, Artificial Sequence
  chemically synthesized
attggtgccacacattctgt

SEQ ID NO: 294192 - DNA, 20 bp, Artificial Sequence
  chemically synthesized
gtttaaactcacagaatgtg

SEQ ID NO: 294193 - DNA, 20 bp, Artificial Sequence
  chemically synthesized
cacagaatgtgtggcaccaa

SEQ ID NO: 294194 - DNA, 20 bp, Artificial Sequence
  chemically synthesized
acagaatgtgtggcaccaat

SEQ ID NO: 294195 - DNA, 20 bp, Artificial Sequence
  chemically synthesized
cagaatgtgtggcaccaata

SEQ ID NO: 294196 - DNA, 20 bp, Artificial Sequence
  chemically synthesized
atgtgtggcaccaataggga

SEQ ID NO: 294197 - DNA, 20 bp, Artificial Sequence
  chemically synthesized
tatacattagctttccctat

SEQ ID NO: 294198 - DNA, 20 bp, Artificial Sequence
  chemically synthesized
aaagttcatagtttatacat

SEQ ID NO: 294199 - DNA, 20 bp, Artificial Sequence
  chemically synthesized
aatgtataaactatgaactt

SEQ ID NO: 294200 - DNA, 20 bp, Artificial Sequence
  chemically synthesized
tcattatctcccaaagttca

SEQ ID NO: 294201 - DNA, 20 bp, Artificial Sequence
  chemically synthesized
atgtataaactatgaacttt

SEQ ID NO: 294202 - DNA, 20 bp, Artificial Sequence
  chemically synthesized
gtataaactatgaactttgg

SEQ ID NO: 294203 - DNA, 20 bp, Artificial Sequence
  chemically synthesized
tgacacatcattatctccca

SEQ ID NO: 294204 - DNA, 20 bp, Artificial Sequence
  chemically synthesized
agataatgatgtgtcaatgt

SEQ ID NO: 294205 - DNA, 20 bp, Artificial Sequence
  chemically synthesized
gagtggtatatttgtttcaa

SEQ ID NO: 294206 - DNA, 20 bp, Artificial Sequence
  chemically synthesized
ttgaaacaaatataccactc

SEQ ID NO: 294207 - DNA, 20 bp, Artificial Sequence
  chemically synthesized
aaacaaatataccactctag

SEQ ID NO: 294208 - DNA, 20 bp, Artificial Sequence
  chemically synthesized
aacaaatataccactctagt

SEQ ID NO: 294209 - DNA, 20 bp, Artificial Sequence
  chemically synthesized
gtcaacatttcccactagag

SEQ ID NO: 294210 - DNA, 20 bp, Artificial Sequence
  chemically synthesized
actgtcaacatttcccacta

SEQ ID NO: 294211 - DNA, 20 bp, Artificial Sequence
  chemically synthesized
ccactgtcaacatttcccac

SEQ ID NO: 294212 - DNA, 20 bp, Artificial Sequence
  chemically synthesized
actctagtgggaaatgttga

SEQ ID NO: 294213 - DNA, 20 bp, Artificial Sequence
  chemically synthesized
ctagtgggaaatgttgacag

SEQ ID NO: 294214 - DNA, 20 bp, Artificial Sequence
  chemically synthesized
tagtgggaaatgttgacagt

SEQ ID NO: 294215 - DNA, 20 bp, Artificial Sequence
  chemically synthesized
agtgggaaatgttgacagtg

SEQ ID NO: 294216 - DNA, 20 bp, Artificial Sequence
  chemically synthesized
gggaaatgttgacagtgggg

SEQ ID NO: 294217 - DNA, 20 bp, Artificial Sequence
  chemically synthesized
ggaaatgttgacagtggggc

SEQ ID NO: 294218 - DNA, 20 bp, Artificial Sequence
  chemically synthesized
acccggctcccacagataca

SEQ ID NO: 294219 - DNA, 20 bp, Artificial Sequence
  chemically synthesized
tggggcaggctatgtatctg

SEQ ID NO: 294220 - DNA, 20 bp, Artificial Sequence
  chemically synthesized
ggggcaggctatgtatctgt

SEQ ID NO: 294221 - DNA, 20 bp, Artificial Sequence
  chemically synthesized
ggcaggctatgtatctgtgg

SEQ ID NO: 294222 - DNA, 20 bp, Artificial Sequence
  chemically synthesized
ggctatgtatctgtgggagc

SEQ ID NO: 294223 - DNA, 20 bp, Artificial Sequence
  chemically synthesized
cccatataacccggctccca

SEQ ID NO: 294224 - DNA, 20 bp, Artificial Sequence
  chemically synthesized
gctatgtatctgtgggagcc

SEQ ID NO: 294225 - DNA, 20 bp, Artificial Sequence
  chemically synthesized
tctgtgggagccgggttata

SEQ ID NO: 294226 - DNA, 20 bp, Artificial Sequence
  chemically synthesized
caaaaatttcccatataacc

SEQ ID NO: 294227 - DNA, 20 bp, Artificial Sequence
  chemically synthesized
ctgtgggagccgggttatat

SEQ ID NO: 294228 - DNA, 20 bp, Artificial Sequence
  chemically synthesized
tcacagcacaattgaacaga

SEQ ID NO: 294229 - DNA, 20 bp, Artificial Sequence
  chemically synthesized
ttcacagcacaattgaacag

SEQ ID NO: 294230 - DNA, 20 bp, Artificial Sequence
  chemically synthesized
aggttcacagcacaattgaa

SEQ ID NO: 294231 - DNA, 20 bp, Artificial Sequence
  chemically synthesized
ttagagtaattataggttca

SEQ ID NO: 294232 - DNA, 20 bp, Artificial Sequence
  chemically synthesized
tccatttttagagtaattat

SEQ ID NO: 294233 - DNA, 20 bp, Artificial Sequence
  chemically synthesized
ctccatttttagagtaatta

SEQ ID NO: 294234 - DNA, 20 bp, Artificial Sequence
  chemically synthesized
acctataattactctaaaaa

SEQ ID NO: 294235 - DNA, 20 bp, Artificial Sequence
  chemically synthesized
tttaatagactccattttta

SEQ ID NO: 294236 - DNA, 20 bp, Artificial Sequence
  chemically synthesized
ctataattactctaaaaatg

SEQ ID NO: 294237 - DNA, 20 bp, Artificial Sequence
  chemically synthesized
attttaatagactccatttt

SEQ ID NO: 294238 - DNA, 20 bp, Artificial Sequence
  chemically synthesized
acctttttttgtgattttaa

SEQ ID NO: 294239 - DNA, 20 bp, Artificial Sequence
  chemically synthesized
gtctattaaaatcacaaaaa

SEQ ID NO: 294240 - DNA, 20 bp, Artificial Sequence
  chemically synthesized
tctattaaaatcacaaaaaa

SEQ ID NO: 294241 - DNA, 20 bp, Artificial Sequence
  chemically synthesized
caaaaaaaggtttcatgaat

SEQ ID NO: 294242 - DNA, 20 bp, Artificial Sequence
  chemically synthesized
aaaaaaaggtttcatgaatt

SEQ ID NO: 294243 - DNA, 20 bp, Artificial Sequence
  chemically synthesized
gtttcatgaattaggaatac

SEQ ID NO: 294244 - DNA, 20 bp, Artificial Sequence
  chemically synthesized
tgtactcttgatattgaatc

SEQ ID NO: 294245 - DNA, 20 bp, Artificial Sequence
  chemically synthesized
ggaatactggattcaatatc

SEQ ID NO: 294246 - DNA, 20 bp, Artificial Sequence
  chemically synthesized
aatactggattcaatatcaa

SEQ ID NO: 294247 - DNA, 20 bp, Artificial Sequence
  chemically synthesized
ttggcttttttttttttttt

SEQ ID NO: 294248 - DNA, 20 bp, Artificial Sequence
  chemically synthesized
aatgctaaaaaaaaaaaaaa

SEQ ID NO: 294249 - DNA, 20 bp, Artificial Sequence
  chemically synthesized
gagtttattctgtgaatgat

SEQ ID NO: 294250 - DNA, 20 bp, Artificial Sequence
  chemically synthesized
aaaaaaaagccaatcattca

SEQ ID NO: 294251 - DNA, 20 bp, Artificial Sequence
  chemically synthesized
attcacagaataaactccat

SEQ ID NO: 294252 - DNA, 20 bp, Artificial Sequence
  chemically synthesized
ttcacagaataaactccatc

SEQ ID NO: 294253 - DNA, 20 bp, Artificial Sequence
  chemically synthesized
tattacagctattcctgatg

SEQ ID NO: 294254 - DNA, 20 bp, Artificial Sequence
  chemically synthesized
agaataaactccatcaggaa

SEQ ID NO: 294255 - DNA, 20 bp, Artificial Sequence
  chemically synthesized
tatattacagctattcctga

SEQ ID NO: 294256 - DNA, 20 bp, Artificial Sequence
  chemically synthesized
aattagtattttatatatta

SEQ ID NO: 294257 - DNA, 20 bp, Artificial Sequence
  chemically synthesized
aatttattctcagttttaat

SEQ ID NO: 294258 - DNA, 20 bp, Artificial Sequence
  chemically synthesized
ataaaatactaattaaaact

SEQ ID NO: 294259 - DNA, 20 bp, Artificial Sequence
  chemically synthesized
ttttactcttaatttattct

SEQ ID NO: 294260 - DNA, 20 bp, Artificial Sequence
  chemically synthesized
attaaaactgagaataaatt

SEQ ID NO: 294261 - DNA, 20 bp, Artificial Sequence
  chemically synthesized
taaaactgagaataaattaa

SEQ ID NO: 294262 - DNA, 20 bp, Artificial Sequence
  chemically synthesized
aaaatttaaaaaaaatctat

SEQ ID NO: 294263 - DNA, 20 bp, Artificial Sequence
  chemically synthesized
aaatttaaaaaaaatctata

SEQ ID NO: 294264 - DNA, 20 bp, Artificial Sequence
  chemically synthesized
tttaaaaaaaatctataagg

SEQ ID NO: 294265 - DNA, 20 bp, Artificial Sequence
  chemically synthesized
aaaacaaaattactacctta

SEQ ID NO: 294266 - DNA, 20 bp, Artificial Sequence
  chemically synthesized
cagctaagagataggtattt

SEQ ID NO: 294267 - DNA, 20 bp, Artificial Sequence
  chemically synthesized
tttcttaaatacctatctct

SEQ ID NO: 294268 - DNA, 20 bp, Artificial Sequence
  chemically synthesized
gtatctttcagctaagagat

SEQ ID NO: 294269 - DNA, 20 bp, Artificial Sequence
  chemically synthesized
tgtatctttcagctaagaga

SEQ ID NO: 294270 - DNA, 20 bp, Artificial Sequence
  chemically synthesized
aatgtgtatctttcagctaa

SEQ ID NO: 294271 - DNA, 20 bp, Artificial Sequence
  chemically synthesized
aatacctatctcttagctga

SEQ ID NO: 294272 - DNA, 20 bp, Artificial Sequence
  chemically synthesized
aaaatgtgtatctttcagct

SEQ ID NO: 294273 - DNA, 20 bp, Artificial Sequence
  chemically synthesized
catgtaaaatgtgtatcttt

SEQ ID NO: 294274 - DNA, 20 bp, Artificial Sequence
  chemically synthesized
tgaaagatacacattttaca

SEQ ID NO: 294275 - DNA, 20 bp, Artificial Sequence
  chemically synthesized
acattttacatggtgctctg

SEQ ID NO: 294276 - DNA, 20 bp, Artificial Sequence
  chemically synthesized
cattttacatggtgctctga

SEQ ID NO: 294277 - DNA, 20 bp, Artificial Sequence
  chemically synthesized
attttacatggtgctctgaa

SEQ ID NO: 294278 - DNA, 20 bp, Artificial Sequence
  chemically synthesized
ttttcatttgttgcccttca

SEQ ID NO: 294279 - DNA, 20 bp, Artificial Sequence
  chemically synthesized
agttttcatttgttgccctt

SEQ ID NO: 294280 - DNA, 20 bp, Artificial Sequence
  chemically synthesized
aagggcaacaaatgaaaact

SEQ ID NO: 294281 - DNA, 20 bp, Artificial Sequence
  chemically synthesized
ttaactaattagacaaaact

SEQ ID NO: 294282 - DNA, 20 bp, Artificial Sequence
  chemically synthesized
aaaactcagttttgtctaat

SEQ ID NO: 294283 - DNA, 20 bp, Artificial Sequence
  chemically synthesized
tcagttttgtctaattagtt

SEQ ID NO: 294284 - DNA, 20 bp, Artificial Sequence
  chemically synthesized
ttcagagtttcttaactaat

SEQ ID NO: 294285 - DNA, 20 bp, Artificial Sequence
  chemically synthesized
aattagttaagaaactctga

SEQ ID NO: 294286 - DNA, 20 bp, Artificial Sequence
  chemically synthesized
aaaagtgtctgtcactttca

SEQ ID NO: 294287 - DNA, 20 bp, Artificial Sequence
  chemically synthesized
ttaagaaactctgaaagtga

SEQ ID NO: 294288 - DNA, 20 bp, Artificial Sequence
  chemically synthesized
taaaaagtgtctgtcacttt

SEQ ID NO: 294289 - DNA, 20 bp, Artificial Sequence
  chemically synthesized
gtggaatgtaagatattaaa

SEQ ID NO: 294290 - DNA, 20 bp, Artificial Sequence
  chemically synthesized
gaaattttcaagtggaatgt

SEQ ID NO: 294291 - DNA, 20 bp, Artificial Sequence
  chemically synthesized
ggtgctttgaaattttcaag

SEQ ID NO: 294292 - DNA, 20 bp, Artificial Sequence
  chemically synthesized
ctgggtgctttgaaattttc

SEQ ID NO: 294293 - DNA, 20 bp, Artificial Sequence
  chemically synthesized
cattccacttgaaaatttca

SEQ ID NO: 294294 - DNA, 20 bp, Artificial Sequence
  chemically synthesized
cttgaaaatttcaaagcacc

SEQ ID NO: 294295 - DNA, 20 bp, Artificial Sequence
  chemically synthesized
atttcaaagcacccagtttg

SEQ ID NO: 294296 - DNA, 20 bp, Artificial Sequence
  chemically synthesized
atcacaaaataccacaaact

SEQ ID NO: 294297 - DNA, 20 bp, Artificial Sequence
  chemically synthesized
aatcacaaaataccacaaac

SEQ ID NO: 294298 - DNA, 20 bp, Artificial Sequence
  chemically synthesized
attttgtgattttatgttcc

SEQ ID NO: 294299 - DNA, 20 bp, Artificial Sequence
  chemically synthesized
ttttgtgattttatgttccc

SEQ ID NO: 294300 - DNA, 20 bp, Artificial Sequence
  chemically synthesized
gctaattggaaagggatcct

SEQ ID NO: 294301 - DNA, 20 bp, Artificial Sequence
  chemically synthesized
tgctaattggaaagggatcc

SEQ ID NO: 294302 - DNA, 20 bp, Artificial Sequence
  chemically synthesized
ttttacctgctaattggaaa

SEQ ID NO: 294303 - DNA, 20 bp, Artificial Sequence
  chemically synthesized
tcccaggatccctttccaat

SEQ ID NO: 294304 - DNA, 20 bp, Artificial Sequence
  chemically synthesized
gttttacctgctaattggaa

SEQ ID NO: 294305 - DNA, 20 bp, Artificial Sequence
  chemically synthesized
agttttacctgctaattgga

SEQ ID NO: 294306 - DNA, 20 bp, Artificial Sequence
  chemically synthesized
caggatccctttccaattag

SEQ ID NO: 294307 - DNA, 20 bp, Artificial Sequence
  chemically synthesized
aggatccctttccaattagc

SEQ ID NO: 294308 - DNA, 20 bp, Artificial Sequence
  chemically synthesized
cagaagttttacctgctaat

SEQ ID NO: 294309 - DNA, 20 bp, Artificial Sequence
  chemically synthesized
aattagcaggtaaaacttct

SEQ ID NO: 294310 - DNA, 20 bp, Artificial Sequence
  chemically synthesized
tgaatttcaagacaactcag

SEQ ID NO: 294311 - DNA, 20 bp, Artificial Sequence
  chemically synthesized
aactgaatttcaagacaact

SEQ ID NO: 294312 - DNA, 20 bp, Artificial Sequence
  chemically synthesized
ttctgagttgtcttgaaatt

SEQ ID NO: 294313 - DNA, 20 bp, Artificial Sequence
  chemically synthesized
tctttgtgaaactgaatttc

SEQ ID NO: 294314 - DNA, 20 bp, Artificial Sequence
  chemically synthesized
tcttgaaattcagtttcaca

SEQ ID NO: 294315 - DNA, 20 bp, Artificial Sequence
  chemically synthesized
gaaattcagtttcacaaaga

SEQ ID NO: 294316 - DNA, 20 bp, Artificial Sequence
  chemically synthesized
agacagtattgaattgtttc

SEQ ID NO: 294317 - DNA, 20 bp, Artificial Sequence
  chemically synthesized
gacagtattgaattgtttcc

SEQ ID NO: 294318 - DNA, 20 bp, Artificial Sequence
  chemically synthesized
tccatgattgtgcacgttcc

SEQ ID NO: 294319 - DNA, 20 bp, Artificial Sequence
  chemically synthesized
tccaggaacgtgcacaatca

SEQ ID NO: 294320 - DNA, 20 bp, Artificial Sequence
  chemically synthesized
ggaacgtgcacaatcatgga

SEQ ID NO: 294321 - DNA, 20 bp, Artificial Sequence
  chemically synthesized
catggatggttctaatttgt

SEQ ID NO: 294322 - DNA, 20 bp, Artificial Sequence
  chemically synthesized
tttcagttcaaccaacaaat

SEQ ID NO: 294323 - DNA, 20 bp, Artificial Sequence
  chemically synthesized
aatttgttggttgaactgaa

SEQ ID NO: 294324 - DNA, 20 bp, Artificial Sequence
  chemically synthesized
ctctattttcatggactttt

SEQ ID NO: 294325 - DNA, 20 bp, Artificial Sequence
  chemically synthesized
aactgaaaagtccatgaaaa

SEQ ID NO: 294326 - DNA, 20 bp, Artificial Sequence
  chemically synthesized
ttgtagctactctattttca

SEQ ID NO: 294327 - DNA, 20 bp, Artificial Sequence
  chemically synthesized
ctgaaaagtccatgaaaata

SEQ ID NO: 294328 - DNA, 20 bp, Artificial Sequence
  chemically synthesized
aaaagtccatgaaaatagag

SEQ ID NO: 294329 - DNA, 20 bp, Artificial Sequence
  chemically synthesized
aatagagtagctacaacatc

SEQ ID NO: 294330 - DNA, 20 bp, Artificial Sequence
  chemically synthesized
ttacttttaactagatgttg

SEQ ID NO: 294331 - DNA, 20 bp, Artificial Sequence
  chemically synthesized
tagctacaacatctagttaa

SEQ ID NO: 294332 - DNA, 20 bp, Artificial Sequence
  chemically synthesized
tctaggatcttacttttaac

SEQ ID NO: 294333 - DNA, 20 bp, Artificial Sequence
  chemically synthesized
tacaacatctagttaaaagt

SEQ ID NO: 294334 - DNA, 20 bp, Artificial Sequence
  chemically synthesized
tctagttaaaagtaagatcc

SEQ ID NO: 294335 - DNA, 20 bp, Artificial Sequence
  chemically synthesized
taaaagtaagatcctagatg

SEQ ID NO: 294336 - DNA, 20 bp, Artificial Sequence
  chemically synthesized
gaaatattggagcttcatct

SEQ ID NO: 294337 - DNA, 20 bp, Artificial Sequence
  chemically synthesized
agaaatattggagcttcatc

SEQ ID NO: 294338 - DNA, 20 bp, Artificial Sequence
  chemically synthesized
ttgagaaaatagaaatattg

SEQ ID NO: 294339 - DNA, 20 bp, Artificial Sequence
  chemically synthesized
agttgagaaaatagaaatat

SEQ ID NO: 294340 - DNA, 20 bp, Artificial Sequence
  chemically synthesized
aaactaataagttgagaaaa

SEQ ID NO: 294341 - DNA, 20 bp, Artificial Sequence
  chemically synthesized
tttctattttctcaacttat

SEQ ID NO: 294342 - DNA, 20 bp, Artificial Sequence
  chemically synthesized
atcacaaaaactaataagtt

SEQ ID NO: 294343 - DNA, 20 bp, Artificial Sequence
  chemically synthesized
cttagatcacaaaaactaat

SEQ ID NO: 294344 - DNA, 20 bp, Artificial Sequence
  chemically synthesized
cttattagtttttgtgatct

SEQ ID NO: 294345 - DNA, 20 bp, Artificial Sequence
  chemically synthesized
gctgctaaggacagataact

SEQ ID NO: 294346 - DNA, 20 bp, Artificial Sequence
  chemically synthesized
tgatctaagttatctgtcct

SEQ ID NO: 294347 - DNA, 20 bp, Artificial Sequence
  chemically synthesized
tctaagttatctgtccttag

SEQ ID NO: 294348 - DNA, 20 bp, Artificial Sequence
  chemically synthesized
atgccataagctgctaagga

SEQ ID NO: 294349 - DNA, 20 bp, Artificial Sequence
  chemically synthesized
aagtatgccataagctgcta

SEQ ID NO: 294350 - DNA, 20 bp, Artificial Sequence
  chemically synthesized
caagtatgccataagctgct

SEQ ID NO: 294351 - DNA, 20 bp, Artificial Sequence
  chemically synthesized
tatctgtccttagcagctta

SEQ ID NO: 294352 - DNA, 20 bp, Artificial Sequence
  chemically synthesized
gtgaaaaacaagtatgccat

SEQ ID NO: 294353 - DNA, 20 bp, Artificial Sequence
  chemically synthesized
aaatgtaagtagtgaaaaac

SEQ ID NO: 294354 - DNA, 20 bp, Artificial Sequence
  chemically synthesized
taatggagaataaatgtaag

SEQ ID NO: 294355 - DNA, 20 bp, Artificial Sequence
  chemically synthesized
ttttaatggagaataaatgt

SEQ ID NO: 294356 - DNA, 20 bp, Artificial Sequence
  chemically synthesized
ttacatttattctccattaa

SEQ ID NO: 294357 - DNA, 20 bp, Artificial Sequence
  chemically synthesized
tacatttattctccattaaa

SEQ ID NO: 294358 - DNA, 20 bp, Artificial Sequence
  chemically synthesized
ataacatttaccttttaatg

SEQ ID NO: 294359 - DNA, 20 bp, Artificial Sequence
  chemically synthesized
atataacatttaccttttaa

SEQ ID NO: 294360 - DNA, 20 bp, Artificial Sequence
  chemically synthesized
attaaaaggtaaatgttata

SEQ ID NO: 294361 - DNA, 20 bp, Artificial Sequence
  chemically synthesized
aaaggtaaatgttatatgga

SEQ ID NO: 294362 - DNA, 20 bp, Artificial Sequence
  chemically synthesized
tgttatatggaaagcaccct

SEQ ID NO: 294363 - DNA, 20 bp, Artificial Sequence
  chemically synthesized
tttctcctctaagatgctca

SEQ ID NO: 294364 - DNA, 20 bp, Artificial Sequence
  chemically synthesized
ttttctcctctaagatgctc

SEQ ID NO: 294365 - DNA, 20 bp, Artificial Sequence
  chemically synthesized
ggaaagcaccctgagcatct

SEQ ID NO: 294366 - DNA, 20 bp, Artificial Sequence
  chemically synthesized
tttttctcctctaagatgct

SEQ ID NO: 294367 - DNA, 20 bp, Artificial Sequence
  chemically synthesized
aaagcaccctgagcatctta

SEQ ID NO: 294368 - DNA, 20 bp, Artificial Sequence
  chemically synthesized
aagcaccctgagcatcttag

SEQ ID NO: 294369 - DNA, 20 bp, Artificial Sequence
  chemically synthesized
gcaccctgagcatcttagag

SEQ ID NO: 294370 - DNA, 20 bp, Artificial Sequence
  chemically synthesized
gtgcttattttttctcctct

SEQ ID NO: 294371 - DNA, 20 bp, Artificial Sequence
  chemically synthesized
catcttagaggagaaaaaat

SEQ ID NO: 294372 - DNA, 20 bp, Artificial Sequence
  chemically synthesized
gagaaaaaataagcacattt

SEQ ID NO: 294373 - DNA, 20 bp, Artificial Sequence
  chemically synthesized
aaatatgtaatgtaaatatc

SEQ ID NO: 294374 - DNA, 20 bp, Artificial Sequence
  chemically synthesized
atgtaatgtaaatatcaaga

SEQ ID NO: 294375 - DNA, 20 bp, Artificial Sequence
  chemically synthesized
aatgtaaatatcaagaaaga

SEQ ID NO: 294376 - DNA, 20 bp, Artificial Sequence
  chemically synthesized
atgtaaatatcaagaaagac

SEQ ID NO: 294377 - DNA, 20 bp, Artificial Sequence
  chemically synthesized
gtaaatatcaagaaagacag

SEQ ID NO: 294378 - DNA, 20 bp, Artificial Sequence
  chemically synthesized
taaatatcaagaaagacagg

SEQ ID NO: 294379 - DNA, 20 bp, Artificial Sequence
  chemically synthesized
tcaagaaagacaggaggatt

SEQ ID NO: 294380 - DNA, 20 bp, Artificial Sequence
  chemically synthesized
caagaaagacaggaggattt

SEQ ID NO: 294381 - DNA, 20 bp, Artificial Sequence
  chemically synthesized
aagaaagacaggaggatttg

SEQ ID NO: 294382 - DNA, 20 bp, Artificial Sequence
  chemically synthesized
acaggaggatttggggtgtc

SEQ ID NO: 294383 - DNA, 20 bp, Artificial Sequence
  chemically synthesized
tctggataaagttcaaattc

SEQ ID NO: 294384 - DNA, 20 bp, Artificial Sequence
  chemically synthesized
tccagaatttgaactttatc

SEQ ID NO: 294385 - DNA, 20 bp, Artificial Sequence
  chemically synthesized
tgtatattgttttctggata

SEQ ID NO: 294386 - DNA, 20 bp, Artificial Sequence
  chemically synthesized
ttcatctgtatattgttttc

SEQ ID NO: 294387 - DNA, 20 bp, Artificial Sequence
  chemically synthesized
tttatccagaaaacaatata

SEQ ID NO: 294388 - DNA, 20 bp, Artificial Sequence
  chemically synthesized
agaaaacaatatacagatga

SEQ ID NO: 294389 - DNA, 20 bp, Artificial Sequence
  chemically synthesized
ttcctttatgtgttgtattg

SEQ ID NO: 294390 - DNA, 20 bp, Artificial Sequence
  chemically synthesized
ataccacaatacaacacata

SEQ ID NO: 294391 - DNA, 20 bp, Artificial Sequence
  chemically synthesized
taccacaatacaacacataa

SEQ ID NO: 294392 - DNA, 20 bp, Artificial Sequence
  chemically synthesized
cataaaggaacaatgacaac

SEQ ID NO: 294393 - DNA, 20 bp, Artificial Sequence
  chemically synthesized
aggaacaatgacaacaagct

SEQ ID NO: 294394 - DNA, 20 bp, Artificial Sequence
  chemically synthesized
caatgacaacaagctgagta

SEQ ID NO: 294395 - DNA, 20 bp, Artificial Sequence
  chemically synthesized
tcaaagaacatcactttact

SEQ ID NO: 294396 - DNA, 20 bp, Artificial Sequence
  chemically synthesized
tgagtaaagtgatgttcttt

SEQ ID NO: 294397 - DNA, 20 bp, Artificial Sequence
  chemically synthesized
ataactctaaaagtaactca

SEQ ID NO: 294398 - DNA, 20 bp, Artificial Sequence
  chemically synthesized
gatgttctttgagttacttt

SEQ ID NO: 294399 - DNA, 20 bp, Artificial Sequence
  chemically synthesized
tgttctttgagttactttta

SEQ ID NO: 294400 - DNA, 20 bp, Artificial Sequence
  chemically synthesized
ataggagaagataactctaa

SEQ ID NO: 294401 - DNA, 20 bp, Artificial Sequence
  chemically synthesized
ttagagttatcttctcctat

SEQ ID NO: 294402 - DNA, 20 bp, Artificial Sequence
  chemically synthesized
agaaacccctctgataggag

SEQ ID NO: 294403 - DNA, 20 bp, Artificial Sequence
  chemically synthesized
agagttatcttctcctatca

SEQ ID NO: 294404 - DNA, 20 bp, Artificial Sequence
  chemically synthesized
gagttatcttctcctatcag

SEQ ID NO: 294405 - DNA, 20 bp, Artificial Sequence
  chemically synthesized
aatagaaacccctctgatag

SEQ ID NO: 294406 - DNA, 20 bp, Artificial Sequence
  chemically synthesized
agttatcttctcctatcaga

SEQ ID NO: 294407 - DNA, 20 bp, Artificial Sequence
  chemically synthesized
gttatcttctcctatcagag

SEQ ID NO: 294408 - DNA, 20 bp, Artificial Sequence
  chemically synthesized
aaaatagaaacccctctgat

SEQ ID NO: 294409 - DNA, 20 bp, Artificial Sequence
  chemically synthesized
taaaatagaaacccctctga

SEQ ID NO: 294410 - DNA, 20 bp, Artificial Sequence
  chemically synthesized
aaagctcaatgtagataaaa

SEQ ID NO: 294411 - DNA, 20 bp, Artificial Sequence
  chemically synthesized
gtttctattttatctacatt

SEQ ID NO: 294412 - DNA, 20 bp, Artificial Sequence
  chemically synthesized
actaaagcaaaagctcaatg

SEQ ID NO: 294413 - DNA, 20 bp, Artificial Sequence
  chemically synthesized
tctacattgagcttttgctt

SEQ ID NO: 294414 - DNA, 20 bp, Artificial Sequence
  chemically synthesized
tttcacaaaaactaaagcaa

SEQ ID NO: 294415 - DNA, 20 bp, Artificial Sequence
  chemically synthesized
atatcatttcacaaaaacta

SEQ ID NO: 294416 - DNA, 20 bp, Artificial Sequence
  chemically synthesized
tttttgtgaaatgatataaa

SEQ ID NO: 294417 - DNA, 20 bp, Artificial Sequence
  chemically synthesized
ttgtgaaatgatataaaaag

SEQ ID NO: 294418 - DNA, 20 bp, Artificial Sequence
  chemically synthesized
aatgatataaaaagtagaat

SEQ ID NO: 294419 - DNA, 20 bp, Artificial Sequence
  chemically synthesized
agtagaatgagaacactatg

SEQ ID NO: 294420 - DNA, 20 bp, Artificial Sequence
  chemically synthesized
caatatttataaagaccaca

SEQ ID NO: 294421 - DNA, 20 bp, Artificial Sequence
  chemically synthesized
atttattttcaatatttata

SEQ ID NO: 294422 - DNA, 20 bp, Artificial Sequence
  chemically synthesized
tattgaaaataaattatcaa

SEQ ID NO: 294423 - DNA, 20 bp, Artificial Sequence
  chemically synthesized
ttatgatgataacatttaga

SEQ ID NO: 294424 - DNA, 20 bp, Artificial Sequence
  chemically synthesized
attatgatgataacatttag

SEQ ID NO: 294425 - DNA, 20 bp, Artificial Sequence
  chemically synthesized
gattatgatgataacattta

SEQ ID NO: 294426 - DNA, 20 bp, Artificial Sequence
  chemically synthesized
gagattatgatgataacatt

SEQ ID NO: 294427 - DNA, 20 bp, Artificial Sequence
  chemically synthesized
tctagtaagcttagaataaa

SEQ ID NO: 294428 - DNA, 20 bp, Artificial Sequence
  chemically synthesized
catcataatctctttattct

SEQ ID NO: 294429 - DNA, 20 bp, Artificial Sequence
  chemically synthesized
attctagtaagcttagaata

SEQ ID NO: 294430 - DNA, 20 bp, Artificial Sequence
  chemically synthesized
tctctttattctaagcttac

SEQ ID NO: 294431 - DNA, 20 bp, Artificial Sequence
  chemically synthesized
ttaattgattctagtaagct

SEQ ID NO: 294432 - DNA, 20 bp, Artificial Sequence
  chemically synthesized
taatattaattgattctagt

SEQ ID NO: 294433 - DNA, 20 bp, Artificial Sequence
  chemically synthesized
ttagtaatattaattgattc

SEQ ID NO: 294434 - DNA, 20 bp, Artificial Sequence
  chemically synthesized
gaatcaattaatattactaa

SEQ ID NO: 294435 - DNA, 20 bp, Artificial Sequence
  chemically synthesized
atcaattaatattactaaca

SEQ ID NO: 294436 - DNA, 20 bp, Artificial Sequence
  chemically synthesized
atataagttttgttctctgt

SEQ ID NO: 294437 - DNA, 20 bp, Artificial Sequence
  chemically synthesized
ttcctgagatattcaaatat

SEQ ID NO: 294438 - DNA, 20 bp, Artificial Sequence
  chemically synthesized
aaacttatatttgaatatct

SEQ ID NO: 294439 - DNA, 20 bp, Artificial Sequence
  chemically synthesized
aacttatatttgaatatctc

SEQ ID NO: 294440 - DNA, 20 bp, Artificial Sequence
  chemically synthesized
aaaggtcaaatatgattcct

SEQ ID NO: 294441 - DNA, 20 bp, Artificial Sequence
  chemically synthesized
tgtggttaacaagatattaa

SEQ ID NO: 294442 - DNA, 20 bp, Artificial Sequence
  chemically synthesized
atgtggttaacaagatatta

SEQ ID NO: 294443 - DNA, 20 bp, Artificial Sequence
  chemically synthesized
actggaacaatgtggttaac

SEQ ID NO: 294444 - DNA, 20 bp, Artificial Sequence
  chemically synthesized
ttagaataactggaacaatg

SEQ ID NO: 294445 - DNA, 20 bp, Artificial Sequence
  chemically synthesized
tcttgttaaccacattgttc

SEQ ID NO: 294446 - DNA, 20 bp, Artificial Sequence
  chemically synthesized
actatttatattagaataac

SEQ ID NO: 294447 - DNA, 20 bp, Artificial Sequence
  chemically synthesized
tccagttattctaatataaa

SEQ ID NO: 294448 - DNA, 20 bp, Artificial Sequence
  chemically synthesized
gttactgagactatttatat

SEQ ID NO: 294449 - DNA, 20 bp, Artificial Sequence
  chemically synthesized
tattctaatataaatagtct

SEQ ID NO: 294450 - DNA, 20 bp, Artificial Sequence
  chemically synthesized
tagttgtggtggttgttact

SEQ ID NO: 294451 - DNA, 20 bp, Artificial Sequence
  chemically synthesized
tgtttttgttgtagttgtgg

SEQ ID NO: 294452 - DNA, 20 bp, Artificial Sequence
  chemically synthesized
tattgtttttgttgtagttg

SEQ ID NO: 294453 - DNA, 20 bp, Artificial Sequence
  chemically synthesized
atagattattgtttttgttg

SEQ ID NO: 294454 - DNA, 20 bp, Artificial Sequence
  chemically synthesized
aacaaaaacaataatctata

SEQ ID NO: 294455 - DNA, 20 bp, Artificial Sequence
  chemically synthesized
aaaaacaataatctataaag

SEQ ID NO: 294456 - DNA, 20 bp, Artificial Sequence
  chemically synthesized
aaaacaataatctataaagt

SEQ ID NO: 294457 - DNA, 20 bp, Artificial Sequence
  chemically synthesized
aagtaatagtacctacttta

SEQ ID NO: 294458 - DNA, 20 bp, Artificial Sequence
  chemically synthesized
ctgtcaaaatgggaaagtaa

SEQ ID NO: 294459 - DNA, 20 bp, Artificial Sequence
  chemically synthesized
cctcctctgtcaaaatggga

SEQ ID NO: 294460 - DNA, 20 bp, Artificial Sequence
  chemically synthesized
ctattactttcccattttga

SEQ ID NO: 294461 - DNA, 20 bp, Artificial Sequence
  chemically synthesized
cttccctcctctgtcaaaat

SEQ ID NO: 294462 - DNA, 20 bp, Artificial Sequence
  chemically synthesized
acttccctcctctgtcaaaa

SEQ ID NO: 294463 - DNA, 20 bp, Artificial Sequence
  chemically synthesized
attactttcccattttgaca

SEQ ID NO: 294464 - DNA, 20 bp, Artificial Sequence
  chemically synthesized
ttactttcccattttgacag

SEQ ID NO: 294465 - DNA, 20 bp, Artificial Sequence
  chemically synthesized
actttcccattttgacagag

SEQ ID NO: 294466 - DNA, 20 bp, Artificial Sequence
  chemically synthesized
ctttcccattttgacagagg

SEQ ID NO: 294467 - DNA, 20 bp, Artificial Sequence
  chemically synthesized
tttcccattttgacagagga

SEQ ID NO: 294468 - DNA, 20 bp, Artificial Sequence
  chemically synthesized
cccattttgacagaggaggg

SEQ ID NO: 294469 - DNA, 20 bp, Artificial Sequence
  chemically synthesized
ttttgacagaggagggaagt

SEQ ID NO: 294470 - DNA, 20 bp, Artificial Sequence
  chemically synthesized
tttgacagaggagggaagtg

SEQ ID NO: 294471 - DNA, 20 bp, Artificial Sequence
  chemically synthesized
cagaggagggaagtgaggca

SEQ ID NO: 294472 - DNA, 20 bp, Artificial Sequence
  chemically synthesized
gaggagggaagtgaggcaca

SEQ ID NO: 294473 - DNA, 20 bp, Artificial Sequence
  chemically synthesized
ggagggaagtgaggcacaga

SEQ ID NO: 294474 - DNA, 20 bp, Artificial Sequence
  chemically synthesized
gagggaagtgaggcacagag

SEQ ID NO: 294475 - DNA, 20 bp, Artificial Sequence
  chemically synthesized
aaattttgaaaacaatgcaa

SEQ ID NO: 294476 - DNA, 20 bp, Artificial Sequence
  chemically synthesized
aaggaatcttattttcaatg

SEQ ID NO: 294477 - DNA, 20 bp, Artificial Sequence
  chemically synthesized
gcaatagccacattgaaaat

SEQ ID NO: 294478 - DNA, 20 bp, Artificial Sequence
  chemically synthesized
aactataatttggtagtata

SEQ ID NO: 294479 - DNA, 20 bp, Artificial Sequence
  chemically synthesized
aaactataatttggtagtat

SEQ ID NO: 294480 - DNA, 20 bp, Artificial Sequence
  chemically synthesized
gtacataaactataatttgg

SEQ ID NO: 294481 - DNA, 20 bp, Artificial Sequence
  chemically synthesized
ttccttatactaccaaatta

SEQ ID NO: 294482 - DNA, 20 bp, Artificial Sequence
  chemically synthesized
tatgtacataaactataatt

SEQ ID NO: 294483 - DNA, 20 bp, Artificial Sequence
  chemically synthesized
caattattatgacatacata

SEQ ID NO: 294484 - DNA, 20 bp, Artificial Sequence
  chemically synthesized
atgtatgtcataataattgt

SEQ ID NO: 294485 - DNA, 20 bp, Artificial Sequence
  chemically synthesized
atgtcataataattgtaaga

SEQ ID NO: 294486 - DNA, 20 bp, Artificial Sequence
  chemically synthesized
tcataataattgtaagaaag

SEQ ID NO: 294487 - DNA, 20 bp, Artificial Sequence
  chemically synthesized
aattgtaagaaagaagaaat

SEQ ID NO: 294488 - DNA, 20 bp, Artificial Sequence
  chemically synthesized
cagttttctcttgtataaaa

SEQ ID NO: 294489 - DNA, 20 bp, Artificial Sequence
  chemically synthesized
tgttgtataccattttatac

SEQ ID NO: 294490 - DNA, 20 bp, Artificial Sequence
  chemically synthesized
ttgtataccattttatacaa

SEQ ID NO: 294491 - DNA, 20 bp, Artificial Sequence
  chemically synthesized
attttatacaagagaaaact

SEQ ID NO: 294492 - DNA, 20 bp, Artificial Sequence
  chemically synthesized
tacaagagaaaactgagcat

SEQ ID NO: 294493 - DNA, 20 bp, Artificial Sequence
  chemically synthesized
gatttaatcttactgatgct

SEQ ID NO: 294494 - DNA, 20 bp, Artificial Sequence
  chemically synthesized
agagaaaactgagcatcagt

SEQ ID NO: 294495 - DNA, 20 bp, Artificial Sequence
  chemically synthesized
taagattaaatcgtatatca

SEQ ID NO: 294496 - DNA, 20 bp, Artificial Sequence
  chemically synthesized
aagattaaatcgtatatcaa

SEQ ID NO: 294497 - DNA, 20 bp, Artificial Sequence
  chemically synthesized
tatatcaaaggtcatcatat

SEQ ID NO: 294498 - DNA, 20 bp, Artificial Sequence
  chemically synthesized
atatcaaaggtcatcatatt

SEQ ID NO: 294499 - DNA, 20 bp, Artificial Sequence
  chemically synthesized
tcaaaggtcatcatattagg

SEQ ID NO: 294500 - DNA, 20 bp, Artificial Sequence
  chemically synthesized
gtcatcatattaggaagttt

SEQ ID NO: 294501 - DNA, 20 bp, Artificial Sequence
  chemically synthesized
ggaagttttagattcaatat

SEQ ID NO: 294502 - DNA, 20 bp, Artificial Sequence
  chemically synthesized
aaattataagtagaagagca

SEQ ID NO: 294503 - DNA, 20 bp, Artificial Sequence
  chemically synthesized
gaaattataagtagaagagc

SEQ ID NO: 294504 - DNA, 20 bp, Artificial Sequence
  chemically synthesized
tgaaattataagtagaagag

SEQ ID NO: 294505 - DNA, 20 bp, Artificial Sequence
  chemically synthesized
agctgaaattataagtagaa

SEQ ID NO: 294506 - DNA, 20 bp, Artificial Sequence
  chemically synthesized
aaagctgaaattataagtag

SEQ ID NO: 294507 - DNA, 20 bp, Artificial Sequence
  chemically synthesized
aagaaagctgaaattataag

SEQ ID NO: 294508 - DNA, 20 bp, Artificial Sequence
  chemically synthesized
tgctcttctacttataattt

SEQ ID NO: 294509 - DNA, 20 bp, Artificial Sequence
  chemically synthesized
tgaaagaaagctgaaattat

SEQ ID NO: 294510 - DNA, 20 bp, Artificial Sequence
  chemically synthesized
ttataatttcagctttcttt

SEQ ID NO: 294511 - DNA, 20 bp, Artificial Sequence
  chemically synthesized
agcagagcatgtctgaaaga

SEQ ID NO: 294512 - DNA, 20 bp, Artificial Sequence
  chemically synthesized
caacagcagagcatgtctga

SEQ ID NO: 294513 - DNA, 20 bp, Artificial Sequence
  chemically synthesized
aaatacccctagcaacagca

SEQ ID NO: 294514 - DNA, 20 bp, Artificial Sequence
  chemically synthesized
cagacatgctctgctgttgc

SEQ ID NO: 294515 - DNA, 20 bp, Artificial Sequence
  chemically synthesized
tgaaatacccctagcaacag

SEQ ID NO: 294516 - DNA, 20 bp, Artificial Sequence
  chemically synthesized
agacatgctctgctgttgct

SEQ ID NO: 294517 - DNA, 20 bp, Artificial Sequence
  chemically synthesized
gacatgctctgctgttgcta

SEQ ID NO: 294518 - DNA, 20 bp, Artificial Sequence
  chemically synthesized
acatgctctgctgttgctag

SEQ ID NO: 294519 - DNA, 20 bp, Artificial Sequence
  chemically synthesized
cattgaaatacccctagcaa

SEQ ID NO: 294520 - DNA, 20 bp, Artificial Sequence
  chemically synthesized
aatatccattgaaatacccc

SEQ ID NO: 294521 - DNA, 20 bp, Artificial Sequence
  chemically synthesized
tgttgctaggggtatttcaa

SEQ ID NO: 294522 - DNA, 20 bp, Artificial Sequence
  chemically synthesized
ttcaatggatattattcaaa

SEQ ID NO: 294523 - DNA, 20 bp, Artificial Sequence
  chemically synthesized
tcaatggatattattcaaaa

SEQ ID NO: 294524 - DNA, 20 bp, Artificial Sequence
  chemically synthesized
gatattattcaaaaaggtgt

SEQ ID NO: 294525 - DNA, 20 bp, Artificial Sequence
  chemically synthesized
tcaaaaaggtgtgagcgtat

SEQ ID NO: 294526 - DNA, 20 bp, Artificial Sequence
  chemically synthesized
gagcgtatcagaatatatat

SEQ ID NO: 294527 - DNA, 20 bp, Artificial Sequence
  chemically synthesized
gcgtatcagaatatatatca

SEQ ID NO: 294528 - DNA, 20 bp, Artificial Sequence
  chemically synthesized
agaatatatatcagagcaaa

SEQ ID NO: 294529 - DNA, 20 bp, Artificial Sequence
  chemically synthesized
aatatatatcagagcaaaca

SEQ ID NO: 294530 - DNA, 20 bp, Artificial Sequence
  chemically synthesized
atcagagcaaacagagctta

SEQ ID NO: 294531 - DNA, 20 bp, Artificial Sequence
  chemically synthesized
agcaaacagagcttatagtt

SEQ ID NO: 294532 - DNA, 20 bp, Artificial Sequence
  chemically synthesized
ccctaatacatccaaactat

SEQ ID NO: 294533 - DNA, 20 bp, Artificial Sequence
  chemically synthesized
agcttatagtttggatgtat

SEQ ID NO: 294534 - DNA, 20 bp, Artificial Sequence
  chemically synthesized
gcttatagtttggatgtatt

SEQ ID NO: 294535 - DNA, 20 bp, Artificial Sequence
  chemically synthesized
cttatagtttggatgtatta

SEQ ID NO: 294536 - DNA, 20 bp, Artificial Sequence
  chemically synthesized
aacatatttaactattaatt

SEQ ID NO: 294537 - DNA, 20 bp, Artificial Sequence
  chemically synthesized
tgttggccctgctgaattaa

SEQ ID NO: 294538 - DNA, 20 bp, Artificial Sequence
  chemically synthesized
atatttaactattaattcag

SEQ ID NO: 294539 - DNA, 20 bp, Artificial Sequence
  chemically synthesized
tatttaactattaattcagc

SEQ ID NO: 294540 - DNA, 20 bp, Artificial Sequence
  chemically synthesized
atttaactattaattcagca

SEQ ID NO: 294541 - DNA, 20 bp, Artificial Sequence
  chemically synthesized
attaattcagcagggccaac

SEQ ID NO: 294542 - DNA, 20 bp, Artificial Sequence
  chemically synthesized
cattccttgtgatatcttgt

SEQ ID NO: 294543 - DNA, 20 bp, Artificial Sequence
  chemically synthesized
cagggccaacaagatatcac

SEQ ID NO: 294544 - DNA, 20 bp, Artificial Sequence
  chemically synthesized
agggccaacaagatatcaca

SEQ ID NO: 294545 - DNA, 20 bp, Artificial Sequence
  chemically synthesized
caagatatcacaaggaatgc

SEQ ID NO: 294546 - DNA, 20 bp, Artificial Sequence
  chemically synthesized
aagatatcacaaggaatgcc

SEQ ID NO: 294547 - DNA, 20 bp, Artificial Sequence
  chemically synthesized
acaaggaatgccgggtcact

SEQ ID NO: 294548 - DNA, 20 bp, Artificial Sequence
  chemically synthesized
agagaccattctgagtgacc

SEQ ID NO: 294549 - DNA, 20 bp, Artificial Sequence
  chemically synthesized
gaatgccgggtcactcagaa

SEQ ID NO: 294550 - DNA, 20 bp, Artificial Sequence
  chemically synthesized
agactgtcagagaccattct

SEQ ID NO: 294551 - DNA, 20 bp, Artificial Sequence
  chemically synthesized
tcactcagaatggtctctga

SEQ ID NO: 294552 - DNA, 20 bp, Artificial Sequence
  chemically synthesized
aatcagcctatagactgtca

SEQ ID NO: 294553 - DNA, 20 bp, Artificial Sequence
  chemically synthesized
gtaatcagcctatagactgt

SEQ ID NO: 294554 - DNA, 20 bp, Artificial Sequence
  chemically synthesized
gaatggtctctgacagtcta

SEQ ID NO: 294555 - DNA, 20 bp, Artificial Sequence
  chemically synthesized
aatggtctctgacagtctat

SEQ ID NO: 294556 - DNA, 20 bp, Artificial Sequence
  chemically synthesized
cagagttggtaatcagccta

SEQ ID NO: 294557 - DNA, 20 bp, Artificial Sequence
  chemically synthesized
ctgtatacagagttggtaat

SEQ ID NO: 294558 - DNA, 20 bp, Artificial Sequence
  chemically synthesized
atttgagctgtatacagagt

SEQ ID NO: 294559 - DNA, 20 bp, Artificial Sequence
  chemically synthesized
ctgattaccaactctgtata

SEQ ID NO: 294560 - DNA, 20 bp, Artificial Sequence
  chemically synthesized
gtttatttgagctgtataca

SEQ ID NO: 294561 - DNA, 20 bp, Artificial Sequence
  chemically synthesized
cagtttatttgagctgtata

SEQ ID NO: 294562 - DNA, 20 bp, Artificial Sequence
  chemically synthesized
accagttattcagtttattt

SEQ ID NO: 294563 - DNA, 20 bp, Artificial Sequence
  chemically synthesized
gctcaaataaactgaataac

SEQ ID NO: 294564 - DNA, 20 bp, Artificial Sequence
  chemically synthesized
ctctttatgcaccagttatt

SEQ ID NO: 294565 - DNA, 20 bp, Artificial Sequence
  chemically synthesized
aactgaataactggtgcata

SEQ ID NO: 294566 - DNA, 20 bp, Artificial Sequence
  chemically synthesized
ctatgtgtctctttatgcac

SEQ ID NO: 294567 - DNA, 20 bp, Artificial Sequence
  chemically synthesized
ctgaataactggtgcataaa

SEQ ID NO: 294568 - DNA, 20 bp, Artificial Sequence
  chemically synthesized
ctggtgcataaagagacaca

SEQ ID NO: 294569 - DNA, 20 bp, Artificial Sequence
  chemically synthesized
ataaagagacacatagaccc

SEQ ID NO: 294570 - DNA, 20 bp, Artificial Sequence
  chemically synthesized
agagacacatagaccccaga

SEQ ID NO: 294571 - DNA, 20 bp, Artificial Sequence
  chemically synthesized
gacacatagaccccagaaag

SEQ ID NO: 294572 - DNA, 20 bp, Artificial Sequence
  chemically synthesized
ccattgactgcttctttctg

SEQ ID NO: 294573 - DNA, 20 bp, Artificial Sequence
  chemically synthesized
accattgactgcttctttct

SEQ ID NO: 294574 - DNA, 20 bp, Artificial Sequence
  chemically synthesized
taccattgactgcttctttc

SEQ ID NO: 294575 - DNA, 20 bp, Artificial Sequence
  chemically synthesized
acatagaccccagaaagaag

SEQ ID NO: 294576 - DNA, 20 bp, Artificial Sequence
  chemically synthesized
ccccagaaagaagcagtcaa

SEQ ID NO: 294577 - DNA, 20 bp, Artificial Sequence
  chemically synthesized
tctgaacattgacaaatatg

SEQ ID NO: 294578 - DNA, 20 bp, Artificial Sequence
  chemically synthesized
tctgcatatttgtcaatgtt

SEQ ID NO: 294579 - DNA, 20 bp, Artificial Sequence
  chemically synthesized
gtcaatgttcagacgatatc

SEQ ID NO: 294580 - DNA, 20 bp, Artificial Sequence
  chemically synthesized
tcaatgttcagacgatatct

SEQ ID NO: 294581 - DNA, 20 bp, Artificial Sequence
  chemically synthesized
taatgtgccctaacagaacc

SEQ ID NO: 294582 - DNA, 20 bp, Artificial Sequence
  chemically synthesized
agacgatatctgggttctgt

SEQ ID NO: 294583 - DNA, 20 bp, Artificial Sequence
  chemically synthesized
gacgatatctgggttctgtt

SEQ ID NO: 294584 - DNA, 20 bp, Artificial Sequence
  chemically synthesized
acgatatctgggttctgtta

SEQ ID NO: 294585 - DNA, 20 bp, Artificial Sequence
  chemically synthesized
ttgaaagtaatgtgccctaa

SEQ ID NO: 294586 - DNA, 20 bp, Artificial Sequence
  chemically synthesized
tgttagggcacattactttc

SEQ ID NO: 294587 - DNA, 20 bp, Artificial Sequence
  chemically synthesized
ttagggcacattactttcaa

SEQ ID NO: 294588 - DNA, 20 bp, Artificial Sequence
  chemically synthesized
tagggcacattactttcaag

SEQ ID NO: 294589 - DNA, 20 bp, Artificial Sequence
  chemically synthesized
ttttgcaatgttcctcttga

SEQ ID NO: 294590 - DNA, 20 bp, Artificial Sequence
  chemically synthesized
aagaggaacattgcaaaatg

SEQ ID NO: 294591 - DNA, 20 bp, Artificial Sequence
  chemically synthesized
gaggaacattgcaaaatgaa

SEQ ID NO: 294592 - DNA, 20 bp, Artificial Sequence
  chemically synthesized
aggaacattgcaaaatgaag

SEQ ID NO: 294593 - DNA, 20 bp, Artificial Sequence
  chemically synthesized
atgaagaggaatatgcatac

SEQ ID NO: 294594 - DNA, 20 bp, Artificial Sequence
  chemically synthesized
atgcatacaagtatgccttg

SEQ ID NO: 294595 - DNA, 20 bp, Artificial Sequence
  chemically synthesized
gcatacaagtatgccttgaa

SEQ ID NO: 294596 - DNA, 20 bp, Artificial Sequence
  chemically synthesized
tgtctcattcacactcttca

SEQ ID NO: 294597 - DNA, 20 bp, Artificial Sequence
  chemically synthesized
ctgtctcattcacactcttc

SEQ ID NO: 294598 - DNA, 20 bp, Artificial Sequence
  chemically synthesized
atgccttgaagagtgtgaat

SEQ ID NO: 294599 - DNA, 20 bp, Artificial Sequence
  chemically synthesized
cttgaagagtgtgaatgaga

SEQ ID NO: 294600 - DNA, 20 bp, Artificial Sequence
  chemically synthesized
agagtgtgaatgagacagtg

SEQ ID NO: 294601 - DNA, 20 bp, Artificial Sequence
  chemically synthesized
agtgtgaatgagacagtgaa

SEQ ID NO: 294602 - DNA, 20 bp, Artificial Sequence
  chemically synthesized
gaatgagacagtgaagagcc

SEQ ID NO: 294603 - DNA, 20 bp, Artificial Sequence
  chemically synthesized
tctgaaatgaaatgttttct

SEQ ID NO: 294604 - DNA, 20 bp, Artificial Sequence
  chemically synthesized
gtctgaaatgaaatgttttc

SEQ ID NO: 294605 - DNA, 20 bp, Artificial Sequence
  chemically synthesized
gcccagaaaacatttcattt

SEQ ID NO: 294606 - DNA, 20 bp, Artificial Sequence
  chemically synthesized
aaaacatttcatttcagaca

SEQ ID NO: 294607 - DNA, 20 bp, Artificial Sequence
  chemically synthesized
tttcatttcagacacagctg

SEQ ID NO: 294608 - DNA, 20 bp, Artificial Sequence
  chemically synthesized
atttcagacacagctgtaga

SEQ ID NO: 294609 - DNA, 20 bp, Artificial Sequence
  chemically synthesized
tatttttaatcaactatcta

SEQ ID NO: 294610 - DNA, 20 bp, Artificial Sequence
  chemically synthesized
tgattaaaaataataaaatt

SEQ ID NO: 294611 - DNA, 20 bp, Artificial Sequence
  chemically synthesized
taataaaatttagtataaca

SEQ ID NO: 294612 - DNA, 20 bp, Artificial Sequence
  chemically synthesized
ataaaatttagtataacaaa

SEQ ID NO: 294613 - DNA, 20 bp, Artificial Sequence
  chemically synthesized
agtataacaaagagatgtta

SEQ ID NO: 294614 - DNA, 20 bp, Artificial Sequence
  chemically synthesized
ataacaaagagatgttaaag

SEQ ID NO: 294615 - DNA, 20 bp, Artificial Sequence
  chemically synthesized
taaagaagatactacaacaa

SEQ ID NO: 294616 - DNA, 20 bp, Artificial Sequence
  chemically synthesized
aaagaagatactacaacaaa

SEQ ID NO: 294617 - DNA, 20 bp, Artificial Sequence
  chemically synthesized
gactgcaggcccttttgttg

SEQ ID NO: 294618 - DNA, 20 bp, Artificial Sequence
  chemically synthesized
aagaagatactacaacaaaa

SEQ ID NO: 294619 - DNA, 20 bp, Artificial Sequence
  chemically synthesized
tactacaacaaaagggcctg

SEQ ID NO: 294620 - DNA, 20 bp, Artificial Sequence
  chemically synthesized
agagcaaaaagggtgactgc

SEQ ID NO: 294621 - DNA, 20 bp, Artificial Sequence
  chemically synthesized
cagagcaaaaagggtgactg

SEQ ID NO: 294622 - DNA, 20 bp, Artificial Sequence
  chemically synthesized
tgataacagcagagcaaaaa

SEQ ID NO: 294623 - DNA, 20 bp, Artificial Sequence
  chemically synthesized
ctgataacagcagagcaaaa

SEQ ID NO: 294624 - DNA, 20 bp, Artificial Sequence
  chemically synthesized
actgataacagcagagcaaa

SEQ ID NO: 294625 - DNA, 20 bp, Artificial Sequence
  chemically synthesized
agacagaactgataacagca

SEQ ID NO: 294626 - DNA, 20 bp, Artificial Sequence
  chemically synthesized
cctttttgctctgctgttat

SEQ ID NO: 294627 - DNA, 20 bp, Artificial Sequence
  chemically synthesized
agagacagaactgataacag

SEQ ID NO: 294628 - DNA, 20 bp, Artificial Sequence
  chemically synthesized
agtagagacagaactgataa

SEQ ID NO: 294629 - DNA, 20 bp, Artificial Sequence
  chemically synthesized
cagatagtaagcagtagaga

SEQ ID NO: 294630 - DNA, 20 bp, Artificial Sequence
  chemically synthesized
gggacagatagtaagcagta

SEQ ID NO: 294631 - DNA, 20 bp, Artificial Sequence
  chemically synthesized
tagggacagatagtaagcag

SEQ ID NO: 294632 - DNA, 20 bp, Artificial Sequence
  chemically synthesized
tattagggacagatagtaag

SEQ ID NO: 294633 - DNA, 20 bp, Artificial Sequence
  chemically synthesized
ctttattagggacagatagt

SEQ ID NO: 294634 - DNA, 20 bp, Artificial Sequence
  chemically synthesized
agtactttattagggacaga

SEQ ID NO: 294635 - DNA, 20 bp, Artificial Sequence
  chemically synthesized
tcgaagtactttattaggga

SEQ ID NO: 294636 - DNA, 20 bp, Artificial Sequence
  chemically synthesized
cttactatctgtccctaata

SEQ ID NO: 294637 - DNA, 20 bp, Artificial Sequence
  chemically synthesized
aaggtcgaagtactttatta

SEQ ID NO: 294638 - DNA, 20 bp, Artificial Sequence
  chemically synthesized
aaaggtcgaagtactttatt

SEQ ID NO: 294639 - DNA, 20 bp, Artificial Sequence
  chemically synthesized
gaaaggtcgaagtactttat

SEQ ID NO: 294640 - DNA, 20 bp, Artificial Sequence
  chemically synthesized
actgaggttcagaaaggtcg

SEQ ID NO: 294641 - DNA, 20 bp, Artificial Sequence
  chemically synthesized
ggaaatactgaggttcagaa

SEQ ID NO: 294642 - DNA, 20 bp, Artificial Sequence
  chemically synthesized
aggaaatactgaggttcaga

SEQ ID NO: 294643 - DNA, 20 bp, Artificial Sequence
  chemically synthesized
acttcgacctttctgaacct

SEQ ID NO: 294644 - DNA, 20 bp, Artificial Sequence
  chemically synthesized
acataggaaatactgaggtt

SEQ ID NO: 294645 - DNA, 20 bp, Artificial Sequence
  chemically synthesized
attttacataggaaatactg

SEQ ID NO: 294646 - DNA, 20 bp, Artificial Sequence
  chemically synthesized
tattttacataggaaatact

SEQ ID NO: 294647 - DNA, 20 bp, Artificial Sequence
  chemically synthesized
tctttattgctattttacat

SEQ ID NO: 294648 - DNA, 20 bp, Artificial Sequence
  chemically synthesized
tcagtatttcctatgtaaaa

SEQ ID NO: 294649 - DNA, 20 bp, Artificial Sequence
  chemically synthesized
atctttattgctattttaca

SEQ ID NO: 294650 - DNA, 20 bp, Artificial Sequence
  chemically synthesized
tcctatgtaaaatagcaata

SEQ ID NO: 294651 - DNA, 20 bp, Artificial Sequence
  chemically synthesized
caataaagatacctaccatg

SEQ ID NO: 294652 - DNA, 20 bp, Artificial Sequence
  chemically synthesized
aataaagatacctaccatgt

SEQ ID NO: 294653 - DNA, 20 bp, Artificial Sequence
  chemically synthesized
cctcagaagtcccacatggt

SEQ ID NO: 294654 - DNA, 20 bp, Artificial Sequence
  chemically synthesized
ccctcagaagtcccacatgg

SEQ ID NO: 294655 - DNA, 20 bp, Artificial Sequence
  chemically synthesized
atcccctcagaagtcccaca

SEQ ID NO: 294656 - DNA, 20 bp, Artificial Sequence
  chemically synthesized
acctaccatgtgggacttct

SEQ ID NO: 294657 - DNA, 20 bp, Artificial Sequence
  chemically synthesized
cctaccatgtgggacttctg

SEQ ID NO: 294658 - DNA, 20 bp, Artificial Sequence
  chemically synthesized
ctaccatgtgggacttctga

SEQ ID NO: 294659 - DNA, 20 bp, Artificial Sequence
  chemically synthesized
taccatgtgggacttctgag

SEQ ID NO: 294660 - DNA, 20 bp, Artificial Sequence
  chemically synthesized
gcttcctttaatcccctcag

SEQ ID NO: 294661 - DNA, 20 bp, Artificial Sequence
  chemically synthesized
cgagcttcctttaatcccct

SEQ ID NO: 294662 - DNA, 20 bp, Artificial Sequence
  chemically synthesized
tgggacttctgaggggatta

SEQ ID NO: 294663 - DNA, 20 bp, Artificial Sequence
  chemically synthesized
gggacttctgaggggattaa

SEQ ID NO: 294664 - DNA, 20 bp, Artificial Sequence
  chemically synthesized
acttctgaggggattaaagg

SEQ ID NO: 294665 - DNA, 20 bp, Artificial Sequence
  chemically synthesized
cattttgggaaataaatagc

SEQ ID NO: 294666 - DNA, 20 bp, Artificial Sequence
  chemically synthesized
atctcattttgggaaataaa

SEQ ID NO: 294667 - DNA, 20 bp, Artificial Sequence
  chemically synthesized
cgctatttatttcccaaaat

SEQ ID NO: 294668 - DNA, 20 bp, Artificial Sequence
  chemically synthesized
tataaaaactatctcatttt

SEQ ID NO: 294669 - DNA, 20 bp, Artificial Sequence
  chemically synthesized
ctataaaaactatctcattt

SEQ ID NO: 294670 - DNA, 20 bp, Artificial Sequence
  chemically synthesized
atttatttcccaaaatgaga

SEQ ID NO: 294671 - DNA, 20 bp, Artificial Sequence
  chemically synthesized
ccaaaatgagatagttttta

SEQ ID NO: 294672 - DNA, 20 bp, Artificial Sequence
  chemically synthesized
agatagtttttatagtaaaa

SEQ ID NO: 294673 - DNA, 20 bp, Artificial Sequence
  chemically synthesized
gatagtttttatagtaaaat

SEQ ID NO: 294674 - DNA, 20 bp, Artificial Sequence
  chemically synthesized
atagtttttatagtaaaatg

SEQ ID NO: 294675 - DNA, 20 bp, Artificial Sequence
  chemically synthesized
agtttttatagtaaaatggg

SEQ ID NO: 294676 - DNA, 20 bp, Artificial Sequence
  chemically synthesized
tttatagtaaaatggggagc

SEQ ID NO: 294677 - DNA, 20 bp, Artificial Sequence
  chemically synthesized
ttatagtaaaatggggagct

SEQ ID NO: 294678 - DNA, 20 bp, Artificial Sequence
  chemically synthesized
tttctcagcttaattattcc

SEQ ID NO: 294679 - DNA, 20 bp, Artificial Sequence
  chemically synthesized
atggggagctaggaataatt

SEQ ID NO: 294680 - DNA, 20 bp, Artificial Sequence
  chemically synthesized
gagctaggaataattaagct

SEQ ID NO: 294681 - DNA, 20 bp, Artificial Sequence
  chemically synthesized
aataattaagctgagaaaaa

SEQ ID NO: 294682 - DNA, 20 bp, Artificial Sequence
  chemically synthesized
ttatgtcaaaccatttttct

SEQ ID NO: 294683 - DNA, 20 bp, Artificial Sequence
  chemically synthesized
tgagaaaaatggtttgacat

SEQ ID NO: 294684 - DNA, 20 bp, Artificial Sequence
  chemically synthesized
aaaatggtttgacataagct

SEQ ID NO: 294685 - DNA, 20 bp, Artificial Sequence
  chemically synthesized
cagtttgtcgggtatagtct

SEQ ID NO: 294686 - DNA, 20 bp, Artificial Sequence
  chemically synthesized
atatttcagtttgtcgggta

SEQ ID NO: 294687 - DNA, 20 bp, Artificial Sequence
  chemically synthesized
agcacatatttcagtttgtc

SEQ ID NO: 294688 - DNA, 20 bp, Artificial Sequence
  chemically synthesized
gagcacatatttcagtttgt

SEQ ID NO: 294689 - DNA, 20 bp, Artificial Sequence
  chemically synthesized
agtagaatgagcacatattt

SEQ ID NO: 294690 - DNA, 20 bp, Artificial Sequence
  chemically synthesized
aagttacctttaagtagaat

SEQ ID NO: 294691 - DNA, 20 bp, Artificial Sequence
  chemically synthesized
atatgtgctcattctactta

SEQ ID NO: 294692 - DNA, 20 bp, Artificial Sequence
  chemically synthesized
tatgtgctcattctacttaa

SEQ ID NO: 294693 - DNA, 20 bp, Artificial Sequence
  chemically synthesized
ttattgaagttacctttaag

SEQ ID NO: 294694 - DNA, 20 bp, Artificial Sequence
  chemically synthesized
agattattgaagttaccttt

SEQ ID NO: 294695 - DNA, 20 bp, Artificial Sequence
  chemically synthesized
atttctttttaagattattg

SEQ ID NO: 294696 - DNA, 20 bp, Artificial Sequence
  chemically synthesized
gtaacttcaataatcttaaa

SEQ ID NO: 294697 - DNA, 20 bp, Artificial Sequence
  chemically synthesized
agtttcctaaatttcttttt

SEQ ID NO: 294698 - DNA, 20 bp, Artificial Sequence
  chemically synthesized
aataatcttaaaaagaaatt

SEQ ID NO: 294699 - DNA, 20 bp, Artificial Sequence
  chemically synthesized
ataatcttaaaaagaaattt

SEQ ID NO: 294700 - DNA, 20 bp, Artificial Sequence
  chemically synthesized
ctcaaaaagaaaaaaaaaaa

SEQ ID NO: 294701 - DNA, 20 bp, Artificial Sequence
  chemically synthesized
ctttttttttttttcttttt

SEQ ID NO: 294702 - DNA, 20 bp, Artificial Sequence
  chemically synthesized
ttttttttttctttttgaga

SEQ ID NO: 294703 - DNA, 20 bp, Artificial Sequence
  chemically synthesized
gagcgagactccgtctcaaa

SEQ ID NO: 294704 - DNA, 20 bp, Artificial Sequence
  chemically synthesized
ttttttttctttttgagacg

SEQ ID NO: 294705 - DNA, 20 bp, Artificial Sequence
  chemically synthesized
tccagcctgggcgacagagc

SEQ ID NO: 294706 - DNA, 20 bp, Artificial Sequence
  chemically synthesized
cggagtctcgctctgtcgcc

SEQ ID NO: 294707 - DNA, 20 bp, Artificial Sequence
  chemically synthesized
gcactccagcctgggcgaca

SEQ ID NO: 294708 - DNA, 20 bp, Artificial Sequence
  chemically synthesized
ggagtctcgctctgtcgccc

SEQ ID NO: 294709 - DNA, 20 bp, Artificial Sequence
  chemically synthesized
ctgcactccagcctgggcga

SEQ ID NO: 294710 - DNA, 20 bp, Artificial Sequence
  chemically synthesized
tctcgctctgtcgcccaggc

SEQ ID NO: 294711 - DNA, 20 bp, Artificial Sequence
  chemically synthesized
tcgctctgtcgcccaggctg

SEQ ID NO: 294712 - DNA, 20 bp, Artificial Sequence
  chemically synthesized
gcgccactgcactccagcct

SEQ ID NO: 294713 - DNA, 20 bp, Artificial Sequence
  chemically synthesized
tgcgccactgcactccagcc

SEQ ID NO: 294714 - DNA, 20 bp, Artificial Sequence
  chemically synthesized
ctgtcgcccaggctggagtg

SEQ ID NO: 294715 - DNA, 20 bp, Artificial Sequence
  chemically synthesized
aagattgcgccactgcactc

SEQ ID NO: 294716 - DNA, 20 bp, Artificial Sequence
  chemically synthesized
tcgcccaggctggagtgcag

SEQ ID NO: 294717 - DNA, 20 bp, Artificial Sequence
  chemically synthesized
ggagtgcagtggcgcaatct

SEQ ID NO: 294718 - DNA, 20 bp, Artificial Sequence
  chemically synthesized
ggcggagcttgcagtgagcc

SEQ ID NO: 294719 - DNA, 20 bp, Artificial Sequence
  chemically synthesized
gcgcaatcttggctcactgc

SEQ ID NO: 294720 - DNA, 20 bp, Artificial Sequence
  chemically synthesized
cgggaggcggagcttgcagt

SEQ ID NO: 294721 - DNA, 20 bp, Artificial Sequence
  chemically synthesized
aacccgggaggcggagcttg

SEQ ID NO: 294722 - DNA, 20 bp, Artificial Sequence
  chemically synthesized
tcactgcaagctccgcctcc

SEQ ID NO: 294723 - DNA, 20 bp, Artificial Sequence
  chemically synthesized
tggcgtgaacccgggaggcg

SEQ ID NO: 294724 - DNA, 20 bp, Artificial Sequence
  chemically synthesized
cactgcaagctccgcctccc

SEQ ID NO: 294725 - DNA, 20 bp, Artificial Sequence
  chemically synthesized
aatggcgtgaacccgggagg

SEQ ID NO: 294726 - DNA, 20 bp, Artificial Sequence
  chemically synthesized
gagaatggcgtgaacccggg

SEQ ID NO: 294727 - DNA, 20 bp, Artificial Sequence
  chemically synthesized
ggagaatggcgtgaacccgg

SEQ ID NO: 294728 - DNA, 20 bp, Artificial Sequence
  chemically synthesized
aaggagaatggcgtgaaccc

SEQ ID NO: 294729 - DNA, 20 bp, Artificial Sequence
  chemically synthesized
gaaggagaatggcgtgaacc

SEQ ID NO: 294730 - DNA, 20 bp, Artificial Sequence
  chemically synthesized
aggaggctgaggaaggagaa

SEQ ID NO: 294731 - DNA, 20 bp, Artificial Sequence
  chemically synthesized
ttcacgccattctccttcct

SEQ ID NO: 294732 - DNA, 20 bp, Artificial Sequence
  chemically synthesized
tactcaggaggctgaggaag

SEQ ID NO: 294733 - DNA, 20 bp, Artificial Sequence
  chemically synthesized
gctactcaggaggctgagga

SEQ ID NO: 294734 - DNA, 20 bp, Artificial Sequence
  chemically synthesized
agctactcaggaggctgagg

SEQ ID NO: 294735 - DNA, 20 bp, Artificial Sequence
  chemically synthesized
cccagctactcaggaggctg

SEQ ID NO: 294736 - DNA, 20 bp, Artificial Sequence
  chemically synthesized
tcccagctactcaggaggct

SEQ ID NO: 294737 - DNA, 20 bp, Artificial Sequence
  chemically synthesized
ttctccttcctcagcctcct

SEQ ID NO: 294738 - DNA, 20 bp, Artificial Sequence
  chemically synthesized
tccttcctcagcctcctgag

SEQ ID NO: 294739 - DNA, 20 bp, Artificial Sequence
  chemically synthesized
tgtagtcccagctactcagg

SEQ ID NO: 294740 - DNA, 20 bp, Artificial Sequence
  chemically synthesized
ctgtagtcccagctactcag

SEQ ID NO: 294741 - DNA, 20 bp, Artificial Sequence
  chemically synthesized
tcctcagcctcctgagtagc

SEQ ID NO: 294742 - DNA, 20 bp, Artificial Sequence
  chemically synthesized
gcctgtagtcccagctactc

SEQ ID NO: 294743 - DNA, 20 bp, Artificial Sequence
  chemically synthesized
cctcagcctcctgagtagct

SEQ ID NO: 294744 - DNA, 20 bp, Artificial Sequence
  chemically synthesized
cgcctgtagtcccagctact

SEQ ID NO: 294745 - DNA, 20 bp, Artificial Sequence
  chemically synthesized
ctcctgagtagctgggacta

SEQ ID NO: 294746 - DNA, 20 bp, Artificial Sequence
  chemically synthesized
tcctgagtagctgggactac

SEQ ID NO: 294747 - DNA, 20 bp, Artificial Sequence
  chemically synthesized
gttgcgggcgcctgtagtcc

SEQ ID NO: 294748 - DNA, 20 bp, Artificial Sequence
  chemically synthesized
ggcatggttgcgggcgcctg

SEQ ID NO: 294749 - DNA, 20 bp, Artificial Sequence
  chemically synthesized
aattagccgggcatggttgc

SEQ ID NO: 294750 - DNA, 20 bp, Artificial Sequence
  chemically synthesized
aaattagccgggcatggttg

SEQ ID NO: 294751 - DNA, 20 bp, Artificial Sequence
  chemically synthesized
caggcgcccgcaaccatgcc

SEQ ID NO: 294752 - DNA, 20 bp, Artificial Sequence
  chemically synthesized
tacaaaaaattagccgggca

SEQ ID NO: 294753 - DNA, 20 bp, Artificial Sequence
  chemically synthesized
aaaaatacaaaaaattagcc

SEQ ID NO: 294754 - DNA, 20 bp, Artificial Sequence
  chemically synthesized
taaaaatacaaaaaattagc

SEQ ID NO: 294755 - DNA, 20 bp, Artificial Sequence
  chemically synthesized
ctactaaaaatacaaaaaat

SEQ ID NO: 294756 - DNA, 20 bp, Artificial Sequence
  chemically synthesized
cggctaattttttgtatttt

SEQ ID NO: 294757 - DNA, 20 bp, Artificial Sequence
  chemically synthesized
ctaattttttgtatttttag

SEQ ID NO: 294758 - DNA, 20 bp, Artificial Sequence
  chemically synthesized
aattttttgtatttttagta

SEQ ID NO: 294759 - DNA, 20 bp, Artificial Sequence
  chemically synthesized
tttgtatttttagtagagac

SEQ ID NO: 294760 - DNA, 20 bp, Artificial Sequence
  chemically synthesized
ttgtatttttagtagagacg

SEQ ID NO: 294761 - DNA, 20 bp, Artificial Sequence
  chemically synthesized
ttagtagagacgaggcttca

SEQ ID NO: 294762 - DNA, 20 bp, Artificial Sequence
  chemically synthesized
ccatcatggttgacaccatg

SEQ ID NO: 294763 - DNA, 20 bp, Artificial Sequence
  chemically synthesized
cttcatggtgtcaaccatga

SEQ ID NO: 294764 - DNA, 20 bp, Artificial Sequence
  chemically synthesized
tcaggagatcaagaccatca

SEQ ID NO: 294765 - DNA, 20 bp, Artificial Sequence
  chemically synthesized
gatcatgaagtcaggagatc

SEQ ID NO: 294766 - DNA, 20 bp, Artificial Sequence
  chemically synthesized
cgggtggatcatgaagtcag

SEQ ID NO: 294767 - DNA, 20 bp, Artificial Sequence
  chemically synthesized
ggcgggtggatcatgaagtc

SEQ ID NO: 294768 - DNA, 20 bp, Artificial Sequence
  chemically synthesized
aggcgggtggatcatgaagt

SEQ ID NO: 294769 - DNA, 20 bp, Artificial Sequence
  chemically synthesized
gtcgaggcgggtggatcatg

SEQ ID NO: 294770 - DNA, 20 bp, Artificial Sequence
  chemically synthesized
ctttgggaggtcgaggcggg

SEQ ID NO: 294771 - DNA, 20 bp, Artificial Sequence
  chemically synthesized
gcactttgggaggtcgaggc

SEQ ID NO: 294772 - DNA, 20 bp, Artificial Sequence
  chemically synthesized
agcactttgggaggtcgagg

SEQ ID NO: 294773 - DNA, 20 bp, Artificial Sequence
  chemically synthesized
ctcagcactttgggaggtcg

SEQ ID NO: 294774 - DNA, 20 bp, Artificial Sequence
  chemically synthesized
tctcagcactttgggaggtc

SEQ ID NO: 294775 - DNA, 20 bp, Artificial Sequence
  chemically synthesized
ccacccgcctcgacctccca

SEQ ID NO: 294776 - DNA, 20 bp, Artificial Sequence
  chemically synthesized
tgtaatctcagcactttggg

SEQ ID NO: 294777 - DNA, 20 bp, Artificial Sequence
  chemically synthesized
ctgtaatctcagcactttgg

SEQ ID NO: 294778 - DNA, 20 bp, Artificial Sequence
  chemically synthesized
gcctgtaatctcagcacttt

SEQ ID NO: 294779 - DNA, 20 bp, Artificial Sequence
  chemically synthesized
cctcgacctcccaaagtgct

SEQ ID NO: 294780 - DNA, 20 bp, Artificial Sequence
  chemically synthesized
cgcctgtaatctcagcactt

SEQ ID NO: 294781 - DNA, 20 bp, Artificial Sequence
  chemically synthesized
ctcccaaagtgctgagatta

SEQ ID NO: 294782 - DNA, 20 bp, Artificial Sequence
  chemically synthesized
tcccaaagtgctgagattac

SEQ ID NO: 294783 - DNA, 20 bp, Artificial Sequence
  chemically synthesized
gtggctcacgcctgtaatct

SEQ ID NO: 294784 - DNA, 20 bp, Artificial Sequence
  chemically synthesized
agtgctgagattacaggcgt

SEQ ID NO: 294785 - DNA, 20 bp, Artificial Sequence
  chemically synthesized
caggcgtgagccaccgtgcc

SEQ ID NO: 294786 - DNA, 20 bp, Artificial Sequence
  chemically synthesized
gtttccgtggccaggcacgg

SEQ ID NO: 294787 - DNA, 20 bp, Artificial Sequence
  chemically synthesized
aatgtttccgtggccaggca

SEQ ID NO: 294788 - DNA, 20 bp, Artificial Sequence
  chemically synthesized
tgagccaccgtgcctggcca

SEQ ID NO: 294789 - DNA, 20 bp, Artificial Sequence
  chemically synthesized
tcaaaaatgtttccgtggcc

SEQ ID NO: 294790 - DNA, 20 bp, Artificial Sequence
  chemically synthesized
gtcaaaaatgtttccgtggc

SEQ ID NO: 294791 - DNA, 20 bp, Artificial Sequence
  chemically synthesized
ttgtgtcaaaaatgtttccg

SEQ ID NO: 294792 - DNA, 20 bp, Artificial Sequence
  chemically synthesized
cacggaaacatttttgacac

SEQ ID NO: 294793 - DNA, 20 bp, Artificial Sequence
  chemically synthesized
cggaaacatttttgacacaa

SEQ ID NO: 294794 - DNA, 20 bp, Artificial Sequence
  chemically synthesized
tttttgacacaagagatgat

SEQ ID NO: 294795 - DNA, 20 bp, Artificial Sequence
  chemically synthesized
tttgacacaagagatgatga

SEQ ID NO: 294796 - DNA, 20 bp, Artificial Sequence
  chemically synthesized
tgatgagagtaccttgttcg

SEQ ID NO: 294797 - DNA, 20 bp, Artificial Sequence
  chemically synthesized
tttggacatttccacgaaca

SEQ ID NO: 294798 - DNA, 20 bp, Artificial Sequence
  chemically synthesized
atttggacatttccacgaac

SEQ ID NO: 294799 - DNA, 20 bp, Artificial Sequence
  chemically synthesized
actttttatatgtggttatt

SEQ ID NO: 294800 - DNA, 20 bp, Artificial Sequence
  chemically synthesized
tttttaacactttttatatg

SEQ ID NO: 294801 - DNA, 20 bp, Artificial Sequence
  chemically synthesized
tccaaataaccacatataaa

SEQ ID NO: 294802 - DNA, 20 bp, Artificial Sequence
  chemically synthesized
gttaaaaaaaaaaaaaaaaa

SEQ ID NO: 294803 - DNA, 20 bp, Artificial Sequence
  chemically synthesized
ttaaaaaaaaaaaaaaaaaa

SEQ ID NO: 294804 - DNA, 20 bp, Artificial Sequence
  chemically synthesized
aaaaaaaaaaaaaaaaggtt

SEQ ID NO: 294805 - DNA, 20 bp, Artificial Sequence
  chemically synthesized
ccaggagaaatggcgatttt

SEQ ID NO: 294806 - DNA, 20 bp, Artificial Sequence
  chemically synthesized
ctgaaaatcgccatttctcc

SEQ ID NO: 294807 - DNA, 20 bp, Artificial Sequence
  chemically synthesized
tggccagatcccaggagaaa

SEQ ID NO: 294808 - DNA, 20 bp, Artificial Sequence
  chemically synthesized
tgaaaatcgccatttctcct

SEQ ID NO: 294809 - DNA, 20 bp, Artificial Sequence
  chemically synthesized
tatgggtggccagatcccag

SEQ ID NO: 294810 - DNA, 20 bp, Artificial Sequence
  chemically synthesized
tcgccatttctcctgggatc

SEQ ID NO: 294811 - DNA, 20 bp, Artificial Sequence
  chemically synthesized
cgtatgggtggccagatccc

SEQ ID NO: 294812 - DNA, 20 bp, Artificial Sequence
  chemically synthesized
acgtatgggtggccagatcc

SEQ ID NO: 294813 - DNA, 20 bp, Artificial Sequence
  chemically synthesized
aggacgaacgtatgggtggc

SEQ ID NO: 294814 - DNA, 20 bp, Artificial Sequence
  chemically synthesized
tttgaggacgaacgtatggg

SEQ ID NO: 294815 - DNA, 20 bp, Artificial Sequence
  chemically synthesized
tcatttgaggacgaacgtat

SEQ ID NO: 294816 - DNA, 20 bp, Artificial Sequence
  chemically synthesized
ttcatttgaggacgaacgta

SEQ ID NO: 294817 - DNA, 20 bp, Artificial Sequence
  chemically synthesized
aagttcatatatttcatttg

SEQ ID NO: 294818 - DNA, 20 bp, Artificial Sequence
  chemically synthesized
gaagttcatatatttcattt

SEQ ID NO: 294819 - DNA, 20 bp, Artificial Sequence
  chemically synthesized
aatatatgaacttctgtttt

SEQ ID NO: 294820 - DNA, 20 bp, Artificial Sequence
  chemically synthesized
tccaacctacctgaaaacag

SEQ ID NO: 294821 - DNA, 20 bp, Artificial Sequence
  chemically synthesized
atatatgaacttctgttttc

SEQ ID NO: 294822 - DNA, 20 bp, Artificial Sequence
  chemically synthesized
tgatccaacctacctgaaaa

SEQ ID NO: 294823 - DNA, 20 bp, Artificial Sequence
  chemically synthesized
tatgaacttctgttttcagg

SEQ ID NO: 294824 - DNA, 20 bp, Artificial Sequence
  chemically synthesized
atgaacttctgttttcaggt

SEQ ID NO: 294825 - DNA, 20 bp, Artificial Sequence
  chemically synthesized
acttctgttttcaggtaggt

SEQ ID NO: 294826 - DNA, 20 bp, Artificial Sequence
  chemically synthesized
tgttttcaggtaggttggat

SEQ ID NO: 294827 - DNA, 20 bp, Artificial Sequence
  chemically synthesized
tttcaggtaggttggatcag

SEQ ID NO: 294828 - DNA, 20 bp, Artificial Sequence
  chemically synthesized
tgggagacggtagaaatttt

SEQ ID NO: 294829 - DNA, 20 bp, Artificial Sequence
  chemically synthesized
atgggagacggtagaaattt

SEQ ID NO: 294830 - DNA, 20 bp, Artificial Sequence
  chemically synthesized
tgtgagttaatgggagacgg

SEQ ID NO: 294831 - DNA, 20 bp, Artificial Sequence
  chemically synthesized
ttctgtgagttaatgggaga

SEQ ID NO: 294832 - DNA, 20 bp, Artificial Sequence
  chemically synthesized
atatttctgtgagttaatgg

SEQ ID NO: 294833 - DNA, 20 bp, Artificial Sequence
  chemically synthesized
gtatatttctgtgagttaat

SEQ ID NO: 294834 - DNA, 20 bp, Artificial Sequence
  chemically synthesized
tgtatatttctgtgagttaa

SEQ ID NO: 294835 - DNA, 20 bp, Artificial Sequence
  chemically synthesized
taccgtctcccattaactca

SEQ ID NO: 294836 - DNA, 20 bp, Artificial Sequence
  chemically synthesized
tttttaatgtatatttctgt

SEQ ID NO: 294837 - DNA, 20 bp, Artificial Sequence
  chemically synthesized
tcacagaaatatacattaaa

SEQ ID NO: 294838 - DNA, 20 bp, Artificial Sequence
  chemically synthesized
gaaatatacattaaaaagca

SEQ ID NO: 294839 - DNA, 20 bp, Artificial Sequence
  chemically synthesized
atacattaaaaagcacagaa

SEQ ID NO: 294840 - DNA, 20 bp, Artificial Sequence
  chemically synthesized
aagcacaaaaaccaaaaaca

SEQ ID NO: 294841 - DNA, 20 bp, Artificial Sequence
  chemically synthesized
atctctttagactttgtttt

SEQ ID NO: 294842 - DNA, 20 bp, Artificial Sequence
  chemically synthesized
aaaaccaaaaacaaagtcta

SEQ ID NO: 294843 - DNA, 20 bp, Artificial Sequence
  chemically synthesized
aaccaaaaacaaagtctaaa

SEQ ID NO: 294844 - DNA, 20 bp, Artificial Sequence
  chemically synthesized
ttcagcaaaatatatctctt

SEQ ID NO: 294845 - DNA, 20 bp, Artificial Sequence
  chemically synthesized
agagatatattttgctgaaa

SEQ ID NO: 294846 - DNA, 20 bp, Artificial Sequence
  chemically synthesized
gagatatattttgctgaaaa

SEQ ID NO: 294847 - DNA, 20 bp, Artificial Sequence
  chemically synthesized
atatattttgctgaaaaagg

SEQ ID NO: 294848 - DNA, 20 bp, Artificial Sequence
  chemically synthesized
ggacagttatcttccttttt

SEQ ID NO: 294849 - DNA, 20 bp, Artificial Sequence
  chemically synthesized
acagtcacttaaaatgagga

SEQ ID NO: 294850 - DNA, 20 bp, Artificial Sequence
  chemically synthesized
aagataactgtcctcatttt

SEQ ID NO: 294851 - DNA, 20 bp, Artificial Sequence
  chemically synthesized
atacacagtcacttaaaatg

SEQ ID NO: 294852 - DNA, 20 bp, Artificial Sequence
  chemically synthesized
gatacacagtcacttaaaat

SEQ ID NO: 294853 - DNA, 20 bp, Artificial Sequence
  chemically synthesized
tgttcctctttgttgataca

SEQ ID NO: 294854 - DNA, 20 bp, Artificial Sequence
  chemically synthesized
taagtgactgtgtatcaaca

SEQ ID NO: 294855 - DNA, 20 bp, Artificial Sequence
  chemically synthesized
agtgactgtgtatcaacaaa

SEQ ID NO: 294856 - DNA, 20 bp, Artificial Sequence
  chemically synthesized
gtgactgtgtatcaacaaag

SEQ ID NO: 294857 - DNA, 20 bp, Artificial Sequence
  chemically synthesized
tgtatcaacaaagaggaaca

SEQ ID NO: 294858 - DNA, 20 bp, Artificial Sequence
  chemically synthesized
gtatcaacaaagaggaacat

SEQ ID NO: 294859 - DNA, 20 bp, Artificial Sequence
  chemically synthesized
agaggaacataggccttcca

SEQ ID NO: 294860 - DNA, 20 bp, Artificial Sequence
  chemically synthesized
gaggaacataggccttccac

SEQ ID NO: 294861 - DNA, 20 bp, Artificial Sequence
  chemically synthesized
ttgcaagatagacctgtgga

SEQ ID NO: 294862 - DNA, 20 bp, Artificial Sequence
  chemically synthesized
tttgcaagatagacctgtgg

SEQ ID NO: 294863 - DNA, 20 bp, Artificial Sequence
  chemically synthesized
tactttgcaagatagacctg

SEQ ID NO: 294864 - DNA, 20 bp, Artificial Sequence
  chemically synthesized
ttccacaggtctatcttgca

SEQ ID NO: 294865 - DNA, 20 bp, Artificial Sequence
  chemically synthesized
ccagtttttactttgcaaga

SEQ ID NO: 294866 - DNA, 20 bp, Artificial Sequence
  chemically synthesized
tgaaccagtttttactttgc

SEQ ID NO: 294867 - DNA, 20 bp, Artificial Sequence
  chemically synthesized
ctatcttgcaaagtaaaaac

SEQ ID NO: 294868 - DNA, 20 bp, Artificial Sequence
  chemically synthesized
tttttgtttttgttttgaac

SEQ ID NO: 294869 - DNA, 20 bp, Artificial Sequence
  chemically synthesized
ttcaaaacaaaaacaaaaac

SEQ ID NO: 294870 - DNA, 20 bp, Artificial Sequence
  chemically synthesized
aagagaatagatgtgagagc

SEQ ID NO: 294871 - DNA, 20 bp, Artificial Sequence
  chemically synthesized
gagtaagagaatagatgtga

SEQ ID NO: 294872 - DNA, 20 bp, Artificial Sequence
  chemically synthesized
ctgagtaagagaatagatgt

SEQ ID NO: 294873 - DNA, 20 bp, Artificial Sequence
  chemically synthesized
gatgggactgagtaagagaa

SEQ ID NO: 294874 - DNA, 20 bp, Artificial Sequence
  chemically synthesized
ctcacatctattctcttact

SEQ ID NO: 294875 - DNA, 20 bp, Artificial Sequence
  chemically synthesized
gttttgatgggactgagtaa

SEQ ID NO: 294876 - DNA, 20 bp, Artificial Sequence
  chemically synthesized
cagttttgatgggactgagt

SEQ ID NO: 294877 - DNA, 20 bp, Artificial Sequence
  chemically synthesized
agagcagttttgatgggact

SEQ ID NO: 294878 - DNA, 20 bp, Artificial Sequence
  chemically synthesized
ctgataagagcagttttgat

SEQ ID NO: 294879 - DNA, 20 bp, Artificial Sequence
  chemically synthesized
actgataagagcagttttga

SEQ ID NO: 294880 - DNA, 20 bp, Artificial Sequence
  chemically synthesized
cccatcaaaactgctcttat

SEQ ID NO: 294881 - DNA, 20 bp, Artificial Sequence
  chemically synthesized
aatggtgagactgataagag

SEQ ID NO: 294882 - DNA, 20 bp, Artificial Sequence
  chemically synthesized
gccaatggtgagactgataa

SEQ ID NO: 294883 - DNA, 20 bp, Artificial Sequence
  chemically synthesized
gggccaatggtgagactgat

SEQ ID NO: 294884 - DNA, 20 bp, Artificial Sequence
  chemically synthesized
gctcttatcagtctcaccat

SEQ ID NO: 294885 - DNA, 20 bp, Artificial Sequence
  chemically synthesized
gtagcttgggggccaatggt

SEQ ID NO: 294886 - DNA, 20 bp, Artificial Sequence
  chemically synthesized
tgcagtagcttgggggccaa

SEQ ID NO: 294887 - DNA, 20 bp, Artificial Sequence
  chemically synthesized
cagtctcaccattggccccc

SEQ ID NO: 294888 - DNA, 20 bp, Artificial Sequence
  chemically synthesized
cattgaatgcagtagcttgg

SEQ ID NO: 294889 - DNA, 20 bp, Artificial Sequence
  chemically synthesized
tcattgaatgcagtagcttg

SEQ ID NO: 294890 - DNA, 20 bp, Artificial Sequence
  chemically synthesized
gtcattgaatgcagtagctt

SEQ ID NO: 294891 - DNA, 20 bp, Artificial Sequence
  chemically synthesized
agtcattgaatgcagtagct

SEQ ID NO: 294892 - DNA, 20 bp, Artificial Sequence
  chemically synthesized
acatcagtcattgaatgcag

SEQ ID NO: 294893 - DNA, 20 bp, Artificial Sequence
  chemically synthesized
tgaacatcagtcattgaatg

SEQ ID NO: 294894 - DNA, 20 bp, Artificial Sequence
  chemically synthesized
tgcattcaatgactgatgtt

SEQ ID NO: 294895 - DNA, 20 bp, Artificial Sequence
  chemically synthesized
gtaaagtgagaactgaacat

SEQ ID NO: 294896 - DNA, 20 bp, Artificial Sequence
  chemically synthesized
atcatggtgataggtaaagt

SEQ ID NO: 294897 - DNA, 20 bp, Artificial Sequence
  chemically synthesized
tcaaatcatggtgataggta

SEQ ID NO: 294898 - DNA, 20 bp, Artificial Sequence
  chemically synthesized
ctcaatcaaatcatggtgat

SEQ ID NO: 294899 - DNA, 20 bp, Artificial Sequence
  chemically synthesized
tctcaatcaaatcatggtga

SEQ ID NO: 294900 - DNA, 20 bp, Artificial Sequence
  chemically synthesized
gaatcctctcaatcaaatca

SEQ ID NO: 294901 - DNA, 20 bp, Artificial Sequence
  chemically synthesized
cctatcaccatgatttgatt

SEQ ID NO: 294902 - DNA, 20 bp, Artificial Sequence
  chemically synthesized
tatcaccatgatttgattga

SEQ ID NO: 294903 - DNA, 20 bp, Artificial Sequence
  chemically synthesized
atcaccatgatttgattgag

SEQ ID NO: 294904 - DNA, 20 bp, Artificial Sequence
  chemically synthesized
aaatacttctaagaagaaaa

SEQ ID NO: 294905 - DNA, 20 bp, Artificial Sequence
  chemically synthesized
caaatacttctaagaagaaa

SEQ ID NO: 294906 - DNA, 20 bp, Artificial Sequence
  chemically synthesized
agaggattcctttttcttct

SEQ ID NO: 294907 - DNA, 20 bp, Artificial Sequence
  chemically synthesized
ggattcctttttcttcttag

SEQ ID NO: 294908 - DNA, 20 bp, Artificial Sequence
  chemically synthesized
aattagcaaatacttctaag

SEQ ID NO: 294909 - DNA, 20 bp, Artificial Sequence
  chemically synthesized
ccaaattagcaaatacttct

SEQ ID NO: 294910 - DNA, 20 bp, Artificial Sequence
  chemically synthesized
cttagaagtatttgctaatt

SEQ ID NO: 294911 - DNA, 20 bp, Artificial Sequence
  chemically synthesized
agtagtacgtgaagccaaat

SEQ ID NO: 294912 - DNA, 20 bp, Artificial Sequence
  chemically synthesized
ctgtgttcaagtagtacgtg

SEQ ID NO: 294913 - DNA, 20 bp, Artificial Sequence
  chemically synthesized
ggaggaaaactgtgttcaag

SEQ ID NO: 294914 - DNA, 20 bp, Artificial Sequence
  chemically synthesized
cttcacgtactacttgaaca

SEQ ID NO: 294915 - DNA, 20 bp, Artificial Sequence
  chemically synthesized
gttggaggaaaactgtgttc

SEQ ID NO: 294916 - DNA, 20 bp, Artificial Sequence
  chemically synthesized
acacagttttcctccaactt

SEQ ID NO: 294917 - DNA, 20 bp, Artificial Sequence
  chemically synthesized
aaggtgacctctgaagttgg

SEQ ID NO: 294918 - DNA, 20 bp, Artificial Sequence
  chemically synthesized
aaaggtgacctctgaagttg

SEQ ID NO: 294919 - DNA, 20 bp, Artificial Sequence
  chemically synthesized
acagttttcctccaacttca

SEQ ID NO: 294920 - DNA, 20 bp, Artificial Sequence
  chemically synthesized
cagttttcctccaacttcag

SEQ ID NO: 294921 - DNA, 20 bp, Artificial Sequence
  chemically synthesized
ggaaaggtgacctctgaagt

SEQ ID NO: 294922 - DNA, 20 bp, Artificial Sequence
  chemically synthesized
tggaggaaaggtgacctctg

SEQ ID NO: 294923 - DNA, 20 bp, Artificial Sequence
  chemically synthesized
ctgcaaaggagatggaggaa

SEQ ID NO: 294924 - DNA, 20 bp, Artificial Sequence
  chemically synthesized
cctgcaaaggagatggagga

SEQ ID NO: 294925 - DNA, 20 bp, Artificial Sequence
  chemically synthesized
ggaacctgcaaaggagatgg

SEQ ID NO: 294926 - DNA, 20 bp, Artificial Sequence
  chemically synthesized
aggaacctgcaaaggagatg

SEQ ID NO: 294927 - DNA, 20 bp, Artificial Sequence
  chemically synthesized
ttaggaacctgcaaaggaga

SEQ ID NO: 294928 - DNA, 20 bp, Artificial Sequence
  chemically synthesized
cctttcctccatctcctttg

SEQ ID NO: 294929 - DNA, 20 bp, Artificial Sequence
  chemically synthesized
ctttcctccatctcctttgc

SEQ ID NO: 294930 - DNA, 20 bp, Artificial Sequence
  chemically synthesized
atgattaggaacctgcaaag

SEQ ID NO: 294931 - DNA, 20 bp, Artificial Sequence
  chemically synthesized
acatgattaggaacctgcaa

SEQ ID NO: 294932 - DNA, 20 bp, Artificial Sequence
  chemically synthesized
gacatgattaggaacctgca

SEQ ID NO: 294933 - DNA, 20 bp, Artificial Sequence
  chemically synthesized
gcgagctcagggacatgatt

SEQ ID NO: 294934 - DNA, 20 bp, Artificial Sequence
  chemically synthesized
tgcgagctcagggacatgat

SEQ ID NO: 294935 - DNA, 20 bp, Artificial Sequence
  chemically synthesized
aggttcctaatcatgtccct

SEQ ID NO: 294936 - DNA, 20 bp, Artificial Sequence
  chemically synthesized
cactccaaagtgcgagctca

SEQ ID NO: 294937 - DNA, 20 bp, Artificial Sequence
  chemically synthesized
acactccaaagtgcgagctc

SEQ ID NO: 294938 - DNA, 20 bp, Artificial Sequence
  chemically synthesized
gacactccaaagtgcgagct

SEQ ID NO: 294939 - DNA, 20 bp, Artificial Sequence
  chemically synthesized
atgtccctgagctcgcactt

SEQ ID NO: 294940 - DNA, 20 bp, Artificial Sequence
  chemically synthesized
cctaggacactccaaagtgc

SEQ ID NO: 294941 - DNA, 20 bp, Artificial Sequence
  chemically synthesized
gtccctgagctcgcactttg

SEQ ID NO: 294942 - DNA, 20 bp, Artificial Sequence
  chemically synthesized
ttgaggcctaggacactcca

SEQ ID NO: 294943 - DNA, 20 bp, Artificial Sequence
  chemically synthesized
gctcgcactttggagtgtcc

SEQ ID NO: 294944 - DNA, 20 bp, Artificial Sequence
  chemically synthesized
ctcgcactttggagtgtcct

SEQ ID NO: 294945 - DNA, 20 bp, Artificial Sequence
  chemically synthesized
gaaaacacagattgaggcct

SEQ ID NO: 294946 - DNA, 20 bp, Artificial Sequence
  chemically synthesized
ggaaaacacagattgaggcc

SEQ ID NO: 294947 - DNA, 20 bp, Artificial Sequence
  chemically synthesized
acaaaggaaaacacagattg

SEQ ID NO: 294948 - DNA, 20 bp, Artificial Sequence
  chemically synthesized
aacaaaggaaaacacagatt

SEQ ID NO: 294949 - DNA, 20 bp, Artificial Sequence
  chemically synthesized
ggcctaaacaaaggaaaaca

SEQ ID NO: 294950 - DNA, 20 bp, Artificial Sequence
  chemically synthesized
aatctgtgttttcctttgtt

SEQ ID NO: 294951 - DNA, 20 bp, Artificial Sequence
  chemically synthesized
atctgtgttttcctttgttt

SEQ ID NO: 294952 - DNA, 20 bp, Artificial Sequence
  chemically synthesized
tctgtttttggcctaaacaa

SEQ ID NO: 294953 - DNA, 20 bp, Artificial Sequence
  chemically synthesized
ttctgtttttggcctaaaca

SEQ ID NO: 294954 - DNA, 20 bp, Artificial Sequence
  chemically synthesized
tcctttgtttaggccaaaaa

SEQ ID NO: 294955 - DNA, 20 bp, Artificial Sequence
  chemically synthesized
ggagtggaggattctgtttt

SEQ ID NO: 294956 - DNA, 20 bp, Artificial Sequence
  chemically synthesized
tgagagagagaggggagtgg

SEQ ID NO: 294957 - DNA, 20 bp, Artificial Sequence
  chemically synthesized
ttgagagagagaggggagtg

SEQ ID NO: 294958 - DNA, 20 bp, Artificial Sequence
  chemically synthesized
gcttgagagagagaggggag

SEQ ID NO: 294959 - DNA, 20 bp, Artificial Sequence
  chemically synthesized
gaggcttgagagagagaggg

SEQ ID NO: 294960 - DNA, 20 bp, Artificial Sequence
  chemically synthesized
gtgaggcttgagagagagag

SEQ ID NO: 294961 - DNA, 20 bp, Artificial Sequence
  chemically synthesized
tgtgaggcttgagagagaga

SEQ ID NO: 294962 - DNA, 20 bp, Artificial Sequence
  chemically synthesized
atgtgaggcttgagagagag

SEQ ID NO: 294963 - DNA, 20 bp, Artificial Sequence
  chemically synthesized
aatgtgaggcttgagagaga

SEQ ID NO: 294964 - DNA, 20 bp, Artificial Sequence
  chemically synthesized
tccactcccctctctctctc

SEQ ID NO: 294965 - DNA, 20 bp, Artificial Sequence
  chemically synthesized
tgaatgtgaggcttgagaga

SEQ ID NO: 294966 - DNA, 20 bp, Artificial Sequence
  chemically synthesized
attgaatgtgaggcttgaga

SEQ ID NO: 294967 - DNA, 20 bp, Artificial Sequence
  chemically synthesized
ggattgaatgtgaggcttga

SEQ ID NO: 294968 - DNA, 20 bp, Artificial Sequence
  chemically synthesized
atggattgaatgtgaggctt

SEQ ID NO: 294969 - DNA, 20 bp, Artificial Sequence
  chemically synthesized
tttgtgatggattgaatgtg

SEQ ID NO: 294970 - DNA, 20 bp, Artificial Sequence
  chemically synthesized
ctttgtgatggattgaatgt

SEQ ID NO: 294971 - DNA, 20 bp, Artificial Sequence
  chemically synthesized
ctcacattcaatccatcaca

SEQ ID NO: 294972 - DNA, 20 bp, Artificial Sequence
  chemically synthesized
gagccaacaggactttgtga

SEQ ID NO: 294973 - DNA, 20 bp, Artificial Sequence
  chemically synthesized
aatccatcacaaagtcctgt

SEQ ID NO: 294974 - DNA, 20 bp, Artificial Sequence
  chemically synthesized
gttttgaggttagagccaac

SEQ ID NO: 294975 - DNA, 20 bp, Artificial Sequence
  chemically synthesized
tgttttgaggttagagccaa

SEQ ID NO: 294976 - DNA, 20 bp, Artificial Sequence
  chemically synthesized
ctggctatgttttgaggtta

SEQ ID NO: 294977 - DNA, 20 bp, Artificial Sequence
  chemically synthesized
ttctggctatgttttgaggt

SEQ ID NO: 294978 - DNA, 20 bp, Artificial Sequence
  chemically synthesized
ttggctctaacctcaaaaca

SEQ ID NO: 294979 - DNA, 20 bp, Artificial Sequence
  chemically synthesized
cactttctggctatgttttg

SEQ ID NO: 294980 - DNA, 20 bp, Artificial Sequence
  chemically synthesized
tcactttctggctatgtttt

SEQ ID NO: 294981 - DNA, 20 bp, Artificial Sequence
  chemically synthesized
ctctaacctcaaaacatagc

SEQ ID NO: 294982 - DNA, 20 bp, Artificial Sequence
  chemically synthesized
aacctcaaaacatagccaga

SEQ ID NO: 294983 - DNA, 20 bp, Artificial Sequence
  chemically synthesized
tcaaaacatagccagaaagt

SEQ ID NO: 294984 - DNA, 20 bp, Artificial Sequence
  chemically synthesized
caccatgataactcactttc

SEQ ID NO: 294985 - DNA, 20 bp, Artificial Sequence
  chemically synthesized
agccagaaagtgagttatca

SEQ ID NO: 294986 - DNA, 20 bp, Artificial Sequence
  chemically synthesized
ttgtctaatgtggtagtagt

SEQ ID NO: 294987 - DNA, 20 bp, Artificial Sequence
  chemically synthesized
tactttgtctaatgtggtag

SEQ ID NO: 294988 - DNA, 20 bp, Artificial Sequence
  chemically synthesized
ggtgctcactactaccacat

SEQ ID NO: 294989 - DNA, 20 bp, Artificial Sequence
  chemically synthesized
gggtactttgtctaatgtgg

SEQ ID NO: 294990 - DNA, 20 bp, Artificial Sequence
  chemically synthesized
atggggtactttgtctaatg

SEQ ID NO: 294991 - DNA, 20 bp, Artificial Sequence
  chemically synthesized
cactactaccacattagaca

SEQ ID NO: 294992 - DNA, 20 bp, Artificial Sequence
  chemically synthesized
catacccctcagagatgatg

SEQ ID NO: 294993 - DNA, 20 bp, Artificial Sequence
  chemically synthesized
tcatacccctcagagatgat

SEQ ID NO: 294994 - DNA, 20 bp, Artificial Sequence
  chemically synthesized
ttcatacccctcagagatga

SEQ ID NO: 294995 - DNA, 20 bp, Artificial Sequence
  chemically synthesized
caaagtaccccatcatctct

SEQ ID NO: 294996 - DNA, 20 bp, Artificial Sequence
  chemically synthesized
aaagtaccccatcatctctg

SEQ ID NO: 294997 - DNA, 20 bp, Artificial Sequence
  chemically synthesized
aagtaccccatcatctctga

SEQ ID NO: 294998 - DNA, 20 bp, Artificial Sequence
  chemically synthesized
agtaccccatcatctctgag

SEQ ID NO: 294999 - DNA, 20 bp, Artificial Sequence
  chemically synthesized
tgaaacattcatacccctca

SEQ ID NO: 295000 - DNA, 20 bp, Artificial Sequence
  chemically synthesized
tttgaaacattcatacccct

SEQ ID NO: 295001 - DNA, 20 bp, Artificial Sequence
  chemically synthesized
ggggtatgaatgtttcaaaa

SEQ ID NO: 295002 - DNA, 20 bp, Artificial Sequence
  chemically synthesized
gggtatgaatgtttcaaaat

SEQ ID NO: 295003 - DNA, 20 bp, Artificial Sequence
  chemically synthesized
tgtttcaaaataggatacta

SEQ ID NO: 295004 - DNA, 20 bp, Artificial Sequence
  chemically synthesized
gtttcaaaataggatactaa

SEQ ID NO: 295005 - DNA, 20 bp, Artificial Sequence
  chemically synthesized
gggtgaaatataaagacctt

SEQ ID NO: 295006 - DNA, 20 bp, Artificial Sequence
  chemically synthesized
agaacaaagggtgaaatata

SEQ ID NO: 295007 - DNA, 20 bp, Artificial Sequence
  chemically synthesized
atatataatcagagaacaaa

SEQ ID NO: 295008 - DNA, 20 bp, Artificial Sequence
  chemically synthesized
aatatataatcagagaacaa

SEQ ID NO: 295009 - DNA, 20 bp, Artificial Sequence
  chemically synthesized
taatatataatcagagaaca

SEQ ID NO: 295010 - DNA, 20 bp, Artificial Sequence
  chemically synthesized
gtgttgataatatataatca

SEQ ID NO: 295011 - DNA, 20 bp, Artificial Sequence
  chemically synthesized
ctgtgttgataatatataat

SEQ ID NO: 295012 - DNA, 20 bp, Artificial Sequence
  chemically synthesized
ctgattatatattatcaaca

SEQ ID NO: 295013 - DNA, 20 bp, Artificial Sequence
  chemically synthesized
attatatattatcaacacag

SEQ ID NO: 295014 - DNA, 20 bp, Artificial Sequence
  chemically synthesized
tatattatcaacacagcaga

SEQ ID NO: 295015 - DNA, 20 bp, Artificial Sequence
  chemically synthesized
tattatcaacacagcagaca

SEQ ID NO: 295016 - DNA, 20 bp, Artificial Sequence
  chemically synthesized
aacacagcagacagagacaa

SEQ ID NO: 295017 - DNA, 20 bp, Artificial Sequence
  chemically synthesized
acacagcagacagagacaac

SEQ ID NO: 295018 - DNA, 20 bp, Artificial Sequence
  chemically synthesized
cagacagagacaacaggatt

SEQ ID NO: 295019 - DNA, 20 bp, Artificial Sequence
  chemically synthesized
tattcagctgtcagcgagtt

SEQ ID NO: 295020 - DNA, 20 bp, Artificial Sequence
  chemically synthesized
gattcagctcaactcgctga

SEQ ID NO: 295021 - DNA, 20 bp, Artificial Sequence
  chemically synthesized
gcttttattcagctgtcagc

SEQ ID NO: 295022 - DNA, 20 bp, Artificial Sequence
  chemically synthesized
ttgagcttttattcagctgt

SEQ ID NO: 295023 - DNA, 20 bp, Artificial Sequence
  chemically synthesized
actcgctgacagctgaataa

SEQ ID NO: 295024 - DNA, 20 bp, Artificial Sequence
  chemically synthesized
taaggacttgagcttttatt

SEQ ID NO: 295025 - DNA, 20 bp, Artificial Sequence
  chemically synthesized
tgacagctgaataaaagctc

SEQ ID NO: 295026 - DNA, 20 bp, Artificial Sequence
  chemically synthesized
tcagaccatggtaaggactt

SEQ ID NO: 295027 - DNA, 20 bp, Artificial Sequence
  chemically synthesized
aaaagctcaagtccttacca

SEQ ID NO: 295028 - DNA, 20 bp, Artificial Sequence
  chemically synthesized
attaagatcagaccatggta

SEQ ID NO: 295029 - DNA, 20 bp, Artificial Sequence
  chemically synthesized
aattaagatcagaccatggt

SEQ ID NO: 295030 - DNA, 20 bp, Artificial Sequence
  chemically synthesized
agttaattaagatcagacca

SEQ ID NO: 295031 - DNA, 20 bp, Artificial Sequence
  chemically synthesized
ttaaggaagttaattaagat

SEQ ID NO: 295032 - DNA, 20 bp, Artificial Sequence
  chemically synthesized
aaaggttaaggaagttaatt

SEQ ID NO: 295033 - DNA, 20 bp, Artificial Sequence
  chemically synthesized
agaattcagaaaggttaagg

SEQ ID NO: 295034 - DNA, 20 bp, Artificial Sequence
  chemically synthesized
agaagaattcagaaaggtta

SEQ ID NO: 295035 - DNA, 20 bp, Artificial Sequence
  chemically synthesized
cagaagaattcagaaaggtt

SEQ ID NO: 295036 - DNA, 20 bp, Artificial Sequence
  chemically synthesized
agcagcagaagaattcagaa

SEQ ID NO: 295037 - DNA, 20 bp, Artificial Sequence
  chemically synthesized
tagcagcagaagaattcaga

SEQ ID NO: 295038 - DNA, 20 bp, Artificial Sequence
  chemically synthesized
tgtttagcagcagaagaatt

SEQ ID NO: 295039 - DNA, 20 bp, Artificial Sequence
  chemically synthesized
atcacgatgtttagcagcag

SEQ ID NO: 295040 - DNA, 20 bp, Artificial Sequence
  chemically synthesized
aaaatcacgatgtttagcag

SEQ ID NO: 295041 - DNA, 20 bp, Artificial Sequence
  chemically synthesized
agaaaaatcacgatgtttag

SEQ ID NO: 295042 - DNA, 20 bp, Artificial Sequence
  chemically synthesized
agcagaaaaatcacgatgtt

SEQ ID NO: 295043 - DNA, 20 bp, Artificial Sequence
  chemically synthesized
acatcgtgatttttctgctg

SEQ ID NO: 295044 - DNA, 20 bp, Artificial Sequence
  chemically synthesized
aggtaagcgtgtggctgcag

SEQ ID NO: 295045 - DNA, 20 bp, Artificial Sequence
  chemically synthesized
aaaaggtaagcgtgtggctg

SEQ ID NO: 295046 - DNA, 20 bp, Artificial Sequence
  chemically synthesized
tcagggaaaaggtaagcgtg

SEQ ID NO: 295047 - DNA, 20 bp, Artificial Sequence
  chemically synthesized
tgtagcatcagggaaaaggt

SEQ ID NO: 295048 - DNA, 20 bp, Artificial Sequence
  chemically synthesized
tgcctgtagcatcagggaaa

SEQ ID NO: 295049 - DNA, 20 bp, Artificial Sequence
  chemically synthesized
atgcctgtagcatcagggaa

SEQ ID NO: 295050 - DNA, 20 bp, Artificial Sequence
  chemically synthesized
gcagcatgcctgtagcatca

SEQ ID NO: 295051 - DNA, 20 bp, Artificial Sequence
  chemically synthesized
ttaccttttccctgatgcta

SEQ ID NO: 295052 - DNA, 20 bp, Artificial Sequence
  chemically synthesized
agcagcatgcctgtagcatc

SEQ ID NO: 295053 - DNA, 20 bp, Artificial Sequence
  chemically synthesized
taccttttccctgatgctac

SEQ ID NO: 295054 - DNA, 20 bp, Artificial Sequence
  chemically synthesized
cagcagcatgcctgtagcat

SEQ ID NO: 295055 - DNA, 20 bp, Artificial Sequence
  chemically synthesized
gtgtaacagcagcatgcctg

SEQ ID NO: 295056 - DNA, 20 bp, Artificial Sequence
  chemically synthesized
aatgcacagccgtgtaacag

SEQ ID NO: 295057 - DNA, 20 bp, Artificial Sequence
  chemically synthesized
acaggcatgctgctgttaca

SEQ ID NO: 295058 - DNA, 20 bp, Artificial Sequence
  chemically synthesized
ataaatgcacagccgtgtaa

SEQ ID NO: 295059 - DNA, 20 bp, Artificial Sequence
  chemically synthesized
catggggaaaaataaatgca

SEQ ID NO: 295060 - DNA, 20 bp, Artificial Sequence
  chemically synthesized
ttagggcctttttaggcatg

SEQ ID NO: 295061 - DNA, 20 bp, Artificial Sequence
  chemically synthesized
tttagggcctttttaggcat

SEQ ID NO: 295062 - DNA, 20 bp, Artificial Sequence
  chemically synthesized
atttagggcctttttaggca

SEQ ID NO: 295063 - DNA, 20 bp, Artificial Sequence
  chemically synthesized
tatttttccccatgcctaaa

SEQ ID NO: 295064 - DNA, 20 bp, Artificial Sequence
  chemically synthesized
atttttccccatgcctaaaa

SEQ ID NO: 295065 - DNA, 20 bp, Artificial Sequence
  chemically synthesized
aagtaatttagggccttttt

SEQ ID NO: 295066 - DNA, 20 bp, Artificial Sequence
  chemically synthesized
taagtaatttagggcctttt

SEQ ID NO: 295067 - DNA, 20 bp, Artificial Sequence
  chemically synthesized
atgtccaagtaagtaattta

SEQ ID NO: 295068 - DNA, 20 bp, Artificial Sequence
  chemically synthesized
aatgtccaagtaagtaattt

SEQ ID NO: 295069 - DNA, 20 bp, Artificial Sequence
  chemically synthesized
aaatgtccaagtaagtaatt

SEQ ID NO: 295070 - DNA, 20 bp, Artificial Sequence
  chemically synthesized
aaggccctaaattacttact

SEQ ID NO: 295071 - DNA, 20 bp, Artificial Sequence
  chemically synthesized
atgggggaaaatgtccaagt

SEQ ID NO: 295072 - DNA, 20 bp, Artificial Sequence
  chemically synthesized
tttgatgggggaaaatgtcc

SEQ ID NO: 295073 - DNA, 20 bp, Artificial Sequence
  chemically synthesized
gaaaaagtggcatttgatgg

SEQ ID NO: 295074 - DNA, 20 bp, Artificial Sequence
  chemically synthesized
tgaaaaagtggcatttgatg

SEQ ID NO: 295075 - DNA, 20 bp, Artificial Sequence
  chemically synthesized
ctgaaaaagtggcatttgat

SEQ ID NO: 295076 - DNA, 20 bp, Artificial Sequence
  chemically synthesized
gctgaaaaagtggcatttga

SEQ ID NO: 295077 - DNA, 20 bp, Artificial Sequence
  chemically synthesized
cccatcaaatgccacttttt

SEQ ID NO: 295078 - DNA, 20 bp, Artificial Sequence
  chemically synthesized
aaaaggcctagctgaaaaag

SEQ ID NO: 295079 - DNA, 20 bp, Artificial Sequence
  chemically synthesized
tcaaatgccactttttcagc

SEQ ID NO: 295080 - DNA, 20 bp, Artificial Sequence
  chemically synthesized
actaaaaggcctagctgaaa

SEQ ID NO: 295081 - DNA, 20 bp, Artificial Sequence
  chemically synthesized
caaatgccactttttcagct

SEQ ID NO: 295082 - DNA, 20 bp, Artificial Sequence
  chemically synthesized
actttttcagctaggccttt

SEQ ID NO: 295083 - DNA, 20 bp, Artificial Sequence
  chemically synthesized
cagagtggcactaaaaggcc

SEQ ID NO: 295084 - DNA, 20 bp, Artificial Sequence
  chemically synthesized
gtagacagagtggcactaaa

SEQ ID NO: 295085 - DNA, 20 bp, Artificial Sequence
  chemically synthesized
tgtagacagagtggcactaa

SEQ ID NO: 295086 - DNA, 20 bp, Artificial Sequence
  chemically synthesized
gcatgtgcttgtagacagag

SEQ ID NO: 295087 - DNA, 20 bp, Artificial Sequence
  chemically synthesized
tttagtgccactctgtctac

SEQ ID NO: 295088 - DNA, 20 bp, Artificial Sequence
  chemically synthesized
tatgcatgtgcttgtagaca

SEQ ID NO: 295089 - DNA, 20 bp, Artificial Sequence
  chemically synthesized
ggtatgcatgtgcttgtaga

SEQ ID NO: 295090 - DNA, 20 bp, Artificial Sequence
  chemically synthesized
agagggtatgcatgtgcttg

SEQ ID NO: 295091 - DNA, 20 bp, Artificial Sequence
  chemically synthesized
aggagcagaataaaatgaga

SEQ ID NO: 295092 - DNA, 20 bp, Artificial Sequence
  chemically synthesized
aaggagcagaataaaatgag

SEQ ID NO: 295093 - DNA, 20 bp, Artificial Sequence
  chemically synthesized
caaggagcagaataaaatga

SEQ ID NO: 295094 - DNA, 20 bp, Artificial Sequence
  chemically synthesized
tccaaggagcagaataaaat

SEQ ID NO: 295095 - DNA, 20 bp, Artificial Sequence
  chemically synthesized
tctcattttattctgctcct

SEQ ID NO: 295096 - DNA, 20 bp, Artificial Sequence
  chemically synthesized
tagtgataagttccaaggag

SEQ ID NO: 295097 - DNA, 20 bp, Artificial Sequence
  chemically synthesized
tgttagtgataagttccaag

SEQ ID NO: 295098 - DNA, 20 bp, Artificial Sequence
  chemically synthesized
aatgttagtgataagttcca

SEQ ID NO: 295099 - DNA, 20 bp, Artificial Sequence
  chemically synthesized
gaatgttagtgataagttcc

SEQ ID NO: 295100 - DNA, 20 bp, Artificial Sequence
  chemically synthesized
gcatgtggaatgttagtgat

SEQ ID NO: 295101 - DNA, 20 bp, Artificial Sequence
  chemically synthesized
atgtaaagcatgtggaatgt

SEQ ID NO: 295102 - DNA, 20 bp, Artificial Sequence
  chemically synthesized
agactaatatgtaaagcatg

SEQ ID NO: 295103 - DNA, 20 bp, Artificial Sequence
  chemically synthesized
attccacatgctttacatat

SEQ ID NO: 295104 - DNA, 20 bp, Artificial Sequence
  chemically synthesized
tgaagcaagactaatatgta

SEQ ID NO: 295105 - DNA, 20 bp, Artificial Sequence
  chemically synthesized
gggaaagatggaaatgaagc

SEQ ID NO: 295106 - DNA, 20 bp, Artificial Sequence
  chemically synthesized
tagtgggaaagatggaaatg

SEQ ID NO: 295107 - DNA, 20 bp, Artificial Sequence
  chemically synthesized
ttacattctagtgggaaaga

SEQ ID NO: 295108 - DNA, 20 bp, Artificial Sequence
  chemically synthesized
ttcatttccatctttcccac

SEQ ID NO: 295109 - DNA, 20 bp, Artificial Sequence
  chemically synthesized
tagtttacattctagtggga

SEQ ID NO: 295110 - DNA, 20 bp, Artificial Sequence
  chemically synthesized
tatatagtttacattctagt

SEQ ID NO: 295111 - DNA, 20 bp, Artificial Sequence
  chemically synthesized
ttatatagtttacattctag

SEQ ID NO: 295112 - DNA, 20 bp, Artificial Sequence
  chemically synthesized
accttatatagtttacattc

SEQ ID NO: 295113 - DNA, 20 bp, Artificial Sequence
  chemically synthesized
cactagaatgtaaactatat

SEQ ID NO: 295114 - DNA, 20 bp, Artificial Sequence
  chemically synthesized
actagaatgtaaactatata

SEQ ID NO: 295115 - DNA, 20 bp, Artificial Sequence
  chemically synthesized
taaggatacctgaccttata

SEQ ID NO: 295116 - DNA, 20 bp, Artificial Sequence
  chemically synthesized
gaatgtaaactatataaggt

SEQ ID NO: 295117 - DNA, 20 bp, Artificial Sequence
  chemically synthesized
aatgtaaactatataaggtc

SEQ ID NO: 295118 - DNA, 20 bp, Artificial Sequence
  chemically synthesized
agtagagaaggatatagata

SEQ ID NO: 295119 - DNA, 20 bp, Artificial Sequence
  chemically synthesized
gagtagagaaggatatagat

SEQ ID NO: 295120 - DNA, 20 bp, Artificial Sequence
  chemically synthesized
ggatagagtagagaaggata

SEQ ID NO: 295121 - DNA, 20 bp, Artificial Sequence
  chemically synthesized
gacttgggatagagtagaga

SEQ ID NO: 295122 - DNA, 20 bp, Artificial Sequence
  chemically synthesized
agacttgggatagagtagag

SEQ ID NO: 295123 - DNA, 20 bp, Artificial Sequence
  chemically synthesized
tggagacttgggatagagta

SEQ ID NO: 295124 - DNA, 20 bp, Artificial Sequence
  chemically synthesized
catggagacttgggatagag

SEQ ID NO: 295125 - DNA, 20 bp, Artificial Sequence
  chemically synthesized
atccttctctactctatccc

SEQ ID NO: 295126 - DNA, 20 bp, Artificial Sequence
  chemically synthesized
tttcatggagacttgggata

SEQ ID NO: 295127 - DNA, 20 bp, Artificial Sequence
  chemically synthesized
actttcatggagacttggga

SEQ ID NO: 295128 - DNA, 20 bp, Artificial Sequence
  chemically synthesized
agccactttcatggagactt

SEQ ID NO: 295129 - DNA, 20 bp, Artificial Sequence
  chemically synthesized
cagccactttcatggagact

SEQ ID NO: 295130 - DNA, 20 bp, Artificial Sequence
  chemically synthesized
tctatcccaagtctccatga

SEQ ID NO: 295131 - DNA, 20 bp, Artificial Sequence
  chemically synthesized
atgtaccagccactttcatg

SEQ ID NO: 295132 - DNA, 20 bp, Artificial Sequence
  chemically synthesized
atcccaagtctccatgaaag

SEQ ID NO: 295133 - DNA, 20 bp, Artificial Sequence
  chemically synthesized
taatgtaccagccactttca

SEQ ID NO: 295134 - DNA, 20 bp, Artificial Sequence
  chemically synthesized
caagtctccatgaaagtggc

SEQ ID NO: 295135 - DNA, 20 bp, Artificial Sequence
  chemically synthesized
attatgtacctataatgtac

SEQ ID NO: 295136 - DNA, 20 bp, Artificial Sequence
  chemically synthesized
tgaaagtggctggtacatta

SEQ ID NO: 295137 - DNA, 20 bp, Artificial Sequence
  chemically synthesized
gaaagtggctggtacattat

SEQ ID NO: 295138 - DNA, 20 bp, Artificial Sequence
  chemically synthesized
gtacattataggtacataat

SEQ ID NO: 295139 - DNA, 20 bp, Artificial Sequence
  chemically synthesized
tacattataggtacataata

SEQ ID NO: 295140 - DNA, 20 bp, Artificial Sequence
  chemically synthesized
ttataggtacataataaggc

SEQ ID NO: 295141 - DNA, 20 bp, Artificial Sequence
  chemically synthesized
taataaggcgagctctattt

SEQ ID NO: 295142 - DNA, 20 bp, Artificial Sequence
  chemically synthesized
ggacgcgttacgctaaaata

SEQ ID NO: 295143 - DNA, 20 bp, Artificial Sequence
  chemically synthesized
atggacgcgttacgctaaaa

SEQ ID NO: 295144 - DNA, 20 bp, Artificial Sequence
  chemically synthesized
agagaccataatattgtata

SEQ ID NO: 295145 - DNA, 20 bp, Artificial Sequence
  chemically synthesized
cgcgtccatatacaatatta

SEQ ID NO: 295146 - DNA, 20 bp, Artificial Sequence
  chemically synthesized
gagcattgtgggtaagggga

SEQ ID NO: 295147 - DNA, 20 bp, Artificial Sequence
  chemically synthesized
gagagcattgtgggtaaggg

SEQ ID NO: 295148 - DNA, 20 bp, Artificial Sequence
  chemically synthesized
aagagagcattgtgggtaag

SEQ ID NO: 295149 - DNA, 20 bp, Artificial Sequence
  chemically synthesized
taagagagcattgtgggtaa

SEQ ID NO: 295150 - DNA, 20 bp, Artificial Sequence
  chemically synthesized
ttaagagagcattgtgggta

SEQ ID NO: 295151 - DNA, 20 bp, Artificial Sequence
  chemically synthesized
tttaagagagcattgtgggt

SEQ ID NO: 295152 - DNA, 20 bp, Artificial Sequence
  chemically synthesized
gcactttaagagagcattgt

SEQ ID NO: 295153 - DNA, 20 bp, Artificial Sequence
  chemically synthesized
tgcactttaagagagcattg

SEQ ID NO: 295154 - DNA, 20 bp, Artificial Sequence
  chemically synthesized
ttacccacaatgctctctta

SEQ ID NO: 295155 - DNA, 20 bp, Artificial Sequence
  chemically synthesized
tatgaatttgcactttaaga

SEQ ID NO: 295156 - DNA, 20 bp, Artificial Sequence
  chemically synthesized
gttatgaatttgcactttaa

SEQ ID NO: 295157 - DNA, 20 bp, Artificial Sequence
  chemically synthesized
tcgttatgaatttgcacttt

SEQ ID NO: 295158 - DNA, 20 bp, Artificial Sequence
  chemically synthesized
aaattcataacgaactctaa

SEQ ID NO: 295159 - DNA, 20 bp, Artificial Sequence
  chemically synthesized
cactttatataaagctatta

SEQ ID NO: 295160 - DNA, 20 bp, Artificial Sequence
  chemically synthesized
gccactttatataaagctat

SEQ ID NO: 295161 - DNA, 20 bp, Artificial Sequence
  chemically synthesized
aactctaatagctttatata

SEQ ID NO: 295162 - DNA, 20 bp, Artificial Sequence
  chemically synthesized
ttttatggccactttatata

SEQ ID NO: 295163 - DNA, 20 bp, Artificial Sequence
  chemically synthesized
tctaatagctttatataaag

SEQ ID NO: 295164 - DNA, 20 bp, Artificial Sequence
  chemically synthesized
atataaagtggccataaaac

SEQ ID NO: 295165 - DNA, 20 bp, Artificial Sequence
  chemically synthesized
gtccccatgtactggtttta

SEQ ID NO: 295166 - DNA, 20 bp, Artificial Sequence
  chemically synthesized
gtggccataaaaccagtaca

SEQ ID NO: 295167 - DNA, 20 bp, Artificial Sequence
  chemically synthesized
tggccataaaaccagtacat

SEQ ID NO: 295168 - DNA, 20 bp, Artificial Sequence
  chemically synthesized
ggccataaaaccagtacatg

SEQ ID NO: 295169 - DNA, 20 bp, Artificial Sequence
  chemically synthesized
cagcacctgtccccatgtac

SEQ ID NO: 295170 - DNA, 20 bp, Artificial Sequence
  chemically synthesized
ataaaaccagtacatgggga

SEQ ID NO: 295171 - DNA, 20 bp, Artificial Sequence
  chemically synthesized
taaaaccagtacatggggac

SEQ ID NO: 295172 - DNA, 20 bp, Artificial Sequence
  chemically synthesized
tacatggggacaggtgctgc

SEQ ID NO: 295173 - DNA, 20 bp, Artificial Sequence
  chemically synthesized
ggggacaggtgctgcaagct

SEQ ID NO: 295174 - DNA, 20 bp, Artificial Sequence
  chemically synthesized
tccttcctttactgagcttg

SEQ ID NO: 295175 - DNA, 20 bp, Artificial Sequence
  chemically synthesized
caggtgctgcaagctcagta

SEQ ID NO: 295176 - DNA, 20 bp, Artificial Sequence
  chemically synthesized
aggtgctgcaagctcagtaa

SEQ ID NO: 295177 - DNA, 20 bp, Artificial Sequence
  chemically synthesized
taatccatccttcctttact

SEQ ID NO: 295178 - DNA, 20 bp, Artificial Sequence
  chemically synthesized
tgctgcaagctcagtaaagg

SEQ ID NO: 295179 - DNA, 20 bp, Artificial Sequence
  chemically synthesized
gctgcaagctcagtaaagga

SEQ ID NO: 295180 - DNA, 20 bp, Artificial Sequence
  chemically synthesized
caagctcagtaaaggaagga

SEQ ID NO: 295181 - DNA, 20 bp, Artificial Sequence
  chemically synthesized
aggaaggatggattaaatca

SEQ ID NO: 295182 - DNA, 20 bp, Artificial Sequence
  chemically synthesized
tggattaaatcaaagtattc

SEQ ID NO: 295183 - DNA, 20 bp, Artificial Sequence
  chemically synthesized
cctaactaatatgcagtttc

SEQ ID NO: 295184 - DNA, 20 bp, Artificial Sequence
  chemically synthesized
gtattctagaaactgcatat

SEQ ID NO: 295185 - DNA, 20 bp, Artificial Sequence
  chemically synthesized
ccaactccctaactaatatg

SEQ ID NO: 295186 - DNA, 20 bp, Artificial Sequence
  chemically synthesized
tctagaaactgcatattagt

SEQ ID NO: 295187 - DNA, 20 bp, Artificial Sequence
  chemically synthesized
ctagaaactgcatattagtt

SEQ ID NO: 295188 - DNA, 20 bp, Artificial Sequence
  chemically synthesized
tagaaactgcatattagtta

SEQ ID NO: 295189 - DNA, 20 bp, Artificial Sequence
  chemically synthesized
gaaactgcatattagttagg

SEQ ID NO: 295190 - DNA, 20 bp, Artificial Sequence
  chemically synthesized
ctgcatattagttagggagt

SEQ ID NO: 295191 - DNA, 20 bp, Artificial Sequence
  chemically synthesized
tgcatattagttagggagtt

SEQ ID NO: 295192 - DNA, 20 bp, Artificial Sequence
  chemically synthesized
gacttgagctgaagaaaaga

SEQ ID NO: 295193 - DNA, 20 bp, Artificial Sequence
  chemically synthesized
gggcacatccatcttttctt

SEQ ID NO: 295194 - DNA, 20 bp, Artificial Sequence
  chemically synthesized
tcaggacttgagctgaagaa

SEQ ID NO: 295195 - DNA, 20 bp, Artificial Sequence
  chemically synthesized
atccatcttttcttcagctc

SEQ ID NO: 295196 - DNA, 20 bp, Artificial Sequence
  chemically synthesized
cagtatcaggacttgagctg

SEQ ID NO: 295197 - DNA, 20 bp, Artificial Sequence
  chemically synthesized
tattaccagtatcaggactt

SEQ ID NO: 295198 - DNA, 20 bp, Artificial Sequence
  chemically synthesized
ttcagctcaagtcctgatac

SEQ ID NO: 295199 - DNA, 20 bp, Artificial Sequence
  chemically synthesized
attggtttattaccagtatc

SEQ ID NO: 295200 - DNA, 20 bp, Artificial Sequence
  chemically synthesized
tattggtttattaccagtat

SEQ ID NO: 295201 - DNA, 20 bp, Artificial Sequence
  chemically synthesized
cttaggtattggtttattac

SEQ ID NO: 295202 - DNA, 20 bp, Artificial Sequence
  chemically synthesized
ctggtaataaaccaatacct

SEQ ID NO: 295203 - DNA, 20 bp, Artificial Sequence
  chemically synthesized
tttcttttctacttaggtat

SEQ ID NO: 295204 - DNA, 20 bp, Artificial Sequence
  chemically synthesized
gtaataaaccaatacctaag

SEQ ID NO: 295205 - DNA, 20 bp, Artificial Sequence
  chemically synthesized
gtactctttcttttctactt

SEQ ID NO: 295206 - DNA, 20 bp, Artificial Sequence
  chemically synthesized
aaaccaatacctaagtagaa

SEQ ID NO: 295207 - DNA, 20 bp, Artificial Sequence
  chemically synthesized
ggtactctttcttttctact

SEQ ID NO: 295208 - DNA, 20 bp, Artificial Sequence
  chemically synthesized
caatacctaagtagaaaaga

SEQ ID NO: 295209 - DNA, 20 bp, Artificial Sequence
  chemically synthesized
atacctaagtagaaaagaaa

SEQ ID NO: 295210 - DNA, 20 bp, Artificial Sequence
  chemically synthesized
tttgactcatggattgtata

SEQ ID NO: 295211 - DNA, 20 bp, Artificial Sequence
  chemically synthesized
gagtaccatatacaatccat

SEQ ID NO: 295212 - DNA, 20 bp, Artificial Sequence
  chemically synthesized
ttctaccaagttttgactca

SEQ ID NO: 295213 - DNA, 20 bp, Artificial Sequence
  chemically synthesized
acaatccatgagtcaaaact

SEQ ID NO: 295214 - DNA, 20 bp, Artificial Sequence
  chemically synthesized
atccatgagtcaaaacttgg

SEQ ID NO: 295215 - DNA, 20 bp, Artificial Sequence
  chemically synthesized
cagagaggtaagattctacc

SEQ ID NO: 295216 - DNA, 20 bp, Artificial Sequence
  chemically synthesized
tgaaataaaaacagagaggt

SEQ ID NO: 295217 - DNA, 20 bp, Artificial Sequence
  chemically synthesized
gccatgaaataaaaacagag

SEQ ID NO: 295218 - DNA, 20 bp, Artificial Sequence
  chemically synthesized
agccatgaaataaaaacaga

SEQ ID NO: 295219 - DNA, 20 bp, Artificial Sequence
  chemically synthesized
agagccatgaaataaaaaca

SEQ ID NO: 295220 - DNA, 20 bp, Artificial Sequence
  chemically synthesized
tcagagccatgaaataaaaa

SEQ ID NO: 295221 - DNA, 20 bp, Artificial Sequence
  chemically synthesized
acctctctgtttttatttca

SEQ ID NO: 295222 - DNA, 20 bp, Artificial Sequence
  chemically synthesized
agagaggaggtggaagatca

SEQ ID NO: 295223 - DNA, 20 bp, Artificial Sequence
  chemically synthesized
agagagaggaggtggaagat

SEQ ID NO: 295224 - DNA, 20 bp, Artificial Sequence
  chemically synthesized
cacatagagagaggaggtgg

SEQ ID NO: 295225 - DNA, 20 bp, Artificial Sequence
  chemically synthesized
acacacatagagagaggagg

SEQ ID NO: 295226 - DNA, 20 bp, Artificial Sequence
  chemically synthesized
tacacacacatagagagagg

SEQ ID NO: 295227 - DNA, 20 bp, Artificial Sequence
  chemically synthesized
atacacacacatagagagag

SEQ ID NO: 295228 - DNA, 20 bp, Artificial Sequence
  chemically synthesized
acatacacacacatagagag

SEQ ID NO: 295229 - DNA, 20 bp, Artificial Sequence
  chemically synthesized
tacatacacacacatagaga

SEQ ID NO: 295230 - DNA, 20 bp, Artificial Sequence
  chemically synthesized
tgtacatacacacacataga

SEQ ID NO: 295231 - DNA, 20 bp, Artificial Sequence
  chemically synthesized
tatgtacatacacacacata

SEQ ID NO: 295232 - DNA, 20 bp, Artificial Sequence
  chemically synthesized
tatatgtacatacacacaca

SEQ ID NO: 295233 - DNA, 20 bp, Artificial Sequence
  chemically synthesized
atgggaaaggggtatatata

SEQ ID NO: 295234 - DNA, 20 bp, Artificial Sequence
  chemically synthesized
gtcttgaaaacatgggaaag

SEQ ID NO: 295235 - DNA, 20 bp, Artificial Sequence
  chemically synthesized
ggtcttgaaaacatgggaaa

SEQ ID NO: 295236 - DNA, 20 bp, Artificial Sequence
  chemically synthesized
tggtcttgaaaacatgggaa

SEQ ID NO: 295237 - DNA, 20 bp, Artificial Sequence
  chemically synthesized
ttggtcttgaaaacatggga

SEQ ID NO: 295238 - DNA, 20 bp, Artificial Sequence
  chemically synthesized
acccttggtcttgaaaacat

SEQ ID NO: 295239 - DNA, 20 bp, Artificial Sequence
  chemically synthesized
tacccctttcccatgttttc

SEQ ID NO: 295240 - DNA, 20 bp, Artificial Sequence
  chemically synthesized
tacccttggtcttgaaaaca

SEQ ID NO: 295241 - DNA, 20 bp, Artificial Sequence
  chemically synthesized
tttcccatgttttcaagacc

SEQ ID NO: 295242 - DNA, 20 bp, Artificial Sequence
  chemically synthesized
ttcccatgttttcaagacca

SEQ ID NO: 295243 - DNA, 20 bp, Artificial Sequence
  chemically synthesized
tcccatgttttcaagaccaa

SEQ ID NO: 295244 - DNA, 20 bp, Artificial Sequence
  chemically synthesized
gagtattcagatgataccct

SEQ ID NO: 295245 - DNA, 20 bp, Artificial Sequence
  chemically synthesized
gactgtggttgaagagtatt

SEQ ID NO: 295246 - DNA, 20 bp, Artificial Sequence
  chemically synthesized
aaatgaagactgtggttgaa

SEQ ID NO: 295247 - DNA, 20 bp, Artificial Sequence
  chemically synthesized
atctgaatactcttcaacca

SEQ ID NO: 295248 - DNA, 20 bp, Artificial Sequence
  chemically synthesized
gaaaatgaagactgtggttg

SEQ ID NO: 295249 - DNA, 20 bp, Artificial Sequence
  chemically synthesized
ataaaagaaaatgaagactg

SEQ ID NO: 295250 - DNA, 20 bp, Artificial Sequence
  chemically synthesized
gaaatatataaaagaaaatg

SEQ ID NO: 295251 - DNA, 20 bp, Artificial Sequence
  chemically synthesized
attgaagatgaaatatataa

SEQ ID NO: 295252 - DNA, 20 bp, Artificial Sequence
  chemically synthesized
tattagtccaaatttcattg

SEQ ID NO: 295253 - DNA, 20 bp, Artificial Sequence
  chemically synthesized
atttcatcttcaatgaaatt

SEQ ID NO: 295254 - DNA, 20 bp, Artificial Sequence
  chemically synthesized
ttggactaatatggtaatat

SEQ ID NO: 295255 - DNA, 20 bp, Artificial Sequence
  chemically synthesized
ttggactaatattaccatat

SEQ ID NO: 295256 - DNA, 20 bp, Artificial Sequence
  chemically synthesized
tactggaatttggactaata

SEQ ID NO: 295257 - DNA, 20 bp, Artificial Sequence
  chemically synthesized
taccatattagtccaaattc

SEQ ID NO: 295258 - DNA, 20 bp, Artificial Sequence
  chemically synthesized
aatattgaaatactggaatt

SEQ ID NO: 295259 - DNA, 20 bp, Artificial Sequence
  chemically synthesized
ttggagtaatattgaaatac

SEQ ID NO: 295260 - DNA, 20 bp, Artificial Sequence
  chemically synthesized
agtctgactgtaggtatttg

SEQ ID NO: 295261 - DNA, 20 bp, Artificial Sequence
  chemically synthesized
gaagtctgactgtaggtatt

SEQ ID NO: 295262 - DNA, 20 bp, Artificial Sequence
  chemically synthesized
aatattactccaaataccta

SEQ ID NO: 295263 - DNA, 20 bp, Artificial Sequence
  chemically synthesized
ttactccaaatacctacagt

SEQ ID NO: 295264 - DNA, 20 bp, Artificial Sequence
  chemically synthesized
gaaggctgaagtctgactgt

SEQ ID NO: 295265 - DNA, 20 bp, Artificial Sequence
  chemically synthesized
tgaaggctgaagtctgactg

SEQ ID NO: 295266 - DNA, 20 bp, Artificial Sequence
  chemically synthesized
aaatacctacagtcagactt

SEQ ID NO: 295267 - DNA, 20 bp, Artificial Sequence
  chemically synthesized
ttgtacagtagtgaaggctg

SEQ ID NO: 295268 - DNA, 20 bp, Artificial Sequence
  chemically synthesized
aactttttgtacagtagtga

SEQ ID NO: 295269 - DNA, 20 bp, Artificial Sequence
  chemically synthesized
taactttttgtacagtagtg

SEQ ID NO: 295270 - DNA, 20 bp, Artificial Sequence
  chemically synthesized
caaaataactttttgtacag

SEQ ID NO: 295271 - DNA, 20 bp, Artificial Sequence
  chemically synthesized
agccttcactactgtacaaa

SEQ ID NO: 295272 - DNA, 20 bp, Artificial Sequence
  chemically synthesized
tcacaaaataactttttgta

SEQ ID NO: 295273 - DNA, 20 bp, Artificial Sequence
  chemically synthesized
tacaaaaagttattttgtga

SEQ ID NO: 295274 - DNA, 20 bp, Artificial Sequence
  chemically synthesized
ttttgtgaaagtcattaatt

SEQ ID NO: 295275 - DNA, 20 bp, Artificial Sequence
  chemically synthesized
gtgaaagtcattaatttggc

SEQ ID NO: 295276 - DNA, 20 bp, Artificial Sequence
  chemically synthesized
tgaaagtcattaatttggcc

SEQ ID NO: 295277 - DNA, 20 bp, Artificial Sequence
  chemically synthesized
gtcattaatttggccgggcg

SEQ ID NO: 295278 - DNA, 20 bp, Artificial Sequence
  chemically synthesized
tcattaatttggccgggcgc

SEQ ID NO: 295279 - DNA, 20 bp, Artificial Sequence
  chemically synthesized
cattaatttggccgggcgca

SEQ ID NO: 295280 - DNA, 20 bp, Artificial Sequence
  chemically synthesized
attaatttggccgggcgcag

SEQ ID NO: 295281 - DNA, 20 bp, Artificial Sequence
  chemically synthesized
caggcgtgagcccctgcgcc

SEQ ID NO: 295282 - DNA, 20 bp, Artificial Sequence
  chemically synthesized
agtgctgggattacaggcgt

SEQ ID NO: 295283 - DNA, 20 bp, Artificial Sequence
  chemically synthesized
ggggctcacgcctgtaatcc

SEQ ID NO: 295284 - DNA, 20 bp, Artificial Sequence
  chemically synthesized
tcccaaagtgctgggattac

SEQ ID NO: 295285 - DNA, 20 bp, Artificial Sequence
  chemically synthesized
ctcccaaagtgctgggatta

SEQ ID NO: 295286 - DNA, 20 bp, Artificial Sequence
  chemically synthesized
cgcctgtaatcccagcactt

SEQ ID NO: 295287 - DNA, 20 bp, Artificial Sequence
  chemically synthesized
ccttggcctcccaaagtgct

SEQ ID NO: 295288 - DNA, 20 bp, Artificial Sequence
  chemically synthesized
gcctgtaatcccagcacttt

SEQ ID NO: 295289 - DNA, 20 bp, Artificial Sequence
  chemically synthesized
gccttggcctcccaaagtgc

SEQ ID NO: 295290 - DNA, 20 bp, Artificial Sequence
  chemically synthesized
ctgtaatcccagcactttgg

SEQ ID NO: 295291 - DNA, 20 bp, Artificial Sequence
  chemically synthesized
tgtaatcccagcactttggg

SEQ ID NO: 295292 - DNA, 20 bp, Artificial Sequence
  chemically synthesized
ccacctgccttggcctccca

SEQ ID NO: 295293 - DNA, 20 bp, Artificial Sequence
  chemically synthesized
tcccagcactttgggaggcc

SEQ ID NO: 295294 - DNA, 20 bp, Artificial Sequence
  chemically synthesized
cccagcactttgggaggcca

SEQ ID NO: 295295 - DNA, 20 bp, Artificial Sequence
  chemically synthesized
agcactttgggaggccaagg

SEQ ID NO: 295296 - DNA, 20 bp, Artificial Sequence
  chemically synthesized
gcactttgggaggccaaggc

SEQ ID NO: 295297 - DNA, 20 bp, Artificial Sequence
  chemically synthesized
ctttgggaggccaaggcagg

SEQ ID NO: 295298 - DNA, 20 bp, Artificial Sequence
  chemically synthesized
accttgtgatccacctgcct

SEQ ID NO: 295299 - DNA, 20 bp, Artificial Sequence
  chemically synthesized
ggccaaggcaggtggatcac

SEQ ID NO: 295300 - DNA, 20 bp, Artificial Sequence
  chemically synthesized
gccaaggcaggtggatcaca

SEQ ID NO: 295301 - DNA, 20 bp, Artificial Sequence
  chemically synthesized
aggcaggtggatcacaaggt

SEQ ID NO: 295302 - DNA, 20 bp, Artificial Sequence
  chemically synthesized
ggcaggtggatcacaaggtc

SEQ ID NO: 295303 - DNA, 20 bp, Artificial Sequence
  chemically synthesized
caggtggatcacaaggtcag

SEQ ID NO: 295304 - DNA, 20 bp, Artificial Sequence
  chemically synthesized
tggatcacaaggtcaggaga

SEQ ID NO: 295305 - DNA, 20 bp, Artificial Sequence
  chemically synthesized
gatcacaaggtcaggagatg

SEQ ID NO: 295306 - DNA, 20 bp, Artificial Sequence
  chemically synthesized
tcaggagatggagaccatcc

SEQ ID NO: 295307 - DNA, 20 bp, Artificial Sequence
  chemically synthesized
gtttcaactgttggccagga

SEQ ID NO: 295308 - DNA, 20 bp, Artificial Sequence
  chemically synthesized
atggagaccatcctggccaa

SEQ ID NO: 295309 - DNA, 20 bp, Artificial Sequence
  chemically synthesized
cggggtttcaactgttggcc

SEQ ID NO: 295310 - DNA, 20 bp, Artificial Sequence
  chemically synthesized
acggggtttcaactgttggc

SEQ ID NO: 295311 - DNA, 20 bp, Artificial Sequence
  chemically synthesized
agagacggggtttcaactgt

SEQ ID NO: 295312 - DNA, 20 bp, Artificial Sequence
  chemically synthesized
ttgtatttttagtagagacg

SEQ ID NO: 295313 - DNA, 20 bp, Artificial Sequence
  chemically synthesized
tttgtatttttagtagagac

SEQ ID NO: 295314 - DNA, 20 bp, Artificial Sequence
  chemically synthesized
ttttgtatttttagtagaga

SEQ ID NO: 295315 - DNA, 20 bp, Artificial Sequence
  chemically synthesized
aattttttgtatttttagta

SEQ ID NO: 295316 - DNA, 20 bp, Artificial Sequence
  chemically synthesized
ctaattttttgtatttttag

SEQ ID NO: 295317 - DNA, 20 bp, Artificial Sequence
  chemically synthesized
cagctaattttttgtatttt

SEQ ID NO: 295318 - DNA, 20 bp, Artificial Sequence
  chemically synthesized
ctactaaaaatacaaaaaat

SEQ ID NO: 295319 - DNA, 20 bp, Artificial Sequence
  chemically synthesized
taaaaatacaaaaaattagc

SEQ ID NO: 295320 - DNA, 20 bp, Artificial Sequence
  chemically synthesized
tacaaaaaattagctggacg

SEQ ID NO: 295321 - DNA, 20 bp, Artificial Sequence
  chemically synthesized
aaaaaattagctggacgtgg

SEQ ID NO: 295322 - DNA, 20 bp, Artificial Sequence
  chemically synthesized
caggcacgtgccaccacgtc

SEQ ID NO: 295323 - DNA, 20 bp, Artificial Sequence
  chemically synthesized
gacgtggtggcacgtgcctg

SEQ ID NO: 295324 - DNA, 20 bp, Artificial Sequence
  chemically synthesized
gtggcacgtgcctgtagtcc

SEQ ID NO: 295325 - DNA, 20 bp, Artificial Sequence
  chemically synthesized
tcccgagtagctgggactac

SEQ ID NO: 295326 - DNA, 20 bp, Artificial Sequence
  chemically synthesized
ctcccgagtagctgggacta

SEQ ID NO: 295327 - DNA, 20 bp, Artificial Sequence
  chemically synthesized
tgcctgtagtcccagctact

SEQ ID NO: 295328 - DNA, 20 bp, Artificial Sequence
  chemically synthesized
cctcagcctcccgagtagct

SEQ ID NO: 295329 - DNA, 20 bp, Artificial Sequence
  chemically synthesized
gcctgtagtcccagctactc

SEQ ID NO: 295330 - DNA, 20 bp, Artificial Sequence
  chemically synthesized
gcctcagcctcccgagtagc

SEQ ID NO: 295331 - DNA, 20 bp, Artificial Sequence
  chemically synthesized
ctgtagtcccagctactcgg

SEQ ID NO: 295332 - DNA, 20 bp, Artificial Sequence
  chemically synthesized
tgtagtcccagctactcggg

SEQ ID NO: 295333 - DNA, 20 bp, Artificial Sequence
  chemically synthesized
tcctgcctcagcctcccgag

SEQ ID NO: 295334 - DNA, 20 bp, Artificial Sequence
  chemically synthesized
ttctcctgcctcagcctccc

SEQ ID NO: 295335 - DNA, 20 bp, Artificial Sequence
  chemically synthesized
tcccagctactcgggaggct

SEQ ID NO: 295336 - DNA, 20 bp, Artificial Sequence
  chemically synthesized
cccagctactcgggaggctg

SEQ ID NO: 295337 - DNA, 20 bp, Artificial Sequence
  chemically synthesized
agctactcgggaggctgagg

SEQ ID NO: 295338 - DNA, 20 bp, Artificial Sequence
  chemically synthesized
gctactcgggaggctgaggc

SEQ ID NO: 295339 - DNA, 20 bp, Artificial Sequence
  chemically synthesized
tactcgggaggctgaggcag

SEQ ID NO: 295340 - DNA, 20 bp, Artificial Sequence
  chemically synthesized
ttcaagcgattctcctgcct

SEQ ID NO: 295341 - DNA, 20 bp, Artificial Sequence
  chemically synthesized
gcaggagaatcgcttgaacc

SEQ ID NO: 295342 - DNA, 20 bp, Artificial Sequence
  chemically synthesized
caggagaatcgcttgaaccc

SEQ ID NO: 295343 - DNA, 20 bp, Artificial Sequence
  chemically synthesized
aacttctgtctcccgggttc

SEQ ID NO: 295344 - DNA, 20 bp, Artificial Sequence
  chemically synthesized
ggagaatcgcttgaacccgg

SEQ ID NO: 295345 - DNA, 20 bp, Artificial Sequence
  chemically synthesized
aatcgcttgaacccgggaga

SEQ ID NO: 295346 - DNA, 20 bp, Artificial Sequence
  chemically synthesized
cactgcaacttctgtctccc

SEQ ID NO: 295347 - DNA, 20 bp, Artificial Sequence
  chemically synthesized
tcactgcaacttctgtctcc

SEQ ID NO: 295348 - DNA, 20 bp, Artificial Sequence
  chemically synthesized
cgcttgaacccgggagacag

SEQ ID NO: 295349 - DNA, 20 bp, Artificial Sequence
  chemically synthesized
aacccgggagacagaagttg

SEQ ID NO: 295350 - DNA, 20 bp, Artificial Sequence
  chemically synthesized
cgggagacagaagttgcagt

SEQ ID NO: 295351 - DNA, 20 bp, Artificial Sequence
  chemically synthesized
gacagaagttgcagtgagcc

SEQ ID NO: 295352 - DNA, 20 bp, Artificial Sequence
  chemically synthesized
ggagtgcagtggcgcaatct

SEQ ID NO: 295353 - DNA, 20 bp, Artificial Sequence
  chemically synthesized
tcacccaggctggagtgcag

SEQ ID NO: 295354 - DNA, 20 bp, Artificial Sequence
  chemically synthesized
aagattgcgccactgcactc

SEQ ID NO: 295355 - DNA, 20 bp, Artificial Sequence
  chemically synthesized
ctgtcacccaggctggagtg

SEQ ID NO: 295356 - DNA, 20 bp, Artificial Sequence
  chemically synthesized
tgcgccactgcactccagcc

SEQ ID NO: 295357 - DNA, 20 bp, Artificial Sequence
  chemically synthesized
gcgccactgcactccagcct

SEQ ID NO: 295358 - DNA, 20 bp, Artificial Sequence
  chemically synthesized
tcgctctgtcacccaggctg

SEQ ID NO: 295359 - DNA, 20 bp, Artificial Sequence
  chemically synthesized
cctcgctctgtcacccaggc

SEQ ID NO: 295360 - DNA, 20 bp, Artificial Sequence
  chemically synthesized
ctgcactccagcctgggtga

SEQ ID NO: 295361 - DNA, 20 bp, Artificial Sequence
  chemically synthesized
ggagcctcgctctgtcaccc

SEQ ID NO: 295362 - DNA, 20 bp, Artificial Sequence
  chemically synthesized
gcactccagcctgggtgaca

SEQ ID NO: 295363 - DNA, 20 bp, Artificial Sequence
  chemically synthesized
cggagcctcgctctgtcacc

SEQ ID NO: 295364 - DNA, 20 bp, Artificial Sequence
  chemically synthesized
tccagcctgggtgacagagc

SEQ ID NO: 295365 - DNA, 20 bp, Artificial Sequence
  chemically synthesized
ccagcctgggtgacagagcg

SEQ ID NO: 295366 - DNA, 20 bp, Artificial Sequence
  chemically synthesized
gacagagcgaggctccgtct

SEQ ID NO: 295367 - DNA, 20 bp, Artificial Sequence
  chemically synthesized
acagagcgaggctccgtctc

SEQ ID NO: 295368 - DNA, 20 bp, Artificial Sequence
  chemically synthesized
tttttttttttcccgagacg

SEQ ID NO: 295369 - DNA, 20 bp, Artificial Sequence
  chemically synthesized
tttttttttttttcccgaga

SEQ ID NO: 295370 - DNA, 20 bp, Artificial Sequence
  chemically synthesized
tttttttttttttttttccc

SEQ ID NO: 295371 - DNA, 20 bp, Artificial Sequence
  chemically synthesized
aaaaaaaaaaaaaaaaaaaa

SEQ ID NO: 295372 - DNA, 20 bp, Artificial Sequence
  chemically synthesized
aaaaaaaaaaaaaaaaagaa

SEQ ID NO: 295373 - DNA, 20 bp, Artificial Sequence
  chemically synthesized
aaaaaaaaaaaaagaaaaga

SEQ ID NO: 295374 - DNA, 20 bp, Artificial Sequence
  chemically synthesized
gtcattaattttcttcttgt

SEQ ID NO: 295375 - DNA, 20 bp, Artificial Sequence
  chemically synthesized
tcattaattttcttcttgtt

SEQ ID NO: 295376 - DNA, 20 bp, Artificial Sequence
  chemically synthesized
gaagcatttttcctaacaag

SEQ ID NO: 295377 - DNA, 20 bp, Artificial Sequence
  chemically synthesized
taagaagcatttttcctaac

SEQ ID NO: 295378 - DNA, 20 bp, Artificial Sequence
  chemically synthesized
tcagtactgaatgttgtaag

SEQ ID NO: 295379 - DNA, 20 bp, Artificial Sequence
  chemically synthesized
ttatcagtactgaatgttgt

SEQ ID NO: 295380 - DNA, 20 bp, Artificial Sequence
  chemically synthesized
aaaatgcttcttacaacatt

SEQ ID NO: 295381 - DNA, 20 bp, Artificial Sequence
  chemically synthesized
gaggtaattgtagtttttat

SEQ ID NO: 295382 - DNA, 20 bp, Artificial Sequence
  chemically synthesized
caatttcgaggaggtaattg

SEQ ID NO: 295383 - DNA, 20 bp, Artificial Sequence
  chemically synthesized
tgaacatggcaatttcgagg

SEQ ID NO: 295384 - DNA, 20 bp, Artificial Sequence
  chemically synthesized
atgaacatggcaatttcgag

SEQ ID NO: 295385 - DNA, 20 bp, Artificial Sequence
  chemically synthesized
ttatgaacatggcaatttcg

SEQ ID NO: 295386 - DNA, 20 bp, Artificial Sequence
  chemically synthesized
tttatgaacatggcaatttc

SEQ ID NO: 295387 - DNA, 20 bp, Artificial Sequence
  chemically synthesized
cagaggtatttttatgaaca

SEQ ID NO: 295388 - DNA, 20 bp, Artificial Sequence
  chemically synthesized
gataatattgtcaagggcag

SEQ ID NO: 295389 - DNA, 20 bp, Artificial Sequence
  chemically synthesized
agataatattgtcaagggca

SEQ ID NO: 295390 - DNA, 20 bp, Artificial Sequence
  chemically synthesized
aaagataatattgtcaaggg

SEQ ID NO: 295391 - DNA, 20 bp, Artificial Sequence
  chemically synthesized
gagaaagataatattgtcaa

SEQ ID NO: 295392 - DNA, 20 bp, Artificial Sequence
  chemically synthesized
agagaaagataatattgtca

SEQ ID NO: 295393 - DNA, 20 bp, Artificial Sequence
  chemically synthesized
aagagaaagataatattgtc

SEQ ID NO: 295394 - DNA, 20 bp, Artificial Sequence
  chemically synthesized
tgaggacgaaatttaagaga

SEQ ID NO: 295395 - DNA, 20 bp, Artificial Sequence
  chemically synthesized
ttcatgaggacgaaatttaa

SEQ ID NO: 295396 - DNA, 20 bp, Artificial Sequence
  chemically synthesized
acttcatgaggacgaaattt

SEQ ID NO: 295397 - DNA, 20 bp, Artificial Sequence
  chemically synthesized
tcttaaatttcgtcctcatg

SEQ ID NO: 295398 - DNA, 20 bp, Artificial Sequence
  chemically synthesized
aaaagctggatgacttcatg

SEQ ID NO: 295399 - DNA, 20 bp, Artificial Sequence
  chemically synthesized
gaaaagctggatgacttcat

SEQ ID NO: 295400 - DNA, 20 bp, Artificial Sequence
  chemically synthesized
ttcgtcctcatgaagtcatc

SEQ ID NO: 295401 - DNA, 20 bp, Artificial Sequence
  chemically synthesized
aaacacacatacagaaaagc

SEQ ID NO: 295402 - DNA, 20 bp, Artificial Sequence
  chemically synthesized
agaaaaacacacatacagaa

SEQ ID NO: 295403 - DNA, 20 bp, Artificial Sequence
  chemically synthesized
tctatagaaaaacacacata

SEQ ID NO: 295404 - DNA, 20 bp, Artificial Sequence
  chemically synthesized
tctgtatgtgtgtttttcta

SEQ ID NO: 295405 - DNA, 20 bp, Artificial Sequence
  chemically synthesized
tgtatgtgtgtttttctata

SEQ ID NO: 295406 - DNA, 20 bp, Artificial Sequence
  chemically synthesized
atatatgataaacagctcta

SEQ ID NO: 295407 - DNA, 20 bp, Artificial Sequence
  chemically synthesized
gtagacacatatatgataaa

SEQ ID NO: 295408 - DNA, 20 bp, Artificial Sequence
  chemically synthesized
attaaaaatgtatatgcatg

SEQ ID NO: 295409 - DNA, 20 bp, Artificial Sequence
  chemically synthesized
atatacatttttaatcttga

SEQ ID NO: 295410 - DNA, 20 bp, Artificial Sequence
  chemically synthesized
tatacatttttaatcttgaa

SEQ ID NO: 295411 - DNA, 20 bp, Artificial Sequence
  chemically synthesized
tatgaaatatagatcctttc

SEQ ID NO: 295412 - DNA, 20 bp, Artificial Sequence
  chemically synthesized
aaactgtatgttatgaaata

SEQ ID NO: 295413 - DNA, 20 bp, Artificial Sequence
  chemically synthesized
gatctatatttcataacata

SEQ ID NO: 295414 - DNA, 20 bp, Artificial Sequence
  chemically synthesized
tttagtattctatatgttaa

SEQ ID NO: 295415 - DNA, 20 bp, Artificial Sequence
  chemically synthesized
taaattatgctattaacata

SEQ ID NO: 295416 - DNA, 20 bp, Artificial Sequence
  chemically synthesized
catatattgagtaaagtatt

SEQ ID NO: 295417 - DNA, 20 bp, Artificial Sequence
  chemically synthesized
tattaagcatatattgagta

SEQ ID NO: 295418 - DNA, 20 bp, Artificial Sequence
  chemically synthesized
tcatatattaagcatatatt

SEQ ID NO: 295419 - DNA, 20 bp, Artificial Sequence
  chemically synthesized
taaacatgtgatcatatatt

SEQ ID NO: 295420 - DNA, 20 bp, Artificial Sequence
  chemically synthesized
ttaatatatgatcacatgtt

SEQ ID NO: 295421 - DNA, 20 bp, Artificial Sequence
  chemically synthesized
atatatgatcacatgtttag

SEQ ID NO: 295422 - DNA, 20 bp, Artificial Sequence
  chemically synthesized
catgtttagaagccactact

SEQ ID NO: 295423 - DNA, 20 bp, Artificial Sequence
  chemically synthesized
ataatttagaatccgagtag

SEQ ID NO: 295424 - DNA, 20 bp, Artificial Sequence
  chemically synthesized
taaataatttagaatccgag

SEQ ID NO: 295425 - DNA, 20 bp, Artificial Sequence
  chemically synthesized
tactaaataatttagaatcc

SEQ ID NO: 295426 - DNA, 20 bp, Artificial Sequence
  chemically synthesized
tactcggattctaaattatt

SEQ ID NO: 295427 - DNA, 20 bp, Artificial Sequence
  chemically synthesized
attatgtgtactaaataatt

SEQ ID NO: 295428 - DNA, 20 bp, Artificial Sequence
  chemically synthesized
tatttagtacacataatttc

SEQ ID NO: 295429 - DNA, 20 bp, Artificial Sequence
  chemically synthesized
agtacacataatttcaagta

SEQ ID NO: 295430 - DNA, 20 bp, Artificial Sequence
  chemically synthesized
ataatttcaagtaaagtata

SEQ ID NO: 295431 - DNA, 20 bp, Artificial Sequence
  chemically synthesized
atttcaagtaaagtatacag

SEQ ID NO: 295432 - DNA, 20 bp, Artificial Sequence
  chemically synthesized
aaagtatacagaagctaaaa

SEQ ID NO: 295433 - DNA, 20 bp, Artificial Sequence
  chemically synthesized
aagtatacagaagctaaaaa

SEQ ID NO: 295434 - DNA, 20 bp, Artificial Sequence
  chemically synthesized
tgatttactgatgccttttt

SEQ ID NO: 295435 - DNA, 20 bp, Artificial Sequence
  chemically synthesized
acagaagctaaaaaaggcat

SEQ ID NO: 295436 - DNA, 20 bp, Artificial Sequence
  chemically synthesized
gcatcagtaaatcaatgtat

SEQ ID NO: 295437 - DNA, 20 bp, Artificial Sequence
  chemically synthesized
taaatcaatgtatcagaaat

SEQ ID NO: 295438 - DNA, 20 bp, Artificial Sequence
  chemically synthesized
tcagaaatgagtgattattg

SEQ ID NO: 295439 - DNA, 20 bp, Artificial Sequence
  chemically synthesized
cagaaatgagtgattattgt

SEQ ID NO: 295440 - DNA, 20 bp, Artificial Sequence
  chemically synthesized
tgatctctaagaattttcat

SEQ ID NO: 295441 - DNA, 20 bp, Artificial Sequence
  chemically synthesized
tgtgggctcatgaaaattct

SEQ ID NO: 295442 - DNA, 20 bp, Artificial Sequence
  chemically synthesized
tgggctcatgaaaattctta

SEQ ID NO: 295443 - DNA, 20 bp, Artificial Sequence
  chemically synthesized
tataattcttcatgatctct

SEQ ID NO: 295444 - DNA, 20 bp, Artificial Sequence
  chemically synthesized
gaaaattcttagagatcatg

SEQ ID NO: 295445 - DNA, 20 bp, Artificial Sequence
  chemically synthesized
aagaattataaatactaaaa

SEQ ID NO: 295446 - DNA, 20 bp, Artificial Sequence
  chemically synthesized
agaattataaatactaaaat

SEQ ID NO: 295447 - DNA, 20 bp, Artificial Sequence
  chemically synthesized
tgcatttaggttacccattt

SEQ ID NO: 295448 - DNA, 20 bp, Artificial Sequence
  chemically synthesized
ttgccttttattttgcattt

SEQ ID NO: 295449 - DNA, 20 bp, Artificial Sequence
  chemically synthesized
gttgccttttattttgcatt

SEQ ID NO: 295450 - DNA, 20 bp, Artificial Sequence
  chemically synthesized
gtaacctaaatgcaaaataa

SEQ ID NO: 295451 - DNA, 20 bp, Artificial Sequence
  chemically synthesized
taacctaaatgcaaaataaa

SEQ ID NO: 295452 - DNA, 20 bp, Artificial Sequence
  chemically synthesized
atgcaaaataaaaggcaact

SEQ ID NO: 295453 - DNA, 20 bp, Artificial Sequence
  chemically synthesized
ttattgaatattatataact

SEQ ID NO: 295454 - DNA, 20 bp, Artificial Sequence
  chemically synthesized
agttatataatattcaataa

SEQ ID NO: 295455 - DNA, 20 bp, Artificial Sequence
  chemically synthesized
gttatataatattcaataaa

SEQ ID NO: 295456 - DNA, 20 bp, Artificial Sequence
  chemically synthesized
atataatattcaataaaagg

SEQ ID NO: 295457 - DNA, 20 bp, Artificial Sequence
  chemically synthesized
atattcaataaaaggaagaa

SEQ ID NO: 295458 - DNA, 20 bp, Artificial Sequence
  chemically synthesized
aagaaaagtaaaataatttg

SEQ ID NO: 295459 - DNA, 20 bp, Artificial Sequence
  chemically synthesized
aagtaaaataatttgaagca

SEQ ID NO: 295460 - DNA, 20 bp, Artificial Sequence
  chemically synthesized
ttgaagcaaagaatacaaca

SEQ ID NO: 295461 - DNA, 20 bp, Artificial Sequence
  chemically synthesized
tgaagcaaagaatacaacac

SEQ ID NO: 295462 - DNA, 20 bp, Artificial Sequence
  chemically synthesized
gaagcaaagaatacaacaca

SEQ ID NO: 295463 - DNA, 20 bp, Artificial Sequence
  chemically synthesized
gcaaagaatacaacacaggg

SEQ ID NO: 295464 - DNA, 20 bp, Artificial Sequence
  chemically synthesized
aagttcacaaattcctcaat

SEQ ID NO: 295465 - DNA, 20 bp, Artificial Sequence
  chemically synthesized
aggttttaatcaacttattg

SEQ ID NO: 295466 - DNA, 20 bp, Artificial Sequence
  chemically synthesized
gaggttttaatcaacttatt

SEQ ID NO: 295467 - DNA, 20 bp, Artificial Sequence
  chemically synthesized
aagttgattaaaacctcttt

SEQ ID NO: 295468 - DNA, 20 bp, Artificial Sequence
  chemically synthesized
gaggaacagaggtctgaaag

SEQ ID NO: 295469 - DNA, 20 bp, Artificial Sequence
  chemically synthesized
ggaggaacagaggtctgaaa

SEQ ID NO: 295470 - DNA, 20 bp, Artificial Sequence
  chemically synthesized
aaggaggaacagaggtctga

SEQ ID NO: 295471 - DNA, 20 bp, Artificial Sequence
  chemically synthesized
taataaagaaggaggaacag

SEQ ID NO: 295472 - DNA, 20 bp, Artificial Sequence
  chemically synthesized
ctaataaagaaggaggaaca

SEQ ID NO: 295473 - DNA, 20 bp, Artificial Sequence
  chemically synthesized
tgctaataaagaaggaggaa

SEQ ID NO: 295474 - DNA, 20 bp, Artificial Sequence
  chemically synthesized
agaggtgctaataaagaagg

SEQ ID NO: 295475 - DNA, 20 bp, Artificial Sequence
  chemically synthesized
aagaggtgctaataaagaag

SEQ ID NO: 295476 - DNA, 20 bp, Artificial Sequence
  chemically synthesized
ctctgttcctccttctttat

SEQ ID NO: 295477 - DNA, 20 bp, Artificial Sequence
  chemically synthesized
ttaagaggtgctaataaaga

SEQ ID NO: 295478 - DNA, 20 bp, Artificial Sequence
  chemically synthesized
tttaagaggtgctaataaag

SEQ ID NO: 295479 - DNA, 20 bp, Artificial Sequence
  chemically synthesized
gcttttaagaggtgctaata

SEQ ID NO: 295480 - DNA, 20 bp, Artificial Sequence
  chemically synthesized
tctttattagcacctcttaa

SEQ ID NO: 295481 - DNA, 20 bp, Artificial Sequence
  chemically synthesized
agaaagaggaggcttttaag

SEQ ID NO: 295482 - DNA, 20 bp, Artificial Sequence
  chemically synthesized
cagaaagaggaggcttttaa

SEQ ID NO: 295483 - DNA, 20 bp, Artificial Sequence
  chemically synthesized
tacagaaagaggaggctttt

SEQ ID NO: 295484 - DNA, 20 bp, Artificial Sequence
  chemically synthesized
agagaagatacagaaagagg

SEQ ID NO: 295485 - DNA, 20 bp, Artificial Sequence
  chemically synthesized
tagagaagatacagaaagag

SEQ ID NO: 295486 - DNA, 20 bp, Artificial Sequence
  chemically synthesized
gttagagaagatacagaaag

SEQ ID NO: 295487 - DNA, 20 bp, Artificial Sequence
  chemically synthesized
tgttagagaagatacagaaa

SEQ ID NO: 295488 - DNA, 20 bp, Artificial Sequence
  chemically synthesized
aatgttagagaagatacaga

SEQ ID NO: 295489 - DNA, 20 bp, Artificial Sequence
  chemically synthesized
tcataatgttagagaagata

SEQ ID NO: 295490 - DNA, 20 bp, Artificial Sequence
  chemically synthesized
ttattttcataatgttagag

SEQ ID NO: 295491 - DNA, 20 bp, Artificial Sequence
  chemically synthesized
aacttattttcataatgtta

SEQ ID NO: 295492 - DNA, 20 bp, Artificial Sequence
  chemically synthesized
ataacttattttcataatgt

SEQ ID NO: 295493 - DNA, 20 bp, Artificial Sequence
  chemically synthesized
ttctctaacattatgaaaat

SEQ ID NO: 295494 - DNA, 20 bp, Artificial Sequence
  chemically synthesized
aacattatgaaaataagtta

SEQ ID NO: 295495 - DNA, 20 bp, Artificial Sequence
  chemically synthesized
aataagttatggatctctat

SEQ ID NO: 295496 - DNA, 20 bp, Artificial Sequence
  chemically synthesized
atgtcggagtaggactgata

SEQ ID NO: 295497 - DNA, 20 bp, Artificial Sequence
  chemically synthesized
taatgtcggagtaggactga

SEQ ID NO: 295498 - DNA, 20 bp, Artificial Sequence
  chemically synthesized
attacttctaatgtcggagt

SEQ ID NO: 295499 - DNA, 20 bp, Artificial Sequence
  chemically synthesized
aattacttctaatgtcggag

SEQ ID NO: 295500 - DNA, 20 bp, Artificial Sequence
  chemically synthesized
tatcagtcctactccgacat

SEQ ID NO: 295501 - DNA, 20 bp, Artificial Sequence
  chemically synthesized
cttaattacttctaatgtcg

SEQ ID NO: 295502 - DNA, 20 bp, Artificial Sequence
  chemically synthesized
cagtcctactccgacattag

SEQ ID NO: 295503 - DNA, 20 bp, Artificial Sequence
  chemically synthesized
ttcttaattacttctaatgt

SEQ ID NO: 295504 - DNA, 20 bp, Artificial Sequence
  chemically synthesized
ctccgacattagaagtaatt

SEQ ID NO: 295505 - DNA, 20 bp, Artificial Sequence
  chemically synthesized
attatagaatgttaaatgag

SEQ ID NO: 295506 - DNA, 20 bp, Artificial Sequence
  chemically synthesized
ttcattatagaatgttaaat

SEQ ID NO: 295507 - DNA, 20 bp, Artificial Sequence
  chemically synthesized
tcatttaacattctataatg

SEQ ID NO: 295508 - DNA, 20 bp, Artificial Sequence
  chemically synthesized
caaagggtaaaacttcatta

SEQ ID NO: 295509 - DNA, 20 bp, Artificial Sequence
  chemically synthesized
taagttactcttcagtcaaa

SEQ ID NO: 295510 - DNA, 20 bp, Artificial Sequence
  chemically synthesized
gaagttttaccctttgactg

SEQ ID NO: 295511 - DNA, 20 bp, Artificial Sequence
  chemically synthesized
ataagttactcttcagtcaa

SEQ ID NO: 295512 - DNA, 20 bp, Artificial Sequence
  chemically synthesized
aataagttactcttcagtca

SEQ ID NO: 295513 - DNA, 20 bp, Artificial Sequence
  chemically synthesized
agttttaccctttgactgaa

SEQ ID NO: 295514 - DNA, 20 bp, Artificial Sequence
  chemically synthesized
tgagtgaataagttactctt

SEQ ID NO: 295515 - DNA, 20 bp, Artificial Sequence
  chemically synthesized
gaataaacatttgagtgaat

SEQ ID NO: 295516 - DNA, 20 bp, Artificial Sequence
  chemically synthesized
caacttctgaataaacattt

SEQ ID NO: 295517 - DNA, 20 bp, Artificial Sequence
  chemically synthesized
tattcactcaaatgtttatt

SEQ ID NO: 295518 - DNA, 20 bp, Artificial Sequence
  chemically synthesized
tcactcaaatgtttattcag

SEQ ID NO: 295519 - DNA, 20 bp, Artificial Sequence
  chemically synthesized
tctattaccaatatgaagga

SEQ ID NO: 295520 - DNA, 20 bp, Artificial Sequence
  chemically synthesized
agttgttctatccttcatat

SEQ ID NO: 295521 - DNA, 20 bp, Artificial Sequence
  chemically synthesized
aggatctattaccaatatga

SEQ ID NO: 295522 - DNA, 20 bp, Artificial Sequence
  chemically synthesized
taggatctattaccaatatg

SEQ ID NO: 295523 - DNA, 20 bp, Artificial Sequence
  chemically synthesized
tctatccttcatattggtaa

SEQ ID NO: 295524 - DNA, 20 bp, Artificial Sequence
  chemically synthesized
tctgcagttgcatttaagat

SEQ ID NO: 295525 - DNA, 20 bp, Artificial Sequence
  chemically synthesized
ttctgcagttgcatttaaga

SEQ ID NO: 295526 - DNA, 20 bp, Artificial Sequence
  chemically synthesized
tcagttctgcagttgcattt

SEQ ID NO: 295527 - DNA, 20 bp, Artificial Sequence
  chemically synthesized
tcctatcttaaatgcaactg

SEQ ID NO: 295528 - DNA, 20 bp, Artificial Sequence
  chemically synthesized
tgtgatttttttcagttctg

SEQ ID NO: 295529 - DNA, 20 bp, Artificial Sequence
  chemically synthesized
tatggatatgtgattttttt

SEQ ID NO: 295530 - DNA, 20 bp, Artificial Sequence
  chemically synthesized
aaaaaaatcacatatccata

SEQ ID NO: 295531 - DNA, 20 bp, Artificial Sequence
  chemically synthesized
ccaataaatgtttaactata

SEQ ID NO: 295532 - DNA, 20 bp, Artificial Sequence
  chemically synthesized
ccatatagttaaacatttat

SEQ ID NO: 295533 - DNA, 20 bp, Artificial Sequence
  chemically synthesized
acatttattggtttgtgtgt

SEQ ID NO: 295534 - DNA, 20 bp, Artificial Sequence
  chemically synthesized
catttattggtttgtgtgtt

SEQ ID NO: 295535 - DNA, 20 bp, Artificial Sequence
  chemically synthesized
attggtttgtgtgttaggca

SEQ ID NO: 295536 - DNA, 20 bp, Artificial Sequence
  chemically synthesized
ttggtttgtgtgttaggcat

SEQ ID NO: 295537 - DNA, 20 bp, Artificial Sequence
  chemically synthesized
tggtttgtgtgttaggcatg

SEQ ID NO: 295538 - DNA, 20 bp, Artificial Sequence
  chemically synthesized
atgtgtgtgtgttttgtttt

SEQ ID NO: 295539 - DNA, 20 bp, Artificial Sequence
  chemically synthesized
aacacacacacataaaacca

SEQ ID NO: 295540 - DNA, 20 bp, Artificial Sequence
  chemically synthesized
acttgaacgtgaagtggctt

SEQ ID NO: 295541 - DNA, 20 bp, Artificial Sequence
  chemically synthesized
atcaggacttgaacgtgaag

SEQ ID NO: 295542 - DNA, 20 bp, Artificial Sequence
  chemically synthesized
accaaagccacttcacgttc

SEQ ID NO: 295543 - DNA, 20 bp, Artificial Sequence
  chemically synthesized
gaaatcaggacttgaacgtg

SEQ ID NO: 295544 - DNA, 20 bp, Artificial Sequence
  chemically synthesized
cacgttcaagtcctgatttc

SEQ ID NO: 295545 - DNA, 20 bp, Artificial Sequence
  chemically synthesized
attgttggtttctagaaatc

SEQ ID NO: 295546 - DNA, 20 bp, Artificial Sequence
  chemically synthesized
cattgttggtttctagaaat

SEQ ID NO: 295547 - DNA, 20 bp, Artificial Sequence
  chemically synthesized
tcaattccattgttggtttc

SEQ ID NO: 295548 - DNA, 20 bp, Artificial Sequence
  chemically synthesized
tgatttctagaaaccaacaa

SEQ ID NO: 295549 - DNA, 20 bp, Artificial Sequence
  chemically synthesized
tttcatttcaattccattgt

SEQ ID NO: 295550 - DNA, 20 bp, Artificial Sequence
  chemically synthesized
caatggaattgaaatgaaaa

SEQ ID NO: 295551 - DNA, 20 bp, Artificial Sequence
  chemically synthesized
ggaattgaaatgaaaatggc

SEQ ID NO: 295552 - DNA, 20 bp, Artificial Sequence
  chemically synthesized
aaatgaaaatggctagaaat

SEQ ID NO: 295553 - DNA, 20 bp, Artificial Sequence
  chemically synthesized
tacttgcacaaactaatttc

SEQ ID NO: 295554 - DNA, 20 bp, Artificial Sequence
  chemically synthesized
ggctagaaattagtttgtgc

SEQ ID NO: 295555 - DNA, 20 bp, Artificial Sequence
  chemically synthesized
ttgtgcaagtaaacaaaaat

SEQ ID NO: 295556 - DNA, 20 bp, Artificial Sequence
  chemically synthesized
aaacaaaaattagatcattg

SEQ ID NO: 295557 - DNA, 20 bp, Artificial Sequence
  chemically synthesized
aacaaaaattagatcattgt

SEQ ID NO: 295558 - DNA, 20 bp, Artificial Sequence
  chemically synthesized
attagatcattgtaggcttt

SEQ ID NO: 295559 - DNA, 20 bp, Artificial Sequence
  chemically synthesized
tagatcattgtaggctttaa

SEQ ID NO: 295560 - DNA, 20 bp, Artificial Sequence
  chemically synthesized
agatcattgtaggctttaag

SEQ ID NO: 295561 - DNA, 20 bp, Artificial Sequence
  chemically synthesized
gatcattgtaggctttaaga

SEQ ID NO: 295562 - DNA, 20 bp, Artificial Sequence
  chemically synthesized
gtcttcatattgccctctta

SEQ ID NO: 295563 - DNA, 20 bp, Artificial Sequence
  chemically synthesized
ggctttaagagggcaatatg

SEQ ID NO: 295564 - DNA, 20 bp, Artificial Sequence
  chemically synthesized
aagagggcaatatgaagaca

SEQ ID NO: 295565 - DNA, 20 bp, Artificial Sequence
  chemically synthesized
ttgtctgaagagtgttgaca

SEQ ID NO: 295566 - DNA, 20 bp, Artificial Sequence
  chemically synthesized
tggactttgtcaacactctt

SEQ ID NO: 295567 - DNA, 20 bp, Artificial Sequence
  chemically synthesized
tccagtggtctttgtctgaa

SEQ ID NO: 295568 - DNA, 20 bp, Artificial Sequence
  chemically synthesized
ttgtcaacactcttcagaca

SEQ ID NO: 295569 - DNA, 20 bp, Artificial Sequence
  chemically synthesized
gttccagtggtctttgtctg

SEQ ID NO: 295570 - DNA, 20 bp, Artificial Sequence
  chemically synthesized
actcttcagacaaagaccac

SEQ ID NO: 295571 - DNA, 20 bp, Artificial Sequence
  chemically synthesized
aacctacaaatatgttccag

SEQ ID NO: 295572 - DNA, 20 bp, Artificial Sequence
  chemically synthesized
gataacctacaaatatgttc

SEQ ID NO: 295573 - DNA, 20 bp, Artificial Sequence
  chemically synthesized
agaccactggaacatatttg

SEQ ID NO: 295574 - DNA, 20 bp, Artificial Sequence
  chemically synthesized
gaccactggaacatatttgt

SEQ ID NO: 295575 - DNA, 20 bp, Artificial Sequence
  chemically synthesized
aacatatttgtaggttatca

SEQ ID NO: 295576 - DNA, 20 bp, Artificial Sequence
  chemically synthesized
ctcgttgcagcgtgtaaatc

SEQ ID NO: 295577 - DNA, 20 bp, Artificial Sequence
  chemically synthesized
tctcgttgcagcgtgtaaat

SEQ ID NO: 295578 - DNA, 20 bp, Artificial Sequence
  chemically synthesized
cctgatttacacgctgcaac

SEQ ID NO: 295579 - DNA, 20 bp, Artificial Sequence
  chemically synthesized
tgatttacacgctgcaacga

SEQ ID NO: 295580 - DNA, 20 bp, Artificial Sequence
  chemically synthesized
atgcgctgtctctctcgttg

SEQ ID NO: 295581 - DNA, 20 bp, Artificial Sequence
  chemically synthesized
atttacacgctgcaacgaga

SEQ ID NO: 295582 - DNA, 20 bp, Artificial Sequence
  chemically synthesized
acacgctgcaacgagagaga

SEQ ID NO: 295583 - DNA, 20 bp, Artificial Sequence
  chemically synthesized
acgagagagacagcgcatca

SEQ ID NO: 295584 - DNA, 20 bp, Artificial Sequence
  chemically synthesized
cgagagagacagcgcatcac

SEQ ID NO: 295585 - DNA, 20 bp, Artificial Sequence
  chemically synthesized
gagagagacagcgcatcaca

SEQ ID NO: 295586 - DNA, 20 bp, Artificial Sequence
  chemically synthesized
cagcgcatcacagggaacta

SEQ ID NO: 295587 - DNA, 20 bp, Artificial Sequence
  chemically synthesized
agcgcatcacagggaactat

SEQ ID NO: 295588 - DNA, 20 bp, Artificial Sequence
  chemically synthesized
gcgcatcacagggaactatg

SEQ ID NO: 295589 - DNA, 20 bp, Artificial Sequence
  chemically synthesized
tactcttagagacagcccca

SEQ ID NO: 295590 - DNA, 20 bp, Artificial Sequence
  chemically synthesized
ggaactatggggctgtctct

SEQ ID NO: 295591 - DNA, 20 bp, Artificial Sequence
  chemically synthesized
aactatggggctgtctctaa

SEQ ID NO: 295592 - DNA, 20 bp, Artificial Sequence
  chemically synthesized
ttctaacatactcttagaga

SEQ ID NO: 295593 - DNA, 20 bp, Artificial Sequence
  chemically synthesized
ctttttctaacatactctta

SEQ ID NO: 295594 - DNA, 20 bp, Artificial Sequence
  chemically synthesized
agctttttctaacatactct

SEQ ID NO: 295595 - DNA, 20 bp, Artificial Sequence
  chemically synthesized
ggctgtctctaagagtatgt

SEQ ID NO: 295596 - DNA, 20 bp, Artificial Sequence
  chemically synthesized
ctctaagagtatgttagaaa

SEQ ID NO: 295597 - DNA, 20 bp, Artificial Sequence
  chemically synthesized
tgttagaaaaagcttatttt

SEQ ID NO: 295598 - DNA, 20 bp, Artificial Sequence
  chemically synthesized
acaagcccacatcttaaaat

SEQ ID NO: 295599 - DNA, 20 bp, Artificial Sequence
  chemically synthesized
aaaaagcttattttaagatg

SEQ ID NO: 295600 - DNA, 20 bp, Artificial Sequence
  chemically synthesized
aaaagcttattttaagatgt

SEQ ID NO: 295601 - DNA, 20 bp, Artificial Sequence
  chemically synthesized
tgccccctatcatgtaacac

SEQ ID NO: 295602 - DNA, 20 bp, Artificial Sequence
  chemically synthesized
tgtgggcttgtgttacatga

SEQ ID NO: 295603 - DNA, 20 bp, Artificial Sequence
  chemically synthesized
gtgggcttgtgttacatgat

SEQ ID NO: 295604 - DNA, 20 bp, Artificial Sequence
  chemically synthesized
tgggcttgtgttacatgata

SEQ ID NO: 295605 - DNA, 20 bp, Artificial Sequence
  chemically synthesized
gggcttgtgttacatgatag

SEQ ID NO: 295606 - DNA, 20 bp, Artificial Sequence
  chemically synthesized
ggcttgtgttacatgatagg

SEQ ID NO: 295607 - DNA, 20 bp, Artificial Sequence
  chemically synthesized
gttacatgatagggggcatc

SEQ ID NO: 295608 - DNA, 20 bp, Artificial Sequence
  chemically synthesized
ttacatgatagggggcatca

SEQ ID NO: 295609 - DNA, 20 bp, Artificial Sequence
  chemically synthesized
catgatagggggcatcaagg

SEQ ID NO: 295610 - DNA, 20 bp, Artificial Sequence
  chemically synthesized
gatagggggcatcaaggaag

SEQ ID NO: 295611 - DNA, 20 bp, Artificial Sequence
  chemically synthesized
atagggggcatcaaggaagt

SEQ ID NO: 295612 - DNA, 20 bp, Artificial Sequence
  chemically synthesized
tagggggcatcaaggaagtg

SEQ ID NO: 295613 - DNA, 20 bp, Artificial Sequence
  chemically synthesized
tacaacatccaatcaaaaca

SEQ ID NO: 295614 - DNA, 20 bp, Artificial Sequence
  chemically synthesized
aagtggggctttgttttgat

SEQ ID NO: 295615 - DNA, 20 bp, Artificial Sequence
  chemically synthesized
ttgttttgattggatgttgt

SEQ ID NO: 295616 - DNA, 20 bp, Artificial Sequence
  chemically synthesized
tgttttgattggatgttgta

SEQ ID NO: 295617 - DNA, 20 bp, Artificial Sequence
  chemically synthesized
tttgattggatgttgtaagg

SEQ ID NO: 295618 - DNA, 20 bp, Artificial Sequence
  chemically synthesized
gattggatgttgtaaggaag

SEQ ID NO: 295619 - DNA, 20 bp, Artificial Sequence
  chemically synthesized
attggatgttgtaaggaagt

SEQ ID NO: 295620 - DNA, 20 bp, Artificial Sequence
  chemically synthesized
ttggatgttgtaaggaagta

SEQ ID NO: 295621 - DNA, 20 bp, Artificial Sequence
  chemically synthesized
aagtagggtaattctatgtt

SEQ ID NO: 295622 - DNA, 20 bp, Artificial Sequence
  chemically synthesized
aaattttaggacactcaaca

SEQ ID NO: 295623 - DNA, 20 bp, Artificial Sequence
  chemically synthesized
gccatctagataaaaatttt

SEQ ID NO: 295624 - DNA, 20 bp, Artificial Sequence
  chemically synthesized
tgccatctagataaaaattt

SEQ ID NO: 295625 - DNA, 20 bp, Artificial Sequence
  chemically synthesized
agtgtcctaaaatttttatc

SEQ ID NO: 295626 - DNA, 20 bp, Artificial Sequence
  chemically synthesized
tcctaaaatttttatctaga

SEQ ID NO: 295627 - DNA, 20 bp, Artificial Sequence
  chemically synthesized
taaaatttttatctagatgg

SEQ ID NO: 295628 - DNA, 20 bp, Artificial Sequence
  chemically synthesized
aaaatttttatctagatggc

SEQ ID NO: 295629 - DNA, 20 bp, Artificial Sequence
  chemically synthesized
tctgcattcctcctgccatc

SEQ ID NO: 295630 - DNA, 20 bp, Artificial Sequence
  chemically synthesized
aatttttatctagatggcag

SEQ ID NO: 295631 - DNA, 20 bp, Artificial Sequence
  chemically synthesized
atttttatctagatggcagg

SEQ ID NO: 295632 - DNA, 20 bp, Artificial Sequence
  chemically synthesized
tctagatggcaggaggaatg

SEQ ID NO: 295633 - DNA, 20 bp, Artificial Sequence
  chemically synthesized
tagatggcaggaggaatgca

SEQ ID NO: 295634 - DNA, 20 bp, Artificial Sequence
  chemically synthesized
gatggcaggaggaatgcaga

SEQ ID NO: 295635 - DNA, 20 bp, Artificial Sequence
  chemically synthesized
atggcaggaggaatgcagag

SEQ ID NO: 295636 - DNA, 20 bp, Artificial Sequence
  chemically synthesized
ggaggaatgcagagaggcta

SEQ ID NO: 295637 - DNA, 20 bp, Artificial Sequence
  chemically synthesized
ttctttactaaacacagctt

SEQ ID NO: 295638 - DNA, 20 bp, Artificial Sequence
  chemically synthesized
agagaggctaaagctgtgtt

SEQ ID NO: 295639 - DNA, 20 bp, Artificial Sequence
  chemically synthesized
ttatgcttctttactaaaca

SEQ ID NO: 295640 - DNA, 20 bp, Artificial Sequence
  chemically synthesized
ggctaaagctgtgtttagta

SEQ ID NO: 295641 - DNA, 20 bp, Artificial Sequence
  chemically synthesized
taaagctgtgtttagtaaag

SEQ ID NO: 295642 - DNA, 20 bp, Artificial Sequence
  chemically synthesized
cataatgtgtcacattaatg

SEQ ID NO: 295643 - DNA, 20 bp, Artificial Sequence
  chemically synthesized
tgtgtcacattaatgaagat

SEQ ID NO: 295644 - DNA, 20 bp, Artificial Sequence
  chemically synthesized
gtgtcacattaatgaagatg

SEQ ID NO: 295645 - DNA, 20 bp, Artificial Sequence
  chemically synthesized
tgtcacattaatgaagatga

SEQ ID NO: 295646 - DNA, 20 bp, Artificial Sequence
  chemically synthesized
taatgaagatgagggatatt

SEQ ID NO: 295647 - DNA, 20 bp, Artificial Sequence
  chemically synthesized
gatgagggatatttggtcat

SEQ ID NO: 295648 - DNA, 20 bp, Artificial Sequence
  chemically synthesized
atgagggatatttggtcatt

SEQ ID NO: 295649 - DNA, 20 bp, Artificial Sequence
  chemically synthesized
ggatatttggtcattaggcg

SEQ ID NO: 295650 - DNA, 20 bp, Artificial Sequence
  chemically synthesized
tttggtcattaggcgtggtt

SEQ ID NO: 295651 - DNA, 20 bp, Artificial Sequence
  chemically synthesized
cttaatacagtaaaaaagaa

SEQ ID NO: 295652 - DNA, 20 bp, Artificial Sequence
  chemically synthesized
catatcttaatacagtaaaa

SEQ ID NO: 295653 - DNA, 20 bp, Artificial Sequence
  chemically synthesized
ctattcttttttactgtatt

SEQ ID NO: 295654 - DNA, 20 bp, Artificial Sequence
  chemically synthesized
tttgtaatcatatcttaata

SEQ ID NO: 295655 - DNA, 20 bp, Artificial Sequence
  chemically synthesized
tgtattaagatatgattaca

SEQ ID NO: 295656 - DNA, 20 bp, Artificial Sequence
  chemically synthesized
attaagatatgattacaaag

SEQ ID NO: 295657 - DNA, 20 bp, Artificial Sequence
  chemically synthesized
tgatgaatcaagataaaagc

SEQ ID NO: 295658 - DNA, 20 bp, Artificial Sequence
  chemically synthesized
gttgtgatgaatcaagataa

SEQ ID NO: 295659 - DNA, 20 bp, Artificial Sequence
  chemically synthesized
cgctatggttgtgatgaatc

SEQ ID NO: 295660 - DNA, 20 bp, Artificial Sequence
  chemically synthesized
atcttgattcatcacaacca

SEQ ID NO: 295661 - DNA, 20 bp, Artificial Sequence
  chemically synthesized
catcatacagggacacgcta

SEQ ID NO: 295662 - DNA, 20 bp, Artificial Sequence
  chemically synthesized
agggatgccagcatcataca

SEQ ID NO: 295663 - DNA, 20 bp, Artificial Sequence
  chemically synthesized
tagggatgccagcatcatac

SEQ ID NO: 295664 - DNA, 20 bp, Artificial Sequence
  chemically synthesized
ctagggatgccagcatcata

SEQ ID NO: 295665 - DNA, 20 bp, Artificial Sequence
  chemically synthesized
agcgtgtccctgtatgatgc

SEQ ID NO: 295666 - DNA, 20 bp, Artificial Sequence
  chemically synthesized
ctgtatgatgctggcatccc

SEQ ID NO: 295667 - DNA, 20 bp, Artificial Sequence
  chemically synthesized
taaataattgctagggatgc

SEQ ID NO: 295668 - DNA, 20 bp, Artificial Sequence
  chemically synthesized
ttgaatataaataattgcta

SEQ ID NO: 295669 - DNA, 20 bp, Artificial Sequence
  chemically synthesized
gttgaatataaataattgct

SEQ ID NO: 295670 - DNA, 20 bp, Artificial Sequence
  chemically synthesized
ggttgaatataaataattgc

SEQ ID NO: 295671 - DNA, 20 bp, Artificial Sequence
  chemically synthesized
agcaattatttatattcaac

SEQ ID NO: 295672 - DNA, 20 bp, Artificial Sequence
  chemically synthesized
caattatttatattcaacca

SEQ ID NO: 295673 - DNA, 20 bp, Artificial Sequence
  chemically synthesized
gcagccagtctgatgttctc

SEQ ID NO: 295674 - DNA, 20 bp, Artificial Sequence
  chemically synthesized
tatattcaaccagagaacat

SEQ ID NO: 295675 - DNA, 20 bp, Artificial Sequence
  chemically synthesized
tcaaccagagaacatcagac

SEQ ID NO: 295676 - DNA, 20 bp, Artificial Sequence
  chemically synthesized
gagaacatcagactggctgc

SEQ ID NO: 295677 - DNA, 20 bp, Artificial Sequence
  chemically synthesized
gttgccttggtacttgcagc

SEQ ID NO: 295678 - DNA, 20 bp, Artificial Sequence
  chemically synthesized
agatgttgccttggtacttg

SEQ ID NO: 295679 - DNA, 20 bp, Artificial Sequence
  chemically synthesized
tcagactggctgcaagtacc

SEQ ID NO: 295680 - DNA, 20 bp, Artificial Sequence
  chemically synthesized
cagactggctgcaagtacca

SEQ ID NO: 295681 - DNA, 20 bp, Artificial Sequence
  chemically synthesized
ggaactgctagatgttgcct

SEQ ID NO: 295682 - DNA, 20 bp, Artificial Sequence
  chemically synthesized
gcaagtaccaaggcaacatc

SEQ ID NO: 295683 - DNA, 20 bp, Artificial Sequence
  chemically synthesized
agtaccaaggcaacatctag

SEQ ID NO: 295684 - DNA, 20 bp, Artificial Sequence
  chemically synthesized
cagttaggctttggaactgc

SEQ ID NO: 295685 - DNA, 20 bp, Artificial Sequence
  chemically synthesized
ggcaacatctagcagttcca

SEQ ID NO: 295686 - DNA, 20 bp, Artificial Sequence
  chemically synthesized
ttggcacttcagttaggctt

SEQ ID NO: 295687 - DNA, 20 bp, Artificial Sequence
  chemically synthesized
gcagttccaaagcctaactg

SEQ ID NO: 295688 - DNA, 20 bp, Artificial Sequence
  chemically synthesized
gctggcttggcacttcagtt

SEQ ID NO: 295689 - DNA, 20 bp, Artificial Sequence
  chemically synthesized
agctggcttggcacttcagt

SEQ ID NO: 295690 - DNA, 20 bp, Artificial Sequence
  chemically synthesized
caaagcctaactgaagtgcc

SEQ ID NO: 295691 - DNA, 20 bp, Artificial Sequence
  chemically synthesized
caggagctggcttggcactt

SEQ ID NO: 295692 - DNA, 20 bp, Artificial Sequence
  chemically synthesized
gcctaactgaagtgccaagc

SEQ ID NO: 295693 - DNA, 20 bp, Artificial Sequence
  chemically synthesized
ctgatagccaggagctggct

SEQ ID NO: 295694 - DNA, 20 bp, Artificial Sequence
  chemically synthesized
tgaagtgccaagccagctcc

SEQ ID NO: 295695 - DNA, 20 bp, Artificial Sequence
  chemically synthesized
agctactgatagccaggagc

SEQ ID NO: 295696 - DNA, 20 bp, Artificial Sequence
  chemically synthesized
aatcagctactgatagccag

SEQ ID NO: 295697 - DNA, 20 bp, Artificial Sequence
  chemically synthesized
ccaagccagctcctggctat

SEQ ID NO: 295698 - DNA, 20 bp, Artificial Sequence
  chemically synthesized
aaaatcagctactgatagcc

SEQ ID NO: 295699 - DNA, 20 bp, Artificial Sequence
  chemically synthesized
taaaatcagctactgatagc

SEQ ID NO: 295700 - DNA, 20 bp, Artificial Sequence
  chemically synthesized
agccagctcctggctatcag

SEQ ID NO: 295701 - DNA, 20 bp, Artificial Sequence
  chemically synthesized
aagataaaatcagctactga

SEQ ID NO: 295702 - DNA, 20 bp, Artificial Sequence
  chemically synthesized
tcatttgagaaagataaaat

SEQ ID NO: 295703 - DNA, 20 bp, Artificial Sequence
  chemically synthesized
gtgtttataatcatttgaga

SEQ ID NO: 295704 - DNA, 20 bp, Artificial Sequence
  chemically synthesized
gtctgtgtttataatcattt

SEQ ID NO: 295705 - DNA, 20 bp, Artificial Sequence
  chemically synthesized
ttctcaaatgattataaaca

SEQ ID NO: 295706 - DNA, 20 bp, Artificial Sequence
  chemically synthesized
attataaacacagacataac

SEQ ID NO: 295707 - DNA, 20 bp, Artificial Sequence
  chemically synthesized
agacataacaagatcatact

SEQ ID NO: 295708 - DNA, 20 bp, Artificial Sequence
  chemically synthesized
gacataacaagatcatactg

SEQ ID NO: 295709 - DNA, 20 bp, Artificial Sequence
  chemically synthesized
aagcgaacatattaaaacct

SEQ ID NO: 295710 - DNA, 20 bp, Artificial Sequence
  chemically synthesized
aggttttaatatgttcgctt

SEQ ID NO: 295711 - DNA, 20 bp, Artificial Sequence
  chemically synthesized
ttttaatatgttcgctttgg

SEQ ID NO: 295712 - DNA, 20 bp, Artificial Sequence
  chemically synthesized
ttaatatgttcgctttggca

SEQ ID NO: 295713 - DNA, 20 bp, Artificial Sequence
  chemically synthesized
taatatgttcgctttggcag

SEQ ID NO: 295714 - DNA, 20 bp, Artificial Sequence
  chemically synthesized
tttccacatcacctctgcca

SEQ ID NO: 295715 - DNA, 20 bp, Artificial Sequence
  chemically synthesized
tcgctttggcagaggtgatg

SEQ ID NO: 295716 - DNA, 20 bp, Artificial Sequence
  chemically synthesized
aggtgatgtggaaacttcta

SEQ ID NO: 295717 - DNA, 20 bp, Artificial Sequence
  chemically synthesized
ggtgatgtggaaacttctaa

SEQ ID NO: 295718 - DNA, 20 bp, Artificial Sequence
  chemically synthesized
ctaatgttatattcctttag

SEQ ID NO: 295719 - DNA, 20 bp, Artificial Sequence
  chemically synthesized
ctactaatgttatattcctt

SEQ ID NO: 295720 - DNA, 20 bp, Artificial Sequence
  chemically synthesized
cttctaaaggaatataacat

SEQ ID NO: 295721 - DNA, 20 bp, Artificial Sequence
  chemically synthesized
ctaaaggaatataacattag

SEQ ID NO: 295722 - DNA, 20 bp, Artificial Sequence
  chemically synthesized
aaggaatataacattagtag

SEQ ID NO: 295723 - DNA, 20 bp, Artificial Sequence
  chemically synthesized
aggaatataacattagtagc

SEQ ID NO: 295724 - DNA, 20 bp, Artificial Sequence
  chemically synthesized
ggaatataacattagtagca

SEQ ID NO: 295725 - DNA, 20 bp, Artificial Sequence
  chemically synthesized
atataacattagtagcaggg

SEQ ID NO: 295726 - DNA, 20 bp, Artificial Sequence
  chemically synthesized
acattagtagcagggaagac

SEQ ID NO: 295727 - DNA, 20 bp, Artificial Sequence
  chemically synthesized
gtagcagggaagaccagcta

SEQ ID NO: 295728 - DNA, 20 bp, Artificial Sequence
  chemically synthesized
tagcagggaagaccagctac

SEQ ID NO: 295729 - DNA, 20 bp, Artificial Sequence
  chemically synthesized
taagatgacaatcctgtagc

SEQ ID NO: 295730 - DNA, 20 bp, Artificial Sequence
  chemically synthesized
tatttaagatgacaatcctg

SEQ ID NO: 295731 - DNA, 20 bp, Artificial Sequence
  chemically synthesized
tacaggattgtcatcttaaa

SEQ ID NO: 295732 - DNA, 20 bp, Artificial Sequence
  chemically synthesized
aggattgtcatcttaaatag

SEQ ID NO: 295733 - DNA, 20 bp, Artificial Sequence
  chemically synthesized
atcatggcttacttctattt

SEQ ID NO: 295734 - DNA, 20 bp, Artificial Sequence
  chemically synthesized
ttgtcatcttaaatagaagt

SEQ ID NO: 295735 - DNA, 20 bp, Artificial Sequence
  chemically synthesized
atagaagtaagccatgatat

SEQ ID NO: 295736 - DNA, 20 bp, Artificial Sequence
  chemically synthesized
cctgattaaagctaatatca

SEQ ID NO: 295737 - DNA, 20 bp, Artificial Sequence
  chemically synthesized
gccatgatattagctttaat

SEQ ID NO: 295738 - DNA, 20 bp, Artificial Sequence
  chemically synthesized
ccatgatattagctttaatc

SEQ ID NO: 295739 - DNA, 20 bp, Artificial Sequence
  chemically synthesized
catgatattagctttaatca

SEQ ID NO: 295740 - DNA, 20 bp, Artificial Sequence
  chemically synthesized
catcaccaaaaccctgatta

SEQ ID NO: 295741 - DNA, 20 bp, Artificial Sequence
  chemically synthesized
attagctttaatcagggttt

SEQ ID NO: 295742 - DNA, 20 bp, Artificial Sequence
  chemically synthesized
tttaatcagggttttggtga

SEQ ID NO: 295743 - DNA, 20 bp, Artificial Sequence
  chemically synthesized
ttaatcagggttttggtgat

SEQ ID NO: 295744 - DNA, 20 bp, Artificial Sequence
  chemically synthesized
cagggttttggtgatgggaa

SEQ ID NO: 295745 - DNA, 20 bp, Artificial Sequence
  chemically synthesized
gggttttggtgatgggaata

SEQ ID NO: 295746 - DNA, 20 bp, Artificial Sequence
  chemically synthesized
gttttggtgatgggaataga

SEQ ID NO: 295747 - DNA, 20 bp, Artificial Sequence
  chemically synthesized
gtgatgggaatagagagaac

SEQ ID NO: 295748 - DNA, 20 bp, Artificial Sequence
  chemically synthesized
taacagctcttgaaaatgtc

SEQ ID NO: 295749 - DNA, 20 bp, Artificial Sequence
  chemically synthesized
agagagaactggacattttc

SEQ ID NO: 295750 - DNA, 20 bp, Artificial Sequence
  chemically synthesized
agagaactggacattttcaa

SEQ ID NO: 295751 - DNA, 20 bp, Artificial Sequence
  chemically synthesized
ggacattttcaagagctgtt

SEQ ID NO: 295752 - DNA, 20 bp, Artificial Sequence
  chemically synthesized
gacattttcaagagctgtta

SEQ ID NO: 295753 - DNA, 20 bp, Artificial Sequence
  chemically synthesized
acattttcaagagctgttaa

SEQ ID NO: 295754 - DNA, 20 bp, Artificial Sequence
  chemically synthesized
attttcaagagctgttaagg

SEQ ID NO: 295755 - DNA, 20 bp, Artificial Sequence
  chemically synthesized
aattaatcctgctcccttaa

SEQ ID NO: 295756 - DNA, 20 bp, Artificial Sequence
  chemically synthesized
ttcaagagctgttaagggag

SEQ ID NO: 295757 - DNA, 20 bp, Artificial Sequence
  chemically synthesized
tcaagagctgttaagggagc

SEQ ID NO: 295758 - DNA, 20 bp, Artificial Sequence
  chemically synthesized
aggattaattgaacctgtca

SEQ ID NO: 295759 - DNA, 20 bp, Artificial Sequence
  chemically synthesized
tcacaagtccaatctttgac

SEQ ID NO: 295760 - DNA, 20 bp, Artificial Sequence
  chemically synthesized
ttcacaagtccaatctttga

SEQ ID NO: 295761 - DNA, 20 bp, Artificial Sequence
  chemically synthesized
taattgaacctgtcaaagat

SEQ ID NO: 295762 - DNA, 20 bp, Artificial Sequence
  chemically synthesized
tcaaagattggacttgtgaa

SEQ ID NO: 295763 - DNA, 20 bp, Artificial Sequence
  chemically synthesized
atttttcttctaccattcac

SEQ ID NO: 295764 - DNA, 20 bp, Artificial Sequence
  chemically synthesized
aagattggacttgtgaatgg

SEQ ID NO: 295765 - DNA, 20 bp, Artificial Sequence
  chemically synthesized
attggacttgtgaatggtag

SEQ ID NO: 295766 - DNA, 20 bp, Artificial Sequence
  chemically synthesized
tgaatggtagaagaaaaatc

SEQ ID NO: 295767 - DNA, 20 bp, Artificial Sequence
  chemically synthesized
gaatggtagaagaaaaatct

SEQ ID NO: 295768 - DNA, 20 bp, Artificial Sequence
  chemically synthesized
gaagaaaaatctaggtgacc

SEQ ID NO: 295769 - DNA, 20 bp, Artificial Sequence
  chemically synthesized
tgaaagtgaactgggtcacc

SEQ ID NO: 295770 - DNA, 20 bp, Artificial Sequence
  chemically synthesized
cagaaacctgaaagtgaact

SEQ ID NO: 295771 - DNA, 20 bp, Artificial Sequence
  chemically synthesized
ccagaaacctgaaagtgaac

SEQ ID NO: 295772 - DNA, 20 bp, Artificial Sequence
  chemically synthesized
taggtgacccagttcacttt

SEQ ID NO: 295773 - DNA, 20 bp, Artificial Sequence
  chemically synthesized
aggtgacccagttcactttc

SEQ ID NO: 295774 - DNA, 20 bp, Artificial Sequence
  chemically synthesized
agcctaatccagaaacctga

SEQ ID NO: 295775 - DNA, 20 bp, Artificial Sequence
  chemically synthesized
ccagttcactttcaggtttc

SEQ ID NO: 295776 - DNA, 20 bp, Artificial Sequence
  chemically synthesized
tcactttcaggtttctggat

SEQ ID NO: 295777 - DNA, 20 bp, Artificial Sequence
  chemically synthesized
cactttcaggtttctggatt

SEQ ID NO: 295778 - DNA, 20 bp, Artificial Sequence
  chemically synthesized
accctgcaaacagcctaatc

SEQ ID NO: 295779 - DNA, 20 bp, Artificial Sequence
  chemically synthesized
tttctggattaggctgtttg

SEQ ID NO: 295780 - DNA, 20 bp, Artificial Sequence
  chemically synthesized
ttctggattaggctgtttgc

SEQ ID NO: 295781 - DNA, 20 bp, Artificial Sequence
  chemically synthesized
tctggattaggctgtttgca

SEQ ID NO: 295782 - DNA, 20 bp, Artificial Sequence
  chemically synthesized
ccttcctttcaccctgcaaa

SEQ ID NO: 295783 - DNA, 20 bp, Artificial Sequence
  chemically synthesized
ttaggctgtttgcagggtga

SEQ ID NO: 295784 - DNA, 20 bp, Artificial Sequence
  chemically synthesized
taggctgtttgcagggtgaa

SEQ ID NO: 295785 - DNA, 20 bp, Artificial Sequence
  chemically synthesized
gctgtttgcagggtgaaagg

SEQ ID NO: 295786 - DNA, 20 bp, Artificial Sequence
  chemically synthesized
ctgtttgcagggtgaaagga

SEQ ID NO: 295787 - DNA, 20 bp, Artificial Sequence
  chemically synthesized
gtttgcagggtgaaaggaag

SEQ ID NO: 295788 - DNA, 20 bp, Artificial Sequence
  chemically synthesized
gcagggtgaaaggaaggaga

SEQ ID NO: 295789 - DNA, 20 bp, Artificial Sequence
  chemically synthesized
gaaaggaaggagaaagaata

SEQ ID NO: 295790 - DNA, 20 bp, Artificial Sequence
  chemically synthesized
aaaggaaggagaaagaataa

SEQ ID NO: 295791 - DNA, 20 bp, Artificial Sequence
  chemically synthesized
aggaaggagaaagaataaag

SEQ ID NO: 295792 - DNA, 20 bp, Artificial Sequence
  chemically synthesized
ggaaggagaaagaataaagg

SEQ ID NO: 295793 - DNA, 20 bp, Artificial Sequence
  chemically synthesized
gagaaagaataaaggaggtc

SEQ ID NO: 295794 - DNA, 20 bp, Artificial Sequence
  chemically synthesized
agaaagaataaaggaggtct

SEQ ID NO: 295795 - DNA, 20 bp, Artificial Sequence
  chemically synthesized
gaaagaataaaggaggtctg

SEQ ID NO: 295796 - DNA, 20 bp, Artificial Sequence
  chemically synthesized
cttaaatctcattatttccc

SEQ ID NO: 295797 - DNA, 20 bp, Artificial Sequence
  chemically synthesized
aggaggtctggggaaataat

SEQ ID NO: 295798 - DNA, 20 bp, Artificial Sequence
  chemically synthesized
ctggggaaataatgagattt

SEQ ID NO: 295799 - DNA, 20 bp, Artificial Sequence
  chemically synthesized
aataatgagatttaagatat

SEQ ID NO: 295800 - DNA, 20 bp, Artificial Sequence
  chemically synthesized
ataatgagatttaagatatc

SEQ ID NO: 295801 - DNA, 20 bp, Artificial Sequence
  chemically synthesized
catcaattaaaattgtctat

SEQ ID NO: 295802 - DNA, 20 bp, Artificial Sequence
  chemically synthesized
atcaattaaaattgtctatt

SEQ ID NO: 295803 - DNA, 20 bp, Artificial Sequence
  chemically synthesized
aattaaaattgtctattagg

SEQ ID NO: 295804 - DNA, 20 bp, Artificial Sequence
  chemically synthesized
tgatatatctgactgcctaa

SEQ ID NO: 295805 - DNA, 20 bp, Artificial Sequence
  chemically synthesized
aaaattgtctattaggcagt

SEQ ID NO: 295806 - DNA, 20 bp, Artificial Sequence
  chemically synthesized
ggcagtcagatatatcaccc

SEQ ID NO: 295807 - DNA, 20 bp, Artificial Sequence
  chemically synthesized
gcagtcagatatatcaccct

SEQ ID NO: 295808 - DNA, 20 bp, Artificial Sequence
  chemically synthesized
catctctttcttaaaaccca

SEQ ID NO: 295809 - DNA, 20 bp, Artificial Sequence
  chemically synthesized
gatatatcaccctgggtttt

SEQ ID NO: 295810 - DNA, 20 bp, Artificial Sequence
  chemically synthesized
tcatctctttcttaaaaccc

SEQ ID NO: 295811 - DNA, 20 bp, Artificial Sequence
  chemically synthesized
ctcatctctttcttaaaacc

SEQ ID NO: 295812 - DNA, 20 bp, Artificial Sequence
  chemically synthesized
tatcaccctgggttttaaga

SEQ ID NO: 295813 - DNA, 20 bp, Artificial Sequence
  chemically synthesized
tcaccctgggttttaagaaa

SEQ ID NO: 295814 - DNA, 20 bp, Artificial Sequence
  chemically synthesized
ctgggttttaagaaagagat

SEQ ID NO: 295815 - DNA, 20 bp, Artificial Sequence
  chemically synthesized
tttaagaaagagatgagcta

SEQ ID NO: 295816 - DNA, 20 bp, Artificial Sequence
  chemically synthesized
ccttctcccatatgtatctt

SEQ ID NO: 295817 - DNA, 20 bp, Artificial Sequence
  chemically synthesized
agatgagctaaagatacata

SEQ ID NO: 295818 - DNA, 20 bp, Artificial Sequence
  chemically synthesized
gatgagctaaagatacatat

SEQ ID NO: 295819 - DNA, 20 bp, Artificial Sequence
  chemically synthesized
tgagctaaagatacatatgg

SEQ ID NO: 295820 - DNA, 20 bp, Artificial Sequence
  chemically synthesized
gctaaagatacatatgggag

SEQ ID NO: 295821 - DNA, 20 bp, Artificial Sequence
  chemically synthesized
ctaaagatacatatgggaga

SEQ ID NO: 295822 - DNA, 20 bp, Artificial Sequence
  chemically synthesized
taaagatacatatgggagaa

SEQ ID NO: 295823 - DNA, 20 bp, Artificial Sequence
  chemically synthesized
gagaagggttcatttgaaaa

SEQ ID NO: 295824 - DNA, 20 bp, Artificial Sequence
  chemically synthesized
gaaaatagacactatttgaa

SEQ ID NO: 295825 - DNA, 20 bp, Artificial Sequence
  chemically synthesized
aaaatagacactatttgaat

SEQ ID NO: 295826 - DNA, 20 bp, Artificial Sequence
  chemically synthesized
ctcattcattcccattcaaa

SEQ ID NO: 295827 - DNA, 20 bp, Artificial Sequence
  chemically synthesized
ctatttgaatgggaatgaat

SEQ ID NO: 295828 - DNA, 20 bp, Artificial Sequence
  chemically synthesized
tatttgaatgggaatgaatg

SEQ ID NO: 295829 - DNA, 20 bp, Artificial Sequence
  chemically synthesized
tgggaatgaatgaggatatc

SEQ ID NO: 295830 - DNA, 20 bp, Artificial Sequence
  chemically synthesized
ggaatgaatgaggatatcca

SEQ ID NO: 295831 - DNA, 20 bp, Artificial Sequence
  chemically synthesized
atgaatgaggatatccagag

SEQ ID NO: 295832 - DNA, 20 bp, Artificial Sequence
  chemically synthesized
gagtccttgtgtttcttctc

SEQ ID NO: 295833 - DNA, 20 bp, Artificial Sequence
  chemically synthesized
gatatccagagaagaaacac

SEQ ID NO: 295834 - DNA, 20 bp, Artificial Sequence
  chemically synthesized
atatccagagaagaaacaca

SEQ ID NO: 295835 - DNA, 20 bp, Artificial Sequence
  chemically synthesized
gaagaaacacaaggactctg

SEQ ID NO: 295836 - DNA, 20 bp, Artificial Sequence
  chemically synthesized
tttaatattgatattcttca

SEQ ID NO: 295837 - DNA, 20 bp, Artificial Sequence
  chemically synthesized
tctttaatattgatattctt

SEQ ID NO: 295838 - DNA, 20 bp, Artificial Sequence
  chemically synthesized
tctgaagaatatcaatatta

SEQ ID NO: 295839 - DNA, 20 bp, Artificial Sequence
  chemically synthesized
atattaaagaaaaactgaat

SEQ ID NO: 295840 - DNA, 20 bp, Artificial Sequence
  chemically synthesized
cttggccatttgttccaatt

SEQ ID NO: 295841 - DNA, 20 bp, Artificial Sequence
  chemically synthesized
aaaaactgaattggaacaaa

SEQ ID NO: 295842 - DNA, 20 bp, Artificial Sequence
  chemically synthesized
ctgaattggaacaaatggcc

SEQ ID NO: 295843 - DNA, 20 bp, Artificial Sequence
  chemically synthesized
gattaattctttcacattct

SEQ ID NO: 295844 - DNA, 20 bp, Artificial Sequence
  chemically synthesized
acaaatggccaagaatgtga

SEQ ID NO: 295845 - DNA, 20 bp, Artificial Sequence
  chemically synthesized
aagaatgtgaaagaattaat

SEQ ID NO: 295846 - DNA, 20 bp, Artificial Sequence
  chemically synthesized
agaatgtgaaagaattaatc

SEQ ID NO: 295847 - DNA, 20 bp, Artificial Sequence
  chemically synthesized
aatgtgaaagaattaatcag

SEQ ID NO: 295848 - DNA, 20 bp, Artificial Sequence
  chemically synthesized
tgaaagaattaatcaggaga

SEQ ID NO: 295849 - DNA, 20 bp, Artificial Sequence
  chemically synthesized
aagaattaatcaggagaaag

SEQ ID NO: 295850 - DNA, 20 bp, Artificial Sequence
  chemically synthesized
aggagaaagcagtatcccat

SEQ ID NO: 295851 - DNA, 20 bp, Artificial Sequence
  chemically synthesized
aaagcagtatcccataagcc

SEQ ID NO: 295852 - DNA, 20 bp, Artificial Sequence
  chemically synthesized
tctttcctcgcttggcttat

SEQ ID NO: 295853 - DNA, 20 bp, Artificial Sequence
  chemically synthesized
ttctttcctcgcttggctta

SEQ ID NO: 295854 - DNA, 20 bp, Artificial Sequence
  chemically synthesized
cagtatcccataagccaagc

SEQ ID NO: 295855 - DNA, 20 bp, Artificial Sequence
  chemically synthesized
agtatcccataagccaagcg

SEQ ID NO: 295856 - DNA, 20 bp, Artificial Sequence
  chemically synthesized
catgaaattctttcctcgct

SEQ ID NO: 295857 - DNA, 20 bp, Artificial Sequence
  chemically synthesized
tcccataagccaagcgagga

SEQ ID NO: 295858 - DNA, 20 bp, Artificial Sequence
  chemically synthesized
aagcgaggaaagaatttcat

SEQ ID NO: 295859 - DNA, 20 bp, Artificial Sequence
  chemically synthesized
agcgaggaaagaatttcatg

SEQ ID NO: 295860 - DNA, 20 bp, Artificial Sequence
  chemically synthesized
gcgaggaaagaatttcatga

SEQ ID NO: 295861 - DNA, 20 bp, Artificial Sequence
  chemically synthesized
gaaagaatttcatgagggaa

SEQ ID NO: 295862 - DNA, 20 bp, Artificial Sequence
  chemically synthesized
aagaatttcatgagggaaaa

SEQ ID NO: 295863 - DNA, 20 bp, Artificial Sequence
  chemically synthesized
agaatttcatgagggaaaag

SEQ ID NO: 295864 - DNA, 20 bp, Artificial Sequence
  chemically synthesized
catgagggaaaagaggttaa

SEQ ID NO: 295865 - DNA, 20 bp, Artificial Sequence
  chemically synthesized
atgagggaaaagaggttaat

SEQ ID NO: 295866 - DNA, 20 bp, Artificial Sequence
  chemically synthesized
gaaaagaggttaataggttc

SEQ ID NO: 295867 - DNA, 20 bp, Artificial Sequence
  chemically synthesized
gttaataggttctagttcta

SEQ ID NO: 295868 - DNA, 20 bp, Artificial Sequence
  chemically synthesized
actcaatccctctgtagaac

SEQ ID NO: 295869 - DNA, 20 bp, Artificial Sequence
  chemically synthesized
taataggttctagttctaca

SEQ ID NO: 295870 - DNA, 20 bp, Artificial Sequence
  chemically synthesized
aataggttctagttctacag

SEQ ID NO: 295871 - DNA, 20 bp, Artificial Sequence
  chemically synthesized
ataggttctagttctacaga

SEQ ID NO: 295872 - DNA, 20 bp, Artificial Sequence
  chemically synthesized
tatcttactcaatccctctg

SEQ ID NO: 295873 - DNA, 20 bp, Artificial Sequence
  chemically synthesized
tctagttctacagagggatt

SEQ ID NO: 295874 - DNA, 20 bp, Artificial Sequence
  chemically synthesized
gttctacagagggattgagt

SEQ ID NO: 295875 - DNA, 20 bp, Artificial Sequence
  chemically synthesized
acagagggattgagtaagat

SEQ ID NO: 295876 - DNA, 20 bp, Artificial Sequence
  chemically synthesized
cagagggattgagtaagata

SEQ ID NO: 295877 - DNA, 20 bp, Artificial Sequence
  chemically synthesized
tgagtaagataaggcacgtt

SEQ ID NO: 295878 - DNA, 20 bp, Artificial Sequence
  chemically synthesized
agtattcacatgcatgttta

SEQ ID NO: 295879 - DNA, 20 bp, Artificial Sequence
  chemically synthesized
gtattcacatgcatgtttat

SEQ ID NO: 295880 - DNA, 20 bp, Artificial Sequence
  chemically synthesized
attcacatgcatgtttatag

SEQ ID NO: 295881 - DNA, 20 bp, Artificial Sequence
  chemically synthesized
tcacatgcatgtttatagga

SEQ ID NO: 295882 - DNA, 20 bp, Artificial Sequence
  chemically synthesized
cacatgcatgtttataggag

SEQ ID NO: 295883 - DNA, 20 bp, Artificial Sequence
  chemically synthesized
taggagaggacacgttctaa

SEQ ID NO: 295884 - DNA, 20 bp, Artificial Sequence
  chemically synthesized
ccggttgtgttttcatcttt

SEQ ID NO: 295885 - DNA, 20 bp, Artificial Sequence
  chemically synthesized
ctaaaagatgaaaacacaac

SEQ ID NO: 295886 - DNA, 20 bp, Artificial Sequence
  chemically synthesized
tgaaaacacaaccggtttaa

SEQ ID NO: 295887 - DNA, 20 bp, Artificial Sequence
  chemically synthesized
tttatcattagcttttaaac

SEQ ID NO: 295888 - DNA, 20 bp, Artificial Sequence
  chemically synthesized
cggtttaaaagctaatgata

SEQ ID NO: 295889 - DNA, 20 bp, Artificial Sequence
  chemically synthesized
acatcccaggtctttatcat

SEQ ID NO: 295890 - DNA, 20 bp, Artificial Sequence
  chemically synthesized
aaaagctaatgataaagacc

SEQ ID NO: 295891 - DNA, 20 bp, Artificial Sequence
  chemically synthesized
aaagctaatgataaagacct

SEQ ID NO: 295892 - DNA, 20 bp, Artificial Sequence
  chemically synthesized
aatgataaagacctgggatg

SEQ ID NO: 295893 - DNA, 20 bp, Artificial Sequence
  chemically synthesized
ttgtcaaaaatctacatccc

SEQ ID NO: 295894 - DNA, 20 bp, Artificial Sequence
  chemically synthesized
attgtcaaaaatctacatcc

SEQ ID NO: 295895 - DNA, 20 bp, Artificial Sequence
  chemically synthesized
gatgtagatttttgacaatc

SEQ ID NO: 295896 - DNA, 20 bp, Artificial Sequence
  chemically synthesized
tttttgacaatctggatata

SEQ ID NO: 295897 - DNA, 20 bp, Artificial Sequence
  chemically synthesized
gttccattcagctgtatatc

SEQ ID NO: 295898 - DNA, 20 bp, Artificial Sequence
  chemically synthesized
aatctggatatacagctgaa

SEQ ID NO: 295899 - DNA, 20 bp, Artificial Sequence
  chemically synthesized
ttaagccacctggttccatt

SEQ ID NO: 295900 - DNA, 20 bp, Artificial Sequence
  chemically synthesized
gatatacagctgaatggaac

SEQ ID NO: 295901 - DNA, 20 bp, Artificial Sequence
  chemically synthesized
atatacagctgaatggaacc

SEQ ID NO: 295902 - DNA, 20 bp, Artificial Sequence
  chemically synthesized
tacagctgaatggaaccagg

SEQ ID NO: 295903 - DNA, 20 bp, Artificial Sequence
  chemically synthesized
tgactatgtattaagccacc

SEQ ID NO: 295904 - DNA, 20 bp, Artificial Sequence
  chemically synthesized
gaaccaggtggcttaataca

SEQ ID NO: 295905 - DNA, 20 bp, Artificial Sequence
  chemically synthesized
agcatcactgactatgtatt

SEQ ID NO: 295906 - DNA, 20 bp, Artificial Sequence
  chemically synthesized
caggtggcttaatacatagt

SEQ ID NO: 295907 - DNA, 20 bp, Artificial Sequence
  chemically synthesized
acatagtcagtgatgctgct

SEQ ID NO: 295908 - DNA, 20 bp, Artificial Sequence
  chemically synthesized
ctctgggtgtgtgttctcag

SEQ ID NO: 295909 - DNA, 20 bp, Artificial Sequence
  chemically synthesized
catctctgggtgtgtgttct

SEQ ID NO: 295910 - DNA, 20 bp, Artificial Sequence
  chemically synthesized
tgctgctgagaacacacacc

SEQ ID NO: 295911 - DNA, 20 bp, Artificial Sequence
  chemically synthesized
ctgctgagaacacacaccca

SEQ ID NO: 295912 - DNA, 20 bp, Artificial Sequence
  chemically synthesized
gagaacacacacccagagat

SEQ ID NO: 295913 - DNA, 20 bp, Artificial Sequence
  chemically synthesized
cctggttgaggctcatctct

SEQ ID NO: 295914 - DNA, 20 bp, Artificial Sequence
  chemically synthesized
acctggttgaggctcatctc

SEQ ID NO: 295915 - DNA, 20 bp, Artificial Sequence
  chemically synthesized
acccagagatgagcctcaac

SEQ ID NO: 295916 - DNA, 20 bp, Artificial Sequence
  chemically synthesized
cccagagatgagcctcaacc

SEQ ID NO: 295917 - DNA, 20 bp, Artificial Sequence
  chemically synthesized
ggctatccttcacctggttg

SEQ ID NO: 295918 - DNA, 20 bp, Artificial Sequence
  chemically synthesized
aggctatccttcacctggtt

SEQ ID NO: 295919 - DNA, 20 bp, Artificial Sequence
  chemically synthesized
agatgagcctcaaccaggtg

SEQ ID NO: 295920 - DNA, 20 bp, Artificial Sequence
  chemically synthesized
gatgagcctcaaccaggtga

SEQ ID NO: 295921 - DNA, 20 bp, Artificial Sequence
  chemically synthesized
ggaagaggctatccttcacc

SEQ ID NO: 295922 - DNA, 20 bp, Artificial Sequence
  chemically synthesized
agcctcaaccaggtgaagga

SEQ ID NO: 295923 - DNA, 20 bp, Artificial Sequence
  chemically synthesized
tccacctgccttagtggaag

SEQ ID NO: 295924 - DNA, 20 bp, Artificial Sequence
  chemically synthesized
gaaggatagcctcttccact

SEQ ID NO: 295925 - DNA, 20 bp, Artificial Sequence
  chemically synthesized
ttccacctgccttagtggaa

SEQ ID NO: 295926 - DNA, 20 bp, Artificial Sequence
  chemically synthesized
aaggatagcctcttccacta

SEQ ID NO: 295927 - DNA, 20 bp, Artificial Sequence
  chemically synthesized
ttttccacctgccttagtgg

SEQ ID NO: 295928 - DNA, 20 bp, Artificial Sequence
  chemically synthesized
gatagcctcttccactaagg

SEQ ID NO: 295929 - DNA, 20 bp, Artificial Sequence
  chemically synthesized
atagcctcttccactaaggc

SEQ ID NO: 295930 - DNA, 20 bp, Artificial Sequence
  chemically synthesized
tttttttccacctgccttag

SEQ ID NO: 295931 - DNA, 20 bp, Artificial Sequence
  chemically synthesized
gcctcttccactaaggcagg

SEQ ID NO: 295932 - DNA, 20 bp, Artificial Sequence
  chemically synthesized
ttttttttttccacctgcct

SEQ ID NO: 295933 - DNA, 20 bp, Artificial Sequence
  chemically synthesized
gtggaaaaaaaaaaaaaaaa

SEQ ID NO: 295934 - DNA, 20 bp, Artificial Sequence
  chemically synthesized
aaaaaaaaaaaagatactat

SEQ ID NO: 295935 - DNA, 20 bp, Artificial Sequence
  chemically synthesized
attgtgggtatttgtgctca

SEQ ID NO: 295936 - DNA, 20 bp, Artificial Sequence
  chemically synthesized
agcacaaatacccacaattt

SEQ ID NO: 295937 - DNA, 20 bp, Artificial Sequence
  chemically synthesized
aataatatttctcaaattgt

SEQ ID NO: 295938 - DNA, 20 bp, Artificial Sequence
  chemically synthesized
aaataatatttctcaaattg

SEQ ID NO: 295939 - DNA, 20 bp, Artificial Sequence
  chemically synthesized
gagaaatattatttcgacta

SEQ ID NO: 295940 - DNA, 20 bp, Artificial Sequence
  chemically synthesized
aaatattatttcgactaaag

SEQ ID NO: 295941 - DNA, 20 bp, Artificial Sequence
  chemically synthesized
aatattatttcgactaaagt

SEQ ID NO: 295942 - DNA, 20 bp, Artificial Sequence
  chemically synthesized
tattatttcgactaaagtag

SEQ ID NO: 295943 - DNA, 20 bp, Artificial Sequence
  chemically synthesized
aatgatttcatctcctactt

SEQ ID NO: 295944 - DNA, 20 bp, Artificial Sequence
  chemically synthesized
aaatcatttactgtgaatga

SEQ ID NO: 295945 - DNA, 20 bp, Artificial Sequence
  chemically synthesized
taaactttccccatcattca

SEQ ID NO: 295946 - DNA, 20 bp, Artificial Sequence
  chemically synthesized
aatcatttactgtgaatgat

SEQ ID NO: 295947 - DNA, 20 bp, Artificial Sequence
  chemically synthesized
atcatttactgtgaatgatg

SEQ ID NO: 295948 - DNA, 20 bp, Artificial Sequence
  chemically synthesized
tttactgtgaatgatgggga

SEQ ID NO: 295949 - DNA, 20 bp, Artificial Sequence
  chemically synthesized
tgtgaatgatggggaaagtt

SEQ ID NO: 295950 - DNA, 20 bp, Artificial Sequence
  chemically synthesized
gtgaatgatggggaaagttt

SEQ ID NO: 295951 - DNA, 20 bp, Artificial Sequence
  chemically synthesized
aaagtttaggtaccccacaa

SEQ ID NO: 295952 - DNA, 20 bp, Artificial Sequence
  chemically synthesized
aattatttcaagcttttgtg

SEQ ID NO: 295953 - DNA, 20 bp, Artificial Sequence
  chemically synthesized
caattatttcaagcttttgt

SEQ ID NO: 295954 - DNA, 20 bp, Artificial Sequence
  chemically synthesized
acaattatttcaagcttttg

SEQ ID NO: 295955 - DNA, 20 bp, Artificial Sequence
  chemically synthesized
tttctctcaacaattatttc

SEQ ID NO: 295956 - DNA, 20 bp, Artificial Sequence
  chemically synthesized
aaaagcttgaaataattgtt

SEQ ID NO: 295957 - DNA, 20 bp, Artificial Sequence
  chemically synthesized
aagcttgaaataattgttga

SEQ ID NO: 295958 - DNA, 20 bp, Artificial Sequence
  chemically synthesized
aataattgttgagagaaact

SEQ ID NO: 295959 - DNA, 20 bp, Artificial Sequence
  chemically synthesized
tcctaagtatattttcaact

SEQ ID NO: 295960 - DNA, 20 bp, Artificial Sequence
  chemically synthesized
aactaagttgaaaatatact

SEQ ID NO: 295961 - DNA, 20 bp, Artificial Sequence
  chemically synthesized
actaagttgaaaatatactt

SEQ ID NO: 295962 - DNA, 20 bp, Artificial Sequence
  chemically synthesized
ataagctttccgtgcatcct

SEQ ID NO: 295963 - DNA, 20 bp, Artificial Sequence
  chemically synthesized
gaaaatatacttaggatgca

SEQ ID NO: 295964 - DNA, 20 bp, Artificial Sequence
  chemically synthesized
atatacttaggatgcacgga

SEQ ID NO: 295965 - DNA, 20 bp, Artificial Sequence
  chemically synthesized
ggatgcacggaaagcttatg

SEQ ID NO: 295966 - DNA, 20 bp, Artificial Sequence
  chemically synthesized
caaaaccagcagttcttcat

SEQ ID NO: 295967 - DNA, 20 bp, Artificial Sequence
  chemically synthesized
gaaagcttatgaagaactgc

SEQ ID NO: 295968 - DNA, 20 bp, Artificial Sequence
  chemically synthesized
acatattttaacaaaaccag

SEQ ID NO: 295969 - DNA, 20 bp, Artificial Sequence
  chemically synthesized
acaacatattttaacaaaac

SEQ ID NO: 295970 - DNA, 20 bp, Artificial Sequence
  chemically synthesized
gttttgttaaaatatgttgt

SEQ ID NO: 295971 - DNA, 20 bp, Artificial Sequence
  chemically synthesized
ttaaaatatgttgttagtgc

SEQ ID NO: 295972 - DNA, 20 bp, Artificial Sequence
  chemically synthesized
taaaatatgttgttagtgcc

SEQ ID NO: 295973 - DNA, 20 bp, Artificial Sequence
  chemically synthesized
tatgttgttagtgccgggcg

SEQ ID NO: 295974 - DNA, 20 bp, Artificial Sequence
  chemically synthesized
gttgttagtgccgggcgcgg

SEQ ID NO: 295975 - DNA, 20 bp, Artificial Sequence
  chemically synthesized
caggcgtgagccaccgcgcc

SEQ ID NO: 295976 - DNA, 20 bp, Artificial Sequence
  chemically synthesized
agtgctgggattacaggcgt

SEQ ID NO: 295977 - DNA, 20 bp, Artificial Sequence
  chemically synthesized
gtggctcacgcctgtaatcc

SEQ ID NO: 295978 - DNA, 20 bp, Artificial Sequence
  chemically synthesized
tcccaaagtgctgggattac

SEQ ID NO: 295979 - DNA, 20 bp, Artificial Sequence
  chemically synthesized
ctcccaaagtgctgggatta

SEQ ID NO: 295980 - DNA, 20 bp, Artificial Sequence
  chemically synthesized
cgcctgtaatcccagcactt

SEQ ID NO: 295981 - DNA, 20 bp, Artificial Sequence
  chemically synthesized
cctcggcctcccaaagtgct

SEQ ID NO: 295982 - DNA, 20 bp, Artificial Sequence
  chemically synthesized
gcctgtaatcccagcacttt

SEQ ID NO: 295983 - DNA, 20 bp, Artificial Sequence
  chemically synthesized
gcctcggcctcccaaagtgc

SEQ ID NO: 295984 - DNA, 20 bp, Artificial Sequence
  chemically synthesized
ctgtaatcccagcactttgg

SEQ ID NO: 295985 - DNA, 20 bp, Artificial Sequence
  chemically synthesized
tgtaatcccagcactttggg

SEQ ID NO: 295986 - DNA, 20 bp, Artificial Sequence
  chemically synthesized
ccgcccgcctcggcctccca

SEQ ID NO: 295987 - DNA, 20 bp, Artificial Sequence
  chemically synthesized
tcccagcactttgggaggcc

SEQ ID NO: 295988 - DNA, 20 bp, Artificial Sequence
  chemically synthesized
cccagcactttgggaggccg

SEQ ID NO: 295989 - DNA, 20 bp, Artificial Sequence
  chemically synthesized
agcactttgggaggccgagg

SEQ ID NO: 295990 - DNA, 20 bp, Artificial Sequence
  chemically synthesized
gcactttgggaggccgaggc

SEQ ID NO: 295991 - DNA, 20 bp, Artificial Sequence
  chemically synthesized
ctttgggaggccgaggcggg

SEQ ID NO: 295992 - DNA, 20 bp, Artificial Sequence
  chemically synthesized
acctcgtgatccgcccgcct

SEQ ID NO: 295993 - DNA, 20 bp, Artificial Sequence
  chemically synthesized
ggccgaggcgggcggatcac

SEQ ID NO: 295994 - DNA, 20 bp, Artificial Sequence
  chemically synthesized
gccgaggcgggcggatcacg

SEQ ID NO: 295995 - DNA, 20 bp, Artificial Sequence
  chemically synthesized
aggcgggcggatcacgaggt

SEQ ID NO: 295996 - DNA, 20 bp, Artificial Sequence
  chemically synthesized
ggcgggcggatcacgaggtc

SEQ ID NO: 295997 - DNA, 20 bp, Artificial Sequence
  chemically synthesized
cgggcggatcacgaggtcag

SEQ ID NO: 295998 - DNA, 20 bp, Artificial Sequence
  chemically synthesized
gatcacgaggtcaggagatc

SEQ ID NO: 295999 - DNA, 20 bp, Artificial Sequence
  chemically synthesized
tcaggagatcgagaccatcc

SEQ ID NO: 296000 - DNA, 20 bp, Artificial Sequence
  chemically synthesized
tttcaccgtgttagccagga

SEQ ID NO: 296001 - DNA, 20 bp, Artificial Sequence
  chemically synthesized
ggggtttcaccgtgttagcc

SEQ ID NO: 296002 - DNA, 20 bp, Artificial Sequence
  chemically synthesized
cgagaccatcctggctaaca

SEQ ID NO: 296003 - DNA, 20 bp, Artificial Sequence
  chemically synthesized
cggggtttcaccgtgttagc

SEQ ID NO: 296004 - DNA, 20 bp, Artificial Sequence
  chemically synthesized
gagacggggtttcaccgtgt

SEQ ID NO: 296005 - DNA, 20 bp, Artificial Sequence
  chemically synthesized
ttgtatttttagtagagacg

SEQ ID NO: 296006 - DNA, 20 bp, Artificial Sequence
  chemically synthesized
tttgtatttttagtagagac

SEQ ID NO: 296007 - DNA, 20 bp, Artificial Sequence
  chemically synthesized
ttttgtatttttagtagaga

SEQ ID NO: 296008 - DNA, 20 bp, Artificial Sequence
  chemically synthesized
aagtttttgtatttttagta

SEQ ID NO: 296009 - DNA, 20 bp, Artificial Sequence
  chemically synthesized
ctaagtttttgtatttttag

SEQ ID NO: 296010 - DNA, 20 bp, Artificial Sequence
  chemically synthesized
cggctaagtttttgtatttt

SEQ ID NO: 296011 - DNA, 20 bp, Artificial Sequence
  chemically synthesized
ctactaaaaatacaaaaact

SEQ ID NO: 296012 - DNA, 20 bp, Artificial Sequence
  chemically synthesized
taaaaatacaaaaacttagc

SEQ ID NO: 296013 - DNA, 20 bp, Artificial Sequence
  chemically synthesized
aaaaatacaaaaacttagcc

SEQ ID NO: 296014 - DNA, 20 bp, Artificial Sequence
  chemically synthesized
gcccgccaccacacccggct

SEQ ID NO: 296015 - DNA, 20 bp, Artificial Sequence
  chemically synthesized
tacaaaaacttagccgggtg

SEQ ID NO: 296016 - DNA, 20 bp, Artificial Sequence
  chemically synthesized
aaaaacttagccgggtgtgg

SEQ ID NO: 296017 - DNA, 20 bp, Artificial Sequence
  chemically synthesized
caggcgcccgccaccacacc

SEQ ID NO: 296018 - DNA, 20 bp, Artificial Sequence
  chemically synthesized
aacttagccgggtgtggtgg

SEQ ID NO: 296019 - DNA, 20 bp, Artificial Sequence
  chemically synthesized
acttagccgggtgtggtggc

SEQ ID NO: 296020 - DNA, 20 bp, Artificial Sequence
  chemically synthesized
ggtgtggtggcgggcgcctg

SEQ ID NO: 296021 - DNA, 20 bp, Artificial Sequence
  chemically synthesized
gtggcgggcgcctgtagtcc

SEQ ID NO: 296022 - DNA, 20 bp, Artificial Sequence
  chemically synthesized
tcctgagtagctgggactac

SEQ ID NO: 296023 - DNA, 20 bp, Artificial Sequence
  chemically synthesized
ctcctgagtagctgggacta

SEQ ID NO: 296024 - DNA, 20 bp, Artificial Sequence
  chemically synthesized
cgcctgtagtcccagctact

SEQ ID NO: 296025 - DNA, 20 bp, Artificial Sequence
  chemically synthesized
cctcagcctcctgagtagct

SEQ ID NO: 296026 - DNA, 20 bp, Artificial Sequence
  chemically synthesized
gcctgtagtcccagctactc

SEQ ID NO: 296027 - DNA, 20 bp, Artificial Sequence
  chemically synthesized
gcctcagcctcctgagtagc

SEQ ID NO: 296028 - DNA, 20 bp, Artificial Sequence
  chemically synthesized
ctgtagtcccagctactcag

SEQ ID NO: 296029 - DNA, 20 bp, Artificial Sequence
  chemically synthesized
tgtagtcccagctactcagg

SEQ ID NO: 296030 - DNA, 20 bp, Artificial Sequence
  chemically synthesized
tcctgcctcagcctcctgag

SEQ ID NO: 296031 - DNA, 20 bp, Artificial Sequence
  chemically synthesized
ttctcctgcctcagcctcct

SEQ ID NO: 296032 - DNA, 20 bp, Artificial Sequence
  chemically synthesized
tcccagctactcaggaggct

SEQ ID NO: 296033 - DNA, 20 bp, Artificial Sequence
  chemically synthesized
cccagctactcaggaggctg

SEQ ID NO: 296034 - DNA, 20 bp, Artificial Sequence
  chemically synthesized
agctactcaggaggctgagg

SEQ ID NO: 296035 - DNA, 20 bp, Artificial Sequence
  chemically synthesized
gctactcaggaggctgaggc

SEQ ID NO: 296036 - DNA, 20 bp, Artificial Sequence
  chemically synthesized
tactcaggaggctgaggcag

SEQ ID NO: 296037 - DNA, 20 bp, Artificial Sequence
  chemically synthesized
ttcacgccgttctcctgcct

SEQ ID NO: 296038 - DNA, 20 bp, Artificial Sequence
  chemically synthesized
aggaggctgaggcaggagaa

SEQ ID NO: 296039 - DNA, 20 bp, Artificial Sequence
  chemically synthesized
gcaggagaacggcgtgaacc

SEQ ID NO: 296040 - DNA, 20 bp, Artificial Sequence
  chemically synthesized
caggagaacggcgtgaaccc

SEQ ID NO: 296041 - DNA, 20 bp, Artificial Sequence
  chemically synthesized
ggagaacggcgtgaacccgg

SEQ ID NO: 296042 - DNA, 20 bp, Artificial Sequence
  chemically synthesized
gagaacggcgtgaacccggg

SEQ ID NO: 296043 - DNA, 20 bp, Artificial Sequence
  chemically synthesized
aacggcgtgaacccgggagg

SEQ ID NO: 296044 - DNA, 20 bp, Artificial Sequence
  chemically synthesized
cactgcaagctctgcctccc

SEQ ID NO: 296045 - DNA, 20 bp, Artificial Sequence
  chemically synthesized
cggcgtgaacccgggaggca

SEQ ID NO: 296046 - DNA, 20 bp, Artificial Sequence
  chemically synthesized
tcactgcaagctctgcctcc

SEQ ID NO: 296047 - DNA, 20 bp, Artificial Sequence
  chemically synthesized
aacccgggaggcagagcttg

SEQ ID NO: 296048 - DNA, 20 bp, Artificial Sequence
  chemically synthesized
cgggaggcagagcttgcagt

SEQ ID NO: 296049 - DNA, 20 bp, Artificial Sequence
  chemically synthesized
gcgcgatctcggctcactgc

SEQ ID NO: 296050 - DNA, 20 bp, Artificial Sequence
  chemically synthesized
ggcagagcttgcagtgagcc

SEQ ID NO: 296051 - DNA, 20 bp, Artificial Sequence
  chemically synthesized
ggagtgcagtggcgcgatct

SEQ ID NO: 296052 - DNA, 20 bp, Artificial Sequence
  chemically synthesized
tgtcccaggcgggagtgcag

SEQ ID NO: 296053 - DNA, 20 bp, Artificial Sequence
  chemically synthesized
ctctgtcccaggcgggagtg

SEQ ID NO: 296054 - DNA, 20 bp, Artificial Sequence
  chemically synthesized
cgcgccactgcactcccgcc

SEQ ID NO: 296055 - DNA, 20 bp, Artificial Sequence
  chemically synthesized
gcgccactgcactcccgcct

SEQ ID NO: 296056 - DNA, 20 bp, Artificial Sequence
  chemically synthesized
tctcgctctgtcccaggcgg

SEQ ID NO: 296057 - DNA, 20 bp, Artificial Sequence
  chemically synthesized
agtctcgctctgtcccaggc

SEQ ID NO: 296058 - DNA, 20 bp, Artificial Sequence
  chemically synthesized
cactgcactcccgcctggga

SEQ ID NO: 296059 - DNA, 20 bp, Artificial Sequence
  chemically synthesized
gagtctcgctctgtcccagg

SEQ ID NO: 296060 - DNA, 20 bp, Artificial Sequence
  chemically synthesized
ctgcactcccgcctgggaca

SEQ ID NO: 296061 - DNA, 20 bp, Artificial Sequence
  chemically synthesized
acggagtctcgctctgtccc

SEQ ID NO: 296062 - DNA, 20 bp, Artificial Sequence
  chemically synthesized
gacggagtctcgctctgtcc

SEQ ID NO: 296063 - DNA, 20 bp, Artificial Sequence
  chemically synthesized
actcccgcctgggacagagc

SEQ ID NO: 296064 - DNA, 20 bp, Artificial Sequence
  chemically synthesized
aagattatttttttgagacg

SEQ ID NO: 296065 - DNA, 20 bp, Artificial Sequence
  chemically synthesized
ataagattatttttttgaga

SEQ ID NO: 296066 - DNA, 20 bp, Artificial Sequence
  chemically synthesized
tttaataagattattttttt

SEQ ID NO: 296067 - DNA, 20 bp, Artificial Sequence
  chemically synthesized
tcaaaaaaataatcttatta

SEQ ID NO: 296068 - DNA, 20 bp, Artificial Sequence
  chemically synthesized
cattactccatttctttaat

SEQ ID NO: 296069 - DNA, 20 bp, Artificial Sequence
  chemically synthesized
aaataatcttattaaagaaa

SEQ ID NO: 296070 - DNA, 20 bp, Artificial Sequence
  chemically synthesized
ataatcttattaaagaaatg

SEQ ID NO: 296071 - DNA, 20 bp, Artificial Sequence
  chemically synthesized
atgtagatgttgtcattgtc

SEQ ID NO: 296072 - DNA, 20 bp, Artificial Sequence
  chemically synthesized
tatgtagatgttgtcattgt

SEQ ID NO: 296073 - DNA, 20 bp, Artificial Sequence
  chemically synthesized
ctgtcatgattgtatgtatg

SEQ ID NO: 296074 - DNA, 20 bp, Artificial Sequence
  chemically synthesized
ctacatacatacaatcatga

SEQ ID NO: 296075 - DNA, 20 bp, Artificial Sequence
  chemically synthesized
catacatacaatcatgacag

SEQ ID NO: 296076 - DNA, 20 bp, Artificial Sequence
  chemically synthesized
atacatacaatcatgacagc

SEQ ID NO: 296077 - DNA, 20 bp, Artificial Sequence
  chemically synthesized
catacaatcatgacagcagg

SEQ ID NO: 296078 - DNA, 20 bp, Artificial Sequence
  chemically synthesized
tgacagcaggtagctgaatt

SEQ ID NO: 296079 - DNA, 20 bp, Artificial Sequence
  chemically synthesized
gacagcaggtagctgaattg

SEQ ID NO: 296080 - DNA, 20 bp, Artificial Sequence
  chemically synthesized
cagcaggtagctgaattgag

SEQ ID NO: 296081 - DNA, 20 bp, Artificial Sequence
  chemically synthesized
tttctctcatctcctcaatt

SEQ ID NO: 296082 - DNA, 20 bp, Artificial Sequence
  chemically synthesized
ggtagctgaattgaggagat

SEQ ID NO: 296083 - DNA, 20 bp, Artificial Sequence
  chemically synthesized
tagctgaattgaggagatga

SEQ ID NO: 296084 - DNA, 20 bp, Artificial Sequence
  chemically synthesized
tgaggagatgagagaaacaa

SEQ ID NO: 296085 - DNA, 20 bp, Artificial Sequence
  chemically synthesized
atgagagaaacaacagcttt

SEQ ID NO: 296086 - DNA, 20 bp, Artificial Sequence
  chemically synthesized
gaaacaacagcttttagtga

SEQ ID NO: 296087 - DNA, 20 bp, Artificial Sequence
  chemically synthesized
ggctctcctgctatcactaa

SEQ ID NO: 296088 - DNA, 20 bp, Artificial Sequence
  chemically synthesized
acaacagcttttagtgatag

SEQ ID NO: 296089 - DNA, 20 bp, Artificial Sequence
  chemically synthesized
caacagcttttagtgatagc

SEQ ID NO: 296090 - DNA, 20 bp, Artificial Sequence
  chemically synthesized
acagcttttagtgatagcag

SEQ ID NO: 296091 - DNA, 20 bp, Artificial Sequence
  chemically synthesized
agcttttagtgatagcagga

SEQ ID NO: 296092 - DNA, 20 bp, Artificial Sequence
  chemically synthesized
agtgatagcaggagagccca

SEQ ID NO: 296093 - DNA, 20 bp, Artificial Sequence
  chemically synthesized
gtgatagcaggagagcccac

SEQ ID NO: 296094 - DNA, 20 bp, Artificial Sequence
  chemically synthesized
tgatagcaggagagcccaca

SEQ ID NO: 296095 - DNA, 20 bp, Artificial Sequence
  chemically synthesized
agttatttcagcatccctgt

SEQ ID NO: 296096 - DNA, 20 bp, Artificial Sequence
  chemically synthesized
tagttatttcagcatccctg

SEQ ID NO: 296097 - DNA, 20 bp, Artificial Sequence
  chemically synthesized
tctttcattcttagttattt

SEQ ID NO: 296098 - DNA, 20 bp, Artificial Sequence
  chemically synthesized
acagggatgctgaaataact

SEQ ID NO: 296099 - DNA, 20 bp, Artificial Sequence
  chemically synthesized
gctgaaataactaagaatga

SEQ ID NO: 296100 - DNA, 20 bp, Artificial Sequence
  chemically synthesized
ccaatttgttctttcattct

SEQ ID NO: 296101 - DNA, 20 bp, Artificial Sequence
  chemically synthesized
ctaagaatgaaagaacaaat

SEQ ID NO: 296102 - DNA, 20 bp, Artificial Sequence
  chemically synthesized
gttgaaaaaatctactaacc

SEQ ID NO: 296103 - DNA, 20 bp, Artificial Sequence
  chemically synthesized
agactttggcactaggttag

SEQ ID NO: 296104 - DNA, 20 bp, Artificial Sequence
  chemically synthesized
tgaagactttggcactaggt

SEQ ID NO: 296105 - DNA, 20 bp, Artificial Sequence
  chemically synthesized
aatctactaacctagtgcca

SEQ ID NO: 296106 - DNA, 20 bp, Artificial Sequence
  chemically synthesized
tcattgaagactttggcact

SEQ ID NO: 296107 - DNA, 20 bp, Artificial Sequence
  chemically synthesized
ctcattgaagactttggcac

SEQ ID NO: 296108 - DNA, 20 bp, Artificial Sequence
  chemically synthesized
tattttctcattgaagactt

SEQ ID NO: 296109 - DNA, 20 bp, Artificial Sequence
  chemically synthesized
ctagtgccaaagtcttcaat

SEQ ID NO: 296110 - DNA, 20 bp, Artificial Sequence
  chemically synthesized
tttatcatattttctcattg

SEQ ID NO: 296111 - DNA, 20 bp, Artificial Sequence
  chemically synthesized
aatgagaaaatatgataaaa

SEQ ID NO: 296112 - DNA, 20 bp, Artificial Sequence
  chemically synthesized
gagaaaatatgataaaatgg

SEQ ID NO: 296113 - DNA, 20 bp, Artificial Sequence
  chemically synthesized
aatatgataaaatggtagat

SEQ ID NO: 296114 - DNA, 20 bp, Artificial Sequence
  chemically synthesized
tatgataaaatggtagataa

SEQ ID NO: 296115 - DNA, 20 bp, Artificial Sequence
  chemically synthesized
ataaaatggtagataagaga

SEQ ID NO: 296116 - DNA, 20 bp, Artificial Sequence
  chemically synthesized
aatggtagataagagatggc

SEQ ID NO: 296117 - DNA, 20 bp, Artificial Sequence
  chemically synthesized
ggtagataagagatggccag

SEQ ID NO: 296118 - DNA, 20 bp, Artificial Sequence
  chemically synthesized
tccttgcagttaatgacttc

SEQ ID NO: 296119 - DNA, 20 bp, Artificial Sequence
  chemically synthesized
ggccagaagtcattaactgc

SEQ ID NO: 296120 - DNA, 20 bp, Artificial Sequence
  chemically synthesized
gccagaagtcattaactgca

SEQ ID NO: 296121 - DNA, 20 bp, Artificial Sequence
  chemically synthesized
gaagtcattaactgcaagga

SEQ ID NO: 296122 - DNA, 20 bp, Artificial Sequence
  chemically synthesized
taaaaatacctctttccttg

SEQ ID NO: 296123 - DNA, 20 bp, Artificial Sequence
  chemically synthesized
agtcattaactgcaaggaaa

SEQ ID NO: 296124 - DNA, 20 bp, Artificial Sequence
  chemically synthesized
gtcattaactgcaaggaaag

SEQ ID NO: 296125 - DNA, 20 bp, Artificial Sequence
  chemically synthesized
gaaagaggtatttttacatg

SEQ ID NO: 296126 - DNA, 20 bp, Artificial Sequence
  chemically synthesized
aagaggtatttttacatgaa

SEQ ID NO: 296127 - DNA, 20 bp, Artificial Sequence
  chemically synthesized
gaggtatttttacatgaaga

SEQ ID NO: 296128 - DNA, 20 bp, Artificial Sequence
  chemically synthesized
gtatttttacatgaagagag

SEQ ID NO: 296129 - DNA, 20 bp, Artificial Sequence
  chemically synthesized
catgaagagagcagtatctt

SEQ ID NO: 296130 - DNA, 20 bp, Artificial Sequence
  chemically synthesized
acctaacagagacaattcca

SEQ ID NO: 296131 - DNA, 20 bp, Artificial Sequence
  chemically synthesized
atctttggaattgtctctgt

SEQ ID NO: 296132 - DNA, 20 bp, Artificial Sequence
  chemically synthesized
tctttggaattgtctctgtt

SEQ ID NO: 296133 - DNA, 20 bp, Artificial Sequence
  chemically synthesized
actgactccctcacctaaca

SEQ ID NO: 296134 - DNA, 20 bp, Artificial Sequence
  chemically synthesized
tggaattgtctctgttaggt

SEQ ID NO: 296135 - DNA, 20 bp, Artificial Sequence
  chemically synthesized
ggaattgtctctgttaggtg

SEQ ID NO: 296136 - DNA, 20 bp, Artificial Sequence
  chemically synthesized
tgactgactccctcacctaa

SEQ ID NO: 296137 - DNA, 20 bp, Artificial Sequence
  chemically synthesized
gaattgtctctgttaggtga

SEQ ID NO: 296138 - DNA, 20 bp, Artificial Sequence
  chemically synthesized
attgtctctgttaggtgagg

SEQ ID NO: 296139 - DNA, 20 bp, Artificial Sequence
  chemically synthesized
tctctgttaggtgagggagt

SEQ ID NO: 296140 - DNA, 20 bp, Artificial Sequence
  chemically synthesized
tgagggagtcagtcattcta

SEQ ID NO: 296141 - DNA, 20 bp, Artificial Sequence
  chemically synthesized
gggagtcagtcattctaaag

SEQ ID NO: 296142 - DNA, 20 bp, Artificial Sequence
  chemically synthesized
agtcagtcattctaaagtag

SEQ ID NO: 296143 - DNA, 20 bp, Artificial Sequence
  chemically synthesized
gtcagtcattctaaagtagt

SEQ ID NO: 296144 - DNA, 20 bp, Artificial Sequence
  chemically synthesized
cttttgtacccccactactt

SEQ ID NO: 296145 - DNA, 20 bp, Artificial Sequence
  chemically synthesized
tcagtcattctaaagtagtg

SEQ ID NO: 296146 - DNA, 20 bp, Artificial Sequence
  chemically synthesized
cagtcattctaaagtagtgg

SEQ ID NO: 296147 - DNA, 20 bp, Artificial Sequence
  chemically synthesized
ctaaagtagtgggggtacaa

SEQ ID NO: 296148 - DNA, 20 bp, Artificial Sequence
  chemically synthesized
aaagtagtgggggtacaaaa

SEQ ID NO: 296149 - DNA, 20 bp, Artificial Sequence
  chemically synthesized
aagtagtgggggtacaaaag

SEQ ID NO: 296150 - DNA, 20 bp, Artificial Sequence
  chemically synthesized
agtagtgggggtacaaaaga

SEQ ID NO: 296151 - DNA, 20 bp, Artificial Sequence
  chemically synthesized
tgggggtacaaaagagggat

SEQ ID NO: 296152 - DNA, 20 bp, Artificial Sequence
  chemically synthesized
tacaaaagagggatgagtca

SEQ ID NO: 296153 - DNA, 20 bp, Artificial Sequence
  chemically synthesized
tgagtcatagtgctgttttc

SEQ ID NO: 296154 - DNA, 20 bp, Artificial Sequence
  chemically synthesized
gagtcatagtgctgttttcg

SEQ ID NO: 296155 - DNA, 20 bp, Artificial Sequence
  chemically synthesized
agtcatagtgctgttttcga

SEQ ID NO: 296156 - DNA, 20 bp, Artificial Sequence
  chemically synthesized
accaattttaccctcgaaaa

SEQ ID NO: 296157 - DNA, 20 bp, Artificial Sequence
  chemically synthesized
gctgttttcgagggtaaaat

SEQ ID NO: 296158 - DNA, 20 bp, Artificial Sequence
  chemically synthesized
taaaattggtttccacgtat

SEQ ID NO: 296159 - DNA, 20 bp, Artificial Sequence
  chemically synthesized
atacttattctactcatacg

SEQ ID NO: 296160 - DNA, 20 bp, Artificial Sequence
  chemically synthesized
aattggtttccacgtatgag

SEQ ID NO: 296161 - DNA, 20 bp, Artificial Sequence
  chemically synthesized
tttccacgtatgagtagaat

SEQ ID NO: 296162 - DNA, 20 bp, Artificial Sequence
  chemically synthesized
gtatgagtagaataagtata

SEQ ID NO: 296163 - DNA, 20 bp, Artificial Sequence
  chemically synthesized
tgagtagaataagtatatag

SEQ ID NO: 296164 - DNA, 20 bp, Artificial Sequence
  chemically synthesized
gagtagaataagtatataga

SEQ ID NO: 296165 - DNA, 20 bp, Artificial Sequence
  chemically synthesized
ctcaaacactttttcaagac

SEQ ID NO: 296166 - DNA, 20 bp, Artificial Sequence
  chemically synthesized
atagaaggcttgtcttgaaa

SEQ ID NO: 296167 - DNA, 20 bp, Artificial Sequence
  chemically synthesized
gcaggctcaaacactttttc

SEQ ID NO: 296168 - DNA, 20 bp, Artificial Sequence
  chemically synthesized
cttgtcttgaaaaagtgttt

SEQ ID NO: 296169 - DNA, 20 bp, Artificial Sequence
  chemically synthesized
aaaaagtgtttgagcctgcc

SEQ ID NO: 296170 - DNA, 20 bp, Artificial Sequence
  chemically synthesized
agtgtttgagcctgccgagt

SEQ ID NO: 296171 - DNA, 20 bp, Artificial Sequence
  chemically synthesized
ttcccacactctcactcggc

SEQ ID NO: 296172 - DNA, 20 bp, Artificial Sequence
  chemically synthesized
tttcccacactctcactcgg

SEQ ID NO: 296173 - DNA, 20 bp, Artificial Sequence
  chemically synthesized
tgtttgagcctgccgagtga

SEQ ID NO: 296174 - DNA, 20 bp, Artificial Sequence
  chemically synthesized
tgctttcccacactctcact

SEQ ID NO: 296175 - DNA, 20 bp, Artificial Sequence
  chemically synthesized
gagcctgccgagtgagagtg

SEQ ID NO: 296176 - DNA, 20 bp, Artificial Sequence
  chemically synthesized
agcctgccgagtgagagtgt

SEQ ID NO: 296177 - DNA, 20 bp, Artificial Sequence
  chemically synthesized
tgccgagtgagagtgtggga

SEQ ID NO: 296178 - DNA, 20 bp, Artificial Sequence
  chemically synthesized
cgagtgagagtgtgggaaag

SEQ ID NO: 296179 - DNA, 20 bp, Artificial Sequence
  chemically synthesized
agtgagagtgtgggaaagca

SEQ ID NO: 296180 - DNA, 20 bp, Artificial Sequence
  chemically synthesized
gtgagagtgtgggaaagcag

SEQ ID NO: 296181 - DNA, 20 bp, Artificial Sequence
  chemically synthesized
agagtgtgggaaagcagagg

SEQ ID NO: 296182 - DNA, 20 bp, Artificial Sequence
  chemically synthesized
gtgggaaagcagaggaagtg

SEQ ID NO: 296183 - DNA, 20 bp, Artificial Sequence
  chemically synthesized
gaaagcagaggaagtgaagc

SEQ ID NO: 296184 - DNA, 20 bp, Artificial Sequence
  chemically synthesized
aaagcagaggaagtgaagca

SEQ ID NO: 296185 - DNA, 20 bp, Artificial Sequence
  chemically synthesized
agaggaagtgaagcaaggaa

SEQ ID NO: 296186 - DNA, 20 bp, Artificial Sequence
  chemically synthesized
gaagtgaagcaaggaaaaga

SEQ ID NO: 296187 - DNA, 20 bp, Artificial Sequence
  chemically synthesized
gcaaggaaaagaaagtgcaa

SEQ ID NO: 296188 - DNA, 20 bp, Artificial Sequence
  chemically synthesized
aaggaaaagaaagtgcaata

SEQ ID NO: 296189 - DNA, 20 bp, Artificial Sequence
  chemically synthesized
gaaaagaaagtgcaatagag

SEQ ID NO: 296190 - DNA, 20 bp, Artificial Sequence
  chemically synthesized
aaagaaagtgcaatagagca

SEQ ID NO: 296191 - DNA, 20 bp, Artificial Sequence
  chemically synthesized
agaaagtgcaatagagcaga

SEQ ID NO: 296192 - DNA, 20 bp, Artificial Sequence
  chemically synthesized
aaagtgcaatagagcagaga

SEQ ID NO: 296193 - DNA, 20 bp, Artificial Sequence
  chemically synthesized
tgcaatagagcagagagaga

SEQ ID NO: 296194 - DNA, 20 bp, Artificial Sequence
  chemically synthesized
atagagcagagagagaaaga

SEQ ID NO: 296195 - DNA, 20 bp, Artificial Sequence
  chemically synthesized
gagcagagagagaaagatag

SEQ ID NO: 296196 - DNA, 20 bp, Artificial Sequence
  chemically synthesized
gagaaagatagaagaaaata

SEQ ID NO: 296197 - DNA, 20 bp, Artificial Sequence
  chemically synthesized
atagaagaaaatatagactc

SEQ ID NO: 296198 - DNA, 20 bp, Artificial Sequence
  chemically synthesized
tagaagaaaatatagactcg

SEQ ID NO: 296199 - DNA, 20 bp, Artificial Sequence
  chemically synthesized
acccagagtataggtacctc

SEQ ID NO: 296200 - DNA, 20 bp, Artificial Sequence
  chemically synthesized
gactcgaggtacctatactc

SEQ ID NO: 296201 - DNA, 20 bp, Artificial Sequence
  chemically synthesized
actcgaggtacctatactct

SEQ ID NO: 296202 - DNA, 20 bp, Artificial Sequence
  chemically synthesized
gtgtttactacccagagtat

SEQ ID NO: 296203 - DNA, 20 bp, Artificial Sequence
  chemically synthesized
tgtgtttactacccagagta

SEQ ID NO: 296204 - DNA, 20 bp, Artificial Sequence
  chemically synthesized
cgaggtacctatactctggg

SEQ ID NO: 296205 - DNA, 20 bp, Artificial Sequence
  chemically synthesized
ttatctgtgtttactaccca

SEQ ID NO: 296206 - DNA, 20 bp, Artificial Sequence
  chemically synthesized
tgttatctgtgtttactacc

SEQ ID NO: 296207 - DNA, 20 bp, Artificial Sequence
  chemically synthesized
tatactctgggtagtaaaca

SEQ ID NO: 296208 - DNA, 20 bp, Artificial Sequence
  chemically synthesized
tgggtagtaaacacagataa

SEQ ID NO: 296209 - DNA, 20 bp, Artificial Sequence
  chemically synthesized
ggtagtaaacacagataaca

SEQ ID NO: 296210 - DNA, 20 bp, Artificial Sequence
  chemically synthesized
gtaaacacagataacagaga

SEQ ID NO: 296211 - DNA, 20 bp, Artificial Sequence
  chemically synthesized
taaacacagataacagagat

SEQ ID NO: 296212 - DNA, 20 bp, Artificial Sequence
  chemically synthesized
aacacagataacagagatag

SEQ ID NO: 296213 - DNA, 20 bp, Artificial Sequence
  chemically synthesized
ataacagagataggagaaat

SEQ ID NO: 296214 - DNA, 20 bp, Artificial Sequence
  chemically synthesized
acagagataggagaaattgg

SEQ ID NO: 296215 - DNA, 20 bp, Artificial Sequence
  chemically synthesized
gagaaattggaagcattaac

SEQ ID NO: 296216 - DNA, 20 bp, Artificial Sequence
  chemically synthesized
cccgctggaaatcatcaagc

SEQ ID NO: 296217 - DNA, 20 bp, Artificial Sequence
  chemically synthesized
aactcccgctggaaatcatc

SEQ ID NO: 296218 - DNA, 20 bp, Artificial Sequence
  chemically synthesized
ttaactggcttgatgatttc

SEQ ID NO: 296219 - DNA, 20 bp, Artificial Sequence
  chemically synthesized
actggcttgatgatttccag

SEQ ID NO: 296220 - DNA, 20 bp, Artificial Sequence
  chemically synthesized
ctggcttgatgatttccagc

SEQ ID NO: 296221 - DNA, 20 bp, Artificial Sequence
  chemically synthesized
ggcttgatgatttccagcgg

SEQ ID NO: 296222 - DNA, 20 bp, Artificial Sequence
  chemically synthesized
aactttttaccaactcccgc

SEQ ID NO: 296223 - DNA, 20 bp, Artificial Sequence
  chemically synthesized
tgatgatttccagcgggagt

SEQ ID NO: 296224 - DNA, 20 bp, Artificial Sequence
  chemically synthesized
ttccagcgggagttggtaaa

SEQ ID NO: 296225 - DNA, 20 bp, Artificial Sequence
  chemically synthesized
tggtaaaaagttgattctga

SEQ ID NO: 296226 - DNA, 20 bp, Artificial Sequence
  chemically synthesized
gtaaaaagttgattctgaaa

SEQ ID NO: 296227 - DNA, 20 bp, Artificial Sequence
  chemically synthesized
taaaaagttgattctgaaag

SEQ ID NO: 296228 - DNA, 20 bp, Artificial Sequence
  chemically synthesized
aaaaagttgattctgaaaga

SEQ ID NO: 296229 - DNA, 20 bp, Artificial Sequence
  chemically synthesized
tgcacttgattaccctcttt

SEQ ID NO: 296230 - DNA, 20 bp, Artificial Sequence
  chemically synthesized
gattctgaaagagggtaatc

SEQ ID NO: 296231 - DNA, 20 bp, Artificial Sequence
  chemically synthesized
tgaaagagggtaatcaagtg

SEQ ID NO: 296232 - DNA, 20 bp, Artificial Sequence
  chemically synthesized
gggtaatcaagtgcagatcc

SEQ ID NO: 296233 - DNA, 20 bp, Artificial Sequence
  chemically synthesized
ggtaatcaagtgcagatccg

SEQ ID NO: 296234 - DNA, 20 bp, Artificial Sequence
  chemically synthesized
aatcaagtgcagatccgagg

SEQ ID NO: 296235 - DNA, 20 bp, Artificial Sequence
  chemically synthesized
tcaagtgcagatccgaggaa

SEQ ID NO: 296236 - DNA, 20 bp, Artificial Sequence
  chemically synthesized
tctggctttgggctcttcct

SEQ ID NO: 296237 - DNA, 20 bp, Artificial Sequence
  chemically synthesized
cagatccgaggaagagccca

SEQ ID NO: 296238 - DNA, 20 bp, Artificial Sequence
  chemically synthesized
tccgaggaagagcccaaagc

SEQ ID NO: 296239 - DNA, 20 bp, Artificial Sequence
  chemically synthesized
cgttatggtcatctggcttt

SEQ ID NO: 296240 - DNA, 20 bp, Artificial Sequence
  chemically synthesized
tcgttatggtcatctggctt

SEQ ID NO: 296241 - DNA, 20 bp, Artificial Sequence
  chemically synthesized
atcaagtcgttatggtcatc

SEQ ID NO: 296242 - DNA, 20 bp, Artificial Sequence
  chemically synthesized
ccctccctatcaagtcgtta

SEQ ID NO: 296243 - DNA, 20 bp, Artificial Sequence
  chemically synthesized
agatgaccataacgacttga

SEQ ID NO: 296244 - DNA, 20 bp, Artificial Sequence
  chemically synthesized
gatgaccataacgacttgat

SEQ ID NO: 296245 - DNA, 20 bp, Artificial Sequence
  chemically synthesized
atgaccataacgacttgata

SEQ ID NO: 296246 - DNA, 20 bp, Artificial Sequence
  chemically synthesized
gaccataacgacttgatagg

SEQ ID NO: 296247 - DNA, 20 bp, Artificial Sequence
  chemically synthesized
accataacgacttgataggg

SEQ ID NO: 296248 - DNA, 20 bp, Artificial Sequence
  chemically synthesized
ctcttgaaaccctccctatc

SEQ ID NO: 296249 - DNA, 20 bp, Artificial Sequence
  chemically synthesized
ccataacgacttgataggga

SEQ ID NO: 296250 - DNA, 20 bp, Artificial Sequence
  chemically synthesized
gacttgatagggagggtttc

SEQ ID NO: 296251 - DNA, 20 bp, Artificial Sequence
  chemically synthesized
cttgatagggagggtttcaa

SEQ ID NO: 296252 - DNA, 20 bp, Artificial Sequence
  chemically synthesized
agggtttcaagagaacctca

SEQ ID NO: 296253 - DNA, 20 bp, Artificial Sequence
  chemically synthesized
gtttcaagagaacctcacag

SEQ ID NO: 296254 - DNA, 20 bp, Artificial Sequence
  chemically synthesized
gaaaatctggagcttctgtg

SEQ ID NO: 296255 - DNA, 20 bp, Artificial Sequence
  chemically synthesized
tgaaaatctggagcttctgt

SEQ ID NO: 296256 - DNA, 20 bp, Artificial Sequence
  chemically synthesized
agagaacctcacagaagctc

SEQ ID NO: 296257 - DNA, 20 bp, Artificial Sequence
  chemically synthesized
ataaggtgtctgaaaatctg

SEQ ID NO: 296258 - DNA, 20 bp, Artificial Sequence
  chemically synthesized
tcacagaagctccagatttt

SEQ ID NO: 296259 - DNA, 20 bp, Artificial Sequence
  chemically synthesized
tgataaggtgtctgaaaatc

SEQ ID NO: 296260 - DNA, 20 bp, Artificial Sequence
  chemically synthesized
gatcacaaggggatttgata

SEQ ID NO: 296261 - DNA, 20 bp, Artificial Sequence
  chemically synthesized
tgatcacaaggggatttgat

SEQ ID NO: 296262 - DNA, 20 bp, Artificial Sequence
  chemically synthesized
tagcctcctttgatcacaag

SEQ ID NO: 296263 - DNA, 20 bp, Artificial Sequence
  chemically synthesized
atagcctcctttgatcacaa

SEQ ID NO: 296264 - DNA, 20 bp, Artificial Sequence
  chemically synthesized
aatagcctcctttgatcaca

SEQ ID NO: 296265 - DNA, 20 bp, Artificial Sequence
  chemically synthesized
atcaaatccccttgtgatca

SEQ ID NO: 296266 - DNA, 20 bp, Artificial Sequence
  chemically synthesized
aaatagcctcctttgatcac

SEQ ID NO: 296267 - DNA, 20 bp, Artificial Sequence
  chemically synthesized
tcaaatccccttgtgatcaa

SEQ ID NO: 296268 - DNA, 20 bp, Artificial Sequence
  chemically synthesized
aaatccccttgtgatcaaag

SEQ ID NO: 296269 - DNA, 20 bp, Artificial Sequence
  chemically synthesized
aatccccttgtgatcaaagg

SEQ ID NO: 296270 - DNA, 20 bp, Artificial Sequence
  chemically synthesized
aatgaaacaaacaaaaaaaa

SEQ ID NO: 296271 - DNA, 20 bp, Artificial Sequence
  chemically synthesized
gagcacatggtaacgcaaat

SEQ ID NO: 296272 - DNA, 20 bp, Artificial Sequence
  chemically synthesized
gaattttttccgtgagcaca

SEQ ID NO: 296273 - DNA, 20 bp, Artificial Sequence
  chemically synthesized
tttgcgttaccatgtgctca

SEQ ID NO: 296274 - DNA, 20 bp, Artificial Sequence
  chemically synthesized
acaactcgaattttttccgt

SEQ ID NO: 296275 - DNA, 20 bp, Artificial Sequence
  chemically synthesized
tgtgctcacggaaaaaattc

SEQ ID NO: 296276 - DNA, 20 bp, Artificial Sequence
  chemically synthesized
acggaaaaaattcgagttgt

SEQ ID NO: 296277 - DNA, 20 bp, Artificial Sequence
  chemically synthesized
gttgttagaatctgttaatt

SEQ ID NO: 296278 - DNA, 20 bp, Artificial Sequence
  chemically synthesized
agactttttagctgaattaa

SEQ ID NO: 296279 - DNA, 20 bp, Artificial Sequence
  chemically synthesized
aatctgttaattcagctaaa

SEQ ID NO: 296280 - DNA, 20 bp, Artificial Sequence
  chemically synthesized
tcactgcagttcagactttt

SEQ ID NO: 296281 - DNA, 20 bp, Artificial Sequence
  chemically synthesized
cagctaaaaagtctgaactg

SEQ ID NO: 296282 - DNA, 20 bp, Artificial Sequence
  chemically synthesized
cttttagtatcactgcagtt

SEQ ID NO: 296283 - DNA, 20 bp, Artificial Sequence
  chemically synthesized
acattcttttagtatcactg

SEQ ID NO: 296284 - DNA, 20 bp, Artificial Sequence
  chemically synthesized
ctgaactgcagtgatactaa

SEQ ID NO: 296285 - DNA, 20 bp, Artificial Sequence
  chemically synthesized
agttacctctcacattcttt

SEQ ID NO: 296286 - DNA, 20 bp, Artificial Sequence
  chemically synthesized
cagtgatactaaaagaatgt

SEQ ID NO: 296287 - DNA, 20 bp, Artificial Sequence
  chemically synthesized
gtgatactaaaagaatgtga

SEQ ID NO: 296288 - DNA, 20 bp, Artificial Sequence
  chemically synthesized
tgatactaaaagaatgtgag

SEQ ID NO: 296289 - DNA, 20 bp, Artificial Sequence
  chemically synthesized
tgagaggtaactgctacgta

SEQ ID NO: 296290 - DNA, 20 bp, Artificial Sequence
  chemically synthesized
caatcttgggctttacgtag

SEQ ID NO: 296291 - DNA, 20 bp, Artificial Sequence
  chemically synthesized
acacaatcttgggctttacg

SEQ ID NO: 296292 - DNA, 20 bp, Artificial Sequence
  chemically synthesized
gtaactgctacgtaaagccc

SEQ ID NO: 296293 - DNA, 20 bp, Artificial Sequence
  chemically synthesized
atattctaggacacaatctt

SEQ ID NO: 296294 - DNA, 20 bp, Artificial Sequence
  chemically synthesized
aatattctaggacacaatct

SEQ ID NO: 296295 - DNA, 20 bp, Artificial Sequence
  chemically synthesized
taaagcccaagattgtgtcc

SEQ ID NO: 296296 - DNA, 20 bp, Artificial Sequence
  chemically synthesized
ggctcgagaatcaatattct

SEQ ID NO: 296297 - DNA, 20 bp, Artificial Sequence
  chemically synthesized
aggctcgagaatcaatattc

SEQ ID NO: 296298 - DNA, 20 bp, Artificial Sequence
  chemically synthesized
gtcctagaatattgattctc

SEQ ID NO: 296299 - DNA, 20 bp, Artificial Sequence
  chemically synthesized
tcctatgcacataaaggctc

SEQ ID NO: 296300 - DNA, 20 bp, Artificial Sequence
  chemically synthesized
agtgattcctatgcacataa

SEQ ID NO: 296301 - DNA, 20 bp, Artificial Sequence
  chemically synthesized
gagtgattcctatgcacata

SEQ ID NO: 296302 - DNA, 20 bp, Artificial Sequence
  chemically synthesized
ttctcgagcctttatgtgca

SEQ ID NO: 296303 - DNA, 20 bp, Artificial Sequence
  chemically synthesized
tctcgagcctttatgtgcat

SEQ ID NO: 296304 - DNA, 20 bp, Artificial Sequence
  chemically synthesized
atgtgcataggaatcactcc

SEQ ID NO: 296305 - DNA, 20 bp, Artificial Sequence
  chemically synthesized
tgcctttgaacattttccag

SEQ ID NO: 296306 - DNA, 20 bp, Artificial Sequence
  chemically synthesized
tttgcctttgaacattttcc

SEQ ID NO: 296307 - DNA, 20 bp, Artificial Sequence
  chemically synthesized
atttgcctttgaacattttc

SEQ ID NO: 296308 - DNA, 20 bp, Artificial Sequence
  chemically synthesized
tcactcctggaaaatgttca

SEQ ID NO: 296309 - DNA, 20 bp, Artificial Sequence
  chemically synthesized
cactcctggaaaatgttcaa

SEQ ID NO: 296310 - DNA, 20 bp, Artificial Sequence
  chemically synthesized
aaaggcaaattttgatttac

SEQ ID NO: 296311 - DNA, 20 bp, Artificial Sequence
  chemically synthesized
aattttgatttactagttct

SEQ ID NO: 296312 - DNA, 20 bp, Artificial Sequence
  chemically synthesized
gaaatatagaatctcagaac

SEQ ID NO: 296313 - DNA, 20 bp, Artificial Sequence
  chemically synthesized
ttgtcagaaatatagaatct

SEQ ID NO: 296314 - DNA, 20 bp, Artificial Sequence
  chemically synthesized
ctgggagcttgtcagaaata

SEQ ID NO: 296315 - DNA, 20 bp, Artificial Sequence
  chemically synthesized
tgagattctatatttctgac

SEQ ID NO: 296316 - DNA, 20 bp, Artificial Sequence
  chemically synthesized
gacattatctgggagcttgt

SEQ ID NO: 296317 - DNA, 20 bp, Artificial Sequence
  chemically synthesized
ctatatttctgacaagctcc

SEQ ID NO: 296318 - DNA, 20 bp, Artificial Sequence
  chemically synthesized
ccaatattgacattatctgg

SEQ ID NO: 296319 - DNA, 20 bp, Artificial Sequence
  chemically synthesized
caccaatattgacattatct

SEQ ID NO: 296320 - DNA, 20 bp, Artificial Sequence
  chemically synthesized
ccaccaatattgacattatc

SEQ ID NO: 296321 - DNA, 20 bp, Artificial Sequence
  chemically synthesized
ctcccagataatgtcaatat

SEQ ID NO: 296322 - DNA, 20 bp, Artificial Sequence
  chemically synthesized
ccagataatgtcaatattgg

SEQ ID NO: 296323 - DNA, 20 bp, Artificial Sequence
  chemically synthesized
taatgtcaatattggtggtc

SEQ ID NO: 296324 - DNA, 20 bp, Artificial Sequence
  chemically synthesized
aatgtcaatattggtggtcc

SEQ ID NO: 296325 - DNA, 20 bp, Artificial Sequence
  chemically synthesized
atgtcaatattggtggtcca

SEQ ID NO: 296326 - DNA, 20 bp, Artificial Sequence
  chemically synthesized
ctttctaatcaaaatgtccc

SEQ ID NO: 296327 - DNA, 20 bp, Artificial Sequence
  chemically synthesized
tggtccagggacattttgat

SEQ ID NO: 296328 - DNA, 20 bp, Artificial Sequence
  chemically synthesized
ccagggacattttgattaga

SEQ ID NO: 296329 - DNA, 20 bp, Artificial Sequence
  chemically synthesized
cagggacattttgattagaa

SEQ ID NO: 296330 - DNA, 20 bp, Artificial Sequence
  chemically synthesized
ttttgattagaaaggtcccc

SEQ ID NO: 296331 - DNA, 20 bp, Artificial Sequence
  chemically synthesized
tgattagaaaggtcccccag

SEQ ID NO: 296332 - DNA, 20 bp, Artificial Sequence
  chemically synthesized
atttaaaagctgacttctgg

SEQ ID NO: 296333 - DNA, 20 bp, Artificial Sequence
  chemically synthesized
tagaaaggtcccccagaagt

SEQ ID NO: 296334 - DNA, 20 bp, Artificial Sequence
  chemically synthesized
tatttaaaagctgacttctg

SEQ ID NO: 296335 - DNA, 20 bp, Artificial Sequence
  chemically synthesized
ttatttaaaagctgacttct

SEQ ID NO: 296336 - DNA, 20 bp, Artificial Sequence
  chemically synthesized
cttatttaaaagctgacttc

SEQ ID NO: 296337 - DNA, 20 bp, Artificial Sequence
  chemically synthesized
ccagaagtcagcttttaaat

SEQ ID NO: 296338 - DNA, 20 bp, Artificial Sequence
  chemically synthesized
aacaaaatgcacttatttaa

SEQ ID NO: 296339 - DNA, 20 bp, Artificial Sequence
  chemically synthesized
aattatatgaataaaacaca

SEQ ID NO: 296340 - DNA, 20 bp, Artificial Sequence
  chemically synthesized
aaaacacatggtgaatatac

SEQ ID NO: 296341 - DNA, 20 bp, Artificial Sequence
  chemically synthesized
aaacacatggtgaatataca

SEQ ID NO: 296342 - DNA, 20 bp, Artificial Sequence
  chemically synthesized
tacaaggaaaaaattatgct

SEQ ID NO: 296343 - DNA, 20 bp, Artificial Sequence
  chemically synthesized
acaaggaaaaaattatgctt

SEQ ID NO: 296344 - DNA, 20 bp, Artificial Sequence
  chemically synthesized
aaaatgcaacttttaaacct

SEQ ID NO: 296345 - DNA, 20 bp, Artificial Sequence
  chemically synthesized
aaaattatgcttaggtttaa

SEQ ID NO: 296346 - DNA, 20 bp, Artificial Sequence
  chemically synthesized
atgtgaaattgaactgataa

SEQ ID NO: 296347 - DNA, 20 bp, Artificial Sequence
  chemically synthesized
agcatatcataggccattat

SEQ ID NO: 296348 - DNA, 20 bp, Artificial Sequence
  chemically synthesized
ttagccagttagcatatcat

SEQ ID NO: 296349 - DNA, 20 bp, Artificial Sequence
  chemically synthesized
tttagccagttagcatatca

SEQ ID NO: 296350 - DNA, 20 bp, Artificial Sequence
  chemically synthesized
atggcctatgatatgctaac

SEQ ID NO: 296351 - DNA, 20 bp, Artificial Sequence
  chemically synthesized
ttcaaatgcttttagccagt

SEQ ID NO: 296352 - DNA, 20 bp, Artificial Sequence
  chemically synthesized
atgatatgctaactggctaa

SEQ ID NO: 296353 - DNA, 20 bp, Artificial Sequence
  chemically synthesized
tcctttcaaatgcttttagc

SEQ ID NO: 296354 - DNA, 20 bp, Artificial Sequence
  chemically synthesized
ttactcctttcaaatgcttt

SEQ ID NO: 296355 - DNA, 20 bp, Artificial Sequence
  chemically synthesized
aactggctaaaagcatttga

SEQ ID NO: 296356 - DNA, 20 bp, Artificial Sequence
  chemically synthesized
actggctaaaagcatttgaa

SEQ ID NO: 296357 - DNA, 20 bp, Artificial Sequence
  chemically synthesized
tggctaaaagcatttgaaag

SEQ ID NO: 296358 - DNA, 20 bp, Artificial Sequence
  chemically synthesized
gcatttgaaaggagtaaatg

SEQ ID NO: 296359 - DNA, 20 bp, Artificial Sequence
  chemically synthesized
aaggagtaaatgaagaaatc

SEQ ID NO: 296360 - DNA, 20 bp, Artificial Sequence
  chemically synthesized
agaaatcaagtgaaaaaaaa

SEQ ID NO: 296361 - DNA, 20 bp, Artificial Sequence
  chemically synthesized
aaatcaagtgaaaaaaaaaa

SEQ ID NO: 296362 - DNA, 20 bp, Artificial Sequence
  chemically synthesized
caagtgaaaaaaaaaagagt

SEQ ID NO: 296363 - DNA, 20 bp, Artificial Sequence
  chemically synthesized
aaaaaagagttggtaatatt

SEQ ID NO: 296364 - DNA, 20 bp, Artificial Sequence
  chemically synthesized
ttttaggctttcattaaaaa

SEQ ID NO: 296365 - DNA, 20 bp, Artificial Sequence
  chemically synthesized
tatttagccatttttaatga

SEQ ID NO: 296366 - DNA, 20 bp, Artificial Sequence
  chemically synthesized
ttttaatgaaagcctaaaaa

SEQ ID NO: 296367 - DNA, 20 bp, Artificial Sequence
  chemically synthesized
agtggtattaatccattttt

SEQ ID NO: 296368 - DNA, 20 bp, Artificial Sequence
  chemically synthesized
gagtggtattaatccatttt

SEQ ID NO: 296369 - DNA, 20 bp, Artificial Sequence
  chemically synthesized
aaaatggattaataccactc

SEQ ID NO: 296370 - DNA, 20 bp, Artificial Sequence
  chemically synthesized
gctcgtgtcatgaacttgag

SEQ ID NO: 296371 - DNA, 20 bp, Artificial Sequence
  chemically synthesized
caggctcgtgtcatgaactt

SEQ ID NO: 296372 - DNA, 20 bp, Artificial Sequence
  chemically synthesized
accactcaagttcatgacac

SEQ ID NO: 296373 - DNA, 20 bp, Artificial Sequence
  chemically synthesized
tcatgacacgagcctgccat

SEQ ID NO: 296374 - DNA, 20 bp, Artificial Sequence
  chemically synthesized
ggttattttaaactcatggc

SEQ ID NO: 296375 - DNA, 20 bp, Artificial Sequence
  chemically synthesized
aggttattttaaactcatgg

SEQ ID NO: 296376 - DNA, 20 bp, Artificial Sequence
  chemically synthesized
tataggttattttaaactca

SEQ ID NO: 296377 - DNA, 20 bp, Artificial Sequence
  chemically synthesized
catcacctgtcggtttatat

SEQ ID NO: 296378 - DNA, 20 bp, Artificial Sequence
  chemically synthesized
acatcacctgtcggtttata

SEQ ID NO: 296379 - DNA, 20 bp, Artificial Sequence
  chemically synthesized
aaataacctatataaaccga

SEQ ID NO: 296380 - DNA, 20 bp, Artificial Sequence
  chemically synthesized
aataacctatataaaccgac

SEQ ID NO: 296381 - DNA, 20 bp, Artificial Sequence
  chemically synthesized
tttcttactacatcacctgt

SEQ ID NO: 296382 - DNA, 20 bp, Artificial Sequence
  chemically synthesized
atataaaccgacaggtgatg

SEQ ID NO: 296383 - DNA, 20 bp, Artificial Sequence
  chemically synthesized
aaaccgacaggtgatgtagt

SEQ ID NO: 296384 - DNA, 20 bp, Artificial Sequence
  chemically synthesized
tgatgtagtaagaaaattaa

SEQ ID NO: 296385 - DNA, 20 bp, Artificial Sequence
  chemically synthesized
cgatgatggatattcagttt

SEQ ID NO: 296386 - DNA, 20 bp, Artificial Sequence
  chemically synthesized
acgatgatggatattcagtt

SEQ ID NO: 296387 - DNA, 20 bp, Artificial Sequence
  chemically synthesized
taattacgatgatggatatt

SEQ ID NO: 296388 - DNA, 20 bp, Artificial Sequence
  chemically synthesized
gaaatacataattacgatga

SEQ ID NO: 296389 - DNA, 20 bp, Artificial Sequence
  chemically synthesized
cgtaattatgtatttctctc

SEQ ID NO: 296390 - DNA, 20 bp, Artificial Sequence
  chemically synthesized
gtaattatgtatttctctca

SEQ ID NO: 296391 - DNA, 20 bp, Artificial Sequence
  chemically synthesized
tatgtattaaaaatccttga

SEQ ID NO: 296392 - DNA, 20 bp, Artificial Sequence
  chemically synthesized
tatatgtattaaaaatcctt

SEQ ID NO: 296393 - DNA, 20 bp, Artificial Sequence
  chemically synthesized
taatacatatacattgtatt

SEQ ID NO: 296394 - DNA, 20 bp, Artificial Sequence
  chemically synthesized
atatacattgtatttagcct

SEQ ID NO: 296395 - DNA, 20 bp, Artificial Sequence
  chemically synthesized
tatacattgtatttagcctg

SEQ ID NO: 296396 - DNA, 20 bp, Artificial Sequence
  chemically synthesized
atacattgtatttagcctga

SEQ ID NO: 296397 - DNA, 20 bp, Artificial Sequence
  chemically synthesized
tttaccttgatgtttccctc

SEQ ID NO: 296398 - DNA, 20 bp, Artificial Sequence
  chemically synthesized
atttaccttgatgtttccct

SEQ ID NO: 296399 - DNA, 20 bp, Artificial Sequence
  chemically synthesized
tttagcctgagggaaacatc

SEQ ID NO: 296400 - DNA, 20 bp, Artificial Sequence
  chemically synthesized
ttagcctgagggaaacatca

SEQ ID NO: 296401 - DNA, 20 bp, Artificial Sequence
  chemically synthesized
aatcatttcatgtcccattt

SEQ ID NO: 296402 - DNA, 20 bp, Artificial Sequence
  chemically synthesized
catttcatgtcccattttag

SEQ ID NO: 296403 - DNA, 20 bp, Artificial Sequence
  chemically synthesized
tcttaattgcctactaaaat

SEQ ID NO: 296404 - DNA, 20 bp, Artificial Sequence
  chemically synthesized
atttcatgtcccattttagt

SEQ ID NO: 296405 - DNA, 20 bp, Artificial Sequence
  chemically synthesized
ttcttaattgcctactaaaa

SEQ ID NO: 296406 - DNA, 20 bp, Artificial Sequence
  chemically synthesized
tcccattttagtaggcaatt

SEQ ID NO: 296407 - DNA, 20 bp, Artificial Sequence
  chemically synthesized
taagaatgatgttgttattt

SEQ ID NO: 296408 - DNA, 20 bp, Artificial Sequence
  chemically synthesized
atgttgttatttcagaaaat

SEQ ID NO: 296409 - DNA, 20 bp, Artificial Sequence
  chemically synthesized
gttgttatttcagaaaatga

SEQ ID NO: 296410 - DNA, 20 bp, Artificial Sequence
  chemically synthesized
tatttcagaaaatgagagtt

SEQ ID NO: 296411 - DNA, 20 bp, Artificial Sequence
  chemically synthesized
atttcagaaaatgagagttc

SEQ ID NO: 296412 - DNA, 20 bp, Artificial Sequence
  chemically synthesized
aatgagagttcaggttgata

SEQ ID NO: 296413 - DNA, 20 bp, Artificial Sequence
  chemically synthesized
atgagagttcaggttgataa

SEQ ID NO: 296414 - DNA, 20 bp, Artificial Sequence
  chemically synthesized
tgagagttcaggttgataaa

SEQ ID NO: 296415 - DNA, 20 bp, Artificial Sequence
  chemically synthesized
gagagttcaggttgataaag

SEQ ID NO: 296416 - DNA, 20 bp, Artificial Sequence
  chemically synthesized
ggttgataaaggggactcac

SEQ ID NO: 296417 - DNA, 20 bp, Artificial Sequence
  chemically synthesized
gttgataaaggggactcaca

SEQ ID NO: 296418 - DNA, 20 bp, Artificial Sequence
  chemically synthesized
ctggttttctgataccttgt

SEQ ID NO: 296419 - DNA, 20 bp, Artificial Sequence
  chemically synthesized
aaaggggactcacaaggtat

SEQ ID NO: 296420 - DNA, 20 bp, Artificial Sequence
  chemically synthesized
ctcacaaggtatcagaaaac

SEQ ID NO: 296421 - DNA, 20 bp, Artificial Sequence
  chemically synthesized
aatgtacagtgttttataac

SEQ ID NO: 296422 - DNA, 20 bp, Artificial Sequence
  chemically synthesized
taaaagtgctcaaaaatgta

SEQ ID NO: 296423 - DNA, 20 bp, Artificial Sequence
  chemically synthesized
ataaaacactgtacattttt

SEQ ID NO: 296424 - DNA, 20 bp, Artificial Sequence
  chemically synthesized
tgtacatttttgagcacttt

SEQ ID NO: 296425 - DNA, 20 bp, Artificial Sequence
  chemically synthesized
gcgggagcatgacagactaa

SEQ ID NO: 296426 - DNA, 20 bp, Artificial Sequence
  chemically synthesized
tatcaatagcgggagcatga

SEQ ID NO: 296427 - DNA, 20 bp, Artificial Sequence
  chemically synthesized
ttgcattttatcaatagcgg

SEQ ID NO: 296428 - DNA, 20 bp, Artificial Sequence
  chemically synthesized
atttgcattttatcaatagc

SEQ ID NO: 296429 - DNA, 20 bp, Artificial Sequence
  chemically synthesized
gatttgcattttatcaatag

SEQ ID NO: 296430 - DNA, 20 bp, Artificial Sequence
  chemically synthesized
aacgatttgcattttatcaa

SEQ ID NO: 296431 - DNA, 20 bp, Artificial Sequence
  chemically synthesized
gataaaatgcaaatcgttca

SEQ ID NO: 296432 - DNA, 20 bp, Artificial Sequence
  chemically synthesized
ataaaatgcaaatcgttcat

SEQ ID NO: 296433 - DNA, 20 bp, Artificial Sequence
  chemically synthesized
taaaagttcctgttatcatg

SEQ ID NO: 296434 - DNA, 20 bp, Artificial Sequence
  chemically synthesized
cataggtaaccacatgataa

SEQ ID NO: 296435 - DNA, 20 bp, Artificial Sequence
  chemically synthesized
ataggtaaccacatgataac

SEQ ID NO: 296436 - DNA, 20 bp, Artificial Sequence
  chemically synthesized
ttcaggaatataaattttaa

SEQ ID NO: 296437 - DNA, 20 bp, Artificial Sequence
  chemically synthesized
aaattgagtttcagtatttc

SEQ ID NO: 296438 - DNA, 20 bp, Artificial Sequence
  chemically synthesized
aaaattgagtttcagtattt

SEQ ID NO: 296439 - DNA, 20 bp, Artificial Sequence
  chemically synthesized
caggcaggaaaattgagttt

SEQ ID NO: 296440 - DNA, 20 bp, Artificial Sequence
  chemically synthesized
tttgatcaggcaggaaaatt

SEQ ID NO: 296441 - DNA, 20 bp, Artificial Sequence
  chemically synthesized
taagacagctttgatcaggc

SEQ ID NO: 296442 - DNA, 20 bp, Artificial Sequence
  chemically synthesized
ttaagacagctttgatcagg

SEQ ID NO: 296443 - DNA, 20 bp, Artificial Sequence
  chemically synthesized
tcaattttcctgcctgatca

SEQ ID NO: 296444 - DNA, 20 bp, Artificial Sequence
  chemically synthesized
atcttaagacagctttgatc

SEQ ID NO: 296445 - DNA, 20 bp, Artificial Sequence
  chemically synthesized
tatcttaagacagctttgat

SEQ ID NO: 296446 - DNA, 20 bp, Artificial Sequence
  chemically synthesized
tgcctgatcaaagctgtctt

SEQ ID NO: 296447 - DNA, 20 bp, Artificial Sequence
  chemically synthesized
tctgtttctttatcttaaga

SEQ ID NO: 296448 - DNA, 20 bp, Artificial Sequence
  chemically synthesized
atcaaagctgtcttaagata

SEQ ID NO: 296449 - DNA, 20 bp, Artificial Sequence
  chemically synthesized
atactctgtttctttatctt

SEQ ID NO: 296450 - DNA, 20 bp, Artificial Sequence
  chemically synthesized
gctgtcttaagataaagaaa

SEQ ID NO: 296451 - DNA, 20 bp, Artificial Sequence
  chemically synthesized
tgtcttaagataaagaaaca

SEQ ID NO: 296452 - DNA, 20 bp, Artificial Sequence
  chemically synthesized
aagataaagaaacagagtat

SEQ ID NO: 296453 - DNA, 20 bp, Artificial Sequence
  chemically synthesized
taaagaaacagagtatcaga

SEQ ID NO: 296454 - DNA, 20 bp, Artificial Sequence
  chemically synthesized
agtatcagacagaaacctgt

SEQ ID NO: 296455 - DNA, 20 bp, Artificial Sequence
  chemically synthesized
attattgatctgattctcac

SEQ ID NO: 296456 - DNA, 20 bp, Artificial Sequence
  chemically synthesized
agacagaaacctgtgagaat

SEQ ID NO: 296457 - DNA, 20 bp, Artificial Sequence
  chemically synthesized
gattattgatctgattctca

SEQ ID NO: 296458 - DNA, 20 bp, Artificial Sequence
  chemically synthesized
gatcaataatcatttttaat

SEQ ID NO: 296459 - DNA, 20 bp, Artificial Sequence
  chemically synthesized
aatcacctttagcattttat

SEQ ID NO: 296460 - DNA, 20 bp, Artificial Sequence
  chemically synthesized
aattagctaataaaatgcta

SEQ ID NO: 296461 - DNA, 20 bp, Artificial Sequence
  chemically synthesized
attagctaataaaatgctaa

SEQ ID NO: 296462 - DNA, 20 bp, Artificial Sequence
  chemically synthesized
ctgaaagtatgaatcacctt

SEQ ID NO: 296463 - DNA, 20 bp, Artificial Sequence
  chemically synthesized
ctaaaggtgattcatacttt

SEQ ID NO: 296464 - DNA, 20 bp, Artificial Sequence
  chemically synthesized
aaggtgattcatactttcag

SEQ ID NO: 296465 - DNA, 20 bp, Artificial Sequence
  chemically synthesized
gttacatatttgaccactga

SEQ ID NO: 296466 - DNA, 20 bp, Artificial Sequence
  chemically synthesized
gtaacatgatgtttgaaaat

SEQ ID NO: 296467 - DNA, 20 bp, Artificial Sequence
  chemically synthesized
aacatgatgtttgaaaatta

SEQ ID NO: 296468 - DNA, 20 bp, Artificial Sequence
  chemically synthesized
tagtagtagaaaattaatta

SEQ ID NO: 296469 - DNA, 20 bp, Artificial Sequence
  chemically synthesized
cttagtagtagaaaattaat

SEQ ID NO: 296470 - DNA, 20 bp, Artificial Sequence
  chemically synthesized
ctaattaattttctactact

SEQ ID NO: 296471 - DNA, 20 bp, Artificial Sequence
  chemically synthesized
aattaattttctactactaa

SEQ ID NO: 296472 - DNA, 20 bp, Artificial Sequence
  chemically synthesized
gagggaaattctcttagtag

SEQ ID NO: 296473 - DNA, 20 bp, Artificial Sequence
  chemically synthesized
tttgagggaaattctcttag

SEQ ID NO: 296474 - DNA, 20 bp, Artificial Sequence
  chemically synthesized
atttttgagggaaattctct

SEQ ID NO: 296475 - DNA, 20 bp, Artificial Sequence
  chemically synthesized
ttgtttgctgtgatttttga

SEQ ID NO: 296476 - DNA, 20 bp, Artificial Sequence
  chemically synthesized
attgtttgctgtgatttttg

SEQ ID NO: 296477 - DNA, 20 bp, Artificial Sequence
  chemically synthesized
aattgtttgctgtgattttt

SEQ ID NO: 296478 - DNA, 20 bp, Artificial Sequence
  chemically synthesized
agaatttccctcaaaaatca

SEQ ID NO: 296479 - DNA, 20 bp, Artificial Sequence
  chemically synthesized
cagcaaacaatttaccttca

SEQ ID NO: 296480 - DNA, 20 bp, Artificial Sequence
  chemically synthesized
caaacaatttaccttcaaag

SEQ ID NO: 296481 - DNA, 20 bp, Artificial Sequence
  chemically synthesized
tttcaagtatacttctttga

SEQ ID NO: 296482 - DNA, 20 bp, Artificial Sequence
  chemically synthesized
ttttcaagtatacttctttg

SEQ ID NO: 296483 - DNA, 20 bp, Artificial Sequence
  chemically synthesized
caaagaagtatacttgaaaa

SEQ ID NO: 296484 - DNA, 20 bp, Artificial Sequence
  chemically synthesized
ttagctaaatgtcttttttc

SEQ ID NO: 296485 - DNA, 20 bp, Artificial Sequence
  chemically synthesized
tatacttgaaaaaagacatt

SEQ ID NO: 296486 - DNA, 20 bp, Artificial Sequence
  chemically synthesized
aatatataattgtagaaaat

SEQ ID NO: 296487 - DNA, 20 bp, Artificial Sequence
  chemically synthesized
tgaaagataatatataattg

SEQ ID NO: 296488 - DNA, 20 bp, Artificial Sequence
  chemically synthesized
tacaattatatattatcttt

SEQ ID NO: 296489 - DNA, 20 bp, Artificial Sequence
  chemically synthesized
atgggaaatatgaaaactga

SEQ ID NO: 296490 - DNA, 20 bp, Artificial Sequence
  chemically synthesized
tctaaattgtttcaagaaat

SEQ ID NO: 296491 - DNA, 20 bp, Artificial Sequence
  chemically synthesized
ttctaaattgtttcaagaaa

SEQ ID NO: 296492 - DNA, 20 bp, Artificial Sequence
  chemically synthesized
agactattctaaattgtttc

SEQ ID NO: 296493 - DNA, 20 bp, Artificial Sequence
  chemically synthesized
tcccatttcttgaaacaatt

SEQ ID NO: 296494 - DNA, 20 bp, Artificial Sequence
  chemically synthesized
tttcttgaaacaatttagaa

SEQ ID NO: 296495 - DNA, 20 bp, Artificial Sequence
  chemically synthesized
tgctgttgtcagcattataa

SEQ ID NO: 296496 - DNA, 20 bp, Artificial Sequence
  chemically synthesized
gtctattataatgctgacaa

SEQ ID NO: 296497 - DNA, 20 bp, Artificial Sequence
  chemically synthesized
tttataagacatgctgttgt

SEQ ID NO: 296498 - DNA, 20 bp, Artificial Sequence
  chemically synthesized
tgacaacagcatgtcttata

SEQ ID NO: 296499 - DNA, 20 bp, Artificial Sequence
  chemically synthesized
aaattacttattagctttat

SEQ ID NO: 296500 - DNA, 20 bp, Artificial Sequence
  chemically synthesized
gcatgtcttataaagctaat

SEQ ID NO: 296501 - DNA, 20 bp, Artificial Sequence
  chemically synthesized
agctattttaaattacttat

SEQ ID NO: 296502 - DNA, 20 bp, Artificial Sequence
  chemically synthesized
agctaataagtaatttaaaa

SEQ ID NO: 296503 - DNA, 20 bp, Artificial Sequence
  chemically synthesized
ttaactacttataaattgga

SEQ ID NO: 296504 - DNA, 20 bp, Artificial Sequence
  chemically synthesized
aaaatagctttccaatttat

SEQ ID NO: 296505 - DNA, 20 bp, Artificial Sequence
  chemically synthesized
agagttaactacttataaat

SEQ ID NO: 296506 - DNA, 20 bp, Artificial Sequence
  chemically synthesized
atagctttccaatttataag

SEQ ID NO: 296507 - DNA, 20 bp, Artificial Sequence
  chemically synthesized
atttataagtagttaactct

SEQ ID NO: 296508 - DNA, 20 bp, Artificial Sequence
  chemically synthesized
tataagtagttaactctaag

SEQ ID NO: 296509 - DNA, 20 bp, Artificial Sequence
  chemically synthesized
tttgtcaccagttcttctta

SEQ ID NO: 296510 - DNA, 20 bp, Artificial Sequence
  chemically synthesized
attttgtcaccagttcttct

SEQ ID NO: 296511 - DNA, 20 bp, Artificial Sequence
  chemically synthesized
tagttaactctaagaagaac

SEQ ID NO: 296512 - DNA, 20 bp, Artificial Sequence
  chemically synthesized
agggaagacaattttgtcac

SEQ ID NO: 296513 - DNA, 20 bp, Artificial Sequence
  chemically synthesized
ttaggctgcttgaaaaaggg

SEQ ID NO: 296514 - DNA, 20 bp, Artificial Sequence
  chemically synthesized
aaaattgtcttccctttttc

SEQ ID NO: 296515 - DNA, 20 bp, Artificial Sequence
  chemically synthesized
tttttaggctgcttgaaaaa

SEQ ID NO: 296516 - DNA, 20 bp, Artificial Sequence
  chemically synthesized
ttttttaggctgcttgaaaa

SEQ ID NO: 296517 - DNA, 20 bp, Artificial Sequence
  chemically synthesized
attgtcttccctttttcaag

SEQ ID NO: 296518 - DNA, 20 bp, Artificial Sequence
  chemically synthesized
attttttaggctgcttgaaa

SEQ ID NO: 296519 - DNA, 20 bp, Artificial Sequence
  chemically synthesized
ttttcaagcagcctaaaaaa

SEQ ID NO: 296520 - DNA, 20 bp, Artificial Sequence
  chemically synthesized
ggaaaaaaaatctatttttt

SEQ ID NO: 296521 - DNA, 20 bp, Artificial Sequence
  chemically synthesized
tggaaaaaaaatctattttt

SEQ ID NO: 296522 - DNA, 20 bp, Artificial Sequence
  chemically synthesized
taaaaaatagattttttttc

SEQ ID NO: 296523 - DNA, 20 bp, Artificial Sequence
  chemically synthesized
caaaagatatatatatattc

SEQ ID NO: 296524 - DNA, 20 bp, Artificial Sequence
  chemically synthesized
gaacttttggagatcaacaa

SEQ ID NO: 296525 - DNA, 20 bp, Artificial Sequence
  chemically synthesized
tatcttttgttgatctccaa

SEQ ID NO: 296526 - DNA, 20 bp, Artificial Sequence
  chemically synthesized
tgttggggttggaacttttg

SEQ ID NO: 296527 - DNA, 20 bp, Artificial Sequence
  chemically synthesized
gctgttggggttggaacttt

SEQ ID NO: 296528 - DNA, 20 bp, Artificial Sequence
  chemically synthesized
tccaaaagttccaaccccaa

SEQ ID NO: 296529 - DNA, 20 bp, Artificial Sequence
  chemically synthesized
ctaatgtttgctgttggggt

SEQ ID NO: 296530 - DNA, 20 bp, Artificial Sequence
  chemically synthesized
caagctaatgtttgctgttg

SEQ ID NO: 296531 - DNA, 20 bp, Artificial Sequence
  chemically synthesized
acaagctaatgtttgctgtt

SEQ ID NO: 296532 - DNA, 20 bp, Artificial Sequence
  chemically synthesized
tacaagctaatgtttgctgt

SEQ ID NO: 296533 - DNA, 20 bp, Artificial Sequence
  chemically synthesized
ccaaccccaacagcaaacat

SEQ ID NO: 296534 - DNA, 20 bp, Artificial Sequence
  chemically synthesized
gcaaacattagcttgtaact

SEQ ID NO: 296535 - DNA, 20 bp, Artificial Sequence
  chemically synthesized
caaacattagcttgtaactg

SEQ ID NO: 296536 - DNA, 20 bp, Artificial Sequence
  chemically synthesized
tacgacattacctcagttac

SEQ ID NO: 296537 - DNA, 20 bp, Artificial Sequence
  chemically synthesized
ttacaaatacgacattacct

SEQ ID NO: 296538 - DNA, 20 bp, Artificial Sequence
  chemically synthesized
tcgtatttgtaaaaatacaa

SEQ ID NO: 296539 - DNA, 20 bp, Artificial Sequence
  chemically synthesized
tctccaggattcaaatcatg

SEQ ID NO: 296540 - DNA, 20 bp, Artificial Sequence
  chemically synthesized
gaacttcatgatttgaatcc

SEQ ID NO: 296541 - DNA, 20 bp, Artificial Sequence
  chemically synthesized
acttcatgatttgaatcctg

SEQ ID NO: 296542 - DNA, 20 bp, Artificial Sequence
  chemically synthesized
ttcatgatttgaatcctgga

SEQ ID NO: 296543 - DNA, 20 bp, Artificial Sequence
  chemically synthesized
tagctctgctttttctctcc

SEQ ID NO: 296544 - DNA, 20 bp, Artificial Sequence
  chemically synthesized
ttagctctgctttttctctc

SEQ ID NO: 296545 - DNA, 20 bp, Artificial Sequence
  chemically synthesized
atttgaatcctggagagaaa

SEQ ID NO: 296546 - DNA, 20 bp, Artificial Sequence
  chemically synthesized
tgaatcctggagagaaaaag

SEQ ID NO: 296547 - DNA, 20 bp, Artificial Sequence
  chemically synthesized
aatcctggagagaaaaagca

SEQ ID NO: 296548 - DNA, 20 bp, Artificial Sequence
  chemically synthesized
tcacatctaaatgtgtatat

SEQ ID NO: 296549 - DNA, 20 bp, Artificial Sequence
  chemically synthesized
gcagagctaatatacacatt

SEQ ID NO: 296550 - DNA, 20 bp, Artificial Sequence
  chemically synthesized
atttagatgtgatcttccca

SEQ ID NO: 296551 - DNA, 20 bp, Artificial Sequence
  chemically synthesized
aaagtaattttatccatggg

SEQ ID NO: 296552 - DNA, 20 bp, Artificial Sequence
  chemically synthesized
tgaaaagtaattttatccat

SEQ ID NO: 296553 - DNA, 20 bp, Artificial Sequence
  chemically synthesized
atgaaaagtaattttatcca

SEQ ID NO: 296554 - DNA, 20 bp, Artificial Sequence
  chemically synthesized
aagcagtgattatgaatgaa

SEQ ID NO: 296555 - DNA, 20 bp, Artificial Sequence
  chemically synthesized
attcataatcactgcttcct

SEQ ID NO: 296556 - DNA, 20 bp, Artificial Sequence
  chemically synthesized
aaatgggcaagctaaggaag

SEQ ID NO: 296557 - DNA, 20 bp, Artificial Sequence
  chemically synthesized
ataaaatgggcaagctaagg

SEQ ID NO: 296558 - DNA, 20 bp, Artificial Sequence
  chemically synthesized
taaataaaatgggcaagcta

SEQ ID NO: 296559 - DNA, 20 bp, Artificial Sequence
  chemically synthesized
gtaaataaaatgggcaagct

SEQ ID NO: 296560 - DNA, 20 bp, Artificial Sequence
  chemically synthesized
gcagagtaaataaaatgggc

SEQ ID NO: 296561 - DNA, 20 bp, Artificial Sequence
  chemically synthesized
acaggcagagtaaataaaat

SEQ ID NO: 296562 - DNA, 20 bp, Artificial Sequence
  chemically synthesized
aacaggcagagtaaataaaa

SEQ ID NO: 296563 - DNA, 20 bp, Artificial Sequence
  chemically synthesized
attttatttactctgcctgt

SEQ ID NO: 296564 - DNA, 20 bp, Artificial Sequence
  chemically synthesized
aaaataatttctaacaggca

SEQ ID NO: 296565 - DNA, 20 bp, Artificial Sequence
  chemically synthesized
gtaaaataatttctaacagg

SEQ ID NO: 296566 - DNA, 20 bp, Artificial Sequence
  chemically synthesized
tttgtaaaataatttctaac

SEQ ID NO: 296567 - DNA, 20 bp, Artificial Sequence
  chemically synthesized
gtttgtaaaataatttctaa

SEQ ID NO: 296568 - DNA, 20 bp, Artificial Sequence
  chemically synthesized
tctttgtatatgattggcaa

SEQ ID NO: 296569 - DNA, 20 bp, Artificial Sequence
  chemically synthesized
catgcatctttgtatatgat

SEQ ID NO: 296570 - DNA, 20 bp, Artificial Sequence
  chemically synthesized
actgttgccaatcatataca

SEQ ID NO: 296571 - DNA, 20 bp, Artificial Sequence
  chemically synthesized
tgcatgttttataattgttg

SEQ ID NO: 296572 - DNA, 20 bp, Artificial Sequence
  chemically synthesized
ttgttgaagttgaaaaatta

SEQ ID NO: 296573 - DNA, 20 bp, Artificial Sequence
  chemically synthesized
catctttagggaaattgtca

SEQ ID NO: 296574 - DNA, 20 bp, Artificial Sequence
  chemically synthesized
tcatctttagggaaattgtc

SEQ ID NO: 296575 - DNA, 20 bp, Artificial Sequence
  chemically synthesized
aagccttgacaatttcccta

SEQ ID NO: 296576 - DNA, 20 bp, Artificial Sequence
  chemically synthesized
tataaagtgtttcatcttta

SEQ ID NO: 296577 - DNA, 20 bp, Artificial Sequence
  chemically synthesized
atataaagtgtttcatcttt

SEQ ID NO: 296578 - DNA, 20 bp, Artificial Sequence
  chemically synthesized
aatataaagtgtttcatctt

SEQ ID NO: 296579 - DNA, 20 bp, Artificial Sequence
  chemically synthesized
agttttattaatttaatata

SEQ ID NO: 296580 - DNA, 20 bp, Artificial Sequence
  chemically synthesized
ttttgaccttcacaaatagg

SEQ ID NO: 296581 - DNA, 20 bp, Artificial Sequence
  chemically synthesized
aataaaacttcctatttgtg

SEQ ID NO: 296582 - DNA, 20 bp, Artificial Sequence
  chemically synthesized
taattttgaccttcacaaat

SEQ ID NO: 296583 - DNA, 20 bp, Artificial Sequence
  chemically synthesized
ataaaacttcctatttgtga

SEQ ID NO: 296584 - DNA, 20 bp, Artificial Sequence
  chemically synthesized
ataattttgaccttcacaaa

SEQ ID NO: 296585 - DNA, 20 bp, Artificial Sequence
  chemically synthesized
aggtcaaaattataccatct

SEQ ID NO: 296586 - DNA, 20 bp, Artificial Sequence
  chemically synthesized
tcaaaattataccatctcag

SEQ ID NO: 296587 - DNA, 20 bp, Artificial Sequence
  chemically synthesized
caaaattataccatctcaga

SEQ ID NO: 296588 - DNA, 20 bp, Artificial Sequence
  chemically synthesized
gttgttattcccttctgaga

SEQ ID NO: 296589 - DNA, 20 bp, Artificial Sequence
  chemically synthesized
aaaattataccatctcagaa

SEQ ID NO: 296590 - DNA, 20 bp, Artificial Sequence
  chemically synthesized
tgttgttgttattcccttct

SEQ ID NO: 296591 - DNA, 20 bp, Artificial Sequence
  chemically synthesized
agaagggaataacaacaaca

SEQ ID NO: 296592 - DNA, 20 bp, Artificial Sequence
  chemically synthesized
tcagtatttacatgtggtag

SEQ ID NO: 296593 - DNA, 20 bp, Artificial Sequence
  chemically synthesized
ttctcagtatttacatgtgg

SEQ ID NO: 296594 - DNA, 20 bp, Artificial Sequence
  chemically synthesized
cctttctcagtatttacatg

SEQ ID NO: 296595 - DNA, 20 bp, Artificial Sequence
  chemically synthesized
tgctaccacatgtaaatact

SEQ ID NO: 296596 - DNA, 20 bp, Artificial Sequence
  chemically synthesized
accacatgtaaatactgaga

SEQ ID NO: 296597 - DNA, 20 bp, Artificial Sequence
  chemically synthesized
ccacatgtaaatactgagaa

SEQ ID NO: 296598 - DNA, 20 bp, Artificial Sequence
  chemically synthesized
aaaaggtgtccagcctttct

SEQ ID NO: 296599 - DNA, 20 bp, Artificial Sequence
  chemically synthesized
atgtaaatactgagaaaggc

SEQ ID NO: 296600 - DNA, 20 bp, Artificial Sequence
  chemically synthesized
taccttatctaaaaggtgtc

SEQ ID NO: 296601 - DNA, 20 bp, Artificial Sequence
  chemically synthesized
gagaaaggctggacaccttt

SEQ ID NO: 296602 - DNA, 20 bp, Artificial Sequence
  chemically synthesized
aggctggacaccttttagat

SEQ ID NO: 296603 - DNA, 20 bp, Artificial Sequence
  chemically synthesized
tgtgtattaccttatctaaa

SEQ ID NO: 296604 - DNA, 20 bp, Artificial Sequence
  chemically synthesized
ggctggacaccttttagata

SEQ ID NO: 296605 - DNA, 20 bp, Artificial Sequence
  chemically synthesized
ttgtgtattaccttatctaa

SEQ ID NO: 296606 - DNA, 20 bp, Artificial Sequence
  chemically synthesized
taaggtaatacacaaatatc

SEQ ID NO: 296607 - DNA, 20 bp, Artificial Sequence
  chemically synthesized
aaggtaatacacaaatatct

SEQ ID NO: 296608 - DNA, 20 bp, Artificial Sequence
  chemically synthesized
tataagatatttaaatttcc

SEQ ID NO: 296609 - DNA, 20 bp, Artificial Sequence
  chemically synthesized
caatccctgtcatatattat

SEQ ID NO: 296610 - DNA, 20 bp, Artificial Sequence
  chemically synthesized
aaatatcttataatatatga

SEQ ID NO: 296611 - DNA, 20 bp, Artificial Sequence
  chemically synthesized
aatatcttataatatatgac

SEQ ID NO: 296612 - DNA, 20 bp, Artificial Sequence
  chemically synthesized
atatcttataatatatgaca

SEQ ID NO: 296613 - DNA, 20 bp, Artificial Sequence
  chemically synthesized
gacagggattgatgactata

SEQ ID NO: 296614 - DNA, 20 bp, Artificial Sequence
  chemically synthesized
tatcaaaaagttattcttta

SEQ ID NO: 296615 - DNA, 20 bp, Artificial Sequence
  chemically synthesized
atattctcactgttatcaaa

SEQ ID NO: 296616 - DNA, 20 bp, Artificial Sequence
  chemically synthesized
aaagaataactttttgataa

SEQ ID NO: 296617 - DNA, 20 bp, Artificial Sequence
  chemically synthesized
aataactttttgataacagt

SEQ ID NO: 296618 - DNA, 20 bp, Artificial Sequence
  chemically synthesized
ttttgataacagtgagaata

SEQ ID NO: 296619 - DNA, 20 bp, Artificial Sequence
  chemically synthesized
taacagtgagaatatagaca

SEQ ID NO: 296620 - DNA, 20 bp, Artificial Sequence
  chemically synthesized
gagaatatagacatagtcct

SEQ ID NO: 296621 - DNA, 20 bp, Artificial Sequence
  chemically synthesized
tatagacatagtcctaagta

SEQ ID NO: 296622 - DNA, 20 bp, Artificial Sequence
  chemically synthesized
atataatagataccatactt

SEQ ID NO: 296623 - DNA, 20 bp, Artificial Sequence
  chemically synthesized
aatataatagataccatact

SEQ ID NO: 296624 - DNA, 20 bp, Artificial Sequence
  chemically synthesized
aatagaatagaataatataa

SEQ ID NO: 296625 - DNA, 20 bp, Artificial Sequence
  chemically synthesized
tagaatagagtaaaatagaa

SEQ ID NO: 296626 - DNA, 20 bp, Artificial Sequence
  chemically synthesized
tagagtagaatagagtaaaa

SEQ ID NO: 296627 - DNA, 20 bp, Artificial Sequence
  chemically synthesized
caattgtgtagagtagaata

SEQ ID NO: 296628 - DNA, 20 bp, Artificial Sequence
  chemically synthesized
cacaattgtgtagagtagaa

SEQ ID NO: 296629 - DNA, 20 bp, Artificial Sequence
  chemically synthesized
gcttgcacaattgtgtagag

SEQ ID NO: 296630 - DNA, 20 bp, Artificial Sequence
  chemically synthesized
caagcttgcacaattgtgta

SEQ ID NO: 296631 - DNA, 20 bp, Artificial Sequence
  chemically synthesized
agcaagcttgcacaattgtg

SEQ ID NO: 296632 - DNA, 20 bp, Artificial Sequence
  chemically synthesized
tctactctacacaattgtgc

SEQ ID NO: 296633 - DNA, 20 bp, Artificial Sequence
  chemically synthesized
cacaattgtgcaagcttgct

SEQ ID NO: 296634 - DNA, 20 bp, Artificial Sequence
  chemically synthesized
acaattgtgcaagcttgcta

SEQ ID NO: 296635 - DNA, 20 bp, Artificial Sequence
  chemically synthesized
cctcaaggctaggccttagc

SEQ ID NO: 296636 - DNA, 20 bp, Artificial Sequence
  chemically synthesized
tgtgcaagcttgctaaggcc

SEQ ID NO: 296637 - DNA, 20 bp, Artificial Sequence
  chemically synthesized
gttacctcaaggctaggcct

SEQ ID NO: 296638 - DNA, 20 bp, Artificial Sequence
  chemically synthesized
gcttgctaaggcctagcctt

SEQ ID NO: 296639 - DNA, 20 bp, Artificial Sequence
  chemically synthesized
cttgctaaggcctagccttg

SEQ ID NO: 296640 - DNA, 20 bp, Artificial Sequence
  chemically synthesized
tgttcagttacctcaaggct

SEQ ID NO: 296641 - DNA, 20 bp, Artificial Sequence
  chemically synthesized
ttgttcagttacctcaaggc

SEQ ID NO: 296642 - DNA, 20 bp, Artificial Sequence
  chemically synthesized
tatattgttcagttacctca

SEQ ID NO: 296643 - DNA, 20 bp, Artificial Sequence
  chemically synthesized
atatattgttcagttacctc

SEQ ID NO: 296644 - DNA, 20 bp, Artificial Sequence
  chemically synthesized
gattcctttcatatattgtt

SEQ ID NO: 296645 - DNA, 20 bp, Artificial Sequence
  chemically synthesized
ggtaactgaacaatatatga

SEQ ID NO: 296646 - DNA, 20 bp, Artificial Sequence
  chemically synthesized
gtaactgaacaatatatgaa

SEQ ID NO: 296647 - DNA, 20 bp, Artificial Sequence
  chemically synthesized
gtcataaaattgttaattta

SEQ ID NO: 296648 - DNA, 20 bp, Artificial Sequence
  chemically synthesized
tttatagttaaataatatgt

SEQ ID NO: 296649 - DNA, 20 bp, Artificial Sequence
  chemically synthesized
agttaaataatatgtaagtt

SEQ ID NO: 296650 - DNA, 20 bp, Artificial Sequence
  chemically synthesized
gttaaataatatgtaagtta

SEQ ID NO: 296651 - DNA, 20 bp, Artificial Sequence
  chemically synthesized
aataatatgtaagttaaggc

SEQ ID NO: 296652 - DNA, 20 bp, Artificial Sequence
  chemically synthesized
aagttaaggcaagtttatga

SEQ ID NO: 296653 - DNA, 20 bp, Artificial Sequence
  chemically synthesized
agttaaggcaagtttatgaa

SEQ ID NO: 296654 - DNA, 20 bp, Artificial Sequence
  chemically synthesized
aagtttatgaaaggcatccc

SEQ ID NO: 296655 - DNA, 20 bp, Artificial Sequence
  chemically synthesized
ttatgaaaggcatccctagt

SEQ ID NO: 296656 - DNA, 20 bp, Artificial Sequence
  chemically synthesized
gattcttctgtgactgacta

SEQ ID NO: 296657 - DNA, 20 bp, Artificial Sequence
  chemically synthesized
ggattcttctgtgactgact

SEQ ID NO: 296658 - DNA, 20 bp, Artificial Sequence
  chemically synthesized
tggattcttctgtgactgac

SEQ ID NO: 296659 - DNA, 20 bp, Artificial Sequence
  chemically synthesized
aaggcatccctagtcagtca

SEQ ID NO: 296660 - DNA, 20 bp, Artificial Sequence
  chemically synthesized
gcatccctagtcagtcacag

SEQ ID NO: 296661 - DNA, 20 bp, Artificial Sequence
  chemically synthesized
tagtcagtcacagaagaatc

SEQ ID NO: 296662 - DNA, 20 bp, Artificial Sequence
  chemically synthesized
cagtcacagaagaatccaga

SEQ ID NO: 296663 - DNA, 20 bp, Artificial Sequence
  chemically synthesized
ttagcctagagaaatctttc

SEQ ID NO: 296664 - DNA, 20 bp, Artificial Sequence
  chemically synthesized
agaatccagaaagatttctc

SEQ ID NO: 296665 - DNA, 20 bp, Artificial Sequence
  chemically synthesized
gaatccagaaagatttctct

SEQ ID NO: 296666 - DNA, 20 bp, Artificial Sequence
  chemically synthesized
caaaatcaaagtttagccta

SEQ ID NO: 296667 - DNA, 20 bp, Artificial Sequence
  chemically synthesized
agcaaaatcaaagtttagcc

SEQ ID NO: 296668 - DNA, 20 bp, Artificial Sequence
  chemically synthesized
tagcaagcaaaatcaaagtt

SEQ ID NO: 296669 - DNA, 20 bp, Artificial Sequence
  chemically synthesized
ttagatagcaagcaaaatca

SEQ ID NO: 296670 - DNA, 20 bp, Artificial Sequence
  chemically synthesized
aaaaatatattttagatagc

SEQ ID NO: 296671 - DNA, 20 bp, Artificial Sequence
  chemically synthesized
tcttaaaaatatattttaga

SEQ ID NO: 296672 - DNA, 20 bp, Artificial Sequence
  chemically synthesized
tatgtcttaaaaatatattt

SEQ ID NO: 296673 - DNA, 20 bp, Artificial Sequence
  chemically synthesized
gctatctaaaatatattttt

SEQ ID NO: 296674 - DNA, 20 bp, Artificial Sequence
  chemically synthesized
tatttttaagacatattaaa

SEQ ID NO: 296675 - DNA, 20 bp, Artificial Sequence
  chemically synthesized
tatcgcattaatctatcaac

SEQ ID NO: 296676 - DNA, 20 bp, Artificial Sequence
  chemically synthesized
tctgtgattctactagttga

SEQ ID NO: 296677 - DNA, 20 bp, Artificial Sequence
  chemically synthesized
cgcattaatctatcaactag

SEQ ID NO: 296678 - DNA, 20 bp, Artificial Sequence
  chemically synthesized
tttgttatctgtgattctac

SEQ ID NO: 296679 - DNA, 20 bp, Artificial Sequence
  chemically synthesized
tctatcaactagtagaatca

SEQ ID NO: 296680 - DNA, 20 bp, Artificial Sequence
  chemically synthesized
tagtagaatcacagataaca

SEQ ID NO: 296681 - DNA, 20 bp, Artificial Sequence
  chemically synthesized
gaatcacagataacaaagca

SEQ ID NO: 296682 - DNA, 20 bp, Artificial Sequence
  chemically synthesized
atcacagataacaaagcacg

SEQ ID NO: 296683 - DNA, 20 bp, Artificial Sequence
  chemically synthesized
taacaaagcacggagtttac

SEQ ID NO: 296684 - DNA, 20 bp, Artificial Sequence
  chemically synthesized
caaagcacggagtttacaag

SEQ ID NO: 296685 - DNA, 20 bp, Artificial Sequence
  chemically synthesized
gtttacaagcagcacaaaat

SEQ ID NO: 296686 - DNA, 20 bp, Artificial Sequence
  chemically synthesized
caagcagcacaaaatgagta

SEQ ID NO: 296687 - DNA, 20 bp, Artificial Sequence
  chemically synthesized
ttaaaagaaaaagtcaatgt

SEQ ID NO: 296688 - DNA, 20 bp, Artificial Sequence
  chemically synthesized
cttaaaagaaaaagtcaatg

SEQ ID NO: 296689 - DNA, 20 bp, Artificial Sequence
  chemically synthesized
cttctcagacttaaaagaaa

SEQ ID NO: 296690 - DNA, 20 bp, Artificial Sequence
  chemically synthesized
ctacattgactttttctttt

SEQ ID NO: 296691 - DNA, 20 bp, Artificial Sequence
  chemically synthesized
aggcaacttctcagacttaa

SEQ ID NO: 296692 - DNA, 20 bp, Artificial Sequence
  chemically synthesized
tgactttttcttttaagtct

SEQ ID NO: 296693 - DNA, 20 bp, Artificial Sequence
  chemically synthesized
ctttttcttttaagtctgag

SEQ ID NO: 296694 - DNA, 20 bp, Artificial Sequence
  chemically synthesized
tcggaaggaaggcaacttct

SEQ ID NO: 296695 - DNA, 20 bp, Artificial Sequence
  chemically synthesized
tttgcaatctttcggaagga

SEQ ID NO: 296696 - DNA, 20 bp, Artificial Sequence
  chemically synthesized
atttgcaatctttcggaagg

SEQ ID NO: 296697 - DNA, 20 bp, Artificial Sequence
  chemically synthesized
agaagttgccttccttccga

SEQ ID NO: 296698 - DNA, 20 bp, Artificial Sequence
  chemically synthesized
tgaatttgcaatctttcgga

SEQ ID NO: 296699 - DNA, 20 bp, Artificial Sequence
  chemically synthesized
ctgaatttgcaatctttcgg

SEQ ID NO: 296700 - DNA, 20 bp, Artificial Sequence
  chemically synthesized
gtcctgaatttgcaatcttt

SEQ ID NO: 296701 - DNA, 20 bp, Artificial Sequence
  chemically synthesized
cttccgaaagattgcaaatt

SEQ ID NO: 296702 - DNA, 20 bp, Artificial Sequence
  chemically synthesized
ttccgaaagattgcaaattc

SEQ ID NO: 296703 - DNA, 20 bp, Artificial Sequence
  chemically synthesized
aaattcaggactctgcaaca

SEQ ID NO: 296704 - DNA, 20 bp, Artificial Sequence
  chemically synthesized
cgctcagaagctgtgttgca

SEQ ID NO: 296705 - DNA, 20 bp, Artificial Sequence
  chemically synthesized
ctcgctcagaagctgtgttg

SEQ ID NO: 296706 - DNA, 20 bp, Artificial Sequence
  chemically synthesized
gactctgcaacacagcttct

SEQ ID NO: 296707 - DNA, 20 bp, Artificial Sequence
  chemically synthesized
ctgcaacacagcttctgagc

SEQ ID NO: 296708 - DNA, 20 bp, Artificial Sequence
  chemically synthesized
cagctggattactcgctcag

SEQ ID NO: 296709 - DNA, 20 bp, Artificial Sequence
  chemically synthesized
tcacagctggattactcgct

SEQ ID NO: 296710 - DNA, 20 bp, Artificial Sequence
  chemically synthesized
cagcttctgagcgagtaatc

SEQ ID NO: 296711 - DNA, 20 bp, Artificial Sequence
  chemically synthesized
gagcgagtaatccagctgtg

SEQ ID NO: 296712 - DNA, 20 bp, Artificial Sequence
  chemically synthesized
atataactgaacttcacagc

SEQ ID NO: 296713 - DNA, 20 bp, Artificial Sequence
  chemically synthesized
agtaatccagctgtgaagtt

SEQ ID NO: 296714 - DNA, 20 bp, Artificial Sequence
  chemically synthesized
gttgatataactgaacttca

SEQ ID NO: 296715 - DNA, 20 bp, Artificial Sequence
  chemically synthesized
gttatatcaacatccaacct

SEQ ID NO: 296716 - DNA, 20 bp, Artificial Sequence
  chemically synthesized
tattttttgctgtcttaggt

SEQ ID NO: 296717 - DNA, 20 bp, Artificial Sequence
  chemically synthesized
tatcaacatccaacctaaga

SEQ ID NO: 296718 - DNA, 20 bp, Artificial Sequence
  chemically synthesized
cttttattttttgctgtctt

SEQ ID NO: 296719 - DNA, 20 bp, Artificial Sequence
  chemically synthesized
acttttattttttgctgtct

SEQ ID NO: 296720 - DNA, 20 bp, Artificial Sequence
  chemically synthesized
cctaagacagcaaaaaataa

SEQ ID NO: 296721 - DNA, 20 bp, Artificial Sequence
  chemically synthesized
tatagaagaaagagataatc

SEQ ID NO: 296722 - DNA, 20 bp, Artificial Sequence
  chemically synthesized
tttttttaatatagaagaaa

SEQ ID NO: 296723 - DNA, 20 bp, Artificial Sequence
  chemically synthesized
gctttttttaatatagaaga

SEQ ID NO: 296724 - DNA, 20 bp, Artificial Sequence
  chemically synthesized
aattgctttttttaatatag

SEQ ID NO: 296725 - DNA, 20 bp, Artificial Sequence
  chemically synthesized
ataaattgctttttttaata

SEQ ID NO: 296726 - DNA, 20 bp, Artificial Sequence
  chemically synthesized
tctttcttctatattaaaaa

SEQ ID NO: 296727 - DNA, 20 bp, Artificial Sequence
  chemically synthesized
tgagaaaagaatgataaatg

SEQ ID NO: 296728 - DNA, 20 bp, Artificial Sequence
  chemically synthesized
caggagtctcagattgagaa

SEQ ID NO: 296729 - DNA, 20 bp, Artificial Sequence
  chemically synthesized
tatcattcttttctcaatct

SEQ ID NO: 296730 - DNA, 20 bp, Artificial Sequence
  chemically synthesized
tcaggcaggagtctcagatt

SEQ ID NO: 296731 - DNA, 20 bp, Artificial Sequence
  chemically synthesized
gaggtgtcaggcaggagtct

SEQ ID NO: 296732 - DNA, 20 bp, Artificial Sequence
  chemically synthesized
ctaatagaggtgtcaggcag

SEQ ID NO: 296733 - DNA, 20 bp, Artificial Sequence
  chemically synthesized
tactaatagaggtgtcaggc

SEQ ID NO: 296734 - DNA, 20 bp, Artificial Sequence
  chemically synthesized
atactaatagaggtgtcagg

SEQ ID NO: 296735 - DNA, 20 bp, Artificial Sequence
  chemically synthesized
ttaatactaatagaggtgtc

SEQ ID NO: 296736 - DNA, 20 bp, Artificial Sequence
  chemically synthesized
attaatactaatagaggtgt

SEQ ID NO: 296737 - DNA, 20 bp, Artificial Sequence
  chemically synthesized
ctcctgcctgacacctctat

SEQ ID NO: 296738 - DNA, 20 bp, Artificial Sequence
  chemically synthesized
gctgctattaatactaatag

SEQ ID NO: 296739 - DNA, 20 bp, Artificial Sequence
  chemically synthesized
tgctgctattaatactaata

SEQ ID NO: 296740 - DNA, 20 bp, Artificial Sequence
  chemically synthesized
agtgctgctattaatactaa

SEQ ID NO: 296741 - DNA, 20 bp, Artificial Sequence
  chemically synthesized
gacacctctattagtattaa

SEQ ID NO: 296742 - DNA, 20 bp, Artificial Sequence
  chemically synthesized
acctctattagtattaatag

SEQ ID NO: 296743 - DNA, 20 bp, Artificial Sequence
  chemically synthesized
agtctacctaacagggaaaa

SEQ ID NO: 296744 - DNA, 20 bp, Artificial Sequence
  chemically synthesized
agcagcactattttccctgt

SEQ ID NO: 296745 - DNA, 20 bp, Artificial Sequence
  chemically synthesized
gcagcactattttccctgtt

SEQ ID NO: 296746 - DNA, 20 bp, Artificial Sequence
  chemically synthesized
gcactattttccctgttagg

SEQ ID NO: 296747 - DNA, 20 bp, Artificial Sequence
  chemically synthesized
aaatttgagtctacctaaca

SEQ ID NO: 296748 - DNA, 20 bp, Artificial Sequence
  chemically synthesized
caaatttgagtctacctaac

SEQ ID NO: 296749 - DNA, 20 bp, Artificial Sequence
  chemically synthesized
ccaaatttgagtctacctaa

SEQ ID NO: 296750 - DNA, 20 bp, Artificial Sequence
  chemically synthesized
ctgttaggtagactcaaatt

SEQ ID NO: 296751 - DNA, 20 bp, Artificial Sequence
  chemically synthesized
gttaggtagactcaaatttg

SEQ ID NO: 296752 - DNA, 20 bp, Artificial Sequence
  chemically synthesized
tcaaagctgactccaaattt

SEQ ID NO: 296753 - DNA, 20 bp, Artificial Sequence
  chemically synthesized
ggtagactcaaatttggagt

SEQ ID NO: 296754 - DNA, 20 bp, Artificial Sequence
  chemically synthesized
atttggagtcagctttgatc

SEQ ID NO: 296755 - DNA, 20 bp, Artificial Sequence
  chemically synthesized
ttggagtcagctttgatcta

SEQ ID NO: 296756 - DNA, 20 bp, Artificial Sequence
  chemically synthesized
gatcataagactctagatca

SEQ ID NO: 296757 - DNA, 20 bp, Artificial Sequence
  chemically synthesized
cctctgtgatcataagactc

SEQ ID NO: 296758 - DNA, 20 bp, Artificial Sequence
  chemically synthesized
gatctagagtcttatgatca

SEQ ID NO: 296759 - DNA, 20 bp, Artificial Sequence
  chemically synthesized
aaaatgacctctgtgatcat

SEQ ID NO: 296760 - DNA, 20 bp, Artificial Sequence
  chemically synthesized
tctagagtcttatgatcaca

SEQ ID NO: 296761 - DNA, 20 bp, Artificial Sequence
  chemically synthesized
ctagagtcttatgatcacag

SEQ ID NO: 296762 - DNA, 20 bp, Artificial Sequence
  chemically synthesized
tagaagtgatttttacattg

SEQ ID NO: 296763 - DNA, 20 bp, Artificial Sequence
  chemically synthesized
gtagaagtgatttttacatt

SEQ ID NO: 296764 - DNA, 20 bp, Artificial Sequence
  chemically synthesized
gcttacaggatatattgtag

SEQ ID NO: 296765 - DNA, 20 bp, Artificial Sequence
  chemically synthesized
atagcttacaggatatattg

SEQ ID NO: 296766 - DNA, 20 bp, Artificial Sequence
  chemically synthesized
acttctacaatatatcctgt

SEQ ID NO: 296767 - DNA, 20 bp, Artificial Sequence
  chemically synthesized
gaggctgggtaatagcttac

SEQ ID NO: 296768 - DNA, 20 bp, Artificial Sequence
  chemically synthesized
agaggctgggtaatagctta

SEQ ID NO: 296769 - DNA, 20 bp, Artificial Sequence
  chemically synthesized
atatcctgtaagctattacc

SEQ ID NO: 296770 - DNA, 20 bp, Artificial Sequence
  chemically synthesized
ttcaagcagaggctgggtaa

SEQ ID NO: 296771 - DNA, 20 bp, Artificial Sequence
  chemically synthesized
gaaacattcaagcagaggct

SEQ ID NO: 296772 - DNA, 20 bp, Artificial Sequence
  chemically synthesized
ggaaacattcaagcagaggc

SEQ ID NO: 296773 - DNA, 20 bp, Artificial Sequence
  chemically synthesized
tagtggaaacattcaagcag

SEQ ID NO: 296774 - DNA, 20 bp, Artificial Sequence
  chemically synthesized
atagtggaaacattcaagca

SEQ ID NO: 296775 - DNA, 20 bp, Artificial Sequence
  chemically synthesized
aaatagtggaaacattcaag

SEQ ID NO: 296776 - DNA, 20 bp, Artificial Sequence
  chemically synthesized
ttcaaatagtggaaacattc

SEQ ID NO: 296777 - DNA, 20 bp, Artificial Sequence
  chemically synthesized
agtagtactttttcaaatag

SEQ ID NO: 296778 - DNA, 20 bp, Artificial Sequence
  chemically synthesized
aatgtttccactatttgaaa

SEQ ID NO: 296779 - DNA, 20 bp, Artificial Sequence
  chemically synthesized
ggaagtagtactttttcaaa

SEQ ID NO: 296780 - DNA, 20 bp, Artificial Sequence
  chemically synthesized
gaaaaggttatcgtgggaag

SEQ ID NO: 296781 - DNA, 20 bp, Artificial Sequence
  chemically synthesized
aaagaaaaggttatcgtggg

SEQ ID NO: 296782 - DNA, 20 bp, Artificial Sequence
  chemically synthesized
caaaaagaaaaggttatcgt

SEQ ID NO: 296783 - DNA, 20 bp, Artificial Sequence
  chemically synthesized
ccaaaaagaaaaggttatcg

SEQ ID NO: 296784 - DNA, 20 bp, Artificial Sequence
  chemically synthesized
aaatactttccaaaaagaaa

SEQ ID NO: 296785 - DNA, 20 bp, Artificial Sequence
  chemically synthesized
ccacgataaccttttctttt

SEQ ID NO: 296786 - DNA, 20 bp, Artificial Sequence
  chemically synthesized
taaatactttccaaaaagaa

SEQ ID NO: 296787 - DNA, 20 bp, Artificial Sequence
  chemically synthesized
gataaccttttctttttgga

SEQ ID NO: 296788 - DNA, 20 bp, Artificial Sequence
  chemically synthesized
tctcataaatactttccaaa

SEQ ID NO: 296789 - DNA, 20 bp, Artificial Sequence
  chemically synthesized
tctttttggaaagtatttat

SEQ ID NO: 296790 - DNA, 20 bp, Artificial Sequence
  chemically synthesized
gagaaaaaaaaaattcctgt

SEQ ID NO: 296791 - DNA, 20 bp, Artificial Sequence
  chemically synthesized
aaaaaaaaaattcctgttgg

SEQ ID NO: 296792 - DNA, 20 bp, Artificial Sequence
  chemically synthesized
tttcaatggtgaccaccaac

SEQ ID NO: 296793 - DNA, 20 bp, Artificial Sequence
  chemically synthesized
gtttcaatggtgaccaccaa

SEQ ID NO: 296794 - DNA, 20 bp, Artificial Sequence
  chemically synthesized
cagaaaagcatgtgtttcaa

SEQ ID NO: 296795 - DNA, 20 bp, Artificial Sequence
  chemically synthesized
ttgaaacacatgcttttctg

SEQ ID NO: 296796 - DNA, 20 bp, Artificial Sequence
  chemically synthesized
tatgattggagactacagaa

SEQ ID NO: 296797 - DNA, 20 bp, Artificial Sequence
  chemically synthesized
ggcagtatgattggagacta

SEQ ID NO: 296798 - DNA, 20 bp, Artificial Sequence
  chemically synthesized
acccagaggcagtatgattg

SEQ ID NO: 296799 - DNA, 20 bp, Artificial Sequence
  chemically synthesized
aaacccagaggcagtatgat

SEQ ID NO: 296800 - DNA, 20 bp, Artificial Sequence
  chemically synthesized
gtctccaatcatactgcctc

SEQ ID NO: 296801 - DNA, 20 bp, Artificial Sequence
  chemically synthesized
tctccaatcatactgcctct

SEQ ID NO: 296802 - DNA, 20 bp, Artificial Sequence
  chemically synthesized
cacgtggccaaacccagagg

SEQ ID NO: 296803 - DNA, 20 bp, Artificial Sequence
  chemically synthesized
aatcatactgcctctgggtt

SEQ ID NO: 296804 - DNA, 20 bp, Artificial Sequence
  chemically synthesized
agtcacgtggccaaacccag

SEQ ID NO: 296805 - DNA, 20 bp, Artificial Sequence
  chemically synthesized
aagtcacgtggccaaaccca

SEQ ID NO: 296806 - DNA, 20 bp, Artificial Sequence
  chemically synthesized
gaaagtcacgtggccaaacc

SEQ ID NO: 296807 - DNA, 20 bp, Artificial Sequence
  chemically synthesized
atttgtgatagaaagtcacg

SEQ ID NO: 296808 - DNA, 20 bp, Artificial Sequence
  chemically synthesized
attgtcccatttgtgataga

SEQ ID NO: 296809 - DNA, 20 bp, Artificial Sequence
  chemically synthesized
acgtgactttctatcacaaa

SEQ ID NO: 296810 - DNA, 20 bp, Artificial Sequence
  chemically synthesized
tactattgtcccatttgtga

SEQ ID NO: 296811 - DNA, 20 bp, Artificial Sequence
  chemically synthesized
cgtgactttctatcacaaat

SEQ ID NO: 296812 - DNA, 20 bp, Artificial Sequence
  chemically synthesized
ttctatcacaaatgggacaa

SEQ ID NO: 296813 - DNA, 20 bp, Artificial Sequence
  chemically synthesized
atcacaaatgggacaatagt

SEQ ID NO: 296814 - DNA, 20 bp, Artificial Sequence
  chemically synthesized
cacaaatgggacaatagtaa

SEQ ID NO: 296815 - DNA, 20 bp, Artificial Sequence
  chemically synthesized
gacaatagtaagagtactgc

SEQ ID NO: 296816 - DNA, 20 bp, Artificial Sequence
  chemically synthesized
atagtaagagtactgcaagt

SEQ ID NO: 296817 - DNA, 20 bp, Artificial Sequence
  chemically synthesized
tagtaagagtactgcaagta

SEQ ID NO: 296818 - DNA, 20 bp, Artificial Sequence
  chemically synthesized
acttctcaaaaccttacttg

SEQ ID NO: 296819 - DNA, 20 bp, Artificial Sequence
  chemically synthesized
agtactgcaagtaaggtttt

SEQ ID NO: 296820 - DNA, 20 bp, Artificial Sequence
  chemically synthesized
actgcaagtaaggttttgag

SEQ ID NO: 296821 - DNA, 20 bp, Artificial Sequence
  chemically synthesized
tttgagaagtgcttgcatgt

SEQ ID NO: 296822 - DNA, 20 bp, Artificial Sequence
  chemically synthesized
aaagtcaagctctgacatgc

SEQ ID NO: 296823 - DNA, 20 bp, Artificial Sequence
  chemically synthesized
tgagaagtgcttgcatgtca

SEQ ID NO: 296824 - DNA, 20 bp, Artificial Sequence
  chemically synthesized
catgtcagagcttgactttt

SEQ ID NO: 296825 - DNA, 20 bp, Artificial Sequence
  chemically synthesized
aatgtgtgctctaaaaagtc

SEQ ID NO: 296826 - DNA, 20 bp, Artificial Sequence
  chemically synthesized
tgtcagagcttgacttttta

SEQ ID NO: 296827 - DNA, 20 bp, Artificial Sequence
  chemically synthesized
ctcagaatgtgtgctctaaa

SEQ ID NO: 296828 - DNA, 20 bp, Artificial Sequence
  chemically synthesized
ctttttagagcacacattct

SEQ ID NO: 296829 - DNA, 20 bp, Artificial Sequence
  chemically synthesized
tttagagcacacattctgag

SEQ ID NO: 296830 - DNA, 20 bp, Artificial Sequence
  chemically synthesized
ttatataattgttgtcttct

SEQ ID NO: 296831 - DNA, 20 bp, Artificial Sequence
  chemically synthesized
tgagaagacaacaattatat

SEQ ID NO: 296832 - DNA, 20 bp, Artificial Sequence
  chemically synthesized
gaagacaacaattatataag

SEQ ID NO: 296833 - DNA, 20 bp, Artificial Sequence
  chemically synthesized
ataagaagtacaatgacctt

SEQ ID NO: 296834 - DNA, 20 bp, Artificial Sequence
  chemically synthesized
taagaagtacaatgaccttg

SEQ ID NO: 296835 - DNA, 20 bp, Artificial Sequence
  chemically synthesized
cttaaaacatgatcacctca

SEQ ID NO: 296836 - DNA, 20 bp, Artificial Sequence
  chemically synthesized
ccttaaaacatgatcacctc

SEQ ID NO: 296837 - DNA, 20 bp, Artificial Sequence
  chemically synthesized
ccttgaggtgatcatgtttt

SEQ ID NO: 296838 - DNA, 20 bp, Artificial Sequence
  chemically synthesized
cttgaggtgatcatgtttta

SEQ ID NO: 296839 - DNA, 20 bp, Artificial Sequence
  chemically synthesized
cctcttcacatggacagatc

SEQ ID NO: 296840 - DNA, 20 bp, Artificial Sequence
  chemically synthesized
atgtggcctcttcacatgga

SEQ ID NO: 296841 - DNA, 20 bp, Artificial Sequence
  chemically synthesized
aaacttgatctgtccatgtg

SEQ ID NO: 296842 - DNA, 20 bp, Artificial Sequence
  chemically synthesized
acttgatctgtccatgtgaa

SEQ ID NO: 296843 - DNA, 20 bp, Artificial Sequence
  chemically synthesized
cttgatctgtccatgtgaag

SEQ ID NO: 296844 - DNA, 20 bp, Artificial Sequence
  chemically synthesized
cttcatgtggcctcttcaca

SEQ ID NO: 296845 - DNA, 20 bp, Artificial Sequence
  chemically synthesized
ccatgtgaagaggccacatg

SEQ ID NO: 296846 - DNA, 20 bp, Artificial Sequence
  chemically synthesized
tgtgaagaggccacatgaag

SEQ ID NO: 296847 - DNA, 20 bp, Artificial Sequence
  chemically synthesized
gtgccccatgcttcttcatg

SEQ ID NO: 296848 - DNA, 20 bp, Artificial Sequence
  chemically synthesized
agaggccacatgaagaagca

SEQ ID NO: 296849 - DNA, 20 bp, Artificial Sequence
  chemically synthesized
gaggccacatgaagaagcat

SEQ ID NO: 296850 - DNA, 20 bp, Artificial Sequence
  chemically synthesized
aggccacatgaagaagcatg

SEQ ID NO: 296851 - DNA, 20 bp, Artificial Sequence
  chemically synthesized
catgaagaagcatggggcac

SEQ ID NO: 296852 - DNA, 20 bp, Artificial Sequence
  chemically synthesized
atgaagaagcatggggcacc

SEQ ID NO: 296853 - DNA, 20 bp, Artificial Sequence
  chemically synthesized
gagggctttatttgcatgcc

SEQ ID NO: 296854 - DNA, 20 bp, Artificial Sequence
  chemically synthesized
gggcaccaggcatgcaaata

SEQ ID NO: 296855 - DNA, 20 bp, Artificial Sequence
  chemically synthesized
gcattgagatgggtcacaga

SEQ ID NO: 296856 - DNA, 20 bp, Artificial Sequence
  chemically synthesized
ggcattgagatgggtcacag

SEQ ID NO: 296857 - DNA, 20 bp, Artificial Sequence
  chemically synthesized
tggcattgagatgggtcaca

SEQ ID NO: 296858 - DNA, 20 bp, Artificial Sequence
  chemically synthesized
gctggcattgagatgggtca

SEQ ID NO: 296859 - DNA, 20 bp, Artificial Sequence
  chemically synthesized
tcttcagctggcattgagat

SEQ ID NO: 296860 - DNA, 20 bp, Artificial Sequence
  chemically synthesized
gtcttcagctggcattgaga

SEQ ID NO: 296861 - DNA, 20 bp, Artificial Sequence
  chemically synthesized
tctgtgacccatctcaatgc

SEQ ID NO: 296862 - DNA, 20 bp, Artificial Sequence
  chemically synthesized
gtctgtcttcagctggcatt

SEQ ID NO: 296863 - DNA, 20 bp, Artificial Sequence
  chemically synthesized
acccatctcaatgccagctg

SEQ ID NO: 296864 - DNA, 20 bp, Artificial Sequence
  chemically synthesized
ctcatttgtctgtcttcagc

SEQ ID NO: 296865 - DNA, 20 bp, Artificial Sequence
  chemically synthesized
atctcaatgccagctgaaga

SEQ ID NO: 296866 - DNA, 20 bp, Artificial Sequence
  chemically synthesized
agcactcatttgtctgtctt

SEQ ID NO: 296867 - DNA, 20 bp, Artificial Sequence
  chemically synthesized
ccagctgaagacagacaaat

SEQ ID NO: 296868 - DNA, 20 bp, Artificial Sequence
  chemically synthesized
agacagacaaatgagtgctc

SEQ ID NO: 296869 - DNA, 20 bp, Artificial Sequence
  chemically synthesized
tctctatgtggcatcaactg

SEQ ID NO: 296870 - DNA, 20 bp, Artificial Sequence
  chemically synthesized
tttctctatgtggcatcaac

SEQ ID NO: 296871 - DNA, 20 bp, Artificial Sequence
  chemically synthesized
gtgctccagttgatgccaca

SEQ ID NO: 296872 - DNA, 20 bp, Artificial Sequence
  chemically synthesized
gctccagttgatgccacata

SEQ ID NO: 296873 - DNA, 20 bp, Artificial Sequence
  chemically synthesized
gggtatttcttttctctatg

SEQ ID NO: 296874 - DNA, 20 bp, Artificial Sequence
  chemically synthesized
agttgatgccacatagagaa

SEQ ID NO: 296875 - DNA, 20 bp, Artificial Sequence
  chemically synthesized
atagagaaaagaaataccca

SEQ ID NO: 296876 - DNA, 20 bp, Artificial Sequence
  chemically synthesized
tagagaaaagaaatacccaa

SEQ ID NO: 296877 - DNA, 20 bp, Artificial Sequence
  chemically synthesized
agagaaaagaaatacccaaa

SEQ ID NO: 296878 - DNA, 20 bp, Artificial Sequence
  chemically synthesized
caacgtaggcagtgcccttt

SEQ ID NO: 296879 - DNA, 20 bp, Artificial Sequence
  chemically synthesized
tcaacgtaggcagtgccctt

SEQ ID NO: 296880 - DNA, 20 bp, Artificial Sequence
  chemically synthesized
tcctaattcttcaacgtagg

SEQ ID NO: 296881 - DNA, 20 bp, Artificial Sequence
  chemically synthesized
aaagggcactgcctacgttg

SEQ ID NO: 296882 - DNA, 20 bp, Artificial Sequence
  chemically synthesized
ttctcctaattcttcaacgt

SEQ ID NO: 296883 - DNA, 20 bp, Artificial Sequence
  chemically synthesized
tttctcctaattcttcaacg

SEQ ID NO: 296884 - DNA, 20 bp, Artificial Sequence
  chemically synthesized
cactgcctacgttgaagaat

SEQ ID NO: 296885 - DNA, 20 bp, Artificial Sequence
  chemically synthesized
actgcctacgttgaagaatt

SEQ ID NO: 296886 - DNA, 20 bp, Artificial Sequence
  chemically synthesized
tgcctacgttgaagaattag

SEQ ID NO: 296887 - DNA, 20 bp, Artificial Sequence
  chemically synthesized
gaattaggagaaataataaa

SEQ ID NO: 296888 - DNA, 20 bp, Artificial Sequence
  chemically synthesized
aattaggagaaataataaat

SEQ ID NO: 296889 - DNA, 20 bp, Artificial Sequence
  chemically synthesized
taataaataggtgctgtttt

SEQ ID NO: 296890 - DNA, 20 bp, Artificial Sequence
  chemically synthesized
caaaatgtagtggcttaaaa

SEQ ID NO: 296891 - DNA, 20 bp, Artificial Sequence
  chemically synthesized
caactcacaccaaaatgtag

SEQ ID NO: 296892 - DNA, 20 bp, Artificial Sequence
  chemically synthesized
tgttttaagccactacattt

SEQ ID NO: 296893 - DNA, 20 bp, Artificial Sequence
  chemically synthesized
taacaactcacaccaaaatg

SEQ ID NO: 296894 - DNA, 20 bp, Artificial Sequence
  chemically synthesized
aagccactacattttggtgt

SEQ ID NO: 296895 - DNA, 20 bp, Artificial Sequence
  chemically synthesized
aggtgatctgatatttatgg

SEQ ID NO: 296896 - DNA, 20 bp, Artificial Sequence
  chemically synthesized
tgttatgctgccataaatat

SEQ ID NO: 296897 - DNA, 20 bp, Artificial Sequence
  chemically synthesized
gataggtgatctgatattta

SEQ ID NO: 296898 - DNA, 20 bp, Artificial Sequence
  chemically synthesized
aggtttgaaaataacaggat

SEQ ID NO: 296899 - DNA, 20 bp, Artificial Sequence
  chemically synthesized
aaggtttgaaaataacagga

SEQ ID NO: 296900 - DNA, 20 bp, Artificial Sequence
  chemically synthesized
aaaaaaggtttgaaaataac

SEQ ID NO: 296901 - DNA, 20 bp, Artificial Sequence
  chemically synthesized
aaaaaaaggtttgaaaataa

SEQ ID NO: 296902 - DNA, 20 bp, Artificial Sequence
  chemically synthesized
aaaaaaaaaaaaaaaaaaaa

SEQ ID NO: 296903 - DNA, 20 bp, Artificial Sequence
  chemically synthesized
aaaaaaaaaaaaaaaaaaaa

SEQ ID NO: 296904 - DNA, 20 bp, Artificial Sequence
  chemically synthesized
tttttttttttttttttttt

SEQ ID NO: 296905 - DNA, 20 bp, Artificial Sequence
  chemically synthesized
ttttttttttttttttttgg

SEQ ID NO: 296906 - DNA, 20 bp, Artificial Sequence
  chemically synthesized
ttttttttttttttttggaa

SEQ ID NO: 296907 - DNA, 20 bp, Artificial Sequence
  chemically synthesized
ttttttttggaagagatctt

SEQ ID NO: 296908 - DNA, 20 bp, Artificial Sequence
  chemically synthesized
ttttttggaagagatctttg

SEQ ID NO: 296909 - DNA, 20 bp, Artificial Sequence
  chemically synthesized
atttatccctggtggctcca

SEQ ID NO: 296910 - DNA, 20 bp, Artificial Sequence
  chemically synthesized
gaagagatctttggagccac

SEQ ID NO: 296911 - DNA, 20 bp, Artificial Sequence
  chemically synthesized
aagagatctttggagccacc

SEQ ID NO: 296912 - DNA, 20 bp, Artificial Sequence
  chemically synthesized
agagatctttggagccacca

SEQ ID NO: 296913 - DNA, 20 bp, Artificial Sequence
  chemically synthesized
aatgaataatttatccctgg

SEQ ID NO: 296914 - DNA, 20 bp, Artificial Sequence
  chemically synthesized
tagaatgaataatttatccc

SEQ ID NO: 296915 - DNA, 20 bp, Artificial Sequence
  chemically synthesized
ataaattattcattctaatc

SEQ ID NO: 296916 - DNA, 20 bp, Artificial Sequence
  chemically synthesized
ctatacctaaatcaccagat

SEQ ID NO: 296917 - DNA, 20 bp, Artificial Sequence
  chemically synthesized
ttcattctaatctggtgatt

SEQ ID NO: 296918 - DNA, 20 bp, Artificial Sequence
  chemically synthesized
tcattctaatctggtgattt

SEQ ID NO: 296919 - DNA, 20 bp, Artificial Sequence
  chemically synthesized
ctcttctatacctaaatcac

SEQ ID NO: 296920 - DNA, 20 bp, Artificial Sequence
  chemically synthesized
ctaatctggtgatttaggta

SEQ ID NO: 296921 - DNA, 20 bp, Artificial Sequence
  chemically synthesized
atctggtgatttaggtatag

SEQ ID NO: 296922 - DNA, 20 bp, Artificial Sequence
  chemically synthesized
ctggtgatttaggtatagaa

SEQ ID NO: 296923 - DNA, 20 bp, Artificial Sequence
  chemically synthesized
ggtatagaagagccaaaata

SEQ ID NO: 296924 - DNA, 20 bp, Artificial Sequence
  chemically synthesized
cttgggttgattccatattt

SEQ ID NO: 296925 - DNA, 20 bp, Artificial Sequence
  chemically synthesized
ccaaaatatggaatcaaccc

SEQ ID NO: 296926 - DNA, 20 bp, Artificial Sequence
  chemically synthesized
tactattccattagacactt

SEQ ID NO: 296927 - DNA, 20 bp, Artificial Sequence
  chemically synthesized
atactattccattagacact

SEQ ID NO: 296928 - DNA, 20 bp, Artificial Sequence
  chemically synthesized
gaatcaacccaagtgtctaa

SEQ ID NO: 296929 - DNA, 20 bp, Artificial Sequence
  chemically synthesized
aacccaagtgtctaatggaa

SEQ ID NO: 296930 - DNA, 20 bp, Artificial Sequence
  chemically synthesized
aaggcttaatactattccat

SEQ ID NO: 296931 - DNA, 20 bp, Artificial Sequence
  chemically synthesized
gtgtctaatggaatagtatt

SEQ ID NO: 296932 - DNA, 20 bp, Artificial Sequence
  chemically synthesized
tggaatagtattaagccttt

SEQ ID NO: 296933 - DNA, 20 bp, Artificial Sequence
  chemically synthesized
aaggctattcatagtcttaa

SEQ ID NO: 296934 - DNA, 20 bp, Artificial Sequence
  chemically synthesized
aaaggctattcatagtctta

SEQ ID NO: 296935 - DNA, 20 bp, Artificial Sequence
  chemically synthesized
taagcctttaagactatgaa

SEQ ID NO: 296936 - DNA, 20 bp, Artificial Sequence
  chemically synthesized
tgcaaatgaaaggctattca

SEQ ID NO: 296937 - DNA, 20 bp, Artificial Sequence
  chemically synthesized
tacatgttgttgcaaatgaa

SEQ ID NO: 296938 - DNA, 20 bp, Artificial Sequence
  chemically synthesized
atacatgttgttgcaaatga

SEQ ID NO: 296939 - DNA, 20 bp, Artificial Sequence
  chemically synthesized
tgcaacaacatgtatgaacc

SEQ ID NO: 296940 - DNA, 20 bp, Artificial Sequence
  chemically synthesized
caacaacatgtatgaacccg

SEQ ID NO: 296941 - DNA, 20 bp, Artificial Sequence
  chemically synthesized
aacaacatgtatgaacccgg

SEQ ID NO: 296942 - DNA, 20 bp, Artificial Sequence
  chemically synthesized
cacttaacataatttcctcc

SEQ ID NO: 296943 - DNA, 20 bp, Artificial Sequence
  chemically synthesized
tcacttaacataatttcctc

SEQ ID NO: 296944 - DNA, 20 bp, Artificial Sequence
  chemically synthesized
aacccggaggaaattatgtt

SEQ ID NO: 296945 - DNA, 20 bp, Artificial Sequence
  chemically synthesized
gaaattatgttaagtgaaat

SEQ ID NO: 296946 - DNA, 20 bp, Artificial Sequence
  chemically synthesized
ttatgttaagtgaaataagc

SEQ ID NO: 296947 - DNA, 20 bp, Artificial Sequence
  chemically synthesized
tatgttaagtgaaataagcc

SEQ ID NO: 296948 - DNA, 20 bp, Artificial Sequence
  chemically synthesized
taagtgaaataagccaggtg

SEQ ID NO: 296949 - DNA, 20 bp, Artificial Sequence
  chemically synthesized
ggtatttgtctttctacacc

SEQ ID NO: 296950 - DNA, 20 bp, Artificial Sequence
  chemically synthesized
tgaaataagccaggtgtaga

SEQ ID NO: 296951 - DNA, 20 bp, Artificial Sequence
  chemically synthesized
cacttgtaagtgagatcatg

SEQ ID NO: 296952 - DNA, 20 bp, Artificial Sequence
  chemically synthesized
taccacatgatctcacttac

SEQ ID NO: 296953 - DNA, 20 bp, Artificial Sequence
  chemically synthesized
tttagattccacttgtaagt

SEQ ID NO: 296954 - DNA, 20 bp, Artificial Sequence
  chemically synthesized
cacatgatctcacttacaag

SEQ ID NO: 296955 - DNA, 20 bp, Artificial Sequence
  chemically synthesized
tttttttagattccacttgt

SEQ ID NO: 296956 - DNA, 20 bp, Artificial Sequence
  chemically synthesized
tttttttttttttttttttt

SEQ ID NO: 296957 - DNA, 20 bp, Artificial Sequence
  chemically synthesized
aaaaaaaaaaatcaaactaa

SEQ ID NO: 296958 - DNA, 20 bp, Artificial Sequence
  chemically synthesized
aaaaatcaaactaaaagaaa

SEQ ID NO: 296959 - DNA, 20 bp, Artificial Sequence
  chemically synthesized
acattgtcttctgtttcttt

SEQ ID NO: 296960 - DNA, 20 bp, Artificial Sequence
  chemically synthesized
aatcaaactaaaagaaacag

SEQ ID NO: 296961 - DNA, 20 bp, Artificial Sequence
  chemically synthesized
cagaagacaatgttcatttc

SEQ ID NO: 296962 - DNA, 20 bp, Artificial Sequence
  chemically synthesized
agaagacaatgttcatttcc

SEQ ID NO: 296963 - DNA, 20 bp, Artificial Sequence
  chemically synthesized
aagacaatgttcatttccag

SEQ ID NO: 296964 - DNA, 20 bp, Artificial Sequence
  chemically synthesized
caatgttcatttccaggagc

SEQ ID NO: 296965 - DNA, 20 bp, Artificial Sequence
  chemically synthesized
tctccacccccaccagctcc

SEQ ID NO: 296966 - DNA, 20 bp, Artificial Sequence
  chemically synthesized
tgttcatttccaggagctgg

SEQ ID NO: 296967 - DNA, 20 bp, Artificial Sequence
  chemically synthesized
gttcatttccaggagctggt

SEQ ID NO: 296968 - DNA, 20 bp, Artificial Sequence
  chemically synthesized
ttcatttccaggagctggtg

SEQ ID NO: 296969 - DNA, 20 bp, Artificial Sequence
  chemically synthesized
tcatttccaggagctggtgg

SEQ ID NO: 296970 - DNA, 20 bp, Artificial Sequence
  chemically synthesized
tttccaggagctggtggggg

SEQ ID NO: 296971 - DNA, 20 bp, Artificial Sequence
  chemically synthesized
caactactctccacccccac

SEQ ID NO: 296972 - DNA, 20 bp, Artificial Sequence
  chemically synthesized
tccaggagctggtgggggtg

SEQ ID NO: 296973 - DNA, 20 bp, Artificial Sequence
  chemically synthesized
caggagctggtgggggtgga

SEQ ID NO: 296974 - DNA, 20 bp, Artificial Sequence
  chemically synthesized
gagctggtgggggtggagag

SEQ ID NO: 296975 - DNA, 20 bp, Artificial Sequence
  chemically synthesized
tggtgggggtggagagtagt

SEQ ID NO: 296976 - DNA, 20 bp, Artificial Sequence
  chemically synthesized
gggggtggagagtagttgga

SEQ ID NO: 296977 - DNA, 20 bp, Artificial Sequence
  chemically synthesized
gagagtagttggaaagatat

SEQ ID NO: 296978 - DNA, 20 bp, Artificial Sequence
  chemically synthesized
agttggaaagatattggcaa

SEQ ID NO: 296979 - DNA, 20 bp, Artificial Sequence
  chemically synthesized
gttggaaagatattggcaaa

SEQ ID NO: 296980 - DNA, 20 bp, Artificial Sequence
  chemically synthesized
ctactgataaatttaaagag

SEQ ID NO: 296981 - DNA, 20 bp, Artificial Sequence
  chemically synthesized
tatctactgataaatttaaa

SEQ ID NO: 296982 - DNA, 20 bp, Artificial Sequence
  chemically synthesized
ggtatctactgataaattta

SEQ ID NO: 296983 - DNA, 20 bp, Artificial Sequence
  chemically synthesized
aatccgctctttaaatttat

SEQ ID NO: 296984 - DNA, 20 bp, Artificial Sequence
  chemically synthesized
ccgctctttaaatttatcag

SEQ ID NO: 296985 - DNA, 20 bp, Artificial Sequence
  chemically synthesized
atcagtagatacctgatcat

SEQ ID NO: 296986 - DNA, 20 bp, Artificial Sequence
  chemically synthesized
catagggtaggctgatgatc

SEQ ID NO: 296987 - DNA, 20 bp, Artificial Sequence
  chemically synthesized
gcatagggtaggctgatgat

SEQ ID NO: 296988 - DNA, 20 bp, Artificial Sequence
  chemically synthesized
gaagtaattaagcatagggt

SEQ ID NO: 296989 - DNA, 20 bp, Artificial Sequence
  chemically synthesized
tgaagtaattaagcataggg

SEQ ID NO: 296990 - DNA, 20 bp, Artificial Sequence
  chemically synthesized
cgttgaagtaattaagcata

SEQ ID NO: 296991 - DNA, 20 bp, Artificial Sequence
  chemically synthesized
ccgttgaagtaattaagcat

SEQ ID NO: 296992 - DNA, 20 bp, Artificial Sequence
  chemically synthesized
tccgttgaagtaattaagca

SEQ ID NO: 296993 - DNA, 20 bp, Artificial Sequence
  chemically synthesized
gaatatccgttgaagtaatt

SEQ ID NO: 296994 - DNA, 20 bp, Artificial Sequence
  chemically synthesized
cctatgcttaattacttcaa

SEQ ID NO: 296995 - DNA, 20 bp, Artificial Sequence
  chemically synthesized
aagccatagaatatccgttg

SEQ ID NO: 296996 - DNA, 20 bp, Artificial Sequence
  chemically synthesized
ttacttcaacggatattcta

SEQ ID NO: 296997 - DNA, 20 bp, Artificial Sequence
  chemically synthesized
actaagataacaacaagcca

SEQ ID NO: 296998 - DNA, 20 bp, Artificial Sequence
  chemically synthesized
aaggaaactaagataacaac

SEQ ID NO: 296999 - DNA, 20 bp, Artificial Sequence
  chemically synthesized
tctatggcttgttgttatct

SEQ ID NO: 297000 - DNA, 20 bp, Artificial Sequence
  chemically synthesized
gtacccaatttaaggaaact

SEQ ID NO: 297001 - DNA, 20 bp, Artificial Sequence
  chemically synthesized
ttatcttagtttccttaaat

SEQ ID NO: 297002 - DNA, 20 bp, Artificial Sequence
  chemically synthesized
tatcttagtttccttaaatt

SEQ ID NO: 297003 - DNA, 20 bp, Artificial Sequence
  chemically synthesized
ccctttaagtacccaattta

SEQ ID NO: 297004 - DNA, 20 bp, Artificial Sequence
  chemically synthesized
tccctttaagtacccaattt

SEQ ID NO: 297005 - DNA, 20 bp, Artificial Sequence
  chemically synthesized
ttccttaaattgggtactta

SEQ ID NO: 297006 - DNA, 20 bp, Artificial Sequence
  chemically synthesized
tccttaaattgggtacttaa

SEQ ID NO: 297007 - DNA, 20 bp, Artificial Sequence
  chemically synthesized
ccttaaattgggtacttaaa

SEQ ID NO: 297008 - DNA, 20 bp, Artificial Sequence
  chemically synthesized
actgctgatatgttcccttt

SEQ ID NO: 297009 - DNA, 20 bp, Artificial Sequence
  chemically synthesized
ggtacttaaagggaacatat

SEQ ID NO: 297010 - DNA, 20 bp, Artificial Sequence
  chemically synthesized
acttaaagggaacatatcag

SEQ ID NO: 297011 - DNA, 20 bp, Artificial Sequence
  chemically synthesized
tcagcagtgtgtaaaataaa

SEQ ID NO: 297012 - DNA, 20 bp, Artificial Sequence
  chemically synthesized
cagcagtgtgtaaaataaac

SEQ ID NO: 297013 - DNA, 20 bp, Artificial Sequence
  chemically synthesized
agcagtgtgtaaaataaaca

SEQ ID NO: 297014 - DNA, 20 bp, Artificial Sequence
  chemically synthesized
agtgtgtaaaataaacaggg

SEQ ID NO: 297015 - DNA, 20 bp, Artificial Sequence
  chemically synthesized
gggaagaataattatctttc

SEQ ID NO: 297016 - DNA, 20 bp, Artificial Sequence
  chemically synthesized
tgaaagtattataaaccaga

SEQ ID NO: 297017 - DNA, 20 bp, Artificial Sequence
  chemically synthesized
tcaatgaaagtattataaac

SEQ ID NO: 297018 - DNA, 20 bp, Artificial Sequence
  chemically synthesized
atcatgggctatatcaatga

SEQ ID NO: 297019 - DNA, 20 bp, Artificial Sequence
  chemically synthesized
ttataatactttcattgata

SEQ ID NO: 297020 - DNA, 20 bp, Artificial Sequence
  chemically synthesized
aaaatatttattgaaatcat

SEQ ID NO: 297021 - DNA, 20 bp, Artificial Sequence
  chemically synthesized
gaaaatatttattgaaatca

SEQ ID NO: 297022 - DNA, 20 bp, Artificial Sequence
  chemically synthesized
aaatattttcacttcaatat

SEQ ID NO: 297023 - DNA, 20 bp, Artificial Sequence
  chemically synthesized
gagttgaaagtctaatattg

SEQ ID NO: 297024 - DNA, 20 bp, Artificial Sequence
  chemically synthesized
tgaattgcaatgtgagttga

SEQ ID NO: 297025 - DNA, 20 bp, Artificial Sequence
  chemically synthesized
agtcaattgaattgcaatgt

SEQ ID NO: 297026 - DNA, 20 bp, Artificial Sequence
  chemically synthesized
aaaaaattcctagaagtttt

SEQ ID NO: 297027 - DNA, 20 bp, Artificial Sequence
  chemically synthesized
ttcaattgacttaaaacttc

SEQ ID NO: 297028 - DNA, 20 bp, Artificial Sequence
  chemically synthesized
tcaattgacttaaaacttct

SEQ ID NO: 297029 - DNA, 20 bp, Artificial Sequence
  chemically synthesized
ttatgtgaaaaaattcctag

SEQ ID NO: 297030 - DNA, 20 bp, Artificial Sequence
  chemically synthesized
agtttatgtgaaaaaattcc

SEQ ID NO: 297031 - DNA, 20 bp, Artificial Sequence
  chemically synthesized
tgatataactggtttaatga

SEQ ID NO: 297032 - DNA, 20 bp, Artificial Sequence
  chemically synthesized
cacataaactatcattaaac

SEQ ID NO: 297033 - DNA, 20 bp, Artificial Sequence
  chemically synthesized
taattaggttgtgatataac

SEQ ID NO: 297034 - DNA, 20 bp, Artificial Sequence
  chemically synthesized
atatgtttgtgatagtaatt

SEQ ID NO: 297035 - DNA, 20 bp, Artificial Sequence
  chemically synthesized
catatgtttgtgatagtaat

SEQ ID NO: 297036 - DNA, 20 bp, Artificial Sequence
  chemically synthesized
atcaggtcatatgtttgtga

SEQ ID NO: 297037 - DNA, 20 bp, Artificial Sequence
  chemically synthesized
aaactggagttcaatagatc

SEQ ID NO: 297038 - DNA, 20 bp, Artificial Sequence
  chemically synthesized
aaaactggagttcaatagat

SEQ ID NO: 297039 - DNA, 20 bp, Artificial Sequence
  chemically synthesized
gtcccaaaactggagttcaa

SEQ ID NO: 297040 - DNA, 20 bp, Artificial Sequence
  chemically synthesized
tgacctgatctattgaactc

SEQ ID NO: 297041 - DNA, 20 bp, Artificial Sequence
  chemically synthesized
gatctattgaactccagttt

SEQ ID NO: 297042 - DNA, 20 bp, Artificial Sequence
  chemically synthesized
atctattgaactccagtttt

SEQ ID NO: 297043 - DNA, 20 bp, Artificial Sequence
  chemically synthesized
gattcaaagtcccaaaactg

SEQ ID NO: 297044 - DNA, 20 bp, Artificial Sequence
  chemically synthesized
atgattcaaagtcccaaaac

SEQ ID NO: 297045 - DNA, 20 bp, Artificial Sequence
  chemically synthesized
taactggtttatatgattca

SEQ ID NO: 297046 - DNA, 20 bp, Artificial Sequence
  chemically synthesized
ggactttgaatcatataaac

SEQ ID NO: 297047 - DNA, 20 bp, Artificial Sequence
  chemically synthesized
tttgaatcatataaaccagt

SEQ ID NO: 297048 - DNA, 20 bp, Artificial Sequence
  chemically synthesized
caaatgtgagaaattctaac

SEQ ID NO: 297049 - DNA, 20 bp, Artificial Sequence
  chemically synthesized
caatagcctgcaacaaatgt

SEQ ID NO: 297050 - DNA, 20 bp, Artificial Sequence
  chemically synthesized
agaatttctcacatttgttg

SEQ ID NO: 297051 - DNA, 20 bp, Artificial Sequence
  chemically synthesized
gaatttctcacatttgttgc

SEQ ID NO: 297052 - DNA, 20 bp, Artificial Sequence
  chemically synthesized
tctgtttaatttttaaacaa

SEQ ID NO: 297053 - DNA, 20 bp, Artificial Sequence
  chemically synthesized
gctattgtttaaaaattaaa

SEQ ID NO: 297054 - DNA, 20 bp, Artificial Sequence
  chemically synthesized
gtttaaaaattaaacagata

SEQ ID NO: 297055 - DNA, 20 bp, Artificial Sequence
  chemically synthesized
taaacagatacagaaattaa

SEQ ID NO: 297056 - DNA, 20 bp, Artificial Sequence
  chemically synthesized
acagaaattaatggaacaca

SEQ ID NO: 297057 - DNA, 20 bp, Artificial Sequence
  chemically synthesized
ttaatggaacacaaagccct

SEQ ID NO: 297058 - DNA, 20 bp, Artificial Sequence
  chemically synthesized
atgcgaatatgtttttctaa

SEQ ID NO: 297059 - DNA, 20 bp, Artificial Sequence
  chemically synthesized
aatgcgaatatgtttttcta

SEQ ID NO: 297060 - DNA, 20 bp, Artificial Sequence
  chemically synthesized
aaatgcgaatatgtttttct

SEQ ID NO: 297061 - DNA, 20 bp, Artificial Sequence
  chemically synthesized
acctaaccaaagaattttgt

SEQ ID NO: 297062 - DNA, 20 bp, Artificial Sequence
  chemically synthesized
tatattctcacaaaattctt

SEQ ID NO: 297063 - DNA, 20 bp, Artificial Sequence
  chemically synthesized
ttctcacaaaattctttggt

SEQ ID NO: 297064 - DNA, 20 bp, Artificial Sequence
  chemically synthesized
tctcacaaaattctttggtt

SEQ ID NO: 297065 - DNA, 20 bp, Artificial Sequence
  chemically synthesized
gaattggtgatacctaacca

SEQ ID NO: 297066 - DNA, 20 bp, Artificial Sequence
  chemically synthesized
tggttaggtatcaccaattc

SEQ ID NO: 297067 - DNA, 20 bp, Artificial Sequence
  chemically synthesized
atcctatgggcagctggaat

SEQ ID NO: 297068 - DNA, 20 bp, Artificial Sequence
  chemically synthesized
catctcatcctatgggcagc

SEQ ID NO: 297069 - DNA, 20 bp, Artificial Sequence
  chemically synthesized
tcaccaattccagctgccca

SEQ ID NO: 297070 - DNA, 20 bp, Artificial Sequence
  chemically synthesized
caccaattccagctgcccat

SEQ ID NO: 297071 - DNA, 20 bp, Artificial Sequence
  chemically synthesized
gctccatctcatcctatggg

SEQ ID NO: 297072 - DNA, 20 bp, Artificial Sequence
  chemically synthesized
attccagctgcccataggat

SEQ ID NO: 297073 - DNA, 20 bp, Artificial Sequence
  chemically synthesized
gaagctccatctcatcctat

SEQ ID NO: 297074 - DNA, 20 bp, Artificial Sequence
  chemically synthesized
tgaagctccatctcatccta

SEQ ID NO: 297075 - DNA, 20 bp, Artificial Sequence
  chemically synthesized
cagctgcccataggatgaga

SEQ ID NO: 297076 - DNA, 20 bp, Artificial Sequence
  chemically synthesized
gctgcccataggatgagatg

SEQ ID NO: 297077 - DNA, 20 bp, Artificial Sequence
  chemically synthesized
cataggatgagatggagctt

SEQ ID NO: 297078 - DNA, 20 bp, Artificial Sequence
  chemically synthesized
taggatgagatggagcttca

SEQ ID NO: 297079 - DNA, 20 bp, Artificial Sequence
  chemically synthesized
caattaacttaatttctctg

SEQ ID NO: 297080 - DNA, 20 bp, Artificial Sequence
  chemically synthesized
gatggagcttcagagaaatt

SEQ ID NO: 297081 - DNA, 20 bp, Artificial Sequence
  chemically synthesized
gtttctgacccatggtattg

SEQ ID NO: 297082 - DNA, 20 bp, Artificial Sequence
  chemically synthesized
gttaattgacctcaatacca

SEQ ID NO: 297083 - DNA, 20 bp, Artificial Sequence
  chemically synthesized
agtttctgacccatggtatt

SEQ ID NO: 297084 - DNA, 20 bp, Artificial Sequence
  chemically synthesized
ttaattgacctcaataccat

SEQ ID NO: 297085 - DNA, 20 bp, Artificial Sequence
  chemically synthesized
ttgacctcaataccatgggt

SEQ ID NO: 297086 - DNA, 20 bp, Artificial Sequence
  chemically synthesized
accgtcaagtttctgaccca

SEQ ID NO: 297087 - DNA, 20 bp, Artificial Sequence
  chemically synthesized
accatgggtcagaaacttga

SEQ ID NO: 297088 - DNA, 20 bp, Artificial Sequence
  chemically synthesized
tctgtatgctatgaaccgtc

SEQ ID NO: 297089 - DNA, 20 bp, Artificial Sequence
  chemically synthesized
gtcagaaacttgacggttca

SEQ ID NO: 297090 - DNA, 20 bp, Artificial Sequence
  chemically synthesized
acttgacggttcatagcata

SEQ ID NO: 297091 - DNA, 20 bp, Artificial Sequence
  chemically synthesized
cggttcatagcatacagatt

SEQ ID NO: 297092 - DNA, 20 bp, Artificial Sequence
  chemically synthesized
agattgagttgttatttatc

SEQ ID NO: 297093 - DNA, 20 bp, Artificial Sequence
  chemically synthesized
gattgagttgttatttatcg

SEQ ID NO: 297094 - DNA, 20 bp, Artificial Sequence
  chemically synthesized
tctcttaatttcaagttgga

SEQ ID NO: 297095 - DNA, 20 bp, Artificial Sequence
  chemically synthesized
ctagtctcttaatttcaagt

SEQ ID NO: 297096 - DNA, 20 bp, Artificial Sequence
  chemically synthesized
aggctatccaacttgaaatt

SEQ ID NO: 297097 - DNA, 20 bp, Artificial Sequence
  chemically synthesized
atccctagtctcttaatttc

SEQ ID NO: 297098 - DNA, 20 bp, Artificial Sequence
  chemically synthesized
gctatccaacttgaaattaa

SEQ ID NO: 297099 - DNA, 20 bp, Artificial Sequence
  chemically synthesized
ccaacttgaaattaagagac

SEQ ID NO: 297100 - DNA, 20 bp, Artificial Sequence
  chemically synthesized
caacttgaaattaagagact

SEQ ID NO: 297101 - DNA, 20 bp, Artificial Sequence
  chemically synthesized
aacttgaaattaagagacta

SEQ ID NO: 297102 - DNA, 20 bp, Artificial Sequence
  chemically synthesized
tttagaggaatcaggatccc

SEQ ID NO: 297103 - DNA, 20 bp, Artificial Sequence
  chemically synthesized
acatgggatttagaggaatc

SEQ ID NO: 297104 - DNA, 20 bp, Artificial Sequence
  chemically synthesized
gacatgggatttagaggaat

SEQ ID NO: 297105 - DNA, 20 bp, Artificial Sequence
  chemically synthesized
ttcagtgacatgggatttag

SEQ ID NO: 297106 - DNA, 20 bp, Artificial Sequence
  chemically synthesized
attcagtgacatgggattta

SEQ ID NO: 297107 - DNA, 20 bp, Artificial Sequence
  chemically synthesized
acattcagtgacatgggatt

SEQ ID NO: 297108 - DNA, 20 bp, Artificial Sequence
  chemically synthesized
ttactgacattcagtgacat

SEQ ID NO: 297109 - DNA, 20 bp, Artificial Sequence
  chemically synthesized
cttactgacattcagtgaca

SEQ ID NO: 297110 - DNA, 20 bp, Artificial Sequence
  chemically synthesized
aatcccatgtcactgaatgt

SEQ ID NO: 297111 - DNA, 20 bp, Artificial Sequence
  chemically synthesized
acagataacttactgacatt

SEQ ID NO: 297112 - DNA, 20 bp, Artificial Sequence
  chemically synthesized
ccatgtcactgaatgtcagt

SEQ ID NO: 297113 - DNA, 20 bp, Artificial Sequence
  chemically synthesized
aaacatttgtaatgcataca

SEQ ID NO: 297114 - DNA, 20 bp, Artificial Sequence
  chemically synthesized
gtatgcattacaaatgttta

SEQ ID NO: 297115 - DNA, 20 bp, Artificial Sequence
  chemically synthesized
tgtggataaaaaatgtagga

SEQ ID NO: 297116 - DNA, 20 bp, Artificial Sequence
  chemically synthesized
aacttgtggataaaaaatgt

SEQ ID NO: 297117 - DNA, 20 bp, Artificial Sequence
  chemically synthesized
aaacttgtggataaaaaatg

SEQ ID NO: 297118 - DNA, 20 bp, Artificial Sequence
  chemically synthesized
ttcctacattttttatccac

SEQ ID NO: 297119 - DNA, 20 bp, Artificial Sequence
  chemically synthesized
gaacctgatagtcaaacttg

SEQ ID NO: 297120 - DNA, 20 bp, Artificial Sequence
  chemically synthesized
ttatccacaagtttgactat

SEQ ID NO: 297121 - DNA, 20 bp, Artificial Sequence
  chemically synthesized
tatccacaagtttgactatc

SEQ ID NO: 297122 - DNA, 20 bp, Artificial Sequence
  chemically synthesized
atgaagaaacaggaacctga

SEQ ID NO: 297123 - DNA, 20 bp, Artificial Sequence
  chemically synthesized
aacattatgaatgaagaaac

SEQ ID NO: 297124 - DNA, 20 bp, Artificial Sequence
  chemically synthesized
caacattatgaatgaagaaa

SEQ ID NO: 297125 - DNA, 20 bp, Artificial Sequence
  chemically synthesized
tttaatcaacattatgaatg

SEQ ID NO: 297126 - DNA, 20 bp, Artificial Sequence
  chemically synthesized
ataatgttgattaaaatata

SEQ ID NO: 297127 - DNA, 20 bp, Artificial Sequence
  chemically synthesized
gagagtgtgaaagattttta

SEQ ID NO: 297128 - DNA, 20 bp, Artificial Sequence
  chemically synthesized
catcgctgaagagagtgtga

SEQ ID NO: 297129 - DNA, 20 bp, Artificial Sequence
  chemically synthesized
aaaatctttcacactctctt

SEQ ID NO: 297130 - DNA, 20 bp, Artificial Sequence
  chemically synthesized
ggagttaacatcgctgaaga

SEQ ID NO: 297131 - DNA, 20 bp, Artificial Sequence
  chemically synthesized
aaggagttaacatcgctgaa

SEQ ID NO: 297132 - DNA, 20 bp, Artificial Sequence
  chemically synthesized
ttaaggagttaacatcgctg

SEQ ID NO: 297133 - DNA, 20 bp, Artificial Sequence
  chemically synthesized
atagtaggagagtatttaag

SEQ ID NO: 297134 - DNA, 20 bp, Artificial Sequence
  chemically synthesized
ccatagtaggagagtattta

SEQ ID NO: 297135 - DNA, 20 bp, Artificial Sequence
  chemically synthesized
accatagtaggagagtattt

SEQ ID NO: 297136 - DNA, 20 bp, Artificial Sequence
  chemically synthesized
atcaaataaccatagtagga

SEQ ID NO: 297137 - DNA, 20 bp, Artificial Sequence
  chemically synthesized
ccttaaatactctcctacta

SEQ ID NO: 297138 - DNA, 20 bp, Artificial Sequence
  chemically synthesized
taatcaaataaccatagtag

SEQ ID NO: 297139 - DNA, 20 bp, Artificial Sequence
  chemically synthesized
ggtaatcaaataaccatagt

SEQ ID NO: 297140 - DNA, 20 bp, Artificial Sequence
  chemically synthesized
aggtaatcaaataaccatag

SEQ ID NO: 297141 - DNA, 20 bp, Artificial Sequence
  chemically synthesized
ggtaggtaatcaaataacca

SEQ ID NO: 297142 - DNA, 20 bp, Artificial Sequence
  chemically synthesized
tataattcactggtttgggt

SEQ ID NO: 297143 - DNA, 20 bp, Artificial Sequence
  chemically synthesized
atttgattacctacccaaac

SEQ ID NO: 297144 - DNA, 20 bp, Artificial Sequence
  chemically synthesized
atataattcactggtttggg

SEQ ID NO: 297145 - DNA, 20 bp, Artificial Sequence
  chemically synthesized
gaaatataattcactggttt

SEQ ID NO: 297146 - DNA, 20 bp, Artificial Sequence
  chemically synthesized
tgaaatataattcactggtt

SEQ ID NO: 297147 - DNA, 20 bp, Artificial Sequence
  chemically synthesized
atgattgaaatataattcac

SEQ ID NO: 297148 - DNA, 20 bp, Artificial Sequence
  chemically synthesized
atgatgataaatatgcataa

SEQ ID NO: 297149 - DNA, 20 bp, Artificial Sequence
  chemically synthesized
agcaaaaataaaaatgtttt

SEQ ID NO: 297150 - DNA, 20 bp, Artificial Sequence
  chemically synthesized
aaacatttttatttttgctt

SEQ ID NO: 297151 - DNA, 20 bp, Artificial Sequence
  chemically synthesized
ggaaattttatgttgggcca

SEQ ID NO: 297152 - DNA, 20 bp, Artificial Sequence
  chemically synthesized
gacacaggaaattttatgtt

SEQ ID NO: 297153 - DNA, 20 bp, Artificial Sequence
  chemically synthesized
agacacaggaaattttatgt

SEQ ID NO: 297154 - DNA, 20 bp, Artificial Sequence
  chemically synthesized
gcttgcagatagagagacac

SEQ ID NO: 297155 - DNA, 20 bp, Artificial Sequence
  chemically synthesized
tgcttgcagatagagagaca

SEQ ID NO: 297156 - DNA, 20 bp, Artificial Sequence
  chemically synthesized
aatagatgcttgcagataga

SEQ ID NO: 297157 - DNA, 20 bp, Artificial Sequence
  chemically synthesized
tcctgtgtctctctatctgc

SEQ ID NO: 297158 - DNA, 20 bp, Artificial Sequence
  chemically synthesized
caaatagatgcttgcagata

SEQ ID NO: 297159 - DNA, 20 bp, Artificial Sequence
  chemically synthesized
ggcaaatagatgcttgcaga

SEQ ID NO: 297160 - DNA, 20 bp, Artificial Sequence
  chemically synthesized
tactggcaaatagatgcttg

SEQ ID NO: 297161 - DNA, 20 bp, Artificial Sequence
  chemically synthesized
atctgcaagcatctatttgc

SEQ ID NO: 297162 - DNA, 20 bp, Artificial Sequence
  chemically synthesized
ctgtccaatatactggcaaa

SEQ ID NO: 297163 - DNA, 20 bp, Artificial Sequence
  chemically synthesized
gcatctatttgccagtatat

SEQ ID NO: 297164 - DNA, 20 bp, Artificial Sequence
  chemically synthesized
tccttctctgtccaatatac

SEQ ID NO: 297165 - DNA, 20 bp, Artificial Sequence
  chemically synthesized
ctatttgccagtatattgga

SEQ ID NO: 297166 - DNA, 20 bp, Artificial Sequence
  chemically synthesized
atttgccagtatattggaca

SEQ ID NO: 297167 - DNA, 20 bp, Artificial Sequence
  chemically synthesized
tgccagtatattggacagag

SEQ ID NO: 297168 - DNA, 20 bp, Artificial Sequence
  chemically synthesized
gccagtatattggacagaga

SEQ ID NO: 297169 - DNA, 20 bp, Artificial Sequence
  chemically synthesized
cagtatattggacagagaag

SEQ ID NO: 297170 - DNA, 20 bp, Artificial Sequence
  chemically synthesized
attggacagagaaggagtgc

SEQ ID NO: 297171 - DNA, 20 bp, Artificial Sequence
  chemically synthesized
cccctaaagtattaacattc

SEQ ID NO: 297172 - DNA, 20 bp, Artificial Sequence
  chemically synthesized
gtgctggaatgttaatactt

SEQ ID NO: 297173 - DNA, 20 bp, Artificial Sequence
  chemically synthesized
tgctggaatgttaatacttt

SEQ ID NO: 297174 - DNA, 20 bp, Artificial Sequence
  chemically synthesized
gctggaatgttaatacttta

SEQ ID NO: 297175 - DNA, 20 bp, Artificial Sequence
  chemically synthesized
ctggaatgttaatactttag

SEQ ID NO: 297176 - DNA, 20 bp, Artificial Sequence
  chemically synthesized
ctggttaagggacaccccta

SEQ ID NO: 297177 - DNA, 20 bp, Artificial Sequence
  chemically synthesized
ctttaggggtgtcccttaac

SEQ ID NO: 297178 - DNA, 20 bp, Artificial Sequence
  chemically synthesized
tccaagctctcactggttaa

SEQ ID NO: 297179 - DNA, 20 bp, Artificial Sequence
  chemically synthesized
ttccaagctctcactggtta

SEQ ID NO: 297180 - DNA, 20 bp, Artificial Sequence
  chemically synthesized
aggggtgtcccttaaccagt

SEQ ID NO: 297181 - DNA, 20 bp, Artificial Sequence
  chemically synthesized
attccaagctctcactggtt

SEQ ID NO: 297182 - DNA, 20 bp, Artificial Sequence
  chemically synthesized
gggtgtcccttaaccagtga

SEQ ID NO: 297183 - DNA, 20 bp, Artificial Sequence
  chemically synthesized
caccaattccaagctctcac

SEQ ID NO: 297184 - DNA, 20 bp, Artificial Sequence
  chemically synthesized
tcccttaaccagtgagagct

SEQ ID NO: 297185 - DNA, 20 bp, Artificial Sequence
  chemically synthesized
aaccagtgagagcttggaat

SEQ ID NO: 297186 - DNA, 20 bp, Artificial Sequence
  chemically synthesized
ctgggaaattcaccaattcc

SEQ ID NO: 297187 - DNA, 20 bp, Artificial Sequence
  chemically synthesized
cttggaattggtgaatttcc

SEQ ID NO: 297188 - DNA, 20 bp, Artificial Sequence
  chemically synthesized
aactgaggggcaagggagct

SEQ ID NO: 297189 - DNA, 20 bp, Artificial Sequence
  chemically synthesized
caactgaggggcaagggagc

SEQ ID NO: 297190 - DNA, 20 bp, Artificial Sequence
  chemically synthesized
tgtccaactgaggggcaagg

SEQ ID NO: 297191 - DNA, 20 bp, Artificial Sequence
  chemically synthesized
attgtccaactgaggggcaa

SEQ ID NO: 297192 - DNA, 20 bp, Artificial Sequence
  chemically synthesized
ttcccagctcccttgcccct

SEQ ID NO: 297193 - DNA, 20 bp, Artificial Sequence
  chemically synthesized
gattgtccaactgaggggca

SEQ ID NO: 297194 - DNA, 20 bp, Artificial Sequence
  chemically synthesized
ggattgtccaactgaggggc

SEQ ID NO: 297195 - DNA, 20 bp, Artificial Sequence
  chemically synthesized
cagctcccttgcccctcagt

SEQ ID NO: 297196 - DNA, 20 bp, Artificial Sequence
  chemically synthesized
ttcaggattgtccaactgag

SEQ ID NO: 297197 - DNA, 20 bp, Artificial Sequence
  chemically synthesized
cttcaggattgtccaactga

SEQ ID NO: 297198 - DNA, 20 bp, Artificial Sequence
  chemically synthesized
acttcaggattgtccaactg

SEQ ID NO: 297199 - DNA, 20 bp, Artificial Sequence
  chemically synthesized
tacttcaggattgtccaact

SEQ ID NO: 297200 - DNA, 20 bp, Artificial Sequence
  chemically synthesized
ccctcagttggacaatcctg

SEQ ID NO: 297201 - DNA, 20 bp, Artificial Sequence
  chemically synthesized
gacactgtgtatcatacttc

SEQ ID NO: 297202 - DNA, 20 bp, Artificial Sequence
  chemically synthesized
agacactgtgtatcatactt

SEQ ID NO: 297203 - DNA, 20 bp, Artificial Sequence
  chemically synthesized
caatcctgaagtatgataca

SEQ ID NO: 297204 - DNA, 20 bp, Artificial Sequence
  chemically synthesized
agtatgatacacagtgtctc

SEQ ID NO: 297205 - DNA, 20 bp, Artificial Sequence
  chemically synthesized
gtatgatacacagtgtctca

SEQ ID NO: 297206 - DNA, 20 bp, Artificial Sequence
  chemically synthesized
tatgatacacagtgtctcaa

SEQ ID NO: 297207 - DNA, 20 bp, Artificial Sequence
  chemically synthesized
atgatacacagtgtctcaag

SEQ ID NO: 297208 - DNA, 20 bp, Artificial Sequence
  chemically synthesized
aatcatgcagggaacccctt

SEQ ID NO: 297209 - DNA, 20 bp, Artificial Sequence
  chemically synthesized
aactggggctcaatcatgca

SEQ ID NO: 297210 - DNA, 20 bp, Artificial Sequence
  chemically synthesized
gaactggggctcaatcatgc

SEQ ID NO: 297211 - DNA, 20 bp, Artificial Sequence
  chemically synthesized
aaggggttccctgcatgatt

SEQ ID NO: 297212 - DNA, 20 bp, Artificial Sequence
  chemically synthesized
ggaactggggctcaatcatg

SEQ ID NO: 297213 - DNA, 20 bp, Artificial Sequence
  chemically synthesized
ttccctgcatgattgagccc

SEQ ID NO: 297214 - DNA, 20 bp, Artificial Sequence
  chemically synthesized
gttactgctggaaggaactg

SEQ ID NO: 297215 - DNA, 20 bp, Artificial Sequence
  chemically synthesized
ggttactgctggaaggaact

SEQ ID NO: 297216 - DNA, 20 bp, Artificial Sequence
  chemically synthesized
aggttactgctggaaggaac

SEQ ID NO: 297217 - DNA, 20 bp, Artificial Sequence
  chemically synthesized
gattgagccccagttccttc

SEQ ID NO: 297218 - DNA, 20 bp, Artificial Sequence
  chemically synthesized
tgagccccagttccttccag

SEQ ID NO: 297219 - DNA, 20 bp, Artificial Sequence
  chemically synthesized
gggatcaggttactgctgga

SEQ ID NO: 297220 - DNA, 20 bp, Artificial Sequence
  chemically synthesized
agggatcaggttactgctgg

SEQ ID NO: 297221 - DNA, 20 bp, Artificial Sequence
  chemically synthesized
tatagggatcaggttactgc

SEQ ID NO: 297222 - DNA, 20 bp, Artificial Sequence
  chemically synthesized
atggcacaaatatagggatc

SEQ ID NO: 297223 - DNA, 20 bp, Artificial Sequence
  chemically synthesized
tatggcacaaatatagggat

SEQ ID NO: 297224 - DNA, 20 bp, Artificial Sequence
  chemically synthesized
taaagtatggcacaaatata

SEQ ID NO: 297225 - DNA, 20 bp, Artificial Sequence
  chemically synthesized
ataaagtatggcacaaatat

SEQ ID NO: 297226 - DNA, 20 bp, Artificial Sequence
  chemically synthesized
aataaagtatggcacaaata

SEQ ID NO: 297227 - DNA, 20 bp, Artificial Sequence
  chemically synthesized
ataaagcagccaataaagta

SEQ ID NO: 297228 - DNA, 20 bp, Artificial Sequence
  chemically synthesized
atatttgtgccatactttat

SEQ ID NO: 297229 - DNA, 20 bp, Artificial Sequence
  chemically synthesized
gaaaaataaagcagccaata

SEQ ID NO: 297230 - DNA, 20 bp, Artificial Sequence
  chemically synthesized
gtgaaataagaaaaataaag

SEQ ID NO: 297231 - DNA, 20 bp, Artificial Sequence
  chemically synthesized
gaagtgaaataagaaaaata

SEQ ID NO: 297232 - DNA, 20 bp, Artificial Sequence
  chemically synthesized
acaaagtagggaagtgaaat

SEQ ID NO: 297233 - DNA, 20 bp, Artificial Sequence
  chemically synthesized
tcccaggaaacaaagtaggg

SEQ ID NO: 297234 - DNA, 20 bp, Artificial Sequence
  chemically synthesized
tgatcccaggaaacaaagta

SEQ ID NO: 297235 - DNA, 20 bp, Artificial Sequence
  chemically synthesized
gtgatcccaggaaacaaagt

SEQ ID NO: 297236 - DNA, 20 bp, Artificial Sequence
  chemically synthesized
agtgatcccaggaaacaaag

SEQ ID NO: 297237 - DNA, 20 bp, Artificial Sequence
  chemically synthesized
cacttccctactttgtttcc

SEQ ID NO: 297238 - DNA, 20 bp, Artificial Sequence
  chemically synthesized
gaaagtgatcccaggaaaca

SEQ ID NO: 297239 - DNA, 20 bp, Artificial Sequence
  chemically synthesized
acttccctactttgtttcct

SEQ ID NO: 297240 - DNA, 20 bp, Artificial Sequence
  chemically synthesized
tttatttggaaagtgatccc

SEQ ID NO: 297241 - DNA, 20 bp, Artificial Sequence
  chemically synthesized
gtttatttggaaagtgatcc

SEQ ID NO: 297242 - DNA, 20 bp, Artificial Sequence
  chemically synthesized
gtgcaagcagtttatttgga

SEQ ID NO: 297243 - DNA, 20 bp, Artificial Sequence
  chemically synthesized
ttaggtgcaagcagtttatt

SEQ ID NO: 297244 - DNA, 20 bp, Artificial Sequence
  chemically synthesized
gagaaggatttaggtgcaag

SEQ ID NO: 297245 - DNA, 20 bp, Artificial Sequence
  chemically synthesized
gaagagaaggatttaggtgc

SEQ ID NO: 297246 - DNA, 20 bp, Artificial Sequence
  chemically synthesized
agatctgaagagaaggattt

SEQ ID NO: 297247 - DNA, 20 bp, Artificial Sequence
  chemically synthesized
tagatctgaagagaaggatt

SEQ ID NO: 297248 - DNA, 20 bp, Artificial Sequence
  chemically synthesized
tgcacctaaatccttctctt

SEQ ID NO: 297249 - DNA, 20 bp, Artificial Sequence
  chemically synthesized
caagagtagatctgaagaga

SEQ ID NO: 297250 - DNA, 20 bp, Artificial Sequence
  chemically synthesized
ccaagagtagatctgaagag

SEQ ID NO: 297251 - DNA, 20 bp, Artificial Sequence
  chemically synthesized
gccccaagagtagatctgaa

SEQ ID NO: 297252 - DNA, 20 bp, Artificial Sequence
  chemically synthesized
ttgccccaagagtagatctg

SEQ ID NO: 297253 - DNA, 20 bp, Artificial Sequence
  chemically synthesized
cttctcttcagatctactct

SEQ ID NO: 297254 - DNA, 20 bp, Artificial Sequence
  chemically synthesized
ttctcttcagatctactctt

SEQ ID NO: 297255 - DNA, 20 bp, Artificial Sequence
  chemically synthesized
tctcttcagatctactcttg

SEQ ID NO: 297256 - DNA, 20 bp, Artificial Sequence
  chemically synthesized
agtttgggttgccccaagag

SEQ ID NO: 297257 - DNA, 20 bp, Artificial Sequence
  chemically synthesized
cttagtttgggttgccccaa

SEQ ID NO: 297258 - DNA, 20 bp, Artificial Sequence
  chemically synthesized
gccttagtttgggttgcccc

SEQ ID NO: 297259 - DNA, 20 bp, Artificial Sequence
  chemically synthesized
ctcttggggcaacccaaact

SEQ ID NO: 297260 - DNA, 20 bp, Artificial Sequence
  chemically synthesized
tcttggggcaacccaaacta

SEQ ID NO: 297261 - DNA, 20 bp, Artificial Sequence
  chemically synthesized
gttgattattgccttagttt

SEQ ID NO: 297262 - DNA, 20 bp, Artificial Sequence
  chemically synthesized
tgttgattattgccttagtt

SEQ ID NO: 297263 - DNA, 20 bp, Artificial Sequence
  chemically synthesized
gaggctgttgattattgcct

SEQ ID NO: 297264 - DNA, 20 bp, Artificial Sequence
  chemically synthesized
caaactaaggcaataatcaa

SEQ ID NO: 297265 - DNA, 20 bp, Artificial Sequence
  chemically synthesized
caggatgctaggttcatttg

SEQ ID NO: 297266 - DNA, 20 bp, Artificial Sequence
  chemically synthesized
gcaggatgctaggttcattt

SEQ ID NO: 297267 - DNA, 20 bp, Artificial Sequence
  chemically synthesized
tcaacagcctcaaatgaacc

SEQ ID NO: 297268 - DNA, 20 bp, Artificial Sequence
  chemically synthesized
aaaaagtatggcaggatgct

SEQ ID NO: 297269 - DNA, 20 bp, Artificial Sequence
  chemically synthesized
aaaaaagtatggcaggatgc

SEQ ID NO: 297270 - DNA, 20 bp, Artificial Sequence
  chemically synthesized
aaaaaaaaaaaaagtatggc

SEQ ID NO: 297271 - DNA, 20 bp, Artificial Sequence
  chemically synthesized
aaaaaaaaaaaaaagtatgg

SEQ ID NO: 297272 - DNA, 20 bp, Artificial Sequence
  chemically synthesized
aaaaaaaaaaaaaaaaagta

SEQ ID NO: 297273 - DNA, 20 bp, Artificial Sequence
  chemically synthesized
ggaaaaaaaaaaaaaaaaaa

SEQ ID NO: 297274 - DNA, 20 bp, Artificial Sequence
  chemically synthesized
tttttttttttttttttccc

SEQ ID NO: 297275 - DNA, 20 bp, Artificial Sequence
  chemically synthesized
tttttttttttttcccaagt

SEQ ID NO: 297276 - DNA, 20 bp, Artificial Sequence
  chemically synthesized
ttttttttttttcccaagtt

SEQ ID NO: 297277 - DNA, 20 bp, Artificial Sequence
  chemically synthesized
agagacttagagcccaactt

SEQ ID NO: 297278 - DNA, 20 bp, Artificial Sequence
  chemically synthesized
tagagacttagagcccaact

SEQ ID NO: 297279 - DNA, 20 bp, Artificial Sequence
  chemically synthesized
tttttcccaagttgggctct

SEQ ID NO: 297280 - DNA, 20 bp, Artificial Sequence
  chemically synthesized
atagttcctgtagagactta

SEQ ID NO: 297281 - DNA, 20 bp, Artificial Sequence
  chemically synthesized
taatagttcctgtagagact

SEQ ID NO: 297282 - DNA, 20 bp, Artificial Sequence
  chemically synthesized
agttgggctctaagtctcta

SEQ ID NO: 297283 - DNA, 20 bp, Artificial Sequence
  chemically synthesized
gttgggctctaagtctctac

SEQ ID NO: 297284 - DNA, 20 bp, Artificial Sequence
  chemically synthesized
aggttttaatagttcctgta

SEQ ID NO: 297285 - DNA, 20 bp, Artificial Sequence
  chemically synthesized
aaaggttttaatagttcctg

SEQ ID NO: 297286 - DNA, 20 bp, Artificial Sequence
  chemically synthesized
gctttgataaaaggttttaa

SEQ ID NO: 297287 - DNA, 20 bp, Artificial Sequence
  chemically synthesized
actattaaaaccttttatca

SEQ ID NO: 297288 - DNA, 20 bp, Artificial Sequence
  chemically synthesized
tgggccagagctttgataaa

SEQ ID NO: 297289 - DNA, 20 bp, Artificial Sequence
  chemically synthesized
atgggccagagctttgataa

SEQ ID NO: 297290 - DNA, 20 bp, Artificial Sequence
  chemically synthesized
aaaaccttttatcaaagctc

SEQ ID NO: 297291 - DNA, 20 bp, Artificial Sequence
  chemically synthesized
tgcagaaagaggatgggcca

SEQ ID NO: 297292 - DNA, 20 bp, Artificial Sequence
  chemically synthesized
gctgcagaaagaggatgggc

SEQ ID NO: 297293 - DNA, 20 bp, Artificial Sequence
  chemically synthesized
gagagctgcagaaagaggat

SEQ ID NO: 297294 - DNA, 20 bp, Artificial Sequence
  chemically synthesized
agagagctgcagaaagagga

SEQ ID NO: 297295 - DNA, 20 bp, Artificial Sequence
  chemically synthesized
tctggcccatcctctttctg

SEQ ID NO: 297296 - DNA, 20 bp, Artificial Sequence
  chemically synthesized
tctgagagagctgcagaaag

SEQ ID NO: 297297 - DNA, 20 bp, Artificial Sequence
  chemically synthesized
atctgagagagctgcagaaa

SEQ ID NO: 297298 - DNA, 20 bp, Artificial Sequence
  chemically synthesized
tcatctgagagagctgcaga

SEQ ID NO: 297299 - DNA, 20 bp, Artificial Sequence
  chemically synthesized
aagatcatctgagagagctg

SEQ ID NO: 297300 - DNA, 20 bp, Artificial Sequence
  chemically synthesized
tcctctttctgcagctctct

SEQ ID NO: 297301 - DNA, 20 bp, Artificial Sequence
  chemically synthesized
gggaacaagatcatctgaga

SEQ ID NO: 297302 - DNA, 20 bp, Artificial Sequence
  chemically synthesized
tagggaacaagatcatctga

SEQ ID NO: 297303 - DNA, 20 bp, Artificial Sequence
  chemically synthesized
ggtagggaacaagatcatct

SEQ ID NO: 297304 - DNA, 20 bp, Artificial Sequence
  chemically synthesized
gtttctgtaaggtagggaac

SEQ ID NO: 297305 - DNA, 20 bp, Artificial Sequence
  chemically synthesized
tgatcttgttccctacctta

SEQ ID NO: 297306 - DNA, 20 bp, Artificial Sequence
  chemically synthesized
gcacttgtttctgtaaggta

SEQ ID NO: 297307 - DNA, 20 bp, Artificial Sequence
  chemically synthesized
tgcacttgtttctgtaaggt

SEQ ID NO: 297308 - DNA, 20 bp, Artificial Sequence
  chemically synthesized
ttgcacttgtttctgtaagg

SEQ ID NO: 297309 - DNA, 20 bp, Artificial Sequence
  chemically synthesized
taattgcacttgtttctgta

SEQ ID NO: 297310 - DNA, 20 bp, Artificial Sequence
  chemically synthesized
ataattgcacttgtttctgt

SEQ ID NO: 297311 - DNA, 20 bp, Artificial Sequence
  chemically synthesized
gttccctaccttacagaaac

SEQ ID NO: 297312 - DNA, 20 bp, Artificial Sequence
  chemically synthesized
acagaaacaagtgcaattat

SEQ ID NO: 297313 - DNA, 20 bp, Artificial Sequence
  chemically synthesized
agaaacaagtgcaattatca

SEQ ID NO: 297314 - DNA, 20 bp, Artificial Sequence
  chemically synthesized
aacaagtgcaattatcagag

SEQ ID NO: 297315 - DNA, 20 bp, Artificial Sequence
  chemically synthesized
ttggaaataggaagtgaaag

SEQ ID NO: 297316 - DNA, 20 bp, Artificial Sequence
  chemically synthesized
tgtttggaaataggaagtga

SEQ ID NO: 297317 - DNA, 20 bp, Artificial Sequence
  chemically synthesized
tgatggtgtttggaaatagg

SEQ ID NO: 297318 - DNA, 20 bp, Artificial Sequence
  chemically synthesized
gtctgatggtgtttggaaat

SEQ ID NO: 297319 - DNA, 20 bp, Artificial Sequence
  chemically synthesized
ggtctgatggtgtttggaaa

SEQ ID NO: 297320 - DNA, 20 bp, Artificial Sequence
  chemically synthesized
tatgcgggtctgatggtgtt

SEQ ID NO: 297321 - DNA, 20 bp, Artificial Sequence
  chemically synthesized
ttcctatttccaaacaccat

SEQ ID NO: 297322 - DNA, 20 bp, Artificial Sequence
  chemically synthesized
ggctacatatgcgggtctga

SEQ ID NO: 297323 - DNA, 20 bp, Artificial Sequence
  chemically synthesized
caccatcagacccgcatatg

SEQ ID NO: 297324 - DNA, 20 bp, Artificial Sequence
  chemically synthesized
agaacggtggctacatatgc

SEQ ID NO: 297325 - DNA, 20 bp, Artificial Sequence
  chemically synthesized
gagaacggtggctacatatg

SEQ ID NO: 297326 - DNA, 20 bp, Artificial Sequence
  chemically synthesized
aaagaagggaatgagaacgg

SEQ ID NO: 297327 - DNA, 20 bp, Artificial Sequence
  chemically synthesized
gtaaaagaagggaatgagaa

SEQ ID NO: 297328 - DNA, 20 bp, Artificial Sequence
  chemically synthesized
caaatgtaaaagaagggaat

SEQ ID NO: 297329 - DNA, 20 bp, Artificial Sequence
  chemically synthesized
gaaactcaaatgtaaaagaa

SEQ ID NO: 297330 - DNA, 20 bp, Artificial Sequence
  chemically synthesized
ggaaactcaaatgtaaaaga

SEQ ID NO: 297331 - DNA, 20 bp, Artificial Sequence
  chemically synthesized
gggaaactcaaatgtaaaag

SEQ ID NO: 297332 - DNA, 20 bp, Artificial Sequence
  chemically synthesized
gaagggaaactcaaatgtaa

SEQ ID NO: 297333 - DNA, 20 bp, Artificial Sequence
  chemically synthesized
cattcccttcttttacattt

SEQ ID NO: 297334 - DNA, 20 bp, Artificial Sequence
  chemically synthesized
aatgactttaattaaaagaa

SEQ ID NO: 297335 - DNA, 20 bp, Artificial Sequence
  chemically synthesized
gaatgactttaattaaaaga

SEQ ID NO: 297336 - DNA, 20 bp, Artificial Sequence
  chemically synthesized
ggaatgactttaattaaaag

SEQ ID NO: 297337 - DNA, 20 bp, Artificial Sequence
  chemically synthesized
agtttcccttcttttaatta

SEQ ID NO: 297338 - DNA, 20 bp, Artificial Sequence
  chemically synthesized
gtgggaatgactttaattaa

SEQ ID NO: 297339 - DNA, 20 bp, Artificial Sequence
  chemically synthesized
aagttcaaaatgtaggtagt

SEQ ID NO: 297340 - DNA, 20 bp, Artificial Sequence
  chemically synthesized
aaagttcaaaatgtaggtag

SEQ ID NO: 297341 - DNA, 20 bp, Artificial Sequence
  chemically synthesized
aataaagttcaaaatgtagg

SEQ ID NO: 297342 - DNA, 20 bp, Artificial Sequence
  chemically synthesized
gagaataaagttcaaaatgt

SEQ ID NO: 297343 - DNA, 20 bp, Artificial Sequence
  chemically synthesized
agagaataaagttcaaaatg

SEQ ID NO: 297344 - DNA, 20 bp, Artificial Sequence
  chemically synthesized
tgagcaaaagtaagagaata

SEQ ID NO: 297345 - DNA, 20 bp, Artificial Sequence
  chemically synthesized
agatgcttgagcaaaagtaa

SEQ ID NO: 297346 - DNA, 20 bp, Artificial Sequence
  chemically synthesized
tcagatgcttgagcaaaagt

SEQ ID NO: 297347 - DNA, 20 bp, Artificial Sequence
  chemically synthesized
ttattctcttacttttgctc

SEQ ID NO: 297348 - DNA, 20 bp, Artificial Sequence
  chemically synthesized
ggactcagatgcttgagcaa

SEQ ID NO: 297349 - DNA, 20 bp, Artificial Sequence
  chemically synthesized
ttggatggactcagatgctt

SEQ ID NO: 297350 - DNA, 20 bp, Artificial Sequence
  chemically synthesized
ttacttttgctcaagcatct

SEQ ID NO: 297351 - DNA, 20 bp, Artificial Sequence
  chemically synthesized
tactagaaattggatggact

SEQ ID NO: 297352 - DNA, 20 bp, Artificial Sequence
  chemically synthesized
aacaaatactagaaattgga

SEQ ID NO: 297353 - DNA, 20 bp, Artificial Sequence
  chemically synthesized
atctgagtccatccaatttc

SEQ ID NO: 297354 - DNA, 20 bp, Artificial Sequence
  chemically synthesized
aataaacaaatactagaaat

SEQ ID NO: 297355 - DNA, 20 bp, Artificial Sequence
  chemically synthesized
gtctcaaaataaacaaatac

SEQ ID NO: 297356 - DNA, 20 bp, Artificial Sequence
  chemically synthesized
ttctagtatttgtttatttt

SEQ ID NO: 297357 - DNA, 20 bp, Artificial Sequence
  chemically synthesized
agtatttgtttattttgaga

SEQ ID NO: 297358 - DNA, 20 bp, Artificial Sequence
  chemically synthesized
tatttgtttattttgagacg

SEQ ID NO: 297359 - DNA, 20 bp, Artificial Sequence
  chemically synthesized
ctccagcctggtgacagagt

SEQ ID NO: 297360 - DNA, 20 bp, Artificial Sequence
  chemically synthesized
acggagtctcactctgtcac

SEQ ID NO: 297361 - DNA, 20 bp, Artificial Sequence
  chemically synthesized
cggagtctcactctgtcacc

SEQ ID NO: 297362 - DNA, 20 bp, Artificial Sequence
  chemically synthesized
tgcactccagcctggtgaca

SEQ ID NO: 297363 - DNA, 20 bp, Artificial Sequence
  chemically synthesized
actgcactccagcctggtga

SEQ ID NO: 297364 - DNA, 20 bp, Artificial Sequence
  chemically synthesized
gtctcactctgtcaccaggc

SEQ ID NO: 297365 - DNA, 20 bp, Artificial Sequence
  chemically synthesized
ctcactctgtcaccaggctg

SEQ ID NO: 297366 - DNA, 20 bp, Artificial Sequence
  chemically synthesized
tgcaccactgcactccagcc

SEQ ID NO: 297367 - DNA, 20 bp, Artificial Sequence
  chemically synthesized
tctgtcaccaggctggagtg

SEQ ID NO: 297368 - DNA, 20 bp, Artificial Sequence
  chemically synthesized
cagattgcaccactgcactc

SEQ ID NO: 297369 - DNA, 20 bp, Artificial Sequence
  chemically synthesized
gtcaccaggctggagtgcag

SEQ ID NO: 297370 - DNA, 20 bp, Artificial Sequence
  chemically synthesized
tggagtgcagtggtgcaatc

SEQ ID NO: 297371 - DNA, 20 bp, Artificial Sequence
  chemically synthesized
ggcagaggttgtggtgagac

SEQ ID NO: 297372 - DNA, 20 bp, Artificial Sequence
  chemically synthesized
cgggaggcagaggttgtggt

SEQ ID NO: 297373 - DNA, 20 bp, Artificial Sequence
  chemically synthesized
aacccgggaggcagaggttg

SEQ ID NO: 297374 - DNA, 20 bp, Artificial Sequence
  chemically synthesized
tccttgaacccgggaggcag

SEQ ID NO: 297375 - DNA, 20 bp, Artificial Sequence
  chemically synthesized
tcaccacaacctctgcctcc

SEQ ID NO: 297376 - DNA, 20 bp, Artificial Sequence
  chemically synthesized
ttccttgaacccgggaggca

SEQ ID NO: 297377 - DNA, 20 bp, Artificial Sequence
  chemically synthesized
caccacaacctctgcctccc

SEQ ID NO: 297378 - DNA, 20 bp, Artificial Sequence
  chemically synthesized
aattccttgaacccgggagg

SEQ ID NO: 297379 - DNA, 20 bp, Artificial Sequence
  chemically synthesized
gggaattccttgaacccggg

SEQ ID NO: 297380 - DNA, 20 bp, Artificial Sequence
  chemically synthesized
ggggaattccttgaacccgg

SEQ ID NO: 297381 - DNA, 20 bp, Artificial Sequence
  chemically synthesized
aacctctgcctcccgggttc

SEQ ID NO: 297382 - DNA, 20 bp, Artificial Sequence
  chemically synthesized
acctctgcctcccgggttca

SEQ ID NO: 297383 - DNA, 20 bp, Artificial Sequence
  chemically synthesized
caggggaattccttgaaccc

SEQ ID NO: 297384 - DNA, 20 bp, Artificial Sequence
  chemically synthesized
gcaggggaattccttgaacc

SEQ ID NO: 297385 - DNA, 20 bp, Artificial Sequence
  chemically synthesized
ttcaaggaattcccctgcct

SEQ ID NO: 297386 - DNA, 20 bp, Artificial Sequence
  chemically synthesized
tacttgggaggctgaggcag

SEQ ID NO: 297387 - DNA, 20 bp, Artificial Sequence
  chemically synthesized
ctacttgggaggctgaggca

SEQ ID NO: 297388 - DNA, 20 bp, Artificial Sequence
  chemically synthesized
gctacttgggaggctgaggc

SEQ ID NO: 297389 - DNA, 20 bp, Artificial Sequence
  chemically synthesized
agctacttgggaggctgagg

SEQ ID NO: 297390 - DNA, 20 bp, Artificial Sequence
  chemically synthesized
cctagctacttgggaggctg

SEQ ID NO: 297391 - DNA, 20 bp, Artificial Sequence
  chemically synthesized
tcctagctacttgggaggct

SEQ ID NO: 297392 - DNA, 20 bp, Artificial Sequence
  chemically synthesized
ttcccctgcctcagcctccc

SEQ ID NO: 297393 - DNA, 20 bp, Artificial Sequence
  chemically synthesized
ccctgcctcagcctcccaag

SEQ ID NO: 297394 - DNA, 20 bp, Artificial Sequence
  chemically synthesized
tgtagtcctagctacttggg

SEQ ID NO: 297395 - DNA, 20 bp, Artificial Sequence
  chemically synthesized
ctgtagtcctagctacttgg

SEQ ID NO: 297396 - DNA, 20 bp, Artificial Sequence
  chemically synthesized
gcctcagcctcccaagtagc

SEQ ID NO: 297397 - DNA, 20 bp, Artificial Sequence
  chemically synthesized
aactgtagtcctagctactt

SEQ ID NO: 297398 - DNA, 20 bp, Artificial Sequence
  chemically synthesized
cctcagcctcccaagtagct

SEQ ID NO: 297399 - DNA, 20 bp, Artificial Sequence
  chemically synthesized
taactgtagtcctagctact

SEQ ID NO: 297400 - DNA, 20 bp, Artificial Sequence
  chemically synthesized
ctcccaagtagctaggacta

SEQ ID NO: 297401 - DNA, 20 bp, Artificial Sequence
  chemically synthesized
aacagtgttaactgtagtcc

SEQ ID NO: 297402 - DNA, 20 bp, Artificial Sequence
  chemically synthesized
atggtcaacagtgttaactg

SEQ ID NO: 297403 - DNA, 20 bp, Artificial Sequence
  chemically synthesized
caaacggatagtatggtcaa

SEQ ID NO: 297404 - DNA, 20 bp, Artificial Sequence
  chemically synthesized
aaaattacaaacggatagta

SEQ ID NO: 297405 - DNA, 20 bp, Artificial Sequence
  chemically synthesized
gaagaaaaattacaaacgga

SEQ ID NO: 297406 - DNA, 20 bp, Artificial Sequence
  chemically synthesized
aaaggaagaaaaattacaaa

SEQ ID NO: 297407 - DNA, 20 bp, Artificial Sequence
  chemically synthesized
gtttgtaatttttcttcctt

SEQ ID NO: 297408 - DNA, 20 bp, Artificial Sequence
  chemically synthesized
tggcatcatgaagccaaagg

SEQ ID NO: 297409 - DNA, 20 bp, Artificial Sequence
  chemically synthesized
gagtggcatcatgaagccaa

SEQ ID NO: 297410 - DNA, 20 bp, Artificial Sequence
  chemically synthesized
agagtggcatcatgaagcca

SEQ ID NO: 297411 - DNA, 20 bp, Artificial Sequence
  chemically synthesized
tagaatagagtggcatcatg

SEQ ID NO: 297412 - DNA, 20 bp, Artificial Sequence
  chemically synthesized
gaaggcaaattagaatagag

SEQ ID NO: 297413 - DNA, 20 bp, Artificial Sequence
  chemically synthesized
atagaaggcaaattagaata

SEQ ID NO: 297414 - DNA, 20 bp, Artificial Sequence
  chemically synthesized
aaatagaaggcaaattagaa

SEQ ID NO: 297415 - DNA, 20 bp, Artificial Sequence
  chemically synthesized
catagaaatagaaggcaaat

SEQ ID NO: 297416 - DNA, 20 bp, Artificial Sequence
  chemically synthesized
ccaatggtcatagaaataga

SEQ ID NO: 297417 - DNA, 20 bp, Artificial Sequence
  chemically synthesized
accaatggtcatagaaatag

SEQ ID NO: 297418 - DNA, 20 bp, Artificial Sequence
  chemically synthesized
attaccaatggtcatagaaa

SEQ ID NO: 297419 - DNA, 20 bp, Artificial Sequence
  chemically synthesized
ccttctatttctatgaccat

SEQ ID NO: 297420 - DNA, 20 bp, Artificial Sequence
  chemically synthesized
gaaaaaattaccaatggtca

SEQ ID NO: 297421 - DNA, 20 bp, Artificial Sequence
  chemically synthesized
tgcaaagaaaaaattaccaa

SEQ ID NO: 297422 - DNA, 20 bp, Artificial Sequence
  chemically synthesized
cattggtaattttttctttg

SEQ ID NO: 297423 - DNA, 20 bp, Artificial Sequence
  chemically synthesized
attggtaattttttctttgc

SEQ ID NO: 297424 - DNA, 20 bp, Artificial Sequence
  chemically synthesized
tggaggaggatggacctgca

SEQ ID NO: 297425 - DNA, 20 bp, Artificial Sequence
  chemically synthesized
aatgatagggtggaggagga

SEQ ID NO: 297426 - DNA, 20 bp, Artificial Sequence
  chemically synthesized
acataatgatagggtggagg

SEQ ID NO: 297427 - DNA, 20 bp, Artificial Sequence
  chemically synthesized
tacataatgatagggtggag

SEQ ID NO: 297428 - DNA, 20 bp, Artificial Sequence
  chemically synthesized
agtacataatgatagggtgg

SEQ ID NO: 297429 - DNA, 20 bp, Artificial Sequence
  chemically synthesized
tagtacataatgatagggtg

SEQ ID NO: 297430 - DNA, 20 bp, Artificial Sequence
  chemically synthesized
tctagtacataatgataggg

SEQ ID NO: 297431 - DNA, 20 bp, Artificial Sequence
  chemically synthesized
acatctagtacataatgata

SEQ ID NO: 297432 - DNA, 20 bp, Artificial Sequence
  chemically synthesized
gacatctagtacataatgat

SEQ ID NO: 297433 - DNA, 20 bp, Artificial Sequence
  chemically synthesized
tgacatctagtacataatga

SEQ ID NO: 297434 - DNA, 20 bp, Artificial Sequence
  chemically synthesized
tccaccctatcattatgtac

SEQ ID NO: 297435 - DNA, 20 bp, Artificial Sequence
  chemically synthesized
atcattatgtactagatgtc

SEQ ID NO: 297436 - DNA, 20 bp, Artificial Sequence
  chemically synthesized
atgaactaggtcttgacatc

SEQ ID NO: 297437 - DNA, 20 bp, Artificial Sequence
  chemically synthesized
atgtactagatgtcaagacc

SEQ ID NO: 297438 - DNA, 20 bp, Artificial Sequence
  chemically synthesized
aagatgattggtaatgaact

SEQ ID NO: 297439 - DNA, 20 bp, Artificial Sequence
  chemically synthesized
gaagatgattggtaatgaac

SEQ ID NO: 297440 - DNA, 20 bp, Artificial Sequence
  chemically synthesized
atagtagagtagaagatgat

SEQ ID NO: 297441 - DNA, 20 bp, Artificial Sequence
  chemically synthesized
ggtgagagatagtagagtag

SEQ ID NO: 297442 - DNA, 20 bp, Artificial Sequence
  chemically synthesized
tctggtgagagatagtagag

SEQ ID NO: 297443 - DNA, 20 bp, Artificial Sequence
  chemically synthesized
ttttctggtgagagatagta

SEQ ID NO: 297444 - DNA, 20 bp, Artificial Sequence
  chemically synthesized
tgttttctggtgagagatag

SEQ ID NO: 297445 - DNA, 20 bp, Artificial Sequence
  chemically synthesized
atgtgttttctggtgagaga

SEQ ID NO: 297446 - DNA, 20 bp, Artificial Sequence
  chemically synthesized
tctactctactatctctcac

SEQ ID NO: 297447 - DNA, 20 bp, Artificial Sequence
  chemically synthesized
actgatgtgttttctggtga

SEQ ID NO: 297448 - DNA, 20 bp, Artificial Sequence
  chemically synthesized
tgactgatgtgttttctggt

SEQ ID NO: 297449 - DNA, 20 bp, Artificial Sequence
  chemically synthesized
atgatgactgatgtgttttc

SEQ ID NO: 297450 - DNA, 20 bp, Artificial Sequence
  chemically synthesized
tctctcaccagaaaacacat

SEQ ID NO: 297451 - DNA, 20 bp, Artificial Sequence
  chemically synthesized
gataaatagattgcaattca

SEQ ID NO: 297452 - DNA, 20 bp, Artificial Sequence
  chemically synthesized
tgataaatagattgcaattc

SEQ ID NO: 297453 - DNA, 20 bp, Artificial Sequence
  chemically synthesized
atatcagaatcattgataaa

SEQ ID NO: 297454 - DNA, 20 bp, Artificial Sequence
  chemically synthesized
tgaattagagatatacatat

SEQ ID NO: 297455 - DNA, 20 bp, Artificial Sequence
  chemically synthesized
tgatatgtatatctctaatt

SEQ ID NO: 297456 - DNA, 20 bp, Artificial Sequence
  chemically synthesized
gatatgtatatctctaattc

SEQ ID NO: 297457 - DNA, 20 bp, Artificial Sequence
  chemically synthesized
cagaacaagtgcctgaatta

SEQ ID NO: 297458 - DNA, 20 bp, Artificial Sequence
  chemically synthesized
ttcagaacaagtgcctgaat

SEQ ID NO: 297459 - DNA, 20 bp, Artificial Sequence
  chemically synthesized
atagctgtggaattcagaac

SEQ ID NO: 297460 - DNA, 20 bp, Artificial Sequence
  chemically synthesized
ggcacttgttctgaattcca

SEQ ID NO: 297461 - DNA, 20 bp, Artificial Sequence
  chemically synthesized
ggttatatagctgtggaatt

SEQ ID NO: 297462 - DNA, 20 bp, Artificial Sequence
  chemically synthesized
ggcagatggttatatagctg

SEQ ID NO: 297463 - DNA, 20 bp, Artificial Sequence
  chemically synthesized
ccaataggcagatggttata

SEQ ID NO: 297464 - DNA, 20 bp, Artificial Sequence
  chemically synthesized
ggagacatccaataggcaga

SEQ ID NO: 297465 - DNA, 20 bp, Artificial Sequence
  chemically synthesized
ctatataaccatctgcctat

SEQ ID NO: 297466 - DNA, 20 bp, Artificial Sequence
  chemically synthesized
aagtggagacatccaatagg

SEQ ID NO: 297467 - DNA, 20 bp, Artificial Sequence
  chemically synthesized
tgcaagtggagacatccaat

SEQ ID NO: 297468 - DNA, 20 bp, Artificial Sequence
  chemically synthesized
atgcaagtggagacatccaa

SEQ ID NO: 297469 - DNA, 20 bp, Artificial Sequence
  chemically synthesized
gattttgcagcatgcaagtg

SEQ ID NO: 297470 - DNA, 20 bp, Artificial Sequence
  chemically synthesized
gagattttgcagcatgcaag

SEQ ID NO: 297471 - DNA, 20 bp, Artificial Sequence
  chemically synthesized
aaggagattttgcagcatgc

SEQ ID NO: 297472 - DNA, 20 bp, Artificial Sequence
  chemically synthesized
taatgtttaaggagattttg

SEQ ID NO: 297473 - DNA, 20 bp, Artificial Sequence
  chemically synthesized
cttggcatataatgtttaag

SEQ ID NO: 297474 - DNA, 20 bp, Artificial Sequence
  chemically synthesized
accttggcatataatgttta

SEQ ID NO: 297475 - DNA, 20 bp, Artificial Sequence
  chemically synthesized
aaccttggcatataatgttt

SEQ ID NO: 297476 - DNA, 20 bp, Artificial Sequence
  chemically synthesized
ctccttaaacattatatgcc

SEQ ID NO: 297477 - DNA, 20 bp, Artificial Sequence
  chemically synthesized
tccttaaacattatatgcca

SEQ ID NO: 297478 - DNA, 20 bp, Artificial Sequence
  chemically synthesized
acattatatgccaaggttta

SEQ ID NO: 297479 - DNA, 20 bp, Artificial Sequence
  chemically synthesized
gaagatcaaactttaaacct

SEQ ID NO: 297480 - DNA, 20 bp, Artificial Sequence
  chemically synthesized
agagtactagtttgagggag

SEQ ID NO: 297481 - DNA, 20 bp, Artificial Sequence
  chemically synthesized
gatagagtactagtttgagg

SEQ ID NO: 297482 - DNA, 20 bp, Artificial Sequence
  chemically synthesized
tttgatcttctccctcaaac

SEQ ID NO: 297483 - DNA, 20 bp, Artificial Sequence
  chemically synthesized
ctgatagagtactagtttga

SEQ ID NO: 297484 - DNA, 20 bp, Artificial Sequence
  chemically synthesized
actgatagagtactagtttg

SEQ ID NO: 297485 - DNA, 20 bp, Artificial Sequence
  chemically synthesized
tactgatagagtactagttt

SEQ ID NO: 297486 - DNA, 20 bp, Artificial Sequence
  chemically synthesized
ggggaatactgatagagtac

SEQ ID NO: 297487 - DNA, 20 bp, Artificial Sequence
  chemically synthesized
ccctcaaactagtactctat

SEQ ID NO: 297488 - DNA, 20 bp, Artificial Sequence
  chemically synthesized
tgatctggggaatactgata

SEQ ID NO: 297489 - DNA, 20 bp, Artificial Sequence
  chemically synthesized
actgatctggggaatactga

SEQ ID NO: 297490 - DNA, 20 bp, Artificial Sequence
  chemically synthesized
agtactctatcagtattccc

SEQ ID NO: 297491 - DNA, 20 bp, Artificial Sequence
  chemically synthesized
tctatcagtattccccagat

SEQ ID NO: 297492 - DNA, 20 bp, Artificial Sequence
  chemically synthesized
tgatgctaattactgatctg

SEQ ID NO: 297493 - DNA, 20 bp, Artificial Sequence
  chemically synthesized
gtgatgctaattactgatct

SEQ ID NO: 297494 - DNA, 20 bp, Artificial Sequence
  chemically synthesized
ggtgatgctaattactgatc

SEQ ID NO: 297495 - DNA, 20 bp, Artificial Sequence
  chemically synthesized
gtattccccagatcagtaat

SEQ ID NO: 297496 - DNA, 20 bp, Artificial Sequence
  chemically synthesized
aagataacaaatatgaggga

SEQ ID NO: 297497 - DNA, 20 bp, Artificial Sequence
  chemically synthesized
gatgaagataacaaatatga

SEQ ID NO: 297498 - DNA, 20 bp, Artificial Sequence
  chemically synthesized
agatgaagataacaaatatg

SEQ ID NO: 297499 - DNA, 20 bp, Artificial Sequence
  chemically synthesized
gagatgaagataacaaatat

SEQ ID NO: 297500 - DNA, 20 bp, Artificial Sequence
  chemically synthesized
ttcagtccatagcggagatg

SEQ ID NO: 297501 - DNA, 20 bp, Artificial Sequence
  chemically synthesized
tgttatcttcatctccgcta

SEQ ID NO: 297502 - DNA, 20 bp, Artificial Sequence
  chemically synthesized
acaaaattcagtccatagcg

SEQ ID NO: 297503 - DNA, 20 bp, Artificial Sequence
  chemically synthesized
gcacaaaattcagtccatag

SEQ ID NO: 297504 - DNA, 20 bp, Artificial Sequence
  chemically synthesized
ggggcacaaaattcagtcca

SEQ ID NO: 297505 - DNA, 20 bp, Artificial Sequence
  chemically synthesized
cttttgtggggcacaaaatt

SEQ ID NO: 297506 - DNA, 20 bp, Artificial Sequence
  chemically synthesized
ctgaattttgtgccccacaa

SEQ ID NO: 297507 - DNA, 20 bp, Artificial Sequence
  chemically synthesized
tcaacatacgaacttttgtg

SEQ ID NO: 297508 - DNA, 20 bp, Artificial Sequence
  chemically synthesized
ttcaacatacgaacttttgt

SEQ ID NO: 297509 - DNA, 20 bp, Artificial Sequence
  chemically synthesized
cttcaacatacgaacttttg

SEQ ID NO: 297510 - DNA, 20 bp, Artificial Sequence
  chemically synthesized
ccacaaaagttcgtatgttg

SEQ ID NO: 297511 - DNA, 20 bp, Artificial Sequence
  chemically synthesized
atatcatcacattgggaatt

SEQ ID NO: 297512 - DNA, 20 bp, Artificial Sequence
  chemically synthesized
aatatcatcacattgggaat

SEQ ID NO: 297513 - DNA, 20 bp, Artificial Sequence
  chemically synthesized
tcttttaatatcatcacatt

SEQ ID NO: 297514 - DNA, 20 bp, Artificial Sequence
  chemically synthesized
atcttttaatatcatcacat

SEQ ID NO: 297515 - DNA, 20 bp, Artificial Sequence
  chemically synthesized
tcccaatgtgatgatattaa

SEQ ID NO: 297516 - DNA, 20 bp, Artificial Sequence
  chemically synthesized
aatgtgatgatattaaaaga

SEQ ID NO: 297517 - DNA, 20 bp, Artificial Sequence
  chemically synthesized
atgtgatgatattaaaagat

SEQ ID NO: 297518 - DNA, 20 bp, Artificial Sequence
  chemically synthesized
tgtgatgatattaaaagatg

SEQ ID NO: 297519 - DNA, 20 bp, Artificial Sequence
  chemically synthesized
atattaaaagatggggcatt

SEQ ID NO: 297520 - DNA, 20 bp, Artificial Sequence
  chemically synthesized
tattaaaagatggggcattt

SEQ ID NO: 297521 - DNA, 20 bp, Artificial Sequence
  chemically synthesized
ttaaaagatggggcatttgg

SEQ ID NO: 297522 - DNA, 20 bp, Artificial Sequence
  chemically synthesized
taaaagatggggcatttggg

SEQ ID NO: 297523 - DNA, 20 bp, Artificial Sequence
  chemically synthesized
tggggcatttgggaggtaat

SEQ ID NO: 297524 - DNA, 20 bp, Artificial Sequence
  chemically synthesized
ggggcatttgggaggtaatt

SEQ ID NO: 297525 - DNA, 20 bp, Artificial Sequence
  chemically synthesized
atttgggaggtaattaggtc

SEQ ID NO: 297526 - DNA, 20 bp, Artificial Sequence
  chemically synthesized
ttgggaggtaattaggtcaa

SEQ ID NO: 297527 - DNA, 20 bp, Artificial Sequence
  chemically synthesized
tgggaggtaattaggtcaag

SEQ ID NO: 297528 - DNA, 20 bp, Artificial Sequence
  chemically synthesized
gggaggtaattaggtcaaga

SEQ ID NO: 297529 - DNA, 20 bp, Artificial Sequence
  chemically synthesized
aggtaattaggtcaagaggg

SEQ ID NO: 297530 - DNA, 20 bp, Artificial Sequence
  chemically synthesized
gtaattaggtcaagagggta

SEQ ID NO: 297531 - DNA, 20 bp, Artificial Sequence
  chemically synthesized
taaggggactcatttcatga

SEQ ID NO: 297532 - DNA, 20 bp, Artificial Sequence
  chemically synthesized
ttaaggggactcatttcatg

SEQ ID NO: 297533 - DNA, 20 bp, Artificial Sequence
  chemically synthesized
gggtagagccctcatgaaat

SEQ ID NO: 297534 - DNA, 20 bp, Artificial Sequence
  chemically synthesized
tttaaggggactcatttcat

SEQ ID NO: 297535 - DNA, 20 bp, Artificial Sequence
  chemically synthesized
tctcttcagatcattttaag

SEQ ID NO: 297536 - DNA, 20 bp, Artificial Sequence
  chemically synthesized
atctcttcagatcattttaa

SEQ ID NO: 297537 - DNA, 20 bp, Artificial Sequence
  chemically synthesized
gatctcttcagatcatttta

SEQ ID NO: 297538 - DNA, 20 bp, Artificial Sequence
  chemically synthesized
tgatctcttcagatcatttt

SEQ ID NO: 297539 - DNA, 20 bp, Artificial Sequence
  chemically synthesized
agtccccttaaaatgatctg

SEQ ID NO: 297540 - DNA, 20 bp, Artificial Sequence
  chemically synthesized
tccccttaaaatgatctgaa

SEQ ID NO: 297541 - DNA, 20 bp, Artificial Sequence
  chemically synthesized
ttaaaatgatctgaagagat

SEQ ID NO: 297542 - DNA, 20 bp, Artificial Sequence
  chemically synthesized
gaaaagaacactgatctctt

SEQ ID NO: 297543 - DNA, 20 bp, Artificial Sequence
  chemically synthesized
tgtgccctcacacggtggaa

SEQ ID NO: 297544 - DNA, 20 bp, Artificial Sequence
  chemically synthesized
agtgttcttttccaccgtgt

SEQ ID NO: 297545 - DNA, 20 bp, Artificial Sequence
  chemically synthesized
gtgttcttttccaccgtgtg

SEQ ID NO: 297546 - DNA, 20 bp, Artificial Sequence
  chemically synthesized
ctcactgtgccctcacacgg

SEQ ID NO: 297547 - DNA, 20 bp, Artificial Sequence
  chemically synthesized
tgttcttttccaccgtgtga

SEQ ID NO: 297548 - DNA, 20 bp, Artificial Sequence
  chemically synthesized
tctctcactgtgccctcaca

SEQ ID NO: 297549 - DNA, 20 bp, Artificial Sequence
  chemically synthesized
ttttccaccgtgtgagggca

SEQ ID NO: 297550 - DNA, 20 bp, Artificial Sequence
  chemically synthesized
ccaccgtgtgagggcacagt

SEQ ID NO: 297551 - DNA, 20 bp, Artificial Sequence
  chemically synthesized
accgtgtgagggcacagtga

SEQ ID NO: 297552 - DNA, 20 bp, Artificial Sequence
  chemically synthesized
cgtgtgagggcacagtgaga

SEQ ID NO: 297553 - DNA, 20 bp, Artificial Sequence
  chemically synthesized
gggcacagtgagagagcacc

SEQ ID NO: 297554 - DNA, 20 bp, Artificial Sequence
  chemically synthesized
caggcttcctggttcatact

SEQ ID NO: 297555 - DNA, 20 bp, Artificial Sequence
  chemically synthesized
agagagcaccaagtatgaac

SEQ ID NO: 297556 - DNA, 20 bp, Artificial Sequence
  chemically synthesized
gagagcaccaagtatgaacc

SEQ ID NO: 297557 - DNA, 20 bp, Artificial Sequence
  chemically synthesized
agcaccaagtatgaaccagg

SEQ ID NO: 297558 - DNA, 20 bp, Artificial Sequence
  chemically synthesized
tcttttaagggcaggcttcc

SEQ ID NO: 297559 - DNA, 20 bp, Artificial Sequence
  chemically synthesized
atttagtgtcttttaagggc

SEQ ID NO: 297560 - DNA, 20 bp, Artificial Sequence
  chemically synthesized
accaggaagcctgcccttaa

SEQ ID NO: 297561 - DNA, 20 bp, Artificial Sequence
  chemically synthesized
gatttagtgtcttttaaggg

SEQ ID NO: 297562 - DNA, 20 bp, Artificial Sequence
  chemically synthesized
gcagatttagtgtcttttaa

SEQ ID NO: 297563 - DNA, 20 bp, Artificial Sequence
  chemically synthesized
agcagatttagtgtctttta

SEQ ID NO: 297564 - DNA, 20 bp, Artificial Sequence
  chemically synthesized
tagcagatttagtgtctttt

SEQ ID NO: 297565 - DNA, 20 bp, Artificial Sequence
  chemically synthesized
ttaaaagacactaaatctgc

SEQ ID NO: 297566 - DNA, 20 bp, Artificial Sequence
  chemically synthesized
tatcaagtaactagcagatt

SEQ ID NO: 297567 - DNA, 20 bp, Artificial Sequence
  chemically synthesized
gtttaatatcaagtaactag

SEQ ID NO: 297568 - DNA, 20 bp, Artificial Sequence
  chemically synthesized
gaagtttaatatcaagtaac

SEQ ID NO: 297569 - DNA, 20 bp, Artificial Sequence
  chemically synthesized
agtttgggaagtttaatatc

SEQ ID NO: 297570 - DNA, 20 bp, Artificial Sequence
  chemically synthesized
tcccatttctggagtttggg

SEQ ID NO: 297571 - DNA, 20 bp, Artificial Sequence
  chemically synthesized
atattaaacttcccaaactc

SEQ ID NO: 297572 - DNA, 20 bp, Artificial Sequence
  chemically synthesized
gtctcccatttctggagttt

SEQ ID NO: 297573 - DNA, 20 bp, Artificial Sequence
  chemically synthesized
tgtctcccatttctggagtt

SEQ ID NO: 297574 - DNA, 20 bp, Artificial Sequence
  chemically synthesized
aacttcccaaactccagaaa

SEQ ID NO: 297575 - DNA, 20 bp, Artificial Sequence
  chemically synthesized
acttcccaaactccagaaat

SEQ ID NO: 297576 - DNA, 20 bp, Artificial Sequence
  chemically synthesized
atttatgtctcccatttctg

SEQ ID NO: 297577 - DNA, 20 bp, Artificial Sequence
  chemically synthesized
ttcccaaactccagaaatgg

SEQ ID NO: 297578 - DNA, 20 bp, Artificial Sequence
  chemically synthesized
aaatttatgtctcccatttc

SEQ ID NO: 297579 - DNA, 20 bp, Artificial Sequence
  chemically synthesized
atgggagacataaatttctg

SEQ ID NO: 297580 - DNA, 20 bp, Artificial Sequence
  chemically synthesized
actgggtagcttataaacca

SEQ ID NO: 297581 - DNA, 20 bp, Artificial Sequence
  chemically synthesized
cataaatttctgtggtttat

SEQ ID NO: 297582 - DNA, 20 bp, Artificial Sequence
  chemically synthesized
tctgtggtttataagctacc

SEQ ID NO: 297583 - DNA, 20 bp, Artificial Sequence
  chemically synthesized
acaaaataccataaactggg

SEQ ID NO: 297584 - DNA, 20 bp, Artificial Sequence
  chemically synthesized
tttataagctacccagttta

SEQ ID NO: 297585 - DNA, 20 bp, Artificial Sequence
  chemically synthesized
gtaacaaaataccataaact

SEQ ID NO: 297586 - DNA, 20 bp, Artificial Sequence
  chemically synthesized
tgtaacaaaataccataaac

SEQ ID NO: 297587 - DNA, 20 bp, Artificial Sequence
  chemically synthesized
cagtttatggtattttgtta

SEQ ID NO: 297588 - DNA, 20 bp, Artificial Sequence
  chemically synthesized
ggaagagagagggttttagt

SEQ ID NO: 297589 - DNA, 20 bp, Artificial Sequence
  chemically synthesized
ggaaggaagagagagggttt

SEQ ID NO: 297590 - DNA, 20 bp, Artificial Sequence
  chemically synthesized
aacatgggaaggaagagaga

SEQ ID NO: 297591 - DNA, 20 bp, Artificial Sequence
  chemically synthesized
aaacatgggaaggaagagag

SEQ ID NO: 297592 - DNA, 20 bp, Artificial Sequence
  chemically synthesized
taaacatgggaaggaagaga

SEQ ID NO: 297593 - DNA, 20 bp, Artificial Sequence
  chemically synthesized
attaaacatgggaaggaaga

SEQ ID NO: 297594 - DNA, 20 bp, Artificial Sequence
  chemically synthesized
acattaaacatgggaaggaa

SEQ ID NO: 297595 - DNA, 20 bp, Artificial Sequence
  chemically synthesized
atacattaaacatgggaagg

SEQ ID NO: 297596 - DNA, 20 bp, Artificial Sequence
  chemically synthesized
gcaatacattaaacatggga

SEQ ID NO: 297597 - DNA, 20 bp, Artificial Sequence
  chemically synthesized
tgcaatacattaaacatggg

SEQ ID NO: 297598 - DNA, 20 bp, Artificial Sequence
  chemically synthesized
ctttgcaatacattaaacat

SEQ ID NO: 297599 - DNA, 20 bp, Artificial Sequence
  chemically synthesized
actttgcaatacattaaaca

SEQ ID NO: 297600 - DNA, 20 bp, Artificial Sequence
  chemically synthesized
cccatgtttaatgtattgca

SEQ ID NO: 297601 - DNA, 20 bp, Artificial Sequence
  chemically synthesized
agaatgtatgtgtgacagat

SEQ ID NO: 297602 - DNA, 20 bp, Artificial Sequence
  chemically synthesized
gacagagaatgtatgtgtga

SEQ ID NO: 297603 - DNA, 20 bp, Artificial Sequence
  chemically synthesized
gcatacatattcaggagaca

SEQ ID NO: 297604 - DNA, 20 bp, Artificial Sequence
  chemically synthesized
aagcatacatattcaggaga

SEQ ID NO: 297605 - DNA, 20 bp, Artificial Sequence
  chemically synthesized
gaagaagcatacatattcag

SEQ ID NO: 297606 - DNA, 20 bp, Artificial Sequence
  chemically synthesized
aggaagaagcatacatattc

SEQ ID NO: 297607 - DNA, 20 bp, Artificial Sequence
  chemically synthesized
caggaagaagcatacatatt

SEQ ID NO: 297608 - DNA, 20 bp, Artificial Sequence
  chemically synthesized
ctggctatggagacaggaag

SEQ ID NO: 297609 - DNA, 20 bp, Artificial Sequence
  chemically synthesized
gttctggctatggagacagg

SEQ ID NO: 297610 - DNA, 20 bp, Artificial Sequence
  chemically synthesized
tatgcttcttcctgtctcca

SEQ ID NO: 297611 - DNA, 20 bp, Artificial Sequence
  chemically synthesized
tgggttctggctatggagac

SEQ ID NO: 297612 - DNA, 20 bp, Artificial Sequence
  chemically synthesized
ttgggttctggctatggaga

SEQ ID NO: 297613 - DNA, 20 bp, Artificial Sequence
  chemically synthesized
cttcttcctgtctccatagc

SEQ ID NO: 297614 - DNA, 20 bp, Artificial Sequence
  chemically synthesized
agatttgggttctggctatg

SEQ ID NO: 297615 - DNA, 20 bp, Artificial Sequence
  chemically synthesized
acagatttgggttctggcta

SEQ ID NO: 297616 - DNA, 20 bp, Artificial Sequence
  chemically synthesized
ggcaacacagatttgggttc

SEQ ID NO: 297617 - DNA, 20 bp, Artificial Sequence
  chemically synthesized
tttaatggcaacacagattt

SEQ ID NO: 297618 - DNA, 20 bp, Artificial Sequence
  chemically synthesized
atttaatggcaacacagatt

SEQ ID NO: 297619 - DNA, 20 bp, Artificial Sequence
  chemically synthesized
ggtcacatttaatggcaaca

SEQ ID NO: 297620 - DNA, 20 bp, Artificial Sequence
  chemically synthesized
gtatttttggtcacatttaa

SEQ ID NO: 297621 - DNA, 20 bp, Artificial Sequence
  chemically synthesized
aaaagctattgcggtatttt

SEQ ID NO: 297622 - DNA, 20 bp, Artificial Sequence
  chemically synthesized
tgtgaccaaaaataccgcaa

SEQ ID NO: 297623 - DNA, 20 bp, Artificial Sequence
  chemically synthesized
ggccaagtgaaaagctattg

SEQ ID NO: 297624 - DNA, 20 bp, Artificial Sequence
  chemically synthesized
taccgcaatagcttttcact

SEQ ID NO: 297625 - DNA, 20 bp, Artificial Sequence
  chemically synthesized
ctgcccagaggccaagtgaa

SEQ ID NO: 297626 - DNA, 20 bp, Artificial Sequence
  chemically synthesized
atagcttttcacttggcctc

SEQ ID NO: 297627 - DNA, 20 bp, Artificial Sequence
  chemically synthesized
tagcttttcacttggcctct

SEQ ID NO: 297628 - DNA, 20 bp, Artificial Sequence
  chemically synthesized
ataaatactgcccagaggcc

SEQ ID NO: 297629 - DNA, 20 bp, Artificial Sequence
  chemically synthesized
cttttcacttggcctctggg

SEQ ID NO: 297630 - DNA, 20 bp, Artificial Sequence
  chemically synthesized
gttccataaatactgcccag

SEQ ID NO: 297631 - DNA, 20 bp, Artificial Sequence
  chemically synthesized
agttccataaatactgccca

SEQ ID NO: 297632 - DNA, 20 bp, Artificial Sequence
  chemically synthesized
agagttccataaatactgcc

SEQ ID NO: 297633 - DNA, 20 bp, Artificial Sequence
  chemically synthesized
tggcctctgggcagtattta

SEQ ID NO: 297634 - DNA, 20 bp, Artificial Sequence
  chemically synthesized
ccagtagtacataaaagaga

SEQ ID NO: 297635 - DNA, 20 bp, Artificial Sequence
  chemically synthesized
ttccagtagtacataaaaga

SEQ ID NO: 297636 - DNA, 20 bp, Artificial Sequence
  chemically synthesized
ttttccagtagtacataaaa

SEQ ID NO: 297637 - DNA, 20 bp, Artificial Sequence
  chemically synthesized
atttttccagtagtacataa

SEQ ID NO: 297638 - DNA, 20 bp, Artificial Sequence
  chemically synthesized
ctctctcttttatgtactac

SEQ ID NO: 297639 - DNA, 20 bp, Artificial Sequence
  chemically synthesized
agaaatgataatttttccag

SEQ ID NO: 297640 - DNA, 20 bp, Artificial Sequence
  chemically synthesized
gatagaaatgataatttttc

SEQ ID NO: 297641 - DNA, 20 bp, Artificial Sequence
  chemically synthesized
tatgcgtcaattaaaaaaga

SEQ ID NO: 297642 - DNA, 20 bp, Artificial Sequence
  chemically synthesized
ctattatgcgtcaattaaaa

SEQ ID NO: 297643 - DNA, 20 bp, Artificial Sequence
  chemically synthesized
cttttttaattgacgcataa

SEQ ID NO: 297644 - DNA, 20 bp, Artificial Sequence
  chemically synthesized
tgacgcataatagatgtact

SEQ ID NO: 297645 - DNA, 20 bp, Artificial Sequence
  chemically synthesized
cataatagatgtacttagat

SEQ ID NO: 297646 - DNA, 20 bp, Artificial Sequence
  chemically synthesized
ataatagatgtacttagatt

SEQ ID NO: 297647 - DNA, 20 bp, Artificial Sequence
  chemically synthesized
taatagatgtacttagattg

SEQ ID NO: 297648 - DNA, 20 bp, Artificial Sequence
  chemically synthesized
aatagatgtacttagattgg

SEQ ID NO: 297649 - DNA, 20 bp, Artificial Sequence
  chemically synthesized
atcacatgtacccccaatct

SEQ ID NO: 297650 - DNA, 20 bp, Artificial Sequence
  chemically synthesized
tgcgatctttacaaattata

SEQ ID NO: 297651 - DNA, 20 bp, Artificial Sequence
  chemically synthesized
acatatccgtataatttgta

SEQ ID NO: 297652 - DNA, 20 bp, Artificial Sequence
  chemically synthesized
ataatttgtaaagatcgcat

SEQ ID NO: 297653 - DNA, 20 bp, Artificial Sequence
  chemically synthesized
aaagatcgcatcagtgtact

SEQ ID NO: 297654 - DNA, 20 bp, Artificial Sequence
  chemically synthesized
aagatcgcatcagtgtactt

SEQ ID NO: 297655 - DNA, 20 bp, Artificial Sequence
  chemically synthesized
tttaagattatggatatccc

SEQ ID NO: 297656 - DNA, 20 bp, Artificial Sequence
  chemically synthesized
tagacaaatatttaagatta

SEQ ID NO: 297657 - DNA, 20 bp, Artificial Sequence
  chemically synthesized
tctagcatagacaaatattt

SEQ ID NO: 297658 - DNA, 20 bp, Artificial Sequence
  chemically synthesized
tcttaaatatttgtctatgc

SEQ ID NO: 297659 - DNA, 20 bp, Artificial Sequence
  chemically synthesized
taatttgaatgtatctagca

SEQ ID NO: 297660 - DNA, 20 bp, Artificial Sequence
  chemically synthesized
gagaataatttgaatgtatc

SEQ ID NO: 297661 - DNA, 20 bp, Artificial Sequence
  chemically synthesized
acattcaaattattctcttc

SEQ ID NO: 297662 - DNA, 20 bp, Artificial Sequence
  chemically synthesized
atatttcaaagtagctagaa

SEQ ID NO: 297663 - DNA, 20 bp, Artificial Sequence
  chemically synthesized
gtatatttcaaagtagctag

SEQ ID NO: 297664 - DNA, 20 bp, Artificial Sequence
  chemically synthesized
accgtatatttcaaagtagc

SEQ ID NO: 297665 - DNA, 20 bp, Artificial Sequence
  chemically synthesized
tactaccgtatatttcaaag

SEQ ID NO: 297666 - DNA, 20 bp, Artificial Sequence
  chemically synthesized
ttttactaccgtatatttca

SEQ ID NO: 297667 - DNA, 20 bp, Artificial Sequence
  chemically synthesized
tctagctactttgaaatata

SEQ ID NO: 297668 - DNA, 20 bp, Artificial Sequence
  chemically synthesized
agctactttgaaatatacgg

SEQ ID NO: 297669 - DNA, 20 bp, Artificial Sequence
  chemically synthesized
acgaatgaaggtaacataat

SEQ ID NO: 297670 - DNA, 20 bp, Artificial Sequence
  chemically synthesized
ttgagtggttttacgaatga

SEQ ID NO: 297671 - DNA, 20 bp, Artificial Sequence
  chemically synthesized
tttgagtggttttacgaatg

SEQ ID NO: 297672 - DNA, 20 bp, Artificial Sequence
  chemically synthesized
ttcattcgtaaaaccactca

SEQ ID NO: 297673 - DNA, 20 bp, Artificial Sequence
  chemically synthesized
aaaatgagaaagtctttgag

SEQ ID NO: 297674 - DNA, 20 bp, Artificial Sequence
  chemically synthesized
agaaaaatgagaaagtcttt

SEQ ID NO: 297675 - DNA, 20 bp, Artificial Sequence
  chemically synthesized
ttattctaagaaaaatgaga

SEQ ID NO: 297676 - DNA, 20 bp, Artificial Sequence
  chemically synthesized
ttctttattctaagaaaaat

SEQ ID NO: 297677 - DNA, 20 bp, Artificial Sequence
  chemically synthesized
aaagactttctcatttttct

SEQ ID NO: 297678 - DNA, 20 bp, Artificial Sequence
  chemically synthesized
ttctcatttttcttagaata

SEQ ID NO: 297679 - DNA, 20 bp, Artificial Sequence
  chemically synthesized
gaaattttgttctttattct

SEQ ID NO: 297680 - DNA, 20 bp, Artificial Sequence
  chemically synthesized
ctatgaaggccagattataa

SEQ ID NO: 297681 - DNA, 20 bp, Artificial Sequence
  chemically synthesized
caacatgatcctttataatc

SEQ ID NO: 297682 - DNA, 20 bp, Artificial Sequence
  chemically synthesized
tctatgaaggccagattata

SEQ ID NO: 297683 - DNA, 20 bp, Artificial Sequence
  chemically synthesized
cctttataatctggccttca

SEQ ID NO: 297684 - DNA, 20 bp, Artificial Sequence
  chemically synthesized
gttaagaggtctatgaaggc

SEQ ID NO: 297685 - DNA, 20 bp, Artificial Sequence
  chemically synthesized
tacagttaagaggtctatga

SEQ ID NO: 297686 - DNA, 20 bp, Artificial Sequence
  chemically synthesized
atacagttaagaggtctatg

SEQ ID NO: 297687 - DNA, 20 bp, Artificial Sequence
  chemically synthesized
aagtagaatatacagttaag

SEQ ID NO: 297688 - DNA, 20 bp, Artificial Sequence
  chemically synthesized
aaagtagaatatacagttaa

SEQ ID NO: 297689 - DNA, 20 bp, Artificial Sequence
  chemically synthesized
acaaagtagaatatacagtt

SEQ ID NO: 297690 - DNA, 20 bp, Artificial Sequence
  chemically synthesized
aaaagacaaagtagaatata

SEQ ID NO: 297691 - DNA, 20 bp, Artificial Sequence
  chemically synthesized
tacttgaataaaagacaaag

SEQ ID NO: 297692 - DNA, 20 bp, Artificial Sequence
  chemically synthesized
aagtacttgaataaaagaca

SEQ ID NO: 297693 - DNA, 20 bp, Artificial Sequence
  chemically synthesized
ttctactttgtcttttattc

SEQ ID NO: 297694 - DNA, 20 bp, Artificial Sequence
  chemically synthesized
ttctacaagtacttgaataa

SEQ ID NO: 297695 - DNA, 20 bp, Artificial Sequence
  chemically synthesized
gtcttttattcaagtacttg

SEQ ID NO: 297696 - DNA, 20 bp, Artificial Sequence
  chemically synthesized
gaagcgaaatttgtttctac

SEQ ID NO: 297697 - DNA, 20 bp, Artificial Sequence
  chemically synthesized
gaattactttagaaaatatg

SEQ ID NO: 297698 - DNA, 20 bp, Artificial Sequence
  chemically synthesized
atttcgcttcatattttcta

SEQ ID NO: 297699 - DNA, 20 bp, Artificial Sequence
  chemically synthesized
agaatagctctgaattactt

SEQ ID NO: 297700 - DNA, 20 bp, Artificial Sequence
  chemically synthesized
tcatattttctaaagtaatt

SEQ ID NO: 297701 - DNA, 20 bp, Artificial Sequence
  chemically synthesized
atattttctaaagtaattca

SEQ ID NO: 297702 - DNA, 20 bp, Artificial Sequence
  chemically synthesized
ggaggaacaagaataaagaa

SEQ ID NO: 297703 - DNA, 20 bp, Artificial Sequence
  chemically synthesized
ttggaggaggaacaagaata

SEQ ID NO: 297704 - DNA, 20 bp, Artificial Sequence
  chemically synthesized
tattccattggaggaggaac

SEQ ID NO: 297705 - DNA, 20 bp, Artificial Sequence
  chemically synthesized
tattcttgttcctcctccaa

SEQ ID NO: 297706 - DNA, 20 bp, Artificial Sequence
  chemically synthesized
ggattttattccattggagg

SEQ ID NO: 297707 - DNA, 20 bp, Artificial Sequence
  chemically synthesized
aggattttattccattggag

SEQ ID NO: 297708 - DNA, 20 bp, Artificial Sequence
  chemically synthesized
gaaggattttattccattgg

SEQ ID NO: 297709 - DNA, 20 bp, Artificial Sequence
  chemically synthesized
tgaaggattttattccattg

SEQ ID NO: 297710 - DNA, 20 bp, Artificial Sequence
  chemically synthesized
agtgaaggattttattccat

SEQ ID NO: 297711 - DNA, 20 bp, Artificial Sequence
  chemically synthesized
atttatggaagagtcagtga

SEQ ID NO: 297712 - DNA, 20 bp, Artificial Sequence
  chemically synthesized
tatttatggaagagtcagtg

SEQ ID NO: 297713 - DNA, 20 bp, Artificial Sequence
  chemically synthesized
caaaatatttatggaagagt

SEQ ID NO: 297714 - DNA, 20 bp, Artificial Sequence
  chemically synthesized
ttttcaaaatatttatggaa

SEQ ID NO: 297715 - DNA, 20 bp, Artificial Sequence
  chemically synthesized
agttttcaaaatatttatgg

SEQ ID NO: 297716 - DNA, 20 bp, Artificial Sequence
  chemically synthesized
cccagttttcaaaatattta

SEQ ID NO: 297717 - DNA, 20 bp, Artificial Sequence
  chemically synthesized
tccataaatattttgaaaac

SEQ ID NO: 297718 - DNA, 20 bp, Artificial Sequence
  chemically synthesized
ccataaatattttgaaaact

SEQ ID NO: 297719 - DNA, 20 bp, Artificial Sequence
  chemically synthesized
aatgcattatattaacaacc

SEQ ID NO: 297720 - DNA, 20 bp, Artificial Sequence
  chemically synthesized
ggttgttaatataatgcatt

SEQ ID NO: 297721 - DNA, 20 bp, Artificial Sequence
  chemically synthesized
gttgttaatataatgcattt

SEQ ID NO: 297722 - DNA, 20 bp, Artificial Sequence
  chemically synthesized
ataatgcatttgggccactt

SEQ ID NO: 297723 - DNA, 20 bp, Artificial Sequence
  chemically synthesized
acaaataaatttcaccaaag

SEQ ID NO: 297724 - DNA, 20 bp, Artificial Sequence
  chemically synthesized
cagacaaataaatttcacca

SEQ ID NO: 297725 - DNA, 20 bp, Artificial Sequence
  chemically synthesized
tatttgatgtataattgagt

SEQ ID NO: 297726 - DNA, 20 bp, Artificial Sequence
  chemically synthesized
agggtatttgatgtataatt

SEQ ID NO: 297727 - DNA, 20 bp, Artificial Sequence
  chemically synthesized
tctcatatttatgagtcaga

SEQ ID NO: 297728 - DNA, 20 bp, Artificial Sequence
  chemically synthesized
atctcatatttatgagtcag

SEQ ID NO: 297729 - DNA, 20 bp, Artificial Sequence
  chemically synthesized
tatctcatatttatgagtca

SEQ ID NO: 297730 - DNA, 20 bp, Artificial Sequence
  chemically synthesized
cctatctcatatttatgagt

SEQ ID NO: 297731 - DNA, 20 bp, Artificial Sequence
  chemically synthesized
tattcctatctcatatttat

SEQ ID NO: 297732 - DNA, 20 bp, Artificial Sequence
  chemically synthesized
accctctgactcataaatat

SEQ ID NO: 297733 - DNA, 20 bp, Artificial Sequence
  chemically synthesized
tctgactcataaatatgaga

SEQ ID NO: 297734 - DNA, 20 bp, Artificial Sequence
  chemically synthesized
ctgactcataaatatgagat

SEQ ID NO: 297735 - DNA, 20 bp, Artificial Sequence
  chemically synthesized
tatgagataggaatatccac

SEQ ID NO: 297736 - DNA, 20 bp, Artificial Sequence
  chemically synthesized
gtgaatttgaaagtgactgg

SEQ ID NO: 297737 - DNA, 20 bp, Artificial Sequence
  chemically synthesized
agcgtgaatttgaaagtgac

SEQ ID NO: 297738 - DNA, 20 bp, Artificial Sequence
  chemically synthesized
agtttaaagcgtgaatttga

SEQ ID NO: 297739 - DNA, 20 bp, Artificial Sequence
  chemically synthesized
gactagagagattaagttta

SEQ ID NO: 297740 - DNA, 20 bp, Artificial Sequence
  chemically synthesized
agggtgagactagagagatt

SEQ ID NO: 297741 - DNA, 20 bp, Artificial Sequence
  chemically synthesized
cgctttaaacttaatctctc

SEQ ID NO: 297742 - DNA, 20 bp, Artificial Sequence
  chemically synthesized
caaatgagggtgagactaga

SEQ ID NO: 297743 - DNA, 20 bp, Artificial Sequence
  chemically synthesized
atcaaatgagggtgagacta

SEQ ID NO: 297744 - DNA, 20 bp, Artificial Sequence
  chemically synthesized
aaatcaaatgagggtgagac

SEQ ID NO: 297745 - DNA, 20 bp, Artificial Sequence
  chemically synthesized
agtctaaatcaaatgagggt

SEQ ID NO: 297746 - DNA, 20 bp, Artificial Sequence
  chemically synthesized
agatagtctaaatcaaatga

SEQ ID NO: 297747 - DNA, 20 bp, Artificial Sequence
  chemically synthesized
gagatagtctaaatcaaatg

SEQ ID NO: 297748 - DNA, 20 bp, Artificial Sequence
  chemically synthesized
agagatagtctaaatcaaat

SEQ ID NO: 297749 - DNA, 20 bp, Artificial Sequence
  chemically synthesized
agtctcaccctcatttgatt

SEQ ID NO: 297750 - DNA, 20 bp, Artificial Sequence
  chemically synthesized
atttgatttagactatctct

SEQ ID NO: 297751 - DNA, 20 bp, Artificial Sequence
  chemically synthesized
tgagcaatctttcttagaga

SEQ ID NO: 297752 - DNA, 20 bp, Artificial Sequence
  chemically synthesized
gatttagactatctctaaga

SEQ ID NO: 297753 - DNA, 20 bp, Artificial Sequence
  chemically synthesized
gaagtgagcaatctttctta

SEQ ID NO: 297754 - DNA, 20 bp, Artificial Sequence
  chemically synthesized
tagaagtgagcaatctttct

SEQ ID NO: 297755 - DNA, 20 bp, Artificial Sequence
  chemically synthesized
agggacctctaagtagaagt

SEQ ID NO: 297756 - DNA, 20 bp, Artificial Sequence
  chemically synthesized
aaagattgctcacttctact

SEQ ID NO: 297757 - DNA, 20 bp, Artificial Sequence
  chemically synthesized
agattgctcacttctactta

SEQ ID NO: 297758 - DNA, 20 bp, Artificial Sequence
  chemically synthesized
tttcagggacctctaagtag

SEQ ID NO: 297759 - DNA, 20 bp, Artificial Sequence
  chemically synthesized
gattgctcacttctacttag

SEQ ID NO: 297760 - DNA, 20 bp, Artificial Sequence
  chemically synthesized
gagtttcagggacctctaag

SEQ ID NO: 297761 - DNA, 20 bp, Artificial Sequence
  chemically synthesized
tttgagtttcagggacctct

SEQ ID NO: 297762 - DNA, 20 bp, Artificial Sequence
  chemically synthesized
tgaggcacgtttgagtttca

SEQ ID NO: 297763 - DNA, 20 bp, Artificial Sequence
  chemically synthesized
ttgaggcacgtttgagtttc

SEQ ID NO: 297764 - DNA, 20 bp, Artificial Sequence
  chemically synthesized
cttgaggcacgtttgagttt

SEQ ID NO: 297765 - DNA, 20 bp, Artificial Sequence
  chemically synthesized
tagtaccttgaggcacgttt

SEQ ID NO: 297766 - DNA, 20 bp, Artificial Sequence
  chemically synthesized
ctgaaactcaaacgtgcctc

SEQ ID NO: 297767 - DNA, 20 bp, Artificial Sequence
  chemically synthesized
tgaaactcaaacgtgcctca

SEQ ID NO: 297768 - DNA, 20 bp, Artificial Sequence
  chemically synthesized
catgccagcctagtaccttg

SEQ ID NO: 297769 - DNA, 20 bp, Artificial Sequence
  chemically synthesized
tcaaacgtgcctcaaggtac

SEQ ID NO: 297770 - DNA, 20 bp, Artificial Sequence
  chemically synthesized
tcatgccagcctagtacctt

SEQ ID NO: 297771 - DNA, 20 bp, Artificial Sequence
  chemically synthesized
caaacgtgcctcaaggtact

SEQ ID NO: 297772 - DNA, 20 bp, Artificial Sequence
  chemically synthesized
cgtgcctcaaggtactaggc

SEQ ID NO: 297773 - DNA, 20 bp, Artificial Sequence
  chemically synthesized
tttcagctgtcatgccagcc

SEQ ID NO: 297774 - DNA, 20 bp, Artificial Sequence
  chemically synthesized
aaggtactaggctggcatga

SEQ ID NO: 297775 - DNA, 20 bp, Artificial Sequence
  chemically synthesized
atttctttcagctgtcatgc

SEQ ID NO: 297776 - DNA, 20 bp, Artificial Sequence
  chemically synthesized
taggctggcatgacagctga

SEQ ID NO: 297777 - DNA, 20 bp, Artificial Sequence
  chemically synthesized
aggcttcagcagatttcttt

SEQ ID NO: 297778 - DNA, 20 bp, Artificial Sequence
  chemically synthesized
cagctgaaagaaatctgctg

SEQ ID NO: 297779 - DNA, 20 bp, Artificial Sequence
  chemically synthesized
ttctccaacataggcttcag

SEQ ID NO: 297780 - DNA, 20 bp, Artificial Sequence
  chemically synthesized
tctttctccaacataggctt

SEQ ID NO: 297781 - DNA, 20 bp, Artificial Sequence
  chemically synthesized
aaatctgctgaagcctatgt

SEQ ID NO: 297782 - DNA, 20 bp, Artificial Sequence
  chemically synthesized
atctgctgaagcctatgttg

SEQ ID NO: 297783 - DNA, 20 bp, Artificial Sequence
  chemically synthesized
tagaaatctttctccaacat

SEQ ID NO: 297784 - DNA, 20 bp, Artificial Sequence
  chemically synthesized
gtagaaatctttctccaaca

SEQ ID NO: 297785 - DNA, 20 bp, Artificial Sequence
  chemically synthesized
gctgaagcctatgttggaga

SEQ ID NO: 297786 - DNA, 20 bp, Artificial Sequence
  chemically synthesized
tgttggagaaagatttctac

SEQ ID NO: 297787 - DNA, 20 bp, Artificial Sequence
  chemically synthesized
gttggagaaagatttctact

SEQ ID NO: 297788 - DNA, 20 bp, Artificial Sequence
  chemically synthesized
aatgtcaattcaacgcctag

SEQ ID NO: 297789 - DNA, 20 bp, Artificial Sequence
  chemically synthesized
agcaatgtcaattcaacgcc

SEQ ID NO: 297790 - DNA, 20 bp, Artificial Sequence
  chemically synthesized
cccctacagtgtgcaaacaa

SEQ ID NO: 297791 - DNA, 20 bp, Artificial Sequence
  chemically synthesized
agcccctacagtgtgcaaac

SEQ ID NO: 297792 - DNA, 20 bp, Artificial Sequence
  chemically synthesized
ttgctcttgtttgcacactg

SEQ ID NO: 297793 - DNA, 20 bp, Artificial Sequence
  chemically synthesized
tgctcttgtttgcacactgt

SEQ ID NO: 297794 - DNA, 20 bp, Artificial Sequence
  chemically synthesized
gctcttgtttgcacactgta

SEQ ID NO: 297795 - DNA, 20 bp, Artificial Sequence
  chemically synthesized
ctcttgtttgcacactgtag

SEQ ID NO: 297796 - DNA, 20 bp, Artificial Sequence
  chemically synthesized
tatcgttttctgagccccta

SEQ ID NO: 297797 - DNA, 20 bp, Artificial Sequence
  chemically synthesized
gtttgcacactgtaggggct

SEQ ID NO: 297798 - DNA, 20 bp, Artificial Sequence
  chemically synthesized
actttggggtatcgttttct

SEQ ID NO: 297799 - DNA, 20 bp, Artificial Sequence
  chemically synthesized
gctcagaaaacgatacccca

SEQ ID NO: 297800 - DNA, 20 bp, Artificial Sequence
  chemically synthesized
gaaaacgataccccaaagta

SEQ ID NO: 297801 - DNA, 20 bp, Artificial Sequence
  chemically synthesized
tgccaaagtgccatactttg

SEQ ID NO: 297802 - DNA, 20 bp, Artificial Sequence
  chemically synthesized
atgccaaagtgccatacttt

SEQ ID NO: 297803 - DNA, 20 bp, Artificial Sequence
  chemically synthesized
catgccaaagtgccatactt

SEQ ID NO: 297804 - DNA, 20 bp, Artificial Sequence
  chemically synthesized
taccccaaagtatggcactt

SEQ ID NO: 297805 - DNA, 20 bp, Artificial Sequence
  chemically synthesized
ttcaaagtttcagcatgcca

SEQ ID NO: 297806 - DNA, 20 bp, Artificial Sequence
  chemically synthesized
tgttctttagttcaaagttt

SEQ ID NO: 297807 - DNA, 20 bp, Artificial Sequence
  chemically synthesized
catgctgaaactttgaacta

SEQ ID NO: 297808 - DNA, 20 bp, Artificial Sequence
  chemically synthesized
ttccagtgttctttagttca

SEQ ID NO: 297809 - DNA, 20 bp, Artificial Sequence
  chemically synthesized
tgaggccttccagtgttctt

SEQ ID NO: 297810 - DNA, 20 bp, Artificial Sequence
  chemically synthesized
aactttgaactaaagaacac

SEQ ID NO: 297811 - DNA, 20 bp, Artificial Sequence
  chemically synthesized
tttgaactaaagaacactgg

SEQ ID NO: 297812 - DNA, 20 bp, Artificial Sequence
  chemically synthesized
ttgaactaaagaacactgga

SEQ ID NO: 297813 - DNA, 20 bp, Artificial Sequence
  chemically synthesized
aggctgcttttgaggccttc

SEQ ID NO: 297814 - DNA, 20 bp, Artificial Sequence
  chemically synthesized
agaacactggaaggcctcaa

SEQ ID NO: 297815 - DNA, 20 bp, Artificial Sequence
  chemically synthesized
acactggaaggcctcaaaag

SEQ ID NO: 297816 - DNA, 20 bp, Artificial Sequence
  chemically synthesized
tggttttgaggctgcttttg

SEQ ID NO: 297817 - DNA, 20 bp, Artificial Sequence
  chemically synthesized
ttggttttgaggctgctttt

SEQ ID NO: 297818 - DNA, 20 bp, Artificial Sequence
  chemically synthesized
tcaaaagcagcctcaaaacc

SEQ ID NO: 297819 - DNA, 20 bp, Artificial Sequence
  chemically synthesized
tcagagggaccttggttttg

SEQ ID NO: 297820 - DNA, 20 bp, Artificial Sequence
  chemically synthesized
caaaagcagcctcaaaacca

SEQ ID NO: 297821 - DNA, 20 bp, Artificial Sequence
  chemically synthesized
gtcagagggaccttggtttt

SEQ ID NO: 297822 - DNA, 20 bp, Artificial Sequence
  chemically synthesized
ggagaaggtcagagggacct

SEQ ID NO: 297823 - DNA, 20 bp, Artificial Sequence
  chemically synthesized
gaggggaggagaaggtcaga

SEQ ID NO: 297824 - DNA, 20 bp, Artificial Sequence
  chemically synthesized
ggaggggaggagaaggtcag

SEQ ID NO: 297825 - DNA, 20 bp, Artificial Sequence
  chemically synthesized
aggaggggaggagaaggtca

SEQ ID NO: 297826 - DNA, 20 bp, Artificial Sequence
  chemically synthesized
acaggaggggaggagaaggt

SEQ ID NO: 297827 - DNA, 20 bp, Artificial Sequence
  chemically synthesized
aaagacaggaggggaggaga

SEQ ID NO: 297828 - DNA, 20 bp, Artificial Sequence
  chemically synthesized
taaagacaggaggggaggag

SEQ ID NO: 297829 - DNA, 20 bp, Artificial Sequence
  chemically synthesized
agttaaagacaggaggggag

SEQ ID NO: 297830 - DNA, 20 bp, Artificial Sequence
  chemically synthesized
ggagttaaagacaggagggg

SEQ ID NO: 297831 - DNA, 20 bp, Artificial Sequence
  chemically synthesized
tggagttaaagacaggaggg

SEQ ID NO: 297832 - DNA, 20 bp, Artificial Sequence
  chemically synthesized
tgtggagttaaagacaggag

SEQ ID NO: 297833 - DNA, 20 bp, Artificial Sequence
  chemically synthesized
atgtggagttaaagacagga

SEQ ID NO: 297834 - DNA, 20 bp, Artificial Sequence
  chemically synthesized
aatgtggagttaaagacagg

SEQ ID NO: 297835 - DNA, 20 bp, Artificial Sequence
  chemically synthesized
gaatgtggagttaaagacag

SEQ ID NO: 297836 - DNA, 20 bp, Artificial Sequence
  chemically synthesized
aagaatgtggagttaaagac

SEQ ID NO: 297837 - DNA, 20 bp, Artificial Sequence
  chemically synthesized
gaagaatgtggagttaaaga

SEQ ID NO: 297838 - DNA, 20 bp, Artificial Sequence
  chemically synthesized
cagggaagaatgtggagtta

SEQ ID NO: 297839 - DNA, 20 bp, Artificial Sequence
  chemically synthesized
tcacttcagggaagaatgtg

SEQ ID NO: 297840 - DNA, 20 bp, Artificial Sequence
  chemically synthesized
actcacttcagggaagaatg

SEQ ID NO: 297841 - DNA, 20 bp, Artificial Sequence
  chemically synthesized
taactccacattcttccctg

SEQ ID NO: 297842 - DNA, 20 bp, Artificial Sequence
  chemically synthesized
tactatgactcacttcaggg

SEQ ID NO: 297843 - DNA, 20 bp, Artificial Sequence
  chemically synthesized
tccacattcttccctgaagt

SEQ ID NO: 297844 - DNA, 20 bp, Artificial Sequence
  chemically synthesized
ggttactatgactcacttca

SEQ ID NO: 297845 - DNA, 20 bp, Artificial Sequence
  chemically synthesized
tggttactatgactcacttc

SEQ ID NO: 297846 - DNA, 20 bp, Artificial Sequence
  chemically synthesized
ctggttactatgactcactt

SEQ ID NO: 297847 - DNA, 20 bp, Artificial Sequence
  chemically synthesized
ttcttccctgaagtgagtca

SEQ ID NO: 297848 - DNA, 20 bp, Artificial Sequence
  chemically synthesized
ctgaagtgagtcatagtaac

SEQ ID NO: 297849 - DNA, 20 bp, Artificial Sequence
  chemically synthesized
accttgaagaagaagaattc

SEQ ID NO: 297850 - DNA, 20 bp, Artificial Sequence
  chemically synthesized
aaccagaattcttcttcttc

SEQ ID NO: 297851 - DNA, 20 bp, Artificial Sequence
  chemically synthesized
tatgacctaccttgaagaag

SEQ ID NO: 297852 - DNA, 20 bp, Artificial Sequence
  chemically synthesized
accagaattcttcttcttca

SEQ ID NO: 297853 - DNA, 20 bp, Artificial Sequence
  chemically synthesized
ttctatgacctaccttgaag

SEQ ID NO: 297854 - DNA, 20 bp, Artificial Sequence
  chemically synthesized
agaattcttcttcttcaagg

SEQ ID NO: 297855 - DNA, 20 bp, Artificial Sequence
  chemically synthesized
gaattcttcttcttcaaggt

SEQ ID NO: 297856 - DNA, 20 bp, Artificial Sequence
  chemically synthesized
ggtttctatgacctaccttg

SEQ ID NO: 297857 - DNA, 20 bp, Artificial Sequence
  chemically synthesized
ttcttcttcaaggtaggtca

SEQ ID NO: 297858 - DNA, 20 bp, Artificial Sequence
  chemically synthesized
gctttggaggagagggtttt

SEQ ID NO: 297859 - DNA, 20 bp, Artificial Sequence
  chemically synthesized
atggttggctttggaggaga

SEQ ID NO: 297860 - DNA, 20 bp, Artificial Sequence
  chemically synthesized
tatggttggctttggaggag

SEQ ID NO: 297861 - DNA, 20 bp, Artificial Sequence
  chemically synthesized
accaaaaaccctctcctcca

SEQ ID NO: 297862 - DNA, 20 bp, Artificial Sequence
  chemically synthesized
ttatggttggctttggagga

SEQ ID NO: 297863 - DNA, 20 bp, Artificial Sequence
  chemically synthesized
ttttatggttggctttggag

SEQ ID NO: 297864 - DNA, 20 bp, Artificial Sequence
  chemically synthesized
gcttttatggttggctttgg

SEQ ID NO: 297865 - DNA, 20 bp, Artificial Sequence
  chemically synthesized
ggcttttatggttggctttg

SEQ ID NO: 297866 - DNA, 20 bp, Artificial Sequence
  chemically synthesized
ctggcttttatggttggctt

SEQ ID NO: 297867 - DNA, 20 bp, Artificial Sequence
  chemically synthesized
tcctccaaagccaaccataa

SEQ ID NO: 297868 - DNA, 20 bp, Artificial Sequence
  chemically synthesized
ataattctggcttttatggt

SEQ ID NO: 297869 - DNA, 20 bp, Artificial Sequence
  chemically synthesized
ccaaagccaaccataaaagc

SEQ ID NO: 297870 - DNA, 20 bp, Artificial Sequence
  chemically synthesized
agttataattctggctttta

SEQ ID NO: 297871 - DNA, 20 bp, Artificial Sequence
  chemically synthesized
aaaatacagagttataattc

SEQ ID NO: 297872 - DNA, 20 bp, Artificial Sequence
  chemically synthesized
agaaaggtgggcaaaataca

SEQ ID NO: 297873 - DNA, 20 bp, Artificial Sequence
  chemically synthesized
agagaaaggtgggcaaaata

SEQ ID NO: 297874 - DNA, 20 bp, Artificial Sequence
  chemically synthesized
tagctaatagagagaaaggt

SEQ ID NO: 297875 - DNA, 20 bp, Artificial Sequence
  chemically synthesized
ctagctaatagagagaaagg

SEQ ID NO: 297876 - DNA, 20 bp, Artificial Sequence
  chemically synthesized
tggctagctaatagagagaa

SEQ ID NO: 297877 - DNA, 20 bp, Artificial Sequence
  chemically synthesized
atggctagctaatagagaga

SEQ ID NO: 297878 - DNA, 20 bp, Artificial Sequence
  chemically synthesized
ttgcccacctttctctctat

SEQ ID NO: 297879 - DNA, 20 bp, Artificial Sequence
  chemically synthesized
ttttatggctagctaataga

SEQ ID NO: 297880 - DNA, 20 bp, Artificial Sequence
  chemically synthesized
ccacctttctctctattagc

SEQ ID NO: 297881 - DNA, 20 bp, Artificial Sequence
  chemically synthesized
ttttttatggctagctaata

SEQ ID NO: 297882 - DNA, 20 bp, Artificial Sequence
  chemically synthesized
aattttttatggctagctaa

SEQ ID NO: 297883 - DNA, 20 bp, Artificial Sequence
  chemically synthesized
gtcagagaattttttatggc

SEQ ID NO: 297884 - DNA, 20 bp, Artificial Sequence
  chemically synthesized
gtatgtcagagaatttttta

SEQ ID NO: 297885 - DNA, 20 bp, Artificial Sequence
  chemically synthesized
tatcaaacaaaagtatgtca

SEQ ID NO: 297886 - DNA, 20 bp, Artificial Sequence
  chemically synthesized
actatcaaacaaaagtatgt

SEQ ID NO: 297887 - DNA, 20 bp, Artificial Sequence
  chemically synthesized
tatgatctactatcaaacaa

SEQ ID NO: 297888 - DNA, 20 bp, Artificial Sequence
  chemically synthesized
tctgacatacttttgtttga

SEQ ID NO: 297889 - DNA, 20 bp, Artificial Sequence
  chemically synthesized
gacatacttttgtttgatag

SEQ ID NO: 297890 - DNA, 20 bp, Artificial Sequence
  chemically synthesized
tttgtttgatagtagatcat

SEQ ID NO: 297891 - DNA, 20 bp, Artificial Sequence
  chemically synthesized
agatcataagaccctcattc

SEQ ID NO: 297892 - DNA, 20 bp, Artificial Sequence
  chemically synthesized
gtaggaccccacttgaatga

SEQ ID NO: 297893 - DNA, 20 bp, Artificial Sequence
  chemically synthesized
ggtaggaccccacttgaatg

SEQ ID NO: 297894 - DNA, 20 bp, Artificial Sequence
  chemically synthesized
tcataagaccctcattcaag

SEQ ID NO: 297895 - DNA, 20 bp, Artificial Sequence
  chemically synthesized
gggtaggaccccacttgaat

SEQ ID NO: 297896 - DNA, 20 bp, Artificial Sequence
  chemically synthesized
cataagaccctcattcaagt

SEQ ID NO: 297897 - DNA, 20 bp, Artificial Sequence
  chemically synthesized
ataagaccctcattcaagtg

SEQ ID NO: 297898 - DNA, 20 bp, Artificial Sequence
  chemically synthesized
cttcctcctacacatggggt

SEQ ID NO: 297899 - DNA, 20 bp, Artificial Sequence
  chemically synthesized
ccttcctcctacacatgggg

SEQ ID NO: 297900 - DNA, 20 bp, Artificial Sequence
  chemically synthesized
gtggggtcctaccccatgtg

SEQ ID NO: 297901 - DNA, 20 bp, Artificial Sequence
  chemically synthesized
tggggtcctaccccatgtgt

SEQ ID NO: 297902 - DNA, 20 bp, Artificial Sequence
  chemically synthesized
attccttcctcctacacatg

SEQ ID NO: 297903 - DNA, 20 bp, Artificial Sequence
  chemically synthesized
aattccttcctcctacacat

SEQ ID NO: 297904 - DNA, 20 bp, Artificial Sequence
  chemically synthesized
gggtcctaccccatgtgtag

SEQ ID NO: 297905 - DNA, 20 bp, Artificial Sequence
  chemically synthesized
gaattccttcctcctacaca

SEQ ID NO: 297906 - DNA, 20 bp, Artificial Sequence
  chemically synthesized
ggtcctaccccatgtgtagg

SEQ ID NO: 297907 - DNA, 20 bp, Artificial Sequence
  chemically synthesized
cctaccccatgtgtaggagg

SEQ ID NO: 297908 - DNA, 20 bp, Artificial Sequence
  chemically synthesized
ctaccccatgtgtaggagga

SEQ ID NO: 297909 - DNA, 20 bp, Artificial Sequence
  chemically synthesized
taggaggaaggaattctaca

SEQ ID NO: 297910 - DNA, 20 bp, Artificial Sequence
  chemically synthesized
aggaaggaattctacacaga

SEQ ID NO: 297911 - DNA, 20 bp, Artificial Sequence
  chemically synthesized
ggaaggaattctacacagac

SEQ ID NO: 297912 - DNA, 20 bp, Artificial Sequence
  chemically synthesized
accagccaggcctgtctgtg

SEQ ID NO: 297913 - DNA, 20 bp, Artificial Sequence
  chemically synthesized
gaattctacacagacaggcc

SEQ ID NO: 297914 - DNA, 20 bp, Artificial Sequence
  chemically synthesized
tctacacagacaggcctggc

SEQ ID NO: 297915 - DNA, 20 bp, Artificial Sequence
  chemically synthesized
tagactagggacaaccagcc

SEQ ID NO: 297916 - DNA, 20 bp, Artificial Sequence
  chemically synthesized
atagactagggacaaccagc

SEQ ID NO: 297917 - DNA, 20 bp, Artificial Sequence
  chemically synthesized
agtaatagactagggacaac

SEQ ID NO: 297918 - DNA, 20 bp, Artificial Sequence
  chemically synthesized
caggcctggctggttgtccc

SEQ ID NO: 297919 - DNA, 20 bp, Artificial Sequence
  chemically synthesized
gatctgatagtaatagacta

SEQ ID NO: 297920 - DNA, 20 bp, Artificial Sequence
  chemically synthesized
tgatctgatagtaatagact

SEQ ID NO: 297921 - DNA, 20 bp, Artificial Sequence
  chemically synthesized
atgatctgatagtaatagac

SEQ ID NO: 297922 - DNA, 20 bp, Artificial Sequence
  chemically synthesized
tgtccctagtctattactat

SEQ ID NO: 297923 - DNA, 20 bp, Artificial Sequence
  chemically synthesized
agggaatgatctgatagtaa

SEQ ID NO: 297924 - DNA, 20 bp, Artificial Sequence
  chemically synthesized
acaaaaagggaatgatctga

SEQ ID NO: 297925 - DNA, 20 bp, Artificial Sequence
  chemically synthesized
ggaatgtgattggacaaaaa

SEQ ID NO: 297926 - DNA, 20 bp, Artificial Sequence
  chemically synthesized
aggaatgtgattggacaaaa

SEQ ID NO: 297927 - DNA, 20 bp, Artificial Sequence
  chemically synthesized
taggaatgtgattggacaaa

SEQ ID NO: 297928 - DNA, 20 bp, Artificial Sequence
  chemically synthesized
cagccatgtaggaatgtgat

SEQ ID NO: 297929 - DNA, 20 bp, Artificial Sequence
  chemically synthesized
tgtccaatcacattcctaca

SEQ ID NO: 297930 - DNA, 20 bp, Artificial Sequence
  chemically synthesized
taaagagtagacagccatgt

SEQ ID NO: 297931 - DNA, 20 bp, Artificial Sequence
  chemically synthesized
ataaagagtagacagccatg

SEQ ID NO: 297932 - DNA, 20 bp, Artificial Sequence
  chemically synthesized
tagagttgataaagagtaga

SEQ ID NO: 297933 - DNA, 20 bp, Artificial Sequence
  chemically synthesized
tgcttagagttgataaagag

SEQ ID NO: 297934 - DNA, 20 bp, Artificial Sequence
  chemically synthesized
ttatgcttagagttgataaa

SEQ ID NO: 297935 - DNA, 20 bp, Artificial Sequence
  chemically synthesized
ttttatgcttagagttgata

SEQ ID NO: 297936 - DNA, 20 bp, Artificial Sequence
  chemically synthesized
gtctactctttatcaactct

SEQ ID NO: 297937 - DNA, 20 bp, Artificial Sequence
  chemically synthesized
gaaaactgtttttatgctta

SEQ ID NO: 297938 - DNA, 20 bp, Artificial Sequence
  chemically synthesized
aggaaaactgtttttatgct

SEQ ID NO: 297939 - DNA, 20 bp, Artificial Sequence
  chemically synthesized
atcaactctaagcataaaaa

SEQ ID NO: 297940 - DNA, 20 bp, Artificial Sequence
  chemically synthesized
gcataaaaacagttttcctt

SEQ ID NO: 297941 - DNA, 20 bp, Artificial Sequence
  chemically synthesized
cataaaaacagttttccttt

SEQ ID NO: 297942 - DNA, 20 bp, Artificial Sequence
  chemically synthesized
atgaagacccaatgacccaa

SEQ ID NO: 297943 - DNA, 20 bp, Artificial Sequence
  chemically synthesized
aatgaagacccaatgaccca

SEQ ID NO: 297944 - DNA, 20 bp, Artificial Sequence
  chemically synthesized
acagttttcctttgggtcat

SEQ ID NO: 297945 - DNA, 20 bp, Artificial Sequence
  chemically synthesized
cagttttcctttgggtcatt

SEQ ID NO: 297946 - DNA, 20 bp, Artificial Sequence
  chemically synthesized
catgggagccttcaaaaatg

SEQ ID NO: 297947 - DNA, 20 bp, Artificial Sequence
  chemically synthesized
tcattgggtcttcatttttg

SEQ ID NO: 297948 - DNA, 20 bp, Artificial Sequence
  chemically synthesized
cattgggtcttcatttttga

SEQ ID NO: 297949 - DNA, 20 bp, Artificial Sequence
  chemically synthesized
aaaagttttaggtgacatgg

SEQ ID NO: 297950 - DNA, 20 bp, Artificial Sequence
  chemically synthesized
ataaaagttttaggtgacat

SEQ ID NO: 297951 - DNA, 20 bp, Artificial Sequence
  chemically synthesized
aataaaagttttaggtgaca

SEQ ID NO: 297952 - DNA, 20 bp, Artificial Sequence
  chemically synthesized
atttatctaataaaagtttt

SEQ ID NO: 297953 - DNA, 20 bp, Artificial Sequence
  chemically synthesized
tatttatctaataaaagttt

SEQ ID NO: 297954 - DNA, 20 bp, Artificial Sequence
  chemically synthesized
atgtcacctaaaacttttat

SEQ ID NO: 297955 - DNA, 20 bp, Artificial Sequence
  chemically synthesized
atgagatatttatctaataa

SEQ ID NO: 297956 - DNA, 20 bp, Artificial Sequence
  chemically synthesized
ggttaacaagagaaaagcat

SEQ ID NO: 297957 - DNA, 20 bp, Artificial Sequence
  chemically synthesized
aagataggttaacaagagaa

SEQ ID NO: 297958 - DNA, 20 bp, Artificial Sequence
  chemically synthesized
aacaaaagataggttaacaa

SEQ ID NO: 297959 - DNA, 20 bp, Artificial Sequence
  chemically synthesized
ataacaaaagataggttaac

SEQ ID NO: 297960 - DNA, 20 bp, Artificial Sequence
  chemically synthesized
acattcctataacaaaagat

SEQ ID NO: 297961 - DNA, 20 bp, Artificial Sequence
  chemically synthesized
gacattcctataacaaaaga

SEQ ID NO: 297962 - DNA, 20 bp, Artificial Sequence
  chemically synthesized
tgttaacctatcttttgtta

SEQ ID NO: 297963 - DNA, 20 bp, Artificial Sequence
  chemically synthesized
gttaacctatcttttgttat

SEQ ID NO: 297964 - DNA, 20 bp, Artificial Sequence
  chemically synthesized
agcagacattcctataacaa

SEQ ID NO: 297965 - DNA, 20 bp, Artificial Sequence
  chemically synthesized
cctccttatacaggtcatag

SEQ ID NO: 297966 - DNA, 20 bp, Artificial Sequence
  chemically synthesized
cttcctccttatacaggtca

SEQ ID NO: 297967 - DNA, 20 bp, Artificial Sequence
  chemically synthesized
atgtctgctatgacctgtat

SEQ ID NO: 297968 - DNA, 20 bp, Artificial Sequence
  chemically synthesized
tgtctgctatgacctgtata

SEQ ID NO: 297969 - DNA, 20 bp, Artificial Sequence
  chemically synthesized
tctgctatgacctgtataag

SEQ ID NO: 297970 - DNA, 20 bp, Artificial Sequence
  chemically synthesized
cctttccttcctccttatac

SEQ ID NO: 297971 - DNA, 20 bp, Artificial Sequence
  chemically synthesized
ctgctatgacctgtataagg

SEQ ID NO: 297972 - DNA, 20 bp, Artificial Sequence
  chemically synthesized
ccctttccttcctccttata

SEQ ID NO: 297973 - DNA, 20 bp, Artificial Sequence
  chemically synthesized
ctatgacctgtataaggagg

SEQ ID NO: 297974 - DNA, 20 bp, Artificial Sequence
  chemically synthesized
tatgacctgtataaggagga

SEQ ID NO: 297975 - DNA, 20 bp, Artificial Sequence
  chemically synthesized
acctgtataaggaggaagga

SEQ ID NO: 297976 - DNA, 20 bp, Artificial Sequence
  chemically synthesized
cctgtataaggaggaaggaa

SEQ ID NO: 297977 - DNA, 20 bp, Artificial Sequence
  chemically synthesized
ctgtataaggaggaaggaaa

SEQ ID NO: 297978 - DNA, 20 bp, Artificial Sequence
  chemically synthesized
aggaggaaggaaagggatca

SEQ ID NO: 297979 - DNA, 20 bp, Artificial Sequence
  chemically synthesized
tgcatgttataggagcagaa

SEQ ID NO: 297980 - DNA, 20 bp, Artificial Sequence
  chemically synthesized
atgcatgttataggagcaga

SEQ ID NO: 297981 - DNA, 20 bp, Artificial Sequence
  chemically synthesized
caacatgcatgttataggag

SEQ ID NO: 297982 - DNA, 20 bp, Artificial Sequence
  chemically synthesized
catcaacatgcatgttatag

SEQ ID NO: 297983 - DNA, 20 bp, Artificial Sequence
  chemically synthesized
tacatcaacatgcatgttat

SEQ ID NO: 297984 - DNA, 20 bp, Artificial Sequence
  chemically synthesized
ttacatcaacatgcatgtta

SEQ ID NO: 297985 - DNA, 20 bp, Artificial Sequence
  chemically synthesized
aattggaggtggtggtataa

SEQ ID NO: 297986 - DNA, 20 bp, Artificial Sequence
  chemically synthesized
ctgcagtgaattggaggtgg

SEQ ID NO: 297987 - DNA, 20 bp, Artificial Sequence
  chemically synthesized
tttctgcagtgaattggagg

SEQ ID NO: 297988 - DNA, 20 bp, Artificial Sequence
  chemically synthesized
ttttttctgcagtgaattgg

SEQ ID NO: 297989 - DNA, 20 bp, Artificial Sequence
  chemically synthesized
cttttttctgcagtgaattg

SEQ ID NO: 297990 - DNA, 20 bp, Artificial Sequence
  chemically synthesized
ttcttttttctgcagtgaat

SEQ ID NO: 297991 - DNA, 20 bp, Artificial Sequence
  chemically synthesized
ccaccacctccaattcactg

SEQ ID NO: 297992 - DNA, 20 bp, Artificial Sequence
  chemically synthesized
ctccaattcactgcagaaaa

SEQ ID NO: 297993 - DNA, 20 bp, Artificial Sequence
  chemically synthesized
aactttgtttcttttttctg

SEQ ID NO: 297994 - DNA, 20 bp, Artificial Sequence
  chemically synthesized
cactgcagaaaaaagaaaca

SEQ ID NO: 297995 - DNA, 20 bp, Artificial Sequence
  chemically synthesized
gaaacaaagttgtttgtttt

SEQ ID NO: 297996 - DNA, 20 bp, Artificial Sequence
  chemically synthesized
gttgtttgtttttagtttga

SEQ ID NO: 297997 - DNA, 20 bp, Artificial Sequence
  chemically synthesized
gtaaataattttcattccaa

SEQ ID NO: 297998 - DNA, 20 bp, Artificial Sequence
  chemically synthesized
aaaaaaaaaaagatttcttt

SEQ ID NO: 297999 - DNA, 20 bp, Artificial Sequence
  chemically synthesized
tctcaaaaaaaaaaaaaaaa

SEQ ID NO: 298000 - DNA, 20 bp, Artificial Sequence
  chemically synthesized
tctttttttttttttttttt

SEQ ID NO: 298001 - DNA, 20 bp, Artificial Sequence
  chemically synthesized
ttttttttttttttttgaga

SEQ ID NO: 298002 - DNA, 20 bp, Artificial Sequence
  chemically synthesized
ttttttttttttttgagacg

SEQ ID NO: 298003 - DNA, 20 bp, Artificial Sequence
  chemically synthesized
tccaggctgggtgacagagc

SEQ ID NO: 298004 - DNA, 20 bp, Artificial Sequence
  chemically synthesized
cggagtcttgctctgtcacc

SEQ ID NO: 298005 - DNA, 20 bp, Artificial Sequence
  chemically synthesized
gcactccaggctgggtgaca

SEQ ID NO: 298006 - DNA, 20 bp, Artificial Sequence
  chemically synthesized
ctgcactccaggctgggtga

SEQ ID NO: 298007 - DNA, 20 bp, Artificial Sequence
  chemically synthesized
tcttgctctgtcacccagcc

SEQ ID NO: 298008 - DNA, 20 bp, Artificial Sequence
  chemically synthesized
ttgctctgtcacccagcctg

SEQ ID NO: 298009 - DNA, 20 bp, Artificial Sequence
  chemically synthesized
gcgccactgcactccaggct

SEQ ID NO: 298010 - DNA, 20 bp, Artificial Sequence
  chemically synthesized
cgcgccactgcactccaggc

SEQ ID NO: 298011 - DNA, 20 bp, Artificial Sequence
  chemically synthesized
ctgtcacccagcctggagtg

SEQ ID NO: 298012 - DNA, 20 bp, Artificial Sequence
  chemically synthesized
agatcgcgccactgcactcc

SEQ ID NO: 298013 - DNA, 20 bp, Artificial Sequence
  chemically synthesized
gagatcgcgccactgcactc

SEQ ID NO: 298014 - DNA, 20 bp, Artificial Sequence
  chemically synthesized
tcacccagcctggagtgcag

SEQ ID NO: 298015 - DNA, 20 bp, Artificial Sequence
  chemically synthesized
ggagtgcagtggcgcgatct

SEQ ID NO: 298016 - DNA, 20 bp, Artificial Sequence
  chemically synthesized
ggcggagcttgcagtgagcc

SEQ ID NO: 298017 - DNA, 20 bp, Artificial Sequence
  chemically synthesized
gcgcgatctcggctcactgc

SEQ ID NO: 298018 - DNA, 20 bp, Artificial Sequence
  chemically synthesized
tgggaggcggagcttgcagt

SEQ ID NO: 298019 - DNA, 20 bp, Artificial Sequence
  chemically synthesized
aacctgggaggcggagcttg

SEQ ID NO: 298020 - DNA, 20 bp, Artificial Sequence
  chemically synthesized
tcactgcaagctccgcctcc

SEQ ID NO: 298021 - DNA, 20 bp, Artificial Sequence
  chemically synthesized
tggcgtgaacctgggaggcg

SEQ ID NO: 298022 - DNA, 20 bp, Artificial Sequence
  chemically synthesized
cactgcaagctccgcctccc

SEQ ID NO: 298023 - DNA, 20 bp, Artificial Sequence
  chemically synthesized
aatggcgtgaacctgggagg

SEQ ID NO: 298024 - DNA, 20 bp, Artificial Sequence
  chemically synthesized
gagaatggcgtgaacctggg

SEQ ID NO: 298025 - DNA, 20 bp, Artificial Sequence
  chemically synthesized
ggagaatggcgtgaacctgg

SEQ ID NO: 298026 - DNA, 20 bp, Artificial Sequence
  chemically synthesized
caggagaatggcgtgaacct

SEQ ID NO: 298027 - DNA, 20 bp, Artificial Sequence
  chemically synthesized
gcaggagaatggcgtgaacc

SEQ ID NO: 298028 - DNA, 20 bp, Artificial Sequence
  chemically synthesized
gggaggctgaggcaggagaa

SEQ ID NO: 298029 - DNA, 20 bp, Artificial Sequence
  chemically synthesized
ttcacgccattctcctgcct

SEQ ID NO: 298030 - DNA, 20 bp, Artificial Sequence
  chemically synthesized
tactcgggaggctgaggcag

SEQ ID NO: 298031 - DNA, 20 bp, Artificial Sequence
  chemically synthesized
gctactcgggaggctgaggc

SEQ ID NO: 298032 - DNA, 20 bp, Artificial Sequence
  chemically synthesized
agctactcgggaggctgagg

SEQ ID NO: 298033 - DNA, 20 bp, Artificial Sequence
  chemically synthesized
cccagctactcgggaggctg

SEQ ID NO: 298034 - DNA, 20 bp, Artificial Sequence
  chemically synthesized
tcccagctactcgggaggct

SEQ ID NO: 298035 - DNA, 20 bp, Artificial Sequence
  chemically synthesized
ttctcctgcctcagcctccc

SEQ ID NO: 298036 - DNA, 20 bp, Artificial Sequence
  chemically synthesized
tcctgcctcagcctcccgag

SEQ ID NO: 298037 - DNA, 20 bp, Artificial Sequence
  chemically synthesized
tgtggtcccagctactcggg

SEQ ID NO: 298038 - DNA, 20 bp, Artificial Sequence
  chemically synthesized
ctgtggtcccagctactcgg

SEQ ID NO: 298039 - DNA, 20 bp, Artificial Sequence
  chemically synthesized
gcctcagcctcccgagtagc

SEQ ID NO: 298040 - DNA, 20 bp, Artificial Sequence
  chemically synthesized
gcctgtggtcccagctactc

SEQ ID NO: 298041 - DNA, 20 bp, Artificial Sequence
  chemically synthesized
cctcagcctcccgagtagct

SEQ ID NO: 298042 - DNA, 20 bp, Artificial Sequence
  chemically synthesized
cgcctgtggtcccagctact

SEQ ID NO: 298043 - DNA, 20 bp, Artificial Sequence
  chemically synthesized
ctcccgagtagctgggacca

SEQ ID NO: 298044 - DNA, 20 bp, Artificial Sequence
  chemically synthesized
tcccgagtagctgggaccac

SEQ ID NO: 298045 - DNA, 20 bp, Artificial Sequence
  chemically synthesized
gtggcgggcgcctgtggtcc

SEQ ID NO: 298046 - DNA, 20 bp, Artificial Sequence
  chemically synthesized
ggcgtggtggcgggcgcctg

SEQ ID NO: 298047 - DNA, 20 bp, Artificial Sequence
  chemically synthesized
aattagccgggcgtggtggc

SEQ ID NO: 298048 - DNA, 20 bp, Artificial Sequence
  chemically synthesized
aaattagccgggcgtggtgg

SEQ ID NO: 298049 - DNA, 20 bp, Artificial Sequence
  chemically synthesized
caggcgcccgccaccacgcc

SEQ ID NO: 298050 - DNA, 20 bp, Artificial Sequence
  chemically synthesized
aaaaaattagccgggcgtgg

SEQ ID NO: 298051 - DNA, 20 bp, Artificial Sequence
  chemically synthesized
caaaaaaaattagccgggcg

SEQ ID NO: 298052 - DNA, 20 bp, Artificial Sequence
  chemically synthesized
aaatacaaaaaaaattagcc

SEQ ID NO: 298053 - DNA, 20 bp, Artificial Sequence
  chemically synthesized
aaaatacaaaaaaaattagc

SEQ ID NO: 298054 - DNA, 20 bp, Artificial Sequence
  chemically synthesized
actaaaaatacaaaaaaaat

SEQ ID NO: 298055 - DNA, 20 bp, Artificial Sequence
  chemically synthesized
gctaattttttttgtatttt

SEQ ID NO: 298056 - DNA, 20 bp, Artificial Sequence
  chemically synthesized
aattttttttgtatttttag

SEQ ID NO: 298057 - DNA, 20 bp, Artificial Sequence
  chemically synthesized
ttttttttgtatttttagta

SEQ ID NO: 298058 - DNA, 20 bp, Artificial Sequence
  chemically synthesized
ttgtatttttagtagagatg

SEQ ID NO: 298059 - DNA, 20 bp, Artificial Sequence
  chemically synthesized
gagatgtggtttcaccgtgt

SEQ ID NO: 298060 - DNA, 20 bp, Artificial Sequence
  chemically synthesized
tgtggtttcaccgtgttagc

SEQ ID NO: 298061 - DNA, 20 bp, Artificial Sequence
  chemically synthesized
cgagaccatcctggctaaca

SEQ ID NO: 298062 - DNA, 20 bp, Artificial Sequence
  chemically synthesized
gtggtttcaccgtgttagcc

SEQ ID NO: 298063 - DNA, 20 bp, Artificial Sequence
  chemically synthesized
tttcaccgtgttagccagga

SEQ ID NO: 298064 - DNA, 20 bp, Artificial Sequence
  chemically synthesized
tcaggagatcgagaccatcc

SEQ ID NO: 298065 - DNA, 20 bp, Artificial Sequence
  chemically synthesized
gatctagaggtcaggagatc

SEQ ID NO: 298066 - DNA, 20 bp, Artificial Sequence
  chemically synthesized
cgggcggatctagaggtcag

SEQ ID NO: 298067 - DNA, 20 bp, Artificial Sequence
  chemically synthesized
ggtctcgatctcctgacctc

SEQ ID NO: 298068 - DNA, 20 bp, Artificial Sequence
  chemically synthesized
ggcgggcggatctagaggtc

SEQ ID NO: 298069 - DNA, 20 bp, Artificial Sequence
  chemically synthesized
aggcgggcggatctagaggt

SEQ ID NO: 298070 - DNA, 20 bp, Artificial Sequence
  chemically synthesized
gccgaggcgggcggatctag

SEQ ID NO: 298071 - DNA, 20 bp, Artificial Sequence
  chemically synthesized
ggccgaggcgggcggatcta

SEQ ID NO: 298072 - DNA, 20 bp, Artificial Sequence
  chemically synthesized
gaggccgaggcgggcggatc

SEQ ID NO: 298073 - DNA, 20 bp, Artificial Sequence
  chemically synthesized
acctctagatccgcccgcct

SEQ ID NO: 298074 - DNA, 20 bp, Artificial Sequence
  chemically synthesized
ctttgggaggccgaggcggg

SEQ ID NO: 298075 - DNA, 20 bp, Artificial Sequence
  chemically synthesized
gcactttgggaggccgaggc

SEQ ID NO: 298076 - DNA, 20 bp, Artificial Sequence
  chemically synthesized
agcactttgggaggccgagg

SEQ ID NO: 298077 - DNA, 20 bp, Artificial Sequence
  chemically synthesized
cccagcactttgggaggccg

SEQ ID NO: 298078 - DNA, 20 bp, Artificial Sequence
  chemically synthesized
tcccagcactttgggaggcc

SEQ ID NO: 298079 - DNA, 20 bp, Artificial Sequence
  chemically synthesized
ccgcccgcctcggcctccca

SEQ ID NO: 298080 - DNA, 20 bp, Artificial Sequence
  chemically synthesized
tgtaatcccagcactttggg

SEQ ID NO: 298081 - DNA, 20 bp, Artificial Sequence
  chemically synthesized
ctgtaatcccagcactttgg

SEQ ID NO: 298082 - DNA, 20 bp, Artificial Sequence
  chemically synthesized
gcctcggcctcccaaagtgc

SEQ ID NO: 298083 - DNA, 20 bp, Artificial Sequence
  chemically synthesized
gcctgtaatcccagcacttt

SEQ ID NO: 298084 - DNA, 20 bp, Artificial Sequence
  chemically synthesized
cctcggcctcccaaagtgct

SEQ ID NO: 298085 - DNA, 20 bp, Artificial Sequence
  chemically synthesized
cgcctgtaatcccagcactt

SEQ ID NO: 298086 - DNA, 20 bp, Artificial Sequence
  chemically synthesized
ctcccaaagtgctgggatta

SEQ ID NO: 298087 - DNA, 20 bp, Artificial Sequence
  chemically synthesized
tcccaaagtgctgggattac

SEQ ID NO: 298088 - DNA, 20 bp, Artificial Sequence
  chemically synthesized
gtggctcacgcctgtaatcc

SEQ ID NO: 298089 - DNA, 20 bp, Artificial Sequence
  chemically synthesized
agtgctgggattacaggcgt

SEQ ID NO: 298090 - DNA, 20 bp, Artificial Sequence
  chemically synthesized
caggcgtgagccaccgcgcc

SEQ ID NO: 298091 - DNA, 20 bp, Artificial Sequence
  chemically synthesized
tcttctggggccgggcgcgg

SEQ ID NO: 298092 - DNA, 20 bp, Artificial Sequence
  chemically synthesized
atttcttctggggccgggcg

SEQ ID NO: 298093 - DNA, 20 bp, Artificial Sequence
  chemically synthesized
tgagccaccgcgcccggccc

SEQ ID NO: 298094 - DNA, 20 bp, Artificial Sequence
  chemically synthesized
acaagatttcttctggggcc

SEQ ID NO: 298095 - DNA, 20 bp, Artificial Sequence
  chemically synthesized
gccaccgcgcccggccccag

SEQ ID NO: 298096 - DNA, 20 bp, Artificial Sequence
  chemically synthesized
tacaagatttcttctggggc

SEQ ID NO: 298097 - DNA, 20 bp, Artificial Sequence
  chemically synthesized
gtgttacaagatttcttctg

SEQ ID NO: 298098 - DNA, 20 bp, Artificial Sequence
  chemically synthesized
agtgttacaagatttcttct

SEQ ID NO: 298099 - DNA, 20 bp, Artificial Sequence
  chemically synthesized
aagtgttacaagatttcttc

SEQ ID NO: 298100 - DNA, 20 bp, Artificial Sequence
  chemically synthesized
tacacctctaaaagtgttac

SEQ ID NO: 298101 - DNA, 20 bp, Artificial Sequence
  chemically synthesized
aagaaatcttgtaacacttt

SEQ ID NO: 298102 - DNA, 20 bp, Artificial Sequence
  chemically synthesized
gaaatcttgtaacactttta

SEQ ID NO: 298103 - DNA, 20 bp, Artificial Sequence
  chemically synthesized
aaatcttgtaacacttttag

SEQ ID NO: 298104 - DNA, 20 bp, Artificial Sequence
  chemically synthesized
tcaggaaaatacacctctaa

SEQ ID NO: 298105 - DNA, 20 bp, Artificial Sequence
  chemically synthesized
agaggtgtattttcctgaaa

SEQ ID NO: 298106 - DNA, 20 bp, Artificial Sequence
  chemically synthesized
gaggtgtattttcctgaaaa

SEQ ID NO: 298107 - DNA, 20 bp, Artificial Sequence
  chemically synthesized
catacaattttgcctttttc

SEQ ID NO: 298108 - DNA, 20 bp, Artificial Sequence
  chemically synthesized
acatacaattttgccttttt

SEQ ID NO: 298109 - DNA, 20 bp, Artificial Sequence
  chemically synthesized
ttgtatgtttccttttaaaa

SEQ ID NO: 298110 - DNA, 20 bp, Artificial Sequence
  chemically synthesized
agacatttgaccgttttaaa

SEQ ID NO: 298111 - DNA, 20 bp, Artificial Sequence
  chemically synthesized
gagacatttgaccgttttaa

SEQ ID NO: 298112 - DNA, 20 bp, Artificial Sequence
  chemically synthesized
tttatgaaggggaaaaaaag

SEQ ID NO: 298113 - DNA, 20 bp, Artificial Sequence
  chemically synthesized
gctttatgaaggggaaaaaa

SEQ ID NO: 298114 - DNA, 20 bp, Artificial Sequence
  chemically synthesized
tgctttatgaaggggaaaaa

SEQ ID NO: 298115 - DNA, 20 bp, Artificial Sequence
  chemically synthesized
tcctttttttccccttcata

SEQ ID NO: 298116 - DNA, 20 bp, Artificial Sequence
  chemically synthesized
ttagtatatgctttatgaag

SEQ ID NO: 298117 - DNA, 20 bp, Artificial Sequence
  chemically synthesized
cttagtatatgctttatgaa

SEQ ID NO: 298118 - DNA, 20 bp, Artificial Sequence
  chemically synthesized
acttagtatatgctttatga

SEQ ID NO: 298119 - DNA, 20 bp, Artificial Sequence
  chemically synthesized
cacttagtatatgctttatg

SEQ ID NO: 298120 - DNA, 20 bp, Artificial Sequence
  chemically synthesized
cccttcataaagcatatact

SEQ ID NO: 298121 - DNA, 20 bp, Artificial Sequence
  chemically synthesized
tctggcacatagtaagcact

SEQ ID NO: 298122 - DNA, 20 bp, Artificial Sequence
  chemically synthesized
tagcatgtctggcacatagt

SEQ ID NO: 298123 - DNA, 20 bp, Artificial Sequence
  chemically synthesized
actaagtgcttactatgtgc

SEQ ID NO: 298124 - DNA, 20 bp, Artificial Sequence
  chemically synthesized
ttaatagcatgtctggcaca

SEQ ID NO: 298125 - DNA, 20 bp, Artificial Sequence
  chemically synthesized
tatggagttaatagcatgtc

SEQ ID NO: 298126 - DNA, 20 bp, Artificial Sequence
  chemically synthesized
tctgttctttatggagttaa

SEQ ID NO: 298127 - DNA, 20 bp, Artificial Sequence
  chemically synthesized
gacatgctattaactccata

SEQ ID NO: 298128 - DNA, 20 bp, Artificial Sequence
  chemically synthesized
tctcgtctctgttctttatg

SEQ ID NO: 298129 - DNA, 20 bp, Artificial Sequence
  chemically synthesized
gctattaactccataaagaa

SEQ ID NO: 298130 - DNA, 20 bp, Artificial Sequence
  chemically synthesized
attctcgtctctgttcttta

SEQ ID NO: 298131 - DNA, 20 bp, Artificial Sequence
  chemically synthesized
tattaactccataaagaaca

SEQ ID NO: 298132 - DNA, 20 bp, Artificial Sequence
  chemically synthesized
actccataaagaacagagac

SEQ ID NO: 298133 - DNA, 20 bp, Artificial Sequence
  chemically synthesized
gaacagagacgagaatgcat

SEQ ID NO: 298134 - DNA, 20 bp, Artificial Sequence
  chemically synthesized
atgcattagtccacattatc

SEQ ID NO: 298135 - DNA, 20 bp, Artificial Sequence
  chemically synthesized
aaccaaattacttgataatg

SEQ ID NO: 298136 - DNA, 20 bp, Artificial Sequence
  chemically synthesized
gtccacattatcaagtaatt

SEQ ID NO: 298137 - DNA, 20 bp, Artificial Sequence
  chemically synthesized
cattatcaagtaatttggtt

SEQ ID NO: 298138 - DNA, 20 bp, Artificial Sequence
  chemically synthesized
tcaagtaatttggtttagtg

SEQ ID NO: 298139 - DNA, 20 bp, Artificial Sequence
  chemically synthesized
tagtgaagcatttgtttgac

SEQ ID NO: 298140 - DNA, 20 bp, Artificial Sequence
  chemically synthesized
tttgtttgacaagataaaaa

SEQ ID NO: 298141 - DNA, 20 bp, Artificial Sequence
  chemically synthesized
ttgacaagataaaaatggtt

SEQ ID NO: 298142 - DNA, 20 bp, Artificial Sequence
  chemically synthesized
agataaaaatggtttagaca

SEQ ID NO: 298143 - DNA, 20 bp, Artificial Sequence
  chemically synthesized
aaatggtttagacacagaac

SEQ ID NO: 298144 - DNA, 20 bp, Artificial Sequence
  chemically synthesized
aatggtttagacacagaact

SEQ ID NO: 298145 - DNA, 20 bp, Artificial Sequence
  chemically synthesized
atggtttagacacagaactg

SEQ ID NO: 298146 - DNA, 20 bp, Artificial Sequence
  chemically synthesized
ttagacacagaactggggct

SEQ ID NO: 298147 - DNA, 20 bp, Artificial Sequence
  chemically synthesized
gaccagtgtgagctgagccc

SEQ ID NO: 298148 - DNA, 20 bp, Artificial Sequence
  chemically synthesized
taaaaagaccagtgtgagct

SEQ ID NO: 298149 - DNA, 20 bp, Artificial Sequence
  chemically synthesized
aactggggctcagctcacac

SEQ ID NO: 298150 - DNA, 20 bp, Artificial Sequence
  chemically synthesized
cctcttaaaaagaccagtgt

SEQ ID NO: 298151 - DNA, 20 bp, Artificial Sequence
  chemically synthesized
gattatcctcttaaaaagac

SEQ ID NO: 298152 - DNA, 20 bp, Artificial Sequence
  chemically synthesized
cagctcacactggtcttttt

SEQ ID NO: 298153 - DNA, 20 bp, Artificial Sequence
  chemically synthesized
gctcacactggtctttttaa

SEQ ID NO: 298154 - DNA, 20 bp, Artificial Sequence
  chemically synthesized
ctcacactggtctttttaag

SEQ ID NO: 298155 - DNA, 20 bp, Artificial Sequence
  chemically synthesized
tttttgattatcctcttaaa

SEQ ID NO: 298156 - DNA, 20 bp, Artificial Sequence
  chemically synthesized
ttaatcctaatttacagaga

SEQ ID NO: 298157 - DNA, 20 bp, Artificial Sequence
  chemically synthesized
tttaatcctaatttacagag

SEQ ID NO: 298158 - DNA, 20 bp, Artificial Sequence
  chemically synthesized
aaaacaccttctctgtaaat

SEQ ID NO: 298159 - DNA, 20 bp, Artificial Sequence
  chemically synthesized
tgatttaatcctaatttaca

SEQ ID NO: 298160 - DNA, 20 bp, Artificial Sequence
  chemically synthesized
aaacaccttctctgtaaatt

SEQ ID NO: 298161 - DNA, 20 bp, Artificial Sequence
  chemically synthesized
gctgatttaatcctaattta

SEQ ID NO: 298162 - DNA, 20 bp, Artificial Sequence
  chemically synthesized
tctgtaaattaggattaaat

SEQ ID NO: 298163 - DNA, 20 bp, Artificial Sequence
  chemically synthesized
attaggattaaatcagcttc

SEQ ID NO: 298164 - DNA, 20 bp, Artificial Sequence
  chemically synthesized
gattaaatcagcttctagcc

SEQ ID NO: 298165 - DNA, 20 bp, Artificial Sequence
  chemically synthesized
tggcagagcctctaggctag

SEQ ID NO: 298166 - DNA, 20 bp, Artificial Sequence
  chemically synthesized
ttaaatcagcttctagccta

SEQ ID NO: 298167 - DNA, 20 bp, Artificial Sequence
  chemically synthesized
taaatcagcttctagcctag

SEQ ID NO: 298168 - DNA, 20 bp, Artificial Sequence
  chemically synthesized
acttggcagagcctctaggc

SEQ ID NO: 298169 - DNA, 20 bp, Artificial Sequence
  chemically synthesized
atatacttggcagagcctct

SEQ ID NO: 298170 - DNA, 20 bp, Artificial Sequence
  chemically synthesized
aatatacttggcagagcctc

SEQ ID NO: 298171 - DNA, 20 bp, Artificial Sequence
  chemically synthesized
tctagcctagaggctctgcc

SEQ ID NO: 298172 - DNA, 20 bp, Artificial Sequence
  chemically synthesized
gataaccaatatacttggca

SEQ ID NO: 298173 - DNA, 20 bp, Artificial Sequence
  chemically synthesized
gagataaccaatatacttgg

SEQ ID NO: 298174 - DNA, 20 bp, Artificial Sequence
  chemically synthesized
agaggctctgccaagtatat

SEQ ID NO: 298175 - DNA, 20 bp, Artificial Sequence
  chemically synthesized
gtggagataaccaatatact

SEQ ID NO: 298176 - DNA, 20 bp, Artificial Sequence
  chemically synthesized
atattggttatctccacaca

SEQ ID NO: 298177 - DNA, 20 bp, Artificial Sequence
  chemically synthesized
cacaaagccttctttgtgtg

SEQ ID NO: 298178 - DNA, 20 bp, Artificial Sequence
  chemically synthesized
ttggttatctccacacaaag

SEQ ID NO: 298179 - DNA, 20 bp, Artificial Sequence
  chemically synthesized
tccacaaagccttctttgtg

SEQ ID NO: 298180 - DNA, 20 bp, Artificial Sequence
  chemically synthesized
tggttatctccacacaaaga

SEQ ID NO: 298181 - DNA, 20 bp, Artificial Sequence
  chemically synthesized
tccacacaaagaaggctttg

SEQ ID NO: 298182 - DNA, 20 bp, Artificial Sequence
  chemically synthesized
cacacaaagaaggctttgtg

SEQ ID NO: 298183 - DNA, 20 bp, Artificial Sequence
  chemically synthesized
accatggtgttgactccaca

SEQ ID NO: 298184 - DNA, 20 bp, Artificial Sequence
  chemically synthesized
gctttgtggagtcaacacca

SEQ ID NO: 298185 - DNA, 20 bp, Artificial Sequence
  chemically synthesized
aagcaaacagacagttacca

SEQ ID NO: 298186 - DNA, 20 bp, Artificial Sequence
  chemically synthesized
cagacagagaagcaaacaga

SEQ ID NO: 298187 - DNA, 20 bp, Artificial Sequence
  chemically synthesized
ttcacagacagagaagcaaa

SEQ ID NO: 298188 - DNA, 20 bp, Artificial Sequence
  chemically synthesized
taaaatcttcacagacagag

SEQ ID NO: 298189 - DNA, 20 bp, Artificial Sequence
  chemically synthesized
ccttaaaatcttcacagaca

SEQ ID NO: 298190 - DNA, 20 bp, Artificial Sequence
  chemically synthesized
tgtttgcttctctgtctgtg

SEQ ID NO: 298191 - DNA, 20 bp, Artificial Sequence
  chemically synthesized
tcccttaaaatcttcacaga

SEQ ID NO: 298192 - DNA, 20 bp, Artificial Sequence
  chemically synthesized
ggcctcccttaaaatcttca

SEQ ID NO: 298193 - DNA, 20 bp, Artificial Sequence
  chemically synthesized
tctctgtctgtgaagatttt

SEQ ID NO: 298194 - DNA, 20 bp, Artificial Sequence
  chemically synthesized
ctctgtctgtgaagatttta

SEQ ID NO: 298195 - DNA, 20 bp, Artificial Sequence
  chemically synthesized
tctgtctgtgaagattttaa

SEQ ID NO: 298196 - DNA, 20 bp, Artificial Sequence
  chemically synthesized
tgtctgtgaagattttaagg

SEQ ID NO: 298197 - DNA, 20 bp, Artificial Sequence
  chemically synthesized
gtctgtgaagattttaaggg

SEQ ID NO: 298198 - DNA, 20 bp, Artificial Sequence
  chemically synthesized
tgaagattttaagggaggcc

SEQ ID NO: 298199 - DNA, 20 bp, Artificial Sequence
  chemically synthesized
tttaagggaggcctggacac

SEQ ID NO: 298200 - DNA, 20 bp, Artificial Sequence
  chemically synthesized
ctacgtgccaactggtgtcc

SEQ ID NO: 298201 - DNA, 20 bp, Artificial Sequence
  chemically synthesized
actacgtgccaactggtgtc

SEQ ID NO: 298202 - DNA, 20 bp, Artificial Sequence
  chemically synthesized
agggaggcctggacaccagt

SEQ ID NO: 298203 - DNA, 20 bp, Artificial Sequence
  chemically synthesized
tatcagaactacgtgccaac

SEQ ID NO: 298204 - DNA, 20 bp, Artificial Sequence
  chemically synthesized
cctggacaccagttggcacg

SEQ ID NO: 298205 - DNA, 20 bp, Artificial Sequence
  chemically synthesized
tttgaattgatttgaattat

SEQ ID NO: 298206 - DNA, 20 bp, Artificial Sequence
  chemically synthesized
attcaaatcaattcaaacaa

SEQ ID NO: 298207 - DNA, 20 bp, Artificial Sequence
  chemically synthesized
ttcaaatcaattcaaacaac

SEQ ID NO: 298208 - DNA, 20 bp, Artificial Sequence
  chemically synthesized
caacaggatgtgaaattcta

SEQ ID NO: 298209 - DNA, 20 bp, Artificial Sequence
  chemically synthesized
aggatgtgaaattctacaga

SEQ ID NO: 298210 - DNA, 20 bp, Artificial Sequence
  chemically synthesized
ggatgtgaaattctacagaa

SEQ ID NO: 298211 - DNA, 20 bp, Artificial Sequence
  chemically synthesized
aatgaggaaagacctttctg

SEQ ID NO: 298212 - DNA, 20 bp, Artificial Sequence
  chemically synthesized
gacaaaaaattgaatgagga

SEQ ID NO: 298213 - DNA, 20 bp, Artificial Sequence
  chemically synthesized
gtcagacaaaaaattgaatg

SEQ ID NO: 298214 - DNA, 20 bp, Artificial Sequence
  chemically synthesized
agtcagacaaaaaattgaat

SEQ ID NO: 298215 - DNA, 20 bp, Artificial Sequence
  chemically synthesized
cctttccaaatttataaagt

SEQ ID NO: 298216 - DNA, 20 bp, Artificial Sequence
  chemically synthesized
gacccctttccaaatttata

SEQ ID NO: 298217 - DNA, 20 bp, Artificial Sequence
  chemically synthesized
tttgtctgactttataaatt

SEQ ID NO: 298218 - DNA, 20 bp, Artificial Sequence
  chemically synthesized
tctgactttataaatttgga

SEQ ID NO: 298219 - DNA, 20 bp, Artificial Sequence
  chemically synthesized
ctgactttataaatttggaa

SEQ ID NO: 298220 - DNA, 20 bp, Artificial Sequence
  chemically synthesized
tgactttataaatttggaaa

SEQ ID NO: 298221 - DNA, 20 bp, Artificial Sequence
  chemically synthesized
gactttataaatttggaaag

SEQ ID NO: 298222 - DNA, 20 bp, Artificial Sequence
  chemically synthesized
atttggaaaggggtcacata

SEQ ID NO: 298223 - DNA, 20 bp, Artificial Sequence
  chemically synthesized
acgatctttgtataaaaggg

SEQ ID NO: 298224 - DNA, 20 bp, Artificial Sequence
  chemically synthesized
catacgatctttgtataaaa

SEQ ID NO: 298225 - DNA, 20 bp, Artificial Sequence
  chemically synthesized
ccatacgatctttgtataaa

SEQ ID NO: 298226 - DNA, 20 bp, Artificial Sequence
  chemically synthesized
gtgaacttcccttttataca

SEQ ID NO: 298227 - DNA, 20 bp, Artificial Sequence
  chemically synthesized
tccatacgatctttgtataa

SEQ ID NO: 298228 - DNA, 20 bp, Artificial Sequence
  chemically synthesized
ccttttatacaaagatcgta

SEQ ID NO: 298229 - DNA, 20 bp, Artificial Sequence
  chemically synthesized
ttttatacaaagatcgtatg

SEQ ID NO: 298230 - DNA, 20 bp, Artificial Sequence
  chemically synthesized
ttatacaaagatcgtatgga

SEQ ID NO: 298231 - DNA, 20 bp, Artificial Sequence
  chemically synthesized
aaatctgtacatcaaaaaac

SEQ ID NO: 298232 - DNA, 20 bp, Artificial Sequence
  chemically synthesized
tacgctcgttttttgatgta

SEQ ID NO: 298233 - DNA, 20 bp, Artificial Sequence
  chemically synthesized
ttgatgtacagatttttaaa

SEQ ID NO: 298234 - DNA, 20 bp, Artificial Sequence
  chemically synthesized
tgatgtacagatttttaaaa

SEQ ID NO: 298235 - DNA, 20 bp, Artificial Sequence
  chemically synthesized
aaggcaatttcaaattttac

SEQ ID NO: 298236 - DNA, 20 bp, Artificial Sequence
  chemically synthesized
aggcaatttcaaattttact

SEQ ID NO: 298237 - DNA, 20 bp, Artificial Sequence
  chemically synthesized
ggcaatttcaaattttacta

SEQ ID NO: 298238 - DNA, 20 bp, Artificial Sequence
  chemically synthesized
aatttcaaattttactaggg

SEQ ID NO: 298239 - DNA, 20 bp, Artificial Sequence
  chemically synthesized
ttcaaattttactagggcag

SEQ ID NO: 298240 - DNA, 20 bp, Artificial Sequence
  chemically synthesized
cgctctcctcaccactgccc

SEQ ID NO: 298241 - DNA, 20 bp, Artificial Sequence
  chemically synthesized
aattttactagggcagtggt

SEQ ID NO: 298242 - DNA, 20 bp, Artificial Sequence
  chemically synthesized
attttactagggcagtggtg

SEQ ID NO: 298243 - DNA, 20 bp, Artificial Sequence
  chemically synthesized
tttactagggcagtggtgag

SEQ ID NO: 298244 - DNA, 20 bp, Artificial Sequence
  chemically synthesized
tactagggcagtggtgagga

SEQ ID NO: 298245 - DNA, 20 bp, Artificial Sequence
  chemically synthesized
gtgaggagagcgttttgtct

SEQ ID NO: 298246 - DNA, 20 bp, Artificial Sequence
  chemically synthesized
tgaggagagcgttttgtcta

SEQ ID NO: 298247 - DNA, 20 bp, Artificial Sequence
  chemically synthesized
tatgaataggttattttcct

SEQ ID NO: 298248 - DNA, 20 bp, Artificial Sequence
  chemically synthesized
aaggaaaataacctattcat

SEQ ID NO: 298249 - DNA, 20 bp, Artificial Sequence
  chemically synthesized
taacctctgtgcttatgaat

SEQ ID NO: 298250 - DNA, 20 bp, Artificial Sequence
  chemically synthesized
ttaacctctgtgcttatgaa

SEQ ID NO: 298251 - DNA, 20 bp, Artificial Sequence
  chemically synthesized
aaataacctattcataagca

SEQ ID NO: 298252 - DNA, 20 bp, Artificial Sequence
  chemically synthesized
ataacctattcataagcaca

SEQ ID NO: 298253 - DNA, 20 bp, Artificial Sequence
  chemically synthesized
taacctattcataagcacag

SEQ ID NO: 298254 - DNA, 20 bp, Artificial Sequence
  chemically synthesized
tttgttccattttagaaaag

SEQ ID NO: 298255 - DNA, 20 bp, Artificial Sequence
  chemically synthesized
ttctttgttccattttagaa

SEQ ID NO: 298256 - DNA, 20 bp, Artificial Sequence
  chemically synthesized
gttatacttcttttctaaaa

SEQ ID NO: 298257 - DNA, 20 bp, Artificial Sequence
  chemically synthesized
tatgtttctttgttccattt

SEQ ID NO: 298258 - DNA, 20 bp, Artificial Sequence
  chemically synthesized
ttcttttctaaaatggaaca

SEQ ID NO: 298259 - DNA, 20 bp, Artificial Sequence
  chemically synthesized
gaacaaagaaacatattaat

SEQ ID NO: 298260 - DNA, 20 bp, Artificial Sequence
  chemically synthesized
aagaaacatattaatgagtt

SEQ ID NO: 298261 - DNA, 20 bp, Artificial Sequence
  chemically synthesized
agaactccaacaggtgagaa

SEQ ID NO: 298262 - DNA, 20 bp, Artificial Sequence
  chemically synthesized
gaagaactccaacaggtgag

SEQ ID NO: 298263 - DNA, 20 bp, Artificial Sequence
  chemically synthesized
tttggactcttctcacctgt

SEQ ID NO: 298264 - DNA, 20 bp, Artificial Sequence
  chemically synthesized
agggaagaactccaacaggt

SEQ ID NO: 298265 - DNA, 20 bp, Artificial Sequence
  chemically synthesized
tggactcttctcacctgttg

SEQ ID NO: 298266 - DNA, 20 bp, Artificial Sequence
  chemically synthesized
tgaaagggaagaactccaac

SEQ ID NO: 298267 - DNA, 20 bp, Artificial Sequence
  chemically synthesized
atgaaagggaagaactccaa

SEQ ID NO: 298268 - DNA, 20 bp, Artificial Sequence
  chemically synthesized
taatgatagaaatgaaaggg

SEQ ID NO: 298269 - DNA, 20 bp, Artificial Sequence
  chemically synthesized
caataatgatagaaatgaaa

SEQ ID NO: 298270 - DNA, 20 bp, Artificial Sequence
  chemically synthesized
acaataatgatagaaatgaa

SEQ ID NO: 298271 - DNA, 20 bp, Artificial Sequence
  chemically synthesized
cacaataatgatagaaatga

SEQ ID NO: 298272 - DNA, 20 bp, Artificial Sequence
  chemically synthesized
tcaagatatcacaataatga

SEQ ID NO: 298273 - DNA, 20 bp, Artificial Sequence
  chemically synthesized
attgtgatatcttgatttca

SEQ ID NO: 298274 - DNA, 20 bp, Artificial Sequence
  chemically synthesized
cacctgtttcccatgaaatc

SEQ ID NO: 298275 - DNA, 20 bp, Artificial Sequence
  chemically synthesized
ttgtgatatcttgatttcat

SEQ ID NO: 298276 - DNA, 20 bp, Artificial Sequence
  chemically synthesized
tatcttgatttcatgggaaa

SEQ ID NO: 298277 - DNA, 20 bp, Artificial Sequence
  chemically synthesized
atcttgatttcatgggaaac

SEQ ID NO: 298278 - DNA, 20 bp, Artificial Sequence
  chemically synthesized
ttgatttcatgggaaacagg

SEQ ID NO: 298279 - DNA, 20 bp, Artificial Sequence
  chemically synthesized
aattgtgtaagaattgggtt

SEQ ID NO: 298280 - DNA, 20 bp, Artificial Sequence
  chemically synthesized
gcttgaattgtgtaagaatt

SEQ ID NO: 298281 - DNA, 20 bp, Artificial Sequence
  chemically synthesized
agcttgaattgtgtaagaat

SEQ ID NO: 298282 - DNA, 20 bp, Artificial Sequence
  chemically synthesized
gctcagagcttgaattgtgt

SEQ ID NO: 298283 - DNA, 20 bp, Artificial Sequence
  chemically synthesized
acccaattcttacacaattc

SEQ ID NO: 298284 - DNA, 20 bp, Artificial Sequence
  chemically synthesized
tcttacacaattcaagctct

SEQ ID NO: 298285 - DNA, 20 bp, Artificial Sequence
  chemically synthesized
attaggttaggaatagctca

SEQ ID NO: 298286 - DNA, 20 bp, Artificial Sequence
  chemically synthesized
agattaggttaggaatagct

SEQ ID NO: 298287 - DNA, 20 bp, Artificial Sequence
  chemically synthesized
tattaagattaggttaggaa

SEQ ID NO: 298288 - DNA, 20 bp, Artificial Sequence
  chemically synthesized
ataaatattaagattaggtt

SEQ ID NO: 298289 - DNA, 20 bp, Artificial Sequence
  chemically synthesized
aataaatattaagattaggt

SEQ ID NO: 298290 - DNA, 20 bp, Artificial Sequence
  chemically synthesized
ataaaataaatattaagatt

SEQ ID NO: 298291 - DNA, 20 bp, Artificial Sequence
  chemically synthesized
cataaaataaatattaagat

SEQ ID NO: 298292 - DNA, 20 bp, Artificial Sequence
  chemically synthesized
agcaacataaaataaatatt

SEQ ID NO: 298293 - DNA, 20 bp, Artificial Sequence
  chemically synthesized
tattttatgttgcttccatt

SEQ ID NO: 298294 - DNA, 20 bp, Artificial Sequence
  chemically synthesized
gaaggaagaagtccaaatgg

SEQ ID NO: 298295 - DNA, 20 bp, Artificial Sequence
  chemically synthesized
tttgaaggaagaagtccaaa

SEQ ID NO: 298296 - DNA, 20 bp, Artificial Sequence
  chemically synthesized
tcagagatgtttgaaggaag

SEQ ID NO: 298297 - DNA, 20 bp, Artificial Sequence
  chemically synthesized
aaatcagagatgtttgaagg

SEQ ID NO: 298298 - DNA, 20 bp, Artificial Sequence
  chemically synthesized
aggaaatcagagatgtttga

SEQ ID NO: 298299 - DNA, 20 bp, Artificial Sequence
  chemically synthesized
aaggaaatcagagatgtttg

SEQ ID NO: 298300 - DNA, 20 bp, Artificial Sequence
  chemically synthesized
gagttttagcaaggaaatca

SEQ ID NO: 298301 - DNA, 20 bp, Artificial Sequence
  chemically synthesized
aagagttttagcaaggaaat

SEQ ID NO: 298302 - DNA, 20 bp, Artificial Sequence
  chemically synthesized
ggacaaaaagagttttagca

SEQ ID NO: 298303 - DNA, 20 bp, Artificial Sequence
  chemically synthesized
tggacaaaaagagttttagc

SEQ ID NO: 298304 - DNA, 20 bp, Artificial Sequence
  chemically synthesized
tgtgtggacaaaaagagttt

SEQ ID NO: 298305 - DNA, 20 bp, Artificial Sequence
  chemically synthesized
acattatgtgtggacaaaaa

SEQ ID NO: 298306 - DNA, 20 bp, Artificial Sequence
  chemically synthesized
gcacattatgtgtggacaaa

SEQ ID NO: 298307 - DNA, 20 bp, Artificial Sequence
  chemically synthesized
ggctgactgcacattatgtg

SEQ ID NO: 298308 - DNA, 20 bp, Artificial Sequence
  chemically synthesized
ttttgtccacacataatgtg

SEQ ID NO: 298309 - DNA, 20 bp, Artificial Sequence
  chemically synthesized
gtccacacataatgtgcagt

SEQ ID NO: 298310 - DNA, 20 bp, Artificial Sequence
  chemically synthesized
catgttaagtattagagtgt

SEQ ID NO: 298311 - DNA, 20 bp, Artificial Sequence
  chemically synthesized
acatgttaagtattagagtg

SEQ ID NO: 298312 - DNA, 20 bp, Artificial Sequence
  chemically synthesized
gtggtacatgttaagtatta

SEQ ID NO: 298313 - DNA, 20 bp, Artificial Sequence
  chemically synthesized
tggtggtacatgttaagtat

SEQ ID NO: 298314 - DNA, 20 bp, Artificial Sequence
  chemically synthesized
aagagatggtggtacatgtt

SEQ ID NO: 298315 - DNA, 20 bp, Artificial Sequence
  chemically synthesized
cccagaactctaagagatgg

SEQ ID NO: 298316 - DNA, 20 bp, Artificial Sequence
  chemically synthesized
taacatgtaccaccatctct

SEQ ID NO: 298317 - DNA, 20 bp, Artificial Sequence
  chemically synthesized
acatgtaccaccatctctta

SEQ ID NO: 298318 - DNA, 20 bp, Artificial Sequence
  chemically synthesized
actcccagaactctaagaga

SEQ ID NO: 298319 - DNA, 20 bp, Artificial Sequence
  chemically synthesized
gttaactcccagaactctaa

SEQ ID NO: 298320 - DNA, 20 bp, Artificial Sequence
  chemically synthesized
accaccatctcttagagttc

SEQ ID NO: 298321 - DNA, 20 bp, Artificial Sequence
  chemically synthesized
cagttaactcccagaactct

SEQ ID NO: 298322 - DNA, 20 bp, Artificial Sequence
  chemically synthesized
ccaccatctcttagagttct

SEQ ID NO: 298323 - DNA, 20 bp, Artificial Sequence
  chemically synthesized
accatctcttagagttctgg

SEQ ID NO: 298324 - DNA, 20 bp, Artificial Sequence
  chemically synthesized
agtagctgacagttaactcc

SEQ ID NO: 298325 - DNA, 20 bp, Artificial Sequence
  chemically synthesized
gagttctgggagttaactgt

SEQ ID NO: 298326 - DNA, 20 bp, Artificial Sequence
  chemically synthesized
aaaacaatgctagtagctga

SEQ ID NO: 298327 - DNA, 20 bp, Artificial Sequence
  chemically synthesized
gggagttaactgtcagctac

SEQ ID NO: 298328 - DNA, 20 bp, Artificial Sequence
  chemically synthesized
tggagagaaaacaatgctag

SEQ ID NO: 298329 - DNA, 20 bp, Artificial Sequence
  chemically synthesized
tattggagagaaaacaatgc

SEQ ID NO: 298330 - DNA, 20 bp, Artificial Sequence
  chemically synthesized
tccactggcagaatattgga

SEQ ID NO: 298331 - DNA, 20 bp, Artificial Sequence
  chemically synthesized
tatccactggcagaatattg

SEQ ID NO: 298332 - DNA, 20 bp, Artificial Sequence
  chemically synthesized
gctatccactggcagaatat

SEQ ID NO: 298333 - DNA, 20 bp, Artificial Sequence
  chemically synthesized
ttttctctccaatattctgc

SEQ ID NO: 298334 - DNA, 20 bp, Artificial Sequence
  chemically synthesized
tctctccaatattctgccag

SEQ ID NO: 298335 - DNA, 20 bp, Artificial Sequence
  chemically synthesized
gagatgaggctatccactgg

SEQ ID NO: 298336 - DNA, 20 bp, Artificial Sequence
  chemically synthesized
tccaatattctgccagtgga

SEQ ID NO: 298337 - DNA, 20 bp, Artificial Sequence
  chemically synthesized
aaagagatgaggctatccac

SEQ ID NO: 298338 - DNA, 20 bp, Artificial Sequence
  chemically synthesized
attgctggcataaagagatg

SEQ ID NO: 298339 - DNA, 20 bp, Artificial Sequence
  chemically synthesized
cattgctggcataaagagat

SEQ ID NO: 298340 - DNA, 20 bp, Artificial Sequence
  chemically synthesized
atagcctcatctctttatgc

SEQ ID NO: 298341 - DNA, 20 bp, Artificial Sequence
  chemically synthesized
atcctcattgctggcataaa

SEQ ID NO: 298342 - DNA, 20 bp, Artificial Sequence
  chemically synthesized
ccatcctcattgctggcata

SEQ ID NO: 298343 - DNA, 20 bp, Artificial Sequence
  chemically synthesized
catctctttatgccagcaat

SEQ ID NO: 298344 - DNA, 20 bp, Artificial Sequence
  chemically synthesized
atctctttatgccagcaatg

SEQ ID NO: 298345 - DNA, 20 bp, Artificial Sequence
  chemically synthesized
cacccttccatcctcattgc

SEQ ID NO: 298346 - DNA, 20 bp, Artificial Sequence
  chemically synthesized
ctttatgccagcaatgagga

SEQ ID NO: 298347 - DNA, 20 bp, Artificial Sequence
  chemically synthesized
tatgccagcaatgaggatgg

SEQ ID NO: 298348 - DNA, 20 bp, Artificial Sequence
  chemically synthesized
atgccagcaatgaggatgga

SEQ ID NO: 298349 - DNA, 20 bp, Artificial Sequence
  chemically synthesized
tgccagcaatgaggatggaa

SEQ ID NO: 298350 - DNA, 20 bp, Artificial Sequence
  chemically synthesized
gcaatgaggatggaagggtg

SEQ ID NO: 298351 - DNA, 20 bp, Artificial Sequence
  chemically synthesized
aatgaggatggaagggtgaa

SEQ ID NO: 298352 - DNA, 20 bp, Artificial Sequence
  chemically synthesized
atgaggatggaagggtgaag

SEQ ID NO: 298353 - DNA, 20 bp, Artificial Sequence
  chemically synthesized
aggatggaagggtgaagagg

SEQ ID NO: 298354 - DNA, 20 bp, Artificial Sequence
  chemically synthesized
atggaagggtgaagaggaag

SEQ ID NO: 298355 - DNA, 20 bp, Artificial Sequence
  chemically synthesized
ggaagggtgaagaggaagca

SEQ ID NO: 298356 - DNA, 20 bp, Artificial Sequence
  chemically synthesized
gaagggtgaagaggaagcag

SEQ ID NO: 298357 - DNA, 20 bp, Artificial Sequence
  chemically synthesized
gggtgaagaggaagcagagg

SEQ ID NO: 298358 - DNA, 20 bp, Artificial Sequence
  chemically synthesized
ggtgaagaggaagcagaggc

SEQ ID NO: 298359 - DNA, 20 bp, Artificial Sequence
  chemically synthesized
gtgaagaggaagcagaggca

SEQ ID NO: 298360 - DNA, 20 bp, Artificial Sequence
  chemically synthesized
ggaagcagaggcagggtttc

SEQ ID NO: 298361 - DNA, 20 bp, Artificial Sequence
  chemically synthesized
gaagcagaggcagggtttca

SEQ ID NO: 298362 - DNA, 20 bp, Artificial Sequence
  chemically synthesized
actcagggagagtacatggg

SEQ ID NO: 298363 - DNA, 20 bp, Artificial Sequence
  chemically synthesized
cactcagggagagtacatgg

SEQ ID NO: 298364 - DNA, 20 bp, Artificial Sequence
  chemically synthesized
ggcactcagggagagtacat

SEQ ID NO: 298365 - DNA, 20 bp, Artificial Sequence
  chemically synthesized
tggcactcagggagagtaca

SEQ ID NO: 298366 - DNA, 20 bp, Artificial Sequence
  chemically synthesized
gcctcccatgtactctccct

SEQ ID NO: 298367 - DNA, 20 bp, Artificial Sequence
  chemically synthesized
aggccattggcactcaggga

SEQ ID NO: 298368 - DNA, 20 bp, Artificial Sequence
  chemically synthesized
gtaggccattggcactcagg

SEQ ID NO: 298369 - DNA, 20 bp, Artificial Sequence
  chemically synthesized
atgtaggccattggcactca

SEQ ID NO: 298370 - DNA, 20 bp, Artificial Sequence
  chemically synthesized
gatgtaggccattggcactc

SEQ ID NO: 298371 - DNA, 20 bp, Artificial Sequence
  chemically synthesized
ggatgtaggccattggcact

SEQ ID NO: 298372 - DNA, 20 bp, Artificial Sequence
  chemically synthesized
gtactctccctgagtgccaa

SEQ ID NO: 298373 - DNA, 20 bp, Artificial Sequence
  chemically synthesized
aagcgttggatgtaggccat

SEQ ID NO: 298374 - DNA, 20 bp, Artificial Sequence
  chemically synthesized
taaaactaagcgttggatgt

SEQ ID NO: 298375 - DNA, 20 bp, Artificial Sequence
  chemically synthesized
ctaaaactaagcgttggatg

SEQ ID NO: 298376 - DNA, 20 bp, Artificial Sequence
  chemically synthesized
aatggcctacatccaacgct

SEQ ID NO: 298377 - DNA, 20 bp, Artificial Sequence
  chemically synthesized
ctgaacctaaaactaagcgt

SEQ ID NO: 298378 - DNA, 20 bp, Artificial Sequence
  chemically synthesized
ctacatccaacgcttagttt

SEQ ID NO: 298379 - DNA, 20 bp, Artificial Sequence
  chemically synthesized
tacatccaacgcttagtttt

SEQ ID NO: 298380 - DNA, 20 bp, Artificial Sequence
  chemically synthesized
atgtcactgaacctaaaact

SEQ ID NO: 298381 - DNA, 20 bp, Artificial Sequence
  chemically synthesized
ccaacgcttagttttaggtt

SEQ ID NO: 298382 - DNA, 20 bp, Artificial Sequence
  chemically synthesized
ttttcaatgcacaatgaact

SEQ ID NO: 298383 - DNA, 20 bp, Artificial Sequence
  chemically synthesized
taggatccgggaaggagact

SEQ ID NO: 298384 - DNA, 20 bp, Artificial Sequence
  chemically synthesized
aatgaactcagtctccttcc

SEQ ID NO: 298385 - DNA, 20 bp, Artificial Sequence
  chemically synthesized
tctgagtaggatccgggaag

SEQ ID NO: 298386 - DNA, 20 bp, Artificial Sequence
  chemically synthesized
ggtctgagtaggatccggga

SEQ ID NO: 298387 - DNA, 20 bp, Artificial Sequence
  chemically synthesized
gggtctgagtaggatccggg

SEQ ID NO: 298388 - DNA, 20 bp, Artificial Sequence
  chemically synthesized
ccagggtctgagtaggatcc

SEQ ID NO: 298389 - DNA, 20 bp, Artificial Sequence
  chemically synthesized
gccagggtctgagtaggatc

SEQ ID NO: 298390 - DNA, 20 bp, Artificial Sequence
  chemically synthesized
tctccttcccggatcctact

SEQ ID NO: 298391 - DNA, 20 bp, Artificial Sequence
  chemically synthesized
ttggaagccagggtctgagt

SEQ ID NO: 298392 - DNA, 20 bp, Artificial Sequence
  chemically synthesized
cttggaagccagggtctgag

SEQ ID NO: 298393 - DNA, 20 bp, Artificial Sequence
  chemically synthesized
cccggatcctactcagaccc

SEQ ID NO: 298394 - DNA, 20 bp, Artificial Sequence
  chemically synthesized
cttcttggaagccagggtct

SEQ ID NO: 298395 - DNA, 20 bp, Artificial Sequence
  chemically synthesized
caattgcttcttggaagcca

SEQ ID NO: 298396 - DNA, 20 bp, Artificial Sequence
  chemically synthesized
ctactcagaccctggcttcc

SEQ ID NO: 298397 - DNA, 20 bp, Artificial Sequence
  chemically synthesized
gcaattgcttcttggaagcc

SEQ ID NO: 298398 - DNA, 20 bp, Artificial Sequence
  chemically synthesized
tgcaattgcttcttggaagc

SEQ ID NO: 298399 - DNA, 20 bp, Artificial Sequence
  chemically synthesized
ctcagaccctggcttccaag

SEQ ID NO: 298400 - DNA, 20 bp, Artificial Sequence
  chemically synthesized
aacgtgcaattgcttcttgg

SEQ ID NO: 298401 - DNA, 20 bp, Artificial Sequence
  chemically synthesized
ataaacgtgcaattgcttct

SEQ ID NO: 298402 - DNA, 20 bp, Artificial Sequence
  chemically synthesized
cgatagttgctaaattgata

SEQ ID NO: 298403 - DNA, 20 bp, Artificial Sequence
  chemically synthesized
tattttattccttatcaatt

SEQ ID NO: 298404 - DNA, 20 bp, Artificial Sequence
  chemically synthesized
gcgatagttgctaaattgat

SEQ ID NO: 298405 - DNA, 20 bp, Artificial Sequence
  chemically synthesized
cacaaaaagtgatgaagcga

SEQ ID NO: 298406 - DNA, 20 bp, Artificial Sequence
  chemically synthesized
acaaaccacaaaaagtgatg

SEQ ID NO: 298407 - DNA, 20 bp, Artificial Sequence
  chemically synthesized
tatcgcttcatcactttttg

SEQ ID NO: 298408 - DNA, 20 bp, Artificial Sequence
  chemically synthesized
actacacgacaaaccacaaa

SEQ ID NO: 298409 - DNA, 20 bp, Artificial Sequence
  chemically synthesized
actttttgtggtttgtcgtg

SEQ ID NO: 298410 - DNA, 20 bp, Artificial Sequence
  chemically synthesized
ttcatgtatttcactgctac

SEQ ID NO: 298411 - DNA, 20 bp, Artificial Sequence
  chemically synthesized
atctgaggaatatctagtag

SEQ ID NO: 298412 - DNA, 20 bp, Artificial Sequence
  chemically synthesized
gatatctgaggaatatctag

SEQ ID NO: 298413 - DNA, 20 bp, Artificial Sequence
  chemically synthesized
aaagatatctgaggaatatc

SEQ ID NO: 298414 - DNA, 20 bp, Artificial Sequence
  chemically synthesized
cactgctactagatattcct

SEQ ID NO: 298415 - DNA, 20 bp, Artificial Sequence
  chemically synthesized
catctcagcaaagatatctg

SEQ ID NO: 298416 - DNA, 20 bp, Artificial Sequence
  chemically synthesized
gcatctcagcaaagatatct

SEQ ID NO: 298417 - DNA, 20 bp, Artificial Sequence
  chemically synthesized
attcctcagatatctttgct

SEQ ID NO: 298418 - DNA, 20 bp, Artificial Sequence
  chemically synthesized
atttgccatgcatctcagca

SEQ ID NO: 298419 - DNA, 20 bp, Artificial Sequence
  chemically synthesized
gatatctttgctgagatgca

SEQ ID NO: 298420 - DNA, 20 bp, Artificial Sequence
  chemically synthesized
tgttcatttgccatgcatct

SEQ ID NO: 298421 - DNA, 20 bp, Artificial Sequence
  chemically synthesized
tgagatgcatggcaaatgaa

SEQ ID NO: 298422 - DNA, 20 bp, Artificial Sequence
  chemically synthesized
catgaagacatttaaatcag

SEQ ID NO: 298423 - DNA, 20 bp, Artificial Sequence
  chemically synthesized
gcatgaagacatttaaatca

SEQ ID NO: 298424 - DNA, 20 bp, Artificial Sequence
  chemically synthesized
aagcatgaagacatttaaat

SEQ ID NO: 298425 - DNA, 20 bp, Artificial Sequence
  chemically synthesized
agcacccaatttaaagcatg

SEQ ID NO: 298426 - DNA, 20 bp, Artificial Sequence
  chemically synthesized
aatgtcttcatgctttaaat

SEQ ID NO: 298427 - DNA, 20 bp, Artificial Sequence
  chemically synthesized
atgtcttcatgctttaaatt

SEQ ID NO: 298428 - DNA, 20 bp, Artificial Sequence
  chemically synthesized
agtagatagcacccaattta

SEQ ID NO: 298429 - DNA, 20 bp, Artificial Sequence
  chemically synthesized
aaagcactgggaagagtaga

SEQ ID NO: 298430 - DNA, 20 bp, Artificial Sequence
  chemically synthesized
tgggtgctatctactcttcc

SEQ ID NO: 298431 - DNA, 20 bp, Artificial Sequence
  chemically synthesized
ctgcaaagcactgggaagag

SEQ ID NO: 298432 - DNA, 20 bp, Artificial Sequence
  chemically synthesized
catctgcaaagcactgggaa

SEQ ID NO: 298433 - DNA, 20 bp, Artificial Sequence
  chemically synthesized
gccatctgcaaagcactggg

SEQ ID NO: 298434 - DNA, 20 bp, Artificial Sequence
  chemically synthesized
aatgccatctgcaaagcact

SEQ ID NO: 298435 - DNA, 20 bp, Artificial Sequence
  chemically synthesized
aaatgccatctgcaaagcac

SEQ ID NO: 298436 - DNA, 20 bp, Artificial Sequence
  chemically synthesized
ctactcttcccagtgctttg

SEQ ID NO: 298437 - DNA, 20 bp, Artificial Sequence
  chemically synthesized
tcttcccagtgctttgcaga

SEQ ID NO: 298438 - DNA, 20 bp, Artificial Sequence
  chemically synthesized
gatagaaaatgccatctgca

SEQ ID NO: 298439 - DNA, 20 bp, Artificial Sequence
  chemically synthesized
tcacttagtgcaaagtatga

SEQ ID NO: 298440 - DNA, 20 bp, Artificial Sequence
  chemically synthesized
tttctatcatactttgcact

SEQ ID NO: 298441 - DNA, 20 bp, Artificial Sequence
  chemically synthesized
acccaggctcacttagtgca

SEQ ID NO: 298442 - DNA, 20 bp, Artificial Sequence
  chemically synthesized
tatcatactttgcactaagt

SEQ ID NO: 298443 - DNA, 20 bp, Artificial Sequence
  chemically synthesized
attaaatacccaggctcact

SEQ ID NO: 298444 - DNA, 20 bp, Artificial Sequence
  chemically synthesized
tactttgcactaagtgagcc

SEQ ID NO: 298445 - DNA, 20 bp, Artificial Sequence
  chemically synthesized
actttgcactaagtgagcct

SEQ ID NO: 298446 - DNA, 20 bp, Artificial Sequence
  chemically synthesized
tcgttcgtaattaaataccc

SEQ ID NO: 298447 - DNA, 20 bp, Artificial Sequence
  chemically synthesized
ttcgttcgtaattaaatacc

SEQ ID NO: 298448 - DNA, 20 bp, Artificial Sequence
  chemically synthesized
tacgaacgaaatatatcatt

SEQ ID NO: 298449 - DNA, 20 bp, Artificial Sequence
  chemically synthesized
tatatcattcagatgcaact

SEQ ID NO: 298450 - DNA, 20 bp, Artificial Sequence
  chemically synthesized
gggttttaaagaaggtaact

SEQ ID NO: 298451 - DNA, 20 bp, Artificial Sequence
  chemically synthesized
ttccttgagggttttaaaga

SEQ ID NO: 298452 - DNA, 20 bp, Artificial Sequence
  chemically synthesized
tttccttgagggttttaaag

SEQ ID NO: 298453 - DNA, 20 bp, Artificial Sequence
  chemically synthesized
tgttttccttgagggtttta

SEQ ID NO: 298454 - DNA, 20 bp, Artificial Sequence
  chemically synthesized
ttaccttctttaaaaccctc

SEQ ID NO: 298455 - DNA, 20 bp, Artificial Sequence
  chemically synthesized
taccttctttaaaaccctca

SEQ ID NO: 298456 - DNA, 20 bp, Artificial Sequence
  chemically synthesized
gtcttcagtgttttccttga

SEQ ID NO: 298457 - DNA, 20 bp, Artificial Sequence
  chemically synthesized
agtcttcagtgttttccttg

SEQ ID NO: 298458 - DNA, 20 bp, Artificial Sequence
  chemically synthesized
aagtcttcagtgttttcctt

SEQ ID NO: 298459 - DNA, 20 bp, Artificial Sequence
  chemically synthesized
aaccctcaaggaaaacactg

SEQ ID NO: 298460 - DNA, 20 bp, Artificial Sequence
  chemically synthesized
tggcattgaaaataagtctt

SEQ ID NO: 298461 - DNA, 20 bp, Artificial Sequence
  chemically synthesized
ttgaatatggcattgaaaat

SEQ ID NO: 298462 - DNA, 20 bp, Artificial Sequence
  chemically synthesized
acagaatccaacgttgaata

SEQ ID NO: 298463 - DNA, 20 bp, Artificial Sequence
  chemically synthesized
ttcaatgccatattcaacgt

SEQ ID NO: 298464 - DNA, 20 bp, Artificial Sequence
  chemically synthesized
aagaagcaaaaatacatgta

SEQ ID NO: 298465 - DNA, 20 bp, Artificial Sequence
  chemically synthesized
aaacgagtaattttatgaag

SEQ ID NO: 298466 - DNA, 20 bp, Artificial Sequence
  chemically synthesized
tagaaacgagtaattttatg

SEQ ID NO: 298467 - DNA, 20 bp, Artificial Sequence
  chemically synthesized
aaaaaagaattattagaaac

SEQ ID NO: 298468 - DNA, 20 bp, Artificial Sequence
  chemically synthesized
agtggggaaaaaagaattat

SEQ ID NO: 298469 - DNA, 20 bp, Artificial Sequence
  chemically synthesized
agttgttaaagtggggaaaa

SEQ ID NO: 298470 - DNA, 20 bp, Artificial Sequence
  chemically synthesized
ttatgtgagttgttaaagtg

SEQ ID NO: 298471 - DNA, 20 bp, Artificial Sequence
  chemically synthesized
tttatgtgagttgttaaagt

SEQ ID NO: 298472 - DNA, 20 bp, Artificial Sequence
  chemically synthesized
ttttatgtgagttgttaaag

SEQ ID NO: 298473 - DNA, 20 bp, Artificial Sequence
  chemically synthesized
tggttttatgtgagttgtta

SEQ ID NO: 298474 - DNA, 20 bp, Artificial Sequence
  chemically synthesized
cattagcaatggttttatgt

SEQ ID NO: 298475 - DNA, 20 bp, Artificial Sequence
  chemically synthesized
atacataagttcattagcaa

SEQ ID NO: 298476 - DNA, 20 bp, Artificial Sequence
  chemically synthesized
cttatgatacataagttcat

SEQ ID NO: 298477 - DNA, 20 bp, Artificial Sequence
  chemically synthesized
atgagcaacttatgatacat

SEQ ID NO: 298478 - DNA, 20 bp, Artificial Sequence
  chemically synthesized
ctaatgaacttatgtatcat

SEQ ID NO: 298479 - DNA, 20 bp, Artificial Sequence
  chemically synthesized
aaggtgtagggacacattat

SEQ ID NO: 298480 - DNA, 20 bp, Artificial Sequence
  chemically synthesized
ggactgattccaaaggtgta

SEQ ID NO: 298481 - DNA, 20 bp, Artificial Sequence
  chemically synthesized
ataatgtgtccctacacctt

SEQ ID NO: 298482 - DNA, 20 bp, Artificial Sequence
  chemically synthesized
tggactgattccaaaggtgt

SEQ ID NO: 298483 - DNA, 20 bp, Artificial Sequence
  chemically synthesized
gtggactgattccaaaggtg

SEQ ID NO: 298484 - DNA, 20 bp, Artificial Sequence
  chemically synthesized
tgtccctacacctttggaat

SEQ ID NO: 298485 - DNA, 20 bp, Artificial Sequence
  chemically synthesized
tattagtggactgattccaa

SEQ ID NO: 298486 - DNA, 20 bp, Artificial Sequence
  chemically synthesized
atattagtggactgattcca

SEQ ID NO: 298487 - DNA, 20 bp, Artificial Sequence
  chemically synthesized
agcactaaggaatatattag

SEQ ID NO: 298488 - DNA, 20 bp, Artificial Sequence
  chemically synthesized
ttaagcactaaggaatatat

SEQ ID NO: 298489 - DNA, 20 bp, Artificial Sequence
  chemically synthesized
cagtccactaatatattcct

SEQ ID NO: 298490 - DNA, 20 bp, Artificial Sequence
  chemically synthesized
ggaaagtaagttaagcacta

SEQ ID NO: 298491 - DNA, 20 bp, Artificial Sequence
  chemically synthesized
aggaaagtaagttaagcact

SEQ ID NO: 298492 - DNA, 20 bp, Artificial Sequence
  chemically synthesized
gtatatgaggaaagtaagtt

SEQ ID NO: 298493 - DNA, 20 bp, Artificial Sequence
  chemically synthesized
gttaagtatatgaggaaagt

SEQ ID NO: 298494 - DNA, 20 bp, Artificial Sequence
  chemically synthesized
cagagttaagtatatgagga

SEQ ID NO: 298495 - DNA, 20 bp, Artificial Sequence
  chemically synthesized
agtacagagttaagtatatg

SEQ ID NO: 298496 - DNA, 20 bp, Artificial Sequence
  chemically synthesized
aagtacagagttaagtatat

SEQ ID NO: 298497 - DNA, 20 bp, Artificial Sequence
  chemically synthesized
agtacgttaagtacagagtt

SEQ ID NO: 298498 - DNA, 20 bp, Artificial Sequence
  chemically synthesized
tcggaagtacgttaagtaca

SEQ ID NO: 298499 - DNA, 20 bp, Artificial Sequence
  chemically synthesized
attcggaagtacgttaagta

SEQ ID NO: 298500 - DNA, 20 bp, Artificial Sequence
  chemically synthesized
ataacattcggaagtacgtt

SEQ ID NO: 298501 - DNA, 20 bp, Artificial Sequence
  chemically synthesized
tagagtctgataacattcgg

SEQ ID NO: 298502 - DNA, 20 bp, Artificial Sequence
  chemically synthesized
ggatagagtctgataacatt

SEQ ID NO: 298503 - DNA, 20 bp, Artificial Sequence
  chemically synthesized
aacgtacttccgaatgttat

SEQ ID NO: 298504 - DNA, 20 bp, Artificial Sequence
  chemically synthesized
tagactgcatttaagggata

SEQ ID NO: 298505 - DNA, 20 bp, Artificial Sequence
  chemically synthesized
gttagactgcatttaaggga

SEQ ID NO: 298506 - DNA, 20 bp, Artificial Sequence
  chemically synthesized
cagactctatcccttaaatg

SEQ ID NO: 298507 - DNA, 20 bp, Artificial Sequence
  chemically synthesized
taaagttagactgcatttaa

SEQ ID NO: 298508 - DNA, 20 bp, Artificial Sequence
  chemically synthesized
gtaaagttagactgcattta

SEQ ID NO: 298509 - DNA, 20 bp, Artificial Sequence
  chemically synthesized
ggtaaagttagactgcattt

SEQ ID NO: 298510 - DNA, 20 bp, Artificial Sequence
  chemically synthesized
gattttaagctaggtaaagt

SEQ ID NO: 298511 - DNA, 20 bp, Artificial Sequence
  chemically synthesized
aaatgcagtctaactttacc

SEQ ID NO: 298512 - DNA, 20 bp, Artificial Sequence
  chemically synthesized
aggagattttaagctaggta

SEQ ID NO: 298513 - DNA, 20 bp, Artificial Sequence
  chemically synthesized
gctaaaggagattttaagct

SEQ ID NO: 298514 - DNA, 20 bp, Artificial Sequence
  chemically synthesized
agctaaaggagattttaagc

SEQ ID NO: 298515 - DNA, 20 bp, Artificial Sequence
  chemically synthesized
tattagctaaaggagatttt

SEQ ID NO: 298516 - DNA, 20 bp, Artificial Sequence
  chemically synthesized
acctagcttaaaatctcctt

SEQ ID NO: 298517 - DNA, 20 bp, Artificial Sequence
  chemically synthesized
tatttttttattagctaaag

SEQ ID NO: 298518 - DNA, 20 bp, Artificial Sequence
  chemically synthesized
gttatttttttattagctaa

SEQ ID NO: 298519 - DNA, 20 bp, Artificial Sequence
  chemically synthesized
agttatttttttattagcta

SEQ ID NO: 298520 - DNA, 20 bp, Artificial Sequence
  chemically synthesized
atgagaagttatttttttat

SEQ ID NO: 298521 - DNA, 20 bp, Artificial Sequence
  chemically synthesized
ttttgtgaacagagaatgag

SEQ ID NO: 298522 - DNA, 20 bp, Artificial Sequence
  chemically synthesized
tcattttgtgaacagagaat

SEQ ID NO: 298523 - DNA, 20 bp, Artificial Sequence
  chemically synthesized
aaataatcattttgtgaaca

SEQ ID NO: 298524 - DNA, 20 bp, Artificial Sequence
  chemically synthesized
agaaataatcattttgtgaa

SEQ ID NO: 298525 - DNA, 20 bp, Artificial Sequence
  chemically synthesized
agaatattcatcaataatta

SEQ ID NO: 298526 - DNA, 20 bp, Artificial Sequence
  chemically synthesized
tatacttgaagaatagagga

SEQ ID NO: 298527 - DNA, 20 bp, Artificial Sequence
  chemically synthesized
aagatatacttgaagaatag

SEQ ID NO: 298528 - DNA, 20 bp, Artificial Sequence
  chemically synthesized
taagatatacttgaagaata

SEQ ID NO: 298529 - DNA, 20 bp, Artificial Sequence
  chemically synthesized
tattctgtcctctattcttc

SEQ ID NO: 298530 - DNA, 20 bp, Artificial Sequence
  chemically synthesized
tttaagatatacttgaagaa

SEQ ID NO: 298531 - DNA, 20 bp, Artificial Sequence
  chemically synthesized
gaggttttaagatatacttg

SEQ ID NO: 298532 - DNA, 20 bp, Artificial Sequence
  chemically synthesized
taataacaaattgaggtttt

SEQ ID NO: 298533 - DNA, 20 bp, Artificial Sequence
  chemically synthesized
ccataaataataacaaattg

SEQ ID NO: 298534 - DNA, 20 bp, Artificial Sequence
  chemically synthesized
accataaataataacaaatt

SEQ ID NO: 298535 - DNA, 20 bp, Artificial Sequence
  chemically synthesized
cctcaatttgttattattta

SEQ ID NO: 298536 - DNA, 20 bp, Artificial Sequence
  chemically synthesized
aatttgttattatttatggt

SEQ ID NO: 298537 - DNA, 20 bp, Artificial Sequence
  chemically synthesized
ttgttattatttatggttag

SEQ ID NO: 298538 - DNA, 20 bp, Artificial Sequence
  chemically synthesized
attatttatggttagcagtg

SEQ ID NO: 298539 - DNA, 20 bp, Artificial Sequence
  chemically synthesized
tgatgagtatatttgtaaag

SEQ ID NO: 298540 - DNA, 20 bp, Artificial Sequence
  chemically synthesized
tctgatgagtatatttgtaa

SEQ ID NO: 298541 - DNA, 20 bp, Artificial Sequence
  chemically synthesized
ttctgatgagtatatttgta

SEQ ID NO: 298542 - DNA, 20 bp, Artificial Sequence
  chemically synthesized
tcctttacaaatatactcat

SEQ ID NO: 298543 - DNA, 20 bp, Artificial Sequence
  chemically synthesized
taatttcaggggtttctgat

SEQ ID NO: 298544 - DNA, 20 bp, Artificial Sequence
  chemically synthesized
tttacaagttttaatttcag

SEQ ID NO: 298545 - DNA, 20 bp, Artificial Sequence
  chemically synthesized
ctttacaagttttaatttca

SEQ ID NO: 298546 - DNA, 20 bp, Artificial Sequence
  chemically synthesized
actttacaagttttaatttc

SEQ ID NO: 298547 - DNA, 20 bp, Artificial Sequence
  chemically synthesized
gactttacaagttttaattt

SEQ ID NO: 298548 - DNA, 20 bp, Artificial Sequence
  chemically synthesized
ccctgaaattaaaacttgta

SEQ ID NO: 298549 - DNA, 20 bp, Artificial Sequence
  chemically synthesized
cctgtatgatgggactttac

SEQ ID NO: 298550 - DNA, 20 bp, Artificial Sequence
  chemically synthesized
acttgtaaagtcccatcata

SEQ ID NO: 298551 - DNA, 20 bp, Artificial Sequence
  chemically synthesized
cttgtaaagtcccatcatac

SEQ ID NO: 298552 - DNA, 20 bp, Artificial Sequence
  chemically synthesized
acttacttgccctgtatgat

SEQ ID NO: 298553 - DNA, 20 bp, Artificial Sequence
  chemically synthesized
ttgtaaagtcccatcataca

SEQ ID NO: 298554 - DNA, 20 bp, Artificial Sequence
  chemically synthesized
gacttacttgccctgtatga

SEQ ID NO: 298555 - DNA, 20 bp, Artificial Sequence
  chemically synthesized
aaagtcccatcatacagggc

SEQ ID NO: 298556 - DNA, 20 bp, Artificial Sequence
  chemically synthesized
tcccatcatacagggcaagt

SEQ ID NO: 298557 - DNA, 20 bp, Artificial Sequence
  chemically synthesized
gccaagaaaaaaaaaaatca

SEQ ID NO: 298558 - DNA, 20 bp, Artificial Sequence
  chemically synthesized
tctttgatttttttttttct

SEQ ID NO: 298559 - DNA, 20 bp, Artificial Sequence
  chemically synthesized
atttttttttttcttggcaa

SEQ ID NO: 298560 - DNA, 20 bp, Artificial Sequence
  chemically synthesized
tgtagtaatacacttttgcc

SEQ ID NO: 298561 - DNA, 20 bp, Artificial Sequence
  chemically synthesized
caaaagtgtattactacacc

SEQ ID NO: 298562 - DNA, 20 bp, Artificial Sequence
  chemically synthesized
tttgaaaaattgtcttggtg

SEQ ID NO: 298563 - DNA, 20 bp, Artificial Sequence
  chemically synthesized
gtctttttgaaaaattgtct

SEQ ID NO: 298564 - DNA, 20 bp, Artificial Sequence
  chemically synthesized
caccaagacaatttttcaaa

SEQ ID NO: 298565 - DNA, 20 bp, Artificial Sequence
  chemically synthesized
tgaaacttccaaaaaatgga

SEQ ID NO: 298566 - DNA, 20 bp, Artificial Sequence
  chemically synthesized
ttgaaacttccaaaaaatgg

SEQ ID NO: 298567 - DNA, 20 bp, Artificial Sequence
  chemically synthesized
caaaaagaccttccattttt

SEQ ID NO: 298568 - DNA, 20 bp, Artificial Sequence
  chemically synthesized
attttgaaacttccaaaaaa

SEQ ID NO: 298569 - DNA, 20 bp, Artificial Sequence
  chemically synthesized
aaagaccttccattttttgg

SEQ ID NO: 298570 - DNA, 20 bp, Artificial Sequence
  chemically synthesized
tggaagtttcaaaatatcaa

SEQ ID NO: 298571 - DNA, 20 bp, Artificial Sequence
  chemically synthesized
gtttcaaaatatcaaaagcc

SEQ ID NO: 298572 - DNA, 20 bp, Artificial Sequence
  chemically synthesized
tttcaaaatatcaaaagcct

SEQ ID NO: 298573 - DNA, 20 bp, Artificial Sequence
  chemically synthesized
ttcaaaatatcaaaagcctg

SEQ ID NO: 298574 - DNA, 20 bp, Artificial Sequence
  chemically synthesized
atatttggtatatatgcccc

SEQ ID NO: 298575 - DNA, 20 bp, Artificial Sequence
  chemically synthesized
aatatttggtatatatgccc

SEQ ID NO: 298576 - DNA, 20 bp, Artificial Sequence
  chemically synthesized
gggcatatataccaaatatt

SEQ ID NO: 298577 - DNA, 20 bp, Artificial Sequence
  chemically synthesized
attgtcactctctgaatatt

SEQ ID NO: 298578 - DNA, 20 bp, Artificial Sequence
  chemically synthesized
gcatatataccaaatattca

SEQ ID NO: 298579 - DNA, 20 bp, Artificial Sequence
  chemically synthesized
atatataccaaatattcaga

SEQ ID NO: 298580 - DNA, 20 bp, Artificial Sequence
  chemically synthesized
cagagagtgacaatttttct

SEQ ID NO: 298581 - DNA, 20 bp, Artificial Sequence
  chemically synthesized
tgtttgtacaatataatact

SEQ ID NO: 298582 - DNA, 20 bp, Artificial Sequence
  chemically synthesized
tcagtattatattgtacaaa

SEQ ID NO: 298583 - DNA, 20 bp, Artificial Sequence
  chemically synthesized
ttatattgtacaaacagact

SEQ ID NO: 298584 - DNA, 20 bp, Artificial Sequence
  chemically synthesized
aaattcaactggatgaggct

SEQ ID NO: 298585 - DNA, 20 bp, Artificial Sequence
  chemically synthesized
caaacagactcagcctcatc

SEQ ID NO: 298586 - DNA, 20 bp, Artificial Sequence
  chemically synthesized
atgggaaattcaactggatg

SEQ ID NO: 298587 - DNA, 20 bp, Artificial Sequence
  chemically synthesized
tatgggaaattcaactggat

SEQ ID NO: 298588 - DNA, 20 bp, Artificial Sequence
  chemically synthesized
atttttatgggaaattcaac

SEQ ID NO: 298589 - DNA, 20 bp, Artificial Sequence
  chemically synthesized
ctaatttacatcatttttat

SEQ ID NO: 298590 - DNA, 20 bp, Artificial Sequence
  chemically synthesized
cctaatttacatcattttta

SEQ ID NO: 298591 - DNA, 20 bp, Artificial Sequence
  chemically synthesized
cccataaaaatgatgtaaat

SEQ ID NO: 298592 - DNA, 20 bp, Artificial Sequence
  chemically synthesized
ccataaaaatgatgtaaatt

SEQ ID NO: 298593 - DNA, 20 bp, Artificial Sequence
  chemically synthesized
taggttaattacatcccata

SEQ ID NO: 298594 - DNA, 20 bp, Artificial Sequence
  chemically synthesized
tctctcagtatttaccatat

SEQ ID NO: 298595 - DNA, 20 bp, Artificial Sequence
  chemically synthesized
atctctcagtatttaccata

SEQ ID NO: 298596 - DNA, 20 bp, Artificial Sequence
  chemically synthesized
catcccatatggtaaatact

SEQ ID NO: 298597 - DNA, 20 bp, Artificial Sequence
  chemically synthesized
tcccatatggtaaatactga

SEQ ID NO: 298598 - DNA, 20 bp, Artificial Sequence
  chemically synthesized
ttatatacacaggtatctct

SEQ ID NO: 298599 - DNA, 20 bp, Artificial Sequence
  chemically synthesized
ttttaaacatttatatacac

SEQ ID NO: 298600 - DNA, 20 bp, Artificial Sequence
  chemically synthesized
attttaaacatttatataca

SEQ ID NO: 298601 - DNA, 20 bp, Artificial Sequence
  chemically synthesized
aaatgtttaaaataaattca

SEQ ID NO: 298602 - DNA, 20 bp, Artificial Sequence
  chemically synthesized
aatgtttaaaataaattcaa

SEQ ID NO: 298603 - DNA, 20 bp, Artificial Sequence
  chemically synthesized
aaacacatacaaacatctca

SEQ ID NO: 298604 - DNA, 20 bp, Artificial Sequence
  chemically synthesized
atacaaacatctcaaagaac

SEQ ID NO: 298605 - DNA, 20 bp, Artificial Sequence
  chemically synthesized
aaacatttctctagttcttt

SEQ ID NO: 298606 - DNA, 20 bp, Artificial Sequence
  chemically synthesized
acaaacatctcaaagaacta

SEQ ID NO: 298607 - DNA, 20 bp, Artificial Sequence
  chemically synthesized
ttaaatggcaaacatttctc

SEQ ID NO: 298608 - DNA, 20 bp, Artificial Sequence
  chemically synthesized
tagagaaatgtttgccattt

SEQ ID NO: 298609 - DNA, 20 bp, Artificial Sequence
  chemically synthesized
agaaatgtttgccatttaag

SEQ ID NO: 298610 - DNA, 20 bp, Artificial Sequence
  chemically synthesized
aaaattgacaacttcttaaa

SEQ ID NO: 298611 - DNA, 20 bp, Artificial Sequence
  chemically synthesized
tgtcaattttgaattgtcaa

SEQ ID NO: 298612 - DNA, 20 bp, Artificial Sequence
  chemically synthesized
tagtaaaacattacatgaat

SEQ ID NO: 298613 - DNA, 20 bp, Artificial Sequence
  chemically synthesized
acataattagcacagttata

SEQ ID NO: 298614 - DNA, 20 bp, Artificial Sequence
  chemically synthesized
ctcttctgacataattagca

SEQ ID NO: 298615 - DNA, 20 bp, Artificial Sequence
  chemically synthesized
tataactgtgctaattatgt

SEQ ID NO: 298616 - DNA, 20 bp, Artificial Sequence
  chemically synthesized
ggaggctcttctgacataat

SEQ ID NO: 298617 - DNA, 20 bp, Artificial Sequence
  chemically synthesized
aactgtgctaattatgtcag

SEQ ID NO: 298618 - DNA, 20 bp, Artificial Sequence
  chemically synthesized
ctgtgctaattatgtcagaa

SEQ ID NO: 298619 - DNA, 20 bp, Artificial Sequence
  chemically synthesized
atgtcagaagagcctcctga

SEQ ID NO: 298620 - DNA, 20 bp, Artificial Sequence
  chemically synthesized
tgtcagaagagcctcctgat

SEQ ID NO: 298621 - DNA, 20 bp, Artificial Sequence
  chemically synthesized
agaacacagtgcccatcagg

SEQ ID NO: 298622 - DNA, 20 bp, Artificial Sequence
  chemically synthesized
cagaacacagtgcccatcag

SEQ ID NO: 298623 - DNA, 20 bp, Artificial Sequence
  chemically synthesized
aacagaacacagtgcccatc

SEQ ID NO: 298624 - DNA, 20 bp, Artificial Sequence
  chemically synthesized
taacagaacacagtgcccat

SEQ ID NO: 298625 - DNA, 20 bp, Artificial Sequence
  chemically synthesized
taaagaaaattaacagaaca

SEQ ID NO: 298626 - DNA, 20 bp, Artificial Sequence
  chemically synthesized
gtcactgtaaagaaaattaa

SEQ ID NO: 298627 - DNA, 20 bp, Artificial Sequence
  chemically synthesized
tgttctgttaattttcttta

SEQ ID NO: 298628 - DNA, 20 bp, Artificial Sequence
  chemically synthesized
gttatgtggcagtcactgta

SEQ ID NO: 298629 - DNA, 20 bp, Artificial Sequence
  chemically synthesized
tagtttaataggttatgtgg

SEQ ID NO: 298630 - DNA, 20 bp, Artificial Sequence
  chemically synthesized
tcttagtttaataggttatg

SEQ ID NO: 298631 - DNA, 20 bp, Artificial Sequence
  chemically synthesized
atgtgtcatcttagtttaat

SEQ ID NO: 298632 - DNA, 20 bp, Artificial Sequence
  chemically synthesized
gccacataacctattaaact

SEQ ID NO: 298633 - DNA, 20 bp, Artificial Sequence
  chemically synthesized
aatgtgtcatcttagtttaa

SEQ ID NO: 298634 - DNA, 20 bp, Artificial Sequence
  chemically synthesized
tttatgtaaatgtgtcatct

SEQ ID NO: 298635 - DNA, 20 bp, Artificial Sequence
  chemically synthesized
catttacataaattttaatt

SEQ ID NO: 298636 - DNA, 20 bp, Artificial Sequence
  chemically synthesized
agttgcaacttgtatattga

SEQ ID NO: 298637 - DNA, 20 bp, Artificial Sequence
  chemically synthesized
ttcagtcactttcaatatac

SEQ ID NO: 298638 - DNA, 20 bp, Artificial Sequence
  chemically synthesized
tttacacatttgggaatgat

SEQ ID NO: 298639 - DNA, 20 bp, Artificial Sequence
  chemically synthesized
ctctcaaagtttacacattt

SEQ ID NO: 298640 - DNA, 20 bp, Artificial Sequence
  chemically synthesized
actctcaaagtttacacatt

SEQ ID NO: 298641 - DNA, 20 bp, Artificial Sequence
  chemically synthesized
ttcccaaatgtgtaaacttt

SEQ ID NO: 298642 - DNA, 20 bp, Artificial Sequence
  chemically synthesized
cccaaatgtgtaaactttga

SEQ ID NO: 298643 - DNA, 20 bp, Artificial Sequence
  chemically synthesized
aaatgtgtaaactttgagag

SEQ ID NO: 298644 - DNA, 20 bp, Artificial Sequence
  chemically synthesized
ttggaggacttccactctca

SEQ ID NO: 298645 - DNA, 20 bp, Artificial Sequence
  chemically synthesized
tgtgtaaactttgagagtgg

SEQ ID NO: 298646 - DNA, 20 bp, Artificial Sequence
  chemically synthesized
tttgagagtggaagtcctcc

SEQ ID NO: 298647 - DNA, 20 bp, Artificial Sequence
  chemically synthesized
agttaagtctgggagcttgg

SEQ ID NO: 298648 - DNA, 20 bp, Artificial Sequence
  chemically synthesized
tagttaagtctgggagcttg

SEQ ID NO: 298649 - DNA, 20 bp, Artificial Sequence
  chemically synthesized
gtggaagtcctccaagctcc

SEQ ID NO: 298650 - DNA, 20 bp, Artificial Sequence
  chemically synthesized
attagttaagtctgggagct

SEQ ID NO: 298651 - DNA, 20 bp, Artificial Sequence
  chemically synthesized
atcaaattagttaagtctgg

SEQ ID NO: 298652 - DNA, 20 bp, Artificial Sequence
  chemically synthesized
taatcaaattagttaagtct

SEQ ID NO: 298653 - DNA, 20 bp, Artificial Sequence
  chemically synthesized
ctaatcaaattagttaagtc

SEQ ID NO: 298654 - DNA, 20 bp, Artificial Sequence
  chemically synthesized
gttcactaatcaaattagtt

SEQ ID NO: 298655 - DNA, 20 bp, Artificial Sequence
  chemically synthesized
ccagacttaactaatttgat

SEQ ID NO: 298656 - DNA, 20 bp, Artificial Sequence
  chemically synthesized
acctagttcactaatcaaat

SEQ ID NO: 298657 - DNA, 20 bp, Artificial Sequence
  chemically synthesized
aactaatttgattagtgaac

SEQ ID NO: 298658 - DNA, 20 bp, Artificial Sequence
  chemically synthesized
actaatttgattagtgaact

SEQ ID NO: 298659 - DNA, 20 bp, Artificial Sequence
  chemically synthesized
aaaatggccattcataaacc

SEQ ID NO: 298660 - DNA, 20 bp, Artificial Sequence
  chemically synthesized
tagtgaactaggtttatgaa

SEQ ID NO: 298661 - DNA, 20 bp, Artificial Sequence
  chemically synthesized
agatgtttaaatatgtaaaa

SEQ ID NO: 298662 - DNA, 20 bp, Artificial Sequence
  chemically synthesized
ttttacatatttaaacatct

SEQ ID NO: 298663 - DNA, 20 bp, Artificial Sequence
  chemically synthesized
tatttaaacatcttagcatg

SEQ ID NO: 298664 - DNA, 20 bp, Artificial Sequence
  chemically synthesized
tttatgaaattctacatgct

SEQ ID NO: 298665 - DNA, 20 bp, Artificial Sequence
  chemically synthesized
agaatttcataaaaacttat

SEQ ID NO: 298666 - DNA, 20 bp, Artificial Sequence
  chemically synthesized
tttctaaggatgaggcttat

SEQ ID NO: 298667 - DNA, 20 bp, Artificial Sequence
  chemically synthesized
aaacttataagcctcatcct

SEQ ID NO: 298668 - DNA, 20 bp, Artificial Sequence
  chemically synthesized
ctttcaggtttctaaggatg

SEQ ID NO: 298669 - DNA, 20 bp, Artificial Sequence
  chemically synthesized
cctttcaggtttctaaggat

SEQ ID NO: 298670 - DNA, 20 bp, Artificial Sequence
  chemically synthesized
attttcctttcaggtttcta

SEQ ID NO: 298671 - DNA, 20 bp, Artificial Sequence
  chemically synthesized
cattttcctttcaggtttct

SEQ ID NO: 298672 - DNA, 20 bp, Artificial Sequence
  chemically synthesized
cctcatccttagaaacctga

SEQ ID NO: 298673 - DNA, 20 bp, Artificial Sequence
  chemically synthesized
ctcatccttagaaacctgaa

SEQ ID NO: 298674 - DNA, 20 bp, Artificial Sequence
  chemically synthesized
ggcatcagcattttcctttc

SEQ ID NO: 298675 - DNA, 20 bp, Artificial Sequence
  chemically synthesized
aggcatcagcattttccttt

SEQ ID NO: 298676 - DNA, 20 bp, Artificial Sequence
  chemically synthesized
ttaacgtatttcacaggcat

SEQ ID NO: 298677 - DNA, 20 bp, Artificial Sequence
  chemically synthesized
caatggttaacgtatttcac

SEQ ID NO: 298678 - DNA, 20 bp, Artificial Sequence
  chemically synthesized
gcaatggttaacgtatttca

SEQ ID NO: 298679 - DNA, 20 bp, Artificial Sequence
  chemically synthesized
gtgaaatacgttaaccattg

SEQ ID NO: 298680 - DNA, 20 bp, Artificial Sequence
  chemically synthesized
tgaaatacgttaaccattgc

SEQ ID NO: 298681 - DNA, 20 bp, Artificial Sequence
  chemically synthesized
gaaatacgttaaccattgca

SEQ ID NO: 298682 - DNA, 20 bp, Artificial Sequence
  chemically synthesized
agagccctgggaccctgcaa

SEQ ID NO: 298683 - DNA, 20 bp, Artificial Sequence
  chemically synthesized
cgttaaccattgcagggtcc

SEQ ID NO: 298684 - DNA, 20 bp, Artificial Sequence
  chemically synthesized
gttaaccattgcagggtccc

SEQ ID NO: 298685 - DNA, 20 bp, Artificial Sequence
  chemically synthesized
ttaaccattgcagggtccca

SEQ ID NO: 298686 - DNA, 20 bp, Artificial Sequence
  chemically synthesized
attgcagggtcccagggctc

SEQ ID NO: 298687 - DNA, 20 bp, Artificial Sequence
  chemically synthesized
tggtctaggcctagagccct

SEQ ID NO: 298688 - DNA, 20 bp, Artificial Sequence
  chemically synthesized
ttgcagggtcccagggctct

SEQ ID NO: 298689 - DNA, 20 bp, Artificial Sequence
  chemically synthesized
ctggtctaggcctagagccc

SEQ ID NO: 298690 - DNA, 20 bp, Artificial Sequence
  chemically synthesized
gggtcccagggctctaggcc

SEQ ID NO: 298691 - DNA, 20 bp, Artificial Sequence
  chemically synthesized
aattatctggtctaggccta

SEQ ID NO: 298692 - DNA, 20 bp, Artificial Sequence
  chemically synthesized
taaattatctggtctaggcc

SEQ ID NO: 298693 - DNA, 20 bp, Artificial Sequence
  chemically synthesized
ccagggctctaggcctagac

SEQ ID NO: 298694 - DNA, 20 bp, Artificial Sequence
  chemically synthesized
tttcataaattatctggtct

SEQ ID NO: 298695 - DNA, 20 bp, Artificial Sequence
  chemically synthesized
gtttcataaattatctggtc

SEQ ID NO: 298696 - DNA, 20 bp, Artificial Sequence
  chemically synthesized
aattggtttcataaattatc

SEQ ID NO: 298697 - DNA, 20 bp, Artificial Sequence
  chemically synthesized
ttaaaatgttcattaagaat

SEQ ID NO: 298698 - DNA, 20 bp, Artificial Sequence
  chemically synthesized
agctaattaaaatgttcatt

SEQ ID NO: 298699 - DNA, 20 bp, Artificial Sequence
  chemically synthesized
ttcttaatgaacattttaat

SEQ ID NO: 298700 - DNA, 20 bp, Artificial Sequence
  chemically synthesized
taatgaacattttaattagc

SEQ ID NO: 298701 - DNA, 20 bp, Artificial Sequence
  chemically synthesized
aatgaacattttaattagct

SEQ ID NO: 298702 - DNA, 20 bp, Artificial Sequence
  chemically synthesized
gaacattttaattagctagg

SEQ ID NO: 298703 - DNA, 20 bp, Artificial Sequence
  chemically synthesized
attttaattagctaggaagc

SEQ ID NO: 298704 - DNA, 20 bp, Artificial Sequence
  chemically synthesized
taatgttaaaacttgcttcc

SEQ ID NO: 298705 - DNA, 20 bp, Artificial Sequence
  chemically synthesized
gaagcaagttttaacattaa

SEQ ID NO: 298706 - DNA, 20 bp, Artificial Sequence
  chemically synthesized
aagcaagttttaacattaat

SEQ ID NO: 298707 - DNA, 20 bp, Artificial Sequence
  chemically synthesized
ataccaacaaagaataatta

SEQ ID NO: 298708 - DNA, 20 bp, Artificial Sequence
  chemically synthesized
aaactataattattctttgt

SEQ ID NO: 298709 - DNA, 20 bp, Artificial Sequence
  chemically synthesized
tttcttctttaataccaaca

SEQ ID NO: 298710 - DNA, 20 bp, Artificial Sequence
  chemically synthesized
attattctttgttggtatta

SEQ ID NO: 298711 - DNA, 20 bp, Artificial Sequence
  chemically synthesized
attctttgttggtattaaag

SEQ ID NO: 298712 - DNA, 20 bp, Artificial Sequence
  chemically synthesized
tattaaagaagaaataattt

SEQ ID NO: 298713 - DNA, 20 bp, Artificial Sequence
  chemically synthesized
ttaaagaagaaataattttg

SEQ ID NO: 298714 - DNA, 20 bp, Artificial Sequence
  chemically synthesized
taaagaagaaataattttgg

SEQ ID NO: 298715 - DNA, 20 bp, Artificial Sequence
  chemically synthesized
gaagaaataattttggaggt

SEQ ID NO: 298716 - DNA, 20 bp, Artificial Sequence
  chemically synthesized
ttttaaaaatacagcaaagt

SEQ ID NO: 298717 - DNA, 20 bp, Artificial Sequence
  chemically synthesized
tgatttttaaaaatacagca

SEQ ID NO: 298718 - DNA, 20 bp, Artificial Sequence
  chemically synthesized
aaaggtgatttttaaaaata

SEQ ID NO: 298719 - DNA, 20 bp, Artificial Sequence
  chemically synthesized
cggaaaactctgaagaagaa

SEQ ID NO: 298720 - DNA, 20 bp, Artificial Sequence
  chemically synthesized
taaaaatcacctttcttctt

SEQ ID NO: 298721 - DNA, 20 bp, Artificial Sequence
  chemically synthesized
tcggaaaactctgaagaaga

SEQ ID NO: 298722 - DNA, 20 bp, Artificial Sequence
  chemically synthesized
aaaatcacctttcttcttca

SEQ ID NO: 298723 - DNA, 20 bp, Artificial Sequence
  chemically synthesized
cacttcggaaaactctgaag

SEQ ID NO: 298724 - DNA, 20 bp, Artificial Sequence
  chemically synthesized
tctcacttcggaaaactctg

SEQ ID NO: 298725 - DNA, 20 bp, Artificial Sequence
  chemically synthesized
ttcttcttcagagttttccg

SEQ ID NO: 298726 - DNA, 20 bp, Artificial Sequence
  chemically synthesized
tcttcagagttttccgaagt

SEQ ID NO: 298727 - DNA, 20 bp, Artificial Sequence
  chemically synthesized
tcagagttttccgaagtgag

SEQ ID NO: 298728 - DNA, 20 bp, Artificial Sequence
  chemically synthesized
attaaaatgtcttctcactt

SEQ ID NO: 298729 - DNA, 20 bp, Artificial Sequence
  chemically synthesized
aaagtgcctgtatagtaata

SEQ ID NO: 298730 - DNA, 20 bp, Artificial Sequence
  chemically synthesized
tttaattccatattactata

SEQ ID NO: 298731 - DNA, 20 bp, Artificial Sequence
  chemically synthesized
ttaattccatattactatac

SEQ ID NO: 298732 - DNA, 20 bp, Artificial Sequence
  chemically synthesized
gggtcaggaaagtgcctgta

SEQ ID NO: 298733 - DNA, 20 bp, Artificial Sequence
  chemically synthesized
ttggggatttagggtcagga

SEQ ID NO: 298734 - DNA, 20 bp, Artificial Sequence
  chemically synthesized
atggttggggatttagggtc

SEQ ID NO: 298735 - DNA, 20 bp, Artificial Sequence
  chemically synthesized
aatggttggggatttagggt

SEQ ID NO: 298736 - DNA, 20 bp, Artificial Sequence
  chemically synthesized
ttcaaatggttggggattta

SEQ ID NO: 298737 - DNA, 20 bp, Artificial Sequence
  chemically synthesized
cttcaaatggttggggattt

SEQ ID NO: 298738 - DNA, 20 bp, Artificial Sequence
  chemically synthesized
tcttcaaatggttggggatt

SEQ ID NO: 298739 - DNA, 20 bp, Artificial Sequence
  chemically synthesized
aggtcatcttcaaatggttg

SEQ ID NO: 298740 - DNA, 20 bp, Artificial Sequence
  chemically synthesized
taggtcatcttcaaatggtt

SEQ ID NO: 298741 - DNA, 20 bp, Artificial Sequence
  chemically synthesized
gtaggtcatcttcaaatggt

SEQ ID NO: 298742 - DNA, 20 bp, Artificial Sequence
  chemically synthesized
cctaaatccccaaccatttg

SEQ ID NO: 298743 - DNA, 20 bp, Artificial Sequence
  chemically synthesized
aatagtaggtcatcttcaaa

SEQ ID NO: 298744 - DNA, 20 bp, Artificial Sequence
  chemically synthesized
agccttggaagatgaatagt

SEQ ID NO: 298745 - DNA, 20 bp, Artificial Sequence
  chemically synthesized
gagccttggaagatgaatag

SEQ ID NO: 298746 - DNA, 20 bp, Artificial Sequence
  chemically synthesized
actgagccttggaagatgaa

SEQ ID NO: 298747 - DNA, 20 bp, Artificial Sequence
  chemically synthesized
tgacctactattcatcttcc

SEQ ID NO: 298748 - DNA, 20 bp, Artificial Sequence
  chemically synthesized
gacctactattcatcttcca

SEQ ID NO: 298749 - DNA, 20 bp, Artificial Sequence
  chemically synthesized
catcttgaactgagccttgg

SEQ ID NO: 298750 - DNA, 20 bp, Artificial Sequence
  chemically synthesized
actattcatcttccaaggct

SEQ ID NO: 298751 - DNA, 20 bp, Artificial Sequence
  chemically synthesized
gtgcatcttgaactgagcct

SEQ ID NO: 298752 - DNA, 20 bp, Artificial Sequence
  chemically synthesized
catcttccaaggctcagttc

SEQ ID NO: 298753 - DNA, 20 bp, Artificial Sequence
  chemically synthesized
gatgatgtgcatcttgaact

SEQ ID NO: 298754 - DNA, 20 bp, Artificial Sequence
  chemically synthesized
caagatgcacatcatctgtg

SEQ ID NO: 298755 - DNA, 20 bp, Artificial Sequence
  chemically synthesized
aagatgcacatcatctgtga

SEQ ID NO: 298756 - DNA, 20 bp, Artificial Sequence
  chemically synthesized
gttgatcaagaaaaccttca

SEQ ID NO: 298757 - DNA, 20 bp, Artificial Sequence
  chemically synthesized
agagtagagagaggttgatc

SEQ ID NO: 298758 - DNA, 20 bp, Artificial Sequence
  chemically synthesized
gaaaggggaagagtagagag

SEQ ID NO: 298759 - DNA, 20 bp, Artificial Sequence
  chemically synthesized
tgaaaggggaagagtagaga

SEQ ID NO: 298760 - DNA, 20 bp, Artificial Sequence
  chemically synthesized
gttgaaaggggaagagtaga

SEQ ID NO: 298761 - DNA, 20 bp, Artificial Sequence
  chemically synthesized
aagttgaaaggggaagagta

SEQ ID NO: 298762 - DNA, 20 bp, Artificial Sequence
  chemically synthesized
gaaagttgaaaggggaagag

SEQ ID NO: 298763 - DNA, 20 bp, Artificial Sequence
  chemically synthesized
aaggaaagttgaaaggggaa

SEQ ID NO: 298764 - DNA, 20 bp, Artificial Sequence
  chemically synthesized
agaaggaaagttgaaagggg

SEQ ID NO: 298765 - DNA, 20 bp, Artificial Sequence
  chemically synthesized
cccagaaggaaagttgaaag

SEQ ID NO: 298766 - DNA, 20 bp, Artificial Sequence
  chemically synthesized
tcccagaaggaaagttgaaa

SEQ ID NO: 298767 - DNA, 20 bp, Artificial Sequence
  chemically synthesized
ttcccagaaggaaagttgaa

SEQ ID NO: 298768 - DNA, 20 bp, Artificial Sequence
  chemically synthesized
tttcccagaaggaaagttga

SEQ ID NO: 298769 - DNA, 20 bp, Artificial Sequence
  chemically synthesized
tcccctttcaactttccttc

SEQ ID NO: 298770 - DNA, 20 bp, Artificial Sequence
  chemically synthesized
cccctttcaactttccttct

SEQ ID NO: 298771 - DNA, 20 bp, Artificial Sequence
  chemically synthesized
gacaagttttcccagaagga

SEQ ID NO: 298772 - DNA, 20 bp, Artificial Sequence
  chemically synthesized
gagggacaagttttcccaga

SEQ ID NO: 298773 - DNA, 20 bp, Artificial Sequence
  chemically synthesized
agagggacaagttttcccag

SEQ ID NO: 298774 - DNA, 20 bp, Artificial Sequence
  chemically synthesized
cagagagggacaagttttcc

SEQ ID NO: 298775 - DNA, 20 bp, Artificial Sequence
  chemically synthesized
ggaaacaagcagagagggac

SEQ ID NO: 298776 - DNA, 20 bp, Artificial Sequence
  chemically synthesized
catgtggaaacaagcagaga

SEQ ID NO: 298777 - DNA, 20 bp, Artificial Sequence
  chemically synthesized
ccatgtggaaacaagcagag

SEQ ID NO: 298778 - DNA, 20 bp, Artificial Sequence
  chemically synthesized
gccatgtggaaacaagcaga

SEQ ID NO: 298779 - DNA, 20 bp, Artificial Sequence
  chemically synthesized
atgccatgtggaaacaagca

SEQ ID NO: 298780 - DNA, 20 bp, Artificial Sequence
  chemically synthesized
aaatgccatgtggaaacaag

SEQ ID NO: 298781 - DNA, 20 bp, Artificial Sequence
  chemically synthesized
agcaaatgccatgtggaaac

SEQ ID NO: 298782 - DNA, 20 bp, Artificial Sequence
  chemically synthesized
cctctctgcttgtttccaca

SEQ ID NO: 298783 - DNA, 20 bp, Artificial Sequence
  chemically synthesized
tttttaaagcaaatgccatg

SEQ ID NO: 298784 - DNA, 20 bp, Artificial Sequence
  chemically synthesized
tattactcgattttttttta

SEQ ID NO: 298785 - DNA, 20 bp, Artificial Sequence
  chemically synthesized
atttgctttaaaaaaaaatc

SEQ ID NO: 298786 - DNA, 20 bp, Artificial Sequence
  chemically synthesized
tttaaaaaaaaatcgagtaa

SEQ ID NO: 298787 - DNA, 20 bp, Artificial Sequence
  chemically synthesized
caaattcaatttgcatcaaa

SEQ ID NO: 298788 - DNA, 20 bp, Artificial Sequence
  chemically synthesized
atttcatttgatatttttat

SEQ ID NO: 298789 - DNA, 20 bp, Artificial Sequence
  chemically synthesized
taaaaatatcaaatgaaatt

SEQ ID NO: 298790 - DNA, 20 bp, Artificial Sequence
  chemically synthesized
aaattcagtataaatcctat

SEQ ID NO: 298791 - DNA, 20 bp, Artificial Sequence
  chemically synthesized
aaaatatttttagaactaat

SEQ ID NO: 298792 - DNA, 20 bp, Artificial Sequence
  chemically synthesized
aaaaatatttttagaactaa

SEQ ID NO: 298793 - DNA, 20 bp, Artificial Sequence
  chemically synthesized
caaagtcctaaaaatatttt

SEQ ID NO: 298794 - DNA, 20 bp, Artificial Sequence
  chemically synthesized
attagttctaaaaatatttt

SEQ ID NO: 298795 - DNA, 20 bp, Artificial Sequence
  chemically synthesized
ttagttctaaaaatattttt

SEQ ID NO: 298796 - DNA, 20 bp, Artificial Sequence
  chemically synthesized
aaaaatatttttaggacttt

SEQ ID NO: 298797 - DNA, 20 bp, Artificial Sequence
  chemically synthesized
catgtagtcaatgcatctca

SEQ ID NO: 298798 - DNA, 20 bp, Artificial Sequence
  chemically synthesized
tttgagatgcattgactaca

SEQ ID NO: 298799 - DNA, 20 bp, Artificial Sequence
  chemically synthesized
aaaatataataattgccatg

SEQ ID NO: 298800 - DNA, 20 bp, Artificial Sequence
  chemically synthesized
catggcaattattatatttt

SEQ ID NO: 298801 - DNA, 20 bp, Artificial Sequence
  chemically synthesized
ttattatatttttggaatta

SEQ ID NO: 298802 - DNA, 20 bp, Artificial Sequence
  chemically synthesized
ggaattacagaatattatta

SEQ ID NO: 298803 - DNA, 20 bp, Artificial Sequence
  chemically synthesized
gaattacagaatattattaa

SEQ ID NO: 298804 - DNA, 20 bp, Artificial Sequence
  chemically synthesized
aattacagaatattattaaa

SEQ ID NO: 298805 - DNA, 20 bp, Artificial Sequence
  chemically synthesized
attacagaatattattaaag

SEQ ID NO: 298806 - DNA, 20 bp, Artificial Sequence
  chemically synthesized
ttgttttcttttggttaaat

SEQ ID NO: 298807 - DNA, 20 bp, Artificial Sequence
  chemically synthesized
cttgttttcttttggttaaa

SEQ ID NO: 298808 - DNA, 20 bp, Artificial Sequence
  chemically synthesized
gggaaatcctatttaaccaa

SEQ ID NO: 298809 - DNA, 20 bp, Artificial Sequence
  chemically synthesized
aatattagcttgttttcttt

SEQ ID NO: 298810 - DNA, 20 bp, Artificial Sequence
  chemically synthesized
ctatttaaccaaaagaaaac

SEQ ID NO: 298811 - DNA, 20 bp, Artificial Sequence
  chemically synthesized
aaagaaaacaagctaatatt

SEQ ID NO: 298812 - DNA, 20 bp, Artificial Sequence
  chemically synthesized
ggaactatttatctaaatat

SEQ ID NO: 298813 - DNA, 20 bp, Artificial Sequence
  chemically synthesized
caagctaatatttagataaa

SEQ ID NO: 298814 - DNA, 20 bp, Artificial Sequence
  chemically synthesized
aaactatcttgatttggaga

SEQ ID NO: 298815 - DNA, 20 bp, Artificial Sequence
  chemically synthesized
caaactatcttgatttggag

SEQ ID NO: 298816 - DNA, 20 bp, Artificial Sequence
  chemically synthesized
acaaactatcttgatttgga

SEQ ID NO: 298817 - DNA, 20 bp, Artificial Sequence
  chemically synthesized
aatagttccctctccaaatc

SEQ ID NO: 298818 - DNA, 20 bp, Artificial Sequence
  chemically synthesized
atacaaactatcttgatttg

SEQ ID NO: 298819 - DNA, 20 bp, Artificial Sequence
  chemically synthesized
gtatacaaactatcttgatt

SEQ ID NO: 298820 - DNA, 20 bp, Artificial Sequence
  chemically synthesized
gttccctctccaaatcaaga

SEQ ID NO: 298821 - DNA, 20 bp, Artificial Sequence
  chemically synthesized
acaacacatacacgtttgta

SEQ ID NO: 298822 - DNA, 20 bp, Artificial Sequence
  chemically synthesized
catacacgtttgtatagtgt

SEQ ID NO: 298823 - DNA, 20 bp, Artificial Sequence
  chemically synthesized
tgtaagtgtgtctccctctg

SEQ ID NO: 298824 - DNA, 20 bp, Artificial Sequence
  chemically synthesized
cttccccccttccacagagg

SEQ ID NO: 298825 - DNA, 20 bp, Artificial Sequence
  chemically synthesized
aagtgtgtctccctctgtgg

SEQ ID NO: 298826 - DNA, 20 bp, Artificial Sequence
  chemically synthesized
atcttccccccttccacaga

SEQ ID NO: 298827 - DNA, 20 bp, Artificial Sequence
  chemically synthesized
agtgtgtctccctctgtgga

SEQ ID NO: 298828 - DNA, 20 bp, Artificial Sequence
  chemically synthesized
tatcttccccccttccacag

SEQ ID NO: 298829 - DNA, 20 bp, Artificial Sequence
  chemically synthesized
gtgtgtctccctctgtggaa

SEQ ID NO: 298830 - DNA, 20 bp, Artificial Sequence
  chemically synthesized
ctatcttccccccttccaca

SEQ ID NO: 298831 - DNA, 20 bp, Artificial Sequence
  chemically synthesized
tgtgtctccctctgtggaag

SEQ ID NO: 298832 - DNA, 20 bp, Artificial Sequence
  chemically synthesized
gtgtctccctctgtggaagg

SEQ ID NO: 298833 - DNA, 20 bp, Artificial Sequence
  chemically synthesized
ccctatcttccccccttcca

SEQ ID NO: 298834 - DNA, 20 bp, Artificial Sequence
  chemically synthesized
tgtctccctctgtggaaggg

SEQ ID NO: 298835 - DNA, 20 bp, Artificial Sequence
  chemically synthesized
ctccctctgtggaagggggg

SEQ ID NO: 298836 - DNA, 20 bp, Artificial Sequence
  chemically synthesized
ctctgtggaaggggggaaga

SEQ ID NO: 298837 - DNA, 20 bp, Artificial Sequence
  chemically synthesized
tctgtggaaggggggaagat

SEQ ID NO: 298838 - DNA, 20 bp, Artificial Sequence
  chemically synthesized
ctgtggaaggggggaagata

SEQ ID NO: 298839 - DNA, 20 bp, Artificial Sequence
  chemically synthesized
caaaatacaagacaatcatg

SEQ ID NO: 298840 - DNA, 20 bp, Artificial Sequence
  chemically synthesized
tcacacatattacaaaatac

SEQ ID NO: 298841 - DNA, 20 bp, Artificial Sequence
  chemically synthesized
gtgtgtttgtgtgtatgttt

SEQ ID NO: 298842 - DNA, 20 bp, Artificial Sequence
  chemically synthesized
gcacatttactttacattta

SEQ ID NO: 298843 - DNA, 20 bp, Artificial Sequence
  chemically synthesized
tttaagttgctttaaatgta

SEQ ID NO: 298844 - DNA, 20 bp, Artificial Sequence
  chemically synthesized
tgtgcatttaaaaatatact

SEQ ID NO: 298845 - DNA, 20 bp, Artificial Sequence
  chemically synthesized
atttaaaaatatactgagct

SEQ ID NO: 298846 - DNA, 20 bp, Artificial Sequence
  chemically synthesized
tttaaaaatatactgagctg

SEQ ID NO: 298847 - DNA, 20 bp, Artificial Sequence
  chemically synthesized
ttaaaaatatactgagctga

SEQ ID NO: 298848 - DNA, 20 bp, Artificial Sequence
  chemically synthesized
gccacgcctggccctcagct

SEQ ID NO: 298849 - DNA, 20 bp, Artificial Sequence
  chemically synthesized
aaatatactgagctgagggc

SEQ ID NO: 298850 - DNA, 20 bp, Artificial Sequence
  chemically synthesized
aatatactgagctgagggcc

SEQ ID NO: 298851 - DNA, 20 bp, Artificial Sequence
  chemically synthesized
gagccgccacgcctggccct

SEQ ID NO: 298852 - DNA, 20 bp, Artificial Sequence
  chemically synthesized
actgagctgagggccaggcg

SEQ ID NO: 298853 - DNA, 20 bp, Artificial Sequence
  chemically synthesized
gagctgagggccaggcgtgg

SEQ ID NO: 298854 - DNA, 20 bp, Artificial Sequence
  chemically synthesized
caggcatgagccgccacgcc

SEQ ID NO: 298855 - DNA, 20 bp, Artificial Sequence
  chemically synthesized
agtgctggaattacaggcat

SEQ ID NO: 298856 - DNA, 20 bp, Artificial Sequence
  chemically synthesized
gcggctcatgcctgtaattc

SEQ ID NO: 298857 - DNA, 20 bp, Artificial Sequence
  chemically synthesized
tctcaaagtgctggaattac

SEQ ID NO: 298858 - DNA, 20 bp, Artificial Sequence
  chemically synthesized
ctctcaaagtgctggaatta

SEQ ID NO: 298859 - DNA, 20 bp, Artificial Sequence
  chemically synthesized
gcctgtaattccagcacttt

SEQ ID NO: 298860 - DNA, 20 bp, Artificial Sequence
  chemically synthesized
gcctcggcctctcaaagtgc

SEQ ID NO: 298861 - DNA, 20 bp, Artificial Sequence
  chemically synthesized
ctgtaattccagcactttga

SEQ ID NO: 298862 - DNA, 20 bp, Artificial Sequence
  chemically synthesized
tgtaattccagcactttgag

SEQ ID NO: 298863 - DNA, 20 bp, Artificial Sequence
  chemically synthesized
ctgcccgcctcggcctctca

SEQ ID NO: 298864 - DNA, 20 bp, Artificial Sequence
  chemically synthesized
ttccagcactttgagaggcc

SEQ ID NO: 298865 - DNA, 20 bp, Artificial Sequence
  chemically synthesized
tccagcactttgagaggccg

SEQ ID NO: 298866 - DNA, 20 bp, Artificial Sequence
  chemically synthesized
agcactttgagaggccgagg

SEQ ID NO: 298867 - DNA, 20 bp, Artificial Sequence
  chemically synthesized
gcactttgagaggccgaggc

SEQ ID NO: 298868 - DNA, 20 bp, Artificial Sequence
  chemically synthesized
ctttgagaggccgaggcggg

SEQ ID NO: 298869 - DNA, 20 bp, Artificial Sequence
  chemically synthesized
ctcaagtgaactgcccgcct

SEQ ID NO: 298870 - DNA, 20 bp, Artificial Sequence
  chemically synthesized
ccgaggcgggcagttcactt

SEQ ID NO: 298871 - DNA, 20 bp, Artificial Sequence
  chemically synthesized
cgaggcgggcagttcacttg

SEQ ID NO: 298872 - DNA, 20 bp, Artificial Sequence
  chemically synthesized
gcgggcagttcacttgaggt

SEQ ID NO: 298873 - DNA, 20 bp, Artificial Sequence
  chemically synthesized
cgggcagttcacttgaggtc

SEQ ID NO: 298874 - DNA, 20 bp, Artificial Sequence
  chemically synthesized
ggtcctgaactcctgacctc

SEQ ID NO: 298875 - DNA, 20 bp, Artificial Sequence
  chemically synthesized
ggcagttcacttgaggtcag

SEQ ID NO: 298876 - DNA, 20 bp, Artificial Sequence
  chemically synthesized
ttcacttgaggtcaggagtt

SEQ ID NO: 298877 - DNA, 20 bp, Artificial Sequence
  chemically synthesized
tcacttgaggtcaggagttc

SEQ ID NO: 298878 - DNA, 20 bp, Artificial Sequence
  chemically synthesized
tcaggagttcaggaccaacc

SEQ ID NO: 298879 - DNA, 20 bp, Artificial Sequence
  chemically synthesized
tttcgtcatggtggccaggt

SEQ ID NO: 298880 - DNA, 20 bp, Artificial Sequence
  chemically synthesized
ggggtttcgtcatggtggcc

SEQ ID NO: 298881 - DNA, 20 bp, Artificial Sequence
  chemically synthesized
cggggtttcgtcatggtggc

SEQ ID NO: 298882 - DNA, 20 bp, Artificial Sequence
  chemically synthesized
gagacggggtttcgtcatgg

SEQ ID NO: 298883 - DNA, 20 bp, Artificial Sequence
  chemically synthesized
gtagagacggggtttcgtca

SEQ ID NO: 298884 - DNA, 20 bp, Artificial Sequence
  chemically synthesized
ttgtatttttagtagagacg

SEQ ID NO: 298885 - DNA, 20 bp, Artificial Sequence
  chemically synthesized
tttgtatttttagtagagac

SEQ ID NO: 298886 - DNA, 20 bp, Artificial Sequence
  chemically synthesized
ttttgtatttttagtagaga

SEQ ID NO: 298887 - DNA, 20 bp, Artificial Sequence
  chemically synthesized
taatttttgtatttttagta

SEQ ID NO: 298888 - DNA, 20 bp, Artificial Sequence
  chemically synthesized
gctaatttttgtatttttag

SEQ ID NO: 298889 - DNA, 20 bp, Artificial Sequence
  chemically synthesized
ctggctaatttttgtatttt

SEQ ID NO: 298890 - DNA, 20 bp, Artificial Sequence
  chemically synthesized
tctactaaaaatacaaaaat

SEQ ID NO: 298891 - DNA, 20 bp, Artificial Sequence
  chemically synthesized
ctaaaaatacaaaaattagc

SEQ ID NO: 298892 - DNA, 20 bp, Artificial Sequence
  chemically synthesized
atacaaaaattagccagctg

SEQ ID NO: 298893 - DNA, 20 bp, Artificial Sequence
  chemically synthesized
caaaaattagccagctgtgg

SEQ ID NO: 298894 - DNA, 20 bp, Artificial Sequence
  chemically synthesized
caggtgcccaccaccacagc

SEQ ID NO: 298895 - DNA, 20 bp, Artificial Sequence
  chemically synthesized
aaattagccagctgtggtgg

SEQ ID NO: 298896 - DNA, 20 bp, Artificial Sequence
  chemically synthesized
aattagccagctgtggtggt

SEQ ID NO: 298897 - DNA, 20 bp, Artificial Sequence
  chemically synthesized
attacaggtgcccaccacca

SEQ ID NO: 298898 - DNA, 20 bp, Artificial Sequence
  chemically synthesized
gtggtgggcacctgtaatcc

SEQ ID NO: 298899 - DNA, 20 bp, Artificial Sequence
  chemically synthesized
tcccgagtagctgggattac

SEQ ID NO: 298900 - DNA, 20 bp, Artificial Sequence
  chemically synthesized
ctcccgagtagctgggatta

SEQ ID NO: 298901 - DNA, 20 bp, Artificial Sequence
  chemically synthesized
cacctgtaatcccagctact

SEQ ID NO: 298902 - DNA, 20 bp, Artificial Sequence
  chemically synthesized
cctcagcctcccgagtagct

SEQ ID NO: 298903 - DNA, 20 bp, Artificial Sequence
  chemically synthesized
acctgtaatcccagctactc

SEQ ID NO: 298904 - DNA, 20 bp, Artificial Sequence
  chemically synthesized
gcctcagcctcccgagtagc

SEQ ID NO: 298905 - DNA, 20 bp, Artificial Sequence
  chemically synthesized
ctgtaatcccagctactcgg

SEQ ID NO: 298906 - DNA, 20 bp, Artificial Sequence
  chemically synthesized
tgtaatcccagctactcggg

SEQ ID NO: 298907 - DNA, 20 bp, Artificial Sequence
  chemically synthesized
tcctgcctcagcctcccgag

SEQ ID NO: 298908 - DNA, 20 bp, Artificial Sequence
  chemically synthesized
ttctcctgcctcagcctccc

SEQ ID NO: 298909 - DNA, 20 bp, Artificial Sequence
  chemically synthesized
tcccagctactcgggaggct

SEQ ID NO: 298910 - DNA, 20 bp, Artificial Sequence
  chemically synthesized
cccagctactcgggaggctg

SEQ ID NO: 298911 - DNA, 20 bp, Artificial Sequence
  chemically synthesized
agctactcgggaggctgagg

SEQ ID NO: 298912 - DNA, 20 bp, Artificial Sequence
  chemically synthesized
gctactcgggaggctgaggc

SEQ ID NO: 298913 - DNA, 20 bp, Artificial Sequence
  chemically synthesized
tactcgggaggctgaggcag

SEQ ID NO: 298914 - DNA, 20 bp, Artificial Sequence
  chemically synthesized
ttcaagcaattctcctgcct

SEQ ID NO: 298915 - DNA, 20 bp, Artificial Sequence
  chemically synthesized
ggcaggagaattgcttgaac

SEQ ID NO: 298916 - DNA, 20 bp, Artificial Sequence
  chemically synthesized
gcaggagaattgcttgaacc

SEQ ID NO: 298917 - DNA, 20 bp, Artificial Sequence
  chemically synthesized
caggagaattgcttgaacca

SEQ ID NO: 298918 - DNA, 20 bp, Artificial Sequence
  chemically synthesized
aacttctgcctccctggttc

SEQ ID NO: 298919 - DNA, 20 bp, Artificial Sequence
  chemically synthesized
ggagaattgcttgaaccagg

SEQ ID NO: 298920 - DNA, 20 bp, Artificial Sequence
  chemically synthesized
gagaattgcttgaaccaggg

SEQ ID NO: 298921 - DNA, 20 bp, Artificial Sequence
  chemically synthesized
aattgcttgaaccagggagg

SEQ ID NO: 298922 - DNA, 20 bp, Artificial Sequence
  chemically synthesized
cactgcaacttctgcctccc

SEQ ID NO: 298923 - DNA, 20 bp, Artificial Sequence
  chemically synthesized
tgcttgaaccagggaggcag

SEQ ID NO: 298924 - DNA, 20 bp, Artificial Sequence
  chemically synthesized
aaccagggaggcagaagttg

SEQ ID NO: 298925 - DNA, 20 bp, Artificial Sequence
  chemically synthesized
agggaggcagaagttgcagt

SEQ ID NO: 298926 - DNA, 20 bp, Artificial Sequence
  chemically synthesized
ggcagaagttgcagtgagcc

SEQ ID NO: 298927 - DNA, 20 bp, Artificial Sequence
  chemically synthesized
ggaatgtagtggcacaatct

SEQ ID NO: 298928 - DNA, 20 bp, Artificial Sequence
  chemically synthesized
ttgcccaggctggaatgtag

SEQ ID NO: 298929 - DNA, 20 bp, Artificial Sequence
  chemically synthesized
aagattgtgccactacattc

SEQ ID NO: 298930 - DNA, 20 bp, Artificial Sequence
  chemically synthesized
ctgttgcccaggctggaatg

SEQ ID NO: 298931 - DNA, 20 bp, Artificial Sequence
  chemically synthesized
tgtgccactacattccagcc

SEQ ID NO: 298932 - DNA, 20 bp, Artificial Sequence
  chemically synthesized
gtgccactacattccagcct

SEQ ID NO: 298933 - DNA, 20 bp, Artificial Sequence
  chemically synthesized
tctcgttctgttgcccaggc

SEQ ID NO: 298934 - DNA, 20 bp, Artificial Sequence
  chemically synthesized
ctacattccagcctgggcaa

SEQ ID NO: 298935 - DNA, 20 bp, Artificial Sequence
  chemically synthesized
tgagtctcgttctgttgccc

SEQ ID NO: 298936 - DNA, 20 bp, Artificial Sequence
  chemically synthesized
ctgagtctcgttctgttgcc

SEQ ID NO: 298937 - DNA, 20 bp, Artificial Sequence
  chemically synthesized
tccagcctgggcaacagaac

SEQ ID NO: 298938 - DNA, 20 bp, Artificial Sequence
  chemically synthesized
ctgggcaacagaacgagact

SEQ ID NO: 298939 - DNA, 20 bp, Artificial Sequence
  chemically synthesized
tttttttcttttttgagact

SEQ ID NO: 298940 - DNA, 20 bp, Artificial Sequence
  chemically synthesized
aacgagactcagtctcaaaa

SEQ ID NO: 298941 - DNA, 20 bp, Artificial Sequence
  chemically synthesized
gttatttttttttctttttt

SEQ ID NO: 298942 - DNA, 20 bp, Artificial Sequence
  chemically synthesized
aaaaagaaaaaaaaataaca

SEQ ID NO: 298943 - DNA, 20 bp, Artificial Sequence
  chemically synthesized
ctgatttacacacacatata

SEQ ID NO: 298944 - DNA, 20 bp, Artificial Sequence
  chemically synthesized
ctatatatgtgtgtgtaaat

SEQ ID NO: 298945 - DNA, 20 bp, Artificial Sequence
  chemically synthesized
tatatatgtgtgtgtaaatc

SEQ ID NO: 298946 - DNA, 20 bp, Artificial Sequence
  chemically synthesized
tgtgtgtaaatcaggcacca

SEQ ID NO: 298947 - DNA, 20 bp, Artificial Sequence
  chemically synthesized
gtgtgtaaatcaggcaccac

SEQ ID NO: 298948 - DNA, 20 bp, Artificial Sequence
  chemically synthesized
aaattagggattaaaacctg

SEQ ID NO: 298949 - DNA, 20 bp, Artificial Sequence
  chemically synthesized
taccagaaagataaaaatta

SEQ ID NO: 298950 - DNA, 20 bp, Artificial Sequence
  chemically synthesized
ataccagaaagataaaaatt

SEQ ID NO: 298951 - DNA, 20 bp, Artificial Sequence
  chemically synthesized
aataccagaaagataaaaat

SEQ ID NO: 298952 - DNA, 20 bp, Artificial Sequence
  chemically synthesized
atccctaatttttatctttc

SEQ ID NO: 298953 - DNA, 20 bp, Artificial Sequence
  chemically synthesized
ttacccaagaaaataccaga

SEQ ID NO: 298954 - DNA, 20 bp, Artificial Sequence
  chemically synthesized
taatttacccaagaaaatac

SEQ ID NO: 298955 - DNA, 20 bp, Artificial Sequence
  chemically synthesized
ttatctttctggtattttct

SEQ ID NO: 298956 - DNA, 20 bp, Artificial Sequence
  chemically synthesized
tatctttctggtattttctt

SEQ ID NO: 298957 - DNA, 20 bp, Artificial Sequence
  chemically synthesized
tcgaagaaattaatttaccc

SEQ ID NO: 298958 - DNA, 20 bp, Artificial Sequence
  chemically synthesized
aaattaatttcttcgatctt

SEQ ID NO: 298959 - DNA, 20 bp, Artificial Sequence
  chemically synthesized
caagaagtcgctgaagatcg

SEQ ID NO: 298960 - DNA, 20 bp, Artificial Sequence
  chemically synthesized
tttaaagcaagaagtcgctg

SEQ ID NO: 298961 - DNA, 20 bp, Artificial Sequence
  chemically synthesized
tttttacaatttaaagcaag

SEQ ID NO: 298962 - DNA, 20 bp, Artificial Sequence
  chemically synthesized
aaatttttacaatttaaagc

SEQ ID NO: 298963 - DNA, 20 bp, Artificial Sequence
  chemically synthesized
ttttaaatttttacaattta

SEQ ID NO: 298964 - DNA, 20 bp, Artificial Sequence
  chemically synthesized
tttaaattgtaaaaatttaa

SEQ ID NO: 298965 - DNA, 20 bp, Artificial Sequence
  chemically synthesized
cttcaggaccagtttgataa

SEQ ID NO: 298966 - DNA, 20 bp, Artificial Sequence
  chemically synthesized
tttaaaagctgttatcaaac

SEQ ID NO: 298967 - DNA, 20 bp, Artificial Sequence
  chemically synthesized
ctgttatcaaactggtcctg

SEQ ID NO: 298968 - DNA, 20 bp, Artificial Sequence
  chemically synthesized
gtatgtttttacttcaggac

SEQ ID NO: 298969 - DNA, 20 bp, Artificial Sequence
  chemically synthesized
ttacagtatgtttttacttc

SEQ ID NO: 298970 - DNA, 20 bp, Artificial Sequence
  chemically synthesized
tttacagtatgtttttactt

SEQ ID NO: 298971 - DNA, 20 bp, Artificial Sequence
  chemically synthesized
agccttttatttttggttta

SEQ ID NO: 298972 - DNA, 20 bp, Artificial Sequence
  chemically synthesized
atactgtaaaccaaaaataa

SEQ ID NO: 298973 - DNA, 20 bp, Artificial Sequence
  chemically synthesized
gggagttagccttttatttt

SEQ ID NO: 298974 - DNA, 20 bp, Artificial Sequence
  chemically synthesized
tactgtaaaccaaaaataaa

SEQ ID NO: 298975 - DNA, 20 bp, Artificial Sequence
  chemically synthesized
agtccctttggagggggagt

SEQ ID NO: 298976 - DNA, 20 bp, Artificial Sequence
  chemically synthesized
aggaagtccctttggagggg

SEQ ID NO: 298977 - DNA, 20 bp, Artificial Sequence
  chemically synthesized
aaaggctaactccccctcca

SEQ ID NO: 298978 - DNA, 20 bp, Artificial Sequence
  chemically synthesized
aaggctaactccccctccaa

SEQ ID NO: 298979 - DNA, 20 bp, Artificial Sequence
  chemically synthesized
ggaggaagtccctttggagg

SEQ ID NO: 298980 - DNA, 20 bp, Artificial Sequence
  chemically synthesized
aggctaactccccctccaaa

SEQ ID NO: 298981 - DNA, 20 bp, Artificial Sequence
  chemically synthesized
aggaggaagtccctttggag

SEQ ID NO: 298982 - DNA, 20 bp, Artificial Sequence
  chemically synthesized
gaggaggaagtccctttgga

SEQ ID NO: 298983 - DNA, 20 bp, Artificial Sequence
  chemically synthesized
tgaggaggaagtccctttgg

SEQ ID NO: 298984 - DNA, 20 bp, Artificial Sequence
  chemically synthesized
ctgaggaggaagtccctttg

SEQ ID NO: 298985 - DNA, 20 bp, Artificial Sequence
  chemically synthesized
ggctgaggaggaagtccctt

SEQ ID NO: 298986 - DNA, 20 bp, Artificial Sequence
  chemically synthesized
ctccaaagggacttcctcct

SEQ ID NO: 298987 - DNA, 20 bp, Artificial Sequence
  chemically synthesized
aagagccctggctgaggagg

SEQ ID NO: 298988 - DNA, 20 bp, Artificial Sequence
  chemically synthesized
aaagggacttcctcctcagc

SEQ ID NO: 298989 - DNA, 20 bp, Artificial Sequence
  chemically synthesized
tttaagagccctggctgagg

SEQ ID NO: 298990 - DNA, 20 bp, Artificial Sequence
  chemically synthesized
aagggacttcctcctcagcc

SEQ ID NO: 298991 - DNA, 20 bp, Artificial Sequence
  chemically synthesized
ttttaagagccctggctgag

SEQ ID NO: 298992 - DNA, 20 bp, Artificial Sequence
  chemically synthesized
agggacttcctcctcagcca

SEQ ID NO: 298993 - DNA, 20 bp, Artificial Sequence
  chemically synthesized
aattttaagagccctggctg

SEQ ID NO: 298994 - DNA, 20 bp, Artificial Sequence
  chemically synthesized
aaattttaagagccctggct

SEQ ID NO: 298995 - DNA, 20 bp, Artificial Sequence
  chemically synthesized
aggttaaattttaagagccc

SEQ ID NO: 298996 - DNA, 20 bp, Artificial Sequence
  chemically synthesized
tctttcaggttaaattttaa

SEQ ID NO: 298997 - DNA, 20 bp, Artificial Sequence
  chemically synthesized
agtctttcaggttaaatttt

SEQ ID NO: 298998 - DNA, 20 bp, Artificial Sequence
  chemically synthesized
gctcttaaaatttaacctga

SEQ ID NO: 298999 - DNA, 20 bp, Artificial Sequence
  chemically synthesized
taaaatttaacctgaaagac

SEQ ID NO: 299000 - DNA, 20 bp, Artificial Sequence
  chemically synthesized
ttggcctgaaccagtctttc

SEQ ID NO: 299001 - DNA, 20 bp, Artificial Sequence
  chemically synthesized
cttggcctgaaccagtcttt

SEQ ID NO: 299002 - DNA, 20 bp, Artificial Sequence
  chemically synthesized
tttaacctgaaagactggtt

SEQ ID NO: 299003 - DNA, 20 bp, Artificial Sequence
  chemically synthesized
ttaacctgaaagactggttc

SEQ ID NO: 299004 - DNA, 20 bp, Artificial Sequence
  chemically synthesized
cttcccttcttggcctgaac

SEQ ID NO: 299005 - DNA, 20 bp, Artificial Sequence
  chemically synthesized
ctgaaagactggttcaggcc

SEQ ID NO: 299006 - DNA, 20 bp, Artificial Sequence
  chemically synthesized
aaagactggttcaggccaag

SEQ ID NO: 299007 - DNA, 20 bp, Artificial Sequence
  chemically synthesized
aagactggttcaggccaaga

SEQ ID NO: 299008 - DNA, 20 bp, Artificial Sequence
  chemically synthesized
agactggttcaggccaagaa

SEQ ID NO: 299009 - DNA, 20 bp, Artificial Sequence
  chemically synthesized
ctggttcaggccaagaaggg

SEQ ID NO: 299010 - DNA, 20 bp, Artificial Sequence
  chemically synthesized
ctgacccccacttcccttct

SEQ ID NO: 299011 - DNA, 20 bp, Artificial Sequence
  chemically synthesized
gttcaggccaagaagggaag

SEQ ID NO: 299012 - DNA, 20 bp, Artificial Sequence
  chemically synthesized
ttcaggccaagaagggaagt

SEQ ID NO: 299013 - DNA, 20 bp, Artificial Sequence
  chemically synthesized
tcaggccaagaagggaagtg

SEQ ID NO: 299014 - DNA, 20 bp, Artificial Sequence
  chemically synthesized
caggccaagaagggaagtgg

SEQ ID NO: 299015 - DNA, 20 bp, Artificial Sequence
  chemically synthesized
ccaagaagggaagtgggggt

SEQ ID NO: 299016 - DNA, 20 bp, Artificial Sequence
  chemically synthesized
agtgtcagagaggtataatg

SEQ ID NO: 299017 - DNA, 20 bp, Artificial Sequence
  chemically synthesized
aagtgtcagagaggtataat

SEQ ID NO: 299018 - DNA, 20 bp, Artificial Sequence
  chemically synthesized
tgttgatgtaagtgtcagag

SEQ ID NO: 299019 - DNA, 20 bp, Artificial Sequence
  chemically synthesized
gtgttgatgtaagtgtcaga

SEQ ID NO: 299020 - DNA, 20 bp, Artificial Sequence
  chemically synthesized
ctgtgttgatgtaagtgtca

SEQ ID NO: 299021 - DNA, 20 bp, Artificial Sequence
  chemically synthesized
gtctgtgttgatgtaagtgt

SEQ ID NO: 299022 - DNA, 20 bp, Artificial Sequence
  chemically synthesized
cttaaagtctgtgttgatgt

SEQ ID NO: 299023 - DNA, 20 bp, Artificial Sequence
  chemically synthesized
ctctgacacttacatcaaca

SEQ ID NO: 299024 - DNA, 20 bp, Artificial Sequence
  chemically synthesized
cttacatcaacacagacttt

SEQ ID NO: 299025 - DNA, 20 bp, Artificial Sequence
  chemically synthesized
agtgcttcttatcagactta

SEQ ID NO: 299026 - DNA, 20 bp, Artificial Sequence
  chemically synthesized
acacagactttaagtctgat

SEQ ID NO: 299027 - DNA, 20 bp, Artificial Sequence
  chemically synthesized
cagactttaagtctgataag

SEQ ID NO: 299028 - DNA, 20 bp, Artificial Sequence
  chemically synthesized
ggctgtagagtgcttcttat

SEQ ID NO: 299029 - DNA, 20 bp, Artificial Sequence
  chemically synthesized
gtctgataagaagcactcta

SEQ ID NO: 299030 - DNA, 20 bp, Artificial Sequence
  chemically synthesized
ttcagagagaagaggctgta

SEQ ID NO: 299031 - DNA, 20 bp, Artificial Sequence
  chemically synthesized
gcttcagagagaagaggctg

SEQ ID NO: 299032 - DNA, 20 bp, Artificial Sequence
  chemically synthesized
tagcaggcttcagagagaag

SEQ ID NO: 299033 - DNA, 20 bp, Artificial Sequence
  chemically synthesized
ctagcaggcttcagagagaa

SEQ ID NO: 299034 - DNA, 20 bp, Artificial Sequence
  chemically synthesized
tctacagcctcttctctctg

SEQ ID NO: 299035 - DNA, 20 bp, Artificial Sequence
  chemically synthesized
agctagcaggcttcagagag

SEQ ID NO: 299036 - DNA, 20 bp, Artificial Sequence
  chemically synthesized
tttagctagcaggcttcaga

SEQ ID NO: 299037 - DNA, 20 bp, Artificial Sequence
  chemically synthesized
cttttagctagcaggcttca

SEQ ID NO: 299038 - DNA, 20 bp, Artificial Sequence
  chemically synthesized
agcttttagctagcaggctt

SEQ ID NO: 299039 - DNA, 20 bp, Artificial Sequence
  chemically synthesized
ctcttctctctgaagcctgc

SEQ ID NO: 299040 - DNA, 20 bp, Artificial Sequence
  chemically synthesized
agatgaagcttttagctagc

SEQ ID NO: 299041 - DNA, 20 bp, Artificial Sequence
  chemically synthesized
tagatgaagcttttagctag

SEQ ID NO: 299042 - DNA, 20 bp, Artificial Sequence
  chemically synthesized
ctctgaagcctgctagctaa

SEQ ID NO: 299043 - DNA, 20 bp, Artificial Sequence
  chemically synthesized
atgtagatgaagcttttagc

SEQ ID NO: 299044 - DNA, 20 bp, Artificial Sequence
  chemically synthesized
tatcatgtagatgaagcttt

SEQ ID NO: 299045 - DNA, 20 bp, Artificial Sequence
  chemically synthesized
aaagttttatcatgtagatg

SEQ ID NO: 299046 - DNA, 20 bp, Artificial Sequence
  chemically synthesized
gataccaaagttttatcatg

SEQ ID NO: 299047 - DNA, 20 bp, Artificial Sequence
  chemically synthesized
tcatctacatgataaaactt

SEQ ID NO: 299048 - DNA, 20 bp, Artificial Sequence
  chemically synthesized
ataagacattgtggatacca

SEQ ID NO: 299049 - DNA, 20 bp, Artificial Sequence
  chemically synthesized
tgggttgagataagacattg

SEQ ID NO: 299050 - DNA, 20 bp, Artificial Sequence
  chemically synthesized
aggaatgtttgggttgagat

SEQ ID NO: 299051 - DNA, 20 bp, Artificial Sequence
  chemically synthesized
tagaaaggaatgtttgggtt

SEQ ID NO: 299052 - DNA, 20 bp, Artificial Sequence
  chemically synthesized
atcaatagaaaggaatgttt

SEQ ID NO: 299053 - DNA, 20 bp, Artificial Sequence
  chemically synthesized
gatcaatagaaaggaatgtt

SEQ ID NO: 299054 - DNA, 20 bp, Artificial Sequence
  chemically synthesized
aagacctgggatcaatagaa

SEQ ID NO: 299055 - DNA, 20 bp, Artificial Sequence
  chemically synthesized
aaagacctgggatcaataga

SEQ ID NO: 299056 - DNA, 20 bp, Artificial Sequence
  chemically synthesized
acattcctttctattgatcc

SEQ ID NO: 299057 - DNA, 20 bp, Artificial Sequence
  chemically synthesized
gtctaaagacctgggatcaa

SEQ ID NO: 299058 - DNA, 20 bp, Artificial Sequence
  chemically synthesized
cattcctttctattgatccc

SEQ ID NO: 299059 - DNA, 20 bp, Artificial Sequence
  chemically synthesized
ttctattgatcccaggtctt

SEQ ID NO: 299060 - DNA, 20 bp, Artificial Sequence
  chemically synthesized
ttgagtttgtctaaagacct

SEQ ID NO: 299061 - DNA, 20 bp, Artificial Sequence
  chemically synthesized
gttgagtttgtctaaagacc

SEQ ID NO: 299062 - DNA, 20 bp, Artificial Sequence
  chemically synthesized
caattggttgagtttgtcta

SEQ ID NO: 299063 - DNA, 20 bp, Artificial Sequence
  chemically synthesized
tttctggttgacaattggtt

SEQ ID NO: 299064 - DNA, 20 bp, Artificial Sequence
  chemically synthesized
aacattttctggttgacaat

SEQ ID NO: 299065 - DNA, 20 bp, Artificial Sequence
  chemically synthesized
aaactcaaccaattgtcaac

SEQ ID NO: 299066 - DNA, 20 bp, Artificial Sequence
  chemically synthesized
aggtaaatttaaacattttc

SEQ ID NO: 299067 - DNA, 20 bp, Artificial Sequence
  chemically synthesized
aaaatgtttaaatttaccta

SEQ ID NO: 299068 - DNA, 20 bp, Artificial Sequence
  chemically synthesized
gtttaaatttacctacagcc

SEQ ID NO: 299069 - DNA, 20 bp, Artificial Sequence
  chemically synthesized
ggtgggggcttccaggctgt

SEQ ID NO: 299070 - DNA, 20 bp, Artificial Sequence
  chemically synthesized
gggtgggggcttccaggctg

SEQ ID NO: 299071 - DNA, 20 bp, Artificial Sequence
  chemically synthesized
taaatttacctacagcctgg

SEQ ID NO: 299072 - DNA, 20 bp, Artificial Sequence
  chemically synthesized
gggtgggggtgggggcttcc

SEQ ID NO: 299073 - DNA, 20 bp, Artificial Sequence
  chemically synthesized
tgggtgggggtgggggcttc

SEQ ID NO: 299074 - DNA, 20 bp, Artificial Sequence
  chemically synthesized
ggacaactgggtgggggtgg

SEQ ID NO: 299075 - DNA, 20 bp, Artificial Sequence
  chemically synthesized
aggacaactgggtgggggtg

SEQ ID NO: 299076 - DNA, 20 bp, Artificial Sequence
  chemically synthesized
caggacaactgggtgggggt

SEQ ID NO: 299077 - DNA, 20 bp, Artificial Sequence
  chemically synthesized
gcaggacaactgggtggggg

SEQ ID NO: 299078 - DNA, 20 bp, Artificial Sequence
  chemically synthesized
tggaagcccccacccccacc

SEQ ID NO: 299079 - DNA, 20 bp, Artificial Sequence
  chemically synthesized
aaggcaggacaactgggtgg

SEQ ID NO: 299080 - DNA, 20 bp, Artificial Sequence
  chemically synthesized
aaaggcaggacaactgggtg

SEQ ID NO: 299081 - DNA, 20 bp, Artificial Sequence
  chemically synthesized
gaaaggcaggacaactgggt

SEQ ID NO: 299082 - DNA, 20 bp, Artificial Sequence
  chemically synthesized
agaaaggcaggacaactggg

SEQ ID NO: 299083 - DNA, 20 bp, Artificial Sequence
  chemically synthesized
tccagaaaggcaggacaact

SEQ ID NO: 299084 - DNA, 20 bp, Artificial Sequence
  chemically synthesized
gtccagaaaggcaggacaac

SEQ ID NO: 299085 - DNA, 20 bp, Artificial Sequence
  chemically synthesized
acccagttgtcctgcctttc

SEQ ID NO: 299086 - DNA, 20 bp, Artificial Sequence
  chemically synthesized
ttggtttggtccagaaaggc

SEQ ID NO: 299087 - DNA, 20 bp, Artificial Sequence
  chemically synthesized
attggtttggtccagaaagg

SEQ ID NO: 299088 - DNA, 20 bp, Artificial Sequence
  chemically synthesized
tacattggtttggtccagaa

SEQ ID NO: 299089 - DNA, 20 bp, Artificial Sequence
  chemically synthesized
atacattggtttggtccaga

SEQ ID NO: 299090 - DNA, 20 bp, Artificial Sequence
  chemically synthesized
agaaatacattggtttggtc

SEQ ID NO: 299091 - DNA, 20 bp, Artificial Sequence
  chemically synthesized
aaaaaagaaatacattggtt

SEQ ID NO: 299092 - DNA, 20 bp, Artificial Sequence
  chemically synthesized
aaaaaaaaaaagaaatacat

SEQ ID NO: 299093 - DNA, 20 bp, Artificial Sequence
  chemically synthesized
ttaaaaaaaaaaaaaaaaaa

SEQ ID NO: 299094 - DNA, 20 bp, Artificial Sequence
  chemically synthesized
ttttttaattttattttttt

SEQ ID NO: 299095 - DNA, 20 bp, Artificial Sequence
  chemically synthesized
ttaattttatttttttcaga

SEQ ID NO: 299096 - DNA, 20 bp, Artificial Sequence
  chemically synthesized
aattttatttttttcagacg

SEQ ID NO: 299097 - DNA, 20 bp, Artificial Sequence
  chemically synthesized
tccagcttgggcaacagagc

SEQ ID NO: 299098 - DNA, 20 bp, Artificial Sequence
  chemically synthesized
gcactccagcttgggcaaca

SEQ ID NO: 299099 - DNA, 20 bp, Artificial Sequence
  chemically synthesized
ggagtctcgctctgttgccc

SEQ ID NO: 299100 - DNA, 20 bp, Artificial Sequence
  chemically synthesized
ctgcactccagcttgggcaa

SEQ ID NO: 299101 - DNA, 20 bp, Artificial Sequence
  chemically synthesized
tctcgctctgttgcccaagc

SEQ ID NO: 299102 - DNA, 20 bp, Artificial Sequence
  chemically synthesized
tcgctctgttgcccaagctg

SEQ ID NO: 299103 - DNA, 20 bp, Artificial Sequence
  chemically synthesized
gtgtcactgcactccagctt

SEQ ID NO: 299104 - DNA, 20 bp, Artificial Sequence
  chemically synthesized
tgtgtcactgcactccagct

SEQ ID NO: 299105 - DNA, 20 bp, Artificial Sequence
  chemically synthesized
ctgttgcccaagctggagtg

SEQ ID NO: 299106 - DNA, 20 bp, Artificial Sequence
  chemically synthesized
aagattgtgtcactgcactc

SEQ ID NO: 299107 - DNA, 20 bp, Artificial Sequence
  chemically synthesized
ggagtgcagtgacacaatct

SEQ ID NO: 299108 - DNA, 20 bp, Artificial Sequence
  chemically synthesized
ggcggaggttgcagtgagcc

SEQ ID NO: 299109 - DNA, 20 bp, Artificial Sequence
  chemically synthesized
tgggaggcggaggttgcagt

SEQ ID NO: 299110 - DNA, 20 bp, Artificial Sequence
  chemically synthesized
aacctgggaggcggaggttg

SEQ ID NO: 299111 - DNA, 20 bp, Artificial Sequence
  chemically synthesized
ggtgtgaacctgggaggcgg

SEQ ID NO: 299112 - DNA, 20 bp, Artificial Sequence
  chemically synthesized
tcactgcaacctccgcctcc

SEQ ID NO: 299113 - DNA, 20 bp, Artificial Sequence
  chemically synthesized
tggtgtgaacctgggaggcg

SEQ ID NO: 299114 - DNA, 20 bp, Artificial Sequence
  chemically synthesized
cactgcaacctccgcctccc

SEQ ID NO: 299115 - DNA, 20 bp, Artificial Sequence
  chemically synthesized
aatggtgtgaacctgggagg

SEQ ID NO: 299116 - DNA, 20 bp, Artificial Sequence
  chemically synthesized
gagaatggtgtgaacctggg

SEQ ID NO: 299117 - DNA, 20 bp, Artificial Sequence
  chemically synthesized
ggagaatggtgtgaacctgg

SEQ ID NO: 299118 - DNA, 20 bp, Artificial Sequence
  chemically synthesized
caggagaatggtgtgaacct

SEQ ID NO: 299119 - DNA, 20 bp, Artificial Sequence
  chemically synthesized
gcaggagaatggtgtgaacc

SEQ ID NO: 299120 - DNA, 20 bp, Artificial Sequence
  chemically synthesized
gggaggctgaggcaggagaa

SEQ ID NO: 299121 - DNA, 20 bp, Artificial Sequence
  chemically synthesized
ttcacaccattctcctgcct

SEQ ID NO: 299122 - DNA, 20 bp, Artificial Sequence
  chemically synthesized
tactcgggaggctgaggcag

SEQ ID NO: 299123 - DNA, 20 bp, Artificial Sequence
  chemically synthesized
gctactcgggaggctgaggc

SEQ ID NO: 299124 - DNA, 20 bp, Artificial Sequence
  chemically synthesized
agctactcgggaggctgagg

SEQ ID NO: 299125 - DNA, 20 bp, Artificial Sequence
  chemically synthesized
cccagctactcgggaggctg

SEQ ID NO: 299126 - DNA, 20 bp, Artificial Sequence
  chemically synthesized
tcccagctactcgggaggct

SEQ ID NO: 299127 - DNA, 20 bp, Artificial Sequence
  chemically synthesized
ttctcctgcctcagcctccc

SEQ ID NO: 299128 - DNA, 20 bp, Artificial Sequence
  chemically synthesized
tcctgcctcagcctcccgag

SEQ ID NO: 299129 - DNA, 20 bp, Artificial Sequence
  chemically synthesized
tgtagtcccagctactcggg

SEQ ID NO: 299130 - DNA, 20 bp, Artificial Sequence
  chemically synthesized
ctgtagtcccagctactcgg

SEQ ID NO: 299131 - DNA, 20 bp, Artificial Sequence
  chemically synthesized
gcctcagcctcccgagtagc

SEQ ID NO: 299132 - DNA, 20 bp, Artificial Sequence
  chemically synthesized
gcctgtagtcccagctactc

SEQ ID NO: 299133 - DNA, 20 bp, Artificial Sequence
  chemically synthesized
cctcagcctcccgagtagct

SEQ ID NO: 299134 - DNA, 20 bp, Artificial Sequence
  chemically synthesized
cgcctgtagtcccagctact

SEQ ID NO: 299135 - DNA, 20 bp, Artificial Sequence
  chemically synthesized
ctcccgagtagctgggacta

SEQ ID NO: 299136 - DNA, 20 bp, Artificial Sequence
  chemically synthesized
tcccgagtagctgggactac

SEQ ID NO: 299137 - DNA, 20 bp, Artificial Sequence
  chemically synthesized
gcggcaggcgcctgtagtcc

SEQ ID NO: 299138 - DNA, 20 bp, Artificial Sequence
  chemically synthesized
gacgtggcggcaggcgcctg

SEQ ID NO: 299139 - DNA, 20 bp, Artificial Sequence
  chemically synthesized
aattagccagacgtggcggc

SEQ ID NO: 299140 - DNA, 20 bp, Artificial Sequence
  chemically synthesized
aaattagccagacgtggcgg

SEQ ID NO: 299141 - DNA, 20 bp, Artificial Sequence
  chemically synthesized
caggcgcctgccgccacgtc

SEQ ID NO: 299142 - DNA, 20 bp, Artificial Sequence
  chemically synthesized
aaaaaattagccagacgtgg

SEQ ID NO: 299143 - DNA, 20 bp, Artificial Sequence
  chemically synthesized
gaaaaaaaattagccagacg

SEQ ID NO: 299144 - DNA, 20 bp, Artificial Sequence
  chemically synthesized
aatagggaaaaaaaattagc

SEQ ID NO: 299145 - DNA, 20 bp, Artificial Sequence
  chemically synthesized
gaaaaatagggaaaaaaaat

SEQ ID NO: 299146 - DNA, 20 bp, Artificial Sequence
  chemically synthesized
ccccgtctctatgaaaaata

SEQ ID NO: 299147 - DNA, 20 bp, Artificial Sequence
  chemically synthesized
accccgtctctatgaaaaat

SEQ ID NO: 299148 - DNA, 20 bp, Artificial Sequence
  chemically synthesized
ttttttttccctatttttca

SEQ ID NO: 299149 - DNA, 20 bp, Artificial Sequence
  chemically synthesized
aaccccgtctctatgaaaaa

SEQ ID NO: 299150 - DNA, 20 bp, Artificial Sequence
  chemically synthesized
ttttttccctatttttcata

SEQ ID NO: 299151 - DNA, 20 bp, Artificial Sequence
  chemically synthesized
ttccctatttttcatagaga

SEQ ID NO: 299152 - DNA, 20 bp, Artificial Sequence
  chemically synthesized
tccctatttttcatagagac

SEQ ID NO: 299153 - DNA, 20 bp, Artificial Sequence
  chemically synthesized
ccctatttttcatagagacg

SEQ ID NO: 299154 - DNA, 20 bp, Artificial Sequence
  chemically synthesized
gagacggggtttcactgttt

SEQ ID NO: 299155 - DNA, 20 bp, Artificial Sequence
  chemically synthesized
cggggtttcactgtttcagc

SEQ ID NO: 299156 - DNA, 20 bp, Artificial Sequence
  chemically synthesized
cgagaccatcctggctgaaa

SEQ ID NO: 299157 - DNA, 20 bp, Artificial Sequence
  chemically synthesized
ggggtttcactgtttcagcc

SEQ ID NO: 299158 - DNA, 20 bp, Artificial Sequence
  chemically synthesized
tttcactgtttcagccagga

SEQ ID NO: 299159 - DNA, 20 bp, Artificial Sequence
  chemically synthesized
tcaggagatcgagaccatcc

SEQ ID NO: 299160 - DNA, 20 bp, Artificial Sequence
  chemically synthesized
gatcacaaggtcaggagatc

SEQ ID NO: 299161 - DNA, 20 bp, Artificial Sequence
  chemically synthesized
cgggcggatcacaaggtcag

SEQ ID NO: 299162 - DNA, 20 bp, Artificial Sequence
  chemically synthesized
gtcgggcggatcacaaggtc

SEQ ID NO: 299163 - DNA, 20 bp, Artificial Sequence
  chemically synthesized
agtcgggcggatcacaaggt

SEQ ID NO: 299164 - DNA, 20 bp, Artificial Sequence
  chemically synthesized
gctgagtcgggcggatcaca

SEQ ID NO: 299165 - DNA, 20 bp, Artificial Sequence
  chemically synthesized
ggctgagtcgggcggatcac

SEQ ID NO: 299166 - DNA, 20 bp, Artificial Sequence
  chemically synthesized
accttgtgatccgcccgact

SEQ ID NO: 299167 - DNA, 20 bp, Artificial Sequence
  chemically synthesized
ctttgggaggctgagtcggg

SEQ ID NO: 299168 - DNA, 20 bp, Artificial Sequence
  chemically synthesized
gcactttgggaggctgagtc

SEQ ID NO: 299169 - DNA, 20 bp, Artificial Sequence
  chemically synthesized
agcactttgggaggctgagt

SEQ ID NO: 299170 - DNA, 20 bp, Artificial Sequence
  chemically synthesized
tcccagcactttgggaggct

SEQ ID NO: 299171 - DNA, 20 bp, Artificial Sequence
  chemically synthesized
ccgcccgactcagcctccca

SEQ ID NO: 299172 - DNA, 20 bp, Artificial Sequence
  chemically synthesized
tgtaatcccagcactttggg

SEQ ID NO: 299173 - DNA, 20 bp, Artificial Sequence
  chemically synthesized
ctgtaatcccagcactttgg

SEQ ID NO: 299174 - DNA, 20 bp, Artificial Sequence
  chemically synthesized
gactcagcctcccaaagtgc

SEQ ID NO: 299175 - DNA, 20 bp, Artificial Sequence
  chemically synthesized
acctgtaatcccagcacttt

SEQ ID NO: 299176 - DNA, 20 bp, Artificial Sequence
  chemically synthesized
actcagcctcccaaagtgct

SEQ ID NO: 299177 - DNA, 20 bp, Artificial Sequence
  chemically synthesized
cacctgtaatcccagcactt

SEQ ID NO: 299178 - DNA, 20 bp, Artificial Sequence
  chemically synthesized
ctcccaaagtgctgggatta

SEQ ID NO: 299179 - DNA, 20 bp, Artificial Sequence
  chemically synthesized
tcccaaagtgctgggattac

SEQ ID NO: 299180 - DNA, 20 bp, Artificial Sequence
  chemically synthesized
gtggctcacacctgtaatcc

SEQ ID NO: 299181 - DNA, 20 bp, Artificial Sequence
  chemically synthesized
agtgctgggattacaggtgt

SEQ ID NO: 299182 - DNA, 20 bp, Artificial Sequence
  chemically synthesized
acaggtgtgagccaccgcgc

SEQ ID NO: 299183 - DNA, 20 bp, Artificial Sequence
  chemically synthesized
caggtgtgagccaccgcgcc

SEQ ID NO: 299184 - DNA, 20 bp, Artificial Sequence
  chemically synthesized
attggtttgacctggcgcgg

SEQ ID NO: 299185 - DNA, 20 bp, Artificial Sequence
  chemically synthesized
tacattggtttgacctggcg

SEQ ID NO: 299186 - DNA, 20 bp, Artificial Sequence
  chemically synthesized
agaaatacattggtttgacc

SEQ ID NO: 299187 - DNA, 20 bp, Artificial Sequence
  chemically synthesized
agtacatttaagaaatacat

SEQ ID NO: 299188 - DNA, 20 bp, Artificial Sequence
  chemically synthesized
gacatcaatcaagtacattt

SEQ ID NO: 299189 - DNA, 20 bp, Artificial Sequence
  chemically synthesized
ggaggcatgagacatcaatc

SEQ ID NO: 299190 - DNA, 20 bp, Artificial Sequence
  chemically synthesized
tacacattttagggaggcat

SEQ ID NO: 299191 - DNA, 20 bp, Artificial Sequence
  chemically synthesized
tggttttacacattttaggg

SEQ ID NO: 299192 - DNA, 20 bp, Artificial Sequence
  chemically synthesized
ttggttttacacattttagg

SEQ ID NO: 299193 - DNA, 20 bp, Artificial Sequence
  chemically synthesized
gcttggttttacacatttta

SEQ ID NO: 299194 - DNA, 20 bp, Artificial Sequence
  chemically synthesized
agcttggttttacacatttt

SEQ ID NO: 299195 - DNA, 20 bp, Artificial Sequence
  chemically synthesized
cagcttggttttacacattt

SEQ ID NO: 299196 - DNA, 20 bp, Artificial Sequence
  chemically synthesized
tccctaaaatgtgtaaaacc

SEQ ID NO: 299197 - DNA, 20 bp, Artificial Sequence
  chemically synthesized
aaggtggttggggtgcagct

SEQ ID NO: 299198 - DNA, 20 bp, Artificial Sequence
  chemically synthesized
tgcccaaggtggttggggtg

SEQ ID NO: 299199 - DNA, 20 bp, Artificial Sequence
  chemically synthesized
acatgtgcccaaggtggttg

SEQ ID NO: 299200 - DNA, 20 bp, Artificial Sequence
  chemically synthesized
gacatgtgcccaaggtggtt

SEQ ID NO: 299201 - DNA, 20 bp, Artificial Sequence
  chemically synthesized
aagctgcaccccaaccacct

SEQ ID NO: 299202 - DNA, 20 bp, Artificial Sequence
  chemically synthesized
cgacatgtgcccaaggtggt

SEQ ID NO: 299203 - DNA, 20 bp, Artificial Sequence
  chemically synthesized
agctgcaccccaaccacctt

SEQ ID NO: 299204 - DNA, 20 bp, Artificial Sequence
  chemically synthesized
ctgacgacatgtgcccaagg

SEQ ID NO: 299205 - DNA, 20 bp, Artificial Sequence
  chemically synthesized
gtcctgacgacatgtgccca

SEQ ID NO: 299206 - DNA, 20 bp, Artificial Sequence
  chemically synthesized
agtcctgacgacatgtgccc

SEQ ID NO: 299207 - DNA, 20 bp, Artificial Sequence
  chemically synthesized
ccaccttgggcacatgtcgt

SEQ ID NO: 299208 - DNA, 20 bp, Artificial Sequence
  chemically synthesized
caccttgggcacatgtcgtc

SEQ ID NO: 299209 - DNA, 20 bp, Artificial Sequence
  chemically synthesized
acatgtcgtcaggacttcct

SEQ ID NO: 299210 - DNA, 20 bp, Artificial Sequence
  chemically synthesized
catgtcgtcaggacttcctg

SEQ ID NO: 299211 - DNA, 20 bp, Artificial Sequence
  chemically synthesized
gcctgtgacacagcctcagg

SEQ ID NO: 299212 - DNA, 20 bp, Artificial Sequence
  chemically synthesized
cgcgcctgtgacacagcctc

SEQ ID NO: 299213 - DNA, 20 bp, Artificial Sequence
  chemically synthesized
gcgcgcctgtgacacagcct

SEQ ID NO: 299214 - DNA, 20 bp, Artificial Sequence
  chemically synthesized
gacttcctgaggctgtgtca

SEQ ID NO: 299215 - DNA, 20 bp, Artificial Sequence
  chemically synthesized
acttcctgaggctgtgtcac

SEQ ID NO: 299216 - DNA, 20 bp, Artificial Sequence
  chemically synthesized
gaattcgcgcgcctgtgaca

SEQ ID NO: 299217 - DNA, 20 bp, Artificial Sequence
  chemically synthesized
caggcgcgcgaattccacct

SEQ ID NO: 299218 - DNA, 20 bp, Artificial Sequence
  chemically synthesized
aaagttgatttttgccaagg

SEQ ID NO: 299219 - DNA, 20 bp, Artificial Sequence
  chemically synthesized
aaaaaagttgatttttgcca

SEQ ID NO: 299220 - DNA, 20 bp, Artificial Sequence
  chemically synthesized
aaaaaaagttgatttttgcc

SEQ ID NO: 299221 - DNA, 20 bp, Artificial Sequence
  chemically synthesized
aaaaaaaaaaaaaaaaaaaa

SEQ ID NO: 299222 - DNA, 20 bp, Artificial Sequence
  chemically synthesized
tttttttttttttttttttt

SEQ ID NO: 299223 - DNA, 20 bp, Artificial Sequence
  chemically synthesized
ttttttttttttttgagaca

SEQ ID NO: 299224 - DNA, 20 bp, Artificial Sequence
  chemically synthesized
tccagcctgggtgatagaat

SEQ ID NO: 299225 - DNA, 20 bp, Artificial Sequence
  chemically synthesized
caaagtctcattctatcacc

SEQ ID NO: 299226 - DNA, 20 bp, Artificial Sequence
  chemically synthesized
aaagtctcattctatcaccc

SEQ ID NO: 299227 - DNA, 20 bp, Artificial Sequence
  chemically synthesized
ctgcactccagcctgggtga

SEQ ID NO: 299228 - DNA, 20 bp, Artificial Sequence
  chemically synthesized
tctcattctatcacccaggc

SEQ ID NO: 299229 - DNA, 20 bp, Artificial Sequence
  chemically synthesized
tcattctatcacccaggctg

SEQ ID NO: 299230 - DNA, 20 bp, Artificial Sequence
  chemically synthesized
gtgccactgcactccagcct

SEQ ID NO: 299231 - DNA, 20 bp, Artificial Sequence
  chemically synthesized
tgtgccactgcactccagcc

SEQ ID NO: 299232 - DNA, 20 bp, Artificial Sequence
  chemically synthesized
ctatcacccaggctggagtg

SEQ ID NO: 299233 - DNA, 20 bp, Artificial Sequence
  chemically synthesized
gagattgtgccactgcactc

SEQ ID NO: 299234 - DNA, 20 bp, Artificial Sequence
  chemically synthesized
tcacccaggctggagtgcag

SEQ ID NO: 299235 - DNA, 20 bp, Artificial Sequence
  chemically synthesized
caggaggcgggggttgcagt

SEQ ID NO: 299236 - DNA, 20 bp, Artificial Sequence
  chemically synthesized
tccccaggaggcgggggttg

SEQ ID NO: 299237 - DNA, 20 bp, Artificial Sequence
  chemically synthesized
tgcttgtccccaggaggcgg

SEQ ID NO: 299238 - DNA, 20 bp, Artificial Sequence
  chemically synthesized
tcactgcaacccccgcctcc

SEQ ID NO: 299239 - DNA, 20 bp, Artificial Sequence
  chemically synthesized
ttgcttgtccccaggaggcg

SEQ ID NO: 299240 - DNA, 20 bp, Artificial Sequence
  chemically synthesized
cactgcaacccccgcctcct

SEQ ID NO: 299241 - DNA, 20 bp, Artificial Sequence
  chemically synthesized
attgcttgtccccaggaggc

SEQ ID NO: 299242 - DNA, 20 bp, Artificial Sequence
  chemically synthesized
actgcaacccccgcctcctg

SEQ ID NO: 299243 - DNA, 20 bp, Artificial Sequence
  chemically synthesized
aattgcttgtccccaggagg

SEQ ID NO: 299244 - DNA, 20 bp, Artificial Sequence
  chemically synthesized
gagaattgcttgtccccagg

SEQ ID NO: 299245 - DNA, 20 bp, Artificial Sequence
  chemically synthesized
cgagaattgcttgtccccag

SEQ ID NO: 299246 - DNA, 20 bp, Artificial Sequence
  chemically synthesized
aacccccgcctcctggggac

SEQ ID NO: 299247 - DNA, 20 bp, Artificial Sequence
  chemically synthesized
cacgagaattgcttgtcccc

SEQ ID NO: 299248 - DNA, 20 bp, Artificial Sequence
  chemically synthesized
gcacgagaattgcttgtccc

SEQ ID NO: 299249 - DNA, 20 bp, Artificial Sequence
  chemically synthesized
gacaagcaattctcgtgcct

SEQ ID NO: 299250 - DNA, 20 bp, Artificial Sequence
  chemically synthesized
tactcgggaggctgaggcac

SEQ ID NO: 299251 - DNA, 20 bp, Artificial Sequence
  chemically synthesized
cctaggtactcgggaggctg

SEQ ID NO: 299252 - DNA, 20 bp, Artificial Sequence
  chemically synthesized
tcctaggtactcgggaggct

SEQ ID NO: 299253 - DNA, 20 bp, Artificial Sequence
  chemically synthesized
ttctcgtgcctcagcctccc

SEQ ID NO: 299254 - DNA, 20 bp, Artificial Sequence
  chemically synthesized
cctaatcctaggtactcggg

SEQ ID NO: 299255 - DNA, 20 bp, Artificial Sequence
  chemically synthesized
gcctaatcctaggtactcgg

SEQ ID NO: 299256 - DNA, 20 bp, Artificial Sequence
  chemically synthesized
gcctcagcctcccgagtacc

SEQ ID NO: 299257 - DNA, 20 bp, Artificial Sequence
  chemically synthesized
ttgcctaatcctaggtactc

SEQ ID NO: 299258 - DNA, 20 bp, Artificial Sequence
  chemically synthesized
cctcagcctcccgagtacct

SEQ ID NO: 299259 - DNA, 20 bp, Artificial Sequence
  chemically synthesized
tttgcctaatcctaggtact

SEQ ID NO: 299260 - DNA, 20 bp, Artificial Sequence
  chemically synthesized
gcctcccgagtacctaggat

SEQ ID NO: 299261 - DNA, 20 bp, Artificial Sequence
  chemically synthesized
cctcccgagtacctaggatt

SEQ ID NO: 299262 - DNA, 20 bp, Artificial Sequence
  chemically synthesized
agttgattttgcctaatcct

SEQ ID NO: 299263 - DNA, 20 bp, Artificial Sequence
  chemically synthesized
aagttgattttgcctaatcc

SEQ ID NO: 299264 - DNA, 20 bp, Artificial Sequence
  chemically synthesized
caggtctcagttaatttaga

SEQ ID NO: 299265 - DNA, 20 bp, Artificial Sequence
  chemically synthesized
gagacaggtctcagttaatt

SEQ ID NO: 299266 - DNA, 20 bp, Artificial Sequence
  chemically synthesized
atcaactttctaaattaact

SEQ ID NO: 299267 - DNA, 20 bp, Artificial Sequence
  chemically synthesized
agaaaatctgagacaggtct

SEQ ID NO: 299268 - DNA, 20 bp, Artificial Sequence
  chemically synthesized
aaattaactgagacctgtct

SEQ ID NO: 299269 - DNA, 20 bp, Artificial Sequence
  chemically synthesized
agacccagaaaatctgagac

SEQ ID NO: 299270 - DNA, 20 bp, Artificial Sequence
  chemically synthesized
tagacccagaaaatctgaga

SEQ ID NO: 299271 - DNA, 20 bp, Artificial Sequence
  chemically synthesized
attgtagacccagaaaatct

SEQ ID NO: 299272 - DNA, 20 bp, Artificial Sequence
  chemically synthesized
gagacctgtctcagattttc

SEQ ID NO: 299273 - DNA, 20 bp, Artificial Sequence
  chemically synthesized
agacctgtctcagattttct

SEQ ID NO: 299274 - DNA, 20 bp, Artificial Sequence
  chemically synthesized
aagcatttgtattgtagacc

SEQ ID NO: 299275 - DNA, 20 bp, Artificial Sequence
  chemically synthesized
tttaaaaagcatttgtattg

SEQ ID NO: 299276 - DNA, 20 bp, Artificial Sequence
  chemically synthesized
atttacaagtaatttttaaa

SEQ ID NO: 299277 - DNA, 20 bp, Artificial Sequence
  chemically synthesized
aggtaagtaaacatatttac

SEQ ID NO: 299278 - DNA, 20 bp, Artificial Sequence
  chemically synthesized
acctctttaattagagaggt

SEQ ID NO: 299279 - DNA, 20 bp, Artificial Sequence
  chemically synthesized
caaaacctctttaattagag

SEQ ID NO: 299280 - DNA, 20 bp, Artificial Sequence
  chemically synthesized
tcaaaacctctttaattaga

SEQ ID NO: 299281 - DNA, 20 bp, Artificial Sequence
  chemically synthesized
tttacttacctctctaatta

SEQ ID NO: 299282 - DNA, 20 bp, Artificial Sequence
  chemically synthesized
ggtcaaaacctctttaatta

SEQ ID NO: 299283 - DNA, 20 bp, Artificial Sequence
  chemically synthesized
tacttacctctctaattaaa

SEQ ID NO: 299284 - DNA, 20 bp, Artificial Sequence
  chemically synthesized
acttacctctctaattaaag

SEQ ID NO: 299285 - DNA, 20 bp, Artificial Sequence
  chemically synthesized
tgggtcaaaacctctttaat

SEQ ID NO: 299286 - DNA, 20 bp, Artificial Sequence
  chemically synthesized
aattaaagaggttttgaccc

SEQ ID NO: 299287 - DNA, 20 bp, Artificial Sequence
  chemically synthesized
gatctcagtttttgtatctt

SEQ ID NO: 299288 - DNA, 20 bp, Artificial Sequence
  chemically synthesized
tgatctcagtttttgtatct

SEQ ID NO: 299289 - DNA, 20 bp, Artificial Sequence
  chemically synthesized
tgacccaagatacaaaaact

SEQ ID NO: 299290 - DNA, 20 bp, Artificial Sequence
  chemically synthesized
caagatacaaaaactgagat

SEQ ID NO: 299291 - DNA, 20 bp, Artificial Sequence
  chemically synthesized
aatataagcaaagctgatct

SEQ ID NO: 299292 - DNA, 20 bp, Artificial Sequence
  chemically synthesized
tgaaagccacaatataagca

SEQ ID NO: 299293 - DNA, 20 bp, Artificial Sequence
  chemically synthesized
gatcagctttgcttatattg

SEQ ID NO: 299294 - DNA, 20 bp, Artificial Sequence
  chemically synthesized
gaatatgaaagccacaatat

SEQ ID NO: 299295 - DNA, 20 bp, Artificial Sequence
  chemically synthesized
ctaatgtaattggaatatga

SEQ ID NO: 299296 - DNA, 20 bp, Artificial Sequence
  chemically synthesized
ctttcatattccaattacat

SEQ ID NO: 299297 - DNA, 20 bp, Artificial Sequence
  chemically synthesized
gatgaatagactaatgtaat

SEQ ID NO: 299298 - DNA, 20 bp, Artificial Sequence
  chemically synthesized
attacattagtctattcatc

SEQ ID NO: 299299 - DNA, 20 bp, Artificial Sequence
  chemically synthesized
taatttgattgctagatgaa

SEQ ID NO: 299300 - DNA, 20 bp, Artificial Sequence
  chemically synthesized
attttatttaatttgattgc

SEQ ID NO: 299301 - DNA, 20 bp, Artificial Sequence
  chemically synthesized
atcaaattaaataaaatcta

SEQ ID NO: 299302 - DNA, 20 bp, Artificial Sequence
  chemically synthesized
actgggaattataacatctt

SEQ ID NO: 299303 - DNA, 20 bp, Artificial Sequence
  chemically synthesized
tctaaagatgttataattcc

SEQ ID NO: 299304 - DNA, 20 bp, Artificial Sequence
  chemically synthesized
ataggctttttattataact

SEQ ID NO: 299305 - DNA, 20 bp, Artificial Sequence
  chemically synthesized
tataggctttttattataac

SEQ ID NO: 299306 - DNA, 20 bp, Artificial Sequence
  chemically synthesized
taattcccagttataataaa

SEQ ID NO: 299307 - DNA, 20 bp, Artificial Sequence
  chemically synthesized
taaaccactgaagagtttat

SEQ ID NO: 299308 - DNA, 20 bp, Artificial Sequence
  chemically synthesized
gtaaaccactgaagagttta

SEQ ID NO: 299309 - DNA, 20 bp, Artificial Sequence
  chemically synthesized
taaaaagcctataaactctt

SEQ ID NO: 299310 - DNA, 20 bp, Artificial Sequence
  chemically synthesized
aaagcctataaactcttcag

SEQ ID NO: 299311 - DNA, 20 bp, Artificial Sequence
  chemically synthesized
gtgctgtgtaaaccactgaa

SEQ ID NO: 299312 - DNA, 20 bp, Artificial Sequence
  chemically synthesized
aggtgctgtgtaaaccactg

SEQ ID NO: 299313 - DNA, 20 bp, Artificial Sequence
  chemically synthesized
aaactcttcagtggtttaca

SEQ ID NO: 299314 - DNA, 20 bp, Artificial Sequence
  chemically synthesized
tcagtggtttacacagcacc

SEQ ID NO: 299315 - DNA, 20 bp, Artificial Sequence
  chemically synthesized
gtcatctgtcacattgttcc

SEQ ID NO: 299316 - DNA, 20 bp, Artificial Sequence
  chemically synthesized
tgtcatctgtcacattgttc

SEQ ID NO: 299317 - DNA, 20 bp, Artificial Sequence
  chemically synthesized
cagcacctggaacaatgtga

SEQ ID NO: 299318 - DNA, 20 bp, Artificial Sequence
  chemically synthesized
tggaacaatgtgacagatga

SEQ ID NO: 299319 - DNA, 20 bp, Artificial Sequence
  chemically synthesized
gaacaatgtgacagatgaca

SEQ ID NO: 299320 - DNA, 20 bp, Artificial Sequence
  chemically synthesized
aacaatgtgacagatgacag

SEQ ID NO: 299321 - DNA, 20 bp, Artificial Sequence
  chemically synthesized
atgacagaggactctgtctt

SEQ ID NO: 299322 - DNA, 20 bp, Artificial Sequence
  chemically synthesized
gtttccactaactgaagaca

SEQ ID NO: 299323 - DNA, 20 bp, Artificial Sequence
  chemically synthesized
cagtttccactaactgaaga

SEQ ID NO: 299324 - DNA, 20 bp, Artificial Sequence
  chemically synthesized
cagaggactctgtcttcagt

SEQ ID NO: 299325 - DNA, 20 bp, Artificial Sequence
  chemically synthesized
aggactctgtcttcagttag

SEQ ID NO: 299326 - DNA, 20 bp, Artificial Sequence
  chemically synthesized
atagcagtttccactaactg

SEQ ID NO: 299327 - DNA, 20 bp, Artificial Sequence
  chemically synthesized
tgataggaatgttaatatag

SEQ ID NO: 299328 - DNA, 20 bp, Artificial Sequence
  chemically synthesized
ttttgataggaatgttaata

SEQ ID NO: 299329 - DNA, 20 bp, Artificial Sequence
  chemically synthesized
aggaaaaatagatttttgat

SEQ ID NO: 299330 - DNA, 20 bp, Artificial Sequence
  chemically synthesized
aaggaaaaatagatttttga

SEQ ID NO: 299331 - DNA, 20 bp, Artificial Sequence
  chemically synthesized
catgcaaatataaggaaaaa

SEQ ID NO: 299332 - DNA, 20 bp, Artificial Sequence
  chemically synthesized
tttgagaccatgcaaatata

SEQ ID NO: 299333 - DNA, 20 bp, Artificial Sequence
  chemically synthesized
atttgagaccatgcaaatat

SEQ ID NO: 299334 - DNA, 20 bp, Artificial Sequence
  chemically synthesized
tatttttccttatatttgca

SEQ ID NO: 299335 - DNA, 20 bp, Artificial Sequence
  chemically synthesized
ataaaactagaaatacattt

SEQ ID NO: 299336 - DNA, 20 bp, Artificial Sequence
  chemically synthesized
catggtctcaaatgtatttc

SEQ ID NO: 299337 - DNA, 20 bp, Artificial Sequence
  chemically synthesized
taaaattacacatataaaac

SEQ ID NO: 299338 - DNA, 20 bp, Artificial Sequence
  chemically synthesized
agttttatatgtgtaatttt

SEQ ID NO: 299339 - DNA, 20 bp, Artificial Sequence
  chemically synthesized
actgaaacatattattttat

SEQ ID NO: 299340 - DNA, 20 bp, Artificial Sequence
  chemically synthesized
actcataaaataatatgttt

SEQ ID NO: 299341 - DNA, 20 bp, Artificial Sequence
  chemically synthesized
taaaataatatgtttcagta

SEQ ID NO: 299342 - DNA, 20 bp, Artificial Sequence
  chemically synthesized
acagtaaaatttaatgattt

SEQ ID NO: 299343 - DNA, 20 bp, Artificial Sequence
  chemically synthesized
atgatttcagattgcactga

SEQ ID NO: 299344 - DNA, 20 bp, Artificial Sequence
  chemically synthesized
tgatttcagattgcactgaa

SEQ ID NO: 299345 - DNA, 20 bp, Artificial Sequence
  chemically synthesized
tatcttttaaagatgccttt

SEQ ID NO: 299346 - DNA, 20 bp, Artificial Sequence
  chemically synthesized
gcactgaaaggcatctttaa

SEQ ID NO: 299347 - DNA, 20 bp, Artificial Sequence
  chemically synthesized
tgattttttagtatctttta

SEQ ID NO: 299348 - DNA, 20 bp, Artificial Sequence
  chemically synthesized
cgccacagaaattgattttt

SEQ ID NO: 299349 - DNA, 20 bp, Artificial Sequence
  chemically synthesized
tactaaaaaatcaatttctg

SEQ ID NO: 299350 - DNA, 20 bp, Artificial Sequence
  chemically synthesized
ttaggacaaggtaaacgcca

SEQ ID NO: 299351 - DNA, 20 bp, Artificial Sequence
  chemically synthesized
aataggcatattttaggaca

SEQ ID NO: 299352 - DNA, 20 bp, Artificial Sequence
  chemically synthesized
aaataggcatattttaggac

SEQ ID NO: 299353 - DNA, 20 bp, Artificial Sequence
  chemically synthesized
atgttaaataggcatatttt

SEQ ID NO: 299354 - DNA, 20 bp, Artificial Sequence
  chemically synthesized
catgttaaataggcatattt

SEQ ID NO: 299355 - DNA, 20 bp, Artificial Sequence
  chemically synthesized
ttttgaggcacatgttaaat

SEQ ID NO: 299356 - DNA, 20 bp, Artificial Sequence
  chemically synthesized
cttttgaggcacatgttaaa

SEQ ID NO: 299357 - DNA, 20 bp, Artificial Sequence
  chemically synthesized
ctatttaacatgtgcctcaa

SEQ ID NO: 299358 - DNA, 20 bp, Artificial Sequence
  chemically synthesized
ggactagaattcagcttttg

SEQ ID NO: 299359 - DNA, 20 bp, Artificial Sequence
  chemically synthesized
tggactagaattcagctttt

SEQ ID NO: 299360 - DNA, 20 bp, Artificial Sequence
  chemically synthesized
gtgcctcaaaagctgaattc

SEQ ID NO: 299361 - DNA, 20 bp, Artificial Sequence
  chemically synthesized
tttgtgcttggactagaatt

SEQ ID NO: 299362 - DNA, 20 bp, Artificial Sequence
  chemically synthesized
caaaagctgaattctagtcc

SEQ ID NO: 299363 - DNA, 20 bp, Artificial Sequence
  chemically synthesized
acaatattttgtgcttggac

SEQ ID NO: 299364 - DNA, 20 bp, Artificial Sequence
  chemically synthesized
taaggacaatattttgtgct

SEQ ID NO: 299365 - DNA, 20 bp, Artificial Sequence
  chemically synthesized
aaagaagatgtacaatttta

SEQ ID NO: 299366 - DNA, 20 bp, Artificial Sequence
  chemically synthesized
taaagaagatgtacaatttt

SEQ ID NO: 299367 - DNA, 20 bp, Artificial Sequence
  chemically synthesized
tgccataattgataataaag

SEQ ID NO: 299368 - DNA, 20 bp, Artificial Sequence
  chemically synthesized
gtatgccataattgataata

SEQ ID NO: 299369 - DNA, 20 bp, Artificial Sequence
  chemically synthesized
atcttctttattatcaatta

SEQ ID NO: 299370 - DNA, 20 bp, Artificial Sequence
  chemically synthesized
aacatactaagtatataatt

SEQ ID NO: 299371 - DNA, 20 bp, Artificial Sequence
  chemically synthesized
ggcataccgaattatatact

SEQ ID NO: 299372 - DNA, 20 bp, Artificial Sequence
  chemically synthesized
gcagaatttttaaacatact

SEQ ID NO: 299373 - DNA, 20 bp, Artificial Sequence
  chemically synthesized
agggcatgtattttaaaaag

SEQ ID NO: 299374 - DNA, 20 bp, Artificial Sequence
  chemically synthesized
gcaagggcatgtattttaaa

SEQ ID NO: 299375 - DNA, 20 bp, Artificial Sequence
  chemically synthesized
atcattcaatttgtatgcaa

SEQ ID NO: 299376 - DNA, 20 bp, Artificial Sequence
  chemically synthesized
aatcattcaatttgtatgca

SEQ ID NO: 299377 - DNA, 20 bp, Artificial Sequence
  chemically synthesized
aaatcattcaatttgtatgc

SEQ ID NO: 299378 - DNA, 20 bp, Artificial Sequence
  chemically synthesized
attgaatgatttaatgtttt

SEQ ID NO: 299379 - DNA, 20 bp, Artificial Sequence
  chemically synthesized
tcagacatttttggcattaa

SEQ ID NO: 299380 - DNA, 20 bp, Artificial Sequence
  chemically synthesized
ccaaataactcagacatttt

SEQ ID NO: 299381 - DNA, 20 bp, Artificial Sequence
  chemically synthesized
tattaatgccaaaaatgtct

SEQ ID NO: 299382 - DNA, 20 bp, Artificial Sequence
  chemically synthesized
ccaaaaatgtctgagttatt

SEQ ID NO: 299383 - DNA, 20 bp, Artificial Sequence
  chemically synthesized
aatatcaataccaaataact

SEQ ID NO: 299384 - DNA, 20 bp, Artificial Sequence
  chemically synthesized
tttggtattgatattcatct

SEQ ID NO: 299385 - DNA, 20 bp, Artificial Sequence
  chemically synthesized
tcaacgattctatgggtgcc

SEQ ID NO: 299386 - DNA, 20 bp, Artificial Sequence
  chemically synthesized
gatattcatcttggcaccca

SEQ ID NO: 299387 - DNA, 20 bp, Artificial Sequence
  chemically synthesized
actgcaatcaacgattctat

SEQ ID NO: 299388 - DNA, 20 bp, Artificial Sequence
  chemically synthesized
cactgcaatcaacgattcta

SEQ ID NO: 299389 - DNA, 20 bp, Artificial Sequence
  chemically synthesized
acccatagaatcgttgattg

SEQ ID NO: 299390 - DNA, 20 bp, Artificial Sequence
  chemically synthesized
tagaatcgttgattgcagtg

SEQ ID NO: 299391 - DNA, 20 bp, Artificial Sequence
  chemically synthesized
gaatcgttgattgcagtgaa

SEQ ID NO: 299392 - DNA, 20 bp, Artificial Sequence
  chemically synthesized
agagaagcaatattttacag

SEQ ID NO: 299393 - DNA, 20 bp, Artificial Sequence
  chemically synthesized
tgcagagaagcaatatttta

SEQ ID NO: 299394 - DNA, 20 bp, Artificial Sequence
  chemically synthesized
aagttttactttgtgcagag

SEQ ID NO: 299395 - DNA, 20 bp, Artificial Sequence
  chemically synthesized
aaatattgcttctctgcaca

SEQ ID NO: 299396 - DNA, 20 bp, Artificial Sequence
  chemically synthesized
ggtaagttttactttgtgca

SEQ ID NO: 299397 - DNA, 20 bp, Artificial Sequence
  chemically synthesized
taggtaagttttactttgtg

SEQ ID NO: 299398 - DNA, 20 bp, Artificial Sequence
  chemically synthesized
gacgtcaaaatattttaggt

SEQ ID NO: 299399 - DNA, 20 bp, Artificial Sequence
  chemically synthesized
accagacgtcaaaatatttt

SEQ ID NO: 299400 - DNA, 20 bp, Artificial Sequence
  chemically synthesized
taccagacgtcaaaatattt

SEQ ID NO: 299401 - DNA, 20 bp, Artificial Sequence
  chemically synthesized
acctaaaatattttgacgtc

SEQ ID NO: 299402 - DNA, 20 bp, Artificial Sequence
  chemically synthesized
taaaatattttgacgtctgg

SEQ ID NO: 299403 - DNA, 20 bp, Artificial Sequence
  chemically synthesized
aaaatattttgacgtctggt

SEQ ID NO: 299404 - DNA, 20 bp, Artificial Sequence
  chemically synthesized
atattttgacgtctggtagg

SEQ ID NO: 299405 - DNA, 20 bp, Artificial Sequence
  chemically synthesized
ttaacatcatttctacctac

SEQ ID NO: 299406 - DNA, 20 bp, Artificial Sequence
  chemically synthesized
taataccaaattaaggtagg

SEQ ID NO: 299407 - DNA, 20 bp, Artificial Sequence
  chemically synthesized
atttaataccaaattaaggt

SEQ ID NO: 299408 - DNA, 20 bp, Artificial Sequence
  chemically synthesized
gatttaataccaaattaagg

SEQ ID NO: 299409 - DNA, 20 bp, Artificial Sequence
  chemically synthesized
ataatcttcctaccttaatt

SEQ ID NO: 299410 - DNA, 20 bp, Artificial Sequence
  chemically synthesized
taagatttaataccaaatta

SEQ ID NO: 299411 - DNA, 20 bp, Artificial Sequence
  chemically synthesized
ttaagatttaataccaaatt

SEQ ID NO: 299412 - DNA, 20 bp, Artificial Sequence
  chemically synthesized
caatgaattttgaaatgatt

SEQ ID NO: 299413 - DNA, 20 bp, Artificial Sequence
  chemically synthesized
ttaatcatttcaaaattcat

SEQ ID NO: 299414 - DNA, 20 bp, Artificial Sequence
  chemically synthesized
attggtaatatttatttcta

SEQ ID NO: 299415 - DNA, 20 bp, Artificial Sequence
  chemically synthesized
tgttcaatcatgtcacactt

SEQ ID NO: 299416 - DNA, 20 bp, Artificial Sequence
  chemically synthesized
taaagtgtgacatgattgaa

SEQ ID NO: 299417 - DNA, 20 bp, Artificial Sequence
  chemically synthesized
tgaacagatgtcacatttat

SEQ ID NO: 299418 - DNA, 20 bp, Artificial Sequence
  chemically synthesized
agttttgtttaaatatcttt

SEQ ID NO: 299419 - DNA, 20 bp, Artificial Sequence
  chemically synthesized
ttttgtttaaatatctttga

SEQ ID NO: 299420 - DNA, 20 bp, Artificial Sequence
  chemically synthesized
ttttaaggttgtttctctca

SEQ ID NO: 299421 - DNA, 20 bp, Artificial Sequence
  chemically synthesized
ttcttaccttttaattttta

SEQ ID NO: 299422 - DNA, 20 bp, Artificial Sequence
  chemically synthesized
tttcttaccttttaattttt

SEQ ID NO: 299423 - DNA, 20 bp, Artificial Sequence
  chemically synthesized
gaaacaaccttaaaaattaa

SEQ ID NO: 299424 - DNA, 20 bp, Artificial Sequence
  chemically synthesized
aaacaaccttaaaaattaaa

SEQ ID NO: 299425 - DNA, 20 bp, Artificial Sequence
  chemically synthesized
aaccttaaaaattaaaaggt

SEQ ID NO: 299426 - DNA, 20 bp, Artificial Sequence
  chemically synthesized
tgacattttagaatttgtgg

SEQ ID NO: 299427 - DNA, 20 bp, Artificial Sequence
  chemically synthesized
ctgacattttagaatttgtg

SEQ ID NO: 299428 - DNA, 20 bp, Artificial Sequence
  chemically synthesized
tctgacattttagaatttgt

SEQ ID NO: 299429 - DNA, 20 bp, Artificial Sequence
  chemically synthesized
atctgacattttagaatttg

SEQ ID NO: 299430 - DNA, 20 bp, Artificial Sequence
  chemically synthesized
ccccacaaattctaaaatgt

SEQ ID NO: 299431 - DNA, 20 bp, Artificial Sequence
  chemically synthesized
tgtagcagtatctgacattt

SEQ ID NO: 299432 - DNA, 20 bp, Artificial Sequence
  chemically synthesized
aatgtcagatactgctacat

SEQ ID NO: 299433 - DNA, 20 bp, Artificial Sequence
  chemically synthesized
aactaattcctctaatgtag

SEQ ID NO: 299434 - DNA, 20 bp, Artificial Sequence
  chemically synthesized
tgtcagatactgctacatta

SEQ ID NO: 299435 - DNA, 20 bp, Artificial Sequence
  chemically synthesized
gtcagatactgctacattag

SEQ ID NO: 299436 - DNA, 20 bp, Artificial Sequence
  chemically synthesized
tataactaattcctctaatg

SEQ ID NO: 299437 - DNA, 20 bp, Artificial Sequence
  chemically synthesized
tactgctacattagaggaat

SEQ ID NO: 299438 - DNA, 20 bp, Artificial Sequence
  chemically synthesized
cattagaggaattagttata

SEQ ID NO: 299439 - DNA, 20 bp, Artificial Sequence
  chemically synthesized
gaggaattagttataaagcc

SEQ ID NO: 299440 - DNA, 20 bp, Artificial Sequence
  chemically synthesized
aggaattagttataaagcca

SEQ ID NO: 299441 - DNA, 20 bp, Artificial Sequence
  chemically synthesized
gaattagttataaagccaag

SEQ ID NO: 299442 - DNA, 20 bp, Artificial Sequence
  chemically synthesized
ccacgtgttttcacactcct

SEQ ID NO: 299443 - DNA, 20 bp, Artificial Sequence
  chemically synthesized
ccaaggagtgtgaaaacacg

SEQ ID NO: 299444 - DNA, 20 bp, Artificial Sequence
  chemically synthesized
caaggagtgtgaaaacacgt

SEQ ID NO: 299445 - DNA, 20 bp, Artificial Sequence
  chemically synthesized
tgggcaaaaactgcatgacc

SEQ ID NO: 299446 - DNA, 20 bp, Artificial Sequence
  chemically synthesized
ttcccatcctctgggtcatg

SEQ ID NO: 299447 - DNA, 20 bp, Artificial Sequence
  chemically synthesized
ggcaaaaactgcatgaccca

SEQ ID NO: 299448 - DNA, 20 bp, Artificial Sequence
  chemically synthesized
gcaaaaactgcatgacccag

SEQ ID NO: 299449 - DNA, 20 bp, Artificial Sequence
  chemically synthesized
aaactgcatgacccagagga

SEQ ID NO: 299450 - DNA, 20 bp, Artificial Sequence
  chemically synthesized
aactgcatgacccagaggat

SEQ ID NO: 299451 - DNA, 20 bp, Artificial Sequence
  chemically synthesized
cattttatttcccatcctct

SEQ ID NO: 299452 - DNA, 20 bp, Artificial Sequence
  chemically synthesized
gcattttatttcccatcctc

SEQ ID NO: 299453 - DNA, 20 bp, Artificial Sequence
  chemically synthesized
atgggaaataaaatgctgct

SEQ ID NO: 299454 - DNA, 20 bp, Artificial Sequence
  chemically synthesized
tttaggcatctgtggcttag

SEQ ID NO: 299455 - DNA, 20 bp, Artificial Sequence
  chemically synthesized
aataaaatgctgctaagcca

SEQ ID NO: 299456 - DNA, 20 bp, Artificial Sequence
  chemically synthesized
ggctttaggcatctgtggct

SEQ ID NO: 299457 - DNA, 20 bp, Artificial Sequence
  chemically synthesized
aaataggctttaggcatctg

SEQ ID NO: 299458 - DNA, 20 bp, Artificial Sequence
  chemically synthesized
tgctaagccacagatgccta

SEQ ID NO: 299459 - DNA, 20 bp, Artificial Sequence
  chemically synthesized
gaaaatgaaaaataggcttt

SEQ ID NO: 299460 - DNA, 20 bp, Artificial Sequence
  chemically synthesized
tgaaaatgaaaaataggctt

SEQ ID NO: 299461 - DNA, 20 bp, Artificial Sequence
  chemically synthesized
atttattgaaaatgaaaaat

SEQ ID NO: 299462 - DNA, 20 bp, Artificial Sequence
  chemically synthesized
aatttattgaaaatgaaaaa

SEQ ID NO: 299463 - DNA, 20 bp, Artificial Sequence
  chemically synthesized
tttcattttcaataaattga

SEQ ID NO: 299464 - DNA, 20 bp, Artificial Sequence
  chemically synthesized
gcacagaagtgtgtttcaaa

SEQ ID NO: 299465 - DNA, 20 bp, Artificial Sequence
  chemically synthesized
tgcacagaagtgtgtttcaa

SEQ ID NO: 299466 - DNA, 20 bp, Artificial Sequence
  chemically synthesized
ttgcacagaagtgtgtttca

SEQ ID NO: 299467 - DNA, 20 bp, Artificial Sequence
  chemically synthesized
tttgaaacacacttctgtgc

SEQ ID NO: 299468 - DNA, 20 bp, Artificial Sequence
  chemically synthesized
aaggtgattttcttgcacag

SEQ ID NO: 299469 - DNA, 20 bp, Artificial Sequence
  chemically synthesized
gttaaggtgattttcttgca

SEQ ID NO: 299470 - DNA, 20 bp, Artificial Sequence
  chemically synthesized
gcaagaaaatcaccttaaca

SEQ ID NO: 299471 - DNA, 20 bp, Artificial Sequence
  chemically synthesized
caagaaaatcaccttaacac

SEQ ID NO: 299472 - DNA, 20 bp, Artificial Sequence
  chemically synthesized
atttctattaacctgtgtta

SEQ ID NO: 299473 - DNA, 20 bp, Artificial Sequence
  chemically synthesized
tatttctattaacctgtgtt

SEQ ID NO: 299474 - DNA, 20 bp, Artificial Sequence
  chemically synthesized
atcaccttaacacaggttaa

SEQ ID NO: 299475 - DNA, 20 bp, Artificial Sequence
  chemically synthesized
ggatttcatctatcatttaa

SEQ ID NO: 299476 - DNA, 20 bp, Artificial Sequence
  chemically synthesized
agaaatattctcttaaatga

SEQ ID NO: 299477 - DNA, 20 bp, Artificial Sequence
  chemically synthesized
caggatttcatctatcattt

SEQ ID NO: 299478 - DNA, 20 bp, Artificial Sequence
  chemically synthesized
aatgatagatgaaatcctgt

SEQ ID NO: 299479 - DNA, 20 bp, Artificial Sequence
  chemically synthesized
tgatagatgaaatcctgtca

SEQ ID NO: 299480 - DNA, 20 bp, Artificial Sequence
  chemically synthesized
catagatttattactctgac

SEQ ID NO: 299481 - DNA, 20 bp, Artificial Sequence
  chemically synthesized
tcatagatttattactctga

SEQ ID NO: 299482 - DNA, 20 bp, Artificial Sequence
  chemically synthesized
tatattatattgtatgatca

SEQ ID NO: 299483 - DNA, 20 bp, Artificial Sequence
  chemically synthesized
tcatacaatataatatactc

SEQ ID NO: 299484 - DNA, 20 bp, Artificial Sequence
  chemically synthesized
tgactcaggattttcaactt

SEQ ID NO: 299485 - DNA, 20 bp, Artificial Sequence
  chemically synthesized
atactcaagttgaaaatcct

SEQ ID NO: 299486 - DNA, 20 bp, Artificial Sequence
  chemically synthesized
gattttaaaatatatgactc

SEQ ID NO: 299487 - DNA, 20 bp, Artificial Sequence
  chemically synthesized
tgattttaaaatatatgact

SEQ ID NO: 299488 - DNA, 20 bp, Artificial Sequence
  chemically synthesized
atattttaaaatcaaatgta

SEQ ID NO: 299489 - DNA, 20 bp, Artificial Sequence
  chemically synthesized
tttaaaatgatgaaacccaa

SEQ ID NO: 299490 - DNA, 20 bp, Artificial Sequence
  chemically synthesized
taaggacataggcagctttt

SEQ ID NO: 299491 - DNA, 20 bp, Artificial Sequence
  chemically synthesized
ataaggacataggcagcttt

SEQ ID NO: 299492 - DNA, 20 bp, Artificial Sequence
  chemically synthesized
atttatcataaggacatagg

SEQ ID NO: 299493 - DNA, 20 bp, Artificial Sequence
  chemically synthesized
tttatttatcataaggacat

SEQ ID NO: 299494 - DNA, 20 bp, Artificial Sequence
  chemically synthesized
atttatttatcataaggaca

SEQ ID NO: 299495 - DNA, 20 bp, Artificial Sequence
  chemically synthesized
acccacatttatttatcata

SEQ ID NO: 299496 - DNA, 20 bp, Artificial Sequence
  chemically synthesized
gacccacatttatttatcat

SEQ ID NO: 299497 - DNA, 20 bp, Artificial Sequence
  chemically synthesized
gtccttatgataaataaatg

SEQ ID NO: 299498 - DNA, 20 bp, Artificial Sequence
  chemically synthesized
tccttatgataaataaatgt

SEQ ID NO: 299499 - DNA, 20 bp, Artificial Sequence
  chemically synthesized
gataaataaatgtgggtcac

SEQ ID NO: 299500 - DNA, 20 bp, Artificial Sequence
  chemically synthesized
taaataaatgtgggtcacta

SEQ ID NO: 299501 - DNA, 20 bp, Artificial Sequence
  chemically synthesized
aaataaatgtgggtcactag

SEQ ID NO: 299502 - DNA, 20 bp, Artificial Sequence
  chemically synthesized
aataaatgtgggtcactaga

SEQ ID NO: 299503 - DNA, 20 bp, Artificial Sequence
  chemically synthesized
gaaagggaatgtgcgccctc

SEQ ID NO: 299504 - DNA, 20 bp, Artificial Sequence
  chemically synthesized
agagggcgcacattcccttt

SEQ ID NO: 299505 - DNA, 20 bp, Artificial Sequence
  chemically synthesized
agggcgcacattccctttca

SEQ ID NO: 299506 - DNA, 20 bp, Artificial Sequence
  chemically synthesized
attgaagacaagctctgaaa

SEQ ID NO: 299507 - DNA, 20 bp, Artificial Sequence
  chemically synthesized
aattgaagacaagctctgaa

SEQ ID NO: 299508 - DNA, 20 bp, Artificial Sequence
  chemically synthesized
aaattgaagacaagctctga

SEQ ID NO: 299509 - DNA, 20 bp, Artificial Sequence
  chemically synthesized
aaagaagccaaattgaagac

SEQ ID NO: 299510 - DNA, 20 bp, Artificial Sequence
  chemically synthesized
ttcagagcttgtcttcaatt

SEQ ID NO: 299511 - DNA, 20 bp, Artificial Sequence
  chemically synthesized
aaacgaaagaagccaaattg

SEQ ID NO: 299512 - DNA, 20 bp, Artificial Sequence
  chemically synthesized
tgcagataagaaaacgaaag

SEQ ID NO: 299513 - DNA, 20 bp, Artificial Sequence
  chemically synthesized
ttatgcagataagaaaacga

SEQ ID NO: 299514 - DNA, 20 bp, Artificial Sequence
  chemically synthesized
catattttcgttatgcagat

SEQ ID NO: 299515 - DNA, 20 bp, Artificial Sequence
  chemically synthesized
gtcaccatattttcgttatg

SEQ ID NO: 299516 - DNA, 20 bp, Artificial Sequence
  chemically synthesized
ttatctgcataacgaaaata

SEQ ID NO: 299517 - DNA, 20 bp, Artificial Sequence
  chemically synthesized
ggtgacaaatgaaattttca

SEQ ID NO: 299518 - DNA, 20 bp, Artificial Sequence
  chemically synthesized
gacaaatgaaattttcatgg

SEQ ID NO: 299519 - DNA, 20 bp, Artificial Sequence
  chemically synthesized
tcatggaagttttacttaca

SEQ ID NO: 299520 - DNA, 20 bp, Artificial Sequence
  chemically synthesized
gacattttatatttctgtgt

SEQ ID NO: 299521 - DNA, 20 bp, Artificial Sequence
  chemically synthesized
acagaaatataaaatgtcca

SEQ ID NO: 299522 - DNA, 20 bp, Artificial Sequence
  chemically synthesized
atataaaatgtccaaagata

SEQ ID NO: 299523 - DNA, 20 bp, Artificial Sequence
  chemically synthesized
cactattttatctatatctt

SEQ ID NO: 299524 - DNA, 20 bp, Artificial Sequence
  chemically synthesized
gtccaaagatatagataaaa

SEQ ID NO: 299525 - DNA, 20 bp, Artificial Sequence
  chemically synthesized
atagtgtacaaataatatgt

SEQ ID NO: 299526 - DNA, 20 bp, Artificial Sequence
  chemically synthesized
tgtacaaataatatgtaagt

SEQ ID NO: 299527 - DNA, 20 bp, Artificial Sequence
  chemically synthesized
atatgtaagtaagacactct

SEQ ID NO: 299528 - DNA, 20 bp, Artificial Sequence
  chemically synthesized
cattttaacagtgcatctga

SEQ ID NO: 299529 - DNA, 20 bp, Artificial Sequence
  chemically synthesized
ggcattttaacagtgcatct

SEQ ID NO: 299530 - DNA, 20 bp, Artificial Sequence
  chemically synthesized
aatggctgaaggcattttaa

SEQ ID NO: 299531 - DNA, 20 bp, Artificial Sequence
  chemically synthesized
atgcactgttaaaatgcctt

SEQ ID NO: 299532 - DNA, 20 bp, Artificial Sequence
  chemically synthesized
gtgtacctcaaaatggctga

SEQ ID NO: 299533 - DNA, 20 bp, Artificial Sequence
  chemically synthesized
tgtgtacctcaaaatggctg

SEQ ID NO: 299534 - DNA, 20 bp, Artificial Sequence
  chemically synthesized
aaaatgccttcagccatttt

SEQ ID NO: 299535 - DNA, 20 bp, Artificial Sequence
  chemically synthesized
aaatgccttcagccattttg

SEQ ID NO: 299536 - DNA, 20 bp, Artificial Sequence
  chemically synthesized
cttttgtgtgtacctcaaaa

SEQ ID NO: 299537 - DNA, 20 bp, Artificial Sequence
  chemically synthesized
ccattttgaggtacacacaa

SEQ ID NO: 299538 - DNA, 20 bp, Artificial Sequence
  chemically synthesized
gtacacacaaaagtaccttg

SEQ ID NO: 299539 - DNA, 20 bp, Artificial Sequence
  chemically synthesized
ttctatgtattatggcttca

SEQ ID NO: 299540 - DNA, 20 bp, Artificial Sequence
  chemically synthesized
attctatgtattatggcttc

SEQ ID NO: 299541 - DNA, 20 bp, Artificial Sequence
  chemically synthesized
taccttgaagccataataca

SEQ ID NO: 299542 - DNA, 20 bp, Artificial Sequence
  chemically synthesized
tcaagggattctatgtatta

SEQ ID NO: 299543 - DNA, 20 bp, Artificial Sequence
  chemically synthesized
cataatacatagaatccctt

SEQ ID NO: 299544 - DNA, 20 bp, Artificial Sequence
  chemically synthesized
ctgtggacatattttctcaa

SEQ ID NO: 299545 - DNA, 20 bp, Artificial Sequence
  chemically synthesized
actgtggacatattttctca

SEQ ID NO: 299546 - DNA, 20 bp, Artificial Sequence
  chemically synthesized
aactgtggacatattttctc

SEQ ID NO: 299547 - DNA, 20 bp, Artificial Sequence
  chemically synthesized
cccttgagaaaatatgtcca

SEQ ID NO: 299548 - DNA, 20 bp, Artificial Sequence
  chemically synthesized
gagaaaatatgtccacagtt

SEQ ID NO: 299549 - DNA, 20 bp, Artificial Sequence
  chemically synthesized
gaaaatatgtccacagtttg

SEQ ID NO: 299550 - DNA, 20 bp, Artificial Sequence
  chemically synthesized
aagcatgactctccaaactg

SEQ ID NO: 299551 - DNA, 20 bp, Artificial Sequence
  chemically synthesized
aaatatgtccacagtttgga

SEQ ID NO: 299552 - DNA, 20 bp, Artificial Sequence
  chemically synthesized
acagtttggagagtcatgct

SEQ ID NO: 299553 - DNA, 20 bp, Artificial Sequence
  chemically synthesized
tttactaaattatttgaact

SEQ ID NO: 299554 - DNA, 20 bp, Artificial Sequence
  chemically synthesized
catgcttagttcaaataatt

SEQ ID NO: 299555 - DNA, 20 bp, Artificial Sequence
  chemically synthesized
aataatttagtaaaattttc

SEQ ID NO: 299556 - DNA, 20 bp, Artificial Sequence
  chemically synthesized
gtaaaattttctggattatg

SEQ ID NO: 299557 - DNA, 20 bp, Artificial Sequence
  chemically synthesized
aaactacttgctacataatc

SEQ ID NO: 299558 - DNA, 20 bp, Artificial Sequence
  chemically synthesized
aattttctggattatgtagc

SEQ ID NO: 299559 - DNA, 20 bp, Artificial Sequence
  chemically synthesized
tttctggattatgtagcaag

SEQ ID NO: 299560 - DNA, 20 bp, Artificial Sequence
  chemically synthesized
agcaagtagttttccttccc

SEQ ID NO: 299561 - DNA, 20 bp, Artificial Sequence
  chemically synthesized
taaaatcaatgaacttggga

SEQ ID NO: 299562 - DNA, 20 bp, Artificial Sequence
  chemically synthesized
ttaaaatcaatgaacttggg

SEQ ID NO: 299563 - DNA, 20 bp, Artificial Sequence
  chemically synthesized
tagttaaaatcaatgaactt

SEQ ID NO: 299564 - DNA, 20 bp, Artificial Sequence
  chemically synthesized
ttagttaaaatcaatgaact

SEQ ID NO: 299565 - DNA, 20 bp, Artificial Sequence
  chemically synthesized
ttaactaaacattcaaaaat

SEQ ID NO: 299566 - DNA, 20 bp, Artificial Sequence
  chemically synthesized
ttaactaatttttgaatgtt

SEQ ID NO: 299567 - DNA, 20 bp, Artificial Sequence
  chemically synthesized
tgaatgtttagttaaatatg

SEQ ID NO: 299568 - DNA, 20 bp, Artificial Sequence
  chemically synthesized
taagcagatttttagagtac

SEQ ID NO: 299569 - DNA, 20 bp, Artificial Sequence
  chemically synthesized
taattttaagcagattttta

SEQ ID NO: 299570 - DNA, 20 bp, Artificial Sequence
  chemically synthesized
tataattttaagcagatttt

SEQ ID NO: 299571 - DNA, 20 bp, Artificial Sequence
  chemically synthesized
tttaggagtataattttaag

SEQ ID NO: 299572 - DNA, 20 bp, Artificial Sequence
  chemically synthesized
tgatttaggagtataatttt

SEQ ID NO: 299573 - DNA, 20 bp, Artificial Sequence
  chemically synthesized
aaaaactttaggtgatttag

SEQ ID NO: 299574 - DNA, 20 bp, Artificial Sequence
  chemically synthesized
taaaaaactttaggtgattt

SEQ ID NO: 299575 - DNA, 20 bp, Artificial Sequence
  chemically synthesized
ttaaaaaactttaggtgatt

SEQ ID NO: 299576 - DNA, 20 bp, Artificial Sequence
  chemically synthesized
ttatactcctaaatcaccta

SEQ ID NO: 299577 - DNA, 20 bp, Artificial Sequence
  chemically synthesized
ttggcattttaaaaaacttt

SEQ ID NO: 299578 - DNA, 20 bp, Artificial Sequence
  chemically synthesized
tttggcattttaaaaaactt

SEQ ID NO: 299579 - DNA, 20 bp, Artificial Sequence
  chemically synthesized
tttaaatttgaatgaaagtt

SEQ ID NO: 299580 - DNA, 20 bp, Artificial Sequence
  chemically synthesized
tgttctttaaatttgaatga

SEQ ID NO: 299581 - DNA, 20 bp, Artificial Sequence
  chemically synthesized
caaactttcattcaaattta

SEQ ID NO: 299582 - DNA, 20 bp, Artificial Sequence
  chemically synthesized
tttcattcaaatttaaagaa

SEQ ID NO: 299583 - DNA, 20 bp, Artificial Sequence
  chemically synthesized
ttcaaatttaaagaacagaa

SEQ ID NO: 299584 - DNA, 20 bp, Artificial Sequence
  chemically synthesized
caaatttaaagaacagaaaa

SEQ ID NO: 299585 - DNA, 20 bp, Artificial Sequence
  chemically synthesized
agagacatatatatcatttt

SEQ ID NO: 299586 - DNA, 20 bp, Artificial Sequence
  chemically synthesized
atcattttaagcatcttaat

SEQ ID NO: 299587 - DNA, 20 bp, Artificial Sequence
  chemically synthesized
tcattttaagcatcttaatc

SEQ ID NO: 299588 - DNA, 20 bp, Artificial Sequence
  chemically synthesized
tgaaagcctgtgacctgatt

SEQ ID NO: 299589 - DNA, 20 bp, Artificial Sequence
  chemically synthesized
taagcatcttaatcaggtca

SEQ ID NO: 299590 - DNA, 20 bp, Artificial Sequence
  chemically synthesized
aagcatcttaatcaggtcac

SEQ ID NO: 299591 - DNA, 20 bp, Artificial Sequence
  chemically synthesized
tcaggtcacaggctttcaaa

SEQ ID NO: 299592 - DNA, 20 bp, Artificial Sequence
  chemically synthesized
cgattaagttttctttttga

SEQ ID NO: 299593 - DNA, 20 bp, Artificial Sequence
  chemically synthesized
acaaggtttcttgagcgatt

SEQ ID NO: 299594 - DNA, 20 bp, Artificial Sequence
  chemically synthesized
aaaagaaaacttaatcgctc

SEQ ID NO: 299595 - DNA, 20 bp, Artificial Sequence
  chemically synthesized
gataacatacaaggtttctt

SEQ ID NO: 299596 - DNA, 20 bp, Artificial Sequence
  chemically synthesized
gctattacagataacataca

SEQ ID NO: 299597 - DNA, 20 bp, Artificial Sequence
  chemically synthesized
agctattacagataacatac

SEQ ID NO: 299598 - DNA, 20 bp, Artificial Sequence
  chemically synthesized
accttgtatgttatctgtaa

SEQ ID NO: 299599 - DNA, 20 bp, Artificial Sequence
  chemically synthesized
tgcaaaaataaaagctatta

SEQ ID NO: 299600 - DNA, 20 bp, Artificial Sequence
  chemically synthesized
tgatcaatctgcaaaaataa

SEQ ID NO: 299601 - DNA, 20 bp, Artificial Sequence
  chemically synthesized
tgtaatagcttttatttttg

SEQ ID NO: 299602 - DNA, 20 bp, Artificial Sequence
  chemically synthesized
ttttgcagattgatcatgaa

SEQ ID NO: 299603 - DNA, 20 bp, Artificial Sequence
  chemically synthesized
cagattgatcatgaatagaa

SEQ ID NO: 299604 - DNA, 20 bp, Artificial Sequence
  chemically synthesized
gatcatgaatagaaaagttg

SEQ ID NO: 299605 - DNA, 20 bp, Artificial Sequence
  chemically synthesized
aaaagttgaagatcttcatt

SEQ ID NO: 299606 - DNA, 20 bp, Artificial Sequence
  chemically synthesized
ctgtgtattgaaactaaatg

SEQ ID NO: 299607 - DNA, 20 bp, Artificial Sequence
  chemically synthesized
cttcatttagtttcaataca

SEQ ID NO: 299608 - DNA, 20 bp, Artificial Sequence
  chemically synthesized
tttagtttcaatacacagtg

SEQ ID NO: 299609 - DNA, 20 bp, Artificial Sequence
  chemically synthesized
tcaatacacagtgaagcact

SEQ ID NO: 299610 - DNA, 20 bp, Artificial Sequence
  chemically synthesized
acacagtgaagcactgagtc

SEQ ID NO: 299611 - DNA, 20 bp, Artificial Sequence
  chemically synthesized
cctgttcttgagtcttgact

SEQ ID NO: 299612 - DNA, 20 bp, Artificial Sequence
  chemically synthesized
gaagcactgagtcaagactc

SEQ ID NO: 299613 - DNA, 20 bp, Artificial Sequence
  chemically synthesized
actgagtcaagactcaagaa

SEQ ID NO: 299614 - DNA, 20 bp, Artificial Sequence
  chemically synthesized
ctgagtcaagactcaagaac

SEQ ID NO: 299615 - DNA, 20 bp, Artificial Sequence
  chemically synthesized
attcagacagacctgttctt

SEQ ID NO: 299616 - DNA, 20 bp, Artificial Sequence
  chemically synthesized
tagaaatctttggattcaga

SEQ ID NO: 299617 - DNA, 20 bp, Artificial Sequence
  chemically synthesized
aacaggtctgtctgaatcca

SEQ ID NO: 299618 - DNA, 20 bp, Artificial Sequence
  chemically synthesized
gttgtagaaatctttggatt

SEQ ID NO: 299619 - DNA, 20 bp, Artificial Sequence
  chemically synthesized
tgtagtgttgtagaaatctt

SEQ ID NO: 299620 - DNA, 20 bp, Artificial Sequence
  chemically synthesized
aaaagaaaaatgtagtgttg

SEQ ID NO: 299621 - DNA, 20 bp, Artificial Sequence
  chemically synthesized
tttggaacaaaagaaaaatg

SEQ ID NO: 299622 - DNA, 20 bp, Artificial Sequence
  chemically synthesized
ttctcgtttatttggaacaa

SEQ ID NO: 299623 - DNA, 20 bp, Artificial Sequence
  chemically synthesized
ttcttttgttccaaataaac

SEQ ID NO: 299624 - DNA, 20 bp, Artificial Sequence
  chemically synthesized
agatgggtttctcgtttatt

SEQ ID NO: 299625 - DNA, 20 bp, Artificial Sequence
  chemically synthesized
ccttattttttttttaagat

SEQ ID NO: 299626 - DNA, 20 bp, Artificial Sequence
  chemically synthesized
tccttattttttttttaaga

SEQ ID NO: 299627 - DNA, 20 bp, Artificial Sequence
  chemically synthesized
cttatccttatttttttttt

SEQ ID NO: 299628 - DNA, 20 bp, Artificial Sequence
  chemically synthesized
acccatcttaaaaaaaaaat

SEQ ID NO: 299629 - DNA, 20 bp, Artificial Sequence
  chemically synthesized
cccatcttaaaaaaaaaata

SEQ ID NO: 299630 - DNA, 20 bp, Artificial Sequence
  chemically synthesized
cttaaaaaaaaaataaggat

SEQ ID NO: 299631 - DNA, 20 bp, Artificial Sequence
  chemically synthesized
aaaataaggataagtcaata

SEQ ID NO: 299632 - DNA, 20 bp, Artificial Sequence
  chemically synthesized
ctgtactgtgtagcaatgaa

SEQ ID NO: 299633 - DNA, 20 bp, Artificial Sequence
  chemically synthesized
aattactgttcattgctaca

SEQ ID NO: 299634 - DNA, 20 bp, Artificial Sequence
  chemically synthesized
ctgttcattgctacacagta

SEQ ID NO: 299635 - DNA, 20 bp, Artificial Sequence
  chemically synthesized
cactaaattactgtactgtg

SEQ ID NO: 299636 - DNA, 20 bp, Artificial Sequence
  chemically synthesized
tgctacacagtacagtaatt

SEQ ID NO: 299637 - DNA, 20 bp, Artificial Sequence
  chemically synthesized
tacacagtacagtaatttag

SEQ ID NO: 299638 - DNA, 20 bp, Artificial Sequence
  chemically synthesized
tcatataatccaagatagcg

SEQ ID NO: 299639 - DNA, 20 bp, Artificial Sequence
  chemically synthesized
tggttttgactacgctatct

SEQ ID NO: 299640 - DNA, 20 bp, Artificial Sequence
  chemically synthesized
aattctcatataatccaaga

SEQ ID NO: 299641 - DNA, 20 bp, Artificial Sequence
  chemically synthesized
atcaaattctcatataatcc

SEQ ID NO: 299642 - DNA, 20 bp, Artificial Sequence
  chemically synthesized
tacgctatcttggattatat

SEQ ID NO: 299643 - DNA, 20 bp, Artificial Sequence
  chemically synthesized
attatatgagaatttgattg

SEQ ID NO: 299644 - DNA, 20 bp, Artificial Sequence
  chemically synthesized
ttgattgaagtctctaatat

SEQ ID NO: 299645 - DNA, 20 bp, Artificial Sequence
  chemically synthesized
tgattgaagtctctaatatc

SEQ ID NO: 299646 - DNA, 20 bp, Artificial Sequence
  chemically synthesized
gaattaatatcctgatatta

SEQ ID NO: 299647 - DNA, 20 bp, Artificial Sequence
  chemically synthesized
cagaattaatatcctgatat

SEQ ID NO: 299648 - DNA, 20 bp, Artificial Sequence
  chemically synthesized
catattttaatgaaaaattt

SEQ ID NO: 299649 - DNA, 20 bp, Artificial Sequence
  chemically synthesized
tttcattaaaatatgatcct

SEQ ID NO: 299650 - DNA, 20 bp, Artificial Sequence
  chemically synthesized
gggtacaaagtatacaacta

SEQ ID NO: 299651 - DNA, 20 bp, Artificial Sequence
  chemically synthesized
agggtacaaagtatacaact

SEQ ID NO: 299652 - DNA, 20 bp, Artificial Sequence
  chemically synthesized
tatattgccattagggtaca

SEQ ID NO: 299653 - DNA, 20 bp, Artificial Sequence
  chemically synthesized
ttgtatactttgtaccctaa

SEQ ID NO: 299654 - DNA, 20 bp, Artificial Sequence
  chemically synthesized
attattttatattgccatta

SEQ ID NO: 299655 - DNA, 20 bp, Artificial Sequence
  chemically synthesized
aattattttatattgccatt

SEQ ID NO: 299656 - DNA, 20 bp, Artificial Sequence
  chemically synthesized
aaattattttatattgccat

SEQ ID NO: 299657 - DNA, 20 bp, Artificial Sequence
  chemically synthesized
ttccaaggtaataataaatt

SEQ ID NO: 299658 - DNA, 20 bp, Artificial Sequence
  chemically synthesized
attccaaggtaataataaat

SEQ ID NO: 299659 - DNA, 20 bp, Artificial Sequence
  chemically synthesized
ttcccaatttattattacct

SEQ ID NO: 299660 - DNA, 20 bp, Artificial Sequence
  chemically synthesized
ggaaattaagggaaattcca

SEQ ID NO: 299661 - DNA, 20 bp, Artificial Sequence
  chemically synthesized
aggaaattaagggaaattcc

SEQ ID NO: 299662 - DNA, 20 bp, Artificial Sequence
  chemically synthesized
tgaggattttaggaaattaa

SEQ ID NO: 299663 - DNA, 20 bp, Artificial Sequence
  chemically synthesized
ttgaggattttaggaaatta

SEQ ID NO: 299664 - DNA, 20 bp, Artificial Sequence
  chemically synthesized
gttgaggattttaggaaatt

SEQ ID NO: 299665 - DNA, 20 bp, Artificial Sequence
  chemically synthesized
attagaaagttgaggatttt

SEQ ID NO: 299666 - DNA, 20 bp, Artificial Sequence
  chemically synthesized
gattagaaagttgaggattt

SEQ ID NO: 299667 - DNA, 20 bp, Artificial Sequence
  chemically synthesized
atcatcagattagaaagttg

SEQ ID NO: 299668 - DNA, 20 bp, Artificial Sequence
  chemically synthesized
tatcatcagattagaaagtt

SEQ ID NO: 299669 - DNA, 20 bp, Artificial Sequence
  chemically synthesized
aattgtatcatcagattaga

SEQ ID NO: 299670 - DNA, 20 bp, Artificial Sequence
  chemically synthesized
gagaaattgtatcatcagat

SEQ ID NO: 299671 - DNA, 20 bp, Artificial Sequence
  chemically synthesized
gatgtgagaaattgtatcat

SEQ ID NO: 299672 - DNA, 20 bp, Artificial Sequence
  chemically synthesized
gatgatacaatttctcacat

SEQ ID NO: 299673 - DNA, 20 bp, Artificial Sequence
  chemically synthesized
tgatacaatttctcacatca

SEQ ID NO: 299674 - DNA, 20 bp, Artificial Sequence
  chemically synthesized
cttaatattttctctgatgt

SEQ ID NO: 299675 - DNA, 20 bp, Artificial Sequence
  chemically synthesized
ctcacatcagagaaaatatt

SEQ ID NO: 299676 - DNA, 20 bp, Artificial Sequence
  chemically synthesized
atcagagaaaatattaagca

SEQ ID NO: 299677 - DNA, 20 bp, Artificial Sequence
  chemically synthesized
atattaagcatagatgaaaa

SEQ ID NO: 299678 - DNA, 20 bp, Artificial Sequence
  chemically synthesized
taaccacattatataataag

SEQ ID NO: 299679 - DNA, 20 bp, Artificial Sequence
  chemically synthesized
tcttaaccacattatataat

SEQ ID NO: 299680 - DNA, 20 bp, Artificial Sequence
  chemically synthesized
ttactacttattatataatg

SEQ ID NO: 299681 - DNA, 20 bp, Artificial Sequence
  chemically synthesized
acttattatataatgtggtt

SEQ ID NO: 299682 - DNA, 20 bp, Artificial Sequence
  chemically synthesized
atataatgtggttaagacca

SEQ ID NO: 299683 - DNA, 20 bp, Artificial Sequence
  chemically synthesized
aatgtggttaagaccatggt

SEQ ID NO: 299684 - DNA, 20 bp, Artificial Sequence
  chemically synthesized
aagacttttggagctcacca

SEQ ID NO: 299685 - DNA, 20 bp, Artificial Sequence
  chemically synthesized
aagaccatggtgagctccaa

SEQ ID NO: 299686 - DNA, 20 bp, Artificial Sequence
  chemically synthesized
ttccaagtgcaagacttttg

SEQ ID NO: 299687 - DNA, 20 bp, Artificial Sequence
  chemically synthesized
ttttccaagtgcaagacttt

SEQ ID NO: 299688 - DNA, 20 bp, Artificial Sequence
  chemically synthesized
agctccaaaagtcttgcact

SEQ ID NO: 299689 - DNA, 20 bp, Artificial Sequence
  chemically synthesized
gaacttttttttccaagtgc

SEQ ID NO: 299690 - DNA, 20 bp, Artificial Sequence
  chemically synthesized
ataattgaacttttttttcc

SEQ ID NO: 299691 - DNA, 20 bp, Artificial Sequence
  chemically synthesized
agtcttgcacttggaaaaaa

SEQ ID NO: 299692 - DNA, 20 bp, Artificial Sequence
  chemically synthesized
gaaaaaaaagttcaattata

SEQ ID NO: 299693 - DNA, 20 bp, Artificial Sequence
  chemically synthesized
ttttcagcatcaaaaataag

SEQ ID NO: 299694 - DNA, 20 bp, Artificial Sequence
  chemically synthesized
tctttttcagcatcaaaaat

SEQ ID NO: 299695 - DNA, 20 bp, Artificial Sequence
  chemically synthesized
acttatttttgatgctgaaa

SEQ ID NO: 299696 - DNA, 20 bp, Artificial Sequence
  chemically synthesized
taaaatttagatgtcttttt

SEQ ID NO: 299697 - DNA, 20 bp, Artificial Sequence
  chemically synthesized
aaaaagacatctaaatttta

SEQ ID NO: 299698 - DNA, 20 bp, Artificial Sequence
  chemically synthesized
gaaaagatttctttaaaatt

SEQ ID NO: 299699 - DNA, 20 bp, Artificial Sequence
  chemically synthesized
aaattttaaagaaatctttt

SEQ ID NO: 299700 - DNA, 20 bp, Artificial Sequence
  chemically synthesized
cagagacctttttcactgaa

SEQ ID NO: 299701 - DNA, 20 bp, Artificial Sequence
  chemically synthesized
aagaaatcttttcagtgaaa

SEQ ID NO: 299702 - DNA, 20 bp, Artificial Sequence
  chemically synthesized
agaaatcttttcagtgaaaa

SEQ ID NO: 299703 - DNA, 20 bp, Artificial Sequence
  chemically synthesized
cttgattatctttaaataca

SEQ ID NO: 299704 - DNA, 20 bp, Artificial Sequence
  chemically synthesized
gaaaaaggtctctgtattta

SEQ ID NO: 299705 - DNA, 20 bp, Artificial Sequence
  chemically synthesized
cacttgattatctttaaata

SEQ ID NO: 299706 - DNA, 20 bp, Artificial Sequence
  chemically synthesized
ctctgtatttaaagataatc

SEQ ID NO: 299707 - DNA, 20 bp, Artificial Sequence
  chemically synthesized
aagataatcaagtgttgcca

SEQ ID NO: 299708 - DNA, 20 bp, Artificial Sequence
  chemically synthesized
agataatcaagtgttgccat

SEQ ID NO: 299709 - DNA, 20 bp, Artificial Sequence
  chemically synthesized
tcattgactctagtgtccca

SEQ ID NO: 299710 - DNA, 20 bp, Artificial Sequence
  chemically synthesized
caagtgttgccatgggacac

SEQ ID NO: 299711 - DNA, 20 bp, Artificial Sequence
  chemically synthesized
agtgttgccatgggacacta

SEQ ID NO: 299712 - DNA, 20 bp, Artificial Sequence
  chemically synthesized
ttctgaagtatcattgactc

SEQ ID NO: 299713 - DNA, 20 bp, Artificial Sequence
  chemically synthesized
cactagagtcaatgatactt

SEQ ID NO: 299714 - DNA, 20 bp, Artificial Sequence
  chemically synthesized
gtcaatgatacttcagaatg

SEQ ID NO: 299715 - DNA, 20 bp, Artificial Sequence
  chemically synthesized
tatgtctgttctacattctg

SEQ ID NO: 299716 - DNA, 20 bp, Artificial Sequence
  chemically synthesized
tgatacttcagaatgtagaa

SEQ ID NO: 299717 - DNA, 20 bp, Artificial Sequence
  chemically synthesized
aatgtagaacagacataatc

SEQ ID NO: 299718 - DNA, 20 bp, Artificial Sequence
  chemically synthesized
gaacagacataatctagaat

SEQ ID NO: 299719 - DNA, 20 bp, Artificial Sequence
  chemically synthesized
tatggaagctgcacttattc

SEQ ID NO: 299720 - DNA, 20 bp, Artificial Sequence
  chemically synthesized
gacataatctagaataagtg

SEQ ID NO: 299721 - DNA, 20 bp, Artificial Sequence
  chemically synthesized
tagaataagtgcagcttcca

SEQ ID NO: 299722 - DNA, 20 bp, Artificial Sequence
  chemically synthesized
gaatttgccaaagtctatgg

SEQ ID NO: 299723 - DNA, 20 bp, Artificial Sequence
  chemically synthesized
agtgcagcttccatagactt

SEQ ID NO: 299724 - DNA, 20 bp, Artificial Sequence
  chemically synthesized
taagaatttgccaaagtcta

SEQ ID NO: 299725 - DNA, 20 bp, Artificial Sequence
  chemically synthesized
gactccttaagaatttgcca

SEQ ID NO: 299726 - DNA, 20 bp, Artificial Sequence
  chemically synthesized
atagactttggcaaattctt

SEQ ID NO: 299727 - DNA, 20 bp, Artificial Sequence
  chemically synthesized
tagactttggcaaattctta

SEQ ID NO: 299728 - DNA, 20 bp, Artificial Sequence
  chemically synthesized
gactttggcaaattcttaag

SEQ ID NO: 299729 - DNA, 20 bp, Artificial Sequence
  chemically synthesized
atgcttgactgggactcctt

SEQ ID NO: 299730 - DNA, 20 bp, Artificial Sequence
  chemically synthesized
ggcaaattcttaaggagtcc

SEQ ID NO: 299731 - DNA, 20 bp, Artificial Sequence
  chemically synthesized
attcttaaggagtcccagtc

SEQ ID NO: 299732 - DNA, 20 bp, Artificial Sequence
  chemically synthesized
ctgaaataaaatgcttgact

SEQ ID NO: 299733 - DNA, 20 bp, Artificial Sequence
  chemically synthesized
gctgaaataaaatgcttgac

SEQ ID NO: 299734 - DNA, 20 bp, Artificial Sequence
  chemically synthesized
cccagtcaagcattttattt

SEQ ID NO: 299735 - DNA, 20 bp, Artificial Sequence
  chemically synthesized
ggtgatttcatcaaattatt

SEQ ID NO: 299736 - DNA, 20 bp, Artificial Sequence
  chemically synthesized
gctatgttgtaataagttaa

SEQ ID NO: 299737 - DNA, 20 bp, Artificial Sequence
  chemically synthesized
tgctatgttgtaataagtta

SEQ ID NO: 299738 - DNA, 20 bp, Artificial Sequence
  chemically synthesized
tcgccttgctatgttgtaat

SEQ ID NO: 299739 - DNA, 20 bp, Artificial Sequence
  chemically synthesized
acctttaacttattacaaca

SEQ ID NO: 299740 - DNA, 20 bp, Artificial Sequence
  chemically synthesized
ttaacttattacaacatagc

SEQ ID NO: 299741 - DNA, 20 bp, Artificial Sequence
  chemically synthesized
taacttattacaacatagca

SEQ ID NO: 299742 - DNA, 20 bp, Artificial Sequence
  chemically synthesized
ttattacaacatagcaaggc

SEQ ID NO: 299743 - DNA, 20 bp, Artificial Sequence
  chemically synthesized
tattacaacatagcaaggcg

SEQ ID NO: 299744 - DNA, 20 bp, Artificial Sequence
  chemically synthesized
agcaaggcgaggaatttccg

SEQ ID NO: 299745 - DNA, 20 bp, Artificial Sequence
  chemically synthesized
gcaaggcgaggaatttccga

SEQ ID NO: 299746 - DNA, 20 bp, Artificial Sequence
  chemically synthesized
ctagcttagggtgttgcctt

SEQ ID NO: 299747 - DNA, 20 bp, Artificial Sequence
  chemically synthesized
atttccgaaggcaacaccct

SEQ ID NO: 299748 - DNA, 20 bp, Artificial Sequence
  chemically synthesized
ccgaaggcaacaccctaagc

SEQ ID NO: 299749 - DNA, 20 bp, Artificial Sequence
  chemically synthesized
cgaaggcaacaccctaagct

SEQ ID NO: 299750 - DNA, 20 bp, Artificial Sequence
  chemically synthesized
aacccagacagcctagctta

SEQ ID NO: 299751 - DNA, 20 bp, Artificial Sequence
  chemically synthesized
gaacccagacagcctagctt

SEQ ID NO: 299752 - DNA, 20 bp, Artificial Sequence
  chemically synthesized
tgaacccagacagcctagct

SEQ ID NO: 299753 - DNA, 20 bp, Artificial Sequence
  chemically synthesized
acaccctaagctaggctgtc

SEQ ID NO: 299754 - DNA, 20 bp, Artificial Sequence
  chemically synthesized
ggatttgaacccagacagcc

SEQ ID NO: 299755 - DNA, 20 bp, Artificial Sequence
  chemically synthesized
caccctaagctaggctgtct

SEQ ID NO: 299756 - DNA, 20 bp, Artificial Sequence
  chemically synthesized
agctaggatttgaacccaga

SEQ ID NO: 299757 - DNA, 20 bp, Artificial Sequence
  chemically synthesized
tcgcagctaggatttgaacc

SEQ ID NO: 299758 - DNA, 20 bp, Artificial Sequence
  chemically synthesized
ggctgtctgggttcaaatcc

SEQ ID NO: 299759 - DNA, 20 bp, Artificial Sequence
  chemically synthesized
ttacaggaagcatcgcagct

SEQ ID NO: 299760 - DNA, 20 bp, Artificial Sequence
  chemically synthesized
tttacaggaagcatcgcagc

SEQ ID NO: 299761 - DNA, 20 bp, Artificial Sequence
  chemically synthesized
atagtttacaggaagcatcg

SEQ ID NO: 299762 - DNA, 20 bp, Artificial Sequence
  chemically synthesized
atggtcacatagtttacagg

SEQ ID NO: 299763 - DNA, 20 bp, Artificial Sequence
  chemically synthesized
ctcatggtcacatagtttac

SEQ ID NO: 299764 - DNA, 20 bp, Artificial Sequence
  chemically synthesized
gctcatggtcacatagttta

SEQ ID NO: 299765 - DNA, 20 bp, Artificial Sequence
  chemically synthesized
gtgacttgctcatggtcaca

SEQ ID NO: 299766 - DNA, 20 bp, Artificial Sequence
  chemically synthesized
cctgtaaactatgtgaccat

SEQ ID NO: 299767 - DNA, 20 bp, Artificial Sequence
  chemically synthesized
taaactatgtgaccatgagc

SEQ ID NO: 299768 - DNA, 20 bp, Artificial Sequence
  chemically synthesized
aatttcaagtgacttgctca

SEQ ID NO: 299769 - DNA, 20 bp, Artificial Sequence
  chemically synthesized
caatgtgtcatagaaatttc

SEQ ID NO: 299770 - DNA, 20 bp, Artificial Sequence
  chemically synthesized
ccaatgataacaatgtgtca

SEQ ID NO: 299771 - DNA, 20 bp, Artificial Sequence
  chemically synthesized
ctatgacacattgttatcat

SEQ ID NO: 299772 - DNA, 20 bp, Artificial Sequence
  chemically synthesized
acacattgttatcattggca

SEQ ID NO: 299773 - DNA, 20 bp, Artificial Sequence
  chemically synthesized
acattgttatcattggcaaa

SEQ ID NO: 299774 - DNA, 20 bp, Artificial Sequence
  chemically synthesized
ttaaaatagcattacgaagt

SEQ ID NO: 299775 - DNA, 20 bp, Artificial Sequence
  chemically synthesized
acacttaaaatagcattacg

SEQ ID NO: 299776 - DNA, 20 bp, Artificial Sequence
  chemically synthesized
ttacttcgtaatgctatttt

SEQ ID NO: 299777 - DNA, 20 bp, Artificial Sequence
  chemically synthesized
aatgtatttcacacttaaaa

SEQ ID NO: 299778 - DNA, 20 bp, Artificial Sequence
  chemically synthesized
gtgtgaaatacattaatatg

SEQ ID NO: 299779 - DNA, 20 bp, Artificial Sequence
  chemically synthesized
attaatatgtagcaaatact

SEQ ID NO: 299780 - DNA, 20 bp, Artificial Sequence
  chemically synthesized
aatatgtagcaaatacttgg

SEQ ID NO: 299781 - DNA, 20 bp, Artificial Sequence
  chemically synthesized
atgtagcaaatacttggtag

SEQ ID NO: 299782 - DNA, 20 bp, Artificial Sequence
  chemically synthesized
atatgtatatggcttctacc

SEQ ID NO: 299783 - DNA, 20 bp, Artificial Sequence
  chemically synthesized
aacaatagctaatatgtata

SEQ ID NO: 299784 - DNA, 20 bp, Artificial Sequence
  chemically synthesized
ggtagaagccatatacatat

SEQ ID NO: 299785 - DNA, 20 bp, Artificial Sequence
  chemically synthesized
atggaagatattaataacaa

SEQ ID NO: 299786 - DNA, 20 bp, Artificial Sequence
  chemically synthesized
cagttaaaaaaggatcatgg

SEQ ID NO: 299787 - DNA, 20 bp, Artificial Sequence
  chemically synthesized
agccagttaaaaaaggatca

SEQ ID NO: 299788 - DNA, 20 bp, Artificial Sequence
  chemically synthesized
ggcttaaagccagttaaaaa

SEQ ID NO: 299789 - DNA, 20 bp, Artificial Sequence
  chemically synthesized
ttccatgatccttttttaac

SEQ ID NO: 299790 - DNA, 20 bp, Artificial Sequence
  chemically synthesized
gggcttaaagccagttaaaa

SEQ ID NO: 299791 - DNA, 20 bp, Artificial Sequence
  chemically synthesized
atccttttttaactggcttt

SEQ ID NO: 299792 - DNA, 20 bp, Artificial Sequence
  chemically synthesized
aatggcatagggcttaaagc

SEQ ID NO: 299793 - DNA, 20 bp, Artificial Sequence
  chemically synthesized
gagaaatggcatagggctta

SEQ ID NO: 299794 - DNA, 20 bp, Artificial Sequence
  chemically synthesized
agaaagtgagaaatggcata

SEQ ID NO: 299795 - DNA, 20 bp, Artificial Sequence
  chemically synthesized
gagaaagtgagaaatggcat

SEQ ID NO: 299796 - DNA, 20 bp, Artificial Sequence
  chemically synthesized
tgagaaagtgagaaatggca

SEQ ID NO: 299797 - DNA, 20 bp, Artificial Sequence
  chemically synthesized
acacgtgagaaagtgagaaa

SEQ ID NO: 299798 - DNA, 20 bp, Artificial Sequence
  chemically synthesized
actctcacacgtgagaaagt

SEQ ID NO: 299799 - DNA, 20 bp, Artificial Sequence
  chemically synthesized
gactactctcacacgtgaga

SEQ ID NO: 299800 - DNA, 20 bp, Artificial Sequence
  chemically synthesized
tttctcactttctcacgtgt

SEQ ID NO: 299801 - DNA, 20 bp, Artificial Sequence
  chemically synthesized
atatgactactctcacacgt

SEQ ID NO: 299802 - DNA, 20 bp, Artificial Sequence
  chemically synthesized
tctcactttctcacgtgtga

SEQ ID NO: 299803 - DNA, 20 bp, Artificial Sequence
  chemically synthesized
cactttctcacgtgtgagag

SEQ ID NO: 299804 - DNA, 20 bp, Artificial Sequence
  chemically synthesized
gagagtagtcatatttgttt

SEQ ID NO: 299805 - DNA, 20 bp, Artificial Sequence
  chemically synthesized
ttactttatcagtcattaag

SEQ ID NO: 299806 - DNA, 20 bp, Artificial Sequence
  chemically synthesized
cttttactttatcagtcatt

SEQ ID NO: 299807 - DNA, 20 bp, Artificial Sequence
  chemically synthesized
tgtcttcttaatgactgata

SEQ ID NO: 299808 - DNA, 20 bp, Artificial Sequence
  chemically synthesized
aattgtggcttttactttat

SEQ ID NO: 299809 - DNA, 20 bp, Artificial Sequence
  chemically synthesized
cttaatgactgataaagtaa

SEQ ID NO: 299810 - DNA, 20 bp, Artificial Sequence
  chemically synthesized
gataaagtaaaagccacaat

SEQ ID NO: 299811 - DNA, 20 bp, Artificial Sequence
  chemically synthesized
tattcttgttattccaattg

SEQ ID NO: 299812 - DNA, 20 bp, Artificial Sequence
  chemically synthesized
aaagccacaattggaataac

SEQ ID NO: 299813 - DNA, 20 bp, Artificial Sequence
  chemically synthesized
aagaataaaaactgcaaaca

SEQ ID NO: 299814 - DNA, 20 bp, Artificial Sequence
  chemically synthesized
ctttgttatagctgtgtttg

SEQ ID NO: 299815 - DNA, 20 bp, Artificial Sequence
  chemically synthesized
ctgcaaacacagctataaca

SEQ ID NO: 299816 - DNA, 20 bp, Artificial Sequence
  chemically synthesized
atgtttcattgtctttgtta

SEQ ID NO: 299817 - DNA, 20 bp, Artificial Sequence
  chemically synthesized
aacatataaacaaaaatcaa

SEQ ID NO: 299818 - DNA, 20 bp, Artificial Sequence
  chemically synthesized
aacaaaaatcaacagcaaaa

SEQ ID NO: 299819 - DNA, 20 bp, Artificial Sequence
  chemically synthesized
ccggcactaatgggtaaaat

SEQ ID NO: 299820 - DNA, 20 bp, Artificial Sequence
  chemically synthesized
aatagtctcattttacccat

SEQ ID NO: 299821 - DNA, 20 bp, Artificial Sequence
  chemically synthesized
ttggggattccggcactaat

SEQ ID NO: 299822 - DNA, 20 bp, Artificial Sequence
  chemically synthesized
ctcattttacccattagtgc

SEQ ID NO: 299823 - DNA, 20 bp, Artificial Sequence
  chemically synthesized
tttggggattccggcactaa

SEQ ID NO: 299824 - DNA, 20 bp, Artificial Sequence
  chemically synthesized
agaacatactttggggattc

SEQ ID NO: 299825 - DNA, 20 bp, Artificial Sequence
  chemically synthesized
cattagtgccggaatcccca

SEQ ID NO: 299826 - DNA, 20 bp, Artificial Sequence
  chemically synthesized
gtcccatagaacatactttg

SEQ ID NO: 299827 - DNA, 20 bp, Artificial Sequence
  chemically synthesized
tgtcccatagaacatacttt

SEQ ID NO: 299828 - DNA, 20 bp, Artificial Sequence
  chemically synthesized
ttgtcccatagaacatactt

SEQ ID NO: 299829 - DNA, 20 bp, Artificial Sequence
  chemically synthesized
aatccccaaagtatgttcta

SEQ ID NO: 299830 - DNA, 20 bp, Artificial Sequence
  chemically synthesized
atccccaaagtatgttctat

SEQ ID NO: 299831 - DNA, 20 bp, Artificial Sequence
  chemically synthesized
ggcagaccatatttgtccca

SEQ ID NO: 299832 - DNA, 20 bp, Artificial Sequence
  chemically synthesized
tatgttctatgggacaaata

SEQ ID NO: 299833 - DNA, 20 bp, Artificial Sequence
  chemically synthesized
ttatttaccaaattagatgg

SEQ ID NO: 299834 - DNA, 20 bp, Artificial Sequence
  chemically synthesized
atatggtctgccatctaatt

SEQ ID NO: 299835 - DNA, 20 bp, Artificial Sequence
  chemically synthesized
attttatttaccaaattaga

SEQ ID NO: 299836 - DNA, 20 bp, Artificial Sequence
  chemically synthesized
taaaattttatttaccaaat

SEQ ID NO: 299837 - DNA, 20 bp, Artificial Sequence
  chemically synthesized
tttggtaaataaaattttac

SEQ ID NO: 299838 - DNA, 20 bp, Artificial Sequence
  chemically synthesized
aataaaattttactggaact

SEQ ID NO: 299839 - DNA, 20 bp, Artificial Sequence
  chemically synthesized
gaatgagcatgactgagttc

SEQ ID NO: 299840 - DNA, 20 bp, Artificial Sequence
  chemically synthesized
ataaatgaatgagcatgact

SEQ ID NO: 299841 - DNA, 20 bp, Artificial Sequence
  chemically synthesized
taaacaatgtataaatgaat

SEQ ID NO: 299842 - DNA, 20 bp, Artificial Sequence
  chemically synthesized
attcatttatacattgttta

SEQ ID NO: 299843 - DNA, 20 bp, Artificial Sequence
  chemically synthesized
cattgtttatggctgctttc

SEQ ID NO: 299844 - DNA, 20 bp, Artificial Sequence
  chemically synthesized
ctgctgctatagctagaaag

SEQ ID NO: 299845 - DNA, 20 bp, Artificial Sequence
  chemically synthesized
actctgctgctatagctaga

SEQ ID NO: 299846 - DNA, 20 bp, Artificial Sequence
  chemically synthesized
ttatggctgctttctagcta

SEQ ID NO: 299847 - DNA, 20 bp, Artificial Sequence
  chemically synthesized
tggctgctttctagctatag

SEQ ID NO: 299848 - DNA, 20 bp, Artificial Sequence
  chemically synthesized
ctcaactctgctgctatagc

SEQ ID NO: 299849 - DNA, 20 bp, Artificial Sequence
  chemically synthesized
ctgctttctagctatagcag

SEQ ID NO: 299850 - DNA, 20 bp, Artificial Sequence
  chemically synthesized
actactcaactctgctgcta

SEQ ID NO: 299851 - DNA, 20 bp, Artificial Sequence
  chemically synthesized
gctttctagctatagcagca

SEQ ID NO: 299852 - DNA, 20 bp, Artificial Sequence
  chemically synthesized
ctagctatagcagcagagtt

SEQ ID NO: 299853 - DNA, 20 bp, Artificial Sequence
  chemically synthesized
gctatagcagcagagttgag

SEQ ID NO: 299854 - DNA, 20 bp, Artificial Sequence
  chemically synthesized
ggccagagagtaaatatttt

SEQ ID NO: 299855 - DNA, 20 bp, Artificial Sequence
  chemically synthesized
gggccagagagtaaatattt

SEQ ID NO: 299856 - DNA, 20 bp, Artificial Sequence
  chemically synthesized
aacctaaaatatttactctc

SEQ ID NO: 299857 - DNA, 20 bp, Artificial Sequence
  chemically synthesized
gttttctctaaagggccaga

SEQ ID NO: 299858 - DNA, 20 bp, Artificial Sequence
  chemically synthesized
aagttttctctaaagggcca

SEQ ID NO: 299859 - DNA, 20 bp, Artificial Sequence
  chemically synthesized
atatttactctctggccctt

SEQ ID NO: 299860 - DNA, 20 bp, Artificial Sequence
  chemically synthesized
aaaagttttctctaaagggc

SEQ ID NO: 299861 - DNA, 20 bp, Artificial Sequence
  chemically synthesized
atttactctctggcccttta

SEQ ID NO: 299862 - DNA, 20 bp, Artificial Sequence
  chemically synthesized
aaagaaaagttttctctaaa

SEQ ID NO: 299863 - DNA, 20 bp, Artificial Sequence
  chemically synthesized
gaaagaaaagttttctctaa

SEQ ID NO: 299864 - DNA, 20 bp, Artificial Sequence
  chemically synthesized
ggaaagaaaagttttctcta

SEQ ID NO: 299865 - DNA, 20 bp, Artificial Sequence
  chemically synthesized
gactgggaagggggaaagaa

SEQ ID NO: 299866 - DNA, 20 bp, Artificial Sequence
  chemically synthesized
tcatagactgggaaggggga

SEQ ID NO: 299867 - DNA, 20 bp, Artificial Sequence
  chemically synthesized
aacttttctttcccccttcc

SEQ ID NO: 299868 - DNA, 20 bp, Artificial Sequence
  chemically synthesized
ggtttcatagactgggaagg

SEQ ID NO: 299869 - DNA, 20 bp, Artificial Sequence
  chemically synthesized
tggtttcatagactgggaag

SEQ ID NO: 299870 - DNA, 20 bp, Artificial Sequence
  chemically synthesized
ttggtttcatagactgggaa

SEQ ID NO: 299871 - DNA, 20 bp, Artificial Sequence
  chemically synthesized
cttggtttcatagactggga

SEQ ID NO: 299872 - DNA, 20 bp, Artificial Sequence
  chemically synthesized
ccttggtttcatagactggg

SEQ ID NO: 299873 - DNA, 20 bp, Artificial Sequence
  chemically synthesized
ttaccttggtttcatagact

SEQ ID NO: 299874 - DNA, 20 bp, Artificial Sequence
  chemically synthesized
cttaccttggtttcatagac

SEQ ID NO: 299875 - DNA, 20 bp, Artificial Sequence
  chemically synthesized
ccttcccagtctatgaaacc

SEQ ID NO: 299876 - DNA, 20 bp, Artificial Sequence
  chemically synthesized
gccatcttaccttggtttca

SEQ ID NO: 299877 - DNA, 20 bp, Artificial Sequence
  chemically synthesized
cttcccagtctatgaaacca

SEQ ID NO: 299878 - DNA, 20 bp, Artificial Sequence
  chemically synthesized
ccagtctatgaaaccaaggt

SEQ ID NO: 299879 - DNA, 20 bp, Artificial Sequence
  chemically synthesized
agagagaggccatcttacct

SEQ ID NO: 299880 - DNA, 20 bp, Artificial Sequence
  chemically synthesized
tctatgaaaccaaggtaaga

SEQ ID NO: 299881 - DNA, 20 bp, Artificial Sequence
  chemically synthesized
acttgagagttgggagagag

SEQ ID NO: 299882 - DNA, 20 bp, Artificial Sequence
  chemically synthesized
cacttgagagttgggagaga

SEQ ID NO: 299883 - DNA, 20 bp, Artificial Sequence
  chemically synthesized
ctcacttgagagttgggaga

SEQ ID NO: 299884 - DNA, 20 bp, Artificial Sequence
  chemically synthesized
atctcacttgagagttggga

SEQ ID NO: 299885 - DNA, 20 bp, Artificial Sequence
  chemically synthesized
tgatctcacttgagagttgg

SEQ ID NO: 299886 - DNA, 20 bp, Artificial Sequence
  chemically synthesized
gcctctctctcccaactctc

SEQ ID NO: 299887 - DNA, 20 bp, Artificial Sequence
  chemically synthesized
tttgatctcacttgagagtt

SEQ ID NO: 299888 - DNA, 20 bp, Artificial Sequence
  chemically synthesized
ttttgatctcacttgagagt

SEQ ID NO: 299889 - DNA, 20 bp, Artificial Sequence
  chemically synthesized
ctctctcccaactctcaagt

SEQ ID NO: 299890 - DNA, 20 bp, Artificial Sequence
  chemically synthesized
atcattttgatctcacttga

SEQ ID NO: 299891 - DNA, 20 bp, Artificial Sequence
  chemically synthesized
atatcattttgatctcactt

SEQ ID NO: 299892 - DNA, 20 bp, Artificial Sequence
  chemically synthesized
caagtgagatcaaaatgata

SEQ ID NO: 299893 - DNA, 20 bp, Artificial Sequence
  chemically synthesized
gatcaaaatgatatggttca

SEQ ID NO: 299894 - DNA, 20 bp, Artificial Sequence
  chemically synthesized
caaaatgatatggttcacag

SEQ ID NO: 299895 - DNA, 20 bp, Artificial Sequence
  chemically synthesized
tgagagagagaaatatgata

SEQ ID NO: 299896 - DNA, 20 bp, Artificial Sequence
  chemically synthesized
cattgcatatttttgagaga

SEQ ID NO: 299897 - DNA, 20 bp, Artificial Sequence
  chemically synthesized
gccattgcatatttttgaga

SEQ ID NO: 299898 - DNA, 20 bp, Artificial Sequence
  chemically synthesized
gagccattgcatatttttga

SEQ ID NO: 299899 - DNA, 20 bp, Artificial Sequence
  chemically synthesized
gggagccattgcatattttt

SEQ ID NO: 299900 - DNA, 20 bp, Artificial Sequence
  chemically synthesized
tctctctcaaaaatatgcaa

SEQ ID NO: 299901 - DNA, 20 bp, Artificial Sequence
  chemically synthesized
ttaaaccttctggtcatggg

SEQ ID NO: 299902 - DNA, 20 bp, Artificial Sequence
  chemically synthesized
atgcaatggctccccatgac

SEQ ID NO: 299903 - DNA, 20 bp, Artificial Sequence
  chemically synthesized
acttaaaccttctggtcatg

SEQ ID NO: 299904 - DNA, 20 bp, Artificial Sequence
  chemically synthesized
gacttaaaccttctggtcat

SEQ ID NO: 299905 - DNA, 20 bp, Artificial Sequence
  chemically synthesized
caatggctccccatgaccag

SEQ ID NO: 299906 - DNA, 20 bp, Artificial Sequence
  chemically synthesized
agacttaaaccttctggtca

SEQ ID NO: 299907 - DNA, 20 bp, Artificial Sequence
  chemically synthesized
aatggctccccatgaccaga

SEQ ID NO: 299908 - DNA, 20 bp, Artificial Sequence
  chemically synthesized
gcatgtagacttaaaccttc

SEQ ID NO: 299909 - DNA, 20 bp, Artificial Sequence
  chemically synthesized
tccccatgaccagaaggttt

SEQ ID NO: 299910 - DNA, 20 bp, Artificial Sequence
  chemically synthesized
caataaaagattaaggcatg

SEQ ID NO: 299911 - DNA, 20 bp, Artificial Sequence
  chemically synthesized
aggtattcaataaaagatta

SEQ ID NO: 299912 - DNA, 20 bp, Artificial Sequence
  chemically synthesized
aaggtattcaataaaagatt

SEQ ID NO: 299913 - DNA, 20 bp, Artificial Sequence
  chemically synthesized
taactaaaggtattcaataa

SEQ ID NO: 299914 - DNA, 20 bp, Artificial Sequence
  chemically synthesized
aatcttttattgaatacctt

SEQ ID NO: 299915 - DNA, 20 bp, Artificial Sequence
  chemically synthesized
gttgagttcataataactaa

SEQ ID NO: 299916 - DNA, 20 bp, Artificial Sequence
  chemically synthesized
ggttgagttcataataacta

SEQ ID NO: 299917 - DNA, 20 bp, Artificial Sequence
  chemically synthesized
tgaggttgaaaaggtaggtt

SEQ ID NO: 299918 - DNA, 20 bp, Artificial Sequence
  chemically synthesized
aggaatgaggttgaaaaggt

SEQ ID NO: 299919 - DNA, 20 bp, Artificial Sequence
  chemically synthesized
aaggaatgaggttgaaaagg

SEQ ID NO: 299920 - DNA, 20 bp, Artificial Sequence
  chemically synthesized
agtaaggaatgaggttgaaa

SEQ ID NO: 299921 - DNA, 20 bp, Artificial Sequence
  chemically synthesized
aagtaaggaatgaggttgaa

SEQ ID NO: 299922 - DNA, 20 bp, Artificial Sequence
  chemically synthesized
aagtttagaagtaaggaatg

SEQ ID NO: 299923 - DNA, 20 bp, Artificial Sequence
  chemically synthesized
gaagtttagaagtaaggaat

SEQ ID NO: 299924 - DNA, 20 bp, Artificial Sequence
  chemically synthesized
gtaaaggaagtttagaagta

SEQ ID NO: 299925 - DNA, 20 bp, Artificial Sequence
  chemically synthesized
agtaaaggaagtttagaagt

SEQ ID NO: 299926 - DNA, 20 bp, Artificial Sequence
  chemically synthesized
atgaagtaaaggaagtttag

SEQ ID NO: 299927 - DNA, 20 bp, Artificial Sequence
  chemically synthesized
agtatgaagtaaaggaagtt

SEQ ID NO: 299928 - DNA, 20 bp, Artificial Sequence
  chemically synthesized
gcagaagtatgaagtaaagg

SEQ ID NO: 299929 - DNA, 20 bp, Artificial Sequence
  chemically synthesized
ccagcagaagtatgaagtaa

SEQ ID NO: 299930 - DNA, 20 bp, Artificial Sequence
  chemically synthesized
tccagcagaagtatgaagta

SEQ ID NO: 299931 - DNA, 20 bp, Artificial Sequence
  chemically synthesized
ttgcctccagcagaagtatg

SEQ ID NO: 299932 - DNA, 20 bp, Artificial Sequence
  chemically synthesized
cctttacttcatacttctgc

SEQ ID NO: 299933 - DNA, 20 bp, Artificial Sequence
  chemically synthesized
tttacttcatacttctgctg

SEQ ID NO: 299934 - DNA, 20 bp, Artificial Sequence
  chemically synthesized
ttacttcatacttctgctgg

SEQ ID NO: 299935 - DNA, 20 bp, Artificial Sequence
  chemically synthesized
ttcttgtttgcctccagcag

SEQ ID NO: 299936 - DNA, 20 bp, Artificial Sequence
  chemically synthesized
gtattcttgtttgcctccag

SEQ ID NO: 299937 - DNA, 20 bp, Artificial Sequence
  chemically synthesized
taagtattcttgtttgcctc

SEQ ID NO: 299938 - DNA, 20 bp, Artificial Sequence
  chemically synthesized
tacttctgctggaggcaaac

SEQ ID NO: 299939 - DNA, 20 bp, Artificial Sequence
  chemically synthesized
aacaaaacttacatgggatt

SEQ ID NO: 299940 - DNA, 20 bp, Artificial Sequence
  chemically synthesized
aagaatacttaatcccatgt

SEQ ID NO: 299941 - DNA, 20 bp, Artificial Sequence
  chemically synthesized
tatgcgaacaaaacttacat

SEQ ID NO: 299942 - DNA, 20 bp, Artificial Sequence
  chemically synthesized
gtatgcgaacaaaacttaca

SEQ ID NO: 299943 - DNA, 20 bp, Artificial Sequence
  chemically synthesized
atgtaagttttgttcgcata

SEQ ID NO: 299944 - DNA, 20 bp, Artificial Sequence
  chemically synthesized
tgtaagttttgttcgcatac

SEQ ID NO: 299945 - DNA, 20 bp, Artificial Sequence
  chemically synthesized
tgacaattcattgcagggga

SEQ ID NO: 299946 - DNA, 20 bp, Artificial Sequence
  chemically synthesized
aaagtgacaattcattgcag

SEQ ID NO: 299947 - DNA, 20 bp, Artificial Sequence
  chemically synthesized
gaaagtgacaattcattgca

SEQ ID NO: 299948 - DNA, 20 bp, Artificial Sequence
  chemically synthesized
ggaaagtgacaattcattgc

SEQ ID NO: 299949 - DNA, 20 bp, Artificial Sequence
  chemically synthesized
aggaaagtgacaattcattg

SEQ ID NO: 299950 - DNA, 20 bp, Artificial Sequence
  chemically synthesized
cattgggctcaagatgagga

SEQ ID NO: 299951 - DNA, 20 bp, Artificial Sequence
  chemically synthesized
attgtcactttcctcatctt

SEQ ID NO: 299952 - DNA, 20 bp, Artificial Sequence
  chemically synthesized
gaagcattgggctcaagatg

SEQ ID NO: 299953 - DNA, 20 bp, Artificial Sequence
  chemically synthesized
ggaagcattgggctcaagat

SEQ ID NO: 299954 - DNA, 20 bp, Artificial Sequence
  chemically synthesized
agtagggaagcattgggctc

SEQ ID NO: 299955 - DNA, 20 bp, Artificial Sequence
  chemically synthesized
ttaaagagtagggaagcatt

SEQ ID NO: 299956 - DNA, 20 bp, Artificial Sequence
  chemically synthesized
attaaagagtagggaagcat

SEQ ID NO: 299957 - DNA, 20 bp, Artificial Sequence
  chemically synthesized
tggataattaaagagtaggg

SEQ ID NO: 299958 - DNA, 20 bp, Artificial Sequence
  chemically synthesized
gactggataattaaagagta

SEQ ID NO: 299959 - DNA, 20 bp, Artificial Sequence
  chemically synthesized
tgactggataattaaagagt

SEQ ID NO: 299960 - DNA, 20 bp, Artificial Sequence
  chemically synthesized
ctgactggataattaaagag

SEQ ID NO: 299961 - DNA, 20 bp, Artificial Sequence
  chemically synthesized
catctgactggataattaaa

SEQ ID NO: 299962 - DNA, 20 bp, Artificial Sequence
  chemically synthesized
agcatctgactggataatta

SEQ ID NO: 299963 - DNA, 20 bp, Artificial Sequence
  chemically synthesized
ttccctactctttaattatc

SEQ ID NO: 299964 - DNA, 20 bp, Artificial Sequence
  chemically synthesized
ctactctttaattatccagt

SEQ ID NO: 299965 - DNA, 20 bp, Artificial Sequence
  chemically synthesized
tgggaaaattagcatctgac

SEQ ID NO: 299966 - DNA, 20 bp, Artificial Sequence
  chemically synthesized
tggaagacttatgggaaaat

SEQ ID NO: 299967 - DNA, 20 bp, Artificial Sequence
  chemically synthesized
tcagatgctaattttcccat

SEQ ID NO: 299968 - DNA, 20 bp, Artificial Sequence
  chemically synthesized
gagaggcatggaagacttat

SEQ ID NO: 299969 - DNA, 20 bp, Artificial Sequence
  chemically synthesized
tgagaggcatggaagactta

SEQ ID NO: 299970 - DNA, 20 bp, Artificial Sequence
  chemically synthesized
ttcctgcttgagaggcatgg

SEQ ID NO: 299971 - DNA, 20 bp, Artificial Sequence
  chemically synthesized
cacttcctgcttgagaggca

SEQ ID NO: 299972 - DNA, 20 bp, Artificial Sequence
  chemically synthesized
ataagtcttccatgcctctc

SEQ ID NO: 299973 - DNA, 20 bp, Artificial Sequence
  chemically synthesized
agtcttccatgcctctcaag

SEQ ID NO: 299974 - DNA, 20 bp, Artificial Sequence
  chemically synthesized
gtcttccatgcctctcaagc

SEQ ID NO: 299975 - DNA, 20 bp, Artificial Sequence
  chemically synthesized
aagttcacttcctgcttgag

SEQ ID NO: 299976 - DNA, 20 bp, Artificial Sequence
  chemically synthesized
aaagttcacttcctgcttga

SEQ ID NO: 299977 - DNA, 20 bp, Artificial Sequence
  chemically synthesized
ttccatgcctctcaagcagg

SEQ ID NO: 299978 - DNA, 20 bp, Artificial Sequence
  chemically synthesized
gaaaagttcacttcctgctt

SEQ ID NO: 299979 - DNA, 20 bp, Artificial Sequence
  chemically synthesized
agaaaagttttaaggaagaa

SEQ ID NO: 299980 - DNA, 20 bp, Artificial Sequence
  chemically synthesized
atgttagaaaagttttaagg

SEQ ID NO: 299981 - DNA, 20 bp, Artificial Sequence
  chemically synthesized
aaaatgttagaaaagtttta

SEQ ID NO: 299982 - DNA, 20 bp, Artificial Sequence
  chemically synthesized
taaaatgttagaaaagtttt

SEQ ID NO: 299983 - DNA, 20 bp, Artificial Sequence
  chemically synthesized
gtactaataaaatgttagaa

SEQ ID NO: 299984 - DNA, 20 bp, Artificial Sequence
  chemically synthesized
aagaagtactaataaaatgt

SEQ ID NO: 299985 - DNA, 20 bp, Artificial Sequence
  chemically synthesized
aaacttttctaacattttat

SEQ ID NO: 299986 - DNA, 20 bp, Artificial Sequence
  chemically synthesized
cagcataaactgtcatgaag

SEQ ID NO: 299987 - DNA, 20 bp, Artificial Sequence
  chemically synthesized
ttattagtacttcttcatga

SEQ ID NO: 299988 - DNA, 20 bp, Artificial Sequence
  chemically synthesized
acccagcataaactgtcatg

SEQ ID NO: 299989 - DNA, 20 bp, Artificial Sequence
  chemically synthesized
ttcttcatgacagtttatgc

SEQ ID NO: 299990 - DNA, 20 bp, Artificial Sequence
  chemically synthesized
tcttcatgacagtttatgct

SEQ ID NO: 299991 - DNA, 20 bp, Artificial Sequence
  chemically synthesized
tgacagtttatgctgggtgc

SEQ ID NO: 299992 - DNA, 20 bp, Artificial Sequence
  chemically synthesized
tccctcaggaagcttgcacc

SEQ ID NO: 299993 - DNA, 20 bp, Artificial Sequence
  chemically synthesized
atgctgggtgcaagcttcct

SEQ ID NO: 299994 - DNA, 20 bp, Artificial Sequence
  chemically synthesized
tgctgggtgcaagcttcctg

SEQ ID NO: 299995 - DNA, 20 bp, Artificial Sequence
  chemically synthesized
gctgggtgcaagcttcctga

SEQ ID NO: 299996 - DNA, 20 bp, Artificial Sequence
  chemically synthesized
aatctaagctttccctcagg

SEQ ID NO: 299997 - DNA, 20 bp, Artificial Sequence
  chemically synthesized
ggtgcaagcttcctgaggga

SEQ ID NO: 299998 - DNA, 20 bp, Artificial Sequence
  chemically synthesized
gtaaatctaagctttccctc

SEQ ID NO: 299999 - DNA, 20 bp, Artificial Sequence
  chemically synthesized
tgtaaatctaagctttccct

SEQ ID NO: 300000 - DNA, 20 bp, Artificial Sequence
  chemically synthesized
aagcttcctgagggaaagct

SEQ ID NO: 300001 - DNA, 20 bp, Artificial Sequence
  chemically synthesized
tgagggaaagcttagattta

SEQ ID NO: 300002 - DNA, 20 bp, Artificial Sequence
  chemically synthesized
gttactttaactgtaaatct

SEQ ID NO: 300003 - DNA, 20 bp, Artificial Sequence
  chemically synthesized
aaagcttagatttacagtta

SEQ ID NO: 300004 - DNA, 20 bp, Artificial Sequence
  chemically synthesized
agatttacagttaaagtaac

SEQ ID NO: 300005 - DNA, 20 bp, Artificial Sequence
  chemically synthesized
atttacagttaaagtaactg

SEQ ID NO: 300006 - DNA, 20 bp, Artificial Sequence
  chemically synthesized
ctatggtatgtaaaacactc

SEQ ID NO: 300007 - DNA, 20 bp, Artificial Sequence
  chemically synthesized
ctggagtgttttacatacca

SEQ ID NO: 300008 - DNA, 20 bp, Artificial Sequence
  chemically synthesized
taatatctaatggattgcta

SEQ ID NO: 300009 - DNA, 20 bp, Artificial Sequence
  chemically synthesized
tacataccatagcaatccat

SEQ ID NO: 300010 - DNA, 20 bp, Artificial Sequence
  chemically synthesized
ttcactcaactaatatctaa

SEQ ID NO: 300011 - DNA, 20 bp, Artificial Sequence
  chemically synthesized
catagcaatccattagatat

SEQ ID NO: 300012 - DNA, 20 bp, Artificial Sequence
  chemically synthesized
caatccattagatattagtt

SEQ ID NO: 300013 - DNA, 20 bp, Artificial Sequence
  chemically synthesized
ttagatattagttgagtgaa

SEQ ID NO: 300014 - DNA, 20 bp, Artificial Sequence
  chemically synthesized
tagatattagttgagtgaat

SEQ ID NO: 300015 - DNA, 20 bp, Artificial Sequence
  chemically synthesized
agttgagtgaataggaaaat

SEQ ID NO: 300016 - DNA, 20 bp, Artificial Sequence
  chemically synthesized
gaaagaagagacagcaacat

SEQ ID NO: 300017 - DNA, 20 bp, Artificial Sequence
  chemically synthesized
tcatttcaagaaagaagaga

SEQ ID NO: 300018 - DNA, 20 bp, Artificial Sequence
  chemically synthesized
cacatcatttcaagaaagaa

SEQ ID NO: 300019 - DNA, 20 bp, Artificial Sequence
  chemically synthesized
tccacatcatttcaagaaag

SEQ ID NO: 300020 - DNA, 20 bp, Artificial Sequence
  chemically synthesized
gagtccacatcatttcaaga

SEQ ID NO: 300021 - DNA, 20 bp, Artificial Sequence
  chemically synthesized
ttatgagtccacatcatttc

SEQ ID NO: 300022 - DNA, 20 bp, Artificial Sequence
  chemically synthesized
tcttctttcttgaaatgatg

SEQ ID NO: 300023 - DNA, 20 bp, Artificial Sequence
  chemically synthesized
aacacttctgtagtcattat

SEQ ID NO: 300024 - DNA, 20 bp, Artificial Sequence
  chemically synthesized
atgtggactcataatgacta

SEQ ID NO: 300025 - DNA, 20 bp, Artificial Sequence
  chemically synthesized
tggactcataatgactacag

SEQ ID NO: 300026 - DNA, 20 bp, Artificial Sequence
  chemically synthesized
ggtttctttgaacacttctg

SEQ ID NO: 300027 - DNA, 20 bp, Artificial Sequence
  chemically synthesized
aatgactacagaagtgttca

SEQ ID NO: 300028 - DNA, 20 bp, Artificial Sequence
  chemically synthesized
gtcatcatccaatgcatggt

SEQ ID NO: 300029 - DNA, 20 bp, Artificial Sequence
  chemically synthesized
agtcatcatccaatgcatgg

SEQ ID NO: 300030 - DNA, 20 bp, Artificial Sequence
  chemically synthesized
caaagaaacccaccatgcat

SEQ ID NO: 300031 - DNA, 20 bp, Artificial Sequence
  chemically synthesized
ccaagtcatcatccaatgca

SEQ ID NO: 300032 - DNA, 20 bp, Artificial Sequence
  chemically synthesized
ccatgcattggatgatgact

SEQ ID NO: 300033 - DNA, 20 bp, Artificial Sequence
  chemically synthesized
aattgcctcccacagggtcc

SEQ ID NO: 300034 - DNA, 20 bp, Artificial Sequence
  chemically synthesized
ggatgatgacttggaccctg

SEQ ID NO: 300035 - DNA, 20 bp, Artificial Sequence
  chemically synthesized
gatgatgacttggaccctgt

SEQ ID NO: 300036 - DNA, 20 bp, Artificial Sequence
  chemically synthesized
tgatgacttggaccctgtgg

SEQ ID NO: 300037 - DNA, 20 bp, Artificial Sequence
  chemically synthesized
gatgacttggaccctgtggg

SEQ ID NO: 300038 - DNA, 20 bp, Artificial Sequence
  chemically synthesized
agtttaaattgcctcccaca

SEQ ID NO: 300039 - DNA, 20 bp, Artificial Sequence
  chemically synthesized
aagtttaaattgcctcccac

SEQ ID NO: 300040 - DNA, 20 bp, Artificial Sequence
  chemically synthesized
aaagtttaaattgcctccca

SEQ ID NO: 300041 - DNA, 20 bp, Artificial Sequence
  chemically synthesized
tttcacactgagagagttta

SEQ ID NO: 300042 - DNA, 20 bp, Artificial Sequence
  chemically synthesized
atttaaactttaaactctct

SEQ ID NO: 300043 - DNA, 20 bp, Artificial Sequence
  chemically synthesized
aaggacctttcacactgaga

SEQ ID NO: 300044 - DNA, 20 bp, Artificial Sequence
  chemically synthesized
tcaaggacctttcacactga

SEQ ID NO: 300045 - DNA, 20 bp, Artificial Sequence
  chemically synthesized
tttaaactctctcagtgtga

SEQ ID NO: 300046 - DNA, 20 bp, Artificial Sequence
  chemically synthesized
actcaaggacctttcacact

SEQ ID NO: 300047 - DNA, 20 bp, Artificial Sequence
  chemically synthesized
ttaaactctctcagtgtgaa

SEQ ID NO: 300048 - DNA, 20 bp, Artificial Sequence
  chemically synthesized
tctcagtgtgaaaggtcctt

SEQ ID NO: 300049 - DNA, 20 bp, Artificial Sequence
  chemically synthesized
tgtgaaaggtccttgagttt

SEQ ID NO: 300050 - DNA, 20 bp, Artificial Sequence
  chemically synthesized
gttgacttctcttaaactca

SEQ ID NO: 300051 - DNA, 20 bp, Artificial Sequence
  chemically synthesized
tgttgacttctcttaaactc

SEQ ID NO: 300052 - DNA, 20 bp, Artificial Sequence
  chemically synthesized
tgaaaggtccttgagtttaa

SEQ ID NO: 300053 - DNA, 20 bp, Artificial Sequence
  chemically synthesized
aaggtccttgagtttaagag

SEQ ID NO: 300054 - DNA, 20 bp, Artificial Sequence
  chemically synthesized
aagagaagtcaacatgcttg

SEQ ID NO: 300055 - DNA, 20 bp, Artificial Sequence
  chemically synthesized
agagaagtcaacatgcttgt

SEQ ID NO: 300056 - DNA, 20 bp, Artificial Sequence
  chemically synthesized
tttaaacttgaaagacccac

SEQ ID NO: 300057 - DNA, 20 bp, Artificial Sequence
  chemically synthesized
aacatgcttgtgggtctttc

SEQ ID NO: 300058 - DNA, 20 bp, Artificial Sequence
  chemically synthesized
tggaagttatttaaacttga

SEQ ID NO: 300059 - DNA, 20 bp, Artificial Sequence
  chemically synthesized
agtttaaataacttccaacc

SEQ ID NO: 300060 - DNA, 20 bp, Artificial Sequence
  chemically synthesized
gtttaaataacttccaaccc

SEQ ID NO: 300061 - DNA, 20 bp, Artificial Sequence
  chemically synthesized
ccttttggaacccgggttgg

SEQ ID NO: 300062 - DNA, 20 bp, Artificial Sequence
  chemically synthesized
gatccttttggaacccgggt

SEQ ID NO: 300063 - DNA, 20 bp, Artificial Sequence
  chemically synthesized
actagatccttttggaaccc

SEQ ID NO: 300064 - DNA, 20 bp, Artificial Sequence
  chemically synthesized
cactagatccttttggaacc

SEQ ID NO: 300065 - DNA, 20 bp, Artificial Sequence
  chemically synthesized
acttccaacccgggttccaa

SEQ ID NO: 300066 - DNA, 20 bp, Artificial Sequence
  chemically synthesized
cttccaacccgggttccaaa

SEQ ID NO: 300067 - DNA, 20 bp, Artificial Sequence
  chemically synthesized
cacattgcactagatccttt

SEQ ID NO: 300068 - DNA, 20 bp, Artificial Sequence
  chemically synthesized
acccgggttccaaaaggatc

SEQ ID NO: 300069 - DNA, 20 bp, Artificial Sequence
  chemically synthesized
aatggctttccacattgcac

SEQ ID NO: 300070 - DNA, 20 bp, Artificial Sequence
  chemically synthesized
caaaaggatctagtgcaatg

SEQ ID NO: 300071 - DNA, 20 bp, Artificial Sequence
  chemically synthesized
aggatctagtgcaatgtgga

SEQ ID NO: 300072 - DNA, 20 bp, Artificial Sequence
  chemically synthesized
aagtacacgtcagattgaaa

SEQ ID NO: 300073 - DNA, 20 bp, Artificial Sequence
  chemically synthesized
gtggggcattaagtacacgt

SEQ ID NO: 300074 - DNA, 20 bp, Artificial Sequence
  chemically synthesized
gatgctggcagtggggcatt

SEQ ID NO: 300075 - DNA, 20 bp, Artificial Sequence
  chemically synthesized
tgtacttaatgccccactgc

SEQ ID NO: 300076 - DNA, 20 bp, Artificial Sequence
  chemically synthesized
aggtcatgatgctggcagtg

SEQ ID NO: 300077 - DNA, 20 bp, Artificial Sequence
  chemically synthesized
caggtcatgatgctggcagt

SEQ ID NO: 300078 - DNA, 20 bp, Artificial Sequence
  chemically synthesized
acaggtcatgatgctggcag

SEQ ID NO: 300079 - DNA, 20 bp, Artificial Sequence
  chemically synthesized
gaaacaggtcatgatgctgg

SEQ ID NO: 300080 - DNA, 20 bp, Artificial Sequence
  chemically synthesized
attgaaacaggtcatgatgc

SEQ ID NO: 300081 - DNA, 20 bp, Artificial Sequence
  chemically synthesized
cacagtagatggattgaaac

SEQ ID NO: 300082 - DNA, 20 bp, Artificial Sequence
  chemically synthesized
acacagtagatggattgaaa

SEQ ID NO: 300083 - DNA, 20 bp, Artificial Sequence
  chemically synthesized
atgcttactaacacagtaga

SEQ ID NO: 300084 - DNA, 20 bp, Artificial Sequence
  chemically synthesized
tttcaatccatctactgtgt

SEQ ID NO: 300085 - DNA, 20 bp, Artificial Sequence
  chemically synthesized
agtgatgcttactaacacag

SEQ ID NO: 300086 - DNA, 20 bp, Artificial Sequence
  chemically synthesized
aatccatctactgtgttagt

SEQ ID NO: 300087 - DNA, 20 bp, Artificial Sequence
  chemically synthesized
catagtgatgcttactaaca

SEQ ID NO: 300088 - DNA, 20 bp, Artificial Sequence
  chemically synthesized
gtaagcatcactatgaactt

SEQ ID NO: 300089 - DNA, 20 bp, Artificial Sequence
  chemically synthesized
tctgttttgactaaagttca

SEQ ID NO: 300090 - DNA, 20 bp, Artificial Sequence
  chemically synthesized
tattacttctgttttgacta

SEQ ID NO: 300091 - DNA, 20 bp, Artificial Sequence
  chemically synthesized
actatgaactttagtcaaaa

SEQ ID NO: 300092 - DNA, 20 bp, Artificial Sequence
  chemically synthesized
atgaactttagtcaaaacag

SEQ ID NO: 300093 - DNA, 20 bp, Artificial Sequence
  chemically synthesized
aaccggctttgttaagcaat

SEQ ID NO: 300094 - DNA, 20 bp, Artificial Sequence
  chemically synthesized
gtaatactcattgcttaaca

SEQ ID NO: 300095 - DNA, 20 bp, Artificial Sequence
  chemically synthesized
gactaaaaaccggctttgtt

SEQ ID NO: 300096 - DNA, 20 bp, Artificial Sequence
  chemically synthesized
tactcattgcttaacaaagc

SEQ ID NO: 300097 - DNA, 20 bp, Artificial Sequence
  chemically synthesized
tgcttaacaaagccggtttt

SEQ ID NO: 300098 - DNA, 20 bp, Artificial Sequence
  chemically synthesized
agtgctagctgactaaaaac

SEQ ID NO: 300099 - DNA, 20 bp, Artificial Sequence
  chemically synthesized
taacaaagccggtttttagt

SEQ ID NO: 300100 - DNA, 20 bp, Artificial Sequence
  chemically synthesized
aaagccggtttttagtcagc

SEQ ID NO: 300101 - DNA, 20 bp, Artificial Sequence
  chemically synthesized
gtattttgttatgtaagtgc

SEQ ID NO: 300102 - DNA, 20 bp, Artificial Sequence
  chemically synthesized
tctatggtattttgttatgt

SEQ ID NO: 300103 - DNA, 20 bp, Artificial Sequence
  chemically synthesized
acttacataacaaaatacca

SEQ ID NO: 300104 - DNA, 20 bp, Artificial Sequence
  chemically synthesized
cataacaaaataccatagac

SEQ ID NO: 300105 - DNA, 20 bp, Artificial Sequence
  chemically synthesized
ataacaaaataccatagact

SEQ ID NO: 300106 - DNA, 20 bp, Artificial Sequence
  chemically synthesized
tggttaagccacccagtcta

SEQ ID NO: 300107 - DNA, 20 bp, Artificial Sequence
  chemically synthesized
acaaaataccatagactggg

SEQ ID NO: 300108 - DNA, 20 bp, Artificial Sequence
  chemically synthesized
tggctgttggttaagccacc

SEQ ID NO: 300109 - DNA, 20 bp, Artificial Sequence
  chemically synthesized
agactgggtggcttaaccaa

SEQ ID NO: 300110 - DNA, 20 bp, Artificial Sequence
  chemically synthesized
gaaataagtggctgttggtt

SEQ ID NO: 300111 - DNA, 20 bp, Artificial Sequence
  chemically synthesized
tgcgagaaataagtggctgt

SEQ ID NO: 300112 - DNA, 20 bp, Artificial Sequence
  chemically synthesized
atagaactgcgagaaataag

SEQ ID NO: 300113 - DNA, 20 bp, Artificial Sequence
  chemically synthesized
cctatagaactgcgagaaat

SEQ ID NO: 300114 - DNA, 20 bp, Artificial Sequence
  chemically synthesized
caacagccacttatttctcg

SEQ ID NO: 300115 - DNA, 20 bp, Artificial Sequence
  chemically synthesized
attgtagcctatagaactgc

SEQ ID NO: 300116 - DNA, 20 bp, Artificial Sequence
  chemically synthesized
acttatttctcgcagttcta

SEQ ID NO: 300117 - DNA, 20 bp, Artificial Sequence
  chemically synthesized
cttatttctcgcagttctat

SEQ ID NO: 300118 - DNA, 20 bp, Artificial Sequence
  chemically synthesized
aattttggaattgtagccta

SEQ ID NO: 300119 - DNA, 20 bp, Artificial Sequence
  chemically synthesized
gtaccttaattttggaattg

SEQ ID NO: 300120 - DNA, 20 bp, Artificial Sequence
  chemically synthesized
taggctacaattccaaaatt

SEQ ID NO: 300121 - DNA, 20 bp, Artificial Sequence
  chemically synthesized
aggctacaattccaaaatta

SEQ ID NO: 300122 - DNA, 20 bp, Artificial Sequence
  chemically synthesized
tcctgctggtaccttaattt

SEQ ID NO: 300123 - DNA, 20 bp, Artificial Sequence
  chemically synthesized
caattccaaaattaaggtac

SEQ ID NO: 300124 - DNA, 20 bp, Artificial Sequence
  chemically synthesized
ttccaaaattaaggtaccag

SEQ ID NO: 300125 - DNA, 20 bp, Artificial Sequence
  chemically synthesized
tccaaaattaaggtaccagc

SEQ ID NO: 300126 - DNA, 20 bp, Artificial Sequence
  chemically synthesized
aattaaggtaccagcaggat

SEQ ID NO: 300127 - DNA, 20 bp, Artificial Sequence
  chemically synthesized
tcaccaggaactgatcctgc

SEQ ID NO: 300128 - DNA, 20 bp, Artificial Sequence
  chemically synthesized
gtaccagcaggatcagttcc

SEQ ID NO: 300129 - DNA, 20 bp, Artificial Sequence
  chemically synthesized
gcaggatcagttcctggtga

SEQ ID NO: 300130 - DNA, 20 bp, Artificial Sequence
  chemically synthesized
ccaggaagaaggctgtcacc

SEQ ID NO: 300131 - DNA, 20 bp, Artificial Sequence
  chemically synthesized
gccaggaagaaggctgtcac

SEQ ID NO: 300132 - DNA, 20 bp, Artificial Sequence
  chemically synthesized
cctggtgacagccttcttcc

SEQ ID NO: 300133 - DNA, 20 bp, Artificial Sequence
  chemically synthesized
ctgtctacaagccaggaaga

SEQ ID NO: 300134 - DNA, 20 bp, Artificial Sequence
  chemically synthesized
gctgtctacaagccaggaag

SEQ ID NO: 300135 - DNA, 20 bp, Artificial Sequence
  chemically synthesized
gaggctgtctacaagccagg

SEQ ID NO: 300136 - DNA, 20 bp, Artificial Sequence
  chemically synthesized
acagccttcttcctggcttg

SEQ ID NO: 300137 - DNA, 20 bp, Artificial Sequence
  chemically synthesized
ccagaggctgtctacaagcc

SEQ ID NO: 300138 - DNA, 20 bp, Artificial Sequence
  chemically synthesized
accagaggctgtctacaagc

SEQ ID NO: 300139 - DNA, 20 bp, Artificial Sequence
  chemically synthesized
ccttcttcctggcttgtaga

SEQ ID NO: 300140 - DNA, 20 bp, Artificial Sequence
  chemically synthesized
ctataccagaggctgtctac

SEQ ID NO: 300141 - DNA, 20 bp, Artificial Sequence
  chemically synthesized
cctggcttgtagacagcctc

SEQ ID NO: 300142 - DNA, 20 bp, Artificial Sequence
  chemically synthesized
cttgtagacagcctctggta

SEQ ID NO: 300143 - DNA, 20 bp, Artificial Sequence
  chemically synthesized
gaatatccaaactataccag

SEQ ID NO: 300144 - DNA, 20 bp, Artificial Sequence
  chemically synthesized
cgaatatccaaactatacca

SEQ ID NO: 300145 - DNA, 20 bp, Artificial Sequence
  chemically synthesized
gacgaatatccaaactatac

SEQ ID NO: 300146 - DNA, 20 bp, Artificial Sequence
  chemically synthesized
agacagcctctggtatagtt

SEQ ID NO: 300147 - DNA, 20 bp, Artificial Sequence
  chemically synthesized
ttcagcataagatttgggaa

SEQ ID NO: 300148 - DNA, 20 bp, Artificial Sequence
  chemically synthesized
attcagcataagatttggga

SEQ ID NO: 300149 - DNA, 20 bp, Artificial Sequence
  chemically synthesized
aattcagcataagatttggg

SEQ ID NO: 300150 - DNA, 20 bp, Artificial Sequence
  chemically synthesized
tacaattcagcataagattt

SEQ ID NO: 300151 - DNA, 20 bp, Artificial Sequence
  chemically synthesized
ttacaattcagcataagatt

SEQ ID NO: 300152 - DNA, 20 bp, Artificial Sequence
  chemically synthesized
tggagtttacaattcagcat

SEQ ID NO: 300153 - DNA, 20 bp, Artificial Sequence
  chemically synthesized
cagcactggagtttacaatt

SEQ ID NO: 300154 - DNA, 20 bp, Artificial Sequence
  chemically synthesized
ttatgctgaattgtaaactc

SEQ ID NO: 300155 - DNA, 20 bp, Artificial Sequence
  chemically synthesized
tgaattgtaaactccagtgc

SEQ ID NO: 300156 - DNA, 20 bp, Artificial Sequence
  chemically synthesized
aggccccatttccagcactg

SEQ ID NO: 300157 - DNA, 20 bp, Artificial Sequence
  chemically synthesized
ccaggccccatttccagcac

SEQ ID NO: 300158 - DNA, 20 bp, Artificial Sequence
  chemically synthesized
gtaaactccagtgctggaaa

SEQ ID NO: 300159 - DNA, 20 bp, Artificial Sequence
  chemically synthesized
taaactccagtgctggaaat

SEQ ID NO: 300160 - DNA, 20 bp, Artificial Sequence
  chemically synthesized
aaactccagtgctggaaatg

SEQ ID NO: 300161 - DNA, 20 bp, Artificial Sequence
  chemically synthesized
ctgccaccaggccccatttc

SEQ ID NO: 300162 - DNA, 20 bp, Artificial Sequence
  chemically synthesized
ccagtgctggaaatggggcc

SEQ ID NO: 300163 - DNA, 20 bp, Artificial Sequence
  chemically synthesized
gtgctggaaatggggcctgg

SEQ ID NO: 300164 - DNA, 20 bp, Artificial Sequence
  chemically synthesized
ctggaaatggggcctggtgg

SEQ ID NO: 300165 - DNA, 20 bp, Artificial Sequence
  chemically synthesized
tggaaatggggcctggtggc

SEQ ID NO: 300166 - DNA, 20 bp, Artificial Sequence
  chemically synthesized
tgatccaaacacctgccacc

SEQ ID NO: 300167 - DNA, 20 bp, Artificial Sequence
  chemically synthesized
atgatccaaacacctgccac

SEQ ID NO: 300168 - DNA, 20 bp, Artificial Sequence
  chemically synthesized
ggggcctggtggcaggtgtt

SEQ ID NO: 300169 - DNA, 20 bp, Artificial Sequence
  chemically synthesized
ggtggcaggtgtttggatca

SEQ ID NO: 300170 - DNA, 20 bp, Artificial Sequence
  chemically synthesized
gtggcaggtgtttggatcat

SEQ ID NO: 300171 - DNA, 20 bp, Artificial Sequence
  chemically synthesized
ggcaggtgtttggatcatgg

SEQ ID NO: 300172 - DNA, 20 bp, Artificial Sequence
  chemically synthesized
aggtgtttggatcatgggag

SEQ ID NO: 300173 - DNA, 20 bp, Artificial Sequence
  chemically synthesized
tcatgggagcggatccctca

SEQ ID NO: 300174 - DNA, 20 bp, Artificial Sequence
  chemically synthesized
aagacagcactaagccgtga

SEQ ID NO: 300175 - DNA, 20 bp, Artificial Sequence
  chemically synthesized
ggagcggatccctcacggct

SEQ ID NO: 300176 - DNA, 20 bp, Artificial Sequence
  chemically synthesized
aaagacagcactaagccgtg

SEQ ID NO: 300177 - DNA, 20 bp, Artificial Sequence
  chemically synthesized
caaagacagcactaagccgt

SEQ ID NO: 300178 - DNA, 20 bp, Artificial Sequence
  chemically synthesized
actatcgcaaagacagcact

SEQ ID NO: 300179 - DNA, 20 bp, Artificial Sequence
  chemically synthesized
agaactcactatcgcaaaga

SEQ ID NO: 300180 - DNA, 20 bp, Artificial Sequence
  chemically synthesized
gcttagtgctgtctttgcga

SEQ ID NO: 300181 - DNA, 20 bp, Artificial Sequence
  chemically synthesized
caggagaactcactatcgca

SEQ ID NO: 300182 - DNA, 20 bp, Artificial Sequence
  chemically synthesized
agtgctgtctttgcgatagt

SEQ ID NO: 300183 - DNA, 20 bp, Artificial Sequence
  chemically synthesized
ttgcgatagtgagttctcct

SEQ ID NO: 300184 - DNA, 20 bp, Artificial Sequence
  chemically synthesized
gcgatagtgagttctcctga

SEQ ID NO: 300185 - DNA, 20 bp, Artificial Sequence
  chemically synthesized
ttgtaagtgagttctctcag

SEQ ID NO: 300186 - DNA, 20 bp, Artificial Sequence
  chemically synthesized
atttgtaagtgagttctctc

SEQ ID NO: 300187 - DNA, 20 bp, Artificial Sequence
  chemically synthesized
catttgtaagtgagttctct

SEQ ID NO: 300188 - DNA, 20 bp, Artificial Sequence
  chemically synthesized
ggtggcacacatttgtaagt

SEQ ID NO: 300189 - DNA, 20 bp, Artificial Sequence
  chemically synthesized
gggaggtggcacacatttgt

SEQ ID NO: 300190 - DNA, 20 bp, Artificial Sequence
  chemically synthesized
tgagacagtgcagggggagg

SEQ ID NO: 300191 - DNA, 20 bp, Artificial Sequence
  chemically synthesized
gagtgagacagtgcaggggg

SEQ ID NO: 300192 - DNA, 20 bp, Artificial Sequence
  chemically synthesized
agagtgagacagtgcagggg

SEQ ID NO: 300193 - DNA, 20 bp, Artificial Sequence
  chemically synthesized
ggagagtgagacagtgcagg

SEQ ID NO: 300194 - DNA, 20 bp, Artificial Sequence
  chemically synthesized
aggagagtgagacagtgcag

SEQ ID NO: 300195 - DNA, 20 bp, Artificial Sequence
  chemically synthesized
aaggagagtgagacagtgca

SEQ ID NO: 300196 - DNA, 20 bp, Artificial Sequence
  chemically synthesized
caaggagagtgagacagtgc

SEQ ID NO: 300197 - DNA, 20 bp, Artificial Sequence
  chemically synthesized
acaaggagagtgagacagtg

SEQ ID NO: 300198 - DNA, 20 bp, Artificial Sequence
  chemically synthesized
atgggacaaggagagtgaga

SEQ ID NO: 300199 - DNA, 20 bp, Artificial Sequence
  chemically synthesized
aagaatgggacaaggagagt

SEQ ID NO: 300200 - DNA, 20 bp, Artificial Sequence
  chemically synthesized
atggaagaatgggacaagga

SEQ ID NO: 300201 - DNA, 20 bp, Artificial Sequence
  chemically synthesized
acatggaagaatgggacaag

SEQ ID NO: 300202 - DNA, 20 bp, Artificial Sequence
  chemically synthesized
tcacatggaagaatgggaca

SEQ ID NO: 300203 - DNA, 20 bp, Artificial Sequence
  chemically synthesized
atcacatggaagaatgggac

SEQ ID NO: 300204 - DNA, 20 bp, Artificial Sequence
  chemically synthesized
gtcacatcacatggaagaat

SEQ ID NO: 300205 - DNA, 20 bp, Artificial Sequence
  chemically synthesized
agtcacatcacatggaagaa

SEQ ID NO: 300206 - DNA, 20 bp, Artificial Sequence
  chemically synthesized
gaaacagtcacatcacatgg

SEQ ID NO: 300207 - DNA, 20 bp, Artificial Sequence
  chemically synthesized
ggggaaacagtcacatcaca

SEQ ID NO: 300208 - DNA, 20 bp, Artificial Sequence
  chemically synthesized
gatggaaggcaaaggggaaa

SEQ ID NO: 300209 - DNA, 20 bp, Artificial Sequence
  chemically synthesized
aatcatgatggaaggcaaag

SEQ ID NO: 300210 - DNA, 20 bp, Artificial Sequence
  chemically synthesized
caatcatgatggaaggcaaa

SEQ ID NO: 300211 - DNA, 20 bp, Artificial Sequence
  chemically synthesized
tcaatcatgatggaaggcaa

SEQ ID NO: 300212 - DNA, 20 bp, Artificial Sequence
  chemically synthesized
ttcaatcatgatggaaggca

SEQ ID NO: 300213 - DNA, 20 bp, Artificial Sequence
  chemically synthesized
aagctttcaatcatgatgga

SEQ ID NO: 300214 - DNA, 20 bp, Artificial Sequence
  chemically synthesized
gaagctttcaatcatgatgg

SEQ ID NO: 300215 - DNA, 20 bp, Artificial Sequence
  chemically synthesized
caggaagctttcaatcatga

SEQ ID NO: 300216 - DNA, 20 bp, Artificial Sequence
  chemically synthesized
ttgccttccatcatgattga

SEQ ID NO: 300217 - DNA, 20 bp, Artificial Sequence
  chemically synthesized
atcatgattgaaagcttcct

SEQ ID NO: 300218 - DNA, 20 bp, Artificial Sequence
  chemically synthesized
gcttctggggaggtctcagg

SEQ ID NO: 300219 - DNA, 20 bp, Artificial Sequence
  chemically synthesized
tctgcttctggggaggtctc

SEQ ID NO: 300220 - DNA, 20 bp, Artificial Sequence
  chemically synthesized
gtctgcttctggggaggtct

SEQ ID NO: 300221 - DNA, 20 bp, Artificial Sequence
  chemically synthesized
aaagcttcctgagacctccc

SEQ ID NO: 300222 - DNA, 20 bp, Artificial Sequence
  chemically synthesized
gcttcctgagacctccccag

SEQ ID NO: 300223 - DNA, 20 bp, Artificial Sequence
  chemically synthesized
ggtggcgtctgcttctgggg

SEQ ID NO: 300224 - DNA, 20 bp, Artificial Sequence
  chemically synthesized
tggtggcgtctgcttctggg

SEQ ID NO: 300225 - DNA, 20 bp, Artificial Sequence
  chemically synthesized
tcctgagacctccccagaag

SEQ ID NO: 300226 - DNA, 20 bp, Artificial Sequence
  chemically synthesized
catggtggcgtctgcttctg

SEQ ID NO: 300227 - DNA, 20 bp, Artificial Sequence
  chemically synthesized
gcatggtggcgtctgcttct

SEQ ID NO: 300228 - DNA, 20 bp, Artificial Sequence
  chemically synthesized
agcatggtggcgtctgcttc

SEQ ID NO: 300229 - DNA, 20 bp, Artificial Sequence
  chemically synthesized
aagctgtagaggaagcatgg

SEQ ID NO: 300230 - DNA, 20 bp, Artificial Sequence
  chemically synthesized
tgcaagctgtagaggaagca

SEQ ID NO: 300231 - DNA, 20 bp, Artificial Sequence
  chemically synthesized
acgccaccatgcttcctcta

SEQ ID NO: 300232 - DNA, 20 bp, Artificial Sequence
  chemically synthesized
ggttctgcaagctgtagagg

SEQ ID NO: 300233 - DNA, 20 bp, Artificial Sequence
  chemically synthesized
cacggttctgcaagctgtag

SEQ ID NO: 300234 - DNA, 20 bp, Artificial Sequence
  chemically synthesized
tcacggttctgcaagctgta

SEQ ID NO: 300235 - DNA, 20 bp, Artificial Sequence
  chemically synthesized
catgcttcctctacagcttg

SEQ ID NO: 300236 - DNA, 20 bp, Artificial Sequence
  chemically synthesized
gctcacggttctgcaagctg

SEQ ID NO: 300237 - DNA, 20 bp, Artificial Sequence
  chemically synthesized
taactggctcacggttctgc

SEQ ID NO: 300238 - DNA, 20 bp, Artificial Sequence
  chemically synthesized
tctacagcttgcagaaccgt

SEQ ID NO: 300239 - DNA, 20 bp, Artificial Sequence
  chemically synthesized
cagcttgcagaaccgtgagc

SEQ ID NO: 300240 - DNA, 20 bp, Artificial Sequence
  chemically synthesized
aaattgatttaactggctca

SEQ ID NO: 300241 - DNA, 20 bp, Artificial Sequence
  chemically synthesized
tacatgaaaattgatttaac

SEQ ID NO: 300242 - DNA, 20 bp, Artificial Sequence
  chemically synthesized
agttaaatcaattttcatgt

SEQ ID NO: 300243 - DNA, 20 bp, Artificial Sequence
  chemically synthesized
caattttcatgtaagtcact

SEQ ID NO: 300244 - DNA, 20 bp, Artificial Sequence
  chemically synthesized
tcatgtaagtcactcagttg

SEQ ID NO: 300245 - DNA, 20 bp, Artificial Sequence
  chemically synthesized
catgtaagtcactcagttgc

SEQ ID NO: 300246 - DNA, 20 bp, Artificial Sequence
  chemically synthesized
ataaagaaatacctgcaact

SEQ ID NO: 300247 - DNA, 20 bp, Artificial Sequence
  chemically synthesized
ttgcaggtatttctttataa

SEQ ID NO: 300248 - DNA, 20 bp, Artificial Sequence
  chemically synthesized
gctgttcttgcactgttata

SEQ ID NO: 300249 - DNA, 20 bp, Artificial Sequence
  chemically synthesized
gtatttctttataacagtgc

SEQ ID NO: 300250 - DNA, 20 bp, Artificial Sequence
  chemically synthesized
tctttataacagtgcaagaa

SEQ ID NO: 300251 - DNA, 20 bp, Artificial Sequence
  chemically synthesized
taacagtgcaagaacagcct

SEQ ID NO: 300252 - DNA, 20 bp, Artificial Sequence
  chemically synthesized
agcaagaaggaggttgtctt

SEQ ID NO: 300253 - DNA, 20 bp, Artificial Sequence
  chemically synthesized
cagcaagaaggaggttgtct

SEQ ID NO: 300254 - DNA, 20 bp, Artificial Sequence
  chemically synthesized
gggaggacacagcaagaagg

SEQ ID NO: 300255 - DNA, 20 bp, Artificial Sequence
  chemically synthesized
tgggaggacacagcaagaag

SEQ ID NO: 300256 - DNA, 20 bp, Artificial Sequence
  chemically synthesized
cttgggaggacacagcaaga

SEQ ID NO: 300257 - DNA, 20 bp, Artificial Sequence
  chemically synthesized
ccttgggaggacacagcaag

SEQ ID NO: 300258 - DNA, 20 bp, Artificial Sequence
  chemically synthesized
ctgccttgggaggacacagc

SEQ ID NO: 300259 - DNA, 20 bp, Artificial Sequence
  chemically synthesized
ctccctgccttgggaggaca

SEQ ID NO: 300260 - DNA, 20 bp, Artificial Sequence
  chemically synthesized
ccttcttgctgtgtcctccc

SEQ ID NO: 300261 - DNA, 20 bp, Artificial Sequence
  chemically synthesized
cttcttgctgtgtcctccca

SEQ ID NO: 300262 - DNA, 20 bp, Artificial Sequence
  chemically synthesized
cttgctgtgtcctcccaagg

SEQ ID NO: 300263 - DNA, 20 bp, Artificial Sequence
  chemically synthesized
ctctttctccctgccttggg

SEQ ID NO: 300264 - DNA, 20 bp, Artificial Sequence
  chemically synthesized
ttgctgtgtcctcccaaggc

SEQ ID NO: 300265 - DNA, 20 bp, Artificial Sequence
  chemically synthesized
gctctttctccctgccttgg

SEQ ID NO: 300266 - DNA, 20 bp, Artificial Sequence
  chemically synthesized
tgctgtgtcctcccaaggca

SEQ ID NO: 300267 - DNA, 20 bp, Artificial Sequence
  chemically synthesized
tggctctttctccctgcctt

SEQ ID NO: 300268 - DNA, 20 bp, Artificial Sequence
  chemically synthesized
ctgtgtcctcccaaggcagg

SEQ ID NO: 300269 - DNA, 20 bp, Artificial Sequence
  chemically synthesized
ctggctctttctccctgcct

SEQ ID NO: 300270 - DNA, 20 bp, Artificial Sequence
  chemically synthesized
gtcctcccaaggcagggaga

SEQ ID NO: 300271 - DNA, 20 bp, Artificial Sequence
  chemically synthesized
cctcccaaggcagggagaaa

SEQ ID NO: 300272 - DNA, 20 bp, Artificial Sequence
  chemically synthesized
ccaaggcagggagaaagagc

SEQ ID NO: 300273 - DNA, 20 bp, Artificial Sequence
  chemically synthesized
ggcagggagaaagagccagc

SEQ ID NO: 300274 - DNA, 20 bp, Artificial Sequence
  chemically synthesized
agacacaacaaagagcttgc

SEQ ID NO: 300275 - DNA, 20 bp, Artificial Sequence
  chemically synthesized
ttataagaagacacaacaaa

SEQ ID NO: 300276 - DNA, 20 bp, Artificial Sequence
  chemically synthesized
ccttataagaagacacaaca

SEQ ID NO: 300277 - DNA, 20 bp, Artificial Sequence
  chemically synthesized
tctttgttgtgtcttcttat

SEQ ID NO: 300278 - DNA, 20 bp, Artificial Sequence
  chemically synthesized
ctttgttgtgtcttcttata

SEQ ID NO: 300279 - DNA, 20 bp, Artificial Sequence
  chemically synthesized
tttgttgtgtcttcttataa

SEQ ID NO: 300280 - DNA, 20 bp, Artificial Sequence
  chemically synthesized
gagattagggcccttataag

SEQ ID NO: 300281 - DNA, 20 bp, Artificial Sequence
  chemically synthesized
gaggagattagggcccttat

SEQ ID NO: 300282 - DNA, 20 bp, Artificial Sequence
  chemically synthesized
gggctcttctgaggagatta

SEQ ID NO: 300283 - DNA, 20 bp, Artificial Sequence
  chemically synthesized
agggctcttctgaggagatt

SEQ ID NO: 300284 - DNA, 20 bp, Artificial Sequence
  chemically synthesized
tataagggccctaatctcct

SEQ ID NO: 300285 - DNA, 20 bp, Artificial Sequence
  chemically synthesized
tagggctcttctgaggagat

SEQ ID NO: 300286 - DNA, 20 bp, Artificial Sequence
  chemically synthesized
aagggccctaatctcctcag

SEQ ID NO: 300287 - DNA, 20 bp, Artificial Sequence
  chemically synthesized
gggccctaatctcctcagaa

SEQ ID NO: 300288 - DNA, 20 bp, Artificial Sequence
  chemically synthesized
gaagatagggctcttctgag

SEQ ID NO: 300289 - DNA, 20 bp, Artificial Sequence
  chemically synthesized
atgaagatagggctcttctg

SEQ ID NO: 300290 - DNA, 20 bp, Artificial Sequence
  chemically synthesized
catgaagatagggctcttct

SEQ ID NO: 300291 - DNA, 20 bp, Artificial Sequence
  chemically synthesized
tagatgaggtcatgaagata

SEQ ID NO: 300292 - DNA, 20 bp, Artificial Sequence
  chemically synthesized
ttagatgaggtcatgaagat

SEQ ID NO: 300293 - DNA, 20 bp, Artificial Sequence
  chemically synthesized
tttagatgaggtcatgaaga

SEQ ID NO: 300294 - DNA, 20 bp, Artificial Sequence
  chemically synthesized
ttgatttagatgaggtcatg

SEQ ID NO: 300295 - DNA, 20 bp, Artificial Sequence
  chemically synthesized
aagataatttgatttagatg

SEQ ID NO: 300296 - DNA, 20 bp, Artificial Sequence
  chemically synthesized
gaagataatttgatttagat

SEQ ID NO: 300297 - DNA, 20 bp, Artificial Sequence
  chemically synthesized
ctttggaagataatttgatt

SEQ ID NO: 300298 - DNA, 20 bp, Artificial Sequence
  chemically synthesized
ctaaatcaaattatcttcca

SEQ ID NO: 300299 - DNA, 20 bp, Artificial Sequence
  chemically synthesized
tttggaaatggagactttgg

SEQ ID NO: 300300 - DNA, 20 bp, Artificial Sequence
  chemically synthesized
gaatttggaaatggagactt

SEQ ID NO: 300301 - DNA, 20 bp, Artificial Sequence
  chemically synthesized
tgtgatggaatttggaaatg

SEQ ID NO: 300302 - DNA, 20 bp, Artificial Sequence
  chemically synthesized
aatgtgatggaatttggaaa

SEQ ID NO: 300303 - DNA, 20 bp, Artificial Sequence
  chemically synthesized
atctccaatgtgatggaatt

SEQ ID NO: 300304 - DNA, 20 bp, Artificial Sequence
  chemically synthesized
atttccaaattccatcacat

SEQ ID NO: 300305 - DNA, 20 bp, Artificial Sequence
  chemically synthesized
agctctaatctccaatgtga

SEQ ID NO: 300306 - DNA, 20 bp, Artificial Sequence
  chemically synthesized
ttccaaattccatcacattg

SEQ ID NO: 300307 - DNA, 20 bp, Artificial Sequence
  chemically synthesized
aattccatcacattggagat

SEQ ID NO: 300308 - DNA, 20 bp, Artificial Sequence
  chemically synthesized
ttccatcacattggagatta

SEQ ID NO: 300309 - DNA, 20 bp, Artificial Sequence
  chemically synthesized
ggagattagagcttcaatat

SEQ ID NO: 300310 - DNA, 20 bp, Artificial Sequence
  chemically synthesized
ctccctaaattcttatattg

SEQ ID NO: 300311 - DNA, 20 bp, Artificial Sequence
  chemically synthesized
agagcttcaatataagaatt

SEQ ID NO: 300312 - DNA, 20 bp, Artificial Sequence
  chemically synthesized
gagcttcaatataagaattt

SEQ ID NO: 300313 - DNA, 20 bp, Artificial Sequence
  chemically synthesized
agcttcaatataagaattta

SEQ ID NO: 300314 - DNA, 20 bp, Artificial Sequence
  chemically synthesized
cttcaatataagaatttagg

SEQ ID NO: 300315 - DNA, 20 bp, Artificial Sequence
  chemically synthesized
ttcaatataagaatttaggg

SEQ ID NO: 300316 - DNA, 20 bp, Artificial Sequence
  chemically synthesized
aatttagggaggacacaatt

SEQ ID NO: 300317 - DNA, 20 bp, Artificial Sequence
  chemically synthesized
atttagggaggacacaattc

SEQ ID NO: 300318 - DNA, 20 bp, Artificial Sequence
  chemically synthesized
ggacacaattcaggccatcc

SEQ ID NO: 300319 - DNA, 20 bp, Artificial Sequence
  chemically synthesized
aaaatgatgccaggctggga

SEQ ID NO: 300320 - DNA, 20 bp, Artificial Sequence
  chemically synthesized
caattcaggccatcccagcc

SEQ ID NO: 300321 - DNA, 20 bp, Artificial Sequence
  chemically synthesized
tataaaaatgatgccaggct

SEQ ID NO: 300322 - DNA, 20 bp, Artificial Sequence
  chemically synthesized
atataaaaatgatgccaggc

SEQ ID NO: 300323 - DNA, 20 bp, Artificial Sequence
  chemically synthesized
agagatataaaaatgatgcc

SEQ ID NO: 300324 - DNA, 20 bp, Artificial Sequence
  chemically synthesized
cagagatataaaaatgatgc

SEQ ID NO: 300325 - DNA, 20 bp, Artificial Sequence
  chemically synthesized
gcatcatttttatatctctg

SEQ ID NO: 300326 - DNA, 20 bp, Artificial Sequence
  chemically synthesized
tcatttttatatctctgtgg

SEQ ID NO: 300327 - DNA, 20 bp, Artificial Sequence
  chemically synthesized
acacatattatgctaccaca

SEQ ID NO: 300328 - DNA, 20 bp, Artificial Sequence
  chemically synthesized
gaacacatattatgctacca

SEQ ID NO: 300329 - DNA, 20 bp, Artificial Sequence
  chemically synthesized
ataatatgtgttcatttgta

SEQ ID NO: 300330 - DNA, 20 bp, Artificial Sequence
  chemically synthesized
aatatgtgttcatttgtaaa

SEQ ID NO: 300331 - DNA, 20 bp, Artificial Sequence
  chemically synthesized
tgtgttcatttgtaaagaga

SEQ ID NO: 300332 - DNA, 20 bp, Artificial Sequence
  chemically synthesized
gtgttcatttgtaaagagac

SEQ ID NO: 300333 - DNA, 20 bp, Artificial Sequence
  chemically synthesized
taaagagacaggtttctgac

SEQ ID NO: 300334 - DNA, 20 bp, Artificial Sequence
  chemically synthesized
aaagagacaggtttctgacc

SEQ ID NO: 300335 - DNA, 20 bp, Artificial Sequence
  chemically synthesized
aagagacaggtttctgacca

SEQ ID NO: 300336 - DNA, 20 bp, Artificial Sequence
  chemically synthesized
agacaggtttctgaccaggg

SEQ ID NO: 300337 - DNA, 20 bp, Artificial Sequence
  chemically synthesized
ttagtaaagtcttccctggt

SEQ ID NO: 300338 - DNA, 20 bp, Artificial Sequence
  chemically synthesized
attcttagtaaagtcttccc

SEQ ID NO: 300339 - DNA, 20 bp, Artificial Sequence
  chemically synthesized
tgaccagggaagactttact

SEQ ID NO: 300340 - DNA, 20 bp, Artificial Sequence
  chemically synthesized
ttctgagagtattcttagta

SEQ ID NO: 300341 - DNA, 20 bp, Artificial Sequence
  chemically synthesized
acatcttctgagagtattct

SEQ ID NO: 300342 - DNA, 20 bp, Artificial Sequence
  chemically synthesized
gactttactaagaatactct

SEQ ID NO: 300343 - DNA, 20 bp, Artificial Sequence
  chemically synthesized
tttactaagaatactctcag

SEQ ID NO: 300344 - DNA, 20 bp, Artificial Sequence
  chemically synthesized
cttattctgacatcttctga

SEQ ID NO: 300345 - DNA, 20 bp, Artificial Sequence
  chemically synthesized
ttcttattctgacatcttct

SEQ ID NO: 300346 - DNA, 20 bp, Artificial Sequence
  chemically synthesized
agaatactctcagaagatgt

SEQ ID NO: 300347 - DNA, 20 bp, Artificial Sequence
  chemically synthesized
ctctcagaagatgtcagaat

SEQ ID NO: 300348 - DNA, 20 bp, Artificial Sequence
  chemically synthesized
ataagaataatatataaatg

SEQ ID NO: 300349 - DNA, 20 bp, Artificial Sequence
  chemically synthesized
ataatatataaatgtggtca

SEQ ID NO: 300350 - DNA, 20 bp, Artificial Sequence
  chemically synthesized
taatatataaatgtggtcat

SEQ ID NO: 300351 - DNA, 20 bp, Artificial Sequence
  chemically synthesized
tatataaatgtggtcatggg

SEQ ID NO: 300352 - DNA, 20 bp, Artificial Sequence
  chemically synthesized
tccaattattaattcaggga

SEQ ID NO: 300353 - DNA, 20 bp, Artificial Sequence
  chemically synthesized
agtttccaattattaattca

SEQ ID NO: 300354 - DNA, 20 bp, Artificial Sequence
  chemically synthesized
gagtttccaattattaattc

SEQ ID NO: 300355 - DNA, 20 bp, Artificial Sequence
  chemically synthesized
tgagtttccaattattaatt

SEQ ID NO: 300356 - DNA, 20 bp, Artificial Sequence
  chemically synthesized
accatccctgaattaataat

SEQ ID NO: 300357 - DNA, 20 bp, Artificial Sequence
  chemically synthesized
cctttccccaggagaaagtt

SEQ ID NO: 300358 - DNA, 20 bp, Artificial Sequence
  chemically synthesized
ttggaaactcaactttctcc

SEQ ID NO: 300359 - DNA, 20 bp, Artificial Sequence
  chemically synthesized
tggaaactcaactttctcct

SEQ ID NO: 300360 - DNA, 20 bp, Artificial Sequence
  chemically synthesized
ggaaactcaactttctcctg

SEQ ID NO: 300361 - DNA, 20 bp, Artificial Sequence
  chemically synthesized
tgtctcctttccccaggaga

SEQ ID NO: 300362 - DNA, 20 bp, Artificial Sequence
  chemically synthesized
actcaactttctcctgggga

SEQ ID NO: 300363 - DNA, 20 bp, Artificial Sequence
  chemically synthesized
acaatgtctcctttccccag

SEQ ID NO: 300364 - DNA, 20 bp, Artificial Sequence
  chemically synthesized
ctcaactttctcctggggaa

SEQ ID NO: 300365 - DNA, 20 bp, Artificial Sequence
  chemically synthesized
aaacaatgtctcctttcccc

SEQ ID NO: 300366 - DNA, 20 bp, Artificial Sequence
  chemically synthesized
caactttctcctggggaaag

SEQ ID NO: 300367 - DNA, 20 bp, Artificial Sequence
  chemically synthesized
aaaacaatgtctcctttccc

SEQ ID NO: 300368 - DNA, 20 bp, Artificial Sequence
  chemically synthesized
tttaaatgtaaacgttcttc

SEQ ID NO: 300369 - DNA, 20 bp, Artificial Sequence
  chemically synthesized
tattacatgtgtttgtcttg

SEQ ID NO: 300370 - DNA, 20 bp, Artificial Sequence
  chemically synthesized
cacatgtaatataatttcca

SEQ ID NO: 300371 - DNA, 20 bp, Artificial Sequence
  chemically synthesized
taatataatttccacagtgt

SEQ ID NO: 300372 - DNA, 20 bp, Artificial Sequence
  chemically synthesized
aatataatttccacagtgtg

SEQ ID NO: 300373 - DNA, 20 bp, Artificial Sequence
  chemically synthesized
ccctgtttgccctcacactg

SEQ ID NO: 300374 - DNA, 20 bp, Artificial Sequence
  chemically synthesized
atataatttccacagtgtga

SEQ ID NO: 300375 - DNA, 20 bp, Artificial Sequence
  chemically synthesized
ttccacagtgtgagggcaaa

SEQ ID NO: 300376 - DNA, 20 bp, Artificial Sequence
  chemically synthesized
tccacagtgtgagggcaaac

SEQ ID NO: 300377 - DNA, 20 bp, Artificial Sequence
  chemically synthesized
ccacagtgtgagggcaaaca

SEQ ID NO: 300378 - DNA, 20 bp, Artificial Sequence
  chemically synthesized
cagtgtgagggcaaacaggg

SEQ ID NO: 300379 - DNA, 20 bp, Artificial Sequence
  chemically synthesized
agtgtgagggcaaacaggga

SEQ ID NO: 300380 - DNA, 20 bp, Artificial Sequence
  chemically synthesized
cccctgaaatggaatgtata

SEQ ID NO: 300381 - DNA, 20 bp, Artificial Sequence
  chemically synthesized
aggccatatacattccattt

SEQ ID NO: 300382 - DNA, 20 bp, Artificial Sequence
  chemically synthesized
ggccatatacattccatttc

SEQ ID NO: 300383 - DNA, 20 bp, Artificial Sequence
  chemically synthesized
gccatatacattccatttca

SEQ ID NO: 300384 - DNA, 20 bp, Artificial Sequence
  chemically synthesized
ccatatacattccatttcag

SEQ ID NO: 300385 - DNA, 20 bp, Artificial Sequence
  chemically synthesized
ctatttcgtcacccctgaaa

SEQ ID NO: 300386 - DNA, 20 bp, Artificial Sequence
  chemically synthesized
ccatttcaggggtgacgaaa

SEQ ID NO: 300387 - DNA, 20 bp, Artificial Sequence
  chemically synthesized
ggggtgacgaaatagattct

SEQ ID NO: 300388 - DNA, 20 bp, Artificial Sequence
  chemically synthesized
gggtgacgaaatagattctt

SEQ ID NO: 300389 - DNA, 20 bp, Artificial Sequence
  chemically synthesized
ggtgacgaaatagattcttg

SEQ ID NO: 300390 - DNA, 20 bp, Artificial Sequence
  chemically synthesized
tgacgaaatagattcttggg

SEQ ID NO: 300391 - DNA, 20 bp, Artificial Sequence
  chemically synthesized
ttaagccacttaatctcccc

SEQ ID NO: 300392 - DNA, 20 bp, Artificial Sequence
  chemically synthesized
aatagattcttggggagatt

SEQ ID NO: 300393 - DNA, 20 bp, Artificial Sequence
  chemically synthesized
agattcttggggagattaag

SEQ ID NO: 300394 - DNA, 20 bp, Artificial Sequence
  chemically synthesized
ttggggagattaagtggctt

SEQ ID NO: 300395 - DNA, 20 bp, Artificial Sequence
  chemically synthesized
gctcataaactatgtgactt

SEQ ID NO: 300396 - DNA, 20 bp, Artificial Sequence
  chemically synthesized
attaagtggcttaagtcaca

SEQ ID NO: 300397 - DNA, 20 bp, Artificial Sequence
  chemically synthesized
gcttaagtcacatagtttat

SEQ ID NO: 300398 - DNA, 20 bp, Artificial Sequence
  chemically synthesized
taagtcacatagtttatgag

SEQ ID NO: 300399 - DNA, 20 bp, Artificial Sequence
  chemically synthesized
gtcacatagtttatgagcag

SEQ ID NO: 300400 - DNA, 20 bp, Artificial Sequence
  chemically synthesized
gtttatgagcagaagatgca

SEQ ID NO: 300401 - DNA, 20 bp, Artificial Sequence
  chemically synthesized
atgagcagaagatgcacggc

SEQ ID NO: 300402 - DNA, 20 bp, Artificial Sequence
  chemically synthesized
attactgcacagatgggttc

SEQ ID NO: 300403 - DNA, 20 bp, Artificial Sequence
  chemically synthesized
acggccagaacccatctgtg

SEQ ID NO: 300404 - DNA, 20 bp, Artificial Sequence
  chemically synthesized
gggcatattactgcacagat

SEQ ID NO: 300405 - DNA, 20 bp, Artificial Sequence
  chemically synthesized
tgggcatattactgcacaga

SEQ ID NO: 300406 - DNA, 20 bp, Artificial Sequence
  chemically synthesized
cagatgggcatattactgca

SEQ ID NO: 300407 - DNA, 20 bp, Artificial Sequence
  chemically synthesized
gaatagatctgagagcagat

SEQ ID NO: 300408 - DNA, 20 bp, Artificial Sequence
  chemically synthesized
ggaatagatctgagagcaga

SEQ ID NO: 300409 - DNA, 20 bp, Artificial Sequence
  chemically synthesized
gtaatatgcccatctgctct

SEQ ID NO: 300410 - DNA, 20 bp, Artificial Sequence
  chemically synthesized
gtggggaatagatctgagag

SEQ ID NO: 300411 - DNA, 20 bp, Artificial Sequence
  chemically synthesized
aatgtggggaatagatctga

SEQ ID NO: 300412 - DNA, 20 bp, Artificial Sequence
  chemically synthesized
gaaatgtggggaatagatct

SEQ ID NO: 300413 - DNA, 20 bp, Artificial Sequence
  chemically synthesized
tacagaagaaatgtggggaa

SEQ ID NO: 300414 - DNA, 20 bp, Artificial Sequence
  chemically synthesized
gaaagtacagaagaaatgtg

SEQ ID NO: 300415 - DNA, 20 bp, Artificial Sequence
  chemically synthesized
agaaagtacagaagaaatgt

SEQ ID NO: 300416 - DNA, 20 bp, Artificial Sequence
  chemically synthesized
cagaaagtacagaagaaatg

SEQ ID NO: 300417 - DNA, 20 bp, Artificial Sequence
  chemically synthesized
ctctaatacagaaagtacag

SEQ ID NO: 300418 - DNA, 20 bp, Artificial Sequence
  chemically synthesized
tccctctaatacagaaagta

SEQ ID NO: 300419 - DNA, 20 bp, Artificial Sequence
  chemically synthesized
ttcttctgtactttctgtat

SEQ ID NO: 300420 - DNA, 20 bp, Artificial Sequence
  chemically synthesized
gtatatccctctaatacaga

SEQ ID NO: 300421 - DNA, 20 bp, Artificial Sequence
  chemically synthesized
cttctgtactttctgtatta

SEQ ID NO: 300422 - DNA, 20 bp, Artificial Sequence
  chemically synthesized
ttctgtactttctgtattag

SEQ ID NO: 300423 - DNA, 20 bp, Artificial Sequence
  chemically synthesized
tctgtactttctgtattaga

SEQ ID NO: 300424 - DNA, 20 bp, Artificial Sequence
  chemically synthesized
aaatgtatatccctctaata

SEQ ID NO: 300425 - DNA, 20 bp, Artificial Sequence
  chemically synthesized
ttaggagggcaagtggtgtt

SEQ ID NO: 300426 - DNA, 20 bp, Artificial Sequence
  chemically synthesized
attaggagggcaagtggtgt

SEQ ID NO: 300427 - DNA, 20 bp, Artificial Sequence
  chemically synthesized
tgaacaattaggagggcaag

SEQ ID NO: 300428 - DNA, 20 bp, Artificial Sequence
  chemically synthesized
aaatgaacaattaggagggc

SEQ ID NO: 300429 - DNA, 20 bp, Artificial Sequence
  chemically synthesized
ctccaaatgaacaattagga

SEQ ID NO: 300430 - DNA, 20 bp, Artificial Sequence
  chemically synthesized
cctccaaatgaacaattagg

SEQ ID NO: 300431 - DNA, 20 bp, Artificial Sequence
  chemically synthesized
gcctccaaatgaacaattag

SEQ ID NO: 300432 - DNA, 20 bp, Artificial Sequence
  chemically synthesized
ttgcctccaaatgaacaatt

SEQ ID NO: 300433 - DNA, 20 bp, Artificial Sequence
  chemically synthesized
attgcctccaaatgaacaat

SEQ ID NO: 300434 - DNA, 20 bp, Artificial Sequence
  chemically synthesized
tgccctcctaattgttcatt

SEQ ID NO: 300435 - DNA, 20 bp, Artificial Sequence
  chemically synthesized
ccctcctaattgttcatttg

SEQ ID NO: 300436 - DNA, 20 bp, Artificial Sequence
  chemically synthesized
cctcctaattgttcatttgg

SEQ ID NO: 300437 - DNA, 20 bp, Artificial Sequence
  chemically synthesized
aattgttcatttggaggcaa

SEQ ID NO: 300438 - DNA, 20 bp, Artificial Sequence
  chemically synthesized
tgttcatttggaggcaatgg

SEQ ID NO: 300439 - DNA, 20 bp, Artificial Sequence
  chemically synthesized
tggaggcaatggcagaatat

SEQ ID NO: 300440 - DNA, 20 bp, Artificial Sequence
  chemically synthesized
aggcaatggcagaatattgg

SEQ ID NO: 300441 - DNA, 20 bp, Artificial Sequence
  chemically synthesized
ggcaatggcagaatattgga

SEQ ID NO: 300442 - DNA, 20 bp, Artificial Sequence
  chemically synthesized
aatggcagaatattggaagg

SEQ ID NO: 300443 - DNA, 20 bp, Artificial Sequence
  chemically synthesized
atggcagaatattggaaggt

SEQ ID NO: 300444 - DNA, 20 bp, Artificial Sequence
  chemically synthesized
ggcagaatattggaaggtgg

SEQ ID NO: 300445 - DNA, 20 bp, Artificial Sequence
  chemically synthesized
gcagaatattggaaggtggg

SEQ ID NO: 300446 - DNA, 20 bp, Artificial Sequence
  chemically synthesized
gaatattggaaggtgggagg

SEQ ID NO: 300447 - DNA, 20 bp, Artificial Sequence
  chemically synthesized
atattggaaggtgggaggaa

SEQ ID NO: 300448 - DNA, 20 bp, Artificial Sequence
  chemically synthesized
ggaaggtgggaggaagagaa

SEQ ID NO: 300449 - DNA, 20 bp, Artificial Sequence
  chemically synthesized
gtgggaggaagagaaaagcc

SEQ ID NO: 300450 - DNA, 20 bp, Artificial Sequence
  chemically synthesized
tgggaggaagagaaaagcca

SEQ ID NO: 300451 - DNA, 20 bp, Artificial Sequence
  chemically synthesized
ttggagaagaaaaaagacct

SEQ ID NO: 300452 - DNA, 20 bp, Artificial Sequence
  chemically synthesized
aaggtagttggagaagaaaa

SEQ ID NO: 300453 - DNA, 20 bp, Artificial Sequence
  chemically synthesized
gccacccaaggtagttggag

SEQ ID NO: 300454 - DNA, 20 bp, Artificial Sequence
  chemically synthesized
aatgccacccaaggtagttg

SEQ ID NO: 300455 - DNA, 20 bp, Artificial Sequence
  chemically synthesized
tttttcttctccaactacct

SEQ ID NO: 300456 - DNA, 20 bp, Artificial Sequence
  chemically synthesized
gaaatgccacccaaggtagt

SEQ ID NO: 300457 - DNA, 20 bp, Artificial Sequence
  chemically synthesized
ttttcttctccaactacctt

SEQ ID NO: 300458 - DNA, 20 bp, Artificial Sequence
  chemically synthesized
tcttctccaactaccttggg

SEQ ID NO: 300459 - DNA, 20 bp, Artificial Sequence
  chemically synthesized
tctagaaatgccacccaagg

SEQ ID NO: 300460 - DNA, 20 bp, Artificial Sequence
  chemically synthesized
tgctctagaaatgccaccca

SEQ ID NO: 300461 - DNA, 20 bp, Artificial Sequence
  chemically synthesized
ctgctctagaaatgccaccc

SEQ ID NO: 300462 - DNA, 20 bp, Artificial Sequence
  chemically synthesized
actaccttgggtggcatttc

SEQ ID NO: 300463 - DNA, 20 bp, Artificial Sequence
  chemically synthesized
taccttgggtggcatttcta

SEQ ID NO: 300464 - DNA, 20 bp, Artificial Sequence
  chemically synthesized
cttgggtggcatttctagag

SEQ ID NO: 300465 - DNA, 20 bp, Artificial Sequence
  chemically synthesized
cagcagagatacatctgctc

SEQ ID NO: 300466 - DNA, 20 bp, Artificial Sequence
  chemically synthesized
gagcagatgtatctctgctg

SEQ ID NO: 300467 - DNA, 20 bp, Artificial Sequence
  chemically synthesized
agaaaacagaagccacagca

SEQ ID NO: 300468 - DNA, 20 bp, Artificial Sequence
  chemically synthesized
agagaaaacagaagccacag

SEQ ID NO: 300469 - DNA, 20 bp, Artificial Sequence
  chemically synthesized
tccagagaaaacagaagcca

SEQ ID NO: 300470 - DNA, 20 bp, Artificial Sequence
  chemically synthesized
tagctatccagagaaaacag

SEQ ID NO: 300471 - DNA, 20 bp, Artificial Sequence
  chemically synthesized
gctgtggcttctgttttctc

SEQ ID NO: 300472 - DNA, 20 bp, Artificial Sequence
  chemically synthesized
agctagctatccagagaaaa

SEQ ID NO: 300473 - DNA, 20 bp, Artificial Sequence
  chemically synthesized
tggcttctgttttctctgga

SEQ ID NO: 300474 - DNA, 20 bp, Artificial Sequence
  chemically synthesized
aagagggagctagctatcca

SEQ ID NO: 300475 - DNA, 20 bp, Artificial Sequence
  chemically synthesized
ttctgttttctctggatagc

SEQ ID NO: 300476 - DNA, 20 bp, Artificial Sequence
  chemically synthesized
tgaagagggagctagctatc

SEQ ID NO: 300477 - DNA, 20 bp, Artificial Sequence
  chemically synthesized
tggattgttgaagagggagc

SEQ ID NO: 300478 - DNA, 20 bp, Artificial Sequence
  chemically synthesized
aaattggattgttgaagagg

SEQ ID NO: 300479 - DNA, 20 bp, Artificial Sequence
  chemically synthesized
gaaaattggattgttgaaga

SEQ ID NO: 300480 - DNA, 20 bp, Artificial Sequence
  chemically synthesized
agaaaattggattgttgaag

SEQ ID NO: 300481 - DNA, 20 bp, Artificial Sequence
  chemically synthesized
cagaaaattggattgttgaa

SEQ ID NO: 300482 - DNA, 20 bp, Artificial Sequence
  chemically synthesized
ggcagaaaattggattgttg

SEQ ID NO: 300483 - DNA, 20 bp, Artificial Sequence
  chemically synthesized
aggactgccaggcagaaaat

SEQ ID NO: 300484 - DNA, 20 bp, Artificial Sequence
  chemically synthesized
caacaatccaattttctgcc

SEQ ID NO: 300485 - DNA, 20 bp, Artificial Sequence
  chemically synthesized
caatccaattttctgcctgg

SEQ ID NO: 300486 - DNA, 20 bp, Artificial Sequence
  chemically synthesized
ctaaagttaggactgccagg

SEQ ID NO: 300487 - DNA, 20 bp, Artificial Sequence
  chemically synthesized
aaactaaagttaggactgcc

SEQ ID NO: 300488 - DNA, 20 bp, Artificial Sequence
  chemically synthesized
taaactaaagttaggactgc

SEQ ID NO: 300489 - DNA, 20 bp, Artificial Sequence
  chemically synthesized
ctgcctggcagtcctaactt

SEQ ID NO: 300490 - DNA, 20 bp, Artificial Sequence
  chemically synthesized
acagagattaaactaaagtt

SEQ ID NO: 300491 - DNA, 20 bp, Artificial Sequence
  chemically synthesized
aacagagattaaactaaagt

SEQ ID NO: 300492 - DNA, 20 bp, Artificial Sequence
  chemically synthesized
ttctaacagagattaaacta

SEQ ID NO: 300493 - DNA, 20 bp, Artificial Sequence
  chemically synthesized
aactttagtttaatctctgt

SEQ ID NO: 300494 - DNA, 20 bp, Artificial Sequence
  chemically synthesized
ttagtttaatctctgttaga

SEQ ID NO: 300495 - DNA, 20 bp, Artificial Sequence
  chemically synthesized
gaagctggggctttctaaca

SEQ ID NO: 300496 - DNA, 20 bp, Artificial Sequence
  chemically synthesized
cagaagctggggctttctaa

SEQ ID NO: 300497 - DNA, 20 bp, Artificial Sequence
  chemically synthesized
taatctctgttagaaagccc

SEQ ID NO: 300498 - DNA, 20 bp, Artificial Sequence
  chemically synthesized
ttaccagagctcagaagctg

SEQ ID NO: 300499 - DNA, 20 bp, Artificial Sequence
  chemically synthesized
gttagaaagccccagcttct

SEQ ID NO: 300500 - DNA, 20 bp, Artificial Sequence
  chemically synthesized
attaccagagctcagaagct

SEQ ID NO: 300501 - DNA, 20 bp, Artificial Sequence
  chemically synthesized
tattaccagagctcagaagc

SEQ ID NO: 300502 - DNA, 20 bp, Artificial Sequence
  chemically synthesized
gtgatattaccagagctcag

SEQ ID NO: 300503 - DNA, 20 bp, Artificial Sequence
  chemically synthesized
aagccccagcttctgagctc

SEQ ID NO: 300504 - DNA, 20 bp, Artificial Sequence
  chemically synthesized
aaagtgatattaccagagct

SEQ ID NO: 300505 - DNA, 20 bp, Artificial Sequence
  chemically synthesized
cagaaaaagtgatattacca

SEQ ID NO: 300506 - DNA, 20 bp, Artificial Sequence
  chemically synthesized
tacagaaaaagtgatattac

SEQ ID NO: 300507 - DNA, 20 bp, Artificial Sequence
  chemically synthesized
ctggagaaacaatacagaaa

SEQ ID NO: 300508 - DNA, 20 bp, Artificial Sequence
  chemically synthesized
ctagagctggagaaacaata

SEQ ID NO: 300509 - DNA, 20 bp, Artificial Sequence
  chemically synthesized
ctttttctgtattgtttctc

SEQ ID NO: 300510 - DNA, 20 bp, Artificial Sequence
  chemically synthesized
ctgtattgtttctccagctc

SEQ ID NO: 300511 - DNA, 20 bp, Artificial Sequence
  chemically synthesized
tgtattgtttctccagctct

SEQ ID NO: 300512 - DNA, 20 bp, Artificial Sequence
  chemically synthesized
tgctaatatccctagagctg

SEQ ID NO: 300513 - DNA, 20 bp, Artificial Sequence
  chemically synthesized
gtattgtttctccagctcta

SEQ ID NO: 300514 - DNA, 20 bp, Artificial Sequence
  chemically synthesized
gctgctaatatccctagagc

SEQ ID NO: 300515 - DNA, 20 bp, Artificial Sequence
  chemically synthesized
ggaagctgctaatatcccta

SEQ ID NO: 300516 - DNA, 20 bp, Artificial Sequence
  chemically synthesized
ttctccagctctagggatat

SEQ ID NO: 300517 - DNA, 20 bp, Artificial Sequence
  chemically synthesized
aaggaagctgctaatatccc

SEQ ID NO: 300518 - DNA, 20 bp, Artificial Sequence
  chemically synthesized
tccagctctagggatattag

SEQ ID NO: 300519 - DNA, 20 bp, Artificial Sequence
  chemically synthesized
aaagcactagtaacgtaagg

SEQ ID NO: 300520 - DNA, 20 bp, Artificial Sequence
  chemically synthesized
ctcaaagcactagtaacgta

SEQ ID NO: 300521 - DNA, 20 bp, Artificial Sequence
  chemically synthesized
tagcagcttccttacgttac

SEQ ID NO: 300522 - DNA, 20 bp, Artificial Sequence
  chemically synthesized
actcaaagcactagtaacgt

SEQ ID NO: 300523 - DNA, 20 bp, Artificial Sequence
  chemically synthesized
ccttacgttactagtgcttt

SEQ ID NO: 300524 - DNA, 20 bp, Artificial Sequence
  chemically synthesized
ggagaggcaactcaaagcac

SEQ ID NO: 300525 - DNA, 20 bp, Artificial Sequence
  chemically synthesized
ggggatggagaggcaactca

SEQ ID NO: 300526 - DNA, 20 bp, Artificial Sequence
  chemically synthesized
acgcagcgcaggggatggag

SEQ ID NO: 300527 - DNA, 20 bp, Artificial Sequence
  chemically synthesized
gacgcagcgcaggggatgga

SEQ ID NO: 300528 - DNA, 20 bp, Artificial Sequence
  chemically synthesized
gagacgcagcgcaggggatg

SEQ ID NO: 300529 - DNA, 20 bp, Artificial Sequence
  chemically synthesized
ctgagacgcagcgcagggga

SEQ ID NO: 300530 - DNA, 20 bp, Artificial Sequence
  chemically synthesized
aaaactgagacgcagcgcag

SEQ ID NO: 300531 - DNA, 20 bp, Artificial Sequence
  chemically synthesized
gaaaactgagacgcagcgca

SEQ ID NO: 300532 - DNA, 20 bp, Artificial Sequence
  chemically synthesized
agaaaactgagacgcagcgc

SEQ ID NO: 300533 - DNA, 20 bp, Artificial Sequence
  chemically synthesized
tagaaaactgagacgcagcg

SEQ ID NO: 300534 - DNA, 20 bp, Artificial Sequence
  chemically synthesized
ccatcccctgcgctgcgtct

SEQ ID NO: 300535 - DNA, 20 bp, Artificial Sequence
  chemically synthesized
ggtagtagaaaactgagacg

SEQ ID NO: 300536 - DNA, 20 bp, Artificial Sequence
  chemically synthesized
taagcaggtagtagaaaact

SEQ ID NO: 300537 - DNA, 20 bp, Artificial Sequence
  chemically synthesized
ggaattggctaagcaggtag

SEQ ID NO: 300538 - DNA, 20 bp, Artificial Sequence
  chemically synthesized
tcagttttctactacctgct

SEQ ID NO: 300539 - DNA, 20 bp, Artificial Sequence
  chemically synthesized
taaggaattggctaagcagg

SEQ ID NO: 300540 - DNA, 20 bp, Artificial Sequence
  chemically synthesized
atataaggaattggctaagc

SEQ ID NO: 300541 - DNA, 20 bp, Artificial Sequence
  chemically synthesized
aatataaggaattggctaag

SEQ ID NO: 300542 - DNA, 20 bp, Artificial Sequence
  chemically synthesized
cgtaatataaggaattggct

SEQ ID NO: 300543 - DNA, 20 bp, Artificial Sequence
  chemically synthesized
ggaaacgtaatataaggaat

SEQ ID NO: 300544 - DNA, 20 bp, Artificial Sequence
  chemically synthesized
aagagaggaaacgtaatata

SEQ ID NO: 300545 - DNA, 20 bp, Artificial Sequence
  chemically synthesized
aaagagaggaaacgtaatat

SEQ ID NO: 300546 - DNA, 20 bp, Artificial Sequence
  chemically synthesized
aatcactgtgatttaaagag

SEQ ID NO: 300547 - DNA, 20 bp, Artificial Sequence
  chemically synthesized
aaatcactgtgatttaaaga

SEQ ID NO: 300548 - DNA, 20 bp, Artificial Sequence
  chemically synthesized
caaaatcactgtgatttaaa

SEQ ID NO: 300549 - DNA, 20 bp, Artificial Sequence
  chemically synthesized
cgtttcctctctttaaatca

SEQ ID NO: 300550 - DNA, 20 bp, Artificial Sequence
  chemically synthesized
aacaaaatcactgtgattta

SEQ ID NO: 300551 - DNA, 20 bp, Artificial Sequence
  chemically synthesized
agtgattttgtttttctgac

SEQ ID NO: 300552 - DNA, 20 bp, Artificial Sequence
  chemically synthesized
aggttttgtgcgagtcttgt

SEQ ID NO: 300553 - DNA, 20 bp, Artificial Sequence
  chemically synthesized
ggattttccaggttttgtgc

SEQ ID NO: 300554 - DNA, 20 bp, Artificial Sequence
  chemically synthesized
gacaagactcgcacaaaacc

SEQ ID NO: 300555 - DNA, 20 bp, Artificial Sequence
  chemically synthesized
atgttgatgagggattttcc

SEQ ID NO: 300556 - DNA, 20 bp, Artificial Sequence
  chemically synthesized
gatgttgatgagggattttc

SEQ ID NO: 300557 - DNA, 20 bp, Artificial Sequence
  chemically synthesized
tatttattggatgttgatga

SEQ ID NO: 300558 - DNA, 20 bp, Artificial Sequence
  chemically synthesized
atatttattggatgttgatg

SEQ ID NO: 300559 - DNA, 20 bp, Artificial Sequence
  chemically synthesized
aatatttattggatgttgat

SEQ ID NO: 300560 - DNA, 20 bp, Artificial Sequence
  chemically synthesized
ggtattgaataaatatttat

SEQ ID NO: 300561 - DNA, 20 bp, Artificial Sequence
  chemically synthesized
atttattcaatacctactat

SEQ ID NO: 300562 - DNA, 20 bp, Artificial Sequence
  chemically synthesized
agcagaagtcagctcatagt

SEQ ID NO: 300563 - DNA, 20 bp, Artificial Sequence
  chemically synthesized
aagcagaagtcagctcatag

SEQ ID NO: 300564 - DNA, 20 bp, Artificial Sequence
  chemically synthesized
ataaagcagaagtcagctca

SEQ ID NO: 300565 - DNA, 20 bp, Artificial Sequence
  chemically synthesized
ataatgcataaagcagaagt

SEQ ID NO: 300566 - DNA, 20 bp, Artificial Sequence
  chemically synthesized
acctataatgcataaagcag

SEQ ID NO: 300567 - DNA, 20 bp, Artificial Sequence
  chemically synthesized
tacacctataatgcataaag

SEQ ID NO: 300568 - DNA, 20 bp, Artificial Sequence
  chemically synthesized
ctgtacacctataatgcata

SEQ ID NO: 300569 - DNA, 20 bp, Artificial Sequence
  chemically synthesized
gacttctgctttatgcatta

SEQ ID NO: 300570 - DNA, 20 bp, Artificial Sequence
  chemically synthesized
acttctgctttatgcattat

SEQ ID NO: 300571 - DNA, 20 bp, Artificial Sequence
  chemically synthesized
ctttatgcattataggtgta

SEQ ID NO: 300572 - DNA, 20 bp, Artificial Sequence
  chemically synthesized
attataggtgtacagatgac

SEQ ID NO: 300573 - DNA, 20 bp, Artificial Sequence
  chemically synthesized
aagaaatgatttcttccctc

SEQ ID NO: 300574 - DNA, 20 bp, Artificial Sequence
  chemically synthesized
agaaatgatttcttccctca

SEQ ID NO: 300575 - DNA, 20 bp, Artificial Sequence
  chemically synthesized
tccagtaaacgccttgaggg

SEQ ID NO: 300576 - DNA, 20 bp, Artificial Sequence
  chemically synthesized
atctccagtaaacgccttga

SEQ ID NO: 300577 - DNA, 20 bp, Artificial Sequence
  chemically synthesized
tatctccagtaaacgccttg

SEQ ID NO: 300578 - DNA, 20 bp, Artificial Sequence
  chemically synthesized
gtatctccagtaaacgcctt

SEQ ID NO: 300579 - DNA, 20 bp, Artificial Sequence
  chemically synthesized
tcttccctcaaggcgtttac

SEQ ID NO: 300580 - DNA, 20 bp, Artificial Sequence
  chemically synthesized
ttccctcaaggcgtttactg

SEQ ID NO: 300581 - DNA, 20 bp, Artificial Sequence
  chemically synthesized
caaggcgtttactggagata

SEQ ID NO: 300582 - DNA, 20 bp, Artificial Sequence
  chemically synthesized
aaggcgtttactggagatac

SEQ ID NO: 300583 - DNA, 20 bp, Artificial Sequence
  chemically synthesized
tttttgcatgcctgtatctc

SEQ ID NO: 300584 - DNA, 20 bp, Artificial Sequence
  chemically synthesized
gatacaggcatgcaaaaata

SEQ ID NO: 300585 - DNA, 20 bp, Artificial Sequence
  chemically synthesized
aaagtcattaccatacaatt

SEQ ID NO: 300586 - DNA, 20 bp, Artificial Sequence
  chemically synthesized
aaaacacttgccaaattgta

SEQ ID NO: 300587 - DNA, 20 bp, Artificial Sequence
  chemically synthesized
tcattaccatacaatttggc

SEQ ID NO: 300588 - DNA, 20 bp, Artificial Sequence
  chemically synthesized
caatttggcaagtgttttaa

SEQ ID NO: 300589 - DNA, 20 bp, Artificial Sequence
  chemically synthesized
tttggcaagtgttttaatag

SEQ ID NO: 300590 - DNA, 20 bp, Artificial Sequence
  chemically synthesized
gttttaatagaagtgttaaa

SEQ ID NO: 300591 - DNA, 20 bp, Artificial Sequence
  chemically synthesized
ttttaatagaagtgttaaaa

SEQ ID NO: 300592 - DNA, 20 bp, Artificial Sequence
  chemically synthesized
atagaagtgttaaaaaggct

SEQ ID NO: 300593 - DNA, 20 bp, Artificial Sequence
  chemically synthesized
gaagtgttaaaaaggctgag

SEQ ID NO: 300594 - DNA, 20 bp, Artificial Sequence
  chemically synthesized
gtgttaaaaaggctgagaag

SEQ ID NO: 300595 - DNA, 20 bp, Artificial Sequence
  chemically synthesized
cacagtgccaggccacttct

SEQ ID NO: 300596 - DNA, 20 bp, Artificial Sequence
  chemically synthesized
aaaaaggctgagaagtggcc

SEQ ID NO: 300597 - DNA, 20 bp, Artificial Sequence
  chemically synthesized
tgagaagtggcctggcactg

SEQ ID NO: 300598 - DNA, 20 bp, Artificial Sequence
  chemically synthesized
gaggcatgagccacagtgcc

SEQ ID NO: 300599 - DNA, 20 bp, Artificial Sequence
  chemically synthesized
agaggcatgagccacagtgc

SEQ ID NO: 300600 - DNA, 20 bp, Artificial Sequence
  chemically synthesized
gggattagaggcatgagcca

SEQ ID NO: 300601 - DNA, 20 bp, Artificial Sequence
  chemically synthesized
agtactgggattagaggcat

SEQ ID NO: 300602 - DNA, 20 bp, Artificial Sequence
  chemically synthesized
gtggctcatgcctctaatcc

SEQ ID NO: 300603 - DNA, 20 bp, Artificial Sequence
  chemically synthesized
tcccaaagtactgggattag

SEQ ID NO: 300604 - DNA, 20 bp, Artificial Sequence
  chemically synthesized
ctcccaaagtactgggatta

SEQ ID NO: 300605 - DNA, 20 bp, Artificial Sequence
  chemically synthesized
gcctcccaaagtactgggat

SEQ ID NO: 300606 - DNA, 20 bp, Artificial Sequence
  chemically synthesized
tgcctctaatcccagtactt

SEQ ID NO: 300607 - DNA, 20 bp, Artificial Sequence
  chemically synthesized
ctaaggcctcccaaagtact

SEQ ID NO: 300608 - DNA, 20 bp, Artificial Sequence
  chemically synthesized
gcctctaatcccagtacttt

SEQ ID NO: 300609 - DNA, 20 bp, Artificial Sequence
  chemically synthesized
gctaaggcctcccaaagtac

SEQ ID NO: 300610 - DNA, 20 bp, Artificial Sequence
  chemically synthesized
ctctaatcccagtactttgg

SEQ ID NO: 300611 - DNA, 20 bp, Artificial Sequence
  chemically synthesized
tctaatcccagtactttggg

SEQ ID NO: 300612 - DNA, 20 bp, Artificial Sequence
  chemically synthesized
ccgactgctaaggcctccca

SEQ ID NO: 300613 - DNA, 20 bp, Artificial Sequence
  chemically synthesized
cccagtactttgggaggcct

SEQ ID NO: 300614 - DNA, 20 bp, Artificial Sequence
  chemically synthesized
agtactttgggaggccttag

SEQ ID NO: 300615 - DNA, 20 bp, Artificial Sequence
  chemically synthesized
ctttgggaggccttagcagt

SEQ ID NO: 300616 - DNA, 20 bp, Artificial Sequence
  chemically synthesized
acctcatgatccgactgcta

SEQ ID NO: 300617 - DNA, 20 bp, Artificial Sequence
  chemically synthesized
gacctcatgatccgactgct

SEQ ID NO: 300618 - DNA, 20 bp, Artificial Sequence
  chemically synthesized
ggccttagcagtcggatcat

SEQ ID NO: 300619 - DNA, 20 bp, Artificial Sequence
  chemically synthesized
gccttagcagtcggatcatg

SEQ ID NO: 300620 - DNA, 20 bp, Artificial Sequence
  chemically synthesized
cagtcggatcatgaggtcaa

SEQ ID NO: 300621 - DNA, 20 bp, Artificial Sequence
  chemically synthesized
gatcatgaggtcaacagatc

SEQ ID NO: 300622 - DNA, 20 bp, Artificial Sequence
  chemically synthesized
tcaacagatcaagcccatcc

SEQ ID NO: 300623 - DNA, 20 bp, Artificial Sequence
  chemically synthesized
ttcaccgtgttggctaggat

SEQ ID NO: 300624 - DNA, 20 bp, Artificial Sequence
  chemically synthesized
tttcaccgtgttggctagga

SEQ ID NO: 300625 - DNA, 20 bp, Artificial Sequence
  chemically synthesized
ggggtttcaccgtgttggct

SEQ ID NO: 300626 - DNA, 20 bp, Artificial Sequence
  chemically synthesized
caagcccatcctagccaaca

SEQ ID NO: 300627 - DNA, 20 bp, Artificial Sequence
  chemically synthesized
tggggtttcaccgtgttggc

SEQ ID NO: 300628 - DNA, 20 bp, Artificial Sequence
  chemically synthesized
gagatggggtttcaccgtgt

SEQ ID NO: 300629 - DNA, 20 bp, Artificial Sequence
  chemically synthesized
ttgtatttttagtagagatg

SEQ ID NO: 300630 - DNA, 20 bp, Artificial Sequence
  chemically synthesized
tttgtatttttagtagagat

SEQ ID NO: 300631 - DNA, 20 bp, Artificial Sequence
  chemically synthesized
ttttgtatttttagtagaga

SEQ ID NO: 300632 - DNA, 20 bp, Artificial Sequence
  chemically synthesized
taatttttgtatttttagta

SEQ ID NO: 300633 - DNA, 20 bp, Artificial Sequence
  chemically synthesized
gctaatttttgtatttttag

SEQ ID NO: 300634 - DNA, 20 bp, Artificial Sequence
  chemically synthesized
ccagctaatttttgtatttt

SEQ ID NO: 300635 - DNA, 20 bp, Artificial Sequence
  chemically synthesized
tctactaaaaatacaaaaat

SEQ ID NO: 300636 - DNA, 20 bp, Artificial Sequence
  chemically synthesized
ctaaaaatacaaaaattagc

SEQ ID NO: 300637 - DNA, 20 bp, Artificial Sequence
  chemically synthesized
taaaaatacaaaaattagct

SEQ ID NO: 300638 - DNA, 20 bp, Artificial Sequence
  chemically synthesized
atacaaaaattagctgggca

SEQ ID NO: 300639 - DNA, 20 bp, Artificial Sequence
  chemically synthesized
caaaaattagctgggcatgg

SEQ ID NO: 300640 - DNA, 20 bp, Artificial Sequence
  chemically synthesized
caggcaagggccaccatgcc

SEQ ID NO: 300641 - DNA, 20 bp, Artificial Sequence
  chemically synthesized
ggcatggtggcccttgcctg

SEQ ID NO: 300642 - DNA, 20 bp, Artificial Sequence
  chemically synthesized
gtagctggcactacaggcaa

SEQ ID NO: 300643 - DNA, 20 bp, Artificial Sequence
  chemically synthesized
agtagctggcactacaggca

SEQ ID NO: 300644 - DNA, 20 bp, Artificial Sequence
  chemically synthesized
aagtagctggcactacaggc

SEQ ID NO: 300645 - DNA, 20 bp, Artificial Sequence
  chemically synthesized
gtggcccttgcctgtagtgc

SEQ ID NO: 300646 - DNA, 20 bp, Artificial Sequence
  chemically synthesized
tcccaagtagctggcactac

SEQ ID NO: 300647 - DNA, 20 bp, Artificial Sequence
  chemically synthesized
ctcccaagtagctggcacta

SEQ ID NO: 300648 - DNA, 20 bp, Artificial Sequence
  chemically synthesized
tgcctgtagtgccagctact

SEQ ID NO: 300649 - DNA, 20 bp, Artificial Sequence
  chemically synthesized
gcctgtagtgccagctactt

SEQ ID NO: 300650 - DNA, 20 bp, Artificial Sequence
  chemically synthesized
gcctcagcctcccaagtagc

SEQ ID NO: 300651 - DNA, 20 bp, Artificial Sequence
  chemically synthesized
ctgtagtgccagctacttgg

SEQ ID NO: 300652 - DNA, 20 bp, Artificial Sequence
  chemically synthesized
tgtagtgccagctacttggg

SEQ ID NO: 300653 - DNA, 20 bp, Artificial Sequence
  chemically synthesized
tcctgcctcagcctcccaag

SEQ ID NO: 300654 - DNA, 20 bp, Artificial Sequence
  chemically synthesized
ttgtcctgcctcagcctccc

SEQ ID NO: 300655 - DNA, 20 bp, Artificial Sequence
  chemically synthesized
tgccagctacttgggaggct

SEQ ID NO: 300656 - DNA, 20 bp, Artificial Sequence
  chemically synthesized
gccagctacttgggaggctg

SEQ ID NO: 300657 - DNA, 20 bp, Artificial Sequence
  chemically synthesized
agctacttgggaggctgagg

SEQ ID NO: 300658 - DNA, 20 bp, Artificial Sequence
  chemically synthesized
gctacttgggaggctgaggc

SEQ ID NO: 300659 - DNA, 20 bp, Artificial Sequence
  chemically synthesized
ttcaagcgattgtcctgcct

SEQ ID NO: 300660 - DNA, 20 bp, Artificial Sequence
  chemically synthesized
aggacaatcgcttgaaccca

SEQ ID NO: 300661 - DNA, 20 bp, Artificial Sequence
  chemically synthesized
atcctctgccccgtgggttc

SEQ ID NO: 300662 - DNA, 20 bp, Artificial Sequence
  chemically synthesized
ggacaatcgcttgaacccac

SEQ ID NO: 300663 - DNA, 20 bp, Artificial Sequence
  chemically synthesized
gacaatcgcttgaacccacg

SEQ ID NO: 300664 - DNA, 20 bp, Artificial Sequence
  chemically synthesized
aatcgcttgaacccacgggg

SEQ ID NO: 300665 - DNA, 20 bp, Artificial Sequence
  chemically synthesized
tactgcatcctctgccccgt

SEQ ID NO: 300666 - DNA, 20 bp, Artificial Sequence
  chemically synthesized
tcgcttgaacccacggggca

SEQ ID NO: 300667 - DNA, 20 bp, Artificial Sequence
  chemically synthesized
ttactgcatcctctgccccg

SEQ ID NO: 300668 - DNA, 20 bp, Artificial Sequence
  chemically synthesized
cgcttgaacccacggggcag

SEQ ID NO: 300669 - DNA, 20 bp, Artificial Sequence
  chemically synthesized
aacccacggggcagaggatg

SEQ ID NO: 300670 - DNA, 20 bp, Artificial Sequence
  chemically synthesized
cacggggcagaggatgcagt

SEQ ID NO: 300671 - DNA, 20 bp, Artificial Sequence
  chemically synthesized
ggcagaggatgcagtaagct

SEQ ID NO: 300672 - DNA, 20 bp, Artificial Sequence
  chemically synthesized
ggagtgcagtggcgcgatct

SEQ ID NO: 300673 - DNA, 20 bp, Artificial Sequence
  chemically synthesized
gttgccagtctggagtgcag

SEQ ID NO: 300674 - DNA, 20 bp, Artificial Sequence
  chemically synthesized
gagatcgcgccactgcactc

SEQ ID NO: 300675 - DNA, 20 bp, Artificial Sequence
  chemically synthesized
tctgttgccagtctggagtg

SEQ ID NO: 300676 - DNA, 20 bp, Artificial Sequence
  chemically synthesized
cgcgccactgcactccagac

SEQ ID NO: 300677 - DNA, 20 bp, Artificial Sequence
  chemically synthesized
ctcactctgttgccagtctg

SEQ ID NO: 300678 - DNA, 20 bp, Artificial Sequence
  chemically synthesized
gtctcactctgttgccagtc

SEQ ID NO: 300679 - DNA, 20 bp, Artificial Sequence
  chemically synthesized
actgcactccagactggcaa

SEQ ID NO: 300680 - DNA, 20 bp, Artificial Sequence
  chemically synthesized
tgcactccagactggcaaca

SEQ ID NO: 300681 - DNA, 20 bp, Artificial Sequence
  chemically synthesized
acggagtctcactctgttgc

SEQ ID NO: 300682 - DNA, 20 bp, Artificial Sequence
  chemically synthesized
ctccagactggcaacagagt

SEQ ID NO: 300683 - DNA, 20 bp, Artificial Sequence
  chemically synthesized
tttttttttttttggagacg

SEQ ID NO: 300684 - DNA, 20 bp, Artificial Sequence
  chemically synthesized
tttttttttttttttggaga

SEQ ID NO: 300685 - DNA, 20 bp, Artificial Sequence
  chemically synthesized
tttttttttttttttttttg

SEQ ID NO: 300686 - DNA, 20 bp, Artificial Sequence
  chemically synthesized
tttttttttttttttttttt

SEQ ID NO: 300687 - DNA, 20 bp, Artificial Sequence
  chemically synthesized
aaaaaaaaaaaacacacaaa

SEQ ID NO: 300688 - DNA, 20 bp, Artificial Sequence
  chemically synthesized
aaaaaaacacacaaatggct

SEQ ID NO: 300689 - DNA, 20 bp, Artificial Sequence
  chemically synthesized
aaccttgcagaggcagttct

SEQ ID NO: 300690 - DNA, 20 bp, Artificial Sequence
  chemically synthesized
tggctgagaactgcctctgc

SEQ ID NO: 300691 - DNA, 20 bp, Artificial Sequence
  chemically synthesized
gttatctaaccttgcagagg

SEQ ID NO: 300692 - DNA, 20 bp, Artificial Sequence
  chemically synthesized
ggctgagaactgcctctgca

SEQ ID NO: 300693 - DNA, 20 bp, Artificial Sequence
  chemically synthesized
ctggttatctaaccttgcag

SEQ ID NO: 300694 - DNA, 20 bp, Artificial Sequence
  chemically synthesized
tctggttatctaaccttgca

SEQ ID NO: 300695 - DNA, 20 bp, Artificial Sequence
  chemically synthesized
gagaactgcctctgcaaggt

SEQ ID NO: 300696 - DNA, 20 bp, Artificial Sequence
  chemically synthesized
tttctggttatctaaccttg

SEQ ID NO: 300697 - DNA, 20 bp, Artificial Sequence
  chemically synthesized
cctctgcaaggttagataac

SEQ ID NO: 300698 - DNA, 20 bp, Artificial Sequence
  chemically synthesized
tgcaaggttagataaccaga

SEQ ID NO: 300699 - DNA, 20 bp, Artificial Sequence
  chemically synthesized
ggttagataaccagaaagac

SEQ ID NO: 300700 - DNA, 20 bp, Artificial Sequence
  chemically synthesized
tactaaccaccttgtctttc

SEQ ID NO: 300701 - DNA, 20 bp, Artificial Sequence
  chemically synthesized
gttagataaccagaaagaca

SEQ ID NO: 300702 - DNA, 20 bp, Artificial Sequence
  chemically synthesized
agataaccagaaagacaagg

SEQ ID NO: 300703 - DNA, 20 bp, Artificial Sequence
  chemically synthesized
aaccagaaagacaaggtggt

SEQ ID NO: 300704 - DNA, 20 bp, Artificial Sequence
  chemically synthesized
cagaaagacaaggtggttag

SEQ ID NO: 300705 - DNA, 20 bp, Artificial Sequence
  chemically synthesized
agacaaggtggttagtagca

SEQ ID NO: 300706 - DNA, 20 bp, Artificial Sequence
  chemically synthesized
caaggtggttagtagcacgg

SEQ ID NO: 300707 - DNA, 20 bp, Artificial Sequence
  chemically synthesized
ggtggttagtagcacggtgg

SEQ ID NO: 300708 - DNA, 20 bp, Artificial Sequence
  chemically synthesized
gtggttagtagcacggtggc

SEQ ID NO: 300709 - DNA, 20 bp, Artificial Sequence
  chemically synthesized
tagcacggtggcaggtaaca

SEQ ID NO: 300710 - DNA, 20 bp, Artificial Sequence
  chemically synthesized
agcacggtggcaggtaacat

SEQ ID NO: 300711 - DNA, 20 bp, Artificial Sequence
  chemically synthesized
ggtggcaggtaacatgggaa

SEQ ID NO: 300712 - DNA, 20 bp, Artificial Sequence
  chemically synthesized
gtggcaggtaacatgggaat

SEQ ID NO: 300713 - DNA, 20 bp, Artificial Sequence
  chemically synthesized
ggtaacatgggaatgggaaa

SEQ ID NO: 300714 - DNA, 20 bp, Artificial Sequence
  chemically synthesized
acatgggaatgggaaaaaga

SEQ ID NO: 300715 - DNA, 20 bp, Artificial Sequence
  chemically synthesized
catgggaatgggaaaaagaa

SEQ ID NO: 300716 - DNA, 20 bp, Artificial Sequence
  chemically synthesized
gggaaaaagaaaggtatcta

SEQ ID NO: 300717 - DNA, 20 bp, Artificial Sequence
  chemically synthesized
gaaaaagaaaggtatctaaa

SEQ ID NO: 300718 - DNA, 20 bp, Artificial Sequence
  chemically synthesized
tctctgcctaagattctctt

SEQ ID NO: 300719 - DNA, 20 bp, Artificial Sequence
  chemically synthesized
aaggtatctaaagagaatct

SEQ ID NO: 300720 - DNA, 20 bp, Artificial Sequence
  chemically synthesized
aggtatctaaagagaatctt

SEQ ID NO: 300721 - DNA, 20 bp, Artificial Sequence
  chemically synthesized
tatctaaagagaatcttagg

SEQ ID NO: 300722 - DNA, 20 bp, Artificial Sequence
  chemically synthesized
tctaaagagaatcttaggca

SEQ ID NO: 300723 - DNA, 20 bp, Artificial Sequence
  chemically synthesized
acctactgttttctctgcct

SEQ ID NO: 300724 - DNA, 20 bp, Artificial Sequence
  chemically synthesized
agaatcttaggcagagaaaa

SEQ ID NO: 300725 - DNA, 20 bp, Artificial Sequence
  chemically synthesized
atcttaggcagagaaaacag

SEQ ID NO: 300726 - DNA, 20 bp, Artificial Sequence
  chemically synthesized
tcttaggcagagaaaacagt

SEQ ID NO: 300727 - DNA, 20 bp, Artificial Sequence
  chemically synthesized
cagagaaaacagtaggtaca

SEQ ID NO: 300728 - DNA, 20 bp, Artificial Sequence
  chemically synthesized
aaacagtaggtacaaagaaa

SEQ ID NO: 300729 - DNA, 20 bp, Artificial Sequence
  chemically synthesized
cagtaggtacaaagaaacag

SEQ ID NO: 300730 - DNA, 20 bp, Artificial Sequence
  chemically synthesized
gtacaaagaaacagaagctt

SEQ ID NO: 300731 - DNA, 20 bp, Artificial Sequence
  chemically synthesized
aaagaaacagaagcttaaga

SEQ ID NO: 300732 - DNA, 20 bp, Artificial Sequence
  chemically synthesized
caaatgctctgtgctttctt

SEQ ID NO: 300733 - DNA, 20 bp, Artificial Sequence
  chemically synthesized
aacagaagcttaagaaagca

SEQ ID NO: 300734 - DNA, 20 bp, Artificial Sequence
  chemically synthesized
cagaagcttaagaaagcaca

SEQ ID NO: 300735 - DNA, 20 bp, Artificial Sequence
  chemically synthesized
ttaagaaagcacagagcatt

SEQ ID NO: 300736 - DNA, 20 bp, Artificial Sequence
  chemically synthesized
aagaaagcacagagcatttg

SEQ ID NO: 300737 - DNA, 20 bp, Artificial Sequence
  chemically synthesized
cacagagcatttggagatca

SEQ ID NO: 300738 - DNA, 20 bp, Artificial Sequence
  chemically synthesized
cagagcatttggagatcaaa

SEQ ID NO: 300739 - DNA, 20 bp, Artificial Sequence
  chemically synthesized
agcatttggagatcaaagag

SEQ ID NO: 300740 - DNA, 20 bp, Artificial Sequence
  chemically synthesized
gatcaaagagtggttaattt

SEQ ID NO: 300741 - DNA, 20 bp, Artificial Sequence
  chemically synthesized
agagtggttaatttaagcta

SEQ ID NO: 300742 - DNA, 20 bp, Artificial Sequence
  chemically synthesized
ggttaatttaagctaaagca

SEQ ID NO: 300743 - DNA, 20 bp, Artificial Sequence
  chemically synthesized
gttaatttaagctaaagcat

SEQ ID NO: 300744 - DNA, 20 bp, Artificial Sequence
  chemically synthesized
ttaatttaagctaaagcata

SEQ ID NO: 300745 - DNA, 20 bp, Artificial Sequence
  chemically synthesized
ttccgcactgccctatgctt

SEQ ID NO: 300746 - DNA, 20 bp, Artificial Sequence
  chemically synthesized
atttaagctaaagcataggg

SEQ ID NO: 300747 - DNA, 20 bp, Artificial Sequence
  chemically synthesized
agctaaagcatagggcagtg

SEQ ID NO: 300748 - DNA, 20 bp, Artificial Sequence
  chemically synthesized
gcatagggcagtgcggaaca

SEQ ID NO: 300749 - DNA, 20 bp, Artificial Sequence
  chemically synthesized
gggcagtgcggaacaaagtt

SEQ ID NO: 300750 - DNA, 20 bp, Artificial Sequence
  chemically synthesized
gcggaacaaagttcagactt

SEQ ID NO: 300751 - DNA, 20 bp, Artificial Sequence
  chemically synthesized
gaacaaagttcagactttag

SEQ ID NO: 300752 - DNA, 20 bp, Artificial Sequence
  chemically synthesized
aaagttcagactttagcaga

SEQ ID NO: 300753 - DNA, 20 bp, Artificial Sequence
  chemically synthesized
aaacagttcactgtctgcta

SEQ ID NO: 300754 - DNA, 20 bp, Artificial Sequence
  chemically synthesized
tcttacagactaatagcaaa

SEQ ID NO: 300755 - DNA, 20 bp, Artificial Sequence
  chemically synthesized
gacagtgaactgtttgctat

SEQ ID NO: 300756 - DNA, 20 bp, Artificial Sequence
  chemically synthesized
cttttcttcttacagactaa

SEQ ID NO: 300757 - DNA, 20 bp, Artificial Sequence
  chemically synthesized
actgtttgctattagtctgt

SEQ ID NO: 300758 - DNA, 20 bp, Artificial Sequence
  chemically synthesized
gtttgctattagtctgtaag

SEQ ID NO: 300759 - DNA, 20 bp, Artificial Sequence
  chemically synthesized
tgaaaactcttttcttctta

SEQ ID NO: 300760 - DNA, 20 bp, Artificial Sequence
  chemically synthesized
ctattagtctgtaagaagaa

SEQ ID NO: 300761 - DNA, 20 bp, Artificial Sequence
  chemically synthesized
attagtctgtaagaagaaaa

SEQ ID NO: 300762 - DNA, 20 bp, Artificial Sequence
  chemically synthesized
aagaagaaaagagttttcac

SEQ ID NO: 300763 - DNA, 20 bp, Artificial Sequence
  chemically synthesized
gaagaaaagagttttcacca

SEQ ID NO: 300764 - DNA, 20 bp, Artificial Sequence
  chemically synthesized
gactcagttgatttatactc

SEQ ID NO: 300765 - DNA, 20 bp, Artificial Sequence
  chemically synthesized
caccagagtataaatcaact

SEQ ID NO: 300766 - DNA, 20 bp, Artificial Sequence
  chemically synthesized
aaatcgtttgttcagtgact

SEQ ID NO: 300767 - DNA, 20 bp, Artificial Sequence
  chemically synthesized
ataagatcaaatcgtttgtt

SEQ ID NO: 300768 - DNA, 20 bp, Artificial Sequence
  chemically synthesized
tcggcaattaaaagcaaaat

SEQ ID NO: 300769 - DNA, 20 bp, Artificial Sequence
  chemically synthesized
caagaaagttcggcaattaa

SEQ ID NO: 300770 - DNA, 20 bp, Artificial Sequence
  chemically synthesized
cttcctttgtcaagaaagtt

SEQ ID NO: 300771 - DNA, 20 bp, Artificial Sequence
  chemically synthesized
tactccttcctttgtcaaga

SEQ ID NO: 300772 - DNA, 20 bp, Artificial Sequence
  chemically synthesized
attgccgaactttcttgaca

SEQ ID NO: 300773 - DNA, 20 bp, Artificial Sequence
  chemically synthesized
ttgccgaactttcttgacaa

SEQ ID NO: 300774 - DNA, 20 bp, Artificial Sequence
  chemically synthesized
aatgtactccttcctttgtc

SEQ ID NO: 300775 - DNA, 20 bp, Artificial Sequence
  chemically synthesized
ccgaactttcttgacaaagg

SEQ ID NO: 300776 - DNA, 20 bp, Artificial Sequence
  chemically synthesized
cgaactttcttgacaaagga

SEQ ID NO: 300777 - DNA, 20 bp, Artificial Sequence
  chemically synthesized
aactttcttgacaaaggaag

SEQ ID NO: 300778 - DNA, 20 bp, Artificial Sequence
  chemically synthesized
gagtacattgatttatattc

SEQ ID NO: 300779 - DNA, 20 bp, Artificial Sequence
  chemically synthesized
attgatttatattctggctc

SEQ ID NO: 300780 - DNA, 20 bp, Artificial Sequence
  chemically synthesized
ttgagataagaagcttgagc

SEQ ID NO: 300781 - DNA, 20 bp, Artificial Sequence
  chemically synthesized
acaattgagataagaagctt

SEQ ID NO: 300782 - DNA, 20 bp, Artificial Sequence
  chemically synthesized
cagtccacaattgagataag

SEQ ID NO: 300783 - DNA, 20 bp, Artificial Sequence
  chemically synthesized
taccagtccacaattgagat

SEQ ID NO: 300784 - DNA, 20 bp, Artificial Sequence
  chemically synthesized
caagcttcttatctcaattg

SEQ ID NO: 300785 - DNA, 20 bp, Artificial Sequence
  chemically synthesized
tttagtaccagtccacaatt

SEQ ID NO: 300786 - DNA, 20 bp, Artificial Sequence
  chemically synthesized
ttcttatctcaattgtggac

SEQ ID NO: 300787 - DNA, 20 bp, Artificial Sequence
  chemically synthesized
atctgcaaactttttagtac

SEQ ID NO: 300788 - DNA, 20 bp, Artificial Sequence
  chemically synthesized
aattgtggactggtactaaa

SEQ ID NO: 300789 - DNA, 20 bp, Artificial Sequence
  chemically synthesized
caaataatctgcaaactttt

SEQ ID NO: 300790 - DNA, 20 bp, Artificial Sequence
  chemically synthesized
gactggtactaaaaagtttg

SEQ ID NO: 300791 - DNA, 20 bp, Artificial Sequence
  chemically synthesized
taaaaagtttgcagattatt

SEQ ID NO: 300792 - DNA, 20 bp, Artificial Sequence
  chemically synthesized
aaaagtttgcagattatttg

SEQ ID NO: 300793 - DNA, 20 bp, Artificial Sequence
  chemically synthesized
agtttgcagattatttggag

SEQ ID NO: 300794 - DNA, 20 bp, Artificial Sequence
  chemically synthesized
cagattatttggagtagcac

SEQ ID NO: 300795 - DNA, 20 bp, Artificial Sequence
  chemically synthesized
tccttttttaaaaaaaatac

SEQ ID NO: 300796 - DNA, 20 bp, Artificial Sequence
  chemically synthesized
cactggtattttttttaaaa

SEQ ID NO: 300797 - DNA, 20 bp, Artificial Sequence
  chemically synthesized
actggtattttttttaaaaa

SEQ ID NO: 300798 - DNA, 20 bp, Artificial Sequence
  chemically synthesized
tggtattttttttaaaaaag

SEQ ID NO: 300799 - DNA, 20 bp, Artificial Sequence
  chemically synthesized
tattttttttaaaaaaggag

SEQ ID NO: 300800 - DNA, 20 bp, Artificial Sequence
  chemically synthesized
ttttttttaaaaaaggagca

SEQ ID NO: 300801 - DNA, 20 bp, Artificial Sequence
  chemically synthesized
tttttttaaaaaaggagcag

SEQ ID NO: 300802 - DNA, 20 bp, Artificial Sequence
  chemically synthesized
tttttaaaaaaggagcagag

SEQ ID NO: 300803 - DNA, 20 bp, Artificial Sequence
  chemically synthesized
ttaaaaaaggagcagaggag

SEQ ID NO: 300804 - DNA, 20 bp, Artificial Sequence
  chemically synthesized
taaaaaaggagcagaggaga

SEQ ID NO: 300805 - DNA, 20 bp, Artificial Sequence
  chemically synthesized
aaaaaaggagcagaggagaa

SEQ ID NO: 300806 - DNA, 20 bp, Artificial Sequence
  chemically synthesized
aaaaggagcagaggagaagg

SEQ ID NO: 300807 - DNA, 20 bp, Artificial Sequence
  chemically synthesized
gagcagaggagaagggagtg

SEQ ID NO: 300808 - DNA, 20 bp, Artificial Sequence
  chemically synthesized
agaggagaagggagtgaagc

SEQ ID NO: 300809 - DNA, 20 bp, Artificial Sequence
  chemically synthesized
aggagaagggagtgaagctg

SEQ ID NO: 300810 - DNA, 20 bp, Artificial Sequence
  chemically synthesized
gagaagggagtgaagctgga

SEQ ID NO: 300811 - DNA, 20 bp, Artificial Sequence
  chemically synthesized
agaagggagtgaagctggag

SEQ ID NO: 300812 - DNA, 20 bp, Artificial Sequence
  chemically synthesized
agggagtgaagctggagagg

SEQ ID NO: 300813 - DNA, 20 bp, Artificial Sequence
  chemically synthesized
gggagtgaagctggagaggt

SEQ ID NO: 300814 - DNA, 20 bp, Artificial Sequence
  chemically synthesized
tctttagctgcctacctctc

SEQ ID NO: 300815 - DNA, 20 bp, Artificial Sequence
  chemically synthesized
agtgaagctggagaggtagg

SEQ ID NO: 300816 - DNA, 20 bp, Artificial Sequence
  chemically synthesized
gctggagaggtaggcagcta

SEQ ID NO: 300817 - DNA, 20 bp, Artificial Sequence
  chemically synthesized
agaaattcttttgtgatctt

SEQ ID NO: 300818 - DNA, 20 bp, Artificial Sequence
  chemically synthesized
taggcagctaaagatcacaa

SEQ ID NO: 300819 - DNA, 20 bp, Artificial Sequence
  chemically synthesized
aaatcttgaaatgcatggcg

SEQ ID NO: 300820 - DNA, 20 bp, Artificial Sequence
  chemically synthesized
cccataaatcttgaaatgca

SEQ ID NO: 300821 - DNA, 20 bp, Artificial Sequence
  chemically synthesized
atttctacgccatgcatttc

SEQ ID NO: 300822 - DNA, 20 bp, Artificial Sequence
  chemically synthesized
gccatgcatttcaagattta

SEQ ID NO: 300823 - DNA, 20 bp, Artificial Sequence
  chemically synthesized
ccatgcatttcaagatttat

SEQ ID NO: 300824 - DNA, 20 bp, Artificial Sequence
  chemically synthesized
tgcatttcaagatttatggg

SEQ ID NO: 300825 - DNA, 20 bp, Artificial Sequence
  chemically synthesized
gcatttcaagatttatgggc

SEQ ID NO: 300826 - DNA, 20 bp, Artificial Sequence
  chemically synthesized
catttcaagatttatgggca

SEQ ID NO: 300827 - DNA, 20 bp, Artificial Sequence
  chemically synthesized
atttcaagatttatgggcag

SEQ ID NO: 300828 - DNA, 20 bp, Artificial Sequence
  chemically synthesized
tcttaaaatgcagttttaat

SEQ ID NO: 300829 - DNA, 20 bp, Artificial Sequence
  chemically synthesized
tctaattaaaactgcatttt

SEQ ID NO: 300830 - DNA, 20 bp, Artificial Sequence
  chemically synthesized
ccgagggatatcttaaaatg

SEQ ID NO: 300831 - DNA, 20 bp, Artificial Sequence
  chemically synthesized
ctgcattttaagatatccct

SEQ ID NO: 300832 - DNA, 20 bp, Artificial Sequence
  chemically synthesized
tgcattttaagatatccctc

SEQ ID NO: 300833 - DNA, 20 bp, Artificial Sequence
  chemically synthesized
cattttaagatatccctcgg

SEQ ID NO: 300834 - DNA, 20 bp, Artificial Sequence
  chemically synthesized
attttaagatatccctcggg

SEQ ID NO: 300835 - DNA, 20 bp, Artificial Sequence
  chemically synthesized
tgctttttacagcctcccga

SEQ ID NO: 300836 - DNA, 20 bp, Artificial Sequence
  chemically synthesized
atgctttttacagcctcccg

SEQ ID NO: 300837 - DNA, 20 bp, Artificial Sequence
  chemically synthesized
catgctttttacagcctccc

SEQ ID NO: 300838 - DNA, 20 bp, Artificial Sequence
  chemically synthesized
atccctcgggaggctgtaaa

SEQ ID NO: 300839 - DNA, 20 bp, Artificial Sequence
  chemically synthesized
tctcttatccatgcttttta

SEQ ID NO: 300840 - DNA, 20 bp, Artificial Sequence
  chemically synthesized
tcgggaggctgtaaaaagca

SEQ ID NO: 300841 - DNA, 20 bp, Artificial Sequence
  chemically synthesized
aggctgtaaaaagcatggat

SEQ ID NO: 300842 - DNA, 20 bp, Artificial Sequence
  chemically synthesized
gctgtaaaaagcatggataa

SEQ ID NO: 300843 - DNA, 20 bp, Artificial Sequence
  chemically synthesized
tgtaaaaagcatggataaga

SEQ ID NO: 300844 - DNA, 20 bp, Artificial Sequence
  chemically synthesized
gtaaaaagcatggataagag

SEQ ID NO: 300845 - DNA, 20 bp, Artificial Sequence
  chemically synthesized
aaagcatggataagagaggt

SEQ ID NO: 300846 - DNA, 20 bp, Artificial Sequence
  chemically synthesized
atggataagagaggtgagat

SEQ ID NO: 300847 - DNA, 20 bp, Artificial Sequence
  chemically synthesized
ggataagagaggtgagatca

SEQ ID NO: 300848 - DNA, 20 bp, Artificial Sequence
  chemically synthesized
gataagagaggtgagatcag

SEQ ID NO: 300849 - DNA, 20 bp, Artificial Sequence
  chemically synthesized
aagagaggtgagatcagagg

SEQ ID NO: 300850 - DNA, 20 bp, Artificial Sequence
  chemically synthesized
gagaggtgagatcagaggca

SEQ ID NO: 300851 - DNA, 20 bp, Artificial Sequence
  chemically synthesized
gagatcagaggcagagaaat

SEQ ID NO: 300852 - DNA, 20 bp, Artificial Sequence
  chemically synthesized
aatcagttaaaaatttcata

SEQ ID NO: 300853 - DNA, 20 bp, Artificial Sequence
  chemically synthesized
aatttcatacagaaaaattt

SEQ ID NO: 300854 - DNA, 20 bp, Artificial Sequence
  chemically synthesized
agaaaaatttcagttttaac

SEQ ID NO: 300855 - DNA, 20 bp, Artificial Sequence
  chemically synthesized
aaaaatttcagttttaacta

SEQ ID NO: 300856 - DNA, 20 bp, Artificial Sequence
  chemically synthesized
tttcagttttaactagagtg

SEQ ID NO: 300857 - DNA, 20 bp, Artificial Sequence
  chemically synthesized
ttcagttttaactagagtga

SEQ ID NO: 300858 - DNA, 20 bp, Artificial Sequence
  chemically synthesized
catccttgctgccttcactc

SEQ ID NO: 300859 - DNA, 20 bp, Artificial Sequence
  chemically synthesized
agttttaactagagtgaagg

SEQ ID NO: 300860 - DNA, 20 bp, Artificial Sequence
  chemically synthesized
ttaactagagtgaaggcagc

SEQ ID NO: 300861 - DNA, 20 bp, Artificial Sequence
  chemically synthesized
taactagagtgaaggcagca

SEQ ID NO: 300862 - DNA, 20 bp, Artificial Sequence
  chemically synthesized
gagtgaaggcagcaaggatg

SEQ ID NO: 300863 - DNA, 20 bp, Artificial Sequence
  chemically synthesized
tagaaaaaaataacaaacta

SEQ ID NO: 300864 - DNA, 20 bp, Artificial Sequence
  chemically synthesized
gaaaaaaataacaaactaaa

SEQ ID NO: 300865 - DNA, 20 bp, Artificial Sequence
  chemically synthesized
tgtacctgttaaattctctt

SEQ ID NO: 300866 - DNA, 20 bp, Artificial Sequence
  chemically synthesized
acaaactaaagagaatttaa

SEQ ID NO: 300867 - DNA, 20 bp, Artificial Sequence
  chemically synthesized
caaactaaagagaatttaac

SEQ ID NO: 300868 - DNA, 20 bp, Artificial Sequence
  chemically synthesized
gagaatttaacaggtacatt

SEQ ID NO: 300869 - DNA, 20 bp, Artificial Sequence
  chemically synthesized
gaatttaacaggtacatttg

SEQ ID NO: 300870 - DNA, 20 bp, Artificial Sequence
  chemically synthesized
aatttaacaggtacatttgg

SEQ ID NO: 300871 - DNA, 20 bp, Artificial Sequence
  chemically synthesized
atttaacaggtacatttgga

SEQ ID NO: 300872 - DNA, 20 bp, Artificial Sequence
  chemically synthesized
caggtacatttggagggatt

SEQ ID NO: 300873 - DNA, 20 bp, Artificial Sequence
  chemically synthesized
tttggagggatttagtgatg

SEQ ID NO: 300874 - DNA, 20 bp, Artificial Sequence
  chemically synthesized
ggagggatttagtgatgtgg

SEQ ID NO: 300875 - DNA, 20 bp, Artificial Sequence
  chemically synthesized
ttagtgatgtggcagatatc

SEQ ID NO: 300876 - DNA, 20 bp, Artificial Sequence
  chemically synthesized
gatatcaagaccactgtgaa

SEQ ID NO: 300877 - DNA, 20 bp, Artificial Sequence
  chemically synthesized
acctgtgcagccattcacag

SEQ ID NO: 300878 - DNA, 20 bp, Artificial Sequence
  chemically synthesized
gcaacctgtgcagccattca

SEQ ID NO: 300879 - DNA, 20 bp, Artificial Sequence
  chemically synthesized
gaccactgtgaatggctgca

SEQ ID NO: 300880 - DNA, 20 bp, Artificial Sequence
  chemically synthesized
accactgtgaatggctgcac

SEQ ID NO: 300881 - DNA, 20 bp, Artificial Sequence
  chemically synthesized
tgtgcagtgagcaacctgtg

SEQ ID NO: 300882 - DNA, 20 bp, Artificial Sequence
  chemically synthesized
gcacaggttgctcactgcac

SEQ ID NO: 300883 - DNA, 20 bp, Artificial Sequence
  chemically synthesized
acatcctgaacttgtgcagt

SEQ ID NO: 300884 - DNA, 20 bp, Artificial Sequence
  chemically synthesized
tggtacatcctgaacttgtg

SEQ ID NO: 300885 - DNA, 20 bp, Artificial Sequence
  chemically synthesized
ggttgctcactgcacaagtt

SEQ ID NO: 300886 - DNA, 20 bp, Artificial Sequence
  chemically synthesized
gttgctcactgcacaagttc

SEQ ID NO: 300887 - DNA, 20 bp, Artificial Sequence
  chemically synthesized
agttcaggatgtaccattct

SEQ ID NO: 300888 - DNA, 20 bp, Artificial Sequence
  chemically synthesized
ttcaggatgtaccattctta

SEQ ID NO: 300889 - DNA, 20 bp, Artificial Sequence
  chemically synthesized
cacatcatagtctctaagaa

SEQ ID NO: 300890 - DNA, 20 bp, Artificial Sequence
  chemically synthesized
tcattcacatcatagtctct

SEQ ID NO: 300891 - DNA, 20 bp, Artificial Sequence
  chemically synthesized
agagagggtcattcacatca

SEQ ID NO: 300892 - DNA, 20 bp, Artificial Sequence
  chemically synthesized
atgatgtgaatgaccctctc

SEQ ID NO: 300893 - DNA, 20 bp, Artificial Sequence
  chemically synthesized
gatgtgaatgaccctctcta

SEQ ID NO: 300894 - DNA, 20 bp, Artificial Sequence
  chemically synthesized
agatcgtataactctagaga

SEQ ID NO: 300895 - DNA, 20 bp, Artificial Sequence
  chemically synthesized
tagatcgtataactctagag

SEQ ID NO: 300896 - DNA, 20 bp, Artificial Sequence
  chemically synthesized
ttagatcgtataactctaga

SEQ ID NO: 300897 - DNA, 20 bp, Artificial Sequence
  chemically synthesized
gtttagatcgtataactcta

SEQ ID NO: 300898 - DNA, 20 bp, Artificial Sequence
  chemically synthesized
gagtttagatcgtataactc

SEQ ID NO: 300899 - DNA, 20 bp, Artificial Sequence
  chemically synthesized
taaaatatagttttggagtt

SEQ ID NO: 300900 - DNA, 20 bp, Artificial Sequence
  chemically synthesized
gaatctaaaatatagttttg

SEQ ID NO: 300901 - DNA, 20 bp, Artificial Sequence
  chemically synthesized
tggaatctaaaatatagttt

SEQ ID NO: 300902 - DNA, 20 bp, Artificial Sequence
  chemically synthesized
taaactccaaaactatattt

SEQ ID NO: 300903 - DNA, 20 bp, Artificial Sequence
  chemically synthesized
tctgactggaatctaaaata

SEQ ID NO: 300904 - DNA, 20 bp, Artificial Sequence
  chemically synthesized
caaaactatattttagattc

SEQ ID NO: 300905 - DNA, 20 bp, Artificial Sequence
  chemically synthesized
actatattttagattccagt

SEQ ID NO: 300906 - DNA, 20 bp, Artificial Sequence
  chemically synthesized
tgtattcctggatttctgac

SEQ ID NO: 300907 - DNA, 20 bp, Artificial Sequence
  chemically synthesized
ttagattccagtcagaaatc

SEQ ID NO: 300908 - DNA, 20 bp, Artificial Sequence
  chemically synthesized
tagattccagtcagaaatcc

SEQ ID NO: 300909 - DNA, 20 bp, Artificial Sequence
  chemically synthesized
gcttataggctatgtattcc

SEQ ID NO: 300910 - DNA, 20 bp, Artificial Sequence
  chemically synthesized
gtcagaaatccaggaataca

SEQ ID NO: 300911 - DNA, 20 bp, Artificial Sequence
  chemically synthesized
tccaggaatacatagcctat

SEQ ID NO: 300912 - DNA, 20 bp, Artificial Sequence
  chemically synthesized
tgtataattcaaatgcttat

SEQ ID NO: 300913 - DNA, 20 bp, Artificial Sequence
  chemically synthesized
ctgtataattcaaatgctta

SEQ ID NO: 300914 - DNA, 20 bp, Artificial Sequence
  chemically synthesized
ctataagcatttgaattata

SEQ ID NO: 300915 - DNA, 20 bp, Artificial Sequence
  chemically synthesized
tataagcatttgaattatac

SEQ ID NO: 300916 - DNA, 20 bp, Artificial Sequence
  chemically synthesized
ataagcatttgaattataca

SEQ ID NO: 300917 - DNA, 20 bp, Artificial Sequence
  chemically synthesized
aattatacagggatgaacat

SEQ ID NO: 300918 - DNA, 20 bp, Artificial Sequence
  chemically synthesized
attatacagggatgaacatc

SEQ ID NO: 300919 - DNA, 20 bp, Artificial Sequence
  chemically synthesized
tatacagggatgaacatcag

SEQ ID NO: 300920 - DNA, 20 bp, Artificial Sequence
  chemically synthesized
tacagggatgaacatcagga

SEQ ID NO: 300921 - DNA, 20 bp, Artificial Sequence
  chemically synthesized
cagggatgaacatcaggaga

SEQ ID NO: 300922 - DNA, 20 bp, Artificial Sequence
  chemically synthesized
agggatgaacatcaggagag

SEQ ID NO: 300923 - DNA, 20 bp, Artificial Sequence
  chemically synthesized
gggatgaacatcaggagaga

SEQ ID NO: 300924 - DNA, 20 bp, Artificial Sequence
  chemically synthesized
gatgaacatcaggagagagg

SEQ ID NO: 300925 - DNA, 20 bp, Artificial Sequence
  chemically synthesized
tgaacatcaggagagaggga

SEQ ID NO: 300926 - DNA, 20 bp, Artificial Sequence
  chemically synthesized
gaacatcaggagagagggag

SEQ ID NO: 300927 - DNA, 20 bp, Artificial Sequence
  chemically synthesized
catcaggagagagggagagg

SEQ ID NO: 300928 - DNA, 20 bp, Artificial Sequence
  chemically synthesized
caatttgtgaatcaaaaata

SEQ ID NO: 300929 - DNA, 20 bp, Artificial Sequence
  chemically synthesized
aatttgtgaatcaaaaatat

SEQ ID NO: 300930 - DNA, 20 bp, Artificial Sequence
  chemically synthesized
caaaaatataggtgatgata

SEQ ID NO: 300931 - DNA, 20 bp, Artificial Sequence
  chemically synthesized
ttatgatgctttattttttg

SEQ ID NO: 300932 - DNA, 20 bp, Artificial Sequence
  chemically synthesized
cttatgatgctttatttttt

SEQ ID NO: 300933 - DNA, 20 bp, Artificial Sequence
  chemically synthesized
tgatatttccccaaaaaata

SEQ ID NO: 300934 - DNA, 20 bp, Artificial Sequence
  chemically synthesized
tcttatgatgctttattttt

SEQ ID NO: 300935 - DNA, 20 bp, Artificial Sequence
  chemically synthesized
cccaaaaaataaagcatcat

SEQ ID NO: 300936 - DNA, 20 bp, Artificial Sequence
  chemically synthesized
aaaaaataaagcatcataag

SEQ ID NO: 300937 - DNA, 20 bp, Artificial Sequence
  chemically synthesized
agaaaataaaatcacaattt

SEQ ID NO: 300938 - DNA, 20 bp, Artificial Sequence
  chemically synthesized
atcacaatttgagtcttatg

SEQ ID NO: 300939 - DNA, 20 bp, Artificial Sequence
  chemically synthesized
cctttaatgtcagtctacat

SEQ ID NO: 300940 - DNA, 20 bp, Artificial Sequence
  chemically synthesized
tcttatgtagactgacatta

SEQ ID NO: 300941 - DNA, 20 bp, Artificial Sequence
  chemically synthesized
cttatgtagactgacattaa

SEQ ID NO: 300942 - DNA, 20 bp, Artificial Sequence
  chemically synthesized
ctattcctgccctttaatgt

SEQ ID NO: 300943 - DNA, 20 bp, Artificial Sequence
  chemically synthesized
ttatgtagactgacattaaa

SEQ ID NO: 300944 - DNA, 20 bp, Artificial Sequence
  chemically synthesized
tgtagactgacattaaaggg

SEQ ID NO: 300945 - DNA, 20 bp, Artificial Sequence
  chemically synthesized
gtagactgacattaaagggc

SEQ ID NO: 300946 - DNA, 20 bp, Artificial Sequence
  chemically synthesized
ctgacattaaagggcaggaa

SEQ ID NO: 300947 - DNA, 20 bp, Artificial Sequence
  chemically synthesized
acattaaagggcaggaatag

SEQ ID NO: 300948 - DNA, 20 bp, Artificial Sequence
  chemically synthesized
taaagggcaggaatagaaga

SEQ ID NO: 300949 - DNA, 20 bp, Artificial Sequence
  chemically synthesized
aaagggcaggaatagaagac

SEQ ID NO: 300950 - DNA, 20 bp, Artificial Sequence
  chemically synthesized
aagggcaggaatagaagaca

SEQ ID NO: 300951 - DNA, 20 bp, Artificial Sequence
  chemically synthesized
ggcaggaatagaagacaggg

SEQ ID NO: 300952 - DNA, 20 bp, Artificial Sequence
  chemically synthesized
acagggaagatatactctga

SEQ ID NO: 300953 - DNA, 20 bp, Artificial Sequence
  chemically synthesized
ttctctcctgttttctttca

SEQ ID NO: 300954 - DNA, 20 bp, Artificial Sequence
  chemically synthesized
tgttctctcctgttttcttt

SEQ ID NO: 300955 - DNA, 20 bp, Artificial Sequence
  chemically synthesized
agatatactctgaaagaaaa

SEQ ID NO: 300956 - DNA, 20 bp, Artificial Sequence
  chemically synthesized
gatatactctgaaagaaaac

SEQ ID NO: 300957 - DNA, 20 bp, Artificial Sequence
  chemically synthesized
tatactctgaaagaaaacag

SEQ ID NO: 300958 - DNA, 20 bp, Artificial Sequence
  chemically synthesized
tactctgaaagaaaacagga

SEQ ID NO: 300959 - DNA, 20 bp, Artificial Sequence
  chemically synthesized
aacaggagagaacaatgtcc

SEQ ID NO: 300960 - DNA, 20 bp, Artificial Sequence
  chemically synthesized
ttttctctcctgcagtttct

SEQ ID NO: 300961 - DNA, 20 bp, Artificial Sequence
  chemically synthesized
gaacaatgtcccagaaactg

SEQ ID NO: 300962 - DNA, 20 bp, Artificial Sequence
  chemically synthesized
tttttctctcctgcagtttc

SEQ ID NO: 300963 - DNA, 20 bp, Artificial Sequence
  chemically synthesized
aacaatgtcccagaaactgc

SEQ ID NO: 300964 - DNA, 20 bp, Artificial Sequence
  chemically synthesized
caatgtcccagaaactgcag

SEQ ID NO: 300965 - DNA, 20 bp, Artificial Sequence
  chemically synthesized
atgtcccagaaactgcagga

SEQ ID NO: 300966 - DNA, 20 bp, Artificial Sequence
  chemically synthesized
cttgaaatttttctctcctg

SEQ ID NO: 300967 - DNA, 20 bp, Artificial Sequence
  chemically synthesized
ctgcaggagagaaaaatttc

SEQ ID NO: 300968 - DNA, 20 bp, Artificial Sequence
  chemically synthesized
caggagagaaaaatttcaag

SEQ ID NO: 300969 - DNA, 20 bp, Artificial Sequence
  chemically synthesized
aggagagaaaaatttcaaga

SEQ ID NO: 300970 - DNA, 20 bp, Artificial Sequence
  chemically synthesized
ggagagaaaaatttcaagaa

SEQ ID NO: 300971 - DNA, 20 bp, Artificial Sequence
  chemically synthesized
ttgtgcttgacagaaatgat

SEQ ID NO: 300972 - DNA, 20 bp, Artificial Sequence
  chemically synthesized
agggactaatcatttctgtc

SEQ ID NO: 300973 - DNA, 20 bp, Artificial Sequence
  chemically synthesized
gacctttgtcttgtgcttga

SEQ ID NO: 300974 - DNA, 20 bp, Artificial Sequence
  chemically synthesized
taatcatttctgtcaagcac

SEQ ID NO: 300975 - DNA, 20 bp, Artificial Sequence
  chemically synthesized
tttctgtcaagcacaagaca

SEQ ID NO: 300976 - DNA, 20 bp, Artificial Sequence
  chemically synthesized
ttctgtcaagcacaagacaa

SEQ ID NO: 300977 - DNA, 20 bp, Artificial Sequence
  chemically synthesized
agcacaagacaaaggtcaaa

SEQ ID NO: 300978 - DNA, 20 bp, Artificial Sequence
  chemically synthesized
gcacaagacaaaggtcaaaa

SEQ ID NO: 300979 - DNA, 20 bp, Artificial Sequence
  chemically synthesized
cacaagacaaaggtcaaaaa

SEQ ID NO: 300980 - DNA, 20 bp, Artificial Sequence
  chemically synthesized
gacaaaggtcaaaaagggaa

SEQ ID NO: 300981 - DNA, 20 bp, Artificial Sequence
  chemically synthesized
tcaaaaagggaaaagaactg

SEQ ID NO: 300982 - DNA, 20 bp, Artificial Sequence
  chemically synthesized
aaaaagggaaaagaactgaa

SEQ ID NO: 300983 - DNA, 20 bp, Artificial Sequence
  chemically synthesized
cagctccaaaggtcactctt

SEQ ID NO: 300984 - DNA, 20 bp, Artificial Sequence
  chemically synthesized
aagaactgaagagtgacctt

SEQ ID NO: 300985 - DNA, 20 bp, Artificial Sequence
  chemically synthesized
gaactgaagagtgacctttg

SEQ ID NO: 300986 - DNA, 20 bp, Artificial Sequence
  chemically synthesized
tgaagagtgacctttggagc

SEQ ID NO: 300987 - DNA, 20 bp, Artificial Sequence
  chemically synthesized
tccttaattgccagctccaa

SEQ ID NO: 300988 - DNA, 20 bp, Artificial Sequence
  chemically synthesized
ctccttaattgccagctcca

SEQ ID NO: 300989 - DNA, 20 bp, Artificial Sequence
  chemically synthesized
gacctttggagctggcaatt

SEQ ID NO: 300990 - DNA, 20 bp, Artificial Sequence
  chemically synthesized
acctttggagctggcaatta

SEQ ID NO: 300991 - DNA, 20 bp, Artificial Sequence
  chemically synthesized
ccagagagctccttaattgc

SEQ ID NO: 300992 - DNA, 20 bp, Artificial Sequence
  chemically synthesized
ctttggagctggcaattaag

SEQ ID NO: 300993 - DNA, 20 bp, Artificial Sequence
  chemically synthesized
ctggcaattaaggagctctc

SEQ ID NO: 300994 - DNA, 20 bp, Artificial Sequence
  chemically synthesized
ctctcagcaaggtcgccaga

SEQ ID NO: 300995 - DNA, 20 bp, Artificial Sequence
  chemically synthesized
tgctctcagcaaggtcgcca

SEQ ID NO: 300996 - DNA, 20 bp, Artificial Sequence
  chemically synthesized
actgctctcagcaaggtcgc

SEQ ID NO: 300997 - DNA, 20 bp, Artificial Sequence
  chemically synthesized
agctctctggcgaccttgct

SEQ ID NO: 300998 - DNA, 20 bp, Artificial Sequence
  chemically synthesized
ctctctggcgaccttgctga

SEQ ID NO: 300999 - DNA, 20 bp, Artificial Sequence
  chemically synthesized
cactgaaactgctctcagca

SEQ ID NO: 301000 - DNA, 20 bp, Artificial Sequence
  chemically synthesized
gcactgaaactgctctcagc

SEQ ID NO: 301001 - DNA, 20 bp, Artificial Sequence
  chemically synthesized
tctggcgaccttgctgagag

SEQ ID NO: 301002 - DNA, 20 bp, Artificial Sequence
  chemically synthesized
tcgagcactgaaactgctct

SEQ ID NO: 301003 - DNA, 20 bp, Artificial Sequence
  chemically synthesized
gaccttgctgagagcagttt

SEQ ID NO: 301004 - DNA, 20 bp, Artificial Sequence
  chemically synthesized
agcagtttcagtgctcgatg

SEQ ID NO: 301005 - DNA, 20 bp, Artificial Sequence
  chemically synthesized
cagtttcagtgctcgatgta

SEQ ID NO: 301006 - DNA, 20 bp, Artificial Sequence
  chemically synthesized
accctctcatactctacatc

SEQ ID NO: 301007 - DNA, 20 bp, Artificial Sequence
  chemically synthesized
cagtgctcgatgtagagtat

SEQ ID NO: 301008 - DNA, 20 bp, Artificial Sequence
  chemically synthesized
gtgctcgatgtagagtatga

SEQ ID NO: 301009 - DNA, 20 bp, Artificial Sequence
  chemically synthesized
tgctcgatgtagagtatgag

SEQ ID NO: 301010 - DNA, 20 bp, Artificial Sequence
  chemically synthesized
gctcgatgtagagtatgaga

SEQ ID NO: 301011 - DNA, 20 bp, Artificial Sequence
  chemically synthesized
atgtagagtatgagagggta

SEQ ID NO: 301012 - DNA, 20 bp, Artificial Sequence
  chemically synthesized
tgtagagtatgagagggtaa

SEQ ID NO: 301013 - DNA, 20 bp, Artificial Sequence
  chemically synthesized
gagtatgagagggtaaagga

SEQ ID NO: 301014 - DNA, 20 bp, Artificial Sequence
  chemically synthesized
gagagggtaaaggaaagaat

SEQ ID NO: 301015 - DNA, 20 bp, Artificial Sequence
  chemically synthesized
agagggtaaaggaaagaatc

SEQ ID NO: 301016 - DNA, 20 bp, Artificial Sequence
  chemically synthesized
agggtaaaggaaagaatcag

SEQ ID NO: 301017 - DNA, 20 bp, Artificial Sequence
  chemically synthesized
ggaaagaatcaggagtccgt

SEQ ID NO: 301018 - DNA, 20 bp, Artificial Sequence
  chemically synthesized
gaaagaatcaggagtccgta

SEQ ID NO: 301019 - DNA, 20 bp, Artificial Sequence
  chemically synthesized
aaagaatcaggagtccgtaa

SEQ ID NO: 301020 - DNA, 20 bp, Artificial Sequence
  chemically synthesized
gaactatctgtattccctta

SEQ ID NO: 301021 - DNA, 20 bp, Artificial Sequence
  chemically synthesized
caggagtccgtaagggaata

SEQ ID NO: 301022 - DNA, 20 bp, Artificial Sequence
  chemically synthesized
agtccgtaagggaatacaga

SEQ ID NO: 301023 - DNA, 20 bp, Artificial Sequence
  chemically synthesized
gtaagggaatacagatagtt

SEQ ID NO: 301024 - DNA, 20 bp, Artificial Sequence
  chemically synthesized
taagggaatacagatagttc

SEQ ID NO: 301025 - DNA, 20 bp, Artificial Sequence
  chemically synthesized
aaaagtcagtttttaatcag

SEQ ID NO: 301026 - DNA, 20 bp, Artificial Sequence
  chemically synthesized
aataaaagtcagtttttaat

SEQ ID NO: 301027 - DNA, 20 bp, Artificial Sequence
  chemically synthesized
agttgagtgcaaataaaagt

SEQ ID NO: 301028 - DNA, 20 bp, Artificial Sequence
  chemically synthesized
gcatagttgagtgcaaataa

SEQ ID NO: 301029 - DNA, 20 bp, Artificial Sequence
  chemically synthesized
ctaaaaggagaagcatagtt

SEQ ID NO: 301030 - DNA, 20 bp, Artificial Sequence
  chemically synthesized
ttcatctaaaaggagaagca

SEQ ID NO: 301031 - DNA, 20 bp, Artificial Sequence
  chemically synthesized
ctcaactatgcttctccttt

SEQ ID NO: 301032 - DNA, 20 bp, Artificial Sequence
  chemically synthesized
acttattcatctaaaaggag

SEQ ID NO: 301033 - DNA, 20 bp, Artificial Sequence
  chemically synthesized
catacttattcatctaaaag

SEQ ID NO: 301034 - DNA, 20 bp, Artificial Sequence
  chemically synthesized
ctcatacttattcatctaaa

SEQ ID NO: 301035 - DNA, 20 bp, Artificial Sequence
  chemically synthesized
actcatacttattcatctaa

SEQ ID NO: 301036 - DNA, 20 bp, Artificial Sequence
  chemically synthesized
gcttctccttttagatgaat

SEQ ID NO: 301037 - DNA, 20 bp, Artificial Sequence
  chemically synthesized
ccttttagatgaataagtat

SEQ ID NO: 301038 - DNA, 20 bp, Artificial Sequence
  chemically synthesized
cgttttttgagtgaagaaaa

SEQ ID NO: 301039 - DNA, 20 bp, Artificial Sequence
  chemically synthesized
ttttgttcgttttttgagtg

SEQ ID NO: 301040 - DNA, 20 bp, Artificial Sequence
  chemically synthesized
tataattttgttcgtttttt

SEQ ID NO: 301041 - DNA, 20 bp, Artificial Sequence
  chemically synthesized
acgaacaaaattatatgtaa

SEQ ID NO: 301042 - DNA, 20 bp, Artificial Sequence
  chemically synthesized
aaaattatatgtaacagctc

SEQ ID NO: 301043 - DNA, 20 bp, Artificial Sequence
  chemically synthesized
aaattatatgtaacagctct

SEQ ID NO: 301044 - DNA, 20 bp, Artificial Sequence
  chemically synthesized
aagacaggatcacattccca

SEQ ID NO: 301045 - DNA, 20 bp, Artificial Sequence
  chemically synthesized
agaagacaggatcacattcc

SEQ ID NO: 301046 - DNA, 20 bp, Artificial Sequence
  chemically synthesized
atatcaacacgaaagaagac

SEQ ID NO: 301047 - DNA, 20 bp, Artificial Sequence
  chemically synthesized
aatatcaacacgaaagaaga

SEQ ID NO: 301048 - DNA, 20 bp, Artificial Sequence
  chemically synthesized
aaagaatatcaacacgaaag

SEQ ID NO: 301049 - DNA, 20 bp, Artificial Sequence
  chemically synthesized
gtaaaagaatatcaacacga

SEQ ID NO: 301050 - DNA, 20 bp, Artificial Sequence
  chemically synthesized
ttccagaatgcaaggcgtaa

SEQ ID NO: 301051 - DNA, 20 bp, Artificial Sequence
  chemically synthesized
ttcttttacgccttgcattc

SEQ ID NO: 301052 - DNA, 20 bp, Artificial Sequence
  chemically synthesized
atgtattcttccagaatgca

SEQ ID NO: 301053 - DNA, 20 bp, Artificial Sequence
  chemically synthesized
aatgtattcttccagaatgc

SEQ ID NO: 301054 - DNA, 20 bp, Artificial Sequence
  chemically synthesized
ttttacgccttgcattctgg

SEQ ID NO: 301055 - DNA, 20 bp, Artificial Sequence
  chemically synthesized
tatgtgaaaatgtattcttc

SEQ ID NO: 301056 - DNA, 20 bp, Artificial Sequence
  chemically synthesized
tggaagaatacattttcaca

SEQ ID NO: 301057 - DNA, 20 bp, Artificial Sequence
  chemically synthesized
acattttcacatagctactg

SEQ ID NO: 301058 - DNA, 20 bp, Artificial Sequence
  chemically synthesized
tttcacatagctactgtagc

SEQ ID NO: 301059 - DNA, 20 bp, Artificial Sequence
  chemically synthesized
ctttggatgtctggctacag

SEQ ID NO: 301060 - DNA, 20 bp, Artificial Sequence
  chemically synthesized
tatctttggatgtctggcta

SEQ ID NO: 301061 - DNA, 20 bp, Artificial Sequence
  chemically synthesized
atactatatctttggatgtc

SEQ ID NO: 301062 - DNA, 20 bp, Artificial Sequence
  chemically synthesized
ctactgtagccagacatcca

SEQ ID NO: 301063 - DNA, 20 bp, Artificial Sequence
  chemically synthesized
tagccagacatccaaagata

SEQ ID NO: 301064 - DNA, 20 bp, Artificial Sequence
  chemically synthesized
cctatgagatactatatctt

SEQ ID NO: 301065 - DNA, 20 bp, Artificial Sequence
  chemically synthesized
tccaaagatatagtatctca

SEQ ID NO: 301066 - DNA, 20 bp, Artificial Sequence
  chemically synthesized
ccaaagatatagtatctcat

SEQ ID NO: 301067 - DNA, 20 bp, Artificial Sequence
  chemically synthesized
gatatagtatctcataggac

SEQ ID NO: 301068 - DNA, 20 bp, Artificial Sequence
  chemically synthesized
atattgagaactggtcctat

SEQ ID NO: 301069 - DNA, 20 bp, Artificial Sequence
  chemically synthesized
aaatgcactatattgagaac

SEQ ID NO: 301070 - DNA, 20 bp, Artificial Sequence
  chemically synthesized
cataggaccagttctcaata

SEQ ID NO: 301071 - DNA, 20 bp, Artificial Sequence
  chemically synthesized
gaatagaaatgcactatatt

SEQ ID NO: 301072 - DNA, 20 bp, Artificial Sequence
  chemically synthesized
atatagtgcatttctattca

SEQ ID NO: 301073 - DNA, 20 bp, Artificial Sequence
  chemically synthesized
tgctcaattcaagctgtgaa

SEQ ID NO: 301074 - DNA, 20 bp, Artificial Sequence
  chemically synthesized
ttctattcacagcttgaatt

SEQ ID NO: 301075 - DNA, 20 bp, Artificial Sequence
  chemically synthesized
gtgtagtagatgctcaattc

SEQ ID NO: 301076 - DNA, 20 bp, Artificial Sequence
  chemically synthesized
tgaattgagcatctactaca

SEQ ID NO: 301077 - DNA, 20 bp, Artificial Sequence
  chemically synthesized
gtgtgatgtcttctgtgtag

SEQ ID NO: 301078 - DNA, 20 bp, Artificial Sequence
  chemically synthesized
attgagcatctactacacag

SEQ ID NO: 301079 - DNA, 20 bp, Artificial Sequence
  chemically synthesized
cctgtgtgatgtcttctgtg

SEQ ID NO: 301080 - DNA, 20 bp, Artificial Sequence
  chemically synthesized
actacacagaagacatcaca

SEQ ID NO: 301081 - DNA, 20 bp, Artificial Sequence
  chemically synthesized
ctacacagaagacatcacac

SEQ ID NO: 301082 - DNA, 20 bp, Artificial Sequence
  chemically synthesized
acatcacacaggtaacgaac

SEQ ID NO: 301083 - DNA, 20 bp, Artificial Sequence
  chemically synthesized
cacaggtaacgaacaagaaa

SEQ ID NO: 301084 - DNA, 20 bp, Artificial Sequence
  chemically synthesized
aacgaacaagaaatggatcc

SEQ ID NO: 301085 - DNA, 20 bp, Artificial Sequence
  chemically synthesized
acaagaaatggatcctggcc

SEQ ID NO: 301086 - DNA, 20 bp, Artificial Sequence
  chemically synthesized
caagaaatggatcctggccc

SEQ ID NO: 301087 - DNA, 20 bp, Artificial Sequence
  chemically synthesized
aagaaatggatcctggccca

SEQ ID NO: 301088 - DNA, 20 bp, Artificial Sequence
  chemically synthesized
aattaaagcttccctgggcc

SEQ ID NO: 301089 - DNA, 20 bp, Artificial Sequence
  chemically synthesized
gaattaaagcttccctgggc

SEQ ID NO: 301090 - DNA, 20 bp, Artificial Sequence
  chemically synthesized
aaatggatcctggcccaggg

SEQ ID NO: 301091 - DNA, 20 bp, Artificial Sequence
  chemically synthesized
actagaattaaagcttccct

SEQ ID NO: 301092 - DNA, 20 bp, Artificial Sequence
  chemically synthesized
cactagaattaaagcttccc

SEQ ID NO: 301093 - DNA, 20 bp, Artificial Sequence
  chemically synthesized
gcccagggaagctttaattc

SEQ ID NO: 301094 - DNA, 20 bp, Artificial Sequence
  chemically synthesized
tgtttcatccactagaatta

SEQ ID NO: 301095 - DNA, 20 bp, Artificial Sequence
  chemically synthesized
cagggaagctttaattctag

SEQ ID NO: 301096 - DNA, 20 bp, Artificial Sequence
  chemically synthesized
catatgcttgtttcatccac

SEQ ID NO: 301097 - DNA, 20 bp, Artificial Sequence
  chemically synthesized
ttaattctagtggatgaaac

SEQ ID NO: 301098 - DNA, 20 bp, Artificial Sequence
  chemically synthesized
tagtggatgaaacaagcata

SEQ ID NO: 301099 - DNA, 20 bp, Artificial Sequence
  chemically synthesized
ggatgaaacaagcatatgga

SEQ ID NO: 301100 - DNA, 20 bp, Artificial Sequence
  chemically synthesized
ggatagatcatttcatcata

SEQ ID NO: 301101 - DNA, 20 bp, Artificial Sequence
  chemically synthesized
tagatcatttcatcataaag

SEQ ID NO: 301102 - DNA, 20 bp, Artificial Sequence
  chemically synthesized
tcatttcatcataaagcagt

SEQ ID NO: 301103 - DNA, 20 bp, Artificial Sequence
  chemically synthesized
catttcatcataaagcagta

SEQ ID NO: 301104 - DNA, 20 bp, Artificial Sequence
  chemically synthesized
ataaagcagtaaggtgtcac

SEQ ID NO: 301105 - DNA, 20 bp, Artificial Sequence
  chemically synthesized
taaggtgtcacaagatgcaa

SEQ ID NO: 301106 - DNA, 20 bp, Artificial Sequence
  chemically synthesized
ggtgtcacaagatgcaacag

SEQ ID NO: 301107 - DNA, 20 bp, Artificial Sequence
  chemically synthesized
tctattcctgggcaggttaa

SEQ ID NO: 301108 - DNA, 20 bp, Artificial Sequence
  chemically synthesized
atctattcctgggcaggtta

SEQ ID NO: 301109 - DNA, 20 bp, Artificial Sequence
  chemically synthesized
catctattcctgggcaggtt

SEQ ID NO: 301110 - DNA, 20 bp, Artificial Sequence
  chemically synthesized
gtagcatcccttaacctgcc

SEQ ID NO: 301111 - DNA, 20 bp, Artificial Sequence
  chemically synthesized
tagcatcccttaacctgccc

SEQ ID NO: 301112 - DNA, 20 bp, Artificial Sequence
  chemically synthesized
ggggccatctattcctgggc

SEQ ID NO: 301113 - DNA, 20 bp, Artificial Sequence
  chemically synthesized
aggggccatctattcctggg

SEQ ID NO: 301114 - DNA, 20 bp, Artificial Sequence
  chemically synthesized
tcccttaacctgcccaggaa

SEQ ID NO: 301115 - DNA, 20 bp, Artificial Sequence
  chemically synthesized
gacaggggccatctattcct

SEQ ID NO: 301116 - DNA, 20 bp, Artificial Sequence
  chemically synthesized
tgacaggggccatctattcc

SEQ ID NO: 301117 - DNA, 20 bp, Artificial Sequence
  chemically synthesized
ttaacctgcccaggaataga

SEQ ID NO: 301118 - DNA, 20 bp, Artificial Sequence
  chemically synthesized
caggaatagatggcccctgt

SEQ ID NO: 301119 - DNA, 20 bp, Artificial Sequence
  chemically synthesized
aggaatagatggcccctgtc

SEQ ID NO: 301120 - DNA, 20 bp, Artificial Sequence
  chemically synthesized
tgggctcagaggcctgacag

SEQ ID NO: 301121 - DNA, 20 bp, Artificial Sequence
  chemically synthesized
ttgggctcagaggcctgaca

SEQ ID NO: 301122 - DNA, 20 bp, Artificial Sequence
  chemically synthesized
cttgggctcagaggcctgac

SEQ ID NO: 301123 - DNA, 20 bp, Artificial Sequence
  chemically synthesized
gcttgggctcagaggcctga

SEQ ID NO: 301124 - DNA, 20 bp, Artificial Sequence
  chemically synthesized
atggcccctgtcaggcctct

SEQ ID NO: 301125 - DNA, 20 bp, Artificial Sequence
  chemically synthesized
atggcttagcttgggctcag

SEQ ID NO: 301126 - DNA, 20 bp, Artificial Sequence
  chemically synthesized
cctgtcaggcctctgagccc

SEQ ID NO: 301127 - DNA, 20 bp, Artificial Sequence
  chemically synthesized
gatggcttagcttgggctca

SEQ ID NO: 301128 - DNA, 20 bp, Artificial Sequence
  chemically synthesized
aggatggcttagcttgggct

SEQ ID NO: 301129 - DNA, 20 bp, Artificial Sequence
  chemically synthesized
caggcctctgagcccaagct

SEQ ID NO: 301130 - DNA, 20 bp, Artificial Sequence
  chemically synthesized
gggaaaggatggcttagctt

SEQ ID NO: 301131 - DNA, 20 bp, Artificial Sequence
  chemically synthesized
ggggaaaggatggcttagct

SEQ ID NO: 301132 - DNA, 20 bp, Artificial Sequence
  chemically synthesized
tcataggggaaaggatggct

SEQ ID NO: 301133 - DNA, 20 bp, Artificial Sequence
  chemically synthesized
gcaggtcataggggaaagga

SEQ ID NO: 301134 - DNA, 20 bp, Artificial Sequence
  chemically synthesized
aggtgcaggtcataggggaa

SEQ ID NO: 301135 - DNA, 20 bp, Artificial Sequence
  chemically synthesized
aaggtgcaggtcatagggga

SEQ ID NO: 301136 - DNA, 20 bp, Artificial Sequence
  chemically synthesized
cgtaaaggtgcaggtcatag

SEQ ID NO: 301137 - DNA, 20 bp, Artificial Sequence
  chemically synthesized
acgtaaaggtgcaggtcata

SEQ ID NO: 301138 - DNA, 20 bp, Artificial Sequence
  chemically synthesized
gacgtaaaggtgcaggtcat

SEQ ID NO: 301139 - DNA, 20 bp, Artificial Sequence
  chemically synthesized
ggacgtaaaggtgcaggtca

SEQ ID NO: 301140 - DNA, 20 bp, Artificial Sequence
  chemically synthesized
ccatctggacgtaaaggtgc

SEQ ID NO: 301141 - DNA, 20 bp, Artificial Sequence
  chemically synthesized
gccatctggacgtaaaggtg

SEQ ID NO: 301142 - DNA, 20 bp, Artificial Sequence
  chemically synthesized
atgacctgcacctttacgtc

SEQ ID NO: 301143 - DNA, 20 bp, Artificial Sequence
  chemically synthesized
ttcaggccatctggacgtaa

SEQ ID NO: 301144 - DNA, 20 bp, Artificial Sequence
  chemically synthesized
cttcaggccatctggacgta

SEQ ID NO: 301145 - DNA, 20 bp, Artificial Sequence
  chemically synthesized
cctgcacctttacgtccaga

SEQ ID NO: 301146 - DNA, 20 bp, Artificial Sequence
  chemically synthesized
ttcagttgcttcaggccatc

SEQ ID NO: 301147 - DNA, 20 bp, Artificial Sequence
  chemically synthesized
ctttacgtccagatggcctg

SEQ ID NO: 301148 - DNA, 20 bp, Artificial Sequence
  chemically synthesized
tgtgattcttcagttgcttc

SEQ ID NO: 301149 - DNA, 20 bp, Artificial Sequence
  chemically synthesized
ttgtgattcttcagttgctt

SEQ ID NO: 301150 - DNA, 20 bp, Artificial Sequence
  chemically synthesized
cagatggcctgaagcaactg

SEQ ID NO: 301151 - DNA, 20 bp, Artificial Sequence
  chemically synthesized
tcacttcttttgtgattctt

SEQ ID NO: 301152 - DNA, 20 bp, Artificial Sequence
  chemically synthesized
aagcaactgaagaatcacaa

SEQ ID NO: 301153 - DNA, 20 bp, Artificial Sequence
  chemically synthesized
caactgaagaatcacaaaag

SEQ ID NO: 301154 - DNA, 20 bp, Artificial Sequence
  chemically synthesized
acaaaagaagtgaaaatgcc

SEQ ID NO: 301155 - DNA, 20 bp, Artificial Sequence
  chemically synthesized
catcagttaaggcagcaacc

SEQ ID NO: 301156 - DNA, 20 bp, Artificial Sequence
  chemically synthesized
tcatcagttaaggcagcaac

SEQ ID NO: 301157 - DNA, 20 bp, Artificial Sequence
  chemically synthesized
tggaatgtcatcagttaagg

SEQ ID NO: 301158 - DNA, 20 bp, Artificial Sequence
  chemically synthesized
tggtggaatgtcatcagtta

SEQ ID NO: 301159 - DNA, 20 bp, Artificial Sequence
  chemically synthesized
atggtggaatgtcatcagtt

SEQ ID NO: 301160 - DNA, 20 bp, Artificial Sequence
  chemically synthesized
tcacaatggtggaatgtcat

SEQ ID NO: 301161 - DNA, 20 bp, Artificial Sequence
  chemically synthesized
gcaaaaacaaatcacaatgg

SEQ ID NO: 301162 - DNA, 20 bp, Artificial Sequence
  chemically synthesized
ggggcaaaaacaaatcacaa

SEQ ID NO: 301163 - DNA, 20 bp, Artificial Sequence
  chemically synthesized
ttaatcgctcggttaaggtg

SEQ ID NO: 301164 - DNA, 20 bp, Artificial Sequence
  chemically synthesized
gttaatcgctcggttaaggt

SEQ ID NO: 301165 - DNA, 20 bp, Artificial Sequence
  chemically synthesized
ggttaatcgctcggttaagg

SEQ ID NO: 301166 - DNA, 20 bp, Artificial Sequence
  chemically synthesized
gtttttgccccaccttaacc

SEQ ID NO: 301167 - DNA, 20 bp, Artificial Sequence
  chemically synthesized
caaggttaatcgctcggtta

SEQ ID NO: 301168 - DNA, 20 bp, Artificial Sequence
  chemically synthesized
acaaggttaatcgctcggtt

SEQ ID NO: 301169 - DNA, 20 bp, Artificial Sequence
  chemically synthesized
atttcacaaggttaatcgct

SEQ ID NO: 301170 - DNA, 20 bp, Artificial Sequence
  chemically synthesized
ccaggagaaggaatttcaca

SEQ ID NO: 301171 - DNA, 20 bp, Artificial Sequence
  chemically synthesized
gccaggagaaggaatttcac

SEQ ID NO: 301172 - DNA, 20 bp, Artificial Sequence
  chemically synthesized
ccttgtgaaattccttctcc

SEQ ID NO: 301173 - DNA, 20 bp, Artificial Sequence
  chemically synthesized
ggaggttttgagccaggaga

SEQ ID NO: 301174 - DNA, 20 bp, Artificial Sequence
  chemically synthesized
gggaggttttgagccaggag

SEQ ID NO: 301175 - DNA, 20 bp, Artificial Sequence
  chemically synthesized
tgggggaggttttgagccag

SEQ ID NO: 301176 - DNA, 20 bp, Artificial Sequence
  chemically synthesized
agtgggggaggttttgagcc

SEQ ID NO: 301177 - DNA, 20 bp, Artificial Sequence
  chemically synthesized
cagtgggggaggttttgagc

SEQ ID NO: 301178 - DNA, 20 bp, Artificial Sequence
  chemically synthesized
tgctcagtgggggaggtttt

SEQ ID NO: 301179 - DNA, 20 bp, Artificial Sequence
  chemically synthesized
cacaaggtgctcagtggggg

SEQ ID NO: 301180 - DNA, 20 bp, Artificial Sequence
  chemically synthesized
ggctcaaaacctcccccact

SEQ ID NO: 301181 - DNA, 20 bp, Artificial Sequence
  chemically synthesized
tcacaaggtgctcagtgggg

SEQ ID NO: 301182 - DNA, 20 bp, Artificial Sequence
  chemically synthesized
ggtcacaaggtgctcagtgg

SEQ ID NO: 301183 - DNA, 20 bp, Artificial Sequence
  chemically synthesized
gggtcacaaggtgctcagtg

SEQ ID NO: 301184 - DNA, 20 bp, Artificial Sequence
  chemically synthesized
ggggtcacaaggtgctcagt

SEQ ID NO: 301185 - DNA, 20 bp, Artificial Sequence
  chemically synthesized
gggggtcacaaggtgctcag

SEQ ID NO: 301186 - DNA, 20 bp, Artificial Sequence
  chemically synthesized
ggcgggggtcacaaggtgct

SEQ ID NO: 301187 - DNA, 20 bp, Artificial Sequence
  chemically synthesized
gggcaggggcgggggtcaca

SEQ ID NO: 301188 - DNA, 20 bp, Artificial Sequence
  chemically synthesized
tgggcaggggcgggggtcac

SEQ ID NO: 301189 - DNA, 20 bp, Artificial Sequence
  chemically synthesized
tctcttgtgggcaggggcgg

SEQ ID NO: 301190 - DNA, 20 bp, Artificial Sequence
  chemically synthesized
ttctcttgtgggcaggggcg

SEQ ID NO: 301191 - DNA, 20 bp, Artificial Sequence
  chemically synthesized
tttctcttgtgggcaggggc

SEQ ID NO: 301192 - DNA, 20 bp, Artificial Sequence
  chemically synthesized
ttttctcttgtgggcagggg

SEQ ID NO: 301193 - DNA, 20 bp, Artificial Sequence
  chemically synthesized
gatttttctcttgtgggcag

SEQ ID NO: 301194 - DNA, 20 bp, Artificial Sequence
  chemically synthesized
tgacccccgcccctgcccac

SEQ ID NO: 301195 - DNA, 20 bp, Artificial Sequence
  chemically synthesized
ggatttttctcttgtgggca

SEQ ID NO: 301196 - DNA, 20 bp, Artificial Sequence
  chemically synthesized
gggatttttctcttgtgggc

SEQ ID NO: 301197 - DNA, 20 bp, Artificial Sequence
  chemically synthesized
acccccgcccctgcccacaa

SEQ ID NO: 301198 - DNA, 20 bp, Artificial Sequence
  chemically synthesized
ggggatttttctcttgtggg

SEQ ID NO: 301199 - DNA, 20 bp, Artificial Sequence
  chemically synthesized
aaaggggatttttctcttgt

SEQ ID NO: 301200 - DNA, 20 bp, Artificial Sequence
  chemically synthesized
caaaggggatttttctcttg

SEQ ID NO: 301201 - DNA, 20 bp, Artificial Sequence
  chemically synthesized
gtggaaaattacagtcaaag

SEQ ID NO: 301202 - DNA, 20 bp, Artificial Sequence
  chemically synthesized
agtggaaaattacagtcaaa

SEQ ID NO: 301203 - DNA, 20 bp, Artificial Sequence
  chemically synthesized
tagtggaaaattacagtcaa

SEQ ID NO: 301204 - DNA, 20 bp, Artificial Sequence
  chemically synthesized
gtagtggaaaattacagtca

SEQ ID NO: 301205 - DNA, 20 bp, Artificial Sequence
  chemically synthesized
gggtgggtagtggaaaatta

SEQ ID NO: 301206 - DNA, 20 bp, Artificial Sequence
  chemically synthesized
tataggatttgggtgggtag

SEQ ID NO: 301207 - DNA, 20 bp, Artificial Sequence
  chemically synthesized
ttttataggatttgggtggg

SEQ ID NO: 301208 - DNA, 20 bp, Artificial Sequence
  chemically synthesized
ccgttttataggatttgggt

SEQ ID NO: 301209 - DNA, 20 bp, Artificial Sequence
  chemically synthesized
gccgttttataggatttggg

SEQ ID NO: 301210 - DNA, 20 bp, Artificial Sequence
  chemically synthesized
ggggccgttttataggattt

SEQ ID NO: 301211 - DNA, 20 bp, Artificial Sequence
  chemically synthesized
tggggccgttttataggatt

SEQ ID NO: 301212 - DNA, 20 bp, Artificial Sequence
  chemically synthesized
cccacccaaatcctataaaa

SEQ ID NO: 301213 - DNA, 20 bp, Artificial Sequence
  chemically synthesized
taggggtggggccgttttat

SEQ ID NO: 301214 - DNA, 20 bp, Artificial Sequence
  chemically synthesized
ataggggtggggccgtttta

SEQ ID NO: 301215 - DNA, 20 bp, Artificial Sequence
  chemically synthesized
acggaagggagataggggtg

SEQ ID NO: 301216 - DNA, 20 bp, Artificial Sequence
  chemically synthesized
cacggaagggagataggggt

SEQ ID NO: 301217 - DNA, 20 bp, Artificial Sequence
  chemically synthesized
tcacggaagggagatagggg

SEQ ID NO: 301218 - DNA, 20 bp, Artificial Sequence
  chemically synthesized
gagtcacggaagggagatag

SEQ ID NO: 301219 - DNA, 20 bp, Artificial Sequence
  chemically synthesized
agagtcacggaagggagata

SEQ ID NO: 301220 - DNA, 20 bp, Artificial Sequence
  chemically synthesized
gagagtcacggaagggagat

SEQ ID NO: 301221 - DNA, 20 bp, Artificial Sequence
  chemically synthesized
agagagtcacggaagggaga

SEQ ID NO: 301222 - DNA, 20 bp, Artificial Sequence
  chemically synthesized
gaaaagagagtcacggaagg

SEQ ID NO: 301223 - DNA, 20 bp, Artificial Sequence
  chemically synthesized
ctgaaaagagagtcacggaa

SEQ ID NO: 301224 - DNA, 20 bp, Artificial Sequence
  chemically synthesized
tctgaaaagagagtcacgga

SEQ ID NO: 301225 - DNA, 20 bp, Artificial Sequence
  chemically synthesized
gtctgaaaagagagtcacgg

SEQ ID NO: 301226 - DNA, 20 bp, Artificial Sequence
  chemically synthesized
tgagtctgaaaagagagtca

SEQ ID NO: 301227 - DNA, 20 bp, Artificial Sequence
  chemically synthesized
cccttccgtgactctctttt

SEQ ID NO: 301228 - DNA, 20 bp, Artificial Sequence
  chemically synthesized
gcaggctgagtctgaaaaga

SEQ ID NO: 301229 - DNA, 20 bp, Artificial Sequence
  chemically synthesized
aggcaggctgagtctgaaaa

SEQ ID NO: 301230 - DNA, 20 bp, Artificial Sequence
  chemically synthesized
gcaggcaggctgagtctgaa

SEQ ID NO: 301231 - DNA, 20 bp, Artificial Sequence
  chemically synthesized
cgtgactctcttttcagact

SEQ ID NO: 301232 - DNA, 20 bp, Artificial Sequence
  chemically synthesized
cacctgggtgcaggcaggct

SEQ ID NO: 301233 - DNA, 20 bp, Artificial Sequence
  chemically synthesized
tatttcacctgggtgcaggc

SEQ ID NO: 301234 - DNA, 20 bp, Artificial Sequence
  chemically synthesized
ctatttcacctgggtgcagg

SEQ ID NO: 301235 - DNA, 20 bp, Artificial Sequence
  chemically synthesized
agactcagcctgcctgcacc

SEQ ID NO: 301236 - DNA, 20 bp, Artificial Sequence
  chemically synthesized
gactcagcctgcctgcaccc

SEQ ID NO: 301237 - DNA, 20 bp, Artificial Sequence
  chemically synthesized
tgtctatttcacctgggtgc

SEQ ID NO: 301238 - DNA, 20 bp, Artificial Sequence
  chemically synthesized
ctgtctatttcacctgggtg

SEQ ID NO: 301239 - DNA, 20 bp, Artificial Sequence
  chemically synthesized
caaggctgtctatttcacct

SEQ ID NO: 301240 - DNA, 20 bp, Artificial Sequence
  chemically synthesized
ctgcctgcacccaggtgaaa

SEQ ID NO: 301241 - DNA, 20 bp, Artificial Sequence
  chemically synthesized
acaaggctgtctatttcacc

SEQ ID NO: 301242 - DNA, 20 bp, Artificial Sequence
  chemically synthesized
ctgcacccaggtgaaataga

SEQ ID NO: 301243 - DNA, 20 bp, Artificial Sequence
  chemically synthesized
caggctttgtgtgagcaaca

SEQ ID NO: 301244 - DNA, 20 bp, Artificial Sequence
  chemically synthesized
acaggctttgtgtgagcaac

SEQ ID NO: 301245 - DNA, 20 bp, Artificial Sequence
  chemically synthesized
acagccttgttgctcacaca

SEQ ID NO: 301246 - DNA, 20 bp, Artificial Sequence
  chemically synthesized
ccaccaaacaggctttgtgt

SEQ ID NO: 301247 - DNA, 20 bp, Artificial Sequence
  chemically synthesized
ttgctcacacaaagcctgtt

SEQ ID NO: 301248 - DNA, 20 bp, Artificial Sequence
  chemically synthesized
ctcacacaaagcctgtttgg

SEQ ID NO: 301249 - DNA, 20 bp, Artificial Sequence
  chemically synthesized
gtgtgaagagaccaccaaac

SEQ ID NO: 301250 - DNA, 20 bp, Artificial Sequence
  chemically synthesized
cgtgtgaagagaccaccaaa

SEQ ID NO: 301251 - DNA, 20 bp, Artificial Sequence
  chemically synthesized
tgtttggtggtctcttcaca

SEQ ID NO: 301252 - DNA, 20 bp, Artificial Sequence
  chemically synthesized
ttcacgtatgtccgtgtgaa

SEQ ID NO: 301253 - DNA, 20 bp, Artificial Sequence
  chemically synthesized
ctttcacgtatgtccgtgtg

SEQ ID NO: 301254 - DNA, 20 bp, Artificial Sequence
  chemically synthesized
cttcacacggacatacgtga

SEQ ID NO: 301255 - DNA, 20 bp, Artificial Sequence
  chemically synthesized
catacgtgaaagccccttta

SEQ ID NO: 301256 - DNA, 20 bp, Artificial Sequence
  chemically synthesized
atacgtgaaagcccctttat

SEQ ID NO: 301257 - DNA, 20 bp, Artificial Sequence
  chemically synthesized
tacgtgaaagcccctttatg

SEQ ID NO: 301258 - DNA, 20 bp, Artificial Sequence
  chemically synthesized
ttatgacagcccccataaag

SEQ ID NO: 301259 - DNA, 20 bp, Artificial Sequence
  chemically synthesized
acgtgaaagcccctttatgg

SEQ ID NO: 301260 - DNA, 20 bp, Artificial Sequence
  chemically synthesized
cttatgacagcccccataaa

SEQ ID NO: 301261 - DNA, 20 bp, Artificial Sequence
  chemically synthesized
ccttatgacagcccccataa

SEQ ID NO: 301262 - DNA, 20 bp, Artificial Sequence
  chemically synthesized
tccttatgacagcccccata

SEQ ID NO: 301263 - DNA, 20 bp, Artificial Sequence
  chemically synthesized
ccctttatgggggctgtcat

SEQ ID NO: 301264 - DNA, 20 bp, Artificial Sequence
  chemically synthesized
cctttatgggggctgtcata

SEQ ID NO: 301265 - DNA, 20 bp, Artificial Sequence
  chemically synthesized
ctgattctctttccttatga

SEQ ID NO: 301266 - DNA, 20 bp, Artificial Sequence
  chemically synthesized
tatgggggctgtcataagga

SEQ ID NO: 301267 - DNA, 20 bp, Artificial Sequence
  chemically synthesized
tgggggctgtcataaggaaa

SEQ ID NO: 301268 - DNA, 20 bp, Artificial Sequence
  chemically synthesized
ctgtcataaggaaagagaat

SEQ ID NO: 301269 - DNA, 20 bp, Artificial Sequence
  chemically synthesized
tgtcataaggaaagagaatc

SEQ ID NO: 301270 - DNA, 20 bp, Artificial Sequence
  chemically synthesized
gtcataaggaaagagaatca

SEQ ID NO: 301271 - DNA, 20 bp, Artificial Sequence
  chemically synthesized
tcataaggaaagagaatcag

SEQ ID NO: 301272 - DNA, 20 bp, Artificial Sequence
  chemically synthesized
aaggaaagagaatcaggggt

SEQ ID NO: 301273 - DNA, 20 bp, Artificial Sequence
  chemically synthesized
ctggagtgtcttgtcattta

SEQ ID NO: 301274 - DNA, 20 bp, Artificial Sequence
  chemically synthesized
ggggtcagactgtaaatgac

SEQ ID NO: 301275 - DNA, 20 bp, Artificial Sequence
  chemically synthesized
ctgtaaatgacaagacactc

SEQ ID NO: 301276 - DNA, 20 bp, Artificial Sequence
  chemically synthesized
ctttggaaatcagttcactg

SEQ ID NO: 301277 - DNA, 20 bp, Artificial Sequence
  chemically synthesized
cactttggaaatcagttcac

SEQ ID NO: 301278 - DNA, 20 bp, Artificial Sequence
  chemically synthesized
ctccagtgaactgatttcca

SEQ ID NO: 301279 - DNA, 20 bp, Artificial Sequence
  chemically synthesized
agggcccacactttggaaat

SEQ ID NO: 301280 - DNA, 20 bp, Artificial Sequence
  chemically synthesized
gtgaactgatttccaaagtg

SEQ ID NO: 301281 - DNA, 20 bp, Artificial Sequence
  chemically synthesized
tgaactgatttccaaagtgt

SEQ ID NO: 301282 - DNA, 20 bp, Artificial Sequence
  chemically synthesized
ctgatttagggcccacactt

SEQ ID NO: 301283 - DNA, 20 bp, Artificial Sequence
  chemically synthesized
ccaaagtgtgggccctaaat

SEQ ID NO: 301284 - DNA, 20 bp, Artificial Sequence
  chemically synthesized
attctgctgctactgattta

SEQ ID NO: 301285 - DNA, 20 bp, Artificial Sequence
  chemically synthesized
aagtgtgggccctaaatcag

SEQ ID NO: 301286 - DNA, 20 bp, Artificial Sequence
  chemically synthesized
gattctgctgctactgattt

SEQ ID NO: 301287 - DNA, 20 bp, Artificial Sequence
  chemically synthesized
tgattctgctgctactgatt

SEQ ID NO: 301288 - DNA, 20 bp, Artificial Sequence
  chemically synthesized
tgtgggccctaaatcagtag

SEQ ID NO: 301289 - DNA, 20 bp, Artificial Sequence
  chemically synthesized
gggccctaaatcagtagcag

SEQ ID NO: 301290 - DNA, 20 bp, Artificial Sequence
  chemically synthesized
tcagtagcagcagaatcacg

SEQ ID NO: 301291 - DNA, 20 bp, Artificial Sequence
  chemically synthesized
cagtagcagcagaatcacgt

SEQ ID NO: 301292 - DNA, 20 bp, Artificial Sequence
  chemically synthesized
agaatcacgtgggaccttgt

SEQ ID NO: 301293 - DNA, 20 bp, Artificial Sequence
  chemically synthesized
aagaattttaatttctaaca

SEQ ID NO: 301294 - DNA, 20 bp, Artificial Sequence
  chemically synthesized
caagaattttaatttctaac

SEQ ID NO: 301295 - DNA, 20 bp, Artificial Sequence
  chemically synthesized
ttgttagaaattaaaattct

SEQ ID NO: 301296 - DNA, 20 bp, Artificial Sequence
  chemically synthesized
tgttagaaattaaaattctt

SEQ ID NO: 301297 - DNA, 20 bp, Artificial Sequence
  chemically synthesized
ataggcgtggagtggtgccc

SEQ ID NO: 301298 - DNA, 20 bp, Artificial Sequence
  chemically synthesized
taattctaataggcgtggag

SEQ ID NO: 301299 - DNA, 20 bp, Artificial Sequence
  chemically synthesized
ttctaattctaataggcgtg

SEQ ID NO: 301300 - DNA, 20 bp, Artificial Sequence
  chemically synthesized
gggcaccactccacgcctat

SEQ ID NO: 301301 - DNA, 20 bp, Artificial Sequence
  chemically synthesized
gtttctaattctaataggcg

SEQ ID NO: 301302 - DNA, 20 bp, Artificial Sequence
  chemically synthesized
ccagagtttctaattctaat

SEQ ID NO: 301303 - DNA, 20 bp, Artificial Sequence
  chemically synthesized
cactccacgcctattagaat

SEQ ID NO: 301304 - DNA, 20 bp, Artificial Sequence
  chemically synthesized
accagagtttctaattctaa

SEQ ID NO: 301305 - DNA, 20 bp, Artificial Sequence
  chemically synthesized
cctattagaattagaaactc

SEQ ID NO: 301306 - DNA, 20 bp, Artificial Sequence
  chemically synthesized
agcatgcgtcggagtcacca

SEQ ID NO: 301307 - DNA, 20 bp, Artificial Sequence
  chemically synthesized
tcagcatgcgtcggagtcac

SEQ ID NO: 301308 - DNA, 20 bp, Artificial Sequence
  chemically synthesized
tcatgcttcagcatgcgtcg

SEQ ID NO: 301309 - DNA, 20 bp, Artificial Sequence
  chemically synthesized
tctcatgcttcagcatgcgt

SEQ ID NO: 301310 - DNA, 20 bp, Artificial Sequence
  chemically synthesized
ggtgactccgacgcatgctg

SEQ ID NO: 301311 - DNA, 20 bp, Artificial Sequence
  chemically synthesized
tccgacgcatgctgaagcat

SEQ ID NO: 301312 - DNA, 20 bp, Artificial Sequence
  chemically synthesized
caacagtggttctcatgctt

SEQ ID NO: 301313 - DNA, 20 bp, Artificial Sequence
  chemically synthesized
tcgcactggcatgacaacag

SEQ ID NO: 301314 - DNA, 20 bp, Artificial Sequence
  chemically synthesized
ccctcgcactggcatgacaa

SEQ ID NO: 301315 - DNA, 20 bp, Artificial Sequence
  chemically synthesized
gagaaccactgttgtcatgc

SEQ ID NO: 301316 - DNA, 20 bp, Artificial Sequence
  chemically synthesized
cactgttgtcatgccagtgc

SEQ ID NO: 301317 - DNA, 20 bp, Artificial Sequence
  chemically synthesized
actgttgtcatgccagtgcg

SEQ ID NO: 301318 - DNA, 20 bp, Artificial Sequence
  chemically synthesized
ctgttgtcatgccagtgcga

SEQ ID NO: 301319 - DNA, 20 bp, Artificial Sequence
  chemically synthesized
aaatttgagaaccctcgcac

SEQ ID NO: 301320 - DNA, 20 bp, Artificial Sequence
  chemically synthesized
acttatacaccataaaattt

SEQ ID NO: 301321 - DNA, 20 bp, Artificial Sequence
  chemically synthesized
gcgagggttctcaaatttta

SEQ ID NO: 301322 - DNA, 20 bp, Artificial Sequence
  chemically synthesized
tctcaaattttatggtgtat

SEQ ID NO: 301323 - DNA, 20 bp, Artificial Sequence
  chemically synthesized
tatggtgtataagtatcacc

SEQ ID NO: 301324 - DNA, 20 bp, Artificial Sequence
  chemically synthesized
tggtgtataagtatcaccga

SEQ ID NO: 301325 - DNA, 20 bp, Artificial Sequence
  chemically synthesized
aaatattttacaagcactct

SEQ ID NO: 301326 - DNA, 20 bp, Artificial Sequence
  chemically synthesized
tgggcccaaaaatattttac

SEQ ID NO: 301327 - DNA, 20 bp, Artificial Sequence
  chemically synthesized
gagtgcttgtaaaatatttt

SEQ ID NO: 301328 - DNA, 20 bp, Artificial Sequence
  chemically synthesized
agtgcttgtaaaatattttt

SEQ ID NO: 301329 - DNA, 20 bp, Artificial Sequence
  chemically synthesized
taaaatatttttgggcccac

SEQ ID NO: 301330 - DNA, 20 bp, Artificial Sequence
  chemically synthesized
aatatttttgggcccaccag

SEQ ID NO: 301331 - DNA, 20 bp, Artificial Sequence
  chemically synthesized
gaatcagaaacactgctggt

SEQ ID NO: 301332 - DNA, 20 bp, Artificial Sequence
  chemically synthesized
tgaatcagaaacactgctgg

SEQ ID NO: 301333 - DNA, 20 bp, Artificial Sequence
  chemically synthesized
tgctgaatcagaaacactgc

SEQ ID NO: 301334 - DNA, 20 bp, Artificial Sequence
  chemically synthesized
caccagcagtgtttctgatt

SEQ ID NO: 301335 - DNA, 20 bp, Artificial Sequence
  chemically synthesized
cagcagtgtttctgattcag

SEQ ID NO: 301336 - DNA, 20 bp, Artificial Sequence
  chemically synthesized
agcagtgtttctgattcagc

SEQ ID NO: 301337 - DNA, 20 bp, Artificial Sequence
  chemically synthesized
ccttcccaaacctgctgaat

SEQ ID NO: 301338 - DNA, 20 bp, Artificial Sequence
  chemically synthesized
tgtttctgattcagcaggtt

SEQ ID NO: 301339 - DNA, 20 bp, Artificial Sequence
  chemically synthesized
gtttctgattcagcaggttt

SEQ ID NO: 301340 - DNA, 20 bp, Artificial Sequence
  chemically synthesized
tctgattcagcaggtttggg

SEQ ID NO: 301341 - DNA, 20 bp, Artificial Sequence
  chemically synthesized
ctgattcagcaggtttggga

SEQ ID NO: 301342 - DNA, 20 bp, Artificial Sequence
  chemically synthesized
tgattcagcaggtttgggaa

SEQ ID NO: 301343 - DNA, 20 bp, Artificial Sequence
  chemically synthesized
ctttgaaatgcagatttgga

SEQ ID NO: 301344 - DNA, 20 bp, Artificial Sequence
  chemically synthesized
tctttgaaatgcagatttgg

SEQ ID NO: 301345 - DNA, 20 bp, Artificial Sequence
  chemically synthesized
ttctttgaaatgcagatttg

SEQ ID NO: 301346 - DNA, 20 bp, Artificial Sequence
  chemically synthesized
ccttctttgaaatgcagatt

SEQ ID NO: 301347 - DNA, 20 bp, Artificial Sequence
  chemically synthesized
ccctccaaatctgcatttca

SEQ ID NO: 301348 - DNA, 20 bp, Artificial Sequence
  chemically synthesized
ctgggaccttctttgaaatg

SEQ ID NO: 301349 - DNA, 20 bp, Artificial Sequence
  chemically synthesized
tccaaatctgcatttcaaag

SEQ ID NO: 301350 - DNA, 20 bp, Artificial Sequence
  chemically synthesized
ccaaatctgcatttcaaaga

SEQ ID NO: 301351 - DNA, 20 bp, Artificial Sequence
  chemically synthesized
ctgcatttcaaagaaggtcc

SEQ ID NO: 301352 - DNA, 20 bp, Artificial Sequence
  chemically synthesized
tgcatttcaaagaaggtccc

SEQ ID NO: 301353 - DNA, 20 bp, Artificial Sequence
  chemically synthesized
atgaaacagtatcatcacct

SEQ ID NO: 301354 - DNA, 20 bp, Artificial Sequence
  chemically synthesized
catgaaacagtatcatcacc

SEQ ID NO: 301355 - DNA, 20 bp, Artificial Sequence
  chemically synthesized
tcaaactgcagtgcatgaaa

SEQ ID NO: 301356 - DNA, 20 bp, Artificial Sequence
  chemically synthesized
tgatactgtttcatgcactg

SEQ ID NO: 301357 - DNA, 20 bp, Artificial Sequence
  chemically synthesized
gaacagtaatattcaaactg

SEQ ID NO: 301358 - DNA, 20 bp, Artificial Sequence
  chemically synthesized
agtttgaatattactgttct

SEQ ID NO: 301359 - DNA, 20 bp, Artificial Sequence
  chemically synthesized
ggatcagagaatacttagaa

SEQ ID NO: 301360 - DNA, 20 bp, Artificial Sequence
  chemically synthesized
ctatgggatcagagaatact

SEQ ID NO: 301361 - DNA, 20 bp, Artificial Sequence
  chemically synthesized
tagagaatgctatgggatca

SEQ ID NO: 301362 - DNA, 20 bp, Artificial Sequence
  chemically synthesized
ctaagtattctctgatccca

SEQ ID NO: 301363 - DNA, 20 bp, Artificial Sequence
  chemically synthesized
tctagagaatgctatgggat

SEQ ID NO: 301364 - DNA, 20 bp, Artificial Sequence
  chemically synthesized
tgaattctagagaatgctat

SEQ ID NO: 301365 - DNA, 20 bp, Artificial Sequence
  chemically synthesized
gtgaattctagagaatgcta

SEQ ID NO: 301366 - DNA, 20 bp, Artificial Sequence
  chemically synthesized
tctgatcccatagcattctc

SEQ ID NO: 301367 - DNA, 20 bp, Artificial Sequence
  chemically synthesized
atatagtaatgtgaattcta

SEQ ID NO: 301368 - DNA, 20 bp, Artificial Sequence
  chemically synthesized
gaatatagtaatgtgaattc

SEQ ID NO: 301369 - DNA, 20 bp, Artificial Sequence
  chemically synthesized
tagcagtgttttgaagaata

SEQ ID NO: 301370 - DNA, 20 bp, Artificial Sequence
  chemically synthesized
aaatcaatagcagtgttttg

SEQ ID NO: 301371 - DNA, 20 bp, Artificial Sequence
  chemically synthesized
catcaagaataaatcaatag

SEQ ID NO: 301372 - DNA, 20 bp, Artificial Sequence
  chemically synthesized
atgcatcaagaataaatcaa

SEQ ID NO: 301373 - DNA, 20 bp, Artificial Sequence
  chemically synthesized
ttgatttattcttgatgcat

SEQ ID NO: 301374 - DNA, 20 bp, Artificial Sequence
  chemically synthesized
attatgttgtcttatgcatc

SEQ ID NO: 301375 - DNA, 20 bp, Artificial Sequence
  chemically synthesized
gcataagacaacataatctc

SEQ ID NO: 301376 - DNA, 20 bp, Artificial Sequence
  chemically synthesized
accatctattaaatgttctt

SEQ ID NO: 301377 - DNA, 20 bp, Artificial Sequence
  chemically synthesized
ataatctcaagaacatttaa

SEQ ID NO: 301378 - DNA, 20 bp, Artificial Sequence
  chemically synthesized
tctcaagaacatttaataga

SEQ ID NO: 301379 - DNA, 20 bp, Artificial Sequence
  chemically synthesized
taatagatggttatcttttt

SEQ ID NO: 301380 - DNA, 20 bp, Artificial Sequence
  chemically synthesized
aatagatggttatctttttg

SEQ ID NO: 301381 - DNA, 20 bp, Artificial Sequence
  chemically synthesized
accatcttcacatcctcaaa

SEQ ID NO: 301382 - DNA, 20 bp, Artificial Sequence
  chemically synthesized
gttatctttttgaggatgtg

SEQ ID NO: 301383 - DNA, 20 bp, Artificial Sequence
  chemically synthesized
tctttttgaggatgtgaaga

SEQ ID NO: 301384 - DNA, 20 bp, Artificial Sequence
  chemically synthesized
aggatgtgaagatggtatgc

SEQ ID NO: 301385 - DNA, 20 bp, Artificial Sequence
  chemically synthesized
aaaaaaaaaaaaaaaagaaa

SEQ ID NO: 301386 - DNA, 20 bp, Artificial Sequence
  chemically synthesized
tttgttaaaaaaaaaaaaaa

SEQ ID NO: 301387 - DNA, 20 bp, Artificial Sequence
  chemically synthesized
tttttttttttaacaaaaaa

SEQ ID NO: 301388 - DNA, 20 bp, Artificial Sequence
  chemically synthesized
ttaacaaaaaatagtgtcta

SEQ ID NO: 301389 - DNA, 20 bp, Artificial Sequence
  chemically synthesized
cataaattcaaatttcgctt

SEQ ID NO: 301390 - DNA, 20 bp, Artificial Sequence
  chemically synthesized
cgaaatttgaatttatgacc

SEQ ID NO: 301391 - DNA, 20 bp, Artificial Sequence
  chemically synthesized
gaaatttgaatttatgacca

SEQ ID NO: 301392 - DNA, 20 bp, Artificial Sequence
  chemically synthesized
gtattaaaggaaaatgacct

SEQ ID NO: 301393 - DNA, 20 bp, Artificial Sequence
  chemically synthesized
tgttactttttatgtattaa

SEQ ID NO: 301394 - DNA, 20 bp, Artificial Sequence
  chemically synthesized
atgttactttttatgtatta

SEQ ID NO: 301395 - DNA, 20 bp, Artificial Sequence
  chemically synthesized
attttcctttaatacataaa

SEQ ID NO: 301396 - DNA, 20 bp, Artificial Sequence
  chemically synthesized
tgacattgcaactataacac

SEQ ID NO: 301397 - DNA, 20 bp, Artificial Sequence
  chemically synthesized
ctaaatccattctagtgtta

SEQ ID NO: 301398 - DNA, 20 bp, Artificial Sequence
  chemically synthesized
ttgcaactataacactagaa

SEQ ID NO: 301399 - DNA, 20 bp, Artificial Sequence
  chemically synthesized
tgactctcctaaatccattc

SEQ ID NO: 301400 - DNA, 20 bp, Artificial Sequence
  chemically synthesized
ctataacactagaatggatt

SEQ ID NO: 301401 - DNA, 20 bp, Artificial Sequence
  chemically synthesized
tataacactagaatggattt

SEQ ID NO: 301402 - DNA, 20 bp, Artificial Sequence
  chemically synthesized
taacactagaatggatttag

SEQ ID NO: 301403 - DNA, 20 bp, Artificial Sequence
  chemically synthesized
acactagaatggatttagga

SEQ ID NO: 301404 - DNA, 20 bp, Artificial Sequence
  chemically synthesized
tagaatggatttaggagagt

SEQ ID NO: 301405 - DNA, 20 bp, Artificial Sequence
  chemically synthesized
ggatttaggagagtcagcac

SEQ ID NO: 301406 - DNA, 20 bp, Artificial Sequence
  chemically synthesized
ttcagttgcaaaataaggac

SEQ ID NO: 301407 - DNA, 20 bp, Artificial Sequence
  chemically synthesized
ttgctttcagttgcaaaata

SEQ ID NO: 301408 - DNA, 20 bp, Artificial Sequence
  chemically synthesized
cttgctttcagttgcaaaat

SEQ ID NO: 301409 - DNA, 20 bp, Artificial Sequence
  chemically synthesized
agtccttattttgcaactga

SEQ ID NO: 301410 - DNA, 20 bp, Artificial Sequence
  chemically synthesized
cttattttgcaactgaaagc

SEQ ID NO: 301411 - DNA, 20 bp, Artificial Sequence
  chemically synthesized
aaggttaaataacttgcttt

SEQ ID NO: 301412 - DNA, 20 bp, Artificial Sequence
  chemically synthesized
agcaagttatttaacctttc

SEQ ID NO: 301413 - DNA, 20 bp, Artificial Sequence
  chemically synthesized
aggttaattgaggtccagaa

SEQ ID NO: 301414 - DNA, 20 bp, Artificial Sequence
  chemically synthesized
caggttaattgaggtccaga

SEQ ID NO: 301415 - DNA, 20 bp, Artificial Sequence
  chemically synthesized
tttacaggttaattgaggtc

SEQ ID NO: 301416 - DNA, 20 bp, Artificial Sequence
  chemically synthesized
gcatgtttacaggttaattg

SEQ ID NO: 301417 - DNA, 20 bp, Artificial Sequence
  chemically synthesized
tgcatgtttacaggttaatt

SEQ ID NO: 301418 - DNA, 20 bp, Artificial Sequence
  chemically synthesized
ctagacttatgcatgtttac

SEQ ID NO: 301419 - DNA, 20 bp, Artificial Sequence
  chemically synthesized
actagacttatgcatgttta

SEQ ID NO: 301420 - DNA, 20 bp, Artificial Sequence
  chemically synthesized
attaacctgtaaacatgcat

SEQ ID NO: 301421 - DNA, 20 bp, Artificial Sequence
  chemically synthesized
cctgtaaacatgcataagtc

SEQ ID NO: 301422 - DNA, 20 bp, Artificial Sequence
  chemically synthesized
atgcataagtctagtctcct

SEQ ID NO: 301423 - DNA, 20 bp, Artificial Sequence
  chemically synthesized
tctttttttcctaaggagac

SEQ ID NO: 301424 - DNA, 20 bp, Artificial Sequence
  chemically synthesized
tgcataagtctagtctcctt

SEQ ID NO: 301425 - DNA, 20 bp, Artificial Sequence
  chemically synthesized
ttgcttctttttttcctaag

SEQ ID NO: 301426 - DNA, 20 bp, Artificial Sequence
  chemically synthesized
atttgcttctttttttccta

SEQ ID NO: 301427 - DNA, 20 bp, Artificial Sequence
  chemically synthesized
gatttgcttctttttttcct

SEQ ID NO: 301428 - DNA, 20 bp, Artificial Sequence
  chemically synthesized
tctagtctccttaggaaaaa

SEQ ID NO: 301429 - DNA, 20 bp, Artificial Sequence
  chemically synthesized
agtctccttaggaaaaaaag

SEQ ID NO: 301430 - DNA, 20 bp, Artificial Sequence
  chemically synthesized
cccatagaaacaaaacattt

SEQ ID NO: 301431 - DNA, 20 bp, Artificial Sequence
  chemically synthesized
tctaaaatgttttgtttcta

SEQ ID NO: 301432 - DNA, 20 bp, Artificial Sequence
  chemically synthesized
ctaaaatgttttgtttctat

SEQ ID NO: 301433 - DNA, 20 bp, Artificial Sequence
  chemically synthesized
ttgcctattggcacagccca

SEQ ID NO: 301434 - DNA, 20 bp, Artificial Sequence
  chemically synthesized
gtttctatgggctgtgccaa

SEQ ID NO: 301435 - DNA, 20 bp, Artificial Sequence
  chemically synthesized
tttctatgggctgtgccaat

SEQ ID NO: 301436 - DNA, 20 bp, Artificial Sequence
  chemically synthesized
gacacttttgcctattggca

SEQ ID NO: 301437 - DNA, 20 bp, Artificial Sequence
  chemically synthesized
gtaatgacacttttgcctat

SEQ ID NO: 301438 - DNA, 20 bp, Artificial Sequence
  chemically synthesized
tgggctgtgccaataggcaa

SEQ ID NO: 301439 - DNA, 20 bp, Artificial Sequence
  chemically synthesized
taggcaaaagtgtcattact

SEQ ID NO: 301440 - DNA, 20 bp, Artificial Sequence
  chemically synthesized
aatatctgggatgttaaact

SEQ ID NO: 301441 - DNA, 20 bp, Artificial Sequence
  chemically synthesized
cattactgagtttaacatcc

SEQ ID NO: 301442 - DNA, 20 bp, Artificial Sequence
  chemically synthesized
aaattgatcctaaaatatct

SEQ ID NO: 301443 - DNA, 20 bp, Artificial Sequence
  chemically synthesized
gtttaacatcccagatattt

SEQ ID NO: 301444 - DNA, 20 bp, Artificial Sequence
  chemically synthesized
taaattgatcctaaaatatc

SEQ ID NO: 301445 - DNA, 20 bp, Artificial Sequence
  chemically synthesized
tttaacatcccagatatttt

SEQ ID NO: 301446 - DNA, 20 bp, Artificial Sequence
  chemically synthesized
tttaggatcaatttatcata

SEQ ID NO: 301447 - DNA, 20 bp, Artificial Sequence
  chemically synthesized
tatagaacattaaaaaaaaa

SEQ ID NO: 301448 - DNA, 20 bp, Artificial Sequence
  chemically synthesized
cattaaaaaaaaaaagttca

SEQ ID NO: 301449 - DNA, 20 bp, Artificial Sequence
  chemically synthesized
ggacacattaattatctaat

SEQ ID NO: 301450 - DNA, 20 bp, Artificial Sequence
  chemically synthesized
gacacattaattatctaatt

SEQ ID NO: 301451 - DNA, 20 bp, Artificial Sequence
  chemically synthesized
agttatttgaaggacctaat

SEQ ID NO: 301452 - DNA, 20 bp, Artificial Sequence
  chemically synthesized
aaatataccaagttatttga

SEQ ID NO: 301453 - DNA, 20 bp, Artificial Sequence
  chemically synthesized
aaaatataccaagttatttg

SEQ ID NO: 301454 - DNA, 20 bp, Artificial Sequence
  chemically synthesized
attaggtccttcaaataact

SEQ ID NO: 301455 - DNA, 20 bp, Artificial Sequence
  chemically synthesized
gttgtatggcaaaatatacc

SEQ ID NO: 301456 - DNA, 20 bp, Artificial Sequence
  chemically synthesized
actaaaatctgaaagttgta

SEQ ID NO: 301457 - DNA, 20 bp, Artificial Sequence
  chemically synthesized
atattttgccatacaacttt

SEQ ID NO: 301458 - DNA, 20 bp, Artificial Sequence
  chemically synthesized
gtttctaaactaaaatctga

SEQ ID NO: 301459 - DNA, 20 bp, Artificial Sequence
  chemically synthesized
gccatacaactttcagattt

SEQ ID NO: 301460 - DNA, 20 bp, Artificial Sequence
  chemically synthesized
acaactttcagattttagtt

SEQ ID NO: 301461 - DNA, 20 bp, Artificial Sequence
  chemically synthesized
agattttagtttagaaactg

SEQ ID NO: 301462 - DNA, 20 bp, Artificial Sequence
  chemically synthesized
ttagatattgattataactt

SEQ ID NO: 301463 - DNA, 20 bp, Artificial Sequence
  chemically synthesized
tgcctaaaacatttttgttt

SEQ ID NO: 301464 - DNA, 20 bp, Artificial Sequence
  chemically synthesized
tatctaaaacaaaaatgttt

SEQ ID NO: 301465 - DNA, 20 bp, Artificial Sequence
  chemically synthesized
atctaaaacaaaaatgtttt

SEQ ID NO: 301466 - DNA, 20 bp, Artificial Sequence
  chemically synthesized
aacaaaaatgttttaggcat

SEQ ID NO: 301467 - DNA, 20 bp, Artificial Sequence
  chemically synthesized
agaccgctctgcagttttgt

SEQ ID NO: 301468 - DNA, 20 bp, Artificial Sequence
  chemically synthesized
gcatgagtctcacaaaactg

SEQ ID NO: 301469 - DNA, 20 bp, Artificial Sequence
  chemically synthesized
atgagtctcacaaaactgca

SEQ ID NO: 301470 - DNA, 20 bp, Artificial Sequence
  chemically synthesized
agtctcacaaaactgcagag

SEQ ID NO: 301471 - DNA, 20 bp, Artificial Sequence
  chemically synthesized
taacagataagaccgctctg

SEQ ID NO: 301472 - DNA, 20 bp, Artificial Sequence
  chemically synthesized
aaagaaaatagataacagat

SEQ ID NO: 301473 - DNA, 20 bp, Artificial Sequence
  chemically synthesized
tctggaaagaaaatagataa

SEQ ID NO: 301474 - DNA, 20 bp, Artificial Sequence
  chemically synthesized
tcacatctctggaaagaaaa

SEQ ID NO: 301475 - DNA, 20 bp, Artificial Sequence
  chemically synthesized
tctgttatctattttctttc

SEQ ID NO: 301476 - DNA, 20 bp, Artificial Sequence
  chemically synthesized
tgttatctattttctttcca

SEQ ID NO: 301477 - DNA, 20 bp, Artificial Sequence
  chemically synthesized
aattgtgtcacatctctgga

SEQ ID NO: 301478 - DNA, 20 bp, Artificial Sequence
  chemically synthesized
gttaaattgtgtcacatctc

SEQ ID NO: 301479 - DNA, 20 bp, Artificial Sequence
  chemically synthesized
tgacacaatttaacttcatc

SEQ ID NO: 301480 - DNA, 20 bp, Artificial Sequence
  chemically synthesized
ttatggctgctgtccagatg

SEQ ID NO: 301481 - DNA, 20 bp, Artificial Sequence
  chemically synthesized
acaatttaacttcatctgga

SEQ ID NO: 301482 - DNA, 20 bp, Artificial Sequence
  chemically synthesized
atttaacttcatctggacag

SEQ ID NO: 301483 - DNA, 20 bp, Artificial Sequence
  chemically synthesized
ttctttttatggctgctgtc

SEQ ID NO: 301484 - DNA, 20 bp, Artificial Sequence
  chemically synthesized
atctggacagcagccataaa

SEQ ID NO: 301485 - DNA, 20 bp, Artificial Sequence
  chemically synthesized
tttgtttgattttcttttta

SEQ ID NO: 301486 - DNA, 20 bp, Artificial Sequence
  chemically synthesized
aaaatcaaacaaacaaaaaa

SEQ ID NO: 301487 - DNA, 20 bp, Artificial Sequence
  chemically synthesized
aaaaacagaaacaaactgaa

SEQ ID NO: 301488 - DNA, 20 bp, Artificial Sequence
  chemically synthesized
aacagaaacaaactgaaaag

SEQ ID NO: 301489 - DNA, 20 bp, Artificial Sequence
  chemically synthesized
ttattatatattctactttt

SEQ ID NO: 301490 - DNA, 20 bp, Artificial Sequence
  chemically synthesized
tagaatatataataataatt

SEQ ID NO: 301491 - DNA, 20 bp, Artificial Sequence
  chemically synthesized
agaatatataataataattc

SEQ ID NO: 301492 - DNA, 20 bp, Artificial Sequence
  chemically synthesized
ataataataattcaggtatg

SEQ ID NO: 301493 - DNA, 20 bp, Artificial Sequence
  chemically synthesized
aataattcaggtatgtagat

SEQ ID NO: 301494 - DNA, 20 bp, Artificial Sequence
  chemically synthesized
agtcaatttatcctcctatg

SEQ ID NO: 301495 - DNA, 20 bp, Artificial Sequence
  chemically synthesized
ctgcatcctaactacatagg

SEQ ID NO: 301496 - DNA, 20 bp, Artificial Sequence
  chemically synthesized
cctgcatcctaactacatag

SEQ ID NO: 301497 - DNA, 20 bp, Artificial Sequence
  chemically synthesized
aatttatcctcctatgtagt

SEQ ID NO: 301498 - DNA, 20 bp, Artificial Sequence
  chemically synthesized
ttcctgcatcctaactacat

SEQ ID NO: 301499 - DNA, 20 bp, Artificial Sequence
  chemically synthesized
atttatcctcctatgtagtt

SEQ ID NO: 301500 - DNA, 20 bp, Artificial Sequence
  chemically synthesized
tttcctgcatcctaactaca

SEQ ID NO: 301501 - DNA, 20 bp, Artificial Sequence
  chemically synthesized
cctcctatgtagttaggatg

SEQ ID NO: 301502 - DNA, 20 bp, Artificial Sequence
  chemically synthesized
ctcctatgtagttaggatgc

SEQ ID NO: 301503 - DNA, 20 bp, Artificial Sequence
  chemically synthesized
tgtagttaggatgcaggaaa

SEQ ID NO: 301504 - DNA, 20 bp, Artificial Sequence
  chemically synthesized
ttaggatgcaggaaatagcc

SEQ ID NO: 301505 - DNA, 20 bp, Artificial Sequence
  chemically synthesized
gatgcaggaaatagccgaga

SEQ ID NO: 301506 - DNA, 20 bp, Artificial Sequence
  chemically synthesized
caggaaatagccgagaaagc

SEQ ID NO: 301507 - DNA, 20 bp, Artificial Sequence
  chemically synthesized
agaatgtaagcttgctttct

SEQ ID NO: 301508 - DNA, 20 bp, Artificial Sequence
  chemically synthesized
agggtaagcagacagaatgt

SEQ ID NO: 301509 - DNA, 20 bp, Artificial Sequence
  chemically synthesized
ttccctccagggtaagcaga

SEQ ID NO: 301510 - DNA, 20 bp, Artificial Sequence
  chemically synthesized
tacattctgtctgcttaccc

SEQ ID NO: 301511 - DNA, 20 bp, Artificial Sequence
  chemically synthesized
ttttttccctccagggtaag

SEQ ID NO: 301512 - DNA, 20 bp, Artificial Sequence
  chemically synthesized
cattctgtctgcttaccctg

SEQ ID NO: 301513 - DNA, 20 bp, Artificial Sequence
  chemically synthesized
attctgtctgcttaccctgg

SEQ ID NO: 301514 - DNA, 20 bp, Artificial Sequence
  chemically synthesized
ctgttttttccctccagggt

SEQ ID NO: 301515 - DNA, 20 bp, Artificial Sequence
  chemically synthesized
ttctgtctgcttaccctgga

SEQ ID NO: 301516 - DNA, 20 bp, Artificial Sequence
  chemically synthesized
tggtctgttttttccctcca

SEQ ID NO: 301517 - DNA, 20 bp, Artificial Sequence
  chemically synthesized
ctggtctgttttttccctcc

SEQ ID NO: 301518 - DNA, 20 bp, Artificial Sequence
  chemically synthesized
cctggtctgttttttccctc

SEQ ID NO: 301519 - DNA, 20 bp, Artificial Sequence
  chemically synthesized
cttaccctggagggaaaaaa

SEQ ID NO: 301520 - DNA, 20 bp, Artificial Sequence
  chemically synthesized
cctggagggaaaaaacagac

SEQ ID NO: 301521 - DNA, 20 bp, Artificial Sequence
  chemically synthesized
ctggagggaaaaaacagacc

SEQ ID NO: 301522 - DNA, 20 bp, Artificial Sequence
  chemically synthesized
ttgaaatgcctcagttcacc

SEQ ID NO: 301523 - DNA, 20 bp, Artificial Sequence
  chemically synthesized
aaaaacagaccaggtgaact

SEQ ID NO: 301524 - DNA, 20 bp, Artificial Sequence
  chemically synthesized
aaaacagaccaggtgaactg

SEQ ID NO: 301525 - DNA, 20 bp, Artificial Sequence
  chemically synthesized
agaggcattttgaaatgcct

SEQ ID NO: 301526 - DNA, 20 bp, Artificial Sequence
  chemically synthesized
tgtcctcaaggataatgtag

SEQ ID NO: 301527 - DNA, 20 bp, Artificial Sequence
  chemically synthesized
ttgtcctcaaggataatgta

SEQ ID NO: 301528 - DNA, 20 bp, Artificial Sequence
  chemically synthesized
ctttgtcctcaaggataatg

SEQ ID NO: 301529 - DNA, 20 bp, Artificial Sequence
  chemically synthesized
aatgcctctacattatcctt

SEQ ID NO: 301530 - DNA, 20 bp, Artificial Sequence
  chemically synthesized
atgcctctacattatccttg

SEQ ID NO: 301531 - DNA, 20 bp, Artificial Sequence
  chemically synthesized
aatgaatatctttgtcctca

SEQ ID NO: 301532 - DNA, 20 bp, Artificial Sequence
  chemically synthesized
ctacattatccttgaggaca

SEQ ID NO: 301533 - DNA, 20 bp, Artificial Sequence
  chemically synthesized
aaatgaatatctttgtcctc

SEQ ID NO: 301534 - DNA, 20 bp, Artificial Sequence
  chemically synthesized
tcatttatgaacgctttact

SEQ ID NO: 301535 - DNA, 20 bp, Artificial Sequence
  chemically synthesized
catttatgaacgctttactt

SEQ ID NO: 301536 - DNA, 20 bp, Artificial Sequence
  chemically synthesized
atttatgaacgctttacttg

SEQ ID NO: 301537 - DNA, 20 bp, Artificial Sequence
  chemically synthesized
tttatgaacgctttacttgg

SEQ ID NO: 301538 - DNA, 20 bp, Artificial Sequence
  chemically synthesized
aagataatttcccccaagta

SEQ ID NO: 301539 - DNA, 20 bp, Artificial Sequence
  chemically synthesized
taataaagataatttccccc

SEQ ID NO: 301540 - DNA, 20 bp, Artificial Sequence
  chemically synthesized
tgggggaaattatctttatt

SEQ ID NO: 301541 - DNA, 20 bp, Artificial Sequence
  chemically synthesized
aagtgaatgccatcttaata

SEQ ID NO: 301542 - DNA, 20 bp, Artificial Sequence
  chemically synthesized
ggaaattatctttattaaga

SEQ ID NO: 301543 - DNA, 20 bp, Artificial Sequence
  chemically synthesized
atgaatggcaaattgttttt

SEQ ID NO: 301544 - DNA, 20 bp, Artificial Sequence
  chemically synthesized
tagcaaccaggcagaatgaa

SEQ ID NO: 301545 - DNA, 20 bp, Artificial Sequence
  chemically synthesized
aatttgccattcattctgcc

SEQ ID NO: 301546 - DNA, 20 bp, Artificial Sequence
  chemically synthesized
atacttttgtagcaaccagg

SEQ ID NO: 301547 - DNA, 20 bp, Artificial Sequence
  chemically synthesized
tttatacttttgtagcaacc

SEQ ID NO: 301548 - DNA, 20 bp, Artificial Sequence
  chemically synthesized
atttatacttttgtagcaac

SEQ ID NO: 301549 - DNA, 20 bp, Artificial Sequence
  chemically synthesized
attctgcctggttgctacaa

SEQ ID NO: 301550 - DNA, 20 bp, Artificial Sequence
  chemically synthesized
agctttaatttatacttttg

SEQ ID NO: 301551 - DNA, 20 bp, Artificial Sequence
  chemically synthesized
tgctacaaaagtataaatta

SEQ ID NO: 301552 - DNA, 20 bp, Artificial Sequence
  chemically synthesized
ttttaagggatttttaaaaa

SEQ ID NO: 301553 - DNA, 20 bp, Artificial Sequence
  chemically synthesized
tcatgtagcagttattttaa

SEQ ID NO: 301554 - DNA, 20 bp, Artificial Sequence
  chemically synthesized
atcatgtagcagttatttta

SEQ ID NO: 301555 - DNA, 20 bp, Artificial Sequence
  chemically synthesized
aatcatgtagcagttatttt

SEQ ID NO: 301556 - DNA, 20 bp, Artificial Sequence
  chemically synthesized
attacttcctaatcatgtag

SEQ ID NO: 301557 - DNA, 20 bp, Artificial Sequence
  chemically synthesized
taaaataactgctacatgat

SEQ ID NO: 301558 - DNA, 20 bp, Artificial Sequence
  chemically synthesized
aaaataactgctacatgatt

SEQ ID NO: 301559 - DNA, 20 bp, Artificial Sequence
  chemically synthesized
gagattacttcctaatcatg

SEQ ID NO: 301560 - DNA, 20 bp, Artificial Sequence
  chemically synthesized
ataactgctacatgattagg

SEQ ID NO: 301561 - DNA, 20 bp, Artificial Sequence
  chemically synthesized
atgattaggaagtaatctcc

SEQ ID NO: 301562 - DNA, 20 bp, Artificial Sequence
  chemically synthesized
gttaattggtatttatccag

SEQ ID NO: 301563 - DNA, 20 bp, Artificial Sequence
  chemically synthesized
tagttaattggtatttatcc

SEQ ID NO: 301564 - DNA, 20 bp, Artificial Sequence
  chemically synthesized
ctagttaattggtatttatc

SEQ ID NO: 301565 - DNA, 20 bp, Artificial Sequence
  chemically synthesized
ctggataaataccaattaac

SEQ ID NO: 301566 - DNA, 20 bp, Artificial Sequence
  chemically synthesized
agatctattatctagttaat

SEQ ID NO: 301567 - DNA, 20 bp, Artificial Sequence
  chemically synthesized
aataccaattaactagataa

SEQ ID NO: 301568 - DNA, 20 bp, Artificial Sequence
  chemically synthesized
gtaaaactagatctattatc

SEQ ID NO: 301569 - DNA, 20 bp, Artificial Sequence
  chemically synthesized
aattaactagataatagatc

SEQ ID NO: 301570 - DNA, 20 bp, Artificial Sequence
  chemically synthesized
aactcagcctagggtaaaac

SEQ ID NO: 301571 - DNA, 20 bp, Artificial Sequence
  chemically synthesized
taatagatctagttttaccc

SEQ ID NO: 301572 - DNA, 20 bp, Artificial Sequence
  chemically synthesized
aatagatctagttttaccct

SEQ ID NO: 301573 - DNA, 20 bp, Artificial Sequence
  chemically synthesized
atctagttttaccctaggct

SEQ ID NO: 301574 - DNA, 20 bp, Artificial Sequence
  chemically synthesized
agagtaaggaactcagccta

SEQ ID NO: 301575 - DNA, 20 bp, Artificial Sequence
  chemically synthesized
cagagtaaggaactcagcct

SEQ ID NO: 301576 - DNA, 20 bp, Artificial Sequence
  chemically synthesized
tcagagtaaggaactcagcc

SEQ ID NO: 301577 - DNA, 20 bp, Artificial Sequence
  chemically synthesized
aattatcagagtaaggaact

SEQ ID NO: 301578 - DNA, 20 bp, Artificial Sequence
  chemically synthesized
cgtaggtaattatcagagta

SEQ ID NO: 301579 - DNA, 20 bp, Artificial Sequence
  chemically synthesized
acgtaggtaattatcagagt

SEQ ID NO: 301580 - DNA, 20 bp, Artificial Sequence
  chemically synthesized
gtacacgtaggtaattatca

SEQ ID NO: 301581 - DNA, 20 bp, Artificial Sequence
  chemically synthesized
ttgtacacgtaggtaattat

SEQ ID NO: 301582 - DNA, 20 bp, Artificial Sequence
  chemically synthesized
agtgatattattgtacacgt

SEQ ID NO: 301583 - DNA, 20 bp, Artificial Sequence
  chemically synthesized
cagtgatattattgtacacg

SEQ ID NO: 301584 - DNA, 20 bp, Artificial Sequence
  chemically synthesized
acaataatatcactgaattg

SEQ ID NO: 301585 - DNA, 20 bp, Artificial Sequence
  chemically synthesized
caataatatcactgaattgc

SEQ ID NO: 301586 - DNA, 20 bp, Artificial Sequence
  chemically synthesized
agcaaattattcctgcaatt

SEQ ID NO: 301587 - DNA, 20 bp, Artificial Sequence
  chemically synthesized
ttgcaggaataatttgctat

SEQ ID NO: 301588 - DNA, 20 bp, Artificial Sequence
  chemically synthesized
cacaagataattatttctaa

SEQ ID NO: 301589 - DNA, 20 bp, Artificial Sequence
  chemically synthesized
aaataattatcttgtgaccc

SEQ ID NO: 301590 - DNA, 20 bp, Artificial Sequence
  chemically synthesized
gtctgatgatcttgggtcac

SEQ ID NO: 301591 - DNA, 20 bp, Artificial Sequence
  chemically synthesized
caaaagtgtctgatgatctt

SEQ ID NO: 301592 - DNA, 20 bp, Artificial Sequence
  chemically synthesized
atcttgtgacccaagatcat

SEQ ID NO: 301593 - DNA, 20 bp, Artificial Sequence
  chemically synthesized
gcaaaagtgtctgatgatct

SEQ ID NO: 301594 - DNA, 20 bp, Artificial Sequence
  chemically synthesized
ctttacactgagatttgcaa

SEQ ID NO: 301595 - DNA, 20 bp, Artificial Sequence
  chemically synthesized
tcagacacttttgcaaatct

SEQ ID NO: 301596 - DNA, 20 bp, Artificial Sequence
  chemically synthesized
cttttgcaaatctcagtgta

SEQ ID NO: 301597 - DNA, 20 bp, Artificial Sequence
  chemically synthesized
taaatttttctctttacact

SEQ ID NO: 301598 - DNA, 20 bp, Artificial Sequence
  chemically synthesized
tttgcaaatctcagtgtaaa

SEQ ID NO: 301599 - DNA, 20 bp, Artificial Sequence
  chemically synthesized
tgcaataaatacaacatatg

SEQ ID NO: 301600 - DNA, 20 bp, Artificial Sequence
  chemically synthesized
tcgattcctaaataattata

SEQ ID NO: 301601 - DNA, 20 bp, Artificial Sequence
  chemically synthesized
gtagaaactgtataattatt

SEQ ID NO: 301602 - DNA, 20 bp, Artificial Sequence
  chemically synthesized
tagaaactgtataattattt

SEQ ID NO: 301603 - DNA, 20 bp, Artificial Sequence
  chemically synthesized
ttaactatctaaggtacatt

SEQ ID NO: 301604 - DNA, 20 bp, Artificial Sequence
  chemically synthesized
ggaatcgactaaatgtacct

SEQ ID NO: 301605 - DNA, 20 bp, Artificial Sequence
  chemically synthesized
tcgactaaatgtaccttaga

SEQ ID NO: 301606 - DNA, 20 bp, Artificial Sequence
  chemically synthesized
catagtttcttaactatcta

SEQ ID NO: 301607 - DNA, 20 bp, Artificial Sequence
  chemically synthesized
acatagtttcttaactatct

SEQ ID NO: 301608 - DNA, 20 bp, Artificial Sequence
  chemically synthesized
taaatgtaccttagatagtt

SEQ ID NO: 301609 - DNA, 20 bp, Artificial Sequence
  chemically synthesized
tagatagttaagaaactatg

SEQ ID NO: 301610 - DNA, 20 bp, Artificial Sequence
  chemically synthesized
atagttaagaaactatgtgg

SEQ ID NO: 301611 - DNA, 20 bp, Artificial Sequence
  chemically synthesized
aaattcagctttctaccaca

SEQ ID NO: 301612 - DNA, 20 bp, Artificial Sequence
  chemically synthesized
ttaagaaactatgtggtaga

SEQ ID NO: 301613 - DNA, 20 bp, Artificial Sequence
  chemically synthesized
caattaagggatttaaaatt

SEQ ID NO: 301614 - DNA, 20 bp, Artificial Sequence
  chemically synthesized
tatttacccaaaacaattaa

SEQ ID NO: 301615 - DNA, 20 bp, Artificial Sequence
  chemically synthesized
ttatttacccaaaacaatta

SEQ ID NO: 301616 - DNA, 20 bp, Artificial Sequence
  chemically synthesized
cttatttacccaaaacaatt

SEQ ID NO: 301617 - DNA, 20 bp, Artificial Sequence
  chemically synthesized
tttaaatcccttaattgttt

SEQ ID NO: 301618 - DNA, 20 bp, Artificial Sequence
  chemically synthesized
ttaaatcccttaattgtttt

SEQ ID NO: 301619 - DNA, 20 bp, Artificial Sequence
  chemically synthesized
cttaattgttttgggtaaat

SEQ ID NO: 301620 - DNA, 20 bp, Artificial Sequence
  chemically synthesized
ttaattgttttgggtaaata

SEQ ID NO: 301621 - DNA, 20 bp, Artificial Sequence
  chemically synthesized
ggtaaataaggataccctaa

SEQ ID NO: 301622 - DNA, 20 bp, Artificial Sequence
  chemically synthesized
gtaaataaggataccctaat

SEQ ID NO: 301623 - DNA, 20 bp, Artificial Sequence
  chemically synthesized
aattccaattttacccatta

SEQ ID NO: 301624 - DNA, 20 bp, Artificial Sequence
  chemically synthesized
taattccaattttacccatt

SEQ ID NO: 301625 - DNA, 20 bp, Artificial Sequence
  chemically synthesized
ataattccaattttacccat

SEQ ID NO: 301626 - DNA, 20 bp, Artificial Sequence
  chemically synthesized
gataccctaatgggtaaaat

SEQ ID NO: 301627 - DNA, 20 bp, Artificial Sequence
  chemically synthesized
gggtaaaattggaattatta

SEQ ID NO: 301628 - DNA, 20 bp, Artificial Sequence
  chemically synthesized
ttggaattattaaagatcat

SEQ ID NO: 301629 - DNA, 20 bp, Artificial Sequence
  chemically synthesized
tggaattattaaagatcatc

SEQ ID NO: 301630 - DNA, 20 bp, Artificial Sequence
  chemically synthesized
attattaaagatcatcagga

SEQ ID NO: 301631 - DNA, 20 bp, Artificial Sequence
  chemically synthesized
ggatggtcacgtttattatt

SEQ ID NO: 301632 - DNA, 20 bp, Artificial Sequence
  chemically synthesized
tttattattaagaacaattc

SEQ ID NO: 301633 - DNA, 20 bp, Artificial Sequence
  chemically synthesized
ttattattaagaacaattcc

SEQ ID NO: 301634 - DNA, 20 bp, Artificial Sequence
  chemically synthesized
ttattaagaacaattccagg

SEQ ID NO: 301635 - DNA, 20 bp, Artificial Sequence
  chemically synthesized
attaagaacaattccaggaa

SEQ ID NO: 301636 - DNA, 20 bp, Artificial Sequence
  chemically synthesized
aaattctacctagctcttcc

SEQ ID NO: 301637 - DNA, 20 bp, Artificial Sequence
  chemically synthesized
agaacaattccaggaagagc

SEQ ID NO: 301638 - DNA, 20 bp, Artificial Sequence
  chemically synthesized
gaacaattccaggaagagct

SEQ ID NO: 301639 - DNA, 20 bp, Artificial Sequence
  chemically synthesized
caattccaggaagagctagg

SEQ ID NO: 301640 - DNA, 20 bp, Artificial Sequence
  chemically synthesized
tatcatttaaaaattctacc

SEQ ID NO: 301641 - DNA, 20 bp, Artificial Sequence
  chemically synthesized
gatattgaaatgtcaaattt

SEQ ID NO: 301642 - DNA, 20 bp, Artificial Sequence
  chemically synthesized
gtatataattcaaataattg

SEQ ID NO: 301643 - DNA, 20 bp, Artificial Sequence
  chemically synthesized
atgtttgttgagagagtgaa

SEQ ID NO: 301644 - DNA, 20 bp, Artificial Sequence
  chemically synthesized
ccaataaatgtttgttgaga

SEQ ID NO: 301645 - DNA, 20 bp, Artificial Sequence
  chemically synthesized
aaccaataaatgtttgttga

SEQ ID NO: 301646 - DNA, 20 bp, Artificial Sequence
  chemically synthesized
gtaaccaataaatgtttgtt

SEQ ID NO: 301647 - DNA, 20 bp, Artificial Sequence
  chemically synthesized
ctctctcaacaaacatttat

SEQ ID NO: 301648 - DNA, 20 bp, Artificial Sequence
  chemically synthesized
gcaaataccgtggatacaat

SEQ ID NO: 301649 - DNA, 20 bp, Artificial Sequence
  chemically synthesized
ttggttacttattgtatcca

SEQ ID NO: 301650 - DNA, 20 bp, Artificial Sequence
  chemically synthesized
ttccattgtagcaaataccg

SEQ ID NO: 301651 - DNA, 20 bp, Artificial Sequence
  chemically synthesized
atccacggtatttgctacaa

SEQ ID NO: 301652 - DNA, 20 bp, Artificial Sequence
  chemically synthesized
gttttacttagattccattg

SEQ ID NO: 301653 - DNA, 20 bp, Artificial Sequence
  chemically synthesized
tatttgctacaatggaatct

SEQ ID NO: 301654 - DNA, 20 bp, Artificial Sequence
  chemically synthesized
acacttctttatgttttact

SEQ ID NO: 301655 - DNA, 20 bp, Artificial Sequence
  chemically synthesized
tggaatctaagtaaaacata

SEQ ID NO: 301656 - DNA, 20 bp, Artificial Sequence
  chemically synthesized
aatctaagtaaaacataaag

SEQ ID NO: 301657 - DNA, 20 bp, Artificial Sequence
  chemically synthesized
aacataaagaagtgtaataa

SEQ ID NO: 301658 - DNA, 20 bp, Artificial Sequence
  chemically synthesized
acataaagaagtgtaataat

SEQ ID NO: 301659 - DNA, 20 bp, Artificial Sequence
  chemically synthesized
attgcccgtcaaaacaaagg

SEQ ID NO: 301660 - DNA, 20 bp, Artificial Sequence
  chemically synthesized
ctcattgcccgtcaaaacaa

SEQ ID NO: 301661 - DNA, 20 bp, Artificial Sequence
  chemically synthesized
tctcattgcccgtcaaaaca

SEQ ID NO: 301662 - DNA, 20 bp, Artificial Sequence
  chemically synthesized
ataggcttcctttgttttga

SEQ ID NO: 301663 - DNA, 20 bp, Artificial Sequence
  chemically synthesized
taggcttcctttgttttgac

SEQ ID NO: 301664 - DNA, 20 bp, Artificial Sequence
  chemically synthesized
cctttgttttgacgggcaat

SEQ ID NO: 301665 - DNA, 20 bp, Artificial Sequence
  chemically synthesized
ggcaatgagaaattttatgt

SEQ ID NO: 301666 - DNA, 20 bp, Artificial Sequence
  chemically synthesized
aatgagaaattttatgtgag

SEQ ID NO: 301667 - DNA, 20 bp, Artificial Sequence
  chemically synthesized
aattttatgtgagtggcatg

SEQ ID NO: 301668 - DNA, 20 bp, Artificial Sequence
  chemically synthesized
attttatgtgagtggcatga

SEQ ID NO: 301669 - DNA, 20 bp, Artificial Sequence
  chemically synthesized
acgaatgtaatgtaatttac

SEQ ID NO: 301670 - DNA, 20 bp, Artificial Sequence
  chemically synthesized
gtaatgtaatttactggctg

SEQ ID NO: 301671 - DNA, 20 bp, Artificial Sequence
  chemically synthesized
atgtaatttactggctgaag

SEQ ID NO: 301672 - DNA, 20 bp, Artificial Sequence
  chemically synthesized
aatcattattccacttcagc

SEQ ID NO: 301673 - DNA, 20 bp, Artificial Sequence
  chemically synthesized
caataatcattattccactt

SEQ ID NO: 301674 - DNA, 20 bp, Artificial Sequence
  chemically synthesized
tgaagtggaataatgattat

SEQ ID NO: 301675 - DNA, 20 bp, Artificial Sequence
  chemically synthesized
gaagtggaataatgattatt

SEQ ID NO: 301676 - DNA, 20 bp, Artificial Sequence
  chemically synthesized
gtggaataatgattattggg

SEQ ID NO: 301677 - DNA, 20 bp, Artificial Sequence
  chemically synthesized
tggaataatgattattggga

SEQ ID NO: 301678 - DNA, 20 bp, Artificial Sequence
  chemically synthesized
aataatgattattgggaagg

SEQ ID NO: 301679 - DNA, 20 bp, Artificial Sequence
  chemically synthesized
tgggaaggtagacataaaat

SEQ ID NO: 301680 - DNA, 20 bp, Artificial Sequence
  chemically synthesized
gaaggtagacataaaattag

SEQ ID NO: 301681 - DNA, 20 bp, Artificial Sequence
  chemically synthesized
aggtagacataaaattagtg

SEQ ID NO: 301682 - DNA, 20 bp, Artificial Sequence
  chemically synthesized
acataaaattagtggagaat

SEQ ID NO: 301683 - DNA, 20 bp, Artificial Sequence
  chemically synthesized
gagaataatactgaatgcca

SEQ ID NO: 301684 - DNA, 20 bp, Artificial Sequence
  chemically synthesized
caagtgcttcctatggcatt

SEQ ID NO: 301685 - DNA, 20 bp, Artificial Sequence
  chemically synthesized
agaataatactgaatgccat

SEQ ID NO: 301686 - DNA, 20 bp, Artificial Sequence
  chemically synthesized
ataatactgaatgccatagg

SEQ ID NO: 301687 - DNA, 20 bp, Artificial Sequence
  chemically synthesized
taaaacccaagtgcttccta

SEQ ID NO: 301688 - DNA, 20 bp, Artificial Sequence
  chemically synthesized
tgaatgccataggaagcact

SEQ ID NO: 301689 - DNA, 20 bp, Artificial Sequence
  chemically synthesized
gaatgccataggaagcactt

SEQ ID NO: 301690 - DNA, 20 bp, Artificial Sequence
  chemically synthesized
atacctccaaaataaaaccc

SEQ ID NO: 301691 - DNA, 20 bp, Artificial Sequence
  chemically synthesized
gaagcacttgggttttattt

SEQ ID NO: 301692 - DNA, 20 bp, Artificial Sequence
  chemically synthesized
agcacttgggttttattttg

SEQ ID NO: 301693 - DNA, 20 bp, Artificial Sequence
  chemically synthesized
gcacttgggttttattttgg

SEQ ID NO: 301694 - DNA, 20 bp, Artificial Sequence
  chemically synthesized
ggttttattttggaggtatc

SEQ ID NO: 301695 - DNA, 20 bp, Artificial Sequence
  chemically synthesized
tttggaggtatctggattta

SEQ ID NO: 301696 - DNA, 20 bp, Artificial Sequence
  chemically synthesized
ttggaggtatctggatttat

SEQ ID NO: 301697 - DNA, 20 bp, Artificial Sequence
  chemically synthesized
catgcgaattcccataaatc

SEQ ID NO: 301698 - DNA, 20 bp, Artificial Sequence
  chemically synthesized
tttatgggaattcgcatgtc

SEQ ID NO: 301699 - DNA, 20 bp, Artificial Sequence
  chemically synthesized
tatgggaattcgcatgtctg

SEQ ID NO: 301700 - DNA, 20 bp, Artificial Sequence
  chemically synthesized
tgggaattcgcatgtctgga

SEQ ID NO: 301701 - DNA, 20 bp, Artificial Sequence
  chemically synthesized
gatgctttttgatgtctctc

SEQ ID NO: 301702 - DNA, 20 bp, Artificial Sequence
  chemically synthesized
atgtctggagagacatcaaa

SEQ ID NO: 301703 - DNA, 20 bp, Artificial Sequence
  chemically synthesized
gacatcaaaaagcatcattt

SEQ ID NO: 301704 - DNA, 20 bp, Artificial Sequence
  chemically synthesized
cattttagatatattcattt

SEQ ID NO: 301705 - DNA, 20 bp, Artificial Sequence
  chemically synthesized
attcattttagtaaatcaat

SEQ ID NO: 301706 - DNA, 20 bp, Artificial Sequence
  chemically synthesized
attttagtaaatcaattaga

SEQ ID NO: 301707 - DNA, 20 bp, Artificial Sequence
  chemically synthesized
ttttagtaaatcaattagaa

SEQ ID NO: 301708 - DNA, 20 bp, Artificial Sequence
  chemically synthesized
ttagtaaatcaattagaaag

SEQ ID NO: 301709 - DNA, 20 bp, Artificial Sequence
  chemically synthesized
tagtaaatcaattagaaagg

SEQ ID NO: 301710 - DNA, 20 bp, Artificial Sequence
  chemically synthesized
agtaaatcaattagaaagga

SEQ ID NO: 301711 - DNA, 20 bp, Artificial Sequence
  chemically synthesized
aaatcaattagaaaggaggg

SEQ ID NO: 301712 - DNA, 20 bp, Artificial Sequence
  chemically synthesized
aaggagggcagttctctcca

SEQ ID NO: 301713 - DNA, 20 bp, Artificial Sequence
  chemically synthesized
gccatatacctcactgtgga

SEQ ID NO: 301714 - DNA, 20 bp, Artificial Sequence
  chemically synthesized
agggcagttctctccacagt

SEQ ID NO: 301715 - DNA, 20 bp, Artificial Sequence
  chemically synthesized
gggcagttctctccacagtg

SEQ ID NO: 301716 - DNA, 20 bp, Artificial Sequence
  chemically synthesized
gagccatatacctcactgtg

SEQ ID NO: 301717 - DNA, 20 bp, Artificial Sequence
  chemically synthesized
ctgagccatatacctcactg

SEQ ID NO: 301718 - DNA, 20 bp, Artificial Sequence
  chemically synthesized
tctctccacagtgaggtata

SEQ ID NO: 301719 - DNA, 20 bp, Artificial Sequence
  chemically synthesized
ccacagtgaggtatatggct

SEQ ID NO: 301720 - DNA, 20 bp, Artificial Sequence
  chemically synthesized
cacagtgaggtatatggctc

SEQ ID NO: 301721 - DNA, 20 bp, Artificial Sequence
  chemically synthesized
gaggtatatggctcaggtta

SEQ ID NO: 301722 - DNA, 20 bp, Artificial Sequence
  chemically synthesized
aattgccaagtccataacct

SEQ ID NO: 301723 - DNA, 20 bp, Artificial Sequence
  chemically synthesized
tatggctcaggttatggact

SEQ ID NO: 301724 - DNA, 20 bp, Artificial Sequence
  chemically synthesized
tcatgttcattcgaattgcc

SEQ ID NO: 301725 - DNA, 20 bp, Artificial Sequence
  chemically synthesized
ttcgaatgaacatgaaatga

SEQ ID NO: 301726 - DNA, 20 bp, Artificial Sequence
  chemically synthesized
acatgaaatgacggaaatga

SEQ ID NO: 301727 - DNA, 20 bp, Artificial Sequence
  chemically synthesized
attagattgtattattgggc

SEQ ID NO: 301728 - DNA, 20 bp, Artificial Sequence
  chemically synthesized
tataattagattgtattatt

SEQ ID NO: 301729 - DNA, 20 bp, Artificial Sequence
  chemically synthesized
ttataattagattgtattat

SEQ ID NO: 301730 - DNA, 20 bp, Artificial Sequence
  chemically synthesized
ttttccttatttattataat

SEQ ID NO: 301731 - DNA, 20 bp, Artificial Sequence
  chemically synthesized
acaatctaattataataaat

SEQ ID NO: 301732 - DNA, 20 bp, Artificial Sequence
  chemically synthesized
caatctaattataataaata

SEQ ID NO: 301733 - DNA, 20 bp, Artificial Sequence
  chemically synthesized
taattataataaataaggaa

SEQ ID NO: 301734 - DNA, 20 bp, Artificial Sequence
  chemically synthesized
tataataaataaggaaaaga

SEQ ID NO: 301735 - DNA, 20 bp, Artificial Sequence
  chemically synthesized
aataaataaggaaaagaaag

SEQ ID NO: 301736 - DNA, 20 bp, Artificial Sequence
  chemically synthesized
aaataaggaaaagaaagtag

SEQ ID NO: 301737 - DNA, 20 bp, Artificial Sequence
  chemically synthesized
gaaagtagaagaaaaattca

SEQ ID NO: 301738 - DNA, 20 bp, Artificial Sequence
  chemically synthesized
agaagaaaaattcacagaac

SEQ ID NO: 301739 - DNA, 20 bp, Artificial Sequence
  chemically synthesized
aagaaaaattcacagaacta

SEQ ID NO: 301740 - DNA, 20 bp, Artificial Sequence
  chemically synthesized
attcacagaactagagatgt

SEQ ID NO: 301741 - DNA, 20 bp, Artificial Sequence
  chemically synthesized
aatttaccacctgacatctc

SEQ ID NO: 301742 - DNA, 20 bp, Artificial Sequence
  chemically synthesized
ttcacagaactagagatgtc

SEQ ID NO: 301743 - DNA, 20 bp, Artificial Sequence
  chemically synthesized
acagaactagagatgtcagg

SEQ ID NO: 301744 - DNA, 20 bp, Artificial Sequence
  chemically synthesized
aggtggtaaattctgttttg

SEQ ID NO: 301745 - DNA, 20 bp, Artificial Sequence
  chemically synthesized
gtggtaaattctgttttgaa

SEQ ID NO: 301746 - DNA, 20 bp, Artificial Sequence
  chemically synthesized
tcctgttttcctcttcaaaa

SEQ ID NO: 301747 - DNA, 20 bp, Artificial Sequence
  chemically synthesized
tggtaaattctgttttgaag

SEQ ID NO: 301748 - DNA, 20 bp, Artificial Sequence
  chemically synthesized
ttctgttttgaagaggaaaa

SEQ ID NO: 301749 - DNA, 20 bp, Artificial Sequence
  chemically synthesized
tctgttttgaagaggaaaac

SEQ ID NO: 301750 - DNA, 20 bp, Artificial Sequence
  chemically synthesized
gttttgaagaggaaaacagg

SEQ ID NO: 301751 - DNA, 20 bp, Artificial Sequence
  chemically synthesized
ttttgaagaggaaaacagga

SEQ ID NO: 301752 - DNA, 20 bp, Artificial Sequence
  chemically synthesized
gaaggtaattttacatttct

SEQ ID NO: 301753 - DNA, 20 bp, Artificial Sequence
  chemically synthesized
aaggtaattttacatttctt

SEQ ID NO: 301754 - DNA, 20 bp, Artificial Sequence
  chemically synthesized
attttacatttcttaggttt

SEQ ID NO: 301755 - DNA, 20 bp, Artificial Sequence
  chemically synthesized
ataaacattatctcaaacct

SEQ ID NO: 301756 - DNA, 20 bp, Artificial Sequence
  chemically synthesized
gtttgagataatgtttatta

SEQ ID NO: 301757 - DNA, 20 bp, Artificial Sequence
  chemically synthesized
gtagtcatctattatcgaca

SEQ ID NO: 301758 - DNA, 20 bp, Artificial Sequence
  chemically synthesized
ggtagtcatctattatcgac

SEQ ID NO: 301759 - DNA, 20 bp, Artificial Sequence
  chemically synthesized
gaatttttccctgtcgataa

SEQ ID NO: 301760 - DNA, 20 bp, Artificial Sequence
  chemically synthesized
tggtagtcatctattatcga

SEQ ID NO: 301761 - DNA, 20 bp, Artificial Sequence
  chemically synthesized
ggaggtagtgatggagatgg

SEQ ID NO: 301762 - DNA, 20 bp, Artificial Sequence
  chemically synthesized
ggtggaggtagtgatggaga

SEQ ID NO: 301763 - DNA, 20 bp, Artificial Sequence
  chemically synthesized
tggtggtggaggtagtgatg

SEQ ID NO: 301764 - DNA, 20 bp, Artificial Sequence
  chemically synthesized
gatggtggtggaggtagtga

SEQ ID NO: 301765 - DNA, 20 bp, Artificial Sequence
  chemically synthesized
gatgatgatggtggtggagg

SEQ ID NO: 301766 - DNA, 20 bp, Artificial Sequence
  chemically synthesized
gatgatgatgatggtggtgg

SEQ ID NO: 301767 - DNA, 20 bp, Artificial Sequence
  chemically synthesized
agatgatgatgatggtggtg

SEQ ID NO: 301768 - DNA, 20 bp, Artificial Sequence
  chemically synthesized
agagatgatgatgatggtgg

SEQ ID NO: 301769 - DNA, 20 bp, Artificial Sequence
  chemically synthesized
agtagagatgatgatgatgg

SEQ ID NO: 301770 - DNA, 20 bp, Artificial Sequence
  chemically synthesized
gatagtagagatgatgatga

SEQ ID NO: 301771 - DNA, 20 bp, Artificial Sequence
  chemically synthesized
tgggagaggtaacgatagta

SEQ ID NO: 301772 - DNA, 20 bp, Artificial Sequence
  chemically synthesized
ggtgggagaggtaacgatag

SEQ ID NO: 301773 - DNA, 20 bp, Artificial Sequence
  chemically synthesized
gatggtgggagaggtaacga

SEQ ID NO: 301774 - DNA, 20 bp, Artificial Sequence
  chemically synthesized
agtagaagtgatggtgggag

SEQ ID NO: 301775 - DNA, 20 bp, Artificial Sequence
  chemically synthesized
gagtagaagtgatggtggga

SEQ ID NO: 301776 - DNA, 20 bp, Artificial Sequence
  chemically synthesized
aggagtagaagtgatggtgg

SEQ ID NO: 301777 - DNA, 20 bp, Artificial Sequence
  chemically synthesized
ggaggagtagaagtgatggt

SEQ ID NO: 301778 - DNA, 20 bp, Artificial Sequence
  chemically synthesized
aggaggagtagaagtgatgg

SEQ ID NO: 301779 - DNA, 20 bp, Artificial Sequence
  chemically synthesized
ggtaggaggagtagaagtga

SEQ ID NO: 301780 - DNA, 20 bp, Artificial Sequence
  chemically synthesized
gtggtgggtaggaggagtag

SEQ ID NO: 301781 - DNA, 20 bp, Artificial Sequence
  chemically synthesized
attgtggtgggtaggaggag

SEQ ID NO: 301782 - DNA, 20 bp, Artificial Sequence
  chemically synthesized
aagattgtggtgggtaggag

SEQ ID NO: 301783 - DNA, 20 bp, Artificial Sequence
  chemically synthesized
ggaagattgtggtgggtagg

SEQ ID NO: 301784 - DNA, 20 bp, Artificial Sequence
  chemically synthesized
aggaagattgtggtgggtag

SEQ ID NO: 301785 - DNA, 20 bp, Artificial Sequence
  chemically synthesized
ggaggaagattgtggtgggt

SEQ ID NO: 301786 - DNA, 20 bp, Artificial Sequence
  chemically synthesized
tggaggaagattgtggtggg

SEQ ID NO: 301787 - DNA, 20 bp, Artificial Sequence
  chemically synthesized
agatggaggaagattgtggt

SEQ ID NO: 301788 - DNA, 20 bp, Artificial Sequence
  chemically synthesized
aagatggaggaagattgtgg

SEQ ID NO: 301789 - DNA, 20 bp, Artificial Sequence
  chemically synthesized
atgaagatggaggaagattg

SEQ ID NO: 301790 - DNA, 20 bp, Artificial Sequence
  chemically synthesized
agagatgatgaagatggagg

SEQ ID NO: 301791 - DNA, 20 bp, Artificial Sequence
  chemically synthesized
catagagatgatgaagatgg

SEQ ID NO: 301792 - DNA, 20 bp, Artificial Sequence
  chemically synthesized
ccatagagatgatgaagatg

SEQ ID NO: 301793 - DNA, 20 bp, Artificial Sequence
  chemically synthesized
gaccatagagatgatgaaga

SEQ ID NO: 301794 - DNA, 20 bp, Artificial Sequence
  chemically synthesized
tggagaccatagagatgatg

SEQ ID NO: 301795 - DNA, 20 bp, Artificial Sequence
  chemically synthesized
ctccatcttcatcatctcta

SEQ ID NO: 301796 - DNA, 20 bp, Artificial Sequence
  chemically synthesized
atttggtggtggagaccata

SEQ ID NO: 301797 - DNA, 20 bp, Artificial Sequence
  chemically synthesized
ttatttggtggtggagacca

SEQ ID NO: 301798 - DNA, 20 bp, Artificial Sequence
  chemically synthesized
tcgattcttatttggtggtg

SEQ ID NO: 301799 - DNA, 20 bp, Artificial Sequence
  chemically synthesized
gttcgattcttatttggtgg

SEQ ID NO: 301800 - DNA, 20 bp, Artificial Sequence
  chemically synthesized
tatggtctccaccaccaaat

SEQ ID NO: 301801 - DNA, 20 bp, Artificial Sequence
  chemically synthesized
gtggttcgattcttatttgg

SEQ ID NO: 301802 - DNA, 20 bp, Artificial Sequence
  chemically synthesized
gcagtggttcgattcttatt

SEQ ID NO: 301803 - DNA, 20 bp, Artificial Sequence
  chemically synthesized
taaacattcaataaatgcag

SEQ ID NO: 301804 - DNA, 20 bp, Artificial Sequence
  chemically synthesized
tggtaaacattcaataaatg

SEQ ID NO: 301805 - DNA, 20 bp, Artificial Sequence
  chemically synthesized
attgaatgtttaccacctta

SEQ ID NO: 301806 - DNA, 20 bp, Artificial Sequence
  chemically synthesized
ttgaatgtttaccaccttaa

SEQ ID NO: 301807 - DNA, 20 bp, Artificial Sequence
  chemically synthesized
ttaatacattgcctttaagg

SEQ ID NO: 301808 - DNA, 20 bp, Artificial Sequence
  chemically synthesized
catttaatacattgccttta

SEQ ID NO: 301809 - DNA, 20 bp, Artificial Sequence
  chemically synthesized
gcatttaatacattgccttt

SEQ ID NO: 301810 - DNA, 20 bp, Artificial Sequence
  chemically synthesized
aactgtcatgaggattaaat

SEQ ID NO: 301811 - DNA, 20 bp, Artificial Sequence
  chemically synthesized
tgcttatttaatcctcatga

SEQ ID NO: 301812 - DNA, 20 bp, Artificial Sequence
  chemically synthesized
tttataaaacaactgtcatg

SEQ ID NO: 301813 - DNA, 20 bp, Artificial Sequence
  chemically synthesized
ctttataaaacaactgtcat

SEQ ID NO: 301814 - DNA, 20 bp, Artificial Sequence
  chemically synthesized
ctcatgacagttgttttata

SEQ ID NO: 301815 - DNA, 20 bp, Artificial Sequence
  chemically synthesized
tgacagttgttttataaagt

SEQ ID NO: 301816 - DNA, 20 bp, Artificial Sequence
  chemically synthesized
gttttataaagtgagaatac

SEQ ID NO: 301817 - DNA, 20 bp, Artificial Sequence
  chemically synthesized
aagtgagaatactggaatct

SEQ ID NO: 301818 - DNA, 20 bp, Artificial Sequence
  chemically synthesized
agtgagaatactggaatctg

SEQ ID NO: 301819 - DNA, 20 bp, Artificial Sequence
  chemically synthesized
gttatctgtgcctcagattc

SEQ ID NO: 301820 - DNA, 20 bp, Artificial Sequence
  chemically synthesized
gaatactggaatctgaggca

SEQ ID NO: 301821 - DNA, 20 bp, Artificial Sequence
  chemically synthesized
attacttgttatctgtgcct

SEQ ID NO: 301822 - DNA, 20 bp, Artificial Sequence
  chemically synthesized
gaatctgaggcacagataac

SEQ ID NO: 301823 - DNA, 20 bp, Artificial Sequence
  chemically synthesized
aattactagcttatgagcgc

SEQ ID NO: 301824 - DNA, 20 bp, Artificial Sequence
  chemically synthesized
agtaatttgcctgcgctcat

SEQ ID NO: 301825 - DNA, 20 bp, Artificial Sequence
  chemically synthesized
taattactagcttatgagcg

SEQ ID NO: 301826 - DNA, 20 bp, Artificial Sequence
  chemically synthesized
atttgcctgcgctcataagc

SEQ ID NO: 301827 - DNA, 20 bp, Artificial Sequence
  chemically synthesized
tgttttaattactagcttat

SEQ ID NO: 301828 - DNA, 20 bp, Artificial Sequence
  chemically synthesized
aacctgcctgttttaattac

SEQ ID NO: 301829 - DNA, 20 bp, Artificial Sequence
  chemically synthesized
tcataagctagtaattaaaa

SEQ ID NO: 301830 - DNA, 20 bp, Artificial Sequence
  chemically synthesized
cataagctagtaattaaaac

SEQ ID NO: 301831 - DNA, 20 bp, Artificial Sequence
  chemically synthesized
aagctagtaattaaaacagg

SEQ ID NO: 301832 - DNA, 20 bp, Artificial Sequence
  chemically synthesized
agctagtaattaaaacaggc

SEQ ID NO: 301833 - DNA, 20 bp, Artificial Sequence
  chemically synthesized
ggcaggtttcacaaatacca

SEQ ID NO: 301834 - DNA, 20 bp, Artificial Sequence
  chemically synthesized
gcaggtttcacaaataccac

SEQ ID NO: 301835 - DNA, 20 bp, Artificial Sequence
  chemically synthesized
cacttataggtaagaacctg

SEQ ID NO: 301836 - DNA, 20 bp, Artificial Sequence
  chemically synthesized
taccacaggttcttacctat

SEQ ID NO: 301837 - DNA, 20 bp, Artificial Sequence
  chemically synthesized
tttatctctcacttataggt

SEQ ID NO: 301838 - DNA, 20 bp, Artificial Sequence
  chemically synthesized
acaggttcttacctataagt

SEQ ID NO: 301839 - DNA, 20 bp, Artificial Sequence
  chemically synthesized
agtgtttatctctcacttat

SEQ ID NO: 301840 - DNA, 20 bp, Artificial Sequence
  chemically synthesized
aggttcttacctataagtga

SEQ ID NO: 301841 - DNA, 20 bp, Artificial Sequence
  chemically synthesized
cagtgtttatctctcactta

SEQ ID NO: 301842 - DNA, 20 bp, Artificial Sequence
  chemically synthesized
ataagtgagagataaacact

SEQ ID NO: 301843 - DNA, 20 bp, Artificial Sequence
  chemically synthesized
tctttgtgtccatgtgtact

SEQ ID NO: 301844 - DNA, 20 bp, Artificial Sequence
  chemically synthesized
agataaacactgagtacaca

SEQ ID NO: 301845 - DNA, 20 bp, Artificial Sequence
  chemically synthesized
actgagtacacatggacaca

SEQ ID NO: 301846 - DNA, 20 bp, Artificial Sequence
  chemically synthesized
gagtacacatggacacaaag

SEQ ID NO: 301847 - DNA, 20 bp, Artificial Sequence
  chemically synthesized
agtacacatggacacaaaga

SEQ ID NO: 301848 - DNA, 20 bp, Artificial Sequence
  chemically synthesized
gtacacatggacacaaagaa

SEQ ID NO: 301849 - DNA, 20 bp, Artificial Sequence
  chemically synthesized
ggacacaaagaagggaataa

SEQ ID NO: 301850 - DNA, 20 bp, Artificial Sequence
  chemically synthesized
aagaagggaataatagacac

SEQ ID NO: 301851 - DNA, 20 bp, Artificial Sequence
  chemically synthesized
agaagggaataatagacact

SEQ ID NO: 301852 - DNA, 20 bp, Artificial Sequence
  chemically synthesized
gaagggaataatagacactg

SEQ ID NO: 301853 - DNA, 20 bp, Artificial Sequence
  chemically synthesized
ttccactctcaaataggccc

SEQ ID NO: 301854 - DNA, 20 bp, Artificial Sequence
  chemically synthesized
atagacactggggcctattt

SEQ ID NO: 301855 - DNA, 20 bp, Artificial Sequence
  chemically synthesized
agacactggggcctatttga

SEQ ID NO: 301856 - DNA, 20 bp, Artificial Sequence
  chemically synthesized
cccaccttccactctcaaat

SEQ ID NO: 301857 - DNA, 20 bp, Artificial Sequence
  chemically synthesized
tcccaccttccactctcaaa

SEQ ID NO: 301858 - DNA, 20 bp, Artificial Sequence
  chemically synthesized
cactggggcctatttgagag

SEQ ID NO: 301859 - DNA, 20 bp, Artificial Sequence
  chemically synthesized
tggggcctatttgagagtgg

SEQ ID NO: 301860 - DNA, 20 bp, Artificial Sequence
  chemically synthesized
ggggcctatttgagagtgga

SEQ ID NO: 301861 - DNA, 20 bp, Artificial Sequence
  chemically synthesized
gcctatttgagagtggaagg

SEQ ID NO: 301862 - DNA, 20 bp, Artificial Sequence
  chemically synthesized
cctatttgagagtggaaggt

SEQ ID NO: 301863 - DNA, 20 bp, Artificial Sequence
  chemically synthesized
tatttgagagtggaaggtgg

SEQ ID NO: 301864 - DNA, 20 bp, Artificial Sequence
  chemically synthesized
atttgagagtggaaggtggg

SEQ ID NO: 301865 - DNA, 20 bp, Artificial Sequence
  chemically synthesized
tgagagtggaaggtgggagg

SEQ ID NO: 301866 - DNA, 20 bp, Artificial Sequence
  chemically synthesized
gagagtggaaggtgggaggc

SEQ ID NO: 301867 - DNA, 20 bp, Artificial Sequence
  chemically synthesized
gtggaaggtgggaggcaggt

SEQ ID NO: 301868 - DNA, 20 bp, Artificial Sequence
  chemically synthesized
tggaaggtgggaggcaggtg

SEQ ID NO: 301869 - DNA, 20 bp, Artificial Sequence
  chemically synthesized
aggtgggaggcaggtgagga

SEQ ID NO: 301870 - DNA, 20 bp, Artificial Sequence
  chemically synthesized
ggtgggaggcaggtgaggat

SEQ ID NO: 301871 - DNA, 20 bp, Artificial Sequence
  chemically synthesized
aggatgggaaaactacctat

SEQ ID NO: 301872 - DNA, 20 bp, Artificial Sequence
  chemically synthesized
tcagcataatatctgatagg

SEQ ID NO: 301873 - DNA, 20 bp, Artificial Sequence
  chemically synthesized
taatcagcataatatctgat

SEQ ID NO: 301874 - DNA, 20 bp, Artificial Sequence
  chemically synthesized
gtaatcagcataatatctga

SEQ ID NO: 301875 - DNA, 20 bp, Artificial Sequence
  chemically synthesized
agatattatgctgattacct

SEQ ID NO: 301876 - DNA, 20 bp, Artificial Sequence
  chemically synthesized
aattttgtctctcaggtaat

SEQ ID NO: 301877 - DNA, 20 bp, Artificial Sequence
  chemically synthesized
atattatgctgattacctga

SEQ ID NO: 301878 - DNA, 20 bp, Artificial Sequence
  chemically synthesized
tacagataattttgtctctc

SEQ ID NO: 301879 - DNA, 20 bp, Artificial Sequence
  chemically synthesized
gtacagataattttgtctct

SEQ ID NO: 301880 - DNA, 20 bp, Artificial Sequence
  chemically synthesized
tgttgtggctgtttggtgta

SEQ ID NO: 301881 - DNA, 20 bp, Artificial Sequence
  chemically synthesized
aaaattatctgtacaccaaa

SEQ ID NO: 301882 - DNA, 20 bp, Artificial Sequence
  chemically synthesized
aattgcgtgttgtggctgtt

SEQ ID NO: 301883 - DNA, 20 bp, Artificial Sequence
  chemically synthesized
catgggtaaattgcgtgttg

SEQ ID NO: 301884 - DNA, 20 bp, Artificial Sequence
  chemically synthesized
aacgtgtaggtttgttacat

SEQ ID NO: 301885 - DNA, 20 bp, Artificial Sequence
  chemically synthesized
taacgtgtaggtttgttaca

SEQ ID NO: 301886 - DNA, 20 bp, Artificial Sequence
  chemically synthesized
ggttcaaggggttaacgtgt

SEQ ID NO: 301887 - DNA, 20 bp, Artificial Sequence
  chemically synthesized
aggttcaaggggttaacgtg

SEQ ID NO: 301888 - DNA, 20 bp, Artificial Sequence
  chemically synthesized
acttttagtttaggttcaag

SEQ ID NO: 301889 - DNA, 20 bp, Artificial Sequence
  chemically synthesized
aacttttagtttaggttcaa

SEQ ID NO: 301890 - DNA, 20 bp, Artificial Sequence
  chemically synthesized
caacttttagtttaggttca

SEQ ID NO: 301891 - DNA, 20 bp, Artificial Sequence
  chemically synthesized
ccaacttttagtttaggttc

SEQ ID NO: 301892 - DNA, 20 bp, Artificial Sequence
  chemically synthesized
accccttgaacctaaactaa

SEQ ID NO: 301893 - DNA, 20 bp, Artificial Sequence
  chemically synthesized
tttttcccaacttttagttt

SEQ ID NO: 301894 - DNA, 20 bp, Artificial Sequence
  chemically synthesized
ttttttcccaacttttagtt

SEQ ID NO: 301895 - DNA, 20 bp, Artificial Sequence
  chemically synthesized
cttgaacctaaactaaaagt

SEQ ID NO: 301896 - DNA, 20 bp, Artificial Sequence
  chemically synthesized
ttgaacctaaactaaaagtt

SEQ ID NO: 301897 - DNA, 20 bp, Artificial Sequence
  chemically synthesized
tttttttttttcccaacttt

SEQ ID NO: 301898 - DNA, 20 bp, Artificial Sequence
  chemically synthesized
taaaagttgggaaaaaaaaa

SEQ ID NO: 301899 - DNA, 20 bp, Artificial Sequence
  chemically synthesized
aaaagttgggaaaaaaaaaa

SEQ ID NO: 301900 - DNA, 20 bp, Artificial Sequence
  chemically synthesized
aaagttgggaaaaaaaaaaa

SEQ ID NO: 301901 - DNA, 20 bp, Artificial Sequence
  chemically synthesized
gttgggaaaaaaaaaaaggg

SEQ ID NO: 301902 - DNA, 20 bp, Artificial Sequence
  chemically synthesized
aaagggcagcattcaaacct

SEQ ID NO: 301903 - DNA, 20 bp, Artificial Sequence
  chemically synthesized
ttttggaatcagaattactg

SEQ ID NO: 301904 - DNA, 20 bp, Artificial Sequence
  chemically synthesized
cttttggaatcagaattact

SEQ ID NO: 301905 - DNA, 20 bp, Artificial Sequence
  chemically synthesized
ctcagtaattctgattccaa

SEQ ID NO: 301906 - DNA, 20 bp, Artificial Sequence
  chemically synthesized
aaaatcattgcttttggaat

SEQ ID NO: 301907 - DNA, 20 bp, Artificial Sequence
  chemically synthesized
atggaaaaaatcattgcttt

SEQ ID NO: 301908 - DNA, 20 bp, Artificial Sequence
  chemically synthesized
gtctagagaagtagcaaata

SEQ ID NO: 301909 - DNA, 20 bp, Artificial Sequence
  chemically synthesized
ttccatatttgctacttctc

SEQ ID NO: 301910 - DNA, 20 bp, Artificial Sequence
  chemically synthesized
tgcctgtgtgtctagagaag

SEQ ID NO: 301911 - DNA, 20 bp, Artificial Sequence
  chemically synthesized
cattgcctgtgtgtctagag

SEQ ID NO: 301912 - DNA, 20 bp, Artificial Sequence
  chemically synthesized
attcattgcctgtgtgtcta

SEQ ID NO: 301913 - DNA, 20 bp, Artificial Sequence
  chemically synthesized
ttgctacttctctagacaca

SEQ ID NO: 301914 - DNA, 20 bp, Artificial Sequence
  chemically synthesized
tgctacttctctagacacac

SEQ ID NO: 301915 - DNA, 20 bp, Artificial Sequence
  chemically synthesized
taattcattgcctgtgtgtc

SEQ ID NO: 301916 - DNA, 20 bp, Artificial Sequence
  chemically synthesized
tatacattgcacacatattt

SEQ ID NO: 301917 - DNA, 20 bp, Artificial Sequence
  chemically synthesized
aaaatatgtgtgcaatgtat

SEQ ID NO: 301918 - DNA, 20 bp, Artificial Sequence
  chemically synthesized
atatgtgtgcaatgtataag

SEQ ID NO: 301919 - DNA, 20 bp, Artificial Sequence
  chemically synthesized
tatgtgtgcaatgtataagt

SEQ ID NO: 301920 - DNA, 20 bp, Artificial Sequence
  chemically synthesized
gtgcaatgtataagtaggta

SEQ ID NO: 301921 - DNA, 20 bp, Artificial Sequence
  chemically synthesized
tataagtaggtatggttaat

SEQ ID NO: 301922 - DNA, 20 bp, Artificial Sequence
  chemically synthesized
aagtaggtatggttaattgg

SEQ ID NO: 301923 - DNA, 20 bp, Artificial Sequence
  chemically synthesized
agtaggtatggttaattgga

SEQ ID NO: 301924 - DNA, 20 bp, Artificial Sequence
  chemically synthesized
gtttgcatttgatgaacatt

SEQ ID NO: 301925 - DNA, 20 bp, Artificial Sequence
  chemically synthesized
tttgcatttgatgaacattg

SEQ ID NO: 301926 - DNA, 20 bp, Artificial Sequence
  chemically synthesized
gcatttgatgaacattgagg

SEQ ID NO: 301927 - DNA, 20 bp, Artificial Sequence
  chemically synthesized
atgaacattgaggcagttgc

SEQ ID NO: 301928 - DNA, 20 bp, Artificial Sequence
  chemically synthesized
gaggcagttgctggatgcac

SEQ ID NO: 301929 - DNA, 20 bp, Artificial Sequence
  chemically synthesized
gctatttccgcttgtgcatc

SEQ ID NO: 301930 - DNA, 20 bp, Artificial Sequence
  chemically synthesized
gcagttgctggatgcacaag

SEQ ID NO: 301931 - DNA, 20 bp, Artificial Sequence
  chemically synthesized
gctggatgcacaagcggaaa

SEQ ID NO: 301932 - DNA, 20 bp, Artificial Sequence
  chemically synthesized
tgcacaagcggaaatagctt

SEQ ID NO: 301933 - DNA, 20 bp, Artificial Sequence
  chemically synthesized
cacaagcggaaatagcttta

SEQ ID NO: 301934 - DNA, 20 bp, Artificial Sequence
  chemically synthesized
attaaagctttatatctcta

SEQ ID NO: 301935 - DNA, 20 bp, Artificial Sequence
  chemically synthesized
gaaatagctttagagatata

SEQ ID NO: 301936 - DNA, 20 bp, Artificial Sequence
  chemically synthesized
gagatataaagctttaattt

SEQ ID NO: 301937 - DNA, 20 bp, Artificial Sequence
  chemically synthesized
agatataaagctttaatttg

SEQ ID NO: 301938 - DNA, 20 bp, Artificial Sequence
  chemically synthesized
tgacactctccctcaaatta

SEQ ID NO: 301939 - DNA, 20 bp, Artificial Sequence
  chemically synthesized
gatataaagctttaatttga

SEQ ID NO: 301940 - DNA, 20 bp, Artificial Sequence
  chemically synthesized
tataaagctttaatttgagg

SEQ ID NO: 301941 - DNA, 20 bp, Artificial Sequence
  chemically synthesized
taaagctttaatttgaggga

SEQ ID NO: 301942 - DNA, 20 bp, Artificial Sequence
  chemically synthesized
ttgagggagagtgtcacatc

SEQ ID NO: 301943 - DNA, 20 bp, Artificial Sequence
  chemically synthesized
gagggagagtgtcacatctg

SEQ ID NO: 301944 - DNA, 20 bp, Artificial Sequence
  chemically synthesized
actcccaaatcatgtagctc

SEQ ID NO: 301945 - DNA, 20 bp, Artificial Sequence
  chemically synthesized
acatctggagctacatgatt

SEQ ID NO: 301946 - DNA, 20 bp, Artificial Sequence
  chemically synthesized
tgactgactcccaaatcatg

SEQ ID NO: 301947 - DNA, 20 bp, Artificial Sequence
  chemically synthesized
catctggagctacatgattt

SEQ ID NO: 301948 - DNA, 20 bp, Artificial Sequence
  chemically synthesized
tctggagctacatgatttgg

SEQ ID NO: 301949 - DNA, 20 bp, Artificial Sequence
  chemically synthesized
gagctacatgatttgggagt

SEQ ID NO: 301950 - DNA, 20 bp, Artificial Sequence
  chemically synthesized
tgatttgggagtcagtcact

SEQ ID NO: 301951 - DNA, 20 bp, Artificial Sequence
  chemically synthesized
atttgggagtcagtcactta

SEQ ID NO: 301952 - DNA, 20 bp, Artificial Sequence
  chemically synthesized
gggagtcagtcacttagagc

SEQ ID NO: 301953 - DNA, 20 bp, Artificial Sequence
  chemically synthesized
ggagtcagtcacttagagcc

SEQ ID NO: 301954 - DNA, 20 bp, Artificial Sequence
  chemically synthesized
attgattcgagcctggctct

SEQ ID NO: 301955 - DNA, 20 bp, Artificial Sequence
  chemically synthesized
tcctctcattgattcgagcc

SEQ ID NO: 301956 - DNA, 20 bp, Artificial Sequence
  chemically synthesized
ttatctcctctcattgattc

SEQ ID NO: 301957 - DNA, 20 bp, Artificial Sequence
  chemically synthesized
agagccaggctcgaatcaat

SEQ ID NO: 301958 - DNA, 20 bp, Artificial Sequence
  chemically synthesized
agccaggctcgaatcaatga

SEQ ID NO: 301959 - DNA, 20 bp, Artificial Sequence
  chemically synthesized
gccaggctcgaatcaatgag

SEQ ID NO: 301960 - DNA, 20 bp, Artificial Sequence
  chemically synthesized
caggctcgaatcaatgagag

SEQ ID NO: 301961 - DNA, 20 bp, Artificial Sequence
  chemically synthesized
atcaatgagaggagataatc

SEQ ID NO: 301962 - DNA, 20 bp, Artificial Sequence
  chemically synthesized
gagaggagataatccagata

SEQ ID NO: 301963 - DNA, 20 bp, Artificial Sequence
  chemically synthesized
aggagataatccagataaag

SEQ ID NO: 301964 - DNA, 20 bp, Artificial Sequence
  chemically synthesized
ggccttttgacttctttatc

SEQ ID NO: 301965 - DNA, 20 bp, Artificial Sequence
  chemically synthesized
aatccagataaagaagtcaa

SEQ ID NO: 301966 - DNA, 20 bp, Artificial Sequence
  chemically synthesized
atccagataaagaagtcaaa

SEQ ID NO: 301967 - DNA, 20 bp, Artificial Sequence
  chemically synthesized
agataaagaagtcaaaaggc

SEQ ID NO: 301968 - DNA, 20 bp, Artificial Sequence
  chemically synthesized
gataaagaagtcaaaaggcc

SEQ ID NO: 301969 - DNA, 20 bp, Artificial Sequence
  chemically synthesized
agaagtcaaaaggccgggca

SEQ ID NO: 301970 - DNA, 20 bp, Artificial Sequence
  chemically synthesized
agtcaaaaggccgggcatgg

SEQ ID NO: 301971 - DNA, 20 bp, Artificial Sequence
  chemically synthesized
caggcatgagccaccatgcc

SEQ ID NO: 301972 - DNA, 20 bp, Artificial Sequence
  chemically synthesized
agtgctgggattacaggcat

SEQ ID NO: 301973 - DNA, 20 bp, Artificial Sequence
  chemically synthesized
gtggctcatgcctgtaatcc

SEQ ID NO: 301974 - DNA, 20 bp, Artificial Sequence
  chemically synthesized
tcccaaagtgctgggattac

SEQ ID NO: 301975 - DNA, 20 bp, Artificial Sequence
  chemically synthesized
ctcccaaagtgctgggatta

SEQ ID NO: 301976 - DNA, 20 bp, Artificial Sequence
  chemically synthesized
tgcctgtaatcccagcactt

SEQ ID NO: 301977 - DNA, 20 bp, Artificial Sequence
  chemically synthesized
cttcagcctcccaaagtgct

SEQ ID NO: 301978 - DNA, 20 bp, Artificial Sequence
  chemically synthesized
gcctgtaatcccagcacttt

SEQ ID NO: 301979 - DNA, 20 bp, Artificial Sequence
  chemically synthesized
acttcagcctcccaaagtgc

SEQ ID NO: 301980 - DNA, 20 bp, Artificial Sequence
  chemically synthesized
ctgtaatcccagcactttgg

SEQ ID NO: 301981 - DNA, 20 bp, Artificial Sequence
  chemically synthesized
tgtaatcccagcactttggg

SEQ ID NO: 301982 - DNA, 20 bp, Artificial Sequence
  chemically synthesized
ccacccacttcagcctccca

SEQ ID NO: 301983 - DNA, 20 bp, Artificial Sequence
  chemically synthesized
cccagcactttgggaggctg

SEQ ID NO: 301984 - DNA, 20 bp, Artificial Sequence
  chemically synthesized
agcactttgggaggctgaag

SEQ ID NO: 301985 - DNA, 20 bp, Artificial Sequence
  chemically synthesized
gcactttgggaggctgaagt

SEQ ID NO: 301986 - DNA, 20 bp, Artificial Sequence
  chemically synthesized
ctttgggaggctgaagtggg

SEQ ID NO: 301987 - DNA, 20 bp, Artificial Sequence
  chemically synthesized
acctcgtgatccacccactt

SEQ ID NO: 301988 - DNA, 20 bp, Artificial Sequence
  chemically synthesized
ggctgaagtgggtggatcac

SEQ ID NO: 301989 - DNA, 20 bp, Artificial Sequence
  chemically synthesized
gctgaagtgggtggatcacg

SEQ ID NO: 301990 - DNA, 20 bp, Artificial Sequence
  chemically synthesized
aagtgggtggatcacgaggt

SEQ ID NO: 301991 - DNA, 20 bp, Artificial Sequence
  chemically synthesized
agtgggtggatcacgaggtc

SEQ ID NO: 301992 - DNA, 20 bp, Artificial Sequence
  chemically synthesized
tgggtggatcacgaggtcag

SEQ ID NO: 301993 - DNA, 20 bp, Artificial Sequence
  chemically synthesized
gatcacgaggtcaggagctc

SEQ ID NO: 301994 - DNA, 20 bp, Artificial Sequence
  chemically synthesized
cgaggtcaggagctcaagac

SEQ ID NO: 301995 - DNA, 20 bp, Artificial Sequence
  chemically synthesized
atcttggccaggctggtctt

SEQ ID NO: 301996 - DNA, 20 bp, Artificial Sequence
  chemically synthesized
tcaggagctcaagaccagcc

SEQ ID NO: 301997 - DNA, 20 bp, Artificial Sequence
  chemically synthesized
tttcaccatcttggccaggc

SEQ ID NO: 301998 - DNA, 20 bp, Artificial Sequence
  chemically synthesized
agctcaagaccagcctggcc

SEQ ID NO: 301999 - DNA, 20 bp, Artificial Sequence
  chemically synthesized
agggtttcaccatcttggcc

SEQ ID NO: 302000 - DNA, 20 bp, Artificial Sequence
  chemically synthesized
caagaccagcctggccaaga

SEQ ID NO: 302001 - DNA, 20 bp, Artificial Sequence
  chemically synthesized
cagggtttcaccatcttggc

SEQ ID NO: 302002 - DNA, 20 bp, Artificial Sequence
  chemically synthesized
gagacagggtttcaccatct

SEQ ID NO: 302003 - DNA, 20 bp, Artificial Sequence
  chemically synthesized
tgtattttttagtagagaca

SEQ ID NO: 302004 - DNA, 20 bp, Artificial Sequence
  chemically synthesized
ttgtattttttagtagagac

SEQ ID NO: 302005 - DNA, 20 bp, Artificial Sequence
  chemically synthesized
tttgtattttttagtagaga

SEQ ID NO: 302006 - DNA, 20 bp, Artificial Sequence
  chemically synthesized
tttttttgtattttttagta

SEQ ID NO: 302007 - DNA, 20 bp, Artificial Sequence
  chemically synthesized
attttttttgtattttttag

SEQ ID NO: 302008 - DNA, 20 bp, Artificial Sequence
  chemically synthesized
ctaattttttttgtattttt

SEQ ID NO: 302009 - DNA, 20 bp, Artificial Sequence
  chemically synthesized
ctaaaaaatacaaaaaaaat

SEQ ID NO: 302010 - DNA, 20 bp, Artificial Sequence
  chemically synthesized
aaaatacaaaaaaaattagc

SEQ ID NO: 302011 - DNA, 20 bp, Artificial Sequence
  chemically synthesized
caaaaaaaattagccggatg

SEQ ID NO: 302012 - DNA, 20 bp, Artificial Sequence
  chemically synthesized
aaaaaattagccggatgtgg

SEQ ID NO: 302013 - DNA, 20 bp, Artificial Sequence
  chemically synthesized
caggcaccctccaccacatc

SEQ ID NO: 302014 - DNA, 20 bp, Artificial Sequence
  chemically synthesized
aaaattagccggatgtggtg

SEQ ID NO: 302015 - DNA, 20 bp, Artificial Sequence
  chemically synthesized
aaattagccggatgtggtgg

SEQ ID NO: 302016 - DNA, 20 bp, Artificial Sequence
  chemically synthesized
aattagccggatgtggtgga

SEQ ID NO: 302017 - DNA, 20 bp, Artificial Sequence
  chemically synthesized
gtggagggtgcctgtaattc

SEQ ID NO: 302018 - DNA, 20 bp, Artificial Sequence
  chemically synthesized
tcccgagtagctggaattac

SEQ ID NO: 302019 - DNA, 20 bp, Artificial Sequence
  chemically synthesized
ctcccgagtagctggaatta

SEQ ID NO: 302020 - DNA, 20 bp, Artificial Sequence
  chemically synthesized
tgcctgtaattccagctact

SEQ ID NO: 302021 - DNA, 20 bp, Artificial Sequence
  chemically synthesized
gcctgtaattccagctactc

SEQ ID NO: 302022 - DNA, 20 bp, Artificial Sequence
  chemically synthesized
gcctcaacctcccgagtagc

SEQ ID NO: 302023 - DNA, 20 bp, Artificial Sequence
  chemically synthesized
ctgtaattccagctactcgg

SEQ ID NO: 302024 - DNA, 20 bp, Artificial Sequence
  chemically synthesized
tgtaattccagctactcggg

SEQ ID NO: 302025 - DNA, 20 bp, Artificial Sequence
  chemically synthesized
ctctgcctcaacctcccgag

SEQ ID NO: 302026 - DNA, 20 bp, Artificial Sequence
  chemically synthesized
attctctgcctcaacctccc

SEQ ID NO: 302027 - DNA, 20 bp, Artificial Sequence
  chemically synthesized
ttccagctactcgggaggtt

SEQ ID NO: 302028 - DNA, 20 bp, Artificial Sequence
  chemically synthesized
tccagctactcgggaggttg

SEQ ID NO: 302029 - DNA, 20 bp, Artificial Sequence
  chemically synthesized
agctactcgggaggttgagg

SEQ ID NO: 302030 - DNA, 20 bp, Artificial Sequence
  chemically synthesized
ctactcgggaggttgaggca

SEQ ID NO: 302031 - DNA, 20 bp, Artificial Sequence
  chemically synthesized
ggcagagaattgcttgaaac

SEQ ID NO: 302032 - DNA, 20 bp, Artificial Sequence
  chemically synthesized
gcagagaattgcttgaaacc

SEQ ID NO: 302033 - DNA, 20 bp, Artificial Sequence
  chemically synthesized
aacctccgcctcctggtttc

SEQ ID NO: 302034 - DNA, 20 bp, Artificial Sequence
  chemically synthesized
agagaattgcttgaaaccag

SEQ ID NO: 302035 - DNA, 20 bp, Artificial Sequence
  chemically synthesized
gagaattgcttgaaaccagg

SEQ ID NO: 302036 - DNA, 20 bp, Artificial Sequence
  chemically synthesized
aattgcttgaaaccaggagg

SEQ ID NO: 302037 - DNA, 20 bp, Artificial Sequence
  chemically synthesized
ttgcttgaaaccaggaggcg

SEQ ID NO: 302038 - DNA, 20 bp, Artificial Sequence
  chemically synthesized
ttactgcaacctccgcctcc

SEQ ID NO: 302039 - DNA, 20 bp, Artificial Sequence
  chemically synthesized
tgcttgaaaccaggaggcgg

SEQ ID NO: 302040 - DNA, 20 bp, Artificial Sequence
  chemically synthesized
aaaccaggaggcggaggttg

SEQ ID NO: 302041 - DNA, 20 bp, Artificial Sequence
  chemically synthesized
caggaggcggaggttgcagt

SEQ ID NO: 302042 - DNA, 20 bp, Artificial Sequence
  chemically synthesized
ggcggaggttgcagtaagct

SEQ ID NO: 302043 - DNA, 20 bp, Artificial Sequence
  chemically synthesized
ggagtgcagtggcgggatct

SEQ ID NO: 302044 - DNA, 20 bp, Artificial Sequence
  chemically synthesized
ccaggctggagtgcagtggc

SEQ ID NO: 302045 - DNA, 20 bp, Artificial Sequence
  chemically synthesized
cccaggctggagtgcagtgg

SEQ ID NO: 302046 - DNA, 20 bp, Artificial Sequence
  chemically synthesized
tcacccaggctggagtgcag

SEQ ID NO: 302047 - DNA, 20 bp, Artificial Sequence
  chemically synthesized
gagatcccgccactgcactc

SEQ ID NO: 302048 - DNA, 20 bp, Artificial Sequence
  chemically synthesized
ctgtcacccaggctggagtg

SEQ ID NO: 302049 - DNA, 20 bp, Artificial Sequence
  chemically synthesized
cccgccactgcactccagcc

SEQ ID NO: 302050 - DNA, 20 bp, Artificial Sequence
  chemically synthesized
ccgccactgcactccagcct

SEQ ID NO: 302051 - DNA, 20 bp, Artificial Sequence
  chemically synthesized
ttgctctgtcacccaggctg

SEQ ID NO: 302052 - DNA, 20 bp, Artificial Sequence
  chemically synthesized
tcttgctctgtcacccaggc

SEQ ID NO: 302053 - DNA, 20 bp, Artificial Sequence
  chemically synthesized
ctgcactccagcctgggtga

SEQ ID NO: 302054 - DNA, 20 bp, Artificial Sequence
  chemically synthesized
agtgtcttgctctgtcaccc

SEQ ID NO: 302055 - DNA, 20 bp, Artificial Sequence
  chemically synthesized
gcactccagcctgggtgaca

SEQ ID NO: 302056 - DNA, 20 bp, Artificial Sequence
  chemically synthesized
cagtgtcttgctctgtcacc

SEQ ID NO: 302057 - DNA, 20 bp, Artificial Sequence
  chemically synthesized
tccagcctgggtgacagagc

SEQ ID NO: 302058 - DNA, 20 bp, Artificial Sequence
  chemically synthesized
tgacttcttttattttgaga

SEQ ID NO: 302059 - DNA, 20 bp, Artificial Sequence
  chemically synthesized
aagacactgtctcaaaataa

SEQ ID NO: 302060 - DNA, 20 bp, Artificial Sequence
  chemically synthesized
tttctgacttcttttatttt

SEQ ID NO: 302061 - DNA, 20 bp, Artificial Sequence
  chemically synthesized
acactgtctcaaaataaaag

SEQ ID NO: 302062 - DNA, 20 bp, Artificial Sequence
  chemically synthesized
tgtctcaaaataaaagaagt

SEQ ID NO: 302063 - DNA, 20 bp, Artificial Sequence
  chemically synthesized
tcaaaataaaagaagtcaga

SEQ ID NO: 302064 - DNA, 20 bp, Artificial Sequence
  chemically synthesized
caaaataaaagaagtcagaa

SEQ ID NO: 302065 - DNA, 20 bp, Artificial Sequence
  chemically synthesized
taaaagaagtcagaaaggca

SEQ ID NO: 302066 - DNA, 20 bp, Artificial Sequence
  chemically synthesized
aaagaagtcagaaaggcaaa

SEQ ID NO: 302067 - DNA, 20 bp, Artificial Sequence
  chemically synthesized
aagtcagaaaggcaaagaga

SEQ ID NO: 302068 - DNA, 20 bp, Artificial Sequence
  chemically synthesized
attcctatgggagtatcaca

SEQ ID NO: 302069 - DNA, 20 bp, Artificial Sequence
  chemically synthesized
ggatctgtgtgatactccca

SEQ ID NO: 302070 - DNA, 20 bp, Artificial Sequence
  chemically synthesized
gatctgtgtgatactcccat

SEQ ID NO: 302071 - DNA, 20 bp, Artificial Sequence
  chemically synthesized
cttctgccttattcctatgg

SEQ ID NO: 302072 - DNA, 20 bp, Artificial Sequence
  chemically synthesized
tccttctgccttattcctat

SEQ ID NO: 302073 - DNA, 20 bp, Artificial Sequence
  chemically synthesized
tgtgatactcccataggaat

SEQ ID NO: 302074 - DNA, 20 bp, Artificial Sequence
  chemically synthesized
ttccttctgccttattccta

SEQ ID NO: 302075 - DNA, 20 bp, Artificial Sequence
  chemically synthesized
gtgatactcccataggaata

SEQ ID NO: 302076 - DNA, 20 bp, Artificial Sequence
  chemically synthesized
atactcccataggaataagg

SEQ ID NO: 302077 - DNA, 20 bp, Artificial Sequence
  chemically synthesized
ctcccataggaataaggcag

SEQ ID NO: 302078 - DNA, 20 bp, Artificial Sequence
  chemically synthesized
tcccataggaataaggcaga

SEQ ID NO: 302079 - DNA, 20 bp, Artificial Sequence
  chemically synthesized
taaggcagaaggaataaaac

SEQ ID NO: 302080 - DNA, 20 bp, Artificial Sequence
  chemically synthesized
gcagaaggaataaaacaagt

SEQ ID NO: 302081 - DNA, 20 bp, Artificial Sequence
  chemically synthesized
cagaaggaataaaacaagtc

SEQ ID NO: 302082 - DNA, 20 bp, Artificial Sequence
  chemically synthesized
ggaataaaacaagtcaggta

SEQ ID NO: 302083 - DNA, 20 bp, Artificial Sequence
  chemically synthesized
aataaaacaagtcaggtaaa

SEQ ID NO: 302084 - DNA, 20 bp, Artificial Sequence
  chemically synthesized
acaagtcaggtaaagagtcg

SEQ ID NO: 302085 - DNA, 20 bp, Artificial Sequence
  chemically synthesized
caagtcaggtaaagagtcgt

SEQ ID NO: 302086 - DNA, 20 bp, Artificial Sequence
  chemically synthesized
aaagagtcgtgggtgacaac

SEQ ID NO: 302087 - DNA, 20 bp, Artificial Sequence
  chemically synthesized
gagtcgtgggtgacaactgg

SEQ ID NO: 302088 - DNA, 20 bp, Artificial Sequence
  chemically synthesized
cagcttctgtgacacactac

SEQ ID NO: 302089 - DNA, 20 bp, Artificial Sequence
  chemically synthesized
tgacaactggtagtgtgtca

SEQ ID NO: 302090 - DNA, 20 bp, Artificial Sequence
  chemically synthesized
caactggtagtgtgtcacag

SEQ ID NO: 302091 - DNA, 20 bp, Artificial Sequence
  chemically synthesized
tggtagtgtgtcacagaagc

SEQ ID NO: 302092 - DNA, 20 bp, Artificial Sequence
  chemically synthesized
tagtgtgtcacagaagctgg

SEQ ID NO: 302093 - DNA, 20 bp, Artificial Sequence
  chemically synthesized
gtgtgtcacagaagctggaa

SEQ ID NO: 302094 - DNA, 20 bp, Artificial Sequence
  chemically synthesized
tgtgtcacagaagctggaag

SEQ ID NO: 302095 - DNA, 20 bp, Artificial Sequence
  chemically synthesized
atttaaatgatgtcctcttc

SEQ ID NO: 302096 - DNA, 20 bp, Artificial Sequence
  chemically synthesized
ttaaataaaacactattcaa

SEQ ID NO: 302097 - DNA, 20 bp, Artificial Sequence
  chemically synthesized
ggtcttgaccatctgttgaa

SEQ ID NO: 302098 - DNA, 20 bp, Artificial Sequence
  chemically synthesized
ataaaacactattcaacaga

SEQ ID NO: 302099 - DNA, 20 bp, Artificial Sequence
  chemically synthesized
acactattcaacagatggtc

SEQ ID NO: 302100 - DNA, 20 bp, Artificial Sequence
  chemically synthesized
atggtcaagacctcaatatt

SEQ ID NO: 302101 - DNA, 20 bp, Artificial Sequence
  chemically synthesized
taatatttcactgaatattg

SEQ ID NO: 302102 - DNA, 20 bp, Artificial Sequence
  chemically synthesized
ctaatatttcactgaatatt

SEQ ID NO: 302103 - DNA, 20 bp, Artificial Sequence
  chemically synthesized
ctcaatattcagtgaaatat

SEQ ID NO: 302104 - DNA, 20 bp, Artificial Sequence
  chemically synthesized
aatattcagtgaaatattag

SEQ ID NO: 302105 - DNA, 20 bp, Artificial Sequence
  chemically synthesized
atattcagtgaaatattagt

SEQ ID NO: 302106 - DNA, 20 bp, Artificial Sequence
  chemically synthesized
agtgaaatattagtgggctt

SEQ ID NO: 302107 - DNA, 20 bp, Artificial Sequence
  chemically synthesized
ccccgtttttgtatcatctg

SEQ ID NO: 302108 - DNA, 20 bp, Artificial Sequence
  chemically synthesized
ggcttcagatgatacaaaaa

SEQ ID NO: 302109 - DNA, 20 bp, Artificial Sequence
  chemically synthesized
gcttcagatgatacaaaaac

SEQ ID NO: 302110 - DNA, 20 bp, Artificial Sequence
  chemically synthesized
cttcagatgatacaaaaacg

SEQ ID NO: 302111 - DNA, 20 bp, Artificial Sequence
  chemically synthesized
atgatacaaaaacggggcac

SEQ ID NO: 302112 - DNA, 20 bp, Artificial Sequence
  chemically synthesized
accataagctttatattagc

SEQ ID NO: 302113 - DNA, 20 bp, Artificial Sequence
  chemically synthesized
acggggcactagctaatata

SEQ ID NO: 302114 - DNA, 20 bp, Artificial Sequence
  chemically synthesized
tataaccataagctttatat

SEQ ID NO: 302115 - DNA, 20 bp, Artificial Sequence
  chemically synthesized
actagctaatataaagctta

SEQ ID NO: 302116 - DNA, 20 bp, Artificial Sequence
  chemically synthesized
catcatgcaaatataaccat

SEQ ID NO: 302117 - DNA, 20 bp, Artificial Sequence
  chemically synthesized
aagtattgtaatgattaaag

SEQ ID NO: 302118 - DNA, 20 bp, Artificial Sequence
  chemically synthesized
aaagtattgtaatgattaaa

SEQ ID NO: 302119 - DNA, 20 bp, Artificial Sequence
  chemically synthesized
ttaaagtattgtaatgatta

SEQ ID NO: 302120 - DNA, 20 bp, Artificial Sequence
  chemically synthesized
aatcattacaatactttaac

SEQ ID NO: 302121 - DNA, 20 bp, Artificial Sequence
  chemically synthesized
tacagggtggaatcttgtta

SEQ ID NO: 302122 - DNA, 20 bp, Artificial Sequence
  chemically synthesized
tttaacaagattccaccctg

SEQ ID NO: 302123 - DNA, 20 bp, Artificial Sequence
  chemically synthesized
attgataattgtctacaggg

SEQ ID NO: 302124 - DNA, 20 bp, Artificial Sequence
  chemically synthesized
ttaattgataattgtctaca

SEQ ID NO: 302125 - DNA, 20 bp, Artificial Sequence
  chemically synthesized
attaattgataattgtctac

SEQ ID NO: 302126 - DNA, 20 bp, Artificial Sequence
  chemically synthesized
cattaattgataattgtcta

SEQ ID NO: 302127 - DNA, 20 bp, Artificial Sequence
  chemically synthesized
tagcaaaaaggcaaacattt

SEQ ID NO: 302128 - DNA, 20 bp, Artificial Sequence
  chemically synthesized
atagcaaaaaggcaaacatt

SEQ ID NO: 302129 - DNA, 20 bp, Artificial Sequence
  chemically synthesized
actgaacgaagatagcaaaa

SEQ ID NO: 302130 - DNA, 20 bp, Artificial Sequence
  chemically synthesized
gactgaacgaagatagcaaa

SEQ ID NO: 302131 - DNA, 20 bp, Artificial Sequence
  chemically synthesized
aaatttagactgaacgaaga

SEQ ID NO: 302132 - DNA, 20 bp, Artificial Sequence
  chemically synthesized
gcctttttgctatcttcgtt

SEQ ID NO: 302133 - DNA, 20 bp, Artificial Sequence
  chemically synthesized
tgataaatttagactgaacg

SEQ ID NO: 302134 - DNA, 20 bp, Artificial Sequence
  chemically synthesized
cgacacttgattgataaatt

SEQ ID NO: 302135 - DNA, 20 bp, Artificial Sequence
  chemically synthesized
tcagtctaaatttatcaatc

SEQ ID NO: 302136 - DNA, 20 bp, Artificial Sequence
  chemically synthesized
tatcaatcaagtgtcgtata

SEQ ID NO: 302137 - DNA, 20 bp, Artificial Sequence
  chemically synthesized
agtgtcgtatatagcgtgtt

SEQ ID NO: 302138 - DNA, 20 bp, Artificial Sequence
  chemically synthesized
gataattttgccgtccaaat

SEQ ID NO: 302139 - DNA, 20 bp, Artificial Sequence
  chemically synthesized
caagtgtgtcctgatttgga

SEQ ID NO: 302140 - DNA, 20 bp, Artificial Sequence
  chemically synthesized
ataattttgccgtccaaatc

SEQ ID NO: 302141 - DNA, 20 bp, Artificial Sequence
  chemically synthesized
ctctcaagtgtgtcctgatt

SEQ ID NO: 302142 - DNA, 20 bp, Artificial Sequence
  chemically synthesized
gtccaaatcaggacacactt

SEQ ID NO: 302143 - DNA, 20 bp, Artificial Sequence
  chemically synthesized
ccaaatcaggacacacttga

SEQ ID NO: 302144 - DNA, 20 bp, Artificial Sequence
  chemically synthesized
tagcatcaactttcactctc

SEQ ID NO: 302145 - DNA, 20 bp, Artificial Sequence
  chemically synthesized
caggacacacttgagagtga

SEQ ID NO: 302146 - DNA, 20 bp, Artificial Sequence
  chemically synthesized
tgtcccagcataattatata

SEQ ID NO: 302147 - DNA, 20 bp, Artificial Sequence
  chemically synthesized
gatgctatatataattatgc

SEQ ID NO: 302148 - DNA, 20 bp, Artificial Sequence
  chemically synthesized
atgctatatataattatgct

SEQ ID NO: 302149 - DNA, 20 bp, Artificial Sequence
  chemically synthesized
atataattatgctgggacaa

SEQ ID NO: 302150 - DNA, 20 bp, Artificial Sequence
  chemically synthesized
tataattatgctgggacaac

SEQ ID NO: 302151 - DNA, 20 bp, Artificial Sequence
  chemically synthesized
cccagttacacctgttgtcc

SEQ ID NO: 302152 - DNA, 20 bp, Artificial Sequence
  chemically synthesized
gctgggacaacaggtgtaac

SEQ ID NO: 302153 - DNA, 20 bp, Artificial Sequence
  chemically synthesized
ctgggacaacaggtgtaact

SEQ ID NO: 302154 - DNA, 20 bp, Artificial Sequence
  chemically synthesized
gacaacaggtgtaactggga

SEQ ID NO: 302155 - DNA, 20 bp, Artificial Sequence
  chemically synthesized
tgatttacctgaagccatcc

SEQ ID NO: 302156 - DNA, 20 bp, Artificial Sequence
  chemically synthesized
aggtgtaactgggatggctt

SEQ ID NO: 302157 - DNA, 20 bp, Artificial Sequence
  chemically synthesized
ggtgtaactgggatggcttc

SEQ ID NO: 302158 - DNA, 20 bp, Artificial Sequence
  chemically synthesized
taatcctattgatttacctg

SEQ ID NO: 302159 - DNA, 20 bp, Artificial Sequence
  chemically synthesized
gatggcttcaggtaaatcaa

SEQ ID NO: 302160 - DNA, 20 bp, Artificial Sequence
  chemically synthesized
atggcttcaggtaaatcaat

SEQ ID NO: 302161 - DNA, 20 bp, Artificial Sequence
  chemically synthesized
gtaaatcaataggattacct

SEQ ID NO: 302162 - DNA, 20 bp, Artificial Sequence
  chemically synthesized
ttttcatagatatatgacta

SEQ ID NO: 302163 - DNA, 20 bp, Artificial Sequence
  chemically synthesized
tttttcatagatatatgact

SEQ ID NO: 302164 - DNA, 20 bp, Artificial Sequence
  chemically synthesized
ttagtcatatatctatgaaa

SEQ ID NO: 302165 - DNA, 20 bp, Artificial Sequence
  chemically synthesized
atagtaaaatgtctttttca

SEQ ID NO: 302166 - DNA, 20 bp, Artificial Sequence
  chemically synthesized
gaaaaagacattttactata

SEQ ID NO: 302167 - DNA, 20 bp, Artificial Sequence
  chemically synthesized
agacattttactatacagcc

SEQ ID NO: 302168 - DNA, 20 bp, Artificial Sequence
  chemically synthesized
gctacaaaacctgggctgta

SEQ ID NO: 302169 - DNA, 20 bp, Artificial Sequence
  chemically synthesized
gacattttactatacagccc

SEQ ID NO: 302170 - DNA, 20 bp, Artificial Sequence
  chemically synthesized
ctgaggtagctacaaaacct

SEQ ID NO: 302171 - DNA, 20 bp, Artificial Sequence
  chemically synthesized
actatacagcccaggttttg

SEQ ID NO: 302172 - DNA, 20 bp, Artificial Sequence
  chemically synthesized
actgaggtagctacaaaacc

SEQ ID NO: 302173 - DNA, 20 bp, Artificial Sequence
  chemically synthesized
cccaggttttgtagctacct

SEQ ID NO: 302174 - DNA, 20 bp, Artificial Sequence
  chemically synthesized
agacaggatttgaactgagg

SEQ ID NO: 302175 - DNA, 20 bp, Artificial Sequence
  chemically synthesized
ctcagacaggatttgaactg

SEQ ID NO: 302176 - DNA, 20 bp, Artificial Sequence
  chemically synthesized
cctcagacaggatttgaact

SEQ ID NO: 302177 - DNA, 20 bp, Artificial Sequence
  chemically synthesized
cctcagttcaaatcctgtct

SEQ ID NO: 302178 - DNA, 20 bp, Artificial Sequence
  chemically synthesized
ctcagttcaaatcctgtctg

SEQ ID NO: 302179 - DNA, 20 bp, Artificial Sequence
  chemically synthesized
agctacagtgtacctcagac

SEQ ID NO: 302180 - DNA, 20 bp, Artificial Sequence
  chemically synthesized
cagctacagtgtacctcaga

SEQ ID NO: 302181 - DNA, 20 bp, Artificial Sequence
  chemically synthesized
tacacagctacagtgtacct

SEQ ID NO: 302182 - DNA, 20 bp, Artificial Sequence
  chemically synthesized
atcctgtctgaggtacactg

SEQ ID NO: 302183 - DNA, 20 bp, Artificial Sequence
  chemically synthesized
tataaaattatacacagcta

SEQ ID NO: 302184 - DNA, 20 bp, Artificial Sequence
  chemically synthesized
ttactttataaaattataca

SEQ ID NO: 302185 - DNA, 20 bp, Artificial Sequence
  chemically synthesized
tagctgtgtataattttata

SEQ ID NO: 302186 - DNA, 20 bp, Artificial Sequence
  chemically synthesized
ataattttataaagtaatta

SEQ ID NO: 302187 - DNA, 20 bp, Artificial Sequence
  chemically synthesized
gtaacctcccaaaataggta

SEQ ID NO: 302188 - DNA, 20 bp, Artificial Sequence
  chemically synthesized
aattatagccatacctattt

SEQ ID NO: 302189 - DNA, 20 bp, Artificial Sequence
  chemically synthesized
attatagccatacctatttt

SEQ ID NO: 302190 - DNA, 20 bp, Artificial Sequence
  chemically synthesized
tatagccatacctattttgg

SEQ ID NO: 302191 - DNA, 20 bp, Artificial Sequence
  chemically synthesized
tcccagtaacctcccaaaat

SEQ ID NO: 302192 - DNA, 20 bp, Artificial Sequence
  chemically synthesized
atagccatacctattttggg

SEQ ID NO: 302193 - DNA, 20 bp, Artificial Sequence
  chemically synthesized
ttcccagtaacctcccaaaa

SEQ ID NO: 302194 - DNA, 20 bp, Artificial Sequence
  chemically synthesized
tacctattttgggaggttac

SEQ ID NO: 302195 - DNA, 20 bp, Artificial Sequence
  chemically synthesized
acctattttgggaggttact

SEQ ID NO: 302196 - DNA, 20 bp, Artificial Sequence
  chemically synthesized
ggcatcgcatgtatttttcc

SEQ ID NO: 302197 - DNA, 20 bp, Artificial Sequence
  chemically synthesized
aaatacatgcgatgccaata

SEQ ID NO: 302198 - DNA, 20 bp, Artificial Sequence
  chemically synthesized
tagtagattcagtgctttat

SEQ ID NO: 302199 - DNA, 20 bp, Artificial Sequence
  chemically synthesized
tatgtgctcagtagtagatt

SEQ ID NO: 302200 - DNA, 20 bp, Artificial Sequence
  chemically synthesized
aaagcactgaatctactact

SEQ ID NO: 302201 - DNA, 20 bp, Artificial Sequence
  chemically synthesized
atttattatgtgctcagtag

SEQ ID NO: 302202 - DNA, 20 bp, Artificial Sequence
  chemically synthesized
aggatttattatgtgctcag

SEQ ID NO: 302203 - DNA, 20 bp, Artificial Sequence
  chemically synthesized
ttgaggatttattatgtgct

SEQ ID NO: 302204 - DNA, 20 bp, Artificial Sequence
  chemically synthesized
ataaaagctaacataaattg

SEQ ID NO: 302205 - DNA, 20 bp, Artificial Sequence
  chemically synthesized
aataaaagctaacataaatt

SEQ ID NO: 302206 - DNA, 20 bp, Artificial Sequence
  chemically synthesized
aataaatcctcaatttatgt

SEQ ID NO: 302207 - DNA, 20 bp, Artificial Sequence
  chemically synthesized
tttatgttagcttttatttg

SEQ ID NO: 302208 - DNA, 20 bp, Artificial Sequence
  chemically synthesized
cagaaagattcttcaaataa

SEQ ID NO: 302209 - DNA, 20 bp, Artificial Sequence
  chemically synthesized
tcccattgggcacatacaga

SEQ ID NO: 302210 - DNA, 20 bp, Artificial Sequence
  chemically synthesized
gaagtcccattgggcacata

SEQ ID NO: 302211 - DNA, 20 bp, Artificial Sequence
  chemically synthesized
atctttctgtatgtgcccaa

SEQ ID NO: 302212 - DNA, 20 bp, Artificial Sequence
  chemically synthesized
tctttctgtatgtgcccaat

SEQ ID NO: 302213 - DNA, 20 bp, Artificial Sequence
  chemically synthesized
cctaaatgagaagtcccatt

SEQ ID NO: 302214 - DNA, 20 bp, Artificial Sequence
  chemically synthesized
gcctaaatgagaagtcccat

SEQ ID NO: 302215 - DNA, 20 bp, Artificial Sequence
  chemically synthesized
gcccaatgggacttctcatt

SEQ ID NO: 302216 - DNA, 20 bp, Artificial Sequence
  chemically synthesized
cccaatgggacttctcattt

SEQ ID NO: 302217 - DNA, 20 bp, Artificial Sequence
  chemically synthesized
tttgtatgtgcctaaatgag

SEQ ID NO: 302218 - DNA, 20 bp, Artificial Sequence
  chemically synthesized
atttttgtatgtgcctaaat

SEQ ID NO: 302219 - DNA, 20 bp, Artificial Sequence
  chemically synthesized
ttgtttgtatcataagtttt

SEQ ID NO: 302220 - DNA, 20 bp, Artificial Sequence
  chemically synthesized
ccaaaatttgtttgtatcat

SEQ ID NO: 302221 - DNA, 20 bp, Artificial Sequence
  chemically synthesized
cttatgatacaaacaaattt

SEQ ID NO: 302222 - DNA, 20 bp, Artificial Sequence
  chemically synthesized
tatgatacaaacaaattttg

SEQ ID NO: 302223 - DNA, 20 bp, Artificial Sequence
  chemically synthesized
tgatacaaacaaattttgga

SEQ ID NO: 302224 - DNA, 20 bp, Artificial Sequence
  chemically synthesized
tacaaacaaattttggagag

SEQ ID NO: 302225 - DNA, 20 bp, Artificial Sequence
  chemically synthesized
acaaacaaattttggagaga

SEQ ID NO: 302226 - DNA, 20 bp, Artificial Sequence
  chemically synthesized
gagagaaggtatttcaccac

SEQ ID NO: 302227 - DNA, 20 bp, Artificial Sequence
  chemically synthesized
tttcaggaaagagtggctag

SEQ ID NO: 302228 - DNA, 20 bp, Artificial Sequence
  chemically synthesized
tgttttcaggaaagagtggc

SEQ ID NO: 302229 - DNA, 20 bp, Artificial Sequence
  chemically synthesized
tttttgttttcaggaaagag

SEQ ID NO: 302230 - DNA, 20 bp, Artificial Sequence
  chemically synthesized
ttctttttgttttcaggaaa

SEQ ID NO: 302231 - DNA, 20 bp, Artificial Sequence
  chemically synthesized
acttctttttgttttcagga

SEQ ID NO: 302232 - DNA, 20 bp, Artificial Sequence
  chemically synthesized
tctgacttctttttgttttc

SEQ ID NO: 302233 - DNA, 20 bp, Artificial Sequence
  chemically synthesized
ttctgacttctttttgtttt

SEQ ID NO: 302234 - DNA, 20 bp, Artificial Sequence
  chemically synthesized
cactctttcctgaaaacaaa

SEQ ID NO: 302235 - DNA, 20 bp, Artificial Sequence
  chemically synthesized
tctttcctgaaaacaaaaag

SEQ ID NO: 302236 - DNA, 20 bp, Artificial Sequence
  chemically synthesized
tcctgaaaacaaaaagaagt

SEQ ID NO: 302237 - DNA, 20 bp, Artificial Sequence
  chemically synthesized
ttgtgttggaaaaaaaaaaa

SEQ ID NO: 302238 - DNA, 20 bp, Artificial Sequence
  chemically synthesized
gtttggagaatggattgtgt

SEQ ID NO: 302239 - DNA, 20 bp, Artificial Sequence
  chemically synthesized
attggctcctgtttggagaa

SEQ ID NO: 302240 - DNA, 20 bp, Artificial Sequence
  chemically synthesized
aacacaatccattctccaaa

SEQ ID NO: 302241 - DNA, 20 bp, Artificial Sequence
  chemically synthesized
acacaatccattctccaaac

SEQ ID NO: 302242 - DNA, 20 bp, Artificial Sequence
  chemically synthesized
acaatccattctccaaacag

SEQ ID NO: 302243 - DNA, 20 bp, Artificial Sequence
  chemically synthesized
ttattattggctcctgtttg

SEQ ID NO: 302244 - DNA, 20 bp, Artificial Sequence
  chemically synthesized
gcttattattggctcctgtt

SEQ ID NO: 302245 - DNA, 20 bp, Artificial Sequence
  chemically synthesized
tccaaacaggagccaataat

SEQ ID NO: 302246 - DNA, 20 bp, Artificial Sequence
  chemically synthesized
tgtcttcaaaagcttattat

SEQ ID NO: 302247 - DNA, 20 bp, Artificial Sequence
  chemically synthesized
gagccaataataagcttttg

SEQ ID NO: 302248 - DNA, 20 bp, Artificial Sequence
  chemically synthesized
caataataagcttttgaaga

SEQ ID NO: 302249 - DNA, 20 bp, Artificial Sequence
  chemically synthesized
atgtcaatctctgtcttcaa

SEQ ID NO: 302250 - DNA, 20 bp, Artificial Sequence
  chemically synthesized
ataataagcttttgaagaca

SEQ ID NO: 302251 - DNA, 20 bp, Artificial Sequence
  chemically synthesized
agacagagattgacatgaat

SEQ ID NO: 302252 - DNA, 20 bp, Artificial Sequence
  chemically synthesized
aatacagaaattaacagagc

SEQ ID NO: 302253 - DNA, 20 bp, Artificial Sequence
  chemically synthesized
gcctaatacagaaattaaca

SEQ ID NO: 302254 - DNA, 20 bp, Artificial Sequence
  chemically synthesized
ttgcctaatacagaaattaa

SEQ ID NO: 302255 - DNA, 20 bp, Artificial Sequence
  chemically synthesized
tgctctgttaatttctgtat

SEQ ID NO: 302256 - DNA, 20 bp, Artificial Sequence
  chemically synthesized
gctctgttaatttctgtatt

SEQ ID NO: 302257 - DNA, 20 bp, Artificial Sequence
  chemically synthesized
tcttcaggacttgcctaata

SEQ ID NO: 302258 - DNA, 20 bp, Artificial Sequence
  chemically synthesized
tgttaatttctgtattaggc

SEQ ID NO: 302259 - DNA, 20 bp, Artificial Sequence
  chemically synthesized
tctgtattaggcaagtcctg

SEQ ID NO: 302260 - DNA, 20 bp, Artificial Sequence
  chemically synthesized
ctaacacttttaatgtcttc

SEQ ID NO: 302261 - DNA, 20 bp, Artificial Sequence
  chemically synthesized
cctaacacttttaatgtctt

SEQ ID NO: 302262 - DNA, 20 bp, Artificial Sequence
  chemically synthesized
gcaagtcctgaagacattaa

SEQ ID NO: 302263 - DNA, 20 bp, Artificial Sequence
  chemically synthesized
cctgaagacattaaaagtgt

SEQ ID NO: 302264 - DNA, 20 bp, Artificial Sequence
  chemically synthesized
ctgaagacattaaaagtgtt

SEQ ID NO: 302265 - DNA, 20 bp, Artificial Sequence
  chemically synthesized
cattaaaagtgttaggcaac

SEQ ID NO: 302266 - DNA, 20 bp, Artificial Sequence
  chemically synthesized
attaaaagtgttaggcaact

SEQ ID NO: 302267 - DNA, 20 bp, Artificial Sequence
  chemically synthesized
aacagagtaatagggacacc

SEQ ID NO: 302268 - DNA, 20 bp, Artificial Sequence
  chemically synthesized
gttctccaaacagagtaata

SEQ ID NO: 302269 - DNA, 20 bp, Artificial Sequence
  chemically synthesized
agttctccaaacagagtaat

SEQ ID NO: 302270 - DNA, 20 bp, Artificial Sequence
  chemically synthesized
cagttctccaaacagagtaa

SEQ ID NO: 302271 - DNA, 20 bp, Artificial Sequence
  chemically synthesized
ggtgtccctattactctgtt

SEQ ID NO: 302272 - DNA, 20 bp, Artificial Sequence
  chemically synthesized
tgtccctattactctgtttg

SEQ ID NO: 302273 - DNA, 20 bp, Artificial Sequence
  chemically synthesized
ctccaacagttctccaaaca

SEQ ID NO: 302274 - DNA, 20 bp, Artificial Sequence
  chemically synthesized
ccctccaacagttctccaaa

SEQ ID NO: 302275 - DNA, 20 bp, Artificial Sequence
  chemically synthesized
tactctgtttggagaactgt

SEQ ID NO: 302276 - DNA, 20 bp, Artificial Sequence
  chemically synthesized
ctctgtttggagaactgttg

SEQ ID NO: 302277 - DNA, 20 bp, Artificial Sequence
  chemically synthesized
tctgtttggagaactgttgg

SEQ ID NO: 302278 - DNA, 20 bp, Artificial Sequence
  chemically synthesized
ctgtttggagaactgttgga

SEQ ID NO: 302279 - DNA, 20 bp, Artificial Sequence
  chemically synthesized
acattccaacaaccctccaa

SEQ ID NO: 302280 - DNA, 20 bp, Artificial Sequence
  chemically synthesized
gagaactgttggagggttgt

SEQ ID NO: 302281 - DNA, 20 bp, Artificial Sequence
  chemically synthesized
agggttgttggaatgttgca

SEQ ID NO: 302282 - DNA, 20 bp, Artificial Sequence
  chemically synthesized
ttagtggacatacagattta

SEQ ID NO: 302283 - DNA, 20 bp, Artificial Sequence
  chemically synthesized
gacaacgcttagtggacata

SEQ ID NO: 302284 - DNA, 20 bp, Artificial Sequence
  chemically synthesized
cataaatctgtatgtccact

SEQ ID NO: 302285 - DNA, 20 bp, Artificial Sequence
  chemically synthesized
tgtttatagacaacgcttag

SEQ ID NO: 302286 - DNA, 20 bp, Artificial Sequence
  chemically synthesized
atgtgtttatagacaacgct

SEQ ID NO: 302287 - DNA, 20 bp, Artificial Sequence
  chemically synthesized
tcacattaaacatgtgttta

SEQ ID NO: 302288 - DNA, 20 bp, Artificial Sequence
  chemically synthesized
tgtttaatgtgacaacaaac

SEQ ID NO: 302289 - DNA, 20 bp, Artificial Sequence
  chemically synthesized
caagttaatgtacatcttac

SEQ ID NO: 302290 - DNA, 20 bp, Artificial Sequence
  chemically synthesized
aagttaatgtacatcttact

SEQ ID NO: 302291 - DNA, 20 bp, Artificial Sequence
  chemically synthesized
tttcttttattattcctagt

SEQ ID NO: 302292 - DNA, 20 bp, Artificial Sequence
  chemically synthesized
tgaatttcttttattattcc

SEQ ID NO: 302293 - DNA, 20 bp, Artificial Sequence
  chemically synthesized
catcttactaggaataataa

SEQ ID NO: 302294 - DNA, 20 bp, Artificial Sequence
  chemically synthesized
taataaaagaaattcatcaa

SEQ ID NO: 302295 - DNA, 20 bp, Artificial Sequence
  chemically synthesized
gaaattcatcaaaagcttca

SEQ ID NO: 302296 - DNA, 20 bp, Artificial Sequence
  chemically synthesized
cataatggcacaaatccgtg

SEQ ID NO: 302297 - DNA, 20 bp, Artificial Sequence
  chemically synthesized
tgatggagtgaaaagcataa

SEQ ID NO: 302298 - DNA, 20 bp, Artificial Sequence
  chemically synthesized
acaaaaattgatggagtgaa

SEQ ID NO: 302299 - DNA, 20 bp, Artificial Sequence
  chemically synthesized
aaatctaacaaaaattgatg

SEQ ID NO: 302300 - DNA, 20 bp, Artificial Sequence
  chemically synthesized
gaaaatctaacaaaaattga

SEQ ID NO: 302301 - DNA, 20 bp, Artificial Sequence
  chemically synthesized
ttcactccatcaatttttgt

SEQ ID NO: 302302 - DNA, 20 bp, Artificial Sequence
  chemically synthesized
cactctactcacgatggtaa

SEQ ID NO: 302303 - DNA, 20 bp, Artificial Sequence
  chemically synthesized
agattttctattaccatcgt

SEQ ID NO: 302304 - DNA, 20 bp, Artificial Sequence
  chemically synthesized
ttttctattaccatcgtgag

SEQ ID NO: 302305 - DNA, 20 bp, Artificial Sequence
  chemically synthesized
tccaagcactctactcacga

SEQ ID NO: 302306 - DNA, 20 bp, Artificial Sequence
  chemically synthesized
ttctattaccatcgtgagta

SEQ ID NO: 302307 - DNA, 20 bp, Artificial Sequence
  chemically synthesized
accatcgtgagtagagtgct

SEQ ID NO: 302308 - DNA, 20 bp, Artificial Sequence
  chemically synthesized
atcgtgagtagagtgcttgg

SEQ ID NO: 302309 - DNA, 20 bp, Artificial Sequence
  chemically synthesized
aacaactttcaggaacttcc

SEQ ID NO: 302310 - DNA, 20 bp, Artificial Sequence
  chemically synthesized
gagtgcttggaagttcctga

SEQ ID NO: 302311 - DNA, 20 bp, Artificial Sequence
  chemically synthesized
tttttgtggcaacaactttc

SEQ ID NO: 302312 - DNA, 20 bp, Artificial Sequence
  chemically synthesized
ctttttgtggcaacaacttt

SEQ ID NO: 302313 - DNA, 20 bp, Artificial Sequence
  chemically synthesized
ctgaaagttgttgccacaaa

SEQ ID NO: 302314 - DNA, 20 bp, Artificial Sequence
  chemically synthesized
gaatattagcattctttttg

SEQ ID NO: 302315 - DNA, 20 bp, Artificial Sequence
  chemically synthesized
aaaaagaatgctaatattca

SEQ ID NO: 302316 - DNA, 20 bp, Artificial Sequence
  chemically synthesized
ctctcaaactctatgaatat

SEQ ID NO: 302317 - DNA, 20 bp, Artificial Sequence
  chemically synthesized
aaagaatgctaatattcata

SEQ ID NO: 302318 - DNA, 20 bp, Artificial Sequence
  chemically synthesized
tgctaatattcatagagttt

SEQ ID NO: 302319 - DNA, 20 bp, Artificial Sequence
  chemically synthesized
ctaatattcatagagtttga

SEQ ID NO: 302320 - DNA, 20 bp, Artificial Sequence
  chemically synthesized
gagtttgagagccatttgac

SEQ ID NO: 302321 - DNA, 20 bp, Artificial Sequence
  chemically synthesized
cgacccttgctccagtcaaa

SEQ ID NO: 302322 - DNA, 20 bp, Artificial Sequence
  chemically synthesized
gtttgagagccatttgactg

SEQ ID NO: 302323 - DNA, 20 bp, Artificial Sequence
  chemically synthesized
gagagccatttgactggagc

SEQ ID NO: 302324 - DNA, 20 bp, Artificial Sequence
  chemically synthesized
agagccatttgactggagca

SEQ ID NO: 302325 - DNA, 20 bp, Artificial Sequence
  chemically synthesized
gagccatttgactggagcaa

SEQ ID NO: 302326 - DNA, 20 bp, Artificial Sequence
  chemically synthesized
aagtttggcgacccttgctc

SEQ ID NO: 302327 - DNA, 20 bp, Artificial Sequence
  chemically synthesized
atcctatcacagaaaaagtt

SEQ ID NO: 302328 - DNA, 20 bp, Artificial Sequence
  chemically synthesized
tacctatcctatcacagaaa

SEQ ID NO: 302329 - DNA, 20 bp, Artificial Sequence
  chemically synthesized
tcgccaaactttttctgtga

SEQ ID NO: 302330 - DNA, 20 bp, Artificial Sequence
  chemically synthesized
cgccaaactttttctgtgat

SEQ ID NO: 302331 - DNA, 20 bp, Artificial Sequence
  chemically synthesized
atttattacctatcctatca

SEQ ID NO: 302332 - DNA, 20 bp, Artificial Sequence
  chemically synthesized
aaactttttctgtgatagga

SEQ ID NO: 302333 - DNA, 20 bp, Artificial Sequence
  chemically synthesized
aactttttctgtgataggat

SEQ ID NO: 302334 - DNA, 20 bp, Artificial Sequence
  chemically synthesized
aggataggtaataaatattt

SEQ ID NO: 302335 - DNA, 20 bp, Artificial Sequence
  chemically synthesized
ggataggtaataaatatttt

SEQ ID NO: 302336 - DNA, 20 bp, Artificial Sequence
  chemically synthesized
aataaatattttaggctttg

SEQ ID NO: 302337 - DNA, 20 bp, Artificial Sequence
  chemically synthesized
cacaaactgtatagtccaca

SEQ ID NO: 302338 - DNA, 20 bp, Artificial Sequence
  chemically synthesized
tttaggctttgtggactata

SEQ ID NO: 302339 - DNA, 20 bp, Artificial Sequence
  chemically synthesized
tagttgtaacacaaactgta

SEQ ID NO: 302340 - DNA, 20 bp, Artificial Sequence
  chemically synthesized
ttacaacggcagagtttgaa

SEQ ID NO: 302341 - DNA, 20 bp, Artificial Sequence
  chemically synthesized
actttcgcattacaacggca

SEQ ID NO: 302342 - DNA, 20 bp, Artificial Sequence
  chemically synthesized
ttactttcgcattacaacgg

SEQ ID NO: 302343 - DNA, 20 bp, Artificial Sequence
  chemically synthesized
tgattactttcgcattacaa

SEQ ID NO: 302344 - DNA, 20 bp, Artificial Sequence
  chemically synthesized
actctgccgttgtaatgcga

SEQ ID NO: 302345 - DNA, 20 bp, Artificial Sequence
  chemically synthesized
tgtaatgcgaaagtaatcat

SEQ ID NO: 302346 - DNA, 20 bp, Artificial Sequence
  chemically synthesized
atcataagtgataaataaat

SEQ ID NO: 302347 - DNA, 20 bp, Artificial Sequence
  chemically synthesized
aagtgataaataaatgagtt

SEQ ID NO: 302348 - DNA, 20 bp, Artificial Sequence
  chemically synthesized
aataatgttttagtggaaca

SEQ ID NO: 302349 - DNA, 20 bp, Artificial Sequence
  chemically synthesized
tgttataaataatgttttag

SEQ ID NO: 302350 - DNA, 20 bp, Artificial Sequence
  chemically synthesized
cagtgttataaataatgttt

SEQ ID NO: 302351 - DNA, 20 bp, Artificial Sequence
  chemically synthesized
attacataaaattcaaattt

SEQ ID NO: 302352 - DNA, 20 bp, Artificial Sequence
  chemically synthesized
aaatggttgaaaataatcaa

SEQ ID NO: 302353 - DNA, 20 bp, Artificial Sequence
  chemically synthesized
agtgtttttacgttttcaaa

SEQ ID NO: 302354 - DNA, 20 bp, Artificial Sequence
  chemically synthesized
gaaaacgtaaaaacacttct

SEQ ID NO: 302355 - DNA, 20 bp, Artificial Sequence
  chemically synthesized
ggtatggctcatcagccaag

SEQ ID NO: 302356 - DNA, 20 bp, Artificial Sequence
  chemically synthesized
aaaaacacttcttggctgat

SEQ ID NO: 302357 - DNA, 20 bp, Artificial Sequence
  chemically synthesized
tttggtatggctcatcagcc

SEQ ID NO: 302358 - DNA, 20 bp, Artificial Sequence
  chemically synthesized
gccagtttggtatggctcat

SEQ ID NO: 302359 - DNA, 20 bp, Artificial Sequence
  chemically synthesized
agcatgctgccagtttggta

SEQ ID NO: 302360 - DNA, 20 bp, Artificial Sequence
  chemically synthesized
gctgatgagccataccaaac

SEQ ID NO: 302361 - DNA, 20 bp, Artificial Sequence
  chemically synthesized
gatgagccataccaaactgg

SEQ ID NO: 302362 - DNA, 20 bp, Artificial Sequence
  chemically synthesized
aatttagcatgctgccagtt

SEQ ID NO: 302363 - DNA, 20 bp, Artificial Sequence
  chemically synthesized
aaccaaatttagcatgctgc

SEQ ID NO: 302364 - DNA, 20 bp, Artificial Sequence
  chemically synthesized
aactggcagcatgctaaatt

SEQ ID NO: 302365 - DNA, 20 bp, Artificial Sequence
  chemically synthesized
taagacctgctaaccaaatt

SEQ ID NO: 302366 - DNA, 20 bp, Artificial Sequence
  chemically synthesized
ggcagcatgctaaatttggt

SEQ ID NO: 302367 - DNA, 20 bp, Artificial Sequence
  chemically synthesized
agcatgctaaatttggttag

SEQ ID NO: 302368 - DNA, 20 bp, Artificial Sequence
  chemically synthesized
gcatgctaaatttggttagc

SEQ ID NO: 302369 - DNA, 20 bp, Artificial Sequence
  chemically synthesized
taaatttggttagcaggtct

SEQ ID NO: 302370 - DNA, 20 bp, Artificial Sequence
  chemically synthesized
ttggttagcaggtcttagtt

SEQ ID NO: 302371 - DNA, 20 bp, Artificial Sequence
  chemically synthesized
agtccaggggtcaccaaact

SEQ ID NO: 302372 - DNA, 20 bp, Artificial Sequence
  chemically synthesized
ggtcttagtttggtgacccc

SEQ ID NO: 302373 - DNA, 20 bp, Artificial Sequence
  chemically synthesized
tagtttggtgacccctggac

SEQ ID NO: 302374 - DNA, 20 bp, Artificial Sequence
  chemically synthesized
aagcaaatccactagtccag

SEQ ID NO: 302375 - DNA, 20 bp, Artificial Sequence
  chemically synthesized
taagcaaatccactagtcca

SEQ ID NO: 302376 - DNA, 20 bp, Artificial Sequence
  chemically synthesized
tttggtgacccctggactag

SEQ ID NO: 302377 - DNA, 20 bp, Artificial Sequence
  chemically synthesized
ctaagcaaatccactagtcc

SEQ ID NO: 302378 - DNA, 20 bp, Artificial Sequence
  chemically synthesized
gctaagcaaatccactagtc

SEQ ID NO: 302379 - DNA, 20 bp, Artificial Sequence
  chemically synthesized
gcttggctaagcaaatccac

SEQ ID NO: 302380 - DNA, 20 bp, Artificial Sequence
  chemically synthesized
cctggactagtggatttgct

SEQ ID NO: 302381 - DNA, 20 bp, Artificial Sequence
  chemically synthesized
actagtggatttgcttagcc

SEQ ID NO: 302382 - DNA, 20 bp, Artificial Sequence
  chemically synthesized
ctggttgtgtcagcttggct

SEQ ID NO: 302383 - DNA, 20 bp, Artificial Sequence
  chemically synthesized
tctccctggttgtgtcagct

SEQ ID NO: 302384 - DNA, 20 bp, Artificial Sequence
  chemically synthesized
cttagccaagctgacacaac

SEQ ID NO: 302385 - DNA, 20 bp, Artificial Sequence
  chemically synthesized
ccttttctccctggttgtgt

SEQ ID NO: 302386 - DNA, 20 bp, Artificial Sequence
  chemically synthesized
ttagccaagctgacacaacc

SEQ ID NO: 302387 - DNA, 20 bp, Artificial Sequence
  chemically synthesized
tagccaagctgacacaacca

SEQ ID NO: 302388 - DNA, 20 bp, Artificial Sequence
  chemically synthesized
gccaagctgacacaaccagg

SEQ ID NO: 302389 - DNA, 20 bp, Artificial Sequence
  chemically synthesized
gctgacacaaccagggagaa

SEQ ID NO: 302390 - DNA, 20 bp, Artificial Sequence
  chemically synthesized
atcactgggccttttctccc

SEQ ID NO: 302391 - DNA, 20 bp, Artificial Sequence
  chemically synthesized
ctgacacaaccagggagaaa

SEQ ID NO: 302392 - DNA, 20 bp, Artificial Sequence
  chemically synthesized
acaaccagggagaaaaggcc

SEQ ID NO: 302393 - DNA, 20 bp, Artificial Sequence
  chemically synthesized
taattccaaagtaaatcact

SEQ ID NO: 302394 - DNA, 20 bp, Artificial Sequence
  chemically synthesized
ataattccaaagtaaatcac

SEQ ID NO: 302395 - DNA, 20 bp, Artificial Sequence
  chemically synthesized
aaaggcccagtgatttactt

SEQ ID NO: 302396 - DNA, 20 bp, Artificial Sequence
  chemically synthesized
gacctactttgataattcca

SEQ ID NO: 302397 - DNA, 20 bp, Artificial Sequence
  chemically synthesized
gatttactttggaattatca

SEQ ID NO: 302398 - DNA, 20 bp, Artificial Sequence
  chemically synthesized
ttactttggaattatcaaag

SEQ ID NO: 302399 - DNA, 20 bp, Artificial Sequence
  chemically synthesized
tactttggaattatcaaagt

SEQ ID NO: 302400 - DNA, 20 bp, Artificial Sequence
  chemically synthesized
gaattatcaaagtaggtcat

SEQ ID NO: 302401 - DNA, 20 bp, Artificial Sequence
  chemically synthesized
caaagtaggtcataagtcat

SEQ ID NO: 302402 - DNA, 20 bp, Artificial Sequence
  chemically synthesized
ggtcataagtcattagttaa

SEQ ID NO: 302403 - DNA, 20 bp, Artificial Sequence
  chemically synthesized
tcataagtcattagttaata

SEQ ID NO: 302404 - DNA, 20 bp, Artificial Sequence
  chemically synthesized
taagtcattagttaatagag

SEQ ID NO: 302405 - DNA, 20 bp, Artificial Sequence
  chemically synthesized
aatatattatttgggatgtt

SEQ ID NO: 302406 - DNA, 20 bp, Artificial Sequence
  chemically synthesized
gttattcaaatatattattt

SEQ ID NO: 302407 - DNA, 20 bp, Artificial Sequence
  chemically synthesized
agttattcaaatatattatt

SEQ ID NO: 302408 - DNA, 20 bp, Artificial Sequence
  chemically synthesized
atatatttgaataacttctc

SEQ ID NO: 302409 - DNA, 20 bp, Artificial Sequence
  chemically synthesized
gaaaaaaaataaatctagag

SEQ ID NO: 302410 - DNA, 20 bp, Artificial Sequence
  chemically synthesized
taagaaaaaaaataaatcta

SEQ ID NO: 302411 - DNA, 20 bp, Artificial Sequence
  chemically synthesized
tctaagaaaaaaaataaatc

SEQ ID NO: 302412 - DNA, 20 bp, Artificial Sequence
  chemically synthesized
tctagatttattttttttct

SEQ ID NO: 302413 - DNA, 20 bp, Artificial Sequence
  chemically synthesized
aataccatgtcagatgttct

SEQ ID NO: 302414 - DNA, 20 bp, Artificial Sequence
  chemically synthesized
ttttcttagaacatctgaca

SEQ ID NO: 302415 - DNA, 20 bp, Artificial Sequence
  chemically synthesized
cacatctaaaaataccatgt

SEQ ID NO: 302416 - DNA, 20 bp, Artificial Sequence
  chemically synthesized
aacatctgacatggtatttt

SEQ ID NO: 302417 - DNA, 20 bp, Artificial Sequence
  chemically synthesized
ccagggtagagaagtttgaa

SEQ ID NO: 302418 - DNA, 20 bp, Artificial Sequence
  chemically synthesized
ttgtgtataccagggtagag

SEQ ID NO: 302419 - DNA, 20 bp, Artificial Sequence
  chemically synthesized
cttttcaaacttctctaccc

SEQ ID NO: 302420 - DNA, 20 bp, Artificial Sequence
  chemically synthesized
aatttgtgtataccagggta

SEQ ID NO: 302421 - DNA, 20 bp, Artificial Sequence
  chemically synthesized
agaatttgtgtataccaggg

SEQ ID NO: 302422 - DNA, 20 bp, Artificial Sequence
  chemically synthesized
attagaatttgtgtatacca

SEQ ID NO: 302423 - DNA, 20 bp, Artificial Sequence
  chemically synthesized
cattagaatttgtgtatacc

SEQ ID NO: 302424 - DNA, 20 bp, Artificial Sequence
  chemically synthesized
acattagaatttgtgtatac

SEQ ID NO: 302425 - DNA, 20 bp, Artificial Sequence
  chemically synthesized
tatacacaaattctaatgtc

SEQ ID NO: 302426 - DNA, 20 bp, Artificial Sequence
  chemically synthesized
actcatggaacacttgacat

SEQ ID NO: 302427 - DNA, 20 bp, Artificial Sequence
  chemically synthesized
tctaatgtcaagtgttccat

SEQ ID NO: 302428 - DNA, 20 bp, Artificial Sequence
  chemically synthesized
agcatatgtttagaaactca

SEQ ID NO: 302429 - DNA, 20 bp, Artificial Sequence
  chemically synthesized
gtttttaagcagcatatgtt

SEQ ID NO: 302430 - DNA, 20 bp, Artificial Sequence
  chemically synthesized
atctgccgtatgtttttaag

SEQ ID NO: 302431 - DNA, 20 bp, Artificial Sequence
  chemically synthesized
aaaatctgccgtatgttttt

SEQ ID NO: 302432 - DNA, 20 bp, Artificial Sequence
  chemically synthesized
atatgctgcttaaaaacata

SEQ ID NO: 302433 - DNA, 20 bp, Artificial Sequence
  chemically synthesized
tgctgcttaaaaacatacgg

SEQ ID NO: 302434 - DNA, 20 bp, Artificial Sequence
  chemically synthesized
ttgtaattctaagattaaga

SEQ ID NO: 302435 - DNA, 20 bp, Artificial Sequence
  chemically synthesized
ttaacgttctttcttaatct

SEQ ID NO: 302436 - DNA, 20 bp, Artificial Sequence
  chemically synthesized
gttattgtaattctaagatt

SEQ ID NO: 302437 - DNA, 20 bp, Artificial Sequence
  chemically synthesized
attccagttattgtaattct

SEQ ID NO: 302438 - DNA, 20 bp, Artificial Sequence
  chemically synthesized
aatcttagaattacaataac

SEQ ID NO: 302439 - DNA, 20 bp, Artificial Sequence
  chemically synthesized
aattacaataactggaatga

SEQ ID NO: 302440 - DNA, 20 bp, Artificial Sequence
  chemically synthesized
attacaataactggaatgaa

SEQ ID NO: 302441 - DNA, 20 bp, Artificial Sequence
  chemically synthesized
gtacaatttccctttcattc

SEQ ID NO: 302442 - DNA, 20 bp, Artificial Sequence
  chemically synthesized
ttacaataactggaatgaaa

SEQ ID NO: 302443 - DNA, 20 bp, Artificial Sequence
  chemically synthesized
ggcataaaaattattttaaa

SEQ ID NO: 302444 - DNA, 20 bp, Artificial Sequence
  chemically synthesized
tggcataaaaattattttaa

SEQ ID NO: 302445 - DNA, 20 bp, Artificial Sequence
  chemically synthesized
ttttaaaataatttttatgc

SEQ ID NO: 302446 - DNA, 20 bp, Artificial Sequence
  chemically synthesized
aaattttatgagtgcaaagc

SEQ ID NO: 302447 - DNA, 20 bp, Artificial Sequence
  chemically synthesized
aataaaattttatgagtgca

SEQ ID NO: 302448 - DNA, 20 bp, Artificial Sequence
  chemically synthesized
tgatggcaataaaattttat

SEQ ID NO: 302449 - DNA, 20 bp, Artificial Sequence
  chemically synthesized
cagtggatatattaaaatga

SEQ ID NO: 302450 - DNA, 20 bp, Artificial Sequence
  chemically synthesized
ttaggtattatgtaaatcag

SEQ ID NO: 302451 - DNA, 20 bp, Artificial Sequence
  chemically synthesized
aagttaggtattatgtaaat

SEQ ID NO: 302452 - DNA, 20 bp, Artificial Sequence
  chemically synthesized
ttatgcattttagataagtt

SEQ ID NO: 302453 - DNA, 20 bp, Artificial Sequence
  chemically synthesized
attatgcattttagataagt

SEQ ID NO: 302454 - DNA, 20 bp, Artificial Sequence
  chemically synthesized
cagaattatgcattttagat

SEQ ID NO: 302455 - DNA, 20 bp, Artificial Sequence
  chemically synthesized
ctattcagaattatgcattt

SEQ ID NO: 302456 - DNA, 20 bp, Artificial Sequence
  chemically synthesized
ctaaaatgcataattctgaa

SEQ ID NO: 302457 - DNA, 20 bp, Artificial Sequence
  chemically synthesized
ctgatctttttgtgactatt

SEQ ID NO: 302458 - DNA, 20 bp, Artificial Sequence
  chemically synthesized
taattctgaatagtcacaaa

SEQ ID NO: 302459 - DNA, 20 bp, Artificial Sequence
  chemically synthesized
ctgaatagtcacaaaaagat

SEQ ID NO: 302460 - DNA, 20 bp, Artificial Sequence
  chemically synthesized
aagtcttatcttgaaggtgt

SEQ ID NO: 302461 - DNA, 20 bp, Artificial Sequence
  chemically synthesized
ttaaaaattctaacaccttc

SEQ ID NO: 302462 - DNA, 20 bp, Artificial Sequence
  chemically synthesized
aattctaacaccttcaagat

SEQ ID NO: 302463 - DNA, 20 bp, Artificial Sequence
  chemically synthesized
tttataaagtcttatcttga

SEQ ID NO: 302464 - DNA, 20 bp, Artificial Sequence
  chemically synthesized
atttataaagtcttatcttg

SEQ ID NO: 302465 - DNA, 20 bp, Artificial Sequence
  chemically synthesized
cctgttctttgatatttata

SEQ ID NO: 302466 - DNA, 20 bp, Artificial Sequence
  chemically synthesized
ataagactttataaatatca

SEQ ID NO: 302467 - DNA, 20 bp, Artificial Sequence
  chemically synthesized
actttataaatatcaaagaa

SEQ ID NO: 302468 - DNA, 20 bp, Artificial Sequence
  chemically synthesized
ctttataaatatcaaagaac

SEQ ID NO: 302469 - DNA, 20 bp, Artificial Sequence
  chemically synthesized
tcctaaatcaggagtaatta

SEQ ID NO: 302470 - DNA, 20 bp, Artificial Sequence
  chemically synthesized
ttctgtaattactcctgatt

SEQ ID NO: 302471 - DNA, 20 bp, Artificial Sequence
  chemically synthesized
tctgtaattactcctgattt

SEQ ID NO: 302472 - DNA, 20 bp, Artificial Sequence
  chemically synthesized
gtctgcgcatcctaaatcag

SEQ ID NO: 302473 - DNA, 20 bp, Artificial Sequence
  chemically synthesized
cagtctgcgcatcctaaatc

SEQ ID NO: 302474 - DNA, 20 bp, Artificial Sequence
  chemically synthesized
tcagtctgcgcatcctaaat

SEQ ID NO: 302475 - DNA, 20 bp, Artificial Sequence
  chemically synthesized
tactcctgatttaggatgcg

SEQ ID NO: 302476 - DNA, 20 bp, Artificial Sequence
  chemically synthesized
tgatttaggatgcgcagact

SEQ ID NO: 302477 - DNA, 20 bp, Artificial Sequence
  chemically synthesized
tttacgagaacatgatgtct

SEQ ID NO: 302478 - DNA, 20 bp, Artificial Sequence
  chemically synthesized
gatccatcctggtagtttac

SEQ ID NO: 302479 - DNA, 20 bp, Artificial Sequence
  chemically synthesized
atcatgttctcgtaaactac

SEQ ID NO: 302480 - DNA, 20 bp, Artificial Sequence
  chemically synthesized
tcatgttctcgtaaactacc

SEQ ID NO: 302481 - DNA, 20 bp, Artificial Sequence
  chemically synthesized
gttctcgtaaactaccagga

SEQ ID NO: 302482 - DNA, 20 bp, Artificial Sequence
  chemically synthesized
atagatgggatccatcctgg

SEQ ID NO: 302483 - DNA, 20 bp, Artificial Sequence
  chemically synthesized
ataatagatgggatccatcc

SEQ ID NO: 302484 - DNA, 20 bp, Artificial Sequence
  chemically synthesized
gaagtacacctataatagat

SEQ ID NO: 302485 - DNA, 20 bp, Artificial Sequence
  chemically synthesized
aggatggatcccatctatta

SEQ ID NO: 302486 - DNA, 20 bp, Artificial Sequence
  chemically synthesized
agaagtacacctataataga

SEQ ID NO: 302487 - DNA, 20 bp, Artificial Sequence
  chemically synthesized
ggatggatcccatctattat

SEQ ID NO: 302488 - DNA, 20 bp, Artificial Sequence
  chemically synthesized
atgaagaagtacacctataa

SEQ ID NO: 302489 - DNA, 20 bp, Artificial Sequence
  chemically synthesized
gaaagtgcattttcatgaag

SEQ ID NO: 302490 - DNA, 20 bp, Artificial Sequence
  chemically synthesized
acggaaagtgcattttcatg

SEQ ID NO: 302491 - DNA, 20 bp, Artificial Sequence
  chemically synthesized
cttttttttccagtaacgga

SEQ ID NO: 302492 - DNA, 20 bp, Artificial Sequence
  chemically synthesized
gaaaatgcactttccgttac

SEQ ID NO: 302493 - DNA, 20 bp, Artificial Sequence
  chemically synthesized
atgtcttttttttccagtaa

SEQ ID NO: 302494 - DNA, 20 bp, Artificial Sequence
  chemically synthesized
ctttccgttactggaaaaaa

SEQ ID NO: 302495 - DNA, 20 bp, Artificial Sequence
  chemically synthesized
cattaaatgtcttttttttc

SEQ ID NO: 302496 - DNA, 20 bp, Artificial Sequence
  chemically synthesized
aaagacatttaatgcaaaac

SEQ ID NO: 302497 - DNA, 20 bp, Artificial Sequence
  chemically synthesized
aagacatttaatgcaaaact

SEQ ID NO: 302498 - DNA, 20 bp, Artificial Sequence
  chemically synthesized
agacatttaatgcaaaacta

SEQ ID NO: 302499 - DNA, 20 bp, Artificial Sequence
  chemically synthesized
gggcctgcttgttgagtccc

SEQ ID NO: 302500 - DNA, 20 bp, Artificial Sequence
  chemically synthesized
tgcaaaactagggactcaac

SEQ ID NO: 302501 - DNA, 20 bp, Artificial Sequence
  chemically synthesized
aaaactagggactcaacaag

SEQ ID NO: 302502 - DNA, 20 bp, Artificial Sequence
  chemically synthesized
aaactagggactcaacaagc

SEQ ID NO: 302503 - DNA, 20 bp, Artificial Sequence
  chemically synthesized
ttataaagggcctgcttgtt

SEQ ID NO: 302504 - DNA, 20 bp, Artificial Sequence
  chemically synthesized
tcaacaagcaggccctttat

SEQ ID NO: 302505 - DNA, 20 bp, Artificial Sequence
  chemically synthesized
caacaagcaggccctttata

SEQ ID NO: 302506 - DNA, 20 bp, Artificial Sequence
  chemically synthesized
ttttttttcttccttataaa

SEQ ID NO: 302507 - DNA, 20 bp, Artificial Sequence
  chemically synthesized
tttttttttcttccttataa

SEQ ID NO: 302508 - DNA, 20 bp, Artificial Sequence
  chemically synthesized
caagcaggccctttataagg

SEQ ID NO: 302509 - DNA, 20 bp, Artificial Sequence
  chemically synthesized
ttttttttttcttccttata

SEQ ID NO: 302510 - DNA, 20 bp, Artificial Sequence
  chemically synthesized
tataaggaagaaaaaaaaaa

SEQ ID NO: 302511 - DNA, 20 bp, Artificial Sequence
  chemically synthesized
aggaagaaaaaaaaaaaaga

SEQ ID NO: 302512 - DNA, 20 bp, Artificial Sequence
  chemically synthesized
agaaaaaaaaaaaagaaaga

SEQ ID NO: 302513 - DNA, 20 bp, Artificial Sequence
  chemically synthesized
aaaagaaagaaagaaacttt

SEQ ID NO: 302514 - DNA, 20 bp, Artificial Sequence
  chemically synthesized
aaagaaagaaagaaactttt

SEQ ID NO: 302515 - DNA, 20 bp, Artificial Sequence
  chemically synthesized
tggtagcattttaatcctaa

SEQ ID NO: 302516 - DNA, 20 bp, Artificial Sequence
  chemically synthesized
ttaggattaaaatgctacca

SEQ ID NO: 302517 - DNA, 20 bp, Artificial Sequence
  chemically synthesized
ggattaaaatgctaccacag

SEQ ID NO: 302518 - DNA, 20 bp, Artificial Sequence
  chemically synthesized
taggtgataaactactgtgg

SEQ ID NO: 302519 - DNA, 20 bp, Artificial Sequence
  chemically synthesized
ctataggtgataaactactg

SEQ ID NO: 302520 - DNA, 20 bp, Artificial Sequence
  chemically synthesized
ccacagtagtttatcaccta

SEQ ID NO: 302521 - DNA, 20 bp, Artificial Sequence
  chemically synthesized
gaagaaactatagaaactat

SEQ ID NO: 302522 - DNA, 20 bp, Artificial Sequence
  chemically synthesized
agaagaaactatagaaacta

SEQ ID NO: 302523 - DNA, 20 bp, Artificial Sequence
  chemically synthesized
tttatcacctatagtttcta

SEQ ID NO: 302524 - DNA, 20 bp, Artificial Sequence
  chemically synthesized
tggggtgaaagaagaaacta

SEQ ID NO: 302525 - DNA, 20 bp, Artificial Sequence
  chemically synthesized
ggtgttttctggggtgaaag

SEQ ID NO: 302526 - DNA, 20 bp, Artificial Sequence
  chemically synthesized
tatagtttcttctttcaccc

SEQ ID NO: 302527 - DNA, 20 bp, Artificial Sequence
  chemically synthesized
aatggtgttttctggggtga

SEQ ID NO: 302528 - DNA, 20 bp, Artificial Sequence
  chemically synthesized
aatggaaatggtgttttctg

SEQ ID NO: 302529 - DNA, 20 bp, Artificial Sequence
  chemically synthesized
taatggaaatggtgttttct

SEQ ID NO: 302530 - DNA, 20 bp, Artificial Sequence
  chemically synthesized
ttaatggaaatggtgttttc

SEQ ID NO: 302531 - DNA, 20 bp, Artificial Sequence
  chemically synthesized
aagtaaatgcttaatggaaa

SEQ ID NO: 302532 - DNA, 20 bp, Artificial Sequence
  chemically synthesized
cagaaaacaccatttccatt

SEQ ID NO: 302533 - DNA, 20 bp, Artificial Sequence
  chemically synthesized
aacagaaagtaaatgcttaa

SEQ ID NO: 302534 - DNA, 20 bp, Artificial Sequence
  chemically synthesized
gaaatcactatcgcaacaga

SEQ ID NO: 302535 - DNA, 20 bp, Artificial Sequence
  chemically synthesized
gcatttactttctgttgcga

SEQ ID NO: 302536 - DNA, 20 bp, Artificial Sequence
  chemically synthesized
acaagaaatcactatcgcaa

SEQ ID NO: 302537 - DNA, 20 bp, Artificial Sequence
  chemically synthesized
gcgatagtgatttcttgtga

SEQ ID NO: 302538 - DNA, 20 bp, Artificial Sequence
  chemically synthesized
gtacattttaaaactttcac

SEQ ID NO: 302539 - DNA, 20 bp, Artificial Sequence
  chemically synthesized
atgtagtgagaaaaattatg

SEQ ID NO: 302540 - DNA, 20 bp, Artificial Sequence
  chemically synthesized
gtaatgtcagttaatgtagt

SEQ ID NO: 302541 - DNA, 20 bp, Artificial Sequence
  chemically synthesized
acctgtaatgtcagttaatg

SEQ ID NO: 302542 - DNA, 20 bp, Artificial Sequence
  chemically synthesized
cactacattaactgacatta

SEQ ID NO: 302543 - DNA, 20 bp, Artificial Sequence
  chemically synthesized
actacattaactgacattac

SEQ ID NO: 302544 - DNA, 20 bp, Artificial Sequence
  chemically synthesized
tcctcgggtacctgtaatgt

SEQ ID NO: 302545 - DNA, 20 bp, Artificial Sequence
  chemically synthesized
aactgacattacaggtaccc

SEQ ID NO: 302546 - DNA, 20 bp, Artificial Sequence
  chemically synthesized
actgacattacaggtacccg

SEQ ID NO: 302547 - DNA, 20 bp, Artificial Sequence
  chemically synthesized
gcaatatttccagaatcctc

SEQ ID NO: 302548 - DNA, 20 bp, Artificial Sequence
  chemically synthesized
ttacaggtacccgaggattc

SEQ ID NO: 302549 - DNA, 20 bp, Artificial Sequence
  chemically synthesized
agcaatatttccagaatcct

SEQ ID NO: 302550 - DNA, 20 bp, Artificial Sequence
  chemically synthesized
tttcacttcagcaatatttc

SEQ ID NO: 302551 - DNA, 20 bp, Artificial Sequence
  chemically synthesized
ggattctggaaatattgctg

SEQ ID NO: 302552 - DNA, 20 bp, Artificial Sequence
  chemically synthesized
tgttggtggtgttttcactt

SEQ ID NO: 302553 - DNA, 20 bp, Artificial Sequence
  chemically synthesized
atttacagcagttttgttgg

SEQ ID NO: 302554 - DNA, 20 bp, Artificial Sequence
  chemically synthesized
ctcatttacagcagttttgt

SEQ ID NO: 302555 - DNA, 20 bp, Artificial Sequence
  chemically synthesized
tggagaaaactcatttacag

SEQ ID NO: 302556 - DNA, 20 bp, Artificial Sequence
  chemically synthesized
ccaacaaaactgctgtaaat

SEQ ID NO: 302557 - DNA, 20 bp, Artificial Sequence
  chemically synthesized
aagtggagaaaactcattta

SEQ ID NO: 302558 - DNA, 20 bp, Artificial Sequence
  chemically synthesized
ttttatctgcaaatgaagtg

SEQ ID NO: 302559 - DNA, 20 bp, Artificial Sequence
  chemically synthesized
gcttttatctgcaaatgaag

SEQ ID NO: 302560 - DNA, 20 bp, Artificial Sequence
  chemically synthesized
agttttctccacttcatttg

SEQ ID NO: 302561 - DNA, 20 bp, Artificial Sequence
  chemically synthesized
taagcttttatctgcaaatg

SEQ ID NO: 302562 - DNA, 20 bp, Artificial Sequence
  chemically synthesized
tccacttcatttgcagataa

SEQ ID NO: 302563 - DNA, 20 bp, Artificial Sequence
  chemically synthesized
tcatttgcagataaaagctt

SEQ ID NO: 302564 - DNA, 20 bp, Artificial Sequence
  chemically synthesized
ggaaaaggtgagagcatctt

SEQ ID NO: 302565 - DNA, 20 bp, Artificial Sequence
  chemically synthesized
ctgaaattaggaaaaggtga

SEQ ID NO: 302566 - DNA, 20 bp, Artificial Sequence
  chemically synthesized
ttctgaaattaggaaaaggt

SEQ ID NO: 302567 - DNA, 20 bp, Artificial Sequence
  chemically synthesized
tggattctgaaattaggaaa

SEQ ID NO: 302568 - DNA, 20 bp, Artificial Sequence
  chemically synthesized
gtggattctgaaattaggaa

SEQ ID NO: 302569 - DNA, 20 bp, Artificial Sequence
  chemically synthesized
ctctcaccttttcctaattt

SEQ ID NO: 302570 - DNA, 20 bp, Artificial Sequence
  chemically synthesized
ttactgtggattctgaaatt

SEQ ID NO: 302571 - DNA, 20 bp, Artificial Sequence
  chemically synthesized
attactgtggattctgaaat

SEQ ID NO: 302572 - DNA, 20 bp, Artificial Sequence
  chemically synthesized
tttcctaatttcagaatcca

SEQ ID NO: 302573 - DNA, 20 bp, Artificial Sequence
  chemically synthesized
aaagaagaggcagattactg

SEQ ID NO: 302574 - DNA, 20 bp, Artificial Sequence
  chemically synthesized
cacctccccaaaagaagagg

SEQ ID NO: 302575 - DNA, 20 bp, Artificial Sequence
  chemically synthesized
cagtaatctgcctcttcttt

SEQ ID NO: 302576 - DNA, 20 bp, Artificial Sequence
  chemically synthesized
caccacctccccaaaagaag

SEQ ID NO: 302577 - DNA, 20 bp, Artificial Sequence
  chemically synthesized
agtaatctgcctcttctttt

SEQ ID NO: 302578 - DNA, 20 bp, Artificial Sequence
  chemically synthesized
ccaccacctccccaaaagaa

SEQ ID NO: 302579 - DNA, 20 bp, Artificial Sequence
  chemically synthesized
gtaatctgcctcttcttttg

SEQ ID NO: 302580 - DNA, 20 bp, Artificial Sequence
  chemically synthesized
caccaccacctccccaaaag

SEQ ID NO: 302581 - DNA, 20 bp, Artificial Sequence
  chemically synthesized
aatctgcctcttcttttggg

SEQ ID NO: 302582 - DNA, 20 bp, Artificial Sequence
  chemically synthesized
atctgcctcttcttttgggg

SEQ ID NO: 302583 - DNA, 20 bp, Artificial Sequence
  chemically synthesized
ttccaccaccacctccccaa

SEQ ID NO: 302584 - DNA, 20 bp, Artificial Sequence
  chemically synthesized
tgcctcttcttttggggagg

SEQ ID NO: 302585 - DNA, 20 bp, Artificial Sequence
  chemically synthesized
ctcttcttttggggaggtgg

SEQ ID NO: 302586 - DNA, 20 bp, Artificial Sequence
  chemically synthesized
ttcttttggggaggtggtgg

SEQ ID NO: 302587 - DNA, 20 bp, Artificial Sequence
  chemically synthesized
ttttggggaggtggtggtgg

SEQ ID NO: 302588 - DNA, 20 bp, Artificial Sequence
  chemically synthesized
tggtggtggaagttcctctt

SEQ ID NO: 302589 - DNA, 20 bp, Artificial Sequence
  chemically synthesized
cctggtaaagcatgctcaag

SEQ ID NO: 302590 - DNA, 20 bp, Artificial Sequence
  chemically synthesized
tcctggtaaagcatgctcaa

SEQ ID NO: 302591 - DNA, 20 bp, Artificial Sequence
  chemically synthesized
gatcctggtaaagcatgctc

SEQ ID NO: 302592 - DNA, 20 bp, Artificial Sequence
  chemically synthesized
tcctcttgagcatgctttac

SEQ ID NO: 302593 - DNA, 20 bp, Artificial Sequence
  chemically synthesized
cctcttgagcatgctttacc

SEQ ID NO: 302594 - DNA, 20 bp, Artificial Sequence
  chemically synthesized
caagggaacagatcctggta

SEQ ID NO: 302595 - DNA, 20 bp, Artificial Sequence
  chemically synthesized
gaccacaagggaacagatcc

SEQ ID NO: 302596 - DNA, 20 bp, Artificial Sequence
  chemically synthesized
ctacggtgaccacaagggaa

SEQ ID NO: 302597 - DNA, 20 bp, Artificial Sequence
  chemically synthesized
taccaggatctgttcccttg

SEQ ID NO: 302598 - DNA, 20 bp, Artificial Sequence
  chemically synthesized
agtaactacggtgaccacaa

SEQ ID NO: 302599 - DNA, 20 bp, Artificial Sequence
  chemically synthesized
cagtaactacggtgaccaca

SEQ ID NO: 302600 - DNA, 20 bp, Artificial Sequence
  chemically synthesized
acagtaactacggtgaccac

SEQ ID NO: 302601 - DNA, 20 bp, Artificial Sequence
  chemically synthesized
ctgttcccttgtggtcaccg

SEQ ID NO: 302602 - DNA, 20 bp, Artificial Sequence
  chemically synthesized
tgtaatggaaacagtaacta

SEQ ID NO: 302603 - DNA, 20 bp, Artificial Sequence
  chemically synthesized
acagacaactgtaatggaaa

SEQ ID NO: 302604 - DNA, 20 bp, Artificial Sequence
  chemically synthesized
cgtagttactgtttccatta

SEQ ID NO: 302605 - DNA, 20 bp, Artificial Sequence
  chemically synthesized
actaacacagacaactgtaa

SEQ ID NO: 302606 - DNA, 20 bp, Artificial Sequence
  chemically synthesized
tccattacagttgtctgtgt

SEQ ID NO: 302607 - DNA, 20 bp, Artificial Sequence
  chemically synthesized
ccactcagccatcactaaca

SEQ ID NO: 302608 - DNA, 20 bp, Artificial Sequence
  chemically synthesized
acagttgtctgtgttagtga

SEQ ID NO: 302609 - DNA, 20 bp, Artificial Sequence
  chemically synthesized
tgtctgtgttagtgatggct

SEQ ID NO: 302610 - DNA, 20 bp, Artificial Sequence
  chemically synthesized
ctgtgttagtgatggctgag

SEQ ID NO: 302611 - DNA, 20 bp, Artificial Sequence
  chemically synthesized
tgttagtgatggctgagtgg

SEQ ID NO: 302612 - DNA, 20 bp, Artificial Sequence
  chemically synthesized
cacaggctgtcaccaccact

SEQ ID NO: 302613 - DNA, 20 bp, Artificial Sequence
  chemically synthesized
tgatggctgagtggtggtga

SEQ ID NO: 302614 - DNA, 20 bp, Artificial Sequence
  chemically synthesized
atacttctcacagatttcac

SEQ ID NO: 302615 - DNA, 20 bp, Artificial Sequence
  chemically synthesized
aatacttctcacagatttca

SEQ ID NO: 302616 - DNA, 20 bp, Artificial Sequence
  chemically synthesized
tgacagcctgtgaaatctgt

SEQ ID NO: 302617 - DNA, 20 bp, Artificial Sequence
  chemically synthesized
cagcctgtgaaatctgtgag

SEQ ID NO: 302618 - DNA, 20 bp, Artificial Sequence
  chemically synthesized
ctctgtttcaatacttctca

SEQ ID NO: 302619 - DNA, 20 bp, Artificial Sequence
  chemically synthesized
atctgtgagaagtattgaaa

SEQ ID NO: 302620 - DNA, 20 bp, Artificial Sequence
  chemically synthesized
ctgtgagaagtattgaaaca

SEQ ID NO: 302621 - DNA, 20 bp, Artificial Sequence
  chemically synthesized
tgtgagaagtattgaaacag

SEQ ID NO: 302622 - DNA, 20 bp, Artificial Sequence
  chemically synthesized
agaagtattgaaacagaggt

SEQ ID NO: 302623 - DNA, 20 bp, Artificial Sequence
  chemically synthesized
aaacagaggtcagacattgc

SEQ ID NO: 302624 - DNA, 20 bp, Artificial Sequence
  chemically synthesized
agaggtcagacattgctaga

SEQ ID NO: 302625 - DNA, 20 bp, Artificial Sequence
  chemically synthesized
agtctttactgaagtctttc

SEQ ID NO: 302626 - DNA, 20 bp, Artificial Sequence
  chemically synthesized
agacattgctagaaagactt

SEQ ID NO: 302627 - DNA, 20 bp, Artificial Sequence
  chemically synthesized
ttgctagaaagacttcagta

SEQ ID NO: 302628 - DNA, 20 bp, Artificial Sequence
  chemically synthesized
actccaagcagtctttactg

SEQ ID NO: 302629 - DNA, 20 bp, Artificial Sequence
  chemically synthesized
agacttcagtaaagactgct

SEQ ID NO: 302630 - DNA, 20 bp, Artificial Sequence
  chemically synthesized
acttcagtaaagactgcttg

SEQ ID NO: 302631 - DNA, 20 bp, Artificial Sequence
  chemically synthesized
tcagtaaagactgcttggag

SEQ ID NO: 302632 - DNA, 20 bp, Artificial Sequence
  chemically synthesized
ttttcctttgccactccaag

SEQ ID NO: 302633 - DNA, 20 bp, Artificial Sequence
  chemically synthesized
ttattttcctttgccactcc

SEQ ID NO: 302634 - DNA, 20 bp, Artificial Sequence
  chemically synthesized
aaagactgcttggagtggca

SEQ ID NO: 302635 - DNA, 20 bp, Artificial Sequence
  chemically synthesized
aagactgcttggagtggcaa

SEQ ID NO: 302636 - DNA, 20 bp, Artificial Sequence
  chemically synthesized
gagtggcaaaggaaaataat

SEQ ID NO: 302637 - DNA, 20 bp, Artificial Sequence
  chemically synthesized
aatctaccaacaagcaagaa

SEQ ID NO: 302638 - DNA, 20 bp, Artificial Sequence
  chemically synthesized
gagaaactgttcttgcttgt

SEQ ID NO: 302639 - DNA, 20 bp, Artificial Sequence
  chemically synthesized
aggtcaatctaccaacaagc

SEQ ID NO: 302640 - DNA, 20 bp, Artificial Sequence
  chemically synthesized
aaactgttcttgcttgttgg

SEQ ID NO: 302641 - DNA, 20 bp, Artificial Sequence
  chemically synthesized
ctgaaggtcaatctaccaac

SEQ ID NO: 302642 - DNA, 20 bp, Artificial Sequence
  chemically synthesized
cttgttggtagattgacctt

SEQ ID NO: 302643 - DNA, 20 bp, Artificial Sequence
  chemically synthesized
atggtgctattttgatctga

SEQ ID NO: 302644 - DNA, 20 bp, Artificial Sequence
  chemically synthesized
tatggtgctattttgatctg

SEQ ID NO: 302645 - DNA, 20 bp, Artificial Sequence
  chemically synthesized
gattgaccttcagatcaaaa

SEQ ID NO: 302646 - DNA, 20 bp, Artificial Sequence
  chemically synthesized
atcaaaatagcaccatattg

SEQ ID NO: 302647 - DNA, 20 bp, Artificial Sequence
  chemically synthesized
aattttatttggcttcaata

SEQ ID NO: 302648 - DNA, 20 bp, Artificial Sequence
  chemically synthesized
tcagataaaacaattttatt

SEQ ID NO: 302649 - DNA, 20 bp, Artificial Sequence
  chemically synthesized
aaaattgttttatctgactt

SEQ ID NO: 302650 - DNA, 20 bp, Artificial Sequence
  chemically synthesized
tcagtgaaccaaacttaagt

SEQ ID NO: 302651 - DNA, 20 bp, Artificial Sequence
  chemically synthesized
tgttttatctgacttaagtt

SEQ ID NO: 302652 - DNA, 20 bp, Artificial Sequence
  chemically synthesized
tatttcagtgaaccaaactt

SEQ ID NO: 302653 - DNA, 20 bp, Artificial Sequence
  chemically synthesized
ttaagtttggttcactgaaa

SEQ ID NO: 302654 - DNA, 20 bp, Artificial Sequence
  chemically synthesized
gtttggttcactgaaatagc

SEQ ID NO: 302655 - DNA, 20 bp, Artificial Sequence
  chemically synthesized
attactttcccttgctattt

SEQ ID NO: 302656 - DNA, 20 bp, Artificial Sequence
  chemically synthesized
tttggttcactgaaatagca

SEQ ID NO: 302657 - DNA, 20 bp, Artificial Sequence
  chemically synthesized
ttggttcactgaaatagcaa

SEQ ID NO: 302658 - DNA, 20 bp, Artificial Sequence
  chemically synthesized
ttcactgaaatagcaaggga

SEQ ID NO: 302659 - DNA, 20 bp, Artificial Sequence
  chemically synthesized
ctaaattgactttcgatgtt

SEQ ID NO: 302660 - DNA, 20 bp, Artificial Sequence
  chemically synthesized
gaaagtaatctcaacatcga

SEQ ID NO: 302661 - DNA, 20 bp, Artificial Sequence
  chemically synthesized
ctcaacatcgaaagtcaatt

SEQ ID NO: 302662 - DNA, 20 bp, Artificial Sequence
  chemically synthesized
gtttgaccaatatattgaag

SEQ ID NO: 302663 - DNA, 20 bp, Artificial Sequence
  chemically synthesized
agtttgaccaatatattgaa

SEQ ID NO: 302664 - DNA, 20 bp, Artificial Sequence
  chemically synthesized
cagtttgaccaatatattga

SEQ ID NO: 302665 - DNA, 20 bp, Artificial Sequence
  chemically synthesized
acagtttgaccaatatattg

SEQ ID NO: 302666 - DNA, 20 bp, Artificial Sequence
  chemically synthesized
ttagcgccccttcaatatat

SEQ ID NO: 302667 - DNA, 20 bp, Artificial Sequence
  chemically synthesized
tcaatatattggtcaaactg

SEQ ID NO: 302668 - DNA, 20 bp, Artificial Sequence
  chemically synthesized
caatatattggtcaaactgt

SEQ ID NO: 302669 - DNA, 20 bp, Artificial Sequence
  chemically synthesized
cccccaccccttatttccta

SEQ ID NO: 302670 - DNA, 20 bp, Artificial Sequence
  chemically synthesized
ttggtcaaactgtaggaaat

SEQ ID NO: 302671 - DNA, 20 bp, Artificial Sequence
  chemically synthesized
tggtcaaactgtaggaaata

SEQ ID NO: 302672 - DNA, 20 bp, Artificial Sequence
  chemically synthesized
ggtcaaactgtaggaaataa

SEQ ID NO: 302673 - DNA, 20 bp, Artificial Sequence
  chemically synthesized
gtcaaactgtaggaaataag

SEQ ID NO: 302674 - DNA, 20 bp, Artificial Sequence
  chemically synthesized
aaactgtaggaaataagggg

SEQ ID NO: 302675 - DNA, 20 bp, Artificial Sequence
  chemically synthesized
aactgtaggaaataaggggt

SEQ ID NO: 302676 - DNA, 20 bp, Artificial Sequence
  chemically synthesized
actgtaggaaataaggggtg

SEQ ID NO: 302677 - DNA, 20 bp, Artificial Sequence
  chemically synthesized
ctgtaggaaataaggggtgg

SEQ ID NO: 302678 - DNA, 20 bp, Artificial Sequence
  chemically synthesized
taggaaataaggggtggggg

SEQ ID NO: 302679 - DNA, 20 bp, Artificial Sequence
  chemically synthesized
ggaaataaggggtgggggca

SEQ ID NO: 302680 - DNA, 20 bp, Artificial Sequence
  chemically synthesized
gaaataaggggtgggggcag

SEQ ID NO: 302681 - DNA, 20 bp, Artificial Sequence
  chemically synthesized
aataaggggtgggggcagag

SEQ ID NO: 302682 - DNA, 20 bp, Artificial Sequence
  chemically synthesized
gggggcagaggagaaaaatg

SEQ ID NO: 302683 - DNA, 20 bp, Artificial Sequence
  chemically synthesized
gggcagaggagaaaaatgta

SEQ ID NO: 302684 - DNA, 20 bp, Artificial Sequence
  chemically synthesized
tagagtataattcattctga

SEQ ID NO: 302685 - DNA, 20 bp, Artificial Sequence
  chemically synthesized
cagcatgtagaattaactat

SEQ ID NO: 302686 - DNA, 20 bp, Artificial Sequence
  chemically synthesized
taaacattttaaacagcatg

SEQ ID NO: 302687 - DNA, 20 bp, Artificial Sequence
  chemically synthesized
attaatgtaaacattttaaa

SEQ ID NO: 302688 - DNA, 20 bp, Artificial Sequence
  chemically synthesized
gaattggtactgatgtacgt

SEQ ID NO: 302689 - DNA, 20 bp, Artificial Sequence
  chemically synthesized
tgaatgttactaacgtacat

SEQ ID NO: 302690 - DNA, 20 bp, Artificial Sequence
  chemically synthesized
aatgttctaggcaatggaat

SEQ ID NO: 302691 - DNA, 20 bp, Artificial Sequence
  chemically synthesized
tcagtaccaattccattgcc

SEQ ID NO: 302692 - DNA, 20 bp, Artificial Sequence
  chemically synthesized
atttaaaatgttctaggcaa

SEQ ID NO: 302693 - DNA, 20 bp, Artificial Sequence
  chemically synthesized
ataagcatttaaaatgttct

SEQ ID NO: 302694 - DNA, 20 bp, Artificial Sequence
  chemically synthesized
aataagcatttaaaatgttc

SEQ ID NO: 302695 - DNA, 20 bp, Artificial Sequence
  chemically synthesized
acattttaaatgcttattaa

SEQ ID NO: 302696 - DNA, 20 bp, Artificial Sequence
  chemically synthesized
gcattctacaaactattaat

SEQ ID NO: 302697 - DNA, 20 bp, Artificial Sequence
  chemically synthesized
aaatgcttattaatagtttg

SEQ ID NO: 302698 - DNA, 20 bp, Artificial Sequence
  chemically synthesized
tagtttgtagaatgcatttt

SEQ ID NO: 302699 - DNA, 20 bp, Artificial Sequence
  chemically synthesized
taaataaaattatttcaact

SEQ ID NO: 302700 - DNA, 20 bp, Artificial Sequence
  chemically synthesized
ttaaagagtcgttcattacc

SEQ ID NO: 302701 - DNA, 20 bp, Artificial Sequence
  chemically synthesized
gtttcacttatttgattaaa

SEQ ID NO: 302702 - DNA, 20 bp, Artificial Sequence
  chemically synthesized
ctgtttcacttatttgatta

SEQ ID NO: 302703 - DNA, 20 bp, Artificial Sequence
  chemically synthesized
gaacgactctttaatcaaat

SEQ ID NO: 302704 - DNA, 20 bp, Artificial Sequence
  chemically synthesized
ctttaatcaaataagtgaaa

SEQ ID NO: 302705 - DNA, 20 bp, Artificial Sequence
  chemically synthesized
accttttattgtaattttaa

SEQ ID NO: 302706 - DNA, 20 bp, Artificial Sequence
  chemically synthesized
agcttttaaaattacaataa

SEQ ID NO: 302707 - DNA, 20 bp, Artificial Sequence
  chemically synthesized
gcttttaaaattacaataaa

SEQ ID NO: 302708 - DNA, 20 bp, Artificial Sequence
  chemically synthesized
tacaataaaaggttaacata

SEQ ID NO: 302709 - DNA, 20 bp, Artificial Sequence
  chemically synthesized
ggttaacataaagtatgtat

SEQ ID NO: 302710 - DNA, 20 bp, Artificial Sequence
  chemically synthesized
attcaacataaagatatata

SEQ ID NO: 302711 - DNA, 20 bp, Artificial Sequence
  chemically synthesized
tttgaataacattcaacata

SEQ ID NO: 302712 - DNA, 20 bp, Artificial Sequence
  chemically synthesized
aacaagagtagtgtgttttt

SEQ ID NO: 302713 - DNA, 20 bp, Artificial Sequence
  chemically synthesized
taatttaaatcaaacaagag

SEQ ID NO: 302714 - DNA, 20 bp, Artificial Sequence
  chemically synthesized
cactaatttaaatcaaacaa

SEQ ID NO: 302715 - DNA, 20 bp, Artificial Sequence
  chemically synthesized
atcactaatttaaatcaaac

SEQ ID NO: 302716 - DNA, 20 bp, Artificial Sequence
  chemically synthesized
tactcttgtttgatttaaat

SEQ ID NO: 302717 - DNA, 20 bp, Artificial Sequence
  chemically synthesized
gtgattatgttcaaatattt

SEQ ID NO: 302718 - DNA, 20 bp, Artificial Sequence
  chemically synthesized
gtgtctccagtgatgaatat

SEQ ID NO: 302719 - DNA, 20 bp, Artificial Sequence
  chemically synthesized
agtgtctccagtgatgaata

SEQ ID NO: 302720 - DNA, 20 bp, Artificial Sequence
  chemically synthesized
tgagttcccatattcatcac

SEQ ID NO: 302721 - DNA, 20 bp, Artificial Sequence
  chemically synthesized
agttcccatattcatcactg

SEQ ID NO: 302722 - DNA, 20 bp, Artificial Sequence
  chemically synthesized
tctaaaccaagaagtgtctc

SEQ ID NO: 302723 - DNA, 20 bp, Artificial Sequence
  chemically synthesized
tcatcactggagacacttct

SEQ ID NO: 302724 - DNA, 20 bp, Artificial Sequence
  chemically synthesized
actggagacacttcttggtt

SEQ ID NO: 302725 - DNA, 20 bp, Artificial Sequence
  chemically synthesized
aattgagattctaaaccaag

SEQ ID NO: 302726 - DNA, 20 bp, Artificial Sequence
  chemically synthesized
ggtaattgagattctaaacc

SEQ ID NO: 302727 - DNA, 20 bp, Artificial Sequence
  chemically synthesized
agtatgaacaggaggtaatt

SEQ ID NO: 302728 - DNA, 20 bp, Artificial Sequence
  chemically synthesized
ctgccaaaagtatgaacagg

SEQ ID NO: 302729 - DNA, 20 bp, Artificial Sequence
  chemically synthesized
gctgccaaaagtatgaacag

SEQ ID NO: 302730 - DNA, 20 bp, Artificial Sequence
  chemically synthesized
ccgctgccaaaagtatgaac

SEQ ID NO: 302731 - DNA, 20 bp, Artificial Sequence
  chemically synthesized
cccgctgccaaaagtatgaa

SEQ ID NO: 302732 - DNA, 20 bp, Artificial Sequence
  chemically synthesized
ttacctcctgttcatacttt

SEQ ID NO: 302733 - DNA, 20 bp, Artificial Sequence
  chemically synthesized
cctcctgttcatacttttgg

SEQ ID NO: 302734 - DNA, 20 bp, Artificial Sequence
  chemically synthesized
cctgttcatacttttggcag

SEQ ID NO: 302735 - DNA, 20 bp, Artificial Sequence
  chemically synthesized
tgcccccggcccgctgccaa

SEQ ID NO: 302736 - DNA, 20 bp, Artificial Sequence
  chemically synthesized
ctgttcatacttttggcagc

SEQ ID NO: 302737 - DNA, 20 bp, Artificial Sequence
  chemically synthesized
tcatacttttggcagcgggc

SEQ ID NO: 302738 - DNA, 20 bp, Artificial Sequence
  chemically synthesized
catacttttggcagcgggcc

SEQ ID NO: 302739 - DNA, 20 bp, Artificial Sequence
  chemically synthesized
atacttttggcagcgggccg

SEQ ID NO: 302740 - DNA, 20 bp, Artificial Sequence
  chemically synthesized
tacttttggcagcgggccgg

SEQ ID NO: 302741 - DNA, 20 bp, Artificial Sequence
  chemically synthesized
tggcagcgggccgggggcaa

SEQ ID NO: 302742 - DNA, 20 bp, Artificial Sequence
  chemically synthesized
gatggatgaactgttgcccc

SEQ ID NO: 302743 - DNA, 20 bp, Artificial Sequence
  chemically synthesized
ggcaacagttcatccatctt

SEQ ID NO: 302744 - DNA, 20 bp, Artificial Sequence
  chemically synthesized
aaaatgtattattccaaaga

SEQ ID NO: 302745 - DNA, 20 bp, Artificial Sequence
  chemically synthesized
tcacaaaatgtattattcca

SEQ ID NO: 302746 - DNA, 20 bp, Artificial Sequence
  chemically synthesized
tttggaataatacattttgt

SEQ ID NO: 302747 - DNA, 20 bp, Artificial Sequence
  chemically synthesized
aataatacattttgtgagcc

SEQ ID NO: 302748 - DNA, 20 bp, Artificial Sequence
  chemically synthesized
cattttgtgagccaagacat

SEQ ID NO: 302749 - DNA, 20 bp, Artificial Sequence
  chemically synthesized
ggtgatggcctctcatgtct

SEQ ID NO: 302750 - DNA, 20 bp, Artificial Sequence
  chemically synthesized
ttttgtgagccaagacatga

SEQ ID NO: 302751 - DNA, 20 bp, Artificial Sequence
  chemically synthesized
tttgtgagccaagacatgag

SEQ ID NO: 302752 - DNA, 20 bp, Artificial Sequence
  chemically synthesized
atgcccatgtattgaggtga

SEQ ID NO: 302753 - DNA, 20 bp, Artificial Sequence
  chemically synthesized
gaggccatcacctcaataca

SEQ ID NO: 302754 - DNA, 20 bp, Artificial Sequence
  chemically synthesized
ctcgtaatgcccatgtattg

SEQ ID NO: 302755 - DNA, 20 bp, Artificial Sequence
  chemically synthesized
aggccatcacctcaatacat

SEQ ID NO: 302756 - DNA, 20 bp, Artificial Sequence
  chemically synthesized
tctcgtaatgcccatgtatt

SEQ ID NO: 302757 - DNA, 20 bp, Artificial Sequence
  chemically synthesized
cctcaatacatgggcattac

SEQ ID NO: 302758 - DNA, 20 bp, Artificial Sequence
  chemically synthesized
aatacatgggcattacgaga

SEQ ID NO: 302759 - DNA, 20 bp, Artificial Sequence
  chemically synthesized
atgggcattacgagatagac

SEQ ID NO: 302760 - DNA, 20 bp, Artificial Sequence
  chemically synthesized
gagatagacaagtcatataa

SEQ ID NO: 302761 - DNA, 20 bp, Artificial Sequence
  chemically synthesized
tagacaagtcatataatggt

SEQ ID NO: 302762 - DNA, 20 bp, Artificial Sequence
  chemically synthesized
gtgagacggagaatatgata

SEQ ID NO: 302763 - DNA, 20 bp, Artificial Sequence
  chemically synthesized
tgtgagacggagaatatgat

SEQ ID NO: 302764 - DNA, 20 bp, Artificial Sequence
  chemically synthesized
ttatcatattctccgtctca

SEQ ID NO: 302765 - DNA, 20 bp, Artificial Sequence
  chemically synthesized
gagaggagctctgtgagacg

SEQ ID NO: 302766 - DNA, 20 bp, Artificial Sequence
  chemically synthesized
atcatattctccgtctcaca

SEQ ID NO: 302767 - DNA, 20 bp, Artificial Sequence
  chemically synthesized
atgagaggagctctgtgaga

SEQ ID NO: 302768 - DNA, 20 bp, Artificial Sequence
  chemically synthesized
cgtcatgagaggagctctgt

SEQ ID NO: 302769 - DNA, 20 bp, Artificial Sequence
  chemically synthesized
cgttacaatcgtcatgagag

SEQ ID NO: 302770 - DNA, 20 bp, Artificial Sequence
  chemically synthesized
aacgttacaatcgtcatgag

SEQ ID NO: 302771 - DNA, 20 bp, Artificial Sequence
  chemically synthesized
taacgttacaatcgtcatga

SEQ ID NO: 302772 - DNA, 20 bp, Artificial Sequence
  chemically synthesized
ggtaacgttacaatcgtcat

SEQ ID NO: 302773 - DNA, 20 bp, Artificial Sequence
  chemically synthesized
acgattgtaacgttacctct

SEQ ID NO: 302774 - DNA, 20 bp, Artificial Sequence
  chemically synthesized
cgattgtaacgttacctctt

SEQ ID NO: 302775 - DNA, 20 bp, Artificial Sequence
  chemically synthesized
tgtaacgttacctcttggga

SEQ ID NO: 302776 - DNA, 20 bp, Artificial Sequence
  chemically synthesized
ataatgattaccatcccaag

SEQ ID NO: 302777 - DNA, 20 bp, Artificial Sequence
  chemically synthesized
gataatgattaccatcccaa

SEQ ID NO: 302778 - DNA, 20 bp, Artificial Sequence
  chemically synthesized
aggataatgattaccatccc

SEQ ID NO: 302779 - DNA, 20 bp, Artificial Sequence
  chemically synthesized
gatggtaatcattatccttc

SEQ ID NO: 302780 - DNA, 20 bp, Artificial Sequence
  chemically synthesized
atataagttggattgccaga

SEQ ID NO: 302781 - DNA, 20 bp, Artificial Sequence
  chemically synthesized
catataagttggattgccag

SEQ ID NO: 302782 - DNA, 20 bp, Artificial Sequence
  chemically synthesized
ttgcatataagttggattgc

SEQ ID NO: 302783 - DNA, 20 bp, Artificial Sequence
  chemically synthesized
aacagaccttgcatataagt

SEQ ID NO: 302784 - DNA, 20 bp, Artificial Sequence
  chemically synthesized
tggcaatccaacttatatgc

SEQ ID NO: 302785 - DNA, 20 bp, Artificial Sequence
  chemically synthesized
ggcaatccaacttatatgca

SEQ ID NO: 302786 - DNA, 20 bp, Artificial Sequence
  chemically synthesized
tggaaacagaccttgcatat

SEQ ID NO: 302787 - DNA, 20 bp, Artificial Sequence
  chemically synthesized
tatatgcaaggtctgtttcc

SEQ ID NO: 302788 - DNA, 20 bp, Artificial Sequence
  chemically synthesized
atatgcaaggtctgtttcca

SEQ ID NO: 302789 - DNA, 20 bp, Artificial Sequence
  chemically synthesized
tcttgtgacttccttggaaa

SEQ ID NO: 302790 - DNA, 20 bp, Artificial Sequence
  chemically synthesized
tgcaaggtctgtttccaagg

SEQ ID NO: 302791 - DNA, 20 bp, Artificial Sequence
  chemically synthesized
caggcctcttgtgacttcct

SEQ ID NO: 302792 - DNA, 20 bp, Artificial Sequence
  chemically synthesized
tctgtttccaaggaagtcac

SEQ ID NO: 302793 - DNA, 20 bp, Artificial Sequence
  chemically synthesized
tgtttccaaggaagtcacaa

SEQ ID NO: 302794 - DNA, 20 bp, Artificial Sequence
  chemically synthesized
gtttccaaggaagtcacaag

SEQ ID NO: 302795 - DNA, 20 bp, Artificial Sequence
  chemically synthesized
accagaggcagtttcaatgc

SEQ ID NO: 302796 - DNA, 20 bp, Artificial Sequence
  chemically synthesized
aaccagaggcagtttcaatg

SEQ ID NO: 302797 - DNA, 20 bp, Artificial Sequence
  chemically synthesized
gcctgcattgaaactgcctc

SEQ ID NO: 302798 - DNA, 20 bp, Artificial Sequence
  chemically synthesized
cctttgcttgtaaccagagg

SEQ ID NO: 302799 - DNA, 20 bp, Artificial Sequence
  chemically synthesized
gctcctttgcttgtaaccag

SEQ ID NO: 302800 - DNA, 20 bp, Artificial Sequence
  chemically synthesized
ttgaaactgcctctggttac

SEQ ID NO: 302801 - DNA, 20 bp, Artificial Sequence
  chemically synthesized
tgctcctttgcttgtaacca

SEQ ID NO: 302802 - DNA, 20 bp, Artificial Sequence
  chemically synthesized
cctgctcctttgcttgtaac

SEQ ID NO: 302803 - DNA, 20 bp, Artificial Sequence
  chemically synthesized
actgcctctggttacaagca

SEQ ID NO: 302804 - DNA, 20 bp, Artificial Sequence
  chemically synthesized
ctgcctctggttacaagcaa

SEQ ID NO: 302805 - DNA, 20 bp, Artificial Sequence
  chemically synthesized
gcctctggttacaagcaaag

SEQ ID NO: 302806 - DNA, 20 bp, Artificial Sequence
  chemically synthesized
tctggttacaagcaaaggag

SEQ ID NO: 302807 - DNA, 20 bp, Artificial Sequence
  chemically synthesized
ctggttacaagcaaaggagc

SEQ ID NO: 302808 - DNA, 20 bp, Artificial Sequence
  chemically synthesized
tggttacaagcaaaggagca

SEQ ID NO: 302809 - DNA, 20 bp, Artificial Sequence
  chemically synthesized
caagcaaaggagcagggatc

SEQ ID NO: 302810 - DNA, 20 bp, Artificial Sequence
  chemically synthesized
caaaggagcagggatctggc

SEQ ID NO: 302811 - DNA, 20 bp, Artificial Sequence
  chemically synthesized
aaaggagcagggatctggct

SEQ ID NO: 302812 - DNA, 20 bp, Artificial Sequence
  chemically synthesized
aaaatgaatcttgacccagc

SEQ ID NO: 302813 - DNA, 20 bp, Artificial Sequence
  chemically synthesized
agcagggatctggctgggtc

SEQ ID NO: 302814 - DNA, 20 bp, Artificial Sequence
  chemically synthesized
tgctaaaatgaatcttgacc

SEQ ID NO: 302815 - DNA, 20 bp, Artificial Sequence
  chemically synthesized
ggctgggtcaagattcattt

SEQ ID NO: 302816 - DNA, 20 bp, Artificial Sequence
  chemically synthesized
ccttacctcttggcaaattc

SEQ ID NO: 302817 - DNA, 20 bp, Artificial Sequence
  chemically synthesized
cccttacctcttggcaaatt

SEQ ID NO: 302818 - DNA, 20 bp, Artificial Sequence
  chemically synthesized
gcaattttcctgaatttgcc

SEQ ID NO: 302819 - DNA, 20 bp, Artificial Sequence
  chemically synthesized
aattttcctgaatttgccaa

SEQ ID NO: 302820 - DNA, 20 bp, Artificial Sequence
  chemically synthesized
attttcctgaatttgccaag

SEQ ID NO: 302821 - DNA, 20 bp, Artificial Sequence
  chemically synthesized
tcctgaatttgccaagaggt

SEQ ID NO: 302822 - DNA, 20 bp, Artificial Sequence
  chemically synthesized
cctgaatttgccaagaggta

SEQ ID NO: 302823 - DNA, 20 bp, Artificial Sequence
  chemically synthesized
caaacccttcccttacctct

SEQ ID NO: 302824 - DNA, 20 bp, Artificial Sequence
  chemically synthesized
ctgaatttgccaagaggtaa

SEQ ID NO: 302825 - DNA, 20 bp, Artificial Sequence
  chemically synthesized
aatttgccaagaggtaaggg

SEQ ID NO: 302826 - DNA, 20 bp, Artificial Sequence
  chemically synthesized
atttgccaagaggtaaggga

SEQ ID NO: 302827 - DNA, 20 bp, Artificial Sequence
  chemically synthesized
tttgccaagaggtaagggaa

SEQ ID NO: 302828 - DNA, 20 bp, Artificial Sequence
  chemically synthesized
agaggtaagggaagggtttg

SEQ ID NO: 302829 - DNA, 20 bp, Artificial Sequence
  chemically synthesized
gtcctcgtgtatgaggcagg

SEQ ID NO: 302830 - DNA, 20 bp, Artificial Sequence
  chemically synthesized
cagtcctcgtgtatgaggca

SEQ ID NO: 302831 - DNA, 20 bp, Artificial Sequence
  chemically synthesized
tcagtcctcgtgtatgaggc

SEQ ID NO: 302832 - DNA, 20 bp, Artificial Sequence
  chemically synthesized
atcagtcctcgtgtatgagg

SEQ ID NO: 302833 - DNA, 20 bp, Artificial Sequence
  chemically synthesized
aatctccctgcctcatacac

SEQ ID NO: 302834 - DNA, 20 bp, Artificial Sequence
  chemically synthesized
ggaatcagtcctcgtgtatg

SEQ ID NO: 302835 - DNA, 20 bp, Artificial Sequence
  chemically synthesized
atctccctgcctcatacacg

SEQ ID NO: 302836 - DNA, 20 bp, Artificial Sequence
  chemically synthesized
aggaatcagtcctcgtgtat

SEQ ID NO: 302837 - DNA, 20 bp, Artificial Sequence
  chemically synthesized
tttcctcacatgaaaggaat

SEQ ID NO: 302838 - DNA, 20 bp, Artificial Sequence
  chemically synthesized
aggactgattcctttcatgt

SEQ ID NO: 302839 - DNA, 20 bp, Artificial Sequence
  chemically synthesized
ttcccatttcctcacatgaa

SEQ ID NO: 302840 - DNA, 20 bp, Artificial Sequence
  chemically synthesized
ggactgattcctttcatgtg

SEQ ID NO: 302841 - DNA, 20 bp, Artificial Sequence
  chemically synthesized
tttcccatttcctcacatga

SEQ ID NO: 302842 - DNA, 20 bp, Artificial Sequence
  chemically synthesized
attcctttcatgtgaggaaa

SEQ ID NO: 302843 - DNA, 20 bp, Artificial Sequence
  chemically synthesized
ttcctttcatgtgaggaaat

SEQ ID NO: 302844 - DNA, 20 bp, Artificial Sequence
  chemically synthesized
ttcatgtgaggaaatgggaa

SEQ ID NO: 302845 - DNA, 20 bp, Artificial Sequence
  chemically synthesized
tgaggaaatgggaaaagcct

SEQ ID NO: 302846 - DNA, 20 bp, Artificial Sequence
  chemically synthesized
gaggaaatgggaaaagcctc

SEQ ID NO: 302847 - DNA, 20 bp, Artificial Sequence
  chemically synthesized
gctgaaataagaagatcctg

SEQ ID NO: 302848 - DNA, 20 bp, Artificial Sequence
  chemically synthesized
agctgaaataagaagatcct

SEQ ID NO: 302849 - DNA, 20 bp, Artificial Sequence
  chemically synthesized
gcctcaggatcttcttattt

SEQ ID NO: 302850 - DNA, 20 bp, Artificial Sequence
  chemically synthesized
aatttggaagctgaaataag

SEQ ID NO: 302851 - DNA, 20 bp, Artificial Sequence
  chemically synthesized
gccaatttggaagctgaaat

SEQ ID NO: 302852 - DNA, 20 bp, Artificial Sequence
  chemically synthesized
tcttatttcagcttccaaat

SEQ ID NO: 302853 - DNA, 20 bp, Artificial Sequence
  chemically synthesized
actgttcattgccaatttgg

SEQ ID NO: 302854 - DNA, 20 bp, Artificial Sequence
  chemically synthesized
ttcactgttcattgccaatt

SEQ ID NO: 302855 - DNA, 20 bp, Artificial Sequence
  chemically synthesized
gcttccaaattggcaatgaa

SEQ ID NO: 302856 - DNA, 20 bp, Artificial Sequence
  chemically synthesized
caaattggcaatgaacagtg

SEQ ID NO: 302857 - DNA, 20 bp, Artificial Sequence
  chemically synthesized
aaattggcaatgaacagtga

SEQ ID NO: 302858 - DNA, 20 bp, Artificial Sequence
  chemically synthesized
ttacttaagacatcatggaa

SEQ ID NO: 302859 - DNA, 20 bp, Artificial Sequence
  chemically synthesized
aatttttacttaagacatca

SEQ ID NO: 302860 - DNA, 20 bp, Artificial Sequence
  chemically synthesized
aatcttttccatgatgtctt

SEQ ID NO: 302861 - DNA, 20 bp, Artificial Sequence
  chemically synthesized
tgtcaaagcaatttttactt

SEQ ID NO: 302862 - DNA, 20 bp, Artificial Sequence
  chemically synthesized
tttttaagctatgtatgtca

SEQ ID NO: 302863 - DNA, 20 bp, Artificial Sequence
  chemically synthesized
aaaaattgctttgacataca

SEQ ID NO: 302864 - DNA, 20 bp, Artificial Sequence
  chemically synthesized
tttgacatacatagcttaaa

SEQ ID NO: 302865 - DNA, 20 bp, Artificial Sequence
  chemically synthesized
ttgacatacatagcttaaaa

SEQ ID NO: 302866 - DNA, 20 bp, Artificial Sequence
  chemically synthesized
taacaaaaggtagccttttt

SEQ ID NO: 302867 - DNA, 20 bp, Artificial Sequence
  chemically synthesized
gatatgtctttaacaaaagg

SEQ ID NO: 302868 - DNA, 20 bp, Artificial Sequence
  chemically synthesized
aaaaaggctaccttttgtta

SEQ ID NO: 302869 - DNA, 20 bp, Artificial Sequence
  chemically synthesized
aaagatatgtctttaacaaa

SEQ ID NO: 302870 - DNA, 20 bp, Artificial Sequence
  chemically synthesized
taaagatatgtctttaacaa

SEQ ID NO: 302871 - DNA, 20 bp, Artificial Sequence
  chemically synthesized
ttcagtccctcacataggta

SEQ ID NO: 302872 - DNA, 20 bp, Artificial Sequence
  chemically synthesized
agacatatctttacctatgt

SEQ ID NO: 302873 - DNA, 20 bp, Artificial Sequence
  chemically synthesized
gacatatctttacctatgtg

SEQ ID NO: 302874 - DNA, 20 bp, Artificial Sequence
  chemically synthesized
acatatctttacctatgtga

SEQ ID NO: 302875 - DNA, 20 bp, Artificial Sequence
  chemically synthesized
aatccttcagtccctcacat

SEQ ID NO: 302876 - DNA, 20 bp, Artificial Sequence
  chemically synthesized
aaatccttcagtccctcaca

SEQ ID NO: 302877 - DNA, 20 bp, Artificial Sequence
  chemically synthesized
tttacctatgtgagggactg

SEQ ID NO: 302878 - DNA, 20 bp, Artificial Sequence
  chemically synthesized
ttacctatgtgagggactga

SEQ ID NO: 302879 - DNA, 20 bp, Artificial Sequence
  chemically synthesized
ctaccaaaatggaaatcctt

SEQ ID NO: 302880 - DNA, 20 bp, Artificial Sequence
  chemically synthesized
ggactgaaggatttccattt

SEQ ID NO: 302881 - DNA, 20 bp, Artificial Sequence
  chemically synthesized
ctgaaggatttccattttgg

SEQ ID NO: 302882 - DNA, 20 bp, Artificial Sequence
  chemically synthesized
tgaaggatttccattttggt

SEQ ID NO: 302883 - DNA, 20 bp, Artificial Sequence
  chemically synthesized
atccttttagcctaccaaaa

SEQ ID NO: 302884 - DNA, 20 bp, Artificial Sequence
  chemically synthesized
tttccattttggtaggctaa

SEQ ID NO: 302885 - DNA, 20 bp, Artificial Sequence
  chemically synthesized
ttccattttggtaggctaaa

SEQ ID NO: 302886 - DNA, 20 bp, Artificial Sequence
  chemically synthesized
tgtaattcttagtatccttt

SEQ ID NO: 302887 - DNA, 20 bp, Artificial Sequence
  chemically synthesized
tggtaggctaaaaggatact

SEQ ID NO: 302888 - DNA, 20 bp, Artificial Sequence
  chemically synthesized
taaaaggatactaagaatta

SEQ ID NO: 302889 - DNA, 20 bp, Artificial Sequence
  chemically synthesized
aatgtagaaactgtaattct

SEQ ID NO: 302890 - DNA, 20 bp, Artificial Sequence
  chemically synthesized
aaacctgtgcttggcaaatg

SEQ ID NO: 302891 - DNA, 20 bp, Artificial Sequence
  chemically synthesized
ttacagtttctacatttgcc

SEQ ID NO: 302892 - DNA, 20 bp, Artificial Sequence
  chemically synthesized
gtttctacatttgccaagca

SEQ ID NO: 302893 - DNA, 20 bp, Artificial Sequence
  chemically synthesized
tttctacatttgccaagcac

SEQ ID NO: 302894 - DNA, 20 bp, Artificial Sequence
  chemically synthesized
gagaagataaaacctgtgct

SEQ ID NO: 302895 - DNA, 20 bp, Artificial Sequence
  chemically synthesized
agcacaggttttatcttctc

SEQ ID NO: 302896 - DNA, 20 bp, Artificial Sequence
  chemically synthesized
gcacaggttttatcttctct

SEQ ID NO: 302897 - DNA, 20 bp, Artificial Sequence
  chemically synthesized
aatctatggagatcctagag

SEQ ID NO: 302898 - DNA, 20 bp, Artificial Sequence
  chemically synthesized
atgaatctatggagatccta

SEQ ID NO: 302899 - DNA, 20 bp, Artificial Sequence
  chemically synthesized
taatgaatctatggagatcc

SEQ ID NO: 302900 - DNA, 20 bp, Artificial Sequence
  chemically synthesized
tatcttctctaggatctcca

SEQ ID NO: 302901 - DNA, 20 bp, Artificial Sequence
  chemically synthesized
ttctaaataatgaatctatg

SEQ ID NO: 302902 - DNA, 20 bp, Artificial Sequence
  chemically synthesized
cattctaaataatgaatcta

SEQ ID NO: 302903 - DNA, 20 bp, Artificial Sequence
  chemically synthesized
atctccatagattcattatt

SEQ ID NO: 302904 - DNA, 20 bp, Artificial Sequence
  chemically synthesized
aattaaagttgtttgaggtt

SEQ ID NO: 302905 - DNA, 20 bp, Artificial Sequence
  chemically synthesized
cttataattaaagttgtttg

SEQ ID NO: 302906 - DNA, 20 bp, Artificial Sequence
  chemically synthesized
acttataattaaagttgttt

SEQ ID NO: 302907 - DNA, 20 bp, Artificial Sequence
  chemically synthesized
cctcaaacaactttaattat

SEQ ID NO: 302908 - DNA, 20 bp, Artificial Sequence
  chemically synthesized
tgtcaacagacttataatta

SEQ ID NO: 302909 - DNA, 20 bp, Artificial Sequence
  chemically synthesized
ttaattataagtctgttgac

SEQ ID NO: 302910 - DNA, 20 bp, Artificial Sequence
  chemically synthesized
atcttgacataacttgtcaa

SEQ ID NO: 302911 - DNA, 20 bp, Artificial Sequence
  chemically synthesized
gtctgttgacaagttatgtc

SEQ ID NO: 302912 - DNA, 20 bp, Artificial Sequence
  chemically synthesized
gacaagttatgtcaagatga

SEQ ID NO: 302913 - DNA, 20 bp, Artificial Sequence
  chemically synthesized
aagttatgtcaagatgaaag

SEQ ID NO: 302914 - DNA, 20 bp, Artificial Sequence
  chemically synthesized
tatgtcaagatgaaagcaga

SEQ ID NO: 302915 - DNA, 20 bp, Artificial Sequence
  chemically synthesized
gatgaaagcagaaagcaaca

SEQ ID NO: 302916 - DNA, 20 bp, Artificial Sequence
  chemically synthesized
aagcaacatagctctaaaaa

SEQ ID NO: 302917 - DNA, 20 bp, Artificial Sequence
  chemically synthesized
tatattttaagcttttttta

SEQ ID NO: 302918 - DNA, 20 bp, Artificial Sequence
  chemically synthesized
tttatattttaagctttttt

SEQ ID NO: 302919 - DNA, 20 bp, Artificial Sequence
  chemically synthesized
aatgtttgagtttatatttt

SEQ ID NO: 302920 - DNA, 20 bp, Artificial Sequence
  chemically synthesized
ttgtgttgggtgcaatgttt

SEQ ID NO: 302921 - DNA, 20 bp, Artificial Sequence
  chemically synthesized
cgtaatggtcattttgtgtt

SEQ ID NO: 302922 - DNA, 20 bp, Artificial Sequence
  chemically synthesized
acgtaatggtcattttgtgt

SEQ ID NO: 302923 - DNA, 20 bp, Artificial Sequence
  chemically synthesized
aaactaattttatcacgtaa

SEQ ID NO: 302924 - DNA, 20 bp, Artificial Sequence
  chemically synthesized
tgaccattacgtgataaaat

SEQ ID NO: 302925 - DNA, 20 bp, Artificial Sequence
  chemically synthesized
gataaaattagttttatttc

SEQ ID NO: 302926 - DNA, 20 bp, Artificial Sequence
  chemically synthesized
tagttttatttctagtcaaa

SEQ ID NO: 302927 - DNA, 20 bp, Artificial Sequence
  chemically synthesized
aactacattttctttttgac

SEQ ID NO: 302928 - DNA, 20 bp, Artificial Sequence
  chemically synthesized
ttctagtcaaaaagaaaatg

SEQ ID NO: 302929 - DNA, 20 bp, Artificial Sequence
  chemically synthesized
caaaaagaaaatgtagtttt

SEQ ID NO: 302930 - DNA, 20 bp, Artificial Sequence
  chemically synthesized
aaagaaaatgtagtttttag

SEQ ID NO: 302931 - DNA, 20 bp, Artificial Sequence
  chemically synthesized
aagaaaatgtagtttttagt

SEQ ID NO: 302932 - DNA, 20 bp, Artificial Sequence
  chemically synthesized
gtagtttttagtaggattcc

SEQ ID NO: 302933 - DNA, 20 bp, Artificial Sequence
  chemically synthesized
agtttttagtaggattccaa

SEQ ID NO: 302934 - DNA, 20 bp, Artificial Sequence
  chemically synthesized
aattacaaagtaaatgctct

SEQ ID NO: 302935 - DNA, 20 bp, Artificial Sequence
  chemically synthesized
taaaaaatattcaaattaca

SEQ ID NO: 302936 - DNA, 20 bp, Artificial Sequence
  chemically synthesized
tttgaatattttttaaccat

SEQ ID NO: 302937 - DNA, 20 bp, Artificial Sequence
  chemically synthesized
ttgcaaagcaagttttctca

SEQ ID NO: 302938 - DNA, 20 bp, Artificial Sequence
  chemically synthesized
ctgcattttctttgcaaagc

SEQ ID NO: 302939 - DNA, 20 bp, Artificial Sequence
  chemically synthesized
atgagaaaacttgctttgca

SEQ ID NO: 302940 - DNA, 20 bp, Artificial Sequence
  chemically synthesized
aaaactgcattttctttgca

SEQ ID NO: 302941 - DNA, 20 bp, Artificial Sequence
  chemically synthesized
cttgctttgcaaagaaaatg

SEQ ID NO: 302942 - DNA, 20 bp, Artificial Sequence
  chemically synthesized
tgcaaagaaaatgcagtttt

SEQ ID NO: 302943 - DNA, 20 bp, Artificial Sequence
  chemically synthesized
aaagaaaatgcagtttttag

SEQ ID NO: 302944 - DNA, 20 bp, Artificial Sequence
  chemically synthesized
aagaaaatgcagtttttagt

SEQ ID NO: 302945 - DNA, 20 bp, Artificial Sequence
  chemically synthesized
gcagtttttagtaggatccc

SEQ ID NO: 302946 - DNA, 20 bp, Artificial Sequence
  chemically synthesized
ataaaaaaataaattatctt

SEQ ID NO: 302947 - DNA, 20 bp, Artificial Sequence
  chemically synthesized
aataaaaaaataaattatct

SEQ ID NO: 302948 - DNA, 20 bp, Artificial Sequence
  chemically synthesized
ttgaatatttttttaaccat

SEQ ID NO: 302949 - DNA, 20 bp, Artificial Sequence
  chemically synthesized
atgcaaagaaagtgtgctca

SEQ ID NO: 302950 - DNA, 20 bp, Artificial Sequence
  chemically synthesized
gcctccactgtatgcaaaga

SEQ ID NO: 302951 - DNA, 20 bp, Artificial Sequence
  chemically synthesized
gagcacactttctttgcata

SEQ ID NO: 302952 - DNA, 20 bp, Artificial Sequence
  chemically synthesized
tctagcctccactgtatgca

SEQ ID NO: 302953 - DNA, 20 bp, Artificial Sequence
  chemically synthesized
cacactttctttgcatacag

SEQ ID NO: 302954 - DNA, 20 bp, Artificial Sequence
  chemically synthesized
cactttctttgcatacagtg

SEQ ID NO: 302955 - DNA, 20 bp, Artificial Sequence
  chemically synthesized
actttctttgcatacagtgg

SEQ ID NO: 302956 - DNA, 20 bp, Artificial Sequence
  chemically synthesized
tctttgcatacagtggaggc

SEQ ID NO: 302957 - DNA, 20 bp, Artificial Sequence
  chemically synthesized
ttgcatacagtggaggctag

SEQ ID NO: 302958 - DNA, 20 bp, Artificial Sequence
  chemically synthesized
atctgcaaaatattatcttc

SEQ ID NO: 302959 - DNA, 20 bp, Artificial Sequence
  chemically synthesized
ggctagaagataatattttg

SEQ ID NO: 302960 - DNA, 20 bp, Artificial Sequence
  chemically synthesized
aagataatattttgcagatt

SEQ ID NO: 302961 - DNA, 20 bp, Artificial Sequence
  chemically synthesized
tggtctgtatgtttaaaatt

SEQ ID NO: 302962 - DNA, 20 bp, Artificial Sequence
  chemically synthesized
ctggtctgtatgtttaaaat

SEQ ID NO: 302963 - DNA, 20 bp, Artificial Sequence
  chemically synthesized
aatacctaattttaaacata

SEQ ID NO: 302964 - DNA, 20 bp, Artificial Sequence
  chemically synthesized
ctaattttaaacatacagac

SEQ ID NO: 302965 - DNA, 20 bp, Artificial Sequence
  chemically synthesized
taaacatacagaccagaatg

SEQ ID NO: 302966 - DNA, 20 bp, Artificial Sequence
  chemically synthesized
aacatacagaccagaatgca

SEQ ID NO: 302967 - DNA, 20 bp, Artificial Sequence
  chemically synthesized
ttttcagaatctctgcattc

SEQ ID NO: 302968 - DNA, 20 bp, Artificial Sequence
  chemically synthesized
atgaattagcttggtatttt

SEQ ID NO: 302969 - DNA, 20 bp, Artificial Sequence
  chemically synthesized
gcagagattctgaaaatacc

SEQ ID NO: 302970 - DNA, 20 bp, Artificial Sequence
  chemically synthesized
tataactgcatgaattagct

SEQ ID NO: 302971 - DNA, 20 bp, Artificial Sequence
  chemically synthesized
aaataccaagctaattcatg

SEQ ID NO: 302972 - DNA, 20 bp, Artificial Sequence
  chemically synthesized
ttggatataactgcatgaat

SEQ ID NO: 302973 - DNA, 20 bp, Artificial Sequence
  chemically synthesized
tgcagttatatccaatctca

SEQ ID NO: 302974 - DNA, 20 bp, Artificial Sequence
  chemically synthesized
gcacaaatgttctatgagat

SEQ ID NO: 302975 - DNA, 20 bp, Artificial Sequence
  chemically synthesized
tagtagcacaaatgttctat

SEQ ID NO: 302976 - DNA, 20 bp, Artificial Sequence
  chemically synthesized
tttaagagtcaaatttttag

SEQ ID NO: 302977 - DNA, 20 bp, Artificial Sequence
  chemically synthesized
taatttaagagtcaaatttt

SEQ ID NO: 302978 - DNA, 20 bp, Artificial Sequence
  chemically synthesized
tattacagaaattaatttaa

SEQ ID NO: 302979 - DNA, 20 bp, Artificial Sequence
  chemically synthesized
aatattacagaaattaattt

SEQ ID NO: 302980 - DNA, 20 bp, Artificial Sequence
  chemically synthesized
ccacgaaaatattaatatta

SEQ ID NO: 302981 - DNA, 20 bp, Artificial Sequence
  chemically synthesized
ctgtaatattaatattttcg

SEQ ID NO: 302982 - DNA, 20 bp, Artificial Sequence
  chemically synthesized
catgtatccaattttataag

SEQ ID NO: 302983 - DNA, 20 bp, Artificial Sequence
  chemically synthesized
gtggtatctacttataaaat

SEQ ID NO: 302984 - DNA, 20 bp, Artificial Sequence
  chemically synthesized
gcacatgtatccaattttat

SEQ ID NO: 302985 - DNA, 20 bp, Artificial Sequence
  chemically synthesized
aaattggatacatgtgccca

SEQ ID NO: 302986 - DNA, 20 bp, Artificial Sequence
  chemically synthesized
attggatacatgtgcccatg

SEQ ID NO: 302987 - DNA, 20 bp, Artificial Sequence
  chemically synthesized
ttggatacatgtgcccatgg

SEQ ID NO: 302988 - DNA, 20 bp, Artificial Sequence
  chemically synthesized
tggatacatgtgcccatgga

SEQ ID NO: 302989 - DNA, 20 bp, Artificial Sequence
  chemically synthesized
catttccctttaccctccat

SEQ ID NO: 302990 - DNA, 20 bp, Artificial Sequence
  chemically synthesized
tcatttccctttaccctcca

SEQ ID NO: 302991 - DNA, 20 bp, Artificial Sequence
  chemically synthesized
acatgtgcccatggagggta

SEQ ID NO: 302992 - DNA, 20 bp, Artificial Sequence
  chemically synthesized
catgtgcccatggagggtaa

SEQ ID NO: 302993 - DNA, 20 bp, Artificial Sequence
  chemically synthesized
atgtgcccatggagggtaaa

SEQ ID NO: 302994 - DNA, 20 bp, Artificial Sequence
  chemically synthesized
tgacaacatgatatactgtg

SEQ ID NO: 302995 - DNA, 20 bp, Artificial Sequence
  chemically synthesized
caacatgatatactgtgaag

SEQ ID NO: 302996 - DNA, 20 bp, Artificial Sequence
  chemically synthesized
tatttttaaatgccgcttca

SEQ ID NO: 302997 - DNA, 20 bp, Artificial Sequence
  chemically synthesized
tttttctttcttaaaaggtt

SEQ ID NO: 302998 - DNA, 20 bp, Artificial Sequence
  chemically synthesized
aaaaatatactcaacctttt

SEQ ID NO: 302999 - DNA, 20 bp, Artificial Sequence
  chemically synthesized
atatactcaaccttttaaga

SEQ ID NO: 303000 - DNA, 20 bp, Artificial Sequence
  chemically synthesized
attcatttttctttcttaaa

SEQ ID NO: 303001 - DNA, 20 bp, Artificial Sequence
  chemically synthesized
gattcatttttctttcttaa

SEQ ID NO: 303002 - DNA, 20 bp, Artificial Sequence
  chemically synthesized
aaatgaatcatttttaataa

SEQ ID NO: 303003 - DNA, 20 bp, Artificial Sequence
  chemically synthesized
atgaatcatttttaataaaa

SEQ ID NO: 303004 - DNA, 20 bp, Artificial Sequence
  chemically synthesized
aatcatttttaataaaagag

SEQ ID NO: 303005 - DNA, 20 bp, Artificial Sequence
  chemically synthesized
atttttaataaaagagtagt

SEQ ID NO: 303006 - DNA, 20 bp, Artificial Sequence
  chemically synthesized
ataaaagagtagtaagacat

SEQ ID NO: 303007 - DNA, 20 bp, Artificial Sequence
  chemically synthesized
attattatatagaacaatta

SEQ ID NO: 303008 - DNA, 20 bp, Artificial Sequence
  chemically synthesized
gtgtagtagtgattattata

SEQ ID NO: 303009 - DNA, 20 bp, Artificial Sequence
  chemically synthesized
atttttcaattacagtgtag

SEQ ID NO: 303010 - DNA, 20 bp, Artificial Sequence
  chemically synthesized
agtatttttcaattacagtg

SEQ ID NO: 303011 - DNA, 20 bp, Artificial Sequence
  chemically synthesized
gaagtagtatttttcaatta

SEQ ID NO: 303012 - DNA, 20 bp, Artificial Sequence
  chemically synthesized
ccatcccgaaggaaatgaag

SEQ ID NO: 303013 - DNA, 20 bp, Artificial Sequence
  chemically synthesized
tctccatcccgaaggaaatg

SEQ ID NO: 303014 - DNA, 20 bp, Artificial Sequence
  chemically synthesized
aaatactacttcatttcctt

SEQ ID NO: 303015 - DNA, 20 bp, Artificial Sequence
  chemically synthesized
aatactacttcatttccttc

SEQ ID NO: 303016 - DNA, 20 bp, Artificial Sequence
  chemically synthesized
ctacttcatttccttcggga

SEQ ID NO: 303017 - DNA, 20 bp, Artificial Sequence
  chemically synthesized
ttcttatttctccatcccga

SEQ ID NO: 303018 - DNA, 20 bp, Artificial Sequence
  chemically synthesized
acttcatttccttcgggatg

SEQ ID NO: 303019 - DNA, 20 bp, Artificial Sequence
  chemically synthesized
tttcttatttctccatcccg

SEQ ID NO: 303020 - DNA, 20 bp, Artificial Sequence
  chemically synthesized
ttccttcgggatggagaaat

SEQ ID NO: 303021 - DNA, 20 bp, Artificial Sequence
  chemically synthesized
atatttacagggtgaatgca

SEQ ID NO: 303022 - DNA, 20 bp, Artificial Sequence
  chemically synthesized
agttctaccctatatttaca

SEQ ID NO: 303023 - DNA, 20 bp, Artificial Sequence
  chemically synthesized
gtgcattcaccctgtaaata

SEQ ID NO: 303024 - DNA, 20 bp, Artificial Sequence
  chemically synthesized
gagttctaccctatatttac

SEQ ID NO: 303025 - DNA, 20 bp, Artificial Sequence
  chemically synthesized
tgcattcaccctgtaaatat

SEQ ID NO: 303026 - DNA, 20 bp, Artificial Sequence
  chemically synthesized
tgagttctaccctatattta

SEQ ID NO: 303027 - DNA, 20 bp, Artificial Sequence
  chemically synthesized
gcattcaccctgtaaatata

SEQ ID NO: 303028 - DNA, 20 bp, Artificial Sequence
  chemically synthesized
ttcaccctgtaaatataggg

SEQ ID NO: 303029 - DNA, 20 bp, Artificial Sequence
  chemically synthesized
attaatttgttatatgtaat

SEQ ID NO: 303030 - DNA, 20 bp, Artificial Sequence
  chemically synthesized
ttgtatgaagtaggttttga

SEQ ID NO: 303031 - DNA, 20 bp, Artificial Sequence
  chemically synthesized
gattgtatgaagtaggtttt

SEQ ID NO: 303032 - DNA, 20 bp, Artificial Sequence
  chemically synthesized
ttattctgattgtatgaagt

SEQ ID NO: 303033 - DNA, 20 bp, Artificial Sequence
  chemically synthesized
tttattctgattgtatgaag

SEQ ID NO: 303034 - DNA, 20 bp, Artificial Sequence
  chemically synthesized
ttttttattctgattgtatg

SEQ ID NO: 303035 - DNA, 20 bp, Artificial Sequence
  chemically synthesized
caaaacctacttcatacaat

SEQ ID NO: 303036 - DNA, 20 bp, Artificial Sequence
  chemically synthesized
caatcagaataaaaaacaat

SEQ ID NO: 303037 - DNA, 20 bp, Artificial Sequence
  chemically synthesized
ctataagccataaggaaatt

SEQ ID NO: 303038 - DNA, 20 bp, Artificial Sequence
  chemically synthesized
tcatgtactaaatttcctta

SEQ ID NO: 303039 - DNA, 20 bp, Artificial Sequence
  chemically synthesized
gtcaataactataagccata

SEQ ID NO: 303040 - DNA, 20 bp, Artificial Sequence
  chemically synthesized
agtcaataactataagccat

SEQ ID NO: 303041 - DNA, 20 bp, Artificial Sequence
  chemically synthesized
ctaaatttccttatggctta

SEQ ID NO: 303042 - DNA, 20 bp, Artificial Sequence
  chemically synthesized
tagttatagtcaataactat

SEQ ID NO: 303043 - DNA, 20 bp, Artificial Sequence
  chemically synthesized
ttaagtgtcaataatagtta

SEQ ID NO: 303044 - DNA, 20 bp, Artificial Sequence
  chemically synthesized
acataattaagtgtcaataa

SEQ ID NO: 303045 - DNA, 20 bp, Artificial Sequence
  chemically synthesized
aatgattctaacacataatt

SEQ ID NO: 303046 - DNA, 20 bp, Artificial Sequence
  chemically synthesized
attgacacttaattatgtgt

SEQ ID NO: 303047 - DNA, 20 bp, Artificial Sequence
  chemically synthesized
taattatgtgttagaatcat

SEQ ID NO: 303048 - DNA, 20 bp, Artificial Sequence
  chemically synthesized
aattatgtgttagaatcatt

SEQ ID NO: 303049 - DNA, 20 bp, Artificial Sequence
  chemically synthesized
gttagaatcattaggaaata

SEQ ID NO: 303050 - DNA, 20 bp, Artificial Sequence
  chemically synthesized
gaatcattaggaaatataga

SEQ ID NO: 303051 - DNA, 20 bp, Artificial Sequence
  chemically synthesized
aatcattaggaaatatagac

SEQ ID NO: 303052 - DNA, 20 bp, Artificial Sequence
  chemically synthesized
tcattaggaaatatagacag

SEQ ID NO: 303053 - DNA, 20 bp, Artificial Sequence
  chemically synthesized
attaggaaatatagacagga

SEQ ID NO: 303054 - DNA, 20 bp, Artificial Sequence
  chemically synthesized
ttaggaaatatagacaggag

SEQ ID NO: 303055 - DNA, 20 bp, Artificial Sequence
  chemically synthesized
taggaaatatagacaggaga

SEQ ID NO: 303056 - DNA, 20 bp, Artificial Sequence
  chemically synthesized
tagacaggagagggactacg

SEQ ID NO: 303057 - DNA, 20 bp, Artificial Sequence
  chemically synthesized
agacaggagagggactacga

SEQ ID NO: 303058 - DNA, 20 bp, Artificial Sequence
  chemically synthesized
gtcatgttaaatggccttcg

SEQ ID NO: 303059 - DNA, 20 bp, Artificial Sequence
  chemically synthesized
aatcaggaggtcatgttaaa

SEQ ID NO: 303060 - DNA, 20 bp, Artificial Sequence
  chemically synthesized
tgagctctgtaataatcagg

SEQ ID NO: 303061 - DNA, 20 bp, Artificial Sequence
  chemically synthesized
gtgagctctgtaataatcag

SEQ ID NO: 303062 - DNA, 20 bp, Artificial Sequence
  chemically synthesized
tagtgagctctgtaataatc

SEQ ID NO: 303063 - DNA, 20 bp, Artificial Sequence
  chemically synthesized
acatgacctcctgattatta

SEQ ID NO: 303064 - DNA, 20 bp, Artificial Sequence
  chemically synthesized
gtagtgagctctgtaataat

SEQ ID NO: 303065 - DNA, 20 bp, Artificial Sequence
  chemically synthesized
atgacctcctgattattaca

SEQ ID NO: 303066 - DNA, 20 bp, Artificial Sequence
  chemically synthesized
tttctgtttcagggagtagt

SEQ ID NO: 303067 - DNA, 20 bp, Artificial Sequence
  chemically synthesized
gagctttctgtttcagggag

SEQ ID NO: 303068 - DNA, 20 bp, Artificial Sequence
  chemically synthesized
gagctcactactccctgaaa

SEQ ID NO: 303069 - DNA, 20 bp, Artificial Sequence
  chemically synthesized
aaggagctttctgtttcagg

SEQ ID NO: 303070 - DNA, 20 bp, Artificial Sequence
  chemically synthesized
gaaaggagctttctgtttca

SEQ ID NO: 303071 - DNA, 20 bp, Artificial Sequence
  chemically synthesized
agaaaggagctttctgtttc

SEQ ID NO: 303072 - DNA, 20 bp, Artificial Sequence
  chemically synthesized
tcactactccctgaaacaga

SEQ ID NO: 303073 - DNA, 20 bp, Artificial Sequence
  chemically synthesized
aagaaaggagctttctgttt

SEQ ID NO: 303074 - DNA, 20 bp, Artificial Sequence
  chemically synthesized
gaaacagaaagctcctttct

SEQ ID NO: 303075 - DNA, 20 bp, Artificial Sequence
  chemically synthesized
ttgcttgcatgctaagaaag

SEQ ID NO: 303076 - DNA, 20 bp, Artificial Sequence
  chemically synthesized
gtttgcttgcatgctaagaa

SEQ ID NO: 303077 - DNA, 20 bp, Artificial Sequence
  chemically synthesized
agtttgcttgcatgctaaga

SEQ ID NO: 303078 - DNA, 20 bp, Artificial Sequence
  chemically synthesized
aagctcctttcttagcatgc

SEQ ID NO: 303079 - DNA, 20 bp, Artificial Sequence
  chemically synthesized
ggaaagtttgcttgcatgct

SEQ ID NO: 303080 - DNA, 20 bp, Artificial Sequence
  chemically synthesized
tgcaagcaaactttccccat

SEQ ID NO: 303081 - DNA, 20 bp, Artificial Sequence
  chemically synthesized
aacatctttcccaatgggga

SEQ ID NO: 303082 - DNA, 20 bp, Artificial Sequence
  chemically synthesized
gcaagcaaactttccccatt

SEQ ID NO: 303083 - DNA, 20 bp, Artificial Sequence
  chemically synthesized
taagaacatctttcccaatg

SEQ ID NO: 303084 - DNA, 20 bp, Artificial Sequence
  chemically synthesized
gcaaactttccccattggga

SEQ ID NO: 303085 - DNA, 20 bp, Artificial Sequence
  chemically synthesized
ttaagaacatctttcccaat

SEQ ID NO: 303086 - DNA, 20 bp, Artificial Sequence
  chemically synthesized
gttaagaacatctttcccaa

SEQ ID NO: 303087 - DNA, 20 bp, Artificial Sequence
  chemically synthesized
ggaaagatgttcttaacaac

SEQ ID NO: 303088 - DNA, 20 bp, Artificial Sequence
  chemically synthesized
gcaggattcctctggttgtt

SEQ ID NO: 303089 - DNA, 20 bp, Artificial Sequence
  chemically synthesized
aaagatgttcttaacaacca

SEQ ID NO: 303090 - DNA, 20 bp, Artificial Sequence
  chemically synthesized
aagatgttcttaacaaccag

SEQ ID NO: 303091 - DNA, 20 bp, Artificial Sequence
  chemically synthesized
ttaatcaggcaggattcctc

SEQ ID NO: 303092 - DNA, 20 bp, Artificial Sequence
  chemically synthesized
agaggaagtcttaatcaggc

SEQ ID NO: 303093 - DNA, 20 bp, Artificial Sequence
  chemically synthesized
cagaggaatcctgcctgatt

SEQ ID NO: 303094 - DNA, 20 bp, Artificial Sequence
  chemically synthesized
aagaggaagtcttaatcagg

SEQ ID NO: 303095 - DNA, 20 bp, Artificial Sequence
  chemically synthesized
aacaagaggaagtcttaatc

SEQ ID NO: 303096 - DNA, 20 bp, Artificial Sequence
  chemically synthesized
taacaagaggaagtcttaat

SEQ ID NO: 303097 - DNA, 20 bp, Artificial Sequence
  chemically synthesized
aaacaagttttaacaagagg

SEQ ID NO: 303098 - DNA, 20 bp, Artificial Sequence
  chemically synthesized
tcaaaacaagttttaacaag

SEQ ID NO: 303099 - DNA, 20 bp, Artificial Sequence
  chemically synthesized
ctcaaaacaagttttaacaa

SEQ ID NO: 303100 - DNA, 20 bp, Artificial Sequence
  chemically synthesized
aactcaaaacaagttttaac

SEQ ID NO: 303101 - DNA, 20 bp, Artificial Sequence
  chemically synthesized
ctcttgttaaaacttgtttt

SEQ ID NO: 303102 - DNA, 20 bp, Artificial Sequence
  chemically synthesized
tttcattcagaactcaaaac

SEQ ID NO: 303103 - DNA, 20 bp, Artificial Sequence
  chemically synthesized
ttgttttgagttctgaatga

SEQ ID NO: 303104 - DNA, 20 bp, Artificial Sequence
  chemically synthesized
caatttactctgctttcatt

SEQ ID NO: 303105 - DNA, 20 bp, Artificial Sequence
  chemically synthesized
ttttgagttctgaatgaaag

SEQ ID NO: 303106 - DNA, 20 bp, Artificial Sequence
  chemically synthesized
ttgagttctgaatgaaagca

SEQ ID NO: 303107 - DNA, 20 bp, Artificial Sequence
  chemically synthesized
tcaaatcttagaatatcagg

SEQ ID NO: 303108 - DNA, 20 bp, Artificial Sequence
  chemically synthesized
atttcaaatcttagaatatc

SEQ ID NO: 303109 - DNA, 20 bp, Artificial Sequence
  chemically synthesized
tcatttctacctgatattct

SEQ ID NO: 303110 - DNA, 20 bp, Artificial Sequence
  chemically synthesized
gatttcaaatcttagaatat

SEQ ID NO: 303111 - DNA, 20 bp, Artificial Sequence
  chemically synthesized
gattattagatttcaaatct

SEQ ID NO: 303112 - DNA, 20 bp, Artificial Sequence
  chemically synthesized
tttatcagggtcatgattat

SEQ ID NO: 303113 - DNA, 20 bp, Artificial Sequence
  chemically synthesized
tttgaaaatgatatttatca

SEQ ID NO: 303114 - DNA, 20 bp, Artificial Sequence
  chemically synthesized
gtttgaaaatgatatttatc

SEQ ID NO: 303115 - DNA, 20 bp, Artificial Sequence
  chemically synthesized
agtttgaaaatgatatttat

SEQ ID NO: 303116 - DNA, 20 bp, Artificial Sequence
  chemically synthesized
agcaaataactggcattata

SEQ ID NO: 303117 - DNA, 20 bp, Artificial Sequence
  chemically synthesized
attttcaaactctataatgc

SEQ ID NO: 303118 - DNA, 20 bp, Artificial Sequence
  chemically synthesized
ctagcaaataactggcatta

SEQ ID NO: 303119 - DNA, 20 bp, Artificial Sequence
  chemically synthesized
atctacttctagcaaataac

SEQ ID NO: 303120 - DNA, 20 bp, Artificial Sequence
  chemically synthesized
ctataatgccagttatttgc

SEQ ID NO: 303121 - DNA, 20 bp, Artificial Sequence
  chemically synthesized
taatgccagttatttgctag

SEQ ID NO: 303122 - DNA, 20 bp, Artificial Sequence
  chemically synthesized
tgccagttatttgctagaag

SEQ ID NO: 303123 - DNA, 20 bp, Artificial Sequence
  chemically synthesized
aatcaagttatatctacttc

SEQ ID NO: 303124 - DNA, 20 bp, Artificial Sequence
  chemically synthesized
ttggttttggatgacgaatc

SEQ ID NO: 303125 - DNA, 20 bp, Artificial Sequence
  chemically synthesized
aagccaagaaacattggttt

SEQ ID NO: 303126 - DNA, 20 bp, Artificial Sequence
  chemically synthesized
tgtccaaagccaagaaacat

SEQ ID NO: 303127 - DNA, 20 bp, Artificial Sequence
  chemically synthesized
catccaaaaccaatgtttct

SEQ ID NO: 303128 - DNA, 20 bp, Artificial Sequence
  chemically synthesized
aaaccaatgtttcttggctt

SEQ ID NO: 303129 - DNA, 20 bp, Artificial Sequence
  chemically synthesized
tgactatggtgtccaaagcc

SEQ ID NO: 303130 - DNA, 20 bp, Artificial Sequence
  chemically synthesized
ttgattgactatggtgtcca

SEQ ID NO: 303131 - DNA, 20 bp, Artificial Sequence
  chemically synthesized
tttcttggctttggacacca

SEQ ID NO: 303132 - DNA, 20 bp, Artificial Sequence
  chemically synthesized
tagaattctttgattgacta

SEQ ID NO: 303133 - DNA, 20 bp, Artificial Sequence
  chemically synthesized
ttggacaccatagtcaatca

SEQ ID NO: 303134 - DNA, 20 bp, Artificial Sequence
  chemically synthesized
ctgaataacttacacagttt

SEQ ID NO: 303135 - DNA, 20 bp, Artificial Sequence
  chemically synthesized
aaagaattctaaaactgtgt

SEQ ID NO: 303136 - DNA, 20 bp, Artificial Sequence
  chemically synthesized
cagctgctgaataacttaca

SEQ ID NO: 303137 - DNA, 20 bp, Artificial Sequence
  chemically synthesized
ctaaaactgtgtaagttatt

SEQ ID NO: 303138 - DNA, 20 bp, Artificial Sequence
  chemically synthesized
aaactgtgtaagttattcag

SEQ ID NO: 303139 - DNA, 20 bp, Artificial Sequence
  chemically synthesized
ttattcagcagctgaaccac

SEQ ID NO: 303140 - DNA, 20 bp, Artificial Sequence
  chemically synthesized
tattcagcagctgaaccaca

SEQ ID NO: 303141 - DNA, 20 bp, Artificial Sequence
  chemically synthesized
tttatagaaaccttgtggtt

SEQ ID NO: 303142 - DNA, 20 bp, Artificial Sequence
  chemically synthesized
agaattttatagaaaccttg

SEQ ID NO: 303143 - DNA, 20 bp, Artificial Sequence
  chemically synthesized
caataaacattagaatttta

SEQ ID NO: 303144 - DNA, 20 bp, Artificial Sequence
  chemically synthesized
aatatatattcaataaacat

SEQ ID NO: 303145 - DNA, 20 bp, Artificial Sequence
  chemically synthesized
tattgaatatatattcacta

SEQ ID NO: 303146 - DNA, 20 bp, Artificial Sequence
  chemically synthesized
attgaatatatattcactat

SEQ ID NO: 303147 - DNA, 20 bp, Artificial Sequence
  chemically synthesized
actcatttctgaatgtccta

SEQ ID NO: 303148 - DNA, 20 bp, Artificial Sequence
  chemically synthesized
tatattcactataggacatt

SEQ ID NO: 303149 - DNA, 20 bp, Artificial Sequence
  chemically synthesized
actataggacattcagaaat

SEQ ID NO: 303150 - DNA, 20 bp, Artificial Sequence
  chemically synthesized
acattcagaaatgagtaaaa

SEQ ID NO: 303151 - DNA, 20 bp, Artificial Sequence
  chemically synthesized
taaaatagaaactccatatt

SEQ ID NO: 303152 - DNA, 20 bp, Artificial Sequence
  chemically synthesized
aaaatagaaactccatattt

SEQ ID NO: 303153 - DNA, 20 bp, Artificial Sequence
  chemically synthesized
ccgtaaggttcctaaatatg

SEQ ID NO: 303154 - DNA, 20 bp, Artificial Sequence
  chemically synthesized
tgccgtaaggttcctaaata

SEQ ID NO: 303155 - DNA, 20 bp, Artificial Sequence
  chemically synthesized
ctccatatttaggaacctta

SEQ ID NO: 303156 - DNA, 20 bp, Artificial Sequence
  chemically synthesized
atcgtccctattttgccgta

SEQ ID NO: 303157 - DNA, 20 bp, Artificial Sequence
  chemically synthesized
catcgtccctattttgccgt

SEQ ID NO: 303158 - DNA, 20 bp, Artificial Sequence
  chemically synthesized
ttaggaaccttacggcaaaa

SEQ ID NO: 303159 - DNA, 20 bp, Artificial Sequence
  chemically synthesized
taggaaccttacggcaaaat

SEQ ID NO: 303160 - DNA, 20 bp, Artificial Sequence
  chemically synthesized
aggaaccttacggcaaaata

SEQ ID NO: 303161 - DNA, 20 bp, Artificial Sequence
  chemically synthesized
taatcacacaaataattgtg

SEQ ID NO: 303162 - DNA, 20 bp, Artificial Sequence
  chemically synthesized
gcatactggtatttttcacg

SEQ ID NO: 303163 - DNA, 20 bp, Artificial Sequence
  chemically synthesized
gaatgccacgtgaaaaatac

SEQ ID NO: 303164 - DNA, 20 bp, Artificial Sequence
  chemically synthesized
tatgtaattattttgcatac

SEQ ID NO: 303165 - DNA, 20 bp, Artificial Sequence
  chemically synthesized
aattacatacaccaaacata

SEQ ID NO: 303166 - DNA, 20 bp, Artificial Sequence
  chemically synthesized
ttacttgattactgtatgtt

SEQ ID NO: 303167 - DNA, 20 bp, Artificial Sequence
  chemically synthesized
acaccaaacatacagtaatc

SEQ ID NO: 303168 - DNA, 20 bp, Artificial Sequence
  chemically synthesized
ctgttttcataacatttaaa

SEQ ID NO: 303169 - DNA, 20 bp, Artificial Sequence
  chemically synthesized
atctgttttcataacattta

SEQ ID NO: 303170 - DNA, 20 bp, Artificial Sequence
  chemically synthesized
ctctttaaatgttatgaaaa

SEQ ID NO: 303171 - DNA, 20 bp, Artificial Sequence
  chemically synthesized
ttatgaaaacagatttctct

SEQ ID NO: 303172 - DNA, 20 bp, Artificial Sequence
  chemically synthesized
gaaaacagatttctctcagc

SEQ ID NO: 303173 - DNA, 20 bp, Artificial Sequence
  chemically synthesized
aatgttaaaatgctagctga

SEQ ID NO: 303174 - DNA, 20 bp, Artificial Sequence
  chemically synthesized
taaatgttaaaatgctagct

SEQ ID NO: 303175 - DNA, 20 bp, Artificial Sequence
  chemically synthesized
aaatctaaatgttaaaatgc

SEQ ID NO: 303176 - DNA, 20 bp, Artificial Sequence
  chemically synthesized
tcagctagcattttaacatt

SEQ ID NO: 303177 - DNA, 20 bp, Artificial Sequence
  chemically synthesized
ttagatttaatttgatgctg

SEQ ID NO: 303178 - DNA, 20 bp, Artificial Sequence
  chemically synthesized
tagatttaatttgatgctga

SEQ ID NO: 303179 - DNA, 20 bp, Artificial Sequence
  chemically synthesized
tttaatttgatgctgaaggc

SEQ ID NO: 303180 - DNA, 20 bp, Artificial Sequence
  chemically synthesized
taaatattatatctagcctt

SEQ ID NO: 303181 - DNA, 20 bp, Artificial Sequence
  chemically synthesized
acaaggataaatattatatc

SEQ ID NO: 303182 - DNA, 20 bp, Artificial Sequence
  chemically synthesized
ataatatttatccttgttta

SEQ ID NO: 303183 - DNA, 20 bp, Artificial Sequence
  chemically synthesized
taatatttatccttgtttat

SEQ ID NO: 303184 - DNA, 20 bp, Artificial Sequence
  chemically synthesized
ttagaaagaccctataaaca

SEQ ID NO: 303185 - DNA, 20 bp, Artificial Sequence
  chemically synthesized
aatatttatccttgtttata

SEQ ID NO: 303186 - DNA, 20 bp, Artificial Sequence
  chemically synthesized
gttagaaagaccctataaac

SEQ ID NO: 303187 - DNA, 20 bp, Artificial Sequence
  chemically synthesized
tgtttatagggtctttctaa

SEQ ID NO: 303188 - DNA, 20 bp, Artificial Sequence
  chemically synthesized
ttccaaaagttactgttaga

SEQ ID NO: 303189 - DNA, 20 bp, Artificial Sequence
  chemically synthesized
ttgtttccaaaagttactgt

SEQ ID NO: 303190 - DNA, 20 bp, Artificial Sequence
  chemically synthesized
gtctttctaacagtaacttt

SEQ ID NO: 303191 - DNA, 20 bp, Artificial Sequence
  chemically synthesized
tgacatgaggttgtttccaa

SEQ ID NO: 303192 - DNA, 20 bp, Artificial Sequence
  chemically synthesized
ttggaaacaacctcatgtca

SEQ ID NO: 303193 - DNA, 20 bp, Artificial Sequence
  chemically synthesized
aaaccatcatctatgacatg

SEQ ID NO: 303194 - DNA, 20 bp, Artificial Sequence
  chemically synthesized
taaaccatcatctatgacat

SEQ ID NO: 303195 - DNA, 20 bp, Artificial Sequence
  chemically synthesized
caacctcatgtcatagatga

SEQ ID NO: 303196 - DNA, 20 bp, Artificial Sequence
  chemically synthesized
catgtcatagatgatggttt

SEQ ID NO: 303197 - DNA, 20 bp, Artificial Sequence
  chemically synthesized
atgatggtttaagtacatta

SEQ ID NO: 303198 - DNA, 20 bp, Artificial Sequence
  chemically synthesized
tacattatggtatatgaatg

SEQ ID NO: 303199 - DNA, 20 bp, Artificial Sequence
  chemically synthesized
ttatggtatatgaatgtgga

SEQ ID NO: 303200 - DNA, 20 bp, Artificial Sequence
  chemically synthesized
atggtatatgaatgtggatg

SEQ ID NO: 303201 - DNA, 20 bp, Artificial Sequence
  chemically synthesized
ttcaaatattttaatgtcat

SEQ ID NO: 303202 - DNA, 20 bp, Artificial Sequence
  chemically synthesized
attgtttactcaatagtgta

SEQ ID NO: 303203 - DNA, 20 bp, Artificial Sequence
  chemically synthesized
aacgtttgctttacactatt

SEQ ID NO: 303204 - DNA, 20 bp, Artificial Sequence
  chemically synthesized
gtctagcattgtttactcaa

SEQ ID NO: 303205 - DNA, 20 bp, Artificial Sequence
  chemically synthesized
cactattgagtaaacaatgc

SEQ ID NO: 303206 - DNA, 20 bp, Artificial Sequence
  chemically synthesized
aatcaaccaatgtttatgtc

SEQ ID NO: 303207 - DNA, 20 bp, Artificial Sequence
  chemically synthesized
acaatgctagacataaacat

SEQ ID NO: 303208 - DNA, 20 bp, Artificial Sequence
  chemically synthesized
aaacattggttgatttttga

SEQ ID NO: 303209 - DNA, 20 bp, Artificial Sequence
  chemically synthesized
acattggttgatttttgaca

SEQ ID NO: 303210 - DNA, 20 bp, Artificial Sequence
  chemically synthesized
tggttgatttttgacagaga

SEQ ID NO: 303211 - DNA, 20 bp, Artificial Sequence
  chemically synthesized
ttgatttttgacagagaaag

SEQ ID NO: 303212 - DNA, 20 bp, Artificial Sequence
  chemically synthesized
gatttttgacagagaaagta

SEQ ID NO: 303213 - DNA, 20 bp, Artificial Sequence
  chemically synthesized
tagagaaaatttctgttgca

SEQ ID NO: 303214 - DNA, 20 bp, Artificial Sequence
  chemically synthesized
cagaaatatacactgtgcaa

SEQ ID NO: 303215 - DNA, 20 bp, Artificial Sequence
  chemically synthesized
ctttggaaactaaaggaata

SEQ ID NO: 303216 - DNA, 20 bp, Artificial Sequence
  chemically synthesized
tgtatatttctgtattcctt

SEQ ID NO: 303217 - DNA, 20 bp, Artificial Sequence
  chemically synthesized
agaagaactttggaaactaa

SEQ ID NO: 303218 - DNA, 20 bp, Artificial Sequence
  chemically synthesized
tagaagaactttggaaacta

SEQ ID NO: 303219 - DNA, 20 bp, Artificial Sequence
  chemically synthesized
ctgtattcctttagtttcca

SEQ ID NO: 303220 - DNA, 20 bp, Artificial Sequence
  chemically synthesized
aatatcttatagaagaactt

SEQ ID NO: 303221 - DNA, 20 bp, Artificial Sequence
  chemically synthesized
agtttccaaagttcttctat

SEQ ID NO: 303222 - DNA, 20 bp, Artificial Sequence
  chemically synthesized
ttgcagataatatcttatag

SEQ ID NO: 303223 - DNA, 20 bp, Artificial Sequence
  chemically synthesized
attttgcagataatatctta

SEQ ID NO: 303224 - DNA, 20 bp, Artificial Sequence
  chemically synthesized
cttacaaatgcaacattttg

SEQ ID NO: 303225 - DNA, 20 bp, Artificial Sequence
  chemically synthesized
ctgcaaaatgttgcatttgt

SEQ ID NO: 303226 - DNA, 20 bp, Artificial Sequence
  chemically synthesized
aaatgttgcatttgtaagca

SEQ ID NO: 303227 - DNA, 20 bp, Artificial Sequence
  chemically synthesized
taagcaaagaaaaattttga

SEQ ID NO: 303228 - DNA, 20 bp, Artificial Sequence
  chemically synthesized
tagatttaaaacaaacagtt

SEQ ID NO: 303229 - DNA, 20 bp, Artificial Sequence
  chemically synthesized
aatgatagatttaaaacaaa

SEQ ID NO: 303230 - DNA, 20 bp, Artificial Sequence
  chemically synthesized
taatatataaatagaaatga

SEQ ID NO: 303231 - DNA, 20 bp, Artificial Sequence
  chemically synthesized
catagatcttaatatataaa

SEQ ID NO: 303232 - DNA, 20 bp, Artificial Sequence
  chemically synthesized
atcatttctatttatatatt

SEQ ID NO: 303233 - DNA, 20 bp, Artificial Sequence
  chemically synthesized
tatttatatattaagatcta

SEQ ID NO: 303234 - DNA, 20 bp, Artificial Sequence
  chemically synthesized
gtgacaggagtatgattcca

SEQ ID NO: 303235 - DNA, 20 bp, Artificial Sequence
  chemically synthesized
tctaatgcattgagtgacag

SEQ ID NO: 303236 - DNA, 20 bp, Artificial Sequence
  chemically synthesized
attctaatgcattgagtgac

SEQ ID NO: 303237 - DNA, 20 bp, Artificial Sequence
  chemically synthesized
cattctaatgcattgagtga

SEQ ID NO: 303238 - DNA, 20 bp, Artificial Sequence
  chemically synthesized
actcctgtcactcaatgcat

SEQ ID NO: 303239 - DNA, 20 bp, Artificial Sequence
  chemically synthesized
tttcctcattctaatgcatt

SEQ ID NO: 303240 - DNA, 20 bp, Artificial Sequence
  chemically synthesized
gtcactcaatgcattagaat

SEQ ID NO: 303241 - DNA, 20 bp, Artificial Sequence
  chemically synthesized
tcactcaatgcattagaatg

SEQ ID NO: 303242 - DNA, 20 bp, Artificial Sequence
  chemically synthesized
attagaatgaggaaaacttc

SEQ ID NO: 303243 - DNA, 20 bp, Artificial Sequence
  chemically synthesized
cgttattcttatcatgcttg

SEQ ID NO: 303244 - DNA, 20 bp, Artificial Sequence
  chemically synthesized
aggaaaacttcaagcatgat

SEQ ID NO: 303245 - DNA, 20 bp, Artificial Sequence
  chemically synthesized
caagcatgataagaataacg

SEQ ID NO: 303246 - DNA, 20 bp, Artificial Sequence
  chemically synthesized
catattaaacattttagtga

SEQ ID NO: 303247 - DNA, 20 bp, Artificial Sequence
  chemically synthesized
ccatattaaacattttagtg

SEQ ID NO: 303248 - DNA, 20 bp, Artificial Sequence
  chemically synthesized
ctctgccatattaaacattt

SEQ ID NO: 303249 - DNA, 20 bp, Artificial Sequence
  chemically synthesized
cttcactaaaatgtttaata

SEQ ID NO: 303250 - DNA, 20 bp, Artificial Sequence
  chemically synthesized
cactaaaatgtttaatatgg

SEQ ID NO: 303251 - DNA, 20 bp, Artificial Sequence
  chemically synthesized
ctaaaatgtttaatatggca

SEQ ID NO: 303252 - DNA, 20 bp, Artificial Sequence
  chemically synthesized
taatatggcagagtcaaaac

SEQ ID NO: 303253 - DNA, 20 bp, Artificial Sequence
  chemically synthesized
tggcagagtcaaaactagaa

SEQ ID NO: 303254 - DNA, 20 bp, Artificial Sequence
  chemically synthesized
ggtcaaactatattctattc

SEQ ID NO: 303255 - DNA, 20 bp, Artificial Sequence
  chemically synthesized
gtcaaaactagaatagaata

SEQ ID NO: 303256 - DNA, 20 bp, Artificial Sequence
  chemically synthesized
atacaaagattgttgaatat

SEQ ID NO: 303257 - DNA, 20 bp, Artificial Sequence
  chemically synthesized
gatacaaagattgttgaata

SEQ ID NO: 303258 - DNA, 20 bp, Artificial Sequence
  chemically synthesized
tattcaacaatctttgtatc

SEQ ID NO: 303259 - DNA, 20 bp, Artificial Sequence
  chemically synthesized
agtatagttagctagataca

SEQ ID NO: 303260 - DNA, 20 bp, Artificial Sequence
  chemically synthesized
tgggtaaaagtatagttagc

SEQ ID NO: 303261 - DNA, 20 bp, Artificial Sequence
  chemically synthesized
tgactgggtaaaagtatagt

SEQ ID NO: 303262 - DNA, 20 bp, Artificial Sequence
  chemically synthesized
aaggtgactgggtaaaagta

SEQ ID NO: 303263 - DNA, 20 bp, Artificial Sequence
  chemically synthesized
tagctaactatacttttacc

SEQ ID NO: 303264 - DNA, 20 bp, Artificial Sequence
  chemically synthesized
gaagaaaggtgactgggtaa

SEQ ID NO: 303265 - DNA, 20 bp, Artificial Sequence
  chemically synthesized
caaaatgaagaaaggtgact

SEQ ID NO: 303266 - DNA, 20 bp, Artificial Sequence
  chemically synthesized
tcaaaatgaagaaaggtgac

SEQ ID NO: 303267 - DNA, 20 bp, Artificial Sequence
  chemically synthesized
ctcataatcaaaatgaagaa

SEQ ID NO: 303268 - DNA, 20 bp, Artificial Sequence
  chemically synthesized
actcataatcaaaatgaaga

SEQ ID NO: 303269 - DNA, 20 bp, Artificial Sequence
  chemically synthesized
atagactcataatcaaaatg

SEQ ID NO: 303270 - DNA, 20 bp, Artificial Sequence
  chemically synthesized
cctttcttcattttgattat

SEQ ID NO: 303271 - DNA, 20 bp, Artificial Sequence
  chemically synthesized
ttttgattatgagtctattt

SEQ ID NO: 303272 - DNA, 20 bp, Artificial Sequence
  chemically synthesized
tatcattttagagtcttaaa

SEQ ID NO: 303273 - DNA, 20 bp, Artificial Sequence
  chemically synthesized
cttttcatgatatcatttta

SEQ ID NO: 303274 - DNA, 20 bp, Artificial Sequence
  chemically synthesized
ttcttttcatgatatcattt

SEQ ID NO: 303275 - DNA, 20 bp, Artificial Sequence
  chemically synthesized
ctctaaaatgatatcatgaa

SEQ ID NO: 303276 - DNA, 20 bp, Artificial Sequence
  chemically synthesized
aaaatgaatagtattttaaa

SEQ ID NO: 303277 - DNA, 20 bp, Artificial Sequence
  chemically synthesized
taacttgcagttaaaatgaa

SEQ ID NO: 303278 - DNA, 20 bp, Artificial Sequence
  chemically synthesized
atactattcattttaactgc

SEQ ID NO: 303279 - DNA, 20 bp, Artificial Sequence
  chemically synthesized
ttactagggaaattaacttg

SEQ ID NO: 303280 - DNA, 20 bp, Artificial Sequence
  chemically synthesized
taactgcaagttaatttccc

SEQ ID NO: 303281 - DNA, 20 bp, Artificial Sequence
  chemically synthesized
actatttcccatttttacta

SEQ ID NO: 303282 - DNA, 20 bp, Artificial Sequence
  chemically synthesized
aactatttcccatttttact

SEQ ID NO: 303283 - DNA, 20 bp, Artificial Sequence
  chemically synthesized
gttaatttccctagtaaaaa

SEQ ID NO: 303284 - DNA, 20 bp, Artificial Sequence
  chemically synthesized
aaactatttcccatttttac

SEQ ID NO: 303285 - DNA, 20 bp, Artificial Sequence
  chemically synthesized
ttaatttccctagtaaaaat

SEQ ID NO: 303286 - DNA, 20 bp, Artificial Sequence
  chemically synthesized
tccctagtaaaaatgggaaa

SEQ ID NO: 303287 - DNA, 20 bp, Artificial Sequence
  chemically synthesized
agtaaaaatgggaaatagtt

SEQ ID NO: 303288 - DNA, 20 bp, Artificial Sequence
  chemically synthesized
cagctcccaaatgtaaagac

SEQ ID NO: 303289 - DNA, 20 bp, Artificial Sequence
  chemically synthesized
gaaatacttgtctttacatt

SEQ ID NO: 303290 - DNA, 20 bp, Artificial Sequence
  chemically synthesized
aaatacttgtctttacattt

SEQ ID NO: 303291 - DNA, 20 bp, Artificial Sequence
  chemically synthesized
ggaatcagctcccaaatgta

SEQ ID NO: 303292 - DNA, 20 bp, Artificial Sequence
  chemically synthesized
atacttgtctttacatttgg

SEQ ID NO: 303293 - DNA, 20 bp, Artificial Sequence
  chemically synthesized
ataaccactctaagaggaat

SEQ ID NO: 303294 - DNA, 20 bp, Artificial Sequence
  chemically synthesized
atttgggagctgattcctct

SEQ ID NO: 303295 - DNA, 20 bp, Artificial Sequence
  chemically synthesized
ttgggagctgattcctctta

SEQ ID NO: 303296 - DNA, 20 bp, Artificial Sequence
  chemically synthesized
ggagctgattcctcttagag

SEQ ID NO: 303297 - DNA, 20 bp, Artificial Sequence
  chemically synthesized
ctacttataaccactctaag

SEQ ID NO: 303298 - DNA, 20 bp, Artificial Sequence
  chemically synthesized
tctacttataaccactctaa

SEQ ID NO: 303299 - DNA, 20 bp, Artificial Sequence
  chemically synthesized
cctctacttataaccactct

SEQ ID NO: 303300 - DNA, 20 bp, Artificial Sequence
  chemically synthesized
attcctcttagagtggttat

SEQ ID NO: 303301 - DNA, 20 bp, Artificial Sequence
  chemically synthesized
cctcttagagtggttataag

SEQ ID NO: 303302 - DNA, 20 bp, Artificial Sequence
  chemically synthesized
tcttagagtggttataagta

SEQ ID NO: 303303 - DNA, 20 bp, Artificial Sequence
  chemically synthesized
cttagagtggttataagtag

SEQ ID NO: 303304 - DNA, 20 bp, Artificial Sequence
  chemically synthesized
gtggttataagtagaggcat

SEQ ID NO: 303305 - DNA, 20 bp, Artificial Sequence
  chemically synthesized
ggttataagtagaggcattg

SEQ ID NO: 303306 - DNA, 20 bp, Artificial Sequence
  chemically synthesized
ataagtagaggcattggagc

SEQ ID NO: 303307 - DNA, 20 bp, Artificial Sequence
  chemically synthesized
tgtttaataattgtggagac

SEQ ID NO: 303308 - DNA, 20 bp, Artificial Sequence
  chemically synthesized
tctggtgtttaataattgtg

SEQ ID NO: 303309 - DNA, 20 bp, Artificial Sequence
  chemically synthesized
gatctggtgtttaataattg

SEQ ID NO: 303310 - DNA, 20 bp, Artificial Sequence
  chemically synthesized
tctccacaattattaaacac

SEQ ID NO: 303311 - DNA, 20 bp, Artificial Sequence
  chemically synthesized
attattaaacaccagatcca

SEQ ID NO: 303312 - DNA, 20 bp, Artificial Sequence
  chemically synthesized
cagtgtataaactatggatc

SEQ ID NO: 303313 - DNA, 20 bp, Artificial Sequence
  chemically synthesized
atgtcacagtgtataaacta

SEQ ID NO: 303314 - DNA, 20 bp, Artificial Sequence
  chemically synthesized
agtttatacactgtgacatt

SEQ ID NO: 303315 - DNA, 20 bp, Artificial Sequence
  chemically synthesized
ccaaccagccccaaatgtca

SEQ ID NO: 303316 - DNA, 20 bp, Artificial Sequence
  chemically synthesized
gtttatacactgtgacattt

SEQ ID NO: 303317 - DNA, 20 bp, Artificial Sequence
  chemically synthesized
tttatacactgtgacatttg

SEQ ID NO: 303318 - DNA, 20 bp, Artificial Sequence
  chemically synthesized
tacactgtgacatttggggc

SEQ ID NO: 303319 - DNA, 20 bp, Artificial Sequence
  chemically synthesized
ctgtgacatttggggctggt

SEQ ID NO: 303320 - DNA, 20 bp, Artificial Sequence
  chemically synthesized
gatttgagataagaaccaac

SEQ ID NO: 303321 - DNA, 20 bp, Artificial Sequence
  chemically synthesized
ataatgcatagatttgagat

SEQ ID NO: 303322 - DNA, 20 bp, Artificial Sequence
  chemically synthesized
agaaaataatgcatagattt

SEQ ID NO: 303323 - DNA, 20 bp, Artificial Sequence
  chemically synthesized
aagatgaagaaaataatgca

SEQ ID NO: 303324 - DNA, 20 bp, Artificial Sequence
  chemically synthesized
ttactcttactttaaagatg

SEQ ID NO: 303325 - DNA, 20 bp, Artificial Sequence
  chemically synthesized
cattattttcttcatcttta

SEQ ID NO: 303326 - DNA, 20 bp, Artificial Sequence
  chemically synthesized
attttcttcatctttaaagt

SEQ ID NO: 303327 - DNA, 20 bp, Artificial Sequence
  chemically synthesized
aatgtgttactcttacttta

SEQ ID NO: 303328 - DNA, 20 bp, Artificial Sequence
  chemically synthesized
tttcttcatctttaaagtaa

SEQ ID NO: 303329 - DNA, 20 bp, Artificial Sequence
  chemically synthesized
aagagtaacacatttcttca

SEQ ID NO: 303330 - DNA, 20 bp, Artificial Sequence
  chemically synthesized
agagtaacacatttcttcac

SEQ ID NO: 303331 - DNA, 20 bp, Artificial Sequence
  chemically synthesized
ttgcttgtaacacacctgtg

SEQ ID NO: 303332 - DNA, 20 bp, Artificial Sequence
  chemically synthesized
tttcttcacaggtgtgttac

SEQ ID NO: 303333 - DNA, 20 bp, Artificial Sequence
  chemically synthesized
ttcacaggtgtgttacaagc

SEQ ID NO: 303334 - DNA, 20 bp, Artificial Sequence
  chemically synthesized
tcacaggtgtgttacaagca

SEQ ID NO: 303335 - DNA, 20 bp, Artificial Sequence
  chemically synthesized
aggtgtgttacaagcaagga

SEQ ID NO: 303336 - DNA, 20 bp, Artificial Sequence
  chemically synthesized
tacaagcaaggacagcttca

SEQ ID NO: 303337 - DNA, 20 bp, Artificial Sequence
  chemically synthesized
acaagcaaggacagcttcat

SEQ ID NO: 303338 - DNA, 20 bp, Artificial Sequence
  chemically synthesized
gcaaggacagcttcatgggc

SEQ ID NO: 303339 - DNA, 20 bp, Artificial Sequence
  chemically synthesized
gcataaattaccagcccatg

SEQ ID NO: 303340 - DNA, 20 bp, Artificial Sequence
  chemically synthesized
tgggcaactgcataaattac

SEQ ID NO: 303341 - DNA, 20 bp, Artificial Sequence
  chemically synthesized
tcatgggctggtaatttatg

SEQ ID NO: 303342 - DNA, 20 bp, Artificial Sequence
  chemically synthesized
tggtaatttatgcagttgcc

SEQ ID NO: 303343 - DNA, 20 bp, Artificial Sequence
  chemically synthesized
ggtaatttatgcagttgccc

SEQ ID NO: 303344 - DNA, 20 bp, Artificial Sequence
  chemically synthesized
gtaatttatgcagttgccca

SEQ ID NO: 303345 - DNA, 20 bp, Artificial Sequence
  chemically synthesized
gcctcctgagcaggggccct

SEQ ID NO: 303346 - DNA, 20 bp, Artificial Sequence
  chemically synthesized
agcctcctgagcaggggccc

SEQ ID NO: 303347 - DNA, 20 bp, Artificial Sequence
  chemically synthesized
agttgcccagggcccctgct

SEQ ID NO: 303348 - DNA, 20 bp, Artificial Sequence
  chemically synthesized
gttgcccagggcccctgctc

SEQ ID NO: 303349 - DNA, 20 bp, Artificial Sequence
  chemically synthesized
catggaagcctcctgagcag

SEQ ID NO: 303350 - DNA, 20 bp, Artificial Sequence
  chemically synthesized
tgcccagggcccctgctcag

SEQ ID NO: 303351 - DNA, 20 bp, Artificial Sequence
  chemically synthesized
gcatggaagcctcctgagca

SEQ ID NO: 303352 - DNA, 20 bp, Artificial Sequence
  chemically synthesized
gcccagggcccctgctcagg

SEQ ID NO: 303353 - DNA, 20 bp, Artificial Sequence
  chemically synthesized
agcatggaagcctcctgagc

SEQ ID NO: 303354 - DNA, 20 bp, Artificial Sequence
  chemically synthesized
aagcatggaagcctcctgag

SEQ ID NO: 303355 - DNA, 20 bp, Artificial Sequence
  chemically synthesized
aacaagcatggaagcctcct

SEQ ID NO: 303356 - DNA, 20 bp, Artificial Sequence
  chemically synthesized
gagcttgaaaacaagcatgg

SEQ ID NO: 303357 - DNA, 20 bp, Artificial Sequence
  chemically synthesized
gcagagcttgaaaacaagca

SEQ ID NO: 303358 - DNA, 20 bp, Artificial Sequence
  chemically synthesized
aggcttccatgcttgttttc

SEQ ID NO: 303359 - DNA, 20 bp, Artificial Sequence
  chemically synthesized
tggaagcagagcttgaaaac

SEQ ID NO: 303360 - DNA, 20 bp, Artificial Sequence
  chemically synthesized
atttcaagacagtggaagca

SEQ ID NO: 303361 - DNA, 20 bp, Artificial Sequence
  chemically synthesized
gaatttcaagacagtggaag

SEQ ID NO: 303362 - DNA, 20 bp, Artificial Sequence
  chemically synthesized
taagaatttcaagacagtgg

SEQ ID NO: 303363 - DNA, 20 bp, Artificial Sequence
  chemically synthesized
acctaagaatttcaagacag

SEQ ID NO: 303364 - DNA, 20 bp, Artificial Sequence
  chemically synthesized
aagacctaagaatttcaaga

SEQ ID NO: 303365 - DNA, 20 bp, Artificial Sequence
  chemically synthesized
gttcaagacctaagaatttc

SEQ ID NO: 303366 - DNA, 20 bp, Artificial Sequence
  chemically synthesized
ttccactgtcttgaaattct

SEQ ID NO: 303367 - DNA, 20 bp, Artificial Sequence
  chemically synthesized
tccactgtcttgaaattctt

SEQ ID NO: 303368 - DNA, 20 bp, Artificial Sequence
  chemically synthesized
gggcttcctgttcaagacct

SEQ ID NO: 303369 - DNA, 20 bp, Artificial Sequence
  chemically synthesized
tgaaattcttaggtcttgaa

SEQ ID NO: 303370 - DNA, 20 bp, Artificial Sequence
  chemically synthesized
gaaattcttaggtcttgaac

SEQ ID NO: 303371 - DNA, 20 bp, Artificial Sequence
  chemically synthesized
attcttaggtcttgaacagg

SEQ ID NO: 303372 - DNA, 20 bp, Artificial Sequence
  chemically synthesized
aaaacaagggcttcctgttc

SEQ ID NO: 303373 - DNA, 20 bp, Artificial Sequence
  chemically synthesized
gaacaggaagcccttgtttt

SEQ ID NO: 303374 - DNA, 20 bp, Artificial Sequence
  chemically synthesized
ccagtgcaaactgaaaacaa

SEQ ID NO: 303375 - DNA, 20 bp, Artificial Sequence
  chemically synthesized
cccagtgcaaactgaaaaca

SEQ ID NO: 303376 - DNA, 20 bp, Artificial Sequence
  chemically synthesized
gcccagtgcaaactgaaaac

SEQ ID NO: 303377 - DNA, 20 bp, Artificial Sequence
  chemically synthesized
cccttgttttcagtttgcac

SEQ ID NO: 303378 - DNA, 20 bp, Artificial Sequence
  chemically synthesized
ccttgttttcagtttgcact

SEQ ID NO: 303379 - DNA, 20 bp, Artificial Sequence
  chemically synthesized
ggctacataatttgtgggcc

SEQ ID NO: 303380 - DNA, 20 bp, Artificial Sequence
  chemically synthesized
ggactggctacataatttgt

SEQ ID NO: 303381 - DNA, 20 bp, Artificial Sequence
  chemically synthesized
aggactggctacataatttg

SEQ ID NO: 303382 - DNA, 20 bp, Artificial Sequence
  chemically synthesized
cactgggcccacaaattatg

SEQ ID NO: 303383 - DNA, 20 bp, Artificial Sequence
  chemically synthesized
gggcccacaaattatgtagc

SEQ ID NO: 303384 - DNA, 20 bp, Artificial Sequence
  chemically synthesized
acaaattatgtagccagtcc

SEQ ID NO: 303385 - DNA, 20 bp, Artificial Sequence
  chemically synthesized
ttaattctcaaaaccaggac

SEQ ID NO: 303386 - DNA, 20 bp, Artificial Sequence
  chemically synthesized
atgtagccagtcctggtttt

SEQ ID NO: 303387 - DNA, 20 bp, Artificial Sequence
  chemically synthesized
atcatttaattctcaaaacc

SEQ ID NO: 303388 - DNA, 20 bp, Artificial Sequence
  chemically synthesized
tatcatttaattctcaaaac

SEQ ID NO: 303389 - DNA, 20 bp, Artificial Sequence
  chemically synthesized
tatagagcacttattttatt

SEQ ID NO: 303390 - DNA, 20 bp, Artificial Sequence
  chemically synthesized
atataatatctgaataaaat

SEQ ID NO: 303391 - DNA, 20 bp, Artificial Sequence
  chemically synthesized
ataaaataagtgctctataa

SEQ ID NO: 303392 - DNA, 20 bp, Artificial Sequence
  chemically synthesized
tgctgatatttaccattata

SEQ ID NO: 303393 - DNA, 20 bp, Artificial Sequence
  chemically synthesized
actgctgatatttaccatta

SEQ ID NO: 303394 - DNA, 20 bp, Artificial Sequence
  chemically synthesized
tgctctataatggtaaatat

SEQ ID NO: 303395 - DNA, 20 bp, Artificial Sequence
  chemically synthesized
tctataatggtaaatatcag

SEQ ID NO: 303396 - DNA, 20 bp, Artificial Sequence
  chemically synthesized
tgagcgtttagaaaagatag

SEQ ID NO: 303397 - DNA, 20 bp, Artificial Sequence
  chemically synthesized
ccctgagcgtttagaaaaga

SEQ ID NO: 303398 - DNA, 20 bp, Artificial Sequence
  chemically synthesized
atttccctgagcgtttagaa

SEQ ID NO: 303399 - DNA, 20 bp, Artificial Sequence
  chemically synthesized
cactatcttttctaaacgct

SEQ ID NO: 303400 - DNA, 20 bp, Artificial Sequence
  chemically synthesized
actatcttttctaaacgctc

SEQ ID NO: 303401 - DNA, 20 bp, Artificial Sequence
  chemically synthesized
ttcaaatttccctgagcgtt

SEQ ID NO: 303402 - DNA, 20 bp, Artificial Sequence
  chemically synthesized
ctatcttttctaaacgctca

SEQ ID NO: 303403 - DNA, 20 bp, Artificial Sequence
  chemically synthesized
aaaattcttcaaatttccct

SEQ ID NO: 303404 - DNA, 20 bp, Artificial Sequence
  chemically synthesized
taaacgctcagggaaatttg

SEQ ID NO: 303405 - DNA, 20 bp, Artificial Sequence
  chemically synthesized
atgagtaagaaggttgagta

SEQ ID NO: 303406 - DNA, 20 bp, Artificial Sequence
  chemically synthesized
atcttatgagtaagaaggtt

SEQ ID NO: 303407 - DNA, 20 bp, Artificial Sequence
  chemically synthesized
atgtaatcttatgagtaaga

SEQ ID NO: 303408 - DNA, 20 bp, Artificial Sequence
  chemically synthesized
tatgtaatcttatgagtaag

SEQ ID NO: 303409 - DNA, 20 bp, Artificial Sequence
  chemically synthesized
tactcaaccttcttactcat

SEQ ID NO: 303410 - DNA, 20 bp, Artificial Sequence
  chemically synthesized
acatatgtaatcttatgagt

SEQ ID NO: 303411 - DNA, 20 bp, Artificial Sequence
  chemically synthesized
tttaacatatgtaatcttat

SEQ ID NO: 303412 - DNA, 20 bp, Artificial Sequence
  chemically synthesized
ataagattacatatgttaaa

SEQ ID NO: 303413 - DNA, 20 bp, Artificial Sequence
  chemically synthesized
atgagaaaatgtaaatttta

SEQ ID NO: 303414 - DNA, 20 bp, Artificial Sequence
  chemically synthesized
aatttacattttctcattct

SEQ ID NO: 303415 - DNA, 20 bp, Artificial Sequence
  chemically synthesized
cttccaatttttctcagaat

SEQ ID NO: 303416 - DNA, 20 bp, Artificial Sequence
  chemically synthesized
aatgctcttccaatttttct

SEQ ID NO: 303417 - DNA, 20 bp, Artificial Sequence
  chemically synthesized
tttctcattctgagaaaaat

SEQ ID NO: 303418 - DNA, 20 bp, Artificial Sequence
  chemically synthesized
ctcattctgagaaaaattgg

SEQ ID NO: 303419 - DNA, 20 bp, Artificial Sequence
  chemically synthesized
cattctgagaaaaattggaa

SEQ ID NO: 303420 - DNA, 20 bp, Artificial Sequence
  chemically synthesized
aaaattggaagagcatttgc

SEQ ID NO: 303421 - DNA, 20 bp, Artificial Sequence
  chemically synthesized
ctggaataatatcaggatgc

SEQ ID NO: 303422 - DNA, 20 bp, Artificial Sequence
  chemically synthesized
gcacaccctggaataatatc

SEQ ID NO: 303423 - DNA, 20 bp, Artificial Sequence
  chemically synthesized
ggcacaccctggaataatat

SEQ ID NO: 303424 - DNA, 20 bp, Artificial Sequence
  chemically synthesized
ccagcatcctgatattattc

SEQ ID NO: 303425 - DNA, 20 bp, Artificial Sequence
  chemically synthesized
cagcatcctgatattattcc

SEQ ID NO: 303426 - DNA, 20 bp, Artificial Sequence
  chemically synthesized
agcatcctgatattattcca

SEQ ID NO: 303427 - DNA, 20 bp, Artificial Sequence
  chemically synthesized
ctgcaagaagaggcacaccc

SEQ ID NO: 303428 - DNA, 20 bp, Artificial Sequence
  chemically synthesized
ccagggtgtgcctcttcttg

SEQ ID NO: 303429 - DNA, 20 bp, Artificial Sequence
  chemically synthesized
cacaatcttactgcaagaag

SEQ ID NO: 303430 - DNA, 20 bp, Artificial Sequence
  chemically synthesized
acacaatcttactgcaagaa

SEQ ID NO: 303431 - DNA, 20 bp, Artificial Sequence
  chemically synthesized
taacacaatcttactgcaag

SEQ ID NO: 303432 - DNA, 20 bp, Artificial Sequence
  chemically synthesized
ggtgtgcctcttcttgcagt

SEQ ID NO: 303433 - DNA, 20 bp, Artificial Sequence
  chemically synthesized
aaataacacaatcttactgc

SEQ ID NO: 303434 - DNA, 20 bp, Artificial Sequence
  chemically synthesized
gtaagattgtgttattttga

SEQ ID NO: 303435 - DNA, 20 bp, Artificial Sequence
  chemically synthesized
taagattgtgttattttgat

SEQ ID NO: 303436 - DNA, 20 bp, Artificial Sequence
  chemically synthesized
ttgtgttattttgataggcc

SEQ ID NO: 303437 - DNA, 20 bp, Artificial Sequence
  chemically synthesized
tgtgttattttgataggcct

SEQ ID NO: 303438 - DNA, 20 bp, Artificial Sequence
  chemically synthesized
gagcatagtttgtttttccc

SEQ ID NO: 303439 - DNA, 20 bp, Artificial Sequence
  chemically synthesized
tgagcatagtttgtttttcc

SEQ ID NO: 303440 - DNA, 20 bp, Artificial Sequence
  chemically synthesized
gggaaaaacaaactatgctc

SEQ ID NO: 303441 - DNA, 20 bp, Artificial Sequence
  chemically synthesized
agaacttcatttcttgagca

SEQ ID NO: 303442 - DNA, 20 bp, Artificial Sequence
  chemically synthesized
aagaaagaacttcatttctt

SEQ ID NO: 303443 - DNA, 20 bp, Artificial Sequence
  chemically synthesized
caaactatgctcaagaaatg

SEQ ID NO: 303444 - DNA, 20 bp, Artificial Sequence
  chemically synthesized
tggaagagaagatggaaaga

SEQ ID NO: 303445 - DNA, 20 bp, Artificial Sequence
  chemically synthesized
caagtggaagagaagatgga

SEQ ID NO: 303446 - DNA, 20 bp, Artificial Sequence
  chemically synthesized
taaacaagtggaagagaaga

SEQ ID NO: 303447 - DNA, 20 bp, Artificial Sequence
  chemically synthesized
tttttaaacaagtggaagag

SEQ ID NO: 303448 - DNA, 20 bp, Artificial Sequence
  chemically synthesized
cattttttaaacaagtggaa

SEQ ID NO: 303449 - DNA, 20 bp, Artificial Sequence
  chemically synthesized
tgcattttttaaacaagtgg

SEQ ID NO: 303450 - DNA, 20 bp, Artificial Sequence
  chemically synthesized
atgtgcattttttaaacaag

SEQ ID NO: 303451 - DNA, 20 bp, Artificial Sequence
  chemically synthesized
taaatgtgcattttttaaac

SEQ ID NO: 303452 - DNA, 20 bp, Artificial Sequence
  chemically synthesized
aaaaaatgcacatttaaaaa

SEQ ID NO: 303453 - DNA, 20 bp, Artificial Sequence
  chemically synthesized
acatttaaaaaaagaaacat

SEQ ID NO: 303454 - DNA, 20 bp, Artificial Sequence
  chemically synthesized
aaagaaacataagtacatca

SEQ ID NO: 303455 - DNA, 20 bp, Artificial Sequence
  chemically synthesized
agtacatcaaagcaaattta

SEQ ID NO: 303456 - DNA, 20 bp, Artificial Sequence
  chemically synthesized
agcaaatttaaagaatacaa

SEQ ID NO: 303457 - DNA, 20 bp, Artificial Sequence
  chemically synthesized
gcaaatttaaagaatacaaa

SEQ ID NO: 303458 - DNA, 20 bp, Artificial Sequence
  chemically synthesized
tggagacagtggtagaaaaa

SEQ ID NO: 303459 - DNA, 20 bp, Artificial Sequence
  chemically synthesized
taataaactggagacagtgg

SEQ ID NO: 303460 - DNA, 20 bp, Artificial Sequence
  chemically synthesized
tttttttctaccactgtctc

SEQ ID NO: 303461 - DNA, 20 bp, Artificial Sequence
  chemically synthesized
tcctaataaactggagacag

SEQ ID NO: 303462 - DNA, 20 bp, Artificial Sequence
  chemically synthesized
gattcctaataaactggaga

SEQ ID NO: 303463 - DNA, 20 bp, Artificial Sequence
  chemically synthesized
tagtgattcctaataaactg

SEQ ID NO: 303464 - DNA, 20 bp, Artificial Sequence
  chemically synthesized
taccactgtctccagtttat

SEQ ID NO: 303465 - DNA, 20 bp, Artificial Sequence
  chemically synthesized
accactgtctccagtttatt

SEQ ID NO: 303466 - DNA, 20 bp, Artificial Sequence
  chemically synthesized
tgtagtgattcctaataaac

SEQ ID NO: 303467 - DNA, 20 bp, Artificial Sequence
  chemically synthesized
agtttattaggaatcactac

SEQ ID NO: 303468 - DNA, 20 bp, Artificial Sequence
  chemically synthesized
gttaagttatacatgacttg

SEQ ID NO: 303469 - DNA, 20 bp, Artificial Sequence
  chemically synthesized
gtcatgtataacttaacaac

SEQ ID NO: 303470 - DNA, 20 bp, Artificial Sequence
  chemically synthesized
tcatgtataacttaacaact

SEQ ID NO: 303471 - DNA, 20 bp, Artificial Sequence
  chemically synthesized
cagaatgtgtcccagttgtt

SEQ ID NO: 303472 - DNA, 20 bp, Artificial Sequence
  chemically synthesized
gaatttctcagaatgtgtcc

SEQ ID NO: 303473 - DNA, 20 bp, Artificial Sequence
  chemically synthesized
taacaactgggacacattct

SEQ ID NO: 303474 - DNA, 20 bp, Artificial Sequence
  chemically synthesized
ttgtctaaggatgaatttct

SEQ ID NO: 303475 - DNA, 20 bp, Artificial Sequence
  chemically synthesized
cattctgagaaattcatcct

SEQ ID NO: 303476 - DNA, 20 bp, Artificial Sequence
  chemically synthesized
tacaaggacaaaattgtcta

SEQ ID NO: 303477 - DNA, 20 bp, Artificial Sequence
  chemically synthesized
gtacaaggacaaaattgtct

SEQ ID NO: 303478 - DNA, 20 bp, Artificial Sequence
  chemically synthesized
cactccacggcgttcgtaca

SEQ ID NO: 303479 - DNA, 20 bp, Artificial Sequence
  chemically synthesized
acactccacggcgttcgtac

SEQ ID NO: 303480 - DNA, 20 bp, Artificial Sequence
  chemically synthesized
ttgtccttgtacgaacgccg

SEQ ID NO: 303481 - DNA, 20 bp, Artificial Sequence
  chemically synthesized
gtccttgtacgaacgccgtg

SEQ ID NO: 303482 - DNA, 20 bp, Artificial Sequence
  chemically synthesized
gtttgtgtaagtacactcca

SEQ ID NO: 303483 - DNA, 20 bp, Artificial Sequence
  chemically synthesized
tgtaccatctaggtttgtgt

SEQ ID NO: 303484 - DNA, 20 bp, Artificial Sequence
  chemically synthesized
ggagtgtacttacacaaacc

SEQ ID NO: 303485 - DNA, 20 bp, Artificial Sequence
  chemically synthesized
tgtacttacacaaacctaga

SEQ ID NO: 303486 - DNA, 20 bp, Artificial Sequence
  chemically synthesized
tatagtagtctgtaccatct

SEQ ID NO: 303487 - DNA, 20 bp, Artificial Sequence
  chemically synthesized
ttacacaaacctagatggta

SEQ ID NO: 303488 - DNA, 20 bp, Artificial Sequence
  chemically synthesized
gtatagtagtctgtaccatc

SEQ ID NO: 303489 - DNA, 20 bp, Artificial Sequence
  chemically synthesized
agatggtacagactactata

SEQ ID NO: 303490 - DNA, 20 bp, Artificial Sequence
  chemically synthesized
cacataggttggccgtatag

SEQ ID NO: 303491 - DNA, 20 bp, Artificial Sequence
  chemically synthesized
taccacataggttggccgta

SEQ ID NO: 303492 - DNA, 20 bp, Artificial Sequence
  chemically synthesized
tactatacggccaacctatg

SEQ ID NO: 303493 - DNA, 20 bp, Artificial Sequence
  chemically synthesized
ataagctgtaccacataggt

SEQ ID NO: 303494 - DNA, 20 bp, Artificial Sequence
  chemically synthesized
agcaataagctgtaccacat

SEQ ID NO: 303495 - DNA, 20 bp, Artificial Sequence
  chemically synthesized
tacggccaacctatgtggta

SEQ ID NO: 303496 - DNA, 20 bp, Artificial Sequence
  chemically synthesized
gagcaataagctgtaccaca

SEQ ID NO: 303497 - DNA, 20 bp, Artificial Sequence
  chemically synthesized
ggtttgtagctaggagcaat

SEQ ID NO: 303498 - DNA, 20 bp, Artificial Sequence
  chemically synthesized
gtggtacagcttattgctcc

SEQ ID NO: 303499 - DNA, 20 bp, Artificial Sequence
  chemically synthesized
ctgtacaggtttgtagctag

SEQ ID NO: 303500 - DNA, 20 bp, Artificial Sequence
  chemically synthesized
tgctgtacaggtttgtagct

SEQ ID NO: 303501 - DNA, 20 bp, Artificial Sequence
  chemically synthesized
atgctgtacaggtttgtagc

SEQ ID NO: 303502 - DNA, 20 bp, Artificial Sequence
  chemically synthesized
tcacatgctgtacaggtttg

SEQ ID NO: 303503 - DNA, 20 bp, Artificial Sequence
  chemically synthesized
ctcctagctacaaacctgta

SEQ ID NO: 303504 - DNA, 20 bp, Artificial Sequence
  chemically synthesized
agtatagtcacatgctgtac

SEQ ID NO: 303505 - DNA, 20 bp, Artificial Sequence
  chemically synthesized
cagtatagtcacatgctgta

SEQ ID NO: 303506 - DNA, 20 bp, Artificial Sequence
  chemically synthesized
cagcatgtgactatactgaa

SEQ ID NO: 303507 - DNA, 20 bp, Artificial Sequence
  chemically synthesized
tgtgcctacactattcagta

SEQ ID NO: 303508 - DNA, 20 bp, Artificial Sequence
  chemically synthesized
tgtgactatactgaatagtg

SEQ ID NO: 303509 - DNA, 20 bp, Artificial Sequence
  chemically synthesized
accattgtgcctacactatt

SEQ ID NO: 303510 - DNA, 20 bp, Artificial Sequence
  chemically synthesized
gtgactatactgaatagtgt

SEQ ID NO: 303511 - DNA, 20 bp, Artificial Sequence
  chemically synthesized
actgaatagtgtaggcacaa

SEQ ID NO: 303512 - DNA, 20 bp, Artificial Sequence
  chemically synthesized
aatagtgtaggcacaatggt

SEQ ID NO: 303513 - DNA, 20 bp, Artificial Sequence
  chemically synthesized
attgtacctttcgatatgtt

SEQ ID NO: 303514 - DNA, 20 bp, Artificial Sequence
  chemically synthesized
tgtgtatccaaacatatcga

SEQ ID NO: 303515 - DNA, 20 bp, Artificial Sequence
  chemically synthesized
gtgtatccaaacatatcgaa

SEQ ID NO: 303516 - DNA, 20 bp, Artificial Sequence
  chemically synthesized
ggtacaataaaaatatgata

SEQ ID NO: 303517 - DNA, 20 bp, Artificial Sequence
  chemically synthesized
tacaataaaaatatgatata

SEQ ID NO: 303518 - DNA, 20 bp, Artificial Sequence
  chemically synthesized
caataaaaatatgatataga

SEQ ID NO: 303519 - DNA, 20 bp, Artificial Sequence
  chemically synthesized
aaaaatatgatatagagagt

SEQ ID NO: 303520 - DNA, 20 bp, Artificial Sequence
  chemically synthesized
aaaatatgatatagagagtt

SEQ ID NO: 303521 - DNA, 20 bp, Artificial Sequence
  chemically synthesized
gttgggcataaaacaatctt

SEQ ID NO: 303522 - DNA, 20 bp, Artificial Sequence
  chemically synthesized
ggttttaaaaaaattttcta

SEQ ID NO: 303523 - DNA, 20 bp, Artificial Sequence
  chemically synthesized
tgttgttggtataattttgt

SEQ ID NO: 303524 - DNA, 20 bp, Artificial Sequence
  chemically synthesized
gtgttgttggtataattttg

SEQ ID NO: 303525 - DNA, 20 bp, Artificial Sequence
  chemically synthesized
ctgtggtccaagagtgttgt

SEQ ID NO: 303526 - DNA, 20 bp, Artificial Sequence
  chemically synthesized
aattataccaacaacactct

SEQ ID NO: 303527 - DNA, 20 bp, Artificial Sequence
  chemically synthesized
tttattgcactgtggtccaa

SEQ ID NO: 303528 - DNA, 20 bp, Artificial Sequence
  chemically synthesized
ccaacaacactcttggacca

SEQ ID NO: 303529 - DNA, 20 bp, Artificial Sequence
  chemically synthesized
tttttattgcactgtggtcc

SEQ ID NO: 303530 - DNA, 20 bp, Artificial Sequence
  chemically synthesized
tttctatttttattgcactg

SEQ ID NO: 303531 - DNA, 20 bp, Artificial Sequence
  chemically synthesized
ggaccacagtgcaataaaaa

SEQ ID NO: 303532 - DNA, 20 bp, Artificial Sequence
  chemically synthesized
taaaaatagaaatcaatgtt

SEQ ID NO: 303533 - DNA, 20 bp, Artificial Sequence
  chemically synthesized
ccattttaatgtatggtttt

SEQ ID NO: 303534 - DNA, 20 bp, Artificial Sequence
  chemically synthesized
ttgatttccattttaatgta

SEQ ID NO: 303535 - DNA, 20 bp, Artificial Sequence
  chemically synthesized
ctcaaaaccatacattaaaa

SEQ ID NO: 303536 - DNA, 20 bp, Artificial Sequence
  chemically synthesized
acccagaggtcattcaggag

SEQ ID NO: 303537 - DNA, 20 bp, Artificial Sequence
  chemically synthesized
tttacccagaggtcattcag

SEQ ID NO: 303538 - DNA, 20 bp, Artificial Sequence
  chemically synthesized
tgtttacccagaggtcattc

SEQ ID NO: 303539 - DNA, 20 bp, Artificial Sequence
  chemically synthesized
ttgtttacccagaggtcatt

SEQ ID NO: 303540 - DNA, 20 bp, Artificial Sequence
  chemically synthesized
aactgctcctgaatgacctc

SEQ ID NO: 303541 - DNA, 20 bp, Artificial Sequence
  chemically synthesized
actgctcctgaatgacctct

SEQ ID NO: 303542 - DNA, 20 bp, Artificial Sequence
  chemically synthesized
taattttattgtttacccag

SEQ ID NO: 303543 - DNA, 20 bp, Artificial Sequence
  chemically synthesized
ttaattttattgtttaccca

SEQ ID NO: 303544 - DNA, 20 bp, Artificial Sequence
  chemically synthesized
ccttaattttattgtttacc

SEQ ID NO: 303545 - DNA, 20 bp, Artificial Sequence
  chemically synthesized
tctgggtaaacaataaaatt

SEQ ID NO: 303546 - DNA, 20 bp, Artificial Sequence
  chemically synthesized
ctgggtaaacaataaaatta

SEQ ID NO: 303547 - DNA, 20 bp, Artificial Sequence
  chemically synthesized
ggtaaacaataaaattaagg

SEQ ID NO: 303548 - DNA, 20 bp, Artificial Sequence
  chemically synthesized
ataaaattaaggcagaaatc

SEQ ID NO: 303549 - DNA, 20 bp, Artificial Sequence
  chemically synthesized
acatctttttaaattttcat

SEQ ID NO: 303550 - DNA, 20 bp, Artificial Sequence
  chemically synthesized
gaaactaatgaaaatttaaa

SEQ ID NO: 303551 - DNA, 20 bp, Artificial Sequence
  chemically synthesized
tttaaaaagatgtaacatac

SEQ ID NO: 303552 - DNA, 20 bp, Artificial Sequence
  chemically synthesized
atgtaacataccagaatctc

SEQ ID NO: 303553 - DNA, 20 bp, Artificial Sequence
  chemically synthesized
tgtgtgtgtcccagagattc

SEQ ID NO: 303554 - DNA, 20 bp, Artificial Sequence
  chemically synthesized
tgtaacataccagaatctct

SEQ ID NO: 303555 - DNA, 20 bp, Artificial Sequence
  chemically synthesized
gctgctttgtgtgtgtccca

SEQ ID NO: 303556 - DNA, 20 bp, Artificial Sequence
  chemically synthesized
acgctgctttgtgtgtgtcc

SEQ ID NO: 303557 - DNA, 20 bp, Artificial Sequence
  chemically synthesized
gaatctctgggacacacaca

SEQ ID NO: 303558 - DNA, 20 bp, Artificial Sequence
  chemically synthesized
tctctgggacacacacaaag

SEQ ID NO: 303559 - DNA, 20 bp, Artificial Sequence
  chemically synthesized
gacacacacaaagcagcgtt

SEQ ID NO: 303560 - DNA, 20 bp, Artificial Sequence
  chemically synthesized
cacacacaaagcagcgttaa

SEQ ID NO: 303561 - DNA, 20 bp, Artificial Sequence
  chemically synthesized
acacacaaagcagcgttaag

SEQ ID NO: 303562 - DNA, 20 bp, Artificial Sequence
  chemically synthesized
acaaagcagcgttaagaggc

SEQ ID NO: 303563 - DNA, 20 bp, Artificial Sequence
  chemically synthesized
agcgttaagaggcaagctta

SEQ ID NO: 303564 - DNA, 20 bp, Artificial Sequence
  chemically synthesized
atatgggtgtttcgtgccat

SEQ ID NO: 303565 - DNA, 20 bp, Artificial Sequence
  chemically synthesized
tccttctaactttttgatat

SEQ ID NO: 303566 - DNA, 20 bp, Artificial Sequence
  chemically synthesized
cacgaaacacccatatcaaa

SEQ ID NO: 303567 - DNA, 20 bp, Artificial Sequence
  chemically synthesized
atccttctaactttttgata

SEQ ID NO: 303568 - DNA, 20 bp, Artificial Sequence
  chemically synthesized
aaacacccatatcaaaaagt

SEQ ID NO: 303569 - DNA, 20 bp, Artificial Sequence
  chemically synthesized
cacccatatcaaaaagttag

SEQ ID NO: 303570 - DNA, 20 bp, Artificial Sequence
  chemically synthesized
acccatatcaaaaagttaga

SEQ ID NO: 303571 - DNA, 20 bp, Artificial Sequence
  chemically synthesized
tgatgttcgttttgtaatta

SEQ ID NO: 303572 - DNA, 20 bp, Artificial Sequence
  chemically synthesized
tgtgatgttcgttttgtaat

SEQ ID NO: 303573 - DNA, 20 bp, Artificial Sequence
  chemically synthesized
aattacaaaacgaacatcac

SEQ ID NO: 303574 - DNA, 20 bp, Artificial Sequence
  chemically synthesized
attacaaaacgaacatcaca

SEQ ID NO: 303575 - DNA, 20 bp, Artificial Sequence
  chemically synthesized
aaacgaacatcacaaggaac

SEQ ID NO: 303576 - DNA, 20 bp, Artificial Sequence
  chemically synthesized
tcacaaggaacgagaaacaa

SEQ ID NO: 303577 - DNA, 20 bp, Artificial Sequence
  chemically synthesized
acaatagcaaactaacccca

SEQ ID NO: 303578 - DNA, 20 bp, Artificial Sequence
  chemically synthesized
ctgtcttctagctttggggt

SEQ ID NO: 303579 - DNA, 20 bp, Artificial Sequence
  chemically synthesized
tagcaaactaaccccaaagc

SEQ ID NO: 303580 - DNA, 20 bp, Artificial Sequence
  chemically synthesized
tttcctgtcttctagctttg

SEQ ID NO: 303581 - DNA, 20 bp, Artificial Sequence
  chemically synthesized
atttcctgtcttctagcttt

SEQ ID NO: 303582 - DNA, 20 bp, Artificial Sequence
  chemically synthesized
caaactaaccccaaagctag

SEQ ID NO: 303583 - DNA, 20 bp, Artificial Sequence
  chemically synthesized
tatttcctgtcttctagctt

SEQ ID NO: 303584 - DNA, 20 bp, Artificial Sequence
  chemically synthesized
ctaaccccaaagctagaaga

SEQ ID NO: 303585 - DNA, 20 bp, Artificial Sequence
  chemically synthesized
taaccccaaagctagaagac

SEQ ID NO: 303586 - DNA, 20 bp, Artificial Sequence
  chemically synthesized
tttggttatttcctgtcttc

SEQ ID NO: 303587 - DNA, 20 bp, Artificial Sequence
  chemically synthesized
agacaggaaataaccaaaat

SEQ ID NO: 303588 - DNA, 20 bp, Artificial Sequence
  chemically synthesized
acaggaaataaccaaaatcg

SEQ ID NO: 303589 - DNA, 20 bp, Artificial Sequence
  chemically synthesized
cttcagttcagctccgattt

SEQ ID NO: 303590 - DNA, 20 bp, Artificial Sequence
  chemically synthesized
ccaaaatcggagctgaactg

SEQ ID NO: 303591 - DNA, 20 bp, Artificial Sequence
  chemically synthesized
caaaatcggagctgaactga

SEQ ID NO: 303592 - DNA, 20 bp, Artificial Sequence
  chemically synthesized
catctcattttccttcagtt

SEQ ID NO: 303593 - DNA, 20 bp, Artificial Sequence
  chemically synthesized
ttttgcatctcattttcctt

SEQ ID NO: 303594 - DNA, 20 bp, Artificial Sequence
  chemically synthesized
gagctgaactgaaggaaaat

SEQ ID NO: 303595 - DNA, 20 bp, Artificial Sequence
  chemically synthesized
aaggaaaatgagatgcaaaa

SEQ ID NO: 303596 - DNA, 20 bp, Artificial Sequence
  chemically synthesized
aaatgagatgcaaaaaagca

SEQ ID NO: 303597 - DNA, 20 bp, Artificial Sequence
  chemically synthesized
agatgcaaaaaagcacagaa

SEQ ID NO: 303598 - DNA, 20 bp, Artificial Sequence
  chemically synthesized
gatgcaaaaaagcacagaaa

SEQ ID NO: 303599 - DNA, 20 bp, Artificial Sequence
  chemically synthesized
acagaaaaggtcaatgaatc

SEQ ID NO: 303600 - DNA, 20 bp, Artificial Sequence
  chemically synthesized
cagaaaaggtcaatgaatct

SEQ ID NO: 303601 - DNA, 20 bp, Artificial Sequence
  chemically synthesized
gaaaaggtcaatgaatctag

SEQ ID NO: 303602 - DNA, 20 bp, Artificial Sequence
  chemically synthesized
tatttcaaagaaacagctcc

SEQ ID NO: 303603 - DNA, 20 bp, Artificial Sequence
  chemically synthesized
tattaattatttcaaagaaa

SEQ ID NO: 303604 - DNA, 20 bp, Artificial Sequence
  chemically synthesized
ctttattattaattatttca

SEQ ID NO: 303605 - DNA, 20 bp, Artificial Sequence
  chemically synthesized
ctttgaaataattaataata

SEQ ID NO: 303606 - DNA, 20 bp, Artificial Sequence
  chemically synthesized
gaaataattaataataaaga

SEQ ID NO: 303607 - DNA, 20 bp, Artificial Sequence
  chemically synthesized
aataaagatagaccactacc

SEQ ID NO: 303608 - DNA, 20 bp, Artificial Sequence
  chemically synthesized
ttctttattattctaggtag

SEQ ID NO: 303609 - DNA, 20 bp, Artificial Sequence
  chemically synthesized
tttttctttattattctagg

SEQ ID NO: 303610 - DNA, 20 bp, Artificial Sequence
  chemically synthesized
ctttttttctttattattct

SEQ ID NO: 303611 - DNA, 20 bp, Artificial Sequence
  chemically synthesized
tctttttttctttattattc

SEQ ID NO: 303612 - DNA, 20 bp, Artificial Sequence
  chemically synthesized
gaccactacctagaataata

SEQ ID NO: 303613 - DNA, 20 bp, Artificial Sequence
  chemically synthesized
cctagaataataaagaaaaa

SEQ ID NO: 303614 - DNA, 20 bp, Artificial Sequence
  chemically synthesized
tagaataataaagaaaaaaa

SEQ ID NO: 303615 - DNA, 20 bp, Artificial Sequence
  chemically synthesized
gaataataaagaaaaaaaga

SEQ ID NO: 303616 - DNA, 20 bp, Artificial Sequence
  chemically synthesized
taataaagaaaaaaagagag

SEQ ID NO: 303617 - DNA, 20 bp, Artificial Sequence
  chemically synthesized
attttttattgtgtttattt

SEQ ID NO: 303618 - DNA, 20 bp, Artificial Sequence
  chemically synthesized
aaacacaataaaaaatgaca

SEQ ID NO: 303619 - DNA, 20 bp, Artificial Sequence
  chemically synthesized
aacacaataaaaaatgacaa

SEQ ID NO: 303620 - DNA, 20 bp, Artificial Sequence
  chemically synthesized
acacaataaaaaatgacaaa

SEQ ID NO: 303621 - DNA, 20 bp, Artificial Sequence
  chemically synthesized
cacaataaaaaatgacaaag

SEQ ID NO: 303622 - DNA, 20 bp, Artificial Sequence
  chemically synthesized
ctctatttctgtggggtcaa

SEQ ID NO: 303623 - DNA, 20 bp, Artificial Sequence
  chemically synthesized
ggatgttaccattgacccca

SEQ ID NO: 303624 - DNA, 20 bp, Artificial Sequence
  chemically synthesized
gggttttctctatttctgtg

SEQ ID NO: 303625 - DNA, 20 bp, Artificial Sequence
  chemically synthesized
taccattgaccccacagaaa

SEQ ID NO: 303626 - DNA, 20 bp, Artificial Sequence
  chemically synthesized
agggttttctctatttctgt

SEQ ID NO: 303627 - DNA, 20 bp, Artificial Sequence
  chemically synthesized
aagggttttctctatttctg

SEQ ID NO: 303628 - DNA, 20 bp, Artificial Sequence
  chemically synthesized
ccattgaccccacagaaata

SEQ ID NO: 303629 - DNA, 20 bp, Artificial Sequence
  chemically synthesized
acagaaatagagaaaaccct

SEQ ID NO: 303630 - DNA, 20 bp, Artificial Sequence
  chemically synthesized
agaaatagagaaaaccctta

SEQ ID NO: 303631 - DNA, 20 bp, Artificial Sequence
  chemically synthesized
tcattatgaatagtctctaa

SEQ ID NO: 303632 - DNA, 20 bp, Artificial Sequence
  chemically synthesized
ttcattatgaatagtctcta

SEQ ID NO: 303633 - DNA, 20 bp, Artificial Sequence
  chemically synthesized
gttcattatgaatagtctct

SEQ ID NO: 303634 - DNA, 20 bp, Artificial Sequence
  chemically synthesized
ataggggtgttcattatgaa

SEQ ID NO: 303635 - DNA, 20 bp, Artificial Sequence
  chemically synthesized
tttctagcttgtgtgcatag

SEQ ID NO: 303636 - DNA, 20 bp, Artificial Sequence
  chemically synthesized
ttttctagcttgtgtgcata

SEQ ID NO: 303637 - DNA, 20 bp, Artificial Sequence
  chemically synthesized
gttttctagcttgtgtgcat

SEQ ID NO: 303638 - DNA, 20 bp, Artificial Sequence
  chemically synthesized
atgaacacccctatgcacac

SEQ ID NO: 303639 - DNA, 20 bp, Artificial Sequence
  chemically synthesized
ggttttctagcttgtgtgca

SEQ ID NO: 303640 - DNA, 20 bp, Artificial Sequence
  chemically synthesized
acacccctatgcacacaagc

SEQ ID NO: 303641 - DNA, 20 bp, Artificial Sequence
  chemically synthesized
tgcacacaagctagaaaacc

SEQ ID NO: 303642 - DNA, 20 bp, Artificial Sequence
  chemically synthesized
tccattgcttctaggttttc

SEQ ID NO: 303643 - DNA, 20 bp, Artificial Sequence
  chemically synthesized
acacaagctagaaaacctag

SEQ ID NO: 303644 - DNA, 20 bp, Artificial Sequence
  chemically synthesized
gcaatttatccattgcttct

SEQ ID NO: 303645 - DNA, 20 bp, Artificial Sequence
  chemically synthesized
gctagaaaacctagaagcaa

SEQ ID NO: 303646 - DNA, 20 bp, Artificial Sequence
  chemically synthesized
agcaatttatccattgcttc

SEQ ID NO: 303647 - DNA, 20 bp, Artificial Sequence
  chemically synthesized
agaagcaatggataaattgc

SEQ ID NO: 303648 - DNA, 20 bp, Artificial Sequence
  chemically synthesized
cttggaaagttgtaagtttc

SEQ ID NO: 303649 - DNA, 20 bp, Artificial Sequence
  chemically synthesized
gttcaaacttggaaagttgt

SEQ ID NO: 303650 - DNA, 20 bp, Artificial Sequence
  chemically synthesized
ctagaaacttacaactttcc

SEQ ID NO: 303651 - DNA, 20 bp, Artificial Sequence
  chemically synthesized
cttcctggttcaaacttgga

SEQ ID NO: 303652 - DNA, 20 bp, Artificial Sequence
  chemically synthesized
atttcttcctggttcaaact

SEQ ID NO: 303653 - DNA, 20 bp, Artificial Sequence
  chemically synthesized
acaactttccaagtttgaac

SEQ ID NO: 303654 - DNA, 20 bp, Artificial Sequence
  chemically synthesized
caactttccaagtttgaacc

SEQ ID NO: 303655 - DNA, 20 bp, Artificial Sequence
  chemically synthesized
ctttccaagtttgaaccagg

SEQ ID NO: 303656 - DNA, 20 bp, Artificial Sequence
  chemically synthesized
tcaatgattccatttcttcc

SEQ ID NO: 303657 - DNA, 20 bp, Artificial Sequence
  chemically synthesized
aagtttgaaccaggaagaaa

SEQ ID NO: 303658 - DNA, 20 bp, Artificial Sequence
  chemically synthesized
gaagaaatggaatcattgaa

SEQ ID NO: 303659 - DNA, 20 bp, Artificial Sequence
  chemically synthesized
tcattgaacagaccaataat

SEQ ID NO: 303660 - DNA, 20 bp, Artificial Sequence
  chemically synthesized
ttaatttcggaactcattat

SEQ ID NO: 303661 - DNA, 20 bp, Artificial Sequence
  chemically synthesized
ttttgttcctaatttaattt

SEQ ID NO: 303662 - DNA, 20 bp, Artificial Sequence
  chemically synthesized
aatgagttccgaaattaaat

SEQ ID NO: 303663 - DNA, 20 bp, Artificial Sequence
  chemically synthesized
atgagttccgaaattaaatt

SEQ ID NO: 303664 - DNA, 20 bp, Artificial Sequence
  chemically synthesized
gaaattaaattaggaacaaa

SEQ ID NO: 303665 - DNA, 20 bp, Artificial Sequence
  chemically synthesized
ggaacaaaaagcccaccaac

SEQ ID NO: 303666 - DNA, 20 bp, Artificial Sequence
  chemically synthesized
ctgggctttttctggttggt

SEQ ID NO: 303667 - DNA, 20 bp, Artificial Sequence
  chemically synthesized
cctgggctttttctggttgg

SEQ ID NO: 303668 - DNA, 20 bp, Artificial Sequence
  chemically synthesized
ggtcctgggctttttctggt

SEQ ID NO: 303669 - DNA, 20 bp, Artificial Sequence
  chemically synthesized
aaaagcccaccaaccagaaa

SEQ ID NO: 303670 - DNA, 20 bp, Artificial Sequence
  chemically synthesized
gtctggtcctgggctttttc

SEQ ID NO: 303671 - DNA, 20 bp, Artificial Sequence
  chemically synthesized
cccaccaaccagaaaaagcc

SEQ ID NO: 303672 - DNA, 20 bp, Artificial Sequence
  chemically synthesized
ccaccaaccagaaaaagccc

SEQ ID NO: 303673 - DNA, 20 bp, Artificial Sequence
  chemically synthesized
aaccagaaaaagcccaggac

SEQ ID NO: 303674 - DNA, 20 bp, Artificial Sequence
  chemically synthesized
gtgtgaatctgtctggtcct

SEQ ID NO: 303675 - DNA, 20 bp, Artificial Sequence
  chemically synthesized
ggtgtgaatctgtctggtcc

SEQ ID NO: 303676 - DNA, 20 bp, Artificial Sequence
  chemically synthesized
agaaaaagcccaggaccaga

SEQ ID NO: 303677 - DNA, 20 bp, Artificial Sequence
  chemically synthesized
tattcaggtgtgaatctgtc

SEQ ID NO: 303678 - DNA, 20 bp, Artificial Sequence
  chemically synthesized
ttctatatctgttagtattc

SEQ ID NO: 303679 - DNA, 20 bp, Artificial Sequence
  chemically synthesized
cttctatatctgttagtatt

SEQ ID NO: 303680 - DNA, 20 bp, Artificial Sequence
  chemically synthesized
gattcacacctgaatactaa

SEQ ID NO: 303681 - DNA, 20 bp, Artificial Sequence
  chemically synthesized
cacctgaatactaacagata

SEQ ID NO: 303682 - DNA, 20 bp, Artificial Sequence
  chemically synthesized
gcttttccttctatatctgt

SEQ ID NO: 303683 - DNA, 20 bp, Artificial Sequence
  chemically synthesized
ctgaatactaacagatatag

SEQ ID NO: 303684 - DNA, 20 bp, Artificial Sequence
  chemically synthesized
tgaatactaacagatataga

SEQ ID NO: 303685 - DNA, 20 bp, Artificial Sequence
  chemically synthesized
actaacagatatagaaggaa

SEQ ID NO: 303686 - DNA, 20 bp, Artificial Sequence
  chemically synthesized
acagatatagaaggaaaagc

SEQ ID NO: 303687 - DNA, 20 bp, Artificial Sequence
  chemically synthesized
tggtttcataggaatgatac

SEQ ID NO: 303688 - DNA, 20 bp, Artificial Sequence
  chemically synthesized
atttttgggagtggtttcat

SEQ ID NO: 303689 - DNA, 20 bp, Artificial Sequence
  chemically synthesized
aatttttgggagtggtttca

SEQ ID NO: 303690 - DNA, 20 bp, Artificial Sequence
  chemically synthesized
cgctcctcaatttttgggag

SEQ ID NO: 303691 - DNA, 20 bp, Artificial Sequence
  chemically synthesized
agccgctcctcaatttttgg

SEQ ID NO: 303692 - DNA, 20 bp, Artificial Sequence
  chemically synthesized
tgaaaccactcccaaaaatt

SEQ ID NO: 303693 - DNA, 20 bp, Artificial Sequence
  chemically synthesized
ggagccgctcctcaattttt

SEQ ID NO: 303694 - DNA, 20 bp, Artificial Sequence
  chemically synthesized
gaaaccactcccaaaaattg

SEQ ID NO: 303695 - DNA, 20 bp, Artificial Sequence
  chemically synthesized
aggagccgctcctcaatttt

SEQ ID NO: 303696 - DNA, 20 bp, Artificial Sequence
  chemically synthesized
aaccactcccaaaaattgag

SEQ ID NO: 303697 - DNA, 20 bp, Artificial Sequence
  chemically synthesized
cactcccaaaaattgaggag

SEQ ID NO: 303698 - DNA, 20 bp, Artificial Sequence
  chemically synthesized
tcatagaatgagttaggaag

SEQ ID NO: 303699 - DNA, 20 bp, Artificial Sequence
  chemically synthesized
cctcatagaatgagttagga

SEQ ID NO: 303700 - DNA, 20 bp, Artificial Sequence
  chemically synthesized
ccctcatagaatgagttagg

SEQ ID NO: 303701 - DNA, 20 bp, Artificial Sequence
  chemically synthesized
cttccctcatagaatgagtt

SEQ ID NO: 303702 - DNA, 20 bp, Artificial Sequence
  chemically synthesized
gcttccctcatagaatgagt

SEQ ID NO: 303703 - DNA, 20 bp, Artificial Sequence
  chemically synthesized
tccttcctaactcattctat

SEQ ID NO: 303704 - DNA, 20 bp, Artificial Sequence
  chemically synthesized
caatgcttccctcatagaat

SEQ ID NO: 303705 - DNA, 20 bp, Artificial Sequence
  chemically synthesized
ccttcctaactcattctatg

SEQ ID NO: 303706 - DNA, 20 bp, Artificial Sequence
  chemically synthesized
cttcctaactcattctatga

SEQ ID NO: 303707 - DNA, 20 bp, Artificial Sequence
  chemically synthesized
cctaactcattctatgaggg

SEQ ID NO: 303708 - DNA, 20 bp, Artificial Sequence
  chemically synthesized
tcaggacaatgcttccctca

SEQ ID NO: 303709 - DNA, 20 bp, Artificial Sequence
  chemically synthesized
gtctgccaggttttggtatc

SEQ ID NO: 303710 - DNA, 20 bp, Artificial Sequence
  chemically synthesized
tgtctgccaggttttggtat

SEQ ID NO: 303711 - DNA, 20 bp, Artificial Sequence
  chemically synthesized
attgtcctgataccaaaacc

SEQ ID NO: 303712 - DNA, 20 bp, Artificial Sequence
  chemically synthesized
gttgtgtgtctgccaggttt

SEQ ID NO: 303713 - DNA, 20 bp, Artificial Sequence
  chemically synthesized
gtcctgataccaaaacctgg

SEQ ID NO: 303714 - DNA, 20 bp, Artificial Sequence
  chemically synthesized
ttggttgttgtgtgtctgcc

SEQ ID NO: 303715 - DNA, 20 bp, Artificial Sequence
  chemically synthesized
tttggttgttgtgtgtctgc

SEQ ID NO: 303716 - DNA, 20 bp, Artificial Sequence
  chemically synthesized
cagacacacaacaaccaaaa

SEQ ID NO: 303717 - DNA, 20 bp, Artificial Sequence
  chemically synthesized
tggcctgaagttttcttttt

SEQ ID NO: 303718 - DNA, 20 bp, Artificial Sequence
  chemically synthesized
acaaccaaaaaagaaaactt

SEQ ID NO: 303719 - DNA, 20 bp, Artificial Sequence
  chemically synthesized
caaccaaaaaagaaaacttc

SEQ ID NO: 303720 - DNA, 20 bp, Artificial Sequence
  chemically synthesized
tcattagggacattggcctg

SEQ ID NO: 303721 - DNA, 20 bp, Artificial Sequence
  chemically synthesized
tctatgttcattagggacat

SEQ ID NO: 303722 - DNA, 20 bp, Artificial Sequence
  chemically synthesized
ttttgcatctatgttcatta

SEQ ID NO: 303723 - DNA, 20 bp, Artificial Sequence
  chemically synthesized
tttttgcatctatgttcatt

SEQ ID NO: 303724 - DNA, 20 bp, Artificial Sequence
  chemically synthesized
gccaatgtccctaatgaaca

SEQ ID NO: 303725 - DNA, 20 bp, Artificial Sequence
  chemically synthesized
atttttgcatctatgttcat

SEQ ID NO: 303726 - DNA, 20 bp, Artificial Sequence
  chemically synthesized
aatgaacatagatgcaaaaa

SEQ ID NO: 303727 - DNA, 20 bp, Artificial Sequence
  chemically synthesized
atagatgcaaaaatagtcaa

SEQ ID NO: 303728 - DNA, 20 bp, Artificial Sequence
  chemically synthesized
aaaaatagtcaacagaatac

SEQ ID NO: 303729 - DNA, 20 bp, Artificial Sequence
  chemically synthesized
tgctgctggattgggtttgc

SEQ ID NO: 303730 - DNA, 20 bp, Artificial Sequence
  chemically synthesized
gaataccagcaaacccaatc

SEQ ID NO: 303731 - DNA, 20 bp, Artificial Sequence
  chemically synthesized
taccagcaaacccaatccag

SEQ ID NO: 303732 - DNA, 20 bp, Artificial Sequence
  chemically synthesized
ttttgatgtgctgctggatt

SEQ ID NO: 303733 - DNA, 20 bp, Artificial Sequence
  chemically synthesized
tttttgatgtgctgctggat

SEQ ID NO: 303734 - DNA, 20 bp, Artificial Sequence
  chemically synthesized
ttagctttttgatgtgctgc

SEQ ID NO: 303735 - DNA, 20 bp, Artificial Sequence
  chemically synthesized
caatccagcagcacatcaaa

SEQ ID NO: 303736 - DNA, 20 bp, Artificial Sequence
  chemically synthesized
gctccttgatcatggtggat

SEQ ID NO: 303737 - DNA, 20 bp, Artificial Sequence
  chemically synthesized
tagaagctccttgatcatgg

SEQ ID NO: 303738 - DNA, 20 bp, Artificial Sequence
  chemically synthesized
aaagctaatccaccatgatc

SEQ ID NO: 303739 - DNA, 20 bp, Artificial Sequence
  chemically synthesized
aagctaatccaccatgatca

SEQ ID NO: 303740 - DNA, 20 bp, Artificial Sequence
  chemically synthesized
ggatagaagctccttgatca

SEQ ID NO: 303741 - DNA, 20 bp, Artificial Sequence
  chemically synthesized
gctaatccaccatgatcaag

SEQ ID NO: 303742 - DNA, 20 bp, Artificial Sequence
  chemically synthesized
tgatcaaggagcttctatcc

SEQ ID NO: 303743 - DNA, 20 bp, Artificial Sequence
  chemically synthesized
gatcaaggagcttctatccc

SEQ ID NO: 303744 - DNA, 20 bp, Artificial Sequence
  chemically synthesized
acctcgcaaccctgggatag

SEQ ID NO: 303745 - DNA, 20 bp, Artificial Sequence
  chemically synthesized
atcaaggagcttctatccca

SEQ ID NO: 303746 - DNA, 20 bp, Artificial Sequence
  chemically synthesized
tcaacctcgcaaccctggga

SEQ ID NO: 303747 - DNA, 20 bp, Artificial Sequence
  chemically synthesized
tgaatcaacctcgcaaccct

SEQ ID NO: 303748 - DNA, 20 bp, Artificial Sequence
  chemically synthesized
agcttctatcccagggttgc

SEQ ID NO: 303749 - DNA, 20 bp, Artificial Sequence
  chemically synthesized
ttgaatcaacctcgcaaccc

SEQ ID NO: 303750 - DNA, 20 bp, Artificial Sequence
  chemically synthesized
gcttctatcccagggttgcg

SEQ ID NO: 303751 - DNA, 20 bp, Artificial Sequence
  chemically synthesized
gaggttgattcaacatacac

SEQ ID NO: 303752 - DNA, 20 bp, Artificial Sequence
  chemically synthesized
aatgtgattcaccacataaa

SEQ ID NO: 303753 - DNA, 20 bp, Artificial Sequence
  chemically synthesized
gattttttgttctgtttatg

SEQ ID NO: 303754 - DNA, 20 bp, Artificial Sequence
  chemically synthesized
tatctactgaaatgatcatg

SEQ ID NO: 303755 - DNA, 20 bp, Artificial Sequence
  chemically synthesized
caaaaaccacatgatcattt

SEQ ID NO: 303756 - DNA, 20 bp, Artificial Sequence
  chemically synthesized
aaaccacatgatcatttcag

SEQ ID NO: 303757 - DNA, 20 bp, Artificial Sequence
  chemically synthesized
catgatcatttcagtagata

SEQ ID NO: 303758 - DNA, 20 bp, Artificial Sequence
  chemically synthesized
tcatttcagtagatatagaa

SEQ ID NO: 303759 - DNA, 20 bp, Artificial Sequence
  chemically synthesized
catttcagtagatatagaaa

SEQ ID NO: 303760 - DNA, 20 bp, Artificial Sequence
  chemically synthesized
gaaagggtgttgaattttat

SEQ ID NO: 303761 - DNA, 20 bp, Artificial Sequence
  chemically synthesized
tgaaagggtgttgaatttta

SEQ ID NO: 303762 - DNA, 20 bp, Artificial Sequence
  chemically synthesized
cgaggatttttaacatgaaa

SEQ ID NO: 303763 - DNA, 20 bp, Artificial Sequence
  chemically synthesized
tcgaggatttttaacatgaa

SEQ ID NO: 303764 - DNA, 20 bp, Artificial Sequence
  chemically synthesized
gtcgaggatttttaacatga

SEQ ID NO: 303765 - DNA, 20 bp, Artificial Sequence
  chemically synthesized
cttcagtgcctagtttgtcg

SEQ ID NO: 303766 - DNA, 20 bp, Artificial Sequence
  chemically synthesized
gttaaaaatcctcgacaaac

SEQ ID NO: 303767 - DNA, 20 bp, Artificial Sequence
  chemically synthesized
ccttcagtgcctagtttgtc

SEQ ID NO: 303768 - DNA, 20 bp, Artificial Sequence
  chemically synthesized
ttaaaaatcctcgacaaact

SEQ ID NO: 303769 - DNA, 20 bp, Artificial Sequence
  chemically synthesized
cctcgacaaactaggcactg

SEQ ID NO: 303770 - DNA, 20 bp, Artificial Sequence
  chemically synthesized
aaatatgttccttcagtgcc

SEQ ID NO: 303771 - DNA, 20 bp, Artificial Sequence
  chemically synthesized
ctcgacaaactaggcactga

SEQ ID NO: 303772 - DNA, 20 bp, Artificial Sequence
  chemically synthesized
tactttgaaatatgttcctt

SEQ ID NO: 303773 - DNA, 20 bp, Artificial Sequence
  chemically synthesized
cactgaaggaacatatttca

SEQ ID NO: 303774 - DNA, 20 bp, Artificial Sequence
  chemically synthesized
ggaacatatttcaaagtaat

SEQ ID NO: 303775 - DNA, 20 bp, Artificial Sequence
  chemically synthesized
ggctgtggactttttaaaga

SEQ ID NO: 303776 - DNA, 20 bp, Artificial Sequence
  chemically synthesized
taattagaaccatctttaaa

SEQ ID NO: 303777 - DNA, 20 bp, Artificial Sequence
  chemically synthesized
tgttggctgtggacttttta

SEQ ID NO: 303778 - DNA, 20 bp, Artificial Sequence
  chemically synthesized
aaccatctttaaaaagtcca

SEQ ID NO: 303779 - DNA, 20 bp, Artificial Sequence
  chemically synthesized
attcagtataatgttggctg

SEQ ID NO: 303780 - DNA, 20 bp, Artificial Sequence
  chemically synthesized
ttgcacattcagtataatgt

SEQ ID NO: 303781 - DNA, 20 bp, Artificial Sequence
  chemically synthesized
gcttctggcttttgcacatt

SEQ ID NO: 303782 - DNA, 20 bp, Artificial Sequence
  chemically synthesized
acattatactgaatgtgcaa

SEQ ID NO: 303783 - DNA, 20 bp, Artificial Sequence
  chemically synthesized
tatactgaatgtgcaaaagc

SEQ ID NO: 303784 - DNA, 20 bp, Artificial Sequence
  chemically synthesized
actgaatgtgcaaaagccag

SEQ ID NO: 303785 - DNA, 20 bp, Artificial Sequence
  chemically synthesized
gttttcaagcacaatgcttc

SEQ ID NO: 303786 - DNA, 20 bp, Artificial Sequence
  chemically synthesized
gaagcattgtgcttgaaaac

SEQ ID NO: 303787 - DNA, 20 bp, Artificial Sequence
  chemically synthesized
cttgtcttatgccagttttc

SEQ ID NO: 303788 - DNA, 20 bp, Artificial Sequence
  chemically synthesized
ttgtgcttgaaaactggcat

SEQ ID NO: 303789 - DNA, 20 bp, Artificial Sequence
  chemically synthesized
agggcccccttgtcttatgc

SEQ ID NO: 303790 - DNA, 20 bp, Artificial Sequence
  chemically synthesized
cttgaaaactggcataagac

SEQ ID NO: 303791 - DNA, 20 bp, Artificial Sequence
  chemically synthesized
ttgaaaactggcataagaca

SEQ ID NO: 303792 - DNA, 20 bp, Artificial Sequence
  chemically synthesized
tgaaaactggcataagacaa

SEQ ID NO: 303793 - DNA, 20 bp, Artificial Sequence
  chemically synthesized
gaaaactggcataagacaag

SEQ ID NO: 303794 - DNA, 20 bp, Artificial Sequence
  chemically synthesized
aaaactggcataagacaagg

SEQ ID NO: 303795 - DNA, 20 bp, Artificial Sequence
  chemically synthesized
tcaatgagatttgtaagaga

SEQ ID NO: 303796 - DNA, 20 bp, Artificial Sequence
  chemically synthesized
ttcaatgagatttgtaagag

SEQ ID NO: 303797 - DNA, 20 bp, Artificial Sequence
  chemically synthesized
gttcaatgagatttgtaaga

SEQ ID NO: 303798 - DNA, 20 bp, Artificial Sequence
  chemically synthesized
atgttcaatgagatttgtaa

SEQ ID NO: 303799 - DNA, 20 bp, Artificial Sequence
  chemically synthesized
ctatgttcaatgagatttgt

SEQ ID NO: 303800 - DNA, 20 bp, Artificial Sequence
  chemically synthesized
tttctagtactatgttcaat

SEQ ID NO: 303801 - DNA, 20 bp, Artificial Sequence
  chemically synthesized
cttacaaatctcattgaaca

SEQ ID NO: 303802 - DNA, 20 bp, Artificial Sequence
  chemically synthesized
aatctcattgaacatagtac

SEQ ID NO: 303803 - DNA, 20 bp, Artificial Sequence
  chemically synthesized
gaacatagtactagaaatcc

SEQ ID NO: 303804 - DNA, 20 bp, Artificial Sequence
  chemically synthesized
attgctttggctaggatttc

SEQ ID NO: 303805 - DNA, 20 bp, Artificial Sequence
  chemically synthesized
agtactagaaatcctagcca

SEQ ID NO: 303806 - DNA, 20 bp, Artificial Sequence
  chemically synthesized
ctttcctgattgctttggct

SEQ ID NO: 303807 - DNA, 20 bp, Artificial Sequence
  chemically synthesized
tctttcctgattgctttggc

SEQ ID NO: 303808 - DNA, 20 bp, Artificial Sequence
  chemically synthesized
gaaatcctagccaaagcaat

SEQ ID NO: 303809 - DNA, 20 bp, Artificial Sequence
  chemically synthesized
tttctctttcctgattgctt

SEQ ID NO: 303810 - DNA, 20 bp, Artificial Sequence
  chemically synthesized
aaatcctagccaaagcaatc

SEQ ID NO: 303811 - DNA, 20 bp, Artificial Sequence
  chemically synthesized
cctagccaaagcaatcagga

SEQ ID NO: 303812 - DNA, 20 bp, Artificial Sequence
  chemically synthesized
tagccaaagcaatcaggaaa

SEQ ID NO: 303813 - DNA, 20 bp, Artificial Sequence
  chemically synthesized
gcaatcaggaaagagaaata

SEQ ID NO: 303814 - DNA, 20 bp, Artificial Sequence
  chemically synthesized
caatcaggaaagagaaataa

SEQ ID NO: 303815 - DNA, 20 bp, Artificial Sequence
  chemically synthesized
agaaataaaggcaatccaaa

SEQ ID NO: 303816 - DNA, 20 bp, Artificial Sequence
  chemically synthesized
gaaataaaggcaatccaaat

SEQ ID NO: 303817 - DNA, 20 bp, Artificial Sequence
  chemically synthesized
ataaaggcaatccaaatagg

SEQ ID NO: 303818 - DNA, 20 bp, Artificial Sequence
  chemically synthesized
tgacttcctctcttcctatt

SEQ ID NO: 303819 - DNA, 20 bp, Artificial Sequence
  chemically synthesized
aaaggcaatccaaataggaa

SEQ ID NO: 303820 - DNA, 20 bp, Artificial Sequence
  chemically synthesized
aggcaatccaaataggaaga

SEQ ID NO: 303821 - DNA, 20 bp, Artificial Sequence
  chemically synthesized
ggcaatccaaataggaagag

SEQ ID NO: 303822 - DNA, 20 bp, Artificial Sequence
  chemically synthesized
aatccaaataggaagagagg

SEQ ID NO: 303823 - DNA, 20 bp, Artificial Sequence
  chemically synthesized
agtcaaattatccctgtttg

SEQ ID NO: 303824 - DNA, 20 bp, Artificial Sequence
  chemically synthesized
aacctcatcgtctgcaaaca

SEQ ID NO: 303825 - DNA, 20 bp, Artificial Sequence
  chemically synthesized
gaacctcatcgtctgcaaac

SEQ ID NO: 303826 - DNA, 20 bp, Artificial Sequence
  chemically synthesized
agaacctcatcgtctgcaaa

SEQ ID NO: 303827 - DNA, 20 bp, Artificial Sequence
  chemically synthesized
tatccctgtttgcagacgat

SEQ ID NO: 303828 - DNA, 20 bp, Artificial Sequence
  chemically synthesized
atccctgtttgcagacgatg

SEQ ID NO: 303829 - DNA, 20 bp, Artificial Sequence
  chemically synthesized
gacgatgaggttctatactt

SEQ ID NO: 303830 - DNA, 20 bp, Artificial Sequence
  chemically synthesized
cagagactatggccaaagta

SEQ ID NO: 303831 - DNA, 20 bp, Artificial Sequence
  chemically synthesized
gaggttctatactttggcca

SEQ ID NO: 303832 - DNA, 20 bp, Artificial Sequence
  chemically synthesized
ttgggcagagactatggcca

SEQ ID NO: 303833 - DNA, 20 bp, Artificial Sequence
  chemically synthesized
gagcttttgggcagagacta

SEQ ID NO: 303834 - DNA, 20 bp, Artificial Sequence
  chemically synthesized
tggccatagtctctgcccaa

SEQ ID NO: 303835 - DNA, 20 bp, Artificial Sequence
  chemically synthesized
gatcaatgagcttttgggca

SEQ ID NO: 303836 - DNA, 20 bp, Artificial Sequence
  chemically synthesized
cagatcaatgagcttttggg

SEQ ID NO: 303837 - DNA, 20 bp, Artificial Sequence
  chemically synthesized
tatcagatcaatgagctttt

SEQ ID NO: 303838 - DNA, 20 bp, Artificial Sequence
  chemically synthesized
gtatcagatcaatgagcttt

SEQ ID NO: 303839 - DNA, 20 bp, Artificial Sequence
  chemically synthesized
aggttgtgtatcagatcaat

SEQ ID NO: 303840 - DNA, 20 bp, Artificial Sequence
  chemically synthesized
actttgctgaggttgtgtat

SEQ ID NO: 303841 - DNA, 20 bp, Artificial Sequence
  chemically synthesized
attgatctgatacacaacct

SEQ ID NO: 303842 - DNA, 20 bp, Artificial Sequence
  chemically synthesized
tctgatacacaacctcagca

SEQ ID NO: 303843 - DNA, 20 bp, Artificial Sequence
  chemically synthesized
tggatgctgaaactttgctg

SEQ ID NO: 303844 - DNA, 20 bp, Artificial Sequence
  chemically synthesized
ttggatgctgaaactttgct

SEQ ID NO: 303845 - DNA, 20 bp, Artificial Sequence
  chemically synthesized
acacaacctcagcaaagttt

SEQ ID NO: 303846 - DNA, 20 bp, Artificial Sequence
  chemically synthesized
tgatatttatacattgattt

SEQ ID NO: 303847 - DNA, 20 bp, Artificial Sequence
  chemically synthesized
aatcaatgtataaatatcac

SEQ ID NO: 303848 - DNA, 20 bp, Artificial Sequence
  chemically synthesized
ttgttggtgtgtaggaacac

SEQ ID NO: 303849 - DNA, 20 bp, Artificial Sequence
  chemically synthesized
cttaaatgttgttggtgtgt

SEQ ID NO: 303850 - DNA, 20 bp, Artificial Sequence
  chemically synthesized
gcttaaatgttgttggtgtg

SEQ ID NO: 303851 - DNA, 20 bp, Artificial Sequence
  chemically synthesized
ggccttagcttaaatgttgt

SEQ ID NO: 303852 - DNA, 20 bp, Artificial Sequence
  chemically synthesized
cctacacaccaacaacattt

SEQ ID NO: 303853 - DNA, 20 bp, Artificial Sequence
  chemically synthesized
acaccaacaacatttaagct

SEQ ID NO: 303854 - DNA, 20 bp, Artificial Sequence
  chemically synthesized
caccaacaacatttaagcta

SEQ ID NO: 303855 - DNA, 20 bp, Artificial Sequence
  chemically synthesized
ctgtgttcttcatttggcct

SEQ ID NO: 303856 - DNA, 20 bp, Artificial Sequence
  chemically synthesized
atttaagctaaggccaaatg

SEQ ID NO: 303857 - DNA, 20 bp, Artificial Sequence
  chemically synthesized
atgggactgtgttcttcatt

SEQ ID NO: 303858 - DNA, 20 bp, Artificial Sequence
  chemically synthesized
ctaaggccaaatgaagaaca

SEQ ID NO: 303859 - DNA, 20 bp, Artificial Sequence
  chemically synthesized
tctttttgacaattatgaat

SEQ ID NO: 303860 - DNA, 20 bp, Artificial Sequence
  chemically synthesized
ttctttttgacaattatgaa

SEQ ID NO: 303861 - DNA, 20 bp, Artificial Sequence
  chemically synthesized
tcccattcataattgtcaaa

SEQ ID NO: 303862 - DNA, 20 bp, Artificial Sequence
  chemically synthesized
cataattgtcaaaaagaaat

SEQ ID NO: 303863 - DNA, 20 bp, Artificial Sequence
  chemically synthesized
tcaaaaagaaataagatacc

SEQ ID NO: 303864 - DNA, 20 bp, Artificial Sequence
  chemically synthesized
caaaaagaaataagatacct

SEQ ID NO: 303865 - DNA, 20 bp, Artificial Sequence
  chemically synthesized
aaataagatacctaggaata

SEQ ID NO: 303866 - DNA, 20 bp, Artificial Sequence
  chemically synthesized
ccttgcttagctgtattcct

SEQ ID NO: 303867 - DNA, 20 bp, Artificial Sequence
  chemically synthesized
tccttgcttagctgtattcc

SEQ ID NO: 303868 - DNA, 20 bp, Artificial Sequence
  chemically synthesized
agatacctaggaatacagct

SEQ ID NO: 303869 - DNA, 20 bp, Artificial Sequence
  chemically synthesized
acctaggaatacagctaagc

SEQ ID NO: 303870 - DNA, 20 bp, Artificial Sequence
  chemically synthesized
cctaggaatacagctaagca

SEQ ID NO: 303871 - DNA, 20 bp, Artificial Sequence
  chemically synthesized
taggaatacagctaagcaag

SEQ ID NO: 303872 - DNA, 20 bp, Artificial Sequence
  chemically synthesized
aggaatacagctaagcaagg

SEQ ID NO: 303873 - DNA, 20 bp, Artificial Sequence
  chemically synthesized
cagtgtttcacctccttgct

SEQ ID NO: 303874 - DNA, 20 bp, Artificial Sequence
  chemically synthesized
aggtgaaacactgctaaact

SEQ ID NO: 303875 - DNA, 20 bp, Artificial Sequence
  chemically synthesized
ttttgtaattctcagtttag

SEQ ID NO: 303876 - DNA, 20 bp, Artificial Sequence
  chemically synthesized
atattttgtaattctcagtt

SEQ ID NO: 303877 - DNA, 20 bp, Artificial Sequence
  chemically synthesized
gagcaatattttgtaattct

SEQ ID NO: 303878 - DNA, 20 bp, Artificial Sequence
  chemically synthesized
agaattacaaaatattgctc

SEQ ID NO: 303879 - DNA, 20 bp, Artificial Sequence
  chemically synthesized
gtgttatctctgagttactt

SEQ ID NO: 303880 - DNA, 20 bp, Artificial Sequence
  chemically synthesized
aaaatattgctcaagtaact

SEQ ID NO: 303881 - DNA, 20 bp, Artificial Sequence
  chemically synthesized
aatattgctcaagtaactca

SEQ ID NO: 303882 - DNA, 20 bp, Artificial Sequence
  chemically synthesized
attttttgtgtgttatctct

SEQ ID NO: 303883 - DNA, 20 bp, Artificial Sequence
  chemically synthesized
cagagataacacacaaaaaa

SEQ ID NO: 303884 - DNA, 20 bp, Artificial Sequence
  chemically synthesized
ggaaaaatattctatgctca

SEQ ID NO: 303885 - DNA, 20 bp, Artificial Sequence
  chemically synthesized
tattgattcttccatgagca

SEQ ID NO: 303886 - DNA, 20 bp, Artificial Sequence
  chemically synthesized
aaaatattctatgctcatgg

SEQ ID NO: 303887 - DNA, 20 bp, Artificial Sequence
  chemically synthesized
gtcaatattgattcttccat

SEQ ID NO: 303888 - DNA, 20 bp, Artificial Sequence
  chemically synthesized
catggaagaatcaatattga

SEQ ID NO: 303889 - DNA, 20 bp, Artificial Sequence
  chemically synthesized
aagaatcaatattgacagaa

SEQ ID NO: 303890 - DNA, 20 bp, Artificial Sequence
  chemically synthesized
aaaaagtgctttaggcatta

SEQ ID NO: 303891 - DNA, 20 bp, Artificial Sequence
  chemically synthesized
cagaatggccataatgccta

SEQ ID NO: 303892 - DNA, 20 bp, Artificial Sequence
  chemically synthesized
attgaattaaaaagtgcttt

SEQ ID NO: 303893 - DNA, 20 bp, Artificial Sequence
  chemically synthesized
cattgaattaaaaagtgctt

SEQ ID NO: 303894 - DNA, 20 bp, Artificial Sequence
  chemically synthesized
gggaatagcattgaattaaa

SEQ ID NO: 303895 - DNA, 20 bp, Artificial Sequence
  chemically synthesized
tattggtagttttttgggaa

SEQ ID NO: 303896 - DNA, 20 bp, Artificial Sequence
  chemically synthesized
aatgttattggtagtttttt

SEQ ID NO: 303897 - DNA, 20 bp, Artificial Sequence
  chemically synthesized
gaatgttattggtagttttt

SEQ ID NO: 303898 - DNA, 20 bp, Artificial Sequence
  chemically synthesized
tcagtgaagaatgttattgg

SEQ ID NO: 303899 - DNA, 20 bp, Artificial Sequence
  chemically synthesized
tattcagtgaagaatgttat

SEQ ID NO: 303900 - DNA, 20 bp, Artificial Sequence
  chemically synthesized
agtctttttcttattcagtg

SEQ ID NO: 303901 - DNA, 20 bp, Artificial Sequence
  chemically synthesized
aataacattcttcactgaat

SEQ ID NO: 303902 - DNA, 20 bp, Artificial Sequence
  chemically synthesized
taaatagtctttttcttatt

SEQ ID NO: 303903 - DNA, 20 bp, Artificial Sequence
  chemically synthesized
attcttcactgaataagaaa

SEQ ID NO: 303904 - DNA, 20 bp, Artificial Sequence
  chemically synthesized
gctccaactgaatttttaaa

SEQ ID NO: 303905 - DNA, 20 bp, Artificial Sequence
  chemically synthesized
aaaaagactatttaaaaatt

SEQ ID NO: 303906 - DNA, 20 bp, Artificial Sequence
  chemically synthesized
agactatttaaaaattcagt

SEQ ID NO: 303907 - DNA, 20 bp, Artificial Sequence
  chemically synthesized
actatttaaaaattcagttg

SEQ ID NO: 303908 - DNA, 20 bp, Artificial Sequence
  chemically synthesized
aattcagttggagccactaa

SEQ ID NO: 303909 - DNA, 20 bp, Artificial Sequence
  chemically synthesized
ttcagttggagccactaaaa

SEQ ID NO: 303910 - DNA, 20 bp, Artificial Sequence
  chemically synthesized
ggctattctggctcttttag

SEQ ID NO: 303911 - DNA, 20 bp, Artificial Sequence
  chemically synthesized
gttggagccactaaaagagc

SEQ ID NO: 303912 - DNA, 20 bp, Artificial Sequence
  chemically synthesized
cttggctattctggctcttt

SEQ ID NO: 303913 - DNA, 20 bp, Artificial Sequence
  chemically synthesized
agccactaaaagagccagaa

SEQ ID NO: 303914 - DNA, 20 bp, Artificial Sequence
  chemically synthesized
taggattaccttggctattc

SEQ ID NO: 303915 - DNA, 20 bp, Artificial Sequence
  chemically synthesized
ctaaaagagccagaatagcc

SEQ ID NO: 303916 - DNA, 20 bp, Artificial Sequence
  chemically synthesized
taaaagagccagaatagcca

SEQ ID NO: 303917 - DNA, 20 bp, Artificial Sequence
  chemically synthesized
ctttttgcttaggattacct

SEQ ID NO: 303918 - DNA, 20 bp, Artificial Sequence
  chemically synthesized
agaatagccaaggtaatcct

SEQ ID NO: 303919 - DNA, 20 bp, Artificial Sequence
  chemically synthesized
ccaaggtaatcctaagcaaa

SEQ ID NO: 303920 - DNA, 20 bp, Artificial Sequence
  chemically synthesized
cagcttttttctttttgctt

SEQ ID NO: 303921 - DNA, 20 bp, Artificial Sequence
  chemically synthesized
ccagcttttttctttttgct

SEQ ID NO: 303922 - DNA, 20 bp, Artificial Sequence
  chemically synthesized
aatcctaagcaaaaagaaaa

SEQ ID NO: 303923 - DNA, 20 bp, Artificial Sequence
  chemically synthesized
ctaagcaaaaagaaaaaagc

SEQ ID NO: 303924 - DNA, 20 bp, Artificial Sequence
  chemically synthesized
gtcaggcaatgggatggttc

SEQ ID NO: 303925 - DNA, 20 bp, Artificial Sequence
  chemically synthesized
tttgcagtcaggcaatggga

SEQ ID NO: 303926 - DNA, 20 bp, Artificial Sequence
  chemically synthesized
atagtttgcagtcaggcaat

SEQ ID NO: 303927 - DNA, 20 bp, Artificial Sequence
  chemically synthesized
tatagtttgcagtcaggcaa

SEQ ID NO: 303928 - DNA, 20 bp, Artificial Sequence
  chemically synthesized
ttgtagtatagtttgcagtc

SEQ ID NO: 303929 - DNA, 20 bp, Artificial Sequence
  chemically synthesized
cttgtagtatagtttgcagt

SEQ ID NO: 303930 - DNA, 20 bp, Artificial Sequence
  chemically synthesized
tatccttgtagtatagtttg

SEQ ID NO: 303931 - DNA, 20 bp, Artificial Sequence
  chemically synthesized
ctgactgcaaactatactac

SEQ ID NO: 303932 - DNA, 20 bp, Artificial Sequence
  chemically synthesized
tgactgcaaactatactaca

SEQ ID NO: 303933 - DNA, 20 bp, Artificial Sequence
  chemically synthesized
gttactatatccttgtagta

SEQ ID NO: 303934 - DNA, 20 bp, Artificial Sequence
  chemically synthesized
ttttggttactatatccttg

SEQ ID NO: 303935 - DNA, 20 bp, Artificial Sequence
  chemically synthesized
caaactatactacaaggata

SEQ ID NO: 303936 - DNA, 20 bp, Artificial Sequence
  chemically synthesized
caaggatatagtaaccaaaa

SEQ ID NO: 303937 - DNA, 20 bp, Artificial Sequence
  chemically synthesized
ttttttgtaccatgctgttt

SEQ ID NO: 303938 - DNA, 20 bp, Artificial Sequence
  chemically synthesized
atatagtaaccaaaacagca

SEQ ID NO: 303939 - DNA, 20 bp, Artificial Sequence
  chemically synthesized
aaacagcatggtacaaaaaa

SEQ ID NO: 303940 - DNA, 20 bp, Artificial Sequence
  chemically synthesized
aaaacagacacataaaccaa

SEQ ID NO: 303941 - DNA, 20 bp, Artificial Sequence
  chemically synthesized
agacacataaaccaatggaa

SEQ ID NO: 303942 - DNA, 20 bp, Artificial Sequence
  chemically synthesized
gactctctattcttttccat

SEQ ID NO: 303943 - DNA, 20 bp, Artificial Sequence
  chemically synthesized
cataaaccaatggaaaagaa

SEQ ID NO: 303944 - DNA, 20 bp, Artificial Sequence
  chemically synthesized
taaaccaatggaaaagaata

SEQ ID NO: 303945 - DNA, 20 bp, Artificial Sequence
  chemically synthesized
aaccaatggaaaagaataga

SEQ ID NO: 303946 - DNA, 20 bp, Artificial Sequence
  chemically synthesized
atggaaaagaatagagagtc

SEQ ID NO: 303947 - DNA, 20 bp, Artificial Sequence
  chemically synthesized
agaatagagagtcgagaaat

SEQ ID NO: 303948 - DNA, 20 bp, Artificial Sequence
  chemically synthesized
gaatagagagtcgagaaata

SEQ ID NO: 303949 - DNA, 20 bp, Artificial Sequence
  chemically synthesized
aacagatggttgtaggtgtg

SEQ ID NO: 303950 - DNA, 20 bp, Artificial Sequence
  chemically synthesized
attgaagaacagatggttgt

SEQ ID NO: 303951 - DNA, 20 bp, Artificial Sequence
  chemically synthesized
cattgaagaacagatggttg

SEQ ID NO: 303952 - DNA, 20 bp, Artificial Sequence
  chemically synthesized
tgatttcattgaagaacaga

SEQ ID NO: 303953 - DNA, 20 bp, Artificial Sequence
  chemically synthesized
ttgttgatttcattgaagaa

SEQ ID NO: 303954 - DNA, 20 bp, Artificial Sequence
  chemically synthesized
tgtttttgttgatttcattg

SEQ ID NO: 303955 - DNA, 20 bp, Artificial Sequence
  chemically synthesized
tcaatgaaatcaacaaaaac

SEQ ID NO: 303956 - DNA, 20 bp, Artificial Sequence
  chemically synthesized
aaatcaacaaaaacaagcaa

SEQ ID NO: 303957 - DNA, 20 bp, Artificial Sequence
  chemically synthesized
aatcaacaaaaacaagcaat

SEQ ID NO: 303958 - DNA, 20 bp, Artificial Sequence
  chemically synthesized
acaaaaacaagcaatgggaa

SEQ ID NO: 303959 - DNA, 20 bp, Artificial Sequence
  chemically synthesized
caaaaacaagcaatgggaaa

SEQ ID NO: 303960 - DNA, 20 bp, Artificial Sequence
  chemically synthesized
gaaggggtccaatgaatagg

SEQ ID NO: 303961 - DNA, 20 bp, Artificial Sequence
  chemically synthesized
gaaaaggactgcctattcat

SEQ ID NO: 303962 - DNA, 20 bp, Artificial Sequence
  chemically synthesized
aaggaaggggtccaatgaat

SEQ ID NO: 303963 - DNA, 20 bp, Artificial Sequence
  chemically synthesized
taaggaaggggtccaatgaa

SEQ ID NO: 303964 - DNA, 20 bp, Artificial Sequence
  chemically synthesized
ttgtatatggtgtaaggaag

SEQ ID NO: 303965 - DNA, 20 bp, Artificial Sequence
  chemically synthesized
tttgtatatggtgtaaggaa

SEQ ID NO: 303966 - DNA, 20 bp, Artificial Sequence
  chemically synthesized
ttttgtatatggtgtaagga

SEQ ID NO: 303967 - DNA, 20 bp, Artificial Sequence
  chemically synthesized
tttttgtatatggtgtaagg

SEQ ID NO: 303968 - DNA, 20 bp, Artificial Sequence
  chemically synthesized
taatttttgtatatggtgta

SEQ ID NO: 303969 - DNA, 20 bp, Artificial Sequence
  chemically synthesized
ttaatttttgtatatggtgt

SEQ ID NO: 303970 - DNA, 20 bp, Artificial Sequence
  chemically synthesized
ctcgggttaatttttgtata

SEQ ID NO: 303971 - DNA, 20 bp, Artificial Sequence
  chemically synthesized
ccatatacaaaaattaaccc

SEQ ID NO: 303972 - DNA, 20 bp, Artificial Sequence
  chemically synthesized
catatacaaaaattaacccg

SEQ ID NO: 303973 - DNA, 20 bp, Artificial Sequence
  chemically synthesized
atacaaaaattaacccgagg

SEQ ID NO: 303974 - DNA, 20 bp, Artificial Sequence
  chemically synthesized
ttaagtctttaatccacctc

SEQ ID NO: 303975 - DNA, 20 bp, Artificial Sequence
  chemically synthesized
tttaagtctttaatccacct

SEQ ID NO: 303976 - DNA, 20 bp, Artificial Sequence
  chemically synthesized
aattaacccgaggtggatta

SEQ ID NO: 303977 - DNA, 20 bp, Artificial Sequence
  chemically synthesized
tagttgttggttttagattt

SEQ ID NO: 303978 - DNA, 20 bp, Artificial Sequence
  chemically synthesized
gtttttatagttgttggttt

SEQ ID NO: 303979 - DNA, 20 bp, Artificial Sequence
  chemically synthesized
tcttaggtttttatagttgt

SEQ ID NO: 303980 - DNA, 20 bp, Artificial Sequence
  chemically synthesized
gttatcttcttaggttttta

SEQ ID NO: 303981 - DNA, 20 bp, Artificial Sequence
  chemically synthesized
accaacaactataaaaacct

SEQ ID NO: 303982 - DNA, 20 bp, Artificial Sequence
  chemically synthesized
aacaactataaaaacctaag

SEQ ID NO: 303983 - DNA, 20 bp, Artificial Sequence
  chemically synthesized
attacctgggttatcttctt

SEQ ID NO: 303984 - DNA, 20 bp, Artificial Sequence
  chemically synthesized
cattacctgggttatcttct

SEQ ID NO: 303985 - DNA, 20 bp, Artificial Sequence
  chemically synthesized
aaaaacctaagaagataacc

SEQ ID NO: 303986 - DNA, 20 bp, Artificial Sequence
  chemically synthesized
aaaacctaagaagataaccc

SEQ ID NO: 303987 - DNA, 20 bp, Artificial Sequence
  chemically synthesized
tgtccagagtggcattacct

SEQ ID NO: 303988 - DNA, 20 bp, Artificial Sequence
  chemically synthesized
atgtccagagtggcattacc

SEQ ID NO: 303989 - DNA, 20 bp, Artificial Sequence
  chemically synthesized
taacccaggtaatgccactc

SEQ ID NO: 303990 - DNA, 20 bp, Artificial Sequence
  chemically synthesized
tgcagtttcaatgtccagag

SEQ ID NO: 303991 - DNA, 20 bp, Artificial Sequence
  chemically synthesized
ctttgcagtttcaatgtcca

SEQ ID NO: 303992 - DNA, 20 bp, Artificial Sequence
  chemically synthesized
gtctttgcagtttcaatgtc

SEQ ID NO: 303993 - DNA, 20 bp, Artificial Sequence
  chemically synthesized
ctctggacattgaaactgca

SEQ ID NO: 303994 - DNA, 20 bp, Artificial Sequence
  chemically synthesized
tctttgttatgaagtctttg

SEQ ID NO: 303995 - DNA, 20 bp, Artificial Sequence
  chemically synthesized
actgcaaagacttcataaca

SEQ ID NO: 303996 - DNA, 20 bp, Artificial Sequence
  chemically synthesized
tttttggtgtctttgttatg

SEQ ID NO: 303997 - DNA, 20 bp, Artificial Sequence
  chemically synthesized
gtttttgtttcaattgtttt

SEQ ID NO: 303998 - DNA, 20 bp, Artificial Sequence
  chemically synthesized
caaaaacaaaaattgaaaac

SEQ ID NO: 303999 - DNA, 20 bp, Artificial Sequence
  chemically synthesized
aaaaacaaaaattgaaaact

SEQ ID NO: 304000 - DNA, 20 bp, Artificial Sequence
  chemically synthesized
tctttagtttaattaggtcc

SEQ ID NO: 304001 - DNA, 20 bp, Artificial Sequence
  chemically synthesized
agaagttctttagtttaatt

SEQ ID NO: 304002 - DNA, 20 bp, Artificial Sequence
  chemically synthesized
tagaagttctttagtttaat

SEQ ID NO: 304003 - DNA, 20 bp, Artificial Sequence
  chemically synthesized
actgggacctaattaaacta

SEQ ID NO: 304004 - DNA, 20 bp, Artificial Sequence
  chemically synthesized
tttgttgtgtagaagttctt

SEQ ID NO: 304005 - DNA, 20 bp, Artificial Sequence
  chemically synthesized
tagtttcttttgttgtgtag

SEQ ID NO: 304006 - DNA, 20 bp, Artificial Sequence
  chemically synthesized
tgatagtttcttttgttgtg

SEQ ID NO: 304007 - DNA, 20 bp, Artificial Sequence
  chemically synthesized
aaagaacttctacacaacaa

SEQ ID NO: 304008 - DNA, 20 bp, Artificial Sequence
  chemically synthesized
acaacaaaagaaactatcaa

SEQ ID NO: 304009 - DNA, 20 bp, Artificial Sequence
  chemically synthesized
aacaaaagaaactatcaaca

SEQ ID NO: 304010 - DNA, 20 bp, Artificial Sequence
  chemically synthesized
ttgtctgtttactctgttga

SEQ ID NO: 304011 - DNA, 20 bp, Artificial Sequence
  chemically synthesized
gaaactatcaacagagtaaa

SEQ ID NO: 304012 - DNA, 20 bp, Artificial Sequence
  chemically synthesized
cagagtaaacagacaacctg

SEQ ID NO: 304013 - DNA, 20 bp, Artificial Sequence
  chemically synthesized
taaacagacaacctgcagaa

SEQ ID NO: 304014 - DNA, 20 bp, Artificial Sequence
  chemically synthesized
aaacagacaacctgcagaat

SEQ ID NO: 304015 - DNA, 20 bp, Artificial Sequence
  chemically synthesized
aaatttttctcccattctgc

SEQ ID NO: 304016 - DNA, 20 bp, Artificial Sequence
  chemically synthesized
aaaatttttctcccattctg

SEQ ID NO: 304017 - DNA, 20 bp, Artificial Sequence
  chemically synthesized
acagacaacctgcagaatgg

SEQ ID NO: 304018 - DNA, 20 bp, Artificial Sequence
  chemically synthesized
ttagacccttgtcagatgga

SEQ ID NO: 304019 - DNA, 20 bp, Artificial Sequence
  chemically synthesized
ttgcaaactttccatctgac

SEQ ID NO: 304020 - DNA, 20 bp, Artificial Sequence
  chemically synthesized
tgcaaactttccatctgaca

SEQ ID NO: 304021 - DNA, 20 bp, Artificial Sequence
  chemically synthesized
gatattagacccttgtcaga

SEQ ID NO: 304022 - DNA, 20 bp, Artificial Sequence
  chemically synthesized
gcaaactttccatctgacaa

SEQ ID NO: 304023 - DNA, 20 bp, Artificial Sequence
  chemically synthesized
tccagatattagacccttgt

SEQ ID NO: 304024 - DNA, 20 bp, Artificial Sequence
  chemically synthesized
tctgacaagggtctaatatc

SEQ ID NO: 304025 - DNA, 20 bp, Artificial Sequence
  chemically synthesized
tccttgtagattccagatat

SEQ ID NO: 304026 - DNA, 20 bp, Artificial Sequence
  chemically synthesized
tttaagttccttgtagattc

SEQ ID NO: 304027 - DNA, 20 bp, Artificial Sequence
  chemically synthesized
gtctaatatctggaatctac

SEQ ID NO: 304028 - DNA, 20 bp, Artificial Sequence
  chemically synthesized
tctaatatctggaatctaca

SEQ ID NO: 304029 - DNA, 20 bp, Artificial Sequence
  chemically synthesized
ttgtaaatttaagttccttg

SEQ ID NO: 304030 - DNA, 20 bp, Artificial Sequence
  chemically synthesized
tggtttttgcttgtaaattt

SEQ ID NO: 304031 - DNA, 20 bp, Artificial Sequence
  chemically synthesized
tacaaggaacttaaatttac

SEQ ID NO: 304032 - DNA, 20 bp, Artificial Sequence
  chemically synthesized
cactttttaatggtgatgtt

SEQ ID NO: 304033 - DNA, 20 bp, Artificial Sequence
  chemically synthesized
aaccaaacatcaccattaaa

SEQ ID NO: 304034 - DNA, 20 bp, Artificial Sequence
  chemically synthesized
gtcctttgcccactttttaa

SEQ ID NO: 304035 - DNA, 20 bp, Artificial Sequence
  chemically synthesized
caaacatcaccattaaaaag

SEQ ID NO: 304036 - DNA, 20 bp, Artificial Sequence
  chemically synthesized
aaacatcaccattaaaaagt

SEQ ID NO: 304037 - DNA, 20 bp, Artificial Sequence
  chemically synthesized
tcaccattaaaaagtgggca

SEQ ID NO: 304038 - DNA, 20 bp, Artificial Sequence
  chemically synthesized
caccattaaaaagtgggcaa

SEQ ID NO: 304039 - DNA, 20 bp, Artificial Sequence
  chemically synthesized
caaaggacatgaaccctttc

SEQ ID NO: 304040 - DNA, 20 bp, Artificial Sequence
  chemically synthesized
tgtatgtctttttctggaaa

SEQ ID NO: 304041 - DNA, 20 bp, Artificial Sequence
  chemically synthesized
atgtatgtctttttctggaa

SEQ ID NO: 304042 - DNA, 20 bp, Artificial Sequence
  chemically synthesized
tatgtatgtctttttctgga

SEQ ID NO: 304043 - DNA, 20 bp, Artificial Sequence
  chemically synthesized
acatgaaccctttccagaaa

SEQ ID NO: 304044 - DNA, 20 bp, Artificial Sequence
  chemically synthesized
tctgtatgtatgtctttttc

SEQ ID NO: 304045 - DNA, 20 bp, Artificial Sequence
  chemically synthesized
tccagaaaaagacatacata

SEQ ID NO: 304046 - DNA, 20 bp, Artificial Sequence
  chemically synthesized
ctctaatgattattgatgtt

SEQ ID NO: 304047 - DNA, 20 bp, Artificial Sequence
  chemically synthesized
tgctgaacatcaataatcat

SEQ ID NO: 304048 - DNA, 20 bp, Artificial Sequence
  chemically synthesized
ctgaacatcaataatcatta

SEQ ID NO: 304049 - DNA, 20 bp, Artificial Sequence
  chemically synthesized
aacatcaataatcattagag

SEQ ID NO: 304050 - DNA, 20 bp, Artificial Sequence
  chemically synthesized
caataatcattagagaagtg

SEQ ID NO: 304051 - DNA, 20 bp, Artificial Sequence
  chemically synthesized
gtgcagatcaaaaccacaat

SEQ ID NO: 304052 - DNA, 20 bp, Artificial Sequence
  chemically synthesized
tgtcaaatggtatcttattg

SEQ ID NO: 304053 - DNA, 20 bp, Artificial Sequence
  chemically synthesized
ccattctcactggtgtcaaa

SEQ ID NO: 304054 - DNA, 20 bp, Artificial Sequence
  chemically synthesized
aataagataccatttgacac

SEQ ID NO: 304055 - DNA, 20 bp, Artificial Sequence
  chemically synthesized
agataccatttgacaccagt

SEQ ID NO: 304056 - DNA, 20 bp, Artificial Sequence
  chemically synthesized
ccatttgacaccagtgagaa

SEQ ID NO: 304057 - DNA, 20 bp, Artificial Sequence
  chemically synthesized
ttaataatagccattctcac

SEQ ID NO: 304058 - DNA, 20 bp, Artificial Sequence
  chemically synthesized
cagtgagaatggctattatt

SEQ ID NO: 304059 - DNA, 20 bp, Artificial Sequence
  chemically synthesized
attttttgacttcttaataa

SEQ ID NO: 304060 - DNA, 20 bp, Artificial Sequence
  chemically synthesized
tgagaatggctattattaag

SEQ ID NO: 304061 - DNA, 20 bp, Artificial Sequence
  chemically synthesized
attaagaagtcaaaaaatca

SEQ ID NO: 304062 - DNA, 20 bp, Artificial Sequence
  chemically synthesized
agtcaaaaaatcacagatgc

SEQ ID NO: 304063 - DNA, 20 bp, Artificial Sequence
  chemically synthesized
aaaaaatcacagatgctggc

SEQ ID NO: 304064 - DNA, 20 bp, Artificial Sequence
  chemically synthesized
aaaaatcacagatgctggca

SEQ ID NO: 304065 - DNA, 20 bp, Artificial Sequence
  chemically synthesized
ccttttctgtgcaaccttgc

SEQ ID NO: 304066 - DNA, 20 bp, Artificial Sequence
  chemically synthesized
cagatgctggcaaggttgca

SEQ ID NO: 304067 - DNA, 20 bp, Artificial Sequence
  chemically synthesized
gctggcaaggttgcacagaa

SEQ ID NO: 304068 - DNA, 20 bp, Artificial Sequence
  chemically synthesized
ctggcaaggttgcacagaaa

SEQ ID NO: 304069 - DNA, 20 bp, Artificial Sequence
  chemically synthesized
tggcaaggttgcacagaaaa

SEQ ID NO: 304070 - DNA, 20 bp, Artificial Sequence
  chemically synthesized
gtttattgcactgctgatat

SEQ ID NO: 304071 - DNA, 20 bp, Artificial Sequence
  chemically synthesized
ctaatttacactaatatcag

SEQ ID NO: 304072 - DNA, 20 bp, Artificial Sequence
  chemically synthesized
gaactaatttacactaatat

SEQ ID NO: 304073 - DNA, 20 bp, Artificial Sequence
  chemically synthesized
ctgctgatattagtgtaaat

SEQ ID NO: 304074 - DNA, 20 bp, Artificial Sequence
  chemically synthesized
gatattagtgtaaattagtt

SEQ ID NO: 304075 - DNA, 20 bp, Artificial Sequence
  chemically synthesized
gtaaattagttcagccaccg

SEQ ID NO: 304076 - DNA, 20 bp, Artificial Sequence
  chemically synthesized
attagttcagccaccgtgga

SEQ ID NO: 304077 - DNA, 20 bp, Artificial Sequence
  chemically synthesized
caccaaactgctttccacgg

SEQ ID NO: 304078 - DNA, 20 bp, Artificial Sequence
  chemically synthesized
agttcagccaccgtggaaag

SEQ ID NO: 304079 - DNA, 20 bp, Artificial Sequence
  chemically synthesized
aatcaccaaactgctttcca

SEQ ID NO: 304080 - DNA, 20 bp, Artificial Sequence
  chemically synthesized
agccaccgtggaaagcagtt

SEQ ID NO: 304081 - DNA, 20 bp, Artificial Sequence
  chemically synthesized
aattctggttttcgttgttt

SEQ ID NO: 304082 - DNA, 20 bp, Artificial Sequence
  chemically synthesized
taattctggttttcgttgtt

SEQ ID NO: 304083 - DNA, 20 bp, Artificial Sequence
  chemically synthesized
atttcccaaacaacgaaaac

SEQ ID NO: 304084 - DNA, 20 bp, Artificial Sequence
  chemically synthesized
gctgggtcgaatggtaattc

SEQ ID NO: 304085 - DNA, 20 bp, Artificial Sequence
  chemically synthesized
accagaattaccattcgacc

SEQ ID NO: 304086 - DNA, 20 bp, Artificial Sequence
  chemically synthesized
attgttattgctgggtcgaa

SEQ ID NO: 304087 - DNA, 20 bp, Artificial Sequence
  chemically synthesized
acccaataattgttattgct

SEQ ID NO: 304088 - DNA, 20 bp, Artificial Sequence
  chemically synthesized
tacccaataattgttattgc

SEQ ID NO: 304089 - DNA, 20 bp, Artificial Sequence
  chemically synthesized
gacccagcaataacaattat

SEQ ID NO: 304090 - DNA, 20 bp, Artificial Sequence
  chemically synthesized
acccagcaataacaattatt

SEQ ID NO: 304091 - DNA, 20 bp, Artificial Sequence
  chemically synthesized
taacaattattgggtatacc

SEQ ID NO: 304092 - DNA, 20 bp, Artificial Sequence
  chemically synthesized
caattattgggtataccaag

SEQ ID NO: 304093 - DNA, 20 bp, Artificial Sequence
  chemically synthesized
tgagggatttatattcttct

SEQ ID NO: 304094 - DNA, 20 bp, Artificial Sequence
  chemically synthesized
gcatgtgtctttagggttga

SEQ ID NO: 304095 - DNA, 20 bp, Artificial Sequence
  chemically synthesized
tgcatgtgtctttagggttg

SEQ ID NO: 304096 - DNA, 20 bp, Artificial Sequence
  chemically synthesized
atataaatccctcaacccta

SEQ ID NO: 304097 - DNA, 20 bp, Artificial Sequence
  chemically synthesized
gtgcatgtgtctttagggtt

SEQ ID NO: 304098 - DNA, 20 bp, Artificial Sequence
  chemically synthesized
tacatgtgcatgtgtcttta

SEQ ID NO: 304099 - DNA, 20 bp, Artificial Sequence
  chemically synthesized
atacatgtgcatgtgtcttt

SEQ ID NO: 304100 - DNA, 20 bp, Artificial Sequence
  chemically synthesized
catacatgtgcatgtgtctt

SEQ ID NO: 304101 - DNA, 20 bp, Artificial Sequence
  chemically synthesized
tgcacatgtatgttttattg

SEQ ID NO: 304102 - DNA, 20 bp, Artificial Sequence
  chemically synthesized
tattgaagcattattcacaa

SEQ ID NO: 304103 - DNA, 20 bp, Artificial Sequence
  chemically synthesized
tattcacaatagcaaacaca

SEQ ID NO: 304104 - DNA, 20 bp, Artificial Sequence
  chemically synthesized
caatagcaaacacatggaat

SEQ ID NO: 304105 - DNA, 20 bp, Artificial Sequence
  chemically synthesized
tctaccactgatgggcattt

SEQ ID NO: 304106 - DNA, 20 bp, Artificial Sequence
  chemically synthesized
gtctaccactgatgggcatt

SEQ ID NO: 304107 - DNA, 20 bp, Artificial Sequence
  chemically synthesized
gaatcagcctaaatgcccat

SEQ ID NO: 304108 - DNA, 20 bp, Artificial Sequence
  chemically synthesized
tcagcctaaatgcccatcag

SEQ ID NO: 304109 - DNA, 20 bp, Artificial Sequence
  chemically synthesized
ttatccagtctaccactgat

SEQ ID NO: 304110 - DNA, 20 bp, Artificial Sequence
  chemically synthesized
gcctaaatgcccatcagtgg

SEQ ID NO: 304111 - DNA, 20 bp, Artificial Sequence
  chemically synthesized
cttatccagtctaccactga

SEQ ID NO: 304112 - DNA, 20 bp, Artificial Sequence
  chemically synthesized
aatgcccatcagtggtagac

SEQ ID NO: 304113 - DNA, 20 bp, Artificial Sequence
  chemically synthesized
ccatcagtggtagactggat

SEQ ID NO: 304114 - DNA, 20 bp, Artificial Sequence
  chemically synthesized
catcagtggtagactggata

SEQ ID NO: 304115 - DNA, 20 bp, Artificial Sequence
  chemically synthesized
tgtaccacattttccttatc

SEQ ID NO: 304116 - DNA, 20 bp, Artificial Sequence
  chemically synthesized
tagactggataaggaaaatg

SEQ ID NO: 304117 - DNA, 20 bp, Artificial Sequence
  chemically synthesized
aatgtggtacatatacactg

SEQ ID NO: 304118 - DNA, 20 bp, Artificial Sequence
  chemically synthesized
catggctgcatagaattcca

SEQ ID NO: 304119 - DNA, 20 bp, Artificial Sequence
  chemically synthesized
atacactgtggaattctatg

SEQ ID NO: 304120 - DNA, 20 bp, Artificial Sequence
  chemically synthesized
tctcttttttcatggctgca

SEQ ID NO: 304121 - DNA, 20 bp, Artificial Sequence
  chemically synthesized
attctatgcagccatgaaaa

SEQ ID NO: 304122 - DNA, 20 bp, Artificial Sequence
  chemically synthesized
gaacacaatctcttttttca

SEQ ID NO: 304123 - DNA, 20 bp, Artificial Sequence
  chemically synthesized
tctatgcagccatgaaaaaa

SEQ ID NO: 304124 - DNA, 20 bp, Artificial Sequence
  chemically synthesized
aaaagagattgtgttctttg

SEQ ID NO: 304125 - DNA, 20 bp, Artificial Sequence
  chemically synthesized
ctccatccatgtttgctgca

SEQ ID NO: 304126 - DNA, 20 bp, Artificial Sequence
  chemically synthesized
tgtgttctttgcagcaaaca

SEQ ID NO: 304127 - DNA, 20 bp, Artificial Sequence
  chemically synthesized
ttctttgcagcaaacatgga

SEQ ID NO: 304128 - DNA, 20 bp, Artificial Sequence
  chemically synthesized
ctttgcagcaaacatggatg

SEQ ID NO: 304129 - DNA, 20 bp, Artificial Sequence
  chemically synthesized
gcagcaaacatggatggagc

SEQ ID NO: 304130 - DNA, 20 bp, Artificial Sequence
  chemically synthesized
agcaaacatggatggagctg

SEQ ID NO: 304131 - DNA, 20 bp, Artificial Sequence
  chemically synthesized
gcaaacatggatggagctgg

SEQ ID NO: 304132 - DNA, 20 bp, Artificial Sequence
  chemically synthesized
ttgcttaggataatggcctc

SEQ ID NO: 304133 - DNA, 20 bp, Artificial Sequence
  chemically synthesized
gagctggaggccattatcct

SEQ ID NO: 304134 - DNA, 20 bp, Artificial Sequence
  chemically synthesized
tgttagtttgcttaggataa

SEQ ID NO: 304135 - DNA, 20 bp, Artificial Sequence
  chemically synthesized
gttattgtgttagtttgctt

SEQ ID NO: 304136 - DNA, 20 bp, Artificial Sequence
  chemically synthesized
tgttattgtgttagtttgct

SEQ ID NO: 304137 - DNA, 20 bp, Artificial Sequence
  chemically synthesized
gatattttgtgttattgtgt

SEQ ID NO: 304138 - DNA, 20 bp, Artificial Sequence
  chemically synthesized
tatcacattttctcacttct

SEQ ID NO: 304139 - DNA, 20 bp, Artificial Sequence
  chemically synthesized
tttatctcccacttagaagt

SEQ ID NO: 304140 - DNA, 20 bp, Artificial Sequence
  chemically synthesized
cacattttctcacttctaag

SEQ ID NO: 304141 - DNA, 20 bp, Artificial Sequence
  chemically synthesized
acattttctcacttctaagt

SEQ ID NO: 304142 - DNA, 20 bp, Artificial Sequence
  chemically synthesized
aatgtttatctcccacttag

SEQ ID NO: 304143 - DNA, 20 bp, Artificial Sequence
  chemically synthesized
attttctcacttctaagtgg

SEQ ID NO: 304144 - DNA, 20 bp, Artificial Sequence
  chemically synthesized
ctcaatgtttatctcccact

SEQ ID NO: 304145 - DNA, 20 bp, Artificial Sequence
  chemically synthesized
ctaagtgggagataaacatt

SEQ ID NO: 304146 - DNA, 20 bp, Artificial Sequence
  chemically synthesized
agataaacattgagaacaca

SEQ ID NO: 304147 - DNA, 20 bp, Artificial Sequence
  chemically synthesized
attgagaacacacggactca

SEQ ID NO: 304148 - DNA, 20 bp, Artificial Sequence
  chemically synthesized
gagaacacacggactcaaag

SEQ ID NO: 304149 - DNA, 20 bp, Artificial Sequence
  chemically synthesized
agaacacacggactcaaaga

SEQ ID NO: 304150 - DNA, 20 bp, Artificial Sequence
  chemically synthesized
gaacacacggactcaaagaa

SEQ ID NO: 304151 - DNA, 20 bp, Artificial Sequence
  chemically synthesized
aacacacggactcaaagaag

SEQ ID NO: 304152 - DNA, 20 bp, Artificial Sequence
  chemically synthesized
tgtctgttgtccccttcttt

SEQ ID NO: 304153 - DNA, 20 bp, Artificial Sequence
  chemically synthesized
ggactcaaagaaggggacaa

SEQ ID NO: 304154 - DNA, 20 bp, Artificial Sequence
  chemically synthesized
aaagaaggggacaacagaca

SEQ ID NO: 304155 - DNA, 20 bp, Artificial Sequence
  chemically synthesized
gaaggggacaacagacacgg

SEQ ID NO: 304156 - DNA, 20 bp, Artificial Sequence
  chemically synthesized
acagacacggtggtctatgt

SEQ ID NO: 304157 - DNA, 20 bp, Artificial Sequence
  chemically synthesized
cagacacggtggtctatgtg

SEQ ID NO: 304158 - DNA, 20 bp, Artificial Sequence
  chemically synthesized
tcttaccctccagcctcaca

SEQ ID NO: 304159 - DNA, 20 bp, Artificial Sequence
  chemically synthesized
cacggtggtctatgtgaggc

SEQ ID NO: 304160 - DNA, 20 bp, Artificial Sequence
  chemically synthesized
cggtggtctatgtgaggctg

SEQ ID NO: 304161 - DNA, 20 bp, Artificial Sequence
  chemically synthesized
ggtggtctatgtgaggctgg

SEQ ID NO: 304162 - DNA, 20 bp, Artificial Sequence
  chemically synthesized
gtggtctatgtgaggctgga

SEQ ID NO: 304163 - DNA, 20 bp, Artificial Sequence
  chemically synthesized
tctatgtgaggctggagggt

SEQ ID NO: 304164 - DNA, 20 bp, Artificial Sequence
  chemically synthesized
ctcaccctcctcttaccctc

SEQ ID NO: 304165 - DNA, 20 bp, Artificial Sequence
  chemically synthesized
tatgtgaggctggagggtaa

SEQ ID NO: 304166 - DNA, 20 bp, Artificial Sequence
  chemically synthesized
atgtgaggctggagggtaag

SEQ ID NO: 304167 - DNA, 20 bp, Artificial Sequence
  chemically synthesized
gtgaggctggagggtaagag

SEQ ID NO: 304168 - DNA, 20 bp, Artificial Sequence
  chemically synthesized
tgaggctggagggtaagagg

SEQ ID NO: 304169 - DNA, 20 bp, Artificial Sequence
  chemically synthesized
gaggctggagggtaagagga

SEQ ID NO: 304170 - DNA, 20 bp, Artificial Sequence
  chemically synthesized
ctggagggtaagaggagggt

SEQ ID NO: 304171 - DNA, 20 bp, Artificial Sequence
  chemically synthesized
tggagggtaagaggagggtg

SEQ ID NO: 304172 - DNA, 20 bp, Artificial Sequence
  chemically synthesized
ggattaaaaaaactacttat

SEQ ID NO: 304173 - DNA, 20 bp, Artificial Sequence
  chemically synthesized
gattaaaaaaactacttatt

SEQ ID NO: 304174 - DNA, 20 bp, Artificial Sequence
  chemically synthesized
taagcatagtacccaataag

SEQ ID NO: 304175 - DNA, 20 bp, Artificial Sequence
  chemically synthesized
taataagcatagtacccaat

SEQ ID NO: 304176 - DNA, 20 bp, Artificial Sequence
  chemically synthesized
catcacccaggtaataagca

SEQ ID NO: 304177 - DNA, 20 bp, Artificial Sequence
  chemically synthesized
tgggtactatgcttattacc

SEQ ID NO: 304178 - DNA, 20 bp, Artificial Sequence
  chemically synthesized
gggtactatgcttattacct

SEQ ID NO: 304179 - DNA, 20 bp, Artificial Sequence
  chemically synthesized
tatttcatcacccaggtaat

SEQ ID NO: 304180 - DNA, 20 bp, Artificial Sequence
  chemically synthesized
tacagattatttcatcaccc

SEQ ID NO: 304181 - DNA, 20 bp, Artificial Sequence
  chemically synthesized
gtacagattatttcatcacc

SEQ ID NO: 304182 - DNA, 20 bp, Artificial Sequence
  chemically synthesized
tgtcacaggggtttgttgta

SEQ ID NO: 304183 - DNA, 20 bp, Artificial Sequence
  chemically synthesized
agataaattgcatgtcacag

SEQ ID NO: 304184 - DNA, 20 bp, Artificial Sequence
  chemically synthesized
tagataaattgcatgtcaca

SEQ ID NO: 304185 - DNA, 20 bp, Artificial Sequence
  chemically synthesized
atagataaattgcatgtcac

SEQ ID NO: 304186 - DNA, 20 bp, Artificial Sequence
  chemically synthesized
tatagataaattgcatgtca

SEQ ID NO: 304187 - DNA, 20 bp, Artificial Sequence
  chemically synthesized
acatgtggtggtttgtcata

SEQ ID NO: 304188 - DNA, 20 bp, Artificial Sequence
  chemically synthesized
tgcttcagaggtacatgtgg

SEQ ID NO: 304189 - DNA, 20 bp, Artificial Sequence
  chemically synthesized
ttttgcttcagaggtacatg

SEQ ID NO: 304190 - DNA, 20 bp, Artificial Sequence
  chemically synthesized
aaccaccacatgtacctctg

SEQ ID NO: 304191 - DNA, 20 bp, Artificial Sequence
  chemically synthesized
tacttttatttttgcttcag

SEQ ID NO: 304192 - DNA, 20 bp, Artificial Sequence
  chemically synthesized
ttacttttatttttgcttca

SEQ ID NO: 304193 - DNA, 20 bp, Artificial Sequence
  chemically synthesized
ttttacttttatttttgctt

SEQ ID NO: 304194 - DNA, 20 bp, Artificial Sequence
  chemically synthesized
tacctctgaagcaaaaataa

SEQ ID NO: 304195 - DNA, 20 bp, Artificial Sequence
  chemically synthesized
aataaaagtaaaaaataata

SEQ ID NO: 304196 - DNA, 20 bp, Artificial Sequence
  chemically synthesized
atatagtataataatattat

SEQ ID NO: 304197 - DNA, 20 bp, Artificial Sequence
  chemically synthesized
atgaaccacatatatgacag

SEQ ID NO: 304198 - DNA, 20 bp, Artificial Sequence
  chemically synthesized
acaatgaaccacatatatga

SEQ ID NO: 304199 - DNA, 20 bp, Artificial Sequence
  chemically synthesized
tgagaccactgtcatatatg

SEQ ID NO: 304200 - DNA, 20 bp, Artificial Sequence
  chemically synthesized
tatgctgcataacaacattt

SEQ ID NO: 304201 - DNA, 20 bp, Artificial Sequence
  chemically synthesized
ttgactgaaatgttgttatg

SEQ ID NO: 304202 - DNA, 20 bp, Artificial Sequence
  chemically synthesized
tgttatgcagcatatgactg

SEQ ID NO: 304203 - DNA, 20 bp, Artificial Sequence
  chemically synthesized
atagttcgtaattgcaacta

SEQ ID NO: 304204 - DNA, 20 bp, Artificial Sequence
  chemically synthesized
agttgcaattacgaactatt

SEQ ID NO: 304205 - DNA, 20 bp, Artificial Sequence
  chemically synthesized
aaaattaaagaatagctgaa

SEQ ID NO: 304206 - DNA, 20 bp, Artificial Sequence
  chemically synthesized
atgaatttaaaattaaagaa

SEQ ID NO: 304207 - DNA, 20 bp, Artificial Sequence
  chemically synthesized
acaaaatgaatttaaaatta

SEQ ID NO: 304208 - DNA, 20 bp, Artificial Sequence
  chemically synthesized
caaaccatatcataaaataa

SEQ ID NO: 304209 - DNA, 20 bp, Artificial Sequence
  chemically synthesized
tatgctgttattttatgata

SEQ ID NO: 304210 - DNA, 20 bp, Artificial Sequence
  chemically synthesized
tgttattttatgatatggtt

SEQ ID NO: 304211 - DNA, 20 bp, Artificial Sequence
  chemically synthesized
aggatttgggtggggacaga

SEQ ID NO: 304212 - DNA, 20 bp, Artificial Sequence
  chemically synthesized
tgaggatttgggtggggaca

SEQ ID NO: 304213 - DNA, 20 bp, Artificial Sequence
  chemically synthesized
catgaggatttgggtgggga

SEQ ID NO: 304214 - DNA, 20 bp, Artificial Sequence
  chemically synthesized
tcaacatgaggatttgggtg

SEQ ID NO: 304215 - DNA, 20 bp, Artificial Sequence
  chemically synthesized
ttcaacatgaggatttgggt

SEQ ID NO: 304216 - DNA, 20 bp, Artificial Sequence
  chemically synthesized
attcaacatgaggatttggg

SEQ ID NO: 304217 - DNA, 20 bp, Artificial Sequence
  chemically synthesized
agaattcaacatgaggattt

SEQ ID NO: 304218 - DNA, 20 bp, Artificial Sequence
  chemically synthesized
cagaattcaacatgaggatt

SEQ ID NO: 304219 - DNA, 20 bp, Artificial Sequence
  chemically synthesized
tgaagacagaattcaacatg

SEQ ID NO: 304220 - DNA, 20 bp, Artificial Sequence
  chemically synthesized
ctgaagacagaattcaacat

SEQ ID NO: 304221 - DNA, 20 bp, Artificial Sequence
  chemically synthesized
ctcatgttgaattctgtctt

SEQ ID NO: 304222 - DNA, 20 bp, Artificial Sequence
  chemically synthesized
ccttcctccaacactgaaga

SEQ ID NO: 304223 - DNA, 20 bp, Artificial Sequence
  chemically synthesized
ttgaattctgtcttcagtgt

SEQ ID NO: 304224 - DNA, 20 bp, Artificial Sequence
  chemically synthesized
aggcccttcctccaacactg

SEQ ID NO: 304225 - DNA, 20 bp, Artificial Sequence
  chemically synthesized
gaattctgtcttcagtgttg

SEQ ID NO: 304226 - DNA, 20 bp, Artificial Sequence
  chemically synthesized
aattctgtcttcagtgttgg

SEQ ID NO: 304227 - DNA, 20 bp, Artificial Sequence
  chemically synthesized
tctgtcttcagtgttggagg

SEQ ID NO: 304228 - DNA, 20 bp, Artificial Sequence
  chemically synthesized
ctgtcttcagtgttggagga

SEQ ID NO: 304229 - DNA, 20 bp, Artificial Sequence
  chemically synthesized
tgtcttcagtgttggaggaa

SEQ ID NO: 304230 - DNA, 20 bp, Artificial Sequence
  chemically synthesized
tcagtgttggaggaagggcc

SEQ ID NO: 304231 - DNA, 20 bp, Artificial Sequence
  chemically synthesized
gtgttggaggaagggcctgg

SEQ ID NO: 304232 - DNA, 20 bp, Artificial Sequence
  chemically synthesized
tgttggaggaagggcctggt

SEQ ID NO: 304233 - DNA, 20 bp, Artificial Sequence
  chemically synthesized
ttggaggaagggcctggtgg

SEQ ID NO: 304234 - DNA, 20 bp, Artificial Sequence
  chemically synthesized
tggaggaagggcctggtggg

SEQ ID NO: 304235 - DNA, 20 bp, Artificial Sequence
  chemically synthesized
ggaggaagggcctggtggga

SEQ ID NO: 304236 - DNA, 20 bp, Artificial Sequence
  chemically synthesized
tgattcagtcccctcccacc

SEQ ID NO: 304237 - DNA, 20 bp, Artificial Sequence
  chemically synthesized
gaggaagggcctggtgggag

SEQ ID NO: 304238 - DNA, 20 bp, Artificial Sequence
  chemically synthesized
atgattcagtcccctcccac

SEQ ID NO: 304239 - DNA, 20 bp, Artificial Sequence
  chemically synthesized
ggtgggaggggactgaatca

SEQ ID NO: 304240 - DNA, 20 bp, Artificial Sequence
  chemically synthesized
gtgggaggggactgaatcat

SEQ ID NO: 304241 - DNA, 20 bp, Artificial Sequence
  chemically synthesized
ggaggtccacacccatgatt

SEQ ID NO: 304242 - DNA, 20 bp, Artificial Sequence
  chemically synthesized
aggggactgaatcatgggtg

SEQ ID NO: 304243 - DNA, 20 bp, Artificial Sequence
  chemically synthesized
tcaggagagcagcaaggggg

SEQ ID NO: 304244 - DNA, 20 bp, Artificial Sequence
  chemically synthesized
atcaggagagcagcaagggg

SEQ ID NO: 304245 - DNA, 20 bp, Artificial Sequence
  chemically synthesized
ttatcaggagagcagcaagg

SEQ ID NO: 304246 - DNA, 20 bp, Artificial Sequence
  chemically synthesized
cttatcaggagagcagcaag

SEQ ID NO: 304247 - DNA, 20 bp, Artificial Sequence
  chemically synthesized
tcttatcaggagagcagcaa

SEQ ID NO: 304248 - DNA, 20 bp, Artificial Sequence
  chemically synthesized
ctcttatcaggagagcagca

SEQ ID NO: 304249 - DNA, 20 bp, Artificial Sequence
  chemically synthesized
actcttatcaggagagcagc

SEQ ID NO: 304250 - DNA, 20 bp, Artificial Sequence
  chemically synthesized
gagaactcttatcaggagag

SEQ ID NO: 304251 - DNA, 20 bp, Artificial Sequence
  chemically synthesized
ccccttgctgctctcctgat

SEQ ID NO: 304252 - DNA, 20 bp, Artificial Sequence
  chemically synthesized
catgagaactcttatcagga

SEQ ID NO: 304253 - DNA, 20 bp, Artificial Sequence
  chemically synthesized
ccttgctgctctcctgataa

SEQ ID NO: 304254 - DNA, 20 bp, Artificial Sequence
  chemically synthesized
ctcatgagaactcttatcag

SEQ ID NO: 304255 - DNA, 20 bp, Artificial Sequence
  chemically synthesized
atctcatgagaactcttatc

SEQ ID NO: 304256 - DNA, 20 bp, Artificial Sequence
  chemically synthesized
aatctcatgagaactcttat

SEQ ID NO: 304257 - DNA, 20 bp, Artificial Sequence
  chemically synthesized
ctcctgataagagttctcat

SEQ ID NO: 304258 - DNA, 20 bp, Artificial Sequence
  chemically synthesized
ttcaaacaaacaaatctcat

SEQ ID NO: 304259 - DNA, 20 bp, Artificial Sequence
  chemically synthesized
catgagatttgtttgtttga

SEQ ID NO: 304260 - DNA, 20 bp, Artificial Sequence
  chemically synthesized
tttgtttgtttgaaagtgtg

SEQ ID NO: 304261 - DNA, 20 bp, Artificial Sequence
  chemically synthesized
aagtgtgtggcaacccttgc

SEQ ID NO: 304262 - DNA, 20 bp, Artificial Sequence
  chemically synthesized
gactggccacgatctggcaa

SEQ ID NO: 304263 - DNA, 20 bp, Artificial Sequence
  chemically synthesized
agactggccacgatctggca

SEQ ID NO: 304264 - DNA, 20 bp, Artificial Sequence
  chemically synthesized
cagactggccacgatctggc

SEQ ID NO: 304265 - DNA, 20 bp, Artificial Sequence
  chemically synthesized
tggcaacccttgccagatcg

SEQ ID NO: 304266 - DNA, 20 bp, Artificial Sequence
  chemically synthesized
gaagcagactggccacgatc

SEQ ID NO: 304267 - DNA, 20 bp, Artificial Sequence
  chemically synthesized
aacccttgccagatcgtggc

SEQ ID NO: 304268 - DNA, 20 bp, Artificial Sequence
  chemically synthesized
tcccacttaaagaagcagac

SEQ ID NO: 304269 - DNA, 20 bp, Artificial Sequence
  chemically synthesized
cgtggccagtctgcttcttt

SEQ ID NO: 304270 - DNA, 20 bp, Artificial Sequence
  chemically synthesized
cagggtcccacttaaagaag

SEQ ID NO: 304271 - DNA, 20 bp, Artificial Sequence
  chemically synthesized
ggccagtctgcttctttaag

SEQ ID NO: 304272 - DNA, 20 bp, Artificial Sequence
  chemically synthesized
gatcagggtcccacttaaag

SEQ ID NO: 304273 - DNA, 20 bp, Artificial Sequence
  chemically synthesized
gccagtctgcttctttaagt

SEQ ID NO: 304274 - DNA, 20 bp, Artificial Sequence
  chemically synthesized
atggatcagggtcccactta

SEQ ID NO: 304275 - DNA, 20 bp, Artificial Sequence
  chemically synthesized
ccagtgaggaggatggatca

SEQ ID NO: 304276 - DNA, 20 bp, Artificial Sequence
  chemically synthesized
cccagtgaggaggatggatc

SEQ ID NO: 304277 - DNA, 20 bp, Artificial Sequence
  chemically synthesized
acccagtgaggaggatggat

SEQ ID NO: 304278 - DNA, 20 bp, Artificial Sequence
  chemically synthesized
gtcccacccagtgaggagga

SEQ ID NO: 304279 - DNA, 20 bp, Artificial Sequence
  chemically synthesized
ccctgatccatcctcctcac

SEQ ID NO: 304280 - DNA, 20 bp, Artificial Sequence
  chemically synthesized
cctgatccatcctcctcact

SEQ ID NO: 304281 - DNA, 20 bp, Artificial Sequence
  chemically synthesized
ggaggtcccacccagtgagg

SEQ ID NO: 304282 - DNA, 20 bp, Artificial Sequence
  chemically synthesized
gggaggtcccacccagtgag

SEQ ID NO: 304283 - DNA, 20 bp, Artificial Sequence
  chemically synthesized
gatccatcctcctcactggg

SEQ ID NO: 304284 - DNA, 20 bp, Artificial Sequence
  chemically synthesized
cagggaggtcccacccagtg

SEQ ID NO: 304285 - DNA, 20 bp, Artificial Sequence
  chemically synthesized
atccatcctcctcactgggt

SEQ ID NO: 304286 - DNA, 20 bp, Artificial Sequence
  chemically synthesized
tcagggaggtcccacccagt

SEQ ID NO: 304287 - DNA, 20 bp, Artificial Sequence
  chemically synthesized
cccctcagggaggtcccacc

SEQ ID NO: 304288 - DNA, 20 bp, Artificial Sequence
  chemically synthesized
tcactgggtgggacctccct

SEQ ID NO: 304289 - DNA, 20 bp, Artificial Sequence
  chemically synthesized
cactgggtgggacctccctg

SEQ ID NO: 304290 - DNA, 20 bp, Artificial Sequence
  chemically synthesized
actgggtgggacctccctga

SEQ ID NO: 304291 - DNA, 20 bp, Artificial Sequence
  chemically synthesized
ctgggtgggacctccctgag

SEQ ID NO: 304292 - DNA, 20 bp, Artificial Sequence
  chemically synthesized
tggctgaagccccctcaggg

SEQ ID NO: 304293 - DNA, 20 bp, Artificial Sequence
  chemically synthesized
tgggtgggacctccctgagg

SEQ ID NO: 304294 - DNA, 20 bp, Artificial Sequence
  chemically synthesized
atggctgaagccccctcagg

SEQ ID NO: 304295 - DNA, 20 bp, Artificial Sequence
  chemically synthesized
gaatggctgaagccccctca

SEQ ID NO: 304296 - DNA, 20 bp, Artificial Sequence
  chemically synthesized
ggaatggctgaagccccctc

SEQ ID NO: 304297 - DNA, 20 bp, Artificial Sequence
  chemically synthesized
tggaatggctgaagccccct

SEQ ID NO: 304298 - DNA, 20 bp, Artificial Sequence
  chemically synthesized
ggacctccctgagggggctt

SEQ ID NO: 304299 - DNA, 20 bp, Artificial Sequence
  chemically synthesized
aatcctgggtggaatggctg

SEQ ID NO: 304300 - DNA, 20 bp, Artificial Sequence
  chemically synthesized
ggggcttcagccattccacc

SEQ ID NO: 304301 - DNA, 20 bp, Artificial Sequence
  chemically synthesized
ccattgaatcctgggtggaa

SEQ ID NO: 304302 - DNA, 20 bp, Artificial Sequence
  chemically synthesized
gggcttcagccattccaccc

SEQ ID NO: 304303 - DNA, 20 bp, Artificial Sequence
  chemically synthesized
tctatccattgaatcctggg

SEQ ID NO: 304304 - DNA, 20 bp, Artificial Sequence
  chemically synthesized
agctctatccattgaatcct

SEQ ID NO: 304305 - DNA, 20 bp, Artificial Sequence
  chemically synthesized
gagctctatccattgaatcc

SEQ ID NO: 304306 - DNA, 20 bp, Artificial Sequence
  chemically synthesized
ccattccacccaggattcaa

SEQ ID NO: 304307 - DNA, 20 bp, Artificial Sequence
  chemically synthesized
tccacccaggattcaatgga

SEQ ID NO: 304308 - DNA, 20 bp, Artificial Sequence
  chemically synthesized
cacccaggattcaatggata

SEQ ID NO: 304309 - DNA, 20 bp, Artificial Sequence
  chemically synthesized
tctgtcccagggagagatca

SEQ ID NO: 304310 - DNA, 20 bp, Artificial Sequence
  chemically synthesized
gctctgtcccagggagagat

SEQ ID NO: 304311 - DNA, 20 bp, Artificial Sequence
  chemically synthesized
atagagctctgatctctccc

SEQ ID NO: 304312 - DNA, 20 bp, Artificial Sequence
  chemically synthesized
tagagctctgatctctccct

SEQ ID NO: 304313 - DNA, 20 bp, Artificial Sequence
  chemically synthesized
cagaagctctgtcccaggga

SEQ ID NO: 304314 - DNA, 20 bp, Artificial Sequence
  chemically synthesized
gctctgatctctccctggga

SEQ ID NO: 304315 - DNA, 20 bp, Artificial Sequence
  chemically synthesized
cccagaagctctgtcccagg

SEQ ID NO: 304316 - DNA, 20 bp, Artificial Sequence
  chemically synthesized
tctgatctctccctgggaca

SEQ ID NO: 304317 - DNA, 20 bp, Artificial Sequence
  chemically synthesized
ctcccagaagctctgtccca

SEQ ID NO: 304318 - DNA, 20 bp, Artificial Sequence
  chemically synthesized
cctcccagaagctctgtccc

SEQ ID NO: 304319 - DNA, 20 bp, Artificial Sequence
  chemically synthesized
tcctcccagaagctctgtcc

SEQ ID NO: 304320 - DNA, 20 bp, Artificial Sequence
  chemically synthesized
tctccctgggacagagcttc

SEQ ID NO: 304321 - DNA, 20 bp, Artificial Sequence
  chemically synthesized
ctccctgggacagagcttct

SEQ ID NO: 304322 - DNA, 20 bp, Artificial Sequence
  chemically synthesized
ccctgggacagagcttctgg

SEQ ID NO: 304323 - DNA, 20 bp, Artificial Sequence
  chemically synthesized
cctgggacagagcttctggg

SEQ ID NO: 304324 - DNA, 20 bp, Artificial Sequence
  chemically synthesized
gcagctggtcttcctcccag

SEQ ID NO: 304325 - DNA, 20 bp, Artificial Sequence
  chemically synthesized
gggacagagcttctgggagg

SEQ ID NO: 304326 - DNA, 20 bp, Artificial Sequence
  chemically synthesized
gtggcagctggtcttcctcc

SEQ ID NO: 304327 - DNA, 20 bp, Artificial Sequence
  chemically synthesized
agagcttctgggaggaagac

SEQ ID NO: 304328 - DNA, 20 bp, Artificial Sequence
  chemically synthesized
agaactgcagaggtggcagc

SEQ ID NO: 304329 - DNA, 20 bp, Artificial Sequence
  chemically synthesized
tcaaagaactgcagaggtgg

SEQ ID NO: 304330 - DNA, 20 bp, Artificial Sequence
  chemically synthesized
aagaccagctgccacctctg

SEQ ID NO: 304331 - DNA, 20 bp, Artificial Sequence
  chemically synthesized
gtttcaaagaactgcagagg

SEQ ID NO: 304332 - DNA, 20 bp, Artificial Sequence
  chemically synthesized
ttagtttcaaagaactgcag

SEQ ID NO: 304333 - DNA, 20 bp, Artificial Sequence
  chemically synthesized
attagtttcaaagaactgca

SEQ ID NO: 304334 - DNA, 20 bp, Artificial Sequence
  chemically synthesized
tcattagtttcaaagaactg

SEQ ID NO: 304335 - DNA, 20 bp, Artificial Sequence
  chemically synthesized
ctttgttctcattagtttca

SEQ ID NO: 304336 - DNA, 20 bp, Artificial Sequence
  chemically synthesized
tgcagttctttgaaactaat

SEQ ID NO: 304337 - DNA, 20 bp, Artificial Sequence
  chemically synthesized
aattgtctctttgttctcat

SEQ ID NO: 304338 - DNA, 20 bp, Artificial Sequence
  chemically synthesized
ctttgaaactaatgagaaca

SEQ ID NO: 304339 - DNA, 20 bp, Artificial Sequence
  chemically synthesized
ttgaaactaatgagaacaaa

SEQ ID NO: 304340 - DNA, 20 bp, Artificial Sequence
  chemically synthesized
agaacaaagagacaatttat

SEQ ID NO: 304341 - DNA, 20 bp, Artificial Sequence
  chemically synthesized
agacaatttatcagaatctc

SEQ ID NO: 304342 - DNA, 20 bp, Artificial Sequence
  chemically synthesized
gacaatttatcagaatctct

SEQ ID NO: 304343 - DNA, 20 bp, Artificial Sequence
  chemically synthesized
ttatcagaatctctgggacg

SEQ ID NO: 304344 - DNA, 20 bp, Artificial Sequence
  chemically synthesized
actgctttagctgcgtccca

SEQ ID NO: 304345 - DNA, 20 bp, Artificial Sequence
  chemically synthesized
acactgctttagctgcgtcc

SEQ ID NO: 304346 - DNA, 20 bp, Artificial Sequence
  chemically synthesized
gaatctctgggacgcagcta

SEQ ID NO: 304347 - DNA, 20 bp, Artificial Sequence
  chemically synthesized
tctctgggacgcagctaaag

SEQ ID NO: 304348 - DNA, 20 bp, Artificial Sequence
  chemically synthesized
tttccctcttaacactgctt

SEQ ID NO: 304349 - DNA, 20 bp, Artificial Sequence
  chemically synthesized
gacgcagctaaagcagtgtt

SEQ ID NO: 304350 - DNA, 20 bp, Artificial Sequence
  chemically synthesized
cgcagctaaagcagtgttaa

SEQ ID NO: 304351 - DNA, 20 bp, Artificial Sequence
  chemically synthesized
gcagctaaagcagtgttaag

SEQ ID NO: 304352 - DNA, 20 bp, Artificial Sequence
  chemically synthesized
cagctaaagcagtgttaaga

SEQ ID NO: 304353 - DNA, 20 bp, Artificial Sequence
  chemically synthesized
agtgttaagagggaaattta

SEQ ID NO: 304354 - DNA, 20 bp, Artificial Sequence
  chemically synthesized
agctatttgatgtgagcatt

SEQ ID NO: 304355 - DNA, 20 bp, Artificial Sequence
  chemically synthesized
tctttctagctatttgatgt

SEQ ID NO: 304356 - DNA, 20 bp, Artificial Sequence
  chemically synthesized
cactaaatgctcacatcaaa

SEQ ID NO: 304357 - DNA, 20 bp, Artificial Sequence
  chemically synthesized
aaatgctcacatcaaatagc

SEQ ID NO: 304358 - DNA, 20 bp, Artificial Sequence
  chemically synthesized
gctcacatcaaatagctaga

SEQ ID NO: 304359 - DNA, 20 bp, Artificial Sequence
  chemically synthesized
ttaggctgttaagatctttc

SEQ ID NO: 304360 - DNA, 20 bp, Artificial Sequence
  chemically synthesized
aatagctagaaagatcttaa

SEQ ID NO: 304361 - DNA, 20 bp, Artificial Sequence
  chemically synthesized
atttgagatgttaggctgtt

SEQ ID NO: 304362 - DNA, 20 bp, Artificial Sequence
  chemically synthesized
gtttttttatttgagatgtt

SEQ ID NO: 304363 - DNA, 20 bp, Artificial Sequence
  chemically synthesized
agtttttttatttgagatgt

SEQ ID NO: 304364 - DNA, 20 bp, Artificial Sequence
  chemically synthesized
gtttgctagtttttttattt

SEQ ID NO: 304365 - DNA, 20 bp, Artificial Sequence
  chemically synthesized
aacatctcaaataaaaaaac

SEQ ID NO: 304366 - DNA, 20 bp, Artificial Sequence
  chemically synthesized
aataaaaaaactagcaaacc

SEQ ID NO: 304367 - DNA, 20 bp, Artificial Sequence
  chemically synthesized
tttgtttgctcttggtttgc

SEQ ID NO: 304368 - DNA, 20 bp, Artificial Sequence
  chemically synthesized
taaaaaaactagcaaaccaa

SEQ ID NO: 304369 - DNA, 20 bp, Artificial Sequence
  chemically synthesized
atttcttgtttgtttgctct

SEQ ID NO: 304370 - DNA, 20 bp, Artificial Sequence
  chemically synthesized
caaaccaagagcaaacaaac

SEQ ID NO: 304371 - DNA, 20 bp, Artificial Sequence
  chemically synthesized
caaacaaacaagaaataacc

SEQ ID NO: 304372 - DNA, 20 bp, Artificial Sequence
  chemically synthesized
aaacaagaaataaccaagat

SEQ ID NO: 304373 - DNA, 20 bp, Artificial Sequence
  chemically synthesized
acaagaaataaccaagatca

SEQ ID NO: 304374 - DNA, 20 bp, Artificial Sequence
  chemically synthesized
cttcagttcagctctgatct

SEQ ID NO: 304375 - DNA, 20 bp, Artificial Sequence
  chemically synthesized
ccaagatcagagctgaactg

SEQ ID NO: 304376 - DNA, 20 bp, Artificial Sequence
  chemically synthesized
caagatcagagctgaactga

SEQ ID NO: 304377 - DNA, 20 bp, Artificial Sequence
  chemically synthesized
tgtctttatctccttcagtt

SEQ ID NO: 304378 - DNA, 20 bp, Artificial Sequence
  chemically synthesized
agatcagagctgaactgaag

SEQ ID NO: 304379 - DNA, 20 bp, Artificial Sequence
  chemically synthesized
tttcatgtctttatctcctt

SEQ ID NO: 304380 - DNA, 20 bp, Artificial Sequence
  chemically synthesized
gagctgaactgaaggagata

SEQ ID NO: 304381 - DNA, 20 bp, Artificial Sequence
  chemically synthesized
gattcatttagttttttgga

SEQ ID NO: 304382 - DNA, 20 bp, Artificial Sequence
  chemically synthesized
ggattcatttagttttttgg

SEQ ID NO: 304383 - DNA, 20 bp, Artificial Sequence
  chemically synthesized
tggattcatttagttttttg

SEQ ID NO: 304384 - DNA, 20 bp, Artificial Sequence
  chemically synthesized
cctggattcatttagttttt

SEQ ID NO: 304385 - DNA, 20 bp, Artificial Sequence
  chemically synthesized
aaccagctcctggattcatt

SEQ ID NO: 304386 - DNA, 20 bp, Artificial Sequence
  chemically synthesized
tccaaaaaactaaatgaatc

SEQ ID NO: 304387 - DNA, 20 bp, Artificial Sequence
  chemically synthesized
ccaaaaaactaaatgaatcc

SEQ ID NO: 304388 - DNA, 20 bp, Artificial Sequence
  chemically synthesized
aaaaaactaaatgaatccag

SEQ ID NO: 304389 - DNA, 20 bp, Artificial Sequence
  chemically synthesized
aactaaatgaatccaggagc

SEQ ID NO: 304390 - DNA, 20 bp, Artificial Sequence
  chemically synthesized
tttttccaaaaaccagctcc

SEQ ID NO: 304391 - DNA, 20 bp, Artificial Sequence
  chemically synthesized
tgaatccaggagctggtttt

SEQ ID NO: 304392 - DNA, 20 bp, Artificial Sequence
  chemically synthesized
ttttatttttttccaaaaac

SEQ ID NO: 304393 - DNA, 20 bp, Artificial Sequence
  chemically synthesized
ggaaaaaaataaaaataaaa

SEQ ID NO: 304394 - DNA, 20 bp, Artificial Sequence
  chemically synthesized
gaaaaaaataaaaataaaaa

SEQ ID NO: 304395 - DNA, 20 bp, Artificial Sequence
  chemically synthesized
aaaaataaaaataaaaaagg

SEQ ID NO: 304396 - DNA, 20 bp, Artificial Sequence
  chemically synthesized
aaataaaaaaggtagacttc

SEQ ID NO: 304397 - DNA, 20 bp, Artificial Sequence
  chemically synthesized
aaaaaaggtagacttctagt

SEQ ID NO: 304398 - DNA, 20 bp, Artificial Sequence
  chemically synthesized
ttccttattagtctaactag

SEQ ID NO: 304399 - DNA, 20 bp, Artificial Sequence
  chemically synthesized
ttcttccttattagtctaac

SEQ ID NO: 304400 - DNA, 20 bp, Artificial Sequence
  chemically synthesized
agacttctagttagactaat

SEQ ID NO: 304401 - DNA, 20 bp, Artificial Sequence
  chemically synthesized
gacttctagttagactaata

SEQ ID NO: 304402 - DNA, 20 bp, Artificial Sequence
  chemically synthesized
ttctagttagactaataagg

SEQ ID NO: 304403 - DNA, 20 bp, Artificial Sequence
  chemically synthesized
ttctctcttttcttccttat

SEQ ID NO: 304404 - DNA, 20 bp, Artificial Sequence
  chemically synthesized
gttagactaataaggaagaa

SEQ ID NO: 304405 - DNA, 20 bp, Artificial Sequence
  chemically synthesized
tagactaataaggaagaaaa

SEQ ID NO: 304406 - DNA, 20 bp, Artificial Sequence
  chemically synthesized
gactaataaggaagaaaaga

SEQ ID NO: 304407 - DNA, 20 bp, Artificial Sequence
  chemically synthesized
taataaggaagaaaagagag

SEQ ID NO: 304408 - DNA, 20 bp, Artificial Sequence
  chemically synthesized
taaacacaatgaaaaatttg

SEQ ID NO: 304409 - DNA, 20 bp, Artificial Sequence
  chemically synthesized
aacacaatgaaaaatttgaa

SEQ ID NO: 304410 - DNA, 20 bp, Artificial Sequence
  chemically synthesized
acacaatgaaaaatttgaag

SEQ ID NO: 304411 - DNA, 20 bp, Artificial Sequence
  chemically synthesized
ttgtatttctgtagaattat

SEQ ID NO: 304412 - DNA, 20 bp, Artificial Sequence
  chemically synthesized
gaatatcaccaataattcta

SEQ ID NO: 304413 - DNA, 20 bp, Artificial Sequence
  chemically synthesized
gatggttgtttgtatttctg

SEQ ID NO: 304414 - DNA, 20 bp, Artificial Sequence
  chemically synthesized
acagaaatacaaacaaccat

SEQ ID NO: 304415 - DNA, 20 bp, Artificial Sequence
  chemically synthesized
cagaaatacaaacaaccatc

SEQ ID NO: 304416 - DNA, 20 bp, Artificial Sequence
  chemically synthesized
agaaatacaaacaaccatca

SEQ ID NO: 304417 - DNA, 20 bp, Artificial Sequence
  chemically synthesized
gtgtttatagtattccctga

SEQ ID NO: 304418 - DNA, 20 bp, Artificial Sequence
  chemically synthesized
tatgtgcatagaggtgttta

SEQ ID NO: 304419 - DNA, 20 bp, Artificial Sequence
  chemically synthesized
tttctagtttatgtgcatag

SEQ ID NO: 304420 - DNA, 20 bp, Artificial Sequence
  chemically synthesized
ttttctagtttatgtgcata

SEQ ID NO: 304421 - DNA, 20 bp, Artificial Sequence
  chemically synthesized
ggttttctagtttatgtgca

SEQ ID NO: 304422 - DNA, 20 bp, Artificial Sequence
  chemically synthesized
acacctctatgcacataaac

SEQ ID NO: 304423 - DNA, 20 bp, Artificial Sequence
  chemically synthesized
tgcacataaactagaaaacc

SEQ ID NO: 304424 - DNA, 20 bp, Artificial Sequence
  chemically synthesized
tccatttcctctaggttttc

SEQ ID NO: 304425 - DNA, 20 bp, Artificial Sequence
  chemically synthesized
cacataaactagaaaaccta

SEQ ID NO: 304426 - DNA, 20 bp, Artificial Sequence
  chemically synthesized
acataaactagaaaacctag

SEQ ID NO: 304427 - DNA, 20 bp, Artificial Sequence
  chemically synthesized
ataatttatccatttcctct

SEQ ID NO: 304428 - DNA, 20 bp, Artificial Sequence
  chemically synthesized
actagaaaacctagaggaaa

SEQ ID NO: 304429 - DNA, 20 bp, Artificial Sequence
  chemically synthesized
aataatttatccatttcctc

SEQ ID NO: 304430 - DNA, 20 bp, Artificial Sequence
  chemically synthesized
tgaacacatttctcccctct

SEQ ID NO: 304431 - DNA, 20 bp, Artificial Sequence
  chemically synthesized
tatggttcagtcttagaggg

SEQ ID NO: 304432 - DNA, 20 bp, Artificial Sequence
  chemically synthesized
tttatggttcagtcttagag

SEQ ID NO: 304433 - DNA, 20 bp, Artificial Sequence
  chemically synthesized
ctttatggttcagtcttaga

SEQ ID NO: 304434 - DNA, 20 bp, Artificial Sequence
  chemically synthesized
cctttatggttcagtcttag

SEQ ID NO: 304435 - DNA, 20 bp, Artificial Sequence
  chemically synthesized
tcctttatggttcagtctta

SEQ ID NO: 304436 - DNA, 20 bp, Artificial Sequence
  chemically synthesized
tttcctttatggttcagtct

SEQ ID NO: 304437 - DNA, 20 bp, Artificial Sequence
  chemically synthesized
ccctctaagactgaaccata

SEQ ID NO: 304438 - DNA, 20 bp, Artificial Sequence
  chemically synthesized
aattcatttcctttatggtt

SEQ ID NO: 304439 - DNA, 20 bp, Artificial Sequence
  chemically synthesized
cctctaagactgaaccataa

SEQ ID NO: 304440 - DNA, 20 bp, Artificial Sequence
  chemically synthesized
tcagcaattcatttccttta

SEQ ID NO: 304441 - DNA, 20 bp, Artificial Sequence
  chemically synthesized
aaaggaaatgaattgctgaa

SEQ ID NO: 304442 - DNA, 20 bp, Artificial Sequence
  chemically synthesized
gaacgcattattgatctatt

SEQ ID NO: 304443 - DNA, 20 bp, Artificial Sequence
  chemically synthesized
caataatgcgttctgaaatt

SEQ ID NO: 304444 - DNA, 20 bp, Artificial Sequence
  chemically synthesized
aataatgcgttctgaaattg

SEQ ID NO: 304445 - DNA, 20 bp, Artificial Sequence
  chemically synthesized
atttattattgcctcaattt

SEQ ID NO: 304446 - DNA, 20 bp, Artificial Sequence
  chemically synthesized
ctgggcttttgttggttggt

SEQ ID NO: 304447 - DNA, 20 bp, Artificial Sequence
  chemically synthesized
cctgggcttttgttggttgg

SEQ ID NO: 304448 - DNA, 20 bp, Artificial Sequence
  chemically synthesized
ggacctgggcttttgttggt

SEQ ID NO: 304449 - DNA, 20 bp, Artificial Sequence
  chemically synthesized
aatatcccaccaaccaacaa

SEQ ID NO: 304450 - DNA, 20 bp, Artificial Sequence
  chemically synthesized
atctggacctgggcttttgt

SEQ ID NO: 304451 - DNA, 20 bp, Artificial Sequence
  chemically synthesized
cccaccaaccaacaaaagcc

SEQ ID NO: 304452 - DNA, 20 bp, Artificial Sequence
  chemically synthesized
ccaccaaccaacaaaagccc

SEQ ID NO: 304453 - DNA, 20 bp, Artificial Sequence
  chemically synthesized
aaccaacaaaagcccaggtc

SEQ ID NO: 304454 - DNA, 20 bp, Artificial Sequence
  chemically synthesized
ctatgattccatctggacct

SEQ ID NO: 304455 - DNA, 20 bp, Artificial Sequence
  chemically synthesized
gctatgattccatctggacc

SEQ ID NO: 304456 - DNA, 20 bp, Artificial Sequence
  chemically synthesized
aacaaaagcccaggtccaga

SEQ ID NO: 304457 - DNA, 20 bp, Artificial Sequence
  chemically synthesized
aattcagctatgattccatc

SEQ ID NO: 304458 - DNA, 20 bp, Artificial Sequence
  chemically synthesized
cccaggtccagatggaatca

SEQ ID NO: 304459 - DNA, 20 bp, Artificial Sequence
  chemically synthesized
tttgtaccgctagtagaatt

SEQ ID NO: 304460 - DNA, 20 bp, Artificial Sequence
  chemically synthesized
gaatcatagctgaattctac

SEQ ID NO: 304461 - DNA, 20 bp, Artificial Sequence
  chemically synthesized
tcatagctgaattctactag

SEQ ID NO: 304462 - DNA, 20 bp, Artificial Sequence
  chemically synthesized
gctcttctttgtaccgctag

SEQ ID NO: 304463 - DNA, 20 bp, Artificial Sequence
  chemically synthesized
ccagctcttctttgtaccgc

SEQ ID NO: 304464 - DNA, 20 bp, Artificial Sequence
  chemically synthesized
tgaattctactagcggtaca

SEQ ID NO: 304465 - DNA, 20 bp, Artificial Sequence
  chemically synthesized
attctactagcggtacaaag

SEQ ID NO: 304466 - DNA, 20 bp, Artificial Sequence
  chemically synthesized
tctactagcggtacaaagaa

SEQ ID NO: 304467 - DNA, 20 bp, Artificial Sequence
  chemically synthesized
ctagcggtacaaagaagagc

SEQ ID NO: 304468 - DNA, 20 bp, Artificial Sequence
  chemically synthesized
agtttcagtggaaatgatac

SEQ ID NO: 304469 - DNA, 20 bp, Artificial Sequence
  chemically synthesized
tttttttggaatagtttcag

SEQ ID NO: 304470 - DNA, 20 bp, Artificial Sequence
  chemically synthesized
caatttttttggaatagttt

SEQ ID NO: 304471 - DNA, 20 bp, Artificial Sequence
  chemically synthesized
tcttttcaatttttttggaa

SEQ ID NO: 304472 - DNA, 20 bp, Artificial Sequence
  chemically synthesized
tcccttcttttcaatttttt

SEQ ID NO: 304473 - DNA, 20 bp, Artificial Sequence
  chemically synthesized
actattccaaaaaaattgaa

SEQ ID NO: 304474 - DNA, 20 bp, Artificial Sequence
  chemically synthesized
attccaaaaaaattgaaaag

SEQ ID NO: 304475 - DNA, 20 bp, Artificial Sequence
  chemically synthesized
ttccaaaaaaattgaaaaga

SEQ ID NO: 304476 - DNA, 20 bp, Artificial Sequence
  chemically synthesized
tccaaaaaaattgaaaagaa

SEQ ID NO: 304477 - DNA, 20 bp, Artificial Sequence
  chemically synthesized
acctcataatataagtttgg

SEQ ID NO: 304478 - DNA, 20 bp, Artificial Sequence
  chemically synthesized
tgacctcataatataagttt

SEQ ID NO: 304479 - DNA, 20 bp, Artificial Sequence
  chemically synthesized
ctgacctcataatataagtt

SEQ ID NO: 304480 - DNA, 20 bp, Artificial Sequence
  chemically synthesized
ttctcccaaacttatattat

SEQ ID NO: 304481 - DNA, 20 bp, Artificial Sequence
  chemically synthesized
tgatgctgacctcataatat

SEQ ID NO: 304482 - DNA, 20 bp, Artificial Sequence
  chemically synthesized
tctcccaaacttatattatg

SEQ ID NO: 304483 - DNA, 20 bp, Artificial Sequence
  chemically synthesized
ccaaacttatattatgaggt

SEQ ID NO: 304484 - DNA, 20 bp, Artificial Sequence
  chemically synthesized
cctcccaggttttggcatca

SEQ ID NO: 304485 - DNA, 20 bp, Artificial Sequence
  chemically synthesized
ccctcccaggttttggcatc

SEQ ID NO: 304486 - DNA, 20 bp, Artificial Sequence
  chemically synthesized
tccctcccaggttttggcat

SEQ ID NO: 304487 - DNA, 20 bp, Artificial Sequence
  chemically synthesized
atcaccctgatgccaaaacc

SEQ ID NO: 304488 - DNA, 20 bp, Artificial Sequence
  chemically synthesized
tcaccctgatgccaaaacct

SEQ ID NO: 304489 - DNA, 20 bp, Artificial Sequence
  chemically synthesized
cctccctccctcccaggttt

SEQ ID NO: 304490 - DNA, 20 bp, Artificial Sequence
  chemically synthesized
accctgatgccaaaacctgg

SEQ ID NO: 304491 - DNA, 20 bp, Artificial Sequence
  chemically synthesized
ccctgatgccaaaacctggg

SEQ ID NO: 304492 - DNA, 20 bp, Artificial Sequence
  chemically synthesized
cctgatgccaaaacctggga

SEQ ID NO: 304493 - DNA, 20 bp, Artificial Sequence
  chemically synthesized
tgatgccaaaacctgggagg

SEQ ID NO: 304494 - DNA, 20 bp, Artificial Sequence
  chemically synthesized
gatgccaaaacctgggaggg

SEQ ID NO: 304495 - DNA, 20 bp, Artificial Sequence
  chemically synthesized
tccctccctccctccctccc

SEQ ID NO: 304496 - DNA, 20 bp, Artificial Sequence
  chemically synthesized
atgccaaaacctgggaggga

SEQ ID NO: 304497 - DNA, 20 bp, Artificial Sequence
  chemically synthesized
ctccctccctccctccctcc

SEQ ID NO: 304498 - DNA, 20 bp, Artificial Sequence
  chemically synthesized
gccaaaacctgggagggagg

SEQ ID NO: 304499 - DNA, 20 bp, Artificial Sequence
  chemically synthesized
ccaaaacctgggagggaggg

SEQ ID NO: 304500 - DNA, 20 bp, Artificial Sequence
  chemically synthesized
caaaacctgggagggaggga

SEQ ID NO: 304501 - DNA, 20 bp, Artificial Sequence
  chemically synthesized
aaacctgggagggagggagg

SEQ ID NO: 304502 - DNA, 20 bp, Artificial Sequence
  chemically synthesized
aacctgggagggagggaggg

SEQ ID NO: 304503 - DNA, 20 bp, Artificial Sequence
  chemically synthesized
acctgggagggagggaggga

SEQ ID NO: 304504 - DNA, 20 bp, Artificial Sequence
  chemically synthesized
ctgggagggagggagggagg

SEQ ID NO: 304505 - DNA, 20 bp, Artificial Sequence
  chemically synthesized
tgggagggagggagggaggg

SEQ ID NO: 304506 - DNA, 20 bp, Artificial Sequence
  chemically synthesized
gggagggagggagggaggga

SEQ ID NO: 304507 - DNA, 20 bp, Artificial Sequence
  chemically synthesized
gagggagggagggagggagg

SEQ ID NO: 304508 - DNA, 20 bp, Artificial Sequence
  chemically synthesized
agggagggagggagggaggg

SEQ ID NO: 304509 - DNA, 20 bp, Artificial Sequence
  chemically synthesized
gggagggagggagggaggga

SEQ ID NO: 304510 - DNA, 20 bp, Artificial Sequence
  chemically synthesized
ggagggagggagggagggag

SEQ ID NO: 304511 - DNA, 20 bp, Artificial Sequence
  chemically synthesized
gagggagggagggagggagg

SEQ ID NO: 304512 - DNA, 20 bp, Artificial Sequence
  chemically synthesized
gggagggagggagggagggg

SEQ ID NO: 304513 - DNA, 20 bp, Artificial Sequence
  chemically synthesized
ggagggagggagggaggggg

SEQ ID NO: 304514 - DNA, 20 bp, Artificial Sequence
  chemically synthesized
gagggagggagggaggggga

SEQ ID NO: 304515 - DNA, 20 bp, Artificial Sequence
  chemically synthesized
gggagggagggagggggagg

SEQ ID NO: 304516 - DNA, 20 bp, Artificial Sequence
  chemically synthesized
gagggagggagggggaggga

SEQ ID NO: 304517 - DNA, 20 bp, Artificial Sequence
  chemically synthesized
gggagggagggggagggaga

SEQ ID NO: 304518 - DNA, 20 bp, Artificial Sequence
  chemically synthesized
gagggagggggagggagaga

SEQ ID NO: 304519 - DNA, 20 bp, Artificial Sequence
  chemically synthesized
gggagggggagggagagaga

SEQ ID NO: 304520 - DNA, 20 bp, Artificial Sequence
  chemically synthesized
gagggggagggagagagaga

SEQ ID NO: 304521 - DNA, 20 bp, Artificial Sequence
  chemically synthesized
gggggagggagagagagaga

SEQ ID NO: 304522 - DNA, 20 bp, Artificial Sequence
  chemically synthesized
gggagggagagagagagaga

SEQ ID NO: 304523 - DNA, 20 bp, Artificial Sequence
  chemically synthesized
gagggagagagagagagaga

SEQ ID NO: 304524 - DNA, 20 bp, Artificial Sequence
  chemically synthesized
gggagagagagagagagaga

SEQ ID NO: 304525 - DNA, 20 bp, Artificial Sequence
  chemically synthesized
gagagagagagagagagaga

SEQ ID NO: 304526 - DNA, 20 bp, Artificial Sequence
  chemically synthesized
gagagagagagagagagaga

SEQ ID NO: 304527 - DNA, 20 bp, Artificial Sequence
  chemically synthesized
gagagagagagagagagaga

SEQ ID NO: 304528 - DNA, 20 bp, Artificial Sequence
  chemically synthesized
gagagagagagagagagaga

SEQ ID NO: 304529 - DNA, 20 bp, Artificial Sequence
  chemically synthesized
gagagagagagagagagaga

SEQ ID NO: 304530 - DNA, 20 bp, Artificial Sequence
  chemically synthesized
gagagagagagagagagaga

SEQ ID NO: 304531 - DNA, 20 bp, Artificial Sequence
  chemically synthesized
gagagagagagagagagaga

SEQ ID NO: 304532 - DNA, 20 bp, Artificial Sequence
  chemically synthesized
gagagagagagagagagaga

SEQ ID NO: 304533 - DNA, 20 bp, Artificial Sequence
  chemically synthesized
gagagagagagagagagaga

SEQ ID NO: 304534 - DNA, 20 bp, Artificial Sequence
  chemically synthesized
agagagagagagagagagag

SEQ ID NO: 304535 - DNA, 20 bp, Artificial Sequence
  chemically synthesized
gagagagagagagagagaga

SEQ ID NO: 304536 - DNA, 20 bp, Artificial Sequence
  chemically synthesized
gagagagagagagagaagga

SEQ ID NO: 304537 - DNA, 20 bp, Artificial Sequence
  chemically synthesized
agagagagagagaaggaaag

SEQ ID NO: 304538 - DNA, 20 bp, Artificial Sequence
  chemically synthesized
agagagagaaggaaagaaga

SEQ ID NO: 304539 - DNA, 20 bp, Artificial Sequence
  chemically synthesized
agagaaggaaagaagaaaga

SEQ ID NO: 304540 - DNA, 20 bp, Artificial Sequence
  chemically synthesized
aaggaaagaagaaagaaaga

SEQ ID NO: 304541 - DNA, 20 bp, Artificial Sequence
  chemically synthesized
aaagaagaaagaaagaaaga

SEQ ID NO: 304542 - DNA, 20 bp, Artificial Sequence
  chemically synthesized
aagaaagaaagaaagaaaga

SEQ ID NO: 304543 - DNA, 20 bp, Artificial Sequence
  chemically synthesized
aagaaagaaagaaagaaaga

SEQ ID NO: 304544 - DNA, 20 bp, Artificial Sequence
  chemically synthesized
aagaaagaaagaaagaaaga

SEQ ID NO: 304545 - DNA, 20 bp, Artificial Sequence
  chemically synthesized
aagaaagaaagaaagaaaga

SEQ ID NO: 304546 - DNA, 20 bp, Artificial Sequence
  chemically synthesized
aagaaagaaagaaagaaaga

SEQ ID NO: 304547 - DNA, 20 bp, Artificial Sequence
  chemically synthesized
aagaaagaaagaaagaaaga

SEQ ID NO: 304548 - DNA, 20 bp, Artificial Sequence
  chemically synthesized
aagaaagaaagaaagaaaga

SEQ ID NO: 304549 - DNA, 20 bp, Artificial Sequence
  chemically synthesized
aagaaagaaagaaagaaaga

SEQ ID NO: 304550 - DNA, 20 bp, Artificial Sequence
  chemically synthesized
aagaaagaaagaaagaaaga

SEQ ID NO: 304551 - DNA, 20 bp, Artificial Sequence
  chemically synthesized
aagaaagaaagaaagaaaga

SEQ ID NO: 304552 - DNA, 20 bp, Artificial Sequence
  chemically synthesized
aagaaagaaagaaagaaaga

SEQ ID NO: 304553 - DNA, 20 bp, Artificial Sequence
  chemically synthesized
gaaagaaagaaagaaagaaa

SEQ ID NO: 304554 - DNA, 20 bp, Artificial Sequence
  chemically synthesized
aagaaagaaagaaagaaaga

SEQ ID NO: 304555 - DNA, 20 bp, Artificial Sequence
  chemically synthesized
gaaagaaagaaagaaagaga

SEQ ID NO: 304556 - DNA, 20 bp, Artificial Sequence
  chemically synthesized
aagaaagaaagaaagagaga

SEQ ID NO: 304557 - DNA, 20 bp, Artificial Sequence
  chemically synthesized
gaaagaaagaaagagagaga

SEQ ID NO: 304558 - DNA, 20 bp, Artificial Sequence
  chemically synthesized
aaagaaagaaagagagagag

SEQ ID NO: 304559 - DNA, 20 bp, Artificial Sequence
  chemically synthesized
aagaaagaaagagagagaga

SEQ ID NO: 304560 - DNA, 20 bp, Artificial Sequence
  chemically synthesized
gaaagaaagagagagagagg

SEQ ID NO: 304561 - DNA, 20 bp, Artificial Sequence
  chemically synthesized
aagaaagagagagagaggga

SEQ ID NO: 304562 - DNA, 20 bp, Artificial Sequence
  chemically synthesized
gaaagagagagagagggaga

SEQ ID NO: 304563 - DNA, 20 bp, Artificial Sequence
  chemically synthesized
gagagagagagggagagaga

SEQ ID NO: 304564 - DNA, 20 bp, Artificial Sequence
  chemically synthesized
gagagagggagagagaaaga

SEQ ID NO: 304565 - DNA, 20 bp, Artificial Sequence
  chemically synthesized
gagagggagagagaaagaaa

SEQ ID NO: 304566 - DNA, 20 bp, Artificial Sequence
  chemically synthesized
gagggagagagaaagaaaga

SEQ ID NO: 304567 - DNA, 20 bp, Artificial Sequence
  chemically synthesized
gggagagagaaagaaagaga

SEQ ID NO: 304568 - DNA, 20 bp, Artificial Sequence
  chemically synthesized
gagagagaaagaaagagaga

SEQ ID NO: 304569 - DNA, 20 bp, Artificial Sequence
  chemically synthesized
gagagaaagaaagagagaga

SEQ ID NO: 304570 - DNA, 20 bp, Artificial Sequence
  chemically synthesized
gagaaagaaagagagagaga

SEQ ID NO: 304571 - DNA, 20 bp, Artificial Sequence
  chemically synthesized
gaaagaaagagagagagaga

SEQ ID NO: 304572 - DNA, 20 bp, Artificial Sequence
  chemically synthesized
aagaaagagagagagagaga

SEQ ID NO: 304573 - DNA, 20 bp, Artificial Sequence
  chemically synthesized
aagagagagagagagagaga

SEQ ID NO: 304574 - DNA, 20 bp, Artificial Sequence
  chemically synthesized
gagagagagagagagaaaga

SEQ ID NO: 304575 - DNA, 20 bp, Artificial Sequence
  chemically synthesized
gagagagagagagaaagaaa

SEQ ID NO: 304576 - DNA, 20 bp, Artificial Sequence
  chemically synthesized
gagagagagagaaagaaaga

SEQ ID NO: 304577 - DNA, 20 bp, Artificial Sequence
  chemically synthesized
gagagagaaagaaagagaga

SEQ ID NO: 304578 - DNA, 20 bp, Artificial Sequence
  chemically synthesized
gagaaagaaagagagaaaga

SEQ ID NO: 304579 - DNA, 20 bp, Artificial Sequence
  chemically synthesized
agaaagagagaaagaaagaa

SEQ ID NO: 304580 - DNA, 20 bp, Artificial Sequence
  chemically synthesized
aaagaaagaaaagcaaactt

SEQ ID NO: 304581 - DNA, 20 bp, Artificial Sequence
  chemically synthesized
aagaaagaaaagcaaacttc

SEQ ID NO: 304582 - DNA, 20 bp, Artificial Sequence
  chemically synthesized
tcatcaatgatattagcctg

SEQ ID NO: 304583 - DNA, 20 bp, Artificial Sequence
  chemically synthesized
tcagtgttcatcaatgatat

SEQ ID NO: 304584 - DNA, 20 bp, Artificial Sequence
  chemically synthesized
ggtattgagaattgttgcat

SEQ ID NO: 304585 - DNA, 20 bp, Artificial Sequence
  chemically synthesized
gatgcaacaattctcaatac

SEQ ID NO: 304586 - DNA, 20 bp, Artificial Sequence
  chemically synthesized
ggatttggtttgctggtatt

SEQ ID NO: 304587 - DNA, 20 bp, Artificial Sequence
  chemically synthesized
tgctactggatttggtttgc

SEQ ID NO: 304588 - DNA, 20 bp, Artificial Sequence
  chemically synthesized
caataccagcaaaccaaatc

SEQ ID NO: 304589 - DNA, 20 bp, Artificial Sequence
  chemically synthesized
taccagcaaaccaaatccag

SEQ ID NO: 304590 - DNA, 20 bp, Artificial Sequence
  chemically synthesized
ttttgatatgctactggatt

SEQ ID NO: 304591 - DNA, 20 bp, Artificial Sequence
  chemically synthesized
taagctttttgatatgctac

SEQ ID NO: 304592 - DNA, 20 bp, Artificial Sequence
  chemically synthesized
aaatccagtagcatatcaaa

SEQ ID NO: 304593 - DNA, 20 bp, Artificial Sequence
  chemically synthesized
caaacttgattgtggtggat

SEQ ID NO: 304594 - DNA, 20 bp, Artificial Sequence
  chemically synthesized
tgaagcaaacttgattgtgg

SEQ ID NO: 304595 - DNA, 20 bp, Artificial Sequence
  chemically synthesized
aaagcttatccaccacaatc

SEQ ID NO: 304596 - DNA, 20 bp, Artificial Sequence
  chemically synthesized
ggatgaagcaaacttgattg

SEQ ID NO: 304597 - DNA, 20 bp, Artificial Sequence
  chemically synthesized
aatcaagtttgcttcatccc

SEQ ID NO: 304598 - DNA, 20 bp, Artificial Sequence
  chemically synthesized
aaccttgcatgctagggatg

SEQ ID NO: 304599 - DNA, 20 bp, Artificial Sequence
  chemically synthesized
taaactaaccttgcatgcta

SEQ ID NO: 304600 - DNA, 20 bp, Artificial Sequence
  chemically synthesized
ttgcttcatccctagcatgc

SEQ ID NO: 304601 - DNA, 20 bp, Artificial Sequence
  chemically synthesized
ttaaactaaccttgcatgct

SEQ ID NO: 304602 - DNA, 20 bp, Artificial Sequence
  chemically synthesized
tgcttcatccctagcatgca

SEQ ID NO: 304603 - DNA, 20 bp, Artificial Sequence
  chemically synthesized
gttaaactaaccttgcatgc

SEQ ID NO: 304604 - DNA, 20 bp, Artificial Sequence
  chemically synthesized
tcatccctagcatgcaaggt

SEQ ID NO: 304605 - DNA, 20 bp, Artificial Sequence
  chemically synthesized
catgtgattcatcacataaa

SEQ ID NO: 304606 - DNA, 20 bp, Artificial Sequence
  chemically synthesized
tcatcacataaacagaacta

SEQ ID NO: 304607 - DNA, 20 bp, Artificial Sequence
  chemically synthesized
agtcatgtggtttttgtctt

SEQ ID NO: 304608 - DNA, 20 bp, Artificial Sequence
  chemically synthesized
tgtctattgagatagtcatg

SEQ ID NO: 304609 - DNA, 20 bp, Artificial Sequence
  chemically synthesized
aaaccacatgactatctcaa

SEQ ID NO: 304610 - DNA, 20 bp, Artificial Sequence
  chemically synthesized
cttttggttgtctattgaga

SEQ ID NO: 304611 - DNA, 20 bp, Artificial Sequence
  chemically synthesized
ataccttttggttgtctatt

SEQ ID NO: 304612 - DNA, 20 bp, Artificial Sequence
  chemically synthesized
ctatctcaatagacaaccaa

SEQ ID NO: 304613 - DNA, 20 bp, Artificial Sequence
  chemically synthesized
tatctcaatagacaaccaaa

SEQ ID NO: 304614 - DNA, 20 bp, Artificial Sequence
  chemically synthesized
gaattttattaaataccttt

SEQ ID NO: 304615 - DNA, 20 bp, Artificial Sequence
  chemically synthesized
ttgagaatttttaacatgaa

SEQ ID NO: 304616 - DNA, 20 bp, Artificial Sequence
  chemically synthesized
attgagaatttttaacatga

SEQ ID NO: 304617 - DNA, 20 bp, Artificial Sequence
  chemically synthesized
tattgagaatttttaacatg

SEQ ID NO: 304618 - DNA, 20 bp, Artificial Sequence
  chemically synthesized
gttaaaaattctcaataaac

SEQ ID NO: 304619 - DNA, 20 bp, Artificial Sequence
  chemically synthesized
ccttcgatacctagtttatt

SEQ ID NO: 304620 - DNA, 20 bp, Artificial Sequence
  chemically synthesized
ttaaaaattctcaataaact

SEQ ID NO: 304621 - DNA, 20 bp, Artificial Sequence
  chemically synthesized
tctcaataaactaggtatcg

SEQ ID NO: 304622 - DNA, 20 bp, Artificial Sequence
  chemically synthesized
aggtatgttccttcgatacc

SEQ ID NO: 304623 - DNA, 20 bp, Artificial Sequence
  chemically synthesized
ctcaataaactaggtatcga

SEQ ID NO: 304624 - DNA, 20 bp, Artificial Sequence
  chemically synthesized
ttatggctcttattattttg

SEQ ID NO: 304625 - DNA, 20 bp, Artificial Sequence
  chemically synthesized
tttatggctcttattatttt

SEQ ID NO: 304626 - DNA, 20 bp, Artificial Sequence
  chemically synthesized
ggaacatacctcaaaataat

SEQ ID NO: 304627 - DNA, 20 bp, Artificial Sequence
  chemically synthesized
aacatacctcaaaataataa

SEQ ID NO: 304628 - DNA, 20 bp, Artificial Sequence
  chemically synthesized
ggatgtgggtttataattta

SEQ ID NO: 304629 - DNA, 20 bp, Artificial Sequence
  chemically synthesized
gcttttgcccatttggatgt

SEQ ID NO: 304630 - DNA, 20 bp, Artificial Sequence
  chemically synthesized
agcttttgcccatttggatg

SEQ ID NO: 304631 - DNA, 20 bp, Artificial Sequence
  chemically synthesized
attataaacccacatccaaa

SEQ ID NO: 304632 - DNA, 20 bp, Artificial Sequence
  chemically synthesized
ttataaacccacatccaaat

SEQ ID NO: 304633 - DNA, 20 bp, Artificial Sequence
  chemically synthesized
gcttctagcttttgcccatt

SEQ ID NO: 304634 - DNA, 20 bp, Artificial Sequence
  chemically synthesized
acccacatccaaatgggcaa

SEQ ID NO: 304635 - DNA, 20 bp, Artificial Sequence
  chemically synthesized
acatccaaatgggcaaaagc

SEQ ID NO: 304636 - DNA, 20 bp, Artificial Sequence
  chemically synthesized
tccaaatgggcaaaagctag

SEQ ID NO: 304637 - DNA, 20 bp, Artificial Sequence
  chemically synthesized
gttttcagggggaatgcttc

SEQ ID NO: 304638 - DNA, 20 bp, Artificial Sequence
  chemically synthesized
atcttgggccagttttcagg

SEQ ID NO: 304639 - DNA, 20 bp, Artificial Sequence
  chemically synthesized
tatcttgggccagttttcag

SEQ ID NO: 304640 - DNA, 20 bp, Artificial Sequence
  chemically synthesized
gaagcattccccctgaaaac

SEQ ID NO: 304641 - DNA, 20 bp, Artificial Sequence
  chemically synthesized
ttatcttgggccagttttca

SEQ ID NO: 304642 - DNA, 20 bp, Artificial Sequence
  chemically synthesized
cttatcttgggccagttttc

SEQ ID NO: 304643 - DNA, 20 bp, Artificial Sequence
  chemically synthesized
ccttatcttgggccagtttt

SEQ ID NO: 304644 - DNA, 20 bp, Artificial Sequence
  chemically synthesized
ttccccctgaaaactggccc

SEQ ID NO: 304645 - DNA, 20 bp, Artificial Sequence
  chemically synthesized
atggcatccttatcttgggc

SEQ ID NO: 304646 - DNA, 20 bp, Artificial Sequence
  chemically synthesized
cctgaaaactggcccaagat

SEQ ID NO: 304647 - DNA, 20 bp, Artificial Sequence
  chemically synthesized
ctgaaaactggcccaagata

SEQ ID NO: 304648 - DNA, 20 bp, Artificial Sequence
  chemically synthesized
agagatggcatccttatctt

SEQ ID NO: 304649 - DNA, 20 bp, Artificial Sequence
  chemically synthesized
gagagatggcatccttatct

SEQ ID NO: 304650 - DNA, 20 bp, Artificial Sequence
  chemically synthesized
tgaaaaggagtggtgagaga

SEQ ID NO: 304651 - DNA, 20 bp, Artificial Sequence
  chemically synthesized
atgttgaaaaggagtggtga

SEQ ID NO: 304652 - DNA, 20 bp, Artificial Sequence
  chemically synthesized
ctatgttgaaaaggagtggt

SEQ ID NO: 304653 - DNA, 20 bp, Artificial Sequence
  chemically synthesized
aatactatgttgaaaaggag

SEQ ID NO: 304654 - DNA, 20 bp, Artificial Sequence
  chemically synthesized
tccaatactatgttgaaaag

SEQ ID NO: 304655 - DNA, 20 bp, Artificial Sequence
  chemically synthesized
cttccaatactatgttgaaa

SEQ ID NO: 304656 - DNA, 20 bp, Artificial Sequence
  chemically synthesized
ctcaccactccttttcaaca

SEQ ID NO: 304657 - DNA, 20 bp, Artificial Sequence
  chemically synthesized
acttccaatactatgttgaa

SEQ ID NO: 304658 - DNA, 20 bp, Artificial Sequence
  chemically synthesized
actccttttcaacatagtat

SEQ ID NO: 304659 - DNA, 20 bp, Artificial Sequence
  chemically synthesized
ccttttcaacatagtattgg

SEQ ID NO: 304660 - DNA, 20 bp, Artificial Sequence
  chemically synthesized
atagtattggaagttctgac

SEQ ID NO: 304661 - DNA, 20 bp, Artificial Sequence
  chemically synthesized
tagtattggaagttctgacc

SEQ ID NO: 304662 - DNA, 20 bp, Artificial Sequence
  chemically synthesized
agtattggaagttctgacca

SEQ ID NO: 304663 - DNA, 20 bp, Artificial Sequence
  chemically synthesized
tcttccctgattgccctggt

SEQ ID NO: 304664 - DNA, 20 bp, Artificial Sequence
  chemically synthesized
gaagttctgaccagggcaat

SEQ ID NO: 304665 - DNA, 20 bp, Artificial Sequence
  chemically synthesized
tttctcttccctgattgccc

SEQ ID NO: 304666 - DNA, 20 bp, Artificial Sequence
  chemically synthesized
aagttctgaccagggcaatc

SEQ ID NO: 304667 - DNA, 20 bp, Artificial Sequence
  chemically synthesized
agttctgaccagggcaatca

SEQ ID NO: 304668 - DNA, 20 bp, Artificial Sequence
  chemically synthesized
tctgaccagggcaatcaggg

SEQ ID NO: 304669 - DNA, 20 bp, Artificial Sequence
  chemically synthesized
tgaccagggcaatcagggaa

SEQ ID NO: 304670 - DNA, 20 bp, Artificial Sequence
  chemically synthesized
cagggcaatcagggaagaga

SEQ ID NO: 304671 - DNA, 20 bp, Artificial Sequence
  chemically synthesized
tcagggaagagaaagaaata

SEQ ID NO: 304672 - DNA, 20 bp, Artificial Sequence
  chemically synthesized
cagggaagagaaagaaataa

SEQ ID NO: 304673 - DNA, 20 bp, Artificial Sequence
  chemically synthesized
agggaagagaaagaaataaa

SEQ ID NO: 304674 - DNA, 20 bp, Artificial Sequence
  chemically synthesized
agaaataaagggtattcaca

SEQ ID NO: 304675 - DNA, 20 bp, Artificial Sequence
  chemically synthesized
gaaataaagggtattcacat

SEQ ID NO: 304676 - DNA, 20 bp, Artificial Sequence
  chemically synthesized
ataaagggtattcacatagg

SEQ ID NO: 304677 - DNA, 20 bp, Artificial Sequence
  chemically synthesized
aaagggtattcacataggaa

SEQ ID NO: 304678 - DNA, 20 bp, Artificial Sequence
  chemically synthesized
agggtattcacataggaaga

SEQ ID NO: 304679 - DNA, 20 bp, Artificial Sequence
  chemically synthesized
gggtattcacataggaagag

SEQ ID NO: 304680 - DNA, 20 bp, Artificial Sequence
  chemically synthesized
tattcacataggaagagagg

SEQ ID NO: 304681 - DNA, 20 bp, Artificial Sequence
  chemically synthesized
agtcaaattatttttgtatt

SEQ ID NO: 304682 - DNA, 20 bp, Artificial Sequence
  chemically synthesized
agatgacatgaacctatatc

SEQ ID NO: 304683 - DNA, 20 bp, Artificial Sequence
  chemically synthesized
aatgggggttttctggatat

SEQ ID NO: 304684 - DNA, 20 bp, Artificial Sequence
  chemically synthesized
caatgggggttttctggata

SEQ ID NO: 304685 - DNA, 20 bp, Artificial Sequence
  chemically synthesized
ctgagacaatgggggttttc

SEQ ID NO: 304686 - DNA, 20 bp, Artificial Sequence
  chemically synthesized
cttttgggctgagacaatgg

SEQ ID NO: 304687 - DNA, 20 bp, Artificial Sequence
  chemically synthesized
gcttttgggctgagacaatg

SEQ ID NO: 304688 - DNA, 20 bp, Artificial Sequence
  chemically synthesized
ccagaaaacccccattgtct

SEQ ID NO: 304689 - DNA, 20 bp, Artificial Sequence
  chemically synthesized
agcttttgggctgagacaat

SEQ ID NO: 304690 - DNA, 20 bp, Artificial Sequence
  chemically synthesized
tagcttttgggctgagacaa

SEQ ID NO: 304691 - DNA, 20 bp, Artificial Sequence
  chemically synthesized
cccccattgtctcagcccaa

SEQ ID NO: 304692 - DNA, 20 bp, Artificial Sequence
  chemically synthesized
gaagtcttagcttttgggct

SEQ ID NO: 304693 - DNA, 20 bp, Artificial Sequence
  chemically synthesized
attgtctcagcccaaaagct

SEQ ID NO: 304694 - DNA, 20 bp, Artificial Sequence
  chemically synthesized
agtttgaagtcttagctttt

SEQ ID NO: 304695 - DNA, 20 bp, Artificial Sequence
  chemically synthesized
tagtttgaagtcttagcttt

SEQ ID NO: 304696 - DNA, 20 bp, Artificial Sequence
  chemically synthesized
tgtagtatagtttgaagtct

SEQ ID NO: 304697 - DNA, 20 bp, Artificial Sequence
  chemically synthesized
taaccttgtagtatagtttg

SEQ ID NO: 304698 - DNA, 20 bp, Artificial Sequence
  chemically synthesized
aagacttcaaactatactac

SEQ ID NO: 304699 - DNA, 20 bp, Artificial Sequence
  chemically synthesized
agacttcaaactatactaca

SEQ ID NO: 304700 - DNA, 20 bp, Artificial Sequence
  chemically synthesized
gtgactgtaaccttgtagta

SEQ ID NO: 304701 - DNA, 20 bp, Artificial Sequence
  chemically synthesized
ttctggtgactgtaaccttg

SEQ ID NO: 304702 - DNA, 20 bp, Artificial Sequence
  chemically synthesized
caaactatactacaaggtta

SEQ ID NO: 304703 - DNA, 20 bp, Artificial Sequence
  chemically synthesized
tactacaaggttacagtcac

SEQ ID NO: 304704 - DNA, 20 bp, Artificial Sequence
  chemically synthesized
caaggttacagtcaccagaa

SEQ ID NO: 304705 - DNA, 20 bp, Artificial Sequence
  chemically synthesized
ggttacagtcaccagaaaag

SEQ ID NO: 304706 - DNA, 20 bp, Artificial Sequence
  chemically synthesized
gttacagtcaccagaaaagc

SEQ ID NO: 304707 - DNA, 20 bp, Artificial Sequence
  chemically synthesized
gtaccagtaccctgcttttc

SEQ ID NO: 304708 - DNA, 20 bp, Artificial Sequence
  chemically synthesized
ttacagtcaccagaaaagca

SEQ ID NO: 304709 - DNA, 20 bp, Artificial Sequence
  chemically synthesized
tcaccagaaaagcagggtac

SEQ ID NO: 304710 - DNA, 20 bp, Artificial Sequence
  chemically synthesized
gaaaagcagggtactggtac

SEQ ID NO: 304711 - DNA, 20 bp, Artificial Sequence
  chemically synthesized
ctatgtgtctgttcttgtac

SEQ ID NO: 304712 - DNA, 20 bp, Artificial Sequence
  chemically synthesized
gcagggtactggtacaagaa

SEQ ID NO: 304713 - DNA, 20 bp, Artificial Sequence
  chemically synthesized
ctggtacaagaacagacaca

SEQ ID NO: 304714 - DNA, 20 bp, Artificial Sequence
  chemically synthesized
agacacatagaccaatgaaa

SEQ ID NO: 304715 - DNA, 20 bp, Artificial Sequence
  chemically synthesized
agttctctattctgtttcat

SEQ ID NO: 304716 - DNA, 20 bp, Artificial Sequence
  chemically synthesized
catagaccaatgaaacagaa

SEQ ID NO: 304717 - DNA, 20 bp, Artificial Sequence
  chemically synthesized
tagaccaatgaaacagaata

SEQ ID NO: 304718 - DNA, 20 bp, Artificial Sequence
  chemically synthesized
atgaaacagaatagagaact

SEQ ID NO: 304719 - DNA, 20 bp, Artificial Sequence
  chemically synthesized
agaatagagaactcagaaat

SEQ ID NO: 304720 - DNA, 20 bp, Artificial Sequence
  chemically synthesized
aggtgcgtggtcttatttct

SEQ ID NO: 304721 - DNA, 20 bp, Artificial Sequence
  chemically synthesized
atcagatggttgtaggtgcg

SEQ ID NO: 304722 - DNA, 20 bp, Artificial Sequence
  chemically synthesized
gtcgaagatcagatggttgt

SEQ ID NO: 304723 - DNA, 20 bp, Artificial Sequence
  chemically synthesized
tgtcgaagatcagatggttg

SEQ ID NO: 304724 - DNA, 20 bp, Artificial Sequence
  chemically synthesized
caggtttgtcgaagatcaga

SEQ ID NO: 304725 - DNA, 20 bp, Artificial Sequence
  chemically synthesized
ttttcaggtttgtcgaagat

SEQ ID NO: 304726 - DNA, 20 bp, Artificial Sequence
  chemically synthesized
ttgttttttcaggtttgtcg

SEQ ID NO: 304727 - DNA, 20 bp, Artificial Sequence
  chemically synthesized
tccccattgcttgttttttc

SEQ ID NO: 304728 - DNA, 20 bp, Artificial Sequence
  chemically synthesized
ttcgacaaacctgaaaaaac

SEQ ID NO: 304729 - DNA, 20 bp, Artificial Sequence
  chemically synthesized
ttccccattgcttgtttttt

SEQ ID NO: 304730 - DNA, 20 bp, Artificial Sequence
  chemically synthesized
aaacctgaaaaaacaagcaa

SEQ ID NO: 304731 - DNA, 20 bp, Artificial Sequence
  chemically synthesized
aacctgaaaaaacaagcaat

SEQ ID NO: 304732 - DNA, 20 bp, Artificial Sequence
  chemically synthesized
acctgaaaaaacaagcaatg

SEQ ID NO: 304733 - DNA, 20 bp, Artificial Sequence
  chemically synthesized
gaaaaaacaagcaatgggga

SEQ ID NO: 304734 - DNA, 20 bp, Artificial Sequence
  chemically synthesized
aaaaaacaagcaatggggaa

SEQ ID NO: 304735 - DNA, 20 bp, Artificial Sequence
  chemically synthesized
agcactatgtattaaatagg

SEQ ID NO: 304736 - DNA, 20 bp, Artificial Sequence
  chemically synthesized
cccagcactatgtattaaat

SEQ ID NO: 304737 - DNA, 20 bp, Artificial Sequence
  chemically synthesized
tcccagcactatgtattaaa

SEQ ID NO: 304738 - DNA, 20 bp, Artificial Sequence
  chemically synthesized
aggactgcctatttaataca

SEQ ID NO: 304739 - DNA, 20 bp, Artificial Sequence
  chemically synthesized
gcctatttaatacatagtgc

SEQ ID NO: 304740 - DNA, 20 bp, Artificial Sequence
  chemically synthesized
cctatttaatacatagtgct

SEQ ID NO: 304741 - DNA, 20 bp, Artificial Sequence
  chemically synthesized
tttaatacatagtgctggga

SEQ ID NO: 304742 - DNA, 20 bp, Artificial Sequence
  chemically synthesized
ttttctgcataggactatcc

SEQ ID NO: 304743 - DNA, 20 bp, Artificial Sequence
  chemically synthesized
agtgctgggatagtcctatg

SEQ ID NO: 304744 - DNA, 20 bp, Artificial Sequence
  chemically synthesized
ccactttcaattttctgcat

SEQ ID NO: 304745 - DNA, 20 bp, Artificial Sequence
  chemically synthesized
tccactttcaattttctgca

SEQ ID NO: 304746 - DNA, 20 bp, Artificial Sequence
  chemically synthesized
agtcctatgcagaaaattga

SEQ ID NO: 304747 - DNA, 20 bp, Artificial Sequence
  chemically synthesized
cctatgcagaaaattgaaag

SEQ ID NO: 304748 - DNA, 20 bp, Artificial Sequence
  chemically synthesized
ttgtatagattgtaaggaag

SEQ ID NO: 304749 - DNA, 20 bp, Artificial Sequence
  chemically synthesized
tttttgtatagattgtaagg

SEQ ID NO: 304750 - DNA, 20 bp, Artificial Sequence
  chemically synthesized
taatttttgtatagattgta

SEQ ID NO: 304751 - DNA, 20 bp, Artificial Sequence
  chemically synthesized
ttaatttttgtatagattgt

SEQ ID NO: 304752 - DNA, 20 bp, Artificial Sequence
  chemically synthesized
atcttgagttaatttttgta

SEQ ID NO: 304753 - DNA, 20 bp, Artificial Sequence
  chemically synthesized
atctatacaaaaattaactc

SEQ ID NO: 304754 - DNA, 20 bp, Artificial Sequence
  chemically synthesized
atacaaaaattaactcaaga

SEQ ID NO: 304755 - DNA, 20 bp, Artificial Sequence
  chemically synthesized
ttaagtctttaatccatctt

SEQ ID NO: 304756 - DNA, 20 bp, Artificial Sequence
  chemically synthesized
aattaactcaagatggatta

SEQ ID NO: 304757 - DNA, 20 bp, Artificial Sequence
  chemically synthesized
ttgtttggggttttgcattt

SEQ ID NO: 304758 - DNA, 20 bp, Artificial Sequence
  chemically synthesized
tctaaggtttttattgtttg

SEQ ID NO: 304759 - DNA, 20 bp, Artificial Sequence
  chemically synthesized
ttctaaggtttttattgttt

SEQ ID NO: 304760 - DNA, 20 bp, Artificial Sequence
  chemically synthesized
cttctaaggtttttattgtt

SEQ ID NO: 304761 - DNA, 20 bp, Artificial Sequence
  chemically synthesized
accccaaacaataaaaacct

SEQ ID NO: 304762 - DNA, 20 bp, Artificial Sequence
  chemically synthesized
ccaaacaataaaaaccttag

SEQ ID NO: 304763 - DNA, 20 bp, Artificial Sequence
  chemically synthesized
attacctaggttttcttcta

SEQ ID NO: 304764 - DNA, 20 bp, Artificial Sequence
  chemically synthesized
tattacctaggttttcttct

SEQ ID NO: 304765 - DNA, 20 bp, Artificial Sequence
  chemically synthesized
aaaaaccttagaagaaaacc

SEQ ID NO: 304766 - DNA, 20 bp, Artificial Sequence
  chemically synthesized
aaaaccttagaagaaaacct

SEQ ID NO: 304767 - DNA, 20 bp, Artificial Sequence
  chemically synthesized
tagaagaaaacctaggtaat

SEQ ID NO: 304768 - DNA, 20 bp, Artificial Sequence
  chemically synthesized
tgtcctgaatcttattacct

SEQ ID NO: 304769 - DNA, 20 bp, Artificial Sequence
  chemically synthesized
atgtcctgaatcttattacc

SEQ ID NO: 304770 - DNA, 20 bp, Artificial Sequence
  chemically synthesized
aaaacctaggtaataagatt

SEQ ID NO: 304771 - DNA, 20 bp, Artificial Sequence
  chemically synthesized
aaacctaggtaataagattc

SEQ ID NO: 304772 - DNA, 20 bp, Artificial Sequence
  chemically synthesized
aggtaataagattcaggaca

SEQ ID NO: 304773 - DNA, 20 bp, Artificial Sequence
  chemically synthesized
ggtaataagattcaggacat

SEQ ID NO: 304774 - DNA, 20 bp, Artificial Sequence
  chemically synthesized
taagattcaggacataggca

SEQ ID NO: 304775 - DNA, 20 bp, Artificial Sequence
  chemically synthesized
aagattcaggacataggcat

SEQ ID NO: 304776 - DNA, 20 bp, Artificial Sequence
  chemically synthesized
tcaggacataggcatgggca

SEQ ID NO: 304777 - DNA, 20 bp, Artificial Sequence
  chemically synthesized
caggacataggcatgggcaa

SEQ ID NO: 304778 - DNA, 20 bp, Artificial Sequence
  chemically synthesized
ggcatgggcaaaggtttcat

SEQ ID NO: 304779 - DNA, 20 bp, Artificial Sequence
  chemically synthesized
gcatgggcaaaggtttcatg

SEQ ID NO: 304780 - DNA, 20 bp, Artificial Sequence
  chemically synthesized
caaaggtttcatgaggaaaa

SEQ ID NO: 304781 - DNA, 20 bp, Artificial Sequence
  chemically synthesized
tttcatgaggaaaatggcaa

SEQ ID NO: 304782 - DNA, 20 bp, Artificial Sequence
  chemically synthesized
ggcaaaagcaactgcaacaa

SEQ ID NO: 304783 - DNA, 20 bp, Artificial Sequence
  chemically synthesized
gtcagtttttgcttttgttg

SEQ ID NO: 304784 - DNA, 20 bp, Artificial Sequence
  chemically synthesized
aacaaaagcaaaaactgaca

SEQ ID NO: 304785 - DNA, 20 bp, Artificial Sequence
  chemically synthesized
acaaaagcaaaaactgacaa

SEQ ID NO: 304786 - DNA, 20 bp, Artificial Sequence
  chemically synthesized
caaaagcaaaaactgacaaa

SEQ ID NO: 304787 - DNA, 20 bp, Artificial Sequence
  chemically synthesized
aaaagcaaaaactgacaaag

SEQ ID NO: 304788 - DNA, 20 bp, Artificial Sequence
  chemically synthesized
tttaattagatcccctttgt

SEQ ID NO: 304789 - DNA, 20 bp, Artificial Sequence
  chemically synthesized
cagaagttctttagtttaat

SEQ ID NO: 304790 - DNA, 20 bp, Artificial Sequence
  chemically synthesized
aaggggatctaattaaacta

SEQ ID NO: 304791 - DNA, 20 bp, Artificial Sequence
  chemically synthesized
tttgctgtgcagaagttctt

SEQ ID NO: 304792 - DNA, 20 bp, Artificial Sequence
  chemically synthesized
taaactaaagaacttctgca

SEQ ID NO: 304793 - DNA, 20 bp, Artificial Sequence
  chemically synthesized
tagtttattttgctgtgcag

SEQ ID NO: 304794 - DNA, 20 bp, Artificial Sequence
  chemically synthesized
cggtagtttattttgctgtg

SEQ ID NO: 304795 - DNA, 20 bp, Artificial Sequence
  chemically synthesized
acagcaaaataaactaccgt

SEQ ID NO: 304796 - DNA, 20 bp, Artificial Sequence
  chemically synthesized
agcaaaataaactaccgtca

SEQ ID NO: 304797 - DNA, 20 bp, Artificial Sequence
  chemically synthesized
ctgtttatttactctgacgg

SEQ ID NO: 304798 - DNA, 20 bp, Artificial Sequence
  chemically synthesized
aggctgtttatttactctga

SEQ ID NO: 304799 - DNA, 20 bp, Artificial Sequence
  chemically synthesized
ctaccgtcagagtaaataaa

SEQ ID NO: 304800 - DNA, 20 bp, Artificial Sequence
  chemically synthesized
cagagtaaataaacagccta

SEQ ID NO: 304801 - DNA, 20 bp, Artificial Sequence
  chemically synthesized
taaataaacagcctacagaa

SEQ ID NO: 304802 - DNA, 20 bp, Artificial Sequence
  chemically synthesized
aaataaacagcctacagaat

SEQ ID NO: 304803 - DNA, 20 bp, Artificial Sequence
  chemically synthesized
aaacttttctcccattctgt

SEQ ID NO: 304804 - DNA, 20 bp, Artificial Sequence
  chemically synthesized
aaaacttttctcccattctg

SEQ ID NO: 304805 - DNA, 20 bp, Artificial Sequence
  chemically synthesized
ataaacagcctacagaatgg

SEQ ID NO: 304806 - DNA, 20 bp, Artificial Sequence
  chemically synthesized
cagcctacagaatgggagaa

SEQ ID NO: 304807 - DNA, 20 bp, Artificial Sequence
  chemically synthesized
accattgtcagatggataga

SEQ ID NO: 304808 - DNA, 20 bp, Artificial Sequence
  chemically synthesized
ctggaccattgtcagatgga

SEQ ID NO: 304809 - DNA, 20 bp, Artificial Sequence
  chemically synthesized
gactctggaccattgtcaga

SEQ ID NO: 304810 - DNA, 20 bp, Artificial Sequence
  chemically synthesized
gccatctatccatctgacaa

SEQ ID NO: 304811 - DNA, 20 bp, Artificial Sequence
  chemically synthesized
tgtagactctggaccattgt

SEQ ID NO: 304812 - DNA, 20 bp, Artificial Sequence
  chemically synthesized
ctatccatctgacaatggtc

SEQ ID NO: 304813 - DNA, 20 bp, Artificial Sequence
  chemically synthesized
atccatctgacaatggtcca

SEQ ID NO: 304814 - DNA, 20 bp, Artificial Sequence
  chemically synthesized
tttaagttccttgtagactc

SEQ ID NO: 304815 - DNA, 20 bp, Artificial Sequence
  chemically synthesized
gacaatggtccagagtctac

SEQ ID NO: 304816 - DNA, 20 bp, Artificial Sequence
  chemically synthesized
acaatggtccagagtctaca

SEQ ID NO: 304817 - DNA, 20 bp, Artificial Sequence
  chemically synthesized
aaatttgtttaagttccttg

SEQ ID NO: 304818 - DNA, 20 bp, Artificial Sequence
  chemically synthesized
tttttcttgtaaatttgttt

SEQ ID NO: 304819 - DNA, 20 bp, Artificial Sequence
  chemically synthesized
aggaacttaaacaaatttac

SEQ ID NO: 304820 - DNA, 20 bp, Artificial Sequence
  chemically synthesized
aaacaaataacctcattaaa

SEQ ID NO: 304821 - DNA, 20 bp, Artificial Sequence
  chemically synthesized
gctttgcccactttttaatg

SEQ ID NO: 304822 - DNA, 20 bp, Artificial Sequence
  chemically synthesized
tgctttgcccactttttaat

SEQ ID NO: 304823 - DNA, 20 bp, Artificial Sequence
  chemically synthesized
caaataacctcattaaaaag

SEQ ID NO: 304824 - DNA, 20 bp, Artificial Sequence
  chemically synthesized
aaataacctcattaaaaagt

SEQ ID NO: 304825 - DNA, 20 bp, Artificial Sequence
  chemically synthesized
acctcattaaaaagtgggca

SEQ ID NO: 304826 - DNA, 20 bp, Artificial Sequence
  chemically synthesized
cataaacaaacacttctcaa

SEQ ID NO: 304827 - DNA, 20 bp, Artificial Sequence
  chemically synthesized
catgtatgtcttcttttgag

SEQ ID NO: 304828 - DNA, 20 bp, Artificial Sequence
  chemically synthesized
aaacaaacacttctcaaaag

SEQ ID NO: 304829 - DNA, 20 bp, Artificial Sequence
  chemically synthesized
tcacatgtatgtcttctttt

SEQ ID NO: 304830 - DNA, 20 bp, Artificial Sequence
  chemically synthesized
gttttctttcatatcgtttt

SEQ ID NO: 304831 - DNA, 20 bp, Artificial Sequence
  chemically synthesized
agttttctttcatatcgttt

SEQ ID NO: 304832 - DNA, 20 bp, Artificial Sequence
  chemically synthesized
tgtgacctaaaacgatatga

SEQ ID NO: 304833 - DNA, 20 bp, Artificial Sequence
  chemically synthesized
ctctcatgatcaatgatgtt

SEQ ID NO: 304834 - DNA, 20 bp, Artificial Sequence
  chemically synthesized
aactcaacatcattgatcat

SEQ ID NO: 304835 - DNA, 20 bp, Artificial Sequence
  chemically synthesized
ctcaacatcattgatcatga

SEQ ID NO: 304836 - DNA, 20 bp, Artificial Sequence
  chemically synthesized
atgcacatcaaaaccacaat

SEQ ID NO: 304837 - DNA, 20 bp, Artificial Sequence
  chemically synthesized
cgtgagatgttatctcattg

SEQ ID NO: 304838 - DNA, 20 bp, Artificial Sequence
  chemically synthesized
aatgagataacatctcacgc

SEQ ID NO: 304839 - DNA, 20 bp, Artificial Sequence
  chemically synthesized
gtaaccattctgactggcgt

SEQ ID NO: 304840 - DNA, 20 bp, Artificial Sequence
  chemically synthesized
agataacatctcacgccagt

SEQ ID NO: 304841 - DNA, 20 bp, Artificial Sequence
  chemically synthesized
acatctcacgccagtcagaa

SEQ ID NO: 304842 - DNA, 20 bp, Artificial Sequence
  chemically synthesized
ttaatagtaaccattctgac

SEQ ID NO: 304843 - DNA, 20 bp, Artificial Sequence
  chemically synthesized
tcagaatggttactattaaa

SEQ ID NO: 304844 - DNA, 20 bp, Artificial Sequence
  chemically synthesized
attgttctttgactttttaa

SEQ ID NO: 304845 - DNA, 20 bp, Artificial Sequence
  chemically synthesized
tggttactattaaaaagtca

SEQ ID NO: 304846 - DNA, 20 bp, Artificial Sequence
  chemically synthesized
attaaaaagtcaaagaacaa

SEQ ID NO: 304847 - DNA, 20 bp, Artificial Sequence
  chemically synthesized
agtcaaagaacaatagatgc

SEQ ID NO: 304848 - DNA, 20 bp, Artificial Sequence
  chemically synthesized
aaagaacaatagatgctggt

SEQ ID NO: 304849 - DNA, 20 bp, Artificial Sequence
  chemically synthesized
aagaacaatagatgctggtg

SEQ ID NO: 304850 - DNA, 20 bp, Artificial Sequence
  chemically synthesized
ccttttctccacaacctcac

SEQ ID NO: 304851 - DNA, 20 bp, Artificial Sequence
  chemically synthesized
aatagatgctggtgaggttg

SEQ ID NO: 304852 - DNA, 20 bp, Artificial Sequence
  chemically synthesized
tagatgctggtgaggttgtg

SEQ ID NO: 304853 - DNA, 20 bp, Artificial Sequence
  chemically synthesized
gctggtgaggttgtggagaa

SEQ ID NO: 304854 - DNA, 20 bp, Artificial Sequence
  chemically synthesized
ctggtgaggttgtggagaaa

SEQ ID NO: 304855 - DNA, 20 bp, Artificial Sequence
  chemically synthesized
tggtgaggttgtggagaaaa

SEQ ID NO: 304856 - DNA, 20 bp, Artificial Sequence
  chemically synthesized
cactcccaccaagagtgtaa

SEQ ID NO: 304857 - DNA, 20 bp, Artificial Sequence
  chemically synthesized
agggaacacttttacactct

SEQ ID NO: 304858 - DNA, 20 bp, Artificial Sequence
  chemically synthesized
gaacacttttacactcttgg

SEQ ID NO: 304859 - DNA, 20 bp, Artificial Sequence
  chemically synthesized
aacacttttacactcttggt

SEQ ID NO: 304860 - DNA, 20 bp, Artificial Sequence
  chemically synthesized
cacttttacactcttggtgg

SEQ ID NO: 304861 - DNA, 20 bp, Artificial Sequence
  chemically synthesized
ctaatttacactcccaccaa

SEQ ID NO: 304862 - DNA, 20 bp, Artificial Sequence
  chemically synthesized
aactaatttacactcccacc

SEQ ID NO: 304863 - DNA, 20 bp, Artificial Sequence
  chemically synthesized
ctcttggtgggagtgtaaat

SEQ ID NO: 304864 - DNA, 20 bp, Artificial Sequence
  chemically synthesized
gtaaattagttcaacccttg

SEQ ID NO: 304865 - DNA, 20 bp, Artificial Sequence
  chemically synthesized
aattagttcaacccttgtgg

SEQ ID NO: 304866 - DNA, 20 bp, Artificial Sequence
  chemically synthesized
ctccgcattgtcttccacaa

SEQ ID NO: 304867 - DNA, 20 bp, Artificial Sequence
  chemically synthesized
tctccgcattgtcttccaca

SEQ ID NO: 304868 - DNA, 20 bp, Artificial Sequence
  chemically synthesized
atctccgcattgtcttccac

SEQ ID NO: 304869 - DNA, 20 bp, Artificial Sequence
  chemically synthesized
aacccttgtggaagacaatg

SEQ ID NO: 304870 - DNA, 20 bp, Artificial Sequence
  chemically synthesized
cccttgtggaagacaatgcg

SEQ ID NO: 304871 - DNA, 20 bp, Artificial Sequence
  chemically synthesized
gacaatgcggagatttctca

SEQ ID NO: 304872 - DNA, 20 bp, Artificial Sequence
  chemically synthesized
gcggagatttctcaaagact

SEQ ID NO: 304873 - DNA, 20 bp, Artificial Sequence
  chemically synthesized
ttttctgcctctaagtcttt

SEQ ID NO: 304874 - DNA, 20 bp, Artificial Sequence
  chemically synthesized
ggagatttctcaaagactta

SEQ ID NO: 304875 - DNA, 20 bp, Artificial Sequence
  chemically synthesized
gagatttctcaaagacttag

SEQ ID NO: 304876 - DNA, 20 bp, Artificial Sequence
  chemically synthesized
atttctcaaagacttagagg

SEQ ID NO: 304877 - DNA, 20 bp, Artificial Sequence
  chemically synthesized
taaatggtttttctgcctct

SEQ ID NO: 304878 - DNA, 20 bp, Artificial Sequence
  chemically synthesized
tagaggcagaaaaaccattt

SEQ ID NO: 304879 - DNA, 20 bp, Artificial Sequence
  chemically synthesized
ggcagaaaaaccatttaagc

SEQ ID NO: 304880 - DNA, 20 bp, Artificial Sequence
  chemically synthesized
aatgggattgctggcttaaa

SEQ ID NO: 304881 - DNA, 20 bp, Artificial Sequence
  chemically synthesized
atacccagtaatgggattgc

SEQ ID NO: 304882 - DNA, 20 bp, Artificial Sequence
  chemically synthesized
taagccagcaatcccattac

SEQ ID NO: 304883 - DNA, 20 bp, Artificial Sequence
  chemically synthesized
aagccagcaatcccattact

SEQ ID NO: 304884 - DNA, 20 bp, Artificial Sequence
  chemically synthesized
ttgggtatatacccagtaat

SEQ ID NO: 304885 - DNA, 20 bp, Artificial Sequence
  chemically synthesized
tttgggtatatacccagtaa

SEQ ID NO: 304886 - DNA, 20 bp, Artificial Sequence
  chemically synthesized
tttatatttgggtatatacc

SEQ ID NO: 304887 - DNA, 20 bp, Artificial Sequence
  chemically synthesized
taatagaatgatttatattt

SEQ ID NO: 304888 - DNA, 20 bp, Artificial Sequence
  chemically synthesized
ataatagaatgatttatatt

SEQ ID NO: 304889 - DNA, 20 bp, Artificial Sequence
  chemically synthesized
atataaatcattctattata

SEQ ID NO: 304890 - DNA, 20 bp, Artificial Sequence
  chemically synthesized
acatgcatgtatctttataa

SEQ ID NO: 304891 - DNA, 20 bp, Artificial Sequence
  chemically synthesized
cattgcaacactatacacaa

SEQ ID NO: 304892 - DNA, 20 bp, Artificial Sequence
  chemically synthesized
catgtctttgctattgtgta

SEQ ID NO: 304893 - DNA, 20 bp, Artificial Sequence
  chemically synthesized
caacactatacacaatagca

SEQ ID NO: 304894 - DNA, 20 bp, Artificial Sequence
  chemically synthesized
tatacacaatagcaaagaca

SEQ ID NO: 304895 - DNA, 20 bp, Artificial Sequence
  chemically synthesized
tctatcattgatgagcatta

SEQ ID NO: 304896 - DNA, 20 bp, Artificial Sequence
  chemically synthesized
gtctatcattgatgagcatt

SEQ ID NO: 304897 - DNA, 20 bp, Artificial Sequence
  chemically synthesized
ttatcttgtctatcattgat

SEQ ID NO: 304898 - DNA, 20 bp, Artificial Sequence
  chemically synthesized
accttaatgctcatcaatga

SEQ ID NO: 304899 - DNA, 20 bp, Artificial Sequence
  chemically synthesized
aatgctcatcaatgatagac

SEQ ID NO: 304900 - DNA, 20 bp, Artificial Sequence
  chemically synthesized
catcaatgatagacaagata

SEQ ID NO: 304901 - DNA, 20 bp, Artificial Sequence
  chemically synthesized
tagacaagataaagaaaatg

SEQ ID NO: 304902 - DNA, 20 bp, Artificial Sequence
  chemically synthesized
aaatgtggtacatttacacc

SEQ ID NO: 304903 - DNA, 20 bp, Artificial Sequence
  chemically synthesized
aatgtggtacatttacacca

SEQ ID NO: 304904 - DNA, 20 bp, Artificial Sequence
  chemically synthesized
tgtggcattatagtattcct

SEQ ID NO: 304905 - DNA, 20 bp, Artificial Sequence
  chemically synthesized
cgttcgtgtttgtggcatta

SEQ ID NO: 304906 - DNA, 20 bp, Artificial Sequence
  chemically synthesized
gtttgactcgttcgtgtttg

SEQ ID NO: 304907 - DNA, 20 bp, Artificial Sequence
  chemically synthesized
ataatgccacaaacacgaac

SEQ ID NO: 304908 - DNA, 20 bp, Artificial Sequence
  chemically synthesized
gagtgatttatgaagaaaag

SEQ ID NO: 304909 - DNA, 20 bp, Artificial Sequence
  chemically synthesized
actgagtgatttatgaagaa

SEQ ID NO: 304910 - DNA, 20 bp, Artificial Sequence
  chemically synthesized
ctgaaactgagtgatttatg

SEQ ID NO: 304911 - DNA, 20 bp, Artificial Sequence
  chemically synthesized
tcttttcttcataaatcact

SEQ ID NO: 304912 - DNA, 20 bp, Artificial Sequence
  chemically synthesized
cttcataaatcactcagttt

SEQ ID NO: 304913 - DNA, 20 bp, Artificial Sequence
  chemically synthesized
ttcataaatcactcagtttc

SEQ ID NO: 304914 - DNA, 20 bp, Artificial Sequence
  chemically synthesized
ataaagacatacctgaaact

SEQ ID NO: 304915 - DNA, 20 bp, Artificial Sequence
  chemically synthesized
cagtttcaggtatgtcttta

SEQ ID NO: 304916 - DNA, 20 bp, Artificial Sequence
  chemically synthesized
tttcaggtatgtctttatag

SEQ ID NO: 304917 - DNA, 20 bp, Artificial Sequence
  chemically synthesized
cctgttcttacactgctata

SEQ ID NO: 304918 - DNA, 20 bp, Artificial Sequence
  chemically synthesized
gtatgtctttatagcagtgt

SEQ ID NO: 304919 - DNA, 20 bp, Artificial Sequence
  chemically synthesized
tctttatagcagtgtaagaa

SEQ ID NO: 304920 - DNA, 20 bp, Artificial Sequence
  chemically synthesized
ctttatagcagtgtaagaac

SEQ ID NO: 304921 - DNA, 20 bp, Artificial Sequence
  chemically synthesized
aaaataaaaggaaaatttat

SEQ ID NO: 304922 - DNA, 20 bp, Artificial Sequence
  chemically synthesized
gaatatcagtcaaaaataaa

SEQ ID NO: 304923 - DNA, 20 bp, Artificial Sequence
  chemically synthesized
agaatatcagtcaaaaataa

SEQ ID NO: 304924 - DNA, 20 bp, Artificial Sequence
  chemically synthesized
aaagtttcaattaagaatat

SEQ ID NO: 304925 - DNA, 20 bp, Artificial Sequence
  chemically synthesized
gaaagttaaaagtttcaatt

SEQ ID NO: 304926 - DNA, 20 bp, Artificial Sequence
  chemically synthesized
ataattaaatggaaagttaa

SEQ ID NO: 304927 - DNA, 20 bp, Artificial Sequence
  chemically synthesized
tatgtaaataattaaatgga

SEQ ID NO: 304928 - DNA, 20 bp, Artificial Sequence
  chemically synthesized
ataatatgtaaataattaaa

SEQ ID NO: 304929 - DNA, 20 bp, Artificial Sequence
  chemically synthesized
gcataacaaaaaagttacaa

SEQ ID NO: 304930 - DNA, 20 bp, Artificial Sequence
  chemically synthesized
agcataacaaaaaagttaca

SEQ ID NO: 304931 - DNA, 20 bp, Artificial Sequence
  chemically synthesized
cttatcccagcataacaaaa

SEQ ID NO: 304932 - DNA, 20 bp, Artificial Sequence
  chemically synthesized
ttgtaacttttttgttatgc

SEQ ID NO: 304933 - DNA, 20 bp, Artificial Sequence
  chemically synthesized
tgtaacttttttgttatgct

SEQ ID NO: 304934 - DNA, 20 bp, Artificial Sequence
  chemically synthesized
cttttttgttatgctgggat

SEQ ID NO: 304935 - DNA, 20 bp, Artificial Sequence
  chemically synthesized
tttttgttatgctgggataa

SEQ ID NO: 304936 - DNA, 20 bp, Artificial Sequence
  chemically synthesized
gaagttgaaatctcttatcc

SEQ ID NO: 304937 - DNA, 20 bp, Artificial Sequence
  chemically synthesized
agaatatctcaaaaggcaag

SEQ ID NO: 304938 - DNA, 20 bp, Artificial Sequence
  chemically synthesized
atttcaacttcttgcctttt

SEQ ID NO: 304939 - DNA, 20 bp, Artificial Sequence
  chemically synthesized
actagaatatctcaaaaggc

SEQ ID NO: 304940 - DNA, 20 bp, Artificial Sequence
  chemically synthesized
aaatactagaatatctcaaa

SEQ ID NO: 304941 - DNA, 20 bp, Artificial Sequence
  chemically synthesized
caaatactagaatatctcaa

SEQ ID NO: 304942 - DNA, 20 bp, Artificial Sequence
  chemically synthesized
tcttgccttttgagatattc

SEQ ID NO: 304943 - DNA, 20 bp, Artificial Sequence
  chemically synthesized
gtatctaaatattcaaatac

SEQ ID NO: 304944 - DNA, 20 bp, Artificial Sequence
  chemically synthesized
tattctagtatttgaatatt

SEQ ID NO: 304945 - DNA, 20 bp, Artificial Sequence
  chemically synthesized
ttgaatatttagatacttac

SEQ ID NO: 304946 - DNA, 20 bp, Artificial Sequence
  chemically synthesized
atatttagatacttactaga

SEQ ID NO: 304947 - DNA, 20 bp, Artificial Sequence
  chemically synthesized
atagcttgaatctttctagt

SEQ ID NO: 304948 - DNA, 20 bp, Artificial Sequence
  chemically synthesized
ctttatagcttgaatctttc

SEQ ID NO: 304949 - DNA, 20 bp, Artificial Sequence
  chemically synthesized
gatacttactagaaagattc

SEQ ID NO: 304950 - DNA, 20 bp, Artificial Sequence
  chemically synthesized
ctagaaagattcaagctata

SEQ ID NO: 304951 - DNA, 20 bp, Artificial Sequence
  chemically synthesized
aattagtaactaatacttta

SEQ ID NO: 304952 - DNA, 20 bp, Artificial Sequence
  chemically synthesized
agattcaagctataaagtat

SEQ ID NO: 304953 - DNA, 20 bp, Artificial Sequence
  chemically synthesized
taaagtattagttactaatt

SEQ ID NO: 304954 - DNA, 20 bp, Artificial Sequence
  chemically synthesized
ataaagattttatgctaaat

SEQ ID NO: 304955 - DNA, 20 bp, Artificial Sequence
  chemically synthesized
gtattagtatttgcaaaata

SEQ ID NO: 304956 - DNA, 20 bp, Artificial Sequence
  chemically synthesized
gtacctgttattgcaagtat

SEQ ID NO: 304957 - DNA, 20 bp, Artificial Sequence
  chemically synthesized
aatactaatacttgcaataa

SEQ ID NO: 304958 - DNA, 20 bp, Artificial Sequence
  chemically synthesized
taactggtacctgttattgc

SEQ ID NO: 304959 - DNA, 20 bp, Artificial Sequence
  chemically synthesized
atactaatacttgcaataac

SEQ ID NO: 304960 - DNA, 20 bp, Artificial Sequence
  chemically synthesized
atacttgcaataacaggtac

SEQ ID NO: 304961 - DNA, 20 bp, Artificial Sequence
  chemically synthesized
aataacaggtaccagttatg

SEQ ID NO: 304962 - DNA, 20 bp, Artificial Sequence
  chemically synthesized
catgcagaaagcttcataac

SEQ ID NO: 304963 - DNA, 20 bp, Artificial Sequence
  chemically synthesized
taatgcctggatcatgcaga

SEQ ID NO: 304964 - DNA, 20 bp, Artificial Sequence
  chemically synthesized
atgaagctttctgcatgatc

SEQ ID NO: 304965 - DNA, 20 bp, Artificial Sequence
  chemically synthesized
attgtaatgcctggatcatg

SEQ ID NO: 304966 - DNA, 20 bp, Artificial Sequence
  chemically synthesized
tgaagctttctgcatgatcc

SEQ ID NO: 304967 - DNA, 20 bp, Artificial Sequence
  chemically synthesized
aaaacacttattgtaatgcc

SEQ ID NO: 304968 - DNA, 20 bp, Artificial Sequence
  chemically synthesized
catgatccaggcattacaat

SEQ ID NO: 304969 - DNA, 20 bp, Artificial Sequence
  chemically synthesized
gaattgattatcttattcaa

SEQ ID NO: 304970 - DNA, 20 bp, Artificial Sequence
  chemically synthesized
tttttctagatcttttgaat

SEQ ID NO: 304971 - DNA, 20 bp, Artificial Sequence
  chemically synthesized
attatcttattcaaaagatc

SEQ ID NO: 304972 - DNA, 20 bp, Artificial Sequence
  chemically synthesized
acatagcaagggagtttttc

SEQ ID NO: 304973 - DNA, 20 bp, Artificial Sequence
  chemically synthesized
agctttacaacatagcaagg

SEQ ID NO: 304974 - DNA, 20 bp, Artificial Sequence
  chemically synthesized
aaagctttacaacatagcaa

SEQ ID NO: 304975 - DNA, 20 bp, Artificial Sequence
  chemically synthesized
taaagctttacaacatagca

SEQ ID NO: 304976 - DNA, 20 bp, Artificial Sequence
  chemically synthesized
ttaaagctttacaacatagc

SEQ ID NO: 304977 - DNA, 20 bp, Artificial Sequence
  chemically synthesized
aactcccttgctatgttgta

SEQ ID NO: 304978 - DNA, 20 bp, Artificial Sequence
  chemically synthesized
tttattaaagctttacaaca

SEQ ID NO: 304979 - DNA, 20 bp, Artificial Sequence
  chemically synthesized
tgttgtaaagctttaataaa

SEQ ID NO: 304980 - DNA, 20 bp, Artificial Sequence
  chemically synthesized
ataatagctaccatttatta

SEQ ID NO: 304981 - DNA, 20 bp, Artificial Sequence
  chemically synthesized
tgtaaagctttaataaatgg

SEQ ID NO: 304982 - DNA, 20 bp, Artificial Sequence
  chemically synthesized
gggccattgtgaggtcataa

SEQ ID NO: 304983 - DNA, 20 bp, Artificial Sequence
  chemically synthesized
tagctattatgacctcacaa

SEQ ID NO: 304984 - DNA, 20 bp, Artificial Sequence
  chemically synthesized
ttactcttagggccattgtg

SEQ ID NO: 304985 - DNA, 20 bp, Artificial Sequence
  chemically synthesized
cttactcttagggccattgt

SEQ ID NO: 304986 - DNA, 20 bp, Artificial Sequence
  chemically synthesized
tatgacctcacaatggccct

SEQ ID NO: 304987 - DNA, 20 bp, Artificial Sequence
  chemically synthesized
tgacctcacaatggccctaa

SEQ ID NO: 304988 - DNA, 20 bp, Artificial Sequence
  chemically synthesized
ctcacaatggccctaagagt

SEQ ID NO: 304989 - DNA, 20 bp, Artificial Sequence
  chemically synthesized
aatattagtacttactctta

SEQ ID NO: 304990 - DNA, 20 bp, Artificial Sequence
  chemically synthesized
taatattagtacttactctt

SEQ ID NO: 304991 - DNA, 20 bp, Artificial Sequence
  chemically synthesized
ataatattagtacttactct

SEQ ID NO: 304992 - DNA, 20 bp, Artificial Sequence
  chemically synthesized
ctataaaataggaataatat

SEQ ID NO: 304993 - DNA, 20 bp, Artificial Sequence
  chemically synthesized
ctaatattattcctatttta

SEQ ID NO: 304994 - DNA, 20 bp, Artificial Sequence
  chemically synthesized
gtcactttcatctataaaat

SEQ ID NO: 304995 - DNA, 20 bp, Artificial Sequence
  chemically synthesized
ggtcactttcatctataaaa

SEQ ID NO: 304996 - DNA, 20 bp, Artificial Sequence
  chemically synthesized
tattcctattttatagatga

SEQ ID NO: 304997 - DNA, 20 bp, Artificial Sequence
  chemically synthesized
tagatgaaagtgaccttgtt

SEQ ID NO: 304998 - DNA, 20 bp, Artificial Sequence
  chemically synthesized
agatgaaagtgaccttgttg

SEQ ID NO: 304999 - DNA, 20 bp, Artificial Sequence
  chemically synthesized
aagttttatctgcctcaaca

SEQ ID NO: 305000 - DNA, 20 bp, Artificial Sequence
  chemically synthesized
tgaaagtgaccttgttgagg

SEQ ID NO: 305001 - DNA, 20 bp, Artificial Sequence
  chemically synthesized
aaagttttatctgcctcaac

SEQ ID NO: 305002 - DNA, 20 bp, Artificial Sequence
  chemically synthesized
ttgaggcagataaaactttt

SEQ ID NO: 305003 - DNA, 20 bp, Artificial Sequence
  chemically synthesized
aggcagataaaactttttag

SEQ ID NO: 305004 - DNA, 20 bp, Artificial Sequence
  chemically synthesized
atctatgctttgctactaaa

SEQ ID NO: 305005 - DNA, 20 bp, Artificial Sequence
  chemically synthesized
gataaaactttttagtagca

SEQ ID NO: 305006 - DNA, 20 bp, Artificial Sequence
  chemically synthesized
aactttttagtagcaaagca

SEQ ID NO: 305007 - DNA, 20 bp, Artificial Sequence
  chemically synthesized
caaagcatagatataaatcc

SEQ ID NO: 305008 - DNA, 20 bp, Artificial Sequence
  chemically synthesized
gatgaatgaacattcagact

SEQ ID NO: 305009 - DNA, 20 bp, Artificial Sequence
  chemically synthesized
gagttggatgaatgaacatt

SEQ ID NO: 305010 - DNA, 20 bp, Artificial Sequence
  chemically synthesized
tgagcatagctgataagagt

SEQ ID NO: 305011 - DNA, 20 bp, Artificial Sequence
  chemically synthesized
ttcattcatccaactcttat

SEQ ID NO: 305012 - DNA, 20 bp, Artificial Sequence
  chemically synthesized
caagtgagcatagctgataa

SEQ ID NO: 305013 - DNA, 20 bp, Artificial Sequence
  chemically synthesized
agcaagtgagcatagctgat

SEQ ID NO: 305014 - DNA, 20 bp, Artificial Sequence
  chemically synthesized
agtgtaggagcaagtgagca

SEQ ID NO: 305015 - DNA, 20 bp, Artificial Sequence
  chemically synthesized
gtacaagtgtaggagcaagt

SEQ ID NO: 305016 - DNA, 20 bp, Artificial Sequence
  chemically synthesized
aagtgtacaagtgtaggagc

SEQ ID NO: 305017 - DNA, 20 bp, Artificial Sequence
  chemically synthesized
aaaaaagtgtacaagtgtag

SEQ ID NO: 305018 - DNA, 20 bp, Artificial Sequence
  chemically synthesized
tcaaaaaagtgtacaagtgt

SEQ ID NO: 305019 - DNA, 20 bp, Artificial Sequence
  chemically synthesized
ttcaaaaaagtgtacaagtg

SEQ ID NO: 305020 - DNA, 20 bp, Artificial Sequence
  chemically synthesized
caccattcaaaaaagtgtac

SEQ ID NO: 305021 - DNA, 20 bp, Artificial Sequence
  chemically synthesized
cacttgtacacttttttgaa

SEQ ID NO: 305022 - DNA, 20 bp, Artificial Sequence
  chemically synthesized
aaggaaaccaccattcaaaa

SEQ ID NO: 305023 - DNA, 20 bp, Artificial Sequence
  chemically synthesized
ttgtacacttttttgaatgg

SEQ ID NO: 305024 - DNA, 20 bp, Artificial Sequence
  chemically synthesized
ttgaatggtggtttcctttt

SEQ ID NO: 305025 - DNA, 20 bp, Artificial Sequence
  chemically synthesized
tgaatggtggtttcctttta

SEQ ID NO: 305026 - DNA, 20 bp, Artificial Sequence
  chemically synthesized
gaatggtggtttccttttaa

SEQ ID NO: 305027 - DNA, 20 bp, Artificial Sequence
  chemically synthesized
aatggtggtttccttttaag

SEQ ID NO: 305028 - DNA, 20 bp, Artificial Sequence
  chemically synthesized
acaaatacacaccccttaaa

SEQ ID NO: 305029 - DNA, 20 bp, Artificial Sequence
  chemically synthesized
tacaaatacacaccccttaa

SEQ ID NO: 305030 - DNA, 20 bp, Artificial Sequence
  chemically synthesized
tacacacacatatataaatt

SEQ ID NO: 305031 - DNA, 20 bp, Artificial Sequence
  chemically synthesized
tgtgccattgtttacaattt

SEQ ID NO: 305032 - DNA, 20 bp, Artificial Sequence
  chemically synthesized
aatactgaaattgtaaacaa

SEQ ID NO: 305033 - DNA, 20 bp, Artificial Sequence
  chemically synthesized
ggcacatcataactattata

SEQ ID NO: 305034 - DNA, 20 bp, Artificial Sequence
  chemically synthesized
gcacatcataactattatat

SEQ ID NO: 305035 - DNA, 20 bp, Artificial Sequence
  chemically synthesized
gagtaattcttcctatataa

SEQ ID NO: 305036 - DNA, 20 bp, Artificial Sequence
  chemically synthesized
catcataactattatatagg

SEQ ID NO: 305037 - DNA, 20 bp, Artificial Sequence
  chemically synthesized
agccaaacatatttaacatt

SEQ ID NO: 305038 - DNA, 20 bp, Artificial Sequence
  chemically synthesized
tactcaatgttaaatatgtt

SEQ ID NO: 305039 - DNA, 20 bp, Artificial Sequence
  chemically synthesized
atttcaatatagcatgtcaa

SEQ ID NO: 305040 - DNA, 20 bp, Artificial Sequence
  chemically synthesized
agatttcaatatagcatgtc

SEQ ID NO: 305041 - DNA, 20 bp, Artificial Sequence
  chemically synthesized
attttgcacagatttcaata

SEQ ID NO: 305042 - DNA, 20 bp, Artificial Sequence
  chemically synthesized
gtattttgactaattttgca

SEQ ID NO: 305043 - DNA, 20 bp, Artificial Sequence
  chemically synthesized
tattgaaatctgtgcaaaat

SEQ ID NO: 305044 - DNA, 20 bp, Artificial Sequence
  chemically synthesized
tcaacctgattgtgtgtgtg

SEQ ID NO: 305045 - DNA, 20 bp, Artificial Sequence
  chemically synthesized
atacactacacacacacaat

SEQ ID NO: 305046 - DNA, 20 bp, Artificial Sequence
  chemically synthesized
tacactacacacacacaatc

SEQ ID NO: 305047 - DNA, 20 bp, Artificial Sequence
  chemically synthesized
cacaatcaggttgacaactg

SEQ ID NO: 305048 - DNA, 20 bp, Artificial Sequence
  chemically synthesized
caggttgacaactgtggatc

SEQ ID NO: 305049 - DNA, 20 bp, Artificial Sequence
  chemically synthesized
aggttgacaactgtggatca

SEQ ID NO: 305050 - DNA, 20 bp, Artificial Sequence
  chemically synthesized
caatgaaaagccttgatcca

SEQ ID NO: 305051 - DNA, 20 bp, Artificial Sequence
  chemically synthesized
tagacagacaacgcaatgaa

SEQ ID NO: 305052 - DNA, 20 bp, Artificial Sequence
  chemically synthesized
aagggttacatatacataga

SEQ ID NO: 305053 - DNA, 20 bp, Artificial Sequence
  chemically synthesized
tccaaagggttacatataca

SEQ ID NO: 305054 - DNA, 20 bp, Artificial Sequence
  chemically synthesized
tctatgtatatgtaaccctt

SEQ ID NO: 305055 - DNA, 20 bp, Artificial Sequence
  chemically synthesized
tatgtatatgtaaccctttg

SEQ ID NO: 305056 - DNA, 20 bp, Artificial Sequence
  chemically synthesized
aacttattgatcactccaaa

SEQ ID NO: 305057 - DNA, 20 bp, Artificial Sequence
  chemically synthesized
aaacttattgatcactccaa

SEQ ID NO: 305058 - DNA, 20 bp, Artificial Sequence
  chemically synthesized
aaaacttattgatcactcca

SEQ ID NO: 305059 - DNA, 20 bp, Artificial Sequence
  chemically synthesized
aaccctttggagtgatcaat

SEQ ID NO: 305060 - DNA, 20 bp, Artificial Sequence
  chemically synthesized
gagtgatcaataagttttaa

SEQ ID NO: 305061 - DNA, 20 bp, Artificial Sequence
  chemically synthesized
agtgatcaataagttttaat

SEQ ID NO: 305062 - DNA, 20 bp, Artificial Sequence
  chemically synthesized
tcaataagttttaatgggca

SEQ ID NO: 305063 - DNA, 20 bp, Artificial Sequence
  chemically synthesized
aataagttttaatgggcatg

SEQ ID NO: 305064 - DNA, 20 bp, Artificial Sequence
  chemically synthesized
ataagttttaatgggcatgg

SEQ ID NO: 305065 - DNA, 20 bp, Artificial Sequence
  chemically synthesized
atggaggaattgcacttctg

SEQ ID NO: 305066 - DNA, 20 bp, Artificial Sequence
  chemically synthesized
cagtatgttttaaactgcag

SEQ ID NO: 305067 - DNA, 20 bp, Artificial Sequence
  chemically synthesized
atgcagtatgttttaaactg

SEQ ID NO: 305068 - DNA, 20 bp, Artificial Sequence
  chemically synthesized
aagctgttgctatgattatg

SEQ ID NO: 305069 - DNA, 20 bp, Artificial Sequence
  chemically synthesized
taaaacatactgcataatca

SEQ ID NO: 305070 - DNA, 20 bp, Artificial Sequence
  chemically synthesized
atactgcataatcatagcaa

SEQ ID NO: 305071 - DNA, 20 bp, Artificial Sequence
  chemically synthesized
cataatcatagcaacagctt

SEQ ID NO: 305072 - DNA, 20 bp, Artificial Sequence
  chemically synthesized
tggctatcaattattatcta

SEQ ID NO: 305073 - DNA, 20 bp, Artificial Sequence
  chemically synthesized
cagctttagataataattga

SEQ ID NO: 305074 - DNA, 20 bp, Artificial Sequence
  chemically synthesized
gtggagttggtttttaagca

SEQ ID NO: 305075 - DNA, 20 bp, Artificial Sequence
  chemically synthesized
tgcctgtggagttggttttt

SEQ ID NO: 305076 - DNA, 20 bp, Artificial Sequence
  chemically synthesized
atgcttaaaaaccaactcca

SEQ ID NO: 305077 - DNA, 20 bp, Artificial Sequence
  chemically synthesized
tgcttaaaaaccaactccac

SEQ ID NO: 305078 - DNA, 20 bp, Artificial Sequence
  chemically synthesized
tgctaccatgcctgtggagt

SEQ ID NO: 305079 - DNA, 20 bp, Artificial Sequence
  chemically synthesized
cttgtgctaccatgcctgtg

SEQ ID NO: 305080 - DNA, 20 bp, Artificial Sequence
  chemically synthesized
aaaaaccaactccacaggca

SEQ ID NO: 305081 - DNA, 20 bp, Artificial Sequence
  chemically synthesized
gccttgtgctaccatgcctg

SEQ ID NO: 305082 - DNA, 20 bp, Artificial Sequence
  chemically synthesized
aaccaactccacaggcatgg

SEQ ID NO: 305083 - DNA, 20 bp, Artificial Sequence
  chemically synthesized
ctccacaggcatggtagcac

SEQ ID NO: 305084 - DNA, 20 bp, Artificial Sequence
  chemically synthesized
tccacaggcatggtagcaca

SEQ ID NO: 305085 - DNA, 20 bp, Artificial Sequence
  chemically synthesized
tagcacaaggcacaaaaatc

SEQ ID NO: 305086 - DNA, 20 bp, Artificial Sequence
  chemically synthesized
caaggcacaaaaatctggta

SEQ ID NO: 305087 - DNA, 20 bp, Artificial Sequence
  chemically synthesized
ttagagatgcaaatctttac

SEQ ID NO: 305088 - DNA, 20 bp, Artificial Sequence
  chemically synthesized
tggtaaagatttgcatctct

SEQ ID NO: 305089 - DNA, 20 bp, Artificial Sequence
  chemically synthesized
agatttgcatctctaagcaa

SEQ ID NO: 305090 - DNA, 20 bp, Artificial Sequence
  chemically synthesized
taaatattttcttttgctta

SEQ ID NO: 305091 - DNA, 20 bp, Artificial Sequence
  chemically synthesized
tataaatattttcttttgct

SEQ ID NO: 305092 - DNA, 20 bp, Artificial Sequence
  chemically synthesized
aatatttatatgttgaactt

SEQ ID NO: 305093 - DNA, 20 bp, Artificial Sequence
  chemically synthesized
atatttatatgttgaacttt

SEQ ID NO: 305094 - DNA, 20 bp, Artificial Sequence
  chemically synthesized
atttatatgttgaactttgg

SEQ ID NO: 305095 - DNA, 20 bp, Artificial Sequence
  chemically synthesized
tttgcccaaggattctccca

SEQ ID NO: 305096 - DNA, 20 bp, Artificial Sequence
  chemically synthesized
ttgaactttgggagaatcct

SEQ ID NO: 305097 - DNA, 20 bp, Artificial Sequence
  chemically synthesized
tgaactttgggagaatcctt

SEQ ID NO: 305098 - DNA, 20 bp, Artificial Sequence
  chemically synthesized
ttgggagaatccttgggcaa

SEQ ID NO: 305099 - DNA, 20 bp, Artificial Sequence
  chemically synthesized
accatctgatcttttgccca

SEQ ID NO: 305100 - DNA, 20 bp, Artificial Sequence
  chemically synthesized
gaccatctgatcttttgccc

SEQ ID NO: 305101 - DNA, 20 bp, Artificial Sequence
  chemically synthesized
agaatccttgggcaaaagat

SEQ ID NO: 305102 - DNA, 20 bp, Artificial Sequence
  chemically synthesized
tccttgggcaaaagatcaga

SEQ ID NO: 305103 - DNA, 20 bp, Artificial Sequence
  chemically synthesized
caaaagatcagatggtcaca

SEQ ID NO: 305104 - DNA, 20 bp, Artificial Sequence
  chemically synthesized
aaaagatcagatggtcacaa

SEQ ID NO: 305105 - DNA, 20 bp, Artificial Sequence
  chemically synthesized
agatcagatggtcacaaagg

SEQ ID NO: 305106 - DNA, 20 bp, Artificial Sequence
  chemically synthesized
agatggtcacaaaggaagct

SEQ ID NO: 305107 - DNA, 20 bp, Artificial Sequence
  chemically synthesized
catccttgtgattagtaact

SEQ ID NO: 305108 - DNA, 20 bp, Artificial Sequence
  chemically synthesized
gaagctgagttactaatcac

SEQ ID NO: 305109 - DNA, 20 bp, Artificial Sequence
  chemically synthesized
aagctgagttactaatcaca

SEQ ID NO: 305110 - DNA, 20 bp, Artificial Sequence
  chemically synthesized
gcattttacatccttgtgat

SEQ ID NO: 305111 - DNA, 20 bp, Artificial Sequence
  chemically synthesized
cctctatacttcataagata

SEQ ID NO: 305112 - DNA, 20 bp, Artificial Sequence
  chemically synthesized
gtaaaatgctttatcttatg

SEQ ID NO: 305113 - DNA, 20 bp, Artificial Sequence
  chemically synthesized
ggaagtcctctatacttcat

SEQ ID NO: 305114 - DNA, 20 bp, Artificial Sequence
  chemically synthesized
atgctttatcttatgaagta

SEQ ID NO: 305115 - DNA, 20 bp, Artificial Sequence
  chemically synthesized
gctttatcttatgaagtata

SEQ ID NO: 305116 - DNA, 20 bp, Artificial Sequence
  chemically synthesized
ctttatcttatgaagtatag

SEQ ID NO: 305117 - DNA, 20 bp, Artificial Sequence
  chemically synthesized
gaagtatagaggacttccca

SEQ ID NO: 305118 - DNA, 20 bp, Artificial Sequence
  chemically synthesized
atgctacattcagctatggg

SEQ ID NO: 305119 - DNA, 20 bp, Artificial Sequence
  chemically synthesized
tgtatgctacattcagctat

SEQ ID NO: 305120 - DNA, 20 bp, Artificial Sequence
  chemically synthesized
ttgtatgctacattcagcta

SEQ ID NO: 305121 - DNA, 20 bp, Artificial Sequence
  chemically synthesized
ggacttcccatagctgaatg

SEQ ID NO: 305122 - DNA, 20 bp, Artificial Sequence
  chemically synthesized
cactcattgtatgctacatt

SEQ ID NO: 305123 - DNA, 20 bp, Artificial Sequence
  chemically synthesized
agctgaatgtagcatacaat

SEQ ID NO: 305124 - DNA, 20 bp, Artificial Sequence
  chemically synthesized
gtagcatacaatgagtgcca

SEQ ID NO: 305125 - DNA, 20 bp, Artificial Sequence
  chemically synthesized
atacaatgagtgccaaagtt

SEQ ID NO: 305126 - DNA, 20 bp, Artificial Sequence
  chemically synthesized
tacaatgagtgccaaagttc

SEQ ID NO: 305127 - DNA, 20 bp, Artificial Sequence
  chemically synthesized
caggctactgtcctgaactt

SEQ ID NO: 305128 - DNA, 20 bp, Artificial Sequence
  chemically synthesized
atgagtgccaaagttcagga

SEQ ID NO: 305129 - DNA, 20 bp, Artificial Sequence
  chemically synthesized
agtgccaaagttcaggacag

SEQ ID NO: 305130 - DNA, 20 bp, Artificial Sequence
  chemically synthesized
caaagttcaggacagtagcc

SEQ ID NO: 305131 - DNA, 20 bp, Artificial Sequence
  chemically synthesized
aatagtaaattttagttacc

SEQ ID NO: 305132 - DNA, 20 bp, Artificial Sequence
  chemically synthesized
taatagtaaattttagttac

SEQ ID NO: 305133 - DNA, 20 bp, Artificial Sequence
  chemically synthesized
cagtaattaatagtaaattt

SEQ ID NO: 305134 - DNA, 20 bp, Artificial Sequence
  chemically synthesized
aaattaattacagtaattaa

SEQ ID NO: 305135 - DNA, 20 bp, Artificial Sequence
  chemically synthesized
ttgtaataataaattaatta

SEQ ID NO: 305136 - DNA, 20 bp, Artificial Sequence
  chemically synthesized
aataattaatttattactgt

SEQ ID NO: 305137 - DNA, 20 bp, Artificial Sequence
  chemically synthesized
ataattaatttattactgta

SEQ ID NO: 305138 - DNA, 20 bp, Artificial Sequence
  chemically synthesized
caagaaattttattacctta

SEQ ID NO: 305139 - DNA, 20 bp, Artificial Sequence
  chemically synthesized
ggtaataaaatttcttgaat

SEQ ID NO: 305140 - DNA, 20 bp, Artificial Sequence
  chemically synthesized
ttcaatgtcagtacttattc

SEQ ID NO: 305141 - DNA, 20 bp, Artificial Sequence
  chemically synthesized
tttgctcatgatttcaatgt

SEQ ID NO: 305142 - DNA, 20 bp, Artificial Sequence
  chemically synthesized
agtactgacattgaaatcat

SEQ ID NO: 305143 - DNA, 20 bp, Artificial Sequence
  chemically synthesized
caaaattattgtcaaatact

SEQ ID NO: 305144 - DNA, 20 bp, Artificial Sequence
  chemically synthesized
aattattgtcaaatacttag

SEQ ID NO: 305145 - DNA, 20 bp, Artificial Sequence
  chemically synthesized
attattgtcaaatacttaga

SEQ ID NO: 305146 - DNA, 20 bp, Artificial Sequence
  chemically synthesized
aatgacttatgatgccttct

SEQ ID NO: 305147 - DNA, 20 bp, Artificial Sequence
  chemically synthesized
aaatacttagaaggcatcat

SEQ ID NO: 305148 - DNA, 20 bp, Artificial Sequence
  chemically synthesized
atcatataatatttatttcg

SEQ ID NO: 305149 - DNA, 20 bp, Artificial Sequence
  chemically synthesized
ataaatattatatgataatt

SEQ ID NO: 305150 - DNA, 20 bp, Artificial Sequence
  chemically synthesized
aatattatatgataattaag

SEQ ID NO: 305151 - DNA, 20 bp, Artificial Sequence
  chemically synthesized
atattatatgataattaaga

SEQ ID NO: 305152 - DNA, 20 bp, Artificial Sequence
  chemically synthesized
aaattggacagacagtttta

SEQ ID NO: 305153 - DNA, 20 bp, Artificial Sequence
  chemically synthesized
aatacattaaattggacaga

SEQ ID NO: 305154 - DNA, 20 bp, Artificial Sequence
  chemically synthesized
acaaaatacattaaattgga

SEQ ID NO: 305155 - DNA, 20 bp, Artificial Sequence
  chemically synthesized
aggaacaaaatacattaaat

SEQ ID NO: 305156 - DNA, 20 bp, Artificial Sequence
  chemically synthesized
actaaagacaatttaaaatg

SEQ ID NO: 305157 - DNA, 20 bp, Artificial Sequence
  chemically synthesized
tactaaagacaatttaaaat

SEQ ID NO: 305158 - DNA, 20 bp, Artificial Sequence
  chemically synthesized
tcctcattttaaattgtctt

SEQ ID NO: 305159 - DNA, 20 bp, Artificial Sequence
  chemically synthesized
ttctgatacaatttgtacta

SEQ ID NO: 305160 - DNA, 20 bp, Artificial Sequence
  chemically synthesized
gtctttagtacaaattgtat

SEQ ID NO: 305161 - DNA, 20 bp, Artificial Sequence
  chemically synthesized
ttagtacaaattgtatcaga

SEQ ID NO: 305162 - DNA, 20 bp, Artificial Sequence
  chemically synthesized
gtacaaattgtatcagaaag

SEQ ID NO: 305163 - DNA, 20 bp, Artificial Sequence
  chemically synthesized
acaaattgtatcagaaagaa

SEQ ID NO: 305164 - DNA, 20 bp, Artificial Sequence
  chemically synthesized
aagagatgtatgttgtcttc

SEQ ID NO: 305165 - DNA, 20 bp, Artificial Sequence
  chemically synthesized
cgtatttaatatgaatccag

SEQ ID NO: 305166 - DNA, 20 bp, Artificial Sequence
  chemically synthesized
ttccgtatttaatatgaatc

SEQ ID NO: 305167 - DNA, 20 bp, Artificial Sequence
  chemically synthesized
ttctggattcatattaaata

SEQ ID NO: 305168 - DNA, 20 bp, Artificial Sequence
  chemically synthesized
tcatattaaatacggaattt

SEQ ID NO: 305169 - DNA, 20 bp, Artificial Sequence
  chemically synthesized
gcaggtgcagttaattcaca

SEQ ID NO: 305170 - DNA, 20 bp, Artificial Sequence
  chemically synthesized
ctttgcaatttttgcaggtg

SEQ ID NO: 305171 - DNA, 20 bp, Artificial Sequence
  chemically synthesized
cattgctttgcaatttttgc

SEQ ID NO: 305172 - DNA, 20 bp, Artificial Sequence
  chemically synthesized
tcattgctttgcaatttttg

SEQ ID NO: 305173 - DNA, 20 bp, Artificial Sequence
  chemically synthesized
ctgcacctgcaaaaattgca

SEQ ID NO: 305174 - DNA, 20 bp, Artificial Sequence
  chemically synthesized
tgcaaaaattgcaaagcaat

SEQ ID NO: 305175 - DNA, 20 bp, Artificial Sequence
  chemically synthesized
tttaatttttctgatccatc

SEQ ID NO: 305176 - DNA, 20 bp, Artificial Sequence
  chemically synthesized
tagaggaaggccagatggat

SEQ ID NO: 305177 - DNA, 20 bp, Artificial Sequence
  chemically synthesized
gtatgtagaggaaggccaga

SEQ ID NO: 305178 - DNA, 20 bp, Artificial Sequence
  chemically synthesized
gatggtatgtagaggaaggc

SEQ ID NO: 305179 - DNA, 20 bp, Artificial Sequence
  chemically synthesized
gttagatggtatgtagagga

SEQ ID NO: 305180 - DNA, 20 bp, Artificial Sequence
  chemically synthesized
tgttagatggtatgtagagg

SEQ ID NO: 305181 - DNA, 20 bp, Artificial Sequence
  chemically synthesized
cagtgttagatggtatgtag

SEQ ID NO: 305182 - DNA, 20 bp, Artificial Sequence
  chemically synthesized
tcagtgttagatggtatgta

SEQ ID NO: 305183 - DNA, 20 bp, Artificial Sequence
  chemically synthesized
cttcagtgttagatggtatg

SEQ ID NO: 305184 - DNA, 20 bp, Artificial Sequence
  chemically synthesized
ttcattacttcagtgttaga

SEQ ID NO: 305185 - DNA, 20 bp, Artificial Sequence
  chemically synthesized
ctacataccatctaacactg

SEQ ID NO: 305186 - DNA, 20 bp, Artificial Sequence
  chemically synthesized
gtgtttcattacttcagtgt

SEQ ID NO: 305187 - DNA, 20 bp, Artificial Sequence
  chemically synthesized
tagaatgtgtttcattactt

SEQ ID NO: 305188 - DNA, 20 bp, Artificial Sequence
  chemically synthesized
aatgaaacacattctataat

SEQ ID NO: 305189 - DNA, 20 bp, Artificial Sequence
  chemically synthesized
atgaaacacattctataatt

SEQ ID NO: 305190 - DNA, 20 bp, Artificial Sequence
  chemically synthesized
tgaaacacattctataatta

SEQ ID NO: 305191 - DNA, 20 bp, Artificial Sequence
  chemically synthesized
ataatatccatccctaatta

SEQ ID NO: 305192 - DNA, 20 bp, Artificial Sequence
  chemically synthesized
acacattctataattaggga

SEQ ID NO: 305193 - DNA, 20 bp, Artificial Sequence
  chemically synthesized
aattagggatggatattatc

SEQ ID NO: 305194 - DNA, 20 bp, Artificial Sequence
  chemically synthesized
gggatggatattatcaagta

SEQ ID NO: 305195 - DNA, 20 bp, Artificial Sequence
  chemically synthesized
ggatggatattatcaagtat

SEQ ID NO: 305196 - DNA, 20 bp, Artificial Sequence
  chemically synthesized
gatattatcaagtataggct

SEQ ID NO: 305197 - DNA, 20 bp, Artificial Sequence
  chemically synthesized
atattatcaagtataggctt

SEQ ID NO: 305198 - DNA, 20 bp, Artificial Sequence
  chemically synthesized
tcaagtataggcttaggaaa

SEQ ID NO: 305199 - DNA, 20 bp, Artificial Sequence
  chemically synthesized
caaatacaagtctttttcct

SEQ ID NO: 305200 - DNA, 20 bp, Artificial Sequence
  chemically synthesized
taacacataaagacaaatac

SEQ ID NO: 305201 - DNA, 20 bp, Artificial Sequence
  chemically synthesized
aaaaaatgaaataacacata

SEQ ID NO: 305202 - DNA, 20 bp, Artificial Sequence
  chemically synthesized
gtgttatttcatttttttgt

SEQ ID NO: 305203 - DNA, 20 bp, Artificial Sequence
  chemically synthesized
tgttatttcatttttttgtc

SEQ ID NO: 305204 - DNA, 20 bp, Artificial Sequence
  chemically synthesized
ttatttcatttttttgtcag

SEQ ID NO: 305205 - DNA, 20 bp, Artificial Sequence
  chemically synthesized
atttttttgtcaggagataa

SEQ ID NO: 305206 - DNA, 20 bp, Artificial Sequence
  chemically synthesized
tttttttgtcaggagataat

SEQ ID NO: 305207 - DNA, 20 bp, Artificial Sequence
  chemically synthesized
gagataataggcgtatcata

SEQ ID NO: 305208 - DNA, 20 bp, Artificial Sequence
  chemically synthesized
aggcgtatcatacagatgct

SEQ ID NO: 305209 - DNA, 20 bp, Artificial Sequence
  chemically synthesized
taccatacagacaaaatgct

SEQ ID NO: 305210 - DNA, 20 bp, Artificial Sequence
  chemically synthesized
tgctgagcattttgtctgta

SEQ ID NO: 305211 - DNA, 20 bp, Artificial Sequence
  chemically synthesized
tatgtcattaaaataccata

SEQ ID NO: 305212 - DNA, 20 bp, Artificial Sequence
  chemically synthesized
tggtattttaatgacatact

SEQ ID NO: 305213 - DNA, 20 bp, Artificial Sequence
  chemically synthesized
attattacactgtattcact

SEQ ID NO: 305214 - DNA, 20 bp, Artificial Sequence
  chemically synthesized
aatgacatactcagtgaata

SEQ ID NO: 305215 - DNA, 20 bp, Artificial Sequence
  chemically synthesized
agtgtaataatttcataatt

SEQ ID NO: 305216 - DNA, 20 bp, Artificial Sequence
  chemically synthesized
ataattaagtctcctttgaa

SEQ ID NO: 305217 - DNA, 20 bp, Artificial Sequence
  chemically synthesized
catcctatccctattcaaag

SEQ ID NO: 305218 - DNA, 20 bp, Artificial Sequence
  chemically synthesized
taattaagtctcctttgaat

SEQ ID NO: 305219 - DNA, 20 bp, Artificial Sequence
  chemically synthesized
aattaagtctcctttgaata

SEQ ID NO: 305220 - DNA, 20 bp, Artificial Sequence
  chemically synthesized
aacatcctatccctattcaa

SEQ ID NO: 305221 - DNA, 20 bp, Artificial Sequence
  chemically synthesized
taacatcctatccctattca

SEQ ID NO: 305222 - DNA, 20 bp, Artificial Sequence
  chemically synthesized
aagtctcctttgaataggga

SEQ ID NO: 305223 - DNA, 20 bp, Artificial Sequence
  chemically synthesized
agtctcctttgaatagggat

SEQ ID NO: 305224 - DNA, 20 bp, Artificial Sequence
  chemically synthesized
atgttattatcattattttt

SEQ ID NO: 305225 - DNA, 20 bp, Artificial Sequence
  chemically synthesized
ttattttttagctgcctttc

SEQ ID NO: 305226 - DNA, 20 bp, Artificial Sequence
  chemically synthesized
tacttttgccactggaaagg

SEQ ID NO: 305227 - DNA, 20 bp, Artificial Sequence
  chemically synthesized
ttttttagctgcctttccag

SEQ ID NO: 305228 - DNA, 20 bp, Artificial Sequence
  chemically synthesized
tcctacttttgccactggaa

SEQ ID NO: 305229 - DNA, 20 bp, Artificial Sequence
  chemically synthesized
ttcctacttttgccactgga

SEQ ID NO: 305230 - DNA, 20 bp, Artificial Sequence
  chemically synthesized
agctgcctttccagtggcaa

SEQ ID NO: 305231 - DNA, 20 bp, Artificial Sequence
  chemically synthesized
aagattcctacttttgccac

SEQ ID NO: 305232 - DNA, 20 bp, Artificial Sequence
  chemically synthesized
tgcctttccagtggcaaaag

SEQ ID NO: 305233 - DNA, 20 bp, Artificial Sequence
  chemically synthesized
gcctttccagtggcaaaagt

SEQ ID NO: 305234 - DNA, 20 bp, Artificial Sequence
  chemically synthesized
aagtaggaatcttcttcact

SEQ ID NO: 305235 - DNA, 20 bp, Artificial Sequence
  chemically synthesized
ctctggagtacttagtgaag

SEQ ID NO: 305236 - DNA, 20 bp, Artificial Sequence
  chemically synthesized
aaactctggagtacttagtg

SEQ ID NO: 305237 - DNA, 20 bp, Artificial Sequence
  chemically synthesized
atcttcttcactaagtactc

SEQ ID NO: 305238 - DNA, 20 bp, Artificial Sequence
  chemically synthesized
atgtgaaactctggagtact

SEQ ID NO: 305239 - DNA, 20 bp, Artificial Sequence
  chemically synthesized
cttcttcactaagtactcca

SEQ ID NO: 305240 - DNA, 20 bp, Artificial Sequence
  chemically synthesized
tgcttttatgtgaaactctg

SEQ ID NO: 305241 - DNA, 20 bp, Artificial Sequence
  chemically synthesized
tttgcttttatgtgaaactc

SEQ ID NO: 305242 - DNA, 20 bp, Artificial Sequence
  chemically synthesized
tactccagagtttcacataa

SEQ ID NO: 305243 - DNA, 20 bp, Artificial Sequence
  chemically synthesized
cagagtttcacataaaagca

SEQ ID NO: 305244 - DNA, 20 bp, Artificial Sequence
  chemically synthesized
gagtttcacataaaagcaaa

SEQ ID NO: 305245 - DNA, 20 bp, Artificial Sequence
  chemically synthesized
aagcaaagagaaacatatca

SEQ ID NO: 305246 - DNA, 20 bp, Artificial Sequence
  chemically synthesized
agaaacatatcaaagacatt

SEQ ID NO: 305247 - DNA, 20 bp, Artificial Sequence
  chemically synthesized
caaagacatttagaactcga

SEQ ID NO: 305248 - DNA, 20 bp, Artificial Sequence
  chemically synthesized
agatttctatagtggccatc

SEQ ID NO: 305249 - DNA, 20 bp, Artificial Sequence
  chemically synthesized
ttagaactcgatggccacta

SEQ ID NO: 305250 - DNA, 20 bp, Artificial Sequence
  chemically synthesized
agctaggcagatttctatag

SEQ ID NO: 305251 - DNA, 20 bp, Artificial Sequence
  chemically synthesized
gtaagctaggcagatttcta

SEQ ID NO: 305252 - DNA, 20 bp, Artificial Sequence
  chemically synthesized
ggccactatagaaatctgcc

SEQ ID NO: 305253 - DNA, 20 bp, Artificial Sequence
  chemically synthesized
taaaggaaaggtaagctagg

SEQ ID NO: 305254 - DNA, 20 bp, Artificial Sequence
  chemically synthesized
atttaaaggaaaggtaagct

SEQ ID NO: 305255 - DNA, 20 bp, Artificial Sequence
  chemically synthesized
aatttaaaggaaaggtaagc

SEQ ID NO: 305256 - DNA, 20 bp, Artificial Sequence
  chemically synthesized
tataaatttaaaggaaaggt

SEQ ID NO: 305257 - DNA, 20 bp, Artificial Sequence
  chemically synthesized
tatttataaatttaaaggaa

SEQ ID NO: 305258 - DNA, 20 bp, Artificial Sequence
  chemically synthesized
ttatttataaatttaaagga

SEQ ID NO: 305259 - DNA, 20 bp, Artificial Sequence
  chemically synthesized
ttctttatttataaatttaa

SEQ ID NO: 305260 - DNA, 20 bp, Artificial Sequence
  chemically synthesized
attctttatttataaattta

SEQ ID NO: 305261 - DNA, 20 bp, Artificial Sequence
  chemically synthesized
ttcctttaaatttataaata

SEQ ID NO: 305262 - DNA, 20 bp, Artificial Sequence
  chemically synthesized
taaatttataaataaagaat

SEQ ID NO: 305263 - DNA, 20 bp, Artificial Sequence
  chemically synthesized
aatttataaataaagaatga

SEQ ID NO: 305264 - DNA, 20 bp, Artificial Sequence
  chemically synthesized
aataaagaatgagagattcc

SEQ ID NO: 305265 - DNA, 20 bp, Artificial Sequence
  chemically synthesized
taaagaatgagagattccaa

SEQ ID NO: 305266 - DNA, 20 bp, Artificial Sequence
  chemically synthesized
attcagtctgagttaactct

SEQ ID NO: 305267 - DNA, 20 bp, Artificial Sequence
  chemically synthesized
agagattccaagagttaact

SEQ ID NO: 305268 - DNA, 20 bp, Artificial Sequence
  chemically synthesized
aaatttaatacattcagtct

SEQ ID NO: 305269 - DNA, 20 bp, Artificial Sequence
  chemically synthesized
actaaaaaatttaatacatt

SEQ ID NO: 305270 - DNA, 20 bp, Artificial Sequence
  chemically synthesized
actgaatgtattaaattttt

SEQ ID NO: 305271 - DNA, 20 bp, Artificial Sequence
  chemically synthesized
tctgtaacaatataaaatgt

SEQ ID NO: 305272 - DNA, 20 bp, Artificial Sequence
  chemically synthesized
gcttacattttatattgtta

SEQ ID NO: 305273 - DNA, 20 bp, Artificial Sequence
  chemically synthesized
gttacagacaatgcatttac

SEQ ID NO: 305274 - DNA, 20 bp, Artificial Sequence
  chemically synthesized
ttacagacaatgcatttaca

SEQ ID NO: 305275 - DNA, 20 bp, Artificial Sequence
  chemically synthesized
gccttgtatatcagtgcaat

SEQ ID NO: 305276 - DNA, 20 bp, Artificial Sequence
  chemically synthesized
ggccttgtatatcagtgcaa

SEQ ID NO: 305277 - DNA, 20 bp, Artificial Sequence
  chemically synthesized
aacctattgcactgatatac

SEQ ID NO: 305278 - DNA, 20 bp, Artificial Sequence
  chemically synthesized
acctattgcactgatataca

SEQ ID NO: 305279 - DNA, 20 bp, Artificial Sequence
  chemically synthesized
tgagaatgggccttgtatat

SEQ ID NO: 305280 - DNA, 20 bp, Artificial Sequence
  chemically synthesized
tataataggtatttgagaat

SEQ ID NO: 305281 - DNA, 20 bp, Artificial Sequence
  chemically synthesized
ctataataggtatttgagaa

SEQ ID NO: 305282 - DNA, 20 bp, Artificial Sequence
  chemically synthesized
tccaactataataggtattt

SEQ ID NO: 305283 - DNA, 20 bp, Artificial Sequence
  chemically synthesized
ccattctcaaatacctatta

SEQ ID NO: 305284 - DNA, 20 bp, Artificial Sequence
  chemically synthesized
ttgctatctccaactataat

SEQ ID NO: 305285 - DNA, 20 bp, Artificial Sequence
  chemically synthesized
tctcaaatacctattatagt

SEQ ID NO: 305286 - DNA, 20 bp, Artificial Sequence
  chemically synthesized
tttgctatctccaactataa

SEQ ID NO: 305287 - DNA, 20 bp, Artificial Sequence
  chemically synthesized
tcaaatacctattatagttg

SEQ ID NO: 305288 - DNA, 20 bp, Artificial Sequence
  chemically synthesized
atacctattatagttggaga

SEQ ID NO: 305289 - DNA, 20 bp, Artificial Sequence
  chemically synthesized
ttggagatagcaaaatgata

SEQ ID NO: 305290 - DNA, 20 bp, Artificial Sequence
  chemically synthesized
aatgatacagttaatttcca

SEQ ID NO: 305291 - DNA, 20 bp, Artificial Sequence
  chemically synthesized
agttacatctcaaataactt

SEQ ID NO: 305292 - DNA, 20 bp, Artificial Sequence
  chemically synthesized
gttaatttccaaagttattt

SEQ ID NO: 305293 - DNA, 20 bp, Artificial Sequence
  chemically synthesized
aaaaaaaaaaagaaaatttg

SEQ ID NO: 305294 - DNA, 20 bp, Artificial Sequence
  chemically synthesized
aaaaaaaaaaaaaaaaaaaa

SEQ ID NO: 305295 - DNA, 20 bp, Artificial Sequence
  chemically synthesized
tttttttttttttttttttt

SEQ ID NO: 305296 - DNA, 20 bp, Artificial Sequence
  chemically synthesized
ttttttttttttttgagacg

SEQ ID NO: 305297 - DNA, 20 bp, Artificial Sequence
  chemically synthesized
tccagccgggatgacagagc

SEQ ID NO: 305298 - DNA, 20 bp, Artificial Sequence
  chemically synthesized
gcactccagccgggatgaca

SEQ ID NO: 305299 - DNA, 20 bp, Artificial Sequence
  chemically synthesized
gaagtctcgctctgtcatcc

SEQ ID NO: 305300 - DNA, 20 bp, Artificial Sequence
  chemically synthesized
ctgcactccagccgggatga

SEQ ID NO: 305301 - DNA, 20 bp, Artificial Sequence
  chemically synthesized
tctcgctctgtcatcccggc

SEQ ID NO: 305302 - DNA, 20 bp, Artificial Sequence
  chemically synthesized
tcgctctgtcatcccggctg

SEQ ID NO: 305303 - DNA, 20 bp, Artificial Sequence
  chemically synthesized
catgccactgcactccagcc

SEQ ID NO: 305304 - DNA, 20 bp, Artificial Sequence
  chemically synthesized
tcatgccactgcactccagc

SEQ ID NO: 305305 - DNA, 20 bp, Artificial Sequence
  chemically synthesized
ctgtcatcccggctggagtg

SEQ ID NO: 305306 - DNA, 20 bp, Artificial Sequence
  chemically synthesized
gagatcatgccactgcactc

SEQ ID NO: 305307 - DNA, 20 bp, Artificial Sequence
  chemically synthesized
tcatcccggctggagtgcag

SEQ ID NO: 305308 - DNA, 20 bp, Artificial Sequence
  chemically synthesized
ggagtgcagtggcatgatct

SEQ ID NO: 305309 - DNA, 20 bp, Artificial Sequence
  chemically synthesized
ggtggaggttgcagtgagcc

SEQ ID NO: 305310 - DNA, 20 bp, Artificial Sequence
  chemically synthesized
cgggaggtggaggttgcagt

SEQ ID NO: 305311 - DNA, 20 bp, Artificial Sequence
  chemically synthesized
aacccgggaggtggaggttg

SEQ ID NO: 305312 - DNA, 20 bp, Artificial Sequence
  chemically synthesized
tgcttgaacccgggaggtgg

SEQ ID NO: 305313 - DNA, 20 bp, Artificial Sequence
  chemically synthesized
tcactgcaacctccacctcc

SEQ ID NO: 305314 - DNA, 20 bp, Artificial Sequence
  chemically synthesized
ttgcttgaacccgggaggtg

SEQ ID NO: 305315 - DNA, 20 bp, Artificial Sequence
  chemically synthesized
cactgcaacctccacctccc

SEQ ID NO: 305316 - DNA, 20 bp, Artificial Sequence
  chemically synthesized
aattgcttgaacccgggagg

SEQ ID NO: 305317 - DNA, 20 bp, Artificial Sequence
  chemically synthesized
gagaattgcttgaacccggg

SEQ ID NO: 305318 - DNA, 20 bp, Artificial Sequence
  chemically synthesized
ggagaattgcttgaacccgg

SEQ ID NO: 305319 - DNA, 20 bp, Artificial Sequence
  chemically synthesized
aacctccacctcccgggttc

SEQ ID NO: 305320 - DNA, 20 bp, Artificial Sequence
  chemically synthesized
caggagaattgcttgaaccc

SEQ ID NO: 305321 - DNA, 20 bp, Artificial Sequence
  chemically synthesized
gcaggagaattgcttgaacc

SEQ ID NO: 305322 - DNA, 20 bp, Artificial Sequence
  chemically synthesized
ttcaagcaattctcctgcct

SEQ ID NO: 305323 - DNA, 20 bp, Artificial Sequence
  chemically synthesized
tacttgggaggctgaggcag

SEQ ID NO: 305324 - DNA, 20 bp, Artificial Sequence
  chemically synthesized
gctacttgggaggctgaggc

SEQ ID NO: 305325 - DNA, 20 bp, Artificial Sequence
  chemically synthesized
agctacttgggaggctgagg

SEQ ID NO: 305326 - DNA, 20 bp, Artificial Sequence
  chemically synthesized
tgcagctacttgggaggctg

SEQ ID NO: 305327 - DNA, 20 bp, Artificial Sequence
  chemically synthesized
ttgcagctacttgggaggct

SEQ ID NO: 305328 - DNA, 20 bp, Artificial Sequence
  chemically synthesized
ttctcctgcctcagcctccc

SEQ ID NO: 305329 - DNA, 20 bp, Artificial Sequence
  chemically synthesized
tcctgcctcagcctcccaag

SEQ ID NO: 305330 - DNA, 20 bp, Artificial Sequence
  chemically synthesized
tgtaattgcagctacttggg

SEQ ID NO: 305331 - DNA, 20 bp, Artificial Sequence
  chemically synthesized
ttgtaattgcagctacttgg

SEQ ID NO: 305332 - DNA, 20 bp, Artificial Sequence
  chemically synthesized
gcttgtaattgcagctactt

SEQ ID NO: 305333 - DNA, 20 bp, Artificial Sequence
  chemically synthesized
cgcttgtaattgcagctact

SEQ ID NO: 305334 - DNA, 20 bp, Artificial Sequence
  chemically synthesized
tcccaagtagctgcaattac

SEQ ID NO: 305335 - DNA, 20 bp, Artificial Sequence
  chemically synthesized
gtggcaggcgcttgtaattg

SEQ ID NO: 305336 - DNA, 20 bp, Artificial Sequence
  chemically synthesized
aagtagccaggcatggtggc

SEQ ID NO: 305337 - DNA, 20 bp, Artificial Sequence
  chemically synthesized
aaagtagccaggcatggtgg

SEQ ID NO: 305338 - DNA, 20 bp, Artificial Sequence
  chemically synthesized
caagcgcctgccaccatgcc

SEQ ID NO: 305339 - DNA, 20 bp, Artificial Sequence
  chemically synthesized
aaaaaagtagccaggcatgg

SEQ ID NO: 305340 - DNA, 20 bp, Artificial Sequence
  chemically synthesized
acaaaaaaagtagccaggca

SEQ ID NO: 305341 - DNA, 20 bp, Artificial Sequence
  chemically synthesized
aaaatacaaaaaaagtagcc

SEQ ID NO: 305342 - DNA, 20 bp, Artificial Sequence
  chemically synthesized
aaaaatacaaaaaaagtagc

SEQ ID NO: 305343 - DNA, 20 bp, Artificial Sequence
  chemically synthesized
tactaaaaatacaaaaaaag

SEQ ID NO: 305344 - DNA, 20 bp, Artificial Sequence
  chemically synthesized
ctttactaaaaatacaaaaa

SEQ ID NO: 305345 - DNA, 20 bp, Artificial Sequence
  chemically synthesized
ggctactttttttgtatttt

SEQ ID NO: 305346 - DNA, 20 bp, Artificial Sequence
  chemically synthesized
ctttttttgtatttttagta

SEQ ID NO: 305347 - DNA, 20 bp, Artificial Sequence
  chemically synthesized
ttttgtatttttagtaaaga

SEQ ID NO: 305348 - DNA, 20 bp, Artificial Sequence
  chemically synthesized
tttgtatttttagtaaagat

SEQ ID NO: 305349 - DNA, 20 bp, Artificial Sequence
  chemically synthesized
ttgtatttttagtaaagatg

SEQ ID NO: 305350 - DNA, 20 bp, Artificial Sequence
  chemically synthesized
tggggtttcaccatgttgac

SEQ ID NO: 305351 - DNA, 20 bp, Artificial Sequence
  chemically synthesized
tgaaaccagcctggtcaaca

SEQ ID NO: 305352 - DNA, 20 bp, Artificial Sequence
  chemically synthesized
ggggtttcaccatgttgacc

SEQ ID NO: 305353 - DNA, 20 bp, Artificial Sequence
  chemically synthesized
tttcaccatgttgaccaggc

SEQ ID NO: 305354 - DNA, 20 bp, Artificial Sequence
  chemically synthesized
tcaggagtttgaaaccagcc

SEQ ID NO: 305355 - DNA, 20 bp, Artificial Sequence
  chemically synthesized
tgaggtcaggagtttgaaac

SEQ ID NO: 305356 - DNA, 20 bp, Artificial Sequence
  chemically synthesized
tggtttcaaactcctgacct

SEQ ID NO: 305357 - DNA, 20 bp, Artificial Sequence
  chemically synthesized
ggcaaatcatctgaggtcag

SEQ ID NO: 305358 - DNA, 20 bp, Artificial Sequence
  chemically synthesized
caggcaaatcatctgaggtc

SEQ ID NO: 305359 - DNA, 20 bp, Artificial Sequence
  chemically synthesized
gcaggcaaatcatctgaggt

SEQ ID NO: 305360 - DNA, 20 bp, Artificial Sequence
  chemically synthesized
caaggcaggcaaatcatctg

SEQ ID NO: 305361 - DNA, 20 bp, Artificial Sequence
  chemically synthesized
acaaggcaggcaaatcatct

SEQ ID NO: 305362 - DNA, 20 bp, Artificial Sequence
  chemically synthesized
gtactttgggaggacaaggc

SEQ ID NO: 305363 - DNA, 20 bp, Artificial Sequence
  chemically synthesized
agtactttgggaggacaagg

SEQ ID NO: 305364 - DNA, 20 bp, Artificial Sequence
  chemically synthesized
cccagtactttgggaggaca

SEQ ID NO: 305365 - DNA, 20 bp, Artificial Sequence
  chemically synthesized
tcccagtactttgggaggac

SEQ ID NO: 305366 - DNA, 20 bp, Artificial Sequence
  chemically synthesized
ttgcctgccttgtcctccca

SEQ ID NO: 305367 - DNA, 20 bp, Artificial Sequence
  chemically synthesized
tgtaatcccagtactttggg

SEQ ID NO: 305368 - DNA, 20 bp, Artificial Sequence
  chemically synthesized
ttgtaatcccagtactttgg

SEQ ID NO: 305369 - DNA, 20 bp, Artificial Sequence
  chemically synthesized
gccttgtcctcccaaagtac

SEQ ID NO: 305370 - DNA, 20 bp, Artificial Sequence
  chemically synthesized
acttgtaatcccagtacttt

SEQ ID NO: 305371 - DNA, 20 bp, Artificial Sequence
  chemically synthesized
ccttgtcctcccaaagtact

SEQ ID NO: 305372 - DNA, 20 bp, Artificial Sequence
  chemically synthesized
cacttgtaatcccagtactt

SEQ ID NO: 305373 - DNA, 20 bp, Artificial Sequence
  chemically synthesized
tcccaaagtactgggattac

SEQ ID NO: 305374 - DNA, 20 bp, Artificial Sequence
  chemically synthesized
gtggctcacacttgtaatcc

SEQ ID NO: 305375 - DNA, 20 bp, Artificial Sequence
  chemically synthesized
agtactgggattacaagtgt

SEQ ID NO: 305376 - DNA, 20 bp, Artificial Sequence
  chemically synthesized
caagtgtgagccaccacact

SEQ ID NO: 305377 - DNA, 20 bp, Artificial Sequence
  chemically synthesized
ttgaagttgaccgagtgtgg

SEQ ID NO: 305378 - DNA, 20 bp, Artificial Sequence
  chemically synthesized
aatttgaagttgaccgagtg

SEQ ID NO: 305379 - DNA, 20 bp, Artificial Sequence
  chemically synthesized
agaaaaatttgaagttgacc

SEQ ID NO: 305380 - DNA, 20 bp, Artificial Sequence
  chemically synthesized
agttttattagaaaaatttg

SEQ ID NO: 305381 - DNA, 20 bp, Artificial Sequence
  chemically synthesized
tcctcaggttaaagttttat

SEQ ID NO: 305382 - DNA, 20 bp, Artificial Sequence
  chemically synthesized
ttctaataaaactttaacct

SEQ ID NO: 305383 - DNA, 20 bp, Artificial Sequence
  chemically synthesized
tctaataaaactttaacctg

SEQ ID NO: 305384 - DNA, 20 bp, Artificial Sequence
  chemically synthesized
ttgggtaattcctcaggtta

SEQ ID NO: 305385 - DNA, 20 bp, Artificial Sequence
  chemically synthesized
catgttttgggtaattcctc

SEQ ID NO: 305386 - DNA, 20 bp, Artificial Sequence
  chemically synthesized
acatgttttgggtaattcct

SEQ ID NO: 305387 - DNA, 20 bp, Artificial Sequence
  chemically synthesized
taaatttgagaacatgtttt

SEQ ID NO: 305388 - DNA, 20 bp, Artificial Sequence
  chemically synthesized
ttaaatttgagaacatgttt

SEQ ID NO: 305389 - DNA, 20 bp, Artificial Sequence
  chemically synthesized
caaaacatgttctcaaattt

SEQ ID NO: 305390 - DNA, 20 bp, Artificial Sequence
  chemically synthesized
aaaacatgttctcaaattta

SEQ ID NO: 305391 - DNA, 20 bp, Artificial Sequence
  chemically synthesized
gaattaactcccttaaattt

SEQ ID NO: 305392 - DNA, 20 bp, Artificial Sequence
  chemically synthesized
aaacatgttctcaaatttaa

SEQ ID NO: 305393 - DNA, 20 bp, Artificial Sequence
  chemically synthesized
acatgttctcaaatttaagg

SEQ ID NO: 305394 - DNA, 20 bp, Artificial Sequence
  chemically synthesized
ggagttaattctatgacctt

SEQ ID NO: 305395 - DNA, 20 bp, Artificial Sequence
  chemically synthesized
ttccttcttacttaaggtca

SEQ ID NO: 305396 - DNA, 20 bp, Artificial Sequence
  chemically synthesized
ttaattctatgaccttaagt

SEQ ID NO: 305397 - DNA, 20 bp, Artificial Sequence
  chemically synthesized
ttgtgtttccttcttactta

SEQ ID NO: 305398 - DNA, 20 bp, Artificial Sequence
  chemically synthesized
attctatgaccttaagtaag

SEQ ID NO: 305399 - DNA, 20 bp, Artificial Sequence
  chemically synthesized
tttgtgtttccttcttactt

SEQ ID NO: 305400 - DNA, 20 bp, Artificial Sequence
  chemically synthesized
ttctatgaccttaagtaaga

SEQ ID NO: 305401 - DNA, 20 bp, Artificial Sequence
  chemically synthesized
gtaagaaggaaacacaaaat

SEQ ID NO: 305402 - DNA, 20 bp, Artificial Sequence
  chemically synthesized
gaaggaaacacaaaataagt

SEQ ID NO: 305403 - DNA, 20 bp, Artificial Sequence
  chemically synthesized
aaggaaacacaaaataagta

SEQ ID NO: 305404 - DNA, 20 bp, Artificial Sequence
  chemically synthesized
aggtatttttattttaattc

SEQ ID NO: 305405 - DNA, 20 bp, Artificial Sequence
  chemically synthesized
gaaaataattttttaaaatc

SEQ ID NO: 305406 - DNA, 20 bp, Artificial Sequence
  chemically synthesized
aaattattttcttttttaat

SEQ ID NO: 305407 - DNA, 20 bp, Artificial Sequence
  chemically synthesized
aagcctgatgccaattaaaa

SEQ ID NO: 305408 - DNA, 20 bp, Artificial Sequence
  chemically synthesized
ttttcttttttaattggcat

SEQ ID NO: 305409 - DNA, 20 bp, Artificial Sequence
  chemically synthesized
tttcttttttaattggcatc

SEQ ID NO: 305410 - DNA, 20 bp, Artificial Sequence
  chemically synthesized
ttaattggcatcaggcttac

SEQ ID NO: 305411 - DNA, 20 bp, Artificial Sequence
  chemically synthesized
gaaagctctccacgactagt

SEQ ID NO: 305412 - DNA, 20 bp, Artificial Sequence
  chemically synthesized
ggcatcaggcttactagtcg

SEQ ID NO: 305413 - DNA, 20 bp, Artificial Sequence
  chemically synthesized
catcaggcttactagtcgtg

SEQ ID NO: 305414 - DNA, 20 bp, Artificial Sequence
  chemically synthesized
tcctgaaagctctccacgac

SEQ ID NO: 305415 - DNA, 20 bp, Artificial Sequence
  chemically synthesized
tcaggcttactagtcgtgga

SEQ ID NO: 305416 - DNA, 20 bp, Artificial Sequence
  chemically synthesized
tactagtcgtggagagcttt

SEQ ID NO: 305417 - DNA, 20 bp, Artificial Sequence
  chemically synthesized
actagtcgtggagagctttc

SEQ ID NO: 305418 - DNA, 20 bp, Artificial Sequence
  chemically synthesized
agtcgtggagagctttcagg

SEQ ID NO: 305419 - DNA, 20 bp, Artificial Sequence
  chemically synthesized
accttttcattgcttcctga

SEQ ID NO: 305420 - DNA, 20 bp, Artificial Sequence
  chemically synthesized
agctttcaggaagcaatgaa

SEQ ID NO: 305421 - DNA, 20 bp, Artificial Sequence
  chemically synthesized
gctttcaggaagcaatgaaa

SEQ ID NO: 305422 - DNA, 20 bp, Artificial Sequence
  chemically synthesized
ctctaaggctttttatttaa

SEQ ID NO: 305423 - DNA, 20 bp, Artificial Sequence
  chemically synthesized
gaaaaggtcttttaaataaa

SEQ ID NO: 305424 - DNA, 20 bp, Artificial Sequence
  chemically synthesized
gtcttttaaataaaaagcct

SEQ ID NO: 305425 - DNA, 20 bp, Artificial Sequence
  chemically synthesized
cttttaaataaaaagcctta

SEQ ID NO: 305426 - DNA, 20 bp, Artificial Sequence
  chemically synthesized
gtttaattaaaaatactcta

SEQ ID NO: 305427 - DNA, 20 bp, Artificial Sequence
  chemically synthesized
agtttaattaaaaatactct

SEQ ID NO: 305428 - DNA, 20 bp, Artificial Sequence
  chemically synthesized
gtatttttaattaaacttac

SEQ ID NO: 305429 - DNA, 20 bp, Artificial Sequence
  chemically synthesized
tctcttcttttttggccagt

SEQ ID NO: 305430 - DNA, 20 bp, Artificial Sequence
  chemically synthesized
attaaacttactggccaaaa

SEQ ID NO: 305431 - DNA, 20 bp, Artificial Sequence
  chemically synthesized
tgcctctcttcttttttggc

SEQ ID NO: 305432 - DNA, 20 bp, Artificial Sequence
  chemically synthesized
aaacttactggccaaaaaag

SEQ ID NO: 305433 - DNA, 20 bp, Artificial Sequence
  chemically synthesized
ggtttgcctctcttcttttt

SEQ ID NO: 305434 - DNA, 20 bp, Artificial Sequence
  chemically synthesized
acttactggccaaaaaagaa

SEQ ID NO: 305435 - DNA, 20 bp, Artificial Sequence
  chemically synthesized
ttactggccaaaaaagaaga

SEQ ID NO: 305436 - DNA, 20 bp, Artificial Sequence
  chemically synthesized
tactggccaaaaaagaagag

SEQ ID NO: 305437 - DNA, 20 bp, Artificial Sequence
  chemically synthesized
aagggggatatagttgcaaa

SEQ ID NO: 305438 - DNA, 20 bp, Artificial Sequence
  chemically synthesized
ctctttgtacaagggggata

SEQ ID NO: 305439 - DNA, 20 bp, Artificial Sequence
  chemically synthesized
gtagacctctttgtacaagg

SEQ ID NO: 305440 - DNA, 20 bp, Artificial Sequence
  chemically synthesized
tgtagacctctttgtacaag

SEQ ID NO: 305441 - DNA, 20 bp, Artificial Sequence
  chemically synthesized
aactatatcccccttgtaca

SEQ ID NO: 305442 - DNA, 20 bp, Artificial Sequence
  chemically synthesized
ttgtagacctctttgtacaa

SEQ ID NO: 305443 - DNA, 20 bp, Artificial Sequence
  chemically synthesized
tttgtagacctctttgtaca

SEQ ID NO: 305444 - DNA, 20 bp, Artificial Sequence
  chemically synthesized
ctatatcccccttgtacaaa

SEQ ID NO: 305445 - DNA, 20 bp, Artificial Sequence
  chemically synthesized
ttttgtagacctctttgtac

SEQ ID NO: 305446 - DNA, 20 bp, Artificial Sequence
  chemically synthesized
tatatcccccttgtacaaag

SEQ ID NO: 305447 - DNA, 20 bp, Artificial Sequence
  chemically synthesized
attctcagagcatcattttg

SEQ ID NO: 305448 - DNA, 20 bp, Artificial Sequence
  chemically synthesized
ggtctacaaaatgatgctct

SEQ ID NO: 305449 - DNA, 20 bp, Artificial Sequence
  chemically synthesized
acaaaatgatgctctgagaa

SEQ ID NO: 305450 - DNA, 20 bp, Artificial Sequence
  chemically synthesized
caaaatgatgctctgagaat

SEQ ID NO: 305451 - DNA, 20 bp, Artificial Sequence
  chemically synthesized
tctggctgtacccattctca

SEQ ID NO: 305452 - DNA, 20 bp, Artificial Sequence
  chemically synthesized
gttctggctgtacccattct

SEQ ID NO: 305453 - DNA, 20 bp, Artificial Sequence
  chemically synthesized
tgatgctctgagaatgggta

SEQ ID NO: 305454 - DNA, 20 bp, Artificial Sequence
  chemically synthesized
gctctgagaatgggtacagc

SEQ ID NO: 305455 - DNA, 20 bp, Artificial Sequence
  chemically synthesized
aatattttatgttcacgttc

SEQ ID NO: 305456 - DNA, 20 bp, Artificial Sequence
  chemically synthesized
tgaacataaaatattttatg

SEQ ID NO: 305457 - DNA, 20 bp, Artificial Sequence
  chemically synthesized
gaacataaaatattttatga

SEQ ID NO: 305458 - DNA, 20 bp, Artificial Sequence
  chemically synthesized
aacataaaatattttatgaa

SEQ ID NO: 305459 - DNA, 20 bp, Artificial Sequence
  chemically synthesized
tattttatgaagggttaaaa

SEQ ID NO: 305460 - DNA, 20 bp, Artificial Sequence
  chemically synthesized
ttttatgaagggttaaaata

SEQ ID NO: 305461 - DNA, 20 bp, Artificial Sequence
  chemically synthesized
tttatgaagggttaaaatag

SEQ ID NO: 305462 - DNA, 20 bp, Artificial Sequence
  chemically synthesized
gttaaaatagaggatcttta

SEQ ID NO: 305463 - DNA, 20 bp, Artificial Sequence
  chemically synthesized
gagttaattctcattcttta

SEQ ID NO: 305464 - DNA, 20 bp, Artificial Sequence
  chemically synthesized
atagaggatctttaaagaat

SEQ ID NO: 305465 - DNA, 20 bp, Artificial Sequence
  chemically synthesized
ttaaagaatgagaattaact

SEQ ID NO: 305466 - DNA, 20 bp, Artificial Sequence
  chemically synthesized
gaatgagaattaactcagaa

SEQ ID NO: 305467 - DNA, 20 bp, Artificial Sequence
  chemically synthesized
tgagaattaactcagaaaag

SEQ ID NO: 305468 - DNA, 20 bp, Artificial Sequence
  chemically synthesized
tttacatgttcttcttttct

SEQ ID NO: 305469 - DNA, 20 bp, Artificial Sequence
  chemically synthesized
tcagaaaagaagaacatgta

SEQ ID NO: 305470 - DNA, 20 bp, Artificial Sequence
  chemically synthesized
atgtaaagaaattttcatct

SEQ ID NO: 305471 - DNA, 20 bp, Artificial Sequence
  chemically synthesized
aaattttcatcttggtacat

SEQ ID NO: 305472 - DNA, 20 bp, Artificial Sequence
  chemically synthesized
tagaaatatgccaatgtacc

SEQ ID NO: 305473 - DNA, 20 bp, Artificial Sequence
  chemically synthesized
tattatacccaaaatgcaaa

SEQ ID NO: 305474 - DNA, 20 bp, Artificial Sequence
  chemically synthesized
gcatatttctatttgcattt

SEQ ID NO: 305475 - DNA, 20 bp, Artificial Sequence
  chemically synthesized
catatttctatttgcatttt

SEQ ID NO: 305476 - DNA, 20 bp, Artificial Sequence
  chemically synthesized
tgcattttgggtataataaa

SEQ ID NO: 305477 - DNA, 20 bp, Artificial Sequence
  chemically synthesized
ttgggtataataaaaagcac

SEQ ID NO: 305478 - DNA, 20 bp, Artificial Sequence
  chemically synthesized
catagctgtaaatgataagc

SEQ ID NO: 305479 - DNA, 20 bp, Artificial Sequence
  chemically synthesized
aaaacatagctgtaaatgat

SEQ ID NO: 305480 - DNA, 20 bp, Artificial Sequence
  chemically synthesized
aagcactggcttatcattta

SEQ ID NO: 305481 - DNA, 20 bp, Artificial Sequence
  chemically synthesized
tcaaatagtaatataaaaca

SEQ ID NO: 305482 - DNA, 20 bp, Artificial Sequence
  chemically synthesized
tgttttatattactatttga

SEQ ID NO: 305483 - DNA, 20 bp, Artificial Sequence
  chemically synthesized
gttttatattactatttgat

SEQ ID NO: 305484 - DNA, 20 bp, Artificial Sequence
  chemically synthesized
gatttaaaactcctatcaaa

SEQ ID NO: 305485 - DNA, 20 bp, Artificial Sequence
  chemically synthesized
tttatattactatttgatag

SEQ ID NO: 305486 - DNA, 20 bp, Artificial Sequence
  chemically synthesized
aggagttttaaatctcccat

SEQ ID NO: 305487 - DNA, 20 bp, Artificial Sequence
  chemically synthesized
ggagttttaaatctcccatc

SEQ ID NO: 305488 - DNA, 20 bp, Artificial Sequence
  chemically synthesized
ccgaagcaagcacctgatgg

SEQ ID NO: 305489 - DNA, 20 bp, Artificial Sequence
  chemically synthesized
tgccgaagcaagcacctgat

SEQ ID NO: 305490 - DNA, 20 bp, Artificial Sequence
  chemically synthesized
ctgccgaagcaagcacctga

SEQ ID NO: 305491 - DNA, 20 bp, Artificial Sequence
  chemically synthesized
ctcccatcaggtgcttgctt

SEQ ID NO: 305492 - DNA, 20 bp, Artificial Sequence
  chemically synthesized
ccatcaggtgcttgcttcgg

SEQ ID NO: 305493 - DNA, 20 bp, Artificial Sequence
  chemically synthesized
attatgtgtgctgccgaagc

SEQ ID NO: 305494 - DNA, 20 bp, Artificial Sequence
  chemically synthesized
atttattatgtgtgctgccg

SEQ ID NO: 305495 - DNA, 20 bp, Artificial Sequence
  chemically synthesized
acacataataaatctctcat

SEQ ID NO: 305496 - DNA, 20 bp, Artificial Sequence
  chemically synthesized
cacataataaatctctcatc

SEQ ID NO: 305497 - DNA, 20 bp, Artificial Sequence
  chemically synthesized
tatcatctatatcctgatga

SEQ ID NO: 305498 - DNA, 20 bp, Artificial Sequence
  chemically synthesized
tatatcatctatatcctgat

SEQ ID NO: 305499 - DNA, 20 bp, Artificial Sequence
  chemically synthesized
ataaatctctcatcaggata

SEQ ID NO: 305500 - DNA, 20 bp, Artificial Sequence
  chemically synthesized
tcatcaggatatagatgata

SEQ ID NO: 305501 - DNA, 20 bp, Artificial Sequence
  chemically synthesized
tcaggatatagatgatatag

SEQ ID NO: 305502 - DNA, 20 bp, Artificial Sequence
  chemically synthesized
caggatatagatgatataga

SEQ ID NO: 305503 - DNA, 20 bp, Artificial Sequence
  chemically synthesized
taataatcattttctctttt

SEQ ID NO: 305504 - DNA, 20 bp, Artificial Sequence
  chemically synthesized
aataatcattttctcttttt

SEQ ID NO: 305505 - DNA, 20 bp, Artificial Sequence
  chemically synthesized
cattcaaggatgcccaaaaa

SEQ ID NO: 305506 - DNA, 20 bp, Artificial Sequence
  chemically synthesized
tacattcaaggatgcccaaa

SEQ ID NO: 305507 - DNA, 20 bp, Artificial Sequence
  chemically synthesized
tttttgggcatccttgaatg

SEQ ID NO: 305508 - DNA, 20 bp, Artificial Sequence
  chemically synthesized
ttttgggcatccttgaatgt

SEQ ID NO: 305509 - DNA, 20 bp, Artificial Sequence
  chemically synthesized
tatgtttgtgcctacattca

SEQ ID NO: 305510 - DNA, 20 bp, Artificial Sequence
  chemically synthesized
atatgtttgtgcctacattc

SEQ ID NO: 305511 - DNA, 20 bp, Artificial Sequence
  chemically synthesized
aatgtaggcacaaacatata

SEQ ID NO: 305512 - DNA, 20 bp, Artificial Sequence
  chemically synthesized
ttgcctcttcttgtacatgg

SEQ ID NO: 305513 - DNA, 20 bp, Artificial Sequence
  chemically synthesized
aaacatgaactgccatgtac

SEQ ID NO: 305514 - DNA, 20 bp, Artificial Sequence
  chemically synthesized
aatttgcctcttcttgtaca

SEQ ID NO: 305515 - DNA, 20 bp, Artificial Sequence
  chemically synthesized
catgaactgccatgtacaag

SEQ ID NO: 305516 - DNA, 20 bp, Artificial Sequence
  chemically synthesized
tgaactgccatgtacaagaa

SEQ ID NO: 305517 - DNA, 20 bp, Artificial Sequence
  chemically synthesized
gaactgccatgtacaagaag

SEQ ID NO: 305518 - DNA, 20 bp, Artificial Sequence
  chemically synthesized
tacaagaagaggcaaattct

SEQ ID NO: 305519 - DNA, 20 bp, Artificial Sequence
  chemically synthesized
taagataaaatacatatgct

SEQ ID NO: 305520 - DNA, 20 bp, Artificial Sequence
  chemically synthesized
agcatatgtattttatctta

SEQ ID NO: 305521 - DNA, 20 bp, Artificial Sequence
  chemically synthesized
catatgtattttatcttaaa

SEQ ID NO: 305522 - DNA, 20 bp, Artificial Sequence
  chemically synthesized
atatgtattttatcttaaag

SEQ ID NO: 305523 - DNA, 20 bp, Artificial Sequence
  chemically synthesized
tcaactgtgagcacctcttt

SEQ ID NO: 305524 - DNA, 20 bp, Artificial Sequence
  chemically synthesized
ttatcttaaagaggtgctca

SEQ ID NO: 305525 - DNA, 20 bp, Artificial Sequence
  chemically synthesized
ttaaagaggtgctcacagtt

SEQ ID NO: 305526 - DNA, 20 bp, Artificial Sequence
  chemically synthesized
tttgcaacattctcaactgt

SEQ ID NO: 305527 - DNA, 20 bp, Artificial Sequence
  chemically synthesized
aatgttgcaaaaattgttgt

SEQ ID NO: 305528 - DNA, 20 bp, Artificial Sequence
  chemically synthesized
aaaaattgttgttagcaata

SEQ ID NO: 305529 - DNA, 20 bp, Artificial Sequence
  chemically synthesized
atagcaaaatattcacaaaa

SEQ ID NO: 305530 - DNA, 20 bp, Artificial Sequence
  chemically synthesized
tagcaaaatattcacaaaat

SEQ ID NO: 305531 - DNA, 20 bp, Artificial Sequence
  chemically synthesized
aatattcacaaaatgggaat

SEQ ID NO: 305532 - DNA, 20 bp, Artificial Sequence
  chemically synthesized
tgagatatttgaaccttaat

SEQ ID NO: 305533 - DNA, 20 bp, Artificial Sequence
  chemically synthesized
gaaagttgtatgacttatta

SEQ ID NO: 305534 - DNA, 20 bp, Artificial Sequence
  chemically synthesized
ggaaagttgtatgacttatt

SEQ ID NO: 305535 - DNA, 20 bp, Artificial Sequence
  chemically synthesized
ttctttctcaggaataagga

SEQ ID NO: 305536 - DNA, 20 bp, Artificial Sequence
  chemically synthesized
atacaactttccttattcct

SEQ ID NO: 305537 - DNA, 20 bp, Artificial Sequence
  chemically synthesized
tgtcttctttctcaggaata

SEQ ID NO: 305538 - DNA, 20 bp, Artificial Sequence
  chemically synthesized
ttgtcttctttctcaggaat

SEQ ID NO: 305539 - DNA, 20 bp, Artificial Sequence
  chemically synthesized
aactttccttattcctgaga

SEQ ID NO: 305540 - DNA, 20 bp, Artificial Sequence
  chemically synthesized
tttccttattcctgagaaag

SEQ ID NO: 305541 - DNA, 20 bp, Artificial Sequence
  chemically synthesized
aataaattgtcttctttctc

SEQ ID NO: 305542 - DNA, 20 bp, Artificial Sequence
  chemically synthesized
gaataaattgtcttctttct

SEQ ID NO: 305543 - DNA, 20 bp, Artificial Sequence
  chemically synthesized
gtagttttgtggatttttag

SEQ ID NO: 305544 - DNA, 20 bp, Artificial Sequence
  chemically synthesized
tttgtagttttgtggatttt

SEQ ID NO: 305545 - DNA, 20 bp, Artificial Sequence
  chemically synthesized
ctaaaggttttgtagttttg

SEQ ID NO: 305546 - DNA, 20 bp, Artificial Sequence
  chemically synthesized
aagcgagtctaaaggttttg

SEQ ID NO: 305547 - DNA, 20 bp, Artificial Sequence
  chemically synthesized
ccacaaaactacaaaacctt

SEQ ID NO: 305548 - DNA, 20 bp, Artificial Sequence
  chemically synthesized
tttttttcaagcgagtctaa

SEQ ID NO: 305549 - DNA, 20 bp, Artificial Sequence
  chemically synthesized
ttttttttcaagcgagtcta

SEQ ID NO: 305550 - DNA, 20 bp, Artificial Sequence
  chemically synthesized
atatattttttttttcaagc

SEQ ID NO: 305551 - DNA, 20 bp, Artificial Sequence
  chemically synthesized
atatatatattttttttttc

SEQ ID NO: 305552 - DNA, 20 bp, Artificial Sequence
  chemically synthesized
atatatatatgcttacacca

SEQ ID NO: 305553 - DNA, 20 bp, Artificial Sequence
  chemically synthesized
tataccaggtgctttggtgt

SEQ ID NO: 305554 - DNA, 20 bp, Artificial Sequence
  chemically synthesized
tatgcttacaccaaagcacc

SEQ ID NO: 305555 - DNA, 20 bp, Artificial Sequence
  chemically synthesized
gtagtatataccaggtgctt

SEQ ID NO: 305556 - DNA, 20 bp, Artificial Sequence
  chemically synthesized
tatattaagtagtatatacc

SEQ ID NO: 305557 - DNA, 20 bp, Artificial Sequence
  chemically synthesized
ttatattaagtagtatatac

SEQ ID NO: 305558 - DNA, 20 bp, Artificial Sequence
  chemically synthesized
aatatgtaatttatattaag

SEQ ID NO: 305559 - DNA, 20 bp, Artificial Sequence
  chemically synthesized
tttaatatgtaatttatatt

SEQ ID NO: 305560 - DNA, 20 bp, Artificial Sequence
  chemically synthesized
tataaattacatattaaata

SEQ ID NO: 305561 - DNA, 20 bp, Artificial Sequence
  chemically synthesized
aatacagtaattacaattta

SEQ ID NO: 305562 - DNA, 20 bp, Artificial Sequence
  chemically synthesized
cgtaatatgataattacaat

SEQ ID NO: 305563 - DNA, 20 bp, Artificial Sequence
  chemically synthesized
aattagcataccaaattgta

SEQ ID NO: 305564 - DNA, 20 bp, Artificial Sequence
  chemically synthesized
tagtcatatgctttacaatt

SEQ ID NO: 305565 - DNA, 20 bp, Artificial Sequence
  chemically synthesized
gtgctgttgaaagggtatat

SEQ ID NO: 305566 - DNA, 20 bp, Artificial Sequence
  chemically synthesized
tgactaatataccctttcaa

SEQ ID NO: 305567 - DNA, 20 bp, Artificial Sequence
  chemically synthesized
aatcacatgtgctgttgaaa

SEQ ID NO: 305568 - DNA, 20 bp, Artificial Sequence
  chemically synthesized
aaatcacatgtgctgttgaa

SEQ ID NO: 305569 - DNA, 20 bp, Artificial Sequence
  chemically synthesized
gaaatcacatgtgctgttga

SEQ ID NO: 305570 - DNA, 20 bp, Artificial Sequence
  chemically synthesized
ttcaacagcacatgtgattt

SEQ ID NO: 305571 - DNA, 20 bp, Artificial Sequence
  chemically synthesized
acatgtgatttcagtcaaat

SEQ ID NO: 305572 - DNA, 20 bp, Artificial Sequence
  chemically synthesized
catgtgatttcagtcaaatg

SEQ ID NO: 305573 - DNA, 20 bp, Artificial Sequence
  chemically synthesized
tgatttcagtcaaatgagga

SEQ ID NO: 305574 - DNA, 20 bp, Artificial Sequence
  chemically synthesized
aatataatgtatgtgatttg

SEQ ID NO: 305575 - DNA, 20 bp, Artificial Sequence
  chemically synthesized
aaaaaaataaatgtgatagt

SEQ ID NO: 305576 - DNA, 20 bp, Artificial Sequence
  chemically synthesized
acttaaaaaaataaatgtga

SEQ ID NO: 305577 - DNA, 20 bp, Artificial Sequence
  chemically synthesized
actatcacatttattttttt

SEQ ID NO: 305578 - DNA, 20 bp, Artificial Sequence
  chemically synthesized
acatttatttttttaagttc

SEQ ID NO: 305579 - DNA, 20 bp, Artificial Sequence
  chemically synthesized
catttatttttttaagttcc

SEQ ID NO: 305580 - DNA, 20 bp, Artificial Sequence
  chemically synthesized
atttatttttttaagttcca

SEQ ID NO: 305581 - DNA, 20 bp, Artificial Sequence
  chemically synthesized
cacatccaatacgtgtaccc

SEQ ID NO: 305582 - DNA, 20 bp, Artificial Sequence
  chemically synthesized
aagttccagggtacacgtat

SEQ ID NO: 305583 - DNA, 20 bp, Artificial Sequence
  chemically synthesized
gggtacacgtattggatgtg

SEQ ID NO: 305584 - DNA, 20 bp, Artificial Sequence
  chemically synthesized
ggtacacgtattggatgtgt

SEQ ID NO: 305585 - DNA, 20 bp, Artificial Sequence
  chemically synthesized
ttggatgtgtaggtttgtta

SEQ ID NO: 305586 - DNA, 20 bp, Artificial Sequence
  chemically synthesized
ggatgtgtaggtttgttatg

SEQ ID NO: 305587 - DNA, 20 bp, Artificial Sequence
  chemically synthesized
gatgtgtaggtttgttatgg

SEQ ID NO: 305588 - DNA, 20 bp, Artificial Sequence
  chemically synthesized
atggaggtaaatgtgtgcca

SEQ ID NO: 305589 - DNA, 20 bp, Artificial Sequence
  chemically synthesized
gaggtaaatgtgtgccacgg

SEQ ID NO: 305590 - DNA, 20 bp, Artificial Sequence
  chemically synthesized
gtaggtgcaccataccaccg

SEQ ID NO: 305591 - DNA, 20 bp, Artificial Sequence
  chemically synthesized
aaatgtgtgccacggtggta

SEQ ID NO: 305592 - DNA, 20 bp, Artificial Sequence
  chemically synthesized
acggtggtatggtgcaccta

SEQ ID NO: 305593 - DNA, 20 bp, Artificial Sequence
  chemically synthesized
tatctacctaatgggtctgt

SEQ ID NO: 305594 - DNA, 20 bp, Artificial Sequence
  chemically synthesized
atatctacctaatgggtctg

SEQ ID NO: 305595 - DNA, 20 bp, Artificial Sequence
  chemically synthesized
tggtgcacctacagacccat

SEQ ID NO: 305596 - DNA, 20 bp, Artificial Sequence
  chemically synthesized
ggtgcacctacagacccatt

SEQ ID NO: 305597 - DNA, 20 bp, Artificial Sequence
  chemically synthesized
gcacctacagacccattagg

SEQ ID NO: 305598 - DNA, 20 bp, Artificial Sequence
  chemically synthesized
gggctcaatatctacctaat

SEQ ID NO: 305599 - DNA, 20 bp, Artificial Sequence
  chemically synthesized
tgggctcaatatctacctaa

SEQ ID NO: 305600 - DNA, 20 bp, Artificial Sequence
  chemically synthesized
agacccattaggtagatatt

SEQ ID NO: 305601 - DNA, 20 bp, Artificial Sequence
  chemically synthesized
cattaggtagatattgagcc

SEQ ID NO: 305602 - DNA, 20 bp, Artificial Sequence
  chemically synthesized
aaaaatagctaacggatgct

SEQ ID NO: 305603 - DNA, 20 bp, Artificial Sequence
  chemically synthesized
gaaaaatagctaacggatgc

SEQ ID NO: 305604 - DNA, 20 bp, Artificial Sequence
  chemically synthesized
atattgagcccagcatccgt

SEQ ID NO: 305605 - DNA, 20 bp, Artificial Sequence
  chemically synthesized
gcatcaggaaaaatagctaa

SEQ ID NO: 305606 - DNA, 20 bp, Artificial Sequence
  chemically synthesized
gaggagagcatcaggaaaaa

SEQ ID NO: 305607 - DNA, 20 bp, Artificial Sequence
  chemically synthesized
tgggagaggaggagagcatc

SEQ ID NO: 305608 - DNA, 20 bp, Artificial Sequence
  chemically synthesized
ctgggagaggaggagagcat

SEQ ID NO: 305609 - DNA, 20 bp, Artificial Sequence
  chemically synthesized
ctgttgctgggagaggagga

SEQ ID NO: 305610 - DNA, 20 bp, Artificial Sequence
  chemically synthesized
gcctgttgctgggagaggag

SEQ ID NO: 305611 - DNA, 20 bp, Artificial Sequence
  chemically synthesized
ctgatgctctcctcctctcc

SEQ ID NO: 305612 - DNA, 20 bp, Artificial Sequence
  chemically synthesized
gggcctgttgctgggagagg

SEQ ID NO: 305613 - DNA, 20 bp, Artificial Sequence
  chemically synthesized
ggggcctgttgctgggagag

SEQ ID NO: 305614 - DNA, 20 bp, Artificial Sequence
  chemically synthesized
ctggggcctgttgctgggag

SEQ ID NO: 305615 - DNA, 20 bp, Artificial Sequence
  chemically synthesized
actggggcctgttgctggga

SEQ ID NO: 305616 - DNA, 20 bp, Artificial Sequence
  chemically synthesized
ctctcctcctctcccagcaa

SEQ ID NO: 305617 - DNA, 20 bp, Artificial Sequence
  chemically synthesized
acactggggcctgttgctgg

SEQ ID NO: 305618 - DNA, 20 bp, Artificial Sequence
  chemically synthesized
tctcctcctctcccagcaac

SEQ ID NO: 305619 - DNA, 20 bp, Artificial Sequence
  chemically synthesized
acacactggggcctgttgct

SEQ ID NO: 305620 - DNA, 20 bp, Artificial Sequence
  chemically synthesized
cacacactggggcctgttgc

SEQ ID NO: 305621 - DNA, 20 bp, Artificial Sequence
  chemically synthesized
cctctcccagcaacaggccc

SEQ ID NO: 305622 - DNA, 20 bp, Artificial Sequence
  chemically synthesized
gaagagaacaacacacactg

SEQ ID NO: 305623 - DNA, 20 bp, Artificial Sequence
  chemically synthesized
ggaagagaacaacacacact

SEQ ID NO: 305624 - DNA, 20 bp, Artificial Sequence
  chemically synthesized
gggaagagaacaacacacac

SEQ ID NO: 305625 - DNA, 20 bp, Artificial Sequence
  chemically synthesized
gaacacatgggcacagggaa

SEQ ID NO: 305626 - DNA, 20 bp, Artificial Sequence
  chemically synthesized
gggaacacatgggcacaggg

SEQ ID NO: 305627 - DNA, 20 bp, Artificial Sequence
  chemically synthesized
aatgggaacacatgggcaca

SEQ ID NO: 305628 - DNA, 20 bp, Artificial Sequence
  chemically synthesized
caatgggaacacatgggcac

SEQ ID NO: 305629 - DNA, 20 bp, Artificial Sequence
  chemically synthesized
acaatgggaacacatgggca

SEQ ID NO: 305630 - DNA, 20 bp, Artificial Sequence
  chemically synthesized
gctgaacaatgggaacacat

SEQ ID NO: 305631 - DNA, 20 bp, Artificial Sequence
  chemically synthesized
agctgaacaatgggaacaca

SEQ ID NO: 305632 - DNA, 20 bp, Artificial Sequence
  chemically synthesized
gcccatgtgttcccattgtt

SEQ ID NO: 305633 - DNA, 20 bp, Artificial Sequence
  chemically synthesized
ataagtaggagctgaacaat

SEQ ID NO: 305634 - DNA, 20 bp, Artificial Sequence
  chemically synthesized
tataagtaggagctgaacaa

SEQ ID NO: 305635 - DNA, 20 bp, Artificial Sequence
  chemically synthesized
atgttctcacttataagtag

SEQ ID NO: 305636 - DNA, 20 bp, Artificial Sequence
  chemically synthesized
attgttcagctcctacttat

SEQ ID NO: 305637 - DNA, 20 bp, Artificial Sequence
  chemically synthesized
gcatgttctcacttataagt

SEQ ID NO: 305638 - DNA, 20 bp, Artificial Sequence
  chemically synthesized
tgcatgttctcacttataag

SEQ ID NO: 305639 - DNA, 20 bp, Artificial Sequence
  chemically synthesized
ttcagctcctacttataagt

SEQ ID NO: 305640 - DNA, 20 bp, Artificial Sequence
  chemically synthesized
cactgcatgttctcacttat

SEQ ID NO: 305641 - DNA, 20 bp, Artificial Sequence
  chemically synthesized
tacttataagtgagaacatg

SEQ ID NO: 305642 - DNA, 20 bp, Artificial Sequence
  chemically synthesized
aagtgagaacatgcagtgtt

SEQ ID NO: 305643 - DNA, 20 bp, Artificial Sequence
  chemically synthesized
tcagcaaactaatgcgggaa

SEQ ID NO: 305644 - DNA, 20 bp, Artificial Sequence
  chemically synthesized
ttggttttctgttcccgcat

SEQ ID NO: 305645 - DNA, 20 bp, Artificial Sequence
  chemically synthesized
tattctcagcaaactaatgc

SEQ ID NO: 305646 - DNA, 20 bp, Artificial Sequence
  chemically synthesized
ttattctcagcaaactaatg

SEQ ID NO: 305647 - DNA, 20 bp, Artificial Sequence
  chemically synthesized
tgttcccgcattagtttgct

SEQ ID NO: 305648 - DNA, 20 bp, Artificial Sequence
  chemically synthesized
cattagtttgctgagaataa

SEQ ID NO: 305649 - DNA, 20 bp, Artificial Sequence
  chemically synthesized
tagctggaagctgttattct

SEQ ID NO: 305650 - DNA, 20 bp, Artificial Sequence
  chemically synthesized
ttgctgagaataacagcttc

SEQ ID NO: 305651 - DNA, 20 bp, Artificial Sequence
  chemically synthesized
agagacatggatgtagctgg

SEQ ID NO: 305652 - DNA, 20 bp, Artificial Sequence
  chemically synthesized
tgcagagacatggatgtagc

SEQ ID NO: 305653 - DNA, 20 bp, Artificial Sequence
  chemically synthesized
cctttgcagagacatggatg

SEQ ID NO: 305654 - DNA, 20 bp, Artificial Sequence
  chemically synthesized
gtatgtcctttgcagagaca

SEQ ID NO: 305655 - DNA, 20 bp, Artificial Sequence
  chemically synthesized
gctacatccatgtctctgca

SEQ ID NO: 305656 - DNA, 20 bp, Artificial Sequence
  chemically synthesized
ctacatccatgtctctgcaa

SEQ ID NO: 305657 - DNA, 20 bp, Artificial Sequence
  chemically synthesized
atgagagtatgtcctttgca

SEQ ID NO: 305658 - DNA, 20 bp, Artificial Sequence
  chemically synthesized
gaatgagagtatgtcctttg

SEQ ID NO: 305659 - DNA, 20 bp, Artificial Sequence
  chemically synthesized
gcagccataaaaaggaatga

SEQ ID NO: 305660 - DNA, 20 bp, Artificial Sequence
  chemically synthesized
atgcagccataaaaaggaat

SEQ ID NO: 305661 - DNA, 20 bp, Artificial Sequence
  chemically synthesized
catactctcattccttttta

SEQ ID NO: 305662 - DNA, 20 bp, Artificial Sequence
  chemically synthesized
aatagtatgcagccataaaa

SEQ ID NO: 305663 - DNA, 20 bp, Artificial Sequence
  chemically synthesized
gaatagtatgcagccataaa

SEQ ID NO: 305664 - DNA, 20 bp, Artificial Sequence
  chemically synthesized
atacaccatggaatagtatg

SEQ ID NO: 305665 - DNA, 20 bp, Artificial Sequence
  chemically synthesized
tatggctgcatactattcca

SEQ ID NO: 305666 - DNA, 20 bp, Artificial Sequence
  chemically synthesized
gatacatatacaccatggaa

SEQ ID NO: 305667 - DNA, 20 bp, Artificial Sequence
  chemically synthesized
aatgtgatacatatacacca

SEQ ID NO: 305668 - DNA, 20 bp, Artificial Sequence
  chemically synthesized
tgtatcacattttctttatc

SEQ ID NO: 305669 - DNA, 20 bp, Artificial Sequence
  chemically synthesized
catcaatgatagactggata

SEQ ID NO: 305670 - DNA, 20 bp, Artificial Sequence
  chemically synthesized
aatgcccatcaatgatagac

SEQ ID NO: 305671 - DNA, 20 bp, Artificial Sequence
  chemically synthesized
tttatccagtctatcattga

SEQ ID NO: 305672 - DNA, 20 bp, Artificial Sequence
  chemically synthesized
acccaaatgcccatcaatga

SEQ ID NO: 305673 - DNA, 20 bp, Artificial Sequence
  chemically synthesized
ttatccagtctatcattgat

SEQ ID NO: 305674 - DNA, 20 bp, Artificial Sequence
  chemically synthesized
gtctatcattgatgggcatt

SEQ ID NO: 305675 - DNA, 20 bp, Artificial Sequence
  chemically synthesized
tctatcattgatgggcattt

SEQ ID NO: 305676 - DNA, 20 bp, Artificial Sequence
  chemically synthesized
tattcacaatagcaaagaca

SEQ ID NO: 305677 - DNA, 20 bp, Artificial Sequence
  chemically synthesized
cagcactattcacaatagca

SEQ ID NO: 305678 - DNA, 20 bp, Artificial Sequence
  chemically synthesized
tatgtctttgctattgtgaa

SEQ ID NO: 305679 - DNA, 20 bp, Artificial Sequence
  chemically synthesized
aattgcagcactattcacaa

SEQ ID NO: 305680 - DNA, 20 bp, Artificial Sequence
  chemically synthesized
atgcatttgtatgttaattg

SEQ ID NO: 305681 - DNA, 20 bp, Artificial Sequence
  chemically synthesized
aaatgcatgtatctttataa

SEQ ID NO: 305682 - DNA, 20 bp, Artificial Sequence
  chemically synthesized
aatgcatgtatctttataat

SEQ ID NO: 305683 - DNA, 20 bp, Artificial Sequence
  chemically synthesized
atataaatcatcctattata

SEQ ID NO: 305684 - DNA, 20 bp, Artificial Sequence
  chemically synthesized
taggatgatttatattcctt

SEQ ID NO: 305685 - DNA, 20 bp, Artificial Sequence
  chemically synthesized
aggatgatttatattccttt

SEQ ID NO: 305686 - DNA, 20 bp, Artificial Sequence
  chemically synthesized
gttactggatatatacccaa

SEQ ID NO: 305687 - DNA, 20 bp, Artificial Sequence
  chemically synthesized
cgttactggatatataccca

SEQ ID NO: 305688 - DNA, 20 bp, Artificial Sequence
  chemically synthesized
tattcctttgggtatatatc

SEQ ID NO: 305689 - DNA, 20 bp, Artificial Sequence
  chemically synthesized
tttgggtatatatccagtaa

SEQ ID NO: 305690 - DNA, 20 bp, Artificial Sequence
  chemically synthesized
atacccagcaaggccgttac

SEQ ID NO: 305691 - DNA, 20 bp, Artificial Sequence
  chemically synthesized
atatccagtaacggccttgc

SEQ ID NO: 305692 - DNA, 20 bp, Artificial Sequence
  chemically synthesized
tatccagtaacggccttgct

SEQ ID NO: 305693 - DNA, 20 bp, Artificial Sequence
  chemically synthesized
agaaccagaaatacccagca

SEQ ID NO: 305694 - DNA, 20 bp, Artificial Sequence
  chemically synthesized
tagaaccagaaatacccagc

SEQ ID NO: 305695 - DNA, 20 bp, Artificial Sequence
  chemically synthesized
gaactagaaccagaaatacc

SEQ ID NO: 305696 - DNA, 20 bp, Artificial Sequence
  chemically synthesized
acggccttgctgggtatttc

SEQ ID NO: 305697 - DNA, 20 bp, Artificial Sequence
  chemically synthesized
ttgctgggtatttctggttc

SEQ ID NO: 305698 - DNA, 20 bp, Artificial Sequence
  chemically synthesized
gttcctcaaagaactagaac

SEQ ID NO: 305699 - DNA, 20 bp, Artificial Sequence
  chemically synthesized
atttctggttctagttcttt

SEQ ID NO: 305700 - DNA, 20 bp, Artificial Sequence
  chemically synthesized
gtggtggttcctcaaagaac

SEQ ID NO: 305701 - DNA, 20 bp, Artificial Sequence
  chemically synthesized
tttctggttctagttctttg

SEQ ID NO: 305702 - DNA, 20 bp, Artificial Sequence
  chemically synthesized
gacagtgtggtggttcctca

SEQ ID NO: 305703 - DNA, 20 bp, Artificial Sequence
  chemically synthesized
cattgtggaagacagtgtgg

SEQ ID NO: 305704 - DNA, 20 bp, Artificial Sequence
  chemically synthesized
atccattgtggaagacagtg

SEQ ID NO: 305705 - DNA, 20 bp, Artificial Sequence
  chemically synthesized
agtttatccattgtggaaga

SEQ ID NO: 305706 - DNA, 20 bp, Artificial Sequence
  chemically synthesized
caccacactgtcttccacaa

SEQ ID NO: 305707 - DNA, 20 bp, Artificial Sequence
  chemically synthesized
aattagtttatccattgtgg

SEQ ID NO: 305708 - DNA, 20 bp, Artificial Sequence
  chemically synthesized
gtaaattagtttatccattg

SEQ ID NO: 305709 - DNA, 20 bp, Artificial Sequence
  chemically synthesized
ctgttggtgggaatgtaaat

SEQ ID NO: 305710 - DNA, 20 bp, Artificial Sequence
  chemically synthesized
ctaatttacattcccaccaa

SEQ ID NO: 305711 - DNA, 20 bp, Artificial Sequence
  chemically synthesized
aatgcttttacactgttggt

SEQ ID NO: 305712 - DNA, 20 bp, Artificial Sequence
  chemically synthesized
gaatgcttttacactgttgg

SEQ ID NO: 305713 - DNA, 20 bp, Artificial Sequence
  chemically synthesized
tgggaatgcttttacactgt

SEQ ID NO: 305714 - DNA, 20 bp, Artificial Sequence
  chemically synthesized
cattcccaccaacagtgtaa

SEQ ID NO: 305715 - DNA, 20 bp, Artificial Sequence
  chemically synthesized
tggcatggtttcagagaaat

SEQ ID NO: 305716 - DNA, 20 bp, Artificial Sequence
  chemically synthesized
ctggcatggtttcagagaaa

SEQ ID NO: 305717 - DNA, 20 bp, Artificial Sequence
  chemically synthesized
cagacgctggcatggtttca

SEQ ID NO: 305718 - DNA, 20 bp, Artificial Sequence
  chemically synthesized
aacagacgctggcatggttt

SEQ ID NO: 305719 - DNA, 20 bp, Artificial Sequence
  chemically synthesized
ccatttctctgaaaccatgc

SEQ ID NO: 305720 - DNA, 20 bp, Artificial Sequence
  chemically synthesized
agatacaacagacgctggca

SEQ ID NO: 305721 - DNA, 20 bp, Artificial Sequence
  chemically synthesized
agtcaagatacaacagacgc

SEQ ID NO: 305722 - DNA, 20 bp, Artificial Sequence
  chemically synthesized
tttaaaaagtcaagatacaa

SEQ ID NO: 305723 - DNA, 20 bp, Artificial Sequence
  chemically synthesized
atggtgatttttaaaaagtc

SEQ ID NO: 305724 - DNA, 20 bp, Artificial Sequence
  chemically synthesized
acagaatggtgatttttaaa

SEQ ID NO: 305725 - DNA, 20 bp, Artificial Sequence
  chemically synthesized
ttaaaaatcaccattctgtc

SEQ ID NO: 305726 - DNA, 20 bp, Artificial Sequence
  chemically synthesized
ccatctcacgccagacagaa

SEQ ID NO: 305727 - DNA, 20 bp, Artificial Sequence
  chemically synthesized
gcacaccatctcacgccaga

SEQ ID NO: 305728 - DNA, 20 bp, Artificial Sequence
  chemically synthesized
atcaccattctgtctggcgt

SEQ ID NO: 305729 - DNA, 20 bp, Artificial Sequence
  chemically synthesized
ctcagcacaccatctcacgc

SEQ ID NO: 305730 - DNA, 20 bp, Artificial Sequence
  chemically synthesized
ccattctgtctggcgtgaga

SEQ ID NO: 305731 - DNA, 20 bp, Artificial Sequence
  chemically synthesized
ctggcgtgagatggtgtgct

SEQ ID NO: 305732 - DNA, 20 bp, Artificial Sequence
  chemically synthesized
tggcgtgagatggtgtgctg

SEQ ID NO: 305733 - DNA, 20 bp, Artificial Sequence
  chemically synthesized
caattcatccatattagcct

SEQ ID NO: 305734 - DNA, 20 bp, Artificial Sequence
  chemically synthesized
atggtgtgctgaggctaata

SEQ ID NO: 305735 - DNA, 20 bp, Artificial Sequence
  chemically synthesized
ttctctcaattcatccatat

SEQ ID NO: 305736 - DNA, 20 bp, Artificial Sequence
  chemically synthesized
gaggctaatatggatgaatt

SEQ ID NO: 305737 - DNA, 20 bp, Artificial Sequence
  chemically synthesized
ggctaatatggatgaattga

SEQ ID NO: 305738 - DNA, 20 bp, Artificial Sequence
  chemically synthesized
taatatggatgaattgagag

SEQ ID NO: 305739 - DNA, 20 bp, Artificial Sequence
  chemically synthesized
tatggatgaattgagagaag

SEQ ID NO: 305740 - DNA, 20 bp, Artificial Sequence
  chemically synthesized
atggatgaattgagagaagt

SEQ ID NO: 305741 - DNA, 20 bp, Artificial Sequence
  chemically synthesized
attgagagaagtaggcttca

SEQ ID NO: 305742 - DNA, 20 bp, Artificial Sequence
  chemically synthesized
ttgagagaagtaggcttcaa

SEQ ID NO: 305743 - DNA, 20 bp, Artificial Sequence
  chemically synthesized
agagaagtaggcttcaaagg

SEQ ID NO: 305744 - DNA, 20 bp, Artificial Sequence
  chemically synthesized
tttgttattatccacctttg

SEQ ID NO: 305745 - DNA, 20 bp, Artificial Sequence
  chemically synthesized
ggataataacaaacttccct

SEQ ID NO: 305746 - DNA, 20 bp, Artificial Sequence
  chemically synthesized
cattctcctctagctcaggg

SEQ ID NO: 305747 - DNA, 20 bp, Artificial Sequence
  chemically synthesized
aataacaaacttccctgagc

SEQ ID NO: 305748 - DNA, 20 bp, Artificial Sequence
  chemically synthesized
taacaaacttccctgagcta

SEQ ID NO: 305749 - DNA, 20 bp, Artificial Sequence
  chemically synthesized
gaacattctcctctagctca

SEQ ID NO: 305750 - DNA, 20 bp, Artificial Sequence
  chemically synthesized
aacaaacttccctgagctag

SEQ ID NO: 305751 - DNA, 20 bp, Artificial Sequence
  chemically synthesized
agaacattctcctctagctc

SEQ ID NO: 305752 - DNA, 20 bp, Artificial Sequence
  chemically synthesized
tagaacattctcctctagct

SEQ ID NO: 305753 - DNA, 20 bp, Artificial Sequence
  chemically synthesized
caaacttccctgagctagag

SEQ ID NO: 305754 - DNA, 20 bp, Artificial Sequence
  chemically synthesized
tgggttagaacattctcctc

SEQ ID NO: 305755 - DNA, 20 bp, Artificial Sequence
  chemically synthesized
ttagcttgtttgcattgggt

SEQ ID NO: 305756 - DNA, 20 bp, Artificial Sequence
  chemically synthesized
gttgttagcttgtttgcatt

SEQ ID NO: 305757 - DNA, 20 bp, Artificial Sequence
  chemically synthesized
ggttgttagcttgtttgcat

SEQ ID NO: 305758 - DNA, 20 bp, Artificial Sequence
  chemically synthesized
tgttctaacccaatgcaaac

SEQ ID NO: 305759 - DNA, 20 bp, Artificial Sequence
  chemically synthesized
ttacgttttatcgtggttgt

SEQ ID NO: 305760 - DNA, 20 bp, Artificial Sequence
  chemically synthesized
gctcctgttacgttttatcg

SEQ ID NO: 305761 - DNA, 20 bp, Artificial Sequence
  chemically synthesized
acaaccacgataaaacgtaa

SEQ ID NO: 305762 - DNA, 20 bp, Artificial Sequence
  chemically synthesized
caaccacgataaaacgtaac

SEQ ID NO: 305763 - DNA, 20 bp, Artificial Sequence
  chemically synthesized
accacgataaaacgtaacag

SEQ ID NO: 305764 - DNA, 20 bp, Artificial Sequence
  chemically synthesized
acgataaaacgtaacaggag

SEQ ID NO: 305765 - DNA, 20 bp, Artificial Sequence
  chemically synthesized
acgtaacaggagcggataac

SEQ ID NO: 305766 - DNA, 20 bp, Artificial Sequence
  chemically synthesized
gagcggataaccagaataac

SEQ ID NO: 305767 - DNA, 20 bp, Artificial Sequence
  chemically synthesized
cctctgtaaactggttattc

SEQ ID NO: 305768 - DNA, 20 bp, Artificial Sequence
  chemically synthesized
taaccagaataaccagttta

SEQ ID NO: 305769 - DNA, 20 bp, Artificial Sequence
  chemically synthesized
accagaataaccagtttaca

SEQ ID NO: 305770 - DNA, 20 bp, Artificial Sequence
  chemically synthesized
attcatgttcctctgtaaac

SEQ ID NO: 305771 - DNA, 20 bp, Artificial Sequence
  chemically synthesized
ccagaataaccagtttacag

SEQ ID NO: 305772 - DNA, 20 bp, Artificial Sequence
  chemically synthesized
gaggaacatgaatgacctga

SEQ ID NO: 305773 - DNA, 20 bp, Artificial Sequence
  chemically synthesized
ggaacatgaatgacctgata

SEQ ID NO: 305774 - DNA, 20 bp, Artificial Sequence
  chemically synthesized
ttgcgtttctcagctctatc

SEQ ID NO: 305775 - DNA, 20 bp, Artificial Sequence
  chemically synthesized
attgcgtttctcagctctat

SEQ ID NO: 305776 - DNA, 20 bp, Artificial Sequence
  chemically synthesized
atgaatgacctgatagagct

SEQ ID NO: 305777 - DNA, 20 bp, Artificial Sequence
  chemically synthesized
agttgtcgtattgcgtttct

SEQ ID NO: 305778 - DNA, 20 bp, Artificial Sequence
  chemically synthesized
gacaatgtgatttcattgtg

SEQ ID NO: 305779 - DNA, 20 bp, Artificial Sequence
  chemically synthesized
ttgacaatgtgatttcattg

SEQ ID NO: 305780 - DNA, 20 bp, Artificial Sequence
  chemically synthesized
tcacattgtcaatacctgaa

SEQ ID NO: 305781 - DNA, 20 bp, Artificial Sequence
  chemically synthesized
ttcctctgcttggtctattc

SEQ ID NO: 305782 - DNA, 20 bp, Artificial Sequence
  chemically synthesized
tttcctctgcttggtctatt

SEQ ID NO: 305783 - DNA, 20 bp, Artificial Sequence
  chemically synthesized
tgtcaatacctgaatagacc

SEQ ID NO: 305784 - DNA, 20 bp, Artificial Sequence
  chemically synthesized
caatacctgaatagaccaag

SEQ ID NO: 305785 - DNA, 20 bp, Artificial Sequence
  chemically synthesized
atacctgaatagaccaagca

SEQ ID NO: 305786 - DNA, 20 bp, Artificial Sequence
  chemically synthesized
tacctgaatagaccaagcag

SEQ ID NO: 305787 - DNA, 20 bp, Artificial Sequence
  chemically synthesized
ctgagattctttcctctgct

SEQ ID NO: 305788 - DNA, 20 bp, Artificial Sequence
  chemically synthesized
tgaatagaccaagcagagga

SEQ ID NO: 305789 - DNA, 20 bp, Artificial Sequence
  chemically synthesized
ccaagcagaggaaagaatct

SEQ ID NO: 305790 - DNA, 20 bp, Artificial Sequence
  chemically synthesized
aagcagaggaaagaatctca

SEQ ID NO: 305791 - DNA, 20 bp, Artificial Sequence
  chemically synthesized
caagatagtcttcaagctct

SEQ ID NO: 305792 - DNA, 20 bp, Artificial Sequence
  chemically synthesized
ggaaagaatctcagagcttg

SEQ ID NO: 305793 - DNA, 20 bp, Artificial Sequence
  chemically synthesized
atttcagcaagatagtcttc

SEQ ID NO: 305794 - DNA, 20 bp, Artificial Sequence
  chemically synthesized
cctgtcttatttcagcaaga

SEQ ID NO: 305795 - DNA, 20 bp, Artificial Sequence
  chemically synthesized
tctgcctgtcttatttcagc

SEQ ID NO: 305796 - DNA, 20 bp, Artificial Sequence
  chemically synthesized
gaagactatcttgctgaaat

SEQ ID NO: 305797 - DNA, 20 bp, Artificial Sequence
  chemically synthesized
cttttctgcctgtcttattt

SEQ ID NO: 305798 - DNA, 20 bp, Artificial Sequence
  chemically synthesized
actatcttgctgaaataaga

SEQ ID NO: 305799 - DNA, 20 bp, Artificial Sequence
  chemically synthesized
ctatcttgctgaaataagac

SEQ ID NO: 305800 - DNA, 20 bp, Artificial Sequence
  chemically synthesized
tcttgctgaaataagacagg

SEQ ID NO: 305801 - DNA, 20 bp, Artificial Sequence
  chemically synthesized
ctgaaataagacaggcagaa

SEQ ID NO: 305802 - DNA, 20 bp, Artificial Sequence
  chemically synthesized
ataagacaggcagaaaagat

SEQ ID NO: 305803 - DNA, 20 bp, Artificial Sequence
  chemically synthesized
aagacaggcagaaaagatta

SEQ ID NO: 305804 - DNA, 20 bp, Artificial Sequence
  chemically synthesized
ggcagaaaagattagagaaa

SEQ ID NO: 305805 - DNA, 20 bp, Artificial Sequence
  chemically synthesized
aaaagattagagaaaaagaa

SEQ ID NO: 305806 - DNA, 20 bp, Artificial Sequence
  chemically synthesized
tacaaaacgtctgacaaatg

SEQ ID NO: 305807 - DNA, 20 bp, Artificial Sequence
  chemically synthesized
ttacataatcccacatttgt

SEQ ID NO: 305808 - DNA, 20 bp, Artificial Sequence
  chemically synthesized
acaaaacgtctgacaaatgt

SEQ ID NO: 305809 - DNA, 20 bp, Artificial Sequence
  chemically synthesized
gtgggattatgtaaattctg

SEQ ID NO: 305810 - DNA, 20 bp, Artificial Sequence
  chemically synthesized
attatgtaaattctgaagca

SEQ ID NO: 305811 - DNA, 20 bp, Artificial Sequence
  chemically synthesized
tccccaaacagtctttgctt

SEQ ID NO: 305812 - DNA, 20 bp, Artificial Sequence
  chemically synthesized
attctgaagcaaagactgtt

SEQ ID NO: 305813 - DNA, 20 bp, Artificial Sequence
  chemically synthesized
ttctgaagcaaagactgttt

SEQ ID NO: 305814 - DNA, 20 bp, Artificial Sequence
  chemically synthesized
tctgaagcaaagactgtttg

SEQ ID NO: 305815 - DNA, 20 bp, Artificial Sequence
  chemically synthesized
tctctttcaggttccccaaa

SEQ ID NO: 305816 - DNA, 20 bp, Artificial Sequence
  chemically synthesized
agactgtttggggaacctga

SEQ ID NO: 305817 - DNA, 20 bp, Artificial Sequence
  chemically synthesized
actgtttggggaacctgaaa

SEQ ID NO: 305818 - DNA, 20 bp, Artificial Sequence
  chemically synthesized
ccgttctccccgtctctttc

SEQ ID NO: 305819 - DNA, 20 bp, Artificial Sequence
  chemically synthesized
tttggggaacctgaaagaga

SEQ ID NO: 305820 - DNA, 20 bp, Artificial Sequence
  chemically synthesized
tccgttctccccgtctcttt

SEQ ID NO: 305821 - DNA, 20 bp, Artificial Sequence
  chemically synthesized
ttggggaacctgaaagagac

SEQ ID NO: 305822 - DNA, 20 bp, Artificial Sequence
  chemically synthesized
tggggaacctgaaagagacg

SEQ ID NO: 305823 - DNA, 20 bp, Artificial Sequence
  chemically synthesized
gggaacctgaaagagacggg

SEQ ID NO: 305824 - DNA, 20 bp, Artificial Sequence
  chemically synthesized
cctgaaagagacggggagaa

SEQ ID NO: 305825 - DNA, 20 bp, Artificial Sequence
  chemically synthesized
gagacggggagaacggaacc

SEQ ID NO: 305826 - DNA, 20 bp, Artificial Sequence
  chemically synthesized
cggggagaacggaaccaagt

SEQ ID NO: 305827 - DNA, 20 bp, Artificial Sequence
  chemically synthesized
ctgaagtgtgatttccaact

SEQ ID NO: 305828 - DNA, 20 bp, Artificial Sequence
  chemically synthesized
ccaagttggaaatcacactt

SEQ ID NO: 305829 - DNA, 20 bp, Artificial Sequence
  chemically synthesized
caagttggaaatcacacttc

SEQ ID NO: 305830 - DNA, 20 bp, Artificial Sequence
  chemically synthesized
ttctcctggatgatatcctg

SEQ ID NO: 305831 - DNA, 20 bp, Artificial Sequence
  chemically synthesized
tcacacttcaggatatcatc

SEQ ID NO: 305832 - DNA, 20 bp, Artificial Sequence
  chemically synthesized
cacacttcaggatatcatcc

SEQ ID NO: 305833 - DNA, 20 bp, Artificial Sequence
  chemically synthesized
cacttcaggatatcatccag

SEQ ID NO: 305834 - DNA, 20 bp, Artificial Sequence
  chemically synthesized
ctagattggagaagttctcc

SEQ ID NO: 305835 - DNA, 20 bp, Artificial Sequence
  chemically synthesized
gctggctttctagattggag

SEQ ID NO: 305836 - DNA, 20 bp, Artificial Sequence
  chemically synthesized
ccaggagaacttctccaatc

SEQ ID NO: 305837 - DNA, 20 bp, Artificial Sequence
  chemically synthesized
ttggctggctttctagattg

SEQ ID NO: 305838 - DNA, 20 bp, Artificial Sequence
  chemically synthesized
gagaacttctccaatctaga

SEQ ID NO: 305839 - DNA, 20 bp, Artificial Sequence
  chemically synthesized
gtttggctggctttctagat

SEQ ID NO: 305840 - DNA, 20 bp, Artificial Sequence
  chemically synthesized
acttctccaatctagaaagc

SEQ ID NO: 305841 - DNA, 20 bp, Artificial Sequence
  chemically synthesized
tgaatgtttggctggctttc

SEQ ID NO: 305842 - DNA, 20 bp, Artificial Sequence
  chemically synthesized
cctgaatttgaatgtttggc

SEQ ID NO: 305843 - DNA, 20 bp, Artificial Sequence
  chemically synthesized
atttcctgaatttgaatgtt

SEQ ID NO: 305844 - DNA, 20 bp, Artificial Sequence
  chemically synthesized
gccagccaaacattcaaatt

SEQ ID NO: 305845 - DNA, 20 bp, Artificial Sequence
  chemically synthesized
ccagccaaacattcaaattc

SEQ ID NO: 305846 - DNA, 20 bp, Artificial Sequence
  chemically synthesized
cattcaaattcaggaaatac

SEQ ID NO: 305847 - DNA, 20 bp, Artificial Sequence
  chemically synthesized
ggaaatacaagatactcact

SEQ ID NO: 305848 - DNA, 20 bp, Artificial Sequence
  chemically synthesized
aatacaagatactcactgag

SEQ ID NO: 305849 - DNA, 20 bp, Artificial Sequence
  chemically synthesized
tgggctggcttctgctcagt

SEQ ID NO: 305850 - DNA, 20 bp, Artificial Sequence
  chemically synthesized
acaagatactcactgagcag

SEQ ID NO: 305851 - DNA, 20 bp, Artificial Sequence
  chemically synthesized
atgttgggctggcttctgct

SEQ ID NO: 305852 - DNA, 20 bp, Artificial Sequence
  chemically synthesized
gatactcactgagcagaagc

SEQ ID NO: 305853 - DNA, 20 bp, Artificial Sequence
  chemically synthesized
cctgaatttgaatgttgggc

SEQ ID NO: 305854 - DNA, 20 bp, Artificial Sequence
  chemically synthesized
attccctgaatttgaatgtt

SEQ ID NO: 305855 - DNA, 20 bp, Artificial Sequence
  chemically synthesized
cattccctgaatttgaatgt

SEQ ID NO: 305856 - DNA, 20 bp, Artificial Sequence
  chemically synthesized
gccagcccaacattcaaatt

SEQ ID NO: 305857 - DNA, 20 bp, Artificial Sequence
  chemically synthesized
ccagcccaacattcaaattc

SEQ ID NO: 305858 - DNA, 20 bp, Artificial Sequence
  chemically synthesized
cagcccaacattcaaattca

SEQ ID NO: 305859 - DNA, 20 bp, Artificial Sequence
  chemically synthesized
cattcaaattcagggaatgc

SEQ ID NO: 305860 - DNA, 20 bp, Artificial Sequence
  chemically synthesized
ttcagggaatgcaagatact

SEQ ID NO: 305861 - DNA, 20 bp, Artificial Sequence
  chemically synthesized
agggaatgcaagatactgag

SEQ ID NO: 305862 - DNA, 20 bp, Artificial Sequence
  chemically synthesized
tatgttggggttggtctgct

SEQ ID NO: 305863 - DNA, 20 bp, Artificial Sequence
  chemically synthesized
atgattacgtatgttggggt

SEQ ID NO: 305864 - DNA, 20 bp, Artificial Sequence
  chemically synthesized
ttgtatgattacgtatgttg

SEQ ID NO: 305865 - DNA, 20 bp, Artificial Sequence
  chemically synthesized
attgtatgattacgtatgtt

SEQ ID NO: 305866 - DNA, 20 bp, Artificial Sequence
  chemically synthesized
aattgtatgattacgtatgt

SEQ ID NO: 305867 - DNA, 20 bp, Artificial Sequence
  chemically synthesized
tacgtaatcatacaattctc

SEQ ID NO: 305868 - DNA, 20 bp, Artificial Sequence
  chemically synthesized
acgtaatcatacaattctcc

SEQ ID NO: 305869 - DNA, 20 bp, Artificial Sequence
  chemically synthesized
ttttctttcatttaaacctg

SEQ ID NO: 305870 - DNA, 20 bp, Artificial Sequence
  chemically synthesized
ttttttctttcatttaaacc

SEQ ID NO: 305871 - DNA, 20 bp, Artificial Sequence
  chemically synthesized
aattctccaggtttaaatga

SEQ ID NO: 305872 - DNA, 20 bp, Artificial Sequence
  chemically synthesized
taaatgaaagaaaaaatgtt

SEQ ID NO: 305873 - DNA, 20 bp, Artificial Sequence
  chemically synthesized
aaatgaaagaaaaaatgtta

SEQ ID NO: 305874 - DNA, 20 bp, Artificial Sequence
  chemically synthesized
gaaagaaaaaatgttaagga

SEQ ID NO: 305875 - DNA, 20 bp, Artificial Sequence
  chemically synthesized
gaaaaaatgttaaggacagc

SEQ ID NO: 305876 - DNA, 20 bp, Artificial Sequence
  chemically synthesized
aaaaatgttaaggacagcca

SEQ ID NO: 305877 - DNA, 20 bp, Artificial Sequence
  chemically synthesized
aaatgttaaggacagccaga

SEQ ID NO: 305878 - DNA, 20 bp, Artificial Sequence
  chemically synthesized
gttaaggacagccagagaga

SEQ ID NO: 305879 - DNA, 20 bp, Artificial Sequence
  chemically synthesized
ttaaggacagccagagagaa

SEQ ID NO: 305880 - DNA, 20 bp, Artificial Sequence
  chemically synthesized
ggtaacctggcctttctctc

SEQ ID NO: 305881 - DNA, 20 bp, Artificial Sequence
  chemically synthesized
ggacagccagagagaaaggc

SEQ ID NO: 305882 - DNA, 20 bp, Artificial Sequence
  chemically synthesized
gacagccagagagaaaggcc

SEQ ID NO: 305883 - DNA, 20 bp, Artificial Sequence
  chemically synthesized
gcttccctttgtaggtaacc

SEQ ID NO: 305884 - DNA, 20 bp, Artificial Sequence
  chemically synthesized
gaaaggccaggttacctaca

SEQ ID NO: 305885 - DNA, 20 bp, Artificial Sequence
  chemically synthesized
aaaggccaggttacctacaa

SEQ ID NO: 305886 - DNA, 20 bp, Artificial Sequence
  chemically synthesized
aaggccaggttacctacaaa

SEQ ID NO: 305887 - DNA, 20 bp, Artificial Sequence
  chemically synthesized
cctgatgggcttccctttgt

SEQ ID NO: 305888 - DNA, 20 bp, Artificial Sequence
  chemically synthesized
gccaggttacctacaaaggg

SEQ ID NO: 305889 - DNA, 20 bp, Artificial Sequence
  chemically synthesized
ccctgatgggcttccctttg

SEQ ID NO: 305890 - DNA, 20 bp, Artificial Sequence
  chemically synthesized
acctacaaagggaagcccat

SEQ ID NO: 305891 - DNA, 20 bp, Artificial Sequence
  chemically synthesized
cctacaaagggaagcccatc

SEQ ID NO: 305892 - DNA, 20 bp, Artificial Sequence
  chemically synthesized
ctacaaagggaagcccatca

SEQ ID NO: 305893 - DNA, 20 bp, Artificial Sequence
  chemically synthesized
agatctgctgttaccctgat

SEQ ID NO: 305894 - DNA, 20 bp, Artificial Sequence
  chemically synthesized
gagatctgctgttaccctga

SEQ ID NO: 305895 - DNA, 20 bp, Artificial Sequence
  chemically synthesized
agggaagcccatcagggtaa

SEQ ID NO: 305896 - DNA, 20 bp, Artificial Sequence
  chemically synthesized
gaagcccatcagggtaacag

SEQ ID NO: 305897 - DNA, 20 bp, Artificial Sequence
  chemically synthesized
cagggtaacagcagatctct

SEQ ID NO: 305898 - DNA, 20 bp, Artificial Sequence
  chemically synthesized
ggtaacagcagatctctcag

SEQ ID NO: 305899 - DNA, 20 bp, Artificial Sequence
  chemically synthesized
gcttatagggtttctgctga

SEQ ID NO: 305900 - DNA, 20 bp, Artificial Sequence
  chemically synthesized
tggcttatagggtttctgct

SEQ ID NO: 305901 - DNA, 20 bp, Artificial Sequence
  chemically synthesized
tctctcagcagaaaccctat

SEQ ID NO: 305902 - DNA, 20 bp, Artificial Sequence
  chemically synthesized
tcagcagaaaccctataagc

SEQ ID NO: 305903 - DNA, 20 bp, Artificial Sequence
  chemically synthesized
ccaatctctactggcttata

SEQ ID NO: 305904 - DNA, 20 bp, Artificial Sequence
  chemically synthesized
cccaatctctactggcttat

SEQ ID NO: 305905 - DNA, 20 bp, Artificial Sequence
  chemically synthesized
ccccaatctctactggctta

SEQ ID NO: 305906 - DNA, 20 bp, Artificial Sequence
  chemically synthesized
gcagaaaccctataagccag

SEQ ID NO: 305907 - DNA, 20 bp, Artificial Sequence
  chemically synthesized
agaaaccctataagccagta

SEQ ID NO: 305908 - DNA, 20 bp, Artificial Sequence
  chemically synthesized
tattagcccccaatctctac

SEQ ID NO: 305909 - DNA, 20 bp, Artificial Sequence
  chemically synthesized
ccctataagccagtagagat

SEQ ID NO: 305910 - DNA, 20 bp, Artificial Sequence
  chemically synthesized
cctataagccagtagagatt

SEQ ID NO: 305911 - DNA, 20 bp, Artificial Sequence
  chemically synthesized
ctataagccagtagagattg

SEQ ID NO: 305912 - DNA, 20 bp, Artificial Sequence
  chemically synthesized
tataagccagtagagattgg

SEQ ID NO: 305913 - DNA, 20 bp, Artificial Sequence
  chemically synthesized
tctttcacggtgttgaatat

SEQ ID NO: 305914 - DNA, 20 bp, Artificial Sequence
  chemically synthesized
gctaatattcaacaccgtga

SEQ ID NO: 305915 - DNA, 20 bp, Artificial Sequence
  chemically synthesized
ttggaaattcttttctttca

SEQ ID NO: 305916 - DNA, 20 bp, Artificial Sequence
  chemically synthesized
tattcaacaccgtgaaagaa

SEQ ID NO: 305917 - DNA, 20 bp, Artificial Sequence
  chemically synthesized
cgtgaaagaaaagaatttcc

SEQ ID NO: 305918 - DNA, 20 bp, Artificial Sequence
  chemically synthesized
gtgaaagaaaagaatttcca

SEQ ID NO: 305919 - DNA, 20 bp, Artificial Sequence
  chemically synthesized
aaagaaaagaatttccaagg

SEQ ID NO: 305920 - DNA, 20 bp, Artificial Sequence
  chemically synthesized
ctggatatgaaattctgcct

SEQ ID NO: 305921 - DNA, 20 bp, Artificial Sequence
  chemically synthesized
ccaaggcagaatttcatatc

SEQ ID NO: 305922 - DNA, 20 bp, Artificial Sequence
  chemically synthesized
cagaatttcatatccagaca

SEQ ID NO: 305923 - DNA, 20 bp, Artificial Sequence
  chemically synthesized
cttatgaagcttactttgtc

SEQ ID NO: 305924 - DNA, 20 bp, Artificial Sequence
  chemically synthesized
atttcatatccagacaaagt

SEQ ID NO: 305925 - DNA, 20 bp, Artificial Sequence
  chemically synthesized
ccagacaaagtaagcttcat

SEQ ID NO: 305926 - DNA, 20 bp, Artificial Sequence
  chemically synthesized
ttattcttccttcacttatg

SEQ ID NO: 305927 - DNA, 20 bp, Artificial Sequence
  chemically synthesized
caaagtaagcttcataagtg

SEQ ID NO: 305928 - DNA, 20 bp, Artificial Sequence
  chemically synthesized
aaagtaagcttcataagtga

SEQ ID NO: 305929 - DNA, 20 bp, Artificial Sequence
  chemically synthesized
gtaagcttcataagtgaagg

SEQ ID NO: 305930 - DNA, 20 bp, Artificial Sequence
  chemically synthesized
aggaagaataaaatcttttc

SEQ ID NO: 305931 - DNA, 20 bp, Artificial Sequence
  chemically synthesized
caacatttgcttgtctggaa

SEQ ID NO: 305932 - DNA, 20 bp, Artificial Sequence
  chemically synthesized
gaataaaatcttttccagac

SEQ ID NO: 305933 - DNA, 20 bp, Artificial Sequence
  chemically synthesized
tccatcaacatttgcttgtc

SEQ ID NO: 305934 - DNA, 20 bp, Artificial Sequence
  chemically synthesized
tccagacaagcaaatgttga

SEQ ID NO: 305935 - DNA, 20 bp, Artificial Sequence
  chemically synthesized
atcataattatgaaatacga

SEQ ID NO: 305936 - DNA, 20 bp, Artificial Sequence
  chemically synthesized
cgtatttcataattatgatc

SEQ ID NO: 305937 - DNA, 20 bp, Artificial Sequence
  chemically synthesized
aagataaaatatatatcgat

SEQ ID NO: 305938 - DNA, 20 bp, Artificial Sequence
  chemically synthesized
agataaaatatatatcgatc

SEQ ID NO: 305939 - DNA, 20 bp, Artificial Sequence
  chemically synthesized
gataaaatatatatcgatca

SEQ ID NO: 305940 - DNA, 20 bp, Artificial Sequence
  chemically synthesized
aatatatatcgatcagggcc

SEQ ID NO: 305941 - DNA, 20 bp, Artificial Sequence
  chemically synthesized
atatatatcgatcagggcca

SEQ ID NO: 305942 - DNA, 20 bp, Artificial Sequence
  chemically synthesized
tcgatcagggccaaggcaat

SEQ ID NO: 305943 - DNA, 20 bp, Artificial Sequence
  chemically synthesized
gcagttttttctaattgcct

SEQ ID NO: 305944 - DNA, 20 bp, Artificial Sequence
  chemically synthesized
aaacatacttgtaatttgtg

SEQ ID NO: 305945 - DNA, 20 bp, Artificial Sequence
  chemically synthesized
gaaaaaactgcacaaattac

SEQ ID NO: 305946 - DNA, 20 bp, Artificial Sequence
  chemically synthesized
agtatgtttataaaaaatta

SEQ ID NO: 305947 - DNA, 20 bp, Artificial Sequence
  chemically synthesized
gtatgtttataaaaaattac

SEQ ID NO: 305948 - DNA, 20 bp, Artificial Sequence
  chemically synthesized
tatgtttataaaaaattaca

SEQ ID NO: 305949 - DNA, 20 bp, Artificial Sequence
  chemically synthesized
acagggaatcatgatcattt

SEQ ID NO: 305950 - DNA, 20 bp, Artificial Sequence
  chemically synthesized
catgatcatttgagttttta

SEQ ID NO: 305951 - DNA, 20 bp, Artificial Sequence
  chemically synthesized
gatcatttgagtttttaaag

SEQ ID NO: 305952 - DNA, 20 bp, Artificial Sequence
  chemically synthesized
agtttttaaagaagtcaatc

SEQ ID NO: 305953 - DNA, 20 bp, Artificial Sequence
  chemically synthesized
gtttttaaagaagtcaatcc

SEQ ID NO: 305954 - DNA, 20 bp, Artificial Sequence
  chemically synthesized
tttttaaagaagtcaatcca

SEQ ID NO: 305955 - DNA, 20 bp, Artificial Sequence
  chemically synthesized
aaaagagggcaaatataccc

SEQ ID NO: 305956 - DNA, 20 bp, Artificial Sequence
  chemically synthesized
aggcttacaatgagaaaaga

SEQ ID NO: 305957 - DNA, 20 bp, Artificial Sequence
  chemically synthesized
gaggcttacaatgagaaaag

SEQ ID NO: 305958 - DNA, 20 bp, Artificial Sequence
  chemically synthesized
ggaggcttacaatgagaaaa

SEQ ID NO: 305959 - DNA, 20 bp, Artificial Sequence
  chemically synthesized
ctggaggcttacaatgagaa

SEQ ID NO: 305960 - DNA, 20 bp, Artificial Sequence
  chemically synthesized
ttgccctcttttctcattgt

SEQ ID NO: 305961 - DNA, 20 bp, Artificial Sequence
  chemically synthesized
gctatctggaggcttacaat

SEQ ID NO: 305962 - DNA, 20 bp, Artificial Sequence
  chemically synthesized
cttttctcattgtaagcctc

SEQ ID NO: 305963 - DNA, 20 bp, Artificial Sequence
  chemically synthesized
tctcattgtaagcctccaga

SEQ ID NO: 305964 - DNA, 20 bp, Artificial Sequence
  chemically synthesized
taataactcttgctatctgg

SEQ ID NO: 305965 - DNA, 20 bp, Artificial Sequence
  chemically synthesized
ataataactcttgctatctg

SEQ ID NO: 305966 - DNA, 20 bp, Artificial Sequence
  chemically synthesized
attgtaagcctccagatagc

SEQ ID NO: 305967 - DNA, 20 bp, Artificial Sequence
  chemically synthesized
agataataactcttgctatc

SEQ ID NO: 305968 - DNA, 20 bp, Artificial Sequence
  chemically synthesized
tgtaagcctccagatagcaa

SEQ ID NO: 305969 - DNA, 20 bp, Artificial Sequence
  chemically synthesized
ctttttttctaaatgttgga

SEQ ID NO: 305970 - DNA, 20 bp, Artificial Sequence
  chemically synthesized
gttattatctctccaacatt

SEQ ID NO: 305971 - DNA, 20 bp, Artificial Sequence
  chemically synthesized
tactttttttctaaatgttg

SEQ ID NO: 305972 - DNA, 20 bp, Artificial Sequence
  chemically synthesized
aatactttttttctaaatgt

SEQ ID NO: 305973 - DNA, 20 bp, Artificial Sequence
  chemically synthesized
ctctccaacatttagaaaaa

SEQ ID NO: 305974 - DNA, 20 bp, Artificial Sequence
  chemically synthesized
aaaagtattttctatcttct

SEQ ID NO: 305975 - DNA, 20 bp, Artificial Sequence
  chemically synthesized
aaagtattttctatcttctt

SEQ ID NO: 305976 - DNA, 20 bp, Artificial Sequence
  chemically synthesized
tagaaggtagcctaagaaga

SEQ ID NO: 305977 - DNA, 20 bp, Artificial Sequence
  chemically synthesized
tgattagaaggtagcctaag

SEQ ID NO: 305978 - DNA, 20 bp, Artificial Sequence
  chemically synthesized
agttgattagaaggtagcct

SEQ ID NO: 305979 - DNA, 20 bp, Artificial Sequence
  chemically synthesized
tatttaagttgattagaagg

SEQ ID NO: 305980 - DNA, 20 bp, Artificial Sequence
  chemically synthesized
gggtatttaagttgattaga

SEQ ID NO: 305981 - DNA, 20 bp, Artificial Sequence
  chemically synthesized
agggtatttaagttgattag

SEQ ID NO: 305982 - DNA, 20 bp, Artificial Sequence
  chemically synthesized
ctgagggtatttaagttgat

SEQ ID NO: 305983 - DNA, 20 bp, Artificial Sequence
  chemically synthesized
gacacaagctgagggtattt

SEQ ID NO: 305984 - DNA, 20 bp, Artificial Sequence
  chemically synthesized
ctaatcaacttaaataccct

SEQ ID NO: 305985 - DNA, 20 bp, Artificial Sequence
  chemically synthesized
aatacctggacacaagctga

SEQ ID NO: 305986 - DNA, 20 bp, Artificial Sequence
  chemically synthesized
taatacctggacacaagctg

SEQ ID NO: 305987 - DNA, 20 bp, Artificial Sequence
  chemically synthesized
ataatacctggacacaagct

SEQ ID NO: 305988 - DNA, 20 bp, Artificial Sequence
  chemically synthesized
aaataccctcagcttgtgtc

SEQ ID NO: 305989 - DNA, 20 bp, Artificial Sequence
  chemically synthesized
aataccctcagcttgtgtcc

SEQ ID NO: 305990 - DNA, 20 bp, Artificial Sequence
  chemically synthesized
cttgaataatacctggacac

SEQ ID NO: 305991 - DNA, 20 bp, Artificial Sequence
  chemically synthesized
gatttgacttgaataatacc

SEQ ID NO: 305992 - DNA, 20 bp, Artificial Sequence
  chemically synthesized
cttgtgtccaggtattattc

SEQ ID NO: 305993 - DNA, 20 bp, Artificial Sequence
  chemically synthesized
gtattattcaagtcaaatct

SEQ ID NO: 305994 - DNA, 20 bp, Artificial Sequence
  chemically synthesized
gctctcttgcatttcaaact

SEQ ID NO: 305995 - DNA, 20 bp, Artificial Sequence
  chemically synthesized
caaatctgagtttgaaatgc

SEQ ID NO: 305996 - DNA, 20 bp, Artificial Sequence
  chemically synthesized
aatctgagtttgaaatgcaa

SEQ ID NO: 305997 - DNA, 20 bp, Artificial Sequence
  chemically synthesized
tctgagtttgaaatgcaaga

SEQ ID NO: 305998 - DNA, 20 bp, Artificial Sequence
  chemically synthesized
gagtttgaaatgcaagagag

SEQ ID NO: 305999 - DNA, 20 bp, Artificial Sequence
  chemically synthesized
atgcaagagagcagtcctcc

SEQ ID NO: 306000 - DNA, 20 bp, Artificial Sequence
  chemically synthesized
tgaaaaaataatcagctagg

SEQ ID NO: 306001 - DNA, 20 bp, Artificial Sequence
  chemically synthesized
gtgaaaaaataatcagctag

SEQ ID NO: 306002 - DNA, 20 bp, Artificial Sequence
  chemically synthesized
acgtgaaaaaataatcagct

SEQ ID NO: 306003 - DNA, 20 bp, Artificial Sequence
  chemically synthesized
aacgtgaaaaaataatcagc

SEQ ID NO: 306004 - DNA, 20 bp, Artificial Sequence
  chemically synthesized
tcaaaacgtgaaaaaataat

SEQ ID NO: 306005 - DNA, 20 bp, Artificial Sequence
  chemically synthesized
ttgaagcagttgcatggcaa

SEQ ID NO: 306006 - DNA, 20 bp, Artificial Sequence
  chemically synthesized
ttttgaagcagttgcatggc

SEQ ID NO: 306007 - DNA, 20 bp, Artificial Sequence
  chemically synthesized
gaccttttgaagcagttgca

SEQ ID NO: 306008 - DNA, 20 bp, Artificial Sequence
  chemically synthesized
ttgccatgcaactgcttcaa

SEQ ID NO: 306009 - DNA, 20 bp, Artificial Sequence
  chemically synthesized
tgccatgcaactgcttcaaa

SEQ ID NO: 306010 - DNA, 20 bp, Artificial Sequence
  chemically synthesized
gcatttttgaccttttgaag

SEQ ID NO: 306011 - DNA, 20 bp, Artificial Sequence
  chemically synthesized
gaggcatttttgaccttttg

SEQ ID NO: 306012 - DNA, 20 bp, Artificial Sequence
  chemically synthesized
aaaaggtcaaaaatgcctca

SEQ ID NO: 306013 - DNA, 20 bp, Artificial Sequence
  chemically synthesized
ctgttcaggtcagagctttg

SEQ ID NO: 306014 - DNA, 20 bp, Artificial Sequence
  chemically synthesized
gctgttcaggtcagagcttt

SEQ ID NO: 306015 - DNA, 20 bp, Artificial Sequence
  chemically synthesized
tatgattgctgttcaggtca

SEQ ID NO: 306016 - DNA, 20 bp, Artificial Sequence
  chemically synthesized
cctcaaagctctgacctgaa

SEQ ID NO: 306017 - DNA, 20 bp, Artificial Sequence
  chemically synthesized
cgtatgattgctgttcaggt

SEQ ID NO: 306018 - DNA, 20 bp, Artificial Sequence
  chemically synthesized
tgcgcgtatgattgctgttc

SEQ ID NO: 306019 - DNA, 20 bp, Artificial Sequence
  chemically synthesized
ttgcgcgtatgattgctgtt

SEQ ID NO: 306020 - DNA, 20 bp, Artificial Sequence
  chemically synthesized
tgaacagcaatcatacgcgc

SEQ ID NO: 306021 - DNA, 20 bp, Artificial Sequence
  chemically synthesized
acagcaatcatacgcgcaag

SEQ ID NO: 306022 - DNA, 20 bp, Artificial Sequence
  chemically synthesized
gcaagcagtgttctttatat

SEQ ID NO: 306023 - DNA, 20 bp, Artificial Sequence
  chemically synthesized
cacccagttgtactcatata

SEQ ID NO: 306024 - DNA, 20 bp, Artificial Sequence
  chemically synthesized
gttctttatatgagtacaac

SEQ ID NO: 306025 - DNA, 20 bp, Artificial Sequence
  chemically synthesized
ttctttatatgagtacaact

SEQ ID NO: 306026 - DNA, 20 bp, Artificial Sequence
  chemically synthesized
gattgagatgacaaggcacc

SEQ ID NO: 306027 - DNA, 20 bp, Artificial Sequence
  chemically synthesized
aaatcgtgattgagatgaca

SEQ ID NO: 306028 - DNA, 20 bp, Artificial Sequence
  chemically synthesized
gaaatcgtgattgagatgac

SEQ ID NO: 306029 - DNA, 20 bp, Artificial Sequence
  chemically synthesized
agggtgtggaaatcgtgatt

SEQ ID NO: 306030 - DNA, 20 bp, Artificial Sequence
  chemically synthesized
acctattgtgaggcagggtg

SEQ ID NO: 306031 - DNA, 20 bp, Artificial Sequence
  chemically synthesized
ttaaaacctattgtgaggca

SEQ ID NO: 306032 - DNA, 20 bp, Artificial Sequence
  chemically synthesized
gttaaaacctattgtgaggc

SEQ ID NO: 306033 - DNA, 20 bp, Artificial Sequence
  chemically synthesized
ggttaaaacctattgtgagg

SEQ ID NO: 306034 - DNA, 20 bp, Artificial Sequence
  chemically synthesized
ttccacaccctgcctcacaa

SEQ ID NO: 306035 - DNA, 20 bp, Artificial Sequence
  chemically synthesized
tccacaccctgcctcacaat

SEQ ID NO: 306036 - DNA, 20 bp, Artificial Sequence
  chemically synthesized
aatggttaaaacctattgtg

SEQ ID NO: 306037 - DNA, 20 bp, Artificial Sequence
  chemically synthesized
taatggttaaaacctattgt

SEQ ID NO: 306038 - DNA, 20 bp, Artificial Sequence
  chemically synthesized
caataggttttaaccattat

SEQ ID NO: 306039 - DNA, 20 bp, Artificial Sequence
  chemically synthesized
aatgagcaaagttctcataa

SEQ ID NO: 306040 - DNA, 20 bp, Artificial Sequence
  chemically synthesized
attagtataaagaatgagca

SEQ ID NO: 306041 - DNA, 20 bp, Artificial Sequence
  chemically synthesized
aaataattagtataaagaat

SEQ ID NO: 306042 - DNA, 20 bp, Artificial Sequence
  chemically synthesized
tcttttaaataattagtata

SEQ ID NO: 306043 - DNA, 20 bp, Artificial Sequence
  chemically synthesized
caaaaattcttttaaataat

SEQ ID NO: 306044 - DNA, 20 bp, Artificial Sequence
  chemically synthesized
tctttatactaattatttaa

SEQ ID NO: 306045 - DNA, 20 bp, Artificial Sequence
  chemically synthesized
aaagaatttttgaaacaatt

SEQ ID NO: 306046 - DNA, 20 bp, Artificial Sequence
  chemically synthesized
aacaattgagtatatcatgt

SEQ ID NO: 306047 - DNA, 20 bp, Artificial Sequence
  chemically synthesized
aattgagtatatcatgtgag

SEQ ID NO: 306048 - DNA, 20 bp, Artificial Sequence
  chemically synthesized
aatgattgtgggagaaaaat

SEQ ID NO: 306049 - DNA, 20 bp, Artificial Sequence
  chemically synthesized
attttctataatgattgtgg

SEQ ID NO: 306050 - DNA, 20 bp, Artificial Sequence
  chemically synthesized
acattttctataatgattgt

SEQ ID NO: 306051 - DNA, 20 bp, Artificial Sequence
  chemically synthesized
tacattttctataatgattg

SEQ ID NO: 306052 - DNA, 20 bp, Artificial Sequence
  chemically synthesized
tttttctcccacaatcatta

SEQ ID NO: 306053 - DNA, 20 bp, Artificial Sequence
  chemically synthesized
attatagaaaatgtacatac

SEQ ID NO: 306054 - DNA, 20 bp, Artificial Sequence
  chemically synthesized
tagaaaatgtacatacaagt

SEQ ID NO: 306055 - DNA, 20 bp, Artificial Sequence
  chemically synthesized
ggttgtgactttgaagaaca

SEQ ID NO: 306056 - DNA, 20 bp, Artificial Sequence
  chemically synthesized
caagtgagctttgttcttca

SEQ ID NO: 306057 - DNA, 20 bp, Artificial Sequence
  chemically synthesized
gctgtaaggttgtgactttg

SEQ ID NO: 306058 - DNA, 20 bp, Artificial Sequence
  chemically synthesized
tcttcaaagtcacaacctta

SEQ ID NO: 306059 - DNA, 20 bp, Artificial Sequence
  chemically synthesized
ttccaagaatatgagctgta

SEQ ID NO: 306060 - DNA, 20 bp, Artificial Sequence
  chemically synthesized
attccaagaatatgagctgt

SEQ ID NO: 306061 - DNA, 20 bp, Artificial Sequence
  chemically synthesized
aaccttacagctcatattct

SEQ ID NO: 306062 - DNA, 20 bp, Artificial Sequence
  chemically synthesized
aaggagaattccaagaatat

SEQ ID NO: 306063 - DNA, 20 bp, Artificial Sequence
  chemically synthesized
aattacataaggagaattcc

SEQ ID NO: 306064 - DNA, 20 bp, Artificial Sequence
  chemically synthesized
cttgattaaaattacataag

SEQ ID NO: 306065 - DNA, 20 bp, Artificial Sequence
  chemically synthesized
accttgattaaaattacata

SEQ ID NO: 306066 - DNA, 20 bp, Artificial Sequence
  chemically synthesized
gaccttgattaaaattacat

SEQ ID NO: 306067 - DNA, 20 bp, Artificial Sequence
  chemically synthesized
ctccttatgtaattttaatc

SEQ ID NO: 306068 - DNA, 20 bp, Artificial Sequence
  chemically synthesized
tccttatgtaattttaatca

SEQ ID NO: 306069 - DNA, 20 bp, Artificial Sequence
  chemically synthesized
taatcaaggtcaatttaaca

SEQ ID NO: 306070 - DNA, 20 bp, Artificial Sequence
  chemically synthesized
ggtcaatttaacatggataa

SEQ ID NO: 306071 - DNA, 20 bp, Artificial Sequence
  chemically synthesized
taacatggataaaagaaaat

SEQ ID NO: 306072 - DNA, 20 bp, Artificial Sequence
  chemically synthesized
agcgaaatagtatcatataa

SEQ ID NO: 306073 - DNA, 20 bp, Artificial Sequence
  chemically synthesized
acagcgaaatagtatcatat

SEQ ID NO: 306074 - DNA, 20 bp, Artificial Sequence
  chemically synthesized
aaacagagacaacagcgaaa

SEQ ID NO: 306075 - DNA, 20 bp, Artificial Sequence
  chemically synthesized
aaggaggtaaacagagacaa

SEQ ID NO: 306076 - DNA, 20 bp, Artificial Sequence
  chemically synthesized
aaattaaaaggaggtaaaca

SEQ ID NO: 306077 - DNA, 20 bp, Artificial Sequence
  chemically synthesized
agaaattaaaaggaggtaaa

SEQ ID NO: 306078 - DNA, 20 bp, Artificial Sequence
  chemically synthesized
ggaaaagagaaattaaaagg

SEQ ID NO: 306079 - DNA, 20 bp, Artificial Sequence
  chemically synthesized
aggaaaagagaaattaaaag

SEQ ID NO: 306080 - DNA, 20 bp, Artificial Sequence
  chemically synthesized
tcaggaaaagagaaattaaa

SEQ ID NO: 306081 - DNA, 20 bp, Artificial Sequence
  chemically synthesized
ctcaggaaaagagaaattaa

SEQ ID NO: 306082 - DNA, 20 bp, Artificial Sequence
  chemically synthesized
cttttaatttctcttttcct

SEQ ID NO: 306083 - DNA, 20 bp, Artificial Sequence
  chemically synthesized
aatggagctactcaggaaaa

SEQ ID NO: 306084 - DNA, 20 bp, Artificial Sequence
  chemically synthesized
gaaatggagctactcaggaa

SEQ ID NO: 306085 - DNA, 20 bp, Artificial Sequence
  chemically synthesized
ttaatttctcttttcctgag

SEQ ID NO: 306086 - DNA, 20 bp, Artificial Sequence
  chemically synthesized
aggtagaaatggagctactc

SEQ ID NO: 306087 - DNA, 20 bp, Artificial Sequence
  chemically synthesized
aaggtagaaatggagctact

SEQ ID NO: 306088 - DNA, 20 bp, Artificial Sequence
  chemically synthesized
ctcacaggaaggtagaaatg

SEQ ID NO: 306089 - DNA, 20 bp, Artificial Sequence
  chemically synthesized
agctcacaggaaggtagaaa

SEQ ID NO: 306090 - DNA, 20 bp, Artificial Sequence
  chemically synthesized
tttttgagctcacaggaagg

SEQ ID NO: 306091 - DNA, 20 bp, Artificial Sequence
  chemically synthesized
ctccatttctaccttcctgt

SEQ ID NO: 306092 - DNA, 20 bp, Artificial Sequence
  chemically synthesized
ctgtttttgagctcacagga

SEQ ID NO: 306093 - DNA, 20 bp, Artificial Sequence
  chemically synthesized
gctgtttttgagctcacagg

SEQ ID NO: 306094 - DNA, 20 bp, Artificial Sequence
  chemically synthesized
ctggctgtttttgagctcac

SEQ ID NO: 306095 - DNA, 20 bp, Artificial Sequence
  chemically synthesized
gctggctgtttttgagctca

SEQ ID NO: 306096 - DNA, 20 bp, Artificial Sequence
  chemically synthesized
ccttcctgtgagctcaaaaa

SEQ ID NO: 306097 - DNA, 20 bp, Artificial Sequence
  chemically synthesized
aatctttgctggctgttttt

SEQ ID NO: 306098 - DNA, 20 bp, Artificial Sequence
  chemically synthesized
cctgtgagctcaaaaacagc

SEQ ID NO: 306099 - DNA, 20 bp, Artificial Sequence
  chemically synthesized
gagctcaaaaacagccagca

SEQ ID NO: 306100 - DNA, 20 bp, Artificial Sequence
  chemically synthesized
ggattgatccaaatctttgc

SEQ ID NO: 306101 - DNA, 20 bp, Artificial Sequence
  chemically synthesized
aaaaacagccagcaaagatt

SEQ ID NO: 306102 - DNA, 20 bp, Artificial Sequence
  chemically synthesized
gatttggatcaatcccatga

SEQ ID NO: 306103 - DNA, 20 bp, Artificial Sequence
  chemically synthesized
tccaaaaattatgctgtcat

SEQ ID NO: 306104 - DNA, 20 bp, Artificial Sequence
  chemically synthesized
ttccaaaaattatgctgtca

SEQ ID NO: 306105 - DNA, 20 bp, Artificial Sequence
  chemically synthesized
tcccatgacagcataatttt

SEQ ID NO: 306106 - DNA, 20 bp, Artificial Sequence
  chemically synthesized
atgacagcataatttttgga

SEQ ID NO: 306107 - DNA, 20 bp, Artificial Sequence
  chemically synthesized
tgacagcataatttttggaa

SEQ ID NO: 306108 - DNA, 20 bp, Artificial Sequence
  chemically synthesized
ataatttttggaaaggcaat

SEQ ID NO: 306109 - DNA, 20 bp, Artificial Sequence
  chemically synthesized
aatttttggaaaggcaatga

SEQ ID NO: 306110 - DNA, 20 bp, Artificial Sequence
  chemically synthesized
atgagagaaaactgaaacat

SEQ ID NO: 306111 - DNA, 20 bp, Artificial Sequence
  chemically synthesized
tttttcttaagcttatgttt

SEQ ID NO: 306112 - DNA, 20 bp, Artificial Sequence
  chemically synthesized
gaaaactgaaacataagctt

SEQ ID NO: 306113 - DNA, 20 bp, Artificial Sequence
  chemically synthesized
actaagcttgagtttttctt

SEQ ID NO: 306114 - DNA, 20 bp, Artificial Sequence
  chemically synthesized
cataagcttaagaaaaactc

SEQ ID NO: 306115 - DNA, 20 bp, Artificial Sequence
  chemically synthesized
gcttaagaaaaactcaagct

SEQ ID NO: 306116 - DNA, 20 bp, Artificial Sequence
  chemically synthesized
ttttccagaacactaagctt

SEQ ID NO: 306117 - DNA, 20 bp, Artificial Sequence
  chemically synthesized
aaaactcaagcttagtgttc

SEQ ID NO: 306118 - DNA, 20 bp, Artificial Sequence
  chemically synthesized
aagttgttttccagaacact

SEQ ID NO: 306119 - DNA, 20 bp, Artificial Sequence
  chemically synthesized
acatcatgtaagttgttttc

SEQ ID NO: 306120 - DNA, 20 bp, Artificial Sequence
  chemically synthesized
aaaaggacttaacatcatgt

SEQ ID NO: 306121 - DNA, 20 bp, Artificial Sequence
  chemically synthesized
aaaacaacttacatgatgtt

SEQ ID NO: 306122 - DNA, 20 bp, Artificial Sequence
  chemically synthesized
gtgggctagaaataaataaa

SEQ ID NO: 306123 - DNA, 20 bp, Artificial Sequence
  chemically synthesized
tgtgggctagaaataaataa

SEQ ID NO: 306124 - DNA, 20 bp, Artificial Sequence
  chemically synthesized
taagtccttttatttatttc

SEQ ID NO: 306125 - DNA, 20 bp, Artificial Sequence
  chemically synthesized
tacacgctcctattgtgggc

SEQ ID NO: 306126 - DNA, 20 bp, Artificial Sequence
  chemically synthesized
tatttatttctagcccacaa

SEQ ID NO: 306127 - DNA, 20 bp, Artificial Sequence
  chemically synthesized
atttatttctagcccacaat

SEQ ID NO: 306128 - DNA, 20 bp, Artificial Sequence
  chemically synthesized
ttatttctagcccacaatag

SEQ ID NO: 306129 - DNA, 20 bp, Artificial Sequence
  chemically synthesized
cagttacacgctcctattgt

SEQ ID NO: 306130 - DNA, 20 bp, Artificial Sequence
  chemically synthesized
acagttacacgctcctattg

SEQ ID NO: 306131 - DNA, 20 bp, Artificial Sequence
  chemically synthesized
cttttaattttattttcaaa

SEQ ID NO: 306132 - DNA, 20 bp, Artificial Sequence
  chemically synthesized
ctgtttgaaaataaaattaa

SEQ ID NO: 306133 - DNA, 20 bp, Artificial Sequence
  chemically synthesized
tgtttgaaaataaaattaaa

SEQ ID NO: 306134 - DNA, 20 bp, Artificial Sequence
  chemically synthesized
tttgaaaataaaattaaaag

SEQ ID NO: 306135 - DNA, 20 bp, Artificial Sequence
  chemically synthesized
aaaataaaattaaaaggaga

SEQ ID NO: 306136 - DNA, 20 bp, Artificial Sequence
  chemically synthesized
ataaaattaaaaggagatag

SEQ ID NO: 306137 - DNA, 20 bp, Artificial Sequence
  chemically synthesized
taaaattaaaaggagatagt

SEQ ID NO: 306138 - DNA, 20 bp, Artificial Sequence
  chemically synthesized
attaaaaggagatagtgggc

SEQ ID NO: 306139 - DNA, 20 bp, Artificial Sequence
  chemically synthesized
ttaaaaggagatagtgggcc

SEQ ID NO: 306140 - DNA, 20 bp, Artificial Sequence
  chemically synthesized
aggagatagtgggccgggcg

SEQ ID NO: 306141 - DNA, 20 bp, Artificial Sequence
  chemically synthesized
cagacataagtcaccgcgcc

SEQ ID NO: 306142 - DNA, 20 bp, Artificial Sequence
  chemically synthesized
agtgctgagattacagacat

SEQ ID NO: 306143 - DNA, 20 bp, Artificial Sequence
  chemically synthesized
gtgacttatgtctgtaatct

SEQ ID NO: 306144 - DNA, 20 bp, Artificial Sequence
  chemically synthesized
ctcccaaagtgctgagatta

SEQ ID NO: 306145 - DNA, 20 bp, Artificial Sequence
  chemically synthesized
tgtctgtaatctcagcactt

SEQ ID NO: 306146 - DNA, 20 bp, Artificial Sequence
  chemically synthesized
cttcggcctcccaaagtgct

SEQ ID NO: 306147 - DNA, 20 bp, Artificial Sequence
  chemically synthesized
gtctgtaatctcagcacttt

SEQ ID NO: 306148 - DNA, 20 bp, Artificial Sequence
  chemically synthesized
ctgtaatctcagcactttgg

SEQ ID NO: 306149 - DNA, 20 bp, Artificial Sequence
  chemically synthesized
tgtaatctcagcactttggg

SEQ ID NO: 306150 - DNA, 20 bp, Artificial Sequence
  chemically synthesized
cctcccacttcggcctccca

SEQ ID NO: 306151 - DNA, 20 bp, Artificial Sequence
  chemically synthesized
ctcagcactttgggaggccg

SEQ ID NO: 306152 - DNA, 20 bp, Artificial Sequence
  chemically synthesized
agcactttgggaggccgaag

SEQ ID NO: 306153 - DNA, 20 bp, Artificial Sequence
  chemically synthesized
gcactttgggaggccgaagt

SEQ ID NO: 306154 - DNA, 20 bp, Artificial Sequence
  chemically synthesized
actttgggaggccgaagtgg

SEQ ID NO: 306155 - DNA, 20 bp, Artificial Sequence
  chemically synthesized
ctttgggaggccgaagtggg

SEQ ID NO: 306156 - DNA, 20 bp, Artificial Sequence
  chemically synthesized
accttgtgatcctcccactt

SEQ ID NO: 306157 - DNA, 20 bp, Artificial Sequence
  chemically synthesized
ggccgaagtgggaggatcac

SEQ ID NO: 306158 - DNA, 20 bp, Artificial Sequence
  chemically synthesized
gccgaagtgggaggatcaca

SEQ ID NO: 306159 - DNA, 20 bp, Artificial Sequence
  chemically synthesized
aagtgggaggatcacaaggt

SEQ ID NO: 306160 - DNA, 20 bp, Artificial Sequence
  chemically synthesized
agtgggaggatcacaaggtc

SEQ ID NO: 306161 - DNA, 20 bp, Artificial Sequence
  chemically synthesized
tgggaggatcacaaggtcag

SEQ ID NO: 306162 - DNA, 20 bp, Artificial Sequence
  chemically synthesized
gatcacaaggtcaggagatc

SEQ ID NO: 306163 - DNA, 20 bp, Artificial Sequence
  chemically synthesized
tcaggagatcgagaccaccc

SEQ ID NO: 306164 - DNA, 20 bp, Artificial Sequence
  chemically synthesized
tttcaccatgttggccaggg

SEQ ID NO: 306165 - DNA, 20 bp, Artificial Sequence
  chemically synthesized
gggtttcaccatgttggcca

SEQ ID NO: 306166 - DNA, 20 bp, Artificial Sequence
  chemically synthesized
ggggtttcaccatgttggcc

SEQ ID NO: 306167 - DNA, 20 bp, Artificial Sequence
  chemically synthesized
cgagaccaccctggccaaca

SEQ ID NO: 306168 - DNA, 20 bp, Artificial Sequence
  chemically synthesized
tggggtttcaccatgttggc

SEQ ID NO: 306169 - DNA, 20 bp, Artificial Sequence
  chemically synthesized
gagatggggtttcaccatgt

SEQ ID NO: 306170 - DNA, 20 bp, Artificial Sequence
  chemically synthesized
ttgtaattttagtagagatg

SEQ ID NO: 306171 - DNA, 20 bp, Artificial Sequence
  chemically synthesized
tttgtaattttagtagagat

SEQ ID NO: 306172 - DNA, 20 bp, Artificial Sequence
  chemically synthesized
ttttgtaattttagtagaga

SEQ ID NO: 306173 - DNA, 20 bp, Artificial Sequence
  chemically synthesized
aattttttgtaattttagta

SEQ ID NO: 306174 - DNA, 20 bp, Artificial Sequence
  chemically synthesized
ctaattttttgtaattttag

SEQ ID NO: 306175 - DNA, 20 bp, Artificial Sequence
  chemically synthesized
ccactaattttttgtaattt

SEQ ID NO: 306176 - DNA, 20 bp, Artificial Sequence
  chemically synthesized
ctactaaaattacaaaaaat

SEQ ID NO: 306177 - DNA, 20 bp, Artificial Sequence
  chemically synthesized
ctaaaattacaaaaaattag

SEQ ID NO: 306178 - DNA, 20 bp, Artificial Sequence
  chemically synthesized
taaaattacaaaaaattagt

SEQ ID NO: 306179 - DNA, 20 bp, Artificial Sequence
  chemically synthesized
aaaattacaaaaaattagtg

SEQ ID NO: 306180 - DNA, 20 bp, Artificial Sequence
  chemically synthesized
aaaaaattagtggggtgtca

SEQ ID NO: 306181 - DNA, 20 bp, Artificial Sequence
  chemically synthesized
aaattagtggggtgtcatgg

SEQ ID NO: 306182 - DNA, 20 bp, Artificial Sequence
  chemically synthesized
aattagtggggtgtcatggt

SEQ ID NO: 306183 - DNA, 20 bp, Artificial Sequence
  chemically synthesized
ggtgtcatggtaggcacctg

SEQ ID NO: 306184 - DNA, 20 bp, Artificial Sequence
  chemically synthesized
atggtaggcacctgtagtcc

SEQ ID NO: 306185 - DNA, 20 bp, Artificial Sequence
  chemically synthesized
caagtagcagctgggactac

SEQ ID NO: 306186 - DNA, 20 bp, Artificial Sequence
  chemically synthesized
ccaagtagcagctgggacta

SEQ ID NO: 306187 - DNA, 20 bp, Artificial Sequence
  chemically synthesized
cagcctcccaagtagcagct

SEQ ID NO: 306188 - DNA, 20 bp, Artificial Sequence
  chemically synthesized
tcagcctcccaagtagcagc

SEQ ID NO: 306189 - DNA, 20 bp, Artificial Sequence
  chemically synthesized
ctgtagtcccagctgctact

SEQ ID NO: 306190 - DNA, 20 bp, Artificial Sequence
  chemically synthesized
tgtagtcccagctgctactt

SEQ ID NO: 306191 - DNA, 20 bp, Artificial Sequence
  chemically synthesized
tgcctcagcctcccaagtag

SEQ ID NO: 306192 - DNA, 20 bp, Artificial Sequence
  chemically synthesized
tagtcccagctgctacttgg

SEQ ID NO: 306193 - DNA, 20 bp, Artificial Sequence
  chemically synthesized
agtcccagctgctacttggg

SEQ ID NO: 306194 - DNA, 20 bp, Artificial Sequence
  chemically synthesized
tcctgcctcagcctcccaag

SEQ ID NO: 306195 - DNA, 20 bp, Artificial Sequence
  chemically synthesized
ttctcctgcctcagcctccc

SEQ ID NO: 306196 - DNA, 20 bp, Artificial Sequence
  chemically synthesized
cagctgctacttgggaggct

SEQ ID NO: 306197 - DNA, 20 bp, Artificial Sequence
  chemically synthesized
agctgctacttgggaggctg

SEQ ID NO: 306198 - DNA, 20 bp, Artificial Sequence
  chemically synthesized
tgctacttgggaggctgagg

SEQ ID NO: 306199 - DNA, 20 bp, Artificial Sequence
  chemically synthesized
gctacttgggaggctgaggc

SEQ ID NO: 306200 - DNA, 20 bp, Artificial Sequence
  chemically synthesized
tacttgggaggctgaggcag

SEQ ID NO: 306201 - DNA, 20 bp, Artificial Sequence
  chemically synthesized
ttcacaccgttctcctgcct

SEQ ID NO: 306202 - DNA, 20 bp, Artificial Sequence
  chemically synthesized
gggaggctgaggcaggagaa

SEQ ID NO: 306203 - DNA, 20 bp, Artificial Sequence
  chemically synthesized
gcaggagaacggtgtgaacc

SEQ ID NO: 306204 - DNA, 20 bp, Artificial Sequence
  chemically synthesized
caggagaacggtgtgaaccc

SEQ ID NO: 306205 - DNA, 20 bp, Artificial Sequence
  chemically synthesized
ggagaacggtgtgaacccag

SEQ ID NO: 306206 - DNA, 20 bp, Artificial Sequence
  chemically synthesized
gagaacggtgtgaacccagg

SEQ ID NO: 306207 - DNA, 20 bp, Artificial Sequence
  chemically synthesized
aacggtgtgaacccaggagg

SEQ ID NO: 306208 - DNA, 20 bp, Artificial Sequence
  chemically synthesized
cactgcaagctctgcctcct

SEQ ID NO: 306209 - DNA, 20 bp, Artificial Sequence
  chemically synthesized
cggtgtgaacccaggaggca

SEQ ID NO: 306210 - DNA, 20 bp, Artificial Sequence
  chemically synthesized
tcactgcaagctctgcctcc

SEQ ID NO: 306211 - DNA, 20 bp, Artificial Sequence
  chemically synthesized
aacccaggaggcagagcttg

SEQ ID NO: 306212 - DNA, 20 bp, Artificial Sequence
  chemically synthesized
caggaggcagagcttgcagt

SEQ ID NO: 306213 - DNA, 20 bp, Artificial Sequence
  chemically synthesized
gcacaatctcagctcactgc

SEQ ID NO: 306214 - DNA, 20 bp, Artificial Sequence
  chemically synthesized
ggcagagcttgcagtgagct

SEQ ID NO: 306215 - DNA, 20 bp, Artificial Sequence
  chemically synthesized
ggagtgcagtggcacaatct

SEQ ID NO: 306216 - DNA, 20 bp, Artificial Sequence
  chemically synthesized
tcacccaggctggagtgcag

SEQ ID NO: 306217 - DNA, 20 bp, Artificial Sequence
  chemically synthesized
gagattgtgccactgcactc

SEQ ID NO: 306218 - DNA, 20 bp, Artificial Sequence
  chemically synthesized
gtgtcacccaggctggagtg

SEQ ID NO: 306219 - DNA, 20 bp, Artificial Sequence
  chemically synthesized
tgtgccactgcactccagcc

SEQ ID NO: 306220 - DNA, 20 bp, Artificial Sequence
  chemically synthesized
gtgccactgcactccagcct

SEQ ID NO: 306221 - DNA, 20 bp, Artificial Sequence
  chemically synthesized
tcactgtgtcacccaggctg

SEQ ID NO: 306222 - DNA, 20 bp, Artificial Sequence
  chemically synthesized
tctcactgtgtcacccaggc

SEQ ID NO: 306223 - DNA, 20 bp, Artificial Sequence
  chemically synthesized
ggagtctcactgtgtcaccc

SEQ ID NO: 306224 - DNA, 20 bp, Artificial Sequence
  chemically synthesized
gcactccagcctgggtgaca

SEQ ID NO: 306225 - DNA, 20 bp, Artificial Sequence
  chemically synthesized
tggagtctcactgtgtcacc

SEQ ID NO: 306226 - DNA, 20 bp, Artificial Sequence
  chemically synthesized
tccagcctgggtgacacagt

SEQ ID NO: 306227 - DNA, 20 bp, Artificial Sequence
  chemically synthesized
ttttttttttttttgagatg

SEQ ID NO: 306228 - DNA, 20 bp, Artificial Sequence
  chemically synthesized
ttttttttttttttttgaga

SEQ ID NO: 306229 - DNA, 20 bp, Artificial Sequence
  chemically synthesized
tttttttttttttttttttt

SEQ ID NO: 306230 - DNA, 20 bp, Artificial Sequence
  chemically synthesized
aaaaaaaaaaaaaaaaaaaa

SEQ ID NO: 306231 - DNA, 20 bp, Artificial Sequence
  chemically synthesized
aaaaaaaaaaaaaaaaaaag

SEQ ID NO: 306232 - DNA, 20 bp, Artificial Sequence
  chemically synthesized
aaaaaaaaaaaaaaagcaga

SEQ ID NO: 306233 - DNA, 20 bp, Artificial Sequence
  chemically synthesized
aaaaaaaaaaaaagcagata

SEQ ID NO: 306234 - DNA, 20 bp, Artificial Sequence
  chemically synthesized
agcagatagagaaccacaaa

SEQ ID NO: 306235 - DNA, 20 bp, Artificial Sequence
  chemically synthesized
tgtgtctggagggctttttg

SEQ ID NO: 306236 - DNA, 20 bp, Artificial Sequence
  chemically synthesized
gagaaccacaaaaagccctc

SEQ ID NO: 306237 - DNA, 20 bp, Artificial Sequence
  chemically synthesized
tgtagttcagtgtgtctgga

SEQ ID NO: 306238 - DNA, 20 bp, Artificial Sequence
  chemically synthesized
atgtagttcagtgtgtctgg

SEQ ID NO: 306239 - DNA, 20 bp, Artificial Sequence
  chemically synthesized
catgtagttcagtgtgtctg

SEQ ID NO: 306240 - DNA, 20 bp, Artificial Sequence
  chemically synthesized
gtcatgtagttcagtgtgtc

SEQ ID NO: 306241 - DNA, 20 bp, Artificial Sequence
  chemically synthesized
gatatgtaagtcatgtagtt

SEQ ID NO: 306242 - DNA, 20 bp, Artificial Sequence
  chemically synthesized
agtttgatatgtaagtcatg

SEQ ID NO: 306243 - DNA, 20 bp, Artificial Sequence
  chemically synthesized
aaaggttgagtttgatatgt

SEQ ID NO: 306244 - DNA, 20 bp, Artificial Sequence
  chemically synthesized
catttgaggggaaaaaggtt

SEQ ID NO: 306245 - DNA, 20 bp, Artificial Sequence
  chemically synthesized
gaaagcatttgaggggaaaa

SEQ ID NO: 306246 - DNA, 20 bp, Artificial Sequence
  chemically synthesized
agaaagcatttgaggggaaa

SEQ ID NO: 306247 - DNA, 20 bp, Artificial Sequence
  chemically synthesized
tagacaagaaagcatttgag

SEQ ID NO: 306248 - DNA, 20 bp, Artificial Sequence
  chemically synthesized
atagacaagaaagcatttga

SEQ ID NO: 306249 - DNA, 20 bp, Artificial Sequence
  chemically synthesized
catagacaagaaagcatttg

SEQ ID NO: 306250 - DNA, 20 bp, Artificial Sequence
  chemically synthesized
gcatagacaagaaagcattt

SEQ ID NO: 306251 - DNA, 20 bp, Artificial Sequence
  chemically synthesized
aaatggaggcatagacaaga

SEQ ID NO: 306252 - DNA, 20 bp, Artificial Sequence
  chemically synthesized
gataaaatggaggcatagac

SEQ ID NO: 306253 - DNA, 20 bp, Artificial Sequence
  chemically synthesized
atgaagataaaatggaggca

SEQ ID NO: 306254 - DNA, 20 bp, Artificial Sequence
  chemically synthesized
atacaatgaagataaaatgg

SEQ ID NO: 306255 - DNA, 20 bp, Artificial Sequence
  chemically synthesized
gatacaatgaagataaaatg

SEQ ID NO: 306256 - DNA, 20 bp, Artificial Sequence
  chemically synthesized
gggatacaatgaagataaaa

SEQ ID NO: 306257 - DNA, 20 bp, Artificial Sequence
  chemically synthesized
ttgctcatagggatacaatg

SEQ ID NO: 306258 - DNA, 20 bp, Artificial Sequence
  chemically synthesized
tatcttcattgtatccctat

SEQ ID NO: 306259 - DNA, 20 bp, Artificial Sequence
  chemically synthesized
ttcattgtatccctatgagc

SEQ ID NO: 306260 - DNA, 20 bp, Artificial Sequence
  chemically synthesized
tatctcttcacttgctcata

SEQ ID NO: 306261 - DNA, 20 bp, Artificial Sequence
  chemically synthesized
gtatctcttcacttgctcat

SEQ ID NO: 306262 - DNA, 20 bp, Artificial Sequence
  chemically synthesized
tgtatctcttcacttgctca

SEQ ID NO: 306263 - DNA, 20 bp, Artificial Sequence
  chemically synthesized
tgtatccctatgagcaagtg

SEQ ID NO: 306264 - DNA, 20 bp, Artificial Sequence
  chemically synthesized
tatccctatgagcaagtgaa

SEQ ID NO: 306265 - DNA, 20 bp, Artificial Sequence
  chemically synthesized
ataaagtccaacatgcatta

SEQ ID NO: 306266 - DNA, 20 bp, Artificial Sequence
  chemically synthesized
atacatgctgtaatgcatgt

SEQ ID NO: 306267 - DNA, 20 bp, Artificial Sequence
  chemically synthesized
gcatggttctttatgaaata

SEQ ID NO: 306268 - DNA, 20 bp, Artificial Sequence
  chemically synthesized
atgttggactttatttcata

SEQ ID NO: 306269 - DNA, 20 bp, Artificial Sequence
  chemically synthesized
aatactggttttgatttgca

SEQ ID NO: 306270 - DNA, 20 bp, Artificial Sequence
  chemically synthesized
agaaccatgcaaatcaaaac

SEQ ID NO: 306271 - DNA, 20 bp, Artificial Sequence
  chemically synthesized
attctataataaaagaatac

SEQ ID NO: 306272 - DNA, 20 bp, Artificial Sequence
  chemically synthesized
aaaccagtattcttttatta

SEQ ID NO: 306273 - DNA, 20 bp, Artificial Sequence
  chemically synthesized
cttgtataattctataataa

SEQ ID NO: 306274 - DNA, 20 bp, Artificial Sequence
  chemically synthesized
cttttattatagaattatac

SEQ ID NO: 306275 - DNA, 20 bp, Artificial Sequence
  chemically synthesized
tattatagaattatacaagt

SEQ ID NO: 306276 - DNA, 20 bp, Artificial Sequence
  chemically synthesized
tatagaattatacaagttgg

SEQ ID NO: 306277 - DNA, 20 bp, Artificial Sequence
  chemically synthesized
aagacatcacgtcaattgcc

SEQ ID NO: 306278 - DNA, 20 bp, Artificial Sequence
  chemically synthesized
agacatcacgtcaattgcct

SEQ ID NO: 306279 - DNA, 20 bp, Artificial Sequence
  chemically synthesized
catcacgtcaattgcctagg

SEQ ID NO: 306280 - DNA, 20 bp, Artificial Sequence
  chemically synthesized
cacgtcaattgcctaggtgg

SEQ ID NO: 306281 - DNA, 20 bp, Artificial Sequence
  chemically synthesized
aaattatgagaccaccacct

SEQ ID NO: 306282 - DNA, 20 bp, Artificial Sequence
  chemically synthesized
gaaattatgagaccaccacc

SEQ ID NO: 306283 - DNA, 20 bp, Artificial Sequence
  chemically synthesized
tttaattccctagaaattat

SEQ ID NO: 306284 - DNA, 20 bp, Artificial Sequence
  chemically synthesized
ggtggtggtctcataatttc

SEQ ID NO: 306285 - DNA, 20 bp, Artificial Sequence
  chemically synthesized
gtggtggtctcataatttct

SEQ ID NO: 306286 - DNA, 20 bp, Artificial Sequence
  chemically synthesized
tggtggtctcataatttcta

SEQ ID NO: 306287 - DNA, 20 bp, Artificial Sequence
  chemically synthesized
aagccttatttttaattccc

SEQ ID NO: 306288 - DNA, 20 bp, Artificial Sequence
  chemically synthesized
atttctagggaattaaaaat

SEQ ID NO: 306289 - DNA, 20 bp, Artificial Sequence
  chemically synthesized
tttctagggaattaaaaata

SEQ ID NO: 306290 - DNA, 20 bp, Artificial Sequence
  chemically synthesized
aattggtagaaaagcatttg

SEQ ID NO: 306291 - DNA, 20 bp, Artificial Sequence
  chemically synthesized
gattattccaattggtagaa

SEQ ID NO: 306292 - DNA, 20 bp, Artificial Sequence
  chemically synthesized
tcaaatgcttttctaccaat

SEQ ID NO: 306293 - DNA, 20 bp, Artificial Sequence
  chemically synthesized
gatttgattattccaattgg

SEQ ID NO: 306294 - DNA, 20 bp, Artificial Sequence
  chemically synthesized
actgatttgattattccaat

SEQ ID NO: 306295 - DNA, 20 bp, Artificial Sequence
  chemically synthesized
accaattggaataatcaaat

SEQ ID NO: 306296 - DNA, 20 bp, Artificial Sequence
  chemically synthesized
catgtacaaacttcatcaaa

SEQ ID NO: 306297 - DNA, 20 bp, Artificial Sequence
  chemically synthesized
aatgggactactttttgatg

SEQ ID NO: 306298 - DNA, 20 bp, Artificial Sequence
  chemically synthesized
gtacaaacttcatcaaaaag

SEQ ID NO: 306299 - DNA, 20 bp, Artificial Sequence
  chemically synthesized
tcaaaaagtagtcccattcc

SEQ ID NO: 306300 - DNA, 20 bp, Artificial Sequence
  chemically synthesized
caaaaagtagtcccattcca

SEQ ID NO: 306301 - DNA, 20 bp, Artificial Sequence
  chemically synthesized
aaaaagtagtcccattccaa

SEQ ID NO: 306302 - DNA, 20 bp, Artificial Sequence
  chemically synthesized
tatgctcattcccttggaat

SEQ ID NO: 306303 - DNA, 20 bp, Artificial Sequence
  chemically synthesized
atatgctcattcccttggaa

SEQ ID NO: 306304 - DNA, 20 bp, Artificial Sequence
  chemically synthesized
tagtcccattccaagggaat

SEQ ID NO: 306305 - DNA, 20 bp, Artificial Sequence
  chemically synthesized
tataaatatgctcattccct

SEQ ID NO: 306306 - DNA, 20 bp, Artificial Sequence
  chemically synthesized
agggaatgagcatatttata

SEQ ID NO: 306307 - DNA, 20 bp, Artificial Sequence
  chemically synthesized
tatttatatagtgtattccc

SEQ ID NO: 306308 - DNA, 20 bp, Artificial Sequence
  chemically synthesized
ttatatagtgtattcccaag

SEQ ID NO: 306309 - DNA, 20 bp, Artificial Sequence
  chemically synthesized
gtgaaaagggagagcttctt

SEQ ID NO: 306310 - DNA, 20 bp, Artificial Sequence
  chemically synthesized
tgtgaaaagggagagcttct

SEQ ID NO: 306311 - DNA, 20 bp, Artificial Sequence
  chemically synthesized
ccctgaaatgtgaaaaggga

SEQ ID NO: 306312 - DNA, 20 bp, Artificial Sequence
  chemically synthesized
ctccctgaaatgtgaaaagg

SEQ ID NO: 306313 - DNA, 20 bp, Artificial Sequence
  chemically synthesized
tgctccctgaaatgtgaaaa

SEQ ID NO: 306314 - DNA, 20 bp, Artificial Sequence
  chemically synthesized
atgctccctgaaatgtgaaa

SEQ ID NO: 306315 - DNA, 20 bp, Artificial Sequence
  chemically synthesized
aatgctccctgaaatgtgaa

SEQ ID NO: 306316 - DNA, 20 bp, Artificial Sequence
  chemically synthesized
agctctcccttttcacattt

SEQ ID NO: 306317 - DNA, 20 bp, Artificial Sequence
  chemically synthesized
gctctcccttttcacatttc

SEQ ID NO: 306318 - DNA, 20 bp, Artificial Sequence
  chemically synthesized
ctctcccttttcacatttca

SEQ ID NO: 306319 - DNA, 20 bp, Artificial Sequence
  chemically synthesized
ctcccttttcacatttcagg

SEQ ID NO: 306320 - DNA, 20 bp, Artificial Sequence
  chemically synthesized
tcacatttcagggagcattg

SEQ ID NO: 306321 - DNA, 20 bp, Artificial Sequence
  chemically synthesized
cagggagcattgtggaaaac

SEQ ID NO: 306322 - DNA, 20 bp, Artificial Sequence
  chemically synthesized
attgtggaaaaccagaatgt

SEQ ID NO: 306323 - DNA, 20 bp, Artificial Sequence
  chemically synthesized
ttgtggaaaaccagaatgtt

SEQ ID NO: 306324 - DNA, 20 bp, Artificial Sequence
  chemically synthesized
gtgtgtgaatcccaacattc

SEQ ID NO: 306325 - DNA, 20 bp, Artificial Sequence
  chemically synthesized
aaatgtttaaagaaaataga

SEQ ID NO: 306326 - DNA, 20 bp, Artificial Sequence
  chemically synthesized
aaataaatgtttaaagaaaa

SEQ ID NO: 306327 - DNA, 20 bp, Artificial Sequence
  chemically synthesized
gagcctaaaataaatgttta

SEQ ID NO: 306328 - DNA, 20 bp, Artificial Sequence
  chemically synthesized
ttttctttaaacatttattt

SEQ ID NO: 306329 - DNA, 20 bp, Artificial Sequence
  chemically synthesized
tttctttaaacatttatttt

SEQ ID NO: 306330 - DNA, 20 bp, Artificial Sequence
  chemically synthesized
ttaaacatttattttaggct

SEQ ID NO: 306331 - DNA, 20 bp, Artificial Sequence
  chemically synthesized
taaacatttattttaggctc

SEQ ID NO: 306332 - DNA, 20 bp, Artificial Sequence
  chemically synthesized
aacatttattttaggctcag

SEQ ID NO: 306333 - DNA, 20 bp, Artificial Sequence
  chemically synthesized
aaaccttcatatgtactcct

SEQ ID NO: 306334 - DNA, 20 bp, Artificial Sequence
  chemically synthesized
taggctcaggagtacatatg

SEQ ID NO: 306335 - DNA, 20 bp, Artificial Sequence
  chemically synthesized
aggctcaggagtacatatga

SEQ ID NO: 306336 - DNA, 20 bp, Artificial Sequence
  chemically synthesized
acatatgaaggtttgttaca

SEQ ID NO: 306337 - DNA, 20 bp, Artificial Sequence
  chemically synthesized
catatgaaggtttgttacat

SEQ ID NO: 306338 - DNA, 20 bp, Artificial Sequence
  chemically synthesized
acataggtaaatgtgtgtca

SEQ ID NO: 306339 - DNA, 20 bp, Artificial Sequence
  chemically synthesized
cataggtaaatgtgtgtcac

SEQ ID NO: 306340 - DNA, 20 bp, Artificial Sequence
  chemically synthesized
ataggtaaatgtgtgtcaca

SEQ ID NO: 306341 - DNA, 20 bp, Artificial Sequence
  chemically synthesized
taggtaaatgtgtgtcacag

SEQ ID NO: 306342 - DNA, 20 bp, Artificial Sequence
  chemically synthesized
tgggtgatgaaataattggt

SEQ ID NO: 306343 - DNA, 20 bp, Artificial Sequence
  chemically synthesized
tacctgggtgatgaaataat

SEQ ID NO: 306344 - DNA, 20 bp, Artificial Sequence
  chemically synthesized
ttaccaattatttcatcacc

SEQ ID NO: 306345 - DNA, 20 bp, Artificial Sequence
  chemically synthesized
taccaattatttcatcaccc

SEQ ID NO: 306346 - DNA, 20 bp, Artificial Sequence
  chemically synthesized
tatttcatcacccaggtatt

SEQ ID NO: 306347 - DNA, 20 bp, Artificial Sequence
  chemically synthesized
ggatactgggcttaatacct

SEQ ID NO: 306348 - DNA, 20 bp, Artificial Sequence
  chemically synthesized
tggatactgggcttaatacc

SEQ ID NO: 306349 - DNA, 20 bp, Artificial Sequence
  chemically synthesized
catcacccaggtattaagcc

SEQ ID NO: 306350 - DNA, 20 bp, Artificial Sequence
  chemically synthesized
aaataagactattggatact

SEQ ID NO: 306351 - DNA, 20 bp, Artificial Sequence
  chemically synthesized
taaataagactattggatac

SEQ ID NO: 306352 - DNA, 20 bp, Artificial Sequence
  chemically synthesized
gtattaagcccagtatccaa

SEQ ID NO: 306353 - DNA, 20 bp, Artificial Sequence
  chemically synthesized
tgagcagtaaataagactat

SEQ ID NO: 306354 - DNA, 20 bp, Artificial Sequence
  chemically synthesized
gaagtagatgagcagtaaat

SEQ ID NO: 306355 - DNA, 20 bp, Artificial Sequence
  chemically synthesized
ggtgggaggaagtagatgag

SEQ ID NO: 306356 - DNA, 20 bp, Artificial Sequence
  chemically synthesized
gagggtgggaggaagtagat

SEQ ID NO: 306357 - DNA, 20 bp, Artificial Sequence
  chemically synthesized
ggtgggagggtgggaggaag

SEQ ID NO: 306358 - DNA, 20 bp, Artificial Sequence
  chemically synthesized
tgaggtgggagggtgggagg

SEQ ID NO: 306359 - DNA, 20 bp, Artificial Sequence
  chemically synthesized
acttgaggtgggagggtggg

SEQ ID NO: 306360 - DNA, 20 bp, Artificial Sequence
  chemically synthesized
tacttgaggtgggagggtgg

SEQ ID NO: 306361 - DNA, 20 bp, Artificial Sequence
  chemically synthesized
tctacttgaggtgggagggt

SEQ ID NO: 306362 - DNA, 20 bp, Artificial Sequence
  chemically synthesized
atctacttgaggtgggaggg

SEQ ID NO: 306363 - DNA, 20 bp, Artificial Sequence
  chemically synthesized
gggatctacttgaggtggga

SEQ ID NO: 306364 - DNA, 20 bp, Artificial Sequence
  chemically synthesized
tgggatctacttgaggtggg

SEQ ID NO: 306365 - DNA, 20 bp, Artificial Sequence
  chemically synthesized
tcctcccaccctcccacctc

SEQ ID NO: 306366 - DNA, 20 bp, Artificial Sequence
  chemically synthesized
ctgggatctacttgaggtgg

SEQ ID NO: 306367 - DNA, 20 bp, Artificial Sequence
  chemically synthesized
cactgggatctacttgaggt

SEQ ID NO: 306368 - DNA, 20 bp, Artificial Sequence
  chemically synthesized
tcccaccctcccacctcaag

SEQ ID NO: 306369 - DNA, 20 bp, Artificial Sequence
  chemically synthesized
acactgggatctacttgagg

SEQ ID NO: 306370 - DNA, 20 bp, Artificial Sequence
  chemically synthesized
catacactgggatctacttg

SEQ ID NO: 306371 - DNA, 20 bp, Artificial Sequence
  chemically synthesized
acatacactgggatctactt

SEQ ID NO: 306372 - DNA, 20 bp, Artificial Sequence
  chemically synthesized
ctcccacctcaagtagatcc

SEQ ID NO: 306373 - DNA, 20 bp, Artificial Sequence
  chemically synthesized
agaggggatcaacatacact

SEQ ID NO: 306374 - DNA, 20 bp, Artificial Sequence
  chemically synthesized
tagaggggatcaacatacac

SEQ ID NO: 306375 - DNA, 20 bp, Artificial Sequence
  chemically synthesized
gtgtatgttgatcccctcta

SEQ ID NO: 306376 - DNA, 20 bp, Artificial Sequence
  chemically synthesized
acaatctgcagaccatagag

SEQ ID NO: 306377 - DNA, 20 bp, Artificial Sequence
  chemically synthesized
tacaatctgcagaccataga

SEQ ID NO: 306378 - DNA, 20 bp, Artificial Sequence
  chemically synthesized
atacaatctgcagaccatag

SEQ ID NO: 306379 - DNA, 20 bp, Artificial Sequence
  chemically synthesized
gatacaatctgcagaccata

SEQ ID NO: 306380 - DNA, 20 bp, Artificial Sequence
  chemically synthesized
ttgatcccctctatggtctg

SEQ ID NO: 306381 - DNA, 20 bp, Artificial Sequence
  chemically synthesized
ttgatacaatctgcagacca

SEQ ID NO: 306382 - DNA, 20 bp, Artificial Sequence
  chemically synthesized
taagcctttgatacaatctg

SEQ ID NO: 306383 - DNA, 20 bp, Artificial Sequence
  chemically synthesized
atggtctgcagattgtatca

SEQ ID NO: 306384 - DNA, 20 bp, Artificial Sequence
  chemically synthesized
tggtctgcagattgtatcaa

SEQ ID NO: 306385 - DNA, 20 bp, Artificial Sequence
  chemically synthesized
tgcagattgtatcaaaggct

SEQ ID NO: 306386 - DNA, 20 bp, Artificial Sequence
  chemically synthesized
attgtatcaaaggcttagta

SEQ ID NO: 306387 - DNA, 20 bp, Artificial Sequence
  chemically synthesized
taaaaatctacatctttact

SEQ ID NO: 306388 - DNA, 20 bp, Artificial Sequence
  chemically synthesized
tcaaaggcttagtaaagatg

SEQ ID NO: 306389 - DNA, 20 bp, Artificial Sequence
  chemically synthesized
ttagtaaagatgtagatttt

SEQ ID NO: 306390 - DNA, 20 bp, Artificial Sequence
  chemically synthesized
tagtaaagatgtagattttt

SEQ ID NO: 306391 - DNA, 20 bp, Artificial Sequence
  chemically synthesized
agatttttaggtccttatca

SEQ ID NO: 306392 - DNA, 20 bp, Artificial Sequence
  chemically synthesized
ctcatccataagctgtgata

SEQ ID NO: 306393 - DNA, 20 bp, Artificial Sequence
  chemically synthesized
tctcatccataagctgtgat

SEQ ID NO: 306394 - DNA, 20 bp, Artificial Sequence
  chemically synthesized
taggtccttatcacagctta

SEQ ID NO: 306395 - DNA, 20 bp, Artificial Sequence
  chemically synthesized
ccttatcacagcttatggat

SEQ ID NO: 306396 - DNA, 20 bp, Artificial Sequence
  chemically synthesized
gctcagaaaatctcatccat

SEQ ID NO: 306397 - DNA, 20 bp, Artificial Sequence
  chemically synthesized
gcttatggatgagattttct

SEQ ID NO: 306398 - DNA, 20 bp, Artificial Sequence
  chemically synthesized
atattcctaaacattttgct

SEQ ID NO: 306399 - DNA, 20 bp, Artificial Sequence
  chemically synthesized
gattttctgagcaaaatgtt

SEQ ID NO: 306400 - DNA, 20 bp, Artificial Sequence
  chemically synthesized
attttctgagcaaaatgttt

SEQ ID NO: 306401 - DNA, 20 bp, Artificial Sequence
  chemically synthesized
ttaggaatatgcattttaat

SEQ ID NO: 306402 - DNA, 20 bp, Artificial Sequence
  chemically synthesized
atgcattttaattagctcct

SEQ ID NO: 306403 - DNA, 20 bp, Artificial Sequence
  chemically synthesized
tgcattttaattagctcctc

SEQ ID NO: 306404 - DNA, 20 bp, Artificial Sequence
  chemically synthesized
attttaattagctcctcagg

SEQ ID NO: 306405 - DNA, 20 bp, Artificial Sequence
  chemically synthesized
ctgcatagtagccacctgag

SEQ ID NO: 306406 - DNA, 20 bp, Artificial Sequence
  chemically synthesized
gtctgcatagtagccacctg

SEQ ID NO: 306407 - DNA, 20 bp, Artificial Sequence
  chemically synthesized
agtctgcatagtagccacct

SEQ ID NO: 306408 - DNA, 20 bp, Artificial Sequence
  chemically synthesized
ctcctcaggtggctactatg

SEQ ID NO: 306409 - DNA, 20 bp, Artificial Sequence
  chemically synthesized
tcaaacttgagtctgcatag

SEQ ID NO: 306410 - DNA, 20 bp, Artificial Sequence
  chemically synthesized
ttctcaaacttgagtctgca

SEQ ID NO: 306411 - DNA, 20 bp, Artificial Sequence
  chemically synthesized
ggtggctactatgcagactc

SEQ ID NO: 306412 - DNA, 20 bp, Artificial Sequence
  chemically synthesized
tactatgcagactcaagttt

SEQ ID NO: 306413 - DNA, 20 bp, Artificial Sequence
  chemically synthesized
atggagtggttctcaaactt

SEQ ID NO: 306414 - DNA, 20 bp, Artificial Sequence
  chemically synthesized
ttcatttgcattgcatggag

SEQ ID NO: 306415 - DNA, 20 bp, Artificial Sequence
  chemically synthesized
tagttcatttgcattgcatg

SEQ ID NO: 306416 - DNA, 20 bp, Artificial Sequence
  chemically synthesized
tctagttcatttgcattgca

SEQ ID NO: 306417 - DNA, 20 bp, Artificial Sequence
  chemically synthesized
tccatgcaatgcaaatgaac

SEQ ID NO: 306418 - DNA, 20 bp, Artificial Sequence
  chemically synthesized
atgcaatgcaaatgaactag

SEQ ID NO: 306419 - DNA, 20 bp, Artificial Sequence
  chemically synthesized
gttaactgtaggtcatcttc

SEQ ID NO: 306420 - DNA, 20 bp, Artificial Sequence
  chemically synthesized
atgaactagaagatgaccta

SEQ ID NO: 306421 - DNA, 20 bp, Artificial Sequence
  chemically synthesized
gagctgtaacagttaactgt

SEQ ID NO: 306422 - DNA, 20 bp, Artificial Sequence
  chemically synthesized
ggagctgtaacagttaactg

SEQ ID NO: 306423 - DNA, 20 bp, Artificial Sequence
  chemically synthesized
tgacctacagttaactgtta

SEQ ID NO: 306424 - DNA, 20 bp, Artificial Sequence
  chemically synthesized
acatgtttagggagctgtaa

SEQ ID NO: 306425 - DNA, 20 bp, Artificial Sequence
  chemically synthesized
ttttaagggacatgtttagg

SEQ ID NO: 306426 - DNA, 20 bp, Artificial Sequence
  chemically synthesized
ccttttaagggacatgttta

SEQ ID NO: 306427 - DNA, 20 bp, Artificial Sequence
  chemically synthesized
cccttttaagggacatgttt

SEQ ID NO: 306428 - DNA, 20 bp, Artificial Sequence
  chemically synthesized
tcccttttaagggacatgtt

SEQ ID NO: 306429 - DNA, 20 bp, Artificial Sequence
  chemically synthesized
tccctaaacatgtcccttaa

SEQ ID NO: 306430 - DNA, 20 bp, Artificial Sequence
  chemically synthesized
ccctaaacatgtcccttaaa

SEQ ID NO: 306431 - DNA, 20 bp, Artificial Sequence
  chemically synthesized
cctaaacatgtcccttaaaa

SEQ ID NO: 306432 - DNA, 20 bp, Artificial Sequence
  chemically synthesized
ttgacgtgcatcccttttaa

SEQ ID NO: 306433 - DNA, 20 bp, Artificial Sequence
  chemically synthesized
tttgacgtgcatccctttta

SEQ ID NO: 306434 - DNA, 20 bp, Artificial Sequence
  chemically synthesized
ttttgacgtgcatccctttt

SEQ ID NO: 306435 - DNA, 20 bp, Artificial Sequence
  chemically synthesized
ttgccattatttgataaaga

SEQ ID NO: 306436 - DNA, 20 bp, Artificial Sequence
  chemically synthesized
aagattgccattatttgata

SEQ ID NO: 306437 - DNA, 20 bp, Artificial Sequence
  chemically synthesized
taactttctttatcaaataa

SEQ ID NO: 306438 - DNA, 20 bp, Artificial Sequence
  chemically synthesized
ggtcagttgccgtgttaaga

SEQ ID NO: 306439 - DNA, 20 bp, Artificial Sequence
  chemically synthesized
aatggcaatctttcttaaca

SEQ ID NO: 306440 - DNA, 20 bp, Artificial Sequence
  chemically synthesized
aaatggtcagttgccgtgtt

SEQ ID NO: 306441 - DNA, 20 bp, Artificial Sequence
  chemically synthesized
tattgctgccataaaatggt

SEQ ID NO: 306442 - DNA, 20 bp, Artificial Sequence
  chemically synthesized
cacggcaactgaccatttta

SEQ ID NO: 306443 - DNA, 20 bp, Artificial Sequence
  chemically synthesized
agattattgctgccataaaa

SEQ ID NO: 306444 - DNA, 20 bp, Artificial Sequence
  chemically synthesized
ggcaactgaccattttatgg

SEQ ID NO: 306445 - DNA, 20 bp, Artificial Sequence
  chemically synthesized
tttatggcagcaataatctg

SEQ ID NO: 306446 - DNA, 20 bp, Artificial Sequence
  chemically synthesized
atggcagcaataatctgtgg

SEQ ID NO: 306447 - DNA, 20 bp, Artificial Sequence
  chemically synthesized
atatgtacccattgcttcca

SEQ ID NO: 306448 - DNA, 20 bp, Artificial Sequence
  chemically synthesized
gcaataatctgtggaagcaa

SEQ ID NO: 306449 - DNA, 20 bp, Artificial Sequence
  chemically synthesized
caataatctgtggaagcaat

SEQ ID NO: 306450 - DNA, 20 bp, Artificial Sequence
  chemically synthesized
gtggaagcaatgggtacata

SEQ ID NO: 306451 - DNA, 20 bp, Artificial Sequence
  chemically synthesized
tggaagcaatgggtacatat

SEQ ID NO: 306452 - DNA, 20 bp, Artificial Sequence
  chemically synthesized
ggtacatatgggaatactct

SEQ ID NO: 306453 - DNA, 20 bp, Artificial Sequence
  chemically synthesized
tatgggaatactctcagtgt

SEQ ID NO: 306454 - DNA, 20 bp, Artificial Sequence
  chemically synthesized
actttttaacccaacactga

SEQ ID NO: 306455 - DNA, 20 bp, Artificial Sequence
  chemically synthesized
atgggaatactctcagtgtt

SEQ ID NO: 306456 - DNA, 20 bp, Artificial Sequence
  chemically synthesized
atactttttaacccaacact

SEQ ID NO: 306457 - DNA, 20 bp, Artificial Sequence
  chemically synthesized
actctcagtgttgggttaaa

SEQ ID NO: 306458 - DNA, 20 bp, Artificial Sequence
  chemically synthesized
gtaataaatacatgagacat

SEQ ID NO: 306459 - DNA, 20 bp, Artificial Sequence
  chemically synthesized
tatttatgtaataaatacat

SEQ ID NO: 306460 - DNA, 20 bp, Artificial Sequence
  chemically synthesized
atggcttctttgcaatacat

SEQ ID NO: 306461 - DNA, 20 bp, Artificial Sequence
  chemically synthesized
ataaataccaatgtattgca

SEQ ID NO: 306462 - DNA, 20 bp, Artificial Sequence
  chemically synthesized
aataccaatgtattgcaaag

SEQ ID NO: 306463 - DNA, 20 bp, Artificial Sequence
  chemically synthesized
aatgtattgcaaagaagcca

SEQ ID NO: 306464 - DNA, 20 bp, Artificial Sequence
  chemically synthesized
atgtattgcaaagaagccat

SEQ ID NO: 306465 - DNA, 20 bp, Artificial Sequence
  chemically synthesized
tattgcaaagaagccatggg

SEQ ID NO: 306466 - DNA, 20 bp, Artificial Sequence
  chemically synthesized
tgttttatgtgatctgccca

SEQ ID NO: 306467 - DNA, 20 bp, Artificial Sequence
  chemically synthesized
catgggcagatcacataaaa

SEQ ID NO: 306468 - DNA, 20 bp, Artificial Sequence
  chemically synthesized
atgggcagatcacataaaac

SEQ ID NO: 306469 - DNA, 20 bp, Artificial Sequence
  chemically synthesized
gggcagatcacataaaacag

SEQ ID NO: 306470 - DNA, 20 bp, Artificial Sequence
  chemically synthesized
ggcagatcacataaaacagg

SEQ ID NO: 306471 - DNA, 20 bp, Artificial Sequence
  chemically synthesized
aaacaggaggaatcataata

SEQ ID NO: 306472 - DNA, 20 bp, Artificial Sequence
  chemically synthesized
aattgacctaatagtagttt

SEQ ID NO: 306473 - DNA, 20 bp, Artificial Sequence
  chemically synthesized
tatagtactaaaactactat

SEQ ID NO: 306474 - DNA, 20 bp, Artificial Sequence
  chemically synthesized
atagtactaaaactactatt

SEQ ID NO: 306475 - DNA, 20 bp, Artificial Sequence
  chemically synthesized
gcaattaattgacctaatag

SEQ ID NO: 306476 - DNA, 20 bp, Artificial Sequence
  chemically synthesized
ttagcaattaattgacctaa

SEQ ID NO: 306477 - DNA, 20 bp, Artificial Sequence
  chemically synthesized
attaggtcaattaattgcta

SEQ ID NO: 306478 - DNA, 20 bp, Artificial Sequence
  chemically synthesized
gttttccattaaacatactt

SEQ ID NO: 306479 - DNA, 20 bp, Artificial Sequence
  chemically synthesized
aattgctaaagtatgtttaa

SEQ ID NO: 306480 - DNA, 20 bp, Artificial Sequence
  chemically synthesized
tatgtttaatggaaaacaaa

SEQ ID NO: 306481 - DNA, 20 bp, Artificial Sequence
  chemically synthesized
tgtttaatggaaaacaaatg

SEQ ID NO: 306482 - DNA, 20 bp, Artificial Sequence
  chemically synthesized
tttattatgtaatgattgtg

SEQ ID NO: 306483 - DNA, 20 bp, Artificial Sequence
  chemically synthesized
ttattatgtaatgattgtgt

SEQ ID NO: 306484 - DNA, 20 bp, Artificial Sequence
  chemically synthesized
cgttaaaaaattataatttg

SEQ ID NO: 306485 - DNA, 20 bp, Artificial Sequence
  chemically synthesized
ataattttttaacgtaaaat

SEQ ID NO: 306486 - DNA, 20 bp, Artificial Sequence
  chemically synthesized
ttaacgtaaaattggattaa

SEQ ID NO: 306487 - DNA, 20 bp, Artificial Sequence
  chemically synthesized
gcctatatgattttcaatca

SEQ ID NO: 306488 - DNA, 20 bp, Artificial Sequence
  chemically synthesized
aactgtgattgaaaatcata

SEQ ID NO: 306489 - DNA, 20 bp, Artificial Sequence
  chemically synthesized
actgtgattgaaaatcatat

SEQ ID NO: 306490 - DNA, 20 bp, Artificial Sequence
  chemically synthesized
tgattgaaaatcatataggc

SEQ ID NO: 306491 - DNA, 20 bp, Artificial Sequence
  chemically synthesized
tttaagacagcgtaataaac

SEQ ID NO: 306492 - DNA, 20 bp, Artificial Sequence
  chemically synthesized
tccaggaatacaatttaaga

SEQ ID NO: 306493 - DNA, 20 bp, Artificial Sequence
  chemically synthesized
tgcctccaggaatacaattt

SEQ ID NO: 306494 - DNA, 20 bp, Artificial Sequence
  chemically synthesized
gctgtcttaaattgtattcc

SEQ ID NO: 306495 - DNA, 20 bp, Artificial Sequence
  chemically synthesized
tgtcttaaattgtattcctg

SEQ ID NO: 306496 - DNA, 20 bp, Artificial Sequence
  chemically synthesized
gtcttaaattgtattcctgg

SEQ ID NO: 306497 - DNA, 20 bp, Artificial Sequence
  chemically synthesized
aagtttgtagtattgcctcc

SEQ ID NO: 306498 - DNA, 20 bp, Artificial Sequence
  chemically synthesized
gaagtttgtagtattgcctc

SEQ ID NO: 306499 - DNA, 20 bp, Artificial Sequence
  chemically synthesized
ttttggagacatgaagtttg

SEQ ID NO: 306500 - DNA, 20 bp, Artificial Sequence
  chemically synthesized
aaatgccttttggagacatg

SEQ ID NO: 306501 - DNA, 20 bp, Artificial Sequence
  chemically synthesized
tacaaacttcatgtctccaa

SEQ ID NO: 306502 - DNA, 20 bp, Artificial Sequence
  chemically synthesized
acaaacttcatgtctccaaa

SEQ ID NO: 306503 - DNA, 20 bp, Artificial Sequence
  chemically synthesized
cacttaggaaatgccttttg

SEQ ID NO: 306504 - DNA, 20 bp, Artificial Sequence
  chemically synthesized
agcacttaggaaatgccttt

SEQ ID NO: 306505 - DNA, 20 bp, Artificial Sequence
  chemically synthesized
gtctccaaaaggcatttcct

SEQ ID NO: 306506 - DNA, 20 bp, Artificial Sequence
  chemically synthesized
acatctgataagtagcactt

SEQ ID NO: 306507 - DNA, 20 bp, Artificial Sequence
  chemically synthesized
gacatctgataagtagcact

SEQ ID NO: 306508 - DNA, 20 bp, Artificial Sequence
  chemically synthesized
atttcctaagtgctacttat

SEQ ID NO: 306509 - DNA, 20 bp, Artificial Sequence
  chemically synthesized
gagacctgacatctgataag

SEQ ID NO: 306510 - DNA, 20 bp, Artificial Sequence
  chemically synthesized
cttgagacctgacatctgat

SEQ ID NO: 306511 - DNA, 20 bp, Artificial Sequence
  chemically synthesized
aagtgctacttatcagatgt

SEQ ID NO: 306512 - DNA, 20 bp, Artificial Sequence
  chemically synthesized
agtgctacttatcagatgtc

SEQ ID NO: 306513 - DNA, 20 bp, Artificial Sequence
  chemically synthesized
cttatcagatgtcaggtctc

SEQ ID NO: 306514 - DNA, 20 bp, Artificial Sequence
  chemically synthesized
tacatggaatttgttttctt

SEQ ID NO: 306515 - DNA, 20 bp, Artificial Sequence
  chemically synthesized
tctatattgagacaagtaca

SEQ ID NO: 306516 - DNA, 20 bp, Artificial Sequence
  chemically synthesized
tatttcctctatattgagac

SEQ ID NO: 306517 - DNA, 20 bp, Artificial Sequence
  chemically synthesized
tccatgtacttgtctcaata

SEQ ID NO: 306518 - DNA, 20 bp, Artificial Sequence
  chemically synthesized
catgtacttgtctcaatata

SEQ ID NO: 306519 - DNA, 20 bp, Artificial Sequence
  chemically synthesized
atgtacttgtctcaatatag

SEQ ID NO: 306520 - DNA, 20 bp, Artificial Sequence
  chemically synthesized
gcaaatatttcctctatatt

SEQ ID NO: 306521 - DNA, 20 bp, Artificial Sequence
  chemically synthesized
ttccatattcaatagatttt

SEQ ID NO: 306522 - DNA, 20 bp, Artificial Sequence
  chemically synthesized
cttccatattcaatagattt

SEQ ID NO: 306523 - DNA, 20 bp, Artificial Sequence
  chemically synthesized
tgcctaaaatctattgaata

SEQ ID NO: 306524 - DNA, 20 bp, Artificial Sequence
  chemically synthesized
gcatacacttccatattcaa

SEQ ID NO: 306525 - DNA, 20 bp, Artificial Sequence
  chemically synthesized
ctaaaatctattgaatatgg

SEQ ID NO: 306526 - DNA, 20 bp, Artificial Sequence
  chemically synthesized
gaagtgtatgcctgtgcatt

SEQ ID NO: 306527 - DNA, 20 bp, Artificial Sequence
  chemically synthesized
aaattcatagctcaatgcac

SEQ ID NO: 306528 - DNA, 20 bp, Artificial Sequence
  chemically synthesized
aaaattcatagctcaatgca

SEQ ID NO: 306529 - DNA, 20 bp, Artificial Sequence
  chemically synthesized
ataactttactcaaaattca

SEQ ID NO: 306530 - DNA, 20 bp, Artificial Sequence
  chemically synthesized
tgcattgagctatgaatttt

SEQ ID NO: 306531 - DNA, 20 bp, Artificial Sequence
  chemically synthesized
tgagctatgaattttgagta

SEQ ID NO: 306532 - DNA, 20 bp, Artificial Sequence
  chemically synthesized
ccacatagcctggcattata

SEQ ID NO: 306533 - DNA, 20 bp, Artificial Sequence
  chemically synthesized
aaagttattccttataatgc

SEQ ID NO: 306534 - DNA, 20 bp, Artificial Sequence
  chemically synthesized
gccacatagcctggcattat

SEQ ID NO: 306535 - DNA, 20 bp, Artificial Sequence
  chemically synthesized
aagttattccttataatgcc

SEQ ID NO: 306536 - DNA, 20 bp, Artificial Sequence
  chemically synthesized
ccttataatgccaggctatg

SEQ ID NO: 306537 - DNA, 20 bp, Artificial Sequence
  chemically synthesized
acatattctgccacatagcc

SEQ ID NO: 306538 - DNA, 20 bp, Artificial Sequence
  chemically synthesized
tataatgccaggctatgtgg

SEQ ID NO: 306539 - DNA, 20 bp, Artificial Sequence
  chemically synthesized
atttaacatattctgccaca

SEQ ID NO: 306540 - DNA, 20 bp, Artificial Sequence
  chemically synthesized
gatataaacattatatataa

SEQ ID NO: 306541 - DNA, 20 bp, Artificial Sequence
  chemically synthesized
agaataatgagtagtcattc

SEQ ID NO: 306542 - DNA, 20 bp, Artificial Sequence
  chemically synthesized
ttggatggtagaataatgag

SEQ ID NO: 306543 - DNA, 20 bp, Artificial Sequence
  chemically synthesized
tagttggatggtagaataat

SEQ ID NO: 306544 - DNA, 20 bp, Artificial Sequence
  chemically synthesized
tgtcttatgtagttggatgg

SEQ ID NO: 306545 - DNA, 20 bp, Artificial Sequence
  chemically synthesized
ttttgtcttatgtagttgga

SEQ ID NO: 306546 - DNA, 20 bp, Artificial Sequence
  chemically synthesized
attctaccatccaactacat

SEQ ID NO: 306547 - DNA, 20 bp, Artificial Sequence
  chemically synthesized
ctctttttgtcttatgtagt

SEQ ID NO: 306548 - DNA, 20 bp, Artificial Sequence
  chemically synthesized
gaacctctttttgtcttatg

SEQ ID NO: 306549 - DNA, 20 bp, Artificial Sequence
  chemically synthesized
atccaactacataagacaaa

SEQ ID NO: 306550 - DNA, 20 bp, Artificial Sequence
  chemically synthesized
ccaactacataagacaaaaa

SEQ ID NO: 306551 - DNA, 20 bp, Artificial Sequence
  chemically synthesized
caactacataagacaaaaag

SEQ ID NO: 306552 - DNA, 20 bp, Artificial Sequence
  chemically synthesized
ctaaaatggggtatcgttaa

SEQ ID NO: 306553 - DNA, 20 bp, Artificial Sequence
  chemically synthesized
cttttaacgataccccattt

SEQ ID NO: 306554 - DNA, 20 bp, Artificial Sequence
  chemically synthesized
aagatttagtcactaaaatg

SEQ ID NO: 306555 - DNA, 20 bp, Artificial Sequence
  chemically synthesized
aaagatttagtcactaaaat

SEQ ID NO: 306556 - DNA, 20 bp, Artificial Sequence
  chemically synthesized
taaagatttagtcactaaaa

SEQ ID NO: 306557 - DNA, 20 bp, Artificial Sequence
  chemically synthesized
tataataatttttaaagatt

SEQ ID NO: 306558 - DNA, 20 bp, Artificial Sequence
  chemically synthesized
ttttattataataattttta

SEQ ID NO: 306559 - DNA, 20 bp, Artificial Sequence
  chemically synthesized
tcagctacatttggggtatg

SEQ ID NO: 306560 - DNA, 20 bp, Artificial Sequence
  chemically synthesized
aaaaccacataccccaaatg

SEQ ID NO: 306561 - DNA, 20 bp, Artificial Sequence
  chemically synthesized
aaacatctcagctacatttg

SEQ ID NO: 306562 - DNA, 20 bp, Artificial Sequence
  chemically synthesized
aaaacatctcagctacattt

SEQ ID NO: 306563 - DNA, 20 bp, Artificial Sequence
  chemically synthesized
gaaaacatctcagctacatt

SEQ ID NO: 306564 - DNA, 20 bp, Artificial Sequence
  chemically synthesized
cacataccccaaatgtagct

SEQ ID NO: 306565 - DNA, 20 bp, Artificial Sequence
  chemically synthesized
tgtagattatgaaaacatct

SEQ ID NO: 306566 - DNA, 20 bp, Artificial Sequence
  chemically synthesized
tgagatgttttcataatcta

SEQ ID NO: 306567 - DNA, 20 bp, Artificial Sequence
  chemically synthesized
atactaacacatacgggctg

SEQ ID NO: 306568 - DNA, 20 bp, Artificial Sequence
  chemically synthesized
ttagttatactaacacatac

SEQ ID NO: 306569 - DNA, 20 bp, Artificial Sequence
  chemically synthesized
aatctacagcccgtatgtgt

SEQ ID NO: 306570 - DNA, 20 bp, Artificial Sequence
  chemically synthesized
cttagttatactaacacata

SEQ ID NO: 306571 - DNA, 20 bp, Artificial Sequence
  chemically synthesized
ccgtatgtgttagtataact

SEQ ID NO: 306572 - DNA, 20 bp, Artificial Sequence
  chemically synthesized
ataaaattatgaatgtggct

SEQ ID NO: 306573 - DNA, 20 bp, Artificial Sequence
  chemically synthesized
atttcataaaattatgaatg

SEQ ID NO: 306574 - DNA, 20 bp, Artificial Sequence
  chemically synthesized
cattcataattttatgaaat

SEQ ID NO: 306575 - DNA, 20 bp, Artificial Sequence
  chemically synthesized
tcataattttatgaaatcag

SEQ ID NO: 306576 - DNA, 20 bp, Artificial Sequence
  chemically synthesized
tttatgaaatcagcagtcta

SEQ ID NO: 306577 - DNA, 20 bp, Artificial Sequence
  chemically synthesized
atgaaatcagcagtctatgg

SEQ ID NO: 306578 - DNA, 20 bp, Artificial Sequence
  chemically synthesized
ctattgtaccttttctgcca

SEQ ID NO: 306579 - DNA, 20 bp, Artificial Sequence
  chemically synthesized
atcagcagtctatggcagaa

SEQ ID NO: 306580 - DNA, 20 bp, Artificial Sequence
  chemically synthesized
tcagcagtctatggcagaaa

SEQ ID NO: 306581 - DNA, 20 bp, Artificial Sequence
  chemically synthesized
ctatggcagaaaaggtacaa

SEQ ID NO: 306582 - DNA, 20 bp, Artificial Sequence
  chemically synthesized
ggcagaaaaggtacaatagt

SEQ ID NO: 306583 - DNA, 20 bp, Artificial Sequence
  chemically synthesized
tggaaagttttttattagtg

SEQ ID NO: 306584 - DNA, 20 bp, Artificial Sequence
  chemically synthesized
tttcttggaaagttttttat

SEQ ID NO: 306585 - DNA, 20 bp, Artificial Sequence
  chemically synthesized
acactaataaaaaactttcc

SEQ ID NO: 306586 - DNA, 20 bp, Artificial Sequence
  chemically synthesized
aggtcttttgatttcttgga

SEQ ID NO: 306587 - DNA, 20 bp, Artificial Sequence
  chemically synthesized
gttcaggtcttttgatttct

SEQ ID NO: 306588 - DNA, 20 bp, Artificial Sequence
  chemically synthesized
aaaactttccaagaaatcaa

SEQ ID NO: 306589 - DNA, 20 bp, Artificial Sequence
  chemically synthesized
aaatcaaaagacctgaaccc

SEQ ID NO: 306590 - DNA, 20 bp, Artificial Sequence
  chemically synthesized
tggtaggagaactagggttc

SEQ ID NO: 306591 - DNA, 20 bp, Artificial Sequence
  chemically synthesized
gtggtaggagaactagggtt

SEQ ID NO: 306592 - DNA, 20 bp, Artificial Sequence
  chemically synthesized
agttagtggtaggagaacta

SEQ ID NO: 306593 - DNA, 20 bp, Artificial Sequence
  chemically synthesized
aagttagtggtaggagaact

SEQ ID NO: 306594 - DNA, 20 bp, Artificial Sequence
  chemically synthesized
gaagttagtggtaggagaac

SEQ ID NO: 306595 - DNA, 20 bp, Artificial Sequence
  chemically synthesized
tcaagagaagttagtggtag

SEQ ID NO: 306596 - DNA, 20 bp, Artificial Sequence
  chemically synthesized
tttcaagagaagttagtggt

SEQ ID NO: 306597 - DNA, 20 bp, Artificial Sequence
  chemically synthesized
ttttcaagagaagttagtgg

SEQ ID NO: 306598 - DNA, 20 bp, Artificial Sequence
  chemically synthesized
aatttttcaagagaagttag

SEQ ID NO: 306599 - DNA, 20 bp, Artificial Sequence
  chemically synthesized
gtaaatttttcaagagaagt

SEQ ID NO: 306600 - DNA, 20 bp, Artificial Sequence
  chemically synthesized
aaaagtaaatttttcaagag

SEQ ID NO: 306601 - DNA, 20 bp, Artificial Sequence
  chemically synthesized
aagaaaagtaaatttttcaa

SEQ ID NO: 306602 - DNA, 20 bp, Artificial Sequence
  chemically synthesized
ggaagaaaagtaaatttttc

SEQ ID NO: 306603 - DNA, 20 bp, Artificial Sequence
  chemically synthesized
aaatgaaacttagggaagaa

SEQ ID NO: 306604 - DNA, 20 bp, Artificial Sequence
  chemically synthesized
aaaatttacttttcttccct

SEQ ID NO: 306605 - DNA, 20 bp, Artificial Sequence
  chemically synthesized
gagaaaaatgaaacttaggg

SEQ ID NO: 306606 - DNA, 20 bp, Artificial Sequence
  chemically synthesized
cttgagaaaaatgaaactta

SEQ ID NO: 306607 - DNA, 20 bp, Artificial Sequence
  chemically synthesized
tcttgagaaaaatgaaactt

SEQ ID NO: 306608 - DNA, 20 bp, Artificial Sequence
  chemically synthesized
ctcttgagaaaaatgaaact

SEQ ID NO: 306609 - DNA, 20 bp, Artificial Sequence
  chemically synthesized
ccctaagtttcatttttctc

SEQ ID NO: 306610 - DNA, 20 bp, Artificial Sequence
  chemically synthesized
ctaagtttcatttttctcaa

SEQ ID NO: 306611 - DNA, 20 bp, Artificial Sequence
  chemically synthesized
gccaactccgttttactctt

SEQ ID NO: 306612 - DNA, 20 bp, Artificial Sequence
  chemically synthesized
catttttctcaagagtaaaa

SEQ ID NO: 306613 - DNA, 20 bp, Artificial Sequence
  chemically synthesized
tttttctcaagagtaaaacg

SEQ ID NO: 306614 - DNA, 20 bp, Artificial Sequence
  chemically synthesized
tctcaagagtaaaacggagt

SEQ ID NO: 306615 - DNA, 20 bp, Artificial Sequence
  chemically synthesized
gctagaaccacgaggaacat

SEQ ID NO: 306616 - DNA, 20 bp, Artificial Sequence
  chemically synthesized
gagttggctaatgttcctcg

SEQ ID NO: 306617 - DNA, 20 bp, Artificial Sequence
  chemically synthesized
cagagattgctagaaccacg

SEQ ID NO: 306618 - DNA, 20 bp, Artificial Sequence
  chemically synthesized
gctaatgttcctcgtggttc

SEQ ID NO: 306619 - DNA, 20 bp, Artificial Sequence
  chemically synthesized
tcagagattgctagaaccac

SEQ ID NO: 306620 - DNA, 20 bp, Artificial Sequence
  chemically synthesized
aaccccaaatcagagattgc

SEQ ID NO: 306621 - DNA, 20 bp, Artificial Sequence
  chemically synthesized
ggttctagcaatctctgatt

SEQ ID NO: 306622 - DNA, 20 bp, Artificial Sequence
  chemically synthesized
gttctagcaatctctgattt

SEQ ID NO: 306623 - DNA, 20 bp, Artificial Sequence
  chemically synthesized
ttctagcaatctctgatttg

SEQ ID NO: 306624 - DNA, 20 bp, Artificial Sequence
  chemically synthesized
cacagtctaaccccaaatca

SEQ ID NO: 306625 - DNA, 20 bp, Artificial Sequence
  chemically synthesized
atcacagtctaaccccaaat

SEQ ID NO: 306626 - DNA, 20 bp, Artificial Sequence
  chemically synthesized
agcaatctctgatttggggt

SEQ ID NO: 306627 - DNA, 20 bp, Artificial Sequence
  chemically synthesized
tgctgggaactgtataatca

SEQ ID NO: 306628 - DNA, 20 bp, Artificial Sequence
  chemically synthesized
ggggttagactgtgattata

SEQ ID NO: 306629 - DNA, 20 bp, Artificial Sequence
  chemically synthesized
gactgtgattatacagttcc

SEQ ID NO: 306630 - DNA, 20 bp, Artificial Sequence
  chemically synthesized
gagcaggcgaacaaaatgct

SEQ ID NO: 306631 - DNA, 20 bp, Artificial Sequence
  chemically synthesized
agagcaggcgaacaaaatgc

SEQ ID NO: 306632 - DNA, 20 bp, Artificial Sequence
  chemically synthesized
gcattttgttcgcctgctct

SEQ ID NO: 306633 - DNA, 20 bp, Artificial Sequence
  chemically synthesized
ggaactgagtgacttagagc

SEQ ID NO: 306634 - DNA, 20 bp, Artificial Sequence
  chemically synthesized
gggaactgagtgacttagag

SEQ ID NO: 306635 - DNA, 20 bp, Artificial Sequence
  chemically synthesized
acggggaactgagtgactta

SEQ ID NO: 306636 - DNA, 20 bp, Artificial Sequence
  chemically synthesized
ttcgcctgctctaagtcact

SEQ ID NO: 306637 - DNA, 20 bp, Artificial Sequence
  chemically synthesized
taacggggaactgagtgact

SEQ ID NO: 306638 - DNA, 20 bp, Artificial Sequence
  chemically synthesized
cccaatagtaacggggaact

SEQ ID NO: 306639 - DNA, 20 bp, Artificial Sequence
  chemically synthesized
cttccagcccaatagtaacg

SEQ ID NO: 306640 - DNA, 20 bp, Artificial Sequence
  chemically synthesized
tcttccagcccaatagtaac

SEQ ID NO: 306641 - DNA, 20 bp, Artificial Sequence
  chemically synthesized
actcagttccccgttactat

SEQ ID NO: 306642 - DNA, 20 bp, Artificial Sequence
  chemically synthesized
ttcttccagcccaatagtaa

SEQ ID NO: 306643 - DNA, 20 bp, Artificial Sequence
  chemically synthesized
ctcagttccccgttactatt

SEQ ID NO: 306644 - DNA, 20 bp, Artificial Sequence
  chemically synthesized
gttccccgttactattgggc

SEQ ID NO: 306645 - DNA, 20 bp, Artificial Sequence
  chemically synthesized
gtgaatttcttccagcccaa

SEQ ID NO: 306646 - DNA, 20 bp, Artificial Sequence
  chemically synthesized
ccccgttactattgggctgg

SEQ ID NO: 306647 - DNA, 20 bp, Artificial Sequence
  chemically synthesized
gccctagagtgaatttcttc

SEQ ID NO: 306648 - DNA, 20 bp, Artificial Sequence
  chemically synthesized
gggctggaagaaattcactc

SEQ ID NO: 306649 - DNA, 20 bp, Artificial Sequence
  chemically synthesized
ggctggaagaaattcactct

SEQ ID NO: 306650 - DNA, 20 bp, Artificial Sequence
  chemically synthesized
gctggaagaaattcactcta

SEQ ID NO: 306651 - DNA, 20 bp, Artificial Sequence
  chemically synthesized
ggaagaaattcactctaggg

SEQ ID NO: 306652 - DNA, 20 bp, Artificial Sequence
  chemically synthesized
ctgaacttgttactgcccta

SEQ ID NO: 306653 - DNA, 20 bp, Artificial Sequence
  chemically synthesized
aactgaacttgttactgccc

SEQ ID NO: 306654 - DNA, 20 bp, Artificial Sequence
  chemically synthesized
attcactctagggcagtaac

SEQ ID NO: 306655 - DNA, 20 bp, Artificial Sequence
  chemically synthesized
ctctagggcagtaacaagtt

SEQ ID NO: 306656 - DNA, 20 bp, Artificial Sequence
  chemically synthesized
cagtaacaagttcagttaat

SEQ ID NO: 306657 - DNA, 20 bp, Artificial Sequence
  chemically synthesized
tggagaatggtggtgaggta

SEQ ID NO: 306658 - DNA, 20 bp, Artificial Sequence
  chemically synthesized
gttggagaatggtggtgagg

SEQ ID NO: 306659 - DNA, 20 bp, Artificial Sequence
  chemically synthesized
gttgttggagaatggtggtg

SEQ ID NO: 306660 - DNA, 20 bp, Artificial Sequence
  chemically synthesized
tgttgttggagaatggtggt

SEQ ID NO: 306661 - DNA, 20 bp, Artificial Sequence
  chemically synthesized
gtcttgttgttggagaatgg

SEQ ID NO: 306662 - DNA, 20 bp, Artificial Sequence
  chemically synthesized
cctgtcttgttgttggagaa

SEQ ID NO: 306663 - DNA, 20 bp, Artificial Sequence
  chemically synthesized
caccaccattctccaacaac

SEQ ID NO: 306664 - DNA, 20 bp, Artificial Sequence
  chemically synthesized
ttttgcctgtcttgttgttg

SEQ ID NO: 306665 - DNA, 20 bp, Artificial Sequence
  chemically synthesized
tcttttgcctgtcttgttgt

SEQ ID NO: 306666 - DNA, 20 bp, Artificial Sequence
  chemically synthesized
accattctccaacaacaaga

SEQ ID NO: 306667 - DNA, 20 bp, Artificial Sequence
  chemically synthesized
ccattctccaacaacaagac

SEQ ID NO: 306668 - DNA, 20 bp, Artificial Sequence
  chemically synthesized
tccaacaacaagacaggcaa

SEQ ID NO: 306669 - DNA, 20 bp, Artificial Sequence
  chemically synthesized
tgtttttatttaactaaaca

SEQ ID NO: 306670 - DNA, 20 bp, Artificial Sequence
  chemically synthesized
gtttttatttaactaaacac

SEQ ID NO: 306671 - DNA, 20 bp, Artificial Sequence
  chemically synthesized
tttttatttaactaaacaca

SEQ ID NO: 306672 - DNA, 20 bp, Artificial Sequence
  chemically synthesized
attagtttttgccctgtgtt

SEQ ID NO: 306673 - DNA, 20 bp, Artificial Sequence
  chemically synthesized
acacagggcaaaaactaatc

SEQ ID NO: 306674 - DNA, 20 bp, Artificial Sequence
  chemically synthesized
tacaaaagaagcaaccagat

SEQ ID NO: 306675 - DNA, 20 bp, Artificial Sequence
  chemically synthesized
aaccctacaaaagaagcaac

SEQ ID NO: 306676 - DNA, 20 bp, Artificial Sequence
  chemically synthesized
taatctggttgcttcttttg

SEQ ID NO: 306677 - DNA, 20 bp, Artificial Sequence
  chemically synthesized
aatctggttgcttcttttgt

SEQ ID NO: 306678 - DNA, 20 bp, Artificial Sequence
  chemically synthesized
acattataaccctacaaaag

SEQ ID NO: 306679 - DNA, 20 bp, Artificial Sequence
  chemically synthesized
atctggttgcttcttttgta

SEQ ID NO: 306680 - DNA, 20 bp, Artificial Sequence
  chemically synthesized
gtgacattataaccctacaa

SEQ ID NO: 306681 - DNA, 20 bp, Artificial Sequence
  chemically synthesized
tttttaaacctgcattaaga

SEQ ID NO: 306682 - DNA, 20 bp, Artificial Sequence
  chemically synthesized
ataatgtcactctcttaatg

SEQ ID NO: 306683 - DNA, 20 bp, Artificial Sequence
  chemically synthesized
taatgtcactctcttaatgc

SEQ ID NO: 306684 - DNA, 20 bp, Artificial Sequence
  chemically synthesized
attttttaaacctgcattaa

SEQ ID NO: 306685 - DNA, 20 bp, Artificial Sequence
  chemically synthesized
agattttttaaacctgcatt

SEQ ID NO: 306686 - DNA, 20 bp, Artificial Sequence
  chemically synthesized
tgcaggtttaaaaaatctct

SEQ ID NO: 306687 - DNA, 20 bp, Artificial Sequence
  chemically synthesized
ggtttaaaaaatctctgaga

SEQ ID NO: 306688 - DNA, 20 bp, Artificial Sequence
  chemically synthesized
tcatgctacagactatctca

SEQ ID NO: 306689 - DNA, 20 bp, Artificial Sequence
  chemically synthesized
tatcatgctacagactatct

SEQ ID NO: 306690 - DNA, 20 bp, Artificial Sequence
  chemically synthesized
aaaatctctgagatagtctg

SEQ ID NO: 306691 - DNA, 20 bp, Artificial Sequence
  chemically synthesized
tgataccaattatcatgcta

SEQ ID NO: 306692 - DNA, 20 bp, Artificial Sequence
  chemically synthesized
atagtctgtagcatgataat

SEQ ID NO: 306693 - DNA, 20 bp, Artificial Sequence
  chemically synthesized
gaaaagagtacagcacaggt

SEQ ID NO: 306694 - DNA, 20 bp, Artificial Sequence
  chemically synthesized
acttgaaaagagtacagcac

SEQ ID NO: 306695 - DNA, 20 bp, Artificial Sequence
  chemically synthesized
aacttgaaaagagtacagca

SEQ ID NO: 306696 - DNA, 20 bp, Artificial Sequence
  chemically synthesized
ccaaaaacttgaaaagagta

SEQ ID NO: 306697 - DNA, 20 bp, Artificial Sequence
  chemically synthesized
acctgtgctgtactcttttc

SEQ ID NO: 306698 - DNA, 20 bp, Artificial Sequence
  chemically synthesized
ttagtccaaaaacttgaaaa

SEQ ID NO: 306699 - DNA, 20 bp, Artificial Sequence
  chemically synthesized
atttagtccaaaaacttgaa

SEQ ID NO: 306700 - DNA, 20 bp, Artificial Sequence
  chemically synthesized
ctgtactcttttcaagtttt

SEQ ID NO: 306701 - DNA, 20 bp, Artificial Sequence
  chemically synthesized
tgcccggtgttgggataatt

SEQ ID NO: 306702 - DNA, 20 bp, Artificial Sequence
  chemically synthesized
ggactaaattatcccaacac

SEQ ID NO: 306703 - DNA, 20 bp, Artificial Sequence
  chemically synthesized
gactaaattatcccaacacc

SEQ ID NO: 306704 - DNA, 20 bp, Artificial Sequence
  chemically synthesized
ggataactttgcccggtgtt

SEQ ID NO: 306705 - DNA, 20 bp, Artificial Sequence
  chemically synthesized
tggataactttgcccggtgt

SEQ ID NO: 306706 - DNA, 20 bp, Artificial Sequence
  chemically synthesized
aattatcccaacaccgggca

SEQ ID NO: 306707 - DNA, 20 bp, Artificial Sequence
  chemically synthesized
catggctggataactttgcc

SEQ ID NO: 306708 - DNA, 20 bp, Artificial Sequence
  chemically synthesized
caacaccgggcaaagttatc

SEQ ID NO: 306709 - DNA, 20 bp, Artificial Sequence
  chemically synthesized
ccagaagacggaagcatggc

SEQ ID NO: 306710 - DNA, 20 bp, Artificial Sequence
  chemically synthesized
tgacccagaagacggaagca

SEQ ID NO: 306711 - DNA, 20 bp, Artificial Sequence
  chemically synthesized
gtcagtgacccagaagacgg

SEQ ID NO: 306712 - DNA, 20 bp, Artificial Sequence
  chemically synthesized
ccagccatgcttccgtcttc

SEQ ID NO: 306713 - DNA, 20 bp, Artificial Sequence
  chemically synthesized
cagccatgcttccgtcttct

SEQ ID NO: 306714 - DNA, 20 bp, Artificial Sequence
  chemically synthesized
taagtcagtgacccagaaga

SEQ ID NO: 306715 - DNA, 20 bp, Artificial Sequence
  chemically synthesized
agaataagtcagtgacccag

SEQ ID NO: 306716 - DNA, 20 bp, Artificial Sequence
  chemically synthesized
tgaagaataagtcagtgacc

SEQ ID NO: 306717 - DNA, 20 bp, Artificial Sequence
  chemically synthesized
ttcaacactgaagaataagt

SEQ ID NO: 306718 - DNA, 20 bp, Artificial Sequence
  chemically synthesized
tgggtcactgacttattctt

SEQ ID NO: 306719 - DNA, 20 bp, Artificial Sequence
  chemically synthesized
ttctttcaacactgaagaat

SEQ ID NO: 306720 - DNA, 20 bp, Artificial Sequence
  chemically synthesized
aagatcttctttcaacactg

SEQ ID NO: 306721 - DNA, 20 bp, Artificial Sequence
  chemically synthesized
gacttattcttcagtgttga

SEQ ID NO: 306722 - DNA, 20 bp, Artificial Sequence
  chemically synthesized
ttattcttcagtgttgaaag

SEQ ID NO: 306723 - DNA, 20 bp, Artificial Sequence
  chemically synthesized
gttgaaagaagatcttgttt

SEQ ID NO: 306724 - DNA, 20 bp, Artificial Sequence
  chemically synthesized
caaactgtattcactcaaac

SEQ ID NO: 306725 - DNA, 20 bp, Artificial Sequence
  chemically synthesized
agatcttgtttgagtgaata

SEQ ID NO: 306726 - DNA, 20 bp, Artificial Sequence
  chemically synthesized
gagtgaatacagtttgccca

SEQ ID NO: 306727 - DNA, 20 bp, Artificial Sequence
  chemically synthesized
gaaaagaaaaagcaatccat

SEQ ID NO: 306728 - DNA, 20 bp, Artificial Sequence
  chemically synthesized
agaaaagaaaaagcaatcca

SEQ ID NO: 306729 - DNA, 20 bp, Artificial Sequence
  chemically synthesized
aagcggatctagaaaagaaa

SEQ ID NO: 306730 - DNA, 20 bp, Artificial Sequence
  chemically synthesized
atggattgctttttcttttc

SEQ ID NO: 306731 - DNA, 20 bp, Artificial Sequence
  chemically synthesized
ttttaaaagcggatctagaa

SEQ ID NO: 306732 - DNA, 20 bp, Artificial Sequence
  chemically synthesized
acaggttttaaaagcggatc

SEQ ID NO: 306733 - DNA, 20 bp, Artificial Sequence
  chemically synthesized
gttttaacaggttttaaaag

SEQ ID NO: 306734 - DNA, 20 bp, Artificial Sequence
  chemically synthesized
cttgttttaacaggttttaa

SEQ ID NO: 306735 - DNA, 20 bp, Artificial Sequence
  chemically synthesized
gtgatctttcttgttttaac

SEQ ID NO: 306736 - DNA, 20 bp, Artificial Sequence
  chemically synthesized
cttttaaaacctgttaaaac

SEQ ID NO: 306737 - DNA, 20 bp, Artificial Sequence
  chemically synthesized
tgtgatctttcttgttttaa

SEQ ID NO: 306738 - DNA, 20 bp, Artificial Sequence
  chemically synthesized
taaaacctgttaaaacaaga

SEQ ID NO: 306739 - DNA, 20 bp, Artificial Sequence
  chemically synthesized
tgttaaaacaagaaagatca

SEQ ID NO: 306740 - DNA, 20 bp, Artificial Sequence
  chemically synthesized
aacaagaaagatcacagaat

SEQ ID NO: 306741 - DNA, 20 bp, Artificial Sequence
  chemically synthesized
gaaagatcacagaataagcc

SEQ ID NO: 306742 - DNA, 20 bp, Artificial Sequence
  chemically synthesized
aaagatcacagaataagcct

SEQ ID NO: 306743 - DNA, 20 bp, Artificial Sequence
  chemically synthesized
tggtgtatggaatgcaaccc

SEQ ID NO: 306744 - DNA, 20 bp, Artificial Sequence
  chemically synthesized
gtggtgtatggaatgcaacc

SEQ ID NO: 306745 - DNA, 20 bp, Artificial Sequence
  chemically synthesized
gattgaactatagtggtgta

SEQ ID NO: 306746 - DNA, 20 bp, Artificial Sequence
  chemically synthesized
ttgcattccatacaccacta

SEQ ID NO: 306747 - DNA, 20 bp, Artificial Sequence
  chemically synthesized
aaaagcagattgaactatag

SEQ ID NO: 306748 - DNA, 20 bp, Artificial Sequence
  chemically synthesized
cgcaaaagcagattgaacta

SEQ ID NO: 306749 - DNA, 20 bp, Artificial Sequence
  chemically synthesized
tgagcaaatacacgcaaaag

SEQ ID NO: 306750 - DNA, 20 bp, Artificial Sequence
  chemically synthesized
aaatgagcaaatacacgcaa

SEQ ID NO: 306751 - DNA, 20 bp, Artificial Sequence
  chemically synthesized
cgtgtatttgctcatttgca

SEQ ID NO: 306752 - DNA, 20 bp, Artificial Sequence
  chemically synthesized
attttcttatctatgcaaat

SEQ ID NO: 306753 - DNA, 20 bp, Artificial Sequence
  chemically synthesized
atttgctcatttgcatagat

SEQ ID NO: 306754 - DNA, 20 bp, Artificial Sequence
  chemically synthesized
atatttcaatcgtgcccgca

SEQ ID NO: 306755 - DNA, 20 bp, Artificial Sequence
  chemically synthesized
tatttcaatcgtgcccgcaa

SEQ ID NO: 306756 - DNA, 20 bp, Artificial Sequence
  chemically synthesized
ctgaacttttgatcctttgc

SEQ ID NO: 306757 - DNA, 20 bp, Artificial Sequence
  chemically synthesized
tctgaacttttgatcctttg

SEQ ID NO: 306758 - DNA, 20 bp, Artificial Sequence
  chemically synthesized
tcgtgcccgcaaaggatcaa

SEQ ID NO: 306759 - DNA, 20 bp, Artificial Sequence
  chemically synthesized
cccgcaaaggatcaaaagtt

SEQ ID NO: 306760 - DNA, 20 bp, Artificial Sequence
  chemically synthesized
ggatcaaaagttcagaaaaa

SEQ ID NO: 306761 - DNA, 20 bp, Artificial Sequence
  chemically synthesized
atcaaaagttcagaaaaata

SEQ ID NO: 306762 - DNA, 20 bp, Artificial Sequence
  chemically synthesized
tcaaaagttcagaaaaatag

SEQ ID NO: 306763 - DNA, 20 bp, Artificial Sequence
  chemically synthesized
aaagttcagaaaaatagagg

SEQ ID NO: 306764 - DNA, 20 bp, Artificial Sequence
  chemically synthesized
ttcagaaaaatagaggtaga

SEQ ID NO: 306765 - DNA, 20 bp, Artificial Sequence
  chemically synthesized
aacttcttgggataattaga

SEQ ID NO: 306766 - DNA, 20 bp, Artificial Sequence
  chemically synthesized
ttcaaacttcttgggataat

SEQ ID NO: 306767 - DNA, 20 bp, Artificial Sequence
  chemically synthesized
ataatctatctaattatccc

SEQ ID NO: 306768 - DNA, 20 bp, Artificial Sequence
  chemically synthesized
atctatctaattatcccaag

SEQ ID NO: 306769 - DNA, 20 bp, Artificial Sequence
  chemically synthesized
cttttctcttcaaacttctt

SEQ ID NO: 306770 - DNA, 20 bp, Artificial Sequence
  chemically synthesized
tcttttctcttcaaacttct

SEQ ID NO: 306771 - DNA, 20 bp, Artificial Sequence
  chemically synthesized
taattatcccaagaagtttg

SEQ ID NO: 306772 - DNA, 20 bp, Artificial Sequence
  chemically synthesized
attatcccaagaagtttgaa

SEQ ID NO: 306773 - DNA, 20 bp, Artificial Sequence
  chemically synthesized
cccaagaagtttgaagagaa

SEQ ID NO: 306774 - DNA, 20 bp, Artificial Sequence
  chemically synthesized
aagaagtttgaagagaaaag

SEQ ID NO: 306775 - DNA, 20 bp, Artificial Sequence
  chemically synthesized
gaagtttgaagagaaaagaa

SEQ ID NO: 306776 - DNA, 20 bp, Artificial Sequence
  chemically synthesized
ttgaagagaaaagaagagaa

SEQ ID NO: 306777 - DNA, 20 bp, Artificial Sequence
  chemically synthesized
agagaaaagaaactcaaacg

SEQ ID NO: 306778 - DNA, 20 bp, Artificial Sequence
  chemically synthesized
taggtctttattctacgttt

SEQ ID NO: 306779 - DNA, 20 bp, Artificial Sequence
  chemically synthesized
agaaactcaaacgtagaata

SEQ ID NO: 306780 - DNA, 20 bp, Artificial Sequence
  chemically synthesized
aacgtagaataaagacctac

SEQ ID NO: 306781 - DNA, 20 bp, Artificial Sequence
  chemically synthesized
cgtagaataaagacctacta

SEQ ID NO: 306782 - DNA, 20 bp, Artificial Sequence
  chemically synthesized
gtagaataaagacctactag

SEQ ID NO: 306783 - DNA, 20 bp, Artificial Sequence
  chemically synthesized
agctcttaattacctctagt

SEQ ID NO: 306784 - DNA, 20 bp, Artificial Sequence
  chemically synthesized
tagctcttaattacctctag

SEQ ID NO: 306785 - DNA, 20 bp, Artificial Sequence
  chemically synthesized
aggtagctcttaattacctc

SEQ ID NO: 306786 - DNA, 20 bp, Artificial Sequence
  chemically synthesized
aagacctactagaggtaatt

SEQ ID NO: 306787 - DNA, 20 bp, Artificial Sequence
  chemically synthesized
gacctactagaggtaattaa

SEQ ID NO: 306788 - DNA, 20 bp, Artificial Sequence
  chemically synthesized
tttcttcaaatatttcaagg

SEQ ID NO: 306789 - DNA, 20 bp, Artificial Sequence
  chemically synthesized
gattttcttcaaatatttca

SEQ ID NO: 306790 - DNA, 20 bp, Artificial Sequence
  chemically synthesized
ggattttcttcaaatatttc

SEQ ID NO: 306791 - DNA, 20 bp, Artificial Sequence
  chemically synthesized
gagctaccttgaaatatttg

SEQ ID NO: 306792 - DNA, 20 bp, Artificial Sequence
  chemically synthesized
gaaatatttgaagaaaatcc

SEQ ID NO: 306793 - DNA, 20 bp, Artificial Sequence
  chemically synthesized
ttgaagaaaatccaagtgaa

SEQ ID NO: 306794 - DNA, 20 bp, Artificial Sequence
  chemically synthesized
tgaagaaaatccaagtgaaa

SEQ ID NO: 306795 - DNA, 20 bp, Artificial Sequence
  chemically synthesized
agcaatattaccttttcact

SEQ ID NO: 306796 - DNA, 20 bp, Artificial Sequence
  chemically synthesized
aaaaggtaatattgcttcaa

SEQ ID NO: 306797 - DNA, 20 bp, Artificial Sequence
  chemically synthesized
aaaggtaatattgcttcaaa

SEQ ID NO: 306798 - DNA, 20 bp, Artificial Sequence
  chemically synthesized
gatctctgttttgccttttg

SEQ ID NO: 306799 - DNA, 20 bp, Artificial Sequence
  chemically synthesized
tattgcttcaaaaggcaaaa

SEQ ID NO: 306800 - DNA, 20 bp, Artificial Sequence
  chemically synthesized
ttgcttcaaaaggcaaaaca

SEQ ID NO: 306801 - DNA, 20 bp, Artificial Sequence
  chemically synthesized
gcaaaacagagatcaacatg

SEQ ID NO: 306802 - DNA, 20 bp, Artificial Sequence
  chemically synthesized
agagatcaacatgtggaaat

SEQ ID NO: 306803 - DNA, 20 bp, Artificial Sequence
  chemically synthesized
gatcaacatgtggaaattag

SEQ ID NO: 306804 - DNA, 20 bp, Artificial Sequence
  chemically synthesized
atcaacatgtggaaattaga

SEQ ID NO: 306805 - DNA, 20 bp, Artificial Sequence
  chemically synthesized
catgtggaaattagaaggca

SEQ ID NO: 306806 - DNA, 20 bp, Artificial Sequence
  chemically synthesized
aaattagaaggcacggatct

SEQ ID NO: 306807 - DNA, 20 bp, Artificial Sequence
  chemically synthesized
caggaattaaggggaaatcc

SEQ ID NO: 306808 - DNA, 20 bp, Artificial Sequence
  chemically synthesized
gaattccgtcaggaattaag

SEQ ID NO: 306809 - DNA, 20 bp, Artificial Sequence
  chemically synthesized
tgaattccgtcaggaattaa

SEQ ID NO: 306810 - DNA, 20 bp, Artificial Sequence
  chemically synthesized
ttgaattccgtcaggaatta

SEQ ID NO: 306811 - DNA, 20 bp, Artificial Sequence
  chemically synthesized
tttgaattccgtcaggaatt

SEQ ID NO: 306812 - DNA, 20 bp, Artificial Sequence
  chemically synthesized
gatttccccttaattcctga

SEQ ID NO: 306813 - DNA, 20 bp, Artificial Sequence
  chemically synthesized
gttttcgtttgaattccgtc

SEQ ID NO: 306814 - DNA, 20 bp, Artificial Sequence
  chemically synthesized
agttttcgtttgaattccgt

SEQ ID NO: 306815 - DNA, 20 bp, Artificial Sequence
  chemically synthesized
ttcaaacgaaaactgacaat

SEQ ID NO: 306816 - DNA, 20 bp, Artificial Sequence
  chemically synthesized
tcaaacgaaaactgacaatc

SEQ ID NO: 306817 - DNA, 20 bp, Artificial Sequence
  chemically synthesized
tactcctggtacctgattgt

SEQ ID NO: 306818 - DNA, 20 bp, Artificial Sequence
  chemically synthesized
gaaaactgacaatcaggtac

SEQ ID NO: 306819 - DNA, 20 bp, Artificial Sequence
  chemically synthesized
aaaactgacaatcaggtacc

SEQ ID NO: 306820 - DNA, 20 bp, Artificial Sequence
  chemically synthesized
aactgacaatcaggtaccag

SEQ ID NO: 306821 - DNA, 20 bp, Artificial Sequence
  chemically synthesized
tagcttttcttcagtactcc

SEQ ID NO: 306822 - DNA, 20 bp, Artificial Sequence
  chemically synthesized
atcaggtaccaggagtactg

SEQ ID NO: 306823 - DNA, 20 bp, Artificial Sequence
  chemically synthesized
gtaccaggagtactgaagaa

SEQ ID NO: 306824 - DNA, 20 bp, Artificial Sequence
  chemically synthesized
tcagctcactagcttttctt

SEQ ID NO: 306825 - DNA, 20 bp, Artificial Sequence
  chemically synthesized
caggagtactgaagaaaagc

SEQ ID NO: 306826 - DNA, 20 bp, Artificial Sequence
  chemically synthesized
agtactgaagaaaagctagt

SEQ ID NO: 306827 - DNA, 20 bp, Artificial Sequence
  chemically synthesized
tgaagaaaagctagtgagct

SEQ ID NO: 306828 - DNA, 20 bp, Artificial Sequence
  chemically synthesized
ttctcattttctcagctcac

SEQ ID NO: 306829 - DNA, 20 bp, Artificial Sequence
  chemically synthesized
agctagtgagctgagaaaat

SEQ ID NO: 306830 - DNA, 20 bp, Artificial Sequence
  chemically synthesized
cttagccattctcattttct

SEQ ID NO: 306831 - DNA, 20 bp, Artificial Sequence
  chemically synthesized
gtgagctgagaaaatgagaa

SEQ ID NO: 306832 - DNA, 20 bp, Artificial Sequence
  chemically synthesized
ctgagaaaatgagaatggct

SEQ ID NO: 306833 - DNA, 20 bp, Artificial Sequence
  chemically synthesized
tgagaaaatgagaatggcta

SEQ ID NO: 306834 - DNA, 20 bp, Artificial Sequence
  chemically synthesized
ttcagaatggcaagtttcct

SEQ ID NO: 306835 - DNA, 20 bp, Artificial Sequence
  chemically synthesized
tcacagcatttcagaatggc

SEQ ID NO: 306836 - DNA, 20 bp, Artificial Sequence
  chemically synthesized
ataatcacagcatttcagaa

SEQ ID NO: 306837 - DNA, 20 bp, Artificial Sequence
  chemically synthesized
tccaaataatcacagcattt

SEQ ID NO: 306838 - DNA, 20 bp, Artificial Sequence
  chemically synthesized
taattttatccaaataatca

SEQ ID NO: 306839 - DNA, 20 bp, Artificial Sequence
  chemically synthesized
tctgaaatgctgtgattatt

SEQ ID NO: 306840 - DNA, 20 bp, Artificial Sequence
  chemically synthesized
ttacaatattattgtttcca

SEQ ID NO: 306841 - DNA, 20 bp, Artificial Sequence
  chemically synthesized
tgaaccgaatgttaaaactg

SEQ ID NO: 306842 - DNA, 20 bp, Artificial Sequence
  chemically synthesized
gtttccacagttttaacatt

SEQ ID NO: 306843 - DNA, 20 bp, Artificial Sequence
  chemically synthesized
ttaacattcggttcattatt

SEQ ID NO: 306844 - DNA, 20 bp, Artificial Sequence
  chemically synthesized
aacattcggttcattatttg

SEQ ID NO: 306845 - DNA, 20 bp, Artificial Sequence
  chemically synthesized
tggtcagtaaatcacataat

SEQ ID NO: 306846 - DNA, 20 bp, Artificial Sequence
  chemically synthesized
tgctacaaaaattttatggt

SEQ ID NO: 306847 - DNA, 20 bp, Artificial Sequence
  chemically synthesized
tggatgctacaaaaatttta

SEQ ID NO: 306848 - DNA, 20 bp, Artificial Sequence
  chemically synthesized
tactgaccataaaatttttg

SEQ ID NO: 306849 - DNA, 20 bp, Artificial Sequence
  chemically synthesized
accagatgttaattgattaa

SEQ ID NO: 306850 - DNA, 20 bp, Artificial Sequence
  chemically synthesized
tccattaatcaattaacatc

SEQ ID NO: 306851 - DNA, 20 bp, Artificial Sequence
  chemically synthesized
caattaacatctggttattt

SEQ ID NO: 306852 - DNA, 20 bp, Artificial Sequence
  chemically synthesized
aaaataattactcaaataac

SEQ ID NO: 306853 - DNA, 20 bp, Artificial Sequence
  chemically synthesized
ttattttttaaaactaattg

SEQ ID NO: 306854 - DNA, 20 bp, Artificial Sequence
  chemically synthesized
attttttaaaactaattgta

SEQ ID NO: 306855 - DNA, 20 bp, Artificial Sequence
  chemically synthesized
tacttaatgggctctacaat

SEQ ID NO: 306856 - DNA, 20 bp, Artificial Sequence
  chemically synthesized
aactaattgtagagcccatt

SEQ ID NO: 306857 - DNA, 20 bp, Artificial Sequence
  chemically synthesized
acttagttcttttacttaat

SEQ ID NO: 306858 - DNA, 20 bp, Artificial Sequence
  chemically synthesized
gacttagttcttttacttaa

SEQ ID NO: 306859 - DNA, 20 bp, Artificial Sequence
  chemically synthesized
ttgtagagcccattaagtaa

SEQ ID NO: 306860 - DNA, 20 bp, Artificial Sequence
  chemically synthesized
gcccattaagtaaaagaact

SEQ ID NO: 306861 - DNA, 20 bp, Artificial Sequence
  chemically synthesized
aagtaaaagaactaagtcgc

SEQ ID NO: 306862 - DNA, 20 bp, Artificial Sequence
  chemically synthesized
agtaaaagaactaagtcgct

SEQ ID NO: 306863 - DNA, 20 bp, Artificial Sequence
  chemically synthesized
ttatgtcatgcccagcgact

SEQ ID NO: 306864 - DNA, 20 bp, Artificial Sequence
  chemically synthesized
tgaagcatttatgtcatgcc

SEQ ID NO: 306865 - DNA, 20 bp, Artificial Sequence
  chemically synthesized
tgggcatgacataaatgctt

SEQ ID NO: 306866 - DNA, 20 bp, Artificial Sequence
  chemically synthesized
aactctgaaaagagatgctg

SEQ ID NO: 306867 - DNA, 20 bp, Artificial Sequence
  chemically synthesized
aatgcttcagcatctctttt

SEQ ID NO: 306868 - DNA, 20 bp, Artificial Sequence
  chemically synthesized
tgcttcagcatctcttttca

SEQ ID NO: 306869 - DNA, 20 bp, Artificial Sequence
  chemically synthesized
gtatttataaactctgaaaa

SEQ ID NO: 306870 - DNA, 20 bp, Artificial Sequence
  chemically synthesized
aagtatttataaactctgaa

SEQ ID NO: 306871 - DNA, 20 bp, Artificial Sequence
  chemically synthesized
aattgcttcataagacacat

SEQ ID NO: 306872 - DNA, 20 bp, Artificial Sequence
  chemically synthesized
aaatacttatgtgtcttatg

SEQ ID NO: 306873 - DNA, 20 bp, Artificial Sequence
  chemically synthesized
tggtataaaaattgcttcat

SEQ ID NO: 306874 - DNA, 20 bp, Artificial Sequence
  chemically synthesized
aggaactttggaaatataaa

SEQ ID NO: 306875 - DNA, 20 bp, Artificial Sequence
  chemically synthesized
ttataccatttatatttcca

SEQ ID NO: 306876 - DNA, 20 bp, Artificial Sequence
  chemically synthesized
tccacagctcacaggaactt

SEQ ID NO: 306877 - DNA, 20 bp, Artificial Sequence
  chemically synthesized
tatatttccaaagttcctgt

SEQ ID NO: 306878 - DNA, 20 bp, Artificial Sequence
  chemically synthesized
tgtaaccctccacagctcac

SEQ ID NO: 306879 - DNA, 20 bp, Artificial Sequence
  chemically synthesized
tccaaagttcctgtgagctg

SEQ ID NO: 306880 - DNA, 20 bp, Artificial Sequence
  chemically synthesized
ttgtaaccctccacagctca

SEQ ID NO: 306881 - DNA, 20 bp, Artificial Sequence
  chemically synthesized
caaagttcctgtgagctgtg

SEQ ID NO: 306882 - DNA, 20 bp, Artificial Sequence
  chemically synthesized
aaagttcctgtgagctgtgg

SEQ ID NO: 306883 - DNA, 20 bp, Artificial Sequence
  chemically synthesized
aagttcctgtgagctgtgga

SEQ ID NO: 306884 - DNA, 20 bp, Artificial Sequence
  chemically synthesized
agggagtttgtaaccctcca

SEQ ID NO: 306885 - DNA, 20 bp, Artificial Sequence
  chemically synthesized
ggagggttacaaactccctt

SEQ ID NO: 306886 - DNA, 20 bp, Artificial Sequence
  chemically synthesized
cctttcaaatcaaccaaagg

SEQ ID NO: 306887 - DNA, 20 bp, Artificial Sequence
  chemically synthesized
ttcctttcaaatcaaccaaa

SEQ ID NO: 306888 - DNA, 20 bp, Artificial Sequence
  chemically synthesized
attcctttcaaatcaaccaa

SEQ ID NO: 306889 - DNA, 20 bp, Artificial Sequence
  chemically synthesized
tattcctttcaaatcaacca

SEQ ID NO: 306890 - DNA, 20 bp, Artificial Sequence
  chemically synthesized
actccctttggttgatttga

SEQ ID NO: 306891 - DNA, 20 bp, Artificial Sequence
  chemically synthesized
ctccctttggttgatttgaa

SEQ ID NO: 306892 - DNA, 20 bp, Artificial Sequence
  chemically synthesized
ttggttgatttgaaaggaat

SEQ ID NO: 306893 - DNA, 20 bp, Artificial Sequence
  chemically synthesized
gttgatttgaaaggaataag

SEQ ID NO: 306894 - DNA, 20 bp, Artificial Sequence
  chemically synthesized
ataagtggtttatgtgaaat

SEQ ID NO: 306895 - DNA, 20 bp, Artificial Sequence
  chemically synthesized
tttatgtgaaatcagtaaat

SEQ ID NO: 306896 - DNA, 20 bp, Artificial Sequence
  chemically synthesized
ttatgtgaaatcagtaaatc

SEQ ID NO: 306897 - DNA, 20 bp, Artificial Sequence
  chemically synthesized
tatgtgaaatcagtaaatca

SEQ ID NO: 306898 - DNA, 20 bp, Artificial Sequence
  chemically synthesized
gtgaaatcagtaaatcaggg

SEQ ID NO: 306899 - DNA, 20 bp, Artificial Sequence
  chemically synthesized
aaagttactgagtcaagtaa

SEQ ID NO: 306900 - DNA, 20 bp, Artificial Sequence
  chemically synthesized
agtttttcttttacttgact

SEQ ID NO: 306901 - DNA, 20 bp, Artificial Sequence
  chemically synthesized
tcaggcaaagttactgagtc

SEQ ID NO: 306902 - DNA, 20 bp, Artificial Sequence
  chemically synthesized
gtgtatcaggcaaagttact

SEQ ID NO: 306903 - DNA, 20 bp, Artificial Sequence
  chemically synthesized
atttgtctgtgtatcaggca

SEQ ID NO: 306904 - DNA, 20 bp, Artificial Sequence
  chemically synthesized
cagtaactttgcctgataca

SEQ ID NO: 306905 - DNA, 20 bp, Artificial Sequence
  chemically synthesized
attgaatttgtctgtgtatc

SEQ ID NO: 306906 - DNA, 20 bp, Artificial Sequence
  chemically synthesized
aattgaatttgtctgtgtat

SEQ ID NO: 306907 - DNA, 20 bp, Artificial Sequence
  chemically synthesized
acacagacaaattcaattcc

SEQ ID NO: 306908 - DNA, 20 bp, Artificial Sequence
  chemically synthesized
cacagacaaattcaattcct

SEQ ID NO: 306909 - DNA, 20 bp, Artificial Sequence
  chemically synthesized
gggagtaatgttcagtaccc

SEQ ID NO: 306910 - DNA, 20 bp, Artificial Sequence
  chemically synthesized
agggagtaatgttcagtacc

SEQ ID NO: 306911 - DNA, 20 bp, Artificial Sequence
  chemically synthesized
ttaagtcagggagtaatgtt

SEQ ID NO: 306912 - DNA, 20 bp, Artificial Sequence
  chemically synthesized
tgtttacagattaagtcagg

SEQ ID NO: 306913 - DNA, 20 bp, Artificial Sequence
  chemically synthesized
tttgtttacagattaagtca

SEQ ID NO: 306914 - DNA, 20 bp, Artificial Sequence
  chemically synthesized
ctttgtttacagattaagtc

SEQ ID NO: 306915 - DNA, 20 bp, Artificial Sequence
  chemically synthesized
cctttgtttacagattaagt

SEQ ID NO: 306916 - DNA, 20 bp, Artificial Sequence
  chemically synthesized
ttctcctttgtttacagatt

SEQ ID NO: 306917 - DNA, 20 bp, Artificial Sequence
  chemically synthesized
cctgacttaatctgtaaaca

SEQ ID NO: 306918 - DNA, 20 bp, Artificial Sequence
  chemically synthesized
ctgacttaatctgtaaacaa

SEQ ID NO: 306919 - DNA, 20 bp, Artificial Sequence
  chemically synthesized
tccttcttctcctttgttta

SEQ ID NO: 306920 - DNA, 20 bp, Artificial Sequence
  chemically synthesized
gacttaatctgtaaacaaag

SEQ ID NO: 306921 - DNA, 20 bp, Artificial Sequence
  chemically synthesized
ttaatctgtaaacaaaggag

SEQ ID NO: 306922 - DNA, 20 bp, Artificial Sequence
  chemically synthesized
atctgtaaacaaaggagaag

SEQ ID NO: 306923 - DNA, 20 bp, Artificial Sequence
  chemically synthesized
tctgtaaacaaaggagaaga

SEQ ID NO: 306924 - DNA, 20 bp, Artificial Sequence
  chemically synthesized
gtaaacaaaggagaagaagg

SEQ ID NO: 306925 - DNA, 20 bp, Artificial Sequence
  chemically synthesized
aaacaaaggagaagaaggaa

SEQ ID NO: 306926 - DNA, 20 bp, Artificial Sequence
  chemically synthesized
gagaagaaggaagagaaata

SEQ ID NO: 306927 - DNA, 20 bp, Artificial Sequence
  chemically synthesized
agaagaaggaagagaaataa

SEQ ID NO: 306928 - DNA, 20 bp, Artificial Sequence
  chemically synthesized
aagaaggaagagaaataaag

SEQ ID NO: 306929 - DNA, 20 bp, Artificial Sequence
  chemically synthesized
taaaggagaaaattatctta

SEQ ID NO: 306930 - DNA, 20 bp, Artificial Sequence
  chemically synthesized
tggggttgttaagtggctgt

SEQ ID NO: 306931 - DNA, 20 bp, Artificial Sequence
  chemically synthesized
ccaaatatggggttgttaag

SEQ ID NO: 306932 - DNA, 20 bp, Artificial Sequence
  chemically synthesized
ctgccaaatatggggttgtt

SEQ ID NO: 306933 - DNA, 20 bp, Artificial Sequence
  chemically synthesized
ccacttaacaaccccatatt

SEQ ID NO: 306934 - DNA, 20 bp, Artificial Sequence
  chemically synthesized
tgtatttgctgccaaatatg

SEQ ID NO: 306935 - DNA, 20 bp, Artificial Sequence
  chemically synthesized
ttgtatttgctgccaaatat

SEQ ID NO: 306936 - DNA, 20 bp, Artificial Sequence
  chemically synthesized
cttaacaaccccatatttgg

SEQ ID NO: 306937 - DNA, 20 bp, Artificial Sequence
  chemically synthesized
attgtatttgctgccaaata

SEQ ID NO: 306938 - DNA, 20 bp, Artificial Sequence
  chemically synthesized
gaaagacaggtatcgcgatt

SEQ ID NO: 306939 - DNA, 20 bp, Artificial Sequence
  chemically synthesized
tacatttgtttcggaaagac

SEQ ID NO: 306940 - DNA, 20 bp, Artificial Sequence
  chemically synthesized
ttacatttgtttcggaaaga

SEQ ID NO: 306941 - DNA, 20 bp, Artificial Sequence
  chemically synthesized
aaacttacatttgtttcgga

SEQ ID NO: 306942 - DNA, 20 bp, Artificial Sequence
  chemically synthesized
aaataaacttacatttgttt

SEQ ID NO: 306943 - DNA, 20 bp, Artificial Sequence
  chemically synthesized
tgtctttccgaaacaaatgt

SEQ ID NO: 306944 - DNA, 20 bp, Artificial Sequence
  chemically synthesized
aaacaaatgtaagtttattt

SEQ ID NO: 306945 - DNA, 20 bp, Artificial Sequence
  chemically synthesized
caatttgctctgtggtatgt

SEQ ID NO: 306946 - DNA, 20 bp, Artificial Sequence
  chemically synthesized
atttaagaactaacatacca

SEQ ID NO: 306947 - DNA, 20 bp, Artificial Sequence
  chemically synthesized
ttaagaactaacataccaca

SEQ ID NO: 306948 - DNA, 20 bp, Artificial Sequence
  chemically synthesized
tgtcatgacaatttgctctg

SEQ ID NO: 306949 - DNA, 20 bp, Artificial Sequence
  chemically synthesized
cactttgcttcatgggcaat

SEQ ID NO: 306950 - DNA, 20 bp, Artificial Sequence
  chemically synthesized
aaatgcaccaattgcccatg

SEQ ID NO: 306951 - DNA, 20 bp, Artificial Sequence
  chemically synthesized
tttggggcactttgcttcat

SEQ ID NO: 306952 - DNA, 20 bp, Artificial Sequence
  chemically synthesized
caccaattgcccatgaagca

SEQ ID NO: 306953 - DNA, 20 bp, Artificial Sequence
  chemically synthesized
gtttggggcactttgcttca

SEQ ID NO: 306954 - DNA, 20 bp, Artificial Sequence
  chemically synthesized
gaagcaaagtgccccaaacc

SEQ ID NO: 306955 - DNA, 20 bp, Artificial Sequence
  chemically synthesized
tattgactgctctaggtttg

SEQ ID NO: 306956 - DNA, 20 bp, Artificial Sequence
  chemically synthesized
agcaaagtgccccaaaccta

SEQ ID NO: 306957 - DNA, 20 bp, Artificial Sequence
  chemically synthesized
gtattgactgctctaggttt

SEQ ID NO: 306958 - DNA, 20 bp, Artificial Sequence
  chemically synthesized
tgtattgactgctctaggtt

SEQ ID NO: 306959 - DNA, 20 bp, Artificial Sequence
  chemically synthesized
aaagtgccccaaacctagag

SEQ ID NO: 306960 - DNA, 20 bp, Artificial Sequence
  chemically synthesized
gaaggtgtattgactgctct

SEQ ID NO: 306961 - DNA, 20 bp, Artificial Sequence
  chemically synthesized
ggaaggtgtattgactgctc

SEQ ID NO: 306962 - DNA, 20 bp, Artificial Sequence
  chemically synthesized
agtcaatacaccttcctgaa

SEQ ID NO: 306963 - DNA, 20 bp, Artificial Sequence
  chemically synthesized
ttagattgtccttttcagga

SEQ ID NO: 306964 - DNA, 20 bp, Artificial Sequence
  chemically synthesized
gtcaatacaccttcctgaaa

SEQ ID NO: 306965 - DNA, 20 bp, Artificial Sequence
  chemically synthesized
cttagattgtccttttcagg

SEQ ID NO: 306966 - DNA, 20 bp, Artificial Sequence
  chemically synthesized
ctacttagattgtccttttc

SEQ ID NO: 306967 - DNA, 20 bp, Artificial Sequence
  chemically synthesized
gctacttagattgtcctttt

SEQ ID NO: 306968 - DNA, 20 bp, Artificial Sequence
  chemically synthesized
cttcctgaaaaggacaatct

SEQ ID NO: 306969 - DNA, 20 bp, Artificial Sequence
  chemically synthesized
cctgaaaaggacaatctaag

SEQ ID NO: 306970 - DNA, 20 bp, Artificial Sequence
  chemically synthesized
ccatgccaaaatgggctact

SEQ ID NO: 306971 - DNA, 20 bp, Artificial Sequence
  chemically synthesized
acaatctaagtagcccattt

SEQ ID NO: 306972 - DNA, 20 bp, Artificial Sequence
  chemically synthesized
tgcaggtgccatgccaaaat

SEQ ID NO: 306973 - DNA, 20 bp, Artificial Sequence
  chemically synthesized
atgcaggtgccatgccaaaa

SEQ ID NO: 306974 - DNA, 20 bp, Artificial Sequence
  chemically synthesized
ctaagtagcccattttggca

SEQ ID NO: 306975 - DNA, 20 bp, Artificial Sequence
  chemically synthesized
tggcatggcacctgcattga

SEQ ID NO: 306976 - DNA, 20 bp, Artificial Sequence
  chemically synthesized
cagttcagagctatcaatgc

SEQ ID NO: 306977 - DNA, 20 bp, Artificial Sequence
  chemically synthesized
gcagttcagagctatcaatg

SEQ ID NO: 306978 - DNA, 20 bp, Artificial Sequence
  chemically synthesized
gcattgatagctctgaactg

SEQ ID NO: 306979 - DNA, 20 bp, Artificial Sequence
  chemically synthesized
ctagagcattctgcagttca

SEQ ID NO: 306980 - DNA, 20 bp, Artificial Sequence
  chemically synthesized
cactagagcattctgcagtt

SEQ ID NO: 306981 - DNA, 20 bp, Artificial Sequence
  chemically synthesized
ggagccactagagcattctg

SEQ ID NO: 306982 - DNA, 20 bp, Artificial Sequence
  chemically synthesized
ctctgaactgcagaatgctc

SEQ ID NO: 306983 - DNA, 20 bp, Artificial Sequence
  chemically synthesized
tgaactgcagaatgctctag

SEQ ID NO: 306984 - DNA, 20 bp, Artificial Sequence
  chemically synthesized
actaattgaaggagccacta

SEQ ID NO: 306985 - DNA, 20 bp, Artificial Sequence
  chemically synthesized
aaactaattgaaggagccac

SEQ ID NO: 306986 - DNA, 20 bp, Artificial Sequence
  chemically synthesized
gctctagtggctccttcaat

SEQ ID NO: 306987 - DNA, 20 bp, Artificial Sequence
  chemically synthesized
aaaagacaaactaattgaag

SEQ ID NO: 306988 - DNA, 20 bp, Artificial Sequence
  chemically synthesized
gtaaaagacaaactaattga

SEQ ID NO: 306989 - DNA, 20 bp, Artificial Sequence
  chemically synthesized
agtaaaagacaaactaattg

SEQ ID NO: 306990 - DNA, 20 bp, Artificial Sequence
  chemically synthesized
caattagtttgtcttttact

SEQ ID NO: 306991 - DNA, 20 bp, Artificial Sequence
  chemically synthesized
gtgaagcagattctgagtaa

SEQ ID NO: 306992 - DNA, 20 bp, Artificial Sequence
  chemically synthesized
ctccaggtgaagcagattct

SEQ ID NO: 306993 - DNA, 20 bp, Artificial Sequence
  chemically synthesized
tactcagaatctgcttcacc

SEQ ID NO: 306994 - DNA, 20 bp, Artificial Sequence
  chemically synthesized
ataacatactccaggtgaag

SEQ ID NO: 306995 - DNA, 20 bp, Artificial Sequence
  chemically synthesized
ctcagaatctgcttcacctg

SEQ ID NO: 306996 - DNA, 20 bp, Artificial Sequence
  chemically synthesized
actataacatactccaggtg

SEQ ID NO: 306997 - DNA, 20 bp, Artificial Sequence
  chemically synthesized
actgaactataacatactcc

SEQ ID NO: 306998 - DNA, 20 bp, Artificial Sequence
  chemically synthesized
gactgaactataacatactc

SEQ ID NO: 306999 - DNA, 20 bp, Artificial Sequence
  chemically synthesized
gcttcacctggagtatgtta

SEQ ID NO: 307000 - DNA, 20 bp, Artificial Sequence
  chemically synthesized
acctggagtatgttatagtt

SEQ ID NO: 307001 - DNA, 20 bp, Artificial Sequence
  chemically synthesized
ttccccttaaaaatggcatg

SEQ ID NO: 307002 - DNA, 20 bp, Artificial Sequence
  chemically synthesized
tcagtcttcatgccattttt

SEQ ID NO: 307003 - DNA, 20 bp, Artificial Sequence
  chemically synthesized
cagtcttcatgccattttta

SEQ ID NO: 307004 - DNA, 20 bp, Artificial Sequence
  chemically synthesized
agtcttcatgccatttttaa

SEQ ID NO: 307005 - DNA, 20 bp, Artificial Sequence
  chemically synthesized
gctttgtttccccttaaaaa

SEQ ID NO: 307006 - DNA, 20 bp, Artificial Sequence
  chemically synthesized
gtcttcatgccatttttaag

SEQ ID NO: 307007 - DNA, 20 bp, Artificial Sequence
  chemically synthesized
gccatttttaaggggaaaca

SEQ ID NO: 307008 - DNA, 20 bp, Artificial Sequence
  chemically synthesized
tttttaaggggaaacaaagc

SEQ ID NO: 307009 - DNA, 20 bp, Artificial Sequence
  chemically synthesized
ggggaaacaaagcaagattt

SEQ ID NO: 307010 - DNA, 20 bp, Artificial Sequence
  chemically synthesized
ttattgttaaggaaaaatta

SEQ ID NO: 307011 - DNA, 20 bp, Artificial Sequence
  chemically synthesized
acttattgttaaggaaaaat

SEQ ID NO: 307012 - DNA, 20 bp, Artificial Sequence
  chemically synthesized
tctaatttttccttaacaat

SEQ ID NO: 307013 - DNA, 20 bp, Artificial Sequence
  chemically synthesized
aaatactgaacttattgtta

SEQ ID NO: 307014 - DNA, 20 bp, Artificial Sequence
  chemically synthesized
aaaatactgaacttattgtt

SEQ ID NO: 307015 - DNA, 20 bp, Artificial Sequence
  chemically synthesized
tttttccttaacaataagtt

SEQ ID NO: 307016 - DNA, 20 bp, Artificial Sequence
  chemically synthesized
aataagttcagtatttttct

SEQ ID NO: 307017 - DNA, 20 bp, Artificial Sequence
  chemically synthesized
cagtatttttctaagtttga

SEQ ID NO: 307018 - DNA, 20 bp, Artificial Sequence
  chemically synthesized
ctattgcattctttcaaact

SEQ ID NO: 307019 - DNA, 20 bp, Artificial Sequence
  chemically synthesized
ctaagtttgaaagaatgcaa

SEQ ID NO: 307020 - DNA, 20 bp, Artificial Sequence
  chemically synthesized
taatatcttaatttgtattt

SEQ ID NO: 307021 - DNA, 20 bp, Artificial Sequence
  chemically synthesized
aatagaccaaaatacaaatt

SEQ ID NO: 307022 - DNA, 20 bp, Artificial Sequence
  chemically synthesized
gttttattttgatttgaatt

SEQ ID NO: 307023 - DNA, 20 bp, Artificial Sequence
  chemically synthesized
tcaaatcaaaataaaactca

SEQ ID NO: 307024 - DNA, 20 bp, Artificial Sequence
  chemically synthesized
tcaaaataaaactcacggtg

SEQ ID NO: 307025 - DNA, 20 bp, Artificial Sequence
  chemically synthesized
caaaataaaactcacggtgt

SEQ ID NO: 307026 - DNA, 20 bp, Artificial Sequence
  chemically synthesized
ttgctaaacccccacaccgt

SEQ ID NO: 307027 - DNA, 20 bp, Artificial Sequence
  chemically synthesized
aaaataaaactcacggtgtg

SEQ ID NO: 307028 - DNA, 20 bp, Artificial Sequence
  chemically synthesized
aaataaaactcacggtgtgg

SEQ ID NO: 307029 - DNA, 20 bp, Artificial Sequence
  chemically synthesized
aaactcacggtgtgggggtt

SEQ ID NO: 307030 - DNA, 20 bp, Artificial Sequence
  chemically synthesized
acggtgtgggggtttagcaa

SEQ ID NO: 307031 - DNA, 20 bp, Artificial Sequence
  chemically synthesized
cggtgtgggggtttagcaat

SEQ ID NO: 307032 - DNA, 20 bp, Artificial Sequence
  chemically synthesized
tgtgggggtttagcaatagg

SEQ ID NO: 307033 - DNA, 20 bp, Artificial Sequence
  chemically synthesized
gtgggggtttagcaataggt

SEQ ID NO: 307034 - DNA, 20 bp, Artificial Sequence
  chemically synthesized
ggggtttagcaataggtagg

SEQ ID NO: 307035 - DNA, 20 bp, Artificial Sequence
  chemically synthesized
gactccaactcaaaacaaaa

SEQ ID NO: 307036 - DNA, 20 bp, Artificial Sequence
  chemically synthesized
tggtttttcttttttgtttt

SEQ ID NO: 307037 - DNA, 20 bp, Artificial Sequence
  chemically synthesized
ttttcttttttgttttgagt

SEQ ID NO: 307038 - DNA, 20 bp, Artificial Sequence
  chemically synthesized
ttcttttttgttttgagttg

SEQ ID NO: 307039 - DNA, 20 bp, Artificial Sequence
  chemically synthesized
tccagcctgggcgacagagt

SEQ ID NO: 307040 - DNA, 20 bp, Artificial Sequence
  chemically synthesized
tggagtctaactctgtcgcc

SEQ ID NO: 307041 - DNA, 20 bp, Artificial Sequence
  chemically synthesized
gcactccagcctgggcgaca

SEQ ID NO: 307042 - DNA, 20 bp, Artificial Sequence
  chemically synthesized
ggagtctaactctgtcgccc

SEQ ID NO: 307043 - DNA, 20 bp, Artificial Sequence
  chemically synthesized
ctgcactccagcctgggcga

SEQ ID NO: 307044 - DNA, 20 bp, Artificial Sequence
  chemically synthesized
tctaactctgtcgcccaggc

SEQ ID NO: 307045 - DNA, 20 bp, Artificial Sequence
  chemically synthesized
taactctgtcgcccaggctg

SEQ ID NO: 307046 - DNA, 20 bp, Artificial Sequence
  chemically synthesized
atgccactgcactccagcct

SEQ ID NO: 307047 - DNA, 20 bp, Artificial Sequence
  chemically synthesized
catgccactgcactccagcc

SEQ ID NO: 307048 - DNA, 20 bp, Artificial Sequence
  chemically synthesized
ctgtcgcccaggctggagtg

SEQ ID NO: 307049 - DNA, 20 bp, Artificial Sequence
  chemically synthesized
gagatcatgccactgcactc

SEQ ID NO: 307050 - DNA, 20 bp, Artificial Sequence
  chemically synthesized
tcgcccaggctggagtgcag

SEQ ID NO: 307051 - DNA, 20 bp, Artificial Sequence
  chemically synthesized
gacagaggctgcagtgagca

SEQ ID NO: 307052 - DNA, 20 bp, Artificial Sequence
  chemically synthesized
ggcatgatctctgctcactg

SEQ ID NO: 307053 - DNA, 20 bp, Artificial Sequence
  chemically synthesized
gagacagaggctgcagtgag

SEQ ID NO: 307054 - DNA, 20 bp, Artificial Sequence
  chemically synthesized
tgggagacagaggctgcagt

SEQ ID NO: 307055 - DNA, 20 bp, Artificial Sequence
  chemically synthesized
aacctgggagacagaggctg

SEQ ID NO: 307056 - DNA, 20 bp, Artificial Sequence
  chemically synthesized
tgcttgaacctgggagacag

SEQ ID NO: 307057 - DNA, 20 bp, Artificial Sequence
  chemically synthesized
tcactgcagcctctgtctcc

SEQ ID NO: 307058 - DNA, 20 bp, Artificial Sequence
  chemically synthesized
ttgcttgaacctgggagaca

SEQ ID NO: 307059 - DNA, 20 bp, Artificial Sequence
  chemically synthesized
cactgcagcctctgtctccc

SEQ ID NO: 307060 - DNA, 20 bp, Artificial Sequence
  chemically synthesized
aattgcttgaacctgggaga

SEQ ID NO: 307061 - DNA, 20 bp, Artificial Sequence
  chemically synthesized
ggagaattgcttgaacctgg

SEQ ID NO: 307062 - DNA, 20 bp, Artificial Sequence
  chemically synthesized
agcctctgtctcccaggttc

SEQ ID NO: 307063 - DNA, 20 bp, Artificial Sequence
  chemically synthesized
caggagaattgcttgaacct

SEQ ID NO: 307064 - DNA, 20 bp, Artificial Sequence
  chemically synthesized
acaggagaattgcttgaacc

SEQ ID NO: 307065 - DNA, 20 bp, Artificial Sequence
  chemically synthesized
ggttcaagcaattctcctgt

SEQ ID NO: 307066 - DNA, 20 bp, Artificial Sequence
  chemically synthesized
gctactcgtgaggctgacag

SEQ ID NO: 307067 - DNA, 20 bp, Artificial Sequence
  chemically synthesized
cagctactcgtgaggctgac

SEQ ID NO: 307068 - DNA, 20 bp, Artificial Sequence
  chemically synthesized
ccagctactcgtgaggctga

SEQ ID NO: 307069 - DNA, 20 bp, Artificial Sequence
  chemically synthesized
aattctcctgtcagcctcac

SEQ ID NO: 307070 - DNA, 20 bp, Artificial Sequence
  chemically synthesized
tctcctgtcagcctcacgag

SEQ ID NO: 307071 - DNA, 20 bp, Artificial Sequence
  chemically synthesized
tataataccagctactcgtg

SEQ ID NO: 307072 - DNA, 20 bp, Artificial Sequence
  chemically synthesized
ctataataccagctactcgt

SEQ ID NO: 307073 - DNA, 20 bp, Artificial Sequence
  chemically synthesized
ctgtcagcctcacgagtagc

SEQ ID NO: 307074 - DNA, 20 bp, Artificial Sequence
  chemically synthesized
ctcacgagtagctggtatta

SEQ ID NO: 307075 - DNA, 20 bp, Artificial Sequence
  chemically synthesized
tcacgagtagctggtattat

SEQ ID NO: 307076 - DNA, 20 bp, Artificial Sequence
  chemically synthesized
gtggcatgtgcctataatac

SEQ ID NO: 307077 - DNA, 20 bp, Artificial Sequence
  chemically synthesized
tattataggcacatgccact

SEQ ID NO: 307078 - DNA, 20 bp, Artificial Sequence
  chemically synthesized
taggcacatgccactaagcc

SEQ ID NO: 307079 - DNA, 20 bp, Artificial Sequence
  chemically synthesized
taaaaattagctgggcttag

SEQ ID NO: 307080 - DNA, 20 bp, Artificial Sequence
  chemically synthesized
atttaaaaattagctgggct

SEQ ID NO: 307081 - DNA, 20 bp, Artificial Sequence
  chemically synthesized
taaaaatttaaaaattagct

SEQ ID NO: 307082 - DNA, 20 bp, Artificial Sequence
  chemically synthesized
ctaaaaatttaaaaattagc

SEQ ID NO: 307083 - DNA, 20 bp, Artificial Sequence
  chemically synthesized
tcttctaaaaatttaaaaat

SEQ ID NO: 307084 - DNA, 20 bp, Artificial Sequence
  chemically synthesized
ccagctaatttttaaatttt

SEQ ID NO: 307085 - DNA, 20 bp, Artificial Sequence
  chemically synthesized
gctaatttttaaatttttag

SEQ ID NO: 307086 - DNA, 20 bp, Artificial Sequence
  chemically synthesized
taatttttaaatttttagaa

SEQ ID NO: 307087 - DNA, 20 bp, Artificial Sequence
  chemically synthesized
ttttaaatttttagaagaga

SEQ ID NO: 307088 - DNA, 20 bp, Artificial Sequence
  chemically synthesized
tttaaatttttagaagagac

SEQ ID NO: 307089 - DNA, 20 bp, Artificial Sequence
  chemically synthesized
taaatttttagaagagacag

SEQ ID NO: 307090 - DNA, 20 bp, Artificial Sequence
  chemically synthesized
agacaggagtctcaacatgt

SEQ ID NO: 307091 - DNA, 20 bp, Artificial Sequence
  chemically synthesized
accagccaggccaacatgtt

SEQ ID NO: 307092 - DNA, 20 bp, Artificial Sequence
  chemically synthesized
ggagtctcaacatgttggcc

SEQ ID NO: 307093 - DNA, 20 bp, Artificial Sequence
  chemically synthesized
tctcaacatgttggcctggc

SEQ ID NO: 307094 - DNA, 20 bp, Artificial Sequence
  chemically synthesized
tcaggagattgagaccagcc

SEQ ID NO: 307095 - DNA, 20 bp, Artificial Sequence
  chemically synthesized
gtcaggagattgagaccagc

SEQ ID NO: 307096 - DNA, 20 bp, Artificial Sequence
  chemically synthesized
tgaggtcaggagattgagac

SEQ ID NO: 307097 - DNA, 20 bp, Artificial Sequence
  chemically synthesized
tcacttgaggtcaggagatt

SEQ ID NO: 307098 - DNA, 20 bp, Artificial Sequence
  chemically synthesized
ggtggatcacttgaggtcag

SEQ ID NO: 307099 - DNA, 20 bp, Artificial Sequence
  chemically synthesized
ggtctcaatctcctgacctc

SEQ ID NO: 307100 - DNA, 20 bp, Artificial Sequence
  chemically synthesized
cgggtggatcacttgaggtc

SEQ ID NO: 307101 - DNA, 20 bp, Artificial Sequence
  chemically synthesized
gcgggtggatcacttgaggt

SEQ ID NO: 307102 - DNA, 20 bp, Artificial Sequence
  chemically synthesized
caaggcgggtggatcacttg

SEQ ID NO: 307103 - DNA, 20 bp, Artificial Sequence
  chemically synthesized
ccaaggcgggtggatcactt

SEQ ID NO: 307104 - DNA, 20 bp, Artificial Sequence
  chemically synthesized
ctcaagtgatccacccgcct

SEQ ID NO: 307105 - DNA, 20 bp, Artificial Sequence
  chemically synthesized
ctttgggaggccaaggcggg

SEQ ID NO: 307106 - DNA, 20 bp, Artificial Sequence
  chemically synthesized
gcactttgggaggccaaggc

SEQ ID NO: 307107 - DNA, 20 bp, Artificial Sequence
  chemically synthesized
agcactttgggaggccaagg

SEQ ID NO: 307108 - DNA, 20 bp, Artificial Sequence
  chemically synthesized
cccagcactttgggaggcca

SEQ ID NO: 307109 - DNA, 20 bp, Artificial Sequence
  chemically synthesized
tcccagcactttgggaggcc

SEQ ID NO: 307110 - DNA, 20 bp, Artificial Sequence
  chemically synthesized
ccacccgccttggcctccca

SEQ ID NO: 307111 - DNA, 20 bp, Artificial Sequence
  chemically synthesized
tgtaatcccagcactttggg

SEQ ID NO: 307112 - DNA, 20 bp, Artificial Sequence
  chemically synthesized
ctgtaatcccagcactttgg

SEQ ID NO: 307113 - DNA, 20 bp, Artificial Sequence
  chemically synthesized
gccttggcctcccaaagtgc

SEQ ID NO: 307114 - DNA, 20 bp, Artificial Sequence
  chemically synthesized
gcctgtaatcccagcacttt

SEQ ID NO: 307115 - DNA, 20 bp, Artificial Sequence
  chemically synthesized
ccttggcctcccaaagtgct

SEQ ID NO: 307116 - DNA, 20 bp, Artificial Sequence
  chemically synthesized
tgcctgtaatcccagcactt

SEQ ID NO: 307117 - DNA, 20 bp, Artificial Sequence
  chemically synthesized
ctcccaaagtgctgggatta

SEQ ID NO: 307118 - DNA, 20 bp, Artificial Sequence
  chemically synthesized
tcccaaagtgctgggattac

SEQ ID NO: 307119 - DNA, 20 bp, Artificial Sequence
  chemically synthesized
gtggctcatgcctgtaatcc

SEQ ID NO: 307120 - DNA, 20 bp, Artificial Sequence
  chemically synthesized
agtgctgggattacaggcat

SEQ ID NO: 307121 - DNA, 20 bp, Artificial Sequence
  chemically synthesized
caggcatgagccaccatacc

SEQ ID NO: 307122 - DNA, 20 bp, Artificial Sequence
  chemically synthesized
atctattgggctgggtatgg

SEQ ID NO: 307123 - DNA, 20 bp, Artificial Sequence
  chemically synthesized
cctatctattgggctgggta

SEQ ID NO: 307124 - DNA, 20 bp, Artificial Sequence
  chemically synthesized
agccaccatacccagcccaa

SEQ ID NO: 307125 - DNA, 20 bp, Artificial Sequence
  chemically synthesized
caaaacctatctattgggct

SEQ ID NO: 307126 - DNA, 20 bp, Artificial Sequence
  chemically synthesized
gcaaaacctatctattgggc

SEQ ID NO: 307127 - DNA, 20 bp, Artificial Sequence
  chemically synthesized
accatacccagcccaataga

SEQ ID NO: 307128 - DNA, 20 bp, Artificial Sequence
  chemically synthesized
ccatacccagcccaatagat

SEQ ID NO: 307129 - DNA, 20 bp, Artificial Sequence
  chemically synthesized
atatgcaaaacctatctatt

SEQ ID NO: 307130 - DNA, 20 bp, Artificial Sequence
  chemically synthesized
aatatgcaaaacctatctat

SEQ ID NO: 307131 - DNA, 20 bp, Artificial Sequence
  chemically synthesized
attttgtttaattcacttgt

SEQ ID NO: 307132 - DNA, 20 bp, Artificial Sequence
  chemically synthesized
aaatttaatggaaaactaac

SEQ ID NO: 307133 - DNA, 20 bp, Artificial Sequence
  chemically synthesized
aaatattcacttaaatttaa

SEQ ID NO: 307134 - DNA, 20 bp, Artificial Sequence
  chemically synthesized
gttagttttccattaaattt

SEQ ID NO: 307135 - DNA, 20 bp, Artificial Sequence
  chemically synthesized
atttaagtgaatatttgcat

SEQ ID NO: 307136 - DNA, 20 bp, Artificial Sequence
  chemically synthesized
gtgaatatttgcattagtac

SEQ ID NO: 307137 - DNA, 20 bp, Artificial Sequence
  chemically synthesized
tttgcattagtactagaaca

SEQ ID NO: 307138 - DNA, 20 bp, Artificial Sequence
  chemically synthesized
ttgcattagtactagaacaa

SEQ ID NO: 307139 - DNA, 20 bp, Artificial Sequence
  chemically synthesized
ggtagcatcaacctttgttc

SEQ ID NO: 307140 - DNA, 20 bp, Artificial Sequence
  chemically synthesized
ggctctcagcttgggacagg

SEQ ID NO: 307141 - DNA, 20 bp, Artificial Sequence
  chemically synthesized
aggttgatgctacctgtccc

SEQ ID NO: 307142 - DNA, 20 bp, Artificial Sequence
  chemically synthesized
tatggctctcagcttgggac

SEQ ID NO: 307143 - DNA, 20 bp, Artificial Sequence
  chemically synthesized
atatggctctcagcttggga

SEQ ID NO: 307144 - DNA, 20 bp, Artificial Sequence
  chemically synthesized
gatgctacctgtcccaagct

SEQ ID NO: 307145 - DNA, 20 bp, Artificial Sequence
  chemically synthesized
tgctacctgtcccaagctga

SEQ ID NO: 307146 - DNA, 20 bp, Artificial Sequence
  chemically synthesized
tcaaatatggctctcagctt
